United States Patent 11,369,692 (MATERIALS AND METHODS FOR TREATMENT OF DUCHENNE MUSCULAR DYSTROPHY) - sequence listing, part 15

SEQ ID NO: 479946 - DNA, 20 bp, Artificial Sequence
  chemically synthesized
aagtattagtttgagccata

SEQ ID NO: 479947 - DNA, 20 bp, Artificial Sequence
  chemically synthesized
gtgtatgctaacttctacac

SEQ ID NO: 479948 - DNA, 20 bp, Artificial Sequence
  chemically synthesized
gggatctagattttgtacct

SEQ ID NO: 479949 - DNA, 20 bp, Artificial Sequence
  chemically synthesized
acctctggatcttttctaag

SEQ ID NO: 479950 - DNA, 20 bp, Artificial Sequence
  chemically synthesized
ttgataaacagaatgttaac

SEQ ID NO: 479951 - DNA, 20 bp, Artificial Sequence
  chemically synthesized
ttatcatgtcttttgataaa

SEQ ID NO: 479952 - DNA, 20 bp, Artificial Sequence
  chemically synthesized
tatatgaaacatgagaaaat

SEQ ID NO: 479953 - DNA, 20 bp, Artificial Sequence
  chemically synthesized
gaaaaacatctacttcttct

SEQ ID NO: 479954 - DNA, 20 bp, Artificial Sequence
  chemically synthesized
cttctccgagtcacattctt

SEQ ID NO: 479955 - DNA, 20 bp, Artificial Sequence
  chemically synthesized
tttaaaaagccagaattcac

SEQ ID NO: 479956 - DNA, 20 bp, Artificial Sequence
  chemically synthesized
caaaaataattttaaaaagc

SEQ ID NO: 479957 - DNA, 20 bp, Artificial Sequence
  chemically synthesized
acagcgccatgtaaactata

SEQ ID NO: 479958 - DNA, 20 bp, Artificial Sequence
  chemically synthesized
ctattttgactatgagacag

SEQ ID NO: 479959 - DNA, 20 bp, Artificial Sequence
  chemically synthesized
tactgaaccctggctgttgg

SEQ ID NO: 479960 - DNA, 20 bp, Artificial Sequence
  chemically synthesized
gaaccaattcccccaacagc

SEQ ID NO: 479961 - DNA, 20 bp, Artificial Sequence
  chemically synthesized
ttattaataatgataataaa

SEQ ID NO: 479962 - DNA, 20 bp, Artificial Sequence
  chemically synthesized
tggtttctaaatagaggaat

SEQ ID NO: 479963 - DNA, 20 bp, Artificial Sequence
  chemically synthesized
caggtctggtttctaaatag

SEQ ID NO: 479964 - DNA, 20 bp, Artificial Sequence
  chemically synthesized
ctctatttagaaaccagacc

SEQ ID NO: 479965 - DNA, 20 bp, Artificial Sequence
  chemically synthesized
acatagctagtgttcagaaa

SEQ ID NO: 479966 - DNA, 20 bp, Artificial Sequence
  chemically synthesized
ttcattactatcctccactg

SEQ ID NO: 479967 - DNA, 20 bp, Artificial Sequence
  chemically synthesized
actggaattatcctgcagtg

SEQ ID NO: 479968 - DNA, 20 bp, Artificial Sequence
  chemically synthesized
tgcaggataattccagtgca

SEQ ID NO: 479969 - DNA, 20 bp, Artificial Sequence
  chemically synthesized
aaacagatcatcctttgcac

SEQ ID NO: 479970 - DNA, 20 bp, Artificial Sequence
  chemically synthesized
gtttttttttttttttgagg

SEQ ID NO: 479971 - DNA, 20 bp, Artificial Sequence
  chemically synthesized
tctggctctgttgcccgggc

SEQ ID NO: 479972 - DNA, 20 bp, Artificial Sequence
  chemically synthesized
gagcttgcggtgagccgaga

SEQ ID NO: 479973 - DNA, 20 bp, Artificial Sequence
  chemically synthesized
ctcaccgcaagctccacctc

SEQ ID NO: 479974 - DNA, 20 bp, Artificial Sequence
  chemically synthesized
ggctgaggcaggaggatggc

SEQ ID NO: 479975 - DNA, 20 bp, Artificial Sequence
  chemically synthesized
tactcaggaggctgaggcag

SEQ ID NO: 479976 - DNA, 20 bp, Artificial Sequence
  chemically synthesized
catcctcctgcctcagcctc

SEQ ID NO: 479977 - DNA, 20 bp, Artificial Sequence
  chemically synthesized
ctgaaaatacaaaaaatcag

SEQ ID NO: 479978 - DNA, 20 bp, Artificial Sequence
  chemically synthesized
ttttgtattttcagtagaga

SEQ ID NO: 479979 - DNA, 20 bp, Artificial Sequence
  chemically synthesized
tggggtttcaccatgttagc

SEQ ID NO: 479980 - DNA, 20 bp, Artificial Sequence
  chemically synthesized
actttgggaggccgaggcag

SEQ ID NO: 479981 - DNA, 20 bp, Artificial Sequence
  chemically synthesized
gcctcggcctcccaaagtgc

SEQ ID NO: 479982 - DNA, 20 bp, Artificial Sequence
  chemically synthesized
agccactgtgcccggctgca

SEQ ID NO: 479983 - DNA, 20 bp, Artificial Sequence
  chemically synthesized
tttaagttaaacatagaaat

SEQ ID NO: 479984 - DNA, 20 bp, Artificial Sequence
  chemically synthesized
atagaaataaggatgtaaaa

SEQ ID NO: 479985 - DNA, 20 bp, Artificial Sequence
  chemically synthesized
taaggatgtaaaatggaatt

SEQ ID NO: 479986 - DNA, 20 bp, Artificial Sequence
  chemically synthesized
gtttccttgttgatagactt

SEQ ID NO: 479987 - DNA, 20 bp, Artificial Sequence
  chemically synthesized
agctctgtccgcaggtagca

SEQ ID NO: 479988 - DNA, 20 bp, Artificial Sequence
  chemically synthesized
caaggggaaatgacttctct

SEQ ID NO: 479989 - DNA, 20 bp, Artificial Sequence
  chemically synthesized
ttaaatgagggaaaaaaaag

SEQ ID NO: 479990 - DNA, 20 bp, Artificial Sequence
  chemically synthesized
aaaagaagagacatcaaata

SEQ ID NO: 479991 - DNA, 20 bp, Artificial Sequence
  chemically synthesized
tgatttggccaaatacgatg

SEQ ID NO: 479992 - DNA, 20 bp, Artificial Sequence
  chemically synthesized
ttttattttgtctcttgaga

SEQ ID NO: 479993 - DNA, 20 bp, Artificial Sequence
  chemically synthesized
gtagttttattttgtctctt

SEQ ID NO: 479994 - DNA, 20 bp, Artificial Sequence
  chemically synthesized
gtatcttatatatcttgata

SEQ ID NO: 479995 - DNA, 20 bp, Artificial Sequence
  chemically synthesized
agttgtcaaatttacactat

SEQ ID NO: 479996 - DNA, 20 bp, Artificial Sequence
  chemically synthesized
acaaaatttatttagccctc

SEQ ID NO: 479997 - DNA, 20 bp, Artificial Sequence
  chemically synthesized
atcttcttgatgataatgag

SEQ ID NO: 479998 - DNA, 20 bp, Artificial Sequence
  chemically synthesized
aatgatttatctaaatctca

SEQ ID NO: 479999 - DNA, 20 bp, Artificial Sequence
  chemically synthesized
tttatttcacaattaagttg

SEQ ID NO: 480000 - DNA, 20 bp, Artificial Sequence
  chemically synthesized
aaatcatgctggtgtaactg

SEQ ID NO: 480001 - DNA, 20 bp, Artificial Sequence
  chemically synthesized
accacaatgaatataacctt

SEQ ID NO: 480002 - DNA, 20 bp, Artificial Sequence
  chemically synthesized
tccaaacaggtggcaccaca

SEQ ID NO: 480003 - DNA, 20 bp, Artificial Sequence
  chemically synthesized
gtttggaaagaagggcacat

SEQ ID NO: 480004 - DNA, 20 bp, Artificial Sequence
  chemically synthesized
aagaagggcacatcaggatt

SEQ ID NO: 480005 - DNA, 20 bp, Artificial Sequence
  chemically synthesized
aggattttgagtacatattt

SEQ ID NO: 480006 - DNA, 20 bp, Artificial Sequence
  chemically synthesized
ttatttcttggcatgttgca

SEQ ID NO: 480007 - DNA, 20 bp, Artificial Sequence
  chemically synthesized
gatgatgcttgaattagtaa

SEQ ID NO: 480008 - DNA, 20 bp, Artificial Sequence
  chemically synthesized
ctagacttacttgatgatgc

SEQ ID NO: 480009 - DNA, 20 bp, Artificial Sequence
  chemically synthesized
ggctaattagctcagtctga

SEQ ID NO: 480010 - DNA, 20 bp, Artificial Sequence
  chemically synthesized
aatgctatcattgggagaag

SEQ ID NO: 480011 - DNA, 20 bp, Artificial Sequence
  chemically synthesized
agctttgatgataatgtact

SEQ ID NO: 480012 - DNA, 20 bp, Artificial Sequence
  chemically synthesized
aatataaatgaggtctgtat

SEQ ID NO: 480013 - DNA, 20 bp, Artificial Sequence
  chemically synthesized
taaaataaatatttatttag

SEQ ID NO: 480014 - DNA, 20 bp, Artificial Sequence
  chemically synthesized
tacttgcctaccataagact

SEQ ID NO: 480015 - DNA, 20 bp, Artificial Sequence
  chemically synthesized
tgaacattatttagaaaatt

SEQ ID NO: 480016 - DNA, 20 bp, Artificial Sequence
  chemically synthesized
gttcagtgtagtaaaattat

SEQ ID NO: 480017 - DNA, 20 bp, Artificial Sequence
  chemically synthesized
agagttttgaattaagtgat

SEQ ID NO: 480018 - DNA, 20 bp, Artificial Sequence
  chemically synthesized
atagcagaaagcaaagagtt

SEQ ID NO: 480019 - DNA, 20 bp, Artificial Sequence
  chemically synthesized
cagtcccatagcagaaagca

SEQ ID NO: 480020 - DNA, 20 bp, Artificial Sequence
  chemically synthesized
ttttaaagacagaaagcatc

SEQ ID NO: 480021 - DNA, 20 bp, Artificial Sequence
  chemically synthesized
ttgagaacgtacatattaac

SEQ ID NO: 480022 - DNA, 20 bp, Artificial Sequence
  chemically synthesized
cttttcatatatggtttcta

SEQ ID NO: 480023 - DNA, 20 bp, Artificial Sequence
  chemically synthesized
aatgtaaaattgactaattt

SEQ ID NO: 480024 - DNA, 20 bp, Artificial Sequence
  chemically synthesized
atttacaattataggtcctt

SEQ ID NO: 480025 - DNA, 20 bp, Artificial Sequence
  chemically synthesized
cctttaggatttttacttgt

SEQ ID NO: 480026 - DNA, 20 bp, Artificial Sequence
  chemically synthesized
gaaaacatacattttgcctt

SEQ ID NO: 480027 - DNA, 20 bp, Artificial Sequence
  chemically synthesized
atgaggttgtttttttttga

SEQ ID NO: 480028 - DNA, 20 bp, Artificial Sequence
  chemically synthesized
ctgcactccagcctgggtga

SEQ ID NO: 480029 - DNA, 20 bp, Artificial Sequence
  chemically synthesized
tctcactctgtcacccaggc

SEQ ID NO: 480030 - DNA, 20 bp, Artificial Sequence
  chemically synthesized
ttgcaccactgcactccagc

SEQ ID NO: 480031 - DNA, 20 bp, Artificial Sequence
  chemically synthesized
ctcactgcaagctctgcctc

SEQ ID NO: 480032 - DNA, 20 bp, Artificial Sequence
  chemically synthesized
ttttgtgtttttagtagaga

SEQ ID NO: 480033 - DNA, 20 bp, Artificial Sequence
  chemically synthesized
cagggtttcaccgtgttagc

SEQ ID NO: 480034 - DNA, 20 bp, Artificial Sequence
  chemically synthesized
actttgggaggccgaggcgg

SEQ ID NO: 480035 - DNA, 20 bp, Artificial Sequence
  chemically synthesized
gcctcggcctcccaaagtgc

SEQ ID NO: 480036 - DNA, 20 bp, Artificial Sequence
  chemically synthesized
tgagccaccgcgcccggccg

SEQ ID NO: 480037 - DNA, 20 bp, Artificial Sequence
  chemically synthesized
cttctagcataggaacagtg

SEQ ID NO: 480038 - DNA, 20 bp, Artificial Sequence
  chemically synthesized
atgccaactctttagctttt

SEQ ID NO: 480039 - DNA, 20 bp, Artificial Sequence
  chemically synthesized
gaagtcactcacaaaagcta

SEQ ID NO: 480040 - DNA, 20 bp, Artificial Sequence
  chemically synthesized
tctgcttcctaaatatttta

SEQ ID NO: 480041 - DNA, 20 bp, Artificial Sequence
  chemically synthesized
ccatataatatctttgtaat

SEQ ID NO: 480042 - DNA, 20 bp, Artificial Sequence
  chemically synthesized
aatatcacaacgaatgccta

SEQ ID NO: 480043 - DNA, 20 bp, Artificial Sequence
  chemically synthesized
ttaattaaagtaatatcaca

SEQ ID NO: 480044 - DNA, 20 bp, Artificial Sequence
  chemically synthesized
taaggacatgccatcaaaag

SEQ ID NO: 480045 - DNA, 20 bp, Artificial Sequence
  chemically synthesized
taatgactacccctcttttg

SEQ ID NO: 480046 - DNA, 20 bp, Artificial Sequence
  chemically synthesized
gatctggcactcaccaaaag

SEQ ID NO: 480047 - DNA, 20 bp, Artificial Sequence
  chemically synthesized
gttgttataatgaatacaaa

SEQ ID NO: 480048 - DNA, 20 bp, Artificial Sequence
  chemically synthesized
ccctgattgatgttgttata

SEQ ID NO: 480049 - DNA, 20 bp, Artificial Sequence
  chemically synthesized
aaagctcatttgctattaat

SEQ ID NO: 480050 - DNA, 20 bp, Artificial Sequence
  chemically synthesized
taatcactactagattagaa

SEQ ID NO: 480051 - DNA, 20 bp, Artificial Sequence
  chemically synthesized
aacattaatcactactagat

SEQ ID NO: 480052 - DNA, 20 bp, Artificial Sequence
  chemically synthesized
gtaattacaatatcacattt

SEQ ID NO: 480053 - DNA, 20 bp, Artificial Sequence
  chemically synthesized
cacagcagcttgtctggact

SEQ ID NO: 480054 - DNA, 20 bp, Artificial Sequence
  chemically synthesized
ttaatctaaggacaaagaga

SEQ ID NO: 480055 - DNA, 20 bp, Artificial Sequence
  chemically synthesized
ttcacctttcccagccacat

SEQ ID NO: 480056 - DNA, 20 bp, Artificial Sequence
  chemically synthesized
ttcttatgtggctgggaaag

SEQ ID NO: 480057 - DNA, 20 bp, Artificial Sequence
  chemically synthesized
aggtgaataatggttaagtg

SEQ ID NO: 480058 - DNA, 20 bp, Artificial Sequence
  chemically synthesized
caagtcaagtagtgatatta

SEQ ID NO: 480059 - DNA, 20 bp, Artificial Sequence
  chemically synthesized
gttttagctccatgatgcca

SEQ ID NO: 480060 - DNA, 20 bp, Artificial Sequence
  chemically synthesized
ccaatgaattttcaaactac

SEQ ID NO: 480061 - DNA, 20 bp, Artificial Sequence
  chemically synthesized
gtaatctgtcatttaggaca

SEQ ID NO: 480062 - DNA, 20 bp, Artificial Sequence
  chemically synthesized
tgacagattactatcaatgt

SEQ ID NO: 480063 - DNA, 20 bp, Artificial Sequence
  chemically synthesized
tttgtatagtttacctaaaa

SEQ ID NO: 480064 - DNA, 20 bp, Artificial Sequence
  chemically synthesized
catattgtgtcaatatgtgt

SEQ ID NO: 480065 - DNA, 20 bp, Artificial Sequence
  chemically synthesized
gatcagagcagtgctagtca

SEQ ID NO: 480066 - DNA, 20 bp, Artificial Sequence
  chemically synthesized
tccagtaagtttaatatttc

SEQ ID NO: 480067 - DNA, 20 bp, Artificial Sequence
  chemically synthesized
tcagagatttataggctata

SEQ ID NO: 480068 - DNA, 20 bp, Artificial Sequence
  chemically synthesized
ttccagtaaatgctctgtag

SEQ ID NO: 480069 - DNA, 20 bp, Artificial Sequence
  chemically synthesized
aagaaaataagttaaaagcc

SEQ ID NO: 480070 - DNA, 20 bp, Artificial Sequence
  chemically synthesized
ctgtcacaagtgagtggagg

SEQ ID NO: 480071 - DNA, 20 bp, Artificial Sequence
  chemically synthesized
ttctctacaggctgtcacaa

SEQ ID NO: 480072 - DNA, 20 bp, Artificial Sequence
  chemically synthesized
cagatgtaagaaaaattgcc

SEQ ID NO: 480073 - DNA, 20 bp, Artificial Sequence
  chemically synthesized
agaaaaattgccaagagttt

SEQ ID NO: 480074 - DNA, 20 bp, Artificial Sequence
  chemically synthesized
agtctgatagtttttgttat

SEQ ID NO: 480075 - DNA, 20 bp, Artificial Sequence
  chemically synthesized
aacaaaaactatcagactat

SEQ ID NO: 480076 - DNA, 20 bp, Artificial Sequence
  chemically synthesized
agagaggaaatcaggaaggc

SEQ ID NO: 480077 - DNA, 20 bp, Artificial Sequence
  chemically synthesized
caatatgtcaggaataaacc

SEQ ID NO: 480078 - DNA, 20 bp, Artificial Sequence
  chemically synthesized
ccaggtttattcctgacata

SEQ ID NO: 480079 - DNA, 20 bp, Artificial Sequence
  chemically synthesized
gacttggtattcaatatgtc

SEQ ID NO: 480080 - DNA, 20 bp, Artificial Sequence
  chemically synthesized
aataccaagtctgtaagtca

SEQ ID NO: 480081 - DNA, 20 bp, Artificial Sequence
  chemically synthesized
tttctgatggtctttgtaat

SEQ ID NO: 480082 - DNA, 20 bp, Artificial Sequence
  chemically synthesized
ggccagcctcatcttagttt

SEQ ID NO: 480083 - DNA, 20 bp, Artificial Sequence
  chemically synthesized
ttatcttccctttgctgccc

SEQ ID NO: 480084 - DNA, 20 bp, Artificial Sequence
  chemically synthesized
cacgtatcttgttgaaaatt

SEQ ID NO: 480085 - DNA, 20 bp, Artificial Sequence
  chemically synthesized
atcttgttgaaaattatgaa

SEQ ID NO: 480086 - DNA, 20 bp, Artificial Sequence
  chemically synthesized
ctctaaaacagggctttcca

SEQ ID NO: 480087 - DNA, 20 bp, Artificial Sequence
  chemically synthesized
tgctaaggcacatgccctga

SEQ ID NO: 480088 - DNA, 20 bp, Artificial Sequence
  chemically synthesized
ctaaccatcccagggctgag

SEQ ID NO: 480089 - DNA, 20 bp, Artificial Sequence
  chemically synthesized
atatcgatccctctcagccc

SEQ ID NO: 480090 - DNA, 20 bp, Artificial Sequence
  chemically synthesized
cctgggatggttaggcagct

SEQ ID NO: 480091 - DNA, 20 bp, Artificial Sequence
  chemically synthesized
gcttaagccagaagacaggt

SEQ ID NO: 480092 - DNA, 20 bp, Artificial Sequence
  chemically synthesized
cttgacatgtcttaatgttg

SEQ ID NO: 480093 - DNA, 20 bp, Artificial Sequence
  chemically synthesized
gattgtgtgataaaagtgca

SEQ ID NO: 480094 - DNA, 20 bp, Artificial Sequence
  chemically synthesized
aagagttcgctagagccata

SEQ ID NO: 480095 - DNA, 20 bp, Artificial Sequence
  chemically synthesized
agaagcatttggccaatggg

SEQ ID NO: 480096 - DNA, 20 bp, Artificial Sequence
  chemically synthesized
gagaaagaagcatttggcca

SEQ ID NO: 480097 - DNA, 20 bp, Artificial Sequence
  chemically synthesized
gcaagtgattgtgcaagaac

SEQ ID NO: 480098 - DNA, 20 bp, Artificial Sequence
  chemically synthesized
cttaatacagataaaactaa

SEQ ID NO: 480099 - DNA, 20 bp, Artificial Sequence
  chemically synthesized
acatcagactacagttttgt

SEQ ID NO: 480100 - DNA, 20 bp, Artificial Sequence
  chemically synthesized
acgctccattgttcaatctt

SEQ ID NO: 480101 - DNA, 20 bp, Artificial Sequence
  chemically synthesized
ttggaagtcagaagtttgaa

SEQ ID NO: 480102 - DNA, 20 bp, Artificial Sequence
  chemically synthesized
agaagtttgaaatgggtttc

SEQ ID NO: 480103 - DNA, 20 bp, Artificial Sequence
  chemically synthesized
gtcctctaagcttcttcaga

SEQ ID NO: 480104 - DNA, 20 bp, Artificial Sequence
  chemically synthesized
gaaaatggaagcaggagagt

SEQ ID NO: 480105 - DNA, 20 bp, Artificial Sequence
  chemically synthesized
ataagtgaaaatggaagcag

SEQ ID NO: 480106 - DNA, 20 bp, Artificial Sequence
  chemically synthesized
agatgggcctaatctaacca

SEQ ID NO: 480107 - DNA, 20 bp, Artificial Sequence
  chemically synthesized
tgtggttagattaggcccat

SEQ ID NO: 480108 - DNA, 20 bp, Artificial Sequence
  chemically synthesized
ttagcaaccttaattccgtc

SEQ ID NO: 480109 - DNA, 20 bp, Artificial Sequence
  chemically synthesized
tagggaattaatattccaga

SEQ ID NO: 480110 - DNA, 20 bp, Artificial Sequence
  chemically synthesized
tgctgtgctccctggcagta

SEQ ID NO: 480111 - DNA, 20 bp, Artificial Sequence
  chemically synthesized
acagcatattcacaggttct

SEQ ID NO: 480112 - DNA, 20 bp, Artificial Sequence
  chemically synthesized
gatgttaatccccagaacct

SEQ ID NO: 480113 - DNA, 20 bp, Artificial Sequence
  chemically synthesized
ttatttccccctgtggtagg

SEQ ID NO: 480114 - DNA, 20 bp, Artificial Sequence
  chemically synthesized
ataaaacttgctttagccaa

SEQ ID NO: 480115 - DNA, 20 bp, Artificial Sequence
  chemically synthesized
tttttgtgaaggctgaggtg

SEQ ID NO: 480116 - DNA, 20 bp, Artificial Sequence
  chemically synthesized
cgggctggttagcctgctgg

SEQ ID NO: 480117 - DNA, 20 bp, Artificial Sequence
  chemically synthesized
gcttaagtgtctgaaagtgg

SEQ ID NO: 480118 - DNA, 20 bp, Artificial Sequence
  chemically synthesized
tgggctcccttgggaatctg

SEQ ID NO: 480119 - DNA, 20 bp, Artificial Sequence
  chemically synthesized
tgctctgactgggctccctt

SEQ ID NO: 480120 - DNA, 20 bp, Artificial Sequence
  chemically synthesized
ttgtgggctgatggtttaca

SEQ ID NO: 480121 - DNA, 20 bp, Artificial Sequence
  chemically synthesized
cttaaaacagtaggtacttc

SEQ ID NO: 480122 - DNA, 20 bp, Artificial Sequence
  chemically synthesized
gtacctactgttttaagcta

SEQ ID NO: 480123 - DNA, 20 bp, Artificial Sequence
  chemically synthesized
ttaacaatatgatggtaaca

SEQ ID NO: 480124 - DNA, 20 bp, Artificial Sequence
  chemically synthesized
taccatcatattgttaagga

SEQ ID NO: 480125 - DNA, 20 bp, Artificial Sequence
  chemically synthesized
ggtaggctgtcctaagaaag

SEQ ID NO: 480126 - DNA, 20 bp, Artificial Sequence
  chemically synthesized
tttgcacattgtaaaccctc

SEQ ID NO: 480127 - DNA, 20 bp, Artificial Sequence
  chemically synthesized
actcatttaacaacattctt

SEQ ID NO: 480128 - DNA, 20 bp, Artificial Sequence
  chemically synthesized
accctcaagaatgttgttaa

SEQ ID NO: 480129 - DNA, 20 bp, Artificial Sequence
  chemically synthesized
gttaaatgagtaatcacaat

SEQ ID NO: 480130 - DNA, 20 bp, Artificial Sequence
  chemically synthesized
gtgaattaagtcattcacaa

SEQ ID NO: 480131 - DNA, 20 bp, Artificial Sequence
  chemically synthesized
agaattagcagcattccatt

SEQ ID NO: 480132 - DNA, 20 bp, Artificial Sequence
  chemically synthesized
gaatgctgctaattctggaa

SEQ ID NO: 480133 - DNA, 20 bp, Artificial Sequence
  chemically synthesized
atgaccacattactcagttc

SEQ ID NO: 480134 - DNA, 20 bp, Artificial Sequence
  chemically synthesized
atgctgattggcttgggggg

SEQ ID NO: 480135 - DNA, 20 bp, Artificial Sequence
  chemically synthesized
taattttcacctgcctgtct

SEQ ID NO: 480136 - DNA, 20 bp, Artificial Sequence
  chemically synthesized
gaattttccttaccatggta

SEQ ID NO: 480137 - DNA, 20 bp, Artificial Sequence
  chemically synthesized
ctttattttgttaatgcacc

SEQ ID NO: 480138 - DNA, 20 bp, Artificial Sequence
  chemically synthesized
tcccactggaatgtcttgtg

SEQ ID NO: 480139 - DNA, 20 bp, Artificial Sequence
  chemically synthesized
ttcctcacaagacattccag

SEQ ID NO: 480140 - DNA, 20 bp, Artificial Sequence
  chemically synthesized
acctgtgttttttatcccac

SEQ ID NO: 480141 - DNA, 20 bp, Artificial Sequence
  chemically synthesized
taggaagagttattataatt

SEQ ID NO: 480142 - DNA, 20 bp, Artificial Sequence
  chemically synthesized
attagatatagaccattagg

SEQ ID NO: 480143 - DNA, 20 bp, Artificial Sequence
  chemically synthesized
ctatatctaatcaggtacag

SEQ ID NO: 480144 - DNA, 20 bp, Artificial Sequence
  chemically synthesized
atccattaacaatataacca

SEQ ID NO: 480145 - DNA, 20 bp, Artificial Sequence
  chemically synthesized
attctctggttatattgtta

SEQ ID NO: 480146 - DNA, 20 bp, Artificial Sequence
  chemically synthesized
ttaatggatacttcaatgca

SEQ ID NO: 480147 - DNA, 20 bp, Artificial Sequence
  chemically synthesized
gaaaagataacttattattt

SEQ ID NO: 480148 - DNA, 20 bp, Artificial Sequence
  chemically synthesized
ataacttattatttaagggt

SEQ ID NO: 480149 - DNA, 20 bp, Artificial Sequence
  chemically synthesized
ttatttaagggtaagagtat

SEQ ID NO: 480150 - DNA, 20 bp, Artificial Sequence
  chemically synthesized
taaaaattgatcacagaaag

SEQ ID NO: 480151 - DNA, 20 bp, Artificial Sequence
  chemically synthesized
aattgatcacagaaagaggg

SEQ ID NO: 480152 - DNA, 20 bp, Artificial Sequence
  chemically synthesized
acagaaagagggatggatag

SEQ ID NO: 480153 - DNA, 20 bp, Artificial Sequence
  chemically synthesized
tcaatggcaaagtataggtg

SEQ ID NO: 480154 - DNA, 20 bp, Artificial Sequence
  chemically synthesized
aagatacagtgcttacaatt

SEQ ID NO: 480155 - DNA, 20 bp, Artificial Sequence
  chemically synthesized
aataatcacatttacagaaa

SEQ ID NO: 480156 - DNA, 20 bp, Artificial Sequence
  chemically synthesized
tattattatactttaagttt

SEQ ID NO: 480157 - DNA, 20 bp, Artificial Sequence
  chemically synthesized
aaatctctcagtaagttgta

SEQ ID NO: 480158 - DNA, 20 bp, Artificial Sequence
  chemically synthesized
tttgaggttatttttaaaga

SEQ ID NO: 480159 - DNA, 20 bp, Artificial Sequence
  chemically synthesized
gttatttttaaagaaagaat

SEQ ID NO: 480160 - DNA, 20 bp, Artificial Sequence
  chemically synthesized
agaaagaataagaattcgtt

SEQ ID NO: 480161 - DNA, 20 bp, Artificial Sequence
  chemically synthesized
tacccaacttcccatcctca

SEQ ID NO: 480162 - DNA, 20 bp, Artificial Sequence
  chemically synthesized
aattcgttgaggatgggaag

SEQ ID NO: 480163 - DNA, 20 bp, Artificial Sequence
  chemically synthesized
tggaagtattgggacgtaag

SEQ ID NO: 480164 - DNA, 20 bp, Artificial Sequence
  chemically synthesized
ggcagaaaatttaaggctgc

SEQ ID NO: 480165 - DNA, 20 bp, Artificial Sequence
  chemically synthesized
tgccacatatatcactcaag

SEQ ID NO: 480166 - DNA, 20 bp, Artificial Sequence
  chemically synthesized
ccccatttcttccactctcc

SEQ ID NO: 480167 - DNA, 20 bp, Artificial Sequence
  chemically synthesized
gcatgctacaccaaggaggt

SEQ ID NO: 480168 - DNA, 20 bp, Artificial Sequence
  chemically synthesized
aatttatcttaaaggtattg

SEQ ID NO: 480169 - DNA, 20 bp, Artificial Sequence
  chemically synthesized
ggtattgaagaatttcaaac

SEQ ID NO: 480170 - DNA, 20 bp, Artificial Sequence
  chemically synthesized
agaatttcaaacatgagtat

SEQ ID NO: 480171 - DNA, 20 bp, Artificial Sequence
  chemically synthesized
tctagcatcacttcctcagc

SEQ ID NO: 480172 - DNA, 20 bp, Artificial Sequence
  chemically synthesized
aagaccagtgaacaagttac

SEQ ID NO: 480173 - DNA, 20 bp, Artificial Sequence
  chemically synthesized
aacaagttaccggagttttc

SEQ ID NO: 480174 - DNA, 20 bp, Artificial Sequence
  chemically synthesized
ttaccggagttttctaggat

SEQ ID NO: 480175 - DNA, 20 bp, Artificial Sequence
  chemically synthesized
tacataaaatgcaattaata

SEQ ID NO: 480176 - DNA, 20 bp, Artificial Sequence
  chemically synthesized
ttaaatgagattaccataca

SEQ ID NO: 480177 - DNA, 20 bp, Artificial Sequence
  chemically synthesized
tcataaagttttctgtttct

SEQ ID NO: 480178 - DNA, 20 bp, Artificial Sequence
  chemically synthesized
tttgccaacggtgacaagat

SEQ ID NO: 480179 - DNA, 20 bp, Artificial Sequence
  chemically synthesized
tgaagtcaagcatacctgat

SEQ ID NO: 480180 - DNA, 20 bp, Artificial Sequence
  chemically synthesized
gataagggcctgaaaccata

SEQ ID NO: 480181 - DNA, 20 bp, Artificial Sequence
  chemically synthesized
ataaaagagagaagtctcac

SEQ ID NO: 480182 - DNA, 20 bp, Artificial Sequence
  chemically synthesized
gaagtttctagcttaaataa

SEQ ID NO: 480183 - DNA, 20 bp, Artificial Sequence
  chemically synthesized
tggtgccatcttctgaaata

SEQ ID NO: 480184 - DNA, 20 bp, Artificial Sequence
  chemically synthesized
aatagagaatagaggcagta

SEQ ID NO: 480185 - DNA, 20 bp, Artificial Sequence
  chemically synthesized
atgttaaaatgtctgtggcc

SEQ ID NO: 480186 - DNA, 20 bp, Artificial Sequence
  chemically synthesized
taaagcagttgtcaaatatt

SEQ ID NO: 480187 - DNA, 20 bp, Artificial Sequence
  chemically synthesized
ataagcacaggtagggtgta

SEQ ID NO: 480188 - DNA, 20 bp, Artificial Sequence
  chemically synthesized
tacctgctgataagcacagg

SEQ ID NO: 480189 - DNA, 20 bp, Artificial Sequence
  chemically synthesized
ctaaatatagaagttcactg

SEQ ID NO: 480190 - DNA, 20 bp, Artificial Sequence
  chemically synthesized
gggagttgcagatgtcaatg

SEQ ID NO: 480191 - DNA, 20 bp, Artificial Sequence
  chemically synthesized
gtcaatgtagaatggccaag

SEQ ID NO: 480192 - DNA, 20 bp, Artificial Sequence
  chemically synthesized
acataggcagcatatgcttt

SEQ ID NO: 480193 - DNA, 20 bp, Artificial Sequence
  chemically synthesized
tatagatactaattagagcc

SEQ ID NO: 480194 - DNA, 20 bp, Artificial Sequence
  chemically synthesized
atggaaagtgaagaagtgct

SEQ ID NO: 480195 - DNA, 20 bp, Artificial Sequence
  chemically synthesized
aagtgaagaagtgctgaggg

SEQ ID NO: 480196 - DNA, 20 bp, Artificial Sequence
  chemically synthesized
tacttattatggaagaggct

SEQ ID NO: 480197 - DNA, 20 bp, Artificial Sequence
  chemically synthesized
tattatggaagaggctgagg

SEQ ID NO: 480198 - DNA, 20 bp, Artificial Sequence
  chemically synthesized
gacctgtctccataggacat

SEQ ID NO: 480199 - DNA, 20 bp, Artificial Sequence
  chemically synthesized
tcaggtgaaaacctggggaa

SEQ ID NO: 480200 - DNA, 20 bp, Artificial Sequence
  chemically synthesized
gagaaaattacaaggagaag

SEQ ID NO: 480201 - DNA, 20 bp, Artificial Sequence
  chemically synthesized
ctgagtcaggcaatttggca

SEQ ID NO: 480202 - DNA, 20 bp, Artificial Sequence
  chemically synthesized
agcagtttgcctggcacggt

SEQ ID NO: 480203 - DNA, 20 bp, Artificial Sequence
  chemically synthesized
aatggactgaaaagtgagct

SEQ ID NO: 480204 - DNA, 20 bp, Artificial Sequence
  chemically synthesized
taagttccgtggtacatgtg

SEQ ID NO: 480205 - DNA, 20 bp, Artificial Sequence
  chemically synthesized
tatatatatatctctaggtg

SEQ ID NO: 480206 - DNA, 20 bp, Artificial Sequence
  chemically synthesized
tattattatactttaagttt

SEQ ID NO: 480207 - DNA, 20 bp, Artificial Sequence
  chemically synthesized
taatgttaactgacgagtta

SEQ ID NO: 480208 - DNA, 20 bp, Artificial Sequence
  chemically synthesized
gatacacctaatgttaactg

SEQ ID NO: 480209 - DNA, 20 bp, Artificial Sequence
  chemically synthesized
gtggggtcgggggagggggg

SEQ ID NO: 480210 - DNA, 20 bp, Artificial Sequence
  chemically synthesized
tcacacaccagggcctgttg

SEQ ID NO: 480211 - DNA, 20 bp, Artificial Sequence
  chemically synthesized
tcattgttcaattcccacct

SEQ ID NO: 480212 - DNA, 20 bp, Artificial Sequence
  chemically synthesized
acatgttctcactcacaggt

SEQ ID NO: 480213 - DNA, 20 bp, Artificial Sequence
  chemically synthesized
tgtccttgccatagtttgct

SEQ ID NO: 480214 - DNA, 20 bp, Artificial Sequence
  chemically synthesized
ttcatgtcctttgtagggac

SEQ ID NO: 480215 - DNA, 20 bp, Artificial Sequence
  chemically synthesized
ctatgcagccataaaaaagg

SEQ ID NO: 480216 - DNA, 20 bp, Artificial Sequence
  chemically synthesized
aatactatgcagccataaaa

SEQ ID NO: 480217 - DNA, 20 bp, Artificial Sequence
  chemically synthesized
aatgtggcacatatacacca

SEQ ID NO: 480218 - DNA, 20 bp, Artificial Sequence
  chemically synthesized
aaatgtccaacaatgataga

SEQ ID NO: 480219 - DNA, 20 bp, Artificial Sequence
  chemically synthesized
agtctatcattgttggacat

SEQ ID NO: 480220 - DNA, 20 bp, Artificial Sequence
  chemically synthesized
acacacactgaggcctgtcg

SEQ ID NO: 480221 - DNA, 20 bp, Artificial Sequence
  chemically synthesized
agtgtgtgttgttcccctcc

SEQ ID NO: 480222 - DNA, 20 bp, Artificial Sequence
  chemically synthesized
tgttcctgtgttagtttgct

SEQ ID NO: 480223 - DNA, 20 bp, Artificial Sequence
  chemically synthesized
tataaccaataatgggattg

SEQ ID NO: 480224 - DNA, 20 bp, Artificial Sequence
  chemically synthesized
tttgggtatataaccaataa

SEQ ID NO: 480225 - DNA, 20 bp, Artificial Sequence
  chemically synthesized
attattggttatatacccaa

SEQ ID NO: 480226 - DNA, 20 bp, Artificial Sequence
  chemically synthesized
atagaatggtttatattcct

SEQ ID NO: 480227 - DNA, 20 bp, Artificial Sequence
  chemically synthesized
gtgtgcatgtatctttaaaa

SEQ ID NO: 480228 - DNA, 20 bp, Artificial Sequence
  chemically synthesized
gattccatgtctttgctatt

SEQ ID NO: 480229 - DNA, 20 bp, Artificial Sequence
  chemically synthesized
tattcacaatagcaaagaca

SEQ ID NO: 480230 - DNA, 20 bp, Artificial Sequence
  chemically synthesized
agtctatcactgatgggcat

SEQ ID NO: 480231 - DNA, 20 bp, Artificial Sequence
  chemically synthesized
aaatgcccatcagtgataga

SEQ ID NO: 480232 - DNA, 20 bp, Artificial Sequence
  chemically synthesized
aatgtggtacatatacactg

SEQ ID NO: 480233 - DNA, 20 bp, Artificial Sequence
  chemically synthesized
ctcattcctttttatggctg

SEQ ID NO: 480234 - DNA, 20 bp, Artificial Sequence
  chemically synthesized
aatactctgcagccataaaa

SEQ ID NO: 480235 - DNA, 20 bp, Artificial Sequence
  chemically synthesized
tttggccatcagaagaggga

SEQ ID NO: 480236 - DNA, 20 bp, Artificial Sequence
  chemically synthesized
ttgacactaggtacaggtgg

SEQ ID NO: 480237 - DNA, 20 bp, Artificial Sequence
  chemically synthesized
attgtttgtttgttaaaatg

SEQ ID NO: 480238 - DNA, 20 bp, Artificial Sequence
  chemically synthesized
tttgttaaaatgaagggtac

SEQ ID NO: 480239 - DNA, 20 bp, Artificial Sequence
  chemically synthesized
agagtggtaagctgacagca

SEQ ID NO: 480240 - DNA, 20 bp, Artificial Sequence
  chemically synthesized
cctctgagccttgttctgtc

SEQ ID NO: 480241 - DNA, 20 bp, Artificial Sequence
  chemically synthesized
agaacaaggctcagaggaga

SEQ ID NO: 480242 - DNA, 20 bp, Artificial Sequence
  chemically synthesized
agaggagacggaatttagaa

SEQ ID NO: 480243 - DNA, 20 bp, Artificial Sequence
  chemically synthesized
ctataggatatggaaggtgc

SEQ ID NO: 480244 - DNA, 20 bp, Artificial Sequence
  chemically synthesized
ttctggctattgtgtgacta

SEQ ID NO: 480245 - DNA, 20 bp, Artificial Sequence
  chemically synthesized
tcctatagtcacacaatagc

SEQ ID NO: 480246 - DNA, 20 bp, Artificial Sequence
  chemically synthesized
ttattggctattttcccaac

SEQ ID NO: 480247 - DNA, 20 bp, Artificial Sequence
  chemically synthesized
tgtgagccaccgcgcctcat

SEQ ID NO: 480248 - DNA, 20 bp, Artificial Sequence
  chemically synthesized
acctcagcctcccaaagtgc

SEQ ID NO: 480249 - DNA, 20 bp, Artificial Sequence
  chemically synthesized
tttgtatttttttgcagaga

SEQ ID NO: 480250 - DNA, 20 bp, Artificial Sequence
  chemically synthesized
acttgggaggctgaggttgg

SEQ ID NO: 480251 - DNA, 20 bp, Artificial Sequence
  chemically synthesized
gcaacctccacctcctgggc

SEQ ID NO: 480252 - DNA, 20 bp, Artificial Sequence
  chemically synthesized
tctcactctgttgcctaggc

SEQ ID NO: 480253 - DNA, 20 bp, Artificial Sequence
  chemically synthesized
ttgcactccagcctaggcaa

SEQ ID NO: 480254 - DNA, 20 bp, Artificial Sequence
  chemically synthesized
ttttttttttttttttgaga

SEQ ID NO: 480255 - DNA, 20 bp, Artificial Sequence
  chemically synthesized
aaaaaaaaaaaaaaaaaaaa

SEQ ID NO: 480256 - DNA, 20 bp, Artificial Sequence
  chemically synthesized
atgtaaacatataaactcca

SEQ ID NO: 480257 - DNA, 20 bp, Artificial Sequence
  chemically synthesized
ctaacagtggtcccaccctc

SEQ ID NO: 480258 - DNA, 20 bp, Artificial Sequence
  chemically synthesized
tcttagactggttcggcaag

SEQ ID NO: 480259 - DNA, 20 bp, Artificial Sequence
  chemically synthesized
acagggcgaaaaaagagaaa

SEQ ID NO: 480260 - DNA, 20 bp, Artificial Sequence
  chemically synthesized
tggttggtttgggagtggga

SEQ ID NO: 480261 - DNA, 20 bp, Artificial Sequence
  chemically synthesized
tttgtggttggtttgggagt

SEQ ID NO: 480262 - DNA, 20 bp, Artificial Sequence
  chemically synthesized
gttagctttgtggttggttt

SEQ ID NO: 480263 - DNA, 20 bp, Artificial Sequence
  chemically synthesized
ttgtgttcatagcaagcaaa

SEQ ID NO: 480264 - DNA, 20 bp, Artificial Sequence
  chemically synthesized
taggccagcaaaacctccta

SEQ ID NO: 480265 - DNA, 20 bp, Artificial Sequence
  chemically synthesized
cagcaacaatagtatcccct

SEQ ID NO: 480266 - DNA, 20 bp, Artificial Sequence
  chemically synthesized
gcatttctatcaaattccca

SEQ ID NO: 480267 - DNA, 20 bp, Artificial Sequence
  chemically synthesized
aactaaatgattacactttg

SEQ ID NO: 480268 - DNA, 20 bp, Artificial Sequence
  chemically synthesized
gtttgttttttaatggttct

SEQ ID NO: 480269 - DNA, 20 bp, Artificial Sequence
  chemically synthesized
actggaaatttgtgagcaat

SEQ ID NO: 480270 - DNA, 20 bp, Artificial Sequence
  chemically synthesized
ttacagatagggtaggacct

SEQ ID NO: 480271 - DNA, 20 bp, Artificial Sequence
  chemically synthesized
aggtcctaccctatctgtaa

SEQ ID NO: 480272 - DNA, 20 bp, Artificial Sequence
  chemically synthesized
gttttacattcagttacaga

SEQ ID NO: 480273 - DNA, 20 bp, Artificial Sequence
  chemically synthesized
agattgaatggtcccatgcc

SEQ ID NO: 480274 - DNA, 20 bp, Artificial Sequence
  chemically synthesized
aggacttgtagaaatacaga

SEQ ID NO: 480275 - DNA, 20 bp, Artificial Sequence
  chemically synthesized
ttcaagtcggccctaaagtg

SEQ ID NO: 480276 - DNA, 20 bp, Artificial Sequence
  chemically synthesized
ttttctattaattaaaaacg

SEQ ID NO: 480277 - DNA, 20 bp, Artificial Sequence
  chemically synthesized
acgtagaattcaagagctaa

SEQ ID NO: 480278 - DNA, 20 bp, Artificial Sequence
  chemically synthesized
tcctgagattcctttagctc

SEQ ID NO: 480279 - DNA, 20 bp, Artificial Sequence
  chemically synthesized
tagcaaagataaatatacaa

SEQ ID NO: 480280 - DNA, 20 bp, Artificial Sequence
  chemically synthesized
ctaacacataatgtttgaaa

SEQ ID NO: 480281 - DNA, 20 bp, Artificial Sequence
  chemically synthesized
gctacatatgtgctaaatct

SEQ ID NO: 480282 - DNA, 20 bp, Artificial Sequence
  chemically synthesized
tcaaactagcacatggaaag

SEQ ID NO: 480283 - DNA, 20 bp, Artificial Sequence
  chemically synthesized
ctgctatcaagaatataaac

SEQ ID NO: 480284 - DNA, 20 bp, Artificial Sequence
  chemically synthesized
cctgtttatattcttgatag

SEQ ID NO: 480285 - DNA, 20 bp, Artificial Sequence
  chemically synthesized
cccaaagctattctgctatc

SEQ ID NO: 480286 - DNA, 20 bp, Artificial Sequence
  chemically synthesized
gaatagctttgggaaatgtt

SEQ ID NO: 480287 - DNA, 20 bp, Artificial Sequence
  chemically synthesized
gctttgggaaatgttctgaa

SEQ ID NO: 480288 - DNA, 20 bp, Artificial Sequence
  chemically synthesized
agcctatctttagagtagct

SEQ ID NO: 480289 - DNA, 20 bp, Artificial Sequence
  chemically synthesized
caaccttgtcagcctatctt

SEQ ID NO: 480290 - DNA, 20 bp, Artificial Sequence
  chemically synthesized
ccatacagttcctatgtacc

SEQ ID NO: 480291 - DNA, 20 bp, Artificial Sequence
  chemically synthesized
ttcctatgtaccatgaatct

SEQ ID NO: 480292 - DNA, 20 bp, Artificial Sequence
  chemically synthesized
aatcttagaatcaagaacgt

SEQ ID NO: 480293 - DNA, 20 bp, Artificial Sequence
  chemically synthesized
tttttgatgtcttgttccct

SEQ ID NO: 480294 - DNA, 20 bp, Artificial Sequence
  chemically synthesized
tcaaaaggttatacgctcaa

SEQ ID NO: 480295 - DNA, 20 bp, Artificial Sequence
  chemically synthesized
gaatgttgcattttaacgca

SEQ ID NO: 480296 - DNA, 20 bp, Artificial Sequence
  chemically synthesized
tcttgaaaggcagtttcaaa

SEQ ID NO: 480297 - DNA, 20 bp, Artificial Sequence
  chemically synthesized
caattacaaaagaaatgttc

SEQ ID NO: 480298 - DNA, 20 bp, Artificial Sequence
  chemically synthesized
ttttatgttgaacaaaatgc

SEQ ID NO: 480299 - DNA, 20 bp, Artificial Sequence
  chemically synthesized
aaatttttatattttgaaag

SEQ ID NO: 480300 - DNA, 20 bp, Artificial Sequence
  chemically synthesized
tgttaaaaaagaaaaagaca

SEQ ID NO: 480301 - DNA, 20 bp, Artificial Sequence
  chemically synthesized
cagaatagtaacaacaacgt

SEQ ID NO: 480302 - DNA, 20 bp, Artificial Sequence
  chemically synthesized
aggctcctaaggtgaccatt

SEQ ID NO: 480303 - DNA, 20 bp, Artificial Sequence
  chemically synthesized
aaaacttaatacctgtaagt

SEQ ID NO: 480304 - DNA, 20 bp, Artificial Sequence
  chemically synthesized
cacaatttcaattagacagg

SEQ ID NO: 480305 - DNA, 20 bp, Artificial Sequence
  chemically synthesized
caagagacctattgtacaac

SEQ ID NO: 480306 - DNA, 20 bp, Artificial Sequence
  chemically synthesized
ttatatacttgatacttgct

SEQ ID NO: 480307 - DNA, 20 bp, Artificial Sequence
  chemically synthesized
ttatttgtggtgagaacact

SEQ ID NO: 480308 - DNA, 20 bp, Artificial Sequence
  chemically synthesized
atttagccattccacaatgt

SEQ ID NO: 480309 - DNA, 20 bp, Artificial Sequence
  chemically synthesized
tttgatatacccatacattg

SEQ ID NO: 480310 - DNA, 20 bp, Artificial Sequence
  chemically synthesized
aaaacatcatgttgtacacc

SEQ ID NO: 480311 - DNA, 20 bp, Artificial Sequence
  chemically synthesized
actgccaacgagaggcactt

SEQ ID NO: 480312 - DNA, 20 bp, Artificial Sequence
  chemically synthesized
gtaagtgcctctcgttggca

SEQ ID NO: 480313 - DNA, 20 bp, Artificial Sequence
  chemically synthesized
taaggcccttatgacttttt

SEQ ID NO: 480314 - DNA, 20 bp, Artificial Sequence
  chemically synthesized
tgagaatggagctaagtgag

SEQ ID NO: 480315 - DNA, 20 bp, Artificial Sequence
  chemically synthesized
cccaagcctcgctgaccatt

SEQ ID NO: 480316 - DNA, 20 bp, Artificial Sequence
  chemically synthesized
tctcaatggtcagcgaggct

SEQ ID NO: 480317 - DNA, 20 bp, Artificial Sequence
  chemically synthesized
caaatgataattgaaatact

SEQ ID NO: 480318 - DNA, 20 bp, Artificial Sequence
  chemically synthesized
tttcagcttaatattctatc

SEQ ID NO: 480319 - DNA, 20 bp, Artificial Sequence
  chemically synthesized
tgtgagtctgaaattcagga

SEQ ID NO: 480320 - DNA, 20 bp, Artificial Sequence
  chemically synthesized
ggctgtgtgagtctgaaatt

SEQ ID NO: 480321 - DNA, 20 bp, Artificial Sequence
  chemically synthesized
attcttgggcagttggctgt

SEQ ID NO: 480322 - DNA, 20 bp, Artificial Sequence
  chemically synthesized
actcacacagccaactgccc

SEQ ID NO: 480323 - DNA, 20 bp, Artificial Sequence
  chemically synthesized
ccaaaaggcggacaagttca

SEQ ID NO: 480324 - DNA, 20 bp, Artificial Sequence
  chemically synthesized
tccctgaacttgtccgcctt

SEQ ID NO: 480325 - DNA, 20 bp, Artificial Sequence
  chemically synthesized
tttaggacgtgtcctgttta

SEQ ID NO: 480326 - DNA, 20 bp, Artificial Sequence
  chemically synthesized
acctccccaattagaagctt

SEQ ID NO: 480327 - DNA, 20 bp, Artificial Sequence
  chemically synthesized
ttctcaaactttagctccac

SEQ ID NO: 480328 - DNA, 20 bp, Artificial Sequence
  chemically synthesized
ttaaaaacattataaataca

SEQ ID NO: 480329 - DNA, 20 bp, Artificial Sequence
  chemically synthesized
ttaaaaaatttccatatttt

SEQ ID NO: 480330 - DNA, 20 bp, Artificial Sequence
  chemically synthesized
acaagttatttgctatcttt

SEQ ID NO: 480331 - DNA, 20 bp, Artificial Sequence
  chemically synthesized
acttgtaaacttgctccctt

SEQ ID NO: 480332 - DNA, 20 bp, Artificial Sequence
  chemically synthesized
cttgctcccttgtggatttg

SEQ ID NO: 480333 - DNA, 20 bp, Artificial Sequence
  chemically synthesized
ggtagttggggatacggact

SEQ ID NO: 480334 - DNA, 20 bp, Artificial Sequence
  chemically synthesized
gttagatgaagaaggtagtt

SEQ ID NO: 480335 - DNA, 20 bp, Artificial Sequence
  chemically synthesized
ctagggtgaggggaaaaagt

SEQ ID NO: 480336 - DNA, 20 bp, Artificial Sequence
  chemically synthesized
ggttgtctggtaccaagccc

SEQ ID NO: 480337 - DNA, 20 bp, Artificial Sequence
  chemically synthesized
aagtctgagcaagtttagga

SEQ ID NO: 480338 - DNA, 20 bp, Artificial Sequence
  chemically synthesized
aggaaaagaaatgagtgagg

SEQ ID NO: 480339 - DNA, 20 bp, Artificial Sequence
  chemically synthesized
gtggtttccaaggaaaagaa

SEQ ID NO: 480340 - DNA, 20 bp, Artificial Sequence
  chemically synthesized
tttccttggaaaccacaata

SEQ ID NO: 480341 - DNA, 20 bp, Artificial Sequence
  chemically synthesized
gccatgcaggaaaaaagttc

SEQ ID NO: 480342 - DNA, 20 bp, Artificial Sequence
  chemically synthesized
ttactcacagttctcaaggg

SEQ ID NO: 480343 - DNA, 20 bp, Artificial Sequence
  chemically synthesized
gtactcttcccttgagaact

SEQ ID NO: 480344 - DNA, 20 bp, Artificial Sequence
  chemically synthesized
agtaatcaaacttcttttaa

SEQ ID NO: 480345 - DNA, 20 bp, Artificial Sequence
  chemically synthesized
gatttgctttacagaaatga

SEQ ID NO: 480346 - DNA, 20 bp, Artificial Sequence
  chemically synthesized
gcagggtattttagttgcac

SEQ ID NO: 480347 - DNA, 20 bp, Artificial Sequence
  chemically synthesized
ttagattatgttgggagggg

SEQ ID NO: 480348 - DNA, 20 bp, Artificial Sequence
  chemically synthesized
ctcccaacataatctaagtc

SEQ ID NO: 480349 - DNA, 20 bp, Artificial Sequence
  chemically synthesized
atagactttgctatctagta

SEQ ID NO: 480350 - DNA, 20 bp, Artificial Sequence
  chemically synthesized
tttttttttttttttcaact

SEQ ID NO: 480351 - DNA, 20 bp, Artificial Sequence
  chemically synthesized
aacacactggtggcttaaac

SEQ ID NO: 480352 - DNA, 20 bp, Artificial Sequence
  chemically synthesized
tgggcttcaataacttaacg

SEQ ID NO: 480353 - DNA, 20 bp, Artificial Sequence
  chemically synthesized
acttcatttaaaaaggtaaa

SEQ ID NO: 480354 - DNA, 20 bp, Artificial Sequence
  chemically synthesized
aaaggttctgtgttaagcag

SEQ ID NO: 480355 - DNA, 20 bp, Artificial Sequence
  chemically synthesized
gatgaagctagaaagttagt

SEQ ID NO: 480356 - DNA, 20 bp, Artificial Sequence
  chemically synthesized
ctgcttggtaaacctagagt

SEQ ID NO: 480357 - DNA, 20 bp, Artificial Sequence
  chemically synthesized
ggattgctgcttggtaaacc

SEQ ID NO: 480358 - DNA, 20 bp, Artificial Sequence
  chemically synthesized
tcatgggaaagtgattttga

SEQ ID NO: 480359 - DNA, 20 bp, Artificial Sequence
  chemically synthesized
acagtatgttgcctggctta

SEQ ID NO: 480360 - DNA, 20 bp, Artificial Sequence
  chemically synthesized
ggtagggggaaggaaacatg

SEQ ID NO: 480361 - DNA, 20 bp, Artificial Sequence
  chemically synthesized
tctaaatggagacctaagag

SEQ ID NO: 480362 - DNA, 20 bp, Artificial Sequence
  chemically synthesized
ggctcagctattctatcatt

SEQ ID NO: 480363 - DNA, 20 bp, Artificial Sequence
  chemically synthesized
taggatagaacccggaatga

SEQ ID NO: 480364 - DNA, 20 bp, Artificial Sequence
  chemically synthesized
aaatgggataggatagaacc

SEQ ID NO: 480365 - DNA, 20 bp, Artificial Sequence
  chemically synthesized
ggagatagcaggaaatggga

SEQ ID NO: 480366 - DNA, 20 bp, Artificial Sequence
  chemically synthesized
gtcagggagatagcaggaaa

SEQ ID NO: 480367 - DNA, 20 bp, Artificial Sequence
  chemically synthesized
tgctatctccctgacttatt

SEQ ID NO: 480368 - DNA, 20 bp, Artificial Sequence
  chemically synthesized
gtcaaaatcagcaaaggaaa

SEQ ID NO: 480369 - DNA, 20 bp, Artificial Sequence
  chemically synthesized
atcagcaaaggaaagcgggt

SEQ ID NO: 480370 - DNA, 20 bp, Artificial Sequence
  chemically synthesized
ggttaggggaagaaggaact

SEQ ID NO: 480371 - DNA, 20 bp, Artificial Sequence
  chemically synthesized
agaaggaagacaatatgcat

SEQ ID NO: 480372 - DNA, 20 bp, Artificial Sequence
  chemically synthesized
gacaatatgcatcaggataa

SEQ ID NO: 480373 - DNA, 20 bp, Artificial Sequence
  chemically synthesized
atgccttcagagtttcaact

SEQ ID NO: 480374 - DNA, 20 bp, Artificial Sequence
  chemically synthesized
acactcatggaaaatgcctt

SEQ ID NO: 480375 - DNA, 20 bp, Artificial Sequence
  chemically synthesized
aaactctgaaggcattttcc

SEQ ID NO: 480376 - DNA, 20 bp, Artificial Sequence
  chemically synthesized
ttgagactaagtaaaacaaa

SEQ ID NO: 480377 - DNA, 20 bp, Artificial Sequence
  chemically synthesized
ttaaattaaattcacataat

SEQ ID NO: 480378 - DNA, 20 bp, Artificial Sequence
  chemically synthesized
tctcataaaattctaattat

SEQ ID NO: 480379 - DNA, 20 bp, Artificial Sequence
  chemically synthesized
tcacataattagaattttat

SEQ ID NO: 480380 - DNA, 20 bp, Artificial Sequence
  chemically synthesized
tgagagtgagaaattactta

SEQ ID NO: 480381 - DNA, 20 bp, Artificial Sequence
  chemically synthesized
caatgcatcttattaaggtg

SEQ ID NO: 480382 - DNA, 20 bp, Artificial Sequence
  chemically synthesized
aatggtcacgtcaggccttt

SEQ ID NO: 480383 - DNA, 20 bp, Artificial Sequence
  chemically synthesized
tgtatttattttgggaggca

SEQ ID NO: 480384 - DNA, 20 bp, Artificial Sequence
  chemically synthesized
caaaataaatacataattgt

SEQ ID NO: 480385 - DNA, 20 bp, Artificial Sequence
  chemically synthesized
tcccactggaagaatgaaaa

SEQ ID NO: 480386 - DNA, 20 bp, Artificial Sequence
  chemically synthesized
tattgtttacttcccactgg

SEQ ID NO: 480387 - DNA, 20 bp, Artificial Sequence
  chemically synthesized
gtatataggtatgtcataaa

SEQ ID NO: 480388 - DNA, 20 bp, Artificial Sequence
  chemically synthesized
atacacttagcaatgaacaa

SEQ ID NO: 480389 - DNA, 20 bp, Artificial Sequence
  chemically synthesized
cttaagattacttgtgaatt

SEQ ID NO: 480390 - DNA, 20 bp, Artificial Sequence
  chemically synthesized
acctgaccttaagattactt

SEQ ID NO: 480391 - DNA, 20 bp, Artificial Sequence
  chemically synthesized
caacactttggaaaacaact

SEQ ID NO: 480392 - DNA, 20 bp, Artificial Sequence
  chemically synthesized
ctgggacctttttgcattgg

SEQ ID NO: 480393 - DNA, 20 bp, Artificial Sequence
  chemically synthesized
acttaacaagaaaatgtctt

SEQ ID NO: 480394 - DNA, 20 bp, Artificial Sequence
  chemically synthesized
agtctgattcagatcatgca

SEQ ID NO: 480395 - DNA, 20 bp, Artificial Sequence
  chemically synthesized
tagtgtaccccatgcatgat

SEQ ID NO: 480396 - DNA, 20 bp, Artificial Sequence
  chemically synthesized
acaagactttcattctagat

SEQ ID NO: 480397 - DNA, 20 bp, Artificial Sequence
  chemically synthesized
atcagactaaaattcatatc

SEQ ID NO: 480398 - DNA, 20 bp, Artificial Sequence
  chemically synthesized
gtgataagaaagtagtcttt

SEQ ID NO: 480399 - DNA, 20 bp, Artificial Sequence
  chemically synthesized
gttgtcttaaatgtcttggt

SEQ ID NO: 480400 - DNA, 20 bp, Artificial Sequence
  chemically synthesized
acatttaagacaacattctc

SEQ ID NO: 480401 - DNA, 20 bp, Artificial Sequence
  chemically synthesized
tgtagtcatttatcacccct

SEQ ID NO: 480402 - DNA, 20 bp, Artificial Sequence
  chemically synthesized
taaacttctaattgctctta

SEQ ID NO: 480403 - DNA, 20 bp, Artificial Sequence
  chemically synthesized
ttacagagtgttctgtaaaa

SEQ ID NO: 480404 - DNA, 20 bp, Artificial Sequence
  chemically synthesized
catagtatttttaaagaatg

SEQ ID NO: 480405 - DNA, 20 bp, Artificial Sequence
  chemically synthesized
ttaatgccatagtattttta

SEQ ID NO: 480406 - DNA, 20 bp, Artificial Sequence
  chemically synthesized
gcattcccaaatgtagtcta

SEQ ID NO: 480407 - DNA, 20 bp, Artificial Sequence
  chemically synthesized
aaactctgtagactacattt

SEQ ID NO: 480408 - DNA, 20 bp, Artificial Sequence
  chemically synthesized
tgcttccaaggttagcagtg

SEQ ID NO: 480409 - DNA, 20 bp, Artificial Sequence
  chemically synthesized
gaacttccggcccttcactg

SEQ ID NO: 480410 - DNA, 20 bp, Artificial Sequence
  chemically synthesized
tcttttccttttggtttaat

SEQ ID NO: 480411 - DNA, 20 bp, Artificial Sequence
  chemically synthesized
tgaaatgtggctgatctgaa

SEQ ID NO: 480412 - DNA, 20 bp, Artificial Sequence
  chemically synthesized
tctgaactgagttgcgctgt

SEQ ID NO: 480413 - DNA, 20 bp, Artificial Sequence
  chemically synthesized
catgttaaaatgacaatgtt

SEQ ID NO: 480414 - DNA, 20 bp, Artificial Sequence
  chemically synthesized
atgacaatgttttgggtata

SEQ ID NO: 480415 - DNA, 20 bp, Artificial Sequence
  chemically synthesized
tgtagtaaaatgaagagaac

SEQ ID NO: 480416 - DNA, 20 bp, Artificial Sequence
  chemically synthesized
gactccaaacgctcacacca

SEQ ID NO: 480417 - DNA, 20 bp, Artificial Sequence
  chemically synthesized
gatcctgtggtgtgagcgtt

SEQ ID NO: 480418 - DNA, 20 bp, Artificial Sequence
  chemically synthesized
caatttagaaatgtaataat

SEQ ID NO: 480419 - DNA, 20 bp, Artificial Sequence
  chemically synthesized
agagaaaataaacacaagca

SEQ ID NO: 480420 - DNA, 20 bp, Artificial Sequence
  chemically synthesized
aatgagagagaatctccccc

SEQ ID NO: 480421 - DNA, 20 bp, Artificial Sequence
  chemically synthesized
ggaaattaaatataatgaga

SEQ ID NO: 480422 - DNA, 20 bp, Artificial Sequence
  chemically synthesized
cattatatttaatttcctct

SEQ ID NO: 480423 - DNA, 20 bp, Artificial Sequence
  chemically synthesized
ctattttactgtcttttaaa

SEQ ID NO: 480424 - DNA, 20 bp, Artificial Sequence
  chemically synthesized
gaagttaagagcaaagtaga

SEQ ID NO: 480425 - DNA, 20 bp, Artificial Sequence
  chemically synthesized
ttaagagcaaagtagactga

SEQ ID NO: 480426 - DNA, 20 bp, Artificial Sequence
  chemically synthesized
tattaaagtagttcctccta

SEQ ID NO: 480427 - DNA, 20 bp, Artificial Sequence
  chemically synthesized
taaggagtttatctcaacca

SEQ ID NO: 480428 - DNA, 20 bp, Artificial Sequence
  chemically synthesized
tttgagtcaagtgttaaagg

SEQ ID NO: 480429 - DNA, 20 bp, Artificial Sequence
  chemically synthesized
tttagaggaggaggtggcat

SEQ ID NO: 480430 - DNA, 20 bp, Artificial Sequence
  chemically synthesized
atgctctaggagaatatgca

SEQ ID NO: 480431 - DNA, 20 bp, Artificial Sequence
  chemically synthesized
tataaggcataatgctctag

SEQ ID NO: 480432 - DNA, 20 bp, Artificial Sequence
  chemically synthesized
ccttatatatatttctctta

SEQ ID NO: 480433 - DNA, 20 bp, Artificial Sequence
  chemically synthesized
ttctcctcgctgtcccaaac

SEQ ID NO: 480434 - DNA, 20 bp, Artificial Sequence
  chemically synthesized
acaacatggctgaagtcaac

SEQ ID NO: 480435 - DNA, 20 bp, Artificial Sequence
  chemically synthesized
acctggaatatatgcacatt

SEQ ID NO: 480436 - DNA, 20 bp, Artificial Sequence
  chemically synthesized
taccatctcattgagaaacc

SEQ ID NO: 480437 - DNA, 20 bp, Artificial Sequence
  chemically synthesized
aaatttaaactacatatatg

SEQ ID NO: 480438 - DNA, 20 bp, Artificial Sequence
  chemically synthesized
atatatatagaatatatatg

SEQ ID NO: 480439 - DNA, 20 bp, Artificial Sequence
  chemically synthesized
tatatatatatatatatata

SEQ ID NO: 480440 - DNA, 20 bp, Artificial Sequence
  chemically synthesized
cacatagaaatattttaatg

SEQ ID NO: 480441 - DNA, 20 bp, Artificial Sequence
  chemically synthesized
acacacacacaaagacataa

SEQ ID NO: 480442 - DNA, 20 bp, Artificial Sequence
  chemically synthesized
acttcgattacgtttgctga

SEQ ID NO: 480443 - DNA, 20 bp, Artificial Sequence
  chemically synthesized
attgtagcaaaaaaagagcc

SEQ ID NO: 480444 - DNA, 20 bp, Artificial Sequence
  chemically synthesized
tttacaaatgagtcaaaacc

SEQ ID NO: 480445 - DNA, 20 bp, Artificial Sequence
  chemically synthesized
cctcagatgggcatttacaa

SEQ ID NO: 480446 - DNA, 20 bp, Artificial Sequence
  chemically synthesized
ggtcaacatatagtaatgag

SEQ ID NO: 480447 - DNA, 20 bp, Artificial Sequence
  chemically synthesized
agagatgagatcacaataga

SEQ ID NO: 480448 - DNA, 20 bp, Artificial Sequence
  chemically synthesized
acaaacccctggaaaatttc

SEQ ID NO: 480449 - DNA, 20 bp, Artificial Sequence
  chemically synthesized
tgatattcatgaaattttcc

SEQ ID NO: 480450 - DNA, 20 bp, Artificial Sequence
  chemically synthesized
ccaggggtttgtaaaaattt

SEQ ID NO: 480451 - DNA, 20 bp, Artificial Sequence
  chemically synthesized
gaaaagatatgtttattttc

SEQ ID NO: 480452 - DNA, 20 bp, Artificial Sequence
  chemically synthesized
gccaaatacatgatcgtggg

SEQ ID NO: 480453 - DNA, 20 bp, Artificial Sequence
  chemically synthesized
tctcttcatagctaaaagtg

SEQ ID NO: 480454 - DNA, 20 bp, Artificial Sequence
  chemically synthesized
tcaacacttttagctatgaa

SEQ ID NO: 480455 - DNA, 20 bp, Artificial Sequence
  chemically synthesized
taaatatggatataaattat

SEQ ID NO: 480456 - DNA, 20 bp, Artificial Sequence
  chemically synthesized
gagtaaccaatgctctaaat

SEQ ID NO: 480457 - DNA, 20 bp, Artificial Sequence
  chemically synthesized
aaccctttatatatttcaac

SEQ ID NO: 480458 - DNA, 20 bp, Artificial Sequence
  chemically synthesized
tactcatgttgaaatatata

SEQ ID NO: 480459 - DNA, 20 bp, Artificial Sequence
  chemically synthesized
aaagggttgaagaagttata

SEQ ID NO: 480460 - DNA, 20 bp, Artificial Sequence
  chemically synthesized
gacttactctgaagatcatc

SEQ ID NO: 480461 - DNA, 20 bp, Artificial Sequence
  chemically synthesized
attttactccagatgatctt

SEQ ID NO: 480462 - DNA, 20 bp, Artificial Sequence
  chemically synthesized
acacagtttaagtaatttgc

SEQ ID NO: 480463 - DNA, 20 bp, Artificial Sequence
  chemically synthesized
gtagctggtaaagacttgga

SEQ ID NO: 480464 - DNA, 20 bp, Artificial Sequence
  chemically synthesized
agattctatagctacagagc

SEQ ID NO: 480465 - DNA, 20 bp, Artificial Sequence
  chemically synthesized
aaacccaagctctgtagcta

SEQ ID NO: 480466 - DNA, 20 bp, Artificial Sequence
  chemically synthesized
gtagctatagaatcttccaa

SEQ ID NO: 480467 - DNA, 20 bp, Artificial Sequence
  chemically synthesized
tcgctgcacattagattgag

SEQ ID NO: 480468 - DNA, 20 bp, Artificial Sequence
  chemically synthesized
gattgagctgagtagtttgt

SEQ ID NO: 480469 - DNA, 20 bp, Artificial Sequence
  chemically synthesized
tggttttcacaagatttcct

SEQ ID NO: 480470 - DNA, 20 bp, Artificial Sequence
  chemically synthesized
tgtgaaaaccaaagtttcaa

SEQ ID NO: 480471 - DNA, 20 bp, Artificial Sequence
  chemically synthesized
aaatacactttgagcatcaa

SEQ ID NO: 480472 - DNA, 20 bp, Artificial Sequence
  chemically synthesized
tggggaattcttcatagttt

SEQ ID NO: 480473 - DNA, 20 bp, Artificial Sequence
  chemically synthesized
gataaaacccaaaaactatg

SEQ ID NO: 480474 - DNA, 20 bp, Artificial Sequence
  chemically synthesized
tacttttatgacgaggcatg

SEQ ID NO: 480475 - DNA, 20 bp, Artificial Sequence
  chemically synthesized
ctaattacataagaaaaagt

SEQ ID NO: 480476 - DNA, 20 bp, Artificial Sequence
  chemically synthesized
catactttttcttatgtaat

SEQ ID NO: 480477 - DNA, 20 bp, Artificial Sequence
  chemically synthesized
ataaaacgtttgtctatata

SEQ ID NO: 480478 - DNA, 20 bp, Artificial Sequence
  chemically synthesized
gcttatattagtatattaat

SEQ ID NO: 480479 - DNA, 20 bp, Artificial Sequence
  chemically synthesized
gggacatagtttcaggaaag

SEQ ID NO: 480480 - DNA, 20 bp, Artificial Sequence
  chemically synthesized
gcataggatagccctccaca

SEQ ID NO: 480481 - DNA, 20 bp, Artificial Sequence
  chemically synthesized
gagggctatcctatgcattg

SEQ ID NO: 480482 - DNA, 20 bp, Artificial Sequence
  chemically synthesized
ataaaatatcctacaatgca

SEQ ID NO: 480483 - DNA, 20 bp, Artificial Sequence
  chemically synthesized
ggagatacaactgaagtcta

SEQ ID NO: 480484 - DNA, 20 bp, Artificial Sequence
  chemically synthesized
ggcatttttaattattatta

SEQ ID NO: 480485 - DNA, 20 bp, Artificial Sequence
  chemically synthesized
ggttctcaaaatggggggcg

SEQ ID NO: 480486 - DNA, 20 bp, Artificial Sequence
  chemically synthesized
ttgcaatagacaaattagct

SEQ ID NO: 480487 - DNA, 20 bp, Artificial Sequence
  chemically synthesized
ccctttcgacttctggtctg

SEQ ID NO: 480488 - DNA, 20 bp, Artificial Sequence
  chemically synthesized
aaacttgtattatagacacg

SEQ ID NO: 480489 - DNA, 20 bp, Artificial Sequence
  chemically synthesized
ataacaatttgtgatgcttt

SEQ ID NO: 480490 - DNA, 20 bp, Artificial Sequence
  chemically synthesized
aatcatcaaaaaaatgttgt

SEQ ID NO: 480491 - DNA, 20 bp, Artificial Sequence
  chemically synthesized
ttccaatagatttccaaact

SEQ ID NO: 480492 - DNA, 20 bp, Artificial Sequence
  chemically synthesized
atcagagcaggatgaaaatt

SEQ ID NO: 480493 - DNA, 20 bp, Artificial Sequence
  chemically synthesized
caaagattaaccaatcagag

SEQ ID NO: 480494 - DNA, 20 bp, Artificial Sequence
  chemically synthesized
tctgattggttaatctttgg

SEQ ID NO: 480495 - DNA, 20 bp, Artificial Sequence
  chemically synthesized
cagcaaataattataatgca

SEQ ID NO: 480496 - DNA, 20 bp, Artificial Sequence
  chemically synthesized
cttatcatataaagacaaaa

SEQ ID NO: 480497 - DNA, 20 bp, Artificial Sequence
  chemically synthesized
tataaagacaaaattgggtg

SEQ ID NO: 480498 - DNA, 20 bp, Artificial Sequence
  chemically synthesized
aacataataacctactgagt

SEQ ID NO: 480499 - DNA, 20 bp, Artificial Sequence
  chemically synthesized
ttaaagaacataataaccta

SEQ ID NO: 480500 - DNA, 20 bp, Artificial Sequence
  chemically synthesized
tttttgagattactgtgaaa

SEQ ID NO: 480501 - DNA, 20 bp, Artificial Sequence
  chemically synthesized
tagtcatttttgcacggtgg

SEQ ID NO: 480502 - DNA, 20 bp, Artificial Sequence
  chemically synthesized
aatagcttacattagtatat

SEQ ID NO: 480503 - DNA, 20 bp, Artificial Sequence
  chemically synthesized
tttaacaatgaggcaaatat

SEQ ID NO: 480504 - DNA, 20 bp, Artificial Sequence
  chemically synthesized
tcacataatttgaaaatatt

SEQ ID NO: 480505 - DNA, 20 bp, Artificial Sequence
  chemically synthesized
atattaagaatttgaagcta

SEQ ID NO: 480506 - DNA, 20 bp, Artificial Sequence
  chemically synthesized
aatttgaaaacattaatgca

SEQ ID NO: 480507 - DNA, 20 bp, Artificial Sequence
  chemically synthesized
taaacagactttcttccata

SEQ ID NO: 480508 - DNA, 20 bp, Artificial Sequence
  chemically synthesized
atctgaagcatttggggagc

SEQ ID NO: 480509 - DNA, 20 bp, Artificial Sequence
  chemically synthesized
tcgctccccaaatgcttcag

SEQ ID NO: 480510 - DNA, 20 bp, Artificial Sequence
  chemically synthesized
ctccagctcccccacacaaa

SEQ ID NO: 480511 - DNA, 20 bp, Artificial Sequence
  chemically synthesized
ggagctggagagagaaatag

SEQ ID NO: 480512 - DNA, 20 bp, Artificial Sequence
  chemically synthesized
gtacttgttaggatggaatc

SEQ ID NO: 480513 - DNA, 20 bp, Artificial Sequence
  chemically synthesized
tttattggtacttgttagga

SEQ ID NO: 480514 - DNA, 20 bp, Artificial Sequence
  chemically synthesized
tgctatttattggtacttgt

SEQ ID NO: 480515 - DNA, 20 bp, Artificial Sequence
  chemically synthesized
ttataaccatagaaaggaca

SEQ ID NO: 480516 - DNA, 20 bp, Artificial Sequence
  chemically synthesized
ggtacctctgaaattttgga

SEQ ID NO: 480517 - DNA, 20 bp, Artificial Sequence
  chemically synthesized
acctcaatttaatgactccc

SEQ ID NO: 480518 - DNA, 20 bp, Artificial Sequence
  chemically synthesized
caaccaattactttattcag

SEQ ID NO: 480519 - DNA, 20 bp, Artificial Sequence
  chemically synthesized
ttgtttttgtttttcctttt

SEQ ID NO: 480520 - DNA, 20 bp, Artificial Sequence
  chemically synthesized
aggaaaaacaaaaacaaaac

SEQ ID NO: 480521 - DNA, 20 bp, Artificial Sequence
  chemically synthesized
gtcattatattataaaatag

SEQ ID NO: 480522 - DNA, 20 bp, Artificial Sequence
  chemically synthesized
taatgacaataatattgcct

SEQ ID NO: 480523 - DNA, 20 bp, Artificial Sequence
  chemically synthesized
taactgtgtaataattcact

SEQ ID NO: 480524 - DNA, 20 bp, Artificial Sequence
  chemically synthesized
caattattgcagtacccaaa

SEQ ID NO: 480525 - DNA, 20 bp, Artificial Sequence
  chemically synthesized
tattacactaaataaaagaa

SEQ ID NO: 480526 - DNA, 20 bp, Artificial Sequence
  chemically synthesized
tgtaaattaatttaacatga

SEQ ID NO: 480527 - DNA, 20 bp, Artificial Sequence
  chemically synthesized
ttttcagtccttgaaacttt

SEQ ID NO: 480528 - DNA, 20 bp, Artificial Sequence
  chemically synthesized
agccttctttgtataaatct

SEQ ID NO: 480529 - DNA, 20 bp, Artificial Sequence
  chemically synthesized
attcatcatcgcttgaaatt

SEQ ID NO: 480530 - DNA, 20 bp, Artificial Sequence
  chemically synthesized
attcaaaatttcaagcgatg

SEQ ID NO: 480531 - DNA, 20 bp, Artificial Sequence
  chemically synthesized
ataaggaaagttcatgttat

SEQ ID NO: 480532 - DNA, 20 bp, Artificial Sequence
  chemically synthesized
gaaagttcatgttattggaa

SEQ ID NO: 480533 - DNA, 20 bp, Artificial Sequence
  chemically synthesized
cagagtagtatctgtcaaat

SEQ ID NO: 480534 - DNA, 20 bp, Artificial Sequence
  chemically synthesized
acaaatttattaagctgtat

SEQ ID NO: 480535 - DNA, 20 bp, Artificial Sequence
  chemically synthesized
tctcgttagtgtttcagcag

SEQ ID NO: 480536 - DNA, 20 bp, Artificial Sequence
  chemically synthesized
tcagctgctgaaacactaac

SEQ ID NO: 480537 - DNA, 20 bp, Artificial Sequence
  chemically synthesized
aaagatgaaaaccaggttct

SEQ ID NO: 480538 - DNA, 20 bp, Artificial Sequence
  chemically synthesized
tggttttcatctttaattga

SEQ ID NO: 480539 - DNA, 20 bp, Artificial Sequence
  chemically synthesized
gaattggacaacctcaagaa

SEQ ID NO: 480540 - DNA, 20 bp, Artificial Sequence
  chemically synthesized
aagaagagagtagtttcact

SEQ ID NO: 480541 - DNA, 20 bp, Artificial Sequence
  chemically synthesized
gatggtgctgggctgctcat

SEQ ID NO: 480542 - DNA, 20 bp, Artificial Sequence
  chemically synthesized
gcttgactgcatttaacctg

SEQ ID NO: 480543 - DNA, 20 bp, Artificial Sequence
  chemically synthesized
cttttgctattatctagtct

SEQ ID NO: 480544 - DNA, 20 bp, Artificial Sequence
  chemically synthesized
ctaaataataaatgttctca

SEQ ID NO: 480545 - DNA, 20 bp, Artificial Sequence
  chemically synthesized
gttatatgtacagacacatg

SEQ ID NO: 480546 - DNA, 20 bp, Artificial Sequence
  chemically synthesized
cactttgagtagtagggctc

SEQ ID NO: 480547 - DNA, 20 bp, Artificial Sequence
  chemically synthesized
gtcagtctctggcgcacact

SEQ ID NO: 480548 - DNA, 20 bp, Artificial Sequence
  chemically synthesized
gcagcatcacctgggaccta

SEQ ID NO: 480549 - DNA, 20 bp, Artificial Sequence
  chemically synthesized
acctactgaatcagcatctc

SEQ ID NO: 480550 - DNA, 20 bp, Artificial Sequence
  chemically synthesized
ttctatgttctcacaatgct

SEQ ID NO: 480551 - DNA, 20 bp, Artificial Sequence
  chemically synthesized
aaagttcttgaggcaaagcc

SEQ ID NO: 480552 - DNA, 20 bp, Artificial Sequence
  chemically synthesized
ttgcctcaagaactttagtt

SEQ ID NO: 480553 - DNA, 20 bp, Artificial Sequence
  chemically synthesized
aggttctcaatatttgttga

SEQ ID NO: 480554 - DNA, 20 bp, Artificial Sequence
  chemically synthesized
tagtaggttctcaatatttg

SEQ ID NO: 480555 - DNA, 20 bp, Artificial Sequence
  chemically synthesized
ttaggcattgtgttagtggc

SEQ ID NO: 480556 - DNA, 20 bp, Artificial Sequence
  chemically synthesized
aaatttatatatttgtttat

SEQ ID NO: 480557 - DNA, 20 bp, Artificial Sequence
  chemically synthesized
aaagaacagaaatggctttg

SEQ ID NO: 480558 - DNA, 20 bp, Artificial Sequence
  chemically synthesized
agaaatggctttgaggggtg

SEQ ID NO: 480559 - DNA, 20 bp, Artificial Sequence
  chemically synthesized
atattccacaagatgcttat

SEQ ID NO: 480560 - DNA, 20 bp, Artificial Sequence
  chemically synthesized
gcacccagataagcatcttg

SEQ ID NO: 480561 - DNA, 20 bp, Artificial Sequence
  chemically synthesized
ataagcatcttgtggaatat

SEQ ID NO: 480562 - DNA, 20 bp, Artificial Sequence
  chemically synthesized
aatataagagtatgccctgg

SEQ ID NO: 480563 - DNA, 20 bp, Artificial Sequence
  chemically synthesized
gtgtccgcagtagaccactt

SEQ ID NO: 480564 - DNA, 20 bp, Artificial Sequence
  chemically synthesized
taagtaagaagcagagagga

SEQ ID NO: 480565 - DNA, 20 bp, Artificial Sequence
  chemically synthesized
gcacagtgaattagaaaacc

SEQ ID NO: 480566 - DNA, 20 bp, Artificial Sequence
  chemically synthesized
tttaaaatttgtcttgcaca

SEQ ID NO: 480567 - DNA, 20 bp, Artificial Sequence
  chemically synthesized
aatgttggctgaaattaatg

SEQ ID NO: 480568 - DNA, 20 bp, Artificial Sequence
  chemically synthesized
tgcagaatgttctgtggaag

SEQ ID NO: 480569 - DNA, 20 bp, Artificial Sequence
  chemically synthesized
ctgtggaagaagaattcaag

SEQ ID NO: 480570 - DNA, 20 bp, Artificial Sequence
  chemically synthesized
ctactgcttcaagacccatc

SEQ ID NO: 480571 - DNA, 20 bp, Artificial Sequence
  chemically synthesized
gatgggtcttgaagcagtag

SEQ ID NO: 480572 - DNA, 20 bp, Artificial Sequence
  chemically synthesized
ataaataaggaagtcatttt

SEQ ID NO: 480573 - DNA, 20 bp, Artificial Sequence
  chemically synthesized
gttattagaaataaaatgat

SEQ ID NO: 480574 - DNA, 20 bp, Artificial Sequence
  chemically synthesized
ctgttaataccacatatcag

SEQ ID NO: 480575 - DNA, 20 bp, Artificial Sequence
  chemically synthesized
aattctacctagatacttat

SEQ ID NO: 480576 - DNA, 20 bp, Artificial Sequence
  chemically synthesized
gactctaataagtatctagg

SEQ ID NO: 480577 - DNA, 20 bp, Artificial Sequence
  chemically synthesized
aggtagaattgtcaaagaag

SEQ ID NO: 480578 - DNA, 20 bp, Artificial Sequence
  chemically synthesized
taacatacttgaaatgaaat

SEQ ID NO: 480579 - DNA, 20 bp, Artificial Sequence
  chemically synthesized
ttttttttaattgagagaga

SEQ ID NO: 480580 - DNA, 20 bp, Artificial Sequence
  chemically synthesized
ctgtactccagtctaggtga

SEQ ID NO: 480581 - DNA, 20 bp, Artificial Sequence
  chemically synthesized
tctcattctgtcacctagac

SEQ ID NO: 480582 - DNA, 20 bp, Artificial Sequence
  chemically synthesized
tactcaggacgctgaggcag

SEQ ID NO: 480583 - DNA, 20 bp, Artificial Sequence
  chemically synthesized
aatcctcctgcctcagcgtc

SEQ ID NO: 480584 - DNA, 20 bp, Artificial Sequence
  chemically synthesized
gcctcagcgtcctgagtagc

SEQ ID NO: 480585 - DNA, 20 bp, Artificial Sequence
  chemically synthesized
aaaaattttttaaaaaatag

SEQ ID NO: 480586 - DNA, 20 bp, Artificial Sequence
  chemically synthesized
aaaaatttttttggtagaga

SEQ ID NO: 480587 - DNA, 20 bp, Artificial Sequence
  chemically synthesized
caggagaatcgcttgagccc

SEQ ID NO: 480588 - DNA, 20 bp, Artificial Sequence
  chemically synthesized
aatttgggaggctaaggcag

SEQ ID NO: 480589 - DNA, 20 bp, Artificial Sequence
  chemically synthesized
gccttagcctcccaaattgc

SEQ ID NO: 480590 - DNA, 20 bp, Artificial Sequence
  chemically synthesized
aagcaattgaaaagcaaata

SEQ ID NO: 480591 - DNA, 20 bp, Artificial Sequence
  chemically synthesized
cttatttcctgtttaactag

SEQ ID NO: 480592 - DNA, 20 bp, Artificial Sequence
  chemically synthesized
atggtcttatttaacaacta

SEQ ID NO: 480593 - DNA, 20 bp, Artificial Sequence
  chemically synthesized
atgcagtgacattggtacaa

SEQ ID NO: 480594 - DNA, 20 bp, Artificial Sequence
  chemically synthesized
aaggtaaagtttctgaccac

SEQ ID NO: 480595 - DNA, 20 bp, Artificial Sequence
  chemically synthesized
atttattttcccccaatggt

SEQ ID NO: 480596 - DNA, 20 bp, Artificial Sequence
  chemically synthesized
aaaataaatccttttagaaa

SEQ ID NO: 480597 - DNA, 20 bp, Artificial Sequence
  chemically synthesized
cagttcaatcctatttctaa

SEQ ID NO: 480598 - DNA, 20 bp, Artificial Sequence
  chemically synthesized
cctttcatgttaaactttat

SEQ ID NO: 480599 - DNA, 20 bp, Artificial Sequence
  chemically synthesized
aaatcagatgtgattttctt

SEQ ID NO: 480600 - DNA, 20 bp, Artificial Sequence
  chemically synthesized
cgatgtatagaaagattttc

SEQ ID NO: 480601 - DNA, 20 bp, Artificial Sequence
  chemically synthesized
tcctaagtatatctggtgat

SEQ ID NO: 480602 - DNA, 20 bp, Artificial Sequence
  chemically synthesized
ttaggaaatgattaagaagg

SEQ ID NO: 480603 - DNA, 20 bp, Artificial Sequence
  chemically synthesized
gaaaatgataattacatttc

SEQ ID NO: 480604 - DNA, 20 bp, Artificial Sequence
  chemically synthesized
gatgcctctcactagtaaat

SEQ ID NO: 480605 - DNA, 20 bp, Artificial Sequence
  chemically synthesized
tttactagtgagaggcatcc

SEQ ID NO: 480606 - DNA, 20 bp, Artificial Sequence
  chemically synthesized
aaacagattaaggagaattc

SEQ ID NO: 480607 - DNA, 20 bp, Artificial Sequence
  chemically synthesized
aagtaactaaacagattaag

SEQ ID NO: 480608 - DNA, 20 bp, Artificial Sequence
  chemically synthesized
gttatttaattggaactcca

SEQ ID NO: 480609 - DNA, 20 bp, Artificial Sequence
  chemically synthesized
agaatgaacttctaattctt

SEQ ID NO: 480610 - DNA, 20 bp, Artificial Sequence
  chemically synthesized
tgtgaagaatgccaaggaaa

SEQ ID NO: 480611 - DNA, 20 bp, Artificial Sequence
  chemically synthesized
acactgtgccaggtgctgtg

SEQ ID NO: 480612 - DNA, 20 bp, Artificial Sequence
  chemically synthesized
tgctcaataaatatttttga

SEQ ID NO: 480613 - DNA, 20 bp, Artificial Sequence
  chemically synthesized
aatagggaagaaataatttt

SEQ ID NO: 480614 - DNA, 20 bp, Artificial Sequence
  chemically synthesized
atttcttccctattcatgga

SEQ ID NO: 480615 - DNA, 20 bp, Artificial Sequence
  chemically synthesized
tttctaatcatatcctctcc

SEQ ID NO: 480616 - DNA, 20 bp, Artificial Sequence
  chemically synthesized
gcaaactcagtaaaagcttg

SEQ ID NO: 480617 - DNA, 20 bp, Artificial Sequence
  chemically synthesized
tgcaattccacaagctttta

SEQ ID NO: 480618 - DNA, 20 bp, Artificial Sequence
  chemically synthesized
tgaagacattttaaaaatta

SEQ ID NO: 480619 - DNA, 20 bp, Artificial Sequence
  chemically synthesized
accactaaactttaagcttc

SEQ ID NO: 480620 - DNA, 20 bp, Artificial Sequence
  chemically synthesized
gtccttaaacaagttaaaag

SEQ ID NO: 480621 - DNA, 20 bp, Artificial Sequence
  chemically synthesized
gtgttcataataaacaattt

SEQ ID NO: 480622 - DNA, 20 bp, Artificial Sequence
  chemically synthesized
atggtcatttttttctgcac

SEQ ID NO: 480623 - DNA, 20 bp, Artificial Sequence
  chemically synthesized
tatttcttatttttttttga

SEQ ID NO: 480624 - DNA, 20 bp, Artificial Sequence
  chemically synthesized
ctgcactccagcctggatga

SEQ ID NO: 480625 - DNA, 20 bp, Artificial Sequence
  chemically synthesized
tctcactctgtcatccaggc

SEQ ID NO: 480626 - DNA, 20 bp, Artificial Sequence
  chemically synthesized
tggcacaactgcactccagc

SEQ ID NO: 480627 - DNA, 20 bp, Artificial Sequence
  chemically synthesized
ctcactgcagcctcgacttc

SEQ ID NO: 480628 - DNA, 20 bp, Artificial Sequence
  chemically synthesized
tactcgggagcctgaggtag

SEQ ID NO: 480629 - DNA, 20 bp, Artificial Sequence
  chemically synthesized
gatccttctacctcaggctc

SEQ ID NO: 480630 - DNA, 20 bp, Artificial Sequence
  chemically synthesized
atctctacaaaaaatgcaaa

SEQ ID NO: 480631 - DNA, 20 bp, Artificial Sequence
  chemically synthesized
ttttgcattttttgtagaga

SEQ ID NO: 480632 - DNA, 20 bp, Artificial Sequence
  chemically synthesized
caggcagatcacttgagtcc

SEQ ID NO: 480633 - DNA, 20 bp, Artificial Sequence
  chemically synthesized
agctgaggcaggcagatcac

SEQ ID NO: 480634 - DNA, 20 bp, Artificial Sequence
  chemically synthesized
gcctcagcttcccaaatcct

SEQ ID NO: 480635 - DNA, 20 bp, Artificial Sequence
  chemically synthesized
tggctcatgcctgtaatccc

SEQ ID NO: 480636 - DNA, 20 bp, Artificial Sequence
  chemically synthesized
gtaaggtatagaaatacact

SEQ ID NO: 480637 - DNA, 20 bp, Artificial Sequence
  chemically synthesized
ggcagatactccagtcatag

SEQ ID NO: 480638 - DNA, 20 bp, Artificial Sequence
  chemically synthesized
catatccattcatctatgac

SEQ ID NO: 480639 - DNA, 20 bp, Artificial Sequence
  chemically synthesized
gatactccagtcatagatga

SEQ ID NO: 480640 - DNA, 20 bp, Artificial Sequence
  chemically synthesized
ccagtcatagatgaatggat

SEQ ID NO: 480641 - DNA, 20 bp, Artificial Sequence
  chemically synthesized
gaatggatatgaatctactg

SEQ ID NO: 480642 - DNA, 20 bp, Artificial Sequence
  chemically synthesized
ttctttgaatgtataacctc

SEQ ID NO: 480643 - DNA, 20 bp, Artificial Sequence
  chemically synthesized
agaggttatacattcaaaga

SEQ ID NO: 480644 - DNA, 20 bp, Artificial Sequence
  chemically synthesized
ctaataataatactccttct

SEQ ID NO: 480645 - DNA, 20 bp, Artificial Sequence
  chemically synthesized
agacctcttactatatttat

SEQ ID NO: 480646 - DNA, 20 bp, Artificial Sequence
  chemically synthesized
gatattttcttgcatgatat

SEQ ID NO: 480647 - DNA, 20 bp, Artificial Sequence
  chemically synthesized
gaaaatggatctggatctgg

SEQ ID NO: 480648 - DNA, 20 bp, Artificial Sequence
  chemically synthesized
aaaaagaagggaaaatggat

SEQ ID NO: 480649 - DNA, 20 bp, Artificial Sequence
  chemically synthesized
aggtggaaaaagaagggaaa

SEQ ID NO: 480650 - DNA, 20 bp, Artificial Sequence
  chemically synthesized
ccaccttccagggggctgac

SEQ ID NO: 480651 - DNA, 20 bp, Artificial Sequence
  chemically synthesized
aacagaaaaccatagggcat

SEQ ID NO: 480652 - DNA, 20 bp, Artificial Sequence
  chemically synthesized
tatgccctatggttttctgt

SEQ ID NO: 480653 - DNA, 20 bp, Artificial Sequence
  chemically synthesized
gcaaaccactgcagagaagg

SEQ ID NO: 480654 - DNA, 20 bp, Artificial Sequence
  chemically synthesized
actgcagagaagggagagtc

SEQ ID NO: 480655 - DNA, 20 bp, Artificial Sequence
  chemically synthesized
gagaagggagagtcttgggt

SEQ ID NO: 480656 - DNA, 20 bp, Artificial Sequence
  chemically synthesized
ctcagggaaaaagagatgaa

SEQ ID NO: 480657 - DNA, 20 bp, Artificial Sequence
  chemically synthesized
ttcccttcatctctttttcc

SEQ ID NO: 480658 - DNA, 20 bp, Artificial Sequence
  chemically synthesized
cagtggctttctcttaagga

SEQ ID NO: 480659 - DNA, 20 bp, Artificial Sequence
  chemically synthesized
agctctgctgctgctagtcc

SEQ ID NO: 480660 - DNA, 20 bp, Artificial Sequence
  chemically synthesized
tccctacaccctgcccaatc

SEQ ID NO: 480661 - DNA, 20 bp, Artificial Sequence
  chemically synthesized
actacatactcaggattggg

SEQ ID NO: 480662 - DNA, 20 bp, Artificial Sequence
  chemically synthesized
tttacaaggcactacatact

SEQ ID NO: 480663 - DNA, 20 bp, Artificial Sequence
  chemically synthesized
attcagattagggtaagttg

SEQ ID NO: 480664 - DNA, 20 bp, Artificial Sequence
  chemically synthesized
actcctcaacttaccctaat

SEQ ID NO: 480665 - DNA, 20 bp, Artificial Sequence
  chemically synthesized
aacagatggcacattcagat

SEQ ID NO: 480666 - DNA, 20 bp, Artificial Sequence
  chemically synthesized
gtgttgatatctcagtcagt

SEQ ID NO: 480667 - DNA, 20 bp, Artificial Sequence
  chemically synthesized
gacacaaattcagcacttca

SEQ ID NO: 480668 - DNA, 20 bp, Artificial Sequence
  chemically synthesized
cgcaataactctgtgaagtg

SEQ ID NO: 480669 - DNA, 20 bp, Artificial Sequence
  chemically synthesized
tgacatggtctaacttgata

SEQ ID NO: 480670 - DNA, 20 bp, Artificial Sequence
  chemically synthesized
tatggtcagccatattaaca

SEQ ID NO: 480671 - DNA, 20 bp, Artificial Sequence
  chemically synthesized
tggaacagactggcggataa

SEQ ID NO: 480672 - DNA, 20 bp, Artificial Sequence
  chemically synthesized
ccacgatctggaacagactg

SEQ ID NO: 480673 - DNA, 20 bp, Artificial Sequence
  chemically synthesized
acttgtacatgttcctagtt

SEQ ID NO: 480674 - DNA, 20 bp, Artificial Sequence
  chemically synthesized
acgggaagcataaccttttt

SEQ ID NO: 480675 - DNA, 20 bp, Artificial Sequence
  chemically synthesized
ctcagccccaatcagggtaa

SEQ ID NO: 480676 - DNA, 20 bp, Artificial Sequence
  chemically synthesized
taatgtagctcagccccaat

SEQ ID NO: 480677 - DNA, 20 bp, Artificial Sequence
  chemically synthesized
cttgcaggaaattttctgtt

SEQ ID NO: 480678 - DNA, 20 bp, Artificial Sequence
  chemically synthesized
aaaacaatgatactgagaca

SEQ ID NO: 480679 - DNA, 20 bp, Artificial Sequence
  chemically synthesized
acgaaaaaaataaatacttt

SEQ ID NO: 480680 - DNA, 20 bp, Artificial Sequence
  chemically synthesized
cactgtagtatgatattttt

SEQ ID NO: 480681 - DNA, 20 bp, Artificial Sequence
  chemically synthesized
gtatattaaaataagtctgt

SEQ ID NO: 480682 - DNA, 20 bp, Artificial Sequence
  chemically synthesized
ccttttattatatatggtcc

SEQ ID NO: 480683 - DNA, 20 bp, Artificial Sequence
  chemically synthesized
tgctgcttgtttcacttctg

SEQ ID NO: 480684 - DNA, 20 bp, Artificial Sequence
  chemically synthesized
tggcagggcattgttgtaaa

SEQ ID NO: 480685 - DNA, 20 bp, Artificial Sequence
  chemically synthesized
ggtcacaaacgtgaaggtca

SEQ ID NO: 480686 - DNA, 20 bp, Artificial Sequence
  chemically synthesized
tgatggaagcaccttgcatt

SEQ ID NO: 480687 - DNA, 20 bp, Artificial Sequence
  chemically synthesized
acttgtctgcacttccaagg

SEQ ID NO: 480688 - DNA, 20 bp, Artificial Sequence
  chemically synthesized
aaaactggagaaaggagcca

SEQ ID NO: 480689 - DNA, 20 bp, Artificial Sequence
  chemically synthesized
ttttataacctgtttgtggt

SEQ ID NO: 480690 - DNA, 20 bp, Artificial Sequence
  chemically synthesized
ttagttcaaaagccaacatg

SEQ ID NO: 480691 - DNA, 20 bp, Artificial Sequence
  chemically synthesized
agccaacatgaagagtcaga

SEQ ID NO: 480692 - DNA, 20 bp, Artificial Sequence
  chemically synthesized
aggtgtgttaattttcaatt

SEQ ID NO: 480693 - DNA, 20 bp, Artificial Sequence
  chemically synthesized
acagccgttttcttcaattt

SEQ ID NO: 480694 - DNA, 20 bp, Artificial Sequence
  chemically synthesized
gatgctgcatacttcacatg

SEQ ID NO: 480695 - DNA, 20 bp, Artificial Sequence
  chemically synthesized
ggaacaaccgtcagatagga

SEQ ID NO: 480696 - DNA, 20 bp, Artificial Sequence
  chemically synthesized
tttagtataacttcaaagat

SEQ ID NO: 480697 - DNA, 20 bp, Artificial Sequence
  chemically synthesized
caggatctctctgacgatga

SEQ ID NO: 480698 - DNA, 20 bp, Artificial Sequence
  chemically synthesized
gcaacccaaggaagagaaag

SEQ ID NO: 480699 - DNA, 20 bp, Artificial Sequence
  chemically synthesized
gagatcctgctttctcttcc

SEQ ID NO: 480700 - DNA, 20 bp, Artificial Sequence
  chemically synthesized
ttctattggagacaagctca

SEQ ID NO: 480701 - DNA, 20 bp, Artificial Sequence
  chemically synthesized
agcttgtctccaatagaaga

SEQ ID NO: 480702 - DNA, 20 bp, Artificial Sequence
  chemically synthesized
tgatactactagggatgtga

SEQ ID NO: 480703 - DNA, 20 bp, Artificial Sequence
  chemically synthesized
cgtgaatgtatgatactact

SEQ ID NO: 480704 - DNA, 20 bp, Artificial Sequence
  chemically synthesized
tgtgaggccatggctggagc

SEQ ID NO: 480705 - DNA, 20 bp, Artificial Sequence
  chemically synthesized
tgtggccaagcccaaagtca

SEQ ID NO: 480706 - DNA, 20 bp, Artificial Sequence
  chemically synthesized
ttgtgctactctgtcatacc

SEQ ID NO: 480707 - DNA, 20 bp, Artificial Sequence
  chemically synthesized
atcagctactcggggtatga

SEQ ID NO: 480708 - DNA, 20 bp, Artificial Sequence
  chemically synthesized
ctgaagggacatcagctact

SEQ ID NO: 480709 - DNA, 20 bp, Artificial Sequence
  chemically synthesized
gtagctgatgtcccttcagc

SEQ ID NO: 480710 - DNA, 20 bp, Artificial Sequence
  chemically synthesized
ctctaggccgtcggttctgt

SEQ ID NO: 480711 - DNA, 20 bp, Artificial Sequence
  chemically synthesized
ttcatggagctgcagtttgg

SEQ ID NO: 480712 - DNA, 20 bp, Artificial Sequence
  chemically synthesized
ccctaccaaactgcagctcc

SEQ ID NO: 480713 - DNA, 20 bp, Artificial Sequence
  chemically synthesized
aatattgttgttattagcca

SEQ ID NO: 480714 - DNA, 20 bp, Artificial Sequence
  chemically synthesized
atacatttagtagaacttta

SEQ ID NO: 480715 - DNA, 20 bp, Artificial Sequence
  chemically synthesized
atgtatatggactttgttag

SEQ ID NO: 480716 - DNA, 20 bp, Artificial Sequence
  chemically synthesized
tccatatacataccaggtac

SEQ ID NO: 480717 - DNA, 20 bp, Artificial Sequence
  chemically synthesized
tatacataccaggtaccaga

SEQ ID NO: 480718 - DNA, 20 bp, Artificial Sequence
  chemically synthesized
tgagttatcaataattgcct

SEQ ID NO: 480719 - DNA, 20 bp, Artificial Sequence
  chemically synthesized
atcaataattgcctaggggt

SEQ ID NO: 480720 - DNA, 20 bp, Artificial Sequence
  chemically synthesized
aaacctggaaatacgaccta

SEQ ID NO: 480721 - DNA, 20 bp, Artificial Sequence
  chemically synthesized
tctggtttgcaatatttgaa

SEQ ID NO: 480722 - DNA, 20 bp, Artificial Sequence
  chemically synthesized
gctgtggtatgctaatgact

SEQ ID NO: 480723 - DNA, 20 bp, Artificial Sequence
  chemically synthesized
actgtgaattctgtggtctt

SEQ ID NO: 480724 - DNA, 20 bp, Artificial Sequence
  chemically synthesized
tggaactattccaaagacca

SEQ ID NO: 480725 - DNA, 20 bp, Artificial Sequence
  chemically synthesized
agctcaagtttaaaacaaaa

SEQ ID NO: 480726 - DNA, 20 bp, Artificial Sequence
  chemically synthesized
tctgagcaagaaagatattt

SEQ ID NO: 480727 - DNA, 20 bp, Artificial Sequence
  chemically synthesized
aaatatctttcttgctcaga

SEQ ID NO: 480728 - DNA, 20 bp, Artificial Sequence
  chemically synthesized
ctttctattacctatgtttc

SEQ ID NO: 480729 - DNA, 20 bp, Artificial Sequence
  chemically synthesized
atgtttccagagtggtaaaa

SEQ ID NO: 480730 - DNA, 20 bp, Artificial Sequence
  chemically synthesized
atatctacaggttccctcct

SEQ ID NO: 480731 - DNA, 20 bp, Artificial Sequence
  chemically synthesized
tgtaaacagaagccaccagg

SEQ ID NO: 480732 - DNA, 20 bp, Artificial Sequence
  chemically synthesized
agaatgcgaaggtcaaggag

SEQ ID NO: 480733 - DNA, 20 bp, Artificial Sequence
  chemically synthesized
ggtcaagaatgcgaaggtca

SEQ ID NO: 480734 - DNA, 20 bp, Artificial Sequence
  chemically synthesized
agcacattgcattatgggtc

SEQ ID NO: 480735 - DNA, 20 bp, Artificial Sequence
  chemically synthesized
ttgtggaagcacattgcatt

SEQ ID NO: 480736 - DNA, 20 bp, Artificial Sequence
  chemically synthesized
acttgtcagcatttcccagg

SEQ ID NO: 480737 - DNA, 20 bp, Artificial Sequence
  chemically synthesized
gacaagtacggactgtgcta

SEQ ID NO: 480738 - DNA, 20 bp, Artificial Sequence
  chemically synthesized
ccaccaacagcttatttgag

SEQ ID NO: 480739 - DNA, 20 bp, Artificial Sequence
  chemically synthesized
ttcttatgtagtctccaaat

SEQ ID NO: 480740 - DNA, 20 bp, Artificial Sequence
  chemically synthesized
ttcctaactagtaaccttgg

SEQ ID NO: 480741 - DNA, 20 bp, Artificial Sequence
  chemically synthesized
ttagcctccaatgtaaaaca

SEQ ID NO: 480742 - DNA, 20 bp, Artificial Sequence
  chemically synthesized
gttttacattggaggctaaa

SEQ ID NO: 480743 - DNA, 20 bp, Artificial Sequence
  chemically synthesized
ttttttttctcatctgataa

SEQ ID NO: 480744 - DNA, 20 bp, Artificial Sequence
  chemically synthesized
aaacaaaatcttggaaatca

SEQ ID NO: 480745 - DNA, 20 bp, Artificial Sequence
  chemically synthesized
atccagagaccatagaatca

SEQ ID NO: 480746 - DNA, 20 bp, Artificial Sequence
  chemically synthesized
actctgtgattctatggtct

SEQ ID NO: 480747 - DNA, 20 bp, Artificial Sequence
  chemically synthesized
actacagtatccagagacca

SEQ ID NO: 480748 - DNA, 20 bp, Artificial Sequence
  chemically synthesized
ggtcacatttaatgagcaag

SEQ ID NO: 480749 - DNA, 20 bp, Artificial Sequence
  chemically synthesized
aggcatttttcccattgtct

SEQ ID NO: 480750 - DNA, 20 bp, Artificial Sequence
  chemically synthesized
ttgtctaggagtcacctcaa

SEQ ID NO: 480751 - DNA, 20 bp, Artificial Sequence
  chemically synthesized
tttaagtaccaaacaggtat

SEQ ID NO: 480752 - DNA, 20 bp, Artificial Sequence
  chemically synthesized
accaaacaggtatatgaatt

SEQ ID NO: 480753 - DNA, 20 bp, Artificial Sequence
  chemically synthesized
atgaatttagaatataaaaa

SEQ ID NO: 480754 - DNA, 20 bp, Artificial Sequence
  chemically synthesized
cttctccaaagtttaaatat

SEQ ID NO: 480755 - DNA, 20 bp, Artificial Sequence
  chemically synthesized
agaagaaccatacagggaaa

SEQ ID NO: 480756 - DNA, 20 bp, Artificial Sequence
  chemically synthesized
gaaccatacagggaaaaaga

SEQ ID NO: 480757 - DNA, 20 bp, Artificial Sequence
  chemically synthesized
ttgatgataaccactgagct

SEQ ID NO: 480758 - DNA, 20 bp, Artificial Sequence
  chemically synthesized
ctcaaatgcaccttttattg

SEQ ID NO: 480759 - DNA, 20 bp, Artificial Sequence
  chemically synthesized
tcaataaaaggtgcatttga

SEQ ID NO: 480760 - DNA, 20 bp, Artificial Sequence
  chemically synthesized
tgctgttttcaattgcttaa

SEQ ID NO: 480761 - DNA, 20 bp, Artificial Sequence
  chemically synthesized
ggttagtgaaagtggtaaag

SEQ ID NO: 480762 - DNA, 20 bp, Artificial Sequence
  chemically synthesized
agtgaaagtggtaaagcaga

SEQ ID NO: 480763 - DNA, 20 bp, Artificial Sequence
  chemically synthesized
acttccttatttatggctgg

SEQ ID NO: 480764 - DNA, 20 bp, Artificial Sequence
  chemically synthesized
gccataaataaggaagtggt

SEQ ID NO: 480765 - DNA, 20 bp, Artificial Sequence
  chemically synthesized
agcagcttgtagctgtggag

SEQ ID NO: 480766 - DNA, 20 bp, Artificial Sequence
  chemically synthesized
tagcagaacatggtcagaga

SEQ ID NO: 480767 - DNA, 20 bp, Artificial Sequence
  chemically synthesized
tctcaaagtagtgggaatga

SEQ ID NO: 480768 - DNA, 20 bp, Artificial Sequence
  chemically synthesized
tgttaagatctcaaagtagt

SEQ ID NO: 480769 - DNA, 20 bp, Artificial Sequence
  chemically synthesized
tctgaacttgaagacacaga

SEQ ID NO: 480770 - DNA, 20 bp, Artificial Sequence
  chemically synthesized
catgtcttagcctgaattat

SEQ ID NO: 480771 - DNA, 20 bp, Artificial Sequence
  chemically synthesized
ttatcagcacatgtcttagc

SEQ ID NO: 480772 - DNA, 20 bp, Artificial Sequence
  chemically synthesized
tttctcatagtatttatttt

SEQ ID NO: 480773 - DNA, 20 bp, Artificial Sequence
  chemically synthesized
tgttaaaaaaaacctttttt

SEQ ID NO: 480774 - DNA, 20 bp, Artificial Sequence
  chemically synthesized
ttcatgtcctaaaaataaaa

SEQ ID NO: 480775 - DNA, 20 bp, Artificial Sequence
  chemically synthesized
ttcaattttatttttaggac

SEQ ID NO: 480776 - DNA, 20 bp, Artificial Sequence
  chemically synthesized
attttatttttaggacatga

SEQ ID NO: 480777 - DNA, 20 bp, Artificial Sequence
  chemically synthesized
gataatttgtgggcacaaaa

SEQ ID NO: 480778 - DNA, 20 bp, Artificial Sequence
  chemically synthesized
gcctgtatctcttgctctaa

SEQ ID NO: 480779 - DNA, 20 bp, Artificial Sequence
  chemically synthesized
tgaatcaattttaaatatat

SEQ ID NO: 480780 - DNA, 20 bp, Artificial Sequence
  chemically synthesized
caattttaaatatatatgaa

SEQ ID NO: 480781 - DNA, 20 bp, Artificial Sequence
  chemically synthesized
ttgagatcttaaaatgagca

SEQ ID NO: 480782 - DNA, 20 bp, Artificial Sequence
  chemically synthesized
gattagatattctctactag

SEQ ID NO: 480783 - DNA, 20 bp, Artificial Sequence
  chemically synthesized
actgctccattcaactagta

SEQ ID NO: 480784 - DNA, 20 bp, Artificial Sequence
  chemically synthesized
cattaaacaaaaacaaaaaa

SEQ ID NO: 480785 - DNA, 20 bp, Artificial Sequence
  chemically synthesized
tacaatttaagatgagattg

SEQ ID NO: 480786 - DNA, 20 bp, Artificial Sequence
  chemically synthesized
gtggggattatggaggttat

SEQ ID NO: 480787 - DNA, 20 bp, Artificial Sequence
  chemically synthesized
tggtctctcccttgacacgt

SEQ ID NO: 480788 - DNA, 20 bp, Artificial Sequence
  chemically synthesized
gagagaccaggtggaggtaa

SEQ ID NO: 480789 - DNA, 20 bp, Artificial Sequence
  chemically synthesized
ccatgctgttctcatgatag

SEQ ID NO: 480790 - DNA, 20 bp, Artificial Sequence
  chemically synthesized
tgactcacagttccacatgg

SEQ ID NO: 480791 - DNA, 20 bp, Artificial Sequence
  chemically synthesized
ctacccagccatgtggaact

SEQ ID NO: 480792 - DNA, 20 bp, Artificial Sequence
  chemically synthesized
ctataaagaactgcccgaga

SEQ ID NO: 480793 - DNA, 20 bp, Artificial Sequence
  chemically synthesized
taagcaacataagtactgaa

SEQ ID NO: 480794 - DNA, 20 bp, Artificial Sequence
  chemically synthesized
tccacctatatgatttatat

SEQ ID NO: 480795 - DNA, 20 bp, Artificial Sequence
  chemically synthesized
ttcaaatataaatcatatag

SEQ ID NO: 480796 - DNA, 20 bp, Artificial Sequence
  chemically synthesized
gataaactgatcttatgaaa

SEQ ID NO: 480797 - DNA, 20 bp, Artificial Sequence
  chemically synthesized
acgtacaatgttattgatta

SEQ ID NO: 480798 - DNA, 20 bp, Artificial Sequence
  chemically synthesized
attggtctcttaatctcaga

SEQ ID NO: 480799 - DNA, 20 bp, Artificial Sequence
  chemically synthesized
ctgagattaagagaccaatg

SEQ ID NO: 480800 - DNA, 20 bp, Artificial Sequence
  chemically synthesized
ggtgaatatattcctcttca

SEQ ID NO: 480801 - DNA, 20 bp, Artificial Sequence
  chemically synthesized
agtgcagtgatcccatgaag

SEQ ID NO: 480802 - DNA, 20 bp, Artificial Sequence
  chemically synthesized
ttgtaaaataaataaaagcc

SEQ ID NO: 480803 - DNA, 20 bp, Artificial Sequence
  chemically synthesized
aaatttctagttaatgatct

SEQ ID NO: 480804 - DNA, 20 bp, Artificial Sequence
  chemically synthesized
tttgttttatataatagttt

SEQ ID NO: 480805 - DNA, 20 bp, Artificial Sequence
  chemically synthesized
tatataccagagttcttaaa

SEQ ID NO: 480806 - DNA, 20 bp, Artificial Sequence
  chemically synthesized
tcttccagagatttatatac

SEQ ID NO: 480807 - DNA, 20 bp, Artificial Sequence
  chemically synthesized
ctgttgatcggaatttattt

SEQ ID NO: 480808 - DNA, 20 bp, Artificial Sequence
  chemically synthesized
aatgtatgcaatctgttgat

SEQ ID NO: 480809 - DNA, 20 bp, Artificial Sequence
  chemically synthesized
gtcatttcataaagatgatt

SEQ ID NO: 480810 - DNA, 20 bp, Artificial Sequence
  chemically synthesized
agcagtaggactgattaatt

SEQ ID NO: 480811 - DNA, 20 bp, Artificial Sequence
  chemically synthesized
aaatgaaatctgtcaatact

SEQ ID NO: 480812 - DNA, 20 bp, Artificial Sequence
  chemically synthesized
attcctatagaggaggagta

SEQ ID NO: 480813 - DNA, 20 bp, Artificial Sequence
  chemically synthesized
actctttactcctcctctat

SEQ ID NO: 480814 - DNA, 20 bp, Artificial Sequence
  chemically synthesized
gagtgttattcctatagagg

SEQ ID NO: 480815 - DNA, 20 bp, Artificial Sequence
  chemically synthesized
cctgctgcccgcaccacatc

SEQ ID NO: 480816 - DNA, 20 bp, Artificial Sequence
  chemically synthesized
tcataggttctcaggattag

SEQ ID NO: 480817 - DNA, 20 bp, Artificial Sequence
  chemically synthesized
cattattgttcataggttct

SEQ ID NO: 480818 - DNA, 20 bp, Artificial Sequence
  chemically synthesized
agaacctatgaacaataatg

SEQ ID NO: 480819 - DNA, 20 bp, Artificial Sequence
  chemically synthesized
gaaccaaacagaagtttgat

SEQ ID NO: 480820 - DNA, 20 bp, Artificial Sequence
  chemically synthesized
ggttcttcaagtgttctctc

SEQ ID NO: 480821 - DNA, 20 bp, Artificial Sequence
  chemically synthesized
catacctctactgaggtcta

SEQ ID NO: 480822 - DNA, 20 bp, Artificial Sequence
  chemically synthesized
cttgatgtcattgttcctag

SEQ ID NO: 480823 - DNA, 20 bp, Artificial Sequence
  chemically synthesized
cttgcagagagccaatctcc

SEQ ID NO: 480824 - DNA, 20 bp, Artificial Sequence
  chemically synthesized
gtgcattctaaaatgtcaca

SEQ ID NO: 480825 - DNA, 20 bp, Artificial Sequence
  chemically synthesized
tcaaactccttgtgacattt

SEQ ID NO: 480826 - DNA, 20 bp, Artificial Sequence
  chemically synthesized
gaatgcactgcatcttctct

SEQ ID NO: 480827 - DNA, 20 bp, Artificial Sequence
  chemically synthesized
gcggcatgaactgttgctag

SEQ ID NO: 480828 - DNA, 20 bp, Artificial Sequence
  chemically synthesized
actgttaatgtatctttaaa

SEQ ID NO: 480829 - DNA, 20 bp, Artificial Sequence
  chemically synthesized
tagtcttttcatatgtctct

SEQ ID NO: 480830 - DNA, 20 bp, Artificial Sequence
  chemically synthesized
aatttagggaaatggcacaa

SEQ ID NO: 480831 - DNA, 20 bp, Artificial Sequence
  chemically synthesized
attggtatttctttacattt

SEQ ID NO: 480832 - DNA, 20 bp, Artificial Sequence
  chemically synthesized
cagctgaagaaaaccaggca

SEQ ID NO: 480833 - DNA, 20 bp, Artificial Sequence
  chemically synthesized
aatttcttcatgtttagtcc

SEQ ID NO: 480834 - DNA, 20 bp, Artificial Sequence
  chemically synthesized
ggactaaacatgaagaaatt

SEQ ID NO: 480835 - DNA, 20 bp, Artificial Sequence
  chemically synthesized
ttttgaataattggattatt

SEQ ID NO: 480836 - DNA, 20 bp, Artificial Sequence
  chemically synthesized
tttgcatgccttttgaataa

SEQ ID NO: 480837 - DNA, 20 bp, Artificial Sequence
  chemically synthesized
taatagtttttgcatgcctt

SEQ ID NO: 480838 - DNA, 20 bp, Artificial Sequence
  chemically synthesized
cttttcacagtgtttttgtt

SEQ ID NO: 480839 - DNA, 20 bp, Artificial Sequence
  chemically synthesized
acatttaattatctagcttt

SEQ ID NO: 480840 - DNA, 20 bp, Artificial Sequence
  chemically synthesized
gaaatacttccaaaattggc

SEQ ID NO: 480841 - DNA, 20 bp, Artificial Sequence
  chemically synthesized
tattatataacaaattggaa

SEQ ID NO: 480842 - DNA, 20 bp, Artificial Sequence
  chemically synthesized
tctctaggaagacaaaccac

SEQ ID NO: 480843 - DNA, 20 bp, Artificial Sequence
  chemically synthesized
tttaacccttgtgatgataa

SEQ ID NO: 480844 - DNA, 20 bp, Artificial Sequence
  chemically synthesized
tatgattccattatcatcac

SEQ ID NO: 480845 - DNA, 20 bp, Artificial Sequence
  chemically synthesized
caggagaactgaactgatac

SEQ ID NO: 480846 - DNA, 20 bp, Artificial Sequence
  chemically synthesized
agttctcctggaaattcatg

SEQ ID NO: 480847 - DNA, 20 bp, Artificial Sequence
  chemically synthesized
gtgttttgttttaatccttc

SEQ ID NO: 480848 - DNA, 20 bp, Artificial Sequence
  chemically synthesized
ttaggcaatattttgatata

SEQ ID NO: 480849 - DNA, 20 bp, Artificial Sequence
  chemically synthesized
gcaatattttgatataagga

SEQ ID NO: 480850 - DNA, 20 bp, Artificial Sequence
  chemically synthesized
tagctattgtcacagtaatg

SEQ ID NO: 480851 - DNA, 20 bp, Artificial Sequence
  chemically synthesized
tgcaacaatcatttcttttc

SEQ ID NO: 480852 - DNA, 20 bp, Artificial Sequence
  chemically synthesized
aatcatttcttttcctggat

SEQ ID NO: 480853 - DNA, 20 bp, Artificial Sequence
  chemically synthesized
agcctagatggacgtgttct

SEQ ID NO: 480854 - DNA, 20 bp, Artificial Sequence
  chemically synthesized
atgatagcagaagcacaaac

SEQ ID NO: 480855 - DNA, 20 bp, Artificial Sequence
  chemically synthesized
ttagcaaatggtaaatgagc

SEQ ID NO: 480856 - DNA, 20 bp, Artificial Sequence
  chemically synthesized
catggccaacccctaagact

SEQ ID NO: 480857 - DNA, 20 bp, Artificial Sequence
  chemically synthesized
acttcccaacccctagtctt

SEQ ID NO: 480858 - DNA, 20 bp, Artificial Sequence
  chemically synthesized
taacaatgcctccttatgag

SEQ ID NO: 480859 - DNA, 20 bp, Artificial Sequence
  chemically synthesized
aaccttaacaatgcctcctt

SEQ ID NO: 480860 - DNA, 20 bp, Artificial Sequence
  chemically synthesized
tgcagaaggtggagaagaaa

SEQ ID NO: 480861 - DNA, 20 bp, Artificial Sequence
  chemically synthesized
gtacttacttatatctttga

SEQ ID NO: 480862 - DNA, 20 bp, Artificial Sequence
  chemically synthesized
atatctttgactgaattctt

SEQ ID NO: 480863 - DNA, 20 bp, Artificial Sequence
  chemically synthesized
gtggcaaaaattacaccctg

SEQ ID NO: 480864 - DNA, 20 bp, Artificial Sequence
  chemically synthesized
atacataacaatcatctagc

SEQ ID NO: 480865 - DNA, 20 bp, Artificial Sequence
  chemically synthesized
gctgctaaatttaagaaata

SEQ ID NO: 480866 - DNA, 20 bp, Artificial Sequence
  chemically synthesized
tttttccagattcttgtata

SEQ ID NO: 480867 - DNA, 20 bp, Artificial Sequence
  chemically synthesized
tgtcttttaattccttatac

SEQ ID NO: 480868 - DNA, 20 bp, Artificial Sequence
  chemically synthesized
ctggaggcaatcctttaaca

SEQ ID NO: 480869 - DNA, 20 bp, Artificial Sequence
  chemically synthesized
tatactcacatccgctgtta

SEQ ID NO: 480870 - DNA, 20 bp, Artificial Sequence
  chemically synthesized
gcaatcctttaacagcggat

SEQ ID NO: 480871 - DNA, 20 bp, Artificial Sequence
  chemically synthesized
tagggagcagagcatgccat

SEQ ID NO: 480872 - DNA, 20 bp, Artificial Sequence
  chemically synthesized
cagagcatgccatctgagtc

SEQ ID NO: 480873 - DNA, 20 bp, Artificial Sequence
  chemically synthesized
agtcttgtcttactcaactc

SEQ ID NO: 480874 - DNA, 20 bp, Artificial Sequence
  chemically synthesized
tcaagtaagtaactccagag

SEQ ID NO: 480875 - DNA, 20 bp, Artificial Sequence
  chemically synthesized
gctcttcaagtaagtaactc

SEQ ID NO: 480876 - DNA, 20 bp, Artificial Sequence
  chemically synthesized
ttgaagagcatatactatat

SEQ ID NO: 480877 - DNA, 20 bp, Artificial Sequence
  chemically synthesized
ataagacaacactgccccta

SEQ ID NO: 480878 - DNA, 20 bp, Artificial Sequence
  chemically synthesized
cgtgcatgcacaggtgatga

SEQ ID NO: 480879 - DNA, 20 bp, Artificial Sequence
  chemically synthesized
aagttgtaattggaaacaga

SEQ ID NO: 480880 - DNA, 20 bp, Artificial Sequence
  chemically synthesized
tggaacaccaccagaaaaac

SEQ ID NO: 480881 - DNA, 20 bp, Artificial Sequence
  chemically synthesized
tgtaaatagaaaagtaaaag

SEQ ID NO: 480882 - DNA, 20 bp, Artificial Sequence
  chemically synthesized
tgtgcttaaaaacctgctca

SEQ ID NO: 480883 - DNA, 20 bp, Artificial Sequence
  chemically synthesized
cttaaaaacctgctcagagg

SEQ ID NO: 480884 - DNA, 20 bp, Artificial Sequence
  chemically synthesized
atatgcaacagtgatcacac

SEQ ID NO: 480885 - DNA, 20 bp, Artificial Sequence
  chemically synthesized
gatcactgttgcatatgtta

SEQ ID NO: 480886 - DNA, 20 bp, Artificial Sequence
  chemically synthesized
atgagtttaggtaggggcag

SEQ ID NO: 480887 - DNA, 20 bp, Artificial Sequence
  chemically synthesized
taccatgtgagagtctcaaa

SEQ ID NO: 480888 - DNA, 20 bp, Artificial Sequence
  chemically synthesized
aggctatcgacctaccatgt

SEQ ID NO: 480889 - DNA, 20 bp, Artificial Sequence
  chemically synthesized
tcacatggtaggtcgatagc

SEQ ID NO: 480890 - DNA, 20 bp, Artificial Sequence
  chemically synthesized
cacatttggtgaagcaccag

SEQ ID NO: 480891 - DNA, 20 bp, Artificial Sequence
  chemically synthesized
caaaggaaagagaaatatgg

SEQ ID NO: 480892 - DNA, 20 bp, Artificial Sequence
  chemically synthesized
tttcctttgtttcactaggc

SEQ ID NO: 480893 - DNA, 20 bp, Artificial Sequence
  chemically synthesized
ccagagtagtcctctctccc

SEQ ID NO: 480894 - DNA, 20 bp, Artificial Sequence
  chemically synthesized
gacagagagagaggaatgga

SEQ ID NO: 480895 - DNA, 20 bp, Artificial Sequence
  chemically synthesized
gagagacagagagagaggaa

SEQ ID NO: 480896 - DNA, 20 bp, Artificial Sequence
  chemically synthesized
agagagagagacagagagag

SEQ ID NO: 480897 - DNA, 20 bp, Artificial Sequence
  chemically synthesized
gagaacaggaaggacagagg

SEQ ID NO: 480898 - DNA, 20 bp, Artificial Sequence
  chemically synthesized
agaagtgtgaaggagagagg

SEQ ID NO: 480899 - DNA, 20 bp, Artificial Sequence
  chemically synthesized
cacataaaatatattgactt

SEQ ID NO: 480900 - DNA, 20 bp, Artificial Sequence
  chemically synthesized
tacttatttgaacttttttc

SEQ ID NO: 480901 - DNA, 20 bp, Artificial Sequence
  chemically synthesized
acgacaacaaaaacctgttt

SEQ ID NO: 480902 - DNA, 20 bp, Artificial Sequence
  chemically synthesized
aatttgtaaaatatacctga

SEQ ID NO: 480903 - DNA, 20 bp, Artificial Sequence
  chemically synthesized
tgaaggagttgtgcctttta

SEQ ID NO: 480904 - DNA, 20 bp, Artificial Sequence
  chemically synthesized
ttacccacccctgactgatg

SEQ ID NO: 480905 - DNA, 20 bp, Artificial Sequence
  chemically synthesized
taatctattcaccatcagtc

SEQ ID NO: 480906 - DNA, 20 bp, Artificial Sequence
  chemically synthesized
ctattcaccatcagtcaggg

SEQ ID NO: 480907 - DNA, 20 bp, Artificial Sequence
  chemically synthesized
aaagtacagaagagtagtca

SEQ ID NO: 480908 - DNA, 20 bp, Artificial Sequence
  chemically synthesized
atataagataaaaagtacag

SEQ ID NO: 480909 - DNA, 20 bp, Artificial Sequence
  chemically synthesized
cttatatacagtctttcaga

SEQ ID NO: 480910 - DNA, 20 bp, Artificial Sequence
  chemically synthesized
ggttttgttttgatttgatt

SEQ ID NO: 480911 - DNA, 20 bp, Artificial Sequence
  chemically synthesized
tatgtctcagtcttgattta

SEQ ID NO: 480912 - DNA, 20 bp, Artificial Sequence
  chemically synthesized
taatccaattataatactgg

SEQ ID NO: 480913 - DNA, 20 bp, Artificial Sequence
  chemically synthesized
aaattcagccagtattataa

SEQ ID NO: 480914 - DNA, 20 bp, Artificial Sequence
  chemically synthesized
attataattggattaagtta

SEQ ID NO: 480915 - DNA, 20 bp, Artificial Sequence
  chemically synthesized
taaaaatttcttttttcagg

SEQ ID NO: 480916 - DNA, 20 bp, Artificial Sequence
  chemically synthesized
atatgaccaaattacaatat

SEQ ID NO: 480917 - DNA, 20 bp, Artificial Sequence
  chemically synthesized
ctaagatataatttaatgtc

SEQ ID NO: 480918 - DNA, 20 bp, Artificial Sequence
  chemically synthesized
aatttaatgtcatgagtcat

SEQ ID NO: 480919 - DNA, 20 bp, Artificial Sequence
  chemically synthesized
tgtatcttcaaaacagtggg

SEQ ID NO: 480920 - DNA, 20 bp, Artificial Sequence
  chemically synthesized
tctccagtggctagccaatc

SEQ ID NO: 480921 - DNA, 20 bp, Artificial Sequence
  chemically synthesized
attggctagccactggagat

SEQ ID NO: 480922 - DNA, 20 bp, Artificial Sequence
  chemically synthesized
acagagtctctgtgcttttg

SEQ ID NO: 480923 - DNA, 20 bp, Artificial Sequence
  chemically synthesized
agcacagagactctgtcttg

SEQ ID NO: 480924 - DNA, 20 bp, Artificial Sequence
  chemically synthesized
aaaaaaatgattctgcaaga

SEQ ID NO: 480925 - DNA, 20 bp, Artificial Sequence
  chemically synthesized
agctctctggggatgggtcg

SEQ ID NO: 480926 - DNA, 20 bp, Artificial Sequence
  chemically synthesized
gtgtcagaagctctctgggg

SEQ ID NO: 480927 - DNA, 20 bp, Artificial Sequence
  chemically synthesized
cattgtgtcagaagctctct

SEQ ID NO: 480928 - DNA, 20 bp, Artificial Sequence
  chemically synthesized
ggttgatcttctgaaaaatg

SEQ ID NO: 480929 - DNA, 20 bp, Artificial Sequence
  chemically synthesized
tccaacagcactgacttccc

SEQ ID NO: 480930 - DNA, 20 bp, Artificial Sequence
  chemically synthesized
cttattttaagtcaagaagt

SEQ ID NO: 480931 - DNA, 20 bp, Artificial Sequence
  chemically synthesized
tagaagtattaaggtattta

SEQ ID NO: 480932 - DNA, 20 bp, Artificial Sequence
  chemically synthesized
acttctattaaaaaaagttt

SEQ ID NO: 480933 - DNA, 20 bp, Artificial Sequence
  chemically synthesized
tgaagaagctgtgccttttt

SEQ ID NO: 480934 - DNA, 20 bp, Artificial Sequence
  chemically synthesized
ctttttaaggatacttaaaa

SEQ ID NO: 480935 - DNA, 20 bp, Artificial Sequence
  chemically synthesized
ttaatcatttctttttgatt

SEQ ID NO: 480936 - DNA, 20 bp, Artificial Sequence
  chemically synthesized
atttgggatcttgaccatgc

SEQ ID NO: 480937 - DNA, 20 bp, Artificial Sequence
  chemically synthesized
cccaggaactggaggaagca

SEQ ID NO: 480938 - DNA, 20 bp, Artificial Sequence
  chemically synthesized
ttcactgcttcctccagttc

SEQ ID NO: 480939 - DNA, 20 bp, Artificial Sequence
  chemically synthesized
tcctccagttcctgggttca

SEQ ID NO: 480940 - DNA, 20 bp, Artificial Sequence
  chemically synthesized
cacactggaggctgaggcag

SEQ ID NO: 480941 - DNA, 20 bp, Artificial Sequence
  chemically synthesized
ctcccacacccagttaattt

SEQ ID NO: 480942 - DNA, 20 bp, Artificial Sequence
  chemically synthesized
acaaagaattcaaaaattaa

SEQ ID NO: 480943 - DNA, 20 bp, Artificial Sequence
  chemically synthesized
ggcaaggccccatctctaca

SEQ ID NO: 480944 - DNA, 20 bp, Artificial Sequence
  chemically synthesized
caggaggatcacttgagctc

SEQ ID NO: 480945 - DNA, 20 bp, Artificial Sequence
  chemically synthesized
actgtgggaggctaaagcag

SEQ ID NO: 480946 - DNA, 20 bp, Artificial Sequence
  chemically synthesized
gctttagcctcccacagttc

SEQ ID NO: 480947 - DNA, 20 bp, Artificial Sequence
  chemically synthesized
aggctaaatggccaggcatt

SEQ ID NO: 480948 - DNA, 20 bp, Artificial Sequence
  chemically synthesized
ttagcctttaaatttttttt

SEQ ID NO: 480949 - DNA, 20 bp, Artificial Sequence
  chemically synthesized
atagtaggtgcatatattta

SEQ ID NO: 480950 - DNA, 20 bp, Artificial Sequence
  chemically synthesized
acaatgtgtaataatcacat

SEQ ID NO: 480951 - DNA, 20 bp, Artificial Sequence
  chemically synthesized
taataatcacatcaggataa

SEQ ID NO: 480952 - DNA, 20 bp, Artificial Sequence
  chemically synthesized
gaccatttttaagtatacag

SEQ ID NO: 480953 - DNA, 20 bp, Artificial Sequence
  chemically synthesized
ccatcaccactatccatctc

SEQ ID NO: 480954 - DNA, 20 bp, Artificial Sequence
  chemically synthesized
atgatgaaaacattctagag

SEQ ID NO: 480955 - DNA, 20 bp, Artificial Sequence
  chemically synthesized
tgagtacctgagtttcagtt

SEQ ID NO: 480956 - DNA, 20 bp, Artificial Sequence
  chemically synthesized
gcttattgtttaatgagtac

SEQ ID NO: 480957 - DNA, 20 bp, Artificial Sequence
  chemically synthesized
gaatgagggcttattgttta

SEQ ID NO: 480958 - DNA, 20 bp, Artificial Sequence
  chemically synthesized
accaggagctggaggaagaa

SEQ ID NO: 480959 - DNA, 20 bp, Artificial Sequence
  chemically synthesized
tttatacagacgtaaagttg

SEQ ID NO: 480960 - DNA, 20 bp, Artificial Sequence
  chemically synthesized
ttgtaggtagctcataccag

SEQ ID NO: 480961 - DNA, 20 bp, Artificial Sequence
  chemically synthesized
caaaagatgagctaatatgg

SEQ ID NO: 480962 - DNA, 20 bp, Artificial Sequence
  chemically synthesized
aaatcaaaagatgagctaat

SEQ ID NO: 480963 - DNA, 20 bp, Artificial Sequence
  chemically synthesized
ttagctcatcttttgatttg

SEQ ID NO: 480964 - DNA, 20 bp, Artificial Sequence
  chemically synthesized
catcttgaacaagaagttaa

SEQ ID NO: 480965 - DNA, 20 bp, Artificial Sequence
  chemically synthesized
atgttctggctctttaagaa

SEQ ID NO: 480966 - DNA, 20 bp, Artificial Sequence
  chemically synthesized
ttcacccaggaatgcccttt

SEQ ID NO: 480967 - DNA, 20 bp, Artificial Sequence
  chemically synthesized
agcattcagaaagggcattc

SEQ ID NO: 480968 - DNA, 20 bp, Artificial Sequence
  chemically synthesized
ttcagaaagggcattcctgg

SEQ ID NO: 480969 - DNA, 20 bp, Artificial Sequence
  chemically synthesized
tctgtctatttcattcaccc

SEQ ID NO: 480970 - DNA, 20 bp, Artificial Sequence
  chemically synthesized
agtgtgtaccaattaatatt

SEQ ID NO: 480971 - DNA, 20 bp, Artificial Sequence
  chemically synthesized
ccaaaggtattttaataata

SEQ ID NO: 480972 - DNA, 20 bp, Artificial Sequence
  chemically synthesized
ttaagcacgataaatacctc

SEQ ID NO: 480973 - DNA, 20 bp, Artificial Sequence
  chemically synthesized
gaagaggtagggctttggcc

SEQ ID NO: 480974 - DNA, 20 bp, Artificial Sequence
  chemically synthesized
ggtagggctttggccaagag

SEQ ID NO: 480975 - DNA, 20 bp, Artificial Sequence
  chemically synthesized
tccaggtagacaaggagaga

SEQ ID NO: 480976 - DNA, 20 bp, Artificial Sequence
  chemically synthesized
caagagaagttatctttgct

SEQ ID NO: 480977 - DNA, 20 bp, Artificial Sequence
  chemically synthesized
caaagataacttctcttgac

SEQ ID NO: 480978 - DNA, 20 bp, Artificial Sequence
  chemically synthesized
tataaatgacactgagctga

SEQ ID NO: 480979 - DNA, 20 bp, Artificial Sequence
  chemically synthesized
ttcttataaatgacactgag

SEQ ID NO: 480980 - DNA, 20 bp, Artificial Sequence
  chemically synthesized
gatacttctccatggaaagg

SEQ ID NO: 480981 - DNA, 20 bp, Artificial Sequence
  chemically synthesized
gagtttatgttctcatcccc

SEQ ID NO: 480982 - DNA, 20 bp, Artificial Sequence
  chemically synthesized
gtgacagagctctgattcaa

SEQ ID NO: 480983 - DNA, 20 bp, Artificial Sequence
  chemically synthesized
ctctgtcactgattgacaaa

SEQ ID NO: 480984 - DNA, 20 bp, Artificial Sequence
  chemically synthesized
tcaaggcctgccctaaaagc

SEQ ID NO: 480985 - DNA, 20 bp, Artificial Sequence
  chemically synthesized
agctttaatttcttgtccct

SEQ ID NO: 480986 - DNA, 20 bp, Artificial Sequence
  chemically synthesized
gctttttcacagtgtaagag

SEQ ID NO: 480987 - DNA, 20 bp, Artificial Sequence
  chemically synthesized
tttgggctttttcacagtgt

SEQ ID NO: 480988 - DNA, 20 bp, Artificial Sequence
  chemically synthesized
agcacctattttccaggcat

SEQ ID NO: 480989 - DNA, 20 bp, Artificial Sequence
  chemically synthesized
gtgagtgagccctcttggaa

SEQ ID NO: 480990 - DNA, 20 bp, Artificial Sequence
  chemically synthesized
gggtagattgcctgatgctg

SEQ ID NO: 480991 - DNA, 20 bp, Artificial Sequence
  chemically synthesized
ctgtttcagttgatatcagt

SEQ ID NO: 480992 - DNA, 20 bp, Artificial Sequence
  chemically synthesized
caactgatatcaactgaaac

SEQ ID NO: 480993 - DNA, 20 bp, Artificial Sequence
  chemically synthesized
aaaaattacttgttttgttc

SEQ ID NO: 480994 - DNA, 20 bp, Artificial Sequence
  chemically synthesized
gttatgtagcaaaagttaac

SEQ ID NO: 480995 - DNA, 20 bp, Artificial Sequence
  chemically synthesized
cttctctgatcttactcata

SEQ ID NO: 480996 - DNA, 20 bp, Artificial Sequence
  chemically synthesized
gggcaccttctgcatccctt

SEQ ID NO: 480997 - DNA, 20 bp, Artificial Sequence
  chemically synthesized
tgcagaaggtgccccttctc

SEQ ID NO: 480998 - DNA, 20 bp, Artificial Sequence
  chemically synthesized
aaggaagggctatattataa

SEQ ID NO: 480999 - DNA, 20 bp, Artificial Sequence
  chemically synthesized
accactattaattcctcttt

SEQ ID NO: 481000 - DNA, 20 bp, Artificial Sequence
  chemically synthesized
atatggaactaccccaaaag

SEQ ID NO: 481001 - DNA, 20 bp, Artificial Sequence
  chemically synthesized
taagaagagctattaagaag

SEQ ID NO: 481002 - DNA, 20 bp, Artificial Sequence
  chemically synthesized
tcttcttaaaagtcacattc

SEQ ID NO: 481003 - DNA, 20 bp, Artificial Sequence
  chemically synthesized
tgtactttttgaatggattc

SEQ ID NO: 481004 - DNA, 20 bp, Artificial Sequence
  chemically synthesized
gtggaaaatgtactttttga

SEQ ID NO: 481005 - DNA, 20 bp, Artificial Sequence
  chemically synthesized
cgtagtggaaaatgtacttt

SEQ ID NO: 481006 - DNA, 20 bp, Artificial Sequence
  chemically synthesized
caaaaagtacattttccact

SEQ ID NO: 481007 - DNA, 20 bp, Artificial Sequence
  chemically synthesized
ccactacgggtatatattgc

SEQ ID NO: 481008 - DNA, 20 bp, Artificial Sequence
  chemically synthesized
ttcaaaatttctttcaggtc

SEQ ID NO: 481009 - DNA, 20 bp, Artificial Sequence
  chemically synthesized
tttcaggtcatggatgaaag

SEQ ID NO: 481010 - DNA, 20 bp, Artificial Sequence
  chemically synthesized
tcatggatgaaagatgaatt

SEQ ID NO: 481011 - DNA, 20 bp, Artificial Sequence
  chemically synthesized
tggaaaacaagtgttcttat

SEQ ID NO: 481012 - DNA, 20 bp, Artificial Sequence
  chemically synthesized
acttgttttccactccaaaa

SEQ ID NO: 481013 - DNA, 20 bp, Artificial Sequence
  chemically synthesized
gtaaattgttgattctcttt

SEQ ID NO: 481014 - DNA, 20 bp, Artificial Sequence
  chemically synthesized
atgcagttttaaaaagtgca

SEQ ID NO: 481015 - DNA, 20 bp, Artificial Sequence
  chemically synthesized
aagctactgcaaaaactaaa

SEQ ID NO: 481016 - DNA, 20 bp, Artificial Sequence
  chemically synthesized
caaaaactaaaaaggattta

SEQ ID NO: 481017 - DNA, 20 bp, Artificial Sequence
  chemically synthesized
tttatggagtaaatcatggg

SEQ ID NO: 481018 - DNA, 20 bp, Artificial Sequence
  chemically synthesized
gaccccaaatagaatgagac

SEQ ID NO: 481019 - DNA, 20 bp, Artificial Sequence
  chemically synthesized
tatccaggtctcattctatt

SEQ ID NO: 481020 - DNA, 20 bp, Artificial Sequence
  chemically synthesized
ttcaaggctgtgaccccaaa

SEQ ID NO: 481021 - DNA, 20 bp, Artificial Sequence
  chemically synthesized
ttctatttggggtcacagcc

SEQ ID NO: 481022 - DNA, 20 bp, Artificial Sequence
  chemically synthesized
gccttgaatttaatccaata

SEQ ID NO: 481023 - DNA, 20 bp, Artificial Sequence
  chemically synthesized
cccaattcaacaattcaata

SEQ ID NO: 481024 - DNA, 20 bp, Artificial Sequence
  chemically synthesized
tttaatccaatattgaattg

SEQ ID NO: 481025 - DNA, 20 bp, Artificial Sequence
  chemically synthesized
gaattgttgaattgggagca

SEQ ID NO: 481026 - DNA, 20 bp, Artificial Sequence
  chemically synthesized
ctgaaatgctgcttcctgca

SEQ ID NO: 481027 - DNA, 20 bp, Artificial Sequence
  chemically synthesized
aactttctttgtaactccca

SEQ ID NO: 481028 - DNA, 20 bp, Artificial Sequence
  chemically synthesized
ttgcaaatatattattctct

SEQ ID NO: 481029 - DNA, 20 bp, Artificial Sequence
  chemically synthesized
tatttgcaaaggtgttggag

SEQ ID NO: 481030 - DNA, 20 bp, Artificial Sequence
  chemically synthesized
ttataataacttacaatgat

SEQ ID NO: 481031 - DNA, 20 bp, Artificial Sequence
  chemically synthesized
aagttattataatgctaata

SEQ ID NO: 481032 - DNA, 20 bp, Artificial Sequence
  chemically synthesized
caaattacttttgtttgctc

SEQ ID NO: 481033 - DNA, 20 bp, Artificial Sequence
  chemically synthesized
gatcatattagtctagatgg

SEQ ID NO: 481034 - DNA, 20 bp, Artificial Sequence
  chemically synthesized
tggttatgagagagagtttc

SEQ ID NO: 481035 - DNA, 20 bp, Artificial Sequence
  chemically synthesized
cattacgcctggttatgaga

SEQ ID NO: 481036 - DNA, 20 bp, Artificial Sequence
  chemically synthesized
tgacttcttttacctcttcg

SEQ ID NO: 481037 - DNA, 20 bp, Artificial Sequence
  chemically synthesized
aactgcaaaaggacctcatg

SEQ ID NO: 481038 - DNA, 20 bp, Artificial Sequence
  chemically synthesized
attaatctttgactaatacc

SEQ ID NO: 481039 - DNA, 20 bp, Artificial Sequence
  chemically synthesized
tacctggaatgttttattat

SEQ ID NO: 481040 - DNA, 20 bp, Artificial Sequence
  chemically synthesized
gtaaattgaggggataaaaa

SEQ ID NO: 481041 - DNA, 20 bp, Artificial Sequence
  chemically synthesized
attctcaaagtgtaaattga

SEQ ID NO: 481042 - DNA, 20 bp, Artificial Sequence
  chemically synthesized
atcccctcaatttacacttt

SEQ ID NO: 481043 - DNA, 20 bp, Artificial Sequence
  chemically synthesized
acactttgagaattttccag

SEQ ID NO: 481044 - DNA, 20 bp, Artificial Sequence
  chemically synthesized
tttgagaattttccagtagg

SEQ ID NO: 481045 - DNA, 20 bp, Artificial Sequence
  chemically synthesized
gattgttacctatcacatag

SEQ ID NO: 481046 - DNA, 20 bp, Artificial Sequence
  chemically synthesized
tctaaccttgaataattttt

SEQ ID NO: 481047 - DNA, 20 bp, Artificial Sequence
  chemically synthesized
cctcctcccttcctctaacc

SEQ ID NO: 481048 - DNA, 20 bp, Artificial Sequence
  chemically synthesized
ttgaccacagaaaaatgtca

SEQ ID NO: 481049 - DNA, 20 bp, Artificial Sequence
  chemically synthesized
tcagaacttcttctccaaac

SEQ ID NO: 481050 - DNA, 20 bp, Artificial Sequence
  chemically synthesized
agaagaagttctgaaattat

SEQ ID NO: 481051 - DNA, 20 bp, Artificial Sequence
  chemically synthesized
gtgtgatttcctgtgttact

SEQ ID NO: 481052 - DNA, 20 bp, Artificial Sequence
  chemically synthesized
gtttctttttcccaaacatc

SEQ ID NO: 481053 - DNA, 20 bp, Artificial Sequence
  chemically synthesized
ctgaaacacagtttggtaaa

SEQ ID NO: 481054 - DNA, 20 bp, Artificial Sequence
  chemically synthesized
agtataatatgtttgttatc

SEQ ID NO: 481055 - DNA, 20 bp, Artificial Sequence
  chemically synthesized
atatgtttgttatcatgaat

SEQ ID NO: 481056 - DNA, 20 bp, Artificial Sequence
  chemically synthesized
gtcttgggatataaacaagg

SEQ ID NO: 481057 - DNA, 20 bp, Artificial Sequence
  chemically synthesized
ggaaaagctctttaaagtct

SEQ ID NO: 481058 - DNA, 20 bp, Artificial Sequence
  chemically synthesized
ctttaaagagcttttccaaa

SEQ ID NO: 481059 - DNA, 20 bp, Artificial Sequence
  chemically synthesized
tgaagctttctttaaacaaa

SEQ ID NO: 481060 - DNA, 20 bp, Artificial Sequence
  chemically synthesized
tgcttgaaatattggttact

SEQ ID NO: 481061 - DNA, 20 bp, Artificial Sequence
  chemically synthesized
acttagaaagaaatagacgt

SEQ ID NO: 481062 - DNA, 20 bp, Artificial Sequence
  chemically synthesized
gtttctcacacaaatcaaat

SEQ ID NO: 481063 - DNA, 20 bp, Artificial Sequence
  chemically synthesized
cataatattagctatgttta

SEQ ID NO: 481064 - DNA, 20 bp, Artificial Sequence
  chemically synthesized
caggttgttgtgagggtgat

SEQ ID NO: 481065 - DNA, 20 bp, Artificial Sequence
  chemically synthesized
ctacctcttcaggttgttgt

SEQ ID NO: 481066 - DNA, 20 bp, Artificial Sequence
  chemically synthesized
tactgaccatagacgcattt

SEQ ID NO: 481067 - DNA, 20 bp, Artificial Sequence
  chemically synthesized
cgtctatggtcagtaagccc

SEQ ID NO: 481068 - DNA, 20 bp, Artificial Sequence
  chemically synthesized
gaactttgaagcccgactgc

SEQ ID NO: 481069 - DNA, 20 bp, Artificial Sequence
  chemically synthesized
tgcattagagagaggctggg

SEQ ID NO: 481070 - DNA, 20 bp, Artificial Sequence
  chemically synthesized
acattgcattagagagaggc

SEQ ID NO: 481071 - DNA, 20 bp, Artificial Sequence
  chemically synthesized
aagtgcagagaaatgcctat

SEQ ID NO: 481072 - DNA, 20 bp, Artificial Sequence
  chemically synthesized
cttttcaaggaaagccattt

SEQ ID NO: 481073 - DNA, 20 bp, Artificial Sequence
  chemically synthesized
ccttgaaaagtaggtaatgt

SEQ ID NO: 481074 - DNA, 20 bp, Artificial Sequence
  chemically synthesized
ggtaagcttagatgaaaaaa

SEQ ID NO: 481075 - DNA, 20 bp, Artificial Sequence
  chemically synthesized
ggctagctgttcattttagt

SEQ ID NO: 481076 - DNA, 20 bp, Artificial Sequence
  chemically synthesized
ctggctctccacaattgccc

SEQ ID NO: 481077 - DNA, 20 bp, Artificial Sequence
  chemically synthesized
aattgtggagagccaggtga

SEQ ID NO: 481078 - DNA, 20 bp, Artificial Sequence
  chemically synthesized
gagccaggtgaaggagtctg

SEQ ID NO: 481079 - DNA, 20 bp, Artificial Sequence
  chemically synthesized
tttttgacttcaaagccctt

SEQ ID NO: 481080 - DNA, 20 bp, Artificial Sequence
  chemically synthesized
caaaaaaggtgtttgaagag

SEQ ID NO: 481081 - DNA, 20 bp, Artificial Sequence
  chemically synthesized
gacacacacagtcttggaca

SEQ ID NO: 481082 - DNA, 20 bp, Artificial Sequence
  chemically synthesized
tggacaatggatatatacaa

SEQ ID NO: 481083 - DNA, 20 bp, Artificial Sequence
  chemically synthesized
agatgaaatctttgctctca

SEQ ID NO: 481084 - DNA, 20 bp, Artificial Sequence
  chemically synthesized
tttaaatggaaatctgcaag

SEQ ID NO: 481085 - DNA, 20 bp, Artificial Sequence
  chemically synthesized
gattggagccactggtgggc

SEQ ID NO: 481086 - DNA, 20 bp, Artificial Sequence
  chemically synthesized
ggagccactggtgggcagga

SEQ ID NO: 481087 - DNA, 20 bp, Artificial Sequence
  chemically synthesized
gtgggcaggaatgagtggag

SEQ ID NO: 481088 - DNA, 20 bp, Artificial Sequence
  chemically synthesized
ggaggagggtaaaaaatagt

SEQ ID NO: 481089 - DNA, 20 bp, Artificial Sequence
  chemically synthesized
gggtaaaaaatagtaagagt

SEQ ID NO: 481090 - DNA, 20 bp, Artificial Sequence
  chemically synthesized
aaaatagtaagagtgtgaat

SEQ ID NO: 481091 - DNA, 20 bp, Artificial Sequence
  chemically synthesized
aggtaaggggctagtgagaa

SEQ ID NO: 481092 - DNA, 20 bp, Artificial Sequence
  chemically synthesized
gtgagaaaggaatggtcata

SEQ ID NO: 481093 - DNA, 20 bp, Artificial Sequence
  chemically synthesized
gtcataaagaattagggagg

SEQ ID NO: 481094 - DNA, 20 bp, Artificial Sequence
  chemically synthesized
cggtaccatcttttcagtca

SEQ ID NO: 481095 - DNA, 20 bp, Artificial Sequence
  chemically synthesized
tctgactgaaaagatggtac

SEQ ID NO: 481096 - DNA, 20 bp, Artificial Sequence
  chemically synthesized
gatggtaccgggatgaacag

SEQ ID NO: 481097 - DNA, 20 bp, Artificial Sequence
  chemically synthesized
tggtataaaaaatggcctat

SEQ ID NO: 481098 - DNA, 20 bp, Artificial Sequence
  chemically synthesized
aatggcctatttgggtcata

SEQ ID NO: 481099 - DNA, 20 bp, Artificial Sequence
  chemically synthesized
ttatgtcatttgtgagacat

SEQ ID NO: 481100 - DNA, 20 bp, Artificial Sequence
  chemically synthesized
atgtgggacagacattggaa

SEQ ID NO: 481101 - DNA, 20 bp, Artificial Sequence
  chemically synthesized
gaataaaaatgttcaaatca

SEQ ID NO: 481102 - DNA, 20 bp, Artificial Sequence
  chemically synthesized
tgagattaatgaaatcagaa

SEQ ID NO: 481103 - DNA, 20 bp, Artificial Sequence
  chemically synthesized
tgaaatcagaaaagaatgca

SEQ ID NO: 481104 - DNA, 20 bp, Artificial Sequence
  chemically synthesized
cgggcgcatcacctgaggtc

SEQ ID NO: 481105 - DNA, 20 bp, Artificial Sequence
  chemically synthesized
ttttttatttttagtacaga

SEQ ID NO: 481106 - DNA, 20 bp, Artificial Sequence
  chemically synthesized
gcctcagcctcccaagtagc

SEQ ID NO: 481107 - DNA, 20 bp, Artificial Sequence
  chemically synthesized
tacttgggaggctgaggcag

SEQ ID NO: 481108 - DNA, 20 bp, Artificial Sequence
  chemically synthesized
ctcactgcaacctccacctc

SEQ ID NO: 481109 - DNA, 20 bp, Artificial Sequence
  chemically synthesized
ctcgctcttgtcccccaggc

SEQ ID NO: 481110 - DNA, 20 bp, Artificial Sequence
  chemically synthesized
tggtgaggttgtgaagaaag

SEQ ID NO: 481111 - DNA, 20 bp, Artificial Sequence
  chemically synthesized
aatgcttataccctgttggt

SEQ ID NO: 481112 - DNA, 20 bp, Artificial Sequence
  chemically synthesized
ctaatttacattcccaccaa

SEQ ID NO: 481113 - DNA, 20 bp, Artificial Sequence
  chemically synthesized
ggttgaacggtagttcagtt

SEQ ID NO: 481114 - DNA, 20 bp, Artificial Sequence
  chemically synthesized
tatacccagtaatggcattg

SEQ ID NO: 481115 - DNA, 20 bp, Artificial Sequence
  chemically synthesized
tcaacccagcaatgccatta

SEQ ID NO: 481116 - DNA, 20 bp, Artificial Sequence
  chemically synthesized
attactgggtatatacccaa

SEQ ID NO: 481117 - DNA, 20 bp, Artificial Sequence
  chemically synthesized
gtagaatgatttatattcct

SEQ ID NO: 481118 - DNA, 20 bp, Artificial Sequence
  chemically synthesized
agctgcatgtgtctttatgg

SEQ ID NO: 481119 - DNA, 20 bp, Artificial Sequence
  chemically synthesized
gattccatgtctttggtatt

SEQ ID NO: 481120 - DNA, 20 bp, Artificial Sequence
  chemically synthesized
tattcccaataccaaagaca

SEQ ID NO: 481121 - DNA, 20 bp, Artificial Sequence
  chemically synthesized
aatgtggtacatatacacca

SEQ ID NO: 481122 - DNA, 20 bp, Artificial Sequence
  chemically synthesized
aatactgtgcagccagaaaa

SEQ ID NO: 481123 - DNA, 20 bp, Artificial Sequence
  chemically synthesized
attatgttctttgcagcaac

SEQ ID NO: 481124 - DNA, 20 bp, Artificial Sequence
  chemically synthesized
tgttcctatgttatttcacc

SEQ ID NO: 481125 - DNA, 20 bp, Artificial Sequence
  chemically synthesized
gtttagctccacttataagt

SEQ ID NO: 481126 - DNA, 20 bp, Artificial Sequence
  chemically synthesized
cttataagtggagctaaaca

SEQ ID NO: 481127 - DNA, 20 bp, Artificial Sequence
  chemically synthesized
aagaagggaacaacagaaac

SEQ ID NO: 481128 - DNA, 20 bp, Artificial Sequence
  chemically synthesized
acagaaaccaggatctactc

SEQ ID NO: 481129 - DNA, 20 bp, Artificial Sequence
  chemically synthesized
ccaggatctactctagggtg

SEQ ID NO: 481130 - DNA, 20 bp, Artificial Sequence
  chemically synthesized
catcctcccaccctccaccc

SEQ ID NO: 481131 - DNA, 20 bp, Artificial Sequence
  chemically synthesized
tactctagggtggagggtgg

SEQ ID NO: 481132 - DNA, 20 bp, Artificial Sequence
  chemically synthesized
tcaggtaccatgcttattat

SEQ ID NO: 481133 - DNA, 20 bp, Artificial Sequence
  chemically synthesized
atgggtaaattgcatgtcat

SEQ ID NO: 481134 - DNA, 20 bp, Artificial Sequence
  chemically synthesized
cacatgtgcaggtttgttac

SEQ ID NO: 481135 - DNA, 20 bp, Artificial Sequence
  chemically synthesized
aaaagaagaaagaaagagga

SEQ ID NO: 481136 - DNA, 20 bp, Artificial Sequence
  chemically synthesized
gaagaaagaaagaggaagga

SEQ ID NO: 481137 - DNA, 20 bp, Artificial Sequence
  chemically synthesized
tgtctcaccttttgacttgc

SEQ ID NO: 481138 - DNA, 20 bp, Artificial Sequence
  chemically synthesized
gtgagcagtaataacaaaat

SEQ ID NO: 481139 - DNA, 20 bp, Artificial Sequence
  chemically synthesized
ctttaaaatgtaaaggaaag

SEQ ID NO: 481140 - DNA, 20 bp, Artificial Sequence
  chemically synthesized
tttccactaatttctattag

SEQ ID NO: 481141 - DNA, 20 bp, Artificial Sequence
  chemically synthesized
gaagcttgcttttggtgatc

SEQ ID NO: 481142 - DNA, 20 bp, Artificial Sequence
  chemically synthesized
ttgggtctttccctgtaatg

SEQ ID NO: 481143 - DNA, 20 bp, Artificial Sequence
  chemically synthesized
cctgtaatgctgagtcaatg

SEQ ID NO: 481144 - DNA, 20 bp, Artificial Sequence
  chemically synthesized
tgctgagtcaatgtagagta

SEQ ID NO: 481145 - DNA, 20 bp, Artificial Sequence
  chemically synthesized
tagagtaatgggtaggacag

SEQ ID NO: 481146 - DNA, 20 bp, Artificial Sequence
  chemically synthesized
atgctgacttttctatatat

SEQ ID NO: 481147 - DNA, 20 bp, Artificial Sequence
  chemically synthesized
tcagatttgggatgctcaac

SEQ ID NO: 481148 - DNA, 20 bp, Artificial Sequence
  chemically synthesized
ggattttggattttcagatt

SEQ ID NO: 481149 - DNA, 20 bp, Artificial Sequence
  chemically synthesized
cttttagagttttttggatt

SEQ ID NO: 481150 - DNA, 20 bp, Artificial Sequence
  chemically synthesized
ttttcagcttttagagtttt

SEQ ID NO: 481151 - DNA, 20 bp, Artificial Sequence
  chemically synthesized
gctcaaaaattttcagcttt

SEQ ID NO: 481152 - DNA, 20 bp, Artificial Sequence
  chemically synthesized
ctccaatgagcatttacttt

SEQ ID NO: 481153 - DNA, 20 bp, Artificial Sequence
  chemically synthesized
ttctcaaagtaaatgctcat

SEQ ID NO: 481154 - DNA, 20 bp, Artificial Sequence
  chemically synthesized
tcattggagtatttccaatt

SEQ ID NO: 481155 - DNA, 20 bp, Artificial Sequence
  chemically synthesized
gtatttccaattttgaattt

SEQ ID NO: 481156 - DNA, 20 bp, Artificial Sequence
  chemically synthesized
caattttgaattttggggtt

SEQ ID NO: 481157 - DNA, 20 bp, Artificial Sequence
  chemically synthesized
ggattacttgctttataatt

SEQ ID NO: 481158 - DNA, 20 bp, Artificial Sequence
  chemically synthesized
atttcagattttttcagatt

SEQ ID NO: 481159 - DNA, 20 bp, Artificial Sequence
  chemically synthesized
aaaaatctgaaatccaaaaa

SEQ ID NO: 481160 - DNA, 20 bp, Artificial Sequence
  chemically synthesized
atttttttctgattcttttt

SEQ ID NO: 481161 - DNA, 20 bp, Artificial Sequence
  chemically synthesized
cacttgggaccacaagtgtt

SEQ ID NO: 481162 - DNA, 20 bp, Artificial Sequence
  chemically synthesized
cacttgtggtcccaagtgtt

SEQ ID NO: 481163 - DNA, 20 bp, Artificial Sequence
  chemically synthesized
ggtcccaagtgttttggata

SEQ ID NO: 481164 - DNA, 20 bp, Artificial Sequence
  chemically synthesized
aggtaacacacaagtactgg

SEQ ID NO: 481165 - DNA, 20 bp, Artificial Sequence
  chemically synthesized
acagaggaaaaactgagagg

SEQ ID NO: 481166 - DNA, 20 bp, Artificial Sequence
  chemically synthesized
tgtatttttcaattattaag

SEQ ID NO: 481167 - DNA, 20 bp, Artificial Sequence
  chemically synthesized
acaataaatgtttacttttc

SEQ ID NO: 481168 - DNA, 20 bp, Artificial Sequence
  chemically synthesized
atataattgccctcctaact

SEQ ID NO: 481169 - DNA, 20 bp, Artificial Sequence
  chemically synthesized
tatttccattttcatttgag

SEQ ID NO: 481170 - DNA, 20 bp, Artificial Sequence
  chemically synthesized
caaatgaaaatggaaataat

SEQ ID NO: 481171 - DNA, 20 bp, Artificial Sequence
  chemically synthesized
caacatcacaggttttcact

SEQ ID NO: 481172 - DNA, 20 bp, Artificial Sequence
  chemically synthesized
caaagttatattaattaata

SEQ ID NO: 481173 - DNA, 20 bp, Artificial Sequence
  chemically synthesized
taggatgctcttaaaagtca

SEQ ID NO: 481174 - DNA, 20 bp, Artificial Sequence
  chemically synthesized
aactgaagatgtaaatctaa

SEQ ID NO: 481175 - DNA, 20 bp, Artificial Sequence
  chemically synthesized
gaaaggtccttattaatttt

SEQ ID NO: 481176 - DNA, 20 bp, Artificial Sequence
  chemically synthesized
cttttgtgaggatcttataa

SEQ ID NO: 481177 - DNA, 20 bp, Artificial Sequence
  chemically synthesized
attcctcgcagagcttttgt

SEQ ID NO: 481178 - DNA, 20 bp, Artificial Sequence
  chemically synthesized
atcctcacaaaagctctgcg

SEQ ID NO: 481179 - DNA, 20 bp, Artificial Sequence
  chemically synthesized
ataactttgtaaattaacta

SEQ ID NO: 481180 - DNA, 20 bp, Artificial Sequence
  chemically synthesized
gatacaaagtaatgactaaa

SEQ ID NO: 481181 - DNA, 20 bp, Artificial Sequence
  chemically synthesized
cattacattaaacaattatc

SEQ ID NO: 481182 - DNA, 20 bp, Artificial Sequence
  chemically synthesized
aaaacctttaaaacctactt

SEQ ID NO: 481183 - DNA, 20 bp, Artificial Sequence
  chemically synthesized
tacaattaacatgtttacgt

SEQ ID NO: 481184 - DNA, 20 bp, Artificial Sequence
  chemically synthesized
tcaccccaatttaatgcaat

SEQ ID NO: 481185 - DNA, 20 bp, Artificial Sequence
  chemically synthesized
aaactcatattgcattaaat

SEQ ID NO: 481186 - DNA, 20 bp, Artificial Sequence
  chemically synthesized
attgcattaaattggggtga

SEQ ID NO: 481187 - DNA, 20 bp, Artificial Sequence
  chemically synthesized
ttggggtgactggatgaaaa

SEQ ID NO: 481188 - DNA, 20 bp, Artificial Sequence
  chemically synthesized
aaagactgaatgcagaaaat

SEQ ID NO: 481189 - DNA, 20 bp, Artificial Sequence
  chemically synthesized
atctcctgcaggaagaaaga

SEQ ID NO: 481190 - DNA, 20 bp, Artificial Sequence
  chemically synthesized
ataattaaaagtttagaaaa

SEQ ID NO: 481191 - DNA, 20 bp, Artificial Sequence
  chemically synthesized
attattttcattatttcatt

SEQ ID NO: 481192 - DNA, 20 bp, Artificial Sequence
  chemically synthesized
ggattttctctgagatctac

SEQ ID NO: 481193 - DNA, 20 bp, Artificial Sequence
  chemically synthesized
ctctgagatctacaggaatt

SEQ ID NO: 481194 - DNA, 20 bp, Artificial Sequence
  chemically synthesized
ttattttccattttgggacc

SEQ ID NO: 481195 - DNA, 20 bp, Artificial Sequence
  chemically synthesized
tatagcaagaagacaatcat

SEQ ID NO: 481196 - DNA, 20 bp, Artificial Sequence
  chemically synthesized
agaagacaatcatgtgagtc

SEQ ID NO: 481197 - DNA, 20 bp, Artificial Sequence
  chemically synthesized
aacctctgactataatgctc

SEQ ID NO: 481198 - DNA, 20 bp, Artificial Sequence
  chemically synthesized
tctcactgaacaatagattc

SEQ ID NO: 481199 - DNA, 20 bp, Artificial Sequence
  chemically synthesized
gaacgtagcatgttctaccc

SEQ ID NO: 481200 - DNA, 20 bp, Artificial Sequence
  chemically synthesized
caattgaactggtatctatc

SEQ ID NO: 481201 - DNA, 20 bp, Artificial Sequence
  chemically synthesized
agggtagagacagtagtatt

SEQ ID NO: 481202 - DNA, 20 bp, Artificial Sequence
  chemically synthesized
gagacagtagtattgtgaat

SEQ ID NO: 481203 - DNA, 20 bp, Artificial Sequence
  chemically synthesized
agtagtattgtgaatgagga

SEQ ID NO: 481204 - DNA, 20 bp, Artificial Sequence
  chemically synthesized
ggtttttatagtatcaatat

SEQ ID NO: 481205 - DNA, 20 bp, Artificial Sequence
  chemically synthesized
gaactaattatcttattgaa

SEQ ID NO: 481206 - DNA, 20 bp, Artificial Sequence
  chemically synthesized
gaaaagagtttttcatgatc

SEQ ID NO: 481207 - DNA, 20 bp, Artificial Sequence
  chemically synthesized
ttttttttttttttttgaga

SEQ ID NO: 481208 - DNA, 20 bp, Artificial Sequence
  chemically synthesized
tctcactgtgtcacccaggc

SEQ ID NO: 481209 - DNA, 20 bp, Artificial Sequence
  chemically synthesized
tcgtgccattgcactccagc

SEQ ID NO: 481210 - DNA, 20 bp, Artificial Sequence
  chemically synthesized
tcgcttgaacgtaggaggca

SEQ ID NO: 481211 - DNA, 20 bp, Artificial Sequence
  chemically synthesized
tactcgggaggcagaggcag

SEQ ID NO: 481212 - DNA, 20 bp, Artificial Sequence
  chemically synthesized
gattctcctgcctctgcctc

SEQ ID NO: 481213 - DNA, 20 bp, Artificial Sequence
  chemically synthesized
gcctctgcctcccgagtagt

SEQ ID NO: 481214 - DNA, 20 bp, Artificial Sequence
  chemically synthesized
ttttgtatttttagtagaga

SEQ ID NO: 481215 - DNA, 20 bp, Artificial Sequence
  chemically synthesized
tgggcagatcacctgaggtc

SEQ ID NO: 481216 - DNA, 20 bp, Artificial Sequence
  chemically synthesized
acctcagcctcccaaagtgc

SEQ ID NO: 481217 - DNA, 20 bp, Artificial Sequence
  chemically synthesized
caccacgcctggcccatgat

SEQ ID NO: 481218 - DNA, 20 bp, Artificial Sequence
  chemically synthesized
aactaattgtgaaaaaggca

SEQ ID NO: 481219 - DNA, 20 bp, Artificial Sequence
  chemically synthesized
tttcacaattagtttattaa

SEQ ID NO: 481220 - DNA, 20 bp, Artificial Sequence
  chemically synthesized
gggtccctataactgtcttt

SEQ ID NO: 481221 - DNA, 20 bp, Artificial Sequence
  chemically synthesized
aaatgttacttactgtagta

SEQ ID NO: 481222 - DNA, 20 bp, Artificial Sequence
  chemically synthesized
ggtgacatttagatatattt

SEQ ID NO: 481223 - DNA, 20 bp, Artificial Sequence
  chemically synthesized
acacaaatttatgtcgttat

SEQ ID NO: 481224 - DNA, 20 bp, Artificial Sequence
  chemically synthesized
tctaaggtttggaaaaagat

SEQ ID NO: 481225 - DNA, 20 bp, Artificial Sequence
  chemically synthesized
ttacctctcttgaagcagtt

SEQ ID NO: 481226 - DNA, 20 bp, Artificial Sequence
  chemically synthesized
cctcacaactgtttgccatc

SEQ ID NO: 481227 - DNA, 20 bp, Artificial Sequence
  chemically synthesized
cttcactcaatcatgagttg

SEQ ID NO: 481228 - DNA, 20 bp, Artificial Sequence
  chemically synthesized
ttgaattctgcaactcatga

SEQ ID NO: 481229 - DNA, 20 bp, Artificial Sequence
  chemically synthesized
ggtagtgtcttcactcaatc

SEQ ID NO: 481230 - DNA, 20 bp, Artificial Sequence
  chemically synthesized
atttctgtaataagccaagc

SEQ ID NO: 481231 - DNA, 20 bp, Artificial Sequence
  chemically synthesized
gtcctaactgttgtccctgc

SEQ ID NO: 481232 - DNA, 20 bp, Artificial Sequence
  chemically synthesized
ttctggtagtggttaggaga

SEQ ID NO: 481233 - DNA, 20 bp, Artificial Sequence
  chemically synthesized
atcattctggtagtggttag

SEQ ID NO: 481234 - DNA, 20 bp, Artificial Sequence
  chemically synthesized
ttcattctcctaaccactac

SEQ ID NO: 481235 - DNA, 20 bp, Artificial Sequence
  chemically synthesized
gacttaaagtgataaaagtc

SEQ ID NO: 481236 - DNA, 20 bp, Artificial Sequence
  chemically synthesized
gcttacacttactgagccct

SEQ ID NO: 481237 - DNA, 20 bp, Artificial Sequence
  chemically synthesized
tctatacaatgagtacatca

SEQ ID NO: 481238 - DNA, 20 bp, Artificial Sequence
  chemically synthesized
gtgatgtactcattgtatag

SEQ ID NO: 481239 - DNA, 20 bp, Artificial Sequence
  chemically synthesized
caattttactcttctataca

SEQ ID NO: 481240 - DNA, 20 bp, Artificial Sequence
  chemically synthesized
actagcttattgtctgacct

SEQ ID NO: 481241 - DNA, 20 bp, Artificial Sequence
  chemically synthesized
aagctagtaagtgctaaata

SEQ ID NO: 481242 - DNA, 20 bp, Artificial Sequence
  chemically synthesized
agacagcatgatgtagcagc

SEQ ID NO: 481243 - DNA, 20 bp, Artificial Sequence
  chemically synthesized
agaatctgaaggaacttggc

SEQ ID NO: 481244 - DNA, 20 bp, Artificial Sequence
  chemically synthesized
cttagtcagtgtggtagtgt

SEQ ID NO: 481245 - DNA, 20 bp, Artificial Sequence
  chemically synthesized
ctaccacactgactaagcct

SEQ ID NO: 481246 - DNA, 20 bp, Artificial Sequence
  chemically synthesized
gatatggtgtttcctctatc

SEQ ID NO: 481247 - DNA, 20 bp, Artificial Sequence
  chemically synthesized
ttaggagttatttaggttca

SEQ ID NO: 481248 - DNA, 20 bp, Artificial Sequence
  chemically synthesized
gtcaccttagaagaattgtt

SEQ ID NO: 481249 - DNA, 20 bp, Artificial Sequence
  chemically synthesized
tttagagaaagtcaccttag

SEQ ID NO: 481250 - DNA, 20 bp, Artificial Sequence
  chemically synthesized
tctcactggacaatagattc

SEQ ID NO: 481251 - DNA, 20 bp, Artificial Sequence
  chemically synthesized
gagcatagcatgtcctaccc

SEQ ID NO: 481252 - DNA, 20 bp, Artificial Sequence
  chemically synthesized
ctgcccacaatagataccaa

SEQ ID NO: 481253 - DNA, 20 bp, Artificial Sequence
  chemically synthesized
caggaaactcacctagaacg

SEQ ID NO: 481254 - DNA, 20 bp, Artificial Sequence
  chemically synthesized
gttaaaatccaccgttctag

SEQ ID NO: 481255 - DNA, 20 bp, Artificial Sequence
  chemically synthesized
aattacagtagagagctgga

SEQ ID NO: 481256 - DNA, 20 bp, Artificial Sequence
  chemically synthesized
caaaattataatagcattat

SEQ ID NO: 481257 - DNA, 20 bp, Artificial Sequence
  chemically synthesized
atgctattataattttgtct

SEQ ID NO: 481258 - DNA, 20 bp, Artificial Sequence
  chemically synthesized
aggatgtatgtcttcacctc

SEQ ID NO: 481259 - DNA, 20 bp, Artificial Sequence
  chemically synthesized
atgttaaaatacagaggctt

SEQ ID NO: 481260 - DNA, 20 bp, Artificial Sequence
  chemically synthesized
tgtctgtcggtgtggaaata

SEQ ID NO: 481261 - DNA, 20 bp, Artificial Sequence
  chemically synthesized
agtaaaatagaatagaaata

SEQ ID NO: 481262 - DNA, 20 bp, Artificial Sequence
  chemically synthesized
aatgaatgaaattagtaaaa

SEQ ID NO: 481263 - DNA, 20 bp, Artificial Sequence
  chemically synthesized
tccatatttttaagatagaa

SEQ ID NO: 481264 - DNA, 20 bp, Artificial Sequence
  chemically synthesized
ttcatttctatcttaaaaat

SEQ ID NO: 481265 - DNA, 20 bp, Artificial Sequence
  chemically synthesized
tgggttgtataatcacttta

SEQ ID NO: 481266 - DNA, 20 bp, Artificial Sequence
  chemically synthesized
aaaacagttcagtaaaagta

SEQ ID NO: 481267 - DNA, 20 bp, Artificial Sequence
  chemically synthesized
ctttcttggggcccttatga

SEQ ID NO: 481268 - DNA, 20 bp, Artificial Sequence
  chemically synthesized
ccctcaccaggccctgatct

SEQ ID NO: 481269 - DNA, 20 bp, Artificial Sequence
  chemically synthesized
tttctcacagttctggaggc

SEQ ID NO: 481270 - DNA, 20 bp, Artificial Sequence
  chemically synthesized
gggaaagaaggcttatacaa

SEQ ID NO: 481271 - DNA, 20 bp, Artificial Sequence
  chemically synthesized
ttttctttcttttttggggg

SEQ ID NO: 481272 - DNA, 20 bp, Artificial Sequence
  chemically synthesized
atgattttctttcttttttg

SEQ ID NO: 481273 - DNA, 20 bp, Artificial Sequence
  chemically synthesized
aggtgtttagcaaagatacg

SEQ ID NO: 481274 - DNA, 20 bp, Artificial Sequence
  chemically synthesized
ggcgatgaatgccttctgct

SEQ ID NO: 481275 - DNA, 20 bp, Artificial Sequence
  chemically synthesized
tatttttattttgcctggcg

SEQ ID NO: 481276 - DNA, 20 bp, Artificial Sequence
  chemically synthesized
gttgtctaaagagtgtgaaa

SEQ ID NO: 481277 - DNA, 20 bp, Artificial Sequence
  chemically synthesized
tctattttgattgttgtcta

SEQ ID NO: 481278 - DNA, 20 bp, Artificial Sequence
  chemically synthesized
tcctgttgctttagtttgaa

SEQ ID NO: 481279 - DNA, 20 bp, Artificial Sequence
  chemically synthesized
ttccttcctgttgctttagt

SEQ ID NO: 481280 - DNA, 20 bp, Artificial Sequence
  chemically synthesized
ttcaaactaaagcaacagga

SEQ ID NO: 481281 - DNA, 20 bp, Artificial Sequence
  chemically synthesized
cactaaaggtttcttctcct

SEQ ID NO: 481282 - DNA, 20 bp, Artificial Sequence
  chemically synthesized
ggtttcttctccttagaatt

SEQ ID NO: 481283 - DNA, 20 bp, Artificial Sequence
  chemically synthesized
tgagaatgcagaggcaattt

SEQ ID NO: 481284 - DNA, 20 bp, Artificial Sequence
  chemically synthesized
tcgtatttcttggactatct

SEQ ID NO: 481285 - DNA, 20 bp, Artificial Sequence
  chemically synthesized
aattagtaccttgaataaat

SEQ ID NO: 481286 - DNA, 20 bp, Artificial Sequence
  chemically synthesized
ttagtagcacaattagtacc

SEQ ID NO: 481287 - DNA, 20 bp, Artificial Sequence
  chemically synthesized
ttaattctgaagaaagaaga

SEQ ID NO: 481288 - DNA, 20 bp, Artificial Sequence
  chemically synthesized
tgcattctttcttctttctt

SEQ ID NO: 481289 - DNA, 20 bp, Artificial Sequence
  chemically synthesized
tctcaccaaaattttggcgc

SEQ ID NO: 481290 - DNA, 20 bp, Artificial Sequence
  chemically synthesized
tttaatttatttttttgaga

SEQ ID NO: 481291 - DNA, 20 bp, Artificial Sequence
  chemically synthesized
agtctgctctttcaccaggc

SEQ ID NO: 481292 - DNA, 20 bp, Artificial Sequence
  chemically synthesized
ctcactgcaacctccacctc

SEQ ID NO: 481293 - DNA, 20 bp, Artificial Sequence
  chemically synthesized
tactcaggaggctgaggcag

SEQ ID NO: 481294 - DNA, 20 bp, Artificial Sequence
  chemically synthesized
aattctcctgcctcagcctc

SEQ ID NO: 481295 - DNA, 20 bp, Artificial Sequence
  chemically synthesized
caaaaattagccgggtgtgg

SEQ ID NO: 481296 - DNA, 20 bp, Artificial Sequence
  chemically synthesized
actaaaaatacaaaaattag

SEQ ID NO: 481297 - DNA, 20 bp, Artificial Sequence
  chemically synthesized
tttgtatttttagtagagac

SEQ ID NO: 481298 - DNA, 20 bp, Artificial Sequence
  chemically synthesized
cgggggtttcaccttgtggc

SEQ ID NO: 481299 - DNA, 20 bp, Artificial Sequence
  chemically synthesized
actttgggaggcagaggcgg

SEQ ID NO: 481300 - DNA, 20 bp, Artificial Sequence
  chemically synthesized
gcctctgcctcccaaagtgc

SEQ ID NO: 481301 - DNA, 20 bp, Artificial Sequence
  chemically synthesized
tttctaatatgttattaaaa

SEQ ID NO: 481302 - DNA, 20 bp, Artificial Sequence
  chemically synthesized
ttgtacatctgagtacacct

SEQ ID NO: 481303 - DNA, 20 bp, Artificial Sequence
  chemically synthesized
ataaagtttgaattgtacat

SEQ ID NO: 481304 - DNA, 20 bp, Artificial Sequence
  chemically synthesized
agagacaagtttcataaagt

SEQ ID NO: 481305 - DNA, 20 bp, Artificial Sequence
  chemically synthesized
attataaaaattgtcttctg

SEQ ID NO: 481306 - DNA, 20 bp, Artificial Sequence
  chemically synthesized
gaagacaatttttataatgg

SEQ ID NO: 481307 - DNA, 20 bp, Artificial Sequence
  chemically synthesized
taaaacacgagattagggaa

SEQ ID NO: 481308 - DNA, 20 bp, Artificial Sequence
  chemically synthesized
gagataccttcatctgtgat

SEQ ID NO: 481309 - DNA, 20 bp, Artificial Sequence
  chemically synthesized
tgtaaagacaatgtgggggt

SEQ ID NO: 481310 - DNA, 20 bp, Artificial Sequence
  chemically synthesized
ttagcttgtaaagacaatgt

SEQ ID NO: 481311 - DNA, 20 bp, Artificial Sequence
  chemically synthesized
taatattacaatgatctctc

SEQ ID NO: 481312 - DNA, 20 bp, Artificial Sequence
  chemically synthesized
tgtctttctgaatatttcac

SEQ ID NO: 481313 - DNA, 20 bp, Artificial Sequence
  chemically synthesized
ttgtgaaatattcagaaaga

SEQ ID NO: 481314 - DNA, 20 bp, Artificial Sequence
  chemically synthesized
aatggaaagactctgtcttt

SEQ ID NO: 481315 - DNA, 20 bp, Artificial Sequence
  chemically synthesized
tccattttcagttagttacc

SEQ ID NO: 481316 - DNA, 20 bp, Artificial Sequence
  chemically synthesized
caaagtactaccataaaacc

SEQ ID NO: 481317 - DNA, 20 bp, Artificial Sequence
  chemically synthesized
ttttctgctttgggcctaag

SEQ ID NO: 481318 - DNA, 20 bp, Artificial Sequence
  chemically synthesized
ggcccaaagcagaaaatgtt

SEQ ID NO: 481319 - DNA, 20 bp, Artificial Sequence
  chemically synthesized
agaaataatccgattcaatt

SEQ ID NO: 481320 - DNA, 20 bp, Artificial Sequence
  chemically synthesized
aaactatattcgtaattgaa

SEQ ID NO: 481321 - DNA, 20 bp, Artificial Sequence
  chemically synthesized
taaaaaaactatattcgtaa

SEQ ID NO: 481322 - DNA, 20 bp, Artificial Sequence
  chemically synthesized
gaatatagtttttttattta

SEQ ID NO: 481323 - DNA, 20 bp, Artificial Sequence
  chemically synthesized
gcctttaggggtgaaagttt

SEQ ID NO: 481324 - DNA, 20 bp, Artificial Sequence
  chemically synthesized
gaacgccatacaaagccttt

SEQ ID NO: 481325 - DNA, 20 bp, Artificial Sequence
  chemically synthesized
gttatttctgatatgctaac

SEQ ID NO: 481326 - DNA, 20 bp, Artificial Sequence
  chemically synthesized
gtccttgtacttcaggataa

SEQ ID NO: 481327 - DNA, 20 bp, Artificial Sequence
  chemically synthesized
ttaccgtcgtccttgtactt

SEQ ID NO: 481328 - DNA, 20 bp, Artificial Sequence
  chemically synthesized
tcttgattttagtaaggaaa

SEQ ID NO: 481329 - DNA, 20 bp, Artificial Sequence
  chemically synthesized
aattcttctctgaaagacat

SEQ ID NO: 481330 - DNA, 20 bp, Artificial Sequence
  chemically synthesized
aattctaatgtctttcagag

SEQ ID NO: 481331 - DNA, 20 bp, Artificial Sequence
  chemically synthesized
ttaatcatgttaattccatt

SEQ ID NO: 481332 - DNA, 20 bp, Artificial Sequence
  chemically synthesized
taaagcatatacattctgaa

SEQ ID NO: 481333 - DNA, 20 bp, Artificial Sequence
  chemically synthesized
taatataaagcatatacatt

SEQ ID NO: 481334 - DNA, 20 bp, Artificial Sequence
  chemically synthesized
ttatattacatgtatgttta

SEQ ID NO: 481335 - DNA, 20 bp, Artificial Sequence
  chemically synthesized
catgtatgtttaaagaatct

SEQ ID NO: 481336 - DNA, 20 bp, Artificial Sequence
  chemically synthesized
tgaattatgattattgctga

SEQ ID NO: 481337 - DNA, 20 bp, Artificial Sequence
  chemically synthesized
ataggtagtctagcaagagc

SEQ ID NO: 481338 - DNA, 20 bp, Artificial Sequence
  chemically synthesized
gagtctccatatatagaaaa

SEQ ID NO: 481339 - DNA, 20 bp, Artificial Sequence
  chemically synthesized
aatgctagtgaatgaagaga

SEQ ID NO: 481340 - DNA, 20 bp, Artificial Sequence
  chemically synthesized
tttacttcatacaaatgcta

SEQ ID NO: 481341 - DNA, 20 bp, Artificial Sequence
  chemically synthesized
aagtaaatcatcactacttt

SEQ ID NO: 481342 - DNA, 20 bp, Artificial Sequence
  chemically synthesized
aactatgattgctatacagc

SEQ ID NO: 481343 - DNA, 20 bp, Artificial Sequence
  chemically synthesized
ttgctatacagcatgaatct

SEQ ID NO: 481344 - DNA, 20 bp, Artificial Sequence
  chemically synthesized
gaatttttattttgaacaaa

SEQ ID NO: 481345 - DNA, 20 bp, Artificial Sequence
  chemically synthesized
gtgtttgctttttttcctct

SEQ ID NO: 481346 - DNA, 20 bp, Artificial Sequence
  chemically synthesized
gcacatttcagctgattgaa

SEQ ID NO: 481347 - DNA, 20 bp, Artificial Sequence
  chemically synthesized
taatggcacatttcagctga

SEQ ID NO: 481348 - DNA, 20 bp, Artificial Sequence
  chemically synthesized
accgttttaccatgacatct

SEQ ID NO: 481349 - DNA, 20 bp, Artificial Sequence
  chemically synthesized
cctgatttttagttagatgg

SEQ ID NO: 481350 - DNA, 20 bp, Artificial Sequence
  chemically synthesized
caaccatctaactaaaaatc

SEQ ID NO: 481351 - DNA, 20 bp, Artificial Sequence
  chemically synthesized
caaggtttaaactacatttt

SEQ ID NO: 481352 - DNA, 20 bp, Artificial Sequence
  chemically synthesized
gtagtttaaaccttgggcaa

SEQ ID NO: 481353 - DNA, 20 bp, Artificial Sequence
  chemically synthesized
tctctgttttaaaataattt

SEQ ID NO: 481354 - DNA, 20 bp, Artificial Sequence
  chemically synthesized
gaggttttcagaggctctat

SEQ ID NO: 481355 - DNA, 20 bp, Artificial Sequence
  chemically synthesized
aggctctatgggagttttat

SEQ ID NO: 481356 - DNA, 20 bp, Artificial Sequence
  chemically synthesized
gggagttttatctggatttt

SEQ ID NO: 481357 - DNA, 20 bp, Artificial Sequence
  chemically synthesized
ataaatgtagtttatcactt

SEQ ID NO: 481358 - DNA, 20 bp, Artificial Sequence
  chemically synthesized
ggtagaaaaagagagagctt

SEQ ID NO: 481359 - DNA, 20 bp, Artificial Sequence
  chemically synthesized
aagctctctctttttctacc

SEQ ID NO: 481360 - DNA, 20 bp, Artificial Sequence
  chemically synthesized
gccttagctcaaagatggaa

SEQ ID NO: 481361 - DNA, 20 bp, Artificial Sequence
  chemically synthesized
ggttaagccactggacaaaa

SEQ ID NO: 481362 - DNA, 20 bp, Artificial Sequence
  chemically synthesized
aaacgaataaatacattttc

SEQ ID NO: 481363 - DNA, 20 bp, Artificial Sequence
  chemically synthesized
atacattttcttgagtaaca

SEQ ID NO: 481364 - DNA, 20 bp, Artificial Sequence
  chemically synthesized
aaatatagttaggacacatg

SEQ ID NO: 481365 - DNA, 20 bp, Artificial Sequence
  chemically synthesized
tctcaagaaactgcaagctt

SEQ ID NO: 481366 - DNA, 20 bp, Artificial Sequence
  chemically synthesized
ctaaaaaattattttatgtc

SEQ ID NO: 481367 - DNA, 20 bp, Artificial Sequence
  chemically synthesized
ataaaataattttttagtca

SEQ ID NO: 481368 - DNA, 20 bp, Artificial Sequence
  chemically synthesized
gcagattactttgaaaaata

SEQ ID NO: 481369 - DNA, 20 bp, Artificial Sequence
  chemically synthesized
ttatttacctaccatagctg

SEQ ID NO: 481370 - DNA, 20 bp, Artificial Sequence
  chemically synthesized
aaataaataaataaaaatac

SEQ ID NO: 481371 - DNA, 20 bp, Artificial Sequence
  chemically synthesized
tctcactttgtcacccaggc

SEQ ID NO: 481372 - DNA, 20 bp, Artificial Sequence
  chemically synthesized
tggcgccactgcactccagc

SEQ ID NO: 481373 - DNA, 20 bp, Artificial Sequence
  chemically synthesized
ctcactgcaacctctgcctc

SEQ ID NO: 481374 - DNA, 20 bp, Artificial Sequence
  chemically synthesized
tacttgggaggctgaggtgg

SEQ ID NO: 481375 - DNA, 20 bp, Artificial Sequence
  chemically synthesized
acctcagcctcccaagtagc

SEQ ID NO: 481376 - DNA, 20 bp, Artificial Sequence
  chemically synthesized
actaaaaatacaaaaattag

SEQ ID NO: 481377 - DNA, 20 bp, Artificial Sequence
  chemically synthesized
ttttgtatttttagtagaga

SEQ ID NO: 481378 - DNA, 20 bp, Artificial Sequence
  chemically synthesized
tgggtggatcacctgaagtc

SEQ ID NO: 481379 - DNA, 20 bp, Artificial Sequence
  chemically synthesized
actttgggaggccgaggtgg

SEQ ID NO: 481380 - DNA, 20 bp, Artificial Sequence
  chemically synthesized
cagcactttgggaggccgag

SEQ ID NO: 481381 - DNA, 20 bp, Artificial Sequence
  chemically synthesized
acctcggcctcccaaagtgc

SEQ ID NO: 481382 - DNA, 20 bp, Artificial Sequence
  chemically synthesized
tccagaattttaatagatat

SEQ ID NO: 481383 - DNA, 20 bp, Artificial Sequence
  chemically synthesized
ccacatatctattaaaattc

SEQ ID NO: 481384 - DNA, 20 bp, Artificial Sequence
  chemically synthesized
aaatgctgataaagctactc

SEQ ID NO: 481385 - DNA, 20 bp, Artificial Sequence
  chemically synthesized
cattgtctaaccatacatcg

SEQ ID NO: 481386 - DNA, 20 bp, Artificial Sequence
  chemically synthesized
atataagggcaatgcaaatg

SEQ ID NO: 481387 - DNA, 20 bp, Artificial Sequence
  chemically synthesized
atatctcccatggcttgtga

SEQ ID NO: 481388 - DNA, 20 bp, Artificial Sequence
  chemically synthesized
tttctcctccaaaatgcgtg

SEQ ID NO: 481389 - DNA, 20 bp, Artificial Sequence
  chemically synthesized
acgcattttggaggagaaag

SEQ ID NO: 481390 - DNA, 20 bp, Artificial Sequence
  chemically synthesized
aggagaaagtggggtcaaag

SEQ ID NO: 481391 - DNA, 20 bp, Artificial Sequence
  chemically synthesized
acagtggcaatgtatggctc

SEQ ID NO: 481392 - DNA, 20 bp, Artificial Sequence
  chemically synthesized
tactttgctgctctgttgca

SEQ ID NO: 481393 - DNA, 20 bp, Artificial Sequence
  chemically synthesized
tgcttattatgatttgattc

SEQ ID NO: 481394 - DNA, 20 bp, Artificial Sequence
  chemically synthesized
tattctagtttgaataattc

SEQ ID NO: 481395 - DNA, 20 bp, Artificial Sequence
  chemically synthesized
gattctggaattattcaaac

SEQ ID NO: 481396 - DNA, 20 bp, Artificial Sequence
  chemically synthesized
tatgaaaagtatattctagt

SEQ ID NO: 481397 - DNA, 20 bp, Artificial Sequence
  chemically synthesized
actagtctctcaaatacaat

SEQ ID NO: 481398 - DNA, 20 bp, Artificial Sequence
  chemically synthesized
ataattttcctgaactatta

SEQ ID NO: 481399 - DNA, 20 bp, Artificial Sequence
  chemically synthesized
ggaaaattatatcaggtatt

SEQ ID NO: 481400 - DNA, 20 bp, Artificial Sequence
  chemically synthesized
ttaagagcctccttgtacta

SEQ ID NO: 481401 - DNA, 20 bp, Artificial Sequence
  chemically synthesized
tgtttaaatgaagtcttggt

SEQ ID NO: 481402 - DNA, 20 bp, Artificial Sequence
  chemically synthesized
taaacagtgaaaacagaacg

SEQ ID NO: 481403 - DNA, 20 bp, Artificial Sequence
  chemically synthesized
tgaaaataagaatgagatgg

SEQ ID NO: 481404 - DNA, 20 bp, Artificial Sequence
  chemically synthesized
ctaacatgatctgtgaaaat

SEQ ID NO: 481405 - DNA, 20 bp, Artificial Sequence
  chemically synthesized
gttttatttagcgttgctaa

SEQ ID NO: 481406 - DNA, 20 bp, Artificial Sequence
  chemically synthesized
tttacagggaaagcatctgt

SEQ ID NO: 481407 - DNA, 20 bp, Artificial Sequence
  chemically synthesized
aattttaaaagttgacattt

SEQ ID NO: 481408 - DNA, 20 bp, Artificial Sequence
  chemically synthesized
tttgctcagagaaataactt

SEQ ID NO: 481409 - DNA, 20 bp, Artificial Sequence
  chemically synthesized
gcatgtactttttctaagac

SEQ ID NO: 481410 - DNA, 20 bp, Artificial Sequence
  chemically synthesized
tctaagacgagggtgttaag

SEQ ID NO: 481411 - DNA, 20 bp, Artificial Sequence
  chemically synthesized
cagttacaagtacaaatgct

SEQ ID NO: 481412 - DNA, 20 bp, Artificial Sequence
  chemically synthesized
aaatgctgagaattgttcaa

SEQ ID NO: 481413 - DNA, 20 bp, Artificial Sequence
  chemically synthesized
aattgttcaattggatccac

SEQ ID NO: 481414 - DNA, 20 bp, Artificial Sequence
  chemically synthesized
atttccgctttagcactctt

SEQ ID NO: 481415 - DNA, 20 bp, Artificial Sequence
  chemically synthesized
catcagctcttttactccct

SEQ ID NO: 481416 - DNA, 20 bp, Artificial Sequence
  chemically synthesized
aggctcctagaagactccaa

SEQ ID NO: 481417 - DNA, 20 bp, Artificial Sequence
  chemically synthesized
tcttctaggagcctttcctt

SEQ ID NO: 481418 - DNA, 20 bp, Artificial Sequence
  chemically synthesized
aaacaactgccaatgtccta

SEQ ID NO: 481419 - DNA, 20 bp, Artificial Sequence
  chemically synthesized
gggaactgttgcagtaatct

SEQ ID NO: 481420 - DNA, 20 bp, Artificial Sequence
  chemically synthesized
aacatttggtcctttgcagg

SEQ ID NO: 481421 - DNA, 20 bp, Artificial Sequence
  chemically synthesized
tctgaacatttggtcctttg

SEQ ID NO: 481422 - DNA, 20 bp, Artificial Sequence
  chemically synthesized
cagatgcaattattaaatat

SEQ ID NO: 481423 - DNA, 20 bp, Artificial Sequence
  chemically synthesized
cctccatctttctcttttta

SEQ ID NO: 481424 - DNA, 20 bp, Artificial Sequence
  chemically synthesized
aaattgtaatataccaacaa

SEQ ID NO: 481425 - DNA, 20 bp, Artificial Sequence
  chemically synthesized
tgtaatataccaacaatggg

SEQ ID NO: 481426 - DNA, 20 bp, Artificial Sequence
  chemically synthesized
ttgtatgggggaaggcatgc

SEQ ID NO: 481427 - DNA, 20 bp, Artificial Sequence
  chemically synthesized
atgaaacctcctctgtggag

SEQ ID NO: 481428 - DNA, 20 bp, Artificial Sequence
  chemically synthesized
caagcatggtacagggattt

SEQ ID NO: 481429 - DNA, 20 bp, Artificial Sequence
  chemically synthesized
atcaaagacaagcatggtac

SEQ ID NO: 481430 - DNA, 20 bp, Artificial Sequence
  chemically synthesized
gctgctctgaggcagaaaac

SEQ ID NO: 481431 - DNA, 20 bp, Artificial Sequence
  chemically synthesized
aagtcaagaaaatacaaacc

SEQ ID NO: 481432 - DNA, 20 bp, Artificial Sequence
  chemically synthesized
agaggaaaagacaaaaagaa

SEQ ID NO: 481433 - DNA, 20 bp, Artificial Sequence
  chemically synthesized
aaatgttatgtgtaatgaaa

SEQ ID NO: 481434 - DNA, 20 bp, Artificial Sequence
  chemically synthesized
ttatgtgtaatgaaaaagag

SEQ ID NO: 481435 - DNA, 20 bp, Artificial Sequence
  chemically synthesized
gttttaaaaactaggcagat

SEQ ID NO: 481436 - DNA, 20 bp, Artificial Sequence
  chemically synthesized
cgtaagtggtaaagaacact

SEQ ID NO: 481437 - DNA, 20 bp, Artificial Sequence
  chemically synthesized
gatattgcagatgagaaact

SEQ ID NO: 481438 - DNA, 20 bp, Artificial Sequence
  chemically synthesized
gcaatatctattgctgtgat

SEQ ID NO: 481439 - DNA, 20 bp, Artificial Sequence
  chemically synthesized
aataaaaaattcctgtgaag

SEQ ID NO: 481440 - DNA, 20 bp, Artificial Sequence
  chemically synthesized
cgtggggcactcaacttcac

SEQ ID NO: 481441 - DNA, 20 bp, Artificial Sequence
  chemically synthesized
ggtagaaggaactaatgttt

SEQ ID NO: 481442 - DNA, 20 bp, Artificial Sequence
  chemically synthesized
caggaatggggaaatgggat

SEQ ID NO: 481443 - DNA, 20 bp, Artificial Sequence
  chemically synthesized
atattacaggaatggggaaa

SEQ ID NO: 481444 - DNA, 20 bp, Artificial Sequence
  chemically synthesized
tcatctttttaaaatattac

SEQ ID NO: 481445 - DNA, 20 bp, Artificial Sequence
  chemically synthesized
ttttagagtttttgtcatga

SEQ ID NO: 481446 - DNA, 20 bp, Artificial Sequence
  chemically synthesized
caaaaatatgaatacatttt

SEQ ID NO: 481447 - DNA, 20 bp, Artificial Sequence
  chemically synthesized
atatatatatgatcaaaaat

SEQ ID NO: 481448 - DNA, 20 bp, Artificial Sequence
  chemically synthesized
atatataaaatgcatgtatt

SEQ ID NO: 481449 - DNA, 20 bp, Artificial Sequence
  chemically synthesized
tcattgcagacaaagtttac

SEQ ID NO: 481450 - DNA, 20 bp, Artificial Sequence
  chemically synthesized
aggcaaataagacatttaaa

SEQ ID NO: 481451 - DNA, 20 bp, Artificial Sequence
  chemically synthesized
attactacacaaacactttc

SEQ ID NO: 481452 - DNA, 20 bp, Artificial Sequence
  chemically synthesized
ggattaaacataagctaaaa

SEQ ID NO: 481453 - DNA, 20 bp, Artificial Sequence
  chemically synthesized
gattttaaaaaattgaacac

SEQ ID NO: 481454 - DNA, 20 bp, Artificial Sequence
  chemically synthesized
tttcagcagcaactttatca

SEQ ID NO: 481455 - DNA, 20 bp, Artificial Sequence
  chemically synthesized
tttgctgccgctggctcggc

SEQ ID NO: 481456 - DNA, 20 bp, Artificial Sequence
  chemically synthesized
ggaagagctgtttattcatc

SEQ ID NO: 481457 - DNA, 20 bp, Artificial Sequence
  chemically synthesized
cagcaaaaacctcacccatg

SEQ ID NO: 481458 - DNA, 20 bp, Artificial Sequence
  chemically synthesized
gagcacacagtcttccacag

SEQ ID NO: 481459 - DNA, 20 bp, Artificial Sequence
  chemically synthesized
gtggagtttcagtgctcata

SEQ ID NO: 481460 - DNA, 20 bp, Artificial Sequence
  chemically synthesized
tctgtctgcattaactggtg

SEQ ID NO: 481461 - DNA, 20 bp, Artificial Sequence
  chemically synthesized
ctgcattaactggtggaggg

SEQ ID NO: 481462 - DNA, 20 bp, Artificial Sequence
  chemically synthesized
ggagggtagaataggtttat

SEQ ID NO: 481463 - DNA, 20 bp, Artificial Sequence
  chemically synthesized
tgcagtattaaagtttattt

SEQ ID NO: 481464 - DNA, 20 bp, Artificial Sequence
  chemically synthesized
tgcacagctgaaaggtagtg

SEQ ID NO: 481465 - DNA, 20 bp, Artificial Sequence
  chemically synthesized
aatgcaaggagaaatatcaa

SEQ ID NO: 481466 - DNA, 20 bp, Artificial Sequence
  chemically synthesized
gtggagttgttgcagtggtt

SEQ ID NO: 481467 - DNA, 20 bp, Artificial Sequence
  chemically synthesized
agaaccactgcaacaactcc

SEQ ID NO: 481468 - DNA, 20 bp, Artificial Sequence
  chemically synthesized
aattgtagcattgagattcg

SEQ ID NO: 481469 - DNA, 20 bp, Artificial Sequence
  chemically synthesized
gtgtaactgctgacaattga

SEQ ID NO: 481470 - DNA, 20 bp, Artificial Sequence
  chemically synthesized
tccaaattttgcactggaga

SEQ ID NO: 481471 - DNA, 20 bp, Artificial Sequence
  chemically synthesized
agaaataagctgtcacattc

SEQ ID NO: 481472 - DNA, 20 bp, Artificial Sequence
  chemically synthesized
ctaaccctgcatttatattc

SEQ ID NO: 481473 - DNA, 20 bp, Artificial Sequence
  chemically synthesized
cacattccagaatataaatg

SEQ ID NO: 481474 - DNA, 20 bp, Artificial Sequence
  chemically synthesized
aatatgaaattctcccatgg

SEQ ID NO: 481475 - DNA, 20 bp, Artificial Sequence
  chemically synthesized
taagtttcactctgccatgg

SEQ ID NO: 481476 - DNA, 20 bp, Artificial Sequence
  chemically synthesized
ccatggcagagtgaaactta

SEQ ID NO: 481477 - DNA, 20 bp, Artificial Sequence
  chemically synthesized
gtaagcggcatttctagttt

SEQ ID NO: 481478 - DNA, 20 bp, Artificial Sequence
  chemically synthesized
agttactttctctggaagca

SEQ ID NO: 481479 - DNA, 20 bp, Artificial Sequence
  chemically synthesized
taactagtaaataactttcc

SEQ ID NO: 481480 - DNA, 20 bp, Artificial Sequence
  chemically synthesized
aatgcacataaatcagatga

SEQ ID NO: 481481 - DNA, 20 bp, Artificial Sequence
  chemically synthesized
caaagcagcaaacttgctgg

SEQ ID NO: 481482 - DNA, 20 bp, Artificial Sequence
  chemically synthesized
atggtttcttactgtcctga

SEQ ID NO: 481483 - DNA, 20 bp, Artificial Sequence
  chemically synthesized
ttgtcaatatttcagaccac

SEQ ID NO: 481484 - DNA, 20 bp, Artificial Sequence
  chemically synthesized
gaaatattgacaacatcagg

SEQ ID NO: 481485 - DNA, 20 bp, Artificial Sequence
  chemically synthesized
attttctgctgttattgcca

SEQ ID NO: 481486 - DNA, 20 bp, Artificial Sequence
  chemically synthesized
tgagctcctttacgtgcctc

SEQ ID NO: 481487 - DNA, 20 bp, Artificial Sequence
  chemically synthesized
ctgttgtttcctgcttgtgt

SEQ ID NO: 481488 - DNA, 20 bp, Artificial Sequence
  chemically synthesized
tacggcttcaacatttctct

SEQ ID NO: 481489 - DNA, 20 bp, Artificial Sequence
  chemically synthesized
ggaatctatgtgtgtgtacg

SEQ ID NO: 481490 - DNA, 20 bp, Artificial Sequence
  chemically synthesized
acctggcacaattaaaattt

SEQ ID NO: 481491 - DNA, 20 bp, Artificial Sequence
  chemically synthesized
taattgtgccaggtctagtc

SEQ ID NO: 481492 - DNA, 20 bp, Artificial Sequence
  chemically synthesized
tgtgccaggtctagtctaga

SEQ ID NO: 481493 - DNA, 20 bp, Artificial Sequence
  chemically synthesized
ggtctagtctagaatgagtc

SEQ ID NO: 481494 - DNA, 20 bp, Artificial Sequence
  chemically synthesized
tatgatacatttagagcatg

SEQ ID NO: 481495 - DNA, 20 bp, Artificial Sequence
  chemically synthesized
tttaaattttccggaaccat

SEQ ID NO: 481496 - DNA, 20 bp, Artificial Sequence
  chemically synthesized
gataagtaaaatgtaaaaat

SEQ ID NO: 481497 - DNA, 20 bp, Artificial Sequence
  chemically synthesized
cagaaaaaaaaccaaaggtc

SEQ ID NO: 481498 - DNA, 20 bp, Artificial Sequence
  chemically synthesized
tagtttgataacttggacaa

SEQ ID NO: 481499 - DNA, 20 bp, Artificial Sequence
  chemically synthesized
aggccctggagaaaatttgg

SEQ ID NO: 481500 - DNA, 20 bp, Artificial Sequence
  chemically synthesized
ctgtaataatgctttgcaaa

SEQ ID NO: 481501 - DNA, 20 bp, Artificial Sequence
  chemically synthesized
atttttgtgcaccataaagc

SEQ ID NO: 481502 - DNA, 20 bp, Artificial Sequence
  chemically synthesized
tatggtgcacaaaaatagct

SEQ ID NO: 481503 - DNA, 20 bp, Artificial Sequence
  chemically synthesized
aaaaatagctgagaatttga

SEQ ID NO: 481504 - DNA, 20 bp, Artificial Sequence
  chemically synthesized
gctgagaatttgatggagta

SEQ ID NO: 481505 - DNA, 20 bp, Artificial Sequence
  chemically synthesized
gtacacagtgctcttatgaa

SEQ ID NO: 481506 - DNA, 20 bp, Artificial Sequence
  chemically synthesized
gaatggtacacagtgctctt

SEQ ID NO: 481507 - DNA, 20 bp, Artificial Sequence
  chemically synthesized
gctgcccttatttacatact

SEQ ID NO: 481508 - DNA, 20 bp, Artificial Sequence
  chemically synthesized
gtagagctaggctgaggcct

SEQ ID NO: 481509 - DNA, 20 bp, Artificial Sequence
  chemically synthesized
caggcctcagcctagctcta

SEQ ID NO: 481510 - DNA, 20 bp, Artificial Sequence
  chemically synthesized
tctactgaatcagagactct

SEQ ID NO: 481511 - DNA, 20 bp, Artificial Sequence
  chemically synthesized
agcttgccggattttaccca

SEQ ID NO: 481512 - DNA, 20 bp, Artificial Sequence
  chemically synthesized
gcttgttaaaacacagcttg

SEQ ID NO: 481513 - DNA, 20 bp, Artificial Sequence
  chemically synthesized
tccaatatatgctaaagctt

SEQ ID NO: 481514 - DNA, 20 bp, Artificial Sequence
  chemically synthesized
gaagtatttcagtcctgaaa

SEQ ID NO: 481515 - DNA, 20 bp, Artificial Sequence
  chemically synthesized
ccagtagcactaccagcagc

SEQ ID NO: 481516 - DNA, 20 bp, Artificial Sequence
  chemically synthesized
gctgagtccagctctcagac

SEQ ID NO: 481517 - DNA, 20 bp, Artificial Sequence
  chemically synthesized
ggctaggcacctctctttag

SEQ ID NO: 481518 - DNA, 20 bp, Artificial Sequence
  chemically synthesized
cagcccgtctcggggacata

SEQ ID NO: 481519 - DNA, 20 bp, Artificial Sequence
  chemically synthesized
ctgcacgtattggttgatgg

SEQ ID NO: 481520 - DNA, 20 bp, Artificial Sequence
  chemically synthesized
attggttgatgggagagttg

SEQ ID NO: 481521 - DNA, 20 bp, Artificial Sequence
  chemically synthesized
gagttgtggggtataaaatc

SEQ ID NO: 481522 - DNA, 20 bp, Artificial Sequence
  chemically synthesized
ctgagttgcagcaagggacc

SEQ ID NO: 481523 - DNA, 20 bp, Artificial Sequence
  chemically synthesized
aatagcccttcagaattgtc

SEQ ID NO: 481524 - DNA, 20 bp, Artificial Sequence
  chemically synthesized
ctgaaggtagaatagccctt

SEQ ID NO: 481525 - DNA, 20 bp, Artificial Sequence
  chemically synthesized
ggatctctgaagtctgaagg

SEQ ID NO: 481526 - DNA, 20 bp, Artificial Sequence
  chemically synthesized
tccttcctagccttccccag

SEQ ID NO: 481527 - DNA, 20 bp, Artificial Sequence
  chemically synthesized
aaggctaggaaggagaggcg

SEQ ID NO: 481528 - DNA, 20 bp, Artificial Sequence
  chemically synthesized
gcggaggaaaggaaagggag

SEQ ID NO: 481529 - DNA, 20 bp, Artificial Sequence
  chemically synthesized
attttattggagagtgctct

SEQ ID NO: 481530 - DNA, 20 bp, Artificial Sequence
  chemically synthesized
agcatgaaggaattttattg

SEQ ID NO: 481531 - DNA, 20 bp, Artificial Sequence
  chemically synthesized
tgagaaagtgattagcatga

SEQ ID NO: 481532 - DNA, 20 bp, Artificial Sequence
  chemically synthesized
cttcatgctaatcactttct

SEQ ID NO: 481533 - DNA, 20 bp, Artificial Sequence
  chemically synthesized
ttctgggagaacttgacctc

SEQ ID NO: 481534 - DNA, 20 bp, Artificial Sequence
  chemically synthesized
cctgaattgtcatgctgaac

SEQ ID NO: 481535 - DNA, 20 bp, Artificial Sequence
  chemically synthesized
tctccaaagggaacaagatg

SEQ ID NO: 481536 - DNA, 20 bp, Artificial Sequence
  chemically synthesized
caggcacaattactgcatgt

SEQ ID NO: 481537 - DNA, 20 bp, Artificial Sequence
  chemically synthesized
ctcacatgcagtaattgtgc

SEQ ID NO: 481538 - DNA, 20 bp, Artificial Sequence
  chemically synthesized
cattatcatcagttacaagc

SEQ ID NO: 481539 - DNA, 20 bp, Artificial Sequence
  chemically synthesized
gcaagaatctactgaagggg

SEQ ID NO: 481540 - DNA, 20 bp, Artificial Sequence
  chemically synthesized
aacactttctttggcacgta

SEQ ID NO: 481541 - DNA, 20 bp, Artificial Sequence
  chemically synthesized
accttcatgtgcagttgtct

SEQ ID NO: 481542 - DNA, 20 bp, Artificial Sequence
  chemically synthesized
gacaactgcacatgaaggta

SEQ ID NO: 481543 - DNA, 20 bp, Artificial Sequence
  chemically synthesized
aatcaggtcttaaaaagaaa

SEQ ID NO: 481544 - DNA, 20 bp, Artificial Sequence
  chemically synthesized
gtgtgtgtgtgtggcgggag

SEQ ID NO: 481545 - DNA, 20 bp, Artificial Sequence
  chemically synthesized
ccatggtgtgtgtgtgtggc

SEQ ID NO: 481546 - DNA, 20 bp, Artificial Sequence
  chemically synthesized
acacacacaccatggtattt

SEQ ID NO: 481547 - DNA, 20 bp, Artificial Sequence
  chemically synthesized
aataaatctctaagactgca

SEQ ID NO: 481548 - DNA, 20 bp, Artificial Sequence
  chemically synthesized
atctctaagactgcattgag

SEQ ID NO: 481549 - DNA, 20 bp, Artificial Sequence
  chemically synthesized
aagggaaacttgttgctttc

SEQ ID NO: 481550 - DNA, 20 bp, Artificial Sequence
  chemically synthesized
ttcatccatatatctaatag

SEQ ID NO: 481551 - DNA, 20 bp, Artificial Sequence
  chemically synthesized
accattctactattagatat

SEQ ID NO: 481552 - DNA, 20 bp, Artificial Sequence
  chemically synthesized
tttatcggtgcattatactg

SEQ ID NO: 481553 - DNA, 20 bp, Artificial Sequence
  chemically synthesized
ggtataattacagaaacata

SEQ ID NO: 481554 - DNA, 20 bp, Artificial Sequence
  chemically synthesized
ttagcagaagactgagttct

SEQ ID NO: 481555 - DNA, 20 bp, Artificial Sequence
  chemically synthesized
aagtgttatttagcagaaga

SEQ ID NO: 481556 - DNA, 20 bp, Artificial Sequence
  chemically synthesized
actatggcctggcattgtta

SEQ ID NO: 481557 - DNA, 20 bp, Artificial Sequence
  chemically synthesized
gagtaatcacataaaatact

SEQ ID NO: 481558 - DNA, 20 bp, Artificial Sequence
  chemically synthesized
taaactaggaaggaaagatt

SEQ ID NO: 481559 - DNA, 20 bp, Artificial Sequence
  chemically synthesized
atattttaggagaaagatta

SEQ ID NO: 481560 - DNA, 20 bp, Artificial Sequence
  chemically synthesized
cagagagaccttagtagcac

SEQ ID NO: 481561 - DNA, 20 bp, Artificial Sequence
  chemically synthesized
tgagtagcggttgatatggc

SEQ ID NO: 481562 - DNA, 20 bp, Artificial Sequence
  chemically synthesized
tcaaccgctactcatagaac

SEQ ID NO: 481563 - DNA, 20 bp, Artificial Sequence
  chemically synthesized
ttcagattaactctggttct

SEQ ID NO: 481564 - DNA, 20 bp, Artificial Sequence
  chemically synthesized
ctgttatggttacaggaaat

SEQ ID NO: 481565 - DNA, 20 bp, Artificial Sequence
  chemically synthesized
ttgtacttgtgaggggaagc

SEQ ID NO: 481566 - DNA, 20 bp, Artificial Sequence
  chemically synthesized
aagctagaattttgtcacct

SEQ ID NO: 481567 - DNA, 20 bp, Artificial Sequence
  chemically synthesized
gatatacagcactttgtaga

SEQ ID NO: 481568 - DNA, 20 bp, Artificial Sequence
  chemically synthesized
tagaattgctagagattaaa

SEQ ID NO: 481569 - DNA, 20 bp, Artificial Sequence
  chemically synthesized
tcattagtgcacgttactaa

SEQ ID NO: 481570 - DNA, 20 bp, Artificial Sequence
  chemically synthesized
gcaaaagctgtcaacattgc

SEQ ID NO: 481571 - DNA, 20 bp, Artificial Sequence
  chemically synthesized
accacagagttggttttgct

SEQ ID NO: 481572 - DNA, 20 bp, Artificial Sequence
  chemically synthesized
cccaaaaacagataaaacca

SEQ ID NO: 481573 - DNA, 20 bp, Artificial Sequence
  chemically synthesized
acctagaaatatgactggag

SEQ ID NO: 481574 - DNA, 20 bp, Artificial Sequence
  chemically synthesized
gagaagggtggtggcaatga

SEQ ID NO: 481575 - DNA, 20 bp, Artificial Sequence
  chemically synthesized
tgttatgaaactgtaaggcg

SEQ ID NO: 481576 - DNA, 20 bp, Artificial Sequence
  chemically synthesized
tgcttttcatccacagcatg

SEQ ID NO: 481577 - DNA, 20 bp, Artificial Sequence
  chemically synthesized
gatctgccattcttcatgct

SEQ ID NO: 481578 - DNA, 20 bp, Artificial Sequence
  chemically synthesized
gaaaacatataaagagttat

SEQ ID NO: 481579 - DNA, 20 bp, Artificial Sequence
  chemically synthesized
aatatgtttgaaaacatata

SEQ ID NO: 481580 - DNA, 20 bp, Artificial Sequence
  chemically synthesized
tatatgttttcaaacatatt

SEQ ID NO: 481581 - DNA, 20 bp, Artificial Sequence
  chemically synthesized
gaagtgatgatagaataact

SEQ ID NO: 481582 - DNA, 20 bp, Artificial Sequence
  chemically synthesized
aatatcttatgaagtgatga

SEQ ID NO: 481583 - DNA, 20 bp, Artificial Sequence
  chemically synthesized
ctttttctatgtatactcag

SEQ ID NO: 481584 - DNA, 20 bp, Artificial Sequence
  chemically synthesized
gcagagaatgaaatatccag

SEQ ID NO: 481585 - DNA, 20 bp, Artificial Sequence
  chemically synthesized
cgagtgtaaagccattggca

SEQ ID NO: 481586 - DNA, 20 bp, Artificial Sequence
  chemically synthesized
agaattaaagataatctgta

SEQ ID NO: 481587 - DNA, 20 bp, Artificial Sequence
  chemically synthesized
gtggaaataagaatgaggtt

SEQ ID NO: 481588 - DNA, 20 bp, Artificial Sequence
  chemically synthesized
gttggtaggcatgtggaaat

SEQ ID NO: 481589 - DNA, 20 bp, Artificial Sequence
  chemically synthesized
atggatgcatggatgaatta

SEQ ID NO: 481590 - DNA, 20 bp, Artificial Sequence
  chemically synthesized
ggtacggaatggatgcatgg

SEQ ID NO: 481591 - DNA, 20 bp, Artificial Sequence
  chemically synthesized
aataggtacggaatggatgc

SEQ ID NO: 481592 - DNA, 20 bp, Artificial Sequence
  chemically synthesized
tggtacacaataggtacgga

SEQ ID NO: 481593 - DNA, 20 bp, Artificial Sequence
  chemically synthesized
atcctggtacacaataggta

SEQ ID NO: 481594 - DNA, 20 bp, Artificial Sequence
  chemically synthesized
attccgtacctattgtgtac

SEQ ID NO: 481595 - DNA, 20 bp, Artificial Sequence
  chemically synthesized
ataccaaagtccatgtatta

SEQ ID NO: 481596 - DNA, 20 bp, Artificial Sequence
  chemically synthesized
atctgtaccctctgttaaac

SEQ ID NO: 481597 - DNA, 20 bp, Artificial Sequence
  chemically synthesized
taacatattcaagtttaaca

SEQ ID NO: 481598 - DNA, 20 bp, Artificial Sequence
  chemically synthesized
cagataggtaaacatttaac

SEQ ID NO: 481599 - DNA, 20 bp, Artificial Sequence
  chemically synthesized
aattaaggctataaaccatc

SEQ ID NO: 481600 - DNA, 20 bp, Artificial Sequence
  chemically synthesized
tctccacctcttttgatgga

SEQ ID NO: 481601 - DNA, 20 bp, Artificial Sequence
  chemically synthesized
tattttgagataaagccttg

SEQ ID NO: 481602 - DNA, 20 bp, Artificial Sequence
  chemically synthesized
agcaaggctttatctcaaaa

SEQ ID NO: 481603 - DNA, 20 bp, Artificial Sequence
  chemically synthesized
ctttatctcaaaatagagtg

SEQ ID NO: 481604 - DNA, 20 bp, Artificial Sequence
  chemically synthesized
gctggagagattgattctga

SEQ ID NO: 481605 - DNA, 20 bp, Artificial Sequence
  chemically synthesized
gaacatcattacaattctct

SEQ ID NO: 481606 - DNA, 20 bp, Artificial Sequence
  chemically synthesized
acaagttaagtggcagagct

SEQ ID NO: 481607 - DNA, 20 bp, Artificial Sequence
  chemically synthesized
agttacaaaaacttcttttc

SEQ ID NO: 481608 - DNA, 20 bp, Artificial Sequence
  chemically synthesized
tgtattccaatatctgtctt

SEQ ID NO: 481609 - DNA, 20 bp, Artificial Sequence
  chemically synthesized
gtaactctgaagacagatat

SEQ ID NO: 481610 - DNA, 20 bp, Artificial Sequence
  chemically synthesized
gtacaatgaatatatcagag

SEQ ID NO: 481611 - DNA, 20 bp, Artificial Sequence
  chemically synthesized
cctttctttcttttagtaca

SEQ ID NO: 481612 - DNA, 20 bp, Artificial Sequence
  chemically synthesized
gcacaaggaagattatgtca

SEQ ID NO: 481613 - DNA, 20 bp, Artificial Sequence
  chemically synthesized
ttgtgctctaaaatgaagac

SEQ ID NO: 481614 - DNA, 20 bp, Artificial Sequence
  chemically synthesized
ttttctgttattgccatatg

SEQ ID NO: 481615 - DNA, 20 bp, Artificial Sequence
  chemically synthesized
ttctgcaatagtttgggtag

SEQ ID NO: 481616 - DNA, 20 bp, Artificial Sequence
  chemically synthesized
cagatcttttctgcaatagt

SEQ ID NO: 481617 - DNA, 20 bp, Artificial Sequence
  chemically synthesized
ccagcaaatttgcattaaaa

SEQ ID NO: 481618 - DNA, 20 bp, Artificial Sequence
  chemically synthesized
ggtttgccgttcaccaacat

SEQ ID NO: 481619 - DNA, 20 bp, Artificial Sequence
  chemically synthesized
gtaccagacctcaagagaga

SEQ ID NO: 481620 - DNA, 20 bp, Artificial Sequence
  chemically synthesized
actaaattactcaaactctc

SEQ ID NO: 481621 - DNA, 20 bp, Artificial Sequence
  chemically synthesized
tccaattaactctggagagt

SEQ ID NO: 481622 - DNA, 20 bp, Artificial Sequence
  chemically synthesized
atggtttccaattaactctg

SEQ ID NO: 481623 - DNA, 20 bp, Artificial Sequence
  chemically synthesized
tggggtgacaaaagatggga

SEQ ID NO: 481624 - DNA, 20 bp, Artificial Sequence
  chemically synthesized
tgtctggggtgacaaaagat

SEQ ID NO: 481625 - DNA, 20 bp, Artificial Sequence
  chemically synthesized
ttttgtcaccccagacacca

SEQ ID NO: 481626 - DNA, 20 bp, Artificial Sequence
  chemically synthesized
aaaagtcatcctgtggtgtc

SEQ ID NO: 481627 - DNA, 20 bp, Artificial Sequence
  chemically synthesized
aaagctgtggtttatctttg

SEQ ID NO: 481628 - DNA, 20 bp, Artificial Sequence
  chemically synthesized
acctagactttagatagtaa

SEQ ID NO: 481629 - DNA, 20 bp, Artificial Sequence
  chemically synthesized
taggcattatcaatcacgta

SEQ ID NO: 481630 - DNA, 20 bp, Artificial Sequence
  chemically synthesized
tctctcatttttttaacctt

SEQ ID NO: 481631 - DNA, 20 bp, Artificial Sequence
  chemically synthesized
tgtttttaaaatagagattt

SEQ ID NO: 481632 - DNA, 20 bp, Artificial Sequence
  chemically synthesized
tgaaatacaaatcaaatgaa

SEQ ID NO: 481633 - DNA, 20 bp, Artificial Sequence
  chemically synthesized
ctaatttttttcagtgattt

SEQ ID NO: 481634 - DNA, 20 bp, Artificial Sequence
  chemically synthesized
cacacatatttttttctttc

SEQ ID NO: 481635 - DNA, 20 bp, Artificial Sequence
  chemically synthesized
aatataaaatgcagatctta

SEQ ID NO: 481636 - DNA, 20 bp, Artificial Sequence
  chemically synthesized
agaggttgaaatataatgtt

SEQ ID NO: 481637 - DNA, 20 bp, Artificial Sequence
  chemically synthesized
gaaatataatgttgggagta

SEQ ID NO: 481638 - DNA, 20 bp, Artificial Sequence
  chemically synthesized
taaatgcccaaaaggatatt

SEQ ID NO: 481639 - DNA, 20 bp, Artificial Sequence
  chemically synthesized
acagttgtataaatgcccaa

SEQ ID NO: 481640 - DNA, 20 bp, Artificial Sequence
  chemically synthesized
tgggcatttatacaactgta

SEQ ID NO: 481641 - DNA, 20 bp, Artificial Sequence
  chemically synthesized
ttcgcattatacaaatcatt

SEQ ID NO: 481642 - DNA, 20 bp, Artificial Sequence
  chemically synthesized
ttctcaatgatttgtataat

SEQ ID NO: 481643 - DNA, 20 bp, Artificial Sequence
  chemically synthesized
cattaggaaatatatcttta

SEQ ID NO: 481644 - DNA, 20 bp, Artificial Sequence
  chemically synthesized
cagcttttcttctctcctaa

SEQ ID NO: 481645 - DNA, 20 bp, Artificial Sequence
  chemically synthesized
ttctctaagttattgtggat

SEQ ID NO: 481646 - DNA, 20 bp, Artificial Sequence
  chemically synthesized
ctgtttttctctaagttatt

SEQ ID NO: 481647 - DNA, 20 bp, Artificial Sequence
  chemically synthesized
cctgcctgctttgctgtctt

SEQ ID NO: 481648 - DNA, 20 bp, Artificial Sequence
  chemically synthesized
agccacttctttcttttaaa

SEQ ID NO: 481649 - DNA, 20 bp, Artificial Sequence
  chemically synthesized
cagatgaaataaacttatag

SEQ ID NO: 481650 - DNA, 20 bp, Artificial Sequence
  chemically synthesized
ttatagtagagtcctgtcag

SEQ ID NO: 481651 - DNA, 20 bp, Artificial Sequence
  chemically synthesized
cataaccgctgatctaaatt

SEQ ID NO: 481652 - DNA, 20 bp, Artificial Sequence
  chemically synthesized
aatatttcgatatcataatt

SEQ ID NO: 481653 - DNA, 20 bp, Artificial Sequence
  chemically synthesized
ttattaaccacaagagagta

SEQ ID NO: 481654 - DNA, 20 bp, Artificial Sequence
  chemically synthesized
atgtgtattattaaccacaa

SEQ ID NO: 481655 - DNA, 20 bp, Artificial Sequence
  chemically synthesized
agataccatcacataccagt

SEQ ID NO: 481656 - DNA, 20 bp, Artificial Sequence
  chemically synthesized
agctccatccatgatctctg

SEQ ID NO: 481657 - DNA, 20 bp, Artificial Sequence
  chemically synthesized
gtggagattcttcagagatc

SEQ ID NO: 481658 - DNA, 20 bp, Artificial Sequence
  chemically synthesized
caacagacgtggaagcctac

SEQ ID NO: 481659 - DNA, 20 bp, Artificial Sequence
  chemically synthesized
tggaagcctactggagtggg

SEQ ID NO: 481660 - DNA, 20 bp, Artificial Sequence
  chemically synthesized
ggggagggtgggaggaggga

SEQ ID NO: 481661 - DNA, 20 bp, Artificial Sequence
  chemically synthesized
atgtgtactacgcttaatac

SEQ ID NO: 481662 - DNA, 20 bp, Artificial Sequence
  chemically synthesized
gtacaacaaacccccatgac

SEQ ID NO: 481663 - DNA, 20 bp, Artificial Sequence
  chemically synthesized
tataggtaaactcatgtcat

SEQ ID NO: 481664 - DNA, 20 bp, Artificial Sequence
  chemically synthesized
aaatactataacaatacatg

SEQ ID NO: 481665 - DNA, 20 bp, Artificial Sequence
  chemically synthesized
cagttttcaagctcctttga

SEQ ID NO: 481666 - DNA, 20 bp, Artificial Sequence
  chemically synthesized
tatgaaaggaggtgctatct

SEQ ID NO: 481667 - DNA, 20 bp, Artificial Sequence
  chemically synthesized
gaacttaactttcagggaag

SEQ ID NO: 481668 - DNA, 20 bp, Artificial Sequence
  chemically synthesized
ttaactttcagggaagctgg

SEQ ID NO: 481669 - DNA, 20 bp, Artificial Sequence
  chemically synthesized
ctccctgtgaagtaaatata

SEQ ID NO: 481670 - DNA, 20 bp, Artificial Sequence
  chemically synthesized
acagaaaacaaagggctttt

SEQ ID NO: 481671 - DNA, 20 bp, Artificial Sequence
  chemically synthesized
ttgttttctgttattattat

SEQ ID NO: 481672 - DNA, 20 bp, Artificial Sequence
  chemically synthesized
tctgttattattatatgaat

SEQ ID NO: 481673 - DNA, 20 bp, Artificial Sequence
  chemically synthesized
tattatatgaattaggatta

SEQ ID NO: 481674 - DNA, 20 bp, Artificial Sequence
  chemically synthesized
cggatgaagatggtaagcaa

SEQ ID NO: 481675 - DNA, 20 bp, Artificial Sequence
  chemically synthesized
tgtaacacatctcatagatg

SEQ ID NO: 481676 - DNA, 20 bp, Artificial Sequence
  chemically synthesized
atcaaatcctcaagcttacc

SEQ ID NO: 481677 - DNA, 20 bp, Artificial Sequence
  chemically synthesized
tttgaactcgaggtaagctt

SEQ ID NO: 481678 - DNA, 20 bp, Artificial Sequence
  chemically synthesized
gaaggcattacaggcattaa

SEQ ID NO: 481679 - DNA, 20 bp, Artificial Sequence
  chemically synthesized
ataactttgtataatttcat

SEQ ID NO: 481680 - DNA, 20 bp, Artificial Sequence
  chemically synthesized
aaatgttggttaatgataca

SEQ ID NO: 481681 - DNA, 20 bp, Artificial Sequence
  chemically synthesized
gttaatgatacagagagtat

SEQ ID NO: 481682 - DNA, 20 bp, Artificial Sequence
  chemically synthesized
atctgaatgtctatgtattt

SEQ ID NO: 481683 - DNA, 20 bp, Artificial Sequence
  chemically synthesized
ttaataaaaccaactgaacg

SEQ ID NO: 481684 - DNA, 20 bp, Artificial Sequence
  chemically synthesized
ttagtttaagtagattctaa

SEQ ID NO: 481685 - DNA, 20 bp, Artificial Sequence
  chemically synthesized
aattagaagggcaattcttt

SEQ ID NO: 481686 - DNA, 20 bp, Artificial Sequence
  chemically synthesized
atgatttacaagacaagatg

SEQ ID NO: 481687 - DNA, 20 bp, Artificial Sequence
  chemically synthesized
gctttcgtacttttaattac

SEQ ID NO: 481688 - DNA, 20 bp, Artificial Sequence
  chemically synthesized
tataaagaacagtcataatt

SEQ ID NO: 481689 - DNA, 20 bp, Artificial Sequence
  chemically synthesized
aattagaagtacaacatgaa

SEQ ID NO: 481690 - DNA, 20 bp, Artificial Sequence
  chemically synthesized
agaagtacaacatgaaagga

SEQ ID NO: 481691 - DNA, 20 bp, Artificial Sequence
  chemically synthesized
aacatgaaaggaatgaatct

SEQ ID NO: 481692 - DNA, 20 bp, Artificial Sequence
  chemically synthesized
ctgagggtgcatctggtttt

SEQ ID NO: 481693 - DNA, 20 bp, Artificial Sequence
  chemically synthesized
ttttaagaatcctctgactt

SEQ ID NO: 481694 - DNA, 20 bp, Artificial Sequence
  chemically synthesized
agtggtatattcataagtca

SEQ ID NO: 481695 - DNA, 20 bp, Artificial Sequence
  chemically synthesized
aatataccacttactatagt

SEQ ID NO: 481696 - DNA, 20 bp, Artificial Sequence
  chemically synthesized
gatgaatggtgatgacgatg

SEQ ID NO: 481697 - DNA, 20 bp, Artificial Sequence
  chemically synthesized
tttacagtaagttgtggttg

SEQ ID NO: 481698 - DNA, 20 bp, Artificial Sequence
  chemically synthesized
aaattgccaggaactgtggt

SEQ ID NO: 481699 - DNA, 20 bp, Artificial Sequence
  chemically synthesized
attgactttaattaaattta

SEQ ID NO: 481700 - DNA, 20 bp, Artificial Sequence
  chemically synthesized
aaacttaaaattttcttgat

SEQ ID NO: 481701 - DNA, 20 bp, Artificial Sequence
  chemically synthesized
attttcttgatgtgaattta

SEQ ID NO: 481702 - DNA, 20 bp, Artificial Sequence
  chemically synthesized
aataataatttatatttata

SEQ ID NO: 481703 - DNA, 20 bp, Artificial Sequence
  chemically synthesized
tttatatttatatagaattt

SEQ ID NO: 481704 - DNA, 20 bp, Artificial Sequence
  chemically synthesized
taaccaagatgtttaaaaat

SEQ ID NO: 481705 - DNA, 20 bp, Artificial Sequence
  chemically synthesized
gcaaaacacaattttgggca

SEQ ID NO: 481706 - DNA, 20 bp, Artificial Sequence
  chemically synthesized
atgtacagatattcaatctt

SEQ ID NO: 481707 - DNA, 20 bp, Artificial Sequence
  chemically synthesized
aaagatacaaattccaaaga

SEQ ID NO: 481708 - DNA, 20 bp, Artificial Sequence
  chemically synthesized
tatattagccatgaaagtga

SEQ ID NO: 481709 - DNA, 20 bp, Artificial Sequence
  chemically synthesized
ttgtatttagctgtcaatga

SEQ ID NO: 481710 - DNA, 20 bp, Artificial Sequence
  chemically synthesized
aaaattgttaactttcgtgg

SEQ ID NO: 481711 - DNA, 20 bp, Artificial Sequence
  chemically synthesized
gaaagttaacaatttttttt

SEQ ID NO: 481712 - DNA, 20 bp, Artificial Sequence
  chemically synthesized
tttttttctgaattttcaaa

SEQ ID NO: 481713 - DNA, 20 bp, Artificial Sequence
  chemically synthesized
ggtacttgatgtctgaagac

SEQ ID NO: 481714 - DNA, 20 bp, Artificial Sequence
  chemically synthesized
aagccaaatgggtgtctgga

SEQ ID NO: 481715 - DNA, 20 bp, Artificial Sequence
  chemically synthesized
ttttgggtgacagaagccaa

SEQ ID NO: 481716 - DNA, 20 bp, Artificial Sequence
  chemically synthesized
gcagggagggcaggagtatt

SEQ ID NO: 481717 - DNA, 20 bp, Artificial Sequence
  chemically synthesized
tgataaaaagcagggagggc

SEQ ID NO: 481718 - DNA, 20 bp, Artificial Sequence
  chemically synthesized
agaggaggcccatcaaactt

SEQ ID NO: 481719 - DNA, 20 bp, Artificial Sequence
  chemically synthesized
ctggatgtttttgacagaac

SEQ ID NO: 481720 - DNA, 20 bp, Artificial Sequence
  chemically synthesized
gtcaaaaacatccagtgtgt

SEQ ID NO: 481721 - DNA, 20 bp, Artificial Sequence
  chemically synthesized
ctgttctcaaccctgacaca

SEQ ID NO: 481722 - DNA, 20 bp, Artificial Sequence
  chemically synthesized
ccacttcatgattttacgca

SEQ ID NO: 481723 - DNA, 20 bp, Artificial Sequence
  chemically synthesized
ctggctagatgcaagataaa

SEQ ID NO: 481724 - DNA, 20 bp, Artificial Sequence
  chemically synthesized
tatttctccaacttattcac

SEQ ID NO: 481725 - DNA, 20 bp, Artificial Sequence
  chemically synthesized
aagtctttcgttatactctt

SEQ ID NO: 481726 - DNA, 20 bp, Artificial Sequence
  chemically synthesized
atctcaataatttagacaat

SEQ ID NO: 481727 - DNA, 20 bp, Artificial Sequence
  chemically synthesized
acacagatatacctgcatac

SEQ ID NO: 481728 - DNA, 20 bp, Artificial Sequence
  chemically synthesized
ttagctaatctcttcaataa

SEQ ID NO: 481729 - DNA, 20 bp, Artificial Sequence
  chemically synthesized
ccagttgttgataaatgcag

SEQ ID NO: 481730 - DNA, 20 bp, Artificial Sequence
  chemically synthesized
tatagctatgtgaggggaag

SEQ ID NO: 481731 - DNA, 20 bp, Artificial Sequence
  chemically synthesized
tgtgaggggaaggagaatag

SEQ ID NO: 481732 - DNA, 20 bp, Artificial Sequence
  chemically synthesized
gaatggcatgatctctataa

SEQ ID NO: 481733 - DNA, 20 bp, Artificial Sequence
  chemically synthesized
ttataatctattttcaccac

SEQ ID NO: 481734 - DNA, 20 bp, Artificial Sequence
  chemically synthesized
tataattgcagtgataatca

SEQ ID NO: 481735 - DNA, 20 bp, Artificial Sequence
  chemically synthesized
tcggagcacctaacctattt

SEQ ID NO: 481736 - DNA, 20 bp, Artificial Sequence
  chemically synthesized
ttccagacaaatactgattt

SEQ ID NO: 481737 - DNA, 20 bp, Artificial Sequence
  chemically synthesized
aaatgtcctccctcaatttc

SEQ ID NO: 481738 - DNA, 20 bp, Artificial Sequence
  chemically synthesized
tttgactatcacagtgattg

SEQ ID NO: 481739 - DNA, 20 bp, Artificial Sequence
  chemically synthesized
ataatagcattctgtggaga

SEQ ID NO: 481740 - DNA, 20 bp, Artificial Sequence
  chemically synthesized
ccatcttcattccctctcca

SEQ ID NO: 481741 - DNA, 20 bp, Artificial Sequence
  chemically synthesized
caaagtgctgtcagacttgg

SEQ ID NO: 481742 - DNA, 20 bp, Artificial Sequence
  chemically synthesized
tcccaagtctgacagcactt

SEQ ID NO: 481743 - DNA, 20 bp, Artificial Sequence
  chemically synthesized
ccacatacatgcatgtccag

SEQ ID NO: 481744 - DNA, 20 bp, Artificial Sequence
  chemically synthesized
caggtttaggtgtttataaa

SEQ ID NO: 481745 - DNA, 20 bp, Artificial Sequence
  chemically synthesized
tcttatgtttacgtgtaaaa

SEQ ID NO: 481746 - DNA, 20 bp, Artificial Sequence
  chemically synthesized
ttcctcatgattttaagaca

SEQ ID NO: 481747 - DNA, 20 bp, Artificial Sequence
  chemically synthesized
accatgaaataaattttttc

SEQ ID NO: 481748 - DNA, 20 bp, Artificial Sequence
  chemically synthesized
aaaatttatttcatggtgtt

SEQ ID NO: 481749 - DNA, 20 bp, Artificial Sequence
  chemically synthesized
atggtgttaggaattttgcc

SEQ ID NO: 481750 - DNA, 20 bp, Artificial Sequence
  chemically synthesized
gcattttggaaaattacgct

SEQ ID NO: 481751 - DNA, 20 bp, Artificial Sequence
  chemically synthesized
accaatgcccctcatggtat

SEQ ID NO: 481752 - DNA, 20 bp, Artificial Sequence
  chemically synthesized
caatgcagtataaacaaatg

SEQ ID NO: 481753 - DNA, 20 bp, Artificial Sequence
  chemically synthesized
gtgttccagtgtgatcctgc

SEQ ID NO: 481754 - DNA, 20 bp, Artificial Sequence
  chemically synthesized
gtagtatgcagttattcagg

SEQ ID NO: 481755 - DNA, 20 bp, Artificial Sequence
  chemically synthesized
actctattttaaagagaaat

SEQ ID NO: 481756 - DNA, 20 bp, Artificial Sequence
  chemically synthesized
actcttatttctctttaaaa

SEQ ID NO: 481757 - DNA, 20 bp, Artificial Sequence
  chemically synthesized
taaactattgcctgtataag

SEQ ID NO: 481758 - DNA, 20 bp, Artificial Sequence
  chemically synthesized
tgttatttaaaaaagaaaag

SEQ ID NO: 481759 - DNA, 20 bp, Artificial Sequence
  chemically synthesized
aaaagaaaagaggggtggca

SEQ ID NO: 481760 - DNA, 20 bp, Artificial Sequence
  chemically synthesized
ccaccgatacagagccactg

SEQ ID NO: 481761 - DNA, 20 bp, Artificial Sequence
  chemically synthesized
tttattatactgaaaattaa

SEQ ID NO: 481762 - DNA, 20 bp, Artificial Sequence
  chemically synthesized
attaatagaatttttcagga

SEQ ID NO: 481763 - DNA, 20 bp, Artificial Sequence
  chemically synthesized
agaatttttcaggagagaat

SEQ ID NO: 481764 - DNA, 20 bp, Artificial Sequence
  chemically synthesized
ggagctctagggatcagaga

SEQ ID NO: 481765 - DNA, 20 bp, Artificial Sequence
  chemically synthesized
ttcattctctatggagctct

SEQ ID NO: 481766 - DNA, 20 bp, Artificial Sequence
  chemically synthesized
ctgatccctagagctccata

SEQ ID NO: 481767 - DNA, 20 bp, Artificial Sequence
  chemically synthesized
ggtctacttcatatacgaac

SEQ ID NO: 481768 - DNA, 20 bp, Artificial Sequence
  chemically synthesized
gaattaaaaacagccagccc

SEQ ID NO: 481769 - DNA, 20 bp, Artificial Sequence
  chemically synthesized
ttgagcactgtcaggctgat

SEQ ID NO: 481770 - DNA, 20 bp, Artificial Sequence
  chemically synthesized
gctaattgggagaagcagcc

SEQ ID NO: 481771 - DNA, 20 bp, Artificial Sequence
  chemically synthesized
gcagcccagctcatctccta

SEQ ID NO: 481772 - DNA, 20 bp, Artificial Sequence
  chemically synthesized
tctggtaaacctgttttgac

SEQ ID NO: 481773 - DNA, 20 bp, Artificial Sequence
  chemically synthesized
tgcgcaaagtttaagataac

SEQ ID NO: 481774 - DNA, 20 bp, Artificial Sequence
  chemically synthesized
ggggaaaacagatacacaat

SEQ ID NO: 481775 - DNA, 20 bp, Artificial Sequence
  chemically synthesized
atgtaatttgaaaacaaaaa

SEQ ID NO: 481776 - DNA, 20 bp, Artificial Sequence
  chemically synthesized
gtcacatggacatggagtta

SEQ ID NO: 481777 - DNA, 20 bp, Artificial Sequence
  chemically synthesized
aacgctatgtcacatggaca

SEQ ID NO: 481778 - DNA, 20 bp, Artificial Sequence
  chemically synthesized
aagtaatttacagaattaca

SEQ ID NO: 481779 - DNA, 20 bp, Artificial Sequence
  chemically synthesized
tataggagagaagtaattta

SEQ ID NO: 481780 - DNA, 20 bp, Artificial Sequence
  chemically synthesized
acttctctcctatatttctg

SEQ ID NO: 481781 - DNA, 20 bp, Artificial Sequence
  chemically synthesized
tctcctatatttctgagggg

SEQ ID NO: 481782 - DNA, 20 bp, Artificial Sequence
  chemically synthesized
ccttatgcgctgtcttctaa

SEQ ID NO: 481783 - DNA, 20 bp, Artificial Sequence
  chemically synthesized
aaatatgcagatgggaaaac

SEQ ID NO: 481784 - DNA, 20 bp, Artificial Sequence
  chemically synthesized
ctggaaaagtaagacaattc

SEQ ID NO: 481785 - DNA, 20 bp, Artificial Sequence
  chemically synthesized
tcttctatctcagcccactc

SEQ ID NO: 481786 - DNA, 20 bp, Artificial Sequence
  chemically synthesized
agagataaaaagaaataagg

SEQ ID NO: 481787 - DNA, 20 bp, Artificial Sequence
  chemically synthesized
accttggcctcccaaagtgc

SEQ ID NO: 481788 - DNA, 20 bp, Artificial Sequence
  chemically synthesized
cagcactttgggaggccaag

SEQ ID NO: 481789 - DNA, 20 bp, Artificial Sequence
  chemically synthesized
actttgggaggccaaggtgg

SEQ ID NO: 481790 - DNA, 20 bp, Artificial Sequence
  chemically synthesized
ggtgggtggatcacgaggtc

SEQ ID NO: 481791 - DNA, 20 bp, Artificial Sequence
  chemically synthesized
ttttgtatttttagtagaga

SEQ ID NO: 481792 - DNA, 20 bp, Artificial Sequence
  chemically synthesized
aaaattagcagggcgtggtg

SEQ ID NO: 481793 - DNA, 20 bp, Artificial Sequence
  chemically synthesized
gtctcagcctcccgagtggc

SEQ ID NO: 481794 - DNA, 20 bp, Artificial Sequence
  chemically synthesized
caattctctgtctcagcctc

SEQ ID NO: 481795 - DNA, 20 bp, Artificial Sequence
  chemically synthesized
ccactcgggaggctgagaca

SEQ ID NO: 481796 - DNA, 20 bp, Artificial Sequence
  chemically synthesized
ctcactgcaacctctccctc

SEQ ID NO: 481797 - DNA, 20 bp, Artificial Sequence
  chemically synthesized
ttttttttttttttttgaga

SEQ ID NO: 481798 - DNA, 20 bp, Artificial Sequence
  chemically synthesized
aaaaaaaaaaaaaaaaaaaa

SEQ ID NO: 481799 - DNA, 20 bp, Artificial Sequence
  chemically synthesized
aaataacaactcagagaaaa

SEQ ID NO: 481800 - DNA, 20 bp, Artificial Sequence
  chemically synthesized
ttgcacttactcacttttct

SEQ ID NO: 481801 - DNA, 20 bp, Artificial Sequence
  chemically synthesized
tgagtaagtgcaacatctct

SEQ ID NO: 481802 - DNA, 20 bp, Artificial Sequence
  chemically synthesized
ttgggtgaatagggatgttt

SEQ ID NO: 481803 - DNA, 20 bp, Artificial Sequence
  chemically synthesized
atgttaatctttgggtgaat

SEQ ID NO: 481804 - DNA, 20 bp, Artificial Sequence
  chemically synthesized
taggaaatgttaatctttgg

SEQ ID NO: 481805 - DNA, 20 bp, Artificial Sequence
  chemically synthesized
cttgtaggaaatgttaatct

SEQ ID NO: 481806 - DNA, 20 bp, Artificial Sequence
  chemically synthesized
ttcctacaagacaccatgtt

SEQ ID NO: 481807 - DNA, 20 bp, Artificial Sequence
  chemically synthesized
gttatgaatatccttaacta

SEQ ID NO: 481808 - DNA, 20 bp, Artificial Sequence
  chemically synthesized
ttgagggatatccattagtt

SEQ ID NO: 481809 - DNA, 20 bp, Artificial Sequence
  chemically synthesized
aaaataaatatttcttcttg

SEQ ID NO: 481810 - DNA, 20 bp, Artificial Sequence
  chemically synthesized
tagtacagttacatacattt

SEQ ID NO: 481811 - DNA, 20 bp, Artificial Sequence
  chemically synthesized
agttacatacatttgggaat

SEQ ID NO: 481812 - DNA, 20 bp, Artificial Sequence
  chemically synthesized
acatacatttgggaattaga

SEQ ID NO: 481813 - DNA, 20 bp, Artificial Sequence
  chemically synthesized
tcctgcaaaatgattaaaac

SEQ ID NO: 481814 - DNA, 20 bp, Artificial Sequence
  chemically synthesized
agccaggactcttacaacat

SEQ ID NO: 481815 - DNA, 20 bp, Artificial Sequence
  chemically synthesized
gatgagtattcatatgttgt

SEQ ID NO: 481816 - DNA, 20 bp, Artificial Sequence
  chemically synthesized
aatgatattatacataatag

SEQ ID NO: 481817 - DNA, 20 bp, Artificial Sequence
  chemically synthesized
ttatgtataatatcatttaa

SEQ ID NO: 481818 - DNA, 20 bp, Artificial Sequence
  chemically synthesized
ggattttgccccaaatcttt

SEQ ID NO: 481819 - DNA, 20 bp, Artificial Sequence
  chemically synthesized
ctttaagattggtcaacaat

SEQ ID NO: 481820 - DNA, 20 bp, Artificial Sequence
  chemically synthesized
ttttgttttctaaaggagaa

SEQ ID NO: 481821 - DNA, 20 bp, Artificial Sequence
  chemically synthesized
ttaattctacaacagaagac

SEQ ID NO: 481822 - DNA, 20 bp, Artificial Sequence
  chemically synthesized
aaaattcacgtcttctgttg

SEQ ID NO: 481823 - DNA, 20 bp, Artificial Sequence
  chemically synthesized
taaagaatgttgactttcgt

SEQ ID NO: 481824 - DNA, 20 bp, Artificial Sequence
  chemically synthesized
ctcttttctcaataatatta

SEQ ID NO: 481825 - DNA, 20 bp, Artificial Sequence
  chemically synthesized
ttctttaatattattgagaa

SEQ ID NO: 481826 - DNA, 20 bp, Artificial Sequence
  chemically synthesized
gaccgtagttttaataaaat

SEQ ID NO: 481827 - DNA, 20 bp, Artificial Sequence
  chemically synthesized
ttagtgaaaaaatccacatg

SEQ ID NO: 481828 - DNA, 20 bp, Artificial Sequence
  chemically synthesized
gaaacagcaaaattcaacat

SEQ ID NO: 481829 - DNA, 20 bp, Artificial Sequence
  chemically synthesized
tccttatgatttggctaagc

SEQ ID NO: 481830 - DNA, 20 bp, Artificial Sequence
  chemically synthesized
gaaactgaaatagaaatcct

SEQ ID NO: 481831 - DNA, 20 bp, Artificial Sequence
  chemically synthesized
aagtatgtagtagtcactca

SEQ ID NO: 481832 - DNA, 20 bp, Artificial Sequence
  chemically synthesized
actactacatactttaaatt

SEQ ID NO: 481833 - DNA, 20 bp, Artificial Sequence
  chemically synthesized
ttggaaaatcatgacagcac

SEQ ID NO: 481834 - DNA, 20 bp, Artificial Sequence
  chemically synthesized
aaatcagttgactaatcatt

SEQ ID NO: 481835 - DNA, 20 bp, Artificial Sequence
  chemically synthesized
tgttcagtggacaacttgta

SEQ ID NO: 481836 - DNA, 20 bp, Artificial Sequence
  chemically synthesized
ctgtgagcattaataaggaa

SEQ ID NO: 481837 - DNA, 20 bp, Artificial Sequence
  chemically synthesized
tagttatcatttttttttta

SEQ ID NO: 481838 - DNA, 20 bp, Artificial Sequence
  chemically synthesized
attttttttttagtgagtca

SEQ ID NO: 481839 - DNA, 20 bp, Artificial Sequence
  chemically synthesized
tttttagtgagtcacagaat

SEQ ID NO: 481840 - DNA, 20 bp, Artificial Sequence
  chemically synthesized
aaaataaggaaaacggaaca

SEQ ID NO: 481841 - DNA, 20 bp, Artificial Sequence
  chemically synthesized
ctggggaagaggccagttta

SEQ ID NO: 481842 - DNA, 20 bp, Artificial Sequence
  chemically synthesized
acctgaaagtttaattgaca

SEQ ID NO: 481843 - DNA, 20 bp, Artificial Sequence
  chemically synthesized
ggacagcacatctaggaaaa

SEQ ID NO: 481844 - DNA, 20 bp, Artificial Sequence
  chemically synthesized
aaaatcggaagaacgattgt

SEQ ID NO: 481845 - DNA, 20 bp, Artificial Sequence
  chemically synthesized
ttgcggtgtatatcaaattg

SEQ ID NO: 481846 - DNA, 20 bp, Artificial Sequence
  chemically synthesized
aaaaacatcacaggtctaca

SEQ ID NO: 481847 - DNA, 20 bp, Artificial Sequence
  chemically synthesized
tagttcccccaagtactttc

SEQ ID NO: 481848 - DNA, 20 bp, Artificial Sequence
  chemically synthesized
gtaatgacaggaaacgtggt

SEQ ID NO: 481849 - DNA, 20 bp, Artificial Sequence
  chemically synthesized
ttattcaggaaggaaaatgg

SEQ ID NO: 481850 - DNA, 20 bp, Artificial Sequence
  chemically synthesized
acatttattcaggaaggaaa

SEQ ID NO: 481851 - DNA, 20 bp, Artificial Sequence
  chemically synthesized
tcactcatccattttccttc

SEQ ID NO: 481852 - DNA, 20 bp, Artificial Sequence
  chemically synthesized
taagtttaacaattattgtt

SEQ ID NO: 481853 - DNA, 20 bp, Artificial Sequence
  chemically synthesized
agacatgattagatggggaa

SEQ ID NO: 481854 - DNA, 20 bp, Artificial Sequence
  chemically synthesized
ttaatctgcatgaaaaataa

SEQ ID NO: 481855 - DNA, 20 bp, Artificial Sequence
  chemically synthesized
aatatgtgctcaaatgatat

SEQ ID NO: 481856 - DNA, 20 bp, Artificial Sequence
  chemically synthesized
tatggaaaagtagttctatg

SEQ ID NO: 481857 - DNA, 20 bp, Artificial Sequence
  chemically synthesized
caatgcagtgaaagcaaata

SEQ ID NO: 481858 - DNA, 20 bp, Artificial Sequence
  chemically synthesized
taatttaatgggagaatcta

SEQ ID NO: 481859 - DNA, 20 bp, Artificial Sequence
  chemically synthesized
atactgttataatttaatgg

SEQ ID NO: 481860 - DNA, 20 bp, Artificial Sequence
  chemically synthesized
cattaaattataacagtatt

SEQ ID NO: 481861 - DNA, 20 bp, Artificial Sequence
  chemically synthesized
caccatatattgaaagaatt

SEQ ID NO: 481862 - DNA, 20 bp, Artificial Sequence
  chemically synthesized
cttcttccaccatatattga

SEQ ID NO: 481863 - DNA, 20 bp, Artificial Sequence
  chemically synthesized
gaagcaaaagctgatattaa

SEQ ID NO: 481864 - DNA, 20 bp, Artificial Sequence
  chemically synthesized
agaaaaacattatactttca

SEQ ID NO: 481865 - DNA, 20 bp, Artificial Sequence
  chemically synthesized
aattctccatatacatatat

SEQ ID NO: 481866 - DNA, 20 bp, Artificial Sequence
  chemically synthesized
gactcatatatatgtatatg

SEQ ID NO: 481867 - DNA, 20 bp, Artificial Sequence
  chemically synthesized
atctattgcagtatctggca

SEQ ID NO: 481868 - DNA, 20 bp, Artificial Sequence
  chemically synthesized
attgcagtatctggcaaaga

SEQ ID NO: 481869 - DNA, 20 bp, Artificial Sequence
  chemically synthesized
ctaactttgaaagtacaagt

SEQ ID NO: 481870 - DNA, 20 bp, Artificial Sequence
  chemically synthesized
ctgacttgtactttcaaagt

SEQ ID NO: 481871 - DNA, 20 bp, Artificial Sequence
  chemically synthesized
gccaaagtttgcttttgaaa

SEQ ID NO: 481872 - DNA, 20 bp, Artificial Sequence
  chemically synthesized
agcaaactttggcaaaactt

SEQ ID NO: 481873 - DNA, 20 bp, Artificial Sequence
  chemically synthesized
gagaaacttgcctttccagg

SEQ ID NO: 481874 - DNA, 20 bp, Artificial Sequence
  chemically synthesized
gttaggttctgtaacttttt

SEQ ID NO: 481875 - DNA, 20 bp, Artificial Sequence
  chemically synthesized
aggagactgatagcaaatac

SEQ ID NO: 481876 - DNA, 20 bp, Artificial Sequence
  chemically synthesized
aaatacaagaatttctgtgt

SEQ ID NO: 481877 - DNA, 20 bp, Artificial Sequence
  chemically synthesized
gaaaaggatactgaggcaca

SEQ ID NO: 481878 - DNA, 20 bp, Artificial Sequence
  chemically synthesized
aaaatatttatgacagagaa

SEQ ID NO: 481879 - DNA, 20 bp, Artificial Sequence
  chemically synthesized
cataggttaactcagaccta

SEQ ID NO: 481880 - DNA, 20 bp, Artificial Sequence
  chemically synthesized
gaacgtgacattctataggt

SEQ ID NO: 481881 - DNA, 20 bp, Artificial Sequence
  chemically synthesized
tatagaatgtcacgttcatt

SEQ ID NO: 481882 - DNA, 20 bp, Artificial Sequence
  chemically synthesized
ggatatgcactgtttgccaa

SEQ ID NO: 481883 - DNA, 20 bp, Artificial Sequence
  chemically synthesized
ttgcgctgggttctgctccc

SEQ ID NO: 481884 - DNA, 20 bp, Artificial Sequence
  chemically synthesized
ggtaggacagcttgcttgcg

SEQ ID NO: 481885 - DNA, 20 bp, Artificial Sequence
  chemically synthesized
tcaattaagggcttgaagtc

SEQ ID NO: 481886 - DNA, 20 bp, Artificial Sequence
  chemically synthesized
ttaagggcttgaagtcaaga

SEQ ID NO: 481887 - DNA, 20 bp, Artificial Sequence
  chemically synthesized
cccaagccactggtttgcca

SEQ ID NO: 481888 - DNA, 20 bp, Artificial Sequence
  chemically synthesized
aatagtgcagttgcaagaac

SEQ ID NO: 481889 - DNA, 20 bp, Artificial Sequence
  chemically synthesized
aaagaaccttggcctcttct

SEQ ID NO: 481890 - DNA, 20 bp, Artificial Sequence
  chemically synthesized
gtagaccaggtccgtccacc

SEQ ID NO: 481891 - DNA, 20 bp, Artificial Sequence
  chemically synthesized
gtccaccaggaatagttgct

SEQ ID NO: 481892 - DNA, 20 bp, Artificial Sequence
  chemically synthesized
aggaatagttgctaagagtt

SEQ ID NO: 481893 - DNA, 20 bp, Artificial Sequence
  chemically synthesized
gctaagagttatgggttggc

SEQ ID NO: 481894 - DNA, 20 bp, Artificial Sequence
  chemically synthesized
acccccatacacttctcatg

SEQ ID NO: 481895 - DNA, 20 bp, Artificial Sequence
  chemically synthesized
actctacatgagaagtgtat

SEQ ID NO: 481896 - DNA, 20 bp, Artificial Sequence
  chemically synthesized
cagccaagcacttggtgtgt

SEQ ID NO: 481897 - DNA, 20 bp, Artificial Sequence
  chemically synthesized
caagtgcttggctgggcttc

SEQ ID NO: 481898 - DNA, 20 bp, Artificial Sequence
  chemically synthesized
ttctggaattgcctacctgt

SEQ ID NO: 481899 - DNA, 20 bp, Artificial Sequence
  chemically synthesized
ggaaaaaaatcctcaaaatt

SEQ ID NO: 481900 - DNA, 20 bp, Artificial Sequence
  chemically synthesized
tggaagtaactcataatttt

SEQ ID NO: 481901 - DNA, 20 bp, Artificial Sequence
  chemically synthesized
atgagttacttccattctat

SEQ ID NO: 481902 - DNA, 20 bp, Artificial Sequence
  chemically synthesized
tgtcttcatcaacattctaa

SEQ ID NO: 481903 - DNA, 20 bp, Artificial Sequence
  chemically synthesized
tattagaatgttgatgaaga

SEQ ID NO: 481904 - DNA, 20 bp, Artificial Sequence
  chemically synthesized
gatgaagacagagtgtcaag

SEQ ID NO: 481905 - DNA, 20 bp, Artificial Sequence
  chemically synthesized
atagagtctattaaaattgc

SEQ ID NO: 481906 - DNA, 20 bp, Artificial Sequence
  chemically synthesized
acaatagaggcaatagacaa

SEQ ID NO: 481907 - DNA, 20 bp, Artificial Sequence
  chemically synthesized
agaaatccaccgaagtaatc

SEQ ID NO: 481908 - DNA, 20 bp, Artificial Sequence
  chemically synthesized
agatatccctgattacttcg

SEQ ID NO: 481909 - DNA, 20 bp, Artificial Sequence
  chemically synthesized
ttcctgagacttcccacaag

SEQ ID NO: 481910 - DNA, 20 bp, Artificial Sequence
  chemically synthesized
cagagcctatttgaatcata

SEQ ID NO: 481911 - DNA, 20 bp, Artificial Sequence
  chemically synthesized
gattctctggcagagcctat

SEQ ID NO: 481912 - DNA, 20 bp, Artificial Sequence
  chemically synthesized
gattcaaataggctctgcca

SEQ ID NO: 481913 - DNA, 20 bp, Artificial Sequence
  chemically synthesized
tagctagctagagacagaga

SEQ ID NO: 481914 - DNA, 20 bp, Artificial Sequence
  chemically synthesized
aagtttaaggacttttttct

SEQ ID NO: 481915 - DNA, 20 bp, Artificial Sequence
  chemically synthesized
aaaagtccttaaacttctac

SEQ ID NO: 481916 - DNA, 20 bp, Artificial Sequence
  chemically synthesized
cttctaccagaatatgaggt

SEQ ID NO: 481917 - DNA, 20 bp, Artificial Sequence
  chemically synthesized
ggtaagaataacagccttgg

SEQ ID NO: 481918 - DNA, 20 bp, Artificial Sequence
  chemically synthesized
ggagtcatagaaaaaaatgt

SEQ ID NO: 481919 - DNA, 20 bp, Artificial Sequence
  chemically synthesized
catagaaaaaaatgtctgaa

SEQ ID NO: 481920 - DNA, 20 bp, Artificial Sequence
  chemically synthesized
accaagggaatttgtgttac

SEQ ID NO: 481921 - DNA, 20 bp, Artificial Sequence
  chemically synthesized
acatttgccatgctaaccaa

SEQ ID NO: 481922 - DNA, 20 bp, Artificial Sequence
  chemically synthesized
tataggcttatgcctacgtg

SEQ ID NO: 481923 - DNA, 20 bp, Artificial Sequence
  chemically synthesized
gaattgagctaatggcacta

SEQ ID NO: 481924 - DNA, 20 bp, Artificial Sequence
  chemically synthesized
atcatctcaccgtgagttac

SEQ ID NO: 481925 - DNA, 20 bp, Artificial Sequence
  chemically synthesized
tgaagggaaatcatctcacc

SEQ ID NO: 481926 - DNA, 20 bp, Artificial Sequence
  chemically synthesized
atctatcttacaaacactta

SEQ ID NO: 481927 - DNA, 20 bp, Artificial Sequence
  chemically synthesized
gaccatgaaaacaatttctc

SEQ ID NO: 481928 - DNA, 20 bp, Artificial Sequence
  chemically synthesized
ttcatggtcaaacttttaga

SEQ ID NO: 481929 - DNA, 20 bp, Artificial Sequence
  chemically synthesized
tttatgaaagtatgggggga

SEQ ID NO: 481930 - DNA, 20 bp, Artificial Sequence
  chemically synthesized
cttattacagtgcatgcttg

SEQ ID NO: 481931 - DNA, 20 bp, Artificial Sequence
  chemically synthesized
caccaagcatgcactgtaat

SEQ ID NO: 481932 - DNA, 20 bp, Artificial Sequence
  chemically synthesized
cgaacagacttctttcccat

SEQ ID NO: 481933 - DNA, 20 bp, Artificial Sequence
  chemically synthesized
ataactcaagaaagggttct

SEQ ID NO: 481934 - DNA, 20 bp, Artificial Sequence
  chemically synthesized
ttcatccatagaaccctttc

SEQ ID NO: 481935 - DNA, 20 bp, Artificial Sequence
  chemically synthesized
taataagtaataactcaaga

SEQ ID NO: 481936 - DNA, 20 bp, Artificial Sequence
  chemically synthesized
gggagttttctttttccaaa

SEQ ID NO: 481937 - DNA, 20 bp, Artificial Sequence
  chemically synthesized
acatactcatcatctagagt

SEQ ID NO: 481938 - DNA, 20 bp, Artificial Sequence
  chemically synthesized
gaaaactcccactctagatg

SEQ ID NO: 481939 - DNA, 20 bp, Artificial Sequence
  chemically synthesized
atcttcacatactcatcatc

SEQ ID NO: 481940 - DNA, 20 bp, Artificial Sequence
  chemically synthesized
gatgatgagtatgtgaagat

SEQ ID NO: 481941 - DNA, 20 bp, Artificial Sequence
  chemically synthesized
aaggtatcaccaacctgttc

SEQ ID NO: 481942 - DNA, 20 bp, Artificial Sequence
  chemically synthesized
tatttcagcttaatagagag

SEQ ID NO: 481943 - DNA, 20 bp, Artificial Sequence
  chemically synthesized
aagccaaaggggatcttagg

SEQ ID NO: 481944 - DNA, 20 bp, Artificial Sequence
  chemically synthesized
agtgggaaaggaaagccaaa

SEQ ID NO: 481945 - DNA, 20 bp, Artificial Sequence
  chemically synthesized
ttccaaatatggagataaca

SEQ ID NO: 481946 - DNA, 20 bp, Artificial Sequence
  chemically synthesized
ctctatgttatctccatatt

SEQ ID NO: 481947 - DNA, 20 bp, Artificial Sequence
  chemically synthesized
ccaactaaatcagaatctct

SEQ ID NO: 481948 - DNA, 20 bp, Artificial Sequence
  chemically synthesized
ccccagagattctgatttag

SEQ ID NO: 481949 - DNA, 20 bp, Artificial Sequence
  chemically synthesized
cctaccccatccaactaaat

SEQ ID NO: 481950 - DNA, 20 bp, Artificial Sequence
  chemically synthesized
gagattctgatttagttgga

SEQ ID NO: 481951 - DNA, 20 bp, Artificial Sequence
  chemically synthesized
gccagtcagaggaccatact

SEQ ID NO: 481952 - DNA, 20 bp, Artificial Sequence
  chemically synthesized
ctttgggtaacactgcggtc

SEQ ID NO: 481953 - DNA, 20 bp, Artificial Sequence
  chemically synthesized
gacctcatgccctagctggt

SEQ ID NO: 481954 - DNA, 20 bp, Artificial Sequence
  chemically synthesized
ccccatgggaaagagcagac

SEQ ID NO: 481955 - DNA, 20 bp, Artificial Sequence
  chemically synthesized
ctccagtctgctctttccca

SEQ ID NO: 481956 - DNA, 20 bp, Artificial Sequence
  chemically synthesized
atactagagagttaatggtc

SEQ ID NO: 481957 - DNA, 20 bp, Artificial Sequence
  chemically synthesized
ggaccattaactctctagta

SEQ ID NO: 481958 - DNA, 20 bp, Artificial Sequence
  chemically synthesized
gacctttgaacccaatacta

SEQ ID NO: 481959 - DNA, 20 bp, Artificial Sequence
  chemically synthesized
agacacgctgaattgaagca

SEQ ID NO: 481960 - DNA, 20 bp, Artificial Sequence
  chemically synthesized
catggccctttagagacacg

SEQ ID NO: 481961 - DNA, 20 bp, Artificial Sequence
  chemically synthesized
cggcctcatcagattttcag

SEQ ID NO: 481962 - DNA, 20 bp, Artificial Sequence
  chemically synthesized
tgtgtgcataaggtttgttg

SEQ ID NO: 481963 - DNA, 20 bp, Artificial Sequence
  chemically synthesized
cctggaaatagactaagata

SEQ ID NO: 481964 - DNA, 20 bp, Artificial Sequence
  chemically synthesized
gggagcccagtctaagttag

SEQ ID NO: 481965 - DNA, 20 bp, Artificial Sequence
  chemically synthesized
gtaaatgcaaggtgctacat

SEQ ID NO: 481966 - DNA, 20 bp, Artificial Sequence
  chemically synthesized
caacaagttggactggtagg

SEQ ID NO: 481967 - DNA, 20 bp, Artificial Sequence
  chemically synthesized
aaatagcaaatatagcagac

SEQ ID NO: 481968 - DNA, 20 bp, Artificial Sequence
  chemically synthesized
ctttgtggcattgatttgat

SEQ ID NO: 481969 - DNA, 20 bp, Artificial Sequence
  chemically synthesized
tcaatattttcatcagtggc

SEQ ID NO: 481970 - DNA, 20 bp, Artificial Sequence
  chemically synthesized
agagctgagattagattacc

SEQ ID NO: 481971 - DNA, 20 bp, Artificial Sequence
  chemically synthesized
gctcccttcactgctgtcta

SEQ ID NO: 481972 - DNA, 20 bp, Artificial Sequence
  chemically synthesized
agtgaagggagcataggcct

SEQ ID NO: 481973 - DNA, 20 bp, Artificial Sequence
  chemically synthesized
aggcctcagagttgcagatt

SEQ ID NO: 481974 - DNA, 20 bp, Artificial Sequence
  chemically synthesized
tggcattgttctctttagct

SEQ ID NO: 481975 - DNA, 20 bp, Artificial Sequence
  chemically synthesized
taaaatcataaataatcatt

SEQ ID NO: 481976 - DNA, 20 bp, Artificial Sequence
  chemically synthesized
ttcatgctgggacaaattag

SEQ ID NO: 481977 - DNA, 20 bp, Artificial Sequence
  chemically synthesized
ctgtatttggtcatttcatg

SEQ ID NO: 481978 - DNA, 20 bp, Artificial Sequence
  chemically synthesized
tttaaatgtcctagtgaagt

SEQ ID NO: 481979 - DNA, 20 bp, Artificial Sequence
  chemically synthesized
ggccgctcatacaattactg

SEQ ID NO: 481980 - DNA, 20 bp, Artificial Sequence
  chemically synthesized
gttattatctacaaaggtga

SEQ ID NO: 481981 - DNA, 20 bp, Artificial Sequence
  chemically synthesized
ataaacacactgactggaca

SEQ ID NO: 481982 - DNA, 20 bp, Artificial Sequence
  chemically synthesized
actggacacagagtgatgta

SEQ ID NO: 481983 - DNA, 20 bp, Artificial Sequence
  chemically synthesized
atgtaatgagtatcataatt

SEQ ID NO: 481984 - DNA, 20 bp, Artificial Sequence
  chemically synthesized
tgaaacacacaactactgct

SEQ ID NO: 481985 - DNA, 20 bp, Artificial Sequence
  chemically synthesized
cacaactactgctttgaatg

SEQ ID NO: 481986 - DNA, 20 bp, Artificial Sequence
  chemically synthesized
aataattttcatctctttct

SEQ ID NO: 481987 - DNA, 20 bp, Artificial Sequence
  chemically synthesized
ctatgaatactgatgacaga

SEQ ID NO: 481988 - DNA, 20 bp, Artificial Sequence
  chemically synthesized
cagcataaaacattggctgg

SEQ ID NO: 481989 - DNA, 20 bp, Artificial Sequence
  chemically synthesized
cttttaactgttaataaaca

SEQ ID NO: 481990 - DNA, 20 bp, Artificial Sequence
  chemically synthesized
atttgcaaaaatatgataga

SEQ ID NO: 481991 - DNA, 20 bp, Artificial Sequence
  chemically synthesized
atatgatagaaggaattgct

SEQ ID NO: 481992 - DNA, 20 bp, Artificial Sequence
  chemically synthesized
aaggaattgctaagaatgtt

SEQ ID NO: 481993 - DNA, 20 bp, Artificial Sequence
  chemically synthesized
ctatcaaaaatttacaaata

SEQ ID NO: 481994 - DNA, 20 bp, Artificial Sequence
  chemically synthesized
tttttgatagtttctacaat

SEQ ID NO: 481995 - DNA, 20 bp, Artificial Sequence
  chemically synthesized
tatctaccatttttctgtgt

SEQ ID NO: 481996 - DNA, 20 bp, Artificial Sequence
  chemically synthesized
ggaagtaggtagcagtagcc

SEQ ID NO: 481997 - DNA, 20 bp, Artificial Sequence
  chemically synthesized
ttatagattcttgagcccag

SEQ ID NO: 481998 - DNA, 20 bp, Artificial Sequence
  chemically synthesized
gttcagattctgctgggctc

SEQ ID NO: 481999 - DNA, 20 bp, Artificial Sequence
  chemically synthesized
ctcaggtcctttgtcttata

SEQ ID NO: 482000 - DNA, 20 bp, Artificial Sequence
  chemically synthesized
gctctttgctgcaattagtc

SEQ ID NO: 482001 - DNA, 20 bp, Artificial Sequence
  chemically synthesized
gatgatatcaggtttcccta

SEQ ID NO: 482002 - DNA, 20 bp, Artificial Sequence
  chemically synthesized
tttccaatttccccctaaaa

SEQ ID NO: 482003 - DNA, 20 bp, Artificial Sequence
  chemically synthesized
gtttggacatataggtatta

SEQ ID NO: 482004 - DNA, 20 bp, Artificial Sequence
  chemically synthesized
tttttaatataagaaatcat

SEQ ID NO: 482005 - DNA, 20 bp, Artificial Sequence
  chemically synthesized
ggctttattcagtatgtaac

SEQ ID NO: 482006 - DNA, 20 bp, Artificial Sequence
  chemically synthesized
aaacagatccctgttacata

SEQ ID NO: 482007 - DNA, 20 bp, Artificial Sequence
  chemically synthesized
ttacatactgaataaagcca

SEQ ID NO: 482008 - DNA, 20 bp, Artificial Sequence
  chemically synthesized
ttctagaaatcttatagttt

SEQ ID NO: 482009 - DNA, 20 bp, Artificial Sequence
  chemically synthesized
tcccaaaactataagatttc

SEQ ID NO: 482010 - DNA, 20 bp, Artificial Sequence
  chemically synthesized
aagttgagtttttttaataa

SEQ ID NO: 482011 - DNA, 20 bp, Artificial Sequence
  chemically synthesized
gtagatttatttttagaaag

SEQ ID NO: 482012 - DNA, 20 bp, Artificial Sequence
  chemically synthesized
ctacctaaattctattttta

SEQ ID NO: 482013 - DNA, 20 bp, Artificial Sequence
  chemically synthesized
tttaaaacattcaataaaaa

SEQ ID NO: 482014 - DNA, 20 bp, Artificial Sequence
  chemically synthesized
tgttttaaagaagtctttct

SEQ ID NO: 482015 - DNA, 20 bp, Artificial Sequence
  chemically synthesized
tataattgaaaagtaacatg

SEQ ID NO: 482016 - DNA, 20 bp, Artificial Sequence
  chemically synthesized
tgtttcctaataaaaaatta

SEQ ID NO: 482017 - DNA, 20 bp, Artificial Sequence
  chemically synthesized
cccagttcaggactgtagga

SEQ ID NO: 482018 - DNA, 20 bp, Artificial Sequence
  chemically synthesized
tcaggactgtaggactgggt

SEQ ID NO: 482019 - DNA, 20 bp, Artificial Sequence
  chemically synthesized
ttagaatgtttctagcttgc

SEQ ID NO: 482020 - DNA, 20 bp, Artificial Sequence
  chemically synthesized
gtcatctcctttcaagtaat

SEQ ID NO: 482021 - DNA, 20 bp, Artificial Sequence
  chemically synthesized
tatgaaccttttagatccat

SEQ ID NO: 482022 - DNA, 20 bp, Artificial Sequence
  chemically synthesized
cagagagtgtcatgatccat

SEQ ID NO: 482023 - DNA, 20 bp, Artificial Sequence
  chemically synthesized
aatcttggggctccgggcca

SEQ ID NO: 482024 - DNA, 20 bp, Artificial Sequence
  chemically synthesized
gatgttatattaccctactg

SEQ ID NO: 482025 - DNA, 20 bp, Artificial Sequence
  chemically synthesized
aaattctctgcattctacag

SEQ ID NO: 482026 - DNA, 20 bp, Artificial Sequence
  chemically synthesized
ttaccctactgtagaatgca

SEQ ID NO: 482027 - DNA, 20 bp, Artificial Sequence
  chemically synthesized
tcagctcacttaaacctccg

SEQ ID NO: 482028 - DNA, 20 bp, Artificial Sequence
  chemically synthesized
tcataatcagttgggaagat

SEQ ID NO: 482029 - DNA, 20 bp, Artificial Sequence
  chemically synthesized
gggtctcagcaatataaaaa

SEQ ID NO: 482030 - DNA, 20 bp, Artificial Sequence
  chemically synthesized
tgtctttcggctcttcagga

SEQ ID NO: 482031 - DNA, 20 bp, Artificial Sequence
  chemically synthesized
atactgctaagtgtacctaa

SEQ ID NO: 482032 - DNA, 20 bp, Artificial Sequence
  chemically synthesized
tgtacctaaaggagttgata

SEQ ID NO: 482033 - DNA, 20 bp, Artificial Sequence
  chemically synthesized
ctaaaggagttgataatgga

SEQ ID NO: 482034 - DNA, 20 bp, Artificial Sequence
  chemically synthesized
tagtccattttaaggactga

SEQ ID NO: 482035 - DNA, 20 bp, Artificial Sequence
  chemically synthesized
caaggtacatttcgcataag

SEQ ID NO: 482036 - DNA, 20 bp, Artificial Sequence
  chemically synthesized
cgcataagaggaatttaaaa

SEQ ID NO: 482037 - DNA, 20 bp, Artificial Sequence
  chemically synthesized
aatagggtattcaaaattga

SEQ ID NO: 482038 - DNA, 20 bp, Artificial Sequence
  chemically synthesized
ccagttcaaccctctcaatt

SEQ ID NO: 482039 - DNA, 20 bp, Artificial Sequence
  chemically synthesized
gagggttgaactggtggctt

SEQ ID NO: 482040 - DNA, 20 bp, Artificial Sequence
  chemically synthesized
tttaatttaattttaagaga

SEQ ID NO: 482041 - DNA, 20 bp, Artificial Sequence
  chemically synthesized
tctcactacgtcacccaggc

SEQ ID NO: 482042 - DNA, 20 bp, Artificial Sequence
  chemically synthesized
tcatgccagtgtactccagc

SEQ ID NO: 482043 - DNA, 20 bp, Artificial Sequence
  chemically synthesized
caagaggatttcttgaacct

SEQ ID NO: 482044 - DNA, 20 bp, Artificial Sequence
  chemically synthesized
tacttgggaagctgaggcaa

SEQ ID NO: 482045 - DNA, 20 bp, Artificial Sequence
  chemically synthesized
tgggaggatcactagaggcc

SEQ ID NO: 482046 - DNA, 20 bp, Artificial Sequence
  chemically synthesized
ggaggccgaggtgggggtgg

SEQ ID NO: 482047 - DNA, 20 bp, Artificial Sequence
  chemically synthesized
gcactttgggaggccgaggt

SEQ ID NO: 482048 - DNA, 20 bp, Artificial Sequence
  chemically synthesized
acctcggcctcccaaagtgc

SEQ ID NO: 482049 - DNA, 20 bp, Artificial Sequence
  chemically synthesized
aaaatatgatagaatgctag

SEQ ID NO: 482050 - DNA, 20 bp, Artificial Sequence
  chemically synthesized
agctatgtacaaaaatatga

SEQ ID NO: 482051 - DNA, 20 bp, Artificial Sequence
  chemically synthesized
ggattatttccaaaaattta

SEQ ID NO: 482052 - DNA, 20 bp, Artificial Sequence
  chemically synthesized
atgttgggcactgaatggct

SEQ ID NO: 482053 - DNA, 20 bp, Artificial Sequence
  chemically synthesized
aattcatcagatgttgggca

SEQ ID NO: 482054 - DNA, 20 bp, Artificial Sequence
  chemically synthesized
cattcagtgcccaacatctg

SEQ ID NO: 482055 - DNA, 20 bp, Artificial Sequence
  chemically synthesized
tactcaataattgtttgtaa

SEQ ID NO: 482056 - DNA, 20 bp, Artificial Sequence
  chemically synthesized
cattcaattacaaacaatta

SEQ ID NO: 482057 - DNA, 20 bp, Artificial Sequence
  chemically synthesized
atagccataccttttatttg

SEQ ID NO: 482058 - DNA, 20 bp, Artificial Sequence
  chemically synthesized
aaataatataacagtctgct

SEQ ID NO: 482059 - DNA, 20 bp, Artificial Sequence
  chemically synthesized
gtcccttggcaatataattt

SEQ ID NO: 482060 - DNA, 20 bp, Artificial Sequence
  chemically synthesized
gacaagcattagaacttcat

SEQ ID NO: 482061 - DNA, 20 bp, Artificial Sequence
  chemically synthesized
ttttactttcagaaaaattt

SEQ ID NO: 482062 - DNA, 20 bp, Artificial Sequence
  chemically synthesized
tatcatgcatcaagtctcag

SEQ ID NO: 482063 - DNA, 20 bp, Artificial Sequence
  chemically synthesized
ggagggtaaaaaaaaagcac

SEQ ID NO: 482064 - DNA, 20 bp, Artificial Sequence
  chemically synthesized
ttggatctgtcttccttgaa

SEQ ID NO: 482065 - DNA, 20 bp, Artificial Sequence
  chemically synthesized
aagacagatccaaggctgtt

SEQ ID NO: 482066 - DNA, 20 bp, Artificial Sequence
  chemically synthesized
atttgacattcacaacagcc

SEQ ID NO: 482067 - DNA, 20 bp, Artificial Sequence
  chemically synthesized
cgtaaagacttgataactgg

SEQ ID NO: 482068 - DNA, 20 bp, Artificial Sequence
  chemically synthesized
caatctcccagaaatctaca

SEQ ID NO: 482069 - DNA, 20 bp, Artificial Sequence
  chemically synthesized
tacaaaggatgaagaggctt

SEQ ID NO: 482070 - DNA, 20 bp, Artificial Sequence
  chemically synthesized
ctttaggatgaggtgacaat

SEQ ID NO: 482071 - DNA, 20 bp, Artificial Sequence
  chemically synthesized
tgacaatagggataaagaga

SEQ ID NO: 482072 - DNA, 20 bp, Artificial Sequence
  chemically synthesized
ttctagagcaatttttgaag

SEQ ID NO: 482073 - DNA, 20 bp, Artificial Sequence
  chemically synthesized
aatttttgaagtagaattca

SEQ ID NO: 482074 - DNA, 20 bp, Artificial Sequence
  chemically synthesized
taaactggcttccaaattct

SEQ ID NO: 482075 - DNA, 20 bp, Artificial Sequence
  chemically synthesized
gtctctaaaactggaaacct

SEQ ID NO: 482076 - DNA, 20 bp, Artificial Sequence
  chemically synthesized
aggctgcaaaatgtgtcaag

SEQ ID NO: 482077 - DNA, 20 bp, Artificial Sequence
  chemically synthesized
cacctaacctacattaccac

SEQ ID NO: 482078 - DNA, 20 bp, Artificial Sequence
  chemically synthesized
acagttctggagatcaggag

SEQ ID NO: 482079 - DNA, 20 bp, Artificial Sequence
  chemically synthesized
taagatggaagttgacactg

SEQ ID NO: 482080 - DNA, 20 bp, Artificial Sequence
  chemically synthesized
cttctttctctctgcacatt

SEQ ID NO: 482081 - DNA, 20 bp, Artificial Sequence
  chemically synthesized
gagaaagaagagagacaatt

SEQ ID NO: 482082 - DNA, 20 bp, Artificial Sequence
  chemically synthesized
gtagctcaagatacaaagtt

SEQ ID NO: 482083 - DNA, 20 bp, Artificial Sequence
  chemically synthesized
tatatgaatcttaagttatg

SEQ ID NO: 482084 - DNA, 20 bp, Artificial Sequence
  chemically synthesized
tggagtagatagctggatat

SEQ ID NO: 482085 - DNA, 20 bp, Artificial Sequence
  chemically synthesized
gagatgtgtggagtagatag

SEQ ID NO: 482086 - DNA, 20 bp, Artificial Sequence
  chemically synthesized
ttatacatctaggagatgtg

SEQ ID NO: 482087 - DNA, 20 bp, Artificial Sequence
  chemically synthesized
acatattttgggaggaagat

SEQ ID NO: 482088 - DNA, 20 bp, Artificial Sequence
  chemically synthesized
actgagatggggaaggctcc

SEQ ID NO: 482089 - DNA, 20 bp, Artificial Sequence
  chemically synthesized
tagcctgagcaacggaaaga

SEQ ID NO: 482090 - DNA, 20 bp, Artificial Sequence
  chemically synthesized
gttgctcaggctaaaaattc

SEQ ID NO: 482091 - DNA, 20 bp, Artificial Sequence
  chemically synthesized
agaaagagtcaagaagactc

SEQ ID NO: 482092 - DNA, 20 bp, Artificial Sequence
  chemically synthesized
ataaatttaggtgtgagaga

SEQ ID NO: 482093 - DNA, 20 bp, Artificial Sequence
  chemically synthesized
gagcacaacagattttataa

SEQ ID NO: 482094 - DNA, 20 bp, Artificial Sequence
  chemically synthesized
gctctgtacccaaaatatag

SEQ ID NO: 482095 - DNA, 20 bp, Artificial Sequence
  chemically synthesized
tggttggattctactatatt

SEQ ID NO: 482096 - DNA, 20 bp, Artificial Sequence
  chemically synthesized
gtgaatgtggtgaggagtgg

SEQ ID NO: 482097 - DNA, 20 bp, Artificial Sequence
  chemically synthesized
tgggagaggtgaatgtggtg

SEQ ID NO: 482098 - DNA, 20 bp, Artificial Sequence
  chemically synthesized
ctgggatcagaatgggagag

SEQ ID NO: 482099 - DNA, 20 bp, Artificial Sequence
  chemically synthesized
gagatgactgtggctgggat

SEQ ID NO: 482100 - DNA, 20 bp, Artificial Sequence
  chemically synthesized
agtcaagagatgactgtggc

SEQ ID NO: 482101 - DNA, 20 bp, Artificial Sequence
  chemically synthesized
cagccacagtcatctcttga

SEQ ID NO: 482102 - DNA, 20 bp, Artificial Sequence
  chemically synthesized
tattggagggttttgaatgg

SEQ ID NO: 482103 - DNA, 20 bp, Artificial Sequence
  chemically synthesized
atgggagttattggagggtt

SEQ ID NO: 482104 - DNA, 20 bp, Artificial Sequence
  chemically synthesized
gaatgagatgggagttattg

SEQ ID NO: 482105 - DNA, 20 bp, Artificial Sequence
  chemically synthesized
gcttttaatctgaatgagat

SEQ ID NO: 482106 - DNA, 20 bp, Artificial Sequence
  chemically synthesized
tgtggactttagcttttaat

SEQ ID NO: 482107 - DNA, 20 bp, Artificial Sequence
  chemically synthesized
gtagttgacaataaatttag

SEQ ID NO: 482108 - DNA, 20 bp, Artificial Sequence
  chemically synthesized
gggagatcagttaggcagaa

SEQ ID NO: 482109 - DNA, 20 bp, Artificial Sequence
  chemically synthesized
taaggttccttcaacatgcc

SEQ ID NO: 482110 - DNA, 20 bp, Artificial Sequence
  chemically synthesized
aagttaaaatgccccaaagc

SEQ ID NO: 482111 - DNA, 20 bp, Artificial Sequence
  chemically synthesized
ggggggaaaaagtagtccag

SEQ ID NO: 482112 - DNA, 20 bp, Artificial Sequence
  chemically synthesized
aagcaaattctaaaagacct

SEQ ID NO: 482113 - DNA, 20 bp, Artificial Sequence
  chemically synthesized
gcccacatcctcaggtcttt

SEQ ID NO: 482114 - DNA, 20 bp, Artificial Sequence
  chemically synthesized
gagagagagggaggtggaag

SEQ ID NO: 482115 - DNA, 20 bp, Artificial Sequence
  chemically synthesized
gtcttccaacttctgcttcc

SEQ ID NO: 482116 - DNA, 20 bp, Artificial Sequence
  chemically synthesized
tccaagaatataagctttat

SEQ ID NO: 482117 - DNA, 20 bp, Artificial Sequence
  chemically synthesized
acttcatacaaaagtatttg

SEQ ID NO: 482118 - DNA, 20 bp, Artificial Sequence
  chemically synthesized
cgatggcagatgatatttta

SEQ ID NO: 482119 - DNA, 20 bp, Artificial Sequence
  chemically synthesized
gttcccagaacaatattatc

SEQ ID NO: 482120 - DNA, 20 bp, Artificial Sequence
  chemically synthesized
atattgttctgggaaccaag

SEQ ID NO: 482121 - DNA, 20 bp, Artificial Sequence
  chemically synthesized
gaggataaagttttgattag

SEQ ID NO: 482122 - DNA, 20 bp, Artificial Sequence
  chemically synthesized
tgattagcagagttgaccaa

SEQ ID NO: 482123 - DNA, 20 bp, Artificial Sequence
  chemically synthesized
aaatatagtcaagaagatgg

SEQ ID NO: 482124 - DNA, 20 bp, Artificial Sequence
  chemically synthesized
tggtgctggggaagtgagac

SEQ ID NO: 482125 - DNA, 20 bp, Artificial Sequence
  chemically synthesized
gctggggaagtgagactgga

SEQ ID NO: 482126 - DNA, 20 bp, Artificial Sequence
  chemically synthesized
gtaagcagaagcaagtacag

SEQ ID NO: 482127 - DNA, 20 bp, Artificial Sequence
  chemically synthesized
atatactaaaaaagttctct

SEQ ID NO: 482128 - DNA, 20 bp, Artificial Sequence
  chemically synthesized
tctcttaggatgagggagac

SEQ ID NO: 482129 - DNA, 20 bp, Artificial Sequence
  chemically synthesized
gagcaaaaagaaagaagaaa

SEQ ID NO: 482130 - DNA, 20 bp, Artificial Sequence
  chemically synthesized
ttattctactttcctttttt

SEQ ID NO: 482131 - DNA, 20 bp, Artificial Sequence
  chemically synthesized
atatcccaaaaaaaggaaag

SEQ ID NO: 482132 - DNA, 20 bp, Artificial Sequence
  chemically synthesized
attactaaaacaacatgttg

SEQ ID NO: 482133 - DNA, 20 bp, Artificial Sequence
  chemically synthesized
aaagagatctagtgtttaac

SEQ ID NO: 482134 - DNA, 20 bp, Artificial Sequence
  chemically synthesized
atgaagatgagaaaggacct

SEQ ID NO: 482135 - DNA, 20 bp, Artificial Sequence
  chemically synthesized
gacctaggaatagagaagca

SEQ ID NO: 482136 - DNA, 20 bp, Artificial Sequence
  chemically synthesized
aaacagtattataaagaaca

SEQ ID NO: 482137 - DNA, 20 bp, Artificial Sequence
  chemically synthesized
catgtacacacatgtacatg

SEQ ID NO: 482138 - DNA, 20 bp, Artificial Sequence
  chemically synthesized
gaatctttcttagaacctag

SEQ ID NO: 482139 - DNA, 20 bp, Artificial Sequence
  chemically synthesized
aggagatggtccttgcatca

SEQ ID NO: 482140 - DNA, 20 bp, Artificial Sequence
  chemically synthesized
aggaccatctcctctgcttg

SEQ ID NO: 482141 - DNA, 20 bp, Artificial Sequence
  chemically synthesized
acagctacaagcagacaatt

SEQ ID NO: 482142 - DNA, 20 bp, Artificial Sequence
  chemically synthesized
acaagaaataagcattaact

SEQ ID NO: 482143 - DNA, 20 bp, Artificial Sequence
  chemically synthesized
taatgcttatttcttgttta

SEQ ID NO: 482144 - DNA, 20 bp, Artificial Sequence
  chemically synthesized
tcatttccttatttctgttc

SEQ ID NO: 482145 - DNA, 20 bp, Artificial Sequence
  chemically synthesized
aattattgtgagaagcctct

SEQ ID NO: 482146 - DNA, 20 bp, Artificial Sequence
  chemically synthesized
ctgtgaatagatatgagttt

SEQ ID NO: 482147 - DNA, 20 bp, Artificial Sequence
  chemically synthesized
ttcaatctctgtgaatagat

SEQ ID NO: 482148 - DNA, 20 bp, Artificial Sequence
  chemically synthesized
tttctttgtcttcaatctct

SEQ ID NO: 482149 - DNA, 20 bp, Artificial Sequence
  chemically synthesized
tttccttatcgtagtcctta

SEQ ID NO: 482150 - DNA, 20 bp, Artificial Sequence
  chemically synthesized
acaataatctatgttcagat

SEQ ID NO: 482151 - DNA, 20 bp, Artificial Sequence
  chemically synthesized
tttttacttgccattttata

SEQ ID NO: 482152 - DNA, 20 bp, Artificial Sequence
  chemically synthesized
gatcatatcaaaagccactg

SEQ ID NO: 482153 - DNA, 20 bp, Artificial Sequence
  chemically synthesized
taagtttattaatacatcag

SEQ ID NO: 482154 - DNA, 20 bp, Artificial Sequence
  chemically synthesized
aaatctttagttttaaactg

SEQ ID NO: 482155 - DNA, 20 bp, Artificial Sequence
  chemically synthesized
caaaatttttgtacacttgg

SEQ ID NO: 482156 - DNA, 20 bp, Artificial Sequence
  chemically synthesized
tgtaatcagaaaactttcca

SEQ ID NO: 482157 - DNA, 20 bp, Artificial Sequence
  chemically synthesized
actatagctttttaggtagg

SEQ ID NO: 482158 - DNA, 20 bp, Artificial Sequence
  chemically synthesized
aagattaataatgtcaatat

SEQ ID NO: 482159 - DNA, 20 bp, Artificial Sequence
  chemically synthesized
attaatctttcctttttaag

SEQ ID NO: 482160 - DNA, 20 bp, Artificial Sequence
  chemically synthesized
ctcaaaaactacaactatga

SEQ ID NO: 482161 - DNA, 20 bp, Artificial Sequence
  chemically synthesized
tgagaccaacacaaatacca

SEQ ID NO: 482162 - DNA, 20 bp, Artificial Sequence
  chemically synthesized
atactacgtagccataaaaa

SEQ ID NO: 482163 - DNA, 20 bp, Artificial Sequence
  chemically synthesized
tgtcctttgcagggacatag

SEQ ID NO: 482164 - DNA, 20 bp, Artificial Sequence
  chemically synthesized
cccacttataaatgagaaca

SEQ ID NO: 482165 - DNA, 20 bp, Artificial Sequence
  chemically synthesized
caacacatgctagggactat

SEQ ID NO: 482166 - DNA, 20 bp, Artificial Sequence
  chemically synthesized
ctagggactattagagtgtg

SEQ ID NO: 482167 - DNA, 20 bp, Artificial Sequence
  chemically synthesized
gtggagggtgggaggagcga

SEQ ID NO: 482168 - DNA, 20 bp, Artificial Sequence
  chemically synthesized
aggatcaggaaagtcaacta

SEQ ID NO: 482169 - DNA, 20 bp, Artificial Sequence
  chemically synthesized
gaaagtcaactaacgggtac

SEQ ID NO: 482170 - DNA, 20 bp, Artificial Sequence
  chemically synthesized
cataggtaaacttgtgtcat

SEQ ID NO: 482171 - DNA, 20 bp, Artificial Sequence
  chemically synthesized
attttttcacttttaagttc

SEQ ID NO: 482172 - DNA, 20 bp, Artificial Sequence
  chemically synthesized
cataaatgggttaagcagtt

SEQ ID NO: 482173 - DNA, 20 bp, Artificial Sequence
  chemically synthesized
aattgcaaccttaggcataa

SEQ ID NO: 482174 - DNA, 20 bp, Artificial Sequence
  chemically synthesized
atgcctaaggttgcaatttt

SEQ ID NO: 482175 - DNA, 20 bp, Artificial Sequence
  chemically synthesized
ttggtgaggaccttgaacag

SEQ ID NO: 482176 - DNA, 20 bp, Artificial Sequence
  chemically synthesized
tattggaatactaagcatgt

SEQ ID NO: 482177 - DNA, 20 bp, Artificial Sequence
  chemically synthesized
ttatcctagtgttccattat

SEQ ID NO: 482178 - DNA, 20 bp, Artificial Sequence
  chemically synthesized
gtattccaataatggaacac

SEQ ID NO: 482179 - DNA, 20 bp, Artificial Sequence
  chemically synthesized
ggtggttacctgatgctggg

SEQ ID NO: 482180 - DNA, 20 bp, Artificial Sequence
  chemically synthesized
acctgatgctgggaagggta

SEQ ID NO: 482181 - DNA, 20 bp, Artificial Sequence
  chemically synthesized
ctgggaagggtagggggtga

SEQ ID NO: 482182 - DNA, 20 bp, Artificial Sequence
  chemically synthesized
ccatctctgagcctgcaaaa

SEQ ID NO: 482183 - DNA, 20 bp, Artificial Sequence
  chemically synthesized
ttgcaggctcagagatggaa

SEQ ID NO: 482184 - DNA, 20 bp, Artificial Sequence
  chemically synthesized
ggaagggaatttgcctcacg

SEQ ID NO: 482185 - DNA, 20 bp, Artificial Sequence
  chemically synthesized
gcctcacgatgaattgtgcc

SEQ ID NO: 482186 - DNA, 20 bp, Artificial Sequence
  chemically synthesized
caatctaatataaattagat

SEQ ID NO: 482187 - DNA, 20 bp, Artificial Sequence
  chemically synthesized
atttatattagattgcactt

SEQ ID NO: 482188 - DNA, 20 bp, Artificial Sequence
  chemically synthesized
aataagatttttggggcttt

SEQ ID NO: 482189 - DNA, 20 bp, Artificial Sequence
  chemically synthesized
tttggggctttggggatgaa

SEQ ID NO: 482190 - DNA, 20 bp, Artificial Sequence
  chemically synthesized
attttgtctttgagaagaac

SEQ ID NO: 482191 - DNA, 20 bp, Artificial Sequence
  chemically synthesized
gaattttggggaaaaggggg

SEQ ID NO: 482192 - DNA, 20 bp, Artificial Sequence
  chemically synthesized
tgaaggctctgccttcatga

SEQ ID NO: 482193 - DNA, 20 bp, Artificial Sequence
  chemically synthesized
cggattagcatcattattgt

SEQ ID NO: 482194 - DNA, 20 bp, Artificial Sequence
  chemically synthesized
ttagcatcattattgtggga

SEQ ID NO: 482195 - DNA, 20 bp, Artificial Sequence
  chemically synthesized
tggtcttccaccttccatca

SEQ ID NO: 482196 - DNA, 20 bp, Artificial Sequence
  chemically synthesized
gaagtccaagatcaaggggc

SEQ ID NO: 482197 - DNA, 20 bp, Artificial Sequence
  chemically synthesized
ctgggtaatttataatgaac

SEQ ID NO: 482198 - DNA, 20 bp, Artificial Sequence
  chemically synthesized
ccgtaacaaaataccacaga

SEQ ID NO: 482199 - DNA, 20 bp, Artificial Sequence
  chemically synthesized
gagattggaagaaggcaaag

SEQ ID NO: 482200 - DNA, 20 bp, Artificial Sequence
  chemically synthesized
ttaacatcgaaagaaagcag

SEQ ID NO: 482201 - DNA, 20 bp, Artificial Sequence
  chemically synthesized
ttccagctgagaatgatctt

SEQ ID NO: 482202 - DNA, 20 bp, Artificial Sequence
  chemically synthesized
ctcaaaagatcattctcagc

SEQ ID NO: 482203 - DNA, 20 bp, Artificial Sequence
  chemically synthesized
acccatctataattccagct

SEQ ID NO: 482204 - DNA, 20 bp, Artificial Sequence
  chemically synthesized
attctcagctggaattatag

SEQ ID NO: 482205 - DNA, 20 bp, Artificial Sequence
  chemically synthesized
aacagactgaaactacacaa

SEQ ID NO: 482206 - DNA, 20 bp, Artificial Sequence
  chemically synthesized
gactgaaactacacaagtgg

SEQ ID NO: 482207 - DNA, 20 bp, Artificial Sequence
  chemically synthesized
caagtggatgaattcttgca

SEQ ID NO: 482208 - DNA, 20 bp, Artificial Sequence
  chemically synthesized
acttcacatgtactctttgc

SEQ ID NO: 482209 - DNA, 20 bp, Artificial Sequence
  chemically synthesized
cagggaagaactttatagac

SEQ ID NO: 482210 - DNA, 20 bp, Artificial Sequence
  chemically synthesized
catgagtcagaagtagcttg

SEQ ID NO: 482211 - DNA, 20 bp, Artificial Sequence
  chemically synthesized
actcacatttttagcctgta

SEQ ID NO: 482212 - DNA, 20 bp, Artificial Sequence
  chemically synthesized
attctgtacaggctaaaaat

SEQ ID NO: 482213 - DNA, 20 bp, Artificial Sequence
  chemically synthesized
cccctatgggtaaagtaaat

SEQ ID NO: 482214 - DNA, 20 bp, Artificial Sequence
  chemically synthesized
tgcatatacttacttcccct

SEQ ID NO: 482215 - DNA, 20 bp, Artificial Sequence
  chemically synthesized
ttccaaaaagctatcagcta

SEQ ID NO: 482216 - DNA, 20 bp, Artificial Sequence
  chemically synthesized
aactggaagtcattcccatg

SEQ ID NO: 482217 - DNA, 20 bp, Artificial Sequence
  chemically synthesized
aaggtctctggattcttcat

SEQ ID NO: 482218 - DNA, 20 bp, Artificial Sequence
  chemically synthesized
aaattgttttatcaaggtct

SEQ ID NO: 482219 - DNA, 20 bp, Artificial Sequence
  chemically synthesized
acaattttttaaaaaactga

SEQ ID NO: 482220 - DNA, 20 bp, Artificial Sequence
  chemically synthesized
cttgggccatcaaggagcat

SEQ ID NO: 482221 - DNA, 20 bp, Artificial Sequence
  chemically synthesized
aggagcatgagaatgaagag

SEQ ID NO: 482222 - DNA, 20 bp, Artificial Sequence
  chemically synthesized
gaagagaggggtctgtcaga

SEQ ID NO: 482223 - DNA, 20 bp, Artificial Sequence
  chemically synthesized
taaagtcagagattaatttg

SEQ ID NO: 482224 - DNA, 20 bp, Artificial Sequence
  chemically synthesized
catggaatcaattggtatca

SEQ ID NO: 482225 - DNA, 20 bp, Artificial Sequence
  chemically synthesized
ctgataccaattgattccat

SEQ ID NO: 482226 - DNA, 20 bp, Artificial Sequence
  chemically synthesized
ttcaggaagaattattcaca

SEQ ID NO: 482227 - DNA, 20 bp, Artificial Sequence
  chemically synthesized
agggacagattaggttcagg

SEQ ID NO: 482228 - DNA, 20 bp, Artificial Sequence
  chemically synthesized
tgagaaaaagtagttactat

SEQ ID NO: 482229 - DNA, 20 bp, Artificial Sequence
  chemically synthesized
ctggtggagaaagggcaaac

SEQ ID NO: 482230 - DNA, 20 bp, Artificial Sequence
  chemically synthesized
caagtttgccctttctccac

SEQ ID NO: 482231 - DNA, 20 bp, Artificial Sequence
  chemically synthesized
taaaacttcccaactttagg

SEQ ID NO: 482232 - DNA, 20 bp, Artificial Sequence
  chemically synthesized
ccatctatacacctactgtc

SEQ ID NO: 482233 - DNA, 20 bp, Artificial Sequence
  chemically synthesized
tacacctactgtctggaatt

SEQ ID NO: 482234 - DNA, 20 bp, Artificial Sequence
  chemically synthesized
tactgtctggaattcaggat

SEQ ID NO: 482235 - DNA, 20 bp, Artificial Sequence
  chemically synthesized
ggaatagagcaactctaatc

SEQ ID NO: 482236 - DNA, 20 bp, Artificial Sequence
  chemically synthesized
attagagttgctctattccc

SEQ ID NO: 482237 - DNA, 20 bp, Artificial Sequence
  chemically synthesized
aatttaagctggtcaccctg

SEQ ID NO: 482238 - DNA, 20 bp, Artificial Sequence
  chemically synthesized
cagcttaaattcagcttcac

SEQ ID NO: 482239 - DNA, 20 bp, Artificial Sequence
  chemically synthesized
gagtaaaaactcctgtgaag

SEQ ID NO: 482240 - DNA, 20 bp, Artificial Sequence
  chemically synthesized
tgaaactgagctagacatta

SEQ ID NO: 482241 - DNA, 20 bp, Artificial Sequence
  chemically synthesized
gccaaaacagattttgaact

SEQ ID NO: 482242 - DNA, 20 bp, Artificial Sequence
  chemically synthesized
aagaccacggtgaaaaataa

SEQ ID NO: 482243 - DNA, 20 bp, Artificial Sequence
  chemically synthesized
gtaattgtacattctgcaaa

SEQ ID NO: 482244 - DNA, 20 bp, Artificial Sequence
  chemically synthesized
ttgaatgatgactccctttg

SEQ ID NO: 482245 - DNA, 20 bp, Artificial Sequence
  chemically synthesized
agggagctagtaaatgtttt

SEQ ID NO: 482246 - DNA, 20 bp, Artificial Sequence
  chemically synthesized
tatcacgtggttcaggacct

SEQ ID NO: 482247 - DNA, 20 bp, Artificial Sequence
  chemically synthesized
tttatatttttatttatgat

SEQ ID NO: 482248 - DNA, 20 bp, Artificial Sequence
  chemically synthesized
gagatcaagagaggtataat

SEQ ID NO: 482249 - DNA, 20 bp, Artificial Sequence
  chemically synthesized
cacttcatttcccattatat

SEQ ID NO: 482250 - DNA, 20 bp, Artificial Sequence
  chemically synthesized
atataatgggaaatgaagtg

SEQ ID NO: 482251 - DNA, 20 bp, Artificial Sequence
  chemically synthesized
gccctccacaaattttccca

SEQ ID NO: 482252 - DNA, 20 bp, Artificial Sequence
  chemically synthesized
aaattttcccattgggtgtg

SEQ ID NO: 482253 - DNA, 20 bp, Artificial Sequence
  chemically synthesized
gggtgtgtggagtgagatac

SEQ ID NO: 482254 - DNA, 20 bp, Artificial Sequence
  chemically synthesized
tgtacagctataactctatc

SEQ ID NO: 482255 - DNA, 20 bp, Artificial Sequence
  chemically synthesized
agtcactttgggattcatga

SEQ ID NO: 482256 - DNA, 20 bp, Artificial Sequence
  chemically synthesized
atctgataaataagtcactt

SEQ ID NO: 482257 - DNA, 20 bp, Artificial Sequence
  chemically synthesized
tgagatagaaagatattcct

SEQ ID NO: 482258 - DNA, 20 bp, Artificial Sequence
  chemically synthesized
tagaaagatattcctttgga

SEQ ID NO: 482259 - DNA, 20 bp, Artificial Sequence
  chemically synthesized
actttgataactctatccaa

SEQ ID NO: 482260 - DNA, 20 bp, Artificial Sequence
  chemically synthesized
tagaagtctgagccaagtcc

SEQ ID NO: 482261 - DNA, 20 bp, Artificial Sequence
  chemically synthesized
ccagctaaactggagcttgg

SEQ ID NO: 482262 - DNA, 20 bp, Artificial Sequence
  chemically synthesized
cctcccaagctccagtttag

SEQ ID NO: 482263 - DNA, 20 bp, Artificial Sequence
  chemically synthesized
ggtgaaactggatggaccat

SEQ ID NO: 482264 - DNA, 20 bp, Artificial Sequence
  chemically synthesized
gtaataatggggtggtgaaa

SEQ ID NO: 482265 - DNA, 20 bp, Artificial Sequence
  chemically synthesized
actactgttggctgtaataa

SEQ ID NO: 482266 - DNA, 20 bp, Artificial Sequence
  chemically synthesized
taatgtaattcatacctttt

SEQ ID NO: 482267 - DNA, 20 bp, Artificial Sequence
  chemically synthesized
gagaagcattcataaaaggt

SEQ ID NO: 482268 - DNA, 20 bp, Artificial Sequence
  chemically synthesized
gaaaagtccacatgataaca

SEQ ID NO: 482269 - DNA, 20 bp, Artificial Sequence
  chemically synthesized
gacttttctggtatcatctg

SEQ ID NO: 482270 - DNA, 20 bp, Artificial Sequence
  chemically synthesized
acttggccctgaaacttctc

SEQ ID NO: 482271 - DNA, 20 bp, Artificial Sequence
  chemically synthesized
ctatagatttttatgagaaa

SEQ ID NO: 482272 - DNA, 20 bp, Artificial Sequence
  chemically synthesized
agatttttatgagaaagaga

SEQ ID NO: 482273 - DNA, 20 bp, Artificial Sequence
  chemically synthesized
ttttttatgaaatctctagt

SEQ ID NO: 482274 - DNA, 20 bp, Artificial Sequence
  chemically synthesized
aaatacttcgtaaacagctt

SEQ ID NO: 482275 - DNA, 20 bp, Artificial Sequence
  chemically synthesized
cagcttctgaatcctcaggt

SEQ ID NO: 482276 - DNA, 20 bp, Artificial Sequence
  chemically synthesized
taatatatgtattctgacct

SEQ ID NO: 482277 - DNA, 20 bp, Artificial Sequence
  chemically synthesized
tgaaaagtttgtcctgaaag

SEQ ID NO: 482278 - DNA, 20 bp, Artificial Sequence
  chemically synthesized
aataagctcatatataattg

SEQ ID NO: 482279 - DNA, 20 bp, Artificial Sequence
  chemically synthesized
tttccctcttcattaacttg

SEQ ID NO: 482280 - DNA, 20 bp, Artificial Sequence
  chemically synthesized
cagaaaatattgaacaacaa

SEQ ID NO: 482281 - DNA, 20 bp, Artificial Sequence
  chemically synthesized
atagtactgttattctagtc

SEQ ID NO: 482282 - DNA, 20 bp, Artificial Sequence
  chemically synthesized
tccttcaaaaaattcgtgac

SEQ ID NO: 482283 - DNA, 20 bp, Artificial Sequence
  chemically synthesized
ttctagtcacgaattttttg

SEQ ID NO: 482284 - DNA, 20 bp, Artificial Sequence
  chemically synthesized
ttgaaggatcaaaatacttt

SEQ ID NO: 482285 - DNA, 20 bp, Artificial Sequence
  chemically synthesized
tagaaaaaaagtcaaaatat

SEQ ID NO: 482286 - DNA, 20 bp, Artificial Sequence
  chemically synthesized
agatagcaagtttgaaaaca

SEQ ID NO: 482287 - DNA, 20 bp, Artificial Sequence
  chemically synthesized
gatagttatatcaaattcaa

SEQ ID NO: 482288 - DNA, 20 bp, Artificial Sequence
  chemically synthesized
gttatatcaaattcaatagg

SEQ ID NO: 482289 - DNA, 20 bp, Artificial Sequence
  chemically synthesized
caatgacttaacccatccta

SEQ ID NO: 482290 - DNA, 20 bp, Artificial Sequence
  chemically synthesized
agtcattgataaatggacac

SEQ ID NO: 482291 - DNA, 20 bp, Artificial Sequence
  chemically synthesized
caggtagttcaaacaagaga

SEQ ID NO: 482292 - DNA, 20 bp, Artificial Sequence
  chemically synthesized
agttcaaacaagagaaagag

SEQ ID NO: 482293 - DNA, 20 bp, Artificial Sequence
  chemically synthesized
aactttcaagtaataaaaaa

SEQ ID NO: 482294 - DNA, 20 bp, Artificial Sequence
  chemically synthesized
ttttactggtcttttcagct

SEQ ID NO: 482295 - DNA, 20 bp, Artificial Sequence
  chemically synthesized
acggtccccagcagtaatac

SEQ ID NO: 482296 - DNA, 20 bp, Artificial Sequence
  chemically synthesized
agtgagattattgagtcaat

SEQ ID NO: 482297 - DNA, 20 bp, Artificial Sequence
  chemically synthesized
aagtaccaaaagtgagatta

SEQ ID NO: 482298 - DNA, 20 bp, Artificial Sequence
  chemically synthesized
tcttcttttgaagattttat

SEQ ID NO: 482299 - DNA, 20 bp, Artificial Sequence
  chemically synthesized
gtaaaaaaatgagaaacagg

SEQ ID NO: 482300 - DNA, 20 bp, Artificial Sequence
  chemically synthesized
gccttggcctccctaagtgc

SEQ ID NO: 482301 - DNA, 20 bp, Artificial Sequence
  chemically synthesized
cagcacttagggaggccaag

SEQ ID NO: 482302 - DNA, 20 bp, Artificial Sequence
  chemically synthesized
acttagggaggccaaggcgg

SEQ ID NO: 482303 - DNA, 20 bp, Artificial Sequence
  chemically synthesized
ggcgggtggatcacgaggtc

SEQ ID NO: 482304 - DNA, 20 bp, Artificial Sequence
  chemically synthesized
actaaaaatataaaaattag

SEQ ID NO: 482305 - DNA, 20 bp, Artificial Sequence
  chemically synthesized
gcctcagcctcccgagtagc

SEQ ID NO: 482306 - DNA, 20 bp, Artificial Sequence
  chemically synthesized
caattctctgcctcagcctc

SEQ ID NO: 482307 - DNA, 20 bp, Artificial Sequence
  chemically synthesized
ctactcgggaggctgaggca

SEQ ID NO: 482308 - DNA, 20 bp, Artificial Sequence
  chemically synthesized
ctcactgcaacttccatctc

SEQ ID NO: 482309 - DNA, 20 bp, Artificial Sequence
  chemically synthesized
tctcactctgtcgcccaggc

SEQ ID NO: 482310 - DNA, 20 bp, Artificial Sequence
  chemically synthesized
ctgcactccagcctgggcga

SEQ ID NO: 482311 - DNA, 20 bp, Artificial Sequence
  chemically synthesized
ttttttttttttttccgaga

SEQ ID NO: 482312 - DNA, 20 bp, Artificial Sequence
  chemically synthesized
tttgctacatattggaccat

SEQ ID NO: 482313 - DNA, 20 bp, Artificial Sequence
  chemically synthesized
actacactgtgtttatctct

SEQ ID NO: 482314 - DNA, 20 bp, Artificial Sequence
  chemically synthesized
ttgcgttagtatgatattta

SEQ ID NO: 482315 - DNA, 20 bp, Artificial Sequence
  chemically synthesized
atagattgtatatgttcaat

SEQ ID NO: 482316 - DNA, 20 bp, Artificial Sequence
  chemically synthesized
ctcagttaactaaaacatcc

SEQ ID NO: 482317 - DNA, 20 bp, Artificial Sequence
  chemically synthesized
actattacttggtttgattc

SEQ ID NO: 482318 - DNA, 20 bp, Artificial Sequence
  chemically synthesized
cttgataatagtttggtaat

SEQ ID NO: 482319 - DNA, 20 bp, Artificial Sequence
  chemically synthesized
acaattaacatttatccgcg

SEQ ID NO: 482320 - DNA, 20 bp, Artificial Sequence
  chemically synthesized
agaaaaggcaggcattccac

SEQ ID NO: 482321 - DNA, 20 bp, Artificial Sequence
  chemically synthesized
aaactgtaatgcttgataaa

SEQ ID NO: 482322 - DNA, 20 bp, Artificial Sequence
  chemically synthesized
gtgcgaggatctgaaaagtg

SEQ ID NO: 482323 - DNA, 20 bp, Artificial Sequence
  chemically synthesized
gaagggctttcaaatagtgc

SEQ ID NO: 482324 - DNA, 20 bp, Artificial Sequence
  chemically synthesized
tgccttttctagaaatatcc

SEQ ID NO: 482325 - DNA, 20 bp, Artificial Sequence
  chemically synthesized
gaagtggtaattttgtaccc

SEQ ID NO: 482326 - DNA, 20 bp, Artificial Sequence
  chemically synthesized
ttacatgttctttcgtatct

SEQ ID NO: 482327 - DNA, 20 bp, Artificial Sequence
  chemically synthesized
taattggcccttagtatcca

SEQ ID NO: 482328 - DNA, 20 bp, Artificial Sequence
  chemically synthesized
taaaatgcaaatagcaccct

SEQ ID NO: 482329 - DNA, 20 bp, Artificial Sequence
  chemically synthesized
aagttattggtctcagtttt

SEQ ID NO: 482330 - DNA, 20 bp, Artificial Sequence
  chemically synthesized
cttggttacctttttttcaa

SEQ ID NO: 482331 - DNA, 20 bp, Artificial Sequence
  chemically synthesized
acaattcagtgttttataaa

SEQ ID NO: 482332 - DNA, 20 bp, Artificial Sequence
  chemically synthesized
tgaattccttttataaaaca

SEQ ID NO: 482333 - DNA, 20 bp, Artificial Sequence
  chemically synthesized
gagcatatatgtaaaagctc

SEQ ID NO: 482334 - DNA, 20 bp, Artificial Sequence
  chemically synthesized
tccaaggttatttaacttgc

SEQ ID NO: 482335 - DNA, 20 bp, Artificial Sequence
  chemically synthesized
caaacaggaacctatgagtg

SEQ ID NO: 482336 - DNA, 20 bp, Artificial Sequence
  chemically synthesized
gacttttcaaacaggaacct

SEQ ID NO: 482337 - DNA, 20 bp, Artificial Sequence
  chemically synthesized
gatataagaggttataccat

SEQ ID NO: 482338 - DNA, 20 bp, Artificial Sequence
  chemically synthesized
tataccatttggatggtttc

SEQ ID NO: 482339 - DNA, 20 bp, Artificial Sequence
  chemically synthesized
ataaaatgcagaaggtgcca

SEQ ID NO: 482340 - DNA, 20 bp, Artificial Sequence
  chemically synthesized
ttataaattataacatatcc

SEQ ID NO: 482341 - DNA, 20 bp, Artificial Sequence
  chemically synthesized
tcagagattttggaaaattc

SEQ ID NO: 482342 - DNA, 20 bp, Artificial Sequence
  chemically synthesized
ctctgaaagaaatagtaagc

SEQ ID NO: 482343 - DNA, 20 bp, Artificial Sequence
  chemically synthesized
tcctactaaacaaggtagta

SEQ ID NO: 482344 - DNA, 20 bp, Artificial Sequence
  chemically synthesized
taacagtcctaactttcgct

SEQ ID NO: 482345 - DNA, 20 bp, Artificial Sequence
  chemically synthesized
tatacctaaggaaatcttga

SEQ ID NO: 482346 - DNA, 20 bp, Artificial Sequence
  chemically synthesized
tgactgagtgctaaccctca

SEQ ID NO: 482347 - DNA, 20 bp, Artificial Sequence
  chemically synthesized
aaacctgggcagtattcagt

SEQ ID NO: 482348 - DNA, 20 bp, Artificial Sequence
  chemically synthesized
gaatactgcccaggttttgt

SEQ ID NO: 482349 - DNA, 20 bp, Artificial Sequence
  chemically synthesized
gcccaggttttgtgaggatg

SEQ ID NO: 482350 - DNA, 20 bp, Artificial Sequence
  chemically synthesized
caatgtcagtcaaggtcagt

SEQ ID NO: 482351 - DNA, 20 bp, Artificial Sequence
  chemically synthesized
tcttaaagacattccccaca

SEQ ID NO: 482352 - DNA, 20 bp, Artificial Sequence
  chemically synthesized
aagggaaaacattctgtgtg

SEQ ID NO: 482353 - DNA, 20 bp, Artificial Sequence
  chemically synthesized
taaaacccaaggtgggcggg

SEQ ID NO: 482354 - DNA, 20 bp, Artificial Sequence
  chemically synthesized
taatattctgcccgcccacc

SEQ ID NO: 482355 - DNA, 20 bp, Artificial Sequence
  chemically synthesized
gttcctagtgtgaatgacac

SEQ ID NO: 482356 - DNA, 20 bp, Artificial Sequence
  chemically synthesized
tcaaggtcatggttcctagt

SEQ ID NO: 482357 - DNA, 20 bp, Artificial Sequence
  chemically synthesized
actgctgtgaaatttactac

SEQ ID NO: 482358 - DNA, 20 bp, Artificial Sequence
  chemically synthesized
tttacactccttctgaggtc

SEQ ID NO: 482359 - DNA, 20 bp, Artificial Sequence
  chemically synthesized
ggataactccagacctcaga

SEQ ID NO: 482360 - DNA, 20 bp, Artificial Sequence
  chemically synthesized
gtgtgaagtctgttgtattt

SEQ ID NO: 482361 - DNA, 20 bp, Artificial Sequence
  chemically synthesized
aatggaattcagaaagagaa

SEQ ID NO: 482362 - DNA, 20 bp, Artificial Sequence
  chemically synthesized
acacacacccttttctcttt

SEQ ID NO: 482363 - DNA, 20 bp, Artificial Sequence
  chemically synthesized
gtggtgtacaccattgtcaa

SEQ ID NO: 482364 - DNA, 20 bp, Artificial Sequence
  chemically synthesized
tgacaatggtgtacaccaca

SEQ ID NO: 482365 - DNA, 20 bp, Artificial Sequence
  chemically synthesized
atgtgtgtgtgttttctatg

SEQ ID NO: 482366 - DNA, 20 bp, Artificial Sequence
  chemically synthesized
ggttggggaaacaatctttt

SEQ ID NO: 482367 - DNA, 20 bp, Artificial Sequence
  chemically synthesized
gcagtagcagcataatgggt

SEQ ID NO: 482368 - DNA, 20 bp, Artificial Sequence
  chemically synthesized
catagtgcagtagcagcata

SEQ ID NO: 482369 - DNA, 20 bp, Artificial Sequence
  chemically synthesized
ctttttctacctaagatact

SEQ ID NO: 482370 - DNA, 20 bp, Artificial Sequence
  chemically synthesized
attgtggactatgagacaac

SEQ ID NO: 482371 - DNA, 20 bp, Artificial Sequence
  chemically synthesized
agacaacctgaattaatttc

SEQ ID NO: 482372 - DNA, 20 bp, Artificial Sequence
  chemically synthesized
ctgaattaatttcaagaatt

SEQ ID NO: 482373 - DNA, 20 bp, Artificial Sequence
  chemically synthesized
ctcctctcttttctaccatg

SEQ ID NO: 482374 - DNA, 20 bp, Artificial Sequence
  chemically synthesized
gaaaagagaggaggaagaga

SEQ ID NO: 482375 - DNA, 20 bp, Artificial Sequence
  chemically synthesized
tgagcaatacaatgagcctg

SEQ ID NO: 482376 - DNA, 20 bp, Artificial Sequence
  chemically synthesized
atacaatgagcctgctgggt

SEQ ID NO: 482377 - DNA, 20 bp, Artificial Sequence
  chemically synthesized
ttgccactaagcgatcacgc

SEQ ID NO: 482378 - DNA, 20 bp, Artificial Sequence
  chemically synthesized
gatcgcttagtggcaaatgg

SEQ ID NO: 482379 - DNA, 20 bp, Artificial Sequence
  chemically synthesized
agtttcctcctttgctaaat

SEQ ID NO: 482380 - DNA, 20 bp, Artificial Sequence
  chemically synthesized
ttatgtggaaatatgattag

SEQ ID NO: 482381 - DNA, 20 bp, Artificial Sequence
  chemically synthesized
tgattaggtgggttaactta

SEQ ID NO: 482382 - DNA, 20 bp, Artificial Sequence
  chemically synthesized
cacctttgtaaatgttctcc

SEQ ID NO: 482383 - DNA, 20 bp, Artificial Sequence
  chemically synthesized
aaaggtgcctggcgtgcccg

SEQ ID NO: 482384 - DNA, 20 bp, Artificial Sequence
  chemically synthesized
cacatctactactaatttta

SEQ ID NO: 482385 - DNA, 20 bp, Artificial Sequence
  chemically synthesized
cagaaggggctcacactgtg

SEQ ID NO: 482386 - DNA, 20 bp, Artificial Sequence
  chemically synthesized
ccccacagtgtgagcccctt

SEQ ID NO: 482387 - DNA, 20 bp, Artificial Sequence
  chemically synthesized
ccaagttaaagggagaattt

SEQ ID NO: 482388 - DNA, 20 bp, Artificial Sequence
  chemically synthesized
tttatcttccaagttaaagg

SEQ ID NO: 482389 - DNA, 20 bp, Artificial Sequence
  chemically synthesized
ctatcattaaaattttaagg

SEQ ID NO: 482390 - DNA, 20 bp, Artificial Sequence
  chemically synthesized
aacatttattttacttgtag

SEQ ID NO: 482391 - DNA, 20 bp, Artificial Sequence
  chemically synthesized
aagtaaaataaatgtttgtt

SEQ ID NO: 482392 - DNA, 20 bp, Artificial Sequence
  chemically synthesized
gaacttcaagaaaggcagtg

SEQ ID NO: 482393 - DNA, 20 bp, Artificial Sequence
  chemically synthesized
cagttttgtcatctgtaaac

SEQ ID NO: 482394 - DNA, 20 bp, Artificial Sequence
  chemically synthesized
ttgtcatctgtaaactagga

SEQ ID NO: 482395 - DNA, 20 bp, Artificial Sequence
  chemically synthesized
ttgctcggaaaattgtaaaa

SEQ ID NO: 482396 - DNA, 20 bp, Artificial Sequence
  chemically synthesized
ctttttgttcataagcatat

SEQ ID NO: 482397 - DNA, 20 bp, Artificial Sequence
  chemically synthesized
tgaacaaaaagttctacatg

SEQ ID NO: 482398 - DNA, 20 bp, Artificial Sequence
  chemically synthesized
gttggatttgttatttttcc

SEQ ID NO: 482399 - DNA, 20 bp, Artificial Sequence
  chemically synthesized
ttggttcatgaatgtaaata

SEQ ID NO: 482400 - DNA, 20 bp, Artificial Sequence
  chemically synthesized
gtatttacattcatgaacca

SEQ ID NO: 482401 - DNA, 20 bp, Artificial Sequence
  chemically synthesized
ttccatgaatcccttggttc

SEQ ID NO: 482402 - DNA, 20 bp, Artificial Sequence
  chemically synthesized
taacagagttaaatttttcc

SEQ ID NO: 482403 - DNA, 20 bp, Artificial Sequence
  chemically synthesized
acctcttggtggttagctaa

SEQ ID NO: 482404 - DNA, 20 bp, Artificial Sequence
  chemically synthesized
gagtaggaaatgggtagaga

SEQ ID NO: 482405 - DNA, 20 bp, Artificial Sequence
  chemically synthesized
agtggagtaggaaatgggta

SEQ ID NO: 482406 - DNA, 20 bp, Artificial Sequence
  chemically synthesized
aatactgagtggagtaggaa

SEQ ID NO: 482407 - DNA, 20 bp, Artificial Sequence
  chemically synthesized
tagtacatctcaatactgag

SEQ ID NO: 482408 - DNA, 20 bp, Artificial Sequence
  chemically synthesized
ggagttagtacatctcaata

SEQ ID NO: 482409 - DNA, 20 bp, Artificial Sequence
  chemically synthesized
aggaaattctgacctcctat

SEQ ID NO: 482410 - DNA, 20 bp, Artificial Sequence
  chemically synthesized
tactaactcccataggaggt

SEQ ID NO: 482411 - DNA, 20 bp, Artificial Sequence
  chemically synthesized
cataggaggtcagaatttcc

SEQ ID NO: 482412 - DNA, 20 bp, Artificial Sequence
  chemically synthesized
ggagacagaagagcatgaga

SEQ ID NO: 482413 - DNA, 20 bp, Artificial Sequence
  chemically synthesized
tgccaagacagagagagaag

SEQ ID NO: 482414 - DNA, 20 bp, Artificial Sequence
  chemically synthesized
aaggtctgcacagcaggtaa

SEQ ID NO: 482415 - DNA, 20 bp, Artificial Sequence
  chemically synthesized
cctgctgtgcagaccttaca

SEQ ID NO: 482416 - DNA, 20 bp, Artificial Sequence
  chemically synthesized
ctgtgcagaccttacattgg

SEQ ID NO: 482417 - DNA, 20 bp, Artificial Sequence
  chemically synthesized
aagcccagaaaccagaacca

SEQ ID NO: 482418 - DNA, 20 bp, Artificial Sequence
  chemically synthesized
tttcctgaagttgctaaact

SEQ ID NO: 482419 - DNA, 20 bp, Artificial Sequence
  chemically synthesized
cagaggacagtgaggcaacc

SEQ ID NO: 482420 - DNA, 20 bp, Artificial Sequence
  chemically synthesized
ggttgcctcactgtcctctg

SEQ ID NO: 482421 - DNA, 20 bp, Artificial Sequence
  chemically synthesized
cagaggactggctcctccat

SEQ ID NO: 482422 - DNA, 20 bp, Artificial Sequence
  chemically synthesized
ggaggagccagtcctctgta

SEQ ID NO: 482423 - DNA, 20 bp, Artificial Sequence
  chemically synthesized
aatttcctctgtttgaaata

SEQ ID NO: 482424 - DNA, 20 bp, Artificial Sequence
  chemically synthesized
ttctttcagttcgtgttgtc

SEQ ID NO: 482425 - DNA, 20 bp, Artificial Sequence
  chemically synthesized
tccccctgtggaattgtagg

SEQ ID NO: 482426 - DNA, 20 bp, Artificial Sequence
  chemically synthesized
atatattaaatttccccctg

SEQ ID NO: 482427 - DNA, 20 bp, Artificial Sequence
  chemically synthesized
cttcctctgagactagagag

SEQ ID NO: 482428 - DNA, 20 bp, Artificial Sequence
  chemically synthesized
atctgggcacccatctattc

SEQ ID NO: 482429 - DNA, 20 bp, Artificial Sequence
  chemically synthesized
ggaggaggatcccagaatag

SEQ ID NO: 482430 - DNA, 20 bp, Artificial Sequence
  chemically synthesized
gagtatgtggaggaggatcc

SEQ ID NO: 482431 - DNA, 20 bp, Artificial Sequence
  chemically synthesized
gagagagggagtatgtggag

SEQ ID NO: 482432 - DNA, 20 bp, Artificial Sequence
  chemically synthesized
ttggaacacacaaagagaga

SEQ ID NO: 482433 - DNA, 20 bp, Artificial Sequence
  chemically synthesized
cttctctagagacttcaaac

SEQ ID NO: 482434 - DNA, 20 bp, Artificial Sequence
  chemically synthesized
tgtgaaaggaaagaaaatga

SEQ ID NO: 482435 - DNA, 20 bp, Artificial Sequence
  chemically synthesized
gagtgaatatctgccttcta

SEQ ID NO: 482436 - DNA, 20 bp, Artificial Sequence
  chemically synthesized
tagtcaagttgagataatga

SEQ ID NO: 482437 - DNA, 20 bp, Artificial Sequence
  chemically synthesized
aatgtagtcaagttgagata

SEQ ID NO: 482438 - DNA, 20 bp, Artificial Sequence
  chemically synthesized
ttcatgaattggagagtggc

SEQ ID NO: 482439 - DNA, 20 bp, Artificial Sequence
  chemically synthesized
agcctgattttcatgaattg

SEQ ID NO: 482440 - DNA, 20 bp, Artificial Sequence
  chemically synthesized
atggcagaagcctgattttc

SEQ ID NO: 482441 - DNA, 20 bp, Artificial Sequence
  chemically synthesized
tttgccatagtgacttctgt

SEQ ID NO: 482442 - DNA, 20 bp, Artificial Sequence
  chemically synthesized
acagaagtcactatggcaaa

SEQ ID NO: 482443 - DNA, 20 bp, Artificial Sequence
  chemically synthesized
catggatacagggagaggta

SEQ ID NO: 482444 - DNA, 20 bp, Artificial Sequence
  chemically synthesized
agagttacttagcaaagggc

SEQ ID NO: 482445 - DNA, 20 bp, Artificial Sequence
  chemically synthesized
gtctttcgtaggaagaattt

SEQ ID NO: 482446 - DNA, 20 bp, Artificial Sequence
  chemically synthesized
ggcatgctgtctttcgtagg

SEQ ID NO: 482447 - DNA, 20 bp, Artificial Sequence
  chemically synthesized
cttgctttgcctaatcccag

SEQ ID NO: 482448 - DNA, 20 bp, Artificial Sequence
  chemically synthesized
tacttctagtaatatcccac

SEQ ID NO: 482449 - DNA, 20 bp, Artificial Sequence
  chemically synthesized
aggtaatggtgaagtgcaaa

SEQ ID NO: 482450 - DNA, 20 bp, Artificial Sequence
  chemically synthesized
tcactcattctcctcctgag

SEQ ID NO: 482451 - DNA, 20 bp, Artificial Sequence
  chemically synthesized
tagcctactcatctcaggag

SEQ ID NO: 482452 - DNA, 20 bp, Artificial Sequence
  chemically synthesized
ctactcatctcaggaggaga

SEQ ID NO: 482453 - DNA, 20 bp, Artificial Sequence
  chemically synthesized
tcttcatgttgcaggttgat

SEQ ID NO: 482454 - DNA, 20 bp, Artificial Sequence
  chemically synthesized
tcatgaattttcagcttggg

SEQ ID NO: 482455 - DNA, 20 bp, Artificial Sequence
  chemically synthesized
gcctttcatgaattttcagc

SEQ ID NO: 482456 - DNA, 20 bp, Artificial Sequence
  chemically synthesized
ataagcccatattgcctttc

SEQ ID NO: 482457 - DNA, 20 bp, Artificial Sequence
  chemically synthesized
agttaactattttcacaaat

SEQ ID NO: 482458 - DNA, 20 bp, Artificial Sequence
  chemically synthesized
taggcattggcttttggtaa

SEQ ID NO: 482459 - DNA, 20 bp, Artificial Sequence
  chemically synthesized
aaagcagagaacttcgagaa

SEQ ID NO: 482460 - DNA, 20 bp, Artificial Sequence
  chemically synthesized
gagaatacagaggcgaccaa

SEQ ID NO: 482461 - DNA, 20 bp, Artificial Sequence
  chemically synthesized
tttggtcgcctctgtattct

SEQ ID NO: 482462 - DNA, 20 bp, Artificial Sequence
  chemically synthesized
aaaaaaagcttgaacactca

SEQ ID NO: 482463 - DNA, 20 bp, Artificial Sequence
  chemically synthesized
tgttctccaaaattctgtct

SEQ ID NO: 482464 - DNA, 20 bp, Artificial Sequence
  chemically synthesized
atatcagattgatccagaga

SEQ ID NO: 482465 - DNA, 20 bp, Artificial Sequence
  chemically synthesized
ggaggcagggaacatactcc

SEQ ID NO: 482466 - DNA, 20 bp, Artificial Sequence
  chemically synthesized
acttatgatacaactaccca

SEQ ID NO: 482467 - DNA, 20 bp, Artificial Sequence
  chemically synthesized
tgtcaatggaagtagaagat

SEQ ID NO: 482468 - DNA, 20 bp, Artificial Sequence
  chemically synthesized
tgtaggtggaagggtggttt

SEQ ID NO: 482469 - DNA, 20 bp, Artificial Sequence
  chemically synthesized
acgcagttgtatgtaggtgg

SEQ ID NO: 482470 - DNA, 20 bp, Artificial Sequence
  chemically synthesized
caaagtcctaacctctctct

SEQ ID NO: 482471 - DNA, 20 bp, Artificial Sequence
  chemically synthesized
ctctttggattacaaggccc

SEQ ID NO: 482472 - DNA, 20 bp, Artificial Sequence
  chemically synthesized
atgaaagtgaatatgtaggt

SEQ ID NO: 482473 - DNA, 20 bp, Artificial Sequence
  chemically synthesized
gaagatatcaaaagatgaaa

SEQ ID NO: 482474 - DNA, 20 bp, Artificial Sequence
  chemically synthesized
tattctcatgtggacaatta

SEQ ID NO: 482475 - DNA, 20 bp, Artificial Sequence
  chemically synthesized
aattccataattgtccacat

SEQ ID NO: 482476 - DNA, 20 bp, Artificial Sequence
  chemically synthesized
gtgacatagctagtcagtga

SEQ ID NO: 482477 - DNA, 20 bp, Artificial Sequence
  chemically synthesized
attgaaatgaaacctgaatt

SEQ ID NO: 482478 - DNA, 20 bp, Artificial Sequence
  chemically synthesized
taactgaattgaaatgaaac

SEQ ID NO: 482479 - DNA, 20 bp, Artificial Sequence
  chemically synthesized
tggatgcataacttctttaa

SEQ ID NO: 482480 - DNA, 20 bp, Artificial Sequence
  chemically synthesized
ttttccttaaatttctttat

SEQ ID NO: 482481 - DNA, 20 bp, Artificial Sequence
  chemically synthesized
aagaaatttaaggaaaagga

SEQ ID NO: 482482 - DNA, 20 bp, Artificial Sequence
  chemically synthesized
tttattttaactgagctttg

SEQ ID NO: 482483 - DNA, 20 bp, Artificial Sequence
  chemically synthesized
tcactaaacaatttggtccc

SEQ ID NO: 482484 - DNA, 20 bp, Artificial Sequence
  chemically synthesized
taaacaatttggtcccaaga

SEQ ID NO: 482485 - DNA, 20 bp, Artificial Sequence
  chemically synthesized
tgtgcttctcttttcccaat

SEQ ID NO: 482486 - DNA, 20 bp, Artificial Sequence
  chemically synthesized
acaatttcttccctccttgt

SEQ ID NO: 482487 - DNA, 20 bp, Artificial Sequence
  chemically synthesized
acgacctataaaacctcttt

SEQ ID NO: 482488 - DNA, 20 bp, Artificial Sequence
  chemically synthesized
taatgtcagaggtttaatag

SEQ ID NO: 482489 - DNA, 20 bp, Artificial Sequence
  chemically synthesized
tagagtgttaccttctgaaa

SEQ ID NO: 482490 - DNA, 20 bp, Artificial Sequence
  chemically synthesized
cttaaatagtatgccctgta

SEQ ID NO: 482491 - DNA, 20 bp, Artificial Sequence
  chemically synthesized
tgtgttatcggccaacccat

SEQ ID NO: 482492 - DNA, 20 bp, Artificial Sequence
  chemically synthesized
cagaaaataatggaactcta

SEQ ID NO: 482493 - DNA, 20 bp, Artificial Sequence
  chemically synthesized
gtcttacatggcttcatgta

SEQ ID NO: 482494 - DNA, 20 bp, Artificial Sequence
  chemically synthesized
catttctcttccagctgctt

SEQ ID NO: 482495 - DNA, 20 bp, Artificial Sequence
  chemically synthesized
aaagagagagcccagataaa

SEQ ID NO: 482496 - DNA, 20 bp, Artificial Sequence
  chemically synthesized
ttctcagatgcctggggtag

SEQ ID NO: 482497 - DNA, 20 bp, Artificial Sequence
  chemically synthesized
actgacttttctcagatgcc

SEQ ID NO: 482498 - DNA, 20 bp, Artificial Sequence
  chemically synthesized
atctgagaaaagtcagttga

SEQ ID NO: 482499 - DNA, 20 bp, Artificial Sequence
  chemically synthesized
tcagttgagagggtgtagaa

SEQ ID NO: 482500 - DNA, 20 bp, Artificial Sequence
  chemically synthesized
ttgagagggtgtagaaatgg

SEQ ID NO: 482501 - DNA, 20 bp, Artificial Sequence
  chemically synthesized
ctgtcctctggcattgtttc

SEQ ID NO: 482502 - DNA, 20 bp, Artificial Sequence
  chemically synthesized
gctgaaaaaacgccattttc

SEQ ID NO: 482503 - DNA, 20 bp, Artificial Sequence
  chemically synthesized
agtctaccacaatatgctca

SEQ ID NO: 482504 - DNA, 20 bp, Artificial Sequence
  chemically synthesized
tcttctggcgtgaaaaggca

SEQ ID NO: 482505 - DNA, 20 bp, Artificial Sequence
  chemically synthesized
tggccattcctgagttcaat

SEQ ID NO: 482506 - DNA, 20 bp, Artificial Sequence
  chemically synthesized
tcggcattcccattgaactc

SEQ ID NO: 482507 - DNA, 20 bp, Artificial Sequence
  chemically synthesized
aaccagtcacatggccattc

SEQ ID NO: 482508 - DNA, 20 bp, Artificial Sequence
  chemically synthesized
ccttgcctctatgatcatga

SEQ ID NO: 482509 - DNA, 20 bp, Artificial Sequence
  chemically synthesized
gataccatcagccatggtcc

SEQ ID NO: 482510 - DNA, 20 bp, Artificial Sequence
  chemically synthesized
ccccgagtgactaagctaag

SEQ ID NO: 482511 - DNA, 20 bp, Artificial Sequence
  chemically synthesized
gtctacaacgaacatgtaac

SEQ ID NO: 482512 - DNA, 20 bp, Artificial Sequence
  chemically synthesized
tatgtgaaataaggtcatat

SEQ ID NO: 482513 - DNA, 20 bp, Artificial Sequence
  chemically synthesized
agatatgaccttatttcaca

SEQ ID NO: 482514 - DNA, 20 bp, Artificial Sequence
  chemically synthesized
ccaggactgtctggaggtat

SEQ ID NO: 482515 - DNA, 20 bp, Artificial Sequence
  chemically synthesized
tcctggaccaggaccagggc

SEQ ID NO: 482516 - DNA, 20 bp, Artificial Sequence
  chemically synthesized
tacctgtagttcagaaaaac

SEQ ID NO: 482517 - DNA, 20 bp, Artificial Sequence
  chemically synthesized
ctgaactacaggtaacatct

SEQ ID NO: 482518 - DNA, 20 bp, Artificial Sequence
  chemically synthesized
gataggcaggttctgtccta

SEQ ID NO: 482519 - DNA, 20 bp, Artificial Sequence
  chemically synthesized
atgggagcctccatcacaca

SEQ ID NO: 482520 - DNA, 20 bp, Artificial Sequence
  chemically synthesized
aaattatgcactttaagtgg

SEQ ID NO: 482521 - DNA, 20 bp, Artificial Sequence
  chemically synthesized
tttctggttcttaatgtatt

SEQ ID NO: 482522 - DNA, 20 bp, Artificial Sequence
  chemically synthesized
ataataatggttgcacaacc

SEQ ID NO: 482523 - DNA, 20 bp, Artificial Sequence
  chemically synthesized
gaaagggactgttaattggt

SEQ ID NO: 482524 - DNA, 20 bp, Artificial Sequence
  chemically synthesized
agtaaagactgaaggaggag

SEQ ID NO: 482525 - DNA, 20 bp, Artificial Sequence
  chemically synthesized
tcctcctccttcagtcttta

SEQ ID NO: 482526 - DNA, 20 bp, Artificial Sequence
  chemically synthesized
gtctttactggatgttttat

SEQ ID NO: 482527 - DNA, 20 bp, Artificial Sequence
  chemically synthesized
atgaatgtattgatacaatt

SEQ ID NO: 482528 - DNA, 20 bp, Artificial Sequence
  chemically synthesized
caatttggggtcttttgtga

SEQ ID NO: 482529 - DNA, 20 bp, Artificial Sequence
  chemically synthesized
ctcaaaaatatgctaagtga

SEQ ID NO: 482530 - DNA, 20 bp, Artificial Sequence
  chemically synthesized
atactgatatgcactgtaac

SEQ ID NO: 482531 - DNA, 20 bp, Artificial Sequence
  chemically synthesized
tgctaaataatattccattt

SEQ ID NO: 482532 - DNA, 20 bp, Artificial Sequence
  chemically synthesized
atgtcctctacatccaaaaa

SEQ ID NO: 482533 - DNA, 20 bp, Artificial Sequence
  chemically synthesized
acccaaatgtccatcagcta

SEQ ID NO: 482534 - DNA, 20 bp, Artificial Sequence
  chemically synthesized
attcattagctgatggacat

SEQ ID NO: 482535 - DNA, 20 bp, Artificial Sequence
  chemically synthesized
tttctgttcagcatacacct

SEQ ID NO: 482536 - DNA, 20 bp, Artificial Sequence
  chemically synthesized
gttcagcatacacctgggag

SEQ ID NO: 482537 - DNA, 20 bp, Artificial Sequence
  chemically synthesized
aatatttccaggagactggg

SEQ ID NO: 482538 - DNA, 20 bp, Artificial Sequence
  chemically synthesized
gtagtggtagggggaaaggg

SEQ ID NO: 482539 - DNA, 20 bp, Artificial Sequence
  chemically synthesized
gggaaagggggggatggcta

SEQ ID NO: 482540 - DNA, 20 bp, Artificial Sequence
  chemically synthesized
aatacaaaaatatagtttga

SEQ ID NO: 482541 - DNA, 20 bp, Artificial Sequence
  chemically synthesized
caaaaatatagtttgataga

SEQ ID NO: 482542 - DNA, 20 bp, Artificial Sequence
  chemically synthesized
tctagtatttgatagcacaa

SEQ ID NO: 482543 - DNA, 20 bp, Artificial Sequence
  chemically synthesized
ctacagtcaaaaaatttatt

SEQ ID NO: 482544 - DNA, 20 bp, Artificial Sequence
  chemically synthesized
aaagataattgcttgaggtg

SEQ ID NO: 482545 - DNA, 20 bp, Artificial Sequence
  chemically synthesized
acaatgtgtaacagtcacat

SEQ ID NO: 482546 - DNA, 20 bp, Artificial Sequence
  chemically synthesized
acagtaggtatatatattta

SEQ ID NO: 482547 - DNA, 20 bp, Artificial Sequence
  chemically synthesized
ttttttaatttttaattttt

SEQ ID NO: 482548 - DNA, 20 bp, Artificial Sequence
  chemically synthesized
ttgagaagatgaagaatgct

SEQ ID NO: 482549 - DNA, 20 bp, Artificial Sequence
  chemically synthesized
taacaagtgttgagaagatg

SEQ ID NO: 482550 - DNA, 20 bp, Artificial Sequence
  chemically synthesized
tttttgtattagccatccta

SEQ ID NO: 482551 - DNA, 20 bp, Artificial Sequence
  chemically synthesized
agatagtactttttacccac

SEQ ID NO: 482552 - DNA, 20 bp, Artificial Sequence
  chemically synthesized
attacaagtgaagaaacagt

SEQ ID NO: 482553 - DNA, 20 bp, Artificial Sequence
  chemically synthesized
gtcatttatcctttttgttg

SEQ ID NO: 482554 - DNA, 20 bp, Artificial Sequence
  chemically synthesized
actcataattcaacaacaaa

SEQ ID NO: 482555 - DNA, 20 bp, Artificial Sequence
  chemically synthesized
atcctttttgttgttgaatt

SEQ ID NO: 482556 - DNA, 20 bp, Artificial Sequence
  chemically synthesized
tttgataagatacttgtatc

SEQ ID NO: 482557 - DNA, 20 bp, Artificial Sequence
  chemically synthesized
caaatatttttacccattct

SEQ ID NO: 482558 - DNA, 20 bp, Artificial Sequence
  chemically synthesized
gggaaaagacaatcctcaga

SEQ ID NO: 482559 - DNA, 20 bp, Artificial Sequence
  chemically synthesized
gaaagggaaaagacaatcct

SEQ ID NO: 482560 - DNA, 20 bp, Artificial Sequence
  chemically synthesized
taagaaaatgtaggaataca

SEQ ID NO: 482561 - DNA, 20 bp, Artificial Sequence
  chemically synthesized
aaactcttctaagaaaatgt

SEQ ID NO: 482562 - DNA, 20 bp, Artificial Sequence
  chemically synthesized
gtattcctacattttcttag

SEQ ID NO: 482563 - DNA, 20 bp, Artificial Sequence
  chemically synthesized
ataataataatatattttta

SEQ ID NO: 482564 - DNA, 20 bp, Artificial Sequence
  chemically synthesized
caaataattatatacattta

SEQ ID NO: 482565 - DNA, 20 bp, Artificial Sequence
  chemically synthesized
tctgatatatgtatacactg

SEQ ID NO: 482566 - DNA, 20 bp, Artificial Sequence
  chemically synthesized
ggttaaaaactttagtcagg

SEQ ID NO: 482567 - DNA, 20 bp, Artificial Sequence
  chemically synthesized
atggggagatgttgatcaaa

SEQ ID NO: 482568 - DNA, 20 bp, Artificial Sequence
  chemically synthesized
ttaccagaggctgtggattt

SEQ ID NO: 482569 - DNA, 20 bp, Artificial Sequence
  chemically synthesized
aatggtggttaccagaggct

SEQ ID NO: 482570 - DNA, 20 bp, Artificial Sequence
  chemically synthesized
aaactcattgaagtagagag

SEQ ID NO: 482571 - DNA, 20 bp, Artificial Sequence
  chemically synthesized
ccattctactctctacttca

SEQ ID NO: 482572 - DNA, 20 bp, Artificial Sequence
  chemically synthesized
aagtcaaactcattgaagta

SEQ ID NO: 482573 - DNA, 20 bp, Artificial Sequence
  chemically synthesized
tgcgtgatctcacttatgtg

SEQ ID NO: 482574 - DNA, 20 bp, Artificial Sequence
  chemically synthesized
atccttttgtttatgacagc

SEQ ID NO: 482575 - DNA, 20 bp, Artificial Sequence
  chemically synthesized
atccacgctgtcataaacaa

SEQ ID NO: 482576 - DNA, 20 bp, Artificial Sequence
  chemically synthesized
gtattattcagccttaaata

SEQ ID NO: 482577 - DNA, 20 bp, Artificial Sequence
  chemically synthesized
aggatattctttatttaagg

SEQ ID NO: 482578 - DNA, 20 bp, Artificial Sequence
  chemically synthesized
aatgtggtacatatacacaa

SEQ ID NO: 482579 - DNA, 20 bp, Artificial Sequence
  chemically synthesized
aagtttccatcagtggatga

SEQ ID NO: 482580 - DNA, 20 bp, Artificial Sequence
  chemically synthesized
acctaagtttccatcagtgg

SEQ ID NO: 482581 - DNA, 20 bp, Artificial Sequence
  chemically synthesized
atcaacctaagtttccatca

SEQ ID NO: 482582 - DNA, 20 bp, Artificial Sequence
  chemically synthesized
tagtcacaaaagccatgata

SEQ ID NO: 482583 - DNA, 20 bp, Artificial Sequence
  chemically synthesized
actaatgctgcaataaacac

SEQ ID NO: 482584 - DNA, 20 bp, Artificial Sequence
  chemically synthesized
acatactggtttaaattctt

SEQ ID NO: 482585 - DNA, 20 bp, Artificial Sequence
  chemically synthesized
acttccgggtatatatccaa

SEQ ID NO: 482586 - DNA, 20 bp, Artificial Sequence
  chemically synthesized
tttggatatatacccggaag

SEQ ID NO: 482587 - DNA, 20 bp, Artificial Sequence
  chemically synthesized
aggatccagcaatcccactt

SEQ ID NO: 482588 - DNA, 20 bp, Artificial Sequence
  chemically synthesized
tatacccggaagtgggattg

SEQ ID NO: 482589 - DNA, 20 bp, Artificial Sequence
  chemically synthesized
aactgaaaacagaattacca

SEQ ID NO: 482590 - DNA, 20 bp, Artificial Sequence
  chemically synthesized
gctcctcaaaaaactgaaaa

SEQ ID NO: 482591 - DNA, 20 bp, Artificial Sequence
  chemically synthesized
aacacttgtatatcattggt

SEQ ID NO: 482592 - DNA, 20 bp, Artificial Sequence
  chemically synthesized
aatgataacaagtgttgatc

SEQ ID NO: 482593 - DNA, 20 bp, Artificial Sequence
  chemically synthesized
aatggctgttataaaaagag

SEQ ID NO: 482594 - DNA, 20 bp, Artificial Sequence
  chemically synthesized
agatgtcaccttacacctgt

SEQ ID NO: 482595 - DNA, 20 bp, Artificial Sequence
  chemically synthesized
agaagatgtacaaatagcta

SEQ ID NO: 482596 - DNA, 20 bp, Artificial Sequence
  chemically synthesized
acaacctggtgctagaataa

SEQ ID NO: 482597 - DNA, 20 bp, Artificial Sequence
  chemically synthesized
agtctttcacaacctggtgc

SEQ ID NO: 482598 - DNA, 20 bp, Artificial Sequence
  chemically synthesized
gaaagactattctttttcca

SEQ ID NO: 482599 - DNA, 20 bp, Artificial Sequence
  chemically synthesized
ccaagagaattcaatggaaa

SEQ ID NO: 482600 - DNA, 20 bp, Artificial Sequence
  chemically synthesized
atttttgacaagggtaccaa

SEQ ID NO: 482601 - DNA, 20 bp, Artificial Sequence
  chemically synthesized
atggtcaactgatttttgac

SEQ ID NO: 482602 - DNA, 20 bp, Artificial Sequence
  chemically synthesized
agacatatagatcaatgaaa

SEQ ID NO: 482603 - DNA, 20 bp, Artificial Sequence
  chemically synthesized
agtcaatgtggtactagaat

SEQ ID NO: 482604 - DNA, 20 bp, Artificial Sequence
  chemically synthesized
ttattaagtcaatgtggtac

SEQ ID NO: 482605 - DNA, 20 bp, Artificial Sequence
  chemically synthesized
tgaaaaaagaacaacattgg

SEQ ID NO: 482606 - DNA, 20 bp, Artificial Sequence
  chemically synthesized
ctattgaaatgcaagggatg

SEQ ID NO: 482607 - DNA, 20 bp, Artificial Sequence
  chemically synthesized
accatttctattgaaatgca

SEQ ID NO: 482608 - DNA, 20 bp, Artificial Sequence
  chemically synthesized
ttgcatttcaatagaaatgg

SEQ ID NO: 482609 - DNA, 20 bp, Artificial Sequence
  chemically synthesized
tttttttcagaaattgacaa

SEQ ID NO: 482610 - DNA, 20 bp, Artificial Sequence
  chemically synthesized
tgattttgataatgattcca

SEQ ID NO: 482611 - DNA, 20 bp, Artificial Sequence
  chemically synthesized
caattgatctacagactcta

SEQ ID NO: 482612 - DNA, 20 bp, Artificial Sequence
  chemically synthesized
agagtctgtagatcaattgg

SEQ ID NO: 482613 - DNA, 20 bp, Artificial Sequence
  chemically synthesized
gatgcaaggcttgtatactg

SEQ ID NO: 482614 - DNA, 20 bp, Artificial Sequence
  chemically synthesized
tcaaaaaatgttaaaaactt

SEQ ID NO: 482615 - DNA, 20 bp, Artificial Sequence
  chemically synthesized
aattattttatacattaaaa

SEQ ID NO: 482616 - DNA, 20 bp, Artificial Sequence
  chemically synthesized
atacaagatcaatatacaaa

SEQ ID NO: 482617 - DNA, 20 bp, Artificial Sequence
  chemically synthesized
aaaataattcagcaaatttg

SEQ ID NO: 482618 - DNA, 20 bp, Artificial Sequence
  chemically synthesized
tcttgtatcctacaaatttg

SEQ ID NO: 482619 - DNA, 20 bp, Artificial Sequence
  chemically synthesized
cttgtaattagaaaattttg

SEQ ID NO: 482620 - DNA, 20 bp, Artificial Sequence
  chemically synthesized
tttacttattcctttctaat

SEQ ID NO: 482621 - DNA, 20 bp, Artificial Sequence
  chemically synthesized
aaaagacatccagattagaa

SEQ ID NO: 482622 - DNA, 20 bp, Artificial Sequence
  chemically synthesized
cctgaacttccagtacaata

SEQ ID NO: 482623 - DNA, 20 bp, Artificial Sequence
  chemically synthesized
cctaagatcaggaaatagtg

SEQ ID NO: 482624 - DNA, 20 bp, Artificial Sequence
  chemically synthesized
gctaatgttattgtgaaaca

SEQ ID NO: 482625 - DNA, 20 bp, Artificial Sequence
  chemically synthesized
tttcacaataacattagctg

SEQ ID NO: 482626 - DNA, 20 bp, Artificial Sequence
  chemically synthesized
ccgaggaaacgaatacagaa

SEQ ID NO: 482627 - DNA, 20 bp, Artificial Sequence
  chemically synthesized
aattacagaagcccgaggaa

SEQ ID NO: 482628 - DNA, 20 bp, Artificial Sequence
  chemically synthesized
aagtgtcacaatttgcgtag

SEQ ID NO: 482629 - DNA, 20 bp, Artificial Sequence
  chemically synthesized
gcctccagaagtctgagaca

SEQ ID NO: 482630 - DNA, 20 bp, Artificial Sequence
  chemically synthesized
ggcctgctggaatcttgatt

SEQ ID NO: 482631 - DNA, 20 bp, Artificial Sequence
  chemically synthesized
cagcaggagtatgggcctgc

SEQ ID NO: 482632 - DNA, 20 bp, Artificial Sequence
  chemically synthesized
tctcccctacaggtttcagc

SEQ ID NO: 482633 - DNA, 20 bp, Artificial Sequence
  chemically synthesized
tcctgctgaaacctgtaggg

SEQ ID NO: 482634 - DNA, 20 bp, Artificial Sequence
  chemically synthesized
aaagaggcatacacagagag

SEQ ID NO: 482635 - DNA, 20 bp, Artificial Sequence
  chemically synthesized
aatgtgaccttatgtagaaa

SEQ ID NO: 482636 - DNA, 20 bp, Artificial Sequence
  chemically synthesized
aaaaaagaaggttttgtgga

SEQ ID NO: 482637 - DNA, 20 bp, Artificial Sequence
  chemically synthesized
aaaaaaaaaaagaaggtttt

SEQ ID NO: 482638 - DNA, 20 bp, Artificial Sequence
  chemically synthesized
tttttttttttttttttaga

SEQ ID NO: 482639 - DNA, 20 bp, Artificial Sequence
  chemically synthesized
ctcactgcaaactctgcctc

SEQ ID NO: 482640 - DNA, 20 bp, Artificial Sequence
  chemically synthesized
aatggcgcgaaccctggagg

SEQ ID NO: 482641 - DNA, 20 bp, Artificial Sequence
  chemically synthesized
tactcaggaggctgaggcag

SEQ ID NO: 482642 - DNA, 20 bp, Artificial Sequence
  chemically synthesized
cattctcctgcctcagcctc

SEQ ID NO: 482643 - DNA, 20 bp, Artificial Sequence
  chemically synthesized
ttttgtatttttagcagaga

SEQ ID NO: 482644 - DNA, 20 bp, Artificial Sequence
  chemically synthesized
cggggttttaccgtgttagc

SEQ ID NO: 482645 - DNA, 20 bp, Artificial Sequence
  chemically synthesized
actttgggaggccgaggcag

SEQ ID NO: 482646 - DNA, 20 bp, Artificial Sequence
  chemically synthesized
gcctcggcctcccaaagtgc

SEQ ID NO: 482647 - DNA, 20 bp, Artificial Sequence
  chemically synthesized
taaagaacacttaacaaatg

SEQ ID NO: 482648 - DNA, 20 bp, Artificial Sequence
  chemically synthesized
tctttatttttcaagcttga

SEQ ID NO: 482649 - DNA, 20 bp, Artificial Sequence
  chemically synthesized
agggttttgtactttgtcac

SEQ ID NO: 482650 - DNA, 20 bp, Artificial Sequence
  chemically synthesized
aatgtattataccatatcaa

SEQ ID NO: 482651 - DNA, 20 bp, Artificial Sequence
  chemically synthesized
tataatacattgattaaatt

SEQ ID NO: 482652 - DNA, 20 bp, Artificial Sequence
  chemically synthesized
aaccaggtaagatttatcac

SEQ ID NO: 482653 - DNA, 20 bp, Artificial Sequence
  chemically synthesized
gctacagagcaatatgcctt

SEQ ID NO: 482654 - DNA, 20 bp, Artificial Sequence
  chemically synthesized
ctttctcttctattttttgg

SEQ ID NO: 482655 - DNA, 20 bp, Artificial Sequence
  chemically synthesized
agagttgtttatatgtttgg

SEQ ID NO: 482656 - DNA, 20 bp, Artificial Sequence
  chemically synthesized
ggcccagaagtcttcccccg

SEQ ID NO: 482657 - DNA, 20 bp, Artificial Sequence
  chemically synthesized
gatagacctataacaagaaa

SEQ ID NO: 482658 - DNA, 20 bp, Artificial Sequence
  chemically synthesized
caactaaacaaatagataac

SEQ ID NO: 482659 - DNA, 20 bp, Artificial Sequence
  chemically synthesized
agaaataaaaagaagtaaaa

SEQ ID NO: 482660 - DNA, 20 bp, Artificial Sequence
  chemically synthesized
ttactaatattagagaaaaa

SEQ ID NO: 482661 - DNA, 20 bp, Artificial Sequence
  chemically synthesized
gaggaggctgaagcagtgct

SEQ ID NO: 482662 - DNA, 20 bp, Artificial Sequence
  chemically synthesized
ctttgtcccattggctattt

SEQ ID NO: 482663 - DNA, 20 bp, Artificial Sequence
  chemically synthesized
tcagtaacagatgtaaattt

SEQ ID NO: 482664 - DNA, 20 bp, Artificial Sequence
  chemically synthesized
tgcagattttatgaccataa

SEQ ID NO: 482665 - DNA, 20 bp, Artificial Sequence
  chemically synthesized
attgtatgattttaatccct

SEQ ID NO: 482666 - DNA, 20 bp, Artificial Sequence
  chemically synthesized
ataagtctcactacattcaa

SEQ ID NO: 482667 - DNA, 20 bp, Artificial Sequence
  chemically synthesized
ctagcatatggcctacccta

SEQ ID NO: 482668 - DNA, 20 bp, Artificial Sequence
  chemically synthesized
actgtacacgaaatattctc

SEQ ID NO: 482669 - DNA, 20 bp, Artificial Sequence
  chemically synthesized
atatttcgtgtacagttgaa

SEQ ID NO: 482670 - DNA, 20 bp, Artificial Sequence
  chemically synthesized
ttcgtgtacagttgaaaaga

SEQ ID NO: 482671 - DNA, 20 bp, Artificial Sequence
  chemically synthesized
gaatgagtattctgctatta

SEQ ID NO: 482672 - DNA, 20 bp, Artificial Sequence
  chemically synthesized
agcgtttcatccaataatag

SEQ ID NO: 482673 - DNA, 20 bp, Artificial Sequence
  chemically synthesized
gaagtctccaactatttttg

SEQ ID NO: 482674 - DNA, 20 bp, Artificial Sequence
  chemically synthesized
aaaactgactgaactgaaag

SEQ ID NO: 482675 - DNA, 20 bp, Artificial Sequence
  chemically synthesized
atattttttctttcttttct

SEQ ID NO: 482676 - DNA, 20 bp, Artificial Sequence
  chemically synthesized
ttttctttcttttctttgga

SEQ ID NO: 482677 - DNA, 20 bp, Artificial Sequence
  chemically synthesized
caaacttgaaaataggtaaa

SEQ ID NO: 482678 - DNA, 20 bp, Artificial Sequence
  chemically synthesized
cagattcaagctgcaaaaga

SEQ ID NO: 482679 - DNA, 20 bp, Artificial Sequence
  chemically synthesized
ctgattctttcttttgcagc

SEQ ID NO: 482680 - DNA, 20 bp, Artificial Sequence
  chemically synthesized
taagaactcagtggaatatc

SEQ ID NO: 482681 - DNA, 20 bp, Artificial Sequence
  chemically synthesized
ttccaactccagatattcca

SEQ ID NO: 482682 - DNA, 20 bp, Artificial Sequence
  chemically synthesized
aattgtaaataagaactcag

SEQ ID NO: 482683 - DNA, 20 bp, Artificial Sequence
  chemically synthesized
tgtgcttgtcttaacaaata

SEQ ID NO: 482684 - DNA, 20 bp, Artificial Sequence
  chemically synthesized
caacctctgacatgttcttg

SEQ ID NO: 482685 - DNA, 20 bp, Artificial Sequence
  chemically synthesized
tggagaatgaggtgtccata

SEQ ID NO: 482686 - DNA, 20 bp, Artificial Sequence
  chemically synthesized
aaacttccagtgaagctctg

SEQ ID NO: 482687 - DNA, 20 bp, Artificial Sequence
  chemically synthesized
cttaggaacctgttatgtta

SEQ ID NO: 482688 - DNA, 20 bp, Artificial Sequence
  chemically synthesized
tctaggaaaagccctagctc

SEQ ID NO: 482689 - DNA, 20 bp, Artificial Sequence
  chemically synthesized
tgacctatcttgcagctccc

SEQ ID NO: 482690 - DNA, 20 bp, Artificial Sequence
  chemically synthesized
tcaaacagtggcaaggttct

SEQ ID NO: 482691 - DNA, 20 bp, Artificial Sequence
  chemically synthesized
gaataaaattggcctttttg

SEQ ID NO: 482692 - DNA, 20 bp, Artificial Sequence
  chemically synthesized
cagagagtgtagaccaggat

SEQ ID NO: 482693 - DNA, 20 bp, Artificial Sequence
  chemically synthesized
agccaccagagagtgtagac

SEQ ID NO: 482694 - DNA, 20 bp, Artificial Sequence
  chemically synthesized
tagcagccttttagccacca

SEQ ID NO: 482695 - DNA, 20 bp, Artificial Sequence
  chemically synthesized
caaactttgccatttttatt

SEQ ID NO: 482696 - DNA, 20 bp, Artificial Sequence
  chemically synthesized
gccagcctttggttaattcc

SEQ ID NO: 482697 - DNA, 20 bp, Artificial Sequence
  chemically synthesized
catcgccttttctgaaccct

SEQ ID NO: 482698 - DNA, 20 bp, Artificial Sequence
  chemically synthesized
acttcagcctcccaaagtgc

SEQ ID NO: 482699 - DNA, 20 bp, Artificial Sequence
  chemically synthesized
tgggcggaacactcgaggtc

SEQ ID NO: 482700 - DNA, 20 bp, Artificial Sequence
  chemically synthesized
ctggtctcaaactcctgacc

SEQ ID NO: 482701 - DNA, 20 bp, Artificial Sequence
  chemically synthesized
tctcgtgtttttagtagaga

SEQ ID NO: 482702 - DNA, 20 bp, Artificial Sequence
  chemically synthesized
cgagaaatagttgggcgtgg

SEQ ID NO: 482703 - DNA, 20 bp, Artificial Sequence
  chemically synthesized
tgcctgtagttccatctact

SEQ ID NO: 482704 - DNA, 20 bp, Artificial Sequence
  chemically synthesized
cctccacctcctgtgatcaa

SEQ ID NO: 482705 - DNA, 20 bp, Artificial Sequence
  chemically synthesized
tcatgccactgcactccagc

SEQ ID NO: 482706 - DNA, 20 bp, Artificial Sequence
  chemically synthesized
tctcactctgtcacccaggc

SEQ ID NO: 482707 - DNA, 20 bp, Artificial Sequence
  chemically synthesized
ctgcactccagcctgggtga

SEQ ID NO: 482708 - DNA, 20 bp, Artificial Sequence
  chemically synthesized
tttttttcctttttttgaga

SEQ ID NO: 482709 - DNA, 20 bp, Artificial Sequence
  chemically synthesized
ccacattatattttcaagca

SEQ ID NO: 482710 - DNA, 20 bp, Artificial Sequence
  chemically synthesized
taatgcagagtcaccaagcc

SEQ ID NO: 482711 - DNA, 20 bp, Artificial Sequence
  chemically synthesized
tattatataaatatttaatg

SEQ ID NO: 482712 - DNA, 20 bp, Artificial Sequence
  chemically synthesized
aagttctcaaagcatacaaa

SEQ ID NO: 482713 - DNA, 20 bp, Artificial Sequence
  chemically synthesized
ttgtatgctttgagaacttt

SEQ ID NO: 482714 - DNA, 20 bp, Artificial Sequence
  chemically synthesized
ctttagaaggaaaagtacta

SEQ ID NO: 482715 - DNA, 20 bp, Artificial Sequence
  chemically synthesized
agctttaggggagaacaaaa

SEQ ID NO: 482716 - DNA, 20 bp, Artificial Sequence
  chemically synthesized
ccacactagtagtttgaggt

SEQ ID NO: 482717 - DNA, 20 bp, Artificial Sequence
  chemically synthesized
ccaaacctcaaactactagt

SEQ ID NO: 482718 - DNA, 20 bp, Artificial Sequence
  chemically synthesized
tatatattttgtgtattttt

SEQ ID NO: 482719 - DNA, 20 bp, Artificial Sequence
  chemically synthesized
aatatgtacggtagtggaaa

SEQ ID NO: 482720 - DNA, 20 bp, Artificial Sequence
  chemically synthesized
ctaccgtacatatttttatg

SEQ ID NO: 482721 - DNA, 20 bp, Artificial Sequence
  chemically synthesized
acatttttagttatctgtgg

SEQ ID NO: 482722 - DNA, 20 bp, Artificial Sequence
  chemically synthesized
gtagtaactaaggcagctat

SEQ ID NO: 482723 - DNA, 20 bp, Artificial Sequence
  chemically synthesized
taaaattaattatgtgatta

SEQ ID NO: 482724 - DNA, 20 bp, Artificial Sequence
  chemically synthesized
tctgtgtttcaagtttccta

SEQ ID NO: 482725 - DNA, 20 bp, Artificial Sequence
  chemically synthesized
attcaatacttttcaaatta

SEQ ID NO: 482726 - DNA, 20 bp, Artificial Sequence
  chemically synthesized
attcaataatttgaaaagta

SEQ ID NO: 482727 - DNA, 20 bp, Artificial Sequence
  chemically synthesized
aacaagatttcacttctcta

SEQ ID NO: 482728 - DNA, 20 bp, Artificial Sequence
  chemically synthesized
cttggctgagctaagagtac

SEQ ID NO: 482729 - DNA, 20 bp, Artificial Sequence
  chemically synthesized
gttttgtgcttggctgagct

SEQ ID NO: 482730 - DNA, 20 bp, Artificial Sequence
  chemically synthesized
acgtttgaaaagcttttacg

SEQ ID NO: 482731 - DNA, 20 bp, Artificial Sequence
  chemically synthesized
aatcacaaagccgacaaaaa

SEQ ID NO: 482732 - DNA, 20 bp, Artificial Sequence
  chemically synthesized
aagagagattttcccaggct

SEQ ID NO: 482733 - DNA, 20 bp, Artificial Sequence
  chemically synthesized
atcaagaaataatttttcca

SEQ ID NO: 482734 - DNA, 20 bp, Artificial Sequence
  chemically synthesized
agattggtccaaacttggca

SEQ ID NO: 482735 - DNA, 20 bp, Artificial Sequence
  chemically synthesized
aacaggttatgaactcaacc

SEQ ID NO: 482736 - DNA, 20 bp, Artificial Sequence
  chemically synthesized
ttcatttggcggattcttgg

SEQ ID NO: 482737 - DNA, 20 bp, Artificial Sequence
  chemically synthesized
cataggatttatttcatttg

SEQ ID NO: 482738 - DNA, 20 bp, Artificial Sequence
  chemically synthesized
actgccaacagtgatcatca

SEQ ID NO: 482739 - DNA, 20 bp, Artificial Sequence
  chemically synthesized
ctaaatggcatcatctctca

SEQ ID NO: 482740 - DNA, 20 bp, Artificial Sequence
  chemically synthesized
tctttgccaataggctatga

SEQ ID NO: 482741 - DNA, 20 bp, Artificial Sequence
  chemically synthesized
ctattggcaaagattttgat

SEQ ID NO: 482742 - DNA, 20 bp, Artificial Sequence
  chemically synthesized
tttttgttttagaaaaaatt

SEQ ID NO: 482743 - DNA, 20 bp, Artificial Sequence
  chemically synthesized
aaaacagaatgcagatggca

SEQ ID NO: 482744 - DNA, 20 bp, Artificial Sequence
  chemically synthesized
gtcttgatttggtgaaaaaa

SEQ ID NO: 482745 - DNA, 20 bp, Artificial Sequence
  chemically synthesized
gtggaaagaaacagcaacag

SEQ ID NO: 482746 - DNA, 20 bp, Artificial Sequence
  chemically synthesized
gcttatcttgaaagcgtggt

SEQ ID NO: 482747 - DNA, 20 bp, Artificial Sequence
  chemically synthesized
tccggttttatttctgttct

SEQ ID NO: 482748 - DNA, 20 bp, Artificial Sequence
  chemically synthesized
ctcaaaaatacataaataag

SEQ ID NO: 482749 - DNA, 20 bp, Artificial Sequence
  chemically synthesized
ttatttatgtatttttgaga

SEQ ID NO: 482750 - DNA, 20 bp, Artificial Sequence
  chemically synthesized
tcttgctctgtcacccaggc

SEQ ID NO: 482751 - DNA, 20 bp, Artificial Sequence
  chemically synthesized
tcacgccactgcactccagc

SEQ ID NO: 482752 - DNA, 20 bp, Artificial Sequence
  chemically synthesized
ctcactgcaacctccgcctc

SEQ ID NO: 482753 - DNA, 20 bp, Artificial Sequence
  chemically synthesized
tacttgggaggctgaggcag

SEQ ID NO: 482754 - DNA, 20 bp, Artificial Sequence
  chemically synthesized
ttttgtatttttagtagaga

SEQ ID NO: 482755 - DNA, 20 bp, Artificial Sequence
  chemically synthesized
ggcaggcagatcacgagatc

SEQ ID NO: 482756 - DNA, 20 bp, Artificial Sequence
  chemically synthesized
gcctcggcctcccaaagtgc

SEQ ID NO: 482757 - DNA, 20 bp, Artificial Sequence
  chemically synthesized
cctccttttatttagaaaaa

SEQ ID NO: 482758 - DNA, 20 bp, Artificial Sequence
  chemically synthesized
ctttttttctaaataaaagg

SEQ ID NO: 482759 - DNA, 20 bp, Artificial Sequence
  chemically synthesized
gcaatattaagtttacaaat

SEQ ID NO: 482760 - DNA, 20 bp, Artificial Sequence
  chemically synthesized
gtcaataaagattagcaatt

SEQ ID NO: 482761 - DNA, 20 bp, Artificial Sequence
  chemically synthesized
tggtgactggctcaaatttt

SEQ ID NO: 482762 - DNA, 20 bp, Artificial Sequence
  chemically synthesized
agttataacagtgttggtgg

SEQ ID NO: 482763 - DNA, 20 bp, Artificial Sequence
  chemically synthesized
tttcattgttgctcagtagt

SEQ ID NO: 482764 - DNA, 20 bp, Artificial Sequence
  chemically synthesized
ccttgctccgtaagttcttt

SEQ ID NO: 482765 - DNA, 20 bp, Artificial Sequence
  chemically synthesized
agaaagaacttacggagcaa

SEQ ID NO: 482766 - DNA, 20 bp, Artificial Sequence
  chemically synthesized
atggttatctggtctttaca

SEQ ID NO: 482767 - DNA, 20 bp, Artificial Sequence
  chemically synthesized
atttgctccctaccttttag

SEQ ID NO: 482768 - DNA, 20 bp, Artificial Sequence
  chemically synthesized
attgttttattttttcatca

SEQ ID NO: 482769 - DNA, 20 bp, Artificial Sequence
  chemically synthesized
atttgtcaattaataattac

SEQ ID NO: 482770 - DNA, 20 bp, Artificial Sequence
  chemically synthesized
gagtctttttcagattctta

SEQ ID NO: 482771 - DNA, 20 bp, Artificial Sequence
  chemically synthesized
acaaagcaagaaaaccccat

SEQ ID NO: 482772 - DNA, 20 bp, Artificial Sequence
  chemically synthesized
aagcctgtgaggtcatctac

SEQ ID NO: 482773 - DNA, 20 bp, Artificial Sequence
  chemically synthesized
gaaagtagtagagttgtgat

SEQ ID NO: 482774 - DNA, 20 bp, Artificial Sequence
  chemically synthesized
gaatcttcttttgaaagtag

SEQ ID NO: 482775 - DNA, 20 bp, Artificial Sequence
  chemically synthesized
aactgaaggctagagaagtt

SEQ ID NO: 482776 - DNA, 20 bp, Artificial Sequence
  chemically synthesized
agttttcttctctgcaaact

SEQ ID NO: 482777 - DNA, 20 bp, Artificial Sequence
  chemically synthesized
ctctgcaaactaagaataat

SEQ ID NO: 482778 - DNA, 20 bp, Artificial Sequence
  chemically synthesized
aataataagagtacttttca

SEQ ID NO: 482779 - DNA, 20 bp, Artificial Sequence
  chemically synthesized
ttttcaaagagtgtttttga

SEQ ID NO: 482780 - DNA, 20 bp, Artificial Sequence
  chemically synthesized
aatgttaataataactttta

SEQ ID NO: 482781 - DNA, 20 bp, Artificial Sequence
  chemically synthesized
ctaaaagttattattaacat

SEQ ID NO: 482782 - DNA, 20 bp, Artificial Sequence
  chemically synthesized
tagcatacatcattcaagaa

SEQ ID NO: 482783 - DNA, 20 bp, Artificial Sequence
  chemically synthesized
gtaattttttcatccatttc

SEQ ID NO: 482784 - DNA, 20 bp, Artificial Sequence
  chemically synthesized
atctgtatcgggaacttaca

SEQ ID NO: 482785 - DNA, 20 bp, Artificial Sequence
  chemically synthesized
tttgtttgtgctctgtgttt

SEQ ID NO: 482786 - DNA, 20 bp, Artificial Sequence
  chemically synthesized
attaaaaaaaaaaaacgctt

SEQ ID NO: 482787 - DNA, 20 bp, Artificial Sequence
  chemically synthesized
ttaatttcaaaagtttgaca

SEQ ID NO: 482788 - DNA, 20 bp, Artificial Sequence
  chemically synthesized
ttaatcacctaaaataaaac

SEQ ID NO: 482789 - DNA, 20 bp, Artificial Sequence
  chemically synthesized
aaagtgatggtaagaatggt

SEQ ID NO: 482790 - DNA, 20 bp, Artificial Sequence
  chemically synthesized
gaaaatcctaaagtgatggt

SEQ ID NO: 482791 - DNA, 20 bp, Artificial Sequence
  chemically synthesized
aaccattcttaccatcactt

SEQ ID NO: 482792 - DNA, 20 bp, Artificial Sequence
  chemically synthesized
atttctcatttgctaactac

SEQ ID NO: 482793 - DNA, 20 bp, Artificial Sequence
  chemically synthesized
tccttcttctcatctaactc

SEQ ID NO: 482794 - DNA, 20 bp, Artificial Sequence
  chemically synthesized
acgaagtttggactggatcc

SEQ ID NO: 482795 - DNA, 20 bp, Artificial Sequence
  chemically synthesized
cagaaaatacgaagtttgga

SEQ ID NO: 482796 - DNA, 20 bp, Artificial Sequence
  chemically synthesized
tttcggatactatgaatcta

SEQ ID NO: 482797 - DNA, 20 bp, Artificial Sequence
  chemically synthesized
ctctataagtttcggatact

SEQ ID NO: 482798 - DNA, 20 bp, Artificial Sequence
  chemically synthesized
ctttttcttctctataagtt

SEQ ID NO: 482799 - DNA, 20 bp, Artificial Sequence
  chemically synthesized
cataacatgctgactacctc

SEQ ID NO: 482800 - DNA, 20 bp, Artificial Sequence
  chemically synthesized
cgaatatgactagagctttc

SEQ ID NO: 482801 - DNA, 20 bp, Artificial Sequence
  chemically synthesized
tggtctgactatgtaatata

SEQ ID NO: 482802 - DNA, 20 bp, Artificial Sequence
  chemically synthesized
atatattacatagtcagacc

SEQ ID NO: 482803 - DNA, 20 bp, Artificial Sequence
  chemically synthesized
tggatgagcatagatgaatt

SEQ ID NO: 482804 - DNA, 20 bp, Artificial Sequence
  chemically synthesized
ttttcaatggatgagcatag

SEQ ID NO: 482805 - DNA, 20 bp, Artificial Sequence
  chemically synthesized
taccactaatggttttttca

SEQ ID NO: 482806 - DNA, 20 bp, Artificial Sequence
  chemically synthesized
tggtaacatgtgtctcttga

SEQ ID NO: 482807 - DNA, 20 bp, Artificial Sequence
  chemically synthesized
ctgttggagtcaaaatctag

SEQ ID NO: 482808 - DNA, 20 bp, Artificial Sequence
  chemically synthesized
agtcttatcattagctctgt

SEQ ID NO: 482809 - DNA, 20 bp, Artificial Sequence
  chemically synthesized
gaggatgttagaaagccaca

SEQ ID NO: 482810 - DNA, 20 bp, Artificial Sequence
  chemically synthesized
aaggttttagtttatatgat

SEQ ID NO: 482811 - DNA, 20 bp, Artificial Sequence
  chemically synthesized
tgaatttcaggaagagttaa

SEQ ID NO: 482812 - DNA, 20 bp, Artificial Sequence
  chemically synthesized
gttctcgattgaatttcagg

SEQ ID NO: 482813 - DNA, 20 bp, Artificial Sequence
  chemically synthesized
cacacagaacttgttctcga

SEQ ID NO: 482814 - DNA, 20 bp, Artificial Sequence
  chemically synthesized
cgagaacaagttctgtgtga

SEQ ID NO: 482815 - DNA, 20 bp, Artificial Sequence
  chemically synthesized
aggcctggccataaaacacc

SEQ ID NO: 482816 - DNA, 20 bp, Artificial Sequence
  chemically synthesized
gccactgcagaaaaggaaga

SEQ ID NO: 482817 - DNA, 20 bp, Artificial Sequence
  chemically synthesized
tgtcacaaaattggaaaagt

SEQ ID NO: 482818 - DNA, 20 bp, Artificial Sequence
  chemically synthesized
catgttgggggacagctcct

SEQ ID NO: 482819 - DNA, 20 bp, Artificial Sequence
  chemically synthesized
gtgttaagctattgagattt

SEQ ID NO: 482820 - DNA, 20 bp, Artificial Sequence
  chemically synthesized
aaggaaaccgtatcattttc

SEQ ID NO: 482821 - DNA, 20 bp, Artificial Sequence
  chemically synthesized
ttagatgacataaccaattt

SEQ ID NO: 482822 - DNA, 20 bp, Artificial Sequence
  chemically synthesized
tgtcagataaaatatctata

SEQ ID NO: 482823 - DNA, 20 bp, Artificial Sequence
  chemically synthesized
gttaaacaatggttaagctt

SEQ ID NO: 482824 - DNA, 20 bp, Artificial Sequence
  chemically synthesized
ctagtaaatactaagtttga

SEQ ID NO: 482825 - DNA, 20 bp, Artificial Sequence
  chemically synthesized
ttcctttttcttttatcctg

SEQ ID NO: 482826 - DNA, 20 bp, Artificial Sequence
  chemically synthesized
cttagtagtctataattcct

SEQ ID NO: 482827 - DNA, 20 bp, Artificial Sequence
  chemically synthesized
agaggaaagagaaagaagag

SEQ ID NO: 482828 - DNA, 20 bp, Artificial Sequence
  chemically synthesized
atgagctgggctggaggtaa

SEQ ID NO: 482829 - DNA, 20 bp, Artificial Sequence
  chemically synthesized
agagaatggggggagaaagt

SEQ ID NO: 482830 - DNA, 20 bp, Artificial Sequence
  chemically synthesized
atcaggattggggaggaata

SEQ ID NO: 482831 - DNA, 20 bp, Artificial Sequence
  chemically synthesized
agtgggtatcaggattgggg

SEQ ID NO: 482832 - DNA, 20 bp, Artificial Sequence
  chemically synthesized
aaatgggggtgagtgggtat

SEQ ID NO: 482833 - DNA, 20 bp, Artificial Sequence
  chemically synthesized
ggatcaagaaatgggggtga

SEQ ID NO: 482834 - DNA, 20 bp, Artificial Sequence
  chemically synthesized
ccctggatcaagaaatgggg

SEQ ID NO: 482835 - DNA, 20 bp, Artificial Sequence
  chemically synthesized
gaggccctggatcaagaaat

SEQ ID NO: 482836 - DNA, 20 bp, Artificial Sequence
  chemically synthesized
tcatatcttatttggaggcc

SEQ ID NO: 482837 - DNA, 20 bp, Artificial Sequence
  chemically synthesized
ggcctccaaataagatatga

SEQ ID NO: 482838 - DNA, 20 bp, Artificial Sequence
  chemically synthesized
acctgttactttttctagga

SEQ ID NO: 482839 - DNA, 20 bp, Artificial Sequence
  chemically synthesized
tttctaggaaggaattaagc

SEQ ID NO: 482840 - DNA, 20 bp, Artificial Sequence
  chemically synthesized
agttaattttgtttagtaat

SEQ ID NO: 482841 - DNA, 20 bp, Artificial Sequence
  chemically synthesized
tagacttttgagtcaaggta

SEQ ID NO: 482842 - DNA, 20 bp, Artificial Sequence
  chemically synthesized
catgcctagccagtagactt

SEQ ID NO: 482843 - DNA, 20 bp, Artificial Sequence
  chemically synthesized
aaagcactaggattacaggc

SEQ ID NO: 482844 - DNA, 20 bp, Artificial Sequence
  chemically synthesized
tccttggcctcccaaagcac

SEQ ID NO: 482845 - DNA, 20 bp, Artificial Sequence
  chemically synthesized
gctttgggaggccaaggaag

SEQ ID NO: 482846 - DNA, 20 bp, Artificial Sequence
  chemically synthesized
aaggagaattgcttgaggcc

SEQ ID NO: 482847 - DNA, 20 bp, Artificial Sequence
  chemically synthesized
aatttttgttttctgtagag

SEQ ID NO: 482848 - DNA, 20 bp, Artificial Sequence
  chemically synthesized
caggaggactgcttgagccc

SEQ ID NO: 482849 - DNA, 20 bp, Artificial Sequence
  chemically synthesized
ttgtgccactgcactttagc

SEQ ID NO: 482850 - DNA, 20 bp, Artificial Sequence
  chemically synthesized
tatatttattttcttagaga

SEQ ID NO: 482851 - DNA, 20 bp, Artificial Sequence
  chemically synthesized
ttggtttctgtgattttctt

SEQ ID NO: 482852 - DNA, 20 bp, Artificial Sequence
  chemically synthesized
ccaagcttgagtcatggaag

SEQ ID NO: 482853 - DNA, 20 bp, Artificial Sequence
  chemically synthesized
aggacaggccagagccaagc

SEQ ID NO: 482854 - DNA, 20 bp, Artificial Sequence
  chemically synthesized
cttagcttccagccattgtg

SEQ ID NO: 482855 - DNA, 20 bp, Artificial Sequence
  chemically synthesized
aacagttgaatgaaatgtta

SEQ ID NO: 482856 - DNA, 20 bp, Artificial Sequence
  chemically synthesized
ttcagaaccggaggcaacag

SEQ ID NO: 482857 - DNA, 20 bp, Artificial Sequence
  chemically synthesized
tgtacttcatcccactgatt

SEQ ID NO: 482858 - DNA, 20 bp, Artificial Sequence
  chemically synthesized
ttgaaagaattcagaatcag

SEQ ID NO: 482859 - DNA, 20 bp, Artificial Sequence
  chemically synthesized
ttattctagttgaaagaatt

SEQ ID NO: 482860 - DNA, 20 bp, Artificial Sequence
  chemically synthesized
tgattctgaattctttcaac

SEQ ID NO: 482861 - DNA, 20 bp, Artificial Sequence
  chemically synthesized
tttccttttattctagttga

SEQ ID NO: 482862 - DNA, 20 bp, Artificial Sequence
  chemically synthesized
atcatcctagccataacaca

SEQ ID NO: 482863 - DNA, 20 bp, Artificial Sequence
  chemically synthesized
attattcattgtgttatggc

SEQ ID NO: 482864 - DNA, 20 bp, Artificial Sequence
  chemically synthesized
atggctaggatgatgaacaa

SEQ ID NO: 482865 - DNA, 20 bp, Artificial Sequence
  chemically synthesized
tatttgccatcaaaaaagca

SEQ ID NO: 482866 - DNA, 20 bp, Artificial Sequence
  chemically synthesized
ttggttctagggatcaagaa

SEQ ID NO: 482867 - DNA, 20 bp, Artificial Sequence
  chemically synthesized
catatttggttctagggatc

SEQ ID NO: 482868 - DNA, 20 bp, Artificial Sequence
  chemically synthesized
gatgattcatatttggttct

SEQ ID NO: 482869 - DNA, 20 bp, Artificial Sequence
  chemically synthesized
cttgatccctagaaccaaat

SEQ ID NO: 482870 - DNA, 20 bp, Artificial Sequence
  chemically synthesized
ctgttagaaaagcactacag

SEQ ID NO: 482871 - DNA, 20 bp, Artificial Sequence
  chemically synthesized
agtggcaaggatgaggggat

SEQ ID NO: 482872 - DNA, 20 bp, Artificial Sequence
  chemically synthesized
tgctgaagtggcaaggatga

SEQ ID NO: 482873 - DNA, 20 bp, Artificial Sequence
  chemically synthesized
ctgatgggtgctgaagtggc

SEQ ID NO: 482874 - DNA, 20 bp, Artificial Sequence
  chemically synthesized
ggcactgggaaatcaggctg

SEQ ID NO: 482875 - DNA, 20 bp, Artificial Sequence
  chemically synthesized
tgaaggctttctgttgccac

SEQ ID NO: 482876 - DNA, 20 bp, Artificial Sequence
  chemically synthesized
tggtatgtctagcctgtcac

SEQ ID NO: 482877 - DNA, 20 bp, Artificial Sequence
  chemically synthesized
tgtatataatgactaattgt

SEQ ID NO: 482878 - DNA, 20 bp, Artificial Sequence
  chemically synthesized
taatgactaattgtaggaat

SEQ ID NO: 482879 - DNA, 20 bp, Artificial Sequence
  chemically synthesized
cccttgtaaaatacatgcct

SEQ ID NO: 482880 - DNA, 20 bp, Artificial Sequence
  chemically synthesized
ctctgaggcatgtattttac

SEQ ID NO: 482881 - DNA, 20 bp, Artificial Sequence
  chemically synthesized
catgtattttacaagggttc

SEQ ID NO: 482882 - DNA, 20 bp, Artificial Sequence
  chemically synthesized
aagggttccagagtttccca

SEQ ID NO: 482883 - DNA, 20 bp, Artificial Sequence
  chemically synthesized
ttatcaagccagctgctgtt

SEQ ID NO: 482884 - DNA, 20 bp, Artificial Sequence
  chemically synthesized
gtgaggcaaggcagccagta

SEQ ID NO: 482885 - DNA, 20 bp, Artificial Sequence
  chemically synthesized
gggggtaaattaatcagtag

SEQ ID NO: 482886 - DNA, 20 bp, Artificial Sequence
  chemically synthesized
aagagcaagtgatttatttg

SEQ ID NO: 482887 - DNA, 20 bp, Artificial Sequence
  chemically synthesized
ttgctcttaaaaccttttcc

SEQ ID NO: 482888 - DNA, 20 bp, Artificial Sequence
  chemically synthesized
aaaccttttccaagggtctt

SEQ ID NO: 482889 - DNA, 20 bp, Artificial Sequence
  chemically synthesized
tctaatacacttatcttccc

SEQ ID NO: 482890 - DNA, 20 bp, Artificial Sequence
  chemically synthesized
tctttcttttttttttttga

SEQ ID NO: 482891 - DNA, 20 bp, Artificial Sequence
  chemically synthesized
tttgctcttgtaacccaggc

SEQ ID NO: 482892 - DNA, 20 bp, Artificial Sequence
  chemically synthesized
ttgcaccattgcactccagc

SEQ ID NO: 482893 - DNA, 20 bp, Artificial Sequence
  chemically synthesized
ctcactgcaacctccgcctc

SEQ ID NO: 482894 - DNA, 20 bp, Artificial Sequence
  chemically synthesized
tactcgggaggctgagacag

SEQ ID NO: 482895 - DNA, 20 bp, Artificial Sequence
  chemically synthesized
tatcctcctgtctcagcctc

SEQ ID NO: 482896 - DNA, 20 bp, Artificial Sequence
  chemically synthesized
ttttgtatttttaatagaga

SEQ ID NO: 482897 - DNA, 20 bp, Artificial Sequence
  chemically synthesized
caggtggatcacctgaggtc

SEQ ID NO: 482898 - DNA, 20 bp, Artificial Sequence
  chemically synthesized
actttgggaggccgaggcag

SEQ ID NO: 482899 - DNA, 20 bp, Artificial Sequence
  chemically synthesized
gcctcggcctcccaaagtgc

SEQ ID NO: 482900 - DNA, 20 bp, Artificial Sequence
  chemically synthesized
aacttcttttaacaatacct

SEQ ID NO: 482901 - DNA, 20 bp, Artificial Sequence
  chemically synthesized
acaatacctaagaattcacg

SEQ ID NO: 482902 - DNA, 20 bp, Artificial Sequence
  chemically synthesized
tcttacaaaatgcacccagc

SEQ ID NO: 482903 - DNA, 20 bp, Artificial Sequence
  chemically synthesized
gaaaagaacatatttcagag

SEQ ID NO: 482904 - DNA, 20 bp, Artificial Sequence
  chemically synthesized
tatttgaaaagaacatattt

SEQ ID NO: 482905 - DNA, 20 bp, Artificial Sequence
  chemically synthesized
tctatcaggtttcatgctta

SEQ ID NO: 482906 - DNA, 20 bp, Artificial Sequence
  chemically synthesized
gtgacgcttaggaaagaatc

SEQ ID NO: 482907 - DNA, 20 bp, Artificial Sequence
  chemically synthesized
gtgttgggtgacgcttagga

SEQ ID NO: 482908 - DNA, 20 bp, Artificial Sequence
  chemically synthesized
gtaactaattatatgaggtg

SEQ ID NO: 482909 - DNA, 20 bp, Artificial Sequence
  chemically synthesized
aggatgatatagagcctctt

SEQ ID NO: 482910 - DNA, 20 bp, Artificial Sequence
  chemically synthesized
aaacagagatttgggtctgg

SEQ ID NO: 482911 - DNA, 20 bp, Artificial Sequence
  chemically synthesized
ttacattctaaaacagagat

SEQ ID NO: 482912 - DNA, 20 bp, Artificial Sequence
  chemically synthesized
ccagacccaaatctctgttt

SEQ ID NO: 482913 - DNA, 20 bp, Artificial Sequence
  chemically synthesized
gttttaatctttaattgggg

SEQ ID NO: 482914 - DNA, 20 bp, Artificial Sequence
  chemically synthesized
tgttagttttaatctttaat

SEQ ID NO: 482915 - DNA, 20 bp, Artificial Sequence
  chemically synthesized
cattgaagggttttataaga

SEQ ID NO: 482916 - DNA, 20 bp, Artificial Sequence
  chemically synthesized
aagacagtagggaaacattg

SEQ ID NO: 482917 - DNA, 20 bp, Artificial Sequence
  chemically synthesized
aatgtttccctactgtcttc

SEQ ID NO: 482918 - DNA, 20 bp, Artificial Sequence
  chemically synthesized
gcaacaaatcacaagataag

SEQ ID NO: 482919 - DNA, 20 bp, Artificial Sequence
  chemically synthesized
tgttactacatctaggccca

SEQ ID NO: 482920 - DNA, 20 bp, Artificial Sequence
  chemically synthesized
gggaaaagtggccaaaagca

SEQ ID NO: 482921 - DNA, 20 bp, Artificial Sequence
  chemically synthesized
agtggccaaaagcagagaat

SEQ ID NO: 482922 - DNA, 20 bp, Artificial Sequence
  chemically synthesized
caaaaggttattgctcttct

SEQ ID NO: 482923 - DNA, 20 bp, Artificial Sequence
  chemically synthesized
ctgtggcaacctcaaaggga

SEQ ID NO: 482924 - DNA, 20 bp, Artificial Sequence
  chemically synthesized
cctcaaagggagggaattag

SEQ ID NO: 482925 - DNA, 20 bp, Artificial Sequence
  chemically synthesized
tcaatttccttctagggctc

SEQ ID NO: 482926 - DNA, 20 bp, Artificial Sequence
  chemically synthesized
gatgacagaggtcagcctcc

SEQ ID NO: 482927 - DNA, 20 bp, Artificial Sequence
  chemically synthesized
gagcaagggagagaaggtca

SEQ ID NO: 482928 - DNA, 20 bp, Artificial Sequence
  chemically synthesized
aaacaaaatgtatatggcac

SEQ ID NO: 482929 - DNA, 20 bp, Artificial Sequence
  chemically synthesized
acataactttgtggaggcaa

SEQ ID NO: 482930 - DNA, 20 bp, Artificial Sequence
  chemically synthesized
gctttggcctcccagagacc

SEQ ID NO: 482931 - DNA, 20 bp, Artificial Sequence
  chemically synthesized
caggtctctgggaggccaaa

SEQ ID NO: 482932 - DNA, 20 bp, Artificial Sequence
  chemically synthesized
tctctgggaggccaaagcgg

SEQ ID NO: 482933 - DNA, 20 bp, Artificial Sequence
  chemically synthesized
agcgggtggatcatgaggtc

SEQ ID NO: 482934 - DNA, 20 bp, Artificial Sequence
  chemically synthesized
ttttgtatttttagtagaga

SEQ ID NO: 482935 - DNA, 20 bp, Artificial Sequence
  chemically synthesized
gcctcagcctcctgagtagc

SEQ ID NO: 482936 - DNA, 20 bp, Artificial Sequence
  chemically synthesized
gattctcctgcctcagcctc

SEQ ID NO: 482937 - DNA, 20 bp, Artificial Sequence
  chemically synthesized
tactcaggaggctgaggcag

SEQ ID NO: 482938 - DNA, 20 bp, Artificial Sequence
  chemically synthesized
ctcactgcaacctctgcctc

SEQ ID NO: 482939 - DNA, 20 bp, Artificial Sequence
  chemically synthesized
tcatgccgctgcactccagc

SEQ ID NO: 482940 - DNA, 20 bp, Artificial Sequence
  chemically synthesized
ttttgctctgtcacccaggc

SEQ ID NO: 482941 - DNA, 20 bp, Artificial Sequence
  chemically synthesized
ctatgtatttatttttgaga

SEQ ID NO: 482942 - DNA, 20 bp, Artificial Sequence
  chemically synthesized
tgttacaatcactagttttg

SEQ ID NO: 482943 - DNA, 20 bp, Artificial Sequence
  chemically synthesized
gaaatcaaaaatatagtccc

SEQ ID NO: 482944 - DNA, 20 bp, Artificial Sequence
  chemically synthesized
tctataatgtgtgccactta

SEQ ID NO: 482945 - DNA, 20 bp, Artificial Sequence
  chemically synthesized
tttatcaggtttatttctgt

SEQ ID NO: 482946 - DNA, 20 bp, Artificial Sequence
  chemically synthesized
taagtgttctgaaatattct

SEQ ID NO: 482947 - DNA, 20 bp, Artificial Sequence
  chemically synthesized
gtttgtaattggaatatcca

SEQ ID NO: 482948 - DNA, 20 bp, Artificial Sequence
  chemically synthesized
gttgaaaaagggtttgtaat

SEQ ID NO: 482949 - DNA, 20 bp, Artificial Sequence
  chemically synthesized
cctgctatgataagttgaaa

SEQ ID NO: 482950 - DNA, 20 bp, Artificial Sequence
  chemically synthesized
atacacatggtacataacag

SEQ ID NO: 482951 - DNA, 20 bp, Artificial Sequence
  chemically synthesized
ggaatcagagactattttta

SEQ ID NO: 482952 - DNA, 20 bp, Artificial Sequence
  chemically synthesized
taacgaaagcgaaggcaaat

SEQ ID NO: 482953 - DNA, 20 bp, Artificial Sequence
  chemically synthesized
actatgctagcaatattttt

SEQ ID NO: 482954 - DNA, 20 bp, Artificial Sequence
  chemically synthesized
tgtacaaaatatttactggc

SEQ ID NO: 482955 - DNA, 20 bp, Artificial Sequence
  chemically synthesized
ttccctattgaaatgaactg

SEQ ID NO: 482956 - DNA, 20 bp, Artificial Sequence
  chemically synthesized
taaaagtttccttctttttc

SEQ ID NO: 482957 - DNA, 20 bp, Artificial Sequence
  chemically synthesized
accattatttcaggcaaaca

SEQ ID NO: 482958 - DNA, 20 bp, Artificial Sequence
  chemically synthesized
atttcaggcaaacatgggat

SEQ ID NO: 482959 - DNA, 20 bp, Artificial Sequence
  chemically synthesized
agcaagttaaaatggctcct

SEQ ID NO: 482960 - DNA, 20 bp, Artificial Sequence
  chemically synthesized
cttggggtgtgcatcccact

SEQ ID NO: 482961 - DNA, 20 bp, Artificial Sequence
  chemically synthesized
gtgaaaaagcataccctcag

SEQ ID NO: 482962 - DNA, 20 bp, Artificial Sequence
  chemically synthesized
ataatgtacagttgaaggtc

SEQ ID NO: 482963 - DNA, 20 bp, Artificial Sequence
  chemically synthesized
agggatagatggattattga

SEQ ID NO: 482964 - DNA, 20 bp, Artificial Sequence
  chemically synthesized
acagagggatagatggatta

SEQ ID NO: 482965 - DNA, 20 bp, Artificial Sequence
  chemically synthesized
ggggatgcacagagggatag

SEQ ID NO: 482966 - DNA, 20 bp, Artificial Sequence
  chemically synthesized
ggatgtgtggggatgcacag

SEQ ID NO: 482967 - DNA, 20 bp, Artificial Sequence
  chemically synthesized
ggctacatggatggatgtgt

SEQ ID NO: 482968 - DNA, 20 bp, Artificial Sequence
  chemically synthesized
gagactagctggctacatgg

SEQ ID NO: 482969 - DNA, 20 bp, Artificial Sequence
  chemically synthesized
aatagagactagctggctac

SEQ ID NO: 482970 - DNA, 20 bp, Artificial Sequence
  chemically synthesized
gataagaacttggaaaacaa

SEQ ID NO: 482971 - DNA, 20 bp, Artificial Sequence
  chemically synthesized
ctgcattctttggataggca

SEQ ID NO: 482972 - DNA, 20 bp, Artificial Sequence
  chemically synthesized
tgctattcactgcctatcca

SEQ ID NO: 482973 - DNA, 20 bp, Artificial Sequence
  chemically synthesized
cactgcctatccaaagaatg

SEQ ID NO: 482974 - DNA, 20 bp, Artificial Sequence
  chemically synthesized
ccatgctcactctgcattct

SEQ ID NO: 482975 - DNA, 20 bp, Artificial Sequence
  chemically synthesized
gagtgagcatggagaagata

SEQ ID NO: 482976 - DNA, 20 bp, Artificial Sequence
  chemically synthesized
gtgttcctcacaacctccca

SEQ ID NO: 482977 - DNA, 20 bp, Artificial Sequence
  chemically synthesized
cattttagtcaggaggactg

SEQ ID NO: 482978 - DNA, 20 bp, Artificial Sequence
  chemically synthesized
ttttgggagagacagaaatc

SEQ ID NO: 482979 - DNA, 20 bp, Artificial Sequence
  chemically synthesized
agtctatgtgccatataaat

SEQ ID NO: 482980 - DNA, 20 bp, Artificial Sequence
  chemically synthesized
actgagcccaacaccgggct

SEQ ID NO: 482981 - DNA, 20 bp, Artificial Sequence
  chemically synthesized
ctttttacgttgtattttcc

SEQ ID NO: 482982 - DNA, 20 bp, Artificial Sequence
  chemically synthesized
cctggaaaatacaacgtaaa

SEQ ID NO: 482983 - DNA, 20 bp, Artificial Sequence
  chemically synthesized
aaacacaaagagcaaataag

SEQ ID NO: 482984 - DNA, 20 bp, Artificial Sequence
  chemically synthesized
tgaaagactagagaaggagg

SEQ ID NO: 482985 - DNA, 20 bp, Artificial Sequence
  chemically synthesized
agaaagattttcaaaaacac

SEQ ID NO: 482986 - DNA, 20 bp, Artificial Sequence
  chemically synthesized
aaatcataactaacatttat

SEQ ID NO: 482987 - DNA, 20 bp, Artificial Sequence
  chemically synthesized
aacgtaaacaattatactta

SEQ ID NO: 482988 - DNA, 20 bp, Artificial Sequence
  chemically synthesized
tatttcctcatttgttaaat

SEQ ID NO: 482989 - DNA, 20 bp, Artificial Sequence
  chemically synthesized
gtgattgttagagccgacac

SEQ ID NO: 482990 - DNA, 20 bp, Artificial Sequence
  chemically synthesized
ggctttggaggtctaacttc

SEQ ID NO: 482991 - DNA, 20 bp, Artificial Sequence
  chemically synthesized
attccatgtggccaaagcca

SEQ ID NO: 482992 - DNA, 20 bp, Artificial Sequence
  chemically synthesized
atccattggctttggccaca

SEQ ID NO: 482993 - DNA, 20 bp, Artificial Sequence
  chemically synthesized
cattttgtgtatggtcttca

SEQ ID NO: 482994 - DNA, 20 bp, Artificial Sequence
  chemically synthesized
cttcttataatgatctatgg

SEQ ID NO: 482995 - DNA, 20 bp, Artificial Sequence
  chemically synthesized
ttataagaaggaagtcagag

SEQ ID NO: 482996 - DNA, 20 bp, Artificial Sequence
  chemically synthesized
ttttcccaaatatggaaaac

SEQ ID NO: 482997 - DNA, 20 bp, Artificial Sequence
  chemically synthesized
caaatatggaaaacttgagt

SEQ ID NO: 482998 - DNA, 20 bp, Artificial Sequence
  chemically synthesized
aatagacctctctttgctct

SEQ ID NO: 482999 - DNA, 20 bp, Artificial Sequence
  chemically synthesized
taaccactaaagccagggag

SEQ ID NO: 483000 - DNA, 20 bp, Artificial Sequence
  chemically synthesized
ttggaaccataagtccatct

SEQ ID NO: 483001 - DNA, 20 bp, Artificial Sequence
  chemically synthesized
cagaaccaatgaaacaactc

SEQ ID NO: 483002 - DNA, 20 bp, Artificial Sequence
  chemically synthesized
aacaacaacaacaaaaatcc

SEQ ID NO: 483003 - DNA, 20 bp, Artificial Sequence
  chemically synthesized
aagcaatgggttttctcttt

SEQ ID NO: 483004 - DNA, 20 bp, Artificial Sequence
  chemically synthesized
tccatcttaaacaagaagca

SEQ ID NO: 483005 - DNA, 20 bp, Artificial Sequence
  chemically synthesized
cccattgcttcttgtttaag

SEQ ID NO: 483006 - DNA, 20 bp, Artificial Sequence
  chemically synthesized
aattgttctaagatggatat

SEQ ID NO: 483007 - DNA, 20 bp, Artificial Sequence
  chemically synthesized
ttcctcttaattgttctaag

SEQ ID NO: 483008 - DNA, 20 bp, Artificial Sequence
  chemically synthesized
tccatcttagaacaattaag

SEQ ID NO: 483009 - DNA, 20 bp, Artificial Sequence
  chemically synthesized
atgcaatggagaaggaaaac

SEQ ID NO: 483010 - DNA, 20 bp, Artificial Sequence
  chemically synthesized
ctggtcatgctatttaattc

SEQ ID NO: 483011 - DNA, 20 bp, Artificial Sequence
  chemically synthesized
agatagacgaggcttgattc

SEQ ID NO: 483012 - DNA, 20 bp, Artificial Sequence
  chemically synthesized
cactgatcaatacattttgt

SEQ ID NO: 483013 - DNA, 20 bp, Artificial Sequence
  chemically synthesized
taagtctaagctactttgaa

SEQ ID NO: 483014 - DNA, 20 bp, Artificial Sequence
  chemically synthesized
gagacctttgtttacatcaa

SEQ ID NO: 483015 - DNA, 20 bp, Artificial Sequence
  chemically synthesized
gatgtaaacaaaggtctcct

SEQ ID NO: 483016 - DNA, 20 bp, Artificial Sequence
  chemically synthesized
aggtctcctaggaattgtac

SEQ ID NO: 483017 - DNA, 20 bp, Artificial Sequence
  chemically synthesized
aggaattgtacaagaatcat

SEQ ID NO: 483018 - DNA, 20 bp, Artificial Sequence
  chemically synthesized
gaatcatgggaattgtacat

SEQ ID NO: 483019 - DNA, 20 bp, Artificial Sequence
  chemically synthesized
ctagttaaagctactttaag

SEQ ID NO: 483020 - DNA, 20 bp, Artificial Sequence
  chemically synthesized
ctgcttaaagtagctttaac

SEQ ID NO: 483021 - DNA, 20 bp, Artificial Sequence
  chemically synthesized
agggtatctagataaataca

SEQ ID NO: 483022 - DNA, 20 bp, Artificial Sequence
  chemically synthesized
gaatgcttatatcaccttgg

SEQ ID NO: 483023 - DNA, 20 bp, Artificial Sequence
  chemically synthesized
cttcctacccataaggctca

SEQ ID NO: 483024 - DNA, 20 bp, Artificial Sequence
  chemically synthesized
aacattattctgtgagcctt

SEQ ID NO: 483025 - DNA, 20 bp, Artificial Sequence
  chemically synthesized
tgtgagccttatgggtagga

SEQ ID NO: 483026 - DNA, 20 bp, Artificial Sequence
  chemically synthesized
gtattcataatataaagaaa

SEQ ID NO: 483027 - DNA, 20 bp, Artificial Sequence
  chemically synthesized
ctattcaatttctttatatt

SEQ ID NO: 483028 - DNA, 20 bp, Artificial Sequence
  chemically synthesized
gtccccagatgtctctcttt

SEQ ID NO: 483029 - DNA, 20 bp, Artificial Sequence
  chemically synthesized
caccctatatgtgaatgtcc

SEQ ID NO: 483030 - DNA, 20 bp, Artificial Sequence
  chemically synthesized
tatcccaggacattcacata

SEQ ID NO: 483031 - DNA, 20 bp, Artificial Sequence
  chemically synthesized
caggcgtggccaccctatat

SEQ ID NO: 483032 - DNA, 20 bp, Artificial Sequence
  chemically synthesized
gagtagaattattttaaacc

SEQ ID NO: 483033 - DNA, 20 bp, Artificial Sequence
  chemically synthesized
tacttaaaagggaaaaagag

SEQ ID NO: 483034 - DNA, 20 bp, Artificial Sequence
  chemically synthesized
agatctacttaaaagggaaa

SEQ ID NO: 483035 - DNA, 20 bp, Artificial Sequence
  chemically synthesized
tatgtgatgatgacatttga

SEQ ID NO: 483036 - DNA, 20 bp, Artificial Sequence
  chemically synthesized
tttatatgtgatgatgacat

SEQ ID NO: 483037 - DNA, 20 bp, Artificial Sequence
  chemically synthesized
tttgaggcaaggacactgtc

SEQ ID NO: 483038 - DNA, 20 bp, Artificial Sequence
  chemically synthesized
ccttgcctcaaaggcaagga

SEQ ID NO: 483039 - DNA, 20 bp, Artificial Sequence
  chemically synthesized
tgctggcatatacttgaagg

SEQ ID NO: 483040 - DNA, 20 bp, Artificial Sequence
  chemically synthesized
acactgctggcatatacttg

SEQ ID NO: 483041 - DNA, 20 bp, Artificial Sequence
  chemically synthesized
caggaagcatttagccaatg

SEQ ID NO: 483042 - DNA, 20 bp, Artificial Sequence
  chemically synthesized
gcatttagccaatgatggat

SEQ ID NO: 483043 - DNA, 20 bp, Artificial Sequence
  chemically synthesized
agccaatgatggataagagt

SEQ ID NO: 483044 - DNA, 20 bp, Artificial Sequence
  chemically synthesized
ctcaaagttgtcaaccacaa

SEQ ID NO: 483045 - DNA, 20 bp, Artificial Sequence
  chemically synthesized
atctcccagagctccttcat

SEQ ID NO: 483046 - DNA, 20 bp, Artificial Sequence
  chemically synthesized
tagttattgctttgggccac

SEQ ID NO: 483047 - DNA, 20 bp, Artificial Sequence
  chemically synthesized
atcccaggaagtaccagtag

SEQ ID NO: 483048 - DNA, 20 bp, Artificial Sequence
  chemically synthesized
actctcctactggtacttcc

SEQ ID NO: 483049 - DNA, 20 bp, Artificial Sequence
  chemically synthesized
ccagagaaggatttttttaa

SEQ ID NO: 483050 - DNA, 20 bp, Artificial Sequence
  chemically synthesized
cttcttccgctttgccagag

SEQ ID NO: 483051 - DNA, 20 bp, Artificial Sequence
  chemically synthesized
caaacactagtttgtgcact

SEQ ID NO: 483052 - DNA, 20 bp, Artificial Sequence
  chemically synthesized
acaaactagtgtttggcatt

SEQ ID NO: 483053 - DNA, 20 bp, Artificial Sequence
  chemically synthesized
cttcaataaatgtctgtcaa

SEQ ID NO: 483054 - DNA, 20 bp, Artificial Sequence
  chemically synthesized
tatcattataaagagaaagt

SEQ ID NO: 483055 - DNA, 20 bp, Artificial Sequence
  chemically synthesized
aggaaggaaatgggaaagtc

SEQ ID NO: 483056 - DNA, 20 bp, Artificial Sequence
  chemically synthesized
tcagaggacatttgttcgcc

SEQ ID NO: 483057 - DNA, 20 bp, Artificial Sequence
  chemically synthesized
tccaggcgaacaaatgtcct

SEQ ID NO: 483058 - DNA, 20 bp, Artificial Sequence
  chemically synthesized
attaaagatgttttatacaa

SEQ ID NO: 483059 - DNA, 20 bp, Artificial Sequence
  chemically synthesized
tttaatgtcatgtttactag

SEQ ID NO: 483060 - DNA, 20 bp, Artificial Sequence
  chemically synthesized
cctcccatatcttttaattt

SEQ ID NO: 483061 - DNA, 20 bp, Artificial Sequence
  chemically synthesized
ccataaattaaaagatatgg

SEQ ID NO: 483062 - DNA, 20 bp, Artificial Sequence
  chemically synthesized
cattgattagttttggctta

SEQ ID NO: 483063 - DNA, 20 bp, Artificial Sequence
  chemically synthesized
taaaataactataggttaga

SEQ ID NO: 483064 - DNA, 20 bp, Artificial Sequence
  chemically synthesized
aagaagatagacacaggcaa

SEQ ID NO: 483065 - DNA, 20 bp, Artificial Sequence
  chemically synthesized
ccctctatatattgaagcca

SEQ ID NO: 483066 - DNA, 20 bp, Artificial Sequence
  chemically synthesized
atatattgaagccagtggat

SEQ ID NO: 483067 - DNA, 20 bp, Artificial Sequence
  chemically synthesized
acaccagctggcatggctaa

SEQ ID NO: 483068 - DNA, 20 bp, Artificial Sequence
  chemically synthesized
ttgctgcaagcttcactgct

SEQ ID NO: 483069 - DNA, 20 bp, Artificial Sequence
  chemically synthesized
cttctccttaacgagaagta

SEQ ID NO: 483070 - DNA, 20 bp, Artificial Sequence
  chemically synthesized
agaagactttgtcttgcatc

SEQ ID NO: 483071 - DNA, 20 bp, Artificial Sequence
  chemically synthesized
ggataccagctcagccacag

SEQ ID NO: 483072 - DNA, 20 bp, Artificial Sequence
  chemically synthesized
acagtaggatggggcatggg

SEQ ID NO: 483073 - DNA, 20 bp, Artificial Sequence
  chemically synthesized
gctatccaggaactagggcc

SEQ ID NO: 483074 - DNA, 20 bp, Artificial Sequence
  chemically synthesized
cccattccaggccctagttc

SEQ ID NO: 483075 - DNA, 20 bp, Artificial Sequence
  chemically synthesized
tagcagattcccttttggcc

SEQ ID NO: 483076 - DNA, 20 bp, Artificial Sequence
  chemically synthesized
agacacaccctgggccaaaa

SEQ ID NO: 483077 - DNA, 20 bp, Artificial Sequence
  chemically synthesized
agggaaggactcagtcctat

SEQ ID NO: 483078 - DNA, 20 bp, Artificial Sequence
  chemically synthesized
gctgatgaatcctgatagga

SEQ ID NO: 483079 - DNA, 20 bp, Artificial Sequence
  chemically synthesized
gcctctttagttagtagctg

SEQ ID NO: 483080 - DNA, 20 bp, Artificial Sequence
  chemically synthesized
aactaaagaggccttgaacg

SEQ ID NO: 483081 - DNA, 20 bp, Artificial Sequence
  chemically synthesized
ataaccagttgcaataccca

SEQ ID NO: 483082 - DNA, 20 bp, Artificial Sequence
  chemically synthesized
caagtcccacagtgtactcc

SEQ ID NO: 483083 - DNA, 20 bp, Artificial Sequence
  chemically synthesized
ccaccacagctgggaatttg

SEQ ID NO: 483084 - DNA, 20 bp, Artificial Sequence
  chemically synthesized
tcaccataaccaccacagct

SEQ ID NO: 483085 - DNA, 20 bp, Artificial Sequence
  chemically synthesized
gtctacttttctcaaacaga

SEQ ID NO: 483086 - DNA, 20 bp, Artificial Sequence
  chemically synthesized
cagagaagcaggcaggcttc

SEQ ID NO: 483087 - DNA, 20 bp, Artificial Sequence
  chemically synthesized
caggcaggcttctgggattt

SEQ ID NO: 483088 - DNA, 20 bp, Artificial Sequence
  chemically synthesized
ggagcccaaggccctaaaat

SEQ ID NO: 483089 - DNA, 20 bp, Artificial Sequence
  chemically synthesized
ggctcttccatcagcttgtg

SEQ ID NO: 483090 - DNA, 20 bp, Artificial Sequence
  chemically synthesized
cctgtggccctcaccaccat

SEQ ID NO: 483091 - DNA, 20 bp, Artificial Sequence
  chemically synthesized
ggtggtgagggccacaggga

SEQ ID NO: 483092 - DNA, 20 bp, Artificial Sequence
  chemically synthesized
ccttgcccttttaaaaggca

SEQ ID NO: 483093 - DNA, 20 bp, Artificial Sequence
  chemically synthesized
ggagcactttatattgtggt

SEQ ID NO: 483094 - DNA, 20 bp, Artificial Sequence
  chemically synthesized
gagtgctagcttagccacaa

SEQ ID NO: 483095 - DNA, 20 bp, Artificial Sequence
  chemically synthesized
gctgtctgagggccagtcat

SEQ ID NO: 483096 - DNA, 20 bp, Artificial Sequence
  chemically synthesized
ctggccctcagacagcatct

SEQ ID NO: 483097 - DNA, 20 bp, Artificial Sequence
  chemically synthesized
ttcctttctcttgctgcttt

SEQ ID NO: 483098 - DNA, 20 bp, Artificial Sequence
  chemically synthesized
ccacaggtcaaggataaaga

SEQ ID NO: 483099 - DNA, 20 bp, Artificial Sequence
  chemically synthesized
tttctttatccttgacctgt

SEQ ID NO: 483100 - DNA, 20 bp, Artificial Sequence
  chemically synthesized
taatcaaactcccacaggtc

SEQ ID NO: 483101 - DNA, 20 bp, Artificial Sequence
  chemically synthesized
caaagttatagaacaccaag

SEQ ID NO: 483102 - DNA, 20 bp, Artificial Sequence
  chemically synthesized
gttctataactttgtcgtac

SEQ ID NO: 483103 - DNA, 20 bp, Artificial Sequence
  chemically synthesized
caggaggtagagaaagagat

SEQ ID NO: 483104 - DNA, 20 bp, Artificial Sequence
  chemically synthesized
agcctcaaaagggtcaatct

SEQ ID NO: 483105 - DNA, 20 bp, Artificial Sequence
  chemically synthesized
gatccagaaaatagcctcaa

SEQ ID NO: 483106 - DNA, 20 bp, Artificial Sequence
  chemically synthesized
gacccttttgaggctatttt

SEQ ID NO: 483107 - DNA, 20 bp, Artificial Sequence
  chemically synthesized
ttttgaagggttttttgtgt

SEQ ID NO: 483108 - DNA, 20 bp, Artificial Sequence
  chemically synthesized
tggattcattgatttttttg

SEQ ID NO: 483109 - DNA, 20 bp, Artificial Sequence
  chemically synthesized
aaaacccttcaaaaaaatca

SEQ ID NO: 483110 - DNA, 20 bp, Artificial Sequence
  chemically synthesized
tcttttcaaaaaactggctc

SEQ ID NO: 483111 - DNA, 20 bp, Artificial Sequence
  chemically synthesized
cagttttttgaaaagatcaa

SEQ ID NO: 483112 - DNA, 20 bp, Artificial Sequence
  chemically synthesized
taataaagaagaaaagagag

SEQ ID NO: 483113 - DNA, 20 bp, Artificial Sequence
  chemically synthesized
atgcaataaaaaatgataaa

SEQ ID NO: 483114 - DNA, 20 bp, Artificial Sequence
  chemically synthesized
agaaatacaaactaccatca

SEQ ID NO: 483115 - DNA, 20 bp, Artificial Sequence
  chemically synthesized
aactagaaaatctagaagaa

SEQ ID NO: 483116 - DNA, 20 bp, Artificial Sequence
  chemically synthesized
ttgggaaggtgtatgtgtgc

SEQ ID NO: 483117 - DNA, 20 bp, Artificial Sequence
  chemically synthesized
aagactaaaccaggaagaag

SEQ ID NO: 483118 - DNA, 20 bp, Artificial Sequence
  chemically synthesized
accaggaagaagttgaatcc

SEQ ID NO: 483119 - DNA, 20 bp, Artificial Sequence
  chemically synthesized
agcctgttattggtctattc

SEQ ID NO: 483120 - DNA, 20 bp, Artificial Sequence
  chemically synthesized
caaaaaaagtccaggaccag

SEQ ID NO: 483121 - DNA, 20 bp, Artificial Sequence
  chemically synthesized
aggaccagacggattcacag

SEQ ID NO: 483122 - DNA, 20 bp, Artificial Sequence
  chemically synthesized
acctctggtagaattcggct

SEQ ID NO: 483123 - DNA, 20 bp, Artificial Sequence
  chemically synthesized
gttcctctttgcacctctgg

SEQ ID NO: 483124 - DNA, 20 bp, Artificial Sequence
  chemically synthesized
ttgattggaatagttttaga

SEQ ID NO: 483125 - DNA, 20 bp, Artificial Sequence
  chemically synthesized
ttccctctttttctattgat

SEQ ID NO: 483126 - DNA, 20 bp, Artificial Sequence
  chemically synthesized
ttccaatcaatagaaaaaga

SEQ ID NO: 483127 - DNA, 20 bp, Artificial Sequence
  chemically synthesized
gcctcataaaatgagttagg

SEQ ID NO: 483128 - DNA, 20 bp, Artificial Sequence
  chemically synthesized
gatgatgctggcctcataaa

SEQ ID NO: 483129 - DNA, 20 bp, Artificial Sequence
  chemically synthesized
tctctgccaggctttggtat

SEQ ID NO: 483130 - DNA, 20 bp, Artificial Sequence
  chemically synthesized
gcagagacacaacaaaaaaa

SEQ ID NO: 483131 - DNA, 20 bp, Artificial Sequence
  chemically synthesized
tttttgcatcgatgttcatc

SEQ ID NO: 483132 - DNA, 20 bp, Artificial Sequence
  chemically synthesized
cggtttgccagtattttatt

SEQ ID NO: 483133 - DNA, 20 bp, Artificial Sequence
  chemically synthesized
ctcaataaaatactggcaaa

SEQ ID NO: 483134 - DNA, 20 bp, Artificial Sequence
  chemically synthesized
ataagctttttgatgtgctg

SEQ ID NO: 483135 - DNA, 20 bp, Artificial Sequence
  chemically synthesized
atgaagcccacttgatcatg

SEQ ID NO: 483136 - DNA, 20 bp, Artificial Sequence
  chemically synthesized
gatcaagtgggcttcatccc

SEQ ID NO: 483137 - DNA, 20 bp, Artificial Sequence
  chemically synthesized
ttgaaccagccttgcatccc

SEQ ID NO: 483138 - DNA, 20 bp, Artificial Sequence
  chemically synthesized
tcgttggttctgtttatatg

SEQ ID NO: 483139 - DNA, 20 bp, Artificial Sequence
  chemically synthesized
gtttttagcatgaagggctg

SEQ ID NO: 483140 - DNA, 20 bp, Artificial Sequence
  chemically synthesized
ccatcaatacctaatttatc

SEQ ID NO: 483141 - DNA, 20 bp, Artificial Sequence
  chemically synthesized
cattcagtatgatattggct

SEQ ID NO: 483142 - DNA, 20 bp, Artificial Sequence
  chemically synthesized
aacccacagccaatatcata

SEQ ID NO: 483143 - DNA, 20 bp, Artificial Sequence
  chemically synthesized
gtcttgtgccagttttcaaa

SEQ ID NO: 483144 - DNA, 20 bp, Artificial Sequence
  chemically synthesized
tttgaaaactggcacaagac

SEQ ID NO: 483145 - DNA, 20 bp, Artificial Sequence
  chemically synthesized
cttccaacactatgttgaat

SEQ ID NO: 483146 - DNA, 20 bp, Artificial Sequence
  chemically synthesized
ccagaacttccaacactatg

SEQ ID NO: 483147 - DNA, 20 bp, Artificial Sequence
  chemically synthesized
tcaggcaggaaaaagaaata

SEQ ID NO: 483148 - DNA, 20 bp, Artificial Sequence
  chemically synthesized
ttgacttcctcttttcctaa

SEQ ID NO: 483149 - DNA, 20 bp, Artificial Sequence
  chemically synthesized
gagattttgggctgagacga

SEQ ID NO: 483150 - DNA, 20 bp, Artificial Sequence
  chemically synthesized
aagcaacttcagcaaagtct

SEQ ID NO: 483151 - DNA, 20 bp, Artificial Sequence
  chemically synthesized
tttgtctgttattggtgtat

SEQ ID NO: 483152 - DNA, 20 bp, Artificial Sequence
  chemically synthesized
gacaaacagagagccaaatc

SEQ ID NO: 483153 - DNA, 20 bp, Artificial Sequence
  chemically synthesized
tctttgaagcaattgtgaat

SEQ ID NO: 483154 - DNA, 20 bp, Artificial Sequence
  chemically synthesized
ttattctctttgaagcaatt

SEQ ID NO: 483155 - DNA, 20 bp, Artificial Sequence
  chemically synthesized
tcattcacaattgcttcaaa

SEQ ID NO: 483156 - DNA, 20 bp, Artificial Sequence
  chemically synthesized
acctacaaatacaacttaca

SEQ ID NO: 483157 - DNA, 20 bp, Artificial Sequence
  chemically synthesized
tggaagaacattccatgctc

SEQ ID NO: 483158 - DNA, 20 bp, Artificial Sequence
  chemically synthesized
attcttcctatccatgagca

SEQ ID NO: 483159 - DNA, 20 bp, Artificial Sequence
  chemically synthesized
attccatgctcatggatagg

SEQ ID NO: 483160 - DNA, 20 bp, Artificial Sequence
  chemically synthesized
gtagcttgatggggatggca

SEQ ID NO: 483161 - DNA, 20 bp, Artificial Sequence
  chemically synthesized
aaagtcattggtagcttgat

SEQ ID NO: 483162 - DNA, 20 bp, Artificial Sequence
  chemically synthesized
gctaccaatgactttcttca

SEQ ID NO: 483163 - DNA, 20 bp, Artificial Sequence
  chemically synthesized
ccagctttgttcttttggct

SEQ ID NO: 483164 - DNA, 20 bp, Artificial Sequence
  chemically synthesized
acaaaaacaagaaatgggga

SEQ ID NO: 483165 - DNA, 20 bp, Artificial Sequence
  chemically synthesized
ccagcaccatttattaaata

SEQ ID NO: 483166 - DNA, 20 bp, Artificial Sequence
  chemically synthesized
ccatatgtagagagctgaaa

SEQ ID NO: 483167 - DNA, 20 bp, Artificial Sequence
  chemically synthesized
ttttgtatatggtataagga

SEQ ID NO: 483168 - DNA, 20 bp, Artificial Sequence
  chemically synthesized
tatacaaaaattaattcaag

SEQ ID NO: 483169 - DNA, 20 bp, Artificial Sequence
  chemically synthesized
cattaagtcttcaatccatc

SEQ ID NO: 483170 - DNA, 20 bp, Artificial Sequence
  chemically synthesized
gtattgcctaggttttcttc

SEQ ID NO: 483171 - DNA, 20 bp, Artificial Sequence
  chemically synthesized
tccttgcccatgcctacgtc

SEQ ID NO: 483172 - DNA, 20 bp, Artificial Sequence
  chemically synthesized
caaaagccaaaacggacaaa

SEQ ID NO: 483173 - DNA, 20 bp, Artificial Sequence
  chemically synthesized
acagcaaaagaaactaccat

SEQ ID NO: 483174 - DNA, 20 bp, Artificial Sequence
  chemically synthesized
cagagtgaacaggcagccta

SEQ ID NO: 483175 - DNA, 20 bp, Artificial Sequence
  chemically synthesized
ggatattagccctttgtcag

SEQ ID NO: 483176 - DNA, 20 bp, Artificial Sequence
  chemically synthesized
tctgacaaagggctaatatc

SEQ ID NO: 483177 - DNA, 20 bp, Artificial Sequence
  chemically synthesized
gtttgagttctttgtagatt

SEQ ID NO: 483178 - DNA, 20 bp, Artificial Sequence
  chemically synthesized
gttttttcttgtaagtttgt

SEQ ID NO: 483179 - DNA, 20 bp, Artificial Sequence
  chemically synthesized
atccttcgcccactttttga

SEQ ID NO: 483180 - DNA, 20 bp, Artificial Sequence
  chemically synthesized
accccatcaaaaagtgggcg

SEQ ID NO: 483181 - DNA, 20 bp, Artificial Sequence
  chemically synthesized
agataccatctcacaccagt

SEQ ID NO: 483182 - DNA, 20 bp, Artificial Sequence
  chemically synthesized
aggaaacaacaggtgctgga

SEQ ID NO: 483183 - DNA, 20 bp, Artificial Sequence
  chemically synthesized
agtcagtgtggcgattcctc

SEQ ID NO: 483184 - DNA, 20 bp, Artificial Sequence
  chemically synthesized
tttctagttctagatccctg

SEQ ID NO: 483185 - DNA, 20 bp, Artificial Sequence
  chemically synthesized
tatacccagtaatgggatag

SEQ ID NO: 483186 - DNA, 20 bp, Artificial Sequence
  chemically synthesized
ttgacccagctatcccatta

SEQ ID NO: 483187 - DNA, 20 bp, Artificial Sequence
  chemically synthesized
tttgggtatatacccagtaa

SEQ ID NO: 483188 - DNA, 20 bp, Artificial Sequence
  chemically synthesized
cattactgggtatataccca

SEQ ID NO: 483189 - DNA, 20 bp, Artificial Sequence
  chemically synthesized
gcagcaggatttataatcct

SEQ ID NO: 483190 - DNA, 20 bp, Artificial Sequence
  chemically synthesized
tgcatgtatctttacagcag

SEQ ID NO: 483191 - DNA, 20 bp, Artificial Sequence
  chemically synthesized
ggttccaggtctttgctatt

SEQ ID NO: 483192 - DNA, 20 bp, Artificial Sequence
  chemically synthesized
agtctatcattgatggacat

SEQ ID NO: 483193 - DNA, 20 bp, Artificial Sequence
  chemically synthesized
aaatgtccatcaatgataga

SEQ ID NO: 483194 - DNA, 20 bp, Artificial Sequence
  chemically synthesized
aatgtggcacatatacacca

SEQ ID NO: 483195 - DNA, 20 bp, Artificial Sequence
  chemically synthesized
aatactatgcaaccataaaa

SEQ ID NO: 483196 - DNA, 20 bp, Artificial Sequence
  chemically synthesized
ctatgcaaccataaaaaagg

SEQ ID NO: 483197 - DNA, 20 bp, Artificial Sequence
  chemically synthesized
gcttcatccatgtccctaca

SEQ ID NO: 483198 - DNA, 20 bp, Artificial Sequence
  chemically synthesized
ttcacatcctttgtagggac

SEQ ID NO: 483199 - DNA, 20 bp, Artificial Sequence
  chemically synthesized
gcatgttctcactcataggt

SEQ ID NO: 483200 - DNA, 20 bp, Artificial Sequence
  chemically synthesized
tcattgttcaattcccacct

SEQ ID NO: 483201 - DNA, 20 bp, Artificial Sequence
  chemically synthesized
tcacacaccggggcctgtcg

SEQ ID NO: 483202 - DNA, 20 bp, Artificial Sequence
  chemically synthesized
gtggggtgaggggacggggg

SEQ ID NO: 483203 - DNA, 20 bp, Artificial Sequence
  chemically synthesized
ctaatgtaaatgacaagtta

SEQ ID NO: 483204 - DNA, 20 bp, Artificial Sequence
  chemically synthesized
tttaattatactttaagttc

SEQ ID NO: 483205 - DNA, 20 bp, Artificial Sequence
  chemically synthesized
acataaaatgtgggaggagg

SEQ ID NO: 483206 - DNA, 20 bp, Artificial Sequence
  chemically synthesized
gaggagggagagtcaaagtg

SEQ ID NO: 483207 - DNA, 20 bp, Artificial Sequence
  chemically synthesized
aaaatgttttatgtaagcct

SEQ ID NO: 483208 - DNA, 20 bp, Artificial Sequence
  chemically synthesized
gtattataagtttgtgcttt

SEQ ID NO: 483209 - DNA, 20 bp, Artificial Sequence
  chemically synthesized
cacaaacttataatacatac

SEQ ID NO: 483210 - DNA, 20 bp, Artificial Sequence
  chemically synthesized
gttttgtgtagtagtatact

SEQ ID NO: 483211 - DNA, 20 bp, Artificial Sequence
  chemically synthesized
aatagaggaagaaaggaaca

SEQ ID NO: 483212 - DNA, 20 bp, Artificial Sequence
  chemically synthesized
tacattcaaaataatgatgg

SEQ ID NO: 483213 - DNA, 20 bp, Artificial Sequence
  chemically synthesized
cttacccatccatcattatt

SEQ ID NO: 483214 - DNA, 20 bp, Artificial Sequence
  chemically synthesized
tatttacattcaaaataatg

SEQ ID NO: 483215 - DNA, 20 bp, Artificial Sequence
  chemically synthesized
cactctatgccttttgattg

SEQ ID NO: 483216 - DNA, 20 bp, Artificial Sequence
  chemically synthesized
aactctccaatcaaaaggca

SEQ ID NO: 483217 - DNA, 20 bp, Artificial Sequence
  chemically synthesized
aatcaaaaggcatagagtgg

SEQ ID NO: 483218 - DNA, 20 bp, Artificial Sequence
  chemically synthesized
aaaaggcatagagtggttga

SEQ ID NO: 483219 - DNA, 20 bp, Artificial Sequence
  chemically synthesized
cacttgtaggcagcacatat

SEQ ID NO: 483220 - DNA, 20 bp, Artificial Sequence
  chemically synthesized
catgcatagactgaaagtaa

SEQ ID NO: 483221 - DNA, 20 bp, Artificial Sequence
  chemically synthesized
tctttttgttctcatgtaca

SEQ ID NO: 483222 - DNA, 20 bp, Artificial Sequence
  chemically synthesized
acatgagaacaaaaagagag

SEQ ID NO: 483223 - DNA, 20 bp, Artificial Sequence
  chemically synthesized
tatatttaggtgctctgatt

SEQ ID NO: 483224 - DNA, 20 bp, Artificial Sequence
  chemically synthesized
aatatataaagcaaacatta

SEQ ID NO: 483225 - DNA, 20 bp, Artificial Sequence
  chemically synthesized
tttctgtctattgcttaaag

SEQ ID NO: 483226 - DNA, 20 bp, Artificial Sequence
  chemically synthesized
ttcaagtccaatgttttctt

SEQ ID NO: 483227 - DNA, 20 bp, Artificial Sequence
  chemically synthesized
ttcataagaaaacattggac

SEQ ID NO: 483228 - DNA, 20 bp, Artificial Sequence
  chemically synthesized
atgttacatgtgtacttgag

SEQ ID NO: 483229 - DNA, 20 bp, Artificial Sequence
  chemically synthesized
agtacacatgtaacattctc

SEQ ID NO: 483230 - DNA, 20 bp, Artificial Sequence
  chemically synthesized
ctaacatatgatctatcctg

SEQ ID NO: 483231 - DNA, 20 bp, Artificial Sequence
  chemically synthesized
gtggtcagaaaagatacacg

SEQ ID NO: 483232 - DNA, 20 bp, Artificial Sequence
  chemically synthesized
aatatgctcctaaacaatta

SEQ ID NO: 483233 - DNA, 20 bp, Artificial Sequence
  chemically synthesized
gacttttaaaaaatttcctc

SEQ ID NO: 483234 - DNA, 20 bp, Artificial Sequence
  chemically synthesized
cacaacatagaaaaacttct

SEQ ID NO: 483235 - DNA, 20 bp, Artificial Sequence
  chemically synthesized
tatttcttcttttttgatgt

SEQ ID NO: 483236 - DNA, 20 bp, Artificial Sequence
  chemically synthesized
cctcaggaaactacaaaaag

SEQ ID NO: 483237 - DNA, 20 bp, Artificial Sequence
  chemically synthesized
aggaaactacaaaaagaaga

SEQ ID NO: 483238 - DNA, 20 bp, Artificial Sequence
  chemically synthesized
tcttcattcttagtctagct

SEQ ID NO: 483239 - DNA, 20 bp, Artificial Sequence
  chemically synthesized
gacaaatccttagctagact

SEQ ID NO: 483240 - DNA, 20 bp, Artificial Sequence
  chemically synthesized
actgataacacagaaataca

SEQ ID NO: 483241 - DNA, 20 bp, Artificial Sequence
  chemically synthesized
aattgttcatcgtagtctct

SEQ ID NO: 483242 - DNA, 20 bp, Artificial Sequence
  chemically synthesized
aattggacatcctaacagaa

SEQ ID NO: 483243 - DNA, 20 bp, Artificial Sequence
  chemically synthesized
aagaattcatccatttctgt

SEQ ID NO: 483244 - DNA, 20 bp, Artificial Sequence
  chemically synthesized
ggacatcctaacagaaatgg

SEQ ID NO: 483245 - DNA, 20 bp, Artificial Sequence
  chemically synthesized
ttggtagattatgtatttct

SEQ ID NO: 483246 - DNA, 20 bp, Artificial Sequence
  chemically synthesized
aaatacataatctaccaaaa

SEQ ID NO: 483247 - DNA, 20 bp, Artificial Sequence
  chemically synthesized
agaccagtaacagctaagga

SEQ ID NO: 483248 - DNA, 20 bp, Artificial Sequence
  chemically synthesized
aagaccagatggcttcatgg

SEQ ID NO: 483249 - DNA, 20 bp, Artificial Sequence
  chemically synthesized
aggtcttctttaaatgtttg

SEQ ID NO: 483250 - DNA, 20 bp, Artificial Sequence
  chemically synthesized
cttcctctttagttttccaa

SEQ ID NO: 483251 - DNA, 20 bp, Artificial Sequence
  chemically synthesized
ttttggaaaactaaagagga

SEQ ID NO: 483252 - DNA, 20 bp, Artificial Sequence
  chemically synthesized
gccttgtaaaataaatttgg

SEQ ID NO: 483253 - DNA, 20 bp, Artificial Sequence
  chemically synthesized
tctttgcctggctttgggat

SEQ ID NO: 483254 - DNA, 20 bp, Artificial Sequence
  chemically synthesized
gtagtgtctttgcctggctt

SEQ ID NO: 483255 - DNA, 20 bp, Artificial Sequence
  chemically synthesized
gaaaactataggccaatatc

SEQ ID NO: 483256 - DNA, 20 bp, Artificial Sequence
  chemically synthesized
tggttcactagtatttcatt

SEQ ID NO: 483257 - DNA, 20 bp, Artificial Sequence
  chemically synthesized
catatttaatagtttattag

SEQ ID NO: 483258 - DNA, 20 bp, Artificial Sequence
  chemically synthesized
ataaatccctcttggtcatg

SEQ ID NO: 483259 - DNA, 20 bp, Artificial Sequence
  chemically synthesized
gattattcaccatgaccaag

SEQ ID NO: 483260 - DNA, 20 bp, Artificial Sequence
  chemically synthesized
gaccaagagggatttatccc

SEQ ID NO: 483261 - DNA, 20 bp, Artificial Sequence
  chemically synthesized
ttgaaacaaccttctatccc

SEQ ID NO: 483262 - DNA, 20 bp, Artificial Sequence
  chemically synthesized
aaatgtgattcaacatataa

SEQ ID NO: 483263 - DNA, 20 bp, Artificial Sequence
  chemically synthesized
gtacttcattctgttatatg

SEQ ID NO: 483264 - DNA, 20 bp, Artificial Sequence
  chemically synthesized
aattttgtcaaatgctcttt

SEQ ID NO: 483265 - DNA, 20 bp, Artificial Sequence
  chemically synthesized
gtttttctcataaaaggatg

SEQ ID NO: 483266 - DNA, 20 bp, Artificial Sequence
  chemically synthesized
gctaagagtttttctcataa

SEQ ID NO: 483267 - DNA, 20 bp, Artificial Sequence
  chemically synthesized
tcttctatacctaatttgct

SEQ ID NO: 483268 - DNA, 20 bp, Artificial Sequence
  chemically synthesized
atagaagaaatgttctccaa

SEQ ID NO: 483269 - DNA, 20 bp, Artificial Sequence
  chemically synthesized
ctaagttaaacaagggtggg

SEQ ID NO: 483270 - DNA, 20 bp, Artificial Sequence
  chemically synthesized
ctcccagtactaagttaaac

SEQ ID NO: 483271 - DNA, 20 bp, Artificial Sequence
  chemically synthesized
cccttgtttaacttagtact

SEQ ID NO: 483272 - DNA, 20 bp, Artificial Sequence
  chemically synthesized
taaaaggcaaccaaactgaa

SEQ ID NO: 483273 - DNA, 20 bp, Artificial Sequence
  chemically synthesized
acagttttcagtggagtcct

SEQ ID NO: 483274 - DNA, 20 bp, Artificial Sequence
  chemically synthesized
tgaattctaacagttttcag

SEQ ID NO: 483275 - DNA, 20 bp, Artificial Sequence
  chemically synthesized
aggactccactgaaaactgt

SEQ ID NO: 483276 - DNA, 20 bp, Artificial Sequence
  chemically synthesized
caactttactaaacttgtgt

SEQ ID NO: 483277 - DNA, 20 bp, Artificial Sequence
  chemically synthesized
acacaagtttagtaaagttg

SEQ ID NO: 483278 - DNA, 20 bp, Artificial Sequence
  chemically synthesized
taatagcatgaaaaaatatt

SEQ ID NO: 483279 - DNA, 20 bp, Artificial Sequence
  chemically synthesized
agcatgaaaaaatatttgga

SEQ ID NO: 483280 - DNA, 20 bp, Artificial Sequence
  chemically synthesized
cagattttgttagtattgtg

SEQ ID NO: 483281 - DNA, 20 bp, Artificial Sequence
  chemically synthesized
aatctgcatattgttcttta

SEQ ID NO: 483282 - DNA, 20 bp, Artificial Sequence
  chemically synthesized
ttgtggttccatgcaaattt

SEQ ID NO: 483283 - DNA, 20 bp, Artificial Sequence
  chemically synthesized
gcatggaaccacaaaagacc

SEQ ID NO: 483284 - DNA, 20 bp, Artificial Sequence
  chemically synthesized
taaagacagctttggctatc

SEQ ID NO: 483285 - DNA, 20 bp, Artificial Sequence
  chemically synthesized
ccaaagctgtctttactaaa

SEQ ID NO: 483286 - DNA, 20 bp, Artificial Sequence
  chemically synthesized
aaattggaagtatgtcacta

SEQ ID NO: 483287 - DNA, 20 bp, Artificial Sequence
  chemically synthesized
agtacataaaaacagaccaa

SEQ ID NO: 483288 - DNA, 20 bp, Artificial Sequence
  chemically synthesized
aataaatggtattgggaaaa

SEQ ID NO: 483289 - DNA, 20 bp, Artificial Sequence
  chemically synthesized
gaaaactgaatgttcacata

SEQ ID NO: 483290 - DNA, 20 bp, Artificial Sequence
  chemically synthesized
tcttgtataaggggtgagat

SEQ ID NO: 483291 - DNA, 20 bp, Artificial Sequence
  chemically synthesized
ccttatctcaccccttatac

SEQ ID NO: 483292 - DNA, 20 bp, Artificial Sequence
  chemically synthesized
tttgagttgattcttgtata

SEQ ID NO: 483293 - DNA, 20 bp, Artificial Sequence
  chemically synthesized
tatacaagaatcaactcaaa

SEQ ID NO: 483294 - DNA, 20 bp, Artificial Sequence
  chemically synthesized
atttaaggctttaatccatt

SEQ ID NO: 483295 - DNA, 20 bp, Artificial Sequence
  chemically synthesized
tttttgtgttgattgtgttt

SEQ ID NO: 483296 - DNA, 20 bp, Artificial Sequence
  chemically synthesized
acagcaaaggaaacaattaa

SEQ ID NO: 483297 - DNA, 20 bp, Artificial Sequence
  chemically synthesized
caaatatcttctcccaatct

SEQ ID NO: 483298 - DNA, 20 bp, Artificial Sequence
  chemically synthesized
gcttgagttccttgtatatt

SEQ ID NO: 483299 - DNA, 20 bp, Artificial Sequence
  chemically synthesized
ttttcttgttattgagtagc

SEQ ID NO: 483300 - DNA, 20 bp, Artificial Sequence
  chemically synthesized
ggttatttgttttcttgtta

SEQ ID NO: 483301 - DNA, 20 bp, Artificial Sequence
  chemically synthesized
atatttgcccatttttttat

SEQ ID NO: 483302 - DNA, 20 bp, Artificial Sequence
  chemically synthesized
ataaaaaaatgggcaaatat

SEQ ID NO: 483303 - DNA, 20 bp, Artificial Sequence
  chemically synthesized
tatgctgtttgtcatctttt

SEQ ID NO: 483304 - DNA, 20 bp, Artificial Sequence
  chemically synthesized
ttttttgatgattagagatg

SEQ ID NO: 483305 - DNA, 20 bp, Artificial Sequence
  chemically synthesized
gagatatcacctcatatctt

SEQ ID NO: 483306 - DNA, 20 bp, Artificial Sequence
  chemically synthesized
gaaagataacaagtgttcat

SEQ ID NO: 483307 - DNA, 20 bp, Artificial Sequence
  chemically synthesized
caagtgttcatgaggataca

SEQ ID NO: 483308 - DNA, 20 bp, Artificial Sequence
  chemically synthesized
aattcacaatactaccaata

SEQ ID NO: 483309 - DNA, 20 bp, Artificial Sequence
  chemically synthesized
tatccactattggtagtatt

SEQ ID NO: 483310 - DNA, 20 bp, Artificial Sequence
  chemically synthesized
acggcctccataaagacagt

SEQ ID NO: 483311 - DNA, 20 bp, Artificial Sequence
  chemically synthesized
gtttctcaaaataataaaaa

SEQ ID NO: 483312 - DNA, 20 bp, Artificial Sequence
  chemically synthesized
atgttccagaaatcccactt

SEQ ID NO: 483313 - DNA, 20 bp, Artificial Sequence
  chemically synthesized
tttgagtatgtacccagaag

SEQ ID NO: 483314 - DNA, 20 bp, Artificial Sequence
  chemically synthesized
atacactccctccttttctt

SEQ ID NO: 483315 - DNA, 20 bp, Artificial Sequence
  chemically synthesized
acatactcaaaagaaaagga

SEQ ID NO: 483316 - DNA, 20 bp, Artificial Sequence
  chemically synthesized
gaacagtgctacaacaatgt

SEQ ID NO: 483317 - DNA, 20 bp, Artificial Sequence
  chemically synthesized
agctaactgtccatcaacat

SEQ ID NO: 483318 - DNA, 20 bp, Artificial Sequence
  chemically synthesized
aactgtccatcaacatgcga

SEQ ID NO: 483319 - DNA, 20 bp, Artificial Sequence
  chemically synthesized
ggtactatttagcaataaaa

SEQ ID NO: 483320 - DNA, 20 bp, Artificial Sequence
  chemically synthesized
atccaagatgttgcaaatga

SEQ ID NO: 483321 - DNA, 20 bp, Artificial Sequence
  chemically synthesized
atcctgtcatttgcaacatc

SEQ ID NO: 483322 - DNA, 20 bp, Artificial Sequence
  chemically synthesized
tgcatgttctcacttatttg

SEQ ID NO: 483323 - DNA, 20 bp, Artificial Sequence
  chemically synthesized
aactattgaactcatggaga

SEQ ID NO: 483324 - DNA, 20 bp, Artificial Sequence
  chemically synthesized
catccttttattctgtctcc

SEQ ID NO: 483325 - DNA, 20 bp, Artificial Sequence
  chemically synthesized
aactcatggagacagaataa

SEQ ID NO: 483326 - DNA, 20 bp, Artificial Sequence
  chemically synthesized
gatggttaccagaggctaca

SEQ ID NO: 483327 - DNA, 20 bp, Artificial Sequence
  chemically synthesized
caaagggtagtgtggaggta

SEQ ID NO: 483328 - DNA, 20 bp, Artificial Sequence
  chemically synthesized
tgtggaggtaggggataggt

SEQ ID NO: 483329 - DNA, 20 bp, Artificial Sequence
  chemically synthesized
ggctacaaaaaatagttaga

SEQ ID NO: 483330 - DNA, 20 bp, Artificial Sequence
  chemically synthesized
acaaaaaatagttagaaaga

SEQ ID NO: 483331 - DNA, 20 bp, Artificial Sequence
  chemically synthesized
attacattgtttgtagcaca

SEQ ID NO: 483332 - DNA, 20 bp, Artificial Sequence
  chemically synthesized
cacaaaggataaatgcttga

SEQ ID NO: 483333 - DNA, 20 bp, Artificial Sequence
  chemically synthesized
aaggataaatgcttgacagg

SEQ ID NO: 483334 - DNA, 20 bp, Artificial Sequence
  chemically synthesized
tgtgaaacaagcacatcatg

SEQ ID NO: 483335 - DNA, 20 bp, Artificial Sequence
  chemically synthesized
atagtaggtatatatattta

SEQ ID NO: 483336 - DNA, 20 bp, Artificial Sequence
  chemically synthesized
tttttttatttttaattttt

SEQ ID NO: 483337 - DNA, 20 bp, Artificial Sequence
  chemically synthesized
acctaggaaattctgtcatt

SEQ ID NO: 483338 - DNA, 20 bp, Artificial Sequence
  chemically synthesized
atccttattattccaaatga

SEQ ID NO: 483339 - DNA, 20 bp, Artificial Sequence
  chemically synthesized
attctgtcatttggaataat

SEQ ID NO: 483340 - DNA, 20 bp, Artificial Sequence
  chemically synthesized
aagttgaactcatagaaatg

SEQ ID NO: 483341 - DNA, 20 bp, Artificial Sequence
  chemically synthesized
ccataatactctccatttct

SEQ ID NO: 483342 - DNA, 20 bp, Artificial Sequence
  chemically synthesized
ggtgatcaaaagctgcagtg

SEQ ID NO: 483343 - DNA, 20 bp, Artificial Sequence
  chemically synthesized
atcaaaagctgcagtggtgg

SEQ ID NO: 483344 - DNA, 20 bp, Artificial Sequence
  chemically synthesized
aaaatgagagacgtttatca

SEQ ID NO: 483345 - DNA, 20 bp, Artificial Sequence
  chemically synthesized
caaagttccagttagacagg

SEQ ID NO: 483346 - DNA, 20 bp, Artificial Sequence
  chemically synthesized
atttccaaatagctaaaaag

SEQ ID NO: 483347 - DNA, 20 bp, Artificial Sequence
  chemically synthesized
atacttctcatttttgtggt

SEQ ID NO: 483348 - DNA, 20 bp, Artificial Sequence
  chemically synthesized
caatccatatatatacattg

SEQ ID NO: 483349 - DNA, 20 bp, Artificial Sequence
  chemically synthesized
ttattccacaatgtatatat

SEQ ID NO: 483350 - DNA, 20 bp, Artificial Sequence
  chemically synthesized
tttagtcgacaactatatta

SEQ ID NO: 483351 - DNA, 20 bp, Artificial Sequence
  chemically synthesized
aacgaaataaaatttttaaa

SEQ ID NO: 483352 - DNA, 20 bp, Artificial Sequence
  chemically synthesized
atttttaaaatgaatattat

SEQ ID NO: 483353 - DNA, 20 bp, Artificial Sequence
  chemically synthesized
gttggatatacacctgggag

SEQ ID NO: 483354 - DNA, 20 bp, Artificial Sequence
  chemically synthesized
tttctgttggatatacacct

SEQ ID NO: 483355 - DNA, 20 bp, Artificial Sequence
  chemically synthesized
ttaataactatgcatttctg

SEQ ID NO: 483356 - DNA, 20 bp, Artificial Sequence
  chemically synthesized
agtctagtacatggtttttg

SEQ ID NO: 483357 - DNA, 20 bp, Artificial Sequence
  chemically synthesized
agactgttgatagcatggct

SEQ ID NO: 483358 - DNA, 20 bp, Artificial Sequence
  chemically synthesized
gatagcatggctatggattg

SEQ ID NO: 483359 - DNA, 20 bp, Artificial Sequence
  chemically synthesized
atgttgatatagatgagaaa

SEQ ID NO: 483360 - DNA, 20 bp, Artificial Sequence
  chemically synthesized
taaatacactgtggtatcaa

SEQ ID NO: 483361 - DNA, 20 bp, Artificial Sequence
  chemically synthesized
tggattgttcacttttctta

SEQ ID NO: 483362 - DNA, 20 bp, Artificial Sequence
  chemically synthesized
ccatattattgtatgtagtt

SEQ ID NO: 483363 - DNA, 20 bp, Artificial Sequence
  chemically synthesized
ccacaactacatacaataat

SEQ ID NO: 483364 - DNA, 20 bp, Artificial Sequence
  chemically synthesized
aactacatacaataatatgg

SEQ ID NO: 483365 - DNA, 20 bp, Artificial Sequence
  chemically synthesized
tgtttttgtgtattatatga

SEQ ID NO: 483366 - DNA, 20 bp, Artificial Sequence
  chemically synthesized
taatagaaaacttttgaagt

SEQ ID NO: 483367 - DNA, 20 bp, Artificial Sequence
  chemically synthesized
tccagtcatgaacatttcac

SEQ ID NO: 483368 - DNA, 20 bp, Artificial Sequence
  chemically synthesized
tgactggagaagacatgaag

SEQ ID NO: 483369 - DNA, 20 bp, Artificial Sequence
  chemically synthesized
atataatatagccagaagct

SEQ ID NO: 483370 - DNA, 20 bp, Artificial Sequence
  chemically synthesized
attatattatgtttcttgat

SEQ ID NO: 483371 - DNA, 20 bp, Artificial Sequence
  chemically synthesized
gaagagtgaatttctataaa

SEQ ID NO: 483372 - DNA, 20 bp, Artificial Sequence
  chemically synthesized
ggctagccatatgcagaaga

SEQ ID NO: 483373 - DNA, 20 bp, Artificial Sequence
  chemically synthesized
aactggctagccatatgcag

SEQ ID NO: 483374 - DNA, 20 bp, Artificial Sequence
  chemically synthesized
ccagcaccatttattaaata

SEQ ID NO: 483375 - DNA, 20 bp, Artificial Sequence
  chemically synthesized
gaattgtccaaagttgtatg

SEQ ID NO: 483376 - DNA, 20 bp, Artificial Sequence
  chemically synthesized
tgacaccttttttaaaaaag

SEQ ID NO: 483377 - DNA, 20 bp, Artificial Sequence
  chemically synthesized
tatgtgtcattttggctgct

SEQ ID NO: 483378 - DNA, 20 bp, Artificial Sequence
  chemically synthesized
aaatcgtattgtgtttgtag

SEQ ID NO: 483379 - DNA, 20 bp, Artificial Sequence
  chemically synthesized
agtccagttcactgtccaat

SEQ ID NO: 483380 - DNA, 20 bp, Artificial Sequence
  chemically synthesized
gtatgtgctgatgtgtgtct

SEQ ID NO: 483381 - DNA, 20 bp, Artificial Sequence
  chemically synthesized
acacacatcagcacatacag

SEQ ID NO: 483382 - DNA, 20 bp, Artificial Sequence
  chemically synthesized
ttgtttcttttattaaatag

SEQ ID NO: 483383 - DNA, 20 bp, Artificial Sequence
  chemically synthesized
ttgattgttatagtagtccc

SEQ ID NO: 483384 - DNA, 20 bp, Artificial Sequence
  chemically synthesized
gtcttttgtatatatttctg

SEQ ID NO: 483385 - DNA, 20 bp, Artificial Sequence
  chemically synthesized
aaatgtatttcattttgtca

SEQ ID NO: 483386 - DNA, 20 bp, Artificial Sequence
  chemically synthesized
gcgaagctgttatcctaaaa

SEQ ID NO: 483387 - DNA, 20 bp, Artificial Sequence
  chemically synthesized
ctaccacactgatccacttt

SEQ ID NO: 483388 - DNA, 20 bp, Artificial Sequence
  chemically synthesized
ctgagcatcaatttatacta

SEQ ID NO: 483389 - DNA, 20 bp, Artificial Sequence
  chemically synthesized
gtttttgatctgtcagtctc

SEQ ID NO: 483390 - DNA, 20 bp, Artificial Sequence
  chemically synthesized
atttcacttttgtatgtcag

SEQ ID NO: 483391 - DNA, 20 bp, Artificial Sequence
  chemically synthesized
tacaaacatgcacagattgt

SEQ ID NO: 483392 - DNA, 20 bp, Artificial Sequence
  chemically synthesized
agaaaaaaaaaatgtgtaca

SEQ ID NO: 483393 - DNA, 20 bp, Artificial Sequence
  chemically synthesized
atttgtgcagtaaatagatg

SEQ ID NO: 483394 - DNA, 20 bp, Artificial Sequence
  chemically synthesized
aaataaccaatgctaagact

SEQ ID NO: 483395 - DNA, 20 bp, Artificial Sequence
  chemically synthesized
ctgggtctcagtctgtcatc

SEQ ID NO: 483396 - DNA, 20 bp, Artificial Sequence
  chemically synthesized
ttcgtaaatcaggacacatg

SEQ ID NO: 483397 - DNA, 20 bp, Artificial Sequence
  chemically synthesized
tgtggttcttgacatgattg

SEQ ID NO: 483398 - DNA, 20 bp, Artificial Sequence
  chemically synthesized
gaaagaaacagttcagttga

SEQ ID NO: 483399 - DNA, 20 bp, Artificial Sequence
  chemically synthesized
tgtgggaatttatatcagtc

SEQ ID NO: 483400 - DNA, 20 bp, Artificial Sequence
  chemically synthesized
ctccctaagagagatgttgt

SEQ ID NO: 483401 - DNA, 20 bp, Artificial Sequence
  chemically synthesized
ccacaacatctctcttaggg

SEQ ID NO: 483402 - DNA, 20 bp, Artificial Sequence
  chemically synthesized
acacaagaaatgattacctt

SEQ ID NO: 483403 - DNA, 20 bp, Artificial Sequence
  chemically synthesized
ctgcactgactgtacagcac

SEQ ID NO: 483404 - DNA, 20 bp, Artificial Sequence
  chemically synthesized
actttgactagcagttagtc

SEQ ID NO: 483405 - DNA, 20 bp, Artificial Sequence
  chemically synthesized
gttagtcttgggttataacc

SEQ ID NO: 483406 - DNA, 20 bp, Artificial Sequence
  chemically synthesized
ccactatttcatcgctaatc

SEQ ID NO: 483407 - DNA, 20 bp, Artificial Sequence
  chemically synthesized
cctggattagcgatgaaata

SEQ ID NO: 483408 - DNA, 20 bp, Artificial Sequence
  chemically synthesized
agttgtcattatttcagttt

SEQ ID NO: 483409 - DNA, 20 bp, Artificial Sequence
  chemically synthesized
taatgacaactgcagaacca

SEQ ID NO: 483410 - DNA, 20 bp, Artificial Sequence
  chemically synthesized
tgtgaagataaaattcaata

SEQ ID NO: 483411 - DNA, 20 bp, Artificial Sequence
  chemically synthesized
ctttatgcttttattcatta

SEQ ID NO: 483412 - DNA, 20 bp, Artificial Sequence
  chemically synthesized
caataatgaataaaagcata

SEQ ID NO: 483413 - DNA, 20 bp, Artificial Sequence
  chemically synthesized
gcagtagcaccttgctttag

SEQ ID NO: 483414 - DNA, 20 bp, Artificial Sequence
  chemically synthesized
tgtatagacaagactaaaca

SEQ ID NO: 483415 - DNA, 20 bp, Artificial Sequence
  chemically synthesized
tgtgcactccctagcagatc

SEQ ID NO: 483416 - DNA, 20 bp, Artificial Sequence
  chemically synthesized
caaacattcacgatctgcta

SEQ ID NO: 483417 - DNA, 20 bp, Artificial Sequence
  chemically synthesized
tctgctagggagtgcacact

SEQ ID NO: 483418 - DNA, 20 bp, Artificial Sequence
  chemically synthesized
tatggatctcactgatccca

SEQ ID NO: 483419 - DNA, 20 bp, Artificial Sequence
  chemically synthesized
tggaactctggcgtactctg

SEQ ID NO: 483420 - DNA, 20 bp, Artificial Sequence
  chemically synthesized
actgatcccacagagtacgc

SEQ ID NO: 483421 - DNA, 20 bp, Artificial Sequence
  chemically synthesized
ggtaaatcttttgaggtcat

SEQ ID NO: 483422 - DNA, 20 bp, Artificial Sequence
  chemically synthesized
aatcttttgaggtcatttga

SEQ ID NO: 483423 - DNA, 20 bp, Artificial Sequence
  chemically synthesized
tgaggtcatttgagtgagtg

SEQ ID NO: 483424 - DNA, 20 bp, Artificial Sequence
  chemically synthesized
aattgggatcatttttcctt

SEQ ID NO: 483425 - DNA, 20 bp, Artificial Sequence
  chemically synthesized
atctttgtcttaactgcaat

SEQ ID NO: 483426 - DNA, 20 bp, Artificial Sequence
  chemically synthesized
aagatttctaaactatttgt

SEQ ID NO: 483427 - DNA, 20 bp, Artificial Sequence
  chemically synthesized
aaaaaatgttaggcatgatc

SEQ ID NO: 483428 - DNA, 20 bp, Artificial Sequence
  chemically synthesized
agctaggacacaactatacc

SEQ ID NO: 483429 - DNA, 20 bp, Artificial Sequence
  chemically synthesized
atgtctttgtatgtcaaaca

SEQ ID NO: 483430 - DNA, 20 bp, Artificial Sequence
  chemically synthesized
aaataataacacagattata

SEQ ID NO: 483431 - DNA, 20 bp, Artificial Sequence
  chemically synthesized
acttccacaaggcatttaaa

SEQ ID NO: 483432 - DNA, 20 bp, Artificial Sequence
  chemically synthesized
gtttcttcctctttgtgggt

SEQ ID NO: 483433 - DNA, 20 bp, Artificial Sequence
  chemically synthesized
atatatgtttcttcctcttt

SEQ ID NO: 483434 - DNA, 20 bp, Artificial Sequence
  chemically synthesized
tcacttagatatagaaaagg

SEQ ID NO: 483435 - DNA, 20 bp, Artificial Sequence
  chemically synthesized
atgtggttgttttacaaata

SEQ ID NO: 483436 - DNA, 20 bp, Artificial Sequence
  chemically synthesized
tcaaaaagctaaaaacagag

SEQ ID NO: 483437 - DNA, 20 bp, Artificial Sequence
  chemically synthesized
aacttggtcatcatagtggc

SEQ ID NO: 483438 - DNA, 20 bp, Artificial Sequence
  chemically synthesized
ttctctaaatcccaaaaagc

SEQ ID NO: 483439 - DNA, 20 bp, Artificial Sequence
  chemically synthesized
gtttctgcattctagctttt

SEQ ID NO: 483440 - DNA, 20 bp, Artificial Sequence
  chemically synthesized
ttaaaatttagtcatttgtt

SEQ ID NO: 483441 - DNA, 20 bp, Artificial Sequence
  chemically synthesized
ttattatccccatataatag

SEQ ID NO: 483442 - DNA, 20 bp, Artificial Sequence
  chemically synthesized
tgtttactcctctattatat

SEQ ID NO: 483443 - DNA, 20 bp, Artificial Sequence
  chemically synthesized
cctataattgagagctgtct

SEQ ID NO: 483444 - DNA, 20 bp, Artificial Sequence
  chemically synthesized
tttctggggcttcttaaatc

SEQ ID NO: 483445 - DNA, 20 bp, Artificial Sequence
  chemically synthesized
tcctcctttgctttatgact

SEQ ID NO: 483446 - DNA, 20 bp, Artificial Sequence
  chemically synthesized
tcctgagtcataaagcaaag

SEQ ID NO: 483447 - DNA, 20 bp, Artificial Sequence
  chemically synthesized
ataaagcaaaggaggataga

SEQ ID NO: 483448 - DNA, 20 bp, Artificial Sequence
  chemically synthesized
ttagagctgaaaacatctcc

SEQ ID NO: 483449 - DNA, 20 bp, Artificial Sequence
  chemically synthesized
tcatctaggcactgggctgg

SEQ ID NO: 483450 - DNA, 20 bp, Artificial Sequence
  chemically synthesized
ttgttcatctaggcactggg

SEQ ID NO: 483451 - DNA, 20 bp, Artificial Sequence
  chemically synthesized
tcaatagccatactgttccc

SEQ ID NO: 483452 - DNA, 20 bp, Artificial Sequence
  chemically synthesized
ttaactgacatgtagcatga

SEQ ID NO: 483453 - DNA, 20 bp, Artificial Sequence
  chemically synthesized
ggaacattttttaggttggc

SEQ ID NO: 483454 - DNA, 20 bp, Artificial Sequence
  chemically synthesized
tatgaaatgagttttgatga

SEQ ID NO: 483455 - DNA, 20 bp, Artificial Sequence
  chemically synthesized
gtattatgaaatgagttttg

SEQ ID NO: 483456 - DNA, 20 bp, Artificial Sequence
  chemically synthesized
aatctcatgtgtattatgaa

SEQ ID NO: 483457 - DNA, 20 bp, Artificial Sequence
  chemically synthesized
gtggcaaaatttgtatagac

SEQ ID NO: 483458 - DNA, 20 bp, Artificial Sequence
  chemically synthesized
acatgcatgttgaagaactt

SEQ ID NO: 483459 - DNA, 20 bp, Artificial Sequence
  chemically synthesized
gaagggcatcagaaaataat

SEQ ID NO: 483460 - DNA, 20 bp, Artificial Sequence
  chemically synthesized
tcagaaaataataggggttg

SEQ ID NO: 483461 - DNA, 20 bp, Artificial Sequence
  chemically synthesized
aagtgatacaacaaaatcta

SEQ ID NO: 483462 - DNA, 20 bp, Artificial Sequence
  chemically synthesized
gatacaacaaaatctagaga

SEQ ID NO: 483463 - DNA, 20 bp, Artificial Sequence
  chemically synthesized
aaagctgaaagaattgtaca

SEQ ID NO: 483464 - DNA, 20 bp, Artificial Sequence
  chemically synthesized
tcaaatacacagaaagctga

SEQ ID NO: 483465 - DNA, 20 bp, Artificial Sequence
  chemically synthesized
gtatttgaaaaattttaaaa

SEQ ID NO: 483466 - DNA, 20 bp, Artificial Sequence
  chemically synthesized
acctcggcctcccaaagtgc

SEQ ID NO: 483467 - DNA, 20 bp, Artificial Sequence
  chemically synthesized
actttgggaggccgaggtga

SEQ ID NO: 483468 - DNA, 20 bp, Artificial Sequence
  chemically synthesized
ttttgtatttttagtacaga

SEQ ID NO: 483469 - DNA, 20 bp, Artificial Sequence
  chemically synthesized
gcctcagcctcccgagtagc

SEQ ID NO: 483470 - DNA, 20 bp, Artificial Sequence
  chemically synthesized
gattctcctgcctcagcctc

SEQ ID NO: 483471 - DNA, 20 bp, Artificial Sequence
  chemically synthesized
tactcgggaggctgaggcag

SEQ ID NO: 483472 - DNA, 20 bp, Artificial Sequence
  chemically synthesized
ctcactgcaacctctgccgc

SEQ ID NO: 483473 - DNA, 20 bp, Artificial Sequence
  chemically synthesized
tctcactatgttgcctaggc

SEQ ID NO: 483474 - DNA, 20 bp, Artificial Sequence
  chemically synthesized
atttttttttttttttgaga

SEQ ID NO: 483475 - DNA, 20 bp, Artificial Sequence
  chemically synthesized
ctgctttgtgttttctgtga

SEQ ID NO: 483476 - DNA, 20 bp, Artificial Sequence
  chemically synthesized
tgtattatttaagcagtttt

SEQ ID NO: 483477 - DNA, 20 bp, Artificial Sequence
  chemically synthesized
gaagaaaaaaataccatctg

SEQ ID NO: 483478 - DNA, 20 bp, Artificial Sequence
  chemically synthesized
agatactaaacagaacttat

SEQ ID NO: 483479 - DNA, 20 bp, Artificial Sequence
  chemically synthesized
aagtcacaatgtgtatggag

SEQ ID NO: 483480 - DNA, 20 bp, Artificial Sequence
  chemically synthesized
gtatggagaggagttggaaa

SEQ ID NO: 483481 - DNA, 20 bp, Artificial Sequence
  chemically synthesized
attacctccttaaaagtatg

SEQ ID NO: 483482 - DNA, 20 bp, Artificial Sequence
  chemically synthesized
ggttaactcattttctctat

SEQ ID NO: 483483 - DNA, 20 bp, Artificial Sequence
  chemically synthesized
tgaatattctaatagagaaa

SEQ ID NO: 483484 - DNA, 20 bp, Artificial Sequence
  chemically synthesized
atgttttattaccaaaacag

SEQ ID NO: 483485 - DNA, 20 bp, Artificial Sequence
  chemically synthesized
ttcccatacggaaagatgag

SEQ ID NO: 483486 - DNA, 20 bp, Artificial Sequence
  chemically synthesized
aaagatgagctgggtgagag

SEQ ID NO: 483487 - DNA, 20 bp, Artificial Sequence
  chemically synthesized
tgagctgggtgagaggagga

SEQ ID NO: 483488 - DNA, 20 bp, Artificial Sequence
  chemically synthesized
tgggtttttaccactggttg

SEQ ID NO: 483489 - DNA, 20 bp, Artificial Sequence
  chemically synthesized
acttacatgtttcattatga

SEQ ID NO: 483490 - DNA, 20 bp, Artificial Sequence
  chemically synthesized
ttgttttattaattaaatag

SEQ ID NO: 483491 - DNA, 20 bp, Artificial Sequence
  chemically synthesized
tattatttgatcacattaaa

SEQ ID NO: 483492 - DNA, 20 bp, Artificial Sequence
  chemically synthesized
aacataatgacttctctttt

SEQ ID NO: 483493 - DNA, 20 bp, Artificial Sequence
  chemically synthesized
atgactgagatgctggaccg

SEQ ID NO: 483494 - DNA, 20 bp, Artificial Sequence
  chemically synthesized
tgaactcttgctgaacactt

SEQ ID NO: 483495 - DNA, 20 bp, Artificial Sequence
  chemically synthesized
acaactcaaaagtgttcagc

SEQ ID NO: 483496 - DNA, 20 bp, Artificial Sequence
  chemically synthesized
tggtaataaatctgtggtgc

SEQ ID NO: 483497 - DNA, 20 bp, Artificial Sequence
  chemically synthesized
gtgcaaatttacagtgatga

SEQ ID NO: 483498 - DNA, 20 bp, Artificial Sequence
  chemically synthesized
tgatgtgcaaatttacagtg

SEQ ID NO: 483499 - DNA, 20 bp, Artificial Sequence
  chemically synthesized
atcaaatttgatgcatttgt

SEQ ID NO: 483500 - DNA, 20 bp, Artificial Sequence
  chemically synthesized
taaatatttttaaaatcatg

SEQ ID NO: 483501 - DNA, 20 bp, Artificial Sequence
  chemically synthesized
tttttctcccttagcacaca

SEQ ID NO: 483502 - DNA, 20 bp, Artificial Sequence
  chemically synthesized
gccacttcaacttttacttg

SEQ ID NO: 483503 - DNA, 20 bp, Artificial Sequence
  chemically synthesized
agtgaggccactttgttttt

SEQ ID NO: 483504 - DNA, 20 bp, Artificial Sequence
  chemically synthesized
tggagtatgcttgtaaaaat

SEQ ID NO: 483505 - DNA, 20 bp, Artificial Sequence
  chemically synthesized
taacttgaatagttggatgg

SEQ ID NO: 483506 - DNA, 20 bp, Artificial Sequence
  chemically synthesized
ttatttcttaacttgaatag

SEQ ID NO: 483507 - DNA, 20 bp, Artificial Sequence
  chemically synthesized
atttatttttatttcttaac

SEQ ID NO: 483508 - DNA, 20 bp, Artificial Sequence
  chemically synthesized
ttctgtcagtaagcaatgta

SEQ ID NO: 483509 - DNA, 20 bp, Artificial Sequence
  chemically synthesized
ctgaagagaaggaggtaagg

SEQ ID NO: 483510 - DNA, 20 bp, Artificial Sequence
  chemically synthesized
gtacagcgagggaattaggc

SEQ ID NO: 483511 - DNA, 20 bp, Artificial Sequence
  chemically synthesized
tggaacattgagtacagcga

SEQ ID NO: 483512 - DNA, 20 bp, Artificial Sequence
  chemically synthesized
agatggaagagactggaaca

SEQ ID NO: 483513 - DNA, 20 bp, Artificial Sequence
  chemically synthesized
gacataggaggggtaaaaga

SEQ ID NO: 483514 - DNA, 20 bp, Artificial Sequence
  chemically synthesized
acggagattgaagacatagg

SEQ ID NO: 483515 - DNA, 20 bp, Artificial Sequence
  chemically synthesized
accaaccaaacaaaagacaa

SEQ ID NO: 483516 - DNA, 20 bp, Artificial Sequence
  chemically synthesized
tttccatcaggggacgcagg

SEQ ID NO: 483517 - DNA, 20 bp, Artificial Sequence
  chemically synthesized
tcccacaaaggaggaagaca

SEQ ID NO: 483518 - DNA, 20 bp, Artificial Sequence
  chemically synthesized
tatgtcttcctcctttgtgg

SEQ ID NO: 483519 - DNA, 20 bp, Artificial Sequence
  chemically synthesized
gcttacaccagtgctactta

SEQ ID NO: 483520 - DNA, 20 bp, Artificial Sequence
  chemically synthesized
ctgataacttgttagaaatg

SEQ ID NO: 483521 - DNA, 20 bp, Artificial Sequence
  chemically synthesized
caggctccactctagagcta

SEQ ID NO: 483522 - DNA, 20 bp, Artificial Sequence
  chemically synthesized
agattttgattcattagctc

SEQ ID NO: 483523 - DNA, 20 bp, Artificial Sequence
  chemically synthesized
gaggtgtggatgtggaaata

SEQ ID NO: 483524 - DNA, 20 bp, Artificial Sequence
  chemically synthesized
tttagaagggtatgtgaggt

SEQ ID NO: 483525 - DNA, 20 bp, Artificial Sequence
  chemically synthesized
gccaaaacgtaatggtttag

SEQ ID NO: 483526 - DNA, 20 bp, Artificial Sequence
  chemically synthesized
ttaaagttgctacagtatta

SEQ ID NO: 483527 - DNA, 20 bp, Artificial Sequence
  chemically synthesized
cgtcaattggcaggtactga

SEQ ID NO: 483528 - DNA, 20 bp, Artificial Sequence
  chemically synthesized
tcaaaagagaaggtttcaaa

SEQ ID NO: 483529 - DNA, 20 bp, Artificial Sequence
  chemically synthesized
ttaatatggaagattccttc

SEQ ID NO: 483530 - DNA, 20 bp, Artificial Sequence
  chemically synthesized
aggcagaataaaatccaaga

SEQ ID NO: 483531 - DNA, 20 bp, Artificial Sequence
  chemically synthesized
gtgaggagtggccaaatagg

SEQ ID NO: 483532 - DNA, 20 bp, Artificial Sequence
  chemically synthesized
ggaatgggcctaagagagtg

SEQ ID NO: 483533 - DNA, 20 bp, Artificial Sequence
  chemically synthesized
catttaaggaatgggcctaa

SEQ ID NO: 483534 - DNA, 20 bp, Artificial Sequence
  chemically synthesized
ctagggaatagcaacattta

SEQ ID NO: 483535 - DNA, 20 bp, Artificial Sequence
  chemically synthesized
cttaaatgttgctattccct

SEQ ID NO: 483536 - DNA, 20 bp, Artificial Sequence
  chemically synthesized
agatcaaagggagaccccta

SEQ ID NO: 483537 - DNA, 20 bp, Artificial Sequence
  chemically synthesized
cactttacatattctctctg

SEQ ID NO: 483538 - DNA, 20 bp, Artificial Sequence
  chemically synthesized
acatacatgaactcaccaga

SEQ ID NO: 483539 - DNA, 20 bp, Artificial Sequence
  chemically synthesized
tttactatctctaaaataat

SEQ ID NO: 483540 - DNA, 20 bp, Artificial Sequence
  chemically synthesized
taaaatctgtgttttaagct

SEQ ID NO: 483541 - DNA, 20 bp, Artificial Sequence
  chemically synthesized
ggcgtttggctctatggata

SEQ ID NO: 483542 - DNA, 20 bp, Artificial Sequence
  chemically synthesized
tttagtaggcgtttggctct

SEQ ID NO: 483543 - DNA, 20 bp, Artificial Sequence
  chemically synthesized
aaatagccaacatatccaaa

SEQ ID NO: 483544 - DNA, 20 bp, Artificial Sequence
  chemically synthesized
tgaagatgatgtaatccagt

SEQ ID NO: 483545 - DNA, 20 bp, Artificial Sequence
  chemically synthesized
atcagtgattaggggagagg

SEQ ID NO: 483546 - DNA, 20 bp, Artificial Sequence
  chemically synthesized
ataaggaagaaagaagaatg

SEQ ID NO: 483547 - DNA, 20 bp, Artificial Sequence
  chemically synthesized
ttaaagtataaggaagaaag

SEQ ID NO: 483548 - DNA, 20 bp, Artificial Sequence
  chemically synthesized
atactttaaccaagaagatg

SEQ ID NO: 483549 - DNA, 20 bp, Artificial Sequence
  chemically synthesized
gcaatctagggaagagagag

SEQ ID NO: 483550 - DNA, 20 bp, Artificial Sequence
  chemically synthesized
acacaaccttgtctgtgcat

SEQ ID NO: 483551 - DNA, 20 bp, Artificial Sequence
  chemically synthesized
agagggctgctttaaaaact

SEQ ID NO: 483552 - DNA, 20 bp, Artificial Sequence
  chemically synthesized
aggctctgatttaactggtt

SEQ ID NO: 483553 - DNA, 20 bp, Artificial Sequence
  chemically synthesized
ctgatttaactggtttgggg

SEQ ID NO: 483554 - DNA, 20 bp, Artificial Sequence
  chemically synthesized
tgcacgttagaatcactagg

SEQ ID NO: 483555 - DNA, 20 bp, Artificial Sequence
  chemically synthesized
tctcatccctggctgcacgt

SEQ ID NO: 483556 - DNA, 20 bp, Artificial Sequence
  chemically synthesized
agtgattctaacgtgcagcc

SEQ ID NO: 483557 - DNA, 20 bp, Artificial Sequence
  chemically synthesized
tagagttttaaagaaggatg

SEQ ID NO: 483558 - DNA, 20 bp, Artificial Sequence
  chemically synthesized
ctctgactagagttttaaag

SEQ ID NO: 483559 - DNA, 20 bp, Artificial Sequence
  chemically synthesized
aaaaaaaagacttctctgac

SEQ ID NO: 483560 - DNA, 20 bp, Artificial Sequence
  chemically synthesized
ttttttttttttttttaata

SEQ ID NO: 483561 - DNA, 20 bp, Artificial Sequence
  chemically synthesized
tggtgccactgcacttcagc

SEQ ID NO: 483562 - DNA, 20 bp, Artificial Sequence
  chemically synthesized
ctcactgccacctctgcctc

SEQ ID NO: 483563 - DNA, 20 bp, Artificial Sequence
  chemically synthesized
tactcaggaggctgaggcag

SEQ ID NO: 483564 - DNA, 20 bp, Artificial Sequence
  chemically synthesized
tattctcctgcctcagcctc

SEQ ID NO: 483565 - DNA, 20 bp, Artificial Sequence
  chemically synthesized
gcctcagcctcctgagtagc

SEQ ID NO: 483566 - DNA, 20 bp, Artificial Sequence
  chemically synthesized
ttttgtatttttagtagaga

SEQ ID NO: 483567 - DNA, 20 bp, Artificial Sequence
  chemically synthesized
tgggtggaccacttgatgtc

SEQ ID NO: 483568 - DNA, 20 bp, Artificial Sequence
  chemically synthesized
ttcagaagacttctctggag

SEQ ID NO: 483569 - DNA, 20 bp, Artificial Sequence
  chemically synthesized
atactatcctgaaagcagtg

SEQ ID NO: 483570 - DNA, 20 bp, Artificial Sequence
  chemically synthesized
ctcccaccccacactgcttt

SEQ ID NO: 483571 - DNA, 20 bp, Artificial Sequence
  chemically synthesized
aagatcttgtaggataggta

SEQ ID NO: 483572 - DNA, 20 bp, Artificial Sequence
  chemically synthesized
ccacgttataaaagatcttg

SEQ ID NO: 483573 - DNA, 20 bp, Artificial Sequence
  chemically synthesized
ttcctgtgtagctgtaaagc

SEQ ID NO: 483574 - DNA, 20 bp, Artificial Sequence
  chemically synthesized
tagtggcagtgacttttgag

SEQ ID NO: 483575 - DNA, 20 bp, Artificial Sequence
  chemically synthesized
aaggctttgatagggtgaaa

SEQ ID NO: 483576 - DNA, 20 bp, Artificial Sequence
  chemically synthesized
gcacgtaaacaaggctttga

SEQ ID NO: 483577 - DNA, 20 bp, Artificial Sequence
  chemically synthesized
gagaaactcacaaggtagca

SEQ ID NO: 483578 - DNA, 20 bp, Artificial Sequence
  chemically synthesized
gtgccattccatgctacctt

SEQ ID NO: 483579 - DNA, 20 bp, Artificial Sequence
  chemically synthesized
tgggtaggaaggacacttac

SEQ ID NO: 483580 - DNA, 20 bp, Artificial Sequence
  chemically synthesized
ttcacttttacagtttaggc

SEQ ID NO: 483581 - DNA, 20 bp, Artificial Sequence
  chemically synthesized
gtatgtgatcaaatgttttg

SEQ ID NO: 483582 - DNA, 20 bp, Artificial Sequence
  chemically synthesized
attaaggggaagatgaggaa

SEQ ID NO: 483583 - DNA, 20 bp, Artificial Sequence
  chemically synthesized
ttctccagaaaagcaaaaag

SEQ ID NO: 483584 - DNA, 20 bp, Artificial Sequence
  chemically synthesized
aataataaaaaaaaagatca

SEQ ID NO: 483585 - DNA, 20 bp, Artificial Sequence
  chemically synthesized
agtatgtatgttaaatgaac

SEQ ID NO: 483586 - DNA, 20 bp, Artificial Sequence
  chemically synthesized
ctatattattaagacaaaca

SEQ ID NO: 483587 - DNA, 20 bp, Artificial Sequence
  chemically synthesized
ggtagaaaaaccaaaaagga

SEQ ID NO: 483588 - DNA, 20 bp, Artificial Sequence
  chemically synthesized
atctgaaaatggagcctagg

SEQ ID NO: 483589 - DNA, 20 bp, Artificial Sequence
  chemically synthesized
tgtttaaacttcagcaattc

SEQ ID NO: 483590 - DNA, 20 bp, Artificial Sequence
  chemically synthesized
aatcatttactataacattc

SEQ ID NO: 483591 - DNA, 20 bp, Artificial Sequence
  chemically synthesized
ggggattattggaacgagga

SEQ ID NO: 483592 - DNA, 20 bp, Artificial Sequence
  chemically synthesized
agctgttttgttacttgaat

SEQ ID NO: 483593 - DNA, 20 bp, Artificial Sequence
  chemically synthesized
gtattaagctgttttgttac

SEQ ID NO: 483594 - DNA, 20 bp, Artificial Sequence
  chemically synthesized
ttacatattttgtagatttt

SEQ ID NO: 483595 - DNA, 20 bp, Artificial Sequence
  chemically synthesized
aggagctgctgtactattgt

SEQ ID NO: 483596 - DNA, 20 bp, Artificial Sequence
  chemically synthesized
cagctccttaaatgcaatgc

SEQ ID NO: 483597 - DNA, 20 bp, Artificial Sequence
  chemically synthesized
aaaacagtgggagcaattga

SEQ ID NO: 483598 - DNA, 20 bp, Artificial Sequence
  chemically synthesized
tctctccaggtctttcttct

SEQ ID NO: 483599 - DNA, 20 bp, Artificial Sequence
  chemically synthesized
atggctacgaaatacaggaa

SEQ ID NO: 483600 - DNA, 20 bp, Artificial Sequence
  chemically synthesized
aaagggaaattctcctgaaa

SEQ ID NO: 483601 - DNA, 20 bp, Artificial Sequence
  chemically synthesized
ctatgggaattctgtttcag

SEQ ID NO: 483602 - DNA, 20 bp, Artificial Sequence
  chemically synthesized
attttttttccttttactat

SEQ ID NO: 483603 - DNA, 20 bp, Artificial Sequence
  chemically synthesized
agtaaaaggaaaaaaaattg

SEQ ID NO: 483604 - DNA, 20 bp, Artificial Sequence
  chemically synthesized
gtttacaaagcactgttcac

SEQ ID NO: 483605 - DNA, 20 bp, Artificial Sequence
  chemically synthesized
attttctttaaaataagata

SEQ ID NO: 483606 - DNA, 20 bp, Artificial Sequence
  chemically synthesized
ttttatatgttttaaaagga

SEQ ID NO: 483607 - DNA, 20 bp, Artificial Sequence
  chemically synthesized
attagttttatatgttttaa

SEQ ID NO: 483608 - DNA, 20 bp, Artificial Sequence
  chemically synthesized
acgtatgtgtgtctttttgt

SEQ ID NO: 483609 - DNA, 20 bp, Artificial Sequence
  chemically synthesized
tatataaagacaaatcagta

SEQ ID NO: 483610 - DNA, 20 bp, Artificial Sequence
  chemically synthesized
agattataaaaaagtttgtg

SEQ ID NO: 483611 - DNA, 20 bp, Artificial Sequence
  chemically synthesized
aatctcttatataactgaga

SEQ ID NO: 483612 - DNA, 20 bp, Artificial Sequence
  chemically synthesized
ttatataactgagattgagt

SEQ ID NO: 483613 - DNA, 20 bp, Artificial Sequence
  chemically synthesized
tcaattatgtaatttactta

SEQ ID NO: 483614 - DNA, 20 bp, Artificial Sequence
  chemically synthesized
tctgtaagtaaattacataa

SEQ ID NO: 483615 - DNA, 20 bp, Artificial Sequence
  chemically synthesized
attgagtattcacatgcctt

SEQ ID NO: 483616 - DNA, 20 bp, Artificial Sequence
  chemically synthesized
agcatagattccaaaggcat

SEQ ID NO: 483617 - DNA, 20 bp, Artificial Sequence
  chemically synthesized
ttcacgatagactccactta

SEQ ID NO: 483618 - DNA, 20 bp, Artificial Sequence
  chemically synthesized
ttagtgatgcattcaataag

SEQ ID NO: 483619 - DNA, 20 bp, Artificial Sequence
  chemically synthesized
tcatagctcccagtggcctt

SEQ ID NO: 483620 - DNA, 20 bp, Artificial Sequence
  chemically synthesized
gtcttcaacctcagtgcaat

SEQ ID NO: 483621 - DNA, 20 bp, Artificial Sequence
  chemically synthesized
tccctgctttaaacctttca

SEQ ID NO: 483622 - DNA, 20 bp, Artificial Sequence
  chemically synthesized
attagtcatgttgctaattg

SEQ ID NO: 483623 - DNA, 20 bp, Artificial Sequence
  chemically synthesized
gcaaaaaagatgcagaaaaa

SEQ ID NO: 483624 - DNA, 20 bp, Artificial Sequence
  chemically synthesized
acagagtaagatgttagcat

SEQ ID NO: 483625 - DNA, 20 bp, Artificial Sequence
  chemically synthesized
agtccaggcacagcctgatg

SEQ ID NO: 483626 - DNA, 20 bp, Artificial Sequence
  chemically synthesized
cccaagttcttccctctgcc

SEQ ID NO: 483627 - DNA, 20 bp, Artificial Sequence
  chemically synthesized
tggtacatggcaggtgcttc

SEQ ID NO: 483628 - DNA, 20 bp, Artificial Sequence
  chemically synthesized
tgcttttgatgggaaatgaa

SEQ ID NO: 483629 - DNA, 20 bp, Artificial Sequence
  chemically synthesized
aaaaacctcacaatttttta

SEQ ID NO: 483630 - DNA, 20 bp, Artificial Sequence
  chemically synthesized
acaattttttaaggggtctt

SEQ ID NO: 483631 - DNA, 20 bp, Artificial Sequence
  chemically synthesized
ttggcttttctagcttgact

SEQ ID NO: 483632 - DNA, 20 bp, Artificial Sequence
  chemically synthesized
tttttagactatgatagaga

SEQ ID NO: 483633 - DNA, 20 bp, Artificial Sequence
  chemically synthesized
tccacattcaacaagaaatt

SEQ ID NO: 483634 - DNA, 20 bp, Artificial Sequence
  chemically synthesized
cacggacccacaatttcttg

SEQ ID NO: 483635 - DNA, 20 bp, Artificial Sequence
  chemically synthesized
ccacaatttcttgttgaatg

SEQ ID NO: 483636 - DNA, 20 bp, Artificial Sequence
  chemically synthesized
ctatattacatttcatcatg

SEQ ID NO: 483637 - DNA, 20 bp, Artificial Sequence
  chemically synthesized
aatatagacagtttgccata

SEQ ID NO: 483638 - DNA, 20 bp, Artificial Sequence
  chemically synthesized
gagctgtcattcatatagtg

SEQ ID NO: 483639 - DNA, 20 bp, Artificial Sequence
  chemically synthesized
cttcagttattcatcactat

SEQ ID NO: 483640 - DNA, 20 bp, Artificial Sequence
  chemically synthesized
tgatgaataactgaagccat

SEQ ID NO: 483641 - DNA, 20 bp, Artificial Sequence
  chemically synthesized
aagaacaagggcaaagcctt

SEQ ID NO: 483642 - DNA, 20 bp, Artificial Sequence
  chemically synthesized
taagaataatataacctttc

SEQ ID NO: 483643 - DNA, 20 bp, Artificial Sequence
  chemically synthesized
agagcttctgccttgaaagt

SEQ ID NO: 483644 - DNA, 20 bp, Artificial Sequence
  chemically synthesized
gacgaagcaaagtgaacctc

SEQ ID NO: 483645 - DNA, 20 bp, Artificial Sequence
  chemically synthesized
aggacatggctgacaagaga

SEQ ID NO: 483646 - DNA, 20 bp, Artificial Sequence
  chemically synthesized
gaaaatgatagaaatgcttg

SEQ ID NO: 483647 - DNA, 20 bp, Artificial Sequence
  chemically synthesized
aaaaccagacaggaaactta

SEQ ID NO: 483648 - DNA, 20 bp, Artificial Sequence
  chemically synthesized
tttcttgttctctacttctt

SEQ ID NO: 483649 - DNA, 20 bp, Artificial Sequence
  chemically synthesized
gagaacaagaaagtaggagg

SEQ ID NO: 483650 - DNA, 20 bp, Artificial Sequence
  chemically synthesized
aaaaaaaaaatgctaaaagt

SEQ ID NO: 483651 - DNA, 20 bp, Artificial Sequence
  chemically synthesized
attatataagagtatgagtt

SEQ ID NO: 483652 - DNA, 20 bp, Artificial Sequence
  chemically synthesized
tttaataattatataagagt

SEQ ID NO: 483653 - DNA, 20 bp, Artificial Sequence
  chemically synthesized
gctccttttaataattatat

SEQ ID NO: 483654 - DNA, 20 bp, Artificial Sequence
  chemically synthesized
agaaaagcaaaaaaagatgg

SEQ ID NO: 483655 - DNA, 20 bp, Artificial Sequence
  chemically synthesized
gagattatgaaagagaggag

SEQ ID NO: 483656 - DNA, 20 bp, Artificial Sequence
  chemically synthesized
tctcctctctttcataatct

SEQ ID NO: 483657 - DNA, 20 bp, Artificial Sequence
  chemically synthesized
accgtggaatataggaaaac

SEQ ID NO: 483658 - DNA, 20 bp, Artificial Sequence
  chemically synthesized
tagtgctttcaaatggaccg

SEQ ID NO: 483659 - DNA, 20 bp, Artificial Sequence
  chemically synthesized
tagatgcgtttattgctagc

SEQ ID NO: 483660 - DNA, 20 bp, Artificial Sequence
  chemically synthesized
ctaatgttggctccaatgat

SEQ ID NO: 483661 - DNA, 20 bp, Artificial Sequence
  chemically synthesized
tattgctcctgaaaattaga

SEQ ID NO: 483662 - DNA, 20 bp, Artificial Sequence
  chemically synthesized
cgttagctgcaaatttctat

SEQ ID NO: 483663 - DNA, 20 bp, Artificial Sequence
  chemically synthesized
tctatatggattctttcaat

SEQ ID NO: 483664 - DNA, 20 bp, Artificial Sequence
  chemically synthesized
ccaaactgtattcagattga

SEQ ID NO: 483665 - DNA, 20 bp, Artificial Sequence
  chemically synthesized
tctttcaatctgaatacagt

SEQ ID NO: 483666 - DNA, 20 bp, Artificial Sequence
  chemically synthesized
cattagcaagaggttcagaa

SEQ ID NO: 483667 - DNA, 20 bp, Artificial Sequence
  chemically synthesized
cgttatttggaacctaatga

SEQ ID NO: 483668 - DNA, 20 bp, Artificial Sequence
  chemically synthesized
tttttaatgttcaaagtaaa

SEQ ID NO: 483669 - DNA, 20 bp, Artificial Sequence
  chemically synthesized
ccaattaggatgatgacgcc

SEQ ID NO: 483670 - DNA, 20 bp, Artificial Sequence
  chemically synthesized
acagcaggttataaaccaat

SEQ ID NO: 483671 - DNA, 20 bp, Artificial Sequence
  chemically synthesized
ttggtttataacctgctgtg

SEQ ID NO: 483672 - DNA, 20 bp, Artificial Sequence
  chemically synthesized
aaaaacaaaacaaaatgagg

SEQ ID NO: 483673 - DNA, 20 bp, Artificial Sequence
  chemically synthesized
gttaaaaaacaaaacaaaat

SEQ ID NO: 483674 - DNA, 20 bp, Artificial Sequence
  chemically synthesized
ctcctccctctagtagtccc

SEQ ID NO: 483675 - DNA, 20 bp, Artificial Sequence
  chemically synthesized
ctactagagggaggagggag

SEQ ID NO: 483676 - DNA, 20 bp, Artificial Sequence
  chemically synthesized
tagagggaggagggagggga

SEQ ID NO: 483677 - DNA, 20 bp, Artificial Sequence
  chemically synthesized
tatgctcactaacatggcga

SEQ ID NO: 483678 - DNA, 20 bp, Artificial Sequence
  chemically synthesized
atgatgctgaggtttggagt

SEQ ID NO: 483679 - DNA, 20 bp, Artificial Sequence
  chemically synthesized
tattgcatgatgctgaggtt

SEQ ID NO: 483680 - DNA, 20 bp, Artificial Sequence
  chemically synthesized
catgtgcagatttgtcacgt

SEQ ID NO: 483681 - DNA, 20 bp, Artificial Sequence
  chemically synthesized
aaaggaaccaacaatgagag

SEQ ID NO: 483682 - DNA, 20 bp, Artificial Sequence
  chemically synthesized
ccaacaatgagagaaggata

SEQ ID NO: 483683 - DNA, 20 bp, Artificial Sequence
  chemically synthesized
ataaaggcctctgaggtttc

SEQ ID NO: 483684 - DNA, 20 bp, Artificial Sequence
  chemically synthesized
ttaatagccacaatggaact

SEQ ID NO: 483685 - DNA, 20 bp, Artificial Sequence
  chemically synthesized
atgaattaaggacactaagc

SEQ ID NO: 483686 - DNA, 20 bp, Artificial Sequence
  chemically synthesized
tctttacttttccttccaca

SEQ ID NO: 483687 - DNA, 20 bp, Artificial Sequence
  chemically synthesized
taataaataaatcatatttc

SEQ ID NO: 483688 - DNA, 20 bp, Artificial Sequence
  chemically synthesized
ttacatatttataaatcatt

SEQ ID NO: 483689 - DNA, 20 bp, Artificial Sequence
  chemically synthesized
tttagtaataacacaaatga

SEQ ID NO: 483690 - DNA, 20 bp, Artificial Sequence
  chemically synthesized
ttcagctatcctgaaaaaat

SEQ ID NO: 483691 - DNA, 20 bp, Artificial Sequence
  chemically synthesized
taatattattctaatttttt

SEQ ID NO: 483692 - DNA, 20 bp, Artificial Sequence
  chemically synthesized
ttttttctaccctaaactta

SEQ ID NO: 483693 - DNA, 20 bp, Artificial Sequence
  chemically synthesized
agactctgattcagtaagtt

SEQ ID NO: 483694 - DNA, 20 bp, Artificial Sequence
  chemically synthesized
ctaccctaaacttactgaat

SEQ ID NO: 483695 - DNA, 20 bp, Artificial Sequence
  chemically synthesized
ttggggtgtcattatctgtt

SEQ ID NO: 483696 - DNA, 20 bp, Artificial Sequence
  chemically synthesized
aacagataatgacaccccaa

SEQ ID NO: 483697 - DNA, 20 bp, Artificial Sequence
  chemically synthesized
agaacaaattttcactccct

SEQ ID NO: 483698 - DNA, 20 bp, Artificial Sequence
  chemically synthesized
attgtgactcagaaatagct

SEQ ID NO: 483699 - DNA, 20 bp, Artificial Sequence
  chemically synthesized
ataaaaattcttagctattt

SEQ ID NO: 483700 - DNA, 20 bp, Artificial Sequence
  chemically synthesized
cccgtatattgtggctttca

SEQ ID NO: 483701 - DNA, 20 bp, Artificial Sequence
  chemically synthesized
catgtctgtggtattaaaac

SEQ ID NO: 483702 - DNA, 20 bp, Artificial Sequence
  chemically synthesized
tctgtggtattaaaacacgg

SEQ ID NO: 483703 - DNA, 20 bp, Artificial Sequence
  chemically synthesized
atcaagttcacctcaatttc

SEQ ID NO: 483704 - DNA, 20 bp, Artificial Sequence
  chemically synthesized
ttctctgttttttacaaaat

SEQ ID NO: 483705 - DNA, 20 bp, Artificial Sequence
  chemically synthesized
atatggaattatttatgcca

SEQ ID NO: 483706 - DNA, 20 bp, Artificial Sequence
  chemically synthesized
tcaggaaaaaaagtaggata

SEQ ID NO: 483707 - DNA, 20 bp, Artificial Sequence
  chemically synthesized
ttaatgctcaggaaaaaaag

SEQ ID NO: 483708 - DNA, 20 bp, Artificial Sequence
  chemically synthesized
aaatagtatttaatgatata

SEQ ID NO: 483709 - DNA, 20 bp, Artificial Sequence
  chemically synthesized
agattgatttatacttacca

SEQ ID NO: 483710 - DNA, 20 bp, Artificial Sequence
  chemically synthesized
tgtttgaacagggatggaaa

SEQ ID NO: 483711 - DNA, 20 bp, Artificial Sequence
  chemically synthesized
taaaatggcattgtttgaac

SEQ ID NO: 483712 - DNA, 20 bp, Artificial Sequence
  chemically synthesized
acttttgaaatcaaactttc

SEQ ID NO: 483713 - DNA, 20 bp, Artificial Sequence
  chemically synthesized
ctctttagaactgcaaaagt

SEQ ID NO: 483714 - DNA, 20 bp, Artificial Sequence
  chemically synthesized
cctacttttgcagttctaaa

SEQ ID NO: 483715 - DNA, 20 bp, Artificial Sequence
  chemically synthesized
gccttgttcccccaaagagc

SEQ ID NO: 483716 - DNA, 20 bp, Artificial Sequence
  chemically synthesized
gaacaaggcagacagatcac

SEQ ID NO: 483717 - DNA, 20 bp, Artificial Sequence
  chemically synthesized
cagacagatcacttgaattc

SEQ ID NO: 483718 - DNA, 20 bp, Artificial Sequence
  chemically synthesized
gtcaggctggtcctgaactc

SEQ ID NO: 483719 - DNA, 20 bp, Artificial Sequence
  chemically synthesized
gattctcctgcctcagcctc

SEQ ID NO: 483720 - DNA, 20 bp, Artificial Sequence
  chemically synthesized
tactcaggaggctgaggcag

SEQ ID NO: 483721 - DNA, 20 bp, Artificial Sequence
  chemically synthesized
tgcaacctccacctcctgtt

SEQ ID NO: 483722 - DNA, 20 bp, Artificial Sequence
  chemically synthesized
ttgagccactacactctagc

SEQ ID NO: 483723 - DNA, 20 bp, Artificial Sequence
  chemically synthesized
tctcactctgtcacccaggc

SEQ ID NO: 483724 - DNA, 20 bp, Artificial Sequence
  chemically synthesized
ctacactctagcctgggtga

SEQ ID NO: 483725 - DNA, 20 bp, Artificial Sequence
  chemically synthesized
gattgattgattgattgagt

SEQ ID NO: 483726 - DNA, 20 bp, Artificial Sequence
  chemically synthesized
ttgattgattgattgattga

SEQ ID NO: 483727 - DNA, 20 bp, Artificial Sequence
  chemically synthesized
tcaatcaatcaatcaatcaa

SEQ ID NO: 483728 - DNA, 20 bp, Artificial Sequence
  chemically synthesized
caatcgagtcaaatcaagaa

SEQ ID NO: 483729 - DNA, 20 bp, Artificial Sequence
  chemically synthesized
gtcaaatcaagaaaagagtg

SEQ ID NO: 483730 - DNA, 20 bp, Artificial Sequence
  chemically synthesized
agaaaagagtgcagagtaca

SEQ ID NO: 483731 - DNA, 20 bp, Artificial Sequence
  chemically synthesized
ttgagactaagctctaagaa

SEQ ID NO: 483732 - DNA, 20 bp, Artificial Sequence
  chemically synthesized
ccatataaacaatgcaacaa

SEQ ID NO: 483733 - DNA, 20 bp, Artificial Sequence
  chemically synthesized
taatctagaaaaaataataa

SEQ ID NO: 483734 - DNA, 20 bp, Artificial Sequence
  chemically synthesized
aataaaaattttttctttat

SEQ ID NO: 483735 - DNA, 20 bp, Artificial Sequence
  chemically synthesized
attttttctttatctgggtc

SEQ ID NO: 483736 - DNA, 20 bp, Artificial Sequence
  chemically synthesized
cagagagaaatatttgcgtt

SEQ ID NO: 483737 - DNA, 20 bp, Artificial Sequence
  chemically synthesized
acatttttaaactatatttt

SEQ ID NO: 483738 - DNA, 20 bp, Artificial Sequence
  chemically synthesized
taagagtgcacatatttctt

SEQ ID NO: 483739 - DNA, 20 bp, Artificial Sequence
  chemically synthesized
tctagtttctttgaaatttc

SEQ ID NO: 483740 - DNA, 20 bp, Artificial Sequence
  chemically synthesized
attttcttctgcaattacaa

SEQ ID NO: 483741 - DNA, 20 bp, Artificial Sequence
  chemically synthesized
acaataggataaaagagatt

SEQ ID NO: 483742 - DNA, 20 bp, Artificial Sequence
  chemically synthesized
tagggatataagaaggcctt

SEQ ID NO: 483743 - DNA, 20 bp, Artificial Sequence
  chemically synthesized
ttcttatatccctattatgt

SEQ ID NO: 483744 - DNA, 20 bp, Artificial Sequence
  chemically synthesized
ataagaaattctgacataat

SEQ ID NO: 483745 - DNA, 20 bp, Artificial Sequence
  chemically synthesized
atgttggaagcaagatgtcc

SEQ ID NO: 483746 - DNA, 20 bp, Artificial Sequence
  chemically synthesized
tgtgggaaatgtcgttttga

SEQ ID NO: 483747 - DNA, 20 bp, Artificial Sequence
  chemically synthesized
tgtcgttttgaaagggtttt

SEQ ID NO: 483748 - DNA, 20 bp, Artificial Sequence
  chemically synthesized
ttggggatgaagtaacccag

SEQ ID NO: 483749 - DNA, 20 bp, Artificial Sequence
  chemically synthesized
cctgttacccccagattcat

SEQ ID NO: 483750 - DNA, 20 bp, Artificial Sequence
  chemically synthesized
gaagtaacccagatgaatct

SEQ ID NO: 483751 - DNA, 20 bp, Artificial Sequence
  chemically synthesized
attaacttatactaacatat

SEQ ID NO: 483752 - DNA, 20 bp, Artificial Sequence
  chemically synthesized
tgttctgtgacagataatag

SEQ ID NO: 483753 - DNA, 20 bp, Artificial Sequence
  chemically synthesized
ttgggggaaaacctcttgca

SEQ ID NO: 483754 - DNA, 20 bp, Artificial Sequence
  chemically synthesized
tgttttttgtaccatctgag

SEQ ID NO: 483755 - DNA, 20 bp, Artificial Sequence
  chemically synthesized
ttaatatttttaaggtcatc

SEQ ID NO: 483756 - DNA, 20 bp, Artificial Sequence
  chemically synthesized
ggtcatctagaatagtaaag

SEQ ID NO: 483757 - DNA, 20 bp, Artificial Sequence
  chemically synthesized
agggtaataaagcattatga

SEQ ID NO: 483758 - DNA, 20 bp, Artificial Sequence
  chemically synthesized
caaagtgatagaattgggag

SEQ ID NO: 483759 - DNA, 20 bp, Artificial Sequence
  chemically synthesized
tagattattgttcaaagtga

SEQ ID NO: 483760 - DNA, 20 bp, Artificial Sequence
  chemically synthesized
ataatctatcatttggtctt

SEQ ID NO: 483761 - DNA, 20 bp, Artificial Sequence
  chemically synthesized
atcaataatggtaatgtgtt

SEQ ID NO: 483762 - DNA, 20 bp, Artificial Sequence
  chemically synthesized
tcttgttgtaaaataatagt

SEQ ID NO: 483763 - DNA, 20 bp, Artificial Sequence
  chemically synthesized
ggtttataaaccagtgcctt

SEQ ID NO: 483764 - DNA, 20 bp, Artificial Sequence
  chemically synthesized
gccttgtgagtttgtgtagc

SEQ ID NO: 483765 - DNA, 20 bp, Artificial Sequence
  chemically synthesized
gttgttggctatgcaaaact

SEQ ID NO: 483766 - DNA, 20 bp, Artificial Sequence
  chemically synthesized
atagagttcatatcatatag

SEQ ID NO: 483767 - DNA, 20 bp, Artificial Sequence
  chemically synthesized
ctgcataaagaggtcattga

SEQ ID NO: 483768 - DNA, 20 bp, Artificial Sequence
  chemically synthesized
aataatcattaacctgaaga

SEQ ID NO: 483769 - DNA, 20 bp, Artificial Sequence
  chemically synthesized
tgctatgtatctcatggatt

SEQ ID NO: 483770 - DNA, 20 bp, Artificial Sequence
  chemically synthesized
gaaaaagtgctatgtatctc

SEQ ID NO: 483771 - DNA, 20 bp, Artificial Sequence
  chemically synthesized
taatattgaatgtttagaat

SEQ ID NO: 483772 - DNA, 20 bp, Artificial Sequence
  chemically synthesized
gcctgttaatattgaatgtt

SEQ ID NO: 483773 - DNA, 20 bp, Artificial Sequence
  chemically synthesized
attcttaatgcctgttaata

SEQ ID NO: 483774 - DNA, 20 bp, Artificial Sequence
  chemically synthesized
attcaatattaacaggcatt

SEQ ID NO: 483775 - DNA, 20 bp, Artificial Sequence
  chemically synthesized
gtatgacctatcaatagtca

SEQ ID NO: 483776 - DNA, 20 bp, Artificial Sequence
  chemically synthesized
caatcaaacagtattttata

SEQ ID NO: 483777 - DNA, 20 bp, Artificial Sequence
  chemically synthesized
tcatgtctttataaagttcc

SEQ ID NO: 483778 - DNA, 20 bp, Artificial Sequence
  chemically synthesized
ttctcctgaggaaacatttt

SEQ ID NO: 483779 - DNA, 20 bp, Artificial Sequence
  chemically synthesized
ttctcaaaatgtttcctcag

SEQ ID NO: 483780 - DNA, 20 bp, Artificial Sequence
  chemically synthesized
ttaactagtgattgttttaa

SEQ ID NO: 483781 - DNA, 20 bp, Artificial Sequence
  chemically synthesized
ttaataacttttagatggga

SEQ ID NO: 483782 - DNA, 20 bp, Artificial Sequence
  chemically synthesized
ccatctaaaagttattaagg

SEQ ID NO: 483783 - DNA, 20 bp, Artificial Sequence
  chemically synthesized
tgaatacagatggtgtcaaa

SEQ ID NO: 483784 - DNA, 20 bp, Artificial Sequence
  chemically synthesized
aggcttgcagcaattgaatt

SEQ ID NO: 483785 - DNA, 20 bp, Artificial Sequence
  chemically synthesized
tggctgaaggcttgcagcaa

SEQ ID NO: 483786 - DNA, 20 bp, Artificial Sequence
  chemically synthesized
caagtctgattttaagataa

SEQ ID NO: 483787 - DNA, 20 bp, Artificial Sequence
  chemically synthesized
caagtttttttttttgccta

SEQ ID NO: 483788 - DNA, 20 bp, Artificial Sequence
  chemically synthesized
gtaaagaaaatactcattgt

SEQ ID NO: 483789 - DNA, 20 bp, Artificial Sequence
  chemically synthesized
atactaaagtcactcttaca

SEQ ID NO: 483790 - DNA, 20 bp, Artificial Sequence
  chemically synthesized
tcctcactaaggctcttttt

SEQ ID NO: 483791 - DNA, 20 bp, Artificial Sequence
  chemically synthesized
ttatatcacaatacacagtt

SEQ ID NO: 483792 - DNA, 20 bp, Artificial Sequence
  chemically synthesized
tggaaaacaaatatagaaat

SEQ ID NO: 483793 - DNA, 20 bp, Artificial Sequence
  chemically synthesized
caaatatagaaatcagagtt

SEQ ID NO: 483794 - DNA, 20 bp, Artificial Sequence
  chemically synthesized
cagagttaagaatgcaattt

SEQ ID NO: 483795 - DNA, 20 bp, Artificial Sequence
  chemically synthesized
gactgaagttcaatattatt

SEQ ID NO: 483796 - DNA, 20 bp, Artificial Sequence
  chemically synthesized
atctgtaagagatctattat

SEQ ID NO: 483797 - DNA, 20 bp, Artificial Sequence
  chemically synthesized
gaaatatgcttcaagaccat

SEQ ID NO: 483798 - DNA, 20 bp, Artificial Sequence
  chemically synthesized
ggtcttgaagcatatttctc

SEQ ID NO: 483799 - DNA, 20 bp, Artificial Sequence
  chemically synthesized
ttgctaaaattcatagaaga

SEQ ID NO: 483800 - DNA, 20 bp, Artificial Sequence
  chemically synthesized
tttttgtaatcctctcttct

SEQ ID NO: 483801 - DNA, 20 bp, Artificial Sequence
  chemically synthesized
aagagaggattacaaaaaac

SEQ ID NO: 483802 - DNA, 20 bp, Artificial Sequence
  chemically synthesized
ttacaaaaaactggaattct

SEQ ID NO: 483803 - DNA, 20 bp, Artificial Sequence
  chemically synthesized
tatttaaaaataattattca

SEQ ID NO: 483804 - DNA, 20 bp, Artificial Sequence
  chemically synthesized
taattatttttaaataaggg

SEQ ID NO: 483805 - DNA, 20 bp, Artificial Sequence
  chemically synthesized
taaataagggaaggatatga

SEQ ID NO: 483806 - DNA, 20 bp, Artificial Sequence
  chemically synthesized
aaaaaaatgtatgcacagtt

SEQ ID NO: 483807 - DNA, 20 bp, Artificial Sequence
  chemically synthesized
gtccaatcacgacattttga

SEQ ID NO: 483808 - DNA, 20 bp, Artificial Sequence
  chemically synthesized
cacagcagtgctcaattgtg

SEQ ID NO: 483809 - DNA, 20 bp, Artificial Sequence
  chemically synthesized
agctatggggtctgttccca

SEQ ID NO: 483810 - DNA, 20 bp, Artificial Sequence
  chemically synthesized
attctaattatctttagcta

SEQ ID NO: 483811 - DNA, 20 bp, Artificial Sequence
  chemically synthesized
accccatagctaaagataat

SEQ ID NO: 483812 - DNA, 20 bp, Artificial Sequence
  chemically synthesized
ataattagaatgttgccctc

SEQ ID NO: 483813 - DNA, 20 bp, Artificial Sequence
  chemically synthesized
tagttggaatgttacctctt

SEQ ID NO: 483814 - DNA, 20 bp, Artificial Sequence
  chemically synthesized
ggagcaataagcagtgtagt

SEQ ID NO: 483815 - DNA, 20 bp, Artificial Sequence
  chemically synthesized
tacatcattcactagattaa

SEQ ID NO: 483816 - DNA, 20 bp, Artificial Sequence
  chemically synthesized
taatttattcacttaatcta

SEQ ID NO: 483817 - DNA, 20 bp, Artificial Sequence
  chemically synthesized
accttcatgtgtatcctgat

SEQ ID NO: 483818 - DNA, 20 bp, Artificial Sequence
  chemically synthesized
gactataaagggattcatat

SEQ ID NO: 483819 - DNA, 20 bp, Artificial Sequence
  chemically synthesized
aaaggaaaggaagactataa

SEQ ID NO: 483820 - DNA, 20 bp, Artificial Sequence
  chemically synthesized
ttcatcaatttatacatttt

SEQ ID NO: 483821 - DNA, 20 bp, Artificial Sequence
  chemically synthesized
ttcataaaatgtataaattg

SEQ ID NO: 483822 - DNA, 20 bp, Artificial Sequence
  chemically synthesized
aatcaggacttatgctgtgt

SEQ ID NO: 483823 - DNA, 20 bp, Artificial Sequence
  chemically synthesized
taggttgttctgttctgttc

SEQ ID NO: 483824 - DNA, 20 bp, Artificial Sequence
  chemically synthesized
ttctgttcttgggtgaaaat

SEQ ID NO: 483825 - DNA, 20 bp, Artificial Sequence
  chemically synthesized
ccatatcgagacattaaaat

SEQ ID NO: 483826 - DNA, 20 bp, Artificial Sequence
  chemically synthesized
gtattgattaatatattgag

SEQ ID NO: 483827 - DNA, 20 bp, Artificial Sequence
  chemically synthesized
ttgaggaagaaatcatatat

SEQ ID NO: 483828 - DNA, 20 bp, Artificial Sequence
  chemically synthesized
gatttcttcctcaattagaa

SEQ ID NO: 483829 - DNA, 20 bp, Artificial Sequence
  chemically synthesized
tggacaggtcctttactacc

SEQ ID NO: 483830 - DNA, 20 bp, Artificial Sequence
  chemically synthesized
agggtgagaaatagcagctg

SEQ ID NO: 483831 - DNA, 20 bp, Artificial Sequence
  chemically synthesized
ctgctatttctcaccctaac

SEQ ID NO: 483832 - DNA, 20 bp, Artificial Sequence
  chemically synthesized
ccactcccattaacccttgt

SEQ ID NO: 483833 - DNA, 20 bp, Artificial Sequence
  chemically synthesized
tcaccctaacaagggttaat

SEQ ID NO: 483834 - DNA, 20 bp, Artificial Sequence
  chemically synthesized
atgggagtggaagaagaaga

SEQ ID NO: 483835 - DNA, 20 bp, Artificial Sequence
  chemically synthesized
gtgacagtactgagtgaagt

SEQ ID NO: 483836 - DNA, 20 bp, Artificial Sequence
  chemically synthesized
acactctaacagtgacagta

SEQ ID NO: 483837 - DNA, 20 bp, Artificial Sequence
  chemically synthesized
tcactcagtactgtcactgt

SEQ ID NO: 483838 - DNA, 20 bp, Artificial Sequence
  chemically synthesized
ctaatgtcaaatatcacttc

SEQ ID NO: 483839 - DNA, 20 bp, Artificial Sequence
  chemically synthesized
tagaagaagtagatcagagg

SEQ ID NO: 483840 - DNA, 20 bp, Artificial Sequence
  chemically synthesized
ttggcacaaagtaggttcag

SEQ ID NO: 483841 - DNA, 20 bp, Artificial Sequence
  chemically synthesized
aaatgtgtaccaacaataac

SEQ ID NO: 483842 - DNA, 20 bp, Artificial Sequence
  chemically synthesized
tggaaaagggatttataaaa

SEQ ID NO: 483843 - DNA, 20 bp, Artificial Sequence
  chemically synthesized
actttagtgaccattggaaa

SEQ ID NO: 483844 - DNA, 20 bp, Artificial Sequence
  chemically synthesized
attaaatgaagtaatgaaca

SEQ ID NO: 483845 - DNA, 20 bp, Artificial Sequence
  chemically synthesized
aagtaatgaacaatgaataa

SEQ ID NO: 483846 - DNA, 20 bp, Artificial Sequence
  chemically synthesized
aatgaacaatgaataaacgg

SEQ ID NO: 483847 - DNA, 20 bp, Artificial Sequence
  chemically synthesized
atggatgtacagagcgataa

SEQ ID NO: 483848 - DNA, 20 bp, Artificial Sequence
  chemically synthesized
agataggatatatgtgtcat

SEQ ID NO: 483849 - DNA, 20 bp, Artificial Sequence
  chemically synthesized
aaaattagtataatattaga

SEQ ID NO: 483850 - DNA, 20 bp, Artificial Sequence
  chemically synthesized
gtgtgcaaggtattggggct

SEQ ID NO: 483851 - DNA, 20 bp, Artificial Sequence
  chemically synthesized
aagcacataatcaacatttg

SEQ ID NO: 483852 - DNA, 20 bp, Artificial Sequence
  chemically synthesized
aatcaacatttgatgaatgt

SEQ ID NO: 483853 - DNA, 20 bp, Artificial Sequence
  chemically synthesized
tcatttcccggaggctgtga

SEQ ID NO: 483854 - DNA, 20 bp, Artificial Sequence
  chemically synthesized
tcagtcacagcctccgggaa

SEQ ID NO: 483855 - DNA, 20 bp, Artificial Sequence
  chemically synthesized
tttacacaaagaaatcaacc

SEQ ID NO: 483856 - DNA, 20 bp, Artificial Sequence
  chemically synthesized
taagtctgcaaatatttagt

SEQ ID NO: 483857 - DNA, 20 bp, Artificial Sequence
  chemically synthesized
tgacccttttctaatagaga

SEQ ID NO: 483858 - DNA, 20 bp, Artificial Sequence
  chemically synthesized
ctattctgtctctattagaa

SEQ ID NO: 483859 - DNA, 20 bp, Artificial Sequence
  chemically synthesized
ttcttaatctaggtatgtta

SEQ ID NO: 483860 - DNA, 20 bp, Artificial Sequence
  chemically synthesized
atataagttgtgagcaactt

SEQ ID NO: 483861 - DNA, 20 bp, Artificial Sequence
  chemically synthesized
acttatatgagagataaatt

SEQ ID NO: 483862 - DNA, 20 bp, Artificial Sequence
  chemically synthesized
atccttcaatatgtacagca

SEQ ID NO: 483863 - DNA, 20 bp, Artificial Sequence
  chemically synthesized
attcactgctgtacatattg

SEQ ID NO: 483864 - DNA, 20 bp, Artificial Sequence
  chemically synthesized
tatgtccatatgtgatttgg

SEQ ID NO: 483865 - DNA, 20 bp, Artificial Sequence
  chemically synthesized
cacagtgcactgatatactg

SEQ ID NO: 483866 - DNA, 20 bp, Artificial Sequence
  chemically synthesized
atctaatttttcaatgaaat

SEQ ID NO: 483867 - DNA, 20 bp, Artificial Sequence
  chemically synthesized
tccaatttagcatactaaaa

SEQ ID NO: 483868 - DNA, 20 bp, Artificial Sequence
  chemically synthesized
ccttaaggaatacaaataaa

SEQ ID NO: 483869 - DNA, 20 bp, Artificial Sequence
  chemically synthesized
tccctttatttgtattcctt

SEQ ID NO: 483870 - DNA, 20 bp, Artificial Sequence
  chemically synthesized
aaccagaattggcatcctta

SEQ ID NO: 483871 - DNA, 20 bp, Artificial Sequence
  chemically synthesized
taaagttgattttgtaaaac

SEQ ID NO: 483872 - DNA, 20 bp, Artificial Sequence
  chemically synthesized
ctagttcagacaaaaaagta

SEQ ID NO: 483873 - DNA, 20 bp, Artificial Sequence
  chemically synthesized
tacatatgccaagtatttta

SEQ ID NO: 483874 - DNA, 20 bp, Artificial Sequence
  chemically synthesized
acagtcttcatcatgagtat

SEQ ID NO: 483875 - DNA, 20 bp, Artificial Sequence
  chemically synthesized
attatgtaacagtcttcatc

SEQ ID NO: 483876 - DNA, 20 bp, Artificial Sequence
  chemically synthesized
atatttaaagtttacctgtt

SEQ ID NO: 483877 - DNA, 20 bp, Artificial Sequence
  chemically synthesized
agcttgttgacgtatatatt

SEQ ID NO: 483878 - DNA, 20 bp, Artificial Sequence
  chemically synthesized
aaatctacgatagggcactt

SEQ ID NO: 483879 - DNA, 20 bp, Artificial Sequence
  chemically synthesized
tacacttcattaagtaggta

SEQ ID NO: 483880 - DNA, 20 bp, Artificial Sequence
  chemically synthesized
cttaatgaagtgtaaagtca

SEQ ID NO: 483881 - DNA, 20 bp, Artificial Sequence
  chemically synthesized
tatcaacatgtggcaactaa

SEQ ID NO: 483882 - DNA, 20 bp, Artificial Sequence
  chemically synthesized
cctgttgtccctaggagaag

SEQ ID NO: 483883 - DNA, 20 bp, Artificial Sequence
  chemically synthesized
acttaagacaaaatgggaat

SEQ ID NO: 483884 - DNA, 20 bp, Artificial Sequence
  chemically synthesized
gttataacttaagacaaaat

SEQ ID NO: 483885 - DNA, 20 bp, Artificial Sequence
  chemically synthesized
agttataacataacatttta

SEQ ID NO: 483886 - DNA, 20 bp, Artificial Sequence
  chemically synthesized
attaccatgatgttttttga

SEQ ID NO: 483887 - DNA, 20 bp, Artificial Sequence
  chemically synthesized
ttgaaagcaggaatttggat

SEQ ID NO: 483888 - DNA, 20 bp, Artificial Sequence
  chemically synthesized
ccaatcttgaaagcaggaat

SEQ ID NO: 483889 - DNA, 20 bp, Artificial Sequence
  chemically synthesized
caacccccaatcttgaaagc

SEQ ID NO: 483890 - DNA, 20 bp, Artificial Sequence
  chemically synthesized
aaattcctgctttcaagatt

SEQ ID NO: 483891 - DNA, 20 bp, Artificial Sequence
  chemically synthesized
gtctcggcctcccaaagtgc

SEQ ID NO: 483892 - DNA, 20 bp, Artificial Sequence
  chemically synthesized
actttgggaggccgagacgg

SEQ ID NO: 483893 - DNA, 20 bp, Artificial Sequence
  chemically synthesized
cggggtttcaccgtgttagc

SEQ ID NO: 483894 - DNA, 20 bp, Artificial Sequence
  chemically synthesized
ttttgtatttttagtagaga

SEQ ID NO: 483895 - DNA, 20 bp, Artificial Sequence
  chemically synthesized
tacacgggaggctgaggcag

SEQ ID NO: 483896 - DNA, 20 bp, Artificial Sequence
  chemically synthesized
ctcactgcaagctccgcctc

SEQ ID NO: 483897 - DNA, 20 bp, Artificial Sequence
  chemically synthesized
cccaggctggagtgcagtgg

SEQ ID NO: 483898 - DNA, 20 bp, Artificial Sequence
  chemically synthesized
tttcgctctgtcgcccaggc

SEQ ID NO: 483899 - DNA, 20 bp, Artificial Sequence
  chemically synthesized
ttttttttttttttttgaga

SEQ ID NO: 483900 - DNA, 20 bp, Artificial Sequence
  chemically synthesized
tgttcctcagtttacttttg

SEQ ID NO: 483901 - DNA, 20 bp, Artificial Sequence
  chemically synthesized
cctagtatgttgtattctgc

SEQ ID NO: 483902 - DNA, 20 bp, Artificial Sequence
  chemically synthesized
gttcacatacctcatccttg

SEQ ID NO: 483903 - DNA, 20 bp, Artificial Sequence
  chemically synthesized
caaggatgaggtatgtgaac

SEQ ID NO: 483904 - DNA, 20 bp, Artificial Sequence
  chemically synthesized
attttcagtcttaagggatt

SEQ ID NO: 483905 - DNA, 20 bp, Artificial Sequence
  chemically synthesized
gtagtgaattttcagtctta

SEQ ID NO: 483906 - DNA, 20 bp, Artificial Sequence
  chemically synthesized
cccagactttgcaatgggta

SEQ ID NO: 483907 - DNA, 20 bp, Artificial Sequence
  chemically synthesized
aaacagacccagactttgca

SEQ ID NO: 483908 - DNA, 20 bp, Artificial Sequence
  chemically synthesized
ttcactacccattgcaaagt

SEQ ID NO: 483909 - DNA, 20 bp, Artificial Sequence
  chemically synthesized
aaagtctgggtctgtttgct

SEQ ID NO: 483910 - DNA, 20 bp, Artificial Sequence
  chemically synthesized
aggcgttttattaacctctt

SEQ ID NO: 483911 - DNA, 20 bp, Artificial Sequence
  chemically synthesized
ccatgaccatgagtcatcac

SEQ ID NO: 483912 - DNA, 20 bp, Artificial Sequence
  chemically synthesized
ccatcatcatctccatgacc

SEQ ID NO: 483913 - DNA, 20 bp, Artificial Sequence
  chemically synthesized
catcttgttctgaaaataac

SEQ ID NO: 483914 - DNA, 20 bp, Artificial Sequence
  chemically synthesized
ttattttcagaacaagatgt

SEQ ID NO: 483915 - DNA, 20 bp, Artificial Sequence
  chemically synthesized
ttaaaataattcaaatataa

SEQ ID NO: 483916 - DNA, 20 bp, Artificial Sequence
  chemically synthesized
aaacggttactcctttatat

SEQ ID NO: 483917 - DNA, 20 bp, Artificial Sequence
  chemically synthesized
ggcgaaacatatactacatg

SEQ ID NO: 483918 - DNA, 20 bp, Artificial Sequence
  chemically synthesized
agttacaaatgccatagatt

SEQ ID NO: 483919 - DNA, 20 bp, Artificial Sequence
  chemically synthesized
agttctcccacttttcctac

SEQ ID NO: 483920 - DNA, 20 bp, Artificial Sequence
  chemically synthesized
ttttaaaaaataaacaccat

SEQ ID NO: 483921 - DNA, 20 bp, Artificial Sequence
  chemically synthesized
gcctcggcctcccaaagtgc

SEQ ID NO: 483922 - DNA, 20 bp, Artificial Sequence
  chemically synthesized
cagcactttgggaggccgag

SEQ ID NO: 483923 - DNA, 20 bp, Artificial Sequence
  chemically synthesized
actttgggaggccgaggcgg

SEQ ID NO: 483924 - DNA, 20 bp, Artificial Sequence
  chemically synthesized
ttttgtatttttagtagaga

SEQ ID NO: 483925 - DNA, 20 bp, Artificial Sequence
  chemically synthesized
gcctcagccatctgagtagc

SEQ ID NO: 483926 - DNA, 20 bp, Artificial Sequence
  chemically synthesized
gattctcctgcctcagccat

SEQ ID NO: 483927 - DNA, 20 bp, Artificial Sequence
  chemically synthesized
tactcagatggctgaggcag

SEQ ID NO: 483928 - DNA, 20 bp, Artificial Sequence
  chemically synthesized
ctcacagcaacctccgcctc

SEQ ID NO: 483929 - DNA, 20 bp, Artificial Sequence
  chemically synthesized
tttgctcttgttgcccaggc

SEQ ID NO: 483930 - DNA, 20 bp, Artificial Sequence
  chemically synthesized
tttgttttgttttgttgaga

SEQ ID NO: 483931 - DNA, 20 bp, Artificial Sequence
  chemically synthesized
tctgagaaattttaagtccc

SEQ ID NO: 483932 - DNA, 20 bp, Artificial Sequence
  chemically synthesized
ttcaattaagttcaaacata

SEQ ID NO: 483933 - DNA, 20 bp, Artificial Sequence
  chemically synthesized
ctttataactatctacatgc

SEQ ID NO: 483934 - DNA, 20 bp, Artificial Sequence
  chemically synthesized
atctacatgcatgagtatat

SEQ ID NO: 483935 - DNA, 20 bp, Artificial Sequence
  chemically synthesized
tgctgaaaggaggctacatt

SEQ ID NO: 483936 - DNA, 20 bp, Artificial Sequence
  chemically synthesized
tttcagcataggtttgggga

SEQ ID NO: 483937 - DNA, 20 bp, Artificial Sequence
  chemically synthesized
attctaaaaataggtgttag

SEQ ID NO: 483938 - DNA, 20 bp, Artificial Sequence
  chemically synthesized
acccatctaacacctatttt

SEQ ID NO: 483939 - DNA, 20 bp, Artificial Sequence
  chemically synthesized
acacctatttttagaatcag

SEQ ID NO: 483940 - DNA, 20 bp, Artificial Sequence
  chemically synthesized
tatttttagaatcagaggag

SEQ ID NO: 483941 - DNA, 20 bp, Artificial Sequence
  chemically synthesized
gatcacacagatagcggaac

SEQ ID NO: 483942 - DNA, 20 bp, Artificial Sequence
  chemically synthesized
gaactcttatacatatataa

SEQ ID NO: 483943 - DNA, 20 bp, Artificial Sequence
  chemically synthesized
aaatccacttatatatgtat

SEQ ID NO: 483944 - DNA, 20 bp, Artificial Sequence
  chemically synthesized
tgtgctgtgctttatacgaa

SEQ ID NO: 483945 - DNA, 20 bp, Artificial Sequence
  chemically synthesized
agatttgtgctgtgctttat

SEQ ID NO: 483946 - DNA, 20 bp, Artificial Sequence
  chemically synthesized
gattttaaagtatctcataa

SEQ ID NO: 483947 - DNA, 20 bp, Artificial Sequence
  chemically synthesized
tttatgagatactttaaaat

SEQ ID NO: 483948 - DNA, 20 bp, Artificial Sequence
  chemically synthesized
gtctgaaatgtttcatattc

SEQ ID NO: 483949 - DNA, 20 bp, Artificial Sequence
  chemically synthesized
aaacatgttccagggaactc

SEQ ID NO: 483950 - DNA, 20 bp, Artificial Sequence
  chemically synthesized
tgccagacattaagaaaaaa

SEQ ID NO: 483951 - DNA, 20 bp, Artificial Sequence
  chemically synthesized
agacatagcaataaatagaa

SEQ ID NO: 483952 - DNA, 20 bp, Artificial Sequence
  chemically synthesized
ttaagagacatagcaataaa

SEQ ID NO: 483953 - DNA, 20 bp, Artificial Sequence
  chemically synthesized
aggttatgtgtctctcaatg

SEQ ID NO: 483954 - DNA, 20 bp, Artificial Sequence
  chemically synthesized
acaagaatttgtaaattgct

SEQ ID NO: 483955 - DNA, 20 bp, Artificial Sequence
  chemically synthesized
ggaattctttctatgattac

SEQ ID NO: 483956 - DNA, 20 bp, Artificial Sequence
  chemically synthesized
caaattcttgtaatcataga

SEQ ID NO: 483957 - DNA, 20 bp, Artificial Sequence
  chemically synthesized
tccttttgggatgtaaaatg

SEQ ID NO: 483958 - DNA, 20 bp, Artificial Sequence
  chemically synthesized
aggagaaggcacagtccttt

SEQ ID NO: 483959 - DNA, 20 bp, Artificial Sequence
  chemically synthesized
tcctcttagtggctcctaca

SEQ ID NO: 483960 - DNA, 20 bp, Artificial Sequence
  chemically synthesized
cactttacctgttcctcatg

SEQ ID NO: 483961 - DNA, 20 bp, Artificial Sequence
  chemically synthesized
taaggtaatatgaacagcac

SEQ ID NO: 483962 - DNA, 20 bp, Artificial Sequence
  chemically synthesized
tgttcacattttcaggttga

SEQ ID NO: 483963 - DNA, 20 bp, Artificial Sequence
  chemically synthesized
aagtctcaaatgcacagaat

SEQ ID NO: 483964 - DNA, 20 bp, Artificial Sequence
  chemically synthesized
aaaatcaagtctcaaatgca

SEQ ID NO: 483965 - DNA, 20 bp, Artificial Sequence
  chemically synthesized
aaaattgtctgttcaaacaa

SEQ ID NO: 483966 - DNA, 20 bp, Artificial Sequence
  chemically synthesized
agacaattttctgataacaa

SEQ ID NO: 483967 - DNA, 20 bp, Artificial Sequence
  chemically synthesized
ggtcgaggaaaggaaaggca

SEQ ID NO: 483968 - DNA, 20 bp, Artificial Sequence
  chemically synthesized
gatacaataagcctgacaat

SEQ ID NO: 483969 - DNA, 20 bp, Artificial Sequence
  chemically synthesized
gccattgggggtcccctaca

SEQ ID NO: 483970 - DNA, 20 bp, Artificial Sequence
  chemically synthesized
gtcataggagtaaagccatt

SEQ ID NO: 483971 - DNA, 20 bp, Artificial Sequence
  chemically synthesized
atggctttactcctatgacc

SEQ ID NO: 483972 - DNA, 20 bp, Artificial Sequence
  chemically synthesized
taagtctaaccctgggtcat

SEQ ID NO: 483973 - DNA, 20 bp, Artificial Sequence
  chemically synthesized
taccatctctaagtctaacc

SEQ ID NO: 483974 - DNA, 20 bp, Artificial Sequence
  chemically synthesized
aagataaagcaaaatgtata

SEQ ID NO: 483975 - DNA, 20 bp, Artificial Sequence
  chemically synthesized
gcatttcatttattcattca

SEQ ID NO: 483976 - DNA, 20 bp, Artificial Sequence
  chemically synthesized
tttccatcaagattctctga

SEQ ID NO: 483977 - DNA, 20 bp, Artificial Sequence
  chemically synthesized
aggttttccatcaagattct

SEQ ID NO: 483978 - DNA, 20 bp, Artificial Sequence
  chemically synthesized
tttttttcaaggccctcgac

SEQ ID NO: 483979 - DNA, 20 bp, Artificial Sequence
  chemically synthesized
actgttctaatgtctatgca

SEQ ID NO: 483980 - DNA, 20 bp, Artificial Sequence
  chemically synthesized
cacatctagaaaatgggtgc

SEQ ID NO: 483981 - DNA, 20 bp, Artificial Sequence
  chemically synthesized
aaaattttcacatctagaaa

SEQ ID NO: 483982 - DNA, 20 bp, Artificial Sequence
  chemically synthesized
gatagtgccctgctagctat

SEQ ID NO: 483983 - DNA, 20 bp, Artificial Sequence
  chemically synthesized
gagttccactaggccttctc

SEQ ID NO: 483984 - DNA, 20 bp, Artificial Sequence
  chemically synthesized
ctagtggaactctcaataat

SEQ ID NO: 483985 - DNA, 20 bp, Artificial Sequence
  chemically synthesized
aatcaactatcctcattatt

SEQ ID NO: 483986 - DNA, 20 bp, Artificial Sequence
  chemically synthesized
ggatagttgattgttatgga

SEQ ID NO: 483987 - DNA, 20 bp, Artificial Sequence
  chemically synthesized
tacaaattttagccggcggg

SEQ ID NO: 483988 - DNA, 20 bp, Artificial Sequence
  chemically synthesized
tgttgaagtgctaaccccca

SEQ ID NO: 483989 - DNA, 20 bp, Artificial Sequence
  chemically synthesized
cccacctccaaatatccatt

SEQ ID NO: 483990 - DNA, 20 bp, Artificial Sequence
  chemically synthesized
tggggcctttgagaaataat

SEQ ID NO: 483991 - DNA, 20 bp, Artificial Sequence
  chemically synthesized
ataggttgaggcctccataa

SEQ ID NO: 483992 - DNA, 20 bp, Artificial Sequence
  chemically synthesized
agaagagcaagaagagagac

SEQ ID NO: 483993 - DNA, 20 bp, Artificial Sequence
  chemically synthesized
cacctctctccccaacatac

SEQ ID NO: 483994 - DNA, 20 bp, Artificial Sequence
  chemically synthesized
ctataaaataatgccataga

SEQ ID NO: 483995 - DNA, 20 bp, Artificial Sequence
  chemically synthesized
aagacattaatatttgtata

SEQ ID NO: 483996 - DNA, 20 bp, Artificial Sequence
  chemically synthesized
cttttccatgcgtcatttca

SEQ ID NO: 483997 - DNA, 20 bp, Artificial Sequence
  chemically synthesized
cttccatactagtttggtgt

SEQ ID NO: 483998 - DNA, 20 bp, Artificial Sequence
  chemically synthesized
caaactagtatggaagttat

SEQ ID NO: 483999 - DNA, 20 bp, Artificial Sequence
  chemically synthesized
aattttctcatctgtaaaac

SEQ ID NO: 484000 - DNA, 20 bp, Artificial Sequence
  chemically synthesized
gagagattaaataatttgcc

SEQ ID NO: 484001 - DNA, 20 bp, Artificial Sequence
  chemically synthesized
gtaatatagtagtaacagca

SEQ ID NO: 484002 - DNA, 20 bp, Artificial Sequence
  chemically synthesized
tactaaagaaataaaggcca

SEQ ID NO: 484003 - DNA, 20 bp, Artificial Sequence
  chemically synthesized
aataaaggccaaagaatctc

SEQ ID NO: 484004 - DNA, 20 bp, Artificial Sequence
  chemically synthesized
ataaaggtagaacctgtcaa

SEQ ID NO: 484005 - DNA, 20 bp, Artificial Sequence
  chemically synthesized
gtttattaccttcaactaac

SEQ ID NO: 484006 - DNA, 20 bp, Artificial Sequence
  chemically synthesized
tacacaaaaagactggactg

SEQ ID NO: 484007 - DNA, 20 bp, Artificial Sequence
  chemically synthesized
tttcctctaatccagaaatc

SEQ ID NO: 484008 - DNA, 20 bp, Artificial Sequence
  chemically synthesized
ttaatccccattcttgattt

SEQ ID NO: 484009 - DNA, 20 bp, Artificial Sequence
  chemically synthesized
ctaatccagaaatcaagaat

SEQ ID NO: 484010 - DNA, 20 bp, Artificial Sequence
  chemically synthesized
aatggggattaaggaaatta

SEQ ID NO: 484011 - DNA, 20 bp, Artificial Sequence
  chemically synthesized
tgttagtgagataaatacat

SEQ ID NO: 484012 - DNA, 20 bp, Artificial Sequence
  chemically synthesized
gggtattgtaaagaaagctt

SEQ ID NO: 484013 - DNA, 20 bp, Artificial Sequence
  chemically synthesized
cctggctccacatggaaaat

SEQ ID NO: 484014 - DNA, 20 bp, Artificial Sequence
  chemically synthesized
attttccatgtggagccagg

SEQ ID NO: 484015 - DNA, 20 bp, Artificial Sequence
  chemically synthesized
cccggagctataaagttttg

SEQ ID NO: 484016 - DNA, 20 bp, Artificial Sequence
  chemically synthesized
atgtgtacaggaaacacgtg

SEQ ID NO: 484017 - DNA, 20 bp, Artificial Sequence
  chemically synthesized
acgtgtttcctgtacacatg

SEQ ID NO: 484018 - DNA, 20 bp, Artificial Sequence
  chemically synthesized
agtctgcaacttttagggca

SEQ ID NO: 484019 - DNA, 20 bp, Artificial Sequence
  chemically synthesized
agagtatgattgacatttgt

SEQ ID NO: 484020 - DNA, 20 bp, Artificial Sequence
  chemically synthesized
catttgtgggagtgtctaat

SEQ ID NO: 484021 - DNA, 20 bp, Artificial Sequence
  chemically synthesized
tggggatattcaaagcaaca

SEQ ID NO: 484022 - DNA, 20 bp, Artificial Sequence
  chemically synthesized
aaacatgatcccatgttgct

SEQ ID NO: 484023 - DNA, 20 bp, Artificial Sequence
  chemically synthesized
agcaacctatgagttttgcc

SEQ ID NO: 484024 - DNA, 20 bp, Artificial Sequence
  chemically synthesized
taccccaggacaagcaacct

SEQ ID NO: 484025 - DNA, 20 bp, Artificial Sequence
  chemically synthesized
aactcataggttgcttgtcc

SEQ ID NO: 484026 - DNA, 20 bp, Artificial Sequence
  chemically synthesized
gagttcctccatgggactac

SEQ ID NO: 484027 - DNA, 20 bp, Artificial Sequence
  chemically synthesized
tctagttggtttccctctaa

SEQ ID NO: 484028 - DNA, 20 bp, Artificial Sequence
  chemically synthesized
gtgagttacttgtatagctt

SEQ ID NO: 484029 - DNA, 20 bp, Artificial Sequence
  chemically synthesized
acaagtaactcactgtgaaa

SEQ ID NO: 484030 - DNA, 20 bp, Artificial Sequence
  chemically synthesized
ctgaaggattcactttcaca

SEQ ID NO: 484031 - DNA, 20 bp, Artificial Sequence
  chemically synthesized
tgatggcttgactggggctg

SEQ ID NO: 484032 - DNA, 20 bp, Artificial Sequence
  chemically synthesized
gactgcagcctaattgacat

SEQ ID NO: 484033 - DNA, 20 bp, Artificial Sequence
  chemically synthesized
tgacatctgagtgcaacatc

SEQ ID NO: 484034 - DNA, 20 bp, Artificial Sequence
  chemically synthesized
attcatgcattgcttggttg

SEQ ID NO: 484035 - DNA, 20 bp, Artificial Sequence
  chemically synthesized
acccctcaaccaagcaatgc

SEQ ID NO: 484036 - DNA, 20 bp, Artificial Sequence
  chemically synthesized
cactcataggttctgtaggt

SEQ ID NO: 484037 - DNA, 20 bp, Artificial Sequence
  chemically synthesized
aatcctgacctacagaacct

SEQ ID NO: 484038 - DNA, 20 bp, Artificial Sequence
  chemically synthesized
ctactttaggacactaagtt

SEQ ID NO: 484039 - DNA, 20 bp, Artificial Sequence
  chemically synthesized
tacttttgtcaggaaagagt

SEQ ID NO: 484040 - DNA, 20 bp, Artificial Sequence
  chemically synthesized
ttgttctacttttgtcagga

SEQ ID NO: 484041 - DNA, 20 bp, Artificial Sequence
  chemically synthesized
acatttataaagtaagtagg

SEQ ID NO: 484042 - DNA, 20 bp, Artificial Sequence
  chemically synthesized
tttacttaagacaagtacaa

SEQ ID NO: 484043 - DNA, 20 bp, Artificial Sequence
  chemically synthesized
ctcaagttatagaaaattgt

SEQ ID NO: 484044 - DNA, 20 bp, Artificial Sequence
  chemically synthesized
attttagataaaactaagcc

SEQ ID NO: 484045 - DNA, 20 bp, Artificial Sequence
  chemically synthesized
taaaatgcatgatgccatca

SEQ ID NO: 484046 - DNA, 20 bp, Artificial Sequence
  chemically synthesized
tggtacctgtgggcataaat

SEQ ID NO: 484047 - DNA, 20 bp, Artificial Sequence
  chemically synthesized
gggtcattgtaactaaagtc

SEQ ID NO: 484048 - DNA, 20 bp, Artificial Sequence
  chemically synthesized
catttttatcttatgaccta

SEQ ID NO: 484049 - DNA, 20 bp, Artificial Sequence
  chemically synthesized
aatgctagcctataaacatg

SEQ ID NO: 484050 - DNA, 20 bp, Artificial Sequence
  chemically synthesized
gtcttattagctcactttgt

SEQ ID NO: 484051 - DNA, 20 bp, Artificial Sequence
  chemically synthesized
gattatgagtaaatatatta

SEQ ID NO: 484052 - DNA, 20 bp, Artificial Sequence
  chemically synthesized
tttttgtgataaagatgatt

SEQ ID NO: 484053 - DNA, 20 bp, Artificial Sequence
  chemically synthesized
tattatgtttaattttcaag

SEQ ID NO: 484054 - DNA, 20 bp, Artificial Sequence
  chemically synthesized
atgtttaattttcaaggtgg

SEQ ID NO: 484055 - DNA, 20 bp, Artificial Sequence
  chemically synthesized
ttctttttaaggggaaagat

SEQ ID NO: 484056 - DNA, 20 bp, Artificial Sequence
  chemically synthesized
tttaattataaatctttcaa

SEQ ID NO: 484057 - DNA, 20 bp, Artificial Sequence
  chemically synthesized
atataatcgcaacaggtaat

SEQ ID NO: 484058 - DNA, 20 bp, Artificial Sequence
  chemically synthesized
aatatcaaaacatatttgaa

SEQ ID NO: 484059 - DNA, 20 bp, Artificial Sequence
  chemically synthesized
ggattaatatcaaaacatat

SEQ ID NO: 484060 - DNA, 20 bp, Artificial Sequence
  chemically synthesized
gtatttcatttttaaattaa

SEQ ID NO: 484061 - DNA, 20 bp, Artificial Sequence
  chemically synthesized
tactaattacctatcatgaa

SEQ ID NO: 484062 - DNA, 20 bp, Artificial Sequence
  chemically synthesized
aatgaatttcagagttctat

SEQ ID NO: 484063 - DNA, 20 bp, Artificial Sequence
  chemically synthesized
tttaatatcttaatgaattt

SEQ ID NO: 484064 - DNA, 20 bp, Artificial Sequence
  chemically synthesized
aaatggtctttaatatctta

SEQ ID NO: 484065 - DNA, 20 bp, Artificial Sequence
  chemically synthesized
aacatttcaatcagcagact

SEQ ID NO: 484066 - DNA, 20 bp, Artificial Sequence
  chemically synthesized
agcagattaccctccacaat

SEQ ID NO: 484067 - DNA, 20 bp, Artificial Sequence
  chemically synthesized
gaaggcccacccacattgtg

SEQ ID NO: 484068 - DNA, 20 bp, Artificial Sequence
  chemically synthesized
ctgaagtccccagaaaagga

SEQ ID NO: 484069 - DNA, 20 bp, Artificial Sequence
  chemically synthesized
aaaaggaaggaattctgcta

SEQ ID NO: 484070 - DNA, 20 bp, Artificial Sequence
  chemically synthesized
gtccaaaggtaatccgatag

SEQ ID NO: 484071 - DNA, 20 bp, Artificial Sequence
  chemically synthesized
gaagagttgatgttgcaatc

SEQ ID NO: 484072 - DNA, 20 bp, Artificial Sequence
  chemically synthesized
ggcaggatggagaccaaggg

SEQ ID NO: 484073 - DNA, 20 bp, Artificial Sequence
  chemically synthesized
tgtaaaatccaaaagcctgg

SEQ ID NO: 484074 - DNA, 20 bp, Artificial Sequence
  chemically synthesized
gtctccatcctgccaggctt

SEQ ID NO: 484075 - DNA, 20 bp, Artificial Sequence
  chemically synthesized
ttttcagctcccacaatcat

SEQ ID NO: 484076 - DNA, 20 bp, Artificial Sequence
  chemically synthesized
gagagagagagagagagaga

SEQ ID NO: 484077 - DNA, 20 bp, Artificial Sequence
  chemically synthesized
tcaccattatcattagagtt

SEQ ID NO: 484078 - DNA, 20 bp, Artificial Sequence
  chemically synthesized
tatcaattcaccattatcat

SEQ ID NO: 484079 - DNA, 20 bp, Artificial Sequence
  chemically synthesized
tctaaactctaatgataatg

SEQ ID NO: 484080 - DNA, 20 bp, Artificial Sequence
  chemically synthesized
tacaggtgaaatattggact

SEQ ID NO: 484081 - DNA, 20 bp, Artificial Sequence
  chemically synthesized
tcttcctgttgaataattaa

SEQ ID NO: 484082 - DNA, 20 bp, Artificial Sequence
  chemically synthesized
atgtggtgaagttcttcctg

SEQ ID NO: 484083 - DNA, 20 bp, Artificial Sequence
  chemically synthesized
caccacataatattagctgt

SEQ ID NO: 484084 - DNA, 20 bp, Artificial Sequence
  chemically synthesized
tcacacatcctttagcaaaa

SEQ ID NO: 484085 - DNA, 20 bp, Artificial Sequence
  chemically synthesized
ttaacaatcctgttttgcta

SEQ ID NO: 484086 - DNA, 20 bp, Artificial Sequence
  chemically synthesized
atttatttatttatttacga

SEQ ID NO: 484087 - DNA, 20 bp, Artificial Sequence
  chemically synthesized
tgcactctaacctgggcaac

SEQ ID NO: 484088 - DNA, 20 bp, Artificial Sequence
  chemically synthesized
ttcactcttgttgcccaggt

SEQ ID NO: 484089 - DNA, 20 bp, Artificial Sequence
  chemically synthesized
ctcagtgcaacctccgcctc

SEQ ID NO: 484090 - DNA, 20 bp, Artificial Sequence
  chemically synthesized
tactcgggaggctgaggcag

SEQ ID NO: 484091 - DNA, 20 bp, Artificial Sequence
  chemically synthesized
aattctcctgcctcagcctc

SEQ ID NO: 484092 - DNA, 20 bp, Artificial Sequence
  chemically synthesized
gcctcagcctcccgagtagc

SEQ ID NO: 484093 - DNA, 20 bp, Artificial Sequence
  chemically synthesized
gcgatggatcacctgaggtc

SEQ ID NO: 484094 - DNA, 20 bp, Artificial Sequence
  chemically synthesized
cactttgggaggctgaagcg

SEQ ID NO: 484095 - DNA, 20 bp, Artificial Sequence
  chemically synthesized
gcttcagcctcccaaagtgc

SEQ ID NO: 484096 - DNA, 20 bp, Artificial Sequence
  chemically synthesized
tcccaaagtgctggaattac

SEQ ID NO: 484097 - DNA, 20 bp, Artificial Sequence
  chemically synthesized
atcttatgagaaattttaat

SEQ ID NO: 484098 - DNA, 20 bp, Artificial Sequence
  chemically synthesized
ctatctctttatacttccat

SEQ ID NO: 484099 - DNA, 20 bp, Artificial Sequence
  chemically synthesized
tatacttccataagaatttg

SEQ ID NO: 484100 - DNA, 20 bp, Artificial Sequence
  chemically synthesized
atatacaaaataaaaagcta

SEQ ID NO: 484101 - DNA, 20 bp, Artificial Sequence
  chemically synthesized
caatctttaatcctcagcta

SEQ ID NO: 484102 - DNA, 20 bp, Artificial Sequence
  chemically synthesized
agtatagaaactctttagct

SEQ ID NO: 484103 - DNA, 20 bp, Artificial Sequence
  chemically synthesized
tcctggttcttaatgatacc

SEQ ID NO: 484104 - DNA, 20 bp, Artificial Sequence
  chemically synthesized
ttcatggtatcattaagaac

SEQ ID NO: 484105 - DNA, 20 bp, Artificial Sequence
  chemically synthesized
caggatgaaacttatgttac

SEQ ID NO: 484106 - DNA, 20 bp, Artificial Sequence
  chemically synthesized
caccgcgcccagcctaaata

SEQ ID NO: 484107 - DNA, 20 bp, Artificial Sequence
  chemically synthesized
gcctcggcctcccaaagtgc

SEQ ID NO: 484108 - DNA, 20 bp, Artificial Sequence
  chemically synthesized
cagcactttgggaggccgag

SEQ ID NO: 484109 - DNA, 20 bp, Artificial Sequence
  chemically synthesized
actttgggaggccgaggcgg

SEQ ID NO: 484110 - DNA, 20 bp, Artificial Sequence
  chemically synthesized
cgggtggatcacctgaagtc

SEQ ID NO: 484111 - DNA, 20 bp, Artificial Sequence
  chemically synthesized
ttttgtatttttagtaggga

SEQ ID NO: 484112 - DNA, 20 bp, Artificial Sequence
  chemically synthesized
tattctcttgcctcagccta

SEQ ID NO: 484113 - DNA, 20 bp, Artificial Sequence
  chemically synthesized
tactcggtaggctgaggcaa

SEQ ID NO: 484114 - DNA, 20 bp, Artificial Sequence
  chemically synthesized
ggctgaggcaagagaatagc

SEQ ID NO: 484115 - DNA, 20 bp, Artificial Sequence
  chemically synthesized
aatagcttgaatctgggagg

SEQ ID NO: 484116 - DNA, 20 bp, Artificial Sequence
  chemically synthesized
tcctgctccattgcccaggc

SEQ ID NO: 484117 - DNA, 20 bp, Artificial Sequence
  chemically synthesized
taataattttttttttgaga

SEQ ID NO: 484118 - DNA, 20 bp, Artificial Sequence
  chemically synthesized
tagaagcatttagacacaca

SEQ ID NO: 484119 - DNA, 20 bp, Artificial Sequence
  chemically synthesized
gcttctatattgtaagttgg

SEQ ID NO: 484120 - DNA, 20 bp, Artificial Sequence
  chemically synthesized
tattgtaagttggcagggtt

SEQ ID NO: 484121 - DNA, 20 bp, Artificial Sequence
  chemically synthesized
gcagggttgggggttgtgtg

SEQ ID NO: 484122 - DNA, 20 bp, Artificial Sequence
  chemically synthesized
ggttgggggttgtgtggggg

SEQ ID NO: 484123 - DNA, 20 bp, Artificial Sequence
  chemically synthesized
tagaagttggtttacattta

SEQ ID NO: 484124 - DNA, 20 bp, Artificial Sequence
  chemically synthesized
tgtctgagcttgcacagaga

SEQ ID NO: 484125 - DNA, 20 bp, Artificial Sequence
  chemically synthesized
acaagaattcaaaagttacc

SEQ ID NO: 484126 - DNA, 20 bp, Artificial Sequence
  chemically synthesized
tcagacattccaggtaactt

SEQ ID NO: 484127 - DNA, 20 bp, Artificial Sequence
  chemically synthesized
gagtgatgttacttttggac

SEQ ID NO: 484128 - DNA, 20 bp, Artificial Sequence
  chemically synthesized
gttgaaaacatagagattgc

SEQ ID NO: 484129 - DNA, 20 bp, Artificial Sequence
  chemically synthesized
cccataatcaactccttatc

SEQ ID NO: 484130 - DNA, 20 bp, Artificial Sequence
  chemically synthesized
ccagagacaaactcaggata

SEQ ID NO: 484131 - DNA, 20 bp, Artificial Sequence
  chemically synthesized
gtcataaccagagacaaact

SEQ ID NO: 484132 - DNA, 20 bp, Artificial Sequence
  chemically synthesized
gttatgacattaatcttcca

SEQ ID NO: 484133 - DNA, 20 bp, Artificial Sequence
  chemically synthesized
ctgcctctaagagttggaga

SEQ ID NO: 484134 - DNA, 20 bp, Artificial Sequence
  chemically synthesized
ctaagagaaggcctgcctct

SEQ ID NO: 484135 - DNA, 20 bp, Artificial Sequence
  chemically synthesized
taaggtggagctagaattaa

SEQ ID NO: 484136 - DNA, 20 bp, Artificial Sequence
  chemically synthesized
attgagacataaggtggagc

SEQ ID NO: 484137 - DNA, 20 bp, Artificial Sequence
  chemically synthesized
ccaagctggagcagtgacca

SEQ ID NO: 484138 - DNA, 20 bp, Artificial Sequence
  chemically synthesized
gtgtgtgttgtggaggataa

SEQ ID NO: 484139 - DNA, 20 bp, Artificial Sequence
  chemically synthesized
gtgtgtgtgtgtgtgttgtg

SEQ ID NO: 484140 - DNA, 20 bp, Artificial Sequence
  chemically synthesized
tggaagacgaatatcagcat

SEQ ID NO: 484141 - DNA, 20 bp, Artificial Sequence
  chemically synthesized
tgttaacagtggggtggaag

SEQ ID NO: 484142 - DNA, 20 bp, Artificial Sequence
  chemically synthesized
ataattagacctgttaacag

SEQ ID NO: 484143 - DNA, 20 bp, Artificial Sequence
  chemically synthesized
atttcaggaattgatgacag

SEQ ID NO: 484144 - DNA, 20 bp, Artificial Sequence
  chemically synthesized
tggagagggaagggtatttc

SEQ ID NO: 484145 - DNA, 20 bp, Artificial Sequence
  chemically synthesized
cagaaggaagctggagaggg

SEQ ID NO: 484146 - DNA, 20 bp, Artificial Sequence
  chemically synthesized
aggctgaatttgacctggtc

SEQ ID NO: 484147 - DNA, 20 bp, Artificial Sequence
  chemically synthesized
ggaatgcttccaggaggagg

SEQ ID NO: 484148 - DNA, 20 bp, Artificial Sequence
  chemically synthesized
agttttaaatgagggcttag

SEQ ID NO: 484149 - DNA, 20 bp, Artificial Sequence
  chemically synthesized
tgttgagagaaaactagagg

SEQ ID NO: 484150 - DNA, 20 bp, Artificial Sequence
  chemically synthesized
tatatttaggcaaggcagtt

SEQ ID NO: 484151 - DNA, 20 bp, Artificial Sequence
  chemically synthesized
taaagagctcacaatcaaat

SEQ ID NO: 484152 - DNA, 20 bp, Artificial Sequence
  chemically synthesized
gagctctttaaagacaaagg

SEQ ID NO: 484153 - DNA, 20 bp, Artificial Sequence
  chemically synthesized
ctaatatcagagatggtaga

SEQ ID NO: 484154 - DNA, 20 bp, Artificial Sequence
  chemically synthesized
atctctgatattagatagca

SEQ ID NO: 484155 - DNA, 20 bp, Artificial Sequence
  chemically synthesized
cagttcagttcagcgaacgt

SEQ ID NO: 484156 - DNA, 20 bp, Artificial Sequence
  chemically synthesized
taggatgccgctggcaacca

SEQ ID NO: 484157 - DNA, 20 bp, Artificial Sequence
  chemically synthesized
tggttgccagcggcatccta

SEQ ID NO: 484158 - DNA, 20 bp, Artificial Sequence
  chemically synthesized
ccagcggcatcctagtggat

SEQ ID NO: 484159 - DNA, 20 bp, Artificial Sequence
  chemically synthesized
ctctcaaaattcacatccac

SEQ ID NO: 484160 - DNA, 20 bp, Artificial Sequence
  chemically synthesized
gttgcttattttagaagaag

SEQ ID NO: 484161 - DNA, 20 bp, Artificial Sequence
  chemically synthesized
agcctttttatttcgccatg

SEQ ID NO: 484162 - DNA, 20 bp, Artificial Sequence
  chemically synthesized
tcatagatttggttgcagca

SEQ ID NO: 484163 - DNA, 20 bp, Artificial Sequence
  chemically synthesized
tttggttgcagcaatgaatg

SEQ ID NO: 484164 - DNA, 20 bp, Artificial Sequence
  chemically synthesized
aaacatctctcacacgattt

SEQ ID NO: 484165 - DNA, 20 bp, Artificial Sequence
  chemically synthesized
gggagaatgttcttctgtat

SEQ ID NO: 484166 - DNA, 20 bp, Artificial Sequence
  chemically synthesized
tatacagggccatagaaggg

SEQ ID NO: 484167 - DNA, 20 bp, Artificial Sequence
  chemically synthesized
agttctttatgcaatataat

SEQ ID NO: 484168 - DNA, 20 bp, Artificial Sequence
  chemically synthesized
agcttataaattttaagaaa

SEQ ID NO: 484169 - DNA, 20 bp, Artificial Sequence
  chemically synthesized
agctatcactaaatttctct

SEQ ID NO: 484170 - DNA, 20 bp, Artificial Sequence
  chemically synthesized
atttctctaagaattctgga

SEQ ID NO: 484171 - DNA, 20 bp, Artificial Sequence
  chemically synthesized
aaggatttttcaacccagtc

SEQ ID NO: 484172 - DNA, 20 bp, Artificial Sequence
  chemically synthesized
ttggaattattttttcagct

SEQ ID NO: 484173 - DNA, 20 bp, Artificial Sequence
  chemically synthesized
taagagggagtcgtttattt

SEQ ID NO: 484174 - DNA, 20 bp, Artificial Sequence
  chemically synthesized
cagaattccaagttttaaga

SEQ ID NO: 484175 - DNA, 20 bp, Artificial Sequence
  chemically synthesized
aacgactccctcttaaaact

SEQ ID NO: 484176 - DNA, 20 bp, Artificial Sequence
  chemically synthesized
caagggaaggacttctgaaa

SEQ ID NO: 484177 - DNA, 20 bp, Artificial Sequence
  chemically synthesized
actggagatgggagaatatg

SEQ ID NO: 484178 - DNA, 20 bp, Artificial Sequence
  chemically synthesized
acagagagaactggagatgg

SEQ ID NO: 484179 - DNA, 20 bp, Artificial Sequence
  chemically synthesized
gtacatattgttatggtgag

SEQ ID NO: 484180 - DNA, 20 bp, Artificial Sequence
  chemically synthesized
aataatagtacttatgctgg

SEQ ID NO: 484181 - DNA, 20 bp, Artificial Sequence
  chemically synthesized
gagaaccacagtttaggaaa

SEQ ID NO: 484182 - DNA, 20 bp, Artificial Sequence
  chemically synthesized
ttacacagctaatagatcat

SEQ ID NO: 484183 - DNA, 20 bp, Artificial Sequence
  chemically synthesized
tgtatttgagtgtctaatca

SEQ ID NO: 484184 - DNA, 20 bp, Artificial Sequence
  chemically synthesized
tacttttgacttctgtgtat

SEQ ID NO: 484185 - DNA, 20 bp, Artificial Sequence
  chemically synthesized
taacctcaggtaattatagt

SEQ ID NO: 484186 - DNA, 20 bp, Artificial Sequence
  chemically synthesized
aaaatcatatagacgtgggc

SEQ ID NO: 484187 - DNA, 20 bp, Artificial Sequence
  chemically synthesized
gaagatgacaagtgaggaag

SEQ ID NO: 484188 - DNA, 20 bp, Artificial Sequence
  chemically synthesized
gagagctaacgtaacttgtc

SEQ ID NO: 484189 - DNA, 20 bp, Artificial Sequence
  chemically synthesized
agacaagttacgttagctct

SEQ ID NO: 484190 - DNA, 20 bp, Artificial Sequence
  chemically synthesized
cggttttctgtctctaaaat

SEQ ID NO: 484191 - DNA, 20 bp, Artificial Sequence
  chemically synthesized
atttcccacaaaaggctttc

SEQ ID NO: 484192 - DNA, 20 bp, Artificial Sequence
  chemically synthesized
gatggaataagatctataaa

SEQ ID NO: 484193 - DNA, 20 bp, Artificial Sequence
  chemically synthesized
agaaggttgcttggaaaaga

SEQ ID NO: 484194 - DNA, 20 bp, Artificial Sequence
  chemically synthesized
gtcttttaaatctctccttt

SEQ ID NO: 484195 - DNA, 20 bp, Artificial Sequence
  chemically synthesized
ttattttaattataatctat

SEQ ID NO: 484196 - DNA, 20 bp, Artificial Sequence
  chemically synthesized
agggccatagtaaaagctga

SEQ ID NO: 484197 - DNA, 20 bp, Artificial Sequence
  chemically synthesized
gatcagggccatagtaaaag

SEQ ID NO: 484198 - DNA, 20 bp, Artificial Sequence
  chemically synthesized
ataactatctcatgggttgg

SEQ ID NO: 484199 - DNA, 20 bp, Artificial Sequence
  chemically synthesized
ggctcacttataactatctc

SEQ ID NO: 484200 - DNA, 20 bp, Artificial Sequence
  chemically synthesized
agccccgaaatggtagtggt

SEQ ID NO: 484201 - DNA, 20 bp, Artificial Sequence
  chemically synthesized
gaatgtcgttcctgtaacat

SEQ ID NO: 484202 - DNA, 20 bp, Artificial Sequence
  chemically synthesized
ttatttcacaaacaatattg

SEQ ID NO: 484203 - DNA, 20 bp, Artificial Sequence
  chemically synthesized
aatattgtttgtgaaataaa

SEQ ID NO: 484204 - DNA, 20 bp, Artificial Sequence
  chemically synthesized
ataccttgcatagcagtgaa

SEQ ID NO: 484205 - DNA, 20 bp, Artificial Sequence
  chemically synthesized
cagtattaacagacacgaac

SEQ ID NO: 484206 - DNA, 20 bp, Artificial Sequence
  chemically synthesized
attttcttccttggaggcgt

SEQ ID NO: 484207 - DNA, 20 bp, Artificial Sequence
  chemically synthesized
ccaaaagcagataagattag

SEQ ID NO: 484208 - DNA, 20 bp, Artificial Sequence
  chemically synthesized
cattttcttctgcaaaaggg

SEQ ID NO: 484209 - DNA, 20 bp, Artificial Sequence
  chemically synthesized
ttttgcagaagaaaatggcc

SEQ ID NO: 484210 - DNA, 20 bp, Artificial Sequence
  chemically synthesized
attgacaaattcagacacca

SEQ ID NO: 484211 - DNA, 20 bp, Artificial Sequence
  chemically synthesized
tttctttaactctttggtgt

SEQ ID NO: 484212 - DNA, 20 bp, Artificial Sequence
  chemically synthesized
gttaaagaaaaatgagcaat

SEQ ID NO: 484213 - DNA, 20 bp, Artificial Sequence
  chemically synthesized
attctccctctttctaatat

SEQ ID NO: 484214 - DNA, 20 bp, Artificial Sequence
  chemically synthesized
attcgaatattagaaagagg

SEQ ID NO: 484215 - DNA, 20 bp, Artificial Sequence
  chemically synthesized
tgcagtaataatctaggtaa

SEQ ID NO: 484216 - DNA, 20 bp, Artificial Sequence
  chemically synthesized
atttccatcaatataattac

SEQ ID NO: 484217 - DNA, 20 bp, Artificial Sequence
  chemically synthesized
tcatgttaaacttcaagtaa

SEQ ID NO: 484218 - DNA, 20 bp, Artificial Sequence
  chemically synthesized
ccaattacttgaagtttaac

SEQ ID NO: 484219 - DNA, 20 bp, Artificial Sequence
  chemically synthesized
aactgttcaaagttatgaaa

SEQ ID NO: 484220 - DNA, 20 bp, Artificial Sequence
  chemically synthesized
cttttcgatcgtgttcaaaa

SEQ ID NO: 484221 - DNA, 20 bp, Artificial Sequence
  chemically synthesized
tgaacacgatcgaaaagttt

SEQ ID NO: 484222 - DNA, 20 bp, Artificial Sequence
  chemically synthesized
gatcgaaaagtttatgagta

SEQ ID NO: 484223 - DNA, 20 bp, Artificial Sequence
  chemically synthesized
tccctttgaaatctataaaa

SEQ ID NO: 484224 - DNA, 20 bp, Artificial Sequence
  chemically synthesized
tttagataaacatatcttgt

SEQ ID NO: 484225 - DNA, 20 bp, Artificial Sequence
  chemically synthesized
ctggagcctctaaatggtac

SEQ ID NO: 484226 - DNA, 20 bp, Artificial Sequence
  chemically synthesized
cgcttattaagagtctaagc

SEQ ID NO: 484227 - DNA, 20 bp, Artificial Sequence
  chemically synthesized
gatgtgtcatagcgcttatt

SEQ ID NO: 484228 - DNA, 20 bp, Artificial Sequence
  chemically synthesized
aaaatgctttcttggaccat

SEQ ID NO: 484229 - DNA, 20 bp, Artificial Sequence
  chemically synthesized
ttttaggaatgaataccttt

SEQ ID NO: 484230 - DNA, 20 bp, Artificial Sequence
  chemically synthesized
taagcttttgtcttttagga

SEQ ID NO: 484231 - DNA, 20 bp, Artificial Sequence
  chemically synthesized
tttctaagcttttgtctttt

SEQ ID NO: 484232 - DNA, 20 bp, Artificial Sequence
  chemically synthesized
aagaagaactattcaaatca

SEQ ID NO: 484233 - DNA, 20 bp, Artificial Sequence
  chemically synthesized
ctctgccaatattcagtgat

SEQ ID NO: 484234 - DNA, 20 bp, Artificial Sequence
  chemically synthesized
tttcatgatagagattaaaa

SEQ ID NO: 484235 - DNA, 20 bp, Artificial Sequence
  chemically synthesized
caatatgaaaaaaaaatgca

SEQ ID NO: 484236 - DNA, 20 bp, Artificial Sequence
  chemically synthesized
ttccctaagaggaagacaat

SEQ ID NO: 484237 - DNA, 20 bp, Artificial Sequence
  chemically synthesized
aaatctgaacatactataca

SEQ ID NO: 484238 - DNA, 20 bp, Artificial Sequence
  chemically synthesized
tgatcacttacctgtgtaat

SEQ ID NO: 484239 - DNA, 20 bp, Artificial Sequence
  chemically synthesized
aatgggaattcagtctcata

SEQ ID NO: 484240 - DNA, 20 bp, Artificial Sequence
  chemically synthesized
gtgatttactcaatatgaga

SEQ ID NO: 484241 - DNA, 20 bp, Artificial Sequence
  chemically synthesized
acccaaaagagtgaatctta

SEQ ID NO: 484242 - DNA, 20 bp, Artificial Sequence
  chemically synthesized
actcactaagattcactctt

SEQ ID NO: 484243 - DNA, 20 bp, Artificial Sequence
  chemically synthesized
caacacactgacccaaaaga

SEQ ID NO: 484244 - DNA, 20 bp, Artificial Sequence
  chemically synthesized
gttgcaacacactgacccaa

SEQ ID NO: 484245 - DNA, 20 bp, Artificial Sequence
  chemically synthesized
ctccaccatactggaacctt

SEQ ID NO: 484246 - DNA, 20 bp, Artificial Sequence
  chemically synthesized
tcaaggttccagtatggtgg

SEQ ID NO: 484247 - DNA, 20 bp, Artificial Sequence
  chemically synthesized
atggtcacacctaactgcga

SEQ ID NO: 484248 - DNA, 20 bp, Artificial Sequence
  chemically synthesized
atgtgacaagatccatccaa

SEQ ID NO: 484249 - DNA, 20 bp, Artificial Sequence
  chemically synthesized
ttttgttcatattctgttgg

SEQ ID NO: 484250 - DNA, 20 bp, Artificial Sequence
  chemically synthesized
ttaattttgttcatattctg

SEQ ID NO: 484251 - DNA, 20 bp, Artificial Sequence
  chemically synthesized
gtggctcatgacaaattttc

SEQ ID NO: 484252 - DNA, 20 bp, Artificial Sequence
  chemically synthesized
atttaatgggcagatgaaga

SEQ ID NO: 484253 - DNA, 20 bp, Artificial Sequence
  chemically synthesized
atgcatttaatgggcagatg

SEQ ID NO: 484254 - DNA, 20 bp, Artificial Sequence
  chemically synthesized
catctgcccattaaatgcat

SEQ ID NO: 484255 - DNA, 20 bp, Artificial Sequence
  chemically synthesized
acacaaaagatggaaggagc

SEQ ID NO: 484256 - DNA, 20 bp, Artificial Sequence
  chemically synthesized
gatggaaggagcttgggttc

SEQ ID NO: 484257 - DNA, 20 bp, Artificial Sequence
  chemically synthesized
ttgttgcttaaacaatgaat

SEQ ID NO: 484258 - DNA, 20 bp, Artificial Sequence
  chemically synthesized
tctttattgttgcttaaaca

SEQ ID NO: 484259 - DNA, 20 bp, Artificial Sequence
  chemically synthesized
tcattgtttaagcaacaata

SEQ ID NO: 484260 - DNA, 20 bp, Artificial Sequence
  chemically synthesized
agaagacatgtctttaggaa

SEQ ID NO: 484261 - DNA, 20 bp, Artificial Sequence
  chemically synthesized
aacaagcaaagaacagagct

SEQ ID NO: 484262 - DNA, 20 bp, Artificial Sequence
  chemically synthesized
tctcgctctgtcgcccaggc

SEQ ID NO: 484263 - DNA, 20 bp, Artificial Sequence
  chemically synthesized
ctcactgcaagctccgcctc

SEQ ID NO: 484264 - DNA, 20 bp, Artificial Sequence
  chemically synthesized
tacttgggaggctgaggcag

SEQ ID NO: 484265 - DNA, 20 bp, Artificial Sequence
  chemically synthesized
ttttgtatttttagtagaga

SEQ ID NO: 484266 - DNA, 20 bp, Artificial Sequence
  chemically synthesized
cggggtttcaccgtgttagc

SEQ ID NO: 484267 - DNA, 20 bp, Artificial Sequence
  chemically synthesized
acttggggaggccgaggcgg

SEQ ID NO: 484268 - DNA, 20 bp, Artificial Sequence
  chemically synthesized
gcctcggcctccccaagtgc

SEQ ID NO: 484269 - DNA, 20 bp, Artificial Sequence
  chemically synthesized
gcgtgagccaccgcgcccgg

SEQ ID NO: 484270 - DNA, 20 bp, Artificial Sequence
  chemically synthesized
tgttttctcgtctataaaat

SEQ ID NO: 484271 - DNA, 20 bp, Artificial Sequence
  chemically synthesized
gtgtgtgtacaaaatcttta

SEQ ID NO: 484272 - DNA, 20 bp, Artificial Sequence
  chemically synthesized
catctaatgcttatgaggta

SEQ ID NO: 484273 - DNA, 20 bp, Artificial Sequence
  chemically synthesized
attagtcatacttccacata

SEQ ID NO: 484274 - DNA, 20 bp, Artificial Sequence
  chemically synthesized
ggggaaagtgaaagagtaac

SEQ ID NO: 484275 - DNA, 20 bp, Artificial Sequence
  chemically synthesized
caatatgttggggaaagtga

SEQ ID NO: 484276 - DNA, 20 bp, Artificial Sequence
  chemically synthesized
aactagtcatttccttaggg

SEQ ID NO: 484277 - DNA, 20 bp, Artificial Sequence
  chemically synthesized
ttagggaagggttaacatag

SEQ ID NO: 484278 - DNA, 20 bp, Artificial Sequence
  chemically synthesized
gatatagactctcatggttt

SEQ ID NO: 484279 - DNA, 20 bp, Artificial Sequence
  chemically synthesized
ttttcaaactcggaaaccat

SEQ ID NO: 484280 - DNA, 20 bp, Artificial Sequence
  chemically synthesized
ttcctccttcctgcactaca

SEQ ID NO: 484281 - DNA, 20 bp, Artificial Sequence
  chemically synthesized
cctgcactacaaaggattct

SEQ ID NO: 484282 - DNA, 20 bp, Artificial Sequence
  chemically synthesized
attttccttcccacaacccg

SEQ ID NO: 484283 - DNA, 20 bp, Artificial Sequence
  chemically synthesized
ggttgtgggaaggaaaatga

SEQ ID NO: 484284 - DNA, 20 bp, Artificial Sequence
  chemically synthesized
tccagggacacacactggta

SEQ ID NO: 484285 - DNA, 20 bp, Artificial Sequence
  chemically synthesized
acttggacctcatttctgag

SEQ ID NO: 484286 - DNA, 20 bp, Artificial Sequence
  chemically synthesized
aggagaatctctgagggaaa

SEQ ID NO: 484287 - DNA, 20 bp, Artificial Sequence
  chemically synthesized
tctctgagggaaaccgggtg

SEQ ID NO: 484288 - DNA, 20 bp, Artificial Sequence
  chemically synthesized
tcaggaagagtgacagacga

SEQ ID NO: 484289 - DNA, 20 bp, Artificial Sequence
  chemically synthesized
tgagtttccatggggtcagg

SEQ ID NO: 484290 - DNA, 20 bp, Artificial Sequence
  chemically synthesized
gttgtgtcagtgagtttcca

SEQ ID NO: 484291 - DNA, 20 bp, Artificial Sequence
  chemically synthesized
agtgattgtgtgttgtgtca

SEQ ID NO: 484292 - DNA, 20 bp, Artificial Sequence
  chemically synthesized
tgacacaacacacaatcact

SEQ ID NO: 484293 - DNA, 20 bp, Artificial Sequence
  chemically synthesized
actcctatccatttaatggg

SEQ ID NO: 484294 - DNA, 20 bp, Artificial Sequence
  chemically synthesized
cgaatcactctccccattaa

SEQ ID NO: 484295 - DNA, 20 bp, Artificial Sequence
  chemically synthesized
actctccccattaaatggat

SEQ ID NO: 484296 - DNA, 20 bp, Artificial Sequence
  chemically synthesized
aggagtgtatgtcagaagaa

SEQ ID NO: 484297 - DNA, 20 bp, Artificial Sequence
  chemically synthesized
tatgcacagcgtctagtcag

SEQ ID NO: 484298 - DNA, 20 bp, Artificial Sequence
  chemically synthesized
tactgtaccttatgccgtag

SEQ ID NO: 484299 - DNA, 20 bp, Artificial Sequence
  chemically synthesized
atgtgcagtgactttcagat

SEQ ID NO: 484300 - DNA, 20 bp, Artificial Sequence
  chemically synthesized
atctgaaagtcactgcacat

SEQ ID NO: 484301 - DNA, 20 bp, Artificial Sequence
  chemically synthesized
gcctgcttggaccaacagcc

SEQ ID NO: 484302 - DNA, 20 bp, Artificial Sequence
  chemically synthesized
agggagagactggcatctcc

SEQ ID NO: 484303 - DNA, 20 bp, Artificial Sequence
  chemically synthesized
tagttgcaaagcatgcattg

SEQ ID NO: 484304 - DNA, 20 bp, Artificial Sequence
  chemically synthesized
gctttgcaactatataagcc

SEQ ID NO: 484305 - DNA, 20 bp, Artificial Sequence
  chemically synthesized
aatgtatttcttctattcaa

SEQ ID NO: 484306 - DNA, 20 bp, Artificial Sequence
  chemically synthesized
aataaatgaatgtaattcca

SEQ ID NO: 484307 - DNA, 20 bp, Artificial Sequence
  chemically synthesized
ataatgttaccttttaataa

SEQ ID NO: 484308 - DNA, 20 bp, Artificial Sequence
  chemically synthesized
attatttttataaatgtgag

SEQ ID NO: 484309 - DNA, 20 bp, Artificial Sequence
  chemically synthesized
aagaggctagaacaatcatt

SEQ ID NO: 484310 - DNA, 20 bp, Artificial Sequence
  chemically synthesized
tcaaattttgggcagcggta

SEQ ID NO: 484311 - DNA, 20 bp, Artificial Sequence
  chemically synthesized
tgttcttacaggcaacaatg

SEQ ID NO: 484312 - DNA, 20 bp, Artificial Sequence
  chemically synthesized
gaacaaatatcccttagtat

SEQ ID NO: 484313 - DNA, 20 bp, Artificial Sequence
  chemically synthesized
gctgaagaaccctgatacta

SEQ ID NO: 484314 - DNA, 20 bp, Artificial Sequence
  chemically synthesized
tttactttgtattatgtaaa

SEQ ID NO: 484315 - DNA, 20 bp, Artificial Sequence
  chemically synthesized
taaaaaagatgttactgtat

SEQ ID NO: 484316 - DNA, 20 bp, Artificial Sequence
  chemically synthesized
ttgaaatatttttgatatct

SEQ ID NO: 484317 - DNA, 20 bp, Artificial Sequence
  chemically synthesized
aggctcaaatggagacattc

SEQ ID NO: 484318 - DNA, 20 bp, Artificial Sequence
  chemically synthesized
tggagacattccggagtacc

SEQ ID NO: 484319 - DNA, 20 bp, Artificial Sequence
  chemically synthesized
ttaagtaatccgaggtactc

SEQ ID NO: 484320 - DNA, 20 bp, Artificial Sequence
  chemically synthesized
cggattacttaaaccactgt

SEQ ID NO: 484321 - DNA, 20 bp, Artificial Sequence
  chemically synthesized
taaaccactgtctgaatgcc

SEQ ID NO: 484322 - DNA, 20 bp, Artificial Sequence
  chemically synthesized
cttgagtaagaaatgttatt

SEQ ID NO: 484323 - DNA, 20 bp, Artificial Sequence
  chemically synthesized
ttaaatacattgtcgtaatt

SEQ ID NO: 484324 - DNA, 20 bp, Artificial Sequence
  chemically synthesized
accttaattttgacgtcaca

SEQ ID NO: 484325 - DNA, 20 bp, Artificial Sequence
  chemically synthesized
tttgacaggtgagaaatctc

SEQ ID NO: 484326 - DNA, 20 bp, Artificial Sequence
  chemically synthesized
ctcctaagctgcctgtccgt

SEQ ID NO: 484327 - DNA, 20 bp, Artificial Sequence
  chemically synthesized
tttgcctccctccagaacta

SEQ ID NO: 484328 - DNA, 20 bp, Artificial Sequence
  chemically synthesized
catttataatacaggggaat

SEQ ID NO: 484329 - DNA, 20 bp, Artificial Sequence
  chemically synthesized
taaagtcatttataatacag

SEQ ID NO: 484330 - DNA, 20 bp, Artificial Sequence
  chemically synthesized
aatagacactgaagaaaggg

SEQ ID NO: 484331 - DNA, 20 bp, Artificial Sequence
  chemically synthesized
cccaattaaaataaaattta

SEQ ID NO: 484332 - DNA, 20 bp, Artificial Sequence
  chemically synthesized
aatcagcaggagtcaaagta

SEQ ID NO: 484333 - DNA, 20 bp, Artificial Sequence
  chemically synthesized
aaattcgttagaaaatcagc

SEQ ID NO: 484334 - DNA, 20 bp, Artificial Sequence
  chemically synthesized
tgactcctgctgattttcta

SEQ ID NO: 484335 - DNA, 20 bp, Artificial Sequence
  chemically synthesized
tcttcacagaagaaacacta

SEQ ID NO: 484336 - DNA, 20 bp, Artificial Sequence
  chemically synthesized
tttactattaccaaaagcaa

SEQ ID NO: 484337 - DNA, 20 bp, Artificial Sequence
  chemically synthesized
aaaagttagaaacctgaaaa

SEQ ID NO: 484338 - DNA, 20 bp, Artificial Sequence
  chemically synthesized
tttatggtttctttacacaa

SEQ ID NO: 484339 - DNA, 20 bp, Artificial Sequence
  chemically synthesized
taagtggcataagtcagctg

SEQ ID NO: 484340 - DNA, 20 bp, Artificial Sequence
  chemically synthesized
aataagatgttttccagtgt

SEQ ID NO: 484341 - DNA, 20 bp, Artificial Sequence
  chemically synthesized
cttcccatgtcacagatgac

SEQ ID NO: 484342 - DNA, 20 bp, Artificial Sequence
  chemically synthesized
gggaagctgaaaggttgctt

SEQ ID NO: 484343 - DNA, 20 bp, Artificial Sequence
  chemically synthesized
aattgcctaccctaaaatgt

SEQ ID NO: 484344 - DNA, 20 bp, Artificial Sequence
  chemically synthesized
ttgaacatattcaaacattt

SEQ ID NO: 484345 - DNA, 20 bp, Artificial Sequence
  chemically synthesized
aaatgtttgaatatgttcaa

SEQ ID NO: 484346 - DNA, 20 bp, Artificial Sequence
  chemically synthesized
tttgacttcatctgaggttt

SEQ ID NO: 484347 - DNA, 20 bp, Artificial Sequence
  chemically synthesized
taaaatgaatggatgagtaa

SEQ ID NO: 484348 - DNA, 20 bp, Artificial Sequence
  chemically synthesized
atatttattaaaatgaatgg

SEQ ID NO: 484349 - DNA, 20 bp, Artificial Sequence
  chemically synthesized
aaaaatatttattaaaatga

SEQ ID NO: 484350 - DNA, 20 bp, Artificial Sequence
  chemically synthesized
gctgaaaaatatttattaaa

SEQ ID NO: 484351 - DNA, 20 bp, Artificial Sequence
  chemically synthesized
actgccacatgcatagtccc

SEQ ID NO: 484352 - DNA, 20 bp, Artificial Sequence
  chemically synthesized
catgtgagttacacactata

SEQ ID NO: 484353 - DNA, 20 bp, Artificial Sequence
  chemically synthesized
cgaaaagcacgatttttcat

SEQ ID NO: 484354 - DNA, 20 bp, Artificial Sequence
  chemically synthesized
tataacaaagattatcttta

SEQ ID NO: 484355 - DNA, 20 bp, Artificial Sequence
  chemically synthesized
aaaaatctggttatgtgaga

SEQ ID NO: 484356 - DNA, 20 bp, Artificial Sequence
  chemically synthesized
caaaaaaaatctggttatgt

SEQ ID NO: 484357 - DNA, 20 bp, Artificial Sequence
  chemically synthesized
ggaaaaaagtatagcaaaca

SEQ ID NO: 484358 - DNA, 20 bp, Artificial Sequence
  chemically synthesized
agagaggaaaatggcttgtt

SEQ ID NO: 484359 - DNA, 20 bp, Artificial Sequence
  chemically synthesized
ctaatgaacaaaataggtct

SEQ ID NO: 484360 - DNA, 20 bp, Artificial Sequence
  chemically synthesized
ttgtgaaacctgttctctag

SEQ ID NO: 484361 - DNA, 20 bp, Artificial Sequence
  chemically synthesized
tgtgtctgtcagcagaatta

SEQ ID NO: 484362 - DNA, 20 bp, Artificial Sequence
  chemically synthesized
acaaagcatgtgtctgtcag

SEQ ID NO: 484363 - DNA, 20 bp, Artificial Sequence
  chemically synthesized
tttttaaggaggctgcttca

SEQ ID NO: 484364 - DNA, 20 bp, Artificial Sequence
  chemically synthesized
tgtatgtgttgaccatagag

SEQ ID NO: 484365 - DNA, 20 bp, Artificial Sequence
  chemically synthesized
atgtttgtatgtgttgacca

SEQ ID NO: 484366 - DNA, 20 bp, Artificial Sequence
  chemically synthesized
tttacagcttctttgttgaa

SEQ ID NO: 484367 - DNA, 20 bp, Artificial Sequence
  chemically synthesized
aatgataatgtatattgcta

SEQ ID NO: 484368 - DNA, 20 bp, Artificial Sequence
  chemically synthesized
ttagtggtcttttagtatag

SEQ ID NO: 484369 - DNA, 20 bp, Artificial Sequence
  chemically synthesized
gtcttttagtatagcagaat

SEQ ID NO: 484370 - DNA, 20 bp, Artificial Sequence
  chemically synthesized
cctctctttatttctagaaa

SEQ ID NO: 484371 - DNA, 20 bp, Artificial Sequence
  chemically synthesized
ccctttctagaaataaagag

SEQ ID NO: 484372 - DNA, 20 bp, Artificial Sequence
  chemically synthesized
attataaaaacagtggttaa

SEQ ID NO: 484373 - DNA, 20 bp, Artificial Sequence
  chemically synthesized
taagaacacaagcatatggt

SEQ ID NO: 484374 - DNA, 20 bp, Artificial Sequence
  chemically synthesized
ttttcatttggtttcctttt

SEQ ID NO: 484375 - DNA, 20 bp, Artificial Sequence
  chemically synthesized
aaagtatagtagcaaataaa

SEQ ID NO: 484376 - DNA, 20 bp, Artificial Sequence
  chemically synthesized
tcagtttatttgagaagttc

SEQ ID NO: 484377 - DNA, 20 bp, Artificial Sequence
  chemically synthesized
ctcatctgtgggtggctcga

SEQ ID NO: 484378 - DNA, 20 bp, Artificial Sequence
  chemically synthesized
tctaaggtgttttctcatct

SEQ ID NO: 484379 - DNA, 20 bp, Artificial Sequence
  chemically synthesized
atattttggaggcaagtagt

SEQ ID NO: 484380 - DNA, 20 bp, Artificial Sequence
  chemically synthesized
cagagaacagaattttatag

SEQ ID NO: 484381 - DNA, 20 bp, Artificial Sequence
  chemically synthesized
agcagattgggggcagagaa

SEQ ID NO: 484382 - DNA, 20 bp, Artificial Sequence
  chemically synthesized
ttgggagagtaacatctggt

SEQ ID NO: 484383 - DNA, 20 bp, Artificial Sequence
  chemically synthesized
actaggaacagcatgtttgg

SEQ ID NO: 484384 - DNA, 20 bp, Artificial Sequence
  chemically synthesized
aaaaggaccagaggtcatat

SEQ ID NO: 484385 - DNA, 20 bp, Artificial Sequence
  chemically synthesized
ctttagtcataacaaacaag

SEQ ID NO: 484386 - DNA, 20 bp, Artificial Sequence
  chemically synthesized
ttatttgtgtcacaaatatc

SEQ ID NO: 484387 - DNA, 20 bp, Artificial Sequence
  chemically synthesized
accagtacctaagcatgata

SEQ ID NO: 484388 - DNA, 20 bp, Artificial Sequence
  chemically synthesized
tgataatggatcgtgtctac

SEQ ID NO: 484389 - DNA, 20 bp, Artificial Sequence
  chemically synthesized
ttttgtttcctctagaatga

SEQ ID NO: 484390 - DNA, 20 bp, Artificial Sequence
  chemically synthesized
ctcctgtgttttgtttcctc

SEQ ID NO: 484391 - DNA, 20 bp, Artificial Sequence
  chemically synthesized
aacaaaacacaggagaagga

SEQ ID NO: 484392 - DNA, 20 bp, Artificial Sequence
  chemically synthesized
aggaatcaatgctatttcta

SEQ ID NO: 484393 - DNA, 20 bp, Artificial Sequence
  chemically synthesized
actgcttaccccttggagat

SEQ ID NO: 484394 - DNA, 20 bp, Artificial Sequence
  chemically synthesized
atgatgaattctcatctcca

SEQ ID NO: 484395 - DNA, 20 bp, Artificial Sequence
  chemically synthesized
cttggagatgagaattcatc

SEQ ID NO: 484396 - DNA, 20 bp, Artificial Sequence
  chemically synthesized
ctcagctagtggaatccatg

SEQ ID NO: 484397 - DNA, 20 bp, Artificial Sequence
  chemically synthesized
ctccatctttgctcagctag

SEQ ID NO: 484398 - DNA, 20 bp, Artificial Sequence
  chemically synthesized
tctgattcactttgtatttg

SEQ ID NO: 484399 - DNA, 20 bp, Artificial Sequence
  chemically synthesized
aaaaattcttcaaatacaaa

SEQ ID NO: 484400 - DNA, 20 bp, Artificial Sequence
  chemically synthesized
ttaatctcactaagtccccc

SEQ ID NO: 484401 - DNA, 20 bp, Artificial Sequence
  chemically synthesized
ctcactaagtccccccagag

SEQ ID NO: 484402 - DNA, 20 bp, Artificial Sequence
  chemically synthesized
ctgtttaacttcctatttca

SEQ ID NO: 484403 - DNA, 20 bp, Artificial Sequence
  chemically synthesized
ttttattgtattcattaaaa

SEQ ID NO: 484404 - DNA, 20 bp, Artificial Sequence
  chemically synthesized
ttaggtggaattctatttta

SEQ ID NO: 484405 - DNA, 20 bp, Artificial Sequence
  chemically synthesized
ttatttgagtattatttagg

SEQ ID NO: 484406 - DNA, 20 bp, Artificial Sequence
  chemically synthesized
tcaacatatagagtttttat

SEQ ID NO: 484407 - DNA, 20 bp, Artificial Sequence
  chemically synthesized
tcaaataaaaactctatatg

SEQ ID NO: 484408 - DNA, 20 bp, Artificial Sequence
  chemically synthesized
taagcattcaactcaacata

SEQ ID NO: 484409 - DNA, 20 bp, Artificial Sequence
  chemically synthesized
taaaaactctatatgttgag

SEQ ID NO: 484410 - DNA, 20 bp, Artificial Sequence
  chemically synthesized
aatgttcccattttcagtaa

SEQ ID NO: 484411 - DNA, 20 bp, Artificial Sequence
  chemically synthesized
cccattttcagtaaatgaat

SEQ ID NO: 484412 - DNA, 20 bp, Artificial Sequence
  chemically synthesized
aacttcaaaaaattaatata

SEQ ID NO: 484413 - DNA, 20 bp, Artificial Sequence
  chemically synthesized
ataaagaattcagaaggtaa

SEQ ID NO: 484414 - DNA, 20 bp, Artificial Sequence
  chemically synthesized
tccgtaaactcttttacctt

SEQ ID NO: 484415 - DNA, 20 bp, Artificial Sequence
  chemically synthesized
gtagcctttctagttaccga

SEQ ID NO: 484416 - DNA, 20 bp, Artificial Sequence
  chemically synthesized
accgaaagggttttactggt

SEQ ID NO: 484417 - DNA, 20 bp, Artificial Sequence
  chemically synthesized
ttggagaggcagccgaatgc

SEQ ID NO: 484418 - DNA, 20 bp, Artificial Sequence
  chemically synthesized
cactctatttggagaggcag

SEQ ID NO: 484419 - DNA, 20 bp, Artificial Sequence
  chemically synthesized
cattcggctgcctctccaaa

SEQ ID NO: 484420 - DNA, 20 bp, Artificial Sequence
  chemically synthesized
ggaagtaagtggaagacaat

SEQ ID NO: 484421 - DNA, 20 bp, Artificial Sequence
  chemically synthesized
catttccattttatactggc

SEQ ID NO: 484422 - DNA, 20 bp, Artificial Sequence
  chemically synthesized
caaccttccctacttctttt

SEQ ID NO: 484423 - DNA, 20 bp, Artificial Sequence
  chemically synthesized
acctccatcggtaacttctt

SEQ ID NO: 484424 - DNA, 20 bp, Artificial Sequence
  chemically synthesized
ccttttttgttctttattca

SEQ ID NO: 484425 - DNA, 20 bp, Artificial Sequence
  chemically synthesized
tcttataaagtatttattca

SEQ ID NO: 484426 - DNA, 20 bp, Artificial Sequence
  chemically synthesized
tttatataatttcaagcttg

SEQ ID NO: 484427 - DNA, 20 bp, Artificial Sequence
  chemically synthesized
aatccgggcaagggttacct

SEQ ID NO: 484428 - DNA, 20 bp, Artificial Sequence
  chemically synthesized
aactcccaggtaacccttgc

SEQ ID NO: 484429 - DNA, 20 bp, Artificial Sequence
  chemically synthesized
aacaaatggtgaatccgggc

SEQ ID NO: 484430 - DNA, 20 bp, Artificial Sequence
  chemically synthesized
tggcaaaatgttaacaaatg

SEQ ID NO: 484431 - DNA, 20 bp, Artificial Sequence
  chemically synthesized
tatatatctatacacacaga

SEQ ID NO: 484432 - DNA, 20 bp, Artificial Sequence
  chemically synthesized
tatatatatatatttttttt

SEQ ID NO: 484433 - DNA, 20 bp, Artificial Sequence
  chemically synthesized
attttttttctgaatcattt

SEQ ID NO: 484434 - DNA, 20 bp, Artificial Sequence
  chemically synthesized
aaataaaacctaaagtattt

SEQ ID NO: 484435 - DNA, 20 bp, Artificial Sequence
  chemically synthesized
actgagctgaggttatttaa

SEQ ID NO: 484436 - DNA, 20 bp, Artificial Sequence
  chemically synthesized
tcatactctgaatatagagt

SEQ ID NO: 484437 - DNA, 20 bp, Artificial Sequence
  chemically synthesized
tcttatccatactctatatt

SEQ ID NO: 484438 - DNA, 20 bp, Artificial Sequence
  chemically synthesized
taattgtcatactctgaata

SEQ ID NO: 484439 - DNA, 20 bp, Artificial Sequence
  chemically synthesized
aatggggtaattgtcatact

SEQ ID NO: 484440 - DNA, 20 bp, Artificial Sequence
  chemically synthesized
atagctataaagttcattaa

SEQ ID NO: 484441 - DNA, 20 bp, Artificial Sequence
  chemically synthesized
acgacaactaaaagcaatgc

SEQ ID NO: 484442 - DNA, 20 bp, Artificial Sequence
  chemically synthesized
aacagaggccaggtattttg

SEQ ID NO: 484443 - DNA, 20 bp, Artificial Sequence
  chemically synthesized
ttgtagaatatcccccaaat

SEQ ID NO: 484444 - DNA, 20 bp, Artificial Sequence
  chemically synthesized
attgctataactcaaatttg

SEQ ID NO: 484445 - DNA, 20 bp, Artificial Sequence
  chemically synthesized
cagcccctgcacctagctca

SEQ ID NO: 484446 - DNA, 20 bp, Artificial Sequence
  chemically synthesized
tttgttttctctttgagaac

SEQ ID NO: 484447 - DNA, 20 bp, Artificial Sequence
  chemically synthesized
tgttctcaaagagaaaacaa

SEQ ID NO: 484448 - DNA, 20 bp, Artificial Sequence
  chemically synthesized
attatggtaggggaaacatg

SEQ ID NO: 484449 - DNA, 20 bp, Artificial Sequence
  chemically synthesized
ggccaaagactgtcttctga

SEQ ID NO: 484450 - DNA, 20 bp, Artificial Sequence
  chemically synthesized
catattctcatggtggccac

SEQ ID NO: 484451 - DNA, 20 bp, Artificial Sequence
  chemically synthesized
catacccaagtggccaccat

SEQ ID NO: 484452 - DNA, 20 bp, Artificial Sequence
  chemically synthesized
aatatgcaggccttctatta

SEQ ID NO: 484453 - DNA, 20 bp, Artificial Sequence
  chemically synthesized
ggatttcaaaatgcagtaac

SEQ ID NO: 484454 - DNA, 20 bp, Artificial Sequence
  chemically synthesized
ggctttggtgcagtgcaatc

SEQ ID NO: 484455 - DNA, 20 bp, Artificial Sequence
  chemically synthesized
gacttctcctcacccaatga

SEQ ID NO: 484456 - DNA, 20 bp, Artificial Sequence
  chemically synthesized
attcccaccacacccaatca

SEQ ID NO: 484457 - DNA, 20 bp, Artificial Sequence
  chemically synthesized
acccaatgattgggtgtggt

SEQ ID NO: 484458 - DNA, 20 bp, Artificial Sequence
  chemically synthesized
ccttccactagaccgcacac

SEQ ID NO: 484459 - DNA, 20 bp, Artificial Sequence
  chemically synthesized
ctctccctctctcttccttg

SEQ ID NO: 484460 - DNA, 20 bp, Artificial Sequence
  chemically synthesized
ctctctcttccttgcagagt

SEQ ID NO: 484461 - DNA, 20 bp, Artificial Sequence
  chemically synthesized
attgtcccattttatcctgt

SEQ ID NO: 484462 - DNA, 20 bp, Artificial Sequence
  chemically synthesized
tgaggttatatgtacccaga

SEQ ID NO: 484463 - DNA, 20 bp, Artificial Sequence
  chemically synthesized
tagggtctaggaggacaaaa

SEQ ID NO: 484464 - DNA, 20 bp, Artificial Sequence
  chemically synthesized
tgaagagctgatgagaggtt

SEQ ID NO: 484465 - DNA, 20 bp, Artificial Sequence
  chemically synthesized
tggttccatgacactactac

SEQ ID NO: 484466 - DNA, 20 bp, Artificial Sequence
  chemically synthesized
gaatgtgtaactgtcaatta

SEQ ID NO: 484467 - DNA, 20 bp, Artificial Sequence
  chemically synthesized
atgtaaaaatacatatttac

SEQ ID NO: 484468 - DNA, 20 bp, Artificial Sequence
  chemically synthesized
ctatttagaaatcactaagg

SEQ ID NO: 484469 - DNA, 20 bp, Artificial Sequence
  chemically synthesized
accattatttccaaggagcg

SEQ ID NO: 484470 - DNA, 20 bp, Artificial Sequence
  chemically synthesized
gaatttaactggaggaaaat

SEQ ID NO: 484471 - DNA, 20 bp, Artificial Sequence
  chemically synthesized
accattaccatgtaacacat

SEQ ID NO: 484472 - DNA, 20 bp, Artificial Sequence
  chemically synthesized
gatgtgttacatggtaatgg

SEQ ID NO: 484473 - DNA, 20 bp, Artificial Sequence
  chemically synthesized
cagttcttgagctgcatgtg

SEQ ID NO: 484474 - DNA, 20 bp, Artificial Sequence
  chemically synthesized
ggaaactaaagcaagccacc

SEQ ID NO: 484475 - DNA, 20 bp, Artificial Sequence
  chemically synthesized
cctagtggttgttatctgtt

SEQ ID NO: 484476 - DNA, 20 bp, Artificial Sequence
  chemically synthesized
gttaagattattccacctct

SEQ ID NO: 484477 - DNA, 20 bp, Artificial Sequence
  chemically synthesized
gcacttctcactcagagagg

SEQ ID NO: 484478 - DNA, 20 bp, Artificial Sequence
  chemically synthesized
acttgtgcagttagttacac

SEQ ID NO: 484479 - DNA, 20 bp, Artificial Sequence
  chemically synthesized
acacaaggatctgcattaga

SEQ ID NO: 484480 - DNA, 20 bp, Artificial Sequence
  chemically synthesized
agtagagcatgaaaccaagt

SEQ ID NO: 484481 - DNA, 20 bp, Artificial Sequence
  chemically synthesized
cccttggttaaaaaaaaatt

SEQ ID NO: 484482 - DNA, 20 bp, Artificial Sequence
  chemically synthesized
cttttattctccactaacct

SEQ ID NO: 484483 - DNA, 20 bp, Artificial Sequence
  chemically synthesized
cctcaaccctaaggttagtg

SEQ ID NO: 484484 - DNA, 20 bp, Artificial Sequence
  chemically synthesized
atgcctcttgcttaattcct

SEQ ID NO: 484485 - DNA, 20 bp, Artificial Sequence
  chemically synthesized
gaaatttgaaacgcattctc

SEQ ID NO: 484486 - DNA, 20 bp, Artificial Sequence
  chemically synthesized
gggaaacgacaaagaaagtg

SEQ ID NO: 484487 - DNA, 20 bp, Artificial Sequence
  chemically synthesized
gtgttagctgtttccaaggc

SEQ ID NO: 484488 - DNA, 20 bp, Artificial Sequence
  chemically synthesized
tatttgtctatgtgtactag

SEQ ID NO: 484489 - DNA, 20 bp, Artificial Sequence
  chemically synthesized
tacacaaaaaataattgttt

SEQ ID NO: 484490 - DNA, 20 bp, Artificial Sequence
  chemically synthesized
acaacaacaatagttgttta

SEQ ID NO: 484491 - DNA, 20 bp, Artificial Sequence
  chemically synthesized
gagtgcataccatatgccaa

SEQ ID NO: 484492 - DNA, 20 bp, Artificial Sequence
  chemically synthesized
tatcacagcatactagttaa

SEQ ID NO: 484493 - DNA, 20 bp, Artificial Sequence
  chemically synthesized
ctagttaaaagaatgaactc

SEQ ID NO: 484494 - DNA, 20 bp, Artificial Sequence
  chemically synthesized
aaattgggaaagcctgactc

SEQ ID NO: 484495 - DNA, 20 bp, Artificial Sequence
  chemically synthesized
aacatactgaaaatagtaaa

SEQ ID NO: 484496 - DNA, 20 bp, Artificial Sequence
  chemically synthesized
agcactgtgaaatggagata

SEQ ID NO: 484497 - DNA, 20 bp, Artificial Sequence
  chemically synthesized
ctacctctcagattcattat

SEQ ID NO: 484498 - DNA, 20 bp, Artificial Sequence
  chemically synthesized
taactctattaattctcata

SEQ ID NO: 484499 - DNA, 20 bp, Artificial Sequence
  chemically synthesized
agattcattatgagaattaa

SEQ ID NO: 484500 - DNA, 20 bp, Artificial Sequence
  chemically synthesized
ttatcatattactctgtgag

SEQ ID NO: 484501 - DNA, 20 bp, Artificial Sequence
  chemically synthesized
caatattagtacccacctca

SEQ ID NO: 484502 - DNA, 20 bp, Artificial Sequence
  chemically synthesized
ctattttactagtaaagaaa

SEQ ID NO: 484503 - DNA, 20 bp, Artificial Sequence
  chemically synthesized
aagaagttaaacaatttgtc

SEQ ID NO: 484504 - DNA, 20 bp, Artificial Sequence
  chemically synthesized
accttatattatactatgac

SEQ ID NO: 484505 - DNA, 20 bp, Artificial Sequence
  chemically synthesized
atgatagtatgatataatat

SEQ ID NO: 484506 - DNA, 20 bp, Artificial Sequence
  chemically synthesized
tagtatgatataatatagga

SEQ ID NO: 484507 - DNA, 20 bp, Artificial Sequence
  chemically synthesized
ataggaatggataaagggac

SEQ ID NO: 484508 - DNA, 20 bp, Artificial Sequence
  chemically synthesized
aagggacagggatatgaaac

SEQ ID NO: 484509 - DNA, 20 bp, Artificial Sequence
  chemically synthesized
attcagaatataatctgtcc

SEQ ID NO: 484510 - DNA, 20 bp, Artificial Sequence
  chemically synthesized
attcaaggacagattatatt

SEQ ID NO: 484511 - DNA, 20 bp, Artificial Sequence
  chemically synthesized
tgcaagaaccatgactgatt

SEQ ID NO: 484512 - DNA, 20 bp, Artificial Sequence
  chemically synthesized
aataaatagttcattcaaag

SEQ ID NO: 484513 - DNA, 20 bp, Artificial Sequence
  chemically synthesized
gaaagcctcctcatcccact

SEQ ID NO: 484514 - DNA, 20 bp, Artificial Sequence
  chemically synthesized
aaggcctgaaaggctaaggg

SEQ ID NO: 484515 - DNA, 20 bp, Artificial Sequence
  chemically synthesized
taaggggagggtatagttag

SEQ ID NO: 484516 - DNA, 20 bp, Artificial Sequence
  chemically synthesized
tcttgacaggagctggggct

SEQ ID NO: 484517 - DNA, 20 bp, Artificial Sequence
  chemically synthesized
gatgagaggagagtgagtcg

SEQ ID NO: 484518 - DNA, 20 bp, Artificial Sequence
  chemically synthesized
gatcaatggatgagaggaga

SEQ ID NO: 484519 - DNA, 20 bp, Artificial Sequence
  chemically synthesized
agcagatcaatggatgagag

SEQ ID NO: 484520 - DNA, 20 bp, Artificial Sequence
  chemically synthesized
tgggaggcatcagcagatca

SEQ ID NO: 484521 - DNA, 20 bp, Artificial Sequence
  chemically synthesized
tgccatattggtcaacctcc

SEQ ID NO: 484522 - DNA, 20 bp, Artificial Sequence
  chemically synthesized
gtagaacaacaggttagaga

SEQ ID NO: 484523 - DNA, 20 bp, Artificial Sequence
  chemically synthesized
ttattttttttatactgttg

SEQ ID NO: 484524 - DNA, 20 bp, Artificial Sequence
  chemically synthesized
tgaaggaaatgaccacatat

SEQ ID NO: 484525 - DNA, 20 bp, Artificial Sequence
  chemically synthesized
cttgatatgaagtctttgct

SEQ ID NO: 484526 - DNA, 20 bp, Artificial Sequence
  chemically synthesized
aactttggcagatttggcta

SEQ ID NO: 484527 - DNA, 20 bp, Artificial Sequence
  chemically synthesized
caaatgggctggttagagcc

SEQ ID NO: 484528 - DNA, 20 bp, Artificial Sequence
  chemically synthesized
cttatttgccattatttgta

SEQ ID NO: 484529 - DNA, 20 bp, Artificial Sequence
  chemically synthesized
ttaaaaatcagtttgaggtt

SEQ ID NO: 484530 - DNA, 20 bp, Artificial Sequence
  chemically synthesized
gaacaaaatctatggaggca

SEQ ID NO: 484531 - DNA, 20 bp, Artificial Sequence
  chemically synthesized
tagattttgttctttctggt

SEQ ID NO: 484532 - DNA, 20 bp, Artificial Sequence
  chemically synthesized
tgtatttctaggaatggacc

SEQ ID NO: 484533 - DNA, 20 bp, Artificial Sequence
  chemically synthesized
tatctgttaactgtatttct

SEQ ID NO: 484534 - DNA, 20 bp, Artificial Sequence
  chemically synthesized
tcaatcaacactttttacgt

SEQ ID NO: 484535 - DNA, 20 bp, Artificial Sequence
  chemically synthesized
ttagagacttgtggcagatc

SEQ ID NO: 484536 - DNA, 20 bp, Artificial Sequence
  chemically synthesized
tgaaaaggtgctcaacatca

SEQ ID NO: 484537 - DNA, 20 bp, Artificial Sequence
  chemically synthesized
tggatataagccattttaac

SEQ ID NO: 484538 - DNA, 20 bp, Artificial Sequence
  chemically synthesized
cattggttattgcctgtctt

SEQ ID NO: 484539 - DNA, 20 bp, Artificial Sequence
  chemically synthesized
catttccaccaacagtatac

SEQ ID NO: 484540 - DNA, 20 bp, Artificial Sequence
  chemically synthesized
ataatatagcattcccgctg

SEQ ID NO: 484541 - DNA, 20 bp, Artificial Sequence
  chemically synthesized
ttgggtatatacccagcagc

SEQ ID NO: 484542 - DNA, 20 bp, Artificial Sequence
  chemically synthesized
atatactgatttattttctt

SEQ ID NO: 484543 - DNA, 20 bp, Artificial Sequence
  chemically synthesized
aatagcgctgcaataaacat

SEQ ID NO: 484544 - DNA, 20 bp, Artificial Sequence
  chemically synthesized
gcttccaaatcttggctatt

SEQ ID NO: 484545 - DNA, 20 bp, Artificial Sequence
  chemically synthesized
acctaagtgtccatcagtag

SEQ ID NO: 484546 - DNA, 20 bp, Artificial Sequence
  chemically synthesized
catgtggtacctatgcacaa

SEQ ID NO: 484547 - DNA, 20 bp, Artificial Sequence
  chemically synthesized
aatctcattcttttttgtgg

SEQ ID NO: 484548 - DNA, 20 bp, Artificial Sequence
  chemically synthesized
aatactactcagccacaaaa

SEQ ID NO: 484549 - DNA, 20 bp, Artificial Sequence
  chemically synthesized
aacaatgttgttgcagatga

SEQ ID NO: 484550 - DNA, 20 bp, Artificial Sequence
  chemically synthesized
tgcatgttctcacttatttg

SEQ ID NO: 484551 - DNA, 20 bp, Artificial Sequence
  chemically synthesized
tgtccatgagttcaattgtt

SEQ ID NO: 484552 - DNA, 20 bp, Artificial Sequence
  chemically synthesized
caattgaactcatggacata

SEQ ID NO: 484553 - DNA, 20 bp, Artificial Sequence
  chemically synthesized
tccttctactctctatgtcc

SEQ ID NO: 484554 - DNA, 20 bp, Artificial Sequence
  chemically synthesized
ctcatggacatagagagtag

SEQ ID NO: 484555 - DNA, 20 bp, Artificial Sequence
  chemically synthesized
gagtagaaggatggttacct

SEQ ID NO: 484556 - DNA, 20 bp, Artificial Sequence
  chemically synthesized
gatggttacctgaggatggg

SEQ ID NO: 484557 - DNA, 20 bp, Artificial Sequence
  chemically synthesized
gggaagggtcgtggggaggt

SEQ ID NO: 484558 - DNA, 20 bp, Artificial Sequence
  chemically synthesized
gggtggtgtaggtatagtta

SEQ ID NO: 484559 - DNA, 20 bp, Artificial Sequence
  chemically synthesized
ggtacaaaaaattagttaga

SEQ ID NO: 484560 - DNA, 20 bp, Artificial Sequence
  chemically synthesized
caaaaaattagttagaaaga

SEQ ID NO: 484561 - DNA, 20 bp, Artificial Sequence
  chemically synthesized
gtacattttacattaattaa

SEQ ID NO: 484562 - DNA, 20 bp, Artificial Sequence
  chemically synthesized
cattaattaaaagagtataa

SEQ ID NO: 484563 - DNA, 20 bp, Artificial Sequence
  chemically synthesized
attggattgtttggaacata

SEQ ID NO: 484564 - DNA, 20 bp, Artificial Sequence
  chemically synthesized
acataaagaataaatgcttg

SEQ ID NO: 484565 - DNA, 20 bp, Artificial Sequence
  chemically synthesized
aagaataaatgcttgagggg

SEQ ID NO: 484566 - DNA, 20 bp, Artificial Sequence
  chemically synthesized
agtaagcacatcatgtaaaa

SEQ ID NO: 484567 - DNA, 20 bp, Artificial Sequence
  chemically synthesized
tttttatatttttaagtttt

SEQ ID NO: 484568 - DNA, 20 bp, Artificial Sequence
  chemically synthesized
aacaaaaagaaacaagtaat

SEQ ID NO: 484569 - DNA, 20 bp, Artificial Sequence
  chemically synthesized
tgtcttattgttttttaagt

SEQ ID NO: 484570 - DNA, 20 bp, Artificial Sequence
  chemically synthesized
ttcaatttgttgatattttg

SEQ ID NO: 484571 - DNA, 20 bp, Artificial Sequence
  chemically synthesized
gaacatgcagtgctaggctt

SEQ ID NO: 484572 - DNA, 20 bp, Artificial Sequence
  chemically synthesized
gcatgttctcactcgtaagt

SEQ ID NO: 484573 - DNA, 20 bp, Artificial Sequence
  chemically synthesized
tcattgttcaattcccactt

SEQ ID NO: 484574 - DNA, 20 bp, Artificial Sequence
  chemically synthesized
tcacacaccggggcctgtca

SEQ ID NO: 484575 - DNA, 20 bp, Artificial Sequence
  chemically synthesized
atgcattgggggcttaaaac

SEQ ID NO: 484576 - DNA, 20 bp, Artificial Sequence
  chemically synthesized
gggggcttaaaacctggatg

SEQ ID NO: 484577 - DNA, 20 bp, Artificial Sequence
  chemically synthesized
aaaacctggatgttgggttg

SEQ ID NO: 484578 - DNA, 20 bp, Artificial Sequence
  chemically synthesized
tttaattttactttaagttc

SEQ ID NO: 484579 - DNA, 20 bp, Artificial Sequence
  chemically synthesized
attataccacacggaactta

SEQ ID NO: 484580 - DNA, 20 bp, Artificial Sequence
  chemically synthesized
cattttcatttttggatgtt

SEQ ID NO: 484581 - DNA, 20 bp, Artificial Sequence
  chemically synthesized
agtgaaaggcattttcattt

SEQ ID NO: 484582 - DNA, 20 bp, Artificial Sequence
  chemically synthesized
taaataatgtggtgtaaatt

SEQ ID NO: 484583 - DNA, 20 bp, Artificial Sequence
  chemically synthesized
tttcaaagtcaagaaaaaaa

SEQ ID NO: 484584 - DNA, 20 bp, Artificial Sequence
  chemically synthesized
aataactaaaagatctaacg

SEQ ID NO: 484585 - DNA, 20 bp, Artificial Sequence
  chemically synthesized
ttcaagaaatgtgaacaatg

SEQ ID NO: 484586 - DNA, 20 bp, Artificial Sequence
  chemically synthesized
atgccaaatttatagaacaa

SEQ ID NO: 484587 - DNA, 20 bp, Artificial Sequence
  chemically synthesized
ataaatttggcatattaaca

SEQ ID NO: 484588 - DNA, 20 bp, Artificial Sequence
  chemically synthesized
ggccataatatcaaaagcct

SEQ ID NO: 484589 - DNA, 20 bp, Artificial Sequence
  chemically synthesized
aacaatatataggactgcct

SEQ ID NO: 484590 - DNA, 20 bp, Artificial Sequence
  chemically synthesized
atcacaataaaatgaggcac

SEQ ID NO: 484591 - DNA, 20 bp, Artificial Sequence
  chemically synthesized
gcacacttgacagatgatag

SEQ ID NO: 484592 - DNA, 20 bp, Artificial Sequence
  chemically synthesized
tgattgttaccatttttttt

SEQ ID NO: 484593 - DNA, 20 bp, Artificial Sequence
  chemically synthesized
aacaatcatctgagcctgca

SEQ ID NO: 484594 - DNA, 20 bp, Artificial Sequence
  chemically synthesized
gtacaggctcttgcctcagt

SEQ ID NO: 484595 - DNA, 20 bp, Artificial Sequence
  chemically synthesized
gaggatggctgctgattgat

SEQ ID NO: 484596 - DNA, 20 bp, Artificial Sequence
  chemically synthesized
gggtggcggttgctgaaggt

SEQ ID NO: 484597 - DNA, 20 bp, Artificial Sequence
  chemically synthesized
aaattttgaaagaagttcta

SEQ ID NO: 484598 - DNA, 20 bp, Artificial Sequence
  chemically synthesized
agtagaacttctttcaaaat

SEQ ID NO: 484599 - DNA, 20 bp, Artificial Sequence
  chemically synthesized
cttagttgataaattagcat

SEQ ID NO: 484600 - DNA, 20 bp, Artificial Sequence
  chemically synthesized
taatttatcaactaagttta

SEQ ID NO: 484601 - DNA, 20 bp, Artificial Sequence
  chemically synthesized
tgaaatgacaacaaaggatt

SEQ ID NO: 484602 - DNA, 20 bp, Artificial Sequence
  chemically synthesized
acattgttgaaatgacaaca

SEQ ID NO: 484603 - DNA, 20 bp, Artificial Sequence
  chemically synthesized
atgttcacagcatcatcacc

SEQ ID NO: 484604 - DNA, 20 bp, Artificial Sequence
  chemically synthesized
cacagcatcatcaccaagag

SEQ ID NO: 484605 - DNA, 20 bp, Artificial Sequence
  chemically synthesized
cggatccagagttgctgctt

SEQ ID NO: 484606 - DNA, 20 bp, Artificial Sequence
  chemically synthesized
ctcatccataagcagcaact

SEQ ID NO: 484607 - DNA, 20 bp, Artificial Sequence
  chemically synthesized
aggtaaaacttcagcggatc

SEQ ID NO: 484608 - DNA, 20 bp, Artificial Sequence
  chemically synthesized
aatctcaaggtaaaacttca

SEQ ID NO: 484609 - DNA, 20 bp, Artificial Sequence
  chemically synthesized
agtggagtcagaaggtgtga

SEQ ID NO: 484610 - DNA, 20 bp, Artificial Sequence
  chemically synthesized
atgagaaccagaatgagaag

SEQ ID NO: 484611 - DNA, 20 bp, Artificial Sequence
  chemically synthesized
ggtagaaatagcatgagaac

SEQ ID NO: 484612 - DNA, 20 bp, Artificial Sequence
  chemically synthesized
caacactcatcaatgacttt

SEQ ID NO: 484613 - DNA, 20 bp, Artificial Sequence
  chemically synthesized
ttggaccctcaaagtcattg

SEQ ID NO: 484614 - DNA, 20 bp, Artificial Sequence
  chemically synthesized
tcaaagtcattgatgagtgt

SEQ ID NO: 484615 - DNA, 20 bp, Artificial Sequence
  chemically synthesized
gtcaaaatatcaacattatc

SEQ ID NO: 484616 - DNA, 20 bp, Artificial Sequence
  chemically synthesized
ttgacctcctcccctcaatc

SEQ ID NO: 484617 - DNA, 20 bp, Artificial Sequence
  chemically synthesized
tgaattttcttcatggcatc

SEQ ID NO: 484618 - DNA, 20 bp, Artificial Sequence
  chemically synthesized
tggtgagtccactgatggat

SEQ ID NO: 484619 - DNA, 20 bp, Artificial Sequence
  chemically synthesized
atattgtggtgagtccactg

SEQ ID NO: 484620 - DNA, 20 bp, Artificial Sequence
  chemically synthesized
ggtatagctgctatattgtg

SEQ ID NO: 484621 - DNA, 20 bp, Artificial Sequence
  chemically synthesized
acttcttgatccaaggactg

SEQ ID NO: 484622 - DNA, 20 bp, Artificial Sequence
  chemically synthesized
caacatccattctgcagtcc

SEQ ID NO: 484623 - DNA, 20 bp, Artificial Sequence
  chemically synthesized
cttgatccaaggactgcaga

SEQ ID NO: 484624 - DNA, 20 bp, Artificial Sequence
  chemically synthesized
ccctgaggaatatgtccaaa

SEQ ID NO: 484625 - DNA, 20 bp, Artificial Sequence
  chemically synthesized
ctggtcacccaagagccctg

SEQ ID NO: 484626 - DNA, 20 bp, Artificial Sequence
  chemically synthesized
ggacatattcctcagggctc

SEQ ID NO: 484627 - DNA, 20 bp, Artificial Sequence
  chemically synthesized
tagcataacctgaagggccc

SEQ ID NO: 484628 - DNA, 20 bp, Artificial Sequence
  chemically synthesized
ctgaagggccctaggatttt

SEQ ID NO: 484629 - DNA, 20 bp, Artificial Sequence
  chemically synthesized
gaaacagccttctattggaa

SEQ ID NO: 484630 - DNA, 20 bp, Artificial Sequence
  chemically synthesized
ttagatgttagtttgatctt

SEQ ID NO: 484631 - DNA, 20 bp, Artificial Sequence
  chemically synthesized
aagtatgttcatgagcctta

SEQ ID NO: 484632 - DNA, 20 bp, Artificial Sequence
  chemically synthesized
ctcacctctctcggcattca

SEQ ID NO: 484633 - DNA, 20 bp, Artificial Sequence
  chemically synthesized
gactaattctctgcaattct

SEQ ID NO: 484634 - DNA, 20 bp, Artificial Sequence
  chemically synthesized
tcggcattcacagaattgca

SEQ ID NO: 484635 - DNA, 20 bp, Artificial Sequence
  chemically synthesized
atgtcttagtggtctggata

SEQ ID NO: 484636 - DNA, 20 bp, Artificial Sequence
  chemically synthesized
atggagaatgtcttagtggt

SEQ ID NO: 484637 - DNA, 20 bp, Artificial Sequence
  chemically synthesized
acggccttatttttaatatg

SEQ ID NO: 484638 - DNA, 20 bp, Artificial Sequence
  chemically synthesized
agtgctactctgttgaacac

SEQ ID NO: 484639 - DNA, 20 bp, Artificial Sequence
  chemically synthesized
tttcttattcctgtgttcaa

SEQ ID NO: 484640 - DNA, 20 bp, Artificial Sequence
  chemically synthesized
ttgtgccagttggccaagtt

SEQ ID NO: 484641 - DNA, 20 bp, Artificial Sequence
  chemically synthesized
taagtgttcatgggaaaaaa

SEQ ID NO: 484642 - DNA, 20 bp, Artificial Sequence
  chemically synthesized
tgaacacttagaggacattg

SEQ ID NO: 484643 - DNA, 20 bp, Artificial Sequence
  chemically synthesized
ttcaatattgttgtgtctca

SEQ ID NO: 484644 - DNA, 20 bp, Artificial Sequence
  chemically synthesized
aaggagaggaagagagatga

SEQ ID NO: 484645 - DNA, 20 bp, Artificial Sequence
  chemically synthesized
atgagggaatggctgatcag

SEQ ID NO: 484646 - DNA, 20 bp, Artificial Sequence
  chemically synthesized
ccagcatcatgtcttaaata

SEQ ID NO: 484647 - DNA, 20 bp, Artificial Sequence
  chemically synthesized
ctgtatttaagacatgatgc

SEQ ID NO: 484648 - DNA, 20 bp, Artificial Sequence
  chemically synthesized
ggctggttagccatatgcag

SEQ ID NO: 484649 - DNA, 20 bp, Artificial Sequence
  chemically synthesized
ttttgtatatggtgtaagga

SEQ ID NO: 484650 - DNA, 20 bp, Artificial Sequence
  chemically synthesized
atacaaaaattaactcaaga

SEQ ID NO: 484651 - DNA, 20 bp, Artificial Sequence
  chemically synthesized
gtttaaacctttattccatc

SEQ ID NO: 484652 - DNA, 20 bp, Artificial Sequence
  chemically synthesized
aacattagatctcaaattat

SEQ ID NO: 484653 - DNA, 20 bp, Artificial Sequence
  chemically synthesized
gtgtttcctaggctttctta

SEQ ID NO: 484654 - DNA, 20 bp, Artificial Sequence
  chemically synthesized
tctttcccaagtctgatgtc

SEQ ID NO: 484655 - DNA, 20 bp, Artificial Sequence
  chemically synthesized
tctggacatcagacttggga

SEQ ID NO: 484656 - DNA, 20 bp, Artificial Sequence
  chemically synthesized
taaagagctcttcacagtga

SEQ ID NO: 484657 - DNA, 20 bp, Artificial Sequence
  chemically synthesized
acagtgaaagaatttatcaa

SEQ ID NO: 484658 - DNA, 20 bp, Artificial Sequence
  chemically synthesized
cagagtaaacagacagtcta

SEQ ID NO: 484659 - DNA, 20 bp, Artificial Sequence
  chemically synthesized
acagacagtctacagaataa

SEQ ID NO: 484660 - DNA, 20 bp, Artificial Sequence
  chemically synthesized
tctgacaaaggtctaatatt

SEQ ID NO: 484661 - DNA, 20 bp, Artificial Sequence
  chemically synthesized
gtttaagttccctatagatt

SEQ ID NO: 484662 - DNA, 20 bp, Artificial Sequence
  chemically synthesized
ggttatttgtttttgacttg

SEQ ID NO: 484663 - DNA, 20 bp, Artificial Sequence
  chemically synthesized
cttttgcccattttttttga

SEQ ID NO: 484664 - DNA, 20 bp, Artificial Sequence
  chemically synthesized
ggccacttgtatgtcttctt

SEQ ID NO: 484665 - DNA, 20 bp, Artificial Sequence
  chemically synthesized
tgatttgcatttctctgatg

SEQ ID NO: 484666 - DNA, 20 bp, Artificial Sequence
  chemically synthesized
actttttaataatagccagt

SEQ ID NO: 484667 - DNA, 20 bp, Artificial Sequence
  chemically synthesized
cattcccagcaacagtgtat

SEQ ID NO: 484668 - DNA, 20 bp, Artificial Sequence
  chemically synthesized
aactctgatacactgttgct

SEQ ID NO: 484669 - DNA, 20 bp, Artificial Sequence
  chemically synthesized
ttgggctatatgcccagtaa

SEQ ID NO: 484670 - DNA, 20 bp, Artificial Sequence
  chemically synthesized
aatagtgctgaaatgaggat

SEQ ID NO: 484671 - DNA, 20 bp, Artificial Sequence
  chemically synthesized
attgtgaatagtgctgaaat

SEQ ID NO: 484672 - DNA, 20 bp, Artificial Sequence
  chemically synthesized
gacttcatacctttgctatt

SEQ ID NO: 484673 - DNA, 20 bp, Artificial Sequence
  chemically synthesized
aatacggtgcatatacacca

SEQ ID NO: 484674 - DNA, 20 bp, Artificial Sequence
  chemically synthesized
atcatgtcctttgcagcaac

SEQ ID NO: 484675 - DNA, 20 bp, Artificial Sequence
  chemically synthesized
gctggaggccattattctaa

SEQ ID NO: 484676 - DNA, 20 bp, Artificial Sequence
  chemically synthesized
tgtttctgcattaattcact

SEQ ID NO: 484677 - DNA, 20 bp, Artificial Sequence
  chemically synthesized
caatagaaacggaggactac

SEQ ID NO: 484678 - DNA, 20 bp, Artificial Sequence
  chemically synthesized
gagtggggagggagggaaac

SEQ ID NO: 484679 - DNA, 20 bp, Artificial Sequence
  chemically synthesized
tcggttactatgctcagtac

SEQ ID NO: 484680 - DNA, 20 bp, Artificial Sequence
  chemically synthesized
tattacatgatgccgaggtt

SEQ ID NO: 484681 - DNA, 20 bp, Artificial Sequence
  chemically synthesized
taaacctacacatgtactcc

SEQ ID NO: 484682 - DNA, 20 bp, Artificial Sequence
  chemically synthesized
caactttgattttagattca

SEQ ID NO: 484683 - DNA, 20 bp, Artificial Sequence
  chemically synthesized
tctttttttttttttccaca

SEQ ID NO: 484684 - DNA, 20 bp, Artificial Sequence
  chemically synthesized
tcactccagtgccctccagc

SEQ ID NO: 484685 - DNA, 20 bp, Artificial Sequence
  chemically synthesized
tcattctggctggagggcac

SEQ ID NO: 484686 - DNA, 20 bp, Artificial Sequence
  chemically synthesized
tgcatgggaggctgacacag

SEQ ID NO: 484687 - DNA, 20 bp, Artificial Sequence
  chemically synthesized
ctacatatatattttaaaga

SEQ ID NO: 484688 - DNA, 20 bp, Artificial Sequence
  chemically synthesized
actttgggaggccaaggcag

SEQ ID NO: 484689 - DNA, 20 bp, Artificial Sequence
  chemically synthesized
gccttggcctcccaaagtgt

SEQ ID NO: 484690 - DNA, 20 bp, Artificial Sequence
  chemically synthesized
atatgagatggcaaactttg

SEQ ID NO: 484691 - DNA, 20 bp, Artificial Sequence
  chemically synthesized
cacaaagtttgccatctcat

SEQ ID NO: 484692 - DNA, 20 bp, Artificial Sequence
  chemically synthesized
tacatgcgtatctcgtttta

SEQ ID NO: 484693 - DNA, 20 bp, Artificial Sequence
  chemically synthesized
agatacgcatgtacatattt

SEQ ID NO: 484694 - DNA, 20 bp, Artificial Sequence
  chemically synthesized
aattaatactgaaaaaattg

SEQ ID NO: 484695 - DNA, 20 bp, Artificial Sequence
  chemically synthesized
tattaatttcttgttctacc

SEQ ID NO: 484696 - DNA, 20 bp, Artificial Sequence
  chemically synthesized
taccttgaataacatcattt

SEQ ID NO: 484697 - DNA, 20 bp, Artificial Sequence
  chemically synthesized
tcttgataagtggaagttcg

SEQ ID NO: 484698 - DNA, 20 bp, Artificial Sequence
  chemically synthesized
tcgaacttccacttatcaag

SEQ ID NO: 484699 - DNA, 20 bp, Artificial Sequence
  chemically synthesized
attcctctgaatagggacaa

SEQ ID NO: 484700 - DNA, 20 bp, Artificial Sequence
  chemically synthesized
attctcttgtccctattcag

SEQ ID NO: 484701 - DNA, 20 bp, Artificial Sequence
  chemically synthesized
aatttgctgtatagattcct

SEQ ID NO: 484702 - DNA, 20 bp, Artificial Sequence
  chemically synthesized
agaggaatctatacagcaaa

SEQ ID NO: 484703 - DNA, 20 bp, Artificial Sequence
  chemically synthesized
cagaagataaattacaagac

SEQ ID NO: 484704 - DNA, 20 bp, Artificial Sequence
  chemically synthesized
ctttaggatgcaaaattagg

SEQ ID NO: 484705 - DNA, 20 bp, Artificial Sequence
  chemically synthesized
cagtctttggatagtatctt

SEQ ID NO: 484706 - DNA, 20 bp, Artificial Sequence
  chemically synthesized
atctggaatttctacagtct

SEQ ID NO: 484707 - DNA, 20 bp, Artificial Sequence
  chemically synthesized
caactctagcctcttgtatc

SEQ ID NO: 484708 - DNA, 20 bp, Artificial Sequence
  chemically synthesized
aaattccagatacaagaggc

SEQ ID NO: 484709 - DNA, 20 bp, Artificial Sequence
  chemically synthesized
atgcataacacatcacagta

SEQ ID NO: 484710 - DNA, 20 bp, Artificial Sequence
  chemically synthesized
cacagtagggaatgtgcctc

SEQ ID NO: 484711 - DNA, 20 bp, Artificial Sequence
  chemically synthesized
caagttcaattatttcacta

SEQ ID NO: 484712 - DNA, 20 bp, Artificial Sequence
  chemically synthesized
ttacatattgtcttctatta

SEQ ID NO: 484713 - DNA, 20 bp, Artificial Sequence
  chemically synthesized
gaccacatatcctaccctaa

SEQ ID NO: 484714 - DNA, 20 bp, Artificial Sequence
  chemically synthesized
ctctcagaatcccattaggg

SEQ ID NO: 484715 - DNA, 20 bp, Artificial Sequence
  chemically synthesized
cccatctctcagaatcccat

SEQ ID NO: 484716 - DNA, 20 bp, Artificial Sequence
  chemically synthesized
cctaatgggattctgagaga

SEQ ID NO: 484717 - DNA, 20 bp, Artificial Sequence
  chemically synthesized
ccatataaaatcccatctct

SEQ ID NO: 484718 - DNA, 20 bp, Artificial Sequence
  chemically synthesized
gcaacatgaactgtaactta

SEQ ID NO: 484719 - DNA, 20 bp, Artificial Sequence
  chemically synthesized
tcccattaggtcattattaa

SEQ ID NO: 484720 - DNA, 20 bp, Artificial Sequence
  chemically synthesized
aataatgacctaatgggaga

SEQ ID NO: 484721 - DNA, 20 bp, Artificial Sequence
  chemically synthesized
ggagaaggaatttcaggaca

SEQ ID NO: 484722 - DNA, 20 bp, Artificial Sequence
  chemically synthesized
taaaactaaagtgtagaagt

SEQ ID NO: 484723 - DNA, 20 bp, Artificial Sequence
  chemically synthesized
gtgtagaagtcagaatacag

SEQ ID NO: 484724 - DNA, 20 bp, Artificial Sequence
  chemically synthesized
atacagcagagtggttgaga

SEQ ID NO: 484725 - DNA, 20 bp, Artificial Sequence
  chemically synthesized
gcagctgtgtaattagttag

SEQ ID NO: 484726 - DNA, 20 bp, Artificial Sequence
  chemically synthesized
ttgagaagggaagctggggc

SEQ ID NO: 484727 - DNA, 20 bp, Artificial Sequence
  chemically synthesized
catcagaggtttgagagcag

SEQ ID NO: 484728 - DNA, 20 bp, Artificial Sequence
  chemically synthesized
tttctttcttggaagggaca

SEQ ID NO: 484729 - DNA, 20 bp, Artificial Sequence
  chemically synthesized
ggagatacaagaggcttttc

SEQ ID NO: 484730 - DNA, 20 bp, Artificial Sequence
  chemically synthesized
ccttcatgcatctttttaag

SEQ ID NO: 484731 - DNA, 20 bp, Artificial Sequence
  chemically synthesized
tttatgttccttgtgtgcag

SEQ ID NO: 484732 - DNA, 20 bp, Artificial Sequence
  chemically synthesized
agtttttacaagcaatgggg

SEQ ID NO: 484733 - DNA, 20 bp, Artificial Sequence
  chemically synthesized
gggacagtttttacaagcaa

SEQ ID NO: 484734 - DNA, 20 bp, Artificial Sequence
  chemically synthesized
tgcttgtaaaaactgtccca

SEQ ID NO: 484735 - DNA, 20 bp, Artificial Sequence
  chemically synthesized
gtaaaatataatattacaag

SEQ ID NO: 484736 - DNA, 20 bp, Artificial Sequence
  chemically synthesized
aatattatattttactatat

SEQ ID NO: 484737 - DNA, 20 bp, Artificial Sequence
  chemically synthesized
tttactatataggggtaaaa

SEQ ID NO: 484738 - DNA, 20 bp, Artificial Sequence
  chemically synthesized
ttagaaaaaaggtaaacatt

SEQ ID NO: 484739 - DNA, 20 bp, Artificial Sequence
  chemically synthesized
taagaatttaacaaaacatt

SEQ ID NO: 484740 - DNA, 20 bp, Artificial Sequence
  chemically synthesized
atcctttagagtaggaatgt

SEQ ID NO: 484741 - DNA, 20 bp, Artificial Sequence
  chemically synthesized
attcttacattcctactcta

SEQ ID NO: 484742 - DNA, 20 bp, Artificial Sequence
  chemically synthesized
ctctgtttatcctttagagt

SEQ ID NO: 484743 - DNA, 20 bp, Artificial Sequence
  chemically synthesized
gaaagtctctgtttatcctt

SEQ ID NO: 484744 - DNA, 20 bp, Artificial Sequence
  chemically synthesized
aaaggataaacagagacttt

SEQ ID NO: 484745 - DNA, 20 bp, Artificial Sequence
  chemically synthesized
ctctctggaaatacaacttc

SEQ ID NO: 484746 - DNA, 20 bp, Artificial Sequence
  chemically synthesized
atgttatgatgtcacatttt

SEQ ID NO: 484747 - DNA, 20 bp, Artificial Sequence
  chemically synthesized
agtactcctttcctagaaat

SEQ ID NO: 484748 - DNA, 20 bp, Artificial Sequence
  chemically synthesized
agtactcctatttctaggaa

SEQ ID NO: 484749 - DNA, 20 bp, Artificial Sequence
  chemically synthesized
tatttctaggaaaggagtac

SEQ ID NO: 484750 - DNA, 20 bp, Artificial Sequence
  chemically synthesized
gtttttaaaacgtgaaaagg

SEQ ID NO: 484751 - DNA, 20 bp, Artificial Sequence
  chemically synthesized
ggttttgtttcagtacttaa

SEQ ID NO: 484752 - DNA, 20 bp, Artificial Sequence
  chemically synthesized
cccatctacaggtagtatca

SEQ ID NO: 484753 - DNA, 20 bp, Artificial Sequence
  chemically synthesized
atgggaagtgaagtgaagaa

SEQ ID NO: 484754 - DNA, 20 bp, Artificial Sequence
  chemically synthesized
tattctgattaactgtgttc

SEQ ID NO: 484755 - DNA, 20 bp, Artificial Sequence
  chemically synthesized
cactcatgaacacagttaat

SEQ ID NO: 484756 - DNA, 20 bp, Artificial Sequence
  chemically synthesized
gcagaagagggttagggggc

SEQ ID NO: 484757 - DNA, 20 bp, Artificial Sequence
  chemically synthesized
accatgtgaagacagcagaa

SEQ ID NO: 484758 - DNA, 20 bp, Artificial Sequence
  chemically synthesized
tcacatggtagatgtgaaat

SEQ ID NO: 484759 - DNA, 20 bp, Artificial Sequence
  chemically synthesized
tctatccctatatgggaaac

SEQ ID NO: 484760 - DNA, 20 bp, Artificial Sequence
  chemically synthesized
tcaattcatgtttcccatat

SEQ ID NO: 484761 - DNA, 20 bp, Artificial Sequence
  chemically synthesized
tcatgtttcccatataggga

SEQ ID NO: 484762 - DNA, 20 bp, Artificial Sequence
  chemically synthesized
taattatctccactttatag

SEQ ID NO: 484763 - DNA, 20 bp, Artificial Sequence
  chemically synthesized
atcacacaagagtggtttat

SEQ ID NO: 484764 - DNA, 20 bp, Artificial Sequence
  chemically synthesized
attcattgctttaatcacac

SEQ ID NO: 484765 - DNA, 20 bp, Artificial Sequence
  chemically synthesized
actcttgtgtgattaaagca

SEQ ID NO: 484766 - DNA, 20 bp, Artificial Sequence
  chemically synthesized
aaagcaatgaatctatttat

SEQ ID NO: 484767 - DNA, 20 bp, Artificial Sequence
  chemically synthesized
ctaatttctacctaaggtat

SEQ ID NO: 484768 - DNA, 20 bp, Artificial Sequence
  chemically synthesized
caattaagacatatgttata

SEQ ID NO: 484769 - DNA, 20 bp, Artificial Sequence
  chemically synthesized
aatcagaaggctgaaacctc

SEQ ID NO: 484770 - DNA, 20 bp, Artificial Sequence
  chemically synthesized
ccttctgattttgccaaatt

SEQ ID NO: 484771 - DNA, 20 bp, Artificial Sequence
  chemically synthesized
tatcttcactttgtagcact

SEQ ID NO: 484772 - DNA, 20 bp, Artificial Sequence
  chemically synthesized
gctacaaagtgaagatacat

SEQ ID NO: 484773 - DNA, 20 bp, Artificial Sequence
  chemically synthesized
ttaatggcttggaaatcctt

SEQ ID NO: 484774 - DNA, 20 bp, Artificial Sequence
  chemically synthesized
cacttatttgtaaaactcac

SEQ ID NO: 484775 - DNA, 20 bp, Artificial Sequence
  chemically synthesized
tttacaaataagtgtgaaac

SEQ ID NO: 484776 - DNA, 20 bp, Artificial Sequence
  chemically synthesized
tccattcggatgttgtctgt

SEQ ID NO: 484777 - DNA, 20 bp, Artificial Sequence
  chemically synthesized
agcactcacacagacaacat

SEQ ID NO: 484778 - DNA, 20 bp, Artificial Sequence
  chemically synthesized
ttcatacctctcttctccat

SEQ ID NO: 484779 - DNA, 20 bp, Artificial Sequence
  chemically synthesized
tccgaatggagaagagaggt

SEQ ID NO: 484780 - DNA, 20 bp, Artificial Sequence
  chemically synthesized
acaccattttgatgcaaatt

SEQ ID NO: 484781 - DNA, 20 bp, Artificial Sequence
  chemically synthesized
aaaggatgttgtttattttg

SEQ ID NO: 484782 - DNA, 20 bp, Artificial Sequence
  chemically synthesized
aactgctgagaaaatgtaca

SEQ ID NO: 484783 - DNA, 20 bp, Artificial Sequence
  chemically synthesized
agataaaaatctgcccttga

SEQ ID NO: 484784 - DNA, 20 bp, Artificial Sequence
  chemically synthesized
tgaagatcatttcttggtag

SEQ ID NO: 484785 - DNA, 20 bp, Artificial Sequence
  chemically synthesized
atcatttcttggtaggtgag

SEQ ID NO: 484786 - DNA, 20 bp, Artificial Sequence
  chemically synthesized
ggtgagtggaattgctatta

SEQ ID NO: 484787 - DNA, 20 bp, Artificial Sequence
  chemically synthesized
acttgcagtgaagtgttgct

SEQ ID NO: 484788 - DNA, 20 bp, Artificial Sequence
  chemically synthesized
ggtgttttttgacagagaag

SEQ ID NO: 484789 - DNA, 20 bp, Artificial Sequence
  chemically synthesized
ggagaacgtaaaaattacaa

SEQ ID NO: 484790 - DNA, 20 bp, Artificial Sequence
  chemically synthesized
tgtcatactgtaagttccag

SEQ ID NO: 484791 - DNA, 20 bp, Artificial Sequence
  chemically synthesized
gaagggacatattctatggg

SEQ ID NO: 484792 - DNA, 20 bp, Artificial Sequence
  chemically synthesized
tatgtctaaaatcctcccca

SEQ ID NO: 484793 - DNA, 20 bp, Artificial Sequence
  chemically synthesized
ataagaattagtacggccta

SEQ ID NO: 484794 - DNA, 20 bp, Artificial Sequence
  chemically synthesized
tagacccatttttatatgat

SEQ ID NO: 484795 - DNA, 20 bp, Artificial Sequence
  chemically synthesized
ctaattcttatcatataaaa

SEQ ID NO: 484796 - DNA, 20 bp, Artificial Sequence
  chemically synthesized
cacaaatgaagccgattctg

SEQ ID NO: 484797 - DNA, 20 bp, Artificial Sequence
  chemically synthesized
cataaagtttccatattcct

SEQ ID NO: 484798 - DNA, 20 bp, Artificial Sequence
  chemically synthesized
caacattacagaaaccactt

SEQ ID NO: 484799 - DNA, 20 bp, Artificial Sequence
  chemically synthesized
tggtactgcagcctttctgc

SEQ ID NO: 484800 - DNA, 20 bp, Artificial Sequence
  chemically synthesized
tacaaataaaacacagaaaa

SEQ ID NO: 484801 - DNA, 20 bp, Artificial Sequence
  chemically synthesized
ctaaagtctctgaggcaaca

SEQ ID NO: 484802 - DNA, 20 bp, Artificial Sequence
  chemically synthesized
tcataaataaatcaacacta

SEQ ID NO: 484803 - DNA, 20 bp, Artificial Sequence
  chemically synthesized
gggcagagaacattgagata

SEQ ID NO: 484804 - DNA, 20 bp, Artificial Sequence
  chemically synthesized
gttttctgtaagatagtaga

SEQ ID NO: 484805 - DNA, 20 bp, Artificial Sequence
  chemically synthesized
aggctacctagttttgtagt

SEQ ID NO: 484806 - DNA, 20 bp, Artificial Sequence
  chemically synthesized
tcctttgtgaaccaaaagca

SEQ ID NO: 484807 - DNA, 20 bp, Artificial Sequence
  chemically synthesized
tccatgcttttggttcacaa

SEQ ID NO: 484808 - DNA, 20 bp, Artificial Sequence
  chemically synthesized
tcttcagtagcacatgtact

SEQ ID NO: 484809 - DNA, 20 bp, Artificial Sequence
  chemically synthesized
cattttgtgctgccctttgt

SEQ ID NO: 484810 - DNA, 20 bp, Artificial Sequence
  chemically synthesized
tactattaaaatattacagc

SEQ ID NO: 484811 - DNA, 20 bp, Artificial Sequence
  chemically synthesized
taatggggaatattacataa

SEQ ID NO: 484812 - DNA, 20 bp, Artificial Sequence
  chemically synthesized
catttgagtagatagtaatg

SEQ ID NO: 484813 - DNA, 20 bp, Artificial Sequence
  chemically synthesized
gagaaagtgtagcagaacat

SEQ ID NO: 484814 - DNA, 20 bp, Artificial Sequence
  chemically synthesized
gtttgaattgtaaggcagtg

SEQ ID NO: 484815 - DNA, 20 bp, Artificial Sequence
  chemically synthesized
aattgctacgctgtaggagt

SEQ ID NO: 484816 - DNA, 20 bp, Artificial Sequence
  chemically synthesized
tgtagtaattgctacgctgt

SEQ ID NO: 484817 - DNA, 20 bp, Artificial Sequence
  chemically synthesized
agcgtagcaattactacaac

SEQ ID NO: 484818 - DNA, 20 bp, Artificial Sequence
  chemically synthesized
tatgtgctagatattgcaca

SEQ ID NO: 484819 - DNA, 20 bp, Artificial Sequence
  chemically synthesized
tgctagatattgcacatggg

SEQ ID NO: 484820 - DNA, 20 bp, Artificial Sequence
  chemically synthesized
gtgtaagtacagaaccattg

SEQ ID NO: 484821 - DNA, 20 bp, Artificial Sequence
  chemically synthesized
ttcattttccttgtctataa

SEQ ID NO: 484822 - DNA, 20 bp, Artificial Sequence
  chemically synthesized
tagacaaggaaaatgaagca

SEQ ID NO: 484823 - DNA, 20 bp, Artificial Sequence
  chemically synthesized
aagctaaaaggtggtgaagg

SEQ ID NO: 484824 - DNA, 20 bp, Artificial Sequence
  chemically synthesized
agagaaaaacactggaaaag

SEQ ID NO: 484825 - DNA, 20 bp, Artificial Sequence
  chemically synthesized
cagctaggtagagttgttgt

SEQ ID NO: 484826 - DNA, 20 bp, Artificial Sequence
  chemically synthesized
ccaacaacaactctacctag

SEQ ID NO: 484827 - DNA, 20 bp, Artificial Sequence
  chemically synthesized
gaatatagtacccagctagg

SEQ ID NO: 484828 - DNA, 20 bp, Artificial Sequence
  chemically synthesized
atttcctcatgtgtaaaaaa

SEQ ID NO: 484829 - DNA, 20 bp, Artificial Sequence
  chemically synthesized
cccaaagacagccagccagt

SEQ ID NO: 484830 - DNA, 20 bp, Artificial Sequence
  chemically synthesized
gacagccagccagttaggat

SEQ ID NO: 484831 - DNA, 20 bp, Artificial Sequence
  chemically synthesized
tattattatactttaagttt

SEQ ID NO: 484832 - DNA, 20 bp, Artificial Sequence
  chemically synthesized
taatgctagatgacgggtta

SEQ ID NO: 484833 - DNA, 20 bp, Artificial Sequence
  chemically synthesized
gatatacctaatgctagatg

SEQ ID NO: 484834 - DNA, 20 bp, Artificial Sequence
  chemically synthesized
gtggggtggggggagggggg

SEQ ID NO: 484835 - DNA, 20 bp, Artificial Sequence
  chemically synthesized
tcacactctggggactgttg

SEQ ID NO: 484836 - DNA, 20 bp, Artificial Sequence
  chemically synthesized
ccccaccccacaacagtccc

SEQ ID NO: 484837 - DNA, 20 bp, Artificial Sequence
  chemically synthesized
tcattgttcaattcccacct

SEQ ID NO: 484838 - DNA, 20 bp, Artificial Sequence
  chemically synthesized
gcatattctcattcataggt

SEQ ID NO: 484839 - DNA, 20 bp, Artificial Sequence
  chemically synthesized
ttcaattcccacctatgaat

SEQ ID NO: 484840 - DNA, 20 bp, Artificial Sequence
  chemically synthesized
tgttcttgcaatagtttact

SEQ ID NO: 484841 - DNA, 20 bp, Artificial Sequence
  chemically synthesized
ttcatgtcctttgtagggac

SEQ ID NO: 484842 - DNA, 20 bp, Artificial Sequence
  chemically synthesized
ctatgcagccataaaaaagg

SEQ ID NO: 484843 - DNA, 20 bp, Artificial Sequence
  chemically synthesized
aatactatgcagccataaaa

SEQ ID NO: 484844 - DNA, 20 bp, Artificial Sequence
  chemically synthesized
aatgtggcacatatacacca

SEQ ID NO: 484845 - DNA, 20 bp, Artificial Sequence
  chemically synthesized
aaatgtccaacaatgataga

SEQ ID NO: 484846 - DNA, 20 bp, Artificial Sequence
  chemically synthesized
agtctatcattgttggacat

SEQ ID NO: 484847 - DNA, 20 bp, Artificial Sequence
  chemically synthesized
gcagcatgatttatagtcct

SEQ ID NO: 484848 - DNA, 20 bp, Artificial Sequence
  chemically synthesized
tttgggtatatacccagtaa

SEQ ID NO: 484849 - DNA, 20 bp, Artificial Sequence
  chemically synthesized
ttgacccagccatcccatta

SEQ ID NO: 484850 - DNA, 20 bp, Artificial Sequence
  chemically synthesized
tatacccagtaatgggatgg

SEQ ID NO: 484851 - DNA, 20 bp, Artificial Sequence
  chemically synthesized
tttctagttctagatccctg

SEQ ID NO: 484852 - DNA, 20 bp, Artificial Sequence
  chemically synthesized
agtcagtgtggcgattcctc

SEQ ID NO: 484853 - DNA, 20 bp, Artificial Sequence
  chemically synthesized
tacagtcccaccaacagtgt

SEQ ID NO: 484854 - DNA, 20 bp, Artificial Sequence
  chemically synthesized
aggaaacaacaggtgctgga

SEQ ID NO: 484855 - DNA, 20 bp, Artificial Sequence
  chemically synthesized
agataccatctcacaccagt

SEQ ID NO: 484856 - DNA, 20 bp, Artificial Sequence
  chemically synthesized
ttcatgtccttcgcccactt

SEQ ID NO: 484857 - DNA, 20 bp, Artificial Sequence
  chemically synthesized
gtccttcgcccacttttgga

SEQ ID NO: 484858 - DNA, 20 bp, Artificial Sequence
  chemically synthesized
tttttttcttgtaaatttgt

SEQ ID NO: 484859 - DNA, 20 bp, Artificial Sequence
  chemically synthesized
gttggagttcattgtagatt

SEQ ID NO: 484860 - DNA, 20 bp, Artificial Sequence
  chemically synthesized
tctgacaaagagctaatatc

SEQ ID NO: 484861 - DNA, 20 bp, Artificial Sequence
  chemically synthesized
acagcaaaagaaactaccat

SEQ ID NO: 484862 - DNA, 20 bp, Artificial Sequence
  chemically synthesized
caaaagccaaaattgacaaa

SEQ ID NO: 484863 - DNA, 20 bp, Artificial Sequence
  chemically synthesized
tccttgcccatgcctatgtc

SEQ ID NO: 484864 - DNA, 20 bp, Artificial Sequence
  chemically synthesized
gtaatgcctaggttttcttc

SEQ ID NO: 484865 - DNA, 20 bp, Artificial Sequence
  chemically synthesized
gtttaagtctttaatccatc

SEQ ID NO: 484866 - DNA, 20 bp, Artificial Sequence
  chemically synthesized
tatacaaaaatcaattcaag

SEQ ID NO: 484867 - DNA, 20 bp, Artificial Sequence
  chemically synthesized
ttttgtataaggtgtaagga

SEQ ID NO: 484868 - DNA, 20 bp, Artificial Sequence
  chemically synthesized
ccatatgtagaaagctgaaa

SEQ ID NO: 484869 - DNA, 20 bp, Artificial Sequence
  chemically synthesized
ccagcaccatttattaaata

SEQ ID NO: 484870 - DNA, 20 bp, Artificial Sequence
  chemically synthesized
agaaaaacaagcaatgggga

SEQ ID NO: 484871 - DNA, 20 bp, Artificial Sequence
  chemically synthesized
gtcttgtgccagttttcaaa

SEQ ID NO: 484872 - DNA, 20 bp, Artificial Sequence
  chemically synthesized
tttgaaaactggcacaagac

SEQ ID NO: 484873 - DNA, 20 bp, Artificial Sequence
  chemically synthesized
cttccaacactatgttgaat

SEQ ID NO: 484874 - DNA, 20 bp, Artificial Sequence
  chemically synthesized
ccagaacttccaacactatg

SEQ ID NO: 484875 - DNA, 20 bp, Artificial Sequence
  chemically synthesized
tcaggcaggagaaggaaata

SEQ ID NO: 484876 - DNA, 20 bp, Artificial Sequence
  chemically synthesized
ttgacttcctcttctcctaa

SEQ ID NO: 484877 - DNA, 20 bp, Artificial Sequence
  chemically synthesized
gagattttgggctgagacaa

SEQ ID NO: 484878 - DNA, 20 bp, Artificial Sequence
  chemically synthesized
aagcaacttcagcaaagtct

SEQ ID NO: 484879 - DNA, 20 bp, Artificial Sequence
  chemically synthesized
tttgtctgtcgttggtgtat

SEQ ID NO: 484880 - DNA, 20 bp, Artificial Sequence
  chemically synthesized
gacaaacagagagccaaatc

SEQ ID NO: 484881 - DNA, 20 bp, Artificial Sequence
  chemically synthesized
tctttgaagcaattgtgaat

SEQ ID NO: 484882 - DNA, 20 bp, Artificial Sequence
  chemically synthesized
ttattctctttgaagcaatt

SEQ ID NO: 484883 - DNA, 20 bp, Artificial Sequence
  chemically synthesized
ccattcacaattgcttcaaa

SEQ ID NO: 484884 - DNA, 20 bp, Artificial Sequence
  chemically synthesized
tcaaagagaataaaatacct

SEQ ID NO: 484885 - DNA, 20 bp, Artificial Sequence
  chemically synthesized
tccttcacatcgcttgtaag

SEQ ID NO: 484886 - DNA, 20 bp, Artificial Sequence
  chemically synthesized
tggaagaacattccgtgctc

SEQ ID NO: 484887 - DNA, 20 bp, Artificial Sequence
  chemically synthesized
attcttcctacccatgagca

SEQ ID NO: 484888 - DNA, 20 bp, Artificial Sequence
  chemically synthesized
attccgtgctcatgggtagg

SEQ ID NO: 484889 - DNA, 20 bp, Artificial Sequence
  chemically synthesized
gtagcttgatggggatggca

SEQ ID NO: 484890 - DNA, 20 bp, Artificial Sequence
  chemically synthesized
aaagtcattggtagcttgat

SEQ ID NO: 484891 - DNA, 20 bp, Artificial Sequence
  chemically synthesized
gctaccaatgactttcttca

SEQ ID NO: 484892 - DNA, 20 bp, Artificial Sequence
  chemically synthesized
ccagctttgttcttttggct

SEQ ID NO: 484893 - DNA, 20 bp, Artificial Sequence
  chemically synthesized
cctgacttcaaactatacta

SEQ ID NO: 484894 - DNA, 20 bp, Artificial Sequence
  chemically synthesized
gacttaggagtcagaaagac

SEQ ID NO: 484895 - DNA, 20 bp, Artificial Sequence
  chemically synthesized
atgtggacagggctagactt

SEQ ID NO: 484896 - DNA, 20 bp, Artificial Sequence
  chemically synthesized
ataagtgttagaataggaag

SEQ ID NO: 484897 - DNA, 20 bp, Artificial Sequence
  chemically synthesized
ggaaagtaaggaataagtgt

SEQ ID NO: 484898 - DNA, 20 bp, Artificial Sequence
  chemically synthesized
gtcacagaggcaggaaagta

SEQ ID NO: 484899 - DNA, 20 bp, Artificial Sequence
  chemically synthesized
ggatttggtggcatgagaac

SEQ ID NO: 484900 - DNA, 20 bp, Artificial Sequence
  chemically synthesized
aggactgcaaggaagtgttg

SEQ ID NO: 484901 - DNA, 20 bp, Artificial Sequence
  chemically synthesized
ttgcagtcctgtttctaaaa

SEQ ID NO: 484902 - DNA, 20 bp, Artificial Sequence
  chemically synthesized
tgtttctaaaatagaattca

SEQ ID NO: 484903 - DNA, 20 bp, Artificial Sequence
  chemically synthesized
atcatgatttgtttaaccca

SEQ ID NO: 484904 - DNA, 20 bp, Artificial Sequence
  chemically synthesized
tagaacaaaaggtgacaaat

SEQ ID NO: 484905 - DNA, 20 bp, Artificial Sequence
  chemically synthesized
gtccactccgttttagccat

SEQ ID NO: 484906 - DNA, 20 bp, Artificial Sequence
  chemically synthesized
acaaattcatatggctaaaa

SEQ ID NO: 484907 - DNA, 20 bp, Artificial Sequence
  chemically synthesized
ttaattacaaggaataaaag

SEQ ID NO: 484908 - DNA, 20 bp, Artificial Sequence
  chemically synthesized
tttattttttcttaattaca

SEQ ID NO: 484909 - DNA, 20 bp, Artificial Sequence
  chemically synthesized
aaaattgtaagataataaat

SEQ ID NO: 484910 - DNA, 20 bp, Artificial Sequence
  chemically synthesized
ggaggtccaaagtccaaaaa

SEQ ID NO: 484911 - DNA, 20 bp, Artificial Sequence
  chemically synthesized
cagagcttgcattccctcta

SEQ ID NO: 484912 - DNA, 20 bp, Artificial Sequence
  chemically synthesized
cctcccctacatcccttaga

SEQ ID NO: 484913 - DNA, 20 bp, Artificial Sequence
  chemically synthesized
tccctctaagggatgtaggg

SEQ ID NO: 484914 - DNA, 20 bp, Artificial Sequence
  chemically synthesized
aagctggaaaaggcatggaa

SEQ ID NO: 484915 - DNA, 20 bp, Artificial Sequence
  chemically synthesized
gaaggaggtgatgatacaag

SEQ ID NO: 484916 - DNA, 20 bp, Artificial Sequence
  chemically synthesized
agtgcgcccaatgtaatcac

SEQ ID NO: 484917 - DNA, 20 bp, Artificial Sequence
  chemically synthesized
tgtgattacattgggcgcac

SEQ ID NO: 484918 - DNA, 20 bp, Artificial Sequence
  chemically synthesized
tcttgacacggagagatagc

SEQ ID NO: 484919 - DNA, 20 bp, Artificial Sequence
  chemically synthesized
gtaacatattcacaggttcc

SEQ ID NO: 484920 - DNA, 20 bp, Artificial Sequence
  chemically synthesized
tatcctaatcccaggaacct

SEQ ID NO: 484921 - DNA, 20 bp, Artificial Sequence
  chemically synthesized
tattcacaggttcctgggat

SEQ ID NO: 484922 - DNA, 20 bp, Artificial Sequence
  chemically synthesized
atggacatctttggcggggg

SEQ ID NO: 484923 - DNA, 20 bp, Artificial Sequence
  chemically synthesized
tgacatactgacatacttct

SEQ ID NO: 484924 - DNA, 20 bp, Artificial Sequence
  chemically synthesized
atactgacatacttcttcgg

SEQ ID NO: 484925 - DNA, 20 bp, Artificial Sequence
  chemically synthesized
cggtactatgtgtcatcgac

SEQ ID NO: 484926 - DNA, 20 bp, Artificial Sequence
  chemically synthesized
gaagtgggaaaggtgtattg

SEQ ID NO: 484927 - DNA, 20 bp, Artificial Sequence
  chemically synthesized
ttcaaatggtcttttggtta

SEQ ID NO: 484928 - DNA, 20 bp, Artificial Sequence
  chemically synthesized
ccctgtaaccaaaagaccat

SEQ ID NO: 484929 - DNA, 20 bp, Artificial Sequence
  chemically synthesized
atttgaattgaggtggaaac

SEQ ID NO: 484930 - DNA, 20 bp, Artificial Sequence
  chemically synthesized
gaaacactgtgatttcctca

SEQ ID NO: 484931 - DNA, 20 bp, Artificial Sequence
  chemically synthesized
ttggtgacaagctgctcttc

SEQ ID NO: 484932 - DNA, 20 bp, Artificial Sequence
  chemically synthesized
tgacaagctgctcttcagga

SEQ ID NO: 484933 - DNA, 20 bp, Artificial Sequence
  chemically synthesized
tcttcaggaatgaatcctat

SEQ ID NO: 484934 - DNA, 20 bp, Artificial Sequence
  chemically synthesized
agctttatctgaaattctta

SEQ ID NO: 484935 - DNA, 20 bp, Artificial Sequence
  chemically synthesized
gataaagctcttatcttttg

SEQ ID NO: 484936 - DNA, 20 bp, Artificial Sequence
  chemically synthesized
gtgaaggctgcaggaaaggc

SEQ ID NO: 484937 - DNA, 20 bp, Artificial Sequence
  chemically synthesized
aaggctagggtattgccttc

SEQ ID NO: 484938 - DNA, 20 bp, Artificial Sequence
  chemically synthesized
tgtggaggggaagaactaag

SEQ ID NO: 484939 - DNA, 20 bp, Artificial Sequence
  chemically synthesized
agaaggcttaatgtttatga

SEQ ID NO: 484940 - DNA, 20 bp, Artificial Sequence
  chemically synthesized
gggaagaaggcttaatgttt

SEQ ID NO: 484941 - DNA, 20 bp, Artificial Sequence
  chemically synthesized
ttttaaacttcatctacttt

SEQ ID NO: 484942 - DNA, 20 bp, Artificial Sequence
  chemically synthesized
gtagtagttgttgcagagaa

SEQ ID NO: 484943 - DNA, 20 bp, Artificial Sequence
  chemically synthesized
caaaacaacaggaacacaca

SEQ ID NO: 484944 - DNA, 20 bp, Artificial Sequence
  chemically synthesized
gtgggtggcaaattcagccc

SEQ ID NO: 484945 - DNA, 20 bp, Artificial Sequence
  chemically synthesized
gattcattcacatccctggg

SEQ ID NO: 484946 - DNA, 20 bp, Artificial Sequence
  chemically synthesized
ggcaaattcagcccagggat

SEQ ID NO: 484947 - DNA, 20 bp, Artificial Sequence
  chemically synthesized
aattcagcccagggatgtga

SEQ ID NO: 484948 - DNA, 20 bp, Artificial Sequence
  chemically synthesized
aggctttgtgataatatgct

SEQ ID NO: 484949 - DNA, 20 bp, Artificial Sequence
  chemically synthesized
tgttcattacttttctgttt

SEQ ID NO: 484950 - DNA, 20 bp, Artificial Sequence
  chemically synthesized
gacaattactctgcagttgt

SEQ ID NO: 484951 - DNA, 20 bp, Artificial Sequence
  chemically synthesized
agcatatattcaaacaactg

SEQ ID NO: 484952 - DNA, 20 bp, Artificial Sequence
  chemically synthesized
attttcaggtaaatgacctt

SEQ ID NO: 484953 - DNA, 20 bp, Artificial Sequence
  chemically synthesized
gaccttcagaatggcagtag

SEQ ID NO: 484954 - DNA, 20 bp, Artificial Sequence
  chemically synthesized
gaatagaagaaagaaaaagg

SEQ ID NO: 484955 - DNA, 20 bp, Artificial Sequence
  chemically synthesized
acttcataacttgtatagag

SEQ ID NO: 484956 - DNA, 20 bp, Artificial Sequence
  chemically synthesized
tttaaaatattttcatgttt

SEQ ID NO: 484957 - DNA, 20 bp, Artificial Sequence
  chemically synthesized
tgtcaggagaattagaacat

SEQ ID NO: 484958 - DNA, 20 bp, Artificial Sequence
  chemically synthesized
atatatatggttcatgtcag

SEQ ID NO: 484959 - DNA, 20 bp, Artificial Sequence
  chemically synthesized
tttttctcagaatcatcaga

SEQ ID NO: 484960 - DNA, 20 bp, Artificial Sequence
  chemically synthesized
attcagaatttgatttttct

SEQ ID NO: 484961 - DNA, 20 bp, Artificial Sequence
  chemically synthesized
attctgagaaaaatcaaatt

SEQ ID NO: 484962 - DNA, 20 bp, Artificial Sequence
  chemically synthesized
acatcatcattttaaaaatt

SEQ ID NO: 484963 - DNA, 20 bp, Artificial Sequence
  chemically synthesized
atttatgtacaggaattgtg

SEQ ID NO: 484964 - DNA, 20 bp, Artificial Sequence
  chemically synthesized
tccacacaaaatttatgtac

SEQ ID NO: 484965 - DNA, 20 bp, Artificial Sequence
  chemically synthesized
tgtggaaaggcttgtatcat

SEQ ID NO: 484966 - DNA, 20 bp, Artificial Sequence
  chemically synthesized
aaatgttgctgatgatgaca

SEQ ID NO: 484967 - DNA, 20 bp, Artificial Sequence
  chemically synthesized
gtgggtattgagaaggggaa

SEQ ID NO: 484968 - DNA, 20 bp, Artificial Sequence
  chemically synthesized
ttgtgtttttaaaagctaga

SEQ ID NO: 484969 - DNA, 20 bp, Artificial Sequence
  chemically synthesized
ctcattgtgtttttaaaagc

SEQ ID NO: 484970 - DNA, 20 bp, Artificial Sequence
  chemically synthesized
actgccgagcgtacgtgtgt

SEQ ID NO: 484971 - DNA, 20 bp, Artificial Sequence
  chemically synthesized
aagttacctcactgatttgc

SEQ ID NO: 484972 - DNA, 20 bp, Artificial Sequence
  chemically synthesized
atttaaaataaaattttata

SEQ ID NO: 484973 - DNA, 20 bp, Artificial Sequence
  chemically synthesized
attacaaatatcatctacct

SEQ ID NO: 484974 - DNA, 20 bp, Artificial Sequence
  chemically synthesized
tggagttaccatgaaattag

SEQ ID NO: 484975 - DNA, 20 bp, Artificial Sequence
  chemically synthesized
tataggccagatgtctagaa

SEQ ID NO: 484976 - DNA, 20 bp, Artificial Sequence
  chemically synthesized
ctgcatataggccagatgtc

SEQ ID NO: 484977 - DNA, 20 bp, Artificial Sequence
  chemically synthesized
caaccaggcagcacaaactc

SEQ ID NO: 484978 - DNA, 20 bp, Artificial Sequence
  chemically synthesized
aagcaattacaagcggactc

SEQ ID NO: 484979 - DNA, 20 bp, Artificial Sequence
  chemically synthesized
gagtccgcttgtaattgctt

SEQ ID NO: 484980 - DNA, 20 bp, Artificial Sequence
  chemically synthesized
caacttaccattaattttct

SEQ ID NO: 484981 - DNA, 20 bp, Artificial Sequence
  chemically synthesized
cagttttgctttgcaaataa

SEQ ID NO: 484982 - DNA, 20 bp, Artificial Sequence
  chemically synthesized
gtctctctctctctctttta

SEQ ID NO: 484983 - DNA, 20 bp, Artificial Sequence
  chemically synthesized
gagacactgactctgattta

SEQ ID NO: 484984 - DNA, 20 bp, Artificial Sequence
  chemically synthesized
taagcaagtatcctataaat

SEQ ID NO: 484985 - DNA, 20 bp, Artificial Sequence
  chemically synthesized
acttgcttatctattcctgt

SEQ ID NO: 484986 - DNA, 20 bp, Artificial Sequence
  chemically synthesized
ggcaagcagaaaattctaac

SEQ ID NO: 484987 - DNA, 20 bp, Artificial Sequence
  chemically synthesized
cttcacatagtatcaacaaa

SEQ ID NO: 484988 - DNA, 20 bp, Artificial Sequence
  chemically synthesized
tatttaatagtctgtaattt

SEQ ID NO: 484989 - DNA, 20 bp, Artificial Sequence
  chemically synthesized
ctttttacacagcacaaact

SEQ ID NO: 484990 - DNA, 20 bp, Artificial Sequence
  chemically synthesized
atattgatatctttgttatt

SEQ ID NO: 484991 - DNA, 20 bp, Artificial Sequence
  chemically synthesized
ttgtgaatatctcagttatt

SEQ ID NO: 484992 - DNA, 20 bp, Artificial Sequence
  chemically synthesized
tgtatgggggtaatagggca

SEQ ID NO: 484993 - DNA, 20 bp, Artificial Sequence
  chemically synthesized
tacatctccctggcttgtat

SEQ ID NO: 484994 - DNA, 20 bp, Artificial Sequence
  chemically synthesized
catgagtgaaatgctattat

SEQ ID NO: 484995 - DNA, 20 bp, Artificial Sequence
  chemically synthesized
taatagcatttcactcatga

SEQ ID NO: 484996 - DNA, 20 bp, Artificial Sequence
  chemically synthesized
catttggtgtcaattcaatc

SEQ ID NO: 484997 - DNA, 20 bp, Artificial Sequence
  chemically synthesized
gtaactgagttcctgcacat

SEQ ID NO: 484998 - DNA, 20 bp, Artificial Sequence
  chemically synthesized
tgaattcctgacttaagtaa

SEQ ID NO: 484999 - DNA, 20 bp, Artificial Sequence
  chemically synthesized
ggaactcagttacttaagtc

SEQ ID NO: 485000 - DNA, 20 bp, Artificial Sequence
  chemically synthesized
cttaagtcaggaattcacgt

SEQ ID NO: 485001 - DNA, 20 bp, Artificial Sequence
  chemically synthesized
gtcaggaattcacgtgggga

SEQ ID NO: 485002 - DNA, 20 bp, Artificial Sequence
  chemically synthesized
aattctaactctatccccac

SEQ ID NO: 485003 - DNA, 20 bp, Artificial Sequence
  chemically synthesized
aattcacgtggggatagagt

SEQ ID NO: 485004 - DNA, 20 bp, Artificial Sequence
  chemically synthesized
aatcagaaaggccagtctcc

SEQ ID NO: 485005 - DNA, 20 bp, Artificial Sequence
  chemically synthesized
agaaaggccagtctcctggg

SEQ ID NO: 485006 - DNA, 20 bp, Artificial Sequence
  chemically synthesized
aggccttgctaatgagcaaa

SEQ ID NO: 485007 - DNA, 20 bp, Artificial Sequence
  chemically synthesized
gagcaaaatgaatattagaa

SEQ ID NO: 485008 - DNA, 20 bp, Artificial Sequence
  chemically synthesized
tacctagcaagctagagatg

SEQ ID NO: 485009 - DNA, 20 bp, Artificial Sequence
  chemically synthesized
gttatggaacctgtattctt

SEQ ID NO: 485010 - DNA, 20 bp, Artificial Sequence
  chemically synthesized
aaatcttgggcaccattcca

SEQ ID NO: 485011 - DNA, 20 bp, Artificial Sequence
  chemically synthesized
aactatgctttgtttccaca

SEQ ID NO: 485012 - DNA, 20 bp, Artificial Sequence
  chemically synthesized
gcatcagacaactagaatct

SEQ ID NO: 485013 - DNA, 20 bp, Artificial Sequence
  chemically synthesized
tagagaaggcatcagacaac

SEQ ID NO: 485014 - DNA, 20 bp, Artificial Sequence
  chemically synthesized
aatattccagaatctagagg

SEQ ID NO: 485015 - DNA, 20 bp, Artificial Sequence
  chemically synthesized
tgcatcctgcctctagattc

SEQ ID NO: 485016 - DNA, 20 bp, Artificial Sequence
  chemically synthesized
agggagacatgagaatattc

SEQ ID NO: 485017 - DNA, 20 bp, Artificial Sequence
  chemically synthesized
ggttcaatcaagggagacat

SEQ ID NO: 485018 - DNA, 20 bp, Artificial Sequence
  chemically synthesized
ccttgattgaaccttttata

SEQ ID NO: 485019 - DNA, 20 bp, Artificial Sequence
  chemically synthesized
tacggagtatgacaacacct

SEQ ID NO: 485020 - DNA, 20 bp, Artificial Sequence
  chemically synthesized
gtatgacaacacctgagagt

SEQ ID NO: 485021 - DNA, 20 bp, Artificial Sequence
  chemically synthesized
acacctgagagtgagggtat

SEQ ID NO: 485022 - DNA, 20 bp, Artificial Sequence
  chemically synthesized
tttgtggcttacgtggtgtt

SEQ ID NO: 485023 - DNA, 20 bp, Artificial Sequence
  chemically synthesized
caaatgtattgttgaatgta

SEQ ID NO: 485024 - DNA, 20 bp, Artificial Sequence
  chemically synthesized
gaataaagtcaaatgtattg

SEQ ID NO: 485025 - DNA, 20 bp, Artificial Sequence
  chemically synthesized
aatacatttgactttattct

SEQ ID NO: 485026 - DNA, 20 bp, Artificial Sequence
  chemically synthesized
aaaatgtaataatatactcc

SEQ ID NO: 485027 - DNA, 20 bp, Artificial Sequence
  chemically synthesized
ttgcatactattactatcat

SEQ ID NO: 485028 - DNA, 20 bp, Artificial Sequence
  chemically synthesized
gactgtgaaaaaataattat

SEQ ID NO: 485029 - DNA, 20 bp, Artificial Sequence
  chemically synthesized
ggtatttacataatcgtctt

SEQ ID NO: 485030 - DNA, 20 bp, Artificial Sequence
  chemically synthesized
cagagagagagcgagagatt

SEQ ID NO: 485031 - DNA, 20 bp, Artificial Sequence
  chemically synthesized
agtaagcccgatcattattg

SEQ ID NO: 485032 - DNA, 20 bp, Artificial Sequence
  chemically synthesized
tttatggagatgcaaaaacc

SEQ ID NO: 485033 - DNA, 20 bp, Artificial Sequence
  chemically synthesized
gcagctcagatgagccccca

SEQ ID NO: 485034 - DNA, 20 bp, Artificial Sequence
  chemically synthesized
aagataaaaatgtcagagag

SEQ ID NO: 485035 - DNA, 20 bp, Artificial Sequence
  chemically synthesized
gggaagaaataatagagaat

SEQ ID NO: 485036 - DNA, 20 bp, Artificial Sequence
  chemically synthesized
tacccagggaagaaataata

SEQ ID NO: 485037 - DNA, 20 bp, Artificial Sequence
  chemically synthesized
tattctctattatttcttcc

SEQ ID NO: 485038 - DNA, 20 bp, Artificial Sequence
  chemically synthesized
tccctgggtatctattttca

SEQ ID NO: 485039 - DNA, 20 bp, Artificial Sequence
  chemically synthesized
acattaaaataggctttatt

SEQ ID NO: 485040 - DNA, 20 bp, Artificial Sequence
  chemically synthesized
taaaaacagtggagattgaa

SEQ ID NO: 485041 - DNA, 20 bp, Artificial Sequence
  chemically synthesized
gtgtgtgtgtgtacacatac

SEQ ID NO: 485042 - DNA, 20 bp, Artificial Sequence
  chemically synthesized
tgttgccaataaacctgtga

SEQ ID NO: 485043 - DNA, 20 bp, Artificial Sequence
  chemically synthesized
gggcaagtcacttaacctct

SEQ ID NO: 485044 - DNA, 20 bp, Artificial Sequence
  chemically synthesized
ttagcttgtaccacttttga

SEQ ID NO: 485045 - DNA, 20 bp, Artificial Sequence
  chemically synthesized
ttttgagaggattagaaata

SEQ ID NO: 485046 - DNA, 20 bp, Artificial Sequence
  chemically synthesized
attaatgcatggtaagcatc

SEQ ID NO: 485047 - DNA, 20 bp, Artificial Sequence
  chemically synthesized
attaaatagtagaaataatt

SEQ ID NO: 485048 - DNA, 20 bp, Artificial Sequence
  chemically synthesized
ctatttaatattttaatggg

SEQ ID NO: 485049 - DNA, 20 bp, Artificial Sequence
  chemically synthesized
taatattttaatgggaagag

SEQ ID NO: 485050 - DNA, 20 bp, Artificial Sequence
  chemically synthesized
taaacctaaatgtgcagcat

SEQ ID NO: 485051 - DNA, 20 bp, Artificial Sequence
  chemically synthesized
ctttaagtgatcactatgaa

SEQ ID NO: 485052 - DNA, 20 bp, Artificial Sequence
  chemically synthesized
tattttatatacacataggg

SEQ ID NO: 485053 - DNA, 20 bp, Artificial Sequence
  chemically synthesized
cacacaccacatatatatct

SEQ ID NO: 485054 - DNA, 20 bp, Artificial Sequence
  chemically synthesized
taaaagtaatatatgtgtgt

SEQ ID NO: 485055 - DNA, 20 bp, Artificial Sequence
  chemically synthesized
atagattgtggtgtgtaaat

SEQ ID NO: 485056 - DNA, 20 bp, Artificial Sequence
  chemically synthesized
ttaaattgcccaaaatttag

SEQ ID NO: 485057 - DNA, 20 bp, Artificial Sequence
  chemically synthesized
taagtccttcatttccaaag

SEQ ID NO: 485058 - DNA, 20 bp, Artificial Sequence
  chemically synthesized
gacttagttccccagctgct

SEQ ID NO: 485059 - DNA, 20 bp, Artificial Sequence
  chemically synthesized
ctatagctaaataccttaga

SEQ ID NO: 485060 - DNA, 20 bp, Artificial Sequence
  chemically synthesized
actgggtaatttataaacaa

SEQ ID NO: 485061 - DNA, 20 bp, Artificial Sequence
  chemically synthesized
tgcttatagttctggaggct

SEQ ID NO: 485062 - DNA, 20 bp, Artificial Sequence
  chemically synthesized
atctgctgatgtcttgatct

SEQ ID NO: 485063 - DNA, 20 bp, Artificial Sequence
  chemically synthesized
gagtgggccctcaccagaca

SEQ ID NO: 485064 - DNA, 20 bp, Artificial Sequence
  chemically synthesized
caccgaagatgccatttaac

SEQ ID NO: 485065 - DNA, 20 bp, Artificial Sequence
  chemically synthesized
gcgggctctgccttcagaaa

SEQ ID NO: 485066 - DNA, 20 bp, Artificial Sequence
  chemically synthesized
attagaaggtgggggtttgg

SEQ ID NO: 485067 - DNA, 20 bp, Artificial Sequence
  chemically synthesized
aggtgatggtattagaaggt

SEQ ID NO: 485068 - DNA, 20 bp, Artificial Sequence
  chemically synthesized
caccttctaataccatcacc

SEQ ID NO: 485069 - DNA, 20 bp, Artificial Sequence
  chemically synthesized
cataagggggctgctatggt

SEQ ID NO: 485070 - DNA, 20 bp, Artificial Sequence
  chemically synthesized
agatgattctctttagccac

SEQ ID NO: 485071 - DNA, 20 bp, Artificial Sequence
  chemically synthesized
tggaaattcccgtggctaaa

SEQ ID NO: 485072 - DNA, 20 bp, Artificial Sequence
  chemically synthesized
gctaaagttcgttgccttcc

SEQ ID NO: 485073 - DNA, 20 bp, Artificial Sequence
  chemically synthesized
accccgtgtcaagtcatgca

SEQ ID NO: 485074 - DNA, 20 bp, Artificial Sequence
  chemically synthesized
atccagtgcatgacttgaca

SEQ ID NO: 485075 - DNA, 20 bp, Artificial Sequence
  chemically synthesized
taggaaacgaagaaagggga

SEQ ID NO: 485076 - DNA, 20 bp, Artificial Sequence
  chemically synthesized
ttcgtttcctagcacttctg

SEQ ID NO: 485077 - DNA, 20 bp, Artificial Sequence
  chemically synthesized
cgttcagggagttcttaagc

SEQ ID NO: 485078 - DNA, 20 bp, Artificial Sequence
  chemically synthesized
gggcctcagctgaccgttca

SEQ ID NO: 485079 - DNA, 20 bp, Artificial Sequence
  chemically synthesized
tgtctatttaggagtgttct

SEQ ID NO: 485080 - DNA, 20 bp, Artificial Sequence
  chemically synthesized
agcatgcagtatgtctattt

SEQ ID NO: 485081 - DNA, 20 bp, Artificial Sequence
  chemically synthesized
ctgcatgctcacctcaatct

SEQ ID NO: 485082 - DNA, 20 bp, Artificial Sequence
  chemically synthesized
cttaaagataatatcatagt

SEQ ID NO: 485083 - DNA, 20 bp, Artificial Sequence
  chemically synthesized
agaaatcagtcccaaatgcc

SEQ ID NO: 485084 - DNA, 20 bp, Artificial Sequence
  chemically synthesized
aggcatttgggactgatttc

SEQ ID NO: 485085 - DNA, 20 bp, Artificial Sequence
  chemically synthesized
aagttttgacctacactttg

SEQ ID NO: 485086 - DNA, 20 bp, Artificial Sequence
  chemically synthesized
tgctcctttatcaagtactt

SEQ ID NO: 485087 - DNA, 20 bp, Artificial Sequence
  chemically synthesized
agtacttgggaattaaggta

SEQ ID NO: 485088 - DNA, 20 bp, Artificial Sequence
  chemically synthesized
ttaaggtaaagaatatttgg

SEQ ID NO: 485089 - DNA, 20 bp, Artificial Sequence
  chemically synthesized
aatatttggaagaattaaag

SEQ ID NO: 485090 - DNA, 20 bp, Artificial Sequence
  chemically synthesized
agacttcctgcatatctctc

SEQ ID NO: 485091 - DNA, 20 bp, Artificial Sequence
  chemically synthesized
gttgagaggtgttcagacga

SEQ ID NO: 485092 - DNA, 20 bp, Artificial Sequence
  chemically synthesized
ttggattgaaagggaagtct

SEQ ID NO: 485093 - DNA, 20 bp, Artificial Sequence
  chemically synthesized
aatagattcaaatttttcag

SEQ ID NO: 485094 - DNA, 20 bp, Artificial Sequence
  chemically synthesized
tttcaatccaactgaaaaat

SEQ ID NO: 485095 - DNA, 20 bp, Artificial Sequence
  chemically synthesized
taaagctttcaaatttgaga

SEQ ID NO: 485096 - DNA, 20 bp, Artificial Sequence
  chemically synthesized
agtgtctatcatttttcacc

SEQ ID NO: 485097 - DNA, 20 bp, Artificial Sequence
  chemically synthesized
cagtcatccttaaaacaaat

SEQ ID NO: 485098 - DNA, 20 bp, Artificial Sequence
  chemically synthesized
ctaaaattcatatttgtttt

SEQ ID NO: 485099 - DNA, 20 bp, Artificial Sequence
  chemically synthesized
aggttggcataaccatcaaa

SEQ ID NO: 485100 - DNA, 20 bp, Artificial Sequence
  chemically synthesized
ccatcaaagggaatttctta

SEQ ID NO: 485101 - DNA, 20 bp, Artificial Sequence
  chemically synthesized
atatagaacaaattcaacta

SEQ ID NO: 485102 - DNA, 20 bp, Artificial Sequence
  chemically synthesized
aataaatctctactctgtag

SEQ ID NO: 485103 - DNA, 20 bp, Artificial Sequence
  chemically synthesized
ctatgtcatattttcgttat

SEQ ID NO: 485104 - DNA, 20 bp, Artificial Sequence
  chemically synthesized
ctgataacgaaaatatgaca

SEQ ID NO: 485105 - DNA, 20 bp, Artificial Sequence
  chemically synthesized
agtttgttcaactgtaaaac

SEQ ID NO: 485106 - DNA, 20 bp, Artificial Sequence
  chemically synthesized
tacagttgaacaaactgtaa

SEQ ID NO: 485107 - DNA, 20 bp, Artificial Sequence
  chemically synthesized
ttgacaacctgcacaaattt

SEQ ID NO: 485108 - DNA, 20 bp, Artificial Sequence
  chemically synthesized
tagagaagctttaagactat

SEQ ID NO: 485109 - DNA, 20 bp, Artificial Sequence
  chemically synthesized
agcttctctatatttcagga

SEQ ID NO: 485110 - DNA, 20 bp, Artificial Sequence
  chemically synthesized
ttcaggagggggtgaagtaa

SEQ ID NO: 485111 - DNA, 20 bp, Artificial Sequence
  chemically synthesized
ccttttattcatgacaagaa

SEQ ID NO: 485112 - DNA, 20 bp, Artificial Sequence
  chemically synthesized
catgatacccaattcttgtc

SEQ ID NO: 485113 - DNA, 20 bp, Artificial Sequence
  chemically synthesized
catcaccttttattcatgac

SEQ ID NO: 485114 - DNA, 20 bp, Artificial Sequence
  chemically synthesized
taattgacaaaaaaaaaaaa

SEQ ID NO: 485115 - DNA, 20 bp, Artificial Sequence
  chemically synthesized
aaaaaaaaggataagaaaaa

SEQ ID NO: 485116 - DNA, 20 bp, Artificial Sequence
  chemically synthesized
ttttataaatatgtaaaagc

SEQ ID NO: 485117 - DNA, 20 bp, Artificial Sequence
  chemically synthesized
tacacatccagagaaataga

SEQ ID NO: 485118 - DNA, 20 bp, Artificial Sequence
  chemically synthesized
ataaaatccattctatttct

SEQ ID NO: 485119 - DNA, 20 bp, Artificial Sequence
  chemically synthesized
tcattacacatccagagaaa

SEQ ID NO: 485120 - DNA, 20 bp, Artificial Sequence
  chemically synthesized
tggatgtgtaatgaaagaaa

SEQ ID NO: 485121 - DNA, 20 bp, Artificial Sequence
  chemically synthesized
catctcttttgttatttcaa

SEQ ID NO: 485122 - DNA, 20 bp, Artificial Sequence
  chemically synthesized
ataacaaaagagatggcatt

SEQ ID NO: 485123 - DNA, 20 bp, Artificial Sequence
  chemically synthesized
ctggaaagagaatgtggact

SEQ ID NO: 485124 - DNA, 20 bp, Artificial Sequence
  chemically synthesized
taaaacttaaaatctggaaa

SEQ ID NO: 485125 - DNA, 20 bp, Artificial Sequence
  chemically synthesized
ttacttacgtaacactatca

SEQ ID NO: 485126 - DNA, 20 bp, Artificial Sequence
  chemically synthesized
actatcaacgaataggacaa

SEQ ID NO: 485127 - DNA, 20 bp, Artificial Sequence
  chemically synthesized
caatagaatacaaacaaaaa

SEQ ID NO: 485128 - DNA, 20 bp, Artificial Sequence
  chemically synthesized
tactcaaactgtcttctaaa

SEQ ID NO: 485129 - DNA, 20 bp, Artificial Sequence
  chemically synthesized
aatcctttttagaagacagt

SEQ ID NO: 485130 - DNA, 20 bp, Artificial Sequence
  chemically synthesized
aaatctgcatgagagcttta

SEQ ID NO: 485131 - DNA, 20 bp, Artificial Sequence
  chemically synthesized
tacatatagtaatttatatt

SEQ ID NO: 485132 - DNA, 20 bp, Artificial Sequence
  chemically synthesized
ttataaataaaatgatttcg

SEQ ID NO: 485133 - DNA, 20 bp, Artificial Sequence
  chemically synthesized
tagagcaactgtctgaggga

SEQ ID NO: 485134 - DNA, 20 bp, Artificial Sequence
  chemically synthesized
tcagacagttgctctagaga

SEQ ID NO: 485135 - DNA, 20 bp, Artificial Sequence
  chemically synthesized
tctcaccatgatgtacctac

SEQ ID NO: 485136 - DNA, 20 bp, Artificial Sequence
  chemically synthesized
ataatttgtgaagttgttac

SEQ ID NO: 485137 - DNA, 20 bp, Artificial Sequence
  chemically synthesized
agttggatgtgtatgtccct

SEQ ID NO: 485138 - DNA, 20 bp, Artificial Sequence
  chemically synthesized
ctgagagaacattatcttag

SEQ ID NO: 485139 - DNA, 20 bp, Artificial Sequence
  chemically synthesized
aggtcactgaaaagtctttt

SEQ ID NO: 485140 - DNA, 20 bp, Artificial Sequence
  chemically synthesized
agatgtacatcatagattgc

SEQ ID NO: 485141 - DNA, 20 bp, Artificial Sequence
  chemically synthesized
agcttatttgaccttttcat

SEQ ID NO: 485142 - DNA, 20 bp, Artificial Sequence
  chemically synthesized
catttaatgaacacagcttg

SEQ ID NO: 485143 - DNA, 20 bp, Artificial Sequence
  chemically synthesized
cagtacagcatgtgactgta

SEQ ID NO: 485144 - DNA, 20 bp, Artificial Sequence
  chemically synthesized
catacaacctagatgtatag

SEQ ID NO: 485145 - DNA, 20 bp, Artificial Sequence
  chemically synthesized
tcagctaaccatgcatttct

SEQ ID NO: 485146 - DNA, 20 bp, Artificial Sequence
  chemically synthesized
gattctggacatgatttcac

SEQ ID NO: 485147 - DNA, 20 bp, Artificial Sequence
  chemically synthesized
tacccctgtgaaatcatgtc

SEQ ID NO: 485148 - DNA, 20 bp, Artificial Sequence
  chemically synthesized
tatatttaaaactttgctaa

SEQ ID NO: 485149 - DNA, 20 bp, Artificial Sequence
  chemically synthesized
ctaggtttcagtcatatgag

SEQ ID NO: 485150 - DNA, 20 bp, Artificial Sequence
  chemically synthesized
ttttttttttttttttgaga

SEQ ID NO: 485151 - DNA, 20 bp, Artificial Sequence
  chemically synthesized
tcttgctctgtcgcccaggc

SEQ ID NO: 485152 - DNA, 20 bp, Artificial Sequence
  chemically synthesized
ggctggagtgcagtagcctc

SEQ ID NO: 485153 - DNA, 20 bp, Artificial Sequence
  chemically synthesized
aaaattagccaggcgtggtg

SEQ ID NO: 485154 - DNA, 20 bp, Artificial Sequence
  chemically synthesized
cgtggtttcaccgtgttagc

SEQ ID NO: 485155 - DNA, 20 bp, Artificial Sequence
  chemically synthesized
actttgggaggatgaggcgg

SEQ ID NO: 485156 - DNA, 20 bp, Artificial Sequence
  chemically synthesized
ctgtaatcccagcactttgg

SEQ ID NO: 485157 - DNA, 20 bp, Artificial Sequence
  chemically synthesized
gcctcatcctcccaaagtgc

SEQ ID NO: 485158 - DNA, 20 bp, Artificial Sequence
  chemically synthesized
tgccgttaaaatggaaaata

SEQ ID NO: 485159 - DNA, 20 bp, Artificial Sequence
  chemically synthesized
cagctgagattatgagagac

SEQ ID NO: 485160 - DNA, 20 bp, Artificial Sequence
  chemically synthesized
ccttctatggttgttctaat

SEQ ID NO: 485161 - DNA, 20 bp, Artificial Sequence
  chemically synthesized
atatctacaagtttgggcca

SEQ ID NO: 485162 - DNA, 20 bp, Artificial Sequence
  chemically synthesized
ggccatggggtggtgctgct

SEQ ID NO: 485163 - DNA, 20 bp, Artificial Sequence
  chemically synthesized
ggtgctgctatgaatagact

SEQ ID NO: 485164 - DNA, 20 bp, Artificial Sequence
  chemically synthesized
acgaatggccatgtaaatat

SEQ ID NO: 485165 - DNA, 20 bp, Artificial Sequence
  chemically synthesized
aacaagtaatatagtctgtt

SEQ ID NO: 485166 - DNA, 20 bp, Artificial Sequence
  chemically synthesized
tatactttctcttgaactca

SEQ ID NO: 485167 - DNA, 20 bp, Artificial Sequence
  chemically synthesized
ttaagacccaaataaaccca

SEQ ID NO: 485168 - DNA, 20 bp, Artificial Sequence
  chemically synthesized
cttgaactcagtgggtttat

SEQ ID NO: 485169 - DNA, 20 bp, Artificial Sequence
  chemically synthesized
ttatttgggtcttaataatt

SEQ ID NO: 485170 - DNA, 20 bp, Artificial Sequence
  chemically synthesized
aggtcatcagtttttatatt

SEQ ID NO: 485171 - DNA, 20 bp, Artificial Sequence
  chemically synthesized
ttgatgctaacggacatgtt

SEQ ID NO: 485172 - DNA, 20 bp, Artificial Sequence
  chemically synthesized
tcatgtctatctttctgcct

SEQ ID NO: 485173 - DNA, 20 bp, Artificial Sequence
  chemically synthesized
tcagaggcagaaagatagac

SEQ ID NO: 485174 - DNA, 20 bp, Artificial Sequence
  chemically synthesized
agaaagatagacatgaataa

SEQ ID NO: 485175 - DNA, 20 bp, Artificial Sequence
  chemically synthesized
gaagaaaaatgtgcattatt

SEQ ID NO: 485176 - DNA, 20 bp, Artificial Sequence
  chemically synthesized
taagaaggaaagaaagggta

SEQ ID NO: 485177 - DNA, 20 bp, Artificial Sequence
  chemically synthesized
ttttagctaagaaggaaaga

SEQ ID NO: 485178 - DNA, 20 bp, Artificial Sequence
  chemically synthesized
cttgctagtctgaacagaat

SEQ ID NO: 485179 - DNA, 20 bp, Artificial Sequence
  chemically synthesized
taaaaccttgctagtctgaa

SEQ ID NO: 485180 - DNA, 20 bp, Artificial Sequence
  chemically synthesized
aagttaccaattttcacatt

SEQ ID NO: 485181 - DNA, 20 bp, Artificial Sequence
  chemically synthesized
gggaggattgagtgttttaa

SEQ ID NO: 485182 - DNA, 20 bp, Artificial Sequence
  chemically synthesized
ttctaaggatcttgggagga

SEQ ID NO: 485183 - DNA, 20 bp, Artificial Sequence
  chemically synthesized
ctaacttctaaggatcttgg

SEQ ID NO: 485184 - DNA, 20 bp, Artificial Sequence
  chemically synthesized
tcccaagatccttagaagtt

SEQ ID NO: 485185 - DNA, 20 bp, Artificial Sequence
  chemically synthesized
cgtgaccattcctaacttct

SEQ ID NO: 485186 - DNA, 20 bp, Artificial Sequence
  chemically synthesized
tttctggcagccccacacag

SEQ ID NO: 485187 - DNA, 20 bp, Artificial Sequence
  chemically synthesized
caaacaggagctgacacagc

SEQ ID NO: 485188 - DNA, 20 bp, Artificial Sequence
  chemically synthesized
acagacatagtgcctggagg

SEQ ID NO: 485189 - DNA, 20 bp, Artificial Sequence
  chemically synthesized
gcctcagcctcccaaagtgg

SEQ ID NO: 485190 - DNA, 20 bp, Artificial Sequence
  chemically synthesized
cggggtttcaccatgttggc

SEQ ID NO: 485191 - DNA, 20 bp, Artificial Sequence
  chemically synthesized
ttttgtatttttagtagaga

SEQ ID NO: 485192 - DNA, 20 bp, Artificial Sequence
  chemically synthesized
gcctcagcctcctgagtagc

SEQ ID NO: 485193 - DNA, 20 bp, Artificial Sequence
  chemically synthesized
gattctcctgcctcagcctc

SEQ ID NO: 485194 - DNA, 20 bp, Artificial Sequence
  chemically synthesized
tactcaggaggctgaggcag

SEQ ID NO: 485195 - DNA, 20 bp, Artificial Sequence
  chemically synthesized
caggagaatcccttgaacca

SEQ ID NO: 485196 - DNA, 20 bp, Artificial Sequence
  chemically synthesized
acctctgactccctggttca

SEQ ID NO: 485197 - DNA, 20 bp, Artificial Sequence
  chemically synthesized
ccagggagtcagaggttgca

SEQ ID NO: 485198 - DNA, 20 bp, Artificial Sequence
  chemically synthesized
tggagtctctgtcgccaggc

SEQ ID NO: 485199 - DNA, 20 bp, Artificial Sequence
  chemically synthesized
tttttgtttttgttttgaga

SEQ ID NO: 485200 - DNA, 20 bp, Artificial Sequence
  chemically synthesized
agtctcatgttggagatgac

SEQ ID NO: 485201 - DNA, 20 bp, Artificial Sequence
  chemically synthesized
acttccagaattatgtgttc

SEQ ID NO: 485202 - DNA, 20 bp, Artificial Sequence
  chemically synthesized
ttctcatagagcaagacttc

SEQ ID NO: 485203 - DNA, 20 bp, Artificial Sequence
  chemically synthesized
ctatgagaaaaagaaactat

SEQ ID NO: 485204 - DNA, 20 bp, Artificial Sequence
  chemically synthesized
tctggataagccactgtagt

SEQ ID NO: 485205 - DNA, 20 bp, Artificial Sequence
  chemically synthesized
atagctaaacacaatcttaa

SEQ ID NO: 485206 - DNA, 20 bp, Artificial Sequence
  chemically synthesized
tctaagaattttagaaatta

SEQ ID NO: 485207 - DNA, 20 bp, Artificial Sequence
  chemically synthesized
cctttaatttctaaaattct

SEQ ID NO: 485208 - DNA, 20 bp, Artificial Sequence
  chemically synthesized
atcataattttagacactct

SEQ ID NO: 485209 - DNA, 20 bp, Artificial Sequence
  chemically synthesized
atgatgaatgaaagtctcct

SEQ ID NO: 485210 - DNA, 20 bp, Artificial Sequence
  chemically synthesized
atgtcttgttttggtcaatg

SEQ ID NO: 485211 - DNA, 20 bp, Artificial Sequence
  chemically synthesized
atcattgaccaaaacaagac

SEQ ID NO: 485212 - DNA, 20 bp, Artificial Sequence
  chemically synthesized
cagttaagataaacatatat

SEQ ID NO: 485213 - DNA, 20 bp, Artificial Sequence
  chemically synthesized
tactagttttacttagtatt

SEQ ID NO: 485214 - DNA, 20 bp, Artificial Sequence
  chemically synthesized
tctttagcggctatgtcaaa

SEQ ID NO: 485215 - DNA, 20 bp, Artificial Sequence
  chemically synthesized
aaggacaaaatgattttgga

SEQ ID NO: 485216 - DNA, 20 bp, Artificial Sequence
  chemically synthesized
gccttggcctcccaaagtgc

SEQ ID NO: 485217 - DNA, 20 bp, Artificial Sequence
  chemically synthesized
actttgggaggccaaggcag

SEQ ID NO: 485218 - DNA, 20 bp, Artificial Sequence
  chemically synthesized
ttttttatttttagtagaga

SEQ ID NO: 485219 - DNA, 20 bp, Artificial Sequence
  chemically synthesized
ctaaaaataaaaaaaattag

SEQ ID NO: 485220 - DNA, 20 bp, Artificial Sequence
  chemically synthesized
aaaattagccgggtgtggtg

SEQ ID NO: 485221 - DNA, 20 bp, Artificial Sequence
  chemically synthesized
gcttcagcctcctgagtagc

SEQ ID NO: 485222 - DNA, 20 bp, Artificial Sequence
  chemically synthesized
gattctcctgcttcagcctc

SEQ ID NO: 485223 - DNA, 20 bp, Artificial Sequence
  chemically synthesized
tactcaggaggctgaagcag

SEQ ID NO: 485224 - DNA, 20 bp, Artificial Sequence
  chemically synthesized
tctcgcactgttgcccgggc

SEQ ID NO: 485225 - DNA, 20 bp, Artificial Sequence
  chemically synthesized
tttgttttgtttttttgaga

SEQ ID NO: 485226 - DNA, 20 bp, Artificial Sequence
  chemically synthesized
caaaaacgaccagtacatac

SEQ ID NO: 485227 - DNA, 20 bp, Artificial Sequence
  chemically synthesized
acaacctttacagaaaaggc

SEQ ID NO: 485228 - DNA, 20 bp, Artificial Sequence
  chemically synthesized
cattatattaatcaacttta

SEQ ID NO: 485229 - DNA, 20 bp, Artificial Sequence
  chemically synthesized
gtcattggtatggttaataa

SEQ ID NO: 485230 - DNA, 20 bp, Artificial Sequence
  chemically synthesized
atttggtcagaactcacacc

SEQ ID NO: 485231 - DNA, 20 bp, Artificial Sequence
  chemically synthesized
accatgcaaacattcaaggt

SEQ ID NO: 485232 - DNA, 20 bp, Artificial Sequence
  chemically synthesized
aataataaataaataaaaat

SEQ ID NO: 485233 - DNA, 20 bp, Artificial Sequence
  chemically synthesized
acaaaactccatttctaaaa

SEQ ID NO: 485234 - DNA, 20 bp, Artificial Sequence
  chemically synthesized
attttattcttttttagaaa

SEQ ID NO: 485235 - DNA, 20 bp, Artificial Sequence
  chemically synthesized
ttttgttccattgcccaggt

SEQ ID NO: 485236 - DNA, 20 bp, Artificial Sequence
  chemically synthesized
agtgagctatgatagcgcca

SEQ ID NO: 485237 - DNA, 20 bp, Artificial Sequence
  chemically synthesized
tgacatgatctcttgggccc

SEQ ID NO: 485238 - DNA, 20 bp, Artificial Sequence
  chemically synthesized
gatcatgtcacctcagcctc

SEQ ID NO: 485239 - DNA, 20 bp, Artificial Sequence
  chemically synthesized
ttcaagagcaacctgggcaa

SEQ ID NO: 485240 - DNA, 20 bp, Artificial Sequence
  chemically synthesized
ctcttgaacttctggcctca

SEQ ID NO: 485241 - DNA, 20 bp, Artificial Sequence
  chemically synthesized
gtaatatcagtgccaggatg

SEQ ID NO: 485242 - DNA, 20 bp, Artificial Sequence
  chemically synthesized
cacacttgtaatatcagtgc

SEQ ID NO: 485243 - DNA, 20 bp, Artificial Sequence
  chemically synthesized
ttttctaaatgaaaatgagg

SEQ ID NO: 485244 - DNA, 20 bp, Artificial Sequence
  chemically synthesized
ggcaaagatcagtagttgga

SEQ ID NO: 485245 - DNA, 20 bp, Artificial Sequence
  chemically synthesized
ataacttaaaaaaatcaaac

SEQ ID NO: 485246 - DNA, 20 bp, Artificial Sequence
  chemically synthesized
gtggcaggctaatttttatg

SEQ ID NO: 485247 - DNA, 20 bp, Artificial Sequence
  chemically synthesized
taatgaaatgcttccacaga

SEQ ID NO: 485248 - DNA, 20 bp, Artificial Sequence
  chemically synthesized
tcacatttagggaaaaaata

SEQ ID NO: 485249 - DNA, 20 bp, Artificial Sequence
  chemically synthesized
tagggaaaaaatatgggatt

SEQ ID NO: 485250 - DNA, 20 bp, Artificial Sequence
  chemically synthesized
agaggagagagtaatttgga

SEQ ID NO: 485251 - DNA, 20 bp, Artificial Sequence
  chemically synthesized
acttaagaaagtggagagga

SEQ ID NO: 485252 - DNA, 20 bp, Artificial Sequence
  chemically synthesized
cctctccactttcttaagta

SEQ ID NO: 485253 - DNA, 20 bp, Artificial Sequence
  chemically synthesized
gccaaaagcatatagataaa

SEQ ID NO: 485254 - DNA, 20 bp, Artificial Sequence
  chemically synthesized
ttttggcaaaaatcgtcttc

SEQ ID NO: 485255 - DNA, 20 bp, Artificial Sequence
  chemically synthesized
aattttttttaatttctagt

SEQ ID NO: 485256 - DNA, 20 bp, Artificial Sequence
  chemically synthesized
tgagtgttcaaaaataattc

SEQ ID NO: 485257 - DNA, 20 bp, Artificial Sequence
  chemically synthesized
agttaatctatgttcaactc

SEQ ID NO: 485258 - DNA, 20 bp, Artificial Sequence
  chemically synthesized
agattaacttgatatggggg

SEQ ID NO: 485259 - DNA, 20 bp, Artificial Sequence
  chemically synthesized
atacagtatatattcttttc

SEQ ID NO: 485260 - DNA, 20 bp, Artificial Sequence
  chemically synthesized
tcctatgatttattcaagaa

SEQ ID NO: 485261 - DNA, 20 bp, Artificial Sequence
  chemically synthesized
aaacaagtgacataatattt

SEQ ID NO: 485262 - DNA, 20 bp, Artificial Sequence
  chemically synthesized
tattatgtcacttgtttaca

SEQ ID NO: 485263 - DNA, 20 bp, Artificial Sequence
  chemically synthesized
taagggaactgaaagcattt

SEQ ID NO: 485264 - DNA, 20 bp, Artificial Sequence
  chemically synthesized
ttcgatttataaaaataact

SEQ ID NO: 485265 - DNA, 20 bp, Artificial Sequence
  chemically synthesized
ttcaaagttatttttataaa

SEQ ID NO: 485266 - DNA, 20 bp, Artificial Sequence
  chemically synthesized
gccacggtttctaaaatgat

SEQ ID NO: 485267 - DNA, 20 bp, Artificial Sequence
  chemically synthesized
aaaccgtggcattattttta

SEQ ID NO: 485268 - DNA, 20 bp, Artificial Sequence
  chemically synthesized
ttgtgcttttatgattttta

SEQ ID NO: 485269 - DNA, 20 bp, Artificial Sequence
  chemically synthesized
ttttgaaaaaaaaaaagcaa

SEQ ID NO: 485270 - DNA, 20 bp, Artificial Sequence
  chemically synthesized
aatgtttttaaatttcataa

SEQ ID NO: 485271 - DNA, 20 bp, Artificial Sequence
  chemically synthesized
caactttcactcccaagtta

SEQ ID NO: 485272 - DNA, 20 bp, Artificial Sequence
  chemically synthesized
tgatttttattcaataactt

SEQ ID NO: 485273 - DNA, 20 bp, Artificial Sequence
  chemically synthesized
taagctatgtttatctttcc

SEQ ID NO: 485274 - DNA, 20 bp, Artificial Sequence
  chemically synthesized
gaaaaaggcaggcacatatt

SEQ ID NO: 485275 - DNA, 20 bp, Artificial Sequence
  chemically synthesized
tcaatcatatatgtattaga

SEQ ID NO: 485276 - DNA, 20 bp, Artificial Sequence
  chemically synthesized
ggtttcaatcatatatgtat

SEQ ID NO: 485277 - DNA, 20 bp, Artificial Sequence
  chemically synthesized
tcttttatgtttttcttata

SEQ ID NO: 485278 - DNA, 20 bp, Artificial Sequence
  chemically synthesized
aaagggataggccctaattt

SEQ ID NO: 485279 - DNA, 20 bp, Artificial Sequence
  chemically synthesized
ttagggaacaaaaattaaaa

SEQ ID NO: 485280 - DNA, 20 bp, Artificial Sequence
  chemically synthesized
aagtgttcaataaataacag

SEQ ID NO: 485281 - DNA, 20 bp, Artificial Sequence
  chemically synthesized
taagagcttttgatacaata

SEQ ID NO: 485282 - DNA, 20 bp, Artificial Sequence
  chemically synthesized
agacagtcaatatatttcta

SEQ ID NO: 485283 - DNA, 20 bp, Artificial Sequence
  chemically synthesized
aagtgcttacttttgatacc

SEQ ID NO: 485284 - DNA, 20 bp, Artificial Sequence
  chemically synthesized
gtaaccatatacataaaagt

SEQ ID NO: 485285 - DNA, 20 bp, Artificial Sequence
  chemically synthesized
gtgtatgatagtgaataagt

SEQ ID NO: 485286 - DNA, 20 bp, Artificial Sequence
  chemically synthesized
tgatttccttgtgtatgata

SEQ ID NO: 485287 - DNA, 20 bp, Artificial Sequence
  chemically synthesized
agagacactagagtaataat

SEQ ID NO: 485288 - DNA, 20 bp, Artificial Sequence
  chemically synthesized
aggagaatagaaagagacac

SEQ ID NO: 485289 - DNA, 20 bp, Artificial Sequence
  chemically synthesized
gttgaagactattaagaaag

SEQ ID NO: 485290 - DNA, 20 bp, Artificial Sequence
  chemically synthesized
aatagtcttcaacctgactc

SEQ ID NO: 485291 - DNA, 20 bp, Artificial Sequence
  chemically synthesized
acccatgttacaaagcactc

SEQ ID NO: 485292 - DNA, 20 bp, Artificial Sequence
  chemically synthesized
actctagagtgctttgtaac

SEQ ID NO: 485293 - DNA, 20 bp, Artificial Sequence
  chemically synthesized
aaagacaatttgttgaacga

SEQ ID NO: 485294 - DNA, 20 bp, Artificial Sequence
  chemically synthesized
cttattattacctttaatgt

SEQ ID NO: 485295 - DNA, 20 bp, Artificial Sequence
  chemically synthesized
ttcatagaaatacgtagaat

SEQ ID NO: 485296 - DNA, 20 bp, Artificial Sequence
  chemically synthesized
attgttttcatagaaatacg

SEQ ID NO: 485297 - DNA, 20 bp, Artificial Sequence
  chemically synthesized
ctagttagggctcctttata

SEQ ID NO: 485298 - DNA, 20 bp, Artificial Sequence
  chemically synthesized
ctatttacaaatttcctttc

SEQ ID NO: 485299 - DNA, 20 bp, Artificial Sequence
  chemically synthesized
caagaaaggaaatttgtaaa

SEQ ID NO: 485300 - DNA, 20 bp, Artificial Sequence
  chemically synthesized
ctcaaataaataaataatta

SEQ ID NO: 485301 - DNA, 20 bp, Artificial Sequence
  chemically synthesized
aattatttatttatttgaga

SEQ ID NO: 485302 - DNA, 20 bp, Artificial Sequence
  chemically synthesized
ttcgctcttgttgcccaggc

SEQ ID NO: 485303 - DNA, 20 bp, Artificial Sequence
  chemically synthesized
ctcactgcaacatctgcctc

SEQ ID NO: 485304 - DNA, 20 bp, Artificial Sequence
  chemically synthesized
tactcctgaggctgaggcag

SEQ ID NO: 485305 - DNA, 20 bp, Artificial Sequence
  chemically synthesized
gattctcctgcctcagcctc

SEQ ID NO: 485306 - DNA, 20 bp, Artificial Sequence
  chemically synthesized
ttttgtatttttagtagaga

SEQ ID NO: 485307 - DNA, 20 bp, Artificial Sequence
  chemically synthesized
cgggtgtatcacctgaggtc

SEQ ID NO: 485308 - DNA, 20 bp, Artificial Sequence
  chemically synthesized
cagcactttgggaggctgag

SEQ ID NO: 485309 - DNA, 20 bp, Artificial Sequence
  chemically synthesized
gcctcagcctcccaaagtgc

SEQ ID NO: 485310 - DNA, 20 bp, Artificial Sequence
  chemically synthesized
gtgagctaccatgcccggcc

SEQ ID NO: 485311 - DNA, 20 bp, Artificial Sequence
  chemically synthesized
tttgccattgtgtttaaata

SEQ ID NO: 485312 - DNA, 20 bp, Artificial Sequence
  chemically synthesized
gcaaacataaacttccttat

SEQ ID NO: 485313 - DNA, 20 bp, Artificial Sequence
  chemically synthesized
tgttttccataaaataccag

SEQ ID NO: 485314 - DNA, 20 bp, Artificial Sequence
  chemically synthesized
cacagtacagtgacttccat

SEQ ID NO: 485315 - DNA, 20 bp, Artificial Sequence
  chemically synthesized
aactgatccaggatatttac

SEQ ID NO: 485316 - DNA, 20 bp, Artificial Sequence
  chemically synthesized
tcagaattcatgtaaatatc

SEQ ID NO: 485317 - DNA, 20 bp, Artificial Sequence
  chemically synthesized
cttatcaagcaaaactgatc

SEQ ID NO: 485318 - DNA, 20 bp, Artificial Sequence
  chemically synthesized
ttttgacagaaaagtttaca

SEQ ID NO: 485319 - DNA, 20 bp, Artificial Sequence
  chemically synthesized
acagaaaagtttacagtgaa

SEQ ID NO: 485320 - DNA, 20 bp, Artificial Sequence
  chemically synthesized
aactacacatttcaaagtct

SEQ ID NO: 485321 - DNA, 20 bp, Artificial Sequence
  chemically synthesized
ccccttaaataaaaaggtca

SEQ ID NO: 485322 - DNA, 20 bp, Artificial Sequence
  chemically synthesized
gtttatttttgttatgacca

SEQ ID NO: 485323 - DNA, 20 bp, Artificial Sequence
  chemically synthesized
atccactattatcttcaacg

SEQ ID NO: 485324 - DNA, 20 bp, Artificial Sequence
  chemically synthesized
atccttcgttgaagataata

SEQ ID NO: 485325 - DNA, 20 bp, Artificial Sequence
  chemically synthesized
agaaagaaaattatataaat

SEQ ID NO: 485326 - DNA, 20 bp, Artificial Sequence
  chemically synthesized
ggtagacagcttgcgaccat

SEQ ID NO: 485327 - DNA, 20 bp, Artificial Sequence
  chemically synthesized
aaatgatgagatgagaaggg

SEQ ID NO: 485328 - DNA, 20 bp, Artificial Sequence
  chemically synthesized
tgatcgatgaaagagaaaaa

SEQ ID NO: 485329 - DNA, 20 bp, Artificial Sequence
  chemically synthesized
aggttgggtgacagtcatct

SEQ ID NO: 485330 - DNA, 20 bp, Artificial Sequence
  chemically synthesized
atcaaatggatttcacgagg

SEQ ID NO: 485331 - DNA, 20 bp, Artificial Sequence
  chemically synthesized
tttatttccatgggcatcaa

SEQ ID NO: 485332 - DNA, 20 bp, Artificial Sequence
  chemically synthesized
ttgctttgttttgttataat

SEQ ID NO: 485333 - DNA, 20 bp, Artificial Sequence
  chemically synthesized
gagatgtgtaagaagttgag

SEQ ID NO: 485334 - DNA, 20 bp, Artificial Sequence
  chemically synthesized
cccagacccccagacctctt

SEQ ID NO: 485335 - DNA, 20 bp, Artificial Sequence
  chemically synthesized
tatctattcccaagaggtct

SEQ ID NO: 485336 - DNA, 20 bp, Artificial Sequence
  chemically synthesized
ttcccaagaggtctgggggt

SEQ ID NO: 485337 - DNA, 20 bp, Artificial Sequence
  chemically synthesized
tctataacttctctcatttg

SEQ ID NO: 485338 - DNA, 20 bp, Artificial Sequence
  chemically synthesized
attgtaatagccactttctg

SEQ ID NO: 485339 - DNA, 20 bp, Artificial Sequence
  chemically synthesized
ttctgctgggtttgtgacaa

SEQ ID NO: 485340 - DNA, 20 bp, Artificial Sequence
  chemically synthesized
aaactaaaagcaatacaaaa

SEQ ID NO: 485341 - DNA, 20 bp, Artificial Sequence
  chemically synthesized
aagaattgatgggacaatgt

SEQ ID NO: 485342 - DNA, 20 bp, Artificial Sequence
  chemically synthesized
cttgtgtagtatagccctgg

SEQ ID NO: 485343 - DNA, 20 bp, Artificial Sequence
  chemically synthesized
gtttagtaatcagattttga

SEQ ID NO: 485344 - DNA, 20 bp, Artificial Sequence
  chemically synthesized
aattctgattataacttttg

SEQ ID NO: 485345 - DNA, 20 bp, Artificial Sequence
  chemically synthesized
tattcaccaaaagttataat

SEQ ID NO: 485346 - DNA, 20 bp, Artificial Sequence
  chemically synthesized
aaaagcatttgaattagcta

SEQ ID NO: 485347 - DNA, 20 bp, Artificial Sequence
  chemically synthesized
tgtctatacacaaaaagcat

SEQ ID NO: 485348 - DNA, 20 bp, Artificial Sequence
  chemically synthesized
aaatgctttttgtgtataga

SEQ ID NO: 485349 - DNA, 20 bp, Artificial Sequence
  chemically synthesized
aatgggacataattacttga

SEQ ID NO: 485350 - DNA, 20 bp, Artificial Sequence
  chemically synthesized
tttaaatgggacataattac

SEQ ID NO: 485351 - DNA, 20 bp, Artificial Sequence
  chemically synthesized
aaattgaatgagcagtttta

SEQ ID NO: 485352 - DNA, 20 bp, Artificial Sequence
  chemically synthesized
gagatttcattatctaaaaa

SEQ ID NO: 485353 - DNA, 20 bp, Artificial Sequence
  chemically synthesized
ccagtaagacctttccagat

SEQ ID NO: 485354 - DNA, 20 bp, Artificial Sequence
  chemically synthesized
aatctggaaaggtcttactg

SEQ ID NO: 485355 - DNA, 20 bp, Artificial Sequence
  chemically synthesized
cacttgtattgaataaagaa

SEQ ID NO: 485356 - DNA, 20 bp, Artificial Sequence
  chemically synthesized
cactgcacttgtattgaata

SEQ ID NO: 485357 - DNA, 20 bp, Artificial Sequence
  chemically synthesized
tctcaaccactgcacttgta

SEQ ID NO: 485358 - DNA, 20 bp, Artificial Sequence
  chemically synthesized
gcagtggttgagattttgtg

SEQ ID NO: 485359 - DNA, 20 bp, Artificial Sequence
  chemically synthesized
attccgtttggccaggtgtt

SEQ ID NO: 485360 - DNA, 20 bp, Artificial Sequence
  chemically synthesized
atcctgaacacctggccaaa

SEQ ID NO: 485361 - DNA, 20 bp, Artificial Sequence
  chemically synthesized
ctggtgtctgattgcctgtg

SEQ ID NO: 485362 - DNA, 20 bp, Artificial Sequence
  chemically synthesized
ctagtgttgctatcaacaaa

SEQ ID NO: 485363 - DNA, 20 bp, Artificial Sequence
  chemically synthesized
aggaaaggaggaaatggaag

SEQ ID NO: 485364 - DNA, 20 bp, Artificial Sequence
  chemically synthesized
aatattaaagaggacaaaag

SEQ ID NO: 485365 - DNA, 20 bp, Artificial Sequence
  chemically synthesized
gaaagaaaaaaagacaagaa

SEQ ID NO: 485366 - DNA, 20 bp, Artificial Sequence
  chemically synthesized
gttctctccttcctttcctt

SEQ ID NO: 485367 - DNA, 20 bp, Artificial Sequence
  chemically synthesized
tatgtcctgggttttgcttt

SEQ ID NO: 485368 - DNA, 20 bp, Artificial Sequence
  chemically synthesized
aatgaagggaaaaatatgtc

SEQ ID NO: 485369 - DNA, 20 bp, Artificial Sequence
  chemically synthesized
ctgaaacaacaatatttgac

SEQ ID NO: 485370 - DNA, 20 bp, Artificial Sequence
  chemically synthesized
agaattgtgaatcaatagca

SEQ ID NO: 485371 - DNA, 20 bp, Artificial Sequence
  chemically synthesized
aaagtttaatttctagaatt

SEQ ID NO: 485372 - DNA, 20 bp, Artificial Sequence
  chemically synthesized
gaagttcaaagtttaatttc

SEQ ID NO: 485373 - DNA, 20 bp, Artificial Sequence
  chemically synthesized
aatataccattatcttttag

SEQ ID NO: 485374 - DNA, 20 bp, Artificial Sequence
  chemically synthesized
ctttaatttttttaagtttt

SEQ ID NO: 485375 - DNA, 20 bp, Artificial Sequence
  chemically synthesized
tgtagcttccatttttttca

SEQ ID NO: 485376 - DNA, 20 bp, Artificial Sequence
  chemically synthesized
ataaaaataatttttactaa

SEQ ID NO: 485377 - DNA, 20 bp, Artificial Sequence
  chemically synthesized
cttttcaccaaatatgtttt

SEQ ID NO: 485378 - DNA, 20 bp, Artificial Sequence
  chemically synthesized
ctagtgaaaggttagcttac

SEQ ID NO: 485379 - DNA, 20 bp, Artificial Sequence
  chemically synthesized
attgaaatatttgccacaga

SEQ ID NO: 485380 - DNA, 20 bp, Artificial Sequence
  chemically synthesized
ctgcacgtctaaggtttggt

SEQ ID NO: 485381 - DNA, 20 bp, Artificial Sequence
  chemically synthesized
atctcataactaactttgcc

SEQ ID NO: 485382 - DNA, 20 bp, Artificial Sequence
  chemically synthesized
ttatctatcttctggtgctt

SEQ ID NO: 485383 - DNA, 20 bp, Artificial Sequence
  chemically synthesized
ttcaacaaagactggaatgt

SEQ ID NO: 485384 - DNA, 20 bp, Artificial Sequence
  chemically synthesized
tcctcacattccagtctttg

SEQ ID NO: 485385 - DNA, 20 bp, Artificial Sequence
  chemically synthesized
acttcatattcaacaaagac

SEQ ID NO: 485386 - DNA, 20 bp, Artificial Sequence
  chemically synthesized
tggatagcttgatggataat

SEQ ID NO: 485387 - DNA, 20 bp, Artificial Sequence
  chemically synthesized
caataaatgtggatagcttg

SEQ ID NO: 485388 - DNA, 20 bp, Artificial Sequence
  chemically synthesized
gtaattggttctcaataaat

SEQ ID NO: 485389 - DNA, 20 bp, Artificial Sequence
  chemically synthesized
tatatttcaggtattggtat

SEQ ID NO: 485390 - DNA, 20 bp, Artificial Sequence
  chemically synthesized
caggtctacacgttgtgaag

SEQ ID NO: 485391 - DNA, 20 bp, Artificial Sequence
  chemically synthesized
ggcccagggaagccaaaaga

SEQ ID NO: 485392 - DNA, 20 bp, Artificial Sequence
  chemically synthesized
tccctgggccacactggaag

SEQ ID NO: 485393 - DNA, 20 bp, Artificial Sequence
  chemically synthesized
acatgcgtcccaggatggct

SEQ ID NO: 485394 - DNA, 20 bp, Artificial Sequence
  chemically synthesized
cctgtgagccacatgcgtcc

SEQ ID NO: 485395 - DNA, 20 bp, Artificial Sequence
  chemically synthesized
acgcatgtggctcacaggcc

SEQ ID NO: 485396 - DNA, 20 bp, Artificial Sequence
  chemically synthesized
agaacatgtagaataagttg

SEQ ID NO: 485397 - DNA, 20 bp, Artificial Sequence
  chemically synthesized
tgaactcagtcaagaacatg

SEQ ID NO: 485398 - DNA, 20 bp, Artificial Sequence
  chemically synthesized
cttattctacatgttcttga

SEQ ID NO: 485399 - DNA, 20 bp, Artificial Sequence
  chemically synthesized
attattgtttagtggttggt

SEQ ID NO: 485400 - DNA, 20 bp, Artificial Sequence
  chemically synthesized
gcaattctcctgaatagaaa

SEQ ID NO: 485401 - DNA, 20 bp, Artificial Sequence
  chemically synthesized
agaacccagtttctattcag

SEQ ID NO: 485402 - DNA, 20 bp, Artificial Sequence
  chemically synthesized
attagggaaaggcaattctc

SEQ ID NO: 485403 - DNA, 20 bp, Artificial Sequence
  chemically synthesized
ttttgagactttgggaggag

SEQ ID NO: 485404 - DNA, 20 bp, Artificial Sequence
  chemically synthesized
gagagtccagttcaccttgt

SEQ ID NO: 485405 - DNA, 20 bp, Artificial Sequence
  chemically synthesized
caaattttaaagtcttaaaa

SEQ ID NO: 485406 - DNA, 20 bp, Artificial Sequence
  chemically synthesized
ttaagactttaaaatttgaa

SEQ ID NO: 485407 - DNA, 20 bp, Artificial Sequence
  chemically synthesized
aatttgaacagagttacaca

SEQ ID NO: 485408 - DNA, 20 bp, Artificial Sequence
  chemically synthesized
tacacacaggatggagaaaa

SEQ ID NO: 485409 - DNA, 20 bp, Artificial Sequence
  chemically synthesized
agagagtatcacaaacagac

SEQ ID NO: 485410 - DNA, 20 bp, Artificial Sequence
  chemically synthesized
acaaaacttacaaaaggaaa

SEQ ID NO: 485411 - DNA, 20 bp, Artificial Sequence
  chemically synthesized
ctttctgcctgatttaatca

SEQ ID NO: 485412 - DNA, 20 bp, Artificial Sequence
  chemically synthesized
tgcctatcaattagagctct

SEQ ID NO: 485413 - DNA, 20 bp, Artificial Sequence
  chemically synthesized
tttcctgtttacaatccttt

SEQ ID NO: 485414 - DNA, 20 bp, Artificial Sequence
  chemically synthesized
acaggcagtggcaactctga

SEQ ID NO: 485415 - DNA, 20 bp, Artificial Sequence
  chemically synthesized
aatcctttgttgccagactg

SEQ ID NO: 485416 - DNA, 20 bp, Artificial Sequence
  chemically synthesized
aattcctcagtctggcaaca

SEQ ID NO: 485417 - DNA, 20 bp, Artificial Sequence
  chemically synthesized
gaggactggggctaaataat

SEQ ID NO: 485418 - DNA, 20 bp, Artificial Sequence
  chemically synthesized
tgaggaagaaattgatgagg

SEQ ID NO: 485419 - DNA, 20 bp, Artificial Sequence
  chemically synthesized
gattccatatggctgaagtt

SEQ ID NO: 485420 - DNA, 20 bp, Artificial Sequence
  chemically synthesized
tacccttaacttcagccata

SEQ ID NO: 485421 - DNA, 20 bp, Artificial Sequence
  chemically synthesized
aaaaaaacagagtatatcag

SEQ ID NO: 485422 - DNA, 20 bp, Artificial Sequence
  chemically synthesized
tcactgaggtggaaaaaaaa

SEQ ID NO: 485423 - DNA, 20 bp, Artificial Sequence
  chemically synthesized
gcacagtctgttccctctgc

SEQ ID NO: 485424 - DNA, 20 bp, Artificial Sequence
  chemically synthesized
ccaggcattaaagaatgagt

SEQ ID NO: 485425 - DNA, 20 bp, Artificial Sequence
  chemically synthesized
cttaagccaggcattaaaga

SEQ ID NO: 485426 - DNA, 20 bp, Artificial Sequence
  chemically synthesized
aaaacttaagccaggcatta

SEQ ID NO: 485427 - DNA, 20 bp, Artificial Sequence
  chemically synthesized
gcttaagtttttccttcttc

SEQ ID NO: 485428 - DNA, 20 bp, Artificial Sequence
  chemically synthesized
aaactaagccaggagagaga

SEQ ID NO: 485429 - DNA, 20 bp, Artificial Sequence
  chemically synthesized
gggaaaactaagccaggaga

SEQ ID NO: 485430 - DNA, 20 bp, Artificial Sequence
  chemically synthesized
ttcaacttctctgatattgt

SEQ ID NO: 485431 - DNA, 20 bp, Artificial Sequence
  chemically synthesized
gaactcaggcagtttggttc

SEQ ID NO: 485432 - DNA, 20 bp, Artificial Sequence
  chemically synthesized
ggactctggaaccaaactgc

SEQ ID NO: 485433 - DNA, 20 bp, Artificial Sequence
  chemically synthesized
ggtagatagagaggcacagt

SEQ ID NO: 485434 - DNA, 20 bp, Artificial Sequence
  chemically synthesized
cagtaatgttgtaagcatta

SEQ ID NO: 485435 - DNA, 20 bp, Artificial Sequence
  chemically synthesized
cattgatctaagtacttcac

SEQ ID NO: 485436 - DNA, 20 bp, Artificial Sequence
  chemically synthesized
actatgatagagataaattt

SEQ ID NO: 485437 - DNA, 20 bp, Artificial Sequence
  chemically synthesized
aaacataaagttgtacaaca

SEQ ID NO: 485438 - DNA, 20 bp, Artificial Sequence
  chemically synthesized
agttggttaaaataataaaa

SEQ ID NO: 485439 - DNA, 20 bp, Artificial Sequence
  chemically synthesized
ttcagtttataaagcccttt

SEQ ID NO: 485440 - DNA, 20 bp, Artificial Sequence
  chemically synthesized
cacacatcaaacattaaagt

SEQ ID NO: 485441 - DNA, 20 bp, Artificial Sequence
  chemically synthesized
gaaggataagtaagtatggg

SEQ ID NO: 485442 - DNA, 20 bp, Artificial Sequence
  chemically synthesized
tgtgtgagaggggaaataag

SEQ ID NO: 485443 - DNA, 20 bp, Artificial Sequence
  chemically synthesized
caagaactgacaatgtcttt

SEQ ID NO: 485444 - DNA, 20 bp, Artificial Sequence
  chemically synthesized
ttctcttgcttgctgaatag

SEQ ID NO: 485445 - DNA, 20 bp, Artificial Sequence
  chemically synthesized
aatctcccttctcttgcttg

SEQ ID NO: 485446 - DNA, 20 bp, Artificial Sequence
  chemically synthesized
atttctgagacacaaaaata

SEQ ID NO: 485447 - DNA, 20 bp, Artificial Sequence
  chemically synthesized
aaatttttttttttctgaga

SEQ ID NO: 485448 - DNA, 20 bp, Artificial Sequence
  chemically synthesized
ttgcactccagactgagtga

SEQ ID NO: 485449 - DNA, 20 bp, Artificial Sequence
  chemically synthesized
tctcactctgtcactcagtc

SEQ ID NO: 485450 - DNA, 20 bp, Artificial Sequence
  chemically synthesized
tcacaccattgcactccaga

SEQ ID NO: 485451 - DNA, 20 bp, Artificial Sequence
  chemically synthesized
gctcaatggaacctctggtc

SEQ ID NO: 485452 - DNA, 20 bp, Artificial Sequence
  chemically synthesized
ggctgaggcaggagaatcac

SEQ ID NO: 485453 - DNA, 20 bp, Artificial Sequence
  chemically synthesized
tactagggaggctgaggcag

SEQ ID NO: 485454 - DNA, 20 bp, Artificial Sequence
  chemically synthesized
gcctcagcctccctagtagc

SEQ ID NO: 485455 - DNA, 20 bp, Artificial Sequence
  chemically synthesized
ttttttattttcagtagaga

SEQ ID NO: 485456 - DNA, 20 bp, Artificial Sequence
  chemically synthesized
caggtggatcacttgaggtc

SEQ ID NO: 485457 - DNA, 20 bp, Artificial Sequence
  chemically synthesized
gctttgggaggctgaggcag

SEQ ID NO: 485458 - DNA, 20 bp, Artificial Sequence
  chemically synthesized
cctcagcctcccaaagcgct

SEQ ID NO: 485459 - DNA, 20 bp, Artificial Sequence
  chemically synthesized
ttgatgtgctcagtagtctc

SEQ ID NO: 485460 - DNA, 20 bp, Artificial Sequence
  chemically synthesized
cacttccttgtgacgggttt

SEQ ID NO: 485461 - DNA, 20 bp, Artificial Sequence
  chemically synthesized
aaagtccacacttccttgtg

SEQ ID NO: 485462 - DNA, 20 bp, Artificial Sequence
  chemically synthesized
gccatcattggttagatttc

SEQ ID NO: 485463 - DNA, 20 bp, Artificial Sequence
  chemically synthesized
tctgccttgcagtttgtcat

SEQ ID NO: 485464 - DNA, 20 bp, Artificial Sequence
  chemically synthesized
agtttatctagctataaaat

SEQ ID NO: 485465 - DNA, 20 bp, Artificial Sequence
  chemically synthesized
taaacttgggctcaggtagg

SEQ ID NO: 485466 - DNA, 20 bp, Artificial Sequence
  chemically synthesized
ggctcccaagctgtgtgacc

SEQ ID NO: 485467 - DNA, 20 bp, Artificial Sequence
  chemically synthesized
aggttttgaagttacattgt

SEQ ID NO: 485468 - DNA, 20 bp, Artificial Sequence
  chemically synthesized
ctttggtaaataaaagtcct

SEQ ID NO: 485469 - DNA, 20 bp, Artificial Sequence
  chemically synthesized
cgttcttttacaataccata

SEQ ID NO: 485470 - DNA, 20 bp, Artificial Sequence
  chemically synthesized
tgttattacttgctactgca

SEQ ID NO: 485471 - DNA, 20 bp, Artificial Sequence
  chemically synthesized
gcaagtaataacacaagctt

SEQ ID NO: 485472 - DNA, 20 bp, Artificial Sequence
  chemically synthesized
agcttaggaatcaaatggac

SEQ ID NO: 485473 - DNA, 20 bp, Artificial Sequence
  chemically synthesized
ggaatcaaatggacttggat

SEQ ID NO: 485474 - DNA, 20 bp, Artificial Sequence
  chemically synthesized
ttcccagtaagtagcagaac

SEQ ID NO: 485475 - DNA, 20 bp, Artificial Sequence
  chemically synthesized
tccttgttctgctacttact

SEQ ID NO: 485476 - DNA, 20 bp, Artificial Sequence
  chemically synthesized
ttcacaatatagttatggat

SEQ ID NO: 485477 - DNA, 20 bp, Artificial Sequence
  chemically synthesized
ttcacattcacaatatagtt

SEQ ID NO: 485478 - DNA, 20 bp, Artificial Sequence
  chemically synthesized
tccatatccataactatatt

SEQ ID NO: 485479 - DNA, 20 bp, Artificial Sequence
  chemically synthesized
tccataactatattgtgaat

SEQ ID NO: 485480 - DNA, 20 bp, Artificial Sequence
  chemically synthesized
tattctgagtacagagcata

SEQ ID NO: 485481 - DNA, 20 bp, Artificial Sequence
  chemically synthesized
tactctgtatgctctgtact

SEQ ID NO: 485482 - DNA, 20 bp, Artificial Sequence
  chemically synthesized
ctggatcttcgtttcctatt

SEQ ID NO: 485483 - DNA, 20 bp, Artificial Sequence
  chemically synthesized
tgattgtggtcaagccatct

SEQ ID NO: 485484 - DNA, 20 bp, Artificial Sequence
  chemically synthesized
atcatcatttgcaaatggca

SEQ ID NO: 485485 - DNA, 20 bp, Artificial Sequence
  chemically synthesized
tgagcttgaatacagaagac

SEQ ID NO: 485486 - DNA, 20 bp, Artificial Sequence
  chemically synthesized
tgcatttaaaggccttgagc

SEQ ID NO: 485487 - DNA, 20 bp, Artificial Sequence
  chemically synthesized
tcaaattacttttattccta

SEQ ID NO: 485488 - DNA, 20 bp, Artificial Sequence
  chemically synthesized
ataaacttcaccaattccat

SEQ ID NO: 485489 - DNA, 20 bp, Artificial Sequence
  chemically synthesized
agtgaggcagacagagtaag

SEQ ID NO: 485490 - DNA, 20 bp, Artificial Sequence
  chemically synthesized
aaaacaagaagtgaggcaga

SEQ ID NO: 485491 - DNA, 20 bp, Artificial Sequence
  chemically synthesized
atgattaagaaaaataatgt

SEQ ID NO: 485492 - DNA, 20 bp, Artificial Sequence
  chemically synthesized
actatatatcttttatattt

SEQ ID NO: 485493 - DNA, 20 bp, Artificial Sequence
  chemically synthesized
atgacatcaactagaaacat

SEQ ID NO: 485494 - DNA, 20 bp, Artificial Sequence
  chemically synthesized
tgatgtcataattttaccaa

SEQ ID NO: 485495 - DNA, 20 bp, Artificial Sequence
  chemically synthesized
taaatgccaactttaagatc

SEQ ID NO: 485496 - DNA, 20 bp, Artificial Sequence
  chemically synthesized
aatttgccttctccaatgat

SEQ ID NO: 485497 - DNA, 20 bp, Artificial Sequence
  chemically synthesized
aattggcacagacaacttag

SEQ ID NO: 485498 - DNA, 20 bp, Artificial Sequence
  chemically synthesized
ggcacagacaacttagaaga

SEQ ID NO: 485499 - DNA, 20 bp, Artificial Sequence
  chemically synthesized
agaatcaaatataatagtct

SEQ ID NO: 485500 - DNA, 20 bp, Artificial Sequence
  chemically synthesized
ctacgcagcccaacatattg

SEQ ID NO: 485501 - DNA, 20 bp, Artificial Sequence
  chemically synthesized
tttaaatgtaaatagctcag

SEQ ID NO: 485502 - DNA, 20 bp, Artificial Sequence
  chemically synthesized
aaaaaaagcagaaaccttac

SEQ ID NO: 485503 - DNA, 20 bp, Artificial Sequence
  chemically synthesized
tattcagcctaagtataatc

SEQ ID NO: 485504 - DNA, 20 bp, Artificial Sequence
  chemically synthesized
tatccttgattatacttagg

SEQ ID NO: 485505 - DNA, 20 bp, Artificial Sequence
  chemically synthesized
ttatacttaggctgaatagt

SEQ ID NO: 485506 - DNA, 20 bp, Artificial Sequence
  chemically synthesized
actggtgggaaatggtctag

SEQ ID NO: 485507 - DNA, 20 bp, Artificial Sequence
  chemically synthesized
gggtgatggtgggtgacctt

SEQ ID NO: 485508 - DNA, 20 bp, Artificial Sequence
  chemically synthesized
taaaatcacagagggtgatg

SEQ ID NO: 485509 - DNA, 20 bp, Artificial Sequence
  chemically synthesized
gatcaagttataaaatcaca

SEQ ID NO: 485510 - DNA, 20 bp, Artificial Sequence
  chemically synthesized
gtaaccacaggttgtgtcac

SEQ ID NO: 485511 - DNA, 20 bp, Artificial Sequence
  chemically synthesized
tgtgtcaccagagtaacagt

SEQ ID NO: 485512 - DNA, 20 bp, Artificial Sequence
  chemically synthesized
tgagtaggagctaaaatatt

SEQ ID NO: 485513 - DNA, 20 bp, Artificial Sequence
  chemically synthesized
caataagtcaaatttaattg

SEQ ID NO: 485514 - DNA, 20 bp, Artificial Sequence
  chemically synthesized
agatatataatgtcatgaat

SEQ ID NO: 485515 - DNA, 20 bp, Artificial Sequence
  chemically synthesized
agaaaaagatatataatgtc

SEQ ID NO: 485516 - DNA, 20 bp, Artificial Sequence
  chemically synthesized
atatatctttttctaacaat

SEQ ID NO: 485517 - DNA, 20 bp, Artificial Sequence
  chemically synthesized
aatgtatattaatgaaaagg

SEQ ID NO: 485518 - DNA, 20 bp, Artificial Sequence
  chemically synthesized
taagttacttgtccaggcat

SEQ ID NO: 485519 - DNA, 20 bp, Artificial Sequence
  chemically synthesized
tgttttgcctttgttttttc

SEQ ID NO: 485520 - DNA, 20 bp, Artificial Sequence
  chemically synthesized
aaaacaaaggcaaaacaaga

SEQ ID NO: 485521 - DNA, 20 bp, Artificial Sequence
  chemically synthesized
ctttctgatttaaaattccc

SEQ ID NO: 485522 - DNA, 20 bp, Artificial Sequence
  chemically synthesized
ttaatttacttcctattcaa

SEQ ID NO: 485523 - DNA, 20 bp, Artificial Sequence
  chemically synthesized
ttcattggctttgatttccc

SEQ ID NO: 485524 - DNA, 20 bp, Artificial Sequence
  chemically synthesized
tacaatattttcttaaaaat

SEQ ID NO: 485525 - DNA, 20 bp, Artificial Sequence
  chemically synthesized
gtcattaaataaatcttaat

SEQ ID NO: 485526 - DNA, 20 bp, Artificial Sequence
  chemically synthesized
atgaatagtgttggacactg

SEQ ID NO: 485527 - DNA, 20 bp, Artificial Sequence
  chemically synthesized
atggttaagatgcatagtac

SEQ ID NO: 485528 - DNA, 20 bp, Artificial Sequence
  chemically synthesized
agagttcctagggcagagaa

SEQ ID NO: 485529 - DNA, 20 bp, Artificial Sequence
  chemically synthesized
atgtggctttaccaaggtcc

SEQ ID NO: 485530 - DNA, 20 bp, Artificial Sequence
  chemically synthesized
tcatgtatttaccttaaaag

SEQ ID NO: 485531 - DNA, 20 bp, Artificial Sequence
  chemically synthesized
ccttaaaagaggaataataa

SEQ ID NO: 485532 - DNA, 20 bp, Artificial Sequence
  chemically synthesized
agggcagttgtgtagattca

SEQ ID NO: 485533 - DNA, 20 bp, Artificial Sequence
  chemically synthesized
tgtattgcttgtactactca

SEQ ID NO: 485534 - DNA, 20 bp, Artificial Sequence
  chemically synthesized
cccaaaatgtgaaatacttg

SEQ ID NO: 485535 - DNA, 20 bp, Artificial Sequence
  chemically synthesized
agagggctgaacttgctggt

SEQ ID NO: 485536 - DNA, 20 bp, Artificial Sequence
  chemically synthesized
tactaaataccaacacacag

SEQ ID NO: 485537 - DNA, 20 bp, Artificial Sequence
  chemically synthesized
acacagctgggttatcagag

SEQ ID NO: 485538 - DNA, 20 bp, Artificial Sequence
  chemically synthesized
agaggtgagtggtgagggga

SEQ ID NO: 485539 - DNA, 20 bp, Artificial Sequence
  chemically synthesized
cttctggttatattatgctc

SEQ ID NO: 485540 - DNA, 20 bp, Artificial Sequence
  chemically synthesized
aattattggactatgtagtt

SEQ ID NO: 485541 - DNA, 20 bp, Artificial Sequence
  chemically synthesized
tcgttcactggttgtccagt

SEQ ID NO: 485542 - DNA, 20 bp, Artificial Sequence
  chemically synthesized
gacaaccagtgaacgattct

SEQ ID NO: 485543 - DNA, 20 bp, Artificial Sequence
  chemically synthesized
tcatttttttttaatattct

SEQ ID NO: 485544 - DNA, 20 bp, Artificial Sequence
  chemically synthesized
tattaaaaaaaaatgagaca

SEQ ID NO: 485545 - DNA, 20 bp, Artificial Sequence
  chemically synthesized
aaattaatgattggctacct

SEQ ID NO: 485546 - DNA, 20 bp, Artificial Sequence
  chemically synthesized
tctcctcattagagaagaag

SEQ ID NO: 485547 - DNA, 20 bp, Artificial Sequence
  chemically synthesized
tcattagagaagaagatgag

SEQ ID NO: 485548 - DNA, 20 bp, Artificial Sequence
  chemically synthesized
gaagaagatgagtagaatgg

SEQ ID NO: 485549 - DNA, 20 bp, Artificial Sequence
  chemically synthesized
tcaagcttctcagggacacc

SEQ ID NO: 485550 - DNA, 20 bp, Artificial Sequence
  chemically synthesized
agggacaccaagagttttct

SEQ ID NO: 485551 - DNA, 20 bp, Artificial Sequence
  chemically synthesized
atagtgttttaattgtcaga

SEQ ID NO: 485552 - DNA, 20 bp, Artificial Sequence
  chemically synthesized
attctttctagaaagagcct

SEQ ID NO: 485553 - DNA, 20 bp, Artificial Sequence
  chemically synthesized
actctgaggctctttctaga

SEQ ID NO: 485554 - DNA, 20 bp, Artificial Sequence
  chemically synthesized
aaagatctagaaatcttaaa

SEQ ID NO: 485555 - DNA, 20 bp, Artificial Sequence
  chemically synthesized
tggatatttagctcctttcc

SEQ ID NO: 485556 - DNA, 20 bp, Artificial Sequence
  chemically synthesized
aaaggagctaaatatccaga

SEQ ID NO: 485557 - DNA, 20 bp, Artificial Sequence
  chemically synthesized
tcctcacacatgcatcctct

SEQ ID NO: 485558 - DNA, 20 bp, Artificial Sequence
  chemically synthesized
tccagagaggatgcatgtgt

SEQ ID NO: 485559 - DNA, 20 bp, Artificial Sequence
  chemically synthesized
caccaggctgactggcaaat

SEQ ID NO: 485560 - DNA, 20 bp, Artificial Sequence
  chemically synthesized
ggctgactggcaaatgtgga

SEQ ID NO: 485561 - DNA, 20 bp, Artificial Sequence
  chemically synthesized
ggcaatatacagcaatttag

SEQ ID NO: 485562 - DNA, 20 bp, Artificial Sequence
  chemically synthesized
tcttgtctctgctcttattt

SEQ ID NO: 485563 - DNA, 20 bp, Artificial Sequence
  chemically synthesized
cactaaatttcaataaagtg

SEQ ID NO: 485564 - DNA, 20 bp, Artificial Sequence
  chemically synthesized
aagtgaaggatgaggaacta

SEQ ID NO: 485565 - DNA, 20 bp, Artificial Sequence
  chemically synthesized
aggagggagggagggaggga

SEQ ID NO: 485566 - DNA, 20 bp, Artificial Sequence
  chemically synthesized
agtaagggaaggaaggagga

SEQ ID NO: 485567 - DNA, 20 bp, Artificial Sequence
  chemically synthesized
gggcctgagactcaaaaaga

SEQ ID NO: 485568 - DNA, 20 bp, Artificial Sequence
  chemically synthesized
tcatgaaccattctctcttt

SEQ ID NO: 485569 - DNA, 20 bp, Artificial Sequence
  chemically synthesized
atgatgactaaatatgccat

SEQ ID NO: 485570 - DNA, 20 bp, Artificial Sequence
  chemically synthesized
aattagctgaagcatattca

SEQ ID NO: 485571 - DNA, 20 bp, Artificial Sequence
  chemically synthesized
ctagacctctccatcatcct

SEQ ID NO: 485572 - DNA, 20 bp, Artificial Sequence
  chemically synthesized
tatctgcccatgactggcgc

SEQ ID NO: 485573 - DNA, 20 bp, Artificial Sequence
  chemically synthesized
agaccagaaatactggcctg

SEQ ID NO: 485574 - DNA, 20 bp, Artificial Sequence
  chemically synthesized
cttgcatcttgcacatgtcc

SEQ ID NO: 485575 - DNA, 20 bp, Artificial Sequence
  chemically synthesized
aggtgctcaattgattccct

SEQ ID NO: 485576 - DNA, 20 bp, Artificial Sequence
  chemically synthesized
gacttttctttagattcaaa

SEQ ID NO: 485577 - DNA, 20 bp, Artificial Sequence
  chemically synthesized
ttagaggtcttctacataca

SEQ ID NO: 485578 - DNA, 20 bp, Artificial Sequence
  chemically synthesized
aaaatttaacagccacccat

SEQ ID NO: 485579 - DNA, 20 bp, Artificial Sequence
  chemically synthesized
gcctccattcttccattcta

SEQ ID NO: 485580 - DNA, 20 bp, Artificial Sequence
  chemically synthesized
acagccacccattagaatgg

SEQ ID NO: 485581 - DNA, 20 bp, Artificial Sequence
  chemically synthesized
ttcattgtctgctccaagca

SEQ ID NO: 485582 - DNA, 20 bp, Artificial Sequence
  chemically synthesized
ggaaaaaaaatgtatgtgtg

SEQ ID NO: 485583 - DNA, 20 bp, Artificial Sequence
  chemically synthesized
gagaaaagcaggaaatagct

SEQ ID NO: 485584 - DNA, 20 bp, Artificial Sequence
  chemically synthesized
aatagctctgaatcagaaag

SEQ ID NO: 485585 - DNA, 20 bp, Artificial Sequence
  chemically synthesized
ctgaatcagaaagcagggtg

SEQ ID NO: 485586 - DNA, 20 bp, Artificial Sequence
  chemically synthesized
ctaggaccagattgttgtat

SEQ ID NO: 485587 - DNA, 20 bp, Artificial Sequence
  chemically synthesized
aaaaaaaaaaattatagagc

SEQ ID NO: 485588 - DNA, 20 bp, Artificial Sequence
  chemically synthesized
agtcagatgacttaacctct

SEQ ID NO: 485589 - DNA, 20 bp, Artificial Sequence
  chemically synthesized
ttataatcgccactttacag

SEQ ID NO: 485590 - DNA, 20 bp, Artificial Sequence
  chemically synthesized
attggaggcatcttgaggta

SEQ ID NO: 485591 - DNA, 20 bp, Artificial Sequence
  chemically synthesized
ttacacaggtgaaaactttt

SEQ ID NO: 485592 - DNA, 20 bp, Artificial Sequence
  chemically synthesized
tgaaaacagtaccaatctaa

SEQ ID NO: 485593 - DNA, 20 bp, Artificial Sequence
  chemically synthesized
caatctaatggaattgtgtt

SEQ ID NO: 485594 - DNA, 20 bp, Artificial Sequence
  chemically synthesized
catacatgtaagtcacctcc

SEQ ID NO: 485595 - DNA, 20 bp, Artificial Sequence
  chemically synthesized
tctgactgtaagtacactat

SEQ ID NO: 485596 - DNA, 20 bp, Artificial Sequence
  chemically synthesized
cctcatgttctacattcgta

SEQ ID NO: 485597 - DNA, 20 bp, Artificial Sequence
  chemically synthesized
tacagagcataaaatcccat

SEQ ID NO: 485598 - DNA, 20 bp, Artificial Sequence
  chemically synthesized
ctggagggtcaaatctggtt

SEQ ID NO: 485599 - DNA, 20 bp, Artificial Sequence
  chemically synthesized
aatggagagaggtaagtctg

SEQ ID NO: 485600 - DNA, 20 bp, Artificial Sequence
  chemically synthesized
tgggtgtggaggagcctgga

SEQ ID NO: 485601 - DNA, 20 bp, Artificial Sequence
  chemically synthesized
tgagagaatgcacaatagac

SEQ ID NO: 485602 - DNA, 20 bp, Artificial Sequence
  chemically synthesized
gaaatggcctgtgctcatga

SEQ ID NO: 485603 - DNA, 20 bp, Artificial Sequence
  chemically synthesized
ctccccaaaacacagaaatc

SEQ ID NO: 485604 - DNA, 20 bp, Artificial Sequence
  chemically synthesized
ttctgtgttttggggaggac

SEQ ID NO: 485605 - DNA, 20 bp, Artificial Sequence
  chemically synthesized
taaaatatctccatgaggaa

SEQ ID NO: 485606 - DNA, 20 bp, Artificial Sequence
  chemically synthesized
aacagaattacacctttctt

SEQ ID NO: 485607 - DNA, 20 bp, Artificial Sequence
  chemically synthesized
tgcaccactattaggttttg

SEQ ID NO: 485608 - DNA, 20 bp, Artificial Sequence
  chemically synthesized
gaggattttgaaagtgtcta

SEQ ID NO: 485609 - DNA, 20 bp, Artificial Sequence
  chemically synthesized
gaggatagctgatagtagtt

SEQ ID NO: 485610 - DNA, 20 bp, Artificial Sequence
  chemically synthesized
tagctgatagtagttgagag

SEQ ID NO: 485611 - DNA, 20 bp, Artificial Sequence
  chemically synthesized
agacccaaagtttctgactt

SEQ ID NO: 485612 - DNA, 20 bp, Artificial Sequence
  chemically synthesized
ggattctaaagtcagaaact

SEQ ID NO: 485613 - DNA, 20 bp, Artificial Sequence
  chemically synthesized
gtcagaaactttgggtctca

SEQ ID NO: 485614 - DNA, 20 bp, Artificial Sequence
  chemically synthesized
ttttctaaaaagacttgcct

SEQ ID NO: 485615 - DNA, 20 bp, Artificial Sequence
  chemically synthesized
tgaaaaaaatatatacatgc

SEQ ID NO: 485616 - DNA, 20 bp, Artificial Sequence
  chemically synthesized
ttttttttttttttttgaga

SEQ ID NO: 485617 - DNA, 20 bp, Artificial Sequence
  chemically synthesized
gtgttgctctgttgccaggc

SEQ ID NO: 485618 - DNA, 20 bp, Artificial Sequence
  chemically synthesized
ctcactgcaatctctgcctc

SEQ ID NO: 485619 - DNA, 20 bp, Artificial Sequence
  chemically synthesized
tactcaggaggctgaggcag

SEQ ID NO: 485620 - DNA, 20 bp, Artificial Sequence
  chemically synthesized
gattcccctgcctcagcctc

SEQ ID NO: 485621 - DNA, 20 bp, Artificial Sequence
  chemically synthesized
tttttgtactttagtggaga

SEQ ID NO: 485622 - DNA, 20 bp, Artificial Sequence
  chemically synthesized
cggggtttcaccatgttggc

SEQ ID NO: 485623 - DNA, 20 bp, Artificial Sequence
  chemically synthesized
gcctcggcctcccaaagtgc

SEQ ID NO: 485624 - DNA, 20 bp, Artificial Sequence
  chemically synthesized
aacgcatctgaaagtgcagt

SEQ ID NO: 485625 - DNA, 20 bp, Artificial Sequence
  chemically synthesized
agcaacctgttcacagttct

SEQ ID NO: 485626 - DNA, 20 bp, Artificial Sequence
  chemically synthesized
tcacagttctaagggtcagg

SEQ ID NO: 485627 - DNA, 20 bp, Artificial Sequence
  chemically synthesized
cagggtcgtattgttgtgcc

SEQ ID NO: 485628 - DNA, 20 bp, Artificial Sequence
  chemically synthesized
aatattttaaaagactgaaa

SEQ ID NO: 485629 - DNA, 20 bp, Artificial Sequence
  chemically synthesized
gaaagaggatttgttttgct

SEQ ID NO: 485630 - DNA, 20 bp, Artificial Sequence
  chemically synthesized
atttgttttgctaagagtgc

SEQ ID NO: 485631 - DNA, 20 bp, Artificial Sequence
  chemically synthesized
ttacccgttcgttctagatt

SEQ ID NO: 485632 - DNA, 20 bp, Artificial Sequence
  chemically synthesized
gaatccataatctagaacga

SEQ ID NO: 485633 - DNA, 20 bp, Artificial Sequence
  chemically synthesized
taatctagaacgaacgggta

SEQ ID NO: 485634 - DNA, 20 bp, Artificial Sequence
  chemically synthesized
agaacgaacgggtaaagagt

SEQ ID NO: 485635 - DNA, 20 bp, Artificial Sequence
  chemically synthesized
aggatatataaattattaca

SEQ ID NO: 485636 - DNA, 20 bp, Artificial Sequence
  chemically synthesized
attttcaatgatgttctggg

SEQ ID NO: 485637 - DNA, 20 bp, Artificial Sequence
  chemically synthesized
agccatttcccatgctcctt

SEQ ID NO: 485638 - DNA, 20 bp, Artificial Sequence
  chemically synthesized
attaaatagggtacacggga

SEQ ID NO: 485639 - DNA, 20 bp, Artificial Sequence
  chemically synthesized
gacttggggttaagattaaa

SEQ ID NO: 485640 - DNA, 20 bp, Artificial Sequence
  chemically synthesized
tgcccaggcatgaacagact

SEQ ID NO: 485641 - DNA, 20 bp, Artificial Sequence
  chemically synthesized
ataggggcataagaaacggg

SEQ ID NO: 485642 - DNA, 20 bp, Artificial Sequence
  chemically synthesized
caagataggggcataagaaa

SEQ ID NO: 485643 - DNA, 20 bp, Artificial Sequence
  chemically synthesized
ccgtttcttatgcccctatc

SEQ ID NO: 485644 - DNA, 20 bp, Artificial Sequence
  chemically synthesized
ctctaaccacctcagagact

SEQ ID NO: 485645 - DNA, 20 bp, Artificial Sequence
  chemically synthesized
attcctccaatggacttgag

SEQ ID NO: 485646 - DNA, 20 bp, Artificial Sequence
  chemically synthesized
attcttctcaagtccattgg

SEQ ID NO: 485647 - DNA, 20 bp, Artificial Sequence
  chemically synthesized
aggaattgtcttttcctgcc

SEQ ID NO: 485648 - DNA, 20 bp, Artificial Sequence
  chemically synthesized
aggttcctccagtaacagat

SEQ ID NO: 485649 - DNA, 20 bp, Artificial Sequence
  chemically synthesized
tcctccagtaacagatttgg

SEQ ID NO: 485650 - DNA, 20 bp, Artificial Sequence
  chemically synthesized
gcaagagagagagagggcat

SEQ ID NO: 485651 - DNA, 20 bp, Artificial Sequence
  chemically synthesized
agagtcattttaattttcta

SEQ ID NO: 485652 - DNA, 20 bp, Artificial Sequence
  chemically synthesized
agggaaaaccacaattttag

SEQ ID NO: 485653 - DNA, 20 bp, Artificial Sequence
  chemically synthesized
tcaagctcaaaatagttgaa

SEQ ID NO: 485654 - DNA, 20 bp, Artificial Sequence
  chemically synthesized
ctcaaaatagttgaaatgaa

SEQ ID NO: 485655 - DNA, 20 bp, Artificial Sequence
  chemically synthesized
atgaattgagtttggcacac

SEQ ID NO: 485656 - DNA, 20 bp, Artificial Sequence
  chemically synthesized
tggcacaccagaatggtagc

SEQ ID NO: 485657 - DNA, 20 bp, Artificial Sequence
  chemically synthesized
ttgcaaaccacagctttgct

SEQ ID NO: 485658 - DNA, 20 bp, Artificial Sequence
  chemically synthesized
ttcaaacacttgaaaaaaat

SEQ ID NO: 485659 - DNA, 20 bp, Artificial Sequence
  chemically synthesized
ctgaaaatttaattggtttc

SEQ ID NO: 485660 - DNA, 20 bp, Artificial Sequence
  chemically synthesized
gaattacaggaaaaccatgt

SEQ ID NO: 485661 - DNA, 20 bp, Artificial Sequence
  chemically synthesized
ttatcaaccaaaggagacct

SEQ ID NO: 485662 - DNA, 20 bp, Artificial Sequence
  chemically synthesized
tcattcaacaaagctagaaa

SEQ ID NO: 485663 - DNA, 20 bp, Artificial Sequence
  chemically synthesized
atactctatttctagctttg

SEQ ID NO: 485664 - DNA, 20 bp, Artificial Sequence
  chemically synthesized
tctatttctagctttgttga

SEQ ID NO: 485665 - DNA, 20 bp, Artificial Sequence
  chemically synthesized
tctagctttgttgaatgaat

SEQ ID NO: 485666 - DNA, 20 bp, Artificial Sequence
  chemically synthesized
ccaataacttattttgtaag

SEQ ID NO: 485667 - DNA, 20 bp, Artificial Sequence
  chemically synthesized
tcacattaacaattctatga

SEQ ID NO: 485668 - DNA, 20 bp, Artificial Sequence
  chemically synthesized
actttttagatattctctca

SEQ ID NO: 485669 - DNA, 20 bp, Artificial Sequence
  chemically synthesized
catggaatgataaggaggaa

SEQ ID NO: 485670 - DNA, 20 bp, Artificial Sequence
  chemically synthesized
acattgctctcctgttgaca

SEQ ID NO: 485671 - DNA, 20 bp, Artificial Sequence
  chemically synthesized
tgcattactatttaatacta

SEQ ID NO: 485672 - DNA, 20 bp, Artificial Sequence
  chemically synthesized
ccaatgttgcttacatggag

SEQ ID NO: 485673 - DNA, 20 bp, Artificial Sequence
  chemically synthesized
cctccatgtaagcaacattg

SEQ ID NO: 485674 - DNA, 20 bp, Artificial Sequence
  chemically synthesized
cattggagaatattttcttt

SEQ ID NO: 485675 - DNA, 20 bp, Artificial Sequence
  chemically synthesized
ttttctttttgaatatttga

SEQ ID NO: 485676 - DNA, 20 bp, Artificial Sequence
  chemically synthesized
aatatttgaaaggatggcat

SEQ ID NO: 485677 - DNA, 20 bp, Artificial Sequence
  chemically synthesized
aaaggatggcatttggatta

SEQ ID NO: 485678 - DNA, 20 bp, Artificial Sequence
  chemically synthesized
tttggattaatgaattccgt

SEQ ID NO: 485679 - DNA, 20 bp, Artificial Sequence
  chemically synthesized
gaagttctcttgaattctta

SEQ ID NO: 485680 - DNA, 20 bp, Artificial Sequence
  chemically synthesized
aattttcttcagaagttctc

SEQ ID NO: 485681 - DNA, 20 bp, Artificial Sequence
  chemically synthesized
acacaatagattgtctttct

SEQ ID NO: 485682 - DNA, 20 bp, Artificial Sequence
  chemically synthesized
aatctattgtgtaggtaagg

SEQ ID NO: 485683 - DNA, 20 bp, Artificial Sequence
  chemically synthesized
ctttcttttctgtcactcta

SEQ ID NO: 485684 - DNA, 20 bp, Artificial Sequence
  chemically synthesized
catatattttatttactctt

SEQ ID NO: 485685 - DNA, 20 bp, Artificial Sequence
  chemically synthesized
agcatttatttttctaaaat

SEQ ID NO: 485686 - DNA, 20 bp, Artificial Sequence
  chemically synthesized
gtactccggccttgcctatg

SEQ ID NO: 485687 - DNA, 20 bp, Artificial Sequence
  chemically synthesized
gtactctacataggcaaggc

SEQ ID NO: 485688 - DNA, 20 bp, Artificial Sequence
  chemically synthesized
aggccggagtactggaactc

SEQ ID NO: 485689 - DNA, 20 bp, Artificial Sequence
  chemically synthesized
caaatggttatcatgaatcc

SEQ ID NO: 485690 - DNA, 20 bp, Artificial Sequence
  chemically synthesized
cagaaatacaaatggttatc

SEQ ID NO: 485691 - DNA, 20 bp, Artificial Sequence
  chemically synthesized
catgataaccatttgtattt

SEQ ID NO: 485692 - DNA, 20 bp, Artificial Sequence
  chemically synthesized
aaatgttaagtttgggagct

SEQ ID NO: 485693 - DNA, 20 bp, Artificial Sequence
  chemically synthesized
ttatatttttaatagcaaga

SEQ ID NO: 485694 - DNA, 20 bp, Artificial Sequence
  chemically synthesized
aagtagtagcaaatatttat

SEQ ID NO: 485695 - DNA, 20 bp, Artificial Sequence
  chemically synthesized
agaatcactgagtaaatgat

SEQ ID NO: 485696 - DNA, 20 bp, Artificial Sequence
  chemically synthesized
tgcctagcacataagaatca

SEQ ID NO: 485697 - DNA, 20 bp, Artificial Sequence
  chemically synthesized
aagaaccttgcctagcacat

SEQ ID NO: 485698 - DNA, 20 bp, Artificial Sequence
  chemically synthesized
ttggtaaaggtgaaataaaa

SEQ ID NO: 485699 - DNA, 20 bp, Artificial Sequence
  chemically synthesized
cacctttaccaaaccatctt

SEQ ID NO: 485700 - DNA, 20 bp, Artificial Sequence
  chemically synthesized
tttcgttaccttggtaaaag

SEQ ID NO: 485701 - DNA, 20 bp, Artificial Sequence
  chemically synthesized
ccaaggtaacgaaacttgtt

SEQ ID NO: 485702 - DNA, 20 bp, Artificial Sequence
  chemically synthesized
taaccactgcacatatttct

SEQ ID NO: 485703 - DNA, 20 bp, Artificial Sequence
  chemically synthesized
acatgtctcattcaatatgc

SEQ ID NO: 485704 - DNA, 20 bp, Artificial Sequence
  chemically synthesized
tgattaataattcttgcata

SEQ ID NO: 485705 - DNA, 20 bp, Artificial Sequence
  chemically synthesized
gctatagctcttagaagtat

SEQ ID NO: 485706 - DNA, 20 bp, Artificial Sequence
  chemically synthesized
atggatattagatatatttc

SEQ ID NO: 485707 - DNA, 20 bp, Artificial Sequence
  chemically synthesized
atcttctctcccaaattaaa

SEQ ID NO: 485708 - DNA, 20 bp, Artificial Sequence
  chemically synthesized
tttgatatagctataaaaat

SEQ ID NO: 485709 - DNA, 20 bp, Artificial Sequence
  chemically synthesized
gggtaatatttaagttgtga

SEQ ID NO: 485710 - DNA, 20 bp, Artificial Sequence
  chemically synthesized
tcaagggtaatatttaagtt

SEQ ID NO: 485711 - DNA, 20 bp, Artificial Sequence
  chemically synthesized
tcaggttggagatatttctc

SEQ ID NO: 485712 - DNA, 20 bp, Artificial Sequence
  chemically synthesized
tctattcaagttagtgaagg

SEQ ID NO: 485713 - DNA, 20 bp, Artificial Sequence
  chemically synthesized
catatccttccttcactaac

SEQ ID NO: 485714 - DNA, 20 bp, Artificial Sequence
  chemically synthesized
ccttctataactaacattat

SEQ ID NO: 485715 - DNA, 20 bp, Artificial Sequence
  chemically synthesized
ttttcactgagcgcatgtag

SEQ ID NO: 485716 - DNA, 20 bp, Artificial Sequence
  chemically synthesized
tacatgcgctcagtgaaaag

SEQ ID NO: 485717 - DNA, 20 bp, Artificial Sequence
  chemically synthesized
gtcccagataattttttgtc

SEQ ID NO: 485718 - DNA, 20 bp, Artificial Sequence
  chemically synthesized
agtggctgtcctgtgcattg

SEQ ID NO: 485719 - DNA, 20 bp, Artificial Sequence
  chemically synthesized
tgtcctgtgcattgtaggat

SEQ ID NO: 485720 - DNA, 20 bp, Artificial Sequence
  chemically synthesized
gttgagcatgtctcaattaa

SEQ ID NO: 485721 - DNA, 20 bp, Artificial Sequence
  chemically synthesized
agcagctatttgagaggtgg

SEQ ID NO: 485722 - DNA, 20 bp, Artificial Sequence
  chemically synthesized
tctaagcagctatttgagag

SEQ ID NO: 485723 - DNA, 20 bp, Artificial Sequence
  chemically synthesized
ccacctctcaaatagctgct

SEQ ID NO: 485724 - DNA, 20 bp, Artificial Sequence
  chemically synthesized
gaggaatgagaaaaaaaaaa

SEQ ID NO: 485725 - DNA, 20 bp, Artificial Sequence
  chemically synthesized
tctcttaatttctacttctg

SEQ ID NO: 485726 - DNA, 20 bp, Artificial Sequence
  chemically synthesized
cataagtttgtggtttactt

SEQ ID NO: 485727 - DNA, 20 bp, Artificial Sequence
  chemically synthesized
ccacaaacttatggctgcca

SEQ ID NO: 485728 - DNA, 20 bp, Artificial Sequence
  chemically synthesized
aaatgacaacatctctgctg

SEQ ID NO: 485729 - DNA, 20 bp, Artificial Sequence
  chemically synthesized
caaaagtgtagatgcaagag

SEQ ID NO: 485730 - DNA, 20 bp, Artificial Sequence
  chemically synthesized
tggctcttaatgggagaatc

SEQ ID NO: 485731 - DNA, 20 bp, Artificial Sequence
  chemically synthesized
cagactatggctcttaatgg

SEQ ID NO: 485732 - DNA, 20 bp, Artificial Sequence
  chemically synthesized
atagtctgtttctccactcc

SEQ ID NO: 485733 - DNA, 20 bp, Artificial Sequence
  chemically synthesized
tgtttctccactccttgaat

SEQ ID NO: 485734 - DNA, 20 bp, Artificial Sequence
  chemically synthesized
acttgaccaatccatattca

SEQ ID NO: 485735 - DNA, 20 bp, Artificial Sequence
  chemically synthesized
aagcagaggcttaacaatgc

SEQ ID NO: 485736 - DNA, 20 bp, Artificial Sequence
  chemically synthesized
gcatagttccatagcggtgg

SEQ ID NO: 485737 - DNA, 20 bp, Artificial Sequence
  chemically synthesized
tatggaactatgctagcctg

SEQ ID NO: 485738 - DNA, 20 bp, Artificial Sequence
  chemically synthesized
agttgagacggtgtgggtga

SEQ ID NO: 485739 - DNA, 20 bp, Artificial Sequence
  chemically synthesized
tggttataagttgagacggt

SEQ ID NO: 485740 - DNA, 20 bp, Artificial Sequence
  chemically synthesized
caaaaagttataccagacat

SEQ ID NO: 485741 - DNA, 20 bp, Artificial Sequence
  chemically synthesized
tcatcaactaccagctgacc

SEQ ID NO: 485742 - DNA, 20 bp, Artificial Sequence
  chemically synthesized
taccagctgaccacgagtgc

SEQ ID NO: 485743 - DNA, 20 bp, Artificial Sequence
  chemically synthesized
gagtgcatgaatgagcacag

SEQ ID NO: 485744 - DNA, 20 bp, Artificial Sequence
  chemically synthesized
agcacagctgagtctagcaa

SEQ ID NO: 485745 - DNA, 20 bp, Artificial Sequence
  chemically synthesized
tcgatgaaccaagccccaag

SEQ ID NO: 485746 - DNA, 20 bp, Artificial Sequence
  chemically synthesized
accaagccccaagcagaatc

SEQ ID NO: 485747 - DNA, 20 bp, Artificial Sequence
  chemically synthesized
caaatgtagagacttaaaat

SEQ ID NO: 485748 - DNA, 20 bp, Artificial Sequence
  chemically synthesized
ttattttaagtctctacatt

SEQ ID NO: 485749 - DNA, 20 bp, Artificial Sequence
  chemically synthesized
caagtgtttaacaggtaaaa

SEQ ID NO: 485750 - DNA, 20 bp, Artificial Sequence
  chemically synthesized
ttaaacacttgtacgcaaaa

SEQ ID NO: 485751 - DNA, 20 bp, Artificial Sequence
  chemically synthesized
aatttctgtggtaatgggaa

SEQ ID NO: 485752 - DNA, 20 bp, Artificial Sequence
  chemically synthesized
ttccagctgtgttctctctg

SEQ ID NO: 485753 - DNA, 20 bp, Artificial Sequence
  chemically synthesized
gagaacacagctggaaaaga

SEQ ID NO: 485754 - DNA, 20 bp, Artificial Sequence
  chemically synthesized
ggagtctttaagttaaaatg

SEQ ID NO: 485755 - DNA, 20 bp, Artificial Sequence
  chemically synthesized
ctttaagttaaaatgtggaa

SEQ ID NO: 485756 - DNA, 20 bp, Artificial Sequence
  chemically synthesized
atgtggaatggaattccaca

SEQ ID NO: 485757 - DNA, 20 bp, Artificial Sequence
  chemically synthesized
tgtgaatcttccattctctg

SEQ ID NO: 485758 - DNA, 20 bp, Artificial Sequence
  chemically synthesized
tgacctcatagagtgactat

SEQ ID NO: 485759 - DNA, 20 bp, Artificial Sequence
  chemically synthesized
tgcctgatttattgacctca

SEQ ID NO: 485760 - DNA, 20 bp, Artificial Sequence
  chemically synthesized
atcaggcagccagcatttga

SEQ ID NO: 485761 - DNA, 20 bp, Artificial Sequence
  chemically synthesized
aaggtcttagtgcattaata

SEQ ID NO: 485762 - DNA, 20 bp, Artificial Sequence
  chemically synthesized
acctttgtatatgaaaaaag

SEQ ID NO: 485763 - DNA, 20 bp, Artificial Sequence
  chemically synthesized
taaagaccacgctattgatg

SEQ ID NO: 485764 - DNA, 20 bp, Artificial Sequence
  chemically synthesized
atcaattgcaaaactgatat

SEQ ID NO: 485765 - DNA, 20 bp, Artificial Sequence
  chemically synthesized
ggttatactcaaatggttat

SEQ ID NO: 485766 - DNA, 20 bp, Artificial Sequence
  chemically synthesized
aataaaatccatataaccat

SEQ ID NO: 485767 - DNA, 20 bp, Artificial Sequence
  chemically synthesized
taaggtgctcagaattttgg

SEQ ID NO: 485768 - DNA, 20 bp, Artificial Sequence
  chemically synthesized
caggagttttttaaggtgct

SEQ ID NO: 485769 - DNA, 20 bp, Artificial Sequence
  chemically synthesized
ctgagcaccttaaaaaactc

SEQ ID NO: 485770 - DNA, 20 bp, Artificial Sequence
  chemically synthesized
cagaataaattatttaattc

SEQ ID NO: 485771 - DNA, 20 bp, Artificial Sequence
  chemically synthesized
attaaataatttattctgat

SEQ ID NO: 485772 - DNA, 20 bp, Artificial Sequence
  chemically synthesized
ttgaataaacaaacccaaat

SEQ ID NO: 485773 - DNA, 20 bp, Artificial Sequence
  chemically synthesized
aggaactctattttaaaaaa

SEQ ID NO: 485774 - DNA, 20 bp, Artificial Sequence
  chemically synthesized
gtttattcaattttttaaaa

SEQ ID NO: 485775 - DNA, 20 bp, Artificial Sequence
  chemically synthesized
taaaatagagttcctcctac

SEQ ID NO: 485776 - DNA, 20 bp, Artificial Sequence
  chemically synthesized
attttgcttagttttcactg

SEQ ID NO: 485777 - DNA, 20 bp, Artificial Sequence
  chemically synthesized
gaggtaagcagtgttttcta

SEQ ID NO: 485778 - DNA, 20 bp, Artificial Sequence
  chemically synthesized
aaacaaataagagatttaga

SEQ ID NO: 485779 - DNA, 20 bp, Artificial Sequence
  chemically synthesized
gttttgaaagttgttatata

SEQ ID NO: 485780 - DNA, 20 bp, Artificial Sequence
  chemically synthesized
tgagggcctgacacatggta

SEQ ID NO: 485781 - DNA, 20 bp, Artificial Sequence
  chemically synthesized
atagcttatcatctcctctg

SEQ ID NO: 485782 - DNA, 20 bp, Artificial Sequence
  chemically synthesized
aagctatttgagataagtat

SEQ ID NO: 485783 - DNA, 20 bp, Artificial Sequence
  chemically synthesized
accaaaggtctgaaaaataa

SEQ ID NO: 485784 - DNA, 20 bp, Artificial Sequence
  chemically synthesized
tttgttgttgttttcacaat

SEQ ID NO: 485785 - DNA, 20 bp, Artificial Sequence
  chemically synthesized
gcaagttgcaatgtactaag

SEQ ID NO: 485786 - DNA, 20 bp, Artificial Sequence
  chemically synthesized
agttatataaattaatataa

SEQ ID NO: 485787 - DNA, 20 bp, Artificial Sequence
  chemically synthesized
actgtgatttacagtttcct

SEQ ID NO: 485788 - DNA, 20 bp, Artificial Sequence
  chemically synthesized
ttataattgatttgaaccaa

SEQ ID NO: 485789 - DNA, 20 bp, Artificial Sequence
  chemically synthesized
cctcatcataccactctggt

SEQ ID NO: 485790 - DNA, 20 bp, Artificial Sequence
  chemically synthesized
catgttttccctatccacac

SEQ ID NO: 485791 - DNA, 20 bp, Artificial Sequence
  chemically synthesized
gaagaagtattttaatttat

SEQ ID NO: 485792 - DNA, 20 bp, Artificial Sequence
  chemically synthesized
ttaagaagaaaggctctgag

SEQ ID NO: 485793 - DNA, 20 bp, Artificial Sequence
  chemically synthesized
tctgaggtgagtaattaata

SEQ ID NO: 485794 - DNA, 20 bp, Artificial Sequence
  chemically synthesized
aatcaggttaattgtttttg

SEQ ID NO: 485795 - DNA, 20 bp, Artificial Sequence
  chemically synthesized
aacctgattttaaaatgggc

SEQ ID NO: 485796 - DNA, 20 bp, Artificial Sequence
  chemically synthesized
ttccccgatgattgacgatg

SEQ ID NO: 485797 - DNA, 20 bp, Artificial Sequence
  chemically synthesized
agatattacctcacaaccat

SEQ ID NO: 485798 - DNA, 20 bp, Artificial Sequence
  chemically synthesized
agaaaataacatgtgctggc

SEQ ID NO: 485799 - DNA, 20 bp, Artificial Sequence
  chemically synthesized
aacacttctgcattgttggt

SEQ ID NO: 485800 - DNA, 20 bp, Artificial Sequence
  chemically synthesized
agttcctcaaaacataaaaa

SEQ ID NO: 485801 - DNA, 20 bp, Artificial Sequence
  chemically synthesized
ctatttttattttttgagga

SEQ ID NO: 485802 - DNA, 20 bp, Artificial Sequence
  chemically synthesized
cagtcctcaaaaaataaaaa

SEQ ID NO: 485803 - DNA, 20 bp, Artificial Sequence
  chemically synthesized
tacacccagaaatgggattg

SEQ ID NO: 485804 - DNA, 20 bp, Artificial Sequence
  chemically synthesized
ataatccagcaatcccattt

SEQ ID NO: 485805 - DNA, 20 bp, Artificial Sequence
  chemically synthesized
actaaccgtacacccagaaa

SEQ ID NO: 485806 - DNA, 20 bp, Artificial Sequence
  chemically synthesized
atttgaagtatggtttctta

SEQ ID NO: 485807 - DNA, 20 bp, Artificial Sequence
  chemically synthesized
aagaaaccatacttcaaatt

SEQ ID NO: 485808 - DNA, 20 bp, Artificial Sequence
  chemically synthesized
tgcaacccaatatgtcagaa

SEQ ID NO: 485809 - DNA, 20 bp, Artificial Sequence
  chemically synthesized
tgatactctcttctgacata

SEQ ID NO: 485810 - DNA, 20 bp, Artificial Sequence
  chemically synthesized
tgcagcatgatatttatcat

SEQ ID NO: 485811 - DNA, 20 bp, Artificial Sequence
  chemically synthesized
tcttgcaacacagtacatag

SEQ ID NO: 485812 - DNA, 20 bp, Artificial Sequence
  chemically synthesized
tcaacttatgatgggctgat

SEQ ID NO: 485813 - DNA, 20 bp, Artificial Sequence
  chemically synthesized
agatgctcattgatttacac

SEQ ID NO: 485814 - DNA, 20 bp, Artificial Sequence
  chemically synthesized
atgagcatctgtatatccaa

SEQ ID NO: 485815 - DNA, 20 bp, Artificial Sequence
  chemically synthesized
agatcctgtttttaattctt

SEQ ID NO: 485816 - DNA, 20 bp, Artificial Sequence
  chemically synthesized
atatccaaaagaattaaaaa

SEQ ID NO: 485817 - DNA, 20 bp, Artificial Sequence
  chemically synthesized
tgaattatgccgcagttaat

SEQ ID NO: 485818 - DNA, 20 bp, Artificial Sequence
  chemically synthesized
tacttcaatttttggctatt

SEQ ID NO: 485819 - DNA, 20 bp, Artificial Sequence
  chemically synthesized
aaatgtccattgattgataa

SEQ ID NO: 485820 - DNA, 20 bp, Artificial Sequence
  chemically synthesized
aaatgtggtataggacacaa

SEQ ID NO: 485821 - DNA, 20 bp, Artificial Sequence
  chemically synthesized
atttccttctttttttgtgg

SEQ ID NO: 485822 - DNA, 20 bp, Artificial Sequence
  chemically synthesized
acccatgttgtagcatagga

SEQ ID NO: 485823 - DNA, 20 bp, Artificial Sequence
  chemically synthesized
atcctttcctatgctacaac

SEQ ID NO: 485824 - DNA, 20 bp, Artificial Sequence
  chemically synthesized
cactctactttctgtctcta

SEQ ID NO: 485825 - DNA, 20 bp, Artificial Sequence
  chemically synthesized
aactctttagagacagaaag

SEQ ID NO: 485826 - DNA, 20 bp, Artificial Sequence
  chemically synthesized
agtggtcatattgccagtgc

SEQ ID NO: 485827 - DNA, 20 bp, Artificial Sequence
  chemically synthesized
ggagcaatgggagctcttca

SEQ ID NO: 485828 - DNA, 20 bp, Artificial Sequence
  chemically synthesized
tgggagctcttcagtgggtt

SEQ ID NO: 485829 - DNA, 20 bp, Artificial Sequence
  chemically synthesized
tcttcagtgggtttggagtt

SEQ ID NO: 485830 - DNA, 20 bp, Artificial Sequence
  chemically synthesized
attgttattcaacagatctc

SEQ ID NO: 485831 - DNA, 20 bp, Artificial Sequence
  chemically synthesized
gaaaacattctagagatctg

SEQ ID NO: 485832 - DNA, 20 bp, Artificial Sequence
  chemically synthesized
gctggcaaagtttgtattat

SEQ ID NO: 485833 - DNA, 20 bp, Artificial Sequence
  chemically synthesized
ttaaattatactttaagttc

SEQ ID NO: 485834 - DNA, 20 bp, Artificial Sequence
  chemically synthesized
taagttctgggatacatgtg

SEQ ID NO: 485835 - DNA, 20 bp, Artificial Sequence
  chemically synthesized
ctaatgtagatgaagggttg

SEQ ID NO: 485836 - DNA, 20 bp, Artificial Sequence
  chemically synthesized
agaaatacctaatgtagatg

SEQ ID NO: 485837 - DNA, 20 bp, Artificial Sequence
  chemically synthesized
ggggattggggggcagaggg

SEQ ID NO: 485838 - DNA, 20 bp, Artificial Sequence
  chemically synthesized
ggaacatcacacaccagttg

SEQ ID NO: 485839 - DNA, 20 bp, Artificial Sequence
  chemically synthesized
tcatcgttcaactcccactt

SEQ ID NO: 485840 - DNA, 20 bp, Artificial Sequence
  chemically synthesized
gcatgttctcactcataagt

SEQ ID NO: 485841 - DNA, 20 bp, Artificial Sequence
  chemically synthesized
tgttcctgtgttagtttgct

SEQ ID NO: 485842 - DNA, 20 bp, Artificial Sequence
  chemically synthesized
ttcgtgtcctttgtaaggac

SEQ ID NO: 485843 - DNA, 20 bp, Artificial Sequence
  chemically synthesized
aatactatgcagccataaaa

SEQ ID NO: 485844 - DNA, 20 bp, Artificial Sequence
  chemically synthesized
aatgtggcacatatacacca

SEQ ID NO: 485845 - DNA, 20 bp, Artificial Sequence
  chemically synthesized
aaatgtccatcaataataga

SEQ ID NO: 485846 - DNA, 20 bp, Artificial Sequence
  chemically synthesized
agtctattattgatggacat

SEQ ID NO: 485847 - DNA, 20 bp, Artificial Sequence
  chemically synthesized
gtgtgcatgtgtctttacag

SEQ ID NO: 485848 - DNA, 20 bp, Artificial Sequence
  chemically synthesized
gtagaatgatttataatcct

SEQ ID NO: 485849 - DNA, 20 bp, Artificial Sequence
  chemically synthesized
cattactgggtatataccca

SEQ ID NO: 485850 - DNA, 20 bp, Artificial Sequence
  chemically synthesized
tttgggtatatacccagtaa

SEQ ID NO: 485851 - DNA, 20 bp, Artificial Sequence
  chemically synthesized
ttaactcagccatcccatta

SEQ ID NO: 485852 - DNA, 20 bp, Artificial Sequence
  chemically synthesized
tatacccagtaatgggatgg

SEQ ID NO: 485853 - DNA, 20 bp, Artificial Sequence
  chemically synthesized
tttctggttgtagatccttg

SEQ ID NO: 485854 - DNA, 20 bp, Artificial Sequence
  chemically synthesized
agaccgtgtggcgattcctc

SEQ ID NO: 485855 - DNA, 20 bp, Artificial Sequence
  chemically synthesized
tttacactgttggtgggagt

SEQ ID NO: 485856 - DNA, 20 bp, Artificial Sequence
  chemically synthesized
aacgcttttacactgttggt

SEQ ID NO: 485857 - DNA, 20 bp, Artificial Sequence
  chemically synthesized
aggaaacaacagatgctgga

SEQ ID NO: 485858 - DNA, 20 bp, Artificial Sequence
  chemically synthesized
cataaatgtcttcttttgag

SEQ ID NO: 485859 - DNA, 20 bp, Artificial Sequence
  chemically synthesized
accccatcaaaaagtggggg

SEQ ID NO: 485860 - DNA, 20 bp, Artificial Sequence
  chemically synthesized
atccttcccccactttttga

SEQ ID NO: 485861 - DNA, 20 bp, Artificial Sequence
  chemically synthesized
aaccacattttattttaaaa

SEQ ID NO: 485862 - DNA, 20 bp, Artificial Sequence
  chemically synthesized
aaagggaattcatagaccag

SEQ ID NO: 485863 - DNA, 20 bp, Artificial Sequence
  chemically synthesized
gtccacaattcacctggtct

SEQ ID NO: 485864 - DNA, 20 bp, Artificial Sequence
  chemically synthesized
ggactttttaaaattccctt

SEQ ID NO: 485865 - DNA, 20 bp, Artificial Sequence
  chemically synthesized
taaatctccttaactcagaa

SEQ ID NO: 485866 - DNA, 20 bp, Artificial Sequence
  chemically synthesized
gagatttaaaagagattttt

SEQ ID NO: 485867 - DNA, 20 bp, Artificial Sequence
  chemically synthesized
atcagaaccattggaattta

SEQ ID NO: 485868 - DNA, 20 bp, Artificial Sequence
  chemically synthesized
ccttaatatatcagaaccat

SEQ ID NO: 485869 - DNA, 20 bp, Artificial Sequence
  chemically synthesized
attgcaatgaggatgcaagt

SEQ ID NO: 485870 - DNA, 20 bp, Artificial Sequence
  chemically synthesized
taccccacaaatattgcaat

SEQ ID NO: 485871 - DNA, 20 bp, Artificial Sequence
  chemically synthesized
catcctcattgcaatatttg

SEQ ID NO: 485872 - DNA, 20 bp, Artificial Sequence
  chemically synthesized
tgcaatatttgtggggtaag

SEQ ID NO: 485873 - DNA, 20 bp, Artificial Sequence
  chemically synthesized
tatgccagtgcctctctgta

SEQ ID NO: 485874 - DNA, 20 bp, Artificial Sequence
  chemically synthesized
gcttcatcaagatcctcttc

SEQ ID NO: 485875 - DNA, 20 bp, Artificial Sequence
  chemically synthesized
tgggtgcatcgactccagaa

SEQ ID NO: 485876 - DNA, 20 bp, Artificial Sequence
  chemically synthesized
ctaggaataatattggtagt

SEQ ID NO: 485877 - DNA, 20 bp, Artificial Sequence
  chemically synthesized
gcaaccacaccacaaatact

SEQ ID NO: 485878 - DNA, 20 bp, Artificial Sequence
  chemically synthesized
tggtgtggttgcattgactc

SEQ ID NO: 485879 - DNA, 20 bp, Artificial Sequence
  chemically synthesized
ttttgtagatattattattc

SEQ ID NO: 485880 - DNA, 20 bp, Artificial Sequence
  chemically synthesized
cagaataataatatctacaa

SEQ ID NO: 485881 - DNA, 20 bp, Artificial Sequence
  chemically synthesized
ctggagctgggatggtcttt

SEQ ID NO: 485882 - DNA, 20 bp, Artificial Sequence
  chemically synthesized
tgtgacagggacactggagc

SEQ ID NO: 485883 - DNA, 20 bp, Artificial Sequence
  chemically synthesized
gcctcagtagcaactgcagt

SEQ ID NO: 485884 - DNA, 20 bp, Artificial Sequence
  chemically synthesized
tgtctcagagactgttgcca

SEQ ID NO: 485885 - DNA, 20 bp, Artificial Sequence
  chemically synthesized
ttttttcaggcattcgatag

SEQ ID NO: 485886 - DNA, 20 bp, Artificial Sequence
  chemically synthesized
ctttaaaaaatattctacta

SEQ ID NO: 485887 - DNA, 20 bp, Artificial Sequence
  chemically synthesized
gtggtagaacacctgaggtc

SEQ ID NO: 485888 - DNA, 20 bp, Artificial Sequence
  chemically synthesized
ttttgtacttttagtagaga

SEQ ID NO: 485889 - DNA, 20 bp, Artificial Sequence
  chemically synthesized
gcctcagcctcccaagtagc

SEQ ID NO: 485890 - DNA, 20 bp, Artificial Sequence
  chemically synthesized
tacttgggaggctgaggcag

SEQ ID NO: 485891 - DNA, 20 bp, Artificial Sequence
  chemically synthesized
tcttgctttgtctcccaggc

SEQ ID NO: 485892 - DNA, 20 bp, Artificial Sequence
  chemically synthesized
tccagcctgggagacaaagc

SEQ ID NO: 485893 - DNA, 20 bp, Artificial Sequence
  chemically synthesized
actttttatttatttattta

SEQ ID NO: 485894 - DNA, 20 bp, Artificial Sequence
  chemically synthesized
tcacatgttatataattcaa

SEQ ID NO: 485895 - DNA, 20 bp, Artificial Sequence
  chemically synthesized
tcattttttagagcattcaa

SEQ ID NO: 485896 - DNA, 20 bp, Artificial Sequence
  chemically synthesized
aaaatgacaaaaagtatgca

SEQ ID NO: 485897 - DNA, 20 bp, Artificial Sequence
  chemically synthesized
ataaagtagttttacactcc

SEQ ID NO: 485898 - DNA, 20 bp, Artificial Sequence
  chemically synthesized
ttgaaactcaaatataccca

SEQ ID NO: 485899 - DNA, 20 bp, Artificial Sequence
  chemically synthesized
tttacactccttgggtatat

SEQ ID NO: 485900 - DNA, 20 bp, Artificial Sequence
  chemically synthesized
tttgagtttcaatgtatcat

SEQ ID NO: 485901 - DNA, 20 bp, Artificial Sequence
  chemically synthesized
cagttgaatttgtcaagctc

SEQ ID NO: 485902 - DNA, 20 bp, Artificial Sequence
  chemically synthesized
ggagttcaagacttcagcag

SEQ ID NO: 485903 - DNA, 20 bp, Artificial Sequence
  chemically synthesized
ttccaaggtcattatgaaga

SEQ ID NO: 485904 - DNA, 20 bp, Artificial Sequence
  chemically synthesized
gtgactgtattgaactaaac

SEQ ID NO: 485905 - DNA, 20 bp, Artificial Sequence
  chemically synthesized
taaacttgagttttaacgtt

SEQ ID NO: 485906 - DNA, 20 bp, Artificial Sequence
  chemically synthesized
tctgggtcagtaaacatgtt

SEQ ID NO: 485907 - DNA, 20 bp, Artificial Sequence
  chemically synthesized
agaatttgagatggtttggc

SEQ ID NO: 485908 - DNA, 20 bp, Artificial Sequence
  chemically synthesized
ttacctttcatacgttcaaa

SEQ ID NO: 485909 - DNA, 20 bp, Artificial Sequence
  chemically synthesized
tacttcctattgtcttggac

SEQ ID NO: 485910 - DNA, 20 bp, Artificial Sequence
  chemically synthesized
tcattgtcttaatccttttg

SEQ ID NO: 485911 - DNA, 20 bp, Artificial Sequence
  chemically synthesized
tgtcttaatccttttgatga

SEQ ID NO: 485912 - DNA, 20 bp, Artificial Sequence
  chemically synthesized
attttaaacccattcatcaa

SEQ ID NO: 485913 - DNA, 20 bp, Artificial Sequence
  chemically synthesized
tgatgaatgggtttaaaatt

SEQ ID NO: 485914 - DNA, 20 bp, Artificial Sequence
  chemically synthesized
ggtttaaaattaagagtgta

SEQ ID NO: 485915 - DNA, 20 bp, Artificial Sequence
  chemically synthesized
atctttctgaataaacagag

SEQ ID NO: 485916 - DNA, 20 bp, Artificial Sequence
  chemically synthesized
cacagatctttctgaataaa

SEQ ID NO: 485917 - DNA, 20 bp, Artificial Sequence
  chemically synthesized
atacagcttcacagatcttt

SEQ ID NO: 485918 - DNA, 20 bp, Artificial Sequence
  chemically synthesized
ttatcttagccctgatctga

SEQ ID NO: 485919 - DNA, 20 bp, Artificial Sequence
  chemically synthesized
gatttactgattgtttaaaa

SEQ ID NO: 485920 - DNA, 20 bp, Artificial Sequence
  chemically synthesized
atcatatgttaggccacaaa

SEQ ID NO: 485921 - DNA, 20 bp, Artificial Sequence
  chemically synthesized
ctaacatatgatctaccctg

SEQ ID NO: 485922 - DNA, 20 bp, Artificial Sequence
  chemically synthesized
gtgcacaagaaacaattctt

SEQ ID NO: 485923 - DNA, 20 bp, Artificial Sequence
  chemically synthesized
ttgtttcttgtgcacttgat

SEQ ID NO: 485924 - DNA, 20 bp, Artificial Sequence
  chemically synthesized
tacatctcatctaacagcag

SEQ ID NO: 485925 - DNA, 20 bp, Artificial Sequence
  chemically synthesized
atccacattaaaaaatcaat

SEQ ID NO: 485926 - DNA, 20 bp, Artificial Sequence
  chemically synthesized
attcttattgattttttaat

SEQ ID NO: 485927 - DNA, 20 bp, Artificial Sequence
  chemically synthesized
tgtggattttctgtctattg

SEQ ID NO: 485928 - DNA, 20 bp, Artificial Sequence
  chemically synthesized
tttctgtctattgttgaatt

SEQ ID NO: 485929 - DNA, 20 bp, Artificial Sequence
  chemically synthesized
tatatttaggtactccaatg

SEQ ID NO: 485930 - DNA, 20 bp, Artificial Sequence
  chemically synthesized
aatatatatgcacccaacat

SEQ ID NO: 485931 - DNA, 20 bp, Artificial Sequence
  chemically synthesized
acaattgttataccttcttg

SEQ ID NO: 485932 - DNA, 20 bp, Artificial Sequence
  chemically synthesized
aggtcattaaataatgataa

SEQ ID NO: 485933 - DNA, 20 bp, Artificial Sequence
  chemically synthesized
aatggaaaccaaaagagaat

SEQ ID NO: 485934 - DNA, 20 bp, Artificial Sequence
  chemically synthesized
catgcaaatggaaaccaaaa

SEQ ID NO: 485935 - DNA, 20 bp, Artificial Sequence
  chemically synthesized
catgtgtcctaaaagatgac

SEQ ID NO: 485936 - DNA, 20 bp, Artificial Sequence
  chemically synthesized
ctcttatgggcagcatgtag

SEQ ID NO: 485937 - DNA, 20 bp, Artificial Sequence
  chemically synthesized
tctaaagatagagtggccaa

SEQ ID NO: 485938 - DNA, 20 bp, Artificial Sequence
  chemically synthesized
taaattcaccagtctaaaga

SEQ ID NO: 485939 - DNA, 20 bp, Artificial Sequence
  chemically synthesized
gccactctatctttagactg

SEQ ID NO: 485940 - DNA, 20 bp, Artificial Sequence
  chemically synthesized
aatatttactttgaatgtaa

SEQ ID NO: 485941 - DNA, 20 bp, Artificial Sequence
  chemically synthesized
cctacctatcaatatttact

SEQ ID NO: 485942 - DNA, 20 bp, Artificial Sequence
  chemically synthesized
caaagtaaatattgataggt

SEQ ID NO: 485943 - DNA, 20 bp, Artificial Sequence
  chemically synthesized
aaaaaaaggcatatagaaca

SEQ ID NO: 485944 - DNA, 20 bp, Artificial Sequence
  chemically synthesized
tatacaaaaggtaaaaagta

SEQ ID NO: 485945 - DNA, 20 bp, Artificial Sequence
  chemically synthesized
cttttctttacatcttacgt

SEQ ID NO: 485946 - DNA, 20 bp, Artificial Sequence
  chemically synthesized
ggattagggaagtaagcgtg

SEQ ID NO: 485947 - DNA, 20 bp, Artificial Sequence
  chemically synthesized
tgacattgaaattacaaaat

SEQ ID NO: 485948 - DNA, 20 bp, Artificial Sequence
  chemically synthesized
tattgtagctataagcacat

SEQ ID NO: 485949 - DNA, 20 bp, Artificial Sequence
  chemically synthesized
ctataagcacattgggatgt

SEQ ID NO: 485950 - DNA, 20 bp, Artificial Sequence
  chemically synthesized
ttaactttaccttggaataa

SEQ ID NO: 485951 - DNA, 20 bp, Artificial Sequence
  chemically synthesized
ctttgtaattaactttacct

SEQ ID NO: 485952 - DNA, 20 bp, Artificial Sequence
  chemically synthesized
gtaaagttaattacaaagtc

SEQ ID NO: 485953 - DNA, 20 bp, Artificial Sequence
  chemically synthesized
aaaaaagaaacatcattttt

SEQ ID NO: 485954 - DNA, 20 bp, Artificial Sequence
  chemically synthesized
tatctttttgttttaaaata

SEQ ID NO: 485955 - DNA, 20 bp, Artificial Sequence
  chemically synthesized
aaacaacattaactcctatc

SEQ ID NO: 485956 - DNA, 20 bp, Artificial Sequence
  chemically synthesized
tagtttgataaaccctagat

SEQ ID NO: 485957 - DNA, 20 bp, Artificial Sequence
  chemically synthesized
ctacagaaaacagaaaggaa

SEQ ID NO: 485958 - DNA, 20 bp, Artificial Sequence
  chemically synthesized
aactatacatgtgcatagtt

SEQ ID NO: 485959 - DNA, 20 bp, Artificial Sequence
  chemically synthesized
ccatttacagggcaaaaatg

SEQ ID NO: 485960 - DNA, 20 bp, Artificial Sequence
  chemically synthesized
tttgccctgtaaatggtgga

SEQ ID NO: 485961 - DNA, 20 bp, Artificial Sequence
  chemically synthesized
agtatagcataatcatgcct

SEQ ID NO: 485962 - DNA, 20 bp, Artificial Sequence
  chemically synthesized
cctaatgtatatattttctg

SEQ ID NO: 485963 - DNA, 20 bp, Artificial Sequence
  chemically synthesized
accaatttccaaagagaaag

SEQ ID NO: 485964 - DNA, 20 bp, Artificial Sequence
  chemically synthesized
acttttacgtcagattgaat

SEQ ID NO: 485965 - DNA, 20 bp, Artificial Sequence
  chemically synthesized
aattccacttttacgtcaga

SEQ ID NO: 485966 - DNA, 20 bp, Artificial Sequence
  chemically synthesized
cattcaatctgacgtaaaag

SEQ ID NO: 485967 - DNA, 20 bp, Artificial Sequence
  chemically synthesized
tcagagactgtattgctaaa

SEQ ID NO: 485968 - DNA, 20 bp, Artificial Sequence
  chemically synthesized
cagataaaaccataacaagt

SEQ ID NO: 485969 - DNA, 20 bp, Artificial Sequence
  chemically synthesized
ttttgaaaatagatgcatga

SEQ ID NO: 485970 - DNA, 20 bp, Artificial Sequence
  chemically synthesized
aaatgatattttggtgatta

SEQ ID NO: 485971 - DNA, 20 bp, Artificial Sequence
  chemically synthesized
gatttattattatgataaaa

SEQ ID NO: 485972 - DNA, 20 bp, Artificial Sequence
  chemically synthesized
cagatgtagcatctatggtt

SEQ ID NO: 485973 - DNA, 20 bp, Artificial Sequence
  chemically synthesized
ctggtaatattaagttggga

SEQ ID NO: 485974 - DNA, 20 bp, Artificial Sequence
  chemically synthesized
ttaaaccaaggcagaaaagg

SEQ ID NO: 485975 - DNA, 20 bp, Artificial Sequence
  chemically synthesized
tctcttgttggctatggttt

SEQ ID NO: 485976 - DNA, 20 bp, Artificial Sequence
  chemically synthesized
ggattgggaattaataaacc

SEQ ID NO: 485977 - DNA, 20 bp, Artificial Sequence
  chemically synthesized
tgttaaaagatcactggatt

SEQ ID NO: 485978 - DNA, 20 bp, Artificial Sequence
  chemically synthesized
caggcactgttaaaagatca

SEQ ID NO: 485979 - DNA, 20 bp, Artificial Sequence
  chemically synthesized
agtgacaaaatcaacttatt

SEQ ID NO: 485980 - DNA, 20 bp, Artificial Sequence
  chemically synthesized
tattacaatattactgaatt

SEQ ID NO: 485981 - DNA, 20 bp, Artificial Sequence
  chemically synthesized
aaaattatattacaatatta

SEQ ID NO: 485982 - DNA, 20 bp, Artificial Sequence
  chemically synthesized
aaaatgtctactacatgttt

SEQ ID NO: 485983 - DNA, 20 bp, Artificial Sequence
  chemically synthesized
aagtgttgtctgtgaatcaa

SEQ ID NO: 485984 - DNA, 20 bp, Artificial Sequence
  chemically synthesized
aaccacctcaagtgttgtct

SEQ ID NO: 485985 - DNA, 20 bp, Artificial Sequence
  chemically synthesized
agacaacacttgaggtggtt

SEQ ID NO: 485986 - DNA, 20 bp, Artificial Sequence
  chemically synthesized
cttgaggtggttgtggattt

SEQ ID NO: 485987 - DNA, 20 bp, Artificial Sequence
  chemically synthesized
agaagttctcaacctgtgtg

SEQ ID NO: 485988 - DNA, 20 bp, Artificial Sequence
  chemically synthesized
acttttaaagatatttggtt

SEQ ID NO: 485989 - DNA, 20 bp, Artificial Sequence
  chemically synthesized
aaagtcgtactctttactct

SEQ ID NO: 485990 - DNA, 20 bp, Artificial Sequence
  chemically synthesized
tgaaatcaactctaagagta

SEQ ID NO: 485991 - DNA, 20 bp, Artificial Sequence
  chemically synthesized
atgaaactgaaatcaactct

SEQ ID NO: 485992 - DNA, 20 bp, Artificial Sequence
  chemically synthesized
gatatctcaatcatttgaca

SEQ ID NO: 485993 - DNA, 20 bp, Artificial Sequence
  chemically synthesized
tataaaaatatttagacaat

SEQ ID NO: 485994 - DNA, 20 bp, Artificial Sequence
  chemically synthesized
caactaaaggttgtcaatat

SEQ ID NO: 485995 - DNA, 20 bp, Artificial Sequence
  chemically synthesized
agaaaagcactttggaatgc

SEQ ID NO: 485996 - DNA, 20 bp, Artificial Sequence
  chemically synthesized
tctcactcagaaaagcactt

SEQ ID NO: 485997 - DNA, 20 bp, Artificial Sequence
  chemically synthesized
tcgcattccaaagtgctttt

SEQ ID NO: 485998 - DNA, 20 bp, Artificial Sequence
  chemically synthesized
aagtgcttttctgagtgaga

SEQ ID NO: 485999 - DNA, 20 bp, Artificial Sequence
  chemically synthesized
cacagtcagaactagtgtgc

SEQ ID NO: 486000 - DNA, 20 bp, Artificial Sequence
  chemically synthesized
ggggctacagatatgtaaag

SEQ ID NO: 486001 - DNA, 20 bp, Artificial Sequence
  chemically synthesized
acatatctgtagcccctgac

SEQ ID NO: 486002 - DNA, 20 bp, Artificial Sequence
  chemically synthesized
gaatatctatcttcaggcaa

SEQ ID NO: 486003 - DNA, 20 bp, Artificial Sequence
  chemically synthesized
atctatcttcaggcaagtga

SEQ ID NO: 486004 - DNA, 20 bp, Artificial Sequence
  chemically synthesized
aacatctgtgatgatactgg

SEQ ID NO: 486005 - DNA, 20 bp, Artificial Sequence
  chemically synthesized
tgtgatgatactggtaggat

SEQ ID NO: 486006 - DNA, 20 bp, Artificial Sequence
  chemically synthesized
aggtattggatatggtcata

SEQ ID NO: 486007 - DNA, 20 bp, Artificial Sequence
  chemically synthesized
tatatgaccatatccaatac

SEQ ID NO: 486008 - DNA, 20 bp, Artificial Sequence
  chemically synthesized
agtggaagagaattcaggta

SEQ ID NO: 486009 - DNA, 20 bp, Artificial Sequence
  chemically synthesized
tttctgtaagtaaagtggaa

SEQ ID NO: 486010 - DNA, 20 bp, Artificial Sequence
  chemically synthesized
tttgacacaatgtgtacttt

SEQ ID NO: 486011 - DNA, 20 bp, Artificial Sequence
  chemically synthesized
ttgtaaagagtgaaagcata

SEQ ID NO: 486012 - DNA, 20 bp, Artificial Sequence
  chemically synthesized
aaggataaatttattttgta

SEQ ID NO: 486013 - DNA, 20 bp, Artificial Sequence
  chemically synthesized
aaaaaagtctaagaaacaac

SEQ ID NO: 486014 - DNA, 20 bp, Artificial Sequence
  chemically synthesized
agacattagtaaggaataaa

SEQ ID NO: 486015 - DNA, 20 bp, Artificial Sequence
  chemically synthesized
tgtgatcgtagacattagta

SEQ ID NO: 486016 - DNA, 20 bp, Artificial Sequence
  chemically synthesized
agaagactgtatgggttaac

SEQ ID NO: 486017 - DNA, 20 bp, Artificial Sequence
  chemically synthesized
gagtttggaaagaagactgt

SEQ ID NO: 486018 - DNA, 20 bp, Artificial Sequence
  chemically synthesized
tgtaagactgaaatcaacat

SEQ ID NO: 486019 - DNA, 20 bp, Artificial Sequence
  chemically synthesized
ccataatttccttccaattg

SEQ ID NO: 486020 - DNA, 20 bp, Artificial Sequence
  chemically synthesized
aagattttaaagttcagcat

SEQ ID NO: 486021 - DNA, 20 bp, Artificial Sequence
  chemically synthesized
gactcttaggcatacctctt

SEQ ID NO: 486022 - DNA, 20 bp, Artificial Sequence
  chemically synthesized
tattctcaagaggtatgcct

SEQ ID NO: 486023 - DNA, 20 bp, Artificial Sequence
  chemically synthesized
atgatctgatagtcttactt

SEQ ID NO: 486024 - DNA, 20 bp, Artificial Sequence
  chemically synthesized
atagtcttacttaggagtta

SEQ ID NO: 486025 - DNA, 20 bp, Artificial Sequence
  chemically synthesized
tgggaaactactgggcaggg

SEQ ID NO: 486026 - DNA, 20 bp, Artificial Sequence
  chemically synthesized
gtactgggaaactactgggc

SEQ ID NO: 486027 - DNA, 20 bp, Artificial Sequence
  chemically synthesized
gcattgatcctattgggtaa

SEQ ID NO: 486028 - DNA, 20 bp, Artificial Sequence
  chemically synthesized
agaaccacccaattacccaa

SEQ ID NO: 486029 - DNA, 20 bp, Artificial Sequence
  chemically synthesized
gtttaatagcattgatccta

SEQ ID NO: 486030 - DNA, 20 bp, Artificial Sequence
  chemically synthesized
gcaatattttatcacttcat

SEQ ID NO: 486031 - DNA, 20 bp, Artificial Sequence
  chemically synthesized
tttgctttagtgcagataat

SEQ ID NO: 486032 - DNA, 20 bp, Artificial Sequence
  chemically synthesized
gcaaaatcttccaaacataa

SEQ ID NO: 486033 - DNA, 20 bp, Artificial Sequence
  chemically synthesized
caaaaggaaataataggttc

SEQ ID NO: 486034 - DNA, 20 bp, Artificial Sequence
  chemically synthesized
tctgtcgtgtctttgataat

SEQ ID NO: 486035 - DNA, 20 bp, Artificial Sequence
  chemically synthesized
ataatctgaatttagtctaa

SEQ ID NO: 486036 - DNA, 20 bp, Artificial Sequence
  chemically synthesized
ctttcatttaagtattatta

SEQ ID NO: 486037 - DNA, 20 bp, Artificial Sequence
  chemically synthesized
gaataattactaacttagta

SEQ ID NO: 486038 - DNA, 20 bp, Artificial Sequence
  chemically synthesized
atacctacttagtaacgaag

SEQ ID NO: 486039 - DNA, 20 bp, Artificial Sequence
  chemically synthesized
ccctgttgcgagttccacaa

SEQ ID NO: 486040 - DNA, 20 bp, Artificial Sequence
  chemically synthesized
ccctttgtggaactcgcaac

SEQ ID NO: 486041 - DNA, 20 bp, Artificial Sequence
  chemically synthesized
gtaaataaggcacccctgtt

SEQ ID NO: 486042 - DNA, 20 bp, Artificial Sequence
  chemically synthesized
gctctcaactcctcactgga

SEQ ID NO: 486043 - DNA, 20 bp, Artificial Sequence
  chemically synthesized
cttgcacactccctccagtg

SEQ ID NO: 486044 - DNA, 20 bp, Artificial Sequence
  chemically synthesized
caagcaaacgaggtgggaac

SEQ ID NO: 486045 - DNA, 20 bp, Artificial Sequence
  chemically synthesized
aacacaccctctggggcttc

SEQ ID NO: 486046 - DNA, 20 bp, Artificial Sequence
  chemically synthesized
ctgcgacccctgaagcccca

SEQ ID NO: 486047 - DNA, 20 bp, Artificial Sequence
  chemically synthesized
tgttaacgcctaagctgtcc

SEQ ID NO: 486048 - DNA, 20 bp, Artificial Sequence
  chemically synthesized
agagctcaggagccacaagt

SEQ ID NO: 486049 - DNA, 20 bp, Artificial Sequence
  chemically synthesized
gaggtcacatgaacaaattg

SEQ ID NO: 486050 - DNA, 20 bp, Artificial Sequence
  chemically synthesized
attgaaggattgtaaatgtg

SEQ ID NO: 486051 - DNA, 20 bp, Artificial Sequence
  chemically synthesized
gtgggaaggggagctgaaaa

SEQ ID NO: 486052 - DNA, 20 bp, Artificial Sequence
  chemically synthesized
aggggagctgaaaaggggat

SEQ ID NO: 486053 - DNA, 20 bp, Artificial Sequence
  chemically synthesized
aatcttcccctgaagtccag

SEQ ID NO: 486054 - DNA, 20 bp, Artificial Sequence
  chemically synthesized
ttgatggcataactttagag

SEQ ID NO: 486055 - DNA, 20 bp, Artificial Sequence
  chemically synthesized
gctgtagtcctgtctaccag

SEQ ID NO: 486056 - DNA, 20 bp, Artificial Sequence
  chemically synthesized
tcctgtctaccagctgagtc

SEQ ID NO: 486057 - DNA, 20 bp, Artificial Sequence
  chemically synthesized
gtctggggtttttataggca

SEQ ID NO: 486058 - DNA, 20 bp, Artificial Sequence
  chemically synthesized
gggtttttataggcacagga

SEQ ID NO: 486059 - DNA, 20 bp, Artificial Sequence
  chemically synthesized
tttataggcacaggatgggg

SEQ ID NO: 486060 - DNA, 20 bp, Artificial Sequence
  chemically synthesized
ggatggggtggggtggggcc

SEQ ID NO: 486061 - DNA, 20 bp, Artificial Sequence
  chemically synthesized
ttatatcccagttttcctgc

SEQ ID NO: 486062 - DNA, 20 bp, Artificial Sequence
  chemically synthesized
caacattcgagcaggaaaac

SEQ ID NO: 486063 - DNA, 20 bp, Artificial Sequence
  chemically synthesized
ggtttcaggctttttggctt

SEQ ID NO: 486064 - DNA, 20 bp, Artificial Sequence
  chemically synthesized
caggctttttggcttgaggg

SEQ ID NO: 486065 - DNA, 20 bp, Artificial Sequence
  chemically synthesized
agagaagctctaggcagaaa

SEQ ID NO: 486066 - DNA, 20 bp, Artificial Sequence
  chemically synthesized
cctcctgccgctatcagtac

SEQ ID NO: 486067 - DNA, 20 bp, Artificial Sequence
  chemically synthesized
aggtgctcctcaacgtacaa

SEQ ID NO: 486068 - DNA, 20 bp, Artificial Sequence
  chemically synthesized
tatgatgttttcaacgtatg

SEQ ID NO: 486069 - DNA, 20 bp, Artificial Sequence
  chemically synthesized
tatgatgttttcaacttatg

SEQ ID NO: 486070 - DNA, 20 bp, Artificial Sequence
  chemically synthesized
tgaacatctcatgtaattta

SEQ ID NO: 486071 - DNA, 20 bp, Artificial Sequence
  chemically synthesized
atgaaaagcagaacagttgt

SEQ ID NO: 486072 - DNA, 20 bp, Artificial Sequence
  chemically synthesized
tacttgaagtatgatttcta

SEQ ID NO: 486073 - DNA, 20 bp, Artificial Sequence
  chemically synthesized
tgatttacaatggttcggct

SEQ ID NO: 486074 - DNA, 20 bp, Artificial Sequence
  chemically synthesized
gagaaataaagaaatataca

SEQ ID NO: 486075 - DNA, 20 bp, Artificial Sequence
  chemically synthesized
gttcactgtttaataaaaat

SEQ ID NO: 486076 - DNA, 20 bp, Artificial Sequence
  chemically synthesized
aagggcaagtgctgatttct

SEQ ID NO: 486077 - DNA, 20 bp, Artificial Sequence
  chemically synthesized
gtgctaaaagctttactctt

SEQ ID NO: 486078 - DNA, 20 bp, Artificial Sequence
  chemically synthesized
tttcttagcatttaactcta

SEQ ID NO: 486079 - DNA, 20 bp, Artificial Sequence
  chemically synthesized
agattttttttttcaagata

SEQ ID NO: 486080 - DNA, 20 bp, Artificial Sequence
  chemically synthesized
ggactggtttagactaaaac

SEQ ID NO: 486081 - DNA, 20 bp, Artificial Sequence
  chemically synthesized
aatagagcaataagtccaag

SEQ ID NO: 486082 - DNA, 20 bp, Artificial Sequence
  chemically synthesized
gtttatctttcagaaaggat

SEQ ID NO: 486083 - DNA, 20 bp, Artificial Sequence
  chemically synthesized
gaggtagtttatctttcaga

SEQ ID NO: 486084 - DNA, 20 bp, Artificial Sequence
  chemically synthesized
tagtatattactattgggtc

SEQ ID NO: 486085 - DNA, 20 bp, Artificial Sequence
  chemically synthesized
gcaataatagtatattacta

SEQ ID NO: 486086 - DNA, 20 bp, Artificial Sequence
  chemically synthesized
atcatcccgatcacagcccc

SEQ ID NO: 486087 - DNA, 20 bp, Artificial Sequence
  chemically synthesized
aacattcctggggctgtgat

SEQ ID NO: 486088 - DNA, 20 bp, Artificial Sequence
  chemically synthesized
ggagcgctaaatgctgaaaa

SEQ ID NO: 486089 - DNA, 20 bp, Artificial Sequence
  chemically synthesized
ctgaaaagtggatgtgacca

SEQ ID NO: 486090 - DNA, 20 bp, Artificial Sequence
  chemically synthesized
tcaacattaagcagcagctg

SEQ ID NO: 486091 - DNA, 20 bp, Artificial Sequence
  chemically synthesized
taatcggtgaagcataactg

SEQ ID NO: 486092 - DNA, 20 bp, Artificial Sequence
  chemically synthesized
agctatttcatattttagat

SEQ ID NO: 486093 - DNA, 20 bp, Artificial Sequence
  chemically synthesized
ttattaggtctgcagaaacc

SEQ ID NO: 486094 - DNA, 20 bp, Artificial Sequence
  chemically synthesized
aaccaagaatacaccaaatg

SEQ ID NO: 486095 - DNA, 20 bp, Artificial Sequence
  chemically synthesized
attggtttaacaacattaat

SEQ ID NO: 486096 - DNA, 20 bp, Artificial Sequence
  chemically synthesized
attgcgtcaaagatcaagat

SEQ ID NO: 486097 - DNA, 20 bp, Artificial Sequence
  chemically synthesized
tttaggaagagcctcccaat

SEQ ID NO: 486098 - DNA, 20 bp, Artificial Sequence
  chemically synthesized
gttcgttgaacaaatattaa

SEQ ID NO: 486099 - DNA, 20 bp, Artificial Sequence
  chemically synthesized
tgggcccagtgtcaccccaa

SEQ ID NO: 486100 - DNA, 20 bp, Artificial Sequence
  chemically synthesized
cccagtgtcaccccaatgga

SEQ ID NO: 486101 - DNA, 20 bp, Artificial Sequence
  chemically synthesized
accaacaatattcactccat

SEQ ID NO: 486102 - DNA, 20 bp, Artificial Sequence
  chemically synthesized
gagtgggtgtagggatatct

SEQ ID NO: 486103 - DNA, 20 bp, Artificial Sequence
  chemically synthesized
cagaatttcagagtgggtgt

SEQ ID NO: 486104 - DNA, 20 bp, Artificial Sequence
  chemically synthesized
ctagaaagcagaatttcaga

SEQ ID NO: 486105 - DNA, 20 bp, Artificial Sequence
  chemically synthesized
tctcctagaaagcagaattt

SEQ ID NO: 486106 - DNA, 20 bp, Artificial Sequence
  chemically synthesized
attggaattctcctagaaag

SEQ ID NO: 486107 - DNA, 20 bp, Artificial Sequence
  chemically synthesized
tctgaaattctgctttctag

SEQ ID NO: 486108 - DNA, 20 bp, Artificial Sequence
  chemically synthesized
cgtagaaacttgaagacaat

SEQ ID NO: 486109 - DNA, 20 bp, Artificial Sequence
  chemically synthesized
caattgtcttcaagtttcta

SEQ ID NO: 486110 - DNA, 20 bp, Artificial Sequence
  chemically synthesized
atccatctccagaactgagg

SEQ ID NO: 486111 - DNA, 20 bp, Artificial Sequence
  chemically synthesized
ctaaatccatctccagaact

SEQ ID NO: 486112 - DNA, 20 bp, Artificial Sequence
  chemically synthesized
atccatcctcagttctggag

SEQ ID NO: 486113 - DNA, 20 bp, Artificial Sequence
  chemically synthesized
gcttagaatcgaagatttag

SEQ ID NO: 486114 - DNA, 20 bp, Artificial Sequence
  chemically synthesized
tgagattatcttgactggct

SEQ ID NO: 486115 - DNA, 20 bp, Artificial Sequence
  chemically synthesized
aacttttcttcctgaaccaa

SEQ ID NO: 486116 - DNA, 20 bp, Artificial Sequence
  chemically synthesized
aaccagcttatgaaaccatt

SEQ ID NO: 486117 - DNA, 20 bp, Artificial Sequence
  chemically synthesized
ctattgtactaaagatgatt

SEQ ID NO: 486118 - DNA, 20 bp, Artificial Sequence
  chemically synthesized
tagtacaatagtagatatat

SEQ ID NO: 486119 - DNA, 20 bp, Artificial Sequence
  chemically synthesized
aattttgattgttcttatct

SEQ ID NO: 486120 - DNA, 20 bp, Artificial Sequence
  chemically synthesized
cttatctgagggtgaaatct

SEQ ID NO: 486121 - DNA, 20 bp, Artificial Sequence
  chemically synthesized
aagatgactgccagcaacaa

SEQ ID NO: 486122 - DNA, 20 bp, Artificial Sequence
  chemically synthesized
gacaaagaaagtcatagaga

SEQ ID NO: 486123 - DNA, 20 bp, Artificial Sequence
  chemically synthesized
acctctgaacttccagttat

SEQ ID NO: 486124 - DNA, 20 bp, Artificial Sequence
  chemically synthesized
tgaacttccagttatgtgag

SEQ ID NO: 486125 - DNA, 20 bp, Artificial Sequence
  chemically synthesized
ttcaaagtggcttcaaaaat

SEQ ID NO: 486126 - DNA, 20 bp, Artificial Sequence
  chemically synthesized
atgctttgggctgcaagaaa

SEQ ID NO: 486127 - DNA, 20 bp, Artificial Sequence
  chemically synthesized
ttaactattaaatatgtcac

SEQ ID NO: 486128 - DNA, 20 bp, Artificial Sequence
  chemically synthesized
attatgatacttgctgaaat

SEQ ID NO: 486129 - DNA, 20 bp, Artificial Sequence
  chemically synthesized
tttcctacttagtcctccag

SEQ ID NO: 486130 - DNA, 20 bp, Artificial Sequence
  chemically synthesized
cacaaataatattataaact

SEQ ID NO: 486131 - DNA, 20 bp, Artificial Sequence
  chemically synthesized
aatgtatttctagcaaaagg

SEQ ID NO: 486132 - DNA, 20 bp, Artificial Sequence
  chemically synthesized
aaggcagcaattggtgatta

SEQ ID NO: 486133 - DNA, 20 bp, Artificial Sequence
  chemically synthesized
ttggtacctactagtctatc

SEQ ID NO: 486134 - DNA, 20 bp, Artificial Sequence
  chemically synthesized
cttggtacacaaggccgttc

SEQ ID NO: 486135 - DNA, 20 bp, Artificial Sequence
  chemically synthesized
taatagttctctttctcttc

SEQ ID NO: 486136 - DNA, 20 bp, Artificial Sequence
  chemically synthesized
tgttaaaaagtgtagtttta

SEQ ID NO: 486137 - DNA, 20 bp, Artificial Sequence
  chemically synthesized
ggttttgtagaagatgctat

SEQ ID NO: 486138 - DNA, 20 bp, Artificial Sequence
  chemically synthesized
ttgtagaagatgctatctga

SEQ ID NO: 486139 - DNA, 20 bp, Artificial Sequence
  chemically synthesized
atttgtcttaacaagatcga

SEQ ID NO: 486140 - DNA, 20 bp, Artificial Sequence
  chemically synthesized
tatcgtggggcttaatatta

SEQ ID NO: 486141 - DNA, 20 bp, Artificial Sequence
  chemically synthesized
ttgtgtcattcacaaaaata

SEQ ID NO: 486142 - DNA, 20 bp, Artificial Sequence
  chemically synthesized
ttactatattccctattttt

SEQ ID NO: 486143 - DNA, 20 bp, Artificial Sequence
  chemically synthesized
aaaatagggaatatagtaag

SEQ ID NO: 486144 - DNA, 20 bp, Artificial Sequence
  chemically synthesized
taacatcaattttacatatc

SEQ ID NO: 486145 - DNA, 20 bp, Artificial Sequence
  chemically synthesized
ttccacaggtatttctaact

SEQ ID NO: 486146 - DNA, 20 bp, Artificial Sequence
  chemically synthesized
gcttgtcagcaggtgaaaat

SEQ ID NO: 486147 - DNA, 20 bp, Artificial Sequence
  chemically synthesized
agcaggtgaaaatatgagtt

SEQ ID NO: 486148 - DNA, 20 bp, Artificial Sequence
  chemically synthesized
atcttagattctctaataaa

SEQ ID NO: 486149 - DNA, 20 bp, Artificial Sequence
  chemically synthesized
actaccaattccatttatta

SEQ ID NO: 486150 - DNA, 20 bp, Artificial Sequence
  chemically synthesized
ggaattggtagtaaaattat

SEQ ID NO: 486151 - DNA, 20 bp, Artificial Sequence
  chemically synthesized
taagccccacctccaatatt

SEQ ID NO: 486152 - DNA, 20 bp, Artificial Sequence
  chemically synthesized
gtggggcttaacgggaagtg

SEQ ID NO: 486153 - DNA, 20 bp, Artificial Sequence
  chemically synthesized
aacgggaagtgtggggtcat

SEQ ID NO: 486154 - DNA, 20 bp, Artificial Sequence
  chemically synthesized
ggaagtgtggggtcatgggg

SEQ ID NO: 486155 - DNA, 20 bp, Artificial Sequence
  chemically synthesized
gtcatgggggtggatccttc

SEQ ID NO: 486156 - DNA, 20 bp, Artificial Sequence
  chemically synthesized
agggcattaagccattcaag

SEQ ID NO: 486157 - DNA, 20 bp, Artificial Sequence
  chemically synthesized
atgcccttcctgggggcagg

SEQ ID NO: 486158 - DNA, 20 bp, Artificial Sequence
  chemically synthesized
ctagctcttgcagaacctaa

SEQ ID NO: 486159 - DNA, 20 bp, Artificial Sequence
  chemically synthesized
gctcccctttgcccttcacc

SEQ ID NO: 486160 - DNA, 20 bp, Artificial Sequence
  chemically synthesized
cagagactgggcaatttata

SEQ ID NO: 486161 - DNA, 20 bp, Artificial Sequence
  chemically synthesized
gttcatgtatgttgctataa

SEQ ID NO: 486162 - DNA, 20 bp, Artificial Sequence
  chemically synthesized
aaaaaaattgacaataagta

SEQ ID NO: 486163 - DNA, 20 bp, Artificial Sequence
  chemically synthesized
gccatagagcaatgcagact

SEQ ID NO: 486164 - DNA, 20 bp, Artificial Sequence
  chemically synthesized
tagagcaatgcagactagga

SEQ ID NO: 486165 - DNA, 20 bp, Artificial Sequence
  chemically synthesized
tgaaaaaccaaaccaaacca

SEQ ID NO: 486166 - DNA, 20 bp, Artificial Sequence
  chemically synthesized
tctcagaaactaacacaata

SEQ ID NO: 486167 - DNA, 20 bp, Artificial Sequence
  chemically synthesized
atagagaatttaaattgaag

SEQ ID NO: 486168 - DNA, 20 bp, Artificial Sequence
  chemically synthesized
tgaagagggataggtgatcc

SEQ ID NO: 486169 - DNA, 20 bp, Artificial Sequence
  chemically synthesized
gcctttaaatagtcttaccc

SEQ ID NO: 486170 - DNA, 20 bp, Artificial Sequence
  chemically synthesized
taagactatttaaaggcact

SEQ ID NO: 486171 - DNA, 20 bp, Artificial Sequence
  chemically synthesized
ttaactgttttgccctttgc

SEQ ID NO: 486172 - DNA, 20 bp, Artificial Sequence
  chemically synthesized
tttttaaattgcatcacatg

SEQ ID NO: 486173 - DNA, 20 bp, Artificial Sequence
  chemically synthesized
aaaaaacaattatatttacc

SEQ ID NO: 486174 - DNA, 20 bp, Artificial Sequence
  chemically synthesized
aggtaaaatgtgcataaaaa

SEQ ID NO: 486175 - DNA, 20 bp, Artificial Sequence
  chemically synthesized
ttcttactatagtttgcttc

SEQ ID NO: 486176 - DNA, 20 bp, Artificial Sequence
  chemically synthesized
gcaaactatagtaagaaaga

SEQ ID NO: 486177 - DNA, 20 bp, Artificial Sequence
  chemically synthesized
agtagaaagttttcaagtca

SEQ ID NO: 486178 - DNA, 20 bp, Artificial Sequence
  chemically synthesized
ttcaagtcaatggattactg

SEQ ID NO: 486179 - DNA, 20 bp, Artificial Sequence
  chemically synthesized
actggtagataaatatatta

SEQ ID NO: 486180 - DNA, 20 bp, Artificial Sequence
  chemically synthesized
gataaatatattaaggaatt

SEQ ID NO: 486181 - DNA, 20 bp, Artificial Sequence
  chemically synthesized
ttgtcatcctatatgtcaga

SEQ ID NO: 486182 - DNA, 20 bp, Artificial Sequence
  chemically synthesized
ggcagattctttctgacata

SEQ ID NO: 486183 - DNA, 20 bp, Artificial Sequence
  chemically synthesized
ttctgacatataggatgaca

SEQ ID NO: 486184 - DNA, 20 bp, Artificial Sequence
  chemically synthesized
caggaagatttataggtggt

SEQ ID NO: 486185 - DNA, 20 bp, Artificial Sequence
  chemically synthesized
caactggtttcaagaaaaca

SEQ ID NO: 486186 - DNA, 20 bp, Artificial Sequence
  chemically synthesized
cctccaaaaaaagacttaaa

SEQ ID NO: 486187 - DNA, 20 bp, Artificial Sequence
  chemically synthesized
cttttataggtggaaatagt

SEQ ID NO: 486188 - DNA, 20 bp, Artificial Sequence
  chemically synthesized
aacccgatatattttacaat

SEQ ID NO: 486189 - DNA, 20 bp, Artificial Sequence
  chemically synthesized
cattcaaattgtaaaatata

SEQ ID NO: 486190 - DNA, 20 bp, Artificial Sequence
  chemically synthesized
aaattgtaaaatatatcggg

SEQ ID NO: 486191 - DNA, 20 bp, Artificial Sequence
  chemically synthesized
taccatagaaattttaaaag

SEQ ID NO: 486192 - DNA, 20 bp, Artificial Sequence
  chemically synthesized
ttaaaatttctatggtactt

SEQ ID NO: 486193 - DNA, 20 bp, Artificial Sequence
  chemically synthesized
tgtgagcataaatttaccca

SEQ ID NO: 486194 - DNA, 20 bp, Artificial Sequence
  chemically synthesized
tcatcttcttcctgaaccca

SEQ ID NO: 486195 - DNA, 20 bp, Artificial Sequence
  chemically synthesized
ccagtgggttcaggaagaag

SEQ ID NO: 486196 - DNA, 20 bp, Artificial Sequence
  chemically synthesized
gaggttgaaagttctccaca

SEQ ID NO: 486197 - DNA, 20 bp, Artificial Sequence
  chemically synthesized
attgattttgatgtcagtgc

SEQ ID NO: 486198 - DNA, 20 bp, Artificial Sequence
  chemically synthesized
ctttatttcccctgtgtttg

SEQ ID NO: 486199 - DNA, 20 bp, Artificial Sequence
  chemically synthesized
caaacacaggggaaataaag

SEQ ID NO: 486200 - DNA, 20 bp, Artificial Sequence
  chemically synthesized
ttggatcattttgccaactt

SEQ ID NO: 486201 - DNA, 20 bp, Artificial Sequence
  chemically synthesized
tacttcattccatttggaat

SEQ ID NO: 486202 - DNA, 20 bp, Artificial Sequence
  chemically synthesized
aaaatgatccaaattccaaa

SEQ ID NO: 486203 - DNA, 20 bp, Artificial Sequence
  chemically synthesized
tttttttacttcattccatt

SEQ ID NO: 486204 - DNA, 20 bp, Artificial Sequence
  chemically synthesized
agtgcaaacatcactggact

SEQ ID NO: 486205 - DNA, 20 bp, Artificial Sequence
  chemically synthesized
catttgacaacagacactct

SEQ ID NO: 486206 - DNA, 20 bp, Artificial Sequence
  chemically synthesized
gcccagatcaagtagactcc

SEQ ID NO: 486207 - DNA, 20 bp, Artificial Sequence
  chemically synthesized
tgggcaccattctaggcact

SEQ ID NO: 486208 - DNA, 20 bp, Artificial Sequence
  chemically synthesized
accactgtactcccagtgcc

SEQ ID NO: 486209 - DNA, 20 bp, Artificial Sequence
  chemically synthesized
tggcacaggcaatggcctca

SEQ ID NO: 486210 - DNA, 20 bp, Artificial Sequence
  chemically synthesized
cagagccaggaaaaaagtaa

SEQ ID NO: 486211 - DNA, 20 bp, Artificial Sequence
  chemically synthesized
ggaaaaaagtaagagagtga

SEQ ID NO: 486212 - DNA, 20 bp, Artificial Sequence
  chemically synthesized
gagagggttgcaagttgggc

SEQ ID NO: 486213 - DNA, 20 bp, Artificial Sequence
  chemically synthesized
ccttagctcattatgaaggt

SEQ ID NO: 486214 - DNA, 20 bp, Artificial Sequence
  chemically synthesized
ggggagctaaggaaatttag

SEQ ID NO: 486215 - DNA, 20 bp, Artificial Sequence
  chemically synthesized
gtgaaaaagagaagtggaga

SEQ ID NO: 486216 - DNA, 20 bp, Artificial Sequence
  chemically synthesized
gggagtgaaaaagagaagtg

SEQ ID NO: 486217 - DNA, 20 bp, Artificial Sequence
  chemically synthesized
ggaaacaaggagtaccaaag

SEQ ID NO: 486218 - DNA, 20 bp, Artificial Sequence
  chemically synthesized
atcagagtcttctggaaaca

SEQ ID NO: 486219 - DNA, 20 bp, Artificial Sequence
  chemically synthesized
ggaacccttgagctggggat

SEQ ID NO: 486220 - DNA, 20 bp, Artificial Sequence
  chemically synthesized
aagactctgatccccagctc

SEQ ID NO: 486221 - DNA, 20 bp, Artificial Sequence
  chemically synthesized
agagaaggaacccttgagct

SEQ ID NO: 486222 - DNA, 20 bp, Artificial Sequence
  chemically synthesized
tcaagggttccttctctgta

SEQ ID NO: 486223 - DNA, 20 bp, Artificial Sequence
  chemically synthesized
gtaattatcttgtgtaactt

SEQ ID NO: 486224 - DNA, 20 bp, Artificial Sequence
  chemically synthesized
tgaatccccattacctggga

SEQ ID NO: 486225 - DNA, 20 bp, Artificial Sequence
  chemically synthesized
ctcattcattcccaggtaat

SEQ ID NO: 486226 - DNA, 20 bp, Artificial Sequence
  chemically synthesized
tcattgaatccccattacct

SEQ ID NO: 486227 - DNA, 20 bp, Artificial Sequence
  chemically synthesized
tcccctcttgtcgattttca

SEQ ID NO: 486228 - DNA, 20 bp, Artificial Sequence
  chemically synthesized
ttcaatgaaaatcgacaaga

SEQ ID NO: 486229 - DNA, 20 bp, Artificial Sequence
  chemically synthesized
ctatgaagaaatacccgaga

SEQ ID NO: 486230 - DNA, 20 bp, Artificial Sequence
  chemically synthesized
tcttcataaattacccagtc

SEQ ID NO: 486231 - DNA, 20 bp, Artificial Sequence
  chemically synthesized
ctccccagccatgcagaatg

SEQ ID NO: 486232 - DNA, 20 bp, Artificial Sequence
  chemically synthesized
ctgaggcctccccagccatg

SEQ ID NO: 486233 - DNA, 20 bp, Artificial Sequence
  chemically synthesized
tggcagaaggcacctcttca

SEQ ID NO: 486234 - DNA, 20 bp, Artificial Sequence
  chemically synthesized
cttcacagggtggcaggagg

SEQ ID NO: 486235 - DNA, 20 bp, Artificial Sequence
  chemically synthesized
acagggtggcaggagggaga

SEQ ID NO: 486236 - DNA, 20 bp, Artificial Sequence
  chemically synthesized
gtgaaatcacccactatcat

SEQ ID NO: 486237 - DNA, 20 bp, Artificial Sequence
  chemically synthesized
cccatgctattctcatgata

SEQ ID NO: 486238 - DNA, 20 bp, Artificial Sequence
  chemically synthesized
agggacccagtgagaggtaa

SEQ ID NO: 486239 - DNA, 20 bp, Artificial Sequence
  chemically synthesized
catgattcaattacctctca

SEQ ID NO: 486240 - DNA, 20 bp, Artificial Sequence
  chemically synthesized
gggtccctcccatgacacct

SEQ ID NO: 486241 - DNA, 20 bp, Artificial Sequence
  chemically synthesized
gtccccacccaaatctcacc

SEQ ID NO: 486242 - DNA, 20 bp, Artificial Sequence
  chemically synthesized
attacaattcaaggtgagat

SEQ ID NO: 486243 - DNA, 20 bp, Artificial Sequence
  chemically synthesized
gatttgggaggggccaggag

SEQ ID NO: 486244 - DNA, 20 bp, Artificial Sequence
  chemically synthesized
tgttggaatgagttaagact

SEQ ID NO: 486245 - DNA, 20 bp, Artificial Sequence
  chemically synthesized
acttttgggttaatgttgga

SEQ ID NO: 486246 - DNA, 20 bp, Artificial Sequence
  chemically synthesized
ttggacttttgggttaatgt

SEQ ID NO: 486247 - DNA, 20 bp, Artificial Sequence
  chemically synthesized
gaaactttggacttggactt

SEQ ID NO: 486248 - DNA, 20 bp, Artificial Sequence
  chemically synthesized
ttggattttcaggctcatag

SEQ ID NO: 486249 - DNA, 20 bp, Artificial Sequence
  chemically synthesized
ctggaagtaactaacttgtt

SEQ ID NO: 486250 - DNA, 20 bp, Artificial Sequence
  chemically synthesized
caaaacaagttagttacttc

SEQ ID NO: 486251 - DNA, 20 bp, Artificial Sequence
  chemically synthesized
gttacttccaggatacaatg

SEQ ID NO: 486252 - DNA, 20 bp, Artificial Sequence
  chemically synthesized
tacaatggggggtacaggca

SEQ ID NO: 486253 - DNA, 20 bp, Artificial Sequence
  chemically synthesized
attgggtaaatacacctgtt

SEQ ID NO: 486254 - DNA, 20 bp, Artificial Sequence
  chemically synthesized
ggagaaattggccaaaataa

SEQ ID NO: 486255 - DNA, 20 bp, Artificial Sequence
  chemically synthesized
aaagtgtaatgactgcccta

SEQ ID NO: 486256 - DNA, 20 bp, Artificial Sequence
  chemically synthesized
acctcttgcatcagcatgac

SEQ ID NO: 486257 - DNA, 20 bp, Artificial Sequence
  chemically synthesized
gctctgcccttgtggctttg

SEQ ID NO: 486258 - DNA, 20 bp, Artificial Sequence
  chemically synthesized
agctgctatcatggctagca

SEQ ID NO: 486259 - DNA, 20 bp, Artificial Sequence
  chemically synthesized
atcagcatttctgactattc

SEQ ID NO: 486260 - DNA, 20 bp, Artificial Sequence
  chemically synthesized
atttctgactattctggggt

SEQ ID NO: 486261 - DNA, 20 bp, Artificial Sequence
  chemically synthesized
gaccaccatcatccaaaccc

SEQ ID NO: 486262 - DNA, 20 bp, Artificial Sequence
  chemically synthesized
tgtggggtcggagctccaca

SEQ ID NO: 486263 - DNA, 20 bp, Artificial Sequence
  chemically synthesized
gacagtgcagaaggaaaatg

SEQ ID NO: 486264 - DNA, 20 bp, Artificial Sequence
  chemically synthesized
taggcttttccatacatcct

SEQ ID NO: 486265 - DNA, 20 bp, Artificial Sequence
  chemically synthesized
caacctctgcctagaattca

SEQ ID NO: 486266 - DNA, 20 bp, Artificial Sequence
  chemically synthesized
tgaggtttgcaacctctgcc

SEQ ID NO: 486267 - DNA, 20 bp, Artificial Sequence
  chemically synthesized
cctggggttggacagaagtc

SEQ ID NO: 486268 - DNA, 20 bp, Artificial Sequence
  chemically synthesized
cttacatgtggtgttgggcc

SEQ ID NO: 486269 - DNA, 20 bp, Artificial Sequence
  chemically synthesized
cagctcaggctgttgcttca

SEQ ID NO: 486270 - DNA, 20 bp, Artificial Sequence
  chemically synthesized
cacagggccgtgctgctttg

SEQ ID NO: 486271 - DNA, 20 bp, Artificial Sequence
  chemically synthesized
cagcttgtatttctcagaaa

SEQ ID NO: 486272 - DNA, 20 bp, Artificial Sequence
  chemically synthesized
tgaaacttcctagagacttg

SEQ ID NO: 486273 - DNA, 20 bp, Artificial Sequence
  chemically synthesized
aatgtggaagtgacttggaa

SEQ ID NO: 486274 - DNA, 20 bp, Artificial Sequence
  chemically synthesized
taaattggtactgcagagag

SEQ ID NO: 486275 - DNA, 20 bp, Artificial Sequence
  chemically synthesized
tacagtaaattggtactgca

SEQ ID NO: 486276 - DNA, 20 bp, Artificial Sequence
  chemically synthesized
ctatgaagaaatacccaaga

SEQ ID NO: 486277 - DNA, 20 bp, Artificial Sequence
  chemically synthesized
tctttataaattacccggtc

SEQ ID NO: 486278 - DNA, 20 bp, Artificial Sequence
  chemically synthesized
ctctgaagccatgcggaact

SEQ ID NO: 486279 - DNA, 20 bp, Artificial Sequence
  chemically synthesized
tggaggaaggcaccttttca

SEQ ID NO: 486280 - DNA, 20 bp, Artificial Sequence
  chemically synthesized
tttcacagggtgataggaga

SEQ ID NO: 486281 - DNA, 20 bp, Artificial Sequence
  chemically synthesized
acagggtgataggagagaga

SEQ ID NO: 486282 - DNA, 20 bp, Artificial Sequence
  chemically synthesized
tgctgttgtcgtgatagtga

SEQ ID NO: 486283 - DNA, 20 bp, Artificial Sequence
  chemically synthesized
cccatgctgttgtcgtgata

SEQ ID NO: 486284 - DNA, 20 bp, Artificial Sequence
  chemically synthesized
cagggggaagtaattgaatc

SEQ ID NO: 486285 - DNA, 20 bp, Artificial Sequence
  chemically synthesized
agggacccagggggaagtaa

SEQ ID NO: 486286 - DNA, 20 bp, Artificial Sequence
  chemically synthesized
catgattcaattacttcccc

SEQ ID NO: 486287 - DNA, 20 bp, Artificial Sequence
  chemically synthesized
gggtccctcccacaacacat

SEQ ID NO: 486288 - DNA, 20 bp, Artificial Sequence
  chemically synthesized
ccacaacacatgggaattac

SEQ ID NO: 486289 - DNA, 20 bp, Artificial Sequence
  chemically synthesized
gtccccacccaaatctcacc

SEQ ID NO: 486290 - DNA, 20 bp, Artificial Sequence
  chemically synthesized
attacaattcaaggtgagat

SEQ ID NO: 486291 - DNA, 20 bp, Artificial Sequence
  chemically synthesized
ctttcagttataagatgtct

SEQ ID NO: 486292 - DNA, 20 bp, Artificial Sequence
  chemically synthesized
acttgaaatttgctacaaga

SEQ ID NO: 486293 - DNA, 20 bp, Artificial Sequence
  chemically synthesized
ttgtgtgtgtgttggggggg

SEQ ID NO: 486294 - DNA, 20 bp, Artificial Sequence
  chemically synthesized
aaatcatcatgttgtatacc

SEQ ID NO: 486295 - DNA, 20 bp, Artificial Sequence
  chemically synthesized
aaagctaggtaaggaggagg

SEQ ID NO: 486296 - DNA, 20 bp, Artificial Sequence
  chemically synthesized
tgtcctcaagaagctcacaa

SEQ ID NO: 486297 - DNA, 20 bp, Artificial Sequence
  chemically synthesized
aattgagtagggggaacaac

SEQ ID NO: 486298 - DNA, 20 bp, Artificial Sequence
  chemically synthesized
atatttatttgtgggacaat

SEQ ID NO: 486299 - DNA, 20 bp, Artificial Sequence
  chemically synthesized
tttggtgtgtgctctggaag

SEQ ID NO: 486300 - DNA, 20 bp, Artificial Sequence
  chemically synthesized
ggaggtaaggagcgtctttc

SEQ ID NO: 486301 - DNA, 20 bp, Artificial Sequence
  chemically synthesized
tttgagctgagacctgaaaa

SEQ ID NO: 486302 - DNA, 20 bp, Artificial Sequence
  chemically synthesized
gtatgaggtcaaaaattcaa

SEQ ID NO: 486303 - DNA, 20 bp, Artificial Sequence
  chemically synthesized
ctgattgagacactatcctt

SEQ ID NO: 486304 - DNA, 20 bp, Artificial Sequence
  chemically synthesized
ggaggtcaatgtggagataa

SEQ ID NO: 486305 - DNA, 20 bp, Artificial Sequence
  chemically synthesized
tagttcacagtatctggtat

SEQ ID NO: 486306 - DNA, 20 bp, Artificial Sequence
  chemically synthesized
tataaggatgatgaaatgga

SEQ ID NO: 486307 - DNA, 20 bp, Artificial Sequence
  chemically synthesized
tcacactatacaagatcctg

SEQ ID NO: 486308 - DNA, 20 bp, Artificial Sequence
  chemically synthesized
aaaaaagaaatgatatccca

SEQ ID NO: 486309 - DNA, 20 bp, Artificial Sequence
  chemically synthesized
aggtactggagcattttaaa

SEQ ID NO: 486310 - DNA, 20 bp, Artificial Sequence
  chemically synthesized
tctgtcatcaaatttatatt

SEQ ID NO: 486311 - DNA, 20 bp, Artificial Sequence
  chemically synthesized
agatgcataggagagaagaa

SEQ ID NO: 486312 - DNA, 20 bp, Artificial Sequence
  chemically synthesized
tgaatgaggagagattaggt

SEQ ID NO: 486313 - DNA, 20 bp, Artificial Sequence
  chemically synthesized
ttgtaacactatgcaggtta

SEQ ID NO: 486314 - DNA, 20 bp, Artificial Sequence
  chemically synthesized
catgctttatgtcattgcct

SEQ ID NO: 486315 - DNA, 20 bp, Artificial Sequence
  chemically synthesized
ctgttacagtagtcttatat

SEQ ID NO: 486316 - DNA, 20 bp, Artificial Sequence
  chemically synthesized
aagagatgatgagattgtac

SEQ ID NO: 486317 - DNA, 20 bp, Artificial Sequence
  chemically synthesized
tgagattgtacaggggtatg

SEQ ID NO: 486318 - DNA, 20 bp, Artificial Sequence
  chemically synthesized
aaaatcaactgaacttagtg

SEQ ID NO: 486319 - DNA, 20 bp, Artificial Sequence
  chemically synthesized
cttagtggtggatgtccagc

SEQ ID NO: 486320 - DNA, 20 bp, Artificial Sequence
  chemically synthesized
gggtgaggtgggaaggtttt

SEQ ID NO: 486321 - DNA, 20 bp, Artificial Sequence
  chemically synthesized
ctatccagtaacaaaatctt

SEQ ID NO: 486322 - DNA, 20 bp, Artificial Sequence
  chemically synthesized
tgacccccaagattttgtta

SEQ ID NO: 486323 - DNA, 20 bp, Artificial Sequence
  chemically synthesized
gtgctacaaaacctgaagaa

SEQ ID NO: 486324 - DNA, 20 bp, Artificial Sequence
  chemically synthesized
gagacatctaagtggaactg

SEQ ID NO: 486325 - DNA, 20 bp, Artificial Sequence
  chemically synthesized
aggcagttaaatatgcagta

SEQ ID NO: 486326 - DNA, 20 bp, Artificial Sequence
  chemically synthesized
catttttcttattgttgtct

SEQ ID NO: 486327 - DNA, 20 bp, Artificial Sequence
  chemically synthesized
gggtcccctgaaaacagggc

SEQ ID NO: 486328 - DNA, 20 bp, Artificial Sequence
  chemically synthesized
aacagggcctggatgaggac

SEQ ID NO: 486329 - DNA, 20 bp, Artificial Sequence
  chemically synthesized
gaagctgatccctaggaagc

SEQ ID NO: 486330 - DNA, 20 bp, Artificial Sequence
  chemically synthesized
gtttttcattcttgcttcct

SEQ ID NO: 486331 - DNA, 20 bp, Artificial Sequence
  chemically synthesized
aagcaagaatgaaaaaccaa

SEQ ID NO: 486332 - DNA, 20 bp, Artificial Sequence
  chemically synthesized
cagaacttttgtatgttcct

SEQ ID NO: 486333 - DNA, 20 bp, Artificial Sequence
  chemically synthesized
gtatgttcctgagaatcaca

SEQ ID NO: 486334 - DNA, 20 bp, Artificial Sequence
  chemically synthesized
ctattccttccgggggcaag

SEQ ID NO: 486335 - DNA, 20 bp, Artificial Sequence
  chemically synthesized
gaattccccttgcccccgga

SEQ ID NO: 486336 - DNA, 20 bp, Artificial Sequence
  chemically synthesized
accaatggagatgggagccc

SEQ ID NO: 486337 - DNA, 20 bp, Artificial Sequence
  chemically synthesized
ttctcacccttgaagtttta

SEQ ID NO: 486338 - DNA, 20 bp, Artificial Sequence
  chemically synthesized
tgctcactcactaaaacttc

SEQ ID NO: 486339 - DNA, 20 bp, Artificial Sequence
  chemically synthesized
tcacaaaatctgtgggctcc

SEQ ID NO: 486340 - DNA, 20 bp, Artificial Sequence
  chemically synthesized
tgggagccattcccttgaca

SEQ ID NO: 486341 - DNA, 20 bp, Artificial Sequence
  chemically synthesized
ctgacagcatcccatgtcaa

SEQ ID NO: 486342 - DNA, 20 bp, Artificial Sequence
  chemically synthesized
gctgcagtggacagccctgt

SEQ ID NO: 486343 - DNA, 20 bp, Artificial Sequence
  chemically synthesized
taacagattcccctggtgcc

SEQ ID NO: 486344 - DNA, 20 bp, Artificial Sequence
  chemically synthesized
cgtgtgactccaggcaccag

SEQ ID NO: 486345 - DNA, 20 bp, Artificial Sequence
  chemically synthesized
gaacgtacacataaagtgtg

SEQ ID NO: 486346 - DNA, 20 bp, Artificial Sequence
  chemically synthesized
gcagtattctatttcttgat

SEQ ID NO: 486347 - DNA, 20 bp, Artificial Sequence
  chemically synthesized
atacaaccccaatcaagaaa

SEQ ID NO: 486348 - DNA, 20 bp, Artificial Sequence
  chemically synthesized
tgctgtggggaacacaaggg

SEQ ID NO: 486349 - DNA, 20 bp, Artificial Sequence
  chemically synthesized
gattgtgctgtggggaacac

SEQ ID NO: 486350 - DNA, 20 bp, Artificial Sequence
  chemically synthesized
ccctggaagtaaccattctc

SEQ ID NO: 486351 - DNA, 20 bp, Artificial Sequence
  chemically synthesized
agaaaaggagaaaaattcag

SEQ ID NO: 486352 - DNA, 20 bp, Artificial Sequence
  chemically synthesized
tttctttttattttttgaga

SEQ ID NO: 486353 - DNA, 20 bp, Artificial Sequence
  chemically synthesized
tgcgctccagcctgggcaac

SEQ ID NO: 486354 - DNA, 20 bp, Artificial Sequence
  chemically synthesized
ctcaccgcaacctccacctc

SEQ ID NO: 486355 - DNA, 20 bp, Artificial Sequence
  chemically synthesized
tactcgggaggctgaggcag

SEQ ID NO: 486356 - DNA, 20 bp, Artificial Sequence
  chemically synthesized
gattctcctgcctcagcctc

SEQ ID NO: 486357 - DNA, 20 bp, Artificial Sequence
  chemically synthesized
gcctcagcctcccgagtagc

SEQ ID NO: 486358 - DNA, 20 bp, Artificial Sequence
  chemically synthesized
tgggtggatcacctgaggtc

SEQ ID NO: 486359 - DNA, 20 bp, Artificial Sequence
  chemically synthesized
actttggggggccgaggtgg

SEQ ID NO: 486360 - DNA, 20 bp, Artificial Sequence
  chemically synthesized
caacactttggggggccgag

SEQ ID NO: 486361 - DNA, 20 bp, Artificial Sequence
  chemically synthesized
acctcggccccccaaagtgt

SEQ ID NO: 486362 - DNA, 20 bp, Artificial Sequence
  chemically synthesized
taaaacaaagctgaagtctc

SEQ ID NO: 486363 - DNA, 20 bp, Artificial Sequence
  chemically synthesized
taggctaaaaatatggatgc

SEQ ID NO: 486364 - DNA, 20 bp, Artificial Sequence
  chemically synthesized
gagaagtttaggctaaaaat

SEQ ID NO: 486365 - DNA, 20 bp, Artificial Sequence
  chemically synthesized
ccactgaggtaactgagcat

SEQ ID NO: 486366 - DNA, 20 bp, Artificial Sequence
  chemically synthesized
ttttagggttcaggggaact

SEQ ID NO: 486367 - DNA, 20 bp, Artificial Sequence
  chemically synthesized
tactaaactatggagtattt

SEQ ID NO: 486368 - DNA, 20 bp, Artificial Sequence
  chemically synthesized
tggtagaaattactaaacta

SEQ ID NO: 486369 - DNA, 20 bp, Artificial Sequence
  chemically synthesized
caggcatttggcttgataaa

SEQ ID NO: 486370 - DNA, 20 bp, Artificial Sequence
  chemically synthesized
cggtttatcaagccaaatgc

SEQ ID NO: 486371 - DNA, 20 bp, Artificial Sequence
  chemically synthesized
aatggagagatacagagaac

SEQ ID NO: 486372 - DNA, 20 bp, Artificial Sequence
  chemically synthesized
ttccacgtgccaagtatcac

SEQ ID NO: 486373 - DNA, 20 bp, Artificial Sequence
  chemically synthesized
taaactaaagaagtaataaa

SEQ ID NO: 486374 - DNA, 20 bp, Artificial Sequence
  chemically synthesized
ttatctatcacctgaaccac

SEQ ID NO: 486375 - DNA, 20 bp, Artificial Sequence
  chemically synthesized
gctgaagaataggtaactga

SEQ ID NO: 486376 - DNA, 20 bp, Artificial Sequence
  chemically synthesized
tcagttacctattcttcagc

SEQ ID NO: 486377 - DNA, 20 bp, Artificial Sequence
  chemically synthesized
tagagggattactctggctg

SEQ ID NO: 486378 - DNA, 20 bp, Artificial Sequence
  chemically synthesized
tgagcatatttgggttttag

SEQ ID NO: 486379 - DNA, 20 bp, Artificial Sequence
  chemically synthesized
gactagtgacatgagcatat

SEQ ID NO: 486380 - DNA, 20 bp, Artificial Sequence
  chemically synthesized
aatcaaacacattttatttg

SEQ ID NO: 486381 - DNA, 20 bp, Artificial Sequence
  chemically synthesized
catgcatttccagcatcatc

SEQ ID NO: 486382 - DNA, 20 bp, Artificial Sequence
  chemically synthesized
gcactgagttggggttggga

SEQ ID NO: 486383 - DNA, 20 bp, Artificial Sequence
  chemically synthesized
tgaagcactgagttggggtt

SEQ ID NO: 486384 - DNA, 20 bp, Artificial Sequence
  chemically synthesized
gtatggctgaagcactgagt

SEQ ID NO: 486385 - DNA, 20 bp, Artificial Sequence
  chemically synthesized
atatcagtatggctgaagca

SEQ ID NO: 486386 - DNA, 20 bp, Artificial Sequence
  chemically synthesized
acctaggcaaacaagtaggg

SEQ ID NO: 486387 - DNA, 20 bp, Artificial Sequence
  chemically synthesized
aaatttgaagatgagacttg

SEQ ID NO: 486388 - DNA, 20 bp, Artificial Sequence
  chemically synthesized
tccttttttttttttttttc

SEQ ID NO: 486389 - DNA, 20 bp, Artificial Sequence
  chemically synthesized
ctctgttgcaatactccaga

SEQ ID NO: 486390 - DNA, 20 bp, Artificial Sequence
  chemically synthesized
aagaatcacctcacccagtc

SEQ ID NO: 486391 - DNA, 20 bp, Artificial Sequence
  chemically synthesized
aatactagggaagaatcagg

SEQ ID NO: 486392 - DNA, 20 bp, Artificial Sequence
  chemically synthesized
taggatgtagaatactaggg

SEQ ID NO: 486393 - DNA, 20 bp, Artificial Sequence
  chemically synthesized
acgtgacaaatactaggatg

SEQ ID NO: 486394 - DNA, 20 bp, Artificial Sequence
  chemically synthesized
taactgtacgtgacaaatac

SEQ ID NO: 486395 - DNA, 20 bp, Artificial Sequence
  chemically synthesized
atttagttttcttactttct

SEQ ID NO: 486396 - DNA, 20 bp, Artificial Sequence
  chemically synthesized
ttcttactttctaggagtct

SEQ ID NO: 486397 - DNA, 20 bp, Artificial Sequence
  chemically synthesized
ttagattctagggatacaat

SEQ ID NO: 486398 - DNA, 20 bp, Artificial Sequence
  chemically synthesized
cttgatccatattgtatccc

SEQ ID NO: 486399 - DNA, 20 bp, Artificial Sequence
  chemically synthesized
cctcctgtgtgttagattct

SEQ ID NO: 486400 - DNA, 20 bp, Artificial Sequence
  chemically synthesized
aatctgacaaataatttatt

SEQ ID NO: 486401 - DNA, 20 bp, Artificial Sequence
  chemically synthesized
gattagtatattgataaatt

SEQ ID NO: 486402 - DNA, 20 bp, Artificial Sequence
  chemically synthesized
ttgataaattaaggatacaa

SEQ ID NO: 486403 - DNA, 20 bp, Artificial Sequence
  chemically synthesized
gcaggagatgtcaccatcag

SEQ ID NO: 486404 - DNA, 20 bp, Artificial Sequence
  chemically synthesized
taaataatgaattagttagg

SEQ ID NO: 486405 - DNA, 20 bp, Artificial Sequence
  chemically synthesized
aactgactatcatttaaata

SEQ ID NO: 486406 - DNA, 20 bp, Artificial Sequence
  chemically synthesized
atggcatacttgtacaaagg

SEQ ID NO: 486407 - DNA, 20 bp, Artificial Sequence
  chemically synthesized
acttctacttaggtatattt

SEQ ID NO: 486408 - DNA, 20 bp, Artificial Sequence
  chemically synthesized
tatatgggacttatagtcat

SEQ ID NO: 486409 - DNA, 20 bp, Artificial Sequence
  chemically synthesized
catcaaaaaatacaaagaaa

SEQ ID NO: 486410 - DNA, 20 bp, Artificial Sequence
  chemically synthesized
ctaaaacatttgttctcact

SEQ ID NO: 486411 - DNA, 20 bp, Artificial Sequence
  chemically synthesized
tgagaacaaatgttttaggc

SEQ ID NO: 486412 - DNA, 20 bp, Artificial Sequence
  chemically synthesized
cactatcatttgaaaaaatg

SEQ ID NO: 486413 - DNA, 20 bp, Artificial Sequence
  chemically synthesized
aatgatagtggaacactctt

SEQ ID NO: 486414 - DNA, 20 bp, Artificial Sequence
  chemically synthesized
aaatacctggtacaactctt

SEQ ID NO: 486415 - DNA, 20 bp, Artificial Sequence
  chemically synthesized
cacatctctttattctttcc

SEQ ID NO: 486416 - DNA, 20 bp, Artificial Sequence
  chemically synthesized
tttataaagccactcatgga

SEQ ID NO: 486417 - DNA, 20 bp, Artificial Sequence
  chemically synthesized
agaataccacttacttagca

SEQ ID NO: 486418 - DNA, 20 bp, Artificial Sequence
  chemically synthesized
agtaagtggtattctttgtt

SEQ ID NO: 486419 - DNA, 20 bp, Artificial Sequence
  chemically synthesized
attaatgcttactcagaaca

SEQ ID NO: 486420 - DNA, 20 bp, Artificial Sequence
  chemically synthesized
gattccttgtagctaataaa

SEQ ID NO: 486421 - DNA, 20 bp, Artificial Sequence
  chemically synthesized
tattccctttattagctaca

SEQ ID NO: 486422 - DNA, 20 bp, Artificial Sequence
  chemically synthesized
gactagtatttatctaaaac

SEQ ID NO: 486423 - DNA, 20 bp, Artificial Sequence
  chemically synthesized
ttgcaagaacaggcagttgg

SEQ ID NO: 486424 - DNA, 20 bp, Artificial Sequence
  chemically synthesized
gctgctttgcacctcattag

SEQ ID NO: 486425 - DNA, 20 bp, Artificial Sequence
  chemically synthesized
tttgcacctcattagcagag

SEQ ID NO: 486426 - DNA, 20 bp, Artificial Sequence
  chemically synthesized
aaagccagatagtaaatatt

SEQ ID NO: 486427 - DNA, 20 bp, Artificial Sequence
  chemically synthesized
caataattgactttataaat

SEQ ID NO: 486428 - DNA, 20 bp, Artificial Sequence
  chemically synthesized
ttgcaattaggggatgccat

SEQ ID NO: 486429 - DNA, 20 bp, Artificial Sequence
  chemically synthesized
atcataatacattgcaatta

SEQ ID NO: 486430 - DNA, 20 bp, Artificial Sequence
  chemically synthesized
ttgcaatgtattatgatttg

SEQ ID NO: 486431 - DNA, 20 bp, Artificial Sequence
  chemically synthesized
ctaactacagtagtgagaac

SEQ ID NO: 486432 - DNA, 20 bp, Artificial Sequence
  chemically synthesized
agttagaagaaaaatggact

SEQ ID NO: 486433 - DNA, 20 bp, Artificial Sequence
  chemically synthesized
gaataagaggagaatcagga

SEQ ID NO: 486434 - DNA, 20 bp, Artificial Sequence
  chemically synthesized
ttgaggaaactgaataagag

SEQ ID NO: 486435 - DNA, 20 bp, Artificial Sequence
  chemically synthesized
aattcccgcagttgaggaaa

SEQ ID NO: 486436 - DNA, 20 bp, Artificial Sequence
  chemically synthesized
tattcagtttcctcaactgc

SEQ ID NO: 486437 - DNA, 20 bp, Artificial Sequence
  chemically synthesized
tattatctaaaatttccctt

SEQ ID NO: 486438 - DNA, 20 bp, Artificial Sequence
  chemically synthesized
ttttattattttttgatcag

SEQ ID NO: 486439 - DNA, 20 bp, Artificial Sequence
  chemically synthesized
atattttgttttcttcactc

SEQ ID NO: 486440 - DNA, 20 bp, Artificial Sequence
  chemically synthesized
tgactgtagttagtgaaccc

SEQ ID NO: 486441 - DNA, 20 bp, Artificial Sequence
  chemically synthesized
acatttgatcagactgtcac

SEQ ID NO: 486442 - DNA, 20 bp, Artificial Sequence
  chemically synthesized
aaggaataaattggaggtag

SEQ ID NO: 486443 - DNA, 20 bp, Artificial Sequence
  chemically synthesized
tgctacctccaatttattcc

SEQ ID NO: 486444 - DNA, 20 bp, Artificial Sequence
  chemically synthesized
taccaagggatgcacactca

SEQ ID NO: 486445 - DNA, 20 bp, Artificial Sequence
  chemically synthesized
gtcagcaataagccatacca

SEQ ID NO: 486446 - DNA, 20 bp, Artificial Sequence
  chemically synthesized
aagtggattgagatgaatga

SEQ ID NO: 486447 - DNA, 20 bp, Artificial Sequence
  chemically synthesized
atgcaagtggattgagatga

SEQ ID NO: 486448 - DNA, 20 bp, Artificial Sequence
  chemically synthesized
atggatgcaagtggattgag

SEQ ID NO: 486449 - DNA, 20 bp, Artificial Sequence
  chemically synthesized
gagcaaggccatggatgcaa

SEQ ID NO: 486450 - DNA, 20 bp, Artificial Sequence
  chemically synthesized
aacccagtgtgagcaaggcc

SEQ ID NO: 486451 - DNA, 20 bp, Artificial Sequence
  chemically synthesized
catccatggccttgctcaca

SEQ ID NO: 486452 - DNA, 20 bp, Artificial Sequence
  chemically synthesized
ctggaatttatttttctcat

SEQ ID NO: 486453 - DNA, 20 bp, Artificial Sequence
  chemically synthesized
acttaagcatgcttcttggc

SEQ ID NO: 486454 - DNA, 20 bp, Artificial Sequence
  chemically synthesized
aggtgttaccacttatcata

SEQ ID NO: 486455 - DNA, 20 bp, Artificial Sequence
  chemically synthesized
aaatttctgtaaaataaaaa

SEQ ID NO: 486456 - DNA, 20 bp, Artificial Sequence
  chemically synthesized
cttaggagctcacttgaaaa

SEQ ID NO: 486457 - DNA, 20 bp, Artificial Sequence
  chemically synthesized
ccctttttaggcttcacata

SEQ ID NO: 486458 - DNA, 20 bp, Artificial Sequence
  chemically synthesized
cccttcggccgtcaaaaggg

SEQ ID NO: 486459 - DNA, 20 bp, Artificial Sequence
  chemically synthesized
gcgtccccttcggccgtcaa

SEQ ID NO: 486460 - DNA, 20 bp, Artificial Sequence
  chemically synthesized
aatcacacaaaccagaaaca

SEQ ID NO: 486461 - DNA, 20 bp, Artificial Sequence
  chemically synthesized
tacagcatgaaatcgtagaa

SEQ ID NO: 486462 - DNA, 20 bp, Artificial Sequence
  chemically synthesized
cgatttcatgctgtaggcaa

SEQ ID NO: 486463 - DNA, 20 bp, Artificial Sequence
  chemically synthesized
ttctttgttcggtggctgtg

SEQ ID NO: 486464 - DNA, 20 bp, Artificial Sequence
  chemically synthesized
aacactagaaaatactttca

SEQ ID NO: 486465 - DNA, 20 bp, Artificial Sequence
  chemically synthesized
aatcaggtctgaacacaaaa

SEQ ID NO: 486466 - DNA, 20 bp, Artificial Sequence
  chemically synthesized
cacaaaaaagaattttccaa

SEQ ID NO: 486467 - DNA, 20 bp, Artificial Sequence
  chemically synthesized
taattgattttgacttgcag

SEQ ID NO: 486468 - DNA, 20 bp, Artificial Sequence
  chemically synthesized
aagtagatctggaaaatcta

SEQ ID NO: 486469 - DNA, 20 bp, Artificial Sequence
  chemically synthesized
tcaaaaagccagtacagcag

SEQ ID NO: 486470 - DNA, 20 bp, Artificial Sequence
  chemically synthesized
gctgtactggctttttgacc

SEQ ID NO: 486471 - DNA, 20 bp, Artificial Sequence
  chemically synthesized
attgacagttacagatgtgg

SEQ ID NO: 486472 - DNA, 20 bp, Artificial Sequence
  chemically synthesized
gctaagtagtaacactgtgg

SEQ ID NO: 486473 - DNA, 20 bp, Artificial Sequence
  chemically synthesized
ttttctttttttggctcctc

SEQ ID NO: 486474 - DNA, 20 bp, Artificial Sequence
  chemically synthesized
gaagcttaatactataacct

SEQ ID NO: 486475 - DNA, 20 bp, Artificial Sequence
  chemically synthesized
ttttattaaatctccgtggg

SEQ ID NO: 486476 - DNA, 20 bp, Artificial Sequence
  chemically synthesized
aaatcttttattaaatctcc

SEQ ID NO: 486477 - DNA, 20 bp, Artificial Sequence
  chemically synthesized
acggaaaagaaaggggaaga

SEQ ID NO: 486478 - DNA, 20 bp, Artificial Sequence
  chemically synthesized
caaaagcatgcacaatatgg

SEQ ID NO: 486479 - DNA, 20 bp, Artificial Sequence
  chemically synthesized
caatatggtagaattggtcc

SEQ ID NO: 486480 - DNA, 20 bp, Artificial Sequence
  chemically synthesized
agaattggtcctagagtata

SEQ ID NO: 486481 - DNA, 20 bp, Artificial Sequence
  chemically synthesized
gaatcttggtcatgcagtct

SEQ ID NO: 486482 - DNA, 20 bp, Artificial Sequence
  chemically synthesized
ttacctttatgttaaacata

SEQ ID NO: 486483 - DNA, 20 bp, Artificial Sequence
  chemically synthesized
ggcacagcatggccttgaac

SEQ ID NO: 486484 - DNA, 20 bp, Artificial Sequence
  chemically synthesized
atgctgtgcccacttagtag

SEQ ID NO: 486485 - DNA, 20 bp, Artificial Sequence
  chemically synthesized
cacttagtagctgggtgttt

SEQ ID NO: 486486 - DNA, 20 bp, Artificial Sequence
  chemically synthesized
agaggaaatgaaagcctaga

SEQ ID NO: 486487 - DNA, 20 bp, Artificial Sequence
  chemically synthesized
attaaacagaaaaatgcaca

SEQ ID NO: 486488 - DNA, 20 bp, Artificial Sequence
  chemically synthesized
aagataaatattaggtatgt

SEQ ID NO: 486489 - DNA, 20 bp, Artificial Sequence
  chemically synthesized
gggtcaatgcaaaagctagg

SEQ ID NO: 486490 - DNA, 20 bp, Artificial Sequence
  chemically synthesized
atgataggcctatatattac

SEQ ID NO: 486491 - DNA, 20 bp, Artificial Sequence
  chemically synthesized
agaccttagagaccctccag

SEQ ID NO: 486492 - DNA, 20 bp, Artificial Sequence
  chemically synthesized
cttcatgtttaactctcctg

SEQ ID NO: 486493 - DNA, 20 bp, Artificial Sequence
  chemically synthesized
aaatgcttcatattgaaaaa

SEQ ID NO: 486494 - DNA, 20 bp, Artificial Sequence
  chemically synthesized
agcatttattcacccagata

SEQ ID NO: 486495 - DNA, 20 bp, Artificial Sequence
  chemically synthesized
gatttgtatccattatctgg

SEQ ID NO: 486496 - DNA, 20 bp, Artificial Sequence
  chemically synthesized
catggatttgtatccattat

SEQ ID NO: 486497 - DNA, 20 bp, Artificial Sequence
  chemically synthesized
tccaaggaacatttgaatgc

SEQ ID NO: 486498 - DNA, 20 bp, Artificial Sequence
  chemically synthesized
tctctgactccaaggaacat

SEQ ID NO: 486499 - DNA, 20 bp, Artificial Sequence
  chemically synthesized
ccatgcattcaaatgttcct

SEQ ID NO: 486500 - DNA, 20 bp, Artificial Sequence
  chemically synthesized
gagatcaagatggaaatccc

SEQ ID NO: 486501 - DNA, 20 bp, Artificial Sequence
  chemically synthesized
acgcaaatctctatgattct

SEQ ID NO: 486502 - DNA, 20 bp, Artificial Sequence
  chemically synthesized
cccttccaacctctttgaat

SEQ ID NO: 486503 - DNA, 20 bp, Artificial Sequence
  chemically synthesized
cactgccccttccaacctct

SEQ ID NO: 486504 - DNA, 20 bp, Artificial Sequence
  chemically synthesized
ggcagtgtcagctttttaac

SEQ ID NO: 486505 - DNA, 20 bp, Artificial Sequence
  chemically synthesized
ttttcattacttctccctgt

SEQ ID NO: 486506 - DNA, 20 bp, Artificial Sequence
  chemically synthesized
ttggggttgcaacacatgct

SEQ ID NO: 486507 - DNA, 20 bp, Artificial Sequence
  chemically synthesized
tgctgcctgcatacagcttg

SEQ ID NO: 486508 - DNA, 20 bp, Artificial Sequence
  chemically synthesized
agctgtatgcaggcagcaaa

SEQ ID NO: 486509 - DNA, 20 bp, Artificial Sequence
  chemically synthesized
tttcttgtctttcagctggt

SEQ ID NO: 486510 - DNA, 20 bp, Artificial Sequence
  chemically synthesized
ttgtctttcagctggtggga

SEQ ID NO: 486511 - DNA, 20 bp, Artificial Sequence
  chemically synthesized
aaataaaacttcttgtgaaa

SEQ ID NO: 486512 - DNA, 20 bp, Artificial Sequence
  chemically synthesized
tcgaagtgtacaattcaatc

SEQ ID NO: 486513 - DNA, 20 bp, Artificial Sequence
  chemically synthesized
aataagcacataactcagga

SEQ ID NO: 486514 - DNA, 20 bp, Artificial Sequence
  chemically synthesized
taacaaataagcacataact

SEQ ID NO: 486515 - DNA, 20 bp, Artificial Sequence
  chemically synthesized
atattttaccttaaagaaat

SEQ ID NO: 486516 - DNA, 20 bp, Artificial Sequence
  chemically synthesized
gaatcaacaataaaaataat

SEQ ID NO: 486517 - DNA, 20 bp, Artificial Sequence
  chemically synthesized
cttgtcatactgaagtgaat

SEQ ID NO: 486518 - DNA, 20 bp, Artificial Sequence
  chemically synthesized
agttttcttgtcatactgaa

SEQ ID NO: 486519 - DNA, 20 bp, Artificial Sequence
  chemically synthesized
aatgttctataatgttcatt

SEQ ID NO: 486520 - DNA, 20 bp, Artificial Sequence
  chemically synthesized
ctttattctcaaagaaatgt

SEQ ID NO: 486521 - DNA, 20 bp, Artificial Sequence
  chemically synthesized
gtgtattcatacatttcttt

SEQ ID NO: 486522 - DNA, 20 bp, Artificial Sequence
  chemically synthesized
acatttctttgagaataaag

SEQ ID NO: 486523 - DNA, 20 bp, Artificial Sequence
  chemically synthesized
ataaaatctcttatatatat

SEQ ID NO: 486524 - DNA, 20 bp, Artificial Sequence
  chemically synthesized
gagtttatatataaatatat

SEQ ID NO: 486525 - DNA, 20 bp, Artificial Sequence
  chemically synthesized
gagtttatatataaatatat

SEQ ID NO: 486526 - DNA, 20 bp, Artificial Sequence
  chemically synthesized
atatatgagtttatatatat

SEQ ID NO: 486527 - DNA, 20 bp, Artificial Sequence
  chemically synthesized
gagtttatatataaatatat

SEQ ID NO: 486528 - DNA, 20 bp, Artificial Sequence
  chemically synthesized
tttaatattggagaacaatt

SEQ ID NO: 486529 - DNA, 20 bp, Artificial Sequence
  chemically synthesized
gtgataattattccagaagt

SEQ ID NO: 486530 - DNA, 20 bp, Artificial Sequence
  chemically synthesized
ctactttcaattcctacttc

SEQ ID NO: 486531 - DNA, 20 bp, Artificial Sequence
  chemically synthesized
aggtttatattgcaatttaa

SEQ ID NO: 486532 - DNA, 20 bp, Artificial Sequence
  chemically synthesized
tagcaattttacctaaatat

SEQ ID NO: 486533 - DNA, 20 bp, Artificial Sequence
  chemically synthesized
aaagtgcttgccagcccatg

SEQ ID NO: 486534 - DNA, 20 bp, Artificial Sequence
  chemically synthesized
ctggcaagcactttggaaat

SEQ ID NO: 486535 - DNA, 20 bp, Artificial Sequence
  chemically synthesized
aaaatactgaagatgagaga

SEQ ID NO: 486536 - DNA, 20 bp, Artificial Sequence
  chemically synthesized
tgagagaaggaataaacctt

SEQ ID NO: 486537 - DNA, 20 bp, Artificial Sequence
  chemically synthesized
tttgatttcaagacacagtc

SEQ ID NO: 486538 - DNA, 20 bp, Artificial Sequence
  chemically synthesized
ttcaagacacagtcaagaat

SEQ ID NO: 486539 - DNA, 20 bp, Artificial Sequence
  chemically synthesized
gaatgagggtttaaggagat

SEQ ID NO: 486540 - DNA, 20 bp, Artificial Sequence
  chemically synthesized
gaagatttgcatcaatgcca

SEQ ID NO: 486541 - DNA, 20 bp, Artificial Sequence
  chemically synthesized
gattacagtgctgatcaaag

SEQ ID NO: 486542 - DNA, 20 bp, Artificial Sequence
  chemically synthesized
ggaacaaagttgagatatat

SEQ ID NO: 486543 - DNA, 20 bp, Artificial Sequence
  chemically synthesized
gaaattaaactcaggagatg

SEQ ID NO: 486544 - DNA, 20 bp, Artificial Sequence
  chemically synthesized
tggacccaaccccacatctc

SEQ ID NO: 486545 - DNA, 20 bp, Artificial Sequence
  chemically synthesized
taaactcaggagatgtgggg

SEQ ID NO: 486546 - DNA, 20 bp, Artificial Sequence
  chemically synthesized
cttgaccagctgtttagtgg

SEQ ID NO: 486547 - DNA, 20 bp, Artificial Sequence
  chemically synthesized
tacctaccatatgctagtca

SEQ ID NO: 486548 - DNA, 20 bp, Artificial Sequence
  chemically synthesized
ttggcatgtaaacgtaggaa

SEQ ID NO: 486549 - DNA, 20 bp, Artificial Sequence
  chemically synthesized
atatagactttatgatgtga

SEQ ID NO: 486550 - DNA, 20 bp, Artificial Sequence
  chemically synthesized
ttctgttgtgggcttcagaa

SEQ ID NO: 486551 - DNA, 20 bp, Artificial Sequence
  chemically synthesized
tatttttctgttgtgggctt

SEQ ID NO: 486552 - DNA, 20 bp, Artificial Sequence
  chemically synthesized
atagtatggaaaacacttgg

SEQ ID NO: 486553 - DNA, 20 bp, Artificial Sequence
  chemically synthesized
tcttttctatcttaaatcag

SEQ ID NO: 486554 - DNA, 20 bp, Artificial Sequence
  chemically synthesized
agattaaataacagacctca

SEQ ID NO: 486555 - DNA, 20 bp, Artificial Sequence
  chemically synthesized
cataaatgtatttttcctat

SEQ ID NO: 486556 - DNA, 20 bp, Artificial Sequence
  chemically synthesized
actgtctaaattatttttat

SEQ ID NO: 486557 - DNA, 20 bp, Artificial Sequence
  chemically synthesized
cttaaaaagtgaagagcaga

SEQ ID NO: 486558 - DNA, 20 bp, Artificial Sequence
  chemically synthesized
tgctcttcactttttaagaa

SEQ ID NO: 486559 - DNA, 20 bp, Artificial Sequence
  chemically synthesized
gcttctaagattgcttctaa

SEQ ID NO: 486560 - DNA, 20 bp, Artificial Sequence
  chemically synthesized
tcctgagatagtggaaaaga

SEQ ID NO: 486561 - DNA, 20 bp, Artificial Sequence
  chemically synthesized
ttcactgaatagttttaaaa

SEQ ID NO: 486562 - DNA, 20 bp, Artificial Sequence
  chemically synthesized
taatatttcctaaaacttca

SEQ ID NO: 486563 - DNA, 20 bp, Artificial Sequence
  chemically synthesized
gtgaagttttaggaaatatt

SEQ ID NO: 486564 - DNA, 20 bp, Artificial Sequence
  chemically synthesized
aagccttccattttgagcgg

SEQ ID NO: 486565 - DNA, 20 bp, Artificial Sequence
  chemically synthesized
aactatttaggcatatttat

SEQ ID NO: 486566 - DNA, 20 bp, Artificial Sequence
  chemically synthesized
aatagttctggtttcttggt

SEQ ID NO: 486567 - DNA, 20 bp, Artificial Sequence
  chemically synthesized
acttttgcttgaaatcacta

SEQ ID NO: 486568 - DNA, 20 bp, Artificial Sequence
  chemically synthesized
caagcaaaagtcctttcttg

SEQ ID NO: 486569 - DNA, 20 bp, Artificial Sequence
  chemically synthesized
atcaaaaaatctctaatcat

SEQ ID NO: 486570 - DNA, 20 bp, Artificial Sequence
  chemically synthesized
ttttcctagaaatgatgaac

SEQ ID NO: 486571 - DNA, 20 bp, Artificial Sequence
  chemically synthesized
ttccagttagggttgtgctt

SEQ ID NO: 486572 - DNA, 20 bp, Artificial Sequence
  chemically synthesized
gcatggttaccatttccagt

SEQ ID NO: 486573 - DNA, 20 bp, Artificial Sequence
  chemically synthesized
aaagggaacttcatcacaaa

SEQ ID NO: 486574 - DNA, 20 bp, Artificial Sequence
  chemically synthesized
ggataattaacatctaaatg

SEQ ID NO: 486575 - DNA, 20 bp, Artificial Sequence
  chemically synthesized
gttaacatccaagacagtga

SEQ ID NO: 486576 - DNA, 20 bp, Artificial Sequence
  chemically synthesized
tttcacattctatcactgtc

SEQ ID NO: 486577 - DNA, 20 bp, Artificial Sequence
  chemically synthesized
gtctttccatgaaggcagta

SEQ ID NO: 486578 - DNA, 20 bp, Artificial Sequence
  chemically synthesized
catggaaagacttccttctg

SEQ ID NO: 486579 - DNA, 20 bp, Artificial Sequence
  chemically synthesized
atgtgtcacactgtagaaag

SEQ ID NO: 486580 - DNA, 20 bp, Artificial Sequence
  chemically synthesized
tttgtatgtatcagtgaggt

SEQ ID NO: 486581 - DNA, 20 bp, Artificial Sequence
  chemically synthesized
cctcactgatacatacaaat

SEQ ID NO: 486582 - DNA, 20 bp, Artificial Sequence
  chemically synthesized
taaattaattaattaatgtc

SEQ ID NO: 486583 - DNA, 20 bp, Artificial Sequence
  chemically synthesized
ttaattaatgtcaagagtta

SEQ ID NO: 486584 - DNA, 20 bp, Artificial Sequence
  chemically synthesized
tccaaggccttgcagtatct

SEQ ID NO: 486585 - DNA, 20 bp, Artificial Sequence
  chemically synthesized
ggccttgcagtatcttggga

SEQ ID NO: 486586 - DNA, 20 bp, Artificial Sequence
  chemically synthesized
atcttgggatagggtttaaa

SEQ ID NO: 486587 - DNA, 20 bp, Artificial Sequence
  chemically synthesized
ttttgttattggaactgatt

SEQ ID NO: 486588 - DNA, 20 bp, Artificial Sequence
  chemically synthesized
ttctgcttcaggtgaacctt

SEQ ID NO: 486589 - DNA, 20 bp, Artificial Sequence
  chemically synthesized
tcctaaaggttcacctgaag

SEQ ID NO: 486590 - DNA, 20 bp, Artificial Sequence
  chemically synthesized
gaaacataaccacaacagga

SEQ ID NO: 486591 - DNA, 20 bp, Artificial Sequence
  chemically synthesized
taaccacaacaggaaagggt

SEQ ID NO: 486592 - DNA, 20 bp, Artificial Sequence
  chemically synthesized
taatagaaacatggcagggg

SEQ ID NO: 486593 - DNA, 20 bp, Artificial Sequence
  chemically synthesized
gccatgtttctattaatgag

SEQ ID NO: 486594 - DNA, 20 bp, Artificial Sequence
  chemically synthesized
gaaggatcaggacccaagag

SEQ ID NO: 486595 - DNA, 20 bp, Artificial Sequence
  chemically synthesized
cttgcattcttattcctctc

SEQ ID NO: 486596 - DNA, 20 bp, Artificial Sequence
  chemically synthesized
tcaggacccaagagaggaat

SEQ ID NO: 486597 - DNA, 20 bp, Artificial Sequence
  chemically synthesized
tatctgcagcaaaggaaaaa

SEQ ID NO: 486598 - DNA, 20 bp, Artificial Sequence
  chemically synthesized
atgatcactgcagataaatg

SEQ ID NO: 486599 - DNA, 20 bp, Artificial Sequence
  chemically synthesized
gccaacaaaagtagtatgac

SEQ ID NO: 486600 - DNA, 20 bp, Artificial Sequence
  chemically synthesized
aagtattattgaaatggaaa

SEQ ID NO: 486601 - DNA, 20 bp, Artificial Sequence
  chemically synthesized
ctttatttaactttgtagag

SEQ ID NO: 486602 - DNA, 20 bp, Artificial Sequence
  chemically synthesized
ttaaaatgtataaatcacca

SEQ ID NO: 486603 - DNA, 20 bp, Artificial Sequence
  chemically synthesized
ctatgcagccataaaaaatg

SEQ ID NO: 486604 - DNA, 20 bp, Artificial Sequence
  chemically synthesized
gatgagttcatgtcctttgt

SEQ ID NO: 486605 - DNA, 20 bp, Artificial Sequence
  chemically synthesized
ttcatgtcctttgtagggat

SEQ ID NO: 486606 - DNA, 20 bp, Artificial Sequence
  chemically synthesized
tgtccttgcgatagtttgct

SEQ ID NO: 486607 - DNA, 20 bp, Artificial Sequence
  chemically synthesized
ttcaattcccacctgtgagt

SEQ ID NO: 486608 - DNA, 20 bp, Artificial Sequence
  chemically synthesized
gcatattctcactcacaggt

SEQ ID NO: 486609 - DNA, 20 bp, Artificial Sequence
  chemically synthesized
tcattgttcaattcccacct

SEQ ID NO: 486610 - DNA, 20 bp, Artificial Sequence
  chemically synthesized
tcacacactggggcctgctg

SEQ ID NO: 486611 - DNA, 20 bp, Artificial Sequence
  chemically synthesized
gtggggtggggggagggggg

SEQ ID NO: 486612 - DNA, 20 bp, Artificial Sequence
  chemically synthesized
gatatacctaatgttcaatg

SEQ ID NO: 486613 - DNA, 20 bp, Artificial Sequence
  chemically synthesized
taatgttcaatgacgagtta

SEQ ID NO: 486614 - DNA, 20 bp, Artificial Sequence
  chemically synthesized
ttttattatactttaagttt

SEQ ID NO: 486615 - DNA, 20 bp, Artificial Sequence
  chemically synthesized
gtataaataaccttatatgt

SEQ ID NO: 486616 - DNA, 20 bp, Artificial Sequence
  chemically synthesized
ttttgaagtctctatttaaa

SEQ ID NO: 486617 - DNA, 20 bp, Artificial Sequence
  chemically synthesized
agtgatttagttatcttcat

SEQ ID NO: 486618 - DNA, 20 bp, Artificial Sequence
  chemically synthesized
ctgattaatagcataagctc

SEQ ID NO: 486619 - DNA, 20 bp, Artificial Sequence
  chemically synthesized
ggaatcatagagacttattt

SEQ ID NO: 486620 - DNA, 20 bp, Artificial Sequence
  chemically synthesized
cagagctagtcagtgacaga

SEQ ID NO: 486621 - DNA, 20 bp, Artificial Sequence
  chemically synthesized
gttacagagctagtcagtga

SEQ ID NO: 486622 - DNA, 20 bp, Artificial Sequence
  chemically synthesized
attttatagatgagataacc

SEQ ID NO: 486623 - DNA, 20 bp, Artificial Sequence
  chemically synthesized
ggttatctcatctataaaat

SEQ ID NO: 486624 - DNA, 20 bp, Artificial Sequence
  chemically synthesized
tagtgccacagttatacctt

SEQ ID NO: 486625 - DNA, 20 bp, Artificial Sequence
  chemically synthesized
acctaaattaatacaagtct

SEQ ID NO: 486626 - DNA, 20 bp, Artificial Sequence
  chemically synthesized
tcagaagtagaccctgagac

SEQ ID NO: 486627 - DNA, 20 bp, Artificial Sequence
  chemically synthesized
ttgtatttaaatccttgtct

SEQ ID NO: 486628 - DNA, 20 bp, Artificial Sequence
  chemically synthesized
tttctgggatcagctcccaa

SEQ ID NO: 486629 - DNA, 20 bp, Artificial Sequence
  chemically synthesized
tctcttctaccatggctttc

SEQ ID NO: 486630 - DNA, 20 bp, Artificial Sequence
  chemically synthesized
ggaacaaagttgagatatat

SEQ ID NO: 486631 - DNA, 20 bp, Artificial Sequence
  chemically synthesized
gaaatcaaactcaggagatg

SEQ ID NO: 486632 - DNA, 20 bp, Artificial Sequence
  chemically synthesized
tggacccaaccccacatctc

SEQ ID NO: 486633 - DNA, 20 bp, Artificial Sequence
  chemically synthesized
caaactcaggagatgtgggg

SEQ ID NO: 486634 - DNA, 20 bp, Artificial Sequence
  chemically synthesized
aggctttcttcccattttgg

SEQ ID NO: 486635 - DNA, 20 bp, Artificial Sequence
  chemically synthesized
ttccacactaaaaatctcca

SEQ ID NO: 486636 - DNA, 20 bp, Artificial Sequence
  chemically synthesized
tatcccaccttcttctcccc

SEQ ID NO: 486637 - DNA, 20 bp, Artificial Sequence
  chemically synthesized
tacccaaggggagaagaagg

SEQ ID NO: 486638 - DNA, 20 bp, Artificial Sequence
  chemically synthesized
gttacaattcaagatgagat

SEQ ID NO: 486639 - DNA, 20 bp, Artificial Sequence
  chemically synthesized
gttctcacccaaatctcatc

SEQ ID NO: 486640 - DNA, 20 bp, Artificial Sequence
  chemically synthesized
ccacaacacgtggggattat

SEQ ID NO: 486641 - DNA, 20 bp, Artificial Sequence
  chemically synthesized
tggtccctcccacaacacgt

SEQ ID NO: 486642 - DNA, 20 bp, Artificial Sequence
  chemically synthesized
agggaccatgtgggaggtaa

SEQ ID NO: 486643 - DNA, 20 bp, Artificial Sequence
  chemically synthesized
gtgggaggtaactgaatcat

SEQ ID NO: 486644 - DNA, 20 bp, Artificial Sequence
  chemically synthesized
aggtaactgaatcatggggg

SEQ ID NO: 486645 - DNA, 20 bp, Artificial Sequence
  chemically synthesized
cctgtgctgttctcctgata

SEQ ID NO: 486646 - DNA, 20 bp, Artificial Sequence
  chemically synthesized
ctctccagccatgtggaact

SEQ ID NO: 486647 - DNA, 20 bp, Artificial Sequence
  chemically synthesized
cctgtataaattatccagtc

SEQ ID NO: 486648 - DNA, 20 bp, Artificial Sequence
  chemically synthesized
ctatgaagaaatacccgaga

SEQ ID NO: 486649 - DNA, 20 bp, Artificial Sequence
  chemically synthesized
taaccaatggacaaaagctg

SEQ ID NO: 486650 - DNA, 20 bp, Artificial Sequence
  chemically synthesized
gctggggaggagattatctc

SEQ ID NO: 486651 - DNA, 20 bp, Artificial Sequence
  chemically synthesized
tgagtcctttctctgcctgt

SEQ ID NO: 486652 - DNA, 20 bp, Artificial Sequence
  chemically synthesized
acaagtacctgtgagtcttc

SEQ ID NO: 486653 - DNA, 20 bp, Artificial Sequence
  chemically synthesized
gcgtctaactacaagtacct

SEQ ID NO: 486654 - DNA, 20 bp, Artificial Sequence
  chemically synthesized
cttcatggtttataggaagg

SEQ ID NO: 486655 - DNA, 20 bp, Artificial Sequence
  chemically synthesized
aggctgagtgctaaggggaa

SEQ ID NO: 486656 - DNA, 20 bp, Artificial Sequence
  chemically synthesized
ggggaaatgggtagcccact

SEQ ID NO: 486657 - DNA, 20 bp, Artificial Sequence
  chemically synthesized
tggcttttagtatacaatga

SEQ ID NO: 486658 - DNA, 20 bp, Artificial Sequence
  chemically synthesized
tactagatattttctgcttt

SEQ ID NO: 486659 - DNA, 20 bp, Artificial Sequence
  chemically synthesized
gttgtgctaccaactatata

SEQ ID NO: 486660 - DNA, 20 bp, Artificial Sequence
  chemically synthesized
tggtagcacaactgagatat

SEQ ID NO: 486661 - DNA, 20 bp, Artificial Sequence
  chemically synthesized
gtgagccaccgcgcccggcc

SEQ ID NO: 486662 - DNA, 20 bp, Artificial Sequence
  chemically synthesized
gcctcggccttccaaagtgc

SEQ ID NO: 486663 - DNA, 20 bp, Artificial Sequence
  chemically synthesized
actttggaaggccgaggcgg

SEQ ID NO: 486664 - DNA, 20 bp, Artificial Sequence
  chemically synthesized
cggggtttcactgtgttagc

SEQ ID NO: 486665 - DNA, 20 bp, Artificial Sequence
  chemically synthesized
tttgtgttttttagtagaga

SEQ ID NO: 486666 - DNA, 20 bp, Artificial Sequence
  chemically synthesized
tacgggggaggctgaggcag

SEQ ID NO: 486667 - DNA, 20 bp, Artificial Sequence
  chemically synthesized
ctcactgcaagctccgcctc

SEQ ID NO: 486668 - DNA, 20 bp, Artificial Sequence
  chemically synthesized
tctcactctgtcgcccaggc

SEQ ID NO: 486669 - DNA, 20 bp, Artificial Sequence
  chemically synthesized
ctgcactccagcctgggcga

SEQ ID NO: 486670 - DNA, 20 bp, Artificial Sequence
  chemically synthesized
ttttttttttttttttgaga

SEQ ID NO: 486671 - DNA, 20 bp, Artificial Sequence
  chemically synthesized
catatagaagagccagttaa

SEQ ID NO: 486672 - DNA, 20 bp, Artificial Sequence
  chemically synthesized
cttctatatgtccatataca

SEQ ID NO: 486673 - DNA, 20 bp, Artificial Sequence
  chemically synthesized
ctcttggtaataactatgga

SEQ ID NO: 486674 - DNA, 20 bp, Artificial Sequence
  chemically synthesized
atgtctcttggtaataacta

SEQ ID NO: 486675 - DNA, 20 bp, Artificial Sequence
  chemically synthesized
tagttattaccaagagacat

SEQ ID NO: 486676 - DNA, 20 bp, Artificial Sequence
  chemically synthesized
ttgaatcaaatatcctgatt

SEQ ID NO: 486677 - DNA, 20 bp, Artificial Sequence
  chemically synthesized
ttaatgtgaagactccaaat

SEQ ID NO: 486678 - DNA, 20 bp, Artificial Sequence
  chemically synthesized
tttctttcaaaaatgctaaa

SEQ ID NO: 486679 - DNA, 20 bp, Artificial Sequence
  chemically synthesized
gttctcaggcccagcagctt

SEQ ID NO: 486680 - DNA, 20 bp, Artificial Sequence
  chemically synthesized
ccagcagcttgtggataaga

SEQ ID NO: 486681 - DNA, 20 bp, Artificial Sequence
  chemically synthesized
atctggttgtaaatgtcaat

SEQ ID NO: 486682 - DNA, 20 bp, Artificial Sequence
  chemically synthesized
ttaggtagacaggactttgc

SEQ ID NO: 486683 - DNA, 20 bp, Artificial Sequence
  chemically synthesized
tgcagagctgttcagtgttc

SEQ ID NO: 486684 - DNA, 20 bp, Artificial Sequence
  chemically synthesized
cttctaagctataacatcct

SEQ ID NO: 486685 - DNA, 20 bp, Artificial Sequence
  chemically synthesized
actccccatctccccacccc

SEQ ID NO: 486686 - DNA, 20 bp, Artificial Sequence
  chemically synthesized
atcctcggggtggggagatg

SEQ ID NO: 486687 - DNA, 20 bp, Artificial Sequence
  chemically synthesized
agtagaggtgctaaaataag

SEQ ID NO: 486688 - DNA, 20 bp, Artificial Sequence
  chemically synthesized
tccctttagcattcacagca

SEQ ID NO: 486689 - DNA, 20 bp, Artificial Sequence
  chemically synthesized
ttccaatgagatccagtgct

SEQ ID NO: 486690 - DNA, 20 bp, Artificial Sequence
  chemically synthesized
ttcacagcactggatctcat

SEQ ID NO: 486691 - DNA, 20 bp, Artificial Sequence
  chemically synthesized
ctgctgtgtgcagcaaggag

SEQ ID NO: 486692 - DNA, 20 bp, Artificial Sequence
  chemically synthesized
cccttctgctgtgtgcagca

SEQ ID NO: 486693 - DNA, 20 bp, Artificial Sequence
  chemically synthesized
tccttgctgcacacagcaga

SEQ ID NO: 486694 - DNA, 20 bp, Artificial Sequence
  chemically synthesized
tgctgcacacagcagaaggg

SEQ ID NO: 486695 - DNA, 20 bp, Artificial Sequence
  chemically synthesized
cagacatacagtgagtgggg

SEQ ID NO: 486696 - DNA, 20 bp, Artificial Sequence
  chemically synthesized
actactaccacagacataca

SEQ ID NO: 486697 - DNA, 20 bp, Artificial Sequence
  chemically synthesized
gcctcagcctcccatagtgc

SEQ ID NO: 486698 - DNA, 20 bp, Artificial Sequence
  chemically synthesized
actatgggaggctgaggcag

SEQ ID NO: 486699 - DNA, 20 bp, Artificial Sequence
  chemically synthesized
caggtggatcacctgaggtc

SEQ ID NO: 486700 - DNA, 20 bp, Artificial Sequence
  chemically synthesized
ttttgtatttttagtagaga

SEQ ID NO: 486701 - DNA, 20 bp, Artificial Sequence
  chemically synthesized
aaaattagccaggcgtggtg

SEQ ID NO: 486702 - DNA, 20 bp, Artificial Sequence
  chemically synthesized
gcctcagcctcctgagtagc

SEQ ID NO: 486703 - DNA, 20 bp, Artificial Sequence
  chemically synthesized
ggttctcctgcctcagcctc

SEQ ID NO: 486704 - DNA, 20 bp, Artificial Sequence
  chemically synthesized
ctcacagcaacctctgcctc

SEQ ID NO: 486705 - DNA, 20 bp, Artificial Sequence
  chemically synthesized
ttgcaccactgcactccagc

SEQ ID NO: 486706 - DNA, 20 bp, Artificial Sequence
  chemically synthesized
tcttgctctgtcacccaggc

SEQ ID NO: 486707 - DNA, 20 bp, Artificial Sequence
  chemically synthesized
ctctctctttttttttgaga

SEQ ID NO: 486708 - DNA, 20 bp, Artificial Sequence
  chemically synthesized
agtttctgatttactagctc

SEQ ID NO: 486709 - DNA, 20 bp, Artificial Sequence
  chemically synthesized
agctagtaaatcagaaactc

SEQ ID NO: 486710 - DNA, 20 bp, Artificial Sequence
  chemically synthesized
agattactgggcttcaaccc

SEQ ID NO: 486711 - DNA, 20 bp, Artificial Sequence
  chemically synthesized
aatctatactttgcgaagaa

SEQ ID NO: 486712 - DNA, 20 bp, Artificial Sequence
  chemically synthesized
tctaacgcatggtaattttt

SEQ ID NO: 486713 - DNA, 20 bp, Artificial Sequence
  chemically synthesized
ggtaatttttgagaattaag

SEQ ID NO: 486714 - DNA, 20 bp, Artificial Sequence
  chemically synthesized
atcaaaggggtatgcatatt

SEQ ID NO: 486715 - DNA, 20 bp, Artificial Sequence
  chemically synthesized
gatgccacatcgcatatcaa

SEQ ID NO: 486716 - DNA, 20 bp, Artificial Sequence
  chemically synthesized
tgaagtaatttcctcatctc

SEQ ID NO: 486717 - DNA, 20 bp, Artificial Sequence
  chemically synthesized
gggcagttttccaagagagg

SEQ ID NO: 486718 - DNA, 20 bp, Artificial Sequence
  chemically synthesized
ctctcttggaaaactgccct

SEQ ID NO: 486719 - DNA, 20 bp, Artificial Sequence
  chemically synthesized
atgaagcctaatctagccta

SEQ ID NO: 486720 - DNA, 20 bp, Artificial Sequence
  chemically synthesized
ctaatctagcctacaggatg

SEQ ID NO: 486721 - DNA, 20 bp, Artificial Sequence
  chemically synthesized
ggatgatgagtggccttatg

SEQ ID NO: 486722 - DNA, 20 bp, Artificial Sequence
  chemically synthesized
gccagctgtcagatatctga

SEQ ID NO: 486723 - DNA, 20 bp, Artificial Sequence
  chemically synthesized
tcttgcttggtgttacttat

SEQ ID NO: 486724 - DNA, 20 bp, Artificial Sequence
  chemically synthesized
gtaacaccaagcaagaccat

SEQ ID NO: 486725 - DNA, 20 bp, Artificial Sequence
  chemically synthesized
gaagtttgctctgtgattag

SEQ ID NO: 486726 - DNA, 20 bp, Artificial Sequence
  chemically synthesized
cagagcaaacttcagacaca

SEQ ID NO: 486727 - DNA, 20 bp, Artificial Sequence
  chemically synthesized
ccaaaacttaacagttcaaa

SEQ ID NO: 486728 - DNA, 20 bp, Artificial Sequence
  chemically synthesized
cgttttgaactgttaagttt

SEQ ID NO: 486729 - DNA, 20 bp, Artificial Sequence
  chemically synthesized
acttaaattataaattataa

SEQ ID NO: 486730 - DNA, 20 bp, Artificial Sequence
  chemically synthesized
agcttctacatctataaaag

SEQ ID NO: 486731 - DNA, 20 bp, Artificial Sequence
  chemically synthesized
ttattgcaattattatctag

SEQ ID NO: 486732 - DNA, 20 bp, Artificial Sequence
  chemically synthesized
ttgcaataattattccaagt

SEQ ID NO: 486733 - DNA, 20 bp, Artificial Sequence
  chemically synthesized
gaaccatagaaatccaaact

SEQ ID NO: 486734 - DNA, 20 bp, Artificial Sequence
  chemically synthesized
atggttctaagaaattcaaa

SEQ ID NO: 486735 - DNA, 20 bp, Artificial Sequence
  chemically synthesized
aaaaaattggttcactctat

SEQ ID NO: 486736 - DNA, 20 bp, Artificial Sequence
  chemically synthesized
gcctcagcctctcaaagtgc

SEQ ID NO: 486737 - DNA, 20 bp, Artificial Sequence
  chemically synthesized
actttgagaggctgaggcag

SEQ ID NO: 486738 - DNA, 20 bp, Artificial Sequence
  chemically synthesized
caggcggatcacttgaggtc

SEQ ID NO: 486739 - DNA, 20 bp, Artificial Sequence
  chemically synthesized
ttttgtagttttagtaaaga

SEQ ID NO: 486740 - DNA, 20 bp, Artificial Sequence
  chemically synthesized
gcctcagcctcccaagtagc

SEQ ID NO: 486741 - DNA, 20 bp, Artificial Sequence
  chemically synthesized
tacttgggaggctgaggcag

SEQ ID NO: 486742 - DNA, 20 bp, Artificial Sequence
  chemically synthesized
tcttgctctgttgcccaggc

SEQ ID NO: 486743 - DNA, 20 bp, Artificial Sequence
  chemically synthesized
gtgtgtgtgtgtgtgtgtga

SEQ ID NO: 486744 - DNA, 20 bp, Artificial Sequence
  chemically synthesized
aactcaatcttaaatttatc

SEQ ID NO: 486745 - DNA, 20 bp, Artificial Sequence
  chemically synthesized
tactccagataaatttaaga

SEQ ID NO: 486746 - DNA, 20 bp, Artificial Sequence
  chemically synthesized
cagctagaaagcaagcaagc

SEQ ID NO: 486747 - DNA, 20 bp, Artificial Sequence
  chemically synthesized
atgttctttgcagttatttt

SEQ ID NO: 486748 - DNA, 20 bp, Artificial Sequence
  chemically synthesized
gcttctacatatttaatagt

SEQ ID NO: 486749 - DNA, 20 bp, Artificial Sequence
  chemically synthesized
aatggaaacaatctgctata

SEQ ID NO: 486750 - DNA, 20 bp, Artificial Sequence
  chemically synthesized
tgtactgtattacaatgtaa

SEQ ID NO: 486751 - DNA, 20 bp, Artificial Sequence
  chemically synthesized
ttcctgcaagtcaggaagtc

SEQ ID NO: 486752 - DNA, 20 bp, Artificial Sequence
  chemically synthesized
gtagttcaaatatcagaata

SEQ ID NO: 486753 - DNA, 20 bp, Artificial Sequence
  chemically synthesized
tactgtggtagttcaaatat

SEQ ID NO: 486754 - DNA, 20 bp, Artificial Sequence
  chemically synthesized
ttattttaataaaagcagct

SEQ ID NO: 486755 - DNA, 20 bp, Artificial Sequence
  chemically synthesized
agatgttaaatacacaaatg

SEQ ID NO: 486756 - DNA, 20 bp, Artificial Sequence
  chemically synthesized
atctgtttcggtttgctaaa

SEQ ID NO: 486757 - DNA, 20 bp, Artificial Sequence
  chemically synthesized
aaaaaagaattaagggaaag

SEQ ID NO: 486758 - DNA, 20 bp, Artificial Sequence
  chemically synthesized
agttgtggtagtagctaaaa

SEQ ID NO: 486759 - DNA, 20 bp, Artificial Sequence
  chemically synthesized
agctgtttggtgatagctgg

SEQ ID NO: 486760 - DNA, 20 bp, Artificial Sequence
  chemically synthesized
gctgccagtatggagagtct

SEQ ID NO: 486761 - DNA, 20 bp, Artificial Sequence
  chemically synthesized
tccacattgctgccagtatg

SEQ ID NO: 486762 - DNA, 20 bp, Artificial Sequence
  chemically synthesized
tggaggacataggagaagac

SEQ ID NO: 486763 - DNA, 20 bp, Artificial Sequence
  chemically synthesized
aggagaagacaagagtggtg

SEQ ID NO: 486764 - DNA, 20 bp, Artificial Sequence
  chemically synthesized
tacttccttctccccaacat

SEQ ID NO: 486765 - DNA, 20 bp, Artificial Sequence
  chemically synthesized
gtagggcagtgctatgaaag

SEQ ID NO: 486766 - DNA, 20 bp, Artificial Sequence
  chemically synthesized
agatcagtgagactagagga

SEQ ID NO: 486767 - DNA, 20 bp, Artificial Sequence
  chemically synthesized
aaggagatcagtgagactag

SEQ ID NO: 486768 - DNA, 20 bp, Artificial Sequence
  chemically synthesized
ctgaagtaggaacaagatga

SEQ ID NO: 486769 - DNA, 20 bp, Artificial Sequence
  chemically synthesized
cagtcttttctctccctgcc

SEQ ID NO: 486770 - DNA, 20 bp, Artificial Sequence
  chemically synthesized
actaagcagggagatgggat

SEQ ID NO: 486771 - DNA, 20 bp, Artificial Sequence
  chemically synthesized
agaacaactaagcagggaga

SEQ ID NO: 486772 - DNA, 20 bp, Artificial Sequence
  chemically synthesized
ttctcaaatgtcagtgtgca

SEQ ID NO: 486773 - DNA, 20 bp, Artificial Sequence
  chemically synthesized
agtgtgcacaggattcacct

SEQ ID NO: 486774 - DNA, 20 bp, Artificial Sequence
  chemically synthesized
cattttaatagaatccccag

SEQ ID NO: 486775 - DNA, 20 bp, Artificial Sequence
  chemically synthesized
aatcacaatctgcattttaa

SEQ ID NO: 486776 - DNA, 20 bp, Artificial Sequence
  chemically synthesized
aaaatgcagattgtgattca

SEQ ID NO: 486777 - DNA, 20 bp, Artificial Sequence
  chemically synthesized
agattgtgattcagtgggtc

SEQ ID NO: 486778 - DNA, 20 bp, Artificial Sequence
  chemically synthesized
aggcccctatcctagaccca

SEQ ID NO: 486779 - DNA, 20 bp, Artificial Sequence
  chemically synthesized
atgggtatttgttagacaca

SEQ ID NO: 486780 - DNA, 20 bp, Artificial Sequence
  chemically synthesized
tagtctacagattgatgtca

SEQ ID NO: 486781 - DNA, 20 bp, Artificial Sequence
  chemically synthesized
ctcaataattataagtgctg

SEQ ID NO: 486782 - DNA, 20 bp, Artificial Sequence
  chemically synthesized
ctggtgctgcgagtacagca

SEQ ID NO: 486783 - DNA, 20 bp, Artificial Sequence
  chemically synthesized
ttgagcatcatactggtgct

SEQ ID NO: 486784 - DNA, 20 bp, Artificial Sequence
  chemically synthesized
catggaagttaataaataaa

SEQ ID NO: 486785 - DNA, 20 bp, Artificial Sequence
  chemically synthesized
gaagttaataaataaagtgg

SEQ ID NO: 486786 - DNA, 20 bp, Artificial Sequence
  chemically synthesized
ttaggtaagttacacgttaa

SEQ ID NO: 486787 - DNA, 20 bp, Artificial Sequence
  chemically synthesized
cttatatgggacataaactc

SEQ ID NO: 486788 - DNA, 20 bp, Artificial Sequence
  chemically synthesized
gggacataaactcatgagtt

SEQ ID NO: 486789 - DNA, 20 bp, Artificial Sequence
  chemically synthesized
gtttgttaaactctgaactc

SEQ ID NO: 486790 - DNA, 20 bp, Artificial Sequence
  chemically synthesized
attggaacataatctcttca

SEQ ID NO: 486791 - DNA, 20 bp, Artificial Sequence
  chemically synthesized
ataatctcttcatggagtta

SEQ ID NO: 486792 - DNA, 20 bp, Artificial Sequence
  chemically synthesized
aacaaataaacctgacacag

SEQ ID NO: 486793 - DNA, 20 bp, Artificial Sequence
  chemically synthesized
ggacactgaaattgctgtat

SEQ ID NO: 486794 - DNA, 20 bp, Artificial Sequence
  chemically synthesized
aaatctaactctgatgactg

SEQ ID NO: 486795 - DNA, 20 bp, Artificial Sequence
  chemically synthesized
tgggattactcggcagtcat

SEQ ID NO: 486796 - DNA, 20 bp, Artificial Sequence
  chemically synthesized
agtgcatctcatgtgccctc

SEQ ID NO: 486797 - DNA, 20 bp, Artificial Sequence
  chemically synthesized
ttagaaggcataaatagtgc

SEQ ID NO: 486798 - DNA, 20 bp, Artificial Sequence
  chemically synthesized
agcactatttatgccttcta

SEQ ID NO: 486799 - DNA, 20 bp, Artificial Sequence
  chemically synthesized
tgaactggaagaatcacagc

SEQ ID NO: 486800 - DNA, 20 bp, Artificial Sequence
  chemically synthesized
gtagaaaaatactgaactgg

SEQ ID NO: 486801 - DNA, 20 bp, Artificial Sequence
  chemically synthesized
aggcagaactaaaaacatct

SEQ ID NO: 486802 - DNA, 20 bp, Artificial Sequence
  chemically synthesized
tttttagttctgcctaatta

SEQ ID NO: 486803 - DNA, 20 bp, Artificial Sequence
  chemically synthesized
ttttctggcctctttcccct

SEQ ID NO: 486804 - DNA, 20 bp, Artificial Sequence
  chemically synthesized
gccagcattaacattgccat

SEQ ID NO: 486805 - DNA, 20 bp, Artificial Sequence
  chemically synthesized
taacattgccatgagaattt

SEQ ID NO: 486806 - DNA, 20 bp, Artificial Sequence
  chemically synthesized
accacaagctgacttggggg

SEQ ID NO: 486807 - DNA, 20 bp, Artificial Sequence
  chemically synthesized
ttagttcaagaaaaagaaaa

SEQ ID NO: 486808 - DNA, 20 bp, Artificial Sequence
  chemically synthesized
caggaacaatgcacacatcc

SEQ ID NO: 486809 - DNA, 20 bp, Artificial Sequence
  chemically synthesized
tgcacacatccctggatgct

SEQ ID NO: 486810 - DNA, 20 bp, Artificial Sequence
  chemically synthesized
aaccaatattcctagcatcc

SEQ ID NO: 486811 - DNA, 20 bp, Artificial Sequence
  chemically synthesized
tgttaatggtgttccttact

SEQ ID NO: 486812 - DNA, 20 bp, Artificial Sequence
  chemically synthesized
ccaggggctggctgctgcct

SEQ ID NO: 486813 - DNA, 20 bp, Artificial Sequence
  chemically synthesized
agcccctggccaatggctgg

SEQ ID NO: 486814 - DNA, 20 bp, Artificial Sequence
  chemically synthesized
ggccaatggctggctggatc

SEQ ID NO: 486815 - DNA, 20 bp, Artificial Sequence
  chemically synthesized
gctggctgtgcagagctgtc

SEQ ID NO: 486816 - DNA, 20 bp, Artificial Sequence
  chemically synthesized
gagcacaagggagattgtgg

SEQ ID NO: 486817 - DNA, 20 bp, Artificial Sequence
  chemically synthesized
cttgtgctcttctcttcctt

SEQ ID NO: 486818 - DNA, 20 bp, Artificial Sequence
  chemically synthesized
ttgcatgacaacgggatatg

SEQ ID NO: 486819 - DNA, 20 bp, Artificial Sequence
  chemically synthesized
ttcaaagtgttgcatgacaa

SEQ ID NO: 486820 - DNA, 20 bp, Artificial Sequence
  chemically synthesized
tcccgttgtcatgcaacact

SEQ ID NO: 486821 - DNA, 20 bp, Artificial Sequence
  chemically synthesized
tgtcatgcaacactttgaat

SEQ ID NO: 486822 - DNA, 20 bp, Artificial Sequence
  chemically synthesized
tgaatcagagtcaatttcca

SEQ ID NO: 486823 - DNA, 20 bp, Artificial Sequence
  chemically synthesized
attgactgtgcaaaaagtct

SEQ ID NO: 486824 - DNA, 20 bp, Artificial Sequence
  chemically synthesized
caaaggtttatctctatctt

SEQ ID NO: 486825 - DNA, 20 bp, Artificial Sequence
  chemically synthesized
gtgcaactatgaagtgatga

SEQ ID NO: 486826 - DNA, 20 bp, Artificial Sequence
  chemically synthesized
aacaaatagctagagccaaa

SEQ ID NO: 486827 - DNA, 20 bp, Artificial Sequence
  chemically synthesized
atagctagagccaaagagaa

SEQ ID NO: 486828 - DNA, 20 bp, Artificial Sequence
  chemically synthesized
tattggagcctgtaagtata

SEQ ID NO: 486829 - DNA, 20 bp, Artificial Sequence
  chemically synthesized
gaagttagaagatctgagct

SEQ ID NO: 486830 - DNA, 20 bp, Artificial Sequence
  chemically synthesized
aattatcttcaaagtgttaa

SEQ ID NO: 486831 - DNA, 20 bp, Artificial Sequence
  chemically synthesized
ccaaatggattaagatgttc

SEQ ID NO: 486832 - DNA, 20 bp, Artificial Sequence
  chemically synthesized
tgaacatcttaatccatttg

SEQ ID NO: 486833 - DNA, 20 bp, Artificial Sequence
  chemically synthesized
tccaataatatattcaccaa

SEQ ID NO: 486834 - DNA, 20 bp, Artificial Sequence
  chemically synthesized
tccatttggtgaatatatta

SEQ ID NO: 486835 - DNA, 20 bp, Artificial Sequence
  chemically synthesized
ttacttctaaattaacttta

SEQ ID NO: 486836 - DNA, 20 bp, Artificial Sequence
  chemically synthesized
tctaaattaactttagtggg

SEQ ID NO: 486837 - DNA, 20 bp, Artificial Sequence
  chemically synthesized
gtgggtagaatttcttttaa

SEQ ID NO: 486838 - DNA, 20 bp, Artificial Sequence
  chemically synthesized
gagcaattgataaatatttg

SEQ ID NO: 486839 - DNA, 20 bp, Artificial Sequence
  chemically synthesized
aataaaattatgcctggaga

SEQ ID NO: 486840 - DNA, 20 bp, Artificial Sequence
  chemically synthesized
ataattttatttaaaggaag

SEQ ID NO: 486841 - DNA, 20 bp, Artificial Sequence
  chemically synthesized
agcaactagcttaattcttg

SEQ ID NO: 486842 - DNA, 20 bp, Artificial Sequence
  chemically synthesized
aaccacaatagatactcttc

SEQ ID NO: 486843 - DNA, 20 bp, Artificial Sequence
  chemically synthesized
taggattttcctaaagttat

SEQ ID NO: 486844 - DNA, 20 bp, Artificial Sequence
  chemically synthesized
ctgggggtgagccagtacat

SEQ ID NO: 486845 - DNA, 20 bp, Artificial Sequence
  chemically synthesized
agactctgatataattgact

SEQ ID NO: 486846 - DNA, 20 bp, Artificial Sequence
  chemically synthesized
tcacccccagtcaattatat

SEQ ID NO: 486847 - DNA, 20 bp, Artificial Sequence
  chemically synthesized
ggaggggctgcagtggacac

SEQ ID NO: 486848 - DNA, 20 bp, Artificial Sequence
  chemically synthesized
gtctttctttgaagggggct

SEQ ID NO: 486849 - DNA, 20 bp, Artificial Sequence
  chemically synthesized
tcatttccatcatctagaac

SEQ ID NO: 486850 - DNA, 20 bp, Artificial Sequence
  chemically synthesized
cctgaagggactgacagttg

SEQ ID NO: 486851 - DNA, 20 bp, Artificial Sequence
  chemically synthesized
actttcaccttcatcagtca

SEQ ID NO: 486852 - DNA, 20 bp, Artificial Sequence
  chemically synthesized
tgctggtagatgtatatcaa

SEQ ID NO: 486853 - DNA, 20 bp, Artificial Sequence
  chemically synthesized
atcaactggatctctgatct

SEQ ID NO: 486854 - DNA, 20 bp, Artificial Sequence
  chemically synthesized
aatttaaatttaaccgtggt

SEQ ID NO: 486855 - DNA, 20 bp, Artificial Sequence
  chemically synthesized
atacgataatttatagccag

SEQ ID NO: 486856 - DNA, 20 bp, Artificial Sequence
  chemically synthesized
aaagatttgccgtaggacct

SEQ ID NO: 486857 - DNA, 20 bp, Artificial Sequence
  chemically synthesized
tctttacaacttactgagga

SEQ ID NO: 486858 - DNA, 20 bp, Artificial Sequence
  chemically synthesized
gggcagttgttctcatactt

SEQ ID NO: 486859 - DNA, 20 bp, Artificial Sequence
  chemically synthesized
ttctcatactttaggatcaa

SEQ ID NO: 486860 - DNA, 20 bp, Artificial Sequence
  chemically synthesized
taattgctgcatggtagccc

SEQ ID NO: 486861 - DNA, 20 bp, Artificial Sequence
  chemically synthesized
tgcatggtagccccggagtt

SEQ ID NO: 486862 - DNA, 20 bp, Artificial Sequence
  chemically synthesized
agttctggatttagtagata

SEQ ID NO: 486863 - DNA, 20 bp, Artificial Sequence
  chemically synthesized
attaggtgtaatagatatct

SEQ ID NO: 486864 - DNA, 20 bp, Artificial Sequence
  chemically synthesized
tgagggtctattatgttctc

SEQ ID NO: 486865 - DNA, 20 bp, Artificial Sequence
  chemically synthesized
aatcctattgaaaatgatct

SEQ ID NO: 486866 - DNA, 20 bp, Artificial Sequence
  chemically synthesized
gaccctcagatcattttcaa

SEQ ID NO: 486867 - DNA, 20 bp, Artificial Sequence
  chemically synthesized
tctctgctcgggtttcgcaa

SEQ ID NO: 486868 - DNA, 20 bp, Artificial Sequence
  chemically synthesized
ccttggtagcttttctctgc

SEQ ID NO: 486869 - DNA, 20 bp, Artificial Sequence
  chemically synthesized
gagcagagaaaagctaccaa

SEQ ID NO: 486870 - DNA, 20 bp, Artificial Sequence
  chemically synthesized
cttgactaggaaaacatacg

SEQ ID NO: 486871 - DNA, 20 bp, Artificial Sequence
  chemically synthesized
tttcagtggcttaacacaat

SEQ ID NO: 486872 - DNA, 20 bp, Artificial Sequence
  chemically synthesized
attcctcataaggtaagcat

SEQ ID NO: 486873 - DNA, 20 bp, Artificial Sequence
  chemically synthesized
attcctatgcttaccttatg

SEQ ID NO: 486874 - DNA, 20 bp, Artificial Sequence
  chemically synthesized
tacaaataacttgattgatg

SEQ ID NO: 486875 - DNA, 20 bp, Artificial Sequence
  chemically synthesized
gaaattgcatttctagtctg

SEQ ID NO: 486876 - DNA, 20 bp, Artificial Sequence
  chemically synthesized
gcatttctagtctgaagaat

SEQ ID NO: 486877 - DNA, 20 bp, Artificial Sequence
  chemically synthesized
aaactacaaactctttaaat

SEQ ID NO: 486878 - DNA, 20 bp, Artificial Sequence
  chemically synthesized
gttcattccattcctattta

SEQ ID NO: 486879 - DNA, 20 bp, Artificial Sequence
  chemically synthesized
acaaactctttaaataggaa

SEQ ID NO: 486880 - DNA, 20 bp, Artificial Sequence
  chemically synthesized
tggaatgaacccaacctaac

SEQ ID NO: 486881 - DNA, 20 bp, Artificial Sequence
  chemically synthesized
tatgaaacattccagttagg

SEQ ID NO: 486882 - DNA, 20 bp, Artificial Sequence
  chemically synthesized
atgctaatcattaatttaat

SEQ ID NO: 486883 - DNA, 20 bp, Artificial Sequence
  chemically synthesized
cacctgaacaattatttttc

SEQ ID NO: 486884 - DNA, 20 bp, Artificial Sequence
  chemically synthesized
aactggcacaaagtctggca

SEQ ID NO: 486885 - DNA, 20 bp, Artificial Sequence
  chemically synthesized
tctaatttacttacatgtct

SEQ ID NO: 486886 - DNA, 20 bp, Artificial Sequence
  chemically synthesized
aacctattgacctctccagg

SEQ ID NO: 486887 - DNA, 20 bp, Artificial Sequence
  chemically synthesized
aaattcaaatgttagctttt

SEQ ID NO: 486888 - DNA, 20 bp, Artificial Sequence
  chemically synthesized
ttacccacaaaagctaacat

SEQ ID NO: 486889 - DNA, 20 bp, Artificial Sequence
  chemically synthesized
gccctttttccacctggcgc

SEQ ID NO: 486890 - DNA, 20 bp, Artificial Sequence
  chemically synthesized
aagtaatgatacagagctgc

SEQ ID NO: 486891 - DNA, 20 bp, Artificial Sequence
  chemically synthesized
tctactctgtggttttagaa

SEQ ID NO: 486892 - DNA, 20 bp, Artificial Sequence
  chemically synthesized
tacattctcttctaaaacca

SEQ ID NO: 486893 - DNA, 20 bp, Artificial Sequence
  chemically synthesized
aagcctccacaatgcaaaac

SEQ ID NO: 486894 - DNA, 20 bp, Artificial Sequence
  chemically synthesized
cattgtggaggctttatcag

SEQ ID NO: 486895 - DNA, 20 bp, Artificial Sequence
  chemically synthesized
tgggaggctaacatggtaac

SEQ ID NO: 486896 - DNA, 20 bp, Artificial Sequence
  chemically synthesized
ggccatacagaaaaaggcag

SEQ ID NO: 486897 - DNA, 20 bp, Artificial Sequence
  chemically synthesized
caaattgtttcttccagttg

SEQ ID NO: 486898 - DNA, 20 bp, Artificial Sequence
  chemically synthesized
tcagggggtactatgaatta

SEQ ID NO: 486899 - DNA, 20 bp, Artificial Sequence
  chemically synthesized
gagaaaaatcagggggtact

SEQ ID NO: 486900 - DNA, 20 bp, Artificial Sequence
  chemically synthesized
aggaaaaaggagaaaaatca

SEQ ID NO: 486901 - DNA, 20 bp, Artificial Sequence
  chemically synthesized
tcctctttccaaataaggaa

SEQ ID NO: 486902 - DNA, 20 bp, Artificial Sequence
  chemically synthesized
aaacatttgatttttttaga

SEQ ID NO: 486903 - DNA, 20 bp, Artificial Sequence
  chemically synthesized
aaatcaaatgtttagccaac

SEQ ID NO: 486904 - DNA, 20 bp, Artificial Sequence
  chemically synthesized
tttccccccattggctgggg

SEQ ID NO: 486905 - DNA, 20 bp, Artificial Sequence
  chemically synthesized
taccctttccccccattggc

SEQ ID NO: 486906 - DNA, 20 bp, Artificial Sequence
  chemically synthesized
aaccccagccaatgggggga

SEQ ID NO: 486907 - DNA, 20 bp, Artificial Sequence
  chemically synthesized
acaggggcaggacttgcgtc

SEQ ID NO: 486908 - DNA, 20 bp, Artificial Sequence
  chemically synthesized
gcaattttacttctgcacag

SEQ ID NO: 486909 - DNA, 20 bp, Artificial Sequence
  chemically synthesized
agaagtaaaattgctttgct

SEQ ID NO: 486910 - DNA, 20 bp, Artificial Sequence
  chemically synthesized
ctttgctaagaatcctttgt

SEQ ID NO: 486911 - DNA, 20 bp, Artificial Sequence
  chemically synthesized
ggacattgaacactcgaaca

SEQ ID NO: 486912 - DNA, 20 bp, Artificial Sequence
  chemically synthesized
gttcgagtgttcaatgtcct

SEQ ID NO: 486913 - DNA, 20 bp, Artificial Sequence
  chemically synthesized
ctgacagggtagactgtgtt

SEQ ID NO: 486914 - DNA, 20 bp, Artificial Sequence
  chemically synthesized
actggaaagacacatgctga

SEQ ID NO: 486915 - DNA, 20 bp, Artificial Sequence
  chemically synthesized
gtgcccttcgcaaggcagga

SEQ ID NO: 486916 - DNA, 20 bp, Artificial Sequence
  chemically synthesized
tcttattaggaagcactaga

SEQ ID NO: 486917 - DNA, 20 bp, Artificial Sequence
  chemically synthesized
gtctagtgcttcctaataag

SEQ ID NO: 486918 - DNA, 20 bp, Artificial Sequence
  chemically synthesized
gaggagttcagtaaatattt

SEQ ID NO: 486919 - DNA, 20 bp, Artificial Sequence
  chemically synthesized
gttcagtaaatatttctgaa

SEQ ID NO: 486920 - DNA, 20 bp, Artificial Sequence
  chemically synthesized
aattaaatgaaaattgctac

SEQ ID NO: 486921 - DNA, 20 bp, Artificial Sequence
  chemically synthesized
ttcaatgtgaactacatacc

SEQ ID NO: 486922 - DNA, 20 bp, Artificial Sequence
  chemically synthesized
gcttattttttcttttgaga

SEQ ID NO: 486923 - DNA, 20 bp, Artificial Sequence
  chemically synthesized
ctgctctcccgcctgggtga

SEQ ID NO: 486924 - DNA, 20 bp, Artificial Sequence
  chemically synthesized
tcttgccactgctctcccgc

SEQ ID NO: 486925 - DNA, 20 bp, Artificial Sequence
  chemically synthesized
tactcaggaggctgaggtgg

SEQ ID NO: 486926 - DNA, 20 bp, Artificial Sequence
  chemically synthesized
aatcctcccacctcagcctc

SEQ ID NO: 486927 - DNA, 20 bp, Artificial Sequence
  chemically synthesized
agtactactcagtagtagta

SEQ ID NO: 486928 - DNA, 20 bp, Artificial Sequence
  chemically synthesized
gtagctactcagtactacta

SEQ ID NO: 486929 - DNA, 20 bp, Artificial Sequence
  chemically synthesized
actactactgagtagtacta

SEQ ID NO: 486930 - DNA, 20 bp, Artificial Sequence
  chemically synthesized
catacatttttatgtagaga

SEQ ID NO: 486931 - DNA, 20 bp, Artificial Sequence
  chemically synthesized
tgggcagatcactggagtcc

SEQ ID NO: 486932 - DNA, 20 bp, Artificial Sequence
  chemically synthesized
ggctgggatgggcagatcac

SEQ ID NO: 486933 - DNA, 20 bp, Artificial Sequence
  chemically synthesized
attccagcgctttgggaggc

SEQ ID NO: 486934 - DNA, 20 bp, Artificial Sequence
  chemically synthesized
atcccagcctcccaaagcgc

SEQ ID NO: 486935 - DNA, 20 bp, Artificial Sequence
  chemically synthesized
tttataaaagcctaataagg

SEQ ID NO: 486936 - DNA, 20 bp, Artificial Sequence
  chemically synthesized
tttttaaatacagtttggtt

SEQ ID NO: 486937 - DNA, 20 bp, Artificial Sequence
  chemically synthesized
taaaaagtaatctcatagac

SEQ ID NO: 486938 - DNA, 20 bp, Artificial Sequence
  chemically synthesized
aacctagtccctatagggac

SEQ ID NO: 486939 - DNA, 20 bp, Artificial Sequence
  chemically synthesized
gactaggttgtaacaaaggg

SEQ ID NO: 486940 - DNA, 20 bp, Artificial Sequence
  chemically synthesized
tggtgagggaatatgatcag

SEQ ID NO: 486941 - DNA, 20 bp, Artificial Sequence
  chemically synthesized
tctccggtatacactggtga

SEQ ID NO: 486942 - DNA, 20 bp, Artificial Sequence
  chemically synthesized
ttgtacttccttatgacctt

SEQ ID NO: 486943 - DNA, 20 bp, Artificial Sequence
  chemically synthesized
aagtttgttgctgcattgtg

SEQ ID NO: 486944 - DNA, 20 bp, Artificial Sequence
  chemically synthesized
tgtggggaattgaggccaac

SEQ ID NO: 486945 - DNA, 20 bp, Artificial Sequence
  chemically synthesized
tgggtatgtatgtgaaagaa

SEQ ID NO: 486946 - DNA, 20 bp, Artificial Sequence
  chemically synthesized
tgtatgtgaaagaaatggat

SEQ ID NO: 486947 - DNA, 20 bp, Artificial Sequence
  chemically synthesized
aagggtatatgtagagcaat

SEQ ID NO: 486948 - DNA, 20 bp, Artificial Sequence
  chemically synthesized
gtatatgtagagcaatgtgg

SEQ ID NO: 486949 - DNA, 20 bp, Artificial Sequence
  chemically synthesized
ttttcttttttttttttaga

SEQ ID NO: 486950 - DNA, 20 bp, Artificial Sequence
  chemically synthesized
ttcactgttgttgccctggc

SEQ ID NO: 486951 - DNA, 20 bp, Artificial Sequence
  chemically synthesized
ctcactgcaacctttgcctc

SEQ ID NO: 486952 - DNA, 20 bp, Artificial Sequence
  chemically synthesized
ctaccgggaggctgaggcag

SEQ ID NO: 486953 - DNA, 20 bp, Artificial Sequence
  chemically synthesized
tgcctcagcctcccggtagc

SEQ ID NO: 486954 - DNA, 20 bp, Artificial Sequence
  chemically synthesized
acaggctcgcaccaccacac

SEQ ID NO: 486955 - DNA, 20 bp, Artificial Sequence
  chemically synthesized
atacaaaatacaaaaattac

SEQ ID NO: 486956 - DNA, 20 bp, Artificial Sequence
  chemically synthesized
tgggcagatcatctgaggtc

SEQ ID NO: 486957 - DNA, 20 bp, Artificial Sequence
  chemically synthesized
atcttggcctcccaatgtgc

SEQ ID NO: 486958 - DNA, 20 bp, Artificial Sequence
  chemically synthesized
atgagccactgcgcccggcc

SEQ ID NO: 486959 - DNA, 20 bp, Artificial Sequence
  chemically synthesized
gccactgcgcccggccatgg

SEQ ID NO: 486960 - DNA, 20 bp, Artificial Sequence
  chemically synthesized
tggatctttaaaacacaatt

SEQ ID NO: 486961 - DNA, 20 bp, Artificial Sequence
  chemically synthesized
ttataaataatatattttaa

SEQ ID NO: 486962 - DNA, 20 bp, Artificial Sequence
  chemically synthesized
ggataaagcaggaaagaaac

SEQ ID NO: 486963 - DNA, 20 bp, Artificial Sequence
  chemically synthesized
aacaaaagataatatatagt

SEQ ID NO: 486964 - DNA, 20 bp, Artificial Sequence
  chemically synthesized
gatagttaaattaggaagtg

SEQ ID NO: 486965 - DNA, 20 bp, Artificial Sequence
  chemically synthesized
aggctttcaatgtttttatc

SEQ ID NO: 486966 - DNA, 20 bp, Artificial Sequence
  chemically synthesized
aaatatttacatcatgcatt

SEQ ID NO: 486967 - DNA, 20 bp, Artificial Sequence
  chemically synthesized
gcattattttttgtttgctt

SEQ ID NO: 486968 - DNA, 20 bp, Artificial Sequence
  chemically synthesized
ttccgtgagtgatgacttcc

SEQ ID NO: 486969 - DNA, 20 bp, Artificial Sequence
  chemically synthesized
aggacaggaaaatatcttcc

SEQ ID NO: 486970 - DNA, 20 bp, Artificial Sequence
  chemically synthesized
tatattactcactagtctct

SEQ ID NO: 486971 - DNA, 20 bp, Artificial Sequence
  chemically synthesized
ttaaatattctaagagacta

SEQ ID NO: 486972 - DNA, 20 bp, Artificial Sequence
  chemically synthesized
tttctgtaaccctacaaaga

SEQ ID NO: 486973 - DNA, 20 bp, Artificial Sequence
  chemically synthesized
cttttagtattctgtctttg

SEQ ID NO: 486974 - DNA, 20 bp, Artificial Sequence
  chemically synthesized
ctattgctactttctgttat

SEQ ID NO: 486975 - DNA, 20 bp, Artificial Sequence
  chemically synthesized
aatgaaatgacctttcaaca

SEQ ID NO: 486976 - DNA, 20 bp, Artificial Sequence
  chemically synthesized
ttcctataaattaaatggtg

SEQ ID NO: 486977 - DNA, 20 bp, Artificial Sequence
  chemically synthesized
aggagagatagtgatagatt

SEQ ID NO: 486978 - DNA, 20 bp, Artificial Sequence
  chemically synthesized
ggattgatttaaatactgct

SEQ ID NO: 486979 - DNA, 20 bp, Artificial Sequence
  chemically synthesized
tctgaggggcaatatgctta

SEQ ID NO: 486980 - DNA, 20 bp, Artificial Sequence
  chemically synthesized
tcagtaagcatattgcccct

SEQ ID NO: 486981 - DNA, 20 bp, Artificial Sequence
  chemically synthesized
agcatattgcccctcagaat

SEQ ID NO: 486982 - DNA, 20 bp, Artificial Sequence
  chemically synthesized
agatacttacaccatgagaa

SEQ ID NO: 486983 - DNA, 20 bp, Artificial Sequence
  chemically synthesized
ggtgtaagtatctcagtgat

SEQ ID NO: 486984 - DNA, 20 bp, Artificial Sequence
  chemically synthesized
aagcaaattaaccacttcaa

SEQ ID NO: 486985 - DNA, 20 bp, Artificial Sequence
  chemically synthesized
aactgggtctcaactgaaga

SEQ ID NO: 486986 - DNA, 20 bp, Artificial Sequence
  chemically synthesized
tcaactgaagaaagggtgct

SEQ ID NO: 486987 - DNA, 20 bp, Artificial Sequence
  chemically synthesized
attaacttttcttaattttc

SEQ ID NO: 486988 - DNA, 20 bp, Artificial Sequence
  chemically synthesized
agttaatttacattgtgatt

SEQ ID NO: 486989 - DNA, 20 bp, Artificial Sequence
  chemically synthesized
ggatcacacaaccagtagta

SEQ ID NO: 486990 - DNA, 20 bp, Artificial Sequence
  chemically synthesized
agtgacccatctcattttcc

SEQ ID NO: 486991 - DNA, 20 bp, Artificial Sequence
  chemically synthesized
tgtgatccttggaaaatgag

SEQ ID NO: 486992 - DNA, 20 bp, Artificial Sequence
  chemically synthesized
agatttatcatccttgaaac

SEQ ID NO: 486993 - DNA, 20 bp, Artificial Sequence
  chemically synthesized
tattattatatccatgtttc

SEQ ID NO: 486994 - DNA, 20 bp, Artificial Sequence
  chemically synthesized
ttagtttctccaacaaagct

SEQ ID NO: 486995 - DNA, 20 bp, Artificial Sequence
  chemically synthesized
tattttaatgagaacttttc

SEQ ID NO: 486996 - DNA, 20 bp, Artificial Sequence
  chemically synthesized
gagtaaatggacagactatt

SEQ ID NO: 486997 - DNA, 20 bp, Artificial Sequence
  chemically synthesized
aagagtgggaaagataatat

SEQ ID NO: 486998 - DNA, 20 bp, Artificial Sequence
  chemically synthesized
tcatttacctatctggaaat

SEQ ID NO: 486999 - DNA, 20 bp, Artificial Sequence
  chemically synthesized
tatttccagataggtaaatg

SEQ ID NO: 487000 - DNA, 20 bp, Artificial Sequence
  chemically synthesized
ctataatctctaatgtagag

SEQ ID NO: 487001 - DNA, 20 bp, Artificial Sequence
  chemically synthesized
aaatgtctgaggacactgca

SEQ ID NO: 487002 - DNA, 20 bp, Artificial Sequence
  chemically synthesized
aacaatcttgctactttttc

SEQ ID NO: 487003 - DNA, 20 bp, Artificial Sequence
  chemically synthesized
ttcaagagtttggtgtactg

SEQ ID NO: 487004 - DNA, 20 bp, Artificial Sequence
  chemically synthesized
tggtgtactgtagagttgaa

SEQ ID NO: 487005 - DNA, 20 bp, Artificial Sequence
  chemically synthesized
cagcttaattggaatgatga

SEQ ID NO: 487006 - DNA, 20 bp, Artificial Sequence
  chemically synthesized
aatgaattttacagcttaat

SEQ ID NO: 487007 - DNA, 20 bp, Artificial Sequence
  chemically synthesized
aaacattttttgttatgcaa

SEQ ID NO: 487008 - DNA, 20 bp, Artificial Sequence
  chemically synthesized
gatacgctatttaaataagt

SEQ ID NO: 487009 - DNA, 20 bp, Artificial Sequence
  chemically synthesized
ttatttaaatagcgtatcag

SEQ ID NO: 487010 - DNA, 20 bp, Artificial Sequence
  chemically synthesized
aaaattatggagatgtagtc

SEQ ID NO: 487011 - DNA, 20 bp, Artificial Sequence
  chemically synthesized
atctccataattttaaaact

SEQ ID NO: 487012 - DNA, 20 bp, Artificial Sequence
  chemically synthesized
cacaagagctccaaactcaa

SEQ ID NO: 487013 - DNA, 20 bp, Artificial Sequence
  chemically synthesized
agagctccaaactcaacaga

SEQ ID NO: 487014 - DNA, 20 bp, Artificial Sequence
  chemically synthesized
tagaacacgaattcactctg

SEQ ID NO: 487015 - DNA, 20 bp, Artificial Sequence
  chemically synthesized
tttatccattttggtagaac

SEQ ID NO: 487016 - DNA, 20 bp, Artificial Sequence
  chemically synthesized
tgaattcgtgttctaccaaa

SEQ ID NO: 487017 - DNA, 20 bp, Artificial Sequence
  chemically synthesized
taccaaaatggataaacttt

SEQ ID NO: 487018 - DNA, 20 bp, Artificial Sequence
  chemically synthesized
atttttccatttacaaacaa

SEQ ID NO: 487019 - DNA, 20 bp, Artificial Sequence
  chemically synthesized
caagcaaagtatatacaatg

SEQ ID NO: 487020 - DNA, 20 bp, Artificial Sequence
  chemically synthesized
tatagttgtcttaacattta

SEQ ID NO: 487021 - DNA, 20 bp, Artificial Sequence
  chemically synthesized
atttctgctttatgaagaac

SEQ ID NO: 487022 - DNA, 20 bp, Artificial Sequence
  chemically synthesized
gttacaagaaaaagtgattt

SEQ ID NO: 487023 - DNA, 20 bp, Artificial Sequence
  chemically synthesized
ctttccttttaaaatttaaa

SEQ ID NO: 487024 - DNA, 20 bp, Artificial Sequence
  chemically synthesized
ataatatataatgatcaaat

SEQ ID NO: 487025 - DNA, 20 bp, Artificial Sequence
  chemically synthesized
gcttttggttcccatttgca

SEQ ID NO: 487026 - DNA, 20 bp, Artificial Sequence
  chemically synthesized
aatgggaaccaaaagcaagc

SEQ ID NO: 487027 - DNA, 20 bp, Artificial Sequence
  chemically synthesized
aagcccattttgtctgatat

SEQ ID NO: 487028 - DNA, 20 bp, Artificial Sequence
  chemically synthesized
aagacattgtataatgataa

SEQ ID NO: 487029 - DNA, 20 bp, Artificial Sequence
  chemically synthesized
cagtgttaggtgcatataaa

SEQ ID NO: 487030 - DNA, 20 bp, Artificial Sequence
  chemically synthesized
gacctgtctagtgctgtaaa

SEQ ID NO: 487031 - DNA, 20 bp, Artificial Sequence
  chemically synthesized
tctgttaagtccatttgttc

SEQ ID NO: 487032 - DNA, 20 bp, Artificial Sequence
  chemically synthesized
tatattctataattgttagg

SEQ ID NO: 487033 - DNA, 20 bp, Artificial Sequence
  chemically synthesized
aacattcttcctaacaatta

SEQ ID NO: 487034 - DNA, 20 bp, Artificial Sequence
  chemically synthesized
agaatggtccatctgctgat

SEQ ID NO: 487035 - DNA, 20 bp, Artificial Sequence
  chemically synthesized
ctcttgtatgacctgtcttg

SEQ ID NO: 487036 - DNA, 20 bp, Artificial Sequence
  chemically synthesized
agtatcttctcagaccacag

SEQ ID NO: 487037 - DNA, 20 bp, Artificial Sequence
  chemically synthesized
atagttttgagggttccttt

SEQ ID NO: 487038 - DNA, 20 bp, Artificial Sequence
  chemically synthesized
ccatgtgtttgtatagtttt

SEQ ID NO: 487039 - DNA, 20 bp, Artificial Sequence
  chemically synthesized
ggaaattaagaaatctgctc

SEQ ID NO: 487040 - DNA, 20 bp, Artificial Sequence
  chemically synthesized
aatctgctcttgaatgattt

SEQ ID NO: 487041 - DNA, 20 bp, Artificial Sequence
  chemically synthesized
gttgtcaatttgtgctcttt

SEQ ID NO: 487042 - DNA, 20 bp, Artificial Sequence
  chemically synthesized
tttcttttcttctgctggat

SEQ ID NO: 487043 - DNA, 20 bp, Artificial Sequence
  chemically synthesized
ttgttatttcttttcttctg

SEQ ID NO: 487044 - DNA, 20 bp, Artificial Sequence
  chemically synthesized
tcatttctacttgagcttat

SEQ ID NO: 487045 - DNA, 20 bp, Artificial Sequence
  chemically synthesized
taaaggtgttcatagtagta

SEQ ID NO: 487046 - DNA, 20 bp, Artificial Sequence
  chemically synthesized
aactagaaaatctagaggaa

SEQ ID NO: 487047 - DNA, 20 bp, Artificial Sequence
  chemically synthesized
taggagggttgtgtgtttcc

SEQ ID NO: 487048 - DNA, 20 bp, Artificial Sequence
  chemically synthesized
ttcttcttgatttaaactag

SEQ ID NO: 487049 - DNA, 20 bp, Artificial Sequence
  chemically synthesized
ccgcgcccagccaaagcgtt

SEQ ID NO: 487050 - DNA, 20 bp, Artificial Sequence
  chemically synthesized
actttgggaggctgaggcag

SEQ ID NO: 487051 - DNA, 20 bp, Artificial Sequence
  chemically synthesized
ggcaggtggatcactaggtc

SEQ ID NO: 487052 - DNA, 20 bp, Artificial Sequence
  chemically synthesized
ttttgtatttttagtagagt

SEQ ID NO: 487053 - DNA, 20 bp, Artificial Sequence
  chemically synthesized
gctaatttttgtatttttag

SEQ ID NO: 487054 - DNA, 20 bp, Artificial Sequence
  chemically synthesized
tacttgggaggctgaggcag

SEQ ID NO: 487055 - DNA, 20 bp, Artificial Sequence
  chemically synthesized
ttttttttttttttttgaga

SEQ ID NO: 487056 - DNA, 20 bp, Artificial Sequence
  chemically synthesized
ctgctcgttactggtatgtt

SEQ ID NO: 487057 - DNA, 20 bp, Artificial Sequence
  chemically synthesized
accagtaacgagcagcaagg

SEQ ID NO: 487058 - DNA, 20 bp, Artificial Sequence
  chemically synthesized
aaaaaaaagtccaggaccag

SEQ ID NO: 487059 - DNA, 20 bp, Artificial Sequence
  chemically synthesized
aggaccagatggattcacag

SEQ ID NO: 487060 - DNA, 20 bp, Artificial Sequence
  chemically synthesized
atgtctggtagaattcagct

SEQ ID NO: 487061 - DNA, 20 bp, Artificial Sequence
  chemically synthesized
attcttctttgaatgtctgg

SEQ ID NO: 487062 - DNA, 20 bp, Artificial Sequence
  chemically synthesized
attctaccagacattcaaag

SEQ ID NO: 487063 - DNA, 20 bp, Artificial Sequence
  chemically synthesized
taattggtaccaattcttct

SEQ ID NO: 487064 - DNA, 20 bp, Artificial Sequence
  chemically synthesized
actatttcaaaagataaaga

SEQ ID NO: 487065 - DNA, 20 bp, Artificial Sequence
  chemically synthesized
acttcatagaatgatttagg

SEQ ID NO: 487066 - DNA, 20 bp, Artificial Sequence
  chemically synthesized
ttagggtgatactgacttca

SEQ ID NO: 487067 - DNA, 20 bp, Artificial Sequence
  chemically synthesized
tccttttctggttttggtat

SEQ ID NO: 487068 - DNA, 20 bp, Artificial Sequence
  chemically synthesized
attcattggtcgatggacac

SEQ ID NO: 487069 - DNA, 20 bp, Artificial Sequence
  chemically synthesized
acccaagtgtccatcgacca

SEQ ID NO: 487070 - DNA, 20 bp, Artificial Sequence
  chemically synthesized
aagtgtccatcgaccaatga

SEQ ID NO: 487071 - DNA, 20 bp, Artificial Sequence
  chemically synthesized
aatgtggtatctatatacca

SEQ ID NO: 487072 - DNA, 20 bp, Artificial Sequence
  chemically synthesized
aaagagattcttttttatgg

SEQ ID NO: 487073 - DNA, 20 bp, Artificial Sequence
  chemically synthesized
aatattactcagccataaaa

SEQ ID NO: 487074 - DNA, 20 bp, Artificial Sequence
  chemically synthesized
agaatctcttttgcagcaac

SEQ ID NO: 487075 - DNA, 20 bp, Artificial Sequence
  chemically synthesized
cgttcctgagttactttact

SEQ ID NO: 487076 - DNA, 20 bp, Artificial Sequence
  chemically synthesized
tggtatttagttttccgttc

SEQ ID NO: 487077 - DNA, 20 bp, Artificial Sequence
  chemically synthesized
tcatagcttagctcccactt

SEQ ID NO: 487078 - DNA, 20 bp, Artificial Sequence
  chemically synthesized
gtaagtgggagctaagctat

SEQ ID NO: 487079 - DNA, 20 bp, Artificial Sequence
  chemically synthesized
tatgaggatacaaagacata

SEQ ID NO: 487080 - DNA, 20 bp, Artificial Sequence
  chemically synthesized
tcactcccaagctccccact

SEQ ID NO: 487081 - DNA, 20 bp, Artificial Sequence
  chemically synthesized
ggactctaagtggggagctt

SEQ ID NO: 487082 - DNA, 20 bp, Artificial Sequence
  chemically synthesized
gggagcttgggagtgaggta

SEQ ID NO: 487083 - DNA, 20 bp, Artificial Sequence
  chemically synthesized
aagggataaaagactattta

SEQ ID NO: 487084 - DNA, 20 bp, Artificial Sequence
  chemically synthesized
cagtatatagtactcaggaa

SEQ ID NO: 487085 - DNA, 20 bp, Artificial Sequence
  chemically synthesized
attttttatgtatccatttc

SEQ ID NO: 487086 - DNA, 20 bp, Artificial Sequence
  chemically synthesized
aatggatacataaaaaattt

SEQ ID NO: 487087 - DNA, 20 bp, Artificial Sequence
  chemically synthesized
catggatgagttctatagtg

SEQ ID NO: 487088 - DNA, 20 bp, Artificial Sequence
  chemically synthesized
ggtggtttttggttacatgg

SEQ ID NO: 487089 - DNA, 20 bp, Artificial Sequence
  chemically synthesized
tataggtggtttttggttac

SEQ ID NO: 487090 - DNA, 20 bp, Artificial Sequence
  chemically synthesized
tttataatttcagtagtttt

SEQ ID NO: 487091 - DNA, 20 bp, Artificial Sequence
  chemically synthesized
gctttcttgcctcatatttt

SEQ ID NO: 487092 - DNA, 20 bp, Artificial Sequence
  chemically synthesized
gaaatagatattatttgatg

SEQ ID NO: 487093 - DNA, 20 bp, Artificial Sequence
  chemically synthesized
atttgtttaaaaaagtaaac

SEQ ID NO: 487094 - DNA, 20 bp, Artificial Sequence
  chemically synthesized
aatatagttttaaactctat

SEQ ID NO: 487095 - DNA, 20 bp, Artificial Sequence
  chemically synthesized
ttgaaaatctcaaactcaaa

SEQ ID NO: 487096 - DNA, 20 bp, Artificial Sequence
  chemically synthesized
tggcatgcaattaatatcta

SEQ ID NO: 487097 - DNA, 20 bp, Artificial Sequence
  chemically synthesized
tgtatatatacagccgtagg

SEQ ID NO: 487098 - DNA, 20 bp, Artificial Sequence
  chemically synthesized
gtatatatacaggcatacat

SEQ ID NO: 487099 - DNA, 20 bp, Artificial Sequence
  chemically synthesized
agatgtttcagttacaatat

SEQ ID NO: 487100 - DNA, 20 bp, Artificial Sequence
  chemically synthesized
tagggaagcattttagagat

SEQ ID NO: 487101 - DNA, 20 bp, Artificial Sequence
  chemically synthesized
cctaatttcagcatgagcta

SEQ ID NO: 487102 - DNA, 20 bp, Artificial Sequence
  chemically synthesized
tttcttttctgagagaatat

SEQ ID NO: 487103 - DNA, 20 bp, Artificial Sequence
  chemically synthesized
gagccaactttcttttctga

SEQ ID NO: 487104 - DNA, 20 bp, Artificial Sequence
  chemically synthesized
ataagagatagtataaagtc

SEQ ID NO: 487105 - DNA, 20 bp, Artificial Sequence
  chemically synthesized
taatatacaacattgtggtt

SEQ ID NO: 487106 - DNA, 20 bp, Artificial Sequence
  chemically synthesized
tgcttacataagtattctga

SEQ ID NO: 487107 - DNA, 20 bp, Artificial Sequence
  chemically synthesized
tttaattaagcaaattctgt

SEQ ID NO: 487108 - DNA, 20 bp, Artificial Sequence
  chemically synthesized
tgattgtgaagctatacatt

SEQ ID NO: 487109 - DNA, 20 bp, Artificial Sequence
  chemically synthesized
cgtttacaatgatctctgcc

SEQ ID NO: 487110 - DNA, 20 bp, Artificial Sequence
  chemically synthesized
cgtggcagagatcattgtaa

SEQ ID NO: 487111 - DNA, 20 bp, Artificial Sequence
  chemically synthesized
cattgtaaacgagtctttca

SEQ ID NO: 487112 - DNA, 20 bp, Artificial Sequence
  chemically synthesized
caaacaacttaaaaagcaga

SEQ ID NO: 487113 - DNA, 20 bp, Artificial Sequence
  chemically synthesized
aaagaatatgttagtctatt

SEQ ID NO: 487114 - DNA, 20 bp, Artificial Sequence
  chemically synthesized
ttttaaaagatcacatctgg

SEQ ID NO: 487115 - DNA, 20 bp, Artificial Sequence
  chemically synthesized
gcctcggcctcccaaagtcc

SEQ ID NO: 487116 - DNA, 20 bp, Artificial Sequence
  chemically synthesized
cagcctgatcacctgaggtc

SEQ ID NO: 487117 - DNA, 20 bp, Artificial Sequence
  chemically synthesized
ttttgtatttttagtagaga

SEQ ID NO: 487118 - DNA, 20 bp, Artificial Sequence
  chemically synthesized
gcctcagccttccaagtagc

SEQ ID NO: 487119 - DNA, 20 bp, Artificial Sequence
  chemically synthesized
tacttggaaggctgaggcag

SEQ ID NO: 487120 - DNA, 20 bp, Artificial Sequence
  chemically synthesized
ttcgctcttgttgcccaggc

SEQ ID NO: 487121 - DNA, 20 bp, Artificial Sequence
  chemically synthesized
ttgtttgtttgtttttgaga

SEQ ID NO: 487122 - DNA, 20 bp, Artificial Sequence
  chemically synthesized
aacagttttcctaatatttt

SEQ ID NO: 487123 - DNA, 20 bp, Artificial Sequence
  chemically synthesized
gttttcctaatattttgtga

SEQ ID NO: 487124 - DNA, 20 bp, Artificial Sequence
  chemically synthesized
tgtgaatgggtattgaagtt

SEQ ID NO: 487125 - DNA, 20 bp, Artificial Sequence
  chemically synthesized
ctaggccatgatggtcccag

SEQ ID NO: 487126 - DNA, 20 bp, Artificial Sequence
  chemically synthesized
tgtctgcctagtttatttct

SEQ ID NO: 487127 - DNA, 20 bp, Artificial Sequence
  chemically synthesized
tcttgtttcaaacacggcca

SEQ ID NO: 487128 - DNA, 20 bp, Artificial Sequence
  chemically synthesized
gattagatgctttcaagaaa

SEQ ID NO: 487129 - DNA, 20 bp, Artificial Sequence
  chemically synthesized
tcagaaagtagaagccattt

SEQ ID NO: 487130 - DNA, 20 bp, Artificial Sequence
  chemically synthesized
ccagaaatggcttctacttt

SEQ ID NO: 487131 - DNA, 20 bp, Artificial Sequence
  chemically synthesized
ctactttctgaattcctcct

SEQ ID NO: 487132 - DNA, 20 bp, Artificial Sequence
  chemically synthesized
ctggctgcatgattctaagg

SEQ ID NO: 487133 - DNA, 20 bp, Artificial Sequence
  chemically synthesized
gcattggaaaaagcttctta

SEQ ID NO: 487134 - DNA, 20 bp, Artificial Sequence
  chemically synthesized
agcaagagcgtaaaacactt

SEQ ID NO: 487135 - DNA, 20 bp, Artificial Sequence
  chemically synthesized
atatctgtaatcaaaaaatt

SEQ ID NO: 487136 - DNA, 20 bp, Artificial Sequence
  chemically synthesized
aatcttggccagagggcttt

SEQ ID NO: 487137 - DNA, 20 bp, Artificial Sequence
  chemically synthesized
gggctttcagagtattatgt

SEQ ID NO: 487138 - DNA, 20 bp, Artificial Sequence
  chemically synthesized
tatttgtaatatggcattgt

SEQ ID NO: 487139 - DNA, 20 bp, Artificial Sequence
  chemically synthesized
ggtgatgagctctacaattc

SEQ ID NO: 487140 - DNA, 20 bp, Artificial Sequence
  chemically synthesized
aacccttcgtatgtatattc

SEQ ID NO: 487141 - DNA, 20 bp, Artificial Sequence
  chemically synthesized
aattctagaatatacatacg

SEQ ID NO: 487142 - DNA, 20 bp, Artificial Sequence
  chemically synthesized
agaatatacatacgaagggt

SEQ ID NO: 487143 - DNA, 20 bp, Artificial Sequence
  chemically synthesized
aatgtgccaggtatttctaa

SEQ ID NO: 487144 - DNA, 20 bp, Artificial Sequence
  chemically synthesized
aattatattcaatttcttaa

SEQ ID NO: 487145 - DNA, 20 bp, Artificial Sequence
  chemically synthesized
aatgctactcaattaagaaa

SEQ ID NO: 487146 - DNA, 20 bp, Artificial Sequence
  chemically synthesized
aaacataaacatttagaaat

SEQ ID NO: 487147 - DNA, 20 bp, Artificial Sequence
  chemically synthesized
ctctcctcaagtttatgcat

SEQ ID NO: 487148 - DNA, 20 bp, Artificial Sequence
  chemically synthesized
aagtcttggagtataagagg

SEQ ID NO: 487149 - DNA, 20 bp, Artificial Sequence
  chemically synthesized
tacaactgaaaaaaaagtct

SEQ ID NO: 487150 - DNA, 20 bp, Artificial Sequence
  chemically synthesized
ttatttatttatttatgaga

SEQ ID NO: 487151 - DNA, 20 bp, Artificial Sequence
  chemically synthesized
ctgcactccagcctgggtga

SEQ ID NO: 487152 - DNA, 20 bp, Artificial Sequence
  chemically synthesized
tctcactctgtcacccaggc

SEQ ID NO: 487153 - DNA, 20 bp, Artificial Sequence
  chemically synthesized
tcacgccactgcactccagc

SEQ ID NO: 487154 - DNA, 20 bp, Artificial Sequence
  chemically synthesized
ctcactgcaagctctgcctc

SEQ ID NO: 487155 - DNA, 20 bp, Artificial Sequence
  chemically synthesized
tactcgggaggctgaggcag

SEQ ID NO: 487156 - DNA, 20 bp, Artificial Sequence
  chemically synthesized
cattctcctgcctcagcctc

SEQ ID NO: 487157 - DNA, 20 bp, Artificial Sequence
  chemically synthesized
ttttgtatttttagtagaga

SEQ ID NO: 487158 - DNA, 20 bp, Artificial Sequence
  chemically synthesized
tggggtttcaccatgttagc

SEQ ID NO: 487159 - DNA, 20 bp, Artificial Sequence
  chemically synthesized
actttgggaggccaaggtgg

SEQ ID NO: 487160 - DNA, 20 bp, Artificial Sequence
  chemically synthesized
aatttccatgccaataacac

SEQ ID NO: 487161 - DNA, 20 bp, Artificial Sequence
  chemically synthesized
atggaaattgtgctcaataa

SEQ ID NO: 487162 - DNA, 20 bp, Artificial Sequence
  chemically synthesized
aattacacttaaaacaatac

SEQ ID NO: 487163 - DNA, 20 bp, Artificial Sequence
  chemically synthesized
accatttgacctgctatacc

SEQ ID NO: 487164 - DNA, 20 bp, Artificial Sequence
  chemically synthesized
tcttgagatgcacatctttt

SEQ ID NO: 487165 - DNA, 20 bp, Artificial Sequence
  chemically synthesized
aacatttttaaaaacttcct

SEQ ID NO: 487166 - DNA, 20 bp, Artificial Sequence
  chemically synthesized
agctgtttttttttctccca

SEQ ID NO: 487167 - DNA, 20 bp, Artificial Sequence
  chemically synthesized
acaacaaaacagctgggaaa

SEQ ID NO: 487168 - DNA, 20 bp, Artificial Sequence
  chemically synthesized
aattacagtcagtcacaacc

SEQ ID NO: 487169 - DNA, 20 bp, Artificial Sequence
  chemically synthesized
aattattttgtgttaaaggt

SEQ ID NO: 487170 - DNA, 20 bp, Artificial Sequence
  chemically synthesized
atatgttttacttactgctc

SEQ ID NO: 487171 - DNA, 20 bp, Artificial Sequence
  chemically synthesized
attagaactgagagcattaa

SEQ ID NO: 487172 - DNA, 20 bp, Artificial Sequence
  chemically synthesized
ttttccaacttaagttaaaa

SEQ ID NO: 487173 - DNA, 20 bp, Artificial Sequence
  chemically synthesized
aacttaagttaaaaatgagt

SEQ ID NO: 487174 - DNA, 20 bp, Artificial Sequence
  chemically synthesized
gctgcttttaaactgctaaa

SEQ ID NO: 487175 - DNA, 20 bp, Artificial Sequence
  chemically synthesized
aattactgaagactgactat

SEQ ID NO: 487176 - DNA, 20 bp, Artificial Sequence
  chemically synthesized
gggagagagggagagaggga

SEQ ID NO: 487177 - DNA, 20 bp, Artificial Sequence
  chemically synthesized
gagagacagagagagagaaa

SEQ ID NO: 487178 - DNA, 20 bp, Artificial Sequence
  chemically synthesized
caaaataactggaaaaatct

SEQ ID NO: 487179 - DNA, 20 bp, Artificial Sequence
  chemically synthesized
aaagaggaaagaaactgagc

SEQ ID NO: 487180 - DNA, 20 bp, Artificial Sequence
  chemically synthesized
agctgagttctgattggaag

SEQ ID NO: 487181 - DNA, 20 bp, Artificial Sequence
  chemically synthesized
tcctacgctcacctcccaag

SEQ ID NO: 487182 - DNA, 20 bp, Artificial Sequence
  chemically synthesized
gacagacaggctgtctgatg

SEQ ID NO: 487183 - DNA, 20 bp, Artificial Sequence
  chemically synthesized
caagtcaatttcctaagaaa

SEQ ID NO: 487184 - DNA, 20 bp, Artificial Sequence
  chemically synthesized
ctccctgatgtgtctttaat

SEQ ID NO: 487185 - DNA, 20 bp, Artificial Sequence
  chemically synthesized
agattttcattttcttttta

SEQ ID NO: 487186 - DNA, 20 bp, Artificial Sequence
  chemically synthesized
cctgcagcacattttcatga

SEQ ID NO: 487187 - DNA, 20 bp, Artificial Sequence
  chemically synthesized
taatagaagaggaaatgagt

SEQ ID NO: 487188 - DNA, 20 bp, Artificial Sequence
  chemically synthesized
acctcttaatagaagaggaa

SEQ ID NO: 487189 - DNA, 20 bp, Artificial Sequence
  chemically synthesized
tattaagaggtaacaagacc

SEQ ID NO: 487190 - DNA, 20 bp, Artificial Sequence
  chemically synthesized
tataatgcctcttcttcact

SEQ ID NO: 487191 - DNA, 20 bp, Artificial Sequence
  chemically synthesized
gaacaaagcctttttaaact

SEQ ID NO: 487192 - DNA, 20 bp, Artificial Sequence
  chemically synthesized
ttcacgttctatcagagcaa

SEQ ID NO: 487193 - DNA, 20 bp, Artificial Sequence
  chemically synthesized
agggctgtttaaatctctgc

SEQ ID NO: 487194 - DNA, 20 bp, Artificial Sequence
  chemically synthesized
cagctttctgccttgtattg

SEQ ID NO: 487195 - DNA, 20 bp, Artificial Sequence
  chemically synthesized
ggaaacatctgaagattagc

SEQ ID NO: 487196 - DNA, 20 bp, Artificial Sequence
  chemically synthesized
gtccacagcaaaagttgtgc

SEQ ID NO: 487197 - DNA, 20 bp, Artificial Sequence
  chemically synthesized
caagaatgatttgagaatta

SEQ ID NO: 487198 - DNA, 20 bp, Artificial Sequence
  chemically synthesized
caaaaatgcaagaatgattt

SEQ ID NO: 487199 - DNA, 20 bp, Artificial Sequence
  chemically synthesized
gttgataggggcaaaaatgc

SEQ ID NO: 487200 - DNA, 20 bp, Artificial Sequence
  chemically synthesized
gatatatatatattttgaga

SEQ ID NO: 487201 - DNA, 20 bp, Artificial Sequence
  chemically synthesized
ttcgctcgtgtcgcccaggc

SEQ ID NO: 487202 - DNA, 20 bp, Artificial Sequence
  chemically synthesized
ctcactgcaacttctgcctc

SEQ ID NO: 487203 - DNA, 20 bp, Artificial Sequence
  chemically synthesized
tacttgggaggctgaggcag

SEQ ID NO: 487204 - DNA, 20 bp, Artificial Sequence
  chemically synthesized
gcctcagcctcccaagtagc

SEQ ID NO: 487205 - DNA, 20 bp, Artificial Sequence
  chemically synthesized
tttcatatttttagtagaga

SEQ ID NO: 487206 - DNA, 20 bp, Artificial Sequence
  chemically synthesized
caggcggatcacctgaggtc

SEQ ID NO: 487207 - DNA, 20 bp, Artificial Sequence
  chemically synthesized
actttgcgaggccgaggcag

SEQ ID NO: 487208 - DNA, 20 bp, Artificial Sequence
  chemically synthesized
gcctcggcctcgcaaagtgc

SEQ ID NO: 487209 - DNA, 20 bp, Artificial Sequence
  chemically synthesized
cctgtcttcccatttctccc

SEQ ID NO: 487210 - DNA, 20 bp, Artificial Sequence
  chemically synthesized
caagggagaaatgggaagac

SEQ ID NO: 487211 - DNA, 20 bp, Artificial Sequence
  chemically synthesized
tctgctacaaaaatggtttt

SEQ ID NO: 487212 - DNA, 20 bp, Artificial Sequence
  chemically synthesized
atgcattagtgatgtaaaag

SEQ ID NO: 487213 - DNA, 20 bp, Artificial Sequence
  chemically synthesized
ggccacttggagatcagaac

SEQ ID NO: 487214 - DNA, 20 bp, Artificial Sequence
  chemically synthesized
atctccaagtggcccagtag

SEQ ID NO: 487215 - DNA, 20 bp, Artificial Sequence
  chemically synthesized
gtggcccagtagttgagtgt

SEQ ID NO: 487216 - DNA, 20 bp, Artificial Sequence
  chemically synthesized
gataagttagcatcaagcat

SEQ ID NO: 487217 - DNA, 20 bp, Artificial Sequence
  chemically synthesized
atgccttatggtgtatgact

SEQ ID NO: 487218 - DNA, 20 bp, Artificial Sequence
  chemically synthesized
ccataaggcataaagtcttt

SEQ ID NO: 487219 - DNA, 20 bp, Artificial Sequence
  chemically synthesized
aaagtctttgaggatcaaca

SEQ ID NO: 487220 - DNA, 20 bp, Artificial Sequence
  chemically synthesized
gtcctgaaagcagcaaattt

SEQ ID NO: 487221 - DNA, 20 bp, Artificial Sequence
  chemically synthesized
atgattatactgggcttgaa

SEQ ID NO: 487222 - DNA, 20 bp, Artificial Sequence
  chemically synthesized
aaactacttttctagatttt

SEQ ID NO: 487223 - DNA, 20 bp, Artificial Sequence
  chemically synthesized
ggagtggttgcaatatattt

SEQ ID NO: 487224 - DNA, 20 bp, Artificial Sequence
  chemically synthesized
acaagagacttttccttagg

SEQ ID NO: 487225 - DNA, 20 bp, Artificial Sequence
  chemically synthesized
ctaagcagcgaccttagaga

SEQ ID NO: 487226 - DNA, 20 bp, Artificial Sequence
  chemically synthesized
tctcagttaatgttgcaggc

SEQ ID NO: 487227 - DNA, 20 bp, Artificial Sequence
  chemically synthesized
tcaataaacagccatgatta

SEQ ID NO: 487228 - DNA, 20 bp, Artificial Sequence
  chemically synthesized
cctgattctctgtacctgac

SEQ ID NO: 487229 - DNA, 20 bp, Artificial Sequence
  chemically synthesized
tataattctggtcaggtaca

SEQ ID NO: 487230 - DNA, 20 bp, Artificial Sequence
  chemically synthesized
aatggcttccatttgcaaat

SEQ ID NO: 487231 - DNA, 20 bp, Artificial Sequence
  chemically synthesized
ccctccttatgtaatagcct

SEQ ID NO: 487232 - DNA, 20 bp, Artificial Sequence
  chemically synthesized
aatgtgacctagacttcaac

SEQ ID NO: 487233 - DNA, 20 bp, Artificial Sequence
  chemically synthesized
tctttggcaaaaagctggcc

SEQ ID NO: 487234 - DNA, 20 bp, Artificial Sequence
  chemically synthesized
cttcagtattttattgggtc

SEQ ID NO: 487235 - DNA, 20 bp, Artificial Sequence
  chemically synthesized
attgaggcttcagtatttta

SEQ ID NO: 487236 - DNA, 20 bp, Artificial Sequence
  chemically synthesized
tttgttgctctttcttataa

SEQ ID NO: 487237 - DNA, 20 bp, Artificial Sequence
  chemically synthesized
gtctgtctccaacagctgta

SEQ ID NO: 487238 - DNA, 20 bp, Artificial Sequence
  chemically synthesized
ctatgatgcagtagcttgat

SEQ ID NO: 487239 - DNA, 20 bp, Artificial Sequence
  chemically synthesized
agcaaagcaataaagcccca

SEQ ID NO: 487240 - DNA, 20 bp, Artificial Sequence
  chemically synthesized
ggcagcacaccaggacagaa

SEQ ID NO: 487241 - DNA, 20 bp, Artificial Sequence
  chemically synthesized
ttgtgatcttaaggctatta

SEQ ID NO: 487242 - DNA, 20 bp, Artificial Sequence
  chemically synthesized
ttaagatcacaatatataaa

SEQ ID NO: 487243 - DNA, 20 bp, Artificial Sequence
  chemically synthesized
gcaatatccattacctcata

SEQ ID NO: 487244 - DNA, 20 bp, Artificial Sequence
  chemically synthesized
gcataacccattatgaggta

SEQ ID NO: 487245 - DNA, 20 bp, Artificial Sequence
  chemically synthesized
tgcttcattaccttcactgg

SEQ ID NO: 487246 - DNA, 20 bp, Artificial Sequence
  chemically synthesized
tagcagttcaagctaaacaa

SEQ ID NO: 487247 - DNA, 20 bp, Artificial Sequence
  chemically synthesized
gtgaagttaatctgcactat

SEQ ID NO: 487248 - DNA, 20 bp, Artificial Sequence
  chemically synthesized
gcaatacatgtggagtctcc

SEQ ID NO: 487249 - DNA, 20 bp, Artificial Sequence
  chemically synthesized
aaattgatctgcaatacatg

SEQ ID NO: 487250 - DNA, 20 bp, Artificial Sequence
  chemically synthesized
ataattcaagaagatattgg

SEQ ID NO: 487251 - DNA, 20 bp, Artificial Sequence
  chemically synthesized
aaaattcatccaatatcttc

SEQ ID NO: 487252 - DNA, 20 bp, Artificial Sequence
  chemically synthesized
ttatataattcaagaagata

SEQ ID NO: 487253 - DNA, 20 bp, Artificial Sequence
  chemically synthesized
gttaatgcctgtgtttctat

SEQ ID NO: 487254 - DNA, 20 bp, Artificial Sequence
  chemically synthesized
aatttattaacataatttat

SEQ ID NO: 487255 - DNA, 20 bp, Artificial Sequence
  chemically synthesized
gtataaagtaaaatgaacat

SEQ ID NO: 487256 - DNA, 20 bp, Artificial Sequence
  chemically synthesized
tttatatccaatactaaaca

SEQ ID NO: 487257 - DNA, 20 bp, Artificial Sequence
  chemically synthesized
acaaaattctgtgtttagta

SEQ ID NO: 487258 - DNA, 20 bp, Artificial Sequence
  chemically synthesized
tcaaaattattttctttcca

SEQ ID NO: 487259 - DNA, 20 bp, Artificial Sequence
  chemically synthesized
tcaaagcttattatttatta

SEQ ID NO: 487260 - DNA, 20 bp, Artificial Sequence
  chemically synthesized
aaaaaaaatccttcaggtat

SEQ ID NO: 487261 - DNA, 20 bp, Artificial Sequence
  chemically synthesized
tgcttatattcatatacctg

SEQ ID NO: 487262 - DNA, 20 bp, Artificial Sequence
  chemically synthesized
ctctcttgatgagacgacaa

SEQ ID NO: 487263 - DNA, 20 bp, Artificial Sequence
  chemically synthesized
taaatattacagaagacttt

SEQ ID NO: 487264 - DNA, 20 bp, Artificial Sequence
  chemically synthesized
atggaacacttgttaaacac

SEQ ID NO: 487265 - DNA, 20 bp, Artificial Sequence
  chemically synthesized
acacttgttaaacactagga

SEQ ID NO: 487266 - DNA, 20 bp, Artificial Sequence
  chemically synthesized
ggggagggaggaagagagat

SEQ ID NO: 487267 - DNA, 20 bp, Artificial Sequence
  chemically synthesized
acagcagtgctgggaggctc

SEQ ID NO: 487268 - DNA, 20 bp, Artificial Sequence
  chemically synthesized
agtatgagattatagtaatt

SEQ ID NO: 487269 - DNA, 20 bp, Artificial Sequence
  chemically synthesized
agtacagtctcttgcaattt

SEQ ID NO: 487270 - DNA, 20 bp, Artificial Sequence
  chemically synthesized
ttccctgaaaatgcagcacc

SEQ ID NO: 487271 - DNA, 20 bp, Artificial Sequence
  chemically synthesized
agcaaagacatacagtcatt

SEQ ID NO: 487272 - DNA, 20 bp, Artificial Sequence
  chemically synthesized
aatagctctgatctcagatg

SEQ ID NO: 487273 - DNA, 20 bp, Artificial Sequence
  chemically synthesized
ggaaaatctagttttactta

SEQ ID NO: 487274 - DNA, 20 bp, Artificial Sequence
  chemically synthesized
atagtggctggggacctatt

SEQ ID NO: 487275 - DNA, 20 bp, Artificial Sequence
  chemically synthesized
cagccactataaattcaccc

SEQ ID NO: 487276 - DNA, 20 bp, Artificial Sequence
  chemically synthesized
tgcaaatgcggtattcaagg

SEQ ID NO: 487277 - DNA, 20 bp, Artificial Sequence
  chemically synthesized
tttttgcaaatgcggtattc

SEQ ID NO: 487278 - DNA, 20 bp, Artificial Sequence
  chemically synthesized
tgctcttttctctacttcct

SEQ ID NO: 487279 - DNA, 20 bp, Artificial Sequence
  chemically synthesized
aagaaaaggaaaaaaagtaa

SEQ ID NO: 487280 - DNA, 20 bp, Artificial Sequence
  chemically synthesized
cttagagaaacacatacaaa

SEQ ID NO: 487281 - DNA, 20 bp, Artificial Sequence
  chemically synthesized
aagaaaagtcccagctgtca

SEQ ID NO: 487282 - DNA, 20 bp, Artificial Sequence
  chemically synthesized
aggcaaatagtagtcattat

SEQ ID NO: 487283 - DNA, 20 bp, Artificial Sequence
  chemically synthesized
aagtggcaatctgttggaat

SEQ ID NO: 487284 - DNA, 20 bp, Artificial Sequence
  chemically synthesized
tctgtaaagtggcaatctgt

SEQ ID NO: 487285 - DNA, 20 bp, Artificial Sequence
  chemically synthesized
tacagataagaaaatgaagc

SEQ ID NO: 487286 - DNA, 20 bp, Artificial Sequence
  chemically synthesized
gataagaaaatgaagcaagg

SEQ ID NO: 487287 - DNA, 20 bp, Artificial Sequence
  chemically synthesized
gaaaatgaagcaagggtggg

SEQ ID NO: 487288 - DNA, 20 bp, Artificial Sequence
  chemically synthesized
gtgacggtagtgacaatgat

SEQ ID NO: 487289 - DNA, 20 bp, Artificial Sequence
  chemically synthesized
atagcttgcccacaacctcg

SEQ ID NO: 487290 - DNA, 20 bp, Artificial Sequence
  chemically synthesized
cacaacctcgtgggatgtgg

SEQ ID NO: 487291 - DNA, 20 bp, Artificial Sequence
  chemically synthesized
ggattcagacctagctgtgt

SEQ ID NO: 487292 - DNA, 20 bp, Artificial Sequence
  chemically synthesized
atattcaaacacagctaggt

SEQ ID NO: 487293 - DNA, 20 bp, Artificial Sequence
  chemically synthesized
tactgccaatagtataaact

SEQ ID NO: 487294 - DNA, 20 bp, Artificial Sequence
  chemically synthesized
acataatttgatcaaatcat

SEQ ID NO: 487295 - DNA, 20 bp, Artificial Sequence
  chemically synthesized
agaaattttactttcaccat

SEQ ID NO: 487296 - DNA, 20 bp, Artificial Sequence
  chemically synthesized
gccctacctctctgataata

SEQ ID NO: 487297 - DNA, 20 bp, Artificial Sequence
  chemically synthesized
tctgataatagagaatcact

SEQ ID NO: 487298 - DNA, 20 bp, Artificial Sequence
  chemically synthesized
cagtcgtcattcccattcat

SEQ ID NO: 487299 - DNA, 20 bp, Artificial Sequence
  chemically synthesized
tttcaaaaattccaatgaat

SEQ ID NO: 487300 - DNA, 20 bp, Artificial Sequence
  chemically synthesized
atcatttttcaaaaattcca

SEQ ID NO: 487301 - DNA, 20 bp, Artificial Sequence
  chemically synthesized
tgttttgaaggaggaagcaa

SEQ ID NO: 487302 - DNA, 20 bp, Artificial Sequence
  chemically synthesized
tatagttttgaccattccta

SEQ ID NO: 487303 - DNA, 20 bp, Artificial Sequence
  chemically synthesized
ctcatagaggataattcttt

SEQ ID NO: 487304 - DNA, 20 bp, Artificial Sequence
  chemically synthesized
cctaaagaattatcctctat

SEQ ID NO: 487305 - DNA, 20 bp, Artificial Sequence
  chemically synthesized
ttatgggtcttactctcata

SEQ ID NO: 487306 - DNA, 20 bp, Artificial Sequence
  chemically synthesized
tatgagtgaacaaggtagtt

SEQ ID NO: 487307 - DNA, 20 bp, Artificial Sequence
  chemically synthesized
tgttaggcacttccagggat

SEQ ID NO: 487308 - DNA, 20 bp, Artificial Sequence
  chemically synthesized
actatgtgttaggcacttcc

SEQ ID NO: 487309 - DNA, 20 bp, Artificial Sequence
  chemically synthesized
tgttgcaactttgagcctat

SEQ ID NO: 487310 - DNA, 20 bp, Artificial Sequence
  chemically synthesized
caactttgagcctatgggaa

SEQ ID NO: 487311 - DNA, 20 bp, Artificial Sequence
  chemically synthesized
gagcctatgggaattgagtt

SEQ ID NO: 487312 - DNA, 20 bp, Artificial Sequence
  chemically synthesized
tttctttctaaataatctgc

SEQ ID NO: 487313 - DNA, 20 bp, Artificial Sequence
  chemically synthesized
taatctgctagagttaaata

SEQ ID NO: 487314 - DNA, 20 bp, Artificial Sequence
  chemically synthesized
cagagtctactcttctgctt

SEQ ID NO: 487315 - DNA, 20 bp, Artificial Sequence
  chemically synthesized
tacgggaaatccaaaagcag

SEQ ID NO: 487316 - DNA, 20 bp, Artificial Sequence
  chemically synthesized
cattttaatttgtcatagaa

SEQ ID NO: 487317 - DNA, 20 bp, Artificial Sequence
  chemically synthesized
atttctatgacaaattaaaa

SEQ ID NO: 487318 - DNA, 20 bp, Artificial Sequence
  chemically synthesized
agtttaaaggaagtcaatga

SEQ ID NO: 487319 - DNA, 20 bp, Artificial Sequence
  chemically synthesized
gaagaaaaatgtgggataaa

SEQ ID NO: 487320 - DNA, 20 bp, Artificial Sequence
  chemically synthesized
ttcagctaagaagaaaaatg

SEQ ID NO: 487321 - DNA, 20 bp, Artificial Sequence
  chemically synthesized
tcccacatttttcttcttag

SEQ ID NO: 487322 - DNA, 20 bp, Artificial Sequence
  chemically synthesized
tttgtatttgtgatgttctc

SEQ ID NO: 487323 - DNA, 20 bp, Artificial Sequence
  chemically synthesized
tagcatttatatgatttagc

SEQ ID NO: 487324 - DNA, 20 bp, Artificial Sequence
  chemically synthesized
atattttatataaccaacat

SEQ ID NO: 487325 - DNA, 20 bp, Artificial Sequence
  chemically synthesized
ttgatttgtaattccagtag

SEQ ID NO: 487326 - DNA, 20 bp, Artificial Sequence
  chemically synthesized
ttccaagtttactcttctac

SEQ ID NO: 487327 - DNA, 20 bp, Artificial Sequence
  chemically synthesized
gagtaaacttggaaaggctg

SEQ ID NO: 487328 - DNA, 20 bp, Artificial Sequence
  chemically synthesized
atacaaatctaaaaacttct

SEQ ID NO: 487329 - DNA, 20 bp, Artificial Sequence
  chemically synthesized
gtgaaaaagaaaagtgaagt

SEQ ID NO: 487330 - DNA, 20 bp, Artificial Sequence
  chemically synthesized
atattgacttcctatgctcg

SEQ ID NO: 487331 - DNA, 20 bp, Artificial Sequence
  chemically synthesized
taaatttaagggaatatgag

SEQ ID NO: 487332 - DNA, 20 bp, Artificial Sequence
  chemically synthesized
gagggacacattaaatttaa

SEQ ID NO: 487333 - DNA, 20 bp, Artificial Sequence
  chemically synthesized
tataaatcttttttaaaggt

SEQ ID NO: 487334 - DNA, 20 bp, Artificial Sequence
  chemically synthesized
aagatttatatttctaaaat

SEQ ID NO: 487335 - DNA, 20 bp, Artificial Sequence
  chemically synthesized
gatgatgcagcaggtatctt

SEQ ID NO: 487336 - DNA, 20 bp, Artificial Sequence
  chemically synthesized
atctctagcttataaatata

SEQ ID NO: 487337 - DNA, 20 bp, Artificial Sequence
  chemically synthesized
tatatttataagctagagat

SEQ ID NO: 487338 - DNA, 20 bp, Artificial Sequence
  chemically synthesized
gaaaattttcaatttacaat

SEQ ID NO: 487339 - DNA, 20 bp, Artificial Sequence
  chemically synthesized
taatacacatacacatatgt

SEQ ID NO: 487340 - DNA, 20 bp, Artificial Sequence
  chemically synthesized
acacatacacatatgtgtga

SEQ ID NO: 487341 - DNA, 20 bp, Artificial Sequence
  chemically synthesized
tacaggtatacctcatttta

SEQ ID NO: 487342 - DNA, 20 bp, Artificial Sequence
  chemically synthesized
gctgatagacttgcttgatg

SEQ ID NO: 487343 - DNA, 20 bp, Artificial Sequence
  chemically synthesized
gaaaaagcttgaaatattgt

SEQ ID NO: 487344 - DNA, 20 bp, Artificial Sequence
  chemically synthesized
tttttataactgttatggtg

SEQ ID NO: 487345 - DNA, 20 bp, Artificial Sequence
  chemically synthesized
tgttactattttaatagttt

SEQ ID NO: 487346 - DNA, 20 bp, Artificial Sequence
  chemically synthesized
tgccacaaacagtgcccata

SEQ ID NO: 487347 - DNA, 20 bp, Artificial Sequence
  chemically synthesized
cgttcagaatacatacatta

SEQ ID NO: 487348 - DNA, 20 bp, Artificial Sequence
  chemically synthesized
tgactggtcagtggagcgtt

SEQ ID NO: 487349 - DNA, 20 bp, Artificial Sequence
  chemically synthesized
aaggagaggaagagaggtag

SEQ ID NO: 487350 - DNA, 20 bp, Artificial Sequence
  chemically synthesized
atttcaatattgttgtgtct

SEQ ID NO: 487351 - DNA, 20 bp, Artificial Sequence
  chemically synthesized
ctaaatgttcaagggaaaac

SEQ ID NO: 487352 - DNA, 20 bp, Artificial Sequence
  chemically synthesized
ttgtgcccgttagctaagtt

SEQ ID NO: 487353 - DNA, 20 bp, Artificial Sequence
  chemically synthesized
tggcacttttaattttcttc

SEQ ID NO: 487354 - DNA, 20 bp, Artificial Sequence
  chemically synthesized
acagccttattgttaatatg

SEQ ID NO: 487355 - DNA, 20 bp, Artificial Sequence
  chemically synthesized
tggattaggctttggcttag

SEQ ID NO: 487356 - DNA, 20 bp, Artificial Sequence
  chemically synthesized
gaacagaattgggccttgct

SEQ ID NO: 487357 - DNA, 20 bp, Artificial Sequence
  chemically synthesized
tcagcattcatacaactgaa

SEQ ID NO: 487358 - DNA, 20 bp, Artificial Sequence
  chemically synthesized
gcccaattctgttcagttgt

SEQ ID NO: 487359 - DNA, 20 bp, Artificial Sequence
  chemically synthesized
ttagatattagcttgatctt

SEQ ID NO: 487360 - DNA, 20 bp, Artificial Sequence
  chemically synthesized
attgcattagcccctcaaaa

SEQ ID NO: 487361 - DNA, 20 bp, Artificial Sequence
  chemically synthesized
cttaagggccctaggatttt

SEQ ID NO: 487362 - DNA, 20 bp, Artificial Sequence
  chemically synthesized
tagcataatcttaagggccc

SEQ ID NO: 487363 - DNA, 20 bp, Artificial Sequence
  chemically synthesized
ttccctttatagagcatagg

SEQ ID NO: 487364 - DNA, 20 bp, Artificial Sequence
  chemically synthesized
tataaagggaacaacaaagc

SEQ ID NO: 487365 - DNA, 20 bp, Artificial Sequence
  chemically synthesized
tttacagcatggtttactta

SEQ ID NO: 487366 - DNA, 20 bp, Artificial Sequence
  chemically synthesized
ctttgtccaaggactgcaga

SEQ ID NO: 487367 - DNA, 20 bp, Artificial Sequence
  chemically synthesized
actcctttgtccaaggactg

SEQ ID NO: 487368 - DNA, 20 bp, Artificial Sequence
  chemically synthesized
attctgcagtccttggacaa

SEQ ID NO: 487369 - DNA, 20 bp, Artificial Sequence
  chemically synthesized
cttacaaaatgtacttttta

SEQ ID NO: 487370 - DNA, 20 bp, Artificial Sequence
  chemically synthesized
cctaggtagcgattcctctg

SEQ ID NO: 487371 - DNA, 20 bp, Artificial Sequence
  chemically synthesized
agtttacccagatccatcag

SEQ ID NO: 487372 - DNA, 20 bp, Artificial Sequence
  chemically synthesized
tagcgattcctctgatggat

SEQ ID NO: 487373 - DNA, 20 bp, Artificial Sequence
  chemically synthesized
tcttaatggcatctggaatg

SEQ ID NO: 487374 - DNA, 20 bp, Artificial Sequence
  chemically synthesized
caaattttcttaatggcatc

SEQ ID NO: 487375 - DNA, 20 bp, Artificial Sequence
  chemically synthesized
gttgatatttacctctttct

SEQ ID NO: 487376 - DNA, 20 bp, Artificial Sequence
  chemically synthesized
agaagtttattccaaccctc

SEQ ID NO: 487377 - DNA, 20 bp, Artificial Sequence
  chemically synthesized
tcataggcattcatgagggt

SEQ ID NO: 487378 - DNA, 20 bp, Artificial Sequence
  chemically synthesized
ggaccctcataggcattcat

SEQ ID NO: 487379 - DNA, 20 bp, Artificial Sequence
  chemically synthesized
caaccctcatgaatgcctat

SEQ ID NO: 487380 - DNA, 20 bp, Artificial Sequence
  chemically synthesized
gactttagtaggggaagtca

SEQ ID NO: 487381 - DNA, 20 bp, Artificial Sequence
  chemically synthesized
ggagaaaattgcaagagaac

SEQ ID NO: 487382 - DNA, 20 bp, Artificial Sequence
  chemically synthesized
agtggagcctgaaggtgtaa

SEQ ID NO: 487383 - DNA, 20 bp, Artificial Sequence
  chemically synthesized
catctcataatgaaacttca

SEQ ID NO: 487384 - DNA, 20 bp, Artificial Sequence
  chemically synthesized
taatgaaacttcaatggatg

SEQ ID NO: 487385 - DNA, 20 bp, Artificial Sequence
  chemically synthesized
aacaaagtgttttcatgaga

SEQ ID NO: 487386 - DNA, 20 bp, Artificial Sequence
  chemically synthesized
ttgtttacagcgtcttcacc

SEQ ID NO: 487387 - DNA, 20 bp, Artificial Sequence
  chemically synthesized
acaatgttgaaatgacaaca

SEQ ID NO: 487388 - DNA, 20 bp, Artificial Sequence
  chemically synthesized
tgaaatgacaacaaagggtt

SEQ ID NO: 487389 - DNA, 20 bp, Artificial Sequence
  chemically synthesized
tgctttaccaactaagttta

SEQ ID NO: 487390 - DNA, 20 bp, Artificial Sequence
  chemically synthesized
cttagttggtaaagcagcag

SEQ ID NO: 487391 - DNA, 20 bp, Artificial Sequence
  chemically synthesized
tcatttttgaaagatctact

SEQ ID NO: 487392 - DNA, 20 bp, Artificial Sequence
  chemically synthesized
gagtgactatgccaatttct

SEQ ID NO: 487393 - DNA, 20 bp, Artificial Sequence
  chemically synthesized
agtagtaactgttgaaaggt

SEQ ID NO: 487394 - DNA, 20 bp, Artificial Sequence
  chemically synthesized
ggagatagctgctgaccgat

SEQ ID NO: 487395 - DNA, 20 bp, Artificial Sequence
  chemically synthesized
tcttaatctttttgctgatg

SEQ ID NO: 487396 - DNA, 20 bp, Artificial Sequence
  chemically synthesized
agcagtcatctgagccttca

SEQ ID NO: 487397 - DNA, 20 bp, Artificial Sequence
  chemically synthesized
caactattgttttagattta

SEQ ID NO: 487398 - DNA, 20 bp, Artificial Sequence
  chemically synthesized
ttgttacatttatatattta

SEQ ID NO: 487399 - DNA, 20 bp, Artificial Sequence
  chemically synthesized
tattgggtgatactgaggtt

SEQ ID NO: 487400 - DNA, 20 bp, Artificial Sequence
  chemically synthesized
atactgaggtttggagtatg

SEQ ID NO: 487401 - DNA, 20 bp, Artificial Sequence
  chemically synthesized
ggtgcgcactatctcagtga

SEQ ID NO: 487402 - DNA, 20 bp, Artificial Sequence
  chemically synthesized
ggaagagataaggaaggggc

SEQ ID NO: 487403 - DNA, 20 bp, Artificial Sequence
  chemically synthesized
ctgttgccatctttatgtcc

SEQ ID NO: 487404 - DNA, 20 bp, Artificial Sequence
  chemically synthesized
actggaggccattatcgtaa

SEQ ID NO: 487405 - DNA, 20 bp, Artificial Sequence
  chemically synthesized
aatactacacaaccattaaa

SEQ ID NO: 487406 - DNA, 20 bp, Artificial Sequence
  chemically synthesized
agatgaccatcaatggtgga

SEQ ID NO: 487407 - DNA, 20 bp, Artificial Sequence
  chemically synthesized
tattcacaatagaaaagcca

SEQ ID NO: 487408 - DNA, 20 bp, Artificial Sequence
  chemically synthesized
gattccttggcttttctatt

SEQ ID NO: 487409 - DNA, 20 bp, Artificial Sequence
  chemically synthesized
aagtgcatgtgtctttttgg

SEQ ID NO: 487410 - DNA, 20 bp, Artificial Sequence
  chemically synthesized
gtagaatgatttatttactt

SEQ ID NO: 487411 - DNA, 20 bp, Artificial Sequence
  chemically synthesized
tttggatatatactcagtaa

SEQ ID NO: 487412 - DNA, 20 bp, Artificial Sequence
  chemically synthesized
tcaacccagcaatcccatta

SEQ ID NO: 487413 - DNA, 20 bp, Artificial Sequence
  chemically synthesized
tatactcagtaatgggattg

SEQ ID NO: 487414 - DNA, 20 bp, Artificial Sequence
  chemically synthesized
tcagtaatgggattgctggg

SEQ ID NO: 487415 - DNA, 20 bp, Artificial Sequence
  chemically synthesized
cccactgtggaaagcagttt

SEQ ID NO: 487416 - DNA, 20 bp, Artificial Sequence
  chemically synthesized
tccccaaactgctttccaca

SEQ ID NO: 487417 - DNA, 20 bp, Artificial Sequence
  chemically synthesized
gaacattatacgctgttggt

SEQ ID NO: 487418 - DNA, 20 bp, Artificial Sequence
  chemically synthesized
tcaccaacatctattgtgtt

SEQ ID NO: 487419 - DNA, 20 bp, Artificial Sequence
  chemically synthesized
agataccatctcacaccagt

SEQ ID NO: 487420 - DNA, 20 bp, Artificial Sequence
  chemically synthesized
tgatttgcatttctctaatg

SEQ ID NO: 487421 - DNA, 20 bp, Artificial Sequence
  chemically synthesized
tacttctcaaaagaagacaa

SEQ ID NO: 487422 - DNA, 20 bp, Artificial Sequence
  chemically synthesized
gtaaaaagtgggcaaaagac

SEQ ID NO: 487423 - DNA, 20 bp, Artificial Sequence
  chemically synthesized
tcttttgcccactttttaca

SEQ ID NO: 487424 - DNA, 20 bp, Artificial Sequence
  chemically synthesized
tgttaagttccctatagatt

SEQ ID NO: 487425 - DNA, 20 bp, Artificial Sequence
  chemically synthesized
ggatattagatctttgtctg

SEQ ID NO: 487426 - DNA, 20 bp, Artificial Sequence
  chemically synthesized
tgtatattttctctcatctt

SEQ ID NO: 487427 - DNA, 20 bp, Artificial Sequence
  chemically synthesized
acagcaaaagaaactatcaa

SEQ ID NO: 487428 - DNA, 20 bp, Artificial Sequence
  chemically synthesized
caaaaccaaaaattaacaag

SEQ ID NO: 487429 - DNA, 20 bp, Artificial Sequence
  chemically synthesized
ttgcttttaaggacttagtc

SEQ ID NO: 487430 - DNA, 20 bp, Artificial Sequence
  chemically synthesized
tctggacatcagccttcaga

SEQ ID NO: 487431 - DNA, 20 bp, Artificial Sequence
  chemically synthesized
tctttctgaaggctgatgtc

SEQ ID NO: 487432 - DNA, 20 bp, Artificial Sequence
  chemically synthesized
acaataaaatctcaaactag

SEQ ID NO: 487433 - DNA, 20 bp, Artificial Sequence
  chemically synthesized
gtattgtatttatttaggga

SEQ ID NO: 487434 - DNA, 20 bp, Artificial Sequence
  chemically synthesized
caggagaaccgcttgagcca

SEQ ID NO: 487435 - DNA, 20 bp, Artificial Sequence
  chemically synthesized
gcctcagcctcccaagtagc

SEQ ID NO: 487436 - DNA, 20 bp, Artificial Sequence
  chemically synthesized
tcccaagtagctgggattac

SEQ ID NO: 487437 - DNA, 20 bp, Artificial Sequence
  chemically synthesized
ttttgtatttttagtagaga

SEQ ID NO: 487438 - DNA, 20 bp, Artificial Sequence
  chemically synthesized
cggggtttcaccatgttggc

SEQ ID NO: 487439 - DNA, 20 bp, Artificial Sequence
  chemically synthesized
actttgggaggctgaagcag

SEQ ID NO: 487440 - DNA, 20 bp, Artificial Sequence
  chemically synthesized
gcttcagcctcccaaagtgc

SEQ ID NO: 487441 - DNA, 20 bp, Artificial Sequence
  chemically synthesized
ttttaaatctttaatccatc

SEQ ID NO: 487442 - DNA, 20 bp, Artificial Sequence
  chemically synthesized
tatacaaaaattaactcaag

SEQ ID NO: 487443 - DNA, 20 bp, Artificial Sequence
  chemically synthesized
ttttgtatatagtgaaaggt

SEQ ID NO: 487444 - DNA, 20 bp, Artificial Sequence
  chemically synthesized
aggagtccagtttcattcct

SEQ ID NO: 487445 - DNA, 20 bp, Artificial Sequence
  chemically synthesized
agctggctaaccgtatccag

SEQ ID NO: 487446 - DNA, 20 bp, Artificial Sequence
  chemically synthesized
ccctactcaataaacggtgc

SEQ ID NO: 487447 - DNA, 20 bp, Artificial Sequence
  chemically synthesized
agctatcccagcaccgttta

SEQ ID NO: 487448 - DNA, 20 bp, Artificial Sequence
  chemically synthesized
ccagcaccgtttattgagta

SEQ ID NO: 487449 - DNA, 20 bp, Artificial Sequence
  chemically synthesized
gtaggtatgcggctttattt

SEQ ID NO: 487450 - DNA, 20 bp, Artificial Sequence
  chemically synthesized
agaaacttggaccagtagaa

SEQ ID NO: 487451 - DNA, 20 bp, Artificial Sequence
  chemically synthesized
ttgtagaagtcccattctct

SEQ ID NO: 487452 - DNA, 20 bp, Artificial Sequence
  chemically synthesized
taaggctacagttacccaaa

SEQ ID NO: 487453 - DNA, 20 bp, Artificial Sequence
  chemically synthesized
taaaaacaatgctaagtgaa

SEQ ID NO: 487454 - DNA, 20 bp, Artificial Sequence
  chemically synthesized
tgaatctaaaaaacagtctg

SEQ ID NO: 487455 - DNA, 20 bp, Artificial Sequence
  chemically synthesized
agactgttttttagattcat

SEQ ID NO: 487456 - DNA, 20 bp, Artificial Sequence
  chemically synthesized
aaaactatcctaaaattcat

SEQ ID NO: 487457 - DNA, 20 bp, Artificial Sequence
  chemically synthesized
ttttagattcatatgaattt

SEQ ID NO: 487458 - DNA, 20 bp, Artificial Sequence
  chemically synthesized
actagcaatgtcatttttca

SEQ ID NO: 487459 - DNA, 20 bp, Artificial Sequence
  chemically synthesized
aatgacattgctagtttgat

SEQ ID NO: 487460 - DNA, 20 bp, Artificial Sequence
  chemically synthesized
ctagtttgataggaatagca

SEQ ID NO: 487461 - DNA, 20 bp, Artificial Sequence
  chemically synthesized
attccatgttaatggaaagg

SEQ ID NO: 487462 - DNA, 20 bp, Artificial Sequence
  chemically synthesized
attcttcctttccattaaca

SEQ ID NO: 487463 - DNA, 20 bp, Artificial Sequence
  chemically synthesized
ccacaaaaaataaaatatct

SEQ ID NO: 487464 - DNA, 20 bp, Artificial Sequence
  chemically synthesized
ttcaagctgagagccaaatc

SEQ ID NO: 487465 - DNA, 20 bp, Artificial Sequence
  chemically synthesized
ttccagaccaccataataaa

SEQ ID NO: 487466 - DNA, 20 bp, Artificial Sequence
  chemically synthesized
tgctatgaagaaagattaaa

SEQ ID NO: 487467 - DNA, 20 bp, Artificial Sequence
  chemically synthesized
aagattaaaaagagtaagta

SEQ ID NO: 487468 - DNA, 20 bp, Artificial Sequence
  chemically synthesized
ctgctcctctcttcaggaaa

SEQ ID NO: 487469 - DNA, 20 bp, Artificial Sequence
  chemically synthesized
aaatggaatgaagtgaagaa

SEQ ID NO: 487470 - DNA, 20 bp, Artificial Sequence
  chemically synthesized
tccattgccaaaaggcggtg

SEQ ID NO: 487471 - DNA, 20 bp, Artificial Sequence
  chemically synthesized
gtgaggagttttgcttgtat

SEQ ID NO: 487472 - DNA, 20 bp, Artificial Sequence
  chemically synthesized
tctgttaacataaatatgta

SEQ ID NO: 487473 - DNA, 20 bp, Artificial Sequence
  chemically synthesized
tattctgtcctctataacac

SEQ ID NO: 487474 - DNA, 20 bp, Artificial Sequence
  chemically synthesized
cattcaggtgttatagagga

SEQ ID NO: 487475 - DNA, 20 bp, Artificial Sequence
  chemically synthesized
ttagtactttgtaatatttc

SEQ ID NO: 487476 - DNA, 20 bp, Artificial Sequence
  chemically synthesized
tcatcttaaaagagtcaaat

SEQ ID NO: 487477 - DNA, 20 bp, Artificial Sequence
  chemically synthesized
cgctagagttatcatcttaa

SEQ ID NO: 487478 - DNA, 20 bp, Artificial Sequence
  chemically synthesized
tcttgcctccaatctgccgc

SEQ ID NO: 487479 - DNA, 20 bp, Artificial Sequence
  chemically synthesized
cagattggaggcaagatttt

SEQ ID NO: 487480 - DNA, 20 bp, Artificial Sequence
  chemically synthesized
taggaaatgcctttagaggt

SEQ ID NO: 487481 - DNA, 20 bp, Artificial Sequence
  chemically synthesized
attgaacaaacaggagcagc

SEQ ID NO: 487482 - DNA, 20 bp, Artificial Sequence
  chemically synthesized
ggaagtattattcctatgtt

SEQ ID NO: 487483 - DNA, 20 bp, Artificial Sequence
  chemically synthesized
cagtcctttatccacaacat

SEQ ID NO: 487484 - DNA, 20 bp, Artificial Sequence
  chemically synthesized
atggggaaaaagaaaatttt

SEQ ID NO: 487485 - DNA, 20 bp, Artificial Sequence
  chemically synthesized
taacttgggagaaactgtct

SEQ ID NO: 487486 - DNA, 20 bp, Artificial Sequence
  chemically synthesized
ggagcctgtccctatatgga

SEQ ID NO: 487487 - DNA, 20 bp, Artificial Sequence
  chemically synthesized
aatgttttcaggttggagac

SEQ ID NO: 487488 - DNA, 20 bp, Artificial Sequence
  chemically synthesized
agaagcgtagtgtgcagatt

SEQ ID NO: 487489 - DNA, 20 bp, Artificial Sequence
  chemically synthesized
tgcagattaggggtaaggct

SEQ ID NO: 487490 - DNA, 20 bp, Artificial Sequence
  chemically synthesized
tattgtcccagtgatacttg

SEQ ID NO: 487491 - DNA, 20 bp, Artificial Sequence
  chemically synthesized
atacttgtagagtgactgaa

SEQ ID NO: 487492 - DNA, 20 bp, Artificial Sequence
  chemically synthesized
gtgactgaagaggatagagc

SEQ ID NO: 487493 - DNA, 20 bp, Artificial Sequence
  chemically synthesized
gaattaggtattcgcctcca

SEQ ID NO: 487494 - DNA, 20 bp, Artificial Sequence
  chemically synthesized
tcttctcttatcctgtggag

SEQ ID NO: 487495 - DNA, 20 bp, Artificial Sequence
  chemically synthesized
attctctcctcacttctatt

SEQ ID NO: 487496 - DNA, 20 bp, Artificial Sequence
  chemically synthesized
acccaaaatagaagtgagga

SEQ ID NO: 487497 - DNA, 20 bp, Artificial Sequence
  chemically synthesized
gaggagagaattatatgaaa

SEQ ID NO: 487498 - DNA, 20 bp, Artificial Sequence
  chemically synthesized
aaataatacaaataataata

SEQ ID NO: 487499 - DNA, 20 bp, Artificial Sequence
  chemically synthesized
atttcatttaacctccaatg

SEQ ID NO: 487500 - DNA, 20 bp, Artificial Sequence
  chemically synthesized
tacaaagtaaaccgagaaca

SEQ ID NO: 487501 - DNA, 20 bp, Artificial Sequence
  chemically synthesized
ttgttacctaaatctgtttg

SEQ ID NO: 487502 - DNA, 20 bp, Artificial Sequence
  chemically synthesized
atgggagcaactataacaag

SEQ ID NO: 487503 - DNA, 20 bp, Artificial Sequence
  chemically synthesized
taacaaggtgagtaaaacaa

SEQ ID NO: 487504 - DNA, 20 bp, Artificial Sequence
  chemically synthesized
cacacacacacacaatcttt

SEQ ID NO: 487505 - DNA, 20 bp, Artificial Sequence
  chemically synthesized
agaaacaaacctaaaattat

SEQ ID NO: 487506 - DNA, 20 bp, Artificial Sequence
  chemically synthesized
aagaatttttatcatatagg

SEQ ID NO: 487507 - DNA, 20 bp, Artificial Sequence
  chemically synthesized
tgttaagaatttttatcata

SEQ ID NO: 487508 - DNA, 20 bp, Artificial Sequence
  chemically synthesized
caagacttttttaaaatgtt

SEQ ID NO: 487509 - DNA, 20 bp, Artificial Sequence
  chemically synthesized
actgtaacaaattcaaaagg

SEQ ID NO: 487510 - DNA, 20 bp, Artificial Sequence
  chemically synthesized
aggaagaaatatccagcctt

SEQ ID NO: 487511 - DNA, 20 bp, Artificial Sequence
  chemically synthesized
ctaaaggtacagaattttca

SEQ ID NO: 487512 - DNA, 20 bp, Artificial Sequence
  chemically synthesized
ctgttcattttctaaaggta

SEQ ID NO: 487513 - DNA, 20 bp, Artificial Sequence
  chemically synthesized
agaatatggagtggatagag

SEQ ID NO: 487514 - DNA, 20 bp, Artificial Sequence
  chemically synthesized
gggtgattgaagaatatgga

SEQ ID NO: 487515 - DNA, 20 bp, Artificial Sequence
  chemically synthesized
ttatgggtgattgaagaata

SEQ ID NO: 487516 - DNA, 20 bp, Artificial Sequence
  chemically synthesized
gaactatttatgggtgattg

SEQ ID NO: 487517 - DNA, 20 bp, Artificial Sequence
  chemically synthesized
catgatttttggaactattt

SEQ ID NO: 487518 - DNA, 20 bp, Artificial Sequence
  chemically synthesized
aaatagttccaaaaatcatg

SEQ ID NO: 487519 - DNA, 20 bp, Artificial Sequence
  chemically synthesized
tatctatctgccagtgcctt

SEQ ID NO: 487520 - DNA, 20 bp, Artificial Sequence
  chemically synthesized
agaaggcactggcagataga

SEQ ID NO: 487521 - DNA, 20 bp, Artificial Sequence
  chemically synthesized
actggcagatagataggatc

SEQ ID NO: 487522 - DNA, 20 bp, Artificial Sequence
  chemically synthesized
agtctgctttgacaactaca

SEQ ID NO: 487523 - DNA, 20 bp, Artificial Sequence
  chemically synthesized
ttattaattaaaatttgtat

SEQ ID NO: 487524 - DNA, 20 bp, Artificial Sequence
  chemically synthesized
aattaataaaattgttattg

SEQ ID NO: 487525 - DNA, 20 bp, Artificial Sequence
  chemically synthesized
aatggcaacaaggctggcat

SEQ ID NO: 487526 - DNA, 20 bp, Artificial Sequence
  chemically synthesized
ttagagctccaaagtactaa

SEQ ID NO: 487527 - DNA, 20 bp, Artificial Sequence
  chemically synthesized
tatttttcacttgcaggaag

SEQ ID NO: 487528 - DNA, 20 bp, Artificial Sequence
  chemically synthesized
ctattttggtgacttgaaca

SEQ ID NO: 487529 - DNA, 20 bp, Artificial Sequence
  chemically synthesized
gccctagatttagtcctctg

SEQ ID NO: 487530 - DNA, 20 bp, Artificial Sequence
  chemically synthesized
tttcaatagagggaaatgat

SEQ ID NO: 487531 - DNA, 20 bp, Artificial Sequence
  chemically synthesized
aaatctgtactatgtcattg

SEQ ID NO: 487532 - DNA, 20 bp, Artificial Sequence
  chemically synthesized
gaactgagaataaatctcat

SEQ ID NO: 487533 - DNA, 20 bp, Artificial Sequence
  chemically synthesized
tgctctgtttctatagaact

SEQ ID NO: 487534 - DNA, 20 bp, Artificial Sequence
  chemically synthesized
agttctatagaaacagagca

SEQ ID NO: 487535 - DNA, 20 bp, Artificial Sequence
  chemically synthesized
agaaacagagcaatgggtga

SEQ ID NO: 487536 - DNA, 20 bp, Artificial Sequence
  chemically synthesized
acaaagaatttagagctgaa

SEQ ID NO: 487537 - DNA, 20 bp, Artificial Sequence
  chemically synthesized
gccaaggaaaagtagccaca

SEQ ID NO: 487538 - DNA, 20 bp, Artificial Sequence
  chemically synthesized
tcactacatttatttgcagg

SEQ ID NO: 487539 - DNA, 20 bp, Artificial Sequence
  chemically synthesized
gggcaagatactattgcttg

SEQ ID NO: 487540 - DNA, 20 bp, Artificial Sequence
  chemically synthesized
aatattttcagtgaagttaa

SEQ ID NO: 487541 - DNA, 20 bp, Artificial Sequence
  chemically synthesized
actgaagaaaatatgtacga

SEQ ID NO: 487542 - DNA, 20 bp, Artificial Sequence
  chemically synthesized
tttcgtacatattttcttca

SEQ ID NO: 487543 - DNA, 20 bp, Artificial Sequence
  chemically synthesized
gacaattatcctaaaaatta

SEQ ID NO: 487544 - DNA, 20 bp, Artificial Sequence
  chemically synthesized
ttcacatattctttaatttt

SEQ ID NO: 487545 - DNA, 20 bp, Artificial Sequence
  chemically synthesized
tccatctcatgtggtttctt

SEQ ID NO: 487546 - DNA, 20 bp, Artificial Sequence
  chemically synthesized
ttagataaaactttctttgt

SEQ ID NO: 487547 - DNA, 20 bp, Artificial Sequence
  chemically synthesized
catttgcaagccacatggtc

SEQ ID NO: 487548 - DNA, 20 bp, Artificial Sequence
  chemically synthesized
accatgtggcttgcaaatgg

SEQ ID NO: 487549 - DNA, 20 bp, Artificial Sequence
  chemically synthesized
gatttggtgacacatacttc

SEQ ID NO: 487550 - DNA, 20 bp, Artificial Sequence
  chemically synthesized
aaatctctatttccttcttt

SEQ ID NO: 487551 - DNA, 20 bp, Artificial Sequence
  chemically synthesized
aagaatattgtagaatgtat

SEQ ID NO: 487552 - DNA, 20 bp, Artificial Sequence
  chemically synthesized
tatattctggaagaatattg

SEQ ID NO: 487553 - DNA, 20 bp, Artificial Sequence
  chemically synthesized
tacattctacaatattcttc

SEQ ID NO: 487554 - DNA, 20 bp, Artificial Sequence
  chemically synthesized
ttctctcatttatattctgg

SEQ ID NO: 487555 - DNA, 20 bp, Artificial Sequence
  chemically synthesized
tcattttttgtgagaaggga

SEQ ID NO: 487556 - DNA, 20 bp, Artificial Sequence
  chemically synthesized
catagccttgtaatagctct

SEQ ID NO: 487557 - DNA, 20 bp, Artificial Sequence
  chemically synthesized
agctctgagggtttctctta

SEQ ID NO: 487558 - DNA, 20 bp, Artificial Sequence
  chemically synthesized
gctcaaaccagttctctgac

SEQ ID NO: 487559 - DNA, 20 bp, Artificial Sequence
  chemically synthesized
tcccatgacgactttcttgt

SEQ ID NO: 487560 - DNA, 20 bp, Artificial Sequence
  chemically synthesized
ttcagacaagaaagtcgtca

SEQ ID NO: 487561 - DNA, 20 bp, Artificial Sequence
  chemically synthesized
cttgcattggaggggacatt

SEQ ID NO: 487562 - DNA, 20 bp, Artificial Sequence
  chemically synthesized
tcaaactctcctcgtatcat

SEQ ID NO: 487563 - DNA, 20 bp, Artificial Sequence
  chemically synthesized
taagatccttatgatacgag

SEQ ID NO: 487564 - DNA, 20 bp, Artificial Sequence
  chemically synthesized
cttgtattaattaggtaata

SEQ ID NO: 487565 - DNA, 20 bp, Artificial Sequence
  chemically synthesized
taatggttcaataacagtag

SEQ ID NO: 487566 - DNA, 20 bp, Artificial Sequence
  chemically synthesized
atttcaaaaacctatcaggg

SEQ ID NO: 487567 - DNA, 20 bp, Artificial Sequence
  chemically synthesized
gccctgataggtttttgaaa

SEQ ID NO: 487568 - DNA, 20 bp, Artificial Sequence
  chemically synthesized
taaataaaagtaaaggtgct

SEQ ID NO: 487569 - DNA, 20 bp, Artificial Sequence
  chemically synthesized
ggtagaaaaaaaaaaccctt

SEQ ID NO: 487570 - DNA, 20 bp, Artificial Sequence
  chemically synthesized
gacttgctacttttaccctc

SEQ ID NO: 487571 - DNA, 20 bp, Artificial Sequence
  chemically synthesized
gatgtagaattagaaatatg

SEQ ID NO: 487572 - DNA, 20 bp, Artificial Sequence
  chemically synthesized
cacacacaatcggcatgatg

SEQ ID NO: 487573 - DNA, 20 bp, Artificial Sequence
  chemically synthesized
tacaagaaaggaaaacaagg

SEQ ID NO: 487574 - DNA, 20 bp, Artificial Sequence
  chemically synthesized
aaaatgaaaatttaaagaaa

SEQ ID NO: 487575 - DNA, 20 bp, Artificial Sequence
  chemically synthesized
attttacctactaataacct

SEQ ID NO: 487576 - DNA, 20 bp, Artificial Sequence
  chemically synthesized
tatatgattatatatatatt

SEQ ID NO: 487577 - DNA, 20 bp, Artificial Sequence
  chemically synthesized
aagcactgaataaatgtttg

SEQ ID NO: 487578 - DNA, 20 bp, Artificial Sequence
  chemically synthesized
ccagtgaaacatagtaagca

SEQ ID NO: 487579 - DNA, 20 bp, Artificial Sequence
  chemically synthesized
cagtgcttactatgtttcac

SEQ ID NO: 487580 - DNA, 20 bp, Artificial Sequence
  chemically synthesized
ttactatgtttcactggggt

SEQ ID NO: 487581 - DNA, 20 bp, Artificial Sequence
  chemically synthesized
gtttcactggggtaggaatg

SEQ ID NO: 487582 - DNA, 20 bp, Artificial Sequence
  chemically synthesized
gctcatgcacctcattataa

SEQ ID NO: 487583 - DNA, 20 bp, Artificial Sequence
  chemically synthesized
ataaggggatggacggcaga

SEQ ID NO: 487584 - DNA, 20 bp, Artificial Sequence
  chemically synthesized
gcatgttccatgttccctct

SEQ ID NO: 487585 - DNA, 20 bp, Artificial Sequence
  chemically synthesized
agtacggagctatcacgtag

SEQ ID NO: 487586 - DNA, 20 bp, Artificial Sequence
  chemically synthesized
cgtaggggaatgggaagtaa

SEQ ID NO: 487587 - DNA, 20 bp, Artificial Sequence
  chemically synthesized
aagcaaaagccagagaaaag

SEQ ID NO: 487588 - DNA, 20 bp, Artificial Sequence
  chemically synthesized
agcttctccactacagttct

SEQ ID NO: 487589 - DNA, 20 bp, Artificial Sequence
  chemically synthesized
aactgtagtggagaagctac

SEQ ID NO: 487590 - DNA, 20 bp, Artificial Sequence
  chemically synthesized
gctacaagagttttaaataa

SEQ ID NO: 487591 - DNA, 20 bp, Artificial Sequence
  chemically synthesized
aattgatcttctaaatatat

SEQ ID NO: 487592 - DNA, 20 bp, Artificial Sequence
  chemically synthesized
atatttataaatgaaggtat

SEQ ID NO: 487593 - DNA, 20 bp, Artificial Sequence
  chemically synthesized
aaatgaaggtatatgaatat

SEQ ID NO: 487594 - DNA, 20 bp, Artificial Sequence
  chemically synthesized
ttctaatcaaataagctgat

SEQ ID NO: 487595 - DNA, 20 bp, Artificial Sequence
  chemically synthesized
aaaaagttgtcatttttatc

SEQ ID NO: 487596 - DNA, 20 bp, Artificial Sequence
  chemically synthesized
taaaagttaaaaaaaattaa

SEQ ID NO: 487597 - DNA, 20 bp, Artificial Sequence
  chemically synthesized
atgggtactaggcttaatat

SEQ ID NO: 487598 - DNA, 20 bp, Artificial Sequence
  chemically synthesized
agaaccagaaaaaataacta

SEQ ID NO: 487599 - DNA, 20 bp, Artificial Sequence
  chemically synthesized
acacacaatggggcctatca

SEQ ID NO: 487600 - DNA, 20 bp, Artificial Sequence
  chemically synthesized
tccttataagtaagtaagtt

SEQ ID NO: 487601 - DNA, 20 bp, Artificial Sequence
  chemically synthesized
tcataacttacttacttata

SEQ ID NO: 487602 - DNA, 20 bp, Artificial Sequence
  chemically synthesized
gatagaaaaactgttaattg

SEQ ID NO: 487603 - DNA, 20 bp, Artificial Sequence
  chemically synthesized
aaatactaaaaaatgcattt

SEQ ID NO: 487604 - DNA, 20 bp, Artificial Sequence
  chemically synthesized
catagtatccacaaatgtct

SEQ ID NO: 487605 - DNA, 20 bp, Artificial Sequence
  chemically synthesized
aatgaaatcctaagacattt

SEQ ID NO: 487606 - DNA, 20 bp, Artificial Sequence
  chemically synthesized
cagccatattaagagaggaa

SEQ ID NO: 487607 - DNA, 20 bp, Artificial Sequence
  chemically synthesized
cttaatatggctgccctgca

SEQ ID NO: 487608 - DNA, 20 bp, Artificial Sequence
  chemically synthesized
gttcttatcttccatcatga

SEQ ID NO: 487609 - DNA, 20 bp, Artificial Sequence
  chemically synthesized
ataaaagctgctctttccgc

SEQ ID NO: 487610 - DNA, 20 bp, Artificial Sequence
  chemically synthesized
tgctctttccgctagggtcc

SEQ ID NO: 487611 - DNA, 20 bp, Artificial Sequence
  chemically synthesized
tttagagcagatccatattc

SEQ ID NO: 487612 - DNA, 20 bp, Artificial Sequence
  chemically synthesized
aggtcttttcattctagaat

SEQ ID NO: 487613 - DNA, 20 bp, Artificial Sequence
  chemically synthesized
aagttaaggtcttttcattc

SEQ ID NO: 487614 - DNA, 20 bp, Artificial Sequence
  chemically synthesized
ccttaacttgattcatagtg

SEQ ID NO: 487615 - DNA, 20 bp, Artificial Sequence
  chemically synthesized
ctgcagctttactccacact

SEQ ID NO: 487616 - DNA, 20 bp, Artificial Sequence
  chemically synthesized
tgcagctgatctgcagacac

SEQ ID NO: 487617 - DNA, 20 bp, Artificial Sequence
  chemically synthesized
gctgatctgcagacacatga

SEQ ID NO: 487618 - DNA, 20 bp, Artificial Sequence
  chemically synthesized
tgtttgttgttatatgtcac

SEQ ID NO: 487619 - DNA, 20 bp, Artificial Sequence
  chemically synthesized
tttagcaaacagtttctgta

SEQ ID NO: 487620 - DNA, 20 bp, Artificial Sequence
  chemically synthesized
gcaagaaacaaaatatgaaa

SEQ ID NO: 487621 - DNA, 20 bp, Artificial Sequence
  chemically synthesized
atccatcagccttcatttgt

SEQ ID NO: 487622 - DNA, 20 bp, Artificial Sequence
  chemically synthesized
actctgacaaatgaaggctg

SEQ ID NO: 487623 - DNA, 20 bp, Artificial Sequence
  chemically synthesized
aaaaacacaacattgttcag

SEQ ID NO: 487624 - DNA, 20 bp, Artificial Sequence
  chemically synthesized
tctttgtctttcctctcatg

SEQ ID NO: 487625 - DNA, 20 bp, Artificial Sequence
  chemically synthesized
acgtgccaacctgattgaca

SEQ ID NO: 487626 - DNA, 20 bp, Artificial Sequence
  chemically synthesized
aaaaaaaaacttagagattt

SEQ ID NO: 487627 - DNA, 20 bp, Artificial Sequence
  chemically synthesized
gaaatgttcaaggccagtga

SEQ ID NO: 487628 - DNA, 20 bp, Artificial Sequence
  chemically synthesized
gagagcttccatagaggctt

SEQ ID NO: 487629 - DNA, 20 bp, Artificial Sequence
  chemically synthesized
gaagctctccaccttaaagt

SEQ ID NO: 487630 - DNA, 20 bp, Artificial Sequence
  chemically synthesized
gggtttcaaagtctttttgg

SEQ ID NO: 487631 - DNA, 20 bp, Artificial Sequence
  chemically synthesized
ggtaatatttcatttgccaa

SEQ ID NO: 487632 - DNA, 20 bp, Artificial Sequence
  chemically synthesized
tgactcaagtgattttttgg

SEQ ID NO: 487633 - DNA, 20 bp, Artificial Sequence
  chemically synthesized
aaactcttccaaaaaatcac

SEQ ID NO: 487634 - DNA, 20 bp, Artificial Sequence
  chemically synthesized
aagtaatctgtcaatattta

SEQ ID NO: 487635 - DNA, 20 bp, Artificial Sequence
  chemically synthesized
gaggtactagatatgtaaca

SEQ ID NO: 487636 - DNA, 20 bp, Artificial Sequence
  chemically synthesized
ttactacacattatcaccat

SEQ ID NO: 487637 - DNA, 20 bp, Artificial Sequence
  chemically synthesized
agagaaattaaggtgctttg

SEQ ID NO: 487638 - DNA, 20 bp, Artificial Sequence
  chemically synthesized
aaagaacaaaatgtaaagca

SEQ ID NO: 487639 - DNA, 20 bp, Artificial Sequence
  chemically synthesized
caaaatgtaaagcactggat

SEQ ID NO: 487640 - DNA, 20 bp, Artificial Sequence
  chemically synthesized
gcaaagggaggtggcatgtg

SEQ ID NO: 487641 - DNA, 20 bp, Artificial Sequence
  chemically synthesized
tgcctgcagggaaagcctca

SEQ ID NO: 487642 - DNA, 20 bp, Artificial Sequence
  chemically synthesized
ttctttcctgagatagctac

SEQ ID NO: 487643 - DNA, 20 bp, Artificial Sequence
  chemically synthesized
aagtgcaaaggccctggggc

SEQ ID NO: 487644 - DNA, 20 bp, Artificial Sequence
  chemically synthesized
aattaaaaaaaaaaggacac

SEQ ID NO: 487645 - DNA, 20 bp, Artificial Sequence
  chemically synthesized
aaaaaaaaaaggacaccagg

SEQ ID NO: 487646 - DNA, 20 bp, Artificial Sequence
  chemically synthesized
aaaaaggacaccagggtgag

SEQ ID NO: 487647 - DNA, 20 bp, Artificial Sequence
  chemically synthesized
tggaatctagtgagcaaggg

SEQ ID NO: 487648 - DNA, 20 bp, Artificial Sequence
  chemically synthesized
gtgagcaaggggagagtagt

SEQ ID NO: 487649 - DNA, 20 bp, Artificial Sequence
  chemically synthesized
agtagtaggaatgatagtca

SEQ ID NO: 487650 - DNA, 20 bp, Artificial Sequence
  chemically synthesized
ggaatgatagtcatagagtt

SEQ ID NO: 487651 - DNA, 20 bp, Artificial Sequence
  chemically synthesized
tcatagagttggggatggag

SEQ ID NO: 487652 - DNA, 20 bp, Artificial Sequence
  chemically synthesized
gataggtcctgcatctttgg

SEQ ID NO: 487653 - DNA, 20 bp, Artificial Sequence
  chemically synthesized
gaaggatcttggctgttatc

SEQ ID NO: 487654 - DNA, 20 bp, Artificial Sequence
  chemically synthesized
ctatgcttcctaatctcact

SEQ ID NO: 487655 - DNA, 20 bp, Artificial Sequence
  chemically synthesized
agtgagattaggaagcatag

SEQ ID NO: 487656 - DNA, 20 bp, Artificial Sequence
  chemically synthesized
cataggagagttttcagcag

SEQ ID NO: 487657 - DNA, 20 bp, Artificial Sequence
  chemically synthesized
tctaatcttaatacagcagc

SEQ ID NO: 487658 - DNA, 20 bp, Artificial Sequence
  chemically synthesized
ctgtattaagattagacttt

SEQ ID NO: 487659 - DNA, 20 bp, Artificial Sequence
  chemically synthesized
agttaagaacagattcttaa

SEQ ID NO: 487660 - DNA, 20 bp, Artificial Sequence
  chemically synthesized
aatgcagattgtaccccctt

SEQ ID NO: 487661 - DNA, 20 bp, Artificial Sequence
  chemically synthesized
gggggtacaatctgcattgt

SEQ ID NO: 487662 - DNA, 20 bp, Artificial Sequence
  chemically synthesized
acctgggagtaccagtttaa

SEQ ID NO: 487663 - DNA, 20 bp, Artificial Sequence
  chemically synthesized
ttaggaaggcagcaagacct

SEQ ID NO: 487664 - DNA, 20 bp, Artificial Sequence
  chemically synthesized
ttcctaagtccttactggtg

SEQ ID NO: 487665 - DNA, 20 bp, Artificial Sequence
  chemically synthesized
ctggtgaagagtatgggctc

SEQ ID NO: 487666 - DNA, 20 bp, Artificial Sequence
  chemically synthesized
atctaggttccaatcctagc

SEQ ID NO: 487667 - DNA, 20 bp, Artificial Sequence
  chemically synthesized
tggaaatagtcaattcatgc

SEQ ID NO: 487668 - DNA, 20 bp, Artificial Sequence
  chemically synthesized
ggaataattatgcatacttg

SEQ ID NO: 487669 - DNA, 20 bp, Artificial Sequence
  chemically synthesized
tttgatatatgtttacattg

SEQ ID NO: 487670 - DNA, 20 bp, Artificial Sequence
  chemically synthesized
taaaataaaataaaaaatac

SEQ ID NO: 487671 - DNA, 20 bp, Artificial Sequence
  chemically synthesized
tctttctatgagtctatata

SEQ ID NO: 487672 - DNA, 20 bp, Artificial Sequence
  chemically synthesized
tccttatatagactcataga

SEQ ID NO: 487673 - DNA, 20 bp, Artificial Sequence
  chemically synthesized
taaattgtttaactctttct

SEQ ID NO: 487674 - DNA, 20 bp, Artificial Sequence
  chemically synthesized
agagttaaacaatttataat

SEQ ID NO: 487675 - DNA, 20 bp, Artificial Sequence
  chemically synthesized
tctcgctctgtcgcccaggc

SEQ ID NO: 487676 - DNA, 20 bp, Artificial Sequence
  chemically synthesized
ggttcttgtgcctcagcctc

SEQ ID NO: 487677 - DNA, 20 bp, Artificial Sequence
  chemically synthesized
ttttgtgtttttagtacaga

SEQ ID NO: 487678 - DNA, 20 bp, Artificial Sequence
  chemically synthesized
tgggtggatcacttgaggcc

SEQ ID NO: 487679 - DNA, 20 bp, Artificial Sequence
  chemically synthesized
actttgagaggccgaaatgg

SEQ ID NO: 487680 - DNA, 20 bp, Artificial Sequence
  chemically synthesized
cagcactttgagaggccgaa

SEQ ID NO: 487681 - DNA, 20 bp, Artificial Sequence
  chemically synthesized
atttcggcctctcaaagtgc

SEQ ID NO: 487682 - DNA, 20 bp, Artificial Sequence
  chemically synthesized
tcatgccacattggcagaat

SEQ ID NO: 487683 - DNA, 20 bp, Artificial Sequence
  chemically synthesized
ctactttcatgccacattgg

SEQ ID NO: 487684 - DNA, 20 bp, Artificial Sequence
  chemically synthesized
tccacctattttcagaaata

SEQ ID NO: 487685 - DNA, 20 bp, Artificial Sequence
  chemically synthesized
tagtttgctgactcttgctt

SEQ ID NO: 487686 - DNA, 20 bp, Artificial Sequence
  chemically synthesized
acactgtaatatcctaaagc

SEQ ID NO: 487687 - DNA, 20 bp, Artificial Sequence
  chemically synthesized
cagtctagaaataagaacat

SEQ ID NO: 487688 - DNA, 20 bp, Artificial Sequence
  chemically synthesized
ggttctaggcttattagccc

SEQ ID NO: 487689 - DNA, 20 bp, Artificial Sequence
  chemically synthesized
tgaaactaacagatattact

SEQ ID NO: 487690 - DNA, 20 bp, Artificial Sequence
  chemically synthesized
aacagatattactgtgagta

SEQ ID NO: 487691 - DNA, 20 bp, Artificial Sequence
  chemically synthesized
aattctcatacagatggaca

SEQ ID NO: 487692 - DNA, 20 bp, Artificial Sequence
  chemically synthesized
caccctttgtccatctgtat

SEQ ID NO: 487693 - DNA, 20 bp, Artificial Sequence
  chemically synthesized
ccctagaaaactgataaagt

SEQ ID NO: 487694 - DNA, 20 bp, Artificial Sequence
  chemically synthesized
aaaaggacatgcttagttac

SEQ ID NO: 487695 - DNA, 20 bp, Artificial Sequence
  chemically synthesized
tgttacaaggcattggcctc

SEQ ID NO: 487696 - DNA, 20 bp, Artificial Sequence
  chemically synthesized
gatgcataaggcttctaggc

SEQ ID NO: 487697 - DNA, 20 bp, Artificial Sequence
  chemically synthesized
gaaggaaacaaatcgagatg

SEQ ID NO: 487698 - DNA, 20 bp, Artificial Sequence
  chemically synthesized
gtgcacctgagatgtcatga

SEQ ID NO: 487699 - DNA, 20 bp, Artificial Sequence
  chemically synthesized
gagtggacaggtgctgcaaa

SEQ ID NO: 487700 - DNA, 20 bp, Artificial Sequence
  chemically synthesized
tgctgcaaagtgaatagctc

SEQ ID NO: 487701 - DNA, 20 bp, Artificial Sequence
  chemically synthesized
aatagctcttggatggctcc

SEQ ID NO: 487702 - DNA, 20 bp, Artificial Sequence
  chemically synthesized
gggtatctctctttagtagg

SEQ ID NO: 487703 - DNA, 20 bp, Artificial Sequence
  chemically synthesized
catcgggtatctctctttag

SEQ ID NO: 487704 - DNA, 20 bp, Artificial Sequence
  chemically synthesized
agcttagcaggaaggtagca

SEQ ID NO: 487705 - DNA, 20 bp, Artificial Sequence
  chemically synthesized
aaaggcacttagaaggatat

SEQ ID NO: 487706 - DNA, 20 bp, Artificial Sequence
  chemically synthesized
tcagtagcaaaggcacttag

SEQ ID NO: 487707 - DNA, 20 bp, Artificial Sequence
  chemically synthesized
ccttctaagtgcctttgcta

SEQ ID NO: 487708 - DNA, 20 bp, Artificial Sequence
  chemically synthesized
ctaacctgttgaaataaaat

SEQ ID NO: 487709 - DNA, 20 bp, Artificial Sequence
  chemically synthesized
gtttttaagataccattgat

SEQ ID NO: 487710 - DNA, 20 bp, Artificial Sequence
  chemically synthesized
tcaggcttttcatagtaggt

SEQ ID NO: 487711 - DNA, 20 bp, Artificial Sequence
  chemically synthesized
gatttatgttaagtgcatag

SEQ ID NO: 487712 - DNA, 20 bp, Artificial Sequence
  chemically synthesized
attttttcagattaaaaaac

SEQ ID NO: 487713 - DNA, 20 bp, Artificial Sequence
  chemically synthesized
agggcacaacctaacatatg

SEQ ID NO: 487714 - DNA, 20 bp, Artificial Sequence
  chemically synthesized
aggatttgcctcagaaagac

SEQ ID NO: 487715 - DNA, 20 bp, Artificial Sequence
  chemically synthesized
tagcatagtaattatgtatg

SEQ ID NO: 487716 - DNA, 20 bp, Artificial Sequence
  chemically synthesized
catacataattactatgcta

SEQ ID NO: 487717 - DNA, 20 bp, Artificial Sequence
  chemically synthesized
attactatgctacagggtct

SEQ ID NO: 487718 - DNA, 20 bp, Artificial Sequence
  chemically synthesized
taaaaagtaggttttatttg

SEQ ID NO: 487719 - DNA, 20 bp, Artificial Sequence
  chemically synthesized
ctttgttccgttctgagccg

SEQ ID NO: 487720 - DNA, 20 bp, Artificial Sequence
  chemically synthesized
cggaacaaagtagtttcgat

SEQ ID NO: 487721 - DNA, 20 bp, Artificial Sequence
  chemically synthesized
agtttcgattaggatgtaat

SEQ ID NO: 487722 - DNA, 20 bp, Artificial Sequence
  chemically synthesized
gatgtaatgtgagtttcaat

SEQ ID NO: 487723 - DNA, 20 bp, Artificial Sequence
  chemically synthesized
agccctattgccatttggga

SEQ ID NO: 487724 - DNA, 20 bp, Artificial Sequence
  chemically synthesized
gggagctaccctgtgtactg

SEQ ID NO: 487725 - DNA, 20 bp, Artificial Sequence
  chemically synthesized
gcaaaacaccctgcagtaca

SEQ ID NO: 487726 - DNA, 20 bp, Artificial Sequence
  chemically synthesized
cagcaattgccaaattcccc

SEQ ID NO: 487727 - DNA, 20 bp, Artificial Sequence
  chemically synthesized
tctaccacagatgattccag

SEQ ID NO: 487728 - DNA, 20 bp, Artificial Sequence
  chemically synthesized
ggtagagaagcattctatta

SEQ ID NO: 487729 - DNA, 20 bp, Artificial Sequence
  chemically synthesized
ttccttcatgtattcaataa

SEQ ID NO: 487730 - DNA, 20 bp, Artificial Sequence
  chemically synthesized
atacatgaaggaacaaatga

SEQ ID NO: 487731 - DNA, 20 bp, Artificial Sequence
  chemically synthesized
ggtctgtattttcagtgtac

SEQ ID NO: 487732 - DNA, 20 bp, Artificial Sequence
  chemically synthesized
atgaattaatatgacatgat

SEQ ID NO: 487733 - DNA, 20 bp, Artificial Sequence
  chemically synthesized
cgtgataaaagtgcatctga

SEQ ID NO: 487734 - DNA, 20 bp, Artificial Sequence
  chemically synthesized
ctatgtctcttaacattcat

SEQ ID NO: 487735 - DNA, 20 bp, Artificial Sequence
  chemically synthesized
ttcatcagaaccacactcaa

SEQ ID NO: 487736 - DNA, 20 bp, Artificial Sequence
  chemically synthesized
ttcatttgagtgtggttctg

SEQ ID NO: 487737 - DNA, 20 bp, Artificial Sequence
  chemically synthesized
ctgaaacatgccatgatggt

SEQ ID NO: 487738 - DNA, 20 bp, Artificial Sequence
  chemically synthesized
tggcatgtttcagtttctgg

SEQ ID NO: 487739 - DNA, 20 bp, Artificial Sequence
  chemically synthesized
atgtttcagtttctggctga

SEQ ID NO: 487740 - DNA, 20 bp, Artificial Sequence
  chemically synthesized
ctgaatgggtcctaatatct

SEQ ID NO: 487741 - DNA, 20 bp, Artificial Sequence
  chemically synthesized
ctctggattatataccccaa

SEQ ID NO: 487742 - DNA, 20 bp, Artificial Sequence
  chemically synthesized
actgtattccctaatccttt

SEQ ID NO: 487743 - DNA, 20 bp, Artificial Sequence
  chemically synthesized
tatataccccaaaaggatta

SEQ ID NO: 487744 - DNA, 20 bp, Artificial Sequence
  chemically synthesized
aaagtgattttgacatatct

SEQ ID NO: 487745 - DNA, 20 bp, Artificial Sequence
  chemically synthesized
gaaccatgtccaattactat

SEQ ID NO: 487746 - DNA, 20 bp, Artificial Sequence
  chemically synthesized
catggttctttaagtcttaa

SEQ ID NO: 487747 - DNA, 20 bp, Artificial Sequence
  chemically synthesized
tgtcagtcatgaagtcagaa

SEQ ID NO: 487748 - DNA, 20 bp, Artificial Sequence
  chemically synthesized
gtgcatgtcagtcatgaagt

SEQ ID NO: 487749 - DNA, 20 bp, Artificial Sequence
  chemically synthesized
tagttatggtagcacttaga

SEQ ID NO: 487750 - DNA, 20 bp, Artificial Sequence
  chemically synthesized
tcaattacccatttgattgc

SEQ ID NO: 487751 - DNA, 20 bp, Artificial Sequence
  chemically synthesized
taataaactcaagcaatcaa

SEQ ID NO: 487752 - DNA, 20 bp, Artificial Sequence
  chemically synthesized
tcaagcaatcaaatgggtaa

SEQ ID NO: 487753 - DNA, 20 bp, Artificial Sequence
  chemically synthesized
ctgtttttttttaaaaaaat

SEQ ID NO: 487754 - DNA, 20 bp, Artificial Sequence
  chemically synthesized
atatatctgcattctctctt

SEQ ID NO: 487755 - DNA, 20 bp, Artificial Sequence
  chemically synthesized
taggaagagtattcagaaga

SEQ ID NO: 487756 - DNA, 20 bp, Artificial Sequence
  chemically synthesized
gtttcctgtacatgtttagg

SEQ ID NO: 487757 - DNA, 20 bp, Artificial Sequence
  chemically synthesized
gtacaggaaacagcaaatat

SEQ ID NO: 487758 - DNA, 20 bp, Artificial Sequence
  chemically synthesized
actgacatattgagtaaacc

SEQ ID NO: 487759 - DNA, 20 bp, Artificial Sequence
  chemically synthesized
cacagatgaagactgacata

SEQ ID NO: 487760 - DNA, 20 bp, Artificial Sequence
  chemically synthesized
tagtggaacatatggaaatc

SEQ ID NO: 487761 - DNA, 20 bp, Artificial Sequence
  chemically synthesized
gaaaagtcaacgataagatt

SEQ ID NO: 487762 - DNA, 20 bp, Artificial Sequence
  chemically synthesized
caacgataagattttggata

SEQ ID NO: 487763 - DNA, 20 bp, Artificial Sequence
  chemically synthesized
ttctagattctagtagagtt

SEQ ID NO: 487764 - DNA, 20 bp, Artificial Sequence
  chemically synthesized
catataatccagaactctac

SEQ ID NO: 487765 - DNA, 20 bp, Artificial Sequence
  chemically synthesized
ctgtatattctagattctag

SEQ ID NO: 487766 - DNA, 20 bp, Artificial Sequence
  chemically synthesized
tccagaactctactagaatc

SEQ ID NO: 487767 - DNA, 20 bp, Artificial Sequence
  chemically synthesized
actttctcttaccgattaat

SEQ ID NO: 487768 - DNA, 20 bp, Artificial Sequence
  chemically synthesized
atatttaccccaattttccg

SEQ ID NO: 487769 - DNA, 20 bp, Artificial Sequence
  chemically synthesized
taaacaatccaacggaaaat

SEQ ID NO: 487770 - DNA, 20 bp, Artificial Sequence
  chemically synthesized
aaaattggggtaaatatatg

SEQ ID NO: 487771 - DNA, 20 bp, Artificial Sequence
  chemically synthesized
ttggacagatttttccttct

SEQ ID NO: 487772 - DNA, 20 bp, Artificial Sequence
  chemically synthesized
acttgaaaacttgttcaacc

SEQ ID NO: 487773 - DNA, 20 bp, Artificial Sequence
  chemically synthesized
caccagcagcaagaagtggc

SEQ ID NO: 487774 - DNA, 20 bp, Artificial Sequence
  chemically synthesized
tatatgataaaattaaaaat

SEQ ID NO: 487775 - DNA, 20 bp, Artificial Sequence
  chemically synthesized
aagtggaattgttacctcat

SEQ ID NO: 487776 - DNA, 20 bp, Artificial Sequence
  chemically synthesized
catatgagaacacctagaag

SEQ ID NO: 487777 - DNA, 20 bp, Artificial Sequence
  chemically synthesized
tctatctgaggagacctaca

SEQ ID NO: 487778 - DNA, 20 bp, Artificial Sequence
  chemically synthesized
atgtgcccgttagattaaca

SEQ ID NO: 487779 - DNA, 20 bp, Artificial Sequence
  chemically synthesized
gtttggtttctattaaaatc

SEQ ID NO: 487780 - DNA, 20 bp, Artificial Sequence
  chemically synthesized
acaaagatttttaatggctt

SEQ ID NO: 487781 - DNA, 20 bp, Artificial Sequence
  chemically synthesized
aatctttgttcgtattttta

SEQ ID NO: 487782 - DNA, 20 bp, Artificial Sequence
  chemically synthesized
gtatcttcaatgagtccatt

SEQ ID NO: 487783 - DNA, 20 bp, Artificial Sequence
  chemically synthesized
tattatctttagtatcttca

SEQ ID NO: 487784 - DNA, 20 bp, Artificial Sequence
  chemically synthesized
caaataacatctgttcagtt

SEQ ID NO: 487785 - DNA, 20 bp, Artificial Sequence
  chemically synthesized
cgtattgtaataaaggtcac

SEQ ID NO: 487786 - DNA, 20 bp, Artificial Sequence
  chemically synthesized
gaatgacaagtagagaaagt

SEQ ID NO: 487787 - DNA, 20 bp, Artificial Sequence
  chemically synthesized
atttgtttgaaggaactttt

SEQ ID NO: 487788 - DNA, 20 bp, Artificial Sequence
  chemically synthesized
tagtttcatgtttcagtaag

SEQ ID NO: 487789 - DNA, 20 bp, Artificial Sequence
  chemically synthesized
ttcagtaaggagaattttac

SEQ ID NO: 487790 - DNA, 20 bp, Artificial Sequence
  chemically synthesized
gaagcactcacaataatgta

SEQ ID NO: 487791 - DNA, 20 bp, Artificial Sequence
  chemically synthesized
cttggatcctatacattatt

SEQ ID NO: 487792 - DNA, 20 bp, Artificial Sequence
  chemically synthesized
ttaccaaaattattaatgtc

SEQ ID NO: 487793 - DNA, 20 bp, Artificial Sequence
  chemically synthesized
cgcctgtaatcccagcactt

SEQ ID NO: 487794 - DNA, 20 bp, Artificial Sequence
  chemically synthesized
gcctcagcatccgaaagtgc

SEQ ID NO: 487795 - DNA, 20 bp, Artificial Sequence
  chemically synthesized
actttcggatgctgaggctg

SEQ ID NO: 487796 - DNA, 20 bp, Artificial Sequence
  chemically synthesized
ctgacggatcacttgaggtc

SEQ ID NO: 487797 - DNA, 20 bp, Artificial Sequence
  chemically synthesized
ttttgtatttttagtagaga

SEQ ID NO: 487798 - DNA, 20 bp, Artificial Sequence
  chemically synthesized
actaaaaatacaaaaattag

SEQ ID NO: 487799 - DNA, 20 bp, Artificial Sequence
  chemically synthesized
gcctcagactgccaagtagc

SEQ ID NO: 487800 - DNA, 20 bp, Artificial Sequence
  chemically synthesized
tacttggcagtctgaggcag

SEQ ID NO: 487801 - DNA, 20 bp, Artificial Sequence
  chemically synthesized
gcctccgcctcctgggttca

SEQ ID NO: 487802 - DNA, 20 bp, Artificial Sequence
  chemically synthesized
ctcactgcagcctccgcctc

SEQ ID NO: 487803 - DNA, 20 bp, Artificial Sequence
  chemically synthesized
tcgcagcactgcactccagc

SEQ ID NO: 487804 - DNA, 20 bp, Artificial Sequence
  chemically synthesized
tcttgctccatcacccaggc

SEQ ID NO: 487805 - DNA, 20 bp, Artificial Sequence
  chemically synthesized
ttttttttttttttccgagg

SEQ ID NO: 487806 - DNA, 20 bp, Artificial Sequence
  chemically synthesized
aaaaaaaaaaaaaaaaaaaa

SEQ ID NO: 487807 - DNA, 20 bp, Artificial Sequence
  chemically synthesized
atagcctaatttaaataatt

SEQ ID NO: 487808 - DNA, 20 bp, Artificial Sequence
  chemically synthesized
ttggtgacccccttgacaca

SEQ ID NO: 487809 - DNA, 20 bp, Artificial Sequence
  chemically synthesized
ccaaatattcattgtgtcaa

SEQ ID NO: 487810 - DNA, 20 bp, Artificial Sequence
  chemically synthesized
aagggggtcaccaaagtgtt

SEQ ID NO: 487811 - DNA, 20 bp, Artificial Sequence
  chemically synthesized
aaatgatacatataaaaaag

SEQ ID NO: 487812 - DNA, 20 bp, Artificial Sequence
  chemically synthesized
ttttgaaattacagaacaaa

SEQ ID NO: 487813 - DNA, 20 bp, Artificial Sequence
  chemically synthesized
tatatgtatctgtgcatata

SEQ ID NO: 487814 - DNA, 20 bp, Artificial Sequence
  chemically synthesized
tatgatatatgaaatatata

SEQ ID NO: 487815 - DNA, 20 bp, Artificial Sequence
  chemically synthesized
gaatttaaattttctatatc

SEQ ID NO: 487816 - DNA, 20 bp, Artificial Sequence
  chemically synthesized
tgcattcacatactgaatga

SEQ ID NO: 487817 - DNA, 20 bp, Artificial Sequence
  chemically synthesized
ctgattcattcattcagtat

SEQ ID NO: 487818 - DNA, 20 bp, Artificial Sequence
  chemically synthesized
ctcatgcattcacatactga

SEQ ID NO: 487819 - DNA, 20 bp, Artificial Sequence
  chemically synthesized
tagactcatgcattcacata

SEQ ID NO: 487820 - DNA, 20 bp, Artificial Sequence
  chemically synthesized
ttcattcagtatgtgaatgc

SEQ ID NO: 487821 - DNA, 20 bp, Artificial Sequence
  chemically synthesized
cctttgagcaatagtgtcag

SEQ ID NO: 487822 - DNA, 20 bp, Artificial Sequence
  chemically synthesized
actgacactattgctcaaag

SEQ ID NO: 487823 - DNA, 20 bp, Artificial Sequence
  chemically synthesized
ttgctcaaaggagggtcagg

SEQ ID NO: 487824 - DNA, 20 bp, Artificial Sequence
  chemically synthesized
agaataggggggaaaatgat

SEQ ID NO: 487825 - DNA, 20 bp, Artificial Sequence
  chemically synthesized
tatggcaattttgaagtatt

SEQ ID NO: 487826 - DNA, 20 bp, Artificial Sequence
  chemically synthesized
gaatacaaagttattataag

SEQ ID NO: 487827 - DNA, 20 bp, Artificial Sequence
  chemically synthesized
aactttgcctagtagatgat

SEQ ID NO: 487828 - DNA, 20 bp, Artificial Sequence
  chemically synthesized
ataggggtacttatataaaa

SEQ ID NO: 487829 - DNA, 20 bp, Artificial Sequence
  chemically synthesized
atagaattgtatttgttaat

SEQ ID NO: 487830 - DNA, 20 bp, Artificial Sequence
  chemically synthesized
tattaagttctgtatcactg

SEQ ID NO: 487831 - DNA, 20 bp, Artificial Sequence
  chemically synthesized
ctaagtgaaatctcagtata

SEQ ID NO: 487832 - DNA, 20 bp, Artificial Sequence
  chemically synthesized
tgccatagcaatatgtcctc

SEQ ID NO: 487833 - DNA, 20 bp, Artificial Sequence
  chemically synthesized
aatcatccaaactttatgcg

SEQ ID NO: 487834 - DNA, 20 bp, Artificial Sequence
  chemically synthesized
gtaaattcaacgcataaagt

SEQ ID NO: 487835 - DNA, 20 bp, Artificial Sequence
  chemically synthesized
atgattacatcttcattgga

SEQ ID NO: 487836 - DNA, 20 bp, Artificial Sequence
  chemically synthesized
tgataacatctaagtttatt

SEQ ID NO: 487837 - DNA, 20 bp, Artificial Sequence
  chemically synthesized
catctaagtttattctgaat

SEQ ID NO: 487838 - DNA, 20 bp, Artificial Sequence
  chemically synthesized
atacttcatatatcctaatt

SEQ ID NO: 487839 - DNA, 20 bp, Artificial Sequence
  chemically synthesized
aagtattacttaaaaccctt

SEQ ID NO: 487840 - DNA, 20 bp, Artificial Sequence
  chemically synthesized
caaaactatgtaacattctg

SEQ ID NO: 487841 - DNA, 20 bp, Artificial Sequence
  chemically synthesized
atttttctcaactctcaaat

SEQ ID NO: 487842 - DNA, 20 bp, Artificial Sequence
  chemically synthesized
ttaaacttccactcatattt

SEQ ID NO: 487843 - DNA, 20 bp, Artificial Sequence
  chemically synthesized
gagtggaagtttaaattggt

SEQ ID NO: 487844 - DNA, 20 bp, Artificial Sequence
  chemically synthesized
agttcttgagatggaaactg

SEQ ID NO: 487845 - DNA, 20 bp, Artificial Sequence
  chemically synthesized
aacactaaaaagaacacttt

SEQ ID NO: 487846 - DNA, 20 bp, Artificial Sequence
  chemically synthesized
tttcctcacagcacctgata

SEQ ID NO: 487847 - DNA, 20 bp, Artificial Sequence
  chemically synthesized
cattgtcatttagtggagga

SEQ ID NO: 487848 - DNA, 20 bp, Artificial Sequence
  chemically synthesized
ggaaggcatccttatacata

SEQ ID NO: 487849 - DNA, 20 bp, Artificial Sequence
  chemically synthesized
cgtgattatccattatgtat

SEQ ID NO: 487850 - DNA, 20 bp, Artificial Sequence
  chemically synthesized
aggtatcataattacaaatt

SEQ ID NO: 487851 - DNA, 20 bp, Artificial Sequence
  chemically synthesized
agttactgctgaagaacact

SEQ ID NO: 487852 - DNA, 20 bp, Artificial Sequence
  chemically synthesized
cagcagtaactcagagattt

SEQ ID NO: 487853 - DNA, 20 bp, Artificial Sequence
  chemically synthesized
ctaaagggattcttaaatct

SEQ ID NO: 487854 - DNA, 20 bp, Artificial Sequence
  chemically synthesized
ctgactatatcagttactaa

SEQ ID NO: 487855 - DNA, 20 bp, Artificial Sequence
  chemically synthesized
gctcagagccacaaggtcag

SEQ ID NO: 487856 - DNA, 20 bp, Artificial Sequence
  chemically synthesized
aggcactgttccagagagca

SEQ ID NO: 487857 - DNA, 20 bp, Artificial Sequence
  chemically synthesized
gctcctctccaaaatggcag

SEQ ID NO: 487858 - DNA, 20 bp, Artificial Sequence
  chemically synthesized
tttttatgggttgggacctc

SEQ ID NO: 487859 - DNA, 20 bp, Artificial Sequence
  chemically synthesized
gatttcaccagtctcttttt

SEQ ID NO: 487860 - DNA, 20 bp, Artificial Sequence
  chemically synthesized
gactggtgaaatcactattt

SEQ ID NO: 487861 - DNA, 20 bp, Artificial Sequence
  chemically synthesized
tctcactgcccagtatggga

SEQ ID NO: 487862 - DNA, 20 bp, Artificial Sequence
  chemically synthesized
aatgaagaagttttcattct

SEQ ID NO: 487863 - DNA, 20 bp, Artificial Sequence
  chemically synthesized
gggagtcaaatattgattct

SEQ ID NO: 487864 - DNA, 20 bp, Artificial Sequence
  chemically synthesized
gaagttaaatgggtatgtcc

SEQ ID NO: 487865 - DNA, 20 bp, Artificial Sequence
  chemically synthesized
aaatatgcaggagaagttaa

SEQ ID NO: 487866 - DNA, 20 bp, Artificial Sequence
  chemically synthesized
gcatgaaaatgtatctactt

SEQ ID NO: 487867 - DNA, 20 bp, Artificial Sequence
  chemically synthesized
ttaagaagcatggctctaga

SEQ ID NO: 487868 - DNA, 20 bp, Artificial Sequence
  chemically synthesized
tggctctagataggatatag

SEQ ID NO: 487869 - DNA, 20 bp, Artificial Sequence
  chemically synthesized
agataggatatagtagaata

SEQ ID NO: 487870 - DNA, 20 bp, Artificial Sequence
  chemically synthesized
aggatatagtagaataagga

SEQ ID NO: 487871 - DNA, 20 bp, Artificial Sequence
  chemically synthesized
ttatatccataagtatgtaa

SEQ ID NO: 487872 - DNA, 20 bp, Artificial Sequence
  chemically synthesized
tttaattcatttacatactt

SEQ ID NO: 487873 - DNA, 20 bp, Artificial Sequence
  chemically synthesized
tctttaaatgatacgacttt

SEQ ID NO: 487874 - DNA, 20 bp, Artificial Sequence
  chemically synthesized
ctttgtgaataaacagcttc

SEQ ID NO: 487875 - DNA, 20 bp, Artificial Sequence
  chemically synthesized
ttttaaaaagttatgattag

SEQ ID NO: 487876 - DNA, 20 bp, Artificial Sequence
  chemically synthesized
attgcaagtgcagagcatgt

SEQ ID NO: 487877 - DNA, 20 bp, Artificial Sequence
  chemically synthesized
gttggtagaaaataacacgt

SEQ ID NO: 487878 - DNA, 20 bp, Artificial Sequence
  chemically synthesized
tttactaactataatgccca

SEQ ID NO: 487879 - DNA, 20 bp, Artificial Sequence
  chemically synthesized
aacaatttctgcttaagtgg

SEQ ID NO: 487880 - DNA, 20 bp, Artificial Sequence
  chemically synthesized
ttcaaacaatttctgcttaa

SEQ ID NO: 487881 - DNA, 20 bp, Artificial Sequence
  chemically synthesized
tcccatttttctcctccaca

SEQ ID NO: 487882 - DNA, 20 bp, Artificial Sequence
  chemically synthesized
aagaaaactctgctctgccc

SEQ ID NO: 487883 - DNA, 20 bp, Artificial Sequence
  chemically synthesized
gatgacacccatgggcagag

SEQ ID NO: 487884 - DNA, 20 bp, Artificial Sequence
  chemically synthesized
gggcagagcagagttttctt

SEQ ID NO: 487885 - DNA, 20 bp, Artificial Sequence
  chemically synthesized
ttatctaaatttccttctaa

SEQ ID NO: 487886 - DNA, 20 bp, Artificial Sequence
  chemically synthesized
ataatgcttttactgcatat

SEQ ID NO: 487887 - DNA, 20 bp, Artificial Sequence
  chemically synthesized
caagaaagtataaacatatt

SEQ ID NO: 487888 - DNA, 20 bp, Artificial Sequence
  chemically synthesized
aaggtttatttcaaaagcaa

SEQ ID NO: 487889 - DNA, 20 bp, Artificial Sequence
  chemically synthesized
agcaagagaatgatctagga

SEQ ID NO: 487890 - DNA, 20 bp, Artificial Sequence
  chemically synthesized
gagaaaatggtataatattg

SEQ ID NO: 487891 - DNA, 20 bp, Artificial Sequence
  chemically synthesized
ttggaaccttttaatttcta

SEQ ID NO: 487892 - DNA, 20 bp, Artificial Sequence
  chemically synthesized
tttgtttcttgtatgtcaag

SEQ ID NO: 487893 - DNA, 20 bp, Artificial Sequence
  chemically synthesized
ggaatggtattctaactgca

SEQ ID NO: 487894 - DNA, 20 bp, Artificial Sequence
  chemically synthesized
tttgttttattctttgcagt

SEQ ID NO: 487895 - DNA, 20 bp, Artificial Sequence
  chemically synthesized
agagggaactggtgtccaag

SEQ ID NO: 487896 - DNA, 20 bp, Artificial Sequence
  chemically synthesized
ttagaaagcccccagctgct

SEQ ID NO: 487897 - DNA, 20 bp, Artificial Sequence
  chemically synthesized
atgtaatttatctgcatcaa

SEQ ID NO: 487898 - DNA, 20 bp, Artificial Sequence
  chemically synthesized
actgcactttcccagtcttc

SEQ ID NO: 487899 - DNA, 20 bp, Artificial Sequence
  chemically synthesized
tcacaaggaaaaataagtgt

SEQ ID NO: 487900 - DNA, 20 bp, Artificial Sequence
  chemically synthesized
ctttaggtaatgtattttga

SEQ ID NO: 487901 - DNA, 20 bp, Artificial Sequence
  chemically synthesized
gtaatgtattttgaaagaat

SEQ ID NO: 487902 - DNA, 20 bp, Artificial Sequence
  chemically synthesized
caatacattgatggctagaa

SEQ ID NO: 487903 - DNA, 20 bp, Artificial Sequence
  chemically synthesized
catcatgttgaacttctgtc

SEQ ID NO: 487904 - DNA, 20 bp, Artificial Sequence
  chemically synthesized
aactaacctttgaattgcat

SEQ ID NO: 487905 - DNA, 20 bp, Artificial Sequence
  chemically synthesized
gaaaacatcaaaactaacct

SEQ ID NO: 487906 - DNA, 20 bp, Artificial Sequence
  chemically synthesized
tcaggttataaccttaagac

SEQ ID NO: 487907 - DNA, 20 bp, Artificial Sequence
  chemically synthesized
tttctatgataaaggtttta

SEQ ID NO: 487908 - DNA, 20 bp, Artificial Sequence
  chemically synthesized
ttttttgccaatgttctctt

SEQ ID NO: 487909 - DNA, 20 bp, Artificial Sequence
  chemically synthesized
ttgaattttttcatgtgttg

SEQ ID NO: 487910 - DNA, 20 bp, Artificial Sequence
  chemically synthesized
tattcattttgtgagtgaat

SEQ ID NO: 487911 - DNA, 20 bp, Artificial Sequence
  chemically synthesized
aattcaaattcactcacaaa

SEQ ID NO: 487912 - DNA, 20 bp, Artificial Sequence
  chemically synthesized
attctttattcattttgtga

SEQ ID NO: 487913 - DNA, 20 bp, Artificial Sequence
  chemically synthesized
ttgaattctttattcatttt

SEQ ID NO: 487914 - DNA, 20 bp, Artificial Sequence
  chemically synthesized
attcactcacaaaatgaata

SEQ ID NO: 487915 - DNA, 20 bp, Artificial Sequence
  chemically synthesized
gtgatatctgtcattttaat

SEQ ID NO: 487916 - DNA, 20 bp, Artificial Sequence
  chemically synthesized
tcaaaaaggttgataacaca

SEQ ID NO: 487917 - DNA, 20 bp, Artificial Sequence
  chemically synthesized
tgataacacactgagtgggc

SEQ ID NO: 487918 - DNA, 20 bp, Artificial Sequence
  chemically synthesized
gacgcagccattcgacggct

SEQ ID NO: 487919 - DNA, 20 bp, Artificial Sequence
  chemically synthesized
atgtgataaattcctagccg

SEQ ID NO: 487920 - DNA, 20 bp, Artificial Sequence
  chemically synthesized
caaactaaaggctcactaat

SEQ ID NO: 487921 - DNA, 20 bp, Artificial Sequence
  chemically synthesized
ctaattggagtgctgcttaa

SEQ ID NO: 487922 - DNA, 20 bp, Artificial Sequence
  chemically synthesized
attatggtatatccttagaa

SEQ ID NO: 487923 - DNA, 20 bp, Artificial Sequence
  chemically synthesized
gttgcatactattctgttct

SEQ ID NO: 487924 - DNA, 20 bp, Artificial Sequence
  chemically synthesized
ccctcccttataagaaaggg

SEQ ID NO: 487925 - DNA, 20 bp, Artificial Sequence
  chemically synthesized
ctttcttataagggagggag

SEQ ID NO: 487926 - DNA, 20 bp, Artificial Sequence
  chemically synthesized
ctttcttatgaaggaggaag

SEQ ID NO: 487927 - DNA, 20 bp, Artificial Sequence
  chemically synthesized
ttcaaaagaaccatcttttg

SEQ ID NO: 487928 - DNA, 20 bp, Artificial Sequence
  chemically synthesized
cttaaaataaagccagctgt

SEQ ID NO: 487929 - DNA, 20 bp, Artificial Sequence
  chemically synthesized
tggctttattttaagaggac

SEQ ID NO: 487930 - DNA, 20 bp, Artificial Sequence
  chemically synthesized
cctgggtagccttccaagaa

SEQ ID NO: 487931 - DNA, 20 bp, Artificial Sequence
  chemically synthesized
agtttcctgggtagccttcc

SEQ ID NO: 487932 - DNA, 20 bp, Artificial Sequence
  chemically synthesized
ctgccaaggttttcagtttc

SEQ ID NO: 487933 - DNA, 20 bp, Artificial Sequence
  chemically synthesized
tgaaagacaacaatgcaaca

SEQ ID NO: 487934 - DNA, 20 bp, Artificial Sequence
  chemically synthesized
aacagaggatttcaatgctt

SEQ ID NO: 487935 - DNA, 20 bp, Artificial Sequence
  chemically synthesized
ataataattttgtttattta

SEQ ID NO: 487936 - DNA, 20 bp, Artificial Sequence
  chemically synthesized
attattattattattaaaga

SEQ ID NO: 487937 - DNA, 20 bp, Artificial Sequence
  chemically synthesized
tcttgctctgtcacccaggc

SEQ ID NO: 487938 - DNA, 20 bp, Artificial Sequence
  chemically synthesized
ttgcaccactgcactctagc

SEQ ID NO: 487939 - DNA, 20 bp, Artificial Sequence
  chemically synthesized
aacctccgcctccaggttca

SEQ ID NO: 487940 - DNA, 20 bp, Artificial Sequence
  chemically synthesized
tactcgggaggctgaggcag

SEQ ID NO: 487941 - DNA, 20 bp, Artificial Sequence
  chemically synthesized
gattctcctgcctcagcctc

SEQ ID NO: 487942 - DNA, 20 bp, Artificial Sequence
  chemically synthesized
gcctcagcctcccgagtagc

SEQ ID NO: 487943 - DNA, 20 bp, Artificial Sequence
  chemically synthesized
aaaattagctgggcatggtg

SEQ ID NO: 487944 - DNA, 20 bp, Artificial Sequence
  chemically synthesized
ttttgtatttttagtggaga

SEQ ID NO: 487945 - DNA, 20 bp, Artificial Sequence
  chemically synthesized
ggcaggtggatcacgaggtc

SEQ ID NO: 487946 - DNA, 20 bp, Artificial Sequence
  chemically synthesized
actttgggaggctgaggcag

SEQ ID NO: 487947 - DNA, 20 bp, Artificial Sequence
  chemically synthesized
cctcagcctcccaaagtgct

SEQ ID NO: 487948 - DNA, 20 bp, Artificial Sequence
  chemically synthesized
atctttaaagtctgttatac

SEQ ID NO: 487949 - DNA, 20 bp, Artificial Sequence
  chemically synthesized
gggttaattattacaaagtt

SEQ ID NO: 487950 - DNA, 20 bp, Artificial Sequence
  chemically synthesized
actgtatcagtgatgtcata

SEQ ID NO: 487951 - DNA, 20 bp, Artificial Sequence
  chemically synthesized
tctgcacagttttatagaaa

SEQ ID NO: 487952 - DNA, 20 bp, Artificial Sequence
  chemically synthesized
tattgtacttcatttttgtt

SEQ ID NO: 487953 - DNA, 20 bp, Artificial Sequence
  chemically synthesized
taagatagcatagggtacca

SEQ ID NO: 487954 - DNA, 20 bp, Artificial Sequence
  chemically synthesized
taaaatagaataagatagca

SEQ ID NO: 487955 - DNA, 20 bp, Artificial Sequence
  chemically synthesized
atttaatgggtaaaataaaa

SEQ ID NO: 487956 - DNA, 20 bp, Artificial Sequence
  chemically synthesized
tattttattttacccattaa

SEQ ID NO: 487957 - DNA, 20 bp, Artificial Sequence
  chemically synthesized
tgagttatgaaatccattta

SEQ ID NO: 487958 - DNA, 20 bp, Artificial Sequence
  chemically synthesized
atggatttcataactcatca

SEQ ID NO: 487959 - DNA, 20 bp, Artificial Sequence
  chemically synthesized
gagaatcttacaacccactg

SEQ ID NO: 487960 - DNA, 20 bp, Artificial Sequence
  chemically synthesized
ttaagctttcaggcccggga

SEQ ID NO: 487961 - DNA, 20 bp, Artificial Sequence
  chemically synthesized
gggcctgaaagcttaaggag

SEQ ID NO: 487962 - DNA, 20 bp, Artificial Sequence
  chemically synthesized
aggaatgggcctgagaaagg

SEQ ID NO: 487963 - DNA, 20 bp, Artificial Sequence
  chemically synthesized
ggcaagtagccttgtgcctt

SEQ ID NO: 487964 - DNA, 20 bp, Artificial Sequence
  chemically synthesized
aagatcgagaaagaggccat

SEQ ID NO: 487965 - DNA, 20 bp, Artificial Sequence
  chemically synthesized
acgtaactgctgcattgtac

SEQ ID NO: 487966 - DNA, 20 bp, Artificial Sequence
  chemically synthesized
catgctgttttaatgagcgc

SEQ ID NO: 487967 - DNA, 20 bp, Artificial Sequence
  chemically synthesized
attaaaacagcatgttgcgg

SEQ ID NO: 487968 - DNA, 20 bp, Artificial Sequence
  chemically synthesized
gcctcggcctcccagagtgc

SEQ ID NO: 487969 - DNA, 20 bp, Artificial Sequence
  chemically synthesized
atctgcccgcctcggcctcc

SEQ ID NO: 487970 - DNA, 20 bp, Artificial Sequence
  chemically synthesized
cggggtttcaccatgttagc

SEQ ID NO: 487971 - DNA, 20 bp, Artificial Sequence
  chemically synthesized
ttgtgtatttttagtagagg

SEQ ID NO: 487972 - DNA, 20 bp, Artificial Sequence
  chemically synthesized
ctgtagtcccagctgctcgg

SEQ ID NO: 487973 - DNA, 20 bp, Artificial Sequence
  chemically synthesized
tgctcgggaggatgacgcag

SEQ ID NO: 487974 - DNA, 20 bp, Artificial Sequence
  chemically synthesized
ctcactgcaagctccgcctc

SEQ ID NO: 487975 - DNA, 20 bp, Artificial Sequence
  chemically synthesized
tcttgctcagtcgcccaggc

SEQ ID NO: 487976 - DNA, 20 bp, Artificial Sequence
  chemically synthesized
ttttgtttgtttgtttgaga

SEQ ID NO: 487977 - DNA, 20 bp, Artificial Sequence
  chemically synthesized
caaacaaaaaaaagatttga

SEQ ID NO: 487978 - DNA, 20 bp, Artificial Sequence
  chemically synthesized
caaaaagtgggcaagaaaat

SEQ ID NO: 487979 - DNA, 20 bp, Artificial Sequence
  chemically synthesized
tcttgactacaatgcaccag

SEQ ID NO: 487980 - DNA, 20 bp, Artificial Sequence
  chemically synthesized
ggatttcagtcgctaatatt

SEQ ID NO: 487981 - DNA, 20 bp, Artificial Sequence
  chemically synthesized
tgatggtaccttgagtaaag

SEQ ID NO: 487982 - DNA, 20 bp, Artificial Sequence
  chemically synthesized
gatgggtatttgatggtacc

SEQ ID NO: 487983 - DNA, 20 bp, Artificial Sequence
  chemically synthesized
atgaatctattatgagatgg

SEQ ID NO: 487984 - DNA, 20 bp, Artificial Sequence
  chemically synthesized
gaaaatgaatctattatgag

SEQ ID NO: 487985 - DNA, 20 bp, Artificial Sequence
  chemically synthesized
tcagtggatagttattgaaa

SEQ ID NO: 487986 - DNA, 20 bp, Artificial Sequence
  chemically synthesized
tcattttcaataactatcca

SEQ ID NO: 487987 - DNA, 20 bp, Artificial Sequence
  chemically synthesized
ataattattaaacatactca

SEQ ID NO: 487988 - DNA, 20 bp, Artificial Sequence
  chemically synthesized
tttaaatactactcaatcta

SEQ ID NO: 487989 - DNA, 20 bp, Artificial Sequence
  chemically synthesized
tatttttaaaattctctaga

SEQ ID NO: 487990 - DNA, 20 bp, Artificial Sequence
  chemically synthesized
caggaaattgtttttaaaaa

SEQ ID NO: 487991 - DNA, 20 bp, Artificial Sequence
  chemically synthesized
cacataaatataattttata

SEQ ID NO: 487992 - DNA, 20 bp, Artificial Sequence
  chemically synthesized
aattttataaagaattatga

SEQ ID NO: 487993 - DNA, 20 bp, Artificial Sequence
  chemically synthesized
gtatcacatatttatcacat

SEQ ID NO: 487994 - DNA, 20 bp, Artificial Sequence
  chemically synthesized
catatttttcaacttcccca

SEQ ID NO: 487995 - DNA, 20 bp, Artificial Sequence
  chemically synthesized
aaaatatgatttaaataaaa

SEQ ID NO: 487996 - DNA, 20 bp, Artificial Sequence
  chemically synthesized
acattatattgcaatggtat

SEQ ID NO: 487997 - DNA, 20 bp, Artificial Sequence
  chemically synthesized
gcaatggtatttggattcca

SEQ ID NO: 487998 - DNA, 20 bp, Artificial Sequence
  chemically synthesized
acagtttagaatgtatcccg

SEQ ID NO: 487999 - DNA, 20 bp, Artificial Sequence
  chemically synthesized
aaagggtttatagtacagtt

SEQ ID NO: 488000 - DNA, 20 bp, Artificial Sequence
  chemically synthesized
agtaaatattgacattttaa

SEQ ID NO: 488001 - DNA, 20 bp, Artificial Sequence
  chemically synthesized
tgacatctattttctgccct

SEQ ID NO: 488002 - DNA, 20 bp, Artificial Sequence
  chemically synthesized
aataaaaatattttagaaaa

SEQ ID NO: 488003 - DNA, 20 bp, Artificial Sequence
  chemically synthesized
ttttttataaatacaatggt

SEQ ID NO: 488004 - DNA, 20 bp, Artificial Sequence
  chemically synthesized
tttcttatgagggaggggag

SEQ ID NO: 488005 - DNA, 20 bp, Artificial Sequence
  chemically synthesized
caacaaattgttagtcctat

SEQ ID NO: 488006 - DNA, 20 bp, Artificial Sequence
  chemically synthesized
ctatttgaatgatctgttcc

SEQ ID NO: 488007 - DNA, 20 bp, Artificial Sequence
  chemically synthesized
ttgagaacagtttcttgaat

SEQ ID NO: 488008 - DNA, 20 bp, Artificial Sequence
  chemically synthesized
ataaacttgagaacagtttc

SEQ ID NO: 488009 - DNA, 20 bp, Artificial Sequence
  chemically synthesized
taacttgcccatataaggaa

SEQ ID NO: 488010 - DNA, 20 bp, Artificial Sequence
  chemically synthesized
tgaccatctactcccttttt

SEQ ID NO: 488011 - DNA, 20 bp, Artificial Sequence
  chemically synthesized
cagaaaaacactccaaaaaa

SEQ ID NO: 488012 - DNA, 20 bp, Artificial Sequence
  chemically synthesized
tggtaccaacttgctgctgt

SEQ ID NO: 488013 - DNA, 20 bp, Artificial Sequence
  chemically synthesized
tcttgctctattccccatgc

SEQ ID NO: 488014 - DNA, 20 bp, Artificial Sequence
  chemically synthesized
caccactgcactccggcatg

SEQ ID NO: 488015 - DNA, 20 bp, Artificial Sequence
  chemically synthesized
ctcactgcaacctccgcctc

SEQ ID NO: 488016 - DNA, 20 bp, Artificial Sequence
  chemically synthesized
tacctgggaggctgaggcat

SEQ ID NO: 488017 - DNA, 20 bp, Artificial Sequence
  chemically synthesized
ttttctatttttagtagaga

SEQ ID NO: 488018 - DNA, 20 bp, Artificial Sequence
  chemically synthesized
caggtggattgcctgagctt

SEQ ID NO: 488019 - DNA, 20 bp, Artificial Sequence
  chemically synthesized
actttgggaggccaaagcag

SEQ ID NO: 488020 - DNA, 20 bp, Artificial Sequence
  chemically synthesized
gctttggcctcccaaagtcc

SEQ ID NO: 488021 - DNA, 20 bp, Artificial Sequence
  chemically synthesized
gggacctttcttgttgtatc

SEQ ID NO: 488022 - DNA, 20 bp, Artificial Sequence
  chemically synthesized
ctaaggcgtagaaaaagaca

SEQ ID NO: 488023 - DNA, 20 bp, Artificial Sequence
  chemically synthesized
cttagttttgccttatctaa

SEQ ID NO: 488024 - DNA, 20 bp, Artificial Sequence
  chemically synthesized
cactaaaaatgaaaaattga

SEQ ID NO: 488025 - DNA, 20 bp, Artificial Sequence
  chemically synthesized
tcttcactaaaaatgaaaaa

SEQ ID NO: 488026 - DNA, 20 bp, Artificial Sequence
  chemically synthesized
aagaagaaggtcaggttaaa

SEQ ID NO: 488027 - DNA, 20 bp, Artificial Sequence
  chemically synthesized
ggtcaggttaaaaagggtaa

SEQ ID NO: 488028 - DNA, 20 bp, Artificial Sequence
  chemically synthesized
aagccagtaagtgtcagcac

SEQ ID NO: 488029 - DNA, 20 bp, Artificial Sequence
  chemically synthesized
aaagaaacaaaagactaagt

SEQ ID NO: 488030 - DNA, 20 bp, Artificial Sequence
  chemically synthesized
aaaccattgctgagttgaag

SEQ ID NO: 488031 - DNA, 20 bp, Artificial Sequence
  chemically synthesized
ctcaactccaaaaaccattg

SEQ ID NO: 488032 - DNA, 20 bp, Artificial Sequence
  chemically synthesized
ttcaactcagcaatggtttt

SEQ ID NO: 488033 - DNA, 20 bp, Artificial Sequence
  chemically synthesized
ctcagcaatggtttttggag

SEQ ID NO: 488034 - DNA, 20 bp, Artificial Sequence
  chemically synthesized
tctgcttctctttatgaaca

SEQ ID NO: 488035 - DNA, 20 bp, Artificial Sequence
  chemically synthesized
tggatagtttcatctattag

SEQ ID NO: 488036 - DNA, 20 bp, Artificial Sequence
  chemically synthesized
aagcgtgtttgtttaagttt

SEQ ID NO: 488037 - DNA, 20 bp, Artificial Sequence
  chemically synthesized
gcttcaaggtgttatcaagc

SEQ ID NO: 488038 - DNA, 20 bp, Artificial Sequence
  chemically synthesized
agtttaggttgcctctgggc

SEQ ID NO: 488039 - DNA, 20 bp, Artificial Sequence
  chemically synthesized
atttattgaatgtttttctc

SEQ ID NO: 488040 - DNA, 20 bp, Artificial Sequence
  chemically synthesized
tgcaactgaacacagattta

SEQ ID NO: 488041 - DNA, 20 bp, Artificial Sequence
  chemically synthesized
tgttcagttgcatggtaaaa

SEQ ID NO: 488042 - DNA, 20 bp, Artificial Sequence
  chemically synthesized
ggaatgtgtcctgaaaaaca

SEQ ID NO: 488043 - DNA, 20 bp, Artificial Sequence
  chemically synthesized
attggatatgaaaatatcag

SEQ ID NO: 488044 - DNA, 20 bp, Artificial Sequence
  chemically synthesized
aaaagtttcagtgttttata

SEQ ID NO: 488045 - DNA, 20 bp, Artificial Sequence
  chemically synthesized
gctagtacacatctatctaa

SEQ ID NO: 488046 - DNA, 20 bp, Artificial Sequence
  chemically synthesized
ctatctaagggagttactat

SEQ ID NO: 488047 - DNA, 20 bp, Artificial Sequence
  chemically synthesized
aagggagttactatttgaat

SEQ ID NO: 488048 - DNA, 20 bp, Artificial Sequence
  chemically synthesized
tttgaattatccattctaaa

SEQ ID NO: 488049 - DNA, 20 bp, Artificial Sequence
  chemically synthesized
gtcattaaattcactttaga

SEQ ID NO: 488050 - DNA, 20 bp, Artificial Sequence
  chemically synthesized
taatgtcattaaattcactt

SEQ ID NO: 488051 - DNA, 20 bp, Artificial Sequence
  chemically synthesized
acctctgcaaagctaatttt

SEQ ID NO: 488052 - DNA, 20 bp, Artificial Sequence
  chemically synthesized
caaagctaattttgtgaatg

SEQ ID NO: 488053 - DNA, 20 bp, Artificial Sequence
  chemically synthesized
ggattcccaattaatcagtc

SEQ ID NO: 488054 - DNA, 20 bp, Artificial Sequence
  chemically synthesized
acactcctgactgattaatt

SEQ ID NO: 488055 - DNA, 20 bp, Artificial Sequence
  chemically synthesized
gtaaggagtcagacttacca

SEQ ID NO: 488056 - DNA, 20 bp, Artificial Sequence
  chemically synthesized
cttccacgctttcgtgggta

SEQ ID NO: 488057 - DNA, 20 bp, Artificial Sequence
  chemically synthesized
taccatgcttccacgctttc

SEQ ID NO: 488058 - DNA, 20 bp, Artificial Sequence
  chemically synthesized
agattttgattctcagtaat

SEQ ID NO: 488059 - DNA, 20 bp, Artificial Sequence
  chemically synthesized
aagaatatactcagattact

SEQ ID NO: 488060 - DNA, 20 bp, Artificial Sequence
  chemically synthesized
tcagtaatctgagtatattc

SEQ ID NO: 488061 - DNA, 20 bp, Artificial Sequence
  chemically synthesized
tctgagtatattcttgagtc

SEQ ID NO: 488062 - DNA, 20 bp, Artificial Sequence
  chemically synthesized
aagcctgggactctagactc

SEQ ID NO: 488063 - DNA, 20 bp, Artificial Sequence
  chemically synthesized
gaaccaaatgagatttcaat

SEQ ID NO: 488064 - DNA, 20 bp, Artificial Sequence
  chemically synthesized
caacaacaaaaaaaggaaac

SEQ ID NO: 488065 - DNA, 20 bp, Artificial Sequence
  chemically synthesized
aggaggagaaacagaatagt

SEQ ID NO: 488066 - DNA, 20 bp, Artificial Sequence
  chemically synthesized
agtcttcagaggaggagaaa

SEQ ID NO: 488067 - DNA, 20 bp, Artificial Sequence
  chemically synthesized
gtcttagatgagccagctta

SEQ ID NO: 488068 - DNA, 20 bp, Artificial Sequence
  chemically synthesized
aagtagtcaaaggaagaagg

SEQ ID NO: 488069 - DNA, 20 bp, Artificial Sequence
  chemically synthesized
gtttgaagaggaatatgctg

SEQ ID NO: 488070 - DNA, 20 bp, Artificial Sequence
  chemically synthesized
gagcaggtacgggtttgaag

SEQ ID NO: 488071 - DNA, 20 bp, Artificial Sequence
  chemically synthesized
gacaaagagatggagcaggt

SEQ ID NO: 488072 - DNA, 20 bp, Artificial Sequence
  chemically synthesized
taggaagagaaaggtctgtc

SEQ ID NO: 488073 - DNA, 20 bp, Artificial Sequence
  chemically synthesized
accatagagagttgagagac

SEQ ID NO: 488074 - DNA, 20 bp, Artificial Sequence
  chemically synthesized
ataacgctttagagaccata

SEQ ID NO: 488075 - DNA, 20 bp, Artificial Sequence
  chemically synthesized
caggtggttgcttctggggt

SEQ ID NO: 488076 - DNA, 20 bp, Artificial Sequence
  chemically synthesized
caacctcaggtggttgcttc

SEQ ID NO: 488077 - DNA, 20 bp, Artificial Sequence
  chemically synthesized
aaaagctaattggaaacaga

SEQ ID NO: 488078 - DNA, 20 bp, Artificial Sequence
  chemically synthesized
ggataccgtgtacgttcaga

SEQ ID NO: 488079 - DNA, 20 bp, Artificial Sequence
  chemically synthesized
aggagatacctagtggccat

SEQ ID NO: 488080 - DNA, 20 bp, Artificial Sequence
  chemically synthesized
tggaggctgtgttctaaaat

SEQ ID NO: 488081 - DNA, 20 bp, Artificial Sequence
  chemically synthesized
gtaaacttttagccctcata

SEQ ID NO: 488082 - DNA, 20 bp, Artificial Sequence
  chemically synthesized
ttagccctcatattgagtag

SEQ ID NO: 488083 - DNA, 20 bp, Artificial Sequence
  chemically synthesized
atagccaactagcaaagctt

SEQ ID NO: 488084 - DNA, 20 bp, Artificial Sequence
  chemically synthesized
cttattttatagagaaaact

SEQ ID NO: 488085 - DNA, 20 bp, Artificial Sequence
  chemically synthesized
ataaaacttccagaaacatt

SEQ ID NO: 488086 - DNA, 20 bp, Artificial Sequence
  chemically synthesized
tgcaaaatatacaaggtatg

SEQ ID NO: 488087 - DNA, 20 bp, Artificial Sequence
  chemically synthesized
gtgtttttgttaaggaaaaa

SEQ ID NO: 488088 - DNA, 20 bp, Artificial Sequence
  chemically synthesized
aggaaggtataggacaaaat

SEQ ID NO: 488089 - DNA, 20 bp, Artificial Sequence
  chemically synthesized
tggcagaagatttgtggaag

SEQ ID NO: 488090 - DNA, 20 bp, Artificial Sequence
  chemically synthesized
atagccaatgctggctaaaa

SEQ ID NO: 488091 - DNA, 20 bp, Artificial Sequence
  chemically synthesized
ccaatgctggctaaaacgga

SEQ ID NO: 488092 - DNA, 20 bp, Artificial Sequence
  chemically synthesized
tgatactaagggtcatttgt

SEQ ID NO: 488093 - DNA, 20 bp, Artificial Sequence
  chemically synthesized
atcaatacactgttgatact

SEQ ID NO: 488094 - DNA, 20 bp, Artificial Sequence
  chemically synthesized
caacagtgtattgatcaaaa

SEQ ID NO: 488095 - DNA, 20 bp, Artificial Sequence
  chemically synthesized
taaaaaatgataaaatattc

SEQ ID NO: 488096 - DNA, 20 bp, Artificial Sequence
  chemically synthesized
aaagagcagaccaataatcc

SEQ ID NO: 488097 - DNA, 20 bp, Artificial Sequence
  chemically synthesized
tctgctcttttgaaataaaa

SEQ ID NO: 488098 - DNA, 20 bp, Artificial Sequence
  chemically synthesized
tttgtttttttttttatatt

SEQ ID NO: 488099 - DNA, 20 bp, Artificial Sequence
  chemically synthesized
aaacaaatattgtttcttat

SEQ ID NO: 488100 - DNA, 20 bp, Artificial Sequence
  chemically synthesized
tgtgttgattttgtatgtcc

SEQ ID NO: 488101 - DNA, 20 bp, Artificial Sequence
  chemically synthesized
aggatcattgctcactatga

SEQ ID NO: 488102 - DNA, 20 bp, Artificial Sequence
  chemically synthesized
ggtttgaatacttggctgaa

SEQ ID NO: 488103 - DNA, 20 bp, Artificial Sequence
  chemically synthesized
caaaaggtttgaatacttgg

SEQ ID NO: 488104 - DNA, 20 bp, Artificial Sequence
  chemically synthesized
gttgtaaaatgacaaaaggt

SEQ ID NO: 488105 - DNA, 20 bp, Artificial Sequence
  chemically synthesized
gattaaaaaaaattttattt

SEQ ID NO: 488106 - DNA, 20 bp, Artificial Sequence
  chemically synthesized
gattggtttgaaaaatttca

SEQ ID NO: 488107 - DNA, 20 bp, Artificial Sequence
  chemically synthesized
tttaacatccttcattttac

SEQ ID NO: 488108 - DNA, 20 bp, Artificial Sequence
  chemically synthesized
tcctgcacccttgtaaaatg

SEQ ID NO: 488109 - DNA, 20 bp, Artificial Sequence
  chemically synthesized
aactaggttcatttggtatg

SEQ ID NO: 488110 - DNA, 20 bp, Artificial Sequence
  chemically synthesized
cttgactaggttatagttgt

SEQ ID NO: 488111 - DNA, 20 bp, Artificial Sequence
  chemically synthesized
tagagcactaacaaagttct

SEQ ID NO: 488112 - DNA, 20 bp, Artificial Sequence
  chemically synthesized
attatcggataaagtagcac

SEQ ID NO: 488113 - DNA, 20 bp, Artificial Sequence
  chemically synthesized
ctgatgacataatattatta

SEQ ID NO: 488114 - DNA, 20 bp, Artificial Sequence
  chemically synthesized
ccacattttaaaataacaac

SEQ ID NO: 488115 - DNA, 20 bp, Artificial Sequence
  chemically synthesized
gggaaaaaaaaaatttcttg

SEQ ID NO: 488116 - DNA, 20 bp, Artificial Sequence
  chemically synthesized
aaaaaaaaatttcttgtcga

SEQ ID NO: 488117 - DNA, 20 bp, Artificial Sequence
  chemically synthesized
tggtttatgctgatgcttcc

SEQ ID NO: 488118 - DNA, 20 bp, Artificial Sequence
  chemically synthesized
tcttacaatcagttagaggt

SEQ ID NO: 488119 - DNA, 20 bp, Artificial Sequence
  chemically synthesized
tacctgtcgtagtacttcct

SEQ ID NO: 488120 - DNA, 20 bp, Artificial Sequence
  chemically synthesized
ggcatcagaagtctgtgtcc

SEQ ID NO: 488121 - DNA, 20 bp, Artificial Sequence
  chemically synthesized
attataccattggacaaagt

SEQ ID NO: 488122 - DNA, 20 bp, Artificial Sequence
  chemically synthesized
tgaactcatcagcttcttca

SEQ ID NO: 488123 - DNA, 20 bp, Artificial Sequence
  chemically synthesized
gaaactctgtgaagaagctg

SEQ ID NO: 488124 - DNA, 20 bp, Artificial Sequence
  chemically synthesized
aattcttgtcttgcttgatc

SEQ ID NO: 488125 - DNA, 20 bp, Artificial Sequence
  chemically synthesized
aactcaagatcaagcaagac

SEQ ID NO: 488126 - DNA, 20 bp, Artificial Sequence
  chemically synthesized
caagaattaactacatgggc

SEQ ID NO: 488127 - DNA, 20 bp, Artificial Sequence
  chemically synthesized
aaacagaacattaaaacatg

SEQ ID NO: 488128 - DNA, 20 bp, Artificial Sequence
  chemically synthesized
ttaagttatctataactcat

SEQ ID NO: 488129 - DNA, 20 bp, Artificial Sequence
  chemically synthesized
atctataactcatgagaatt

SEQ ID NO: 488130 - DNA, 20 bp, Artificial Sequence
  chemically synthesized
aaagcatactctaaattctc

SEQ ID NO: 488131 - DNA, 20 bp, Artificial Sequence
  chemically synthesized
ttagagtatgcttttgtaaa

SEQ ID NO: 488132 - DNA, 20 bp, Artificial Sequence
  chemically synthesized
gaattttacagggatcaggc

SEQ ID NO: 488133 - DNA, 20 bp, Artificial Sequence
  chemically synthesized
taagaatttctgaattttac

SEQ ID NO: 488134 - DNA, 20 bp, Artificial Sequence
  chemically synthesized
agaatactcggtaagaattt

SEQ ID NO: 488135 - DNA, 20 bp, Artificial Sequence
  chemically synthesized
gtaaaattcagaaattctta

SEQ ID NO: 488136 - DNA, 20 bp, Artificial Sequence
  chemically synthesized
tgaaaataagaatactcggt

SEQ ID NO: 488137 - DNA, 20 bp, Artificial Sequence
  chemically synthesized
aattatattgccatgaaaat

SEQ ID NO: 488138 - DNA, 20 bp, Artificial Sequence
  chemically synthesized
tatataaccaaggctttgac

SEQ ID NO: 488139 - DNA, 20 bp, Artificial Sequence
  chemically synthesized
ttgactggaatgtcatattt

SEQ ID NO: 488140 - DNA, 20 bp, Artificial Sequence
  chemically synthesized
atatttgagaattaagtgca

SEQ ID NO: 488141 - DNA, 20 bp, Artificial Sequence
  chemically synthesized
tatattagctccatatagtc

SEQ ID NO: 488142 - DNA, 20 bp, Artificial Sequence
  chemically synthesized
ctgtcccggtacctggctta

SEQ ID NO: 488143 - DNA, 20 bp, Artificial Sequence
  chemically synthesized
ccttactcagttgtaagatt

SEQ ID NO: 488144 - DNA, 20 bp, Artificial Sequence
  chemically synthesized
cagaattcccaatcttacaa

SEQ ID NO: 488145 - DNA, 20 bp, Artificial Sequence
  chemically synthesized
cttggtttcctgggtctcct

SEQ ID NO: 488146 - DNA, 20 bp, Artificial Sequence
  chemically synthesized
cttaggagacccaggaaacc

SEQ ID NO: 488147 - DNA, 20 bp, Artificial Sequence
  chemically synthesized
cctaaaatacccttggtttc

SEQ ID NO: 488148 - DNA, 20 bp, Artificial Sequence
  chemically synthesized
tggaaaacagaacacttcag

SEQ ID NO: 488149 - DNA, 20 bp, Artificial Sequence
  chemically synthesized
tatttaatgcatagaacttg

SEQ ID NO: 488150 - DNA, 20 bp, Artificial Sequence
  chemically synthesized
atgtaccactgctcctaaaa

SEQ ID NO: 488151 - DNA, 20 bp, Artificial Sequence
  chemically synthesized
aattagaaatttgctgaggg

SEQ ID NO: 488152 - DNA, 20 bp, Artificial Sequence
  chemically synthesized
ttttcatgaagaatcacaag

SEQ ID NO: 488153 - DNA, 20 bp, Artificial Sequence
  chemically synthesized
attagctggaagttttcatg

SEQ ID NO: 488154 - DNA, 20 bp, Artificial Sequence
  chemically synthesized
actggcctatttatttatat

SEQ ID NO: 488155 - DNA, 20 bp, Artificial Sequence
  chemically synthesized
ctttgattaacactgatcaa

SEQ ID NO: 488156 - DNA, 20 bp, Artificial Sequence
  chemically synthesized
caaaagggtgatggtagaga

SEQ ID NO: 488157 - DNA, 20 bp, Artificial Sequence
  chemically synthesized
gatagagtttcagtaaccct

SEQ ID NO: 488158 - DNA, 20 bp, Artificial Sequence
  chemically synthesized
gactagaatctgataacccc

SEQ ID NO: 488159 - DNA, 20 bp, Artificial Sequence
  chemically synthesized
tcaaagacaatgaacaggac

SEQ ID NO: 488160 - DNA, 20 bp, Artificial Sequence
  chemically synthesized
ttacctacctgtaaattgat

SEQ ID NO: 488161 - DNA, 20 bp, Artificial Sequence
  chemically synthesized
ggacaaaatgtgtaagacag

SEQ ID NO: 488162 - DNA, 20 bp, Artificial Sequence
  chemically synthesized
aaatttgaaatgttaatttg

SEQ ID NO: 488163 - DNA, 20 bp, Artificial Sequence
  chemically synthesized
agttctcagtgtcaccaagt

SEQ ID NO: 488164 - DNA, 20 bp, Artificial Sequence
  chemically synthesized
ctataagacaacctagagaa

SEQ ID NO: 488165 - DNA, 20 bp, Artificial Sequence
  chemically synthesized
agaagccctgcaagcagaag

SEQ ID NO: 488166 - DNA, 20 bp, Artificial Sequence
  chemically synthesized
atacataatttgctgtggtg

SEQ ID NO: 488167 - DNA, 20 bp, Artificial Sequence
  chemically synthesized
gagcatggcacggaagaggt

SEQ ID NO: 488168 - DNA, 20 bp, Artificial Sequence
  chemically synthesized
gccatgctccaagaaatcca

SEQ ID NO: 488169 - DNA, 20 bp, Artificial Sequence
  chemically synthesized
aggatggcagtagcaatccg

SEQ ID NO: 488170 - DNA, 20 bp, Artificial Sequence
  chemically synthesized
gcattctcagatggtagagt

SEQ ID NO: 488171 - DNA, 20 bp, Artificial Sequence
  chemically synthesized
ccatcctcactctaccatct

SEQ ID NO: 488172 - DNA, 20 bp, Artificial Sequence
  chemically synthesized
ctgtaggcattctcagatgg

SEQ ID NO: 488173 - DNA, 20 bp, Artificial Sequence
  chemically synthesized
atgcctacagcccagcttct

SEQ ID NO: 488174 - DNA, 20 bp, Artificial Sequence
  chemically synthesized
ctgccctctggactcaaaaa

SEQ ID NO: 488175 - DNA, 20 bp, Artificial Sequence
  chemically synthesized
gcagactgcaaactcagttt

SEQ ID NO: 488176 - DNA, 20 bp, Artificial Sequence
  chemically synthesized
gtctgattactaccaagtgt

SEQ ID NO: 488177 - DNA, 20 bp, Artificial Sequence
  chemically synthesized
ggtttcccttgaacaaaatg

SEQ ID NO: 488178 - DNA, 20 bp, Artificial Sequence
  chemically synthesized
aagaaagctttaaaaatacc

SEQ ID NO: 488179 - DNA, 20 bp, Artificial Sequence
  chemically synthesized
gtctcaaatgtagtcaaact

SEQ ID NO: 488180 - DNA, 20 bp, Artificial Sequence
  chemically synthesized
aaataatatataaagttttc

SEQ ID NO: 488181 - DNA, 20 bp, Artificial Sequence
  chemically synthesized
taaaagtggcaagaggctag

SEQ ID NO: 488182 - DNA, 20 bp, Artificial Sequence
  chemically synthesized
tcttgccacttttatacctc

SEQ ID NO: 488183 - DNA, 20 bp, Artificial Sequence
  chemically synthesized
tgggagctagcactttgata

SEQ ID NO: 488184 - DNA, 20 bp, Artificial Sequence
  chemically synthesized
atctgctagtcttctgttgg

SEQ ID NO: 488185 - DNA, 20 bp, Artificial Sequence
  chemically synthesized
tagtcttctgttgggaggat

SEQ ID NO: 488186 - DNA, 20 bp, Artificial Sequence
  chemically synthesized
gagagcctctaagtgctgag

SEQ ID NO: 488187 - DNA, 20 bp, Artificial Sequence
  chemically synthesized
tctcctgccttttatttcag

SEQ ID NO: 488188 - DNA, 20 bp, Artificial Sequence
  chemically synthesized
tgccttttatttcagcagaa

SEQ ID NO: 488189 - DNA, 20 bp, Artificial Sequence
  chemically synthesized
ctgtgtgtgttcacattgct

SEQ ID NO: 488190 - DNA, 20 bp, Artificial Sequence
  chemically synthesized
ttaatggtcagtcactacaa

SEQ ID NO: 488191 - DNA, 20 bp, Artificial Sequence
  chemically synthesized
gtcctttggtagtttttagt

SEQ ID NO: 488192 - DNA, 20 bp, Artificial Sequence
  chemically synthesized
gggggttttttcctcccctc

SEQ ID NO: 488193 - DNA, 20 bp, Artificial Sequence
  chemically synthesized
tttcatcttaatcacaggga

SEQ ID NO: 488194 - DNA, 20 bp, Artificial Sequence
  chemically synthesized
tcttatgtttttaaccttta

SEQ ID NO: 488195 - DNA, 20 bp, Artificial Sequence
  chemically synthesized
accagtttagaatttctata

SEQ ID NO: 488196 - DNA, 20 bp, Artificial Sequence
  chemically synthesized
ctaagatcccgggaccagtt

SEQ ID NO: 488197 - DNA, 20 bp, Artificial Sequence
  chemically synthesized
tagaaattctaaactggtcc

SEQ ID NO: 488198 - DNA, 20 bp, Artificial Sequence
  chemically synthesized
tcagatttcagaaatgataa

SEQ ID NO: 488199 - DNA, 20 bp, Artificial Sequence
  chemically synthesized
acatattttatgtctaaatt

SEQ ID NO: 488200 - DNA, 20 bp, Artificial Sequence
  chemically synthesized
gcccactagaaggcatgcct

SEQ ID NO: 488201 - DNA, 20 bp, Artificial Sequence
  chemically synthesized
atcaatgagatcgtgatgta

SEQ ID NO: 488202 - DNA, 20 bp, Artificial Sequence
  chemically synthesized
attatgtttctcagcttgct

SEQ ID NO: 488203 - DNA, 20 bp, Artificial Sequence
  chemically synthesized
tctgtgaggtgattttcaag

SEQ ID NO: 488204 - DNA, 20 bp, Artificial Sequence
  chemically synthesized
aagatgaatattgctatttg

SEQ ID NO: 488205 - DNA, 20 bp, Artificial Sequence
  chemically synthesized
attgctatttgcaggatttc

SEQ ID NO: 488206 - DNA, 20 bp, Artificial Sequence
  chemically synthesized
atttgcaggatttcctgaat

SEQ ID NO: 488207 - DNA, 20 bp, Artificial Sequence
  chemically synthesized
ttcctgaataggaatatttc

SEQ ID NO: 488208 - DNA, 20 bp, Artificial Sequence
  chemically synthesized
ttctaatacattgtttatgc

SEQ ID NO: 488209 - DNA, 20 bp, Artificial Sequence
  chemically synthesized
cccttaaagcttttttttat

SEQ ID NO: 488210 - DNA, 20 bp, Artificial Sequence
  chemically synthesized
gctagctgcatttcatcaat

SEQ ID NO: 488211 - DNA, 20 bp, Artificial Sequence
  chemically synthesized
aaaactgaggctcacagaga

SEQ ID NO: 488212 - DNA, 20 bp, Artificial Sequence
  chemically synthesized
atttttctaacaggtgtgct

SEQ ID NO: 488213 - DNA, 20 bp, Artificial Sequence
  chemically synthesized
gactagagaaaacaaactac

SEQ ID NO: 488214 - DNA, 20 bp, Artificial Sequence
  chemically synthesized
agggtctgaggccttgccat

SEQ ID NO: 488215 - DNA, 20 bp, Artificial Sequence
  chemically synthesized
ccatagctgcctcggaaaca

SEQ ID NO: 488216 - DNA, 20 bp, Artificial Sequence
  chemically synthesized
aaggcaagtttctttacatt

SEQ ID NO: 488217 - DNA, 20 bp, Artificial Sequence
  chemically synthesized
cctttactaaaatcttaaga

SEQ ID NO: 488218 - DNA, 20 bp, Artificial Sequence
  chemically synthesized
caccaaaaataaaattttta

SEQ ID NO: 488219 - DNA, 20 bp, Artificial Sequence
  chemically synthesized
tgctgtattcctctgcttaa

SEQ ID NO: 488220 - DNA, 20 bp, Artificial Sequence
  chemically synthesized
agtttaattcctttaagcag

SEQ ID NO: 488221 - DNA, 20 bp, Artificial Sequence
  chemically synthesized
agtttttctgatttaagata

SEQ ID NO: 488222 - DNA, 20 bp, Artificial Sequence
  chemically synthesized
ataaatcatttattagtgaa

SEQ ID NO: 488223 - DNA, 20 bp, Artificial Sequence
  chemically synthesized
ggaatggaagctagacaaag

SEQ ID NO: 488224 - DNA, 20 bp, Artificial Sequence
  chemically synthesized
attaggaaatggtgacctgt

SEQ ID NO: 488225 - DNA, 20 bp, Artificial Sequence
  chemically synthesized
ccatttcctaattataagct

SEQ ID NO: 488226 - DNA, 20 bp, Artificial Sequence
  chemically synthesized
taattataagctgggggttt

SEQ ID NO: 488227 - DNA, 20 bp, Artificial Sequence
  chemically synthesized
aatcatagatttgatgactt

SEQ ID NO: 488228 - DNA, 20 bp, Artificial Sequence
  chemically synthesized
aagcagaagaaaaaggctaa

SEQ ID NO: 488229 - DNA, 20 bp, Artificial Sequence
  chemically synthesized
cattccgagtttcttatctc

SEQ ID NO: 488230 - DNA, 20 bp, Artificial Sequence
  chemically synthesized
cactccagagataagaaact

SEQ ID NO: 488231 - DNA, 20 bp, Artificial Sequence
  chemically synthesized
ttcagtcctctgagcacatt

SEQ ID NO: 488232 - DNA, 20 bp, Artificial Sequence
  chemically synthesized
tgctcagaggactgaagcca

SEQ ID NO: 488233 - DNA, 20 bp, Artificial Sequence
  chemically synthesized
cactgctgtgtgtagtttct

SEQ ID NO: 488234 - DNA, 20 bp, Artificial Sequence
  chemically synthesized
ctcagaaactacacacagca

SEQ ID NO: 488235 - DNA, 20 bp, Artificial Sequence
  chemically synthesized
aagaaaagtgattaacacag

SEQ ID NO: 488236 - DNA, 20 bp, Artificial Sequence
  chemically synthesized
ggcccatagggctctgccaa

SEQ ID NO: 488237 - DNA, 20 bp, Artificial Sequence
  chemically synthesized
ttgtcccagtctgtgccccc

SEQ ID NO: 488238 - DNA, 20 bp, Artificial Sequence
  chemically synthesized
tgggacaaaagtcattttga

SEQ ID NO: 488239 - DNA, 20 bp, Artificial Sequence
  chemically synthesized
agtcattttgattgagtaaa

SEQ ID NO: 488240 - DNA, 20 bp, Artificial Sequence
  chemically synthesized
aacaggatctatttgtacca

SEQ ID NO: 488241 - DNA, 20 bp, Artificial Sequence
  chemically synthesized
atttaagaaaagattttttt

SEQ ID NO: 488242 - DNA, 20 bp, Artificial Sequence
  chemically synthesized
aggaagagagatagctagca

SEQ ID NO: 488243 - DNA, 20 bp, Artificial Sequence
  chemically synthesized
taaccaaagattgcatttaa

SEQ ID NO: 488244 - DNA, 20 bp, Artificial Sequence
  chemically synthesized
aaagattgcatttaaaagag

SEQ ID NO: 488245 - DNA, 20 bp, Artificial Sequence
  chemically synthesized
tattacgccagttacttttt

SEQ ID NO: 488246 - DNA, 20 bp, Artificial Sequence
  chemically synthesized
agttactttttaagaatata

SEQ ID NO: 488247 - DNA, 20 bp, Artificial Sequence
  chemically synthesized
atactggatataagataatt

SEQ ID NO: 488248 - DNA, 20 bp, Artificial Sequence
  chemically synthesized
aagtaactgtactttcttgt

SEQ ID NO: 488249 - DNA, 20 bp, Artificial Sequence
  chemically synthesized
caccagtacaattacatctc

SEQ ID NO: 488250 - DNA, 20 bp, Artificial Sequence
  chemically synthesized
catgagatgtaattgtactg

SEQ ID NO: 488251 - DNA, 20 bp, Artificial Sequence
  chemically synthesized
taggagctagtcaaacacct

SEQ ID NO: 488252 - DNA, 20 bp, Artificial Sequence
  chemically synthesized
tagctaagtggagaaatggt

SEQ ID NO: 488253 - DNA, 20 bp, Artificial Sequence
  chemically synthesized
ctcagggaagccatcagttc

SEQ ID NO: 488254 - DNA, 20 bp, Artificial Sequence
  chemically synthesized
catgatcacaaggggcaaga

SEQ ID NO: 488255 - DNA, 20 bp, Artificial Sequence
  chemically synthesized
gatcatgtatgactaaaatt

SEQ ID NO: 488256 - DNA, 20 bp, Artificial Sequence
  chemically synthesized
gcttctgatgtcccatcacc

SEQ ID NO: 488257 - DNA, 20 bp, Artificial Sequence
  chemically synthesized
gctttaagaaattatacagg

SEQ ID NO: 488258 - DNA, 20 bp, Artificial Sequence
  chemically synthesized
gttagctttaagaaattata

SEQ ID NO: 488259 - DNA, 20 bp, Artificial Sequence
  chemically synthesized
aaagctaactaaatttgtta

SEQ ID NO: 488260 - DNA, 20 bp, Artificial Sequence
  chemically synthesized
gctcagccagtggcacagtc

SEQ ID NO: 488261 - DNA, 20 bp, Artificial Sequence
  chemically synthesized
tgtgccactggctgagcagg

SEQ ID NO: 488262 - DNA, 20 bp, Artificial Sequence
  chemically synthesized
cacagtgccatctgctcttg

SEQ ID NO: 488263 - DNA, 20 bp, Artificial Sequence
  chemically synthesized
tgctcttgaggagtagctat

SEQ ID NO: 488264 - DNA, 20 bp, Artificial Sequence
  chemically synthesized
ggaagtttgctacaactaaa

SEQ ID NO: 488265 - DNA, 20 bp, Artificial Sequence
  chemically synthesized
aaagtttcgggaagatgggc

SEQ ID NO: 488266 - DNA, 20 bp, Artificial Sequence
  chemically synthesized
aacttttacttcctcttcac

SEQ ID NO: 488267 - DNA, 20 bp, Artificial Sequence
  chemically synthesized
gcaaagggaaaaggaagttt

SEQ ID NO: 488268 - DNA, 20 bp, Artificial Sequence
  chemically synthesized
aaaaaggataagtaacattt

SEQ ID NO: 488269 - DNA, 20 bp, Artificial Sequence
  chemically synthesized
ttgggcaacttcagagtaaa

SEQ ID NO: 488270 - DNA, 20 bp, Artificial Sequence
  chemically synthesized
aatgtattgttgggcaactt

SEQ ID NO: 488271 - DNA, 20 bp, Artificial Sequence
  chemically synthesized
gttgaaattacaatctatta

SEQ ID NO: 488272 - DNA, 20 bp, Artificial Sequence
  chemically synthesized
taagtagccaatcaaataaa

SEQ ID NO: 488273 - DNA, 20 bp, Artificial Sequence
  chemically synthesized
aaaacggggcagcatattga

SEQ ID NO: 488274 - DNA, 20 bp, Artificial Sequence
  chemically synthesized
cagcatattgaaagaatctt

SEQ ID NO: 488275 - DNA, 20 bp, Artificial Sequence
  chemically synthesized
atcttcttttctccctttca

SEQ ID NO: 488276 - DNA, 20 bp, Artificial Sequence
  chemically synthesized
agatagtggtgttcaattgg

SEQ ID NO: 488277 - DNA, 20 bp, Artificial Sequence
  chemically synthesized
tgcagtatctcattcgtatt

SEQ ID NO: 488278 - DNA, 20 bp, Artificial Sequence
  chemically synthesized
agtaccaagacacccagaat

SEQ ID NO: 488279 - DNA, 20 bp, Artificial Sequence
  chemically synthesized
aaagacagtaccaagacacc

SEQ ID NO: 488280 - DNA, 20 bp, Artificial Sequence
  chemically synthesized
ttgtgagtgtttttaagtca

SEQ ID NO: 488281 - DNA, 20 bp, Artificial Sequence
  chemically synthesized
ccagtaaatgatgcttactt

SEQ ID NO: 488282 - DNA, 20 bp, Artificial Sequence
  chemically synthesized
tcacaagtaagcatcattta

SEQ ID NO: 488283 - DNA, 20 bp, Artificial Sequence
  chemically synthesized
atcatttactggatcctagg

SEQ ID NO: 488284 - DNA, 20 bp, Artificial Sequence
  chemically synthesized
catatcatacacactcagcc

SEQ ID NO: 488285 - DNA, 20 bp, Artificial Sequence
  chemically synthesized
ctaggctgagtgtgtatgat

SEQ ID NO: 488286 - DNA, 20 bp, Artificial Sequence
  chemically synthesized
ggagaagcagagataaataa

SEQ ID NO: 488287 - DNA, 20 bp, Artificial Sequence
  chemically synthesized
ttacacatctgcactgttct

SEQ ID NO: 488288 - DNA, 20 bp, Artificial Sequence
  chemically synthesized
tacacttaaattttatacac

SEQ ID NO: 488289 - DNA, 20 bp, Artificial Sequence
  chemically synthesized
caacatatgaacaatgggag

SEQ ID NO: 488290 - DNA, 20 bp, Artificial Sequence
  chemically synthesized
ggtttataagaaatcctaac

SEQ ID NO: 488291 - DNA, 20 bp, Artificial Sequence
  chemically synthesized
agtagagttagaatccctgt

SEQ ID NO: 488292 - DNA, 20 bp, Artificial Sequence
  chemically synthesized
ttccgtaccccaagtagagt

SEQ ID NO: 488293 - DNA, 20 bp, Artificial Sequence
  chemically synthesized
acagggattctaactctact

SEQ ID NO: 488294 - DNA, 20 bp, Artificial Sequence
  chemically synthesized
gttttcttccgtaccccaag

SEQ ID NO: 488295 - DNA, 20 bp, Artificial Sequence
  chemically synthesized
acttggaagacgcaatgact

SEQ ID NO: 488296 - DNA, 20 bp, Artificial Sequence
  chemically synthesized
tgactttgaattcattctta

SEQ ID NO: 488297 - DNA, 20 bp, Artificial Sequence
  chemically synthesized
ttttcttccattctttaaga

SEQ ID NO: 488298 - DNA, 20 bp, Artificial Sequence
  chemically synthesized
tgaattttcttccattcttt

SEQ ID NO: 488299 - DNA, 20 bp, Artificial Sequence
  chemically synthesized
tttcagtttattttgatata

SEQ ID NO: 488300 - DNA, 20 bp, Artificial Sequence
  chemically synthesized
caggtatgacatgaaattac

SEQ ID NO: 488301 - DNA, 20 bp, Artificial Sequence
  chemically synthesized
ctatacggggagattgctgg

SEQ ID NO: 488302 - DNA, 20 bp, Artificial Sequence
  chemically synthesized
tctcataaacaacttcaatt

SEQ ID NO: 488303 - DNA, 20 bp, Artificial Sequence
  chemically synthesized
aacaacttcaattttggata

SEQ ID NO: 488304 - DNA, 20 bp, Artificial Sequence
  chemically synthesized
caattttggataaggaatct

SEQ ID NO: 488305 - DNA, 20 bp, Artificial Sequence
  chemically synthesized
gtattaagcacaattaaaac

SEQ ID NO: 488306 - DNA, 20 bp, Artificial Sequence
  chemically synthesized
aattaaaacagggatagaaa

SEQ ID NO: 488307 - DNA, 20 bp, Artificial Sequence
  chemically synthesized
cttcattaaacttatgttac

SEQ ID NO: 488308 - DNA, 20 bp, Artificial Sequence
  chemically synthesized
aataattattattattttac

SEQ ID NO: 488309 - DNA, 20 bp, Artificial Sequence
  chemically synthesized
gactaaagtttagtcaagca

SEQ ID NO: 488310 - DNA, 20 bp, Artificial Sequence
  chemically synthesized
gctgaacctggattttacag

SEQ ID NO: 488311 - DNA, 20 bp, Artificial Sequence
  chemically synthesized
gacaggcttctttgctgaac

SEQ ID NO: 488312 - DNA, 20 bp, Artificial Sequence
  chemically synthesized
gtgatcaggtaccaaggata

SEQ ID NO: 488313 - DNA, 20 bp, Artificial Sequence
  chemically synthesized
actgagggtgatcaggtacc

SEQ ID NO: 488314 - DNA, 20 bp, Artificial Sequence
  chemically synthesized
ggggaatggtggagaatact

SEQ ID NO: 488315 - DNA, 20 bp, Artificial Sequence
  chemically synthesized
acaacccttggggaatggtg

SEQ ID NO: 488316 - DNA, 20 bp, Artificial Sequence
  chemically synthesized
agtattctccaccattcccc

SEQ ID NO: 488317 - DNA, 20 bp, Artificial Sequence
  chemically synthesized
atcttatcagacaacccttg

SEQ ID NO: 488318 - DNA, 20 bp, Artificial Sequence
  chemically synthesized
gattcttgctgaagataggc

SEQ ID NO: 488319 - DNA, 20 bp, Artificial Sequence
  chemically synthesized
aaccctggcctatcttcagc

SEQ ID NO: 488320 - DNA, 20 bp, Artificial Sequence
  chemically synthesized
ttctggctaaaccaacctca

SEQ ID NO: 488321 - DNA, 20 bp, Artificial Sequence
  chemically synthesized
tcctgtgaggttggtttagc

SEQ ID NO: 488322 - DNA, 20 bp, Artificial Sequence
  chemically synthesized
gaggaaacatcaggggtaag

SEQ ID NO: 488323 - DNA, 20 bp, Artificial Sequence
  chemically synthesized
aattattaagaggaaacatc

SEQ ID NO: 488324 - DNA, 20 bp, Artificial Sequence
  chemically synthesized
ttatagccaaggagcagtgt

SEQ ID NO: 488325 - DNA, 20 bp, Artificial Sequence
  chemically synthesized
aaatacagcacagtggaagt

SEQ ID NO: 488326 - DNA, 20 bp, Artificial Sequence
  chemically synthesized
tacttccactgtgctgtatt

SEQ ID NO: 488327 - DNA, 20 bp, Artificial Sequence
  chemically synthesized
caatggagtattacaggagg

SEQ ID NO: 488328 - DNA, 20 bp, Artificial Sequence
  chemically synthesized
aggcacagggaccactgcaa

SEQ ID NO: 488329 - DNA, 20 bp, Artificial Sequence
  chemically synthesized
ctgtgcctattgtggttatc

SEQ ID NO: 488330 - DNA, 20 bp, Artificial Sequence
  chemically synthesized
gtggtaaggaagactttatt

SEQ ID NO: 488331 - DNA, 20 bp, Artificial Sequence
  chemically synthesized
taagaaaaatggcaatatca

SEQ ID NO: 488332 - DNA, 20 bp, Artificial Sequence
  chemically synthesized
tgctgtggttatctcctatt

SEQ ID NO: 488333 - DNA, 20 bp, Artificial Sequence
  chemically synthesized
aacattttggcttatgcctt

SEQ ID NO: 488334 - DNA, 20 bp, Artificial Sequence
  chemically synthesized
ttatttatcatgaaatatta

SEQ ID NO: 488335 - DNA, 20 bp, Artificial Sequence
  chemically synthesized
tatttacatatattacatgt

SEQ ID NO: 488336 - DNA, 20 bp, Artificial Sequence
  chemically synthesized
tagcaggttaatgaataatt

SEQ ID NO: 488337 - DNA, 20 bp, Artificial Sequence
  chemically synthesized
agaatttttgtagcaggtta

SEQ ID NO: 488338 - DNA, 20 bp, Artificial Sequence
  chemically synthesized
gtattagtttctttaaagca

SEQ ID NO: 488339 - DNA, 20 bp, Artificial Sequence
  chemically synthesized
taaagaaactaatacctttt

SEQ ID NO: 488340 - DNA, 20 bp, Artificial Sequence
  chemically synthesized
ccagtatatttagtaactga

SEQ ID NO: 488341 - DNA, 20 bp, Artificial Sequence
  chemically synthesized
cacaccagtatatttagtaa

SEQ ID NO: 488342 - DNA, 20 bp, Artificial Sequence
  chemically synthesized
cttcctttgcagttataaaa

SEQ ID NO: 488343 - DNA, 20 bp, Artificial Sequence
  chemically synthesized
ttatatatctggtgctaatg

SEQ ID NO: 488344 - DNA, 20 bp, Artificial Sequence
  chemically synthesized
acaggtcttctaaatcccaa

SEQ ID NO: 488345 - DNA, 20 bp, Artificial Sequence
  chemically synthesized
ttgaataaaaatcactcatt

SEQ ID NO: 488346 - DNA, 20 bp, Artificial Sequence
  chemically synthesized
ttttaattttaggatgcgca

SEQ ID NO: 488347 - DNA, 20 bp, Artificial Sequence
  chemically synthesized
agttggtttggttttaattt

SEQ ID NO: 488348 - DNA, 20 bp, Artificial Sequence
  chemically synthesized
gtttttgtgagctatagttt

SEQ ID NO: 488349 - DNA, 20 bp, Artificial Sequence
  chemically synthesized
atgagaagtaaaaagaacat

SEQ ID NO: 488350 - DNA, 20 bp, Artificial Sequence
  chemically synthesized
agtaaaaagaacatttggat

SEQ ID NO: 488351 - DNA, 20 bp, Artificial Sequence
  chemically synthesized
tggattagagtagactgtaa

SEQ ID NO: 488352 - DNA, 20 bp, Artificial Sequence
  chemically synthesized
tctacaaatgtgaaacttcc

SEQ ID NO: 488353 - DNA, 20 bp, Artificial Sequence
  chemically synthesized
ctatgtcgtagcattgttgg

SEQ ID NO: 488354 - DNA, 20 bp, Artificial Sequence
  chemically synthesized
atatctatgtcgtagcattg

SEQ ID NO: 488355 - DNA, 20 bp, Artificial Sequence
  chemically synthesized
tcatcacccatgtgtgatag

SEQ ID NO: 488356 - DNA, 20 bp, Artificial Sequence
  chemically synthesized
ttatgatcccactatcacac

SEQ ID NO: 488357 - DNA, 20 bp, Artificial Sequence
  chemically synthesized
tcacacatgggtgatgacgt

SEQ ID NO: 488358 - DNA, 20 bp, Artificial Sequence
  chemically synthesized
gtattaagcattgtgaggtc

SEQ ID NO: 488359 - DNA, 20 bp, Artificial Sequence
  chemically synthesized
gaggtctagagttaggccac

SEQ ID NO: 488360 - DNA, 20 bp, Artificial Sequence
  chemically synthesized
tgttaggcaagaactagaac

SEQ ID NO: 488361 - DNA, 20 bp, Artificial Sequence
  chemically synthesized
caatctacagaggaggcatt

SEQ ID NO: 488362 - DNA, 20 bp, Artificial Sequence
  chemically synthesized
caatgatagcacctgcttca

SEQ ID NO: 488363 - DNA, 20 bp, Artificial Sequence
  chemically synthesized
tatgttcagggatgacgtta

SEQ ID NO: 488364 - DNA, 20 bp, Artificial Sequence
  chemically synthesized
tattgctctaaggtatgttc

SEQ ID NO: 488365 - DNA, 20 bp, Artificial Sequence
  chemically synthesized
gagcaatactctgcatgata

SEQ ID NO: 488366 - DNA, 20 bp, Artificial Sequence
  chemically synthesized
tattgtcattcattatcatg

SEQ ID NO: 488367 - DNA, 20 bp, Artificial Sequence
  chemically synthesized
cttacatgtaaataaagagc

SEQ ID NO: 488368 - DNA, 20 bp, Artificial Sequence
  chemically synthesized
gcctcagcctcccaaagtgc

SEQ ID NO: 488369 - DNA, 20 bp, Artificial Sequence
  chemically synthesized
actttgggaggctgaggcag

SEQ ID NO: 488370 - DNA, 20 bp, Artificial Sequence
  chemically synthesized
caggaggattgcttgagccc

SEQ ID NO: 488371 - DNA, 20 bp, Artificial Sequence
  chemically synthesized
tgttttttttttgtagagat

SEQ ID NO: 488372 - DNA, 20 bp, Artificial Sequence
  chemically synthesized
acaaaacaaaaaaacagagc

SEQ ID NO: 488373 - DNA, 20 bp, Artificial Sequence
  chemically synthesized
aaaacagagccagaataaac

SEQ ID NO: 488374 - DNA, 20 bp, Artificial Sequence
  chemically synthesized
aagagtaaagctattttctt

SEQ ID NO: 488375 - DNA, 20 bp, Artificial Sequence
  chemically synthesized
gctattttcttcagaatatc

SEQ ID NO: 488376 - DNA, 20 bp, Artificial Sequence
  chemically synthesized
aagagttaaaactggcatcc

SEQ ID NO: 488377 - DNA, 20 bp, Artificial Sequence
  chemically synthesized
aaaactggcatcccagaata

SEQ ID NO: 488378 - DNA, 20 bp, Artificial Sequence
  chemically synthesized
caagtttaaattctttattc

SEQ ID NO: 488379 - DNA, 20 bp, Artificial Sequence
  chemically synthesized
acaaaatattacactgcaat

SEQ ID NO: 488380 - DNA, 20 bp, Artificial Sequence
  chemically synthesized
ctgttccataataatatatt

SEQ ID NO: 488381 - DNA, 20 bp, Artificial Sequence
  chemically synthesized
atgaacagtacattgtttaa

SEQ ID NO: 488382 - DNA, 20 bp, Artificial Sequence
  chemically synthesized
tacattgtttaattggatgc

SEQ ID NO: 488383 - DNA, 20 bp, Artificial Sequence
  chemically synthesized
atcaattaatgtacagaaaa

SEQ ID NO: 488384 - DNA, 20 bp, Artificial Sequence
  chemically synthesized
tcctttgcttatacagtctc

SEQ ID NO: 488385 - DNA, 20 bp, Artificial Sequence
  chemically synthesized
ttcatgagactgtataagca

SEQ ID NO: 488386 - DNA, 20 bp, Artificial Sequence
  chemically synthesized
ctgacctgcaacagcccagg

SEQ ID NO: 488387 - DNA, 20 bp, Artificial Sequence
  chemically synthesized
gaaacagtgctgtgggagcc

SEQ ID NO: 488388 - DNA, 20 bp, Artificial Sequence
  chemically synthesized
ttggaaacactaactttaag

SEQ ID NO: 488389 - DNA, 20 bp, Artificial Sequence
  chemically synthesized
tcatcgcaggagctgtcagt

SEQ ID NO: 488390 - DNA, 20 bp, Artificial Sequence
  chemically synthesized
tgtcagttggaatacagtcc

SEQ ID NO: 488391 - DNA, 20 bp, Artificial Sequence
  chemically synthesized
ttttacaccattgtagtcac

SEQ ID NO: 488392 - DNA, 20 bp, Artificial Sequence
  chemically synthesized
ccacacagggaaaggctgcc

SEQ ID NO: 488393 - DNA, 20 bp, Artificial Sequence
  chemically synthesized
tcctggcagcctttccctgt

SEQ ID NO: 488394 - DNA, 20 bp, Artificial Sequence
  chemically synthesized
cagcctttccctgtgtgggt

SEQ ID NO: 488395 - DNA, 20 bp, Artificial Sequence
  chemically synthesized
gcattgtgtttcagatagca

SEQ ID NO: 488396 - DNA, 20 bp, Artificial Sequence
  chemically synthesized
tcagatagcacagaatgtcc

SEQ ID NO: 488397 - DNA, 20 bp, Artificial Sequence
  chemically synthesized
gcacagaatgtccatgaatc

SEQ ID NO: 488398 - DNA, 20 bp, Artificial Sequence
  chemically synthesized
ctttgcttgatttgtgtttt

SEQ ID NO: 488399 - DNA, 20 bp, Artificial Sequence
  chemically synthesized
tcagcaccacaggtgtagtt

SEQ ID NO: 488400 - DNA, 20 bp, Artificial Sequence
  chemically synthesized
acacacacacacacacacac

SEQ ID NO: 488401 - DNA, 20 bp, Artificial Sequence
  chemically synthesized
agatcatgtattacagacgt

SEQ ID NO: 488402 - DNA, 20 bp, Artificial Sequence
  chemically synthesized
aactaaacattttattttta

SEQ ID NO: 488403 - DNA, 20 bp, Artificial Sequence
  chemically synthesized
aacgctttttacatctactt

SEQ ID NO: 488404 - DNA, 20 bp, Artificial Sequence
  chemically synthesized
ggctattatctcagtagctt

SEQ ID NO: 488405 - DNA, 20 bp, Artificial Sequence
  chemically synthesized
aatttcatgatcagataaaa

SEQ ID NO: 488406 - DNA, 20 bp, Artificial Sequence
  chemically synthesized
acaaggaagggatagtatgg

SEQ ID NO: 488407 - DNA, 20 bp, Artificial Sequence
  chemically synthesized
ttttacctctattacaagga

SEQ ID NO: 488408 - DNA, 20 bp, Artificial Sequence
  chemically synthesized
ccattacactgttttctgtc

SEQ ID NO: 488409 - DNA, 20 bp, Artificial Sequence
  chemically synthesized
tcctgacagaaaacagtgta

SEQ ID NO: 488410 - DNA, 20 bp, Artificial Sequence
  chemically synthesized
ggtcagatttgactaatatc

SEQ ID NO: 488411 - DNA, 20 bp, Artificial Sequence
  chemically synthesized
gtgggaaagacaagatctga

SEQ ID NO: 488412 - DNA, 20 bp, Artificial Sequence
  chemically synthesized
ttctcactgacctttgattt

SEQ ID NO: 488413 - DNA, 20 bp, Artificial Sequence
  chemically synthesized
ttaaaaacaatttccaaatt

SEQ ID NO: 488414 - DNA, 20 bp, Artificial Sequence
  chemically synthesized
acattgaaaaaataataatc

SEQ ID NO: 488415 - DNA, 20 bp, Artificial Sequence
  chemically synthesized
taattaaagttatttaactt

SEQ ID NO: 488416 - DNA, 20 bp, Artificial Sequence
  chemically synthesized
ggaaaattagtcccttagac

SEQ ID NO: 488417 - DNA, 20 bp, Artificial Sequence
  chemically synthesized
atcttttgtccaattttctt

SEQ ID NO: 488418 - DNA, 20 bp, Artificial Sequence
  chemically synthesized
ttcacagaaaagaaaataca

SEQ ID NO: 488419 - DNA, 20 bp, Artificial Sequence
  chemically synthesized
agcatagtgtacctgcagac

SEQ ID NO: 488420 - DNA, 20 bp, Artificial Sequence
  chemically synthesized
acttcccaccagccacgtag

SEQ ID NO: 488421 - DNA, 20 bp, Artificial Sequence
  chemically synthesized
gacctggaaattttattccc

SEQ ID NO: 488422 - DNA, 20 bp, Artificial Sequence
  chemically synthesized
aatctacaaaataaattcct

SEQ ID NO: 488423 - DNA, 20 bp, Artificial Sequence
  chemically synthesized
ttattttgtagatttgtttc

SEQ ID NO: 488424 - DNA, 20 bp, Artificial Sequence
  chemically synthesized
aattaaggttaatgtgcagt

SEQ ID NO: 488425 - DNA, 20 bp, Artificial Sequence
  chemically synthesized
cagtgagggtagagcagatg

SEQ ID NO: 488426 - DNA, 20 bp, Artificial Sequence
  chemically synthesized
agggtagagcagatgatggg

SEQ ID NO: 488427 - DNA, 20 bp, Artificial Sequence
  chemically synthesized
taacaaagacatatctgaga

SEQ ID NO: 488428 - DNA, 20 bp, Artificial Sequence
  chemically synthesized
cccccccgccatgtagaatg

SEQ ID NO: 488429 - DNA, 20 bp, Artificial Sequence
  chemically synthesized
tgaggcccccccccgccatg

SEQ ID NO: 488430 - DNA, 20 bp, Artificial Sequence
  chemically synthesized
ctctcttccctgctgccatg

SEQ ID NO: 488431 - DNA, 20 bp, Artificial Sequence
  chemically synthesized
gatctgatagttttataaat

SEQ ID NO: 488432 - DNA, 20 bp, Artificial Sequence
  chemically synthesized
attatcaggagaacagtatg

SEQ ID NO: 488433 - DNA, 20 bp, Artificial Sequence
  chemically synthesized
cagataattgaatcatggaa

SEQ ID NO: 488434 - DNA, 20 bp, Artificial Sequence
  chemically synthesized
gtggagccaggtgcagataa

SEQ ID NO: 488435 - DNA, 20 bp, Artificial Sequence
  chemically synthesized
tggctccacccttgacatgt

SEQ ID NO: 488436 - DNA, 20 bp, Artificial Sequence
  chemically synthesized
tatggtaatccccacatgtc

SEQ ID NO: 488437 - DNA, 20 bp, Artificial Sequence
  chemically synthesized
gtccccacccaaatctcacc

SEQ ID NO: 488438 - DNA, 20 bp, Artificial Sequence
  chemically synthesized
accataattcaaggtgagat

SEQ ID NO: 488439 - DNA, 20 bp, Artificial Sequence
  chemically synthesized
acactttgcatattttaata

SEQ ID NO: 488440 - DNA, 20 bp, Artificial Sequence
  chemically synthesized
tggctttagatatgttatac

SEQ ID NO: 488441 - DNA, 20 bp, Artificial Sequence
  chemically synthesized
catcagtgaaaaatgctctg

SEQ ID NO: 488442 - DNA, 20 bp, Artificial Sequence
  chemically synthesized
ttggcaatatcacttaatgg

SEQ ID NO: 488443 - DNA, 20 bp, Artificial Sequence
  chemically synthesized
tgcactttaaaacagtttcc

SEQ ID NO: 488444 - DNA, 20 bp, Artificial Sequence
  chemically synthesized
taaaacagtttccaggaatc

SEQ ID NO: 488445 - DNA, 20 bp, Artificial Sequence
  chemically synthesized
atatttttccgtgaagtatt

SEQ ID NO: 488446 - DNA, 20 bp, Artificial Sequence
  chemically synthesized
cacggaaaaatataacaggt

SEQ ID NO: 488447 - DNA, 20 bp, Artificial Sequence
  chemically synthesized
gtaaattaatttaaaacaca

SEQ ID NO: 488448 - DNA, 20 bp, Artificial Sequence
  chemically synthesized
gtttgtgtctatactttgat

SEQ ID NO: 488449 - DNA, 20 bp, Artificial Sequence
  chemically synthesized
catggttttataatacataa

SEQ ID NO: 488450 - DNA, 20 bp, Artificial Sequence
  chemically synthesized
taaattaacacataagggaa

SEQ ID NO: 488451 - DNA, 20 bp, Artificial Sequence
  chemically synthesized
gatactaaattaacacataa

SEQ ID NO: 488452 - DNA, 20 bp, Artificial Sequence
  chemically synthesized
tttccttattctttcaatct

SEQ ID NO: 488453 - DNA, 20 bp, Artificial Sequence
  chemically synthesized
aattaacattcagagattga

SEQ ID NO: 488454 - DNA, 20 bp, Artificial Sequence
  chemically synthesized
ttagaaataaacatattaag

SEQ ID NO: 488455 - DNA, 20 bp, Artificial Sequence
  chemically synthesized
ataaaaatagtaagaagaac

SEQ ID NO: 488456 - DNA, 20 bp, Artificial Sequence
  chemically synthesized
aagccttttagaagcaaaaa

SEQ ID NO: 488457 - DNA, 20 bp, Artificial Sequence
  chemically synthesized
aaaaaaagaatataaaaaga

SEQ ID NO: 488458 - DNA, 20 bp, Artificial Sequence
  chemically synthesized
ttagtggctttaatttataa

SEQ ID NO: 488459 - DNA, 20 bp, Artificial Sequence
  chemically synthesized
aattaaaacaaatgacaact

SEQ ID NO: 488460 - DNA, 20 bp, Artificial Sequence
  chemically synthesized
tttgcagcatatatcagaca

SEQ ID NO: 488461 - DNA, 20 bp, Artificial Sequence
  chemically synthesized
gcatataaaaaaatctttta

SEQ ID NO: 488462 - DNA, 20 bp, Artificial Sequence
  chemically synthesized
aggaaaaatctactggaaaa

SEQ ID NO: 488463 - DNA, 20 bp, Artificial Sequence
  chemically synthesized
tttcattgattactaactgt

SEQ ID NO: 488464 - DNA, 20 bp, Artificial Sequence
  chemically synthesized
agtctgttgactgaaatgtg

SEQ ID NO: 488465 - DNA, 20 bp, Artificial Sequence
  chemically synthesized
tcagctccattgtaatctca

SEQ ID NO: 488466 - DNA, 20 bp, Artificial Sequence
  chemically synthesized
ctgtgacatcactaggtaat

SEQ ID NO: 488467 - DNA, 20 bp, Artificial Sequence
  chemically synthesized
cctagtgatgtcacagtgca

SEQ ID NO: 488468 - DNA, 20 bp, Artificial Sequence
  chemically synthesized
accagcatcaccacaaacgt

SEQ ID NO: 488469 - DNA, 20 bp, Artificial Sequence
  chemically synthesized
tgccttcttttgaactaatt

SEQ ID NO: 488470 - DNA, 20 bp, Artificial Sequence
  chemically synthesized
ttcatgaaactatcatctca

SEQ ID NO: 488471 - DNA, 20 bp, Artificial Sequence
  chemically synthesized
tcctatgagatgatagtttc

SEQ ID NO: 488472 - DNA, 20 bp, Artificial Sequence
  chemically synthesized
gagcctaggcctacatgggt

SEQ ID NO: 488473 - DNA, 20 bp, Artificial Sequence
  chemically synthesized
gcacatgagcctaggcctac

SEQ ID NO: 488474 - DNA, 20 bp, Artificial Sequence
  chemically synthesized
aataagaaagctgctacaat

SEQ ID NO: 488475 - DNA, 20 bp, Artificial Sequence
  chemically synthesized
aggatataaaatatttttgt

SEQ ID NO: 488476 - DNA, 20 bp, Artificial Sequence
  chemically synthesized
ttttaagctaagtgttatta

SEQ ID NO: 488477 - DNA, 20 bp, Artificial Sequence
  chemically synthesized
gcctcggcctcccaaagtgc

SEQ ID NO: 488478 - DNA, 20 bp, Artificial Sequence
  chemically synthesized
cagcactttgggaggccgag

SEQ ID NO: 488479 - DNA, 20 bp, Artificial Sequence
  chemically synthesized
actttgggaggccgaggcgg

SEQ ID NO: 488480 - DNA, 20 bp, Artificial Sequence
  chemically synthesized
tggggtttcaccgtgttagc

SEQ ID NO: 488481 - DNA, 20 bp, Artificial Sequence
  chemically synthesized
ttttgtatttttagtagaga

SEQ ID NO: 488482 - DNA, 20 bp, Artificial Sequence
  chemically synthesized
tgctctgggtgagtcggtga

SEQ ID NO: 488483 - DNA, 20 bp, Artificial Sequence
  chemically synthesized
aagttgctctgggtgagtcg

SEQ ID NO: 488484 - DNA, 20 bp, Artificial Sequence
  chemically synthesized
aggactcaaagttgctctgg

SEQ ID NO: 488485 - DNA, 20 bp, Artificial Sequence
  chemically synthesized
ccgactcacccagagcaact

SEQ ID NO: 488486 - DNA, 20 bp, Artificial Sequence
  chemically synthesized
ttgcaggactcaaagttgct

SEQ ID NO: 488487 - DNA, 20 bp, Artificial Sequence
  chemically synthesized
agctgcatacggtatttacc

SEQ ID NO: 488488 - DNA, 20 bp, Artificial Sequence
  chemically synthesized
ctgtactgcatgtgacttta

SEQ ID NO: 488489 - DNA, 20 bp, Artificial Sequence
  chemically synthesized
aatatgctgtaccatatagc

SEQ ID NO: 488490 - DNA, 20 bp, Artificial Sequence
  chemically synthesized
attttgttgttgtataatca

SEQ ID NO: 488491 - DNA, 20 bp, Artificial Sequence
  chemically synthesized
tagaagcttaacttttcggt

SEQ ID NO: 488492 - DNA, 20 bp, Artificial Sequence
  chemically synthesized
tcagtagtgtttgtagtttc

SEQ ID NO: 488493 - DNA, 20 bp, Artificial Sequence
  chemically synthesized
aatagaggactaccttcttc

SEQ ID NO: 488494 - DNA, 20 bp, Artificial Sequence
  chemically synthesized
caattttgattgagattgca

SEQ ID NO: 488495 - DNA, 20 bp, Artificial Sequence
  chemically synthesized
ttgcacttacatataaatct

SEQ ID NO: 488496 - DNA, 20 bp, Artificial Sequence
  chemically synthesized
atatgtaagtgcaaagggct

SEQ ID NO: 488497 - DNA, 20 bp, Artificial Sequence
  chemically synthesized
cgtcgttcttcaaagttgcc

SEQ ID NO: 488498 - DNA, 20 bp, Artificial Sequence
  chemically synthesized
tttgaagaacgacgaagttt

SEQ ID NO: 488499 - DNA, 20 bp, Artificial Sequence
  chemically synthesized
aagaatgtttgccaccagac

SEQ ID NO: 488500 - DNA, 20 bp, Artificial Sequence
  chemically synthesized
ttattataattaagcctgtg

SEQ ID NO: 488501 - DNA, 20 bp, Artificial Sequence
  chemically synthesized
tggtgtcacttaagttggaa

SEQ ID NO: 488502 - DNA, 20 bp, Artificial Sequence
  chemically synthesized
tatgttttgtgtatgatgtg

SEQ ID NO: 488503 - DNA, 20 bp, Artificial Sequence
  chemically synthesized
attgaggtctgcaaacaatc

SEQ ID NO: 488504 - DNA, 20 bp, Artificial Sequence
  chemically synthesized
taacaatctttcctgataaa

SEQ ID NO: 488505 - DNA, 20 bp, Artificial Sequence
  chemically synthesized
ctttgtcagatctatgcatt

SEQ ID NO: 488506 - DNA, 20 bp, Artificial Sequence
  chemically synthesized
cttactgatgtagaagttat

SEQ ID NO: 488507 - DNA, 20 bp, Artificial Sequence
  chemically synthesized
tgcataatgacttcacataa

SEQ ID NO: 488508 - DNA, 20 bp, Artificial Sequence
  chemically synthesized
ttatccttttaaccatttag

SEQ ID NO: 488509 - DNA, 20 bp, Artificial Sequence
  chemically synthesized
acattcacctaaatggttaa

SEQ ID NO: 488510 - DNA, 20 bp, Artificial Sequence
  chemically synthesized
gttgaaaatacatactcttg

SEQ ID NO: 488511 - DNA, 20 bp, Artificial Sequence
  chemically synthesized
agttgatccacatattcatc

SEQ ID NO: 488512 - DNA, 20 bp, Artificial Sequence
  chemically synthesized
tacatactcttgatgaatat

SEQ ID NO: 488513 - DNA, 20 bp, Artificial Sequence
  chemically synthesized
aagatgtgtacatttggctt

SEQ ID NO: 488514 - DNA, 20 bp, Artificial Sequence
  chemically synthesized
gcccaatgtccattgattag

SEQ ID NO: 488515 - DNA, 20 bp, Artificial Sequence
  chemically synthesized
aatgtccattgattagcaga

SEQ ID NO: 488516 - DNA, 20 bp, Artificial Sequence
  chemically synthesized
actgtggcatattcacacaa

SEQ ID NO: 488517 - DNA, 20 bp, Artificial Sequence
  chemically synthesized
tatgtatggtattctattgt

SEQ ID NO: 488518 - DNA, 20 bp, Artificial Sequence
  chemically synthesized
ctatggcacaggcaatagca

SEQ ID NO: 488519 - DNA, 20 bp, Artificial Sequence
  chemically synthesized
gtcaaatacaagggcatata

SEQ ID NO: 488520 - DNA, 20 bp, Artificial Sequence
  chemically synthesized
gactttgaaattactataaa

SEQ ID NO: 488521 - DNA, 20 bp, Artificial Sequence
  chemically synthesized
atctaggtgttagaagtcaa

SEQ ID NO: 488522 - DNA, 20 bp, Artificial Sequence
  chemically synthesized
aagagtgcttatctttggga

SEQ ID NO: 488523 - DNA, 20 bp, Artificial Sequence
  chemically synthesized
atgctactaccaccaagttc

SEQ ID NO: 488524 - DNA, 20 bp, Artificial Sequence
  chemically synthesized
ttgaacttggtggtagtagc

SEQ ID NO: 488525 - DNA, 20 bp, Artificial Sequence
  chemically synthesized
taagttttttttaaaaatcc

SEQ ID NO: 488526 - DNA, 20 bp, Artificial Sequence
  chemically synthesized
aatcataagaatagaaattc

SEQ ID NO: 488527 - DNA, 20 bp, Artificial Sequence
  chemically synthesized
tagaaaagtacacaaatcat

SEQ ID NO: 488528 - DNA, 20 bp, Artificial Sequence
  chemically synthesized
gcattttggagttgaaggga

SEQ ID NO: 488529 - DNA, 20 bp, Artificial Sequence
  chemically synthesized
agtagcattttggagttgaa

SEQ ID NO: 488530 - DNA, 20 bp, Artificial Sequence
  chemically synthesized
aattcatagaagtagcattt

SEQ ID NO: 488531 - DNA, 20 bp, Artificial Sequence
  chemically synthesized
aactccaaaatgctacttct

SEQ ID NO: 488532 - DNA, 20 bp, Artificial Sequence
  chemically synthesized
acttctatgaattttcctag

SEQ ID NO: 488533 - DNA, 20 bp, Artificial Sequence
  chemically synthesized
taaacacagagacctatgac

SEQ ID NO: 488534 - DNA, 20 bp, Artificial Sequence
  chemically synthesized
atttcgtttcactttttcgc

SEQ ID NO: 488535 - DNA, 20 bp, Artificial Sequence
  chemically synthesized
tgaaacgaaatctccccaaa

SEQ ID NO: 488536 - DNA, 20 bp, Artificial Sequence
  chemically synthesized
attaatatttttcagtgtaa

SEQ ID NO: 488537 - DNA, 20 bp, Artificial Sequence
  chemically synthesized
atcgacacacagcaaaggac

SEQ ID NO: 488538 - DNA, 20 bp, Artificial Sequence
  chemically synthesized
agatatcatcttatacctgt

SEQ ID NO: 488539 - DNA, 20 bp, Artificial Sequence
  chemically synthesized
gacaaaagaaaagtgttggc

SEQ ID NO: 488540 - DNA, 20 bp, Artificial Sequence
  chemically synthesized
cattcccatcaacattgtac

SEQ ID NO: 488541 - DNA, 20 bp, Artificial Sequence
  chemically synthesized
aacccttgtacaatgttgat

SEQ ID NO: 488542 - DNA, 20 bp, Artificial Sequence
  chemically synthesized
agttctatttttaatgtttt

SEQ ID NO: 488543 - DNA, 20 bp, Artificial Sequence
  chemically synthesized
aaatactgatttcagttctt

SEQ ID NO: 488544 - DNA, 20 bp, Artificial Sequence
  chemically synthesized
tatttgcaatagccaagata

SEQ ID NO: 488545 - DNA, 20 bp, Artificial Sequence
  chemically synthesized
ctttctttcctaaggctgaa

SEQ ID NO: 488546 - DNA, 20 bp, Artificial Sequence
  chemically synthesized
gatttctttctttcctaagg

SEQ ID NO: 488547 - DNA, 20 bp, Artificial Sequence
  chemically synthesized
atccgtgttgttgcaaatga

SEQ ID NO: 488548 - DNA, 20 bp, Artificial Sequence
  chemically synthesized
atcctgtcatttgcaacaac

SEQ ID NO: 488549 - DNA, 20 bp, Artificial Sequence
  chemically synthesized
caccatttttctctgtttct

SEQ ID NO: 488550 - DNA, 20 bp, Artificial Sequence
  chemically synthesized
aatggtggttattagatcct

SEQ ID NO: 488551 - DNA, 20 bp, Artificial Sequence
  chemically synthesized
tggttattagatcctggggg

SEQ ID NO: 488552 - DNA, 20 bp, Artificial Sequence
  chemically synthesized
ctcccaaatcaccccacccc

SEQ ID NO: 488553 - DNA, 20 bp, Artificial Sequence
  chemically synthesized
cacaatttcagtttgacagg

SEQ ID NO: 488554 - DNA, 20 bp, Artificial Sequence
  chemically synthesized
cctgagttacaacagataac

SEQ ID NO: 488555 - DNA, 20 bp, Artificial Sequence
  chemically synthesized
cctagttatctgttgtaact

SEQ ID NO: 488556 - DNA, 20 bp, Artificial Sequence
  chemically synthesized
tgttactaacagtagtcacc

SEQ ID NO: 488557 - DNA, 20 bp, Artificial Sequence
  chemically synthesized
aataataagtatgtaaggta

SEQ ID NO: 488558 - DNA, 20 bp, Artificial Sequence
  chemically synthesized
atattgtgaaataaacattg

SEQ ID NO: 488559 - DNA, 20 bp, Artificial Sequence
  chemically synthesized
acacatagattttcatattt

SEQ ID NO: 488560 - DNA, 20 bp, Artificial Sequence
  chemically synthesized
cacactttagtaaccttgaa

SEQ ID NO: 488561 - DNA, 20 bp, Artificial Sequence
  chemically synthesized
tttcaaagttaccactcaga

SEQ ID NO: 488562 - DNA, 20 bp, Artificial Sequence
  chemically synthesized
taaaacatataatattcttt

SEQ ID NO: 488563 - DNA, 20 bp, Artificial Sequence
  chemically synthesized
tattgttgctaatatttcag

SEQ ID NO: 488564 - DNA, 20 bp, Artificial Sequence
  chemically synthesized
catatttcaggtacttcatg

SEQ ID NO: 488565 - DNA, 20 bp, Artificial Sequence
  chemically synthesized
atcatgggtagaataagaaa

SEQ ID NO: 488566 - DNA, 20 bp, Artificial Sequence
  chemically synthesized
gtacttcataggatcatggg

SEQ ID NO: 488567 - DNA, 20 bp, Artificial Sequence
  chemically synthesized
gttatgtacttcataggatc

SEQ ID NO: 488568 - DNA, 20 bp, Artificial Sequence
  chemically synthesized
agaaaatgttatgtacttca

SEQ ID NO: 488569 - DNA, 20 bp, Artificial Sequence
  chemically synthesized
attttctaaaattatcaagt

SEQ ID NO: 488570 - DNA, 20 bp, Artificial Sequence
  chemically synthesized
aattatcaagtgaggatatt

SEQ ID NO: 488571 - DNA, 20 bp, Artificial Sequence
  chemically synthesized
tgttacttactagtaacctt

SEQ ID NO: 488572 - DNA, 20 bp, Artificial Sequence
  chemically synthesized
gaatatgaagtcagtaaaac

SEQ ID NO: 488573 - DNA, 20 bp, Artificial Sequence
  chemically synthesized
gggaagagggaaggaaagag

SEQ ID NO: 488574 - DNA, 20 bp, Artificial Sequence
  chemically synthesized
tgggagggaagagggaagga

SEQ ID NO: 488575 - DNA, 20 bp, Artificial Sequence
  chemically synthesized
cctcggcctccccaaagtgc

SEQ ID NO: 488576 - DNA, 20 bp, Artificial Sequence
  chemically synthesized
ctttggggaggccgaggcgg

SEQ ID NO: 488577 - DNA, 20 bp, Artificial Sequence
  chemically synthesized
cggggtttcaccgtgttagc

SEQ ID NO: 488578 - DNA, 20 bp, Artificial Sequence
  chemically synthesized
ttttgtatttttagtagaga

SEQ ID NO: 488579 - DNA, 20 bp, Artificial Sequence
  chemically synthesized
cattctcctgcctcagcctc

SEQ ID NO: 488580 - DNA, 20 bp, Artificial Sequence
  chemically synthesized
tactctggaggctgaggcag

SEQ ID NO: 488581 - DNA, 20 bp, Artificial Sequence
  chemically synthesized
aatggtgtgaacttaggagg

SEQ ID NO: 488582 - DNA, 20 bp, Artificial Sequence
  chemically synthesized
tctcgctctgtcgcccaggc

SEQ ID NO: 488583 - DNA, 20 bp, Artificial Sequence
  chemically synthesized
ttttttttttttttgtgaga

SEQ ID NO: 488584 - DNA, 20 bp, Artificial Sequence
  chemically synthesized
aaaaagacatcatttgataa

SEQ ID NO: 488585 - DNA, 20 bp, Artificial Sequence
  chemically synthesized
gcttttcaatagttatttgt

SEQ ID NO: 488586 - DNA, 20 bp, Artificial Sequence
  chemically synthesized
ctttaatgatactaagtatt

SEQ ID NO: 488587 - DNA, 20 bp, Artificial Sequence
  chemically synthesized
caagtaaacatattttgaaa

SEQ ID NO: 488588 - DNA, 20 bp, Artificial Sequence
  chemically synthesized
ttttgaaaatgaatattaat

SEQ ID NO: 488589 - DNA, 20 bp, Artificial Sequence
  chemically synthesized
atggggactagaagaacagt

SEQ ID NO: 488590 - DNA, 20 bp, Artificial Sequence
  chemically synthesized
aatgcttatcaaatgcattt

SEQ ID NO: 488591 - DNA, 20 bp, Artificial Sequence
  chemically synthesized
atgataatttaaacatgatt

SEQ ID NO: 488592 - DNA, 20 bp, Artificial Sequence
  chemically synthesized
aaagattaaaaataataata

SEQ ID NO: 488593 - DNA, 20 bp, Artificial Sequence
  chemically synthesized
tcatgtaaattattacttat

SEQ ID NO: 488594 - DNA, 20 bp, Artificial Sequence
  chemically synthesized
caaaaaatttaatgtaaatg

SEQ ID NO: 488595 - DNA, 20 bp, Artificial Sequence
  chemically synthesized
ttttttaagtacagaagttt

SEQ ID NO: 488596 - DNA, 20 bp, Artificial Sequence
  chemically synthesized
cttaaaaaataaagacttga

SEQ ID NO: 488597 - DNA, 20 bp, Artificial Sequence
  chemically synthesized
tagttaggaattgtgtgaga

SEQ ID NO: 488598 - DNA, 20 bp, Artificial Sequence
  chemically synthesized
cattcatctggtatttagtt

SEQ ID NO: 488599 - DNA, 20 bp, Artificial Sequence
  chemically synthesized
aattcctaactaaataccag

SEQ ID NO: 488600 - DNA, 20 bp, Artificial Sequence
  chemically synthesized
ggcttttaaattaaaattat

SEQ ID NO: 488601 - DNA, 20 bp, Artificial Sequence
  chemically synthesized
taaagaaattttatactgct

SEQ ID NO: 488602 - DNA, 20 bp, Artificial Sequence
  chemically synthesized
atcttaagagtgtcaaaaag

SEQ ID NO: 488603 - DNA, 20 bp, Artificial Sequence
  chemically synthesized
tgtgagaatgtttttatctt

SEQ ID NO: 488604 - DNA, 20 bp, Artificial Sequence
  chemically synthesized
ctttttttctactgatttgt

SEQ ID NO: 488605 - DNA, 20 bp, Artificial Sequence
  chemically synthesized
aagacaaatactcaattaaa

SEQ ID NO: 488606 - DNA, 20 bp, Artificial Sequence
  chemically synthesized
ttcctcattatcctttttaa

SEQ ID NO: 488607 - DNA, 20 bp, Artificial Sequence
  chemically synthesized
ctcaattaaaaaggataatg

SEQ ID NO: 488608 - DNA, 20 bp, Artificial Sequence
  chemically synthesized
gcaatattacacctccctgt

SEQ ID NO: 488609 - DNA, 20 bp, Artificial Sequence
  chemically synthesized
catacaacagaaattgtgtg

SEQ ID NO: 488610 - DNA, 20 bp, Artificial Sequence
  chemically synthesized
aacagaaattgtgtggtgaa

SEQ ID NO: 488611 - DNA, 20 bp, Artificial Sequence
  chemically synthesized
aaataaaatgaaatatctct

SEQ ID NO: 488612 - DNA, 20 bp, Artificial Sequence
  chemically synthesized
aaatgaaatatctctgggag

SEQ ID NO: 488613 - DNA, 20 bp, Artificial Sequence
  chemically synthesized
aaatatctctgggagtgggg

SEQ ID NO: 488614 - DNA, 20 bp, Artificial Sequence
  chemically synthesized
tttcaaaaaaattttctgca

SEQ ID NO: 488615 - DNA, 20 bp, Artificial Sequence
  chemically synthesized
caataatactacctgtatta

SEQ ID NO: 488616 - DNA, 20 bp, Artificial Sequence
  chemically synthesized
ctgtgaaatggtaaccaagc

SEQ ID NO: 488617 - DNA, 20 bp, Artificial Sequence
  chemically synthesized
aggcttcaaagcctaacttc

SEQ ID NO: 488618 - DNA, 20 bp, Artificial Sequence
  chemically synthesized
taaaatagtacagtggttaa

SEQ ID NO: 488619 - DNA, 20 bp, Artificial Sequence
  chemically synthesized
ctcaaagtcatatagctaaa

SEQ ID NO: 488620 - DNA, 20 bp, Artificial Sequence
  chemically synthesized
actttgagaaaatatactat

SEQ ID NO: 488621 - DNA, 20 bp, Artificial Sequence
  chemically synthesized
aagctccagtcagtacctaa

SEQ ID NO: 488622 - DNA, 20 bp, Artificial Sequence
  chemically synthesized
ttcataactttgaaagtaag

SEQ ID NO: 488623 - DNA, 20 bp, Artificial Sequence
  chemically synthesized
atgagtggcagttttgaaaa

SEQ ID NO: 488624 - DNA, 20 bp, Artificial Sequence
  chemically synthesized
aattttaagcaagagaatca

SEQ ID NO: 488625 - DNA, 20 bp, Artificial Sequence
  chemically synthesized
agtcacacaattttaagcaa

SEQ ID NO: 488626 - DNA, 20 bp, Artificial Sequence
  chemically synthesized
tttgttattaggaagatttg

SEQ ID NO: 488627 - DNA, 20 bp, Artificial Sequence
  chemically synthesized
aaaagaagacattttaatgg

SEQ ID NO: 488628 - DNA, 20 bp, Artificial Sequence
  chemically synthesized
ccaaaacatgaaggattggg

SEQ ID NO: 488629 - DNA, 20 bp, Artificial Sequence
  chemically synthesized
tcttcccaatccttcatgtt

SEQ ID NO: 488630 - DNA, 20 bp, Artificial Sequence
  chemically synthesized
cttttattacccaaaacatg

SEQ ID NO: 488631 - DNA, 20 bp, Artificial Sequence
  chemically synthesized
gaatcattatttccttccag

SEQ ID NO: 488632 - DNA, 20 bp, Artificial Sequence
  chemically synthesized
taatgctagagtttattaga

SEQ ID NO: 488633 - DNA, 20 bp, Artificial Sequence
  chemically synthesized
gtagcccaggtaattaatgc

SEQ ID NO: 488634 - DNA, 20 bp, Artificial Sequence
  chemically synthesized
tcttgtctctccccaaaagc

SEQ ID NO: 488635 - DNA, 20 bp, Artificial Sequence
  chemically synthesized
aattgtggctgtgtgtatgt

SEQ ID NO: 488636 - DNA, 20 bp, Artificial Sequence
  chemically synthesized
acacatacacacagccacaa

SEQ ID NO: 488637 - DNA, 20 bp, Artificial Sequence
  chemically synthesized
ttctcttttctgttttatta

SEQ ID NO: 488638 - DNA, 20 bp, Artificial Sequence
  chemically synthesized
acatagcctaaaatgggaaa

SEQ ID NO: 488639 - DNA, 20 bp, Artificial Sequence
  chemically synthesized
tttcccattttaggctatgt

SEQ ID NO: 488640 - DNA, 20 bp, Artificial Sequence
  chemically synthesized
ttctgactgtgctagtgaac

SEQ ID NO: 488641 - DNA, 20 bp, Artificial Sequence
  chemically synthesized
gactagtgaaatttgatgtg

SEQ ID NO: 488642 - DNA, 20 bp, Artificial Sequence
  chemically synthesized
gaaatttgatgtgaggaata

SEQ ID NO: 488643 - DNA, 20 bp, Artificial Sequence
  chemically synthesized
gtgaggaatacagagtagaa

SEQ ID NO: 488644 - DNA, 20 bp, Artificial Sequence
  chemically synthesized
agaagagggtagaccctctt

SEQ ID NO: 488645 - DNA, 20 bp, Artificial Sequence
  chemically synthesized
tcctcttgactgaccctcaa

SEQ ID NO: 488646 - DNA, 20 bp, Artificial Sequence
  chemically synthesized
agggtcagtcaagaggacta

SEQ ID NO: 488647 - DNA, 20 bp, Artificial Sequence
  chemically synthesized
taactaacagaaaacatatc

SEQ ID NO: 488648 - DNA, 20 bp, Artificial Sequence
  chemically synthesized
ctgttagttagcttgatgtc

SEQ ID NO: 488649 - DNA, 20 bp, Artificial Sequence
  chemically synthesized
cctagccctgtctccagccc

SEQ ID NO: 488650 - DNA, 20 bp, Artificial Sequence
  chemically synthesized
atattgattgaattaattac

SEQ ID NO: 488651 - DNA, 20 bp, Artificial Sequence
  chemically synthesized
agctactaggtaaatattga

SEQ ID NO: 488652 - DNA, 20 bp, Artificial Sequence
  chemically synthesized
tttagctattttcaaggtag

SEQ ID NO: 488653 - DNA, 20 bp, Artificial Sequence
  chemically synthesized
tagctaaataacagcgcact

SEQ ID NO: 488654 - DNA, 20 bp, Artificial Sequence
  chemically synthesized
atatttgcctaaaatgcatt

SEQ ID NO: 488655 - DNA, 20 bp, Artificial Sequence
  chemically synthesized
tgatttttggttgggggcaa

SEQ ID NO: 488656 - DNA, 20 bp, Artificial Sequence
  chemically synthesized
aaaagaagataatggtttac

SEQ ID NO: 488657 - DNA, 20 bp, Artificial Sequence
  chemically synthesized
atgtaaaccattatcttctt

SEQ ID NO: 488658 - DNA, 20 bp, Artificial Sequence
  chemically synthesized
cacgtagtatgaaatatttg

SEQ ID NO: 488659 - DNA, 20 bp, Artificial Sequence
  chemically synthesized
gagaccagttgtaaaaataa

SEQ ID NO: 488660 - DNA, 20 bp, Artificial Sequence
  chemically synthesized
aaataaatgacctcctagtg

SEQ ID NO: 488661 - DNA, 20 bp, Artificial Sequence
  chemically synthesized
ggaaatttaataaaataatg

SEQ ID NO: 488662 - DNA, 20 bp, Artificial Sequence
  chemically synthesized
tagtcacttttacattgtat

SEQ ID NO: 488663 - DNA, 20 bp, Artificial Sequence
  chemically synthesized
gagagctatgccactggggg

SEQ ID NO: 488664 - DNA, 20 bp, Artificial Sequence
  chemically synthesized
gcccccagtggcatagctct

SEQ ID NO: 488665 - DNA, 20 bp, Artificial Sequence
  chemically synthesized
gaatattactttaaaagtaa

SEQ ID NO: 488666 - DNA, 20 bp, Artificial Sequence
  chemically synthesized
ggatttcctttttaaagcat

SEQ ID NO: 488667 - DNA, 20 bp, Artificial Sequence
  chemically synthesized
taaccacttcattaccacac

SEQ ID NO: 488668 - DNA, 20 bp, Artificial Sequence
  chemically synthesized
ttttagtgtggtaataaggg

SEQ ID NO: 488669 - DNA, 20 bp, Artificial Sequence
  chemically synthesized
tactgcaaacaaataaatta

SEQ ID NO: 488670 - DNA, 20 bp, Artificial Sequence
  chemically synthesized
agcatctaactccatggtca

SEQ ID NO: 488671 - DNA, 20 bp, Artificial Sequence
  chemically synthesized
tattaagtattctttgacca

SEQ ID NO: 488672 - DNA, 20 bp, Artificial Sequence
  chemically synthesized
aagaatacttaataatatac

SEQ ID NO: 488673 - DNA, 20 bp, Artificial Sequence
  chemically synthesized
ttaataatatacgtgagtac

SEQ ID NO: 488674 - DNA, 20 bp, Artificial Sequence
  chemically synthesized
aagggcttgttacctaactt

SEQ ID NO: 488675 - DNA, 20 bp, Artificial Sequence
  chemically synthesized
ggaggcattagacaaatgaa

SEQ ID NO: 488676 - DNA, 20 bp, Artificial Sequence
  chemically synthesized
caaacctcaatagttctaaa

SEQ ID NO: 488677 - DNA, 20 bp, Artificial Sequence
  chemically synthesized
agttctaaaatggattttat

SEQ ID NO: 488678 - DNA, 20 bp, Artificial Sequence
  chemically synthesized
gtgggtaggtggatagttag

SEQ ID NO: 488679 - DNA, 20 bp, Artificial Sequence
  chemically synthesized
agtgaagagtttgtgggtag

SEQ ID NO: 488680 - DNA, 20 bp, Artificial Sequence
  chemically synthesized
cattatttagtgaagagttt

SEQ ID NO: 488681 - DNA, 20 bp, Artificial Sequence
  chemically synthesized
caaaatcacattatttagtg

SEQ ID NO: 488682 - DNA, 20 bp, Artificial Sequence
  chemically synthesized
tctttaaattttattgtcct

SEQ ID NO: 488683 - DNA, 20 bp, Artificial Sequence
  chemically synthesized
acacacacacacgcacacca

SEQ ID NO: 488684 - DNA, 20 bp, Artificial Sequence
  chemically synthesized
gggagagagggagaaaaata

SEQ ID NO: 488685 - DNA, 20 bp, Artificial Sequence
  chemically synthesized
tactttgtagagcctttgtt

SEQ ID NO: 488686 - DNA, 20 bp, Artificial Sequence
  chemically synthesized
gatttctgattggagagtgt

SEQ ID NO: 488687 - DNA, 20 bp, Artificial Sequence
  chemically synthesized
agatcaaagatttctgattg

SEQ ID NO: 488688 - DNA, 20 bp, Artificial Sequence
  chemically synthesized
ctgatacagaaaaatgtccc

SEQ ID NO: 488689 - DNA, 20 bp, Artificial Sequence
  chemically synthesized
tattaaaaatgatatttcct

SEQ ID NO: 488690 - DNA, 20 bp, Artificial Sequence
  chemically synthesized
agatcatgacttagttttcc

SEQ ID NO: 488691 - DNA, 20 bp, Artificial Sequence
  chemically synthesized
tttgttatggttcttgttgc

SEQ ID NO: 488692 - DNA, 20 bp, Artificial Sequence
  chemically synthesized
gttaaaatttggtttcttaa

SEQ ID NO: 488693 - DNA, 20 bp, Artificial Sequence
  chemically synthesized
ttatataaatcactgtactt

SEQ ID NO: 488694 - DNA, 20 bp, Artificial Sequence
  chemically synthesized
aaatcactgtacttcagaat

SEQ ID NO: 488695 - DNA, 20 bp, Artificial Sequence
  chemically synthesized
taaatgaaacttctgaattt

SEQ ID NO: 488696 - DNA, 20 bp, Artificial Sequence
  chemically synthesized
ttgtttcttaaatgaaactt

SEQ ID NO: 488697 - DNA, 20 bp, Artificial Sequence
  chemically synthesized
atttaagaaacaatttagct

SEQ ID NO: 488698 - DNA, 20 bp, Artificial Sequence
  chemically synthesized
tcctcggcctcccaaagtgc

SEQ ID NO: 488699 - DNA, 20 bp, Artificial Sequence
  chemically synthesized
aaggaggactgcttgagccc

SEQ ID NO: 488700 - DNA, 20 bp, Artificial Sequence
  chemically synthesized
ggactgcttgagcccaggag

SEQ ID NO: 488701 - DNA, 20 bp, Artificial Sequence
  chemically synthesized
tctgccctgtctaatacaat

SEQ ID NO: 488702 - DNA, 20 bp, Artificial Sequence
  chemically synthesized
ttcaagataacttttttata

SEQ ID NO: 488703 - DNA, 20 bp, Artificial Sequence
  chemically synthesized
atagtttcaataatatgacc

SEQ ID NO: 488704 - DNA, 20 bp, Artificial Sequence
  chemically synthesized
tttgttttgttttttagaga

SEQ ID NO: 488705 - DNA, 20 bp, Artificial Sequence
  chemically synthesized
ttgttttgttttgtttttta

SEQ ID NO: 488706 - DNA, 20 bp, Artificial Sequence
  chemically synthesized
ttcagatgaaggcaaaggaa

SEQ ID NO: 488707 - DNA, 20 bp, Artificial Sequence
  chemically synthesized
ttccattcagatgaaggcaa

SEQ ID NO: 488708 - DNA, 20 bp, Artificial Sequence
  chemically synthesized
tcctattcctttgccttcat

SEQ ID NO: 488709 - DNA, 20 bp, Artificial Sequence
  chemically synthesized
ttcctttgccttcatctgaa

SEQ ID NO: 488710 - DNA, 20 bp, Artificial Sequence
  chemically synthesized
tacacatagaaaagataaat

SEQ ID NO: 488711 - DNA, 20 bp, Artificial Sequence
  chemically synthesized
atgcatcaaattgcaacaat

SEQ ID NO: 488712 - DNA, 20 bp, Artificial Sequence
  chemically synthesized
tgttagccatgtttcattga

SEQ ID NO: 488713 - DNA, 20 bp, Artificial Sequence
  chemically synthesized
tctttgttagccatgtttca

SEQ ID NO: 488714 - DNA, 20 bp, Artificial Sequence
  chemically synthesized
ttggtaaggttaaaagttcc

SEQ ID NO: 488715 - DNA, 20 bp, Artificial Sequence
  chemically synthesized
agtaaaataataatatcata

SEQ ID NO: 488716 - DNA, 20 bp, Artificial Sequence
  chemically synthesized
catatagaattgctactcct

SEQ ID NO: 488717 - DNA, 20 bp, Artificial Sequence
  chemically synthesized
ttctaagcatcaccattccc

SEQ ID NO: 488718 - DNA, 20 bp, Artificial Sequence
  chemically synthesized
gttttgaacacaacatcggg

SEQ ID NO: 488719 - DNA, 20 bp, Artificial Sequence
  chemically synthesized
tgtgtgacggtatgaggaaa

SEQ ID NO: 488720 - DNA, 20 bp, Artificial Sequence
  chemically synthesized
aaagtgaatacaattcaaag

SEQ ID NO: 488721 - DNA, 20 bp, Artificial Sequence
  chemically synthesized
aggaagagaccaacccatct

SEQ ID NO: 488722 - DNA, 20 bp, Artificial Sequence
  chemically synthesized
gaagagagcaaagaaaaaaa

SEQ ID NO: 488723 - DNA, 20 bp, Artificial Sequence
  chemically synthesized
agcaaagaaaaaaagagaat

SEQ ID NO: 488724 - DNA, 20 bp, Artificial Sequence
  chemically synthesized
aaaatagttttatattctgc

SEQ ID NO: 488725 - DNA, 20 bp, Artificial Sequence
  chemically synthesized
ggttatggcaacaatcctcg

SEQ ID NO: 488726 - DNA, 20 bp, Artificial Sequence
  chemically synthesized
gcccaagtctcctgttgaaa

SEQ ID NO: 488727 - DNA, 20 bp, Artificial Sequence
  chemically synthesized
agggcagcaaactatggctt

SEQ ID NO: 488728 - DNA, 20 bp, Artificial Sequence
  chemically synthesized
tgtacaaagacatatggtgg

SEQ ID NO: 488729 - DNA, 20 bp, Artificial Sequence
  chemically synthesized
aaactgaaaataattaataa

SEQ ID NO: 488730 - DNA, 20 bp, Artificial Sequence
  chemically synthesized
aattaataaatgggtgagac

SEQ ID NO: 488731 - DNA, 20 bp, Artificial Sequence
  chemically synthesized
atttacttggggacacaaat

SEQ ID NO: 488732 - DNA, 20 bp, Artificial Sequence
  chemically synthesized
taatacgtaactacacataa

SEQ ID NO: 488733 - DNA, 20 bp, Artificial Sequence
  chemically synthesized
gactacttaacaccgctatt

SEQ ID NO: 488734 - DNA, 20 bp, Artificial Sequence
  chemically synthesized
acctctgctctaggtgttca

SEQ ID NO: 488735 - DNA, 20 bp, Artificial Sequence
  chemically synthesized
tgtatttcagagccgcttta

SEQ ID NO: 488736 - DNA, 20 bp, Artificial Sequence
  chemically synthesized
tttcagagccgctttaacgg

SEQ ID NO: 488737 - DNA, 20 bp, Artificial Sequence
  chemically synthesized
ccgctttaacgggtgagttg

SEQ ID NO: 488738 - DNA, 20 bp, Artificial Sequence
  chemically synthesized
tttccaatttgggtaaatta

SEQ ID NO: 488739 - DNA, 20 bp, Artificial Sequence
  chemically synthesized
tgtcttgtccattttccaat

SEQ ID NO: 488740 - DNA, 20 bp, Artificial Sequence
  chemically synthesized
atttaaaaaaatttccacca

SEQ ID NO: 488741 - DNA, 20 bp, Artificial Sequence
  chemically synthesized
aaaaacagaccaggagggtc

SEQ ID NO: 488742 - DNA, 20 bp, Artificial Sequence
  chemically synthesized
gtgtcccaaaaacagaccag

SEQ ID NO: 488743 - DNA, 20 bp, Artificial Sequence
  chemically synthesized
cttcagctagctggtcccag

SEQ ID NO: 488744 - DNA, 20 bp, Artificial Sequence
  chemically synthesized
agttagctgaaatttgaaac

SEQ ID NO: 488745 - DNA, 20 bp, Artificial Sequence
  chemically synthesized
tttggaaacgcacaacttct

SEQ ID NO: 488746 - DNA, 20 bp, Artificial Sequence
  chemically synthesized
tcaaggctacacgtaattta

SEQ ID NO: 488747 - DNA, 20 bp, Artificial Sequence
  chemically synthesized
tagctattgagcacccagcc

SEQ ID NO: 488748 - DNA, 20 bp, Artificial Sequence
  chemically synthesized
ccaaataggcatattctggg

SEQ ID NO: 488749 - DNA, 20 bp, Artificial Sequence
  chemically synthesized
cagcccagaatatgcctatt

SEQ ID NO: 488750 - DNA, 20 bp, Artificial Sequence
  chemically synthesized
catatgctgtaaaatacata

SEQ ID NO: 488751 - DNA, 20 bp, Artificial Sequence
  chemically synthesized
ttttttcagtactatgcctt

SEQ ID NO: 488752 - DNA, 20 bp, Artificial Sequence
  chemically synthesized
gcatagtactgaaaaaaaaa

SEQ ID NO: 488753 - DNA, 20 bp, Artificial Sequence
  chemically synthesized
catggatgaattaaaatatt

SEQ ID NO: 488754 - DNA, 20 bp, Artificial Sequence
  chemically synthesized
tgtcattaagtgatgcatgg

SEQ ID NO: 488755 - DNA, 20 bp, Artificial Sequence
  chemically synthesized
ttcctgtcattaagtgatgc

SEQ ID NO: 488756 - DNA, 20 bp, Artificial Sequence
  chemically synthesized
tccatgcatcacttaatgac

SEQ ID NO: 488757 - DNA, 20 bp, Artificial Sequence
  chemically synthesized
tcacctaatgacacatctct

SEQ ID NO: 488758 - DNA, 20 bp, Artificial Sequence
  chemically synthesized
acacactatgatgtttgcat

SEQ ID NO: 488759 - DNA, 20 bp, Artificial Sequence
  chemically synthesized
ttgtgcagcacgtgactgta

SEQ ID NO: 488760 - DNA, 20 bp, Artificial Sequence
  chemically synthesized
acgagtacttgccactatgt

SEQ ID NO: 488761 - DNA, 20 bp, Artificial Sequence
  chemically synthesized
gtttaggtatgtttagatgc

SEQ ID NO: 488762 - DNA, 20 bp, Artificial Sequence
  chemically synthesized
tatatacactggtgatctaa

SEQ ID NO: 488763 - DNA, 20 bp, Artificial Sequence
  chemically synthesized
atgatacaattttagataca

SEQ ID NO: 488764 - DNA, 20 bp, Artificial Sequence
  chemically synthesized
aataaacaggtgaaatttat

SEQ ID NO: 488765 - DNA, 20 bp, Artificial Sequence
  chemically synthesized
agcagcttttattctatagt

SEQ ID NO: 488766 - DNA, 20 bp, Artificial Sequence
  chemically synthesized
tttttctgctattcctacta

SEQ ID NO: 488767 - DNA, 20 bp, Artificial Sequence
  chemically synthesized
tcacatgacttttgacatct

SEQ ID NO: 488768 - DNA, 20 bp, Artificial Sequence
  chemically synthesized
ccatagatgtcaaaagtcat

SEQ ID NO: 488769 - DNA, 20 bp, Artificial Sequence
  chemically synthesized
cgtaaggttgcttcttttca

SEQ ID NO: 488770 - DNA, 20 bp, Artificial Sequence
  chemically synthesized
gaggccagaaattaaccaca

SEQ ID NO: 488771 - DNA, 20 bp, Artificial Sequence
  chemically synthesized
gtgtgcttcagacaaaactg

SEQ ID NO: 488772 - DNA, 20 bp, Artificial Sequence
  chemically synthesized
gaccagaagttaatgaaaaa

SEQ ID NO: 488773 - DNA, 20 bp, Artificial Sequence
  chemically synthesized
gaaaaaaggaagagctgtac

SEQ ID NO: 488774 - DNA, 20 bp, Artificial Sequence
  chemically synthesized
aaaagacctggcctccattc

SEQ ID NO: 488775 - DNA, 20 bp, Artificial Sequence
  chemically synthesized
ggcatcctcatctgagaccc

SEQ ID NO: 488776 - DNA, 20 bp, Artificial Sequence
  chemically synthesized
tccattcccgggtctcagat

SEQ ID NO: 488777 - DNA, 20 bp, Artificial Sequence
  chemically synthesized
gtggtagtttcccttgtagg

SEQ ID NO: 488778 - DNA, 20 bp, Artificial Sequence
  chemically synthesized
tcccttgtaggagggatagg

SEQ ID NO: 488779 - DNA, 20 bp, Artificial Sequence
  chemically synthesized
atgtggcgaaaaagggaagt

SEQ ID NO: 488780 - DNA, 20 bp, Artificial Sequence
  chemically synthesized
aaaaagggaagtgagagttg

SEQ ID NO: 488781 - DNA, 20 bp, Artificial Sequence
  chemically synthesized
accacctctaccgctactta

SEQ ID NO: 488782 - DNA, 20 bp, Artificial Sequence
  chemically synthesized
aggatactcagggaaggccc

SEQ ID NO: 488783 - DNA, 20 bp, Artificial Sequence
  chemically synthesized
atagaatccgagggccttcc

SEQ ID NO: 488784 - DNA, 20 bp, Artificial Sequence
  chemically synthesized
tgtctgcatttttcagttcc

SEQ ID NO: 488785 - DNA, 20 bp, Artificial Sequence
  chemically synthesized
agtcaagctagaagggacct

SEQ ID NO: 488786 - DNA, 20 bp, Artificial Sequence
  chemically synthesized
caaacattttgtctctggca

SEQ ID NO: 488787 - DNA, 20 bp, Artificial Sequence
  chemically synthesized
ttgtctctggcagggaatgg

SEQ ID NO: 488788 - DNA, 20 bp, Artificial Sequence
  chemically synthesized
agactgtgtctgcctgacac

SEQ ID NO: 488789 - DNA, 20 bp, Artificial Sequence
  chemically synthesized
gaacacaaaagatcttctct

SEQ ID NO: 488790 - DNA, 20 bp, Artificial Sequence
  chemically synthesized
tgtggaaaatcctgtgacaa

SEQ ID NO: 488791 - DNA, 20 bp, Artificial Sequence
  chemically synthesized
gacagggtatcctgttgtca

SEQ ID NO: 488792 - DNA, 20 bp, Artificial Sequence
  chemically synthesized
cttacatctgcttagggtga

SEQ ID NO: 488793 - DNA, 20 bp, Artificial Sequence
  chemically synthesized
aaattaagcttacatctgct

SEQ ID NO: 488794 - DNA, 20 bp, Artificial Sequence
  chemically synthesized
cacagcaagataatgagcaa

SEQ ID NO: 488795 - DNA, 20 bp, Artificial Sequence
  chemically synthesized
tagaacctaacaaagcaatt

SEQ ID NO: 488796 - DNA, 20 bp, Artificial Sequence
  chemically synthesized
gtgttccagccatttattta

SEQ ID NO: 488797 - DNA, 20 bp, Artificial Sequence
  chemically synthesized
cattacacaggttatctggc

SEQ ID NO: 488798 - DNA, 20 bp, Artificial Sequence
  chemically synthesized
ttgtccagcccatgggcttt

SEQ ID NO: 488799 - DNA, 20 bp, Artificial Sequence
  chemically synthesized
taaaatgttgccacatcatc

SEQ ID NO: 488800 - DNA, 20 bp, Artificial Sequence
  chemically synthesized
agcggtggttcccaaggcct

SEQ ID NO: 488801 - DNA, 20 bp, Artificial Sequence
  chemically synthesized
aaagatgccccaaaacttct

SEQ ID NO: 488802 - DNA, 20 bp, Artificial Sequence
  chemically synthesized
gttctgtgtttgcctttcaa

SEQ ID NO: 488803 - DNA, 20 bp, Artificial Sequence
  chemically synthesized
cagcgatgtgtagacttcag

SEQ ID NO: 488804 - DNA, 20 bp, Artificial Sequence
  chemically synthesized
agacattttaatttcttcat

SEQ ID NO: 488805 - DNA, 20 bp, Artificial Sequence
  chemically synthesized
atgtttgtatgaactgaagc

SEQ ID NO: 488806 - DNA, 20 bp, Artificial Sequence
  chemically synthesized
tcacttttatataaattact

SEQ ID NO: 488807 - DNA, 20 bp, Artificial Sequence
  chemically synthesized
atgaattgcaatctggaact

SEQ ID NO: 488808 - DNA, 20 bp, Artificial Sequence
  chemically synthesized
tcacctgtaaaaatatatag

SEQ ID NO: 488809 - DNA, 20 bp, Artificial Sequence
  chemically synthesized
tatatttttacaggtgaagc

SEQ ID NO: 488810 - DNA, 20 bp, Artificial Sequence
  chemically synthesized
ccaattcaacagttttttaa

SEQ ID NO: 488811 - DNA, 20 bp, Artificial Sequence
  chemically synthesized
ttcactcatttaaaaaactg

SEQ ID NO: 488812 - DNA, 20 bp, Artificial Sequence
  chemically synthesized
aataagtgttcatagaaggg

SEQ ID NO: 488813 - DNA, 20 bp, Artificial Sequence
  chemically synthesized
taaatacattttttttcttc

SEQ ID NO: 488814 - DNA, 20 bp, Artificial Sequence
  chemically synthesized
aaaaaaaatgtatttaaaca

SEQ ID NO: 488815 - DNA, 20 bp, Artificial Sequence
  chemically synthesized
gagtattcatcacttggtaa

SEQ ID NO: 488816 - DNA, 20 bp, Artificial Sequence
  chemically synthesized
cagaattcaattaccaagtg

SEQ ID NO: 488817 - DNA, 20 bp, Artificial Sequence
  chemically synthesized
tgtattgtgtctgtctttat

SEQ ID NO: 488818 - DNA, 20 bp, Artificial Sequence
  chemically synthesized
cacaatacactacaaagtca

SEQ ID NO: 488819 - DNA, 20 bp, Artificial Sequence
  chemically synthesized
gggcctctgtctcctggaga

SEQ ID NO: 488820 - DNA, 20 bp, Artificial Sequence
  chemically synthesized
agagacaggaggcaggagag

SEQ ID NO: 488821 - DNA, 20 bp, Artificial Sequence
  chemically synthesized
gagagaaggatgatttcaca

SEQ ID NO: 488822 - DNA, 20 bp, Artificial Sequence
  chemically synthesized
tttcacagaggatatctcat

SEQ ID NO: 488823 - DNA, 20 bp, Artificial Sequence
  chemically synthesized
tttgaattttctgttaatta

SEQ ID NO: 488824 - DNA, 20 bp, Artificial Sequence
  chemically synthesized
gtaccttttaatgggctgcg

SEQ ID NO: 488825 - DNA, 20 bp, Artificial Sequence
  chemically synthesized
cactgtcaagcttgagccaa

SEQ ID NO: 488826 - DNA, 20 bp, Artificial Sequence
  chemically synthesized
gaagaaagagatcttatgac

SEQ ID NO: 488827 - DNA, 20 bp, Artificial Sequence
  chemically synthesized
tagggttgccttataaaata

SEQ ID NO: 488828 - DNA, 20 bp, Artificial Sequence
  chemically synthesized
atttgggacatagttatgct

SEQ ID NO: 488829 - DNA, 20 bp, Artificial Sequence
  chemically synthesized
acatagttatgcttagaatt

SEQ ID NO: 488830 - DNA, 20 bp, Artificial Sequence
  chemically synthesized
aaataaaaatatgaaacatc

SEQ ID NO: 488831 - DNA, 20 bp, Artificial Sequence
  chemically synthesized
tatttttatttgctaattct

SEQ ID NO: 488832 - DNA, 20 bp, Artificial Sequence
  chemically synthesized
ccagtcataactaggatccc

SEQ ID NO: 488833 - DNA, 20 bp, Artificial Sequence
  chemically synthesized
ttccacattccagtcataac

SEQ ID NO: 488834 - DNA, 20 bp, Artificial Sequence
  chemically synthesized
cttgggatcctagttatgac

SEQ ID NO: 488835 - DNA, 20 bp, Artificial Sequence
  chemically synthesized
gtggaagaaaacaataccag

SEQ ID NO: 488836 - DNA, 20 bp, Artificial Sequence
  chemically synthesized
taccagctgaatatgatttg

SEQ ID NO: 488837 - DNA, 20 bp, Artificial Sequence
  chemically synthesized
gagttttgtgtgccatgaca

SEQ ID NO: 488838 - DNA, 20 bp, Artificial Sequence
  chemically synthesized
gagttttgaacttattctac

SEQ ID NO: 488839 - DNA, 20 bp, Artificial Sequence
  chemically synthesized
ttcaaaagtgtttatccctg

SEQ ID NO: 488840 - DNA, 20 bp, Artificial Sequence
  chemically synthesized
cagggataaacacttttgaa

SEQ ID NO: 488841 - DNA, 20 bp, Artificial Sequence
  chemically synthesized
ttatacaaagttgactttag

SEQ ID NO: 488842 - DNA, 20 bp, Artificial Sequence
  chemically synthesized
aaagttgactttagaaggat

SEQ ID NO: 488843 - DNA, 20 bp, Artificial Sequence
  chemically synthesized
cagattagatatttggaaag

SEQ ID NO: 488844 - DNA, 20 bp, Artificial Sequence
  chemically synthesized
tgcagtagatacttagtggc

SEQ ID NO: 488845 - DNA, 20 bp, Artificial Sequence
  chemically synthesized
aaaaattatgccgcgcttta

SEQ ID NO: 488846 - DNA, 20 bp, Artificial Sequence
  chemically synthesized
aaagcgcggcataatttttc

SEQ ID NO: 488847 - DNA, 20 bp, Artificial Sequence
  chemically synthesized
caaatgtaagagtgaaagaa

SEQ ID NO: 488848 - DNA, 20 bp, Artificial Sequence
  chemically synthesized
atcctcaaatgtaagagtga

SEQ ID NO: 488849 - DNA, 20 bp, Artificial Sequence
  chemically synthesized
attctttcactcttacattt

SEQ ID NO: 488850 - DNA, 20 bp, Artificial Sequence
  chemically synthesized
agaagttcatcctcaaatgt

SEQ ID NO: 488851 - DNA, 20 bp, Artificial Sequence
  chemically synthesized
tcttgtcttacattctgttc

SEQ ID NO: 488852 - DNA, 20 bp, Artificial Sequence
  chemically synthesized
agtttaaatacactcaagaa

SEQ ID NO: 488853 - DNA, 20 bp, Artificial Sequence
  chemically synthesized
actttttggaagaaatggaa

SEQ ID NO: 488854 - DNA, 20 bp, Artificial Sequence
  chemically synthesized
ttccatttcttccaaaaagt

SEQ ID NO: 488855 - DNA, 20 bp, Artificial Sequence
  chemically synthesized
acttctttccctgaaaaagt

SEQ ID NO: 488856 - DNA, 20 bp, Artificial Sequence
  chemically synthesized
gtttgggtgatccttagcat

SEQ ID NO: 488857 - DNA, 20 bp, Artificial Sequence
  chemically synthesized
tcatactaaaccctgatgct

SEQ ID NO: 488858 - DNA, 20 bp, Artificial Sequence
  chemically synthesized
tagttattgtacaagataac

SEQ ID NO: 488859 - DNA, 20 bp, Artificial Sequence
  chemically synthesized
catatgtgaaagaaacttgg

SEQ ID NO: 488860 - DNA, 20 bp, Artificial Sequence
  chemically synthesized
taatcaacaatgctggggga

SEQ ID NO: 488861 - DNA, 20 bp, Artificial Sequence
  chemically synthesized
cacatgaagaggtgctgaaa

SEQ ID NO: 488862 - DNA, 20 bp, Artificial Sequence
  chemically synthesized
aaataattttttctatcttt

SEQ ID NO: 488863 - DNA, 20 bp, Artificial Sequence
  chemically synthesized
atgaaccatctctgcaatac

SEQ ID NO: 488864 - DNA, 20 bp, Artificial Sequence
  chemically synthesized
caaaaattgaaaaaaataag

SEQ ID NO: 488865 - DNA, 20 bp, Artificial Sequence
  chemically synthesized
tggcagttttctttaagtca

SEQ ID NO: 488866 - DNA, 20 bp, Artificial Sequence
  chemically synthesized
cttaaagaaaactgccaaat

SEQ ID NO: 488867 - DNA, 20 bp, Artificial Sequence
  chemically synthesized
tctatactcaataaaggtaa

SEQ ID NO: 488868 - DNA, 20 bp, Artificial Sequence
  chemically synthesized
tgcttattcttttaccttta

SEQ ID NO: 488869 - DNA, 20 bp, Artificial Sequence
  chemically synthesized
aaattagttattttaggata

SEQ ID NO: 488870 - DNA, 20 bp, Artificial Sequence
  chemically synthesized
ctataccaaattagttattt

SEQ ID NO: 488871 - DNA, 20 bp, Artificial Sequence
  chemically synthesized
tttacatctgttagaaacga

SEQ ID NO: 488872 - DNA, 20 bp, Artificial Sequence
  chemically synthesized
aagtagtacattaaaactag

SEQ ID NO: 488873 - DNA, 20 bp, Artificial Sequence
  chemically synthesized
taaaatttaaaaataattag

SEQ ID NO: 488874 - DNA, 20 bp, Artificial Sequence
  chemically synthesized
tattattgtactttaagttt

SEQ ID NO: 488875 - DNA, 20 bp, Artificial Sequence
  chemically synthesized
caatgctagatgacaagtta

SEQ ID NO: 488876 - DNA, 20 bp, Artificial Sequence
  chemically synthesized
cactaacttgtcatctagca

SEQ ID NO: 488877 - DNA, 20 bp, Artificial Sequence
  chemically synthesized
gtggggtgggggaagggggg

SEQ ID NO: 488878 - DNA, 20 bp, Artificial Sequence
  chemically synthesized
tcacactctggggactgttg

SEQ ID NO: 488879 - DNA, 20 bp, Artificial Sequence
  chemically synthesized
ccccaccccacaacagtccc

SEQ ID NO: 488880 - DNA, 20 bp, Artificial Sequence
  chemically synthesized
tcattgttcaattcccacct

SEQ ID NO: 488881 - DNA, 20 bp, Artificial Sequence
  chemically synthesized
gcatgttctcactcataggt

SEQ ID NO: 488882 - DNA, 20 bp, Artificial Sequence
  chemically synthesized
ttcatgtcctttgtaggcac

SEQ ID NO: 488883 - DNA, 20 bp, Artificial Sequence
  chemically synthesized
ctatgcagccataaaaaagg

SEQ ID NO: 488884 - DNA, 20 bp, Artificial Sequence
  chemically synthesized
aatactatgcagccataaaa

SEQ ID NO: 488885 - DNA, 20 bp, Artificial Sequence
  chemically synthesized
aaatgtccaacaatgataga

SEQ ID NO: 488886 - DNA, 20 bp, Artificial Sequence
  chemically synthesized
agtctatcattgttggacat

SEQ ID NO: 488887 - DNA, 20 bp, Artificial Sequence
  chemically synthesized
ggttccaagtctttgctatt

SEQ ID NO: 488888 - DNA, 20 bp, Artificial Sequence
  chemically synthesized
gcagcatgatttatagtcct

SEQ ID NO: 488889 - DNA, 20 bp, Artificial Sequence
  chemically synthesized
tttgggtatatacccagtaa

SEQ ID NO: 488890 - DNA, 20 bp, Artificial Sequence
  chemically synthesized
ttgacccagccatcccatta

SEQ ID NO: 488891 - DNA, 20 bp, Artificial Sequence
  chemically synthesized
tatacccagtaatgggatgg

SEQ ID NO: 488892 - DNA, 20 bp, Artificial Sequence
  chemically synthesized
tttctagttctagatccctg

SEQ ID NO: 488893 - DNA, 20 bp, Artificial Sequence
  chemically synthesized
agtcggtgtggcgattcctc

SEQ ID NO: 488894 - DNA, 20 bp, Artificial Sequence
  chemically synthesized
aggaaacaacaggtgctgga

SEQ ID NO: 488895 - DNA, 20 bp, Artificial Sequence
  chemically synthesized
agataccatctcacaccagt

SEQ ID NO: 488896 - DNA, 20 bp, Artificial Sequence
  chemically synthesized
gtccttcgcccactttttga

SEQ ID NO: 488897 - DNA, 20 bp, Artificial Sequence
  chemically synthesized
tttttttcttgtaaatttgt

SEQ ID NO: 488898 - DNA, 20 bp, Artificial Sequence
  chemically synthesized
gttggagttcattgtagatt

SEQ ID NO: 488899 - DNA, 20 bp, Artificial Sequence
  chemically synthesized
tctgataaagggctaatatc

SEQ ID NO: 488900 - DNA, 20 bp, Artificial Sequence
  chemically synthesized
ggatattagccctttatcag

SEQ ID NO: 488901 - DNA, 20 bp, Artificial Sequence
  chemically synthesized
acagcaaaagaaactaccat

SEQ ID NO: 488902 - DNA, 20 bp, Artificial Sequence
  chemically synthesized
caaaagccaaaattgacaaa

SEQ ID NO: 488903 - DNA, 20 bp, Artificial Sequence
  chemically synthesized
tccttgcccatgcctatgtc

SEQ ID NO: 488904 - DNA, 20 bp, Artificial Sequence
  chemically synthesized
cctgaatggtaatgcctcaa

SEQ ID NO: 488905 - DNA, 20 bp, Artificial Sequence
  chemically synthesized
ctcaagagaataaaatgcct

SEQ ID NO: 488906 - DNA, 20 bp, Artificial Sequence
  chemically synthesized
gcctaggaatccaacttaca

SEQ ID NO: 488907 - DNA, 20 bp, Artificial Sequence
  chemically synthesized
tccttcacatcccttgtaag

SEQ ID NO: 488908 - DNA, 20 bp, Artificial Sequence
  chemically synthesized
cactgctcaaggaaataaaa

SEQ ID NO: 488909 - DNA, 20 bp, Artificial Sequence
  chemically synthesized
tggaagaacattccatgctc

SEQ ID NO: 488910 - DNA, 20 bp, Artificial Sequence
  chemically synthesized
attcttcctacccatgagca

SEQ ID NO: 488911 - DNA, 20 bp, Artificial Sequence
  chemically synthesized
attccatgctcatgggtagg

SEQ ID NO: 488912 - DNA, 20 bp, Artificial Sequence
  chemically synthesized
gtagcttgatggggatggca

SEQ ID NO: 488913 - DNA, 20 bp, Artificial Sequence
  chemically synthesized
aaaggcattggtagcttgat

SEQ ID NO: 488914 - DNA, 20 bp, Artificial Sequence
  chemically synthesized
gctaccaatgcctttcttca

SEQ ID NO: 488915 - DNA, 20 bp, Artificial Sequence
  chemically synthesized
ccagctttgttcttttggct

SEQ ID NO: 488916 - DNA, 20 bp, Artificial Sequence
  chemically synthesized
agaaaaacaagcaatgggga

SEQ ID NO: 488917 - DNA, 20 bp, Artificial Sequence
  chemically synthesized
ccagcaccgtttattaaata

SEQ ID NO: 488918 - DNA, 20 bp, Artificial Sequence
  chemically synthesized
ccatacgtagaaagctgaaa

SEQ ID NO: 488919 - DNA, 20 bp, Artificial Sequence
  chemically synthesized
ttttgtataaggtgtaagga

SEQ ID NO: 488920 - DNA, 20 bp, Artificial Sequence
  chemically synthesized
tatacaaaaatcaattcaag

SEQ ID NO: 488921 - DNA, 20 bp, Artificial Sequence
  chemically synthesized
gtttaagtctttaatccatc

SEQ ID NO: 488922 - DNA, 20 bp, Artificial Sequence
  chemically synthesized
gtaatgcctaggttatcttc

SEQ ID NO: 488923 - DNA, 20 bp, Artificial Sequence
  chemically synthesized
cattacaatttcttttctta

SEQ ID NO: 488924 - DNA, 20 bp, Artificial Sequence
  chemically synthesized
ttttcttaaggaatgatggt

SEQ ID NO: 488925 - DNA, 20 bp, Artificial Sequence
  chemically synthesized
tgatggtttgagtaatcctt

SEQ ID NO: 488926 - DNA, 20 bp, Artificial Sequence
  chemically synthesized
atgtaaagggtaaaacccta

SEQ ID NO: 488927 - DNA, 20 bp, Artificial Sequence
  chemically synthesized
tgacaatttaatggcatgta

SEQ ID NO: 488928 - DNA, 20 bp, Artificial Sequence
  chemically synthesized
caatttagaggctgatacag

SEQ ID NO: 488929 - DNA, 20 bp, Artificial Sequence
  chemically synthesized
gaggctgatacagaagaata

SEQ ID NO: 488930 - DNA, 20 bp, Artificial Sequence
  chemically synthesized
acagaagaatagcgaataac

SEQ ID NO: 488931 - DNA, 20 bp, Artificial Sequence
  chemically synthesized
catcatgaggggaaatagct

SEQ ID NO: 488932 - DNA, 20 bp, Artificial Sequence
  chemically synthesized
acagtattctaaagtcaata

SEQ ID NO: 488933 - DNA, 20 bp, Artificial Sequence
  chemically synthesized
agcagactcagtattgactt

SEQ ID NO: 488934 - DNA, 20 bp, Artificial Sequence
  chemically synthesized
tgcttaatttcttccaaaca

SEQ ID NO: 488935 - DNA, 20 bp, Artificial Sequence
  chemically synthesized
aaatatatcagaaaagtatg

SEQ ID NO: 488936 - DNA, 20 bp, Artificial Sequence
  chemically synthesized
tttggaggagcacactgcaa

SEQ ID NO: 488937 - DNA, 20 bp, Artificial Sequence
  chemically synthesized
attatttcagctgcttagca

SEQ ID NO: 488938 - DNA, 20 bp, Artificial Sequence
  chemically synthesized
caatgcataaatccagtgca

SEQ ID NO: 488939 - DNA, 20 bp, Artificial Sequence
  chemically synthesized
agaaaattatattcagtgca

SEQ ID NO: 488940 - DNA, 20 bp, Artificial Sequence
  chemically synthesized
ccaacatgaagttgcagaaa

SEQ ID NO: 488941 - DNA, 20 bp, Artificial Sequence
  chemically synthesized
cattttctgcaacttcatgt

SEQ ID NO: 488942 - DNA, 20 bp, Artificial Sequence
  chemically synthesized
cttcactttttttcagtctt

SEQ ID NO: 488943 - DNA, 20 bp, Artificial Sequence
  chemically synthesized
aaaataataacgtagaaaca

SEQ ID NO: 488944 - DNA, 20 bp, Artificial Sequence
  chemically synthesized
aatatgactgattttcaaat

SEQ ID NO: 488945 - DNA, 20 bp, Artificial Sequence
  chemically synthesized
aatctggatttgttgtctct

SEQ ID NO: 488946 - DNA, 20 bp, Artificial Sequence
  chemically synthesized
gaaaataaataatcgctgta

SEQ ID NO: 488947 - DNA, 20 bp, Artificial Sequence
  chemically synthesized
gtcttaactagagcacacag

SEQ ID NO: 488948 - DNA, 20 bp, Artificial Sequence
  chemically synthesized
agagcacacagcagaatcaa

SEQ ID NO: 488949 - DNA, 20 bp, Artificial Sequence
  chemically synthesized
cacagcagaatcaattgggt

SEQ ID NO: 488950 - DNA, 20 bp, Artificial Sequence
  chemically synthesized
tagattctctggtatggagc

SEQ ID NO: 488951 - DNA, 20 bp, Artificial Sequence
  chemically synthesized
tatatccaagctccatacca

SEQ ID NO: 488952 - DNA, 20 bp, Artificial Sequence
  chemically synthesized
gcgactccattacaaactta

SEQ ID NO: 488953 - DNA, 20 bp, Artificial Sequence
  chemically synthesized
ctaattccataagtttgtaa

SEQ ID NO: 488954 - DNA, 20 bp, Artificial Sequence
  chemically synthesized
agcagggatgtttgtaccac

SEQ ID NO: 488955 - DNA, 20 bp, Artificial Sequence
  chemically synthesized
cagtttgtgtgggctctagc

SEQ ID NO: 488956 - DNA, 20 bp, Artificial Sequence
  chemically synthesized
atctgaggtaaatgcagatt

SEQ ID NO: 488957 - DNA, 20 bp, Artificial Sequence
  chemically synthesized
tttactgcactacacttgac

SEQ ID NO: 488958 - DNA, 20 bp, Artificial Sequence
  chemically synthesized
tcataatgcacactgttaca

SEQ ID NO: 488959 - DNA, 20 bp, Artificial Sequence
  chemically synthesized
gcattatgacttatgtgcct

SEQ ID NO: 488960 - DNA, 20 bp, Artificial Sequence
  chemically synthesized
atttcttcttttgtagaaca

SEQ ID NO: 488961 - DNA, 20 bp, Artificial Sequence
  chemically synthesized
ctaggaagtatagatactgt

SEQ ID NO: 488962 - DNA, 20 bp, Artificial Sequence
  chemically synthesized
tgcaaaataaaagaagactg

SEQ ID NO: 488963 - DNA, 20 bp, Artificial Sequence
  chemically synthesized
atgggaattcaacatgagat

SEQ ID NO: 488964 - DNA, 20 bp, Artificial Sequence
  chemically synthesized
gtctccacccaaatctcatg

SEQ ID NO: 488965 - DNA, 20 bp, Artificial Sequence
  chemically synthesized
gggtccctcccataacacat

SEQ ID NO: 488966 - DNA, 20 bp, Artificial Sequence
  chemically synthesized
catgattaaattacctccca

SEQ ID NO: 488967 - DNA, 20 bp, Artificial Sequence
  chemically synthesized
cctgtgctgttctagtgatt

SEQ ID NO: 488968 - DNA, 20 bp, Artificial Sequence
  chemically synthesized
gatctgatggttttgaaaag

SEQ ID NO: 488969 - DNA, 20 bp, Artificial Sequence
  chemically synthesized
aggaacgagtcacatcttac

SEQ ID NO: 488970 - DNA, 20 bp, Artificial Sequence
  chemically synthesized
atggcaccaggcaaggagga

SEQ ID NO: 488971 - DNA, 20 bp, Artificial Sequence
  chemically synthesized
cttttgtaaattgcccagtc

SEQ ID NO: 488972 - DNA, 20 bp, Artificial Sequence
  chemically synthesized
tattagtccattttcacact

SEQ ID NO: 488973 - DNA, 20 bp, Artificial Sequence
  chemically synthesized
atacagtaatttggtaccag

SEQ ID NO: 488974 - DNA, 20 bp, Artificial Sequence
  chemically synthesized
ccaaagtcgcttccacattt

SEQ ID NO: 488975 - DNA, 20 bp, Artificial Sequence
  chemically synthesized
ctttggaagtgcgtaacatg

SEQ ID NO: 488976 - DNA, 20 bp, Artificial Sequence
  chemically synthesized
tgggaatgtaaaaggccagg

SEQ ID NO: 488977 - DNA, 20 bp, Artificial Sequence
  chemically synthesized
ttgaacagacttcttgctct

SEQ ID NO: 488978 - DNA, 20 bp, Artificial Sequence
  chemically synthesized
gtctgatggcaatgcagggg

SEQ ID NO: 488979 - DNA, 20 bp, Artificial Sequence
  chemically synthesized
actcagtctgatggcaatgc

SEQ ID NO: 488980 - DNA, 20 bp, Artificial Sequence
  chemically synthesized
acccctgcattgccatcaga

SEQ ID NO: 488981 - DNA, 20 bp, Artificial Sequence
  chemically synthesized
ataaaacttaattcttaaaa

SEQ ID NO: 488982 - DNA, 20 bp, Artificial Sequence
  chemically synthesized
caggggagggactcattttt

SEQ ID NO: 488983 - DNA, 20 bp, Artificial Sequence
  chemically synthesized
taaaaatgagtccctcccct

SEQ ID NO: 488984 - DNA, 20 bp, Artificial Sequence
  chemically synthesized
aatgagtccctcccctgtga

SEQ ID NO: 488985 - DNA, 20 bp, Artificial Sequence
  chemically synthesized
accagaatgtctagaggagc

SEQ ID NO: 488986 - DNA, 20 bp, Artificial Sequence
  chemically synthesized
gtctacatgggagaatatac

SEQ ID NO: 488987 - DNA, 20 bp, Artificial Sequence
  chemically synthesized
tgccttgtatgtctacatgg

SEQ ID NO: 488988 - DNA, 20 bp, Artificial Sequence
  chemically synthesized
tactgggggaaaataatgta

SEQ ID NO: 488989 - DNA, 20 bp, Artificial Sequence
  chemically synthesized
tctagcattagtccatatca

SEQ ID NO: 488990 - DNA, 20 bp, Artificial Sequence
  chemically synthesized
tggactaatgctagaagcag

SEQ ID NO: 488991 - DNA, 20 bp, Artificial Sequence
  chemically synthesized
atctactgtctttaatggga

SEQ ID NO: 488992 - DNA, 20 bp, Artificial Sequence
  chemically synthesized
aatgggacagagttgtgctc

SEQ ID NO: 488993 - DNA, 20 bp, Artificial Sequence
  chemically synthesized
gagatcttaaatctttatct

SEQ ID NO: 488994 - DNA, 20 bp, Artificial Sequence
  chemically synthesized
ttgaaaaggtatgtttgggc

SEQ ID NO: 488995 - DNA, 20 bp, Artificial Sequence
  chemically synthesized
atcaccttgctctattcagg

SEQ ID NO: 488996 - DNA, 20 bp, Artificial Sequence
  chemically synthesized
atattatggtaggattcctc

SEQ ID NO: 488997 - DNA, 20 bp, Artificial Sequence
  chemically synthesized
ctgtaaacaaaatattatgg

SEQ ID NO: 488998 - DNA, 20 bp, Artificial Sequence
  chemically synthesized
taataatctttcctcttctc

SEQ ID NO: 488999 - DNA, 20 bp, Artificial Sequence
  chemically synthesized
gagtactgcaaattctactt

SEQ ID NO: 489000 - DNA, 20 bp, Artificial Sequence
  chemically synthesized
gacattgttctattctgaag

SEQ ID NO: 489001 - DNA, 20 bp, Artificial Sequence
  chemically synthesized
gcaacaaaggacggtagtac

SEQ ID NO: 489002 - DNA, 20 bp, Artificial Sequence
  chemically synthesized
gctatactacgaggcaaagg

SEQ ID NO: 489003 - DNA, 20 bp, Artificial Sequence
  chemically synthesized
gaggcaaagggaggattatg

SEQ ID NO: 489004 - DNA, 20 bp, Artificial Sequence
  chemically synthesized
agggaggattatgaagggtt

SEQ ID NO: 489005 - DNA, 20 bp, Artificial Sequence
  chemically synthesized
aattacagtgaagcggaaga

SEQ ID NO: 489006 - DNA, 20 bp, Artificial Sequence
  chemically synthesized
agacagaatgtttctaaata

SEQ ID NO: 489007 - DNA, 20 bp, Artificial Sequence
  chemically synthesized
caaaataataaaggaataga

SEQ ID NO: 489008 - DNA, 20 bp, Artificial Sequence
  chemically synthesized
tatagactacaaaataataa

SEQ ID NO: 489009 - DNA, 20 bp, Artificial Sequence
  chemically synthesized
tattaatatgacactatatt

SEQ ID NO: 489010 - DNA, 20 bp, Artificial Sequence
  chemically synthesized
ttagaaacggtaaaagtcac

SEQ ID NO: 489011 - DNA, 20 bp, Artificial Sequence
  chemically synthesized
tttgaaatatgcatacactg

SEQ ID NO: 489012 - DNA, 20 bp, Artificial Sequence
  chemically synthesized
ataaaaaaatgataagaatg

SEQ ID NO: 489013 - DNA, 20 bp, Artificial Sequence
  chemically synthesized
tctcaccataaaaaaatgat

SEQ ID NO: 489014 - DNA, 20 bp, Artificial Sequence
  chemically synthesized
tcttatcatttttttatggt

SEQ ID NO: 489015 - DNA, 20 bp, Artificial Sequence
  chemically synthesized
gtaatctcttggcaattttc

SEQ ID NO: 489016 - DNA, 20 bp, Artificial Sequence
  chemically synthesized
agcctaagcagatacctaaa

SEQ ID NO: 489017 - DNA, 20 bp, Artificial Sequence
  chemically synthesized
aataaatgttcaattattta

SEQ ID NO: 489018 - DNA, 20 bp, Artificial Sequence
  chemically synthesized
ttcattaaagaaataaaaca

SEQ ID NO: 489019 - DNA, 20 bp, Artificial Sequence
  chemically synthesized
cccaatgttttatttcttta

SEQ ID NO: 489020 - DNA, 20 bp, Artificial Sequence
  chemically synthesized
ttgacagaagtattagtttt

SEQ ID NO: 489021 - DNA, 20 bp, Artificial Sequence
  chemically synthesized
tggagagcgggagttatggg

SEQ ID NO: 489022 - DNA, 20 bp, Artificial Sequence
  chemically synthesized
actttggagagcgggagtta

SEQ ID NO: 489023 - DNA, 20 bp, Artificial Sequence
  chemically synthesized
aagaattcactttggagagc

SEQ ID NO: 489024 - DNA, 20 bp, Artificial Sequence
  chemically synthesized
cataactcccgctctccaaa

SEQ ID NO: 489025 - DNA, 20 bp, Artificial Sequence
  chemically synthesized
tgcatatcaaaagagattta

SEQ ID NO: 489026 - DNA, 20 bp, Artificial Sequence
  chemically synthesized
gccagttaacctcgctgaac

SEQ ID NO: 489027 - DNA, 20 bp, Artificial Sequence
  chemically synthesized
agtcacagaagttataggag

SEQ ID NO: 489028 - DNA, 20 bp, Artificial Sequence
  chemically synthesized
tttcctatacattagctcat

SEQ ID NO: 489029 - DNA, 20 bp, Artificial Sequence
  chemically synthesized
gttcaatcagctaatttttt

SEQ ID NO: 489030 - DNA, 20 bp, Artificial Sequence
  chemically synthesized
aaaattagctgattgaacca

SEQ ID NO: 489031 - DNA, 20 bp, Artificial Sequence
  chemically synthesized
acatttattagtagcaaaat

SEQ ID NO: 489032 - DNA, 20 bp, Artificial Sequence
  chemically synthesized
agatgttcaacaaattatta

SEQ ID NO: 489033 - DNA, 20 bp, Artificial Sequence
  chemically synthesized
tataagaccaaaagaaatcc

SEQ ID NO: 489034 - DNA, 20 bp, Artificial Sequence
  chemically synthesized
gattatacgggatgtaattc

SEQ ID NO: 489035 - DNA, 20 bp, Artificial Sequence
  chemically synthesized
aatccacaactaggattata

SEQ ID NO: 489036 - DNA, 20 bp, Artificial Sequence
  chemically synthesized
catcccgtataatcctagtt

SEQ ID NO: 489037 - DNA, 20 bp, Artificial Sequence
  chemically synthesized
gaaaaatataaatccacaac

SEQ ID NO: 489038 - DNA, 20 bp, Artificial Sequence
  chemically synthesized
ttatatttttctttttgata

SEQ ID NO: 489039 - DNA, 20 bp, Artificial Sequence
  chemically synthesized
aaaggggaaaaaatcatttt

SEQ ID NO: 489040 - DNA, 20 bp, Artificial Sequence
  chemically synthesized
ttaagatttttgtttgctca

SEQ ID NO: 489041 - DNA, 20 bp, Artificial Sequence
  chemically synthesized
aaaacctattttcaacaaga

SEQ ID NO: 489042 - DNA, 20 bp, Artificial Sequence
  chemically synthesized
gtattagccgcagagttgct

SEQ ID NO: 489043 - DNA, 20 bp, Artificial Sequence
  chemically synthesized
cctacaacatgtattagccg

SEQ ID NO: 489044 - DNA, 20 bp, Artificial Sequence
  chemically synthesized
tctgcggctaatacatgttg

SEQ ID NO: 489045 - DNA, 20 bp, Artificial Sequence
  chemically synthesized
tcgctctcattataatttta

SEQ ID NO: 489046 - DNA, 20 bp, Artificial Sequence
  chemically synthesized
tctcattggtactttttata

SEQ ID NO: 489047 - DNA, 20 bp, Artificial Sequence
  chemically synthesized
tacttaggttttgtaatttg

SEQ ID NO: 489048 - DNA, 20 bp, Artificial Sequence
  chemically synthesized
tgattaaactttgagcaaat

SEQ ID NO: 489049 - DNA, 20 bp, Artificial Sequence
  chemically synthesized
agaaacaataagagactgat

SEQ ID NO: 489050 - DNA, 20 bp, Artificial Sequence
  chemically synthesized
attgctggttttataatatt

SEQ ID NO: 489051 - DNA, 20 bp, Artificial Sequence
  chemically synthesized
tcttccatctttttcaaatg

SEQ ID NO: 489052 - DNA, 20 bp, Artificial Sequence
  chemically synthesized
atttgaaaaagatggaagat

SEQ ID NO: 489053 - DNA, 20 bp, Artificial Sequence
  chemically synthesized
caaaatggctgctttggtgt

SEQ ID NO: 489054 - DNA, 20 bp, Artificial Sequence
  chemically synthesized
atacatatgaaaattcttct

SEQ ID NO: 489055 - DNA, 20 bp, Artificial Sequence
  chemically synthesized
tttgctttcagtattcacag

SEQ ID NO: 489056 - DNA, 20 bp, Artificial Sequence
  chemically synthesized
tgtgaatactgaaagcaaat

SEQ ID NO: 489057 - DNA, 20 bp, Artificial Sequence
  chemically synthesized
ttaaaattacattacagatg

SEQ ID NO: 489058 - DNA, 20 bp, Artificial Sequence
  chemically synthesized
taatagaggcacagctcttc

SEQ ID NO: 489059 - DNA, 20 bp, Artificial Sequence
  chemically synthesized
cagctcttcatgaatatagt

SEQ ID NO: 489060 - DNA, 20 bp, Artificial Sequence
  chemically synthesized
gaaagaacattacttcaata

SEQ ID NO: 489061 - DNA, 20 bp, Artificial Sequence
  chemically synthesized
aatacttttgaaaaaataat

SEQ ID NO: 489062 - DNA, 20 bp, Artificial Sequence
  chemically synthesized
ggtgttttattttttatata

SEQ ID NO: 489063 - DNA, 20 bp, Artificial Sequence
  chemically synthesized
aacaccatatatgaaaatat

SEQ ID NO: 489064 - DNA, 20 bp, Artificial Sequence
  chemically synthesized
tgcattaaaactaaatacat

SEQ ID NO: 489065 - DNA, 20 bp, Artificial Sequence
  chemically synthesized
ttaatacatacatgattgga

SEQ ID NO: 489066 - DNA, 20 bp, Artificial Sequence
  chemically synthesized
aactttaatacatacatgat

SEQ ID NO: 489067 - DNA, 20 bp, Artificial Sequence
  chemically synthesized
ttcatatttcaaaaagtaca

SEQ ID NO: 489068 - DNA, 20 bp, Artificial Sequence
  chemically synthesized
atgtactttttgaaatatga

SEQ ID NO: 489069 - DNA, 20 bp, Artificial Sequence
  chemically synthesized
tgtagtaatatattaagaaa

SEQ ID NO: 489070 - DNA, 20 bp, Artificial Sequence
  chemically synthesized
atacaaaaaaattaggtttg

SEQ ID NO: 489071 - DNA, 20 bp, Artificial Sequence
  chemically synthesized
aaattaggtttggagaatcc

SEQ ID NO: 489072 - DNA, 20 bp, Artificial Sequence
  chemically synthesized
tgaaaatgcagctaatactc

SEQ ID NO: 489073 - DNA, 20 bp, Artificial Sequence
  chemically synthesized
cattttagagtcttcccacc

SEQ ID NO: 489074 - DNA, 20 bp, Artificial Sequence
  chemically synthesized
gagatcactgagtgccattt

SEQ ID NO: 489075 - DNA, 20 bp, Artificial Sequence
  chemically synthesized
atactaggagacagagatca

SEQ ID NO: 489076 - DNA, 20 bp, Artificial Sequence
  chemically synthesized
tgatctctgtctcctagtat

SEQ ID NO: 489077 - DNA, 20 bp, Artificial Sequence
  chemically synthesized
tttaataatttcctcccctt

SEQ ID NO: 489078 - DNA, 20 bp, Artificial Sequence
  chemically synthesized
tttgacttgcttctgacaag

SEQ ID NO: 489079 - DNA, 20 bp, Artificial Sequence
  chemically synthesized
gcagaatatgtcaaagacaa

SEQ ID NO: 489080 - DNA, 20 bp, Artificial Sequence
  chemically synthesized
aggggggaaagagacagaga

SEQ ID NO: 489081 - DNA, 20 bp, Artificial Sequence
  chemically synthesized
ttggtaagtttcagttccat

SEQ ID NO: 489082 - DNA, 20 bp, Artificial Sequence
  chemically synthesized
ctgaaacttaccaacaacag

SEQ ID NO: 489083 - DNA, 20 bp, Artificial Sequence
  chemically synthesized
cactaggtgttggccagggc

SEQ ID NO: 489084 - DNA, 20 bp, Artificial Sequence
  chemically synthesized
ttgtgagagaccccgaagca

SEQ ID NO: 489085 - DNA, 20 bp, Artificial Sequence
  chemically synthesized
attatccatattctttgctt

SEQ ID NO: 489086 - DNA, 20 bp, Artificial Sequence
  chemically synthesized
gagaccccgaagcaaagaat

SEQ ID NO: 489087 - DNA, 20 bp, Artificial Sequence
  chemically synthesized
tttagagtatcaggatacat

SEQ ID NO: 489088 - DNA, 20 bp, Artificial Sequence
  chemically synthesized
aaactgtatctttagagtat

SEQ ID NO: 489089 - DNA, 20 bp, Artificial Sequence
  chemically synthesized
ggggcttaaaactgtatctt

SEQ ID NO: 489090 - DNA, 20 bp, Artificial Sequence
  chemically synthesized
attaaataatggtgaagttg

SEQ ID NO: 489091 - DNA, 20 bp, Artificial Sequence
  chemically synthesized
agttgtagggttttcagtat

SEQ ID NO: 489092 - DNA, 20 bp, Artificial Sequence
  chemically synthesized
taagaacggaccatatttta

SEQ ID NO: 489093 - DNA, 20 bp, Artificial Sequence
  chemically synthesized
cgagttactgaaaaatagtg

SEQ ID NO: 489094 - DNA, 20 bp, Artificial Sequence
  chemically synthesized
taatggttttatcatttcat

SEQ ID NO: 489095 - DNA, 20 bp, Artificial Sequence
  chemically synthesized
aattaatgttagaaatgtga

SEQ ID NO: 489096 - DNA, 20 bp, Artificial Sequence
  chemically synthesized
taagtagaacagtgataaag

SEQ ID NO: 489097 - DNA, 20 bp, Artificial Sequence
  chemically synthesized
ttaaaacagacaatttatct

SEQ ID NO: 489098 - DNA, 20 bp, Artificial Sequence
  chemically synthesized
ttccacaatttcacacagag

SEQ ID NO: 489099 - DNA, 20 bp, Artificial Sequence
  chemically synthesized
ttcacacagagacgaatgct

SEQ ID NO: 489100 - DNA, 20 bp, Artificial Sequence
  chemically synthesized
ttaagcttgcttttagggaa

SEQ ID NO: 489101 - DNA, 20 bp, Artificial Sequence
  chemically synthesized
ctttttaaacttggttcttt

SEQ ID NO: 489102 - DNA, 20 bp, Artificial Sequence
  chemically synthesized
attaaagataaaccatgtga

SEQ ID NO: 489103 - DNA, 20 bp, Artificial Sequence
  chemically synthesized
agataaaccatgtgagagaa

SEQ ID NO: 489104 - DNA, 20 bp, Artificial Sequence
  chemically synthesized
gagagaatggaatcaaaatg

SEQ ID NO: 489105 - DNA, 20 bp, Artificial Sequence
  chemically synthesized
gagatggggaaaagagcaaa

SEQ ID NO: 489106 - DNA, 20 bp, Artificial Sequence
  chemically synthesized
aggggattaacacatcttga

SEQ ID NO: 489107 - DNA, 20 bp, Artificial Sequence
  chemically synthesized
tagtgtactaacatgtaata

SEQ ID NO: 489108 - DNA, 20 bp, Artificial Sequence
  chemically synthesized
tagagttgatgaagacatgt

SEQ ID NO: 489109 - DNA, 20 bp, Artificial Sequence
  chemically synthesized
ttaacttctgaaaattgttg

SEQ ID NO: 489110 - DNA, 20 bp, Artificial Sequence
  chemically synthesized
gaatgcacagtttagaaatg

SEQ ID NO: 489111 - DNA, 20 bp, Artificial Sequence
  chemically synthesized
ctttatcctttaaatggaaa

SEQ ID NO: 489112 - DNA, 20 bp, Artificial Sequence
  chemically synthesized
ttctattccatttccattta

SEQ ID NO: 489113 - DNA, 20 bp, Artificial Sequence
  chemically synthesized
aatgcatgaaaaattataaa

SEQ ID NO: 489114 - DNA, 20 bp, Artificial Sequence
  chemically synthesized
ccaaaccatatcatagagtt

SEQ ID NO: 489115 - DNA, 20 bp, Artificial Sequence
  chemically synthesized
gacacagccaaaccatatca

SEQ ID NO: 489116 - DNA, 20 bp, Artificial Sequence
  chemically synthesized
tgatccctcccaggacgtgt

SEQ ID NO: 489117 - DNA, 20 bp, Artificial Sequence
  chemically synthesized
taacccccacacgtcctggg

SEQ ID NO: 489118 - DNA, 20 bp, Artificial Sequence
  chemically synthesized
gagggatcaggtggagataa

SEQ ID NO: 489119 - DNA, 20 bp, Artificial Sequence
  chemically synthesized
cactgtcacaagaacagcat

SEQ ID NO: 489120 - DNA, 20 bp, Artificial Sequence
  chemically synthesized
ctcatgctgttcttgtgaca

SEQ ID NO: 489121 - DNA, 20 bp, Artificial Sequence
  chemically synthesized
cacatggcagcaggaaggag

SEQ ID NO: 489122 - DNA, 20 bp, Artificial Sequence
  chemically synthesized
ctccccagccatgctgaact

SEQ ID NO: 489123 - DNA, 20 bp, Artificial Sequence
  chemically synthesized
taataaagacatacctgaga

SEQ ID NO: 489124 - DNA, 20 bp, Artificial Sequence
  chemically synthesized
gagacctggttggtgttgta

SEQ ID NO: 489125 - DNA, 20 bp, Artificial Sequence
  chemically synthesized
attaggaaaaatatgtttca

SEQ ID NO: 489126 - DNA, 20 bp, Artificial Sequence
  chemically synthesized
tcacaattcaatgggacaaa

SEQ ID NO: 489127 - DNA, 20 bp, Artificial Sequence
  chemically synthesized
tcctaattctttttgtccca

SEQ ID NO: 489128 - DNA, 20 bp, Artificial Sequence
  chemically synthesized
tggaagattttgaaagtgaa

SEQ ID NO: 489129 - DNA, 20 bp, Artificial Sequence
  chemically synthesized
aagaattatcttatattgcc

SEQ ID NO: 489130 - DNA, 20 bp, Artificial Sequence
  chemically synthesized
aatgacacagcccttgataa

SEQ ID NO: 489131 - DNA, 20 bp, Artificial Sequence
  chemically synthesized
acagcccttgataaatgagt

SEQ ID NO: 489132 - DNA, 20 bp, Artificial Sequence
  chemically synthesized
gttatgatgtcaataataga

SEQ ID NO: 489133 - DNA, 20 bp, Artificial Sequence
  chemically synthesized
caatgttatgatgtcaataa

SEQ ID NO: 489134 - DNA, 20 bp, Artificial Sequence
  chemically synthesized
ctattattgacatcataaca

SEQ ID NO: 489135 - DNA, 20 bp, Artificial Sequence
  chemically synthesized
agatttagtaaaactgtaca

SEQ ID NO: 489136 - DNA, 20 bp, Artificial Sequence
  chemically synthesized
ctagatgacttatgttatac

SEQ ID NO: 489137 - DNA, 20 bp, Artificial Sequence
  chemically synthesized
ggagctgcttagtctagtca

SEQ ID NO: 489138 - DNA, 20 bp, Artificial Sequence
  chemically synthesized
aggttggagggggaaattgt

SEQ ID NO: 489139 - DNA, 20 bp, Artificial Sequence
  chemically synthesized
ccagggaaggaattgaaatt

SEQ ID NO: 489140 - DNA, 20 bp, Artificial Sequence
  chemically synthesized
aacatggctgcaaccaggga

SEQ ID NO: 489141 - DNA, 20 bp, Artificial Sequence
  chemically synthesized
gcagccatgttttgagacac

SEQ ID NO: 489142 - DNA, 20 bp, Artificial Sequence
  chemically synthesized
acagaaaatactgtggaagg

SEQ ID NO: 489143 - DNA, 20 bp, Artificial Sequence
  chemically synthesized
aaatttgaaaagctatgaca

SEQ ID NO: 489144 - DNA, 20 bp, Artificial Sequence
  chemically synthesized
atcatggatatcaattgaat

SEQ ID NO: 489145 - DNA, 20 bp, Artificial Sequence
  chemically synthesized
aaggagatcatggatatcaa

SEQ ID NO: 489146 - DNA, 20 bp, Artificial Sequence
  chemically synthesized
caggtacttacaaggagatc

SEQ ID NO: 489147 - DNA, 20 bp, Artificial Sequence
  chemically synthesized
catgatctccttgtaagtac

SEQ ID NO: 489148 - DNA, 20 bp, Artificial Sequence
  chemically synthesized
ctgaagccaactgtcttgat

SEQ ID NO: 489149 - DNA, 20 bp, Artificial Sequence
  chemically synthesized
ttgagctcaaatttttattt

SEQ ID NO: 489150 - DNA, 20 bp, Artificial Sequence
  chemically synthesized
aatttgagctcaagtagttt

SEQ ID NO: 489151 - DNA, 20 bp, Artificial Sequence
  chemically synthesized
ctcaccctgttgatgtgtcc

SEQ ID NO: 489152 - DNA, 20 bp, Artificial Sequence
  chemically synthesized
gtgattccaggacacatcaa

SEQ ID NO: 489153 - DNA, 20 bp, Artificial Sequence
  chemically synthesized
aatagggaagatagccaata

SEQ ID NO: 489154 - DNA, 20 bp, Artificial Sequence
  chemically synthesized
caagtcatcaatgtgaacaa

SEQ ID NO: 489155 - DNA, 20 bp, Artificial Sequence
  chemically synthesized
atcttcttttagggataaca

SEQ ID NO: 489156 - DNA, 20 bp, Artificial Sequence
  chemically synthesized
agtttcctacatcttctttt

SEQ ID NO: 489157 - DNA, 20 bp, Artificial Sequence
  chemically synthesized
caaaaaacaagaaatgggga

SEQ ID NO: 489158 - DNA, 20 bp, Artificial Sequence
  chemically synthesized
ccagcaccatttattaaata

SEQ ID NO: 489159 - DNA, 20 bp, Artificial Sequence
  chemically synthesized
ccatatgtagaaagctgaaa

SEQ ID NO: 489160 - DNA, 20 bp, Artificial Sequence
  chemically synthesized
ttttgtataaggtgtaagga

SEQ ID NO: 489161 - DNA, 20 bp, Artificial Sequence
  chemically synthesized
caaaaattaattaattcaag

SEQ ID NO: 489162 - DNA, 20 bp, Artificial Sequence
  chemically synthesized
atgtaagtctttaatccatc

SEQ ID NO: 489163 - DNA, 20 bp, Artificial Sequence
  chemically synthesized
gtattgcctaggttttcttc

SEQ ID NO: 489164 - DNA, 20 bp, Artificial Sequence
  chemically synthesized
tccttgcccatgcctttgtc

SEQ ID NO: 489165 - DNA, 20 bp, Artificial Sequence
  chemically synthesized
cagaagccaaaattgacaaa

SEQ ID NO: 489166 - DNA, 20 bp, Artificial Sequence
  chemically synthesized
acagcaaaagaaagtaccat

SEQ ID NO: 489167 - DNA, 20 bp, Artificial Sequence
  chemically synthesized
cgatattagccctttgtcag

SEQ ID NO: 489168 - DNA, 20 bp, Artificial Sequence
  chemically synthesized
tctgacaaagggctaatatc

SEQ ID NO: 489169 - DNA, 20 bp, Artificial Sequence
  chemically synthesized
acctcatcgaaaagtcggcc

SEQ ID NO: 489170 - DNA, 20 bp, Artificial Sequence
  chemically synthesized
agataccatctcactccagt

SEQ ID NO: 489171 - DNA, 20 bp, Artificial Sequence
  chemically synthesized
ttaatgatcaccattctaac

SEQ ID NO: 489172 - DNA, 20 bp, Artificial Sequence
  chemically synthesized
aggaaacaacagatgctgga

SEQ ID NO: 489173 - DNA, 20 bp, Artificial Sequence
  chemically synthesized
agacagtgtggcgattcctc

SEQ ID NO: 489174 - DNA, 20 bp, Artificial Sequence
  chemically synthesized
tttctagttctagatccttg

SEQ ID NO: 489175 - DNA, 20 bp, Artificial Sequence
  chemically synthesized
tatacccagtaatgggatgg

SEQ ID NO: 489176 - DNA, 20 bp, Artificial Sequence
  chemically synthesized
ttgacccggccatcccatta

SEQ ID NO: 489177 - DNA, 20 bp, Artificial Sequence
  chemically synthesized
tttgggtatatacccagtaa

SEQ ID NO: 489178 - DNA, 20 bp, Artificial Sequence
  chemically synthesized
cattactgggtatataccca

SEQ ID NO: 489179 - DNA, 20 bp, Artificial Sequence
  chemically synthesized
gcagcatgatttataatcct

SEQ ID NO: 489180 - DNA, 20 bp, Artificial Sequence
  chemically synthesized
ggttccaagtctttgctatt

SEQ ID NO: 489181 - DNA, 20 bp, Artificial Sequence
  chemically synthesized
agtctatcactgatggacat

SEQ ID NO: 489182 - DNA, 20 bp, Artificial Sequence
  chemically synthesized
aaatgtccatcagtgataga

SEQ ID NO: 489183 - DNA, 20 bp, Artificial Sequence
  chemically synthesized
aatgtggcacatacacacca

SEQ ID NO: 489184 - DNA, 20 bp, Artificial Sequence
  chemically synthesized
aatactacgcaaccataaaa

SEQ ID NO: 489185 - DNA, 20 bp, Artificial Sequence
  chemically synthesized
ctacgcaaccataaaaaagg

SEQ ID NO: 489186 - DNA, 20 bp, Artificial Sequence
  chemically synthesized
tttatgtcctttgaagggac

SEQ ID NO: 489187 - DNA, 20 bp, Artificial Sequence
  chemically synthesized
tgtccttgtgatagtttgct

SEQ ID NO: 489188 - DNA, 20 bp, Artificial Sequence
  chemically synthesized
gcatgtcctcactcataggt

SEQ ID NO: 489189 - DNA, 20 bp, Artificial Sequence
  chemically synthesized
tcattgttcaattcccacct

SEQ ID NO: 489190 - DNA, 20 bp, Artificial Sequence
  chemically synthesized
tcacacactggggcctgtcg

SEQ ID NO: 489191 - DNA, 20 bp, Artificial Sequence
  chemically synthesized
cgtggggtggggggctgggg

SEQ ID NO: 489192 - DNA, 20 bp, Artificial Sequence
  chemically synthesized
agaaatagctaatgtaaatg

SEQ ID NO: 489193 - DNA, 20 bp, Artificial Sequence
  chemically synthesized
ctaatgtaaatgacgagtta

SEQ ID NO: 489194 - DNA, 20 bp, Artificial Sequence
  chemically synthesized
tatatatatacttgaagttc

SEQ ID NO: 489195 - DNA, 20 bp, Artificial Sequence
  chemically synthesized
atacttatatgaaagatgta

SEQ ID NO: 489196 - DNA, 20 bp, Artificial Sequence
  chemically synthesized
aagatgtagggaattaagct

SEQ ID NO: 489197 - DNA, 20 bp, Artificial Sequence
  chemically synthesized
gatctgaagggcaaggggga

SEQ ID NO: 489198 - DNA, 20 bp, Artificial Sequence
  chemically synthesized
ctacatttctgctctctccc

SEQ ID NO: 489199 - DNA, 20 bp, Artificial Sequence
  chemically synthesized
ataaaaatggtaagtgctaa

SEQ ID NO: 489200 - DNA, 20 bp, Artificial Sequence
  chemically synthesized
tttttagtcaattaatgaaa

SEQ ID NO: 489201 - DNA, 20 bp, Artificial Sequence
  chemically synthesized
caggtagacagaatagatag

SEQ ID NO: 489202 - DNA, 20 bp, Artificial Sequence
  chemically synthesized
ctgataaacagacaggtaga

SEQ ID NO: 489203 - DNA, 20 bp, Artificial Sequence
  chemically synthesized
aaagttcctcaaaggaacgt

SEQ ID NO: 489204 - DNA, 20 bp, Artificial Sequence
  chemically synthesized
cctttgttgtggtgcagctg

SEQ ID NO: 489205 - DNA, 20 bp, Artificial Sequence
  chemically synthesized
agtgaggtgtgatttagtac

SEQ ID NO: 489206 - DNA, 20 bp, Artificial Sequence
  chemically synthesized
ctgctctgaaactgactggc

SEQ ID NO: 489207 - DNA, 20 bp, Artificial Sequence
  chemically synthesized
cagtttcagagcagtctttc

SEQ ID NO: 489208 - DNA, 20 bp, Artificial Sequence
  chemically synthesized
tcaaaagtaagtttgcagat

SEQ ID NO: 489209 - DNA, 20 bp, Artificial Sequence
  chemically synthesized
tttttttttttcacatttct

SEQ ID NO: 489210 - DNA, 20 bp, Artificial Sequence
  chemically synthesized
accttctgtgaagtgtcatg

SEQ ID NO: 489211 - DNA, 20 bp, Artificial Sequence
  chemically synthesized
atgaattattttaaaaatgc

SEQ ID NO: 489212 - DNA, 20 bp, Artificial Sequence
  chemically synthesized
tattcaagtaaaatgataga

SEQ ID NO: 489213 - DNA, 20 bp, Artificial Sequence
  chemically synthesized
atgatattcaagtaaaatga

SEQ ID NO: 489214 - DNA, 20 bp, Artificial Sequence
  chemically synthesized
aattcattctatcattttac

SEQ ID NO: 489215 - DNA, 20 bp, Artificial Sequence
  chemically synthesized
attcacactatttcacatta

SEQ ID NO: 489216 - DNA, 20 bp, Artificial Sequence
  chemically synthesized
atcccataatgtgaaatagt

SEQ ID NO: 489217 - DNA, 20 bp, Artificial Sequence
  chemically synthesized
caaatttaaaaatctctctc

SEQ ID NO: 489218 - DNA, 20 bp, Artificial Sequence
  chemically synthesized
acagatggtggcatttgcct

SEQ ID NO: 489219 - DNA, 20 bp, Artificial Sequence
  chemically synthesized
tggtggcatttgcctgggag

SEQ ID NO: 489220 - DNA, 20 bp, Artificial Sequence
  chemically synthesized
ttgcctgggagttgggtgcc

SEQ ID NO: 489221 - DNA, 20 bp, Artificial Sequence
  chemically synthesized
ctcaaaggcacacaaaaaga

SEQ ID NO: 489222 - DNA, 20 bp, Artificial Sequence
  chemically synthesized
gtctctcttttcttaaatat

SEQ ID NO: 489223 - DNA, 20 bp, Artificial Sequence
  chemically synthesized
cttttcttaaatatgtggat

SEQ ID NO: 489224 - DNA, 20 bp, Artificial Sequence
  chemically synthesized
gtggtgatgacttttcaagt

SEQ ID NO: 489225 - DNA, 20 bp, Artificial Sequence
  chemically synthesized
ggagaatgtggtacatacta

SEQ ID NO: 489226 - DNA, 20 bp, Artificial Sequence
  chemically synthesized
tccttgcttgcctggcaagg

SEQ ID NO: 489227 - DNA, 20 bp, Artificial Sequence
  chemically synthesized
tctcccttgccaggcaagca

SEQ ID NO: 489228 - DNA, 20 bp, Artificial Sequence
  chemically synthesized
aacagcagtctagaacaaag

SEQ ID NO: 489229 - DNA, 20 bp, Artificial Sequence
  chemically synthesized
gtgctttgcactgttagaag

SEQ ID NO: 489230 - DNA, 20 bp, Artificial Sequence
  chemically synthesized
ttctaacagtgcaaagcact

SEQ ID NO: 489231 - DNA, 20 bp, Artificial Sequence
  chemically synthesized
tatcattacctaacacactg

SEQ ID NO: 489232 - DNA, 20 bp, Artificial Sequence
  chemically synthesized
aggaatctttaactctccca

SEQ ID NO: 489233 - DNA, 20 bp, Artificial Sequence
  chemically synthesized
aagtcctccccactccttgg

SEQ ID NO: 489234 - DNA, 20 bp, Artificial Sequence
  chemically synthesized
agtggggaggacttcaaaac

SEQ ID NO: 489235 - DNA, 20 bp, Artificial Sequence
  chemically synthesized
gtgaaatactgctgtgggct

SEQ ID NO: 489236 - DNA, 20 bp, Artificial Sequence
  chemically synthesized
gaggataacaggaggccaag

SEQ ID NO: 489237 - DNA, 20 bp, Artificial Sequence
  chemically synthesized
agatgacaaggcaggctcta

SEQ ID NO: 489238 - DNA, 20 bp, Artificial Sequence
  chemically synthesized
ctttctaagtggaccaggca

SEQ ID NO: 489239 - DNA, 20 bp, Artificial Sequence
  chemically synthesized
cagaacaaatggaaagaaca

SEQ ID NO: 489240 - DNA, 20 bp, Artificial Sequence
  chemically synthesized
agtctcattttgatggcagc

SEQ ID NO: 489241 - DNA, 20 bp, Artificial Sequence
  chemically synthesized
atatcagaagatttctatag

SEQ ID NO: 489242 - DNA, 20 bp, Artificial Sequence
  chemically synthesized
tttctatagctgaatgacac

SEQ ID NO: 489243 - DNA, 20 bp, Artificial Sequence
  chemically synthesized
gataaatttctcctttagcc

SEQ ID NO: 489244 - DNA, 20 bp, Artificial Sequence
  chemically synthesized
gtacctatgtgggcgatgct

SEQ ID NO: 489245 - DNA, 20 bp, Artificial Sequence
  chemically synthesized
taggtacagacttgtttgtc

SEQ ID NO: 489246 - DNA, 20 bp, Artificial Sequence
  chemically synthesized
tggcagtttgccttatcaaa

SEQ ID NO: 489247 - DNA, 20 bp, Artificial Sequence
  chemically synthesized
tgccttatcaaagtgagtga

SEQ ID NO: 489248 - DNA, 20 bp, Artificial Sequence
  chemically synthesized
ggaagagaaaaagaaatagg

SEQ ID NO: 489249 - DNA, 20 bp, Artificial Sequence
  chemically synthesized
gccctgaggggaaggcagat

SEQ ID NO: 489250 - DNA, 20 bp, Artificial Sequence
  chemically synthesized
aatatcaaatggcaagttcc

SEQ ID NO: 489251 - DNA, 20 bp, Artificial Sequence
  chemically synthesized
taacataatcacatttattt

SEQ ID NO: 489252 - DNA, 20 bp, Artificial Sequence
  chemically synthesized
aactcgaataagaaaaacgc

SEQ ID NO: 489253 - DNA, 20 bp, Artificial Sequence
  chemically synthesized
aattcgagcgtttttcttat

SEQ ID NO: 489254 - DNA, 20 bp, Artificial Sequence
  chemically synthesized
ttttcttattcgagttcaaa

SEQ ID NO: 489255 - DNA, 20 bp, Artificial Sequence
  chemically synthesized
ctttacaatccattttgaac

SEQ ID NO: 489256 - DNA, 20 bp, Artificial Sequence
  chemically synthesized
ccaaatgtgtttttgacatt

SEQ ID NO: 489257 - DNA, 20 bp, Artificial Sequence
  chemically synthesized
agaagtttttcaaaggagat

SEQ ID NO: 489258 - DNA, 20 bp, Artificial Sequence
  chemically synthesized
aacttctcgtgtagttgtaa

SEQ ID NO: 489259 - DNA, 20 bp, Artificial Sequence
  chemically synthesized
caactgtgaaatggttgaca

SEQ ID NO: 489260 - DNA, 20 bp, Artificial Sequence
  chemically synthesized
aaggcgaaaaaactcgataa

SEQ ID NO: 489261 - DNA, 20 bp, Artificial Sequence
  chemically synthesized
gcttatgaggcacccactta

SEQ ID NO: 489262 - DNA, 20 bp, Artificial Sequence
  chemically synthesized
atggtttgttgttgttggcg

SEQ ID NO: 489263 - DNA, 20 bp, Artificial Sequence
  chemically synthesized
aacaacaaaccatttcttga

SEQ ID NO: 489264 - DNA, 20 bp, Artificial Sequence
  chemically synthesized
attgtaacgtgcaacaaaaa

SEQ ID NO: 489265 - DNA, 20 bp, Artificial Sequence
  chemically synthesized
ccgggattcagaaagcggta

SEQ ID NO: 489266 - DNA, 20 bp, Artificial Sequence
  chemically synthesized
gcctgacccactaccgcttt

SEQ ID NO: 489267 - DNA, 20 bp, Artificial Sequence
  chemically synthesized
ctcaaatgtagtggtttcgc

SEQ ID NO: 489268 - DNA, 20 bp, Artificial Sequence
  chemically synthesized
ggtcgggcgttgtcacagag

SEQ ID NO: 489269 - DNA, 20 bp, Artificial Sequence
  chemically synthesized
cacaaccaacgcttcacaag

SEQ ID NO: 489270 - DNA, 20 bp, Artificial Sequence
  chemically synthesized
accaacgcttcacaagttga

SEQ ID NO: 489271 - DNA, 20 bp, Artificial Sequence
  chemically synthesized
gaaaatgcttccacaactag

SEQ ID NO: 489272 - DNA, 20 bp, Artificial Sequence
  chemically synthesized
ggatgaagaaaatgctttcc

SEQ ID NO: 489273 - DNA, 20 bp, Artificial Sequence
  chemically synthesized
aaatgctttccaagagttca

SEQ ID NO: 489274 - DNA, 20 bp, Artificial Sequence
  chemically synthesized
agttcattgaatcccaaagc

SEQ ID NO: 489275 - DNA, 20 bp, Artificial Sequence
  chemically synthesized
tagcataaaaattcatgctt

SEQ ID NO: 489276 - DNA, 20 bp, Artificial Sequence
  chemically synthesized
agcatgaatttttatgctac

SEQ ID NO: 489277 - DNA, 20 bp, Artificial Sequence
  chemically synthesized
agaaattgcagtttgggacc

SEQ ID NO: 489278 - DNA, 20 bp, Artificial Sequence
  chemically synthesized
gagagatgacacagctagta

SEQ ID NO: 489279 - DNA, 20 bp, Artificial Sequence
  chemically synthesized
cccacaattaatcacgcctc

SEQ ID NO: 489280 - DNA, 20 bp, Artificial Sequence
  chemically synthesized
agaagggactacacaaaggc

SEQ ID NO: 489281 - DNA, 20 bp, Artificial Sequence
  chemically synthesized
gccaggcatatggccaagtt

SEQ ID NO: 489282 - DNA, 20 bp, Artificial Sequence
  chemically synthesized
atatgcctggctttggccaa

SEQ ID NO: 489283 - DNA, 20 bp, Artificial Sequence
  chemically synthesized
gcttccccacagcttggtgg

SEQ ID NO: 489284 - DNA, 20 bp, Artificial Sequence
  chemically synthesized
ctcatggccaatagctttag

SEQ ID NO: 489285 - DNA, 20 bp, Artificial Sequence
  chemically synthesized
cagcaccaactgccagtcat

SEQ ID NO: 489286 - DNA, 20 bp, Artificial Sequence
  chemically synthesized
gttgatatcaggtgaagcag

SEQ ID NO: 489287 - DNA, 20 bp, Artificial Sequence
  chemically synthesized
tgaatatcatagtcaactct

SEQ ID NO: 489288 - DNA, 20 bp, Artificial Sequence
  chemically synthesized
ttacgatttctcataattct

SEQ ID NO: 489289 - DNA, 20 bp, Artificial Sequence
  chemically synthesized
tattttaagccagtaacttt

SEQ ID NO: 489290 - DNA, 20 bp, Artificial Sequence
  chemically synthesized
catagcatatataactggaa

SEQ ID NO: 489291 - DNA, 20 bp, Artificial Sequence
  chemically synthesized
aaatcaaaatttgaaccagg

SEQ ID NO: 489292 - DNA, 20 bp, Artificial Sequence
  chemically synthesized
aacatgtcgaactaactata

SEQ ID NO: 489293 - DNA, 20 bp, Artificial Sequence
  chemically synthesized
gtagtctggtatagccaatg

SEQ ID NO: 489294 - DNA, 20 bp, Artificial Sequence
  chemically synthesized
ttcctgtttcctgctcttat

SEQ ID NO: 489295 - DNA, 20 bp, Artificial Sequence
  chemically synthesized
gcaaagataatgtcaccaga

SEQ ID NO: 489296 - DNA, 20 bp, Artificial Sequence
  chemically synthesized
tatctttgctctcaggaaca

SEQ ID NO: 489297 - DNA, 20 bp, Artificial Sequence
  chemically synthesized
ggtgctaattaaaatgtgaa

SEQ ID NO: 489298 - DNA, 20 bp, Artificial Sequence
  chemically synthesized
ctctttcaagattaatatga

SEQ ID NO: 489299 - DNA, 20 bp, Artificial Sequence
  chemically synthesized
aatatgactgagttgtggtg

SEQ ID NO: 489300 - DNA, 20 bp, Artificial Sequence
  chemically synthesized
tttcaaaatcttcctctgga

SEQ ID NO: 489301 - DNA, 20 bp, Artificial Sequence
  chemically synthesized
tttttttcaaaatcttcctc

SEQ ID NO: 489302 - DNA, 20 bp, Artificial Sequence
  chemically synthesized
cttatcactgagacatttat

SEQ ID NO: 489303 - DNA, 20 bp, Artificial Sequence
  chemically synthesized
actgagacatttatttgggt

SEQ ID NO: 489304 - DNA, 20 bp, Artificial Sequence
  chemically synthesized
agcaagagagcataaaacgg

SEQ ID NO: 489305 - DNA, 20 bp, Artificial Sequence
  chemically synthesized
ggaaagcaagagagcataaa

SEQ ID NO: 489306 - DNA, 20 bp, Artificial Sequence
  chemically synthesized
agcaattattactttgatgg

SEQ ID NO: 489307 - DNA, 20 bp, Artificial Sequence
  chemically synthesized
caataaagctttttgaagtc

SEQ ID NO: 489308 - DNA, 20 bp, Artificial Sequence
  chemically synthesized
cttgacttcaaaaagcttta

SEQ ID NO: 489309 - DNA, 20 bp, Artificial Sequence
  chemically synthesized
ttagcttacatttgaaaact

SEQ ID NO: 489310 - DNA, 20 bp, Artificial Sequence
  chemically synthesized
ttacatttgaaaactcagaa

SEQ ID NO: 489311 - DNA, 20 bp, Artificial Sequence
  chemically synthesized
cccatacccaccactccatt

SEQ ID NO: 489312 - DNA, 20 bp, Artificial Sequence
  chemically synthesized
tgaaaactcagaatggagtg

SEQ ID NO: 489313 - DNA, 20 bp, Artificial Sequence
  chemically synthesized
cagaatggagtggtgggtat

SEQ ID NO: 489314 - DNA, 20 bp, Artificial Sequence
  chemically synthesized
tgtggagagggagagaagta

SEQ ID NO: 489315 - DNA, 20 bp, Artificial Sequence
  chemically synthesized
gtctttgtgcctgggctgga

SEQ ID NO: 489316 - DNA, 20 bp, Artificial Sequence
  chemically synthesized
aaaccttgcacactgttggt

SEQ ID NO: 489317 - DNA, 20 bp, Artificial Sequence
  chemically synthesized
tatacccagcagtgggattg

SEQ ID NO: 489318 - DNA, 20 bp, Artificial Sequence
  chemically synthesized
atgatccagcaatcccactg

SEQ ID NO: 489319 - DNA, 20 bp, Artificial Sequence
  chemically synthesized
tttgggtatatacccagcag

SEQ ID NO: 489320 - DNA, 20 bp, Artificial Sequence
  chemically synthesized
aatatactgatttcctttct

SEQ ID NO: 489321 - DNA, 20 bp, Artificial Sequence
  chemically synthesized
aatagagctgcaataaacat

SEQ ID NO: 489322 - DNA, 20 bp, Artificial Sequence
  chemically synthesized
ttttccaaaccttggctatt

SEQ ID NO: 489323 - DNA, 20 bp, Artificial Sequence
  chemically synthesized
atttaagtgtccatcaacaa

SEQ ID NO: 489324 - DNA, 20 bp, Artificial Sequence
  chemically synthesized
aagtgtccatcaacaaatga

SEQ ID NO: 489325 - DNA, 20 bp, Artificial Sequence
  chemically synthesized
acgtggtacatatacacaaa

SEQ ID NO: 489326 - DNA, 20 bp, Artificial Sequence
  chemically synthesized
gatctcaatcttttctatgg

SEQ ID NO: 489327 - DNA, 20 bp, Artificial Sequence
  chemically synthesized
atccatgttgttgcaaatga

SEQ ID NO: 489328 - DNA, 20 bp, Artificial Sequence
  chemically synthesized
atcctgtcatttgcaacaac

SEQ ID NO: 489329 - DNA, 20 bp, Artificial Sequence
  chemically synthesized
ctcatgttctcacttatttg

SEQ ID NO: 489330 - DNA, 20 bp, Artificial Sequence
  chemically synthesized
caatggaactcatggacata

SEQ ID NO: 489331 - DNA, 20 bp, Artificial Sequence
  chemically synthesized
cctttctactctctatgtcc

SEQ ID NO: 489332 - DNA, 20 bp, Artificial Sequence
  chemically synthesized
ggtagttgccagaggctggg

SEQ ID NO: 489333 - DNA, 20 bp, Artificial Sequence
  chemically synthesized
gaggctgggaaggatagtgg

SEQ ID NO: 489334 - DNA, 20 bp, Artificial Sequence
  chemically synthesized
aggagtcggggagggggcag

SEQ ID NO: 489335 - DNA, 20 bp, Artificial Sequence
  chemically synthesized
agggggcagcgggatggtta

SEQ ID NO: 489336 - DNA, 20 bp, Artificial Sequence
  chemically synthesized
acaaaaaatacttaggaaaa

SEQ ID NO: 489337 - DNA, 20 bp, Artificial Sequence
  chemically synthesized
ccctgttgtgctatcgaata

SEQ ID NO: 489338 - DNA, 20 bp, Artificial Sequence
  chemically synthesized
atagtcaccctgttgtgcta

SEQ ID NO: 489339 - DNA, 20 bp, Artificial Sequence
  chemically synthesized
cccagtattcgatagcacaa

SEQ ID NO: 489340 - DNA, 20 bp, Artificial Sequence
  chemically synthesized
ctgcacatttaaaaataaat

SEQ ID NO: 489341 - DNA, 20 bp, Artificial Sequence
  chemically synthesized
aaaaataaataagagtataa

SEQ ID NO: 489342 - DNA, 20 bp, Artificial Sequence
  chemically synthesized
cacaaaagattaatgctgga

SEQ ID NO: 489343 - DNA, 20 bp, Artificial Sequence
  chemically synthesized
aaagattaatgctggagggg

SEQ ID NO: 489344 - DNA, 20 bp, Artificial Sequence
  chemically synthesized
taatcacatcatggagaacg

SEQ ID NO: 489345 - DNA, 20 bp, Artificial Sequence
  chemically synthesized
atagtaggtgtatgtattta

SEQ ID NO: 489346 - DNA, 20 bp, Artificial Sequence
  chemically synthesized
taaaatttttttaaattttt

SEQ ID NO: 489347 - DNA, 20 bp, Artificial Sequence
  chemically synthesized
ttaaaaaaattttaaaaaga

SEQ ID NO: 489348 - DNA, 20 bp, Artificial Sequence
  chemically synthesized
cagctaaaagtccattgtct

SEQ ID NO: 489349 - DNA, 20 bp, Artificial Sequence
  chemically synthesized
cacagacaatggacttttag

SEQ ID NO: 489350 - DNA, 20 bp, Artificial Sequence
  chemically synthesized
cttttagctggatgcagtaa

SEQ ID NO: 489351 - DNA, 20 bp, Artificial Sequence
  chemically synthesized
gttctcttgatgataagaaa

SEQ ID NO: 489352 - DNA, 20 bp, Artificial Sequence
  chemically synthesized
gatgataagaaagagagtgc

SEQ ID NO: 489353 - DNA, 20 bp, Artificial Sequence
  chemically synthesized
ttgaaatgcagtattatatt

SEQ ID NO: 489354 - DNA, 20 bp, Artificial Sequence
  chemically synthesized
ttgtttgaaacatggaaact

SEQ ID NO: 489355 - DNA, 20 bp, Artificial Sequence
  chemically synthesized
cattgtcttttcagatttct

SEQ ID NO: 489356 - DNA, 20 bp, Artificial Sequence
  chemically synthesized
ggagggggacaaacattaaa

SEQ ID NO: 489357 - DNA, 20 bp, Artificial Sequence
  chemically synthesized
acagacagacacttgtcttt

SEQ ID NO: 489358 - DNA, 20 bp, Artificial Sequence
  chemically synthesized
ataatgttaaggaatgagga

SEQ ID NO: 489359 - DNA, 20 bp, Artificial Sequence
  chemically synthesized
atggtataatgttaaggaat

SEQ ID NO: 489360 - DNA, 20 bp, Artificial Sequence
  chemically synthesized
tccaatatggtataatgtta

SEQ ID NO: 489361 - DNA, 20 bp, Artificial Sequence
  chemically synthesized
ttggaaacacttaataaata

SEQ ID NO: 489362 - DNA, 20 bp, Artificial Sequence
  chemically synthesized
aggtactgtttctatactcc

SEQ ID NO: 489363 - DNA, 20 bp, Artificial Sequence
  chemically synthesized
gatactttatgcaaaatcct

SEQ ID NO: 489364 - DNA, 20 bp, Artificial Sequence
  chemically synthesized
attttgcataaagtatcttt

SEQ ID NO: 489365 - DNA, 20 bp, Artificial Sequence
  chemically synthesized
tctcaaaagccaatagtcta

SEQ ID NO: 489366 - DNA, 20 bp, Artificial Sequence
  chemically synthesized
cctctagactattggctttt

SEQ ID NO: 489367 - DNA, 20 bp, Artificial Sequence
  chemically synthesized
atactgtgtcaatattacgt

SEQ ID NO: 489368 - DNA, 20 bp, Artificial Sequence
  chemically synthesized
tgtcaatattacgtgagaat

SEQ ID NO: 489369 - DNA, 20 bp, Artificial Sequence
  chemically synthesized
aggattagttgattagaaat

SEQ ID NO: 489370 - DNA, 20 bp, Artificial Sequence
  chemically synthesized
gattagaaatctgaatacat

SEQ ID NO: 489371 - DNA, 20 bp, Artificial Sequence
  chemically synthesized
tacataggaatgcatcttaa

SEQ ID NO: 489372 - DNA, 20 bp, Artificial Sequence
  chemically synthesized
actgaataccttacttgtga

SEQ ID NO: 489373 - DNA, 20 bp, Artificial Sequence
  chemically synthesized
cttttaaagttgctaccatc

SEQ ID NO: 489374 - DNA, 20 bp, Artificial Sequence
  chemically synthesized
gtaacctatttccctaatcc

SEQ ID NO: 489375 - DNA, 20 bp, Artificial Sequence
  chemically synthesized
cacaaggcaggcccatattc

SEQ ID NO: 489376 - DNA, 20 bp, Artificial Sequence
  chemically synthesized
gttaaaaaaatgtgttagaa

SEQ ID NO: 489377 - DNA, 20 bp, Artificial Sequence
  chemically synthesized
agtcttgtttccttctctat

SEQ ID NO: 489378 - DNA, 20 bp, Artificial Sequence
  chemically synthesized
gcttattctcatgcaagaaa

SEQ ID NO: 489379 - DNA, 20 bp, Artificial Sequence
  chemically synthesized
tagaatcctgtttcttgcat

SEQ ID NO: 489380 - DNA, 20 bp, Artificial Sequence
  chemically synthesized
aagcccaggagcgcttgccg

SEQ ID NO: 489381 - DNA, 20 bp, Artificial Sequence
  chemically synthesized
agagaccatatggagcagag

SEQ ID NO: 489382 - DNA, 20 bp, Artificial Sequence
  chemically synthesized
ttatctagcataagcgcagc

SEQ ID NO: 489383 - DNA, 20 bp, Artificial Sequence
  chemically synthesized
catacattttcagtcagcta

SEQ ID NO: 489384 - DNA, 20 bp, Artificial Sequence
  chemically synthesized
cattagctgactgaaaatgt

SEQ ID NO: 489385 - DNA, 20 bp, Artificial Sequence
  chemically synthesized
ttataattgcacacagtctg

SEQ ID NO: 489386 - DNA, 20 bp, Artificial Sequence
  chemically synthesized
aattttaagtcaataagttt

SEQ ID NO: 489387 - DNA, 20 bp, Artificial Sequence
  chemically synthesized
tattgcaaattttacactat

SEQ ID NO: 489388 - DNA, 20 bp, Artificial Sequence
  chemically synthesized
tataggggaaagccagaaat

SEQ ID NO: 489389 - DNA, 20 bp, Artificial Sequence
  chemically synthesized
gagtgaggcttggtacagtt

SEQ ID NO: 489390 - DNA, 20 bp, Artificial Sequence
  chemically synthesized
taagagttcttaaataatac

SEQ ID NO: 489391 - DNA, 20 bp, Artificial Sequence
  chemically synthesized
aaaatcaaaatcagtaattt

SEQ ID NO: 489392 - DNA, 20 bp, Artificial Sequence
  chemically synthesized
taaaattactgattttgatt

SEQ ID NO: 489393 - DNA, 20 bp, Artificial Sequence
  chemically synthesized
attactgattttgattttga

SEQ ID NO: 489394 - DNA, 20 bp, Artificial Sequence
  chemically synthesized
tctcttcagacatctttgca

SEQ ID NO: 489395 - DNA, 20 bp, Artificial Sequence
  chemically synthesized
gttacccccattgatttgcc

SEQ ID NO: 489396 - DNA, 20 bp, Artificial Sequence
  chemically synthesized
gacattcatggcaaatcaat

SEQ ID NO: 489397 - DNA, 20 bp, Artificial Sequence
  chemically synthesized
gctttgggcaacagctgata

SEQ ID NO: 489398 - DNA, 20 bp, Artificial Sequence
  chemically synthesized
agcaggagaaggggagattt

SEQ ID NO: 489399 - DNA, 20 bp, Artificial Sequence
  chemically synthesized
atagttgagaagaaagcctg

SEQ ID NO: 489400 - DNA, 20 bp, Artificial Sequence
  chemically synthesized
aagaaagcctgaggaataag

SEQ ID NO: 489401 - DNA, 20 bp, Artificial Sequence
  chemically synthesized
gcacagaaagaggaaggaaa

SEQ ID NO: 489402 - DNA, 20 bp, Artificial Sequence
  chemically synthesized
agaaagaggaaggaaattga

SEQ ID NO: 489403 - DNA, 20 bp, Artificial Sequence
  chemically synthesized
aatctgtgggaaagttatac

SEQ ID NO: 489404 - DNA, 20 bp, Artificial Sequence
  chemically synthesized
ctttgaaacatagatcgttg

SEQ ID NO: 489405 - DNA, 20 bp, Artificial Sequence
  chemically synthesized
gtttcaaaggtataaatcat

SEQ ID NO: 489406 - DNA, 20 bp, Artificial Sequence
  chemically synthesized
ttgatatgtatcttctgtgg

SEQ ID NO: 489407 - DNA, 20 bp, Artificial Sequence
  chemically synthesized
tatgtatcttctgtggtcgg

SEQ ID NO: 489408 - DNA, 20 bp, Artificial Sequence
  chemically synthesized
aacacactgtatgcattcca

SEQ ID NO: 489409 - DNA, 20 bp, Artificial Sequence
  chemically synthesized
actgtatgcattccattgaa

SEQ ID NO: 489410 - DNA, 20 bp, Artificial Sequence
  chemically synthesized
tgaccaccaatcccattcaa

SEQ ID NO: 489411 - DNA, 20 bp, Artificial Sequence
  chemically synthesized
tggctatcaagagtctgtgt

SEQ ID NO: 489412 - DNA, 20 bp, Artificial Sequence
  chemically synthesized
ggaggtagagagtggctatc

SEQ ID NO: 489413 - DNA, 20 bp, Artificial Sequence
  chemically synthesized
tcttaaatggtagggaggta

SEQ ID NO: 489414 - DNA, 20 bp, Artificial Sequence
  chemically synthesized
caggtcctatgcaagagcca

SEQ ID NO: 489415 - DNA, 20 bp, Artificial Sequence
  chemically synthesized
aattgatgacttactgaaac

SEQ ID NO: 489416 - DNA, 20 bp, Artificial Sequence
  chemically synthesized
ttgcctaagtcacagtttcc

SEQ ID NO: 489417 - DNA, 20 bp, Artificial Sequence
  chemically synthesized
ccataggctaattgataaac

SEQ ID NO: 489418 - DNA, 20 bp, Artificial Sequence
  chemically synthesized
ttggggtctttatttagatg

SEQ ID NO: 489419 - DNA, 20 bp, Artificial Sequence
  chemically synthesized
agtttaatattagaagtgct

SEQ ID NO: 489420 - DNA, 20 bp, Artificial Sequence
  chemically synthesized
tgtatatctcacatttattt

SEQ ID NO: 489421 - DNA, 20 bp, Artificial Sequence
  chemically synthesized
tttttattaatctttctaaa

SEQ ID NO: 489422 - DNA, 20 bp, Artificial Sequence
  chemically synthesized
aattatttacccagtttttg

SEQ ID NO: 489423 - DNA, 20 bp, Artificial Sequence
  chemically synthesized
actcactgattcaccaaaaa

SEQ ID NO: 489424 - DNA, 20 bp, Artificial Sequence
  chemically synthesized
acccagtttttggtgaatca

SEQ ID NO: 489425 - DNA, 20 bp, Artificial Sequence
  chemically synthesized
cagtggcggtggttcattca

SEQ ID NO: 489426 - DNA, 20 bp, Artificial Sequence
  chemically synthesized
gctttgcaaacatttattcc

SEQ ID NO: 489427 - DNA, 20 bp, Artificial Sequence
  chemically synthesized
gtttgcaaagcataaactgc

SEQ ID NO: 489428 - DNA, 20 bp, Artificial Sequence
  chemically synthesized
gtcacgcatctttatgatta

SEQ ID NO: 489429 - DNA, 20 bp, Artificial Sequence
  chemically synthesized
ttatgattattgaatactat

SEQ ID NO: 489430 - DNA, 20 bp, Artificial Sequence
  chemically synthesized
gtggcttggaaaatgaatga

SEQ ID NO: 489431 - DNA, 20 bp, Artificial Sequence
  chemically synthesized
tggaatacgtggcttggaaa

SEQ ID NO: 489432 - DNA, 20 bp, Artificial Sequence
  chemically synthesized
ggcctcccaagtccctgaac

SEQ ID NO: 489433 - DNA, 20 bp, Artificial Sequence
  chemically synthesized
tgtctggtgctctgagttgc

SEQ ID NO: 489434 - DNA, 20 bp, Artificial Sequence
  chemically synthesized
gttggctcctgtctggtgct

SEQ ID NO: 489435 - DNA, 20 bp, Artificial Sequence
  chemically synthesized
agacaggagccaacactggc

SEQ ID NO: 489436 - DNA, 20 bp, Artificial Sequence
  chemically synthesized
tctacgactgtgccctgcga

SEQ ID NO: 489437 - DNA, 20 bp, Artificial Sequence
  chemically synthesized
tgtgtctacattgtccccat

SEQ ID NO: 489438 - DNA, 20 bp, Artificial Sequence
  chemically synthesized
tcccaaactgtgcacgttag

SEQ ID NO: 489439 - DNA, 20 bp, Artificial Sequence
  chemically synthesized
tttgggacatgtgaggaaac

SEQ ID NO: 489440 - DNA, 20 bp, Artificial Sequence
  chemically synthesized
tggggttttcttttgtctct

SEQ ID NO: 489441 - DNA, 20 bp, Artificial Sequence
  chemically synthesized
ctaggggggcactgtctatg

SEQ ID NO: 489442 - DNA, 20 bp, Artificial Sequence
  chemically synthesized
ctttaatgtacggcaggtcc

SEQ ID NO: 489443 - DNA, 20 bp, Artificial Sequence
  chemically synthesized
tctgctctacgtgatggcac

SEQ ID NO: 489444 - DNA, 20 bp, Artificial Sequence
  chemically synthesized
aaattctaatagcagtggta

SEQ ID NO: 489445 - DNA, 20 bp, Artificial Sequence
  chemically synthesized
ttaccccttaccactgctat

SEQ ID NO: 489446 - DNA, 20 bp, Artificial Sequence
  chemically synthesized
tactatcatactttattacg

SEQ ID NO: 489447 - DNA, 20 bp, Artificial Sequence
  chemically synthesized
taaataagtggcccacagtt

SEQ ID NO: 489448 - DNA, 20 bp, Artificial Sequence
  chemically synthesized
tggcccacagttatgagtta

SEQ ID NO: 489449 - DNA, 20 bp, Artificial Sequence
  chemically synthesized
tgagttagtgagtgttgaac

SEQ ID NO: 489450 - DNA, 20 bp, Artificial Sequence
  chemically synthesized
gtgttgaacctgggtctaga

SEQ ID NO: 489451 - DNA, 20 bp, Artificial Sequence
  chemically synthesized
caggactgagatgaggcatg

SEQ ID NO: 489452 - DNA, 20 bp, Artificial Sequence
  chemically synthesized
atattctaatggtttgtgta

SEQ ID NO: 489453 - DNA, 20 bp, Artificial Sequence
  chemically synthesized
gcactcattacacaaaccat

SEQ ID NO: 489454 - DNA, 20 bp, Artificial Sequence
  chemically synthesized
agaatatttgaggccacgtt

SEQ ID NO: 489455 - DNA, 20 bp, Artificial Sequence
  chemically synthesized
cgcgaactgagaagctggaa

SEQ ID NO: 489456 - DNA, 20 bp, Artificial Sequence
  chemically synthesized
aatcatttctacttcgggtg

SEQ ID NO: 489457 - DNA, 20 bp, Artificial Sequence
  chemically synthesized
attaaataatcatttctact

SEQ ID NO: 489458 - DNA, 20 bp, Artificial Sequence
  chemically synthesized
tcaagtctttatgctgaaac

SEQ ID NO: 489459 - DNA, 20 bp, Artificial Sequence
  chemically synthesized
ttttttttgtttgtttgaga

SEQ ID NO: 489460 - DNA, 20 bp, Artificial Sequence
  chemically synthesized
ctgcattccagcctgggcaa

SEQ ID NO: 489461 - DNA, 20 bp, Artificial Sequence
  chemically synthesized
tctcactcggttgcccaggc

SEQ ID NO: 489462 - DNA, 20 bp, Artificial Sequence
  chemically synthesized
ttcactgcaacctccgcctc

SEQ ID NO: 489463 - DNA, 20 bp, Artificial Sequence
  chemically synthesized
tacttgggaggctgaggcag

SEQ ID NO: 489464 - DNA, 20 bp, Artificial Sequence
  chemically synthesized
tgggcgtggtggcacatgac

SEQ ID NO: 489465 - DNA, 20 bp, Artificial Sequence
  chemically synthesized
ttttgtatttttagtagaga

SEQ ID NO: 489466 - DNA, 20 bp, Artificial Sequence
  chemically synthesized
gagggcaggccacttgaggt

SEQ ID NO: 489467 - DNA, 20 bp, Artificial Sequence
  chemically synthesized
tccttggcctcccaaagtgc

SEQ ID NO: 489468 - DNA, 20 bp, Artificial Sequence
  chemically synthesized
actatatgaaatcttaccca

SEQ ID NO: 489469 - DNA, 20 bp, Artificial Sequence
  chemically synthesized
attaatagaaaagacactct

SEQ ID NO: 489470 - DNA, 20 bp, Artificial Sequence
  chemically synthesized
ttggcctttatttgttctca

SEQ ID NO: 489471 - DNA, 20 bp, Artificial Sequence
  chemically synthesized
aataagggcctatatagcac

SEQ ID NO: 489472 - DNA, 20 bp, Artificial Sequence
  chemically synthesized
gtgtattttatcagtgatgt

SEQ ID NO: 489473 - DNA, 20 bp, Artificial Sequence
  chemically synthesized
gatagtcatttacattgcaa

SEQ ID NO: 489474 - DNA, 20 bp, Artificial Sequence
  chemically synthesized
atttacattgcaattgagtt

SEQ ID NO: 489475 - DNA, 20 bp, Artificial Sequence
  chemically synthesized
acttattgaaacttttataa

SEQ ID NO: 489476 - DNA, 20 bp, Artificial Sequence
  chemically synthesized
tgtgggtgacatcaacagtt

SEQ ID NO: 489477 - DNA, 20 bp, Artificial Sequence
  chemically synthesized
tgacacattctgactgtgat

SEQ ID NO: 489478 - DNA, 20 bp, Artificial Sequence
  chemically synthesized
gatgtcacccacatcacagt

SEQ ID NO: 489479 - DNA, 20 bp, Artificial Sequence
  chemically synthesized
catcagtcacaggttgcctg

SEQ ID NO: 489480 - DNA, 20 bp, Artificial Sequence
  chemically synthesized
aatgtaaccatcagaacaaa

SEQ ID NO: 489481 - DNA, 20 bp, Artificial Sequence
  chemically synthesized
ccggaaaccaaagtcatcaa

SEQ ID NO: 489482 - DNA, 20 bp, Artificial Sequence
  chemically synthesized
tggaaatgaaagcatttgag

SEQ ID NO: 489483 - DNA, 20 bp, Artificial Sequence
  chemically synthesized
tcatttccacaacaaaattg

SEQ ID NO: 489484 - DNA, 20 bp, Artificial Sequence
  chemically synthesized
gttcggggcaagaccactgt

SEQ ID NO: 489485 - DNA, 20 bp, Artificial Sequence
  chemically synthesized
gtcttgccccgaaccataag

SEQ ID NO: 489486 - DNA, 20 bp, Artificial Sequence
  chemically synthesized
ccataaggtggataaatgag

SEQ ID NO: 489487 - DNA, 20 bp, Artificial Sequence
  chemically synthesized
ctagattatctgaaagtaag

SEQ ID NO: 489488 - DNA, 20 bp, Artificial Sequence
  chemically synthesized
tctgtctcgtgtcagctgag

SEQ ID NO: 489489 - DNA, 20 bp, Artificial Sequence
  chemically synthesized
acgagacagaaataacatca

SEQ ID NO: 489490 - DNA, 20 bp, Artificial Sequence
  chemically synthesized
ggaaccccaggtttgcaaga

SEQ ID NO: 489491 - DNA, 20 bp, Artificial Sequence
  chemically synthesized
taaactctttcttgcaaacc

SEQ ID NO: 489492 - DNA, 20 bp, Artificial Sequence
  chemically synthesized
attgtgtagaaaatggattg

SEQ ID NO: 489493 - DNA, 20 bp, Artificial Sequence
  chemically synthesized
taccttttattgtgtagaaa

SEQ ID NO: 489494 - DNA, 20 bp, Artificial Sequence
  chemically synthesized
aggcttataacagatctgta

SEQ ID NO: 489495 - DNA, 20 bp, Artificial Sequence
  chemically synthesized
caggtggtatacggcaaaaa

SEQ ID NO: 489496 - DNA, 20 bp, Artificial Sequence
  chemically synthesized
tagaaaagggataccaaatg

SEQ ID NO: 489497 - DNA, 20 bp, Artificial Sequence
  chemically synthesized
agtgcttcaaaccatagaaa

SEQ ID NO: 489498 - DNA, 20 bp, Artificial Sequence
  chemically synthesized
tttctatggtttgaagcact

SEQ ID NO: 489499 - DNA, 20 bp, Artificial Sequence
  chemically synthesized
agcactaggggtcagctgac

SEQ ID NO: 489500 - DNA, 20 bp, Artificial Sequence
  chemically synthesized
ttatactcatacatcaagat

SEQ ID NO: 489501 - DNA, 20 bp, Artificial Sequence
  chemically synthesized
ataaactcacatcttgatgt

SEQ ID NO: 489502 - DNA, 20 bp, Artificial Sequence
  chemically synthesized
gggtgatttttattaaagat

SEQ ID NO: 489503 - DNA, 20 bp, Artificial Sequence
  chemically synthesized
gccatacaaaagtaaaataa

SEQ ID NO: 489504 - DNA, 20 bp, Artificial Sequence
  chemically synthesized
aggtgatataataaatgaaa

SEQ ID NO: 489505 - DNA, 20 bp, Artificial Sequence
  chemically synthesized
tataataaatgaaactgggt

SEQ ID NO: 489506 - DNA, 20 bp, Artificial Sequence
  chemically synthesized
ccttatttaacctcagttta

SEQ ID NO: 489507 - DNA, 20 bp, Artificial Sequence
  chemically synthesized
gcaccaaccctgagactaga

SEQ ID NO: 489508 - DNA, 20 bp, Artificial Sequence
  chemically synthesized
aaggaaactccctctagtct

SEQ ID NO: 489509 - DNA, 20 bp, Artificial Sequence
  chemically synthesized
gaagaaatgacataataaaa

SEQ ID NO: 489510 - DNA, 20 bp, Artificial Sequence
  chemically synthesized
aaacacctttgtgctaataa

SEQ ID NO: 489511 - DNA, 20 bp, Artificial Sequence
  chemically synthesized
aaaatgctacactgaagatg

SEQ ID NO: 489512 - DNA, 20 bp, Artificial Sequence
  chemically synthesized
atgatggatttaaaatgatg

SEQ ID NO: 489513 - DNA, 20 bp, Artificial Sequence
  chemically synthesized
atctctcctccccgttcatg

SEQ ID NO: 489514 - DNA, 20 bp, Artificial Sequence
  chemically synthesized
aacggggaggagagattgct

SEQ ID NO: 489515 - DNA, 20 bp, Artificial Sequence
  chemically synthesized
ggagagattgctaagaatag

SEQ ID NO: 489516 - DNA, 20 bp, Artificial Sequence
  chemically synthesized
tcagtgcttcacaatttatg

SEQ ID NO: 489517 - DNA, 20 bp, Artificial Sequence
  chemically synthesized
tttttaaaacattattatat

SEQ ID NO: 489518 - DNA, 20 bp, Artificial Sequence
  chemically synthesized
caaaaataaaggtaggggga

SEQ ID NO: 489519 - DNA, 20 bp, Artificial Sequence
  chemically synthesized
aaagtttacttgctttctgc

SEQ ID NO: 489520 - DNA, 20 bp, Artificial Sequence
  chemically synthesized
cttgctttctgcttggattt

SEQ ID NO: 489521 - DNA, 20 bp, Artificial Sequence
  chemically synthesized
agattgataaaaacgatgtt

SEQ ID NO: 489522 - DNA, 20 bp, Artificial Sequence
  chemically synthesized
tgttcagaattaaaagtcct

SEQ ID NO: 489523 - DNA, 20 bp, Artificial Sequence
  chemically synthesized
tatgttcatactttaaaagt

SEQ ID NO: 489524 - DNA, 20 bp, Artificial Sequence
  chemically synthesized
gaaaatgaaagtaatatcag

SEQ ID NO: 489525 - DNA, 20 bp, Artificial Sequence
  chemically synthesized
tggctctcgtggaaggcaca

SEQ ID NO: 489526 - DNA, 20 bp, Artificial Sequence
  chemically synthesized
atgcaacaggtgaaggagag

SEQ ID NO: 489527 - DNA, 20 bp, Artificial Sequence
  chemically synthesized
ctgaactatgtgctactatt

SEQ ID NO: 489528 - DNA, 20 bp, Artificial Sequence
  chemically synthesized
ttaagaaggtgagacttttg

SEQ ID NO: 489529 - DNA, 20 bp, Artificial Sequence
  chemically synthesized
cttttggagaatttggaggt

SEQ ID NO: 489530 - DNA, 20 bp, Artificial Sequence
  chemically synthesized
aatgttagattaaaaacagt

SEQ ID NO: 489531 - DNA, 20 bp, Artificial Sequence
  chemically synthesized
atttcccatttactacctca

SEQ ID NO: 489532 - DNA, 20 bp, Artificial Sequence
  chemically synthesized
gaagtgtcttcttttagtat

SEQ ID NO: 489533 - DNA, 20 bp, Artificial Sequence
  chemically synthesized
tcttttagtatttgaatttt

SEQ ID NO: 489534 - DNA, 20 bp, Artificial Sequence
  chemically synthesized
tgttataacttaggtatgga

SEQ ID NO: 489535 - DNA, 20 bp, Artificial Sequence
  chemically synthesized
atcacatagctggtagcaag

SEQ ID NO: 489536 - DNA, 20 bp, Artificial Sequence
  chemically synthesized
taatgatgagattatgaatt

SEQ ID NO: 489537 - DNA, 20 bp, Artificial Sequence
  chemically synthesized
caggcattaatgatgagatt

SEQ ID NO: 489538 - DNA, 20 bp, Artificial Sequence
  chemically synthesized
caaacaaggaaaaagtaaac

SEQ ID NO: 489539 - DNA, 20 bp, Artificial Sequence
  chemically synthesized
atataggcaatgccaagaat

SEQ ID NO: 489540 - DNA, 20 bp, Artificial Sequence
  chemically synthesized
aataccatataggcaatgcc

SEQ ID NO: 489541 - DNA, 20 bp, Artificial Sequence
  chemically synthesized
gggtgttatgagccaggaac

SEQ ID NO: 489542 - DNA, 20 bp, Artificial Sequence
  chemically synthesized
aaaaaactgtaacaagggct

SEQ ID NO: 489543 - DNA, 20 bp, Artificial Sequence
  chemically synthesized
ttgttataatgttggttgcg

SEQ ID NO: 489544 - DNA, 20 bp, Artificial Sequence
  chemically synthesized
gtcttaaaaacctcctgtta

SEQ ID NO: 489545 - DNA, 20 bp, Artificial Sequence
  chemically synthesized
ccaccatatacccttgggga

SEQ ID NO: 489546 - DNA, 20 bp, Artificial Sequence
  chemically synthesized
gacatcagcattccttcccc

SEQ ID NO: 489547 - DNA, 20 bp, Artificial Sequence
  chemically synthesized
tccataaaaaacaaagagga

SEQ ID NO: 489548 - DNA, 20 bp, Artificial Sequence
  chemically synthesized
ggacagagtccagtgagctt

SEQ ID NO: 489549 - DNA, 20 bp, Artificial Sequence
  chemically synthesized
ttccgggtagctgaacaggt

SEQ ID NO: 489550 - DNA, 20 bp, Artificial Sequence
  chemically synthesized
tgaacaggtggggattccta

SEQ ID NO: 489551 - DNA, 20 bp, Artificial Sequence
  chemically synthesized
ccctgagtgcaccaccctct

SEQ ID NO: 489552 - DNA, 20 bp, Artificial Sequence
  chemically synthesized
atggagcttccatgccctcc

SEQ ID NO: 489553 - DNA, 20 bp, Artificial Sequence
  chemically synthesized
tgcatagggtgaggtatggt

SEQ ID NO: 489554 - DNA, 20 bp, Artificial Sequence
  chemically synthesized
gacacagatgaagagatgca

SEQ ID NO: 489555 - DNA, 20 bp, Artificial Sequence
  chemically synthesized
gctttcacctgtttatgata

SEQ ID NO: 489556 - DNA, 20 bp, Artificial Sequence
  chemically synthesized
tttatcataaacaggtgaaa

SEQ ID NO: 489557 - DNA, 20 bp, Artificial Sequence
  chemically synthesized
aggtgaaagcgagtgttttc

SEQ ID NO: 489558 - DNA, 20 bp, Artificial Sequence
  chemically synthesized
aagttagttgaacccaaaga

SEQ ID NO: 489559 - DNA, 20 bp, Artificial Sequence
  chemically synthesized
gggttcccatgaccctctct

SEQ ID NO: 489560 - DNA, 20 bp, Artificial Sequence
  chemically synthesized
ctgacccatgggcttcaagt

SEQ ID NO: 489561 - DNA, 20 bp, Artificial Sequence
  chemically synthesized
ggaaccccaacttgaagccc

SEQ ID NO: 489562 - DNA, 20 bp, Artificial Sequence
  chemically synthesized
tgtgcgcgcgcgtgcgctag

SEQ ID NO: 489563 - DNA, 20 bp, Artificial Sequence
  chemically synthesized
ggtactgagccctcaatcta

SEQ ID NO: 489564 - DNA, 20 bp, Artificial Sequence
  chemically synthesized
tatgggatctgacactatct

SEQ ID NO: 489565 - DNA, 20 bp, Artificial Sequence
  chemically synthesized
ggatctgacactatctctgg

SEQ ID NO: 489566 - DNA, 20 bp, Artificial Sequence
  chemically synthesized
ctgggtggatagtgtcagga

SEQ ID NO: 489567 - DNA, 20 bp, Artificial Sequence
  chemically synthesized
caccaaacagcaggcaccag

SEQ ID NO: 489568 - DNA, 20 bp, Artificial Sequence
  chemically synthesized
gacttttatgaccaaatttg

SEQ ID NO: 489569 - DNA, 20 bp, Artificial Sequence
  chemically synthesized
gttgacgattgttacgattt

SEQ ID NO: 489570 - DNA, 20 bp, Artificial Sequence
  chemically synthesized
agagaaaaaacacggttaga

SEQ ID NO: 489571 - DNA, 20 bp, Artificial Sequence
  chemically synthesized
ctttaatgacaatagtatat

SEQ ID NO: 489572 - DNA, 20 bp, Artificial Sequence
  chemically synthesized
cttatatactattgtcatta

SEQ ID NO: 489573 - DNA, 20 bp, Artificial Sequence
  chemically synthesized
aaatctgattgccattatta

SEQ ID NO: 489574 - DNA, 20 bp, Artificial Sequence
  chemically synthesized
aataatggcaatcagatttc

SEQ ID NO: 489575 - DNA, 20 bp, Artificial Sequence
  chemically synthesized
cctaatactttagttcagct

SEQ ID NO: 489576 - DNA, 20 bp, Artificial Sequence
  chemically synthesized
ctgatgtttgttctcataac

SEQ ID NO: 489577 - DNA, 20 bp, Artificial Sequence
  chemically synthesized
tagaagataaaatatataga

SEQ ID NO: 489578 - DNA, 20 bp, Artificial Sequence
  chemically synthesized
atatattttatcttctaaag

SEQ ID NO: 489579 - DNA, 20 bp, Artificial Sequence
  chemically synthesized
ggagctattaaaaattatga

SEQ ID NO: 489580 - DNA, 20 bp, Artificial Sequence
  chemically synthesized
ttattactaggttgtgtgtc

SEQ ID NO: 489581 - DNA, 20 bp, Artificial Sequence
  chemically synthesized
aaattataggaggcaaagtc

SEQ ID NO: 489582 - DNA, 20 bp, Artificial Sequence
  chemically synthesized
gaagctgagggttgggggaa

SEQ ID NO: 489583 - DNA, 20 bp, Artificial Sequence
  chemically synthesized
ttgctaaacagtttgaagct

SEQ ID NO: 489584 - DNA, 20 bp, Artificial Sequence
  chemically synthesized
agcaactataaattagagat

SEQ ID NO: 489585 - DNA, 20 bp, Artificial Sequence
  chemically synthesized
gcatgtcctttaaataaggg

SEQ ID NO: 489586 - DNA, 20 bp, Artificial Sequence
  chemically synthesized
tgattatgatatgcttagaa

SEQ ID NO: 489587 - DNA, 20 bp, Artificial Sequence
  chemically synthesized
agtcctttaatagatagctc

SEQ ID NO: 489588 - DNA, 20 bp, Artificial Sequence
  chemically synthesized
ataaagaaaacatccaaata

SEQ ID NO: 489589 - DNA, 20 bp, Artificial Sequence
  chemically synthesized
agttcctggaaatccattat

SEQ ID NO: 489590 - DNA, 20 bp, Artificial Sequence
  chemically synthesized
taaagaaaacattcaagata

SEQ ID NO: 489591 - DNA, 20 bp, Artificial Sequence
  chemically synthesized
gttcccagaaacccattatc

SEQ ID NO: 489592 - DNA, 20 bp, Artificial Sequence
  chemically synthesized
aaaaaaaaaaaaaaaaaaaa

SEQ ID NO: 489593 - DNA, 20 bp, Artificial Sequence
  chemically synthesized
ttttttttttttttttgaga

SEQ ID NO: 489594 - DNA, 20 bp, Artificial Sequence
  chemically synthesized
gtcttgctctgtcgccaggc

SEQ ID NO: 489595 - DNA, 20 bp, Artificial Sequence
  chemically synthesized
caggagaatcacttgaacca

SEQ ID NO: 489596 - DNA, 20 bp, Artificial Sequence
  chemically synthesized
tatttgggaggctgaggcag

SEQ ID NO: 489597 - DNA, 20 bp, Artificial Sequence
  chemically synthesized
gcctcagcctcccaaatagc

SEQ ID NO: 489598 - DNA, 20 bp, Artificial Sequence
  chemically synthesized
ttttgtatttttaatagaga

SEQ ID NO: 489599 - DNA, 20 bp, Artificial Sequence
  chemically synthesized
cggagttttgccatgttggc

SEQ ID NO: 489600 - DNA, 20 bp, Artificial Sequence
  chemically synthesized
gcctgggcctcccaaagtgc

SEQ ID NO: 489601 - DNA, 20 bp, Artificial Sequence
  chemically synthesized
ctattatataagaaaacggg

SEQ ID NO: 489602 - DNA, 20 bp, Artificial Sequence
  chemically synthesized
ttttacagcatttttttttc

SEQ ID NO: 489603 - DNA, 20 bp, Artificial Sequence
  chemically synthesized
atgttttttcaaccaaataa

SEQ ID NO: 489604 - DNA, 20 bp, Artificial Sequence
  chemically synthesized
acatcacgttaagggcagga

SEQ ID NO: 489605 - DNA, 20 bp, Artificial Sequence
  chemically synthesized
aaagtgtccatttttgagca

SEQ ID NO: 489606 - DNA, 20 bp, Artificial Sequence
  chemically synthesized
tattagtcgtcagtataaat

SEQ ID NO: 489607 - DNA, 20 bp, Artificial Sequence
  chemically synthesized
ttttcatttgtataaggtaa

SEQ ID NO: 489608 - DNA, 20 bp, Artificial Sequence
  chemically synthesized
tgcttctaaatatgtatctg

SEQ ID NO: 489609 - DNA, 20 bp, Artificial Sequence
  chemically synthesized
tgtggaagatagtttgtgct

SEQ ID NO: 489610 - DNA, 20 bp, Artificial Sequence
  chemically synthesized
atataacaaacctttaatat

SEQ ID NO: 489611 - DNA, 20 bp, Artificial Sequence
  chemically synthesized
ctacctttttcctcggtaaa

SEQ ID NO: 489612 - DNA, 20 bp, Artificial Sequence
  chemically synthesized
ttaagaaatttggctggaaa

SEQ ID NO: 489613 - DNA, 20 bp, Artificial Sequence
  chemically synthesized
tgtaaatggtaaattactat

SEQ ID NO: 489614 - DNA, 20 bp, Artificial Sequence
  chemically synthesized
acatatttattaaaactaat

SEQ ID NO: 489615 - DNA, 20 bp, Artificial Sequence
  chemically synthesized
ttacttgacattaaaaatag

SEQ ID NO: 489616 - DNA, 20 bp, Artificial Sequence
  chemically synthesized
aaaacatgtttatgttgttt

SEQ ID NO: 489617 - DNA, 20 bp, Artificial Sequence
  chemically synthesized
ttttcttttaaaaaaactat

SEQ ID NO: 489618 - DNA, 20 bp, Artificial Sequence
  chemically synthesized
taatatcctaatattaaaat

SEQ ID NO: 489619 - DNA, 20 bp, Artificial Sequence
  chemically synthesized
ataaatccccattttaatat

SEQ ID NO: 489620 - DNA, 20 bp, Artificial Sequence
  chemically synthesized
gaagctcaagtgatttttat

SEQ ID NO: 489621 - DNA, 20 bp, Artificial Sequence
  chemically synthesized
gtgattccaaaataaacagt

SEQ ID NO: 489622 - DNA, 20 bp, Artificial Sequence
  chemically synthesized
aaaacccctactgtttattt

SEQ ID NO: 489623 - DNA, 20 bp, Artificial Sequence
  chemically synthesized
tcattctttatttttgaaca

SEQ ID NO: 489624 - DNA, 20 bp, Artificial Sequence
  chemically synthesized
ggactcggtgttcaaaaata

SEQ ID NO: 489625 - DNA, 20 bp, Artificial Sequence
  chemically synthesized
catattttggttttaaataa

SEQ ID NO: 489626 - DNA, 20 bp, Artificial Sequence
  chemically synthesized
gctctttgtatatgttatat

SEQ ID NO: 489627 - DNA, 20 bp, Artificial Sequence
  chemically synthesized
aacatatacaaagagcaatg

SEQ ID NO: 489628 - DNA, 20 bp, Artificial Sequence
  chemically synthesized
agacatgaaagagatgaaac

SEQ ID NO: 489629 - DNA, 20 bp, Artificial Sequence
  chemically synthesized
agagatgaaactgggattaa

SEQ ID NO: 489630 - DNA, 20 bp, Artificial Sequence
  chemically synthesized
gtcagggaaggagagcagaa

SEQ ID NO: 489631 - DNA, 20 bp, Artificial Sequence
  chemically synthesized
ataaacaactggggcagaaa

SEQ ID NO: 489632 - DNA, 20 bp, Artificial Sequence
  chemically synthesized
gtgagccaccgcacctggcc

SEQ ID NO: 489633 - DNA, 20 bp, Artificial Sequence
  chemically synthesized
tgggcagatcacctgaggtc

SEQ ID NO: 489634 - DNA, 20 bp, Artificial Sequence
  chemically synthesized
ttttgtattttaagtagaga

SEQ ID NO: 489635 - DNA, 20 bp, Artificial Sequence
  chemically synthesized
gcctcagcttcccgagtagc

SEQ ID NO: 489636 - DNA, 20 bp, Artificial Sequence
  chemically synthesized
gattctcctgcctcagcttc

SEQ ID NO: 489637 - DNA, 20 bp, Artificial Sequence
  chemically synthesized
tactcgggaagctgaggcag

SEQ ID NO: 489638 - DNA, 20 bp, Artificial Sequence
  chemically synthesized
ctcactgcaacctctgtctc

SEQ ID NO: 489639 - DNA, 20 bp, Artificial Sequence
  chemically synthesized
cccaggagacagaggttgca

SEQ ID NO: 489640 - DNA, 20 bp, Artificial Sequence
  chemically synthesized
ttttgctctgtcgcccaggc

SEQ ID NO: 489641 - DNA, 20 bp, Artificial Sequence
  chemically synthesized
ttttttttttttttttgaga

SEQ ID NO: 489642 - DNA, 20 bp, Artificial Sequence
  chemically synthesized
tttatttttatatatttatt

SEQ ID NO: 489643 - DNA, 20 bp, Artificial Sequence
  chemically synthesized
tgaattgacacgtatattat

SEQ ID NO: 489644 - DNA, 20 bp, Artificial Sequence
  chemically synthesized
ttttaggctaattttcatct

SEQ ID NO: 489645 - DNA, 20 bp, Artificial Sequence
  chemically synthesized
aagtgagaaacacagaggaa

SEQ ID NO: 489646 - DNA, 20 bp, Artificial Sequence
  chemically synthesized
tattttctctgaacatgcat

SEQ ID NO: 489647 - DNA, 20 bp, Artificial Sequence
  chemically synthesized
aaatacaaagaaatatgaag

SEQ ID NO: 489648 - DNA, 20 bp, Artificial Sequence
  chemically synthesized
gggataaatattaaaaacac

SEQ ID NO: 489649 - DNA, 20 bp, Artificial Sequence
  chemically synthesized
aaaacacctgagtcagaagt

SEQ ID NO: 489650 - DNA, 20 bp, Artificial Sequence
  chemically synthesized
agaagtgtgggtgaagatca

SEQ ID NO: 489651 - DNA, 20 bp, Artificial Sequence
  chemically synthesized
acccgtaagagccacaaagt

SEQ ID NO: 489652 - DNA, 20 bp, Artificial Sequence
  chemically synthesized
atccccactttgtggctctt

SEQ ID NO: 489653 - DNA, 20 bp, Artificial Sequence
  chemically synthesized
ggtcaagttatgtattagac

SEQ ID NO: 489654 - DNA, 20 bp, Artificial Sequence
  chemically synthesized
gttatgtattagacaagaat

SEQ ID NO: 489655 - DNA, 20 bp, Artificial Sequence
  chemically synthesized
atagccattagcgtaaattt

SEQ ID NO: 489656 - DNA, 20 bp, Artificial Sequence
  chemically synthesized
gtggacagggttgctttaaa

SEQ ID NO: 489657 - DNA, 20 bp, Artificial Sequence
  chemically synthesized
ttctttaagggagtggtgga

SEQ ID NO: 489658 - DNA, 20 bp, Artificial Sequence
  chemically synthesized
taatatagctatttctttaa

SEQ ID NO: 489659 - DNA, 20 bp, Artificial Sequence
  chemically synthesized
acctcagcctccgaaagtgc

SEQ ID NO: 489660 - DNA, 20 bp, Artificial Sequence
  chemically synthesized
ggtgagcagatcatgaggtc

SEQ ID NO: 489661 - DNA, 20 bp, Artificial Sequence
  chemically synthesized
ttgtatttttagtagagatg

SEQ ID NO: 489662 - DNA, 20 bp, Artificial Sequence
  chemically synthesized
actaaaaatacaaaaattag

SEQ ID NO: 489663 - DNA, 20 bp, Artificial Sequence
  chemically synthesized
gattcttctgcctcagcctc

SEQ ID NO: 489664 - DNA, 20 bp, Artificial Sequence
  chemically synthesized
tactcgagaggctgaggcag

SEQ ID NO: 489665 - DNA, 20 bp, Artificial Sequence
  chemically synthesized
ctcactgcaacctccacctc

SEQ ID NO: 489666 - DNA, 20 bp, Artificial Sequence
  chemically synthesized
tcgtgccactgcactgcagc

SEQ ID NO: 489667 - DNA, 20 bp, Artificial Sequence
  chemically synthesized
tttttatttattttttgaga

SEQ ID NO: 489668 - DNA, 20 bp, Artificial Sequence
  chemically synthesized
aaaaaataaaataaaggtac

SEQ ID NO: 489669 - DNA, 20 bp, Artificial Sequence
  chemically synthesized
aaaataaaggtacaagagta

SEQ ID NO: 489670 - DNA, 20 bp, Artificial Sequence
  chemically synthesized
gggtcagttggctcaatacg

SEQ ID NO: 489671 - DNA, 20 bp, Artificial Sequence
  chemically synthesized
atacgcagaatgcagcatat

SEQ ID NO: 489672 - DNA, 20 bp, Artificial Sequence
  chemically synthesized
ctgccaactgattatgatat

SEQ ID NO: 489673 - DNA, 20 bp, Artificial Sequence
  chemically synthesized
tttggagatactatgtacta

SEQ ID NO: 489674 - DNA, 20 bp, Artificial Sequence
  chemically synthesized
tgggtcatagttactgtgac

SEQ ID NO: 489675 - DNA, 20 bp, Artificial Sequence
  chemically synthesized
gggtgatataattggaacta

SEQ ID NO: 489676 - DNA, 20 bp, Artificial Sequence
  chemically synthesized
cccttcatccaaaggttaga

SEQ ID NO: 489677 - DNA, 20 bp, Artificial Sequence
  chemically synthesized
tatatcacccactctaacct

SEQ ID NO: 489678 - DNA, 20 bp, Artificial Sequence
  chemically synthesized
cctacccttcatccaaaggt

SEQ ID NO: 489679 - DNA, 20 bp, Artificial Sequence
  chemically synthesized
cccactctaacctttggatg

SEQ ID NO: 489680 - DNA, 20 bp, Artificial Sequence
  chemically synthesized
agggctggaggacacaggga

SEQ ID NO: 489681 - DNA, 20 bp, Artificial Sequence
  chemically synthesized
caagctcttacttattacag

SEQ ID NO: 489682 - DNA, 20 bp, Artificial Sequence
  chemically synthesized
atccctgttagtttagattt

SEQ ID NO: 489683 - DNA, 20 bp, Artificial Sequence
  chemically synthesized
atccctaaatctaaactaac

SEQ ID NO: 489684 - DNA, 20 bp, Artificial Sequence
  chemically synthesized
taacagggatacagaggcat

SEQ ID NO: 489685 - DNA, 20 bp, Artificial Sequence
  chemically synthesized
aaataattttaatatgacta

SEQ ID NO: 489686 - DNA, 20 bp, Artificial Sequence
  chemically synthesized
ccattaaatgccacaggatt

SEQ ID NO: 489687 - DNA, 20 bp, Artificial Sequence
  chemically synthesized
gtctttgccattaaatgcca

SEQ ID NO: 489688 - DNA, 20 bp, Artificial Sequence
  chemically synthesized
tggcataggaaacagatatt

SEQ ID NO: 489689 - DNA, 20 bp, Artificial Sequence
  chemically synthesized
aggttttatgtgtcctgcaa

SEQ ID NO: 489690 - DNA, 20 bp, Artificial Sequence
  chemically synthesized
agcagctttgtgggttgtga

SEQ ID NO: 489691 - DNA, 20 bp, Artificial Sequence
  chemically synthesized
aaatatacaatagcagcttt

SEQ ID NO: 489692 - DNA, 20 bp, Artificial Sequence
  chemically synthesized
ctgagatattgtagaacatt

SEQ ID NO: 489693 - DNA, 20 bp, Artificial Sequence
  chemically synthesized
ataaaaagagaacaaggagg

SEQ ID NO: 489694 - DNA, 20 bp, Artificial Sequence
  chemically synthesized
ctccttgttctctttttatg

SEQ ID NO: 489695 - DNA, 20 bp, Artificial Sequence
  chemically synthesized
attaaaggtagaaaccaaga

SEQ ID NO: 489696 - DNA, 20 bp, Artificial Sequence
  chemically synthesized
tcgtgtaaatgatctgttat

SEQ ID NO: 489697 - DNA, 20 bp, Artificial Sequence
  chemically synthesized
tcatctaatttgtgaacatt

SEQ ID NO: 489698 - DNA, 20 bp, Artificial Sequence
  chemically synthesized
cagtcaacatctttacgata

SEQ ID NO: 489699 - DNA, 20 bp, Artificial Sequence
  chemically synthesized
aggatattgattgaaatttt

SEQ ID NO: 489700 - DNA, 20 bp, Artificial Sequence
  chemically synthesized
tatttttacataaagccttc

SEQ ID NO: 489701 - DNA, 20 bp, Artificial Sequence
  chemically synthesized
ccttggctacttttggttct

SEQ ID NO: 489702 - DNA, 20 bp, Artificial Sequence
  chemically synthesized
caaaagtagccaaggcaatc

SEQ ID NO: 489703 - DNA, 20 bp, Artificial Sequence
  chemically synthesized
aatcattttatttaaacatt

SEQ ID NO: 489704 - DNA, 20 bp, Artificial Sequence
  chemically synthesized
gattgcgtatatacatacaa

SEQ ID NO: 489705 - DNA, 20 bp, Artificial Sequence
  chemically synthesized
aacttcattcctttttatga

SEQ ID NO: 489706 - DNA, 20 bp, Artificial Sequence
  chemically synthesized
aatattattcagtcataaaa

SEQ ID NO: 489707 - DNA, 20 bp, Artificial Sequence
  chemically synthesized
ttctagatcttttatataat

SEQ ID NO: 489708 - DNA, 20 bp, Artificial Sequence
  chemically synthesized
ttccaattatataaaagatc

SEQ ID NO: 489709 - DNA, 20 bp, Artificial Sequence
  chemically synthesized
ctggactactttctgtttct

SEQ ID NO: 489710 - DNA, 20 bp, Artificial Sequence
  chemically synthesized
aagtagtccagaggctacta

SEQ ID NO: 489711 - DNA, 20 bp, Artificial Sequence
  chemically synthesized
atggttacagactgtctggt

SEQ ID NO: 489712 - DNA, 20 bp, Artificial Sequence
  chemically synthesized
cgctgtaatcccaggacttt

SEQ ID NO: 489713 - DNA, 20 bp, Artificial Sequence
  chemically synthesized
accttggactcccaaagtcc

SEQ ID NO: 489714 - DNA, 20 bp, Artificial Sequence
  chemically synthesized
actttgggagtccaaggtgg

SEQ ID NO: 489715 - DNA, 20 bp, Artificial Sequence
  chemically synthesized
tgggcggatcacctgaggtc

SEQ ID NO: 489716 - DNA, 20 bp, Artificial Sequence
  chemically synthesized
ttttgtatttttagtagaga

SEQ ID NO: 489717 - DNA, 20 bp, Artificial Sequence
  chemically synthesized
gcctcagcctccctagtagc

SEQ ID NO: 489718 - DNA, 20 bp, Artificial Sequence
  chemically synthesized
tctcgctgtgtcgctcaggc

SEQ ID NO: 489719 - DNA, 20 bp, Artificial Sequence
  chemically synthesized
ttttttttcttttttggaga

SEQ ID NO: 489720 - DNA, 20 bp, Artificial Sequence
  chemically synthesized
aaaaaagaaaaaaaaaaatt

SEQ ID NO: 489721 - DNA, 20 bp, Artificial Sequence
  chemically synthesized
aaagtaacaccgaaatacga

SEQ ID NO: 489722 - DNA, 20 bp, Artificial Sequence
  chemically synthesized
gattgaattgttcactttaa

SEQ ID NO: 489723 - DNA, 20 bp, Artificial Sequence
  chemically synthesized
ttaaatgagtttaatggtat

SEQ ID NO: 489724 - DNA, 20 bp, Artificial Sequence
  chemically synthesized
gtatgtgaattatagctcgg

SEQ ID NO: 489725 - DNA, 20 bp, Artificial Sequence
  chemically synthesized
acagatttaatcaaatggaa

SEQ ID NO: 489726 - DNA, 20 bp, Artificial Sequence
  chemically synthesized
taatcaaatggaagaggata

SEQ ID NO: 489727 - DNA, 20 bp, Artificial Sequence
  chemically synthesized
ttgtatgtatgaatctgctt

SEQ ID NO: 489728 - DNA, 20 bp, Artificial Sequence
  chemically synthesized
aatcaagagaacttgtatgt

SEQ ID NO: 489729 - DNA, 20 bp, Artificial Sequence
  chemically synthesized
cagtggggaaatgattgtct

SEQ ID NO: 489730 - DNA, 20 bp, Artificial Sequence
  chemically synthesized
ggggaaatgattgtctttga

SEQ ID NO: 489731 - DNA, 20 bp, Artificial Sequence
  chemically synthesized
ttgtctttgaatgaatagtg

SEQ ID NO: 489732 - DNA, 20 bp, Artificial Sequence
  chemically synthesized
atataaagcaagtggtacat

SEQ ID NO: 489733 - DNA, 20 bp, Artificial Sequence
  chemically synthesized
acctactgatttattaactt

SEQ ID NO: 489734 - DNA, 20 bp, Artificial Sequence
  chemically synthesized
attaagtccataccacaggt

SEQ ID NO: 489735 - DNA, 20 bp, Artificial Sequence
  chemically synthesized
tgtcagtacatgcctggcca

SEQ ID NO: 489736 - DNA, 20 bp, Artificial Sequence
  chemically synthesized
atttcttcagtctgattctt

SEQ ID NO: 489737 - DNA, 20 bp, Artificial Sequence
  chemically synthesized
tttttgcataaattattctg

SEQ ID NO: 489738 - DNA, 20 bp, Artificial Sequence
  chemically synthesized
ggctagaaaaaatgatgatg

SEQ ID NO: 489739 - DNA, 20 bp, Artificial Sequence
  chemically synthesized
gtcggggaggaggctggtat

SEQ ID NO: 489740 - DNA, 20 bp, Artificial Sequence
  chemically synthesized
atttgtatgtattttgtttc

SEQ ID NO: 489741 - DNA, 20 bp, Artificial Sequence
  chemically synthesized
ctcaagcagacaaatctcca

SEQ ID NO: 489742 - DNA, 20 bp, Artificial Sequence
  chemically synthesized
ttatgggagcacttacaagc

SEQ ID NO: 489743 - DNA, 20 bp, Artificial Sequence
  chemically synthesized
ccagtttcatttaattgttt

SEQ ID NO: 489744 - DNA, 20 bp, Artificial Sequence
  chemically synthesized
gaagagttgcccctgcgcca

SEQ ID NO: 489745 - DNA, 20 bp, Artificial Sequence
  chemically synthesized
tctgtttcagttactggtgg

SEQ ID NO: 489746 - DNA, 20 bp, Artificial Sequence
  chemically synthesized
caaatgcaacaacgtttaaa

SEQ ID NO: 489747 - DNA, 20 bp, Artificial Sequence
  chemically synthesized
agaagcaaagacaaggtagt

SEQ ID NO: 489748 - DNA, 20 bp, Artificial Sequence
  chemically synthesized
gagatttatctactgagggg

SEQ ID NO: 489749 - DNA, 20 bp, Artificial Sequence
  chemically synthesized
tacagagatttatctactga

SEQ ID NO: 489750 - DNA, 20 bp, Artificial Sequence
  chemically synthesized
tttctcttaaaaaatttatg

SEQ ID NO: 489751 - DNA, 20 bp, Artificial Sequence
  chemically synthesized
tttcagacactaactttatt

SEQ ID NO: 489752 - DNA, 20 bp, Artificial Sequence
  chemically synthesized
tgaacaaattcatcagcctc

SEQ ID NO: 489753 - DNA, 20 bp, Artificial Sequence
  chemically synthesized
ctatgatacccaagaggctg

SEQ ID NO: 489754 - DNA, 20 bp, Artificial Sequence
  chemically synthesized
cttaagaggtaactgacatt

SEQ ID NO: 489755 - DNA, 20 bp, Artificial Sequence
  chemically synthesized
tgcctggcactgtgtatatt

SEQ ID NO: 489756 - DNA, 20 bp, Artificial Sequence
  chemically synthesized
tccatataaaatgaagataa

SEQ ID NO: 489757 - DNA, 20 bp, Artificial Sequence
  chemically synthesized
atggaaggaaactgagacaa

SEQ ID NO: 489758 - DNA, 20 bp, Artificial Sequence
  chemically synthesized
aacaaaggtgtggttcaaat

SEQ ID NO: 489759 - DNA, 20 bp, Artificial Sequence
  chemically synthesized
aaatttgggtagtttcattc

SEQ ID NO: 489760 - DNA, 20 bp, Artificial Sequence
  chemically synthesized
gaagtaaaaaatgaggactc

SEQ ID NO: 489761 - DNA, 20 bp, Artificial Sequence
  chemically synthesized
tgaatgagttcgagaaattt

SEQ ID NO: 489762 - DNA, 20 bp, Artificial Sequence
  chemically synthesized
catacactatgtggtggtga

SEQ ID NO: 489763 - DNA, 20 bp, Artificial Sequence
  chemically synthesized
agggcatacactatgtggtg

SEQ ID NO: 489764 - DNA, 20 bp, Artificial Sequence
  chemically synthesized
ttaatagcgttgtatggcta

SEQ ID NO: 489765 - DNA, 20 bp, Artificial Sequence
  chemically synthesized
tttagtgaattttgattaac

SEQ ID NO: 489766 - DNA, 20 bp, Artificial Sequence
  chemically synthesized
gaacttgagattttatttta

SEQ ID NO: 489767 - DNA, 20 bp, Artificial Sequence
  chemically synthesized
ttgtgccttttgaatacctg

SEQ ID NO: 489768 - DNA, 20 bp, Artificial Sequence
  chemically synthesized
cgactagctatttgtgcctt

SEQ ID NO: 489769 - DNA, 20 bp, Artificial Sequence
  chemically synthesized
aatagctagtcgttacaaaa

SEQ ID NO: 489770 - DNA, 20 bp, Artificial Sequence
  chemically synthesized
cgttacaaaaatggatgatg

SEQ ID NO: 489771 - DNA, 20 bp, Artificial Sequence
  chemically synthesized
cagaatattttcatcatcac

SEQ ID NO: 489772 - DNA, 20 bp, Artificial Sequence
  chemically synthesized
atgagtctattttctcctga

SEQ ID NO: 489773 - DNA, 20 bp, Artificial Sequence
  chemically synthesized
tttcttattaattaatatgc

SEQ ID NO: 489774 - DNA, 20 bp, Artificial Sequence
  chemically synthesized
aaaatgccactaaatatgtt

SEQ ID NO: 489775 - DNA, 20 bp, Artificial Sequence
  chemically synthesized
tgccactaaatatgtttcga

SEQ ID NO: 489776 - DNA, 20 bp, Artificial Sequence
  chemically synthesized
atttatctttcccaaatgta

SEQ ID NO: 489777 - DNA, 20 bp, Artificial Sequence
  chemically synthesized
gataaatttccaagaaaaga

SEQ ID NO: 489778 - DNA, 20 bp, Artificial Sequence
  chemically synthesized
aaagactgagttcattgttc

SEQ ID NO: 489779 - DNA, 20 bp, Artificial Sequence
  chemically synthesized
attcaaaaatagaaaagagt

SEQ ID NO: 489780 - DNA, 20 bp, Artificial Sequence
  chemically synthesized
tttgggattcaaaaatagaa

SEQ ID NO: 489781 - DNA, 20 bp, Artificial Sequence
  chemically synthesized
attcccactcttttctattt

SEQ ID NO: 489782 - DNA, 20 bp, Artificial Sequence
  chemically synthesized
ccgatgttttactaggtatt

SEQ ID NO: 489783 - DNA, 20 bp, Artificial Sequence
  chemically synthesized
cccaaatacctagtaaaaca

SEQ ID NO: 489784 - DNA, 20 bp, Artificial Sequence
  chemically synthesized
cagtgctccatatttgttta

SEQ ID NO: 489785 - DNA, 20 bp, Artificial Sequence
  chemically synthesized
ggtgctttacacatgtaaat

SEQ ID NO: 489786 - DNA, 20 bp, Artificial Sequence
  chemically synthesized
aatttacatgtgtaaagcac

SEQ ID NO: 489787 - DNA, 20 bp, Artificial Sequence
  chemically synthesized
attatgtgaccgtgtaaaat

SEQ ID NO: 489788 - DNA, 20 bp, Artificial Sequence
  chemically synthesized
ctaatacttggcacataaca

SEQ ID NO: 489789 - DNA, 20 bp, Artificial Sequence
  chemically synthesized
gttttaggaaagcagctctt

SEQ ID NO: 489790 - DNA, 20 bp, Artificial Sequence
  chemically synthesized
gacatgctctgattgtgcaa

SEQ ID NO: 489791 - DNA, 20 bp, Artificial Sequence
  chemically synthesized
aggacggtatgaaaagccac

SEQ ID NO: 489792 - DNA, 20 bp, Artificial Sequence
  chemically synthesized
tgaaaagccactggaataag

SEQ ID NO: 489793 - DNA, 20 bp, Artificial Sequence
  chemically synthesized
tggatgtctattcaaccaaa

SEQ ID NO: 489794 - DNA, 20 bp, Artificial Sequence
  chemically synthesized
ttggttcacattccatttgg

SEQ ID NO: 489795 - DNA, 20 bp, Artificial Sequence
  chemically synthesized
ttgttttagctgatttgtct

SEQ ID NO: 489796 - DNA, 20 bp, Artificial Sequence
  chemically synthesized
aaaacaaaacattgcttcgg

SEQ ID NO: 489797 - DNA, 20 bp, Artificial Sequence
  chemically synthesized
tccattttcttagggaagat

SEQ ID NO: 489798 - DNA, 20 bp, Artificial Sequence
  chemically synthesized
tccagatcttccctaagaaa

SEQ ID NO: 489799 - DNA, 20 bp, Artificial Sequence
  chemically synthesized
tgagaagagtctttaaaaag

SEQ ID NO: 489800 - DNA, 20 bp, Artificial Sequence
  chemically synthesized
tacctacctggagatttgag

SEQ ID NO: 489801 - DNA, 20 bp, Artificial Sequence
  chemically synthesized
cataaaatctaaatctaaat

SEQ ID NO: 489802 - DNA, 20 bp, Artificial Sequence
  chemically synthesized
aaaaactgaagaccagattg

SEQ ID NO: 489803 - DNA, 20 bp, Artificial Sequence
  chemically synthesized
tcaaatcaaagataaaaact

SEQ ID NO: 489804 - DNA, 20 bp, Artificial Sequence
  chemically synthesized
attatatacatttagacata

SEQ ID NO: 489805 - DNA, 20 bp, Artificial Sequence
  chemically synthesized
tgtgcactggttcagaactg

SEQ ID NO: 489806 - DNA, 20 bp, Artificial Sequence
  chemically synthesized
aaacactttagcaaggaact

SEQ ID NO: 489807 - DNA, 20 bp, Artificial Sequence
  chemically synthesized
aatgggcagaaaaccaatga

SEQ ID NO: 489808 - DNA, 20 bp, Artificial Sequence
  chemically synthesized
ctgcttgcataaagaagtat

SEQ ID NO: 489809 - DNA, 20 bp, Artificial Sequence
  chemically synthesized
ctttatgcaagcaggccctg

SEQ ID NO: 489810 - DNA, 20 bp, Artificial Sequence
  chemically synthesized
tgctcttttccaggttcaag

SEQ ID NO: 489811 - DNA, 20 bp, Artificial Sequence
  chemically synthesized
agaatttcaaagagatttaa

SEQ ID NO: 489812 - DNA, 20 bp, Artificial Sequence
  chemically synthesized
agaacaaaagaatatcttgt

SEQ ID NO: 489813 - DNA, 20 bp, Artificial Sequence
  chemically synthesized
tctccaggctagaagaacaa

SEQ ID NO: 489814 - DNA, 20 bp, Artificial Sequence
  chemically synthesized
ttcttctagcctggagaaag

SEQ ID NO: 489815 - DNA, 20 bp, Artificial Sequence
  chemically synthesized
aattactttgttcaaagtga

SEQ ID NO: 489816 - DNA, 20 bp, Artificial Sequence
  chemically synthesized
ttgaaattactttgttcaaa

SEQ ID NO: 489817 - DNA, 20 bp, Artificial Sequence
  chemically synthesized
caaagtaatttcaatatttc

SEQ ID NO: 489818 - DNA, 20 bp, Artificial Sequence
  chemically synthesized
ctggccaggaatttttgaat

SEQ ID NO: 489819 - DNA, 20 bp, Artificial Sequence
  chemically synthesized
ctgcgcctggccaggaattt

SEQ ID NO: 489820 - DNA, 20 bp, Artificial Sequence
  chemically synthesized
atgagccactgcgcctggcc

SEQ ID NO: 489821 - DNA, 20 bp, Artificial Sequence
  chemically synthesized
acatcggcctccctaagcgc

SEQ ID NO: 489822 - DNA, 20 bp, Artificial Sequence
  chemically synthesized
gcttagggaggccgatgtgg

SEQ ID NO: 489823 - DNA, 20 bp, Artificial Sequence
  chemically synthesized
tgggcggatcacttgaggtc

SEQ ID NO: 489824 - DNA, 20 bp, Artificial Sequence
  chemically synthesized
ttttgtatttttagtgtaga

SEQ ID NO: 489825 - DNA, 20 bp, Artificial Sequence
  chemically synthesized
gcctcagcctccctagtagc

SEQ ID NO: 489826 - DNA, 20 bp, Artificial Sequence
  chemically synthesized
tactagggaggctgaggcag

SEQ ID NO: 489827 - DNA, 20 bp, Artificial Sequence
  chemically synthesized
tctttctctgttgcccgggg

SEQ ID NO: 489828 - DNA, 20 bp, Artificial Sequence
  chemically synthesized
tggagtctttctctgttgcc

SEQ ID NO: 489829 - DNA, 20 bp, Artificial Sequence
  chemically synthesized
atgtatgtatgtatttgaga

SEQ ID NO: 489830 - DNA, 20 bp, Artificial Sequence
  chemically synthesized
acatacatacatacattaaa

SEQ ID NO: 489831 - DNA, 20 bp, Artificial Sequence
  chemically synthesized
atataatgacataatgttgt

SEQ ID NO: 489832 - DNA, 20 bp, Artificial Sequence
  chemically synthesized
gaggatagctgctcacagca

SEQ ID NO: 489833 - DNA, 20 bp, Artificial Sequence
  chemically synthesized
agcagctatcctctgcattg

SEQ ID NO: 489834 - DNA, 20 bp, Artificial Sequence
  chemically synthesized
gctaaataccctacaatgca

SEQ ID NO: 489835 - DNA, 20 bp, Artificial Sequence
  chemically synthesized
tccagtgtgttcaacaggcc

SEQ ID NO: 489836 - DNA, 20 bp, Artificial Sequence
  chemically synthesized
tccctggcctgttgaacaca

SEQ ID NO: 489837 - DNA, 20 bp, Artificial Sequence
  chemically synthesized
aggcactgccaaatatgctg

SEQ ID NO: 489838 - DNA, 20 bp, Artificial Sequence
  chemically synthesized
gccaaatatgctggggggtt

SEQ ID NO: 489839 - DNA, 20 bp, Artificial Sequence
  chemically synthesized
ttttatctgcttcttattct

SEQ ID NO: 489840 - DNA, 20 bp, Artificial Sequence
  chemically synthesized
tgcttcttattctgtgggtc

SEQ ID NO: 489841 - DNA, 20 bp, Artificial Sequence
  chemically synthesized
ctatccaaatccttgaccca

SEQ ID NO: 489842 - DNA, 20 bp, Artificial Sequence
  chemically synthesized
ttattctgtgggtcaaggat

SEQ ID NO: 489843 - DNA, 20 bp, Artificial Sequence
  chemically synthesized
attacatgctaaactgtttt

SEQ ID NO: 489844 - DNA, 20 bp, Artificial Sequence
  chemically synthesized
ctctttcctcaaataaggtt

SEQ ID NO: 489845 - DNA, 20 bp, Artificial Sequence
  chemically synthesized
ttttcataattaaaacttcc

SEQ ID NO: 489846 - DNA, 20 bp, Artificial Sequence
  chemically synthesized
aaatttatggctaattagca

SEQ ID NO: 489847 - DNA, 20 bp, Artificial Sequence
  chemically synthesized
tgtcttacaatcgaatatgt

SEQ ID NO: 489848 - DNA, 20 bp, Artificial Sequence
  chemically synthesized
tttgttcagctgtcttacaa

SEQ ID NO: 489849 - DNA, 20 bp, Artificial Sequence
  chemically synthesized
tgtacaaccagagaaggaaa

SEQ ID NO: 489850 - DNA, 20 bp, Artificial Sequence
  chemically synthesized
agaaggaaatagaatattat

SEQ ID NO: 489851 - DNA, 20 bp, Artificial Sequence
  chemically synthesized
cttggaggcagtgactgcaa

SEQ ID NO: 489852 - DNA, 20 bp, Artificial Sequence
  chemically synthesized
ggcaaaataatcaaagttga

SEQ ID NO: 489853 - DNA, 20 bp, Artificial Sequence
  chemically synthesized
ctttgattattttgccggta

SEQ ID NO: 489854 - DNA, 20 bp, Artificial Sequence
  chemically synthesized
ggtactgaatattatgaaaa

SEQ ID NO: 489855 - DNA, 20 bp, Artificial Sequence
  chemically synthesized
atgaaaaaggcgagacacaa

SEQ ID NO: 489856 - DNA, 20 bp, Artificial Sequence
  chemically synthesized
ggattatcgtaaacataatt

SEQ ID NO: 489857 - DNA, 20 bp, Artificial Sequence
  chemically synthesized
agactaaaattatatgcaac

SEQ ID NO: 489858 - DNA, 20 bp, Artificial Sequence
  chemically synthesized
atttgtgataattcagtttt

SEQ ID NO: 489859 - DNA, 20 bp, Artificial Sequence
  chemically synthesized
atagctaatcattcaaaaaa

SEQ ID NO: 489860 - DNA, 20 bp, Artificial Sequence
  chemically synthesized
ctaagagctcaattgggcat

SEQ ID NO: 489861 - DNA, 20 bp, Artificial Sequence
  chemically synthesized
tacgttatataccttgtctt

SEQ ID NO: 489862 - DNA, 20 bp, Artificial Sequence
  chemically synthesized
aagaaacaagcatgtaagcc

SEQ ID NO: 489863 - DNA, 20 bp, Artificial Sequence
  chemically synthesized
actcagatcattatcttctc

SEQ ID NO: 489864 - DNA, 20 bp, Artificial Sequence
  chemically synthesized
atcccagagaagataatgat

SEQ ID NO: 489865 - DNA, 20 bp, Artificial Sequence
  chemically synthesized
aagatagatcagcatgttgc

SEQ ID NO: 489866 - DNA, 20 bp, Artificial Sequence
  chemically synthesized
gttgcgatcattctgtaaat

SEQ ID NO: 489867 - DNA, 20 bp, Artificial Sequence
  chemically synthesized
aataaccagattctgattta

SEQ ID NO: 489868 - DNA, 20 bp, Artificial Sequence
  chemically synthesized
ttatcatataggaaaactga

SEQ ID NO: 489869 - DNA, 20 bp, Artificial Sequence
  chemically synthesized
gctcttatcatataggaaaa

SEQ ID NO: 489870 - DNA, 20 bp, Artificial Sequence
  chemically synthesized
aaaagagaatagacagaggg

SEQ ID NO: 489871 - DNA, 20 bp, Artificial Sequence
  chemically synthesized
atgtataaatgaatttaaaa

SEQ ID NO: 489872 - DNA, 20 bp, Artificial Sequence
  chemically synthesized
ataagcgaataaatgtataa

SEQ ID NO: 489873 - DNA, 20 bp, Artificial Sequence
  chemically synthesized
ataaacatttgtaaaaataa

SEQ ID NO: 489874 - DNA, 20 bp, Artificial Sequence
  chemically synthesized
atagtaagtgtatgtacttg

SEQ ID NO: 489875 - DNA, 20 bp, Artificial Sequence
  chemically synthesized
cagtgtcccaggaatgaaca

SEQ ID NO: 489876 - DNA, 20 bp, Artificial Sequence
  chemically synthesized
gaccctgctcccagtgtccc

SEQ ID NO: 489877 - DNA, 20 bp, Artificial Sequence
  chemically synthesized
cattcctgggacactgggag

SEQ ID NO: 489878 - DNA, 20 bp, Artificial Sequence
  chemically synthesized
gggtctgtttttaacctatc

SEQ ID NO: 489879 - DNA, 20 bp, Artificial Sequence
  chemically synthesized
tctagatcagatgttatatt

SEQ ID NO: 489880 - DNA, 20 bp, Artificial Sequence
  chemically synthesized
tgccttatctgactgggaag

SEQ ID NO: 489881 - DNA, 20 bp, Artificial Sequence
  chemically synthesized
gaatgctatttacttcagct

SEQ ID NO: 489882 - DNA, 20 bp, Artificial Sequence
  chemically synthesized
catttcatgtttgctatttt

SEQ ID NO: 489883 - DNA, 20 bp, Artificial Sequence
  chemically synthesized
taaaattcataaaacgaaga

SEQ ID NO: 489884 - DNA, 20 bp, Artificial Sequence
  chemically synthesized
gtccattctttcttcgtttt

SEQ ID NO: 489885 - DNA, 20 bp, Artificial Sequence
  chemically synthesized
atttttcaatttaaataaga

SEQ ID NO: 489886 - DNA, 20 bp, Artificial Sequence
  chemically synthesized
gctttccatggccaagcaca

SEQ ID NO: 489887 - DNA, 20 bp, Artificial Sequence
  chemically synthesized
gcttggccatggaaagccaa

SEQ ID NO: 489888 - DNA, 20 bp, Artificial Sequence
  chemically synthesized
ctctcacttcaatgaatgtt

SEQ ID NO: 489889 - DNA, 20 bp, Artificial Sequence
  chemically synthesized
aaaagcatcctctcacttca

SEQ ID NO: 489890 - DNA, 20 bp, Artificial Sequence
  chemically synthesized
ccaaacattcattgaagtga

SEQ ID NO: 489891 - DNA, 20 bp, Artificial Sequence
  chemically synthesized
agaggatgctttttccttct

SEQ ID NO: 489892 - DNA, 20 bp, Artificial Sequence
  chemically synthesized
gagacttcgagagaatcact

SEQ ID NO: 489893 - DNA, 20 bp, Artificial Sequence
  chemically synthesized
gtcagaagtagagacttcga

SEQ ID NO: 489894 - DNA, 20 bp, Artificial Sequence
  chemically synthesized
gttccttctctttcatctct

SEQ ID NO: 489895 - DNA, 20 bp, Artificial Sequence
  chemically synthesized
aaggggtagtaagctttgtg

SEQ ID NO: 489896 - DNA, 20 bp, Artificial Sequence
  chemically synthesized
agcttactaccccttcctac

SEQ ID NO: 489897 - DNA, 20 bp, Artificial Sequence
  chemically synthesized
ttaaaaagactcaggtagga

SEQ ID NO: 489898 - DNA, 20 bp, Artificial Sequence
  chemically synthesized
ttttaatcttgcctgggaca

SEQ ID NO: 489899 - DNA, 20 bp, Artificial Sequence
  chemically synthesized
agaggagattggaaattgct

SEQ ID NO: 489900 - DNA, 20 bp, Artificial Sequence
  chemically synthesized
gataataatccctgttgctt

SEQ ID NO: 489901 - DNA, 20 bp, Artificial Sequence
  chemically synthesized
agggtttactctaaagcaac

SEQ ID NO: 489902 - DNA, 20 bp, Artificial Sequence
  chemically synthesized
cgagaccagccacttcccca

SEQ ID NO: 489903 - DNA, 20 bp, Artificial Sequence
  chemically synthesized
cgattgctggcagtttgttt

SEQ ID NO: 489904 - DNA, 20 bp, Artificial Sequence
  chemically synthesized
ttcccctcagattctgacct

SEQ ID NO: 489905 - DNA, 20 bp, Artificial Sequence
  chemically synthesized
tccacaattgattctaaggt

SEQ ID NO: 489906 - DNA, 20 bp, Artificial Sequence
  chemically synthesized
ttggaacatttaaacaaata

SEQ ID NO: 489907 - DNA, 20 bp, Artificial Sequence
  chemically synthesized
ttccaagcagatttaattcc

SEQ ID NO: 489908 - DNA, 20 bp, Artificial Sequence
  chemically synthesized
accctcaaaatctagaccca

SEQ ID NO: 489909 - DNA, 20 bp, Artificial Sequence
  chemically synthesized
attccttgggtctagatttt

SEQ ID NO: 489910 - DNA, 20 bp, Artificial Sequence
  chemically synthesized
gtaatggaggcaatgatttg

SEQ ID NO: 489911 - DNA, 20 bp, Artificial Sequence
  chemically synthesized
gaacactgtgcaaaatcatc

SEQ ID NO: 489912 - DNA, 20 bp, Artificial Sequence
  chemically synthesized
agatgattttgcacagtgtt

SEQ ID NO: 489913 - DNA, 20 bp, Artificial Sequence
  chemically synthesized
ttttgtttgtttggggggtt

SEQ ID NO: 489914 - DNA, 20 bp, Artificial Sequence
  chemically synthesized
cttaaatttttgtttgtttg

SEQ ID NO: 489915 - DNA, 20 bp, Artificial Sequence
  chemically synthesized
atttagaattttctaaactt

SEQ ID NO: 489916 - DNA, 20 bp, Artificial Sequence
  chemically synthesized
aaagaggggagtgtttgatt

SEQ ID NO: 489917 - DNA, 20 bp, Artificial Sequence
  chemically synthesized
tgagacatatttgaaaagag

SEQ ID NO: 489918 - DNA, 20 bp, Artificial Sequence
  chemically synthesized
ctagcatatttttttctatc

SEQ ID NO: 489919 - DNA, 20 bp, Artificial Sequence
  chemically synthesized
cacaacatctctcctctgta

SEQ ID NO: 489920 - DNA, 20 bp, Artificial Sequence
  chemically synthesized
acatataaatctcaactatg

SEQ ID NO: 489921 - DNA, 20 bp, Artificial Sequence
  chemically synthesized
gttgagatttatatgtatta

SEQ ID NO: 489922 - DNA, 20 bp, Artificial Sequence
  chemically synthesized
aagaaaataagcatacaata

SEQ ID NO: 489923 - DNA, 20 bp, Artificial Sequence
  chemically synthesized
tgacctacagagacacatag

SEQ ID NO: 489924 - DNA, 20 bp, Artificial Sequence
  chemically synthesized
acccctatatatcttattac

SEQ ID NO: 489925 - DNA, 20 bp, Artificial Sequence
  chemically synthesized
atcctagtaataagatatat

SEQ ID NO: 489926 - DNA, 20 bp, Artificial Sequence
  chemically synthesized
aacacaataatggtgaaata

SEQ ID NO: 489927 - DNA, 20 bp, Artificial Sequence
  chemically synthesized
ttcaccattattgtgttatt

SEQ ID NO: 489928 - DNA, 20 bp, Artificial Sequence
  chemically synthesized
tgctttcattttttattata

SEQ ID NO: 489929 - DNA, 20 bp, Artificial Sequence
  chemically synthesized
ataaataaatgtgtttattg

SEQ ID NO: 489930 - DNA, 20 bp, Artificial Sequence
  chemically synthesized
aacacatttatttatacatt

SEQ ID NO: 489931 - DNA, 20 bp, Artificial Sequence
  chemically synthesized
attttgaatcatgtatctgc

SEQ ID NO: 489932 - DNA, 20 bp, Artificial Sequence
  chemically synthesized
aatcatgtatctgctggaat

SEQ ID NO: 489933 - DNA, 20 bp, Artificial Sequence
  chemically synthesized
gagaatgaaaagttaacaat

SEQ ID NO: 489934 - DNA, 20 bp, Artificial Sequence
  chemically synthesized
aagttaacaatgggaatcct

SEQ ID NO: 489935 - DNA, 20 bp, Artificial Sequence
  chemically synthesized
acaatgtgtatctaaatcct

SEQ ID NO: 489936 - DNA, 20 bp, Artificial Sequence
  chemically synthesized
aaggatttagatacacattg

SEQ ID NO: 489937 - DNA, 20 bp, Artificial Sequence
  chemically synthesized
ggtgggagtttacgagtgtt

SEQ ID NO: 489938 - DNA, 20 bp, Artificial Sequence
  chemically synthesized
gtaactgttggtgggagttt

SEQ ID NO: 489939 - DNA, 20 bp, Artificial Sequence
  chemically synthesized
agtattttgtaactgttggt

SEQ ID NO: 489940 - DNA, 20 bp, Artificial Sequence
  chemically synthesized
attttcaactttcctattag

SEQ ID NO: 489941 - DNA, 20 bp, Artificial Sequence
  chemically synthesized
ggtaaaatggccacaatttt

SEQ ID NO: 489942 - DNA, 20 bp, Artificial Sequence
  chemically synthesized
gtaaaggatcaagaataaat

SEQ ID NO: 489943 - DNA, 20 bp, Artificial Sequence
  chemically synthesized
aaatgaaagagtaaaggatc

SEQ ID NO: 489944 - DNA, 20 bp, Artificial Sequence
  chemically synthesized
ttttaacaaatgaaagagta

SEQ ID NO: 489945 - DNA, 20 bp, Artificial Sequence
  chemically synthesized
tgttcttttttaacaaatga

SEQ ID NO: 489946 - DNA, 20 bp, Artificial Sequence
  chemically synthesized
caacactatataaatttaag

SEQ ID NO: 489947 - DNA, 20 bp, Artificial Sequence
  chemically synthesized
tagtgttgtttctaaccttg

SEQ ID NO: 489948 - DNA, 20 bp, Artificial Sequence
  chemically synthesized
ttcccccagcaccatctctt

SEQ ID NO: 489949 - DNA, 20 bp, Artificial Sequence
  chemically synthesized
agaataactaaagtgggaga

SEQ ID NO: 489950 - DNA, 20 bp, Artificial Sequence
  chemically synthesized
gaatgatacattacataagt

SEQ ID NO: 489951 - DNA, 20 bp, Artificial Sequence
  chemically synthesized
agaattgttttataatttga

SEQ ID NO: 489952 - DNA, 20 bp, Artificial Sequence
  chemically synthesized
cccatttaaaaattttcagc

SEQ ID NO: 489953 - DNA, 20 bp, Artificial Sequence
  chemically synthesized
tctcgctgaaaatttttaaa

SEQ ID NO: 489954 - DNA, 20 bp, Artificial Sequence
  chemically synthesized
tatcaataagttaatttgtg

SEQ ID NO: 489955 - DNA, 20 bp, Artificial Sequence
  chemically synthesized
tgtaaatacagaaagtttag

SEQ ID NO: 489956 - DNA, 20 bp, Artificial Sequence
  chemically synthesized
atttacagtgttcttggaca

SEQ ID NO: 489957 - DNA, 20 bp, Artificial Sequence
  chemically synthesized
taattatttatagtgtccca

SEQ ID NO: 489958 - DNA, 20 bp, Artificial Sequence
  chemically synthesized
agcatcttgcatatgatttt

SEQ ID NO: 489959 - DNA, 20 bp, Artificial Sequence
  chemically synthesized
gatttattctgagagttctt

SEQ ID NO: 489960 - DNA, 20 bp, Artificial Sequence
  chemically synthesized
agaaaactcttaagaactct

SEQ ID NO: 489961 - DNA, 20 bp, Artificial Sequence
  chemically synthesized
tttaagtgatgatttattct

SEQ ID NO: 489962 - DNA, 20 bp, Artificial Sequence
  chemically synthesized
agattataacaaggtcccaa

SEQ ID NO: 489963 - DNA, 20 bp, Artificial Sequence
  chemically synthesized
gaagttttaaaagctgcaat

SEQ ID NO: 489964 - DNA, 20 bp, Artificial Sequence
  chemically synthesized
ctttgcttttctgcaatcat

SEQ ID NO: 489965 - DNA, 20 bp, Artificial Sequence
  chemically synthesized
aagaaataacacttcatgtg

SEQ ID NO: 489966 - DNA, 20 bp, Artificial Sequence
  chemically synthesized
tacttgcttaatgcttatgg

SEQ ID NO: 489967 - DNA, 20 bp, Artificial Sequence
  chemically synthesized
ttattattactaccacttgt

SEQ ID NO: 489968 - DNA, 20 bp, Artificial Sequence
  chemically synthesized
gacaagtggtagtaataata

SEQ ID NO: 489969 - DNA, 20 bp, Artificial Sequence
  chemically synthesized
tatttagcacttatttgcag

SEQ ID NO: 489970 - DNA, 20 bp, Artificial Sequence
  chemically synthesized
gacatttagctttttttaga

SEQ ID NO: 489971 - DNA, 20 bp, Artificial Sequence
  chemically synthesized
ttcattgaatttagcaacac

SEQ ID NO: 489972 - DNA, 20 bp, Artificial Sequence
  chemically synthesized
ctcatgtgttgctaaattca

SEQ ID NO: 489973 - DNA, 20 bp, Artificial Sequence
  chemically synthesized
aagagttaatgttaaattca

SEQ ID NO: 489974 - DNA, 20 bp, Artificial Sequence
  chemically synthesized
cccgacagaaaatgttcatt

SEQ ID NO: 489975 - DNA, 20 bp, Artificial Sequence
  chemically synthesized
cagtctattcctcttagcgt

SEQ ID NO: 489976 - DNA, 20 bp, Artificial Sequence
  chemically synthesized
cgggctactcttacgctaag

SEQ ID NO: 489977 - DNA, 20 bp, Artificial Sequence
  chemically synthesized
acatggcatgattttggtga

SEQ ID NO: 489978 - DNA, 20 bp, Artificial Sequence
  chemically synthesized
agtgctagatagtttcacag

SEQ ID NO: 489979 - DNA, 20 bp, Artificial Sequence
  chemically synthesized
aaggcaatccaaaggatgta

SEQ ID NO: 489980 - DNA, 20 bp, Artificial Sequence
  chemically synthesized
tttaatattccatacatcct

SEQ ID NO: 489981 - DNA, 20 bp, Artificial Sequence
  chemically synthesized
agcatataaaaggcaatcca

SEQ ID NO: 489982 - DNA, 20 bp, Artificial Sequence
  chemically synthesized
ggaaaatgggatagtcacct

SEQ ID NO: 489983 - DNA, 20 bp, Artificial Sequence
  chemically synthesized
gggacttctcatttggaaaa

SEQ ID NO: 489984 - DNA, 20 bp, Artificial Sequence
  chemically synthesized
tagtacacacaatcaaatta

SEQ ID NO: 489985 - DNA, 20 bp, Artificial Sequence
  chemically synthesized
acaaaattgttgcatgaaat

SEQ ID NO: 489986 - DNA, 20 bp, Artificial Sequence
  chemically synthesized
caatgttgaaggtgcctgtg

SEQ ID NO: 489987 - DNA, 20 bp, Artificial Sequence
  chemically synthesized
acattgaaatttgcatcctc

SEQ ID NO: 489988 - DNA, 20 bp, Artificial Sequence
  chemically synthesized
gcaacaacaagtgcatccat

SEQ ID NO: 489989 - DNA, 20 bp, Artificial Sequence
  chemically synthesized
agatgatgccctctggaaaa

SEQ ID NO: 489990 - DNA, 20 bp, Artificial Sequence
  chemically synthesized
agtactatacctcaggccac

SEQ ID NO: 489991 - DNA, 20 bp, Artificial Sequence
  chemically synthesized
tggcctgaggtatagtactg

SEQ ID NO: 489992 - DNA, 20 bp, Artificial Sequence
  chemically synthesized
tctagaggtaatgtttcact

SEQ ID NO: 489993 - DNA, 20 bp, Artificial Sequence
  chemically synthesized
acaagcacacatttacataa

SEQ ID NO: 489994 - DNA, 20 bp, Artificial Sequence
  chemically synthesized
ctacaccatgtaaccactta

SEQ ID NO: 489995 - DNA, 20 bp, Artificial Sequence
  chemically synthesized
cattgtaaacaagctatgga

SEQ ID NO: 489996 - DNA, 20 bp, Artificial Sequence
  chemically synthesized
tgacatcacaattgcaagag

SEQ ID NO: 489997 - DNA, 20 bp, Artificial Sequence
  chemically synthesized
ttgtatgacatcacaattgc

SEQ ID NO: 489998 - DNA, 20 bp, Artificial Sequence
  chemically synthesized
aaataaatttaacacagttt

SEQ ID NO: 489999 - DNA, 20 bp, Artificial Sequence
  chemically synthesized
ctccaaaataagcataaatt

SEQ ID NO: 490000 - DNA, 20 bp, Artificial Sequence
  chemically synthesized
tgtaatttgagaaacttcag

SEQ ID NO: 490001 - DNA, 20 bp, Artificial Sequence
  chemically synthesized
cgggaagggtcaacttatac

SEQ ID NO: 490002 - DNA, 20 bp, Artificial Sequence
  chemically synthesized
tgttttggttttccctcggg

SEQ ID NO: 490003 - DNA, 20 bp, Artificial Sequence
  chemically synthesized
gattctgataatgacctacg

SEQ ID NO: 490004 - DNA, 20 bp, Artificial Sequence
  chemically synthesized
taccctccgtaggtcattat

SEQ ID NO: 490005 - DNA, 20 bp, Artificial Sequence
  chemically synthesized
cttaaaaataaagttgatgc

SEQ ID NO: 490006 - DNA, 20 bp, Artificial Sequence
  chemically synthesized
ctaccatacctggttggtgc

SEQ ID NO: 490007 - DNA, 20 bp, Artificial Sequence
  chemically synthesized
ccctaaagtttgtgtcttgt

SEQ ID NO: 490008 - DNA, 20 bp, Artificial Sequence
  chemically synthesized
cggaatgaagtgctcctgag

SEQ ID NO: 490009 - DNA, 20 bp, Artificial Sequence
  chemically synthesized
aaggaaatgattagcaactt

SEQ ID NO: 490010 - DNA, 20 bp, Artificial Sequence
  chemically synthesized
aaaacctgaaggttagcaat

SEQ ID NO: 490011 - DNA, 20 bp, Artificial Sequence
  chemically synthesized
taaatgctgccagttatcag

SEQ ID NO: 490012 - DNA, 20 bp, Artificial Sequence
  chemically synthesized
agctgagtacgtgaacacgg

SEQ ID NO: 490013 - DNA, 20 bp, Artificial Sequence
  chemically synthesized
aattagaacaataaacattt

SEQ ID NO: 490014 - DNA, 20 bp, Artificial Sequence
  chemically synthesized
taaacattttagagtgttgt

SEQ ID NO: 490015 - DNA, 20 bp, Artificial Sequence
  chemically synthesized
gtgaagcactaggctaaatc

SEQ ID NO: 490016 - DNA, 20 bp, Artificial Sequence
  chemically synthesized
tatgttctctaccatttttt

SEQ ID NO: 490017 - DNA, 20 bp, Artificial Sequence
  chemically synthesized
aggtacaaaaaagggaaaat

SEQ ID NO: 490018 - DNA, 20 bp, Artificial Sequence
  chemically synthesized
agagctttctgttttaatcc

SEQ ID NO: 490019 - DNA, 20 bp, Artificial Sequence
  chemically synthesized
cgtgggcttagacacaattc

SEQ ID NO: 490020 - DNA, 20 bp, Artificial Sequence
  chemically synthesized
aaaagtatttataaaacatt

SEQ ID NO: 490021 - DNA, 20 bp, Artificial Sequence
  chemically synthesized
aaacattatgagtacacagg

SEQ ID NO: 490022 - DNA, 20 bp, Artificial Sequence
  chemically synthesized
ggctcatcaaaagttcaatt

SEQ ID NO: 490023 - DNA, 20 bp, Artificial Sequence
  chemically synthesized
ttgctggggaaaaaacaata

SEQ ID NO: 490024 - DNA, 20 bp, Artificial Sequence
  chemically synthesized
tagagaattaatgtcaatct

SEQ ID NO: 490025 - DNA, 20 bp, Artificial Sequence
  chemically synthesized
caatgcaacagccatttatt

SEQ ID NO: 490026 - DNA, 20 bp, Artificial Sequence
  chemically synthesized
tagtgtccattgatatggcc

SEQ ID NO: 490027 - DNA, 20 bp, Artificial Sequence
  chemically synthesized
ggatgtaaggtccatgaggc

SEQ ID NO: 490028 - DNA, 20 bp, Artificial Sequence
  chemically synthesized
ctgcctccccttcctcccaa

SEQ ID NO: 490029 - DNA, 20 bp, Artificial Sequence
  chemically synthesized
aaaaaaatgaagcatggaaa

SEQ ID NO: 490030 - DNA, 20 bp, Artificial Sequence
  chemically synthesized
ggagcagttgtgattttata

SEQ ID NO: 490031 - DNA, 20 bp, Artificial Sequence
  chemically synthesized
tagctgcacaattaagagaa

SEQ ID NO: 490032 - DNA, 20 bp, Artificial Sequence
  chemically synthesized
ccattagtttggctacatga

SEQ ID NO: 490033 - DNA, 20 bp, Artificial Sequence
  chemically synthesized
catgactgagttcgagccaa

SEQ ID NO: 490034 - DNA, 20 bp, Artificial Sequence
  chemically synthesized
tgtgagcaaaagtgatgctc

SEQ ID NO: 490035 - DNA, 20 bp, Artificial Sequence
  chemically synthesized
gtggtggtggttattggagg

SEQ ID NO: 490036 - DNA, 20 bp, Artificial Sequence
  chemically synthesized
cataagaatgaaaaagaaca

SEQ ID NO: 490037 - DNA, 20 bp, Artificial Sequence
  chemically synthesized
atcactgtgctcttgtacat

SEQ ID NO: 490038 - DNA, 20 bp, Artificial Sequence
  chemically synthesized
ggctctgatgtctttaacat

SEQ ID NO: 490039 - DNA, 20 bp, Artificial Sequence
  chemically synthesized
aagtagatttcctccaaatg

SEQ ID NO: 490040 - DNA, 20 bp, Artificial Sequence
  chemically synthesized
aagtacaaaggccttgaggc

SEQ ID NO: 490041 - DNA, 20 bp, Artificial Sequence
  chemically synthesized
gtgaacaagaagttcagaaa

SEQ ID NO: 490042 - DNA, 20 bp, Artificial Sequence
  chemically synthesized
tcagattccagatagaatct

SEQ ID NO: 490043 - DNA, 20 bp, Artificial Sequence
  chemically synthesized
ttctattcagagattctatc

SEQ ID NO: 490044 - DNA, 20 bp, Artificial Sequence
  chemically synthesized
aaaagccttcagattccaga

SEQ ID NO: 490045 - DNA, 20 bp, Artificial Sequence
  chemically synthesized
aactgaattcgatgtgggat

SEQ ID NO: 490046 - DNA, 20 bp, Artificial Sequence
  chemically synthesized
tttataatccctatcccaca

SEQ ID NO: 490047 - DNA, 20 bp, Artificial Sequence
  chemically synthesized
cccagaaactgaattcgatg

SEQ ID NO: 490048 - DNA, 20 bp, Artificial Sequence
  chemically synthesized
tcccacatcgaattcagttt

SEQ ID NO: 490049 - DNA, 20 bp, Artificial Sequence
  chemically synthesized
aatttatttttacccagaaa

SEQ ID NO: 490050 - DNA, 20 bp, Artificial Sequence
  chemically synthesized
cctagggctcagttagttga

SEQ ID NO: 490051 - DNA, 20 bp, Artificial Sequence
  chemically synthesized
aacaggcttcgggaaaatct

SEQ ID NO: 490052 - DNA, 20 bp, Artificial Sequence
  chemically synthesized
cgggaaaatctgaggatgct

SEQ ID NO: 490053 - DNA, 20 bp, Artificial Sequence
  chemically synthesized
ggatcttcatctgtcagagg

SEQ ID NO: 490054 - DNA, 20 bp, Artificial Sequence
  chemically synthesized
cctcttaattgcattttcta

SEQ ID NO: 490055 - DNA, 20 bp, Artificial Sequence
  chemically synthesized
ccgatagaaaatgcaattaa

SEQ ID NO: 490056 - DNA, 20 bp, Artificial Sequence
  chemically synthesized
ttcaaaccgttttttctgat

SEQ ID NO: 490057 - DNA, 20 bp, Artificial Sequence
  chemically synthesized
tgcgaagggaaaaactgaac

SEQ ID NO: 490058 - DNA, 20 bp, Artificial Sequence
  chemically synthesized
aggcaggaagatgatggtgt

SEQ ID NO: 490059 - DNA, 20 bp, Artificial Sequence
  chemically synthesized
gtgctcctctgtcaagttca

SEQ ID NO: 490060 - DNA, 20 bp, Artificial Sequence
  chemically synthesized
cttaaaaaaccgggagctgg

SEQ ID NO: 490061 - DNA, 20 bp, Artificial Sequence
  chemically synthesized
gtgagggagagagaagaatc

SEQ ID NO: 490062 - DNA, 20 bp, Artificial Sequence
  chemically synthesized
tctgggagtgagggagagag

SEQ ID NO: 490063 - DNA, 20 bp, Artificial Sequence
  chemically synthesized
catgcttattgatacgctct

SEQ ID NO: 490064 - DNA, 20 bp, Artificial Sequence
  chemically synthesized
gtccacttgagaaatctctc

SEQ ID NO: 490065 - DNA, 20 bp, Artificial Sequence
  chemically synthesized
agcgaaggagacagcgacag

SEQ ID NO: 490066 - DNA, 20 bp, Artificial Sequence
  chemically synthesized
tcaaaaataaaagttgaaat

SEQ ID NO: 490067 - DNA, 20 bp, Artificial Sequence
  chemically synthesized
caaacctgtacgtatactac

SEQ ID NO: 490068 - DNA, 20 bp, Artificial Sequence
  chemically synthesized
tatacgtacaggtttgttac

SEQ ID NO: 490069 - DNA, 20 bp, Artificial Sequence
  chemically synthesized
tgttgtgtgatgccaaggtt

SEQ ID NO: 490070 - DNA, 20 bp, Artificial Sequence
  chemically synthesized
tgctcactacctgtgtgtgg

SEQ ID NO: 490071 - DNA, 20 bp, Artificial Sequence
  chemically synthesized
aagggttgaaaaactaccta

SEQ ID NO: 490072 - DNA, 20 bp, Artificial Sequence
  chemically synthesized
gggggaggaaggagaggggc

SEQ ID NO: 490073 - DNA, 20 bp, Artificial Sequence
  chemically synthesized
ctattgttttcacctttata

SEQ ID NO: 490074 - DNA, 20 bp, Artificial Sequence
  chemically synthesized
agatagttagaagctaaaca

SEQ ID NO: 490075 - DNA, 20 bp, Artificial Sequence
  chemically synthesized
tgttcctgcattaattcact

SEQ ID NO: 490076 - DNA, 20 bp, Artificial Sequence
  chemically synthesized
gctggaggtcattatcctaa

SEQ ID NO: 490077 - DNA, 20 bp, Artificial Sequence
  chemically synthesized
gtcacgccttttgtaggaac

SEQ ID NO: 490078 - DNA, 20 bp, Artificial Sequence
  chemically synthesized
aacgtggtatacatgcacca

SEQ ID NO: 490079 - DNA, 20 bp, Artificial Sequence
  chemically synthesized
aggtgcccaccagtggtgga

SEQ ID NO: 490080 - DNA, 20 bp, Artificial Sequence
  chemically synthesized
aacctaggtgcccaccagtg

SEQ ID NO: 490081 - DNA, 20 bp, Artificial Sequence
  chemically synthesized
actatacagtaacaaagaca

SEQ ID NO: 490082 - DNA, 20 bp, Artificial Sequence
  chemically synthesized
tatagtgctgcgacgaacat

SEQ ID NO: 490083 - DNA, 20 bp, Artificial Sequence
  chemically synthesized
tggtatatatttaaaagaac

SEQ ID NO: 490084 - DNA, 20 bp, Artificial Sequence
  chemically synthesized
tataccaagtaatgagattg

SEQ ID NO: 490085 - DNA, 20 bp, Artificial Sequence
  chemically synthesized
caagtaatgagattgctggg

SEQ ID NO: 490086 - DNA, 20 bp, Artificial Sequence
  chemically synthesized
cactgtttatgggaatgtaa

SEQ ID NO: 490087 - DNA, 20 bp, Artificial Sequence
  chemically synthesized
aatgcttatacactgtttat

SEQ ID NO: 490088 - DNA, 20 bp, Artificial Sequence
  chemically synthesized
tggtgaggcttcagagaaaa

SEQ ID NO: 490089 - DNA, 20 bp, Artificial Sequence
  chemically synthesized
gaggctgttagaaatcagaa

SEQ ID NO: 490090 - DNA, 20 bp, Artificial Sequence
  chemically synthesized
cttattctgaagtgtaaaga

SEQ ID NO: 490091 - DNA, 20 bp, Artificial Sequence
  chemically synthesized
cttatccactctttacactt

SEQ ID NO: 490092 - DNA, 20 bp, Artificial Sequence
  chemically synthesized
atctcttattctgaagtgta

SEQ ID NO: 490093 - DNA, 20 bp, Artificial Sequence
  chemically synthesized
ccattggcactaggatgttg

SEQ ID NO: 490094 - DNA, 20 bp, Artificial Sequence
  chemically synthesized
caacaacatcctagtgccaa

SEQ ID NO: 490095 - DNA, 20 bp, Artificial Sequence
  chemically synthesized
atattttatcccattggcac

SEQ ID NO: 490096 - DNA, 20 bp, Artificial Sequence
  chemically synthesized
tatagtgctggattttaagg

SEQ ID NO: 490097 - DNA, 20 bp, Artificial Sequence
  chemically synthesized
atcctgatatggatatagtg

SEQ ID NO: 490098 - DNA, 20 bp, Artificial Sequence
  chemically synthesized
atccagcactatatccatat

SEQ ID NO: 490099 - DNA, 20 bp, Artificial Sequence
  chemically synthesized
attgtatgatgaatcctgat

SEQ ID NO: 490100 - DNA, 20 bp, Artificial Sequence
  chemically synthesized
ggcagagggaacattgtatg

SEQ ID NO: 490101 - DNA, 20 bp, Artificial Sequence
  chemically synthesized
catacaatgttccctctgcc

SEQ ID NO: 490102 - DNA, 20 bp, Artificial Sequence
  chemically synthesized
ctgtgacctatacctgggtt

SEQ ID NO: 490103 - DNA, 20 bp, Artificial Sequence
  chemically synthesized
acaggacctgtgacctatac

SEQ ID NO: 490104 - DNA, 20 bp, Artificial Sequence
  chemically synthesized
tatatgctaagtactgagga

SEQ ID NO: 490105 - DNA, 20 bp, Artificial Sequence
  chemically synthesized
aatactatatgctaagtact

SEQ ID NO: 490106 - DNA, 20 bp, Artificial Sequence
  chemically synthesized
tgctgtatagctttccctgg

SEQ ID NO: 490107 - DNA, 20 bp, Artificial Sequence
  chemically synthesized
catagacaatatgtaaatga

SEQ ID NO: 490108 - DNA, 20 bp, Artificial Sequence
  chemically synthesized
taaccatagacaatatgtaa

SEQ ID NO: 490109 - DNA, 20 bp, Artificial Sequence
  chemically synthesized
ttactttcatgctacaatag

SEQ ID NO: 490110 - DNA, 20 bp, Artificial Sequence
  chemically synthesized
ttcatgctacaatagcagag

SEQ ID NO: 490111 - DNA, 20 bp, Artificial Sequence
  chemically synthesized
ttgagtagttgcagcaaaga

SEQ ID NO: 490112 - DNA, 20 bp, Artificial Sequence
  chemically synthesized
catagcagatggtggtaaac

SEQ ID NO: 490113 - DNA, 20 bp, Artificial Sequence
  chemically synthesized
tccttcttagacatctacta

SEQ ID NO: 490114 - DNA, 20 bp, Artificial Sequence
  chemically synthesized
tactagggaattaaagatac

SEQ ID NO: 490115 - DNA, 20 bp, Artificial Sequence
  chemically synthesized
catgattgtttcaaggggtg

SEQ ID NO: 490116 - DNA, 20 bp, Artificial Sequence
  chemically synthesized
aagtgctcatgattgtttca

SEQ ID NO: 490117 - DNA, 20 bp, Artificial Sequence
  chemically synthesized
gaaatgttcgtgaatttaaa

SEQ ID NO: 490118 - DNA, 20 bp, Artificial Sequence
  chemically synthesized
tctcatagttggaaatgttc

SEQ ID NO: 490119 - DNA, 20 bp, Artificial Sequence
  chemically synthesized
gaaactatatctacttacct

SEQ ID NO: 490120 - DNA, 20 bp, Artificial Sequence
  chemically synthesized
aataaatgataaagttggtt

SEQ ID NO: 490121 - DNA, 20 bp, Artificial Sequence
  chemically synthesized
taggaggtgaaattataaaa

SEQ ID NO: 490122 - DNA, 20 bp, Artificial Sequence
  chemically synthesized
aagcccagaggggaaaaaaa

SEQ ID NO: 490123 - DNA, 20 bp, Artificial Sequence
  chemically synthesized
tttattactgtgtctgtatt

SEQ ID NO: 490124 - DNA, 20 bp, Artificial Sequence
  chemically synthesized
tggaaagaattactaccacg

SEQ ID NO: 490125 - DNA, 20 bp, Artificial Sequence
  chemically synthesized
acattttttctgggggtgga

SEQ ID NO: 490126 - DNA, 20 bp, Artificial Sequence
  chemically synthesized
aaacagatgacattttttct

SEQ ID NO: 490127 - DNA, 20 bp, Artificial Sequence
  chemically synthesized
caaactatgtatgtttccag

SEQ ID NO: 490128 - DNA, 20 bp, Artificial Sequence
  chemically synthesized
atgtatgtttccagtggaat

SEQ ID NO: 490129 - DNA, 20 bp, Artificial Sequence
  chemically synthesized
ctctcactctctggggaact

SEQ ID NO: 490130 - DNA, 20 bp, Artificial Sequence
  chemically synthesized
cggaaacccgaagttcccca

SEQ ID NO: 490131 - DNA, 20 bp, Artificial Sequence
  chemically synthesized
aataccctttgcctttctgc

SEQ ID NO: 490132 - DNA, 20 bp, Artificial Sequence
  chemically synthesized
catactcgagcagaaaggca

SEQ ID NO: 490133 - DNA, 20 bp, Artificial Sequence
  chemically synthesized
aacttagctgcaattatgtg

SEQ ID NO: 490134 - DNA, 20 bp, Artificial Sequence
  chemically synthesized
cagaggttactattctttaa

SEQ ID NO: 490135 - DNA, 20 bp, Artificial Sequence
  chemically synthesized
cctgtggctatattctttta

SEQ ID NO: 490136 - DNA, 20 bp, Artificial Sequence
  chemically synthesized
tttaaggaaatactgtttca

SEQ ID NO: 490137 - DNA, 20 bp, Artificial Sequence
  chemically synthesized
aatgtggtctggggacccct

SEQ ID NO: 490138 - DNA, 20 bp, Artificial Sequence
  chemically synthesized
catgggtctcagggactccc

SEQ ID NO: 490139 - DNA, 20 bp, Artificial Sequence
  chemically synthesized
ggacctcacagaaccactgc

SEQ ID NO: 490140 - DNA, 20 bp, Artificial Sequence
  chemically synthesized
ttttcctctctcattctatt

SEQ ID NO: 490141 - DNA, 20 bp, Artificial Sequence
  chemically synthesized
agcctctgaaaaactcataa

SEQ ID NO: 490142 - DNA, 20 bp, Artificial Sequence
  chemically synthesized
ttcttatatctgtttctgca

SEQ ID NO: 490143 - DNA, 20 bp, Artificial Sequence
  chemically synthesized
aacagaaacaatatagtgag

SEQ ID NO: 490144 - DNA, 20 bp, Artificial Sequence
  chemically synthesized
tttcaacatgcaattttaaa

SEQ ID NO: 490145 - DNA, 20 bp, Artificial Sequence
  chemically synthesized
ttttttttttttttttgaga

SEQ ID NO: 490146 - DNA, 20 bp, Artificial Sequence
  chemically synthesized
actgcactccagccgggcga

SEQ ID NO: 490147 - DNA, 20 bp, Artificial Sequence
  chemically synthesized
gtctcactctgtcgcccggc

SEQ ID NO: 490148 - DNA, 20 bp, Artificial Sequence
  chemically synthesized
ctcactgcaacctctgcctc

SEQ ID NO: 490149 - DNA, 20 bp, Artificial Sequence
  chemically synthesized
tactcgggaggctgaagcag

SEQ ID NO: 490150 - DNA, 20 bp, Artificial Sequence
  chemically synthesized
aattcttctgcttcagcctc

SEQ ID NO: 490151 - DNA, 20 bp, Artificial Sequence
  chemically synthesized
acaaaacaaaacaaacaaac

SEQ ID NO: 490152 - DNA, 20 bp, Artificial Sequence
  chemically synthesized
ttttgtatttttaacagaga

SEQ ID NO: 490153 - DNA, 20 bp, Artificial Sequence
  chemically synthesized
cagggtttcaccatgttcac

SEQ ID NO: 490154 - DNA, 20 bp, Artificial Sequence
  chemically synthesized
actctgggaggccgaggcgg

SEQ ID NO: 490155 - DNA, 20 bp, Artificial Sequence
  chemically synthesized
atccgcccgcctcggcctcc

SEQ ID NO: 490156 - DNA, 20 bp, Artificial Sequence
  chemically synthesized
gcctcggcctcccagagtgc

SEQ ID NO: 490157 - DNA, 20 bp, Artificial Sequence
  chemically synthesized
atgacagcttatcatgcatg

SEQ ID NO: 490158 - DNA, 20 bp, Artificial Sequence
  chemically synthesized
ggtggatttcttcataccta

SEQ ID NO: 490159 - DNA, 20 bp, Artificial Sequence
  chemically synthesized
ctccaactggaatgtttgtg

SEQ ID NO: 490160 - DNA, 20 bp, Artificial Sequence
  chemically synthesized
tccaccacaaacattccagt

SEQ ID NO: 490161 - DNA, 20 bp, Artificial Sequence
  chemically synthesized
gcaaatttctgaactccaac

SEQ ID NO: 490162 - DNA, 20 bp, Artificial Sequence
  chemically synthesized
tggagttcagaaatttgcca

SEQ ID NO: 490163 - DNA, 20 bp, Artificial Sequence
  chemically synthesized
tttattagagacagagggag

SEQ ID NO: 490164 - DNA, 20 bp, Artificial Sequence
  chemically synthesized
taatgtaggccaatgactat

SEQ ID NO: 490165 - DNA, 20 bp, Artificial Sequence
  chemically synthesized
tgactatgagggtcaacttt

SEQ ID NO: 490166 - DNA, 20 bp, Artificial Sequence
  chemically synthesized
gaactgcctaaatatttact

SEQ ID NO: 490167 - DNA, 20 bp, Artificial Sequence
  chemically synthesized
ctagtcagtgatacagatac

SEQ ID NO: 490168 - DNA, 20 bp, Artificial Sequence
  chemically synthesized
tcagtgatacagatacatga

SEQ ID NO: 490169 - DNA, 20 bp, Artificial Sequence
  chemically synthesized
attgtttttattttttgaga

SEQ ID NO: 490170 - DNA, 20 bp, Artificial Sequence
  chemically synthesized
tctcgctctgtcacccaggc

SEQ ID NO: 490171 - DNA, 20 bp, Artificial Sequence
  chemically synthesized
tcgcgccactgcaccccagc

SEQ ID NO: 490172 - DNA, 20 bp, Artificial Sequence
  chemically synthesized
ctcacagcaacctccacctc

SEQ ID NO: 490173 - DNA, 20 bp, Artificial Sequence
  chemically synthesized
ctactcggaggctgaggcag

SEQ ID NO: 490174 - DNA, 20 bp, Artificial Sequence
  chemically synthesized
cgattctcctgcctcagcct

SEQ ID NO: 490175 - DNA, 20 bp, Artificial Sequence
  chemically synthesized
tgcctcagcctccgagtagc

SEQ ID NO: 490176 - DNA, 20 bp, Artificial Sequence
  chemically synthesized
agatgtgtaataaatgtttg

SEQ ID NO: 490177 - DNA, 20 bp, Artificial Sequence
  chemically synthesized
caggcactatactatttttg

SEQ ID NO: 490178 - DNA, 20 bp, Artificial Sequence
  chemically synthesized
actatttttgctggatattc

SEQ ID NO: 490179 - DNA, 20 bp, Artificial Sequence
  chemically synthesized
tggctctgttttgttcactc

SEQ ID NO: 490180 - DNA, 20 bp, Artificial Sequence
  chemically synthesized
tacacgtagcttatggtgtc

SEQ ID NO: 490181 - DNA, 20 bp, Artificial Sequence
  chemically synthesized
ttaaaccactaatcatacaa

SEQ ID NO: 490182 - DNA, 20 bp, Artificial Sequence
  chemically synthesized
aaaaaaattaagattgttag

SEQ ID NO: 490183 - DNA, 20 bp, Artificial Sequence
  chemically synthesized
aaagtgaaagtttgtaaaaa

SEQ ID NO: 490184 - DNA, 20 bp, Artificial Sequence
  chemically synthesized
tgcatcaaattttactttcc

SEQ ID NO: 490185 - DNA, 20 bp, Artificial Sequence
  chemically synthesized
ttttactttccatgaataaa

SEQ ID NO: 490186 - DNA, 20 bp, Artificial Sequence
  chemically synthesized
tattaatctcattatgtgcc

SEQ ID NO: 490187 - DNA, 20 bp, Artificial Sequence
  chemically synthesized
aaaagcaaagcaaatttgtt

SEQ ID NO: 490188 - DNA, 20 bp, Artificial Sequence
  chemically synthesized
aattttctcaaagggcttaa

SEQ ID NO: 490189 - DNA, 20 bp, Artificial Sequence
  chemically synthesized
actgaatatctatcggtctt

SEQ ID NO: 490190 - DNA, 20 bp, Artificial Sequence
  chemically synthesized
caaaagcacttacagtcatt

SEQ ID NO: 490191 - DNA, 20 bp, Artificial Sequence
  chemically synthesized
acctgtttctaagaagagca

SEQ ID NO: 490192 - DNA, 20 bp, Artificial Sequence
  chemically synthesized
aggctgtggtggttgtaaca

SEQ ID NO: 490193 - DNA, 20 bp, Artificial Sequence
  chemically synthesized
ggttgtaacagtgagtccct

SEQ ID NO: 490194 - DNA, 20 bp, Artificial Sequence
  chemically synthesized
aaaactatgtcaatatcagc

SEQ ID NO: 490195 - DNA, 20 bp, Artificial Sequence
  chemically synthesized
atacagatggtacaagacaa

SEQ ID NO: 490196 - DNA, 20 bp, Artificial Sequence
  chemically synthesized
caaggtagaagaaatactta

SEQ ID NO: 490197 - DNA, 20 bp, Artificial Sequence
  chemically synthesized
agaaatacttagcgagtcag

SEQ ID NO: 490198 - DNA, 20 bp, Artificial Sequence
  chemically synthesized
gagtcagaggaattgaaact

SEQ ID NO: 490199 - DNA, 20 bp, Artificial Sequence
  chemically synthesized
ctctctaaactttagccaca

SEQ ID NO: 490200 - DNA, 20 bp, Artificial Sequence
  chemically synthesized
aaagtttagagagaaaaatg

SEQ ID NO: 490201 - DNA, 20 bp, Artificial Sequence
  chemically synthesized
atacactaataaagttcatg

SEQ ID NO: 490202 - DNA, 20 bp, Artificial Sequence
  chemically synthesized
taatgaatttagtaattgac

SEQ ID NO: 490203 - DNA, 20 bp, Artificial Sequence
  chemically synthesized
taccttgtaccaaattttta

SEQ ID NO: 490204 - DNA, 20 bp, Artificial Sequence
  chemically synthesized
acaaggtacagatgaactta

SEQ ID NO: 490205 - DNA, 20 bp, Artificial Sequence
  chemically synthesized
ttcaaggatcaaaaccaatc

SEQ ID NO: 490206 - DNA, 20 bp, Artificial Sequence
  chemically synthesized
taagtgaagtggtctacttc

SEQ ID NO: 490207 - DNA, 20 bp, Artificial Sequence
  chemically synthesized
ttggattctagtattttaaa

SEQ ID NO: 490208 - DNA, 20 bp, Artificial Sequence
  chemically synthesized
aagcatccgttttaaaatac

SEQ ID NO: 490209 - DNA, 20 bp, Artificial Sequence
  chemically synthesized
ttttaaaatactagaatcca

SEQ ID NO: 490210 - DNA, 20 bp, Artificial Sequence
  chemically synthesized
gaaatccttgaagataccct

SEQ ID NO: 490211 - DNA, 20 bp, Artificial Sequence
  chemically synthesized
agaatccaaagggtatcttc

SEQ ID NO: 490212 - DNA, 20 bp, Artificial Sequence
  chemically synthesized
acagacctagccatgtacaa

SEQ ID NO: 490213 - DNA, 20 bp, Artificial Sequence
  chemically synthesized
gtatgtttacgaaaactgaa

SEQ ID NO: 490214 - DNA, 20 bp, Artificial Sequence
  chemically synthesized
tgaccatcattaccttccag

SEQ ID NO: 490215 - DNA, 20 bp, Artificial Sequence
  chemically synthesized
ccttccagctgaatctatga

SEQ ID NO: 490216 - DNA, 20 bp, Artificial Sequence
  chemically synthesized
ttaattcaggagaatgggaa

SEQ ID NO: 490217 - DNA, 20 bp, Artificial Sequence
  chemically synthesized
agaattctgttcccattctc

SEQ ID NO: 490218 - DNA, 20 bp, Artificial Sequence
  chemically synthesized
cttagcaactattaattcag

SEQ ID NO: 490219 - DNA, 20 bp, Artificial Sequence
  chemically synthesized
aggcaaagcataatgaaaat

SEQ ID NO: 490220 - DNA, 20 bp, Artificial Sequence
  chemically synthesized
gtagctaaaccttaaataca

SEQ ID NO: 490221 - DNA, 20 bp, Artificial Sequence
  chemically synthesized
tctatttatttattttgaga

SEQ ID NO: 490222 - DNA, 20 bp, Artificial Sequence
  chemically synthesized
tattttgagacagggtctcc

SEQ ID NO: 490223 - DNA, 20 bp, Artificial Sequence
  chemically synthesized
tgggagaatttcttgagccc

SEQ ID NO: 490224 - DNA, 20 bp, Artificial Sequence
  chemically synthesized
tgctcgggaggctgagttgg

SEQ ID NO: 490225 - DNA, 20 bp, Artificial Sequence
  chemically synthesized
agtcctagatgctcgggagg

SEQ ID NO: 490226 - DNA, 20 bp, Artificial Sequence
  chemically synthesized
tttttaattttatgtagaga

SEQ ID NO: 490227 - DNA, 20 bp, Artificial Sequence
  chemically synthesized
caagaggattgcttgaggcc

SEQ ID NO: 490228 - DNA, 20 bp, Artificial Sequence
  chemically synthesized
gctttgggaggccaaggcaa

SEQ ID NO: 490229 - DNA, 20 bp, Artificial Sequence
  chemically synthesized
aagtatttaaggtgtacacg

SEQ ID NO: 490230 - DNA, 20 bp, Artificial Sequence
  chemically synthesized
atttagtataatcctggact

SEQ ID NO: 490231 - DNA, 20 bp, Artificial Sequence
  chemically synthesized
atataaccccatcctcagtc

SEQ ID NO: 490232 - DNA, 20 bp, Artificial Sequence
  chemically synthesized
gtataatcctggactgagga

SEQ ID NO: 490233 - DNA, 20 bp, Artificial Sequence
  chemically synthesized
gactgaggatggggttatat

SEQ ID NO: 490234 - DNA, 20 bp, Artificial Sequence
  chemically synthesized
aatgatattttcaacttaca

SEQ ID NO: 490235 - DNA, 20 bp, Artificial Sequence
  chemically synthesized
catcataaattgaaaatgtt

SEQ ID NO: 490236 - DNA, 20 bp, Artificial Sequence
  chemically synthesized
cataacattttcaatttatg

SEQ ID NO: 490237 - DNA, 20 bp, Artificial Sequence
  chemically synthesized
agatgctcctcaccttagga

SEQ ID NO: 490238 - DNA, 20 bp, Artificial Sequence
  chemically synthesized
tatacagatgctcctcacct

SEQ ID NO: 490239 - DNA, 20 bp, Artificial Sequence
  chemically synthesized
gagcatctgtatacaatgtg

SEQ ID NO: 490240 - DNA, 20 bp, Artificial Sequence
  chemically synthesized
ctgtatacaatgtgatgaat

SEQ ID NO: 490241 - DNA, 20 bp, Artificial Sequence
  chemically synthesized
tacttggttaccttgattat

SEQ ID NO: 490242 - DNA, 20 bp, Artificial Sequence
  chemically synthesized
agggggcatgagcaaacttt

SEQ ID NO: 490243 - DNA, 20 bp, Artificial Sequence
  chemically synthesized
tgcacttaaattattattaa

SEQ ID NO: 490244 - DNA, 20 bp, Artificial Sequence
  chemically synthesized
gaactgggagttgctgttca

SEQ ID NO: 490245 - DNA, 20 bp, Artificial Sequence
  chemically synthesized
ggctgggcgaagggggaact

SEQ ID NO: 490246 - DNA, 20 bp, Artificial Sequence
  chemically synthesized
aaactcgtagaaccagagag

SEQ ID NO: 490247 - DNA, 20 bp, Artificial Sequence
  chemically synthesized
tcattctactctctggttct

SEQ ID NO: 490248 - DNA, 20 bp, Artificial Sequence
  chemically synthesized
cagtcaaactcgtagaacca

SEQ ID NO: 490249 - DNA, 20 bp, Artificial Sequence
  chemically synthesized
tctcagacacctcatataaa

SEQ ID NO: 490250 - DNA, 20 bp, Artificial Sequence
  chemically synthesized
cagtcaccaaagggcaaata

SEQ ID NO: 490251 - DNA, 20 bp, Artificial Sequence
  chemically synthesized
ggccaaataatattccctgt

SEQ ID NO: 490252 - DNA, 20 bp, Artificial Sequence
  chemically synthesized
aaatgtggtgtattcataca

SEQ ID NO: 490253 - DNA, 20 bp, Artificial Sequence
  chemically synthesized
agctgtgcatggaagaatgc

SEQ ID NO: 490254 - DNA, 20 bp, Artificial Sequence
  chemically synthesized
tacagcatagctgtgcatgg

SEQ ID NO: 490255 - DNA, 20 bp, Artificial Sequence
  chemically synthesized
gtattgatatcttggctact

SEQ ID NO: 490256 - DNA, 20 bp, Artificial Sequence
  chemically synthesized
aataatgcttcagagaagat

SEQ ID NO: 490257 - DNA, 20 bp, Artificial Sequence
  chemically synthesized
atatcccaaagaattaaaac

SEQ ID NO: 490258 - DNA, 20 bp, Artificial Sequence
  chemically synthesized
agattctggttttaattctt

SEQ ID NO: 490259 - DNA, 20 bp, Artificial Sequence
  chemically synthesized
actcctgggtatatatccca

SEQ ID NO: 490260 - DNA, 20 bp, Artificial Sequence
  chemically synthesized
attctttgggatatataccc

SEQ ID NO: 490261 - DNA, 20 bp, Artificial Sequence
  chemically synthesized
atgatccagcaacctcactc

SEQ ID NO: 490262 - DNA, 20 bp, Artificial Sequence
  chemically synthesized
tatacccaggagtgaggttg

SEQ ID NO: 490263 - DNA, 20 bp, Artificial Sequence
  chemically synthesized
aagagataagaaatgttgtt

SEQ ID NO: 490264 - DNA, 20 bp, Artificial Sequence
  chemically synthesized
tttatagtagccatcctaac

SEQ ID NO: 490265 - DNA, 20 bp, Artificial Sequence
  chemically synthesized
cactatcatctcacccctgt

SEQ ID NO: 490266 - DNA, 20 bp, Artificial Sequence
  chemically synthesized
agttatttgcctttttcctg

SEQ ID NO: 490267 - DNA, 20 bp, Artificial Sequence
  chemically synthesized
aatagaagaaaagcttatta

SEQ ID NO: 490268 - DNA, 20 bp, Artificial Sequence
  chemically synthesized
aataataagcttttcttcta

SEQ ID NO: 490269 - DNA, 20 bp, Artificial Sequence
  chemically synthesized
tattgattgaccataaatat

SEQ ID NO: 490270 - DNA, 20 bp, Artificial Sequence
  chemically synthesized
aagagtttattgctggacta

SEQ ID NO: 490271 - DNA, 20 bp, Artificial Sequence
  chemically synthesized
tctcttccattgtcaacatt

SEQ ID NO: 490272 - DNA, 20 bp, Artificial Sequence
  chemically synthesized
agtagatttaagaaaaaaat

SEQ ID NO: 490273 - DNA, 20 bp, Artificial Sequence
  chemically synthesized
gttttggctatttggtacat

SEQ ID NO: 490274 - DNA, 20 bp, Artificial Sequence
  chemically synthesized
gaattgctatatataaattg

SEQ ID NO: 490275 - DNA, 20 bp, Artificial Sequence
  chemically synthesized
aatctatagaacaagttggg

SEQ ID NO: 490276 - DNA, 20 bp, Artificial Sequence
  chemically synthesized
gaatcactaccttatcagta

SEQ ID NO: 490277 - DNA, 20 bp, Artificial Sequence
  chemically synthesized
agtcttccaattcatgaaca

SEQ ID NO: 490278 - DNA, 20 bp, Artificial Sequence
  chemically synthesized
tgggaccatattccatgttc

SEQ ID NO: 490279 - DNA, 20 bp, Artificial Sequence
  chemically synthesized
cagcaatgtattacagtttt

SEQ ID NO: 490280 - DNA, 20 bp, Artificial Sequence
  chemically synthesized
ttaatctattttatgctaca

SEQ ID NO: 490281 - DNA, 20 bp, Artificial Sequence
  chemically synthesized
attttttattgctagtacac

SEQ ID NO: 490282 - DNA, 20 bp, Artificial Sequence
  chemically synthesized
ttgcaagataatcaatatac

SEQ ID NO: 490283 - DNA, 20 bp, Artificial Sequence
  chemically synthesized
tcagatctagcagttatttt

SEQ ID NO: 490284 - DNA, 20 bp, Artificial Sequence
  chemically synthesized
atatcagatttttctacata

SEQ ID NO: 490285 - DNA, 20 bp, Artificial Sequence
  chemically synthesized
catacaggattgtattgtct

SEQ ID NO: 490286 - DNA, 20 bp, Artificial Sequence
  chemically synthesized
ttgtattgtctgtgaataaa

SEQ ID NO: 490287 - DNA, 20 bp, Artificial Sequence
  chemically synthesized
ttcatttcttcttctatact

SEQ ID NO: 490288 - DNA, 20 bp, Artificial Sequence
  chemically synthesized
tcttctatactgtggatgcc

SEQ ID NO: 490289 - DNA, 20 bp, Artificial Sequence
  chemically synthesized
cccaggtccaggagaaagat

SEQ ID NO: 490290 - DNA, 20 bp, Artificial Sequence
  chemically synthesized
ttcctatctttctcctggac

SEQ ID NO: 490291 - DNA, 20 bp, Artificial Sequence
  chemically synthesized
acctaacacaaacacagaaa

SEQ ID NO: 490292 - DNA, 20 bp, Artificial Sequence
  chemically synthesized
ttcaagaaaaaaatagacat

SEQ ID NO: 490293 - DNA, 20 bp, Artificial Sequence
  chemically synthesized
ttcatatgtctatttttttc

SEQ ID NO: 490294 - DNA, 20 bp, Artificial Sequence
  chemically synthesized
ttgttaatttatgtctttct

SEQ ID NO: 490295 - DNA, 20 bp, Artificial Sequence
  chemically synthesized
cctacagaaattagaaagac

SEQ ID NO: 490296 - DNA, 20 bp, Artificial Sequence
  chemically synthesized
tctagtctttctaatttctg

SEQ ID NO: 490297 - DNA, 20 bp, Artificial Sequence
  chemically synthesized
accaaaatcataaaggaaaa

SEQ ID NO: 490298 - DNA, 20 bp, Artificial Sequence
  chemically synthesized
gctagactgaccaaaaaaaa

SEQ ID NO: 490299 - DNA, 20 bp, Artificial Sequence
  chemically synthesized
agcataaggaaggaaataac

SEQ ID NO: 490300 - DNA, 20 bp, Artificial Sequence
  chemically synthesized
tagtttcttatggcgaaagc

SEQ ID NO: 490301 - DNA, 20 bp, Artificial Sequence
  chemically synthesized
aaagcttgagttaatgattt

SEQ ID NO: 490302 - DNA, 20 bp, Artificial Sequence
  chemically synthesized
tttaaatacctattttagaa

SEQ ID NO: 490303 - DNA, 20 bp, Artificial Sequence
  chemically synthesized
gcacaacatgtcaagattta

SEQ ID NO: 490304 - DNA, 20 bp, Artificial Sequence
  chemically synthesized
aaattataaaatattttgaa

SEQ ID NO: 490305 - DNA, 20 bp, Artificial Sequence
  chemically synthesized
tgtgatttagtttttaacca

SEQ ID NO: 490306 - DNA, 20 bp, Artificial Sequence
  chemically synthesized
accaatggatttagaagttg

SEQ ID NO: 490307 - DNA, 20 bp, Artificial Sequence
  chemically synthesized
atcttccaaatttccttctg

SEQ ID NO: 490308 - DNA, 20 bp, Artificial Sequence
  chemically synthesized
ttaatatgtcagaattaaat

SEQ ID NO: 490309 - DNA, 20 bp, Artificial Sequence
  chemically synthesized
attatgttctcttaatatgt

SEQ ID NO: 490310 - DNA, 20 bp, Artificial Sequence
  chemically synthesized
attaagagaacataattttt

SEQ ID NO: 490311 - DNA, 20 bp, Artificial Sequence
  chemically synthesized
tttttatgaattcaagcctg

SEQ ID NO: 490312 - DNA, 20 bp, Artificial Sequence
  chemically synthesized
tctcaatacactcaacaggc

SEQ ID NO: 490313 - DNA, 20 bp, Artificial Sequence
  chemically synthesized
atttgttttttgacctagca

SEQ ID NO: 490314 - DNA, 20 bp, Artificial Sequence
  chemically synthesized
agtgcacatgaaattttctc

SEQ ID NO: 490315 - DNA, 20 bp, Artificial Sequence
  chemically synthesized
gagacgccaccaaatgaaag

SEQ ID NO: 490316 - DNA, 20 bp, Artificial Sequence
  chemically synthesized
caagctggttgatagtgttg

SEQ ID NO: 490317 - DNA, 20 bp, Artificial Sequence
  chemically synthesized
gaaaaatagcaacaatatag

SEQ ID NO: 490318 - DNA, 20 bp, Artificial Sequence
  chemically synthesized
taattggcctgccagctatt

SEQ ID NO: 490319 - DNA, 20 bp, Artificial Sequence
  chemically synthesized
ggcctgccagctattgagag

SEQ ID NO: 490320 - DNA, 20 bp, Artificial Sequence
  chemically synthesized
gaagtctccaataataattg

SEQ ID NO: 490321 - DNA, 20 bp, Artificial Sequence
  chemically synthesized
ttgaattgtctagttctcct

SEQ ID NO: 490322 - DNA, 20 bp, Artificial Sequence
  chemically synthesized
ttctatgatgcagaaattga

SEQ ID NO: 490323 - DNA, 20 bp, Artificial Sequence
  chemically synthesized
ttctgtcaatttctgcatca

SEQ ID NO: 490324 - DNA, 20 bp, Artificial Sequence
  chemically synthesized
aagacatttttaattatata

SEQ ID NO: 490325 - DNA, 20 bp, Artificial Sequence
  chemically synthesized
ctcttttaaacaaactatgg

SEQ ID NO: 490326 - DNA, 20 bp, Artificial Sequence
  chemically synthesized
ttataggcagagatttcaga

SEQ ID NO: 490327 - DNA, 20 bp, Artificial Sequence
  chemically synthesized
ctgaaatctctgcctataat

SEQ ID NO: 490328 - DNA, 20 bp, Artificial Sequence
  chemically synthesized
tatcaatagttatagtaaat

SEQ ID NO: 490329 - DNA, 20 bp, Artificial Sequence
  chemically synthesized
tataactattgatatgtagg

SEQ ID NO: 490330 - DNA, 20 bp, Artificial Sequence
  chemically synthesized
aatcccaagcattttggata

SEQ ID NO: 490331 - DNA, 20 bp, Artificial Sequence
  chemically synthesized
tatcccatatccaaaatgct

SEQ ID NO: 490332 - DNA, 20 bp, Artificial Sequence
  chemically synthesized
cacttccaatcccaagcatt

SEQ ID NO: 490333 - DNA, 20 bp, Artificial Sequence
  chemically synthesized
tgcttgggattggaagtgtt

SEQ ID NO: 490334 - DNA, 20 bp, Artificial Sequence
  chemically synthesized
gattggaagtgttttggatt

SEQ ID NO: 490335 - DNA, 20 bp, Artificial Sequence
  chemically synthesized
aatttcacacctgacctgta

SEQ ID NO: 490336 - DNA, 20 bp, Artificial Sequence
  chemically synthesized
aaatttcagatttttttaat

SEQ ID NO: 490337 - DNA, 20 bp, Artificial Sequence
  chemically synthesized
tgtaattgcaactaaaagtt

SEQ ID NO: 490338 - DNA, 20 bp, Artificial Sequence
  chemically synthesized
gaaacaggaacaaaaaagac

SEQ ID NO: 490339 - DNA, 20 bp, Artificial Sequence
  chemically synthesized
cgaacccaaatgaagagata

SEQ ID NO: 490340 - DNA, 20 bp, Artificial Sequence
  chemically synthesized
gtgattctttatctcttcat

SEQ ID NO: 490341 - DNA, 20 bp, Artificial Sequence
  chemically synthesized
ctttatctcttcatttgggt

SEQ ID NO: 490342 - DNA, 20 bp, Artificial Sequence
  chemically synthesized
cttcatttgggttcgagtta

SEQ ID NO: 490343 - DNA, 20 bp, Artificial Sequence
  chemically synthesized
gaatatcacttcttttcagc

SEQ ID NO: 490344 - DNA, 20 bp, Artificial Sequence
  chemically synthesized
tatattaccaagttgagaat

SEQ ID NO: 490345 - DNA, 20 bp, Artificial Sequence
  chemically synthesized
aataaatatattaccaagtt

SEQ ID NO: 490346 - DNA, 20 bp, Artificial Sequence
  chemically synthesized
ttattttacctatatttttg

SEQ ID NO: 490347 - DNA, 20 bp, Artificial Sequence
  chemically synthesized
aaggatagttttgttttatg

SEQ ID NO: 490348 - DNA, 20 bp, Artificial Sequence
  chemically synthesized
agaacacaaaattgccaacc

SEQ ID NO: 490349 - DNA, 20 bp, Artificial Sequence
  chemically synthesized
ttttgtgttctctgagaact

SEQ ID NO: 490350 - DNA, 20 bp, Artificial Sequence
  chemically synthesized
aggtattgaaatgacatatt

SEQ ID NO: 490351 - DNA, 20 bp, Artificial Sequence
  chemically synthesized
tcatgtgatccctgtacatg

SEQ ID NO: 490352 - DNA, 20 bp, Artificial Sequence
  chemically synthesized
aaaaatgactcctcatgtac

SEQ ID NO: 490353 - DNA, 20 bp, Artificial Sequence
  chemically synthesized
atagtttgactcttatgttt

SEQ ID NO: 490354 - DNA, 20 bp, Artificial Sequence
  chemically synthesized
agatcaataccctaaaacat

SEQ ID NO: 490355 - DNA, 20 bp, Artificial Sequence
  chemically synthesized
ctcttcgtgtttattctatt

SEQ ID NO: 490356 - DNA, 20 bp, Artificial Sequence
  chemically synthesized
taagctcaacaaaccccaaa

SEQ ID NO: 490357 - DNA, 20 bp, Artificial Sequence
  chemically synthesized
acaagagttccagaaaaaaa

SEQ ID NO: 490358 - DNA, 20 bp, Artificial Sequence
  chemically synthesized
catatcaatgtagatgttac

SEQ ID NO: 490359 - DNA, 20 bp, Artificial Sequence
  chemically synthesized
aaacagtataaaaaacgaac

SEQ ID NO: 490360 - DNA, 20 bp, Artificial Sequence
  chemically synthesized
ttttacctctgacattcaga

SEQ ID NO: 490361 - DNA, 20 bp, Artificial Sequence
  chemically synthesized
ataaataaaaattatccaat

SEQ ID NO: 490362 - DNA, 20 bp, Artificial Sequence
  chemically synthesized
aaaattctagaattggaaag

SEQ ID NO: 490363 - DNA, 20 bp, Artificial Sequence
  chemically synthesized
gttattctactttccaattc

SEQ ID NO: 490364 - DNA, 20 bp, Artificial Sequence
  chemically synthesized
aaagaaccaaatgaaaattc

SEQ ID NO: 490365 - DNA, 20 bp, Artificial Sequence
  chemically synthesized
ggtaacaataactacaaata

SEQ ID NO: 490366 - DNA, 20 bp, Artificial Sequence
  chemically synthesized
gcagtcaacaaaagttgtct

SEQ ID NO: 490367 - DNA, 20 bp, Artificial Sequence
  chemically synthesized
tgttgactgcttttccccat

SEQ ID NO: 490368 - DNA, 20 bp, Artificial Sequence
  chemically synthesized
gactgcttttccccatgaga

SEQ ID NO: 490369 - DNA, 20 bp, Artificial Sequence
  chemically synthesized
ctgggcataagaaggaacat

SEQ ID NO: 490370 - DNA, 20 bp, Artificial Sequence
  chemically synthesized
acttgcctagatgaaatctg

SEQ ID NO: 490371 - DNA, 20 bp, Artificial Sequence
  chemically synthesized
tttctgttgtttgacagaga

SEQ ID NO: 490372 - DNA, 20 bp, Artificial Sequence
  chemically synthesized
aaggttctttatatgtgtta

SEQ ID NO: 490373 - DNA, 20 bp, Artificial Sequence
  chemically synthesized
acttaaaatgtgcctgcatg

SEQ ID NO: 490374 - DNA, 20 bp, Artificial Sequence
  chemically synthesized
gttttcatgaaggagacaca

SEQ ID NO: 490375 - DNA, 20 bp, Artificial Sequence
  chemically synthesized
agactgcaactttaggccag

SEQ ID NO: 490376 - DNA, 20 bp, Artificial Sequence
  chemically synthesized
ctaggcggcaaacaaaaagg

SEQ ID NO: 490377 - DNA, 20 bp, Artificial Sequence
  chemically synthesized
actgacaatgcttctggaca

SEQ ID NO: 490378 - DNA, 20 bp, Artificial Sequence
  chemically synthesized
ctattatgcttgaccaagct

SEQ ID NO: 490379 - DNA, 20 bp, Artificial Sequence
  chemically synthesized
aaactttgtatatgaacaat

SEQ ID NO: 490380 - DNA, 20 bp, Artificial Sequence
  chemically synthesized
atatgccgttggttgatatc

SEQ ID NO: 490381 - DNA, 20 bp, Artificial Sequence
  chemically synthesized
ggagaaaacatcttatgacc

SEQ ID NO: 490382 - DNA, 20 bp, Artificial Sequence
  chemically synthesized
gtagctcgataaatctcccc

SEQ ID NO: 490383 - DNA, 20 bp, Artificial Sequence
  chemically synthesized
tgacttctggggatgataaa

SEQ ID NO: 490384 - DNA, 20 bp, Artificial Sequence
  chemically synthesized
tgtctgggtacatgacttct

SEQ ID NO: 490385 - DNA, 20 bp, Artificial Sequence
  chemically synthesized
aggtgcttagaagttagtgt

SEQ ID NO: 490386 - DNA, 20 bp, Artificial Sequence
  chemically synthesized
gctagctctatgcccagcac

SEQ ID NO: 490387 - DNA, 20 bp, Artificial Sequence
  chemically synthesized
catatttatagagatgttgt

SEQ ID NO: 490388 - DNA, 20 bp, Artificial Sequence
  chemically synthesized
atgtactattatctttattt

SEQ ID NO: 490389 - DNA, 20 bp, Artificial Sequence
  chemically synthesized
ataaacctggcaactaaatg

SEQ ID NO: 490390 - DNA, 20 bp, Artificial Sequence
  chemically synthesized
tatactaggcagtagtaaat

SEQ ID NO: 490391 - DNA, 20 bp, Artificial Sequence
  chemically synthesized
agaaacaagctgtttttgtc

SEQ ID NO: 490392 - DNA, 20 bp, Artificial Sequence
  chemically synthesized
atgattgtttttttaatgat

SEQ ID NO: 490393 - DNA, 20 bp, Artificial Sequence
  chemically synthesized
attatattggctcataaagt

SEQ ID NO: 490394 - DNA, 20 bp, Artificial Sequence
  chemically synthesized
attttattagaattacatgt

SEQ ID NO: 490395 - DNA, 20 bp, Artificial Sequence
  chemically synthesized
cgtgggaccctggattttat

SEQ ID NO: 490396 - DNA, 20 bp, Artificial Sequence
  chemically synthesized
catgtaattctaataaaatc

SEQ ID NO: 490397 - DNA, 20 bp, Artificial Sequence
  chemically synthesized
aatatgggtcacgtgggacc

SEQ ID NO: 490398 - DNA, 20 bp, Artificial Sequence
  chemically synthesized
ggtgtaactctttaacgaat

SEQ ID NO: 490399 - DNA, 20 bp, Artificial Sequence
  chemically synthesized
cacgtgacccatattcgtta

SEQ ID NO: 490400 - DNA, 20 bp, Artificial Sequence
  chemically synthesized
tctgttggtgtaactcttta

SEQ ID NO: 490401 - DNA, 20 bp, Artificial Sequence
  chemically synthesized
gttaaagagttacaccaaca

SEQ ID NO: 490402 - DNA, 20 bp, Artificial Sequence
  chemically synthesized
gaatgttctgtaaattgtag

SEQ ID NO: 490403 - DNA, 20 bp, Artificial Sequence
  chemically synthesized
aggagaagaaatgaaagttc

SEQ ID NO: 490404 - DNA, 20 bp, Artificial Sequence
  chemically synthesized
gaaagattgtgaagaactgg

SEQ ID NO: 490405 - DNA, 20 bp, Artificial Sequence
  chemically synthesized
ggttgaaagattgtgaagaa

SEQ ID NO: 490406 - DNA, 20 bp, Artificial Sequence
  chemically synthesized
gtgaatgtggatacggtttc

SEQ ID NO: 490407 - DNA, 20 bp, Artificial Sequence
  chemically synthesized
taacaagagaatctgtgaat

SEQ ID NO: 490408 - DNA, 20 bp, Artificial Sequence
  chemically synthesized
taaagataacaagagaatct

SEQ ID NO: 490409 - DNA, 20 bp, Artificial Sequence
  chemically synthesized
ctaccccataaagataacaa

SEQ ID NO: 490410 - DNA, 20 bp, Artificial Sequence
  chemically synthesized
agattctcttgttatcttta

SEQ ID NO: 490411 - DNA, 20 bp, Artificial Sequence
  chemically synthesized
tttaaatggtgtggaatttg

SEQ ID NO: 490412 - DNA, 20 bp, Artificial Sequence
  chemically synthesized
cctataaattttaaatggtg

SEQ ID NO: 490413 - DNA, 20 bp, Artificial Sequence
  chemically synthesized
tccacaccatttaaaattta

SEQ ID NO: 490414 - DNA, 20 bp, Artificial Sequence
  chemically synthesized
caccatttaaaatttatagg

SEQ ID NO: 490415 - DNA, 20 bp, Artificial Sequence
  chemically synthesized
atttaaaatttataggatga

SEQ ID NO: 490416 - DNA, 20 bp, Artificial Sequence
  chemically synthesized
tgatatatatatatgcacca

SEQ ID NO: 490417 - DNA, 20 bp, Artificial Sequence
  chemically synthesized
ggatattattcagccataca

SEQ ID NO: 490418 - DNA, 20 bp, Artificial Sequence
  chemically synthesized
ggatttcaccctttgtatgg

SEQ ID NO: 490419 - DNA, 20 bp, Artificial Sequence
  chemically synthesized
atccacgttgctgcaaatga

SEQ ID NO: 490420 - DNA, 20 bp, Artificial Sequence
  chemically synthesized
atcctgtcatttgcagcaac

SEQ ID NO: 490421 - DNA, 20 bp, Artificial Sequence
  chemically synthesized
catgtttttagctcccacat

SEQ ID NO: 490422 - DNA, 20 bp, Artificial Sequence
  chemically synthesized
cacatgtgggagctaaaaac

SEQ ID NO: 490423 - DNA, 20 bp, Artificial Sequence
  chemically synthesized
ggttaccagagatcagaaat

SEQ ID NO: 490424 - DNA, 20 bp, Artificial Sequence
  chemically synthesized
catgagccaatgtgattggc

SEQ ID NO: 490425 - DNA, 20 bp, Artificial Sequence
  chemically synthesized
acctcagcctcccaaagtgc

SEQ ID NO: 490426 - DNA, 20 bp, Artificial Sequence
  chemically synthesized
ccgcactttgggaggctgag

SEQ ID NO: 490427 - DNA, 20 bp, Artificial Sequence
  chemically synthesized
actttgggaggctgaggtgg

SEQ ID NO: 490428 - DNA, 20 bp, Artificial Sequence
  chemically synthesized
tgggtggatcacttgacctc

SEQ ID NO: 490429 - DNA, 20 bp, Artificial Sequence
  chemically synthesized
ttttttttttttggtagagg

SEQ ID NO: 490430 - DNA, 20 bp, Artificial Sequence
  chemically synthesized
aaaaaaaaaaaaagaaatag

SEQ ID NO: 490431 - DNA, 20 bp, Artificial Sequence
  chemically synthesized
gatcctccaacctcagcctc

SEQ ID NO: 490432 - DNA, 20 bp, Artificial Sequence
  chemically synthesized
tactcaggaggctgaggttg

SEQ ID NO: 490433 - DNA, 20 bp, Artificial Sequence
  chemically synthesized
tcatgccactgcattccagc

SEQ ID NO: 490434 - DNA, 20 bp, Artificial Sequence
  chemically synthesized
tctggctctgtcactcaggc

SEQ ID NO: 490435 - DNA, 20 bp, Artificial Sequence
  chemically synthesized
atgaactttcttttttgaga

SEQ ID NO: 490436 - DNA, 20 bp, Artificial Sequence
  chemically synthesized
aaataatcataaatgtagtg

SEQ ID NO: 490437 - DNA, 20 bp, Artificial Sequence
  chemically synthesized
agggtagaacaaataagaaa

SEQ ID NO: 490438 - DNA, 20 bp, Artificial Sequence
  chemically synthesized
aaagcagctaatagtgacga

SEQ ID NO: 490439 - DNA, 20 bp, Artificial Sequence
  chemically synthesized
ataagggaaaaggcacagat

SEQ ID NO: 490440 - DNA, 20 bp, Artificial Sequence
  chemically synthesized
aaggctaaccaaagttatag

SEQ ID NO: 490441 - DNA, 20 bp, Artificial Sequence
  chemically synthesized
gtaatttgtaaaatggacat

SEQ ID NO: 490442 - DNA, 20 bp, Artificial Sequence
  chemically synthesized
atgctttgcttatgatctcg

SEQ ID NO: 490443 - DNA, 20 bp, Artificial Sequence
  chemically synthesized
tctatgaacaggactttgat

SEQ ID NO: 490444 - DNA, 20 bp, Artificial Sequence
  chemically synthesized
tcttatcaaagtcctgttca

SEQ ID NO: 490445 - DNA, 20 bp, Artificial Sequence
  chemically synthesized
gtaacttccaaatttatagt

SEQ ID NO: 490446 - DNA, 20 bp, Artificial Sequence
  chemically synthesized
caaatttatagtttgggtac

SEQ ID NO: 490447 - DNA, 20 bp, Artificial Sequence
  chemically synthesized
ttcctctcccaaaatctact

SEQ ID NO: 490448 - DNA, 20 bp, Artificial Sequence
  chemically synthesized
cccacagtagattttgggag

SEQ ID NO: 490449 - DNA, 20 bp, Artificial Sequence
  chemically synthesized
tgggagaggaatataacatg

SEQ ID NO: 490450 - DNA, 20 bp, Artificial Sequence
  chemically synthesized
ggaatataacatgttgagtt

SEQ ID NO: 490451 - DNA, 20 bp, Artificial Sequence
  chemically synthesized
ggcattcaaaatgtagtgga

SEQ ID NO: 490452 - DNA, 20 bp, Artificial Sequence
  chemically synthesized
atgatccattccactacatt

SEQ ID NO: 490453 - DNA, 20 bp, Artificial Sequence
  chemically synthesized
aatgggcattcaaaatgtag

SEQ ID NO: 490454 - DNA, 20 bp, Artificial Sequence
  chemically synthesized
ttgcagtttggcattgtcat

SEQ ID NO: 490455 - DNA, 20 bp, Artificial Sequence
  chemically synthesized
ttagcttgtatgtcattggc

SEQ ID NO: 490456 - DNA, 20 bp, Artificial Sequence
  chemically synthesized
cttccatgaagtccctttaa

SEQ ID NO: 490457 - DNA, 20 bp, Artificial Sequence
  chemically synthesized
gtgtaggaagtggacaaaaa

SEQ ID NO: 490458 - DNA, 20 bp, Artificial Sequence
  chemically synthesized
gctgatagtcatcttgatcc

SEQ ID NO: 490459 - DNA, 20 bp, Artificial Sequence
  chemically synthesized
ttggtgaggtccttacactc

SEQ ID NO: 490460 - DNA, 20 bp, Artificial Sequence
  chemically synthesized
tgagtgtaaggacctcacca

SEQ ID NO: 490461 - DNA, 20 bp, Artificial Sequence
  chemically synthesized
tggcagatctgtgagacaga

SEQ ID NO: 490462 - DNA, 20 bp, Artificial Sequence
  chemically synthesized
atctgtgagacagaagggat

SEQ ID NO: 490463 - DNA, 20 bp, Artificial Sequence
  chemically synthesized
tatattcatcttcttgtaga

SEQ ID NO: 490464 - DNA, 20 bp, Artificial Sequence
  chemically synthesized
cagattccttctacaagaag

SEQ ID NO: 490465 - DNA, 20 bp, Artificial Sequence
  chemically synthesized
aatatctagggagattaaaa

SEQ ID NO: 490466 - DNA, 20 bp, Artificial Sequence
  chemically synthesized
gtagctttcactgtatcaat

SEQ ID NO: 490467 - DNA, 20 bp, Artificial Sequence
  chemically synthesized
tgaaagctacatttgttgct

SEQ ID NO: 490468 - DNA, 20 bp, Artificial Sequence
  chemically synthesized
taacaatcagggaaaccgta

SEQ ID NO: 490469 - DNA, 20 bp, Artificial Sequence
  chemically synthesized
cgtatagaatgagaagaagg

SEQ ID NO: 490470 - DNA, 20 bp, Artificial Sequence
  chemically synthesized
aacatgtcctagagaaacat

SEQ ID NO: 490471 - DNA, 20 bp, Artificial Sequence
  chemically synthesized
tgtaaggggcaggtaaagca

SEQ ID NO: 490472 - DNA, 20 bp, Artificial Sequence
  chemically synthesized
ggagtgtcatcaatatagta

SEQ ID NO: 490473 - DNA, 20 bp, Artificial Sequence
  chemically synthesized
aaggaattacatagagaggt

SEQ ID NO: 490474 - DNA, 20 bp, Artificial Sequence
  chemically synthesized
ttccaagtcactaatcttat

SEQ ID NO: 490475 - DNA, 20 bp, Artificial Sequence
  chemically synthesized
cagttaatggcacatggcct

SEQ ID NO: 490476 - DNA, 20 bp, Artificial Sequence
  chemically synthesized
ataggactaagatatgtcca

SEQ ID NO: 490477 - DNA, 20 bp, Artificial Sequence
  chemically synthesized
aatggtttctgagcagtggt

SEQ ID NO: 490478 - DNA, 20 bp, Artificial Sequence
  chemically synthesized
gagagggaaatgtgataata

SEQ ID NO: 490479 - DNA, 20 bp, Artificial Sequence
  chemically synthesized
actatgaagaagattcaaat

SEQ ID NO: 490480 - DNA, 20 bp, Artificial Sequence
  chemically synthesized
tttcttgttattattcccat

SEQ ID NO: 490481 - DNA, 20 bp, Artificial Sequence
  chemically synthesized
atttgttaactttggttgcc

SEQ ID NO: 490482 - DNA, 20 bp, Artificial Sequence
  chemically synthesized
taactttggttgcccagaat

SEQ ID NO: 490483 - DNA, 20 bp, Artificial Sequence
  chemically synthesized
atcagattccatttgtattt

SEQ ID NO: 490484 - DNA, 20 bp, Artificial Sequence
  chemically synthesized
acaaaatccccaaatacaaa

SEQ ID NO: 490485 - DNA, 20 bp, Artificial Sequence
  chemically synthesized
tgatgggggaagttcagttt

SEQ ID NO: 490486 - DNA, 20 bp, Artificial Sequence
  chemically synthesized
ggaagttcagtttttgaatc

SEQ ID NO: 490487 - DNA, 20 bp, Artificial Sequence
  chemically synthesized
gttcagtttttgaatctgga

SEQ ID NO: 490488 - DNA, 20 bp, Artificial Sequence
  chemically synthesized
tttgaatctggaatgagtga

SEQ ID NO: 490489 - DNA, 20 bp, Artificial Sequence
  chemically synthesized
cagaattataaggcactatc

SEQ ID NO: 490490 - DNA, 20 bp, Artificial Sequence
  chemically synthesized
agaatgtcattgctactgga

SEQ ID NO: 490491 - DNA, 20 bp, Artificial Sequence
  chemically synthesized
accactgcagacactgggtg

SEQ ID NO: 490492 - DNA, 20 bp, Artificial Sequence
  chemically synthesized
ccactctaccactgcagaca

SEQ ID NO: 490493 - DNA, 20 bp, Artificial Sequence
  chemically synthesized
tcacccagtgtctgcagtgg

SEQ ID NO: 490494 - DNA, 20 bp, Artificial Sequence
  chemically synthesized
atcttagcctcccacagtgc

SEQ ID NO: 490495 - DNA, 20 bp, Artificial Sequence
  chemically synthesized
cagcactgtgggaggctaag

SEQ ID NO: 490496 - DNA, 20 bp, Artificial Sequence
  chemically synthesized
actgtgggaggctaagatga

SEQ ID NO: 490497 - DNA, 20 bp, Artificial Sequence
  chemically synthesized
ggctaagatgagtggatcgc

SEQ ID NO: 490498 - DNA, 20 bp, Artificial Sequence
  chemically synthesized
tgagtggatcgcttgagtcc

SEQ ID NO: 490499 - DNA, 20 bp, Artificial Sequence
  chemically synthesized
caagagttcgagatccaatc

SEQ ID NO: 490500 - DNA, 20 bp, Artificial Sequence
  chemically synthesized
agtccaaatcataccctaga

SEQ ID NO: 490501 - DNA, 20 bp, Artificial Sequence
  chemically synthesized
cttggagctgagcctctttt

SEQ ID NO: 490502 - DNA, 20 bp, Artificial Sequence
  chemically synthesized
ggttttctatccctttgttt

SEQ ID NO: 490503 - DNA, 20 bp, Artificial Sequence
  chemically synthesized
ctgttcccattcctaaacaa

SEQ ID NO: 490504 - DNA, 20 bp, Artificial Sequence
  chemically synthesized
tccgcttctatcaacaaaaa

SEQ ID NO: 490505 - DNA, 20 bp, Artificial Sequence
  chemically synthesized
acttgtcagagttcatagct

SEQ ID NO: 490506 - DNA, 20 bp, Artificial Sequence
  chemically synthesized
attcattccactgtacttgt

SEQ ID NO: 490507 - DNA, 20 bp, Artificial Sequence
  chemically synthesized
atgaactctgacaagtacag

SEQ ID NO: 490508 - DNA, 20 bp, Artificial Sequence
  chemically synthesized
actctgacaagtacagtgga

SEQ ID NO: 490509 - DNA, 20 bp, Artificial Sequence
  chemically synthesized
tggaatgaatgcatttggaa

SEQ ID NO: 490510 - DNA, 20 bp, Artificial Sequence
  chemically synthesized
atgcatttggaaaggaatgt

SEQ ID NO: 490511 - DNA, 20 bp, Artificial Sequence
  chemically synthesized
ctaaaaacattcacctgatc

SEQ ID NO: 490512 - DNA, 20 bp, Artificial Sequence
  chemically synthesized
gcctcactatccctgatcag

SEQ ID NO: 490513 - DNA, 20 bp, Artificial Sequence
  chemically synthesized
ggatagtgaggcagcagaaa

SEQ ID NO: 490514 - DNA, 20 bp, Artificial Sequence
  chemically synthesized
gtttgtgtgcattcaagaga

SEQ ID NO: 490515 - DNA, 20 bp, Artificial Sequence
  chemically synthesized
ccggttaattattctgtctc

SEQ ID NO: 490516 - DNA, 20 bp, Artificial Sequence
  chemically synthesized
agccttatctctcatttcag

SEQ ID NO: 490517 - DNA, 20 bp, Artificial Sequence
  chemically synthesized
atgagagataaggctttctg

SEQ ID NO: 490518 - DNA, 20 bp, Artificial Sequence
  chemically synthesized
taaggctttctgctgaatat

SEQ ID NO: 490519 - DNA, 20 bp, Artificial Sequence
  chemically synthesized
tatcatttaccattatgatg

SEQ ID NO: 490520 - DNA, 20 bp, Artificial Sequence
  chemically synthesized
ttttttctacaaaggttaat

SEQ ID NO: 490521 - DNA, 20 bp, Artificial Sequence
  chemically synthesized
atataattagtaaaacaaaa

SEQ ID NO: 490522 - DNA, 20 bp, Artificial Sequence
  chemically synthesized
accttggtttaatatagtta

SEQ ID NO: 490523 - DNA, 20 bp, Artificial Sequence
  chemically synthesized
aactatattaaaccaaggta

SEQ ID NO: 490524 - DNA, 20 bp, Artificial Sequence
  chemically synthesized
cacatttttctcttaggact

SEQ ID NO: 490525 - DNA, 20 bp, Artificial Sequence
  chemically synthesized
caaaggtaggacactcacct

SEQ ID NO: 490526 - DNA, 20 bp, Artificial Sequence
  chemically synthesized
aaggaatacactatcctcag

SEQ ID NO: 490527 - DNA, 20 bp, Artificial Sequence
  chemically synthesized
aggatagtgtattccttttt

SEQ ID NO: 490528 - DNA, 20 bp, Artificial Sequence
  chemically synthesized
aaatcataacactccaaaaa

SEQ ID NO: 490529 - DNA, 20 bp, Artificial Sequence
  chemically synthesized
ttacaaagttctttttatgt

SEQ ID NO: 490530 - DNA, 20 bp, Artificial Sequence
  chemically synthesized
tgtctcaaaggacaggcttt

SEQ ID NO: 490531 - DNA, 20 bp, Artificial Sequence
  chemically synthesized
ttccttgttgctgaagaaac

SEQ ID NO: 490532 - DNA, 20 bp, Artificial Sequence
  chemically synthesized
agcaacaaggaaaataaatg

SEQ ID NO: 490533 - DNA, 20 bp, Artificial Sequence
  chemically synthesized
cagtcttggtgcagctgctg

SEQ ID NO: 490534 - DNA, 20 bp, Artificial Sequence
  chemically synthesized
gcaataaccttaaagggaga

SEQ ID NO: 490535 - DNA, 20 bp, Artificial Sequence
  chemically synthesized
aatttacagcaacccaagta

SEQ ID NO: 490536 - DNA, 20 bp, Artificial Sequence
  chemically synthesized
gccccagtcagactccttac

SEQ ID NO: 490537 - DNA, 20 bp, Artificial Sequence
  chemically synthesized
atactgcaaatggtcaatac

SEQ ID NO: 490538 - DNA, 20 bp, Artificial Sequence
  chemically synthesized
agtatgaatacagcatttat

SEQ ID NO: 490539 - DNA, 20 bp, Artificial Sequence
  chemically synthesized
cccatatgtatatttaaagt

SEQ ID NO: 490540 - DNA, 20 bp, Artificial Sequence
  chemically synthesized
atgggcatctactctttccc

SEQ ID NO: 490541 - DNA, 20 bp, Artificial Sequence
  chemically synthesized
tatttggggcaccctaggga

SEQ ID NO: 490542 - DNA, 20 bp, Artificial Sequence
  chemically synthesized
catttcttatctgcaatctg

SEQ ID NO: 490543 - DNA, 20 bp, Artificial Sequence
  chemically synthesized
gggttgacaaacaaaatatt

SEQ ID NO: 490544 - DNA, 20 bp, Artificial Sequence
  chemically synthesized
tgtaaactatcacaaatcag

SEQ ID NO: 490545 - DNA, 20 bp, Artificial Sequence
  chemically synthesized
gggtgatctttatggggcca

SEQ ID NO: 490546 - DNA, 20 bp, Artificial Sequence
  chemically synthesized
gacaaatgaaccaaagtgat

SEQ ID NO: 490547 - DNA, 20 bp, Artificial Sequence
  chemically synthesized
attaagcactgctgtggaaa

SEQ ID NO: 490548 - DNA, 20 bp, Artificial Sequence
  chemically synthesized
taatggttaatgtgtactct

SEQ ID NO: 490549 - DNA, 20 bp, Artificial Sequence
  chemically synthesized
agtaaacaaaccagaattcc

SEQ ID NO: 490550 - DNA, 20 bp, Artificial Sequence
  chemically synthesized
ttgctaaccagtaaacaaac

SEQ ID NO: 490551 - DNA, 20 bp, Artificial Sequence
  chemically synthesized
ggtgatcagaaaacacgcat

SEQ ID NO: 490552 - DNA, 20 bp, Artificial Sequence
  chemically synthesized
cagacatacagagctcaact

SEQ ID NO: 490553 - DNA, 20 bp, Artificial Sequence
  chemically synthesized
ggaaatacaaaggagagtaa

SEQ ID NO: 490554 - DNA, 20 bp, Artificial Sequence
  chemically synthesized
tcaggataggaaatacaaag

SEQ ID NO: 490555 - DNA, 20 bp, Artificial Sequence
  chemically synthesized
ctgcatggaaggctgttagt

SEQ ID NO: 490556 - DNA, 20 bp, Artificial Sequence
  chemically synthesized
ccaagcaaaaaacctggaaa

SEQ ID NO: 490557 - DNA, 20 bp, Artificial Sequence
  chemically synthesized
acctggaaaagggatcatcc

SEQ ID NO: 490558 - DNA, 20 bp, Artificial Sequence
  chemically synthesized
ggggaatgaagggacaattc

SEQ ID NO: 490559 - DNA, 20 bp, Artificial Sequence
  chemically synthesized
taagtagatgggatgatgag

SEQ ID NO: 490560 - DNA, 20 bp, Artificial Sequence
  chemically synthesized
caatttagtcgttaagtaga

SEQ ID NO: 490561 - DNA, 20 bp, Artificial Sequence
  chemically synthesized
ccactttcatcaagtatttc

SEQ ID NO: 490562 - DNA, 20 bp, Artificial Sequence
  chemically synthesized
agttagagacaatgagtaag

SEQ ID NO: 490563 - DNA, 20 bp, Artificial Sequence
  chemically synthesized
ggtgactcaagttagagaca

SEQ ID NO: 490564 - DNA, 20 bp, Artificial Sequence
  chemically synthesized
gcttactcattgtctctaac

SEQ ID NO: 490565 - DNA, 20 bp, Artificial Sequence
  chemically synthesized
aaagagagtgaaactagtgg

SEQ ID NO: 490566 - DNA, 20 bp, Artificial Sequence
  chemically synthesized
tgagctcagagtgaaaaaaa

SEQ ID NO: 490567 - DNA, 20 bp, Artificial Sequence
  chemically synthesized
gtccctttgacagttgagct

SEQ ID NO: 490568 - DNA, 20 bp, Artificial Sequence
  chemically synthesized
caactgtcaaagggacatat

SEQ ID NO: 490569 - DNA, 20 bp, Artificial Sequence
  chemically synthesized
ttttttccagggtagaatat

SEQ ID NO: 490570 - DNA, 20 bp, Artificial Sequence
  chemically synthesized
tcaaagaattttttccaggg

SEQ ID NO: 490571 - DNA, 20 bp, Artificial Sequence
  chemically synthesized
aaatctcaaagaattttttc

SEQ ID NO: 490572 - DNA, 20 bp, Artificial Sequence
  chemically synthesized
atggaagatttgaaatctca

SEQ ID NO: 490573 - DNA, 20 bp, Artificial Sequence
  chemically synthesized
gtccccttatcaaacttgat

SEQ ID NO: 490574 - DNA, 20 bp, Artificial Sequence
  chemically synthesized
atcaaacttgattagggtaa

SEQ ID NO: 490575 - DNA, 20 bp, Artificial Sequence
  chemically synthesized
gaaaaatattgtaaaattgg

SEQ ID NO: 490576 - DNA, 20 bp, Artificial Sequence
  chemically synthesized
ttcaaacattttatttttct

SEQ ID NO: 490577 - DNA, 20 bp, Artificial Sequence
  chemically synthesized
ccataccaaatgagaagtaa

SEQ ID NO: 490578 - DNA, 20 bp, Artificial Sequence
  chemically synthesized
catttacttctcatttggta

SEQ ID NO: 490579 - DNA, 20 bp, Artificial Sequence
  chemically synthesized
atggggtccgagacttttcc

SEQ ID NO: 490580 - DNA, 20 bp, Artificial Sequence
  chemically synthesized
tgacttttagtttggtttct

SEQ ID NO: 490581 - DNA, 20 bp, Artificial Sequence
  chemically synthesized
gcaaaatacctccatttttt

SEQ ID NO: 490582 - DNA, 20 bp, Artificial Sequence
  chemically synthesized
ttaagattgggtatgaggga

SEQ ID NO: 490583 - DNA, 20 bp, Artificial Sequence
  chemically synthesized
actgtttaagattgggtatg

SEQ ID NO: 490584 - DNA, 20 bp, Artificial Sequence
  chemically synthesized
ggtaagacaactgtttaaga

SEQ ID NO: 490585 - DNA, 20 bp, Artificial Sequence
  chemically synthesized
aaaaaaaaaccacggtgctg

SEQ ID NO: 490586 - DNA, 20 bp, Artificial Sequence
  chemically synthesized
ttgcactccagcctgggtga

SEQ ID NO: 490587 - DNA, 20 bp, Artificial Sequence
  chemically synthesized
cctcactctgtcacccaggc

SEQ ID NO: 490588 - DNA, 20 bp, Artificial Sequence
  chemically synthesized
tcatgccattgcactccagc

SEQ ID NO: 490589 - DNA, 20 bp, Artificial Sequence
  chemically synthesized
ctcactgcaacctccgcctc

SEQ ID NO: 490590 - DNA, 20 bp, Artificial Sequence
  chemically synthesized
tacatgggagtctgaggtgg

SEQ ID NO: 490591 - DNA, 20 bp, Artificial Sequence
  chemically synthesized
gcctgtagtcccagctacat

SEQ ID NO: 490592 - DNA, 20 bp, Artificial Sequence
  chemically synthesized
atgggtggatcacctgaggt

SEQ ID NO: 490593 - DNA, 20 bp, Artificial Sequence
  chemically synthesized
actttgggaggccgagatgg

SEQ ID NO: 490594 - DNA, 20 bp, Artificial Sequence
  chemically synthesized
cagcactttgggaggccgag

SEQ ID NO: 490595 - DNA, 20 bp, Artificial Sequence
  chemically synthesized
atctcggcctcccaaagtgc

SEQ ID NO: 490596 - DNA, 20 bp, Artificial Sequence
  chemically synthesized
tggtttctatgaatactaaa

SEQ ID NO: 490597 - DNA, 20 bp, Artificial Sequence
  chemically synthesized
ataagagaattgtggtttct

SEQ ID NO: 490598 - DNA, 20 bp, Artificial Sequence
  chemically synthesized
aaatagaaatgaaaagataa

SEQ ID NO: 490599 - DNA, 20 bp, Artificial Sequence
  chemically synthesized
aataggacaattttaataat

SEQ ID NO: 490600 - DNA, 20 bp, Artificial Sequence
  chemically synthesized
taccttggctcccaccattt

SEQ ID NO: 490601 - DNA, 20 bp, Artificial Sequence
  chemically synthesized
ccaaggtacatggtaccaga

SEQ ID NO: 490602 - DNA, 20 bp, Artificial Sequence
  chemically synthesized
ttcccactccaaacctattg

SEQ ID NO: 490603 - DNA, 20 bp, Artificial Sequence
  chemically synthesized
ctaatatccatcaataggtt

SEQ ID NO: 490604 - DNA, 20 bp, Artificial Sequence
  chemically synthesized
tccatcaataggtttggagt

SEQ ID NO: 490605 - DNA, 20 bp, Artificial Sequence
  chemically synthesized
cagtttatatgtagaaaatg

SEQ ID NO: 490606 - DNA, 20 bp, Artificial Sequence
  chemically synthesized
tatgtagaaaatgaagagtt

SEQ ID NO: 490607 - DNA, 20 bp, Artificial Sequence
  chemically synthesized
aggatgagaagaggcaaatg

SEQ ID NO: 490608 - DNA, 20 bp, Artificial Sequence
  chemically synthesized
gatctctgggatgggtctta

SEQ ID NO: 490609 - DNA, 20 bp, Artificial Sequence
  chemically synthesized
tagggaacgtgatctctggg

SEQ ID NO: 490610 - DNA, 20 bp, Artificial Sequence
  chemically synthesized
ttgttagggaacgtgatctc

SEQ ID NO: 490611 - DNA, 20 bp, Artificial Sequence
  chemically synthesized
ctgggaaagtaggagttagg

SEQ ID NO: 490612 - DNA, 20 bp, Artificial Sequence
  chemically synthesized
ctttatgtgcctgggaaagt

SEQ ID NO: 490613 - DNA, 20 bp, Artificial Sequence
  chemically synthesized
cactgtgtggagatatacaa

SEQ ID NO: 490614 - DNA, 20 bp, Artificial Sequence
  chemically synthesized
tttttcatagtcttttgatg

SEQ ID NO: 490615 - DNA, 20 bp, Artificial Sequence
  chemically synthesized
tagtcttttgatgaagaatt

SEQ ID NO: 490616 - DNA, 20 bp, Artificial Sequence
  chemically synthesized
aatgcccttgaaagcttttc

SEQ ID NO: 490617 - DNA, 20 bp, Artificial Sequence
  chemically synthesized
cagcttttccattgacacct

SEQ ID NO: 490618 - DNA, 20 bp, Artificial Sequence
  chemically synthesized
ctatttttagattgatcaga

SEQ ID NO: 490619 - DNA, 20 bp, Artificial Sequence
  chemically synthesized
aaaaatagctctttggtgat

SEQ ID NO: 490620 - DNA, 20 bp, Artificial Sequence
  chemically synthesized
aaacatcttgtggctatatg

SEQ ID NO: 490621 - DNA, 20 bp, Artificial Sequence
  chemically synthesized
agcaggaattagccctgaaa

SEQ ID NO: 490622 - DNA, 20 bp, Artificial Sequence
  chemically synthesized
accttttaagtgaattaagc

SEQ ID NO: 490623 - DNA, 20 bp, Artificial Sequence
  chemically synthesized
tctcaactaataccttttaa

SEQ ID NO: 490624 - DNA, 20 bp, Artificial Sequence
  chemically synthesized
ggtattagttgagatacagt

SEQ ID NO: 490625 - DNA, 20 bp, Artificial Sequence
  chemically synthesized
tagttgagatacagtgagag

SEQ ID NO: 490626 - DNA, 20 bp, Artificial Sequence
  chemically synthesized
taaacaaatgtacaaaatgt

SEQ ID NO: 490627 - DNA, 20 bp, Artificial Sequence
  chemically synthesized
cttaaatgtactaaattctg

SEQ ID NO: 490628 - DNA, 20 bp, Artificial Sequence
  chemically synthesized
ataatattttaggtattctt

SEQ ID NO: 490629 - DNA, 20 bp, Artificial Sequence
  chemically synthesized
tctagtcttaaaaaaatgga

SEQ ID NO: 490630 - DNA, 20 bp, Artificial Sequence
  chemically synthesized
tccatttttttaagactaga

SEQ ID NO: 490631 - DNA, 20 bp, Artificial Sequence
  chemically synthesized
aagggatcaaggtcaatttc

SEQ ID NO: 490632 - DNA, 20 bp, Artificial Sequence
  chemically synthesized
tatcatgttatcacatttcc

SEQ ID NO: 490633 - DNA, 20 bp, Artificial Sequence
  chemically synthesized
atttaaatcttcagtttaat

SEQ ID NO: 490634 - DNA, 20 bp, Artificial Sequence
  chemically synthesized
atcttcagtttaatctgaat

SEQ ID NO: 490635 - DNA, 20 bp, Artificial Sequence
  chemically synthesized
actttcttaatttaaatcgt

SEQ ID NO: 490636 - DNA, 20 bp, Artificial Sequence
  chemically synthesized
caggctttctggtaagtact

SEQ ID NO: 490637 - DNA, 20 bp, Artificial Sequence
  chemically synthesized
ggttatagagataacaataa

SEQ ID NO: 490638 - DNA, 20 bp, Artificial Sequence
  chemically synthesized
atatatacatacaatattac

SEQ ID NO: 490639 - DNA, 20 bp, Artificial Sequence
  chemically synthesized
aaggggcaagaaaaccttaa

SEQ ID NO: 490640 - DNA, 20 bp, Artificial Sequence
  chemically synthesized
tcttaactgctattacctca

SEQ ID NO: 490641 - DNA, 20 bp, Artificial Sequence
  chemically synthesized
ttgaggtaatagcagttaag

SEQ ID NO: 490642 - DNA, 20 bp, Artificial Sequence
  chemically synthesized
agcagttaagatgagtctta

SEQ ID NO: 490643 - DNA, 20 bp, Artificial Sequence
  chemically synthesized
ggaaaaaaaataaggggaaa

SEQ ID NO: 490644 - DNA, 20 bp, Artificial Sequence
  chemically synthesized
aaaaaaaccgcttcctttgg

SEQ ID NO: 490645 - DNA, 20 bp, Artificial Sequence
  chemically synthesized
ttctgtttatgtctgaagct

SEQ ID NO: 490646 - DNA, 20 bp, Artificial Sequence
  chemically synthesized
atagtggaaattatgaaaaa

SEQ ID NO: 490647 - DNA, 20 bp, Artificial Sequence
  chemically synthesized
agtagcaaaagaattgaaca

SEQ ID NO: 490648 - DNA, 20 bp, Artificial Sequence
  chemically synthesized
atggccacacgtagtagcaa

SEQ ID NO: 490649 - DNA, 20 bp, Artificial Sequence
  chemically synthesized
gaaattgcaagtgtatacca

SEQ ID NO: 490650 - DNA, 20 bp, Artificial Sequence
  chemically synthesized
tttatcccagttttgtccat

SEQ ID NO: 490651 - DNA, 20 bp, Artificial Sequence
  chemically synthesized
agaatcctgatggacaaaac

SEQ ID NO: 490652 - DNA, 20 bp, Artificial Sequence
  chemically synthesized
aaataatgcaaaatctgatc

SEQ ID NO: 490653 - DNA, 20 bp, Artificial Sequence
  chemically synthesized
gcagtcccgcagtctgcctc

SEQ ID NO: 490654 - DNA, 20 bp, Artificial Sequence
  chemically synthesized
cagccagcaagtatttgaac

SEQ ID NO: 490655 - DNA, 20 bp, Artificial Sequence
  chemically synthesized
tggctgtgcaatcttgggca

SEQ ID NO: 490656 - DNA, 20 bp, Artificial Sequence
  chemically synthesized
ccctcctgtaaaattaaaag

SEQ ID NO: 490657 - DNA, 20 bp, Artificial Sequence
  chemically synthesized
ggagaatagcaactatttca

SEQ ID NO: 490658 - DNA, 20 bp, Artificial Sequence
  chemically synthesized
ctttgtatgatgatgacggt

SEQ ID NO: 490659 - DNA, 20 bp, Artificial Sequence
  chemically synthesized
aaagtttgagaagcattgcc

SEQ ID NO: 490660 - DNA, 20 bp, Artificial Sequence
  chemically synthesized
tctcaaactttaatgtgccc

SEQ ID NO: 490661 - DNA, 20 bp, Artificial Sequence
  chemically synthesized
ctgggagttgctaagaaatg

SEQ ID NO: 490662 - DNA, 20 bp, Artificial Sequence
  chemically synthesized
ccagagcacagacatcacct

SEQ ID NO: 490663 - DNA, 20 bp, Artificial Sequence
  chemically synthesized
tctggaccagagaccacact

SEQ ID NO: 490664 - DNA, 20 bp, Artificial Sequence
  chemically synthesized
cttggcaccatcacctacaa

SEQ ID NO: 490665 - DNA, 20 bp, Artificial Sequence
  chemically synthesized
tgccaagagaaaatatagta

SEQ ID NO: 490666 - DNA, 20 bp, Artificial Sequence
  chemically synthesized
acctcattttttaaaaaaat

SEQ ID NO: 490667 - DNA, 20 bp, Artificial Sequence
  chemically synthesized
gcaaaaatactgcatgcatt

SEQ ID NO: 490668 - DNA, 20 bp, Artificial Sequence
  chemically synthesized
gagtacccacaggctgaatc

SEQ ID NO: 490669 - DNA, 20 bp, Artificial Sequence
  chemically synthesized
atgcattcaggattcagcct

SEQ ID NO: 490670 - DNA, 20 bp, Artificial Sequence
  chemically synthesized
ggaaactgagtacccacagg

SEQ ID NO: 490671 - DNA, 20 bp, Artificial Sequence
  chemically synthesized
tccagcccagagtttggaaa

SEQ ID NO: 490672 - DNA, 20 bp, Artificial Sequence
  chemically synthesized
ctcagtttccaaactctggg

SEQ ID NO: 490673 - DNA, 20 bp, Artificial Sequence
  chemically synthesized
ccttgactctccatccagcc

SEQ ID NO: 490674 - DNA, 20 bp, Artificial Sequence
  chemically synthesized
tccaaactctgggctggatg

SEQ ID NO: 490675 - DNA, 20 bp, Artificial Sequence
  chemically synthesized
caatgagaaaaaaaggaagt

SEQ ID NO: 490676 - DNA, 20 bp, Artificial Sequence
  chemically synthesized
acacattcacattttgcccc

SEQ ID NO: 490677 - DNA, 20 bp, Artificial Sequence
  chemically synthesized
acagatcctgggggcaaaat

SEQ ID NO: 490678 - DNA, 20 bp, Artificial Sequence
  chemically synthesized
ggcttgtagcactggttcac

SEQ ID NO: 490679 - DNA, 20 bp, Artificial Sequence
  chemically synthesized
cactggttcacacggatata

SEQ ID NO: 490680 - DNA, 20 bp, Artificial Sequence
  chemically synthesized
cacacactgtaaagagccat

SEQ ID NO: 490681 - DNA, 20 bp, Artificial Sequence
  chemically synthesized
ttatttcctacaaattaaaa

SEQ ID NO: 490682 - DNA, 20 bp, Artificial Sequence
  chemically synthesized
tggttgaaagctatttggtt

SEQ ID NO: 490683 - DNA, 20 bp, Artificial Sequence
  chemically synthesized
gaaagctatttggttggggg

SEQ ID NO: 490684 - DNA, 20 bp, Artificial Sequence
  chemically synthesized
tatttggttgggggtggggt

SEQ ID NO: 490685 - DNA, 20 bp, Artificial Sequence
  chemically synthesized
aaggaagcgcatagagcaat

SEQ ID NO: 490686 - DNA, 20 bp, Artificial Sequence
  chemically synthesized
gaccaaccaggcctacttta

SEQ ID NO: 490687 - DNA, 20 bp, Artificial Sequence
  chemically synthesized
ttcttcctttaagtacattt

SEQ ID NO: 490688 - DNA, 20 bp, Artificial Sequence
  chemically synthesized
atactagtacattttggttt

SEQ ID NO: 490689 - DNA, 20 bp, Artificial Sequence
  chemically synthesized
tcctttaaacctctctactt

SEQ ID NO: 490690 - DNA, 20 bp, Artificial Sequence
  chemically synthesized
tcagaagtagagaggtttaa

SEQ ID NO: 490691 - DNA, 20 bp, Artificial Sequence
  chemically synthesized
gattcttgacaaatctcttt

SEQ ID NO: 490692 - DNA, 20 bp, Artificial Sequence
  chemically synthesized
tattctgaaagagatttgtc

SEQ ID NO: 490693 - DNA, 20 bp, Artificial Sequence
  chemically synthesized
gggtagtagccccttctcaa

SEQ ID NO: 490694 - DNA, 20 bp, Artificial Sequence
  chemically synthesized
tagtacgtagaaacgtacat

SEQ ID NO: 490695 - DNA, 20 bp, Artificial Sequence
  chemically synthesized
aactctggttacttttagag

SEQ ID NO: 490696 - DNA, 20 bp, Artificial Sequence
  chemically synthesized
tattcacctctaaaagtaac

SEQ ID NO: 490697 - DNA, 20 bp, Artificial Sequence
  chemically synthesized
accagagttccttgaaaaaa

SEQ ID NO: 490698 - DNA, 20 bp, Artificial Sequence
  chemically synthesized
aaaatgggtaattctaaatc

SEQ ID NO: 490699 - DNA, 20 bp, Artificial Sequence
  chemically synthesized
gactttgcctatcccagatt

SEQ ID NO: 490700 - DNA, 20 bp, Artificial Sequence
  chemically synthesized
ttgagcaggaagctctgggc

SEQ ID NO: 490701 - DNA, 20 bp, Artificial Sequence
  chemically synthesized
tatttattcaatatattatt

SEQ ID NO: 490702 - DNA, 20 bp, Artificial Sequence
  chemically synthesized
ctgtaattcataataatata

SEQ ID NO: 490703 - DNA, 20 bp, Artificial Sequence
  chemically synthesized
tattgaataaataaaaattt

SEQ ID NO: 490704 - DNA, 20 bp, Artificial Sequence
  chemically synthesized
tgcaagccccagtgtaataa

SEQ ID NO: 490705 - DNA, 20 bp, Artificial Sequence
  chemically synthesized
gtgtaataactgagttaggg

SEQ ID NO: 490706 - DNA, 20 bp, Artificial Sequence
  chemically synthesized
gagttagggaaggatcatca

SEQ ID NO: 490707 - DNA, 20 bp, Artificial Sequence
  chemically synthesized
gcatgtcaaacatgtttggc

SEQ ID NO: 490708 - DNA, 20 bp, Artificial Sequence
  chemically synthesized
tttaacttgttctgtagtct

SEQ ID NO: 490709 - DNA, 20 bp, Artificial Sequence
  chemically synthesized
ttttattttttttcccctga

SEQ ID NO: 490710 - DNA, 20 bp, Artificial Sequence
  chemically synthesized
tcaaaaaatgtctcatcttt

SEQ ID NO: 490711 - DNA, 20 bp, Artificial Sequence
  chemically synthesized
aagggctattttagactaag

SEQ ID NO: 490712 - DNA, 20 bp, Artificial Sequence
  chemically synthesized
atgtcttttatattttgcag

SEQ ID NO: 490713 - DNA, 20 bp, Artificial Sequence
  chemically synthesized
ttttgaactattaaggaaat

SEQ ID NO: 490714 - DNA, 20 bp, Artificial Sequence
  chemically synthesized
ctattaaggaaatatgaata

SEQ ID NO: 490715 - DNA, 20 bp, Artificial Sequence
  chemically synthesized
taaggaaatatgaatatgga

SEQ ID NO: 490716 - DNA, 20 bp, Artificial Sequence
  chemically synthesized
gtatttcaaagcgacacatg

SEQ ID NO: 490717 - DNA, 20 bp, Artificial Sequence
  chemically synthesized
cgacacatgctgaattattt

SEQ ID NO: 490718 - DNA, 20 bp, Artificial Sequence
  chemically synthesized
atatatgagagatacagaaa

SEQ ID NO: 490719 - DNA, 20 bp, Artificial Sequence
  chemically synthesized
tgttaacaattgttgactct

SEQ ID NO: 490720 - DNA, 20 bp, Artificial Sequence
  chemically synthesized
ttttcctccccctaaattct

SEQ ID NO: 490721 - DNA, 20 bp, Artificial Sequence
  chemically synthesized
ttaccttaatgaaaataatt

SEQ ID NO: 490722 - DNA, 20 bp, Artificial Sequence
  chemically synthesized
tattctactaatatgcatta

SEQ ID NO: 490723 - DNA, 20 bp, Artificial Sequence
  chemically synthesized
tattccttaatgcatattag

SEQ ID NO: 490724 - DNA, 20 bp, Artificial Sequence
  chemically synthesized
taattgccttatctgtgata

SEQ ID NO: 490725 - DNA, 20 bp, Artificial Sequence
  chemically synthesized
cagacttgtctaaaagaaga

SEQ ID NO: 490726 - DNA, 20 bp, Artificial Sequence
  chemically synthesized
aaatcttaattattattgct

SEQ ID NO: 490727 - DNA, 20 bp, Artificial Sequence
  chemically synthesized
attcctaaattgaggaacct

SEQ ID NO: 490728 - DNA, 20 bp, Artificial Sequence
  chemically synthesized
attcagaggttcctcaattt

SEQ ID NO: 490729 - DNA, 20 bp, Artificial Sequence
  chemically synthesized
ggaagcaaggcagtgggaag

SEQ ID NO: 490730 - DNA, 20 bp, Artificial Sequence
  chemically synthesized
taatgtcagttgataaaagt

SEQ ID NO: 490731 - DNA, 20 bp, Artificial Sequence
  chemically synthesized
ataatgaagaggattttact

SEQ ID NO: 490732 - DNA, 20 bp, Artificial Sequence
  chemically synthesized
attgctgacaacataatgaa

SEQ ID NO: 490733 - DNA, 20 bp, Artificial Sequence
  chemically synthesized
gggagccaggccttcaagca

SEQ ID NO: 490734 - DNA, 20 bp, Artificial Sequence
  chemically synthesized
aggagaagacataccagtcg

SEQ ID NO: 490735 - DNA, 20 bp, Artificial Sequence
  chemically synthesized
tcgactggtatgtcttctcc

SEQ ID NO: 490736 - DNA, 20 bp, Artificial Sequence
  chemically synthesized
ctagaatactccagaagaaa

SEQ ID NO: 490737 - DNA, 20 bp, Artificial Sequence
  chemically synthesized
ttcatacactccttttcttc

SEQ ID NO: 490738 - DNA, 20 bp, Artificial Sequence
  chemically synthesized
tgactgaaaccatagtaaat

SEQ ID NO: 490739 - DNA, 20 bp, Artificial Sequence
  chemically synthesized
cagctgtctgtttatctgcc

SEQ ID NO: 490740 - DNA, 20 bp, Artificial Sequence
  chemically synthesized
cagataaacagacagctggc

SEQ ID NO: 490741 - DNA, 20 bp, Artificial Sequence
  chemically synthesized
tgttgaagcctgacattcct

SEQ ID NO: 490742 - DNA, 20 bp, Artificial Sequence
  chemically synthesized
ggctttaaaacattattctg

SEQ ID NO: 490743 - DNA, 20 bp, Artificial Sequence
  chemically synthesized
agtacttattatatgtgcta

SEQ ID NO: 490744 - DNA, 20 bp, Artificial Sequence
  chemically synthesized
tgcctactttcaaaatgaaa

SEQ ID NO: 490745 - DNA, 20 bp, Artificial Sequence
  chemically synthesized
aagtctttaagcaagcgtcc

SEQ ID NO: 490746 - DNA, 20 bp, Artificial Sequence
  chemically synthesized
taggcttaagcatgataata

SEQ ID NO: 490747 - DNA, 20 bp, Artificial Sequence
  chemically synthesized
tcaattatgtaacagaagaa

SEQ ID NO: 490748 - DNA, 20 bp, Artificial Sequence
  chemically synthesized
gttacataattgaagctgta

SEQ ID NO: 490749 - DNA, 20 bp, Artificial Sequence
  chemically synthesized
tccaacatagactaaccttc

SEQ ID NO: 490750 - DNA, 20 bp, Artificial Sequence
  chemically synthesized
gctccatatagacatctagc

SEQ ID NO: 490751 - DNA, 20 bp, Artificial Sequence
  chemically synthesized
cgaagactactgttgttaag

SEQ ID NO: 490752 - DNA, 20 bp, Artificial Sequence
  chemically synthesized
aacgcaagcagatgttagaa

SEQ ID NO: 490753 - DNA, 20 bp, Artificial Sequence
  chemically synthesized
acatctgcttgcgttgcact

SEQ ID NO: 490754 - DNA, 20 bp, Artificial Sequence
  chemically synthesized
aattaataaaataatatttt

SEQ ID NO: 490755 - DNA, 20 bp, Artificial Sequence
  chemically synthesized
aatttttacttgatttgcta

SEQ ID NO: 490756 - DNA, 20 bp, Artificial Sequence
  chemically synthesized
ctggatgcttagaaatagct

SEQ ID NO: 490757 - DNA, 20 bp, Artificial Sequence
  chemically synthesized
acttttgtggcatacttcct

SEQ ID NO: 490758 - DNA, 20 bp, Artificial Sequence
  chemically synthesized
aaaagtcaagttcagcttcc

SEQ ID NO: 490759 - DNA, 20 bp, Artificial Sequence
  chemically synthesized
attttaagttaattacagct

SEQ ID NO: 490760 - DNA, 20 bp, Artificial Sequence
  chemically synthesized
atttgtatactatttcacaa

SEQ ID NO: 490761 - DNA, 20 bp, Artificial Sequence
  chemically synthesized
acaagattttgaaaattcag

SEQ ID NO: 490762 - DNA, 20 bp, Artificial Sequence
  chemically synthesized
ttttgaaaattcaggtgaat

SEQ ID NO: 490763 - DNA, 20 bp, Artificial Sequence
  chemically synthesized
ctctgataactctaattcac

SEQ ID NO: 490764 - DNA, 20 bp, Artificial Sequence
  chemically synthesized
ggtgaattagagttatcaga

SEQ ID NO: 490765 - DNA, 20 bp, Artificial Sequence
  chemically synthesized
ttactcatatagtatttgaa

SEQ ID NO: 490766 - DNA, 20 bp, Artificial Sequence
  chemically synthesized
acactctattcaaatactat

SEQ ID NO: 490767 - DNA, 20 bp, Artificial Sequence
  chemically synthesized
atgtcttactcatatagtat

SEQ ID NO: 490768 - DNA, 20 bp, Artificial Sequence
  chemically synthesized
cagtcgatttaatccacttt

SEQ ID NO: 490769 - DNA, 20 bp, Artificial Sequence
  chemically synthesized
atacggagagaattcataaa

SEQ ID NO: 490770 - DNA, 20 bp, Artificial Sequence
  chemically synthesized
tataaatatatatatacgga

SEQ ID NO: 490771 - DNA, 20 bp, Artificial Sequence
  chemically synthesized
aaatgagaaaattaaaaaaa

SEQ ID NO: 490772 - DNA, 20 bp, Artificial Sequence
  chemically synthesized
tcatttcttaccatcttaat

SEQ ID NO: 490773 - DNA, 20 bp, Artificial Sequence
  chemically synthesized
aatacttgtatgattaagag

SEQ ID NO: 490774 - DNA, 20 bp, Artificial Sequence
  chemically synthesized
tagcctcatcaaaagatatt

SEQ ID NO: 490775 - DNA, 20 bp, Artificial Sequence
  chemically synthesized
cacaccccttgccaaagtta

SEQ ID NO: 490776 - DNA, 20 bp, Artificial Sequence
  chemically synthesized
ataattctttaactttggca

SEQ ID NO: 490777 - DNA, 20 bp, Artificial Sequence
  chemically synthesized
gtgtttattttgtacaaaat

SEQ ID NO: 490778 - DNA, 20 bp, Artificial Sequence
  chemically synthesized
atatgaattgtatctacttt

SEQ ID NO: 490779 - DNA, 20 bp, Artificial Sequence
  chemically synthesized
tactttctgaataatgtaac

SEQ ID NO: 490780 - DNA, 20 bp, Artificial Sequence
  chemically synthesized
atgtattaaaaagaagattt

SEQ ID NO: 490781 - DNA, 20 bp, Artificial Sequence
  chemically synthesized
ttaacgaaagatattcatca

SEQ ID NO: 490782 - DNA, 20 bp, Artificial Sequence
  chemically synthesized
gaagctagaacaactcattg

SEQ ID NO: 490783 - DNA, 20 bp, Artificial Sequence
  chemically synthesized
caatgagttgttctagcttc

SEQ ID NO: 490784 - DNA, 20 bp, Artificial Sequence
  chemically synthesized
tattaaaatccacctattat

SEQ ID NO: 490785 - DNA, 20 bp, Artificial Sequence
  chemically synthesized
acccatcatccacataatag

SEQ ID NO: 490786 - DNA, 20 bp, Artificial Sequence
  chemically synthesized
atccacctattatgtggatg

SEQ ID NO: 490787 - DNA, 20 bp, Artificial Sequence
  chemically synthesized
cctattatgtggatgatggg

SEQ ID NO: 490788 - DNA, 20 bp, Artificial Sequence
  chemically synthesized
aagcctagagagtttataaa

SEQ ID NO: 490789 - DNA, 20 bp, Artificial Sequence
  chemically synthesized
tgctgcagttggaaagccta

SEQ ID NO: 490790 - DNA, 20 bp, Artificial Sequence
  chemically synthesized
atcatcatttaaatttccct

SEQ ID NO: 490791 - DNA, 20 bp, Artificial Sequence
  chemically synthesized
aagggaaatttaaatgatga

SEQ ID NO: 490792 - DNA, 20 bp, Artificial Sequence
  chemically synthesized
tttggctcaagttccccttc

SEQ ID NO: 490793 - DNA, 20 bp, Artificial Sequence
  chemically synthesized
cctctagtttcaccacattt

SEQ ID NO: 490794 - DNA, 20 bp, Artificial Sequence
  chemically synthesized
gcttagttttaaaaatagct

SEQ ID NO: 490795 - DNA, 20 bp, Artificial Sequence
  chemically synthesized
tatattttaacttcaacaag

SEQ ID NO: 490796 - DNA, 20 bp, Artificial Sequence
  chemically synthesized
tcacccatgattgcttaaag

SEQ ID NO: 490797 - DNA, 20 bp, Artificial Sequence
  chemically synthesized
atattcacctttaagcaatc

SEQ ID NO: 490798 - DNA, 20 bp, Artificial Sequence
  chemically synthesized
atttcatgagagattataag

SEQ ID NO: 490799 - DNA, 20 bp, Artificial Sequence
  chemically synthesized
actttttaagctttctttag

SEQ ID NO: 490800 - DNA, 20 bp, Artificial Sequence
  chemically synthesized
ggtagggcgacagatctaat

SEQ ID NO: 490801 - DNA, 20 bp, Artificial Sequence
  chemically synthesized
tacaggaaaaattgggaagc

SEQ ID NO: 490802 - DNA, 20 bp, Artificial Sequence
  chemically synthesized
aggcttcccaatttttcctg

SEQ ID NO: 490803 - DNA, 20 bp, Artificial Sequence
  chemically synthesized
gaatactggcatctgttttt

SEQ ID NO: 490804 - DNA, 20 bp, Artificial Sequence
  chemically synthesized
gcatctgtttttgaggattg

SEQ ID NO: 490805 - DNA, 20 bp, Artificial Sequence
  chemically synthesized
ggcaaactgttgtcagaaca

SEQ ID NO: 490806 - DNA, 20 bp, Artificial Sequence
  chemically synthesized
gccgctgcccaatgccatcc

SEQ ID NO: 490807 - DNA, 20 bp, Artificial Sequence
  chemically synthesized
ttggtatcttacaggaactc

SEQ ID NO: 490808 - DNA, 20 bp, Artificial Sequence
  chemically synthesized
aactgacatgcccatatcca

SEQ ID NO: 490809 - DNA, 20 bp, Artificial Sequence
  chemically synthesized
gtctttctgtcttgtatcct

SEQ ID NO: 490810 - DNA, 20 bp, Artificial Sequence
  chemically synthesized
taaaaactggagctaaccga

SEQ ID NO: 490811 - DNA, 20 bp, Artificial Sequence
  chemically synthesized
ttttgtaagcttgtcagcta

SEQ ID NO: 490812 - DNA, 20 bp, Artificial Sequence
  chemically synthesized
atccttgtggggacaagaaa

SEQ ID NO: 490813 - DNA, 20 bp, Artificial Sequence
  chemically synthesized
attcgatttcttgtccccac

SEQ ID NO: 490814 - DNA, 20 bp, Artificial Sequence
  chemically synthesized
tttaaacatgaacaaagtat

SEQ ID NO: 490815 - DNA, 20 bp, Artificial Sequence
  chemically synthesized
atttgggtttcttagtgatc

SEQ ID NO: 490816 - DNA, 20 bp, Artificial Sequence
  chemically synthesized
taattttatttaaatatctc

SEQ ID NO: 490817 - DNA, 20 bp, Artificial Sequence
  chemically synthesized
tgacgcagacagaatttgaa

SEQ ID NO: 490818 - DNA, 20 bp, Artificial Sequence
  chemically synthesized
gcaaaatacattgacgcaga

SEQ ID NO: 490819 - DNA, 20 bp, Artificial Sequence
  chemically synthesized
attagaagccacaaaaaact

SEQ ID NO: 490820 - DNA, 20 bp, Artificial Sequence
  chemically synthesized
gtagcttagggatatcttga

SEQ ID NO: 490821 - DNA, 20 bp, Artificial Sequence
  chemically synthesized
aaaatttattactgtagctt

SEQ ID NO: 490822 - DNA, 20 bp, Artificial Sequence
  chemically synthesized
aaatattgtttacttttttc

SEQ ID NO: 490823 - DNA, 20 bp, Artificial Sequence
  chemically synthesized
tttttcctgaatgaaatttt

SEQ ID NO: 490824 - DNA, 20 bp, Artificial Sequence
  chemically synthesized
aaaatagctcaattgaaaag

SEQ ID NO: 490825 - DNA, 20 bp, Artificial Sequence
  chemically synthesized
actttttaaaaaagataatc

SEQ ID NO: 490826 - DNA, 20 bp, Artificial Sequence
  chemically synthesized
ggtacctaccgtatttaaat

SEQ ID NO: 490827 - DNA, 20 bp, Artificial Sequence
  chemically synthesized
tctgtcagtgacataaggat

SEQ ID NO: 490828 - DNA, 20 bp, Artificial Sequence
  chemically synthesized
cattattctgtcagtgacat

SEQ ID NO: 490829 - DNA, 20 bp, Artificial Sequence
  chemically synthesized
tcaaatccttatgtcactga

SEQ ID NO: 490830 - DNA, 20 bp, Artificial Sequence
  chemically synthesized
atatgaatcacatctattag

SEQ ID NO: 490831 - DNA, 20 bp, Artificial Sequence
  chemically synthesized
atacaaaaatattagagaat

SEQ ID NO: 490832 - DNA, 20 bp, Artificial Sequence
  chemically synthesized
aggagaatacaaaaatatta

SEQ ID NO: 490833 - DNA, 20 bp, Artificial Sequence
  chemically synthesized
gctattgtgtcaaggagtag

SEQ ID NO: 490834 - DNA, 20 bp, Artificial Sequence
  chemically synthesized
gtcagcttgctattgtgtca

SEQ ID NO: 490835 - DNA, 20 bp, Artificial Sequence
  chemically synthesized
ttcatttaggaagcatgtac

SEQ ID NO: 490836 - DNA, 20 bp, Artificial Sequence
  chemically synthesized
catgcttcctaaatgaagga

SEQ ID NO: 490837 - DNA, 20 bp, Artificial Sequence
  chemically synthesized
ccaagaaatgtatgtgaaac

SEQ ID NO: 490838 - DNA, 20 bp, Artificial Sequence
  chemically synthesized
gtattcgaaaataattttgc

SEQ ID NO: 490839 - DNA, 20 bp, Artificial Sequence
  chemically synthesized
acattcaagcaaaattattt

SEQ ID NO: 490840 - DNA, 20 bp, Artificial Sequence
  chemically synthesized
gtcaccggtttgctgattta

SEQ ID NO: 490841 - DNA, 20 bp, Artificial Sequence
  chemically synthesized
cggtgacacggtgcctcaca

SEQ ID NO: 490842 - DNA, 20 bp, Artificial Sequence
  chemically synthesized
gagtatggccaggacagctt

SEQ ID NO: 490843 - DNA, 20 bp, Artificial Sequence
  chemically synthesized
gctgtcctggccatactctc

SEQ ID NO: 490844 - DNA, 20 bp, Artificial Sequence
  chemically synthesized
cacatctcatgggcattcaa

SEQ ID NO: 490845 - DNA, 20 bp, Artificial Sequence
  chemically synthesized
gctgatctgaacaggtggta

SEQ ID NO: 490846 - DNA, 20 bp, Artificial Sequence
  chemically synthesized
agacacaatatctgacctca

SEQ ID NO: 490847 - DNA, 20 bp, Artificial Sequence
  chemically synthesized
ctaaacaataggaaactatc

SEQ ID NO: 490848 - DNA, 20 bp, Artificial Sequence
  chemically synthesized
aaggtttcagtaagcatttg

SEQ ID NO: 490849 - DNA, 20 bp, Artificial Sequence
  chemically synthesized
agcatttgctgagtgaacgc

SEQ ID NO: 490850 - DNA, 20 bp, Artificial Sequence
  chemically synthesized
ctgagtgaacgcatgaatct

SEQ ID NO: 490851 - DNA, 20 bp, Artificial Sequence
  chemically synthesized
gcggagggaggaagagagga

SEQ ID NO: 490852 - DNA, 20 bp, Artificial Sequence
  chemically synthesized
gttcaggctcatcatcacca

SEQ ID NO: 490853 - DNA, 20 bp, Artificial Sequence
  chemically synthesized
aatctctaggaggatcagta

SEQ ID NO: 490854 - DNA, 20 bp, Artificial Sequence
  chemically synthesized
ttatttatttgaatctctag

SEQ ID NO: 490855 - DNA, 20 bp, Artificial Sequence
  chemically synthesized
agaaaattgtgcttatttat

SEQ ID NO: 490856 - DNA, 20 bp, Artificial Sequence
  chemically synthesized
atttgttatactacatacag

SEQ ID NO: 490857 - DNA, 20 bp, Artificial Sequence
  chemically synthesized
aacaaatggtaggccagaag

SEQ ID NO: 490858 - DNA, 20 bp, Artificial Sequence
  chemically synthesized
agagggatgatctcagtgaa

SEQ ID NO: 490859 - DNA, 20 bp, Artificial Sequence
  chemically synthesized
aggatgagcggaggagactt

SEQ ID NO: 490860 - DNA, 20 bp, Artificial Sequence
  chemically synthesized
aggagacttctgggtcaatt

SEQ ID NO: 490861 - DNA, 20 bp, Artificial Sequence
  chemically synthesized
ctgggtcaatttggaattta

SEQ ID NO: 490862 - DNA, 20 bp, Artificial Sequence
  chemically synthesized
tcgtagaacttaggcatatg

SEQ ID NO: 490863 - DNA, 20 bp, Artificial Sequence
  chemically synthesized
tatggagggttagaggcagt

SEQ ID NO: 490864 - DNA, 20 bp, Artificial Sequence
  chemically synthesized
atgagagcaggcgttagggg

SEQ ID NO: 490865 - DNA, 20 bp, Artificial Sequence
  chemically synthesized
ggcaacatgaactattacat

SEQ ID NO: 490866 - DNA, 20 bp, Artificial Sequence
  chemically synthesized
catgagaatcaccattgttt

SEQ ID NO: 490867 - DNA, 20 bp, Artificial Sequence
  chemically synthesized
agatgtcagggaggtattta

SEQ ID NO: 490868 - DNA, 20 bp, Artificial Sequence
  chemically synthesized
tggctcttatttgttccttc

SEQ ID NO: 490869 - DNA, 20 bp, Artificial Sequence
  chemically synthesized
tttgaagtttgtaggaaatg

SEQ ID NO: 490870 - DNA, 20 bp, Artificial Sequence
  chemically synthesized
aatgccaatactgctggtcc

SEQ ID NO: 490871 - DNA, 20 bp, Artificial Sequence
  chemically synthesized
gctggtccaggaatacctct

SEQ ID NO: 490872 - DNA, 20 bp, Artificial Sequence
  chemically synthesized
ctctttgagttgtaaggtaa

SEQ ID NO: 490873 - DNA, 20 bp, Artificial Sequence
  chemically synthesized
ggtaatggagtaaatgcctt

SEQ ID NO: 490874 - DNA, 20 bp, Artificial Sequence
  chemically synthesized
gagtctttgttaagcaatca

SEQ ID NO: 490875 - DNA, 20 bp, Artificial Sequence
  chemically synthesized
atagcattataagcagcaat

SEQ ID NO: 490876 - DNA, 20 bp, Artificial Sequence
  chemically synthesized
tgacttttacaacctaattg

SEQ ID NO: 490877 - DNA, 20 bp, Artificial Sequence
  chemically synthesized
tcggtttcccaaataagaga

SEQ ID NO: 490878 - DNA, 20 bp, Artificial Sequence
  chemically synthesized
agagatagaattgaacagct

SEQ ID NO: 490879 - DNA, 20 bp, Artificial Sequence
  chemically synthesized
agatctaaatctcatttgta

SEQ ID NO: 490880 - DNA, 20 bp, Artificial Sequence
  chemically synthesized
cagtgcatggcctgctcaag

SEQ ID NO: 490881 - DNA, 20 bp, Artificial Sequence
  chemically synthesized
aagcataagaaagaaaaata

SEQ ID NO: 490882 - DNA, 20 bp, Artificial Sequence
  chemically synthesized
ctgagctggaaaagataaca

SEQ ID NO: 490883 - DNA, 20 bp, Artificial Sequence
  chemically synthesized
taattaatgttgttcactgt

SEQ ID NO: 490884 - DNA, 20 bp, Artificial Sequence
  chemically synthesized
cttaaaatatttagaagcta

SEQ ID NO: 490885 - DNA, 20 bp, Artificial Sequence
  chemically synthesized
gcttctaaatattttaagta

SEQ ID NO: 490886 - DNA, 20 bp, Artificial Sequence
  chemically synthesized
gcttggaaattttattggta

SEQ ID NO: 490887 - DNA, 20 bp, Artificial Sequence
  chemically synthesized
taattgccagagaaatagat

SEQ ID NO: 490888 - DNA, 20 bp, Artificial Sequence
  chemically synthesized
gaaaatcataattaaatctg

SEQ ID NO: 490889 - DNA, 20 bp, Artificial Sequence
  chemically synthesized
caataagctttctaactatg

SEQ ID NO: 490890 - DNA, 20 bp, Artificial Sequence
  chemically synthesized
taagaatgaatgcttaatat

SEQ ID NO: 490891 - DNA, 20 bp, Artificial Sequence
  chemically synthesized
atatgcacttcttattaaga

SEQ ID NO: 490892 - DNA, 20 bp, Artificial Sequence
  chemically synthesized
ttagatatgcacttcttatt

SEQ ID NO: 490893 - DNA, 20 bp, Artificial Sequence
  chemically synthesized
tattttgaaaagctccccac

SEQ ID NO: 490894 - DNA, 20 bp, Artificial Sequence
  chemically synthesized
cttttcaaaatataaaagcc

SEQ ID NO: 490895 - DNA, 20 bp, Artificial Sequence
  chemically synthesized
ctgattcagtagacttagaa

SEQ ID NO: 490896 - DNA, 20 bp, Artificial Sequence
  chemically synthesized
agaattccattctaagtcta

SEQ ID NO: 490897 - DNA, 20 bp, Artificial Sequence
  chemically synthesized
aaattctgattcagtagact

SEQ ID NO: 490898 - DNA, 20 bp, Artificial Sequence
  chemically synthesized
ccattctaagtctactgaat

SEQ ID NO: 490899 - DNA, 20 bp, Artificial Sequence
  chemically synthesized
ggaggttacaaacatgtgca

SEQ ID NO: 490900 - DNA, 20 bp, Artificial Sequence
  chemically synthesized
tgggaagcaggaaggacatg

SEQ ID NO: 490901 - DNA, 20 bp, Artificial Sequence
  chemically synthesized
atttttatttttatacaggg

SEQ ID NO: 490902 - DNA, 20 bp, Artificial Sequence
  chemically synthesized
aaaacacaatagatgaaaaa

SEQ ID NO: 490903 - DNA, 20 bp, Artificial Sequence
  chemically synthesized
gaatgtgacaaatgaagaaa

SEQ ID NO: 490904 - DNA, 20 bp, Artificial Sequence
  chemically synthesized
agaaattgtacaatgacaga

SEQ ID NO: 490905 - DNA, 20 bp, Artificial Sequence
  chemically synthesized
attgtacaatgacagattgg

SEQ ID NO: 490906 - DNA, 20 bp, Artificial Sequence
  chemically synthesized
attgaacaaggagatgtttc

SEQ ID NO: 490907 - DNA, 20 bp, Artificial Sequence
  chemically synthesized
attacaagtaaatctcagta

SEQ ID NO: 490908 - DNA, 20 bp, Artificial Sequence
  chemically synthesized
atttacttgtaattttgttc

SEQ ID NO: 490909 - DNA, 20 bp, Artificial Sequence
  chemically synthesized
tgagacaggtaaatcattaa

SEQ ID NO: 490910 - DNA, 20 bp, Artificial Sequence
  chemically synthesized
tgtaataaaatgaaatttgg

SEQ ID NO: 490911 - DNA, 20 bp, Artificial Sequence
  chemically synthesized
agacacaatgagaatgacct

SEQ ID NO: 490912 - DNA, 20 bp, Artificial Sequence
  chemically synthesized
cactgacgaagagacacaat

SEQ ID NO: 490913 - DNA, 20 bp, Artificial Sequence
  chemically synthesized
tgtgtctcttcgtcagtgcc

SEQ ID NO: 490914 - DNA, 20 bp, Artificial Sequence
  chemically synthesized
ttcgtcagtgccaagaattc

SEQ ID NO: 490915 - DNA, 20 bp, Artificial Sequence
  chemically synthesized
agaaactgtatatcaaactc

SEQ ID NO: 490916 - DNA, 20 bp, Artificial Sequence
  chemically synthesized
caagtttctttcaacttcta

SEQ ID NO: 490917 - DNA, 20 bp, Artificial Sequence
  chemically synthesized
ctttcaacttctatcggatg

SEQ ID NO: 490918 - DNA, 20 bp, Artificial Sequence
  chemically synthesized
tgctgtgcttagcatatgcc

SEQ ID NO: 490919 - DNA, 20 bp, Artificial Sequence
  chemically synthesized
ctatggacaggctaagttga

SEQ ID NO: 490920 - DNA, 20 bp, Artificial Sequence
  chemically synthesized
cagtctatggacaggctaag

SEQ ID NO: 490921 - DNA, 20 bp, Artificial Sequence
  chemically synthesized
cttagcctgtccatagactg

SEQ ID NO: 490922 - DNA, 20 bp, Artificial Sequence
  chemically synthesized
tatcagaccttccaccaaga

SEQ ID NO: 490923 - DNA, 20 bp, Artificial Sequence
  chemically synthesized
ataaccttgtgggagcacct

SEQ ID NO: 490924 - DNA, 20 bp, Artificial Sequence
  chemically synthesized
aaaatagtatagaaaaaaaa

SEQ ID NO: 490925 - DNA, 20 bp, Artificial Sequence
  chemically synthesized
agtatagaaaagcaactagg

SEQ ID NO: 490926 - DNA, 20 bp, Artificial Sequence
  chemically synthesized
ctgaaataaatggccttttt

SEQ ID NO: 490927 - DNA, 20 bp, Artificial Sequence
  chemically synthesized
ggcctttttttgagtaaaga

SEQ ID NO: 490928 - DNA, 20 bp, Artificial Sequence
  chemically synthesized
gaatgaaagttataggaggt

SEQ ID NO: 490929 - DNA, 20 bp, Artificial Sequence
  chemically synthesized
aatcaaggtcaaggagagct

SEQ ID NO: 490930 - DNA, 20 bp, Artificial Sequence
  chemically synthesized
gagctcagaatgagaaggac

SEQ ID NO: 490931 - DNA, 20 bp, Artificial Sequence
  chemically synthesized
tcttatacttcatatatgga

SEQ ID NO: 490932 - DNA, 20 bp, Artificial Sequence
  chemically synthesized
tccctgttgtactaacatgt

SEQ ID NO: 490933 - DNA, 20 bp, Artificial Sequence
  chemically synthesized
gaaggcagtggggagaagag

SEQ ID NO: 490934 - DNA, 20 bp, Artificial Sequence
  chemically synthesized
agctccaatgcccagtaaaa

SEQ ID NO: 490935 - DNA, 20 bp, Artificial Sequence
  chemically synthesized
ctaactattaaagatgagta

SEQ ID NO: 490936 - DNA, 20 bp, Artificial Sequence
  chemically synthesized
ttttatgctaactattaaag

SEQ ID NO: 490937 - DNA, 20 bp, Artificial Sequence
  chemically synthesized
tcttaaaagtcctctagaaa

SEQ ID NO: 490938 - DNA, 20 bp, Artificial Sequence
  chemically synthesized
ctgtaaagtccaaaacatat

SEQ ID NO: 490939 - DNA, 20 bp, Artificial Sequence
  chemically synthesized
atatgttttggactttacag

SEQ ID NO: 490940 - DNA, 20 bp, Artificial Sequence
  chemically synthesized
cagctgaatattaagcatga

SEQ ID NO: 490941 - DNA, 20 bp, Artificial Sequence
  chemically synthesized
tggaggtccttagttaaaag

SEQ ID NO: 490942 - DNA, 20 bp, Artificial Sequence
  chemically synthesized
gacaggacctttttatttga

SEQ ID NO: 490943 - DNA, 20 bp, Artificial Sequence
  chemically synthesized
gattccatgtctttgctatt

SEQ ID NO: 490944 - DNA, 20 bp, Artificial Sequence
  chemically synthesized
tattcacaatagcaaagaca

SEQ ID NO: 490945 - DNA, 20 bp, Artificial Sequence
  chemically synthesized
taccattgtttcacaactag

SEQ ID NO: 490946 - DNA, 20 bp, Artificial Sequence
  chemically synthesized
agttgtgaaacaatggtaga

SEQ ID NO: 490947 - DNA, 20 bp, Artificial Sequence
  chemically synthesized
aaatactacatagtcataaa

SEQ ID NO: 490948 - DNA, 20 bp, Artificial Sequence
  chemically synthesized
atcatgtcctttgcggaagc

SEQ ID NO: 490949 - DNA, 20 bp, Artificial Sequence
  chemically synthesized
tagtagatgtgggaaggagg

SEQ ID NO: 490950 - DNA, 20 bp, Artificial Sequence
  chemically synthesized
gtgagcatagtacctacctg

SEQ ID NO: 490951 - DNA, 20 bp, Artificial Sequence
  chemically synthesized
gtaggtactatgctcactgt

SEQ ID NO: 490952 - DNA, 20 bp, Artificial Sequence
  chemically synthesized
tagcgcatgatgctgaggtt

SEQ ID NO: 490953 - DNA, 20 bp, Artificial Sequence
  chemically synthesized
catgtacaggcttgtcacag

SEQ ID NO: 490954 - DNA, 20 bp, Artificial Sequence
  chemically synthesized
caaattttattttatataca

SEQ ID NO: 490955 - DNA, 20 bp, Artificial Sequence
  chemically synthesized
tgttcatttgttacaggaac

SEQ ID NO: 490956 - DNA, 20 bp, Artificial Sequence
  chemically synthesized
attatacctcacaggaaaaa

SEQ ID NO: 490957 - DNA, 20 bp, Artificial Sequence
  chemically synthesized
cctgataatggttgctataa

SEQ ID NO: 490958 - DNA, 20 bp, Artificial Sequence
  chemically synthesized
ggttgctataaaagaataat

SEQ ID NO: 490959 - DNA, 20 bp, Artificial Sequence
  chemically synthesized
agtctatttctagttttaga

SEQ ID NO: 490960 - DNA, 20 bp, Artificial Sequence
  chemically synthesized
attttccttcagttcattgg

SEQ ID NO: 490961 - DNA, 20 bp, Artificial Sequence
  chemically synthesized
tatatatatatataattgat

SEQ ID NO: 490962 - DNA, 20 bp, Artificial Sequence
  chemically synthesized
agtacttaaagctctttatg

SEQ ID NO: 490963 - DNA, 20 bp, Artificial Sequence
  chemically synthesized
ttaagtactacatgttttgt

SEQ ID NO: 490964 - DNA, 20 bp, Artificial Sequence
  chemically synthesized
acatgttttgtaagggtatc

SEQ ID NO: 490965 - DNA, 20 bp, Artificial Sequence
  chemically synthesized
tcactttaggtaacactgta

SEQ ID NO: 490966 - DNA, 20 bp, Artificial Sequence
  chemically synthesized
aactttgtttgattaatgat

SEQ ID NO: 490967 - DNA, 20 bp, Artificial Sequence
  chemically synthesized
caaatgcctttacagaatga

SEQ ID NO: 490968 - DNA, 20 bp, Artificial Sequence
  chemically synthesized
caccaattcaaatgccttta

SEQ ID NO: 490969 - DNA, 20 bp, Artificial Sequence
  chemically synthesized
caatcattctgtaaaggcat

SEQ ID NO: 490970 - DNA, 20 bp, Artificial Sequence
  chemically synthesized
acagaacagaactttgcaaa

SEQ ID NO: 490971 - DNA, 20 bp, Artificial Sequence
  chemically synthesized
tgttagctctctctacgttc

SEQ ID NO: 490972 - DNA, 20 bp, Artificial Sequence
  chemically synthesized
tgaatgagttagaaggcgag

SEQ ID NO: 490973 - DNA, 20 bp, Artificial Sequence
  chemically synthesized
ttgtcctgaagttctcatga

SEQ ID NO: 490974 - DNA, 20 bp, Artificial Sequence
  chemically synthesized
ctatttgtcctgaagttctc

SEQ ID NO: 490975 - DNA, 20 bp, Artificial Sequence
  chemically synthesized
gaagtcacatgttctataac

SEQ ID NO: 490976 - DNA, 20 bp, Artificial Sequence
  chemically synthesized
catgctagtaatcatgtaga

SEQ ID NO: 490977 - DNA, 20 bp, Artificial Sequence
  chemically synthesized
acgtcctgagacagtgtttt

SEQ ID NO: 490978 - DNA, 20 bp, Artificial Sequence
  chemically synthesized
aaaatgacctatgcttcctt

SEQ ID NO: 490979 - DNA, 20 bp, Artificial Sequence
  chemically synthesized
acttcttcaaaagccatttg

SEQ ID NO: 490980 - DNA, 20 bp, Artificial Sequence
  chemically synthesized
caaaagccatttggcgggta

SEQ ID NO: 490981 - DNA, 20 bp, Artificial Sequence
  chemically synthesized
caaataccagtagagaacta

SEQ ID NO: 490982 - DNA, 20 bp, Artificial Sequence
  chemically synthesized
tccaatcaataattgactta

SEQ ID NO: 490983 - DNA, 20 bp, Artificial Sequence
  chemically synthesized
ctctgtaagtcaattattga

SEQ ID NO: 490984 - DNA, 20 bp, Artificial Sequence
  chemically synthesized
ctagtcatcattctctgctg

SEQ ID NO: 490985 - DNA, 20 bp, Artificial Sequence
  chemically synthesized
aatccattcatcctccagca

SEQ ID NO: 490986 - DNA, 20 bp, Artificial Sequence
  chemically synthesized
tcatcattctctgctggagg

SEQ ID NO: 490987 - DNA, 20 bp, Artificial Sequence
  chemically synthesized
cattctctgctggaggatga

SEQ ID NO: 490988 - DNA, 20 bp, Artificial Sequence
  chemically synthesized
tgaatggattggaggagccc

SEQ ID NO: 490989 - DNA, 20 bp, Artificial Sequence
  chemically synthesized
aagtgaggaaagatggtcgc

SEQ ID NO: 490990 - DNA, 20 bp, Artificial Sequence
  chemically synthesized
gatggtcgcttggattgagg

SEQ ID NO: 490991 - DNA, 20 bp, Artificial Sequence
  chemically synthesized
ttggagacagaaatgaagga

SEQ ID NO: 490992 - DNA, 20 bp, Artificial Sequence
  chemically synthesized
tttcagtcctaatatttcct

SEQ ID NO: 490993 - DNA, 20 bp, Artificial Sequence
  chemically synthesized
ctatgtctaaaatttatgat

SEQ ID NO: 490994 - DNA, 20 bp, Artificial Sequence
  chemically synthesized
gagttttgctccaaatgtgt

SEQ ID NO: 490995 - DNA, 20 bp, Artificial Sequence
  chemically synthesized
ttgctagctttgagtttgcc

SEQ ID NO: 490996 - DNA, 20 bp, Artificial Sequence
  chemically synthesized
ttggattatgattgctagct

SEQ ID NO: 490997 - DNA, 20 bp, Artificial Sequence
  chemically synthesized
cagggattcccaaaatatgt

SEQ ID NO: 490998 - DNA, 20 bp, Artificial Sequence
  chemically synthesized
tcataatccaaacatatttt

SEQ ID NO: 490999 - DNA, 20 bp, Artificial Sequence
  chemically synthesized
caaacatattttgggaatcc

SEQ ID NO: 491000 - DNA, 20 bp, Artificial Sequence
  chemically synthesized
tagtcatcatgcagatactc

SEQ ID NO: 491001 - DNA, 20 bp, Artificial Sequence
  chemically synthesized
ctattttcttcaaatttgtg

SEQ ID NO: 491002 - DNA, 20 bp, Artificial Sequence
  chemically synthesized
ccccacaaatttgaagaaaa

SEQ ID NO: 491003 - DNA, 20 bp, Artificial Sequence
  chemically synthesized
actaataggtgggtgggagt

SEQ ID NO: 491004 - DNA, 20 bp, Artificial Sequence
  chemically synthesized
tttttaactaataggtgggt

SEQ ID NO: 491005 - DNA, 20 bp, Artificial Sequence
  chemically synthesized
ccattttttttaactaatag

SEQ ID NO: 491006 - DNA, 20 bp, Artificial Sequence
  chemically synthesized
agtgttgtgctttaagagaa

SEQ ID NO: 491007 - DNA, 20 bp, Artificial Sequence
  chemically synthesized
cacttctattctgtgttcac

SEQ ID NO: 491008 - DNA, 20 bp, Artificial Sequence
  chemically synthesized
ccatggaattcttgtgaaca

SEQ ID NO: 491009 - DNA, 20 bp, Artificial Sequence
  chemically synthesized
tatgccacagcaaaggccca

SEQ ID NO: 491010 - DNA, 20 bp, Artificial Sequence
  chemically synthesized
accctaaattaaatatttgt

SEQ ID NO: 491011 - DNA, 20 bp, Artificial Sequence
  chemically synthesized
actccaacaaatatttaatt

SEQ ID NO: 491012 - DNA, 20 bp, Artificial Sequence
  chemically synthesized
tagggtgtccccattaagtt

SEQ ID NO: 491013 - DNA, 20 bp, Artificial Sequence
  chemically synthesized
tattgtaacacagcattttc

SEQ ID NO: 491014 - DNA, 20 bp, Artificial Sequence
  chemically synthesized
tttgagaacaagatagatca

SEQ ID NO: 491015 - DNA, 20 bp, Artificial Sequence
  chemically synthesized
gattgctttctcattctgga

SEQ ID NO: 491016 - DNA, 20 bp, Artificial Sequence
  chemically synthesized
aagttacttttgaccctttc

SEQ ID NO: 491017 - DNA, 20 bp, Artificial Sequence
  chemically synthesized
ttgaaatacatacaacagcc

SEQ ID NO: 491018 - DNA, 20 bp, Artificial Sequence
  chemically synthesized
ctgtcgtttctcaggctctt

SEQ ID NO: 491019 - DNA, 20 bp, Artificial Sequence
  chemically synthesized
ggcctagaaatacgataaag

SEQ ID NO: 491020 - DNA, 20 bp, Artificial Sequence
  chemically synthesized
ggattgttagttgatgtctt

SEQ ID NO: 491021 - DNA, 20 bp, Artificial Sequence
  chemically synthesized
tgcccaacatgtgcttagat

SEQ ID NO: 491022 - DNA, 20 bp, Artificial Sequence
  chemically synthesized
taaggcttggggaaaaataa

SEQ ID NO: 491023 - DNA, 20 bp, Artificial Sequence
  chemically synthesized
gtattaccatacaacagata

SEQ ID NO: 491024 - DNA, 20 bp, Artificial Sequence
  chemically synthesized
ggtaatactactctccttca

SEQ ID NO: 491025 - DNA, 20 bp, Artificial Sequence
  chemically synthesized
tctcatctaattccatgaag

SEQ ID NO: 491026 - DNA, 20 bp, Artificial Sequence
  chemically synthesized
aatcaaaaaaaaaaaaaaaa

SEQ ID NO: 491027 - DNA, 20 bp, Artificial Sequence
  chemically synthesized
aaaaaaaagaatgcacaagc

SEQ ID NO: 491028 - DNA, 20 bp, Artificial Sequence
  chemically synthesized
caatgtactgataatgggga

SEQ ID NO: 491029 - DNA, 20 bp, Artificial Sequence
  chemically synthesized
tgtacaatgtactgataatg

SEQ ID NO: 491030 - DNA, 20 bp, Artificial Sequence
  chemically synthesized
tatataagccagaggaacct

SEQ ID NO: 491031 - DNA, 20 bp, Artificial Sequence
  chemically synthesized
gatttttctcaattattcat

SEQ ID NO: 491032 - DNA, 20 bp, Artificial Sequence
  chemically synthesized
ctaaccttttagatattcac

SEQ ID NO: 491033 - DNA, 20 bp, Artificial Sequence
  chemically synthesized
atgtgaatatctaaaaggtt

SEQ ID NO: 491034 - DNA, 20 bp, Artificial Sequence
  chemically synthesized
aaggttagggatatttgtaa

SEQ ID NO: 491035 - DNA, 20 bp, Artificial Sequence
  chemically synthesized
aaaccagttttaggagtgaa

SEQ ID NO: 491036 - DNA, 20 bp, Artificial Sequence
  chemically synthesized
gaatataagaaaccagtttt

SEQ ID NO: 491037 - DNA, 20 bp, Artificial Sequence
  chemically synthesized
tcattcaaataaataatgta

SEQ ID NO: 491038 - DNA, 20 bp, Artificial Sequence
  chemically synthesized
atattcattacattatttat

SEQ ID NO: 491039 - DNA, 20 bp, Artificial Sequence
  chemically synthesized
tgacatctgtattttccagt

SEQ ID NO: 491040 - DNA, 20 bp, Artificial Sequence
  chemically synthesized
taaaatagaatttggattgg

SEQ ID NO: 491041 - DNA, 20 bp, Artificial Sequence
  chemically synthesized
taggatcagtaaaatagaat

SEQ ID NO: 491042 - DNA, 20 bp, Artificial Sequence
  chemically synthesized
aacaattaggatcagtaaaa

SEQ ID NO: 491043 - DNA, 20 bp, Artificial Sequence
  chemically synthesized
cgggcaagaagtataacaat

SEQ ID NO: 491044 - DNA, 20 bp, Artificial Sequence
  chemically synthesized
tggaggaaaagcaataacga

SEQ ID NO: 491045 - DNA, 20 bp, Artificial Sequence
  chemically synthesized
aataacataggtgaagtgta

SEQ ID NO: 491046 - DNA, 20 bp, Artificial Sequence
  chemically synthesized
gtctgagatgaaacagttag

SEQ ID NO: 491047 - DNA, 20 bp, Artificial Sequence
  chemically synthesized
tgtagaatgttatgcagtga

SEQ ID NO: 491048 - DNA, 20 bp, Artificial Sequence
  chemically synthesized
attaatctggaaagattgtg

SEQ ID NO: 491049 - DNA, 20 bp, Artificial Sequence
  chemically synthesized
ccagaagaactatgcatctg

SEQ ID NO: 491050 - DNA, 20 bp, Artificial Sequence
  chemically synthesized
ccagatgcatagttcttctg

SEQ ID NO: 491051 - DNA, 20 bp, Artificial Sequence
  chemically synthesized
tcagtataaatttttgagca

SEQ ID NO: 491052 - DNA, 20 bp, Artificial Sequence
  chemically synthesized
tccctgctcaaaaatttata

SEQ ID NO: 491053 - DNA, 20 bp, Artificial Sequence
  chemically synthesized
tgggcttcaacaggcaggca

SEQ ID NO: 491054 - DNA, 20 bp, Artificial Sequence
  chemically synthesized
ctcagggatgctatgaggtt

SEQ ID NO: 491055 - DNA, 20 bp, Artificial Sequence
  chemically synthesized
agcctaaaaaggtatctctc

SEQ ID NO: 491056 - DNA, 20 bp, Artificial Sequence
  chemically synthesized
attgcactgaagcatggatg

SEQ ID NO: 491057 - DNA, 20 bp, Artificial Sequence
  chemically synthesized
ttgtctaattgcactgaagc

SEQ ID NO: 491058 - DNA, 20 bp, Artificial Sequence
  chemically synthesized
agaatgaccaggacgtcact

SEQ ID NO: 491059 - DNA, 20 bp, Artificial Sequence
  chemically synthesized
ggagaatagtcaaaggtctg

SEQ ID NO: 491060 - DNA, 20 bp, Artificial Sequence
  chemically synthesized
gacacacatgatggaggatg

SEQ ID NO: 491061 - DNA, 20 bp, Artificial Sequence
  chemically synthesized
aggtaaagacacacatgatg

SEQ ID NO: 491062 - DNA, 20 bp, Artificial Sequence
  chemically synthesized
ggtctagtcaactggaatga

SEQ ID NO: 491063 - DNA, 20 bp, Artificial Sequence
  chemically synthesized
gatctcatggtctagtcaac

SEQ ID NO: 491064 - DNA, 20 bp, Artificial Sequence
  chemically synthesized
agattacagttcctgctctc

SEQ ID NO: 491065 - DNA, 20 bp, Artificial Sequence
  chemically synthesized
agcaacacgttactaggcac

SEQ ID NO: 491066 - DNA, 20 bp, Artificial Sequence
  chemically synthesized
gctcaaaacatgtttgttaa

SEQ ID NO: 491067 - DNA, 20 bp, Artificial Sequence
  chemically synthesized
ccccaaatactaactctatt

SEQ ID NO: 491068 - DNA, 20 bp, Artificial Sequence
  chemically synthesized
gcttgaaaatgtattcacaa

SEQ ID NO: 491069 - DNA, 20 bp, Artificial Sequence
  chemically synthesized
agttatctatcctataaatt

SEQ ID NO: 491070 - DNA, 20 bp, Artificial Sequence
  chemically synthesized
gaaaatgtattcccaattta

SEQ ID NO: 491071 - DNA, 20 bp, Artificial Sequence
  chemically synthesized
tcaagtacagtatgatttta

SEQ ID NO: 491072 - DNA, 20 bp, Artificial Sequence
  chemically synthesized
actcaaacttgcatgacaga

SEQ ID NO: 491073 - DNA, 20 bp, Artificial Sequence
  chemically synthesized
ctgcactcaaacttgcatga

SEQ ID NO: 491074 - DNA, 20 bp, Artificial Sequence
  chemically synthesized
actcattctgtcatgcaagt

SEQ ID NO: 491075 - DNA, 20 bp, Artificial Sequence
  chemically synthesized
gtggaggatcaccagagctc

SEQ ID NO: 491076 - DNA, 20 bp, Artificial Sequence
  chemically synthesized
ctactcaagaggctgaggtg

SEQ ID NO: 491077 - DNA, 20 bp, Artificial Sequence
  chemically synthesized
tgatcctccacctcagcctc

SEQ ID NO: 491078 - DNA, 20 bp, Artificial Sequence
  chemically synthesized
aaaaaaattttaaaaattat

SEQ ID NO: 491079 - DNA, 20 bp, Artificial Sequence
  chemically synthesized
ttaaaatttttttgtggaga

SEQ ID NO: 491080 - DNA, 20 bp, Artificial Sequence
  chemically synthesized
tgggaggattgtttgaggcc

SEQ ID NO: 491081 - DNA, 20 bp, Artificial Sequence
  chemically synthesized
actttggaaggctaaggtgg

SEQ ID NO: 491082 - DNA, 20 bp, Artificial Sequence
  chemically synthesized
accttagccttccaaagtgc

SEQ ID NO: 491083 - DNA, 20 bp, Artificial Sequence
  chemically synthesized
tctttttactaaatggctaa

SEQ ID NO: 491084 - DNA, 20 bp, Artificial Sequence
  chemically synthesized
ctaaatggctaaatgagtga

SEQ ID NO: 491085 - DNA, 20 bp, Artificial Sequence
  chemically synthesized
actggtatgtggtgaaactg

SEQ ID NO: 491086 - DNA, 20 bp, Artificial Sequence
  chemically synthesized
agaatttttatgcacgttga

SEQ ID NO: 491087 - DNA, 20 bp, Artificial Sequence
  chemically synthesized
ggtatttaaaagtacagaaa

SEQ ID NO: 491088 - DNA, 20 bp, Artificial Sequence
  chemically synthesized
tgtacttttaaatacctact

SEQ ID NO: 491089 - DNA, 20 bp, Artificial Sequence
  chemically synthesized
taatatgaagtgcagaacat

SEQ ID NO: 491090 - DNA, 20 bp, Artificial Sequence
  chemically synthesized
tctgcacttcatattagtgg

SEQ ID NO: 491091 - DNA, 20 bp, Artificial Sequence
  chemically synthesized
actttatctgaagagtctac

SEQ ID NO: 491092 - DNA, 20 bp, Artificial Sequence
  chemically synthesized
ttttctttttactttatctg

SEQ ID NO: 491093 - DNA, 20 bp, Artificial Sequence
  chemically synthesized
attcatataacttgaagact

SEQ ID NO: 491094 - DNA, 20 bp, Artificial Sequence
  chemically synthesized
attcccagtcttcaagttat

SEQ ID NO: 491095 - DNA, 20 bp, Artificial Sequence
  chemically synthesized
gattattacctttatgatta

SEQ ID NO: 491096 - DNA, 20 bp, Artificial Sequence
  chemically synthesized
cttcaacacacataatctat

SEQ ID NO: 491097 - DNA, 20 bp, Artificial Sequence
  chemically synthesized
gcactattaagcatcttttc

SEQ ID NO: 491098 - DNA, 20 bp, Artificial Sequence
  chemically synthesized
ttaatagtgctagtaatcag

SEQ ID NO: 491099 - DNA, 20 bp, Artificial Sequence
  chemically synthesized
ttttaatttttgctatctta

SEQ ID NO: 491100 - DNA, 20 bp, Artificial Sequence
  chemically synthesized
accaaatattgacaaagatg

SEQ ID NO: 491101 - DNA, 20 bp, Artificial Sequence
  chemically synthesized
caatgccaccagtgatgatg

SEQ ID NO: 491102 - DNA, 20 bp, Artificial Sequence
  chemically synthesized
actctgtagaagtggaatgg

SEQ ID NO: 491103 - DNA, 20 bp, Artificial Sequence
  chemically synthesized
acccagccattccacttcta

SEQ ID NO: 491104 - DNA, 20 bp, Artificial Sequence
  chemically synthesized
tttgagtaactctgtagaag

SEQ ID NO: 491105 - DNA, 20 bp, Artificial Sequence
  chemically synthesized
agcatatgttttcatttagt

SEQ ID NO: 491106 - DNA, 20 bp, Artificial Sequence
  chemically synthesized
gttttcagtttttggctgtt

SEQ ID NO: 491107 - DNA, 20 bp, Artificial Sequence
  chemically synthesized
agccaaaaactgaaaaccac

SEQ ID NO: 491108 - DNA, 20 bp, Artificial Sequence
  chemically synthesized
acctgaatgtccatcaaaag

SEQ ID NO: 491109 - DNA, 20 bp, Artificial Sequence
  chemically synthesized
attgtggtatatctatacaa

SEQ ID NO: 491110 - DNA, 20 bp, Artificial Sequence
  chemically synthesized
agaatattaatcatcaataa

SEQ ID NO: 491111 - DNA, 20 bp, Artificial Sequence
  chemically synthesized
tgaacagctgatacacttac

SEQ ID NO: 491112 - DNA, 20 bp, Artificial Sequence
  chemically synthesized
cagctgatacacttacatgg

SEQ ID NO: 491113 - DNA, 20 bp, Artificial Sequence
  chemically synthesized
tctatggtgatataaatcag

SEQ ID NO: 491114 - DNA, 20 bp, Artificial Sequence
  chemically synthesized
aataggtgcctattggggct

SEQ ID NO: 491115 - DNA, 20 bp, Artificial Sequence
  chemically synthesized
atattttccacgctttctta

SEQ ID NO: 491116 - DNA, 20 bp, Artificial Sequence
  chemically synthesized
gtggaaaatatattagatgg

SEQ ID NO: 491117 - DNA, 20 bp, Artificial Sequence
  chemically synthesized
aatatattagatggcagaat

SEQ ID NO: 491118 - DNA, 20 bp, Artificial Sequence
  chemically synthesized
gacttatttgggagaggagg

SEQ ID NO: 491119 - DNA, 20 bp, Artificial Sequence
  chemically synthesized
agagaaagtacttagatttg

SEQ ID NO: 491120 - DNA, 20 bp, Artificial Sequence
  chemically synthesized
tagttgttttcttgcataag

SEQ ID NO: 491121 - DNA, 20 bp, Artificial Sequence
  chemically synthesized
aaacctcagtcatttgcaga

SEQ ID NO: 491122 - DNA, 20 bp, Artificial Sequence
  chemically synthesized
catttgcagacagaatttaa

SEQ ID NO: 491123 - DNA, 20 bp, Artificial Sequence
  chemically synthesized
aacagacttcgtgaaccatc

SEQ ID NO: 491124 - DNA, 20 bp, Artificial Sequence
  chemically synthesized
ttgtgtgtggggataaaagg

SEQ ID NO: 491125 - DNA, 20 bp, Artificial Sequence
  chemically synthesized
atcattgtgtgtggggataa

SEQ ID NO: 491126 - DNA, 20 bp, Artificial Sequence
  chemically synthesized
ctaaattgatcattgtgtgt

SEQ ID NO: 491127 - DNA, 20 bp, Artificial Sequence
  chemically synthesized
caatttagacaatctataag

SEQ ID NO: 491128 - DNA, 20 bp, Artificial Sequence
  chemically synthesized
aggaacacacgtgtgtatgt

SEQ ID NO: 491129 - DNA, 20 bp, Artificial Sequence
  chemically synthesized
agcgtagagattcaacgatc

SEQ ID NO: 491130 - DNA, 20 bp, Artificial Sequence
  chemically synthesized
tctcttgaaattcaagatcg

SEQ ID NO: 491131 - DNA, 20 bp, Artificial Sequence
  chemically synthesized
gaaagcctgtaaaagctctt

SEQ ID NO: 491132 - DNA, 20 bp, Artificial Sequence
  chemically synthesized
tataatggcaaatcatccca

SEQ ID NO: 491133 - DNA, 20 bp, Artificial Sequence
  chemically synthesized
catctttgttttatactcac

SEQ ID NO: 491134 - DNA, 20 bp, Artificial Sequence
  chemically synthesized
caaaggtgctcagattctaa

SEQ ID NO: 491135 - DNA, 20 bp, Artificial Sequence
  chemically synthesized
ttcccatgttcatactctat

SEQ ID NO: 491136 - DNA, 20 bp, Artificial Sequence
  chemically synthesized
cagtgaggaaaagctgagct

SEQ ID NO: 491137 - DNA, 20 bp, Artificial Sequence
  chemically synthesized
gaggaaaagctgagcttgga

SEQ ID NO: 491138 - DNA, 20 bp, Artificial Sequence
  chemically synthesized
caaatggaagtaaaaaggcc

SEQ ID NO: 491139 - DNA, 20 bp, Artificial Sequence
  chemically synthesized
ggggcagaagggagaaggtt

SEQ ID NO: 491140 - DNA, 20 bp, Artificial Sequence
  chemically synthesized
tgcttgtctgctctgtcaag

SEQ ID NO: 491141 - DNA, 20 bp, Artificial Sequence
  chemically synthesized
atgaagcccaaaataggtga

SEQ ID NO: 491142 - DNA, 20 bp, Artificial Sequence
  chemically synthesized
cgcaagttctctcatttccc

SEQ ID NO: 491143 - DNA, 20 bp, Artificial Sequence
  chemically synthesized
tcctcaaagaccactgacag

SEQ ID NO: 491144 - DNA, 20 bp, Artificial Sequence
  chemically synthesized
attcagaaatgctctttagc

SEQ ID NO: 491145 - DNA, 20 bp, Artificial Sequence
  chemically synthesized
attcctgctaaagagcattt

SEQ ID NO: 491146 - DNA, 20 bp, Artificial Sequence
  chemically synthesized
acaacgtggaggcagctaat

SEQ ID NO: 491147 - DNA, 20 bp, Artificial Sequence
  chemically synthesized
cacacatgtctggtgtaaga

SEQ ID NO: 491148 - DNA, 20 bp, Artificial Sequence
  chemically synthesized
atgtgtgcctgtgtttgcag

SEQ ID NO: 491149 - DNA, 20 bp, Artificial Sequence
  chemically synthesized
tctcttttgcagtatgaaaa

SEQ ID NO: 491150 - DNA, 20 bp, Artificial Sequence
  chemically synthesized
atgaaataaccatataaata

SEQ ID NO: 491151 - DNA, 20 bp, Artificial Sequence
  chemically synthesized
ctttttcaggtggtgggcaa

SEQ ID NO: 491152 - DNA, 20 bp, Artificial Sequence
  chemically synthesized
tgttatttgacatggtgaca

SEQ ID NO: 491153 - DNA, 20 bp, Artificial Sequence
  chemically synthesized
aacaagaggaaataagattg

SEQ ID NO: 491154 - DNA, 20 bp, Artificial Sequence
  chemically synthesized
gttggggaacctacacagga

SEQ ID NO: 491155 - DNA, 20 bp, Artificial Sequence
  chemically synthesized
aaatcaccttcgacattttt

SEQ ID NO: 491156 - DNA, 20 bp, Artificial Sequence
  chemically synthesized
aagtgatagaagaaaaccaa

SEQ ID NO: 491157 - DNA, 20 bp, Artificial Sequence
  chemically synthesized
gttttcttctatcactttta

SEQ ID NO: 491158 - DNA, 20 bp, Artificial Sequence
  chemically synthesized
atttatttcccaaatgggta

SEQ ID NO: 491159 - DNA, 20 bp, Artificial Sequence
  chemically synthesized
tatatcaatttatttcccaa

SEQ ID NO: 491160 - DNA, 20 bp, Artificial Sequence
  chemically synthesized
ccaaaacaaggtattttttt

SEQ ID NO: 491161 - DNA, 20 bp, Artificial Sequence
  chemically synthesized
ttttctggatttttttattc

SEQ ID NO: 491162 - DNA, 20 bp, Artificial Sequence
  chemically synthesized
atttttttattcaagagtga

SEQ ID NO: 491163 - DNA, 20 bp, Artificial Sequence
  chemically synthesized
ttttatctattctctcactc

SEQ ID NO: 491164 - DNA, 20 bp, Artificial Sequence
  chemically synthesized
cagagatatggccatatata

SEQ ID NO: 491165 - DNA, 20 bp, Artificial Sequence
  chemically synthesized
ctgaataatgttacttgaga

SEQ ID NO: 491166 - DNA, 20 bp, Artificial Sequence
  chemically synthesized
ctgaaattatattagaggag

SEQ ID NO: 491167 - DNA, 20 bp, Artificial Sequence
  chemically synthesized
tatttttctacatactagtt

SEQ ID NO: 491168 - DNA, 20 bp, Artificial Sequence
  chemically synthesized
ctagatagttcatggtagac

SEQ ID NO: 491169 - DNA, 20 bp, Artificial Sequence
  chemically synthesized
ctactgaaatcaggaaagct

SEQ ID NO: 491170 - DNA, 20 bp, Artificial Sequence
  chemically synthesized
tctaattttgttctgacatt

SEQ ID NO: 491171 - DNA, 20 bp, Artificial Sequence
  chemically synthesized
atacctattatctttatatt

SEQ ID NO: 491172 - DNA, 20 bp, Artificial Sequence
  chemically synthesized
gaaaaagaatggtattgaat

SEQ ID NO: 491173 - DNA, 20 bp, Artificial Sequence
  chemically synthesized
tatatggaaaaagaatggta

SEQ ID NO: 491174 - DNA, 20 bp, Artificial Sequence
  chemically synthesized
aaagtaagtatatatggaaa

SEQ ID NO: 491175 - DNA, 20 bp, Artificial Sequence
  chemically synthesized
ttgagttttgtattaaggcc

SEQ ID NO: 491176 - DNA, 20 bp, Artificial Sequence
  chemically synthesized
ttcaaactataaatgaaata

SEQ ID NO: 491177 - DNA, 20 bp, Artificial Sequence
  chemically synthesized
acatactaccctaatcctat

SEQ ID NO: 491178 - DNA, 20 bp, Artificial Sequence
  chemically synthesized
ttcttcaatccacataggat

SEQ ID NO: 491179 - DNA, 20 bp, Artificial Sequence
  chemically synthesized
atacccttcttcaatccaca

SEQ ID NO: 491180 - DNA, 20 bp, Artificial Sequence
  chemically synthesized
taatcctatgtggattgaag

SEQ ID NO: 491181 - DNA, 20 bp, Artificial Sequence
  chemically synthesized
taaatcaataaaacttaaaa

SEQ ID NO: 491182 - DNA, 20 bp, Artificial Sequence
  chemically synthesized
taacttgttgttcctgaatc

SEQ ID NO: 491183 - DNA, 20 bp, Artificial Sequence
  chemically synthesized
agatacttaacttgttgttc

SEQ ID NO: 491184 - DNA, 20 bp, Artificial Sequence
  chemically synthesized
agaagatcatgccagaaaag

SEQ ID NO: 491185 - DNA, 20 bp, Artificial Sequence
  chemically synthesized
acatcactaatactatgcca

SEQ ID NO: 491186 - DNA, 20 bp, Artificial Sequence
  chemically synthesized
tttctgacctcatacttcac

SEQ ID NO: 491187 - DNA, 20 bp, Artificial Sequence
  chemically synthesized
gaaaaatgtgttattattcc

SEQ ID NO: 491188 - DNA, 20 bp, Artificial Sequence
  chemically synthesized
caattcctcgtctttaccct

SEQ ID NO: 491189 - DNA, 20 bp, Artificial Sequence
  chemically synthesized
ttattcctagggtaaagacg

SEQ ID NO: 491190 - DNA, 20 bp, Artificial Sequence
  chemically synthesized
tagggtaaagacgaggaatt

SEQ ID NO: 491191 - DNA, 20 bp, Artificial Sequence
  chemically synthesized
aagagccagtaccgaataat

SEQ ID NO: 491192 - DNA, 20 bp, Artificial Sequence
  chemically synthesized
gagtcagaaaagagccagta

SEQ ID NO: 491193 - DNA, 20 bp, Artificial Sequence
  chemically synthesized
tctctttaatatctaagtat

SEQ ID NO: 491194 - DNA, 20 bp, Artificial Sequence
  chemically synthesized
gtttaataggaaagtgagta

SEQ ID NO: 491195 - DNA, 20 bp, Artificial Sequence
  chemically synthesized
aatagatgtttaataggaaa

SEQ ID NO: 491196 - DNA, 20 bp, Artificial Sequence
  chemically synthesized
cagttaaatataatcattat

SEQ ID NO: 491197 - DNA, 20 bp, Artificial Sequence
  chemically synthesized
tcattatgtgaataaacaat

SEQ ID NO: 491198 - DNA, 20 bp, Artificial Sequence
  chemically synthesized
ataaacaatgtggatcaaaa

SEQ ID NO: 491199 - DNA, 20 bp, Artificial Sequence
  chemically synthesized
aagaatgagaaatatcaacc

SEQ ID NO: 491200 - DNA, 20 bp, Artificial Sequence
  chemically synthesized
aaatcagcttcaaacatatt

SEQ ID NO: 491201 - DNA, 20 bp, Artificial Sequence
  chemically synthesized
aaaaacatgtaatctaatct

SEQ ID NO: 491202 - DNA, 20 bp, Artificial Sequence
  chemically synthesized
tttttgtaaagctgctatat

SEQ ID NO: 491203 - DNA, 20 bp, Artificial Sequence
  chemically synthesized
tacccattaaatacattatc

SEQ ID NO: 491204 - DNA, 20 bp, Artificial Sequence
  chemically synthesized
gattcttgataatgtattta

SEQ ID NO: 491205 - DNA, 20 bp, Artificial Sequence
  chemically synthesized
atgcatagtgaacatttgtg

SEQ ID NO: 491206 - DNA, 20 bp, Artificial Sequence
  chemically synthesized
ttttcttttgatacacgaag

SEQ ID NO: 491207 - DNA, 20 bp, Artificial Sequence
  chemically synthesized
tctatttgattgatagtgga

SEQ ID NO: 491208 - DNA, 20 bp, Artificial Sequence
  chemically synthesized
tacaagacttttcaataaaa

SEQ ID NO: 491209 - DNA, 20 bp, Artificial Sequence
  chemically synthesized
gtttgtgtttttttcatcat

SEQ ID NO: 491210 - DNA, 20 bp, Artificial Sequence
  chemically synthesized
acctggtctatctacataac

SEQ ID NO: 491211 - DNA, 20 bp, Artificial Sequence
  chemically synthesized
atatgagccaatcttcagaa

SEQ ID NO: 491212 - DNA, 20 bp, Artificial Sequence
  chemically synthesized
aaccttgtgtttttatagag

SEQ ID NO: 491213 - DNA, 20 bp, Artificial Sequence
  chemically synthesized
ttctctataaaaacacaagg

SEQ ID NO: 491214 - DNA, 20 bp, Artificial Sequence
  chemically synthesized
gtgtgatgtctgtcctggcc

SEQ ID NO: 491215 - DNA, 20 bp, Artificial Sequence
  chemically synthesized
ctgtcctggccgagagtatg

SEQ ID NO: 491216 - DNA, 20 bp, Artificial Sequence
  chemically synthesized
atacaaagaaatgatatggg

SEQ ID NO: 491217 - DNA, 20 bp, Artificial Sequence
  chemically synthesized
agtatcaattttaaatactt

SEQ ID NO: 491218 - DNA, 20 bp, Artificial Sequence
  chemically synthesized
ttctatggtgatcttcaaaa

SEQ ID NO: 491219 - DNA, 20 bp, Artificial Sequence
  chemically synthesized
ctctattttgaagatcacca

SEQ ID NO: 491220 - DNA, 20 bp, Artificial Sequence
  chemically synthesized
tagaattagaaacaatgtaa

SEQ ID NO: 491221 - DNA, 20 bp, Artificial Sequence
  chemically synthesized
actataatttctttcaaaaa

SEQ ID NO: 491222 - DNA, 20 bp, Artificial Sequence
  chemically synthesized
agtccttggtttctatgttt

SEQ ID NO: 491223 - DNA, 20 bp, Artificial Sequence
  chemically synthesized
tgtttataagtggttcttct

SEQ ID NO: 491224 - DNA, 20 bp, Artificial Sequence
  chemically synthesized
gaagaaccacttataaacat

SEQ ID NO: 491225 - DNA, 20 bp, Artificial Sequence
  chemically synthesized
ttacctttatatgctaaatt

SEQ ID NO: 491226 - DNA, 20 bp, Artificial Sequence
  chemically synthesized
aatattgttaaaattggcaa

SEQ ID NO: 491227 - DNA, 20 bp, Artificial Sequence
  chemically synthesized
gaaacatatgccccactctc

SEQ ID NO: 491228 - DNA, 20 bp, Artificial Sequence
  chemically synthesized
ctacacagctatttattctg

SEQ ID NO: 491229 - DNA, 20 bp, Artificial Sequence
  chemically synthesized
tttcatattttaagaagaca

SEQ ID NO: 491230 - DNA, 20 bp, Artificial Sequence
  chemically synthesized
tcgcttctacataatagcct

SEQ ID NO: 491231 - DNA, 20 bp, Artificial Sequence
  chemically synthesized
ttgattgacaaccaacagta

SEQ ID NO: 491232 - DNA, 20 bp, Artificial Sequence
  chemically synthesized
ttgcctgcaagactgagcaa

SEQ ID NO: 491233 - DNA, 20 bp, Artificial Sequence
  chemically synthesized
aggtcaggaactgtctgatg

SEQ ID NO: 491234 - DNA, 20 bp, Artificial Sequence
  chemically synthesized
caaacaaagatgtacataca

SEQ ID NO: 491235 - DNA, 20 bp, Artificial Sequence
  chemically synthesized
atagggacaaaagaaaatca

SEQ ID NO: 491236 - DNA, 20 bp, Artificial Sequence
  chemically synthesized
aatcacgggatgctttcaca

SEQ ID NO: 491237 - DNA, 20 bp, Artificial Sequence
  chemically synthesized
tgctttcacagagaataatg

SEQ ID NO: 491238 - DNA, 20 bp, Artificial Sequence
  chemically synthesized
actaataatgctcaatagtt

SEQ ID NO: 491239 - DNA, 20 bp, Artificial Sequence
  chemically synthesized
gggagatgcacaaagaagaa

SEQ ID NO: 491240 - DNA, 20 bp, Artificial Sequence
  chemically synthesized
atacatgctgttttctccat

SEQ ID NO: 491241 - DNA, 20 bp, Artificial Sequence
  chemically synthesized
aaacagcatgtatgacgctc

SEQ ID NO: 491242 - DNA, 20 bp, Artificial Sequence
  chemically synthesized
caggaaggaactttatatgc

SEQ ID NO: 491243 - DNA, 20 bp, Artificial Sequence
  chemically synthesized
taaagaagctgaaagaaaac

SEQ ID NO: 491244 - DNA, 20 bp, Artificial Sequence
  chemically synthesized
acgagaatggttggagcccc

SEQ ID NO: 491245 - DNA, 20 bp, Artificial Sequence
  chemically synthesized
ttggagccccttgaatgaag

SEQ ID NO: 491246 - DNA, 20 bp, Artificial Sequence
  chemically synthesized
cccttgaatgaaggggagtg

SEQ ID NO: 491247 - DNA, 20 bp, Artificial Sequence
  chemically synthesized
caacatacagattcatgtac

SEQ ID NO: 491248 - DNA, 20 bp, Artificial Sequence
  chemically synthesized
tgcagtgaacatccttgtac

SEQ ID NO: 491249 - DNA, 20 bp, Artificial Sequence
  chemically synthesized
gtcccaatgcccaataatgg

SEQ ID NO: 491250 - DNA, 20 bp, Artificial Sequence
  chemically synthesized
aattatttacaatcacatct

SEQ ID NO: 491251 - DNA, 20 bp, Artificial Sequence
  chemically synthesized
ttttattgatgtttaataat

SEQ ID NO: 491252 - DNA, 20 bp, Artificial Sequence
  chemically synthesized
ttacaccttttgatgttttc

SEQ ID NO: 491253 - DNA, 20 bp, Artificial Sequence
  chemically synthesized
tcccataggttgccttctta

SEQ ID NO: 491254 - DNA, 20 bp, Artificial Sequence
  chemically synthesized
gttttgttttttttctgaga

SEQ ID NO: 491255 - DNA, 20 bp, Artificial Sequence
  chemically synthesized
gtctcgctctgtcaccaggc

SEQ ID NO: 491256 - DNA, 20 bp, Artificial Sequence
  chemically synthesized
aggcagaggttgcagtgagc

SEQ ID NO: 491257 - DNA, 20 bp, Artificial Sequence
  chemically synthesized
ctcactgcaacctctgcctc

SEQ ID NO: 491258 - DNA, 20 bp, Artificial Sequence
  chemically synthesized
tactcgggaggctgaggcag

SEQ ID NO: 491259 - DNA, 20 bp, Artificial Sequence
  chemically synthesized
gattctcctgcctcagcctc

SEQ ID NO: 491260 - DNA, 20 bp, Artificial Sequence
  chemically synthesized
ttttgtatttttagtagaga

SEQ ID NO: 491261 - DNA, 20 bp, Artificial Sequence
  chemically synthesized
acaccatcctggccaacatg

SEQ ID NO: 491262 - DNA, 20 bp, Artificial Sequence
  chemically synthesized
acgggattcaccatgttggc

SEQ ID NO: 491263 - DNA, 20 bp, Artificial Sequence
  chemically synthesized
acttcgggaggccaaggtgg

SEQ ID NO: 491264 - DNA, 20 bp, Artificial Sequence
  chemically synthesized
cagcacttcgggaggccaag

SEQ ID NO: 491265 - DNA, 20 bp, Artificial Sequence
  chemically synthesized
accttggcctcccgaagtgc

SEQ ID NO: 491266 - DNA, 20 bp, Artificial Sequence
  chemically synthesized
ctcaatgtgaacatgcatat

SEQ ID NO: 491267 - DNA, 20 bp, Artificial Sequence
  chemically synthesized
aaaatagtgagacaaaatgt

SEQ ID NO: 491268 - DNA, 20 bp, Artificial Sequence
  chemically synthesized
tccatttctatcatagttac

SEQ ID NO: 491269 - DNA, 20 bp, Artificial Sequence
  chemically synthesized
cctggtaactatgatagaaa

SEQ ID NO: 491270 - DNA, 20 bp, Artificial Sequence
  chemically synthesized
ataaatatagataatcgaga

SEQ ID NO: 491271 - DNA, 20 bp, Artificial Sequence
  chemically synthesized
acaattcagtagtgattttt

SEQ ID NO: 491272 - DNA, 20 bp, Artificial Sequence
  chemically synthesized
cctattctcaaaaatcacta

SEQ ID NO: 491273 - DNA, 20 bp, Artificial Sequence
  chemically synthesized
taattatttggcaaagcatg

SEQ ID NO: 491274 - DNA, 20 bp, Artificial Sequence
  chemically synthesized
taagacctttatttgtattc

SEQ ID NO: 491275 - DNA, 20 bp, Artificial Sequence
  chemically synthesized
ttgtttggcaattaagactc

SEQ ID NO: 491276 - DNA, 20 bp, Artificial Sequence
  chemically synthesized
tcaaacatttaccatttatt

SEQ ID NO: 491277 - DNA, 20 bp, Artificial Sequence
  chemically synthesized
atctcaaaacggctagaaga

SEQ ID NO: 491278 - DNA, 20 bp, Artificial Sequence
  chemically synthesized
caaagtcacgattagaaagg

SEQ ID NO: 491279 - DNA, 20 bp, Artificial Sequence
  chemically synthesized
gaatggggagaggattgtca

SEQ ID NO: 491280 - DNA, 20 bp, Artificial Sequence
  chemically synthesized
gggaaaagcgagaatgggga

SEQ ID NO: 491281 - DNA, 20 bp, Artificial Sequence
  chemically synthesized
gggggaagtaggggaaaagc

SEQ ID NO: 491282 - DNA, 20 bp, Artificial Sequence
  chemically synthesized
taaatggacggtggtcacca

SEQ ID NO: 491283 - DNA, 20 bp, Artificial Sequence
  chemically synthesized
gatgtttttagattgtgcat

SEQ ID NO: 491284 - DNA, 20 bp, Artificial Sequence
  chemically synthesized
agatatcatctcattccagt

SEQ ID NO: 491285 - DNA, 20 bp, Artificial Sequence
  chemically synthesized
ttgataatagccattctaac

SEQ ID NO: 491286 - DNA, 20 bp, Artificial Sequence
  chemically synthesized
aaaagataaaaagtgttggc

SEQ ID NO: 491287 - DNA, 20 bp, Artificial Sequence
  chemically synthesized
cattcccaccaacagtgcat

SEQ ID NO: 491288 - DNA, 20 bp, Artificial Sequence
  chemically synthesized
aacccttatgcactgttggt

SEQ ID NO: 491289 - DNA, 20 bp, Artificial Sequence
  chemically synthesized
cactgttggtgggaatgtaa

SEQ ID NO: 491290 - DNA, 20 bp, Artificial Sequence
  chemically synthesized
cctccataccgtcctccata

SEQ ID NO: 491291 - DNA, 20 bp, Artificial Sequence
  chemically synthesized
tttgtctctgtccccagtag

SEQ ID NO: 491292 - DNA, 20 bp, Artificial Sequence
  chemically synthesized
aataatgctgcaataaacat

SEQ ID NO: 491293 - DNA, 20 bp, Artificial Sequence
  chemically synthesized
gattctatatcttggctatt

SEQ ID NO: 491294 - DNA, 20 bp, Artificial Sequence
  chemically synthesized
tattcacaatagccaagata

SEQ ID NO: 491295 - DNA, 20 bp, Artificial Sequence
  chemically synthesized
atcaacttaagtgtttaata

SEQ ID NO: 491296 - DNA, 20 bp, Artificial Sequence
  chemically synthesized
acttaagtgtttaataatgg

SEQ ID NO: 491297 - DNA, 20 bp, Artificial Sequence
  chemically synthesized
aatattgcatatatatgcaa

SEQ ID NO: 491298 - DNA, 20 bp, Artificial Sequence
  chemically synthesized
atatatgcaatgggatatta

SEQ ID NO: 491299 - DNA, 20 bp, Artificial Sequence
  chemically synthesized
gatattattgagtcatataa

SEQ ID NO: 491300 - DNA, 20 bp, Artificial Sequence
  chemically synthesized
atccatgttgtcataaatga

SEQ ID NO: 491301 - DNA, 20 bp, Artificial Sequence
  chemically synthesized
atcctgtcatttatgacaac

SEQ ID NO: 491302 - DNA, 20 bp, Artificial Sequence
  chemically synthesized
atgacaacatggatgaacct

SEQ ID NO: 491303 - DNA, 20 bp, Artificial Sequence
  chemically synthesized
cgaggacattataacatttc

SEQ ID NO: 491304 - DNA, 20 bp, Artificial Sequence
  chemically synthesized
atgttataatgtcctcggtt

SEQ ID NO: 491305 - DNA, 20 bp, Artificial Sequence
  chemically synthesized
cctcggtttaggatattagc

SEQ ID NO: 491306 - DNA, 20 bp, Artificial Sequence
  chemically synthesized
gtttaggatattagcttgag

SEQ ID NO: 491307 - DNA, 20 bp, Artificial Sequence
  chemically synthesized
cttaaatagcactttttctt

SEQ ID NO: 491308 - DNA, 20 bp, Artificial Sequence
  chemically synthesized
accttggcctcccaaagtgc

SEQ ID NO: 491309 - DNA, 20 bp, Artificial Sequence
  chemically synthesized
cagcactttgggaggccaag

SEQ ID NO: 491310 - DNA, 20 bp, Artificial Sequence
  chemically synthesized
actttgggaggccaaggtgg

SEQ ID NO: 491311 - DNA, 20 bp, Artificial Sequence
  chemically synthesized
ttgtatttttttagtagaga

SEQ ID NO: 491312 - DNA, 20 bp, Artificial Sequence
  chemically synthesized
acaggcggccgccaccacgt

SEQ ID NO: 491313 - DNA, 20 bp, Artificial Sequence
  chemically synthesized
tacttgggaggctgaggcag

SEQ ID NO: 491314 - DNA, 20 bp, Artificial Sequence
  chemically synthesized
ctcactgcaagctccactgc

SEQ ID NO: 491315 - DNA, 20 bp, Artificial Sequence
  chemically synthesized
tctcactctgttgcccaggc

SEQ ID NO: 491316 - DNA, 20 bp, Artificial Sequence
  chemically synthesized
ctgcactccagcctgggcaa

SEQ ID NO: 491317 - DNA, 20 bp, Artificial Sequence
  chemically synthesized
ttttttttttttttttgaga

SEQ ID NO: 491318 - DNA, 20 bp, Artificial Sequence
  chemically synthesized
tatttaaaaatagcaacact

SEQ ID NO: 491319 - DNA, 20 bp, Artificial Sequence
  chemically synthesized
tctggtgtcctgaaagttat

SEQ ID NO: 491320 - DNA, 20 bp, Artificial Sequence
  chemically synthesized
gaaagtcacaattaaaaagg

SEQ ID NO: 491321 - DNA, 20 bp, Artificial Sequence
  chemically synthesized
aaggtgacctcaatttttca

SEQ ID NO: 491322 - DNA, 20 bp, Artificial Sequence
  chemically synthesized
ataccaattttataactttg

SEQ ID NO: 491323 - DNA, 20 bp, Artificial Sequence
  chemically synthesized
gagcacaagaacgtgagtgt

SEQ ID NO: 491324 - DNA, 20 bp, Artificial Sequence
  chemically synthesized
agaaatgagagcacaagaac

SEQ ID NO: 491325 - DNA, 20 bp, Artificial Sequence
  chemically synthesized
ttgtaataaattggctcatt

SEQ ID NO: 491326 - DNA, 20 bp, Artificial Sequence
  chemically synthesized
gaactacatcattggctttc

SEQ ID NO: 491327 - DNA, 20 bp, Artificial Sequence
  chemically synthesized
gccaatgatgtagttcctgt

SEQ ID NO: 491328 - DNA, 20 bp, Artificial Sequence
  chemically synthesized
aattgaaaccttgggtcttc

SEQ ID NO: 491329 - DNA, 20 bp, Artificial Sequence
  chemically synthesized
tttgagcttgaattgaaacc

SEQ ID NO: 491330 - DNA, 20 bp, Artificial Sequence
  chemically synthesized
atcttttcctgcctttgagc

SEQ ID NO: 491331 - DNA, 20 bp, Artificial Sequence
  chemically synthesized
aagctcaaaggcaggaaaag

SEQ ID NO: 491332 - DNA, 20 bp, Artificial Sequence
  chemically synthesized
tccagctttagctatcaggc

SEQ ID NO: 491333 - DNA, 20 bp, Artificial Sequence
  chemically synthesized
ggacttaggtcctcaattga

SEQ ID NO: 491334 - DNA, 20 bp, Artificial Sequence
  chemically synthesized
gattgttctcccttgtgtgg

SEQ ID NO: 491335 - DNA, 20 bp, Artificial Sequence
  chemically synthesized
agccgattgttctcccttgt

SEQ ID NO: 491336 - DNA, 20 bp, Artificial Sequence
  chemically synthesized
ctccctctactgattcaaat

SEQ ID NO: 491337 - DNA, 20 bp, Artificial Sequence
  chemically synthesized
gtttctggagagattcacat

SEQ ID NO: 491338 - DNA, 20 bp, Artificial Sequence
  chemically synthesized
aacagcctcataaacacacc

SEQ ID NO: 491339 - DNA, 20 bp, Artificial Sequence
  chemically synthesized
acatttggtcaaacattatt

SEQ ID NO: 491340 - DNA, 20 bp, Artificial Sequence
  chemically synthesized
gtgtcaacttggctgggccg

SEQ ID NO: 491341 - DNA, 20 bp, Artificial Sequence
  chemically synthesized
aaggaaaaaacacatcaggc

SEQ ID NO: 491342 - DNA, 20 bp, Artificial Sequence
  chemically synthesized
tcttcatgcattgaatacgg

SEQ ID NO: 491343 - DNA, 20 bp, Artificial Sequence
  chemically synthesized
atttgagctttcttcatgca

SEQ ID NO: 491344 - DNA, 20 bp, Artificial Sequence
  chemically synthesized
aatgcatgaagaaagctcaa

SEQ ID NO: 491345 - DNA, 20 bp, Artificial Sequence
  chemically synthesized
ttctgattgtggcagccaag

SEQ ID NO: 491346 - DNA, 20 bp, Artificial Sequence
  chemically synthesized
cggggaaaaaaacataaaga

SEQ ID NO: 491347 - DNA, 20 bp, Artificial Sequence
  chemically synthesized
cattgtatataagttcattt

SEQ ID NO: 491348 - DNA, 20 bp, Artificial Sequence
  chemically synthesized
aaattttagattattatttt

SEQ ID NO: 491349 - DNA, 20 bp, Artificial Sequence
  chemically synthesized
tctatttttaatgtagactc

SEQ ID NO: 491350 - DNA, 20 bp, Artificial Sequence
  chemically synthesized
acaaaccaacacatgtaccc

SEQ ID NO: 491351 - DNA, 20 bp, Artificial Sequence
  chemically synthesized
tacatgtgttggtttgttac

SEQ ID NO: 491352 - DNA, 20 bp, Artificial Sequence
  chemically synthesized
tatgttcactatctgggtga

SEQ ID NO: 491353 - DNA, 20 bp, Artificial Sequence
  chemically synthesized
ttgggtactatgttcactat

SEQ ID NO: 491354 - DNA, 20 bp, Artificial Sequence
  chemically synthesized
aagtgctgcaaaacttcctg

SEQ ID NO: 491355 - DNA, 20 bp, Artificial Sequence
  chemically synthesized
cctccctcccctcctccttt

SEQ ID NO: 491356 - DNA, 20 bp, Artificial Sequence
  chemically synthesized
gattaaagcaaatttccaac

SEQ ID NO: 491357 - DNA, 20 bp, Artificial Sequence
  chemically synthesized
ccctttgtacagttttttct

SEQ ID NO: 491358 - DNA, 20 bp, Artificial Sequence
  chemically synthesized
ttcatagaaaaaactgtaca

SEQ ID NO: 491359 - DNA, 20 bp, Artificial Sequence
  chemically synthesized
tcaacatgattttcatcatt

SEQ ID NO: 491360 - DNA, 20 bp, Artificial Sequence
  chemically synthesized
aactaaacacttcagtcctt

SEQ ID NO: 491361 - DNA, 20 bp, Artificial Sequence
  chemically synthesized
tttatgtaaatgccttttcc

SEQ ID NO: 491362 - DNA, 20 bp, Artificial Sequence
  chemically synthesized
tctgtttttatccacaacag

SEQ ID NO: 491363 - DNA, 20 bp, Artificial Sequence
  chemically synthesized
tttcctactactctactgtt

SEQ ID NO: 491364 - DNA, 20 bp, Artificial Sequence
  chemically synthesized
caataatgtacagtgacaaa

SEQ ID NO: 491365 - DNA, 20 bp, Artificial Sequence
  chemically synthesized
taaaactgtaccgcatgaaa

SEQ ID NO: 491366 - DNA, 20 bp, Artificial Sequence
  chemically synthesized
tgttttcgtatatttaatct

SEQ ID NO: 491367 - DNA, 20 bp, Artificial Sequence
  chemically synthesized
ctgccttacaccttgcttac

SEQ ID NO: 491368 - DNA, 20 bp, Artificial Sequence
  chemically synthesized
gtagcatactttacacgtgg

SEQ ID NO: 491369 - DNA, 20 bp, Artificial Sequence
  chemically synthesized
tgtaaagtatgctactaaat

SEQ ID NO: 491370 - DNA, 20 bp, Artificial Sequence
  chemically synthesized
gcttacatcttgtttcctca

SEQ ID NO: 491371 - DNA, 20 bp, Artificial Sequence
  chemically synthesized
atgtcatatttcaatacctg

SEQ ID NO: 491372 - DNA, 20 bp, Artificial Sequence
  chemically synthesized
gacaaacaaaaggtctacaa

SEQ ID NO: 491373 - DNA, 20 bp, Artificial Sequence
  chemically synthesized
ggtctacaaaagaataattt

SEQ ID NO: 491374 - DNA, 20 bp, Artificial Sequence
  chemically synthesized
tgaaaaccaatacaggtttt

SEQ ID NO: 491375 - DNA, 20 bp, Artificial Sequence
  chemically synthesized
taaaaagtgcaagaacacag

SEQ ID NO: 491376 - DNA, 20 bp, Artificial Sequence
  chemically synthesized
agattatattaaaacaggca

SEQ ID NO: 491377 - DNA, 20 bp, Artificial Sequence
  chemically synthesized
aacaggcattgaatatcagg

SEQ ID NO: 491378 - DNA, 20 bp, Artificial Sequence
  chemically synthesized
taccagatcttgtaaataga

SEQ ID NO: 491379 - DNA, 20 bp, Artificial Sequence
  chemically synthesized
ggctgatcacagtattataa

SEQ ID NO: 491380 - DNA, 20 bp, Artificial Sequence
  chemically synthesized
tcacagtattataaatggat

SEQ ID NO: 491381 - DNA, 20 bp, Artificial Sequence
  chemically synthesized
agtattataaatggattgga

SEQ ID NO: 491382 - DNA, 20 bp, Artificial Sequence
  chemically synthesized
cctgcaaaggaggagcaaaa

SEQ ID NO: 491383 - DNA, 20 bp, Artificial Sequence
  chemically synthesized
aggaacaggaagtcaattgt

SEQ ID NO: 491384 - DNA, 20 bp, Artificial Sequence
  chemically synthesized
atgactttggaggggagagc

SEQ ID NO: 491385 - DNA, 20 bp, Artificial Sequence
  chemically synthesized
ctttggaggggagagcaggg

SEQ ID NO: 491386 - DNA, 20 bp, Artificial Sequence
  chemically synthesized
ctactacctggacatgacat

SEQ ID NO: 491387 - DNA, 20 bp, Artificial Sequence
  chemically synthesized
gttggaacagagataaaaaa

SEQ ID NO: 491388 - DNA, 20 bp, Artificial Sequence
  chemically synthesized
gatgtaaacaaaggtgaggt

SEQ ID NO: 491389 - DNA, 20 bp, Artificial Sequence
  chemically synthesized
tgatgattttgacacatgag

SEQ ID NO: 491390 - DNA, 20 bp, Artificial Sequence
  chemically synthesized
catgagaggaataaaaaact

SEQ ID NO: 491391 - DNA, 20 bp, Artificial Sequence
  chemically synthesized
taggaatattacagaagcta

SEQ ID NO: 491392 - DNA, 20 bp, Artificial Sequence
  chemically synthesized
aaaaaaaaaaaaaaaggaag

SEQ ID NO: 491393 - DNA, 20 bp, Artificial Sequence
  chemically synthesized
ataaaatggcagagaagcca

SEQ ID NO: 491394 - DNA, 20 bp, Artificial Sequence
  chemically synthesized
gggcattccttaaatagctg

SEQ ID NO: 491395 - DNA, 20 bp, Artificial Sequence
  chemically synthesized
gtttattctacagctattta

SEQ ID NO: 491396 - DNA, 20 bp, Artificial Sequence
  chemically synthesized
gatacggcagtgagctctca

SEQ ID NO: 491397 - DNA, 20 bp, Artificial Sequence
  chemically synthesized
atgcatgatacaaggtgata

SEQ ID NO: 491398 - DNA, 20 bp, Artificial Sequence
  chemically synthesized
aaacgcagtgtaaggaagtg

SEQ ID NO: 491399 - DNA, 20 bp, Artificial Sequence
  chemically synthesized
agtggagagtgagaacagca

SEQ ID NO: 491400 - DNA, 20 bp, Artificial Sequence
  chemically synthesized
cttaccctctaacttccctc

SEQ ID NO: 491401 - DNA, 20 bp, Artificial Sequence
  chemically synthesized
gacactcctgagggaagtta

SEQ ID NO: 491402 - DNA, 20 bp, Artificial Sequence
  chemically synthesized
gaagttagagggtaagacgt

SEQ ID NO: 491403 - DNA, 20 bp, Artificial Sequence
  chemically synthesized
ggatagctgaagaaagaagg

SEQ ID NO: 491404 - DNA, 20 bp, Artificial Sequence
  chemically synthesized
gaaggttgaatttcagcagg

SEQ ID NO: 491405 - DNA, 20 bp, Artificial Sequence
  chemically synthesized
caaaaccaaatctatagaga

SEQ ID NO: 491406 - DNA, 20 bp, Artificial Sequence
  chemically synthesized
tctatagagagaggatagtg

SEQ ID NO: 491407 - DNA, 20 bp, Artificial Sequence
  chemically synthesized
ggatagtgaaggatttatgt

SEQ ID NO: 491408 - DNA, 20 bp, Artificial Sequence
  chemically synthesized
tgtgtagctagtttttctta

SEQ ID NO: 491409 - DNA, 20 bp, Artificial Sequence
  chemically synthesized
actggcttatcctcttgata

SEQ ID NO: 491410 - DNA, 20 bp, Artificial Sequence
  chemically synthesized
caccactaattccttatcaa

SEQ ID NO: 491411 - DNA, 20 bp, Artificial Sequence
  chemically synthesized
aatgttaggaagcaagaaat

SEQ ID NO: 491412 - DNA, 20 bp, Artificial Sequence
  chemically synthesized
catatttggagccaatgatg

SEQ ID NO: 491413 - DNA, 20 bp, Artificial Sequence
  chemically synthesized
tgttgtgggtggaggaggag

SEQ ID NO: 491414 - DNA, 20 bp, Artificial Sequence
  chemically synthesized
ttagtggaggaaggtttgtt

SEQ ID NO: 491415 - DNA, 20 bp, Artificial Sequence
  chemically synthesized
atatatacttttgtagagca

SEQ ID NO: 491416 - DNA, 20 bp, Artificial Sequence
  chemically synthesized
agagcagagggtgagaagag

SEQ ID NO: 491417 - DNA, 20 bp, Artificial Sequence
  chemically synthesized
gatttatttttaccttggta

SEQ ID NO: 491418 - DNA, 20 bp, Artificial Sequence
  chemically synthesized
aaagccagccaatctcttgg

SEQ ID NO: 491419 - DNA, 20 bp, Artificial Sequence
  chemically synthesized
aattatattttatttgcaga

SEQ ID NO: 491420 - DNA, 20 bp, Artificial Sequence
  chemically synthesized
tctgttctttacatttgtga

SEQ ID NO: 491421 - DNA, 20 bp, Artificial Sequence
  chemically synthesized
tacatctaagcagaagcgtg

SEQ ID NO: 491422 - DNA, 20 bp, Artificial Sequence
  chemically synthesized
cttgagtgtcattatgttca

SEQ ID NO: 491423 - DNA, 20 bp, Artificial Sequence
  chemically synthesized
aatttattggaaggatggcc

SEQ ID NO: 491424 - DNA, 20 bp, Artificial Sequence
  chemically synthesized
tttatagggtaatttattgg

SEQ ID NO: 491425 - DNA, 20 bp, Artificial Sequence
  chemically synthesized
aattttgaatggaagtttta

SEQ ID NO: 491426 - DNA, 20 bp, Artificial Sequence
  chemically synthesized
aacctgtaccatattaaatt

SEQ ID NO: 491427 - DNA, 20 bp, Artificial Sequence
  chemically synthesized
atttaatatggtacaggttg

SEQ ID NO: 491428 - DNA, 20 bp, Artificial Sequence
  chemically synthesized
gtagaggtagaaagaagacc

SEQ ID NO: 491429 - DNA, 20 bp, Artificial Sequence
  chemically synthesized
ttaccatcttttcctttacc

SEQ ID NO: 491430 - DNA, 20 bp, Artificial Sequence
  chemically synthesized
agatggtaattaagatttga

SEQ ID NO: 491431 - DNA, 20 bp, Artificial Sequence
  chemically synthesized
gcatactgataagattttcc

SEQ ID NO: 491432 - DNA, 20 bp, Artificial Sequence
  chemically synthesized
ttaggtcccttatcatagga

SEQ ID NO: 491433 - DNA, 20 bp, Artificial Sequence
  chemically synthesized
cctagcatttgaaaccgcta

SEQ ID NO: 491434 - DNA, 20 bp, Artificial Sequence
  chemically synthesized
ccttagcggtttcaaatgct

SEQ ID NO: 491435 - DNA, 20 bp, Artificial Sequence
  chemically synthesized
gatggaaacaaattcgactc

SEQ ID NO: 491436 - DNA, 20 bp, Artificial Sequence
  chemically synthesized
gcttgcttgccatccaggag

SEQ ID NO: 491437 - DNA, 20 bp, Artificial Sequence
  chemically synthesized
gtgcagcttgcttgccatcc

SEQ ID NO: 491438 - DNA, 20 bp, Artificial Sequence
  chemically synthesized
ggatggcaagcaagctgcac

SEQ ID NO: 491439 - DNA, 20 bp, Artificial Sequence
  chemically synthesized
gcaagcaagctgcactggga

SEQ ID NO: 491440 - DNA, 20 bp, Artificial Sequence
  chemically synthesized
caacacagagataagcgagg

SEQ ID NO: 491441 - DNA, 20 bp, Artificial Sequence
  chemically synthesized
tacagtctcaaaaggccaca

SEQ ID NO: 491442 - DNA, 20 bp, Artificial Sequence
  chemically synthesized
agactgtattatgtgaaatg

SEQ ID NO: 491443 - DNA, 20 bp, Artificial Sequence
  chemically synthesized
cacggtttctggtttttcat

SEQ ID NO: 491444 - DNA, 20 bp, Artificial Sequence
  chemically synthesized
caaaaaatgtagcaaataaa

SEQ ID NO: 491445 - DNA, 20 bp, Artificial Sequence
  chemically synthesized
agtgtttacatactggctga

SEQ ID NO: 491446 - DNA, 20 bp, Artificial Sequence
  chemically synthesized
ggctgaaagagtgaactgta

SEQ ID NO: 491447 - DNA, 20 bp, Artificial Sequence
  chemically synthesized
gaaaacagaccacgggctgg

SEQ ID NO: 491448 - DNA, 20 bp, Artificial Sequence
  chemically synthesized
acgggctggaagagtttgtc

SEQ ID NO: 491449 - DNA, 20 bp, Artificial Sequence
  chemically synthesized
gataacgggcattgaagcat

SEQ ID NO: 491450 - DNA, 20 bp, Artificial Sequence
  chemically synthesized
tgtaaataatgcaagctctt

SEQ ID NO: 491451 - DNA, 20 bp, Artificial Sequence
  chemically synthesized
aaaattatcatgctgtcgag

SEQ ID NO: 491452 - DNA, 20 bp, Artificial Sequence
  chemically synthesized
tagctaaaattatcatgctg

SEQ ID NO: 491453 - DNA, 20 bp, Artificial Sequence
  chemically synthesized
agtttatggagtcttgtgga

SEQ ID NO: 491454 - DNA, 20 bp, Artificial Sequence
  chemically synthesized
cagctttcttctttagttta

SEQ ID NO: 491455 - DNA, 20 bp, Artificial Sequence
  chemically synthesized
taaactaaagaagaaagctg

SEQ ID NO: 491456 - DNA, 20 bp, Artificial Sequence
  chemically synthesized
cgcttctaacagttggcgtt

SEQ ID NO: 491457 - DNA, 20 bp, Artificial Sequence
  chemically synthesized
ggcaatgtcatgggcaacta

SEQ ID NO: 491458 - DNA, 20 bp, Artificial Sequence
  chemically synthesized
agattttgcagcacttaaac

SEQ ID NO: 491459 - DNA, 20 bp, Artificial Sequence
  chemically synthesized
tgtctaaccatgctaaaaat

SEQ ID NO: 491460 - DNA, 20 bp, Artificial Sequence
  chemically synthesized
tgtactttgtgttttgtcaa

SEQ ID NO: 491461 - DNA, 20 bp, Artificial Sequence
  chemically synthesized
aaacacaaagtacaatgact

SEQ ID NO: 491462 - DNA, 20 bp, Artificial Sequence
  chemically synthesized
ggggaagggacagcgttcat

SEQ ID NO: 491463 - DNA, 20 bp, Artificial Sequence
  chemically synthesized
tgtttatttcattggtgtta

SEQ ID NO: 491464 - DNA, 20 bp, Artificial Sequence
  chemically synthesized
actgttttccagatgatacg

SEQ ID NO: 491465 - DNA, 20 bp, Artificial Sequence
  chemically synthesized
tccagttagtctgtgtcact

SEQ ID NO: 491466 - DNA, 20 bp, Artificial Sequence
  chemically synthesized
tcatttgcagaacaagactt

SEQ ID NO: 491467 - DNA, 20 bp, Artificial Sequence
  chemically synthesized
gtgcctactcctgtataact

SEQ ID NO: 491468 - DNA, 20 bp, Artificial Sequence
  chemically synthesized
ggttttattccaagttatac

SEQ ID NO: 491469 - DNA, 20 bp, Artificial Sequence
  chemically synthesized
ttatatctgcccttagcact

SEQ ID NO: 491470 - DNA, 20 bp, Artificial Sequence
  chemically synthesized
ctatatatgtgcgattaatc

SEQ ID NO: 491471 - DNA, 20 bp, Artificial Sequence
  chemically synthesized
aatcgcacatatatagggaa

SEQ ID NO: 491472 - DNA, 20 bp, Artificial Sequence
  chemically synthesized
ctttgagaaccaagtgacaa

SEQ ID NO: 491473 - DNA, 20 bp, Artificial Sequence
  chemically synthesized
agtgaacgcgaaagaaactg

SEQ ID NO: 491474 - DNA, 20 bp, Artificial Sequence
  chemically synthesized
aaagaaactgaagaattcaa

SEQ ID NO: 491475 - DNA, 20 bp, Artificial Sequence
  chemically synthesized
ctgaagaattcaaaggggtc

SEQ ID NO: 491476 - DNA, 20 bp, Artificial Sequence
  chemically synthesized
aagaaatatccatgacccct

SEQ ID NO: 491477 - DNA, 20 bp, Artificial Sequence
  chemically synthesized
atagttgtttggtagagatg

SEQ ID NO: 491478 - DNA, 20 bp, Artificial Sequence
  chemically synthesized
gagttgataagcacgtaagg

SEQ ID NO: 491479 - DNA, 20 bp, Artificial Sequence
  chemically synthesized
tcctctccctagggccgcaa

SEQ ID NO: 491480 - DNA, 20 bp, Artificial Sequence
  chemically synthesized
ctcacttgcggccctaggga

SEQ ID NO: 491481 - DNA, 20 bp, Artificial Sequence
  chemically synthesized
agcacacagatacacacaga

SEQ ID NO: 491482 - DNA, 20 bp, Artificial Sequence
  chemically synthesized
ctcttgccctttttcagtaa

SEQ ID NO: 491483 - DNA, 20 bp, Artificial Sequence
  chemically synthesized
gaggtagtaaagtaagtcca

SEQ ID NO: 491484 - DNA, 20 bp, Artificial Sequence
  chemically synthesized
gtaagtccacagagtgaaaa

SEQ ID NO: 491485 - DNA, 20 bp, Artificial Sequence
  chemically synthesized
taatgcatcttttcaaccaa

SEQ ID NO: 491486 - DNA, 20 bp, Artificial Sequence
  chemically synthesized
tgaaaagatgcattatcata

SEQ ID NO: 491487 - DNA, 20 bp, Artificial Sequence
  chemically synthesized
tacaagtgtcaataggtttg

SEQ ID NO: 491488 - DNA, 20 bp, Artificial Sequence
  chemically synthesized
tataggaagttgcacggaag

SEQ ID NO: 491489 - DNA, 20 bp, Artificial Sequence
  chemically synthesized
aaggtaataagtgctcatta

SEQ ID NO: 491490 - DNA, 20 bp, Artificial Sequence
  chemically synthesized
attgaaaagttttacatttt

SEQ ID NO: 491491 - DNA, 20 bp, Artificial Sequence
  chemically synthesized
gctttatctatttttctttg

SEQ ID NO: 491492 - DNA, 20 bp, Artificial Sequence
  chemically synthesized
aagggaggagggagggagag

SEQ ID NO: 491493 - DNA, 20 bp, Artificial Sequence
  chemically synthesized
gagggaaagttaatttgctc

SEQ ID NO: 491494 - DNA, 20 bp, Artificial Sequence
  chemically synthesized
gagcaaattaactttccctc

SEQ ID NO: 491495 - DNA, 20 bp, Artificial Sequence
  chemically synthesized
attgatgataattaagaaaa

SEQ ID NO: 491496 - DNA, 20 bp, Artificial Sequence
  chemically synthesized
ctttagctaatatgaaaata

SEQ ID NO: 491497 - DNA, 20 bp, Artificial Sequence
  chemically synthesized
catccaactgcaaagttgta

SEQ ID NO: 491498 - DNA, 20 bp, Artificial Sequence
  chemically synthesized
gatccagtacaactttgcag

SEQ ID NO: 491499 - DNA, 20 bp, Artificial Sequence
  chemically synthesized
tagaaggggccacattcatg

SEQ ID NO: 491500 - DNA, 20 bp, Artificial Sequence
  chemically synthesized
acgaggtcttgagattcacc

SEQ ID NO: 491501 - DNA, 20 bp, Artificial Sequence
  chemically synthesized
caaatgtcctgtgtactatt

SEQ ID NO: 491502 - DNA, 20 bp, Artificial Sequence
  chemically synthesized
gcagtcacgtttgtagattt

SEQ ID NO: 491503 - DNA, 20 bp, Artificial Sequence
  chemically synthesized
acgccttaacaaaagcaccc

SEQ ID NO: 491504 - DNA, 20 bp, Artificial Sequence
  chemically synthesized
tataaagccatggccgattc

SEQ ID NO: 491505 - DNA, 20 bp, Artificial Sequence
  chemically synthesized
ttggaaaaaaagaaaataac

SEQ ID NO: 491506 - DNA, 20 bp, Artificial Sequence
  chemically synthesized
aaaaagaaaataacgtgaat

SEQ ID NO: 491507 - DNA, 20 bp, Artificial Sequence
  chemically synthesized
attagcactaatactattgg

SEQ ID NO: 491508 - DNA, 20 bp, Artificial Sequence
  chemically synthesized
gtaatcaacatgacataagt

SEQ ID NO: 491509 - DNA, 20 bp, Artificial Sequence
  chemically synthesized
atctttgaaataccaaaact

SEQ ID NO: 491510 - DNA, 20 bp, Artificial Sequence
  chemically synthesized
ctcaacaatatctttcttct

SEQ ID NO: 491511 - DNA, 20 bp, Artificial Sequence
  chemically synthesized
ttcttctcagggtaatcata

SEQ ID NO: 491512 - DNA, 20 bp, Artificial Sequence
  chemically synthesized
agggtaatcatagtgaatat

SEQ ID NO: 491513 - DNA, 20 bp, Artificial Sequence
  chemically synthesized
aagaacagtaggtaatttga

SEQ ID NO: 491514 - DNA, 20 bp, Artificial Sequence
  chemically synthesized
gcagtttggaataatgacca

SEQ ID NO: 491515 - DNA, 20 bp, Artificial Sequence
  chemically synthesized
cattactgtccctcgcagtt

SEQ ID NO: 491516 - DNA, 20 bp, Artificial Sequence
  chemically synthesized
ccaaactgcgagggacagta

SEQ ID NO: 491517 - DNA, 20 bp, Artificial Sequence
  chemically synthesized
gtttgcctttcgaatagtgt

SEQ ID NO: 491518 - DNA, 20 bp, Artificial Sequence
  chemically synthesized
tctctgtaatagtttgcctt

SEQ ID NO: 491519 - DNA, 20 bp, Artificial Sequence
  chemically synthesized
tcgaaaggcaaactattaca

SEQ ID NO: 491520 - DNA, 20 bp, Artificial Sequence
  chemically synthesized
tgtgccactcacaacttagg

SEQ ID NO: 491521 - DNA, 20 bp, Artificial Sequence
  chemically synthesized
tgttacacccttcctaagtt

SEQ ID NO: 491522 - DNA, 20 bp, Artificial Sequence
  chemically synthesized
aattgtagtactttatctag

SEQ ID NO: 491523 - DNA, 20 bp, Artificial Sequence
  chemically synthesized
aaattcagtgctaaaaaaat

SEQ ID NO: 491524 - DNA, 20 bp, Artificial Sequence
  chemically synthesized
aaatccacatttttttagca

SEQ ID NO: 491525 - DNA, 20 bp, Artificial Sequence
  chemically synthesized
aagtttaaggtatcaagcct

SEQ ID NO: 491526 - DNA, 20 bp, Artificial Sequence
  chemically synthesized
aggcttgataccttaaactt

SEQ ID NO: 491527 - DNA, 20 bp, Artificial Sequence
  chemically synthesized
ctgcaacgctacgtaaggct

SEQ ID NO: 491528 - DNA, 20 bp, Artificial Sequence
  chemically synthesized
ccaaaacaataaaaaccatg

SEQ ID NO: 491529 - DNA, 20 bp, Artificial Sequence
  chemically synthesized
aaaccatgttgaattaatta

SEQ ID NO: 491530 - DNA, 20 bp, Artificial Sequence
  chemically synthesized
catgttgaattaattagtga

SEQ ID NO: 491531 - DNA, 20 bp, Artificial Sequence
  chemically synthesized
aattagtgagtgagtgaaca

SEQ ID NO: 491532 - DNA, 20 bp, Artificial Sequence
  chemically synthesized
tgtagaagtagataataagc

SEQ ID NO: 491533 - DNA, 20 bp, Artificial Sequence
  chemically synthesized
ggaaagggcagtatgctttc

SEQ ID NO: 491534 - DNA, 20 bp, Artificial Sequence
  chemically synthesized
tatatcttccattccacaat

SEQ ID NO: 491535 - DNA, 20 bp, Artificial Sequence
  chemically synthesized
aaagagctgaacccacattg

SEQ ID NO: 491536 - DNA, 20 bp, Artificial Sequence
  chemically synthesized
cttgactaaggttcttctga

SEQ ID NO: 491537 - DNA, 20 bp, Artificial Sequence
  chemically synthesized
gctgcaaagaggtgcctgaa

SEQ ID NO: 491538 - DNA, 20 bp, Artificial Sequence
  chemically synthesized
gcaggcagcagaattttctt

SEQ ID NO: 491539 - DNA, 20 bp, Artificial Sequence
  chemically synthesized
attcttgccaatgcaggcag

SEQ ID NO: 491540 - DNA, 20 bp, Artificial Sequence
  chemically synthesized
attctgctgcctgcattggc

SEQ ID NO: 491541 - DNA, 20 bp, Artificial Sequence
  chemically synthesized
tgcagtatacagagtggctt

SEQ ID NO: 491542 - DNA, 20 bp, Artificial Sequence
  chemically synthesized
ttcacataagatgcagtata

SEQ ID NO: 491543 - DNA, 20 bp, Artificial Sequence
  chemically synthesized
ctctgtatactgcatcttat

SEQ ID NO: 491544 - DNA, 20 bp, Artificial Sequence
  chemically synthesized
tatcatttgtatattcaatc

SEQ ID NO: 491545 - DNA, 20 bp, Artificial Sequence
  chemically synthesized
gcaaattgatttattcaaga

SEQ ID NO: 491546 - DNA, 20 bp, Artificial Sequence
  chemically synthesized
gaataaatcaatttgccctc

SEQ ID NO: 491547 - DNA, 20 bp, Artificial Sequence
  chemically synthesized
atgatcttcgtctataaaat

SEQ ID NO: 491548 - DNA, 20 bp, Artificial Sequence
  chemically synthesized
aggcaacctaggtggcacac

SEQ ID NO: 491549 - DNA, 20 bp, Artificial Sequence
  chemically synthesized
ctggtgcgagacctgagaat

SEQ ID NO: 491550 - DNA, 20 bp, Artificial Sequence
  chemically synthesized
atttttctggtgcgagacct

SEQ ID NO: 491551 - DNA, 20 bp, Artificial Sequence
  chemically synthesized
tcgcaccagaaaaatcaaat

SEQ ID NO: 491552 - DNA, 20 bp, Artificial Sequence
  chemically synthesized
ttttgtttttttagagcttc

SEQ ID NO: 491553 - DNA, 20 bp, Artificial Sequence
  chemically synthesized
tttcaatcttagctacaagt

SEQ ID NO: 491554 - DNA, 20 bp, Artificial Sequence
  chemically synthesized
gtgacaacaattagtgttta

SEQ ID NO: 491555 - DNA, 20 bp, Artificial Sequence
  chemically synthesized
taaacactaattgttgtcac

SEQ ID NO: 491556 - DNA, 20 bp, Artificial Sequence
  chemically synthesized
tgttgtcacctgagtaaatt

SEQ ID NO: 491557 - DNA, 20 bp, Artificial Sequence
  chemically synthesized
ggcctaaagttatatatttc

SEQ ID NO: 491558 - DNA, 20 bp, Artificial Sequence
  chemically synthesized
atgaaaactggtagcaaatt

SEQ ID NO: 491559 - DNA, 20 bp, Artificial Sequence
  chemically synthesized
gccatccatgcctgaaaata

SEQ ID NO: 491560 - DNA, 20 bp, Artificial Sequence
  chemically synthesized
attactcagtattttcaggc

SEQ ID NO: 491561 - DNA, 20 bp, Artificial Sequence
  chemically synthesized
gcatggatggctccatagtt

SEQ ID NO: 491562 - DNA, 20 bp, Artificial Sequence
  chemically synthesized
ttttcattattaaaagcagg

SEQ ID NO: 491563 - DNA, 20 bp, Artificial Sequence
  chemically synthesized
tttaagtgataatccctaaa

SEQ ID NO: 491564 - DNA, 20 bp, Artificial Sequence
  chemically synthesized
tctgccaggaaatccttttt

SEQ ID NO: 491565 - DNA, 20 bp, Artificial Sequence
  chemically synthesized
ccctaaaaaggatttcctgg

SEQ ID NO: 491566 - DNA, 20 bp, Artificial Sequence
  chemically synthesized
tttatatcataagagcgtat

SEQ ID NO: 491567 - DNA, 20 bp, Artificial Sequence
  chemically synthesized
cataagagcgtatgggagtt

SEQ ID NO: 491568 - DNA, 20 bp, Artificial Sequence
  chemically synthesized
gagttaagaataattatgca

SEQ ID NO: 491569 - DNA, 20 bp, Artificial Sequence
  chemically synthesized
aaagagcttaaagcacttta

SEQ ID NO: 491570 - DNA, 20 bp, Artificial Sequence
  chemically synthesized
atagtgtgaacattaattag

SEQ ID NO: 491571 - DNA, 20 bp, Artificial Sequence
  chemically synthesized
tcactgtccactgccttctc

SEQ ID NO: 491572 - DNA, 20 bp, Artificial Sequence
  chemically synthesized
cagtggacagtgaagcatgg

SEQ ID NO: 491573 - DNA, 20 bp, Artificial Sequence
  chemically synthesized
aatcttaccctctcaaggca

SEQ ID NO: 491574 - DNA, 20 bp, Artificial Sequence
  chemically synthesized
gctcccattccatgccttga

SEQ ID NO: 491575 - DNA, 20 bp, Artificial Sequence
  chemically synthesized
aagattaaacccagcaaacg

SEQ ID NO: 491576 - DNA, 20 bp, Artificial Sequence
  chemically synthesized
ctacactaactctgcgtttg

SEQ ID NO: 491577 - DNA, 20 bp, Artificial Sequence
  chemically synthesized
ggaagaaacgtataaatcag

SEQ ID NO: 491578 - DNA, 20 bp, Artificial Sequence
  chemically synthesized
cagctgagtttctttaccct

SEQ ID NO: 491579 - DNA, 20 bp, Artificial Sequence
  chemically synthesized
gttaggatacttgaaatcca

SEQ ID NO: 491580 - DNA, 20 bp, Artificial Sequence
  chemically synthesized
gtttttgtgtttttaactgt

SEQ ID NO: 491581 - DNA, 20 bp, Artificial Sequence
  chemically synthesized
ttctaaaatgccagagcatc

SEQ ID NO: 491582 - DNA, 20 bp, Artificial Sequence
  chemically synthesized
caatgcttaccatttattgt

SEQ ID NO: 491583 - DNA, 20 bp, Artificial Sequence
  chemically synthesized
cagtcagatctgggtaacat

SEQ ID NO: 491584 - DNA, 20 bp, Artificial Sequence
  chemically synthesized
ctaaaagtacacagtcagat

SEQ ID NO: 491585 - DNA, 20 bp, Artificial Sequence
  chemically synthesized
tctggtggagaaaaagatag

SEQ ID NO: 491586 - DNA, 20 bp, Artificial Sequence
  chemically synthesized
ggagaaaaagatagaaggat

SEQ ID NO: 491587 - DNA, 20 bp, Artificial Sequence
  chemically synthesized
ccacagttcagcttttccac

SEQ ID NO: 491588 - DNA, 20 bp, Artificial Sequence
  chemically synthesized
taacctggtcagattttctt

SEQ ID NO: 491589 - DNA, 20 bp, Artificial Sequence
  chemically synthesized
cttcagaataaaattaataa

SEQ ID NO: 491590 - DNA, 20 bp, Artificial Sequence
  chemically synthesized
aatgaaattgtaagccttct

SEQ ID NO: 491591 - DNA, 20 bp, Artificial Sequence
  chemically synthesized
ataagtattcttttatgtct

SEQ ID NO: 491592 - DNA, 20 bp, Artificial Sequence
  chemically synthesized
tggcacattcaaagacataa

SEQ ID NO: 491593 - DNA, 20 bp, Artificial Sequence
  chemically synthesized
atttcacagattatgcattg

SEQ ID NO: 491594 - DNA, 20 bp, Artificial Sequence
  chemically synthesized
atcatgtctccagtgtatgg

SEQ ID NO: 491595 - DNA, 20 bp, Artificial Sequence
  chemically synthesized
attgatcatgtctccagtgt

SEQ ID NO: 491596 - DNA, 20 bp, Artificial Sequence
  chemically synthesized
cctactatgaaagtgatgag

SEQ ID NO: 491597 - DNA, 20 bp, Artificial Sequence
  chemically synthesized
tctcatcactttcatagtag

SEQ ID NO: 491598 - DNA, 20 bp, Artificial Sequence
  chemically synthesized
tcatagtaggggaataacta

SEQ ID NO: 491599 - DNA, 20 bp, Artificial Sequence
  chemically synthesized
aaatttgtactgataatcat

SEQ ID NO: 491600 - DNA, 20 bp, Artificial Sequence
  chemically synthesized
atcttaaaagatgaacatca

SEQ ID NO: 491601 - DNA, 20 bp, Artificial Sequence
  chemically synthesized
agtcaagagttagtacaaag

SEQ ID NO: 491602 - DNA, 20 bp, Artificial Sequence
  chemically synthesized
taaatgggaaagtatgagtc

SEQ ID NO: 491603 - DNA, 20 bp, Artificial Sequence
  chemically synthesized
gttactttaaatgggaaagt

SEQ ID NO: 491604 - DNA, 20 bp, Artificial Sequence
  chemically synthesized
aactgtttattaattgaaca

SEQ ID NO: 491605 - DNA, 20 bp, Artificial Sequence
  chemically synthesized
tttataataccagctaataa

SEQ ID NO: 491606 - DNA, 20 bp, Artificial Sequence
  chemically synthesized
taataactggataagctctt

SEQ ID NO: 491607 - DNA, 20 bp, Artificial Sequence
  chemically synthesized
ccacaattttcaactgtacg

SEQ ID NO: 491608 - DNA, 20 bp, Artificial Sequence
  chemically synthesized
ccaacgtacagttgaaaatt

SEQ ID NO: 491609 - DNA, 20 bp, Artificial Sequence
  chemically synthesized
gcattgctatcaatttcagt

SEQ ID NO: 491610 - DNA, 20 bp, Artificial Sequence
  chemically synthesized
ttaaagcaaaataataccat

SEQ ID NO: 491611 - DNA, 20 bp, Artificial Sequence
  chemically synthesized
ttgaatttagttttagcctt

SEQ ID NO: 491612 - DNA, 20 bp, Artificial Sequence
  chemically synthesized
agtttggctaatcttaatca

SEQ ID NO: 491613 - DNA, 20 bp, Artificial Sequence
  chemically synthesized
cctaggcatgtctagaaagg

SEQ ID NO: 491614 - DNA, 20 bp, Artificial Sequence
  chemically synthesized
tagacatgcctagggactaa

SEQ ID NO: 491615 - DNA, 20 bp, Artificial Sequence
  chemically synthesized
tctcttttactgcaaaagga

SEQ ID NO: 491616 - DNA, 20 bp, Artificial Sequence
  chemically synthesized
aaggcaaagctctatagcca

SEQ ID NO: 491617 - DNA, 20 bp, Artificial Sequence
  chemically synthesized
atgagttaagaagttactta

SEQ ID NO: 491618 - DNA, 20 bp, Artificial Sequence
  chemically synthesized
aagttacttactgaattcca

SEQ ID NO: 491619 - DNA, 20 bp, Artificial Sequence
  chemically synthesized
gtataatatggaacaccctc

SEQ ID NO: 491620 - DNA, 20 bp, Artificial Sequence
  chemically synthesized
tgaacgtggcagtggttgaa

SEQ ID NO: 491621 - DNA, 20 bp, Artificial Sequence
  chemically synthesized
gtggttgaagtgggttctta

SEQ ID NO: 491622 - DNA, 20 bp, Artificial Sequence
  chemically synthesized
aagtggttctgaagtcgttt

SEQ ID NO: 491623 - DNA, 20 bp, Artificial Sequence
  chemically synthesized
agttgaaaagtaacttggtt

SEQ ID NO: 491624 - DNA, 20 bp, Artificial Sequence
  chemically synthesized
cttttcaactggtctctccc

SEQ ID NO: 491625 - DNA, 20 bp, Artificial Sequence
  chemically synthesized
attagccataaggttgttgt

SEQ ID NO: 491626 - DNA, 20 bp, Artificial Sequence
  chemically synthesized
acaacaaccttatggctaat

SEQ ID NO: 491627 - DNA, 20 bp, Artificial Sequence
  chemically synthesized
ccttatggctaatgaggatt

SEQ ID NO: 491628 - DNA, 20 bp, Artificial Sequence
  chemically synthesized
aaattctccatttctggatt

SEQ ID NO: 491629 - DNA, 20 bp, Artificial Sequence
  chemically synthesized
ggattcagaatccagaaatg

SEQ ID NO: 491630 - DNA, 20 bp, Artificial Sequence
  chemically synthesized
gaggaacaaattctccattt

SEQ ID NO: 491631 - DNA, 20 bp, Artificial Sequence
  chemically synthesized
tttgttcctctgaagaaagt

SEQ ID NO: 491632 - DNA, 20 bp, Artificial Sequence
  chemically synthesized
tgtggtcactatgatcacta

SEQ ID NO: 491633 - DNA, 20 bp, Artificial Sequence
  chemically synthesized
atagtgatcatagtgaccac

SEQ ID NO: 491634 - DNA, 20 bp, Artificial Sequence
  chemically synthesized
cttcaaattgataaataaaa

SEQ ID NO: 491635 - DNA, 20 bp, Artificial Sequence
  chemically synthesized
acatctgtttctaattgtgc

SEQ ID NO: 491636 - DNA, 20 bp, Artificial Sequence
  chemically synthesized
acaatggctttagatgcatg

SEQ ID NO: 491637 - DNA, 20 bp, Artificial Sequence
  chemically synthesized
aaaatgtacacttatagagt

SEQ ID NO: 491638 - DNA, 20 bp, Artificial Sequence
  chemically synthesized
gtgtttaaaatgtacactta

SEQ ID NO: 491639 - DNA, 20 bp, Artificial Sequence
  chemically synthesized
taatttcatgaagctttcct

SEQ ID NO: 491640 - DNA, 20 bp, Artificial Sequence
  chemically synthesized
atgctagtttttaacctcct

SEQ ID NO: 491641 - DNA, 20 bp, Artificial Sequence
  chemically synthesized
ctcaggtctgtgactattta

SEQ ID NO: 491642 - DNA, 20 bp, Artificial Sequence
  chemically synthesized
tgctaaagctttactatcac

SEQ ID NO: 491643 - DNA, 20 bp, Artificial Sequence
  chemically synthesized
aatatgatacattataacgc

SEQ ID NO: 491644 - DNA, 20 bp, Artificial Sequence
  chemically synthesized
atagaagctgtactttccag

SEQ ID NO: 491645 - DNA, 20 bp, Artificial Sequence
  chemically synthesized
gaacttgaaatgtgcttagt

SEQ ID NO: 491646 - DNA, 20 bp, Artificial Sequence
  chemically synthesized
atactgcatttctaacattg

SEQ ID NO: 491647 - DNA, 20 bp, Artificial Sequence
  chemically synthesized
tgaagaatgttctataagat

SEQ ID NO: 491648 - DNA, 20 bp, Artificial Sequence
  chemically synthesized
caacccctgccctcctcacc

SEQ ID NO: 491649 - DNA, 20 bp, Artificial Sequence
  chemically synthesized
ttatccctggtgaggagggc

SEQ ID NO: 491650 - DNA, 20 bp, Artificial Sequence
  chemically synthesized
gagggcaggggttgagcata

SEQ ID NO: 491651 - DNA, 20 bp, Artificial Sequence
  chemically synthesized
ctcaaaaatacagtgaacca

SEQ ID NO: 491652 - DNA, 20 bp, Artificial Sequence
  chemically synthesized
tatcagtggtttccaggggc

SEQ ID NO: 491653 - DNA, 20 bp, Artificial Sequence
  chemically synthesized
ggcaggagactgactgcaac

SEQ ID NO: 491654 - DNA, 20 bp, Artificial Sequence
  chemically synthesized
cctacaaccacgtccgtgat

SEQ ID NO: 491655 - DNA, 20 bp, Artificial Sequence
  chemically synthesized
tttttaaagtgtacagtttg

SEQ ID NO: 491656 - DNA, 20 bp, Artificial Sequence
  chemically synthesized
tatacctcaataaaacaaaa

SEQ ID NO: 491657 - DNA, 20 bp, Artificial Sequence
  chemically synthesized
aaaatttcatccttgacttt

SEQ ID NO: 491658 - DNA, 20 bp, Artificial Sequence
  chemically synthesized
gtttagtcactctaaaagtc

SEQ ID NO: 491659 - DNA, 20 bp, Artificial Sequence
  chemically synthesized
aataaaaatatttagaaatg

SEQ ID NO: 491660 - DNA, 20 bp, Artificial Sequence
  chemically synthesized
taggatgcatcaagtgtgct

SEQ ID NO: 491661 - DNA, 20 bp, Artificial Sequence
  chemically synthesized
cacagatttctaaaattgtc

SEQ ID NO: 491662 - DNA, 20 bp, Artificial Sequence
  chemically synthesized
actgctcagggaagacgcta

SEQ ID NO: 491663 - DNA, 20 bp, Artificial Sequence
  chemically synthesized
gattagagaatcagtggggt

SEQ ID NO: 491664 - DNA, 20 bp, Artificial Sequence
  chemically synthesized
aaaagtgattagagaatcag

SEQ ID NO: 491665 - DNA, 20 bp, Artificial Sequence
  chemically synthesized
ggtaaaatcaaaagtgatta

SEQ ID NO: 491666 - DNA, 20 bp, Artificial Sequence
  chemically synthesized
tcgatttaatccactattta

SEQ ID NO: 491667 - DNA, 20 bp, Artificial Sequence
  chemically synthesized
gaataggcactcaataaata

SEQ ID NO: 491668 - DNA, 20 bp, Artificial Sequence
  chemically synthesized
tagccatgaatttatacttc

SEQ ID NO: 491669 - DNA, 20 bp, Artificial Sequence
  chemically synthesized
catgtcagactggtatagcc

SEQ ID NO: 491670 - DNA, 20 bp, Artificial Sequence
  chemically synthesized
catgatttcactaatattat

SEQ ID NO: 491671 - DNA, 20 bp, Artificial Sequence
  chemically synthesized
cttttgtgcaatgtggaaat

SEQ ID NO: 491672 - DNA, 20 bp, Artificial Sequence
  chemically synthesized
tgactgttctgagaaacttt

SEQ ID NO: 491673 - DNA, 20 bp, Artificial Sequence
  chemically synthesized
agaaactttgagggttaact

SEQ ID NO: 491674 - DNA, 20 bp, Artificial Sequence
  chemically synthesized
tttgagggttaactaggaat

SEQ ID NO: 491675 - DNA, 20 bp, Artificial Sequence
  chemically synthesized
atcacaaggtttactttcca

SEQ ID NO: 491676 - DNA, 20 bp, Artificial Sequence
  chemically synthesized
ctggaaagtaaaccttgtga

SEQ ID NO: 491677 - DNA, 20 bp, Artificial Sequence
  chemically synthesized
tttctgtaagccgttccttt

SEQ ID NO: 491678 - DNA, 20 bp, Artificial Sequence
  chemically synthesized
ggtgcagcaggaacttgatt

SEQ ID NO: 491679 - DNA, 20 bp, Artificial Sequence
  chemically synthesized
ctgctctgaagattaacaag

SEQ ID NO: 491680 - DNA, 20 bp, Artificial Sequence
  chemically synthesized
cagcttgttaatcttcagag

SEQ ID NO: 491681 - DNA, 20 bp, Artificial Sequence
  chemically synthesized
actggaatttgtgaaagtaa

SEQ ID NO: 491682 - DNA, 20 bp, Artificial Sequence
  chemically synthesized
accatagaggcaacagcgac

SEQ ID NO: 491683 - DNA, 20 bp, Artificial Sequence
  chemically synthesized
acaaacacgaagtaatgaca

SEQ ID NO: 491684 - DNA, 20 bp, Artificial Sequence
  chemically synthesized
aaaggtatgtctctgcttat

SEQ ID NO: 491685 - DNA, 20 bp, Artificial Sequence
  chemically synthesized
ttatttttgcagacacttat

SEQ ID NO: 491686 - DNA, 20 bp, Artificial Sequence
  chemically synthesized
tattcaccaagaaaagtaga

SEQ ID NO: 491687 - DNA, 20 bp, Artificial Sequence
  chemically synthesized
aatcccatctacttttcttg

SEQ ID NO: 491688 - DNA, 20 bp, Artificial Sequence
  chemically synthesized
tctacttttcttggtgaata

SEQ ID NO: 491689 - DNA, 20 bp, Artificial Sequence
  chemically synthesized
gcatttgattatcttctcaa

SEQ ID NO: 491690 - DNA, 20 bp, Artificial Sequence
  chemically synthesized
atttctctcagtcctagaag

SEQ ID NO: 491691 - DNA, 20 bp, Artificial Sequence
  chemically synthesized
tagctgtgctacttatagac

SEQ ID NO: 491692 - DNA, 20 bp, Artificial Sequence
  chemically synthesized
ataagtagcacagctatgtc

SEQ ID NO: 491693 - DNA, 20 bp, Artificial Sequence
  chemically synthesized
ctggggtcttagtttttttt

SEQ ID NO: 491694 - DNA, 20 bp, Artificial Sequence
  chemically synthesized
tcttagtttttttttagaat

SEQ ID NO: 491695 - DNA, 20 bp, Artificial Sequence
  chemically synthesized
agggcctgagctctaggcct

SEQ ID NO: 491696 - DNA, 20 bp, Artificial Sequence
  chemically synthesized
agaggtaatctgtcctacat

SEQ ID NO: 491697 - DNA, 20 bp, Artificial Sequence
  chemically synthesized
catgtgaattaatgtgagga

SEQ ID NO: 491698 - DNA, 20 bp, Artificial Sequence
  chemically synthesized
aataaaccagttgaaagaca

SEQ ID NO: 491699 - DNA, 20 bp, Artificial Sequence
  chemically synthesized
atatatatggagaaagctaa

SEQ ID NO: 491700 - DNA, 20 bp, Artificial Sequence
  chemically synthesized
tctggtcctatggaaagtgt

SEQ ID NO: 491701 - DNA, 20 bp, Artificial Sequence
  chemically synthesized
atagacttaacttccaaact

SEQ ID NO: 491702 - DNA, 20 bp, Artificial Sequence
  chemically synthesized
gtttatgcattactttgttt

SEQ ID NO: 491703 - DNA, 20 bp, Artificial Sequence
  chemically synthesized
aatcaagaacctcttggggt

SEQ ID NO: 491704 - DNA, 20 bp, Artificial Sequence
  chemically synthesized
gagctaaatcaagaacctct

SEQ ID NO: 491705 - DNA, 20 bp, Artificial Sequence
  chemically synthesized
ttaaatttaactatctggtt

SEQ ID NO: 491706 - DNA, 20 bp, Artificial Sequence
  chemically synthesized
tatttggctaactaaaatca

SEQ ID NO: 491707 - DNA, 20 bp, Artificial Sequence
  chemically synthesized
actctgtgggtgtatttgcc

SEQ ID NO: 491708 - DNA, 20 bp, Artificial Sequence
  chemically synthesized
accctaggcaaatacaccca

SEQ ID NO: 491709 - DNA, 20 bp, Artificial Sequence
  chemically synthesized
ggcaaatacacccacagagt

SEQ ID NO: 491710 - DNA, 20 bp, Artificial Sequence
  chemically synthesized
tttgccaaaatcctcactct

SEQ ID NO: 491711 - DNA, 20 bp, Artificial Sequence
  chemically synthesized
gattgtttgctctcaaaaag

SEQ ID NO: 491712 - DNA, 20 bp, Artificial Sequence
  chemically synthesized
acttattataagaaaagccc

SEQ ID NO: 491713 - DNA, 20 bp, Artificial Sequence
  chemically synthesized
cagggcttttcttataataa

SEQ ID NO: 491714 - DNA, 20 bp, Artificial Sequence
  chemically synthesized
aagtgggtggtaaataattg

SEQ ID NO: 491715 - DNA, 20 bp, Artificial Sequence
  chemically synthesized
attctatcttttatagctct

SEQ ID NO: 491716 - DNA, 20 bp, Artificial Sequence
  chemically synthesized
actcttagagctataaaaga

SEQ ID NO: 491717 - DNA, 20 bp, Artificial Sequence
  chemically synthesized
gagctataaaagatagaatt

SEQ ID NO: 491718 - DNA, 20 bp, Artificial Sequence
  chemically synthesized
aattaactaaatcattttgt

SEQ ID NO: 491719 - DNA, 20 bp, Artificial Sequence
  chemically synthesized
caaggcaaatgtgaggccaa

SEQ ID NO: 491720 - DNA, 20 bp, Artificial Sequence
  chemically synthesized
aaagattcagtgtgggcaga

SEQ ID NO: 491721 - DNA, 20 bp, Artificial Sequence
  chemically synthesized
taaaattccttctgcccaca

SEQ ID NO: 491722 - DNA, 20 bp, Artificial Sequence
  chemically synthesized
acactgaatctttaaaaaca

SEQ ID NO: 491723 - DNA, 20 bp, Artificial Sequence
  chemically synthesized
actacggtcatttctttata

SEQ ID NO: 491724 - DNA, 20 bp, Artificial Sequence
  chemically synthesized
aagaaatgaccgtagttctc

SEQ ID NO: 491725 - DNA, 20 bp, Artificial Sequence
  chemically synthesized
atttaacccccacgcagcat

SEQ ID NO: 491726 - DNA, 20 bp, Artificial Sequence
  chemically synthesized
cttgaatccagatgctgcgt

SEQ ID NO: 491727 - DNA, 20 bp, Artificial Sequence
  chemically synthesized
ttatttttcttagcaaatgg

SEQ ID NO: 491728 - DNA, 20 bp, Artificial Sequence
  chemically synthesized
gaaaaataaggtcaaaattt

SEQ ID NO: 491729 - DNA, 20 bp, Artificial Sequence
  chemically synthesized
ttttagggtaagaaaataat

SEQ ID NO: 491730 - DNA, 20 bp, Artificial Sequence
  chemically synthesized
tttgacaacaaaactgtgat

SEQ ID NO: 491731 - DNA, 20 bp, Artificial Sequence
  chemically synthesized
taaataagttacttagcttc

SEQ ID NO: 491732 - DNA, 20 bp, Artificial Sequence
  chemically synthesized
ggtaattgtagtatagtgga

SEQ ID NO: 491733 - DNA, 20 bp, Artificial Sequence
  chemically synthesized
agtgtttttagatgtaaagt

SEQ ID NO: 491734 - DNA, 20 bp, Artificial Sequence
  chemically synthesized
atacatgattaatctatttt

SEQ ID NO: 491735 - DNA, 20 bp, Artificial Sequence
  chemically synthesized
tatcagagatattacaagtt

SEQ ID NO: 491736 - DNA, 20 bp, Artificial Sequence
  chemically synthesized
tattacaagttgagaattag

SEQ ID NO: 491737 - DNA, 20 bp, Artificial Sequence
  chemically synthesized
gtatgtcttttaataaatta

SEQ ID NO: 491738 - DNA, 20 bp, Artificial Sequence
  chemically synthesized
gtcttttaataaattacaga

SEQ ID NO: 491739 - DNA, 20 bp, Artificial Sequence
  chemically synthesized
agtgaatagtttaccaaatg

SEQ ID NO: 491740 - DNA, 20 bp, Artificial Sequence
  chemically synthesized
gcaaactttcagccacaaga

SEQ ID NO: 491741 - DNA, 20 bp, Artificial Sequence
  chemically synthesized
tcaataaaaaccacatatct

SEQ ID NO: 491742 - DNA, 20 bp, Artificial Sequence
  chemically synthesized
tacattttatgttaccatcc

SEQ ID NO: 491743 - DNA, 20 bp, Artificial Sequence
  chemically synthesized
atttcaagttactttgatcc

SEQ ID NO: 491744 - DNA, 20 bp, Artificial Sequence
  chemically synthesized
aggtaaataaatccttctgt

SEQ ID NO: 491745 - DNA, 20 bp, Artificial Sequence
  chemically synthesized
gttcatccttatcccaacag

SEQ ID NO: 491746 - DNA, 20 bp, Artificial Sequence
  chemically synthesized
ataaatccttctgttgggat

SEQ ID NO: 491747 - DNA, 20 bp, Artificial Sequence
  chemically synthesized
ataaggatgaacatgtccat

SEQ ID NO: 491748 - DNA, 20 bp, Artificial Sequence
  chemically synthesized
aacttgtgttaggcaagtga

SEQ ID NO: 491749 - DNA, 20 bp, Artificial Sequence
  chemically synthesized
aaagtgacaaagaataaaac

SEQ ID NO: 491750 - DNA, 20 bp, Artificial Sequence
  chemically synthesized
ggcagaaaaaaaaagtgaca

SEQ ID NO: 491751 - DNA, 20 bp, Artificial Sequence
  chemically synthesized
atgcagtatgtttcaacaga

SEQ ID NO: 491752 - DNA, 20 bp, Artificial Sequence
  chemically synthesized
ccttgtattttaaagttaaa

SEQ ID NO: 491753 - DNA, 20 bp, Artificial Sequence
  chemically synthesized
aggttaggcaaggcttttta

SEQ ID NO: 491754 - DNA, 20 bp, Artificial Sequence
  chemically synthesized
ctaaaaagccttgcctaacc

SEQ ID NO: 491755 - DNA, 20 bp, Artificial Sequence
  chemically synthesized
aaagccttgcctaacctaga

SEQ ID NO: 491756 - DNA, 20 bp, Artificial Sequence
  chemically synthesized
ttttagagtgcatgcagcag

SEQ ID NO: 491757 - DNA, 20 bp, Artificial Sequence
  chemically synthesized
ctagattttaatggaacttt

SEQ ID NO: 491758 - DNA, 20 bp, Artificial Sequence
  chemically synthesized
gcagcctgctgcagataaga

SEQ ID NO: 491759 - DNA, 20 bp, Artificial Sequence
  chemically synthesized
ctcagcagcctgctgcagat

SEQ ID NO: 491760 - DNA, 20 bp, Artificial Sequence
  chemically synthesized
caggtggaatcttctcttta

SEQ ID NO: 491761 - DNA, 20 bp, Artificial Sequence
  chemically synthesized
ctgtaaagagaagattccac

SEQ ID NO: 491762 - DNA, 20 bp, Artificial Sequence
  chemically synthesized
gagataaggtaagatccagg

SEQ ID NO: 491763 - DNA, 20 bp, Artificial Sequence
  chemically synthesized
tggctcccagtgtcagcgct

SEQ ID NO: 491764 - DNA, 20 bp, Artificial Sequence
  chemically synthesized
tcccagtgtcagcgctatga

SEQ ID NO: 491765 - DNA, 20 bp, Artificial Sequence
  chemically synthesized
aatgggtctcttgcaacagc

SEQ ID NO: 491766 - DNA, 20 bp, Artificial Sequence
  chemically synthesized
atctcacaccaagtttaata

SEQ ID NO: 491767 - DNA, 20 bp, Artificial Sequence
  chemically synthesized
gtgtgagatgagctagcatc

SEQ ID NO: 491768 - DNA, 20 bp, Artificial Sequence
  chemically synthesized
gtgggctcaagggggaaatt

SEQ ID NO: 491769 - DNA, 20 bp, Artificial Sequence
  chemically synthesized
agaattcatcaagatcagag

SEQ ID NO: 491770 - DNA, 20 bp, Artificial Sequence
  chemically synthesized
cgtattcctctctgatcttg

SEQ ID NO: 491771 - DNA, 20 bp, Artificial Sequence
  chemically synthesized
gatcttgatgaattctttct

SEQ ID NO: 491772 - DNA, 20 bp, Artificial Sequence
  chemically synthesized
ttgatgaattctttcttggg

SEQ ID NO: 491773 - DNA, 20 bp, Artificial Sequence
  chemically synthesized
ataacacatccatcccaaga

SEQ ID NO: 491774 - DNA, 20 bp, Artificial Sequence
  chemically synthesized
tcttgggatggatgtgttat

SEQ ID NO: 491775 - DNA, 20 bp, Artificial Sequence
  chemically synthesized
ttattaggataataaggctt

SEQ ID NO: 491776 - DNA, 20 bp, Artificial Sequence
  chemically synthesized
ttgagagttgaacaatgggc

SEQ ID NO: 491777 - DNA, 20 bp, Artificial Sequence
  chemically synthesized
agtggttagggaacatctca

SEQ ID NO: 491778 - DNA, 20 bp, Artificial Sequence
  chemically synthesized
tgagatgttccctaaccact

SEQ ID NO: 491779 - DNA, 20 bp, Artificial Sequence
  chemically synthesized
ggggagattggtgaaagagc

SEQ ID NO: 491780 - DNA, 20 bp, Artificial Sequence
  chemically synthesized
gtataaagatacaaaaaata

SEQ ID NO: 491781 - DNA, 20 bp, Artificial Sequence
  chemically synthesized
tcatttttctaaaccaataa

SEQ ID NO: 491782 - DNA, 20 bp, Artificial Sequence
  chemically synthesized
aacagagtacttctgtggga

SEQ ID NO: 491783 - DNA, 20 bp, Artificial Sequence
  chemically synthesized
ttatttatagtaccatgtat

SEQ ID NO: 491784 - DNA, 20 bp, Artificial Sequence
  chemically synthesized
tgaagcactttaatgaagtg

SEQ ID NO: 491785 - DNA, 20 bp, Artificial Sequence
  chemically synthesized
agacttaggaaatcagtctt

SEQ ID NO: 491786 - DNA, 20 bp, Artificial Sequence
  chemically synthesized
ataaactttagctttagacg

SEQ ID NO: 491787 - DNA, 20 bp, Artificial Sequence
  chemically synthesized
ctttagctttagacggtggg

SEQ ID NO: 491788 - DNA, 20 bp, Artificial Sequence
  chemically synthesized
tcagtaaaagcacctaagcc

SEQ ID NO: 491789 - DNA, 20 bp, Artificial Sequence
  chemically synthesized
agtcagtcttattatgtctg

SEQ ID NO: 491790 - DNA, 20 bp, Artificial Sequence
  chemically synthesized
acctttcaacaaagatcttt

SEQ ID NO: 491791 - DNA, 20 bp, Artificial Sequence
  chemically synthesized
aagatctttgttgaaaggtg

SEQ ID NO: 491792 - DNA, 20 bp, Artificial Sequence
  chemically synthesized
atactattacatagatatgg

SEQ ID NO: 491793 - DNA, 20 bp, Artificial Sequence
  chemically synthesized
gatatatagctgttggaaga

SEQ ID NO: 491794 - DNA, 20 bp, Artificial Sequence
  chemically synthesized
tctagatatatagctgttgg

SEQ ID NO: 491795 - DNA, 20 bp, Artificial Sequence
  chemically synthesized
tcttccaacagctatatatc

SEQ ID NO: 491796 - DNA, 20 bp, Artificial Sequence
  chemically synthesized
gtctttcatgtgaaatattg

SEQ ID NO: 491797 - DNA, 20 bp, Artificial Sequence
  chemically synthesized
gaaactaaatctctaagaaa

SEQ ID NO: 491798 - DNA, 20 bp, Artificial Sequence
  chemically synthesized
ttgttatttcctgtagctgt

SEQ ID NO: 491799 - DNA, 20 bp, Artificial Sequence
  chemically synthesized
gaggtatgctgcttcagtta

SEQ ID NO: 491800 - DNA, 20 bp, Artificial Sequence
  chemically synthesized
tttattattatttttagact

SEQ ID NO: 491801 - DNA, 20 bp, Artificial Sequence
  chemically synthesized
acacatccgatattttggtt

SEQ ID NO: 491802 - DNA, 20 bp, Artificial Sequence
  chemically synthesized
ataaatccaaaaccaaaata

SEQ ID NO: 491803 - DNA, 20 bp, Artificial Sequence
  chemically synthesized
ctttttagtaatttataacc

SEQ ID NO: 491804 - DNA, 20 bp, Artificial Sequence
  chemically synthesized
gcctttattactacattttc

SEQ ID NO: 491805 - DNA, 20 bp, Artificial Sequence
  chemically synthesized
cattttccagaattttcaag

SEQ ID NO: 491806 - DNA, 20 bp, Artificial Sequence
  chemically synthesized
aattttcaagggggatgtgg

SEQ ID NO: 491807 - DNA, 20 bp, Artificial Sequence
  chemically synthesized
ttcaagggggatgtggtggg

SEQ ID NO: 491808 - DNA, 20 bp, Artificial Sequence
  chemically synthesized
ggtgggatgaatagtttccc

SEQ ID NO: 491809 - DNA, 20 bp, Artificial Sequence
  chemically synthesized
agtcacatgtccctgaaacc

SEQ ID NO: 491810 - DNA, 20 bp, Artificial Sequence
  chemically synthesized
aatgtcaccagatttggaaa

SEQ ID NO: 491811 - DNA, 20 bp, Artificial Sequence
  chemically synthesized
ctttgaagatgtaattagtt

SEQ ID NO: 491812 - DNA, 20 bp, Artificial Sequence
  chemically synthesized
aatttcaaaatgacatcacc

SEQ ID NO: 491813 - DNA, 20 bp, Artificial Sequence
  chemically synthesized
aaatgacatcaccatgaatt

SEQ ID NO: 491814 - DNA, 20 bp, Artificial Sequence
  chemically synthesized
ccgcaaaaggacaccagtct

SEQ ID NO: 491815 - DNA, 20 bp, Artificial Sequence
  chemically synthesized
ggttccaagtctttgctatt

SEQ ID NO: 491816 - DNA, 20 bp, Artificial Sequence
  chemically synthesized
agtctatcattgttggacat

SEQ ID NO: 491817 - DNA, 20 bp, Artificial Sequence
  chemically synthesized
aaatgtccaacaatgataga

SEQ ID NO: 491818 - DNA, 20 bp, Artificial Sequence
  chemically synthesized
aatgtggcacatatacacca

SEQ ID NO: 491819 - DNA, 20 bp, Artificial Sequence
  chemically synthesized
tatgcagccataaaaaaatg

SEQ ID NO: 491820 - DNA, 20 bp, Artificial Sequence
  chemically synthesized
ttcatgttctttgtagagac

SEQ ID NO: 491821 - DNA, 20 bp, Artificial Sequence
  chemically synthesized
tgttcttgcgatagtttact

SEQ ID NO: 491822 - DNA, 20 bp, Artificial Sequence
  chemically synthesized
ttcaattcccacctgtgagt

SEQ ID NO: 491823 - DNA, 20 bp, Artificial Sequence
  chemically synthesized
gcatactctcactcacaggt

SEQ ID NO: 491824 - DNA, 20 bp, Artificial Sequence
  chemically synthesized
tcattgttcaattcccacct

SEQ ID NO: 491825 - DNA, 20 bp, Artificial Sequence
  chemically synthesized
caatgagaacacatggacac

SEQ ID NO: 491826 - DNA, 20 bp, Artificial Sequence
  chemically synthesized
ccccaccccacaacagtccc

SEQ ID NO: 491827 - DNA, 20 bp, Artificial Sequence
  chemically synthesized
tcacactctggggactgttg

SEQ ID NO: 491828 - DNA, 20 bp, Artificial Sequence
  chemically synthesized
tggggtggggggaggggggg

SEQ ID NO: 491829 - DNA, 20 bp, Artificial Sequence
  chemically synthesized
taatgctaaatgatgagcta

SEQ ID NO: 491830 - DNA, 20 bp, Artificial Sequence
  chemically synthesized
tattattatactttaagttt

SEQ ID NO: 491831 - DNA, 20 bp, Artificial Sequence
  chemically synthesized
ataataataataataaagaa

SEQ ID NO: 491832 - DNA, 20 bp, Artificial Sequence
  chemically synthesized
acagaaagacacacaaagaa

SEQ ID NO: 491833 - DNA, 20 bp, Artificial Sequence
  chemically synthesized
agaagctggaagaggcaagg

SEQ ID NO: 491834 - DNA, 20 bp, Artificial Sequence
  chemically synthesized
tccctctgaaggctctgggg

SEQ ID NO: 491835 - DNA, 20 bp, Artificial Sequence
  chemically synthesized
ttcttccccagagccttcag

SEQ ID NO: 491836 - DNA, 20 bp, Artificial Sequence
  chemically synthesized
cctagcttccagatttgtga

SEQ ID NO: 491837 - DNA, 20 bp, Artificial Sequence
  chemically synthesized
atgtaacaaattaccacaag

SEQ ID NO: 491838 - DNA, 20 bp, Artificial Sequence
  chemically synthesized
tgtgttaggaaacaattgca

SEQ ID NO: 491839 - DNA, 20 bp, Artificial Sequence
  chemically synthesized
ttcgtatgcacttggcaata

SEQ ID NO: 491840 - DNA, 20 bp, Artificial Sequence
  chemically synthesized
ccagagacacgtcaatctta

SEQ ID NO: 491841 - DNA, 20 bp, Artificial Sequence
  chemically synthesized
gactagacagtaactagaaa

SEQ ID NO: 491842 - DNA, 20 bp, Artificial Sequence
  chemically synthesized
gttcataatgttaagacttc

SEQ ID NO: 491843 - DNA, 20 bp, Artificial Sequence
  chemically synthesized
acctcataaattttaaaaat

SEQ ID NO: 491844 - DNA, 20 bp, Artificial Sequence
  chemically synthesized
taaaaatcagaataaagtct

SEQ ID NO: 491845 - DNA, 20 bp, Artificial Sequence
  chemically synthesized
attaaagactttactgttag

SEQ ID NO: 491846 - DNA, 20 bp, Artificial Sequence
  chemically synthesized
cagtaaagtctttaatctaa

SEQ ID NO: 491847 - DNA, 20 bp, Artificial Sequence
  chemically synthesized
aaatggatgatgaaaatgga

SEQ ID NO: 491848 - DNA, 20 bp, Artificial Sequence
  chemically synthesized
tagctagaaaattaagacta

SEQ ID NO: 491849 - DNA, 20 bp, Artificial Sequence
  chemically synthesized
tgatttgctactgcccattt

SEQ ID NO: 491850 - DNA, 20 bp, Artificial Sequence
  chemically synthesized
tctatactcatttacttctc

SEQ ID NO: 491851 - DNA, 20 bp, Artificial Sequence
  chemically synthesized
cttgcatccctgagaagtaa

SEQ ID NO: 491852 - DNA, 20 bp, Artificial Sequence
  chemically synthesized
aaaagctttcccttcccacc

SEQ ID NO: 491853 - DNA, 20 bp, Artificial Sequence
  chemically synthesized
aaatgttgaggctaggtgga

SEQ ID NO: 491854 - DNA, 20 bp, Artificial Sequence
  chemically synthesized
tgaggctaggtggaaagagt

SEQ ID NO: 491855 - DNA, 20 bp, Artificial Sequence
  chemically synthesized
ctaggtggaaagagttggaa

SEQ ID NO: 491856 - DNA, 20 bp, Artificial Sequence
  chemically synthesized
atttttgcaaatgatataaa

SEQ ID NO: 491857 - DNA, 20 bp, Artificial Sequence
  chemically synthesized
aatgatataaagagggtgat

SEQ ID NO: 491858 - DNA, 20 bp, Artificial Sequence
  chemically synthesized
taaagagggtgatatgaata

SEQ ID NO: 491859 - DNA, 20 bp, Artificial Sequence
  chemically synthesized
tgtggagctttgaagagaaa

SEQ ID NO: 491860 - DNA, 20 bp, Artificial Sequence
  chemically synthesized
ggaataatgattagcattta

SEQ ID NO: 491861 - DNA, 20 bp, Artificial Sequence
  chemically synthesized
ctcttgttggaattaaataa

SEQ ID NO: 491862 - DNA, 20 bp, Artificial Sequence
  chemically synthesized
ctcatttatttaattccaac

SEQ ID NO: 491863 - DNA, 20 bp, Artificial Sequence
  chemically synthesized
tcatactgcagaactcttgt

SEQ ID NO: 491864 - DNA, 20 bp, Artificial Sequence
  chemically synthesized
tccaacaagagttctgcagt

SEQ ID NO: 491865 - DNA, 20 bp, Artificial Sequence
  chemically synthesized
attttacaggtgaggtaatt

SEQ ID NO: 491866 - DNA, 20 bp, Artificial Sequence
  chemically synthesized
ggtgaggtaattgaggatca

SEQ ID NO: 491867 - DNA, 20 bp, Artificial Sequence
  chemically synthesized
ataggattaaaaaaaattac

SEQ ID NO: 491868 - DNA, 20 bp, Artificial Sequence
  chemically synthesized
cctgaatttacacagtatgt

SEQ ID NO: 491869 - DNA, 20 bp, Artificial Sequence
  chemically synthesized
ttttaggtccaagaatacaa

SEQ ID NO: 491870 - DNA, 20 bp, Artificial Sequence
  chemically synthesized
ccgttaggtcttttaggtcc

SEQ ID NO: 491871 - DNA, 20 bp, Artificial Sequence
  chemically synthesized
ggtgtggttgtataagcaaa

SEQ ID NO: 491872 - DNA, 20 bp, Artificial Sequence
  chemically synthesized
atagacttgaaagttttagt

SEQ ID NO: 491873 - DNA, 20 bp, Artificial Sequence
  chemically synthesized
ctataggaggtaagaggtgg

SEQ ID NO: 491874 - DNA, 20 bp, Artificial Sequence
  chemically synthesized
aatcatttaactgttcacag

SEQ ID NO: 491875 - DNA, 20 bp, Artificial Sequence
  chemically synthesized
gtggctgtgagctgaagatg

SEQ ID NO: 491876 - DNA, 20 bp, Artificial Sequence
  chemically synthesized
atggaggattaaaagagaag

SEQ ID NO: 491877 - DNA, 20 bp, Artificial Sequence
  chemically synthesized
gcaggatatcatagtctatg

SEQ ID NO: 491878 - DNA, 20 bp, Artificial Sequence
  chemically synthesized
acatgagcatgatggaacct

SEQ ID NO: 491879 - DNA, 20 bp, Artificial Sequence
  chemically synthesized
ttgaaaagtttgcatgaacc

SEQ ID NO: 491880 - DNA, 20 bp, Artificial Sequence
  chemically synthesized
catattctgactttcatatt

SEQ ID NO: 491881 - DNA, 20 bp, Artificial Sequence
  chemically synthesized
tgaacccagaatatgaaagt

SEQ ID NO: 491882 - DNA, 20 bp, Artificial Sequence
  chemically synthesized
aaaataatcatgtttgaata

SEQ ID NO: 491883 - DNA, 20 bp, Artificial Sequence
  chemically synthesized
gtttctaaaaataatcatgt

SEQ ID NO: 491884 - DNA, 20 bp, Artificial Sequence
  chemically synthesized
ttctagtcatgtgcaatctt

SEQ ID NO: 491885 - DNA, 20 bp, Artificial Sequence
  chemically synthesized
gaagaggtcaaaagtgtctg

SEQ ID NO: 491886 - DNA, 20 bp, Artificial Sequence
  chemically synthesized
gaaggataactgaaaataaa

SEQ ID NO: 491887 - DNA, 20 bp, Artificial Sequence
  chemically synthesized
atcttttagctgctattgct

SEQ ID NO: 491888 - DNA, 20 bp, Artificial Sequence
  chemically synthesized
aaaacgcactgattgtaatg

SEQ ID NO: 491889 - DNA, 20 bp, Artificial Sequence
  chemically synthesized
atttttaaaatccttcacga

SEQ ID NO: 491890 - DNA, 20 bp, Artificial Sequence
  chemically synthesized
attacttcaattcaatcgtg

SEQ ID NO: 491891 - DNA, 20 bp, Artificial Sequence
  chemically synthesized
gaataatgaagtaattttca

SEQ ID NO: 491892 - DNA, 20 bp, Artificial Sequence
  chemically synthesized
atctctgtccattttcttta

SEQ ID NO: 491893 - DNA, 20 bp, Artificial Sequence
  chemically synthesized
acttaagtctatgggcctga

SEQ ID NO: 491894 - DNA, 20 bp, Artificial Sequence
  chemically synthesized
aagtgaattagttatcatct

SEQ ID NO: 491895 - DNA, 20 bp, Artificial Sequence
  chemically synthesized
tatcaaactaagttcttcaa

SEQ ID NO: 491896 - DNA, 20 bp, Artificial Sequence
  chemically synthesized
tgatacatttagaggctcct

SEQ ID NO: 491897 - DNA, 20 bp, Artificial Sequence
  chemically synthesized
ttcttcaaaagaggttgcta

SEQ ID NO: 491898 - DNA, 20 bp, Artificial Sequence
  chemically synthesized
aagaggttgctacagagttc

SEQ ID NO: 491899 - DNA, 20 bp, Artificial Sequence
  chemically synthesized
atgtgacctttcaaataaat

SEQ ID NO: 491900 - DNA, 20 bp, Artificial Sequence
  chemically synthesized
ctatttttatcaccatgtgg

SEQ ID NO: 491901 - DNA, 20 bp, Artificial Sequence
  chemically synthesized
atactacctacctagttgag

SEQ ID NO: 491902 - DNA, 20 bp, Artificial Sequence
  chemically synthesized
ggtagtatggtatagcagaa

SEQ ID NO: 491903 - DNA, 20 bp, Artificial Sequence
  chemically synthesized
ggtatagcagaaacgagtcc

SEQ ID NO: 491904 - DNA, 20 bp, Artificial Sequence
  chemically synthesized
atcacacaattggtacatga

SEQ ID NO: 491905 - DNA, 20 bp, Artificial Sequence
  chemically synthesized
gctgagaaattaagacatat

SEQ ID NO: 491906 - DNA, 20 bp, Artificial Sequence
  chemically synthesized
ccaaacgcagttctagctgc

SEQ ID NO: 491907 - DNA, 20 bp, Artificial Sequence
  chemically synthesized
aatgtttgttaaattaacac

SEQ ID NO: 491908 - DNA, 20 bp, Artificial Sequence
  chemically synthesized
tttgttaaattaacacgtga

SEQ ID NO: 491909 - DNA, 20 bp, Artificial Sequence
  chemically synthesized
ttaaattaacacgtgaatga

SEQ ID NO: 491910 - DNA, 20 bp, Artificial Sequence
  chemically synthesized
aacacgtgaatgaatggata

SEQ ID NO: 491911 - DNA, 20 bp, Artificial Sequence
  chemically synthesized
cattcatgtgcttcatgtta

SEQ ID NO: 491912 - DNA, 20 bp, Artificial Sequence
  chemically synthesized
cattcagtaacatgaagcac

SEQ ID NO: 491913 - DNA, 20 bp, Artificial Sequence
  chemically synthesized
ccagatggtatttaatagat

SEQ ID NO: 491914 - DNA, 20 bp, Artificial Sequence
  chemically synthesized
ccatatctattaaataccat

SEQ ID NO: 491915 - DNA, 20 bp, Artificial Sequence
  chemically synthesized
ggatattttatctattatat

SEQ ID NO: 491916 - DNA, 20 bp, Artificial Sequence
  chemically synthesized
cagtgtgacgtcattgaatg

SEQ ID NO: 491917 - DNA, 20 bp, Artificial Sequence
  chemically synthesized
aagctaccagtgtgacgtca

SEQ ID NO: 491918 - DNA, 20 bp, Artificial Sequence
  chemically synthesized
agaggctcttggcggggaga

SEQ ID NO: 491919 - DNA, 20 bp, Artificial Sequence
  chemically synthesized
tttggtgactgctagtattt

SEQ ID NO: 491920 - DNA, 20 bp, Artificial Sequence
  chemically synthesized
tgtgcagtgacgcccagagc

SEQ ID NO: 491921 - DNA, 20 bp, Artificial Sequence
  chemically synthesized
atgtcttagctaacacttac

SEQ ID NO: 491922 - DNA, 20 bp, Artificial Sequence
  chemically synthesized
gagactgctttcaaggatat

SEQ ID NO: 491923 - DNA, 20 bp, Artificial Sequence
  chemically synthesized
ggtagtcagagactgctttc

SEQ ID NO: 491924 - DNA, 20 bp, Artificial Sequence
  chemically synthesized
agaggtacccaagtctaact

SEQ ID NO: 491925 - DNA, 20 bp, Artificial Sequence
  chemically synthesized
ctgactaccccaagttagac

SEQ ID NO: 491926 - DNA, 20 bp, Artificial Sequence
  chemically synthesized
taccgtcatggtgataacca

SEQ ID NO: 491927 - DNA, 20 bp, Artificial Sequence
  chemically synthesized
aagcaattattatcatacgt

SEQ ID NO: 491928 - DNA, 20 bp, Artificial Sequence
  chemically synthesized
gggactgtcttattcctaat

SEQ ID NO: 491929 - DNA, 20 bp, Artificial Sequence
  chemically synthesized
aagatacagaaactctaatt

SEQ ID NO: 491930 - DNA, 20 bp, Artificial Sequence
  chemically synthesized
gttcatggaactatcattta

SEQ ID NO: 491931 - DNA, 20 bp, Artificial Sequence
  chemically synthesized
caacatgtacaaaaccagat

SEQ ID NO: 491932 - DNA, 20 bp, Artificial Sequence
  chemically synthesized
taataacacacttagccttc

SEQ ID NO: 491933 - DNA, 20 bp, Artificial Sequence
  chemically synthesized
ttattagtccaagaaatgta

SEQ ID NO: 491934 - DNA, 20 bp, Artificial Sequence
  chemically synthesized
caagcacagagtgcctatgt

SEQ ID NO: 491935 - DNA, 20 bp, Artificial Sequence
  chemically synthesized
tcaggaaatcatgtcaagca

SEQ ID NO: 491936 - DNA, 20 bp, Artificial Sequence
  chemically synthesized
tctgtgcttgacatgatttc

SEQ ID NO: 491937 - DNA, 20 bp, Artificial Sequence
  chemically synthesized
gatttcctgaatgttagtgg

SEQ ID NO: 491938 - DNA, 20 bp, Artificial Sequence
  chemically synthesized
tacttgtgtggattagtgta

SEQ ID NO: 491939 - DNA, 20 bp, Artificial Sequence
  chemically synthesized
gcagcattacgactacttgt

SEQ ID NO: 491940 - DNA, 20 bp, Artificial Sequence
  chemically synthesized
tcacaagaaaagtatcagac

SEQ ID NO: 491941 - DNA, 20 bp, Artificial Sequence
  chemically synthesized
gccctgtaggtggctgtcct

SEQ ID NO: 491942 - DNA, 20 bp, Artificial Sequence
  chemically synthesized
cagccacctacagggccacc

SEQ ID NO: 491943 - DNA, 20 bp, Artificial Sequence
  chemically synthesized
tgttggcttaatgagccatt

SEQ ID NO: 491944 - DNA, 20 bp, Artificial Sequence
  chemically synthesized
ttttgcatctttgtgcatga

SEQ ID NO: 491945 - DNA, 20 bp, Artificial Sequence
  chemically synthesized
tgaggcaggagggaaaaaac

SEQ ID NO: 491946 - DNA, 20 bp, Artificial Sequence
  chemically synthesized
ccagagaagtccattggcat

SEQ ID NO: 491947 - DNA, 20 bp, Artificial Sequence
  chemically synthesized
tcatatgccaatggacttct

SEQ ID NO: 491948 - DNA, 20 bp, Artificial Sequence
  chemically synthesized
tgccaatggacttctctgga

SEQ ID NO: 491949 - DNA, 20 bp, Artificial Sequence
  chemically synthesized
actaaatggcagggaaaata

SEQ ID NO: 491950 - DNA, 20 bp, Artificial Sequence
  chemically synthesized
ggcagggaaaatacggaatt

SEQ ID NO: 491951 - DNA, 20 bp, Artificial Sequence
  chemically synthesized
cagagagaaggagaaatacc

SEQ ID NO: 491952 - DNA, 20 bp, Artificial Sequence
  chemically synthesized
aggtattttgtggcttatgg

SEQ ID NO: 491953 - DNA, 20 bp, Artificial Sequence
  chemically synthesized
cagaaagttggaacacaaga

SEQ ID NO: 491954 - DNA, 20 bp, Artificial Sequence
  chemically synthesized
aggacctgcaaccacaggag

SEQ ID NO: 491955 - DNA, 20 bp, Artificial Sequence
  chemically synthesized
tgaagtcgtctggaggcagc

SEQ ID NO: 491956 - DNA, 20 bp, Artificial Sequence
  chemically synthesized
cacaaggtgacatgagattt

SEQ ID NO: 491957 - DNA, 20 bp, Artificial Sequence
  chemically synthesized
cttcctgcgactgccaatcc

SEQ ID NO: 491958 - DNA, 20 bp, Artificial Sequence
  chemically synthesized
agaaaagatcaaaacaaccc

SEQ ID NO: 491959 - DNA, 20 bp, Artificial Sequence
  chemically synthesized
aaattaattccgtaggtgat

SEQ ID NO: 491960 - DNA, 20 bp, Artificial Sequence
  chemically synthesized
ctcaggactctcatcaccta

SEQ ID NO: 491961 - DNA, 20 bp, Artificial Sequence
  chemically synthesized
ctccaaatagtaccaaggga

SEQ ID NO: 491962 - DNA, 20 bp, Artificial Sequence
  chemically synthesized
cctcccttggtactatttgg

SEQ ID NO: 491963 - DNA, 20 bp, Artificial Sequence
  chemically synthesized
aaaatcaaaatcaaaatatt

SEQ ID NO: 491964 - DNA, 20 bp, Artificial Sequence
  chemically synthesized
ataggaagccaaagataatt

SEQ ID NO: 491965 - DNA, 20 bp, Artificial Sequence
  chemically synthesized
ttgacaactgtttagacttg

SEQ ID NO: 491966 - DNA, 20 bp, Artificial Sequence
  chemically synthesized
cacattgttgtcccaggaat

SEQ ID NO: 491967 - DNA, 20 bp, Artificial Sequence
  chemically synthesized
ggccatcacattgttgtccc

SEQ ID NO: 491968 - DNA, 20 bp, Artificial Sequence
  chemically synthesized
ctttcccttctctgtttact

SEQ ID NO: 491969 - DNA, 20 bp, Artificial Sequence
  chemically synthesized
cttctctgtttactaggaat

SEQ ID NO: 491970 - DNA, 20 bp, Artificial Sequence
  chemically synthesized
tagactttacttaagccagc

SEQ ID NO: 491971 - DNA, 20 bp, Artificial Sequence
  chemically synthesized
ctttacttaagccagcttgg

SEQ ID NO: 491972 - DNA, 20 bp, Artificial Sequence
  chemically synthesized
tggatggatagaaagataga

SEQ ID NO: 491973 - DNA, 20 bp, Artificial Sequence
  chemically synthesized
ggtttgaggtgagacgataa

SEQ ID NO: 491974 - DNA, 20 bp, Artificial Sequence
  chemically synthesized
agacgataagggagtctctg

SEQ ID NO: 491975 - DNA, 20 bp, Artificial Sequence
  chemically synthesized
agttatgacagatgctgtta

SEQ ID NO: 491976 - DNA, 20 bp, Artificial Sequence
  chemically synthesized
tgttcattctttgtcatgct

SEQ ID NO: 491977 - DNA, 20 bp, Artificial Sequence
  chemically synthesized
tcataactctgagcatgaca

SEQ ID NO: 491978 - DNA, 20 bp, Artificial Sequence
  chemically synthesized
gaatgaacatataggtggtc

SEQ ID NO: 491979 - DNA, 20 bp, Artificial Sequence
  chemically synthesized
atgagatttctactgttgcc

SEQ ID NO: 491980 - DNA, 20 bp, Artificial Sequence
  chemically synthesized
acagtagaaatctcatcagt

SEQ ID NO: 491981 - DNA, 20 bp, Artificial Sequence
  chemically synthesized
acaaatgagggagacaccta

SEQ ID NO: 491982 - DNA, 20 bp, Artificial Sequence
  chemically synthesized
aattgaagaaacagtagcag

SEQ ID NO: 491983 - DNA, 20 bp, Artificial Sequence
  chemically synthesized
atttcttctccctcataatt

SEQ ID NO: 491984 - DNA, 20 bp, Artificial Sequence
  chemically synthesized
cttgaaagctatgtacaatt

SEQ ID NO: 491985 - DNA, 20 bp, Artificial Sequence
  chemically synthesized
gtatagctttaataacatga

SEQ ID NO: 491986 - DNA, 20 bp, Artificial Sequence
  chemically synthesized
ctgtatctattctgaaattc

SEQ ID NO: 491987 - DNA, 20 bp, Artificial Sequence
  chemically synthesized
cttggaaaacccaagaattt

SEQ ID NO: 491988 - DNA, 20 bp, Artificial Sequence
  chemically synthesized
tttctattcttggaaaaccc

SEQ ID NO: 491989 - DNA, 20 bp, Artificial Sequence
  chemically synthesized
ctgaaattcttgggttttcc

SEQ ID NO: 491990 - DNA, 20 bp, Artificial Sequence
  chemically synthesized
tggaggcagttacgaagggc

SEQ ID NO: 491991 - DNA, 20 bp, Artificial Sequence
  chemically synthesized
gcccgaatgcacccttttac

SEQ ID NO: 491992 - DNA, 20 bp, Artificial Sequence
  chemically synthesized
cctgtgtcctatcccagtaa

SEQ ID NO: 491993 - DNA, 20 bp, Artificial Sequence
  chemically synthesized
cagggcagttcatttaggaa

SEQ ID NO: 491994 - DNA, 20 bp, Artificial Sequence
  chemically synthesized
tgataatctattatccaaac

SEQ ID NO: 491995 - DNA, 20 bp, Artificial Sequence
  chemically synthesized
gctctcaaaaatatccttgt

SEQ ID NO: 491996 - DNA, 20 bp, Artificial Sequence
  chemically synthesized
aggcccaataaatgattaca

SEQ ID NO: 491997 - DNA, 20 bp, Artificial Sequence
  chemically synthesized
taggataaacaagtagaaag

SEQ ID NO: 491998 - DNA, 20 bp, Artificial Sequence
  chemically synthesized
aagtagaaagtgggattgtt

SEQ ID NO: 491999 - DNA, 20 bp, Artificial Sequence
  chemically synthesized
tgcaacttacagtcaacgta

SEQ ID NO: 492000 - DNA, 20 bp, Artificial Sequence
  chemically synthesized
atttacaatacttgcctgcc

SEQ ID NO: 492001 - DNA, 20 bp, Artificial Sequence
  chemically synthesized
aggcaggcaagtattgtaaa

SEQ ID NO: 492002 - DNA, 20 bp, Artificial Sequence
  chemically synthesized
tactgctcttcatatatata

SEQ ID NO: 492003 - DNA, 20 bp, Artificial Sequence
  chemically synthesized
tgaatatctctttctcagtg

SEQ ID NO: 492004 - DNA, 20 bp, Artificial Sequence
  chemically synthesized
caggctgatgttagggaaga

SEQ ID NO: 492005 - DNA, 20 bp, Artificial Sequence
  chemically synthesized
ggatcaggctgatgttaggg

SEQ ID NO: 492006 - DNA, 20 bp, Artificial Sequence
  chemically synthesized
acacacacttgacgtagcag

SEQ ID NO: 492007 - DNA, 20 bp, Artificial Sequence
  chemically synthesized
tcctttttttttttttgaga

SEQ ID NO: 492008 - DNA, 20 bp, Artificial Sequence
  chemically synthesized
aatcttgctgttgcccaggc

SEQ ID NO: 492009 - DNA, 20 bp, Artificial Sequence
  chemically synthesized
tacttagcaggctgaggcag

SEQ ID NO: 492010 - DNA, 20 bp, Artificial Sequence
  chemically synthesized
gcctcagcctgctaagtagc

SEQ ID NO: 492011 - DNA, 20 bp, Artificial Sequence
  chemically synthesized
actaaatatacaaaaattag

SEQ ID NO: 492012 - DNA, 20 bp, Artificial Sequence
  chemically synthesized
ttttgtatatttagtagaga

SEQ ID NO: 492013 - DNA, 20 bp, Artificial Sequence
  chemically synthesized
tagagtttcaccatgttggc

SEQ ID NO: 492014 - DNA, 20 bp, Artificial Sequence
  chemically synthesized
ggtgggcagatcacgaggtc

SEQ ID NO: 492015 - DNA, 20 bp, Artificial Sequence
  chemically synthesized
accttggcctcccaaagtgc

SEQ ID NO: 492016 - DNA, 20 bp, Artificial Sequence
  chemically synthesized
catttattataaaaagaaag

SEQ ID NO: 492017 - DNA, 20 bp, Artificial Sequence
  chemically synthesized
tagaaaataaatacaagccc

SEQ ID NO: 492018 - DNA, 20 bp, Artificial Sequence
  chemically synthesized
aataggtgtaagttcttagg

SEQ ID NO: 492019 - DNA, 20 bp, Artificial Sequence
  chemically synthesized
aaagtattggctaggccatg

SEQ ID NO: 492020 - DNA, 20 bp, Artificial Sequence
  chemically synthesized
ttgcttatagttggtaggca

SEQ ID NO: 492021 - DNA, 20 bp, Artificial Sequence
  chemically synthesized
aggcaatgaatatttattaa

SEQ ID NO: 492022 - DNA, 20 bp, Artificial Sequence
  chemically synthesized
atttattaaacgaatgattg

SEQ ID NO: 492023 - DNA, 20 bp, Artificial Sequence
  chemically synthesized
gagctcaaaacaacaatggc

SEQ ID NO: 492024 - DNA, 20 bp, Artificial Sequence
  chemically synthesized
tttgagctcactcaattatt

SEQ ID NO: 492025 - DNA, 20 bp, Artificial Sequence
  chemically synthesized
gacatcaggatccagaataa

SEQ ID NO: 492026 - DNA, 20 bp, Artificial Sequence
  chemically synthesized
atttcatagacatcaggatc

SEQ ID NO: 492027 - DNA, 20 bp, Artificial Sequence
  chemically synthesized
tttttgcatttcatagacat

SEQ ID NO: 492028 - DNA, 20 bp, Artificial Sequence
  chemically synthesized
attgatcacgtctaaattag

SEQ ID NO: 492029 - DNA, 20 bp, Artificial Sequence
  chemically synthesized
ggtgagataaacagaaataa

SEQ ID NO: 492030 - DNA, 20 bp, Artificial Sequence
  chemically synthesized
taacttatttacataatctg

SEQ ID NO: 492031 - DNA, 20 bp, Artificial Sequence
  chemically synthesized
tgcttctgaagagataaaca

SEQ ID NO: 492032 - DNA, 20 bp, Artificial Sequence
  chemically synthesized
ttccttttctttcaattatc

SEQ ID NO: 492033 - DNA, 20 bp, Artificial Sequence
  chemically synthesized
tcctagataattgaaagaaa

SEQ ID NO: 492034 - DNA, 20 bp, Artificial Sequence
  chemically synthesized
aggaatacatttatttctca

SEQ ID NO: 492035 - DNA, 20 bp, Artificial Sequence
  chemically synthesized
tttgtctaaataaatcatgt

SEQ ID NO: 492036 - DNA, 20 bp, Artificial Sequence
  chemically synthesized
ttataaattatagaaaccaa

SEQ ID NO: 492037 - DNA, 20 bp, Artificial Sequence
  chemically synthesized
tatttaactgcttcttatgt

SEQ ID NO: 492038 - DNA, 20 bp, Artificial Sequence
  chemically synthesized
acatacactaacaaatatag

SEQ ID NO: 492039 - DNA, 20 bp, Artificial Sequence
  chemically synthesized
tatttgttagtgtatgtaac

SEQ ID NO: 492040 - DNA, 20 bp, Artificial Sequence
  chemically synthesized
aagccacctgaagtaattca

SEQ ID NO: 492041 - DNA, 20 bp, Artificial Sequence
  chemically synthesized
aaagtgcacgttatgacccc

SEQ ID NO: 492042 - DNA, 20 bp, Artificial Sequence
  chemically synthesized
tcacctaaagtattatggaa

SEQ ID NO: 492043 - DNA, 20 bp, Artificial Sequence
  chemically synthesized
taatacaactctacatatcc

SEQ ID NO: 492044 - DNA, 20 bp, Artificial Sequence
  chemically synthesized
tgcttggattcctggatatg

SEQ ID NO: 492045 - DNA, 20 bp, Artificial Sequence
  chemically synthesized
aatttccaatgcttggattc

SEQ ID NO: 492046 - DNA, 20 bp, Artificial Sequence
  chemically synthesized
aaggggtcaatttccaatgc

SEQ ID NO: 492047 - DNA, 20 bp, Artificial Sequence
  chemically synthesized
cttgatttggtcgaggccca

SEQ ID NO: 492048 - DNA, 20 bp, Artificial Sequence
  chemically synthesized
atatgagccttcggtacaac

SEQ ID NO: 492049 - DNA, 20 bp, Artificial Sequence
  chemically synthesized
gctaaagggagcataatggt

SEQ ID NO: 492050 - DNA, 20 bp, Artificial Sequence
  chemically synthesized
tttctcacctgataagcaag

SEQ ID NO: 492051 - DNA, 20 bp, Artificial Sequence
  chemically synthesized
agctctgggaggtagaaggt

SEQ ID NO: 492052 - DNA, 20 bp, Artificial Sequence
  chemically synthesized
tgtgattattaaaagccagt

SEQ ID NO: 492053 - DNA, 20 bp, Artificial Sequence
  chemically synthesized
gaccttcacttatgttcttt

SEQ ID NO: 492054 - DNA, 20 bp, Artificial Sequence
  chemically synthesized
aatgtttagaaaagttctag

SEQ ID NO: 492055 - DNA, 20 bp, Artificial Sequence
  chemically synthesized
aaaatttgtcttttaattaa

SEQ ID NO: 492056 - DNA, 20 bp, Artificial Sequence
  chemically synthesized
cttcagtagtcttacctatt

SEQ ID NO: 492057 - DNA, 20 bp, Artificial Sequence
  chemically synthesized
aggtaaaatcaaagcagtac

SEQ ID NO: 492058 - DNA, 20 bp, Artificial Sequence
  chemically synthesized
aactaccatcttcgcaaaag

SEQ ID NO: 492059 - DNA, 20 bp, Artificial Sequence
  chemically synthesized
taagatcttaggcaaatcac

SEQ ID NO: 492060 - DNA, 20 bp, Artificial Sequence
  chemically synthesized
attaaaggattaatgtgttt

SEQ ID NO: 492061 - DNA, 20 bp, Artificial Sequence
  chemically synthesized
gaaacactgttctaggatta

SEQ ID NO: 492062 - DNA, 20 bp, Artificial Sequence
  chemically synthesized
aaggttgagaaacactgttc

SEQ ID NO: 492063 - DNA, 20 bp, Artificial Sequence
  chemically synthesized
tctcaaccttagctacactc

SEQ ID NO: 492064 - DNA, 20 bp, Artificial Sequence
  chemically synthesized
aaatatttcttgaatgatcc

SEQ ID NO: 492065 - DNA, 20 bp, Artificial Sequence
  chemically synthesized
tcagtattttaaaatatttc

SEQ ID NO: 492066 - DNA, 20 bp, Artificial Sequence
  chemically synthesized
atattttaaaatactgatgt

SEQ ID NO: 492067 - DNA, 20 bp, Artificial Sequence
  chemically synthesized
cacatctagaccaattgaat

SEQ ID NO: 492068 - DNA, 20 bp, Artificial Sequence
  chemically synthesized
ccagatcacatctagaccaa

SEQ ID NO: 492069 - DNA, 20 bp, Artificial Sequence
  chemically synthesized
gtctagatgtgatctgggcc

SEQ ID NO: 492070 - DNA, 20 bp, Artificial Sequence
  chemically synthesized
tctcagctttgattgcgtat

SEQ ID NO: 492071 - DNA, 20 bp, Artificial Sequence
  chemically synthesized
gacgcttttcaaattttgac

SEQ ID NO: 492072 - DNA, 20 bp, Artificial Sequence
  chemically synthesized
tttcaaattttgacatgaat

SEQ ID NO: 492073 - DNA, 20 bp, Artificial Sequence
  chemically synthesized
ggagtagggccaagaaaact

SEQ ID NO: 492074 - DNA, 20 bp, Artificial Sequence
  chemically synthesized
cctactaaatcagagttttt

SEQ ID NO: 492075 - DNA, 20 bp, Artificial Sequence
  chemically synthesized
ccaccccaagcctactaaat

SEQ ID NO: 492076 - DNA, 20 bp, Artificial Sequence
  chemically synthesized
aaactctgatttagtaggct

SEQ ID NO: 492077 - DNA, 20 bp, Artificial Sequence
  chemically synthesized
gatgccgagcatgatggcct

SEQ ID NO: 492078 - DNA, 20 bp, Artificial Sequence
  chemically synthesized
cgttctgaaacttgaacatt

SEQ ID NO: 492079 - DNA, 20 bp, Artificial Sequence
  chemically synthesized
ttgttgtgaccagctctcca

SEQ ID NO: 492080 - DNA, 20 bp, Artificial Sequence
  chemically synthesized
gactgccgggctacaccccc

SEQ ID NO: 492081 - DNA, 20 bp, Artificial Sequence
  chemically synthesized
gatctcacttgaaaactcta

SEQ ID NO: 492082 - DNA, 20 bp, Artificial Sequence
  chemically synthesized
tagagttttcaagtgagatc

SEQ ID NO: 492083 - DNA, 20 bp, Artificial Sequence
  chemically synthesized
tagttctcaaagggaggtcc

SEQ ID NO: 492084 - DNA, 20 bp, Artificial Sequence
  chemically synthesized
gagagtaagtactttttatc

SEQ ID NO: 492085 - DNA, 20 bp, Artificial Sequence
  chemically synthesized
tgtttttaaaaatgcagatg

SEQ ID NO: 492086 - DNA, 20 bp, Artificial Sequence
  chemically synthesized
accttatcatagcagcttcc

SEQ ID NO: 492087 - DNA, 20 bp, Artificial Sequence
  chemically synthesized
ttccacggattgctgtgcct

SEQ ID NO: 492088 - DNA, 20 bp, Artificial Sequence
  chemically synthesized
tgtgcatccaagtagacagg

SEQ ID NO: 492089 - DNA, 20 bp, Artificial Sequence
  chemically synthesized
tatatattctccctgtctac

SEQ ID NO: 492090 - DNA, 20 bp, Artificial Sequence
  chemically synthesized
tgaatggtatcagatggttt

SEQ ID NO: 492091 - DNA, 20 bp, Artificial Sequence
  chemically synthesized
tgataccattcaccaagctg

SEQ ID NO: 492092 - DNA, 20 bp, Artificial Sequence
  chemically synthesized
acacacaatccatcagcttg

SEQ ID NO: 492093 - DNA, 20 bp, Artificial Sequence
  chemically synthesized
aagaactattagataaggag

SEQ ID NO: 492094 - DNA, 20 bp, Artificial Sequence
  chemically synthesized
gtgttctatcagcatctaat

SEQ ID NO: 492095 - DNA, 20 bp, Artificial Sequence
  chemically synthesized
tcaccaactgatgtcctgcc

SEQ ID NO: 492096 - DNA, 20 bp, Artificial Sequence
  chemically synthesized
tgctcaggccagcgggaggg

SEQ ID NO: 492097 - DNA, 20 bp, Artificial Sequence
  chemically synthesized
cctgctgctcaggccagcgg

SEQ ID NO: 492098 - DNA, 20 bp, Artificial Sequence
  chemically synthesized
gatatgttgtgatttaattc

SEQ ID NO: 492099 - DNA, 20 bp, Artificial Sequence
  chemically synthesized
cctctaaactgaaggaattc

SEQ ID NO: 492100 - DNA, 20 bp, Artificial Sequence
  chemically synthesized
ttaatagacctctaaactga

SEQ ID NO: 492101 - DNA, 20 bp, Artificial Sequence
  chemically synthesized
gcctaatggagaacaatccc

SEQ ID NO: 492102 - DNA, 20 bp, Artificial Sequence
  chemically synthesized
gagaacaatcccaaggatct

SEQ ID NO: 492103 - DNA, 20 bp, Artificial Sequence
  chemically synthesized
taatagtattcccagatcct

SEQ ID NO: 492104 - DNA, 20 bp, Artificial Sequence
  chemically synthesized
gcgaggacattaaggtgaaa

SEQ ID NO: 492105 - DNA, 20 bp, Artificial Sequence
  chemically synthesized
cctccctttccctcctgctt

SEQ ID NO: 492106 - DNA, 20 bp, Artificial Sequence
  chemically synthesized
aatagatgtgatagatgagt

SEQ ID NO: 492107 - DNA, 20 bp, Artificial Sequence
  chemically synthesized
tgctaaaatagatgtgatag

SEQ ID NO: 492108 - DNA, 20 bp, Artificial Sequence
  chemically synthesized
tcgggtggtactatcttagt

SEQ ID NO: 492109 - DNA, 20 bp, Artificial Sequence
  chemically synthesized
ccagactaagatagtaccac

SEQ ID NO: 492110 - DNA, 20 bp, Artificial Sequence
  chemically synthesized
acatttgagaaagacttcac

SEQ ID NO: 492111 - DNA, 20 bp, Artificial Sequence
  chemically synthesized
tggtcatgctgcctagttct

SEQ ID NO: 492112 - DNA, 20 bp, Artificial Sequence
  chemically synthesized
cccagttctcatgcagtgta

SEQ ID NO: 492113 - DNA, 20 bp, Artificial Sequence
  chemically synthesized
tcattacactgcatgagaac

SEQ ID NO: 492114 - DNA, 20 bp, Artificial Sequence
  chemically synthesized
gtgctttgtggggaggtgag

SEQ ID NO: 492115 - DNA, 20 bp, Artificial Sequence
  chemically synthesized
tgcttgtgctttgtggggag

SEQ ID NO: 492116 - DNA, 20 bp, Artificial Sequence
  chemically synthesized
ctagcaagtatagcagatgg

SEQ ID NO: 492117 - DNA, 20 bp, Artificial Sequence
  chemically synthesized
ctagtgtttccaagatactt

SEQ ID NO: 492118 - DNA, 20 bp, Artificial Sequence
  chemically synthesized
tacatttggaagaaataccg

SEQ ID NO: 492119 - DNA, 20 bp, Artificial Sequence
  chemically synthesized
gccctgaccataagcaccat

SEQ ID NO: 492120 - DNA, 20 bp, Artificial Sequence
  chemically synthesized
agttttatcatcagcatttt

SEQ ID NO: 492121 - DNA, 20 bp, Artificial Sequence
  chemically synthesized
gcttcagttaagtaaatatt

SEQ ID NO: 492122 - DNA, 20 bp, Artificial Sequence
  chemically synthesized
agaagctgtaaatactaacg

SEQ ID NO: 492123 - DNA, 20 bp, Artificial Sequence
  chemically synthesized
tatgtcaacacaagaagtca

SEQ ID NO: 492124 - DNA, 20 bp, Artificial Sequence
  chemically synthesized
taaatggtctctaaatgcaa

SEQ ID NO: 492125 - DNA, 20 bp, Artificial Sequence
  chemically synthesized
tcttttggaaacggctttgt

SEQ ID NO: 492126 - DNA, 20 bp, Artificial Sequence
  chemically synthesized
aagaagcccgtaaatggaat

SEQ ID NO: 492127 - DNA, 20 bp, Artificial Sequence
  chemically synthesized
ctttggaagaagcccgtaaa

SEQ ID NO: 492128 - DNA, 20 bp, Artificial Sequence
  chemically synthesized
ccatttacgggcttcttcca

SEQ ID NO: 492129 - DNA, 20 bp, Artificial Sequence
  chemically synthesized
aatttcttctcagatatgtc

SEQ ID NO: 492130 - DNA, 20 bp, Artificial Sequence
  chemically synthesized
ttatcagttgctagttgaca

SEQ ID NO: 492131 - DNA, 20 bp, Artificial Sequence
  chemically synthesized
attttgaagcatcaatagaa

SEQ ID NO: 492132 - DNA, 20 bp, Artificial Sequence
  chemically synthesized
gggagataaaagaggcaaat

SEQ ID NO: 492133 - DNA, 20 bp, Artificial Sequence
  chemically synthesized
gaagctctgctcaaagtatt

SEQ ID NO: 492134 - DNA, 20 bp, Artificial Sequence
  chemically synthesized
cgtcgttgcatttttcagaa

SEQ ID NO: 492135 - DNA, 20 bp, Artificial Sequence
  chemically synthesized
cagttctaagtggaaataag

SEQ ID NO: 492136 - DNA, 20 bp, Artificial Sequence
  chemically synthesized
aaatcaatgatgtttcaata

SEQ ID NO: 492137 - DNA, 20 bp, Artificial Sequence
  chemically synthesized
ttttagcagagtgtaggttt

SEQ ID NO: 492138 - DNA, 20 bp, Artificial Sequence
  chemically synthesized
ctgcagttaacacattttag

SEQ ID NO: 492139 - DNA, 20 bp, Artificial Sequence
  chemically synthesized
gcagcaaaatgattaactcg

SEQ ID NO: 492140 - DNA, 20 bp, Artificial Sequence
  chemically synthesized
cttcccacatgctagactca

SEQ ID NO: 492141 - DNA, 20 bp, Artificial Sequence
  chemically synthesized
tcttgcttcatcttgccatc

SEQ ID NO: 492142 - DNA, 20 bp, Artificial Sequence
  chemically synthesized
ccaagatggcaagatgaagc

SEQ ID NO: 492143 - DNA, 20 bp, Artificial Sequence
  chemically synthesized
ctaccttattacacaatgag

SEQ ID NO: 492144 - DNA, 20 bp, Artificial Sequence
  chemically synthesized
tacttctaccttattacaca

SEQ ID NO: 492145 - DNA, 20 bp, Artificial Sequence
  chemically synthesized
gtcactttccaataattttg

SEQ ID NO: 492146 - DNA, 20 bp, Artificial Sequence
  chemically synthesized
tcaaaattattggaaagtga

SEQ ID NO: 492147 - DNA, 20 bp, Artificial Sequence
  chemically synthesized
attggaaagtgacagaatgt

SEQ ID NO: 492148 - DNA, 20 bp, Artificial Sequence
  chemically synthesized
gaaagtgacagaatgtttga

SEQ ID NO: 492149 - DNA, 20 bp, Artificial Sequence
  chemically synthesized
cagaaatgtcatttggtatt

SEQ ID NO: 492150 - DNA, 20 bp, Artificial Sequence
  chemically synthesized
taaattgtcaaatggatgca

SEQ ID NO: 492151 - DNA, 20 bp, Artificial Sequence
  chemically synthesized
ggtactcgataaattgtcaa

SEQ ID NO: 492152 - DNA, 20 bp, Artificial Sequence
  chemically synthesized
tgcatccatttgacaattta

SEQ ID NO: 492153 - DNA, 20 bp, Artificial Sequence
  chemically synthesized
tgtttcaagtgctatgtact

SEQ ID NO: 492154 - DNA, 20 bp, Artificial Sequence
  chemically synthesized
cacataatttacagtccagt

SEQ ID NO: 492155 - DNA, 20 bp, Artificial Sequence
  chemically synthesized
gagggaaaagggtctttatc

SEQ ID NO: 492156 - DNA, 20 bp, Artificial Sequence
  chemically synthesized
gagagggtggaatgagggaa

SEQ ID NO: 492157 - DNA, 20 bp, Artificial Sequence
  chemically synthesized
agttatgcaccttgagaggg

SEQ ID NO: 492158 - DNA, 20 bp, Artificial Sequence
  chemically synthesized
tattaagttatgcaccttga

SEQ ID NO: 492159 - DNA, 20 bp, Artificial Sequence
  chemically synthesized
ctgttcgatctaattgtctt

SEQ ID NO: 492160 - DNA, 20 bp, Artificial Sequence
  chemically synthesized
ttaaatacttttgaaaaagg

SEQ ID NO: 492161 - DNA, 20 bp, Artificial Sequence
  chemically synthesized
atgtgaacctctgtgcaaaa

SEQ ID NO: 492162 - DNA, 20 bp, Artificial Sequence
  chemically synthesized
gagttgttagcctgaggagc

SEQ ID NO: 492163 - DNA, 20 bp, Artificial Sequence
  chemically synthesized
taatacaaatttacagtggg

SEQ ID NO: 492164 - DNA, 20 bp, Artificial Sequence
  chemically synthesized
tgattaatacaaatttacag

SEQ ID NO: 492165 - DNA, 20 bp, Artificial Sequence
  chemically synthesized
gagggacaaaagaggacaat

SEQ ID NO: 492166 - DNA, 20 bp, Artificial Sequence
  chemically synthesized
ttgagcagccaaggagtgac

SEQ ID NO: 492167 - DNA, 20 bp, Artificial Sequence
  chemically synthesized
ggtggtatattgagcagcca

SEQ ID NO: 492168 - DNA, 20 bp, Artificial Sequence
  chemically synthesized
tgagctcccccgcaaagaac

SEQ ID NO: 492169 - DNA, 20 bp, Artificial Sequence
  chemically synthesized
cctttcatctgaagacacat

SEQ ID NO: 492170 - DNA, 20 bp, Artificial Sequence
  chemically synthesized
gacacatttgggtgagactt

SEQ ID NO: 492171 - DNA, 20 bp, Artificial Sequence
  chemically synthesized
gatttgtatgtttaagcacc

SEQ ID NO: 492172 - DNA, 20 bp, Artificial Sequence
  chemically synthesized
agtggtatgtcagagtcact

SEQ ID NO: 492173 - DNA, 20 bp, Artificial Sequence
  chemically synthesized
tagatagagtagtggtatgt

SEQ ID NO: 492174 - DNA, 20 bp, Artificial Sequence
  chemically synthesized
ttgtaagcagagtttataga

SEQ ID NO: 492175 - DNA, 20 bp, Artificial Sequence
  chemically synthesized
aattggccttaggttgtaag

SEQ ID NO: 492176 - DNA, 20 bp, Artificial Sequence
  chemically synthesized
ttttctagaaagagtaggat

SEQ ID NO: 492177 - DNA, 20 bp, Artificial Sequence
  chemically synthesized
tgaatgttttctagaaagag

SEQ ID NO: 492178 - DNA, 20 bp, Artificial Sequence
  chemically synthesized
gttaatgaatgttttctaga

SEQ ID NO: 492179 - DNA, 20 bp, Artificial Sequence
  chemically synthesized
atgatgagaagtaacagtta

SEQ ID NO: 492180 - DNA, 20 bp, Artificial Sequence
  chemically synthesized
gtaagtgttattgtactata

SEQ ID NO: 492181 - DNA, 20 bp, Artificial Sequence
  chemically synthesized
agaacatgtcttctcattgg

SEQ ID NO: 492182 - DNA, 20 bp, Artificial Sequence
  chemically synthesized
caactcacaaaagttgctag

SEQ ID NO: 492183 - DNA, 20 bp, Artificial Sequence
  chemically synthesized
tgactcttctagcaactttt

SEQ ID NO: 492184 - DNA, 20 bp, Artificial Sequence
  chemically synthesized
ttacttcacaataggtctca

SEQ ID NO: 492185 - DNA, 20 bp, Artificial Sequence
  chemically synthesized
ttcacaataggtctcagtga

SEQ ID NO: 492186 - DNA, 20 bp, Artificial Sequence
  chemically synthesized
tcagtgaatgaattaaccct

SEQ ID NO: 492187 - DNA, 20 bp, Artificial Sequence
  chemically synthesized
ttagatgaaacggacactct

SEQ ID NO: 492188 - DNA, 20 bp, Artificial Sequence
  chemically synthesized
agtgtccgtttcatctaaag

SEQ ID NO: 492189 - DNA, 20 bp, Artificial Sequence
  chemically synthesized
tacatatatttgacctacat

SEQ ID NO: 492190 - DNA, 20 bp, Artificial Sequence
  chemically synthesized
ttaccatgtactatgtcacg

SEQ ID NO: 492191 - DNA, 20 bp, Artificial Sequence
  chemically synthesized
tgttcttctttggcttcttg

SEQ ID NO: 492192 - DNA, 20 bp, Artificial Sequence
  chemically synthesized
aattttttcaatagatcgaa

SEQ ID NO: 492193 - DNA, 20 bp, Artificial Sequence
  chemically synthesized
ctgaatttacaagataatct

SEQ ID NO: 492194 - DNA, 20 bp, Artificial Sequence
  chemically synthesized
gcactgtaatattttagaat

SEQ ID NO: 492195 - DNA, 20 bp, Artificial Sequence
  chemically synthesized
gggagtgcactgtaatattt

SEQ ID NO: 492196 - DNA, 20 bp, Artificial Sequence
  chemically synthesized
attttaaaccacaatgcttt

SEQ ID NO: 492197 - DNA, 20 bp, Artificial Sequence
  chemically synthesized
gagattatcattatataatt

SEQ ID NO: 492198 - DNA, 20 bp, Artificial Sequence
  chemically synthesized
taatcacatttgactaaaac

SEQ ID NO: 492199 - DNA, 20 bp, Artificial Sequence
  chemically synthesized
gaaacatgtgtaagaaagat

SEQ ID NO: 492200 - DNA, 20 bp, Artificial Sequence
  chemically synthesized
aaaagtagaatgacagcgtc

SEQ ID NO: 492201 - DNA, 20 bp, Artificial Sequence
  chemically synthesized
aatgtaaaattttcaaaaag

SEQ ID NO: 492202 - DNA, 20 bp, Artificial Sequence
  chemically synthesized
ttgaaaattttacattcaaa

SEQ ID NO: 492203 - DNA, 20 bp, Artificial Sequence
  chemically synthesized
aaagagttgagatattctat

SEQ ID NO: 492204 - DNA, 20 bp, Artificial Sequence
  chemically synthesized
tctgaagacagacaaataga

SEQ ID NO: 492205 - DNA, 20 bp, Artificial Sequence
  chemically synthesized
tattttagtttgttaaatct

SEQ ID NO: 492206 - DNA, 20 bp, Artificial Sequence
  chemically synthesized
attcaacttagccccatgaa

SEQ ID NO: 492207 - DNA, 20 bp, Artificial Sequence
  chemically synthesized
aattaattcaacttagcccc

SEQ ID NO: 492208 - DNA, 20 bp, Artificial Sequence
  chemically synthesized
accctattcatggggctaag

SEQ ID NO: 492209 - DNA, 20 bp, Artificial Sequence
  chemically synthesized
tgaattaattcttaaattgt

SEQ ID NO: 492210 - DNA, 20 bp, Artificial Sequence
  chemically synthesized
tctccaaatcctcacaattt

SEQ ID NO: 492211 - DNA, 20 bp, Artificial Sequence
  chemically synthesized
gcaaaaaagccgctatgttt

SEQ ID NO: 492212 - DNA, 20 bp, Artificial Sequence
  chemically synthesized
tgcaaatgttcattttgcct

SEQ ID NO: 492213 - DNA, 20 bp, Artificial Sequence
  chemically synthesized
tttccttgcccaccttgcag

SEQ ID NO: 492214 - DNA, 20 bp, Artificial Sequence
  chemically synthesized
acctgcaaggtgggcaagga

SEQ ID NO: 492215 - DNA, 20 bp, Artificial Sequence
  chemically synthesized
ccactgatcgtgatctacta

SEQ ID NO: 492216 - DNA, 20 bp, Artificial Sequence
  chemically synthesized
tcactagtagatcacgatca

SEQ ID NO: 492217 - DNA, 20 bp, Artificial Sequence
  chemically synthesized
agtagatcacgatcagtgga

SEQ ID NO: 492218 - DNA, 20 bp, Artificial Sequence
  chemically synthesized
acgctttggggacaagtagg

SEQ ID NO: 492219 - DNA, 20 bp, Artificial Sequence
  chemically synthesized
tgatgatatgagaagggttg

SEQ ID NO: 492220 - DNA, 20 bp, Artificial Sequence
  chemically synthesized
gaataagctgatgatatgag

SEQ ID NO: 492221 - DNA, 20 bp, Artificial Sequence
  chemically synthesized
tgggaatgtcttttggatgg

SEQ ID NO: 492222 - DNA, 20 bp, Artificial Sequence
  chemically synthesized
tactttactgggaatgtctt

SEQ ID NO: 492223 - DNA, 20 bp, Artificial Sequence
  chemically synthesized
acagttaatgttactttact

SEQ ID NO: 492224 - DNA, 20 bp, Artificial Sequence
  chemically synthesized
agttaattaaagaccatctt

SEQ ID NO: 492225 - DNA, 20 bp, Artificial Sequence
  chemically synthesized
ttaaaacttcaacatatgaa

SEQ ID NO: 492226 - DNA, 20 bp, Artificial Sequence
  chemically synthesized
aggggttaaaacttcaacat

SEQ ID NO: 492227 - DNA, 20 bp, Artificial Sequence
  chemically synthesized
aaggccctacctccacttgc

SEQ ID NO: 492228 - DNA, 20 bp, Artificial Sequence
  chemically synthesized
agtggaggtagggcctttaa

SEQ ID NO: 492229 - DNA, 20 bp, Artificial Sequence
  chemically synthesized
aaaggggtaattaaggttaa

SEQ ID NO: 492230 - DNA, 20 bp, Artificial Sequence
  chemically synthesized
ttaaggttaaatgagttcat

SEQ ID NO: 492231 - DNA, 20 bp, Artificial Sequence
  chemically synthesized
ttatgaggacattagactta

SEQ ID NO: 492232 - DNA, 20 bp, Artificial Sequence
  chemically synthesized
taaaaggaagaacagctaca

SEQ ID NO: 492233 - DNA, 20 bp, Artificial Sequence
  chemically synthesized
gatgacagggttggtttctg

SEQ ID NO: 492234 - DNA, 20 bp, Artificial Sequence
  chemically synthesized
gtctaagattaaggtgatga

SEQ ID NO: 492235 - DNA, 20 bp, Artificial Sequence
  chemically synthesized
tctgttgcttaagccaccca

SEQ ID NO: 492236 - DNA, 20 bp, Artificial Sequence
  chemically synthesized
ttaagcaaggtaaacaccca

SEQ ID NO: 492237 - DNA, 20 bp, Artificial Sequence
  chemically synthesized
gtgtttaccttgcttaagtc

SEQ ID NO: 492238 - DNA, 20 bp, Artificial Sequence
  chemically synthesized
gtcaattcggttgattaact

SEQ ID NO: 492239 - DNA, 20 bp, Artificial Sequence
  chemically synthesized
atatatccaaagttaatcaa

SEQ ID NO: 492240 - DNA, 20 bp, Artificial Sequence
  chemically synthesized
ataagcaaagattacactta

SEQ ID NO: 492241 - DNA, 20 bp, Artificial Sequence
  chemically synthesized
ggagccaatctaaatgagct

SEQ ID NO: 492242 - DNA, 20 bp, Artificial Sequence
  chemically synthesized
atccatgtttaagactttaa

SEQ ID NO: 492243 - DNA, 20 bp, Artificial Sequence
  chemically synthesized
attcagttaaagtcttaaac

SEQ ID NO: 492244 - DNA, 20 bp, Artificial Sequence
  chemically synthesized
ctagtagtattgtcaggtca

SEQ ID NO: 492245 - DNA, 20 bp, Artificial Sequence
  chemically synthesized
atgacctgacaatactacta

SEQ ID NO: 492246 - DNA, 20 bp, Artificial Sequence
  chemically synthesized
ttttacatgcgtatggacat

SEQ ID NO: 492247 - DNA, 20 bp, Artificial Sequence
  chemically synthesized
cattgtgttatatacataca

SEQ ID NO: 492248 - DNA, 20 bp, Artificial Sequence
  chemically synthesized
aaaacatagtattgagagaa

SEQ ID NO: 492249 - DNA, 20 bp, Artificial Sequence
  chemically synthesized
ccccatctctaatcttctct

SEQ ID NO: 492250 - DNA, 20 bp, Artificial Sequence
  chemically synthesized
ttcacagagaagattagaga

SEQ ID NO: 492251 - DNA, 20 bp, Artificial Sequence
  chemically synthesized
agtagctagttttagtttgc

SEQ ID NO: 492252 - DNA, 20 bp, Artificial Sequence
  chemically synthesized
cacctgtatttgtatcttta

SEQ ID NO: 492253 - DNA, 20 bp, Artificial Sequence
  chemically synthesized
agccaaaagtaaccattatc

SEQ ID NO: 492254 - DNA, 20 bp, Artificial Sequence
  chemically synthesized
gggaaggaaggtgattagca

SEQ ID NO: 492255 - DNA, 20 bp, Artificial Sequence
  chemically synthesized
tgttcttcttatttgaaact

SEQ ID NO: 492256 - DNA, 20 bp, Artificial Sequence
  chemically synthesized
aacatctgtgttccaacatt

SEQ ID NO: 492257 - DNA, 20 bp, Artificial Sequence
  chemically synthesized
tgttggacagcacaggttta

SEQ ID NO: 492258 - DNA, 20 bp, Artificial Sequence
  chemically synthesized
gcaatttgcattagtcacat

SEQ ID NO: 492259 - DNA, 20 bp, Artificial Sequence
  chemically synthesized
catatttaaataattgtgat

SEQ ID NO: 492260 - DNA, 20 bp, Artificial Sequence
  chemically synthesized
aaacagagaaattaatgtaa

SEQ ID NO: 492261 - DNA, 20 bp, Artificial Sequence
  chemically synthesized
ttgtccaatggaaatataat

SEQ ID NO: 492262 - DNA, 20 bp, Artificial Sequence
  chemically synthesized
tcacaatataaacgtttaca

SEQ ID NO: 492263 - DNA, 20 bp, Artificial Sequence
  chemically synthesized
ttatccttaagggtgaaaac

SEQ ID NO: 492264 - DNA, 20 bp, Artificial Sequence
  chemically synthesized
aaatccaggttttcaccctt

SEQ ID NO: 492265 - DNA, 20 bp, Artificial Sequence
  chemically synthesized
aaactactccttttatcctt

SEQ ID NO: 492266 - DNA, 20 bp, Artificial Sequence
  chemically synthesized
ttttcacccttaaggataaa

SEQ ID NO: 492267 - DNA, 20 bp, Artificial Sequence
  chemically synthesized
ttaaccacatctcattgctt

SEQ ID NO: 492268 - DNA, 20 bp, Artificial Sequence
  chemically synthesized
ggttaatttcaacacatata

SEQ ID NO: 492269 - DNA, 20 bp, Artificial Sequence
  chemically synthesized
ggaaaatccaggcccctttt

SEQ ID NO: 492270 - DNA, 20 bp, Artificial Sequence
  chemically synthesized
taaaaatccagaaaaggggc

SEQ ID NO: 492271 - DNA, 20 bp, Artificial Sequence
  chemically synthesized
ggattttcccaaaggcaaat

SEQ ID NO: 492272 - DNA, 20 bp, Artificial Sequence
  chemically synthesized
cccaaaggcaaatctgagtg

SEQ ID NO: 492273 - DNA, 20 bp, Artificial Sequence
  chemically synthesized
ctgagtggtgagttgatata

SEQ ID NO: 492274 - DNA, 20 bp, Artificial Sequence
  chemically synthesized
taggctatattaagatttca

SEQ ID NO: 492275 - DNA, 20 bp, Artificial Sequence
  chemically synthesized
gcatagcaacgatacaattt

SEQ ID NO: 492276 - DNA, 20 bp, Artificial Sequence
  chemically synthesized
ttctgtagcttccctaatta

SEQ ID NO: 492277 - DNA, 20 bp, Artificial Sequence
  chemically synthesized
ttcaataattagggaagcta

SEQ ID NO: 492278 - DNA, 20 bp, Artificial Sequence
  chemically synthesized
ttgcaaattgtatggtcaga

SEQ ID NO: 492279 - DNA, 20 bp, Artificial Sequence
  chemically synthesized
ataaattacataatttagca

SEQ ID NO: 492280 - DNA, 20 bp, Artificial Sequence
  chemically synthesized
tttagcattgaatacttcat

SEQ ID NO: 492281 - DNA, 20 bp, Artificial Sequence
  chemically synthesized
cttcatctgaatagtaaggt

SEQ ID NO: 492282 - DNA, 20 bp, Artificial Sequence
  chemically synthesized
ctctgttttctaaaatctgc

SEQ ID NO: 492283 - DNA, 20 bp, Artificial Sequence
  chemically synthesized
tttctaaaatctgctagagt

SEQ ID NO: 492284 - DNA, 20 bp, Artificial Sequence
  chemically synthesized
aatgtcatgtacaagttcta

SEQ ID NO: 492285 - DNA, 20 bp, Artificial Sequence
  chemically synthesized
aagaatttttaagagaaaaa

SEQ ID NO: 492286 - DNA, 20 bp, Artificial Sequence
  chemically synthesized
gttgacactggaagagaaac

SEQ ID NO: 492287 - DNA, 20 bp, Artificial Sequence
  chemically synthesized
gattctgaatttattttcca

SEQ ID NO: 492288 - DNA, 20 bp, Artificial Sequence
  chemically synthesized
gattcaatggaaaataaatt

SEQ ID NO: 492289 - DNA, 20 bp, Artificial Sequence
  chemically synthesized
tcaaaattcattttcagatt

SEQ ID NO: 492290 - DNA, 20 bp, Artificial Sequence
  chemically synthesized
aataaattcagaatctgaaa

SEQ ID NO: 492291 - DNA, 20 bp, Artificial Sequence
  chemically synthesized
aatgaattttgatcaggcca

SEQ ID NO: 492292 - DNA, 20 bp, Artificial Sequence
  chemically synthesized
gccacaggatgtgtgataca

SEQ ID NO: 492293 - DNA, 20 bp, Artificial Sequence
  chemically synthesized
gatgtgtgatacacagaatg

SEQ ID NO: 492294 - DNA, 20 bp, Artificial Sequence
  chemically synthesized
caatgtcatatattgcaaaa

SEQ ID NO: 492295 - DNA, 20 bp, Artificial Sequence
  chemically synthesized
aaaaaggatttgtttgggct

SEQ ID NO: 492296 - DNA, 20 bp, Artificial Sequence
  chemically synthesized
aaaaaaaaaagaggattata

SEQ ID NO: 492297 - DNA, 20 bp, Artificial Sequence
  chemically synthesized
gaaaaaaaaaaaaaaaaaaa

SEQ ID NO: 492298 - DNA, 20 bp, Artificial Sequence
  chemically synthesized
tttttttttttcttctgaga

SEQ ID NO: 492299 - DNA, 20 bp, Artificial Sequence
  chemically synthesized
tttgctcttgtcgcccaggc

SEQ ID NO: 492300 - DNA, 20 bp, Artificial Sequence
  chemically synthesized
ctcactgcaaactccgcctc

SEQ ID NO: 492301 - DNA, 20 bp, Artificial Sequence
  chemically synthesized
aatcacttgaacccgggagg

SEQ ID NO: 492302 - DNA, 20 bp, Artificial Sequence
  chemically synthesized
tactcgggaggctgaggtag

SEQ ID NO: 492303 - DNA, 20 bp, Artificial Sequence
  chemically synthesized
gattctcctacctcagcctc

SEQ ID NO: 492304 - DNA, 20 bp, Artificial Sequence
  chemically synthesized
tttactatttttagtaaaga

SEQ ID NO: 492305 - DNA, 20 bp, Artificial Sequence
  chemically synthesized
cggggtctcaccatgttggc

SEQ ID NO: 492306 - DNA, 20 bp, Artificial Sequence
  chemically synthesized
gcttcaggaggccgaggcgg

SEQ ID NO: 492307 - DNA, 20 bp, Artificial Sequence
  chemically synthesized
gttgcaaagaaagtgaatgg

SEQ ID NO: 492308 - DNA, 20 bp, Artificial Sequence
  chemically synthesized
tttccgaagttgcaaagaaa

SEQ ID NO: 492309 - DNA, 20 bp, Artificial Sequence
  chemically synthesized
ataactatgctatcactttg

SEQ ID NO: 492310 - DNA, 20 bp, Artificial Sequence
  chemically synthesized
accctacatttaatgctcct

SEQ ID NO: 492311 - DNA, 20 bp, Artificial Sequence
  chemically synthesized
attcctaggagcattaaatg

SEQ ID NO: 492312 - DNA, 20 bp, Artificial Sequence
  chemically synthesized
ctgcaggtatctaagacctg

SEQ ID NO: 492313 - DNA, 20 bp, Artificial Sequence
  chemically synthesized
tatcaaattctgttagtgaa

SEQ ID NO: 492314 - DNA, 20 bp, Artificial Sequence
  chemically synthesized
tgttctaccctcttcactaa

SEQ ID NO: 492315 - DNA, 20 bp, Artificial Sequence
  chemically synthesized
cagaatttgataatctacat

SEQ ID NO: 492316 - DNA, 20 bp, Artificial Sequence
  chemically synthesized
tgtaagtgcagttttattga

SEQ ID NO: 492317 - DNA, 20 bp, Artificial Sequence
  chemically synthesized
tatttataatgttaaaggaa

SEQ ID NO: 492318 - DNA, 20 bp, Artificial Sequence
  chemically synthesized
gaggaaaatagcatttctct

SEQ ID NO: 492319 - DNA, 20 bp, Artificial Sequence
  chemically synthesized
gattgcatgtctttgccatt

SEQ ID NO: 492320 - DNA, 20 bp, Artificial Sequence
  chemically synthesized
aggtgcccattaatggtgga

SEQ ID NO: 492321 - DNA, 20 bp, Artificial Sequence
  chemically synthesized
cattaatggtggacaggata

SEQ ID NO: 492322 - DNA, 20 bp, Artificial Sequence
  chemically synthesized
aatgtggcgcgtatacacca

SEQ ID NO: 492323 - DNA, 20 bp, Artificial Sequence
  chemically synthesized
atcatggcctgtgcaacaac

SEQ ID NO: 492324 - DNA, 20 bp, Artificial Sequence
  chemically synthesized
tgttcctgcgttaacgtgct

SEQ ID NO: 492325 - DNA, 20 bp, Artificial Sequence
  chemically synthesized
cgttaacgcaggaacagaca

SEQ ID NO: 492326 - DNA, 20 bp, Artificial Sequence
  chemically synthesized
ttaaaagtgggagctaaaca

SEQ ID NO: 492327 - DNA, 20 bp, Artificial Sequence
  chemically synthesized
gagggaggaagggaacaggc

SEQ ID NO: 492328 - DNA, 20 bp, Artificial Sequence
  chemically synthesized
gtggttaccatgctcgctac

SEQ ID NO: 492329 - DNA, 20 bp, Artificial Sequence
  chemically synthesized
catgctcgctacctgggtgg

SEQ ID NO: 492330 - DNA, 20 bp, Artificial Sequence
  chemically synthesized
atgatgatgaggtttgctat

SEQ ID NO: 492331 - DNA, 20 bp, Artificial Sequence
  chemically synthesized
attcagcgggtacatgttcc

SEQ ID NO: 492332 - DNA, 20 bp, Artificial Sequence
  chemically synthesized
atccagggaacatgtacccg

SEQ ID NO: 492333 - DNA, 20 bp, Artificial Sequence
  chemically synthesized
caacttttattttagattca

SEQ ID NO: 492334 - DNA, 20 bp, Artificial Sequence
  chemically synthesized
atttcatttaactgtttcca

SEQ ID NO: 492335 - DNA, 20 bp, Artificial Sequence
  chemically synthesized
ttaaaatatttatgtatggg

SEQ ID NO: 492336 - DNA, 20 bp, Artificial Sequence
  chemically synthesized
gccttggcctcccacagtgc

SEQ ID NO: 492337 - DNA, 20 bp, Artificial Sequence
  chemically synthesized
ccatgttgaccaggctggtc

SEQ ID NO: 492338 - DNA, 20 bp, Artificial Sequence
  chemically synthesized
gcctcagcctccgaagtacc

SEQ ID NO: 492339 - DNA, 20 bp, Artificial Sequence
  chemically synthesized
tacttcggaggctgaggcag

SEQ ID NO: 492340 - DNA, 20 bp, Artificial Sequence
  chemically synthesized
aacctctgcccccaccaggt

SEQ ID NO: 492341 - DNA, 20 bp, Artificial Sequence
  chemically synthesized
tttcgctctttcgcccaggc

SEQ ID NO: 492342 - DNA, 20 bp, Artificial Sequence
  chemically synthesized
ttttttttttttttttgaga

SEQ ID NO: 492343 - DNA, 20 bp, Artificial Sequence
  chemically synthesized
aaaaaagtatgaaacaaaca

SEQ ID NO: 492344 - DNA, 20 bp, Artificial Sequence
  chemically synthesized
attttagaagagaaaagctc

SEQ ID NO: 492345 - DNA, 20 bp, Artificial Sequence
  chemically synthesized
taataataaaacctgtcctg

SEQ ID NO: 492346 - DNA, 20 bp, Artificial Sequence
  chemically synthesized
gggattgttgtgatgattgc

SEQ ID NO: 492347 - DNA, 20 bp, Artificial Sequence
  chemically synthesized
tcattattactattgctgaa

SEQ ID NO: 492348 - DNA, 20 bp, Artificial Sequence
  chemically synthesized
gcaggaagccccactttatg

SEQ ID NO: 492349 - DNA, 20 bp, Artificial Sequence
  chemically synthesized
cttcttcaataaatgcaaca

SEQ ID NO: 492350 - DNA, 20 bp, Artificial Sequence
  chemically synthesized
ctctgatttaattgtagtat

SEQ ID NO: 492351 - DNA, 20 bp, Artificial Sequence
  chemically synthesized
tcccaatactacaattaaat

SEQ ID NO: 492352 - DNA, 20 bp, Artificial Sequence
  chemically synthesized
atttaatgttaaaataaaac

SEQ ID NO: 492353 - DNA, 20 bp, Artificial Sequence
  chemically synthesized
aggcaacaaagaacatgtat

SEQ ID NO: 492354 - DNA, 20 bp, Artificial Sequence
  chemically synthesized
aggatgcatgaagattgtct

SEQ ID NO: 492355 - DNA, 20 bp, Artificial Sequence
  chemically synthesized
atgaagattgtctctgggtt

SEQ ID NO: 492356 - DNA, 20 bp, Artificial Sequence
  chemically synthesized
actaaacctatttttaatag

SEQ ID NO: 492357 - DNA, 20 bp, Artificial Sequence
  chemically synthesized
atactgcagttatagaaaat

SEQ ID NO: 492358 - DNA, 20 bp, Artificial Sequence
  chemically synthesized
tgctgacaatattaggtgtg

SEQ ID NO: 492359 - DNA, 20 bp, Artificial Sequence
  chemically synthesized
aagcaatagcaaaatactac

SEQ ID NO: 492360 - DNA, 20 bp, Artificial Sequence
  chemically synthesized
acttaaatgtaattctctgg

SEQ ID NO: 492361 - DNA, 20 bp, Artificial Sequence
  chemically synthesized
taagaaaataaattcctcca

SEQ ID NO: 492362 - DNA, 20 bp, Artificial Sequence
  chemically synthesized
cctgagaagtgtggcacagt

SEQ ID NO: 492363 - DNA, 20 bp, Artificial Sequence
  chemically synthesized
agtaggaataaaaacacggt

SEQ ID NO: 492364 - DNA, 20 bp, Artificial Sequence
  chemically synthesized
atccctgttacctggagccc

SEQ ID NO: 492365 - DNA, 20 bp, Artificial Sequence
  chemically synthesized
acccaggggctccaggtaac

SEQ ID NO: 492366 - DNA, 20 bp, Artificial Sequence
  chemically synthesized
catgaagaacaagtgagaaa

SEQ ID NO: 492367 - DNA, 20 bp, Artificial Sequence
  chemically synthesized
ttaggatttcagagtttacg

SEQ ID NO: 492368 - DNA, 20 bp, Artificial Sequence
  chemically synthesized
gtaacatttgtttaggattt

SEQ ID NO: 492369 - DNA, 20 bp, Artificial Sequence
  chemically synthesized
cataataagtaacatttgtt

SEQ ID NO: 492370 - DNA, 20 bp, Artificial Sequence
  chemically synthesized
tctacatgtatttttttcat

SEQ ID NO: 492371 - DNA, 20 bp, Artificial Sequence
  chemically synthesized
catgtatttttttcatctgg

SEQ ID NO: 492372 - DNA, 20 bp, Artificial Sequence
  chemically synthesized
tttttttcatctggatgaat

SEQ ID NO: 492373 - DNA, 20 bp, Artificial Sequence
  chemically synthesized
ttttctctaatcagtagccc

SEQ ID NO: 492374 - DNA, 20 bp, Artificial Sequence
  chemically synthesized
tttaacaaaatattttatat

SEQ ID NO: 492375 - DNA, 20 bp, Artificial Sequence
  chemically synthesized
agtcccattgtggaatgaga

SEQ ID NO: 492376 - DNA, 20 bp, Artificial Sequence
  chemically synthesized
gcagaaattaagtcccattg

SEQ ID NO: 492377 - DNA, 20 bp, Artificial Sequence
  chemically synthesized
tctatatatgtttttgtctt

SEQ ID NO: 492378 - DNA, 20 bp, Artificial Sequence
  chemically synthesized
tgaagacaaaaacatatata

SEQ ID NO: 492379 - DNA, 20 bp, Artificial Sequence
  chemically synthesized
ctacaattgaaaagtgtttt

SEQ ID NO: 492380 - DNA, 20 bp, Artificial Sequence
  chemically synthesized
tacagctatgtgctacaaag

SEQ ID NO: 492381 - DNA, 20 bp, Artificial Sequence
  chemically synthesized
ttcttaagccactaaaattg

SEQ ID NO: 492382 - DNA, 20 bp, Artificial Sequence
  chemically synthesized
tttagtggcttaagaaaaga

SEQ ID NO: 492383 - DNA, 20 bp, Artificial Sequence
  chemically synthesized
gagaaaagctgtttgcagat

SEQ ID NO: 492384 - DNA, 20 bp, Artificial Sequence
  chemically synthesized
gactcagagtccctgaatta

SEQ ID NO: 492385 - DNA, 20 bp, Artificial Sequence
  chemically synthesized
tacccagtaattcagggact

SEQ ID NO: 492386 - DNA, 20 bp, Artificial Sequence
  chemically synthesized
aatggaaggactcagagtcc

SEQ ID NO: 492387 - DNA, 20 bp, Artificial Sequence
  chemically synthesized
aagcctaaaatggaaggact

SEQ ID NO: 492388 - DNA, 20 bp, Artificial Sequence
  chemically synthesized
catttgctaaccttatggaa

SEQ ID NO: 492389 - DNA, 20 bp, Artificial Sequence
  chemically synthesized
gtgaccaattgaatgtgagt

SEQ ID NO: 492390 - DNA, 20 bp, Artificial Sequence
  chemically synthesized
ctagttgtgaccaattgaat

SEQ ID NO: 492391 - DNA, 20 bp, Artificial Sequence
  chemically synthesized
atgtgactagttgtgaccaa

SEQ ID NO: 492392 - DNA, 20 bp, Artificial Sequence
  chemically synthesized
atgtagttgctggcttgcag

SEQ ID NO: 492393 - DNA, 20 bp, Artificial Sequence
  chemically synthesized
tcatagtatagagttcttgc

SEQ ID NO: 492394 - DNA, 20 bp, Artificial Sequence
  chemically synthesized
gtggtccctctttcatagta

SEQ ID NO: 492395 - DNA, 20 bp, Artificial Sequence
  chemically synthesized
tatactatgaaagagggacc

SEQ ID NO: 492396 - DNA, 20 bp, Artificial Sequence
  chemically synthesized
tgcttgaaagaaaagaaagg

SEQ ID NO: 492397 - DNA, 20 bp, Artificial Sequence
  chemically synthesized
tttacttagatgctagagaa

SEQ ID NO: 492398 - DNA, 20 bp, Artificial Sequence
  chemically synthesized
tacatgtttaagggagaaaa

SEQ ID NO: 492399 - DNA, 20 bp, Artificial Sequence
  chemically synthesized
aagcttggtgtaaagaagaa

SEQ ID NO: 492400 - DNA, 20 bp, Artificial Sequence
  chemically synthesized
tctctagtgtccccaacttc

SEQ ID NO: 492401 - DNA, 20 bp, Artificial Sequence
  chemically synthesized
tatttttccctgcatcaaac

SEQ ID NO: 492402 - DNA, 20 bp, Artificial Sequence
  chemically synthesized
caaaccaaggggtattagga

SEQ ID NO: 492403 - DNA, 20 bp, Artificial Sequence
  chemically synthesized
ataatgagaactacaaacca

SEQ ID NO: 492404 - DNA, 20 bp, Artificial Sequence
  chemically synthesized
attatcagcatgaaatgaaa

SEQ ID NO: 492405 - DNA, 20 bp, Artificial Sequence
  chemically synthesized
aaatgaaagaggatgtaatt

SEQ ID NO: 492406 - DNA, 20 bp, Artificial Sequence
  chemically synthesized
cctatggtggggctataacc

SEQ ID NO: 492407 - DNA, 20 bp, Artificial Sequence
  chemically synthesized
actttcttaagactgtagtt

SEQ ID NO: 492408 - DNA, 20 bp, Artificial Sequence
  chemically synthesized
ttgtgtaaggtaacaggcta

SEQ ID NO: 492409 - DNA, 20 bp, Artificial Sequence
  chemically synthesized
ttaccttacacaaagcactg

SEQ ID NO: 492410 - DNA, 20 bp, Artificial Sequence
  chemically synthesized
gaggctgccacggtaatctg

SEQ ID NO: 492411 - DNA, 20 bp, Artificial Sequence
  chemically synthesized
aagttatgtcatttgaaata

SEQ ID NO: 492412 - DNA, 20 bp, Artificial Sequence
  chemically synthesized
gcattattcctcaagagaag

SEQ ID NO: 492413 - DNA, 20 bp, Artificial Sequence
  chemically synthesized
aatacatccatcttctcttg

SEQ ID NO: 492414 - DNA, 20 bp, Artificial Sequence
  chemically synthesized
atcttctcttgaggaataat

SEQ ID NO: 492415 - DNA, 20 bp, Artificial Sequence
  chemically synthesized
caagaaggacattttgcagt

SEQ ID NO: 492416 - DNA, 20 bp, Artificial Sequence
  chemically synthesized
aagaacaagttgtataaata

SEQ ID NO: 492417 - DNA, 20 bp, Artificial Sequence
  chemically synthesized
taagccctaggccggaagtt

SEQ ID NO: 492418 - DNA, 20 bp, Artificial Sequence
  chemically synthesized
ttatggatacaaagacaaac

SEQ ID NO: 492419 - DNA, 20 bp, Artificial Sequence
  chemically synthesized
ggatacaaagacaaacatga

SEQ ID NO: 492420 - DNA, 20 bp, Artificial Sequence
  chemically synthesized
atgagtgggtctttaagcaa

SEQ ID NO: 492421 - DNA, 20 bp, Artificial Sequence
  chemically synthesized
cattaataaaagtcactatg

SEQ ID NO: 492422 - DNA, 20 bp, Artificial Sequence
  chemically synthesized
aaaagtcactatgaagagta

SEQ ID NO: 492423 - DNA, 20 bp, Artificial Sequence
  chemically synthesized
agccagtggtgaagagactg

SEQ ID NO: 492424 - DNA, 20 bp, Artificial Sequence
  chemically synthesized
ttgaacagtcatttctttac

SEQ ID NO: 492425 - DNA, 20 bp, Artificial Sequence
  chemically synthesized
gactgttcaaatgaaaacaa

SEQ ID NO: 492426 - DNA, 20 bp, Artificial Sequence
  chemically synthesized
aaacaagtggataaattcaa

SEQ ID NO: 492427 - DNA, 20 bp, Artificial Sequence
  chemically synthesized
caaatctacaataaactctc

SEQ ID NO: 492428 - DNA, 20 bp, Artificial Sequence
  chemically synthesized
gataaatgaacgtgccttac

SEQ ID NO: 492429 - DNA, 20 bp, Artificial Sequence
  chemically synthesized
agacaatggcaccaccatac

SEQ ID NO: 492430 - DNA, 20 bp, Artificial Sequence
  chemically synthesized
agctttcccctaccatcgag

SEQ ID NO: 492431 - DNA, 20 bp, Artificial Sequence
  chemically synthesized
ggtaggggaaagcttgtgag

SEQ ID NO: 492432 - DNA, 20 bp, Artificial Sequence
  chemically synthesized
ttaaaaggttggtcaagtgt

SEQ ID NO: 492433 - DNA, 20 bp, Artificial Sequence
  chemically synthesized
gtctggaagaaagaagatgc

SEQ ID NO: 492434 - DNA, 20 bp, Artificial Sequence
  chemically synthesized
ggatggagggaaaatgtagt

SEQ ID NO: 492435 - DNA, 20 bp, Artificial Sequence
  chemically synthesized
ggaaaatgtagttggaatca

SEQ ID NO: 492436 - DNA, 20 bp, Artificial Sequence
  chemically synthesized
aatgtagttggaatcacgga

SEQ ID NO: 492437 - DNA, 20 bp, Artificial Sequence
  chemically synthesized
gttggaatcacggaatggat

SEQ ID NO: 492438 - DNA, 20 bp, Artificial Sequence
  chemically synthesized
aggaaaaatccaactttttg

SEQ ID NO: 492439 - DNA, 20 bp, Artificial Sequence
  chemically synthesized
ctttaatattcctcaaaaag

SEQ ID NO: 492440 - DNA, 20 bp, Artificial Sequence
  chemically synthesized
agaaaatgggctcaaaaagg

SEQ ID NO: 492441 - DNA, 20 bp, Artificial Sequence
  chemically synthesized
gtagtaccagaatctccttg

SEQ ID NO: 492442 - DNA, 20 bp, Artificial Sequence
  chemically synthesized
gaatttagcttctgtagtac

SEQ ID NO: 492443 - DNA, 20 bp, Artificial Sequence
  chemically synthesized
gaaaatgccttccttcttaa

SEQ ID NO: 492444 - DNA, 20 bp, Artificial Sequence
  chemically synthesized
gcattctgtagcaaaatgct

SEQ ID NO: 492445 - DNA, 20 bp, Artificial Sequence
  chemically synthesized
tcacccacagcattttgcta

SEQ ID NO: 492446 - DNA, 20 bp, Artificial Sequence
  chemically synthesized
agcattttgctacagaatgc

SEQ ID NO: 492447 - DNA, 20 bp, Artificial Sequence
  chemically synthesized
acttgcttatgatgccgcat

SEQ ID NO: 492448 - DNA, 20 bp, Artificial Sequence
  chemically synthesized
taaaatgaaaatgtgtatgt

SEQ ID NO: 492449 - DNA, 20 bp, Artificial Sequence
  chemically synthesized
ttttgaacatactgaagccc

SEQ ID NO: 492450 - DNA, 20 bp, Artificial Sequence
  chemically synthesized
gtttctcttcagaaaagctg

SEQ ID NO: 492451 - DNA, 20 bp, Artificial Sequence
  chemically synthesized
tgaagagaaacctgaggttc

SEQ ID NO: 492452 - DNA, 20 bp, Artificial Sequence
  chemically synthesized
caggtgggaagatgatagag

SEQ ID NO: 492453 - DNA, 20 bp, Artificial Sequence
  chemically synthesized
gaggaaagaaccagcagagc

SEQ ID NO: 492454 - DNA, 20 bp, Artificial Sequence
  chemically synthesized
gattggtacttggagcttaa

SEQ ID NO: 492455 - DNA, 20 bp, Artificial Sequence
  chemically synthesized
gtcaggtttcatcagacatt

SEQ ID NO: 492456 - DNA, 20 bp, Artificial Sequence
  chemically synthesized
gacctcatgcaaaaatatta

SEQ ID NO: 492457 - DNA, 20 bp, Artificial Sequence
  chemically synthesized
aaaatattaaagaatactta

SEQ ID NO: 492458 - DNA, 20 bp, Artificial Sequence
  chemically synthesized
attacattttcaattgtatc

SEQ ID NO: 492459 - DNA, 20 bp, Artificial Sequence
  chemically synthesized
agaggtcaaacttcacaaaa

SEQ ID NO: 492460 - DNA, 20 bp, Artificial Sequence
  chemically synthesized
ttattgcctcaatttctgca

SEQ ID NO: 492461 - DNA, 20 bp, Artificial Sequence
  chemically synthesized
ttgggaaataaggaacacct

SEQ ID NO: 492462 - DNA, 20 bp, Artificial Sequence
  chemically synthesized
agcatttattacgtgttgtg

SEQ ID NO: 492463 - DNA, 20 bp, Artificial Sequence
  chemically synthesized
cgtaataaatgctgcctggt

SEQ ID NO: 492464 - DNA, 20 bp, Artificial Sequence
  chemically synthesized
ttgggaagtgctgacacaaa

SEQ ID NO: 492465 - DNA, 20 bp, Artificial Sequence
  chemically synthesized
acaagaattgtctagaataa

SEQ ID NO: 492466 - DNA, 20 bp, Artificial Sequence
  chemically synthesized
cattcagtacaagaattgtc

SEQ ID NO: 492467 - DNA, 20 bp, Artificial Sequence
  chemically synthesized
tattctagacaattcttgta

SEQ ID NO: 492468 - DNA, 20 bp, Artificial Sequence
  chemically synthesized
aaattaagttcattcagtac

SEQ ID NO: 492469 - DNA, 20 bp, Artificial Sequence
  chemically synthesized
tctttcagttctggcatagt

SEQ ID NO: 492470 - DNA, 20 bp, Artificial Sequence
  chemically synthesized
tcagttctggcatagtttgg

SEQ ID NO: 492471 - DNA, 20 bp, Artificial Sequence
  chemically synthesized
cagaagtttgtttagcagca

SEQ ID NO: 492472 - DNA, 20 bp, Artificial Sequence
  chemically synthesized
tgaggaaaatgttagtctat

SEQ ID NO: 492473 - DNA, 20 bp, Artificial Sequence
  chemically synthesized
taatgggggaaaggttaccg

SEQ ID NO: 492474 - DNA, 20 bp, Artificial Sequence
  chemically synthesized
aaccccataggttcaaacta

SEQ ID NO: 492475 - DNA, 20 bp, Artificial Sequence
  chemically synthesized
tatccactagtttgaaccta

SEQ ID NO: 492476 - DNA, 20 bp, Artificial Sequence
  chemically synthesized
tggcattttatctctgagac

SEQ ID NO: 492477 - DNA, 20 bp, Artificial Sequence
  chemically synthesized
tctgagacgtggatttatcg

SEQ ID NO: 492478 - DNA, 20 bp, Artificial Sequence
  chemically synthesized
tcgacgataaatccacgtct

SEQ ID NO: 492479 - DNA, 20 bp, Artificial Sequence
  chemically synthesized
cttagagcaaattctgagac

SEQ ID NO: 492480 - DNA, 20 bp, Artificial Sequence
  chemically synthesized
ctaagcctgagaggagatga

SEQ ID NO: 492481 - DNA, 20 bp, Artificial Sequence
  chemically synthesized
ttctcaagaagtctgcacat

SEQ ID NO: 492482 - DNA, 20 bp, Artificial Sequence
  chemically synthesized
ctcttatgtgcagacttctt

SEQ ID NO: 492483 - DNA, 20 bp, Artificial Sequence
  chemically synthesized
atgtgcagacttcttgagaa

SEQ ID NO: 492484 - DNA, 20 bp, Artificial Sequence
  chemically synthesized
acagcttgttgggagaaagc

SEQ ID NO: 492485 - DNA, 20 bp, Artificial Sequence
  chemically synthesized
ctcatgctttgattgaaatg

SEQ ID NO: 492486 - DNA, 20 bp, Artificial Sequence
  chemically synthesized
atataatgaatggaggagga

SEQ ID NO: 492487 - DNA, 20 bp, Artificial Sequence
  chemically synthesized
ctaaatataatgaatggagg

SEQ ID NO: 492488 - DNA, 20 bp, Artificial Sequence
  chemically synthesized
ctgtaacagagctaaatata

SEQ ID NO: 492489 - DNA, 20 bp, Artificial Sequence
  chemically synthesized
ctctgttacagcatcaactg

SEQ ID NO: 492490 - DNA, 20 bp, Artificial Sequence
  chemically synthesized
gacatgtaagagaattattt

SEQ ID NO: 492491 - DNA, 20 bp, Artificial Sequence
  chemically synthesized
tgaaggaggcagacatgtaa

SEQ ID NO: 492492 - DNA, 20 bp, Artificial Sequence
  chemically synthesized
ctgcctccttcaccagattg

SEQ ID NO: 492493 - DNA, 20 bp, Artificial Sequence
  chemically synthesized
aggtgttcaataaatatttg

SEQ ID NO: 492494 - DNA, 20 bp, Artificial Sequence
  chemically synthesized
agtcaaaaatttctgtccat

SEQ ID NO: 492495 - DNA, 20 bp, Artificial Sequence
  chemically synthesized
atcttacacttcaagtaatg

SEQ ID NO: 492496 - DNA, 20 bp, Artificial Sequence
  chemically synthesized
aagaggtttggcttgtaact

SEQ ID NO: 492497 - DNA, 20 bp, Artificial Sequence
  chemically synthesized
agctgtcttatttataaatt

SEQ ID NO: 492498 - DNA, 20 bp, Artificial Sequence
  chemically synthesized
aagttagctagtggaagagc

SEQ ID NO: 492499 - DNA, 20 bp, Artificial Sequence
  chemically synthesized
agtatacagagtagagccca

SEQ ID NO: 492500 - DNA, 20 bp, Artificial Sequence
  chemically synthesized
atactaaagaaagcagtata

SEQ ID NO: 492501 - DNA, 20 bp, Artificial Sequence
  chemically synthesized
tagagggcagttgtgacagt

SEQ ID NO: 492502 - DNA, 20 bp, Artificial Sequence
  chemically synthesized
gtttactgtttttgattaat

SEQ ID NO: 492503 - DNA, 20 bp, Artificial Sequence
  chemically synthesized
taatcaaaaacagtaaacaa

SEQ ID NO: 492504 - DNA, 20 bp, Artificial Sequence
  chemically synthesized
ttttcaatgacgtgaaccag

SEQ ID NO: 492505 - DNA, 20 bp, Artificial Sequence
  chemically synthesized
ctgcaagtgaagttcaatca

SEQ ID NO: 492506 - DNA, 20 bp, Artificial Sequence
  chemically synthesized
cagacacaagagggagacct

SEQ ID NO: 492507 - DNA, 20 bp, Artificial Sequence
  chemically synthesized
ttagttcaacgcaagagaaa

SEQ ID NO: 492508 - DNA, 20 bp, Artificial Sequence
  chemically synthesized
agcgcaaatggtattgctct

SEQ ID NO: 492509 - DNA, 20 bp, Artificial Sequence
  chemically synthesized
ataccatttgcgctccagag

SEQ ID NO: 492510 - DNA, 20 bp, Artificial Sequence
  chemically synthesized
gagattcccttggtgaatat

SEQ ID NO: 492511 - DNA, 20 bp, Artificial Sequence
  chemically synthesized
aaaatccacatattcaccaa

SEQ ID NO: 492512 - DNA, 20 bp, Artificial Sequence
  chemically synthesized
gtgtgagagagattcccttg

SEQ ID NO: 492513 - DNA, 20 bp, Artificial Sequence
  chemically synthesized
acacagtcaatatagtttag

SEQ ID NO: 492514 - DNA, 20 bp, Artificial Sequence
  chemically synthesized
ttactacatgagattgctta

SEQ ID NO: 492515 - DNA, 20 bp, Artificial Sequence
  chemically synthesized
tgccaggaatgattacgtga

SEQ ID NO: 492516 - DNA, 20 bp, Artificial Sequence
  chemically synthesized
aatatgccaggaatgattac

SEQ ID NO: 492517 - DNA, 20 bp, Artificial Sequence
  chemically synthesized
atttcaaacagaaatatgcc

SEQ ID NO: 492518 - DNA, 20 bp, Artificial Sequence
  chemically synthesized
cgctgtttccatgtagatga

SEQ ID NO: 492519 - DNA, 20 bp, Artificial Sequence
  chemically synthesized
actaaacaattcatttttat

SEQ ID NO: 492520 - DNA, 20 bp, Artificial Sequence
  chemically synthesized
tgagtaaaactcctataaaa

SEQ ID NO: 492521 - DNA, 20 bp, Artificial Sequence
  chemically synthesized
aacatttgaatttgtgggag

SEQ ID NO: 492522 - DNA, 20 bp, Artificial Sequence
  chemically synthesized
aaaattagcaagacaaacat

SEQ ID NO: 492523 - DNA, 20 bp, Artificial Sequence
  chemically synthesized
gtacaaagaccttttagtga

SEQ ID NO: 492524 - DNA, 20 bp, Artificial Sequence
  chemically synthesized
aggtgtacaaagacctttta

SEQ ID NO: 492525 - DNA, 20 bp, Artificial Sequence
  chemically synthesized
gtctttgtacacctaatact

SEQ ID NO: 492526 - DNA, 20 bp, Artificial Sequence
  chemically synthesized
acatttcgttgcaaatgtgg

SEQ ID NO: 492527 - DNA, 20 bp, Artificial Sequence
  chemically synthesized
atgagctacatatttttggg

SEQ ID NO: 492528 - DNA, 20 bp, Artificial Sequence
  chemically synthesized
ccatttcacattttcatttt

SEQ ID NO: 492529 - DNA, 20 bp, Artificial Sequence
  chemically synthesized
actttattgttatttagtca

SEQ ID NO: 492530 - DNA, 20 bp, Artificial Sequence
  chemically synthesized
cattccagattgaacttacg

SEQ ID NO: 492531 - DNA, 20 bp, Artificial Sequence
  chemically synthesized
catccctcgtaagttcaatc

SEQ ID NO: 492532 - DNA, 20 bp, Artificial Sequence
  chemically synthesized
agattgctcaatgatcaaat

SEQ ID NO: 492533 - DNA, 20 bp, Artificial Sequence
  chemically synthesized
agcgcttagatgtaaactac

SEQ ID NO: 492534 - DNA, 20 bp, Artificial Sequence
  chemically synthesized
ctacttgagtgtcactgcct

SEQ ID NO: 492535 - DNA, 20 bp, Artificial Sequence
  chemically synthesized
aaaatttagaccttaacaag

SEQ ID NO: 492536 - DNA, 20 bp, Artificial Sequence
  chemically synthesized
tcaaaggcaaagctctgatt

SEQ ID NO: 492537 - DNA, 20 bp, Artificial Sequence
  chemically synthesized
cgctcccatgatctggcatt

SEQ ID NO: 492538 - DNA, 20 bp, Artificial Sequence
  chemically synthesized
gcccagggagttgagggatt

SEQ ID NO: 492539 - DNA, 20 bp, Artificial Sequence
  chemically synthesized
aacatttgcccagggagttg

SEQ ID NO: 492540 - DNA, 20 bp, Artificial Sequence
  chemically synthesized
gactttgaaacatttgccca

SEQ ID NO: 492541 - DNA, 20 bp, Artificial Sequence
  chemically synthesized
aaatgtttcaaagtcagtta

SEQ ID NO: 492542 - DNA, 20 bp, Artificial Sequence
  chemically synthesized
tcagttactgggtatggcta

SEQ ID NO: 492543 - DNA, 20 bp, Artificial Sequence
  chemically synthesized
ggggtaaatctttgcatgag

SEQ ID NO: 492544 - DNA, 20 bp, Artificial Sequence
  chemically synthesized
agtgggaaaaacttgaacat

SEQ ID NO: 492545 - DNA, 20 bp, Artificial Sequence
  chemically synthesized
ggcgaccagatctatgtgca

SEQ ID NO: 492546 - DNA, 20 bp, Artificial Sequence
  chemically synthesized
gcacagagttcctcacagtg

SEQ ID NO: 492547 - DNA, 20 bp, Artificial Sequence
  chemically synthesized
gagttcctcacagtgcagga

SEQ ID NO: 492548 - DNA, 20 bp, Artificial Sequence
  chemically synthesized
gtttctgcatcttagctatt

SEQ ID NO: 492549 - DNA, 20 bp, Artificial Sequence
  chemically synthesized
acctaaatgcccattggcag

SEQ ID NO: 492550 - DNA, 20 bp, Artificial Sequence
  chemically synthesized
aatgtggtatatatacacaa

SEQ ID NO: 492551 - DNA, 20 bp, Artificial Sequence
  chemically synthesized
agaatttccttttataaagg

SEQ ID NO: 492552 - DNA, 20 bp, Artificial Sequence
  chemically synthesized
atccatattgtttcatattg

SEQ ID NO: 492553 - DNA, 20 bp, Artificial Sequence
  chemically synthesized
attctgcaatatgaaacaat

SEQ ID NO: 492554 - DNA, 20 bp, Artificial Sequence
  chemically synthesized
gataccttatttcaagtaag

SEQ ID NO: 492555 - DNA, 20 bp, Artificial Sequence
  chemically synthesized
ccagtccagtctttgatttt

SEQ ID NO: 492556 - DNA, 20 bp, Artificial Sequence
  chemically synthesized
actggtggttgccaggggct

SEQ ID NO: 492557 - DNA, 20 bp, Artificial Sequence
  chemically synthesized
gacattacatttcagttaag

SEQ ID NO: 492558 - DNA, 20 bp, Artificial Sequence
  chemically synthesized
ttacatttcagttaagtagg

SEQ ID NO: 492559 - DNA, 20 bp, Artificial Sequence
  chemically synthesized
ctgctgtccaacattctacc

SEQ ID NO: 492560 - DNA, 20 bp, Artificial Sequence
  chemically synthesized
acattattattgactctagg

SEQ ID NO: 492561 - DNA, 20 bp, Artificial Sequence
  chemically synthesized
ctaaccctaagcctgttatt

SEQ ID NO: 492562 - DNA, 20 bp, Artificial Sequence
  chemically synthesized
tgtatcctaaataacaggct

SEQ ID NO: 492563 - DNA, 20 bp, Artificial Sequence
  chemically synthesized
aattccttagagttttgtac

SEQ ID NO: 492564 - DNA, 20 bp, Artificial Sequence
  chemically synthesized
cattccagtacaaaactcta

SEQ ID NO: 492565 - DNA, 20 bp, Artificial Sequence
  chemically synthesized
atacaataaaataaattcct

SEQ ID NO: 492566 - DNA, 20 bp, Artificial Sequence
  chemically synthesized
tgtatcaagtggtttgctat

SEQ ID NO: 492567 - DNA, 20 bp, Artificial Sequence
  chemically synthesized
tttttccaaattccttgcca

SEQ ID NO: 492568 - DNA, 20 bp, Artificial Sequence
  chemically synthesized
aagcagtttattccctggca

SEQ ID NO: 492569 - DNA, 20 bp, Artificial Sequence
  chemically synthesized
gaaaaagaaaatgagagaga

SEQ ID NO: 492570 - DNA, 20 bp, Artificial Sequence
  chemically synthesized
gagagagagagaattctaaa

SEQ ID NO: 492571 - DNA, 20 bp, Artificial Sequence
  chemically synthesized
atggacatctagattcgatt

SEQ ID NO: 492572 - DNA, 20 bp, Artificial Sequence
  chemically synthesized
taattgtcaaggaaagcaga

SEQ ID NO: 492573 - DNA, 20 bp, Artificial Sequence
  chemically synthesized
aattttttaaattcccagac

SEQ ID NO: 492574 - DNA, 20 bp, Artificial Sequence
  chemically synthesized
tcctcataccatcctggtct

SEQ ID NO: 492575 - DNA, 20 bp, Artificial Sequence
  chemically synthesized
tcccagaccaggatggtatg

SEQ ID NO: 492576 - DNA, 20 bp, Artificial Sequence
  chemically synthesized
caatgcatagctcttacagc

SEQ ID NO: 492577 - DNA, 20 bp, Artificial Sequence
  chemically synthesized
gcttcattcccttaagaaaa

SEQ ID NO: 492578 - DNA, 20 bp, Artificial Sequence
  chemically synthesized
ttattattcctttttcttaa

SEQ ID NO: 492579 - DNA, 20 bp, Artificial Sequence
  chemically synthesized
cataacacaagttataagtt

SEQ ID NO: 492580 - DNA, 20 bp, Artificial Sequence
  chemically synthesized
tgtatgccagggaaatgctt

SEQ ID NO: 492581 - DNA, 20 bp, Artificial Sequence
  chemically synthesized
ctggcatacatttctaatgt

SEQ ID NO: 492582 - DNA, 20 bp, Artificial Sequence
  chemically synthesized
tttctaatgtgtgaatcttt

SEQ ID NO: 492583 - DNA, 20 bp, Artificial Sequence
  chemically synthesized
tgccagaaataaagaaacaa

SEQ ID NO: 492584 - DNA, 20 bp, Artificial Sequence
  chemically synthesized
atcaatttaattgttgagct

SEQ ID NO: 492585 - DNA, 20 bp, Artificial Sequence
  chemically synthesized
attaattattttaaatgtaa

SEQ ID NO: 492586 - DNA, 20 bp, Artificial Sequence
  chemically synthesized
tataaacataaacttgacta

SEQ ID NO: 492587 - DNA, 20 bp, Artificial Sequence
  chemically synthesized
agagtcataatttttaaaca

SEQ ID NO: 492588 - DNA, 20 bp, Artificial Sequence
  chemically synthesized
tgaaaagtgaaatctatatt

SEQ ID NO: 492589 - DNA, 20 bp, Artificial Sequence
  chemically synthesized
cagtttcatggtgtcaaaaa

SEQ ID NO: 492590 - DNA, 20 bp, Artificial Sequence
  chemically synthesized
aatatgtgtgaaatttatgt

SEQ ID NO: 492591 - DNA, 20 bp, Artificial Sequence
  chemically synthesized
taattaattttttagtattt

SEQ ID NO: 492592 - DNA, 20 bp, Artificial Sequence
  chemically synthesized
gtcagtaaatagttgttgaa

SEQ ID NO: 492593 - DNA, 20 bp, Artificial Sequence
  chemically synthesized
aacaagtcagtaaatagttg

SEQ ID NO: 492594 - DNA, 20 bp, Artificial Sequence
  chemically synthesized
ttgtgtacacagttctaaca

SEQ ID NO: 492595 - DNA, 20 bp, Artificial Sequence
  chemically synthesized
tccctaagatgggttggact

SEQ ID NO: 492596 - DNA, 20 bp, Artificial Sequence
  chemically synthesized
ccatagtccaacccatctta

SEQ ID NO: 492597 - DNA, 20 bp, Artificial Sequence
  chemically synthesized
tgcttcttaaactccctaag

SEQ ID NO: 492598 - DNA, 20 bp, Artificial Sequence
  chemically synthesized
tttgcaaaataattgtattt

SEQ ID NO: 492599 - DNA, 20 bp, Artificial Sequence
  chemically synthesized
ccttaaaacttcaggatcag

SEQ ID NO: 492600 - DNA, 20 bp, Artificial Sequence
  chemically synthesized
tcaaatatgccttaaaactt

SEQ ID NO: 492601 - DNA, 20 bp, Artificial Sequence
  chemically synthesized
tttaaaaaatttaaaaaaga

SEQ ID NO: 492602 - DNA, 20 bp, Artificial Sequence
  chemically synthesized
aaatttaaaaaagaaagaat

SEQ ID NO: 492603 - DNA, 20 bp, Artificial Sequence
  chemically synthesized
aagaattggggttgggaaag

SEQ ID NO: 492604 - DNA, 20 bp, Artificial Sequence
  chemically synthesized
tgtccttactagagtctaaa

SEQ ID NO: 492605 - DNA, 20 bp, Artificial Sequence
  chemically synthesized
ggtaattcttgtgtccttac

SEQ ID NO: 492606 - DNA, 20 bp, Artificial Sequence
  chemically synthesized
ttagactctagtaaggacac

SEQ ID NO: 492607 - DNA, 20 bp, Artificial Sequence
  chemically synthesized
atttctttcccaaataacta

SEQ ID NO: 492608 - DNA, 20 bp, Artificial Sequence
  chemically synthesized
ttatttgggaaagaaatgta

SEQ ID NO: 492609 - DNA, 20 bp, Artificial Sequence
  chemically synthesized
tatggtgctaggtcctatat

SEQ ID NO: 492610 - DNA, 20 bp, Artificial Sequence
  chemically synthesized
aagttacggtaggataagaa

SEQ ID NO: 492611 - DNA, 20 bp, Artificial Sequence
  chemically synthesized
tactagaatgtaagttacgg

SEQ ID NO: 492612 - DNA, 20 bp, Artificial Sequence
  chemically synthesized
actctcatgcaattgcctac

SEQ ID NO: 492613 - DNA, 20 bp, Artificial Sequence
  chemically synthesized
attctagtaggcaattgcat

SEQ ID NO: 492614 - DNA, 20 bp, Artificial Sequence
  chemically synthesized
aaatacaccttctcctctac

SEQ ID NO: 492615 - DNA, 20 bp, Artificial Sequence
  chemically synthesized
agacttattggtttggacag

SEQ ID NO: 492616 - DNA, 20 bp, Artificial Sequence
  chemically synthesized
aaaaaaatatgtaagtcttc

SEQ ID NO: 492617 - DNA, 20 bp, Artificial Sequence
  chemically synthesized
atatgtaagtcttcaagagt

SEQ ID NO: 492618 - DNA, 20 bp, Artificial Sequence
  chemically synthesized
tggataagctcagataaagt

SEQ ID NO: 492619 - DNA, 20 bp, Artificial Sequence
  chemically synthesized
taggaatgggagagataggc

SEQ ID NO: 492620 - DNA, 20 bp, Artificial Sequence
  chemically synthesized
tggtgatgtttagagccact

SEQ ID NO: 492621 - DNA, 20 bp, Artificial Sequence
  chemically synthesized
gatgtttagagccactgtga

SEQ ID NO: 492622 - DNA, 20 bp, Artificial Sequence
  chemically synthesized
gttgtttttttcgttgggac

SEQ ID NO: 492623 - DNA, 20 bp, Artificial Sequence
  chemically synthesized
aaaaaaacaacagggaacgt

SEQ ID NO: 492624 - DNA, 20 bp, Artificial Sequence
  chemically synthesized
acgttaggatcgctgattcc

SEQ ID NO: 492625 - DNA, 20 bp, Artificial Sequence
  chemically synthesized
aaaaaggtctgtacaattcc

SEQ ID NO: 492626 - DNA, 20 bp, Artificial Sequence
  chemically synthesized
tgcgtaagctaagtagtttt

SEQ ID NO: 492627 - DNA, 20 bp, Artificial Sequence
  chemically synthesized
gactggaggaagaaacattt

SEQ ID NO: 492628 - DNA, 20 bp, Artificial Sequence
  chemically synthesized
gggaaggaaaagggaaaggg

SEQ ID NO: 492629 - DNA, 20 bp, Artificial Sequence
  chemically synthesized
ttagggcgaagtgtgttagg

SEQ ID NO: 492630 - DNA, 20 bp, Artificial Sequence
  chemically synthesized
tagggggagtagacaagtga

SEQ ID NO: 492631 - DNA, 20 bp, Artificial Sequence
  chemically synthesized
cttatttgttcttccaggga

SEQ ID NO: 492632 - DNA, 20 bp, Artificial Sequence
  chemically synthesized
taattcttatttgttcttcc

SEQ ID NO: 492633 - DNA, 20 bp, Artificial Sequence
  chemically synthesized
ctatccctggaagaacaaat

SEQ ID NO: 492634 - DNA, 20 bp, Artificial Sequence
  chemically synthesized
attttttaaaaaacaaaaat

SEQ ID NO: 492635 - DNA, 20 bp, Artificial Sequence
  chemically synthesized
atctatttctacacaaaagc

SEQ ID NO: 492636 - DNA, 20 bp, Artificial Sequence
  chemically synthesized
gaggagcaagactgaaattc

SEQ ID NO: 492637 - DNA, 20 bp, Artificial Sequence
  chemically synthesized
aagactgaaattccagagtc

SEQ ID NO: 492638 - DNA, 20 bp, Artificial Sequence
  chemically synthesized
tatttctacaccctagactc

SEQ ID NO: 492639 - DNA, 20 bp, Artificial Sequence
  chemically synthesized
gaggagcaagactgaaattc

SEQ ID NO: 492640 - DNA, 20 bp, Artificial Sequence
  chemically synthesized
actatctcttgcctagactc

SEQ ID NO: 492641 - DNA, 20 bp, Artificial Sequence
  chemically synthesized
ttgaaatctaagcaggagat

SEQ ID NO: 492642 - DNA, 20 bp, Artificial Sequence
  chemically synthesized
gggtcatctgacttttggtt

SEQ ID NO: 492643 - DNA, 20 bp, Artificial Sequence
  chemically synthesized
acgttcttacattttctctc

SEQ ID NO: 492644 - DNA, 20 bp, Artificial Sequence
  chemically synthesized
cttctgctttattcaactaa

SEQ ID NO: 492645 - DNA, 20 bp, Artificial Sequence
  chemically synthesized
tatgaccaccatccacttag

SEQ ID NO: 492646 - DNA, 20 bp, Artificial Sequence
  chemically synthesized
agggagccagggaggagaag

SEQ ID NO: 492647 - DNA, 20 bp, Artificial Sequence
  chemically synthesized
agatgaggtgatgagctcag

SEQ ID NO: 492648 - DNA, 20 bp, Artificial Sequence
  chemically synthesized
catttttctgaggaagctac

SEQ ID NO: 492649 - DNA, 20 bp, Artificial Sequence
  chemically synthesized
ctcagaaaaatgatttgggc

SEQ ID NO: 492650 - DNA, 20 bp, Artificial Sequence
  chemically synthesized
ttgggctggaattatagctt

SEQ ID NO: 492651 - DNA, 20 bp, Artificial Sequence
  chemically synthesized
agcttaagggtcatcaacat

SEQ ID NO: 492652 - DNA, 20 bp, Artificial Sequence
  chemically synthesized
ttcctcttacttgacattat

SEQ ID NO: 492653 - DNA, 20 bp, Artificial Sequence
  chemically synthesized
ggtcctagatcaaaactatg

SEQ ID NO: 492654 - DNA, 20 bp, Artificial Sequence
  chemically synthesized
acttaatggaagggcagatg

SEQ ID NO: 492655 - DNA, 20 bp, Artificial Sequence
  chemically synthesized
ggcagatgaggaattcacaa

SEQ ID NO: 492656 - DNA, 20 bp, Artificial Sequence
  chemically synthesized
tctacactcttaactccttt

SEQ ID NO: 492657 - DNA, 20 bp, Artificial Sequence
  chemically synthesized
gaggaattcacaaaggagtt

SEQ ID NO: 492658 - DNA, 20 bp, Artificial Sequence
  chemically synthesized
tcacaaaggagttaagagtg

SEQ ID NO: 492659 - DNA, 20 bp, Artificial Sequence
  chemically synthesized
agagtcatataagcaaggaa

SEQ ID NO: 492660 - DNA, 20 bp, Artificial Sequence
  chemically synthesized
acagagtgttttaagcagaa

SEQ ID NO: 492661 - DNA, 20 bp, Artificial Sequence
  chemically synthesized
tggtccataataaggtgaac

SEQ ID NO: 492662 - DNA, 20 bp, Artificial Sequence
  chemically synthesized
tcctcatgttgctaaatttg

SEQ ID NO: 492663 - DNA, 20 bp, Artificial Sequence
  chemically synthesized
ggaccatcagtgtccttgat

SEQ ID NO: 492664 - DNA, 20 bp, Artificial Sequence
  chemically synthesized
tagataggttgtttatgata

SEQ ID NO: 492665 - DNA, 20 bp, Artificial Sequence
  chemically synthesized
cagtgtagcacatagacttc

SEQ ID NO: 492666 - DNA, 20 bp, Artificial Sequence
  chemically synthesized
atgattaaacaaaaatacta

SEQ ID NO: 492667 - DNA, 20 bp, Artificial Sequence
  chemically synthesized
agagaatgttcaaatgctca

SEQ ID NO: 492668 - DNA, 20 bp, Artificial Sequence
  chemically synthesized
gttcaaatgctcatagaata

SEQ ID NO: 492669 - DNA, 20 bp, Artificial Sequence
  chemically synthesized
tctctttctcaaaatactga

SEQ ID NO: 492670 - DNA, 20 bp, Artificial Sequence
  chemically synthesized
cttccatgaatatgttctgt

SEQ ID NO: 492671 - DNA, 20 bp, Artificial Sequence
  chemically synthesized
tattttgtgttaacacttcc

SEQ ID NO: 492672 - DNA, 20 bp, Artificial Sequence
  chemically synthesized
catttatttgttcaaatgtt

SEQ ID NO: 492673 - DNA, 20 bp, Artificial Sequence
  chemically synthesized
atgttgagaattacaaattg

SEQ ID NO: 492674 - DNA, 20 bp, Artificial Sequence
  chemically synthesized
tctttaataataagagtttt

SEQ ID NO: 492675 - DNA, 20 bp, Artificial Sequence
  chemically synthesized
tgtattatatctttaataat

SEQ ID NO: 492676 - DNA, 20 bp, Artificial Sequence
  chemically synthesized
acactttgtgtgtctttcgt

SEQ ID NO: 492677 - DNA, 20 bp, Artificial Sequence
  chemically synthesized
ataaatactgtcaagctttg

SEQ ID NO: 492678 - DNA, 20 bp, Artificial Sequence
  chemically synthesized
atctcggtaccaataaaacg

SEQ ID NO: 492679 - DNA, 20 bp, Artificial Sequence
  chemically synthesized
gttacaaaaagtggtgctta

SEQ ID NO: 492680 - DNA, 20 bp, Artificial Sequence
  chemically synthesized
ggcacgtataatgagtatca

SEQ ID NO: 492681 - DNA, 20 bp, Artificial Sequence
  chemically synthesized
ccgtgtgcatggcacgtata

SEQ ID NO: 492682 - DNA, 20 bp, Artificial Sequence
  chemically synthesized
cattgaaattaaataaataa

SEQ ID NO: 492683 - DNA, 20 bp, Artificial Sequence
  chemically synthesized
taatttcaatgatgttatca

SEQ ID NO: 492684 - DNA, 20 bp, Artificial Sequence
  chemically synthesized
cactggaaacaaagaatttc

SEQ ID NO: 492685 - DNA, 20 bp, Artificial Sequence
  chemically synthesized
atgaatatacactggaaaca

SEQ ID NO: 492686 - DNA, 20 bp, Artificial Sequence
  chemically synthesized
ttccagtgtatattcatata

SEQ ID NO: 492687 - DNA, 20 bp, Artificial Sequence
  chemically synthesized
aatagtggtttattccatat

SEQ ID NO: 492688 - DNA, 20 bp, Artificial Sequence
  chemically synthesized
gtctgcagaacatgaaaaat

SEQ ID NO: 492689 - DNA, 20 bp, Artificial Sequence
  chemically synthesized
agctgattagaagacgtttg

SEQ ID NO: 492690 - DNA, 20 bp, Artificial Sequence
  chemically synthesized
acaaacgtcttctaatcagc

SEQ ID NO: 492691 - DNA, 20 bp, Artificial Sequence
  chemically synthesized
ttaacataagagatacaaag

SEQ ID NO: 492692 - DNA, 20 bp, Artificial Sequence
  chemically synthesized
tctctagggcaaatctaggg

SEQ ID NO: 492693 - DNA, 20 bp, Artificial Sequence
  chemically synthesized
atatgaggatttatttttgt

SEQ ID NO: 492694 - DNA, 20 bp, Artificial Sequence
  chemically synthesized
gttttctactattattatat

SEQ ID NO: 492695 - DNA, 20 bp, Artificial Sequence
  chemically synthesized
gatccgtcttaatgtccctt

SEQ ID NO: 492696 - DNA, 20 bp, Artificial Sequence
  chemically synthesized
aactcaaaagggacattaag

SEQ ID NO: 492697 - DNA, 20 bp, Artificial Sequence
  chemically synthesized
attgctaatgtatttatttt

SEQ ID NO: 492698 - DNA, 20 bp, Artificial Sequence
  chemically synthesized
caaaagtccatcaggaaaac

SEQ ID NO: 492699 - DNA, 20 bp, Artificial Sequence
  chemically synthesized
catcaggaaaacaggagttg

SEQ ID NO: 492700 - DNA, 20 bp, Artificial Sequence
  chemically synthesized
gaacaaaggaaacaatagca

SEQ ID NO: 492701 - DNA, 20 bp, Artificial Sequence
  chemically synthesized
ccccagctatactgtgttgc

SEQ ID NO: 492702 - DNA, 20 bp, Artificial Sequence
  chemically synthesized
ctctagcaacacagtatagc

SEQ ID NO: 492703 - DNA, 20 bp, Artificial Sequence
  chemically synthesized
aacacagtatagctggggtg

SEQ ID NO: 492704 - DNA, 20 bp, Artificial Sequence
  chemically synthesized
tcagggacaaagtcaattag

SEQ ID NO: 492705 - DNA, 20 bp, Artificial Sequence
  chemically synthesized
aagtcaattagagggataga

SEQ ID NO: 492706 - DNA, 20 bp, Artificial Sequence
  chemically synthesized
aagcaaacaaggtaaccctg

SEQ ID NO: 492707 - DNA, 20 bp, Artificial Sequence
  chemically synthesized
attgaaattcaggaatcctc

SEQ ID NO: 492708 - DNA, 20 bp, Artificial Sequence
  chemically synthesized
aaggtaaccctggaggattc

SEQ ID NO: 492709 - DNA, 20 bp, Artificial Sequence
  chemically synthesized
gtgattctagattgaaattc

SEQ ID NO: 492710 - DNA, 20 bp, Artificial Sequence
  chemically synthesized
aggattcctgaatttcaatc

SEQ ID NO: 492711 - DNA, 20 bp, Artificial Sequence
  chemically synthesized
attaataaatttacttagtc

SEQ ID NO: 492712 - DNA, 20 bp, Artificial Sequence
  chemically synthesized
aatttacttagtctaggatt

SEQ ID NO: 492713 - DNA, 20 bp, Artificial Sequence
  chemically synthesized
tttccctgtaatcgtgtcac

SEQ ID NO: 492714 - DNA, 20 bp, Artificial Sequence
  chemically synthesized
agagacagcagagataactc

SEQ ID NO: 492715 - DNA, 20 bp, Artificial Sequence
  chemically synthesized
ttaacctagtttctctattc

SEQ ID NO: 492716 - DNA, 20 bp, Artificial Sequence
  chemically synthesized
ctgaatagagaaactaggtt

SEQ ID NO: 492717 - DNA, 20 bp, Artificial Sequence
  chemically synthesized
gaaccatgaagccttcctta

SEQ ID NO: 492718 - DNA, 20 bp, Artificial Sequence
  chemically synthesized
catgaagccttccttacagg

SEQ ID NO: 492719 - DNA, 20 bp, Artificial Sequence
  chemically synthesized
atatccccccctcctttaca

SEQ ID NO: 492720 - DNA, 20 bp, Artificial Sequence
  chemically synthesized
caatccaatgtaaaggaggg

SEQ ID NO: 492721 - DNA, 20 bp, Artificial Sequence
  chemically synthesized
cttctcttgttcgtttttcc

SEQ ID NO: 492722 - DNA, 20 bp, Artificial Sequence
  chemically synthesized
ataataggccttcaagaaat

SEQ ID NO: 492723 - DNA, 20 bp, Artificial Sequence
  chemically synthesized
atccttctcatgaggccatt

SEQ ID NO: 492724 - DNA, 20 bp, Artificial Sequence
  chemically synthesized
actctcaatggcctcatgag

SEQ ID NO: 492725 - DNA, 20 bp, Artificial Sequence
  chemically synthesized
cctcatgagaaggatgagaa

SEQ ID NO: 492726 - DNA, 20 bp, Artificial Sequence
  chemically synthesized
aaagggtaaagacttggaaa

SEQ ID NO: 492727 - DNA, 20 bp, Artificial Sequence
  chemically synthesized
cggacagtgtgcattttaga

SEQ ID NO: 492728 - DNA, 20 bp, Artificial Sequence
  chemically synthesized
atttgggggcacaaggatct

SEQ ID NO: 492729 - DNA, 20 bp, Artificial Sequence
  chemically synthesized
acagtgagatttgggggcac

SEQ ID NO: 492730 - DNA, 20 bp, Artificial Sequence
  chemically synthesized
aaatctcactgtctcagttc

SEQ ID NO: 492731 - DNA, 20 bp, Artificial Sequence
  chemically synthesized
agttcccagggcatctgtct

SEQ ID NO: 492732 - DNA, 20 bp, Artificial Sequence
  chemically synthesized
ccagggcatctgtctatgag

SEQ ID NO: 492733 - DNA, 20 bp, Artificial Sequence
  chemically synthesized
ctatgagtaggatattcaca

SEQ ID NO: 492734 - DNA, 20 bp, Artificial Sequence
  chemically synthesized
gcattacctttttactcact

SEQ ID NO: 492735 - DNA, 20 bp, Artificial Sequence
  chemically synthesized
aatgccataaaaatctaggt

SEQ ID NO: 492736 - DNA, 20 bp, Artificial Sequence
  chemically synthesized
aaaatctaggtgtgggttag

SEQ ID NO: 492737 - DNA, 20 bp, Artificial Sequence
  chemically synthesized
tgatgttctatatcgtttat

SEQ ID NO: 492738 - DNA, 20 bp, Artificial Sequence
  chemically synthesized
tttagttaacatatttgaat

SEQ ID NO: 492739 - DNA, 20 bp, Artificial Sequence
  chemically synthesized
cattactttagttaacatat

SEQ ID NO: 492740 - DNA, 20 bp, Artificial Sequence
  chemically synthesized
agtaatgatttcctattact

SEQ ID NO: 492741 - DNA, 20 bp, Artificial Sequence
  chemically synthesized
gatttcctattacttagagt

SEQ ID NO: 492742 - DNA, 20 bp, Artificial Sequence
  chemically synthesized
caaagtttcaactagacaga

SEQ ID NO: 492743 - DNA, 20 bp, Artificial Sequence
  chemically synthesized
ggaggtggagtgagggaata

SEQ ID NO: 492744 - DNA, 20 bp, Artificial Sequence
  chemically synthesized
aggcttgggaggtggagtga

SEQ ID NO: 492745 - DNA, 20 bp, Artificial Sequence
  chemically synthesized
gttaacagaggcttgggagg

SEQ ID NO: 492746 - DNA, 20 bp, Artificial Sequence
  chemically synthesized
gaattcatagagatgtagag

SEQ ID NO: 492747 - DNA, 20 bp, Artificial Sequence
  chemically synthesized
tgattctactctacatctct

SEQ ID NO: 492748 - DNA, 20 bp, Artificial Sequence
  chemically synthesized
aagttgaattcatagagatg

SEQ ID NO: 492749 - DNA, 20 bp, Artificial Sequence
  chemically synthesized
aatgtgcaatgtaagaaaag

SEQ ID NO: 492750 - DNA, 20 bp, Artificial Sequence
  chemically synthesized
tctgtgaatatatatttata

SEQ ID NO: 492751 - DNA, 20 bp, Artificial Sequence
  chemically synthesized
atttaaaattacatatgtct

SEQ ID NO: 492752 - DNA, 20 bp, Artificial Sequence
  chemically synthesized
taatatgcgtgctaaacagt

SEQ ID NO: 492753 - DNA, 20 bp, Artificial Sequence
  chemically synthesized
taggtcagttgttaccaaag

SEQ ID NO: 492754 - DNA, 20 bp, Artificial Sequence
  chemically synthesized
ataatcaaattcaaggtcgt

SEQ ID NO: 492755 - DNA, 20 bp, Artificial Sequence
  chemically synthesized
attttgtcactccaacgacc

SEQ ID NO: 492756 - DNA, 20 bp, Artificial Sequence
  chemically synthesized
cacacaccagtgaagttatg

SEQ ID NO: 492757 - DNA, 20 bp, Artificial Sequence
  chemically synthesized
ttttgagtttaaaatctagt

SEQ ID NO: 492758 - DNA, 20 bp, Artificial Sequence
  chemically synthesized
aaggcattgttggttctctt

SEQ ID NO: 492759 - DNA, 20 bp, Artificial Sequence
  chemically synthesized
ggccagtgaaccaaatagaa

SEQ ID NO: 492760 - DNA, 20 bp, Artificial Sequence
  chemically synthesized
ccacagagtggaaactgctt

SEQ ID NO: 492761 - DNA, 20 bp, Artificial Sequence
  chemically synthesized
gaaactatttccttcttcca

SEQ ID NO: 492762 - DNA, 20 bp, Artificial Sequence
  chemically synthesized
agtttcattatattttggct

SEQ ID NO: 492763 - DNA, 20 bp, Artificial Sequence
  chemically synthesized
cgtagctaaagtccagacca

SEQ ID NO: 492764 - DNA, 20 bp, Artificial Sequence
  chemically synthesized
tgatttgaaaaccatacctt

SEQ ID NO: 492765 - DNA, 20 bp, Artificial Sequence
  chemically synthesized
ttgaaaaccataccttaaga

SEQ ID NO: 492766 - DNA, 20 bp, Artificial Sequence
  chemically synthesized
acagtagacataagaactct

SEQ ID NO: 492767 - DNA, 20 bp, Artificial Sequence
  chemically synthesized
ttttgactcccccccatcca

SEQ ID NO: 492768 - DNA, 20 bp, Artificial Sequence
  chemically synthesized
taagaactctctggatgggg

SEQ ID NO: 492769 - DNA, 20 bp, Artificial Sequence
  chemically synthesized
ctgaggcctcaagaaattta

SEQ ID NO: 492770 - DNA, 20 bp, Artificial Sequence
  chemically synthesized
cactaaatttcttgaggcct

SEQ ID NO: 492771 - DNA, 20 bp, Artificial Sequence
  chemically synthesized
acatttttcctgtccctgaa

SEQ ID NO: 492772 - DNA, 20 bp, Artificial Sequence
  chemically synthesized
cctgtccctgaaaagagtgt

SEQ ID NO: 492773 - DNA, 20 bp, Artificial Sequence
  chemically synthesized
tgtgggagttgactgaggaa

SEQ ID NO: 492774 - DNA, 20 bp, Artificial Sequence
  chemically synthesized
cttctcaaggcctcaatttc

SEQ ID NO: 492775 - DNA, 20 bp, Artificial Sequence
  chemically synthesized
ttactcttgagcatctgccc

SEQ ID NO: 492776 - DNA, 20 bp, Artificial Sequence
  chemically synthesized
ggacccatgggcagatgctc

SEQ ID NO: 492777 - DNA, 20 bp, Artificial Sequence
  chemically synthesized
gttttgtctgcaccttggtt

SEQ ID NO: 492778 - DNA, 20 bp, Artificial Sequence
  chemically synthesized
tctgtatacattgttatctt

SEQ ID NO: 492779 - DNA, 20 bp, Artificial Sequence
  chemically synthesized
tgaagcacgtatggccttca

SEQ ID NO: 492780 - DNA, 20 bp, Artificial Sequence
  chemically synthesized
cttcatgaacacttgggaac

SEQ ID NO: 492781 - DNA, 20 bp, Artificial Sequence
  chemically synthesized
tttcttcattggtttccatt

SEQ ID NO: 492782 - DNA, 20 bp, Artificial Sequence
  chemically synthesized
ttttctgtcttcaagtagaa

SEQ ID NO: 492783 - DNA, 20 bp, Artificial Sequence
  chemically synthesized
ggtcatgtccatccattcaa

SEQ ID NO: 492784 - DNA, 20 bp, Artificial Sequence
  chemically synthesized
catcttagccattcttttga

SEQ ID NO: 492785 - DNA, 20 bp, Artificial Sequence
  chemically synthesized
atctcatcttagccattctt

SEQ ID NO: 492786 - DNA, 20 bp, Artificial Sequence
  chemically synthesized
tgagattaatcttgcatttc

SEQ ID NO: 492787 - DNA, 20 bp, Artificial Sequence
  chemically synthesized
cggatgcattttccccaagt

SEQ ID NO: 492788 - DNA, 20 bp, Artificial Sequence
  chemically synthesized
tgatctccacaagtgttgga

SEQ ID NO: 492789 - DNA, 20 bp, Artificial Sequence
  chemically synthesized
catatgggctctgcgcccag

SEQ ID NO: 492790 - DNA, 20 bp, Artificial Sequence
  chemically synthesized
agaaggtttttaagaatttg

SEQ ID NO: 492791 - DNA, 20 bp, Artificial Sequence
  chemically synthesized
tcagaaagcagaaggttttt

SEQ ID NO: 492792 - DNA, 20 bp, Artificial Sequence
  chemically synthesized
tcttaaaaaccttctgcttt

SEQ ID NO: 492793 - DNA, 20 bp, Artificial Sequence
  chemically synthesized
caaacatatgagtatacagc

SEQ ID NO: 492794 - DNA, 20 bp, Artificial Sequence
  chemically synthesized
ctagctgtatactcatatgt

SEQ ID NO: 492795 - DNA, 20 bp, Artificial Sequence
  chemically synthesized
taaacaaaacactcaaacat

SEQ ID NO: 492796 - DNA, 20 bp, Artificial Sequence
  chemically synthesized
aatgagtctttcaatgtgtg

SEQ ID NO: 492797 - DNA, 20 bp, Artificial Sequence
  chemically synthesized
atgatgctcaaggacagaca

SEQ ID NO: 492798 - DNA, 20 bp, Artificial Sequence
  chemically synthesized
gtgagacaatgatgaatgta

SEQ ID NO: 492799 - DNA, 20 bp, Artificial Sequence
  chemically synthesized
acataaatagtgagacaatg

SEQ ID NO: 492800 - DNA, 20 bp, Artificial Sequence
  chemically synthesized
tgaagacctataataataat

SEQ ID NO: 492801 - DNA, 20 bp, Artificial Sequence
  chemically synthesized
ctttcaaattagcactgtcg

SEQ ID NO: 492802 - DNA, 20 bp, Artificial Sequence
  chemically synthesized
gccctgttcttccttagttg

SEQ ID NO: 492803 - DNA, 20 bp, Artificial Sequence
  chemically synthesized
tggttaacattaactttggt

SEQ ID NO: 492804 - DNA, 20 bp, Artificial Sequence
  chemically synthesized
ctttggtgggggtatgatag

SEQ ID NO: 492805 - DNA, 20 bp, Artificial Sequence
  chemically synthesized
gagggaagcatggagaaaga

SEQ ID NO: 492806 - DNA, 20 bp, Artificial Sequence
  chemically synthesized
caataaagaactgcctgaga

SEQ ID NO: 492807 - DNA, 20 bp, Artificial Sequence
  chemically synthesized
ctgggtaatttataaaggaa

SEQ ID NO: 492808 - DNA, 20 bp, Artificial Sequence
  chemically synthesized
ctccccagccatgctgaact

SEQ ID NO: 492809 - DNA, 20 bp, Artificial Sequence
  chemically synthesized
ctttacaaggtggcaagaag

SEQ ID NO: 492810 - DNA, 20 bp, Artificial Sequence
  chemically synthesized
acaaggtggcaagaaggaga

SEQ ID NO: 492811 - DNA, 20 bp, Artificial Sequence
  chemically synthesized
cccatgctgttctcctgata

SEQ ID NO: 492812 - DNA, 20 bp, Artificial Sequence
  chemically synthesized
ggtggaggcaattggatctt

SEQ ID NO: 492813 - DNA, 20 bp, Artificial Sequence
  chemically synthesized
gagagaccaggtggaggcaa

SEQ ID NO: 492814 - DNA, 20 bp, Artificial Sequence
  chemically synthesized
tggtctctcccttgacacac

SEQ ID NO: 492815 - DNA, 20 bp, Artificial Sequence
  chemically synthesized
gtccccactcaaatctcatt

SEQ ID NO: 492816 - DNA, 20 bp, Artificial Sequence
  chemically synthesized
attataattcaaaatgagat

SEQ ID NO: 492817 - DNA, 20 bp, Artificial Sequence
  chemically synthesized
tcctctcattttatatttaa

SEQ ID NO: 492818 - DNA, 20 bp, Artificial Sequence
  chemically synthesized
tagattactacattttcccc

SEQ ID NO: 492819 - DNA, 20 bp, Artificial Sequence
  chemically synthesized
aatcaattacttttttcctc

SEQ ID NO: 492820 - DNA, 20 bp, Artificial Sequence
  chemically synthesized
gtaattgattatatgaagat

SEQ ID NO: 492821 - DNA, 20 bp, Artificial Sequence
  chemically synthesized
ttctaagatgttagaaaaat

SEQ ID NO: 492822 - DNA, 20 bp, Artificial Sequence
  chemically synthesized
tctactgtttcatagcacaa

SEQ ID NO: 492823 - DNA, 20 bp, Artificial Sequence
  chemically synthesized
gtacattttaaaataactaa

SEQ ID NO: 492824 - DNA, 20 bp, Artificial Sequence
  chemically synthesized
aataactaacagagtataat

SEQ ID NO: 492825 - DNA, 20 bp, Artificial Sequence
  chemically synthesized
tacaaagcacaaatgcttga

SEQ ID NO: 492826 - DNA, 20 bp, Artificial Sequence
  chemically synthesized
aaatagtcacatcatggaga

SEQ ID NO: 492827 - DNA, 20 bp, Artificial Sequence
  chemically synthesized
tatgaaatagtcacatcatg

SEQ ID NO: 492828 - DNA, 20 bp, Artificial Sequence
  chemically synthesized
catgatgtgactatttcata

SEQ ID NO: 492829 - DNA, 20 bp, Artificial Sequence
  chemically synthesized
gaggaaggtgtatatattga

SEQ ID NO: 492830 - DNA, 20 bp, Artificial Sequence
  chemically synthesized
atggtaggtgtatatgtcaa

SEQ ID NO: 492831 - DNA, 20 bp, Artificial Sequence
  chemically synthesized
tcaatgggttttttatcttt

SEQ ID NO: 492832 - DNA, 20 bp, Artificial Sequence
  chemically synthesized
cttttaagttttttctttca

SEQ ID NO: 492833 - DNA, 20 bp, Artificial Sequence
  chemically synthesized
cagcccctggacacagctca

SEQ ID NO: 492834 - DNA, 20 bp, Artificial Sequence
  chemically synthesized
gtgacttttgctaacactta

SEQ ID NO: 492835 - DNA, 20 bp, Artificial Sequence
  chemically synthesized
atgattttttattgaacata

SEQ ID NO: 492836 - DNA, 20 bp, Artificial Sequence
  chemically synthesized
ttcacttcctaggtgccttt

SEQ ID NO: 492837 - DNA, 20 bp, Artificial Sequence
  chemically synthesized
ttcaaaaaggcacctaggaa

SEQ ID NO: 492838 - DNA, 20 bp, Artificial Sequence
  chemically synthesized
acttgcatatttcctttgac

SEQ ID NO: 492839 - DNA, 20 bp, Artificial Sequence
  chemically synthesized
acaaaggcattttattttaa

SEQ ID NO: 492840 - DNA, 20 bp, Artificial Sequence
  chemically synthesized
tcactattagtataacctat

SEQ ID NO: 492841 - DNA, 20 bp, Artificial Sequence
  chemically synthesized
taatagtgatgcaataaacc

SEQ ID NO: 492842 - DNA, 20 bp, Artificial Sequence
  chemically synthesized
aaatcagtggtatgtaatgt

SEQ ID NO: 492843 - DNA, 20 bp, Artificial Sequence
  chemically synthesized
cccaacttgtttaacacttt

SEQ ID NO: 492844 - DNA, 20 bp, Artificial Sequence
  chemically synthesized
taaaagtgttaaacaagttg

SEQ ID NO: 492845 - DNA, 20 bp, Artificial Sequence
  chemically synthesized
ttcgaaatccccttacctgg

SEQ ID NO: 492846 - DNA, 20 bp, Artificial Sequence
  chemically synthesized
tctgacattctcccaggtaa

SEQ ID NO: 492847 - DNA, 20 bp, Artificial Sequence
  chemically synthesized
ttctcccaggtaaggggatt

SEQ ID NO: 492848 - DNA, 20 bp, Artificial Sequence
  chemically synthesized
taacttcatgacactgggaa

SEQ ID NO: 492849 - DNA, 20 bp, Artificial Sequence
  chemically synthesized
agctttagaaagcaaatgtt

SEQ ID NO: 492850 - DNA, 20 bp, Artificial Sequence
  chemically synthesized
aaagaagtatataaaggaac

SEQ ID NO: 492851 - DNA, 20 bp, Artificial Sequence
  chemically synthesized
gtatacttcaatgattatgt

SEQ ID NO: 492852 - DNA, 20 bp, Artificial Sequence
  chemically synthesized
taagcccttcctattcaata

SEQ ID NO: 492853 - DNA, 20 bp, Artificial Sequence
  chemically synthesized
tggtcctaagacatccccta

SEQ ID NO: 492854 - DNA, 20 bp, Artificial Sequence
  chemically synthesized
aataggggatgtcttaggac

SEQ ID NO: 492855 - DNA, 20 bp, Artificial Sequence
  chemically synthesized
ttaataggcattgtgatttc

SEQ ID NO: 492856 - DNA, 20 bp, Artificial Sequence
  chemically synthesized
taaataaataataacgataa

SEQ ID NO: 492857 - DNA, 20 bp, Artificial Sequence
  chemically synthesized
tctcgctctgtcgcccaggt

SEQ ID NO: 492858 - DNA, 20 bp, Artificial Sequence
  chemically synthesized
gcaggagaatggcgtgaacc

SEQ ID NO: 492859 - DNA, 20 bp, Artificial Sequence
  chemically synthesized
tacttgggaggctgaggcag

SEQ ID NO: 492860 - DNA, 20 bp, Artificial Sequence
  chemically synthesized
ttttgtatttttagtagaga

SEQ ID NO: 492861 - DNA, 20 bp, Artificial Sequence
  chemically synthesized
cggggtttcactgtgttagc

SEQ ID NO: 492862 - DNA, 20 bp, Artificial Sequence
  chemically synthesized
actttgggaggccaaggcgg

SEQ ID NO: 492863 - DNA, 20 bp, Artificial Sequence
  chemically synthesized
gccttggcctcccaaagtgc

SEQ ID NO: 492864 - DNA, 20 bp, Artificial Sequence
  chemically synthesized
agtaataacaatgatatagg

SEQ ID NO: 492865 - DNA, 20 bp, Artificial Sequence
  chemically synthesized
agtgggcaccatattaacat

SEQ ID NO: 492866 - DNA, 20 bp, Artificial Sequence
  chemically synthesized
aatacttatatttttcttta

SEQ ID NO: 492867 - DNA, 20 bp, Artificial Sequence
  chemically synthesized
tgacaaggcagtgatttgga

SEQ ID NO: 492868 - DNA, 20 bp, Artificial Sequence
  chemically synthesized
agtgatttggacaggatgtt

SEQ ID NO: 492869 - DNA, 20 bp, Artificial Sequence
  chemically synthesized
gacatgagccctgatatagt

SEQ ID NO: 492870 - DNA, 20 bp, Artificial Sequence
  chemically synthesized
attatatttccacttgagat

SEQ ID NO: 492871 - DNA, 20 bp, Artificial Sequence
  chemically synthesized
caggccccaccaccaacatt

SEQ ID NO: 492872 - DNA, 20 bp, Artificial Sequence
  chemically synthesized
tggggcctggcgggaggttt

SEQ ID NO: 492873 - DNA, 20 bp, Artificial Sequence
  chemically synthesized
gaggacaatacaaaaccatg

SEQ ID NO: 492874 - DNA, 20 bp, Artificial Sequence
  chemically synthesized
tttgtattgtcctcagtgta

SEQ ID NO: 492875 - DNA, 20 bp, Artificial Sequence
  chemically synthesized
tattgtcctcagtgtagtga

SEQ ID NO: 492876 - DNA, 20 bp, Artificial Sequence
  chemically synthesized
tggctcctggggaggcctca

SEQ ID NO: 492877 - DNA, 20 bp, Artificial Sequence
  chemically synthesized
tggggcctggtgtgagatgt

SEQ ID NO: 492878 - DNA, 20 bp, Artificial Sequence
  chemically synthesized
gagatgtttgagtcacggag

SEQ ID NO: 492879 - DNA, 20 bp, Artificial Sequence
  chemically synthesized
gaggacagcatcaagctgtg

SEQ ID NO: 492880 - DNA, 20 bp, Artificial Sequence
  chemically synthesized
tgctgtcctcatgatagcag

SEQ ID NO: 492881 - DNA, 20 bp, Artificial Sequence
  chemically synthesized
ctcatagtggaagatgaaac

SEQ ID NO: 492882 - DNA, 20 bp, Artificial Sequence
  chemically synthesized
ctcctgtttcatcttccact

SEQ ID NO: 492883 - DNA, 20 bp, Artificial Sequence
  chemically synthesized
cccggaggcctccccagaag

SEQ ID NO: 492884 - DNA, 20 bp, Artificial Sequence
  chemically synthesized
cctgcttcctgtacaacctg

SEQ ID NO: 492885 - DNA, 20 bp, Artificial Sequence
  chemically synthesized
cctgtacaacctgcagaatc

SEQ ID NO: 492886 - DNA, 20 bp, Artificial Sequence
  chemically synthesized
ctatgaagaaatagccgaga

SEQ ID NO: 492887 - DNA, 20 bp, Artificial Sequence
  chemically synthesized
atcaaggacagacggggagg

SEQ ID NO: 492888 - DNA, 20 bp, Artificial Sequence
  chemically synthesized
gagtatcaaggacagacggg

SEQ ID NO: 492889 - DNA, 20 bp, Artificial Sequence
  chemically synthesized
aataaaatcggcagaaaaac

SEQ ID NO: 492890 - DNA, 20 bp, Artificial Sequence
  chemically synthesized
aaacaaagagtagatacaat

SEQ ID NO: 492891 - DNA, 20 bp, Artificial Sequence
  chemically synthesized
cattttcttaacatcaaaca

SEQ ID NO: 492892 - DNA, 20 bp, Artificial Sequence
  chemically synthesized
agagcttgcaggattataat

SEQ ID NO: 492893 - DNA, 20 bp, Artificial Sequence
  chemically synthesized
cacttatatcaaagagcttg

SEQ ID NO: 492894 - DNA, 20 bp, Artificial Sequence
  chemically synthesized
atacactttcccttagttac

SEQ ID NO: 492895 - DNA, 20 bp, Artificial Sequence
  chemically synthesized
caataattttatcacctctg

SEQ ID NO: 492896 - DNA, 20 bp, Artificial Sequence
  chemically synthesized
tattggcaattgatgatcat

SEQ ID NO: 492897 - DNA, 20 bp, Artificial Sequence
  chemically synthesized
gaggagctattaatgaataa

SEQ ID NO: 492898 - DNA, 20 bp, Artificial Sequence
  chemically synthesized
acatcaatgaggagctatta

SEQ ID NO: 492899 - DNA, 20 bp, Artificial Sequence
  chemically synthesized
agagaaggaaaggagacatt

SEQ ID NO: 492900 - DNA, 20 bp, Artificial Sequence
  chemically synthesized
agactttctaatgtccacct

SEQ ID NO: 492901 - DNA, 20 bp, Artificial Sequence
  chemically synthesized
gtcgtttttaatcctaaaga

SEQ ID NO: 492902 - DNA, 20 bp, Artificial Sequence
  chemically synthesized
taggtagattattctgtctt

SEQ ID NO: 492903 - DNA, 20 bp, Artificial Sequence
  chemically synthesized
catagaactaatataatgta

SEQ ID NO: 492904 - DNA, 20 bp, Artificial Sequence
  chemically synthesized
catgttcttccagtgatgac

SEQ ID NO: 492905 - DNA, 20 bp, Artificial Sequence
  chemically synthesized
cttgtcatcactggaagaac

SEQ ID NO: 492906 - DNA, 20 bp, Artificial Sequence
  chemically synthesized
aatgaatgtgggaaccttaa

SEQ ID NO: 492907 - DNA, 20 bp, Artificial Sequence
  chemically synthesized
tctgtgtgaggagaagggta

SEQ ID NO: 492908 - DNA, 20 bp, Artificial Sequence
  chemically synthesized
ttgcatttctgtgtgaggag

SEQ ID NO: 492909 - DNA, 20 bp, Artificial Sequence
  chemically synthesized
cattgaaaagtttcttcgtg

SEQ ID NO: 492910 - DNA, 20 bp, Artificial Sequence
  chemically synthesized
gttcattcagcttgataaac

SEQ ID NO: 492911 - DNA, 20 bp, Artificial Sequence
  chemically synthesized
atttattcaagtttatcaag

SEQ ID NO: 492912 - DNA, 20 bp, Artificial Sequence
  chemically synthesized
caaaataaaatcccaaggct

SEQ ID NO: 492913 - DNA, 20 bp, Artificial Sequence
  chemically synthesized
ttgtttcaaactccaagcct

SEQ ID NO: 492914 - DNA, 20 bp, Artificial Sequence
  chemically synthesized
ttcttccacagggaaataaa

SEQ ID NO: 492915 - DNA, 20 bp, Artificial Sequence
  chemically synthesized
caggtcatgtggcaaagagt

SEQ ID NO: 492916 - DNA, 20 bp, Artificial Sequence
  chemically synthesized
ttcccacaggtcatgtggca

SEQ ID NO: 492917 - DNA, 20 bp, Artificial Sequence
  chemically synthesized
attatagtagatgggcacta

SEQ ID NO: 492918 - DNA, 20 bp, Artificial Sequence
  chemically synthesized
gtcatagtatgtaaaaaaca

SEQ ID NO: 492919 - DNA, 20 bp, Artificial Sequence
  chemically synthesized
ttttttacatactatgacaa

SEQ ID NO: 492920 - DNA, 20 bp, Artificial Sequence
  chemically synthesized
aattggctcactgaaatgct

SEQ ID NO: 492921 - DNA, 20 bp, Artificial Sequence
  chemically synthesized
ctaaaaagtgtcaatttcaa

SEQ ID NO: 492922 - DNA, 20 bp, Artificial Sequence
  chemically synthesized
cttcatatgccaaaaaacat

SEQ ID NO: 492923 - DNA, 20 bp, Artificial Sequence
  chemically synthesized
accatagatattattagtag

SEQ ID NO: 492924 - DNA, 20 bp, Artificial Sequence
  chemically synthesized
ctaataatatctatggttca

SEQ ID NO: 492925 - DNA, 20 bp, Artificial Sequence
  chemically synthesized
ctacataggtgcatagatac

SEQ ID NO: 492926 - DNA, 20 bp, Artificial Sequence
  chemically synthesized
aacagagaaatatttttact

SEQ ID NO: 492927 - DNA, 20 bp, Artificial Sequence
  chemically synthesized
ttatcttggaaggtggttat

SEQ ID NO: 492928 - DNA, 20 bp, Artificial Sequence
  chemically synthesized
taattatctgcaaagatttt

SEQ ID NO: 492929 - DNA, 20 bp, Artificial Sequence
  chemically synthesized
aatctttgcagataattaga

SEQ ID NO: 492930 - DNA, 20 bp, Artificial Sequence
  chemically synthesized
aaaaacatatatatttaatt

SEQ ID NO: 492931 - DNA, 20 bp, Artificial Sequence
  chemically synthesized
cacaggcaagggacaaggaa

SEQ ID NO: 492932 - DNA, 20 bp, Artificial Sequence
  chemically synthesized
ttgtcccttgcctgtgatta

SEQ ID NO: 492933 - DNA, 20 bp, Artificial Sequence
  chemically synthesized
ttgcctgtgattagtgaata

SEQ ID NO: 492934 - DNA, 20 bp, Artificial Sequence
  chemically synthesized
acatttgtcctccagagata

SEQ ID NO: 492935 - DNA, 20 bp, Artificial Sequence
  chemically synthesized
atatgtgaaactgcctaaag

SEQ ID NO: 492936 - DNA, 20 bp, Artificial Sequence
  chemically synthesized
attttgcaaatctgtttgtt

SEQ ID NO: 492937 - DNA, 20 bp, Artificial Sequence
  chemically synthesized
tgcaaatctgtttgttaaga

SEQ ID NO: 492938 - DNA, 20 bp, Artificial Sequence
  chemically synthesized
aactaccagaatgtcaatgt

SEQ ID NO: 492939 - DNA, 20 bp, Artificial Sequence
  chemically synthesized
tttataaactgatgaactac

SEQ ID NO: 492940 - DNA, 20 bp, Artificial Sequence
  chemically synthesized
ttataaaactagtgaaatgg

SEQ ID NO: 492941 - DNA, 20 bp, Artificial Sequence
  chemically synthesized
attaaaacagatacattgaa

SEQ ID NO: 492942 - DNA, 20 bp, Artificial Sequence
  chemically synthesized
atcatacacttaataataca

SEQ ID NO: 492943 - DNA, 20 bp, Artificial Sequence
  chemically synthesized
agtaaatgagatgatatatc

SEQ ID NO: 492944 - DNA, 20 bp, Artificial Sequence
  chemically synthesized
tacttaataggttcattgtg

SEQ ID NO: 492945 - DNA, 20 bp, Artificial Sequence
  chemically synthesized
agcaaactaaatgcatgaac

SEQ ID NO: 492946 - DNA, 20 bp, Artificial Sequence
  chemically synthesized
aagagccgaggcccagagat

SEQ ID NO: 492947 - DNA, 20 bp, Artificial Sequence
  chemically synthesized
tactatctaaagaaatgagt

SEQ ID NO: 492948 - DNA, 20 bp, Artificial Sequence
  chemically synthesized
acatgctactatctaaagaa

SEQ ID NO: 492949 - DNA, 20 bp, Artificial Sequence
  chemically synthesized
cagagacctaaatcaagtca

SEQ ID NO: 492950 - DNA, 20 bp, Artificial Sequence
  chemically synthesized
agtggtgaagagaggaggct

SEQ ID NO: 492951 - DNA, 20 bp, Artificial Sequence
  chemically synthesized
aagggaagcagtattttagc

SEQ ID NO: 492952 - DNA, 20 bp, Artificial Sequence
  chemically synthesized
agtacgatgaaaaaaatcat

SEQ ID NO: 492953 - DNA, 20 bp, Artificial Sequence
  chemically synthesized
ctgatattttatcatattta

SEQ ID NO: 492954 - DNA, 20 bp, Artificial Sequence
  chemically synthesized
aaaacaacgtccctttgttg

SEQ ID NO: 492955 - DNA, 20 bp, Artificial Sequence
  chemically synthesized
aaagggacgttgttttcttt

SEQ ID NO: 492956 - DNA, 20 bp, Artificial Sequence
  chemically synthesized
ggacgttgttttctttatgg

SEQ ID NO: 492957 - DNA, 20 bp, Artificial Sequence
  chemically synthesized
ggctgattgactagtattgg

SEQ ID NO: 492958 - DNA, 20 bp, Artificial Sequence
  chemically synthesized
ttggttgaataagagcaaaa

SEQ ID NO: 492959 - DNA, 20 bp, Artificial Sequence
  chemically synthesized
atcaaaatatttgaaaattt

SEQ ID NO: 492960 - DNA, 20 bp, Artificial Sequence
  chemically synthesized
ttgatgtataaaaatagtct

SEQ ID NO: 492961 - DNA, 20 bp, Artificial Sequence
  chemically synthesized
actgtgtggacagaggctga

SEQ ID NO: 492962 - DNA, 20 bp, Artificial Sequence
  chemically synthesized
tcaagtggtgtgtgtatgtg

SEQ ID NO: 492963 - DNA, 20 bp, Artificial Sequence
  chemically synthesized
ttttagaagaagtacctatg

SEQ ID NO: 492964 - DNA, 20 bp, Artificial Sequence
  chemically synthesized
cctccattcgtttgtccttt

SEQ ID NO: 492965 - DNA, 20 bp, Artificial Sequence
  chemically synthesized
ttgaaactctgaaaggacaa

SEQ ID NO: 492966 - DNA, 20 bp, Artificial Sequence
  chemically synthesized
agggaagaaacagtagactg

SEQ ID NO: 492967 - DNA, 20 bp, Artificial Sequence
  chemically synthesized
gaaacaaacaaacaaacaaa

SEQ ID NO: 492968 - DNA, 20 bp, Artificial Sequence
  chemically synthesized
cactgtcagttcttggaaca

SEQ ID NO: 492969 - DNA, 20 bp, Artificial Sequence
  chemically synthesized
tctgttctccttcccctgac

SEQ ID NO: 492970 - DNA, 20 bp, Artificial Sequence
  chemically synthesized
gacaacagcatgcatccact

SEQ ID NO: 492971 - DNA, 20 bp, Artificial Sequence
  chemically synthesized
cctctttgtaagaactccaa

SEQ ID NO: 492972 - DNA, 20 bp, Artificial Sequence
  chemically synthesized
cacttggagttcttacaaag

SEQ ID NO: 492973 - DNA, 20 bp, Artificial Sequence
  chemically synthesized
aacggacgtattacaaatgt

SEQ ID NO: 492974 - DNA, 20 bp, Artificial Sequence
  chemically synthesized
atactcatttccaatagcaa

SEQ ID NO: 492975 - DNA, 20 bp, Artificial Sequence
  chemically synthesized
aaaccctattgctattggaa

SEQ ID NO: 492976 - DNA, 20 bp, Artificial Sequence
  chemically synthesized
aaatgagtatggaaagcttt

SEQ ID NO: 492977 - DNA, 20 bp, Artificial Sequence
  chemically synthesized
attgcaccccttaccaacaa

SEQ ID NO: 492978 - DNA, 20 bp, Artificial Sequence
  chemically synthesized
gttttattccattgttggta

SEQ ID NO: 492979 - DNA, 20 bp, Artificial Sequence
  chemically synthesized
ccttgtagttgcggttatgc

SEQ ID NO: 492980 - DNA, 20 bp, Artificial Sequence
  chemically synthesized
cataaagaggtgaggtaagt

SEQ ID NO: 492981 - DNA, 20 bp, Artificial Sequence
  chemically synthesized
tcaggtcttttatttgaaat

SEQ ID NO: 492982 - DNA, 20 bp, Artificial Sequence
  chemically synthesized
atggagactctgaagggata

SEQ ID NO: 492983 - DNA, 20 bp, Artificial Sequence
  chemically synthesized
acatttattccttatccctt

SEQ ID NO: 492984 - DNA, 20 bp, Artificial Sequence
  chemically synthesized
atagaaaatggagactctga

SEQ ID NO: 492985 - DNA, 20 bp, Artificial Sequence
  chemically synthesized
gtacaatctatgacaacaat

SEQ ID NO: 492986 - DNA, 20 bp, Artificial Sequence
  chemically synthesized
atcacttctacgtctacatc

SEQ ID NO: 492987 - DNA, 20 bp, Artificial Sequence
  chemically synthesized
aagatgtagacgtagaagtg

SEQ ID NO: 492988 - DNA, 20 bp, Artificial Sequence
  chemically synthesized
aatggtatctgatgtgaact

SEQ ID NO: 492989 - DNA, 20 bp, Artificial Sequence
  chemically synthesized
ggatcattcaagctgtattt

SEQ ID NO: 492990 - DNA, 20 bp, Artificial Sequence
  chemically synthesized
taaggactcaaaaatacagc

SEQ ID NO: 492991 - DNA, 20 bp, Artificial Sequence
  chemically synthesized
agcctgataccttcaatttt

SEQ ID NO: 492992 - DNA, 20 bp, Artificial Sequence
  chemically synthesized
tagtgatacctaacaattag

SEQ ID NO: 492993 - DNA, 20 bp, Artificial Sequence
  chemically synthesized
agtaatttttgtattcttac

SEQ ID NO: 492994 - DNA, 20 bp, Artificial Sequence
  chemically synthesized
agtgtaaggaacaccccagt

SEQ ID NO: 492995 - DNA, 20 bp, Artificial Sequence
  chemically synthesized
aagtagcattttcttaggga

SEQ ID NO: 492996 - DNA, 20 bp, Artificial Sequence
  chemically synthesized
tgaaaaagtagcattttctt

SEQ ID NO: 492997 - DNA, 20 bp, Artificial Sequence
  chemically synthesized
tacgtttattaaaaaactgt

SEQ ID NO: 492998 - DNA, 20 bp, Artificial Sequence
  chemically synthesized
gtatttttaattaaaatcag

SEQ ID NO: 492999 - DNA, 20 bp, Artificial Sequence
  chemically synthesized
tactaaaggtaaataaaatc

SEQ ID NO: 493000 - DNA, 20 bp, Artificial Sequence
  chemically synthesized
gtcatttttcaaatttgagc

SEQ ID NO: 493001 - DNA, 20 bp, Artificial Sequence
  chemically synthesized
ctgcctatatcaaatagtat

SEQ ID NO: 493002 - DNA, 20 bp, Artificial Sequence
  chemically synthesized
gggtccaaaacaggttttta

SEQ ID NO: 493003 - DNA, 20 bp, Artificial Sequence
  chemically synthesized
gtaataatgctgataaatga

SEQ ID NO: 493004 - DNA, 20 bp, Artificial Sequence
  chemically synthesized
aatgctgataaatgaaagaa

SEQ ID NO: 493005 - DNA, 20 bp, Artificial Sequence
  chemically synthesized
atatgtgcctttattgtagt

SEQ ID NO: 493006 - DNA, 20 bp, Artificial Sequence
  chemically synthesized
tgtaaaccttatgttctata

SEQ ID NO: 493007 - DNA, 20 bp, Artificial Sequence
  chemically synthesized
aaggaatgatttcttaaaaa

SEQ ID NO: 493008 - DNA, 20 bp, Artificial Sequence
  chemically synthesized
acatggtgaagcattttgaa

SEQ ID NO: 493009 - DNA, 20 bp, Artificial Sequence
  chemically synthesized
gacacaaaagtttttaaaga

SEQ ID NO: 493010 - DNA, 20 bp, Artificial Sequence
  chemically synthesized
ttaactgaaataaaaacaca

SEQ ID NO: 493011 - DNA, 20 bp, Artificial Sequence
  chemically synthesized
gttattttacactattttgc

SEQ ID NO: 493012 - DNA, 20 bp, Artificial Sequence
  chemically synthesized
cttctctggcacatctttat

SEQ ID NO: 493013 - DNA, 20 bp, Artificial Sequence
  chemically synthesized
cacatctttatatgaataac

SEQ ID NO: 493014 - DNA, 20 bp, Artificial Sequence
  chemically synthesized
gtaaatgaaatacatatttc

SEQ ID NO: 493015 - DNA, 20 bp, Artificial Sequence
  chemically synthesized
tgggattatcgattgagccc

SEQ ID NO: 493016 - DNA, 20 bp, Artificial Sequence
  chemically synthesized
agcatttttggaggccaagg

SEQ ID NO: 493017 - DNA, 20 bp, Artificial Sequence
  chemically synthesized
accttggcctccaaaaatgc

SEQ ID NO: 493018 - DNA, 20 bp, Artificial Sequence
  chemically synthesized
aaaatgctgggattacaggt

SEQ ID NO: 493019 - DNA, 20 bp, Artificial Sequence
  chemically synthesized
tcaagagggcagcctgaaag

SEQ ID NO: 493020 - DNA, 20 bp, Artificial Sequence
  chemically synthesized
ttgaaaaaaaatcagtaatt

SEQ ID NO: 493021 - DNA, 20 bp, Artificial Sequence
  chemically synthesized
agagatgactagacacagaa

SEQ ID NO: 493022 - DNA, 20 bp, Artificial Sequence
  chemically synthesized
gaatgcacatttataaatta

SEQ ID NO: 493023 - DNA, 20 bp, Artificial Sequence
  chemically synthesized
atttataaatgtgcattccc

SEQ ID NO: 493024 - DNA, 20 bp, Artificial Sequence
  chemically synthesized
caagagccattttcactctg

SEQ ID NO: 493025 - DNA, 20 bp, Artificial Sequence
  chemically synthesized
gttgaaatatagtgtaatga

SEQ ID NO: 493026 - DNA, 20 bp, Artificial Sequence
  chemically synthesized
tttttatgatgttaagtata

SEQ ID NO: 493027 - DNA, 20 bp, Artificial Sequence
  chemically synthesized
gatgttaagtatatggaatg

SEQ ID NO: 493028 - DNA, 20 bp, Artificial Sequence
  chemically synthesized
tatatggaatgctgaattaa

SEQ ID NO: 493029 - DNA, 20 bp, Artificial Sequence
  chemically synthesized
acacactagatataggtgaa

SEQ ID NO: 493030 - DNA, 20 bp, Artificial Sequence
  chemically synthesized
actagatataggtgaagtga

SEQ ID NO: 493031 - DNA, 20 bp, Artificial Sequence
  chemically synthesized
aacggctcaatgatgatatt

SEQ ID NO: 493032 - DNA, 20 bp, Artificial Sequence
  chemically synthesized
aactcctatgccttgattat

SEQ ID NO: 493033 - DNA, 20 bp, Artificial Sequence
  chemically synthesized
tattcacataatcaaggcat

SEQ ID NO: 493034 - DNA, 20 bp, Artificial Sequence
  chemically synthesized
ataatcaaggcataggagtt

SEQ ID NO: 493035 - DNA, 20 bp, Artificial Sequence
  chemically synthesized
agagaatctagtttgcttaa

SEQ ID NO: 493036 - DNA, 20 bp, Artificial Sequence
  chemically synthesized
gggtttgcttgtggtggaga

SEQ ID NO: 493037 - DNA, 20 bp, Artificial Sequence
  chemically synthesized
gtgtacttgcatctcccact

SEQ ID NO: 493038 - DNA, 20 bp, Artificial Sequence
  chemically synthesized
tacaccttgttctttaaact

SEQ ID NO: 493039 - DNA, 20 bp, Artificial Sequence
  chemically synthesized
gtcctgtgaatacaaagatc

SEQ ID NO: 493040 - DNA, 20 bp, Artificial Sequence
  chemically synthesized
gccttattgaatgttgtcct

SEQ ID NO: 493041 - DNA, 20 bp, Artificial Sequence
  chemically synthesized
acaatggacaggtggcctta

SEQ ID NO: 493042 - DNA, 20 bp, Artificial Sequence
  chemically synthesized
atgtagaaaaatatgttccc

SEQ ID NO: 493043 - DNA, 20 bp, Artificial Sequence
  chemically synthesized
tgttcccaggaattttcgta

SEQ ID NO: 493044 - DNA, 20 bp, Artificial Sequence
  chemically synthesized
cagtataaaagtatgaaaaa

SEQ ID NO: 493045 - DNA, 20 bp, Artificial Sequence
  chemically synthesized
taaaagtatgaaaaatagga

SEQ ID NO: 493046 - DNA, 20 bp, Artificial Sequence
  chemically synthesized
agaccatctaggcatagaac

SEQ ID NO: 493047 - DNA, 20 bp, Artificial Sequence
  chemically synthesized
accttaagattaattattgg

SEQ ID NO: 493048 - DNA, 20 bp, Artificial Sequence
  chemically synthesized
ggtttaatagctagaggagc

SEQ ID NO: 493049 - DNA, 20 bp, Artificial Sequence
  chemically synthesized
tttacttagtttccactccc

SEQ ID NO: 493050 - DNA, 20 bp, Artificial Sequence
  chemically synthesized
aatctaaatttcatatccct

SEQ ID NO: 493051 - DNA, 20 bp, Artificial Sequence
  chemically synthesized
gttaagattcatttggggtc

SEQ ID NO: 493052 - DNA, 20 bp, Artificial Sequence
  chemically synthesized
atttagattcttgaccccaa

SEQ ID NO: 493053 - DNA, 20 bp, Artificial Sequence
  chemically synthesized
tccatgtgttaagattcatt

SEQ ID NO: 493054 - DNA, 20 bp, Artificial Sequence
  chemically synthesized
ccccaaatgaatcttaacac

SEQ ID NO: 493055 - DNA, 20 bp, Artificial Sequence
  chemically synthesized
gcacaatcaattttgaatta

SEQ ID NO: 493056 - DNA, 20 bp, Artificial Sequence
  chemically synthesized
aatagagagcacaatcaatt

SEQ ID NO: 493057 - DNA, 20 bp, Artificial Sequence
  chemically synthesized
tgtgctctctattctagact

SEQ ID NO: 493058 - DNA, 20 bp, Artificial Sequence
  chemically synthesized
aatatgggtcactcgaagtc

SEQ ID NO: 493059 - DNA, 20 bp, Artificial Sequence
  chemically synthesized
aaatacaaatggcaaaaaat

SEQ ID NO: 493060 - DNA, 20 bp, Artificial Sequence
  chemically synthesized
cggtcttctcattgtatgtt

SEQ ID NO: 493061 - DNA, 20 bp, Artificial Sequence
  chemically synthesized
taaaagaaaaggaccacgag

SEQ ID NO: 493062 - DNA, 20 bp, Artificial Sequence
  chemically synthesized
cgttttcatatagtaccata

SEQ ID NO: 493063 - DNA, 20 bp, Artificial Sequence
  chemically synthesized
gtactatatgaaaacgtggc

SEQ ID NO: 493064 - DNA, 20 bp, Artificial Sequence
  chemically synthesized
cacactactgtccacagata

SEQ ID NO: 493065 - DNA, 20 bp, Artificial Sequence
  chemically synthesized
aaagctgacattaattggaa

SEQ ID NO: 493066 - DNA, 20 bp, Artificial Sequence
  chemically synthesized
gacattaattggaaatgaat

SEQ ID NO: 493067 - DNA, 20 bp, Artificial Sequence
  chemically synthesized
gctcaaggtactgcagatat

SEQ ID NO: 493068 - DNA, 20 bp, Artificial Sequence
  chemically synthesized
ctggagcagtgatgttttgg

SEQ ID NO: 493069 - DNA, 20 bp, Artificial Sequence
  chemically synthesized
ccaccaaaacatcactgctc

SEQ ID NO: 493070 - DNA, 20 bp, Artificial Sequence
  chemically synthesized
ataaaaacaaactataaaag

SEQ ID NO: 493071 - DNA, 20 bp, Artificial Sequence
  chemically synthesized
ttgggaagacttgggcaata

SEQ ID NO: 493072 - DNA, 20 bp, Artificial Sequence
  chemically synthesized
ataaagaatactcataaatt

SEQ ID NO: 493073 - DNA, 20 bp, Artificial Sequence
  chemically synthesized
ggaaactaaactcacaattt

SEQ ID NO: 493074 - DNA, 20 bp, Artificial Sequence
  chemically synthesized
attgtgagtttagtttcctg

SEQ ID NO: 493075 - DNA, 20 bp, Artificial Sequence
  chemically synthesized
gataaatctagcagtggtgt

SEQ ID NO: 493076 - DNA, 20 bp, Artificial Sequence
  chemically synthesized
aatagttaggtcacgcattc

SEQ ID NO: 493077 - DNA, 20 bp, Artificial Sequence
  chemically synthesized
ggtcacgcattcatggatct

SEQ ID NO: 493078 - DNA, 20 bp, Artificial Sequence
  chemically synthesized
tatgtcccattctaagatcc

SEQ ID NO: 493079 - DNA, 20 bp, Artificial Sequence
  chemically synthesized
agaatgggacatagtggtca

SEQ ID NO: 493080 - DNA, 20 bp, Artificial Sequence
  chemically synthesized
atctaagaagctctcaaatg

SEQ ID NO: 493081 - DNA, 20 bp, Artificial Sequence
  chemically synthesized
tctgttagggatgcttagat

SEQ ID NO: 493082 - DNA, 20 bp, Artificial Sequence
  chemically synthesized
aaattgacttgtcatctgtt

SEQ ID NO: 493083 - DNA, 20 bp, Artificial Sequence
  chemically synthesized
gtgatgctcaaaatactatg

SEQ ID NO: 493084 - DNA, 20 bp, Artificial Sequence
  chemically synthesized
tgataaaaagaagtatagga

SEQ ID NO: 493085 - DNA, 20 bp, Artificial Sequence
  chemically synthesized
agtagtttactagatcaaca

SEQ ID NO: 493086 - DNA, 20 bp, Artificial Sequence
  chemically synthesized
gtttactagatcaacacaga

SEQ ID NO: 493087 - DNA, 20 bp, Artificial Sequence
  chemically synthesized
atttccccctcaagaagtat

SEQ ID NO: 493088 - DNA, 20 bp, Artificial Sequence
  chemically synthesized
ctcaagaagtatatgaataa

SEQ ID NO: 493089 - DNA, 20 bp, Artificial Sequence
  chemically synthesized
gagagtggtatgtgtggctt

SEQ ID NO: 493090 - DNA, 20 bp, Artificial Sequence
  chemically synthesized
caagggcatatttaggactg

SEQ ID NO: 493091 - DNA, 20 bp, Artificial Sequence
  chemically synthesized
tgtcattagaaccaacctta

SEQ ID NO: 493092 - DNA, 20 bp, Artificial Sequence
  chemically synthesized
atttaaagaactattttaag

SEQ ID NO: 493093 - DNA, 20 bp, Artificial Sequence
  chemically synthesized
ttctgtaaaccttttgaaag

SEQ ID NO: 493094 - DNA, 20 bp, Artificial Sequence
  chemically synthesized
tatatacctaaatcaaaggg

SEQ ID NO: 493095 - DNA, 20 bp, Artificial Sequence
  chemically synthesized
caatatgattaaggatatat

SEQ ID NO: 493096 - DNA, 20 bp, Artificial Sequence
  chemically synthesized
cccacatatacaatatgatt

SEQ ID NO: 493097 - DNA, 20 bp, Artificial Sequence
  chemically synthesized
ccttaatcatattgtatatg

SEQ ID NO: 493098 - DNA, 20 bp, Artificial Sequence
  chemically synthesized
ttttattatactttaagttt

SEQ ID NO: 493099 - DNA, 20 bp, Artificial Sequence
  chemically synthesized
taatgctaaatgaccagtta

SEQ ID NO: 493100 - DNA, 20 bp, Artificial Sequence
  chemically synthesized
gtggggtggggggagggtgg

SEQ ID NO: 493101 - DNA, 20 bp, Artificial Sequence
  chemically synthesized
ggcctgttgtggggtggggg

SEQ ID NO: 493102 - DNA, 20 bp, Artificial Sequence
  chemically synthesized
tcacacaccggggcctgttg

SEQ ID NO: 493103 - DNA, 20 bp, Artificial Sequence
  chemically synthesized
tcattgttcaattcccacct

SEQ ID NO: 493104 - DNA, 20 bp, Artificial Sequence
  chemically synthesized
gcatgttctcactcataggt

SEQ ID NO: 493105 - DNA, 20 bp, Artificial Sequence
  chemically synthesized
aatactttgtagggacatgg

SEQ ID NO: 493106 - DNA, 20 bp, Artificial Sequence
  chemically synthesized
ggaaaatactttgtagggac

SEQ ID NO: 493107 - DNA, 20 bp, Artificial Sequence
  chemically synthesized
aataatgtgcacaggtcaat

SEQ ID NO: 493108 - DNA, 20 bp, Artificial Sequence
  chemically synthesized
taacaagtgtttgccaaagc

SEQ ID NO: 493109 - DNA, 20 bp, Artificial Sequence
  chemically synthesized
aatgtcctgtatggtgcctc

SEQ ID NO: 493110 - DNA, 20 bp, Artificial Sequence
  chemically synthesized
aatttccttcacatagagaa

SEQ ID NO: 493111 - DNA, 20 bp, Artificial Sequence
  chemically synthesized
gagaaagagttaaggtatta

SEQ ID NO: 493112 - DNA, 20 bp, Artificial Sequence
  chemically synthesized
cctctctcacacattagaga

SEQ ID NO: 493113 - DNA, 20 bp, Artificial Sequence
  chemically synthesized
aagaaaataaccagagatac

SEQ ID NO: 493114 - DNA, 20 bp, Artificial Sequence
  chemically synthesized
cagagatacaaggatgcaaa

SEQ ID NO: 493115 - DNA, 20 bp, Artificial Sequence
  chemically synthesized
tcgttcttaacgtttttgca

SEQ ID NO: 493116 - DNA, 20 bp, Artificial Sequence
  chemically synthesized
tacaacaaaacagcccatca

SEQ ID NO: 493117 - DNA, 20 bp, Artificial Sequence
  chemically synthesized
tcatcttatgaatgaggaga

SEQ ID NO: 493118 - DNA, 20 bp, Artificial Sequence
  chemically synthesized
tagtgcaaatttctcatctt

SEQ ID NO: 493119 - DNA, 20 bp, Artificial Sequence
  chemically synthesized
tgctccacctctaaaatgac

SEQ ID NO: 493120 - DNA, 20 bp, Artificial Sequence
  chemically synthesized
cattactctgtttaatttac

SEQ ID NO: 493121 - DNA, 20 bp, Artificial Sequence
  chemically synthesized
ccatattctggtaaattaaa

SEQ ID NO: 493122 - DNA, 20 bp, Artificial Sequence
  chemically synthesized
ttgcctgttgagcataaatt

SEQ ID NO: 493123 - DNA, 20 bp, Artificial Sequence
  chemically synthesized
tttgaatctgttactataaa

SEQ ID NO: 493124 - DNA, 20 bp, Artificial Sequence
  chemically synthesized
tttatttttaaatatgcttt

SEQ ID NO: 493125 - DNA, 20 bp, Artificial Sequence
  chemically synthesized
agttctagtgctctatacga

SEQ ID NO: 493126 - DNA, 20 bp, Artificial Sequence
  chemically synthesized
aaatggctagaaggagaacg

SEQ ID NO: 493127 - DNA, 20 bp, Artificial Sequence
  chemically synthesized
aatgaccaatgtttgagata

SEQ ID NO: 493128 - DNA, 20 bp, Artificial Sequence
  chemically synthesized
gtaatgtatagtgatcagat

SEQ ID NO: 493129 - DNA, 20 bp, Artificial Sequence
  chemically synthesized
aaaacatcactaggttctcc

SEQ ID NO: 493130 - DNA, 20 bp, Artificial Sequence
  chemically synthesized
ttttacattgtttacttttg

SEQ ID NO: 493131 - DNA, 20 bp, Artificial Sequence
  chemically synthesized
attttatataacttctttgc

SEQ ID NO: 493132 - DNA, 20 bp, Artificial Sequence
  chemically synthesized
tcagaaaaatagtagagcca

SEQ ID NO: 493133 - DNA, 20 bp, Artificial Sequence
  chemically synthesized
gtggctctactatttttctg

SEQ ID NO: 493134 - DNA, 20 bp, Artificial Sequence
  chemically synthesized
atcacagtatcatgatactt

SEQ ID NO: 493135 - DNA, 20 bp, Artificial Sequence
  chemically synthesized
gaatttaggaggctgctata

SEQ ID NO: 493136 - DNA, 20 bp, Artificial Sequence
  chemically synthesized
atttccaagatggagaaact

SEQ ID NO: 493137 - DNA, 20 bp, Artificial Sequence
  chemically synthesized
aagttagatgtaatgataac

SEQ ID NO: 493138 - DNA, 20 bp, Artificial Sequence
  chemically synthesized
tttcagttttatgtgatcat

SEQ ID NO: 493139 - DNA, 20 bp, Artificial Sequence
  chemically synthesized
actataaaaataattaattt

SEQ ID NO: 493140 - DNA, 20 bp, Artificial Sequence
  chemically synthesized
atagaaaaatcaacaaagct

SEQ ID NO: 493141 - DNA, 20 bp, Artificial Sequence
  chemically synthesized
tcatttctgattttacttat

SEQ ID NO: 493142 - DNA, 20 bp, Artificial Sequence
  chemically synthesized
cattacaactggtatccaaa

SEQ ID NO: 493143 - DNA, 20 bp, Artificial Sequence
  chemically synthesized
tataatcatttgcattcttt

SEQ ID NO: 493144 - DNA, 20 bp, Artificial Sequence
  chemically synthesized
ttggtagattgcatgtttca

SEQ ID NO: 493145 - DNA, 20 bp, Artificial Sequence
  chemically synthesized
aaacatgcaatctaccaata

SEQ ID NO: 493146 - DNA, 20 bp, Artificial Sequence
  chemically synthesized
atcttgaagaaatagaaaat

SEQ ID NO: 493147 - DNA, 20 bp, Artificial Sequence
  chemically synthesized
ggccgaaactagtaaggaga

SEQ ID NO: 493148 - DNA, 20 bp, Artificial Sequence
  chemically synthesized
aatctaatgaacagttaaag

SEQ ID NO: 493149 - DNA, 20 bp, Artificial Sequence
  chemically synthesized
atttttctgaagaatttgag

SEQ ID NO: 493150 - DNA, 20 bp, Artificial Sequence
  chemically synthesized
tcttctctttaatttttctg

SEQ ID NO: 493151 - DNA, 20 bp, Artificial Sequence
  chemically synthesized
caggatactgatgccccttg

SEQ ID NO: 493152 - DNA, 20 bp, Artificial Sequence
  chemically synthesized
tcttttattgactttgatat

SEQ ID NO: 493153 - DNA, 20 bp, Artificial Sequence
  chemically synthesized
ttcagtttgctagtatttta

SEQ ID NO: 493154 - DNA, 20 bp, Artificial Sequence
  chemically synthesized
ataatcctttcaatatactg

SEQ ID NO: 493155 - DNA, 20 bp, Artificial Sequence
  chemically synthesized
tgaactcaacagtatattga

SEQ ID NO: 493156 - DNA, 20 bp, Artificial Sequence
  chemically synthesized
gattatacacgagagccata

SEQ ID NO: 493157 - DNA, 20 bp, Artificial Sequence
  chemically synthesized
agccatataggatttattct

SEQ ID NO: 493158 - DNA, 20 bp, Artificial Sequence
  chemically synthesized
ttgaaccatttttgcattcc

SEQ ID NO: 493159 - DNA, 20 bp, Artificial Sequence
  chemically synthesized
ataaaaacacacaacaaact

SEQ ID NO: 493160 - DNA, 20 bp, Artificial Sequence
  chemically synthesized
ccgtatatgaaaaacccaca

SEQ ID NO: 493161 - DNA, 20 bp, Artificial Sequence
  chemically synthesized
cattaaatgtgatattcact

SEQ ID NO: 493162 - DNA, 20 bp, Artificial Sequence
  chemically synthesized
cttaagatcagaaacaagac

SEQ ID NO: 493163 - DNA, 20 bp, Artificial Sequence
  chemically synthesized
tctgatacgtagaaaatctt

SEQ ID NO: 493164 - DNA, 20 bp, Artificial Sequence
  chemically synthesized
ctttgtatcctgcaactttg

SEQ ID NO: 493165 - DNA, 20 bp, Artificial Sequence
  chemically synthesized
aaacaaattcagcaaagttg

SEQ ID NO: 493166 - DNA, 20 bp, Artificial Sequence
  chemically synthesized
agcgtatagaaacgcaactg

SEQ ID NO: 493167 - DNA, 20 bp, Artificial Sequence
  chemically synthesized
tcatttacaatagcaataaa

SEQ ID NO: 493168 - DNA, 20 bp, Artificial Sequence
  chemically synthesized
cacatcttttaccttcttgg

SEQ ID NO: 493169 - DNA, 20 bp, Artificial Sequence
  chemically synthesized
acactgtatctgtagatggt

SEQ ID NO: 493170 - DNA, 20 bp, Artificial Sequence
  chemically synthesized
aatgcgattgggattatgat

SEQ ID NO: 493171 - DNA, 20 bp, Artificial Sequence
  chemically synthesized
atttctgtaaaaaatgcgat

SEQ ID NO: 493172 - DNA, 20 bp, Artificial Sequence
  chemically synthesized
ggagtcgtttgtggtttcat

SEQ ID NO: 493173 - DNA, 20 bp, Artificial Sequence
  chemically synthesized
tcaagactgttttggctatt

SEQ ID NO: 493174 - DNA, 20 bp, Artificial Sequence
  chemically synthesized
ccaaaacagtcttgaggaag

SEQ ID NO: 493175 - DNA, 20 bp, Artificial Sequence
  chemically synthesized
tcacacttgctagtttcaaa

SEQ ID NO: 493176 - DNA, 20 bp, Artificial Sequence
  chemically synthesized
agacatatagaccaatggaa

SEQ ID NO: 493177 - DNA, 20 bp, Artificial Sequence
  chemically synthesized
ggtgatgctaggtttatttc

SEQ ID NO: 493178 - DNA, 20 bp, Artificial Sequence
  chemically synthesized
aacctagcatcaccttcaat

SEQ ID NO: 493179 - DNA, 20 bp, Artificial Sequence
  chemically synthesized
tcaccttcaataggggtgcc

SEQ ID NO: 493180 - DNA, 20 bp, Artificial Sequence
  chemically synthesized
ccaagaatacacaactggga

SEQ ID NO: 493181 - DNA, 20 bp, Artificial Sequence
  chemically synthesized
tcccagcaccattggttgaa

SEQ ID NO: 493182 - DNA, 20 bp, Artificial Sequence
  chemically synthesized
aaccaatggtgctgggaaaa

SEQ ID NO: 493183 - DNA, 20 bp, Artificial Sequence
  chemically synthesized
aactggatatacacattgca

SEQ ID NO: 493184 - DNA, 20 bp, Artificial Sequence
  chemically synthesized
gatatacacattgcaaagaa

SEQ ID NO: 493185 - DNA, 20 bp, Artificial Sequence
  chemically synthesized
aaaatcaactcaaaatgaaa

SEQ ID NO: 493186 - DNA, 20 bp, Artificial Sequence
  chemically synthesized
agtctttactccatttcatt

SEQ ID NO: 493187 - DNA, 20 bp, Artificial Sequence
  chemically synthesized
tttcccttatgttttcttct

SEQ ID NO: 493188 - DNA, 20 bp, Artificial Sequence
  chemically synthesized
ggtcttcacaataatttttt

SEQ ID NO: 493189 - DNA, 20 bp, Artificial Sequence
  chemically synthesized
aaagcaagggaaacaatcaa

SEQ ID NO: 493190 - DNA, 20 bp, Artificial Sequence
  chemically synthesized
acagaattaaaagcaaccta

SEQ ID NO: 493191 - DNA, 20 bp, Artificial Sequence
  chemically synthesized
cactttaaaaattgggttgt

SEQ ID NO: 493192 - DNA, 20 bp, Artificial Sequence
  chemically synthesized
tcctttgttcactttaaaaa

SEQ ID NO: 493193 - DNA, 20 bp, Artificial Sequence
  chemically synthesized
ccaatttttaaagtgaacaa

SEQ ID NO: 493194 - DNA, 20 bp, Artificial Sequence
  chemically synthesized
ttttaaagtgaacaaaggaa

SEQ ID NO: 493195 - DNA, 20 bp, Artificial Sequence
  chemically synthesized
ccgtgaggtagtatatcatt

SEQ ID NO: 493196 - DNA, 20 bp, Artificial Sequence
  chemically synthesized
ccacaatgatatactacctc

SEQ ID NO: 493197 - DNA, 20 bp, Artificial Sequence
  chemically synthesized
tgatatactacctcacggat

SEQ ID NO: 493198 - DNA, 20 bp, Artificial Sequence
  chemically synthesized
agcttttgtggaaaacaata

SEQ ID NO: 493199 - DNA, 20 bp, Artificial Sequence
  chemically synthesized
aagatctagcaatcccgcat

SEQ ID NO: 493200 - DNA, 20 bp, Artificial Sequence
  chemically synthesized
tttagataaatatccagatg

SEQ ID NO: 493201 - DNA, 20 bp, Artificial Sequence
  chemically synthesized
gcatctggatatttatctaa

SEQ ID NO: 493202 - DNA, 20 bp, Artificial Sequence
  chemically synthesized
ttatctaaacgaattcaatt

SEQ ID NO: 493203 - DNA, 20 bp, Artificial Sequence
  chemically synthesized
tatctcttcaagatcctaaa

SEQ ID NO: 493204 - DNA, 20 bp, Artificial Sequence
  chemically synthesized
aaaaatgctacaataaacat

SEQ ID NO: 493205 - DNA, 20 bp, Artificial Sequence
  chemically synthesized
aactaaatgtctattgacag

SEQ ID NO: 493206 - DNA, 20 bp, Artificial Sequence
  chemically synthesized
gctatgttatatacatacaa

SEQ ID NO: 493207 - DNA, 20 bp, Artificial Sequence
  chemically synthesized
gtaagatttcctttttgtgg

SEQ ID NO: 493208 - DNA, 20 bp, Artificial Sequence
  chemically synthesized
atcttaccatatgctacaat

SEQ ID NO: 493209 - DNA, 20 bp, Artificial Sequence
  chemically synthesized
taccatatgctacaatgtgg

SEQ ID NO: 493210 - DNA, 20 bp, Artificial Sequence
  chemically synthesized
actttagatacctcatgtaa

SEQ ID NO: 493211 - DNA, 20 bp, Artificial Sequence
  chemically synthesized
aaatggtgagatgctgtgca

SEQ ID NO: 493212 - DNA, 20 bp, Artificial Sequence
  chemically synthesized
ggtatagactatcaggcatg

SEQ ID NO: 493213 - DNA, 20 bp, Artificial Sequence
  chemically synthesized
gtgcacttaaaatttattaa

SEQ ID NO: 493214 - DNA, 20 bp, Artificial Sequence
  chemically synthesized
acttaaaatttattaagagg

SEQ ID NO: 493215 - DNA, 20 bp, Artificial Sequence
  chemically synthesized
aatgattaagttcattaaca

SEQ ID NO: 493216 - DNA, 20 bp, Artificial Sequence
  chemically synthesized
tttgttaatgaacttaatca

SEQ ID NO: 493217 - DNA, 20 bp, Artificial Sequence
  chemically synthesized
tggtatttgcaacttctcgt

SEQ ID NO: 493218 - DNA, 20 bp, Artificial Sequence
  chemically synthesized
agtgtgagatcattgtgaac

SEQ ID NO: 493219 - DNA, 20 bp, Artificial Sequence
  chemically synthesized
atatttcggaatttaaagcc

SEQ ID NO: 493220 - DNA, 20 bp, Artificial Sequence
  chemically synthesized
ttcttactctctaaatattt

SEQ ID NO: 493221 - DNA, 20 bp, Artificial Sequence
  chemically synthesized
tttaaattccgaaatattta

SEQ ID NO: 493222 - DNA, 20 bp, Artificial Sequence
  chemically synthesized
acttccgttgcaactgttgt

SEQ ID NO: 493223 - DNA, 20 bp, Artificial Sequence
  chemically synthesized
agaaagagctcagcatgcac

SEQ ID NO: 493224 - DNA, 20 bp, Artificial Sequence
  chemically synthesized
aacaggaagagcccagtgct

SEQ ID NO: 493225 - DNA, 20 bp, Artificial Sequence
  chemically synthesized
gctaaggattcactcagggg

SEQ ID NO: 493226 - DNA, 20 bp, Artificial Sequence
  chemically synthesized
atcacccacccttcccctga

SEQ ID NO: 493227 - DNA, 20 bp, Artificial Sequence
  chemically synthesized
aggattcactcaggggaagg

SEQ ID NO: 493228 - DNA, 20 bp, Artificial Sequence
  chemically synthesized
tattatcacccacccttccc

SEQ ID NO: 493229 - DNA, 20 bp, Artificial Sequence
  chemically synthesized
gggaagggtgggtgataata

SEQ ID NO: 493230 - DNA, 20 bp, Artificial Sequence
  chemically synthesized
gatagtaagatacctgaaat

SEQ ID NO: 493231 - DNA, 20 bp, Artificial Sequence
  chemically synthesized
tctgatgttttagtttttta

SEQ ID NO: 493232 - DNA, 20 bp, Artificial Sequence
  chemically synthesized
acaactgcttcgtttctctt

SEQ ID NO: 493233 - DNA, 20 bp, Artificial Sequence
  chemically synthesized
gaagcagttgtacccaaaag

SEQ ID NO: 493234 - DNA, 20 bp, Artificial Sequence
  chemically synthesized
agatctttattatcctactt

SEQ ID NO: 493235 - DNA, 20 bp, Artificial Sequence
  chemically synthesized
ataaatgcatactccatcca

SEQ ID NO: 493236 - DNA, 20 bp, Artificial Sequence
  chemically synthesized
ctttggcatcaccctatgga

SEQ ID NO: 493237 - DNA, 20 bp, Artificial Sequence
  chemically synthesized
tccttctttggcatcaccct

SEQ ID NO: 493238 - DNA, 20 bp, Artificial Sequence
  chemically synthesized
gcaagtaatcggtgggtctg

SEQ ID NO: 493239 - DNA, 20 bp, Artificial Sequence
  chemically synthesized
tgtcactgtgcaagtaatcg

SEQ ID NO: 493240 - DNA, 20 bp, Artificial Sequence
  chemically synthesized
accgattacttgcacagtga

SEQ ID NO: 493241 - DNA, 20 bp, Artificial Sequence
  chemically synthesized
cttgcacagtgacagaattt

SEQ ID NO: 493242 - DNA, 20 bp, Artificial Sequence
  chemically synthesized
cagtggaaataaattagttc

SEQ ID NO: 493243 - DNA, 20 bp, Artificial Sequence
  chemically synthesized
catgaactaatttatttcca

SEQ ID NO: 493244 - DNA, 20 bp, Artificial Sequence
  chemically synthesized
gtgtcaccgcttaaattttc

SEQ ID NO: 493245 - DNA, 20 bp, Artificial Sequence
  chemically synthesized
aggagctttataatgcaaca

SEQ ID NO: 493246 - DNA, 20 bp, Artificial Sequence
  chemically synthesized
aaataatgatctatccaact

SEQ ID NO: 493247 - DNA, 20 bp, Artificial Sequence
  chemically synthesized
tgtagggaaaccactcaaag

SEQ ID NO: 493248 - DNA, 20 bp, Artificial Sequence
  chemically synthesized
agagacctagaaaaaaactg

SEQ ID NO: 493249 - DNA, 20 bp, Artificial Sequence
  chemically synthesized
acctagaaaaaaactgctga

SEQ ID NO: 493250 - DNA, 20 bp, Artificial Sequence
  chemically synthesized
ttccaaaaaattgacaaatt

SEQ ID NO: 493251 - DNA, 20 bp, Artificial Sequence
  chemically synthesized
agtttcttgcaaactgccct

SEQ ID NO: 493252 - DNA, 20 bp, Artificial Sequence
  chemically synthesized
ggctgtggtaaggttgcagg

SEQ ID NO: 493253 - DNA, 20 bp, Artificial Sequence
  chemically synthesized
ttgattactgtgtgttctgg

SEQ ID NO: 493254 - DNA, 20 bp, Artificial Sequence
  chemically synthesized
taatcaatggcaaagttaat

SEQ ID NO: 493255 - DNA, 20 bp, Artificial Sequence
  chemically synthesized
aatggcaaagttaattggaa

SEQ ID NO: 493256 - DNA, 20 bp, Artificial Sequence
  chemically synthesized
acattgtagaattgctaagg

SEQ ID NO: 493257 - DNA, 20 bp, Artificial Sequence
  chemically synthesized
gtctatcactaggaacattg

SEQ ID NO: 493258 - DNA, 20 bp, Artificial Sequence
  chemically synthesized
agacagttttaatcaaagct

SEQ ID NO: 493259 - DNA, 20 bp, Artificial Sequence
  chemically synthesized
taaaacctagtctttccact

SEQ ID NO: 493260 - DNA, 20 bp, Artificial Sequence
  chemically synthesized
gtttggagctgaaacacttt

SEQ ID NO: 493261 - DNA, 20 bp, Artificial Sequence
  chemically synthesized
ctttttgagtagagaagaca

SEQ ID NO: 493262 - DNA, 20 bp, Artificial Sequence
  chemically synthesized
gtggttgaaaagaagttggt

SEQ ID NO: 493263 - DNA, 20 bp, Artificial Sequence
  chemically synthesized
ctcagctaacatgctgcagt

SEQ ID NO: 493264 - DNA, 20 bp, Artificial Sequence
  chemically synthesized
gagaggctaagtgagttgtc

SEQ ID NO: 493265 - DNA, 20 bp, Artificial Sequence
  chemically synthesized
ctggagcacagagaggctaa

SEQ ID NO: 493266 - DNA, 20 bp, Artificial Sequence
  chemically synthesized
atgtagagaagtggttcaag

SEQ ID NO: 493267 - DNA, 20 bp, Artificial Sequence
  chemically synthesized
ttctttactctgccctggcc

SEQ ID NO: 493268 - DNA, 20 bp, Artificial Sequence
  chemically synthesized
accataaccccaggccaggg

SEQ ID NO: 493269 - DNA, 20 bp, Artificial Sequence
  chemically synthesized
taaacaactgcttagatctg

SEQ ID NO: 493270 - DNA, 20 bp, Artificial Sequence
  chemically synthesized
tcagatctaagcagttgttt

SEQ ID NO: 493271 - DNA, 20 bp, Artificial Sequence
  chemically synthesized
atacctaaaagaaaagacag

SEQ ID NO: 493272 - DNA, 20 bp, Artificial Sequence
  chemically synthesized
ccattaaaatttggaagagt

SEQ ID NO: 493273 - DNA, 20 bp, Artificial Sequence
  chemically synthesized
caggagccattaaaatttgg

SEQ ID NO: 493274 - DNA, 20 bp, Artificial Sequence
  chemically synthesized
atttcttaccagctgagatg

SEQ ID NO: 493275 - DNA, 20 bp, Artificial Sequence
  chemically synthesized
ttcatactgttttcagaacg

SEQ ID NO: 493276 - DNA, 20 bp, Artificial Sequence
  chemically synthesized
agcatatcggccattcctgg

SEQ ID NO: 493277 - DNA, 20 bp, Artificial Sequence
  chemically synthesized
ataatgaactggaccccacc

SEQ ID NO: 493278 - DNA, 20 bp, Artificial Sequence
  chemically synthesized
attagaaggcgattcagcat

SEQ ID NO: 493279 - DNA, 20 bp, Artificial Sequence
  chemically synthesized
gacaattctcaattccaatg

SEQ ID NO: 493280 - DNA, 20 bp, Artificial Sequence
  chemically synthesized
ggcgattcagcattggaatt

SEQ ID NO: 493281 - DNA, 20 bp, Artificial Sequence
  chemically synthesized
cacaccactgcttataacct

SEQ ID NO: 493282 - DNA, 20 bp, Artificial Sequence
  chemically synthesized
gtggaggtgccattgttccc

SEQ ID NO: 493283 - DNA, 20 bp, Artificial Sequence
  chemically synthesized
caaaaacaaaagacctatta

SEQ ID NO: 493284 - DNA, 20 bp, Artificial Sequence
  chemically synthesized
tatttgccacctttggtcaa

SEQ ID NO: 493285 - DNA, 20 bp, Artificial Sequence
  chemically synthesized
tcgtggtgttgctctagcta

SEQ ID NO: 493286 - DNA, 20 bp, Artificial Sequence
  chemically synthesized
aaccaatgtacggaggccag

SEQ ID NO: 493287 - DNA, 20 bp, Artificial Sequence
  chemically synthesized
ctctgtaatttattagaata

SEQ ID NO: 493288 - DNA, 20 bp, Artificial Sequence
  chemically synthesized
atgtggactctgtaatttat

SEQ ID NO: 493289 - DNA, 20 bp, Artificial Sequence
  chemically synthesized
ctctttattctaataaatta

SEQ ID NO: 493290 - DNA, 20 bp, Artificial Sequence
  chemically synthesized
tatttagtgaaatcatttca

SEQ ID NO: 493291 - DNA, 20 bp, Artificial Sequence
  chemically synthesized
aaaatatgtgtacacatatt

SEQ ID NO: 493292 - DNA, 20 bp, Artificial Sequence
  chemically synthesized
ttcagttgagctgaatgacc

SEQ ID NO: 493293 - DNA, 20 bp, Artificial Sequence
  chemically synthesized
agctatcagtttcagttgag

SEQ ID NO: 493294 - DNA, 20 bp, Artificial Sequence
  chemically synthesized
aagcagttatgtaaagtgta

SEQ ID NO: 493295 - DNA, 20 bp, Artificial Sequence
  chemically synthesized
gtaaagtgtaaagaattggt

SEQ ID NO: 493296 - DNA, 20 bp, Artificial Sequence
  chemically synthesized
tcatttggtcttctttcatg

SEQ ID NO: 493297 - DNA, 20 bp, Artificial Sequence
  chemically synthesized
gaagaaatgttaaacacaat

SEQ ID NO: 493298 - DNA, 20 bp, Artificial Sequence
  chemically synthesized
tggaagaaaacaagtagatg

SEQ ID NO: 493299 - DNA, 20 bp, Artificial Sequence
  chemically synthesized
aacaagtagatgaggagtta

SEQ ID NO: 493300 - DNA, 20 bp, Artificial Sequence
  chemically synthesized
ggagttagtgaatgctacct

SEQ ID NO: 493301 - DNA, 20 bp, Artificial Sequence
  chemically synthesized
attaacctagaaatatgttc

SEQ ID NO: 493302 - DNA, 20 bp, Artificial Sequence
  chemically synthesized
tacgtgacaagagctagaca

SEQ ID NO: 493303 - DNA, 20 bp, Artificial Sequence
  chemically synthesized
tttaatatatataacatata

SEQ ID NO: 493304 - DNA, 20 bp, Artificial Sequence
  chemically synthesized
atatattaaaacacgttcat

SEQ ID NO: 493305 - DNA, 20 bp, Artificial Sequence
  chemically synthesized
atacagataaatgtcttgat

SEQ ID NO: 493306 - DNA, 20 bp, Artificial Sequence
  chemically synthesized
agataaatgtcttgatgtga

SEQ ID NO: 493307 - DNA, 20 bp, Artificial Sequence
  chemically synthesized
taactttcttaagtgttcat

SEQ ID NO: 493308 - DNA, 20 bp, Artificial Sequence
  chemically synthesized
atgtgttacttttgtatatc

SEQ ID NO: 493309 - DNA, 20 bp, Artificial Sequence
  chemically synthesized
tcttaaaaagtataagtaaa

SEQ ID NO: 493310 - DNA, 20 bp, Artificial Sequence
  chemically synthesized
agtataagtaaaaaggattt

SEQ ID NO: 493311 - DNA, 20 bp, Artificial Sequence
  chemically synthesized
aacaagcagcttgccatatg

SEQ ID NO: 493312 - DNA, 20 bp, Artificial Sequence
  chemically synthesized
attcatccaaaaagactagt

SEQ ID NO: 493313 - DNA, 20 bp, Artificial Sequence
  chemically synthesized
aagaattcatactagtcttt

SEQ ID NO: 493314 - DNA, 20 bp, Artificial Sequence
  chemically synthesized
attcatactagtctttttgg

SEQ ID NO: 493315 - DNA, 20 bp, Artificial Sequence
  chemically synthesized
atggctttgtcttacacaga

SEQ ID NO: 493316 - DNA, 20 bp, Artificial Sequence
  chemically synthesized
ccaaacaagtaaaacagaaa

SEQ ID NO: 493317 - DNA, 20 bp, Artificial Sequence
  chemically synthesized
agtaaaacagaaactgaatg

SEQ ID NO: 493318 - DNA, 20 bp, Artificial Sequence
  chemically synthesized
gttggaactgatattcaatt

SEQ ID NO: 493319 - DNA, 20 bp, Artificial Sequence
  chemically synthesized
aatcagtttctaatccaaaa

SEQ ID NO: 493320 - DNA, 20 bp, Artificial Sequence
  chemically synthesized
tcagtaaacctgacactaat

SEQ ID NO: 493321 - DNA, 20 bp, Artificial Sequence
  chemically synthesized
aacattatctcaagctttgt

SEQ ID NO: 493322 - DNA, 20 bp, Artificial Sequence
  chemically synthesized
cttgagataatgttttaata

SEQ ID NO: 493323 - DNA, 20 bp, Artificial Sequence
  chemically synthesized
tgaattgacttaattgaatg

SEQ ID NO: 493324 - DNA, 20 bp, Artificial Sequence
  chemically synthesized
caaaagctgaattgacttaa

SEQ ID NO: 493325 - DNA, 20 bp, Artificial Sequence
  chemically synthesized
cctggctgaaacatcaaaag

SEQ ID NO: 493326 - DNA, 20 bp, Artificial Sequence
  chemically synthesized
caggtaaatgctcaacatgt

SEQ ID NO: 493327 - DNA, 20 bp, Artificial Sequence
  chemically synthesized
gttatacttttccatttgtg

SEQ ID NO: 493328 - DNA, 20 bp, Artificial Sequence
  chemically synthesized
agacatacttaaaacattat

SEQ ID NO: 493329 - DNA, 20 bp, Artificial Sequence
  chemically synthesized
ttcagattttgttgaaggat

SEQ ID NO: 493330 - DNA, 20 bp, Artificial Sequence
  chemically synthesized
ggcatattcagattttgttg

SEQ ID NO: 493331 - DNA, 20 bp, Artificial Sequence
  chemically synthesized
tccatatccttcaacaaaat

SEQ ID NO: 493332 - DNA, 20 bp, Artificial Sequence
  chemically synthesized
agaaaagacaatctatcctt

SEQ ID NO: 493333 - DNA, 20 bp, Artificial Sequence
  chemically synthesized
ataggcaattgatcactcca

SEQ ID NO: 493334 - DNA, 20 bp, Artificial Sequence
  chemically synthesized
tttggagtgatcaattgcct

SEQ ID NO: 493335 - DNA, 20 bp, Artificial Sequence
  chemically synthesized
ttatgtagtaaaatgataac

SEQ ID NO: 493336 - DNA, 20 bp, Artificial Sequence
  chemically synthesized
atgataacctgaatataaga

SEQ ID NO: 493337 - DNA, 20 bp, Artificial Sequence
  chemically synthesized
ttttgtggatctagactttt

SEQ ID NO: 493338 - DNA, 20 bp, Artificial Sequence
  chemically synthesized
gaatcctaggtttgcatttt

SEQ ID NO: 493339 - DNA, 20 bp, Artificial Sequence
  chemically synthesized
agatccacaaaatgcaaacc

SEQ ID NO: 493340 - DNA, 20 bp, Artificial Sequence
  chemically synthesized
acctaggattccacgcacaa

SEQ ID NO: 493341 - DNA, 20 bp, Artificial Sequence
  chemically synthesized
tgtttgcacccttttgtgcg

SEQ ID NO: 493342 - DNA, 20 bp, Artificial Sequence
  chemically synthesized
taagtatatttgaaagatat

SEQ ID NO: 493343 - DNA, 20 bp, Artificial Sequence
  chemically synthesized
catatctttcaaatatactt

SEQ ID NO: 493344 - DNA, 20 bp, Artificial Sequence
  chemically synthesized
tttattactatgggacaggt

SEQ ID NO: 493345 - DNA, 20 bp, Artificial Sequence
  chemically synthesized
catagtatgtatatatattt

SEQ ID NO: 493346 - DNA, 20 bp, Artificial Sequence
  chemically synthesized
atatttgtgggttacttatt

SEQ ID NO: 493347 - DNA, 20 bp, Artificial Sequence
  chemically synthesized
acttattgagaatccattca

SEQ ID NO: 493348 - DNA, 20 bp, Artificial Sequence
  chemically synthesized
gatctttgtatactcgttga

SEQ ID NO: 493349 - DNA, 20 bp, Artificial Sequence
  chemically synthesized
ccgcgatctttgtatactcg

SEQ ID NO: 493350 - DNA, 20 bp, Artificial Sequence
  chemically synthesized
tcaacgagtatacaaagatc

SEQ ID NO: 493351 - DNA, 20 bp, Artificial Sequence
  chemically synthesized
atataagttcatctgatatg

SEQ ID NO: 493352 - DNA, 20 bp, Artificial Sequence
  chemically synthesized
atgatggatgcttccaattg

SEQ ID NO: 493353 - DNA, 20 bp, Artificial Sequence
  chemically synthesized
agaatacagaaattatattc

SEQ ID NO: 493354 - DNA, 20 bp, Artificial Sequence
  chemically synthesized
caagtttaaaatgtaaactc

SEQ ID NO: 493355 - DNA, 20 bp, Artificial Sequence
  chemically synthesized
aaacttgtgagatgtttgga

SEQ ID NO: 493356 - DNA, 20 bp, Artificial Sequence
  chemically synthesized
gaaatgacttaaaaattttc

SEQ ID NO: 493357 - DNA, 20 bp, Artificial Sequence
  chemically synthesized
aattttcatgaatattttca

SEQ ID NO: 493358 - DNA, 20 bp, Artificial Sequence
  chemically synthesized
attcgttgagaataaatcga

SEQ ID NO: 493359 - DNA, 20 bp, Artificial Sequence
  chemically synthesized
attcattcgttgagaataaa

SEQ ID NO: 493360 - DNA, 20 bp, Artificial Sequence
  chemically synthesized
actcattcgatttattctca

SEQ ID NO: 493361 - DNA, 20 bp, Artificial Sequence
  chemically synthesized
attcgatttattctcaacga

SEQ ID NO: 493362 - DNA, 20 bp, Artificial Sequence
  chemically synthesized
tattagataattcattcgtt

SEQ ID NO: 493363 - DNA, 20 bp, Artificial Sequence
  chemically synthesized
tgagataaacatgtttatat

SEQ ID NO: 493364 - DNA, 20 bp, Artificial Sequence
  chemically synthesized
aattaaggctttatatatta

SEQ ID NO: 493365 - DNA, 20 bp, Artificial Sequence
  chemically synthesized
tatcttatagtgaatatgtg

SEQ ID NO: 493366 - DNA, 20 bp, Artificial Sequence
  chemically synthesized
tccatagtgtttatcttata

SEQ ID NO: 493367 - DNA, 20 bp, Artificial Sequence
  chemically synthesized
tatgtgtgtgtgcatgtgtg

SEQ ID NO: 493368 - DNA, 20 bp, Artificial Sequence
  chemically synthesized
gtagtcaagtggatagagaa

SEQ ID NO: 493369 - DNA, 20 bp, Artificial Sequence
  chemically synthesized
gagaaatgacaagtagtcaa

SEQ ID NO: 493370 - DNA, 20 bp, Artificial Sequence
  chemically synthesized
agtgtaaaatgcagacatac

SEQ ID NO: 493371 - DNA, 20 bp, Artificial Sequence
  chemically synthesized
cataccagaatttttgcatg

SEQ ID NO: 493372 - DNA, 20 bp, Artificial Sequence
  chemically synthesized
ggattaatgatctaacagtt

SEQ ID NO: 493373 - DNA, 20 bp, Artificial Sequence
  chemically synthesized
aatgtagatgtttttgtggc

SEQ ID NO: 493374 - DNA, 20 bp, Artificial Sequence
  chemically synthesized
cattgtttctcagcatctta

SEQ ID NO: 493375 - DNA, 20 bp, Artificial Sequence
  chemically synthesized
atactgaagaaatgtattta

SEQ ID NO: 493376 - DNA, 20 bp, Artificial Sequence
  chemically synthesized
aatacatttcttcagtatat

SEQ ID NO: 493377 - DNA, 20 bp, Artificial Sequence
  chemically synthesized
atgcatgcatgcccatgtgt

SEQ ID NO: 493378 - DNA, 20 bp, Artificial Sequence
  chemically synthesized
agtgtggcctgtgggaaaat

SEQ ID NO: 493379 - DNA, 20 bp, Artificial Sequence
  chemically synthesized
agcaacattttaagaatggg

SEQ ID NO: 493380 - DNA, 20 bp, Artificial Sequence
  chemically synthesized
gcctaagcaacattttaaga

SEQ ID NO: 493381 - DNA, 20 bp, Artificial Sequence
  chemically synthesized
gaatgcctaagcaacatttt

SEQ ID NO: 493382 - DNA, 20 bp, Artificial Sequence
  chemically synthesized
ccattatcctgaaggagaag

SEQ ID NO: 493383 - DNA, 20 bp, Artificial Sequence
  chemically synthesized
taggcattcatcttctcctt

SEQ ID NO: 493384 - DNA, 20 bp, Artificial Sequence
  chemically synthesized
agcatcgatagcatgctagg

SEQ ID NO: 493385 - DNA, 20 bp, Artificial Sequence
  chemically synthesized
ctgaagcatcgatagcatgc

SEQ ID NO: 493386 - DNA, 20 bp, Artificial Sequence
  chemically synthesized
aacagtaggccagatgttta

SEQ ID NO: 493387 - DNA, 20 bp, Artificial Sequence
  chemically synthesized
ggcctactgtttaaaatgca

SEQ ID NO: 493388 - DNA, 20 bp, Artificial Sequence
  chemically synthesized
aagacagtgcaagtttgcca

SEQ ID NO: 493389 - DNA, 20 bp, Artificial Sequence
  chemically synthesized
ttttgagaatcagactatga

SEQ ID NO: 493390 - DNA, 20 bp, Artificial Sequence
  chemically synthesized
aagtgattctaattgctttt

SEQ ID NO: 493391 - DNA, 20 bp, Artificial Sequence
  chemically synthesized
gtctgattctcaaaagcaat

SEQ ID NO: 493392 - DNA, 20 bp, Artificial Sequence
  chemically synthesized
agaatcacttcttttggcct

SEQ ID NO: 493393 - DNA, 20 bp, Artificial Sequence
  chemically synthesized
ttcttttggccttggaatta

SEQ ID NO: 493394 - DNA, 20 bp, Artificial Sequence
  chemically synthesized
tttaaatttcaaatgattcc

SEQ ID NO: 493395 - DNA, 20 bp, Artificial Sequence
  chemically synthesized
cttctcaagtttgatatcct

SEQ ID NO: 493396 - DNA, 20 bp, Artificial Sequence
  chemically synthesized
agtgtaataatggtaggtct

SEQ ID NO: 493397 - DNA, 20 bp, Artificial Sequence
  chemically synthesized
attctaaacagagagaaata

SEQ ID NO: 493398 - DNA, 20 bp, Artificial Sequence
  chemically synthesized
actccgtatttctctctgtt

SEQ ID NO: 493399 - DNA, 20 bp, Artificial Sequence
  chemically synthesized
gaactagtttcaattaatct

SEQ ID NO: 493400 - DNA, 20 bp, Artificial Sequence
  chemically synthesized
aaacaagtttgctctcataa

SEQ ID NO: 493401 - DNA, 20 bp, Artificial Sequence
  chemically synthesized
tttaagcaaattacagtgtg

SEQ ID NO: 493402 - DNA, 20 bp, Artificial Sequence
  chemically synthesized
aatacaggatatgttgatat

SEQ ID NO: 493403 - DNA, 20 bp, Artificial Sequence
  chemically synthesized
ttaaatgtcactttcaaata

SEQ ID NO: 493404 - DNA, 20 bp, Artificial Sequence
  chemically synthesized
ttgacagaaaacaaaataca

SEQ ID NO: 493405 - DNA, 20 bp, Artificial Sequence
  chemically synthesized
ctttggccatagaaagcaac

SEQ ID NO: 493406 - DNA, 20 bp, Artificial Sequence
  chemically synthesized
acagacaagaccacttttat

SEQ ID NO: 493407 - DNA, 20 bp, Artificial Sequence
  chemically synthesized
ggacgttaaatattttaatc

SEQ ID NO: 493408 - DNA, 20 bp, Artificial Sequence
  chemically synthesized
acttttgtcagaatgagtta

SEQ ID NO: 493409 - DNA, 20 bp, Artificial Sequence
  chemically synthesized
atgcacatacttttgtcaga

SEQ ID NO: 493410 - DNA, 20 bp, Artificial Sequence
  chemically synthesized
aaacatgcacatacttttgt

SEQ ID NO: 493411 - DNA, 20 bp, Artificial Sequence
  chemically synthesized
acctctttctttcctcgaca

SEQ ID NO: 493412 - DNA, 20 bp, Artificial Sequence
  chemically synthesized
aaaatctcaacagtctaaag

SEQ ID NO: 493413 - DNA, 20 bp, Artificial Sequence
  chemically synthesized
ttccttcatggctgcttgat

SEQ ID NO: 493414 - DNA, 20 bp, Artificial Sequence
  chemically synthesized
tccatatcaagcagccatga

SEQ ID NO: 493415 - DNA, 20 bp, Artificial Sequence
  chemically synthesized
tccctcttcacaggtgtact

SEQ ID NO: 493416 - DNA, 20 bp, Artificial Sequence
  chemically synthesized
ccatgtattaatattttata

SEQ ID NO: 493417 - DNA, 20 bp, Artificial Sequence
  chemically synthesized
tgctgagttggaaaagatcg

SEQ ID NO: 493418 - DNA, 20 bp, Artificial Sequence
  chemically synthesized
atttaagttctgttgaaatg

SEQ ID NO: 493419 - DNA, 20 bp, Artificial Sequence
  chemically synthesized
ttcaacagaacttaaatcac

SEQ ID NO: 493420 - DNA, 20 bp, Artificial Sequence
  chemically synthesized
ttgcaaaacaaaatgtacac

SEQ ID NO: 493421 - DNA, 20 bp, Artificial Sequence
  chemically synthesized
tcattaagtcccctatatat

SEQ ID NO: 493422 - DNA, 20 bp, Artificial Sequence
  chemically synthesized
tcagctcatcatatggtgac

SEQ ID NO: 493423 - DNA, 20 bp, Artificial Sequence
  chemically synthesized
caaactaatgctaacatttt

SEQ ID NO: 493424 - DNA, 20 bp, Artificial Sequence
  chemically synthesized
tcagtacatagttaccaacg

SEQ ID NO: 493425 - DNA, 20 bp, Artificial Sequence
  chemically synthesized
tacatagttaccaacgatgg

SEQ ID NO: 493426 - DNA, 20 bp, Artificial Sequence
  chemically synthesized
gaaatattgttttagaaagt

SEQ ID NO: 493427 - DNA, 20 bp, Artificial Sequence
  chemically synthesized
gtctgagttttaatataaaa

SEQ ID NO: 493428 - DNA, 20 bp, Artificial Sequence
  chemically synthesized
ttccactataggtgatttgt

SEQ ID NO: 493429 - DNA, 20 bp, Artificial Sequence
  chemically synthesized
aaatcacctatagtggaaat

SEQ ID NO: 493430 - DNA, 20 bp, Artificial Sequence
  chemically synthesized
cccaatccatgggttatata

SEQ ID NO: 493431 - DNA, 20 bp, Artificial Sequence
  chemically synthesized
agcaattcaatatataaccc

SEQ ID NO: 493432 - DNA, 20 bp, Artificial Sequence
  chemically synthesized
tcaatatataacccatggat

SEQ ID NO: 493433 - DNA, 20 bp, Artificial Sequence
  chemically synthesized
ctgaaaaatcatcccaatcc

SEQ ID NO: 493434 - DNA, 20 bp, Artificial Sequence
  chemically synthesized
aattttcagacacatggaca

SEQ ID NO: 493435 - DNA, 20 bp, Artificial Sequence
  chemically synthesized
ttatctttctgacagattat

SEQ ID NO: 493436 - DNA, 20 bp, Artificial Sequence
  chemically synthesized
gactggtaacaaaaatgcaa

SEQ ID NO: 493437 - DNA, 20 bp, Artificial Sequence
  chemically synthesized
tattctgctttgatcacagt

SEQ ID NO: 493438 - DNA, 20 bp, Artificial Sequence
  chemically synthesized
aattcacactgtgatcaaag

SEQ ID NO: 493439 - DNA, 20 bp, Artificial Sequence
  chemically synthesized
acactgtgatcaaagcagaa

SEQ ID NO: 493440 - DNA, 20 bp, Artificial Sequence
  chemically synthesized
ctccgacatgacttgataca

SEQ ID NO: 493441 - DNA, 20 bp, Artificial Sequence
  chemically synthesized
tacataaaaataaaaattgg

SEQ ID NO: 493442 - DNA, 20 bp, Artificial Sequence
  chemically synthesized
attatacataaaaataaaaa

SEQ ID NO: 493443 - DNA, 20 bp, Artificial Sequence
  chemically synthesized
attagatacttttagtgacc

SEQ ID NO: 493444 - DNA, 20 bp, Artificial Sequence
  chemically synthesized
ttttcaacttttaagatcca

SEQ ID NO: 493445 - DNA, 20 bp, Artificial Sequence
  chemically synthesized
caaacctgaacatgtaccct

SEQ ID NO: 493446 - DNA, 20 bp, Artificial Sequence
  chemically synthesized
tacatgttcaggtttgttac

SEQ ID NO: 493447 - DNA, 20 bp, Artificial Sequence
  chemically synthesized
tatggcgtgatgctgaggtt

SEQ ID NO: 493448 - DNA, 20 bp, Artificial Sequence
  chemically synthesized
tatgcttactacctggttaa

SEQ ID NO: 493449 - DNA, 20 bp, Artificial Sequence
  chemically synthesized
gggaaaggaaagggggagac

SEQ ID NO: 493450 - DNA, 20 bp, Artificial Sequence
  chemically synthesized
agctaaatgttaggtactta

SEQ ID NO: 493451 - DNA, 20 bp, Artificial Sequence
  chemically synthesized
catttagctccaactcataa

SEQ ID NO: 493452 - DNA, 20 bp, Artificial Sequence
  chemically synthesized
aatactatatgtactcagtt

SEQ ID NO: 493453 - DNA, 20 bp, Artificial Sequence
  chemically synthesized
tgttcttatgttaatttgct

SEQ ID NO: 493454 - DNA, 20 bp, Artificial Sequence
  chemically synthesized
gctgcatctatgttgctgca

SEQ ID NO: 493455 - DNA, 20 bp, Artificial Sequence
  chemically synthesized
aggtgtccgtcaacgttgga

SEQ ID NO: 493456 - DNA, 20 bp, Artificial Sequence
  chemically synthesized
aacataggtgtccgtcaacg

SEQ ID NO: 493457 - DNA, 20 bp, Artificial Sequence
  chemically synthesized
tatgcacaatagcaaagtaa

SEQ ID NO: 493458 - DNA, 20 bp, Artificial Sequence
  chemically synthesized
catagtgctgtgacaaacat

SEQ ID NO: 493459 - DNA, 20 bp, Artificial Sequence
  chemically synthesized
gtagaaccatttgttttctt

SEQ ID NO: 493460 - DNA, 20 bp, Artificial Sequence
  chemically synthesized
tttggatatctactcagtaa

SEQ ID NO: 493461 - DNA, 20 bp, Artificial Sequence
  chemically synthesized
ttgacccatcaatcccatta

SEQ ID NO: 493462 - DNA, 20 bp, Artificial Sequence
  chemically synthesized
tctactcagtaatgggattg

SEQ ID NO: 493463 - DNA, 20 bp, Artificial Sequence
  chemically synthesized
gatgcttatacactgttgtt

SEQ ID NO: 493464 - DNA, 20 bp, Artificial Sequence
  chemically synthesized
tggcaaggccgcagagacaa

SEQ ID NO: 493465 - DNA, 20 bp, Artificial Sequence
  chemically synthesized
tctctgcggccttgccagca

SEQ ID NO: 493466 - DNA, 20 bp, Artificial Sequence
  chemically synthesized
tttttaacaaagccagtctg

SEQ ID NO: 493467 - DNA, 20 bp, Artificial Sequence
  chemically synthesized
tgatttgcatttctctgatg

SEQ ID NO: 493468 - DNA, 20 bp, Artificial Sequence
  chemically synthesized
gtttaggttcctcatagatt

SEQ ID NO: 493469 - DNA, 20 bp, Artificial Sequence
  chemically synthesized
tctgacggtggtgtaatatc

SEQ ID NO: 493470 - DNA, 20 bp, Artificial Sequence
  chemically synthesized
atggcaaaataaatgatcaa

SEQ ID NO: 493471 - DNA, 20 bp, Artificial Sequence
  chemically synthesized
ttctggacattggcttggga

SEQ ID NO: 493472 - DNA, 20 bp, Artificial Sequence
  chemically synthesized
ttctttcccaagccaatgtc

SEQ ID NO: 493473 - DNA, 20 bp, Artificial Sequence
  chemically synthesized
gtatttcccagattttattc

SEQ ID NO: 493474 - DNA, 20 bp, Artificial Sequence
  chemically synthesized
acttcaagctataagaatcc

SEQ ID NO: 493475 - DNA, 20 bp, Artificial Sequence
  chemically synthesized
aatgtaagacttcaagctat

SEQ ID NO: 493476 - DNA, 20 bp, Artificial Sequence
  chemically synthesized
aaaaaaataagcattgggaa

SEQ ID NO: 493477 - DNA, 20 bp, Artificial Sequence
  chemically synthesized
gtacacatagaccaatagaa

SEQ ID NO: 493478 - DNA, 20 bp, Artificial Sequence
  chemically synthesized
atgtgtacatgacatcttgg

SEQ ID NO: 493479 - DNA, 20 bp, Artificial Sequence
  chemically synthesized
ctacttaattctataatgag

SEQ ID NO: 493480 - DNA, 20 bp, Artificial Sequence
  chemically synthesized
tgagattacccttctcatta

SEQ ID NO: 493481 - DNA, 20 bp, Artificial Sequence
  chemically synthesized
ggttacttgtcaagtagata

SEQ ID NO: 493482 - DNA, 20 bp, Artificial Sequence
  chemically synthesized
tacctcacttccatattatg

SEQ ID NO: 493483 - DNA, 20 bp, Artificial Sequence
  chemically synthesized
tggaagtgaggtaggtgaga

SEQ ID NO: 493484 - DNA, 20 bp, Artificial Sequence
  chemically synthesized
taggtgagattggatggttt

SEQ ID NO: 493485 - DNA, 20 bp, Artificial Sequence
  chemically synthesized
gagatacaatgttataaatt

SEQ ID NO: 493486 - DNA, 20 bp, Artificial Sequence
  chemically synthesized
caggtcaatatgttccaatt

SEQ ID NO: 493487 - DNA, 20 bp, Artificial Sequence
  chemically synthesized
ggaacatattgacctgacaa

SEQ ID NO: 493488 - DNA, 20 bp, Artificial Sequence
  chemically synthesized
atattgacctgacaactggg

SEQ ID NO: 493489 - DNA, 20 bp, Artificial Sequence
  chemically synthesized
gtcatttggcccttctgtaa

SEQ ID NO: 493490 - DNA, 20 bp, Artificial Sequence
  chemically synthesized
tgtcccaggtatttcatgat

SEQ ID NO: 493491 - DNA, 20 bp, Artificial Sequence
  chemically synthesized
gacgtaattatggtttgtgg

SEQ ID NO: 493492 - DNA, 20 bp, Artificial Sequence
  chemically synthesized
tcataccaaaaggaagtaaa

SEQ ID NO: 493493 - DNA, 20 bp, Artificial Sequence
  chemically synthesized
aatgataagtgtttcagatg

SEQ ID NO: 493494 - DNA, 20 bp, Artificial Sequence
  chemically synthesized
aatgatcaaatcagggtaat

SEQ ID NO: 493495 - DNA, 20 bp, Artificial Sequence
  chemically synthesized
ataatgtgtaatgatcaaat

SEQ ID NO: 493496 - DNA, 20 bp, Artificial Sequence
  chemically synthesized
cgcttgtatcaaaatatcac

SEQ ID NO: 493497 - DNA, 20 bp, Artificial Sequence
  chemically synthesized
atgtttctttagaaaaaagg

SEQ ID NO: 493498 - DNA, 20 bp, Artificial Sequence
  chemically synthesized
tctcatatacataattatgg

SEQ ID NO: 493499 - DNA, 20 bp, Artificial Sequence
  chemically synthesized
tatacataattatggtagaa

SEQ ID NO: 493500 - DNA, 20 bp, Artificial Sequence
  chemically synthesized
aattatggtagaattgagtg

SEQ ID NO: 493501 - DNA, 20 bp, Artificial Sequence
  chemically synthesized
gcccacaaatctattgctat

SEQ ID NO: 493502 - DNA, 20 bp, Artificial Sequence
  chemically synthesized
aagttttatctatgttatgt

SEQ ID NO: 493503 - DNA, 20 bp, Artificial Sequence
  chemically synthesized
atctatgttatgtaagggtt

SEQ ID NO: 493504 - DNA, 20 bp, Artificial Sequence
  chemically synthesized
atttggtgaaataaaattaa

SEQ ID NO: 493505 - DNA, 20 bp, Artificial Sequence
  chemically synthesized
agatattcacagatggtctg

SEQ ID NO: 493506 - DNA, 20 bp, Artificial Sequence
  chemically synthesized
tcaaatcctccagaccatct

SEQ ID NO: 493507 - DNA, 20 bp, Artificial Sequence
  chemically synthesized
tgaatatctggttgacttgt

SEQ ID NO: 493508 - DNA, 20 bp, Artificial Sequence
  chemically synthesized
cttgtcagagtgcattttgc

SEQ ID NO: 493509 - DNA, 20 bp, Artificial Sequence
  chemically synthesized
tgcctgagttcaggggcgct

SEQ ID NO: 493510 - DNA, 20 bp, Artificial Sequence
  chemically synthesized
cagaggtcctaaatttaaat

SEQ ID NO: 493511 - DNA, 20 bp, Artificial Sequence
  chemically synthesized
ttgacatctgatgggaagac

SEQ ID NO: 493512 - DNA, 20 bp, Artificial Sequence
  chemically synthesized
taatttctggaatgcaggta

SEQ ID NO: 493513 - DNA, 20 bp, Artificial Sequence
  chemically synthesized
gttgctgatggtttaatttc

SEQ ID NO: 493514 - DNA, 20 bp, Artificial Sequence
  chemically synthesized
taatgtcctccttgtcaatt

SEQ ID NO: 493515 - DNA, 20 bp, Artificial Sequence
  chemically synthesized
caggactgtaggtagccaca

SEQ ID NO: 493516 - DNA, 20 bp, Artificial Sequence
  chemically synthesized
ctagagtgctggtttcatgc

SEQ ID NO: 493517 - DNA, 20 bp, Artificial Sequence
  chemically synthesized
aaccagcactctagaacatg

SEQ ID NO: 493518 - DNA, 20 bp, Artificial Sequence
  chemically synthesized
agattacacccatcatgttc

SEQ ID NO: 493519 - DNA, 20 bp, Artificial Sequence
  chemically synthesized
tttttgatgattcaggccaa

SEQ ID NO: 493520 - DNA, 20 bp, Artificial Sequence
  chemically synthesized
ttcctagccatccgattggc

SEQ ID NO: 493521 - DNA, 20 bp, Artificial Sequence
  chemically synthesized
accttcctcagcagtttgag

SEQ ID NO: 493522 - DNA, 20 bp, Artificial Sequence
  chemically synthesized
gcctctgtggaaaccaccca

SEQ ID NO: 493523 - DNA, 20 bp, Artificial Sequence
  chemically synthesized
ttacatagatgagaaacccc

SEQ ID NO: 493524 - DNA, 20 bp, Artificial Sequence
  chemically synthesized
ctgaatgtgctctaggcagc

SEQ ID NO: 493525 - DNA, 20 bp, Artificial Sequence
  chemically synthesized
agagcacattcagagaacaa

SEQ ID NO: 493526 - DNA, 20 bp, Artificial Sequence
  chemically synthesized
tgcactcattcacttgttct

SEQ ID NO: 493527 - DNA, 20 bp, Artificial Sequence
  chemically synthesized
cacattcagagaacaagtga

SEQ ID NO: 493528 - DNA, 20 bp, Artificial Sequence
  chemically synthesized
tcacttacatcatgcttcct

SEQ ID NO: 493529 - DNA, 20 bp, Artificial Sequence
  chemically synthesized
tgagaatatcacttgcaatt

SEQ ID NO: 493530 - DNA, 20 bp, Artificial Sequence
  chemically synthesized
acttgtcgattgatgggcat

SEQ ID NO: 493531 - DNA, 20 bp, Artificial Sequence
  chemically synthesized
gtgtgtctatatatatatat

SEQ ID NO: 493532 - DNA, 20 bp, Artificial Sequence
  chemically synthesized
taattcattcctttttatgg

SEQ ID NO: 493533 - DNA, 20 bp, Artificial Sequence
  chemically synthesized
aatactactcagccataaaa

SEQ ID NO: 493534 - DNA, 20 bp, Artificial Sequence
  chemically synthesized
ctactcagccataaaaagga

SEQ ID NO: 493535 - DNA, 20 bp, Artificial Sequence
  chemically synthesized
ttaacagcatttgcaatgac

SEQ ID NO: 493536 - DNA, 20 bp, Artificial Sequence
  chemically synthesized
cattgtaagtgaagtaactc

SEQ ID NO: 493537 - DNA, 20 bp, Artificial Sequence
  chemically synthesized
tgctgtttggttttccattc

SEQ ID NO: 493538 - DNA, 20 bp, Artificial Sequence
  chemically synthesized
atacgtgggagctaagctat

SEQ ID NO: 493539 - DNA, 20 bp, Artificial Sequence
  chemically synthesized
ctatgaggatgcaaaggcat

SEQ ID NO: 493540 - DNA, 20 bp, Artificial Sequence
  chemically synthesized
caatgggctttggagacttg

SEQ ID NO: 493541 - DNA, 20 bp, Artificial Sequence
  chemically synthesized
ggagacttggggggtagaaa

SEQ ID NO: 493542 - DNA, 20 bp, Artificial Sequence
  chemically synthesized
cagtgtatactactcgtgtg

SEQ ID NO: 493543 - DNA, 20 bp, Artificial Sequence
  chemically synthesized
gatcctggtgcacccatcac

SEQ ID NO: 493544 - DNA, 20 bp, Artificial Sequence
  chemically synthesized
tactcgtgtgatgggtgcac

SEQ ID NO: 493545 - DNA, 20 bp, Artificial Sequence
  chemically synthesized
attctcagcaaactattgca

SEQ ID NO: 493546 - DNA, 20 bp, Artificial Sequence
  chemically synthesized
actcattgcaatagtttgct

SEQ ID NO: 493547 - DNA, 20 bp, Artificial Sequence
  chemically synthesized
ttcacgtcctttgtagggac

SEQ ID NO: 493548 - DNA, 20 bp, Artificial Sequence
  chemically synthesized
ctgtgcagccataaaaaagg

SEQ ID NO: 493549 - DNA, 20 bp, Artificial Sequence
  chemically synthesized
aatactgtgcagccataaaa

SEQ ID NO: 493550 - DNA, 20 bp, Artificial Sequence
  chemically synthesized
aatgtggcacatatacacca

SEQ ID NO: 493551 - DNA, 20 bp, Artificial Sequence
  chemically synthesized
aaatgtccgacaatgataga

SEQ ID NO: 493552 - DNA, 20 bp, Artificial Sequence
  chemically synthesized
agtctatcattgtcggacat

SEQ ID NO: 493553 - DNA, 20 bp, Artificial Sequence
  chemically synthesized
ggttccaagtctttgctatt

SEQ ID NO: 493554 - DNA, 20 bp, Artificial Sequence
  chemically synthesized
gcagcatgatttataatcct

SEQ ID NO: 493555 - DNA, 20 bp, Artificial Sequence
  chemically synthesized
cattactgggtatataccca

SEQ ID NO: 493556 - DNA, 20 bp, Artificial Sequence
  chemically synthesized
tttgggtatatacccagtaa

SEQ ID NO: 493557 - DNA, 20 bp, Artificial Sequence
  chemically synthesized
ttgacccagccatcccatta

SEQ ID NO: 493558 - DNA, 20 bp, Artificial Sequence
  chemically synthesized
tatacccagtaatgggatgg

SEQ ID NO: 493559 - DNA, 20 bp, Artificial Sequence
  chemically synthesized
attcctcaggcatctagaac

SEQ ID NO: 493560 - DNA, 20 bp, Artificial Sequence
  chemically synthesized
attctagttctagatgcctg

SEQ ID NO: 493561 - DNA, 20 bp, Artificial Sequence
  chemically synthesized
aggaaacaacaggtgctggt

SEQ ID NO: 493562 - DNA, 20 bp, Artificial Sequence
  chemically synthesized
aggtaccatctcacgccagt

SEQ ID NO: 493563 - DNA, 20 bp, Artificial Sequence
  chemically synthesized
gcatgttctcgctcataggt

SEQ ID NO: 493564 - DNA, 20 bp, Artificial Sequence
  chemically synthesized
tcacacaccggggcctgttg

SEQ ID NO: 493565 - DNA, 20 bp, Artificial Sequence
  chemically synthesized
gtggggtggggggagggggg

SEQ ID NO: 493566 - DNA, 20 bp, Artificial Sequence
  chemically synthesized
gatatacctaatgctaaatg

SEQ ID NO: 493567 - DNA, 20 bp, Artificial Sequence
  chemically synthesized
taatgctaaatgacgagtta

SEQ ID NO: 493568 - DNA, 20 bp, Artificial Sequence
  chemically synthesized
ttttattctactttaagttt

SEQ ID NO: 493569 - DNA, 20 bp, Artificial Sequence
  chemically synthesized
atgtaccctaaaacttaaag

SEQ ID NO: 493570 - DNA, 20 bp, Artificial Sequence
  chemically synthesized
tacaggtggtatttggttac

SEQ ID NO: 493571 - DNA, 20 bp, Artificial Sequence
  chemically synthesized
tttatttttctgtaaattat

SEQ ID NO: 493572 - DNA, 20 bp, Artificial Sequence
  chemically synthesized
taataaaaactaaaataaaa

SEQ ID NO: 493573 - DNA, 20 bp, Artificial Sequence
  chemically synthesized
aaaaaagaatatcatttgct

SEQ ID NO: 493574 - DNA, 20 bp, Artificial Sequence
  chemically synthesized
aatatatttgctttctcatc

SEQ ID NO: 493575 - DNA, 20 bp, Artificial Sequence
  chemically synthesized
catatcattgaagagaaaat

SEQ ID NO: 493576 - DNA, 20 bp, Artificial Sequence
  chemically synthesized
caacgtgttagtaattgctc

SEQ ID NO: 493577 - DNA, 20 bp, Artificial Sequence
  chemically synthesized
ataattctgataaatgccaa

SEQ ID NO: 493578 - DNA, 20 bp, Artificial Sequence
  chemically synthesized
tctattctgttggcatttat

SEQ ID NO: 493579 - DNA, 20 bp, Artificial Sequence
  chemically synthesized
taaatttcaaagcacagtct

SEQ ID NO: 493580 - DNA, 20 bp, Artificial Sequence
  chemically synthesized
ttacaataagatttatctca

SEQ ID NO: 493581 - DNA, 20 bp, Artificial Sequence
  chemically synthesized
tgagataaatcttattgtaa

SEQ ID NO: 493582 - DNA, 20 bp, Artificial Sequence
  chemically synthesized
gcacccaaccgctcaagata

SEQ ID NO: 493583 - DNA, 20 bp, Artificial Sequence
  chemically synthesized
gaactctgtatcttgagcgg

SEQ ID NO: 493584 - DNA, 20 bp, Artificial Sequence
  chemically synthesized
aagaatgtcattggagagca

SEQ ID NO: 493585 - DNA, 20 bp, Artificial Sequence
  chemically synthesized
aagaaatgacttcaaatgat

SEQ ID NO: 493586 - DNA, 20 bp, Artificial Sequence
  chemically synthesized
cactatatagtttcctccta

SEQ ID NO: 493587 - DNA, 20 bp, Artificial Sequence
  chemically synthesized
cacaatgactgtgggcccct

SEQ ID NO: 493588 - DNA, 20 bp, Artificial Sequence
  chemically synthesized
attgtgttctttcttgacta

SEQ ID NO: 493589 - DNA, 20 bp, Artificial Sequence
  chemically synthesized
tttcttgactaacgaattcc

SEQ ID NO: 493590 - DNA, 20 bp, Artificial Sequence
  chemically synthesized
tgtacttgaaactgcactca

SEQ ID NO: 493591 - DNA, 20 bp, Artificial Sequence
  chemically synthesized
tgaaacactgacagggaaaa

SEQ ID NO: 493592 - DNA, 20 bp, Artificial Sequence
  chemically synthesized
cacatcccagattattttac

SEQ ID NO: 493593 - DNA, 20 bp, Artificial Sequence
  chemically synthesized
ttaattcctgtaaaataatc

SEQ ID NO: 493594 - DNA, 20 bp, Artificial Sequence
  chemically synthesized
ggtttctattaaggaattac

SEQ ID NO: 493595 - DNA, 20 bp, Artificial Sequence
  chemically synthesized
tttctcttaggtttctatta

SEQ ID NO: 493596 - DNA, 20 bp, Artificial Sequence
  chemically synthesized
ataggaaaggatgctgtacc

SEQ ID NO: 493597 - DNA, 20 bp, Artificial Sequence
  chemically synthesized
aaggaaatgagaaaatagga

SEQ ID NO: 493598 - DNA, 20 bp, Artificial Sequence
  chemically synthesized
caggctatgtctgtcctttg

SEQ ID NO: 493599 - DNA, 20 bp, Artificial Sequence
  chemically synthesized
tggttgataatgggctaatt

SEQ ID NO: 493600 - DNA, 20 bp, Artificial Sequence
  chemically synthesized
atcaaccaacaaataaagga

SEQ ID NO: 493601 - DNA, 20 bp, Artificial Sequence
  chemically synthesized
taagtacgtttttgcaacat

SEQ ID NO: 493602 - DNA, 20 bp, Artificial Sequence
  chemically synthesized
cttagcctttaagaaagaca

SEQ ID NO: 493603 - DNA, 20 bp, Artificial Sequence
  chemically synthesized
gcctttaagaaagacatggg

SEQ ID NO: 493604 - DNA, 20 bp, Artificial Sequence
  chemically synthesized
aagaaagacatgggatgaat

SEQ ID NO: 493605 - DNA, 20 bp, Artificial Sequence
  chemically synthesized
gagtactggataaaggagct

SEQ ID NO: 493606 - DNA, 20 bp, Artificial Sequence
  chemically synthesized
accttgcagagtcaggagta

SEQ ID NO: 493607 - DNA, 20 bp, Artificial Sequence
  chemically synthesized
acaatctaccttgcagagtc

SEQ ID NO: 493608 - DNA, 20 bp, Artificial Sequence
  chemically synthesized
ggaggaaacaatctaccttg

SEQ ID NO: 493609 - DNA, 20 bp, Artificial Sequence
  chemically synthesized
atgacgccctagtgaactga

SEQ ID NO: 493610 - DNA, 20 bp, Artificial Sequence
  chemically synthesized
tatatgtgagcaataaatca

SEQ ID NO: 493611 - DNA, 20 bp, Artificial Sequence
  chemically synthesized
agatgccttgagaaattctc

SEQ ID NO: 493612 - DNA, 20 bp, Artificial Sequence
  chemically synthesized
aaggcaagagaataatcctg

SEQ ID NO: 493613 - DNA, 20 bp, Artificial Sequence
  chemically synthesized
tctaatttaccagaaggcaa

SEQ ID NO: 493614 - DNA, 20 bp, Artificial Sequence
  chemically synthesized
aacatactacattcaataac

SEQ ID NO: 493615 - DNA, 20 bp, Artificial Sequence
  chemically synthesized
aaatatgtatactcttgtta

SEQ ID NO: 493616 - DNA, 20 bp, Artificial Sequence
  chemically synthesized
taggaaaacatttaaaaaga

SEQ ID NO: 493617 - DNA, 20 bp, Artificial Sequence
  chemically synthesized
tttcaaactgtcaaaaatcc

SEQ ID NO: 493618 - DNA, 20 bp, Artificial Sequence
  chemically synthesized
ttgaattttacttgcaatcc

SEQ ID NO: 493619 - DNA, 20 bp, Artificial Sequence
  chemically synthesized
tcattttgcaagtgggatag

SEQ ID NO: 493620 - DNA, 20 bp, Artificial Sequence
  chemically synthesized
taacccattcattttgcaag

SEQ ID NO: 493621 - DNA, 20 bp, Artificial Sequence
  chemically synthesized
tcaactatcccacttgcaaa

SEQ ID NO: 493622 - DNA, 20 bp, Artificial Sequence
  chemically synthesized
ctatcccacttgcaaaatga

SEQ ID NO: 493623 - DNA, 20 bp, Artificial Sequence
  chemically synthesized
aaattattctttgaaaactt

SEQ ID NO: 493624 - DNA, 20 bp, Artificial Sequence
  chemically synthesized
tttagactcataagttttca

SEQ ID NO: 493625 - DNA, 20 bp, Artificial Sequence
  chemically synthesized
tttggtgacttaatagataa

SEQ ID NO: 493626 - DNA, 20 bp, Artificial Sequence
  chemically synthesized
tgacttaatagataagagaa

SEQ ID NO: 493627 - DNA, 20 bp, Artificial Sequence
  chemically synthesized
aataatgaactactgtcatt

SEQ ID NO: 493628 - DNA, 20 bp, Artificial Sequence
  chemically synthesized
atgtaaaaatatgtttaaat

SEQ ID NO: 493629 - DNA, 20 bp, Artificial Sequence
  chemically synthesized
tatgccaatctatggttgaa

SEQ ID NO: 493630 - DNA, 20 bp, Artificial Sequence
  chemically synthesized
tctttgtctatctattttta

SEQ ID NO: 493631 - DNA, 20 bp, Artificial Sequence
  chemically synthesized
aaagtatttacctactacat

SEQ ID NO: 493632 - DNA, 20 bp, Artificial Sequence
  chemically synthesized
aatacttttccctcaaataa

SEQ ID NO: 493633 - DNA, 20 bp, Artificial Sequence
  chemically synthesized
tttataaaatgaaaaagttt

SEQ ID NO: 493634 - DNA, 20 bp, Artificial Sequence
  chemically synthesized
cggggaaatttaaaaggatg

SEQ ID NO: 493635 - DNA, 20 bp, Artificial Sequence
  chemically synthesized
tagggttcggggaaatttaa

SEQ ID NO: 493636 - DNA, 20 bp, Artificial Sequence
  chemically synthesized
tgtatattgttcccatgcac

SEQ ID NO: 493637 - DNA, 20 bp, Artificial Sequence
  chemically synthesized
aacaatatacagtattttct

SEQ ID NO: 493638 - DNA, 20 bp, Artificial Sequence
  chemically synthesized
tattttctcagaataaaaat

SEQ ID NO: 493639 - DNA, 20 bp, Artificial Sequence
  chemically synthesized
cggcgtttactatgcaaggg

SEQ ID NO: 493640 - DNA, 20 bp, Artificial Sequence
  chemically synthesized
tagtggactgtttggaaaaa

SEQ ID NO: 493641 - DNA, 20 bp, Artificial Sequence
  chemically synthesized
tacgcacacaggcagcaaat

SEQ ID NO: 493642 - DNA, 20 bp, Artificial Sequence
  chemically synthesized
gtgcgtatggcacacaagct

SEQ ID NO: 493643 - DNA, 20 bp, Artificial Sequence
  chemically synthesized
tatggcacacaagctaagaa

SEQ ID NO: 493644 - DNA, 20 bp, Artificial Sequence
  chemically synthesized
aatggttggggagaaatcaa

SEQ ID NO: 493645 - DNA, 20 bp, Artificial Sequence
  chemically synthesized
aactttacgcacagagaaat

SEQ ID NO: 493646 - DNA, 20 bp, Artificial Sequence
  chemically synthesized
tgaaagcagacaatacatac

SEQ ID NO: 493647 - DNA, 20 bp, Artificial Sequence
  chemically synthesized
ttcatactacaacagcgtag

SEQ ID NO: 493648 - DNA, 20 bp, Artificial Sequence
  chemically synthesized
tacgtgctttctcctaaagc

SEQ ID NO: 493649 - DNA, 20 bp, Artificial Sequence
  chemically synthesized
ctgagctcttagggtccatc

SEQ ID NO: 493650 - DNA, 20 bp, Artificial Sequence
  chemically synthesized
cacttccgtaactgagctct

SEQ ID NO: 493651 - DNA, 20 bp, Artificial Sequence
  chemically synthesized
aaccgaagaggaaaagagag

SEQ ID NO: 493652 - DNA, 20 bp, Artificial Sequence
  chemically synthesized
ctgtgacttcaggagagcat

SEQ ID NO: 493653 - DNA, 20 bp, Artificial Sequence
  chemically synthesized
cttctgctttaagaggacat

SEQ ID NO: 493654 - DNA, 20 bp, Artificial Sequence
  chemically synthesized
tcatattagagctttatctg

SEQ ID NO: 493655 - DNA, 20 bp, Artificial Sequence
  chemically synthesized
atttccttcaagctcaaagc

SEQ ID NO: 493656 - DNA, 20 bp, Artificial Sequence
  chemically synthesized
tctgtttttaggatggcaga

SEQ ID NO: 493657 - DNA, 20 bp, Artificial Sequence
  chemically synthesized
ggtccccctccttctgtttt

SEQ ID NO: 493658 - DNA, 20 bp, Artificial Sequence
  chemically synthesized
aaaaataatttatccatatg

SEQ ID NO: 493659 - DNA, 20 bp, Artificial Sequence
  chemically synthesized
aactgaaaaaaatcctacat

SEQ ID NO: 493660 - DNA, 20 bp, Artificial Sequence
  chemically synthesized
ggagaaagcacccaagccta

SEQ ID NO: 493661 - DNA, 20 bp, Artificial Sequence
  chemically synthesized
taggcacgcactctgtaggc

SEQ ID NO: 493662 - DNA, 20 bp, Artificial Sequence
  chemically synthesized
tcacaagaaagaccttgttg

SEQ ID NO: 493663 - DNA, 20 bp, Artificial Sequence
  chemically synthesized
aaaattatgggtacagaatt

SEQ ID NO: 493664 - DNA, 20 bp, Artificial Sequence
  chemically synthesized
ggataggaaaattatgggta

SEQ ID NO: 493665 - DNA, 20 bp, Artificial Sequence
  chemically synthesized
cctcaagggataggaaaatt

SEQ ID NO: 493666 - DNA, 20 bp, Artificial Sequence
  chemically synthesized
gaaaactttaccaggcctca

SEQ ID NO: 493667 - DNA, 20 bp, Artificial Sequence
  chemically synthesized
taaagttttcatggaaaaaa

SEQ ID NO: 493668 - DNA, 20 bp, Artificial Sequence
  chemically synthesized
aataattaagagattaaatg

SEQ ID NO: 493669 - DNA, 20 bp, Artificial Sequence
  chemically synthesized
ctggaaagatgttattgcct

SEQ ID NO: 493670 - DNA, 20 bp, Artificial Sequence
  chemically synthesized
aaaaaaaaaaaagtttattt

SEQ ID NO: 493671 - DNA, 20 bp, Artificial Sequence
  chemically synthesized
aatctcagcactttgggagg

SEQ ID NO: 493672 - DNA, 20 bp, Artificial Sequence
  chemically synthesized
agggcagactgcttgagacc

SEQ ID NO: 493673 - DNA, 20 bp, Artificial Sequence
  chemically synthesized
ttttgtatctttagtggaga

SEQ ID NO: 493674 - DNA, 20 bp, Artificial Sequence
  chemically synthesized
tgcctctgtcttccagtagc

SEQ ID NO: 493675 - DNA, 20 bp, Artificial Sequence
  chemically synthesized
ctactggaagacagaggcag

SEQ ID NO: 493676 - DNA, 20 bp, Artificial Sequence
  chemically synthesized
ccattgcactgcactccagc

SEQ ID NO: 493677 - DNA, 20 bp, Artificial Sequence
  chemically synthesized
tctcgttctgtcacccaggc

SEQ ID NO: 493678 - DNA, 20 bp, Artificial Sequence
  chemically synthesized
ttttttttttttttttgaga

SEQ ID NO: 493679 - DNA, 20 bp, Artificial Sequence
  chemically synthesized
gctgctaatgggagacacaa

SEQ ID NO: 493680 - DNA, 20 bp, Artificial Sequence
  chemically synthesized
tgcaaagtcatgaccctcca

SEQ ID NO: 493681 - DNA, 20 bp, Artificial Sequence
  chemically synthesized
gctgaggttataatcctctg

SEQ ID NO: 493682 - DNA, 20 bp, Artificial Sequence
  chemically synthesized
tcttttttttttttttgaga

SEQ ID NO: 493683 - DNA, 20 bp, Artificial Sequence
  chemically synthesized
tctcgctctgtcacccaggc

SEQ ID NO: 493684 - DNA, 20 bp, Artificial Sequence
  chemically synthesized
ctctgtcacccaggctggag

SEQ ID NO: 493685 - DNA, 20 bp, Artificial Sequence
  chemically synthesized
tcacgacactccactccagc

SEQ ID NO: 493686 - DNA, 20 bp, Artificial Sequence
  chemically synthesized
ctcactgcaagctccacctc

SEQ ID NO: 493687 - DNA, 20 bp, Artificial Sequence
  chemically synthesized
cattttcctgcctcagcctc

SEQ ID NO: 493688 - DNA, 20 bp, Artificial Sequence
  chemically synthesized
ttttatatttttagtagaga

SEQ ID NO: 493689 - DNA, 20 bp, Artificial Sequence
  chemically synthesized
tggggtttcaccgtgttagc

SEQ ID NO: 493690 - DNA, 20 bp, Artificial Sequence
  chemically synthesized
actttgggagcctgaggcgg

SEQ ID NO: 493691 - DNA, 20 bp, Artificial Sequence
  chemically synthesized
gcctcaggctcccaaagtgc

SEQ ID NO: 493692 - DNA, 20 bp, Artificial Sequence
  chemically synthesized
aagaaatcttatgggccggg

SEQ ID NO: 493693 - DNA, 20 bp, Artificial Sequence
  chemically synthesized
ataatgtaataatgtcttcc

SEQ ID NO: 493694 - DNA, 20 bp, Artificial Sequence
  chemically synthesized
attacattatagaggcatga

SEQ ID NO: 493695 - DNA, 20 bp, Artificial Sequence
  chemically synthesized
ctcccatggtttatgaatct

SEQ ID NO: 493696 - DNA, 20 bp, Artificial Sequence
  chemically synthesized
ctaggcccctcccatggttt

SEQ ID NO: 493697 - DNA, 20 bp, Artificial Sequence
  chemically synthesized
ataaaccatgggaggggcct

SEQ ID NO: 493698 - DNA, 20 bp, Artificial Sequence
  chemically synthesized
tccctaggagattctgatgg

SEQ ID NO: 493699 - DNA, 20 bp, Artificial Sequence
  chemically synthesized
agtttgcagaacccctccat

SEQ ID NO: 493700 - DNA, 20 bp, Artificial Sequence
  chemically synthesized
tagatattctatatcagtct

SEQ ID NO: 493701 - DNA, 20 bp, Artificial Sequence
  chemically synthesized
actgcactctaagactgata

SEQ ID NO: 493702 - DNA, 20 bp, Artificial Sequence
  chemically synthesized
atagaatatctaccaagaaa

SEQ ID NO: 493703 - DNA, 20 bp, Artificial Sequence
  chemically synthesized
gcaagtctaagcttgtggca

SEQ ID NO: 493704 - DNA, 20 bp, Artificial Sequence
  chemically synthesized
gtaattttcagtgtaaggca

SEQ ID NO: 493705 - DNA, 20 bp, Artificial Sequence
  chemically synthesized
agtttttgaattttatgcaa

SEQ ID NO: 493706 - DNA, 20 bp, Artificial Sequence
  chemically synthesized
tagattaattttgccagttt

SEQ ID NO: 493707 - DNA, 20 bp, Artificial Sequence
  chemically synthesized
tcacgataatgcttatccat

SEQ ID NO: 493708 - DNA, 20 bp, Artificial Sequence
  chemically synthesized
agtctctccgtgctaccccc

SEQ ID NO: 493709 - DNA, 20 bp, Artificial Sequence
  chemically synthesized
ttaatctaagtgctggttaa

SEQ ID NO: 493710 - DNA, 20 bp, Artificial Sequence
  chemically synthesized
taatataaaggtgcagctag

SEQ ID NO: 493711 - DNA, 20 bp, Artificial Sequence
  chemically synthesized
aagaagttataaaaattagg

SEQ ID NO: 493712 - DNA, 20 bp, Artificial Sequence
  chemically synthesized
gattaataagataacaatta

SEQ ID NO: 493713 - DNA, 20 bp, Artificial Sequence
  chemically synthesized
tcacatttatataactttca

SEQ ID NO: 493714 - DNA, 20 bp, Artificial Sequence
  chemically synthesized
gttatataaatgtgataaaa

SEQ ID NO: 493715 - DNA, 20 bp, Artificial Sequence
  chemically synthesized
gtgataaaatagaatataag

SEQ ID NO: 493716 - DNA, 20 bp, Artificial Sequence
  chemically synthesized
taagaagttattttccccat

SEQ ID NO: 493717 - DNA, 20 bp, Artificial Sequence
  chemically synthesized
aataagaaatttcaatctga

SEQ ID NO: 493718 - DNA, 20 bp, Artificial Sequence
  chemically synthesized
agactcaaggatggtaactt

SEQ ID NO: 493719 - DNA, 20 bp, Artificial Sequence
  chemically synthesized
ttattctaaagttaccatcc

SEQ ID NO: 493720 - DNA, 20 bp, Artificial Sequence
  chemically synthesized
tgaggataaataatagactc

SEQ ID NO: 493721 - DNA, 20 bp, Artificial Sequence
  chemically synthesized
gcacagcaagctgagacagt

SEQ ID NO: 493722 - DNA, 20 bp, Artificial Sequence
  chemically synthesized
ggaaggtccagaggagtagg

SEQ ID NO: 493723 - DNA, 20 bp, Artificial Sequence
  chemically synthesized
gatggatatggaaggtccag

SEQ ID NO: 493724 - DNA, 20 bp, Artificial Sequence
  chemically synthesized
agagcaatttgaacagaatg

SEQ ID NO: 493725 - DNA, 20 bp, Artificial Sequence
  chemically synthesized
ctggacaagagcaatttgaa

SEQ ID NO: 493726 - DNA, 20 bp, Artificial Sequence
  chemically synthesized
aatgaaaagataagtgacta

SEQ ID NO: 493727 - DNA, 20 bp, Artificial Sequence
  chemically synthesized
caaaaagagtgttgaaggga

SEQ ID NO: 493728 - DNA, 20 bp, Artificial Sequence
  chemically synthesized
ggcaatatgaaagatacaaa

SEQ ID NO: 493729 - DNA, 20 bp, Artificial Sequence
  chemically synthesized
agaattaggaggggaatcaa

SEQ ID NO: 493730 - DNA, 20 bp, Artificial Sequence
  chemically synthesized
agaataccaagaattaggag

SEQ ID NO: 493731 - DNA, 20 bp, Artificial Sequence
  chemically synthesized
gacatccaatatagaatacc

SEQ ID NO: 493732 - DNA, 20 bp, Artificial Sequence
  chemically synthesized
ctaattcttggtattctata

SEQ ID NO: 493733 - DNA, 20 bp, Artificial Sequence
  chemically synthesized
cagaagagggacatccaata

SEQ ID NO: 493734 - DNA, 20 bp, Artificial Sequence
  chemically synthesized
tctgttccacttctaaacat

SEQ ID NO: 493735 - DNA, 20 bp, Artificial Sequence
  chemically synthesized
agggctggcagatgcacatt

SEQ ID NO: 493736 - DNA, 20 bp, Artificial Sequence
  chemically synthesized
ctaggaaactgaatataaat

SEQ ID NO: 493737 - DNA, 20 bp, Artificial Sequence
  chemically synthesized
cacatttatattcagtttcc

SEQ ID NO: 493738 - DNA, 20 bp, Artificial Sequence
  chemically synthesized
ttattagagaccctaggaaa

SEQ ID NO: 493739 - DNA, 20 bp, Artificial Sequence
  chemically synthesized
ttatttggacatgctagttt

SEQ ID NO: 493740 - DNA, 20 bp, Artificial Sequence
  chemically synthesized
agatttgttcaaaaagtatc

SEQ ID NO: 493741 - DNA, 20 bp, Artificial Sequence
  chemically synthesized
tattaccatttattgagatg

SEQ ID NO: 493742 - DNA, 20 bp, Artificial Sequence
  chemically synthesized
ttaacttgaataattatgat

SEQ ID NO: 493743 - DNA, 20 bp, Artificial Sequence
  chemically synthesized
ttaactctttaatgtttaac

SEQ ID NO: 493744 - DNA, 20 bp, Artificial Sequence
  chemically synthesized
attattcaagttaaacatta

SEQ ID NO: 493745 - DNA, 20 bp, Artificial Sequence
  chemically synthesized
ataaaaagaccagtcattaa

SEQ ID NO: 493746 - DNA, 20 bp, Artificial Sequence
  chemically synthesized
cggaatgtagggggtgaaag

SEQ ID NO: 493747 - DNA, 20 bp, Artificial Sequence
  chemically synthesized
cttatcgaaaacggaatgta

SEQ ID NO: 493748 - DNA, 20 bp, Artificial Sequence
  chemically synthesized
tttgactggcttatcgaaaa

SEQ ID NO: 493749 - DNA, 20 bp, Artificial Sequence
  chemically synthesized
attatggtggcaagtgattg

SEQ ID NO: 493750 - DNA, 20 bp, Artificial Sequence
  chemically synthesized
ggctaagacattgaggatga

SEQ ID NO: 493751 - DNA, 20 bp, Artificial Sequence
  chemically synthesized
atatggctaagacattgagg

SEQ ID NO: 493752 - DNA, 20 bp, Artificial Sequence
  chemically synthesized
gccaatatggctaagacatt

SEQ ID NO: 493753 - DNA, 20 bp, Artificial Sequence
  chemically synthesized
cttattgttgttgttgcccc

SEQ ID NO: 493754 - DNA, 20 bp, Artificial Sequence
  chemically synthesized
gcattagtggtactcctgcc

SEQ ID NO: 493755 - DNA, 20 bp, Artificial Sequence
  chemically synthesized
aaaggaacagtattctaggc

SEQ ID NO: 493756 - DNA, 20 bp, Artificial Sequence
  chemically synthesized
tatgtcaaagtgccatattt

SEQ ID NO: 493757 - DNA, 20 bp, Artificial Sequence
  chemically synthesized
acttttagttagaggcaagt

SEQ ID NO: 493758 - DNA, 20 bp, Artificial Sequence
  chemically synthesized
gggaaattgttatggccatg

SEQ ID NO: 493759 - DNA, 20 bp, Artificial Sequence
  chemically synthesized
gtaaatatatgggagaaaca

SEQ ID NO: 493760 - DNA, 20 bp, Artificial Sequence
  chemically synthesized
aaaaaaggggtttaggtatt

SEQ ID NO: 493761 - DNA, 20 bp, Artificial Sequence
  chemically synthesized
aatgacaaaacaaagaaaaa

SEQ ID NO: 493762 - DNA, 20 bp, Artificial Sequence
  chemically synthesized
tcaaaggggtggttagaatg

SEQ ID NO: 493763 - DNA, 20 bp, Artificial Sequence
  chemically synthesized
gagtaactcaaaggggtggt

SEQ ID NO: 493764 - DNA, 20 bp, Artificial Sequence
  chemically synthesized
ccaacattctaaccacccct

SEQ ID NO: 493765 - DNA, 20 bp, Artificial Sequence
  chemically synthesized
ctcagtgatgagtaactcaa

SEQ ID NO: 493766 - DNA, 20 bp, Artificial Sequence
  chemically synthesized
cccctttgagttactcatca

SEQ ID NO: 493767 - DNA, 20 bp, Artificial Sequence
  chemically synthesized
cacctggtagaaactcagtg

SEQ ID NO: 493768 - DNA, 20 bp, Artificial Sequence
  chemically synthesized
ttctaccaggtgtatgtgca

SEQ ID NO: 493769 - DNA, 20 bp, Artificial Sequence
  chemically synthesized
cagctggagtcctacaaagt

SEQ ID NO: 493770 - DNA, 20 bp, Artificial Sequence
  chemically synthesized
acccttctaggctgcccagc

SEQ ID NO: 493771 - DNA, 20 bp, Artificial Sequence
  chemically synthesized
actccagctgggcagcctag

SEQ ID NO: 493772 - DNA, 20 bp, Artificial Sequence
  chemically synthesized
catgttatttaaacagagat

SEQ ID NO: 493773 - DNA, 20 bp, Artificial Sequence
  chemically synthesized
aatgtccttgcttgggcctg

SEQ ID NO: 493774 - DNA, 20 bp, Artificial Sequence
  chemically synthesized
gcctcagcctcccaaagtgc

SEQ ID NO: 493775 - DNA, 20 bp, Artificial Sequence
  chemically synthesized
cagcactttgggaggctgag

SEQ ID NO: 493776 - DNA, 20 bp, Artificial Sequence
  chemically synthesized
actttgggaggctgaggcgg

SEQ ID NO: 493777 - DNA, 20 bp, Artificial Sequence
  chemically synthesized
ttttgtatttttagtagaga

SEQ ID NO: 493778 - DNA, 20 bp, Artificial Sequence
  chemically synthesized
ttctttttctttctgccttt

SEQ ID NO: 493779 - DNA, 20 bp, Artificial Sequence
  chemically synthesized
acaggatgaccactttggtt

SEQ ID NO: 493780 - DNA, 20 bp, Artificial Sequence
  chemically synthesized
ggtaaaattacagattgtga

SEQ ID NO: 493781 - DNA, 20 bp, Artificial Sequence
  chemically synthesized
tacataaagagactttaaaa

SEQ ID NO: 493782 - DNA, 20 bp, Artificial Sequence
  chemically synthesized
ttgttttctgtctcctgtga

SEQ ID NO: 493783 - DNA, 20 bp, Artificial Sequence
  chemically synthesized
aagatatgatttgtatcgac

SEQ ID NO: 493784 - DNA, 20 bp, Artificial Sequence
  chemically synthesized
acgtgcaattttgggcgcac

SEQ ID NO: 493785 - DNA, 20 bp, Artificial Sequence
  chemically synthesized
aggtgtttgataaacttttg

SEQ ID NO: 493786 - DNA, 20 bp, Artificial Sequence
  chemically synthesized
tgataaacttttgttgaatt

SEQ ID NO: 493787 - DNA, 20 bp, Artificial Sequence
  chemically synthesized
ttgtcaaagggtttaacatt

SEQ ID NO: 493788 - DNA, 20 bp, Artificial Sequence
  chemically synthesized
tcatgtcaggtcacttgtca

SEQ ID NO: 493789 - DNA, 20 bp, Artificial Sequence
  chemically synthesized
ttgacaagtgacctgacatg

SEQ ID NO: 493790 - DNA, 20 bp, Artificial Sequence
  chemically synthesized
acatgatgaataaaaactta

SEQ ID NO: 493791 - DNA, 20 bp, Artificial Sequence
  chemically synthesized
aataaaaacttatagggttt

SEQ ID NO: 493792 - DNA, 20 bp, Artificial Sequence
  chemically synthesized
aggattaaaaaatttccata

SEQ ID NO: 493793 - DNA, 20 bp, Artificial Sequence
  chemically synthesized
attggcaagtcctagccatt

SEQ ID NO: 493794 - DNA, 20 bp, Artificial Sequence
  chemically synthesized
acaatggctaggacttgcca

SEQ ID NO: 493795 - DNA, 20 bp, Artificial Sequence
  chemically synthesized
ttaaaatctcataatataag

SEQ ID NO: 493796 - DNA, 20 bp, Artificial Sequence
  chemically synthesized
attattaactggccactatt

SEQ ID NO: 493797 - DNA, 20 bp, Artificial Sequence
  chemically synthesized
gtaaaatgtttttcaaaact

SEQ ID NO: 493798 - DNA, 20 bp, Artificial Sequence
  chemically synthesized
tactcgtctccttgctttat

SEQ ID NO: 493799 - DNA, 20 bp, Artificial Sequence
  chemically synthesized
gattcaaataaagcaaggag

SEQ ID NO: 493800 - DNA, 20 bp, Artificial Sequence
  chemically synthesized
ctttgttacttatagccaca

SEQ ID NO: 493801 - DNA, 20 bp, Artificial Sequence
  chemically synthesized
ttaaaaacagctaattaaaa

SEQ ID NO: 493802 - DNA, 20 bp, Artificial Sequence
  chemically synthesized
aaacagctaattaaaaatgg

SEQ ID NO: 493803 - DNA, 20 bp, Artificial Sequence
  chemically synthesized
acttaaagagctgatttctt

SEQ ID NO: 493804 - DNA, 20 bp, Artificial Sequence
  chemically synthesized
aagctttttttccccagtat

SEQ ID NO: 493805 - DNA, 20 bp, Artificial Sequence
  chemically synthesized
taacctaaaatgttctggaa

SEQ ID NO: 493806 - DNA, 20 bp, Artificial Sequence
  chemically synthesized
acaatgttgtcataagaagg

SEQ ID NO: 493807 - DNA, 20 bp, Artificial Sequence
  chemically synthesized
gttctttattgaagggaaat

SEQ ID NO: 493808 - DNA, 20 bp, Artificial Sequence
  chemically synthesized
agccttcagctctcagtttt

SEQ ID NO: 493809 - DNA, 20 bp, Artificial Sequence
  chemically synthesized
actcctgcattaatcagtca

SEQ ID NO: 493810 - DNA, 20 bp, Artificial Sequence
  chemically synthesized
atccaatgactgattaatgc

SEQ ID NO: 493811 - DNA, 20 bp, Artificial Sequence
  chemically synthesized
ctgttctcaggactactctg

SEQ ID NO: 493812 - DNA, 20 bp, Artificial Sequence
  chemically synthesized
cagagcttcgaatgaccctt

SEQ ID NO: 493813 - DNA, 20 bp, Artificial Sequence
  chemically synthesized
atatgggaagcttcagagct

SEQ ID NO: 493814 - DNA, 20 bp, Artificial Sequence
  chemically synthesized
actttgtgtatgtggcctat

SEQ ID NO: 493815 - DNA, 20 bp, Artificial Sequence
  chemically synthesized
cacagagcatttgtcaagac

SEQ ID NO: 493816 - DNA, 20 bp, Artificial Sequence
  chemically synthesized
tgcctatcttcccatgttgg

SEQ ID NO: 493817 - DNA, 20 bp, Artificial Sequence
  chemically synthesized
cctaaagatacagaggtggg

SEQ ID NO: 493818 - DNA, 20 bp, Artificial Sequence
  chemically synthesized
acttccctaaagatacagag

SEQ ID NO: 493819 - DNA, 20 bp, Artificial Sequence
  chemically synthesized
ctccccttaaagtacagctg

SEQ ID NO: 493820 - DNA, 20 bp, Artificial Sequence
  chemically synthesized
cgaaattggcttctcaacaa

SEQ ID NO: 493821 - DNA, 20 bp, Artificial Sequence
  chemically synthesized
tttgatgcctataaaactgt

SEQ ID NO: 493822 - DNA, 20 bp, Artificial Sequence
  chemically synthesized
gttgactgtctcattaactg

SEQ ID NO: 493823 - DNA, 20 bp, Artificial Sequence
  chemically synthesized
ttcaagagagggcttagaag

SEQ ID NO: 493824 - DNA, 20 bp, Artificial Sequence
  chemically synthesized
tcctgcttctaagccctctc

SEQ ID NO: 493825 - DNA, 20 bp, Artificial Sequence
  chemically synthesized
aatatgcagaatacttatca

SEQ ID NO: 493826 - DNA, 20 bp, Artificial Sequence
  chemically synthesized
ctaaaataaagtttaatatg

SEQ ID NO: 493827 - DNA, 20 bp, Artificial Sequence
  chemically synthesized
ctgcatattaaactttattt

SEQ ID NO: 493828 - DNA, 20 bp, Artificial Sequence
  chemically synthesized
acttctgcctcccaaagtgc

SEQ ID NO: 493829 - DNA, 20 bp, Artificial Sequence
  chemically synthesized
cagcactttgggaggcagaa

SEQ ID NO: 493830 - DNA, 20 bp, Artificial Sequence
  chemically synthesized
actttgggaggcagaagtgg

SEQ ID NO: 493831 - DNA, 20 bp, Artificial Sequence
  chemically synthesized
agtgggtggatcacctgagg

SEQ ID NO: 493832 - DNA, 20 bp, Artificial Sequence
  chemically synthesized
ttttgtatttttagtagaga

SEQ ID NO: 493833 - DNA, 20 bp, Artificial Sequence
  chemically synthesized
gcctgtaatcccagatactt

SEQ ID NO: 493834 - DNA, 20 bp, Artificial Sequence
  chemically synthesized
gcctcaaactcccaagtatc

SEQ ID NO: 493835 - DNA, 20 bp, Artificial Sequence
  chemically synthesized
tacttgggagtttgaggcag

SEQ ID NO: 493836 - DNA, 20 bp, Artificial Sequence
  chemically synthesized
ctcactgtaatttccgcctt

SEQ ID NO: 493837 - DNA, 20 bp, Artificial Sequence
  chemically synthesized
tttgctctcgttgtccatgt

SEQ ID NO: 493838 - DNA, 20 bp, Artificial Sequence
  chemically synthesized
attattattattattttaga

SEQ ID NO: 493839 - DNA, 20 bp, Artificial Sequence
  chemically synthesized
aagtaaaaataaaaatgttt

SEQ ID NO: 493840 - DNA, 20 bp, Artificial Sequence
  chemically synthesized
tactaagtaggtgttacagg

SEQ ID NO: 493841 - DNA, 20 bp, Artificial Sequence
  chemically synthesized
tctctttttatttggctgtc

SEQ ID NO: 493842 - DNA, 20 bp, Artificial Sequence
  chemically synthesized
atcactctgggctcctcaga

SEQ ID NO: 493843 - DNA, 20 bp, Artificial Sequence
  chemically synthesized
attactctatctgaggagcc

SEQ ID NO: 493844 - DNA, 20 bp, Artificial Sequence
  chemically synthesized
ttccaaacctggctgcctgc

SEQ ID NO: 493845 - DNA, 20 bp, Artificial Sequence
  chemically synthesized
actttttagatgtaatggaa

SEQ ID NO: 493846 - DNA, 20 bp, Artificial Sequence
  chemically synthesized
ggcatactttttagatgtaa

SEQ ID NO: 493847 - DNA, 20 bp, Artificial Sequence
  chemically synthesized
tatgccttttgttttcgaga

SEQ ID NO: 493848 - DNA, 20 bp, Artificial Sequence
  chemically synthesized
ctgcactccagcctgggtga

SEQ ID NO: 493849 - DNA, 20 bp, Artificial Sequence
  chemically synthesized
tctcactctgtcacccaggc

SEQ ID NO: 493850 - DNA, 20 bp, Artificial Sequence
  chemically synthesized
tcctgccactgcactccagc

SEQ ID NO: 493851 - DNA, 20 bp, Artificial Sequence
  chemically synthesized
tactcaggaggctgagatgg

SEQ ID NO: 493852 - DNA, 20 bp, Artificial Sequence
  chemically synthesized
gattctcccatctcagcctc

SEQ ID NO: 493853 - DNA, 20 bp, Artificial Sequence
  chemically synthesized
gctagcagttcaagaccagc

SEQ ID NO: 493854 - DNA, 20 bp, Artificial Sequence
  chemically synthesized
acactggggggctgtggtgt

SEQ ID NO: 493855 - DNA, 20 bp, Artificial Sequence
  chemically synthesized
acaccacagccccccagtgt

SEQ ID NO: 493856 - DNA, 20 bp, Artificial Sequence
  chemically synthesized
gaaagggagcaataaaacaa

SEQ ID NO: 493857 - DNA, 20 bp, Artificial Sequence
  chemically synthesized
ctcaaaggctgttttttaca

SEQ ID NO: 493858 - DNA, 20 bp, Artificial Sequence
  chemically synthesized
taattgagactatttctcca

SEQ ID NO: 493859 - DNA, 20 bp, Artificial Sequence
  chemically synthesized
cttcaatttacataggactt

SEQ ID NO: 493860 - DNA, 20 bp, Artificial Sequence
  chemically synthesized
ctatgtaaattgaagaccta

SEQ ID NO: 493861 - DNA, 20 bp, Artificial Sequence
  chemically synthesized
gtaggggaggtatggttggg

SEQ ID NO: 493862 - DNA, 20 bp, Artificial Sequence
  chemically synthesized
cttgatggaagagaaaataa

SEQ ID NO: 493863 - DNA, 20 bp, Artificial Sequence
  chemically synthesized
aaaataaaggagttctccaa

SEQ ID NO: 493864 - DNA, 20 bp, Artificial Sequence
  chemically synthesized
ctccaaagggatttaggcgt

SEQ ID NO: 493865 - DNA, 20 bp, Artificial Sequence
  chemically synthesized
gtcaatattagatccaaagc

SEQ ID NO: 493866 - DNA, 20 bp, Artificial Sequence
  chemically synthesized
ggaacagaatgacccttgct

SEQ ID NO: 493867 - DNA, 20 bp, Artificial Sequence
  chemically synthesized
agcccttagaaacataggaa

SEQ ID NO: 493868 - DNA, 20 bp, Artificial Sequence
  chemically synthesized
ggtgcttaaaaattattaga

SEQ ID NO: 493869 - DNA, 20 bp, Artificial Sequence
  chemically synthesized
ttattgtcctagctaacacc

SEQ ID NO: 493870 - DNA, 20 bp, Artificial Sequence
  chemically synthesized
tgctttctgaccatttcatc

SEQ ID NO: 493871 - DNA, 20 bp, Artificial Sequence
  chemically synthesized
tgaaatgttatttaaaaagt

SEQ ID NO: 493872 - DNA, 20 bp, Artificial Sequence
  chemically synthesized
atgttcataaaataatagaa

SEQ ID NO: 493873 - DNA, 20 bp, Artificial Sequence
  chemically synthesized
agaagccttaggttaagttc

SEQ ID NO: 493874 - DNA, 20 bp, Artificial Sequence
  chemically synthesized
taacctaaggcttctattta

SEQ ID NO: 493875 - DNA, 20 bp, Artificial Sequence
  chemically synthesized
ttaatgagtctgatagccac

SEQ ID NO: 493876 - DNA, 20 bp, Artificial Sequence
  chemically synthesized
ttttttttctttttttgaga

SEQ ID NO: 493877 - DNA, 20 bp, Artificial Sequence
  chemically synthesized
tctggctctgtcgcccaggc

SEQ ID NO: 493878 - DNA, 20 bp, Artificial Sequence
  chemically synthesized
ctctgtcgcccaggctggag

SEQ ID NO: 493879 - DNA, 20 bp, Artificial Sequence
  chemically synthesized
cccaggctggagtggagtgg

SEQ ID NO: 493880 - DNA, 20 bp, Artificial Sequence
  chemically synthesized
gagtggcaggatctcggcta

SEQ ID NO: 493881 - DNA, 20 bp, Artificial Sequence
  chemically synthesized
tactcgggaggctgaggcag

SEQ ID NO: 493882 - DNA, 20 bp, Artificial Sequence
  chemically synthesized
gattctcctgcctcagcctc

SEQ ID NO: 493883 - DNA, 20 bp, Artificial Sequence
  chemically synthesized
tttttgtatttgtagtagag

SEQ ID NO: 493884 - DNA, 20 bp, Artificial Sequence
  chemically synthesized
tgggttttcaccgtgttagc

SEQ ID NO: 493885 - DNA, 20 bp, Artificial Sequence
  chemically synthesized
actttgggaggccgaggcag

SEQ ID NO: 493886 - DNA, 20 bp, Artificial Sequence
  chemically synthesized
gcctcggcctcccaaagtgc

SEQ ID NO: 493887 - DNA, 20 bp, Artificial Sequence
  chemically synthesized
gtgagccaccatgcctggcc

SEQ ID NO: 493888 - DNA, 20 bp, Artificial Sequence
  chemically synthesized
aaggggctcatagccacttc

SEQ ID NO: 493889 - DNA, 20 bp, Artificial Sequence
  chemically synthesized
caaaacaattcaatacacta

SEQ ID NO: 493890 - DNA, 20 bp, Artificial Sequence
  chemically synthesized
tcaaagaatccagtagtgta

SEQ ID NO: 493891 - DNA, 20 bp, Artificial Sequence
  chemically synthesized
gttttcaaggttttggttca

SEQ ID NO: 493892 - DNA, 20 bp, Artificial Sequence
  chemically synthesized
ggagagaataaagcaggttt

SEQ ID NO: 493893 - DNA, 20 bp, Artificial Sequence
  chemically synthesized
attagaagaaaaatgctgga

SEQ ID NO: 493894 - DNA, 20 bp, Artificial Sequence
  chemically synthesized
aaccttaaattccaaatatt

SEQ ID NO: 493895 - DNA, 20 bp, Artificial Sequence
  chemically synthesized
aaaagaaaattcagaatatt

SEQ ID NO: 493896 - DNA, 20 bp, Artificial Sequence
  chemically synthesized
ttatagacaaaaagaaaatt

SEQ ID NO: 493897 - DNA, 20 bp, Artificial Sequence
  chemically synthesized
aaaatgaactttaaatgttt

SEQ ID NO: 493898 - DNA, 20 bp, Artificial Sequence
  chemically synthesized
cttacctaaggtgagtgtgt

SEQ ID NO: 493899 - DNA, 20 bp, Artificial Sequence
  chemically synthesized
agcttttttacttacctaag

SEQ ID NO: 493900 - DNA, 20 bp, Artificial Sequence
  chemically synthesized
aagtaaaaaagctttagagc

SEQ ID NO: 493901 - DNA, 20 bp, Artificial Sequence
  chemically synthesized
tcaaggaaagagacaataca

SEQ ID NO: 493902 - DNA, 20 bp, Artificial Sequence
  chemically synthesized
ggaaagagacaatacagtga

SEQ ID NO: 493903 - DNA, 20 bp, Artificial Sequence
  chemically synthesized
agagacaatacagtgagtga

SEQ ID NO: 493904 - DNA, 20 bp, Artificial Sequence
  chemically synthesized
atgtgcctgtgtgtgtgttg

SEQ ID NO: 493905 - DNA, 20 bp, Artificial Sequence
  chemically synthesized
gcacatgacatcgagaagtg

SEQ ID NO: 493906 - DNA, 20 bp, Artificial Sequence
  chemically synthesized
gaggtgaatgagatgcagct

SEQ ID NO: 493907 - DNA, 20 bp, Artificial Sequence
  chemically synthesized
tccaaccagggacctaagag

SEQ ID NO: 493908 - DNA, 20 bp, Artificial Sequence
  chemically synthesized
tcacctcttaggtccctggt

SEQ ID NO: 493909 - DNA, 20 bp, Artificial Sequence
  chemically synthesized
tattaaaccatcaagtcaaa

SEQ ID NO: 493910 - DNA, 20 bp, Artificial Sequence
  chemically synthesized
ttctaatacatacaaagact

SEQ ID NO: 493911 - DNA, 20 bp, Artificial Sequence
  chemically synthesized
atgtctgtatatggcatatc

SEQ ID NO: 493912 - DNA, 20 bp, Artificial Sequence
  chemically synthesized
ttattactaaaataattatt

SEQ ID NO: 493913 - DNA, 20 bp, Artificial Sequence
  chemically synthesized
agatagatgatggtgccaaa

SEQ ID NO: 493914 - DNA, 20 bp, Artificial Sequence
  chemically synthesized
atgatggtgccaaattgaat

SEQ ID NO: 493915 - DNA, 20 bp, Artificial Sequence
  chemically synthesized
acatattttccacataagca

SEQ ID NO: 493916 - DNA, 20 bp, Artificial Sequence
  chemically synthesized
cctcattagatagcttaagt

SEQ ID NO: 493917 - DNA, 20 bp, Artificial Sequence
  chemically synthesized
gaggacaacagacctgctat

SEQ ID NO: 493918 - DNA, 20 bp, Artificial Sequence
  chemically synthesized
cagacctgctattgggatta

SEQ ID NO: 493919 - DNA, 20 bp, Artificial Sequence
  chemically synthesized
cagagtgaatttactgtttc

SEQ ID NO: 493920 - DNA, 20 bp, Artificial Sequence
  chemically synthesized
ggatctcaattgctctcaga

SEQ ID NO: 493921 - DNA, 20 bp, Artificial Sequence
  chemically synthesized
cagaggatctcaattgctct

SEQ ID NO: 493922 - DNA, 20 bp, Artificial Sequence
  chemically synthesized
gcaattgagatcctctgaaa

SEQ ID NO: 493923 - DNA, 20 bp, Artificial Sequence
  chemically synthesized
ccttccgagaccccatttca

SEQ ID NO: 493924 - DNA, 20 bp, Artificial Sequence
  chemically synthesized
aaatggggtctcggaaggcg

SEQ ID NO: 493925 - DNA, 20 bp, Artificial Sequence
  chemically synthesized
gggaattaataacagggcct

SEQ ID NO: 493926 - DNA, 20 bp, Artificial Sequence
  chemically synthesized
ccactgttttccttctctca

SEQ ID NO: 493927 - DNA, 20 bp, Artificial Sequence
  chemically synthesized
ccttctctcaagggatccac

SEQ ID NO: 493928 - DNA, 20 bp, Artificial Sequence
  chemically synthesized
taagacacgtgctaacccat

SEQ ID NO: 493929 - DNA, 20 bp, Artificial Sequence
  chemically synthesized
ttagcacgtgtcttaagtgt

SEQ ID NO: 493930 - DNA, 20 bp, Artificial Sequence
  chemically synthesized
aataatttggcttgcctttc

SEQ ID NO: 493931 - DNA, 20 bp, Artificial Sequence
  chemically synthesized
tttcttgcttttgtctagga

SEQ ID NO: 493932 - DNA, 20 bp, Artificial Sequence
  chemically synthesized
gtgagatacttgccacaagt

SEQ ID NO: 493933 - DNA, 20 bp, Artificial Sequence
  chemically synthesized
gcaatgaatgctcaatttac

SEQ ID NO: 493934 - DNA, 20 bp, Artificial Sequence
  chemically synthesized
aaataagcatggatgctgca

SEQ ID NO: 493935 - DNA, 20 bp, Artificial Sequence
  chemically synthesized
aacttacacttaaaataagc

SEQ ID NO: 493936 - DNA, 20 bp, Artificial Sequence
  chemically synthesized
ttaaataattttttatttgt

SEQ ID NO: 493937 - DNA, 20 bp, Artificial Sequence
  chemically synthesized
tttttatttgtatgaatgta

SEQ ID NO: 493938 - DNA, 20 bp, Artificial Sequence
  chemically synthesized
tacaagtgcaattttattat

SEQ ID NO: 493939 - DNA, 20 bp, Artificial Sequence
  chemically synthesized
aattttattatgtgagtatg

SEQ ID NO: 493940 - DNA, 20 bp, Artificial Sequence
  chemically synthesized
atgttggatagtggtgaact

SEQ ID NO: 493941 - DNA, 20 bp, Artificial Sequence
  chemically synthesized
caatgtacataatttgggtg

SEQ ID NO: 493942 - DNA, 20 bp, Artificial Sequence
  chemically synthesized
atggctacaatgtacataat

SEQ ID NO: 493943 - DNA, 20 bp, Artificial Sequence
  chemically synthesized
tgaagtgtgggggtgtgcaa

SEQ ID NO: 493944 - DNA, 20 bp, Artificial Sequence
  chemically synthesized
agcattggagactgaagtgt

SEQ ID NO: 493945 - DNA, 20 bp, Artificial Sequence
  chemically synthesized
taaacatgtacacatggaca

SEQ ID NO: 493946 - DNA, 20 bp, Artificial Sequence
  chemically synthesized
ttcacttataagtgagaaca

SEQ ID NO: 493947 - DNA, 20 bp, Artificial Sequence
  chemically synthesized
catggggtatctttctgctt

SEQ ID NO: 493948 - DNA, 20 bp, Artificial Sequence
  chemically synthesized
aatatttagcaatctcagtt

SEQ ID NO: 493949 - DNA, 20 bp, Artificial Sequence
  chemically synthesized
taagaatttacacatttcac

SEQ ID NO: 493950 - DNA, 20 bp, Artificial Sequence
  chemically synthesized
tattacatgtcttttggtat

SEQ ID NO: 493951 - DNA, 20 bp, Artificial Sequence
  chemically synthesized
ttataccaaaagacatgtaa

SEQ ID NO: 493952 - DNA, 20 bp, Artificial Sequence
  chemically synthesized
aaactgttatatttacccta

SEQ ID NO: 493953 - DNA, 20 bp, Artificial Sequence
  chemically synthesized
atgggctgcataatattcca

SEQ ID NO: 493954 - DNA, 20 bp, Artificial Sequence
  chemically synthesized
tgtttaataactacacacaa

SEQ ID NO: 493955 - DNA, 20 bp, Artificial Sequence
  chemically synthesized
tttgccctactatatttttg

SEQ ID NO: 493956 - DNA, 20 bp, Artificial Sequence
  chemically synthesized
tttgcaatcattagtctccc

SEQ ID NO: 493957 - DNA, 20 bp, Artificial Sequence
  chemically synthesized
aatgattgcaaagaggaacc

SEQ ID NO: 493958 - DNA, 20 bp, Artificial Sequence
  chemically synthesized
gttttgttttctttcttgaa

SEQ ID NO: 493959 - DNA, 20 bp, Artificial Sequence
  chemically synthesized
ttttataaaattatttaaaa

SEQ ID NO: 493960 - DNA, 20 bp, Artificial Sequence
  chemically synthesized
ctactgctatgaaccacatc

SEQ ID NO: 493961 - DNA, 20 bp, Artificial Sequence
  chemically synthesized
tatgcgtgaaacaccttact

SEQ ID NO: 493962 - DNA, 20 bp, Artificial Sequence
  chemically synthesized
ttatctttaattcacacaat

SEQ ID NO: 493963 - DNA, 20 bp, Artificial Sequence
  chemically synthesized
ggccatacaatccatattgt

SEQ ID NO: 493964 - DNA, 20 bp, Artificial Sequence
  chemically synthesized
gattgtatggcctgtctggt

SEQ ID NO: 493965 - DNA, 20 bp, Artificial Sequence
  chemically synthesized
ggctggatcacttgtgcaat

SEQ ID NO: 493966 - DNA, 20 bp, Artificial Sequence
  chemically synthesized
tcagttttttgcgtcaaagg

SEQ ID NO: 493967 - DNA, 20 bp, Artificial Sequence
  chemically synthesized
ccagcctttgacgcaaaaaa

SEQ ID NO: 493968 - DNA, 20 bp, Artificial Sequence
  chemically synthesized
cccccacccaacaacaaagg

SEQ ID NO: 493969 - DNA, 20 bp, Artificial Sequence
  chemically synthesized
ttggcattcatcctttgttg

SEQ ID NO: 493970 - DNA, 20 bp, Artificial Sequence
  chemically synthesized
ttcccccccacccaacaaca

SEQ ID NO: 493971 - DNA, 20 bp, Artificial Sequence
  chemically synthesized
gaagcacaatcatcatcact

SEQ ID NO: 493972 - DNA, 20 bp, Artificial Sequence
  chemically synthesized
actgtggatgtgttcatgat

SEQ ID NO: 493973 - DNA, 20 bp, Artificial Sequence
  chemically synthesized
cctaaagcatcaaggaaact

SEQ ID NO: 493974 - DNA, 20 bp, Artificial Sequence
  chemically synthesized
ccaagtttccttgatgcttt

SEQ ID NO: 493975 - DNA, 20 bp, Artificial Sequence
  chemically synthesized
ctctccagactgcttctagg

SEQ ID NO: 493976 - DNA, 20 bp, Artificial Sequence
  chemically synthesized
atgcctctccagactgcttc

SEQ ID NO: 493977 - DNA, 20 bp, Artificial Sequence
  chemically synthesized
gattgttgacacagacaaat

SEQ ID NO: 493978 - DNA, 20 bp, Artificial Sequence
  chemically synthesized
agtgtttcttttttggtact

SEQ ID NO: 493979 - DNA, 20 bp, Artificial Sequence
  chemically synthesized
ccaaaagtactttgttgaca

SEQ ID NO: 493980 - DNA, 20 bp, Artificial Sequence
  chemically synthesized
taatatatatgacgtgttca

SEQ ID NO: 493981 - DNA, 20 bp, Artificial Sequence
  chemically synthesized
gactataaaataaaatatct

SEQ ID NO: 493982 - DNA, 20 bp, Artificial Sequence
  chemically synthesized
ctgttaaggtttttgatgtt

SEQ ID NO: 493983 - DNA, 20 bp, Artificial Sequence
  chemically synthesized
ttgatgttaagaattgaaac

SEQ ID NO: 493984 - DNA, 20 bp, Artificial Sequence
  chemically synthesized
gataggcaagaatgctttat

SEQ ID NO: 493985 - DNA, 20 bp, Artificial Sequence
  chemically synthesized
gagtggtggttaagataggc

SEQ ID NO: 493986 - DNA, 20 bp, Artificial Sequence
  chemically synthesized
tctttcctagtcattagaaa

SEQ ID NO: 493987 - DNA, 20 bp, Artificial Sequence
  chemically synthesized
tccctttctaatgactagga

SEQ ID NO: 493988 - DNA, 20 bp, Artificial Sequence
  chemically synthesized
ttttttcatgctcgaaaatt

SEQ ID NO: 493989 - DNA, 20 bp, Artificial Sequence
  chemically synthesized
gcatgaaaaaattatcatga

SEQ ID NO: 493990 - DNA, 20 bp, Artificial Sequence
  chemically synthesized
tcagtggataagttaaggag

SEQ ID NO: 493991 - DNA, 20 bp, Artificial Sequence
  chemically synthesized
acatgtacgtttctacatca

SEQ ID NO: 493992 - DNA, 20 bp, Artificial Sequence
  chemically synthesized
taattgagaaaaataataaa

SEQ ID NO: 493993 - DNA, 20 bp, Artificial Sequence
  chemically synthesized
atgttgacggtatttcccag

SEQ ID NO: 493994 - DNA, 20 bp, Artificial Sequence
  chemically synthesized
attaacaaatttgaaattaa

SEQ ID NO: 493995 - DNA, 20 bp, Artificial Sequence
  chemically synthesized
aaaagaccctgaaataatga

SEQ ID NO: 493996 - DNA, 20 bp, Artificial Sequence
  chemically synthesized
ctgttattcagtcattattt

SEQ ID NO: 493997 - DNA, 20 bp, Artificial Sequence
  chemically synthesized
tagcctataattcaagatct

SEQ ID NO: 493998 - DNA, 20 bp, Artificial Sequence
  chemically synthesized
tttaatgatactcaaagatc

SEQ ID NO: 493999 - DNA, 20 bp, Artificial Sequence
  chemically synthesized
cattaaaatgatgtacctgt

SEQ ID NO: 494000 - DNA, 20 bp, Artificial Sequence
  chemically synthesized
tgatacatcgtgttgtgcgt

SEQ ID NO: 494001 - DNA, 20 bp, Artificial Sequence
  chemically synthesized
cctgatattgacccgctagt

SEQ ID NO: 494002 - DNA, 20 bp, Artificial Sequence
  chemically synthesized
ggtctgattgactcggacta

SEQ ID NO: 494003 - DNA, 20 bp, Artificial Sequence
  chemically synthesized
tagtccgagtcaatcagacc

SEQ ID NO: 494004 - DNA, 20 bp, Artificial Sequence
  chemically synthesized
agtctagaaccagtcatcag

SEQ ID NO: 494005 - DNA, 20 bp, Artificial Sequence
  chemically synthesized
catgtcctaaattggctcaa

SEQ ID NO: 494006 - DNA, 20 bp, Artificial Sequence
  chemically synthesized
gaaaacctcttccacctcgt

SEQ ID NO: 494007 - DNA, 20 bp, Artificial Sequence
  chemically synthesized
agccaatctatgactacagg

SEQ ID NO: 494008 - DNA, 20 bp, Artificial Sequence
  chemically synthesized
ctacaggaggaataaaactt

SEQ ID NO: 494009 - DNA, 20 bp, Artificial Sequence
  chemically synthesized
cttaggaattcacgagcata

SEQ ID NO: 494010 - DNA, 20 bp, Artificial Sequence
  chemically synthesized
tggccttactctttatgctc

SEQ ID NO: 494011 - DNA, 20 bp, Artificial Sequence
  chemically synthesized
tggccaggtttgccaagtat

SEQ ID NO: 494012 - DNA, 20 bp, Artificial Sequence
  chemically synthesized
aatcctccaaagagaagcct

SEQ ID NO: 494013 - DNA, 20 bp, Artificial Sequence
  chemically synthesized
cactctgaggcttctctttg

SEQ ID NO: 494014 - DNA, 20 bp, Artificial Sequence
  chemically synthesized
ttgtctagatgtagcagagg

SEQ ID NO: 494015 - DNA, 20 bp, Artificial Sequence
  chemically synthesized
ccttatatccagaaataaca

SEQ ID NO: 494016 - DNA, 20 bp, Artificial Sequence
  chemically synthesized
acaatgactcagtgttattt

SEQ ID NO: 494017 - DNA, 20 bp, Artificial Sequence
  chemically synthesized
gcactgctgggaacacacag

SEQ ID NO: 494018 - DNA, 20 bp, Artificial Sequence
  chemically synthesized
aacacacagatgaatctgac

SEQ ID NO: 494019 - DNA, 20 bp, Artificial Sequence
  chemically synthesized
aatctgacatgaattctata

SEQ ID NO: 494020 - DNA, 20 bp, Artificial Sequence
  chemically synthesized
ttctcctgagaaactcatta

SEQ ID NO: 494021 - DNA, 20 bp, Artificial Sequence
  chemically synthesized
ttctataatgagtttctcag

SEQ ID NO: 494022 - DNA, 20 bp, Artificial Sequence
  chemically synthesized
atgagtttctcaggagaata

SEQ ID NO: 494023 - DNA, 20 bp, Artificial Sequence
  chemically synthesized
acttgaccttcgtctataat

SEQ ID NO: 494024 - DNA, 20 bp, Artificial Sequence
  chemically synthesized
atttgctaatggattgttga

SEQ ID NO: 494025 - DNA, 20 bp, Artificial Sequence
  chemically synthesized
ttaagttaaatgatttgcta

SEQ ID NO: 494026 - DNA, 20 bp, Artificial Sequence
  chemically synthesized
ttagtagcccaatttaacat

SEQ ID NO: 494027 - DNA, 20 bp, Artificial Sequence
  chemically synthesized
ctgatatgcataaagctcct

SEQ ID NO: 494028 - DNA, 20 bp, Artificial Sequence
  chemically synthesized
atcaggcactgtgctaaaca

SEQ ID NO: 494029 - DNA, 20 bp, Artificial Sequence
  chemically synthesized
ggaaaaccatgtctatctca

SEQ ID NO: 494030 - DNA, 20 bp, Artificial Sequence
  chemically synthesized
gaatatatgctggaggtaaa

SEQ ID NO: 494031 - DNA, 20 bp, Artificial Sequence
  chemically synthesized
gtcctctgcttatgccatgt

SEQ ID NO: 494032 - DNA, 20 bp, Artificial Sequence
  chemically synthesized
tcgtaataggagaaaagctg

SEQ ID NO: 494033 - DNA, 20 bp, Artificial Sequence
  chemically synthesized
gctgatgaataatgagatag

SEQ ID NO: 494034 - DNA, 20 bp, Artificial Sequence
  chemically synthesized
catgcacaatcactacaaaa

SEQ ID NO: 494035 - DNA, 20 bp, Artificial Sequence
  chemically synthesized
cattctctgtagtaaaagga

SEQ ID NO: 494036 - DNA, 20 bp, Artificial Sequence
  chemically synthesized
gatcctttccttttactaca

SEQ ID NO: 494037 - DNA, 20 bp, Artificial Sequence
  chemically synthesized
agcgctaagattgaagttca

SEQ ID NO: 494038 - DNA, 20 bp, Artificial Sequence
  chemically synthesized
ggcaagcaagacaaggtttc

SEQ ID NO: 494039 - DNA, 20 bp, Artificial Sequence
  chemically synthesized
acctaaatatagcgtattga

SEQ ID NO: 494040 - DNA, 20 bp, Artificial Sequence
  chemically synthesized
ggatacctaaatatagcgta

SEQ ID NO: 494041 - DNA, 20 bp, Artificial Sequence
  chemically synthesized
aatactttgtctttaagcaa

SEQ ID NO: 494042 - DNA, 20 bp, Artificial Sequence
  chemically synthesized
aaagacaaagtatttgttat

SEQ ID NO: 494043 - DNA, 20 bp, Artificial Sequence
  chemically synthesized
agaactttacttcaaaagga

SEQ ID NO: 494044 - DNA, 20 bp, Artificial Sequence
  chemically synthesized
tccttttgaagtaaagttct

SEQ ID NO: 494045 - DNA, 20 bp, Artificial Sequence
  chemically synthesized
gacagcacaagagcattttg

SEQ ID NO: 494046 - DNA, 20 bp, Artificial Sequence
  chemically synthesized
tgcttctgaggaggtgagat

SEQ ID NO: 494047 - DNA, 20 bp, Artificial Sequence
  chemically synthesized
tacaatacaccacagagtag

SEQ ID NO: 494048 - DNA, 20 bp, Artificial Sequence
  chemically synthesized
attttcagtacaatacacca

SEQ ID NO: 494049 - DNA, 20 bp, Artificial Sequence
  chemically synthesized
ataacttttaaattaggttc

SEQ ID NO: 494050 - DNA, 20 bp, Artificial Sequence
  chemically synthesized
acaggtgaactgcattttgc

SEQ ID NO: 494051 - DNA, 20 bp, Artificial Sequence
  chemically synthesized
aagatcaggaaaaataatta

SEQ ID NO: 494052 - DNA, 20 bp, Artificial Sequence
  chemically synthesized
acacacactggggcctactg

SEQ ID NO: 494053 - DNA, 20 bp, Artificial Sequence
  chemically synthesized
gaacatatggacacaaagag

SEQ ID NO: 494054 - DNA, 20 bp, Artificial Sequence
  chemically synthesized
tgtttccatataagtttgct

SEQ ID NO: 494055 - DNA, 20 bp, Artificial Sequence
  chemically synthesized
atcatgtcctttgcagcgac

SEQ ID NO: 494056 - DNA, 20 bp, Artificial Sequence
  chemically synthesized
aatactatgtggccatgaaa

SEQ ID NO: 494057 - DNA, 20 bp, Artificial Sequence
  chemically synthesized
aatgtggtacatatacacca

SEQ ID NO: 494058 - DNA, 20 bp, Artificial Sequence
  chemically synthesized
aatgcctatcaatgaacaga

SEQ ID NO: 494059 - DNA, 20 bp, Artificial Sequence
  chemically synthesized
ttcattgataggcatttaag

SEQ ID NO: 494060 - DNA, 20 bp, Artificial Sequence
  chemically synthesized
ctactcacaatagcaaagac

SEQ ID NO: 494061 - DNA, 20 bp, Artificial Sequence
  chemically synthesized
gaatccatgtctttgctatt

SEQ ID NO: 494062 - DNA, 20 bp, Artificial Sequence
  chemically synthesized
acgtgcatatgtctttatgg

SEQ ID NO: 494063 - DNA, 20 bp, Artificial Sequence
  chemically synthesized
gtagaatgatttctattcct

SEQ ID NO: 494064 - DNA, 20 bp, Artificial Sequence
  chemically synthesized
attattgggcatatacccag

SEQ ID NO: 494065 - DNA, 20 bp, Artificial Sequence
  chemically synthesized
tctgggtatatgcccaataa

SEQ ID NO: 494066 - DNA, 20 bp, Artificial Sequence
  chemically synthesized
tatgcccaataatgggattg

SEQ ID NO: 494067 - DNA, 20 bp, Artificial Sequence
  chemically synthesized
atttctcaaataacttacaa

SEQ ID NO: 494068 - DNA, 20 bp, Artificial Sequence
  chemically synthesized
aaataacttcctagaaggat

SEQ ID NO: 494069 - DNA, 20 bp, Artificial Sequence
  chemically synthesized
tacttcaaataacttcctag

SEQ ID NO: 494070 - DNA, 20 bp, Artificial Sequence
  chemically synthesized
acaaagatttgaagaacaat

SEQ ID NO: 494071 - DNA, 20 bp, Artificial Sequence
  chemically synthesized
ttaactacataatatttact

SEQ ID NO: 494072 - DNA, 20 bp, Artificial Sequence
  chemically synthesized
ttctacttacattatgttta

SEQ ID NO: 494073 - DNA, 20 bp, Artificial Sequence
  chemically synthesized
tgagtcctcatcaagaaacc

SEQ ID NO: 494074 - DNA, 20 bp, Artificial Sequence
  chemically synthesized
aataaacagagatgacatga

SEQ ID NO: 494075 - DNA, 20 bp, Artificial Sequence
  chemically synthesized
atgatagaatctccaagaag

SEQ ID NO: 494076 - DNA, 20 bp, Artificial Sequence
  chemically synthesized
acaaatcaacagaaattgca

SEQ ID NO: 494077 - DNA, 20 bp, Artificial Sequence
  chemically synthesized
ctctagaagtccattaggag

SEQ ID NO: 494078 - DNA, 20 bp, Artificial Sequence
  chemically synthesized
aagtccattaggaggggagt

SEQ ID NO: 494079 - DNA, 20 bp, Artificial Sequence
  chemically synthesized
ccttcagctttgttagtgac

SEQ ID NO: 494080 - DNA, 20 bp, Artificial Sequence
  chemically synthesized
gtcactaacaaagctgaagg

SEQ ID NO: 494081 - DNA, 20 bp, Artificial Sequence
  chemically synthesized
ctctagtagctgtaaggtgg

SEQ ID NO: 494082 - DNA, 20 bp, Artificial Sequence
  chemically synthesized
ccctcccaccttacagctac

SEQ ID NO: 494083 - DNA, 20 bp, Artificial Sequence
  chemically synthesized
gaataatccccaccttaaaa

SEQ ID NO: 494084 - DNA, 20 bp, Artificial Sequence
  chemically synthesized
ggtcaacccacttttaaggt

SEQ ID NO: 494085 - DNA, 20 bp, Artificial Sequence
  chemically synthesized
tgaggctgtggataacgctg

SEQ ID NO: 494086 - DNA, 20 bp, Artificial Sequence
  chemically synthesized
aggagtatttccctgaggct

SEQ ID NO: 494087 - DNA, 20 bp, Artificial Sequence
  chemically synthesized
caaggaatgagatgtctttg

SEQ ID NO: 494088 - DNA, 20 bp, Artificial Sequence
  chemically synthesized
tgatcagaagcaatggagca

SEQ ID NO: 494089 - DNA, 20 bp, Artificial Sequence
  chemically synthesized
tatctcatggttagaagttt

SEQ ID NO: 494090 - DNA, 20 bp, Artificial Sequence
  chemically synthesized
aactggatacctgagtgtgt

SEQ ID NO: 494091 - DNA, 20 bp, Artificial Sequence
  chemically synthesized
ccttttcagaaactggatac

SEQ ID NO: 494092 - DNA, 20 bp, Artificial Sequence
  chemically synthesized
ttgtactaccttttcagaaa

SEQ ID NO: 494093 - DNA, 20 bp, Artificial Sequence
  chemically synthesized
gaaaaggtagtacaagtaat

SEQ ID NO: 494094 - DNA, 20 bp, Artificial Sequence
  chemically synthesized
agtacaagtaatgtgaatga

SEQ ID NO: 494095 - DNA, 20 bp, Artificial Sequence
  chemically synthesized
gaatgaaagagtattccggt

SEQ ID NO: 494096 - DNA, 20 bp, Artificial Sequence
  chemically synthesized
attcagaatcatatccaaac

SEQ ID NO: 494097 - DNA, 20 bp, Artificial Sequence
  chemically synthesized
attccggtttggatatgatt

SEQ ID NO: 494098 - DNA, 20 bp, Artificial Sequence
  chemically synthesized
tttggatatgattctgaatt

SEQ ID NO: 494099 - DNA, 20 bp, Artificial Sequence
  chemically synthesized
gaaaaaaaaaacccaaaatt

SEQ ID NO: 494100 - DNA, 20 bp, Artificial Sequence
  chemically synthesized
attgggttggctcacctaga

SEQ ID NO: 494101 - DNA, 20 bp, Artificial Sequence
  chemically synthesized
ccagggtctgtccctcagca

SEQ ID NO: 494102 - DNA, 20 bp, Artificial Sequence
  chemically synthesized
gttgaagcatctcctttaac

SEQ ID NO: 494103 - DNA, 20 bp, Artificial Sequence
  chemically synthesized
gcctctcagacagcacctca

SEQ ID NO: 494104 - DNA, 20 bp, Artificial Sequence
  chemically synthesized
catgtgtttaattttcagca

SEQ ID NO: 494105 - DNA, 20 bp, Artificial Sequence
  chemically synthesized
cataaaaaaatgggcatggc

SEQ ID NO: 494106 - DNA, 20 bp, Artificial Sequence
  chemically synthesized
ctaatagtcaggagctttga

SEQ ID NO: 494107 - DNA, 20 bp, Artificial Sequence
  chemically synthesized
ggacaacatctctgttatcc

SEQ ID NO: 494108 - DNA, 20 bp, Artificial Sequence
  chemically synthesized
acatctctgttatccttgaa

SEQ ID NO: 494109 - DNA, 20 bp, Artificial Sequence
  chemically synthesized
gtggaataagaattcaattc

SEQ ID NO: 494110 - DNA, 20 bp, Artificial Sequence
  chemically synthesized
tggattttgatgtgtggaat

SEQ ID NO: 494111 - DNA, 20 bp, Artificial Sequence
  chemically synthesized
tagatatggattttgatgtg

SEQ ID NO: 494112 - DNA, 20 bp, Artificial Sequence
  chemically synthesized
ttctctggtgtttcttagat

SEQ ID NO: 494113 - DNA, 20 bp, Artificial Sequence
  chemically synthesized
tccatatctaagaaacacca

SEQ ID NO: 494114 - DNA, 20 bp, Artificial Sequence
  chemically synthesized
ataagtttctatgtatctgg

SEQ ID NO: 494115 - DNA, 20 bp, Artificial Sequence
  chemically synthesized
aaaaaagcatggcttagatg

SEQ ID NO: 494116 - DNA, 20 bp, Artificial Sequence
  chemically synthesized
atttattgatgttgagcttt

SEQ ID NO: 494117 - DNA, 20 bp, Artificial Sequence
  chemically synthesized
aagctttagaaaccaatgct

SEQ ID NO: 494118 - DNA, 20 bp, Artificial Sequence
  chemically synthesized
tctggataacatccctattt

SEQ ID NO: 494119 - DNA, 20 bp, Artificial Sequence
  chemically synthesized
ccctttgagtattctaaaat

SEQ ID NO: 494120 - DNA, 20 bp, Artificial Sequence
  chemically synthesized
aaaatagctgtagcagccct

SEQ ID NO: 494121 - DNA, 20 bp, Artificial Sequence
  chemically synthesized
caagctatagatcacctgtg

SEQ ID NO: 494122 - DNA, 20 bp, Artificial Sequence
  chemically synthesized
aactgtaactttaaaaacct

SEQ ID NO: 494123 - DNA, 20 bp, Artificial Sequence
  chemically synthesized
aatatatacaagacatacac

SEQ ID NO: 494124 - DNA, 20 bp, Artificial Sequence
  chemically synthesized
tactttcattttattagtat

SEQ ID NO: 494125 - DNA, 20 bp, Artificial Sequence
  chemically synthesized
acaataattacaagaacttc

SEQ ID NO: 494126 - DNA, 20 bp, Artificial Sequence
  chemically synthesized
actgatcagtataagggctt

SEQ ID NO: 494127 - DNA, 20 bp, Artificial Sequence
  chemically synthesized
agttagtcattttatagatg

SEQ ID NO: 494128 - DNA, 20 bp, Artificial Sequence
  chemically synthesized
aaattttaaatgttgaaata

SEQ ID NO: 494129 - DNA, 20 bp, Artificial Sequence
  chemically synthesized
atagcatgagccagtctgtc

SEQ ID NO: 494130 - DNA, 20 bp, Artificial Sequence
  chemically synthesized
ctcatgctatgattcggtgt

SEQ ID NO: 494131 - DNA, 20 bp, Artificial Sequence
  chemically synthesized
ccagccttttcatcctgaca

SEQ ID NO: 494132 - DNA, 20 bp, Artificial Sequence
  chemically synthesized
ggctggcttagagacatgtt

SEQ ID NO: 494133 - DNA, 20 bp, Artificial Sequence
  chemically synthesized
cagtggtttaaaagatttct

SEQ ID NO: 494134 - DNA, 20 bp, Artificial Sequence
  chemically synthesized
aggagctctgcttgcatgct

SEQ ID NO: 494135 - DNA, 20 bp, Artificial Sequence
  chemically synthesized
accagcggattacggtgtgg

SEQ ID NO: 494136 - DNA, 20 bp, Artificial Sequence
  chemically synthesized
ataaaccagcggattacggt

SEQ ID NO: 494137 - DNA, 20 bp, Artificial Sequence
  chemically synthesized
cataaaggtggaataaacca

SEQ ID NO: 494138 - DNA, 20 bp, Artificial Sequence
  chemically synthesized
taataggagtttcataaagg

SEQ ID NO: 494139 - DNA, 20 bp, Artificial Sequence
  chemically synthesized
acagggtggacaaatgtaat

SEQ ID NO: 494140 - DNA, 20 bp, Artificial Sequence
  chemically synthesized
agctgttgctgctttaagca

SEQ ID NO: 494141 - DNA, 20 bp, Artificial Sequence
  chemically synthesized
cacttcagacaaggcccctt

SEQ ID NO: 494142 - DNA, 20 bp, Artificial Sequence
  chemically synthesized
atggaagcaacagcagtaga

SEQ ID NO: 494143 - DNA, 20 bp, Artificial Sequence
  chemically synthesized
cactaaatagctttcagatg

SEQ ID NO: 494144 - DNA, 20 bp, Artificial Sequence
  chemically synthesized
tatttaaaatagaaatacca

SEQ ID NO: 494145 - DNA, 20 bp, Artificial Sequence
  chemically synthesized
ttatctatacatgtttaatt

SEQ ID NO: 494146 - DNA, 20 bp, Artificial Sequence
  chemically synthesized
tttagagtgatgatgtaaca

SEQ ID NO: 494147 - DNA, 20 bp, Artificial Sequence
  chemically synthesized
tggatgtggagactccaaag

SEQ ID NO: 494148 - DNA, 20 bp, Artificial Sequence
  chemically synthesized
tatattacattattcagctt

SEQ ID NO: 494149 - DNA, 20 bp, Artificial Sequence
  chemically synthesized
ctgcagaaacagctatgcag

SEQ ID NO: 494150 - DNA, 20 bp, Artificial Sequence
  chemically synthesized
tagaaacacaggactggctt

SEQ ID NO: 494151 - DNA, 20 bp, Artificial Sequence
  chemically synthesized
gctttggagttatttagggg

SEQ ID NO: 494152 - DNA, 20 bp, Artificial Sequence
  chemically synthesized
cttgatgttttatttgttac

SEQ ID NO: 494153 - DNA, 20 bp, Artificial Sequence
  chemically synthesized
gggagcaatagaaacaatga

SEQ ID NO: 494154 - DNA, 20 bp, Artificial Sequence
  chemically synthesized
aacagggagcaatagaaaca

SEQ ID NO: 494155 - DNA, 20 bp, Artificial Sequence
  chemically synthesized
ctgttattgttcctttctaa

SEQ ID NO: 494156 - DNA, 20 bp, Artificial Sequence
  chemically synthesized
agcgccaatgagcaagacta

SEQ ID NO: 494157 - DNA, 20 bp, Artificial Sequence
  chemically synthesized
agtcactttagtcttcacaa

SEQ ID NO: 494158 - DNA, 20 bp, Artificial Sequence
  chemically synthesized
agtattgagttatagattta

SEQ ID NO: 494159 - DNA, 20 bp, Artificial Sequence
  chemically synthesized
ttcttctcagctgttaagta

SEQ ID NO: 494160 - DNA, 20 bp, Artificial Sequence
  chemically synthesized
ctcaatacttaacagctgag

SEQ ID NO: 494161 - DNA, 20 bp, Artificial Sequence
  chemically synthesized
acttaacagctgagaagaat

SEQ ID NO: 494162 - DNA, 20 bp, Artificial Sequence
  chemically synthesized
acctaaacgtccatcagtgg

SEQ ID NO: 494163 - DNA, 20 bp, Artificial Sequence
  chemically synthesized
atcaacctaaacgtccatca

SEQ ID NO: 494164 - DNA, 20 bp, Artificial Sequence
  chemically synthesized
ttttcatactagccatgata

SEQ ID NO: 494165 - DNA, 20 bp, Artificial Sequence
  chemically synthesized
agatactgatttccttttct

SEQ ID NO: 494166 - DNA, 20 bp, Artificial Sequence
  chemically synthesized
tttggataaatgcccagtag

SEQ ID NO: 494167 - DNA, 20 bp, Artificial Sequence
  chemically synthesized
aatgcccagtagtgggattg

SEQ ID NO: 494168 - DNA, 20 bp, Artificial Sequence
  chemically synthesized
aaacactttcttaataaaac

SEQ ID NO: 494169 - DNA, 20 bp, Artificial Sequence
  chemically synthesized
ataaaacatactgaaatctt

SEQ ID NO: 494170 - DNA, 20 bp, Artificial Sequence
  chemically synthesized
catactacatagtatgcttc

SEQ ID NO: 494171 - DNA, 20 bp, Artificial Sequence
  chemically synthesized
ttttcatcccactgaaatag

SEQ ID NO: 494172 - DNA, 20 bp, Artificial Sequence
  chemically synthesized
ctttgattcctctatttcag

SEQ ID NO: 494173 - DNA, 20 bp, Artificial Sequence
  chemically synthesized
atgaaaacagcttgtgcctc

SEQ ID NO: 494174 - DNA, 20 bp, Artificial Sequence
  chemically synthesized
agaattaagacaatggccca

SEQ ID NO: 494175 - DNA, 20 bp, Artificial Sequence
  chemically synthesized
acagaattaataatatgata

SEQ ID NO: 494176 - DNA, 20 bp, Artificial Sequence
  chemically synthesized
gttattttctgtgaaatata

SEQ ID NO: 494177 - DNA, 20 bp, Artificial Sequence
  chemically synthesized
tatacagagttgaactatct

SEQ ID NO: 494178 - DNA, 20 bp, Artificial Sequence
  chemically synthesized
aatttttcttgttagttata

SEQ ID NO: 494179 - DNA, 20 bp, Artificial Sequence
  chemically synthesized
ataagcttttttttttaaag

SEQ ID NO: 494180 - DNA, 20 bp, Artificial Sequence
  chemically synthesized
gagatatcaatgaggttacg

SEQ ID NO: 494181 - DNA, 20 bp, Artificial Sequence
  chemically synthesized
ctcttgaaattatttcctaa

SEQ ID NO: 494182 - DNA, 20 bp, Artificial Sequence
  chemically synthesized
ctctcttaggaaataatttc

SEQ ID NO: 494183 - DNA, 20 bp, Artificial Sequence
  chemically synthesized
atagttcttgaaatggcaat

SEQ ID NO: 494184 - DNA, 20 bp, Artificial Sequence
  chemically synthesized
ttacatatctaagtgaacac

SEQ ID NO: 494185 - DNA, 20 bp, Artificial Sequence
  chemically synthesized
gtaacaatattgcataattg

SEQ ID NO: 494186 - DNA, 20 bp, Artificial Sequence
  chemically synthesized
attgatattacatatttgcc

SEQ ID NO: 494187 - DNA, 20 bp, Artificial Sequence
  chemically synthesized
aaatataaattaatgtttgt

SEQ ID NO: 494188 - DNA, 20 bp, Artificial Sequence
  chemically synthesized
aataaccctatgcaaagtga

SEQ ID NO: 494189 - DNA, 20 bp, Artificial Sequence
  chemically synthesized
aaacattctatcactttgca

SEQ ID NO: 494190 - DNA, 20 bp, Artificial Sequence
  chemically synthesized
cttggttctttcctgcacat

SEQ ID NO: 494191 - DNA, 20 bp, Artificial Sequence
  chemically synthesized
tactaaaattcataggcctg

SEQ ID NO: 494192 - DNA, 20 bp, Artificial Sequence
  chemically synthesized
ttgatgtacccttcaggcct

SEQ ID NO: 494193 - DNA, 20 bp, Artificial Sequence
  chemically synthesized
acatgacttacagacttagc

SEQ ID NO: 494194 - DNA, 20 bp, Artificial Sequence
  chemically synthesized
aagccactaagcatcgtttt

SEQ ID NO: 494195 - DNA, 20 bp, Artificial Sequence
  chemically synthesized
caggaaatgatggtttttga

SEQ ID NO: 494196 - DNA, 20 bp, Artificial Sequence
  chemically synthesized
tgagcaagtgtcttgtgatg

SEQ ID NO: 494197 - DNA, 20 bp, Artificial Sequence
  chemically synthesized
gtgtaatttgtaccttgcat

SEQ ID NO: 494198 - DNA, 20 bp, Artificial Sequence
  chemically synthesized
atttagaagatgtgctggag

SEQ ID NO: 494199 - DNA, 20 bp, Artificial Sequence
  chemically synthesized
tgctggaggtgaattaccaa

SEQ ID NO: 494200 - DNA, 20 bp, Artificial Sequence
  chemically synthesized
gtttcttcacctctggaagg

SEQ ID NO: 494201 - DNA, 20 bp, Artificial Sequence
  chemically synthesized
cagaggtgaagaaacaggcc

SEQ ID NO: 494202 - DNA, 20 bp, Artificial Sequence
  chemically synthesized
aataatagggccctgtcttt

SEQ ID NO: 494203 - DNA, 20 bp, Artificial Sequence
  chemically synthesized
aggtacattttaactagtga

SEQ ID NO: 494204 - DNA, 20 bp, Artificial Sequence
  chemically synthesized
tttcactttgtgaaaatgac

SEQ ID NO: 494205 - DNA, 20 bp, Artificial Sequence
  chemically synthesized
tttgtgaaaatgacgtgagt

SEQ ID NO: 494206 - DNA, 20 bp, Artificial Sequence
  chemically synthesized
acaaatctaggcttgaaact

SEQ ID NO: 494207 - DNA, 20 bp, Artificial Sequence
  chemically synthesized
aagcctagatttgtggaagt

SEQ ID NO: 494208 - DNA, 20 bp, Artificial Sequence
  chemically synthesized
aaccaactcaagagtactta

SEQ ID NO: 494209 - DNA, 20 bp, Artificial Sequence
  chemically synthesized
agaaaattctctaagtactc

SEQ ID NO: 494210 - DNA, 20 bp, Artificial Sequence
  chemically synthesized
ataaggactttaaccaactc

SEQ ID NO: 494211 - DNA, 20 bp, Artificial Sequence
  chemically synthesized
catacacagacctggtctcg

SEQ ID NO: 494212 - DNA, 20 bp, Artificial Sequence
  chemically synthesized
cctcgagaccaggtctgtgt

SEQ ID NO: 494213 - DNA, 20 bp, Artificial Sequence
  chemically synthesized
tcatctgaaatcctccccaa

SEQ ID NO: 494214 - DNA, 20 bp, Artificial Sequence
  chemically synthesized
gcattatccatccctttggg

SEQ ID NO: 494215 - DNA, 20 bp, Artificial Sequence
  chemically synthesized
ctgaaatcctccccaaaggg

SEQ ID NO: 494216 - DNA, 20 bp, Artificial Sequence
  chemically synthesized
atgtaggtgcttagtaaatt

SEQ ID NO: 494217 - DNA, 20 bp, Artificial Sequence
  chemically synthesized
gaactagaatgtactttgat

SEQ ID NO: 494218 - DNA, 20 bp, Artificial Sequence
  chemically synthesized
ttctatgtgatataaagaac

SEQ ID NO: 494219 - DNA, 20 bp, Artificial Sequence
  chemically synthesized
ctttatatcacatagaaata

SEQ ID NO: 494220 - DNA, 20 bp, Artificial Sequence
  chemically synthesized
tgtttctgatttgattttct

SEQ ID NO: 494221 - DNA, 20 bp, Artificial Sequence
  chemically synthesized
ataatgagcttccaactgca

SEQ ID NO: 494222 - DNA, 20 bp, Artificial Sequence
  chemically synthesized
caactgtagtggctgctagt

SEQ ID NO: 494223 - DNA, 20 bp, Artificial Sequence
  chemically synthesized
caactgtagtagaaagagat

SEQ ID NO: 494224 - DNA, 20 bp, Artificial Sequence
  chemically synthesized
ttttattatactttaagttt

SEQ ID NO: 494225 - DNA, 20 bp, Artificial Sequence
  chemically synthesized
taatggtaaatgacgagtta

SEQ ID NO: 494226 - DNA, 20 bp, Artificial Sequence
  chemically synthesized
aacttacctaatggtaaatg

SEQ ID NO: 494227 - DNA, 20 bp, Artificial Sequence
  chemically synthesized
ttaccattaggtaagttttt

SEQ ID NO: 494228 - DNA, 20 bp, Artificial Sequence
  chemically synthesized
cagggatcatgctatgcatt

SEQ ID NO: 494229 - DNA, 20 bp, Artificial Sequence
  chemically synthesized
gattgcacatgacacatgtc

SEQ ID NO: 494230 - DNA, 20 bp, Artificial Sequence
  chemically synthesized
gggatttattatttttaaat

SEQ ID NO: 494231 - DNA, 20 bp, Artificial Sequence
  chemically synthesized
taatggaaatgtatttggta

SEQ ID NO: 494232 - DNA, 20 bp, Artificial Sequence
  chemically synthesized
atttccattaaatatttcac

SEQ ID NO: 494233 - DNA, 20 bp, Artificial Sequence
  chemically synthesized
catttgtaaagtgaggtttg

SEQ ID NO: 494234 - DNA, 20 bp, Artificial Sequence
  chemically synthesized
gggctctggagtcaaagagc

SEQ ID NO: 494235 - DNA, 20 bp, Artificial Sequence
  chemically synthesized
gtattttcttgcaggggctc

SEQ ID NO: 494236 - DNA, 20 bp, Artificial Sequence
  chemically synthesized
agagctatgtcaaggcagca

SEQ ID NO: 494237 - DNA, 20 bp, Artificial Sequence
  chemically synthesized
taggaaatcactgagcataa

SEQ ID NO: 494238 - DNA, 20 bp, Artificial Sequence
  chemically synthesized
agtgatttcctaatagtttc

SEQ ID NO: 494239 - DNA, 20 bp, Artificial Sequence
  chemically synthesized
accattatttttctcatggc

SEQ ID NO: 494240 - DNA, 20 bp, Artificial Sequence
  chemically synthesized
gaaaaataatggttactaat

SEQ ID NO: 494241 - DNA, 20 bp, Artificial Sequence
  chemically synthesized
gttactaatttgaataacgt

SEQ ID NO: 494242 - DNA, 20 bp, Artificial Sequence
  chemically synthesized
ataatttttttaaagttcca

SEQ ID NO: 494243 - DNA, 20 bp, Artificial Sequence
  chemically synthesized
tttttttttgtattttttta

SEQ ID NO: 494244 - DNA, 20 bp, Artificial Sequence
  chemically synthesized
ttatgctcaggcccgtcact

SEQ ID NO: 494245 - DNA, 20 bp, Artificial Sequence
  chemically synthesized
gcactcagaacctcacctac

SEQ ID NO: 494246 - DNA, 20 bp, Artificial Sequence
  chemically synthesized
ggacccaggtaggtgaggtt

SEQ ID NO: 494247 - DNA, 20 bp, Artificial Sequence
  chemically synthesized
gttctgagtgcatctaacag

SEQ ID NO: 494248 - DNA, 20 bp, Artificial Sequence
  chemically synthesized
tatagtcttattttaagtga

SEQ ID NO: 494249 - DNA, 20 bp, Artificial Sequence
  chemically synthesized
actatatacgcatagcatta

SEQ ID NO: 494250 - DNA, 20 bp, Artificial Sequence
  chemically synthesized
gtcaaccatcattaagacaa

SEQ ID NO: 494251 - DNA, 20 bp, Artificial Sequence
  chemically synthesized
gatttttcggagactttagc

SEQ ID NO: 494252 - DNA, 20 bp, Artificial Sequence
  chemically synthesized
atatggcatctgcagagcag

SEQ ID NO: 494253 - DNA, 20 bp, Artificial Sequence
  chemically synthesized
tagattttaaacagtaatac

SEQ ID NO: 494254 - DNA, 20 bp, Artificial Sequence
  chemically synthesized
tattactgtttaaaatctac

SEQ ID NO: 494255 - DNA, 20 bp, Artificial Sequence
  chemically synthesized
taacgacagctttaataaaa

SEQ ID NO: 494256 - DNA, 20 bp, Artificial Sequence
  chemically synthesized
cagctttaataaaatagagt

SEQ ID NO: 494257 - DNA, 20 bp, Artificial Sequence
  chemically synthesized
tcttgaacccttgaatcttt

SEQ ID NO: 494258 - DNA, 20 bp, Artificial Sequence
  chemically synthesized
aagaaaattcttaaagattc

SEQ ID NO: 494259 - DNA, 20 bp, Artificial Sequence
  chemically synthesized
tcttaaagattcaagggttc

SEQ ID NO: 494260 - DNA, 20 bp, Artificial Sequence
  chemically synthesized
agtagactactcttgaaccc

SEQ ID NO: 494261 - DNA, 20 bp, Artificial Sequence
  chemically synthesized
caaaaaaaatgttcattaat

SEQ ID NO: 494262 - DNA, 20 bp, Artificial Sequence
  chemically synthesized
cccattaatgaacatttttt

SEQ ID NO: 494263 - DNA, 20 bp, Artificial Sequence
  chemically synthesized
cggggcttaaaacctaaatg

SEQ ID NO: 494264 - DNA, 20 bp, Artificial Sequence
  chemically synthesized
tcattgctcaactcccaatt

SEQ ID NO: 494265 - DNA, 20 bp, Artificial Sequence
  chemically synthesized
gcattttctcactcataatt

SEQ ID NO: 494266 - DNA, 20 bp, Artificial Sequence
  chemically synthesized
catcctcagcaaactaacac

SEQ ID NO: 494267 - DNA, 20 bp, Artificial Sequence
  chemically synthesized
cattcctgtgttagtttgct

SEQ ID NO: 494268 - DNA, 20 bp, Artificial Sequence
  chemically synthesized
ttcatgtcctttgaagggac

SEQ ID NO: 494269 - DNA, 20 bp, Artificial Sequence
  chemically synthesized
ctatgaatccataaaaaaga

SEQ ID NO: 494270 - DNA, 20 bp, Artificial Sequence
  chemically synthesized
acatgaactcgttctttttt

SEQ ID NO: 494271 - DNA, 20 bp, Artificial Sequence
  chemically synthesized
catacacaccatggaatact

SEQ ID NO: 494272 - DNA, 20 bp, Artificial Sequence
  chemically synthesized
aaggtggcacatacacacca

SEQ ID NO: 494273 - DNA, 20 bp, Artificial Sequence
  chemically synthesized
aaatgcccatcagtgatgga

SEQ ID NO: 494274 - DNA, 20 bp, Artificial Sequence
  chemically synthesized
agtccatcactgatgggcat

SEQ ID NO: 494275 - DNA, 20 bp, Artificial Sequence
  chemically synthesized
tatacaagtatacttttcct

SEQ ID NO: 494276 - DNA, 20 bp, Artificial Sequence
  chemically synthesized
attccctttaattttatact

SEQ ID NO: 494277 - DNA, 20 bp, Artificial Sequence
  chemically synthesized
accctaagtataaaattaaa

SEQ ID NO: 494278 - DNA, 20 bp, Artificial Sequence
  chemically synthesized
ttccatatacatgttgtatt

SEQ ID NO: 494279 - DNA, 20 bp, Artificial Sequence
  chemically synthesized
tcaagtgctttgtcaacatt

SEQ ID NO: 494280 - DNA, 20 bp, Artificial Sequence
  chemically synthesized
taaatgctatgatatagtaa

SEQ ID NO: 494281 - DNA, 20 bp, Artificial Sequence
  chemically synthesized
taacagtccgtgttaaaaat

SEQ ID NO: 494282 - DNA, 20 bp, Artificial Sequence
  chemically synthesized
gtaaagaagatgtgcaaagc

SEQ ID NO: 494283 - DNA, 20 bp, Artificial Sequence
  chemically synthesized
acatcttctttacaatgcta

SEQ ID NO: 494284 - DNA, 20 bp, Artificial Sequence
  chemically synthesized
ttaatttatggtcatgttct

SEQ ID NO: 494285 - DNA, 20 bp, Artificial Sequence
  chemically synthesized
gcatagcatctgaatttatt

SEQ ID NO: 494286 - DNA, 20 bp, Artificial Sequence
  chemically synthesized
ttccttgaagagcatagcat

SEQ ID NO: 494287 - DNA, 20 bp, Artificial Sequence
  chemically synthesized
ttcaaggaaaaaaatcaaaa

SEQ ID NO: 494288 - DNA, 20 bp, Artificial Sequence
  chemically synthesized
tgtatatatgtatatagttt

SEQ ID NO: 494289 - DNA, 20 bp, Artificial Sequence
  chemically synthesized
tttctggcaaaaaattaaag

SEQ ID NO: 494290 - DNA, 20 bp, Artificial Sequence
  chemically synthesized
tctgtataatggactgatat

SEQ ID NO: 494291 - DNA, 20 bp, Artificial Sequence
  chemically synthesized
aagtaaaagtttgtcctacc

SEQ ID NO: 494292 - DNA, 20 bp, Artificial Sequence
  chemically synthesized
aaactggactattagcaaga

SEQ ID NO: 494293 - DNA, 20 bp, Artificial Sequence
  chemically synthesized
aaactaccttgtttgaaaat

SEQ ID NO: 494294 - DNA, 20 bp, Artificial Sequence
  chemically synthesized
gagagaatgaaatatctaga

SEQ ID NO: 494295 - DNA, 20 bp, Artificial Sequence
  chemically synthesized
gaaagagagaatgaaatatc

SEQ ID NO: 494296 - DNA, 20 bp, Artificial Sequence
  chemically synthesized
aaattacatgggtagaaaga

SEQ ID NO: 494297 - DNA, 20 bp, Artificial Sequence
  chemically synthesized
gcaagcaatgctaaaattac

SEQ ID NO: 494298 - DNA, 20 bp, Artificial Sequence
  chemically synthesized
tactgagatgattatattgt

SEQ ID NO: 494299 - DNA, 20 bp, Artificial Sequence
  chemically synthesized
ggtaaagtatgggtatggca

SEQ ID NO: 494300 - DNA, 20 bp, Artificial Sequence
  chemically synthesized
agaataagagaaggtaaagt

SEQ ID NO: 494301 - DNA, 20 bp, Artificial Sequence
  chemically synthesized
gtgatcatatttagccccgg

SEQ ID NO: 494302 - DNA, 20 bp, Artificial Sequence
  chemically synthesized
ctaaatatgatcacttcaat

SEQ ID NO: 494303 - DNA, 20 bp, Artificial Sequence
  chemically synthesized
agtagactaatctattttaa

SEQ ID NO: 494304 - DNA, 20 bp, Artificial Sequence
  chemically synthesized
ctttattgccttggtaaata

SEQ ID NO: 494305 - DNA, 20 bp, Artificial Sequence
  chemically synthesized
gccttggtaaatatagaatg

SEQ ID NO: 494306 - DNA, 20 bp, Artificial Sequence
  chemically synthesized
ttttaatcattgctaatgat

SEQ ID NO: 494307 - DNA, 20 bp, Artificial Sequence
  chemically synthesized
ttggggtcattaaaaagttc

SEQ ID NO: 494308 - DNA, 20 bp, Artificial Sequence
  chemically synthesized
gtcatctttacaaatagtct

SEQ ID NO: 494309 - DNA, 20 bp, Artificial Sequence
  chemically synthesized
gccctatgaacattgctttt

SEQ ID NO: 494310 - DNA, 20 bp, Artificial Sequence
  chemically synthesized
tttaggaataaattgatgtt

SEQ ID NO: 494311 - DNA, 20 bp, Artificial Sequence
  chemically synthesized
gaacacttttacactgttgg

SEQ ID NO: 494312 - DNA, 20 bp, Artificial Sequence
  chemically synthesized
aggaaacaacaggtgctgga

SEQ ID NO: 494313 - DNA, 20 bp, Artificial Sequence
  chemically synthesized
agataccatctcacaccagt

SEQ ID NO: 494314 - DNA, 20 bp, Artificial Sequence
  chemically synthesized
tttctagttctaggcccctg

SEQ ID NO: 494315 - DNA, 20 bp, Artificial Sequence
  chemically synthesized
tatacccagtaatgggatgg

SEQ ID NO: 494316 - DNA, 20 bp, Artificial Sequence
  chemically synthesized
ttgacccagccatcccatta

SEQ ID NO: 494317 - DNA, 20 bp, Artificial Sequence
  chemically synthesized
tttgggtatatacccagtaa

SEQ ID NO: 494318 - DNA, 20 bp, Artificial Sequence
  chemically synthesized
gcagcatgatttatagtcct

SEQ ID NO: 494319 - DNA, 20 bp, Artificial Sequence
  chemically synthesized
ggttccaagtctttgctatt

SEQ ID NO: 494320 - DNA, 20 bp, Artificial Sequence
  chemically synthesized
agtctatcattgttggacat

SEQ ID NO: 494321 - DNA, 20 bp, Artificial Sequence
  chemically synthesized
aaatgtccaacaatgataga

SEQ ID NO: 494322 - DNA, 20 bp, Artificial Sequence
  chemically synthesized
aatgtggcacatatacacca

SEQ ID NO: 494323 - DNA, 20 bp, Artificial Sequence
  chemically synthesized
ctatgcagccagaaaaaatg

SEQ ID NO: 494324 - DNA, 20 bp, Artificial Sequence
  chemically synthesized
ttcatgtcctttgtagggac

SEQ ID NO: 494325 - DNA, 20 bp, Artificial Sequence
  chemically synthesized
tgtagggacatggatgaaac

SEQ ID NO: 494326 - DNA, 20 bp, Artificial Sequence
  chemically synthesized
tgtccttgcgatagtttact

SEQ ID NO: 494327 - DNA, 20 bp, Artificial Sequence
  chemically synthesized
gcatgttctcactcttaggt

SEQ ID NO: 494328 - DNA, 20 bp, Artificial Sequence
  chemically synthesized
tcattgttccattcccacct

SEQ ID NO: 494329 - DNA, 20 bp, Artificial Sequence
  chemically synthesized
ccccaccccacaacagttcc

SEQ ID NO: 494330 - DNA, 20 bp, Artificial Sequence
  chemically synthesized
tcacaccctgggaactgttg

SEQ ID NO: 494331 - DNA, 20 bp, Artificial Sequence
  chemically synthesized
gatatacctaatgttaaatg

SEQ ID NO: 494332 - DNA, 20 bp, Artificial Sequence
  chemically synthesized
taatgttaaatgaagagtta

SEQ ID NO: 494333 - DNA, 20 bp, Artificial Sequence
  chemically synthesized
tatgtatacctgtgccatgt

SEQ ID NO: 494334 - DNA, 20 bp, Artificial Sequence
  chemically synthesized
tttaattatactttaagttt

SEQ ID NO: 494335 - DNA, 20 bp, Artificial Sequence
  chemically synthesized
aaagtataattaaaaaaaaa

SEQ ID NO: 494336 - DNA, 20 bp, Artificial Sequence
  chemically synthesized
aggaaaaagacacatcatgg

SEQ ID NO: 494337 - DNA, 20 bp, Artificial Sequence
  chemically synthesized
ggtcacatggtgataaaaat

SEQ ID NO: 494338 - DNA, 20 bp, Artificial Sequence
  chemically synthesized
gatctaattttatgttactt

SEQ ID NO: 494339 - DNA, 20 bp, Artificial Sequence
  chemically synthesized
ctcagagagaggcaaatgca

SEQ ID NO: 494340 - DNA, 20 bp, Artificial Sequence
  chemically synthesized
tttacttctccctttcagga

SEQ ID NO: 494341 - DNA, 20 bp, Artificial Sequence
  chemically synthesized
tcctttttacttctcccttt

SEQ ID NO: 494342 - DNA, 20 bp, Artificial Sequence
  chemically synthesized
atagcagtttcttctgggga

SEQ ID NO: 494343 - DNA, 20 bp, Artificial Sequence
  chemically synthesized
ctttaatagcagtttcttct

SEQ ID NO: 494344 - DNA, 20 bp, Artificial Sequence
  chemically synthesized
cattgcagctgaagacaaac

SEQ ID NO: 494345 - DNA, 20 bp, Artificial Sequence
  chemically synthesized
tattgttcaccttttctttg

SEQ ID NO: 494346 - DNA, 20 bp, Artificial Sequence
  chemically synthesized
ctaagcctttgacggatgca

SEQ ID NO: 494347 - DNA, 20 bp, Artificial Sequence
  chemically synthesized
aacagaaagctaagcctttg

SEQ ID NO: 494348 - DNA, 20 bp, Artificial Sequence
  chemically synthesized
gggagatgtgaagctaaaaa

SEQ ID NO: 494349 - DNA, 20 bp, Artificial Sequence
  chemically synthesized
aagtacatcgattgctttag

SEQ ID NO: 494350 - DNA, 20 bp, Artificial Sequence
  chemically synthesized
gaatgaataggaacatggaa

SEQ ID NO: 494351 - DNA, 20 bp, Artificial Sequence
  chemically synthesized
aaagaaataaagacaaatga

SEQ ID NO: 494352 - DNA, 20 bp, Artificial Sequence
  chemically synthesized
acttaaagaaataaagacaa

SEQ ID NO: 494353 - DNA, 20 bp, Artificial Sequence
  chemically synthesized
agtgttacagatctatgcct

SEQ ID NO: 494354 - DNA, 20 bp, Artificial Sequence
  chemically synthesized
acgagttgatgtctggttgc

SEQ ID NO: 494355 - DNA, 20 bp, Artificial Sequence
  chemically synthesized
aatgtgattaacacttctgc

SEQ ID NO: 494356 - DNA, 20 bp, Artificial Sequence
  chemically synthesized
attatgtaaaatgttcgtat

SEQ ID NO: 494357 - DNA, 20 bp, Artificial Sequence
  chemically synthesized
attttgttgcagaacatgtt

SEQ ID NO: 494358 - DNA, 20 bp, Artificial Sequence
  chemically synthesized
ttcttcttttcacctagatt

SEQ ID NO: 494359 - DNA, 20 bp, Artificial Sequence
  chemically synthesized
agtggtggtttaaaagacca

SEQ ID NO: 494360 - DNA, 20 bp, Artificial Sequence
  chemically synthesized
cagaatgatgtcagacaggc

SEQ ID NO: 494361 - DNA, 20 bp, Artificial Sequence
  chemically synthesized
tactcacgctcatagagcca

SEQ ID NO: 494362 - DNA, 20 bp, Artificial Sequence
  chemically synthesized
tactctatggctctatgagc

SEQ ID NO: 494363 - DNA, 20 bp, Artificial Sequence
  chemically synthesized
aaattgagctggagagaggc

SEQ ID NO: 494364 - DNA, 20 bp, Artificial Sequence
  chemically synthesized
agcctctctccagctcaatt

SEQ ID NO: 494365 - DNA, 20 bp, Artificial Sequence
  chemically synthesized
agcaggtatcaacgttaatt

SEQ ID NO: 494366 - DNA, 20 bp, Artificial Sequence
  chemically synthesized
acaatagcaatggtgaggat

SEQ ID NO: 494367 - DNA, 20 bp, Artificial Sequence
  chemically synthesized
atagttacaatagcaatggt

SEQ ID NO: 494368 - DNA, 20 bp, Artificial Sequence
  chemically synthesized
ctccccttgcaattggttcc

SEQ ID NO: 494369 - DNA, 20 bp, Artificial Sequence
  chemically synthesized
cccagaatttcacataaact

SEQ ID NO: 494370 - DNA, 20 bp, Artificial Sequence
  chemically synthesized
caataaatattaagttcaaa

SEQ ID NO: 494371 - DNA, 20 bp, Artificial Sequence
  chemically synthesized
cagtttgaacttaatattta

SEQ ID NO: 494372 - DNA, 20 bp, Artificial Sequence
  chemically synthesized
tttaccagatgttattcata

SEQ ID NO: 494373 - DNA, 20 bp, Artificial Sequence
  chemically synthesized
ttttaaatttacaattcaat

SEQ ID NO: 494374 - DNA, 20 bp, Artificial Sequence
  chemically synthesized
agtgttaagtcctctaacca

SEQ ID NO: 494375 - DNA, 20 bp, Artificial Sequence
  chemically synthesized
tctcccggtgctgccacgtt

SEQ ID NO: 494376 - DNA, 20 bp, Artificial Sequence
  chemically synthesized
atcatgagggctctgccctt

SEQ ID NO: 494377 - DNA, 20 bp, Artificial Sequence
  chemically synthesized
tgagggctctgcccttatga

SEQ ID NO: 494378 - DNA, 20 bp, Artificial Sequence
  chemically synthesized
acctattaatttatgaatgg

SEQ ID NO: 494379 - DNA, 20 bp, Artificial Sequence
  chemically synthesized
attaacctattaatttatga

SEQ ID NO: 494380 - DNA, 20 bp, Artificial Sequence
  chemically synthesized
acccattaacctattaattt

SEQ ID NO: 494381 - DNA, 20 bp, Artificial Sequence
  chemically synthesized
attcataaattaataggtta

SEQ ID NO: 494382 - DNA, 20 bp, Artificial Sequence
  chemically synthesized
ataggttaatgggttatcat

SEQ ID NO: 494383 - DNA, 20 bp, Artificial Sequence
  chemically synthesized
ttaatgggttatcatgggag

SEQ ID NO: 494384 - DNA, 20 bp, Artificial Sequence
  chemically synthesized
cttcctgttcttataaaatc

SEQ ID NO: 494385 - DNA, 20 bp, Artificial Sequence
  chemically synthesized
gaagagagacatgaacacat

SEQ ID NO: 494386 - DNA, 20 bp, Artificial Sequence
  chemically synthesized
gacattacatggcaagaagg

SEQ ID NO: 494387 - DNA, 20 bp, Artificial Sequence
  chemically synthesized
cttagcttccaagatcagat

SEQ ID NO: 494388 - DNA, 20 bp, Artificial Sequence
  chemically synthesized
aggttcgacctggttagtac

SEQ ID NO: 494389 - DNA, 20 bp, Artificial Sequence
  chemically synthesized
atgggtaatttacaaagaaa

SEQ ID NO: 494390 - DNA, 20 bp, Artificial Sequence
  chemically synthesized
ttgtaacagaatacctgaaa

SEQ ID NO: 494391 - DNA, 20 bp, Artificial Sequence
  chemically synthesized
ccatttgctgttgcttgtaa

SEQ ID NO: 494392 - DNA, 20 bp, Artificial Sequence
  chemically synthesized
gcaacagcaaatggacttag

SEQ ID NO: 494393 - DNA, 20 bp, Artificial Sequence
  chemically synthesized
aataaaatcttatactgtga

SEQ ID NO: 494394 - DNA, 20 bp, Artificial Sequence
  chemically synthesized
ttttattgacacatagtgtg

SEQ ID NO: 494395 - DNA, 20 bp, Artificial Sequence
  chemically synthesized
atagtgtgttgaataaataa

SEQ ID NO: 494396 - DNA, 20 bp, Artificial Sequence
  chemically synthesized
ttcatccacctgatctttga

SEQ ID NO: 494397 - DNA, 20 bp, Artificial Sequence
  chemically synthesized
ctaactcattcaaagatcag

SEQ ID NO: 494398 - DNA, 20 bp, Artificial Sequence
  chemically synthesized
gtccttcatccacctgatct

SEQ ID NO: 494399 - DNA, 20 bp, Artificial Sequence
  chemically synthesized
ttaaaaagtcacatatttaa

SEQ ID NO: 494400 - DNA, 20 bp, Artificial Sequence
  chemically synthesized
gttgtataacacagttactt

SEQ ID NO: 494401 - DNA, 20 bp, Artificial Sequence
  chemically synthesized
ggctatttatgaaatatgac

SEQ ID NO: 494402 - DNA, 20 bp, Artificial Sequence
  chemically synthesized
tatgaaatatgacatgaatt

SEQ ID NO: 494403 - DNA, 20 bp, Artificial Sequence
  chemically synthesized
gatgatgaacccatcttctg

SEQ ID NO: 494404 - DNA, 20 bp, Artificial Sequence
  chemically synthesized
tttttcttattcatcagaag

SEQ ID NO: 494405 - DNA, 20 bp, Artificial Sequence
  chemically synthesized
atgatcagctccattgccaa

SEQ ID NO: 494406 - DNA, 20 bp, Artificial Sequence
  chemically synthesized
ttaaagccaatttaatttca

SEQ ID NO: 494407 - DNA, 20 bp, Artificial Sequence
  chemically synthesized
tgtactagtcttcttatgca

SEQ ID NO: 494408 - DNA, 20 bp, Artificial Sequence
  chemically synthesized
ccagtcttagttataaattg

SEQ ID NO: 494409 - DNA, 20 bp, Artificial Sequence
  chemically synthesized
tccccaatttataactaaga

SEQ ID NO: 494410 - DNA, 20 bp, Artificial Sequence
  chemically synthesized
atgtctttggaaaaaaagtt

SEQ ID NO: 494411 - DNA, 20 bp, Artificial Sequence
  chemically synthesized
taatcacatgacttatcact

SEQ ID NO: 494412 - DNA, 20 bp, Artificial Sequence
  chemically synthesized
tttgagatcgatttctacaa

SEQ ID NO: 494413 - DNA, 20 bp, Artificial Sequence
  chemically synthesized
gtaacctaaatgcagctccg

SEQ ID NO: 494414 - DNA, 20 bp, Artificial Sequence
  chemically synthesized
caagttcaaaagtaatcaca

SEQ ID NO: 494415 - DNA, 20 bp, Artificial Sequence
  chemically synthesized
aaataacagtgctaaccaag

SEQ ID NO: 494416 - DNA, 20 bp, Artificial Sequence
  chemically synthesized
aggacatgttcagtaatttc

SEQ ID NO: 494417 - DNA, 20 bp, Artificial Sequence
  chemically synthesized
aatagctaatcattattcca

SEQ ID NO: 494418 - DNA, 20 bp, Artificial Sequence
  chemically synthesized
gtacactgtattatattcac

SEQ ID NO: 494419 - DNA, 20 bp, Artificial Sequence
  chemically synthesized
agatatgagaactataatgt

SEQ ID NO: 494420 - DNA, 20 bp, Artificial Sequence
  chemically synthesized
tgccccacacgcgttagcac

SEQ ID NO: 494421 - DNA, 20 bp, Artificial Sequence
  chemically synthesized
gcgttagcacttgaataaat

SEQ ID NO: 494422 - DNA, 20 bp, Artificial Sequence
  chemically synthesized
aagtgttattccaaccatta

SEQ ID NO: 494423 - DNA, 20 bp, Artificial Sequence
  chemically synthesized
agtaaaaatcctttaatggt

SEQ ID NO: 494424 - DNA, 20 bp, Artificial Sequence
  chemically synthesized
taaaggatttttactaagag

SEQ ID NO: 494425 - DNA, 20 bp, Artificial Sequence
  chemically synthesized
ttttgttttcagctaagtta

SEQ ID NO: 494426 - DNA, 20 bp, Artificial Sequence
  chemically synthesized
ataattgaaatgtcatcaga

SEQ ID NO: 494427 - DNA, 20 bp, Artificial Sequence
  chemically synthesized
tgatcaattgttagaccttt

SEQ ID NO: 494428 - DNA, 20 bp, Artificial Sequence
  chemically synthesized
attacaggcacttcagtgta

SEQ ID NO: 494429 - DNA, 20 bp, Artificial Sequence
  chemically synthesized
tgaagccaatctgagtcagg

SEQ ID NO: 494430 - DNA, 20 bp, Artificial Sequence
  chemically synthesized
tacatacatctgaagccaat

SEQ ID NO: 494431 - DNA, 20 bp, Artificial Sequence
  chemically synthesized
ctctcaacttagcagtgttt

SEQ ID NO: 494432 - DNA, 20 bp, Artificial Sequence
  chemically synthesized
aatttctcttaactatttac

SEQ ID NO: 494433 - DNA, 20 bp, Artificial Sequence
  chemically synthesized
gatgcaaccagatcaatgat

SEQ ID NO: 494434 - DNA, 20 bp, Artificial Sequence
  chemically synthesized
ccccccagtggctattcatt

SEQ ID NO: 494435 - DNA, 20 bp, Artificial Sequence
  chemically synthesized
tgttctaaaggatatcctaa

SEQ ID NO: 494436 - DNA, 20 bp, Artificial Sequence
  chemically synthesized
aatcctattcttttgttcta

SEQ ID NO: 494437 - DNA, 20 bp, Artificial Sequence
  chemically synthesized
taggatatcctttagaacaa

SEQ ID NO: 494438 - DNA, 20 bp, Artificial Sequence
  chemically synthesized
tatcctttagaacaaaagaa

SEQ ID NO: 494439 - DNA, 20 bp, Artificial Sequence
  chemically synthesized
tttagaacaaaagaatagga

SEQ ID NO: 494440 - DNA, 20 bp, Artificial Sequence
  chemically synthesized
ggccacggcagcaaacccct

SEQ ID NO: 494441 - DNA, 20 bp, Artificial Sequence
  chemically synthesized
ctcccaagccctgaactctg

SEQ ID NO: 494442 - DNA, 20 bp, Artificial Sequence
  chemically synthesized
cccctcagagttcagggctt

SEQ ID NO: 494443 - DNA, 20 bp, Artificial Sequence
  chemically synthesized
agttcagggcttgggagtgg

SEQ ID NO: 494444 - DNA, 20 bp, Artificial Sequence
  chemically synthesized
agggcttgggagtgggggag

SEQ ID NO: 494445 - DNA, 20 bp, Artificial Sequence
  chemically synthesized
aaaaatcatgcctaaattaa

SEQ ID NO: 494446 - DNA, 20 bp, Artificial Sequence
  chemically synthesized
atttttgtactacatattct

SEQ ID NO: 494447 - DNA, 20 bp, Artificial Sequence
  chemically synthesized
aaaatatattttccaattca

SEQ ID NO: 494448 - DNA, 20 bp, Artificial Sequence
  chemically synthesized
caacaaatattgcttatcag

SEQ ID NO: 494449 - DNA, 20 bp, Artificial Sequence
  chemically synthesized
taaccacatgataaagaact

SEQ ID NO: 494450 - DNA, 20 bp, Artificial Sequence
  chemically synthesized
cactatgtatatgatgttgg

SEQ ID NO: 494451 - DNA, 20 bp, Artificial Sequence
  chemically synthesized
tcttcactatgtatatgatg

SEQ ID NO: 494452 - DNA, 20 bp, Artificial Sequence
  chemically synthesized
gcacagggcttagagctgtt

SEQ ID NO: 494453 - DNA, 20 bp, Artificial Sequence
  chemically synthesized
aagggagacattgggtatta

SEQ ID NO: 494454 - DNA, 20 bp, Artificial Sequence
  chemically synthesized
tggttctaaaaagggagaca

SEQ ID NO: 494455 - DNA, 20 bp, Artificial Sequence
  chemically synthesized
ttcatttcagggtggtaaat

SEQ ID NO: 494456 - DNA, 20 bp, Artificial Sequence
  chemically synthesized
atttaccaccctgaaatgaa

SEQ ID NO: 494457 - DNA, 20 bp, Artificial Sequence
  chemically synthesized
gagatctattcatttcattt

SEQ ID NO: 494458 - DNA, 20 bp, Artificial Sequence
  chemically synthesized
aaaacatatattgttgtgtt

SEQ ID NO: 494459 - DNA, 20 bp, Artificial Sequence
  chemically synthesized
tttaaaatactttgaaacgt

SEQ ID NO: 494460 - DNA, 20 bp, Artificial Sequence
  chemically synthesized
cagacacttgcgcctatgtt

SEQ ID NO: 494461 - DNA, 20 bp, Artificial Sequence
  chemically synthesized
gttaagaatcccctttaatg

SEQ ID NO: 494462 - DNA, 20 bp, Artificial Sequence
  chemically synthesized
ttgaaaaattctacattaaa

SEQ ID NO: 494463 - DNA, 20 bp, Artificial Sequence
  chemically synthesized
tagaatttttcaaatgtccc

SEQ ID NO: 494464 - DNA, 20 bp, Artificial Sequence
  chemically synthesized
caaatgtcccctgaatatag

SEQ ID NO: 494465 - DNA, 20 bp, Artificial Sequence
  chemically synthesized
gtatggaacactcaagtacc

SEQ ID NO: 494466 - DNA, 20 bp, Artificial Sequence
  chemically synthesized
agccttgcgactcatggtac

SEQ ID NO: 494467 - DNA, 20 bp, Artificial Sequence
  chemically synthesized
tgatagttgctgaatttttc

SEQ ID NO: 494468 - DNA, 20 bp, Artificial Sequence
  chemically synthesized
aaatgcagttttgatagttg

SEQ ID NO: 494469 - DNA, 20 bp, Artificial Sequence
  chemically synthesized
aaacacaaagcgtgttttgt

SEQ ID NO: 494470 - DNA, 20 bp, Artificial Sequence
  chemically synthesized
gctttgtgtttatatgttaa

SEQ ID NO: 494471 - DNA, 20 bp, Artificial Sequence
  chemically synthesized
tgtttatagttaatttcccc

SEQ ID NO: 494472 - DNA, 20 bp, Artificial Sequence
  chemically synthesized
taaacaaggttttcctctat

SEQ ID NO: 494473 - DNA, 20 bp, Artificial Sequence
  chemically synthesized
tttcctctatttgaatgtgc

SEQ ID NO: 494474 - DNA, 20 bp, Artificial Sequence
  chemically synthesized
aacactgtttacgcatcatg

SEQ ID NO: 494475 - DNA, 20 bp, Artificial Sequence
  chemically synthesized
tctgctggaatatggtctct

SEQ ID NO: 494476 - DNA, 20 bp, Artificial Sequence
  chemically synthesized
tgaggcatttctgtttctgc

SEQ ID NO: 494477 - DNA, 20 bp, Artificial Sequence
  chemically synthesized
gaaacagaaatgcctcaggt

SEQ ID NO: 494478 - DNA, 20 bp, Artificial Sequence
  chemically synthesized
taccatttatttagtgcttg

SEQ ID NO: 494479 - DNA, 20 bp, Artificial Sequence
  chemically synthesized
taaataaatggtagctatta

SEQ ID NO: 494480 - DNA, 20 bp, Artificial Sequence
  chemically synthesized
agagcaattctgtataaata

SEQ ID NO: 494481 - DNA, 20 bp, Artificial Sequence
  chemically synthesized
atgacaattctatatttata

SEQ ID NO: 494482 - DNA, 20 bp, Artificial Sequence
  chemically synthesized
tgtaacatttatagcttaaa

SEQ ID NO: 494483 - DNA, 20 bp, Artificial Sequence
  chemically synthesized
atttaaattttaaaaactgt

SEQ ID NO: 494484 - DNA, 20 bp, Artificial Sequence
  chemically synthesized
tgtggaaaactggttttaat

SEQ ID NO: 494485 - DNA, 20 bp, Artificial Sequence
  chemically synthesized
ttaatgatttaaacaaaaac

SEQ ID NO: 494486 - DNA, 20 bp, Artificial Sequence
  chemically synthesized
tcaggtgattattatgaagc

SEQ ID NO: 494487 - DNA, 20 bp, Artificial Sequence
  chemically synthesized
cacgatccttttattatatg

SEQ ID NO: 494488 - DNA, 20 bp, Artificial Sequence
  chemically synthesized
gataatccagcatataataa

SEQ ID NO: 494489 - DNA, 20 bp, Artificial Sequence
  chemically synthesized
gatgtcaatgtagaaactca

SEQ ID NO: 494490 - DNA, 20 bp, Artificial Sequence
  chemically synthesized
ttccacaaaaatactattca

SEQ ID NO: 494491 - DNA, 20 bp, Artificial Sequence
  chemically synthesized
atggtgaagtttaaacataa

SEQ ID NO: 494492 - DNA, 20 bp, Artificial Sequence
  chemically synthesized
tatgtttaaacttcaccata

SEQ ID NO: 494493 - DNA, 20 bp, Artificial Sequence
  chemically synthesized
agaactttcacttttctctc

SEQ ID NO: 494494 - DNA, 20 bp, Artificial Sequence
  chemically synthesized
gctgtctaatagatctaacc

SEQ ID NO: 494495 - DNA, 20 bp, Artificial Sequence
  chemically synthesized
tttccaggtagaccaatcaa

SEQ ID NO: 494496 - DNA, 20 bp, Artificial Sequence
  chemically synthesized
aaataataaaattaataaag

SEQ ID NO: 494497 - DNA, 20 bp, Artificial Sequence
  chemically synthesized
gacacatcatttatgtacta

SEQ ID NO: 494498 - DNA, 20 bp, Artificial Sequence
  chemically synthesized
actactatgaaattatggtt

SEQ ID NO: 494499 - DNA, 20 bp, Artificial Sequence
  chemically synthesized
taatgagctcaactcaagaa

SEQ ID NO: 494500 - DNA, 20 bp, Artificial Sequence
  chemically synthesized
actagacttctatccttttc

SEQ ID NO: 494501 - DNA, 20 bp, Artificial Sequence
  chemically synthesized
gatagaagtctagtcaggaa

SEQ ID NO: 494502 - DNA, 20 bp, Artificial Sequence
  chemically synthesized
aacaggttattaaaatagac

SEQ ID NO: 494503 - DNA, 20 bp, Artificial Sequence
  chemically synthesized
ggttattaaaatagacttga

SEQ ID NO: 494504 - DNA, 20 bp, Artificial Sequence
  chemically synthesized
ggtttttcaatatgaaacac

SEQ ID NO: 494505 - DNA, 20 bp, Artificial Sequence
  chemically synthesized
tcatctgaaggagaggctgt

SEQ ID NO: 494506 - DNA, 20 bp, Artificial Sequence
  chemically synthesized
ctgtctgagtaggggaccat

SEQ ID NO: 494507 - DNA, 20 bp, Artificial Sequence
  chemically synthesized
catagactacagaagctgaa

SEQ ID NO: 494508 - DNA, 20 bp, Artificial Sequence
  chemically synthesized
cagaacattccctgctacat

SEQ ID NO: 494509 - DNA, 20 bp, Artificial Sequence
  chemically synthesized
attattattcccatgtagca

SEQ ID NO: 494510 - DNA, 20 bp, Artificial Sequence
  chemically synthesized
ccaggaagtacaatttgtat

SEQ ID NO: 494511 - DNA, 20 bp, Artificial Sequence
  chemically synthesized
gtacaatttgtatcaggatc

SEQ ID NO: 494512 - DNA, 20 bp, Artificial Sequence
  chemically synthesized
cagatatgtagagaaatgac

SEQ ID NO: 494513 - DNA, 20 bp, Artificial Sequence
  chemically synthesized
accatacttaataaaattat

SEQ ID NO: 494514 - DNA, 20 bp, Artificial Sequence
  chemically synthesized
cttcacttcatggtctccac

SEQ ID NO: 494515 - DNA, 20 bp, Artificial Sequence
  chemically synthesized
ggaaaataaatcagttttgc

SEQ ID NO: 494516 - DNA, 20 bp, Artificial Sequence
  chemically synthesized
attgacttttctgctttctc

SEQ ID NO: 494517 - DNA, 20 bp, Artificial Sequence
  chemically synthesized
tgagaaagcagaaaagtcaa

SEQ ID NO: 494518 - DNA, 20 bp, Artificial Sequence
  chemically synthesized
ggatctaatatttttatggt

SEQ ID NO: 494519 - DNA, 20 bp, Artificial Sequence
  chemically synthesized
tccatctggggacatttgta

SEQ ID NO: 494520 - DNA, 20 bp, Artificial Sequence
  chemically synthesized
acatttgtatggggttgaag

SEQ ID NO: 494521 - DNA, 20 bp, Artificial Sequence
  chemically synthesized
taccacgttcctcagtatgt

SEQ ID NO: 494522 - DNA, 20 bp, Artificial Sequence
  chemically synthesized
tttagttgagctaaatggct

SEQ ID NO: 494523 - DNA, 20 bp, Artificial Sequence
  chemically synthesized
taatgattaggaaaaagagc

SEQ ID NO: 494524 - DNA, 20 bp, Artificial Sequence
  chemically synthesized
taggaaaaagagccaggatg

SEQ ID NO: 494525 - DNA, 20 bp, Artificial Sequence
  chemically synthesized
aagatctctaaggcagtaga

SEQ ID NO: 494526 - DNA, 20 bp, Artificial Sequence
  chemically synthesized
aggcagtagaaagagtaata

SEQ ID NO: 494527 - DNA, 20 bp, Artificial Sequence
  chemically synthesized
aagagtaataaggagtatat

SEQ ID NO: 494528 - DNA, 20 bp, Artificial Sequence
  chemically synthesized
gggttccttagagaaacaaa

SEQ ID NO: 494529 - DNA, 20 bp, Artificial Sequence
  chemically synthesized
tagagaaacaaaaggaataa

SEQ ID NO: 494530 - DNA, 20 bp, Artificial Sequence
  chemically synthesized
ttgttcaccctgtatacctt

SEQ ID NO: 494531 - DNA, 20 bp, Artificial Sequence
  chemically synthesized
ctgacaactcccaaggtata

SEQ ID NO: 494532 - DNA, 20 bp, Artificial Sequence
  chemically synthesized
gaactacactatcagctctc

SEQ ID NO: 494533 - DNA, 20 bp, Artificial Sequence
  chemically synthesized
tgaccctcccctgagcaaaa

SEQ ID NO: 494534 - DNA, 20 bp, Artificial Sequence
  chemically synthesized
cgattcccttttgctcaggg

SEQ ID NO: 494535 - DNA, 20 bp, Artificial Sequence
  chemically synthesized
tcatgtaattaattaaaggc

SEQ ID NO: 494536 - DNA, 20 bp, Artificial Sequence
  chemically synthesized
ttaacatttaaattggtaga

SEQ ID NO: 494537 - DNA, 20 bp, Artificial Sequence
  chemically synthesized
ctcatctgataacacttgca

SEQ ID NO: 494538 - DNA, 20 bp, Artificial Sequence
  chemically synthesized
aacacttgcacagaatcacc

SEQ ID NO: 494539 - DNA, 20 bp, Artificial Sequence
  chemically synthesized
atatttggtcaaacattatt

SEQ ID NO: 494540 - DNA, 20 bp, Artificial Sequence
  chemically synthesized
aaagtgaacaacagtatcat

SEQ ID NO: 494541 - DNA, 20 bp, Artificial Sequence
  chemically synthesized
aaacccagtcaatatgtttc

SEQ ID NO: 494542 - DNA, 20 bp, Artificial Sequence
  chemically synthesized
caattccagaaacatattga

SEQ ID NO: 494543 - DNA, 20 bp, Artificial Sequence
  chemically synthesized
tatgagcattgagtatcatg

SEQ ID NO: 494544 - DNA, 20 bp, Artificial Sequence
  chemically synthesized
ccaaggcagtcatatgagca

SEQ ID NO: 494545 - DNA, 20 bp, Artificial Sequence
  chemically synthesized
tgctcatatgactgccttgg

SEQ ID NO: 494546 - DNA, 20 bp, Artificial Sequence
  chemically synthesized
aaagtttgggacagggggta

SEQ ID NO: 494547 - DNA, 20 bp, Artificial Sequence
  chemically synthesized
gttttttaaagtttgggaca

SEQ ID NO: 494548 - DNA, 20 bp, Artificial Sequence
  chemically synthesized
ttttgtgtactgaaatgatt

SEQ ID NO: 494549 - DNA, 20 bp, Artificial Sequence
  chemically synthesized
aacaagaaaatagtaactca

SEQ ID NO: 494550 - DNA, 20 bp, Artificial Sequence
  chemically synthesized
catcttgcttggaccacccc

SEQ ID NO: 494551 - DNA, 20 bp, Artificial Sequence
  chemically synthesized
tccaacttcactaaagcgtt

SEQ ID NO: 494552 - DNA, 20 bp, Artificial Sequence
  chemically synthesized
ttcttaacgctttagtgaag

SEQ ID NO: 494553 - DNA, 20 bp, Artificial Sequence
  chemically synthesized
atatttgcaatgatcaaaat

SEQ ID NO: 494554 - DNA, 20 bp, Artificial Sequence
  chemically synthesized
caggtcatttaaaaatgtga

SEQ ID NO: 494555 - DNA, 20 bp, Artificial Sequence
  chemically synthesized
aatgaaatttaagagcaaag

SEQ ID NO: 494556 - DNA, 20 bp, Artificial Sequence
  chemically synthesized
agaaagtcatctaaattctc

SEQ ID NO: 494557 - DNA, 20 bp, Artificial Sequence
  chemically synthesized
gtcatctaaattctcatgga

SEQ ID NO: 494558 - DNA, 20 bp, Artificial Sequence
  chemically synthesized
atctattgcattctatccat

SEQ ID NO: 494559 - DNA, 20 bp, Artificial Sequence
  chemically synthesized
ggaaacagtatttatagaaa

SEQ ID NO: 494560 - DNA, 20 bp, Artificial Sequence
  chemically synthesized
tctaattttatggcaattta

SEQ ID NO: 494561 - DNA, 20 bp, Artificial Sequence
  chemically synthesized
atgatggcatttacagaaaa

SEQ ID NO: 494562 - DNA, 20 bp, Artificial Sequence
  chemically synthesized
gcagagaaaagataccacct

SEQ ID NO: 494563 - DNA, 20 bp, Artificial Sequence
  chemically synthesized
taagagaagaggttggggta

SEQ ID NO: 494564 - DNA, 20 bp, Artificial Sequence
  chemically synthesized
tatccattaagagaagaggt

SEQ ID NO: 494565 - DNA, 20 bp, Artificial Sequence
  chemically synthesized
taccccaacctcttctctta

SEQ ID NO: 494566 - DNA, 20 bp, Artificial Sequence
  chemically synthesized
taagaacacaaggagcatgt

SEQ ID NO: 494567 - DNA, 20 bp, Artificial Sequence
  chemically synthesized
tattgccttttcataaacat

SEQ ID NO: 494568 - DNA, 20 bp, Artificial Sequence
  chemically synthesized
ttttttcctgttatataaat

SEQ ID NO: 494569 - DNA, 20 bp, Artificial Sequence
  chemically synthesized
caagtaaataacactttttt

SEQ ID NO: 494570 - DNA, 20 bp, Artificial Sequence
  chemically synthesized
ctgagcagaagaaacacagt

SEQ ID NO: 494571 - DNA, 20 bp, Artificial Sequence
  chemically synthesized
tgtttcttctgctcagtttt

SEQ ID NO: 494572 - DNA, 20 bp, Artificial Sequence
  chemically synthesized
gttgattcttctcagataga

SEQ ID NO: 494573 - DNA, 20 bp, Artificial Sequence
  chemically synthesized
ctacactcaatctatctgag

SEQ ID NO: 494574 - DNA, 20 bp, Artificial Sequence
  chemically synthesized
atttagagactctatgcgcc

SEQ ID NO: 494575 - DNA, 20 bp, Artificial Sequence
  chemically synthesized
acagaattattctgggcgca

SEQ ID NO: 494576 - DNA, 20 bp, Artificial Sequence
  chemically synthesized
ataaagagaaatacatatca

SEQ ID NO: 494577 - DNA, 20 bp, Artificial Sequence
  chemically synthesized
gctgcaggaaagttaatcgt

SEQ ID NO: 494578 - DNA, 20 bp, Artificial Sequence
  chemically synthesized
gttattgatacaggtctctg

SEQ ID NO: 494579 - DNA, 20 bp, Artificial Sequence
  chemically synthesized
ctaggaaataaaagtatcgg

SEQ ID NO: 494580 - DNA, 20 bp, Artificial Sequence
  chemically synthesized
caccctaggaaataaaagta

SEQ ID NO: 494581 - DNA, 20 bp, Artificial Sequence
  chemically synthesized
cacccgatacttttatttcc

SEQ ID NO: 494582 - DNA, 20 bp, Artificial Sequence
  chemically synthesized
ccgcactcagattttcttta

SEQ ID NO: 494583 - DNA, 20 bp, Artificial Sequence
  chemically synthesized
caaaattcattaaagaaaat

SEQ ID NO: 494584 - DNA, 20 bp, Artificial Sequence
  chemically synthesized
gtgcggaaattaccaaatca

SEQ ID NO: 494585 - DNA, 20 bp, Artificial Sequence
  chemically synthesized
aggcatttctgtgaggacag

SEQ ID NO: 494586 - DNA, 20 bp, Artificial Sequence
  chemically synthesized
agaaatgcctgctacttcta

SEQ ID NO: 494587 - DNA, 20 bp, Artificial Sequence
  chemically synthesized
catcttcctttaagcatttc

SEQ ID NO: 494588 - DNA, 20 bp, Artificial Sequence
  chemically synthesized
tgccttagtcggctcgcatt

SEQ ID NO: 494589 - DNA, 20 bp, Artificial Sequence
  chemically synthesized
gttttctttacctcatggat

SEQ ID NO: 494590 - DNA, 20 bp, Artificial Sequence
  chemically synthesized
aatttggttttctttacctc

SEQ ID NO: 494591 - DNA, 20 bp, Artificial Sequence
  chemically synthesized
cgctgaatctcagaatatag

SEQ ID NO: 494592 - DNA, 20 bp, Artificial Sequence
  chemically synthesized
aaatgtataacgctgaatct

SEQ ID NO: 494593 - DNA, 20 bp, Artificial Sequence
  chemically synthesized
caaattgaaaatgtataacg

SEQ ID NO: 494594 - DNA, 20 bp, Artificial Sequence
  chemically synthesized
tctccccagagaatgtaaaa

SEQ ID NO: 494595 - DNA, 20 bp, Artificial Sequence
  chemically synthesized
gtgtgtaggttgtctcccca

SEQ ID NO: 494596 - DNA, 20 bp, Artificial Sequence
  chemically synthesized
ttttactctgcaacgtgttg

SEQ ID NO: 494597 - DNA, 20 bp, Artificial Sequence
  chemically synthesized
tttaattctgcaacacgttg

SEQ ID NO: 494598 - DNA, 20 bp, Artificial Sequence
  chemically synthesized
attgtcacaggaaacttcta

SEQ ID NO: 494599 - DNA, 20 bp, Artificial Sequence
  chemically synthesized
tagctccaacttgccacact

SEQ ID NO: 494600 - DNA, 20 bp, Artificial Sequence
  chemically synthesized
gttggagctaaggctgatcc

SEQ ID NO: 494601 - DNA, 20 bp, Artificial Sequence
  chemically synthesized
ctgtggaaactagttgattc

SEQ ID NO: 494602 - DNA, 20 bp, Artificial Sequence
  chemically synthesized
actagtttccacagtaaaaa

SEQ ID NO: 494603 - DNA, 20 bp, Artificial Sequence
  chemically synthesized
ttccacagtaaaaaaagaat

SEQ ID NO: 494604 - DNA, 20 bp, Artificial Sequence
  chemically synthesized
acctctattggatttaagtg

SEQ ID NO: 494605 - DNA, 20 bp, Artificial Sequence
  chemically synthesized
cagagtgaaaactacctcta

SEQ ID NO: 494606 - DNA, 20 bp, Artificial Sequence
  chemically synthesized
cacacactgttgcatgataa

SEQ ID NO: 494607 - DNA, 20 bp, Artificial Sequence
  chemically synthesized
ggttttagcatttaaaataa

SEQ ID NO: 494608 - DNA, 20 bp, Artificial Sequence
  chemically synthesized
gtctaaaggaagagaacaat

SEQ ID NO: 494609 - DNA, 20 bp, Artificial Sequence
  chemically synthesized
aatatactctcttctccagt

SEQ ID NO: 494610 - DNA, 20 bp, Artificial Sequence
  chemically synthesized
tttagactctaactggagaa

SEQ ID NO: 494611 - DNA, 20 bp, Artificial Sequence
  chemically synthesized
ttcccaggtaatagcattta

SEQ ID NO: 494612 - DNA, 20 bp, Artificial Sequence
  chemically synthesized
tgtccttcttgtgactacat

SEQ ID NO: 494613 - DNA, 20 bp, Artificial Sequence
  chemically synthesized
cacattttttcaaaaggaaa

SEQ ID NO: 494614 - DNA, 20 bp, Artificial Sequence
  chemically synthesized
aaaaaatgtgtttcaggttc

SEQ ID NO: 494615 - DNA, 20 bp, Artificial Sequence
  chemically synthesized
tataaaggaggatcacatta

SEQ ID NO: 494616 - DNA, 20 bp, Artificial Sequence
  chemically synthesized
gtaataacaattttataaag

SEQ ID NO: 494617 - DNA, 20 bp, Artificial Sequence
  chemically synthesized
aaaagaaagtgagcatctcc

SEQ ID NO: 494618 - DNA, 20 bp, Artificial Sequence
  chemically synthesized
ccagagatctgccttcaatg

SEQ ID NO: 494619 - DNA, 20 bp, Artificial Sequence
  chemically synthesized
caacattgaaggcagatctc

SEQ ID NO: 494620 - DNA, 20 bp, Artificial Sequence
  chemically synthesized
aatgtctattttatttactt

SEQ ID NO: 494621 - DNA, 20 bp, Artificial Sequence
  chemically synthesized
atttatttggtcactgtttg

SEQ ID NO: 494622 - DNA, 20 bp, Artificial Sequence
  chemically synthesized
cattatttcttatgtaaaca

SEQ ID NO: 494623 - DNA, 20 bp, Artificial Sequence
  chemically synthesized
ttgtttacataagaaataat

SEQ ID NO: 494624 - DNA, 20 bp, Artificial Sequence
  chemically synthesized
ttaaaatatatttgttggtt

SEQ ID NO: 494625 - DNA, 20 bp, Artificial Sequence
  chemically synthesized
gcagcattttataacagtcc

SEQ ID NO: 494626 - DNA, 20 bp, Artificial Sequence
  chemically synthesized
taggatatgtgtatatacag

SEQ ID NO: 494627 - DNA, 20 bp, Artificial Sequence
  chemically synthesized
gcccagatggcaataaaatg

SEQ ID NO: 494628 - DNA, 20 bp, Artificial Sequence
  chemically synthesized
agaagccacggagaaacgaa

SEQ ID NO: 494629 - DNA, 20 bp, Artificial Sequence
  chemically synthesized
tgctatactcaacttcaaga

SEQ ID NO: 494630 - DNA, 20 bp, Artificial Sequence
  chemically synthesized
agcgctatcccttcttgaag

SEQ ID NO: 494631 - DNA, 20 bp, Artificial Sequence
  chemically synthesized
tttactaaaatttttttctt

SEQ ID NO: 494632 - DNA, 20 bp, Artificial Sequence
  chemically synthesized
ttttttcttaaggataacag

SEQ ID NO: 494633 - DNA, 20 bp, Artificial Sequence
  chemically synthesized
gcaaatacattataaaccaa

SEQ ID NO: 494634 - DNA, 20 bp, Artificial Sequence
  chemically synthesized
atctgtatctatattctcct

SEQ ID NO: 494635 - DNA, 20 bp, Artificial Sequence
  chemically synthesized
caatctaggcttatcctaag

SEQ ID NO: 494636 - DNA, 20 bp, Artificial Sequence
  chemically synthesized
aaccaaaaagaaagaatgtc

SEQ ID NO: 494637 - DNA, 20 bp, Artificial Sequence
  chemically synthesized
tgatatgataaccaaaaaga

SEQ ID NO: 494638 - DNA, 20 bp, Artificial Sequence
  chemically synthesized
caagtcccaactgtgcagcc

SEQ ID NO: 494639 - DNA, 20 bp, Artificial Sequence
  chemically synthesized
ggtatggaaagtggttgaca

SEQ ID NO: 494640 - DNA, 20 bp, Artificial Sequence
  chemically synthesized
gtcagagctgatggaatcac

SEQ ID NO: 494641 - DNA, 20 bp, Artificial Sequence
  chemically synthesized
tatgattcggtcagagctga

SEQ ID NO: 494642 - DNA, 20 bp, Artificial Sequence
  chemically synthesized
tgtgattccatcagctctga

SEQ ID NO: 494643 - DNA, 20 bp, Artificial Sequence
  chemically synthesized
tcaatgggcaaaaacgggac

SEQ ID NO: 494644 - DNA, 20 bp, Artificial Sequence
  chemically synthesized
tttgcccattgagcagaggc

SEQ ID NO: 494645 - DNA, 20 bp, Artificial Sequence
  chemically synthesized
aggctaggatttattataca

SEQ ID NO: 494646 - DNA, 20 bp, Artificial Sequence
  chemically synthesized
atataactatagagtaacaa

SEQ ID NO: 494647 - DNA, 20 bp, Artificial Sequence
  chemically synthesized
cagaatgtaatatataacta

SEQ ID NO: 494648 - DNA, 20 bp, Artificial Sequence
  chemically synthesized
aggtatctgaaatttgtttg

SEQ ID NO: 494649 - DNA, 20 bp, Artificial Sequence
  chemically synthesized
atttcagatacctcaagggc

SEQ ID NO: 494650 - DNA, 20 bp, Artificial Sequence
  chemically synthesized
gattagctgatttattggca

SEQ ID NO: 494651 - DNA, 20 bp, Artificial Sequence
  chemically synthesized
tttcaaggagatcccgtccc

SEQ ID NO: 494652 - DNA, 20 bp, Artificial Sequence
  chemically synthesized
attagaatgaattcgaggga

SEQ ID NO: 494653 - DNA, 20 bp, Artificial Sequence
  chemically synthesized
ctcttctaaaaattattaga

SEQ ID NO: 494654 - DNA, 20 bp, Artificial Sequence
  chemically synthesized
aactctcttctaaaaattat

SEQ ID NO: 494655 - DNA, 20 bp, Artificial Sequence
  chemically synthesized
cattctaataatttttagaa

SEQ ID NO: 494656 - DNA, 20 bp, Artificial Sequence
  chemically synthesized
tttttagaagagagttaaag

SEQ ID NO: 494657 - DNA, 20 bp, Artificial Sequence
  chemically synthesized
ctgcttgatcagaaacattg

SEQ ID NO: 494658 - DNA, 20 bp, Artificial Sequence
  chemically synthesized
gcaggtctgagatgaggcct

SEQ ID NO: 494659 - DNA, 20 bp, Artificial Sequence
  chemically synthesized
cctgaggatctatatttcta

SEQ ID NO: 494660 - DNA, 20 bp, Artificial Sequence
  chemically synthesized
cagcaacatcagcaccatct

SEQ ID NO: 494661 - DNA, 20 bp, Artificial Sequence
  chemically synthesized
tgatgttgctggtccagcga

SEQ ID NO: 494662 - DNA, 20 bp, Artificial Sequence
  chemically synthesized
tccagcgaaagagtgattta

SEQ ID NO: 494663 - DNA, 20 bp, Artificial Sequence
  chemically synthesized
tatgaccttcccgctgctac

SEQ ID NO: 494664 - DNA, 20 bp, Artificial Sequence
  chemically synthesized
agcagcgggaaggtcatatg

SEQ ID NO: 494665 - DNA, 20 bp, Artificial Sequence
  chemically synthesized
aaggtcatatggtgggttta

SEQ ID NO: 494666 - DNA, 20 bp, Artificial Sequence
  chemically synthesized
tggtgggtttagagggtgca

SEQ ID NO: 494667 - DNA, 20 bp, Artificial Sequence
  chemically synthesized
ccacaacatggcacttggag

SEQ ID NO: 494668 - DNA, 20 bp, Artificial Sequence
  chemically synthesized
tggacatcatggtaatggta

SEQ ID NO: 494669 - DNA, 20 bp, Artificial Sequence
  chemically synthesized
gtaaggaatgtagatattag

SEQ ID NO: 494670 - DNA, 20 bp, Artificial Sequence
  chemically synthesized
cagaaatttgtaaataacgg

SEQ ID NO: 494671 - DNA, 20 bp, Artificial Sequence
  chemically synthesized
agaaagaaaacaatagggca

SEQ ID NO: 494672 - DNA, 20 bp, Artificial Sequence
  chemically synthesized
gcagaggatatgtctacaca

SEQ ID NO: 494673 - DNA, 20 bp, Artificial Sequence
  chemically synthesized
cataatggcaagtagatatc

SEQ ID NO: 494674 - DNA, 20 bp, Artificial Sequence
  chemically synthesized
atgttgatgctatttaatag

SEQ ID NO: 494675 - DNA, 20 bp, Artificial Sequence
  chemically synthesized
ctattaaatagcatcaacat

SEQ ID NO: 494676 - DNA, 20 bp, Artificial Sequence
  chemically synthesized
ctgagaaatcggtgaaacac

SEQ ID NO: 494677 - DNA, 20 bp, Artificial Sequence
  chemically synthesized
ctgataagtaaaattacaac

SEQ ID NO: 494678 - DNA, 20 bp, Artificial Sequence
  chemically synthesized
atgttgtaattttacttatc

SEQ ID NO: 494679 - DNA, 20 bp, Artificial Sequence
  chemically synthesized
gtaacgcagctagttaacag

SEQ ID NO: 494680 - DNA, 20 bp, Artificial Sequence
  chemically synthesized
tttaattaattgacaacaat

SEQ ID NO: 494681 - DNA, 20 bp, Artificial Sequence
  chemically synthesized
taaaaacaaggtgcatccag

SEQ ID NO: 494682 - DNA, 20 bp, Artificial Sequence
  chemically synthesized
cattaactatagtcacccta

SEQ ID NO: 494683 - DNA, 20 bp, Artificial Sequence
  chemically synthesized
aatggtaaatgtttgaggtg

SEQ ID NO: 494684 - DNA, 20 bp, Artificial Sequence
  chemically synthesized
accatgtgtaattatcaaat

SEQ ID NO: 494685 - DNA, 20 bp, Artificial Sequence
  chemically synthesized
ataataattgtacatatttg

SEQ ID NO: 494686 - DNA, 20 bp, Artificial Sequence
  chemically synthesized
gcctcgatttcgttcatggg

SEQ ID NO: 494687 - DNA, 20 bp, Artificial Sequence
  chemically synthesized
tagggcatggaaaaagtcat

SEQ ID NO: 494688 - DNA, 20 bp, Artificial Sequence
  chemically synthesized
catgccctatttccaggcaa

SEQ ID NO: 494689 - DNA, 20 bp, Artificial Sequence
  chemically synthesized
agagtgtccttctaaaccag

SEQ ID NO: 494690 - DNA, 20 bp, Artificial Sequence
  chemically synthesized
agaacagccaatgctctcaa

SEQ ID NO: 494691 - DNA, 20 bp, Artificial Sequence
  chemically synthesized
cttgtgaaatcgagaaagga

SEQ ID NO: 494692 - DNA, 20 bp, Artificial Sequence
  chemically synthesized
aataaattcctagaatcgtc

SEQ ID NO: 494693 - DNA, 20 bp, Artificial Sequence
  chemically synthesized
aagcaactcctgacgattct

SEQ ID NO: 494694 - DNA, 20 bp, Artificial Sequence
  chemically synthesized
aaaattggacaataaattcc

SEQ ID NO: 494695 - DNA, 20 bp, Artificial Sequence
  chemically synthesized
ataatttgtgtctgagaggt

SEQ ID NO: 494696 - DNA, 20 bp, Artificial Sequence
  chemically synthesized
gacacaaattatattattac

SEQ ID NO: 494697 - DNA, 20 bp, Artificial Sequence
  chemically synthesized
tcagtattctattgttttat

SEQ ID NO: 494698 - DNA, 20 bp, Artificial Sequence
  chemically synthesized
cctaaatccaaataaaacaa

SEQ ID NO: 494699 - DNA, 20 bp, Artificial Sequence
  chemically synthesized
ccaaataaaacaatagaata

SEQ ID NO: 494700 - DNA, 20 bp, Artificial Sequence
  chemically synthesized
tattttcttgttttttttct

SEQ ID NO: 494701 - DNA, 20 bp, Artificial Sequence
  chemically synthesized
tttttctgagaatgtggtta

SEQ ID NO: 494702 - DNA, 20 bp, Artificial Sequence
  chemically synthesized
aaagaaaaatattgtgtgat

SEQ ID NO: 494703 - DNA, 20 bp, Artificial Sequence
  chemically synthesized
ccagctacaacattttctca

SEQ ID NO: 494704 - DNA, 20 bp, Artificial Sequence
  chemically synthesized
acaacattttctcacagaat

SEQ ID NO: 494705 - DNA, 20 bp, Artificial Sequence
  chemically synthesized
ataatctacatcagatttct

SEQ ID NO: 494706 - DNA, 20 bp, Artificial Sequence
  chemically synthesized
aggatggataaggggagaga

SEQ ID NO: 494707 - DNA, 20 bp, Artificial Sequence
  chemically synthesized
ttttagaagggctacacagg

SEQ ID NO: 494708 - DNA, 20 bp, Artificial Sequence
  chemically synthesized
ttctttttagaagggctaca

SEQ ID NO: 494709 - DNA, 20 bp, Artificial Sequence
  chemically synthesized
tcctgtgtagcccttctaaa

SEQ ID NO: 494710 - DNA, 20 bp, Artificial Sequence
  chemically synthesized
agcccttctaaaaagaatct

SEQ ID NO: 494711 - DNA, 20 bp, Artificial Sequence
  chemically synthesized
gaggaacaggcgatcataaa

SEQ ID NO: 494712 - DNA, 20 bp, Artificial Sequence
  chemically synthesized
ggggaaaggcataaggtgaa

SEQ ID NO: 494713 - DNA, 20 bp, Artificial Sequence
  chemically synthesized
tattaggggaaaggcataag

SEQ ID NO: 494714 - DNA, 20 bp, Artificial Sequence
  chemically synthesized
tcagaagtgtggacaacagc

SEQ ID NO: 494715 - DNA, 20 bp, Artificial Sequence
  chemically synthesized
agattagctcatctgggagg

SEQ ID NO: 494716 - DNA, 20 bp, Artificial Sequence
  chemically synthesized
ctaccaccttctccgtgaag

SEQ ID NO: 494717 - DNA, 20 bp, Artificial Sequence
  chemically synthesized
agtaaaatctgtgaaggaat

SEQ ID NO: 494718 - DNA, 20 bp, Artificial Sequence
  chemically synthesized
aggtacagtaaaatctgtga

SEQ ID NO: 494719 - DNA, 20 bp, Artificial Sequence
  chemically synthesized
agattttactgtacctatct

SEQ ID NO: 494720 - DNA, 20 bp, Artificial Sequence
  chemically synthesized
ccattgctaaatagtaacag

SEQ ID NO: 494721 - DNA, 20 bp, Artificial Sequence
  chemically synthesized
ccagctgttactatttagca

SEQ ID NO: 494722 - DNA, 20 bp, Artificial Sequence
  chemically synthesized
cactaattaaaagacatttg

SEQ ID NO: 494723 - DNA, 20 bp, Artificial Sequence
  chemically synthesized
gttaaaatgtagtaggaggt

SEQ ID NO: 494724 - DNA, 20 bp, Artificial Sequence
  chemically synthesized
aaacacaaaagaatagacca

SEQ ID NO: 494725 - DNA, 20 bp, Artificial Sequence
  chemically synthesized
atacaattagacaaacacaa

SEQ ID NO: 494726 - DNA, 20 bp, Artificial Sequence
  chemically synthesized
atgaagaaagtccttcatga

SEQ ID NO: 494727 - DNA, 20 bp, Artificial Sequence
  chemically synthesized
tatagagaaaaccaggcaag

SEQ ID NO: 494728 - DNA, 20 bp, Artificial Sequence
  chemically synthesized
agaagttgcttttgtctcct

SEQ ID NO: 494729 - DNA, 20 bp, Artificial Sequence
  chemically synthesized
agagtttgggaaaagagccc

SEQ ID NO: 494730 - DNA, 20 bp, Artificial Sequence
  chemically synthesized
tggatgaagtcttctaggag

SEQ ID NO: 494731 - DNA, 20 bp, Artificial Sequence
  chemically synthesized
tggtttttaaagacatggga

SEQ ID NO: 494732 - DNA, 20 bp, Artificial Sequence
  chemically synthesized
tttatttatttattttgaga

SEQ ID NO: 494733 - DNA, 20 bp, Artificial Sequence
  chemically synthesized
ctgcactccagcctgggcaa

SEQ ID NO: 494734 - DNA, 20 bp, Artificial Sequence
  chemically synthesized
tctcactctgttgcccaggc

SEQ ID NO: 494735 - DNA, 20 bp, Artificial Sequence
  chemically synthesized
tactcaggaggccgaggctg

SEQ ID NO: 494736 - DNA, 20 bp, Artificial Sequence
  chemically synthesized
gatccttcagcctcggcctc

SEQ ID NO: 494737 - DNA, 20 bp, Artificial Sequence
  chemically synthesized
cacacgcgcgcaaaaattaa

SEQ ID NO: 494738 - DNA, 20 bp, Artificial Sequence
  chemically synthesized
cccaggagtccaagaccagc

SEQ ID NO: 494739 - DNA, 20 bp, Artificial Sequence
  chemically synthesized
taggagaattacttgagccc

SEQ ID NO: 494740 - DNA, 20 bp, Artificial Sequence
  chemically synthesized
actttgggaggccaggatag

SEQ ID NO: 494741 - DNA, 20 bp, Artificial Sequence
  chemically synthesized
atcccagcactttgggaggc

SEQ ID NO: 494742 - DNA, 20 bp, Artificial Sequence
  chemically synthesized
atcctggcctcccaaagtgc

SEQ ID NO: 494743 - DNA, 20 bp, Artificial Sequence
  chemically synthesized
tcccaaagtgctgggattat

SEQ ID NO: 494744 - DNA, 20 bp, Artificial Sequence
  chemically synthesized
tgtgactggaataataacgt

SEQ ID NO: 494745 - DNA, 20 bp, Artificial Sequence
  chemically synthesized
ctgaagacagatactgtgac

SEQ ID NO: 494746 - DNA, 20 bp, Artificial Sequence
  chemically synthesized
tggaaatgctggaaagaaag

SEQ ID NO: 494747 - DNA, 20 bp, Artificial Sequence
  chemically synthesized
tttctttccagcatttccac

SEQ ID NO: 494748 - DNA, 20 bp, Artificial Sequence
  chemically synthesized
tcaagagtctctcttattat

SEQ ID NO: 494749 - DNA, 20 bp, Artificial Sequence
  chemically synthesized
gtacaaggtgtgatgaaatc

SEQ ID NO: 494750 - DNA, 20 bp, Artificial Sequence
  chemically synthesized
aaagtggaggaggaaaaagt

SEQ ID NO: 494751 - DNA, 20 bp, Artificial Sequence
  chemically synthesized
tgtaaagtatgagaataatt

SEQ ID NO: 494752 - DNA, 20 bp, Artificial Sequence
  chemically synthesized
atgaattagatgtaaagtat

SEQ ID NO: 494753 - DNA, 20 bp, Artificial Sequence
  chemically synthesized
agctgacaggatttgctgtg

SEQ ID NO: 494754 - DNA, 20 bp, Artificial Sequence
  chemically synthesized
cattttaaagacaaagctga

SEQ ID NO: 494755 - DNA, 20 bp, Artificial Sequence
  chemically synthesized
tcagttagagagctggtatt

SEQ ID NO: 494756 - DNA, 20 bp, Artificial Sequence
  chemically synthesized
ttcagactagggtggagtgg

SEQ ID NO: 494757 - DNA, 20 bp, Artificial Sequence
  chemically synthesized
agaggtggttcagactaggg

SEQ ID NO: 494758 - DNA, 20 bp, Artificial Sequence
  chemically synthesized
acatcagaggtggttcagac

SEQ ID NO: 494759 - DNA, 20 bp, Artificial Sequence
  chemically synthesized
agactgaaatggaagcaata

SEQ ID NO: 494760 - DNA, 20 bp, Artificial Sequence
  chemically synthesized
ctaacctctactcagcaatg

SEQ ID NO: 494761 - DNA, 20 bp, Artificial Sequence
  chemically synthesized
aaagagttcattcatcattg

SEQ ID NO: 494762 - DNA, 20 bp, Artificial Sequence
  chemically synthesized
tacctgatctgctttcttca

SEQ ID NO: 494763 - DNA, 20 bp, Artificial Sequence
  chemically synthesized
cattgaagaatttagaaaaa

SEQ ID NO: 494764 - DNA, 20 bp, Artificial Sequence
  chemically synthesized
attttgacaggacatcattg

SEQ ID NO: 494765 - DNA, 20 bp, Artificial Sequence
  chemically synthesized
atgtcctgtcaaaattatga

SEQ ID NO: 494766 - DNA, 20 bp, Artificial Sequence
  chemically synthesized
gatcttgcaggccgtgataa

SEQ ID NO: 494767 - DNA, 20 bp, Artificial Sequence
  chemically synthesized
taggcaagggcaagatcaca

SEQ ID NO: 494768 - DNA, 20 bp, Artificial Sequence
  chemically synthesized
ttccccaccttctcttacac

SEQ ID NO: 494769 - DNA, 20 bp, Artificial Sequence
  chemically synthesized
tgacctagccaacaaatagc

SEQ ID NO: 494770 - DNA, 20 bp, Artificial Sequence
  chemically synthesized
aggaaacaagggcaagggca

SEQ ID NO: 494771 - DNA, 20 bp, Artificial Sequence
  chemically synthesized
ttgcccttgtttcctctgcc

SEQ ID NO: 494772 - DNA, 20 bp, Artificial Sequence
  chemically synthesized
gaatgtttttgcccaaattg

SEQ ID NO: 494773 - DNA, 20 bp, Artificial Sequence
  chemically synthesized
ggtggacttgtttagattgg

SEQ ID NO: 494774 - DNA, 20 bp, Artificial Sequence
  chemically synthesized
tgaaggtggacttgtttaga

SEQ ID NO: 494775 - DNA, 20 bp, Artificial Sequence
  chemically synthesized
ttggaaataaagctggttaa

SEQ ID NO: 494776 - DNA, 20 bp, Artificial Sequence
  chemically synthesized
taaccagctttatttccaat

SEQ ID NO: 494777 - DNA, 20 bp, Artificial Sequence
  chemically synthesized
tacactctagtagtgagcta

SEQ ID NO: 494778 - DNA, 20 bp, Artificial Sequence
  chemically synthesized
tttattctctagctcactac

SEQ ID NO: 494779 - DNA, 20 bp, Artificial Sequence
  chemically synthesized
atgccaggtacttgggatac

SEQ ID NO: 494780 - DNA, 20 bp, Artificial Sequence
  chemically synthesized
catgatatatgccaggtact

SEQ ID NO: 494781 - DNA, 20 bp, Artificial Sequence
  chemically synthesized
atgtacttcacaaatatctg

SEQ ID NO: 494782 - DNA, 20 bp, Artificial Sequence
  chemically synthesized
gttttgagctaaagccattt

SEQ ID NO: 494783 - DNA, 20 bp, Artificial Sequence
  chemically synthesized
tttgcttttaggcagatagg

SEQ ID NO: 494784 - DNA, 20 bp, Artificial Sequence
  chemically synthesized
taaaggaggatttaaaacag

SEQ ID NO: 494785 - DNA, 20 bp, Artificial Sequence
  chemically synthesized
gcaagaaactttccttaaag

SEQ ID NO: 494786 - DNA, 20 bp, Artificial Sequence
  chemically synthesized
taaggaaagtttcttgcacc

SEQ ID NO: 494787 - DNA, 20 bp, Artificial Sequence
  chemically synthesized
agtttcttgcaccaggggta

SEQ ID NO: 494788 - DNA, 20 bp, Artificial Sequence
  chemically synthesized
aacttctcatctctggtgac

SEQ ID NO: 494789 - DNA, 20 bp, Artificial Sequence
  chemically synthesized
ggttttgaaaagaagagtgt

SEQ ID NO: 494790 - DNA, 20 bp, Artificial Sequence
  chemically synthesized
ttaacaagggttttgaaaag

SEQ ID NO: 494791 - DNA, 20 bp, Artificial Sequence
  chemically synthesized
ggcttatgtactattttaac

SEQ ID NO: 494792 - DNA, 20 bp, Artificial Sequence
  chemically synthesized
aaaacatagctcaatgaagt

SEQ ID NO: 494793 - DNA, 20 bp, Artificial Sequence
  chemically synthesized
gtgagctcccacatacttct

SEQ ID NO: 494794 - DNA, 20 bp, Artificial Sequence
  chemically synthesized
ccaagtaatgaacctaagag

SEQ ID NO: 494795 - DNA, 20 bp, Artificial Sequence
  chemically synthesized
acaaatggacacatcaataa

SEQ ID NO: 494796 - DNA, 20 bp, Artificial Sequence
  chemically synthesized
cacatcaataaatggatagc

SEQ ID NO: 494797 - DNA, 20 bp, Artificial Sequence
  chemically synthesized
tgtgatcaataaaaatgtaa

SEQ ID NO: 494798 - DNA, 20 bp, Artificial Sequence
  chemically synthesized
accagtgccagacgacaaat

SEQ ID NO: 494799 - DNA, 20 bp, Artificial Sequence
  chemically synthesized
cttctaatgccctttctctt

SEQ ID NO: 494800 - DNA, 20 bp, Artificial Sequence
  chemically synthesized
atttgatctcactcctagtt

SEQ ID NO: 494801 - DNA, 20 bp, Artificial Sequence
  chemically synthesized
cattctgatgactcccaact

SEQ ID NO: 494802 - DNA, 20 bp, Artificial Sequence
  chemically synthesized
cactcctagttgggagtcat

SEQ ID NO: 494803 - DNA, 20 bp, Artificial Sequence
  chemically synthesized
aaatatgtcaaaagacacat

SEQ ID NO: 494804 - DNA, 20 bp, Artificial Sequence
  chemically synthesized
attctgtggaaccgtattag

SEQ ID NO: 494805 - DNA, 20 bp, Artificial Sequence
  chemically synthesized
attctactaatacggttcca

SEQ ID NO: 494806 - DNA, 20 bp, Artificial Sequence
  chemically synthesized
agagggggcactgctgggac

SEQ ID NO: 494807 - DNA, 20 bp, Artificial Sequence
  chemically synthesized
tggcagtaagaagatttatg

SEQ ID NO: 494808 - DNA, 20 bp, Artificial Sequence
  chemically synthesized
gtcagctcgaagaggttgga

SEQ ID NO: 494809 - DNA, 20 bp, Artificial Sequence
  chemically synthesized
taaaaaccagcagaaggttc

SEQ ID NO: 494810 - DNA, 20 bp, Artificial Sequence
  chemically synthesized
ttcatgaatgcatatgggag

SEQ ID NO: 494811 - DNA, 20 bp, Artificial Sequence
  chemically synthesized
tgaatgcatatgggagaaga

SEQ ID NO: 494812 - DNA, 20 bp, Artificial Sequence
  chemically synthesized
acaaggttaaatcatagcct

SEQ ID NO: 494813 - DNA, 20 bp, Artificial Sequence
  chemically synthesized
aggcttcctctctgatttgg

SEQ ID NO: 494814 - DNA, 20 bp, Artificial Sequence
  chemically synthesized
aagcctgcctacagggcact

SEQ ID NO: 494815 - DNA, 20 bp, Artificial Sequence
  chemically synthesized
ttaaccaataggtttgtttg

SEQ ID NO: 494816 - DNA, 20 bp, Artificial Sequence
  chemically synthesized
aggtttgtttgggggatggt

SEQ ID NO: 494817 - DNA, 20 bp, Artificial Sequence
  chemically synthesized
gtttgggggatggtttggat

SEQ ID NO: 494818 - DNA, 20 bp, Artificial Sequence
  chemically synthesized
gatcttctatatggacctag

SEQ ID NO: 494819 - DNA, 20 bp, Artificial Sequence
  chemically synthesized
aaggattatcatcagagaca

SEQ ID NO: 494820 - DNA, 20 bp, Artificial Sequence
  chemically synthesized
accagagaggctgggcagaa

SEQ ID NO: 494821 - DNA, 20 bp, Artificial Sequence
  chemically synthesized
aactgtaaaatcatctattt

SEQ ID NO: 494822 - DNA, 20 bp, Artificial Sequence
  chemically synthesized
agcctaggattgagaatttc

SEQ ID NO: 494823 - DNA, 20 bp, Artificial Sequence
  chemically synthesized
aaaactgctagcctaggatt

SEQ ID NO: 494824 - DNA, 20 bp, Artificial Sequence
  chemically synthesized
gttgcagaaaactgctagcc

SEQ ID NO: 494825 - DNA, 20 bp, Artificial Sequence
  chemically synthesized
tgtaatgttattggaaacct

SEQ ID NO: 494826 - DNA, 20 bp, Artificial Sequence
  chemically synthesized
aaataatatacttcttgtcc

SEQ ID NO: 494827 - DNA, 20 bp, Artificial Sequence
  chemically synthesized
ataaactttactgtgtaaaa

SEQ ID NO: 494828 - DNA, 20 bp, Artificial Sequence
  chemically synthesized
tttcccaaaaccctgtgttt

SEQ ID NO: 494829 - DNA, 20 bp, Artificial Sequence
  chemically synthesized
taattgaaaatccagaaaca

SEQ ID NO: 494830 - DNA, 20 bp, Artificial Sequence
  chemically synthesized
tcatagttcaaaaggtgaca

SEQ ID NO: 494831 - DNA, 20 bp, Artificial Sequence
  chemically synthesized
tgacagggaatagcagccta

SEQ ID NO: 494832 - DNA, 20 bp, Artificial Sequence
  chemically synthesized
tggagcttaaccatggctca

SEQ ID NO: 494833 - DNA, 20 bp, Artificial Sequence
  chemically synthesized
catagagggggagaagttcc

SEQ ID NO: 494834 - DNA, 20 bp, Artificial Sequence
  chemically synthesized
gtagctgtggggtgagacct

SEQ ID NO: 494835 - DNA, 20 bp, Artificial Sequence
  chemically synthesized
gagttctgataaggtagctg

SEQ ID NO: 494836 - DNA, 20 bp, Artificial Sequence
  chemically synthesized
gctaccttatcagaactcct

SEQ ID NO: 494837 - DNA, 20 bp, Artificial Sequence
  chemically synthesized
gattgctgtgccccactcgt

SEQ ID NO: 494838 - DNA, 20 bp, Artificial Sequence
  chemically synthesized
gcacagcaatcagtatttta

SEQ ID NO: 494839 - DNA, 20 bp, Artificial Sequence
  chemically synthesized
gtcacctggaaattttgatg

SEQ ID NO: 494840 - DNA, 20 bp, Artificial Sequence
  chemically synthesized
tctctggtgccgaaaaggtt

SEQ ID NO: 494841 - DNA, 20 bp, Artificial Sequence
  chemically synthesized
tagaggaagacaatttttcc

SEQ ID NO: 494842 - DNA, 20 bp, Artificial Sequence
  chemically synthesized
aatttttccatggatcaggg

SEQ ID NO: 494843 - DNA, 20 bp, Artificial Sequence
  chemically synthesized
ttccatggatcaggggcggg

SEQ ID NO: 494844 - DNA, 20 bp, Artificial Sequence
  chemically synthesized
tgcgtgggaggcgatggttt

SEQ ID NO: 494845 - DNA, 20 bp, Artificial Sequence
  chemically synthesized
ctaggttgtgtgctccttat

SEQ ID NO: 494846 - DNA, 20 bp, Artificial Sequence
  chemically synthesized
tattgtgaactgtccacacg

SEQ ID NO: 494847 - DNA, 20 bp, Artificial Sequence
  chemically synthesized
ctcgtgtggacagttcacaa

SEQ ID NO: 494848 - DNA, 20 bp, Artificial Sequence
  chemically synthesized
aatagggttcgtgatcctat

SEQ ID NO: 494849 - DNA, 20 bp, Artificial Sequence
  chemically synthesized
gcagcggtattagattctca

SEQ ID NO: 494850 - DNA, 20 bp, Artificial Sequence
  chemically synthesized
ggcttttaacactatagagc

SEQ ID NO: 494851 - DNA, 20 bp, Artificial Sequence
  chemically synthesized
ttttgcatttttagtagaga

SEQ ID NO: 494852 - DNA, 20 bp, Artificial Sequence
  chemically synthesized
gccacagcctcccaagtagc

SEQ ID NO: 494853 - DNA, 20 bp, Artificial Sequence
  chemically synthesized
tacttgggaggctgtggcat

SEQ ID NO: 494854 - DNA, 20 bp, Artificial Sequence
  chemically synthesized
gtcatccaggtgaagtgccc

SEQ ID NO: 494855 - DNA, 20 bp, Artificial Sequence
  chemically synthesized
atcatcccagggcacttcac

SEQ ID NO: 494856 - DNA, 20 bp, Artificial Sequence
  chemically synthesized
agggcacttcacctggatga

SEQ ID NO: 494857 - DNA, 20 bp, Artificial Sequence
  chemically synthesized
aaaaaaaaaaaaaaagccaa

SEQ ID NO: 494858 - DNA, 20 bp, Artificial Sequence
  chemically synthesized
gccaaaaggattagagcaca

SEQ ID NO: 494859 - DNA, 20 bp, Artificial Sequence
  chemically synthesized
acatactgtcaccttgcaaa

SEQ ID NO: 494860 - DNA, 20 bp, Artificial Sequence
  chemically synthesized
cctaatcttggttttaggac

SEQ ID NO: 494861 - DNA, 20 bp, Artificial Sequence
  chemically synthesized
aaaacagacttgagattcat

SEQ ID NO: 494862 - DNA, 20 bp, Artificial Sequence
  chemically synthesized
gtaatgggaccttgactcaa

SEQ ID NO: 494863 - DNA, 20 bp, Artificial Sequence
  chemically synthesized
tgtgttcatctcaggagtta

SEQ ID NO: 494864 - DNA, 20 bp, Artificial Sequence
  chemically synthesized
atgggcattgtgttcatctc

SEQ ID NO: 494865 - DNA, 20 bp, Artificial Sequence
  chemically synthesized
acacaatgcccatatataac

SEQ ID NO: 494866 - DNA, 20 bp, Artificial Sequence
  chemically synthesized
aggaggcagtatcagaagat

SEQ ID NO: 494867 - DNA, 20 bp, Artificial Sequence
  chemically synthesized
catctgattgatgtttatct

SEQ ID NO: 494868 - DNA, 20 bp, Artificial Sequence
  chemically synthesized
atgcgaactgtttcttcttt

SEQ ID NO: 494869 - DNA, 20 bp, Artificial Sequence
  chemically synthesized
aatgaagaatgaaagcaggg

SEQ ID NO: 494870 - DNA, 20 bp, Artificial Sequence
  chemically synthesized
gtggaatcagtcccaaaatg

SEQ ID NO: 494871 - DNA, 20 bp, Artificial Sequence
  chemically synthesized
ttgggactgattccacagcc

SEQ ID NO: 494872 - DNA, 20 bp, Artificial Sequence
  chemically synthesized
gtgatggccacccagggctg

SEQ ID NO: 494873 - DNA, 20 bp, Artificial Sequence
  chemically synthesized
tgcactgaaaagggtgacca

SEQ ID NO: 494874 - DNA, 20 bp, Artificial Sequence
  chemically synthesized
ttgcaagactgtgcactgaa

SEQ ID NO: 494875 - DNA, 20 bp, Artificial Sequence
  chemically synthesized
ttgatagttgataacttttg

SEQ ID NO: 494876 - DNA, 20 bp, Artificial Sequence
  chemically synthesized
tagttgataacttttgatga

SEQ ID NO: 494877 - DNA, 20 bp, Artificial Sequence
  chemically synthesized
cttttgatgaatgaatgaac

SEQ ID NO: 494878 - DNA, 20 bp, Artificial Sequence
  chemically synthesized
gaatccagacacatttgttt

SEQ ID NO: 494879 - DNA, 20 bp, Artificial Sequence
  chemically synthesized
ttatccttaaacaaatgtgt

SEQ ID NO: 494880 - DNA, 20 bp, Artificial Sequence
  chemically synthesized
acaaatgtgtctggattcag

SEQ ID NO: 494881 - DNA, 20 bp, Artificial Sequence
  chemically synthesized
tcgaagggaaaatgattctt

SEQ ID NO: 494882 - DNA, 20 bp, Artificial Sequence
  chemically synthesized
ctttatgctcacaaatgtgt

SEQ ID NO: 494883 - DNA, 20 bp, Artificial Sequence
  chemically synthesized
acaaatgtgttgggattcag

SEQ ID NO: 494884 - DNA, 20 bp, Artificial Sequence
  chemically synthesized
atgaaaaggttggaattctt

SEQ ID NO: 494885 - DNA, 20 bp, Artificial Sequence
  chemically synthesized
gacaaggcaaatgaaaaggt

SEQ ID NO: 494886 - DNA, 20 bp, Artificial Sequence
  chemically synthesized
cagtaactttggtgcaggtc

SEQ ID NO: 494887 - DNA, 20 bp, Artificial Sequence
  chemically synthesized
actcacgtcagaatcagctg

SEQ ID NO: 494888 - DNA, 20 bp, Artificial Sequence
  chemically synthesized
accctccagctgattctgac

SEQ ID NO: 494889 - DNA, 20 bp, Artificial Sequence
  chemically synthesized
taggccagtagtactcacgt

SEQ ID NO: 494890 - DNA, 20 bp, Artificial Sequence
  chemically synthesized
tgacgtgagtactactggcc

SEQ ID NO: 494891 - DNA, 20 bp, Artificial Sequence
  chemically synthesized
actttggtataactaccagt

SEQ ID NO: 494892 - DNA, 20 bp, Artificial Sequence
  chemically synthesized
agacactgattcagtaggtt

SEQ ID NO: 494893 - DNA, 20 bp, Artificial Sequence
  chemically synthesized
tgcccttcatcccaaaccta

SEQ ID NO: 494894 - DNA, 20 bp, Artificial Sequence
  chemically synthesized
atgatgctgaaaggtgtttt

SEQ ID NO: 494895 - DNA, 20 bp, Artificial Sequence
  chemically synthesized
aaggtgttttatggattcag

SEQ ID NO: 494896 - DNA, 20 bp, Artificial Sequence
  chemically synthesized
acgaatgtgttgagactctt

SEQ ID NO: 494897 - DNA, 20 bp, Artificial Sequence
  chemically synthesized
ttcccttcaactttatgctc

SEQ ID NO: 494898 - DNA, 20 bp, Artificial Sequence
  chemically synthesized
ttgaagggaaaaaatgttta

SEQ ID NO: 494899 - DNA, 20 bp, Artificial Sequence
  chemically synthesized
aaatgtttaatgaatttgcc

SEQ ID NO: 494900 - DNA, 20 bp, Artificial Sequence
  chemically synthesized
ccttgattataaatgaagtt

SEQ ID NO: 494901 - DNA, 20 bp, Artificial Sequence
  chemically synthesized
ataatcccaactgaatttgt

SEQ ID NO: 494902 - DNA, 20 bp, Artificial Sequence
  chemically synthesized
caaactcatacaaattcagt

SEQ ID NO: 494903 - DNA, 20 bp, Artificial Sequence
  chemically synthesized
gaagttgtaaataatcccaa

SEQ ID NO: 494904 - DNA, 20 bp, Artificial Sequence
  chemically synthesized
ttgggattatttacaacttc

SEQ ID NO: 494905 - DNA, 20 bp, Artificial Sequence
  chemically synthesized
gggttacttgcaattgtata

SEQ ID NO: 494906 - DNA, 20 bp, Artificial Sequence
  chemically synthesized
aaggtggttaatgagccact

SEQ ID NO: 494907 - DNA, 20 bp, Artificial Sequence
  chemically synthesized
ggtcagtaaatcagagaagc

SEQ ID NO: 494908 - DNA, 20 bp, Artificial Sequence
  chemically synthesized
gcaattgggatttgagcagc

SEQ ID NO: 494909 - DNA, 20 bp, Artificial Sequence
  chemically synthesized
tgcctcaatcaggttgcaat

SEQ ID NO: 494910 - DNA, 20 bp, Artificial Sequence
  chemically synthesized
gattgaggcattattagtat

SEQ ID NO: 494911 - DNA, 20 bp, Artificial Sequence
  chemically synthesized
aagtgactgcccaagccaca

SEQ ID NO: 494912 - DNA, 20 bp, Artificial Sequence
  chemically synthesized
atgcattgcacgtatctacc

SEQ ID NO: 494913 - DNA, 20 bp, Artificial Sequence
  chemically synthesized
ttgagatcgaaagacaaaaa

SEQ ID NO: 494914 - DNA, 20 bp, Artificial Sequence
  chemically synthesized
gaagtgtggcagtcacaaag

SEQ ID NO: 494915 - DNA, 20 bp, Artificial Sequence
  chemically synthesized
ttggcttttgtgctaaaaat

SEQ ID NO: 494916 - DNA, 20 bp, Artificial Sequence
  chemically synthesized
ttagcacaaaagccaaaagg

SEQ ID NO: 494917 - DNA, 20 bp, Artificial Sequence
  chemically synthesized
catcttggttaggctctgtg

SEQ ID NO: 494918 - DNA, 20 bp, Artificial Sequence
  chemically synthesized
gtcagcagtccacaggcagc

SEQ ID NO: 494919 - DNA, 20 bp, Artificial Sequence
  chemically synthesized
aacgttatttagccacttaa

SEQ ID NO: 494920 - DNA, 20 bp, Artificial Sequence
  chemically synthesized
tatatgtattcggttttatt

SEQ ID NO: 494921 - DNA, 20 bp, Artificial Sequence
  chemically synthesized
cttctgcattctgaataaaa

SEQ ID NO: 494922 - DNA, 20 bp, Artificial Sequence
  chemically synthesized
cgcagatacacttctgcatt

SEQ ID NO: 494923 - DNA, 20 bp, Artificial Sequence
  chemically synthesized
gagagcagaagggcattgga

SEQ ID NO: 494924 - DNA, 20 bp, Artificial Sequence
  chemically synthesized
gcttttccttttggcatata

SEQ ID NO: 494925 - DNA, 20 bp, Artificial Sequence
  chemically synthesized
cacagacaacagtggcatat

SEQ ID NO: 494926 - DNA, 20 bp, Artificial Sequence
  chemically synthesized
atttgagttagaaaataaac

SEQ ID NO: 494927 - DNA, 20 bp, Artificial Sequence
  chemically synthesized
ataaacaagggtgtgcattt

SEQ ID NO: 494928 - DNA, 20 bp, Artificial Sequence
  chemically synthesized
gacaaaaatcaaataaatct

SEQ ID NO: 494929 - DNA, 20 bp, Artificial Sequence
  chemically synthesized
tgtccaaccactacaaagta

SEQ ID NO: 494930 - DNA, 20 bp, Artificial Sequence
  chemically synthesized
ctacaaagtaaggagtaaac

SEQ ID NO: 494931 - DNA, 20 bp, Artificial Sequence
  chemically synthesized
aggagtaaacgtgaatatga

SEQ ID NO: 494932 - DNA, 20 bp, Artificial Sequence
  chemically synthesized
caaggaaaggtgctgaagac

SEQ ID NO: 494933 - DNA, 20 bp, Artificial Sequence
  chemically synthesized
agcacctttccttggcaagt

SEQ ID NO: 494934 - DNA, 20 bp, Artificial Sequence
  chemically synthesized
ttgtgttagttctgtttcct

SEQ ID NO: 494935 - DNA, 20 bp, Artificial Sequence
  chemically synthesized
tggccaatgacttcacaggc

SEQ ID NO: 494936 - DNA, 20 bp, Artificial Sequence
  chemically synthesized
cagattgctaggttagcctt

SEQ ID NO: 494937 - DNA, 20 bp, Artificial Sequence
  chemically synthesized
actcacatcagaatcagctg

SEQ ID NO: 494938 - DNA, 20 bp, Artificial Sequence
  chemically synthesized
accctccagctgattctgat

SEQ ID NO: 494939 - DNA, 20 bp, Artificial Sequence
  chemically synthesized
taggccagtaatactcacat

SEQ ID NO: 494940 - DNA, 20 bp, Artificial Sequence
  chemically synthesized
tgatgtgagtattactggcc

SEQ ID NO: 494941 - DNA, 20 bp, Artificial Sequence
  chemically synthesized
agacactgattcaataggtt

SEQ ID NO: 494942 - DNA, 20 bp, Artificial Sequence
  chemically synthesized
tacccttcatcccaaaccta

SEQ ID NO: 494943 - DNA, 20 bp, Artificial Sequence
  chemically synthesized
gattcaataggtttgggatg

SEQ ID NO: 494944 - DNA, 20 bp, Artificial Sequence
  chemically synthesized
ataggtttgggatgaagggt

SEQ ID NO: 494945 - DNA, 20 bp, Artificial Sequence
  chemically synthesized
gcaatccagataacacctta

SEQ ID NO: 494946 - DNA, 20 bp, Artificial Sequence
  chemically synthesized
atgattctgtaaggtgttat

SEQ ID NO: 494947 - DNA, 20 bp, Artificial Sequence
  chemically synthesized
atctcaaaaaatttcacaga

SEQ ID NO: 494948 - DNA, 20 bp, Artificial Sequence
  chemically synthesized
ttattcagaaacatttagag

SEQ ID NO: 494949 - DNA, 20 bp, Artificial Sequence
  chemically synthesized
acattcctctctaaatgttt

SEQ ID NO: 494950 - DNA, 20 bp, Artificial Sequence
  chemically synthesized
agagaaaaaaggttcacatt

SEQ ID NO: 494951 - DNA, 20 bp, Artificial Sequence
  chemically synthesized
aaactaccactgaagtctgt

SEQ ID NO: 494952 - DNA, 20 bp, Artificial Sequence
  chemically synthesized
ttttaaattgttgttattta

SEQ ID NO: 494953 - DNA, 20 bp, Artificial Sequence
  chemically synthesized
atgtgagaagaaaagtcctt

SEQ ID NO: 494954 - DNA, 20 bp, Artificial Sequence
  chemically synthesized
gtgttttagaaaaccgatta

SEQ ID NO: 494955 - DNA, 20 bp, Artificial Sequence
  chemically synthesized
gcagtgaagacgctttgacc

SEQ ID NO: 494956 - DNA, 20 bp, Artificial Sequence
  chemically synthesized
cttgtatacatacataccac

SEQ ID NO: 494957 - DNA, 20 bp, Artificial Sequence
  chemically synthesized
taccacatgaatacaggaag

SEQ ID NO: 494958 - DNA, 20 bp, Artificial Sequence
  chemically synthesized
gaatactaaaacctagtaag

SEQ ID NO: 494959 - DNA, 20 bp, Artificial Sequence
  chemically synthesized
gaaaaaaatctgtcttgtta

SEQ ID NO: 494960 - DNA, 20 bp, Artificial Sequence
  chemically synthesized
tcttcccgtggttctttaac

SEQ ID NO: 494961 - DNA, 20 bp, Artificial Sequence
  chemically synthesized
tctttaacttgagtgtgcgt

SEQ ID NO: 494962 - DNA, 20 bp, Artificial Sequence
  chemically synthesized
atctgcgggctccactctcc

SEQ ID NO: 494963 - DNA, 20 bp, Artificial Sequence
  chemically synthesized
tactgaaacagaaattcttg

SEQ ID NO: 494964 - DNA, 20 bp, Artificial Sequence
  chemically synthesized
gtaggtctgttgtgaggctc

SEQ ID NO: 494965 - DNA, 20 bp, Artificial Sequence
  chemically synthesized
gggtcccagatcagcatcac

SEQ ID NO: 494966 - DNA, 20 bp, Artificial Sequence
  chemically synthesized
agagcagttgttttcaaagt

SEQ ID NO: 494967 - DNA, 20 bp, Artificial Sequence
  chemically synthesized
gacacattcatttcccccta

SEQ ID NO: 494968 - DNA, 20 bp, Artificial Sequence
  chemically synthesized
gctctactccatagggggaa

SEQ ID NO: 494969 - DNA, 20 bp, Artificial Sequence
  chemically synthesized
gaaacatgaaaggttagaca

SEQ ID NO: 494970 - DNA, 20 bp, Artificial Sequence
  chemically synthesized
ggtggaatttattttacttc

SEQ ID NO: 494971 - DNA, 20 bp, Artificial Sequence
  chemically synthesized
ttataggtatagttaagagg

SEQ ID NO: 494972 - DNA, 20 bp, Artificial Sequence
  chemically synthesized
ttaggctggcctgtgaaaca

SEQ ID NO: 494973 - DNA, 20 bp, Artificial Sequence
  chemically synthesized
aaatttaccactttatctta

SEQ ID NO: 494974 - DNA, 20 bp, Artificial Sequence
  chemically synthesized
tatcttatagagttgtctgt

SEQ ID NO: 494975 - DNA, 20 bp, Artificial Sequence
  chemically synthesized
gctcactatatcataagaaa

SEQ ID NO: 494976 - DNA, 20 bp, Artificial Sequence
  chemically synthesized
aatctatgacagacataaag

SEQ ID NO: 494977 - DNA, 20 bp, Artificial Sequence
  chemically synthesized
ccataaaatttctaccaatc

SEQ ID NO: 494978 - DNA, 20 bp, Artificial Sequence
  chemically synthesized
atcaatagtgtaccttacct

SEQ ID NO: 494979 - DNA, 20 bp, Artificial Sequence
  chemically synthesized
tacactattgatttcaatgt

SEQ ID NO: 494980 - DNA, 20 bp, Artificial Sequence
  chemically synthesized
taaaacaattcacatgtgta

SEQ ID NO: 494981 - DNA, 20 bp, Artificial Sequence
  chemically synthesized
atgtttaattcattacacat

SEQ ID NO: 494982 - DNA, 20 bp, Artificial Sequence
  chemically synthesized
tgctgtagaaataccatata

SEQ ID NO: 494983 - DNA, 20 bp, Artificial Sequence
  chemically synthesized
caatataaagttttgttaaa

SEQ ID NO: 494984 - DNA, 20 bp, Artificial Sequence
  chemically synthesized
tatattagatatttccagca

SEQ ID NO: 494985 - DNA, 20 bp, Artificial Sequence
  chemically synthesized
aacttcgtagaggtattgcg

SEQ ID NO: 494986 - DNA, 20 bp, Artificial Sequence
  chemically synthesized
catttcttagctgtgtgatt

SEQ ID NO: 494987 - DNA, 20 bp, Artificial Sequence
  chemically synthesized
tagcttcggacaacgttggt

SEQ ID NO: 494988 - DNA, 20 bp, Artificial Sequence
  chemically synthesized
ggaccaacgttgtccgaagc

SEQ ID NO: 494989 - DNA, 20 bp, Artificial Sequence
  chemically synthesized
gggctaaccctgtcttcgga

SEQ ID NO: 494990 - DNA, 20 bp, Artificial Sequence
  chemically synthesized
gtattgactcattccgaaga

SEQ ID NO: 494991 - DNA, 20 bp, Artificial Sequence
  chemically synthesized
ctaagggctaaccctgtctt

SEQ ID NO: 494992 - DNA, 20 bp, Artificial Sequence
  chemically synthesized
gtttaaacagtagaaagtaa

SEQ ID NO: 494993 - DNA, 20 bp, Artificial Sequence
  chemically synthesized
tgtttaaacctgagcgaaac

SEQ ID NO: 494994 - DNA, 20 bp, Artificial Sequence
  chemically synthesized
tccaaaaaagagctcccctt

SEQ ID NO: 494995 - DNA, 20 bp, Artificial Sequence
  chemically synthesized
ccccaaaggggagctctttt

SEQ ID NO: 494996 - DNA, 20 bp, Artificial Sequence
  chemically synthesized
aagagaaatttattgaattg

SEQ ID NO: 494997 - DNA, 20 bp, Artificial Sequence
  chemically synthesized
aaatattcaagagaaattta

SEQ ID NO: 494998 - DNA, 20 bp, Artificial Sequence
  chemically synthesized
atcaattcaataaatttctc

SEQ ID NO: 494999 - DNA, 20 bp, Artificial Sequence
  chemically synthesized
tgtacaattactgtggttct

SEQ ID NO: 495000 - DNA, 20 bp, Artificial Sequence
  chemically synthesized
gtggttctatgaattcagtg

SEQ ID NO: 495001 - DNA, 20 bp, Artificial Sequence
  chemically synthesized
cattctttacttactcacca

SEQ ID NO: 495002 - DNA, 20 bp, Artificial Sequence
  chemically synthesized
aattcagtggtgagtaagta

SEQ ID NO: 495003 - DNA, 20 bp, Artificial Sequence
  chemically synthesized
taaagaatgcccaatatcta

SEQ ID NO: 495004 - DNA, 20 bp, Artificial Sequence
  chemically synthesized
taattacatgttatttgtgt

SEQ ID NO: 495005 - DNA, 20 bp, Artificial Sequence
  chemically synthesized
aaataacatgtaattacaaa

SEQ ID NO: 495006 - DNA, 20 bp, Artificial Sequence
  chemically synthesized
atgtaattacaaactgaatt

SEQ ID NO: 495007 - DNA, 20 bp, Artificial Sequence
  chemically synthesized
ctggtcaccccctccacaaa

SEQ ID NO: 495008 - DNA, 20 bp, Artificial Sequence
  chemically synthesized
gacttaattcaatttgtgga

SEQ ID NO: 495009 - DNA, 20 bp, Artificial Sequence
  chemically synthesized
ggtaagacgggcaggaaaac

SEQ ID NO: 495010 - DNA, 20 bp, Artificial Sequence
  chemically synthesized
ggcaggaaaacgtgagtgtg

SEQ ID NO: 495011 - DNA, 20 bp, Artificial Sequence
  chemically synthesized
ggaaaacgtgagtgtgtgga

SEQ ID NO: 495012 - DNA, 20 bp, Artificial Sequence
  chemically synthesized
tgagcagattccctgacaaa

SEQ ID NO: 495013 - DNA, 20 bp, Artificial Sequence
  chemically synthesized
acgtactattccgtttgtca

SEQ ID NO: 495014 - DNA, 20 bp, Artificial Sequence
  chemically synthesized
aaaaacaaagttagtgtagt

SEQ ID NO: 495015 - DNA, 20 bp, Artificial Sequence
  chemically synthesized
gttagtgtagttggagtaca

SEQ ID NO: 495016 - DNA, 20 bp, Artificial Sequence
  chemically synthesized
acagagaatgagcagatgag

SEQ ID NO: 495017 - DNA, 20 bp, Artificial Sequence
  chemically synthesized
tctgtaggcagaacagtctg

SEQ ID NO: 495018 - DNA, 20 bp, Artificial Sequence
  chemically synthesized
cagaacagtctggtgggtag

SEQ ID NO: 495019 - DNA, 20 bp, Artificial Sequence
  chemically synthesized
aagctaccatcgtctctcat

SEQ ID NO: 495020 - DNA, 20 bp, Artificial Sequence
  chemically synthesized
gagacgatggtagcttgcac

SEQ ID NO: 495021 - DNA, 20 bp, Artificial Sequence
  chemically synthesized
gtagttgacggacagtgagg

SEQ ID NO: 495022 - DNA, 20 bp, Artificial Sequence
  chemically synthesized
cagttaagcaagccaaaagt

SEQ ID NO: 495023 - DNA, 20 bp, Artificial Sequence
  chemically synthesized
cagacttttggcttgcttaa

SEQ ID NO: 495024 - DNA, 20 bp, Artificial Sequence
  chemically synthesized
aactggatagtgtcattcac

SEQ ID NO: 495025 - DNA, 20 bp, Artificial Sequence
  chemically synthesized
atccaggttcctccatccca

SEQ ID NO: 495026 - DNA, 20 bp, Artificial Sequence
  chemically synthesized
attcactgggatggaggaac

SEQ ID NO: 495027 - DNA, 20 bp, Artificial Sequence
  chemically synthesized
tggaggaacctggatgtgta

SEQ ID NO: 495028 - DNA, 20 bp, Artificial Sequence
  chemically synthesized
cagactcaacaaggaccaaa

SEQ ID NO: 495029 - DNA, 20 bp, Artificial Sequence
  chemically synthesized
aacattcagtttggtccttg

SEQ ID NO: 495030 - DNA, 20 bp, Artificial Sequence
  chemically synthesized
cagtttggtccttgttgagt

SEQ ID NO: 495031 - DNA, 20 bp, Artificial Sequence
  chemically synthesized
tggagatgtcaattaggcag

SEQ ID NO: 495032 - DNA, 20 bp, Artificial Sequence
  chemically synthesized
tataagactagcattcaaat

SEQ ID NO: 495033 - DNA, 20 bp, Artificial Sequence
  chemically synthesized
tccagccctgaaactctcat

SEQ ID NO: 495034 - DNA, 20 bp, Artificial Sequence
  chemically synthesized
actacacaaggttccaaaga

SEQ ID NO: 495035 - DNA, 20 bp, Artificial Sequence
  chemically synthesized
cttctttggaaccttgtgta

SEQ ID NO: 495036 - DNA, 20 bp, Artificial Sequence
  chemically synthesized
tggaaccttgtgtagtgaat

SEQ ID NO: 495037 - DNA, 20 bp, Artificial Sequence
  chemically synthesized
ctttgtaatttaaaattaaa

SEQ ID NO: 495038 - DNA, 20 bp, Artificial Sequence
  chemically synthesized
cagttctcttcatctacaca

SEQ ID NO: 495039 - DNA, 20 bp, Artificial Sequence
  chemically synthesized
atgaagagaactgaagtcct

SEQ ID NO: 495040 - DNA, 20 bp, Artificial Sequence
  chemically synthesized
tgacttttacaatctagcaa

SEQ ID NO: 495041 - DNA, 20 bp, Artificial Sequence
  chemically synthesized
taaactgcagctcagaagac

SEQ ID NO: 495042 - DNA, 20 bp, Artificial Sequence
  chemically synthesized
aagaaatatcgataaaggtg

SEQ ID NO: 495043 - DNA, 20 bp, Artificial Sequence
  chemically synthesized
taggccccatcccagatcta

SEQ ID NO: 495044 - DNA, 20 bp, Artificial Sequence
  chemically synthesized
agcttctgattcagtagatc

SEQ ID NO: 495045 - DNA, 20 bp, Artificial Sequence
  chemically synthesized
tagagcaggagccctctgac

SEQ ID NO: 495046 - DNA, 20 bp, Artificial Sequence
  chemically synthesized
tattttgtgtaatccccttc

SEQ ID NO: 495047 - DNA, 20 bp, Artificial Sequence
  chemically synthesized
actttgctaacactcaggaa

SEQ ID NO: 495048 - DNA, 20 bp, Artificial Sequence
  chemically synthesized
tcctgagtgttagcaaagtg

SEQ ID NO: 495049 - DNA, 20 bp, Artificial Sequence
  chemically synthesized
aaagtgatgggttcacactt

SEQ ID NO: 495050 - DNA, 20 bp, Artificial Sequence
  chemically synthesized
ttctgtaatctcttctggca

SEQ ID NO: 495051 - DNA, 20 bp, Artificial Sequence
  chemically synthesized
acagcttctgttgagttcga

SEQ ID NO: 495052 - DNA, 20 bp, Artificial Sequence
  chemically synthesized
aatgtggtctacagcttctg

SEQ ID NO: 495053 - DNA, 20 bp, Artificial Sequence
  chemically synthesized
tagctgtttacatctattaa

SEQ ID NO: 495054 - DNA, 20 bp, Artificial Sequence
  chemically synthesized
actgttctaaagatgtaagt

SEQ ID NO: 495055 - DNA, 20 bp, Artificial Sequence
  chemically synthesized
agatttatctggcaagcata

SEQ ID NO: 495056 - DNA, 20 bp, Artificial Sequence
  chemically synthesized
ggttttaaatctcatggctg

SEQ ID NO: 495057 - DNA, 20 bp, Artificial Sequence
  chemically synthesized
cagccatgagatttaaaacc

SEQ ID NO: 495058 - DNA, 20 bp, Artificial Sequence
  chemically synthesized
cttaaccagatgtttatacc

SEQ ID NO: 495059 - DNA, 20 bp, Artificial Sequence
  chemically synthesized
tcaattagatttttgtgacc

SEQ ID NO: 495060 - DNA, 20 bp, Artificial Sequence
  chemically synthesized
cctgggtcacaaaaatctaa

SEQ ID NO: 495061 - DNA, 20 bp, Artificial Sequence
  chemically synthesized
ctcttcccctattaaggaag

SEQ ID NO: 495062 - DNA, 20 bp, Artificial Sequence
  chemically synthesized
tgtttttgaaaattaaacat

SEQ ID NO: 495063 - DNA, 20 bp, Artificial Sequence
  chemically synthesized
gtggttttagggaccctttg

SEQ ID NO: 495064 - DNA, 20 bp, Artificial Sequence
  chemically synthesized
agatctcttaatatccccca

SEQ ID NO: 495065 - DNA, 20 bp, Artificial Sequence
  chemically synthesized
tataaaacgtgtctactgtc

SEQ ID NO: 495066 - DNA, 20 bp, Artificial Sequence
  chemically synthesized
taatataattaatgttaaag

SEQ ID NO: 495067 - DNA, 20 bp, Artificial Sequence
  chemically synthesized
ttagatagcccagttaaaag

SEQ ID NO: 495068 - DNA, 20 bp, Artificial Sequence
  chemically synthesized
ttatacaagcatattggtca

SEQ ID NO: 495069 - DNA, 20 bp, Artificial Sequence
  chemically synthesized
gcttagtttatttttgtgta

SEQ ID NO: 495070 - DNA, 20 bp, Artificial Sequence
  chemically synthesized
tacttttttcatcagtacaa

SEQ ID NO: 495071 - DNA, 20 bp, Artificial Sequence
  chemically synthesized
ggacagagttgttaagtgct

SEQ ID NO: 495072 - DNA, 20 bp, Artificial Sequence
  chemically synthesized
tcttagtgcaagggtttgga

SEQ ID NO: 495073 - DNA, 20 bp, Artificial Sequence
  chemically synthesized
gtttagtcaagtcttagtgc

SEQ ID NO: 495074 - DNA, 20 bp, Artificial Sequence
  chemically synthesized
tctggggctagaaaccatac

SEQ ID NO: 495075 - DNA, 20 bp, Artificial Sequence
  chemically synthesized
gccccagaaggccatgtccc

SEQ ID NO: 495076 - DNA, 20 bp, Artificial Sequence
  chemically synthesized
gcaggcacttaagggaaggc

SEQ ID NO: 495077 - DNA, 20 bp, Artificial Sequence
  chemically synthesized
atgttctaagaaacggaggt

SEQ ID NO: 495078 - DNA, 20 bp, Artificial Sequence
  chemically synthesized
gttcacaattgtaagccctt

SEQ ID NO: 495079 - DNA, 20 bp, Artificial Sequence
  chemically synthesized
aaagaatggctttcaggtcc

SEQ ID NO: 495080 - DNA, 20 bp, Artificial Sequence
  chemically synthesized
tcttgatgatgtcatttgaa

SEQ ID NO: 495081 - DNA, 20 bp, Artificial Sequence
  chemically synthesized
tttcaaatgacatcatcaag

SEQ ID NO: 495082 - DNA, 20 bp, Artificial Sequence
  chemically synthesized
tcctgttctctgtgggaaga

SEQ ID NO: 495083 - DNA, 20 bp, Artificial Sequence
  chemically synthesized
tagctggaagttattgaagt

SEQ ID NO: 495084 - DNA, 20 bp, Artificial Sequence
  chemically synthesized
tacttttttacttctctaac

SEQ ID NO: 495085 - DNA, 20 bp, Artificial Sequence
  chemically synthesized
gagaaggagtgggggttcat

SEQ ID NO: 495086 - DNA, 20 bp, Artificial Sequence
  chemically synthesized
aagaaggagggagaaggagt

SEQ ID NO: 495087 - DNA, 20 bp, Artificial Sequence
  chemically synthesized
taaggcaagaaggagggaga

SEQ ID NO: 495088 - DNA, 20 bp, Artificial Sequence
  chemically synthesized
caagtcgcctctgcacaaat

SEQ ID NO: 495089 - DNA, 20 bp, Artificial Sequence
  chemically synthesized
tcgcctctgcacaaattaga

SEQ ID NO: 495090 - DNA, 20 bp, Artificial Sequence
  chemically synthesized
tcccctaatttcacgaggta

SEQ ID NO: 495091 - DNA, 20 bp, Artificial Sequence
  chemically synthesized
attgtcagagataaacacag

SEQ ID NO: 495092 - DNA, 20 bp, Artificial Sequence
  chemically synthesized
attgaggaaaatttatttat

SEQ ID NO: 495093 - DNA, 20 bp, Artificial Sequence
  chemically synthesized
catactaatggtagagttgt

SEQ ID NO: 495094 - DNA, 20 bp, Artificial Sequence
  chemically synthesized
gctacctcacatactaatgg

SEQ ID NO: 495095 - DNA, 20 bp, Artificial Sequence
  chemically synthesized
tatttgcaattgcattgctc

SEQ ID NO: 495096 - DNA, 20 bp, Artificial Sequence
  chemically synthesized
gtctttgtttcattgaaggg

SEQ ID NO: 495097 - DNA, 20 bp, Artificial Sequence
  chemically synthesized
gatggtctttgtttcattga

SEQ ID NO: 495098 - DNA, 20 bp, Artificial Sequence
  chemically synthesized
gtgattacctctaaaagaaa

SEQ ID NO: 495099 - DNA, 20 bp, Artificial Sequence
  chemically synthesized
atacctatatagaaagttaa

SEQ ID NO: 495100 - DNA, 20 bp, Artificial Sequence
  chemically synthesized
aaaccagcttctaagatttt

SEQ ID NO: 495101 - DNA, 20 bp, Artificial Sequence
  chemically synthesized
tattttatgtaacaaatgcc

SEQ ID NO: 495102 - DNA, 20 bp, Artificial Sequence
  chemically synthesized
aattttgaaatgccatttta

SEQ ID NO: 495103 - DNA, 20 bp, Artificial Sequence
  chemically synthesized
ttagtttgtagtacaaaatc

SEQ ID NO: 495104 - DNA, 20 bp, Artificial Sequence
  chemically synthesized
taaattatagttcaaatcat

SEQ ID NO: 495105 - DNA, 20 bp, Artificial Sequence
  chemically synthesized
caatcgattggcttgctatt

SEQ ID NO: 495106 - DNA, 20 bp, Artificial Sequence
  chemically synthesized
accataaaacgctatgttta

SEQ ID NO: 495107 - DNA, 20 bp, Artificial Sequence
  chemically synthesized
aactacatcattcaaaacta

SEQ ID NO: 495108 - DNA, 20 bp, Artificial Sequence
  chemically synthesized
ttacaggcaactcaatagtt

SEQ ID NO: 495109 - DNA, 20 bp, Artificial Sequence
  chemically synthesized
taaatgttgaatttgacact

SEQ ID NO: 495110 - DNA, 20 bp, Artificial Sequence
  chemically synthesized
taggctttaaagcctaaatg

SEQ ID NO: 495111 - DNA, 20 bp, Artificial Sequence
  chemically synthesized
acatttaggctttaaagcct

SEQ ID NO: 495112 - DNA, 20 bp, Artificial Sequence
  chemically synthesized
ttatgtgataaatgcgagtg

SEQ ID NO: 495113 - DNA, 20 bp, Artificial Sequence
  chemically synthesized
attttccttatgtgataaat

SEQ ID NO: 495114 - DNA, 20 bp, Artificial Sequence
  chemically synthesized
gcaaaactgaaataggaact

SEQ ID NO: 495115 - DNA, 20 bp, Artificial Sequence
  chemically synthesized
aagtagaagtgttttaaacc

SEQ ID NO: 495116 - DNA, 20 bp, Artificial Sequence
  chemically synthesized
ttataacaaagcatcgaaca

SEQ ID NO: 495117 - DNA, 20 bp, Artificial Sequence
  chemically synthesized
ctgataagctagatatttca

SEQ ID NO: 495118 - DNA, 20 bp, Artificial Sequence
  chemically synthesized
atatacttttatttgcagtc

SEQ ID NO: 495119 - DNA, 20 bp, Artificial Sequence
  chemically synthesized
aaagctgaaaaacaaaattt

SEQ ID NO: 495120 - DNA, 20 bp, Artificial Sequence
  chemically synthesized
gctttgcttcatcagattac

SEQ ID NO: 495121 - DNA, 20 bp, Artificial Sequence
  chemically synthesized
aggtgactttggaaatttta

SEQ ID NO: 495122 - DNA, 20 bp, Artificial Sequence
  chemically synthesized
gaggccaatttgacagtcag

SEQ ID NO: 495123 - DNA, 20 bp, Artificial Sequence
  chemically synthesized
aatttgacagtcagaagagt

SEQ ID NO: 495124 - DNA, 20 bp, Artificial Sequence
  chemically synthesized
taatgtttttcaaaagtttc

SEQ ID NO: 495125 - DNA, 20 bp, Artificial Sequence
  chemically synthesized
gagaagctggtattacattg

SEQ ID NO: 495126 - DNA, 20 bp, Artificial Sequence
  chemically synthesized
cttaaaggagatcataacga

SEQ ID NO: 495127 - DNA, 20 bp, Artificial Sequence
  chemically synthesized
ggagatcataacgattgaat

SEQ ID NO: 495128 - DNA, 20 bp, Artificial Sequence
  chemically synthesized
cacatttgtcattggcttat

SEQ ID NO: 495129 - DNA, 20 bp, Artificial Sequence
  chemically synthesized
caatgacaaatgtgaaatga

SEQ ID NO: 495130 - DNA, 20 bp, Artificial Sequence
  chemically synthesized
aggatgcaatgattattggt

SEQ ID NO: 495131 - DNA, 20 bp, Artificial Sequence
  chemically synthesized
agcagtttttctttggcttt

SEQ ID NO: 495132 - DNA, 20 bp, Artificial Sequence
  chemically synthesized
ctcaatcagtccctatagat

SEQ ID NO: 495133 - DNA, 20 bp, Artificial Sequence
  chemically synthesized
cttggacataatgttttctg

SEQ ID NO: 495134 - DNA, 20 bp, Artificial Sequence
  chemically synthesized
ggcttctgatttcgaggcca

SEQ ID NO: 495135 - DNA, 20 bp, Artificial Sequence
  chemically synthesized
tgatttcgaggccaacgagt

SEQ ID NO: 495136 - DNA, 20 bp, Artificial Sequence
  chemically synthesized
gttggccagattgaccaaag

SEQ ID NO: 495137 - DNA, 20 bp, Artificial Sequence
  chemically synthesized
tctttgaaaaatgagaaagg

SEQ ID NO: 495138 - DNA, 20 bp, Artificial Sequence
  chemically synthesized
ttaccaatgtaatattagtg

SEQ ID NO: 495139 - DNA, 20 bp, Artificial Sequence
  chemically synthesized
ttagtggagagttataacaa

SEQ ID NO: 495140 - DNA, 20 bp, Artificial Sequence
  chemically synthesized
ctgaaggcttacacaggtgc

SEQ ID NO: 495141 - DNA, 20 bp, Artificial Sequence
  chemically synthesized
ctgcaccacttgcaccagtg

SEQ ID NO: 495142 - DNA, 20 bp, Artificial Sequence
  chemically synthesized
ggcttttgctacatatactt

SEQ ID NO: 495143 - DNA, 20 bp, Artificial Sequence
  chemically synthesized
agtgtaggttttcagaaagt

SEQ ID NO: 495144 - DNA, 20 bp, Artificial Sequence
  chemically synthesized
taattctggcattgatagta

SEQ ID NO: 495145 - DNA, 20 bp, Artificial Sequence
  chemically synthesized
atacccactactatcaatgc

SEQ ID NO: 495146 - DNA, 20 bp, Artificial Sequence
  chemically synthesized
tatcaatgccagaattatca

SEQ ID NO: 495147 - DNA, 20 bp, Artificial Sequence
  chemically synthesized
tttattattttctattgaca

SEQ ID NO: 495148 - DNA, 20 bp, Artificial Sequence
  chemically synthesized
ttggatggagtgtgcattat

SEQ ID NO: 495149 - DNA, 20 bp, Artificial Sequence
  chemically synthesized
aaattatgtttgttcttgga

SEQ ID NO: 495150 - DNA, 20 bp, Artificial Sequence
  chemically synthesized
tagttaaattatgtttgttc

SEQ ID NO: 495151 - DNA, 20 bp, Artificial Sequence
  chemically synthesized
ccattggggtttttaaccag

SEQ ID NO: 495152 - DNA, 20 bp, Artificial Sequence
  chemically synthesized
taaattaaatgttaagccat

SEQ ID NO: 495153 - DNA, 20 bp, Artificial Sequence
  chemically synthesized
cagtcttccgggacgttgta

SEQ ID NO: 495154 - DNA, 20 bp, Artificial Sequence
  chemically synthesized
ctacttgaggaaaagtgtga

SEQ ID NO: 495155 - DNA, 20 bp, Artificial Sequence
  chemically synthesized
tagcctacttgaggaaaagt

SEQ ID NO: 495156 - DNA, 20 bp, Artificial Sequence
  chemically synthesized
gtgacagaggcagataccta

SEQ ID NO: 495157 - DNA, 20 bp, Artificial Sequence
  chemically synthesized
aatgacatttgaaaaggaac

SEQ ID NO: 495158 - DNA, 20 bp, Artificial Sequence
  chemically synthesized
tggtagagtgtaactggaat

SEQ ID NO: 495159 - DNA, 20 bp, Artificial Sequence
  chemically synthesized
gcagtgtggtagagtgtaac

SEQ ID NO: 495160 - DNA, 20 bp, Artificial Sequence
  chemically synthesized
cagaaaagtgagcagtgtgg

SEQ ID NO: 495161 - DNA, 20 bp, Artificial Sequence
  chemically synthesized
tccacggcctcccaaagtgc

SEQ ID NO: 495162 - DNA, 20 bp, Artificial Sequence
  chemically synthesized
ttttgtatttttagtagaga

SEQ ID NO: 495163 - DNA, 20 bp, Artificial Sequence
  chemically synthesized
gcctcagcctaccgagtagc

SEQ ID NO: 495164 - DNA, 20 bp, Artificial Sequence
  chemically synthesized
gattctcctgcctcagccta

SEQ ID NO: 495165 - DNA, 20 bp, Artificial Sequence
  chemically synthesized
tactcggtaggctgaggcag

SEQ ID NO: 495166 - DNA, 20 bp, Artificial Sequence
  chemically synthesized
ctcactgcaacctctgcctc

SEQ ID NO: 495167 - DNA, 20 bp, Artificial Sequence
  chemically synthesized
ctgtgccactgcactccagc

SEQ ID NO: 495168 - DNA, 20 bp, Artificial Sequence
  chemically synthesized
tctcactctgtcacccaggc

SEQ ID NO: 495169 - DNA, 20 bp, Artificial Sequence
  chemically synthesized
ctgcactccagcctgggtga

SEQ ID NO: 495170 - DNA, 20 bp, Artificial Sequence
  chemically synthesized
tttattttattttgttgaga

SEQ ID NO: 495171 - DNA, 20 bp, Artificial Sequence
  chemically synthesized
cattagcatataagatcctt

SEQ ID NO: 495172 - DNA, 20 bp, Artificial Sequence
  chemically synthesized
agcaaaaagttcttactctc

SEQ ID NO: 495173 - DNA, 20 bp, Artificial Sequence
  chemically synthesized
ctaggtgctgaattacagga

SEQ ID NO: 495174 - DNA, 20 bp, Artificial Sequence
  chemically synthesized
ttttctaggtgctgaattac

SEQ ID NO: 495175 - DNA, 20 bp, Artificial Sequence
  chemically synthesized
gccaaatgtttttctaggtg

SEQ ID NO: 495176 - DNA, 20 bp, Artificial Sequence
  chemically synthesized
tggcatatagaagataatca

SEQ ID NO: 495177 - DNA, 20 bp, Artificial Sequence
  chemically synthesized
aacagctctttgaaacaggt

SEQ ID NO: 495178 - DNA, 20 bp, Artificial Sequence
  chemically synthesized
acgagttttcttgttatctt

SEQ ID NO: 495179 - DNA, 20 bp, Artificial Sequence
  chemically synthesized
acttaccccttctaaacttc

SEQ ID NO: 495180 - DNA, 20 bp, Artificial Sequence
  chemically synthesized
aaaaattcctgaagtttaga

SEQ ID NO: 495181 - DNA, 20 bp, Artificial Sequence
  chemically synthesized
actttcaatggttggctctg

SEQ ID NO: 495182 - DNA, 20 bp, Artificial Sequence
  chemically synthesized
tgcctgtctagccaaataaa

SEQ ID NO: 495183 - DNA, 20 bp, Artificial Sequence
  chemically synthesized
ggacacattgtgatggagct

SEQ ID NO: 495184 - DNA, 20 bp, Artificial Sequence
  chemically synthesized
ttccaatgcgacaagaatgt

SEQ ID NO: 495185 - DNA, 20 bp, Artificial Sequence
  chemically synthesized
tctgcgttttccaatgcgac

SEQ ID NO: 495186 - DNA, 20 bp, Artificial Sequence
  chemically synthesized
cagatattatcatgtattat

SEQ ID NO: 495187 - DNA, 20 bp, Artificial Sequence
  chemically synthesized
atgagaataatttcttagtc

SEQ ID NO: 495188 - DNA, 20 bp, Artificial Sequence
  chemically synthesized
ttgaagttatcttagtttta

SEQ ID NO: 495189 - DNA, 20 bp, Artificial Sequence
  chemically synthesized
actaagataacttcaagaaa

SEQ ID NO: 495190 - DNA, 20 bp, Artificial Sequence
  chemically synthesized
aaaacagcagcagtagaaca

SEQ ID NO: 495191 - DNA, 20 bp, Artificial Sequence
  chemically synthesized
tgaatacgtaatacctagag

SEQ ID NO: 495192 - DNA, 20 bp, Artificial Sequence
  chemically synthesized
caagcactaaatattttcca

SEQ ID NO: 495193 - DNA, 20 bp, Artificial Sequence
  chemically synthesized
gtgaagtatagtgctctaca

SEQ ID NO: 495194 - DNA, 20 bp, Artificial Sequence
  chemically synthesized
ccaactactgtgtgaagaag

SEQ ID NO: 495195 - DNA, 20 bp, Artificial Sequence
  chemically synthesized
gcttcttcacacagtagttg

SEQ ID NO: 495196 - DNA, 20 bp, Artificial Sequence
  chemically synthesized
aagcacattttaaatgccag

SEQ ID NO: 495197 - DNA, 20 bp, Artificial Sequence
  chemically synthesized
aggtcccatcattgttattt

SEQ ID NO: 495198 - DNA, 20 bp, Artificial Sequence
  chemically synthesized
tatattgcatgagaaaatag

SEQ ID NO: 495199 - DNA, 20 bp, Artificial Sequence
  chemically synthesized
catgagaaaataggtgaatg

SEQ ID NO: 495200 - DNA, 20 bp, Artificial Sequence
  chemically synthesized
ttaggcaacatgttgcataa

SEQ ID NO: 495201 - DNA, 20 bp, Artificial Sequence
  chemically synthesized
gcaacatgttgcataaatgg

SEQ ID NO: 495202 - DNA, 20 bp, Artificial Sequence
  chemically synthesized
ttgcttccttgcacattttt

SEQ ID NO: 495203 - DNA, 20 bp, Artificial Sequence
  chemically synthesized
gtcaaattacttcagatgcc

SEQ ID NO: 495204 - DNA, 20 bp, Artificial Sequence
  chemically synthesized
acttcagatgccttgaattc

SEQ ID NO: 495205 - DNA, 20 bp, Artificial Sequence
  chemically synthesized
tttgatggagtgttttattc

SEQ ID NO: 495206 - DNA, 20 bp, Artificial Sequence
  chemically synthesized
ttgagatgcataaaatttga

SEQ ID NO: 495207 - DNA, 20 bp, Artificial Sequence
  chemically synthesized
ccctacctcactaggatgtt

SEQ ID NO: 495208 - DNA, 20 bp, Artificial Sequence
  chemically synthesized
ttcctccttccctacctcac

SEQ ID NO: 495209 - DNA, 20 bp, Artificial Sequence
  chemically synthesized
tcctagtgaggtagggaagg

SEQ ID NO: 495210 - DNA, 20 bp, Artificial Sequence
  chemically synthesized
tttttcttatttggtgaaat

SEQ ID NO: 495211 - DNA, 20 bp, Artificial Sequence
  chemically synthesized
aggttaatgatagatttgaa

SEQ ID NO: 495212 - DNA, 20 bp, Artificial Sequence
  chemically synthesized
gtcagcagcaaaaccatggt

SEQ ID NO: 495213 - DNA, 20 bp, Artificial Sequence
  chemically synthesized
atggttggaatttaggttcc

SEQ ID NO: 495214 - DNA, 20 bp, Artificial Sequence
  chemically synthesized
taggttccctgaattccact

SEQ ID NO: 495215 - DNA, 20 bp, Artificial Sequence
  chemically synthesized
atctcgaaaagaaccctaag

SEQ ID NO: 495216 - DNA, 20 bp, Artificial Sequence
  chemically synthesized
taactacatttcattgttgg

SEQ ID NO: 495217 - DNA, 20 bp, Artificial Sequence
  chemically synthesized
gagcatctgtatctacatga

SEQ ID NO: 495218 - DNA, 20 bp, Artificial Sequence
  chemically synthesized
catcttttttcatcctacta

SEQ ID NO: 495219 - DNA, 20 bp, Artificial Sequence
  chemically synthesized
ttagcagcaagattccttag

SEQ ID NO: 495220 - DNA, 20 bp, Artificial Sequence
  chemically synthesized
cgtattatttgtctcagtgg

SEQ ID NO: 495221 - DNA, 20 bp, Artificial Sequence
  chemically synthesized
aagttagctcaggaaatgac

SEQ ID NO: 495222 - DNA, 20 bp, Artificial Sequence
  chemically synthesized
taacttctgttccttttcct

SEQ ID NO: 495223 - DNA, 20 bp, Artificial Sequence
  chemically synthesized
tattttttcacattatacca

SEQ ID NO: 495224 - DNA, 20 bp, Artificial Sequence
  chemically synthesized
cactgaattattcagattca

SEQ ID NO: 495225 - DNA, 20 bp, Artificial Sequence
  chemically synthesized
tctaagggtattcaatgaat

SEQ ID NO: 495226 - DNA, 20 bp, Artificial Sequence
  chemically synthesized
aataactctaagggtattca

SEQ ID NO: 495227 - DNA, 20 bp, Artificial Sequence
  chemically synthesized
tcagattcattgaataccct

SEQ ID NO: 495228 - DNA, 20 bp, Artificial Sequence
  chemically synthesized
tataacatgttaataactct

SEQ ID NO: 495229 - DNA, 20 bp, Artificial Sequence
  chemically synthesized
tggttatatagctagaaagt

SEQ ID NO: 495230 - DNA, 20 bp, Artificial Sequence
  chemically synthesized
ctattttcaaaacctacatt

SEQ ID NO: 495231 - DNA, 20 bp, Artificial Sequence
  chemically synthesized
aaaaaaaaaaagaaaagaaa

SEQ ID NO: 495232 - DNA, 20 bp, Artificial Sequence
  chemically synthesized
tgctctggaggctgaggcag

SEQ ID NO: 495233 - DNA, 20 bp, Artificial Sequence
  chemically synthesized
tactaaaaatacaaaattag

SEQ ID NO: 495234 - DNA, 20 bp, Artificial Sequence
  chemically synthesized
ttttgtatttttagtagaga

SEQ ID NO: 495235 - DNA, 20 bp, Artificial Sequence
  chemically synthesized
ggcgggcagatcacgaggtc

SEQ ID NO: 495236 - DNA, 20 bp, Artificial Sequence
  chemically synthesized
gcctcggcctcccaaagtac

SEQ ID NO: 495237 - DNA, 20 bp, Artificial Sequence
  chemically synthesized
aacagcacaggataatgaaa

SEQ ID NO: 495238 - DNA, 20 bp, Artificial Sequence
  chemically synthesized
tgacaaaggagaaaacagca

SEQ ID NO: 495239 - DNA, 20 bp, Artificial Sequence
  chemically synthesized
aaggactctaacattaagag

SEQ ID NO: 495240 - DNA, 20 bp, Artificial Sequence
  chemically synthesized
gtcaatccacctcttaatgt

SEQ ID NO: 495241 - DNA, 20 bp, Artificial Sequence
  chemically synthesized
atcagattgtatcactaagg

SEQ ID NO: 495242 - DNA, 20 bp, Artificial Sequence
  chemically synthesized
ggcaattgaataaatacctt

SEQ ID NO: 495243 - DNA, 20 bp, Artificial Sequence
  chemically synthesized
cagatatattgaataggcaa

SEQ ID NO: 495244 - DNA, 20 bp, Artificial Sequence
  chemically synthesized
tagacatatcaccagatata

SEQ ID NO: 495245 - DNA, 20 bp, Artificial Sequence
  chemically synthesized
cgattagggaggcattaaat

SEQ ID NO: 495246 - DNA, 20 bp, Artificial Sequence
  chemically synthesized
gaaataataaagactataga

SEQ ID NO: 495247 - DNA, 20 bp, Artificial Sequence
  chemically synthesized
ttttgctctgattaactgga

SEQ ID NO: 495248 - DNA, 20 bp, Artificial Sequence
  chemically synthesized
catgggagaaaaatggagtc

SEQ ID NO: 495249 - DNA, 20 bp, Artificial Sequence
  chemically synthesized
taaggggcatgggagaaaaa

SEQ ID NO: 495250 - DNA, 20 bp, Artificial Sequence
  chemically synthesized
aacaaggatttctggatgaa

SEQ ID NO: 495251 - DNA, 20 bp, Artificial Sequence
  chemically synthesized
gggccaacaaggatttctgg

SEQ ID NO: 495252 - DNA, 20 bp, Artificial Sequence
  chemically synthesized
agtggggccaacaaggattt

SEQ ID NO: 495253 - DNA, 20 bp, Artificial Sequence
  chemically synthesized
tgtttggaagtggggccaac

SEQ ID NO: 495254 - DNA, 20 bp, Artificial Sequence
  chemically synthesized
gccccacttccaaacacgtt

SEQ ID NO: 495255 - DNA, 20 bp, Artificial Sequence
  chemically synthesized
aagatgatgctgactgagac

SEQ ID NO: 495256 - DNA, 20 bp, Artificial Sequence
  chemically synthesized
ggagagaatgttagtgaggt

SEQ ID NO: 495257 - DNA, 20 bp, Artificial Sequence
  chemically synthesized
taagtgagagaggtttagga

SEQ ID NO: 495258 - DNA, 20 bp, Artificial Sequence
  chemically synthesized
ctggttatctgcagtgtggc

SEQ ID NO: 495259 - DNA, 20 bp, Artificial Sequence
  chemically synthesized
agcagataaaccgatggctt

SEQ ID NO: 495260 - DNA, 20 bp, Artificial Sequence
  chemically synthesized
ggttcagtaaacagtcaatg

SEQ ID NO: 495261 - DNA, 20 bp, Artificial Sequence
  chemically synthesized
gactgtttactgaacccaaa

SEQ ID NO: 495262 - DNA, 20 bp, Artificial Sequence
  chemically synthesized
atatcagcagtaaactcatt

SEQ ID NO: 495263 - DNA, 20 bp, Artificial Sequence
  chemically synthesized
tcaaagaatgaggcatgggg

SEQ ID NO: 495264 - DNA, 20 bp, Artificial Sequence
  chemically synthesized
agatctcaaagaatgaggca

SEQ ID NO: 495265 - DNA, 20 bp, Artificial Sequence
  chemically synthesized
acatttgagcaaagatctca

SEQ ID NO: 495266 - DNA, 20 bp, Artificial Sequence
  chemically synthesized
caaatgtcaccttctcaatg

SEQ ID NO: 495267 - DNA, 20 bp, Artificial Sequence
  chemically synthesized
gagtacattccaattttaaa

SEQ ID NO: 495268 - DNA, 20 bp, Artificial Sequence
  chemically synthesized
catgataccctatttaaaat

SEQ ID NO: 495269 - DNA, 20 bp, Artificial Sequence
  chemically synthesized
aaataagagatggctcatgc

SEQ ID NO: 495270 - DNA, 20 bp, Artificial Sequence
  chemically synthesized
gtgctgtgaaaaaaaagaag

SEQ ID NO: 495271 - DNA, 20 bp, Artificial Sequence
  chemically synthesized
tttcactatttgagaccccc

SEQ ID NO: 495272 - DNA, 20 bp, Artificial Sequence
  chemically synthesized
tgtatgccctctggattctt

SEQ ID NO: 495273 - DNA, 20 bp, Artificial Sequence
  chemically synthesized
gcagaaaagatgtatgccct

SEQ ID NO: 495274 - DNA, 20 bp, Artificial Sequence
  chemically synthesized
cagccactactgtagatgtt

SEQ ID NO: 495275 - DNA, 20 bp, Artificial Sequence
  chemically synthesized
tgaacaaacagataatggaa

SEQ ID NO: 495276 - DNA, 20 bp, Artificial Sequence
  chemically synthesized
gtagatagagaagaaattaa

SEQ ID NO: 495277 - DNA, 20 bp, Artificial Sequence
  chemically synthesized
ttctcattctacatgagaat

SEQ ID NO: 495278 - DNA, 20 bp, Artificial Sequence
  chemically synthesized
aaagaattctcattctcatg

SEQ ID NO: 495279 - DNA, 20 bp, Artificial Sequence
  chemically synthesized
attgtcttctcattctacat

SEQ ID NO: 495280 - DNA, 20 bp, Artificial Sequence
  chemically synthesized
tgtagaatgagaagacaatg

SEQ ID NO: 495281 - DNA, 20 bp, Artificial Sequence
  chemically synthesized
atgagaagacaatggggaat

SEQ ID NO: 495282 - DNA, 20 bp, Artificial Sequence
  chemically synthesized
tgcaggcaaggcacagaagc

SEQ ID NO: 495283 - DNA, 20 bp, Artificial Sequence
  chemically synthesized
aaacctatattagcatcttc

SEQ ID NO: 495284 - DNA, 20 bp, Artificial Sequence
  chemically synthesized
agtttattttatcttttttt

SEQ ID NO: 495285 - DNA, 20 bp, Artificial Sequence
  chemically synthesized
ttaacggtgacatggtttta

SEQ ID NO: 495286 - DNA, 20 bp, Artificial Sequence
  chemically synthesized
gacatggttttaaagagttg

SEQ ID NO: 495287 - DNA, 20 bp, Artificial Sequence
  chemically synthesized
tccagcgctatattatttca

SEQ ID NO: 495288 - DNA, 20 bp, Artificial Sequence
  chemically synthesized
ttgccacttgtataagtcag

SEQ ID NO: 495289 - DNA, 20 bp, Artificial Sequence
  chemically synthesized
caaagtatacctcatttatc

SEQ ID NO: 495290 - DNA, 20 bp, Artificial Sequence
  chemically synthesized
aaggcaaaatgttcagaaaa

SEQ ID NO: 495291 - DNA, 20 bp, Artificial Sequence
  chemically synthesized
tggcaaatcctttcatctct

SEQ ID NO: 495292 - DNA, 20 bp, Artificial Sequence
  chemically synthesized
aaaagtatcctcagagatga

SEQ ID NO: 495293 - DNA, 20 bp, Artificial Sequence
  chemically synthesized
caaaaactgatataaattcc

SEQ ID NO: 495294 - DNA, 20 bp, Artificial Sequence
  chemically synthesized
tagaactctgtttgcaccca

SEQ ID NO: 495295 - DNA, 20 bp, Artificial Sequence
  chemically synthesized
ataaattccatgggtgcaaa

SEQ ID NO: 495296 - DNA, 20 bp, Artificial Sequence
  chemically synthesized
tgcaataagatttgacttta

SEQ ID NO: 495297 - DNA, 20 bp, Artificial Sequence
  chemically synthesized
atgaaatatattattgtagt

SEQ ID NO: 495298 - DNA, 20 bp, Artificial Sequence
  chemically synthesized
atctggtctagacttcacaa

SEQ ID NO: 495299 - DNA, 20 bp, Artificial Sequence
  chemically synthesized
cttcacaaaagaattacaat

SEQ ID NO: 495300 - DNA, 20 bp, Artificial Sequence
  chemically synthesized
tgtgttttttggcatcttgg

SEQ ID NO: 495301 - DNA, 20 bp, Artificial Sequence
  chemically synthesized
cagtctaggcaatatctttc

SEQ ID NO: 495302 - DNA, 20 bp, Artificial Sequence
  chemically synthesized
gtctaaatctgaaaattaac

SEQ ID NO: 495303 - DNA, 20 bp, Artificial Sequence
  chemically synthesized
agatgaaaatgaagtaatta

SEQ ID NO: 495304 - DNA, 20 bp, Artificial Sequence
  chemically synthesized
catctatagctcaaataatc

SEQ ID NO: 495305 - DNA, 20 bp, Artificial Sequence
  chemically synthesized
ttttgttactgttttaagaa

SEQ ID NO: 495306 - DNA, 20 bp, Artificial Sequence
  chemically synthesized
tttgaaaattcatgctttgg

SEQ ID NO: 495307 - DNA, 20 bp, Artificial Sequence
  chemically synthesized
atcatttattcttccaaagc

SEQ ID NO: 495308 - DNA, 20 bp, Artificial Sequence
  chemically synthesized
aataaaaataaacaacttac

SEQ ID NO: 495309 - DNA, 20 bp, Artificial Sequence
  chemically synthesized
gctatttaatggtggttcac

SEQ ID NO: 495310 - DNA, 20 bp, Artificial Sequence
  chemically synthesized
tttaatggtggttcacaggg

SEQ ID NO: 495311 - DNA, 20 bp, Artificial Sequence
  chemically synthesized
ggttcacaggggtgagtgca

SEQ ID NO: 495312 - DNA, 20 bp, Artificial Sequence
  chemically synthesized
tgggcagattgcttgagctc

SEQ ID NO: 495313 - DNA, 20 bp, Artificial Sequence
  chemically synthesized
gatcctcccacctcagcctc

SEQ ID NO: 495314 - DNA, 20 bp, Artificial Sequence
  chemically synthesized
tacccgggaggctgaggtgg

SEQ ID NO: 495315 - DNA, 20 bp, Artificial Sequence
  chemically synthesized
ggtgggaggatcacctgagc

SEQ ID NO: 495316 - DNA, 20 bp, Artificial Sequence
  chemically synthesized
gatggttgaggcagtgagcc

SEQ ID NO: 495317 - DNA, 20 bp, Artificial Sequence
  chemically synthesized
tcttgctctgctgcccaggc

SEQ ID NO: 495318 - DNA, 20 bp, Artificial Sequence
  chemically synthesized
acaacttaaatttgtttttt

SEQ ID NO: 495319 - DNA, 20 bp, Artificial Sequence
  chemically synthesized
caaaaaacaaatttaagttg

SEQ ID NO: 495320 - DNA, 20 bp, Artificial Sequence
  chemically synthesized
aaatttagtcattaaccctt

SEQ ID NO: 495321 - DNA, 20 bp, Artificial Sequence
  chemically synthesized
aattataacatgtcatccag

SEQ ID NO: 495322 - DNA, 20 bp, Artificial Sequence
  chemically synthesized
tctggatgacatgttataat

SEQ ID NO: 495323 - DNA, 20 bp, Artificial Sequence
  chemically synthesized
gttataattaggatattaat

SEQ ID NO: 495324 - DNA, 20 bp, Artificial Sequence
  chemically synthesized
attggcattataaaaccatt

SEQ ID NO: 495325 - DNA, 20 bp, Artificial Sequence
  chemically synthesized
aatcagatttttttaataca

SEQ ID NO: 495326 - DNA, 20 bp, Artificial Sequence
  chemically synthesized
aaaaaattccccatgattta

SEQ ID NO: 495327 - DNA, 20 bp, Artificial Sequence
  chemically synthesized
atctgattccataaatcatg

SEQ ID NO: 495328 - DNA, 20 bp, Artificial Sequence
  chemically synthesized
attttctgtaagtctaatac

SEQ ID NO: 495329 - DNA, 20 bp, Artificial Sequence
  chemically synthesized
aaagaaagcatttgatgttt

SEQ ID NO: 495330 - DNA, 20 bp, Artificial Sequence
  chemically synthesized
aaacatcaaatgctttcttt

SEQ ID NO: 495331 - DNA, 20 bp, Artificial Sequence
  chemically synthesized
caacagtgcctagaatgtca

SEQ ID NO: 495332 - DNA, 20 bp, Artificial Sequence
  chemically synthesized
tgggacacaccaacagtgcc

SEQ ID NO: 495333 - DNA, 20 bp, Artificial Sequence
  chemically synthesized
aaaactgattccatttatac

SEQ ID NO: 495334 - DNA, 20 bp, Artificial Sequence
  chemically synthesized
tgatattattctagtataaa

SEQ ID NO: 495335 - DNA, 20 bp, Artificial Sequence
  chemically synthesized
aaagtaccataagaagggag

SEQ ID NO: 495336 - DNA, 20 bp, Artificial Sequence
  chemically synthesized
taatgaaagtaccataagaa

SEQ ID NO: 495337 - DNA, 20 bp, Artificial Sequence
  chemically synthesized
ttgacttcggctgccaggaa

SEQ ID NO: 495338 - DNA, 20 bp, Artificial Sequence
  chemically synthesized
gtagattgacttcggctgcc

SEQ ID NO: 495339 - DNA, 20 bp, Artificial Sequence
  chemically synthesized
ctgccttgtccttcaaaaaa

SEQ ID NO: 495340 - DNA, 20 bp, Artificial Sequence
  chemically synthesized
gattaattttcaaaaccagt

SEQ ID NO: 495341 - DNA, 20 bp, Artificial Sequence
  chemically synthesized
tacttcatccatcggtggat

SEQ ID NO: 495342 - DNA, 20 bp, Artificial Sequence
  chemically synthesized
atacaaattctaatccaccg

SEQ ID NO: 495343 - DNA, 20 bp, Artificial Sequence
  chemically synthesized
aagttctacttcatccatcg

SEQ ID NO: 495344 - DNA, 20 bp, Artificial Sequence
  chemically synthesized
gccacttagaaaataatatt

SEQ ID NO: 495345 - DNA, 20 bp, Artificial Sequence
  chemically synthesized
gaacacatggacacaggaag

SEQ ID NO: 495346 - DNA, 20 bp, Artificial Sequence
  chemically synthesized
ccccaccccacagcagtccc

SEQ ID NO: 495347 - DNA, 20 bp, Artificial Sequence
  chemically synthesized
tcacactctggggactgctg

SEQ ID NO: 495348 - DNA, 20 bp, Artificial Sequence
  chemically synthesized
gtggggtggggggaaggggg

SEQ ID NO: 495349 - DNA, 20 bp, Artificial Sequence
  chemically synthesized
gatttaccttaagctagatg

SEQ ID NO: 495350 - DNA, 20 bp, Artificial Sequence
  chemically synthesized
ttaagctagatgacgagtta

SEQ ID NO: 495351 - DNA, 20 bp, Artificial Sequence
  chemically synthesized
ataaaactttttttaaaaat

SEQ ID NO: 495352 - DNA, 20 bp, Artificial Sequence
  chemically synthesized
gcctcatagatttaaaaatc

SEQ ID NO: 495353 - DNA, 20 bp, Artificial Sequence
  chemically synthesized
ttaaatctatgaggcttatt

SEQ ID NO: 495354 - DNA, 20 bp, Artificial Sequence
  chemically synthesized
tatgaggcttatttagaatg

SEQ ID NO: 495355 - DNA, 20 bp, Artificial Sequence
  chemically synthesized
aatcttgaagaaccagatat

SEQ ID NO: 495356 - DNA, 20 bp, Artificial Sequence
  chemically synthesized
gcatacacaaatcaggtggg

SEQ ID NO: 495357 - DNA, 20 bp, Artificial Sequence
  chemically synthesized
agcataaattacaaggtcag

SEQ ID NO: 495358 - DNA, 20 bp, Artificial Sequence
  chemically synthesized
aaggtcagaggaataccttc

SEQ ID NO: 495359 - DNA, 20 bp, Artificial Sequence
  chemically synthesized
taggtttctatactgttcaa

SEQ ID NO: 495360 - DNA, 20 bp, Artificial Sequence
  chemically synthesized
tttgaacagtatagaaacct

SEQ ID NO: 495361 - DNA, 20 bp, Artificial Sequence
  chemically synthesized
ttcttgtagttttcttctat

SEQ ID NO: 495362 - DNA, 20 bp, Artificial Sequence
  chemically synthesized
aagaaaactacaagaaccaa

SEQ ID NO: 495363 - DNA, 20 bp, Artificial Sequence
  chemically synthesized
ataatgctatgtttagtgga

SEQ ID NO: 495364 - DNA, 20 bp, Artificial Sequence
  chemically synthesized
aacatataatgctatgttta

SEQ ID NO: 495365 - DNA, 20 bp, Artificial Sequence
  chemically synthesized
gtcattcactatctttgtgt

SEQ ID NO: 495366 - DNA, 20 bp, Artificial Sequence
  chemically synthesized
gtcactcacacacaaagata

SEQ ID NO: 495367 - DNA, 20 bp, Artificial Sequence
  chemically synthesized
aacctggccaggcattaaca

SEQ ID NO: 495368 - DNA, 20 bp, Artificial Sequence
  chemically synthesized
taacaggggatggcctttca

SEQ ID NO: 495369 - DNA, 20 bp, Artificial Sequence
  chemically synthesized
tgagtaaaagatattccttc

SEQ ID NO: 495370 - DNA, 20 bp, Artificial Sequence
  chemically synthesized
tttaccagctctactctgga

SEQ ID NO: 495371 - DNA, 20 bp, Artificial Sequence
  chemically synthesized
aaaaaaaactatactttcat

SEQ ID NO: 495372 - DNA, 20 bp, Artificial Sequence
  chemically synthesized
tcaactttaattttggacta

SEQ ID NO: 495373 - DNA, 20 bp, Artificial Sequence
  chemically synthesized
tggactagggagtacctatg

SEQ ID NO: 495374 - DNA, 20 bp, Artificial Sequence
  chemically synthesized
tacctatgcaggattgttac

SEQ ID NO: 495375 - DNA, 20 bp, Artificial Sequence
  chemically synthesized
tttcaggtttttggagaaac

SEQ ID NO: 495376 - DNA, 20 bp, Artificial Sequence
  chemically synthesized
gagaccaggccttcattctg

SEQ ID NO: 495377 - DNA, 20 bp, Artificial Sequence
  chemically synthesized
ttcaagaggcaggaattctg

SEQ ID NO: 495378 - DNA, 20 bp, Artificial Sequence
  chemically synthesized
ctagagaattttcaagaggc

SEQ ID NO: 495379 - DNA, 20 bp, Artificial Sequence
  chemically synthesized
gggttgtaagtcagggccta

SEQ ID NO: 495380 - DNA, 20 bp, Artificial Sequence
  chemically synthesized
caggttaaccatacagcaaa

SEQ ID NO: 495381 - DNA, 20 bp, Artificial Sequence
  chemically synthesized
atcacttataggggacatag

SEQ ID NO: 495382 - DNA, 20 bp, Artificial Sequence
  chemically synthesized
taacagctctctatgtttcc

SEQ ID NO: 495383 - DNA, 20 bp, Artificial Sequence
  chemically synthesized
cccaccgagatctgccaaat

SEQ ID NO: 495384 - DNA, 20 bp, Artificial Sequence
  chemically synthesized
tggcagatctcggtgggccc

SEQ ID NO: 495385 - DNA, 20 bp, Artificial Sequence
  chemically synthesized
gtccctcataagaattatat

SEQ ID NO: 495386 - DNA, 20 bp, Artificial Sequence
  chemically synthesized
gcaggactttagtccctcat

SEQ ID NO: 495387 - DNA, 20 bp, Artificial Sequence
  chemically synthesized
gtgggcgaccttgggaagac

SEQ ID NO: 495388 - DNA, 20 bp, Artificial Sequence
  chemically synthesized
caactggggacgagttggct

SEQ ID NO: 495389 - DNA, 20 bp, Artificial Sequence
  chemically synthesized
gctcttgtctccaactgggg

SEQ ID NO: 495390 - DNA, 20 bp, Artificial Sequence
  chemically synthesized
ggcctaatcaaacagctttg

SEQ ID NO: 495391 - DNA, 20 bp, Artificial Sequence
  chemically synthesized
taggcctcacatacatcatc

SEQ ID NO: 495392 - DNA, 20 bp, Artificial Sequence
  chemically synthesized
aagaaaaaatatatagggaa

SEQ ID NO: 495393 - DNA, 20 bp, Artificial Sequence
  chemically synthesized
gagatttgaagtaggataaa

SEQ ID NO: 495394 - DNA, 20 bp, Artificial Sequence
  chemically synthesized
ggtgctatagagatttgaag

SEQ ID NO: 495395 - DNA, 20 bp, Artificial Sequence
  chemically synthesized
aatctctatagcaccatatt

SEQ ID NO: 495396 - DNA, 20 bp, Artificial Sequence
  chemically synthesized
ttattgattcaaatcaagat

SEQ ID NO: 495397 - DNA, 20 bp, Artificial Sequence
  chemically synthesized
agagtcattcagatcttgat

SEQ ID NO: 495398 - DNA, 20 bp, Artificial Sequence
  chemically synthesized
aggcttgaatatagggttaa

SEQ ID NO: 495399 - DNA, 20 bp, Artificial Sequence
  chemically synthesized
aattcatgaaggcttgaata

SEQ ID NO: 495400 - DNA, 20 bp, Artificial Sequence
  chemically synthesized
aaccctatattcaagccttc

SEQ ID NO: 495401 - DNA, 20 bp, Artificial Sequence
  chemically synthesized
acaggtgaattcatgaaggc

SEQ ID NO: 495402 - DNA, 20 bp, Artificial Sequence
  chemically synthesized
ttatttttttcatttgacag

SEQ ID NO: 495403 - DNA, 20 bp, Artificial Sequence
  chemically synthesized
aaataacacctacagctttg

SEQ ID NO: 495404 - DNA, 20 bp, Artificial Sequence
  chemically synthesized
cagctttgcagaattatttt

SEQ ID NO: 495405 - DNA, 20 bp, Artificial Sequence
  chemically synthesized
tgtatcagataatgtgctag

SEQ ID NO: 495406 - DNA, 20 bp, Artificial Sequence
  chemically synthesized
cacagttgctctacttgcat

SEQ ID NO: 495407 - DNA, 20 bp, Artificial Sequence
  chemically synthesized
aataaagtaataaatgatgc

SEQ ID NO: 495408 - DNA, 20 bp, Artificial Sequence
  chemically synthesized
atgagacaaatgatagaaac

SEQ ID NO: 495409 - DNA, 20 bp, Artificial Sequence
  chemically synthesized
aatatctatctttattagtc

SEQ ID NO: 495410 - DNA, 20 bp, Artificial Sequence
  chemically synthesized
tattgcatactaagtgtgtg

SEQ ID NO: 495411 - DNA, 20 bp, Artificial Sequence
  chemically synthesized
ccaactctgcctctcaatat

SEQ ID NO: 495412 - DNA, 20 bp, Artificial Sequence
  chemically synthesized
aggactcaaatattgagagg

SEQ ID NO: 495413 - DNA, 20 bp, Artificial Sequence
  chemically synthesized
caaatattgagaggcagagt

SEQ ID NO: 495414 - DNA, 20 bp, Artificial Sequence
  chemically synthesized
tgagaggcagagttggaatt

SEQ ID NO: 495415 - DNA, 20 bp, Artificial Sequence
  chemically synthesized
aggagctgtagcttgagatt

SEQ ID NO: 495416 - DNA, 20 bp, Artificial Sequence
  chemically synthesized
ttaggcacagttggaggaaa

SEQ ID NO: 495417 - DNA, 20 bp, Artificial Sequence
  chemically synthesized
ctaagctaagtgcctggtat

SEQ ID NO: 495418 - DNA, 20 bp, Artificial Sequence
  chemically synthesized
gtatgtggattaactgctat

SEQ ID NO: 495419 - DNA, 20 bp, Artificial Sequence
  chemically synthesized
cagagtcttttttactgtaa

SEQ ID NO: 495420 - DNA, 20 bp, Artificial Sequence
  chemically synthesized
aattatgtggatgcagcaaa

SEQ ID NO: 495421 - DNA, 20 bp, Artificial Sequence
  chemically synthesized
ttgaacggactgataattat

SEQ ID NO: 495422 - DNA, 20 bp, Artificial Sequence
  chemically synthesized
aaaatgtgaagtgtatgaga

SEQ ID NO: 495423 - DNA, 20 bp, Artificial Sequence
  chemically synthesized
ctggaaaatgtgaagtgtat

SEQ ID NO: 495424 - DNA, 20 bp, Artificial Sequence
  chemically synthesized
ctcatacacttcacattttc

SEQ ID NO: 495425 - DNA, 20 bp, Artificial Sequence
  chemically synthesized
ctgttggggcaacgattgag

SEQ ID NO: 495426 - DNA, 20 bp, Artificial Sequence
  chemically synthesized
cccagtttagcaaacaggat

SEQ ID NO: 495427 - DNA, 20 bp, Artificial Sequence
  chemically synthesized
gaacagcccagtttagcaaa

SEQ ID NO: 495428 - DNA, 20 bp, Artificial Sequence
  chemically synthesized
tatgatgatgtgaacatgtt

SEQ ID NO: 495429 - DNA, 20 bp, Artificial Sequence
  chemically synthesized
aatctcagtcaatatattta

SEQ ID NO: 495430 - DNA, 20 bp, Artificial Sequence
  chemically synthesized
aatatatttatagagtcagg

SEQ ID NO: 495431 - DNA, 20 bp, Artificial Sequence
  chemically synthesized
atttatagagtcaggaagag

SEQ ID NO: 495432 - DNA, 20 bp, Artificial Sequence
  chemically synthesized
gaattacagttgatgaatat

SEQ ID NO: 495433 - DNA, 20 bp, Artificial Sequence
  chemically synthesized
atcctgatgaattacagttg

SEQ ID NO: 495434 - DNA, 20 bp, Artificial Sequence
  chemically synthesized
attcatcaactgtaattcat

SEQ ID NO: 495435 - DNA, 20 bp, Artificial Sequence
  chemically synthesized
ccctaactataataatcctg

SEQ ID NO: 495436 - DNA, 20 bp, Artificial Sequence
  chemically synthesized
tgtctttcagtgtcataact

SEQ ID NO: 495437 - DNA, 20 bp, Artificial Sequence
  chemically synthesized
gacactgaaagacatgatca

SEQ ID NO: 495438 - DNA, 20 bp, Artificial Sequence
  chemically synthesized
tgttatatagcaagtatgtt

SEQ ID NO: 495439 - DNA, 20 bp, Artificial Sequence
  chemically synthesized
acatacttgctatataacac

SEQ ID NO: 495440 - DNA, 20 bp, Artificial Sequence
  chemically synthesized
catcaccacaaagtaactta

SEQ ID NO: 495441 - DNA, 20 bp, Artificial Sequence
  chemically synthesized
tatagacatggttaatgtca

SEQ ID NO: 495442 - DNA, 20 bp, Artificial Sequence
  chemically synthesized
tttgcacatgctcttttact

SEQ ID NO: 495443 - DNA, 20 bp, Artificial Sequence
  chemically synthesized
aactagactgtagaccttac

SEQ ID NO: 495444 - DNA, 20 bp, Artificial Sequence
  chemically synthesized
actgtgccaatgtcagttta

SEQ ID NO: 495445 - DNA, 20 bp, Artificial Sequence
  chemically synthesized
taatatgtaactggggaaag

SEQ ID NO: 495446 - DNA, 20 bp, Artificial Sequence
  chemically synthesized
tactgtttttgcaactcctt

SEQ ID NO: 495447 - DNA, 20 bp, Artificial Sequence
  chemically synthesized
gaaatattcatagactcaca

SEQ ID NO: 495448 - DNA, 20 bp, Artificial Sequence
  chemically synthesized
ttgcaactccttgtgagtct

SEQ ID NO: 495449 - DNA, 20 bp, Artificial Sequence
  chemically synthesized
caaaatttctataaagtttt

SEQ ID NO: 495450 - DNA, 20 bp, Artificial Sequence
  chemically synthesized
aataaagaaaacttcctatt

SEQ ID NO: 495451 - DNA, 20 bp, Artificial Sequence
  chemically synthesized
aaacatagttgctatatcaa

SEQ ID NO: 495452 - DNA, 20 bp, Artificial Sequence
  chemically synthesized
ttcacaaagctgaagaaggt

SEQ ID NO: 495453 - DNA, 20 bp, Artificial Sequence
  chemically synthesized
aatgacttttctctgtgcaa

SEQ ID NO: 495454 - DNA, 20 bp, Artificial Sequence
  chemically synthesized
gatgtaaacaagacaaaaac

SEQ ID NO: 495455 - DNA, 20 bp, Artificial Sequence
  chemically synthesized
tattggcaggtttatggaag

SEQ ID NO: 495456 - DNA, 20 bp, Artificial Sequence
  chemically synthesized
tcactaatcttaagctatga

SEQ ID NO: 495457 - DNA, 20 bp, Artificial Sequence
  chemically synthesized
ggtgaattcaaatcatatca

SEQ ID NO: 495458 - DNA, 20 bp, Artificial Sequence
  chemically synthesized
aacagattcaatgatatgat

SEQ ID NO: 495459 - DNA, 20 bp, Artificial Sequence
  chemically synthesized
tttacaatatcttacataag

SEQ ID NO: 495460 - DNA, 20 bp, Artificial Sequence
  chemically synthesized
gtgtcttctctcaaatggaa

SEQ ID NO: 495461 - DNA, 20 bp, Artificial Sequence
  chemically synthesized
aactaaagtgattaaatggg

SEQ ID NO: 495462 - DNA, 20 bp, Artificial Sequence
  chemically synthesized
catacaaaaatcgtcaacac

SEQ ID NO: 495463 - DNA, 20 bp, Artificial Sequence
  chemically synthesized
tgcttaatgcctttggataa

SEQ ID NO: 495464 - DNA, 20 bp, Artificial Sequence
  chemically synthesized
aaagtcattgcttaatgcct

SEQ ID NO: 495465 - DNA, 20 bp, Artificial Sequence
  chemically synthesized
aatgacttttcaaagttgat

SEQ ID NO: 495466 - DNA, 20 bp, Artificial Sequence
  chemically synthesized
ccacatgactggggaggcct

SEQ ID NO: 495467 - DNA, 20 bp, Artificial Sequence
  chemically synthesized
cgagatctgttggttttatc

SEQ ID NO: 495468 - DNA, 20 bp, Artificial Sequence
  chemically synthesized
cccatactgttctcatggta

SEQ ID NO: 495469 - DNA, 20 bp, Artificial Sequence
  chemically synthesized
gggatccagtgggaggtcat

SEQ ID NO: 495470 - DNA, 20 bp, Artificial Sequence
  chemically synthesized
atgattcaaatgacctccca

SEQ ID NO: 495471 - DNA, 20 bp, Artificial Sequence
  chemically synthesized
taattcctacttgttgtggg

SEQ ID NO: 495472 - DNA, 20 bp, Artificial Sequence
  chemically synthesized
ggatccctcccacaacaagt

SEQ ID NO: 495473 - DNA, 20 bp, Artificial Sequence
  chemically synthesized
ccacaacaagtaggaattat

SEQ ID NO: 495474 - DNA, 20 bp, Artificial Sequence
  chemically synthesized
acaagtaggaattatgggag

SEQ ID NO: 495475 - DNA, 20 bp, Artificial Sequence
  chemically synthesized
gtccccacccaaatctcatc

SEQ ID NO: 495476 - DNA, 20 bp, Artificial Sequence
  chemically synthesized
agtagaattcaagatgagat

SEQ ID NO: 495477 - DNA, 20 bp, Artificial Sequence
  chemically synthesized
cattgctctgcatggtacat

SEQ ID NO: 495478 - DNA, 20 bp, Artificial Sequence
  chemically synthesized
atattaaatgttactgcata

SEQ ID NO: 495479 - DNA, 20 bp, Artificial Sequence
  chemically synthesized
gtaacatttaatatttttaa

SEQ ID NO: 495480 - DNA, 20 bp, Artificial Sequence
  chemically synthesized
taaaaataaggtcaggtgca

SEQ ID NO: 495481 - DNA, 20 bp, Artificial Sequence
  chemically synthesized
gactcagcctcccaaagtgt

SEQ ID NO: 495482 - DNA, 20 bp, Artificial Sequence
  chemically synthesized
aatcccaacactttgggagg

SEQ ID NO: 495483 - DNA, 20 bp, Artificial Sequence
  chemically synthesized
caacactttgggaggctgag

SEQ ID NO: 495484 - DNA, 20 bp, Artificial Sequence
  chemically synthesized
actttgggaggctgagtcgg

SEQ ID NO: 495485 - DNA, 20 bp, Artificial Sequence
  chemically synthesized
cgggtggatgacttgaggct

SEQ ID NO: 495486 - DNA, 20 bp, Artificial Sequence
  chemically synthesized
ttttgtatttttagtagaga

SEQ ID NO: 495487 - DNA, 20 bp, Artificial Sequence
  chemically synthesized
gcctcggcctcccaagcagc

SEQ ID NO: 495488 - DNA, 20 bp, Artificial Sequence
  chemically synthesized
tgcttgggaggccgaggcac

SEQ ID NO: 495489 - DNA, 20 bp, Artificial Sequence
  chemically synthesized
ctcactgcaacctccacctc

SEQ ID NO: 495490 - DNA, 20 bp, Artificial Sequence
  chemically synthesized
tcataccactgcacttcagc

SEQ ID NO: 495491 - DNA, 20 bp, Artificial Sequence
  chemically synthesized
tttttgtttttgttttgaga

SEQ ID NO: 495492 - DNA, 20 bp, Artificial Sequence
  chemically synthesized
cacactgaggccatttagaa

SEQ ID NO: 495493 - DNA, 20 bp, Artificial Sequence
  chemically synthesized
gttgtgcatactaattgcca

SEQ ID NO: 495494 - DNA, 20 bp, Artificial Sequence
  chemically synthesized
gagaataaaaattgcaggtt

SEQ ID NO: 495495 - DNA, 20 bp, Artificial Sequence
  chemically synthesized
aggaggcacagagagcaaag

SEQ ID NO: 495496 - DNA, 20 bp, Artificial Sequence
  chemically synthesized
aaaaatagttctttaaaaat

SEQ ID NO: 495497 - DNA, 20 bp, Artificial Sequence
  chemically synthesized
tttatttataagaaaaaatc

SEQ ID NO: 495498 - DNA, 20 bp, Artificial Sequence
  chemically synthesized
actctatattatattgaatt

SEQ ID NO: 495499 - DNA, 20 bp, Artificial Sequence
  chemically synthesized
atccagaattcaatataata

SEQ ID NO: 495500 - DNA, 20 bp, Artificial Sequence
  chemically synthesized
gtgttgcactctatattata

SEQ ID NO: 495501 - DNA, 20 bp, Artificial Sequence
  chemically synthesized
ttaaaattaaggctttctac

SEQ ID NO: 495502 - DNA, 20 bp, Artificial Sequence
  chemically synthesized
atcatttcttgtgtaacttc

SEQ ID NO: 495503 - DNA, 20 bp, Artificial Sequence
  chemically synthesized
agatggagataacagacaca

SEQ ID NO: 495504 - DNA, 20 bp, Artificial Sequence
  chemically synthesized
caatgtctatttgtagaaaa

SEQ ID NO: 495505 - DNA, 20 bp, Artificial Sequence
  chemically synthesized
cccccgtgtgtagcagcgca

SEQ ID NO: 495506 - DNA, 20 bp, Artificial Sequence
  chemically synthesized
cccttgcgctgctacacacg

SEQ ID NO: 495507 - DNA, 20 bp, Artificial Sequence
  chemically synthesized
gtttcctgccttgtttttgt

SEQ ID NO: 495508 - DNA, 20 bp, Artificial Sequence
  chemically synthesized
agaaacaaggagctgagcta

SEQ ID NO: 495509 - DNA, 20 bp, Artificial Sequence
  chemically synthesized
tgagctatagaataatgtta

SEQ ID NO: 495510 - DNA, 20 bp, Artificial Sequence
  chemically synthesized
atgttagaggatggtgcaag

SEQ ID NO: 495511 - DNA, 20 bp, Artificial Sequence
  chemically synthesized
tctccaggactctccttgga

SEQ ID NO: 495512 - DNA, 20 bp, Artificial Sequence
  chemically synthesized
ggtaggtaatcctctccaag

SEQ ID NO: 495513 - DNA, 20 bp, Artificial Sequence
  chemically synthesized
ttctatatagcctcagggct

SEQ ID NO: 495514 - DNA, 20 bp, Artificial Sequence
  chemically synthesized
tagaagacacgattgcagag

SEQ ID NO: 495515 - DNA, 20 bp, Artificial Sequence
  chemically synthesized
caatttgcagagtgtctctc

SEQ ID NO: 495516 - DNA, 20 bp, Artificial Sequence
  chemically synthesized
ggaagttttaatacaatttg

SEQ ID NO: 495517 - DNA, 20 bp, Artificial Sequence
  chemically synthesized
ttaaaacttcccacatcaag

SEQ ID NO: 495518 - DNA, 20 bp, Artificial Sequence
  chemically synthesized
tttgctgactctccttttgt

SEQ ID NO: 495519 - DNA, 20 bp, Artificial Sequence
  chemically synthesized
tgacaatattcaaacaaaag

SEQ ID NO: 495520 - DNA, 20 bp, Artificial Sequence
  chemically synthesized
ggccgtaaaggttggtgagg

SEQ ID NO: 495521 - DNA, 20 bp, Artificial Sequence
  chemically synthesized
caaaacctctctttttctca

SEQ ID NO: 495522 - DNA, 20 bp, Artificial Sequence
  chemically synthesized
cattgttttacttgcacttg

SEQ ID NO: 495523 - DNA, 20 bp, Artificial Sequence
  chemically synthesized
tgcacttgctgagtcccctt

SEQ ID NO: 495524 - DNA, 20 bp, Artificial Sequence
  chemically synthesized
gctctcgacttttctgtgag

SEQ ID NO: 495525 - DNA, 20 bp, Artificial Sequence
  chemically synthesized
cattaagcaaagtaacggtt

SEQ ID NO: 495526 - DNA, 20 bp, Artificial Sequence
  chemically synthesized
gtaacggttaagaatatgca

SEQ ID NO: 495527 - DNA, 20 bp, Artificial Sequence
  chemically synthesized
atgtcctgtgttaatgaaga

SEQ ID NO: 495528 - DNA, 20 bp, Artificial Sequence
  chemically synthesized
tcctttgtgcagagaaggat

SEQ ID NO: 495529 - DNA, 20 bp, Artificial Sequence
  chemically synthesized
ttctcctcctttgtgcagag

SEQ ID NO: 495530 - DNA, 20 bp, Artificial Sequence
  chemically synthesized
gtctttgaacttagttagat

SEQ ID NO: 495531 - DNA, 20 bp, Artificial Sequence
  chemically synthesized
gaacttagttagatatgggt

SEQ ID NO: 495532 - DNA, 20 bp, Artificial Sequence
  chemically synthesized
agctttgcaaggtcgtagca

SEQ ID NO: 495533 - DNA, 20 bp, Artificial Sequence
  chemically synthesized
tccatgagtttattggggtt

SEQ ID NO: 495534 - DNA, 20 bp, Artificial Sequence
  chemically synthesized
taatgtatccatgagtttat

SEQ ID NO: 495535 - DNA, 20 bp, Artificial Sequence
  chemically synthesized
ttctgaaccccaataaactc

SEQ ID NO: 495536 - DNA, 20 bp, Artificial Sequence
  chemically synthesized
gcttttactttaatgtatcc

SEQ ID NO: 495537 - DNA, 20 bp, Artificial Sequence
  chemically synthesized
aaagctctgtgcatgcttgt

SEQ ID NO: 495538 - DNA, 20 bp, Artificial Sequence
  chemically synthesized
atggcaaagtgcctggcatg

SEQ ID NO: 495539 - DNA, 20 bp, Artificial Sequence
  chemically synthesized
attgaagaaattactgtcca

SEQ ID NO: 495540 - DNA, 20 bp, Artificial Sequence
  chemically synthesized
ccatgggatctagtcaatca

SEQ ID NO: 495541 - DNA, 20 bp, Artificial Sequence
  chemically synthesized
atatcagtcttgaatgctga

SEQ ID NO: 495542 - DNA, 20 bp, Artificial Sequence
  chemically synthesized
taaaatatcagtcttgaatg

SEQ ID NO: 495543 - DNA, 20 bp, Artificial Sequence
  chemically synthesized
attcagataaaatatcagtc

SEQ ID NO: 495544 - DNA, 20 bp, Artificial Sequence
  chemically synthesized
attcaagactgatattttat

SEQ ID NO: 495545 - DNA, 20 bp, Artificial Sequence
  chemically synthesized
gttgagtgaagggtgatttg

SEQ ID NO: 495546 - DNA, 20 bp, Artificial Sequence
  chemically synthesized
taagaaaaccgtgttgagtg

SEQ ID NO: 495547 - DNA, 20 bp, Artificial Sequence
  chemically synthesized
atgatgataagaaaaccgtg

SEQ ID NO: 495548 - DNA, 20 bp, Artificial Sequence
  chemically synthesized
ggatggaggggctctacctg

SEQ ID NO: 495549 - DNA, 20 bp, Artificial Sequence
  chemically synthesized
agagcccctccatcctatct

SEQ ID NO: 495550 - DNA, 20 bp, Artificial Sequence
  chemically synthesized
agtgtatgcaaatccagaga

SEQ ID NO: 495551 - DNA, 20 bp, Artificial Sequence
  chemically synthesized
ctggatttgcatacactgtt

SEQ ID NO: 495552 - DNA, 20 bp, Artificial Sequence
  chemically synthesized
gtctactagatcatgaaatc

SEQ ID NO: 495553 - DNA, 20 bp, Artificial Sequence
  chemically synthesized
taaaaatacagggccttgtg

SEQ ID NO: 495554 - DNA, 20 bp, Artificial Sequence
  chemically synthesized
aggagctcaatataaatata

SEQ ID NO: 495555 - DNA, 20 bp, Artificial Sequence
  chemically synthesized
ctcaatataaatatattgaa

SEQ ID NO: 495556 - DNA, 20 bp, Artificial Sequence
  chemically synthesized
taaaggatagtttcttttac

SEQ ID NO: 495557 - DNA, 20 bp, Artificial Sequence
  chemically synthesized
tgaagttgtgtaactaggta

SEQ ID NO: 495558 - DNA, 20 bp, Artificial Sequence
  chemically synthesized
cttcataataatttattact

SEQ ID NO: 495559 - DNA, 20 bp, Artificial Sequence
  chemically synthesized
caaaagttcttgtgaaaatt

SEQ ID NO: 495560 - DNA, 20 bp, Artificial Sequence
  chemically synthesized
tatctgcagattttttttaa

SEQ ID NO: 495561 - DNA, 20 bp, Artificial Sequence
  chemically synthesized
tgtgctggagaaatatatta

SEQ ID NO: 495562 - DNA, 20 bp, Artificial Sequence
  chemically synthesized
ctcaatactgcctgcttcat

SEQ ID NO: 495563 - DNA, 20 bp, Artificial Sequence
  chemically synthesized
gattgcatggatttaatgtg

SEQ ID NO: 495564 - DNA, 20 bp, Artificial Sequence
  chemically synthesized
gtgttcattatttagattgc

SEQ ID NO: 495565 - DNA, 20 bp, Artificial Sequence
  chemically synthesized
aattgtatgctgtaggctgc

SEQ ID NO: 495566 - DNA, 20 bp, Artificial Sequence
  chemically synthesized
ttttttttttctttttgaga

SEQ ID NO: 495567 - DNA, 20 bp, Artificial Sequence
  chemically synthesized
tctccctctgtcgcccaggc

SEQ ID NO: 495568 - DNA, 20 bp, Artificial Sequence
  chemically synthesized
ctcactgcaagctccgcctc

SEQ ID NO: 495569 - DNA, 20 bp, Artificial Sequence
  chemically synthesized
tactcgggaggttaaggcag

SEQ ID NO: 495570 - DNA, 20 bp, Artificial Sequence
  chemically synthesized
cattctcctgccttaacctc

SEQ ID NO: 495571 - DNA, 20 bp, Artificial Sequence
  chemically synthesized
cgaggtttcaccgtgttagc

SEQ ID NO: 495572 - DNA, 20 bp, Artificial Sequence
  chemically synthesized
actttgggaggccgaggcgg

SEQ ID NO: 495573 - DNA, 20 bp, Artificial Sequence
  chemically synthesized
gcctcggcctcccaaagtgc

SEQ ID NO: 495574 - DNA, 20 bp, Artificial Sequence
  chemically synthesized
ttatacacagtgaccagtta

SEQ ID NO: 495575 - DNA, 20 bp, Artificial Sequence
  chemically synthesized
tcataatcacattgaaatac

SEQ ID NO: 495576 - DNA, 20 bp, Artificial Sequence
  chemically synthesized
ccaagaaaatatgtttcgtt

SEQ ID NO: 495577 - DNA, 20 bp, Artificial Sequence
  chemically synthesized
gtgggagatgggcaagtctt

SEQ ID NO: 495578 - DNA, 20 bp, Artificial Sequence
  chemically synthesized
aagaaataaaagcagattag

SEQ ID NO: 495579 - DNA, 20 bp, Artificial Sequence
  chemically synthesized
tgtcacctagattttgcctt

SEQ ID NO: 495580 - DNA, 20 bp, Artificial Sequence
  chemically synthesized
caagcacatttctgttgcca

SEQ ID NO: 495581 - DNA, 20 bp, Artificial Sequence
  chemically synthesized
tccatatgagtggaatggag

SEQ ID NO: 495582 - DNA, 20 bp, Artificial Sequence
  chemically synthesized
ctcctctccattccactcat

SEQ ID NO: 495583 - DNA, 20 bp, Artificial Sequence
  chemically synthesized
catgtgagaatccatatgag

SEQ ID NO: 495584 - DNA, 20 bp, Artificial Sequence
  chemically synthesized
aaacccatgtgagaatccat

SEQ ID NO: 495585 - DNA, 20 bp, Artificial Sequence
  chemically synthesized
ccactcatatggattctcac

SEQ ID NO: 495586 - DNA, 20 bp, Artificial Sequence
  chemically synthesized
ttttctactaaaacccatgt

SEQ ID NO: 495587 - DNA, 20 bp, Artificial Sequence
  chemically synthesized
gaacatggactgatttttct

SEQ ID NO: 495588 - DNA, 20 bp, Artificial Sequence
  chemically synthesized
tctctggattattaaatgag

SEQ ID NO: 495589 - DNA, 20 bp, Artificial Sequence
  chemically synthesized
gattattaaatgagaagggt

SEQ ID NO: 495590 - DNA, 20 bp, Artificial Sequence
  chemically synthesized
ttttaattagaaaagtaatg

SEQ ID NO: 495591 - DNA, 20 bp, Artificial Sequence
  chemically synthesized
ttctctgtaatatacatgct

SEQ ID NO: 495592 - DNA, 20 bp, Artificial Sequence
  chemically synthesized
taaaattacttaaaatctga

SEQ ID NO: 495593 - DNA, 20 bp, Artificial Sequence
  chemically synthesized
ttaaagtgctattaatataa

SEQ ID NO: 495594 - DNA, 20 bp, Artificial Sequence
  chemically synthesized
agcactttaaagtaatacat

SEQ ID NO: 495595 - DNA, 20 bp, Artificial Sequence
  chemically synthesized
cggatacaactttaaaaagt

SEQ ID NO: 495596 - DNA, 20 bp, Artificial Sequence
  chemically synthesized
cgcttataaggaagaccaaa

SEQ ID NO: 495597 - DNA, 20 bp, Artificial Sequence
  chemically synthesized
accaaaaagagtacactgat

SEQ ID NO: 495598 - DNA, 20 bp, Artificial Sequence
  chemically synthesized
gaattttatttttgaaagac

SEQ ID NO: 495599 - DNA, 20 bp, Artificial Sequence
  chemically synthesized
tgagccaccgcgcccagccc

SEQ ID NO: 495600 - DNA, 20 bp, Artificial Sequence
  chemically synthesized
tgggcgcggtggctcacgtc

SEQ ID NO: 495601 - DNA, 20 bp, Artificial Sequence
  chemically synthesized
tcctcagcttcccaaagcac

SEQ ID NO: 495602 - DNA, 20 bp, Artificial Sequence
  chemically synthesized
cagtgctttgggaagctgag

SEQ ID NO: 495603 - DNA, 20 bp, Artificial Sequence
  chemically synthesized
gctttgggaagctgaggagg

SEQ ID NO: 495604 - DNA, 20 bp, Artificial Sequence
  chemically synthesized
agggtggatcacctgaggtc

SEQ ID NO: 495605 - DNA, 20 bp, Artificial Sequence
  chemically synthesized
tttgtatttttagtagagac

SEQ ID NO: 495606 - DNA, 20 bp, Artificial Sequence
  chemically synthesized
gcctcagcctccctagtagc

SEQ ID NO: 495607 - DNA, 20 bp, Artificial Sequence
  chemically synthesized
tactagggaggctgaggcag

SEQ ID NO: 495608 - DNA, 20 bp, Artificial Sequence
  chemically synthesized
ggcaggagaatcgcttgaac

SEQ ID NO: 495609 - DNA, 20 bp, Artificial Sequence
  chemically synthesized
ttcactcttgttgcccaggc

SEQ ID NO: 495610 - DNA, 20 bp, Artificial Sequence
  chemically synthesized
tgcaccccagcctgggcaac

SEQ ID NO: 495611 - DNA, 20 bp, Artificial Sequence
  chemically synthesized
aagagtgaaacaccgtctca

SEQ ID NO: 495612 - DNA, 20 bp, Artificial Sequence
  chemically synthesized
caaaaaatagatttcaaagt

SEQ ID NO: 495613 - DNA, 20 bp, Artificial Sequence
  chemically synthesized
atcatgttgttttagccagt

SEQ ID NO: 495614 - DNA, 20 bp, Artificial Sequence
  chemically synthesized
ataacttacatacatgtgtc

SEQ ID NO: 495615 - DNA, 20 bp, Artificial Sequence
  chemically synthesized
ctggaagtgtttttgttact

SEQ ID NO: 495616 - DNA, 20 bp, Artificial Sequence
  chemically synthesized
catatacacacataaacatt

SEQ ID NO: 495617 - DNA, 20 bp, Artificial Sequence
  chemically synthesized
tatagtgaaagccccaataa

SEQ ID NO: 495618 - DNA, 20 bp, Artificial Sequence
  chemically synthesized
gggctttcactataatatgc

SEQ ID NO: 495619 - DNA, 20 bp, Artificial Sequence
  chemically synthesized
tatgcctgggtgtgcctcca

SEQ ID NO: 495620 - DNA, 20 bp, Artificial Sequence
  chemically synthesized
cttggaaaaaaacagtccca

SEQ ID NO: 495621 - DNA, 20 bp, Artificial Sequence
  chemically synthesized
taaaatgtgttaatagtaga

SEQ ID NO: 495622 - DNA, 20 bp, Artificial Sequence
  chemically synthesized
cgctaatttattatctccat

SEQ ID NO: 495623 - DNA, 20 bp, Artificial Sequence
  chemically synthesized
agataatatatagattactt

SEQ ID NO: 495624 - DNA, 20 bp, Artificial Sequence
  chemically synthesized
tgtgaattataagccttaaa

SEQ ID NO: 495625 - DNA, 20 bp, Artificial Sequence
  chemically synthesized
gcttcttcctactgacatgt

SEQ ID NO: 495626 - DNA, 20 bp, Artificial Sequence
  chemically synthesized
aatttcaatttgtgattttc

SEQ ID NO: 495627 - DNA, 20 bp, Artificial Sequence
  chemically synthesized
taattactgtaaactatcgg

SEQ ID NO: 495628 - DNA, 20 bp, Artificial Sequence
  chemically synthesized
gtaacctcatagattgtggt

SEQ ID NO: 495629 - DNA, 20 bp, Artificial Sequence
  chemically synthesized
gaagagatgtcctaaacagt

SEQ ID NO: 495630 - DNA, 20 bp, Artificial Sequence
  chemically synthesized
tggtaacaaaagaccacatt

SEQ ID NO: 495631 - DNA, 20 bp, Artificial Sequence
  chemically synthesized
ctttacttatctatctatcg

SEQ ID NO: 495632 - DNA, 20 bp, Artificial Sequence
  chemically synthesized
cgatagatagataagtaaag

SEQ ID NO: 495633 - DNA, 20 bp, Artificial Sequence
  chemically synthesized
agagggagagggaaagggaa

SEQ ID NO: 495634 - DNA, 20 bp, Artificial Sequence
  chemically synthesized
ggtgggagagagagaagtaa

SEQ ID NO: 495635 - DNA, 20 bp, Artificial Sequence
  chemically synthesized
ggagagagagaagtaactga

SEQ ID NO: 495636 - DNA, 20 bp, Artificial Sequence
  chemically synthesized
agagagaagtaactgagtgg

SEQ ID NO: 495637 - DNA, 20 bp, Artificial Sequence
  chemically synthesized
agaagtaactgagtggatgg

SEQ ID NO: 495638 - DNA, 20 bp, Artificial Sequence
  chemically synthesized
ctgagtggatggatgggtag

SEQ ID NO: 495639 - DNA, 20 bp, Artificial Sequence
  chemically synthesized
atggatgggtagatgaataa

SEQ ID NO: 495640 - DNA, 20 bp, Artificial Sequence
  chemically synthesized
atgggtagatgaataagtgg

SEQ ID NO: 495641 - DNA, 20 bp, Artificial Sequence
  chemically synthesized
gtagatgaataagtggatgg

SEQ ID NO: 495642 - DNA, 20 bp, Artificial Sequence
  chemically synthesized
ggagacaggtagacagccag

SEQ ID NO: 495643 - DNA, 20 bp, Artificial Sequence
  chemically synthesized
agacagccagatgggtatat

SEQ ID NO: 495644 - DNA, 20 bp, Artificial Sequence
  chemically synthesized
caattttagaagatataaaa

SEQ ID NO: 495645 - DNA, 20 bp, Artificial Sequence
  chemically synthesized
aagatataaaataggataac

SEQ ID NO: 495646 - DNA, 20 bp, Artificial Sequence
  chemically synthesized
taacaagagtacctatctta

SEQ ID NO: 495647 - DNA, 20 bp, Artificial Sequence
  chemically synthesized
tagttggtatttggctctta

SEQ ID NO: 495648 - DNA, 20 bp, Artificial Sequence
  chemically synthesized
tattaggctacatctaatct

SEQ ID NO: 495649 - DNA, 20 bp, Artificial Sequence
  chemically synthesized
agacacatagagggtgctta

SEQ ID NO: 495650 - DNA, 20 bp, Artificial Sequence
  chemically synthesized
catctgcgtttagacacata

SEQ ID NO: 495651 - DNA, 20 bp, Artificial Sequence
  chemically synthesized
taccgtaagtcatataacat

SEQ ID NO: 495652 - DNA, 20 bp, Artificial Sequence
  chemically synthesized
taaagtattgcccaaggtct

SEQ ID NO: 495653 - DNA, 20 bp, Artificial Sequence
  chemically synthesized
aaaaccagaacaactgacag

SEQ ID NO: 495654 - DNA, 20 bp, Artificial Sequence
  chemically synthesized
ttactggctacatcagttct

SEQ ID NO: 495655 - DNA, 20 bp, Artificial Sequence
  chemically synthesized
catgatggtacctatacctc

SEQ ID NO: 495656 - DNA, 20 bp, Artificial Sequence
  chemically synthesized
attattattgacttacatca

SEQ ID NO: 495657 - DNA, 20 bp, Artificial Sequence
  chemically synthesized
ctagtgagttaagaaagaag

SEQ ID NO: 495658 - DNA, 20 bp, Artificial Sequence
  chemically synthesized
atgtttattacagtatgcta

SEQ ID NO: 495659 - DNA, 20 bp, Artificial Sequence
  chemically synthesized
gggatctgcatggtgggtat

SEQ ID NO: 495660 - DNA, 20 bp, Artificial Sequence
  chemically synthesized
taattgctgggatctgcatg

SEQ ID NO: 495661 - DNA, 20 bp, Artificial Sequence
  chemically synthesized
gcccttgagtttataattgc

SEQ ID NO: 495662 - DNA, 20 bp, Artificial Sequence
  chemically synthesized
agatgaaaccatatgggccc

SEQ ID NO: 495663 - DNA, 20 bp, Artificial Sequence
  chemically synthesized
taggggtgggttgcgcttgg

SEQ ID NO: 495664 - DNA, 20 bp, Artificial Sequence
  chemically synthesized
atacaaagctaggtttaggg

SEQ ID NO: 495665 - DNA, 20 bp, Artificial Sequence
  chemically synthesized
aataatacaaagctaggttt

SEQ ID NO: 495666 - DNA, 20 bp, Artificial Sequence
  chemically synthesized
ggtattccaagcagcaaaag

SEQ ID NO: 495667 - DNA, 20 bp, Artificial Sequence
  chemically synthesized
gtgatccttcttttgctgct

SEQ ID NO: 495668 - DNA, 20 bp, Artificial Sequence
  chemically synthesized
ctgcttggaataccaagtta

SEQ ID NO: 495669 - DNA, 20 bp, Artificial Sequence
  chemically synthesized
aaatcacaaagctgttgctt

SEQ ID NO: 495670 - DNA, 20 bp, Artificial Sequence
  chemically synthesized
cataaaaacgctacctatca

SEQ ID NO: 495671 - DNA, 20 bp, Artificial Sequence
  chemically synthesized
ttatctatttaataggaata

SEQ ID NO: 495672 - DNA, 20 bp, Artificial Sequence
  chemically synthesized
tatcaacttatctatttaat

SEQ ID NO: 495673 - DNA, 20 bp, Artificial Sequence
  chemically synthesized
acataaaagaagtagtgaac

SEQ ID NO: 495674 - DNA, 20 bp, Artificial Sequence
  chemically synthesized
tctaagtgccagttggaaac

SEQ ID NO: 495675 - DNA, 20 bp, Artificial Sequence
  chemically synthesized
tactgataagaaaggtatcc

SEQ ID NO: 495676 - DNA, 20 bp, Artificial Sequence
  chemically synthesized
agacccaaacagtaagactc

SEQ ID NO: 495677 - DNA, 20 bp, Artificial Sequence
  chemically synthesized
gtatccttgagtcttactgt

SEQ ID NO: 495678 - DNA, 20 bp, Artificial Sequence
  chemically synthesized
ttgagtcttactgtttgggt

SEQ ID NO: 495679 - DNA, 20 bp, Artificial Sequence
  chemically synthesized
cagttagaaaatggcaaaat

SEQ ID NO: 495680 - DNA, 20 bp, Artificial Sequence
  chemically synthesized
aaaaaaaagaagaaattttt

SEQ ID NO: 495681 - DNA, 20 bp, Artificial Sequence
  chemically synthesized
ttttttttttttttttgaga

SEQ ID NO: 495682 - DNA, 20 bp, Artificial Sequence
  chemically synthesized
tctcgctctgtcacccaggc

SEQ ID NO: 495683 - DNA, 20 bp, Artificial Sequence
  chemically synthesized
tcgcgccactgcactccagc

SEQ ID NO: 495684 - DNA, 20 bp, Artificial Sequence
  chemically synthesized
ctcactgcaacctccacctc

SEQ ID NO: 495685 - DNA, 20 bp, Artificial Sequence
  chemically synthesized
tactcgggaggctgaggcag

SEQ ID NO: 495686 - DNA, 20 bp, Artificial Sequence
  chemically synthesized
cattctcctgcctcagcctc

SEQ ID NO: 495687 - DNA, 20 bp, Artificial Sequence
  chemically synthesized
aaaattagcctggcgtggta

SEQ ID NO: 495688 - DNA, 20 bp, Artificial Sequence
  chemically synthesized
ttttatatttttagtagaga

SEQ ID NO: 495689 - DNA, 20 bp, Artificial Sequence
  chemically synthesized
cggggtttcaccgtgttcgc

SEQ ID NO: 495690 - DNA, 20 bp, Artificial Sequence
  chemically synthesized
gcctcggcctcccaaagtgc

SEQ ID NO: 495691 - DNA, 20 bp, Artificial Sequence
  chemically synthesized
ataaataagaaattttttgg

SEQ ID NO: 495692 - DNA, 20 bp, Artificial Sequence
  chemically synthesized
aagtaacttacatggattaa

SEQ ID NO: 495693 - DNA, 20 bp, Artificial Sequence
  chemically synthesized
gacaggtctaagtaacttac

SEQ ID NO: 495694 - DNA, 20 bp, Artificial Sequence
  chemically synthesized
taataagaaaaacattgtta

SEQ ID NO: 495695 - DNA, 20 bp, Artificial Sequence
  chemically synthesized
ttaaagaatttgaaaataag

SEQ ID NO: 495696 - DNA, 20 bp, Artificial Sequence
  chemically synthesized
attgttgttttgttagttag

SEQ ID NO: 495697 - DNA, 20 bp, Artificial Sequence
  chemically synthesized
agcttattggaggtgatatg

SEQ ID NO: 495698 - DNA, 20 bp, Artificial Sequence
  chemically synthesized
catccctgaaatgggatatg

SEQ ID NO: 495699 - DNA, 20 bp, Artificial Sequence
  chemically synthesized
gactctacatatcccatttc

SEQ ID NO: 495700 - DNA, 20 bp, Artificial Sequence
  chemically synthesized
tctgtaagtcatccctgaaa

SEQ ID NO: 495701 - DNA, 20 bp, Artificial Sequence
  chemically synthesized
agagggacttaataaaaatg

SEQ ID NO: 495702 - DNA, 20 bp, Artificial Sequence
  chemically synthesized
tttgttttgttttgttttac

SEQ ID NO: 495703 - DNA, 20 bp, Artificial Sequence
  chemically synthesized
cattttgtaggaatttattt

SEQ ID NO: 495704 - DNA, 20 bp, Artificial Sequence
  chemically synthesized
taattcctatttcattttgt

SEQ ID NO: 495705 - DNA, 20 bp, Artificial Sequence
  chemically synthesized
aaattcctacaaaatgaaat

SEQ ID NO: 495706 - DNA, 20 bp, Artificial Sequence
  chemically synthesized
gttagctatagtatttgtac

SEQ ID NO: 495707 - DNA, 20 bp, Artificial Sequence
  chemically synthesized
aatgcttcagaagcatttaa

SEQ ID NO: 495708 - DNA, 20 bp, Artificial Sequence
  chemically synthesized
aaaagttattaacttctgaa

SEQ ID NO: 495709 - DNA, 20 bp, Artificial Sequence
  chemically synthesized
aagtcaaatcatgcaatttg

SEQ ID NO: 495710 - DNA, 20 bp, Artificial Sequence
  chemically synthesized
tggtttccgagcattacaag

SEQ ID NO: 495711 - DNA, 20 bp, Artificial Sequence
  chemically synthesized
acttggctactgtctttaca

SEQ ID NO: 495712 - DNA, 20 bp, Artificial Sequence
  chemically synthesized
ataccattttctttaaaaaa

SEQ ID NO: 495713 - DNA, 20 bp, Artificial Sequence
  chemically synthesized
ctttttctactttcatattt

SEQ ID NO: 495714 - DNA, 20 bp, Artificial Sequence
  chemically synthesized
gtagaaaaaggcagctatga

SEQ ID NO: 495715 - DNA, 20 bp, Artificial Sequence
  chemically synthesized
agcagatcaatttaagaaag

SEQ ID NO: 495716 - DNA, 20 bp, Artificial Sequence
  chemically synthesized
atctttcttaaattgatctg

SEQ ID NO: 495717 - DNA, 20 bp, Artificial Sequence
  chemically synthesized
tcgtgacgagccaaggctaa

SEQ ID NO: 495718 - DNA, 20 bp, Artificial Sequence
  chemically synthesized
aataccttttgttctttgca

SEQ ID NO: 495719 - DNA, 20 bp, Artificial Sequence
  chemically synthesized
attaaatattagctgttttt

SEQ ID NO: 495720 - DNA, 20 bp, Artificial Sequence
  chemically synthesized
acagctaatatttaatgagc

SEQ ID NO: 495721 - DNA, 20 bp, Artificial Sequence
  chemically synthesized
aatgatatatgccaagtgtt

SEQ ID NO: 495722 - DNA, 20 bp, Artificial Sequence
  chemically synthesized
ctcatagagtagacttaaaa

SEQ ID NO: 495723 - DNA, 20 bp, Artificial Sequence
  chemically synthesized
caataatgctacttatctca

SEQ ID NO: 495724 - DNA, 20 bp, Artificial Sequence
  chemically synthesized
ctgtggcccagagaggtcaa

SEQ ID NO: 495725 - DNA, 20 bp, Artificial Sequence
  chemically synthesized
tagttaggatattatggttc

SEQ ID NO: 495726 - DNA, 20 bp, Artificial Sequence
  chemically synthesized
tattatatttataccatagt

SEQ ID NO: 495727 - DNA, 20 bp, Artificial Sequence
  chemically synthesized
tgtttgctgactaaagattg

SEQ ID NO: 495728 - DNA, 20 bp, Artificial Sequence
  chemically synthesized
gattgaagaatgtgttgtaa

SEQ ID NO: 495729 - DNA, 20 bp, Artificial Sequence
  chemically synthesized
gagtctattaattaaagaca

SEQ ID NO: 495730 - DNA, 20 bp, Artificial Sequence
  chemically synthesized
taagaccaagccaaatcttt

SEQ ID NO: 495731 - DNA, 20 bp, Artificial Sequence
  chemically synthesized
tcaataaagtttctatttta

SEQ ID NO: 495732 - DNA, 20 bp, Artificial Sequence
  chemically synthesized
attttagagaatatcttagt

SEQ ID NO: 495733 - DNA, 20 bp, Artificial Sequence
  chemically synthesized
ttcatgcaaaaatgatctaa

SEQ ID NO: 495734 - DNA, 20 bp, Artificial Sequence
  chemically synthesized
acatatatggcataaaagcc

SEQ ID NO: 495735 - DNA, 20 bp, Artificial Sequence
  chemically synthesized
tggcagtgccattcacactt

SEQ ID NO: 495736 - DNA, 20 bp, Artificial Sequence
  chemically synthesized
caactgagaaattcagaagt

SEQ ID NO: 495737 - DNA, 20 bp, Artificial Sequence
  chemically synthesized
acacacagggacataaattc

SEQ ID NO: 495738 - DNA, 20 bp, Artificial Sequence
  chemically synthesized
agagagagatggatctatcc

SEQ ID NO: 495739 - DNA, 20 bp, Artificial Sequence
  chemically synthesized
tggtctgtgtaaagagagag

SEQ ID NO: 495740 - DNA, 20 bp, Artificial Sequence
  chemically synthesized
gctccctaatcgctctgttg

SEQ ID NO: 495741 - DNA, 20 bp, Artificial Sequence
  chemically synthesized
cgattagggagctagttgtt

SEQ ID NO: 495742 - DNA, 20 bp, Artificial Sequence
  chemically synthesized
cacagcagggaaaatgttaa

SEQ ID NO: 495743 - DNA, 20 bp, Artificial Sequence
  chemically synthesized
aaaatgttaaacggatgtga

SEQ ID NO: 495744 - DNA, 20 bp, Artificial Sequence
  chemically synthesized
ttaaacggatgtgaaaggat

SEQ ID NO: 495745 - DNA, 20 bp, Artificial Sequence
  chemically synthesized
acggatgtgaaaggatatga

SEQ ID NO: 495746 - DNA, 20 bp, Artificial Sequence
  chemically synthesized
gagaacttgtttcttcattc

SEQ ID NO: 495747 - DNA, 20 bp, Artificial Sequence
  chemically synthesized
tttccacgttatttttattc

SEQ ID NO: 495748 - DNA, 20 bp, Artificial Sequence
  chemically synthesized
aaaataacgtggaaagttat

SEQ ID NO: 495749 - DNA, 20 bp, Artificial Sequence
  chemically synthesized
ggaaagttatgaggataaaa

SEQ ID NO: 495750 - DNA, 20 bp, Artificial Sequence
  chemically synthesized
ctcacaacaagagagtgcca

SEQ ID NO: 495751 - DNA, 20 bp, Artificial Sequence
  chemically synthesized
cactggcactctcttgttgt

SEQ ID NO: 495752 - DNA, 20 bp, Artificial Sequence
  chemically synthesized
acattccatcctcacaacaa

SEQ ID NO: 495753 - DNA, 20 bp, Artificial Sequence
  chemically synthesized
gcactctcttgttgtgagga

SEQ ID NO: 495754 - DNA, 20 bp, Artificial Sequence
  chemically synthesized
tggtggtggcatacctaaat

SEQ ID NO: 495755 - DNA, 20 bp, Artificial Sequence
  chemically synthesized
ttcaagcattttacagactt

SEQ ID NO: 495756 - DNA, 20 bp, Artificial Sequence
  chemically synthesized
ctccaaagtctgtaaaatgc

SEQ ID NO: 495757 - DNA, 20 bp, Artificial Sequence
  chemically synthesized
ctgccaccgtctgtggaggt

SEQ ID NO: 495758 - DNA, 20 bp, Artificial Sequence
  chemically synthesized
atggtattaggtaagaacct

SEQ ID NO: 495759 - DNA, 20 bp, Artificial Sequence
  chemically synthesized
ttgctatcacatatgagatg

SEQ ID NO: 495760 - DNA, 20 bp, Artificial Sequence
  chemically synthesized
ttattgataacagtattaag

SEQ ID NO: 495761 - DNA, 20 bp, Artificial Sequence
  chemically synthesized
aaaggaatgtcaaaatctgg

SEQ ID NO: 495762 - DNA, 20 bp, Artificial Sequence
  chemically synthesized
ctctcactaataattttgaa

SEQ ID NO: 495763 - DNA, 20 bp, Artificial Sequence
  chemically synthesized
taaattttcttccaagagtg

SEQ ID NO: 495764 - DNA, 20 bp, Artificial Sequence
  chemically synthesized
aaaggcctaaattttcttcc

SEQ ID NO: 495765 - DNA, 20 bp, Artificial Sequence
  chemically synthesized
taaatgttaatattaaggga

SEQ ID NO: 495766 - DNA, 20 bp, Artificial Sequence
  chemically synthesized
atattaagggaggggatagg

SEQ ID NO: 495767 - DNA, 20 bp, Artificial Sequence
  chemically synthesized
ctagaacaaatgaaacagga

SEQ ID NO: 495768 - DNA, 20 bp, Artificial Sequence
  chemically synthesized
actcactagaacaaatgaaa

SEQ ID NO: 495769 - DNA, 20 bp, Artificial Sequence
  chemically synthesized
atcctgtttcatttgttcta

SEQ ID NO: 495770 - DNA, 20 bp, Artificial Sequence
  chemically synthesized
cttaccttggctgggttttt

SEQ ID NO: 495771 - DNA, 20 bp, Artificial Sequence
  chemically synthesized
attttcttttcttaccttgg

SEQ ID NO: 495772 - DNA, 20 bp, Artificial Sequence
  chemically synthesized
ccttctcatgctctcaaact

SEQ ID NO: 495773 - DNA, 20 bp, Artificial Sequence
  chemically synthesized
atacataaattggctaagaa

SEQ ID NO: 495774 - DNA, 20 bp, Artificial Sequence
  chemically synthesized
taaattggctaagaaacgga

SEQ ID NO: 495775 - DNA, 20 bp, Artificial Sequence
  chemically synthesized
actcttgtccctggaaaaag

SEQ ID NO: 495776 - DNA, 20 bp, Artificial Sequence
  chemically synthesized
actcccctttttccagggac

SEQ ID NO: 495777 - DNA, 20 bp, Artificial Sequence
  chemically synthesized
ccctttttccagggacaaga

SEQ ID NO: 495778 - DNA, 20 bp, Artificial Sequence
  chemically synthesized
acaagtatataactagagaa

SEQ ID NO: 495779 - DNA, 20 bp, Artificial Sequence
  chemically synthesized
tttgcctccagaggcaaaag

SEQ ID NO: 495780 - DNA, 20 bp, Artificial Sequence
  chemically synthesized
ctggaggcaaaaggtatggt

SEQ ID NO: 495781 - DNA, 20 bp, Artificial Sequence
  chemically synthesized
gacaaagtgacaatcatcaa

SEQ ID NO: 495782 - DNA, 20 bp, Artificial Sequence
  chemically synthesized
gtttcatggtctgactgtat

SEQ ID NO: 495783 - DNA, 20 bp, Artificial Sequence
  chemically synthesized
atttctggaagcaaaggcag

SEQ ID NO: 495784 - DNA, 20 bp, Artificial Sequence
  chemically synthesized
aggcagcagaatttagccac

SEQ ID NO: 495785 - DNA, 20 bp, Artificial Sequence
  chemically synthesized
aataagggtctctgtagatt

SEQ ID NO: 495786 - DNA, 20 bp, Artificial Sequence
  chemically synthesized
tctctgtaatatctgtcaat

SEQ ID NO: 495787 - DNA, 20 bp, Artificial Sequence
  chemically synthesized
catgtttcgctggcatgttg

SEQ ID NO: 495788 - DNA, 20 bp, Artificial Sequence
  chemically synthesized
aagaccctaataaaatagat

SEQ ID NO: 495789 - DNA, 20 bp, Artificial Sequence
  chemically synthesized
cttatcctcatctattttat

SEQ ID NO: 495790 - DNA, 20 bp, Artificial Sequence
  chemically synthesized
tctattttattagggtcttg

SEQ ID NO: 495791 - DNA, 20 bp, Artificial Sequence
  chemically synthesized
acattttctttctggagaca

SEQ ID NO: 495792 - DNA, 20 bp, Artificial Sequence
  chemically synthesized
tattagatactatgtcagta

SEQ ID NO: 495793 - DNA, 20 bp, Artificial Sequence
  chemically synthesized
ctatttaaacagctatttat

SEQ ID NO: 495794 - DNA, 20 bp, Artificial Sequence
  chemically synthesized
tgtttaaatagccctgacct

SEQ ID NO: 495795 - DNA, 20 bp, Artificial Sequence
  chemically synthesized
gtatatatgcccttgtacac

SEQ ID NO: 495796 - DNA, 20 bp, Artificial Sequence
  chemically synthesized
tgccttctttcttctgttga

SEQ ID NO: 495797 - DNA, 20 bp, Artificial Sequence
  chemically synthesized
atcctgccttctttcttctg

SEQ ID NO: 495798 - DNA, 20 bp, Artificial Sequence
  chemically synthesized
attcaacagaagaaagaagg

SEQ ID NO: 495799 - DNA, 20 bp, Artificial Sequence
  chemically synthesized
ctataatttcaggttttctt

SEQ ID NO: 495800 - DNA, 20 bp, Artificial Sequence
  chemically synthesized
aaattgattttttaaagatg

SEQ ID NO: 495801 - DNA, 20 bp, Artificial Sequence
  chemically synthesized
ttaaagatggggggtgggcg

SEQ ID NO: 495802 - DNA, 20 bp, Artificial Sequence
  chemically synthesized
caacaaattttcttctttat

SEQ ID NO: 495803 - DNA, 20 bp, Artificial Sequence
  chemically synthesized
atgaatatactgatctccca

SEQ ID NO: 495804 - DNA, 20 bp, Artificial Sequence
  chemically synthesized
ccttgagataagagatgctc

SEQ ID NO: 495805 - DNA, 20 bp, Artificial Sequence
  chemically synthesized
ggtttcattagatttttaga

SEQ ID NO: 495806 - DNA, 20 bp, Artificial Sequence
  chemically synthesized
aagccaggctgaaaatgttc

SEQ ID NO: 495807 - DNA, 20 bp, Artificial Sequence
  chemically synthesized
gataagtgaagagacaaata

SEQ ID NO: 495808 - DNA, 20 bp, Artificial Sequence
  chemically synthesized
gtataaaaatgtgtctgtgt

SEQ ID NO: 495809 - DNA, 20 bp, Artificial Sequence
  chemically synthesized
gggcatacttttatttgaag

SEQ ID NO: 495810 - DNA, 20 bp, Artificial Sequence
  chemically synthesized
cttttgctgataataaatat

SEQ ID NO: 495811 - DNA, 20 bp, Artificial Sequence
  chemically synthesized
tttttaaagtagaaaaatcc

SEQ ID NO: 495812 - DNA, 20 bp, Artificial Sequence
  chemically synthesized
attttacaatttcaatattc

SEQ ID NO: 495813 - DNA, 20 bp, Artificial Sequence
  chemically synthesized
ggcaaaatcttcttaagaaa

SEQ ID NO: 495814 - DNA, 20 bp, Artificial Sequence
  chemically synthesized
tttcctatgtttaaacgtgc

SEQ ID NO: 495815 - DNA, 20 bp, Artificial Sequence
  chemically synthesized
tggcacgtttaaacatagga

SEQ ID NO: 495816 - DNA, 20 bp, Artificial Sequence
  chemically synthesized
aatgttttacttaaatttta

SEQ ID NO: 495817 - DNA, 20 bp, Artificial Sequence
  chemically synthesized
atgtattttatacctttact

SEQ ID NO: 495818 - DNA, 20 bp, Artificial Sequence
  chemically synthesized
ttgtattctatggagtaaag

SEQ ID NO: 495819 - DNA, 20 bp, Artificial Sequence
  chemically synthesized
gataattctcctttactcca

SEQ ID NO: 495820 - DNA, 20 bp, Artificial Sequence
  chemically synthesized
tgcagagtttttgtattcta

SEQ ID NO: 495821 - DNA, 20 bp, Artificial Sequence
  chemically synthesized
ttttaagataatgatatttg

SEQ ID NO: 495822 - DNA, 20 bp, Artificial Sequence
  chemically synthesized
atttgtatatatgtgttaaa

SEQ ID NO: 495823 - DNA, 20 bp, Artificial Sequence
  chemically synthesized
tcatctgataagaacaacct

SEQ ID NO: 495824 - DNA, 20 bp, Artificial Sequence
  chemically synthesized
tctcaggttgttcttatcag

SEQ ID NO: 495825 - DNA, 20 bp, Artificial Sequence
  chemically synthesized
agctaatagagacgtcagta

SEQ ID NO: 495826 - DNA, 20 bp, Artificial Sequence
  chemically synthesized
ttgagaacaagggaaaacat

SEQ ID NO: 495827 - DNA, 20 bp, Artificial Sequence
  chemically synthesized
aaacataagaatggtattat

SEQ ID NO: 495828 - DNA, 20 bp, Artificial Sequence
  chemically synthesized
gaaatataaaatactgtgat

SEQ ID NO: 495829 - DNA, 20 bp, Artificial Sequence
  chemically synthesized
ttgtacacagacaatatctc

SEQ ID NO: 495830 - DNA, 20 bp, Artificial Sequence
  chemically synthesized
ctctggaattatttttatta

SEQ ID NO: 495831 - DNA, 20 bp, Artificial Sequence
  chemically synthesized
aacacttaaaggtcttcgct

SEQ ID NO: 495832 - DNA, 20 bp, Artificial Sequence
  chemically synthesized
ctgtatattatctgcagtac

SEQ ID NO: 495833 - DNA, 20 bp, Artificial Sequence
  chemically synthesized
cagtactgcagataatatac

SEQ ID NO: 495834 - DNA, 20 bp, Artificial Sequence
  chemically synthesized
aactagatgattgcagtaat

SEQ ID NO: 495835 - DNA, 20 bp, Artificial Sequence
  chemically synthesized
aatcatctagtttgtgaaag

SEQ ID NO: 495836 - DNA, 20 bp, Artificial Sequence
  chemically synthesized
aaacaaaatatcaaatcatt

SEQ ID NO: 495837 - DNA, 20 bp, Artificial Sequence
  chemically synthesized
tcacaaccaagactatccta

SEQ ID NO: 495838 - DNA, 20 bp, Artificial Sequence
  chemically synthesized
gaggaaagctctgaattcct

SEQ ID NO: 495839 - DNA, 20 bp, Artificial Sequence
  chemically synthesized
ttggtcttgtgaggaaagct

SEQ ID NO: 495840 - DNA, 20 bp, Artificial Sequence
  chemically synthesized
acacagaatggtggctcttt

SEQ ID NO: 495841 - DNA, 20 bp, Artificial Sequence
  chemically synthesized
gtgtcagccaagaagtcaca

SEQ ID NO: 495842 - DNA, 20 bp, Artificial Sequence
  chemically synthesized
atttagatatttatagcttt

SEQ ID NO: 495843 - DNA, 20 bp, Artificial Sequence
  chemically synthesized
tgaagctttctctagccagg

SEQ ID NO: 495844 - DNA, 20 bp, Artificial Sequence
  chemically synthesized
cgtgagggctttcaggaaga

SEQ ID NO: 495845 - DNA, 20 bp, Artificial Sequence
  chemically synthesized
ttattatttagatttaattg

SEQ ID NO: 495846 - DNA, 20 bp, Artificial Sequence
  chemically synthesized
tgtctgtgttttatcacatc

SEQ ID NO: 495847 - DNA, 20 bp, Artificial Sequence
  chemically synthesized
ttaaatttaaaacatagaag

SEQ ID NO: 495848 - DNA, 20 bp, Artificial Sequence
  chemically synthesized
atgggttctctgttgcacat

SEQ ID NO: 495849 - DNA, 20 bp, Artificial Sequence
  chemically synthesized
ttaataaagggaaaacagtt

SEQ ID NO: 495850 - DNA, 20 bp, Artificial Sequence
  chemically synthesized
agtgaggttttcctttcagt

SEQ ID NO: 495851 - DNA, 20 bp, Artificial Sequence
  chemically synthesized
atttctttgtaacaagttat

SEQ ID NO: 495852 - DNA, 20 bp, Artificial Sequence
  chemically synthesized
agtttgatttgttcaagttt

SEQ ID NO: 495853 - DNA, 20 bp, Artificial Sequence
  chemically synthesized
atatacatagctgccttcct

SEQ ID NO: 495854 - DNA, 20 bp, Artificial Sequence
  chemically synthesized
tcaaggttctctaagcaaag

SEQ ID NO: 495855 - DNA, 20 bp, Artificial Sequence
  chemically synthesized
aaagtttcatggtactcaca

SEQ ID NO: 495856 - DNA, 20 bp, Artificial Sequence
  chemically synthesized
agcagtcattaaaattcagt

SEQ ID NO: 495857 - DNA, 20 bp, Artificial Sequence
  chemically synthesized
ggcgccaagattcccctagc

SEQ ID NO: 495858 - DNA, 20 bp, Artificial Sequence
  chemically synthesized
ttttaagagactcctgctag

SEQ ID NO: 495859 - DNA, 20 bp, Artificial Sequence
  chemically synthesized
tatactccatcagggaacaa

SEQ ID NO: 495860 - DNA, 20 bp, Artificial Sequence
  chemically synthesized
taaactctattgttccctga

SEQ ID NO: 495861 - DNA, 20 bp, Artificial Sequence
  chemically synthesized
aaatgctccaggagagggaa

SEQ ID NO: 495862 - DNA, 20 bp, Artificial Sequence
  chemically synthesized
tccaggagagggaagtggat

SEQ ID NO: 495863 - DNA, 20 bp, Artificial Sequence
  chemically synthesized
tttttttttttaatttcccc

SEQ ID NO: 495864 - DNA, 20 bp, Artificial Sequence
  chemically synthesized
tttttttaatttcccctaga

SEQ ID NO: 495865 - DNA, 20 bp, Artificial Sequence
  chemically synthesized
aacttgagagcaaataatgg

SEQ ID NO: 495866 - DNA, 20 bp, Artificial Sequence
  chemically synthesized
tagaggcagaataaaaagct

SEQ ID NO: 495867 - DNA, 20 bp, Artificial Sequence
  chemically synthesized
ttgtaatagctagttagagg

SEQ ID NO: 495868 - DNA, 20 bp, Artificial Sequence
  chemically synthesized
ggtacttggaatgctgaggt

SEQ ID NO: 495869 - DNA, 20 bp, Artificial Sequence
  chemically synthesized
ggaggagatgctttggtact

SEQ ID NO: 495870 - DNA, 20 bp, Artificial Sequence
  chemically synthesized
gatgcaggagcgtgtgagca

SEQ ID NO: 495871 - DNA, 20 bp, Artificial Sequence
  chemically synthesized
ctgctcacacgctcctgcat

SEQ ID NO: 495872 - DNA, 20 bp, Artificial Sequence
  chemically synthesized
tgagaggaaagtgctcttct

SEQ ID NO: 495873 - DNA, 20 bp, Artificial Sequence
  chemically synthesized
attaaggtaggcaagtgtgt

SEQ ID NO: 495874 - DNA, 20 bp, Artificial Sequence
  chemically synthesized
aaaaacctctttcggtcccc

SEQ ID NO: 495875 - DNA, 20 bp, Artificial Sequence
  chemically synthesized
gtgtgaagagaaagagctgc

SEQ ID NO: 495876 - DNA, 20 bp, Artificial Sequence
  chemically synthesized
gagaaagagctgctgggatg

SEQ ID NO: 495877 - DNA, 20 bp, Artificial Sequence
  chemically synthesized
gatccagcagagtttcagcc

SEQ ID NO: 495878 - DNA, 20 bp, Artificial Sequence
  chemically synthesized
aatcctgggctgaaactctg

SEQ ID NO: 495879 - DNA, 20 bp, Artificial Sequence
  chemically synthesized
ggctgaaactctgctggatc

SEQ ID NO: 495880 - DNA, 20 bp, Artificial Sequence
  chemically synthesized
gagtccaatccatgatccag

SEQ ID NO: 495881 - DNA, 20 bp, Artificial Sequence
  chemically synthesized
agactgtgtgtggagtgaaa

SEQ ID NO: 495882 - DNA, 20 bp, Artificial Sequence
  chemically synthesized
caggtaatgcagactgtgtg

SEQ ID NO: 495883 - DNA, 20 bp, Artificial Sequence
  chemically synthesized
aattgatatcaggttcaaat

SEQ ID NO: 495884 - DNA, 20 bp, Artificial Sequence
  chemically synthesized
aggtttgctgaacagctcca

SEQ ID NO: 495885 - DNA, 20 bp, Artificial Sequence
  chemically synthesized
aacagctccagagggttaat

SEQ ID NO: 495886 - DNA, 20 bp, Artificial Sequence
  chemically synthesized
gtgtgtgtgttgaatgacaa

SEQ ID NO: 495887 - DNA, 20 bp, Artificial Sequence
  chemically synthesized
tgtgtgtgtgtgtgtgtgtg

SEQ ID NO: 495888 - DNA, 20 bp, Artificial Sequence
  chemically synthesized
gataaatatacattatatca

SEQ ID NO: 495889 - DNA, 20 bp, Artificial Sequence
  chemically synthesized
atagccccattgctcagtga

SEQ ID NO: 495890 - DNA, 20 bp, Artificial Sequence
  chemically synthesized
ggcaatagccccattgctca

SEQ ID NO: 495891 - DNA, 20 bp, Artificial Sequence
  chemically synthesized
tgcctcagcctcccaaagtg

SEQ ID NO: 495892 - DNA, 20 bp, Artificial Sequence
  chemically synthesized
actttgggaggctgaggcag

SEQ ID NO: 495893 - DNA, 20 bp, Artificial Sequence
  chemically synthesized
tttttgtatttttagtagag

SEQ ID NO: 495894 - DNA, 20 bp, Artificial Sequence
  chemically synthesized
gattctcctacctcagcctc

SEQ ID NO: 495895 - DNA, 20 bp, Artificial Sequence
  chemically synthesized
tactcgggaggctgaggtag

SEQ ID NO: 495896 - DNA, 20 bp, Artificial Sequence
  chemically synthesized
ctcactgcaaccactgcctc

SEQ ID NO: 495897 - DNA, 20 bp, Artificial Sequence
  chemically synthesized
gtctcgctctgtcgccaggc

SEQ ID NO: 495898 - DNA, 20 bp, Artificial Sequence
  chemically synthesized
ctttctaagtattgttatca

SEQ ID NO: 495899 - DNA, 20 bp, Artificial Sequence
  chemically synthesized
ttataatagcccattcctca

SEQ ID NO: 495900 - DNA, 20 bp, Artificial Sequence
  chemically synthesized
aatagcccattcctcagtga

SEQ ID NO: 495901 - DNA, 20 bp, Artificial Sequence
  chemically synthesized
agtgtgctattcattcactg

SEQ ID NO: 495902 - DNA, 20 bp, Artificial Sequence
  chemically synthesized
gataaatatacattgtatca

SEQ ID NO: 495903 - DNA, 20 bp, Artificial Sequence
  chemically synthesized
gtgtgtgtatacgtatactt

SEQ ID NO: 495904 - DNA, 20 bp, Artificial Sequence
  chemically synthesized
cgtatacttttgaatgacaa

SEQ ID NO: 495905 - DNA, 20 bp, Artificial Sequence
  chemically synthesized
caccaagccttgcattaaac

SEQ ID NO: 495906 - DNA, 20 bp, Artificial Sequence
  chemically synthesized
agccttgcattaaacctgga

SEQ ID NO: 495907 - DNA, 20 bp, Artificial Sequence
  chemically synthesized
gtaaaatttccttgaggaat

SEQ ID NO: 495908 - DNA, 20 bp, Artificial Sequence
  chemically synthesized
gaagaagtaaaatttccttg

SEQ ID NO: 495909 - DNA, 20 bp, Artificial Sequence
  chemically synthesized
aaagaatatgcctgtgaatt

SEQ ID NO: 495910 - DNA, 20 bp, Artificial Sequence
  chemically synthesized
aacatgtaaagaatatgcct

SEQ ID NO: 495911 - DNA, 20 bp, Artificial Sequence
  chemically synthesized
ctttgggacagtaacatgta

SEQ ID NO: 495912 - DNA, 20 bp, Artificial Sequence
  chemically synthesized
gaaccttttcctctagcttc

SEQ ID NO: 495913 - DNA, 20 bp, Artificial Sequence
  chemically synthesized
gtggatctgttgggcgacct

SEQ ID NO: 495914 - DNA, 20 bp, Artificial Sequence
  chemically synthesized
ggcggagattgcttccaggt

SEQ ID NO: 495915 - DNA, 20 bp, Artificial Sequence
  chemically synthesized
cacaataaagcctgccacat

SEQ ID NO: 495916 - DNA, 20 bp, Artificial Sequence
  chemically synthesized
aagtggagtaataggcagta

SEQ ID NO: 495917 - DNA, 20 bp, Artificial Sequence
  chemically synthesized
cttcagtggatattaagaag

SEQ ID NO: 495918 - DNA, 20 bp, Artificial Sequence
  chemically synthesized
cacttcttaatatccactga

SEQ ID NO: 495919 - DNA, 20 bp, Artificial Sequence
  chemically synthesized
acagactgaggattccttca

SEQ ID NO: 495920 - DNA, 20 bp, Artificial Sequence
  chemically synthesized
gagatgtgtgtatacagact

SEQ ID NO: 495921 - DNA, 20 bp, Artificial Sequence
  chemically synthesized
aggtgtaagtaggtctttct

SEQ ID NO: 495922 - DNA, 20 bp, Artificial Sequence
  chemically synthesized
gtatttattgaatgcctgtt

SEQ ID NO: 495923 - DNA, 20 bp, Artificial Sequence
  chemically synthesized
gatcatttgacaagtattta

SEQ ID NO: 495924 - DNA, 20 bp, Artificial Sequence
  chemically synthesized
ctatgggcatataattttac

SEQ ID NO: 495925 - DNA, 20 bp, Artificial Sequence
  chemically synthesized
aattttacaggagttgctac

SEQ ID NO: 495926 - DNA, 20 bp, Artificial Sequence
  chemically synthesized
atataattggcagttgcctt

SEQ ID NO: 495927 - DNA, 20 bp, Artificial Sequence
  chemically synthesized
ccaagcctgataactagttc

SEQ ID NO: 495928 - DNA, 20 bp, Artificial Sequence
  chemically synthesized
agttgtaaaatctgcagtta

SEQ ID NO: 495929 - DNA, 20 bp, Artificial Sequence
  chemically synthesized
ctgtgagctgctcagaggga

SEQ ID NO: 495930 - DNA, 20 bp, Artificial Sequence
  chemically synthesized
ggttaccagacattccttgg

SEQ ID NO: 495931 - DNA, 20 bp, Artificial Sequence
  chemically synthesized
gtttgatttgcattctgcca

SEQ ID NO: 495932 - DNA, 20 bp, Artificial Sequence
  chemically synthesized
cagaatgcaaatcaaacatc

SEQ ID NO: 495933 - DNA, 20 bp, Artificial Sequence
  chemically synthesized
tcaaacatcttgaatggcaa

SEQ ID NO: 495934 - DNA, 20 bp, Artificial Sequence
  chemically synthesized
agaaaacttgaaagagaaat

SEQ ID NO: 495935 - DNA, 20 bp, Artificial Sequence
  chemically synthesized
ttttagcatatttgtccctc

SEQ ID NO: 495936 - DNA, 20 bp, Artificial Sequence
  chemically synthesized
gttcagctgctgccctacaa

SEQ ID NO: 495937 - DNA, 20 bp, Artificial Sequence
  chemically synthesized
ttgtagggcagcagctgaac

SEQ ID NO: 495938 - DNA, 20 bp, Artificial Sequence
  chemically synthesized
tcaacttccacatccataag

SEQ ID NO: 495939 - DNA, 20 bp, Artificial Sequence
  chemically synthesized
aggtattattaattccactt

SEQ ID NO: 495940 - DNA, 20 bp, Artificial Sequence
  chemically synthesized
ataatacctcatcaagtgat

SEQ ID NO: 495941 - DNA, 20 bp, Artificial Sequence
  chemically synthesized
acctcatcaagtgatgagaa

SEQ ID NO: 495942 - DNA, 20 bp, Artificial Sequence
  chemically synthesized
acctcagcctcctaagtagc

SEQ ID NO: 495943 - DNA, 20 bp, Artificial Sequence
  chemically synthesized
tacttaggaggctgaggtgg

SEQ ID NO: 495944 - DNA, 20 bp, Artificial Sequence
  chemically synthesized
tgggaggatcatttgagctc

SEQ ID NO: 495945 - DNA, 20 bp, Artificial Sequence
  chemically synthesized
gatggggtcttgctattttg

SEQ ID NO: 495946 - DNA, 20 bp, Artificial Sequence
  chemically synthesized
ttctttatttgtttttgaga

SEQ ID NO: 495947 - DNA, 20 bp, Artificial Sequence
  chemically synthesized
aaaaaagaaaaaaataataa

SEQ ID NO: 495948 - DNA, 20 bp, Artificial Sequence
  chemically synthesized
acaaatgaccttaaaaaaag

SEQ ID NO: 495949 - DNA, 20 bp, Artificial Sequence
  chemically synthesized
caggcaccaccgcaggtcca

SEQ ID NO: 495950 - DNA, 20 bp, Artificial Sequence
  chemically synthesized
ttggacctgcggtggtgcct

SEQ ID NO: 495951 - DNA, 20 bp, Artificial Sequence
  chemically synthesized
ctgatatttgctacacacag

SEQ ID NO: 495952 - DNA, 20 bp, Artificial Sequence
  chemically synthesized
acaaattcactatcatttgg

SEQ ID NO: 495953 - DNA, 20 bp, Artificial Sequence
  chemically synthesized
tgttattcttccaaatgata

SEQ ID NO: 495954 - DNA, 20 bp, Artificial Sequence
  chemically synthesized
aagcatctagtaattgacgg

SEQ ID NO: 495955 - DNA, 20 bp, Artificial Sequence
  chemically synthesized
aggaagctttcaatctatgt

SEQ ID NO: 495956 - DNA, 20 bp, Artificial Sequence
  chemically synthesized
cagccagctatgtgagcata

SEQ ID NO: 495957 - DNA, 20 bp, Artificial Sequence
  chemically synthesized
gtcaaattatttgcctggcc

SEQ ID NO: 495958 - DNA, 20 bp, Artificial Sequence
  chemically synthesized
ttttttgttgaagagttgat

SEQ ID NO: 495959 - DNA, 20 bp, Artificial Sequence
  chemically synthesized
tctattgatgttttttgttg

SEQ ID NO: 495960 - DNA, 20 bp, Artificial Sequence
  chemically synthesized
tcttcaacaaaaaacatcaa

SEQ ID NO: 495961 - DNA, 20 bp, Artificial Sequence
  chemically synthesized
gggcacaattaggattgggt

SEQ ID NO: 495962 - DNA, 20 bp, Artificial Sequence
  chemically synthesized
ctgtgggggcacaattagga

SEQ ID NO: 495963 - DNA, 20 bp, Artificial Sequence
  chemically synthesized
tttcactgtgggggcacaat

SEQ ID NO: 495964 - DNA, 20 bp, Artificial Sequence
  chemically synthesized
aggtgaggttggatttcatt

SEQ ID NO: 495965 - DNA, 20 bp, Artificial Sequence
  chemically synthesized
tcataaggagaaaggtgagg

SEQ ID NO: 495966 - DNA, 20 bp, Artificial Sequence
  chemically synthesized
catatggaagaaatagacat

SEQ ID NO: 495967 - DNA, 20 bp, Artificial Sequence
  chemically synthesized
ggagataagcagtggtgcca

SEQ ID NO: 495968 - DNA, 20 bp, Artificial Sequence
  chemically synthesized
ataagcagtggtgccaaggg

SEQ ID NO: 495969 - DNA, 20 bp, Artificial Sequence
  chemically synthesized
tgttatgacaaaaaaggagc

SEQ ID NO: 495970 - DNA, 20 bp, Artificial Sequence
  chemically synthesized
atgtactgattataattaaa

SEQ ID NO: 495971 - DNA, 20 bp, Artificial Sequence
  chemically synthesized
cctgggtgagtaaataagag

SEQ ID NO: 495972 - DNA, 20 bp, Artificial Sequence
  chemically synthesized
gataacatccaaatgcctgg

SEQ ID NO: 495973 - DNA, 20 bp, Artificial Sequence
  chemically synthesized
ttatttactcacccaggcat

SEQ ID NO: 495974 - DNA, 20 bp, Artificial Sequence
  chemically synthesized
cagtgataacatccaaatgc

SEQ ID NO: 495975 - DNA, 20 bp, Artificial Sequence
  chemically synthesized
tcattaacagtataatacat

SEQ ID NO: 495976 - DNA, 20 bp, Artificial Sequence
  chemically synthesized
cctaaaactacatggaggcc

SEQ ID NO: 495977 - DNA, 20 bp, Artificial Sequence
  chemically synthesized
ttacattgtctgtctggatg

SEQ ID NO: 495978 - DNA, 20 bp, Artificial Sequence
  chemically synthesized
cgtgatcttacattgtctgt

SEQ ID NO: 495979 - DNA, 20 bp, Artificial Sequence
  chemically synthesized
gaaagagcgagagagaaact

SEQ ID NO: 495980 - DNA, 20 bp, Artificial Sequence
  chemically synthesized
tttggcctgcagaccatact

SEQ ID NO: 495981 - DNA, 20 bp, Artificial Sequence
  chemically synthesized
ctgcatttctagcaagtgct

SEQ ID NO: 495982 - DNA, 20 bp, Artificial Sequence
  chemically synthesized
ctgagcacttgctagaaatg

SEQ ID NO: 495983 - DNA, 20 bp, Artificial Sequence
  chemically synthesized
cagacaataccccagaccta

SEQ ID NO: 495984 - DNA, 20 bp, Artificial Sequence
  chemically synthesized
tgatgctgattcagtaggtc

SEQ ID NO: 495985 - DNA, 20 bp, Artificial Sequence
  chemically synthesized
gatgtgcatcagaatcacct

SEQ ID NO: 495986 - DNA, 20 bp, Artificial Sequence
  chemically synthesized
tctcaaactttgatgtgcat

SEQ ID NO: 495987 - DNA, 20 bp, Artificial Sequence
  chemically synthesized
gtagcctccagcatattatt

SEQ ID NO: 495988 - DNA, 20 bp, Artificial Sequence
  chemically synthesized
gaggctacgggaagctactg

SEQ ID NO: 495989 - DNA, 20 bp, Artificial Sequence
  chemically synthesized
taagaagggaagtgacataa

SEQ ID NO: 495990 - DNA, 20 bp, Artificial Sequence
  chemically synthesized
cctgaaggaatgaatggaca

SEQ ID NO: 495991 - DNA, 20 bp, Artificial Sequence
  chemically synthesized
tctgtgtccattcattcctt

SEQ ID NO: 495992 - DNA, 20 bp, Artificial Sequence
  chemically synthesized
ggcatatatatcctgaagga

SEQ ID NO: 495993 - DNA, 20 bp, Artificial Sequence
  chemically synthesized
gcttggcatatatatcctga

SEQ ID NO: 495994 - DNA, 20 bp, Artificial Sequence
  chemically synthesized
gctggaaattcagcactatt

SEQ ID NO: 495995 - DNA, 20 bp, Artificial Sequence
  chemically synthesized
ctaatccactcaaaatagtg

SEQ ID NO: 495996 - DNA, 20 bp, Artificial Sequence
  chemically synthesized
gaaattcagcactattttga

SEQ ID NO: 495997 - DNA, 20 bp, Artificial Sequence
  chemically synthesized
cattgaatgaatactgaata

SEQ ID NO: 495998 - DNA, 20 bp, Artificial Sequence
  chemically synthesized
aaatgttcattgaatgaata

SEQ ID NO: 495999 - DNA, 20 bp, Artificial Sequence
  chemically synthesized
atgcaataaatgttcattga

SEQ ID NO: 496000 - DNA, 20 bp, Artificial Sequence
  chemically synthesized
tggaatgcaataaatgttca

SEQ ID NO: 496001 - DNA, 20 bp, Artificial Sequence
  chemically synthesized
aaaaaaaaaaaaaccaaagt

SEQ ID NO: 496002 - DNA, 20 bp, Artificial Sequence
  chemically synthesized
gttttttgcttttttgaaga

SEQ ID NO: 496003 - DNA, 20 bp, Artificial Sequence
  chemically synthesized
ctgcactccagcccacatga

SEQ ID NO: 496004 - DNA, 20 bp, Artificial Sequence
  chemically synthesized
tctcactctgtcatgtgggc

SEQ ID NO: 496005 - DNA, 20 bp, Artificial Sequence
  chemically synthesized
aggcagaggttgcagtgagc

SEQ ID NO: 496006 - DNA, 20 bp, Artificial Sequence
  chemically synthesized
ctcactgcaacctctgcctc

SEQ ID NO: 496007 - DNA, 20 bp, Artificial Sequence
  chemically synthesized
tactcaggagcctgaggcac

SEQ ID NO: 496008 - DNA, 20 bp, Artificial Sequence
  chemically synthesized
gattctcgtgcctcaggctc

SEQ ID NO: 496009 - DNA, 20 bp, Artificial Sequence
  chemically synthesized
gcctcaggctcctgagtagc

SEQ ID NO: 496010 - DNA, 20 bp, Artificial Sequence
  chemically synthesized
tttgtatttttagtagagat

SEQ ID NO: 496011 - DNA, 20 bp, Artificial Sequence
  chemically synthesized
caggcggatcacctgaggtc

SEQ ID NO: 496012 - DNA, 20 bp, Artificial Sequence
  chemically synthesized
actttgggatgctgaggcag

SEQ ID NO: 496013 - DNA, 20 bp, Artificial Sequence
  chemically synthesized
tgcctgtaatctcagcactt

SEQ ID NO: 496014 - DNA, 20 bp, Artificial Sequence
  chemically synthesized
taaaaacatagccatcagtg

SEQ ID NO: 496015 - DNA, 20 bp, Artificial Sequence
  chemically synthesized
actgatggctatgtttttaa

SEQ ID NO: 496016 - DNA, 20 bp, Artificial Sequence
  chemically synthesized
gtccaggacaaataactgtt

SEQ ID NO: 496017 - DNA, 20 bp, Artificial Sequence
  chemically synthesized
gcctgatagtgctaaggact

SEQ ID NO: 496018 - DNA, 20 bp, Artificial Sequence
  chemically synthesized
gtttttttgatgtagttttg

SEQ ID NO: 496019 - DNA, 20 bp, Artificial Sequence
  chemically synthesized
tgcaatggtatttgctgtat

SEQ ID NO: 496020 - DNA, 20 bp, Artificial Sequence
  chemically synthesized
cttgtactataacttgtact

SEQ ID NO: 496021 - DNA, 20 bp, Artificial Sequence
  chemically synthesized
aactttaatattagagatta

SEQ ID NO: 496022 - DNA, 20 bp, Artificial Sequence
  chemically synthesized
attttttgctaacctatgca

SEQ ID NO: 496023 - DNA, 20 bp, Artificial Sequence
  chemically synthesized
acaataaattcctacttatg

SEQ ID NO: 496024 - DNA, 20 bp, Artificial Sequence
  chemically synthesized
gacagagactccacataagt

SEQ ID NO: 496025 - DNA, 20 bp, Artificial Sequence
  chemically synthesized
gctcttcacaccaagtcttt

SEQ ID NO: 496026 - DNA, 20 bp, Artificial Sequence
  chemically synthesized
tatgtttgcatataggaagc

SEQ ID NO: 496027 - DNA, 20 bp, Artificial Sequence
  chemically synthesized
gcacttctattttagcgatt

SEQ ID NO: 496028 - DNA, 20 bp, Artificial Sequence
  chemically synthesized
tagaggcagcccgagtaacc

SEQ ID NO: 496029 - DNA, 20 bp, Artificial Sequence
  chemically synthesized
cttggtagattagaggcagc

SEQ ID NO: 496030 - DNA, 20 bp, Artificial Sequence
  chemically synthesized
ctgcctctaatctaccaagc

SEQ ID NO: 496031 - DNA, 20 bp, Artificial Sequence
  chemically synthesized
ttcctgcagctacaaaggaa

SEQ ID NO: 496032 - DNA, 20 bp, Artificial Sequence
  chemically synthesized
tagtgttcctgcagctacaa

SEQ ID NO: 496033 - DNA, 20 bp, Artificial Sequence
  chemically synthesized
caggaacactaaatttcatt

SEQ ID NO: 496034 - DNA, 20 bp, Artificial Sequence
  chemically synthesized
gctttttgggagttagaatt

SEQ ID NO: 496035 - DNA, 20 bp, Artificial Sequence
  chemically synthesized
ttacccagctttttgggagt

SEQ ID NO: 496036 - DNA, 20 bp, Artificial Sequence
  chemically synthesized
gaattctaactcccaaaaag

SEQ ID NO: 496037 - DNA, 20 bp, Artificial Sequence
  chemically synthesized
cttagattacccagcttttt

SEQ ID NO: 496038 - DNA, 20 bp, Artificial Sequence
  chemically synthesized
gaggctataagaaaaccatt

SEQ ID NO: 496039 - DNA, 20 bp, Artificial Sequence
  chemically synthesized
atggttttcttatagcctca

SEQ ID NO: 496040 - DNA, 20 bp, Artificial Sequence
  chemically synthesized
tctgagtttttgttctctca

SEQ ID NO: 496041 - DNA, 20 bp, Artificial Sequence
  chemically synthesized
atttcaatctttggtagctt

SEQ ID NO: 496042 - DNA, 20 bp, Artificial Sequence
  chemically synthesized
cctagttggtgggtattgaa

SEQ ID NO: 496043 - DNA, 20 bp, Artificial Sequence
  chemically synthesized
tgtataagctcccctagttg

SEQ ID NO: 496044 - DNA, 20 bp, Artificial Sequence
  chemically synthesized
aggggagcttatacaagacc

SEQ ID NO: 496045 - DNA, 20 bp, Artificial Sequence
  chemically synthesized
caatgataatatctttgttg

SEQ ID NO: 496046 - DNA, 20 bp, Artificial Sequence
  chemically synthesized
ctttgttgtagaattactcg

SEQ ID NO: 496047 - DNA, 20 bp, Artificial Sequence
  chemically synthesized
attttcttgtatttaatcct

SEQ ID NO: 496048 - DNA, 20 bp, Artificial Sequence
  chemically synthesized
ggggaaaattaatatatatt

SEQ ID NO: 496049 - DNA, 20 bp, Artificial Sequence
  chemically synthesized
ttaattttccccactccctt

SEQ ID NO: 496050 - DNA, 20 bp, Artificial Sequence
  chemically synthesized
ggggtcttagtaacccagaa

SEQ ID NO: 496051 - DNA, 20 bp, Artificial Sequence
  chemically synthesized
taaataaatttgcattttat

SEQ ID NO: 496052 - DNA, 20 bp, Artificial Sequence
  chemically synthesized
tcactaatatttttgaaaag

SEQ ID NO: 496053 - DNA, 20 bp, Artificial Sequence
  chemically synthesized
tttttgaaaagttgagttaa

SEQ ID NO: 496054 - DNA, 20 bp, Artificial Sequence
  chemically synthesized
gaattaggaagcctgttata

SEQ ID NO: 496055 - DNA, 20 bp, Artificial Sequence
  chemically synthesized
cctgttataaagaataagcc

SEQ ID NO: 496056 - DNA, 20 bp, Artificial Sequence
  chemically synthesized
aagaataagccctgagtaaa

SEQ ID NO: 496057 - DNA, 20 bp, Artificial Sequence
  chemically synthesized
agctagggtgtactatcttc

SEQ ID NO: 496058 - DNA, 20 bp, Artificial Sequence
  chemically synthesized
aagtcaatggttctgacagc

SEQ ID NO: 496059 - DNA, 20 bp, Artificial Sequence
  chemically synthesized
tcagtgtcctcatctgcaaa

SEQ ID NO: 496060 - DNA, 20 bp, Artificial Sequence
  chemically synthesized
gaaataacttgcctaggcct

SEQ ID NO: 496061 - DNA, 20 bp, Artificial Sequence
  chemically synthesized
gagttagaacactagcaagg

SEQ ID NO: 496062 - DNA, 20 bp, Artificial Sequence
  chemically synthesized
caaggcaggattgaaaccta

SEQ ID NO: 496063 - DNA, 20 bp, Artificial Sequence
  chemically synthesized
tggggcttaaaacctagatg

SEQ ID NO: 496064 - DNA, 20 bp, Artificial Sequence
  chemically synthesized
aaaacctagatgacgggttg

SEQ ID NO: 496065 - DNA, 20 bp, Artificial Sequence
  chemically synthesized
taagttctgggatacacgtg

SEQ ID NO: 496066 - DNA, 20 bp, Artificial Sequence
  chemically synthesized
tattattatactttaagttc

SEQ ID NO: 496067 - DNA, 20 bp, Artificial Sequence
  chemically synthesized
gaaagaaggaaaacaatgtg

SEQ ID NO: 496068 - DNA, 20 bp, Artificial Sequence
  chemically synthesized
aacaatgtgaagaatgaaag

SEQ ID NO: 496069 - DNA, 20 bp, Artificial Sequence
  chemically synthesized
aaggagggagcgctacagct

SEQ ID NO: 496070 - DNA, 20 bp, Artificial Sequence
  chemically synthesized
actaaggggacagaggcaaa

SEQ ID NO: 496071 - DNA, 20 bp, Artificial Sequence
  chemically synthesized
ccttagtagtaaatatttct

SEQ ID NO: 496072 - DNA, 20 bp, Artificial Sequence
  chemically synthesized
agtagtaaatatttctcggg

SEQ ID NO: 496073 - DNA, 20 bp, Artificial Sequence
  chemically synthesized
cacttctgtatgagaggctg

SEQ ID NO: 496074 - DNA, 20 bp, Artificial Sequence
  chemically synthesized
agcctctcatacagaagtgc

SEQ ID NO: 496075 - DNA, 20 bp, Artificial Sequence
  chemically synthesized
ggatcttgaatgtttaatgg

SEQ ID NO: 496076 - DNA, 20 bp, Artificial Sequence
  chemically synthesized
gttcatggttgtagaggatc

SEQ ID NO: 496077 - DNA, 20 bp, Artificial Sequence
  chemically synthesized
cttctatgttcatggttgta

SEQ ID NO: 496078 - DNA, 20 bp, Artificial Sequence
  chemically synthesized
ctctacaaccatgaacatag

SEQ ID NO: 496079 - DNA, 20 bp, Artificial Sequence
  chemically synthesized
ctttgatacagcaagaacat

SEQ ID NO: 496080 - DNA, 20 bp, Artificial Sequence
  chemically synthesized
gcatgtctctgaaaatctct

SEQ ID NO: 496081 - DNA, 20 bp, Artificial Sequence
  chemically synthesized
ttccatactgatcaatgaag

SEQ ID NO: 496082 - DNA, 20 bp, Artificial Sequence
  chemically synthesized
agataattttacagactgac

SEQ ID NO: 496083 - DNA, 20 bp, Artificial Sequence
  chemically synthesized
ttttttttttttttttgagg

SEQ ID NO: 496084 - DNA, 20 bp, Artificial Sequence
  chemically synthesized
tttgctcttgttgcccaggc

SEQ ID NO: 496085 - DNA, 20 bp, Artificial Sequence
  chemically synthesized
tacttgggaggctgaggcag

SEQ ID NO: 496086 - DNA, 20 bp, Artificial Sequence
  chemically synthesized
gcctcagcctcccaagtacc

SEQ ID NO: 496087 - DNA, 20 bp, Artificial Sequence
  chemically synthesized
tttgtatttttagtagagat

SEQ ID NO: 496088 - DNA, 20 bp, Artificial Sequence
  chemically synthesized
tgggtggaacacttgaggtc

SEQ ID NO: 496089 - DNA, 20 bp, Artificial Sequence
  chemically synthesized
cagcactttgggagtctgag

SEQ ID NO: 496090 - DNA, 20 bp, Artificial Sequence
  chemically synthesized
acctcagactcccaaagtgc

SEQ ID NO: 496091 - DNA, 20 bp, Artificial Sequence
  chemically synthesized
gcctgtaatcccagcacttt

SEQ ID NO: 496092 - DNA, 20 bp, Artificial Sequence
  chemically synthesized
catttttatgaagaccctgc

SEQ ID NO: 496093 - DNA, 20 bp, Artificial Sequence
  chemically synthesized
ggaatgaatggctattcagg

SEQ ID NO: 496094 - DNA, 20 bp, Artificial Sequence
  chemically synthesized
caaattcaagtccccttgga

SEQ ID NO: 496095 - DNA, 20 bp, Artificial Sequence
  chemically synthesized
gccattcattccaaggggac

SEQ ID NO: 496096 - DNA, 20 bp, Artificial Sequence
  chemically synthesized
tattcaaattcaagtcccct

SEQ ID NO: 496097 - DNA, 20 bp, Artificial Sequence
  chemically synthesized
cattccaaggggacttgaat

SEQ ID NO: 496098 - DNA, 20 bp, Artificial Sequence
  chemically synthesized
tgtgctagagatgcagattt

SEQ ID NO: 496099 - DNA, 20 bp, Artificial Sequence
  chemically synthesized
ctctagcacatacttcttcc

SEQ ID NO: 496100 - DNA, 20 bp, Artificial Sequence
  chemically synthesized
agtgcagttggatgaaagta

SEQ ID NO: 496101 - DNA, 20 bp, Artificial Sequence
  chemically synthesized
taaagtcacaaagagtgcag

SEQ ID NO: 496102 - DNA, 20 bp, Artificial Sequence
  chemically synthesized
gacatcccagtaaagtcaca

SEQ ID NO: 496103 - DNA, 20 bp, Artificial Sequence
  chemically synthesized
tgcactctttgtgactttac

SEQ ID NO: 496104 - DNA, 20 bp, Artificial Sequence
  chemically synthesized
tggaagcaataattttgttt

SEQ ID NO: 496105 - DNA, 20 bp, Artificial Sequence
  chemically synthesized
aggatcaagttagatggtag

SEQ ID NO: 496106 - DNA, 20 bp, Artificial Sequence
  chemically synthesized
tagaattgagaaaatggtag

SEQ ID NO: 496107 - DNA, 20 bp, Artificial Sequence
  chemically synthesized
tccaaggtggataaggtgaa

SEQ ID NO: 496108 - DNA, 20 bp, Artificial Sequence
  chemically synthesized
atgagtccaaggtggataag

SEQ ID NO: 496109 - DNA, 20 bp, Artificial Sequence
  chemically synthesized
gagcccaggatgagtccaag

SEQ ID NO: 496110 - DNA, 20 bp, Artificial Sequence
  chemically synthesized
aagaaagagaagagcccagg

SEQ ID NO: 496111 - DNA, 20 bp, Artificial Sequence
  chemically synthesized
gggaaagaaagagaagagcc

SEQ ID NO: 496112 - DNA, 20 bp, Artificial Sequence
  chemically synthesized
gtttgctgatgaatggggta

SEQ ID NO: 496113 - DNA, 20 bp, Artificial Sequence
  chemically synthesized
ctaccaggtttgctgatgaa

SEQ ID NO: 496114 - DNA, 20 bp, Artificial Sequence
  chemically synthesized
tagcactaccaggtttgctg

SEQ ID NO: 496115 - DNA, 20 bp, Artificial Sequence
  chemically synthesized
tgctaccttccaaaaatacc

SEQ ID NO: 496116 - DNA, 20 bp, Artificial Sequence
  chemically synthesized
caatgagaggtacatggatt

SEQ ID NO: 496117 - DNA, 20 bp, Artificial Sequence
  chemically synthesized
gtgaaaacaatgagaggtac

SEQ ID NO: 496118 - DNA, 20 bp, Artificial Sequence
  chemically synthesized
tcactgaaagcttcctggtt

SEQ ID NO: 496119 - DNA, 20 bp, Artificial Sequence
  chemically synthesized
gaatcaccattatttctcat

SEQ ID NO: 496120 - DNA, 20 bp, Artificial Sequence
  chemically synthesized
agagtacctattgaagcaga

SEQ ID NO: 496121 - DNA, 20 bp, Artificial Sequence
  chemically synthesized
cggagtggagaacagagagt

SEQ ID NO: 496122 - DNA, 20 bp, Artificial Sequence
  chemically synthesized
tagccacggagtggagaaca

SEQ ID NO: 496123 - DNA, 20 bp, Artificial Sequence
  chemically synthesized
gagatgaattgttctagcca

SEQ ID NO: 496124 - DNA, 20 bp, Artificial Sequence
  chemically synthesized
catttggggaaagaaaggag

SEQ ID NO: 496125 - DNA, 20 bp, Artificial Sequence
  chemically synthesized
catctcctttctttccccaa

SEQ ID NO: 496126 - DNA, 20 bp, Artificial Sequence
  chemically synthesized
ctatgattttgtcttttcaa

SEQ ID NO: 496127 - DNA, 20 bp, Artificial Sequence
  chemically synthesized
atagagatggagaacagatt

SEQ ID NO: 496128 - DNA, 20 bp, Artificial Sequence
  chemically synthesized
gttgctagtgattcaggaag

SEQ ID NO: 496129 - DNA, 20 bp, Artificial Sequence
  chemically synthesized
ccaatctcccattctacttc

SEQ ID NO: 496130 - DNA, 20 bp, Artificial Sequence
  chemically synthesized
tcaggaagtagaatgggaga

SEQ ID NO: 496131 - DNA, 20 bp, Artificial Sequence
  chemically synthesized
gaagtagaatgggagattgg

SEQ ID NO: 496132 - DNA, 20 bp, Artificial Sequence
  chemically synthesized
ttggatgggtgtgacaatta

SEQ ID NO: 496133 - DNA, 20 bp, Artificial Sequence
  chemically synthesized
ccctattttgatacatggta

SEQ ID NO: 496134 - DNA, 20 bp, Artificial Sequence
  chemically synthesized
tcagtaccatgtatcaaaat

SEQ ID NO: 496135 - DNA, 20 bp, Artificial Sequence
  chemically synthesized
atgcaattttataccatgtt

SEQ ID NO: 496136 - DNA, 20 bp, Artificial Sequence
  chemically synthesized
aaacatggtataaaattgca

SEQ ID NO: 496137 - DNA, 20 bp, Artificial Sequence
  chemically synthesized
catgtaaaagctggtgagat

SEQ ID NO: 496138 - DNA, 20 bp, Artificial Sequence
  chemically synthesized
agctatgtaagatgtgagat

SEQ ID NO: 496139 - DNA, 20 bp, Artificial Sequence
  chemically synthesized
gatgtaaccattagctgaag

SEQ ID NO: 496140 - DNA, 20 bp, Artificial Sequence
  chemically synthesized
ccattagctgaagatgagtg

SEQ ID NO: 496141 - DNA, 20 bp, Artificial Sequence
  chemically synthesized
caaaagtattaagaaagatc

SEQ ID NO: 496142 - DNA, 20 bp, Artificial Sequence
  chemically synthesized
acacggcattcctcaagact

SEQ ID NO: 496143 - DNA, 20 bp, Artificial Sequence
  chemically synthesized
acagaaaatccgtagtcttg

SEQ ID NO: 496144 - DNA, 20 bp, Artificial Sequence
  chemically synthesized
gattttctgtttcttctacc

SEQ ID NO: 496145 - DNA, 20 bp, Artificial Sequence
  chemically synthesized
ctctttccccaaatatgtaa

SEQ ID NO: 496146 - DNA, 20 bp, Artificial Sequence
  chemically synthesized
tcacctcatagaggtctgcc

SEQ ID NO: 496147 - DNA, 20 bp, Artificial Sequence
  chemically synthesized
gtctgtaatttcagcacttt

SEQ ID NO: 496148 - DNA, 20 bp, Artificial Sequence
  chemically synthesized
caagcagatcgcttgagcgc

SEQ ID NO: 496149 - DNA, 20 bp, Artificial Sequence
  chemically synthesized
atgtggaagcaactttagaa

SEQ ID NO: 496150 - DNA, 20 bp, Artificial Sequence
  chemically synthesized
tttagaactgggtaataggc

SEQ ID NO: 496151 - DNA, 20 bp, Artificial Sequence
  chemically synthesized
tggaacttcctagagacttg

SEQ ID NO: 496152 - DNA, 20 bp, Artificial Sequence
  chemically synthesized
atgaagaacttattggtaac

SEQ ID NO: 496153 - DNA, 20 bp, Artificial Sequence
  chemically synthesized
gtctctttgttagtcatagc

SEQ ID NO: 496154 - DNA, 20 bp, Artificial Sequence
  chemically synthesized
agttccacagatctctaggt

SEQ ID NO: 496155 - DNA, 20 bp, Artificial Sequence
  chemically synthesized
cttttatgctctgtgacctc

SEQ ID NO: 496156 - DNA, 20 bp, Artificial Sequence
  chemically synthesized
acagccagcctctccagaaa

SEQ ID NO: 496157 - DNA, 20 bp, Artificial Sequence
  chemically synthesized
catttttgcctcctagacct

SEQ ID NO: 496158 - DNA, 20 bp, Artificial Sequence
  chemically synthesized
cctgatgccgcacacagtgg

SEQ ID NO: 496159 - DNA, 20 bp, Artificial Sequence
  chemically synthesized
gtgtcccagccactccagcc

SEQ ID NO: 496160 - DNA, 20 bp, Artificial Sequence
  chemically synthesized
tggccccttttatccatggc

SEQ ID NO: 496161 - DNA, 20 bp, Artificial Sequence
  chemically synthesized
ttggcaactgccacgtggtg

SEQ ID NO: 496162 - DNA, 20 bp, Artificial Sequence
  chemically synthesized
tgccacgtggtgttgagtct

SEQ ID NO: 496163 - DNA, 20 bp, Artificial Sequence
  chemically synthesized
gtgttgagtctgtggataca

SEQ ID NO: 496164 - DNA, 20 bp, Artificial Sequence
  chemically synthesized
tctgtggatacacagaattc

SEQ ID NO: 496165 - DNA, 20 bp, Artificial Sequence
  chemically synthesized
aggttcccaaacttcaattc

SEQ ID NO: 496166 - DNA, 20 bp, Artificial Sequence
  chemically synthesized
gaacctctgcctagatttca

SEQ ID NO: 496167 - DNA, 20 bp, Artificial Sequence
  chemically synthesized
cagaggatgtatggaaactc

SEQ ID NO: 496168 - DNA, 20 bp, Artificial Sequence
  chemically synthesized
agacttctgcctggacatcc

SEQ ID NO: 496169 - DNA, 20 bp, Artificial Sequence
  chemically synthesized
tccaggcagaagtctgctgc

SEQ ID NO: 496170 - DNA, 20 bp, Artificial Sequence
  chemically synthesized
gacagtgtggaagggaaatg

SEQ ID NO: 496171 - DNA, 20 bp, Artificial Sequence
  chemically synthesized
gtggggttggagccccaaca

SEQ ID NO: 496172 - DNA, 20 bp, Artificial Sequence
  chemically synthesized
tgttgatcgctctaccattg

SEQ ID NO: 496173 - DNA, 20 bp, Artificial Sequence
  chemically synthesized
gctgcttttacaggctggca

SEQ ID NO: 496174 - DNA, 20 bp, Artificial Sequence
  chemically synthesized
gctccacccctgtgggtttg

SEQ ID NO: 496175 - DNA, 20 bp, Artificial Sequence
  chemically synthesized
gctctaccctgcaaacccac

SEQ ID NO: 496176 - DNA, 20 bp, Artificial Sequence
  chemically synthesized
tcttggtaagctccacccct

SEQ ID NO: 496177 - DNA, 20 bp, Artificial Sequence
  chemically synthesized
aggtaacactgatgcaagag

SEQ ID NO: 496178 - DNA, 20 bp, Artificial Sequence
  chemically synthesized
acctcttgcatcagtgttac

SEQ ID NO: 496179 - DNA, 20 bp, Artificial Sequence
  chemically synthesized
tgttacctggatgtgagaaa

SEQ ID NO: 496180 - DNA, 20 bp, Artificial Sequence
  chemically synthesized
gctaatttctcccatttgta

SEQ ID NO: 496181 - DNA, 20 bp, Artificial Sequence
  chemically synthesized
ataaaatggaagcacaggca

SEQ ID NO: 496182 - DNA, 20 bp, Artificial Sequence
  chemically synthesized
gagactttggacttggactt

SEQ ID NO: 496183 - DNA, 20 bp, Artificial Sequence
  chemically synthesized
acttttgggttaatgctgaa

SEQ ID NO: 496184 - DNA, 20 bp, Artificial Sequence
  chemically synthesized
gctgaaatgaattaatactt

SEQ ID NO: 496185 - DNA, 20 bp, Artificial Sequence
  chemically synthesized
attacaattcaagatgagat

SEQ ID NO: 496186 - DNA, 20 bp, Artificial Sequence
  chemically synthesized
gtccccacccaaatctcatc

SEQ ID NO: 496187 - DNA, 20 bp, Artificial Sequence
  chemically synthesized
ctggggattatggggattat

SEQ ID NO: 496188 - DNA, 20 bp, Artificial Sequence
  chemically synthesized
ctttgacacctggggattat

SEQ ID NO: 496189 - DNA, 20 bp, Artificial Sequence
  chemically synthesized
tagcctctcctttgacacct

SEQ ID NO: 496190 - DNA, 20 bp, Artificial Sequence
  chemically synthesized
gagaggctatgtggaggtaa

SEQ ID NO: 496191 - DNA, 20 bp, Artificial Sequence
  chemically synthesized
atgtggaggtaattgaatca

SEQ ID NO: 496192 - DNA, 20 bp, Artificial Sequence
  chemically synthesized
cccatgctgttctcatgata

SEQ ID NO: 496193 - DNA, 20 bp, Artificial Sequence
  chemically synthesized
tgctgttctcatgatagtga

SEQ ID NO: 496194 - DNA, 20 bp, Artificial Sequence
  chemically synthesized
ataaaaccatcagattttgg

SEQ ID NO: 496195 - DNA, 20 bp, Artificial Sequence
  chemically synthesized
ccaaaatctgatggttttat

SEQ ID NO: 496196 - DNA, 20 bp, Artificial Sequence
  chemically synthesized
ctccccagccatattgaact

SEQ ID NO: 496197 - DNA, 20 bp, Artificial Sequence
  chemically synthesized
ctagaaagaactgcccgaga

SEQ ID NO: 496198 - DNA, 20 bp, Artificial Sequence
  chemically synthesized
tgaacagaaatctcaagaga

SEQ ID NO: 496199 - DNA, 20 bp, Artificial Sequence
  chemically synthesized
acatctacctcctaaggtgc

SEQ ID NO: 496200 - DNA, 20 bp, Artificial Sequence
  chemically synthesized
cagcaccttaggaggtagat

SEQ ID NO: 496201 - DNA, 20 bp, Artificial Sequence
  chemically synthesized
tgggtggactgcttgagccc

SEQ ID NO: 496202 - DNA, 20 bp, Artificial Sequence
  chemically synthesized
gttttcttttcttatagaga

SEQ ID NO: 496203 - DNA, 20 bp, Artificial Sequence
  chemically synthesized
aagaaaagaaaacgtgttag

SEQ ID NO: 496204 - DNA, 20 bp, Artificial Sequence
  chemically synthesized
tacttgggaggctgatgtgg

SEQ ID NO: 496205 - DNA, 20 bp, Artificial Sequence
  chemically synthesized
ctgcacaccagcttaggcaa

SEQ ID NO: 496206 - DNA, 20 bp, Artificial Sequence
  chemically synthesized
tttatatatattttttgaga

SEQ ID NO: 496207 - DNA, 20 bp, Artificial Sequence
  chemically synthesized
ccacatactaatataggcac

SEQ ID NO: 496208 - DNA, 20 bp, Artificial Sequence
  chemically synthesized
attaattcatcaaatatttg

SEQ ID NO: 496209 - DNA, 20 bp, Artificial Sequence
  chemically synthesized
agtcactctacaaatatttg

SEQ ID NO: 496210 - DNA, 20 bp, Artificial Sequence
  chemically synthesized
aatatttgatgaattaataa

SEQ ID NO: 496211 - DNA, 20 bp, Artificial Sequence
  chemically synthesized
agtttttttaagtactgcca

SEQ ID NO: 496212 - DNA, 20 bp, Artificial Sequence
  chemically synthesized
taaagttgagcattaccatg

SEQ ID NO: 496213 - DNA, 20 bp, Artificial Sequence
  chemically synthesized
aaataagtaacttccctggg

SEQ ID NO: 496214 - DNA, 20 bp, Artificial Sequence
  chemically synthesized
agatagtccctagattacaa

SEQ ID NO: 496215 - DNA, 20 bp, Artificial Sequence
  chemically synthesized
atgctctctaaattttctga

SEQ ID NO: 496216 - DNA, 20 bp, Artificial Sequence
  chemically synthesized
gtatgactgaatgcacaggt

SEQ ID NO: 496217 - DNA, 20 bp, Artificial Sequence
  chemically synthesized
ttccagggaatagagtatga

SEQ ID NO: 496218 - DNA, 20 bp, Artificial Sequence
  chemically synthesized
ttcagtcatactctattccc

SEQ ID NO: 496219 - DNA, 20 bp, Artificial Sequence
  chemically synthesized
ggtttggtgattccagggaa

SEQ ID NO: 496220 - DNA, 20 bp, Artificial Sequence
  chemically synthesized
gtacaggtttggtgattcca

SEQ ID NO: 496221 - DNA, 20 bp, Artificial Sequence
  chemically synthesized
accaaacctgtacctaacag

SEQ ID NO: 496222 - DNA, 20 bp, Artificial Sequence
  chemically synthesized
acctatgaaatgtaaccaca

SEQ ID NO: 496223 - DNA, 20 bp, Artificial Sequence
  chemically synthesized
tttgaattacttacaacgtg

SEQ ID NO: 496224 - DNA, 20 bp, Artificial Sequence
  chemically synthesized
ttgtaagtaattcaaatgct

SEQ ID NO: 496225 - DNA, 20 bp, Artificial Sequence
  chemically synthesized
tgtgatacaactctaagcat

SEQ ID NO: 496226 - DNA, 20 bp, Artificial Sequence
  chemically synthesized
caacatcacaaaggtagcat

SEQ ID NO: 496227 - DNA, 20 bp, Artificial Sequence
  chemically synthesized
tgatcattgagactacccac

SEQ ID NO: 496228 - DNA, 20 bp, Artificial Sequence
  chemically synthesized
ttaatcctaaaacaatcctg

SEQ ID NO: 496229 - DNA, 20 bp, Artificial Sequence
  chemically synthesized
actacccaccaggattgttt

SEQ ID NO: 496230 - DNA, 20 bp, Artificial Sequence
  chemically synthesized
attgagcacttccagttagt

SEQ ID NO: 496231 - DNA, 20 bp, Artificial Sequence
  chemically synthesized
gttaatgctaaatatgtgag

SEQ ID NO: 496232 - DNA, 20 bp, Artificial Sequence
  chemically synthesized
atgctaaatatgtgaggtga

SEQ ID NO: 496233 - DNA, 20 bp, Artificial Sequence
  chemically synthesized
tattcatccctctccagtat

SEQ ID NO: 496234 - DNA, 20 bp, Artificial Sequence
  chemically synthesized
cattgattcacatactggag

SEQ ID NO: 496235 - DNA, 20 bp, Artificial Sequence
  chemically synthesized
gattcacatactggagaggg

SEQ ID NO: 496236 - DNA, 20 bp, Artificial Sequence
  chemically synthesized
gtaaaaggaaaacatcatag

SEQ ID NO: 496237 - DNA, 20 bp, Artificial Sequence
  chemically synthesized
ttttagcaaacctgtgagta

SEQ ID NO: 496238 - DNA, 20 bp, Artificial Sequence
  chemically synthesized
agagatcttttagcaaacct

SEQ ID NO: 496239 - DNA, 20 bp, Artificial Sequence
  chemically synthesized
ctcctcccactgtggggaca

SEQ ID NO: 496240 - DNA, 20 bp, Artificial Sequence
  chemically synthesized
tacataagtggtatttattt

SEQ ID NO: 496241 - DNA, 20 bp, Artificial Sequence
  chemically synthesized
cttatgtagcattttttggt

SEQ ID NO: 496242 - DNA, 20 bp, Artificial Sequence
  chemically synthesized
gcattttttggttggaattt

SEQ ID NO: 496243 - DNA, 20 bp, Artificial Sequence
  chemically synthesized
atctttttgaccttagttta

SEQ ID NO: 496244 - DNA, 20 bp, Artificial Sequence
  chemically synthesized
tctgaagaccgtgctgccca

SEQ ID NO: 496245 - DNA, 20 bp, Artificial Sequence
  chemically synthesized
gaccgtgctgcccaaaggat

SEQ ID NO: 496246 - DNA, 20 bp, Artificial Sequence
  chemically synthesized
atgccaatgaattactttaa

SEQ ID NO: 496247 - DNA, 20 bp, Artificial Sequence
  chemically synthesized
caaaccaagcagtcatgcca

SEQ ID NO: 496248 - DNA, 20 bp, Artificial Sequence
  chemically synthesized
gcatgactgcttggtttgtc

SEQ ID NO: 496249 - DNA, 20 bp, Artificial Sequence
  chemically synthesized
tcaggttaggcatcttgcac

SEQ ID NO: 496250 - DNA, 20 bp, Artificial Sequence
  chemically synthesized
tcattctagcttgggagcct

SEQ ID NO: 496251 - DNA, 20 bp, Artificial Sequence
  chemically synthesized
tgattcctaggctcccaagc

SEQ ID NO: 496252 - DNA, 20 bp, Artificial Sequence
  chemically synthesized
taacatacaattttgatctc

SEQ ID NO: 496253 - DNA, 20 bp, Artificial Sequence
  chemically synthesized
acattggtaggatcattgac

SEQ ID NO: 496254 - DNA, 20 bp, Artificial Sequence
  chemically synthesized
agaggtagagctcacattgg

SEQ ID NO: 496255 - DNA, 20 bp, Artificial Sequence
  chemically synthesized
ttcctcttgaaacacatgtt

SEQ ID NO: 496256 - DNA, 20 bp, Artificial Sequence
  chemically synthesized
taaactcttccaaagggaag

SEQ ID NO: 496257 - DNA, 20 bp, Artificial Sequence
  chemically synthesized
atgacccatcttccctttgg

SEQ ID NO: 496258 - DNA, 20 bp, Artificial Sequence
  chemically synthesized
tactttcctgttttctctga

SEQ ID NO: 496259 - DNA, 20 bp, Artificial Sequence
  chemically synthesized
agcaactttaagaaaacact

SEQ ID NO: 496260 - DNA, 20 bp, Artificial Sequence
  chemically synthesized
cccttgatgttttctcatgc

SEQ ID NO: 496261 - DNA, 20 bp, Artificial Sequence
  chemically synthesized
acatattttgtgtaatttat

SEQ ID NO: 496262 - DNA, 20 bp, Artificial Sequence
  chemically synthesized
agggataataaaagaaggga

SEQ ID NO: 496263 - DNA, 20 bp, Artificial Sequence
  chemically synthesized
aagcagggataataaaagaa

SEQ ID NO: 496264 - DNA, 20 bp, Artificial Sequence
  chemically synthesized
agtgacaaggtagctaaagc

SEQ ID NO: 496265 - DNA, 20 bp, Artificial Sequence
  chemically synthesized
gtgtgaattacacagtttat

SEQ ID NO: 496266 - DNA, 20 bp, Artificial Sequence
  chemically synthesized
ccaatcagctcaaagcaggt

SEQ ID NO: 496267 - DNA, 20 bp, Artificial Sequence
  chemically synthesized
tctgtccttgattgtcccag

SEQ ID NO: 496268 - DNA, 20 bp, Artificial Sequence
  chemically synthesized
ttcctacctgaagcttaagg

SEQ ID NO: 496269 - DNA, 20 bp, Artificial Sequence
  chemically synthesized
ttctcccttaagcttcaggt

SEQ ID NO: 496270 - DNA, 20 bp, Artificial Sequence
  chemically synthesized
cttctccaggtatgaacctg

SEQ ID NO: 496271 - DNA, 20 bp, Artificial Sequence
  chemically synthesized
cttaaatgcaatgttcatta

SEQ ID NO: 496272 - DNA, 20 bp, Artificial Sequence
  chemically synthesized
tcttggtaccattgccagtt

SEQ ID NO: 496273 - DNA, 20 bp, Artificial Sequence
  chemically synthesized
tcataactggcaatggtacc

SEQ ID NO: 496274 - DNA, 20 bp, Artificial Sequence
  chemically synthesized
attaaaagcagagcagccta

SEQ ID NO: 496275 - DNA, 20 bp, Artificial Sequence
  chemically synthesized
gccaagtccttgaaggtgac

SEQ ID NO: 496276 - DNA, 20 bp, Artificial Sequence
  chemically synthesized
acagggatttgacaaaaatg

SEQ ID NO: 496277 - DNA, 20 bp, Artificial Sequence
  chemically synthesized
atttgacaaaaatggagggt

SEQ ID NO: 496278 - DNA, 20 bp, Artificial Sequence
  chemically synthesized
gatgcctgttgggggactat

SEQ ID NO: 496279 - DNA, 20 bp, Artificial Sequence
  chemically synthesized
acaaagcaaggcaataaaag

SEQ ID NO: 496280 - DNA, 20 bp, Artificial Sequence
  chemically synthesized
agagtcaagacagaaatgct

SEQ ID NO: 496281 - DNA, 20 bp, Artificial Sequence
  chemically synthesized
tgttatgaatttacacttct

SEQ ID NO: 496282 - DNA, 20 bp, Artificial Sequence
  chemically synthesized
atgtctagaaacctcctgtt

SEQ ID NO: 496283 - DNA, 20 bp, Artificial Sequence
  chemically synthesized
ttatcaattgtcaatatttt

SEQ ID NO: 496284 - DNA, 20 bp, Artificial Sequence
  chemically synthesized
tagagaaggggtagatggca

SEQ ID NO: 496285 - DNA, 20 bp, Artificial Sequence
  chemically synthesized
catgccatctaccccttctc

SEQ ID NO: 496286 - DNA, 20 bp, Artificial Sequence
  chemically synthesized
ttccatggcaactctagaga

SEQ ID NO: 496287 - DNA, 20 bp, Artificial Sequence
  chemically synthesized
tttctatttggaggaaagat

SEQ ID NO: 496288 - DNA, 20 bp, Artificial Sequence
  chemically synthesized
ggggtcattttttctaattg

SEQ ID NO: 496289 - DNA, 20 bp, Artificial Sequence
  chemically synthesized
cttttaaaattgagaagaca

SEQ ID NO: 496290 - DNA, 20 bp, Artificial Sequence
  chemically synthesized
caaggaaaaatgatcagcta

SEQ ID NO: 496291 - DNA, 20 bp, Artificial Sequence
  chemically synthesized
gagttacagcatgcacataa

SEQ ID NO: 496292 - DNA, 20 bp, Artificial Sequence
  chemically synthesized
gtcaaaagtaacaggtgtgg

SEQ ID NO: 496293 - DNA, 20 bp, Artificial Sequence
  chemically synthesized
ttctcaataattaaaaaaga

SEQ ID NO: 496294 - DNA, 20 bp, Artificial Sequence
  chemically synthesized
acctcagcctcccaaagtgc

SEQ ID NO: 496295 - DNA, 20 bp, Artificial Sequence
  chemically synthesized
cagcactttgggaggctgag

SEQ ID NO: 496296 - DNA, 20 bp, Artificial Sequence
  chemically synthesized
actttgggaggctgaggtgg

SEQ ID NO: 496297 - DNA, 20 bp, Artificial Sequence
  chemically synthesized
tggatggatcatctgaggtc

SEQ ID NO: 496298 - DNA, 20 bp, Artificial Sequence
  chemically synthesized
ttttgtatttttggtagaaa

SEQ ID NO: 496299 - DNA, 20 bp, Artificial Sequence
  chemically synthesized
aatacaaaaaattaactggg

SEQ ID NO: 496300 - DNA, 20 bp, Artificial Sequence
  chemically synthesized
gcctcagcctcctgaatagc

SEQ ID NO: 496301 - DNA, 20 bp, Artificial Sequence
  chemically synthesized
gattctcctgcctcagcctc

SEQ ID NO: 496302 - DNA, 20 bp, Artificial Sequence
  chemically synthesized
tattcaggaggctgaggcag

SEQ ID NO: 496303 - DNA, 20 bp, Artificial Sequence
  chemically synthesized
ggctgaggcaggagaatcgc

SEQ ID NO: 496304 - DNA, 20 bp, Artificial Sequence
  chemically synthesized
tctgggaggcagaggttgaa

SEQ ID NO: 496305 - DNA, 20 bp, Artificial Sequence
  chemically synthesized
tttcgctctgttgcccgggt

SEQ ID NO: 496306 - DNA, 20 bp, Artificial Sequence
  chemically synthesized
atggagtttcgctctgttgc

SEQ ID NO: 496307 - DNA, 20 bp, Artificial Sequence
  chemically synthesized
attattattattatttgaga

SEQ ID NO: 496308 - DNA, 20 bp, Artificial Sequence
  chemically synthesized
attattattattattactat

SEQ ID NO: 496309 - DNA, 20 bp, Artificial Sequence
  chemically synthesized
gacatttaacaagctgaaca

SEQ ID NO: 496310 - DNA, 20 bp, Artificial Sequence
  chemically synthesized
ggaaacactggtctggaaga

SEQ ID NO: 496311 - DNA, 20 bp, Artificial Sequence
  chemically synthesized
accacaactgacattttgga

SEQ ID NO: 496312 - DNA, 20 bp, Artificial Sequence
  chemically synthesized
caggaaagtctcttacaaca

SEQ ID NO: 496313 - DNA, 20 bp, Artificial Sequence
  chemically synthesized
aatatctctgtctctaccaa

SEQ ID NO: 496314 - DNA, 20 bp, Artificial Sequence
  chemically synthesized
tttttggttgtgacaattgc

SEQ ID NO: 496315 - DNA, 20 bp, Artificial Sequence
  chemically synthesized
ggtgattctgctgcacgctg

SEQ ID NO: 496316 - DNA, 20 bp, Artificial Sequence
  chemically synthesized
atttatccctcagcgtgcag

SEQ ID NO: 496317 - DNA, 20 bp, Artificial Sequence
  chemically synthesized
taatacagtggttctcagcc

SEQ ID NO: 496318 - DNA, 20 bp, Artificial Sequence
  chemically synthesized
ttgaaaggagtatatcactt

SEQ ID NO: 496319 - DNA, 20 bp, Artificial Sequence
  chemically synthesized
ggtataaatatgcgcttgaa

SEQ ID NO: 496320 - DNA, 20 bp, Artificial Sequence
  chemically synthesized
gttatatgtaaaaataagat

SEQ ID NO: 496321 - DNA, 20 bp, Artificial Sequence
  chemically synthesized
aataaaagcttattcagcaa

SEQ ID NO: 496322 - DNA, 20 bp, Artificial Sequence
  chemically synthesized
catatcaatatattcatttg

SEQ ID NO: 496323 - DNA, 20 bp, Artificial Sequence
  chemically synthesized
atgatgccttatatactaaa

SEQ ID NO: 496324 - DNA, 20 bp, Artificial Sequence
  chemically synthesized
ggattaataaatacaaaata

SEQ ID NO: 496325 - DNA, 20 bp, Artificial Sequence
  chemically synthesized
agcaacagaagcattaaaag

SEQ ID NO: 496326 - DNA, 20 bp, Artificial Sequence
  chemically synthesized
tttaattgactttgtcctta

SEQ ID NO: 496327 - DNA, 20 bp, Artificial Sequence
  chemically synthesized
tccttaccgaatactagtga

SEQ ID NO: 496328 - DNA, 20 bp, Artificial Sequence
  chemically synthesized
tactagtgataggatttata

SEQ ID NO: 496329 - DNA, 20 bp, Artificial Sequence
  chemically synthesized
tttgttgaactcatataaca

SEQ ID NO: 496330 - DNA, 20 bp, Artificial Sequence
  chemically synthesized
tcattgaaactcactgttat

SEQ ID NO: 496331 - DNA, 20 bp, Artificial Sequence
  chemically synthesized
agtttcaatgaaatcacact

SEQ ID NO: 496332 - DNA, 20 bp, Artificial Sequence
  chemically synthesized
agctggaacaaagcattaca

SEQ ID NO: 496333 - DNA, 20 bp, Artificial Sequence
  chemically synthesized
ttttcatctcttagatgaaa

SEQ ID NO: 496334 - DNA, 20 bp, Artificial Sequence
  chemically synthesized
ttatcataatataataacta

SEQ ID NO: 496335 - DNA, 20 bp, Artificial Sequence
  chemically synthesized
taaaggtctatgtacatttc

SEQ ID NO: 496336 - DNA, 20 bp, Artificial Sequence
  chemically synthesized
tgaaatgtatgggaaagatc

SEQ ID NO: 496337 - DNA, 20 bp, Artificial Sequence
  chemically synthesized
aagatctttcccatacattt

SEQ ID NO: 496338 - DNA, 20 bp, Artificial Sequence
  chemically synthesized
caaatgtatgaatgataaaa

SEQ ID NO: 496339 - DNA, 20 bp, Artificial Sequence
  chemically synthesized
aaaatatgtttatcaaatgt

SEQ ID NO: 496340 - DNA, 20 bp, Artificial Sequence
  chemically synthesized
tgatctacttttaattttgg

SEQ ID NO: 496341 - DNA, 20 bp, Artificial Sequence
  chemically synthesized
tgtttttctatgacattaag

SEQ ID NO: 496342 - DNA, 20 bp, Artificial Sequence
  chemically synthesized
tgtcctttatcttaatagag

SEQ ID NO: 496343 - DNA, 20 bp, Artificial Sequence
  chemically synthesized
ctcatataaagaaatataga

SEQ ID NO: 496344 - DNA, 20 bp, Artificial Sequence
  chemically synthesized
atatgtacttattcatttca

SEQ ID NO: 496345 - DNA, 20 bp, Artificial Sequence
  chemically synthesized
aaaccatacaattccctgaa

SEQ ID NO: 496346 - DNA, 20 bp, Artificial Sequence
  chemically synthesized
aacaaaacggtcaaatttgc

SEQ ID NO: 496347 - DNA, 20 bp, Artificial Sequence
  chemically synthesized
tagtaaaggattattaagtt

SEQ ID NO: 496348 - DNA, 20 bp, Artificial Sequence
  chemically synthesized
aagactttgctgaattagta

SEQ ID NO: 496349 - DNA, 20 bp, Artificial Sequence
  chemically synthesized
aaattttttataagactttg

SEQ ID NO: 496350 - DNA, 20 bp, Artificial Sequence
  chemically synthesized
aatagataacaggtcatatg

SEQ ID NO: 496351 - DNA, 20 bp, Artificial Sequence
  chemically synthesized
cacaaaatgccttataacat

SEQ ID NO: 496352 - DNA, 20 bp, Artificial Sequence
  chemically synthesized
aaattatatttctatgtaat

SEQ ID NO: 496353 - DNA, 20 bp, Artificial Sequence
  chemically synthesized
tagaaatataatttatgtag

SEQ ID NO: 496354 - DNA, 20 bp, Artificial Sequence
  chemically synthesized
cggaaactgatgtttttaaa

SEQ ID NO: 496355 - DNA, 20 bp, Artificial Sequence
  chemically synthesized
ctttttaaaaacatcagttt

SEQ ID NO: 496356 - DNA, 20 bp, Artificial Sequence
  chemically synthesized
atcagtttccgaatatgcca

SEQ ID NO: 496357 - DNA, 20 bp, Artificial Sequence
  chemically synthesized
ccctctcccttctctcaaca

SEQ ID NO: 496358 - DNA, 20 bp, Artificial Sequence
  chemically synthesized
cctttctcaagtcccacaac

SEQ ID NO: 496359 - DNA, 20 bp, Artificial Sequence
  chemically synthesized
agaggatgaagagggtgctg

SEQ ID NO: 496360 - DNA, 20 bp, Artificial Sequence
  chemically synthesized
attttataatagaggatgaa

SEQ ID NO: 496361 - DNA, 20 bp, Artificial Sequence
  chemically synthesized
aatggtagtattttataata

SEQ ID NO: 496362 - DNA, 20 bp, Artificial Sequence
  chemically synthesized
tgggcaaaatcagaacacta

SEQ ID NO: 496363 - DNA, 20 bp, Artificial Sequence
  chemically synthesized
tggccttagtgatctcatgt

SEQ ID NO: 496364 - DNA, 20 bp, Artificial Sequence
  chemically synthesized
ctggccacataaacagaaaa

SEQ ID NO: 496365 - DNA, 20 bp, Artificial Sequence
  chemically synthesized
ttcaattttataaacatgtt

SEQ ID NO: 496366 - DNA, 20 bp, Artificial Sequence
  chemically synthesized
ttcacaacatgtttataaaa

SEQ ID NO: 496367 - DNA, 20 bp, Artificial Sequence
  chemically synthesized
aactcattaaaaattttcag

SEQ ID NO: 496368 - DNA, 20 bp, Artificial Sequence
  chemically synthesized
aattcagctgaaaattttta

SEQ ID NO: 496369 - DNA, 20 bp, Artificial Sequence
  chemically synthesized
tgcatgataactgaaaagct

SEQ ID NO: 496370 - DNA, 20 bp, Artificial Sequence
  chemically synthesized
caaagatcatagaggtatct

SEQ ID NO: 496371 - DNA, 20 bp, Artificial Sequence
  chemically synthesized
acaccacagtttggaggtat

SEQ ID NO: 496372 - DNA, 20 bp, Artificial Sequence
  chemically synthesized
gctaagtatttgttgcagta

SEQ ID NO: 496373 - DNA, 20 bp, Artificial Sequence
  chemically synthesized
atcacaagctgaaaataaaa

SEQ ID NO: 496374 - DNA, 20 bp, Artificial Sequence
  chemically synthesized
gcatgtggcaggtggctttt

SEQ ID NO: 496375 - DNA, 20 bp, Artificial Sequence
  chemically synthesized
ttgtcacgtcaacaggtcac

SEQ ID NO: 496376 - DNA, 20 bp, Artificial Sequence
  chemically synthesized
ggagaaaaaaatcactcctc

SEQ ID NO: 496377 - DNA, 20 bp, Artificial Sequence
  chemically synthesized
gggatactactgtactcatg

SEQ ID NO: 496378 - DNA, 20 bp, Artificial Sequence
  chemically synthesized
tgagtgtgatctgcctctct

SEQ ID NO: 496379 - DNA, 20 bp, Artificial Sequence
  chemically synthesized
acttgattcttatgtcatgt

SEQ ID NO: 496380 - DNA, 20 bp, Artificial Sequence
  chemically synthesized
atcacactcacacatgacat

SEQ ID NO: 496381 - DNA, 20 bp, Artificial Sequence
  chemically synthesized
gattatgattattattgaga

SEQ ID NO: 496382 - DNA, 20 bp, Artificial Sequence
  chemically synthesized
gtctagctctgtcaccaggc

SEQ ID NO: 496383 - DNA, 20 bp, Artificial Sequence
  chemically synthesized
tactcgggaggctgaggcag

SEQ ID NO: 496384 - DNA, 20 bp, Artificial Sequence
  chemically synthesized
gattctcctgcctcagcctc

SEQ ID NO: 496385 - DNA, 20 bp, Artificial Sequence
  chemically synthesized
gcctcagcctcccgagtagc

SEQ ID NO: 496386 - DNA, 20 bp, Artificial Sequence
  chemically synthesized
ttttgtatttttagtagaga

SEQ ID NO: 496387 - DNA, 20 bp, Artificial Sequence
  chemically synthesized
cggagtttcaccgtgttagc

SEQ ID NO: 496388 - DNA, 20 bp, Artificial Sequence
  chemically synthesized
acctcggcctcccaaagtgc

SEQ ID NO: 496389 - DNA, 20 bp, Artificial Sequence
  chemically synthesized
tatatgtatgctttaggaaa

SEQ ID NO: 496390 - DNA, 20 bp, Artificial Sequence
  chemically synthesized
tggaacaatacagcaacagg

SEQ ID NO: 496391 - DNA, 20 bp, Artificial Sequence
  chemically synthesized
tataccataagaggctatgt

SEQ ID NO: 496392 - DNA, 20 bp, Artificial Sequence
  chemically synthesized
tttctatacaccttgaaaat

SEQ ID NO: 496393 - DNA, 20 bp, Artificial Sequence
  chemically synthesized
tcattgttaattgttataga

SEQ ID NO: 496394 - DNA, 20 bp, Artificial Sequence
  chemically synthesized
agagtagacaagagagaaga

SEQ ID NO: 496395 - DNA, 20 bp, Artificial Sequence
  chemically synthesized
tcataaaaattagaaaattg

SEQ ID NO: 496396 - DNA, 20 bp, Artificial Sequence
  chemically synthesized
acaggggaattataataatg

SEQ ID NO: 496397 - DNA, 20 bp, Artificial Sequence
  chemically synthesized
ccatgtctactttctgacag

SEQ ID NO: 496398 - DNA, 20 bp, Artificial Sequence
  chemically synthesized
tgacttcaacctctgaaaat

SEQ ID NO: 496399 - DNA, 20 bp, Artificial Sequence
  chemically synthesized
ctcactttttgaattatgag

SEQ ID NO: 496400 - DNA, 20 bp, Artificial Sequence
  chemically synthesized
tcctttttctctctcacttt

SEQ ID NO: 496401 - DNA, 20 bp, Artificial Sequence
  chemically synthesized
aaagtgagagagaaaaagga

SEQ ID NO: 496402 - DNA, 20 bp, Artificial Sequence
  chemically synthesized
tgaggtactataacaccaaa

SEQ ID NO: 496403 - DNA, 20 bp, Artificial Sequence
  chemically synthesized
cagagctaacagttgttgtc

SEQ ID NO: 496404 - DNA, 20 bp, Artificial Sequence
  chemically synthesized
acaactgttagctctgaagt

SEQ ID NO: 496405 - DNA, 20 bp, Artificial Sequence
  chemically synthesized
tttttgtaaataaagtttta

SEQ ID NO: 496406 - DNA, 20 bp, Artificial Sequence
  chemically synthesized
ctgcttcaacattctaacag

SEQ ID NO: 496407 - DNA, 20 bp, Artificial Sequence
  chemically synthesized
caactattcaactctgctgt

SEQ ID NO: 496408 - DNA, 20 bp, Artificial Sequence
  chemically synthesized
tcaacattctaacagcagag

SEQ ID NO: 496409 - DNA, 20 bp, Artificial Sequence
  chemically synthesized
gcagagttgaatagttgcaa

SEQ ID NO: 496410 - DNA, 20 bp, Artificial Sequence
  chemically synthesized
aatgtaaacgtaaagggcca

SEQ ID NO: 496411 - DNA, 20 bp, Artificial Sequence
  chemically synthesized
agacaacattgttttatagt

SEQ ID NO: 496412 - DNA, 20 bp, Artificial Sequence
  chemically synthesized
aagctatggtaaattaaaaa

SEQ ID NO: 496413 - DNA, 20 bp, Artificial Sequence
  chemically synthesized
atgtaaccaagcacacttat

SEQ ID NO: 496414 - DNA, 20 bp, Artificial Sequence
  chemically synthesized
caataagtgtgcttggttac

SEQ ID NO: 496415 - DNA, 20 bp, Artificial Sequence
  chemically synthesized
catgaataacttgtgatggt

SEQ ID NO: 496416 - DNA, 20 bp, Artificial Sequence
  chemically synthesized
gtctgcctggtacttttaag

SEQ ID NO: 496417 - DNA, 20 bp, Artificial Sequence
  chemically synthesized
tctccatactaaaatgtctc

SEQ ID NO: 496418 - DNA, 20 bp, Artificial Sequence
  chemically synthesized
tctggagacattttagtatg

SEQ ID NO: 496419 - DNA, 20 bp, Artificial Sequence
  chemically synthesized
aatacagcaactaagatagt

SEQ ID NO: 496420 - DNA, 20 bp, Artificial Sequence
  chemically synthesized
tagggccaaatgtttcccta

SEQ ID NO: 496421 - DNA, 20 bp, Artificial Sequence
  chemically synthesized
atatagtttcacgagcatat

SEQ ID NO: 496422 - DNA, 20 bp, Artificial Sequence
  chemically synthesized
cctcacctctcaatagcatt

SEQ ID NO: 496423 - DNA, 20 bp, Artificial Sequence
  chemically synthesized
ggtgaggccagctggacttt

SEQ ID NO: 496424 - DNA, 20 bp, Artificial Sequence
  chemically synthesized
ggccagctggactttctggg

SEQ ID NO: 496425 - DNA, 20 bp, Artificial Sequence
  chemically synthesized
ggaacttttctgtcttacaa

SEQ ID NO: 496426 - DNA, 20 bp, Artificial Sequence
  chemically synthesized
ggaaccttcccgtcttacaa

SEQ ID NO: 496427 - DNA, 20 bp, Artificial Sequence
  chemically synthesized
ctgtaaaatgcaccaatcag

SEQ ID NO: 496428 - DNA, 20 bp, Artificial Sequence
  chemically synthesized
tccccacgattggctacttt

SEQ ID NO: 496429 - DNA, 20 bp, Artificial Sequence
  chemically synthesized
taaaagtagccaatcgtggg

SEQ ID NO: 496430 - DNA, 20 bp, Artificial Sequence
  chemically synthesized
atgttccatttctgtcctat

SEQ ID NO: 496431 - DNA, 20 bp, Artificial Sequence
  chemically synthesized
aacatgggaggggacagtaa

SEQ ID NO: 496432 - DNA, 20 bp, Artificial Sequence
  chemically synthesized
agcaggttgccgctgctggc

SEQ ID NO: 496433 - DNA, 20 bp, Artificial Sequence
  chemically synthesized
agccagcagcggcaacctgc

SEQ ID NO: 496434 - DNA, 20 bp, Artificial Sequence
  chemically synthesized
atcttgctgctgctcgctgt

SEQ ID NO: 496435 - DNA, 20 bp, Artificial Sequence
  chemically synthesized
tccagagttggttcccgccg

SEQ ID NO: 496436 - DNA, 20 bp, Artificial Sequence
  chemically synthesized
acttaaggtcatagtgtgtc

SEQ ID NO: 496437 - DNA, 20 bp, Artificial Sequence
  chemically synthesized
ccttaagtaagtctgtcttc

SEQ ID NO: 496438 - DNA, 20 bp, Artificial Sequence
  chemically synthesized
tacaaaggctaggaaatatc

SEQ ID NO: 496439 - DNA, 20 bp, Artificial Sequence
  chemically synthesized
cataaaataggaatcaaaag

SEQ ID NO: 496440 - DNA, 20 bp, Artificial Sequence
  chemically synthesized
atctaatggaaacataaaat

SEQ ID NO: 496441 - DNA, 20 bp, Artificial Sequence
  chemically synthesized
acctccctccgtagtaatgc

SEQ ID NO: 496442 - DNA, 20 bp, Artificial Sequence
  chemically synthesized
atctcaaatattgcatccag

SEQ ID NO: 496443 - DNA, 20 bp, Artificial Sequence
  chemically synthesized
ttattcttagtgtcattctt

SEQ ID NO: 496444 - DNA, 20 bp, Artificial Sequence
  chemically synthesized
gcatccagaagaatgacact

SEQ ID NO: 496445 - DNA, 20 bp, Artificial Sequence
  chemically synthesized
cacattatctcatacttcaa

SEQ ID NO: 496446 - DNA, 20 bp, Artificial Sequence
  chemically synthesized
ataaggtaattaggaagagg

SEQ ID NO: 496447 - DNA, 20 bp, Artificial Sequence
  chemically synthesized
atctataaggtaattaggaa

SEQ ID NO: 496448 - DNA, 20 bp, Artificial Sequence
  chemically synthesized
actagctttgtatgttggag

SEQ ID NO: 496449 - DNA, 20 bp, Artificial Sequence
  chemically synthesized
cataagctgtcccttgtgcc

SEQ ID NO: 496450 - DNA, 20 bp, Artificial Sequence
  chemically synthesized
agaagaactgatggacaaac

SEQ ID NO: 496451 - DNA, 20 bp, Artificial Sequence
  chemically synthesized
aaagtgggaaatattatgca

SEQ ID NO: 496452 - DNA, 20 bp, Artificial Sequence
  chemically synthesized
gtaattttagtaagcaggga

SEQ ID NO: 496453 - DNA, 20 bp, Artificial Sequence
  chemically synthesized
aaactgtaattttagtaagc

SEQ ID NO: 496454 - DNA, 20 bp, Artificial Sequence
  chemically synthesized
gcttccttgtacgtagtgtg

SEQ ID NO: 496455 - DNA, 20 bp, Artificial Sequence
  chemically synthesized
gtagtgtgcaggatattact

SEQ ID NO: 496456 - DNA, 20 bp, Artificial Sequence
  chemically synthesized
agtgggcacccaatatatta

SEQ ID NO: 496457 - DNA, 20 bp, Artificial Sequence
  chemically synthesized
tgattgtattcattaatata

SEQ ID NO: 496458 - DNA, 20 bp, Artificial Sequence
  chemically synthesized
aacaccacatctggaccact

SEQ ID NO: 496459 - DNA, 20 bp, Artificial Sequence
  chemically synthesized
tcaaggtgctcctaatatgg

SEQ ID NO: 496460 - DNA, 20 bp, Artificial Sequence
  chemically synthesized
accgtccccactttactgat

SEQ ID NO: 496461 - DNA, 20 bp, Artificial Sequence
  chemically synthesized
tatcagtaaagtggggacgg

SEQ ID NO: 496462 - DNA, 20 bp, Artificial Sequence
  chemically synthesized
tattgtaggtgacattttag

SEQ ID NO: 496463 - DNA, 20 bp, Artificial Sequence
  chemically synthesized
tgagtatagaaagggaggtt

SEQ ID NO: 496464 - DNA, 20 bp, Artificial Sequence
  chemically synthesized
tgcttgtcacaagtgacctt

SEQ ID NO: 496465 - DNA, 20 bp, Artificial Sequence
  chemically synthesized
tgagtcacttgtgacatgaa

SEQ ID NO: 496466 - DNA, 20 bp, Artificial Sequence
  chemically synthesized
gggtagtcagagaaatgaat

SEQ ID NO: 496467 - DNA, 20 bp, Artificial Sequence
  chemically synthesized
ggggttgggtagtcagagaa

SEQ ID NO: 496468 - DNA, 20 bp, Artificial Sequence
  chemically synthesized
tgaaaaatccaagtgagggg

SEQ ID NO: 496469 - DNA, 20 bp, Artificial Sequence
  chemically synthesized
ctgactacccaacccctcac

SEQ ID NO: 496470 - DNA, 20 bp, Artificial Sequence
  chemically synthesized
acctttgaaaaatccaagtg

SEQ ID NO: 496471 - DNA, 20 bp, Artificial Sequence
  chemically synthesized
agaaagagagtaaacgtatt

SEQ ID NO: 496472 - DNA, 20 bp, Artificial Sequence
  chemically synthesized
ggaaaagagttgcagagaaa

SEQ ID NO: 496473 - DNA, 20 bp, Artificial Sequence
  chemically synthesized
aatgcataaggggagaggaa

SEQ ID NO: 496474 - DNA, 20 bp, Artificial Sequence
  chemically synthesized
agtacgtattggataaaata

SEQ ID NO: 496475 - DNA, 20 bp, Artificial Sequence
  chemically synthesized
aagtgatcagtaagtacgta

SEQ ID NO: 496476 - DNA, 20 bp, Artificial Sequence
  chemically synthesized
ggtgtatgacatcagaaact

SEQ ID NO: 496477 - DNA, 20 bp, Artificial Sequence
  chemically synthesized
taagttgaacgattgcagag

SEQ ID NO: 496478 - DNA, 20 bp, Artificial Sequence
  chemically synthesized
agtgttaagttgaacgattg

SEQ ID NO: 496479 - DNA, 20 bp, Artificial Sequence
  chemically synthesized
atacaggagacgtaattgac

SEQ ID NO: 496480 - DNA, 20 bp, Artificial Sequence
  chemically synthesized
ttgactaaaatagttctagt

SEQ ID NO: 496481 - DNA, 20 bp, Artificial Sequence
  chemically synthesized
tggttcagagagaagcaaat

SEQ ID NO: 496482 - DNA, 20 bp, Artificial Sequence
  chemically synthesized
acttctttcgctgaagtgtg

SEQ ID NO: 496483 - DNA, 20 bp, Artificial Sequence
  chemically synthesized
cacttcagcgaaagaagtct

SEQ ID NO: 496484 - DNA, 20 bp, Artificial Sequence
  chemically synthesized
ttgtcacgtggttgtcagga

SEQ ID NO: 496485 - DNA, 20 bp, Artificial Sequence
  chemically synthesized
agggtccttcgggtcctgtt

SEQ ID NO: 496486 - DNA, 20 bp, Artificial Sequence
  chemically synthesized
gctagaacctggagggtcct

SEQ ID NO: 496487 - DNA, 20 bp, Artificial Sequence
  chemically synthesized
ggagatggggctagaacctg

SEQ ID NO: 496488 - DNA, 20 bp, Artificial Sequence
  chemically synthesized
gtcagagataaaggaacaga

SEQ ID NO: 496489 - DNA, 20 bp, Artificial Sequence
  chemically synthesized
acatttaaagagctaagcct

SEQ ID NO: 496490 - DNA, 20 bp, Artificial Sequence
  chemically synthesized
gtggtggaaatttttctatg

SEQ ID NO: 496491 - DNA, 20 bp, Artificial Sequence
  chemically synthesized
ttagaaatttgaattagtat

SEQ ID NO: 496492 - DNA, 20 bp, Artificial Sequence
  chemically synthesized
ctggtgtccgagttagaaat

SEQ ID NO: 496493 - DNA, 20 bp, Artificial Sequence
  chemically synthesized
gaaaggggaaccactggtgt

SEQ ID NO: 496494 - DNA, 20 bp, Artificial Sequence
  chemically synthesized
caatctctctctctctctct

SEQ ID NO: 496495 - DNA, 20 bp, Artificial Sequence
  chemically synthesized
tatgcaagtaatcaaccatg

SEQ ID NO: 496496 - DNA, 20 bp, Artificial Sequence
  chemically synthesized
ataaagtctgacatccctgc

SEQ ID NO: 496497 - DNA, 20 bp, Artificial Sequence
  chemically synthesized
atgacagacataatcccagc

SEQ ID NO: 496498 - DNA, 20 bp, Artificial Sequence
  chemically synthesized
gggagctaaatacttatttg

SEQ ID NO: 496499 - DNA, 20 bp, Artificial Sequence
  chemically synthesized
gctaaatacttatttgttgg

SEQ ID NO: 496500 - DNA, 20 bp, Artificial Sequence
  chemically synthesized
aatgaaatgatgtaaaatag

SEQ ID NO: 496501 - DNA, 20 bp, Artificial Sequence
  chemically synthesized
aaaatagtggaatgataaaa

SEQ ID NO: 496502 - DNA, 20 bp, Artificial Sequence
  chemically synthesized
tatttcagaggctgtgctga

SEQ ID NO: 496503 - DNA, 20 bp, Artificial Sequence
  chemically synthesized
agatttgggcaataaagagc

SEQ ID NO: 496504 - DNA, 20 bp, Artificial Sequence
  chemically synthesized
ttgggcaataaagagccaga

SEQ ID NO: 496505 - DNA, 20 bp, Artificial Sequence
  chemically synthesized
aataaagagccagaatggat

SEQ ID NO: 496506 - DNA, 20 bp, Artificial Sequence
  chemically synthesized
atagggatatatgataactg

SEQ ID NO: 496507 - DNA, 20 bp, Artificial Sequence
  chemically synthesized
tgcagggtttttcagagaaa

SEQ ID NO: 496508 - DNA, 20 bp, Artificial Sequence
  chemically synthesized
tgcatttcttatattgactg

SEQ ID NO: 496509 - DNA, 20 bp, Artificial Sequence
  chemically synthesized
gcagaaagaaaaacaatgtt

SEQ ID NO: 496510 - DNA, 20 bp, Artificial Sequence
  chemically synthesized
acaatgttgcggatgttaga

SEQ ID NO: 496511 - DNA, 20 bp, Artificial Sequence
  chemically synthesized
attgagagattctgaagtga

SEQ ID NO: 496512 - DNA, 20 bp, Artificial Sequence
  chemically synthesized
tcctgaacatcccatcactt

SEQ ID NO: 496513 - DNA, 20 bp, Artificial Sequence
  chemically synthesized
gtcttgagacttttgggtca

SEQ ID NO: 496514 - DNA, 20 bp, Artificial Sequence
  chemically synthesized
aaaaaatggtcttgagactt

SEQ ID NO: 496515 - DNA, 20 bp, Artificial Sequence
  chemically synthesized
ggttaactattgttaaaaat

SEQ ID NO: 496516 - DNA, 20 bp, Artificial Sequence
  chemically synthesized
ttattttacaaacacatatt

SEQ ID NO: 496517 - DNA, 20 bp, Artificial Sequence
  chemically synthesized
aattttattgtatatattta

SEQ ID NO: 496518 - DNA, 20 bp, Artificial Sequence
  chemically synthesized
ttcttgccacagagtgaaaa

SEQ ID NO: 496519 - DNA, 20 bp, Artificial Sequence
  chemically synthesized
gattatagctgttcttgcca

SEQ ID NO: 496520 - DNA, 20 bp, Artificial Sequence
  chemically synthesized
gtattcaagatttttgataa

SEQ ID NO: 496521 - DNA, 20 bp, Artificial Sequence
  chemically synthesized
ctattcatttatcaaaaatc

SEQ ID NO: 496522 - DNA, 20 bp, Artificial Sequence
  chemically synthesized
aaatggggcaatgtaggtca

SEQ ID NO: 496523 - DNA, 20 bp, Artificial Sequence
  chemically synthesized
taaacagtggttaccagggt

SEQ ID NO: 496524 - DNA, 20 bp, Artificial Sequence
  chemically synthesized
gtgaattaaacagtggttac

SEQ ID NO: 496525 - DNA, 20 bp, Artificial Sequence
  chemically synthesized
aggtcaaatatatacagata

SEQ ID NO: 496526 - DNA, 20 bp, Artificial Sequence
  chemically synthesized
tgtatgatctcacttatata

SEQ ID NO: 496527 - DNA, 20 bp, Artificial Sequence
  chemically synthesized
gatctgtcatttgtcccaac

SEQ ID NO: 496528 - DNA, 20 bp, Artificial Sequence
  chemically synthesized
taaggctgaaaaatattcca

SEQ ID NO: 496529 - DNA, 20 bp, Artificial Sequence
  chemically synthesized
acacacacacacacaccccc

SEQ ID NO: 496530 - DNA, 20 bp, Artificial Sequence
  chemically synthesized
tttacaaagaaatatggtcc

SEQ ID NO: 496531 - DNA, 20 bp, Artificial Sequence
  chemically synthesized
ggggtttctatggaagggct

SEQ ID NO: 496532 - DNA, 20 bp, Artificial Sequence
  chemically synthesized
agagagagagagagagaatc

SEQ ID NO: 496533 - DNA, 20 bp, Artificial Sequence
  chemically synthesized
gagagagagagagagagaga

SEQ ID NO: 496534 - DNA, 20 bp, Artificial Sequence
  chemically synthesized
gaatatttaaaattatattt

SEQ ID NO: 496535 - DNA, 20 bp, Artificial Sequence
  chemically synthesized
agtctggcaccagacaaaat

SEQ ID NO: 496536 - DNA, 20 bp, Artificial Sequence
  chemically synthesized
ttgtaagttcttttataata

SEQ ID NO: 496537 - DNA, 20 bp, Artificial Sequence
  chemically synthesized
tgtggtgatgagataaagaa

SEQ ID NO: 496538 - DNA, 20 bp, Artificial Sequence
  chemically synthesized
ataatggtcttcctaggtat

SEQ ID NO: 496539 - DNA, 20 bp, Artificial Sequence
  chemically synthesized
acaagagccaacataatgat

SEQ ID NO: 496540 - DNA, 20 bp, Artificial Sequence
  chemically synthesized
taatgatctgagttctgata

SEQ ID NO: 496541 - DNA, 20 bp, Artificial Sequence
  chemically synthesized
gttttggcacaaactgtcac

SEQ ID NO: 496542 - DNA, 20 bp, Artificial Sequence
  chemically synthesized
atctaaatattttctggctg

SEQ ID NO: 496543 - DNA, 20 bp, Artificial Sequence
  chemically synthesized
tgcttagagtaacagattta

SEQ ID NO: 496544 - DNA, 20 bp, Artificial Sequence
  chemically synthesized
cttaactcctgaattttgct

SEQ ID NO: 496545 - DNA, 20 bp, Artificial Sequence
  chemically synthesized
tgttactctaagcaaaattc

SEQ ID NO: 496546 - DNA, 20 bp, Artificial Sequence
  chemically synthesized
atctatcattgacttaactc

SEQ ID NO: 496547 - DNA, 20 bp, Artificial Sequence
  chemically synthesized
atagatggccattttggtgt

SEQ ID NO: 496548 - DNA, 20 bp, Artificial Sequence
  chemically synthesized
aaagaaataaacttttgtcc

SEQ ID NO: 496549 - DNA, 20 bp, Artificial Sequence
  chemically synthesized
gataatattgatcatccaaa

SEQ ID NO: 496550 - DNA, 20 bp, Artificial Sequence
  chemically synthesized
gccaaaccatatcatcctat

SEQ ID NO: 496551 - DNA, 20 bp, Artificial Sequence
  chemically synthesized
gctacaattcaagatgagat

SEQ ID NO: 496552 - DNA, 20 bp, Artificial Sequence
  chemically synthesized
gtccccatccaaatctcatc

SEQ ID NO: 496553 - DNA, 20 bp, Artificial Sequence
  chemically synthesized
aggtcactcccatgacacat

SEQ ID NO: 496554 - DNA, 20 bp, Artificial Sequence
  chemically synthesized
ccataatccccatgtgtcat

SEQ ID NO: 496555 - DNA, 20 bp, Artificial Sequence
  chemically synthesized
agtgacctggtgggaggtaa

SEQ ID NO: 496556 - DNA, 20 bp, Artificial Sequence
  chemically synthesized
gtgggaggtaattgaatcac

SEQ ID NO: 496557 - DNA, 20 bp, Artificial Sequence
  chemically synthesized
cttgtgctgtccttatggca

SEQ ID NO: 496558 - DNA, 20 bp, Artificial Sequence
  chemically synthesized
acaatcatggtggaaggtga

SEQ ID NO: 496559 - DNA, 20 bp, Artificial Sequence
  chemically synthesized
ctccctagtcatgtgagact

SEQ ID NO: 496560 - DNA, 20 bp, Artificial Sequence
  chemically synthesized
tacttataaattacccagtc

SEQ ID NO: 496561 - DNA, 20 bp, Artificial Sequence
  chemically synthesized
ctatgaagaaatacccaaga

SEQ ID NO: 496562 - DNA, 20 bp, Artificial Sequence
  chemically synthesized
taggaaaatgaactaataca

SEQ ID NO: 496563 - DNA, 20 bp, Artificial Sequence
  chemically synthesized
tttccgcagaagaaaacacc

SEQ ID NO: 496564 - DNA, 20 bp, Artificial Sequence
  chemically synthesized
atttttccctttggaaagtc

SEQ ID NO: 496565 - DNA, 20 bp, Artificial Sequence
  chemically synthesized
atggacagaaggttacatcg

SEQ ID NO: 496566 - DNA, 20 bp, Artificial Sequence
  chemically synthesized
cctagaaggaggtaatattt

SEQ ID NO: 496567 - DNA, 20 bp, Artificial Sequence
  chemically synthesized
cctccttctaggtttttgat

SEQ ID NO: 496568 - DNA, 20 bp, Artificial Sequence
  chemically synthesized
ttctaggtttttgataggag

SEQ ID NO: 496569 - DNA, 20 bp, Artificial Sequence
  chemically synthesized
ttgagaaatacagacctggt

SEQ ID NO: 496570 - DNA, 20 bp, Artificial Sequence
  chemically synthesized
agacctggtttggatactaa

SEQ ID NO: 496571 - DNA, 20 bp, Artificial Sequence
  chemically synthesized
aacacactgttaggaaaatt

SEQ ID NO: 496572 - DNA, 20 bp, Artificial Sequence
  chemically synthesized
ctttgagcactaaaacctgc

SEQ ID NO: 496573 - DNA, 20 bp, Artificial Sequence
  chemically synthesized
gtgggcttggagagaccctt

SEQ ID NO: 496574 - DNA, 20 bp, Artificial Sequence
  chemically synthesized
gcttggagagacccttcaga

SEQ ID NO: 496575 - DNA, 20 bp, Artificial Sequence
  chemically synthesized
gaaggtcccaactcattctg

SEQ ID NO: 496576 - DNA, 20 bp, Artificial Sequence
  chemically synthesized
accttcctgaagaaggagct

SEQ ID NO: 496577 - DNA, 20 bp, Artificial Sequence
  chemically synthesized
gaagtcacagtgatgcttga

SEQ ID NO: 496578 - DNA, 20 bp, Artificial Sequence
  chemically synthesized
ctataaagaactgcctgaga

SEQ ID NO: 496579 - DNA, 20 bp, Artificial Sequence
  chemically synthesized
tgctgttctcctgatagtga

SEQ ID NO: 496580 - DNA, 20 bp, Artificial Sequence
  chemically synthesized
cccatgctgttctcctgata

SEQ ID NO: 496581 - DNA, 20 bp, Artificial Sequence
  chemically synthesized
gagagaccaggtggaggtaa

SEQ ID NO: 496582 - DNA, 20 bp, Artificial Sequence
  chemically synthesized
gtctctctcccttgacatgt

SEQ ID NO: 496583 - DNA, 20 bp, Artificial Sequence
  chemically synthesized
ccttgacatgtggggattgt

SEQ ID NO: 496584 - DNA, 20 bp, Artificial Sequence
  chemically synthesized
gtccccacccaaatctcatt

SEQ ID NO: 496585 - DNA, 20 bp, Artificial Sequence
  chemically synthesized
attacaattcaaaatgagat

SEQ ID NO: 496586 - DNA, 20 bp, Artificial Sequence
  chemically synthesized
ggggacacaaagccaaacca

SEQ ID NO: 496587 - DNA, 20 bp, Artificial Sequence
  chemically synthesized
ccataggatccatcaaatcc

SEQ ID NO: 496588 - DNA, 20 bp, Artificial Sequence
  chemically synthesized
aaccatcatcctgggatttg

SEQ ID NO: 496589 - DNA, 20 bp, Artificial Sequence
  chemically synthesized
gggatggagaaccatcatcc

SEQ ID NO: 496590 - DNA, 20 bp, Artificial Sequence
  chemically synthesized
taaaatattgcacacattgt

SEQ ID NO: 496591 - DNA, 20 bp, Artificial Sequence
  chemically synthesized
cacaatgtgtgcaatatttt

SEQ ID NO: 496592 - DNA, 20 bp, Artificial Sequence
  chemically synthesized
agatctgtactttagctatt

SEQ ID NO: 496593 - DNA, 20 bp, Artificial Sequence
  chemically synthesized
tgcaagtagtttcatcttcc

SEQ ID NO: 496594 - DNA, 20 bp, Artificial Sequence
  chemically synthesized
ggtgagagtaatgtttttgt

SEQ ID NO: 496595 - DNA, 20 bp, Artificial Sequence
  chemically synthesized
cgaaaacgtatgatgcaggt

SEQ ID NO: 496596 - DNA, 20 bp, Artificial Sequence
  chemically synthesized
cacctgcatcatacgttttc

SEQ ID NO: 496597 - DNA, 20 bp, Artificial Sequence
  chemically synthesized
tatggcttacataaaacagc

SEQ ID NO: 496598 - DNA, 20 bp, Artificial Sequence
  chemically synthesized
tttatgtaagccatagtcct

SEQ ID NO: 496599 - DNA, 20 bp, Artificial Sequence
  chemically synthesized
aaaaaagtacctgctcttct

SEQ ID NO: 496600 - DNA, 20 bp, Artificial Sequence
  chemically synthesized
tctttaacctggaccatttt

SEQ ID NO: 496601 - DNA, 20 bp, Artificial Sequence
  chemically synthesized
gaaactgtagcagagcttcc

SEQ ID NO: 496602 - DNA, 20 bp, Artificial Sequence
  chemically synthesized
agcttccatggatattctga

SEQ ID NO: 496603 - DNA, 20 bp, Artificial Sequence
  chemically synthesized
gaagcaatgatatatccaat

SEQ ID NO: 496604 - DNA, 20 bp, Artificial Sequence
  chemically synthesized
aaacagaaaatccttttgtc

SEQ ID NO: 496605 - DNA, 20 bp, Artificial Sequence
  chemically synthesized
taaatacctactccagacaa

SEQ ID NO: 496606 - DNA, 20 bp, Artificial Sequence
  chemically synthesized
aagtggaaagacattattac

SEQ ID NO: 496607 - DNA, 20 bp, Artificial Sequence
  chemically synthesized
tagtttttttatgaacaacc

SEQ ID NO: 496608 - DNA, 20 bp, Artificial Sequence
  chemically synthesized
atgaacaacccagaatatta

SEQ ID NO: 496609 - DNA, 20 bp, Artificial Sequence
  chemically synthesized
acctttaacccggtaatatt

SEQ ID NO: 496610 - DNA, 20 bp, Artificial Sequence
  chemically synthesized
aataattgctttgacatata

SEQ ID NO: 496611 - DNA, 20 bp, Artificial Sequence
  chemically synthesized
aatcggaggcagatctacag

SEQ ID NO: 496612 - DNA, 20 bp, Artificial Sequence
  chemically synthesized
ggcagatctacagtggaata

SEQ ID NO: 496613 - DNA, 20 bp, Artificial Sequence
  chemically synthesized
ctacagtggaatagggaatt

SEQ ID NO: 496614 - DNA, 20 bp, Artificial Sequence
  chemically synthesized
tttctgttagaatataaatt

SEQ ID NO: 496615 - DNA, 20 bp, Artificial Sequence
  chemically synthesized
gaatttatattctaacagaa

SEQ ID NO: 496616 - DNA, 20 bp, Artificial Sequence
  chemically synthesized
attactgtatccttttctgt

SEQ ID NO: 496617 - DNA, 20 bp, Artificial Sequence
  chemically synthesized
ggaaaatatactatattttt

SEQ ID NO: 496618 - DNA, 20 bp, Artificial Sequence
  chemically synthesized
tatttccagaccaatttcaa

SEQ ID NO: 496619 - DNA, 20 bp, Artificial Sequence
  chemically synthesized
tatagcttactgcagcagag

SEQ ID NO: 496620 - DNA, 20 bp, Artificial Sequence
  chemically synthesized
ggtgggatgtatttcaagtg

SEQ ID NO: 496621 - DNA, 20 bp, Artificial Sequence
  chemically synthesized
agaggtaattataggaaagg

SEQ ID NO: 496622 - DNA, 20 bp, Artificial Sequence
  chemically synthesized
cctataattacctcttccac

SEQ ID NO: 496623 - DNA, 20 bp, Artificial Sequence
  chemically synthesized
aaataatggaaatttaaatt

SEQ ID NO: 496624 - DNA, 20 bp, Artificial Sequence
  chemically synthesized
cactgtcagagagctgaaat

SEQ ID NO: 496625 - DNA, 20 bp, Artificial Sequence
  chemically synthesized
gtgaaatatgtttcctggag

SEQ ID NO: 496626 - DNA, 20 bp, Artificial Sequence
  chemically synthesized
attatgtgaaatatgtttcc

SEQ ID NO: 496627 - DNA, 20 bp, Artificial Sequence
  chemically synthesized
ttatttaacaccagatttta

SEQ ID NO: 496628 - DNA, 20 bp, Artificial Sequence
  chemically synthesized
attgcagatggtagtattat

SEQ ID NO: 496629 - DNA, 20 bp, Artificial Sequence
  chemically synthesized
tagagtcttaccagaaccat

SEQ ID NO: 496630 - DNA, 20 bp, Artificial Sequence
  chemically synthesized
gacctggggggagggggatg

SEQ ID NO: 496631 - DNA, 20 bp, Artificial Sequence
  chemically synthesized
ttccacagacctggggggag

SEQ ID NO: 496632 - DNA, 20 bp, Artificial Sequence
  chemically synthesized
tccccctccccccaggtctg

SEQ ID NO: 496633 - DNA, 20 bp, Artificial Sequence
  chemically synthesized
gtgttagacactgttaggtg

SEQ ID NO: 496634 - DNA, 20 bp, Artificial Sequence
  chemically synthesized
cattttatatcttccaataa

SEQ ID NO: 496635 - DNA, 20 bp, Artificial Sequence
  chemically synthesized
accactcaaattaaagtaaa

SEQ ID NO: 496636 - DNA, 20 bp, Artificial Sequence
  chemically synthesized
tttattcagtttactttaat

SEQ ID NO: 496637 - DNA, 20 bp, Artificial Sequence
  chemically synthesized
agtctaattggggaaagtaa

SEQ ID NO: 496638 - DNA, 20 bp, Artificial Sequence
  chemically synthesized
gatatgtgaatgtttagaaa

SEQ ID NO: 496639 - DNA, 20 bp, Artificial Sequence
  chemically synthesized
ttctaaacattcacatatct

SEQ ID NO: 496640 - DNA, 20 bp, Artificial Sequence
  chemically synthesized
ctgtagagattcaaagatat

SEQ ID NO: 496641 - DNA, 20 bp, Artificial Sequence
  chemically synthesized
acatatctttgaatctctac

SEQ ID NO: 496642 - DNA, 20 bp, Artificial Sequence
  chemically synthesized
tctacaggaatcctggaaaa

SEQ ID NO: 496643 - DNA, 20 bp, Artificial Sequence
  chemically synthesized
tgcaaaatgatcctcttttc

SEQ ID NO: 496644 - DNA, 20 bp, Artificial Sequence
  chemically synthesized
tgcagaaaaaaaacataggc

SEQ ID NO: 496645 - DNA, 20 bp, Artificial Sequence
  chemically synthesized
ccttgtcccaaaggtacagc

SEQ ID NO: 496646 - DNA, 20 bp, Artificial Sequence
  chemically synthesized
cccaaaggtacagccagagt

SEQ ID NO: 496647 - DNA, 20 bp, Artificial Sequence
  chemically synthesized
atgtttggaattagactgac

SEQ ID NO: 496648 - DNA, 20 bp, Artificial Sequence
  chemically synthesized
ttgaggaaaagatctatgtt

SEQ ID NO: 496649 - DNA, 20 bp, Artificial Sequence
  chemically synthesized
aatattgtgagtaagttggc

SEQ ID NO: 496650 - DNA, 20 bp, Artificial Sequence
  chemically synthesized
tctaggctactgataatatt

SEQ ID NO: 496651 - DNA, 20 bp, Artificial Sequence
  chemically synthesized
ttgttcacagttggcattta

SEQ ID NO: 496652 - DNA, 20 bp, Artificial Sequence
  chemically synthesized
acaagtgaagcctttaagac

SEQ ID NO: 496653 - DNA, 20 bp, Artificial Sequence
  chemically synthesized
tcagtttactcagtacccac

SEQ ID NO: 496654 - DNA, 20 bp, Artificial Sequence
  chemically synthesized
agcattcattcaggtgggta

SEQ ID NO: 496655 - DNA, 20 bp, Artificial Sequence
  chemically synthesized
tttactcagtacccacctga

SEQ ID NO: 496656 - DNA, 20 bp, Artificial Sequence
  chemically synthesized
tcttcaaagcattcattcag

SEQ ID NO: 496657 - DNA, 20 bp, Artificial Sequence
  chemically synthesized
ttaatcagctaagtaaatgt

SEQ ID NO: 496658 - DNA, 20 bp, Artificial Sequence
  chemically synthesized
cttaaatgagtagatcagag

SEQ ID NO: 496659 - DNA, 20 bp, Artificial Sequence
  chemically synthesized
atggtaattgtttgacttaa

SEQ ID NO: 496660 - DNA, 20 bp, Artificial Sequence
  chemically synthesized
attaaagaaaacataatttt

SEQ ID NO: 496661 - DNA, 20 bp, Artificial Sequence
  chemically synthesized
aattatgttttctttaatta

SEQ ID NO: 496662 - DNA, 20 bp, Artificial Sequence
  chemically synthesized
tgttttctttaattattgaa

SEQ ID NO: 496663 - DNA, 20 bp, Artificial Sequence
  chemically synthesized
gcatgtgtgtatttggacta

SEQ ID NO: 496664 - DNA, 20 bp, Artificial Sequence
  chemically synthesized
tatatgtatgtatacataga

SEQ ID NO: 496665 - DNA, 20 bp, Artificial Sequence
  chemically synthesized
gtcatctccatcttgtcagt

SEQ ID NO: 496666 - DNA, 20 bp, Artificial Sequence
  chemically synthesized
ttacagactgtacttgtatc

SEQ ID NO: 496667 - DNA, 20 bp, Artificial Sequence
  chemically synthesized
tgtttaaatatctttttaaa

SEQ ID NO: 496668 - DNA, 20 bp, Artificial Sequence
  chemically synthesized
tctttttaaactgagtgtgc

SEQ ID NO: 496669 - DNA, 20 bp, Artificial Sequence
  chemically synthesized
tttaagtagcatcaggctgt

SEQ ID NO: 496670 - DNA, 20 bp, Artificial Sequence
  chemically synthesized
gatacagaagcaagaatgtt

SEQ ID NO: 496671 - DNA, 20 bp, Artificial Sequence
  chemically synthesized
tttttaggggatacagaagc

SEQ ID NO: 496672 - DNA, 20 bp, Artificial Sequence
  chemically synthesized
atttttcaagagtcttttta

SEQ ID NO: 496673 - DNA, 20 bp, Artificial Sequence
  chemically synthesized
cctaaaaagactcttgaaaa

SEQ ID NO: 496674 - DNA, 20 bp, Artificial Sequence
  chemically synthesized
caagggttgactcatttttc

SEQ ID NO: 496675 - DNA, 20 bp, Artificial Sequence
  chemically synthesized
aatgcggattttaaatctgc

SEQ ID NO: 496676 - DNA, 20 bp, Artificial Sequence
  chemically synthesized
atgaaaagtacatttcgaat

SEQ ID NO: 496677 - DNA, 20 bp, Artificial Sequence
  chemically synthesized
ttaagaatgaaaagtacatt

SEQ ID NO: 496678 - DNA, 20 bp, Artificial Sequence
  chemically synthesized
tatattattttcagtcattt

SEQ ID NO: 496679 - DNA, 20 bp, Artificial Sequence
  chemically synthesized
ttaaacagtatgtatacaca

SEQ ID NO: 496680 - DNA, 20 bp, Artificial Sequence
  chemically synthesized
aaaatacatctcttaataag

SEQ ID NO: 496681 - DNA, 20 bp, Artificial Sequence
  chemically synthesized
tacatctcttaataagatgg

SEQ ID NO: 496682 - DNA, 20 bp, Artificial Sequence
  chemically synthesized
aacaatttatacaccttcag

SEQ ID NO: 496683 - DNA, 20 bp, Artificial Sequence
  chemically synthesized
tgctgaagcctttccaattg

SEQ ID NO: 496684 - DNA, 20 bp, Artificial Sequence
  chemically synthesized
atacagacaaaaattaggga

SEQ ID NO: 496685 - DNA, 20 bp, Artificial Sequence
  chemically synthesized
catctatacagacaaaaatt

SEQ ID NO: 496686 - DNA, 20 bp, Artificial Sequence
  chemically synthesized
gaaaaatcttattcaaatag

SEQ ID NO: 496687 - DNA, 20 bp, Artificial Sequence
  chemically synthesized
gtttctttctactcacctat

SEQ ID NO: 496688 - DNA, 20 bp, Artificial Sequence
  chemically synthesized
ggtgagtagaaagaaacgga

SEQ ID NO: 496689 - DNA, 20 bp, Artificial Sequence
  chemically synthesized
caacttatcaggtcttctct

SEQ ID NO: 496690 - DNA, 20 bp, Artificial Sequence
  chemically synthesized
ttcgggttcagttgaaagca

SEQ ID NO: 496691 - DNA, 20 bp, Artificial Sequence
  chemically synthesized
gcaacatagctttttgcaag

SEQ ID NO: 496692 - DNA, 20 bp, Artificial Sequence
  chemically synthesized
aggcttcaaacaaaagaagc

SEQ ID NO: 496693 - DNA, 20 bp, Artificial Sequence
  chemically synthesized
gtttgaagccttagtaagat

SEQ ID NO: 496694 - DNA, 20 bp, Artificial Sequence
  chemically synthesized
aagccttagtaagatcagag

SEQ ID NO: 496695 - DNA, 20 bp, Artificial Sequence
  chemically synthesized
ttttgtactcttcctgaaaa

SEQ ID NO: 496696 - DNA, 20 bp, Artificial Sequence
  chemically synthesized
caggcaattcagttttcagg

SEQ ID NO: 496697 - DNA, 20 bp, Artificial Sequence
  chemically synthesized
gtaggcacagatagttttaa

SEQ ID NO: 496698 - DNA, 20 bp, Artificial Sequence
  chemically synthesized
aactatctgtgcctactcct

SEQ ID NO: 496699 - DNA, 20 bp, Artificial Sequence
  chemically synthesized
gagtacatgaaggcattcca

SEQ ID NO: 496700 - DNA, 20 bp, Artificial Sequence
  chemically synthesized
tcctcacagtggagtaacct

SEQ ID NO: 496701 - DNA, 20 bp, Artificial Sequence
  chemically synthesized
taaaacagctgtcctcacag

SEQ ID NO: 496702 - DNA, 20 bp, Artificial Sequence
  chemically synthesized
gacagctgttttaagaaatt

SEQ ID NO: 496703 - DNA, 20 bp, Artificial Sequence
  chemically synthesized
agaaatataaactggcacat

SEQ ID NO: 496704 - DNA, 20 bp, Artificial Sequence
  chemically synthesized
agccttattggtatttgtgc

SEQ ID NO: 496705 - DNA, 20 bp, Artificial Sequence
  chemically synthesized
aaggtagaaaagagggagtt

SEQ ID NO: 496706 - DNA, 20 bp, Artificial Sequence
  chemically synthesized
agcctagaaggtagaaaaga

SEQ ID NO: 496707 - DNA, 20 bp, Artificial Sequence
  chemically synthesized
tcttttctaccttctaggct

SEQ ID NO: 496708 - DNA, 20 bp, Artificial Sequence
  chemically synthesized
tcccacatagtgtagattca

SEQ ID NO: 496709 - DNA, 20 bp, Artificial Sequence
  chemically synthesized
ctgtttggctccctcattca

SEQ ID NO: 496710 - DNA, 20 bp, Artificial Sequence
  chemically synthesized
aggcaagtttctcaaccttc

SEQ ID NO: 496711 - DNA, 20 bp, Artificial Sequence
  chemically synthesized
gtcgaaggtgcagccagact

SEQ ID NO: 496712 - DNA, 20 bp, Artificial Sequence
  chemically synthesized
atctctttaaagatctttgt

SEQ ID NO: 496713 - DNA, 20 bp, Artificial Sequence
  chemically synthesized
gttgtccaagcatcgccccc

SEQ ID NO: 496714 - DNA, 20 bp, Artificial Sequence
  chemically synthesized
caagcatcgcccccaggaat

SEQ ID NO: 496715 - DNA, 20 bp, Artificial Sequence
  chemically synthesized
cttcactttagaattaagca

SEQ ID NO: 496716 - DNA, 20 bp, Artificial Sequence
  chemically synthesized
ttcctgttttgccttcactt

SEQ ID NO: 496717 - DNA, 20 bp, Artificial Sequence
  chemically synthesized
aaaacaggaaaagtcaaagt

SEQ ID NO: 496718 - DNA, 20 bp, Artificial Sequence
  chemically synthesized
tatattttttgaaagactat

SEQ ID NO: 496719 - DNA, 20 bp, Artificial Sequence
  chemically synthesized
attatacttctaaagaaaaa

SEQ ID NO: 496720 - DNA, 20 bp, Artificial Sequence
  chemically synthesized
aaagaaaaattgaatgctac

SEQ ID NO: 496721 - DNA, 20 bp, Artificial Sequence
  chemically synthesized
ctttgcatcgtttttgaaca

SEQ ID NO: 496722 - DNA, 20 bp, Artificial Sequence
  chemically synthesized
aaaacttttatttaaaaaaa

SEQ ID NO: 496723 - DNA, 20 bp, Artificial Sequence
  chemically synthesized
ttttccatgctatacacttt

SEQ ID NO: 496724 - DNA, 20 bp, Artificial Sequence
  chemically synthesized
tgtctctgtgctatacatta

SEQ ID NO: 496725 - DNA, 20 bp, Artificial Sequence
  chemically synthesized
atgataaacaacacaaattt

SEQ ID NO: 496726 - DNA, 20 bp, Artificial Sequence
  chemically synthesized
acattctgctacatgaaatg

SEQ ID NO: 496727 - DNA, 20 bp, Artificial Sequence
  chemically synthesized
taattccacatttcatgtag

SEQ ID NO: 496728 - DNA, 20 bp, Artificial Sequence
  chemically synthesized
ccttctggatctcaaaatga

SEQ ID NO: 496729 - DNA, 20 bp, Artificial Sequence
  chemically synthesized
tgtgcaacccttttgtcctt

SEQ ID NO: 496730 - DNA, 20 bp, Artificial Sequence
  chemically synthesized
tttgagatccagaaggacaa

SEQ ID NO: 496731 - DNA, 20 bp, Artificial Sequence
  chemically synthesized
gcctctcggagatcttaaaa

SEQ ID NO: 496732 - DNA, 20 bp, Artificial Sequence
  chemically synthesized
gataaacaattaattctacc

SEQ ID NO: 496733 - DNA, 20 bp, Artificial Sequence
  chemically synthesized
attttcattggtatcctggg

SEQ ID NO: 496734 - DNA, 20 bp, Artificial Sequence
  chemically synthesized
aatagattttcattggtatc

SEQ ID NO: 496735 - DNA, 20 bp, Artificial Sequence
  chemically synthesized
tcagaggggaattttctttc

SEQ ID NO: 496736 - DNA, 20 bp, Artificial Sequence
  chemically synthesized
aaagaaaattcccctctgaa

SEQ ID NO: 496737 - DNA, 20 bp, Artificial Sequence
  chemically synthesized
aaaaattattcacttcagag

SEQ ID NO: 496738 - DNA, 20 bp, Artificial Sequence
  chemically synthesized
atacactcattttttttctt

SEQ ID NO: 496739 - DNA, 20 bp, Artificial Sequence
  chemically synthesized
tcacactcgtaagaaaaaaa

SEQ ID NO: 496740 - DNA, 20 bp, Artificial Sequence
  chemically synthesized
atggactgaaatggatagag

SEQ ID NO: 496741 - DNA, 20 bp, Artificial Sequence
  chemically synthesized
aaaagatggactgaaatgga

SEQ ID NO: 496742 - DNA, 20 bp, Artificial Sequence
  chemically synthesized
ttaagaaaagatggactgaa

SEQ ID NO: 496743 - DNA, 20 bp, Artificial Sequence
  chemically synthesized
cctaacaaaattgaattaca

SEQ ID NO: 496744 - DNA, 20 bp, Artificial Sequence
  chemically synthesized
agttacatttcctaacaaaa

SEQ ID NO: 496745 - DNA, 20 bp, Artificial Sequence
  chemically synthesized
aatatataaagcataaaaca

SEQ ID NO: 496746 - DNA, 20 bp, Artificial Sequence
  chemically synthesized
tcaaaggtggactaaaaatg

SEQ ID NO: 496747 - DNA, 20 bp, Artificial Sequence
  chemically synthesized
tctgcatttttagtccacct

SEQ ID NO: 496748 - DNA, 20 bp, Artificial Sequence
  chemically synthesized
gctaaaaaaatcttagccag

SEQ ID NO: 496749 - DNA, 20 bp, Artificial Sequence
  chemically synthesized
gttcaaatcaaatggaaaac

SEQ ID NO: 496750 - DNA, 20 bp, Artificial Sequence
  chemically synthesized
atgtacattatttcagcatg

SEQ ID NO: 496751 - DNA, 20 bp, Artificial Sequence
  chemically synthesized
tgtgcattggggaggttttg

SEQ ID NO: 496752 - DNA, 20 bp, Artificial Sequence
  chemically synthesized
ctgtagtttgatttatttgt

SEQ ID NO: 496753 - DNA, 20 bp, Artificial Sequence
  chemically synthesized
tattggaaagtaactaaaat

SEQ ID NO: 496754 - DNA, 20 bp, Artificial Sequence
  chemically synthesized
aaatggaccttttatgaacg

SEQ ID NO: 496755 - DNA, 20 bp, Artificial Sequence
  chemically synthesized
aatttctggcaggtggggaa

SEQ ID NO: 496756 - DNA, 20 bp, Artificial Sequence
  chemically synthesized
atttgctttgctttcataca

SEQ ID NO: 496757 - DNA, 20 bp, Artificial Sequence
  chemically synthesized
atatcagcagatgtggttct

SEQ ID NO: 496758 - DNA, 20 bp, Artificial Sequence
  chemically synthesized
atagtcattaatgtaaatgt

SEQ ID NO: 496759 - DNA, 20 bp, Artificial Sequence
  chemically synthesized
tacattaatgactatctaaa

SEQ ID NO: 496760 - DNA, 20 bp, Artificial Sequence
  chemically synthesized
gcttcagattattttttttc

SEQ ID NO: 496761 - DNA, 20 bp, Artificial Sequence
  chemically synthesized
accttcacacttccgagaca

SEQ ID NO: 496762 - DNA, 20 bp, Artificial Sequence
  chemically synthesized
tgtgggaaaaatgaagggac

SEQ ID NO: 496763 - DNA, 20 bp, Artificial Sequence
  chemically synthesized
acaagagtaggaaggtcatt

SEQ ID NO: 496764 - DNA, 20 bp, Artificial Sequence
  chemically synthesized
aggaaggtcattcagggtca

SEQ ID NO: 496765 - DNA, 20 bp, Artificial Sequence
  chemically synthesized
tagaaatgtattcagtgacc

SEQ ID NO: 496766 - DNA, 20 bp, Artificial Sequence
  chemically synthesized
agggatatgagatgttggaa

SEQ ID NO: 496767 - DNA, 20 bp, Artificial Sequence
  chemically synthesized
ctccaactttctggggggac

SEQ ID NO: 496768 - DNA, 20 bp, Artificial Sequence
  chemically synthesized
tccctgtccccccagaaagt

SEQ ID NO: 496769 - DNA, 20 bp, Artificial Sequence
  chemically synthesized
cccttctgagaacagtgttc

SEQ ID NO: 496770 - DNA, 20 bp, Artificial Sequence
  chemically synthesized
ttcatcacaatatgctgtct

SEQ ID NO: 496771 - DNA, 20 bp, Artificial Sequence
  chemically synthesized
tcttggaggctttatattaa

SEQ ID NO: 496772 - DNA, 20 bp, Artificial Sequence
  chemically synthesized
ttggtttaaaaaattaggtt

SEQ ID NO: 496773 - DNA, 20 bp, Artificial Sequence
  chemically synthesized
ctaattttttaaaccaaaac

SEQ ID NO: 496774 - DNA, 20 bp, Artificial Sequence
  chemically synthesized
cgttttcccatcttttctcc

SEQ ID NO: 496775 - DNA, 20 bp, Artificial Sequence
  chemically synthesized
atttacattttgtggcaaac

SEQ ID NO: 496776 - DNA, 20 bp, Artificial Sequence
  chemically synthesized
gtatttcagtaaatgttcta

SEQ ID NO: 496777 - DNA, 20 bp, Artificial Sequence
  chemically synthesized
atacctttctggtaatgata

SEQ ID NO: 496778 - DNA, 20 bp, Artificial Sequence
  chemically synthesized
taataataacaatatgtaag

SEQ ID NO: 496779 - DNA, 20 bp, Artificial Sequence
  chemically synthesized
accaagttttaaaatatata

SEQ ID NO: 496780 - DNA, 20 bp, Artificial Sequence
  chemically synthesized
taaaacataaaattggcaga

SEQ ID NO: 496781 - DNA, 20 bp, Artificial Sequence
  chemically synthesized
cactttcctttattgtttat

SEQ ID NO: 496782 - DNA, 20 bp, Artificial Sequence
  chemically synthesized
atagttaaacttataggtac

SEQ ID NO: 496783 - DNA, 20 bp, Artificial Sequence
  chemically synthesized
attggatattttagttctgt

SEQ ID NO: 496784 - DNA, 20 bp, Artificial Sequence
  chemically synthesized
actaaaatatccaatcttat

SEQ ID NO: 496785 - DNA, 20 bp, Artificial Sequence
  chemically synthesized
aggaaaacatccaaataaga

SEQ ID NO: 496786 - DNA, 20 bp, Artificial Sequence
  chemically synthesized
tgggttagtggtttacaagt

SEQ ID NO: 496787 - DNA, 20 bp, Artificial Sequence
  chemically synthesized
gctggcataaggctagagaa

SEQ ID NO: 496788 - DNA, 20 bp, Artificial Sequence
  chemically synthesized
gaatttaatacagttataat

SEQ ID NO: 496789 - DNA, 20 bp, Artificial Sequence
  chemically synthesized
aataccagccaagttaacat

SEQ ID NO: 496790 - DNA, 20 bp, Artificial Sequence
  chemically synthesized
ttgactacgtaggattgttt

SEQ ID NO: 496791 - DNA, 20 bp, Artificial Sequence
  chemically synthesized
aaaagcaaaaattgactacg

SEQ ID NO: 496792 - DNA, 20 bp, Artificial Sequence
  chemically synthesized
atttttatgcttttcaccta

SEQ ID NO: 496793 - DNA, 20 bp, Artificial Sequence
  chemically synthesized
tgacaatgtataaattaagg

SEQ ID NO: 496794 - DNA, 20 bp, Artificial Sequence
  chemically synthesized
atttatacattgtcatcagt

SEQ ID NO: 496795 - DNA, 20 bp, Artificial Sequence
  chemically synthesized
ttgcatttatagtcattaat

SEQ ID NO: 496796 - DNA, 20 bp, Artificial Sequence
  chemically synthesized
aataattttaaaaatacttt

SEQ ID NO: 496797 - DNA, 20 bp, Artificial Sequence
  chemically synthesized
ttatttcacagattttaaaa

SEQ ID NO: 496798 - DNA, 20 bp, Artificial Sequence
  chemically synthesized
gaagaaaaattattgttaaa

SEQ ID NO: 496799 - DNA, 20 bp, Artificial Sequence
  chemically synthesized
tgacaatggtgcttctttac

SEQ ID NO: 496800 - DNA, 20 bp, Artificial Sequence
  chemically synthesized
tgcttccaatgccacaactg

SEQ ID NO: 496801 - DNA, 20 bp, Artificial Sequence
  chemically synthesized
tgcgtagtaaaaggaaggag

SEQ ID NO: 496802 - DNA, 20 bp, Artificial Sequence
  chemically synthesized
ctacgcagcaggcatacttc

SEQ ID NO: 496803 - DNA, 20 bp, Artificial Sequence
  chemically synthesized
ctttccagccccatttcaca

SEQ ID NO: 496804 - DNA, 20 bp, Artificial Sequence
  chemically synthesized
acattggataaaactgaggc

SEQ ID NO: 496805 - DNA, 20 bp, Artificial Sequence
  chemically synthesized
agtcacctgccaaaggtcac

SEQ ID NO: 496806 - DNA, 20 bp, Artificial Sequence
  chemically synthesized
tgaactcatagttaggcttt

SEQ ID NO: 496807 - DNA, 20 bp, Artificial Sequence
  chemically synthesized
ttgaccccaaaagcctaact

SEQ ID NO: 496808 - DNA, 20 bp, Artificial Sequence
  chemically synthesized
tgctatgggaccaaagatga

SEQ ID NO: 496809 - DNA, 20 bp, Artificial Sequence
  chemically synthesized
ttttattatactttaagttc

SEQ ID NO: 496810 - DNA, 20 bp, Artificial Sequence
  chemically synthesized
tagaccagtgattttcaact

SEQ ID NO: 496811 - DNA, 20 bp, Artificial Sequence
  chemically synthesized
acaaatttgtgattaaagaa

SEQ ID NO: 496812 - DNA, 20 bp, Artificial Sequence
  chemically synthesized
gtggactgccctgtccacta

SEQ ID NO: 496813 - DNA, 20 bp, Artificial Sequence
  chemically synthesized
tctagtggtgaaagcagtga

SEQ ID NO: 496814 - DNA, 20 bp, Artificial Sequence
  chemically synthesized
tcagtctagtggtgaaagca

SEQ ID NO: 496815 - DNA, 20 bp, Artificial Sequence
  chemically synthesized
aaaacatatgtggtctctga

SEQ ID NO: 496816 - DNA, 20 bp, Artificial Sequence
  chemically synthesized
actcactaagcttatactta

SEQ ID NO: 496817 - DNA, 20 bp, Artificial Sequence
  chemically synthesized
actcattaagtataagctta

SEQ ID NO: 496818 - DNA, 20 bp, Artificial Sequence
  chemically synthesized
attaagtataagcttagtga

SEQ ID NO: 496819 - DNA, 20 bp, Artificial Sequence
  chemically synthesized
ataagcttagtgagtgaata

SEQ ID NO: 496820 - DNA, 20 bp, Artificial Sequence
  chemically synthesized
gtgtatacatgggacttgtc

SEQ ID NO: 496821 - DNA, 20 bp, Artificial Sequence
  chemically synthesized
aaattttaaatatggttagc

SEQ ID NO: 496822 - DNA, 20 bp, Artificial Sequence
  chemically synthesized
ctcttaaagaacttataact

SEQ ID NO: 496823 - DNA, 20 bp, Artificial Sequence
  chemically synthesized
ttgtgaaaaaagcccaactg

SEQ ID NO: 496824 - DNA, 20 bp, Artificial Sequence
  chemically synthesized
actatcaaaacctgaagatt

SEQ ID NO: 496825 - DNA, 20 bp, Artificial Sequence
  chemically synthesized
ccagttaaaacatctttaac

SEQ ID NO: 496826 - DNA, 20 bp, Artificial Sequence
  chemically synthesized
gagccagccctacctactta

SEQ ID NO: 496827 - DNA, 20 bp, Artificial Sequence
  chemically synthesized
ctaggcaagcacctgaagta

SEQ ID NO: 496828 - DNA, 20 bp, Artificial Sequence
  chemically synthesized
tgccttccttttcttacctt

SEQ ID NO: 496829 - DNA, 20 bp, Artificial Sequence
  chemically synthesized
gaagatgggattgggagaaa

SEQ ID NO: 496830 - DNA, 20 bp, Artificial Sequence
  chemically synthesized
gagaggtacagagcagaaga

SEQ ID NO: 496831 - DNA, 20 bp, Artificial Sequence
  chemically synthesized
tcttgttgggaaataagact

SEQ ID NO: 496832 - DNA, 20 bp, Artificial Sequence
  chemically synthesized
tgttctaagagtctgtgatt

SEQ ID NO: 496833 - DNA, 20 bp, Artificial Sequence
  chemically synthesized
ttaaagtcctgttgtgttct

SEQ ID NO: 496834 - DNA, 20 bp, Artificial Sequence
  chemically synthesized
catgggaatttgtttatcag

SEQ ID NO: 496835 - DNA, 20 bp, Artificial Sequence
  chemically synthesized
gggacctgggagttatacat

SEQ ID NO: 496836 - DNA, 20 bp, Artificial Sequence
  chemically synthesized
ataatgaaaaattgggacct

SEQ ID NO: 496837 - DNA, 20 bp, Artificial Sequence
  chemically synthesized
gatatttagatggctttttg

SEQ ID NO: 496838 - DNA, 20 bp, Artificial Sequence
  chemically synthesized
tctcgatagaagctaaagtg

SEQ ID NO: 496839 - DNA, 20 bp, Artificial Sequence
  chemically synthesized
tcgagagactgtgtacctct

SEQ ID NO: 496840 - DNA, 20 bp, Artificial Sequence
  chemically synthesized
cacaaaaatttaaacttgtg

SEQ ID NO: 496841 - DNA, 20 bp, Artificial Sequence
  chemically synthesized
tctcgctgttccttcatgta

SEQ ID NO: 496842 - DNA, 20 bp, Artificial Sequence
  chemically synthesized
tcattacatgaaggaacagc

SEQ ID NO: 496843 - DNA, 20 bp, Artificial Sequence
  chemically synthesized
tgaaggaacagcgagaataa

SEQ ID NO: 496844 - DNA, 20 bp, Artificial Sequence
  chemically synthesized
acctagcatagctcctggca

SEQ ID NO: 496845 - DNA, 20 bp, Artificial Sequence
  chemically synthesized
ttataagcagcaagagggaa

SEQ ID NO: 496846 - DNA, 20 bp, Artificial Sequence
  chemically synthesized
attgtccctcagtatccatg

SEQ ID NO: 496847 - DNA, 20 bp, Artificial Sequence
  chemically synthesized
gatcctggaaccaatccccc

SEQ ID NO: 496848 - DNA, 20 bp, Artificial Sequence
  chemically synthesized
tatccatgggggattggttc

SEQ ID NO: 496849 - DNA, 20 bp, Artificial Sequence
  chemically synthesized
ggattggttccaggatcccc

SEQ ID NO: 496850 - DNA, 20 bp, Artificial Sequence
  chemically synthesized
tttgtggatttgctatccgt

SEQ ID NO: 496851 - DNA, 20 bp, Artificial Sequence
  chemically synthesized
tatatgtcacttgaacattt

SEQ ID NO: 496852 - DNA, 20 bp, Artificial Sequence
  chemically synthesized
agatgttttaaagtatatag

SEQ ID NO: 496853 - DNA, 20 bp, Artificial Sequence
  chemically synthesized
ttattacattgtactgttta

SEQ ID NO: 496854 - DNA, 20 bp, Artificial Sequence
  chemically synthesized
ggtaggcattcattgttttt

SEQ ID NO: 496855 - DNA, 20 bp, Artificial Sequence
  chemically synthesized
caaaaatattcagaaaaaca

SEQ ID NO: 496856 - DNA, 20 bp, Artificial Sequence
  chemically synthesized
tattcttggattacaaatct

SEQ ID NO: 496857 - DNA, 20 bp, Artificial Sequence
  chemically synthesized
cattcacagatttgtaatcc

SEQ ID NO: 496858 - DNA, 20 bp, Artificial Sequence
  chemically synthesized
tacaggggctcttcatattc

SEQ ID NO: 496859 - DNA, 20 bp, Artificial Sequence
  chemically synthesized
atgcatgtttgggtcattgt

SEQ ID NO: 496860 - DNA, 20 bp, Artificial Sequence
  chemically synthesized
tttaaggtgaaaatgcatgt

SEQ ID NO: 496861 - DNA, 20 bp, Artificial Sequence
  chemically synthesized
attgcacaggtattcttaac

SEQ ID NO: 496862 - DNA, 20 bp, Artificial Sequence
  chemically synthesized
ccagacccggcatccatgtt

SEQ ID NO: 496863 - DNA, 20 bp, Artificial Sequence
  chemically synthesized
aggtattcttaacatggatg

SEQ ID NO: 496864 - DNA, 20 bp, Artificial Sequence
  chemically synthesized
tgccgggtctgggcctcaag

SEQ ID NO: 496865 - DNA, 20 bp, Artificial Sequence
  chemically synthesized
cctcatagagtgaaggaacc

SEQ ID NO: 496866 - DNA, 20 bp, Artificial Sequence
  chemically synthesized
tgggtatcatacctccctca

SEQ ID NO: 496867 - DNA, 20 bp, Artificial Sequence
  chemically synthesized
tgcatacttggctttgagtc

SEQ ID NO: 496868 - DNA, 20 bp, Artificial Sequence
  chemically synthesized
aagactatgcatacttggct

SEQ ID NO: 496869 - DNA, 20 bp, Artificial Sequence
  chemically synthesized
gcatggtgtcagaaggaact

SEQ ID NO: 496870 - DNA, 20 bp, Artificial Sequence
  chemically synthesized
ccatgctttctaccacaggc

SEQ ID NO: 496871 - DNA, 20 bp, Artificial Sequence
  chemically synthesized
ctggatctttatggctgact

SEQ ID NO: 496872 - DNA, 20 bp, Artificial Sequence
  chemically synthesized
tcagccataaagatccagaa

SEQ ID NO: 496873 - DNA, 20 bp, Artificial Sequence
  chemically synthesized
gatgtatgttttactcattt

SEQ ID NO: 496874 - DNA, 20 bp, Artificial Sequence
  chemically synthesized
gttgccaatatgaaatgaaa

SEQ ID NO: 496875 - DNA, 20 bp, Artificial Sequence
  chemically synthesized
aatgaagtctgaattgagtt

SEQ ID NO: 496876 - DNA, 20 bp, Artificial Sequence
  chemically synthesized
aggtagaaatgaagtctgaa

SEQ ID NO: 496877 - DNA, 20 bp, Artificial Sequence
  chemically synthesized
cacataggtagaaatgaagt

SEQ ID NO: 496878 - DNA, 20 bp, Artificial Sequence
  chemically synthesized
agacttcatttctacctatg

SEQ ID NO: 496879 - DNA, 20 bp, Artificial Sequence
  chemically synthesized
gccatgtacctaactcttaa

SEQ ID NO: 496880 - DNA, 20 bp, Artificial Sequence
  chemically synthesized
gcatttgaggatatccactt

SEQ ID NO: 496881 - DNA, 20 bp, Artificial Sequence
  chemically synthesized
ttaaatggatatttgcattt

SEQ ID NO: 496882 - DNA, 20 bp, Artificial Sequence
  chemically synthesized
gtaattcttgtatattttaa

SEQ ID NO: 496883 - DNA, 20 bp, Artificial Sequence
  chemically synthesized
aatatccatttaaaatatac

SEQ ID NO: 496884 - DNA, 20 bp, Artificial Sequence
  chemically synthesized
cgcccagtggcctttagact

SEQ ID NO: 496885 - DNA, 20 bp, Artificial Sequence
  chemically synthesized
catgccagttaacatatatc

SEQ ID NO: 496886 - DNA, 20 bp, Artificial Sequence
  chemically synthesized
gttaactggcatggctactt

SEQ ID NO: 496887 - DNA, 20 bp, Artificial Sequence
  chemically synthesized
ggccattatggtttacatat

SEQ ID NO: 496888 - DNA, 20 bp, Artificial Sequence
  chemically synthesized
tgtgtaccgcaggctgttct

SEQ ID NO: 496889 - DNA, 20 bp, Artificial Sequence
  chemically synthesized
ttttatttttctgattaaac

SEQ ID NO: 496890 - DNA, 20 bp, Artificial Sequence
  chemically synthesized
tgattaaacatggatatcat

SEQ ID NO: 496891 - DNA, 20 bp, Artificial Sequence
  chemically synthesized
caggccccacctccaacact

SEQ ID NO: 496892 - DNA, 20 bp, Artificial Sequence
  chemically synthesized
tggggcctggtgggaggtga

SEQ ID NO: 496893 - DNA, 20 bp, Artificial Sequence
  chemically synthesized
gaggtgactggatcatgtgt

SEQ ID NO: 496894 - DNA, 20 bp, Artificial Sequence
  chemically synthesized
atcatgtgtgtggatttctc

SEQ ID NO: 496895 - DNA, 20 bp, Artificial Sequence
  chemically synthesized
catcatgaggatggcaccaa

SEQ ID NO: 496896 - DNA, 20 bp, Artificial Sequence
  chemically synthesized
ttggtgccatcctcatgatg

SEQ ID NO: 496897 - DNA, 20 bp, Artificial Sequence
  chemically synthesized
gagaactcactcatcatcat

SEQ ID NO: 496898 - DNA, 20 bp, Artificial Sequence
  chemically synthesized
tgccatcctcatgatgatga

SEQ ID NO: 496899 - DNA, 20 bp, Artificial Sequence
  chemically synthesized
tagagcaggagcaagagaga

SEQ ID NO: 496900 - DNA, 20 bp, Artificial Sequence
  chemically synthesized
gaaatacctgagactgggta

SEQ ID NO: 496901 - DNA, 20 bp, Artificial Sequence
  chemically synthesized
ctataaagaaatacctgaga

SEQ ID NO: 496902 - DNA, 20 bp, Artificial Sequence
  chemically synthesized
ataacacaacacacagacac

SEQ ID NO: 496903 - DNA, 20 bp, Artificial Sequence
  chemically synthesized
attgttttaattagtgtatt

SEQ ID NO: 496904 - DNA, 20 bp, Artificial Sequence
  chemically synthesized
aaacatgcccatgtaatttt

SEQ ID NO: 496905 - DNA, 20 bp, Artificial Sequence
  chemically synthesized
tgtctttcgtatatcctttc

SEQ ID NO: 496906 - DNA, 20 bp, Artificial Sequence
  chemically synthesized
aatgaacgtccaatccctga

SEQ ID NO: 496907 - DNA, 20 bp, Artificial Sequence
  chemically synthesized
acaatatataagaggtatgt

SEQ ID NO: 496908 - DNA, 20 bp, Artificial Sequence
  chemically synthesized
gcacttgggatcgatttatt

SEQ ID NO: 496909 - DNA, 20 bp, Artificial Sequence
  chemically synthesized
gttatttgctttctggcact

SEQ ID NO: 496910 - DNA, 20 bp, Artificial Sequence
  chemically synthesized
ttctaaatgtgcaaaaaata

SEQ ID NO: 496911 - DNA, 20 bp, Artificial Sequence
  chemically synthesized
ccctttattttttgcacatt

SEQ ID NO: 496912 - DNA, 20 bp, Artificial Sequence
  chemically synthesized
gagggagacggtaggtatta

SEQ ID NO: 496913 - DNA, 20 bp, Artificial Sequence
  chemically synthesized
gaacaagttgggatgtcaaa

SEQ ID NO: 496914 - DNA, 20 bp, Artificial Sequence
  chemically synthesized
catcacagactagaacaagt

SEQ ID NO: 496915 - DNA, 20 bp, Artificial Sequence
  chemically synthesized
caacttgttctagtctgtga

SEQ ID NO: 496916 - DNA, 20 bp, Artificial Sequence
  chemically synthesized
gggtctttaacctggcatct

SEQ ID NO: 496917 - DNA, 20 bp, Artificial Sequence
  chemically synthesized
tttaacctggcatctgtgga

SEQ ID NO: 496918 - DNA, 20 bp, Artificial Sequence
  chemically synthesized
gatgggattaagggaggtcc

SEQ ID NO: 496919 - DNA, 20 bp, Artificial Sequence
  chemically synthesized
aagggaggtcccaggatcgc

SEQ ID NO: 496920 - DNA, 20 bp, Artificial Sequence
  chemically synthesized
aaggtaaatacctttgcgtt

SEQ ID NO: 496921 - DNA, 20 bp, Artificial Sequence
  chemically synthesized
aataatcttccactgtgaaa

SEQ ID NO: 496922 - DNA, 20 bp, Artificial Sequence
  chemically synthesized
tcaatgatgtgggtatgttg

SEQ ID NO: 496923 - DNA, 20 bp, Artificial Sequence
  chemically synthesized
gtctaccaattatcaatgat

SEQ ID NO: 496924 - DNA, 20 bp, Artificial Sequence
  chemically synthesized
tcattgataattggtagaca

SEQ ID NO: 496925 - DNA, 20 bp, Artificial Sequence
  chemically synthesized
gttgaagcaagcatgtgttt

SEQ ID NO: 496926 - DNA, 20 bp, Artificial Sequence
  chemically synthesized
tcatattatgcagccttctt

SEQ ID NO: 496927 - DNA, 20 bp, Artificial Sequence
  chemically synthesized
aaaactatcatacatcaatg

SEQ ID NO: 496928 - DNA, 20 bp, Artificial Sequence
  chemically synthesized
tcatacatcaatgatggata

SEQ ID NO: 496929 - DNA, 20 bp, Artificial Sequence
  chemically synthesized
ggatacagaattaatctcat

SEQ ID NO: 496930 - DNA, 20 bp, Artificial Sequence
  chemically synthesized
catttgaatcaaatctttaa

SEQ ID NO: 496931 - DNA, 20 bp, Artificial Sequence
  chemically synthesized
aagtgcaaaagtctaagtgt

SEQ ID NO: 496932 - DNA, 20 bp, Artificial Sequence
  chemically synthesized
gcaaaagtctaagtgtttgg

SEQ ID NO: 496933 - DNA, 20 bp, Artificial Sequence
  chemically synthesized
ggatggatgtgttttgacaa

SEQ ID NO: 496934 - DNA, 20 bp, Artificial Sequence
  chemically synthesized
ttgtctattttgttcaggtg

SEQ ID NO: 496935 - DNA, 20 bp, Artificial Sequence
  chemically synthesized
agaggcattagtgacttttt

SEQ ID NO: 496936 - DNA, 20 bp, Artificial Sequence
  chemically synthesized
cctctgggtgagggttggaa

SEQ ID NO: 496937 - DNA, 20 bp, Artificial Sequence
  chemically synthesized
ggttacctctgggtgagggt

SEQ ID NO: 496938 - DNA, 20 bp, Artificial Sequence
  chemically synthesized
gaaagtggttacctctgggt

SEQ ID NO: 496939 - DNA, 20 bp, Artificial Sequence
  chemically synthesized
aattaagaaagtggttacct

SEQ ID NO: 496940 - DNA, 20 bp, Artificial Sequence
  chemically synthesized
gcaaaactcaattacggtaa

SEQ ID NO: 496941 - DNA, 20 bp, Artificial Sequence
  chemically synthesized
tcttaattctattaccgtaa

SEQ ID NO: 496942 - DNA, 20 bp, Artificial Sequence
  chemically synthesized
caaaagtcatagacacaaat

SEQ ID NO: 496943 - DNA, 20 bp, Artificial Sequence
  chemically synthesized
aaaagcaaccatatgaatga

SEQ ID NO: 496944 - DNA, 20 bp, Artificial Sequence
  chemically synthesized
tggtaaaagcaaccatatga

SEQ ID NO: 496945 - DNA, 20 bp, Artificial Sequence
  chemically synthesized
ccaatggtaaaagcaaccat

SEQ ID NO: 496946 - DNA, 20 bp, Artificial Sequence
  chemically synthesized
ggtttttcctctattcactg

SEQ ID NO: 496947 - DNA, 20 bp, Artificial Sequence
  chemically synthesized
gaatggaattttactcggca

SEQ ID NO: 496948 - DNA, 20 bp, Artificial Sequence
  chemically synthesized
tgcctctgttaaaccatgaa

SEQ ID NO: 496949 - DNA, 20 bp, Artificial Sequence
  chemically synthesized
gttgatgcctctgttaaacc

SEQ ID NO: 496950 - DNA, 20 bp, Artificial Sequence
  chemically synthesized
aggtagtgagggaaggagga

SEQ ID NO: 496951 - DNA, 20 bp, Artificial Sequence
  chemically synthesized
aagagaaaaggaagagcatt

SEQ ID NO: 496952 - DNA, 20 bp, Artificial Sequence
  chemically synthesized
tgtttctctgttcttagacc

SEQ ID NO: 496953 - DNA, 20 bp, Artificial Sequence
  chemically synthesized
cactaatatgattatcctat

SEQ ID NO: 496954 - DNA, 20 bp, Artificial Sequence
  chemically synthesized
tcaacctttctcaatccata

SEQ ID NO: 496955 - DNA, 20 bp, Artificial Sequence
  chemically synthesized
acaatgaattacaacacata

SEQ ID NO: 496956 - DNA, 20 bp, Artificial Sequence
  chemically synthesized
ttattatggcttagaataca

SEQ ID NO: 496957 - DNA, 20 bp, Artificial Sequence
  chemically synthesized
cccaactctttattatggct

SEQ ID NO: 496958 - DNA, 20 bp, Artificial Sequence
  chemically synthesized
ttgtattctaagccataata

SEQ ID NO: 496959 - DNA, 20 bp, Artificial Sequence
  chemically synthesized
ttctaagccataataaagag

SEQ ID NO: 496960 - DNA, 20 bp, Artificial Sequence
  chemically synthesized
ccctcatggatttatcttat

SEQ ID NO: 496961 - DNA, 20 bp, Artificial Sequence
  chemically synthesized
tttctgtgcttaaggccctc

SEQ ID NO: 496962 - DNA, 20 bp, Artificial Sequence
  chemically synthesized
caatcctacaccgcagcaaa

SEQ ID NO: 496963 - DNA, 20 bp, Artificial Sequence
  chemically synthesized
agatccattttgctgcggtg

SEQ ID NO: 496964 - DNA, 20 bp, Artificial Sequence
  chemically synthesized
cattttgctgcggtgtagga

SEQ ID NO: 496965 - DNA, 20 bp, Artificial Sequence
  chemically synthesized
ggtgtaggattgaataggaa

SEQ ID NO: 496966 - DNA, 20 bp, Artificial Sequence
  chemically synthesized
gagaataacaacagtagtaa

SEQ ID NO: 496967 - DNA, 20 bp, Artificial Sequence
  chemically synthesized
tctgtctccaaaaatttatt

SEQ ID NO: 496968 - DNA, 20 bp, Artificial Sequence
  chemically synthesized
ataaaatgggagataaatga

SEQ ID NO: 496969 - DNA, 20 bp, Artificial Sequence
  chemically synthesized
ttatctacttgattggtaag

SEQ ID NO: 496970 - DNA, 20 bp, Artificial Sequence
  chemically synthesized
agctgcatgtgcggcagcca

SEQ ID NO: 496971 - DNA, 20 bp, Artificial Sequence
  chemically synthesized
ctcaggtgaacaagcaggtt

SEQ ID NO: 496972 - DNA, 20 bp, Artificial Sequence
  chemically synthesized
gtttggaatcaagagaaata

SEQ ID NO: 496973 - DNA, 20 bp, Artificial Sequence
  chemically synthesized
aatatgggatggaaagatag

SEQ ID NO: 496974 - DNA, 20 bp, Artificial Sequence
  chemically synthesized
gacttaactgccatctttag

SEQ ID NO: 496975 - DNA, 20 bp, Artificial Sequence
  chemically synthesized
tggcagttaagtccgtagaa

SEQ ID NO: 496976 - DNA, 20 bp, Artificial Sequence
  chemically synthesized
gagagcgaaaccagaaaccc

SEQ ID NO: 496977 - DNA, 20 bp, Artificial Sequence
  chemically synthesized
tgagactataccttcaatcc

SEQ ID NO: 496978 - DNA, 20 bp, Artificial Sequence
  chemically synthesized
ctgtgacatacctacctccg

SEQ ID NO: 496979 - DNA, 20 bp, Artificial Sequence
  chemically synthesized
cagttttcttttgtgtccca

SEQ ID NO: 496980 - DNA, 20 bp, Artificial Sequence
  chemically synthesized
ctgggacacaaaagaaaact

SEQ ID NO: 496981 - DNA, 20 bp, Artificial Sequence
  chemically synthesized
catttatttgtaaatcatat

SEQ ID NO: 496982 - DNA, 20 bp, Artificial Sequence
  chemically synthesized
gttattgtttcaagaagaaa

SEQ ID NO: 496983 - DNA, 20 bp, Artificial Sequence
  chemically synthesized
cagatagaaagagggaacaa

SEQ ID NO: 496984 - DNA, 20 bp, Artificial Sequence
  chemically synthesized
aggaccacacgagacaaact

SEQ ID NO: 496985 - DNA, 20 bp, Artificial Sequence
  chemically synthesized
aatgccatacttgctggaaa

SEQ ID NO: 496986 - DNA, 20 bp, Artificial Sequence
  chemically synthesized
ttagtcttatagactgtttt

SEQ ID NO: 496987 - DNA, 20 bp, Artificial Sequence
  chemically synthesized
gaagaactagacttgagaaa

SEQ ID NO: 496988 - DNA, 20 bp, Artificial Sequence
  chemically synthesized
cttctgctggcctgtggtta

SEQ ID NO: 496989 - DNA, 20 bp, Artificial Sequence
  chemically synthesized
ctgtggttagggggtttatt

SEQ ID NO: 496990 - DNA, 20 bp, Artificial Sequence
  chemically synthesized
taaagacacagggaaatact

SEQ ID NO: 496991 - DNA, 20 bp, Artificial Sequence
  chemically synthesized
caagtaacctgatgatttca

SEQ ID NO: 496992 - DNA, 20 bp, Artificial Sequence
  chemically synthesized
aataataggcttatgacaac

SEQ ID NO: 496993 - DNA, 20 bp, Artificial Sequence
  chemically synthesized
gatataagcctgaaactttc

SEQ ID NO: 496994 - DNA, 20 bp, Artificial Sequence
  chemically synthesized
catttatgttatatattcaa

SEQ ID NO: 496995 - DNA, 20 bp, Artificial Sequence
  chemically synthesized
tttttccatggtatatccat

SEQ ID NO: 496996 - DNA, 20 bp, Artificial Sequence
  chemically synthesized
tggaaaaaaagaacctatta

SEQ ID NO: 496997 - DNA, 20 bp, Artificial Sequence
  chemically synthesized
gcacatatatatattaaatg

SEQ ID NO: 496998 - DNA, 20 bp, Artificial Sequence
  chemically synthesized
ttaatatatatatgtgctga

SEQ ID NO: 496999 - DNA, 20 bp, Artificial Sequence
  chemically synthesized
attgatcatgttgaaagaaa

SEQ ID NO: 497000 - DNA, 20 bp, Artificial Sequence
  chemically synthesized
tacacatacatatatactct

SEQ ID NO: 497001 - DNA, 20 bp, Artificial Sequence
  chemically synthesized
tcttgttttatcatgatccc

SEQ ID NO: 497002 - DNA, 20 bp, Artificial Sequence
  chemically synthesized
accttggcctcccaaagtgc

SEQ ID NO: 497003 - DNA, 20 bp, Artificial Sequence
  chemically synthesized
cggggtttcaccgtgttagc

SEQ ID NO: 497004 - DNA, 20 bp, Artificial Sequence
  chemically synthesized
ttttgtatttttagtagaga

SEQ ID NO: 497005 - DNA, 20 bp, Artificial Sequence
  chemically synthesized
cattctcctgcctcagcctc

SEQ ID NO: 497006 - DNA, 20 bp, Artificial Sequence
  chemically synthesized
tactcgggaggctgaggcag

SEQ ID NO: 497007 - DNA, 20 bp, Artificial Sequence
  chemically synthesized
ctcactgcaagctctgcctc

SEQ ID NO: 497008 - DNA, 20 bp, Artificial Sequence
  chemically synthesized
cgcgccactgtactccagcc

SEQ ID NO: 497009 - DNA, 20 bp, Artificial Sequence
  chemically synthesized
ctcgctctgtcaccccaggc

SEQ ID NO: 497010 - DNA, 20 bp, Artificial Sequence
  chemically synthesized
ttttttttttttttttgaga

SEQ ID NO: 497011 - DNA, 20 bp, Artificial Sequence
  chemically synthesized
aaaaaacaagacaggtgact

SEQ ID NO: 497012 - DNA, 20 bp, Artificial Sequence
  chemically synthesized
tttaaaaccagatgttgggg

SEQ ID NO: 497013 - DNA, 20 bp, Artificial Sequence
  chemically synthesized
gcttaaatattagcttatct

SEQ ID NO: 497014 - DNA, 20 bp, Artificial Sequence
  chemically synthesized
tcttttttattttaattttt

SEQ ID NO: 497015 - DNA, 20 bp, Artificial Sequence
  chemically synthesized
aatttttgtgggtacatcgt

SEQ ID NO: 497016 - DNA, 20 bp, Artificial Sequence
  chemically synthesized
atcgtaggagtatatatttg

SEQ ID NO: 497017 - DNA, 20 bp, Artificial Sequence
  chemically synthesized
tgttttgacacaggcaggca

SEQ ID NO: 497018 - DNA, 20 bp, Artificial Sequence
  chemically synthesized
aataatcacatcatggagaa

SEQ ID NO: 497019 - DNA, 20 bp, Artificial Sequence
  chemically synthesized
aaggagaaatgcttgaaggg

SEQ ID NO: 497020 - DNA, 20 bp, Artificial Sequence
  chemically synthesized
cacaaaggagaaatgcttga

SEQ ID NO: 497021 - DNA, 20 bp, Artificial Sequence
  chemically synthesized
aaataactaaaggagtgtga

SEQ ID NO: 497022 - DNA, 20 bp, Artificial Sequence
  chemically synthesized
gtacatttaaaaataactaa

SEQ ID NO: 497023 - DNA, 20 bp, Artificial Sequence
  chemically synthesized
cgggatgattatggttaata

SEQ ID NO: 497024 - DNA, 20 bp, Artificial Sequence
  chemically synthesized
tatttgatctgatcaaacaa

SEQ ID NO: 497025 - DNA, 20 bp, Artificial Sequence
  chemically synthesized
agtgtgtcttattttccctg

SEQ ID NO: 497026 - DNA, 20 bp, Artificial Sequence
  chemically synthesized
gtttatgttttcatgagctt

SEQ ID NO: 497027 - DNA, 20 bp, Artificial Sequence
  chemically synthesized
atgagctttgggatttgggg

SEQ ID NO: 497028 - DNA, 20 bp, Artificial Sequence
  chemically synthesized
tagcccagcagtgaacttca

SEQ ID NO: 497029 - DNA, 20 bp, Artificial Sequence
  chemically synthesized
ctcatggtttcatatgaaaa

SEQ ID NO: 497030 - DNA, 20 bp, Artificial Sequence
  chemically synthesized
ttacatttatttttacttat

SEQ ID NO: 497031 - DNA, 20 bp, Artificial Sequence
  chemically synthesized
atgttttcgaaaattactaa

SEQ ID NO: 497032 - DNA, 20 bp, Artificial Sequence
  chemically synthesized
caaaagggctgtgttggtca

SEQ ID NO: 497033 - DNA, 20 bp, Artificial Sequence
  chemically synthesized
caacgccttttttaaaatca

SEQ ID NO: 497034 - DNA, 20 bp, Artificial Sequence
  chemically synthesized
acagtttctttagcatgaaa

SEQ ID NO: 497035 - DNA, 20 bp, Artificial Sequence
  chemically synthesized
acatcttttagatttttcag

SEQ ID NO: 497036 - DNA, 20 bp, Artificial Sequence
  chemically synthesized
atttttcagtagaattaaaa

SEQ ID NO: 497037 - DNA, 20 bp, Artificial Sequence
  chemically synthesized
tggaatatagttgatatgtg

SEQ ID NO: 497038 - DNA, 20 bp, Artificial Sequence
  chemically synthesized
taggcacttttattgatttt

SEQ ID NO: 497039 - DNA, 20 bp, Artificial Sequence
  chemically synthesized
aggttaaggaaattaagaaa

SEQ ID NO: 497040 - DNA, 20 bp, Artificial Sequence
  chemically synthesized
ttttgttttacttctaagtt

SEQ ID NO: 497041 - DNA, 20 bp, Artificial Sequence
  chemically synthesized
gaagctcttgtgagggtgtg

SEQ ID NO: 497042 - DNA, 20 bp, Artificial Sequence
  chemically synthesized
gaaaatattgaagctcttgt

SEQ ID NO: 497043 - DNA, 20 bp, Artificial Sequence
  chemically synthesized
cacaagagcttcaatatttt

SEQ ID NO: 497044 - DNA, 20 bp, Artificial Sequence
  chemically synthesized
ccaaattaatagtaaacagt

SEQ ID NO: 497045 - DNA, 20 bp, Artificial Sequence
  chemically synthesized
aaatgactttttacccagta

SEQ ID NO: 497046 - DNA, 20 bp, Artificial Sequence
  chemically synthesized
ctttggggttatatcctcta

SEQ ID NO: 497047 - DNA, 20 bp, Artificial Sequence
  chemically synthesized
ggatataaccccaaaggctg

SEQ ID NO: 497048 - DNA, 20 bp, Artificial Sequence
  chemically synthesized
cgttgataccctacagcctt

SEQ ID NO: 497049 - DNA, 20 bp, Artificial Sequence
  chemically synthesized
ccaaaggctgtagggtatca

SEQ ID NO: 497050 - DNA, 20 bp, Artificial Sequence
  chemically synthesized
agtattctggaataagatta

SEQ ID NO: 497051 - DNA, 20 bp, Artificial Sequence
  chemically synthesized
cttattcactaatcttattc

SEQ ID NO: 497052 - DNA, 20 bp, Artificial Sequence
  chemically synthesized
gaatttttaaaaaagtattc

SEQ ID NO: 497053 - DNA, 20 bp, Artificial Sequence
  chemically synthesized
aacaaatgcttctataatga

SEQ ID NO: 497054 - DNA, 20 bp, Artificial Sequence
  chemically synthesized
aagaaacaaatgcttctata

SEQ ID NO: 497055 - DNA, 20 bp, Artificial Sequence
  chemically synthesized
aagacaaaactggttcaaaa

SEQ ID NO: 497056 - DNA, 20 bp, Artificial Sequence
  chemically synthesized
tgtattaaataaaacctacc

SEQ ID NO: 497057 - DNA, 20 bp, Artificial Sequence
  chemically synthesized
ttcactgtgctgataggtgg

SEQ ID NO: 497058 - DNA, 20 bp, Artificial Sequence
  chemically synthesized
tgctgataggtggtagaatt

SEQ ID NO: 497059 - DNA, 20 bp, Artificial Sequence
  chemically synthesized
cagagtatactggggacatt

SEQ ID NO: 497060 - DNA, 20 bp, Artificial Sequence
  chemically synthesized
attaaatgtttaattttgtt

SEQ ID NO: 497061 - DNA, 20 bp, Artificial Sequence
  chemically synthesized
tacgtattgacgtgcttatt

SEQ ID NO: 497062 - DNA, 20 bp, Artificial Sequence
  chemically synthesized
gaaaggcaagtcaggacagt

SEQ ID NO: 497063 - DNA, 20 bp, Artificial Sequence
  chemically synthesized
tactctttcatttatagtgt

SEQ ID NO: 497064 - DNA, 20 bp, Artificial Sequence
  chemically synthesized
cattctcacactataaatga

SEQ ID NO: 497065 - DNA, 20 bp, Artificial Sequence
  chemically synthesized
tatcttggccatggaagtta

SEQ ID NO: 497066 - DNA, 20 bp, Artificial Sequence
  chemically synthesized
tcaggagaaagcttctcaaa

SEQ ID NO: 497067 - DNA, 20 bp, Artificial Sequence
  chemically synthesized
taataattagtagttcagct

SEQ ID NO: 497068 - DNA, 20 bp, Artificial Sequence
  chemically synthesized
tcagtgctgaagcaaatgtg

SEQ ID NO: 497069 - DNA, 20 bp, Artificial Sequence
  chemically synthesized
acaagtgagtttggccacca

SEQ ID NO: 497070 - DNA, 20 bp, Artificial Sequence
  chemically synthesized
catttcaaaggtgaaaacaa

SEQ ID NO: 497071 - DNA, 20 bp, Artificial Sequence
  chemically synthesized
cacttgttttcacctttgaa

SEQ ID NO: 497072 - DNA, 20 bp, Artificial Sequence
  chemically synthesized
ttgaaatgagttagttttca

SEQ ID NO: 497073 - DNA, 20 bp, Artificial Sequence
  chemically synthesized
ttagttttcactgagtgctg

SEQ ID NO: 497074 - DNA, 20 bp, Artificial Sequence
  chemically synthesized
actgagccactagcagaagt

SEQ ID NO: 497075 - DNA, 20 bp, Artificial Sequence
  chemically synthesized
gtatttagtggcgtgcaacc

SEQ ID NO: 497076 - DNA, 20 bp, Artificial Sequence
  chemically synthesized
gcaaattttggggaaggggg

SEQ ID NO: 497077 - DNA, 20 bp, Artificial Sequence
  chemically synthesized
ggggaggggtgtgaaggggg

SEQ ID NO: 497078 - DNA, 20 bp, Artificial Sequence
  chemically synthesized
ggggaggggtgtgaaggagg

SEQ ID NO: 497079 - DNA, 20 bp, Artificial Sequence
  chemically synthesized
ggtgtgagcagctgcatata

SEQ ID NO: 497080 - DNA, 20 bp, Artificial Sequence
  chemically synthesized
ctgcactccgacctgggtga

SEQ ID NO: 497081 - DNA, 20 bp, Artificial Sequence
  chemically synthesized
tcttactctgtcacccaggt

SEQ ID NO: 497082 - DNA, 20 bp, Artificial Sequence
  chemically synthesized
tagcaccactgcactccgac

SEQ ID NO: 497083 - DNA, 20 bp, Artificial Sequence
  chemically synthesized
aatcttcccgcctcagcctc

SEQ ID NO: 497084 - DNA, 20 bp, Artificial Sequence
  chemically synthesized
gtgtgtatttttagtagagg

SEQ ID NO: 497085 - DNA, 20 bp, Artificial Sequence
  chemically synthesized
tttgagtctagcctggccta

SEQ ID NO: 497086 - DNA, 20 bp, Artificial Sequence
  chemically synthesized
tattgcttgagcccagaagt

SEQ ID NO: 497087 - DNA, 20 bp, Artificial Sequence
  chemically synthesized
gcactttgggaagctggggc

SEQ ID NO: 497088 - DNA, 20 bp, Artificial Sequence
  chemically synthesized
gccccagcttcccaaagtgc

SEQ ID NO: 497089 - DNA, 20 bp, Artificial Sequence
  chemically synthesized
caactgtgaactctgcactt

SEQ ID NO: 497090 - DNA, 20 bp, Artificial Sequence
  chemically synthesized
ctcatcccaattcaaaagtg

SEQ ID NO: 497091 - DNA, 20 bp, Artificial Sequence
  chemically synthesized
tgaactctgcacttttgaat

SEQ ID NO: 497092 - DNA, 20 bp, Artificial Sequence
  chemically synthesized
gcacttttgaattgggatga

SEQ ID NO: 497093 - DNA, 20 bp, Artificial Sequence
  chemically synthesized
aaactttgagacttttgtag

SEQ ID NO: 497094 - DNA, 20 bp, Artificial Sequence
  chemically synthesized
accctatttaataaagcatc

SEQ ID NO: 497095 - DNA, 20 bp, Artificial Sequence
  chemically synthesized
actcatgatgctttattaaa

SEQ ID NO: 497096 - DNA, 20 bp, Artificial Sequence
  chemically synthesized
tataacacacatgccagggt

SEQ ID NO: 497097 - DNA, 20 bp, Artificial Sequence
  chemically synthesized
actgagtataacacacatgc

SEQ ID NO: 497098 - DNA, 20 bp, Artificial Sequence
  chemically synthesized
agtactaattgagatgggca

SEQ ID NO: 497099 - DNA, 20 bp, Artificial Sequence
  chemically synthesized
tcttatgtggctagggggca

SEQ ID NO: 497100 - DNA, 20 bp, Artificial Sequence
  chemically synthesized
tttcaaaattatttctctgc

SEQ ID NO: 497101 - DNA, 20 bp, Artificial Sequence
  chemically synthesized
gtgagagtgatgtatttgca

SEQ ID NO: 497102 - DNA, 20 bp, Artificial Sequence
  chemically synthesized
ctaatccaggatttggtagt

SEQ ID NO: 497103 - DNA, 20 bp, Artificial Sequence
  chemically synthesized
atcactctcactaccaaatc

SEQ ID NO: 497104 - DNA, 20 bp, Artificial Sequence
  chemically synthesized
acatcaacactgaactaatc

SEQ ID NO: 497105 - DNA, 20 bp, Artificial Sequence
  chemically synthesized
acctgtagcattcacacaaa

SEQ ID NO: 497106 - DNA, 20 bp, Artificial Sequence
  chemically synthesized
aaccactgtatcctatttgt

SEQ ID NO: 497107 - DNA, 20 bp, Artificial Sequence
  chemically synthesized
gaatgtatcccctacagata

SEQ ID NO: 497108 - DNA, 20 bp, Artificial Sequence
  chemically synthesized
tggtttaccccttatctgta

SEQ ID NO: 497109 - DNA, 20 bp, Artificial Sequence
  chemically synthesized
cagacatccactgggagtct

SEQ ID NO: 497110 - DNA, 20 bp, Artificial Sequence
  chemically synthesized
gatacattccaagactccca

SEQ ID NO: 497111 - DNA, 20 bp, Artificial Sequence
  chemically synthesized
tgcagtttcagacatccact

SEQ ID NO: 497112 - DNA, 20 bp, Artificial Sequence
  chemically synthesized
cagttaagagattaaaaatc

SEQ ID NO: 497113 - DNA, 20 bp, Artificial Sequence
  chemically synthesized
tacattgtaatgaaaatcat

SEQ ID NO: 497114 - DNA, 20 bp, Artificial Sequence
  chemically synthesized
ttttcagacagcagttgacc

SEQ ID NO: 497115 - DNA, 20 bp, Artificial Sequence
  chemically synthesized
aaactggggaaagcaaaact

SEQ ID NO: 497116 - DNA, 20 bp, Artificial Sequence
  chemically synthesized
accatctgtggttttccttt

SEQ ID NO: 497117 - DNA, 20 bp, Artificial Sequence
  chemically synthesized
gttggggggggggggggtgt

SEQ ID NO: 497118 - DNA, 20 bp, Artificial Sequence
  chemically synthesized
gcctccttgttggggggggg

SEQ ID NO: 497119 - DNA, 20 bp, Artificial Sequence
  chemically synthesized
tggaaagttacttaactctc

SEQ ID NO: 497120 - DNA, 20 bp, Artificial Sequence
  chemically synthesized
gttacttaactctctggaat

SEQ ID NO: 497121 - DNA, 20 bp, Artificial Sequence
  chemically synthesized
ttatttaaattcaaattcca

SEQ ID NO: 497122 - DNA, 20 bp, Artificial Sequence
  chemically synthesized
ctggaatttgaatttaaata

SEQ ID NO: 497123 - DNA, 20 bp, Artificial Sequence
  chemically synthesized
agtagacttcttatttcatt

SEQ ID NO: 497124 - DNA, 20 bp, Artificial Sequence
  chemically synthesized
tatcaagagctcaatatcct

SEQ ID NO: 497125 - DNA, 20 bp, Artificial Sequence
  chemically synthesized
catgatcagtatttcattca

SEQ ID NO: 497126 - DNA, 20 bp, Artificial Sequence
  chemically synthesized
ggtaagaaagaagaactata

SEQ ID NO: 497127 - DNA, 20 bp, Artificial Sequence
  chemically synthesized
gtaagtggacagcccataaa

SEQ ID NO: 497128 - DNA, 20 bp, Artificial Sequence
  chemically synthesized
ggggcacaggacagatgcca

SEQ ID NO: 497129 - DNA, 20 bp, Artificial Sequence
  chemically synthesized
agtcttaaagaaacagataa

SEQ ID NO: 497130 - DNA, 20 bp, Artificial Sequence
  chemically synthesized
gtctaattgtatcattgcac

SEQ ID NO: 497131 - DNA, 20 bp, Artificial Sequence
  chemically synthesized
atttgtaccttttgacttat

SEQ ID NO: 497132 - DNA, 20 bp, Artificial Sequence
  chemically synthesized
atactcattcagcagttttc

SEQ ID NO: 497133 - DNA, 20 bp, Artificial Sequence
  chemically synthesized
gtacaaatccctgaaaactg

SEQ ID NO: 497134 - DNA, 20 bp, Artificial Sequence
  chemically synthesized
aaatccctgaaaactgctga

SEQ ID NO: 497135 - DNA, 20 bp, Artificial Sequence
  chemically synthesized
ttggcagttacagcttatga

SEQ ID NO: 497136 - DNA, 20 bp, Artificial Sequence
  chemically synthesized
tcaaaagagaaatttaattc

SEQ ID NO: 497137 - DNA, 20 bp, Artificial Sequence
  chemically synthesized
atatacgtatagtgatatcc

SEQ ID NO: 497138 - DNA, 20 bp, Artificial Sequence
  chemically synthesized
agttcccaaaaaggaaataa

SEQ ID NO: 497139 - DNA, 20 bp, Artificial Sequence
  chemically synthesized
gaaacaagtatggcttctta

SEQ ID NO: 497140 - DNA, 20 bp, Artificial Sequence
  chemically synthesized
aagccatacttgtttcattg

SEQ ID NO: 497141 - DNA, 20 bp, Artificial Sequence
  chemically synthesized
ttgctggatctcttatttcc

SEQ ID NO: 497142 - DNA, 20 bp, Artificial Sequence
  chemically synthesized
ttggttaatttatgtattga

SEQ ID NO: 497143 - DNA, 20 bp, Artificial Sequence
  chemically synthesized
ctgcataaactttgagaggg

SEQ ID NO: 497144 - DNA, 20 bp, Artificial Sequence
  chemically synthesized
ctcacctgcataaactttga

SEQ ID NO: 497145 - DNA, 20 bp, Artificial Sequence
  chemically synthesized
tatctgattttgagagagct

SEQ ID NO: 497146 - DNA, 20 bp, Artificial Sequence
  chemically synthesized
tgtcttttaaaataagactc

SEQ ID NO: 497147 - DNA, 20 bp, Artificial Sequence
  chemically synthesized
attatgatcataaagtactc

SEQ ID NO: 497148 - DNA, 20 bp, Artificial Sequence
  chemically synthesized
aagcagtgaatgcgattaag

SEQ ID NO: 497149 - DNA, 20 bp, Artificial Sequence
  chemically synthesized
ataaaaaagaaaataaagca

SEQ ID NO: 497150 - DNA, 20 bp, Artificial Sequence
  chemically synthesized
cttttttatttcttttgaga

SEQ ID NO: 497151 - DNA, 20 bp, Artificial Sequence
  chemically synthesized
actgcactccagcctggcga

SEQ ID NO: 497152 - DNA, 20 bp, Artificial Sequence
  chemically synthesized
gtctcactctgtcgccaggc

SEQ ID NO: 497153 - DNA, 20 bp, Artificial Sequence
  chemically synthesized
ctcactgcgacctccgcctc

SEQ ID NO: 497154 - DNA, 20 bp, Artificial Sequence
  chemically synthesized
gctacttgggaggctgaggc

SEQ ID NO: 497155 - DNA, 20 bp, Artificial Sequence
  chemically synthesized
caggcgtggtggtgcatgcc

SEQ ID NO: 497156 - DNA, 20 bp, Artificial Sequence
  chemically synthesized
tttcatatttttagtagaga

SEQ ID NO: 497157 - DNA, 20 bp, Artificial Sequence
  chemically synthesized
tggggtttcgccatgttggc

SEQ ID NO: 497158 - DNA, 20 bp, Artificial Sequence
  chemically synthesized
gcctcggcctcccaaagtgc

SEQ ID NO: 497159 - DNA, 20 bp, Artificial Sequence
  chemically synthesized
cttgaaaataaagcagtggg

SEQ ID NO: 497160 - DNA, 20 bp, Artificial Sequence
  chemically synthesized
aacatacacaacaccttcag

SEQ ID NO: 497161 - DNA, 20 bp, Artificial Sequence
  chemically synthesized
tgagaagaaaataagcatca

SEQ ID NO: 497162 - DNA, 20 bp, Artificial Sequence
  chemically synthesized
ctgcagtttagcatacttga

SEQ ID NO: 497163 - DNA, 20 bp, Artificial Sequence
  chemically synthesized
tacggtttgctgtatacttc

SEQ ID NO: 497164 - DNA, 20 bp, Artificial Sequence
  chemically synthesized
tttcaagatttaagtttgtt

SEQ ID NO: 497165 - DNA, 20 bp, Artificial Sequence
  chemically synthesized
gtgtttgagcaaaggctttt

SEQ ID NO: 497166 - DNA, 20 bp, Artificial Sequence
  chemically synthesized
tagcctataaaccacagttg

SEQ ID NO: 497167 - DNA, 20 bp, Artificial Sequence
  chemically synthesized
ggatcccaggcctccagatg

SEQ ID NO: 497168 - DNA, 20 bp, Artificial Sequence
  chemically synthesized
tcaccctccatctggaggcc

SEQ ID NO: 497169 - DNA, 20 bp, Artificial Sequence
  chemically synthesized
atattaagtggcaaaagctt

SEQ ID NO: 497170 - DNA, 20 bp, Artificial Sequence
  chemically synthesized
agtctggaaaagccagcttg

SEQ ID NO: 497171 - DNA, 20 bp, Artificial Sequence
  chemically synthesized
cctgcactagactggctttc

SEQ ID NO: 497172 - DNA, 20 bp, Artificial Sequence
  chemically synthesized
tgcctttatgtgagggaata

SEQ ID NO: 497173 - DNA, 20 bp, Artificial Sequence
  chemically synthesized
agatgcctgcctttatgtga

SEQ ID NO: 497174 - DNA, 20 bp, Artificial Sequence
  chemically synthesized
atctgcctccctgactgagg

SEQ ID NO: 497175 - DNA, 20 bp, Artificial Sequence
  chemically synthesized
tgaaacttaagaaaactatg

SEQ ID NO: 497176 - DNA, 20 bp, Artificial Sequence
  chemically synthesized
tccttaaaatttactgttcc

SEQ ID NO: 497177 - DNA, 20 bp, Artificial Sequence
  chemically synthesized
ttatggtgggcttttctctt

SEQ ID NO: 497178 - DNA, 20 bp, Artificial Sequence
  chemically synthesized
tttagtaattgcctcccttt

SEQ ID NO: 497179 - DNA, 20 bp, Artificial Sequence
  chemically synthesized
gccctttgaagatcatagcc

SEQ ID NO: 497180 - DNA, 20 bp, Artificial Sequence
  chemically synthesized
tcaaatggaggacatgagca

SEQ ID NO: 497181 - DNA, 20 bp, Artificial Sequence
  chemically synthesized
ataggttactgaggtgacgg

SEQ ID NO: 497182 - DNA, 20 bp, Artificial Sequence
  chemically synthesized
cacctcagtaacctatgtct

SEQ ID NO: 497183 - DNA, 20 bp, Artificial Sequence
  chemically synthesized
acctatgtcttagagtgata

SEQ ID NO: 497184 - DNA, 20 bp, Artificial Sequence
  chemically synthesized
ctgtttgatatatagatttg

SEQ ID NO: 497185 - DNA, 20 bp, Artificial Sequence
  chemically synthesized
tatcaaacagagattaccat

SEQ ID NO: 497186 - DNA, 20 bp, Artificial Sequence
  chemically synthesized
gttgttattagagatgatgt

SEQ ID NO: 497187 - DNA, 20 bp, Artificial Sequence
  chemically synthesized
attaaaagaaggatgttaaa

SEQ ID NO: 497188 - DNA, 20 bp, Artificial Sequence
  chemically synthesized
gacccatagtgtattaaaag

SEQ ID NO: 497189 - DNA, 20 bp, Artificial Sequence
  chemically synthesized
catccttcttttaatacact

SEQ ID NO: 497190 - DNA, 20 bp, Artificial Sequence
  chemically synthesized
cataaaaatgttatttagtt

SEQ ID NO: 497191 - DNA, 20 bp, Artificial Sequence
  chemically synthesized
cataactaaataacattttt

SEQ ID NO: 497192 - DNA, 20 bp, Artificial Sequence
  chemically synthesized
atcttgaggaaactaataaa

SEQ ID NO: 497193 - DNA, 20 bp, Artificial Sequence
  chemically synthesized
cagtaaaaaaaatatggtgt

SEQ ID NO: 497194 - DNA, 20 bp, Artificial Sequence
  chemically synthesized
aagctaataaatgaagaatc

SEQ ID NO: 497195 - DNA, 20 bp, Artificial Sequence
  chemically synthesized
aatcataaagctaataaatg

SEQ ID NO: 497196 - DNA, 20 bp, Artificial Sequence
  chemically synthesized
catttattagctttatgatt

SEQ ID NO: 497197 - DNA, 20 bp, Artificial Sequence
  chemically synthesized
actttccgaaatttttgtct

SEQ ID NO: 497198 - DNA, 20 bp, Artificial Sequence
  chemically synthesized
aatttttgtctaagagttat

SEQ ID NO: 497199 - DNA, 20 bp, Artificial Sequence
  chemically synthesized
ccttttctacctatcttgct

SEQ ID NO: 497200 - DNA, 20 bp, Artificial Sequence
  chemically synthesized
atgctgttttaaaaattacc

SEQ ID NO: 497201 - DNA, 20 bp, Artificial Sequence
  chemically synthesized
tagtacaaaatcaactttac

SEQ ID NO: 497202 - DNA, 20 bp, Artificial Sequence
  chemically synthesized
tgtcacaaggttgtaatatg

SEQ ID NO: 497203 - DNA, 20 bp, Artificial Sequence
  chemically synthesized
gtgtgttgggtgatttctgg

SEQ ID NO: 497204 - DNA, 20 bp, Artificial Sequence
  chemically synthesized
gttgtatgtgtatgtgtgtg

SEQ ID NO: 497205 - DNA, 20 bp, Artificial Sequence
  chemically synthesized
ctataaagaaatacctgaaa

SEQ ID NO: 497206 - DNA, 20 bp, Artificial Sequence
  chemically synthesized
ctgggtgctttaaaaagaaa

SEQ ID NO: 497207 - DNA, 20 bp, Artificial Sequence
  chemically synthesized
ggggagagcaggaaacaggt

SEQ ID NO: 497208 - DNA, 20 bp, Artificial Sequence
  chemically synthesized
tgctatatgtggttgtttaa

SEQ ID NO: 497209 - DNA, 20 bp, Artificial Sequence
  chemically synthesized
atgaactaacttgtcaccaa

SEQ ID NO: 497210 - DNA, 20 bp, Artificial Sequence
  chemically synthesized
caccaaagggatcattcatg

SEQ ID NO: 497211 - DNA, 20 bp, Artificial Sequence
  chemically synthesized
atcatgtgggtggatccttc

SEQ ID NO: 497212 - DNA, 20 bp, Artificial Sequence
  chemically synthesized
ggtgtgattggatcatgtgg

SEQ ID NO: 497213 - DNA, 20 bp, Artificial Sequence
  chemically synthesized
ggtaggtgtgattggatcat

SEQ ID NO: 497214 - DNA, 20 bp, Artificial Sequence
  chemically synthesized
gcagggcctggtaggtgtga

SEQ ID NO: 497215 - DNA, 20 bp, Artificial Sequence
  chemically synthesized
ggcttggatgtttatcacct

SEQ ID NO: 497216 - DNA, 20 bp, Artificial Sequence
  chemically synthesized
gagagagagagagagatggc

SEQ ID NO: 497217 - DNA, 20 bp, Artificial Sequence
  chemically synthesized
ttaattgcgactgtgtgtgt

SEQ ID NO: 497218 - DNA, 20 bp, Artificial Sequence
  chemically synthesized
ctgtgaaacatctatttgtg

SEQ ID NO: 497219 - DNA, 20 bp, Artificial Sequence
  chemically synthesized
ggccggtgttgatccacaaa

SEQ ID NO: 497220 - DNA, 20 bp, Artificial Sequence
  chemically synthesized
gtgaatcataaactcagttt

SEQ ID NO: 497221 - DNA, 20 bp, Artificial Sequence
  chemically synthesized
tagtgttcattgtccaaact

SEQ ID NO: 497222 - DNA, 20 bp, Artificial Sequence
  chemically synthesized
aggaactcttggtaagcgtg

SEQ ID NO: 497223 - DNA, 20 bp, Artificial Sequence
  chemically synthesized
atgcatccaacacgcttacc

SEQ ID NO: 497224 - DNA, 20 bp, Artificial Sequence
  chemically synthesized
ttcaactttttctcattttc

SEQ ID NO: 497225 - DNA, 20 bp, Artificial Sequence
  chemically synthesized
agcgatatgaaaataaggga

SEQ ID NO: 497226 - DNA, 20 bp, Artificial Sequence
  chemically synthesized
cccaaagagtaactagccag

SEQ ID NO: 497227 - DNA, 20 bp, Artificial Sequence
  chemically synthesized
ttcttctggctagttactct

SEQ ID NO: 497228 - DNA, 20 bp, Artificial Sequence
  chemically synthesized
gtcagagcagaggcaaccca

SEQ ID NO: 497229 - DNA, 20 bp, Artificial Sequence
  chemically synthesized
tagaggtcggtacaccattg

SEQ ID NO: 497230 - DNA, 20 bp, Artificial Sequence
  chemically synthesized
tccatcaatttcagcaaacc

SEQ ID NO: 497231 - DNA, 20 bp, Artificial Sequence
  chemically synthesized
cagcaaaccttggattatat

SEQ ID NO: 497232 - DNA, 20 bp, Artificial Sequence
  chemically synthesized
tggattatatgtgaataggt

SEQ ID NO: 497233 - DNA, 20 bp, Artificial Sequence
  chemically synthesized
caggctctatgctaggtgct

SEQ ID NO: 497234 - DNA, 20 bp, Artificial Sequence
  chemically synthesized
gctccaaaagtaaaagtttt

SEQ ID NO: 497235 - DNA, 20 bp, Artificial Sequence
  chemically synthesized
aagagaacagctgtgcagga

SEQ ID NO: 497236 - DNA, 20 bp, Artificial Sequence
  chemically synthesized
cctgatggacgatgatggac

SEQ ID NO: 497237 - DNA, 20 bp, Artificial Sequence
  chemically synthesized
acaaagatgatcactttaag

SEQ ID NO: 497238 - DNA, 20 bp, Artificial Sequence
  chemically synthesized
tcagtttaggggctggggca

SEQ ID NO: 497239 - DNA, 20 bp, Artificial Sequence
  chemically synthesized
acattgttgaagcagaggca

SEQ ID NO: 497240 - DNA, 20 bp, Artificial Sequence
  chemically synthesized
gtggttcagggccagtgcat

SEQ ID NO: 497241 - DNA, 20 bp, Artificial Sequence
  chemically synthesized
agtagctggggaggaagata

SEQ ID NO: 497242 - DNA, 20 bp, Artificial Sequence
  chemically synthesized
agtcagaagacgaacaggag

SEQ ID NO: 497243 - DNA, 20 bp, Artificial Sequence
  chemically synthesized
atcgctttccagatatactt

SEQ ID NO: 497244 - DNA, 20 bp, Artificial Sequence
  chemically synthesized
gacttttgtgcatttttggc

SEQ ID NO: 497245 - DNA, 20 bp, Artificial Sequence
  chemically synthesized
aaaatgcacaaaagtcaaat

SEQ ID NO: 497246 - DNA, 20 bp, Artificial Sequence
  chemically synthesized
tgatcttggtgttgacggtt

SEQ ID NO: 497247 - DNA, 20 bp, Artificial Sequence
  chemically synthesized
aacaccaagatcaaaaggac

SEQ ID NO: 497248 - DNA, 20 bp, Artificial Sequence
  chemically synthesized
aggagtttttccttgttttg

SEQ ID NO: 497249 - DNA, 20 bp, Artificial Sequence
  chemically synthesized
ctaggtcctttgggtgtttt

SEQ ID NO: 497250 - DNA, 20 bp, Artificial Sequence
  chemically synthesized
cttctacagaactaggtcct

SEQ ID NO: 497251 - DNA, 20 bp, Artificial Sequence
  chemically synthesized
ctaaagtggaagccaagttc

SEQ ID NO: 497252 - DNA, 20 bp, Artificial Sequence
  chemically synthesized
ccaagttcatgaattatgtg

SEQ ID NO: 497253 - DNA, 20 bp, Artificial Sequence
  chemically synthesized
ttcctccactgccagagatc

SEQ ID NO: 497254 - DNA, 20 bp, Artificial Sequence
  chemically synthesized
tggctgtcgttttgataatg

SEQ ID NO: 497255 - DNA, 20 bp, Artificial Sequence
  chemically synthesized
gttgtccagattccattgcc

SEQ ID NO: 497256 - DNA, 20 bp, Artificial Sequence
  chemically synthesized
ggacaacacattcttggcaa

SEQ ID NO: 497257 - DNA, 20 bp, Artificial Sequence
  chemically synthesized
ccttaaaaccaagcaaaggg

SEQ ID NO: 497258 - DNA, 20 bp, Artificial Sequence
  chemically synthesized
tacatccttaaaaccaagca

SEQ ID NO: 497259 - DNA, 20 bp, Artificial Sequence
  chemically synthesized
tccaccctttgcttggtttt

SEQ ID NO: 497260 - DNA, 20 bp, Artificial Sequence
  chemically synthesized
tgcttggttttaaggatgta

SEQ ID NO: 497261 - DNA, 20 bp, Artificial Sequence
  chemically synthesized
agtggtcagacatggaaatg

SEQ ID NO: 497262 - DNA, 20 bp, Artificial Sequence
  chemically synthesized
cacattagaagattcatctc

SEQ ID NO: 497263 - DNA, 20 bp, Artificial Sequence
  chemically synthesized
ctagctgttgcacccaagag

SEQ ID NO: 497264 - DNA, 20 bp, Artificial Sequence
  chemically synthesized
catctcttgggtgcaacagc

SEQ ID NO: 497265 - DNA, 20 bp, Artificial Sequence
  chemically synthesized
ttgccattgtgacagtatta

SEQ ID NO: 497266 - DNA, 20 bp, Artificial Sequence
  chemically synthesized
gggagctttaggaggtgatt

SEQ ID NO: 497267 - DNA, 20 bp, Artificial Sequence
  chemically synthesized
ggattgagggctccaccctc

SEQ ID NO: 497268 - DNA, 20 bp, Artificial Sequence
  chemically synthesized
tgagggctccaccctcacga

SEQ ID NO: 497269 - DNA, 20 bp, Artificial Sequence
  chemically synthesized
agggaaccaaacccactcgt

SEQ ID NO: 497270 - DNA, 20 bp, Artificial Sequence
  chemically synthesized
tttggttcccttataaaagt

SEQ ID NO: 497271 - DNA, 20 bp, Artificial Sequence
  chemically synthesized
agcagcacaaaacgtattaa

SEQ ID NO: 497272 - DNA, 20 bp, Artificial Sequence
  chemically synthesized
taagagcagaaattttgaaa

SEQ ID NO: 497273 - DNA, 20 bp, Artificial Sequence
  chemically synthesized
gaaatattttctagtctcct

SEQ ID NO: 497274 - DNA, 20 bp, Artificial Sequence
  chemically synthesized
cacgcaagataatttcattg

SEQ ID NO: 497275 - DNA, 20 bp, Artificial Sequence
  chemically synthesized
agaatggtcagggcaattta

SEQ ID NO: 497276 - DNA, 20 bp, Artificial Sequence
  chemically synthesized
attgccctgaccattctttg

SEQ ID NO: 497277 - DNA, 20 bp, Artificial Sequence
  chemically synthesized
ataaccagtgctatccttca

SEQ ID NO: 497278 - DNA, 20 bp, Artificial Sequence
  chemically synthesized
aagttcctatgaactatcag

SEQ ID NO: 497279 - DNA, 20 bp, Artificial Sequence
  chemically synthesized
tcctatgaactatcagttga

SEQ ID NO: 497280 - DNA, 20 bp, Artificial Sequence
  chemically synthesized
tgtacttttaaatactagta

SEQ ID NO: 497281 - DNA, 20 bp, Artificial Sequence
  chemically synthesized
ttataaaaaaatagaaattc

SEQ ID NO: 497282 - DNA, 20 bp, Artificial Sequence
  chemically synthesized
atttttcaaacattttatcc

SEQ ID NO: 497283 - DNA, 20 bp, Artificial Sequence
  chemically synthesized
atttaagattagcagtaaaa

SEQ ID NO: 497284 - DNA, 20 bp, Artificial Sequence
  chemically synthesized
tcaaataaatccatgttaac

SEQ ID NO: 497285 - DNA, 20 bp, Artificial Sequence
  chemically synthesized
tattgtaaatcctagttaac

SEQ ID NO: 497286 - DNA, 20 bp, Artificial Sequence
  chemically synthesized
ttacaatacaagcctgtact

SEQ ID NO: 497287 - DNA, 20 bp, Artificial Sequence
  chemically synthesized
tgtactatgagttgtaaagc

SEQ ID NO: 497288 - DNA, 20 bp, Artificial Sequence
  chemically synthesized
aatgtctgcaggctgtgaaa

SEQ ID NO: 497289 - DNA, 20 bp, Artificial Sequence
  chemically synthesized
gcctgcagacattttaatgc

SEQ ID NO: 497290 - DNA, 20 bp, Artificial Sequence
  chemically synthesized
attaccaaaaaaacttttaa

SEQ ID NO: 497291 - DNA, 20 bp, Artificial Sequence
  chemically synthesized
tagggtataataaattaaga

SEQ ID NO: 497292 - DNA, 20 bp, Artificial Sequence
  chemically synthesized
gactgaatggtaatgcaaac

SEQ ID NO: 497293 - DNA, 20 bp, Artificial Sequence
  chemically synthesized
gggtacaacaggacaaaatt

SEQ ID NO: 497294 - DNA, 20 bp, Artificial Sequence
  chemically synthesized
tataatgacccaacaacact

SEQ ID NO: 497295 - DNA, 20 bp, Artificial Sequence
  chemically synthesized
tttccacactctaagtgttg

SEQ ID NO: 497296 - DNA, 20 bp, Artificial Sequence
  chemically synthesized
tggaaacaacgttggtattc

SEQ ID NO: 497297 - DNA, 20 bp, Artificial Sequence
  chemically synthesized
ttaaccgtggtcgtatatcc

SEQ ID NO: 497298 - DNA, 20 bp, Artificial Sequence
  chemically synthesized
tttgacaagggaaaaacaat

SEQ ID NO: 497299 - DNA, 20 bp, Artificial Sequence
  chemically synthesized
ggctccttttgtaaagaagg

SEQ ID NO: 497300 - DNA, 20 bp, Artificial Sequence
  chemically synthesized
aaaaggagccaggctagaag

SEQ ID NO: 497301 - DNA, 20 bp, Artificial Sequence
  chemically synthesized
taatgacagtaagtatccat

SEQ ID NO: 497302 - DNA, 20 bp, Artificial Sequence
  chemically synthesized
cttatatatgaggaactcta

SEQ ID NO: 497303 - DNA, 20 bp, Artificial Sequence
  chemically synthesized
acttgggaaaacctgacttt

SEQ ID NO: 497304 - DNA, 20 bp, Artificial Sequence
  chemically synthesized
acagtcctccattacacctc

SEQ ID NO: 497305 - DNA, 20 bp, Artificial Sequence
  chemically synthesized
gatctggcctaggacaaatg

SEQ ID NO: 497306 - DNA, 20 bp, Artificial Sequence
  chemically synthesized
aggccagatccagtactttc

SEQ ID NO: 497307 - DNA, 20 bp, Artificial Sequence
  chemically synthesized
agtaaacactccagaaagta

SEQ ID NO: 497308 - DNA, 20 bp, Artificial Sequence
  chemically synthesized
ctttatgagctcacagtctc

SEQ ID NO: 497309 - DNA, 20 bp, Artificial Sequence
  chemically synthesized
agcagatactgcttgctgct

SEQ ID NO: 497310 - DNA, 20 bp, Artificial Sequence
  chemically synthesized
agtatctgctttgcacacag

SEQ ID NO: 497311 - DNA, 20 bp, Artificial Sequence
  chemically synthesized
tcacaatatatgtttgttac

SEQ ID NO: 497312 - DNA, 20 bp, Artificial Sequence
  chemically synthesized
ggtatttaacatatgctcca

SEQ ID NO: 497313 - DNA, 20 bp, Artificial Sequence
  chemically synthesized
gaaggaagctcaatgtaaga

SEQ ID NO: 497314 - DNA, 20 bp, Artificial Sequence
  chemically synthesized
tgaaaagcaaggacaaactt

SEQ ID NO: 497315 - DNA, 20 bp, Artificial Sequence
  chemically synthesized
ttatgtatttattcgttcta

SEQ ID NO: 497316 - DNA, 20 bp, Artificial Sequence
  chemically synthesized
aaaatgtaatattcagtaga

SEQ ID NO: 497317 - DNA, 20 bp, Artificial Sequence
  chemically synthesized
gaatattacattttcaatat

SEQ ID NO: 497318 - DNA, 20 bp, Artificial Sequence
  chemically synthesized
tccattagaatgaacatatt

SEQ ID NO: 497319 - DNA, 20 bp, Artificial Sequence
  chemically synthesized
atgtttattatcttttccat

SEQ ID NO: 497320 - DNA, 20 bp, Artificial Sequence
  chemically synthesized
actacagtttcagcaagtga

SEQ ID NO: 497321 - DNA, 20 bp, Artificial Sequence
  chemically synthesized
agttaagcagatctcccaga

SEQ ID NO: 497322 - DNA, 20 bp, Artificial Sequence
  chemically synthesized
gtgtgctttctttaagatgg

SEQ ID NO: 497323 - DNA, 20 bp, Artificial Sequence
  chemically synthesized
gagttacaaaaggcatatct

SEQ ID NO: 497324 - DNA, 20 bp, Artificial Sequence
  chemically synthesized
agtgtacaaaaattctgaga

SEQ ID NO: 497325 - DNA, 20 bp, Artificial Sequence
  chemically synthesized
tgtcccaatctactccctct

SEQ ID NO: 497326 - DNA, 20 bp, Artificial Sequence
  chemically synthesized
acatggtgagaaactggaga

SEQ ID NO: 497327 - DNA, 20 bp, Artificial Sequence
  chemically synthesized
catcccttcttactgttccc

SEQ ID NO: 497328 - DNA, 20 bp, Artificial Sequence
  chemically synthesized
cattctagggaacagtaaga

SEQ ID NO: 497329 - DNA, 20 bp, Artificial Sequence
  chemically synthesized
tttctgcttctcattgcttc

SEQ ID NO: 497330 - DNA, 20 bp, Artificial Sequence
  chemically synthesized
ttgttttgattttttctatt

SEQ ID NO: 497331 - DNA, 20 bp, Artificial Sequence
  chemically synthesized
aagagactacaaaaaatgag

SEQ ID NO: 497332 - DNA, 20 bp, Artificial Sequence
  chemically synthesized
ttagagcatgaaattatcaa

SEQ ID NO: 497333 - DNA, 20 bp, Artificial Sequence
  chemically synthesized
tcttgataatttcatgctct

SEQ ID NO: 497334 - DNA, 20 bp, Artificial Sequence
  chemically synthesized
taatttcatgctctaagaat

SEQ ID NO: 497335 - DNA, 20 bp, Artificial Sequence
  chemically synthesized
tctaagaatgggaatccctt

SEQ ID NO: 497336 - DNA, 20 bp, Artificial Sequence
  chemically synthesized
ggataaacatgtcatcccta

SEQ ID NO: 497337 - DNA, 20 bp, Artificial Sequence
  chemically synthesized
gtaaagaactgcttaaaatg

SEQ ID NO: 497338 - DNA, 20 bp, Artificial Sequence
  chemically synthesized
aaataagtatattaaaataa

SEQ ID NO: 497339 - DNA, 20 bp, Artificial Sequence
  chemically synthesized
gaaagatacacttgatgggc

SEQ ID NO: 497340 - DNA, 20 bp, Artificial Sequence
  chemically synthesized
caaggattgaaagcccctct

SEQ ID NO: 497341 - DNA, 20 bp, Artificial Sequence
  chemically synthesized
tagtaaataaccaatttact

SEQ ID NO: 497342 - DNA, 20 bp, Artificial Sequence
  chemically synthesized
tatttactacttctgaaaag

SEQ ID NO: 497343 - DNA, 20 bp, Artificial Sequence
  chemically synthesized
taggggccaaaaagttgcag

SEQ ID NO: 497344 - DNA, 20 bp, Artificial Sequence
  chemically synthesized
gagtttccaagcagcaataa

SEQ ID NO: 497345 - DNA, 20 bp, Artificial Sequence
  chemically synthesized
aagggtaacaatatttacgc

SEQ ID NO: 497346 - DNA, 20 bp, Artificial Sequence
  chemically synthesized
ttattagctggtagtggcat

SEQ ID NO: 497347 - DNA, 20 bp, Artificial Sequence
  chemically synthesized
ttacagcaatgtgtaagtgt

SEQ ID NO: 497348 - DNA, 20 bp, Artificial Sequence
  chemically synthesized
gccggaaaatttactgctaa

SEQ ID NO: 497349 - DNA, 20 bp, Artificial Sequence
  chemically synthesized
gaagacatacactagcataa

SEQ ID NO: 497350 - DNA, 20 bp, Artificial Sequence
  chemically synthesized
tgtcttctagttacagaaac

SEQ ID NO: 497351 - DNA, 20 bp, Artificial Sequence
  chemically synthesized
tataaaggacaagcaatggt

SEQ ID NO: 497352 - DNA, 20 bp, Artificial Sequence
  chemically synthesized
gtatgaattattcttaacgt

SEQ ID NO: 497353 - DNA, 20 bp, Artificial Sequence
  chemically synthesized
ttcactgggaccctaacgtt

SEQ ID NO: 497354 - DNA, 20 bp, Artificial Sequence
  chemically synthesized
aactttgatggaaaaatcac

SEQ ID NO: 497355 - DNA, 20 bp, Artificial Sequence
  chemically synthesized
atcaaagtttctatcagcat

SEQ ID NO: 497356 - DNA, 20 bp, Artificial Sequence
  chemically synthesized
gtgatttcaccagctggctg

SEQ ID NO: 497357 - DNA, 20 bp, Artificial Sequence
  chemically synthesized
tattaatacagattgaatta

SEQ ID NO: 497358 - DNA, 20 bp, Artificial Sequence
  chemically synthesized
tgaatttatattaatacaga

SEQ ID NO: 497359 - DNA, 20 bp, Artificial Sequence
  chemically synthesized
aagaactctataggaggtaa

SEQ ID NO: 497360 - DNA, 20 bp, Artificial Sequence
  chemically synthesized
ataaattcacttacctccta

SEQ ID NO: 497361 - DNA, 20 bp, Artificial Sequence
  chemically synthesized
atgagttttcgtatttttat

SEQ ID NO: 497362 - DNA, 20 bp, Artificial Sequence
  chemically synthesized
gacagtatctgctacagaga

SEQ ID NO: 497363 - DNA, 20 bp, Artificial Sequence
  chemically synthesized
cactgacagtatctgctaca

SEQ ID NO: 497364 - DNA, 20 bp, Artificial Sequence
  chemically synthesized
ttgtacaaaaatgatgagtg

SEQ ID NO: 497365 - DNA, 20 bp, Artificial Sequence
  chemically synthesized
cattgacttgtacaaaaatg

SEQ ID NO: 497366 - DNA, 20 bp, Artificial Sequence
  chemically synthesized
agataagggctttctgggct

SEQ ID NO: 497367 - DNA, 20 bp, Artificial Sequence
  chemically synthesized
agtgctgaaagcaaggcgag

SEQ ID NO: 497368 - DNA, 20 bp, Artificial Sequence
  chemically synthesized
ggcgagaagaatgagaaaac

SEQ ID NO: 497369 - DNA, 20 bp, Artificial Sequence
  chemically synthesized
tgctcaaaagtttgagacaa

SEQ ID NO: 497370 - DNA, 20 bp, Artificial Sequence
  chemically synthesized
cttgtctcaaacttttgagc

SEQ ID NO: 497371 - DNA, 20 bp, Artificial Sequence
  chemically synthesized
ttcagagagcacaatggagt

SEQ ID NO: 497372 - DNA, 20 bp, Artificial Sequence
  chemically synthesized
tttagattcagagagcacaa

SEQ ID NO: 497373 - DNA, 20 bp, Artificial Sequence
  chemically synthesized
ctccaactccattgtgctct

SEQ ID NO: 497374 - DNA, 20 bp, Artificial Sequence
  chemically synthesized
ctctctgaatctaaactctt

SEQ ID NO: 497375 - DNA, 20 bp, Artificial Sequence
  chemically synthesized
tgaatctaaactcttcagaa

SEQ ID NO: 497376 - DNA, 20 bp, Artificial Sequence
  chemically synthesized
ttttaaaggacccaattctg

SEQ ID NO: 497377 - DNA, 20 bp, Artificial Sequence
  chemically synthesized
gggtcctttaaaaagtgctt

SEQ ID NO: 497378 - DNA, 20 bp, Artificial Sequence
  chemically synthesized
gagttgagagaaggcaaaaa

SEQ ID NO: 497379 - DNA, 20 bp, Artificial Sequence
  chemically synthesized
gaaagagcacactggtgctt

SEQ ID NO: 497380 - DNA, 20 bp, Artificial Sequence
  chemically synthesized
cctcatctgagagatcacag

SEQ ID NO: 497381 - DNA, 20 bp, Artificial Sequence
  chemically synthesized
tcaaatgtgaaatgtccaga

SEQ ID NO: 497382 - DNA, 20 bp, Artificial Sequence
  chemically synthesized
acatttcacatttgagaaaa

SEQ ID NO: 497383 - DNA, 20 bp, Artificial Sequence
  chemically synthesized
gggagtgtatttttcttcaa

SEQ ID NO: 497384 - DNA, 20 bp, Artificial Sequence
  chemically synthesized
ttgagcatacagaagtaaat

SEQ ID NO: 497385 - DNA, 20 bp, Artificial Sequence
  chemically synthesized
cttctgtatgctcaatgaca

SEQ ID NO: 497386 - DNA, 20 bp, Artificial Sequence
  chemically synthesized
aaacagcagtttattcatgt

SEQ ID NO: 497387 - DNA, 20 bp, Artificial Sequence
  chemically synthesized
caccagtgtgttattctgac

SEQ ID NO: 497388 - DNA, 20 bp, Artificial Sequence
  chemically synthesized
gtcttaaggtcgatttcaaa

SEQ ID NO: 497389 - DNA, 20 bp, Artificial Sequence
  chemically synthesized
aatggaataccttaagattt

SEQ ID NO: 497390 - DNA, 20 bp, Artificial Sequence
  chemically synthesized
tgttttatgaaataatgctg

SEQ ID NO: 497391 - DNA, 20 bp, Artificial Sequence
  chemically synthesized
agattaagtatttaaaccag

SEQ ID NO: 497392 - DNA, 20 bp, Artificial Sequence
  chemically synthesized
ttttaaaacatgggctatga

SEQ ID NO: 497393 - DNA, 20 bp, Artificial Sequence
  chemically synthesized
ttagctcatatattgacagg

SEQ ID NO: 497394 - DNA, 20 bp, Artificial Sequence
  chemically synthesized
aatgttagctcatatattga

SEQ ID NO: 497395 - DNA, 20 bp, Artificial Sequence
  chemically synthesized
taacaagaagaaatgttaat

SEQ ID NO: 497396 - DNA, 20 bp, Artificial Sequence
  chemically synthesized
ttcttcttgttagctaggaa

SEQ ID NO: 497397 - DNA, 20 bp, Artificial Sequence
  chemically synthesized
tctgaaacagatgcgtttgg

SEQ ID NO: 497398 - DNA, 20 bp, Artificial Sequence
  chemically synthesized
acagatgcgtttggctgaat

SEQ ID NO: 497399 - DNA, 20 bp, Artificial Sequence
  chemically synthesized
agcataagggctcttggatt

SEQ ID NO: 497400 - DNA, 20 bp, Artificial Sequence
  chemically synthesized
ttctcaaagcataagggctc

SEQ ID NO: 497401 - DNA, 20 bp, Artificial Sequence
  chemically synthesized
caggttggtttttctgcagt

SEQ ID NO: 497402 - DNA, 20 bp, Artificial Sequence
  chemically synthesized
tacaaactaagacttattta

SEQ ID NO: 497403 - DNA, 20 bp, Artificial Sequence
  chemically synthesized
atatgaactaatcacttata

SEQ ID NO: 497404 - DNA, 20 bp, Artificial Sequence
  chemically synthesized
ataataggggcttacattta

SEQ ID NO: 497405 - DNA, 20 bp, Artificial Sequence
  chemically synthesized
gagatgtgtataaagccact

SEQ ID NO: 497406 - DNA, 20 bp, Artificial Sequence
  chemically synthesized
agagaaatcagagacatgaa

SEQ ID NO: 497407 - DNA, 20 bp, Artificial Sequence
  chemically synthesized
gtcctttagcttaatagttg

SEQ ID NO: 497408 - DNA, 20 bp, Artificial Sequence
  chemically synthesized
aactattaagctaaaggacc

SEQ ID NO: 497409 - DNA, 20 bp, Artificial Sequence
  chemically synthesized
taagctaaaggacctgggat

SEQ ID NO: 497410 - DNA, 20 bp, Artificial Sequence
  chemically synthesized
gggatttgaatccaatcttt

SEQ ID NO: 497411 - DNA, 20 bp, Artificial Sequence
  chemically synthesized
aaatgctggactcagaaaga

SEQ ID NO: 497412 - DNA, 20 bp, Artificial Sequence
  chemically synthesized
ctctaatagaagtttagaaa

SEQ ID NO: 497413 - DNA, 20 bp, Artificial Sequence
  chemically synthesized
aacttctattagagcctcat

SEQ ID NO: 497414 - DNA, 20 bp, Artificial Sequence
  chemically synthesized
tgtggattgtcactgttttg

SEQ ID NO: 497415 - DNA, 20 bp, Artificial Sequence
  chemically synthesized
attcactaaacaagcagtaa

SEQ ID NO: 497416 - DNA, 20 bp, Artificial Sequence
  chemically synthesized
actcaattactgcttgttta

SEQ ID NO: 497417 - DNA, 20 bp, Artificial Sequence
  chemically synthesized
agagatgctgatatcattca

SEQ ID NO: 497418 - DNA, 20 bp, Artificial Sequence
  chemically synthesized
aaattggtttattaaattcg

SEQ ID NO: 497419 - DNA, 20 bp, Artificial Sequence
  chemically synthesized
aacgaatttaataaaccaat

SEQ ID NO: 497420 - DNA, 20 bp, Artificial Sequence
  chemically synthesized
atttttctcaggtaaaaaaa

SEQ ID NO: 497421 - DNA, 20 bp, Artificial Sequence
  chemically synthesized
agtggcatggtatattgctc

SEQ ID NO: 497422 - DNA, 20 bp, Artificial Sequence
  chemically synthesized
taaaagacaaaattaagtac

SEQ ID NO: 497423 - DNA, 20 bp, Artificial Sequence
  chemically synthesized
ttgcgacagaggaaaaaaaa

SEQ ID NO: 497424 - DNA, 20 bp, Artificial Sequence
  chemically synthesized
ctattggcagtcagtatatt

SEQ ID NO: 497425 - DNA, 20 bp, Artificial Sequence
  chemically synthesized
atttttttcactttaaagaa

SEQ ID NO: 497426 - DNA, 20 bp, Artificial Sequence
  chemically synthesized
aaacacacgcagaagcacgt

SEQ ID NO: 497427 - DNA, 20 bp, Artificial Sequence
  chemically synthesized
tatgaaattattttagaaga

SEQ ID NO: 497428 - DNA, 20 bp, Artificial Sequence
  chemically synthesized
gactaataatgaataagaga

SEQ ID NO: 497429 - DNA, 20 bp, Artificial Sequence
  chemically synthesized
gattgactaataatgaataa

SEQ ID NO: 497430 - DNA, 20 bp, Artificial Sequence
  chemically synthesized
cctttgttgattgactaata

SEQ ID NO: 497431 - DNA, 20 bp, Artificial Sequence
  chemically synthesized
ttatcgatgaaggtatctta

SEQ ID NO: 497432 - DNA, 20 bp, Artificial Sequence
  chemically synthesized
ttctgagtaattatcgtaaa

SEQ ID NO: 497433 - DNA, 20 bp, Artificial Sequence
  chemically synthesized
cccattttacgataattact

SEQ ID NO: 497434 - DNA, 20 bp, Artificial Sequence
  chemically synthesized
ccttaggttatctttccatt

SEQ ID NO: 497435 - DNA, 20 bp, Artificial Sequence
  chemically synthesized
acatgagcgtgcacacacac

SEQ ID NO: 497436 - DNA, 20 bp, Artificial Sequence
  chemically synthesized
agaaataccttaactgtttg

SEQ ID NO: 497437 - DNA, 20 bp, Artificial Sequence
  chemically synthesized
aattctttcagaaaagagct

SEQ ID NO: 497438 - DNA, 20 bp, Artificial Sequence
  chemically synthesized
cattcacagctcttttctga

SEQ ID NO: 497439 - DNA, 20 bp, Artificial Sequence
  chemically synthesized
agaatttttccttggacatc

SEQ ID NO: 497440 - DNA, 20 bp, Artificial Sequence
  chemically synthesized
gagccaccatgcctggccaa

SEQ ID NO: 497441 - DNA, 20 bp, Artificial Sequence
  chemically synthesized
gtctcagcctcccaaagtgc

SEQ ID NO: 497442 - DNA, 20 bp, Artificial Sequence
  chemically synthesized
tacaaaaattagccaggtgt

SEQ ID NO: 497443 - DNA, 20 bp, Artificial Sequence
  chemically synthesized
gccttagcctcccgagtagc

SEQ ID NO: 497444 - DNA, 20 bp, Artificial Sequence
  chemically synthesized
aattctcctgccttagcctc

SEQ ID NO: 497445 - DNA, 20 bp, Artificial Sequence
  chemically synthesized
tactcgggaggctaaggcag

SEQ ID NO: 497446 - DNA, 20 bp, Artificial Sequence
  chemically synthesized
tgagatcatgccactccagc

SEQ ID NO: 497447 - DNA, 20 bp, Artificial Sequence
  chemically synthesized
tttgcttttgtcacccaggc

SEQ ID NO: 497448 - DNA, 20 bp, Artificial Sequence
  chemically synthesized
atacttttttttttttgaga

SEQ ID NO: 497449 - DNA, 20 bp, Artificial Sequence
  chemically synthesized
atcaaaacttttcccctcaa

SEQ ID NO: 497450 - DNA, 20 bp, Artificial Sequence
  chemically synthesized
atcataatttaaaattttca

SEQ ID NO: 497451 - DNA, 20 bp, Artificial Sequence
  chemically synthesized
cattaacattacacaatttt

SEQ ID NO: 497452 - DNA, 20 bp, Artificial Sequence
  chemically synthesized
ttttggacttgttttcaagt

SEQ ID NO: 497453 - DNA, 20 bp, Artificial Sequence
  chemically synthesized
tttaacaaaagcctcctggc

SEQ ID NO: 497454 - DNA, 20 bp, Artificial Sequence
  chemically synthesized
ttttgttaaaagatgaagct

SEQ ID NO: 497455 - DNA, 20 bp, Artificial Sequence
  chemically synthesized
agctttattttattcttcat

SEQ ID NO: 497456 - DNA, 20 bp, Artificial Sequence
  chemically synthesized
aactgatcaagactcagatg

SEQ ID NO: 497457 - DNA, 20 bp, Artificial Sequence
  chemically synthesized
gtgaagttctttccttagct

SEQ ID NO: 497458 - DNA, 20 bp, Artificial Sequence
  chemically synthesized
ctaaggaaagaacttcacaa

SEQ ID NO: 497459 - DNA, 20 bp, Artificial Sequence
  chemically synthesized
agtactctctctgatgtcct

SEQ ID NO: 497460 - DNA, 20 bp, Artificial Sequence
  chemically synthesized
atcattcacaggacatcaga

SEQ ID NO: 497461 - DNA, 20 bp, Artificial Sequence
  chemically synthesized
acatcagagagagtactcag

SEQ ID NO: 497462 - DNA, 20 bp, Artificial Sequence
  chemically synthesized
actactgaggcaaaaccctt

SEQ ID NO: 497463 - DNA, 20 bp, Artificial Sequence
  chemically synthesized
tggaaacaatttgatctttt

SEQ ID NO: 497464 - DNA, 20 bp, Artificial Sequence
  chemically synthesized
aaagatcaaattgtttccaa

SEQ ID NO: 497465 - DNA, 20 bp, Artificial Sequence
  chemically synthesized
tgtgttccagaacgaggttt

SEQ ID NO: 497466 - DNA, 20 bp, Artificial Sequence
  chemically synthesized
gaatatttatttcaatatat

SEQ ID NO: 497467 - DNA, 20 bp, Artificial Sequence
  chemically synthesized
ttgactatatgccagacatt

SEQ ID NO: 497468 - DNA, 20 bp, Artificial Sequence
  chemically synthesized
tgtgttgtttaactgcttct

SEQ ID NO: 497469 - DNA, 20 bp, Artificial Sequence
  chemically synthesized
taaatcaatttaaattaacc

SEQ ID NO: 497470 - DNA, 20 bp, Artificial Sequence
  chemically synthesized
ttttatcatctgtgtctatt

SEQ ID NO: 497471 - DNA, 20 bp, Artificial Sequence
  chemically synthesized
agatgataaaattagtagag

SEQ ID NO: 497472 - DNA, 20 bp, Artificial Sequence
  chemically synthesized
aatacagatataataactgt

SEQ ID NO: 497473 - DNA, 20 bp, Artificial Sequence
  chemically synthesized
tctttactttcttgactata

SEQ ID NO: 497474 - DNA, 20 bp, Artificial Sequence
  chemically synthesized
gaaagtaaagactgaacatg

SEQ ID NO: 497475 - DNA, 20 bp, Artificial Sequence
  chemically synthesized
tcatctcttagaagtaaaag

SEQ ID NO: 497476 - DNA, 20 bp, Artificial Sequence
  chemically synthesized
tgttaaaaatatatactaca

SEQ ID NO: 497477 - DNA, 20 bp, Artificial Sequence
  chemically synthesized
agacaatgaacataacatca

SEQ ID NO: 497478 - DNA, 20 bp, Artificial Sequence
  chemically synthesized
gagcctaataaatgtacaat

SEQ ID NO: 497479 - DNA, 20 bp, Artificial Sequence
  chemically synthesized
tcttgaagtcagttaagctc

SEQ ID NO: 497480 - DNA, 20 bp, Artificial Sequence
  chemically synthesized
tgtatgtagaaggttaacta

SEQ ID NO: 497481 - DNA, 20 bp, Artificial Sequence
  chemically synthesized
attttgctacatatttcagg

SEQ ID NO: 497482 - DNA, 20 bp, Artificial Sequence
  chemically synthesized
ttggaggatagttgttcagt

SEQ ID NO: 497483 - DNA, 20 bp, Artificial Sequence
  chemically synthesized
tactgaacaactatcctcca

SEQ ID NO: 497484 - DNA, 20 bp, Artificial Sequence
  chemically synthesized
aacaactatcctccaaagag

SEQ ID NO: 497485 - DNA, 20 bp, Artificial Sequence
  chemically synthesized
tacctccattctactctttg

SEQ ID NO: 497486 - DNA, 20 bp, Artificial Sequence
  chemically synthesized
aattgaaatatataactacc

SEQ ID NO: 497487 - DNA, 20 bp, Artificial Sequence
  chemically synthesized
aaatatataactaccttggg

SEQ ID NO: 497488 - DNA, 20 bp, Artificial Sequence
  chemically synthesized
tagagttatataaaatgttt

SEQ ID NO: 497489 - DNA, 20 bp, Artificial Sequence
  chemically synthesized
cctgagaggcagaaacatat

SEQ ID NO: 497490 - DNA, 20 bp, Artificial Sequence
  chemically synthesized
tttgggctaatgtagcataa

SEQ ID NO: 497491 - DNA, 20 bp, Artificial Sequence
  chemically synthesized
attttaaaaatagcactgaa

SEQ ID NO: 497492 - DNA, 20 bp, Artificial Sequence
  chemically synthesized
cttctatattaaagcagatt

SEQ ID NO: 497493 - DNA, 20 bp, Artificial Sequence
  chemically synthesized
tttgtatagagaggaaatgt

SEQ ID NO: 497494 - DNA, 20 bp, Artificial Sequence
  chemically synthesized
aaatatgccctttaatatta

SEQ ID NO: 497495 - DNA, 20 bp, Artificial Sequence
  chemically synthesized
tttactatggaaacatattt

SEQ ID NO: 497496 - DNA, 20 bp, Artificial Sequence
  chemically synthesized
tcaaatgtgatactgctttt

SEQ ID NO: 497497 - DNA, 20 bp, Artificial Sequence
  chemically synthesized
actttagatatttcaaaatg

SEQ ID NO: 497498 - DNA, 20 bp, Artificial Sequence
  chemically synthesized
ctaaagtatttaataaacta

SEQ ID NO: 497499 - DNA, 20 bp, Artificial Sequence
  chemically synthesized
caatagtcaatcaagtggat

SEQ ID NO: 497500 - DNA, 20 bp, Artificial Sequence
  chemically synthesized
atgttgcaatagtcaatcaa

SEQ ID NO: 497501 - DNA, 20 bp, Artificial Sequence
  chemically synthesized
taaagatagattagattgtc

SEQ ID NO: 497502 - DNA, 20 bp, Artificial Sequence
  chemically synthesized
atttcaacttgtggtgtcct

SEQ ID NO: 497503 - DNA, 20 bp, Artificial Sequence
  chemically synthesized
tgttaatagggaaacagcat

SEQ ID NO: 497504 - DNA, 20 bp, Artificial Sequence
  chemically synthesized
gtccagaggccaaaacaatg

SEQ ID NO: 497505 - DNA, 20 bp, Artificial Sequence
  chemically synthesized
ttcagaaggcattttgtcaa

SEQ ID NO: 497506 - DNA, 20 bp, Artificial Sequence
  chemically synthesized
agaactgtaattttatcatg

SEQ ID NO: 497507 - DNA, 20 bp, Artificial Sequence
  chemically synthesized
tgataaactgcaaaatataa

SEQ ID NO: 497508 - DNA, 20 bp, Artificial Sequence
  chemically synthesized
gactttttgtgtcaggatga

SEQ ID NO: 497509 - DNA, 20 bp, Artificial Sequence
  chemically synthesized
gtgctatggactttttgtgt

SEQ ID NO: 497510 - DNA, 20 bp, Artificial Sequence
  chemically synthesized
ttcttaaagatcaggttctg

SEQ ID NO: 497511 - DNA, 20 bp, Artificial Sequence
  chemically synthesized
acctgatctttaagaagtta

SEQ ID NO: 497512 - DNA, 20 bp, Artificial Sequence
  chemically synthesized
ttagcatgttcccaattctc

SEQ ID NO: 497513 - DNA, 20 bp, Artificial Sequence
  chemically synthesized
tcagaaagacacaaattcct

SEQ ID NO: 497514 - DNA, 20 bp, Artificial Sequence
  chemically synthesized
tcgcctgcaggtaaaagcat

SEQ ID NO: 497515 - DNA, 20 bp, Artificial Sequence
  chemically synthesized
atatggatcaagaaaaatag

SEQ ID NO: 497516 - DNA, 20 bp, Artificial Sequence
  chemically synthesized
ctgcaaatgcaggaaactat

SEQ ID NO: 497517 - DNA, 20 bp, Artificial Sequence
  chemically synthesized
ctgatagtttcctgcatttg

SEQ ID NO: 497518 - DNA, 20 bp, Artificial Sequence
  chemically synthesized
atttaaaatcagcttttata

SEQ ID NO: 497519 - DNA, 20 bp, Artificial Sequence
  chemically synthesized
ttgcaatttttccctttaaa

SEQ ID NO: 497520 - DNA, 20 bp, Artificial Sequence
  chemically synthesized
ttaagatatttgtaaatttc

SEQ ID NO: 497521 - DNA, 20 bp, Artificial Sequence
  chemically synthesized
tatccaaaaatattttgaaa

SEQ ID NO: 497522 - DNA, 20 bp, Artificial Sequence
  chemically synthesized
tattccctttcaaaatattt

SEQ ID NO: 497523 - DNA, 20 bp, Artificial Sequence
  chemically synthesized
aagaataatattgaaagtga

SEQ ID NO: 497524 - DNA, 20 bp, Artificial Sequence
  chemically synthesized
tgaacaggcagttttggatc

SEQ ID NO: 497525 - DNA, 20 bp, Artificial Sequence
  chemically synthesized
cagttgatgaacaggcagtt

SEQ ID NO: 497526 - DNA, 20 bp, Artificial Sequence
  chemically synthesized
ctgcctgttcatcaactgaa

SEQ ID NO: 497527 - DNA, 20 bp, Artificial Sequence
  chemically synthesized
tatatttcaaaatagtgaaa

SEQ ID NO: 497528 - DNA, 20 bp, Artificial Sequence
  chemically synthesized
aattataaatgtttgaggct

SEQ ID NO: 497529 - DNA, 20 bp, Artificial Sequence
  chemically synthesized
gtaataactatatgtattta

SEQ ID NO: 497530 - DNA, 20 bp, Artificial Sequence
  chemically synthesized
cagaatctttaatgatagtg

SEQ ID NO: 497531 - DNA, 20 bp, Artificial Sequence
  chemically synthesized
catcttattttaaatattga

SEQ ID NO: 497532 - DNA, 20 bp, Artificial Sequence
  chemically synthesized
cttacatgtgagcctacaat

SEQ ID NO: 497533 - DNA, 20 bp, Artificial Sequence
  chemically synthesized
agtgactacaataaaataag

SEQ ID NO: 497534 - DNA, 20 bp, Artificial Sequence
  chemically synthesized
tagtcactaaaattttagat

SEQ ID NO: 497535 - DNA, 20 bp, Artificial Sequence
  chemically synthesized
gtgttaatactacacatgga

SEQ ID NO: 497536 - DNA, 20 bp, Artificial Sequence
  chemically synthesized
tacctaagacagttgcacat

SEQ ID NO: 497537 - DNA, 20 bp, Artificial Sequence
  chemically synthesized
gttggtctggaatggagccc

SEQ ID NO: 497538 - DNA, 20 bp, Artificial Sequence
  chemically synthesized
aaatactgattaagttggtc

SEQ ID NO: 497539 - DNA, 20 bp, Artificial Sequence
  chemically synthesized
tgactgtacattgaaatcac

SEQ ID NO: 497540 - DNA, 20 bp, Artificial Sequence
  chemically synthesized
gcaccatagccggtaatctg

SEQ ID NO: 497541 - DNA, 20 bp, Artificial Sequence
  chemically synthesized
taccggctatggtgctgcct

SEQ ID NO: 497542 - DNA, 20 bp, Artificial Sequence
  chemically synthesized
atggtgctgcctcagagtac

SEQ ID NO: 497543 - DNA, 20 bp, Artificial Sequence
  chemically synthesized
gatccattgcttcttaagaa

SEQ ID NO: 497544 - DNA, 20 bp, Artificial Sequence
  chemically synthesized
agtatgatccattgcttctt

SEQ ID NO: 497545 - DNA, 20 bp, Artificial Sequence
  chemically synthesized
aactctattcttaagaagca

SEQ ID NO: 497546 - DNA, 20 bp, Artificial Sequence
  chemically synthesized
agaagcaatggatcatactt

SEQ ID NO: 497547 - DNA, 20 bp, Artificial Sequence
  chemically synthesized
tcagtcctctaccttcattc

SEQ ID NO: 497548 - DNA, 20 bp, Artificial Sequence
  chemically synthesized
tctagtgttactttaaattc

SEQ ID NO: 497549 - DNA, 20 bp, Artificial Sequence
  chemically synthesized
ctgatgtcctgggcagagaa

SEQ ID NO: 497550 - DNA, 20 bp, Artificial Sequence
  chemically synthesized
gaataataattgttatgctg

SEQ ID NO: 497551 - DNA, 20 bp, Artificial Sequence
  chemically synthesized
tgttttctccaatggaaaat

SEQ ID NO: 497552 - DNA, 20 bp, Artificial Sequence
  chemically synthesized
gccattgaaacaagagatat

SEQ ID NO: 497553 - DNA, 20 bp, Artificial Sequence
  chemically synthesized
tgtagatacattattaaatt

SEQ ID NO: 497554 - DNA, 20 bp, Artificial Sequence
  chemically synthesized
ataattattcattaaataca

SEQ ID NO: 497555 - DNA, 20 bp, Artificial Sequence
  chemically synthesized
cattgcactcattgtattta

SEQ ID NO: 497556 - DNA, 20 bp, Artificial Sequence
  chemically synthesized
tttttcactaactacagtta

SEQ ID NO: 497557 - DNA, 20 bp, Artificial Sequence
  chemically synthesized
aactgtagttagtgaaaaat

SEQ ID NO: 497558 - DNA, 20 bp, Artificial Sequence
  chemically synthesized
tttgatgatttatggtattc

SEQ ID NO: 497559 - DNA, 20 bp, Artificial Sequence
  chemically synthesized
atattgtatctgaataactc

SEQ ID NO: 497560 - DNA, 20 bp, Artificial Sequence
  chemically synthesized
tgtggaaggatatattgtat

SEQ ID NO: 497561 - DNA, 20 bp, Artificial Sequence
  chemically synthesized
gcaagatcattttgttgtgg

SEQ ID NO: 497562 - DNA, 20 bp, Artificial Sequence
  chemically synthesized
ttatataccattgaaaatat

SEQ ID NO: 497563 - DNA, 20 bp, Artificial Sequence
  chemically synthesized
taacacacaataaatgacct

SEQ ID NO: 497564 - DNA, 20 bp, Artificial Sequence
  chemically synthesized
taagtttattccctttaaaa

SEQ ID NO: 497565 - DNA, 20 bp, Artificial Sequence
  chemically synthesized
atgtgcaattcatttttaaa

SEQ ID NO: 497566 - DNA, 20 bp, Artificial Sequence
  chemically synthesized
gttacatgcatttgcatcac

SEQ ID NO: 497567 - DNA, 20 bp, Artificial Sequence
  chemically synthesized
catttgcatcactggagtca

SEQ ID NO: 497568 - DNA, 20 bp, Artificial Sequence
  chemically synthesized
ctggagtcaaagagttgctt

SEQ ID NO: 497569 - DNA, 20 bp, Artificial Sequence
  chemically synthesized
tcaaagagttgcttttgaat

SEQ ID NO: 497570 - DNA, 20 bp, Artificial Sequence
  chemically synthesized
tacaatgtgcttttcatatt

SEQ ID NO: 497571 - DNA, 20 bp, Artificial Sequence
  chemically synthesized
tgtggtagcaggaggagggt

SEQ ID NO: 497572 - DNA, 20 bp, Artificial Sequence
  chemically synthesized
tcagactgtggtagcaggag

SEQ ID NO: 497573 - DNA, 20 bp, Artificial Sequence
  chemically synthesized
actgatggttgctacaaagg

SEQ ID NO: 497574 - DNA, 20 bp, Artificial Sequence
  chemically synthesized
ggtaggaaaaacagcaaacc

SEQ ID NO: 497575 - DNA, 20 bp, Artificial Sequence
  chemically synthesized
caaaagtatagttcaagtga

SEQ ID NO: 497576 - DNA, 20 bp, Artificial Sequence
  chemically synthesized
taaatgcccattcttcattt

SEQ ID NO: 497577 - DNA, 20 bp, Artificial Sequence
  chemically synthesized
gtgtacaggatcctgaaatg

SEQ ID NO: 497578 - DNA, 20 bp, Artificial Sequence
  chemically synthesized
tcgaaaatctttgaggtgta

SEQ ID NO: 497579 - DNA, 20 bp, Artificial Sequence
  chemically synthesized
ggatggcaattaccaatatg

SEQ ID NO: 497580 - DNA, 20 bp, Artificial Sequence
  chemically synthesized
gggatttgttgaatttgata

SEQ ID NO: 497581 - DNA, 20 bp, Artificial Sequence
  chemically synthesized
cagggtgagagggggatttg

SEQ ID NO: 497582 - DNA, 20 bp, Artificial Sequence
  chemically synthesized
aaaagaattcagggtgagag

SEQ ID NO: 497583 - DNA, 20 bp, Artificial Sequence
  chemically synthesized
caacaaatccccctctcacc

SEQ ID NO: 497584 - DNA, 20 bp, Artificial Sequence
  chemically synthesized
ttgtaaaaaggaaaagaatt

SEQ ID NO: 497585 - DNA, 20 bp, Artificial Sequence
  chemically synthesized
agataacttgtaaaaaggaa

SEQ ID NO: 497586 - DNA, 20 bp, Artificial Sequence
  chemically synthesized
ttacggttttcttctcttgg

SEQ ID NO: 497587 - DNA, 20 bp, Artificial Sequence
  chemically synthesized
tcccaagagaagaaaaccgt

SEQ ID NO: 497588 - DNA, 20 bp, Artificial Sequence
  chemically synthesized
cagctctgtcttacagagct

SEQ ID NO: 497589 - DNA, 20 bp, Artificial Sequence
  chemically synthesized
ccaggcccacaagagggagg

SEQ ID NO: 497590 - DNA, 20 bp, Artificial Sequence
  chemically synthesized
acaagtcctaagacagtagc

SEQ ID NO: 497591 - DNA, 20 bp, Artificial Sequence
  chemically synthesized
ctgctactgtcttaggactt

SEQ ID NO: 497592 - DNA, 20 bp, Artificial Sequence
  chemically synthesized
gtccttgaggatgcaaaagt

SEQ ID NO: 497593 - DNA, 20 bp, Artificial Sequence
  chemically synthesized
gtcatttttattaggtcctt

SEQ ID NO: 497594 - DNA, 20 bp, Artificial Sequence
  chemically synthesized
tttattctttaatattttgt

SEQ ID NO: 497595 - DNA, 20 bp, Artificial Sequence
  chemically synthesized
actattcaaacaaaatatta

SEQ ID NO: 497596 - DNA, 20 bp, Artificial Sequence
  chemically synthesized
tacatgtgatgacacttaat

SEQ ID NO: 497597 - DNA, 20 bp, Artificial Sequence
  chemically synthesized
attttatgtgaggcttgaaa

SEQ ID NO: 497598 - DNA, 20 bp, Artificial Sequence
  chemically synthesized
agcacagtctaaatctattc

SEQ ID NO: 497599 - DNA, 20 bp, Artificial Sequence
  chemically synthesized
taattttacgtagtaaattc

SEQ ID NO: 497600 - DNA, 20 bp, Artificial Sequence
  chemically synthesized
tggaattttccttggtggaa

SEQ ID NO: 497601 - DNA, 20 bp, Artificial Sequence
  chemically synthesized
atatatatatttttttcatt

SEQ ID NO: 497602 - DNA, 20 bp, Artificial Sequence
  chemically synthesized
ctccattaattgggctgccc

SEQ ID NO: 497603 - DNA, 20 bp, Artificial Sequence
  chemically synthesized
caaaaattatatttgtttcc

SEQ ID NO: 497604 - DNA, 20 bp, Artificial Sequence
  chemically synthesized
tcttggcagtaagaagaaat

SEQ ID NO: 497605 - DNA, 20 bp, Artificial Sequence
  chemically synthesized
aaaaatgtcagtataaacat

SEQ ID NO: 497606 - DNA, 20 bp, Artificial Sequence
  chemically synthesized
gataataaatcaagtgattt

SEQ ID NO: 497607 - DNA, 20 bp, Artificial Sequence
  chemically synthesized
ataccggttgcacggtgaat

SEQ ID NO: 497608 - DNA, 20 bp, Artificial Sequence
  chemically synthesized
ttttaaataccggttgcacg

SEQ ID NO: 497609 - DNA, 20 bp, Artificial Sequence
  chemically synthesized
cctaaatgtaatttatgctt

SEQ ID NO: 497610 - DNA, 20 bp, Artificial Sequence
  chemically synthesized
tcaagcataaattacattta

SEQ ID NO: 497611 - DNA, 20 bp, Artificial Sequence
  chemically synthesized
ttaaagtatgccccagagta

SEQ ID NO: 497612 - DNA, 20 bp, Artificial Sequence
  chemically synthesized
gaaagtgttaaagtatgccc

SEQ ID NO: 497613 - DNA, 20 bp, Artificial Sequence
  chemically synthesized
atttatttaaatctatttca

SEQ ID NO: 497614 - DNA, 20 bp, Artificial Sequence
  chemically synthesized
tggatatgtcagaagtctac

SEQ ID NO: 497615 - DNA, 20 bp, Artificial Sequence
  chemically synthesized
gaccgaagtataaagcaaca

SEQ ID NO: 497616 - DNA, 20 bp, Artificial Sequence
  chemically synthesized
aaataatcagcagtccaatg

SEQ ID NO: 497617 - DNA, 20 bp, Artificial Sequence
  chemically synthesized
caaagatgaaatatgtggga

SEQ ID NO: 497618 - DNA, 20 bp, Artificial Sequence
  chemically synthesized
ctaatcaaagatgaaatatg

SEQ ID NO: 497619 - DNA, 20 bp, Artificial Sequence
  chemically synthesized
tcatggtccaaactgtatgt

SEQ ID NO: 497620 - DNA, 20 bp, Artificial Sequence
  chemically synthesized
tttgtattacttgggaagtt

SEQ ID NO: 497621 - DNA, 20 bp, Artificial Sequence
  chemically synthesized
taattgtgggagctcaataa

SEQ ID NO: 497622 - DNA, 20 bp, Artificial Sequence
  chemically synthesized
tattccaaagactattgaat

SEQ ID NO: 497623 - DNA, 20 bp, Artificial Sequence
  chemically synthesized
aattcaaattcaatagtctt

SEQ ID NO: 497624 - DNA, 20 bp, Artificial Sequence
  chemically synthesized
cacttgtattccaaagacta

SEQ ID NO: 497625 - DNA, 20 bp, Artificial Sequence
  chemically synthesized
tacaagtgatttttggttac

SEQ ID NO: 497626 - DNA, 20 bp, Artificial Sequence
  chemically synthesized
agtgatttttggttacatga

SEQ ID NO: 497627 - DNA, 20 bp, Artificial Sequence
  chemically synthesized
tggggtgtaatgtacactac

SEQ ID NO: 497628 - DNA, 20 bp, Artificial Sequence
  chemically synthesized
gagggataaaaaattacctt

SEQ ID NO: 497629 - DNA, 20 bp, Artificial Sequence
  chemically synthesized
ggcagagtgggaaggtagtg

SEQ ID NO: 497630 - DNA, 20 bp, Artificial Sequence
  chemically synthesized
accttcccactctgcccctt

SEQ ID NO: 497631 - DNA, 20 bp, Artificial Sequence
  chemically synthesized
ctttgaagactcagaagggg

SEQ ID NO: 497632 - DNA, 20 bp, Artificial Sequence
  chemically synthesized
cacaaaggcagacagagtgg

SEQ ID NO: 497633 - DNA, 20 bp, Artificial Sequence
  chemically synthesized
tgtaggtacacaaaggcaga

SEQ ID NO: 497634 - DNA, 20 bp, Artificial Sequence
  chemically synthesized
cagtatttggttttccattc

SEQ ID NO: 497635 - DNA, 20 bp, Artificial Sequence
  chemically synthesized
tattctaagtgaagtaattc

SEQ ID NO: 497636 - DNA, 20 bp, Artificial Sequence
  chemically synthesized
cattcctgaattacttcact

SEQ ID NO: 497637 - DNA, 20 bp, Artificial Sequence
  chemically synthesized
ttgcagcaactttgatggag

SEQ ID NO: 497638 - DNA, 20 bp, Artificial Sequence
  chemically synthesized
tatttcattattttctacgg

SEQ ID NO: 497639 - DNA, 20 bp, Artificial Sequence
  chemically synthesized
tagtattgcatggtatgtgg

SEQ ID NO: 497640 - DNA, 20 bp, Artificial Sequence
  chemically synthesized
aagtgccagccgaccaatga

SEQ ID NO: 497641 - DNA, 20 bp, Artificial Sequence
  chemically synthesized
tcctaagtgccagccgacca

SEQ ID NO: 497642 - DNA, 20 bp, Artificial Sequence
  chemically synthesized
ctcattggtcggctggcact

SEQ ID NO: 497643 - DNA, 20 bp, Artificial Sequence
  chemically synthesized
ggttccatatctttgcaact

SEQ ID NO: 497644 - DNA, 20 bp, Artificial Sequence
  chemically synthesized
gcaagtgtctttttgatata

SEQ ID NO: 497645 - DNA, 20 bp, Artificial Sequence
  chemically synthesized
cgattatgtacctagaggaa

SEQ ID NO: 497646 - DNA, 20 bp, Artificial Sequence
  chemically synthesized
ggttttgaatagattttgtt

SEQ ID NO: 497647 - DNA, 20 bp, Artificial Sequence
  chemically synthesized
caaaatctattcaaaacctc

SEQ ID NO: 497648 - DNA, 20 bp, Artificial Sequence
  chemically synthesized
tttgctgtatcccagaggtt

SEQ ID NO: 497649 - DNA, 20 bp, Artificial Sequence
  chemically synthesized
catcacacctgaaggaacta

SEQ ID NO: 497650 - DNA, 20 bp, Artificial Sequence
  chemically synthesized
caattttacttatcttttca

SEQ ID NO: 497651 - DNA, 20 bp, Artificial Sequence
  chemically synthesized
tcatttgtaactgagcttac

SEQ ID NO: 497652 - DNA, 20 bp, Artificial Sequence
  chemically synthesized
tctggcagtgttccacaagt

SEQ ID NO: 497653 - DNA, 20 bp, Artificial Sequence
  chemically synthesized
tgcaaataaaatgaccaaca

SEQ ID NO: 497654 - DNA, 20 bp, Artificial Sequence
  chemically synthesized
atgctagtgtctctctggtg

SEQ ID NO: 497655 - DNA, 20 bp, Artificial Sequence
  chemically synthesized
aaggaatttctaatttatgg

SEQ ID NO: 497656 - DNA, 20 bp, Artificial Sequence
  chemically synthesized
caagaaggaatttctaattt

SEQ ID NO: 497657 - DNA, 20 bp, Artificial Sequence
  chemically synthesized
aagaaggtaatttctcaaga

SEQ ID NO: 497658 - DNA, 20 bp, Artificial Sequence
  chemically synthesized
cattagcctgctgatgaaat

SEQ ID NO: 497659 - DNA, 20 bp, Artificial Sequence
  chemically synthesized
tctgaatcattatttcagca

SEQ ID NO: 497660 - DNA, 20 bp, Artificial Sequence
  chemically synthesized
agggataggcatggccaacc

SEQ ID NO: 497661 - DNA, 20 bp, Artificial Sequence
  chemically synthesized
atggttggccatgcctatcc

SEQ ID NO: 497662 - DNA, 20 bp, Artificial Sequence
  chemically synthesized
taaatatatgtaatgtactc

SEQ ID NO: 497663 - DNA, 20 bp, Artificial Sequence
  chemically synthesized
gatggtcaccatgggtttat

SEQ ID NO: 497664 - DNA, 20 bp, Artificial Sequence
  chemically synthesized
tggtctgggtgatggtcacc

SEQ ID NO: 497665 - DNA, 20 bp, Artificial Sequence
  chemically synthesized
tggaagttttatttcttggt

SEQ ID NO: 497666 - DNA, 20 bp, Artificial Sequence
  chemically synthesized
ttaatcttgaaactatgata

SEQ ID NO: 497667 - DNA, 20 bp, Artificial Sequence
  chemically synthesized
ttataacaaaatgcctgaga

SEQ ID NO: 497668 - DNA, 20 bp, Artificial Sequence
  chemically synthesized
cccagcctccagaactgtga

SEQ ID NO: 497669 - DNA, 20 bp, Artificial Sequence
  chemically synthesized
acttcccagcctccagaact

SEQ ID NO: 497670 - DNA, 20 bp, Artificial Sequence
  chemically synthesized
agggcaagagagcaagctga

SEQ ID NO: 497671 - DNA, 20 bp, Artificial Sequence
  chemically synthesized
ctgcgtgaagccttgtttat

SEQ ID NO: 497672 - DNA, 20 bp, Artificial Sequence
  chemically synthesized
aatgtgctagtactaagagg

SEQ ID NO: 497673 - DNA, 20 bp, Artificial Sequence
  chemically synthesized
tactagcacattatcgacac

SEQ ID NO: 497674 - DNA, 20 bp, Artificial Sequence
  chemically synthesized
atagtaaaatttgctatagt

SEQ ID NO: 497675 - DNA, 20 bp, Artificial Sequence
  chemically synthesized
atattccaggagacatgttt

SEQ ID NO: 497676 - DNA, 20 bp, Artificial Sequence
  chemically synthesized
acattcccaaacatgtctcc

SEQ ID NO: 497677 - DNA, 20 bp, Artificial Sequence
  chemically synthesized
tatgaacatatgcatttctg

SEQ ID NO: 497678 - DNA, 20 bp, Artificial Sequence
  chemically synthesized
gctataggttatgcagatct

SEQ ID NO: 497679 - DNA, 20 bp, Artificial Sequence
  chemically synthesized
aatttactaaatagtgccaa

SEQ ID NO: 497680 - DNA, 20 bp, Artificial Sequence
  chemically synthesized
aaaattacactactgcttct

SEQ ID NO: 497681 - DNA, 20 bp, Artificial Sequence
  chemically synthesized
cacacaatgttacttggtct

SEQ ID NO: 497682 - DNA, 20 bp, Artificial Sequence
  chemically synthesized
tgacaattccatgtggtggt

SEQ ID NO: 497683 - DNA, 20 bp, Artificial Sequence
  chemically synthesized
tgtatattctcaccaccaca

SEQ ID NO: 497684 - DNA, 20 bp, Artificial Sequence
  chemically synthesized
aaatatcactgcttaccaac

SEQ ID NO: 497685 - DNA, 20 bp, Artificial Sequence
  chemically synthesized
aaacggccaataaatatata

SEQ ID NO: 497686 - DNA, 20 bp, Artificial Sequence
  chemically synthesized
tttatatatttattggccgt

SEQ ID NO: 497687 - DNA, 20 bp, Artificial Sequence
  chemically synthesized
gcaatattctgtatcttgac

SEQ ID NO: 497688 - DNA, 20 bp, Artificial Sequence
  chemically synthesized
atgccatccaggtcaagata

SEQ ID NO: 497689 - DNA, 20 bp, Artificial Sequence
  chemically synthesized
gaacttttcccatttttcta

SEQ ID NO: 497690 - DNA, 20 bp, Artificial Sequence
  chemically synthesized
ttcttttctgaaagatttgt

SEQ ID NO: 497691 - DNA, 20 bp, Artificial Sequence
  chemically synthesized
tgtaggaattctttataatt

SEQ ID NO: 497692 - DNA, 20 bp, Artificial Sequence
  chemically synthesized
tgtgtgtattcataattata

SEQ ID NO: 497693 - DNA, 20 bp, Artificial Sequence
  chemically synthesized
ttatttggaatacacacata

SEQ ID NO: 497694 - DNA, 20 bp, Artificial Sequence
  chemically synthesized
acagagtaggataaattatt

SEQ ID NO: 497695 - DNA, 20 bp, Artificial Sequence
  chemically synthesized
caaataatttatcctactct

SEQ ID NO: 497696 - DNA, 20 bp, Artificial Sequence
  chemically synthesized
taaaaatgaaacccacagag

SEQ ID NO: 497697 - DNA, 20 bp, Artificial Sequence
  chemically synthesized
gagagtaaaaatgaaaccca

SEQ ID NO: 497698 - DNA, 20 bp, Artificial Sequence
  chemically synthesized
acatcaaaagacagcactga

SEQ ID NO: 497699 - DNA, 20 bp, Artificial Sequence
  chemically synthesized
caaatgatgaagcactaatc

SEQ ID NO: 497700 - DNA, 20 bp, Artificial Sequence
  chemically synthesized
ggagaatatgttaattaata

SEQ ID NO: 497701 - DNA, 20 bp, Artificial Sequence
  chemically synthesized
gcttttacagtaaaatagag

SEQ ID NO: 497702 - DNA, 20 bp, Artificial Sequence
  chemically synthesized
catgtcagtttttagtcacc

SEQ ID NO: 497703 - DNA, 20 bp, Artificial Sequence
  chemically synthesized
tttttgtatatagtttgaaa

SEQ ID NO: 497704 - DNA, 20 bp, Artificial Sequence
  chemically synthesized
ttttacctaaaaaattaaaa

SEQ ID NO: 497705 - DNA, 20 bp, Artificial Sequence
  chemically synthesized
aacagtgagagcagaactac

SEQ ID NO: 497706 - DNA, 20 bp, Artificial Sequence
  chemically synthesized
atatattgaaagcagtaaaa

SEQ ID NO: 497707 - DNA, 20 bp, Artificial Sequence
  chemically synthesized
gagttgtaaaaatatcagca

SEQ ID NO: 497708 - DNA, 20 bp, Artificial Sequence
  chemically synthesized
atgctgatatttttacaact

SEQ ID NO: 497709 - DNA, 20 bp, Artificial Sequence
  chemically synthesized
tacaaagtataatgtcaatc

SEQ ID NO: 497710 - DNA, 20 bp, Artificial Sequence
  chemically synthesized
aggattagggatcaataaaa

SEQ ID NO: 497711 - DNA, 20 bp, Artificial Sequence
  chemically synthesized
ctcacaacctagggaggatt

SEQ ID NO: 497712 - DNA, 20 bp, Artificial Sequence
  chemically synthesized
aacaaggctcacaacctagg

SEQ ID NO: 497713 - DNA, 20 bp, Artificial Sequence
  chemically synthesized
tctcaggcttcaaatacgtt

SEQ ID NO: 497714 - DNA, 20 bp, Artificial Sequence
  chemically synthesized
gaggggataaaggcatgaga

SEQ ID NO: 497715 - DNA, 20 bp, Artificial Sequence
  chemically synthesized
aagagaggggataaaggcat

SEQ ID NO: 497716 - DNA, 20 bp, Artificial Sequence
  chemically synthesized
gaatttcaacagcgaagaga

SEQ ID NO: 497717 - DNA, 20 bp, Artificial Sequence
  chemically synthesized
gaaataagggaaaaaatgtg

SEQ ID NO: 497718 - DNA, 20 bp, Artificial Sequence
  chemically synthesized
ataacttcacttattgcatt

SEQ ID NO: 497719 - DNA, 20 bp, Artificial Sequence
  chemically synthesized
atttatctttgctgtttatt

SEQ ID NO: 497720 - DNA, 20 bp, Artificial Sequence
  chemically synthesized
gtctccattaagcacagtag

SEQ ID NO: 497721 - DNA, 20 bp, Artificial Sequence
  chemically synthesized
ctactgtgcttaatggagac

SEQ ID NO: 497722 - DNA, 20 bp, Artificial Sequence
  chemically synthesized
ctaggatgtgttcccctcaa

SEQ ID NO: 497723 - DNA, 20 bp, Artificial Sequence
  chemically synthesized
acaagtttacctataaaaac

SEQ ID NO: 497724 - DNA, 20 bp, Artificial Sequence
  chemically synthesized
ttttgaacttcaaggcagag

SEQ ID NO: 497725 - DNA, 20 bp, Artificial Sequence
  chemically synthesized
cttttttttgaacttcaagg

SEQ ID NO: 497726 - DNA, 20 bp, Artificial Sequence
  chemically synthesized
tatacatggagcataagcaa

SEQ ID NO: 497727 - DNA, 20 bp, Artificial Sequence
  chemically synthesized
cataagcaaatggatatggc

SEQ ID NO: 497728 - DNA, 20 bp, Artificial Sequence
  chemically synthesized
cttgtttttgtaaagtagta

SEQ ID NO: 497729 - DNA, 20 bp, Artificial Sequence
  chemically synthesized
ctactttacaaaaacaagtg

SEQ ID NO: 497730 - DNA, 20 bp, Artificial Sequence
  chemically synthesized
tgtcataatcagcctagatt

SEQ ID NO: 497731 - DNA, 20 bp, Artificial Sequence
  chemically synthesized
ttcacatcaaatgttctgat

SEQ ID NO: 497732 - DNA, 20 bp, Artificial Sequence
  chemically synthesized
aagacttgcatgggaaaata

SEQ ID NO: 497733 - DNA, 20 bp, Artificial Sequence
  chemically synthesized
atgcaagtctttgatatgat

SEQ ID NO: 497734 - DNA, 20 bp, Artificial Sequence
  chemically synthesized
attacaatttaatatgagat

SEQ ID NO: 497735 - DNA, 20 bp, Artificial Sequence
  chemically synthesized
caggccccacctccaacatt

SEQ ID NO: 497736 - DNA, 20 bp, Artificial Sequence
  chemically synthesized
tggggcctggtgagaggtga

SEQ ID NO: 497737 - DNA, 20 bp, Artificial Sequence
  chemically synthesized
gtgagaggtgactggatcat

SEQ ID NO: 497738 - DNA, 20 bp, Artificial Sequence
  chemically synthesized
tttcatgaggacagtaccaa

SEQ ID NO: 497739 - DNA, 20 bp, Artificial Sequence
  chemically synthesized
ttggtactgtcctcatgaaa

SEQ ID NO: 497740 - DNA, 20 bp, Artificial Sequence
  chemically synthesized
tactgtcctcatgaaaatga

SEQ ID NO: 497741 - DNA, 20 bp, Artificial Sequence
  chemically synthesized
agagagagttggtggtgggg

SEQ ID NO: 497742 - DNA, 20 bp, Artificial Sequence
  chemically synthesized
agagagagagagttggtggt

SEQ ID NO: 497743 - DNA, 20 bp, Artificial Sequence
  chemically synthesized
acatggcgaaagcagagaga

SEQ ID NO: 497744 - DNA, 20 bp, Artificial Sequence
  chemically synthesized
cacctgctctgccttccacc

SEQ ID NO: 497745 - DNA, 20 bp, Artificial Sequence
  chemically synthesized
tatgcttcctgtagagcctg

SEQ ID NO: 497746 - DNA, 20 bp, Artificial Sequence
  chemically synthesized
ctataaagaaatacctgaga

SEQ ID NO: 497747 - DNA, 20 bp, Artificial Sequence
  chemically synthesized
gtatttctttatagcaatgc

SEQ ID NO: 497748 - DNA, 20 bp, Artificial Sequence
  chemically synthesized
actaaaattaaaactaagga

SEQ ID NO: 497749 - DNA, 20 bp, Artificial Sequence
  chemically synthesized
ttaaagagtcatttctggtt

SEQ ID NO: 497750 - DNA, 20 bp, Artificial Sequence
  chemically synthesized
agagagaagaggctaaatta

SEQ ID NO: 497751 - DNA, 20 bp, Artificial Sequence
  chemically synthesized
tatgctgaggaaaagttatt

SEQ ID NO: 497752 - DNA, 20 bp, Artificial Sequence
  chemically synthesized
gaaaatagggagagatgagt

SEQ ID NO: 497753 - DNA, 20 bp, Artificial Sequence
  chemically synthesized
gaaaccgaaaatagggagag

SEQ ID NO: 497754 - DNA, 20 bp, Artificial Sequence
  chemically synthesized
cagtatacatggtgggctat

SEQ ID NO: 497755 - DNA, 20 bp, Artificial Sequence
  chemically synthesized
caaaaggcccacagtaaaaa

SEQ ID NO: 497756 - DNA, 20 bp, Artificial Sequence
  chemically synthesized
gtgggccttttgctgtattt

SEQ ID NO: 497757 - DNA, 20 bp, Artificial Sequence
  chemically synthesized
tggaatagtgacattttaga

SEQ ID NO: 497758 - DNA, 20 bp, Artificial Sequence
  chemically synthesized
tccaagggagagaagcctta

SEQ ID NO: 497759 - DNA, 20 bp, Artificial Sequence
  chemically synthesized
tccataaggcttctctccct

SEQ ID NO: 497760 - DNA, 20 bp, Artificial Sequence
  chemically synthesized
ccagtacactatgtacctct

SEQ ID NO: 497761 - DNA, 20 bp, Artificial Sequence
  chemically synthesized
ggaagatgttttatgcacct

SEQ ID NO: 497762 - DNA, 20 bp, Artificial Sequence
  chemically synthesized
caggaacagcgcttagtacc

SEQ ID NO: 497763 - DNA, 20 bp, Artificial Sequence
  chemically synthesized
ttcctggtacatgataaatg

SEQ ID NO: 497764 - DNA, 20 bp, Artificial Sequence
  chemically synthesized
tgttgaatacattttaataa

SEQ ID NO: 497765 - DNA, 20 bp, Artificial Sequence
  chemically synthesized
gaatacattttaataactga

SEQ ID NO: 497766 - DNA, 20 bp, Artificial Sequence
  chemically synthesized
acattttaataactgaatga

SEQ ID NO: 497767 - DNA, 20 bp, Artificial Sequence
  chemically synthesized
atgaatgaataaaaaagtcc

SEQ ID NO: 497768 - DNA, 20 bp, Artificial Sequence
  chemically synthesized
gctcttaaatggaagatata

SEQ ID NO: 497769 - DNA, 20 bp, Artificial Sequence
  chemically synthesized
atatcttccatttaagagcc

SEQ ID NO: 497770 - DNA, 20 bp, Artificial Sequence
  chemically synthesized
catttaagagccatgaatgc

SEQ ID NO: 497771 - DNA, 20 bp, Artificial Sequence
  chemically synthesized
ttggatacactattttacct

SEQ ID NO: 497772 - DNA, 20 bp, Artificial Sequence
  chemically synthesized
agttatctcacacataaacc

SEQ ID NO: 497773 - DNA, 20 bp, Artificial Sequence
  chemically synthesized
atgaggtaggcagtattatt

SEQ ID NO: 497774 - DNA, 20 bp, Artificial Sequence
  chemically synthesized
ctttcatcctcctgaaaaag

SEQ ID NO: 497775 - DNA, 20 bp, Artificial Sequence
  chemically synthesized
acctcattcagctttttcag

SEQ ID NO: 497776 - DNA, 20 bp, Artificial Sequence
  chemically synthesized
ttttattgctatttataact

SEQ ID NO: 497777 - DNA, 20 bp, Artificial Sequence
  chemically synthesized
ataaatttttaataccgaca

SEQ ID NO: 497778 - DNA, 20 bp, Artificial Sequence
  chemically synthesized
tttaataccgacacagaatt

SEQ ID NO: 497779 - DNA, 20 bp, Artificial Sequence
  chemically synthesized
ttgctaaattatttatcttt

SEQ ID NO: 497780 - DNA, 20 bp, Artificial Sequence
  chemically synthesized
aagttcaacaccatcctaaa

SEQ ID NO: 497781 - DNA, 20 bp, Artificial Sequence
  chemically synthesized
tgtgcaaagtgtattctttt

SEQ ID NO: 497782 - DNA, 20 bp, Artificial Sequence
  chemically synthesized
ctgagacctaatttaaatat

SEQ ID NO: 497783 - DNA, 20 bp, Artificial Sequence
  chemically synthesized
gggactgtgactcttttaag

SEQ ID NO: 497784 - DNA, 20 bp, Artificial Sequence
  chemically synthesized
gtttaaaacactcaccttaa

SEQ ID NO: 497785 - DNA, 20 bp, Artificial Sequence
  chemically synthesized
atgctattgacttctttagg

SEQ ID NO: 497786 - DNA, 20 bp, Artificial Sequence
  chemically synthesized
aataatgctattgacttctt

SEQ ID NO: 497787 - DNA, 20 bp, Artificial Sequence
  chemically synthesized
cattatttaaaaacagatga

SEQ ID NO: 497788 - DNA, 20 bp, Artificial Sequence
  chemically synthesized
taaaaacagatgattggata

SEQ ID NO: 497789 - DNA, 20 bp, Artificial Sequence
  chemically synthesized
attcacacacatataaataa

SEQ ID NO: 497790 - DNA, 20 bp, Artificial Sequence
  chemically synthesized
attcttttatttatatgtgt

SEQ ID NO: 497791 - DNA, 20 bp, Artificial Sequence
  chemically synthesized
ttttatttatatgtgtgtga

SEQ ID NO: 497792 - DNA, 20 bp, Artificial Sequence
  chemically synthesized
cacaatggaatactacacaa

SEQ ID NO: 497793 - DNA, 20 bp, Artificial Sequence
  chemically synthesized
aagctaggatagacacacaa

SEQ ID NO: 497794 - DNA, 20 bp, Artificial Sequence
  chemically synthesized
atatgcttagacttagaagc

SEQ ID NO: 497795 - DNA, 20 bp, Artificial Sequence
  chemically synthesized
acacacacacaaattgcgta

SEQ ID NO: 497796 - DNA, 20 bp, Artificial Sequence
  chemically synthesized
aatactacaaagccatagta

SEQ ID NO: 497797 - DNA, 20 bp, Artificial Sequence
  chemically synthesized
atcatgtcttttgcagcaac

SEQ ID NO: 497798 - DNA, 20 bp, Artificial Sequence
  chemically synthesized
gaactggtggtcatcttaag

SEQ ID NO: 497799 - DNA, 20 bp, Artificial Sequence
  chemically synthesized
caatatttgactttctgttt

SEQ ID NO: 497800 - DNA, 20 bp, Artificial Sequence
  chemically synthesized
ataatgtgtacacatgcgca

SEQ ID NO: 497801 - DNA, 20 bp, Artificial Sequence
  chemically synthesized
gtacacatgcgcacagagtg

SEQ ID NO: 497802 - DNA, 20 bp, Artificial Sequence
  chemically synthesized
catcccaccctctcgccctt

SEQ ID NO: 497803 - DNA, 20 bp, Artificial Sequence
  chemically synthesized
ctggagactcagaagggcga

SEQ ID NO: 497804 - DNA, 20 bp, Artificial Sequence
  chemically synthesized
gactcagaagggcgagaggg

SEQ ID NO: 497805 - DNA, 20 bp, Artificial Sequence
  chemically synthesized
gagagggtgggatgggggcg

SEQ ID NO: 497806 - DNA, 20 bp, Artificial Sequence
  chemically synthesized
aaaggtacatcatttgcatg

SEQ ID NO: 497807 - DNA, 20 bp, Artificial Sequence
  chemically synthesized
tttgttacatggatatattg

SEQ ID NO: 497808 - DNA, 20 bp, Artificial Sequence
  chemically synthesized
tacaagtacatttttgttac

SEQ ID NO: 497809 - DNA, 20 bp, Artificial Sequence
  chemically synthesized
agtgataacctgaattgttt

SEQ ID NO: 497810 - DNA, 20 bp, Artificial Sequence
  chemically synthesized
ttaatagtcttagtgataac

SEQ ID NO: 497811 - DNA, 20 bp, Artificial Sequence
  chemically synthesized
aacaacactttagaaatcta

SEQ ID NO: 497812 - DNA, 20 bp, Artificial Sequence
  chemically synthesized
tctagagatttaagcccaat

SEQ ID NO: 497813 - DNA, 20 bp, Artificial Sequence
  chemically synthesized
acacatatcagaaacttggc

SEQ ID NO: 497814 - DNA, 20 bp, Artificial Sequence
  chemically synthesized
tgttttcccctaagccaaaa

SEQ ID NO: 497815 - DNA, 20 bp, Artificial Sequence
  chemically synthesized
agtacttatcaatttatctc

SEQ ID NO: 497816 - DNA, 20 bp, Artificial Sequence
  chemically synthesized
agaaatgaatctctaactat

SEQ ID NO: 497817 - DNA, 20 bp, Artificial Sequence
  chemically synthesized
taccaagcataggtaaagaa

SEQ ID NO: 497818 - DNA, 20 bp, Artificial Sequence
  chemically synthesized
tgctttctttgttattacta

SEQ ID NO: 497819 - DNA, 20 bp, Artificial Sequence
  chemically synthesized
agaagggcaaagaaaatttg

SEQ ID NO: 497820 - DNA, 20 bp, Artificial Sequence
  chemically synthesized
tgaatatttttccatcatga

SEQ ID NO: 497821 - DNA, 20 bp, Artificial Sequence
  chemically synthesized
catcatgatggaaaaatatt

SEQ ID NO: 497822 - DNA, 20 bp, Artificial Sequence
  chemically synthesized
cagtgcaggaatagtacacc

SEQ ID NO: 497823 - DNA, 20 bp, Artificial Sequence
  chemically synthesized
tattttttcagaagcagtgc

SEQ ID NO: 497824 - DNA, 20 bp, Artificial Sequence
  chemically synthesized
actgcttctgaaaaaatatg

SEQ ID NO: 497825 - DNA, 20 bp, Artificial Sequence
  chemically synthesized
tgctactttgggtattttta

SEQ ID NO: 497826 - DNA, 20 bp, Artificial Sequence
  chemically synthesized
agcaaactatttctgctact

SEQ ID NO: 497827 - DNA, 20 bp, Artificial Sequence
  chemically synthesized
aaattatttaacttagcctg

SEQ ID NO: 497828 - DNA, 20 bp, Artificial Sequence
  chemically synthesized
tttaaactgacatactctct

SEQ ID NO: 497829 - DNA, 20 bp, Artificial Sequence
  chemically synthesized
ttgaatatatcaaatcctca

SEQ ID NO: 497830 - DNA, 20 bp, Artificial Sequence
  chemically synthesized
tctgaggatttgatatattc

SEQ ID NO: 497831 - DNA, 20 bp, Artificial Sequence
  chemically synthesized
acattttataaaggagaccc

SEQ ID NO: 497832 - DNA, 20 bp, Artificial Sequence
  chemically synthesized
tataaaatgtgagcatttaa

SEQ ID NO: 497833 - DNA, 20 bp, Artificial Sequence
  chemically synthesized
ttcatgtggactatatagta

SEQ ID NO: 497834 - DNA, 20 bp, Artificial Sequence
  chemically synthesized
tactatatagtccacatgaa

SEQ ID NO: 497835 - DNA, 20 bp, Artificial Sequence
  chemically synthesized
gaaagctaagacttggaagc

SEQ ID NO: 497836 - DNA, 20 bp, Artificial Sequence
  chemically synthesized
gctttcatttgttggctaga

SEQ ID NO: 497837 - DNA, 20 bp, Artificial Sequence
  chemically synthesized
ctattatatatgttttgtgt

SEQ ID NO: 497838 - DNA, 20 bp, Artificial Sequence
  chemically synthesized
ggttgcttttgctcctattt

SEQ ID NO: 497839 - DNA, 20 bp, Artificial Sequence
  chemically synthesized
acttaatctgaagttttaat

SEQ ID NO: 497840 - DNA, 20 bp, Artificial Sequence
  chemically synthesized
gtacctaccccaaggtgctg

SEQ ID NO: 497841 - DNA, 20 bp, Artificial Sequence
  chemically synthesized
aaatatactccacagcacct

SEQ ID NO: 497842 - DNA, 20 bp, Artificial Sequence
  chemically synthesized
tcagttttctcatttgcaaa

SEQ ID NO: 497843 - DNA, 20 bp, Artificial Sequence
  chemically synthesized
aatgagaaaactgagacttt

SEQ ID NO: 497844 - DNA, 20 bp, Artificial Sequence
  chemically synthesized
taacttgtatgtttctaatc

SEQ ID NO: 497845 - DNA, 20 bp, Artificial Sequence
  chemically synthesized
aatgcaagacaataacatag

SEQ ID NO: 497846 - DNA, 20 bp, Artificial Sequence
  chemically synthesized
agacaataacatagctgaat

SEQ ID NO: 497847 - DNA, 20 bp, Artificial Sequence
  chemically synthesized
ttgttttttttaagtgtcat

SEQ ID NO: 497848 - DNA, 20 bp, Artificial Sequence
  chemically synthesized
atagtatattataggagaag

SEQ ID NO: 497849 - DNA, 20 bp, Artificial Sequence
  chemically synthesized
acaacatgatttatttccaa

SEQ ID NO: 497850 - DNA, 20 bp, Artificial Sequence
  chemically synthesized
ggaaataaatcatgttgtta

SEQ ID NO: 497851 - DNA, 20 bp, Artificial Sequence
  chemically synthesized
aatttcatgatcagaaacac

SEQ ID NO: 497852 - DNA, 20 bp, Artificial Sequence
  chemically synthesized
tcatgaaatttatatttcaa

SEQ ID NO: 497853 - DNA, 20 bp, Artificial Sequence
  chemically synthesized
gaaatttatatttcaaagga

SEQ ID NO: 497854 - DNA, 20 bp, Artificial Sequence
  chemically synthesized
gagaaattccattttgattt

SEQ ID NO: 497855 - DNA, 20 bp, Artificial Sequence
  chemically synthesized
ctcatactctcaaatcaaaa

SEQ ID NO: 497856 - DNA, 20 bp, Artificial Sequence
  chemically synthesized
ccaaaagatgaagaaccacc

SEQ ID NO: 497857 - DNA, 20 bp, Artificial Sequence
  chemically synthesized
agcaacgatactttaagaaa

SEQ ID NO: 497858 - DNA, 20 bp, Artificial Sequence
  chemically synthesized
agagtgttattaaagagggg

SEQ ID NO: 497859 - DNA, 20 bp, Artificial Sequence
  chemically synthesized
tttaataacactctttttat

SEQ ID NO: 497860 - DNA, 20 bp, Artificial Sequence
  chemically synthesized
aaaataatcaccctaataaa

SEQ ID NO: 497861 - DNA, 20 bp, Artificial Sequence
  chemically synthesized
tcattaaggtggttacaaaa

SEQ ID NO: 497862 - DNA, 20 bp, Artificial Sequence
  chemically synthesized
atatatatatatatatctca

SEQ ID NO: 497863 - DNA, 20 bp, Artificial Sequence
  chemically synthesized
tatatatatatataaaatca

SEQ ID NO: 497864 - DNA, 20 bp, Artificial Sequence
  chemically synthesized
tatataaaatcaaagagttt

SEQ ID NO: 497865 - DNA, 20 bp, Artificial Sequence
  chemically synthesized
ttcatggtggcgatggtttt

SEQ ID NO: 497866 - DNA, 20 bp, Artificial Sequence
  chemically synthesized
aaaggggacaagaggaaatt

SEQ ID NO: 497867 - DNA, 20 bp, Artificial Sequence
  chemically synthesized
tatgctgtataatagatctc

SEQ ID NO: 497868 - DNA, 20 bp, Artificial Sequence
  chemically synthesized
attctttaaagcaggacaaa

SEQ ID NO: 497869 - DNA, 20 bp, Artificial Sequence
  chemically synthesized
actccttttgtcctgcttta

SEQ ID NO: 497870 - DNA, 20 bp, Artificial Sequence
  chemically synthesized
gacactaatgtaaattagag

SEQ ID NO: 497871 - DNA, 20 bp, Artificial Sequence
  chemically synthesized
gtaatgacactaatgtaaat

SEQ ID NO: 497872 - DNA, 20 bp, Artificial Sequence
  chemically synthesized
aaccacactaaatgctccct

SEQ ID NO: 497873 - DNA, 20 bp, Artificial Sequence
  chemically synthesized
ccctaagggtagaaactata

SEQ ID NO: 497874 - DNA, 20 bp, Artificial Sequence
  chemically synthesized
aaaattacttatggataaat

SEQ ID NO: 497875 - DNA, 20 bp, Artificial Sequence
  chemically synthesized
tatttgtattaaaattactt

SEQ ID NO: 497876 - DNA, 20 bp, Artificial Sequence
  chemically synthesized
ataattggtatccacttcaa

SEQ ID NO: 497877 - DNA, 20 bp, Artificial Sequence
  chemically synthesized
agaaggtatactcatttgaa

SEQ ID NO: 497878 - DNA, 20 bp, Artificial Sequence
  chemically synthesized
ttgttttgttatttttgaga

SEQ ID NO: 497879 - DNA, 20 bp, Artificial Sequence
  chemically synthesized
tctcgctctgtcaaccaggc

SEQ ID NO: 497880 - DNA, 20 bp, Artificial Sequence
  chemically synthesized
ctttctcccgcctcagcttc

SEQ ID NO: 497881 - DNA, 20 bp, Artificial Sequence
  chemically synthesized
tttgtattttttagtagaga

SEQ ID NO: 497882 - DNA, 20 bp, Artificial Sequence
  chemically synthesized
actttgggaggccgaggcag

SEQ ID NO: 497883 - DNA, 20 bp, Artificial Sequence
  chemically synthesized
gcctcggcctcccaaagtgc

SEQ ID NO: 497884 - DNA, 20 bp, Artificial Sequence
  chemically synthesized
atactaaaagatgatacttt

SEQ ID NO: 497885 - DNA, 20 bp, Artificial Sequence
  chemically synthesized
aaatttgaagacaagcaaac

SEQ ID NO: 497886 - DNA, 20 bp, Artificial Sequence
  chemically synthesized
agcactgttaggcaataaaa

SEQ ID NO: 497887 - DNA, 20 bp, Artificial Sequence
  chemically synthesized
gtgatttaatttcctgattt

SEQ ID NO: 497888 - DNA, 20 bp, Artificial Sequence
  chemically synthesized
taggcataatatatatttca

SEQ ID NO: 497889 - DNA, 20 bp, Artificial Sequence
  chemically synthesized
atatttcacagggttgttat

SEQ ID NO: 497890 - DNA, 20 bp, Artificial Sequence
  chemically synthesized
attatatactgtatatatat

SEQ ID NO: 497891 - DNA, 20 bp, Artificial Sequence
  chemically synthesized
tcaaatacatgtacacatat

SEQ ID NO: 497892 - DNA, 20 bp, Artificial Sequence
  chemically synthesized
tatgaatattttcaatatct

SEQ ID NO: 497893 - DNA, 20 bp, Artificial Sequence
  chemically synthesized
accaaaacaattacagtaaa

SEQ ID NO: 497894 - DNA, 20 bp, Artificial Sequence
  chemically synthesized
aaaagccattttattttaaa

SEQ ID NO: 497895 - DNA, 20 bp, Artificial Sequence
  chemically synthesized
tatcttcccaaaagtatggt

SEQ ID NO: 497896 - DNA, 20 bp, Artificial Sequence
  chemically synthesized
cccaaaagtatggtgagaat

SEQ ID NO: 497897 - DNA, 20 bp, Artificial Sequence
  chemically synthesized
gaatacgaattccaaatatg

SEQ ID NO: 497898 - DNA, 20 bp, Artificial Sequence
  chemically synthesized
ttattcatactccgcatatt

SEQ ID NO: 497899 - DNA, 20 bp, Artificial Sequence
  chemically synthesized
gaattccaaatatgcggagt

SEQ ID NO: 497900 - DNA, 20 bp, Artificial Sequence
  chemically synthesized
attttttatggccaaagaaa

SEQ ID NO: 497901 - DNA, 20 bp, Artificial Sequence
  chemically synthesized
attaagatctctgtctatct

SEQ ID NO: 497902 - DNA, 20 bp, Artificial Sequence
  chemically synthesized
agaataaagctaagtaaaaa

SEQ ID NO: 497903 - DNA, 20 bp, Artificial Sequence
  chemically synthesized
agaaaatagaatttcccgtt

SEQ ID NO: 497904 - DNA, 20 bp, Artificial Sequence
  chemically synthesized
aatagtagtaagagagaaaa

SEQ ID NO: 497905 - DNA, 20 bp, Artificial Sequence
  chemically synthesized
gtgagagaaaatagagaaag

SEQ ID NO: 497906 - DNA, 20 bp, Artificial Sequence
  chemically synthesized
tggaaaattattttataatt

SEQ ID NO: 497907 - DNA, 20 bp, Artificial Sequence
  chemically synthesized
ccaacttataaaagtaaaat

SEQ ID NO: 497908 - DNA, 20 bp, Artificial Sequence
  chemically synthesized
ccaattttacttttataagt

SEQ ID NO: 497909 - DNA, 20 bp, Artificial Sequence
  chemically synthesized
tatagtattattgaaaaagg

SEQ ID NO: 497910 - DNA, 20 bp, Artificial Sequence
  chemically synthesized
gagacatgacctattctgcc

SEQ ID NO: 497911 - DNA, 20 bp, Artificial Sequence
  chemically synthesized
cttatgggtgcaactcccgg

SEQ ID NO: 497912 - DNA, 20 bp, Artificial Sequence
  chemically synthesized
ggacccgttccctctgcctt

SEQ ID NO: 497913 - DNA, 20 bp, Artificial Sequence
  chemically synthesized
gcacccataaggcagaggga

SEQ ID NO: 497914 - DNA, 20 bp, Artificial Sequence
  chemically synthesized
tatgccaggggccccttatt

SEQ ID NO: 497915 - DNA, 20 bp, Artificial Sequence
  chemically synthesized
gctgtaaggctaattttagt

SEQ ID NO: 497916 - DNA, 20 bp, Artificial Sequence
  chemically synthesized
actgacaccataaacattaa

SEQ ID NO: 497917 - DNA, 20 bp, Artificial Sequence
  chemically synthesized
gctagggagtgggtaggagt

SEQ ID NO: 497918 - DNA, 20 bp, Artificial Sequence
  chemically synthesized
atacaggctagggagtgggt

SEQ ID NO: 497919 - DNA, 20 bp, Artificial Sequence
  chemically synthesized
agttacatacaggctaggga

SEQ ID NO: 497920 - DNA, 20 bp, Artificial Sequence
  chemically synthesized
ccacagttacatacaggcta

SEQ ID NO: 497921 - DNA, 20 bp, Artificial Sequence
  chemically synthesized
ctgtgggagcagggcagttc

SEQ ID NO: 497922 - DNA, 20 bp, Artificial Sequence
  chemically synthesized
ttgacttagagctgctatac

SEQ ID NO: 497923 - DNA, 20 bp, Artificial Sequence
  chemically synthesized
cacatctgacttactacctt

SEQ ID NO: 497924 - DNA, 20 bp, Artificial Sequence
  chemically synthesized
gcacctgtgttttaataaga

SEQ ID NO: 497925 - DNA, 20 bp, Artificial Sequence
  chemically synthesized
tgtgggaaagaaaaaattta

SEQ ID NO: 497926 - DNA, 20 bp, Artificial Sequence
  chemically synthesized
aggcacatgtctaaacctgt

SEQ ID NO: 497927 - DNA, 20 bp, Artificial Sequence
  chemically synthesized
aaacacctaaaatgatagaa

SEQ ID NO: 497928 - DNA, 20 bp, Artificial Sequence
  chemically synthesized
aagcaacattttaaaaaata

SEQ ID NO: 497929 - DNA, 20 bp, Artificial Sequence
  chemically synthesized
aagcatttctagtgagcttt

SEQ ID NO: 497930 - DNA, 20 bp, Artificial Sequence
  chemically synthesized
tttatcaaaagattgagtaa

SEQ ID NO: 497931 - DNA, 20 bp, Artificial Sequence
  chemically synthesized
aataaatgtttatcaaaaga

SEQ ID NO: 497932 - DNA, 20 bp, Artificial Sequence
  chemically synthesized
gtcctgaggctagcagtgtg

SEQ ID NO: 497933 - DNA, 20 bp, Artificial Sequence
  chemically synthesized
ctttttcagctttacacctt

SEQ ID NO: 497934 - DNA, 20 bp, Artificial Sequence
  chemically synthesized
tagttgcacagtattttaag

SEQ ID NO: 497935 - DNA, 20 bp, Artificial Sequence
  chemically synthesized
tgacttccaaatgccagcat

SEQ ID NO: 497936 - DNA, 20 bp, Artificial Sequence
  chemically synthesized
catttggatttcattaccta

SEQ ID NO: 497937 - DNA, 20 bp, Artificial Sequence
  chemically synthesized
aggtctgatgctgatgttac

SEQ ID NO: 497938 - DNA, 20 bp, Artificial Sequence
  chemically synthesized
ttttcaaccagtggcatgga

SEQ ID NO: 497939 - DNA, 20 bp, Artificial Sequence
  chemically synthesized
gatcaacattatgaaggttc

SEQ ID NO: 497940 - DNA, 20 bp, Artificial Sequence
  chemically synthesized
gttcatgaatatcaaagttt

SEQ ID NO: 497941 - DNA, 20 bp, Artificial Sequence
  chemically synthesized
gcagaagtagtttattgcaa

SEQ ID NO: 497942 - DNA, 20 bp, Artificial Sequence
  chemically synthesized
aaaaaaacttcttggagggg

SEQ ID NO: 497943 - DNA, 20 bp, Artificial Sequence
  chemically synthesized
attgtaccaggaagtggatt

SEQ ID NO: 497944 - DNA, 20 bp, Artificial Sequence
  chemically synthesized
aaaagaaattgtaccaggaa

SEQ ID NO: 497945 - DNA, 20 bp, Artificial Sequence
  chemically synthesized
ttcgctcttgttgccccagc

SEQ ID NO: 497946 - DNA, 20 bp, Artificial Sequence
  chemically synthesized
ctcaccacaacctatgcctc

SEQ ID NO: 497947 - DNA, 20 bp, Artificial Sequence
  chemically synthesized
tactcaggaggctaaggcaa

SEQ ID NO: 497948 - DNA, 20 bp, Artificial Sequence
  chemically synthesized
gattctcttgccttagcctc

SEQ ID NO: 497949 - DNA, 20 bp, Artificial Sequence
  chemically synthesized
gccttagcctcctgagtagc

SEQ ID NO: 497950 - DNA, 20 bp, Artificial Sequence
  chemically synthesized
aattttgtattttaagtaga

SEQ ID NO: 497951 - DNA, 20 bp, Artificial Sequence
  chemically synthesized
tgggcggatcacctgaggtc

SEQ ID NO: 497952 - DNA, 20 bp, Artificial Sequence
  chemically synthesized
actttgagagaccaaggtgg

SEQ ID NO: 497953 - DNA, 20 bp, Artificial Sequence
  chemically synthesized
accttggtctctcaaagtgc

SEQ ID NO: 497954 - DNA, 20 bp, Artificial Sequence
  chemically synthesized
aaagtgctgggattacaggc

SEQ ID NO: 497955 - DNA, 20 bp, Artificial Sequence
  chemically synthesized
gcctaagaaattgtaccggg

SEQ ID NO: 497956 - DNA, 20 bp, Artificial Sequence
  chemically synthesized
agctgccgaaatcgcagttg

SEQ ID NO: 497957 - DNA, 20 bp, Artificial Sequence
  chemically synthesized
tgcttctcaagagccatggt

SEQ ID NO: 497958 - DNA, 20 bp, Artificial Sequence
  chemically synthesized
agacagcagggacggcagtg

SEQ ID NO: 497959 - DNA, 20 bp, Artificial Sequence
  chemically synthesized
catgaccacgagagaccaga

SEQ ID NO: 497960 - DNA, 20 bp, Artificial Sequence
  chemically synthesized
tgaactataatctcacagac

SEQ ID NO: 497961 - DNA, 20 bp, Artificial Sequence
  chemically synthesized
aaaggaaggttttagttatg

SEQ ID NO: 497962 - DNA, 20 bp, Artificial Sequence
  chemically synthesized
gttgggtcaggaaaagacag

SEQ ID NO: 497963 - DNA, 20 bp, Artificial Sequence
  chemically synthesized
attttgtaagctataaagaa

SEQ ID NO: 497964 - DNA, 20 bp, Artificial Sequence
  chemically synthesized
agaagggggtggtgagaagt

SEQ ID NO: 497965 - DNA, 20 bp, Artificial Sequence
  chemically synthesized
tttgcaaacttgctgtacaa

SEQ ID NO: 497966 - DNA, 20 bp, Artificial Sequence
  chemically synthesized
gctgtacaatggagtcatcc

SEQ ID NO: 497967 - DNA, 20 bp, Artificial Sequence
  chemically synthesized
gtattttttttttaagatcc

SEQ ID NO: 497968 - DNA, 20 bp, Artificial Sequence
  chemically synthesized
ctggccatgtcccaaatcag

SEQ ID NO: 497969 - DNA, 20 bp, Artificial Sequence
  chemically synthesized
ttgggacatggccagggcat

SEQ ID NO: 497970 - DNA, 20 bp, Artificial Sequence
  chemically synthesized
aaatttgttatgttaaaata

SEQ ID NO: 497971 - DNA, 20 bp, Artificial Sequence
  chemically synthesized
gtatagtaaaatgttcatgg

SEQ ID NO: 497972 - DNA, 20 bp, Artificial Sequence
  chemically synthesized
ggaaaagatatgtgatcaaa

SEQ ID NO: 497973 - DNA, 20 bp, Artificial Sequence
  chemically synthesized
aaaatatgattgattgatgg

SEQ ID NO: 497974 - DNA, 20 bp, Artificial Sequence
  chemically synthesized
atcaaaaatatgattgattg

SEQ ID NO: 497975 - DNA, 20 bp, Artificial Sequence
  chemically synthesized
tactgatgtcagcagtttac

SEQ ID NO: 497976 - DNA, 20 bp, Artificial Sequence
  chemically synthesized
tccatattgaggtatttaag

SEQ ID NO: 497977 - DNA, 20 bp, Artificial Sequence
  chemically synthesized
ttcaccttaaatacctcaat

SEQ ID NO: 497978 - DNA, 20 bp, Artificial Sequence
  chemically synthesized
atacctcaatatggatatca

SEQ ID NO: 497979 - DNA, 20 bp, Artificial Sequence
  chemically synthesized
tcaatatggatatcactgaa

SEQ ID NO: 497980 - DNA, 20 bp, Artificial Sequence
  chemically synthesized
cataataataaagaaacctt

SEQ ID NO: 497981 - DNA, 20 bp, Artificial Sequence
  chemically synthesized
ctaccttgcagagttattac

SEQ ID NO: 497982 - DNA, 20 bp, Artificial Sequence
  chemically synthesized
tctaagtaataactaccttg

SEQ ID NO: 497983 - DNA, 20 bp, Artificial Sequence
  chemically synthesized
taaaagatgacttaatgtct

SEQ ID NO: 497984 - DNA, 20 bp, Artificial Sequence
  chemically synthesized
ttcacatgggaagtaaaagg

SEQ ID NO: 497985 - DNA, 20 bp, Artificial Sequence
  chemically synthesized
atgggaagtaaaaggtagag

SEQ ID NO: 497986 - DNA, 20 bp, Artificial Sequence
  chemically synthesized
gggataagtgaaagctggat

SEQ ID NO: 497987 - DNA, 20 bp, Artificial Sequence
  chemically synthesized
ttttatgggataagtgaaag

SEQ ID NO: 497988 - DNA, 20 bp, Artificial Sequence
  chemically synthesized
ggtcagggaccactgtttta

SEQ ID NO: 497989 - DNA, 20 bp, Artificial Sequence
  chemically synthesized
aaatcagttcctggtgccaa

SEQ ID NO: 497990 - DNA, 20 bp, Artificial Sequence
  chemically synthesized
gaagacaatttttccgtgga

SEQ ID NO: 497991 - DNA, 20 bp, Artificial Sequence
  chemically synthesized
tttttccgtggaccgggttg

SEQ ID NO: 497992 - DNA, 20 bp, Artificial Sequence
  chemically synthesized
gtgcaataactgtaatgcac

SEQ ID NO: 497993 - DNA, 20 bp, Artificial Sequence
  chemically synthesized
cccactgaatctacattatg

SEQ ID NO: 497994 - DNA, 20 bp, Artificial Sequence
  chemically synthesized
aaggaagctcaaggctccca

SEQ ID NO: 497995 - DNA, 20 bp, Artificial Sequence
  chemically synthesized
cagctagatggtcccatctg

SEQ ID NO: 497996 - DNA, 20 bp, Artificial Sequence
  chemically synthesized
ctaggttgcatgctccttat

SEQ ID NO: 497997 - DNA, 20 bp, Artificial Sequence
  chemically synthesized
atgcaacctagatcccttgc

SEQ ID NO: 497998 - DNA, 20 bp, Artificial Sequence
  chemically synthesized
tattgtgaactactcatgca

SEQ ID NO: 497999 - DNA, 20 bp, Artificial Sequence
  chemically synthesized
cttgcatgagtagttcacaa

SEQ ID NO: 498000 - DNA, 20 bp, Artificial Sequence
  chemically synthesized
aatagggtttgtgctcctat

SEQ ID NO: 498001 - DNA, 20 bp, Artificial Sequence
  chemically synthesized
aggtggagctcaggcagaaa

SEQ ID NO: 498002 - DNA, 20 bp, Artificial Sequence
  chemically synthesized
tgctgctcacctactgcttt

SEQ ID NO: 498003 - DNA, 20 bp, Artificial Sequence
  chemically synthesized
ctcacctactgctttgcgaa

SEQ ID NO: 498004 - DNA, 20 bp, Artificial Sequence
  chemically synthesized
aatcgggtccctaacaggca

SEQ ID NO: 498005 - DNA, 20 bp, Artificial Sequence
  chemically synthesized
ctaacaggcaacggattggt

SEQ ID NO: 498006 - DNA, 20 bp, Artificial Sequence
  chemically synthesized
ttggtacgggtctgtggctc

SEQ ID NO: 498007 - DNA, 20 bp, Artificial Sequence
  chemically synthesized
aaaaatatagtattttatgg

SEQ ID NO: 498008 - DNA, 20 bp, Artificial Sequence
  chemically synthesized
ccaaatgtctctaatgctat

SEQ ID NO: 498009 - DNA, 20 bp, Artificial Sequence
  chemically synthesized
ctatgagggtagaagtggaa

SEQ ID NO: 498010 - DNA, 20 bp, Artificial Sequence
  chemically synthesized
agggtagaagtggaaaggag

SEQ ID NO: 498011 - DNA, 20 bp, Artificial Sequence
  chemically synthesized
tctaaccttccaaaattgta

SEQ ID NO: 498012 - DNA, 20 bp, Artificial Sequence
  chemically synthesized
tggaaggttagaggccaaaa

SEQ ID NO: 498013 - DNA, 20 bp, Artificial Sequence
  chemically synthesized
gccttcactttgttttcatt

SEQ ID NO: 498014 - DNA, 20 bp, Artificial Sequence
  chemically synthesized
ccatgttaaggcattataag

SEQ ID NO: 498015 - DNA, 20 bp, Artificial Sequence
  chemically synthesized
tcatcttataatgccttaac

SEQ ID NO: 498016 - DNA, 20 bp, Artificial Sequence
  chemically synthesized
ttgtcattgtattaaaaaat

SEQ ID NO: 498017 - DNA, 20 bp, Artificial Sequence
  chemically synthesized
tgatagctgttatgtgaggg

SEQ ID NO: 498018 - DNA, 20 bp, Artificial Sequence
  chemically synthesized
catcctgatagctgttatgt

SEQ ID NO: 498019 - DNA, 20 bp, Artificial Sequence
  chemically synthesized
caccctcacataacagctat

SEQ ID NO: 498020 - DNA, 20 bp, Artificial Sequence
  chemically synthesized
acataacagctatcaggatg

SEQ ID NO: 498021 - DNA, 20 bp, Artificial Sequence
  chemically synthesized
ttctctaacctaatttttta

SEQ ID NO: 498022 - DNA, 20 bp, Artificial Sequence
  chemically synthesized
ttattttaccatgattttaa

SEQ ID NO: 498023 - DNA, 20 bp, Artificial Sequence
  chemically synthesized
taagatagtatttgaggtga

SEQ ID NO: 498024 - DNA, 20 bp, Artificial Sequence
  chemically synthesized
aggaaacaagtctattttaa

SEQ ID NO: 498025 - DNA, 20 bp, Artificial Sequence
  chemically synthesized
ctatcttcaatgtgattaac

SEQ ID NO: 498026 - DNA, 20 bp, Artificial Sequence
  chemically synthesized
agcaataatctagttaaact

SEQ ID NO: 498027 - DNA, 20 bp, Artificial Sequence
  chemically synthesized
ttaagttggtacaaccaatt

SEQ ID NO: 498028 - DNA, 20 bp, Artificial Sequence
  chemically synthesized
gtaccaacttaaatttctac

SEQ ID NO: 498029 - DNA, 20 bp, Artificial Sequence
  chemically synthesized
acttaaatttctacaagaat

SEQ ID NO: 498030 - DNA, 20 bp, Artificial Sequence
  chemically synthesized
tttacttgttccagtccgat

SEQ ID NO: 498031 - DNA, 20 bp, Artificial Sequence
  chemically synthesized
gtaggaattcaagatgagat

SEQ ID NO: 498032 - DNA, 20 bp, Artificial Sequence
  chemically synthesized
gtccccacccaaatctcatc

SEQ ID NO: 498033 - DNA, 20 bp, Artificial Sequence
  chemically synthesized
aggtccttcccacaacatgt

SEQ ID NO: 498034 - DNA, 20 bp, Artificial Sequence
  chemically synthesized
aaggacctcgtgggaggtaa

SEQ ID NO: 498035 - DNA, 20 bp, Artificial Sequence
  chemically synthesized
aggagcaagtcacatcttac

SEQ ID NO: 498036 - DNA, 20 bp, Artificial Sequence
  chemically synthesized
tgggtcatttatacaggaaa

SEQ ID NO: 498037 - DNA, 20 bp, Artificial Sequence
  chemically synthesized
tgataaagacatacatgaga

SEQ ID NO: 498038 - DNA, 20 bp, Artificial Sequence
  chemically synthesized
taatttttccaataataaat

SEQ ID NO: 498039 - DNA, 20 bp, Artificial Sequence
  chemically synthesized
tctgtatgtcaaatacactt

SEQ ID NO: 498040 - DNA, 20 bp, Artificial Sequence
  chemically synthesized
tttgcaatactaaaacaata

SEQ ID NO: 498041 - DNA, 20 bp, Artificial Sequence
  chemically synthesized
aacataaaaatggtaaattg

SEQ ID NO: 498042 - DNA, 20 bp, Artificial Sequence
  chemically synthesized
gtttatgtacagtgtgagat

SEQ ID NO: 498043 - DNA, 20 bp, Artificial Sequence
  chemically synthesized
tttaaaattttattaaacat

SEQ ID NO: 498044 - DNA, 20 bp, Artificial Sequence
  chemically synthesized
atattatactcttacacaat

SEQ ID NO: 498045 - DNA, 20 bp, Artificial Sequence
  chemically synthesized
aggtggtattcttattgtgt

SEQ ID NO: 498046 - DNA, 20 bp, Artificial Sequence
  chemically synthesized
aataccacctctcaatacat

SEQ ID NO: 498047 - DNA, 20 bp, Artificial Sequence
  chemically synthesized
aaaaaaaaaatctaatgtat

SEQ ID NO: 498048 - DNA, 20 bp, Artificial Sequence
  chemically synthesized
ggagaagaaaatagtgctcc

SEQ ID NO: 498049 - DNA, 20 bp, Artificial Sequence
  chemically synthesized
ctgttatacagctgttgtta

SEQ ID NO: 498050 - DNA, 20 bp, Artificial Sequence
  chemically synthesized
ctttgcatcttcctcccacg

SEQ ID NO: 498051 - DNA, 20 bp, Artificial Sequence
  chemically synthesized
cacgttgggttctctgtttt

SEQ ID NO: 498052 - DNA, 20 bp, Artificial Sequence
  chemically synthesized
ttagtattacctgcaaagcc

SEQ ID NO: 498053 - DNA, 20 bp, Artificial Sequence
  chemically synthesized
aatatttttaagagaggtaa

SEQ ID NO: 498054 - DNA, 20 bp, Artificial Sequence
  chemically synthesized
tgcctaactctgaggggaca

SEQ ID NO: 498055 - DNA, 20 bp, Artificial Sequence
  chemically synthesized
attataatcccctgtcccct

SEQ ID NO: 498056 - DNA, 20 bp, Artificial Sequence
  chemically synthesized
gcatgaccacgtgacttcct

SEQ ID NO: 498057 - DNA, 20 bp, Artificial Sequence
  chemically synthesized
actcttacatgcctctatgt

SEQ ID NO: 498058 - DNA, 20 bp, Artificial Sequence
  chemically synthesized
actcctacatagaggcatgt

SEQ ID NO: 498059 - DNA, 20 bp, Artificial Sequence
  chemically synthesized
aaagcttcttattgttacgg

SEQ ID NO: 498060 - DNA, 20 bp, Artificial Sequence
  chemically synthesized
ttattgttacggtagaatga

SEQ ID NO: 498061 - DNA, 20 bp, Artificial Sequence
  chemically synthesized
gaatgatagaatactagaga

SEQ ID NO: 498062 - DNA, 20 bp, Artificial Sequence
  chemically synthesized
gactgaatcagcttagattc

SEQ ID NO: 498063 - DNA, 20 bp, Artificial Sequence
  chemically synthesized
tctgatcattgtagtcactc

SEQ ID NO: 498064 - DNA, 20 bp, Artificial Sequence
  chemically synthesized
atatccaacacaagtcagtc

SEQ ID NO: 498065 - DNA, 20 bp, Artificial Sequence
  chemically synthesized
gaacccttgactgacttgtg

SEQ ID NO: 498066 - DNA, 20 bp, Artificial Sequence
  chemically synthesized
gtttctagccactaatattt

SEQ ID NO: 498067 - DNA, 20 bp, Artificial Sequence
  chemically synthesized
tattattgcagcataacaag

SEQ ID NO: 498068 - DNA, 20 bp, Artificial Sequence
  chemically synthesized
ttgtgattggagatcagaag

SEQ ID NO: 498069 - DNA, 20 bp, Artificial Sequence
  chemically synthesized
gaaagaaaccaagaaagaca

SEQ ID NO: 498070 - DNA, 20 bp, Artificial Sequence
  chemically synthesized
tggtttctttcttcacttgg

SEQ ID NO: 498071 - DNA, 20 bp, Artificial Sequence
  chemically synthesized
tctggggaaaaaaggtttag

SEQ ID NO: 498072 - DNA, 20 bp, Artificial Sequence
  chemically synthesized
ccgcacaatttatagtttat

SEQ ID NO: 498073 - DNA, 20 bp, Artificial Sequence
  chemically synthesized
ggtgtacaatttatatattg

SEQ ID NO: 498074 - DNA, 20 bp, Artificial Sequence
  chemically synthesized
gtttttaagctgctaaattt

SEQ ID NO: 498075 - DNA, 20 bp, Artificial Sequence
  chemically synthesized
tttggcagtttctgaaggtc

SEQ ID NO: 498076 - DNA, 20 bp, Artificial Sequence
  chemically synthesized
tttctgaaggtcaagaatct

SEQ ID NO: 498077 - DNA, 20 bp, Artificial Sequence
  chemically synthesized
agaatctgagagtggcttag

SEQ ID NO: 498078 - DNA, 20 bp, Artificial Sequence
  chemically synthesized
ggcctcctgcaaagagccac

SEQ ID NO: 498079 - DNA, 20 bp, Artificial Sequence
  chemically synthesized
agacacagagagagataggc

SEQ ID NO: 498080 - DNA, 20 bp, Artificial Sequence
  chemically synthesized
gaaatgacatatcatcacaa

SEQ ID NO: 498081 - DNA, 20 bp, Artificial Sequence
  chemically synthesized
atatcatcacaaaagagtca

SEQ ID NO: 498082 - DNA, 20 bp, Artificial Sequence
  chemically synthesized
acagctaaatgtccctgtca

SEQ ID NO: 498083 - DNA, 20 bp, Artificial Sequence
  chemically synthesized
gggacatttagctgtaactc

SEQ ID NO: 498084 - DNA, 20 bp, Artificial Sequence
  chemically synthesized
tctgtgatgctcttctattc

SEQ ID NO: 498085 - DNA, 20 bp, Artificial Sequence
  chemically synthesized
tcttgaatagaagagcatca

SEQ ID NO: 498086 - DNA, 20 bp, Artificial Sequence
  chemically synthesized
tttgtgaacataatttcata

SEQ ID NO: 498087 - DNA, 20 bp, Artificial Sequence
  chemically synthesized
aacacttcctttaaacttct

SEQ ID NO: 498088 - DNA, 20 bp, Artificial Sequence
  chemically synthesized
gaagttcacagatcagaaat

SEQ ID NO: 498089 - DNA, 20 bp, Artificial Sequence
  chemically synthesized
ttttcttagaactgaagaaa

SEQ ID NO: 498090 - DNA, 20 bp, Artificial Sequence
  chemically synthesized
ttatttttaacatctattat

SEQ ID NO: 498091 - DNA, 20 bp, Artificial Sequence
  chemically synthesized
taacatctattatttgaatg

SEQ ID NO: 498092 - DNA, 20 bp, Artificial Sequence
  chemically synthesized
aacactattgacactttgaa

SEQ ID NO: 498093 - DNA, 20 bp, Artificial Sequence
  chemically synthesized
gaaatgagtaattcttggtt

SEQ ID NO: 498094 - DNA, 20 bp, Artificial Sequence
  chemically synthesized
ccatgcagccatccacaacc

SEQ ID NO: 498095 - DNA, 20 bp, Artificial Sequence
  chemically synthesized
cttgtgaagagtgacgcaag

SEQ ID NO: 498096 - DNA, 20 bp, Artificial Sequence
  chemically synthesized
tgtactactggcctcttgtg

SEQ ID NO: 498097 - DNA, 20 bp, Artificial Sequence
  chemically synthesized
ttcgttgtcacaaataagga

SEQ ID NO: 498098 - DNA, 20 bp, Artificial Sequence
  chemically synthesized
ctatttgtgaaacacttacc

SEQ ID NO: 498099 - DNA, 20 bp, Artificial Sequence
  chemically synthesized
catggaaaatgggagagtat

SEQ ID NO: 498100 - DNA, 20 bp, Artificial Sequence
  chemically synthesized
gccaaaagcatggaaaatgg

SEQ ID NO: 498101 - DNA, 20 bp, Artificial Sequence
  chemically synthesized
tgtaatgaggaagggggcca

SEQ ID NO: 498102 - DNA, 20 bp, Artificial Sequence
  chemically synthesized
ctggtgtgggatgttgatag

SEQ ID NO: 498103 - DNA, 20 bp, Artificial Sequence
  chemically synthesized
ccgctatcaacatcccacac

SEQ ID NO: 498104 - DNA, 20 bp, Artificial Sequence
  chemically synthesized
acaaatgtaccactctggtg

SEQ ID NO: 498105 - DNA, 20 bp, Artificial Sequence
  chemically synthesized
tctaatgtaaactatggact

SEQ ID NO: 498106 - DNA, 20 bp, Artificial Sequence
  chemically synthesized
tcgaagtccatagtttacat

SEQ ID NO: 498107 - DNA, 20 bp, Artificial Sequence
  chemically synthesized
cttgtgatgttgtatcttct

SEQ ID NO: 498108 - DNA, 20 bp, Artificial Sequence
  chemically synthesized
ctctgtgtgatactataatg

SEQ ID NO: 498109 - DNA, 20 bp, Artificial Sequence
  chemically synthesized
tccaccattatagtatcaca

SEQ ID NO: 498110 - DNA, 20 bp, Artificial Sequence
  chemically synthesized
ccatgtatgttattccagtg

SEQ ID NO: 498111 - DNA, 20 bp, Artificial Sequence
  chemically synthesized
gcttttagtatatccaccac

SEQ ID NO: 498112 - DNA, 20 bp, Artificial Sequence
  chemically synthesized
taccagtgtaattttgttat

SEQ ID NO: 498113 - DNA, 20 bp, Artificial Sequence
  chemically synthesized
attcttaattgtataaattt

SEQ ID NO: 498114 - DNA, 20 bp, Artificial Sequence
  chemically synthesized
acccataaatttatacaatt

SEQ ID NO: 498115 - DNA, 20 bp, Artificial Sequence
  chemically synthesized
gtggtatttccgagaaagat

SEQ ID NO: 498116 - DNA, 20 bp, Artificial Sequence
  chemically synthesized
atagtctcttgttctttctt

SEQ ID NO: 498117 - DNA, 20 bp, Artificial Sequence
  chemically synthesized
ctcagttttaagagacaatc

SEQ ID NO: 498118 - DNA, 20 bp, Artificial Sequence
  chemically synthesized
ataagccctacatacgcaca

SEQ ID NO: 498119 - DNA, 20 bp, Artificial Sequence
  chemically synthesized
cagatctggctatttcactg

SEQ ID NO: 498120 - DNA, 20 bp, Artificial Sequence
  chemically synthesized
taattgtaggttactatgat

SEQ ID NO: 498121 - DNA, 20 bp, Artificial Sequence
  chemically synthesized
aatgtcatcaccttgagggt

SEQ ID NO: 498122 - DNA, 20 bp, Artificial Sequence
  chemically synthesized
cttcctaatgtcatcacctt

SEQ ID NO: 498123 - DNA, 20 bp, Artificial Sequence
  chemically synthesized
gtcataaggccaaagccatc

SEQ ID NO: 498124 - DNA, 20 bp, Artificial Sequence
  chemically synthesized
aggccaaagccatccagaat

SEQ ID NO: 498125 - DNA, 20 bp, Artificial Sequence
  chemically synthesized
gtaagggtactattctcatt

SEQ ID NO: 498126 - DNA, 20 bp, Artificial Sequence
  chemically synthesized
ctgtcttgggcctcttttgt

SEQ ID NO: 498127 - DNA, 20 bp, Artificial Sequence
  chemically synthesized
ctataacaaaataccataga

SEQ ID NO: 498128 - DNA, 20 bp, Artificial Sequence
  chemically synthesized
tattgcaggtaggctctcag

SEQ ID NO: 498129 - DNA, 20 bp, Artificial Sequence
  chemically synthesized
aatttataatctactgccca

SEQ ID NO: 498130 - DNA, 20 bp, Artificial Sequence
  chemically synthesized
gagccaccatactgaaaata

SEQ ID NO: 498131 - DNA, 20 bp, Artificial Sequence
  chemically synthesized
aacttttggcatttggacaa

SEQ ID NO: 498132 - DNA, 20 bp, Artificial Sequence
  chemically synthesized
tctcatcccagcagacgtga

SEQ ID NO: 498133 - DNA, 20 bp, Artificial Sequence
  chemically synthesized
aaccactcactcacgtctgc

SEQ ID NO: 498134 - DNA, 20 bp, Artificial Sequence
  chemically synthesized
cctctctcatcccagcagac

SEQ ID NO: 498135 - DNA, 20 bp, Artificial Sequence
  chemically synthesized
cacgtctgctgggatgagag

SEQ ID NO: 498136 - DNA, 20 bp, Artificial Sequence
  chemically synthesized
tacatttcatgtccccagct

SEQ ID NO: 498137 - DNA, 20 bp, Artificial Sequence
  chemically synthesized
aaatgtaattgcccctttta

SEQ ID NO: 498138 - DNA, 20 bp, Artificial Sequence
  chemically synthesized
ctggaaataaaggggttgtt

SEQ ID NO: 498139 - DNA, 20 bp, Artificial Sequence
  chemically synthesized
ccgagaggggctggaaataa

SEQ ID NO: 498140 - DNA, 20 bp, Artificial Sequence
  chemically synthesized
ctttatttccagcccctctc

SEQ ID NO: 498141 - DNA, 20 bp, Artificial Sequence
  chemically synthesized
tcaggatcccagaaaaactt

SEQ ID NO: 498142 - DNA, 20 bp, Artificial Sequence
  chemically synthesized
cttcaatccacaagtttttc

SEQ ID NO: 498143 - DNA, 20 bp, Artificial Sequence
  chemically synthesized
aagtaagccaatttgttttt

SEQ ID NO: 498144 - DNA, 20 bp, Artificial Sequence
  chemically synthesized
ttgttcaaagattacgctaa

SEQ ID NO: 498145 - DNA, 20 bp, Artificial Sequence
  chemically synthesized
gcaactactaaatgctagat

SEQ ID NO: 498146 - DNA, 20 bp, Artificial Sequence
  chemically synthesized
gcaagaactttaaaccttaa

SEQ ID NO: 498147 - DNA, 20 bp, Artificial Sequence
  chemically synthesized
tcttgcactgcaatgttact

SEQ ID NO: 498148 - DNA, 20 bp, Artificial Sequence
  chemically synthesized
tctgttctcttgcttgatga

SEQ ID NO: 498149 - DNA, 20 bp, Artificial Sequence
  chemically synthesized
tgcatctgttctcttgcttg

SEQ ID NO: 498150 - DNA, 20 bp, Artificial Sequence
  chemically synthesized
ttatgggcctatgtaggtgt

SEQ ID NO: 498151 - DNA, 20 bp, Artificial Sequence
  chemically synthesized
ttttccccaggttttctttc

SEQ ID NO: 498152 - DNA, 20 bp, Artificial Sequence
  chemically synthesized
ccacagcccagcctctggtt

SEQ ID NO: 498153 - DNA, 20 bp, Artificial Sequence
  chemically synthesized
ccagcctctggttttgaata

SEQ ID NO: 498154 - DNA, 20 bp, Artificial Sequence
  chemically synthesized
tttggatgctgcgggatagt

SEQ ID NO: 498155 - DNA, 20 bp, Artificial Sequence
  chemically synthesized
agccaggaatttggatgctg

SEQ ID NO: 498156 - DNA, 20 bp, Artificial Sequence
  chemically synthesized
caacagtggaagccaggaat

SEQ ID NO: 498157 - DNA, 20 bp, Artificial Sequence
  chemically synthesized
acaaaacaacagtggaagcc

SEQ ID NO: 498158 - DNA, 20 bp, Artificial Sequence
  chemically synthesized
atttacagaaatgtaaagca

SEQ ID NO: 498159 - DNA, 20 bp, Artificial Sequence
  chemically synthesized
tgaaaaaatagaaaataaaa

SEQ ID NO: 498160 - DNA, 20 bp, Artificial Sequence
  chemically synthesized
gctgtattttgggagcagat

SEQ ID NO: 498161 - DNA, 20 bp, Artificial Sequence
  chemically synthesized
ggagcagatgaggataacac

SEQ ID NO: 498162 - DNA, 20 bp, Artificial Sequence
  chemically synthesized
ataaaatagtggtccctcta

SEQ ID NO: 498163 - DNA, 20 bp, Artificial Sequence
  chemically synthesized
tgtaaactgtatagaaccgg

SEQ ID NO: 498164 - DNA, 20 bp, Artificial Sequence
  chemically synthesized
ataaccctaatcatcttatc

SEQ ID NO: 498165 - DNA, 20 bp, Artificial Sequence
  chemically synthesized
gagacccaagataagatgat

SEQ ID NO: 498166 - DNA, 20 bp, Artificial Sequence
  chemically synthesized
tccttttctgacatggaggc

SEQ ID NO: 498167 - DNA, 20 bp, Artificial Sequence
  chemically synthesized
agttaccaaggaaatttggt

SEQ ID NO: 498168 - DNA, 20 bp, Artificial Sequence
  chemically synthesized
gttccctgaaggactgaagg

SEQ ID NO: 498169 - DNA, 20 bp, Artificial Sequence
  chemically synthesized
ctgcagatctgtggaatctc

SEQ ID NO: 498170 - DNA, 20 bp, Artificial Sequence
  chemically synthesized
ttactaggcctgcagatctg

SEQ ID NO: 498171 - DNA, 20 bp, Artificial Sequence
  chemically synthesized
caactaaccaatcaaccaac

SEQ ID NO: 498172 - DNA, 20 bp, Artificial Sequence
  chemically synthesized
gtaacaggacttaggtggcc

SEQ ID NO: 498173 - DNA, 20 bp, Artificial Sequence
  chemically synthesized
gacactgaagtttaaaggag

SEQ ID NO: 498174 - DNA, 20 bp, Artificial Sequence
  chemically synthesized
ctattggctttatttccaac

SEQ ID NO: 498175 - DNA, 20 bp, Artificial Sequence
  chemically synthesized
catgttggaaataaagccaa

SEQ ID NO: 498176 - DNA, 20 bp, Artificial Sequence
  chemically synthesized
ttcaggtaataaagcatatg

SEQ ID NO: 498177 - DNA, 20 bp, Artificial Sequence
  chemically synthesized
taactgttaaaaagtcatca

SEQ ID NO: 498178 - DNA, 20 bp, Artificial Sequence
  chemically synthesized
acacgaaagatttatataca

SEQ ID NO: 498179 - DNA, 20 bp, Artificial Sequence
  chemically synthesized
aaatgttccatgtgatttta

SEQ ID NO: 498180 - DNA, 20 bp, Artificial Sequence
  chemically synthesized
attataatacttcatttctt

SEQ ID NO: 498181 - DNA, 20 bp, Artificial Sequence
  chemically synthesized
aatacttcatttcttgaggg

SEQ ID NO: 498182 - DNA, 20 bp, Artificial Sequence
  chemically synthesized
gatattattattgatgataa

SEQ ID NO: 498183 - DNA, 20 bp, Artificial Sequence
  chemically synthesized
catagatatataatcatttt

SEQ ID NO: 498184 - DNA, 20 bp, Artificial Sequence
  chemically synthesized
attttatgggtccgtgaaat

SEQ ID NO: 498185 - DNA, 20 bp, Artificial Sequence
  chemically synthesized
atgggtccgtgaaatgagga

SEQ ID NO: 498186 - DNA, 20 bp, Artificial Sequence
  chemically synthesized
ttttagataaggaaataaat

SEQ ID NO: 498187 - DNA, 20 bp, Artificial Sequence
  chemically synthesized
aaattatatgatcctagggc

SEQ ID NO: 498188 - DNA, 20 bp, Artificial Sequence
  chemically synthesized
tcttttctttaccctagccc

SEQ ID NO: 498189 - DNA, 20 bp, Artificial Sequence
  chemically synthesized
aaaaataacttcaaaagtgc

SEQ ID NO: 498190 - DNA, 20 bp, Artificial Sequence
  chemically synthesized
tgggttgatgatagcctgac

SEQ ID NO: 498191 - DNA, 20 bp, Artificial Sequence
  chemically synthesized
atagcctgacaaggattagc

SEQ ID NO: 498192 - DNA, 20 bp, Artificial Sequence
  chemically synthesized
tgagccagtaaatatcacag

SEQ ID NO: 498193 - DNA, 20 bp, Artificial Sequence
  chemically synthesized
atttactggctcaacatctt

SEQ ID NO: 498194 - DNA, 20 bp, Artificial Sequence
  chemically synthesized
caaatatgtccttcctctca

SEQ ID NO: 498195 - DNA, 20 bp, Artificial Sequence
  chemically synthesized
ccctgagaggaaggacatat

SEQ ID NO: 498196 - DNA, 20 bp, Artificial Sequence
  chemically synthesized
agcttaaaattaaacatact

SEQ ID NO: 498197 - DNA, 20 bp, Artificial Sequence
  chemically synthesized
cgggtttgttacctgtataa

SEQ ID NO: 498198 - DNA, 20 bp, Artificial Sequence
  chemically synthesized
attatatttcactattatct

SEQ ID NO: 498199 - DNA, 20 bp, Artificial Sequence
  chemically synthesized
ataatagtgaaatataataa

SEQ ID NO: 498200 - DNA, 20 bp, Artificial Sequence
  chemically synthesized
gaaatacttgttaaattttc

SEQ ID NO: 498201 - DNA, 20 bp, Artificial Sequence
  chemically synthesized
gtgataaactaatgtttaac

SEQ ID NO: 498202 - DNA, 20 bp, Artificial Sequence
  chemically synthesized
taggaaaaattaatgatgta

SEQ ID NO: 498203 - DNA, 20 bp, Artificial Sequence
  chemically synthesized
tatataaactaatacctgag

SEQ ID NO: 498204 - DNA, 20 bp, Artificial Sequence
  chemically synthesized
ttgttttctctttgaaaata

SEQ ID NO: 498205 - DNA, 20 bp, Artificial Sequence
  chemically synthesized
aaaaagttcgttcctcttgt

SEQ ID NO: 498206 - DNA, 20 bp, Artificial Sequence
  chemically synthesized
ttttattatactttaagttt

SEQ ID NO: 498207 - DNA, 20 bp, Artificial Sequence
  chemically synthesized
taatgctagatgacgagtta

SEQ ID NO: 498208 - DNA, 20 bp, Artificial Sequence
  chemically synthesized
gatatacctaatgctagatg

SEQ ID NO: 498209 - DNA, 20 bp, Artificial Sequence
  chemically synthesized
gtggggtggggggagggggg

SEQ ID NO: 498210 - DNA, 20 bp, Artificial Sequence
  chemically synthesized
tcacactctggggactgtgg

SEQ ID NO: 498211 - DNA, 20 bp, Artificial Sequence
  chemically synthesized
ccccaccccaccacagtccc

SEQ ID NO: 498212 - DNA, 20 bp, Artificial Sequence
  chemically synthesized
gatcacatggacacaggaag

SEQ ID NO: 498213 - DNA, 20 bp, Artificial Sequence
  chemically synthesized
ttctcactcataggtggggt

SEQ ID NO: 498214 - DNA, 20 bp, Artificial Sequence
  chemically synthesized
gttcaattcccaccccacct

SEQ ID NO: 498215 - DNA, 20 bp, Artificial Sequence
  chemically synthesized
tgcatattctcactcatagg

SEQ ID NO: 498216 - DNA, 20 bp, Artificial Sequence
  chemically synthesized
ttcccaccccacctatgagt

SEQ ID NO: 498217 - DNA, 20 bp, Artificial Sequence
  chemically synthesized
tgttcttgcgatagtttact

SEQ ID NO: 498218 - DNA, 20 bp, Artificial Sequence
  chemically synthesized
ttcatgtcctttgtagggac

SEQ ID NO: 498219 - DNA, 20 bp, Artificial Sequence
  chemically synthesized
ctatgcagccagaaaaaatg

SEQ ID NO: 498220 - DNA, 20 bp, Artificial Sequence
  chemically synthesized
aatgtggcacatatacacca

SEQ ID NO: 498221 - DNA, 20 bp, Artificial Sequence
  chemically synthesized
aaatgtccaacaatgataga

SEQ ID NO: 498222 - DNA, 20 bp, Artificial Sequence
  chemically synthesized
agtctatcattgttggacat

SEQ ID NO: 498223 - DNA, 20 bp, Artificial Sequence
  chemically synthesized
ggttccaagtctttgttatt

SEQ ID NO: 498224 - DNA, 20 bp, Artificial Sequence
  chemically synthesized
gcagcatgatttatagtcct

SEQ ID NO: 498225 - DNA, 20 bp, Artificial Sequence
  chemically synthesized
tttgggtatatacccagtaa

SEQ ID NO: 498226 - DNA, 20 bp, Artificial Sequence
  chemically synthesized
ttgacccagccatcccatta

SEQ ID NO: 498227 - DNA, 20 bp, Artificial Sequence
  chemically synthesized
tatacccagtaatgggatgg

SEQ ID NO: 498228 - DNA, 20 bp, Artificial Sequence
  chemically synthesized
tttctagttctagatccctg

SEQ ID NO: 498229 - DNA, 20 bp, Artificial Sequence
  chemically synthesized
agtcagtgtggcgattcctc

SEQ ID NO: 498230 - DNA, 20 bp, Artificial Sequence
  chemically synthesized
aggaaacaacaggtgctgga

SEQ ID NO: 498231 - DNA, 20 bp, Artificial Sequence
  chemically synthesized
cacctgttgtttcctgactt

SEQ ID NO: 498232 - DNA, 20 bp, Artificial Sequence
  chemically synthesized
agatatcatctcacaccagt

SEQ ID NO: 498233 - DNA, 20 bp, Artificial Sequence
  chemically synthesized
tcctcaccatcactggccat

SEQ ID NO: 498234 - DNA, 20 bp, Artificial Sequence
  chemically synthesized
ctctgatggccagtgatggt

SEQ ID NO: 498235 - DNA, 20 bp, Artificial Sequence
  chemically synthesized
gtccttcgctcactttttga

SEQ ID NO: 498236 - DNA, 20 bp, Artificial Sequence
  chemically synthesized
tttttttcttgtaaatttgt

SEQ ID NO: 498237 - DNA, 20 bp, Artificial Sequence
  chemically synthesized
gtttgagttcattgtagatt

SEQ ID NO: 498238 - DNA, 20 bp, Artificial Sequence
  chemically synthesized
tctgacaaagggctaatatc

SEQ ID NO: 498239 - DNA, 20 bp, Artificial Sequence
  chemically synthesized
ggatattagccctttgtcag

SEQ ID NO: 498240 - DNA, 20 bp, Artificial Sequence
  chemically synthesized
acagcaaaagaaactaccat

SEQ ID NO: 498241 - DNA, 20 bp, Artificial Sequence
  chemically synthesized
caaaagccaaaattgacaaa

SEQ ID NO: 498242 - DNA, 20 bp, Artificial Sequence
  chemically synthesized
tccttgcccatgcctatgtc

SEQ ID NO: 498243 - DNA, 20 bp, Artificial Sequence
  chemically synthesized
gtaatgcctaggttttcttc

SEQ ID NO: 498244 - DNA, 20 bp, Artificial Sequence
  chemically synthesized
gtttaaatctttaatccatc

SEQ ID NO: 498245 - DNA, 20 bp, Artificial Sequence
  chemically synthesized
tatacaaaaatcaattcaag

SEQ ID NO: 498246 - DNA, 20 bp, Artificial Sequence
  chemically synthesized
ttttgtataaggtgtaagga

SEQ ID NO: 498247 - DNA, 20 bp, Artificial Sequence
  chemically synthesized
ccatatgtagaaagctgaaa

SEQ ID NO: 498248 - DNA, 20 bp, Artificial Sequence
  chemically synthesized
ccagcaccatttattaaata

SEQ ID NO: 498249 - DNA, 20 bp, Artificial Sequence
  chemically synthesized
aggaaaacaagcaatgggga

SEQ ID NO: 498250 - DNA, 20 bp, Artificial Sequence
  chemically synthesized
ccagctttgttcttttggct

SEQ ID NO: 498251 - DNA, 20 bp, Artificial Sequence
  chemically synthesized
gctaccaatgcctttcttca

SEQ ID NO: 498252 - DNA, 20 bp, Artificial Sequence
  chemically synthesized
aaaggcattggtagcttgat

SEQ ID NO: 498253 - DNA, 20 bp, Artificial Sequence
  chemically synthesized
gtagcttgatggggatggca

SEQ ID NO: 498254 - DNA, 20 bp, Artificial Sequence
  chemically synthesized
attccatgctcatgggtagg

SEQ ID NO: 498255 - DNA, 20 bp, Artificial Sequence
  chemically synthesized
attcttcctacccatgagca

SEQ ID NO: 498256 - DNA, 20 bp, Artificial Sequence
  chemically synthesized
tggaagaacattccatgctc

SEQ ID NO: 498257 - DNA, 20 bp, Artificial Sequence
  chemically synthesized
cactgctcaaggaaataaaa

SEQ ID NO: 498258 - DNA, 20 bp, Artificial Sequence
  chemically synthesized
tccttcacatcccttgtaag

SEQ ID NO: 498259 - DNA, 20 bp, Artificial Sequence
  chemically synthesized
acctaggaatccaacttaca

SEQ ID NO: 498260 - DNA, 20 bp, Artificial Sequence
  chemically synthesized
tcaaagagaataaaatacct

SEQ ID NO: 498261 - DNA, 20 bp, Artificial Sequence
  chemically synthesized
ccattcacaattgcttcaaa

SEQ ID NO: 498262 - DNA, 20 bp, Artificial Sequence
  chemically synthesized
ttattctctttgaagcaatt

SEQ ID NO: 498263 - DNA, 20 bp, Artificial Sequence
  chemically synthesized
tctttgaagcaattgtgaat

SEQ ID NO: 498264 - DNA, 20 bp, Artificial Sequence
  chemically synthesized
gacaaacagagagccaaatc

SEQ ID NO: 498265 - DNA, 20 bp, Artificial Sequence
  chemically synthesized
tttgtctgttgttggtgtat

SEQ ID NO: 498266 - DNA, 20 bp, Artificial Sequence
  chemically synthesized
aagcaacttcagcaaagtct

SEQ ID NO: 498267 - DNA, 20 bp, Artificial Sequence
  chemically synthesized
gagattttgggctgagacga

SEQ ID NO: 498268 - DNA, 20 bp, Artificial Sequence
  chemically synthesized
ttgacttcctcttttcctaa

SEQ ID NO: 498269 - DNA, 20 bp, Artificial Sequence
  chemically synthesized
ccagaacttccaacactatg

SEQ ID NO: 498270 - DNA, 20 bp, Artificial Sequence
  chemically synthesized
tttgaaaactggcacaagac

SEQ ID NO: 498271 - DNA, 20 bp, Artificial Sequence
  chemically synthesized
gtcttgtgccagttttcaaa

SEQ ID NO: 498272 - DNA, 20 bp, Artificial Sequence
  chemically synthesized
aacccacagccaatatcata

SEQ ID NO: 498273 - DNA, 20 bp, Artificial Sequence
  chemically synthesized
cattcagtatgatattggct

SEQ ID NO: 498274 - DNA, 20 bp, Artificial Sequence
  chemically synthesized
ccatcaatacctaatttatt

SEQ ID NO: 498275 - DNA, 20 bp, Artificial Sequence
  chemically synthesized
tattgagagtttttagcatg

SEQ ID NO: 498276 - DNA, 20 bp, Artificial Sequence
  chemically synthesized
gtttttagcatgaagggttg

SEQ ID NO: 498277 - DNA, 20 bp, Artificial Sequence
  chemically synthesized
tctttggctctgtttatatg

SEQ ID NO: 498278 - DNA, 20 bp, Artificial Sequence
  chemically synthesized
ttgaaccagccttgcatccc

SEQ ID NO: 498279 - DNA, 20 bp, Artificial Sequence
  chemically synthesized
gatcaagtgggcttcatcct

SEQ ID NO: 498280 - DNA, 20 bp, Artificial Sequence
  chemically synthesized
atgaagcccacttgatcatg

SEQ ID NO: 498281 - DNA, 20 bp, Artificial Sequence
  chemically synthesized
ataagctttttgatgtgctg

SEQ ID NO: 498282 - DNA, 20 bp, Artificial Sequence
  chemically synthesized
ctcaataaaatactggcata

SEQ ID NO: 498283 - DNA, 20 bp, Artificial Sequence
  chemically synthesized
cggtatgccagtattttatt

SEQ ID NO: 498284 - DNA, 20 bp, Artificial Sequence
  chemically synthesized
tttttgcatcaatgttcatc

SEQ ID NO: 498285 - DNA, 20 bp, Artificial Sequence
  chemically synthesized
gcagagacacaaccaaaaaa

SEQ ID NO: 498286 - DNA, 20 bp, Artificial Sequence
  chemically synthesized
tctctgcccggctttggtat

SEQ ID NO: 498287 - DNA, 20 bp, Artificial Sequence
  chemically synthesized
aatgatgctggcctcataaa

SEQ ID NO: 498288 - DNA, 20 bp, Artificial Sequence
  chemically synthesized
gcctcataaaatgagttagg

SEQ ID NO: 498289 - DNA, 20 bp, Artificial Sequence
  chemically synthesized
ttccaatcaatagaaaaaga

SEQ ID NO: 498290 - DNA, 20 bp, Artificial Sequence
  chemically synthesized
ttccctctttttctattgat

SEQ ID NO: 498291 - DNA, 20 bp, Artificial Sequence
  chemically synthesized
ttgattggaatagtttcaga

SEQ ID NO: 498292 - DNA, 20 bp, Artificial Sequence
  chemically synthesized
gttcctccttgtacctctgg

SEQ ID NO: 498293 - DNA, 20 bp, Artificial Sequence
  chemically synthesized
acctctggtagaattcggct

SEQ ID NO: 498294 - DNA, 20 bp, Artificial Sequence
  chemically synthesized
aggaccagatggattcacag

SEQ ID NO: 498295 - DNA, 20 bp, Artificial Sequence
  chemically synthesized
caaaaagagtccaggaccag

SEQ ID NO: 498296 - DNA, 20 bp, Artificial Sequence
  chemically synthesized
tcaatagcttaccaaccaaa

SEQ ID NO: 498297 - DNA, 20 bp, Artificial Sequence
  chemically synthesized
accaggaagaagttgaatct

SEQ ID NO: 498298 - DNA, 20 bp, Artificial Sequence
  chemically synthesized
aagactaaaccaggaagaag

SEQ ID NO: 498299 - DNA, 20 bp, Artificial Sequence
  chemically synthesized
tcttcctggtttagtcttgg

SEQ ID NO: 498300 - DNA, 20 bp, Artificial Sequence
  chemically synthesized
ttgggagagtgtatgtgtcg

SEQ ID NO: 498301 - DNA, 20 bp, Artificial Sequence
  chemically synthesized
aactagaaaatctagaagaa

SEQ ID NO: 498302 - DNA, 20 bp, Artificial Sequence
  chemically synthesized
agaaatacaaactaccgtca

SEQ ID NO: 498303 - DNA, 20 bp, Artificial Sequence
  chemically synthesized
gacggtagtttgtatttctg

SEQ ID NO: 498304 - DNA, 20 bp, Artificial Sequence
  chemically synthesized
atgatttcaggtttgacttg

SEQ ID NO: 498305 - DNA, 20 bp, Artificial Sequence
  chemically synthesized
caccacctaatgtcaggcat

SEQ ID NO: 498306 - DNA, 20 bp, Artificial Sequence
  chemically synthesized
ggaattgcatatgtagagcc

SEQ ID NO: 498307 - DNA, 20 bp, Artificial Sequence
  chemically synthesized
aattggttttccacgtactt

SEQ ID NO: 498308 - DNA, 20 bp, Artificial Sequence
  chemically synthesized
tggccatatctgtagggtgt

SEQ ID NO: 498309 - DNA, 20 bp, Artificial Sequence
  chemically synthesized
gtgggtcctggccatatctg

SEQ ID NO: 498310 - DNA, 20 bp, Artificial Sequence
  chemically synthesized
tcctggttatttggtctggg

SEQ ID NO: 498311 - DNA, 20 bp, Artificial Sequence
  chemically synthesized
gatatcctggttatttggtc

SEQ ID NO: 498312 - DNA, 20 bp, Artificial Sequence
  chemically synthesized
cccaccccagaccaaataac

SEQ ID NO: 498313 - DNA, 20 bp, Artificial Sequence
  chemically synthesized
tttcaaacttggttcaacaa

SEQ ID NO: 498314 - DNA, 20 bp, Artificial Sequence
  chemically synthesized
atgatgtaaaattttaaaat

SEQ ID NO: 498315 - DNA, 20 bp, Artificial Sequence
  chemically synthesized
caaggtggtgacaggtgcat

SEQ ID NO: 498316 - DNA, 20 bp, Artificial Sequence
  chemically synthesized
ttgagcaattatcaacattt

SEQ ID NO: 498317 - DNA, 20 bp, Artificial Sequence
  chemically synthesized
agtttgtcaaaacaaaaccc

SEQ ID NO: 498318 - DNA, 20 bp, Artificial Sequence
  chemically synthesized
caggtgaagtaatgtgattc

SEQ ID NO: 498319 - DNA, 20 bp, Artificial Sequence
  chemically synthesized
aaaatactttggcatgtatc

SEQ ID NO: 498320 - DNA, 20 bp, Artificial Sequence
  chemically synthesized
aagtttgaccaaatgtgtct

SEQ ID NO: 498321 - DNA, 20 bp, Artificial Sequence
  chemically synthesized
tctcctaaactttccattat

SEQ ID NO: 498322 - DNA, 20 bp, Artificial Sequence
  chemically synthesized
cattttttagaactcaattc

SEQ ID NO: 498323 - DNA, 20 bp, Artificial Sequence
  chemically synthesized
cgggtgagatgatccttgaa

SEQ ID NO: 498324 - DNA, 20 bp, Artificial Sequence
  chemically synthesized
ggatccgggtgagatgatcc

SEQ ID NO: 498325 - DNA, 20 bp, Artificial Sequence
  chemically synthesized
caattcaaggatcatctcac

SEQ ID NO: 498326 - DNA, 20 bp, Artificial Sequence
  chemically synthesized
gggtctcagtctggaaggat

SEQ ID NO: 498327 - DNA, 20 bp, Artificial Sequence
  chemically synthesized
gtttgggggtctcagtctgg

SEQ ID NO: 498328 - DNA, 20 bp, Artificial Sequence
  chemically synthesized
aggactgtctaacacagttt

SEQ ID NO: 498329 - DNA, 20 bp, Artificial Sequence
  chemically synthesized
cacagttttaatgcacagtg

SEQ ID NO: 498330 - DNA, 20 bp, Artificial Sequence
  chemically synthesized
cgtcactgtgcattaaaact

SEQ ID NO: 498331 - DNA, 20 bp, Artificial Sequence
  chemically synthesized
ctgtatttatatatacagaa

SEQ ID NO: 498332 - DNA, 20 bp, Artificial Sequence
  chemically synthesized
gtatatataaatacagaaat

SEQ ID NO: 498333 - DNA, 20 bp, Artificial Sequence
  chemically synthesized
tgagggctagaaatataaaa

SEQ ID NO: 498334 - DNA, 20 bp, Artificial Sequence
  chemically synthesized
agttttatatttctagccct

SEQ ID NO: 498335 - DNA, 20 bp, Artificial Sequence
  chemically synthesized
tctagccctcagaatcatag

SEQ ID NO: 498336 - DNA, 20 bp, Artificial Sequence
  chemically synthesized
tagggtcacactaatctttg

SEQ ID NO: 498337 - DNA, 20 bp, Artificial Sequence
  chemically synthesized
gtcacactaatctttgttga

SEQ ID NO: 498338 - DNA, 20 bp, Artificial Sequence
  chemically synthesized
taatctttgttgaatgaata

SEQ ID NO: 498339 - DNA, 20 bp, Artificial Sequence
  chemically synthesized
gttgaatgaataatgagtct

SEQ ID NO: 498340 - DNA, 20 bp, Artificial Sequence
  chemically synthesized
tctatgaatgaccagtttga

SEQ ID NO: 498341 - DNA, 20 bp, Artificial Sequence
  chemically synthesized
cagtttgacagagtttaagt

SEQ ID NO: 498342 - DNA, 20 bp, Artificial Sequence
  chemically synthesized
agagtttaagtgtggatgtc

SEQ ID NO: 498343 - DNA, 20 bp, Artificial Sequence
  chemically synthesized
gctacgaagaaagattaagg

SEQ ID NO: 498344 - DNA, 20 bp, Artificial Sequence
  chemically synthesized
ggtacagccaatacttatat

SEQ ID NO: 498345 - DNA, 20 bp, Artificial Sequence
  chemically synthesized
atatgtaaacagctccaaaa

SEQ ID NO: 498346 - DNA, 20 bp, Artificial Sequence
  chemically synthesized
acatatattttaattataat

SEQ ID NO: 498347 - DNA, 20 bp, Artificial Sequence
  chemically synthesized
acagaatataaagtgggttt

SEQ ID NO: 498348 - DNA, 20 bp, Artificial Sequence
  chemically synthesized
taatagaaacagaatataaa

SEQ ID NO: 498349 - DNA, 20 bp, Artificial Sequence
  chemically synthesized
actttatattctgtttctat

SEQ ID NO: 498350 - DNA, 20 bp, Artificial Sequence
  chemically synthesized
aattagtatcctaatagaaa

SEQ ID NO: 498351 - DNA, 20 bp, Artificial Sequence
  chemically synthesized
tgtttctttgtttttttttt

SEQ ID NO: 498352 - DNA, 20 bp, Artificial Sequence
  chemically synthesized
ttaatagtattgtgtttgca

SEQ ID NO: 498353 - DNA, 20 bp, Artificial Sequence
  chemically synthesized
tcaaattttattgagaacca

SEQ ID NO: 498354 - DNA, 20 bp, Artificial Sequence
  chemically synthesized
tgataattaacttggcatag

SEQ ID NO: 498355 - DNA, 20 bp, Artificial Sequence
  chemically synthesized
actatgccaagttaattatc

SEQ ID NO: 498356 - DNA, 20 bp, Artificial Sequence
  chemically synthesized
aacttggtgtgacttttatt

SEQ ID NO: 498357 - DNA, 20 bp, Artificial Sequence
  chemically synthesized
tggtgtgacttttattatga

SEQ ID NO: 498358 - DNA, 20 bp, Artificial Sequence
  chemically synthesized
taattacaaccttgtttttc

SEQ ID NO: 498359 - DNA, 20 bp, Artificial Sequence
  chemically synthesized
ccttgtttttctagaattat

SEQ ID NO: 498360 - DNA, 20 bp, Artificial Sequence
  chemically synthesized
tgctaatcattatgaaataa

SEQ ID NO: 498361 - DNA, 20 bp, Artificial Sequence
  chemically synthesized
tcctgtcttggtccctatat

SEQ ID NO: 498362 - DNA, 20 bp, Artificial Sequence
  chemically synthesized
ttcttatatagggaccaaga

SEQ ID NO: 498363 - DNA, 20 bp, Artificial Sequence
  chemically synthesized
gctaaacaaataagttaaca

SEQ ID NO: 498364 - DNA, 20 bp, Artificial Sequence
  chemically synthesized
aacaaataagttaacaaagg

SEQ ID NO: 498365 - DNA, 20 bp, Artificial Sequence
  chemically synthesized
aagaattggcctttcacttc

SEQ ID NO: 498366 - DNA, 20 bp, Artificial Sequence
  chemically synthesized
aataaaactaatgtctaact

SEQ ID NO: 498367 - DNA, 20 bp, Artificial Sequence
  chemically synthesized
ttagttttattccagcctag

SEQ ID NO: 498368 - DNA, 20 bp, Artificial Sequence
  chemically synthesized
gaatgagaattctcctaggc

SEQ ID NO: 498369 - DNA, 20 bp, Artificial Sequence
  chemically synthesized
ggtagagcatgggaatgaat

SEQ ID NO: 498370 - DNA, 20 bp, Artificial Sequence
  chemically synthesized
tcttatggtagagcatggga

SEQ ID NO: 498371 - DNA, 20 bp, Artificial Sequence
  chemically synthesized
taattcttatggtagagcat

SEQ ID NO: 498372 - DNA, 20 bp, Artificial Sequence
  chemically synthesized
tcattcccatgctctaccat

SEQ ID NO: 498373 - DNA, 20 bp, Artificial Sequence
  chemically synthesized
catcaattttatttcagtta

SEQ ID NO: 498374 - DNA, 20 bp, Artificial Sequence
  chemically synthesized
actgagtcagaactgcccaa

SEQ ID NO: 498375 - DNA, 20 bp, Artificial Sequence
  chemically synthesized
tttttttgtgctttgaaaat

SEQ ID NO: 498376 - DNA, 20 bp, Artificial Sequence
  chemically synthesized
gattcaaaggaacattttag

SEQ ID NO: 498377 - DNA, 20 bp, Artificial Sequence
  chemically synthesized
tatcctactaaaatgttcct

SEQ ID NO: 498378 - DNA, 20 bp, Artificial Sequence
  chemically synthesized
agctactgttcataatttca

SEQ ID NO: 498379 - DNA, 20 bp, Artificial Sequence
  chemically synthesized
aaagtgcttgaggaagagac

SEQ ID NO: 498380 - DNA, 20 bp, Artificial Sequence
  chemically synthesized
ggatacactgacaagtagct

SEQ ID NO: 498381 - DNA, 20 bp, Artificial Sequence
  chemically synthesized
tagctcagagtgctaatggc

SEQ ID NO: 498382 - DNA, 20 bp, Artificial Sequence
  chemically synthesized
agagtgctaatggcaagggt

SEQ ID NO: 498383 - DNA, 20 bp, Artificial Sequence
  chemically synthesized
ctccatcaatctctgattgt

SEQ ID NO: 498384 - DNA, 20 bp, Artificial Sequence
  chemically synthesized
ggaattagattgacctgagt

SEQ ID NO: 498385 - DNA, 20 bp, Artificial Sequence
  chemically synthesized
ggctttggaattagattgac

SEQ ID NO: 498386 - DNA, 20 bp, Artificial Sequence
  chemically synthesized
cacagttaagagcttggctt

SEQ ID NO: 498387 - DNA, 20 bp, Artificial Sequence
  chemically synthesized
tgtagcttttccagggataa

SEQ ID NO: 498388 - DNA, 20 bp, Artificial Sequence
  chemically synthesized
gccagatttgtagcttttcc

SEQ ID NO: 498389 - DNA, 20 bp, Artificial Sequence
  chemically synthesized
aaggttgccttcattttgtg

SEQ ID NO: 498390 - DNA, 20 bp, Artificial Sequence
  chemically synthesized
tcgatccttgaaccaaggac

SEQ ID NO: 498391 - DNA, 20 bp, Artificial Sequence
  chemically synthesized
tctattcttgtccttggttc

SEQ ID NO: 498392 - DNA, 20 bp, Artificial Sequence
  chemically synthesized
tccaaaatatttaggtctcc

SEQ ID NO: 498393 - DNA, 20 bp, Artificial Sequence
  chemically synthesized
tcaaggagacctaaatattt

SEQ ID NO: 498394 - DNA, 20 bp, Artificial Sequence
  chemically synthesized
aaatattttggaataggagc

SEQ ID NO: 498395 - DNA, 20 bp, Artificial Sequence
  chemically synthesized
tgcaagttttcctgcaaaaa

SEQ ID NO: 498396 - DNA, 20 bp, Artificial Sequence
  chemically synthesized
agtttggtatggtatggttc

SEQ ID NO: 498397 - DNA, 20 bp, Artificial Sequence
  chemically synthesized
acaagtatattcctgggaag

SEQ ID NO: 498398 - DNA, 20 bp, Artificial Sequence
  chemically synthesized
agaccttaattcatcttccc

SEQ ID NO: 498399 - DNA, 20 bp, Artificial Sequence
  chemically synthesized
aataatactttatagtttta

SEQ ID NO: 498400 - DNA, 20 bp, Artificial Sequence
  chemically synthesized
tttatagaatcttctcaatg

SEQ ID NO: 498401 - DNA, 20 bp, Artificial Sequence
  chemically synthesized
cacatgtatattactgattg

SEQ ID NO: 498402 - DNA, 20 bp, Artificial Sequence
  chemically synthesized
tttattgcatatatctcagt

SEQ ID NO: 498403 - DNA, 20 bp, Artificial Sequence
  chemically synthesized
tctcagtgggagtattggaa

SEQ ID NO: 498404 - DNA, 20 bp, Artificial Sequence
  chemically synthesized
attgtaagcagaagaggaag

SEQ ID NO: 498405 - DNA, 20 bp, Artificial Sequence
  chemically synthesized
atattatcactttgaagaca

SEQ ID NO: 498406 - DNA, 20 bp, Artificial Sequence
  chemically synthesized
gtttccaaagtcgacattaa

SEQ ID NO: 498407 - DNA, 20 bp, Artificial Sequence
  chemically synthesized
acataataaaaatggtaaat

SEQ ID NO: 498408 - DNA, 20 bp, Artificial Sequence
  chemically synthesized
gccacaatattagctaaaaa

SEQ ID NO: 498409 - DNA, 20 bp, Artificial Sequence
  chemically synthesized
cttatcgtattcctatccat

SEQ ID NO: 498410 - DNA, 20 bp, Artificial Sequence
  chemically synthesized
tccttttgacccgcatggat

SEQ ID NO: 498411 - DNA, 20 bp, Artificial Sequence
  chemically synthesized
ttaatttccttttgacccgc

SEQ ID NO: 498412 - DNA, 20 bp, Artificial Sequence
  chemically synthesized
ttcactgtttccgtcatgtc

SEQ ID NO: 498413 - DNA, 20 bp, Artificial Sequence
  chemically synthesized
tggctgaccatatgttgatt

SEQ ID NO: 498414 - DNA, 20 bp, Artificial Sequence
  chemically synthesized
catatggtcagccacttcca

SEQ ID NO: 498415 - DNA, 20 bp, Artificial Sequence
  chemically synthesized
atggtttttgtgctcctttt

SEQ ID NO: 498416 - DNA, 20 bp, Artificial Sequence
  chemically synthesized
atgcatttagtgactgggta

SEQ ID NO: 498417 - DNA, 20 bp, Artificial Sequence
  chemically synthesized
acttttaatgcatttagtga

SEQ ID NO: 498418 - DNA, 20 bp, Artificial Sequence
  chemically synthesized
attaaaagtacctcataaaa

SEQ ID NO: 498419 - DNA, 20 bp, Artificial Sequence
  chemically synthesized
ttcatgtcctttgcagggac

SEQ ID NO: 498420 - DNA, 20 bp, Artificial Sequence
  chemically synthesized
tgttcctgtgttagtttgct

SEQ ID NO: 498421 - DNA, 20 bp, Artificial Sequence
  chemically synthesized
tgttccactcccacttacga

SEQ ID NO: 498422 - DNA, 20 bp, Artificial Sequence
  chemically synthesized
gcatggactcactcgtaagt

SEQ ID NO: 498423 - DNA, 20 bp, Artificial Sequence
  chemically synthesized
tcactgttccactcccactt

SEQ ID NO: 498424 - DNA, 20 bp, Artificial Sequence
  chemically synthesized
aacacacactggtgcctgtt

SEQ ID NO: 498425 - DNA, 20 bp, Artificial Sequence
  chemically synthesized
gcctgttgggggtggggggc

SEQ ID NO: 498426 - DNA, 20 bp, Artificial Sequence
  chemically synthesized
tgggggtggggggctagggt

SEQ ID NO: 498427 - DNA, 20 bp, Artificial Sequence
  chemically synthesized
agaaatacctaatgtagatg

SEQ ID NO: 498428 - DNA, 20 bp, Artificial Sequence
  chemically synthesized
ctaatgtagatgacgggttg

SEQ ID NO: 498429 - DNA, 20 bp, Artificial Sequence
  chemically synthesized
tattattatactttacgttc

SEQ ID NO: 498430 - DNA, 20 bp, Artificial Sequence
  chemically synthesized
taatatttaaagttatgtga

SEQ ID NO: 498431 - DNA, 20 bp, Artificial Sequence
  chemically synthesized
taaataatatttaaagttat

SEQ ID NO: 498432 - DNA, 20 bp, Artificial Sequence
  chemically synthesized
ctgtgaccaagatacatacg

SEQ ID NO: 498433 - DNA, 20 bp, Artificial Sequence
  chemically synthesized
ctgaaacatctacatgaaac

SEQ ID NO: 498434 - DNA, 20 bp, Artificial Sequence
  chemically synthesized
tgtttcagatgtatctcaaa

SEQ ID NO: 498435 - DNA, 20 bp, Artificial Sequence
  chemically synthesized
caatattatctaatatgctc

SEQ ID NO: 498436 - DNA, 20 bp, Artificial Sequence
  chemically synthesized
ttgaaagacagtgaagtgtc

SEQ ID NO: 498437 - DNA, 20 bp, Artificial Sequence
  chemically synthesized
acttttgacagatttgaaag

SEQ ID NO: 498438 - DNA, 20 bp, Artificial Sequence
  chemically synthesized
ctgaaaacagaatggccact

SEQ ID NO: 498439 - DNA, 20 bp, Artificial Sequence
  chemically synthesized
ttagggaacctccctgaaaa

SEQ ID NO: 498440 - DNA, 20 bp, Artificial Sequence
  chemically synthesized
atgattatgtcactaccttg

SEQ ID NO: 498441 - DNA, 20 bp, Artificial Sequence
  chemically synthesized
gcctcatcctcttaaaatgg

SEQ ID NO: 498442 - DNA, 20 bp, Artificial Sequence
  chemically synthesized
ctgtaatcccaccattttaa

SEQ ID NO: 498443 - DNA, 20 bp, Artificial Sequence
  chemically synthesized
attttaagaggatgaggcgg

SEQ ID NO: 498444 - DNA, 20 bp, Artificial Sequence
  chemically synthesized
ctaagtttctaaggctgatc

SEQ ID NO: 498445 - DNA, 20 bp, Artificial Sequence
  chemically synthesized
aaacaattattttgaagaga

SEQ ID NO: 498446 - DNA, 20 bp, Artificial Sequence
  chemically synthesized
caccctcctacctcagcttc

SEQ ID NO: 498447 - DNA, 20 bp, Artificial Sequence
  chemically synthesized
tacccaggaagctgaggtag

SEQ ID NO: 498448 - DNA, 20 bp, Artificial Sequence
  chemically synthesized
gaggtaggagggtgatatgg

SEQ ID NO: 498449 - DNA, 20 bp, Artificial Sequence
  chemically synthesized
gggaggattgcttgagccca

SEQ ID NO: 498450 - DNA, 20 bp, Artificial Sequence
  chemically synthesized
tctcactctgttgcccaggc

SEQ ID NO: 498451 - DNA, 20 bp, Artificial Sequence
  chemically synthesized
ctgcactccagcctgggcaa

SEQ ID NO: 498452 - DNA, 20 bp, Artificial Sequence
  chemically synthesized
aaataagtaaaacaaaattt

SEQ ID NO: 498453 - DNA, 20 bp, Artificial Sequence
  chemically synthesized
taaaagaaagcccttgtgta

SEQ ID NO: 498454 - DNA, 20 bp, Artificial Sequence
  chemically synthesized
catacacaagggctttcttt

SEQ ID NO: 498455 - DNA, 20 bp, Artificial Sequence
  chemically synthesized
tgagatgttggtagagatct

SEQ ID NO: 498456 - DNA, 20 bp, Artificial Sequence
  chemically synthesized
gcaactcagtaaagagtgta

SEQ ID NO: 498457 - DNA, 20 bp, Artificial Sequence
  chemically synthesized
gtgactccctacactcttta

SEQ ID NO: 498458 - DNA, 20 bp, Artificial Sequence
  chemically synthesized
cagagacctgcaactcagta

SEQ ID NO: 498459 - DNA, 20 bp, Artificial Sequence
  chemically synthesized
aatgctgcagtctagagact

SEQ ID NO: 498460 - DNA, 20 bp, Artificial Sequence
  chemically synthesized
actgcagcatttctttttgt

SEQ ID NO: 498461 - DNA, 20 bp, Artificial Sequence
  chemically synthesized
tacaagccgcagtaggtgct

SEQ ID NO: 498462 - DNA, 20 bp, Artificial Sequence
  chemically synthesized
ttaaggcaataatcatatac

SEQ ID NO: 498463 - DNA, 20 bp, Artificial Sequence
  chemically synthesized
ttgtttctgcctttttggag

SEQ ID NO: 498464 - DNA, 20 bp, Artificial Sequence
  chemically synthesized
gtgttctttgttaatttctg

SEQ ID NO: 498465 - DNA, 20 bp, Artificial Sequence
  chemically synthesized
tttctgtagagtttttgaga

SEQ ID NO: 498466 - DNA, 20 bp, Artificial Sequence
  chemically synthesized
tagagtttttgagacaggat

SEQ ID NO: 498467 - DNA, 20 bp, Artificial Sequence
  chemically synthesized
aggatcagaattactatatg

SEQ ID NO: 498468 - DNA, 20 bp, Artificial Sequence
  chemically synthesized
aattactatatgttgaataa

SEQ ID NO: 498469 - DNA, 20 bp, Artificial Sequence
  chemically synthesized
gttttataaaccatttaccg

SEQ ID NO: 498470 - DNA, 20 bp, Artificial Sequence
  chemically synthesized
cgatcgattaagtattggta

SEQ ID NO: 498471 - DNA, 20 bp, Artificial Sequence
  chemically synthesized
gagatatcatggtgagattt

SEQ ID NO: 498472 - DNA, 20 bp, Artificial Sequence
  chemically synthesized
gtctttaagaacctcataga

SEQ ID NO: 498473 - DNA, 20 bp, Artificial Sequence
  chemically synthesized
tcttatcttcatctattttt

SEQ ID NO: 498474 - DNA, 20 bp, Artificial Sequence
  chemically synthesized
atgaaaaaattgaggcggcc

SEQ ID NO: 498475 - DNA, 20 bp, Artificial Sequence
  chemically synthesized
ttctattctcttagtgtcga

SEQ ID NO: 498476 - DNA, 20 bp, Artificial Sequence
  chemically synthesized
tttaaccctatcgacactaa

SEQ ID NO: 498477 - DNA, 20 bp, Artificial Sequence
  chemically synthesized
gcacacagtattttttggca

SEQ ID NO: 498478 - DNA, 20 bp, Artificial Sequence
  chemically synthesized
gtgtgctattcaaatttctg

SEQ ID NO: 498479 - DNA, 20 bp, Artificial Sequence
  chemically synthesized
gcttttcatcctccagaaat

SEQ ID NO: 498480 - DNA, 20 bp, Artificial Sequence
  chemically synthesized
tggcagaacgatgtaaagtg

SEQ ID NO: 498481 - DNA, 20 bp, Artificial Sequence
  chemically synthesized
caaagggctgacaatataaa

SEQ ID NO: 498482 - DNA, 20 bp, Artificial Sequence
  chemically synthesized
gttagatcatccttactcat

SEQ ID NO: 498483 - DNA, 20 bp, Artificial Sequence
  chemically synthesized
aggatcagaccctgatgagt

SEQ ID NO: 498484 - DNA, 20 bp, Artificial Sequence
  chemically synthesized
aaagcaaggatcagaccctg

SEQ ID NO: 498485 - DNA, 20 bp, Artificial Sequence
  chemically synthesized
tccctaagtacaattaaagc

SEQ ID NO: 498486 - DNA, 20 bp, Artificial Sequence
  chemically synthesized
ccttgctttaattgtactta

SEQ ID NO: 498487 - DNA, 20 bp, Artificial Sequence
  chemically synthesized
tctcgctctgtcacccaggc

SEQ ID NO: 498488 - DNA, 20 bp, Artificial Sequence
  chemically synthesized
tcacgccactgcactccagc

SEQ ID NO: 498489 - DNA, 20 bp, Artificial Sequence
  chemically synthesized
ctcactgcaacctccgcctg

SEQ ID NO: 498490 - DNA, 20 bp, Artificial Sequence
  chemically synthesized
tacttgggaggctgaggcag

SEQ ID NO: 498491 - DNA, 20 bp, Artificial Sequence
  chemically synthesized
ttttgtatttttagtagaga

SEQ ID NO: 498492 - DNA, 20 bp, Artificial Sequence
  chemically synthesized
gacgggcagattatgaggtc

SEQ ID NO: 498493 - DNA, 20 bp, Artificial Sequence
  chemically synthesized
acatagaggaaaaagaagat

SEQ ID NO: 498494 - DNA, 20 bp, Artificial Sequence
  chemically synthesized
aaatgaaaactcttctgcaa

SEQ ID NO: 498495 - DNA, 20 bp, Artificial Sequence
  chemically synthesized
tttaataaactcttttgcag

SEQ ID NO: 498496 - DNA, 20 bp, Artificial Sequence
  chemically synthesized
ctctgtctcaaaaacaaaca

SEQ ID NO: 498497 - DNA, 20 bp, Artificial Sequence
  chemically synthesized
ttctttgtttgtttttgaga

SEQ ID NO: 498498 - DNA, 20 bp, Artificial Sequence
  chemically synthesized
ctcactgcaacctccgcctc

SEQ ID NO: 498499 - DNA, 20 bp, Artificial Sequence
  chemically synthesized
tacttgggaggctgaggcag

SEQ ID NO: 498500 - DNA, 20 bp, Artificial Sequence
  chemically synthesized
gcctcagcctcccaagtagc

SEQ ID NO: 498501 - DNA, 20 bp, Artificial Sequence
  chemically synthesized
ttttgtatttttagcagaga

SEQ ID NO: 498502 - DNA, 20 bp, Artificial Sequence
  chemically synthesized
gatcacttgaggccaggagt

SEQ ID NO: 498503 - DNA, 20 bp, Artificial Sequence
  chemically synthesized
tgggcagatcacttgaggcc

SEQ ID NO: 498504 - DNA, 20 bp, Artificial Sequence
  chemically synthesized
acctcggcctctcaaattgc

SEQ ID NO: 498505 - DNA, 20 bp, Artificial Sequence
  chemically synthesized
acttcttatataaaacaaaa

SEQ ID NO: 498506 - DNA, 20 bp, Artificial Sequence
  chemically synthesized
ccagtaagcataactagcaa

SEQ ID NO: 498507 - DNA, 20 bp, Artificial Sequence
  chemically synthesized
tcacttgctagttatgctta

SEQ ID NO: 498508 - DNA, 20 bp, Artificial Sequence
  chemically synthesized
ggtatctacttggccaaaca

SEQ ID NO: 498509 - DNA, 20 bp, Artificial Sequence
  chemically synthesized
atacacactgtgaacttctt

SEQ ID NO: 498510 - DNA, 20 bp, Artificial Sequence
  chemically synthesized
gtatgttgtttgtacatgta

SEQ ID NO: 498511 - DNA, 20 bp, Artificial Sequence
  chemically synthesized
ataacatgattcataatgtg

SEQ ID NO: 498512 - DNA, 20 bp, Artificial Sequence
  chemically synthesized
atataaacacccttcacatt

SEQ ID NO: 498513 - DNA, 20 bp, Artificial Sequence
  chemically synthesized
caccaatttccatttccatt

SEQ ID NO: 498514 - DNA, 20 bp, Artificial Sequence
  chemically synthesized
cacaatggaaatggaaattg

SEQ ID NO: 498515 - DNA, 20 bp, Artificial Sequence
  chemically synthesized
caattgcatgtaatgcaatg

SEQ ID NO: 498516 - DNA, 20 bp, Artificial Sequence
  chemically synthesized
gctcattactgctcactaat

SEQ ID NO: 498517 - DNA, 20 bp, Artificial Sequence
  chemically synthesized
gtggcattagatacattcac

SEQ ID NO: 498518 - DNA, 20 bp, Artificial Sequence
  chemically synthesized
ggtgatgtttacatatccat

SEQ ID NO: 498519 - DNA, 20 bp, Artificial Sequence
  chemically synthesized
agtttcagtttagaaagatg

SEQ ID NO: 498520 - DNA, 20 bp, Artificial Sequence
  chemically synthesized
cagttcttgtgtcattggta

SEQ ID NO: 498521 - DNA, 20 bp, Artificial Sequence
  chemically synthesized
atggttgccagggaccaggg

SEQ ID NO: 498522 - DNA, 20 bp, Artificial Sequence
  chemically synthesized
aaccatgcaactatttgtct

SEQ ID NO: 498523 - DNA, 20 bp, Artificial Sequence
  chemically synthesized
aagaatttaactactctagg

SEQ ID NO: 498524 - DNA, 20 bp, Artificial Sequence
  chemically synthesized
aactttggagatattccacc

SEQ ID NO: 498525 - DNA, 20 bp, Artificial Sequence
  chemically synthesized
tccaaagttcatccctattt

SEQ ID NO: 498526 - DNA, 20 bp, Artificial Sequence
  chemically synthesized
attctgtcacatcctaaaat

SEQ ID NO: 498527 - DNA, 20 bp, Artificial Sequence
  chemically synthesized
atccctattttaggatgtga

SEQ ID NO: 498528 - DNA, 20 bp, Artificial Sequence
  chemically synthesized
aacagtattctgctttaaaa

SEQ ID NO: 498529 - DNA, 20 bp, Artificial Sequence
  chemically synthesized
aatttcattcctttttaaag

SEQ ID NO: 498530 - DNA, 20 bp, Artificial Sequence
  chemically synthesized
gcagaatactgttctgctgt

SEQ ID NO: 498531 - DNA, 20 bp, Artificial Sequence
  chemically synthesized
gtacactgtgtacactgacc

SEQ ID NO: 498532 - DNA, 20 bp, Artificial Sequence
  chemically synthesized
taaaatatgctgctatgaac

SEQ ID NO: 498533 - DNA, 20 bp, Artificial Sequence
  chemically synthesized
ttgggtgtacaaatatctgt

SEQ ID NO: 498534 - DNA, 20 bp, Artificial Sequence
  chemically synthesized
aatacctgttttcaattatt

SEQ ID NO: 498535 - DNA, 20 bp, Artificial Sequence
  chemically synthesized
tttgggtatatacccagaag

SEQ ID NO: 498536 - DNA, 20 bp, Artificial Sequence
  chemically synthesized
atgatccaataattccactt

SEQ ID NO: 498537 - DNA, 20 bp, Artificial Sequence
  chemically synthesized
tatacccagaagtggaatta

SEQ ID NO: 498538 - DNA, 20 bp, Artificial Sequence
  chemically synthesized
gtttaaaaataaagttttat

SEQ ID NO: 498539 - DNA, 20 bp, Artificial Sequence
  chemically synthesized
catagacaatatgtaaatga

SEQ ID NO: 498540 - DNA, 20 bp, Artificial Sequence
  chemically synthesized
caaccatagacaatatgtaa

SEQ ID NO: 498541 - DNA, 20 bp, Artificial Sequence
  chemically synthesized
gcaaaaaaaaaaaaaaatgg

SEQ ID NO: 498542 - DNA, 20 bp, Artificial Sequence
  chemically synthesized
atttactatcttgttcctta

SEQ ID NO: 498543 - DNA, 20 bp, Artificial Sequence
  chemically synthesized
atatgtttcatgtgaaacca

SEQ ID NO: 498544 - DNA, 20 bp, Artificial Sequence
  chemically synthesized
ttcatgttgggaaatagaaa

SEQ ID NO: 498545 - DNA, 20 bp, Artificial Sequence
  chemically synthesized
tgttttctcatatgtaggcc

SEQ ID NO: 498546 - DNA, 20 bp, Artificial Sequence
  chemically synthesized
atgagaaaacaaggaaagtg

SEQ ID NO: 498547 - DNA, 20 bp, Artificial Sequence
  chemically synthesized
atgaggtctggatattaata

SEQ ID NO: 498548 - DNA, 20 bp, Artificial Sequence
  chemically synthesized
tttagctgcaacaatgaggt

SEQ ID NO: 498549 - DNA, 20 bp, Artificial Sequence
  chemically synthesized
atctatctcatcacaaatca

SEQ ID NO: 498550 - DNA, 20 bp, Artificial Sequence
  chemically synthesized
ttgatatagggaaagtatat

SEQ ID NO: 498551 - DNA, 20 bp, Artificial Sequence
  chemically synthesized
ctttcttcttttattgaaga

SEQ ID NO: 498552 - DNA, 20 bp, Artificial Sequence
  chemically synthesized
tcttttattgaagatggggt

SEQ ID NO: 498553 - DNA, 20 bp, Artificial Sequence
  chemically synthesized
tactgcatcaagtgagagac

SEQ ID NO: 498554 - DNA, 20 bp, Artificial Sequence
  chemically synthesized
agacttgagtctgggagagg

SEQ ID NO: 498555 - DNA, 20 bp, Artificial Sequence
  chemically synthesized
atcatttgtcctccaaaagc

SEQ ID NO: 498556 - DNA, 20 bp, Artificial Sequence
  chemically synthesized
ttttcagtcatacatagtac

SEQ ID NO: 498557 - DNA, 20 bp, Artificial Sequence
  chemically synthesized
tgactgaaaacatacttgcc

SEQ ID NO: 498558 - DNA, 20 bp, Artificial Sequence
  chemically synthesized
ttgcctggaatgttaaagat

SEQ ID NO: 498559 - DNA, 20 bp, Artificial Sequence
  chemically synthesized
cgttaatctaatattgacag

SEQ ID NO: 498560 - DNA, 20 bp, Artificial Sequence
  chemically synthesized
gtctctcactattactgtgt

SEQ ID NO: 498561 - DNA, 20 bp, Artificial Sequence
  chemically synthesized
ggtctctaggaacttgcttt

SEQ ID NO: 498562 - DNA, 20 bp, Artificial Sequence
  chemically synthesized
taggaacttgctttacgaat

SEQ ID NO: 498563 - DNA, 20 bp, Artificial Sequence
  chemically synthesized
cgaatctgggtgctcctgta

SEQ ID NO: 498564 - DNA, 20 bp, Artificial Sequence
  chemically synthesized
gtattgggtgcatatatatt

SEQ ID NO: 498565 - DNA, 20 bp, Artificial Sequence
  chemically synthesized
aaagatcaagaaagacaaag

SEQ ID NO: 498566 - DNA, 20 bp, Artificial Sequence
  chemically synthesized
aagtctgttttatcagagac

SEQ ID NO: 498567 - DNA, 20 bp, Artificial Sequence
  chemically synthesized
aaaaaaataaaaaaaaaaac

SEQ ID NO: 498568 - DNA, 20 bp, Artificial Sequence
  chemically synthesized
ggctcaaagcaaagggatgg

SEQ ID NO: 498569 - DNA, 20 bp, Artificial Sequence
  chemically synthesized
cacacataggctcaaagcaa

SEQ ID NO: 498570 - DNA, 20 bp, Artificial Sequence
  chemically synthesized
tgtgtgtgtttgcatgtgag

SEQ ID NO: 498571 - DNA, 20 bp, Artificial Sequence
  chemically synthesized
ttgcatgtgagatgggtctc

SEQ ID NO: 498572 - DNA, 20 bp, Artificial Sequence
  chemically synthesized
acagactggcaaattggata

SEQ ID NO: 498573 - DNA, 20 bp, Artificial Sequence
  chemically synthesized
aaaagacacagactggcaaa

SEQ ID NO: 498574 - DNA, 20 bp, Artificial Sequence
  chemically synthesized
taaagttaatattgtcatgt

SEQ ID NO: 498575 - DNA, 20 bp, Artificial Sequence
  chemically synthesized
actaaccaacatcataatta

SEQ ID NO: 498576 - DNA, 20 bp, Artificial Sequence
  chemically synthesized
tagttgaggcagtttcttca

SEQ ID NO: 498577 - DNA, 20 bp, Artificial Sequence
  chemically synthesized
tggcttacaagagctcctga

SEQ ID NO: 498578 - DNA, 20 bp, Artificial Sequence
  chemically synthesized
cctttacagacaagcaaatg

SEQ ID NO: 498579 - DNA, 20 bp, Artificial Sequence
  chemically synthesized
tcagcatttgcttgtctgta

SEQ ID NO: 498580 - DNA, 20 bp, Artificial Sequence
  chemically synthesized
gcttatgaaacttagtttgg

SEQ ID NO: 498581 - DNA, 20 bp, Artificial Sequence
  chemically synthesized
gtttggctggatatgaaatt

SEQ ID NO: 498582 - DNA, 20 bp, Artificial Sequence
  chemically synthesized
caataagggaattttcaacc

SEQ ID NO: 498583 - DNA, 20 bp, Artificial Sequence
  chemically synthesized
ggttgaaaattcccttattg

SEQ ID NO: 498584 - DNA, 20 bp, Artificial Sequence
  chemically synthesized
tattcaacactcttcaataa

SEQ ID NO: 498585 - DNA, 20 bp, Artificial Sequence
  chemically synthesized
aattcccttattgaagagtg

SEQ ID NO: 498586 - DNA, 20 bp, Artificial Sequence
  chemically synthesized
accctacaagctagaagaga

SEQ ID NO: 498587 - DNA, 20 bp, Artificial Sequence
  chemically synthesized
agaaaccctacaagctagaa

SEQ ID NO: 498588 - DNA, 20 bp, Artificial Sequence
  chemically synthesized
acccactctcttctagcttg

SEQ ID NO: 498589 - DNA, 20 bp, Artificial Sequence
  chemically synthesized
tctagcttgtagggtttctg

SEQ ID NO: 498590 - DNA, 20 bp, Artificial Sequence
  chemically synthesized
ggaagcccatcagactaaca

SEQ ID NO: 498591 - DNA, 20 bp, Artificial Sequence
  chemically synthesized
agtctgatgggcttcccttt

SEQ ID NO: 498592 - DNA, 20 bp, Artificial Sequence
  chemically synthesized
ggggcagccagagagaaagg

SEQ ID NO: 498593 - DNA, 20 bp, Artificial Sequence
  chemically synthesized
gagcaacttcagccaagtct

SEQ ID NO: 498594 - DNA, 20 bp, Artificial Sequence
  chemically synthesized
cacaagcattcctatacacc

SEQ ID NO: 498595 - DNA, 20 bp, Artificial Sequence
  chemically synthesized
tttgtctattcttggtgtat

SEQ ID NO: 498596 - DNA, 20 bp, Artificial Sequence
  chemically synthesized
gacaaacagagagccaaatc

SEQ ID NO: 498597 - DNA, 20 bp, Artificial Sequence
  chemically synthesized
tctttgtagcaattgtgaat

SEQ ID NO: 498598 - DNA, 20 bp, Artificial Sequence
  chemically synthesized
ttattctctttgtagcaatt

SEQ ID NO: 498599 - DNA, 20 bp, Artificial Sequence
  chemically synthesized
ctattcacaattgctacaaa

SEQ ID NO: 498600 - DNA, 20 bp, Artificial Sequence
  chemically synthesized
acaaagagaataaagtgcct

SEQ ID NO: 498601 - DNA, 20 bp, Artificial Sequence
  chemically synthesized
gcctaggaatacaacttaca

SEQ ID NO: 498602 - DNA, 20 bp, Artificial Sequence
  chemically synthesized
atttcatgctcgtggttagg

SEQ ID NO: 498603 - DNA, 20 bp, Artificial Sequence
  chemically synthesized
tcgtggttaggaagaatcag

SEQ ID NO: 498604 - DNA, 20 bp, Artificial Sequence
  chemically synthesized
gtagcctgttggggatagca

SEQ ID NO: 498605 - DNA, 20 bp, Artificial Sequence
  chemically synthesized
aaagtcagtggtagcctgtt

SEQ ID NO: 498606 - DNA, 20 bp, Artificial Sequence
  chemically synthesized
gctaccactgactttcttta

SEQ ID NO: 498607 - DNA, 20 bp, Artificial Sequence
  chemically synthesized
ccagctttgttcattttact

SEQ ID NO: 498608 - DNA, 20 bp, Artificial Sequence
  chemically synthesized
acaaaaacaagcaacgggga

SEQ ID NO: 498609 - DNA, 20 bp, Artificial Sequence
  chemically synthesized
ccaacaccatttattaaata

SEQ ID NO: 498610 - DNA, 20 bp, Artificial Sequence
  chemically synthesized
ttttgtataaggggtaagga

SEQ ID NO: 498611 - DNA, 20 bp, Artificial Sequence
  chemically synthesized
cttgagttgatttttgtata

SEQ ID NO: 498612 - DNA, 20 bp, Artificial Sequence
  chemically synthesized
gtttaagtctttaatgcatc

SEQ ID NO: 498613 - DNA, 20 bp, Artificial Sequence
  chemically synthesized
gtattgcctaggttttcttc

SEQ ID NO: 498614 - DNA, 20 bp, Artificial Sequence
  chemically synthesized
tctttccccgtacttgtgtc

SEQ ID NO: 498615 - DNA, 20 bp, Artificial Sequence
  chemically synthesized
caaaagccaaaattgacaaa

SEQ ID NO: 498616 - DNA, 20 bp, Artificial Sequence
  chemically synthesized
actgcaaaagaaactatcat

SEQ ID NO: 498617 - DNA, 20 bp, Artificial Sequence
  chemically synthesized
tctgacaaagggctaatacc

SEQ ID NO: 498618 - DNA, 20 bp, Artificial Sequence
  chemically synthesized
gtttaagttccttatagatt

SEQ ID NO: 498619 - DNA, 20 bp, Artificial Sequence
  chemically synthesized
tatccttagcccactttctg

SEQ ID NO: 498620 - DNA, 20 bp, Artificial Sequence
  chemically synthesized
aacccatcagaaagtgggct

SEQ ID NO: 498621 - DNA, 20 bp, Artificial Sequence
  chemically synthesized
tcattatcactggtcattag

SEQ ID NO: 498622 - DNA, 20 bp, Artificial Sequence
  chemically synthesized
agataccatctcacaccagt

SEQ ID NO: 498623 - DNA, 20 bp, Artificial Sequence
  chemically synthesized
catctgttgttgcctgactt

SEQ ID NO: 498624 - DNA, 20 bp, Artificial Sequence
  chemically synthesized
aggcaacaacagatgctgga

SEQ ID NO: 498625 - DNA, 20 bp, Artificial Sequence
  chemically synthesized
agacagtgtggcgattcctc

SEQ ID NO: 498626 - DNA, 20 bp, Artificial Sequence
  chemically synthesized
tttctggttctgtatccttg

SEQ ID NO: 498627 - DNA, 20 bp, Artificial Sequence
  chemically synthesized
tatatgcagtaatgggattg

SEQ ID NO: 498628 - DNA, 20 bp, Artificial Sequence
  chemically synthesized
tttgggtatatatgcagtaa

SEQ ID NO: 498629 - DNA, 20 bp, Artificial Sequence
  chemically synthesized
ggagaatgatttataatact

SEQ ID NO: 498630 - DNA, 20 bp, Artificial Sequence
  chemically synthesized
gtgtgcatgtgtctttatag

SEQ ID NO: 498631 - DNA, 20 bp, Artificial Sequence
  chemically synthesized
agtctatcattgatgggcat

SEQ ID NO: 498632 - DNA, 20 bp, Artificial Sequence
  chemically synthesized
aaatgcccatcaatgataga

SEQ ID NO: 498633 - DNA, 20 bp, Artificial Sequence
  chemically synthesized
aaattggcacatatacacca

SEQ ID NO: 498634 - DNA, 20 bp, Artificial Sequence
  chemically synthesized
aatactatgcagccataaaa

SEQ ID NO: 498635 - DNA, 20 bp, Artificial Sequence
  chemically synthesized
ctatgcagccataaaaaaga

SEQ ID NO: 498636 - DNA, 20 bp, Artificial Sequence
  chemically synthesized
ttcatgtcctttgcacggac

SEQ ID NO: 498637 - DNA, 20 bp, Artificial Sequence
  chemically synthesized
tgttcctgtgttagtttgct

SEQ ID NO: 498638 - DNA, 20 bp, Artificial Sequence
  chemically synthesized
ttcaactcccacttatgggt

SEQ ID NO: 498639 - DNA, 20 bp, Artificial Sequence
  chemically synthesized
acatattctcacccataagt

SEQ ID NO: 498640 - DNA, 20 bp, Artificial Sequence
  chemically synthesized
tcatcgttcaactcccactt

SEQ ID NO: 498641 - DNA, 20 bp, Artificial Sequence
  chemically synthesized
tcacacaccggggcctctca

SEQ ID NO: 498642 - DNA, 20 bp, Artificial Sequence
  chemically synthesized
ccggggcctctcaggggatg

SEQ ID NO: 498643 - DNA, 20 bp, Artificial Sequence
  chemically synthesized
aggggatggggggttagggg

SEQ ID NO: 498644 - DNA, 20 bp, Artificial Sequence
  chemically synthesized
agaaatacctaatgtagatg

SEQ ID NO: 498645 - DNA, 20 bp, Artificial Sequence
  chemically synthesized
tataataatgaaaaaaagat

SEQ ID NO: 498646 - DNA, 20 bp, Artificial Sequence
  chemically synthesized
gttttgaacatagccatagg

SEQ ID NO: 498647 - DNA, 20 bp, Artificial Sequence
  chemically synthesized
aaatagaaaaataaatgatt

SEQ ID NO: 498648 - DNA, 20 bp, Artificial Sequence
  chemically synthesized
tttgtacctgagacctgatt

SEQ ID NO: 498649 - DNA, 20 bp, Artificial Sequence
  chemically synthesized
agtatagagaaataatttca

SEQ ID NO: 498650 - DNA, 20 bp, Artificial Sequence
  chemically synthesized
tatatcagatatgatgccat

SEQ ID NO: 498651 - DNA, 20 bp, Artificial Sequence
  chemically synthesized
taaataatagtttattttaa

SEQ ID NO: 498652 - DNA, 20 bp, Artificial Sequence
  chemically synthesized
tattttaaatgaatatagac

SEQ ID NO: 498653 - DNA, 20 bp, Artificial Sequence
  chemically synthesized
ttcttctccataagatgaaa

SEQ ID NO: 498654 - DNA, 20 bp, Artificial Sequence
  chemically synthesized
ccataagatgaaagaggatt

SEQ ID NO: 498655 - DNA, 20 bp, Artificial Sequence
  chemically synthesized
tgatattttagggtccaaaa

SEQ ID NO: 498656 - DNA, 20 bp, Artificial Sequence
  chemically synthesized
aataatattgtgtgatattt

SEQ ID NO: 498657 - DNA, 20 bp, Artificial Sequence
  chemically synthesized
tttgagtaggtataatttta

SEQ ID NO: 498658 - DNA, 20 bp, Artificial Sequence
  chemically synthesized
tatgatatggctagacagat

SEQ ID NO: 498659 - DNA, 20 bp, Artificial Sequence
  chemically synthesized
atgaaaaatatttcacactt

SEQ ID NO: 498660 - DNA, 20 bp, Artificial Sequence
  chemically synthesized
tgaatacatattaaatgtaa

SEQ ID NO: 498661 - DNA, 20 bp, Artificial Sequence
  chemically synthesized
tttaaatttaaaaagttagc

SEQ ID NO: 498662 - DNA, 20 bp, Artificial Sequence
  chemically synthesized
ttgaagtaaattatacaata

SEQ ID NO: 498663 - DNA, 20 bp, Artificial Sequence
  chemically synthesized
ttttatatttcatattattt

SEQ ID NO: 498664 - DNA, 20 bp, Artificial Sequence
  chemically synthesized
ataattttatatatgtttaa

SEQ ID NO: 498665 - DNA, 20 bp, Artificial Sequence
  chemically synthesized
ttactttgtactaaatgtaa

SEQ ID NO: 498666 - DNA, 20 bp, Artificial Sequence
  chemically synthesized
atattaaatttatattcatg

SEQ ID NO: 498667 - DNA, 20 bp, Artificial Sequence
  chemically synthesized
aatgtttacttatattcatc

SEQ ID NO: 498668 - DNA, 20 bp, Artificial Sequence
  chemically synthesized
atgatgaatataagtaaaca

SEQ ID NO: 498669 - DNA, 20 bp, Artificial Sequence
  chemically synthesized
ttaagaaatttgctatctgc

SEQ ID NO: 498670 - DNA, 20 bp, Artificial Sequence
  chemically synthesized
ggatgttcaataaaaatgta

SEQ ID NO: 498671 - DNA, 20 bp, Artificial Sequence
  chemically synthesized
acatttttattgaacatcca

SEQ ID NO: 498672 - DNA, 20 bp, Artificial Sequence
  chemically synthesized
tattcatcgcaacgaactcg

SEQ ID NO: 498673 - DNA, 20 bp, Artificial Sequence
  chemically synthesized
catccatcgagttcgttgcg

SEQ ID NO: 498674 - DNA, 20 bp, Artificial Sequence
  chemically synthesized
tacatagcagtcttcgaagc

SEQ ID NO: 498675 - DNA, 20 bp, Artificial Sequence
  chemically synthesized
tattgaaggtctacaatgct

SEQ ID NO: 498676 - DNA, 20 bp, Artificial Sequence
  chemically synthesized
agcttataatttgtctaata

SEQ ID NO: 498677 - DNA, 20 bp, Artificial Sequence
  chemically synthesized
taggagacagtaaaaataag

SEQ ID NO: 498678 - DNA, 20 bp, Artificial Sequence
  chemically synthesized
gcaatgttccagatgttcag

SEQ ID NO: 498679 - DNA, 20 bp, Artificial Sequence
  chemically synthesized
gagttggagatcatctcctt

SEQ ID NO: 498680 - DNA, 20 bp, Artificial Sequence
  chemically synthesized
agcatctgagcagggcatgg

SEQ ID NO: 498681 - DNA, 20 bp, Artificial Sequence
  chemically synthesized
gggcatggaaggatcattta

SEQ ID NO: 498682 - DNA, 20 bp, Artificial Sequence
  chemically synthesized
gacaaaaaattttgggacag

SEQ ID NO: 498683 - DNA, 20 bp, Artificial Sequence
  chemically synthesized
ctaattttcttcaccacaga

SEQ ID NO: 498684 - DNA, 20 bp, Artificial Sequence
  chemically synthesized
gtgaagaaaattagtactct

SEQ ID NO: 498685 - DNA, 20 bp, Artificial Sequence
  chemically synthesized
aatcaataccaagatatcca

SEQ ID NO: 498686 - DNA, 20 bp, Artificial Sequence
  chemically synthesized
tcatgttcccttgaggtttc

SEQ ID NO: 498687 - DNA, 20 bp, Artificial Sequence
  chemically synthesized
tttcgtgagtgcaattgtga

SEQ ID NO: 498688 - DNA, 20 bp, Artificial Sequence
  chemically synthesized
tcctacactttcccactttc

SEQ ID NO: 498689 - DNA, 20 bp, Artificial Sequence
  chemically synthesized
gatgaaagcaatttaggtcc

SEQ ID NO: 498690 - DNA, 20 bp, Artificial Sequence
  chemically synthesized
aggtccctgagtcactgtga

SEQ ID NO: 498691 - DNA, 20 bp, Artificial Sequence
  chemically synthesized
cctgaaatcaaagtggccta

SEQ ID NO: 498692 - DNA, 20 bp, Artificial Sequence
  chemically synthesized
tcattaggccactttgattt

SEQ ID NO: 498693 - DNA, 20 bp, Artificial Sequence
  chemically synthesized
ggcatctaacattaattgtt

SEQ ID NO: 498694 - DNA, 20 bp, Artificial Sequence
  chemically synthesized
ataagtatctccactctttg

SEQ ID NO: 498695 - DNA, 20 bp, Artificial Sequence
  chemically synthesized
aagcagggtaccattcacca

SEQ ID NO: 498696 - DNA, 20 bp, Artificial Sequence
  chemically synthesized
gaatggtaccctgcttttcc

SEQ ID NO: 498697 - DNA, 20 bp, Artificial Sequence
  chemically synthesized
taatttcatccaaggaaaag

SEQ ID NO: 498698 - DNA, 20 bp, Artificial Sequence
  chemically synthesized
aagatcatgcagaatgaggg

SEQ ID NO: 498699 - DNA, 20 bp, Artificial Sequence
  chemically synthesized
taggtccccctaagatcatg

SEQ ID NO: 498700 - DNA, 20 bp, Artificial Sequence
  chemically synthesized
gaacttgtcccaccagttta

SEQ ID NO: 498701 - DNA, 20 bp, Artificial Sequence
  chemically synthesized
tgccaattacatttagaaat

SEQ ID NO: 498702 - DNA, 20 bp, Artificial Sequence
  chemically synthesized
tacatttagaaatttgaatc

SEQ ID NO: 498703 - DNA, 20 bp, Artificial Sequence
  chemically synthesized
gaatctagaattgagaaagg

SEQ ID NO: 498704 - DNA, 20 bp, Artificial Sequence
  chemically synthesized
aactccagggaagttacttt

SEQ ID NO: 498705 - DNA, 20 bp, Artificial Sequence
  chemically synthesized
catccaaaaagtaacttccc

SEQ ID NO: 498706 - DNA, 20 bp, Artificial Sequence
  chemically synthesized
ggcagagggagggcagcact

SEQ ID NO: 498707 - DNA, 20 bp, Artificial Sequence
  chemically synthesized
agtgaaatgaaacttactgg

SEQ ID NO: 498708 - DNA, 20 bp, Artificial Sequence
  chemically synthesized
tggagatggcttctgcttct

SEQ ID NO: 498709 - DNA, 20 bp, Artificial Sequence
  chemically synthesized
acccttattccatacttctt

SEQ ID NO: 498710 - DNA, 20 bp, Artificial Sequence
  chemically synthesized
aattacactccaaagaagta

SEQ ID NO: 498711 - DNA, 20 bp, Artificial Sequence
  chemically synthesized
actccaaagaagtatggaat

SEQ ID NO: 498712 - DNA, 20 bp, Artificial Sequence
  chemically synthesized
aaaataagtacattttgctg

SEQ ID NO: 498713 - DNA, 20 bp, Artificial Sequence
  chemically synthesized
acaagtgacagaagctaagt

SEQ ID NO: 498714 - DNA, 20 bp, Artificial Sequence
  chemically synthesized
gggtttataagtgccagact

SEQ ID NO: 498715 - DNA, 20 bp, Artificial Sequence
  chemically synthesized
taagtgccagactatgaatt

SEQ ID NO: 498716 - DNA, 20 bp, Artificial Sequence
  chemically synthesized
ctaggccagaggctaacatc

SEQ ID NO: 498717 - DNA, 20 bp, Artificial Sequence
  chemically synthesized
cccaggagaaaagagagctg

SEQ ID NO: 498718 - DNA, 20 bp, Artificial Sequence
  chemically synthesized
gttgatagctttgatttcaa

SEQ ID NO: 498719 - DNA, 20 bp, Artificial Sequence
  chemically synthesized
tgtgctgggaaatgtgaagc

SEQ ID NO: 498720 - DNA, 20 bp, Artificial Sequence
  chemically synthesized
caaatcactgtttcttttga

SEQ ID NO: 498721 - DNA, 20 bp, Artificial Sequence
  chemically synthesized
ctttcaaaagaaacagtgat

SEQ ID NO: 498722 - DNA, 20 bp, Artificial Sequence
  chemically synthesized
gacttgcgattgatgtccag

SEQ ID NO: 498723 - DNA, 20 bp, Artificial Sequence
  chemically synthesized
atgaaaacataaaaagtgta

SEQ ID NO: 498724 - DNA, 20 bp, Artificial Sequence
  chemically synthesized
attgaatattttgccattta

SEQ ID NO: 498725 - DNA, 20 bp, Artificial Sequence
  chemically synthesized
tatacctccctgcactttaa

SEQ ID NO: 498726 - DNA, 20 bp, Artificial Sequence
  chemically synthesized
aaataatggtggtatgttct

SEQ ID NO: 498727 - DNA, 20 bp, Artificial Sequence
  chemically synthesized
ctaactaagtcacaggttat

SEQ ID NO: 498728 - DNA, 20 bp, Artificial Sequence
  chemically synthesized
aagagaactttataaaattt

SEQ ID NO: 498729 - DNA, 20 bp, Artificial Sequence
  chemically synthesized
gcatttaagataaagaaata

SEQ ID NO: 498730 - DNA, 20 bp, Artificial Sequence
  chemically synthesized
aaatagcctgtataacttct

SEQ ID NO: 498731 - DNA, 20 bp, Artificial Sequence
  chemically synthesized
atacaggctattttgtttca

SEQ ID NO: 498732 - DNA, 20 bp, Artificial Sequence
  chemically synthesized
gaaaatggttgcactcaaga

SEQ ID NO: 498733 - DNA, 20 bp, Artificial Sequence
  chemically synthesized
acagtcgcaaacattctctc

SEQ ID NO: 498734 - DNA, 20 bp, Artificial Sequence
  chemically synthesized
ctgtttttggaaattcttct

SEQ ID NO: 498735 - DNA, 20 bp, Artificial Sequence
  chemically synthesized
tttggaaattcttctgtggg

SEQ ID NO: 498736 - DNA, 20 bp, Artificial Sequence
  chemically synthesized
tattattacccaacccacag

SEQ ID NO: 498737 - DNA, 20 bp, Artificial Sequence
  chemically synthesized
aaaaatcacaaacatgtctc

SEQ ID NO: 498738 - DNA, 20 bp, Artificial Sequence
  chemically synthesized
ttttctgggaaattttttcg

SEQ ID NO: 498739 - DNA, 20 bp, Artificial Sequence
  chemically synthesized
ctgggaaattttttcgtgga

SEQ ID NO: 498740 - DNA, 20 bp, Artificial Sequence
  chemically synthesized
ggagtgggtaataaatagag

SEQ ID NO: 498741 - DNA, 20 bp, Artificial Sequence
  chemically synthesized
taaaataactagtcctgaaa

SEQ ID NO: 498742 - DNA, 20 bp, Artificial Sequence
  chemically synthesized
aattataaaatttaaacatt

SEQ ID NO: 498743 - DNA, 20 bp, Artificial Sequence
  chemically synthesized
aaaaatatttgatttaatac

SEQ ID NO: 498744 - DNA, 20 bp, Artificial Sequence
  chemically synthesized
aggtattaaatcaaatattt

SEQ ID NO: 498745 - DNA, 20 bp, Artificial Sequence
  chemically synthesized
aacagtaactgcctcaactc

SEQ ID NO: 498746 - DNA, 20 bp, Artificial Sequence
  chemically synthesized
ccttaggtatcaagtaaccc

SEQ ID NO: 498747 - DNA, 20 bp, Artificial Sequence
  chemically synthesized
atttaaagatactatcatgt

SEQ ID NO: 498748 - DNA, 20 bp, Artificial Sequence
  chemically synthesized
tttgattccgatactagttt

SEQ ID NO: 498749 - DNA, 20 bp, Artificial Sequence
  chemically synthesized
gtagacccataaactagtat

SEQ ID NO: 498750 - DNA, 20 bp, Artificial Sequence
  chemically synthesized
aaactactaactttcatttt

SEQ ID NO: 498751 - DNA, 20 bp, Artificial Sequence
  chemically synthesized
aaaatgaaagttagtagttt

SEQ ID NO: 498752 - DNA, 20 bp, Artificial Sequence
  chemically synthesized
tttatagaattttataaaag

SEQ ID NO: 498753 - DNA, 20 bp, Artificial Sequence
  chemically synthesized
atagataagtttgcgtttta

SEQ ID NO: 498754 - DNA, 20 bp, Artificial Sequence
  chemically synthesized
gtcagcatcagtggtaacct

SEQ ID NO: 498755 - DNA, 20 bp, Artificial Sequence
  chemically synthesized
gaatcaagggaggggcagga

SEQ ID NO: 498756 - DNA, 20 bp, Artificial Sequence
  chemically synthesized
attaccgaaaacagacttgt

SEQ ID NO: 498757 - DNA, 20 bp, Artificial Sequence
  chemically synthesized
aaaacagacttgtgaggata

SEQ ID NO: 498758 - DNA, 20 bp, Artificial Sequence
  chemically synthesized
gaatgcttcatttgtaattg

SEQ ID NO: 498759 - DNA, 20 bp, Artificial Sequence
  chemically synthesized
caatcccagcaactgggaga

SEQ ID NO: 498760 - DNA, 20 bp, Artificial Sequence
  chemically synthesized
ataacaatcccagcaactgg

SEQ ID NO: 498761 - DNA, 20 bp, Artificial Sequence
  chemically synthesized
gcattcattctcccagttgc

SEQ ID NO: 498762 - DNA, 20 bp, Artificial Sequence
  chemically synthesized
aggctcacatctaatgacta

SEQ ID NO: 498763 - DNA, 20 bp, Artificial Sequence
  chemically synthesized
catctaatgactaatggatt

SEQ ID NO: 498764 - DNA, 20 bp, Artificial Sequence
  chemically synthesized
gtggggttgggatgaccatt

SEQ ID NO: 498765 - DNA, 20 bp, Artificial Sequence
  chemically synthesized
tatctggtcccatgtggggt

SEQ ID NO: 498766 - DNA, 20 bp, Artificial Sequence
  chemically synthesized
agatcttatctggtcccatg

SEQ ID NO: 498767 - DNA, 20 bp, Artificial Sequence
  chemically synthesized
ggattgaggagagagaggag

SEQ ID NO: 498768 - DNA, 20 bp, Artificial Sequence
  chemically synthesized
cagcaggattgaggagagag

SEQ ID NO: 498769 - DNA, 20 bp, Artificial Sequence
  chemically synthesized
ctgggagggagtaaaggcag

SEQ ID NO: 498770 - DNA, 20 bp, Artificial Sequence
  chemically synthesized
tttaagaaaaatgcctggga

SEQ ID NO: 498771 - DNA, 20 bp, Artificial Sequence
  chemically synthesized
tccatgcagatggtttctta

SEQ ID NO: 498772 - DNA, 20 bp, Artificial Sequence
  chemically synthesized
ctgcatggaaatctctgtct

SEQ ID NO: 498773 - DNA, 20 bp, Artificial Sequence
  chemically synthesized
tattaggttgttatcttaga

SEQ ID NO: 498774 - DNA, 20 bp, Artificial Sequence
  chemically synthesized
ctagatttcagggaaaaata

SEQ ID NO: 498775 - DNA, 20 bp, Artificial Sequence
  chemically synthesized
agatatggctgattgcataa

SEQ ID NO: 498776 - DNA, 20 bp, Artificial Sequence
  chemically synthesized
gaggacgctggcatgtttgg

SEQ ID NO: 498777 - DNA, 20 bp, Artificial Sequence
  chemically synthesized
atgttattctgaaatgctga

SEQ ID NO: 498778 - DNA, 20 bp, Artificial Sequence
  chemically synthesized
aataaatccattcagcattt

SEQ ID NO: 498779 - DNA, 20 bp, Artificial Sequence
  chemically synthesized
tttcatgttattctgaaatg

SEQ ID NO: 498780 - DNA, 20 bp, Artificial Sequence
  chemically synthesized
tgatagtaacaatagtaaaa

SEQ ID NO: 498781 - DNA, 20 bp, Artificial Sequence
  chemically synthesized
aaaatttggttttttacttt

SEQ ID NO: 498782 - DNA, 20 bp, Artificial Sequence
  chemically synthesized
aatgatacaggtaacatata

SEQ ID NO: 498783 - DNA, 20 bp, Artificial Sequence
  chemically synthesized
agccgtgacaattctgtctt

SEQ ID NO: 498784 - DNA, 20 bp, Artificial Sequence
  chemically synthesized
ctctctcttcatcctaaaga

SEQ ID NO: 498785 - DNA, 20 bp, Artificial Sequence
  chemically synthesized
agagcattttccatgaaaat

SEQ ID NO: 498786 - DNA, 20 bp, Artificial Sequence
  chemically synthesized
tcctctataggaaggccatc

SEQ ID NO: 498787 - DNA, 20 bp, Artificial Sequence
  chemically synthesized
taggaaggccatccaggatg

SEQ ID NO: 498788 - DNA, 20 bp, Artificial Sequence
  chemically synthesized
gtctcttaccattcaacatc

SEQ ID NO: 498789 - DNA, 20 bp, Artificial Sequence
  chemically synthesized
ttggtagaaagggaaaggat

SEQ ID NO: 498790 - DNA, 20 bp, Artificial Sequence
  chemically synthesized
tgagggttggtagaaaggga

SEQ ID NO: 498791 - DNA, 20 bp, Artificial Sequence
  chemically synthesized
tcaatggctgagggataaat

SEQ ID NO: 498792 - DNA, 20 bp, Artificial Sequence
  chemically synthesized
ttttttaaaatcaatggctg

SEQ ID NO: 498793 - DNA, 20 bp, Artificial Sequence
  chemically synthesized
tttcatttacattttttcct

SEQ ID NO: 498794 - DNA, 20 bp, Artificial Sequence
  chemically synthesized
agagcagtagtctcttggaa

SEQ ID NO: 498795 - DNA, 20 bp, Artificial Sequence
  chemically synthesized
tgctctcagcaaaccaaaaa

SEQ ID NO: 498796 - DNA, 20 bp, Artificial Sequence
  chemically synthesized
tatcactgcctttaagatct

SEQ ID NO: 498797 - DNA, 20 bp, Artificial Sequence
  chemically synthesized
atagatcttaaaggcagtga

SEQ ID NO: 498798 - DNA, 20 bp, Artificial Sequence
  chemically synthesized
actgcaattcaagacgggat

SEQ ID NO: 498799 - DNA, 20 bp, Artificial Sequence
  chemically synthesized
gtccccacccaaatcccgtc

SEQ ID NO: 498800 - DNA, 20 bp, Artificial Sequence
  chemically synthesized
atgggaactgcaattcaaga

SEQ ID NO: 498801 - DNA, 20 bp, Artificial Sequence
  chemically synthesized
ggatccctcccatgacatct

SEQ ID NO: 498802 - DNA, 20 bp, Artificial Sequence
  chemically synthesized
taatccccagatgtcatggg

SEQ ID NO: 498803 - DNA, 20 bp, Artificial Sequence
  chemically synthesized
catgattcagttacctccca

SEQ ID NO: 498804 - DNA, 20 bp, Artificial Sequence
  chemically synthesized
agggatccagtgggaggtaa

SEQ ID NO: 498805 - DNA, 20 bp, Artificial Sequence
  chemically synthesized
tgggaggtaactgaatcatg

SEQ ID NO: 498806 - DNA, 20 bp, Artificial Sequence
  chemically synthesized
tatcataagaacagcagcac

SEQ ID NO: 498807 - DNA, 20 bp, Artificial Sequence
  chemically synthesized
cttcttgccatcatgtgaca

SEQ ID NO: 498808 - DNA, 20 bp, Artificial Sequence
  chemically synthesized
ctccccagccatgcaaacca

SEQ ID NO: 498809 - DNA, 20 bp, Artificial Sequence
  chemically synthesized
ctataaagaactacctgaga

SEQ ID NO: 498810 - DNA, 20 bp, Artificial Sequence
  chemically synthesized
tacagtaaattggtaccaca

SEQ ID NO: 498811 - DNA, 20 bp, Artificial Sequence
  chemically synthesized
taaattggtaccacagagag

SEQ ID NO: 498812 - DNA, 20 bp, Artificial Sequence
  chemically synthesized
ccaaagttgcttccacattt

SEQ ID NO: 498813 - DNA, 20 bp, Artificial Sequence
  chemically synthesized
atgtggaagcaactttggaa

SEQ ID NO: 498814 - DNA, 20 bp, Artificial Sequence
  chemically synthesized
ccatactttcctgtcttctt

SEQ ID NO: 498815 - DNA, 20 bp, Artificial Sequence
  chemically synthesized
tccaattctctaggaagttc

SEQ ID NO: 498816 - DNA, 20 bp, Artificial Sequence
  chemically synthesized
ggaaactctggaacttccta

SEQ ID NO: 498817 - DNA, 20 bp, Artificial Sequence
  chemically synthesized
ggaacttcctagagaattgg

SEQ ID NO: 498818 - DNA, 20 bp, Artificial Sequence
  chemically synthesized
tggaacttcctagagacttg

SEQ ID NO: 498819 - DNA, 20 bp, Artificial Sequence
  chemically synthesized
gtccatatcactatcagcat

SEQ ID NO: 498820 - DNA, 20 bp, Artificial Sequence
  chemically synthesized
gcccctgtccgagagatctg

SEQ ID NO: 498821 - DNA, 20 bp, Artificial Sequence
  chemically synthesized
gatttagggcatctggtgga

SEQ ID NO: 498822 - DNA, 20 bp, Artificial Sequence
  chemically synthesized
caaagtgttcaagatttgac

SEQ ID NO: 498823 - DNA, 20 bp, Artificial Sequence
  chemically synthesized
atctttgtggatacataaaa

SEQ ID NO: 498824 - DNA, 20 bp, Artificial Sequence
  chemically synthesized
caattccaaaccatatcttt

SEQ ID NO: 498825 - DNA, 20 bp, Artificial Sequence
  chemically synthesized
gtatccacaaagatatggtt

SEQ ID NO: 498826 - DNA, 20 bp, Artificial Sequence
  chemically synthesized
attgaatttctcctcagaaa

SEQ ID NO: 498827 - DNA, 20 bp, Artificial Sequence
  chemically synthesized
tgcaaatttctgtagtcaga

SEQ ID NO: 498828 - DNA, 20 bp, Artificial Sequence
  chemically synthesized
ttagccatggctggagtggc

SEQ ID NO: 498829 - DNA, 20 bp, Artificial Sequence
  chemically synthesized
tggctccttttagccatggc

SEQ ID NO: 498830 - DNA, 20 bp, Artificial Sequence
  chemically synthesized
gagctcagcccatggctaca

SEQ ID NO: 498831 - DNA, 20 bp, Artificial Sequence
  chemically synthesized
ttccatgtggtgttgagcct

SEQ ID NO: 498832 - DNA, 20 bp, Artificial Sequence
  chemically synthesized
gaacttctacctagatttca

SEQ ID NO: 498833 - DNA, 20 bp, Artificial Sequence
  chemically synthesized
tctctgcagcaaacttctgc

SEQ ID NO: 498834 - DNA, 20 bp, Artificial Sequence
  chemically synthesized
gtcagtgcagaagagaaatg

SEQ ID NO: 498835 - DNA, 20 bp, Artificial Sequence
  chemically synthesized
gtggggttggagcccccaca

SEQ ID NO: 498836 - DNA, 20 bp, Artificial Sequence
  chemically synthesized
gtggctgttccatgcacacg

SEQ ID NO: 498837 - DNA, 20 bp, Artificial Sequence
  chemically synthesized
gctgctttcacaggctagca

SEQ ID NO: 498838 - DNA, 20 bp, Artificial Sequence
  chemically synthesized
gctccactcctttggcgttg

SEQ ID NO: 498839 - DNA, 20 bp, Artificial Sequence
  chemically synthesized
gctgtaccctgcaacgccaa

SEQ ID NO: 498840 - DNA, 20 bp, Artificial Sequence
  chemically synthesized
caaggtgggctcccacagcc

SEQ ID NO: 498841 - DNA, 20 bp, Artificial Sequence
  chemically synthesized
ccaccttgcatcagcgtgac

SEQ ID NO: 498842 - DNA, 20 bp, Artificial Sequence
  chemically synthesized
cgtgacctggatgtgagaca

SEQ ID NO: 498843 - DNA, 20 bp, Artificial Sequence
  chemically synthesized
aagatttaattactgcctca

SEQ ID NO: 498844 - DNA, 20 bp, Artificial Sequence
  chemically synthesized
ttgggccaatttctcccatc

SEQ ID NO: 498845 - DNA, 20 bp, Artificial Sequence
  chemically synthesized
gccaatttctcccatctgga

SEQ ID NO: 498846 - DNA, 20 bp, Artificial Sequence
  chemically synthesized
gagactttggacttggactc

SEQ ID NO: 498847 - DNA, 20 bp, Artificial Sequence
  chemically synthesized
actcactctagcattaaccc

SEQ ID NO: 498848 - DNA, 20 bp, Artificial Sequence
  chemically synthesized
ttggactcctgggttaatgc

SEQ ID NO: 498849 - DNA, 20 bp, Artificial Sequence
  chemically synthesized
actcctgggttaatgctaga

SEQ ID NO: 498850 - DNA, 20 bp, Artificial Sequence
  chemically synthesized
tgctagagtgagttaagact

SEQ ID NO: 498851 - DNA, 20 bp, Artificial Sequence
  chemically synthesized
cgtgccatttgggaggggcc

SEQ ID NO: 498852 - DNA, 20 bp, Artificial Sequence
  chemically synthesized
actacaattcagaatgagat

SEQ ID NO: 498853 - DNA, 20 bp, Artificial Sequence
  chemically synthesized
gtccccacccaaatctcatt

SEQ ID NO: 498854 - DNA, 20 bp, Artificial Sequence
  chemically synthesized
ggattacaggaactacaatt

SEQ ID NO: 498855 - DNA, 20 bp, Artificial Sequence
  chemically synthesized
gggtccctcacatgacacat

SEQ ID NO: 498856 - DNA, 20 bp, Artificial Sequence
  chemically synthesized
tgtaattcaattacctccaa

SEQ ID NO: 498857 - DNA, 20 bp, Artificial Sequence
  chemically synthesized
agggacccagttggaggtaa

SEQ ID NO: 498858 - DNA, 20 bp, Artificial Sequence
  chemically synthesized
tatcacaagaacagcaccat

SEQ ID NO: 498859 - DNA, 20 bp, Artificial Sequence
  chemically synthesized
atggtgctgttcttgtgata

SEQ ID NO: 498860 - DNA, 20 bp, Artificial Sequence
  chemically synthesized
aaaagccccttataaaacca

SEQ ID NO: 498861 - DNA, 20 bp, Artificial Sequence
  chemically synthesized
ctttctgccaccatatgaag

SEQ ID NO: 498862 - DNA, 20 bp, Artificial Sequence
  chemically synthesized
ctccccagccatgtggaact

SEQ ID NO: 498863 - DNA, 20 bp, Artificial Sequence
  chemically synthesized
ctctaaagaactgcccaaga

SEQ ID NO: 498864 - DNA, 20 bp, Artificial Sequence
  chemically synthesized
tgatcaatatattttacttt

SEQ ID NO: 498865 - DNA, 20 bp, Artificial Sequence
  chemically synthesized
cgccattgtcatattaataa

SEQ ID NO: 498866 - DNA, 20 bp, Artificial Sequence
  chemically synthesized
aatgttatgaaaatcattta

SEQ ID NO: 498867 - DNA, 20 bp, Artificial Sequence
  chemically synthesized
atcaccgcatagctaaaggg

SEQ ID NO: 498868 - DNA, 20 bp, Artificial Sequence
  chemically synthesized
tacttccagccccatttttt

SEQ ID NO: 498869 - DNA, 20 bp, Artificial Sequence
  chemically synthesized
tagattgggtttaaaagcac

SEQ ID NO: 498870 - DNA, 20 bp, Artificial Sequence
  chemically synthesized
aaaggaaattaaattgtaga

SEQ ID NO: 498871 - DNA, 20 bp, Artificial Sequence
  chemically synthesized
agtggcaaatctggggcatt

SEQ ID NO: 498872 - DNA, 20 bp, Artificial Sequence
  chemically synthesized
acaaaaaccttcacataatt

SEQ ID NO: 498873 - DNA, 20 bp, Artificial Sequence
  chemically synthesized
ctctttcttctcagtaaggg

SEQ ID NO: 498874 - DNA, 20 bp, Artificial Sequence
  chemically synthesized
taagagagacatgaacaagg

SEQ ID NO: 498875 - DNA, 20 bp, Artificial Sequence
  chemically synthesized
gttgtaacataaagagtaat

SEQ ID NO: 498876 - DNA, 20 bp, Artificial Sequence
  chemically synthesized
ggttaataggttgtaacata

SEQ ID NO: 498877 - DNA, 20 bp, Artificial Sequence
  chemically synthesized
caaaatattttcatgtggca

SEQ ID NO: 498878 - DNA, 20 bp, Artificial Sequence
  chemically synthesized
agttcattttgcctcatgat

SEQ ID NO: 498879 - DNA, 20 bp, Artificial Sequence
  chemically synthesized
gaaatatccctagagaaagc

SEQ ID NO: 498880 - DNA, 20 bp, Artificial Sequence
  chemically synthesized
aatttattcttgctttctct

SEQ ID NO: 498881 - DNA, 20 bp, Artificial Sequence
  chemically synthesized
gctttctctagggatatttc

SEQ ID NO: 498882 - DNA, 20 bp, Artificial Sequence
  chemically synthesized
ttttaggactttgaaaatgt

SEQ ID NO: 498883 - DNA, 20 bp, Artificial Sequence
  chemically synthesized
tgaaaatgttggaattggta

SEQ ID NO: 498884 - DNA, 20 bp, Artificial Sequence
  chemically synthesized
gggttacttttctttggtca

SEQ ID NO: 498885 - DNA, 20 bp, Artificial Sequence
  chemically synthesized
gtcaaaggaaaggttaatat

SEQ ID NO: 498886 - DNA, 20 bp, Artificial Sequence
  chemically synthesized
ttgactttaaagacaataat

SEQ ID NO: 498887 - DNA, 20 bp, Artificial Sequence
  chemically synthesized
caccaatatagaaataattt

SEQ ID NO: 498888 - DNA, 20 bp, Artificial Sequence
  chemically synthesized
tcttgaacgacataaaatac

SEQ ID NO: 498889 - DNA, 20 bp, Artificial Sequence
  chemically synthesized
gttcaagaaattggcttgtg

SEQ ID NO: 498890 - DNA, 20 bp, Artificial Sequence
  chemically synthesized
taattttgtcactaactgtt

SEQ ID NO: 498891 - DNA, 20 bp, Artificial Sequence
  chemically synthesized
ttggttagctctgtgaatta

SEQ ID NO: 498892 - DNA, 20 bp, Artificial Sequence
  chemically synthesized
actcacctttggttagctct

SEQ ID NO: 498893 - DNA, 20 bp, Artificial Sequence
  chemically synthesized
attcacagagctaaccaaag

SEQ ID NO: 498894 - DNA, 20 bp, Artificial Sequence
  chemically synthesized
ctaaccaaaggtgagtacat

SEQ ID NO: 498895 - DNA, 20 bp, Artificial Sequence
  chemically synthesized
agacacagccacacaagcct

SEQ ID NO: 498896 - DNA, 20 bp, Artificial Sequence
  chemically synthesized
tcagaatacaaaagctgatg

SEQ ID NO: 498897 - DNA, 20 bp, Artificial Sequence
  chemically synthesized
tacaaaagctgatggtgaat

SEQ ID NO: 498898 - DNA, 20 bp, Artificial Sequence
  chemically synthesized
gatggtgaatcaggatccag

SEQ ID NO: 498899 - DNA, 20 bp, Artificial Sequence
  chemically synthesized
tttctgactcctgcattcct

SEQ ID NO: 498900 - DNA, 20 bp, Artificial Sequence
  chemically synthesized
atcaggatccagaggaatgc

SEQ ID NO: 498901 - DNA, 20 bp, Artificial Sequence
  chemically synthesized
aaagtaacacaaatacgcag

SEQ ID NO: 498902 - DNA, 20 bp, Artificial Sequence
  chemically synthesized
atacgcagaagagtgaccag

SEQ ID NO: 498903 - DNA, 20 bp, Artificial Sequence
  chemically synthesized
ggaagtgcagtggcccttgc

SEQ ID NO: 498904 - DNA, 20 bp, Artificial Sequence
  chemically synthesized
agataatgggtgagctccac

SEQ ID NO: 498905 - DNA, 20 bp, Artificial Sequence
  chemically synthesized
gagtgtccaggcccaagata

SEQ ID NO: 498906 - DNA, 20 bp, Artificial Sequence
  chemically synthesized
tatcttgggcctggacactc

SEQ ID NO: 498907 - DNA, 20 bp, Artificial Sequence
  chemically synthesized
ggacatcaaccagagtaccc

SEQ ID NO: 498908 - DNA, 20 bp, Artificial Sequence
  chemically synthesized
tccggctgtaggacatcaac

SEQ ID NO: 498909 - DNA, 20 bp, Artificial Sequence
  chemically synthesized
taaagggccgctcagggtgt

SEQ ID NO: 498910 - DNA, 20 bp, Artificial Sequence
  chemically synthesized
gtcacttttaaagggccgct

SEQ ID NO: 498911 - DNA, 20 bp, Artificial Sequence
  chemically synthesized
gccctttaaaagtgactaac

SEQ ID NO: 498912 - DNA, 20 bp, Artificial Sequence
  chemically synthesized
aaggcataaaacacttgtct

SEQ ID NO: 498913 - DNA, 20 bp, Artificial Sequence
  chemically synthesized
gccttcccagactttctcca

SEQ ID NO: 498914 - DNA, 20 bp, Artificial Sequence
  chemically synthesized
ttaagagaaagcaacctgta

SEQ ID NO: 498915 - DNA, 20 bp, Artificial Sequence
  chemically synthesized
aggaagctgtggtaggatgt

SEQ ID NO: 498916 - DNA, 20 bp, Artificial Sequence
  chemically synthesized
gtgattctaggaagctgtgg

SEQ ID NO: 498917 - DNA, 20 bp, Artificial Sequence
  chemically synthesized
aacatcctaccacagcttcc

SEQ ID NO: 498918 - DNA, 20 bp, Artificial Sequence
  chemically synthesized
gcaaatcctgagacaaggat

SEQ ID NO: 498919 - DNA, 20 bp, Artificial Sequence
  chemically synthesized
ttgaactcacatccttgtct

SEQ ID NO: 498920 - DNA, 20 bp, Artificial Sequence
  chemically synthesized
acataagcaaatcctgagac

SEQ ID NO: 498921 - DNA, 20 bp, Artificial Sequence
  chemically synthesized
tgcattatgagtgtctcagt

SEQ ID NO: 498922 - DNA, 20 bp, Artificial Sequence
  chemically synthesized
aactgagacactcataatgc

SEQ ID NO: 498923 - DNA, 20 bp, Artificial Sequence
  chemically synthesized
ataatataaattcttgcatt

SEQ ID NO: 498924 - DNA, 20 bp, Artificial Sequence
  chemically synthesized
agaatttatattattaatac

SEQ ID NO: 498925 - DNA, 20 bp, Artificial Sequence
  chemically synthesized
gtgtcaaactagccatgctt

SEQ ID NO: 498926 - DNA, 20 bp, Artificial Sequence
  chemically synthesized
tgcttttccttacctctatg

SEQ ID NO: 498927 - DNA, 20 bp, Artificial Sequence
  chemically synthesized
ttcatttttcaaaagaatga

SEQ ID NO: 498928 - DNA, 20 bp, Artificial Sequence
  chemically synthesized
cttattcatttttcaaaaga

SEQ ID NO: 498929 - DNA, 20 bp, Artificial Sequence
  chemically synthesized
ttcactcattcttttgaaaa

SEQ ID NO: 498930 - DNA, 20 bp, Artificial Sequence
  chemically synthesized
gtaccttattcatttttcaa

SEQ ID NO: 498931 - DNA, 20 bp, Artificial Sequence
  chemically synthesized
actcactctctattacaaaa

SEQ ID NO: 498932 - DNA, 20 bp, Artificial Sequence
  chemically synthesized
aggtactcttttttgtaata

SEQ ID NO: 498933 - DNA, 20 bp, Artificial Sequence
  chemically synthesized
actcttttttgtaatagaga

SEQ ID NO: 498934 - DNA, 20 bp, Artificial Sequence
  chemically synthesized
gtaatagagagtgagtgtaa

SEQ ID NO: 498935 - DNA, 20 bp, Artificial Sequence
  chemically synthesized
gatagctagtcagatatgag

SEQ ID NO: 498936 - DNA, 20 bp, Artificial Sequence
  chemically synthesized
tggttggggtggcgggggtg

SEQ ID NO: 498937 - DNA, 20 bp, Artificial Sequence
  chemically synthesized
acattcctggttggggtggc

SEQ ID NO: 498938 - DNA, 20 bp, Artificial Sequence
  chemically synthesized
ccacccccgccaccccaacc

SEQ ID NO: 498939 - DNA, 20 bp, Artificial Sequence
  chemically synthesized
ggttgcctgacattcctggt

SEQ ID NO: 498940 - DNA, 20 bp, Artificial Sequence
  chemically synthesized
cagcttcccgataagatcgc

SEQ ID NO: 498941 - DNA, 20 bp, Artificial Sequence
  chemically synthesized
gactggtaagggaacacctc

SEQ ID NO: 498942 - DNA, 20 bp, Artificial Sequence
  chemically synthesized
agcatgcacggtgtatttac

SEQ ID NO: 498943 - DNA, 20 bp, Artificial Sequence
  chemically synthesized
atagccccctaccccaaggg

SEQ ID NO: 498944 - DNA, 20 bp, Artificial Sequence
  chemically synthesized
cttctccccaattcttccct

SEQ ID NO: 498945 - DNA, 20 bp, Artificial Sequence
  chemically synthesized
actgaggcaagtgttagagc

SEQ ID NO: 498946 - DNA, 20 bp, Artificial Sequence
  chemically synthesized
tctgccttatgcctccttgg

SEQ ID NO: 498947 - DNA, 20 bp, Artificial Sequence
  chemically synthesized
attcatgcctcctcagaaga

SEQ ID NO: 498948 - DNA, 20 bp, Artificial Sequence
  chemically synthesized
attctttcttctgaggaggc

SEQ ID NO: 498949 - DNA, 20 bp, Artificial Sequence
  chemically synthesized
taaggttgctgaagacccgt

SEQ ID NO: 498950 - DNA, 20 bp, Artificial Sequence
  chemically synthesized
gttactggcagtgaatccat

SEQ ID NO: 498951 - DNA, 20 bp, Artificial Sequence
  chemically synthesized
ctctcctcctgttactggca

SEQ ID NO: 498952 - DNA, 20 bp, Artificial Sequence
  chemically synthesized
ctgccagtaacaggaggaga

SEQ ID NO: 498953 - DNA, 20 bp, Artificial Sequence
  chemically synthesized
ggaggagagagagttattca

SEQ ID NO: 498954 - DNA, 20 bp, Artificial Sequence
  chemically synthesized
agtcggtatataataattcg

SEQ ID NO: 498955 - DNA, 20 bp, Artificial Sequence
  chemically synthesized
tattgtgatggtgagccgga

SEQ ID NO: 498956 - DNA, 20 bp, Artificial Sequence
  chemically synthesized
ctcatattgtgatggtgagc

SEQ ID NO: 498957 - DNA, 20 bp, Artificial Sequence
  chemically synthesized
ttccggctcaccatcacaat

SEQ ID NO: 498958 - DNA, 20 bp, Artificial Sequence
  chemically synthesized
caccatcacaatatgagtat

SEQ ID NO: 498959 - DNA, 20 bp, Artificial Sequence
  chemically synthesized
aatgtaaatctcttaatata

SEQ ID NO: 498960 - DNA, 20 bp, Artificial Sequence
  chemically synthesized
atttatttagaatctaatac

SEQ ID NO: 498961 - DNA, 20 bp, Artificial Sequence
  chemically synthesized
tagttttaaaagtatttatt

SEQ ID NO: 498962 - DNA, 20 bp, Artificial Sequence
  chemically synthesized
agctgctgaaacaaatttaa

SEQ ID NO: 498963 - DNA, 20 bp, Artificial Sequence
  chemically synthesized
atggagtccttccctcatca

SEQ ID NO: 498964 - DNA, 20 bp, Artificial Sequence
  chemically synthesized
acaactgaaagaaaaatcta

SEQ ID NO: 498965 - DNA, 20 bp, Artificial Sequence
  chemically synthesized
ttccttttgaagatgttggc

SEQ ID NO: 498966 - DNA, 20 bp, Artificial Sequence
  chemically synthesized
gattagaaaaatgctttatt

SEQ ID NO: 498967 - DNA, 20 bp, Artificial Sequence
  chemically synthesized
agctgcatgacaaagtaaga

SEQ ID NO: 498968 - DNA, 20 bp, Artificial Sequence
  chemically synthesized
taaaccagatggtcttcttc

SEQ ID NO: 498969 - DNA, 20 bp, Artificial Sequence
  chemically synthesized
aagctgactatcacagctca

SEQ ID NO: 498970 - DNA, 20 bp, Artificial Sequence
  chemically synthesized
tagttttgagcagcagacag

SEQ ID NO: 498971 - DNA, 20 bp, Artificial Sequence
  chemically synthesized
tgcttcagcacacttggtag

SEQ ID NO: 498972 - DNA, 20 bp, Artificial Sequence
  chemically synthesized
attttattatttactgactt

SEQ ID NO: 498973 - DNA, 20 bp, Artificial Sequence
  chemically synthesized
gttaatgccccctgtaaaaa

SEQ ID NO: 498974 - DNA, 20 bp, Artificial Sequence
  chemically synthesized
tgctttataatattactttt

SEQ ID NO: 498975 - DNA, 20 bp, Artificial Sequence
  chemically synthesized
aataaaagtaccccaacaca

SEQ ID NO: 498976 - DNA, 20 bp, Artificial Sequence
  chemically synthesized
ttctttctaattcaatgtgt

SEQ ID NO: 498977 - DNA, 20 bp, Artificial Sequence
  chemically synthesized
gaaagaaaacttgtgaaaaa

SEQ ID NO: 498978 - DNA, 20 bp, Artificial Sequence
  chemically synthesized
aacttgtgaaaaaatggatt

SEQ ID NO: 498979 - DNA, 20 bp, Artificial Sequence
  chemically synthesized
atcccacttggaaaggtatt

SEQ ID NO: 498980 - DNA, 20 bp, Artificial Sequence
  chemically synthesized
attcagaatacctttccaag

SEQ ID NO: 498981 - DNA, 20 bp, Artificial Sequence
  chemically synthesized
ttgtaagttgggctttctaa

SEQ ID NO: 498982 - DNA, 20 bp, Artificial Sequence
  chemically synthesized
atactgtaataaaattctac

SEQ ID NO: 498983 - DNA, 20 bp, Artificial Sequence
  chemically synthesized
gaaataccacaccattctag

SEQ ID NO: 498984 - DNA, 20 bp, Artificial Sequence
  chemically synthesized
agtgaacccatttcaagagt

SEQ ID NO: 498985 - DNA, 20 bp, Artificial Sequence
  chemically synthesized
tatacacccacactcttgaa

SEQ ID NO: 498986 - DNA, 20 bp, Artificial Sequence
  chemically synthesized
gcagttagtgaacccatttc

SEQ ID NO: 498987 - DNA, 20 bp, Artificial Sequence
  chemically synthesized
tatttctctatccctgatct

SEQ ID NO: 498988 - DNA, 20 bp, Artificial Sequence
  chemically synthesized
acgtggcatatccaaagatc

SEQ ID NO: 498989 - DNA, 20 bp, Artificial Sequence
  chemically synthesized
acttgctttgacaattgact

SEQ ID NO: 498990 - DNA, 20 bp, Artificial Sequence
  chemically synthesized
agagaacgctagttataaat

SEQ ID NO: 498991 - DNA, 20 bp, Artificial Sequence
  chemically synthesized
ctgagttctaaagatctcag

SEQ ID NO: 498992 - DNA, 20 bp, Artificial Sequence
  chemically synthesized
tctttagaactcagccatgg

SEQ ID NO: 498993 - DNA, 20 bp, Artificial Sequence
  chemically synthesized
tggggcacattcctccatgg

SEQ ID NO: 498994 - DNA, 20 bp, Artificial Sequence
  chemically synthesized
tctcattctggggctcaagc

SEQ ID NO: 498995 - DNA, 20 bp, Artificial Sequence
  chemically synthesized
tgccattccagcttgagccc

SEQ ID NO: 498996 - DNA, 20 bp, Artificial Sequence
  chemically synthesized
ggtcaacctacagtcagatt

SEQ ID NO: 498997 - DNA, 20 bp, Artificial Sequence
  chemically synthesized
actttgagtaatctctgatt

SEQ ID NO: 498998 - DNA, 20 bp, Artificial Sequence
  chemically synthesized
ctcatattcacaggcctact

SEQ ID NO: 498999 - DNA, 20 bp, Artificial Sequence
  chemically synthesized
agattactcaaagtaggcct

SEQ ID NO: 499000 - DNA, 20 bp, Artificial Sequence
  chemically synthesized
caaagtaggcctgtgaatat

SEQ ID NO: 499001 - DNA, 20 bp, Artificial Sequence
  chemically synthesized
ataagtgcttattgttcttt

SEQ ID NO: 499002 - DNA, 20 bp, Artificial Sequence
  chemically synthesized
gggcccaataaacagctacc

SEQ ID NO: 499003 - DNA, 20 bp, Artificial Sequence
  chemically synthesized
cccctatctctcagtaatgt

SEQ ID NO: 499004 - DNA, 20 bp, Artificial Sequence
  chemically synthesized
gttagcatctacgtccttat

SEQ ID NO: 499005 - DNA, 20 bp, Artificial Sequence
  chemically synthesized
gatataattctggaatttct

SEQ ID NO: 499006 - DNA, 20 bp, Artificial Sequence
  chemically synthesized
gaaggtacccaaagaaattc

SEQ ID NO: 499007 - DNA, 20 bp, Artificial Sequence
  chemically synthesized
aatcatcagagatataattc

SEQ ID NO: 499008 - DNA, 20 bp, Artificial Sequence
  chemically synthesized
cctttgttttgaaggaattt

SEQ ID NO: 499009 - DNA, 20 bp, Artificial Sequence
  chemically synthesized
gtctgtgtcctttgttttga

SEQ ID NO: 499010 - DNA, 20 bp, Artificial Sequence
  chemically synthesized
tagcatagtacttgaaaacc

SEQ ID NO: 499011 - DNA, 20 bp, Artificial Sequence
  chemically synthesized
tcaagtactatgctataatt

SEQ ID NO: 499012 - DNA, 20 bp, Artificial Sequence
  chemically synthesized
cctttgagtaatttatatgt

SEQ ID NO: 499013 - DNA, 20 bp, Artificial Sequence
  chemically synthesized
atataaattactcaaaggct

SEQ ID NO: 499014 - DNA, 20 bp, Artificial Sequence
  chemically synthesized
catttgaaaattcttagcct

SEQ ID NO: 499015 - DNA, 20 bp, Artificial Sequence
  chemically synthesized
agccatactaggaaactaca

SEQ ID NO: 499016 - DNA, 20 bp, Artificial Sequence
  chemically synthesized
agaacactgatattttcaag

SEQ ID NO: 499017 - DNA, 20 bp, Artificial Sequence
  chemically synthesized
agaggaatttgagactatcc

SEQ ID NO: 499018 - DNA, 20 bp, Artificial Sequence
  chemically synthesized
atattagttttagtttatcc

SEQ ID NO: 499019 - DNA, 20 bp, Artificial Sequence
  chemically synthesized
gcctgtaaggcaattttcac

SEQ ID NO: 499020 - DNA, 20 bp, Artificial Sequence
  chemically synthesized
gtgaaaattgccttacaggc

SEQ ID NO: 499021 - DNA, 20 bp, Artificial Sequence
  chemically synthesized
gcaagaatttgcaactttca

SEQ ID NO: 499022 - DNA, 20 bp, Artificial Sequence
  chemically synthesized
taaacagatttttaaagcgt

SEQ ID NO: 499023 - DNA, 20 bp, Artificial Sequence
  chemically synthesized
aattgtgacaaacatcctcc

SEQ ID NO: 499024 - DNA, 20 bp, Artificial Sequence
  chemically synthesized
tgtttcaccttctattctag

SEQ ID NO: 499025 - DNA, 20 bp, Artificial Sequence
  chemically synthesized
caagcaagcaaacctttcac

SEQ ID NO: 499026 - DNA, 20 bp, Artificial Sequence
  chemically synthesized
tatactgactttagtgacta

SEQ ID NO: 499027 - DNA, 20 bp, Artificial Sequence
  chemically synthesized
gatatatgtttttctaatta

SEQ ID NO: 499028 - DNA, 20 bp, Artificial Sequence
  chemically synthesized
tatataaaataatctaagac

SEQ ID NO: 499029 - DNA, 20 bp, Artificial Sequence
  chemically synthesized
tcaaatcatgacttttaggt

SEQ ID NO: 499030 - DNA, 20 bp, Artificial Sequence
  chemically synthesized
tattcaataaattattaatg

SEQ ID NO: 499031 - DNA, 20 bp, Artificial Sequence
  chemically synthesized
taccctgcattaataattta

SEQ ID NO: 499032 - DNA, 20 bp, Artificial Sequence
  chemically synthesized
aatggagattctgttaacca

SEQ ID NO: 499033 - DNA, 20 bp, Artificial Sequence
  chemically synthesized
ttgagaaactctttggttaa

SEQ ID NO: 499034 - DNA, 20 bp, Artificial Sequence
  chemically synthesized
ctcaagaaacttattcattc

SEQ ID NO: 499035 - DNA, 20 bp, Artificial Sequence
  chemically synthesized
aaaagctgtaatattctaga

SEQ ID NO: 499036 - DNA, 20 bp, Artificial Sequence
  chemically synthesized
actcaaaagctgtaatattc

SEQ ID NO: 499037 - DNA, 20 bp, Artificial Sequence
  chemically synthesized
attctagaatattacagctt

SEQ ID NO: 499038 - DNA, 20 bp, Artificial Sequence
  chemically synthesized
aaccatactgcattccactt

SEQ ID NO: 499039 - DNA, 20 bp, Artificial Sequence
  chemically synthesized
taccttttgtcacccctaag

SEQ ID NO: 499040 - DNA, 20 bp, Artificial Sequence
  chemically synthesized
ctgtaggaaaaagtactcca

SEQ ID NO: 499041 - DNA, 20 bp, Artificial Sequence
  chemically synthesized
tgcaacatgttaccattcag

SEQ ID NO: 499042 - DNA, 20 bp, Artificial Sequence
  chemically synthesized
ttatcttacaggttattatc

SEQ ID NO: 499043 - DNA, 20 bp, Artificial Sequence
  chemically synthesized
gtaagataaataggtaaaca

SEQ ID NO: 499044 - DNA, 20 bp, Artificial Sequence
  chemically synthesized
ataggtaaacagagagttct

SEQ ID NO: 499045 - DNA, 20 bp, Artificial Sequence
  chemically synthesized
agttctatgaatccagacaa

SEQ ID NO: 499046 - DNA, 20 bp, Artificial Sequence
  chemically synthesized
ttgatcaattattccattgt

SEQ ID NO: 499047 - DNA, 20 bp, Artificial Sequence
  chemically synthesized
ataattgatcaagaacagag

SEQ ID NO: 499048 - DNA, 20 bp, Artificial Sequence
  chemically synthesized
tcagtgcaaataccacctct

SEQ ID NO: 499049 - DNA, 20 bp, Artificial Sequence
  chemically synthesized
tccaagaggtggtatttgca

SEQ ID NO: 499050 - DNA, 20 bp, Artificial Sequence
  chemically synthesized
ggtggtatttgcactgaatg

SEQ ID NO: 499051 - DNA, 20 bp, Artificial Sequence
  chemically synthesized
ctgaatgctgaatggtgtgt

SEQ ID NO: 499052 - DNA, 20 bp, Artificial Sequence
  chemically synthesized
aggattttctgatgtgcttg

SEQ ID NO: 499053 - DNA, 20 bp, Artificial Sequence
  chemically synthesized
cttagcaaagccaagtggta

SEQ ID NO: 499054 - DNA, 20 bp, Artificial Sequence
  chemically synthesized
gctttgctaagcatcttgta

SEQ ID NO: 499055 - DNA, 20 bp, Artificial Sequence
  chemically synthesized
gttcgagatcagtagcagaa

SEQ ID NO: 499056 - DNA, 20 bp, Artificial Sequence
  chemically synthesized
acataggatttcttatgctc

SEQ ID NO: 499057 - DNA, 20 bp, Artificial Sequence
  chemically synthesized
tgcctccatggcatttcaca

SEQ ID NO: 499058 - DNA, 20 bp, Artificial Sequence
  chemically synthesized
aggcaggctatgtagtggaa

SEQ ID NO: 499059 - DNA, 20 bp, Artificial Sequence
  chemically synthesized
agtggaaaagaattcataac

SEQ ID NO: 499060 - DNA, 20 bp, Artificial Sequence
  chemically synthesized
tctatatcgtgaccccagtt

SEQ ID NO: 499061 - DNA, 20 bp, Artificial Sequence
  chemically synthesized
ctcacacatgaagtatgtgc

SEQ ID NO: 499062 - DNA, 20 bp, Artificial Sequence
  chemically synthesized
agacgaataattttgagttt

SEQ ID NO: 499063 - DNA, 20 bp, Artificial Sequence
  chemically synthesized
aattttagagacgaataatt

SEQ ID NO: 499064 - DNA, 20 bp, Artificial Sequence
  chemically synthesized
agagaaccttaattttagag

SEQ ID NO: 499065 - DNA, 20 bp, Artificial Sequence
  chemically synthesized
tctaaaattaaggttctctt

SEQ ID NO: 499066 - DNA, 20 bp, Artificial Sequence
  chemically synthesized
ggcacacctatgtgccaggc

SEQ ID NO: 499067 - DNA, 20 bp, Artificial Sequence
  chemically synthesized
cattactttttctggacacg

SEQ ID NO: 499068 - DNA, 20 bp, Artificial Sequence
  chemically synthesized
tgttttatagtggttagtca

SEQ ID NO: 499069 - DNA, 20 bp, Artificial Sequence
  chemically synthesized
tttaggtaacttatataact

SEQ ID NO: 499070 - DNA, 20 bp, Artificial Sequence
  chemically synthesized
tttcctaaattttactaaag

SEQ ID NO: 499071 - DNA, 20 bp, Artificial Sequence
  chemically synthesized
cttaggaaatgtgagaaatg

SEQ ID NO: 499072 - DNA, 20 bp, Artificial Sequence
  chemically synthesized
tctaagtcagacaaaagttg

SEQ ID NO: 499073 - DNA, 20 bp, Artificial Sequence
  chemically synthesized
gatgaatgagaaattacttt

SEQ ID NO: 499074 - DNA, 20 bp, Artificial Sequence
  chemically synthesized
ttgagaatatggagaaacag

SEQ ID NO: 499075 - DNA, 20 bp, Artificial Sequence
  chemically synthesized
aacttctactcttatattgg

SEQ ID NO: 499076 - DNA, 20 bp, Artificial Sequence
  chemically synthesized
ttactaaattctgccaatat

SEQ ID NO: 499077 - DNA, 20 bp, Artificial Sequence
  chemically synthesized
attggcagaatttagtaagc

SEQ ID NO: 499078 - DNA, 20 bp, Artificial Sequence
  chemically synthesized
aagccagagtaagatgcggg

SEQ ID NO: 499079 - DNA, 20 bp, Artificial Sequence
  chemically synthesized
gagtaagatgcgggctgaat

SEQ ID NO: 499080 - DNA, 20 bp, Artificial Sequence
  chemically synthesized
taggaaagaaaaaaaaaggg

SEQ ID NO: 499081 - DNA, 20 bp, Artificial Sequence
  chemically synthesized
tttatttaaggagccctaag

SEQ ID NO: 499082 - DNA, 20 bp, Artificial Sequence
  chemically synthesized
aaaacaaaacaaaacaggag

SEQ ID NO: 499083 - DNA, 20 bp, Artificial Sequence
  chemically synthesized
acctcagccttctgagaaga

SEQ ID NO: 499084 - DNA, 20 bp, Artificial Sequence
  chemically synthesized
ttctcagaaggctgaggtgg

SEQ ID NO: 499085 - DNA, 20 bp, Artificial Sequence
  chemically synthesized
tgggaggattacttcatcca

SEQ ID NO: 499086 - DNA, 20 bp, Artificial Sequence
  chemically synthesized
tggggctggtctcaaactcc

SEQ ID NO: 499087 - DNA, 20 bp, Artificial Sequence
  chemically synthesized
ttatttatttttttttgagt

SEQ ID NO: 499088 - DNA, 20 bp, Artificial Sequence
  chemically synthesized
ttttacttatttattttttt

SEQ ID NO: 499089 - DNA, 20 bp, Artificial Sequence
  chemically synthesized
tcagtcatgaaaaaaaaaaa

SEQ ID NO: 499090 - DNA, 20 bp, Artificial Sequence
  chemically synthesized
gaaggccagaagaagggtca

SEQ ID NO: 499091 - DNA, 20 bp, Artificial Sequence
  chemically synthesized
ggatgtaagaaggccagaag

SEQ ID NO: 499092 - DNA, 20 bp, Artificial Sequence
  chemically synthesized
tggccttcttacatccttct

SEQ ID NO: 499093 - DNA, 20 bp, Artificial Sequence
  chemically synthesized
catgacatccacattccaag

SEQ ID NO: 499094 - DNA, 20 bp, Artificial Sequence
  chemically synthesized
tcttacatccttcttggaat

SEQ ID NO: 499095 - DNA, 20 bp, Artificial Sequence
  chemically synthesized
agagctccatcttgcaacat

SEQ ID NO: 499096 - DNA, 20 bp, Artificial Sequence
  chemically synthesized
agtgagttatctttacttgg

SEQ ID NO: 499097 - DNA, 20 bp, Artificial Sequence
  chemically synthesized
tcatttctgttttctactga

SEQ ID NO: 499098 - DNA, 20 bp, Artificial Sequence
  chemically synthesized
ccgctcatttctgttttcta

SEQ ID NO: 499099 - DNA, 20 bp, Artificial Sequence
  chemically synthesized
ctgccttggctgcaaacttc

SEQ ID NO: 499100 - DNA, 20 bp, Artificial Sequence
  chemically synthesized
attataattgataaaataaa

SEQ ID NO: 499101 - DNA, 20 bp, Artificial Sequence
  chemically synthesized
tttttctctacctggaatag

SEQ ID NO: 499102 - DNA, 20 bp, Artificial Sequence
  chemically synthesized
atatgcattttttctctacc

SEQ ID NO: 499103 - DNA, 20 bp, Artificial Sequence
  chemically synthesized
acaaaaccaagaaatacaca

SEQ ID NO: 499104 - DNA, 20 bp, Artificial Sequence
  chemically synthesized
cacaaaatttctttctgtat

SEQ ID NO: 499105 - DNA, 20 bp, Artificial Sequence
  chemically synthesized
cccctcatatactgaagaac

SEQ ID NO: 499106 - DNA, 20 bp, Artificial Sequence
  chemically synthesized
gaacaagaatcatctatggt

SEQ ID NO: 499107 - DNA, 20 bp, Artificial Sequence
  chemically synthesized
aattgaacatttttgtttcc

SEQ ID NO: 499108 - DNA, 20 bp, Artificial Sequence
  chemically synthesized
attactttgagaaaaagact

SEQ ID NO: 499109 - DNA, 20 bp, Artificial Sequence
  chemically synthesized
atggctaactctgagattat

SEQ ID NO: 499110 - DNA, 20 bp, Artificial Sequence
  chemically synthesized
atataaaattcacataatct

SEQ ID NO: 499111 - DNA, 20 bp, Artificial Sequence
  chemically synthesized
agtgaactgtgaagatttat

SEQ ID NO: 499112 - DNA, 20 bp, Artificial Sequence
  chemically synthesized
aagatataaggcaaatgatc

SEQ ID NO: 499113 - DNA, 20 bp, Artificial Sequence
  chemically synthesized
tttatgatcaccgcttcatc

SEQ ID NO: 499114 - DNA, 20 bp, Artificial Sequence
  chemically synthesized
ttcaaagcacttaagagttg

SEQ ID NO: 499115 - DNA, 20 bp, Artificial Sequence
  chemically synthesized
atttatagttcaaagcactt

SEQ ID NO: 499116 - DNA, 20 bp, Artificial Sequence
  chemically synthesized
aagtgctttgaactataaat

SEQ ID NO: 499117 - DNA, 20 bp, Artificial Sequence
  chemically synthesized
ttgttaagagcaggtggtga

SEQ ID NO: 499118 - DNA, 20 bp, Artificial Sequence
  chemically synthesized
accacctgctcttaacaact

SEQ ID NO: 499119 - DNA, 20 bp, Artificial Sequence
  chemically synthesized
agttttaaatataatttctt

SEQ ID NO: 499120 - DNA, 20 bp, Artificial Sequence
  chemically synthesized
aatttagacggtatagtgtg

SEQ ID NO: 499121 - DNA, 20 bp, Artificial Sequence
  chemically synthesized
tgaatggttcatgtttttta

SEQ ID NO: 499122 - DNA, 20 bp, Artificial Sequence
  chemically synthesized
tcaataagtcacaataagat

SEQ ID NO: 499123 - DNA, 20 bp, Artificial Sequence
  chemically synthesized
ttacaacaaaccaattatca

SEQ ID NO: 499124 - DNA, 20 bp, Artificial Sequence
  chemically synthesized
acctcatgacaccaactata

SEQ ID NO: 499125 - DNA, 20 bp, Artificial Sequence
  chemically synthesized
gtcaaatcacacaattcatt

SEQ ID NO: 499126 - DNA, 20 bp, Artificial Sequence
  chemically synthesized
tttccacccagcaacccaaa

SEQ ID NO: 499127 - DNA, 20 bp, Artificial Sequence
  chemically synthesized
acacaattcattttgggttg

SEQ ID NO: 499128 - DNA, 20 bp, Artificial Sequence
  chemically synthesized
tgcattttgcacaccactga

SEQ ID NO: 499129 - DNA, 20 bp, Artificial Sequence
  chemically synthesized
caaaatgcaatgactggcca

SEQ ID NO: 499130 - DNA, 20 bp, Artificial Sequence
  chemically synthesized
gaatgatatttacaatagct

SEQ ID NO: 499131 - DNA, 20 bp, Artificial Sequence
  chemically synthesized
cttgtatatataatgcccag

SEQ ID NO: 499132 - DNA, 20 bp, Artificial Sequence
  chemically synthesized
tgttgaatgtcagaaaccac

SEQ ID NO: 499133 - DNA, 20 bp, Artificial Sequence
  chemically synthesized
ctgatttattttattggttg

SEQ ID NO: 499134 - DNA, 20 bp, Artificial Sequence
  chemically synthesized
acctttaagtttttctccat

SEQ ID NO: 499135 - DNA, 20 bp, Artificial Sequence
  chemically synthesized
aattcatttttaagaaaata

SEQ ID NO: 499136 - DNA, 20 bp, Artificial Sequence
  chemically synthesized
tattcattattttcttaaaa

SEQ ID NO: 499137 - DNA, 20 bp, Artificial Sequence
  chemically synthesized
ttactaagtaactagttgga

SEQ ID NO: 499138 - DNA, 20 bp, Artificial Sequence
  chemically synthesized
atgatttactaagtaactag

SEQ ID NO: 499139 - DNA, 20 bp, Artificial Sequence
  chemically synthesized
tgattttcaaagaagatctt

SEQ ID NO: 499140 - DNA, 20 bp, Artificial Sequence
  chemically synthesized
caccactccgtctcactttt

SEQ ID NO: 499141 - DNA, 20 bp, Artificial Sequence
  chemically synthesized
aacaattcaaaaaagtgaga

SEQ ID NO: 499142 - DNA, 20 bp, Artificial Sequence
  chemically synthesized
gacggagtggtgcaagatgt

SEQ ID NO: 499143 - DNA, 20 bp, Artificial Sequence
  chemically synthesized
ccagaaccaaaaaccaggta

SEQ ID NO: 499144 - DNA, 20 bp, Artificial Sequence
  chemically synthesized
gaaaggcaggagacacagtc

SEQ ID NO: 499145 - DNA, 20 bp, Artificial Sequence
  chemically synthesized
tctgcactgcacgtccagtg

SEQ ID NO: 499146 - DNA, 20 bp, Artificial Sequence
  chemically synthesized
ctggacgtgcagtgcagaga

SEQ ID NO: 499147 - DNA, 20 bp, Artificial Sequence
  chemically synthesized
agtcagtgcctgtgcacgga

SEQ ID NO: 499148 - DNA, 20 bp, Artificial Sequence
  chemically synthesized
tgaactagccccagccagaa

SEQ ID NO: 499149 - DNA, 20 bp, Artificial Sequence
  chemically synthesized
gaaacttgagttctgactgc

SEQ ID NO: 499150 - DNA, 20 bp, Artificial Sequence
  chemically synthesized
ggtgaggcttgccaagaaac

SEQ ID NO: 499151 - DNA, 20 bp, Artificial Sequence
  chemically synthesized
cattgtgggccaaagtgctc

SEQ ID NO: 499152 - DNA, 20 bp, Artificial Sequence
  chemically synthesized
gctatgactagaagttatct

SEQ ID NO: 499153 - DNA, 20 bp, Artificial Sequence
  chemically synthesized
tgggctaagagctagaggac

SEQ ID NO: 499154 - DNA, 20 bp, Artificial Sequence
  chemically synthesized
acaccagctggcatggctaa

SEQ ID NO: 499155 - DNA, 20 bp, Artificial Sequence
  chemically synthesized
tgcactgcttgaggtggggg

SEQ ID NO: 499156 - DNA, 20 bp, Artificial Sequence
  chemically synthesized
cctctccttaagcaaaagta

SEQ ID NO: 499157 - DNA, 20 bp, Artificial Sequence
  chemically synthesized
ttacttttgcttaaggagag

SEQ ID NO: 499158 - DNA, 20 bp, Artificial Sequence
  chemically synthesized
agaggagagtgaaaagtaaa

SEQ ID NO: 499159 - DNA, 20 bp, Artificial Sequence
  chemically synthesized
ctggtatccaagatgcaaga

SEQ ID NO: 499160 - DNA, 20 bp, Artificial Sequence
  chemically synthesized
agaggattctgtcttgcatc

SEQ ID NO: 499161 - DNA, 20 bp, Artificial Sequence
  chemically synthesized
ggataccagcttagtcacag

SEQ ID NO: 499162 - DNA, 20 bp, Artificial Sequence
  chemically synthesized
tccaggagctgagcctagaa

SEQ ID NO: 499163 - DNA, 20 bp, Artificial Sequence
  chemically synthesized
cactgtatctctcttgattg

SEQ ID NO: 499164 - DNA, 20 bp, Artificial Sequence
  chemically synthesized
acttcggcctcccaaagtgc

SEQ ID NO: 499165 - DNA, 20 bp, Artificial Sequence
  chemically synthesized
actttgggaggccgaagtag

SEQ ID NO: 499166 - DNA, 20 bp, Artificial Sequence
  chemically synthesized
taggtggatcacttgaggtc

SEQ ID NO: 499167 - DNA, 20 bp, Artificial Sequence
  chemically synthesized
ttttgtatttttagtagagt

SEQ ID NO: 499168 - DNA, 20 bp, Artificial Sequence
  chemically synthesized
gctaatttttgtatttttag

SEQ ID NO: 499169 - DNA, 20 bp, Artificial Sequence
  chemically synthesized
aaaattagccacgcgtgatt

SEQ ID NO: 499170 - DNA, 20 bp, Artificial Sequence
  chemically synthesized
ctcttggggggctaaggcac

SEQ ID NO: 499171 - DNA, 20 bp, Artificial Sequence
  chemically synthesized
ttcgctgcaacctccgcctc

SEQ ID NO: 499172 - DNA, 20 bp, Artificial Sequence
  chemically synthesized
cccaggctggagtgctgtga

SEQ ID NO: 499173 - DNA, 20 bp, Artificial Sequence
  chemically synthesized
tctcactctgttgcccaggc

SEQ ID NO: 499174 - DNA, 20 bp, Artificial Sequence
  chemically synthesized
cagcactccagcctgggcaa

SEQ ID NO: 499175 - DNA, 20 bp, Artificial Sequence
  chemically synthesized
aagaaaaatagatacagtgt

SEQ ID NO: 499176 - DNA, 20 bp, Artificial Sequence
  chemically synthesized
aaaatagatacagtgtctga

SEQ ID NO: 499177 - DNA, 20 bp, Artificial Sequence
  chemically synthesized
ttcttgaggtcaacacaaaa

SEQ ID NO: 499178 - DNA, 20 bp, Artificial Sequence
  chemically synthesized
tgtgtgtagctttataggtg

SEQ ID NO: 499179 - DNA, 20 bp, Artificial Sequence
  chemically synthesized
tacacacagactggaaataa

SEQ ID NO: 499180 - DNA, 20 bp, Artificial Sequence
  chemically synthesized
tgtttgggtttccattggca

SEQ ID NO: 499181 - DNA, 20 bp, Artificial Sequence
  chemically synthesized
tagagctagtccagctatgt

SEQ ID NO: 499182 - DNA, 20 bp, Artificial Sequence
  chemically synthesized
aggtcattatataatgacaa

SEQ ID NO: 499183 - DNA, 20 bp, Artificial Sequence
  chemically synthesized
caaaagggtcaattcagcaa

SEQ ID NO: 499184 - DNA, 20 bp, Artificial Sequence
  chemically synthesized
ataattgttatatcctgttg

SEQ ID NO: 499185 - DNA, 20 bp, Artificial Sequence
  chemically synthesized
attatatatgcactcaacac

SEQ ID NO: 499186 - DNA, 20 bp, Artificial Sequence
  chemically synthesized
tatatatatatactccagtg

SEQ ID NO: 499187 - DNA, 20 bp, Artificial Sequence
  chemically synthesized
agcaaatatatatacaacac

SEQ ID NO: 499188 - DNA, 20 bp, Artificial Sequence
  chemically synthesized
ggtctttctctctcctgagc

SEQ ID NO: 499189 - DNA, 20 bp, Artificial Sequence
  chemically synthesized
gatctgcccaatgttgaaag

SEQ ID NO: 499190 - DNA, 20 bp, Artificial Sequence
  chemically synthesized
attggacttaatctgcacta

SEQ ID NO: 499191 - DNA, 20 bp, Artificial Sequence
  chemically synthesized
taatctgcactatagaataa

SEQ ID NO: 499192 - DNA, 20 bp, Artificial Sequence
  chemically synthesized
tttacaggacatttaattca

SEQ ID NO: 499193 - DNA, 20 bp, Artificial Sequence
  chemically synthesized
gacatttaattcaatgagtg

SEQ ID NO: 499194 - DNA, 20 bp, Artificial Sequence
  chemically synthesized
gaatgtgtattctacactca

SEQ ID NO: 499195 - DNA, 20 bp, Artificial Sequence
  chemically synthesized
ataatctgtgtgctgagaag

SEQ ID NO: 499196 - DNA, 20 bp, Artificial Sequence
  chemically synthesized
ttgatattatttcattgtta

SEQ ID NO: 499197 - DNA, 20 bp, Artificial Sequence
  chemically synthesized
agcatcttctctgaccacaa

SEQ ID NO: 499198 - DNA, 20 bp, Artificial Sequence
  chemically synthesized
gagactagaaatcaacaatg

SEQ ID NO: 499199 - DNA, 20 bp, Artificial Sequence
  chemically synthesized
aatatgctactaaatgacca

SEQ ID NO: 499200 - DNA, 20 bp, Artificial Sequence
  chemically synthesized
aaaccacataccaaaaccta

SEQ ID NO: 499201 - DNA, 20 bp, Artificial Sequence
  chemically synthesized
atttctttcttccactaatt

SEQ ID NO: 499202 - DNA, 20 bp, Artificial Sequence
  chemically synthesized
tcatttctgattttacttat

SEQ ID NO: 499203 - DNA, 20 bp, Artificial Sequence
  chemically synthesized
tagtagccactaatgagcct

SEQ ID NO: 499204 - DNA, 20 bp, Artificial Sequence
  chemically synthesized
aattgaaaaatctagaggta

SEQ ID NO: 499205 - DNA, 20 bp, Artificial Sequence
  chemically synthesized
ttggtaggttgtatgtgtct

SEQ ID NO: 499206 - DNA, 20 bp, Artificial Sequence
  chemically synthesized
gttactggtccgttcaggtt

SEQ ID NO: 499207 - DNA, 20 bp, Artificial Sequence
  chemically synthesized
aaaacctgaacggaccagta

SEQ ID NO: 499208 - DNA, 20 bp, Artificial Sequence
  chemically synthesized
cccaagcttttctttactgg

SEQ ID NO: 499209 - DNA, 20 bp, Artificial Sequence
  chemically synthesized
agagttcagcagtgcagcca

SEQ ID NO: 499210 - DNA, 20 bp, Artificial Sequence
  chemically synthesized
catcaatatttatcacatgg

SEQ ID NO: 499211 - DNA, 20 bp, Artificial Sequence
  chemically synthesized
atattgatgcaaaattgatg

SEQ ID NO: 499212 - DNA, 20 bp, Artificial Sequence
  chemically synthesized
ggatattagccctttgtcag

SEQ ID NO: 499213 - DNA, 20 bp, Artificial Sequence
  chemically synthesized
tctgacaaagggctaatatc

SEQ ID NO: 499214 - DNA, 20 bp, Artificial Sequence
  chemically synthesized
gtttgagttcattgtagatt

SEQ ID NO: 499215 - DNA, 20 bp, Artificial Sequence
  chemically synthesized
tttttttcttgtacgtttgt

SEQ ID NO: 499216 - DNA, 20 bp, Artificial Sequence
  chemically synthesized
acaaacaaccccatcaaaaa

SEQ ID NO: 499217 - DNA, 20 bp, Artificial Sequence
  chemically synthesized
gtccttcacccactttttga

SEQ ID NO: 499218 - DNA, 20 bp, Artificial Sequence
  chemically synthesized
tcagagaactgcaaatcaaa

SEQ ID NO: 499219 - DNA, 20 bp, Artificial Sequence
  chemically synthesized
gaaacattggagaaactctc

SEQ ID NO: 499220 - DNA, 20 bp, Artificial Sequence
  chemically synthesized
ttacccagacagatatcctg

SEQ ID NO: 499221 - DNA, 20 bp, Artificial Sequence
  chemically synthesized
aaactctccaggatatctgt

SEQ ID NO: 499222 - DNA, 20 bp, Artificial Sequence
  chemically synthesized
ctgtctgggtaaaacaaatc

SEQ ID NO: 499223 - DNA, 20 bp, Artificial Sequence
  chemically synthesized
gcttttgttgcctgtgctta

SEQ ID NO: 499224 - DNA, 20 bp, Artificial Sequence
  chemically synthesized
acaaaagcaaaaatagacaa

SEQ ID NO: 499225 - DNA, 20 bp, Artificial Sequence
  chemically synthesized
tgcaaattacccatctcaca

SEQ ID NO: 499226 - DNA, 20 bp, Artificial Sequence
  chemically synthesized
ggttattaatcccttgtgag

SEQ ID NO: 499227 - DNA, 20 bp, Artificial Sequence
  chemically synthesized
tctcacaagggattaataac

SEQ ID NO: 499228 - DNA, 20 bp, Artificial Sequence
  chemically synthesized
attaataaccagaatatata

SEQ ID NO: 499229 - DNA, 20 bp, Artificial Sequence
  chemically synthesized
aattattagactttttccta

SEQ ID NO: 499230 - DNA, 20 bp, Artificial Sequence
  chemically synthesized
tcagaaaatagacaaaagat

SEQ ID NO: 499231 - DNA, 20 bp, Artificial Sequence
  chemically synthesized
ttcttttgagaaatgcctat

SEQ ID NO: 499232 - DNA, 20 bp, Artificial Sequence
  chemically synthesized
aatacaaagcaaaactacaa

SEQ ID NO: 499233 - DNA, 20 bp, Artificial Sequence
  chemically synthesized
tgtcgttttaattggggtga

SEQ ID NO: 499234 - DNA, 20 bp, Artificial Sequence
  chemically synthesized
tttggatatgtcgttttaat

SEQ ID NO: 499235 - DNA, 20 bp, Artificial Sequence
  chemically synthesized
catttgtaattgcctgtctt

SEQ ID NO: 499236 - DNA, 20 bp, Artificial Sequence
  chemically synthesized
aggcaattacaaatgctgga

SEQ ID NO: 499237 - DNA, 20 bp, Artificial Sequence
  chemically synthesized
cattcctgccaacagtgtac

SEQ ID NO: 499238 - DNA, 20 bp, Artificial Sequence
  chemically synthesized
gactcctgtacactgttggc

SEQ ID NO: 499239 - DNA, 20 bp, Artificial Sequence
  chemically synthesized
aaattagtacaaccaaaatg

SEQ ID NO: 499240 - DNA, 20 bp, Artificial Sequence
  chemically synthesized
tatacccagcagtgggattg

SEQ ID NO: 499241 - DNA, 20 bp, Artificial Sequence
  chemically synthesized
atgatccagcaatcccactg

SEQ ID NO: 499242 - DNA, 20 bp, Artificial Sequence
  chemically synthesized
ttgggatatatacccagcag

SEQ ID NO: 499243 - DNA, 20 bp, Artificial Sequence
  chemically synthesized
atatactgatttgctttctt

SEQ ID NO: 499244 - DNA, 20 bp, Artificial Sequence
  chemically synthesized
aacagtgcttcaacaaacgt

SEQ ID NO: 499245 - DNA, 20 bp, Artificial Sequence
  chemically synthesized
acctgagcgtccatcaagag

SEQ ID NO: 499246 - DNA, 20 bp, Artificial Sequence
  chemically synthesized
aatgtgatacatatacgtaa

SEQ ID NO: 499247 - DNA, 20 bp, Artificial Sequence
  chemically synthesized
gagtactattcagccataaa

SEQ ID NO: 499248 - DNA, 20 bp, Artificial Sequence
  chemically synthesized
ggatctcattctttttatgg

SEQ ID NO: 499249 - DNA, 20 bp, Artificial Sequence
  chemically synthesized
atccatgatgttgcaaatga

SEQ ID NO: 499250 - DNA, 20 bp, Artificial Sequence
  chemically synthesized
atcctttcatttgcaacatc

SEQ ID NO: 499251 - DNA, 20 bp, Artificial Sequence
  chemically synthesized
caactgaacacttggagata

SEQ ID NO: 499252 - DNA, 20 bp, Artificial Sequence
  chemically synthesized
cacttggagatagagggtgg

SEQ ID NO: 499253 - DNA, 20 bp, Artificial Sequence
  chemically synthesized
gatggttaccagaggctgtg

SEQ ID NO: 499254 - DNA, 20 bp, Artificial Sequence
  chemically synthesized
gaggctgtgaagggtagtgg

SEQ ID NO: 499255 - DNA, 20 bp, Artificial Sequence
  chemically synthesized
tggtacaaaaaatagttaga

SEQ ID NO: 499256 - DNA, 20 bp, Artificial Sequence
  chemically synthesized
cctactatttgctagcacaa

SEQ ID NO: 499257 - DNA, 20 bp, Artificial Sequence
  chemically synthesized
attttactgtttgtaaaaca

SEQ ID NO: 499258 - DNA, 20 bp, Artificial Sequence
  chemically synthesized
aacaaagaataattgcttga

SEQ ID NO: 499259 - DNA, 20 bp, Artificial Sequence
  chemically synthesized
catgcaagtatcatggaaaa

SEQ ID NO: 499260 - DNA, 20 bp, Artificial Sequence
  chemically synthesized
gtggggtacatatatatata

SEQ ID NO: 499261 - DNA, 20 bp, Artificial Sequence
  chemically synthesized
catatatatgtgtatatatg

SEQ ID NO: 499262 - DNA, 20 bp, Artificial Sequence
  chemically synthesized
tatgtggggtacatatatat

SEQ ID NO: 499263 - DNA, 20 bp, Artificial Sequence
  chemically synthesized
ggggtacatatatatatatg

SEQ ID NO: 499264 - DNA, 20 bp, Artificial Sequence
  chemically synthesized
gtggggtacatatatatatg

SEQ ID NO: 499265 - DNA, 20 bp, Artificial Sequence
  chemically synthesized
atgtggggtatatatatatg

SEQ ID NO: 499266 - DNA, 20 bp, Artificial Sequence
  chemically synthesized
acatacatagtgtatatatg

SEQ ID NO: 499267 - DNA, 20 bp, Artificial Sequence
  chemically synthesized
aaatgttatttttaacgttt

SEQ ID NO: 499268 - DNA, 20 bp, Artificial Sequence
  chemically synthesized
cttctgcattgtccccatga

SEQ ID NO: 499269 - DNA, 20 bp, Artificial Sequence
  chemically synthesized
tgtccccatgactgaatcca

SEQ ID NO: 499270 - DNA, 20 bp, Artificial Sequence
  chemically synthesized
gactggaagaaaggaatccc

SEQ ID NO: 499271 - DNA, 20 bp, Artificial Sequence
  chemically synthesized
tgttttactgactggaagaa

SEQ ID NO: 499272 - DNA, 20 bp, Artificial Sequence
  chemically synthesized
agtcagtaaaacagtggcca

SEQ ID NO: 499273 - DNA, 20 bp, Artificial Sequence
  chemically synthesized
gtaaaacagtggccatggaa

SEQ ID NO: 499274 - DNA, 20 bp, Artificial Sequence
  chemically synthesized
cttggtagaattaggaagta

SEQ ID NO: 499275 - DNA, 20 bp, Artificial Sequence
  chemically synthesized
ctgttggtttctgagcttgg

SEQ ID NO: 499276 - DNA, 20 bp, Artificial Sequence
  chemically synthesized
attggcacatatacctatac

SEQ ID NO: 499277 - DNA, 20 bp, Artificial Sequence
  chemically synthesized
atatacctatacctgggttg

SEQ ID NO: 499278 - DNA, 20 bp, Artificial Sequence
  chemically synthesized
ttgaagatttttatgcaaga

SEQ ID NO: 499279 - DNA, 20 bp, Artificial Sequence
  chemically synthesized
aaggattatcattgcagtct

SEQ ID NO: 499280 - DNA, 20 bp, Artificial Sequence
  chemically synthesized
gactgcaatgataatccttc

SEQ ID NO: 499281 - DNA, 20 bp, Artificial Sequence
  chemically synthesized
caggatgctgacaactcacg

SEQ ID NO: 499282 - DNA, 20 bp, Artificial Sequence
  chemically synthesized
agatacatgataagcacata

SEQ ID NO: 499283 - DNA, 20 bp, Artificial Sequence
  chemically synthesized
ggctgctaatgctgctatag

SEQ ID NO: 499284 - DNA, 20 bp, Artificial Sequence
  chemically synthesized
gcataatctgggagcttttc

SEQ ID NO: 499285 - DNA, 20 bp, Artificial Sequence
  chemically synthesized
taatcctcacgttatcacta

SEQ ID NO: 499286 - DNA, 20 bp, Artificial Sequence
  chemically synthesized
aaattctatagtgataacgt

SEQ ID NO: 499287 - DNA, 20 bp, Artificial Sequence
  chemically synthesized
gtatactattctttccttat

SEQ ID NO: 499288 - DNA, 20 bp, Artificial Sequence
  chemically synthesized
tcacattacccatataagga

SEQ ID NO: 499289 - DNA, 20 bp, Artificial Sequence
  chemically synthesized
acatgaaagaaaattattta

SEQ ID NO: 499290 - DNA, 20 bp, Artificial Sequence
  chemically synthesized
tcctaatgtgagtttctgat

SEQ ID NO: 499291 - DNA, 20 bp, Artificial Sequence
  chemically synthesized
tcttatcagaaactcacatt

SEQ ID NO: 499292 - DNA, 20 bp, Artificial Sequence
  chemically synthesized
tctgcaagcccattcctaat

SEQ ID NO: 499293 - DNA, 20 bp, Artificial Sequence
  chemically synthesized
tcacattaggaatgggcttg

SEQ ID NO: 499294 - DNA, 20 bp, Artificial Sequence
  chemically synthesized
gcatgctcattccctactgt

SEQ ID NO: 499295 - DNA, 20 bp, Artificial Sequence
  chemically synthesized
gtctctgtattcagacagta

SEQ ID NO: 499296 - DNA, 20 bp, Artificial Sequence
  chemically synthesized
gacgattagggactttctct

SEQ ID NO: 499297 - DNA, 20 bp, Artificial Sequence
  chemically synthesized
gaaacgaaaggagagaaaac

SEQ ID NO: 499298 - DNA, 20 bp, Artificial Sequence
  chemically synthesized
acaaatggcagccagagcct

SEQ ID NO: 499299 - DNA, 20 bp, Artificial Sequence
  chemically synthesized
cagttggaagctgcttcccc

SEQ ID NO: 499300 - DNA, 20 bp, Artificial Sequence
  chemically synthesized
ccacaggtcattaggatgct

SEQ ID NO: 499301 - DNA, 20 bp, Artificial Sequence
  chemically synthesized
accacagttccacaggtcat

SEQ ID NO: 499302 - DNA, 20 bp, Artificial Sequence
  chemically synthesized
gacctgtggaactgtggttc

SEQ ID NO: 499303 - DNA, 20 bp, Artificial Sequence
  chemically synthesized
tgggcaattataaaatgttc

SEQ ID NO: 499304 - DNA, 20 bp, Artificial Sequence
  chemically synthesized
tgatgtgtacacatttctgt

SEQ ID NO: 499305 - DNA, 20 bp, Artificial Sequence
  chemically synthesized
gtaatgttttgtttcttgat

SEQ ID NO: 499306 - DNA, 20 bp, Artificial Sequence
  chemically synthesized
ctgaagcaggcttctaggga

SEQ ID NO: 499307 - DNA, 20 bp, Artificial Sequence
  chemically synthesized
gtcagataggagttaccttt

SEQ ID NO: 499308 - DNA, 20 bp, Artificial Sequence
  chemically synthesized
ttggagtttagaggtcagat

SEQ ID NO: 499309 - DNA, 20 bp, Artificial Sequence
  chemically synthesized
aactaaaaaattaggcactt

SEQ ID NO: 499310 - DNA, 20 bp, Artificial Sequence
  chemically synthesized
aataagagaacacttactgt

SEQ ID NO: 499311 - DNA, 20 bp, Artificial Sequence
  chemically synthesized
tgtaaaatagacatgagact

SEQ ID NO: 499312 - DNA, 20 bp, Artificial Sequence
  chemically synthesized
atctaaagctcagaaccatc

SEQ ID NO: 499313 - DNA, 20 bp, Artificial Sequence
  chemically synthesized
tcttgaatttaactacttat

SEQ ID NO: 499314 - DNA, 20 bp, Artificial Sequence
  chemically synthesized
gaatttaactacttatatgg

SEQ ID NO: 499315 - DNA, 20 bp, Artificial Sequence
  chemically synthesized
attctacttagtcagatatg

SEQ ID NO: 499316 - DNA, 20 bp, Artificial Sequence
  chemically synthesized
acccaacatatctgactaag

SEQ ID NO: 499317 - DNA, 20 bp, Artificial Sequence
  chemically synthesized
taaaatcagtatttccttct

SEQ ID NO: 499318 - DNA, 20 bp, Artificial Sequence
  chemically synthesized
aatgacttcccaaagactaa

SEQ ID NO: 499319 - DNA, 20 bp, Artificial Sequence
  chemically synthesized
tactatcctgtaagccatta

SEQ ID NO: 499320 - DNA, 20 bp, Artificial Sequence
  chemically synthesized
aaacactcactaatggctta

SEQ ID NO: 499321 - DNA, 20 bp, Artificial Sequence
  chemically synthesized
cagaaagaaactaacgacaa

SEQ ID NO: 499322 - DNA, 20 bp, Artificial Sequence
  chemically synthesized
gaatttacataagatctatc

SEQ ID NO: 499323 - DNA, 20 bp, Artificial Sequence
  chemically synthesized
ataggaaacatgtaaaaaca

SEQ ID NO: 499324 - DNA, 20 bp, Artificial Sequence
  chemically synthesized
cagttttcattgattttcgg

SEQ ID NO: 499325 - DNA, 20 bp, Artificial Sequence
  chemically synthesized
aattcagttttcattgattt

SEQ ID NO: 499326 - DNA, 20 bp, Artificial Sequence
  chemically synthesized
cacccgaaaatcaatgaaaa

SEQ ID NO: 499327 - DNA, 20 bp, Artificial Sequence
  chemically synthesized
tccacaagcaccatgaacgt

SEQ ID NO: 499328 - DNA, 20 bp, Artificial Sequence
  chemically synthesized
tccatacgttcatggtgctt

SEQ ID NO: 499329 - DNA, 20 bp, Artificial Sequence
  chemically synthesized
gttgactgttagtgaacaat

SEQ ID NO: 499330 - DNA, 20 bp, Artificial Sequence
  chemically synthesized
atacattgtctttcagcaaa

SEQ ID NO: 499331 - DNA, 20 bp, Artificial Sequence
  chemically synthesized
ggaagcaggtatgttagata

SEQ ID NO: 499332 - DNA, 20 bp, Artificial Sequence
  chemically synthesized
agatagttaataatttataa

SEQ ID NO: 499333 - DNA, 20 bp, Artificial Sequence
  chemically synthesized
tattaactatctctaataat

SEQ ID NO: 499334 - DNA, 20 bp, Artificial Sequence
  chemically synthesized
ctccccccttccactgtagg

SEQ ID NO: 499335 - DNA, 20 bp, Artificial Sequence
  chemically synthesized
gttgccaaatctgacatcaa

SEQ ID NO: 499336 - DNA, 20 bp, Artificial Sequence
  chemically synthesized
acttcacaggagcagaggcc

SEQ ID NO: 499337 - DNA, 20 bp, Artificial Sequence
  chemically synthesized
tttgctctggacctaagatg

SEQ ID NO: 499338 - DNA, 20 bp, Artificial Sequence
  chemically synthesized
gctaggttccatgatgcatg

SEQ ID NO: 499339 - DNA, 20 bp, Artificial Sequence
  chemically synthesized
gggaagctctgcttcaagat

SEQ ID NO: 499340 - DNA, 20 bp, Artificial Sequence
  chemically synthesized
agcttcccggccaagcccag

SEQ ID NO: 499341 - DNA, 20 bp, Artificial Sequence
  chemically synthesized
tgttttcagtcagcaagttc

SEQ ID NO: 499342 - DNA, 20 bp, Artificial Sequence
  chemically synthesized
gagttttttagtaagccaat

SEQ ID NO: 499343 - DNA, 20 bp, Artificial Sequence
  chemically synthesized
gtgttctcaacaaaaatctg

SEQ ID NO: 499344 - DNA, 20 bp, Artificial Sequence
  chemically synthesized
tactgaacatttgtgtattc

SEQ ID NO: 499345 - DNA, 20 bp, Artificial Sequence
  chemically synthesized
gatttagaagctatgcattc

SEQ ID NO: 499346 - DNA, 20 bp, Artificial Sequence
  chemically synthesized
catagcttctaaatctctcc

SEQ ID NO: 499347 - DNA, 20 bp, Artificial Sequence
  chemically synthesized
ctaaatctctccaaggattc

SEQ ID NO: 499348 - DNA, 20 bp, Artificial Sequence
  chemically synthesized
tcccatacaatggtagattc

SEQ ID NO: 499349 - DNA, 20 bp, Artificial Sequence
  chemically synthesized
agatcagggaaaataaatag

SEQ ID NO: 499350 - DNA, 20 bp, Artificial Sequence
  chemically synthesized
taccaaggcagatggcaggc

SEQ ID NO: 499351 - DNA, 20 bp, Artificial Sequence
  chemically synthesized
aaaccatgtataatatataa

SEQ ID NO: 499352 - DNA, 20 bp, Artificial Sequence
  chemically synthesized
tttttttcaccctaaaacag

SEQ ID NO: 499353 - DNA, 20 bp, Artificial Sequence
  chemically synthesized
actactcaactctgctgttt

SEQ ID NO: 499354 - DNA, 20 bp, Artificial Sequence
  chemically synthesized
ttcaccctaaaacagcagag

SEQ ID NO: 499355 - DNA, 20 bp, Artificial Sequence
  chemically synthesized
aagcatctgatagtcagagg

SEQ ID NO: 499356 - DNA, 20 bp, Artificial Sequence
  chemically synthesized
gcagaagcatctgatagtca

SEQ ID NO: 499357 - DNA, 20 bp, Artificial Sequence
  chemically synthesized
tctgccagagaccctagttg

SEQ ID NO: 499358 - DNA, 20 bp, Artificial Sequence
  chemically synthesized
tgtgtcgctcattctacaac

SEQ ID NO: 499359 - DNA, 20 bp, Artificial Sequence
  chemically synthesized
tagaatgagcgacacacagc

SEQ ID NO: 499360 - DNA, 20 bp, Artificial Sequence
  chemically synthesized
gaattattttgctgtcatgc

SEQ ID NO: 499361 - DNA, 20 bp, Artificial Sequence
  chemically synthesized
tatcaagctatgaggtaaat

SEQ ID NO: 499362 - DNA, 20 bp, Artificial Sequence
  chemically synthesized
agcttgatagtagatatatt

SEQ ID NO: 499363 - DNA, 20 bp, Artificial Sequence
  chemically synthesized
ggaagagcaggctaggcatc

SEQ ID NO: 499364 - DNA, 20 bp, Artificial Sequence
  chemically synthesized
gaaggatatcagatacctca

SEQ ID NO: 499365 - DNA, 20 bp, Artificial Sequence
  chemically synthesized
agaattatataaattactag

SEQ ID NO: 499366 - DNA, 20 bp, Artificial Sequence
  chemically synthesized
gtgactctagttactttagg

SEQ ID NO: 499367 - DNA, 20 bp, Artificial Sequence
  chemically synthesized
ataattctacctaaagtaac

SEQ ID NO: 499368 - DNA, 20 bp, Artificial Sequence
  chemically synthesized
gttagttgtaactcagaacc

SEQ ID NO: 499369 - DNA, 20 bp, Artificial Sequence
  chemically synthesized
tctatagaccattcaaggtt

SEQ ID NO: 499370 - DNA, 20 bp, Artificial Sequence
  chemically synthesized
aagctatcttactaagaatg

SEQ ID NO: 499371 - DNA, 20 bp, Artificial Sequence
  chemically synthesized
tggaatgaagctatcttact

SEQ ID NO: 499372 - DNA, 20 bp, Artificial Sequence
  chemically synthesized
atagcttcattccattcccc

SEQ ID NO: 499373 - DNA, 20 bp, Artificial Sequence
  chemically synthesized
agaacaagatccctggggaa

SEQ ID NO: 499374 - DNA, 20 bp, Artificial Sequence
  chemically synthesized
gggcaagaacaagatccctg

SEQ ID NO: 499375 - DNA, 20 bp, Artificial Sequence
  chemically synthesized
gcacaaccagccagtaaaat

SEQ ID NO: 499376 - DNA, 20 bp, Artificial Sequence
  chemically synthesized
gaagctcttcaaagcaggga

SEQ ID NO: 499377 - DNA, 20 bp, Artificial Sequence
  chemically synthesized
tccctgagaactacagagag

SEQ ID NO: 499378 - DNA, 20 bp, Artificial Sequence
  chemically synthesized
agggaaatttgaaagcatgt

SEQ ID NO: 499379 - DNA, 20 bp, Artificial Sequence
  chemically synthesized
aaatttgaaagcatgtaaga

SEQ ID NO: 499380 - DNA, 20 bp, Artificial Sequence
  chemically synthesized
caatatatgtggggagctta

SEQ ID NO: 499381 - DNA, 20 bp, Artificial Sequence
  chemically synthesized
ctatgtcacagggttgttat

SEQ ID NO: 499382 - DNA, 20 bp, Artificial Sequence
  chemically synthesized
taagaatagtgtctatgtca

SEQ ID NO: 499383 - DNA, 20 bp, Artificial Sequence
  chemically synthesized
tctgatgtataaaataggat

SEQ ID NO: 499384 - DNA, 20 bp, Artificial Sequence
  chemically synthesized
tacatttctgatgtataaaa

SEQ ID NO: 499385 - DNA, 20 bp, Artificial Sequence
  chemically synthesized
cacatagatagcagaaaggc

SEQ ID NO: 499386 - DNA, 20 bp, Artificial Sequence
  chemically synthesized
agaaaggccagaattccaaa

SEQ ID NO: 499387 - DNA, 20 bp, Artificial Sequence
  chemically synthesized
tctagagttccaacccgttt

SEQ ID NO: 499388 - DNA, 20 bp, Artificial Sequence
  chemically synthesized
ttgcttataagcacaggctc

SEQ ID NO: 499389 - DNA, 20 bp, Artificial Sequence
  chemically synthesized
cagctcctgaccaattccta

SEQ ID NO: 499390 - DNA, 20 bp, Artificial Sequence
  chemically synthesized
tacttccattgacattctat

SEQ ID NO: 499391 - DNA, 20 bp, Artificial Sequence
  chemically synthesized
tggaagtacaatttcaacct

SEQ ID NO: 499392 - DNA, 20 bp, Artificial Sequence
  chemically synthesized
tttcaacctctggataagga

SEQ ID NO: 499393 - DNA, 20 bp, Artificial Sequence
  chemically synthesized
aacctctggataaggacagg

SEQ ID NO: 499394 - DNA, 20 bp, Artificial Sequence
  chemically synthesized
tttctggttttgacaaagga

SEQ ID NO: 499395 - DNA, 20 bp, Artificial Sequence
  chemically synthesized
ggacttttctggttttgaca

SEQ ID NO: 499396 - DNA, 20 bp, Artificial Sequence
  chemically synthesized
gtcaaaaccagaaaagtcct

SEQ ID NO: 499397 - DNA, 20 bp, Artificial Sequence
  chemically synthesized
accagaaaagtcctcagagt

SEQ ID NO: 499398 - DNA, 20 bp, Artificial Sequence
  chemically synthesized
gatttcagcgaccctctctg

SEQ ID NO: 499399 - DNA, 20 bp, Artificial Sequence
  chemically synthesized
cactaacgccattccacaga

SEQ ID NO: 499400 - DNA, 20 bp, Artificial Sequence
  chemically synthesized
tccatatgacccagtgagaa

SEQ ID NO: 499401 - DNA, 20 bp, Artificial Sequence
  chemically synthesized
atccaggtattcccttctca

SEQ ID NO: 499402 - DNA, 20 bp, Artificial Sequence
  chemically synthesized
acccagtgagaagggaatac

SEQ ID NO: 499403 - DNA, 20 bp, Artificial Sequence
  chemically synthesized
tcatttgccaaaaattactc

SEQ ID NO: 499404 - DNA, 20 bp, Artificial Sequence
  chemically synthesized
gtttctcctccgctttactc

SEQ ID NO: 499405 - DNA, 20 bp, Artificial Sequence
  chemically synthesized
ctaaggaccgttgaggtttc

SEQ ID NO: 499406 - DNA, 20 bp, Artificial Sequence
  chemically synthesized
agaaacctcaacggtcctta

SEQ ID NO: 499407 - DNA, 20 bp, Artificial Sequence
  chemically synthesized
aacggtccttaggggatggt

SEQ ID NO: 499408 - DNA, 20 bp, Artificial Sequence
  chemically synthesized
aggggatggtgtgggtggcc

SEQ ID NO: 499409 - DNA, 20 bp, Artificial Sequence
  chemically synthesized
cagagggggaagaacttccc

SEQ ID NO: 499410 - DNA, 20 bp, Artificial Sequence
  chemically synthesized
ggggaagaacttcccaagag

SEQ ID NO: 499411 - DNA, 20 bp, Artificial Sequence
  chemically synthesized
tcagtttcattaccatcttt

SEQ ID NO: 499412 - DNA, 20 bp, Artificial Sequence
  chemically synthesized
ggtaatgaaactgacatcat

SEQ ID NO: 499413 - DNA, 20 bp, Artificial Sequence
  chemically synthesized
aaataaattaacaaaaatat

SEQ ID NO: 499414 - DNA, 20 bp, Artificial Sequence
  chemically synthesized
ttttgttaatttattttaga

SEQ ID NO: 499415 - DNA, 20 bp, Artificial Sequence
  chemically synthesized
ttgtgccactgtactacagc

SEQ ID NO: 499416 - DNA, 20 bp, Artificial Sequence
  chemically synthesized
aatcatggctcgtggcagcc

SEQ ID NO: 499417 - DNA, 20 bp, Artificial Sequence
  chemically synthesized
caggagggtcacttgagccc

SEQ ID NO: 499418 - DNA, 20 bp, Artificial Sequence
  chemically synthesized
gctttgggaggctgaggcag

SEQ ID NO: 499419 - DNA, 20 bp, Artificial Sequence
  chemically synthesized
gcctcagcctcccaaagcac

SEQ ID NO: 499420 - DNA, 20 bp, Artificial Sequence
  chemically synthesized
ttgtatttgtagcatataca

SEQ ID NO: 499421 - DNA, 20 bp, Artificial Sequence
  chemically synthesized
gtagcatatacacagagtgg

SEQ ID NO: 499422 - DNA, 20 bp, Artificial Sequence
  chemically synthesized
tgcctttatcaagcctggct

SEQ ID NO: 499423 - DNA, 20 bp, Artificial Sequence
  chemically synthesized
ccttgctctgtcacccaggc

SEQ ID NO: 499424 - DNA, 20 bp, Artificial Sequence
  chemically synthesized
atccaccactgcattccagc

SEQ ID NO: 499425 - DNA, 20 bp, Artificial Sequence
  chemically synthesized
acccaggctggaatgcagtg

SEQ ID NO: 499426 - DNA, 20 bp, Artificial Sequence
  chemically synthesized
ctcactgcagcctctgcctc

SEQ ID NO: 499427 - DNA, 20 bp, Artificial Sequence
  chemically synthesized
gcctctgcctcctgggttca

SEQ ID NO: 499428 - DNA, 20 bp, Artificial Sequence
  chemically synthesized
tactcgggaggctgaggcag

SEQ ID NO: 499429 - DNA, 20 bp, Artificial Sequence
  chemically synthesized
gattctcctgcctcagcctc

SEQ ID NO: 499430 - DNA, 20 bp, Artificial Sequence
  chemically synthesized
cgggcacatcatttgaggtc

SEQ ID NO: 499431 - DNA, 20 bp, Artificial Sequence
  chemically synthesized
gccttggactcccaaagtgc

SEQ ID NO: 499432 - DNA, 20 bp, Artificial Sequence
  chemically synthesized
gtctgtaatcccagcacttt

SEQ ID NO: 499433 - DNA, 20 bp, Artificial Sequence
  chemically synthesized
aacctgagaatatttcccct

SEQ ID NO: 499434 - DNA, 20 bp, Artificial Sequence
  chemically synthesized
aagcctcctctccgaaacct

SEQ ID NO: 499435 - DNA, 20 bp, Artificial Sequence
  chemically synthesized
tcaggtttcggagaggaggc

SEQ ID NO: 499436 - DNA, 20 bp, Artificial Sequence
  chemically synthesized
gatatagtgctgagcacaaa

SEQ ID NO: 499437 - DNA, 20 bp, Artificial Sequence
  chemically synthesized
cagacttggtggctaccgtg

SEQ ID NO: 499438 - DNA, 20 bp, Artificial Sequence
  chemically synthesized
cgctcctaacatctggaaac

SEQ ID NO: 499439 - DNA, 20 bp, Artificial Sequence
  chemically synthesized
ttaggagcgactaatagttt

SEQ ID NO: 499440 - DNA, 20 bp, Artificial Sequence
  chemically synthesized
tgaagaacaggcaggtcaga

SEQ ID NO: 499441 - DNA, 20 bp, Artificial Sequence
  chemically synthesized
cagataattttgcacaatta

SEQ ID NO: 499442 - DNA, 20 bp, Artificial Sequence
  chemically synthesized
attttgcacaattaaggagt

SEQ ID NO: 499443 - DNA, 20 bp, Artificial Sequence
  chemically synthesized
agtcagggtttcattctcaa

SEQ ID NO: 499444 - DNA, 20 bp, Artificial Sequence
  chemically synthesized
tactataatctcattccctt

SEQ ID NO: 499445 - DNA, 20 bp, Artificial Sequence
  chemically synthesized
agtaaaccaagaactaaaat

SEQ ID NO: 499446 - DNA, 20 bp, Artificial Sequence
  chemically synthesized
aggttccctataattattag

SEQ ID NO: 499447 - DNA, 20 bp, Artificial Sequence
  chemically synthesized
cgaatgatttgatttcctct

SEQ ID NO: 499448 - DNA, 20 bp, Artificial Sequence
  chemically synthesized
ataattaagaagcctacctt

SEQ ID NO: 499449 - DNA, 20 bp, Artificial Sequence
  chemically synthesized
tgaggataaagacttctgaa

SEQ ID NO: 499450 - DNA, 20 bp, Artificial Sequence
  chemically synthesized
taatctaaaaatgtaaaaga

SEQ ID NO: 499451 - DNA, 20 bp, Artificial Sequence
  chemically synthesized
ttagcttcacatcacaagaa

SEQ ID NO: 499452 - DNA, 20 bp, Artificial Sequence
  chemically synthesized
tgtgaagctaaataatgtaa

SEQ ID NO: 499453 - DNA, 20 bp, Artificial Sequence
  chemically synthesized
tttagctgttgacttaattg

SEQ ID NO: 499454 - DNA, 20 bp, Artificial Sequence
  chemically synthesized
ccacatttttttttgccatg

SEQ ID NO: 499455 - DNA, 20 bp, Artificial Sequence
  chemically synthesized
tggcaaaaaaaaatgtgggg

SEQ ID NO: 499456 - DNA, 20 bp, Artificial Sequence
  chemically synthesized
tttcatttatttatattttg

SEQ ID NO: 499457 - DNA, 20 bp, Artificial Sequence
  chemically synthesized
atctgtatctacaaatttat

SEQ ID NO: 499458 - DNA, 20 bp, Artificial Sequence
  chemically synthesized
acataacgctaaatttaata

SEQ ID NO: 499459 - DNA, 20 bp, Artificial Sequence
  chemically synthesized
ctacagttcagctcatttgt

SEQ ID NO: 499460 - DNA, 20 bp, Artificial Sequence
  chemically synthesized
tttacttaccatttttcaat

SEQ ID NO: 499461 - DNA, 20 bp, Artificial Sequence
  chemically synthesized
ttccctgtcttttttccatg

SEQ ID NO: 499462 - DNA, 20 bp, Artificial Sequence
  chemically synthesized
gatttgttttcagggaactg

SEQ ID NO: 499463 - DNA, 20 bp, Artificial Sequence
  chemically synthesized
caaaatgtacaaggaccgac

SEQ ID NO: 499464 - DNA, 20 bp, Artificial Sequence
  chemically synthesized
caaagtgcaacgcctgtgga

SEQ ID NO: 499465 - DNA, 20 bp, Artificial Sequence
  chemically synthesized
aatgctgctgtcttcttgct

SEQ ID NO: 499466 - DNA, 20 bp, Artificial Sequence
  chemically synthesized
agtctacaacaaagctcagg

SEQ ID NO: 499467 - DNA, 20 bp, Artificial Sequence
  chemically synthesized
gttttaaaatttttatatta

SEQ ID NO: 499468 - DNA, 20 bp, Artificial Sequence
  chemically synthesized
aattttaaaacagtaaaaaa

SEQ ID NO: 499469 - DNA, 20 bp, Artificial Sequence
  chemically synthesized
gcaacaccatttgctacctt

SEQ ID NO: 499470 - DNA, 20 bp, Artificial Sequence
  chemically synthesized
actttaaaaagtcaataatt

SEQ ID NO: 499471 - DNA, 20 bp, Artificial Sequence
  chemically synthesized
tgaggtctgtgatttaccta

SEQ ID NO: 499472 - DNA, 20 bp, Artificial Sequence
  chemically synthesized
aatcacagacctcatcctga

SEQ ID NO: 499473 - DNA, 20 bp, Artificial Sequence
  chemically synthesized
acagacctcatcctgagaga

SEQ ID NO: 499474 - DNA, 20 bp, Artificial Sequence
  chemically synthesized
tagggagcgatccactctct

SEQ ID NO: 499475 - DNA, 20 bp, Artificial Sequence
  chemically synthesized
caaaggaaagcagaagaggt

SEQ ID NO: 499476 - DNA, 20 bp, Artificial Sequence
  chemically synthesized
acctcttctgctttcctttg

SEQ ID NO: 499477 - DNA, 20 bp, Artificial Sequence
  chemically synthesized
aatattaagatcaggatgag

SEQ ID NO: 499478 - DNA, 20 bp, Artificial Sequence
  chemically synthesized
gagcactctaatattaagat

SEQ ID NO: 499479 - DNA, 20 bp, Artificial Sequence
  chemically synthesized
tctcatcctgatcttaatat

SEQ ID NO: 499480 - DNA, 20 bp, Artificial Sequence
  chemically synthesized
gaagaaaagaagtgcaaata

SEQ ID NO: 499481 - DNA, 20 bp, Artificial Sequence
  chemically synthesized
aaattatgagaacaaatggg

SEQ ID NO: 499482 - DNA, 20 bp, Artificial Sequence
  chemically synthesized
tttaaaattatgagaacaaa

SEQ ID NO: 499483 - DNA, 20 bp, Artificial Sequence
  chemically synthesized
tccgggcttgagatacacat

SEQ ID NO: 499484 - DNA, 20 bp, Artificial Sequence
  chemically synthesized
gaaattagcatttgttagac

SEQ ID NO: 499485 - DNA, 20 bp, Artificial Sequence
  chemically synthesized
aaggattaggaaatgcagtt

SEQ ID NO: 499486 - DNA, 20 bp, Artificial Sequence
  chemically synthesized
gagggaatctatgggatgag

SEQ ID NO: 499487 - DNA, 20 bp, Artificial Sequence
  chemically synthesized
tactgaaatgagggaatcta

SEQ ID NO: 499488 - DNA, 20 bp, Artificial Sequence
  chemically synthesized
attgccatttactgaaatga

SEQ ID NO: 499489 - DNA, 20 bp, Artificial Sequence
  chemically synthesized
atggcaattactgatttcaa

SEQ ID NO: 499490 - DNA, 20 bp, Artificial Sequence
  chemically synthesized
tcaatctgagtaattgttaa

SEQ ID NO: 499491 - DNA, 20 bp, Artificial Sequence
  chemically synthesized
atggctccaaagttgtcaat

SEQ ID NO: 499492 - DNA, 20 bp, Artificial Sequence
  chemically synthesized
tactggagactgaaaaaatt

SEQ ID NO: 499493 - DNA, 20 bp, Artificial Sequence
  chemically synthesized
caaaacatttgcccaataat

SEQ ID NO: 499494 - DNA, 20 bp, Artificial Sequence
  chemically synthesized
cttgactttcaggacatatg

SEQ ID NO: 499495 - DNA, 20 bp, Artificial Sequence
  chemically synthesized
aagctattattgtctctcat

SEQ ID NO: 499496 - DNA, 20 bp, Artificial Sequence
  chemically synthesized
cttccgctctttccccccta

SEQ ID NO: 499497 - DNA, 20 bp, Artificial Sequence
  chemically synthesized
atcttttcggctcttgtgtg

SEQ ID NO: 499498 - DNA, 20 bp, Artificial Sequence
  chemically synthesized
tgatcccaattatgttttaa

SEQ ID NO: 499499 - DNA, 20 bp, Artificial Sequence
  chemically synthesized
agattcttttaaaacataat

SEQ ID NO: 499500 - DNA, 20 bp, Artificial Sequence
  chemically synthesized
caccagaagattttgagcag

SEQ ID NO: 499501 - DNA, 20 bp, Artificial Sequence
  chemically synthesized
cttctggtggctcttcatca

SEQ ID NO: 499502 - DNA, 20 bp, Artificial Sequence
  chemically synthesized
ttatttgtataaagtgttgc

SEQ ID NO: 499503 - DNA, 20 bp, Artificial Sequence
  chemically synthesized
gtctcccatttttactaaag

SEQ ID NO: 499504 - DNA, 20 bp, Artificial Sequence
  chemically synthesized
attagtctcgtcagctgttt

SEQ ID NO: 499505 - DNA, 20 bp, Artificial Sequence
  chemically synthesized
ggcaggttcacaggaataag

SEQ ID NO: 499506 - DNA, 20 bp, Artificial Sequence
  chemically synthesized
gagatcactggcaggttcac

SEQ ID NO: 499507 - DNA, 20 bp, Artificial Sequence
  chemically synthesized
tgcacctcagaagaaacaag

SEQ ID NO: 499508 - DNA, 20 bp, Artificial Sequence
  chemically synthesized
cctcagaagaaacaagaagg

SEQ ID NO: 499509 - DNA, 20 bp, Artificial Sequence
  chemically synthesized
aggatgggtaatataaaaac

SEQ ID NO: 499510 - DNA, 20 bp, Artificial Sequence
  chemically synthesized
ttccaatacatgcccagaat

SEQ ID NO: 499511 - DNA, 20 bp, Artificial Sequence
  chemically synthesized
agctgattccaatacatgcc

SEQ ID NO: 499512 - DNA, 20 bp, Artificial Sequence
  chemically synthesized
ttctaattctgggcatgtat

SEQ ID NO: 499513 - DNA, 20 bp, Artificial Sequence
  chemically synthesized
gccttctaatttagtttact

SEQ ID NO: 499514 - DNA, 20 bp, Artificial Sequence
  chemically synthesized
cttattgtgttttactgttg

SEQ ID NO: 499515 - DNA, 20 bp, Artificial Sequence
  chemically synthesized
tgctgttttactttttgtat

SEQ ID NO: 499516 - DNA, 20 bp, Artificial Sequence
  chemically synthesized
ttactttttgtataggaatg

SEQ ID NO: 499517 - DNA, 20 bp, Artificial Sequence
  chemically synthesized
gttttcaatctaagaaaaca

SEQ ID NO: 499518 - DNA, 20 bp, Artificial Sequence
  chemically synthesized
gatatcaccatttatcagtt

SEQ ID NO: 499519 - DNA, 20 bp, Artificial Sequence
  chemically synthesized
tgactgagctcctctctacc

SEQ ID NO: 499520 - DNA, 20 bp, Artificial Sequence
  chemically synthesized
ctattagggtctcttgtatt

SEQ ID NO: 499521 - DNA, 20 bp, Artificial Sequence
  chemically synthesized
tgatatttctgcctaactat

SEQ ID NO: 499522 - DNA, 20 bp, Artificial Sequence
  chemically synthesized
gtaacttcttcaggctgaat

SEQ ID NO: 499523 - DNA, 20 bp, Artificial Sequence
  chemically synthesized
tcttctgtaacttcttcagg

SEQ ID NO: 499524 - DNA, 20 bp, Artificial Sequence
  chemically synthesized
cccttaggattaagtagtag

SEQ ID NO: 499525 - DNA, 20 bp, Artificial Sequence
  chemically synthesized
cccttctactacttaatcct

SEQ ID NO: 499526 - DNA, 20 bp, Artificial Sequence
  chemically synthesized
aagggtagtagagttaccct

SEQ ID NO: 499527 - DNA, 20 bp, Artificial Sequence
  chemically synthesized
aagggtaactctactaccct

SEQ ID NO: 499528 - DNA, 20 bp, Artificial Sequence
  chemically synthesized
acccttaatcctaagggtag

SEQ ID NO: 499529 - DNA, 20 bp, Artificial Sequence
  chemically synthesized
actctactacccttaggatt

SEQ ID NO: 499530 - DNA, 20 bp, Artificial Sequence
  chemically synthesized
acaagggaacccttaatcct

SEQ ID NO: 499531 - DNA, 20 bp, Artificial Sequence
  chemically synthesized
cgaactagaacaactccatc

SEQ ID NO: 499532 - DNA, 20 bp, Artificial Sequence
  chemically synthesized
tacccagcccctattcaaga

SEQ ID NO: 499533 - DNA, 20 bp, Artificial Sequence
  chemically synthesized
aactccatcttgaatagggg

SEQ ID NO: 499534 - DNA, 20 bp, Artificial Sequence
  chemically synthesized
ctaagaatgcccaacctcct

SEQ ID NO: 499535 - DNA, 20 bp, Artificial Sequence
  chemically synthesized
aggttgggcattcttagtca

SEQ ID NO: 499536 - DNA, 20 bp, Artificial Sequence
  chemically synthesized
tcttatctcatcctgtgact

SEQ ID NO: 499537 - DNA, 20 bp, Artificial Sequence
  chemically synthesized
ataagaggccagaacaagat

SEQ ID NO: 499538 - DNA, 20 bp, Artificial Sequence
  chemically synthesized
ttttcaccagcttggttttg

SEQ ID NO: 499539 - DNA, 20 bp, Artificial Sequence
  chemically synthesized
taacctgtcatggcactgct

SEQ ID NO: 499540 - DNA, 20 bp, Artificial Sequence
  chemically synthesized
ttctcccattttagaccata

SEQ ID NO: 499541 - DNA, 20 bp, Artificial Sequence
  chemically synthesized
tgggagaaaccctcagttct

SEQ ID NO: 499542 - DNA, 20 bp, Artificial Sequence
  chemically synthesized
agtcagcaattcctagaact

SEQ ID NO: 499543 - DNA, 20 bp, Artificial Sequence
  chemically synthesized
ttcatgagttttctgggaaa

SEQ ID NO: 499544 - DNA, 20 bp, Artificial Sequence
  chemically synthesized
ctccttttcccagaaaactc

SEQ ID NO: 499545 - DNA, 20 bp, Artificial Sequence
  chemically synthesized
aaacaaggggtggattattc

SEQ ID NO: 499546 - DNA, 20 bp, Artificial Sequence
  chemically synthesized
gattatatgctaaacaaggg

SEQ ID NO: 499547 - DNA, 20 bp, Artificial Sequence
  chemically synthesized
tcttgattatatgctaaaca

SEQ ID NO: 499548 - DNA, 20 bp, Artificial Sequence
  chemically synthesized
aagaaataactacaagtatc

SEQ ID NO: 499549 - DNA, 20 bp, Artificial Sequence
  chemically synthesized
gtggcatgggctgcttgact

SEQ ID NO: 499550 - DNA, 20 bp, Artificial Sequence
  chemically synthesized
ccatgccactgcactgccta

SEQ ID NO: 499551 - DNA, 20 bp, Artificial Sequence
  chemically synthesized
attaagaaagtaaaggaata

SEQ ID NO: 499552 - DNA, 20 bp, Artificial Sequence
  chemically synthesized
caagtttattaagaaagtaa

SEQ ID NO: 499553 - DNA, 20 bp, Artificial Sequence
  chemically synthesized
agactgggaagagatgagct

SEQ ID NO: 499554 - DNA, 20 bp, Artificial Sequence
  chemically synthesized
agtaatgcaataaacctaat

SEQ ID NO: 499555 - DNA, 20 bp, Artificial Sequence
  chemically synthesized
cattaggtttattgcattac

SEQ ID NO: 499556 - DNA, 20 bp, Artificial Sequence
  chemically synthesized
aagggcagaaatcttgaagc

SEQ ID NO: 499557 - DNA, 20 bp, Artificial Sequence
  chemically synthesized
agggaaccactgatagaaat

SEQ ID NO: 499558 - DNA, 20 bp, Artificial Sequence
  chemically synthesized
attgctggtgctatttaaaa

SEQ ID NO: 499559 - DNA, 20 bp, Artificial Sequence
  chemically synthesized
gaagagtaatgccaggaata

SEQ ID NO: 499560 - DNA, 20 bp, Artificial Sequence
  chemically synthesized
gaaaagggaagagtaatgcc

SEQ ID NO: 499561 - DNA, 20 bp, Artificial Sequence
  chemically synthesized
aagtactataaagaaaaggg

SEQ ID NO: 499562 - DNA, 20 bp, Artificial Sequence
  chemically synthesized
aatttgaaatctatgactac

SEQ ID NO: 499563 - DNA, 20 bp, Artificial Sequence
  chemically synthesized
agatggcaaaagcttttttg

SEQ ID NO: 499564 - DNA, 20 bp, Artificial Sequence
  chemically synthesized
aaagcttttttgttgaataa

SEQ ID NO: 499565 - DNA, 20 bp, Artificial Sequence
  chemically synthesized
tagaatataaacaaaacatt

SEQ ID NO: 499566 - DNA, 20 bp, Artificial Sequence
  chemically synthesized
tttgtgatttttccgttaaa

SEQ ID NO: 499567 - DNA, 20 bp, Artificial Sequence
  chemically synthesized
ggaaaaatcacaaaccacaa

SEQ ID NO: 499568 - DNA, 20 bp, Artificial Sequence
  chemically synthesized
tagtttttagcaaatttatt

SEQ ID NO: 499569 - DNA, 20 bp, Artificial Sequence
  chemically synthesized
ttcgtactaggaagaatagc

SEQ ID NO: 499570 - DNA, 20 bp, Artificial Sequence
  chemically synthesized
ttctggctattcttcctagt

SEQ ID NO: 499571 - DNA, 20 bp, Artificial Sequence
  chemically synthesized
ataacaaaattcgtactagg

SEQ ID NO: 499572 - DNA, 20 bp, Artificial Sequence
  chemically synthesized
ggtccactgagcaaaattta

SEQ ID NO: 499573 - DNA, 20 bp, Artificial Sequence
  chemically synthesized
gcaatatagcagaaacaaag

SEQ ID NO: 499574 - DNA, 20 bp, Artificial Sequence
  chemically synthesized
gttttattgtagtagtaaga

SEQ ID NO: 499575 - DNA, 20 bp, Artificial Sequence
  chemically synthesized
gtaagaaaggatatggtttg

SEQ ID NO: 499576 - DNA, 20 bp, Artificial Sequence
  chemically synthesized
tccagctaaggcttctatac

SEQ ID NO: 499577 - DNA, 20 bp, Artificial Sequence
  chemically synthesized
tccaagtatagaagccttag

SEQ ID NO: 499578 - DNA, 20 bp, Artificial Sequence
  chemically synthesized
tggatgagaagaaggaagaa

SEQ ID NO: 499579 - DNA, 20 bp, Artificial Sequence
  chemically synthesized
atttggtcataggctcagga

SEQ ID NO: 499580 - DNA, 20 bp, Artificial Sequence
  chemically synthesized
ctgcaatttgcaccttcttc

SEQ ID NO: 499581 - DNA, 20 bp, Artificial Sequence
  chemically synthesized
gcaaattgcagtagacatat

SEQ ID NO: 499582 - DNA, 20 bp, Artificial Sequence
  chemically synthesized
tggggcatgaaacagaggct

SEQ ID NO: 499583 - DNA, 20 bp, Artificial Sequence
  chemically synthesized
aggatgttcaataatgtgct

SEQ ID NO: 499584 - DNA, 20 bp, Artificial Sequence
  chemically synthesized
attagctactgaagtacagg

SEQ ID NO: 499585 - DNA, 20 bp, Artificial Sequence
  chemically synthesized
taacagttggcactggatta

SEQ ID NO: 499586 - DNA, 20 bp, Artificial Sequence
  chemically synthesized
tggagtcataacagttggca

SEQ ID NO: 499587 - DNA, 20 bp, Artificial Sequence
  chemically synthesized
gtgagtgggtggattgtcca

SEQ ID NO: 499588 - DNA, 20 bp, Artificial Sequence
  chemically synthesized
ctagttgaagaggtgagtgg

SEQ ID NO: 499589 - DNA, 20 bp, Artificial Sequence
  chemically synthesized
taatctagttgaagaggtga

SEQ ID NO: 499590 - DNA, 20 bp, Artificial Sequence
  chemically synthesized
agaataatctagttgaagag

SEQ ID NO: 499591 - DNA, 20 bp, Artificial Sequence
  chemically synthesized
aataatatatcagtttgttt

SEQ ID NO: 499592 - DNA, 20 bp, Artificial Sequence
  chemically synthesized
tccgaaaaaagttctcatga

SEQ ID NO: 499593 - DNA, 20 bp, Artificial Sequence
  chemically synthesized
tcttaacaaaagttcattaa

SEQ ID NO: 499594 - DNA, 20 bp, Artificial Sequence
  chemically synthesized
cttcccacttcagctcaaat

SEQ ID NO: 499595 - DNA, 20 bp, Artificial Sequence
  chemically synthesized
agtttaggaaaacagctcag

SEQ ID NO: 499596 - DNA, 20 bp, Artificial Sequence
  chemically synthesized
cttcacccaacacacagtca

SEQ ID NO: 499597 - DNA, 20 bp, Artificial Sequence
  chemically synthesized
cagaattcagtgactgtgtg

SEQ ID NO: 499598 - DNA, 20 bp, Artificial Sequence
  chemically synthesized
gggtgaagaagaggaagaac

SEQ ID NO: 499599 - DNA, 20 bp, Artificial Sequence
  chemically synthesized
gaagaagaggaagaacttga

SEQ ID NO: 499600 - DNA, 20 bp, Artificial Sequence
  chemically synthesized
ccaatgacaccacaaatcat

SEQ ID NO: 499601 - DNA, 20 bp, Artificial Sequence
  chemically synthesized
ccacatgatttgtggtgtca

SEQ ID NO: 499602 - DNA, 20 bp, Artificial Sequence
  chemically synthesized
tttgtggtgtcattgggtaa

SEQ ID NO: 499603 - DNA, 20 bp, Artificial Sequence
  chemically synthesized
ttgatgcctcaaaggctttt

SEQ ID NO: 499604 - DNA, 20 bp, Artificial Sequence
  chemically synthesized
tgaaatcagattttgagaag

SEQ ID NO: 499605 - DNA, 20 bp, Artificial Sequence
  chemically synthesized
gagaagaggagtaagatggc

SEQ ID NO: 499606 - DNA, 20 bp, Artificial Sequence
  chemically synthesized
agccatacatattttcacat

SEQ ID NO: 499607 - DNA, 20 bp, Artificial Sequence
  chemically synthesized
tggactaggctttctgagca

SEQ ID NO: 499608 - DNA, 20 bp, Artificial Sequence
  chemically synthesized
gagttgtagtaactgtctta

SEQ ID NO: 499609 - DNA, 20 bp, Artificial Sequence
  chemically synthesized
gtaactgtcttaaagggtga

SEQ ID NO: 499610 - DNA, 20 bp, Artificial Sequence
  chemically synthesized
actgaatggcaagcgtacct

SEQ ID NO: 499611 - DNA, 20 bp, Artificial Sequence
  chemically synthesized
tgatctaggtctattatttt

SEQ ID NO: 499612 - DNA, 20 bp, Artificial Sequence
  chemically synthesized
atctccaagatccacaattc

SEQ ID NO: 499613 - DNA, 20 bp, Artificial Sequence
  chemically synthesized
aggagagaaatcccagaatt

SEQ ID NO: 499614 - DNA, 20 bp, Artificial Sequence
  chemically synthesized
gtagtacaggagagaaatcc

SEQ ID NO: 499615 - DNA, 20 bp, Artificial Sequence
  chemically synthesized
agatgtttatctgtgagtgc

SEQ ID NO: 499616 - DNA, 20 bp, Artificial Sequence
  chemically synthesized
tcagggcaagatgtttatct

SEQ ID NO: 499617 - DNA, 20 bp, Artificial Sequence
  chemically synthesized
catcttgccctgagatgctt

SEQ ID NO: 499618 - DNA, 20 bp, Artificial Sequence
  chemically synthesized
aacataagatctctggatga

SEQ ID NO: 499619 - DNA, 20 bp, Artificial Sequence
  chemically synthesized
agtcaggaaacataagatct

SEQ ID NO: 499620 - DNA, 20 bp, Artificial Sequence
  chemically synthesized
ttttaacaaatatcaacaaa

SEQ ID NO: 499621 - DNA, 20 bp, Artificial Sequence
  chemically synthesized
catctcaaaaaaaaaaaaaa

SEQ ID NO: 499622 - DNA, 20 bp, Artificial Sequence
  chemically synthesized
ttttttttttttttttgaga

SEQ ID NO: 499623 - DNA, 20 bp, Artificial Sequence
  chemically synthesized
tctagctctgtcacccaggc

SEQ ID NO: 499624 - DNA, 20 bp, Artificial Sequence
  chemically synthesized
tcagaccactgcactccagc

SEQ ID NO: 499625 - DNA, 20 bp, Artificial Sequence
  chemically synthesized
ctcactgcaagctccgcctc

SEQ ID NO: 499626 - DNA, 20 bp, Artificial Sequence
  chemically synthesized
tcgggaggaggctgaggcaa

SEQ ID NO: 499627 - DNA, 20 bp, Artificial Sequence
  chemically synthesized
tctcttgcctcagcctcctc

SEQ ID NO: 499628 - DNA, 20 bp, Artificial Sequence
  chemically synthesized
ttttgtatctttagtagaga

SEQ ID NO: 499629 - DNA, 20 bp, Artificial Sequence
  chemically synthesized
cggggtttcaccgtgttagc

SEQ ID NO: 499630 - DNA, 20 bp, Artificial Sequence
  chemically synthesized
gttttgggaggctgaggcgg

SEQ ID NO: 499631 - DNA, 20 bp, Artificial Sequence
  chemically synthesized
ctttgttttgggaggctgag

SEQ ID NO: 499632 - DNA, 20 bp, Artificial Sequence
  chemically synthesized
cctcagcctcccaaaacaaa

SEQ ID NO: 499633 - DNA, 20 bp, Artificial Sequence
  chemically synthesized
aattttgactgaaaataggc

SEQ ID NO: 499634 - DNA, 20 bp, Artificial Sequence
  chemically synthesized
gttggagactgtgttagata

SEQ ID NO: 499635 - DNA, 20 bp, Artificial Sequence
  chemically synthesized
gaagttaacaataaaactta

SEQ ID NO: 499636 - DNA, 20 bp, Artificial Sequence
  chemically synthesized
ggaccacaaacgtgaaatct

SEQ ID NO: 499637 - DNA, 20 bp, Artificial Sequence
  chemically synthesized
cttatttatcagctcagcaa

SEQ ID NO: 499638 - DNA, 20 bp, Artificial Sequence
  chemically synthesized
caggataagatacaatggtt

SEQ ID NO: 499639 - DNA, 20 bp, Artificial Sequence
  chemically synthesized
atacaatggttatgggtgat

SEQ ID NO: 499640 - DNA, 20 bp, Artificial Sequence
  chemically synthesized
aatggttatgggtgatgtga

SEQ ID NO: 499641 - DNA, 20 bp, Artificial Sequence
  chemically synthesized
aaggtgtacatagactggaa

SEQ ID NO: 499642 - DNA, 20 bp, Artificial Sequence
  chemically synthesized
tcagataagtactttttcca

SEQ ID NO: 499643 - DNA, 20 bp, Artificial Sequence
  chemically synthesized
agccaacacagaaacaatct

SEQ ID NO: 499644 - DNA, 20 bp, Artificial Sequence
  chemically synthesized
ctgagaatttacttatctgg

SEQ ID NO: 499645 - DNA, 20 bp, Artificial Sequence
  chemically synthesized
tcttttagcaatttcacata

SEQ ID NO: 499646 - DNA, 20 bp, Artificial Sequence
  chemically synthesized
catagagaattgatagtcat

SEQ ID NO: 499647 - DNA, 20 bp, Artificial Sequence
  chemically synthesized
tcattggaatgtgtgtgatg

SEQ ID NO: 499648 - DNA, 20 bp, Artificial Sequence
  chemically synthesized
gtgtgatgttgaataagact

SEQ ID NO: 499649 - DNA, 20 bp, Artificial Sequence
  chemically synthesized
gattgctcaggaaaggtgtt

SEQ ID NO: 499650 - DNA, 20 bp, Artificial Sequence
  chemically synthesized
ggaaaggtgtttagggtgaa

SEQ ID NO: 499651 - DNA, 20 bp, Artificial Sequence
  chemically synthesized
agcatgggcagaggaaggag

SEQ ID NO: 499652 - DNA, 20 bp, Artificial Sequence
  chemically synthesized
gaaggagatgagtatcccta

SEQ ID NO: 499653 - DNA, 20 bp, Artificial Sequence
  chemically synthesized
tctgatgactattattcttt

SEQ ID NO: 499654 - DNA, 20 bp, Artificial Sequence
  chemically synthesized
ccctccttctggttctcttc

SEQ ID NO: 499655 - DNA, 20 bp, Artificial Sequence
  chemically synthesized
aagagaaccagaaggaggga

SEQ ID NO: 499656 - DNA, 20 bp, Artificial Sequence
  chemically synthesized
ccaacagtttctgttttatt

SEQ ID NO: 499657 - DNA, 20 bp, Artificial Sequence
  chemically synthesized
tcataataaaacagaaactg

SEQ ID NO: 499658 - DNA, 20 bp, Artificial Sequence
  chemically synthesized
ttggatactatgctcactgc

SEQ ID NO: 499659 - DNA, 20 bp, Artificial Sequence
  chemically synthesized
tatgctcactgcctgggtga

SEQ ID NO: 499660 - DNA, 20 bp, Artificial Sequence
  chemically synthesized
ttgatgctgagatttgggat

SEQ ID NO: 499661 - DNA, 20 bp, Artificial Sequence
  chemically synthesized
tattgtttgatgctgagatt

SEQ ID NO: 499662 - DNA, 20 bp, Artificial Sequence
  chemically synthesized
tacatgtgcaggtttgttac

SEQ ID NO: 499663 - DNA, 20 bp, Artificial Sequence
  chemically synthesized
acaaacctgcacatgtattc

SEQ ID NO: 499664 - DNA, 20 bp, Artificial Sequence
  chemically synthesized
ttcaagtgtattttagattc

SEQ ID NO: 499665 - DNA, 20 bp, Artificial Sequence
  chemically synthesized
attataataaaagagataca

SEQ ID NO: 499666 - DNA, 20 bp, Artificial Sequence
  chemically synthesized
aaataatactagagatacgc

SEQ ID NO: 499667 - DNA, 20 bp, Artificial Sequence
  chemically synthesized
ctttacttttatttacctgg

SEQ ID NO: 499668 - DNA, 20 bp, Artificial Sequence
  chemically synthesized
tcttctgatggctccaagcc

SEQ ID NO: 499669 - DNA, 20 bp, Artificial Sequence
  chemically synthesized
atggctccaagcctggagtc

SEQ ID NO: 499670 - DNA, 20 bp, Artificial Sequence
  chemically synthesized
tccaagcctggagtcttggg

SEQ ID NO: 499671 - DNA, 20 bp, Artificial Sequence
  chemically synthesized
acctgacctaatcaggctag

SEQ ID NO: 499672 - DNA, 20 bp, Artificial Sequence
  chemically synthesized
cacaagtacttgattcaact

SEQ ID NO: 499673 - DNA, 20 bp, Artificial Sequence
  chemically synthesized
tgacttaaaagaattcagag

SEQ ID NO: 499674 - DNA, 20 bp, Artificial Sequence
  chemically synthesized
gacagtgacttaaaagaatt

SEQ ID NO: 499675 - DNA, 20 bp, Artificial Sequence
  chemically synthesized
tgatggagacagtgacttaa

SEQ ID NO: 499676 - DNA, 20 bp, Artificial Sequence
  chemically synthesized
cattggactggcagccaagc

SEQ ID NO: 499677 - DNA, 20 bp, Artificial Sequence
  chemically synthesized
gtatcaggtggaggacttgg

SEQ ID NO: 499678 - DNA, 20 bp, Artificial Sequence
  chemically synthesized
acctgataccaagactccag

SEQ ID NO: 499679 - DNA, 20 bp, Artificial Sequence
  chemically synthesized
taatcagcctttcattcagc

SEQ ID NO: 499680 - DNA, 20 bp, Artificial Sequence
  chemically synthesized
aatgtgattggttgcccaat

SEQ ID NO: 499681 - DNA, 20 bp, Artificial Sequence
  chemically synthesized
tgcttacagctatgcattta

SEQ ID NO: 499682 - DNA, 20 bp, Artificial Sequence
  chemically synthesized
tcccttgaatgtttttctcc

SEQ ID NO: 499683 - DNA, 20 bp, Artificial Sequence
  chemically synthesized
aagatcctttatctcttccc

SEQ ID NO: 499684 - DNA, 20 bp, Artificial Sequence
  chemically synthesized
aacattcaagggaagagata

SEQ ID NO: 499685 - DNA, 20 bp, Artificial Sequence
  chemically synthesized
ataccatatcaaagccataa

SEQ ID NO: 499686 - DNA, 20 bp, Artificial Sequence
  chemically synthesized
tgtgtgtatgtatactctct

SEQ ID NO: 499687 - DNA, 20 bp, Artificial Sequence
  chemically synthesized
tttgcaagctcaaatcctca

SEQ ID NO: 499688 - DNA, 20 bp, Artificial Sequence
  chemically synthesized
caaagcttcctgattttaat

SEQ ID NO: 499689 - DNA, 20 bp, Artificial Sequence
  chemically synthesized
ctggggagctaccaattctt

SEQ ID NO: 499690 - DNA, 20 bp, Artificial Sequence
  chemically synthesized
agcaatgctacagcattcca

SEQ ID NO: 499691 - DNA, 20 bp, Artificial Sequence
  chemically synthesized
aaaaagcaaaaactggggca

SEQ ID NO: 499692 - DNA, 20 bp, Artificial Sequence
  chemically synthesized
ggcaggggatgtcacactcc

SEQ ID NO: 499693 - DNA, 20 bp, Artificial Sequence
  chemically synthesized
agctattatctagatatcca

SEQ ID NO: 499694 - DNA, 20 bp, Artificial Sequence
  chemically synthesized
agctccttggtgcattctca

SEQ ID NO: 499695 - DNA, 20 bp, Artificial Sequence
  chemically synthesized
caattttgacagcattctct

SEQ ID NO: 499696 - DNA, 20 bp, Artificial Sequence
  chemically synthesized
agaatgctgtcaaaattggc

SEQ ID NO: 499697 - DNA, 20 bp, Artificial Sequence
  chemically synthesized
atatgtgcagggactttaaa

SEQ ID NO: 499698 - DNA, 20 bp, Artificial Sequence
  chemically synthesized
gtgtgcagtgccttgaggac

SEQ ID NO: 499699 - DNA, 20 bp, Artificial Sequence
  chemically synthesized
ggactatggcttccttttta

SEQ ID NO: 499700 - DNA, 20 bp, Artificial Sequence
  chemically synthesized
tatggcgatataaacatccc

SEQ ID NO: 499701 - DNA, 20 bp, Artificial Sequence
  chemically synthesized
ctatattctatagtgattct

SEQ ID NO: 499702 - DNA, 20 bp, Artificial Sequence
  chemically synthesized
aaacatccctagaatcacta

SEQ ID NO: 499703 - DNA, 20 bp, Artificial Sequence
  chemically synthesized
tagcatttctatttctctcc

SEQ ID NO: 499704 - DNA, 20 bp, Artificial Sequence
  chemically synthesized
ggggcatgtcaaaattaaga

SEQ ID NO: 499705 - DNA, 20 bp, Artificial Sequence
  chemically synthesized
cttaattttgacatgcccct

SEQ ID NO: 499706 - DNA, 20 bp, Artificial Sequence
  chemically synthesized
aacatcttacagaatttcag

SEQ ID NO: 499707 - DNA, 20 bp, Artificial Sequence
  chemically synthesized
ggccaaaaataaacatctta

SEQ ID NO: 499708 - DNA, 20 bp, Artificial Sequence
  chemically synthesized
ttagaatttccttttgcaga

SEQ ID NO: 499709 - DNA, 20 bp, Artificial Sequence
  chemically synthesized
attccatttgtatgtatatt

SEQ ID NO: 499710 - DNA, 20 bp, Artificial Sequence
  chemically synthesized
attctaaatatacatacaaa

SEQ ID NO: 499711 - DNA, 20 bp, Artificial Sequence
  chemically synthesized
tttctgaaaggcatctgtac

SEQ ID NO: 499712 - DNA, 20 bp, Artificial Sequence
  chemically synthesized
tgtacacgaatttatacaac

SEQ ID NO: 499713 - DNA, 20 bp, Artificial Sequence
  chemically synthesized
tattttaaaatattaaggac

SEQ ID NO: 499714 - DNA, 20 bp, Artificial Sequence
  chemically synthesized
gagtccttaatattttaaaa

SEQ ID NO: 499715 - DNA, 20 bp, Artificial Sequence
  chemically synthesized
tctttaacttattggagact

SEQ ID NO: 499716 - DNA, 20 bp, Artificial Sequence
  chemically synthesized
ctctattcacagtgcataat

SEQ ID NO: 499717 - DNA, 20 bp, Artificial Sequence
  chemically synthesized
gaagaccctgattatgcact

SEQ ID NO: 499718 - DNA, 20 bp, Artificial Sequence
  chemically synthesized
cttttccttactttaggtat

SEQ ID NO: 499719 - DNA, 20 bp, Artificial Sequence
  chemically synthesized
taagcttttcaaacagataa

SEQ ID NO: 499720 - DNA, 20 bp, Artificial Sequence
  chemically synthesized
gaaaataaagactttaaaat

SEQ ID NO: 499721 - DNA, 20 bp, Artificial Sequence
  chemically synthesized
ctttgtttattcaagtgttg

SEQ ID NO: 499722 - DNA, 20 bp, Artificial Sequence
  chemically synthesized
agacacatactccacaacac

SEQ ID NO: 499723 - DNA, 20 bp, Artificial Sequence
  chemically synthesized
tgtggagtatgtgtctttaa

SEQ ID NO: 499724 - DNA, 20 bp, Artificial Sequence
  chemically synthesized
caggataaaaggagaagcca

SEQ ID NO: 499725 - DNA, 20 bp, Artificial Sequence
  chemically synthesized
ataaagaatggagcatagtt

SEQ ID NO: 499726 - DNA, 20 bp, Artificial Sequence
  chemically synthesized
atgctccattctttatcata

SEQ ID NO: 499727 - DNA, 20 bp, Artificial Sequence
  chemically synthesized
gaagtctatcccttatgata

SEQ ID NO: 499728 - DNA, 20 bp, Artificial Sequence
  chemically synthesized
atgaaaatctttgacagcaa

SEQ ID NO: 499729 - DNA, 20 bp, Artificial Sequence
  chemically synthesized
ttgcagaacctgaagagaac

SEQ ID NO: 499730 - DNA, 20 bp, Artificial Sequence
  chemically synthesized
tgaagagaactagagtaggg

SEQ ID NO: 499731 - DNA, 20 bp, Artificial Sequence
  chemically synthesized
atagcaaagctcgttgcttc

SEQ ID NO: 499732 - DNA, 20 bp, Artificial Sequence
  chemically synthesized
acctcggcctcccaaagtgc

SEQ ID NO: 499733 - DNA, 20 bp, Artificial Sequence
  chemically synthesized
actttgggaggccgaggtag

SEQ ID NO: 499734 - DNA, 20 bp, Artificial Sequence
  chemically synthesized
taggtggatcactttaggac

SEQ ID NO: 499735 - DNA, 20 bp, Artificial Sequence
  chemically synthesized
gtttgtatttttagtagaga

SEQ ID NO: 499736 - DNA, 20 bp, Artificial Sequence
  chemically synthesized
ggcgcccaccgccacacctg

SEQ ID NO: 499737 - DNA, 20 bp, Artificial Sequence
  chemically synthesized
accttagcctcccaagtagc

SEQ ID NO: 499738 - DNA, 20 bp, Artificial Sequence
  chemically synthesized
tacttgggaggctaaggtag

SEQ ID NO: 499739 - DNA, 20 bp, Artificial Sequence
  chemically synthesized
tcactgcaacctccgcttcc

SEQ ID NO: 499740 - DNA, 20 bp, Artificial Sequence
  chemically synthesized
ttcactcttgttgcccaggc

SEQ ID NO: 499741 - DNA, 20 bp, Artificial Sequence
  chemically synthesized
cgcactccagcctgggcaac

SEQ ID NO: 499742 - DNA, 20 bp, Artificial Sequence
  chemically synthesized
tgtttaattgtttattgaga

SEQ ID NO: 499743 - DNA, 20 bp, Artificial Sequence
  chemically synthesized
aagatgaagaaatggctgaa

SEQ ID NO: 499744 - DNA, 20 bp, Artificial Sequence
  chemically synthesized
tgttgaagatgaagaaatgg

SEQ ID NO: 499745 - DNA, 20 bp, Artificial Sequence
  chemically synthesized
tagacatccttatttagtaa

SEQ ID NO: 499746 - DNA, 20 bp, Artificial Sequence
  chemically synthesized
tcaacatccaattactaaat

SEQ ID NO: 499747 - DNA, 20 bp, Artificial Sequence
  chemically synthesized
atattatttaaaatcttgga

SEQ ID NO: 499748 - DNA, 20 bp, Artificial Sequence
  chemically synthesized
tttaaataatatgtccactg

SEQ ID NO: 499749 - DNA, 20 bp, Artificial Sequence
  chemically synthesized
aaaattttacatcagaagtt

SEQ ID NO: 499750 - DNA, 20 bp, Artificial Sequence
  chemically synthesized
aagttcaatatatttcaaac

SEQ ID NO: 499751 - DNA, 20 bp, Artificial Sequence
  chemically synthesized
aaataaatatggttaaaaat

SEQ ID NO: 499752 - DNA, 20 bp, Artificial Sequence
  chemically synthesized
ctattactaagtgagtgaat

SEQ ID NO: 499753 - DNA, 20 bp, Artificial Sequence
  chemically synthesized
gggaagctattactaagtga

SEQ ID NO: 499754 - DNA, 20 bp, Artificial Sequence
  chemically synthesized
aatggggaagctattactaa

SEQ ID NO: 499755 - DNA, 20 bp, Artificial Sequence
  chemically synthesized
tttcatctttccctccttgg

SEQ ID NO: 499756 - DNA, 20 bp, Artificial Sequence
  chemically synthesized
gaaaactgtgcctaactgta

SEQ ID NO: 499757 - DNA, 20 bp, Artificial Sequence
  chemically synthesized
aatatttcttgagttaatga

SEQ ID NO: 499758 - DNA, 20 bp, Artificial Sequence
  chemically synthesized
aacaaatatttcttgagtta

SEQ ID NO: 499759 - DNA, 20 bp, Artificial Sequence
  chemically synthesized
gttttttcaacaaatatttc

SEQ ID NO: 499760 - DNA, 20 bp, Artificial Sequence
  chemically synthesized
ttatttatttattttggaga

SEQ ID NO: 499761 - DNA, 20 bp, Artificial Sequence
  chemically synthesized
ctgcattccagcctgggtga

SEQ ID NO: 499762 - DNA, 20 bp, Artificial Sequence
  chemically synthesized
tctcactctgtcacccaggc

SEQ ID NO: 499763 - DNA, 20 bp, Artificial Sequence
  chemically synthesized
ttgcgccactgcattccagc

SEQ ID NO: 499764 - DNA, 20 bp, Artificial Sequence
  chemically synthesized
tactcgggaggctgaggcag

SEQ ID NO: 499765 - DNA, 20 bp, Artificial Sequence
  chemically synthesized
aattctcctgcctcagcctc

SEQ ID NO: 499766 - DNA, 20 bp, Artificial Sequence
  chemically synthesized
gcctcagcctcccgagtagc

SEQ ID NO: 499767 - DNA, 20 bp, Artificial Sequence
  chemically synthesized
ttttgtatttttagtagaga

SEQ ID NO: 499768 - DNA, 20 bp, Artificial Sequence
  chemically synthesized
aggcgggtgaccacagggtc

SEQ ID NO: 499769 - DNA, 20 bp, Artificial Sequence
  chemically synthesized
gaggccaaggcgggtgacca

SEQ ID NO: 499770 - DNA, 20 bp, Artificial Sequence
  chemically synthesized
cagcactttgggaggccaag

SEQ ID NO: 499771 - DNA, 20 bp, Artificial Sequence
  chemically synthesized
gccttggcctcccaaagtgc

SEQ ID NO: 499772 - DNA, 20 bp, Artificial Sequence
  chemically synthesized
agacagtcatatattatatc

SEQ ID NO: 499773 - DNA, 20 bp, Artificial Sequence
  chemically synthesized
gagagcggggcttttgcttt

SEQ ID NO: 499774 - DNA, 20 bp, Artificial Sequence
  chemically synthesized
aaagcaaaagccccgctctc

SEQ ID NO: 499775 - DNA, 20 bp, Artificial Sequence
  chemically synthesized
tggaatctcaccttctacag

SEQ ID NO: 499776 - DNA, 20 bp, Artificial Sequence
  chemically synthesized
agcacttaaccactatctaa

SEQ ID NO: 499777 - DNA, 20 bp, Artificial Sequence
  chemically synthesized
aagcagggaaggaagaaatg

SEQ ID NO: 499778 - DNA, 20 bp, Artificial Sequence
  chemically synthesized
gaagaaatgaaggataaagt

SEQ ID NO: 499779 - DNA, 20 bp, Artificial Sequence
  chemically synthesized
atgaaggataaagtgggggt

SEQ ID NO: 499780 - DNA, 20 bp, Artificial Sequence
  chemically synthesized
gggtcagaattttaggtaag

SEQ ID NO: 499781 - DNA, 20 bp, Artificial Sequence
  chemically synthesized
accattgaaagaaaaatcat

SEQ ID NO: 499782 - DNA, 20 bp, Artificial Sequence
  chemically synthesized
ttatacttgctttacctgtc

SEQ ID NO: 499783 - DNA, 20 bp, Artificial Sequence
  chemically synthesized
aagtataagggccctgacac

SEQ ID NO: 499784 - DNA, 20 bp, Artificial Sequence
  chemically synthesized
tgacactggaatgtgcctgg

SEQ ID NO: 499785 - DNA, 20 bp, Artificial Sequence
  chemically synthesized
atggaggaagtgattatggc

SEQ ID NO: 499786 - DNA, 20 bp, Artificial Sequence
  chemically synthesized
cgactaccagagaaatatca

SEQ ID NO: 499787 - DNA, 20 bp, Artificial Sequence
  chemically synthesized
accagagaaatatcagagaa

SEQ ID NO: 499788 - DNA, 20 bp, Artificial Sequence
  chemically synthesized
gagaaatatcagagaatggg

SEQ ID NO: 499789 - DNA, 20 bp, Artificial Sequence
  chemically synthesized
ttatgttcataagtaccttc

SEQ ID NO: 499790 - DNA, 20 bp, Artificial Sequence
  chemically synthesized
acttccctgtttactttgag

SEQ ID NO: 499791 - DNA, 20 bp, Artificial Sequence
  chemically synthesized
tgagggggatggggagcatt

SEQ ID NO: 499792 - DNA, 20 bp, Artificial Sequence
  chemically synthesized
ttttgaacagaagcagaaag

SEQ ID NO: 499793 - DNA, 20 bp, Artificial Sequence
  chemically synthesized
tctggctagtatattgacag

SEQ ID NO: 499794 - DNA, 20 bp, Artificial Sequence
  chemically synthesized
aaagcaccatcatctccagc

SEQ ID NO: 499795 - DNA, 20 bp, Artificial Sequence
  chemically synthesized
atgctggagatgatggtgct

SEQ ID NO: 499796 - DNA, 20 bp, Artificial Sequence
  chemically synthesized
gagatgatggtgctttggat

SEQ ID NO: 499797 - DNA, 20 bp, Artificial Sequence
  chemically synthesized
gctttggatcagagtggagg

SEQ ID NO: 499798 - DNA, 20 bp, Artificial Sequence
  chemically synthesized
ggatcagagtggaggcaggg

SEQ ID NO: 499799 - DNA, 20 bp, Artificial Sequence
  chemically synthesized
agtggaggcagggttgaatt

SEQ ID NO: 499800 - DNA, 20 bp, Artificial Sequence
  chemically synthesized
ttctgcctttacaatgtatc

SEQ ID NO: 499801 - DNA, 20 bp, Artificial Sequence
  chemically synthesized
ttccggatacattgtaaagg

SEQ ID NO: 499802 - DNA, 20 bp, Artificial Sequence
  chemically synthesized
cattgtaaaggcagaatcct

SEQ ID NO: 499803 - DNA, 20 bp, Artificial Sequence
  chemically synthesized
gtaattggccaccaaatcct

SEQ ID NO: 499804 - DNA, 20 bp, Artificial Sequence
  chemically synthesized
tgttggtagagaaaggcctt

SEQ ID NO: 499805 - DNA, 20 bp, Artificial Sequence
  chemically synthesized
aaggccttaaggataacatg

SEQ ID NO: 499806 - DNA, 20 bp, Artificial Sequence
  chemically synthesized
agaattttggcacagacaag

SEQ ID NO: 499807 - DNA, 20 bp, Artificial Sequence
  chemically synthesized
ggcacagacaagtggaataa

SEQ ID NO: 499808 - DNA, 20 bp, Artificial Sequence
  chemically synthesized
tatagtgtagaaaactgcag

SEQ ID NO: 499809 - DNA, 20 bp, Artificial Sequence
  chemically synthesized
aaactgcaggaggataaggt

SEQ ID NO: 499810 - DNA, 20 bp, Artificial Sequence
  chemically synthesized
gatgtttattatacttctaa

SEQ ID NO: 499811 - DNA, 20 bp, Artificial Sequence
  chemically synthesized
tatatgtcatgattcaggag

SEQ ID NO: 499812 - DNA, 20 bp, Artificial Sequence
  chemically synthesized
ctctagtcaagattcctctc

SEQ ID NO: 499813 - DNA, 20 bp, Artificial Sequence
  chemically synthesized
ttgactagagatataaattt

SEQ ID NO: 499814 - DNA, 20 bp, Artificial Sequence
  chemically synthesized
atataaatttgagagtcact

SEQ ID NO: 499815 - DNA, 20 bp, Artificial Sequence
  chemically synthesized
gaagaaaagaggtctggaaa

SEQ ID NO: 499816 - DNA, 20 bp, Artificial Sequence
  chemically synthesized
ggctaagattgtctacaggg

SEQ ID NO: 499817 - DNA, 20 bp, Artificial Sequence
  chemically synthesized
gaaatggctaagattgtcta

SEQ ID NO: 499818 - DNA, 20 bp, Artificial Sequence
  chemically synthesized
taaatcaaactttgacacaa

SEQ ID NO: 499819 - DNA, 20 bp, Artificial Sequence
  chemically synthesized
tatttaggggaggtgggaaa

SEQ ID NO: 499820 - DNA, 20 bp, Artificial Sequence
  chemically synthesized
tctgttgggccccagcagca

SEQ ID NO: 499821 - DNA, 20 bp, Artificial Sequence
  chemically synthesized
gggctaactccctcctcctg

SEQ ID NO: 499822 - DNA, 20 bp, Artificial Sequence
  chemically synthesized
gaaggcacccagcaggagga

SEQ ID NO: 499823 - DNA, 20 bp, Artificial Sequence
  chemically synthesized
caccttgatgtagccttaag

SEQ ID NO: 499824 - DNA, 20 bp, Artificial Sequence
  chemically synthesized
aggctacatcaaggtgtttt

SEQ ID NO: 499825 - DNA, 20 bp, Artificial Sequence
  chemically synthesized
ctgtctaccaacctgtagac

SEQ ID NO: 499826 - DNA, 20 bp, Artificial Sequence
  chemically synthesized
cccaccatggcaacagaacc

SEQ ID NO: 499827 - DNA, 20 bp, Artificial Sequence
  chemically synthesized
tcttggttctgttgccatgg

SEQ ID NO: 499828 - DNA, 20 bp, Artificial Sequence
  chemically synthesized
aaaacctttccttaaccaat

SEQ ID NO: 499829 - DNA, 20 bp, Artificial Sequence
  chemically synthesized
gtgttagtgcaaaatgtgga

SEQ ID NO: 499830 - DNA, 20 bp, Artificial Sequence
  chemically synthesized
ttttgcactaacacaggaaa

SEQ ID NO: 499831 - DNA, 20 bp, Artificial Sequence
  chemically synthesized
acacaggaaaatgggtgatc

SEQ ID NO: 499832 - DNA, 20 bp, Artificial Sequence
  chemically synthesized
tctaggatgttgggcatctc

SEQ ID NO: 499833 - DNA, 20 bp, Artificial Sequence
  chemically synthesized
cctgagtgaactttaataat

SEQ ID NO: 499834 - DNA, 20 bp, Artificial Sequence
  chemically synthesized
tgagagtcctggtacagcta

SEQ ID NO: 499835 - DNA, 20 bp, Artificial Sequence
  chemically synthesized
cctggtacagctactgaatc

SEQ ID NO: 499836 - DNA, 20 bp, Artificial Sequence
  chemically synthesized
ccaatttatcctgccatttt

SEQ ID NO: 499837 - DNA, 20 bp, Artificial Sequence
  chemically synthesized
agggataatccttaaaatgg

SEQ ID NO: 499838 - DNA, 20 bp, Artificial Sequence
  chemically synthesized
atcatggatggattttggtc

SEQ ID NO: 499839 - DNA, 20 bp, Artificial Sequence
  chemically synthesized
aaagctatatgtcatcatgg

SEQ ID NO: 499840 - DNA, 20 bp, Artificial Sequence
  chemically synthesized
ccaaaaagctatatgtcatc

SEQ ID NO: 499841 - DNA, 20 bp, Artificial Sequence
  chemically synthesized
ccaggaaaaaaaagaaaaaa

SEQ ID NO: 499842 - DNA, 20 bp, Artificial Sequence
  chemically synthesized
aatcaagttggataaaaact

SEQ ID NO: 499843 - DNA, 20 bp, Artificial Sequence
  chemically synthesized
caaagcactaggaaatcaag

SEQ ID NO: 499844 - DNA, 20 bp, Artificial Sequence
  chemically synthesized
ttgccagcagagacacttga

SEQ ID NO: 499845 - DNA, 20 bp, Artificial Sequence
  chemically synthesized
cacttgaaaggataatcaaa

SEQ ID NO: 499846 - DNA, 20 bp, Artificial Sequence
  chemically synthesized
tcaaagtgaataacaaagtg

SEQ ID NO: 499847 - DNA, 20 bp, Artificial Sequence
  chemically synthesized
gtatcagaaggatgtgtctg

SEQ ID NO: 499848 - DNA, 20 bp, Artificial Sequence
  chemically synthesized
aaaaaaaaaaattgtatcag

SEQ ID NO: 499849 - DNA, 20 bp, Artificial Sequence
  chemically synthesized
gttaaagatacaaagtcagt

SEQ ID NO: 499850 - DNA, 20 bp, Artificial Sequence
  chemically synthesized
cactctggatgttcaagctc

SEQ ID NO: 499851 - DNA, 20 bp, Artificial Sequence
  chemically synthesized
aactctggagcttgaacatc

SEQ ID NO: 499852 - DNA, 20 bp, Artificial Sequence
  chemically synthesized
atcatagttgaagtcccact

SEQ ID NO: 499853 - DNA, 20 bp, Artificial Sequence
  chemically synthesized
caggacctccgtttctccat

SEQ ID NO: 499854 - DNA, 20 bp, Artificial Sequence
  chemically synthesized
ctccgtttctccatctgagt

SEQ ID NO: 499855 - DNA, 20 bp, Artificial Sequence
  chemically synthesized
tacaagttactctaagtgtt

SEQ ID NO: 499856 - DNA, 20 bp, Artificial Sequence
  chemically synthesized
caggacacattctaaacact

SEQ ID NO: 499857 - DNA, 20 bp, Artificial Sequence
  chemically synthesized
aactggaatctggactaatc

SEQ ID NO: 499858 - DNA, 20 bp, Artificial Sequence
  chemically synthesized
gcttgaggtgtgaatataac

SEQ ID NO: 499859 - DNA, 20 bp, Artificial Sequence
  chemically synthesized
aggaatccttagcttgaggt

SEQ ID NO: 499860 - DNA, 20 bp, Artificial Sequence
  chemically synthesized
ttatattcacacctcaagct

SEQ ID NO: 499861 - DNA, 20 bp, Artificial Sequence
  chemically synthesized
taggaggaattttatagagg

SEQ ID NO: 499862 - DNA, 20 bp, Artificial Sequence
  chemically synthesized
cacaaaaagcagaaactagg

SEQ ID NO: 499863 - DNA, 20 bp, Artificial Sequence
  chemically synthesized
caagcaaaaatatataagac

SEQ ID NO: 499864 - DNA, 20 bp, Artificial Sequence
  chemically synthesized
catgtcttatatatttttgc

SEQ ID NO: 499865 - DNA, 20 bp, Artificial Sequence
  chemically synthesized
atagttatacaaacaagtta

SEQ ID NO: 499866 - DNA, 20 bp, Artificial Sequence
  chemically synthesized
tctggtagttgataacatta

SEQ ID NO: 499867 - DNA, 20 bp, Artificial Sequence
  chemically synthesized
tcaataatgttatcaactac

SEQ ID NO: 499868 - DNA, 20 bp, Artificial Sequence
  chemically synthesized
gttatcaactaccagagtac

SEQ ID NO: 499869 - DNA, 20 bp, Artificial Sequence
  chemically synthesized
aagataagaaagaaatatta

SEQ ID NO: 499870 - DNA, 20 bp, Artificial Sequence
  chemically synthesized
aatatttctttcttatcttt

SEQ ID NO: 499871 - DNA, 20 bp, Artificial Sequence
  chemically synthesized
tgttgacttgaagtaaaaag

SEQ ID NO: 499872 - DNA, 20 bp, Artificial Sequence
  chemically synthesized
cttgcttatgaaaatccaat

SEQ ID NO: 499873 - DNA, 20 bp, Artificial Sequence
  chemically synthesized
gttcaatgattgaattcaaa

SEQ ID NO: 499874 - DNA, 20 bp, Artificial Sequence
  chemically synthesized
aaatcttagaggttcaatga

SEQ ID NO: 499875 - DNA, 20 bp, Artificial Sequence
  chemically synthesized
atctatctacaatggttgaa

SEQ ID NO: 499876 - DNA, 20 bp, Artificial Sequence
  chemically synthesized
tagctcacgtctgaccatac

SEQ ID NO: 499877 - DNA, 20 bp, Artificial Sequence
  chemically synthesized
tagaataaacaaggaattac

SEQ ID NO: 499878 - DNA, 20 bp, Artificial Sequence
  chemically synthesized
aaagtaaagtagaataaaca

SEQ ID NO: 499879 - DNA, 20 bp, Artificial Sequence
  chemically synthesized
aatgtcttgtaaaagtaaag

SEQ ID NO: 499880 - DNA, 20 bp, Artificial Sequence
  chemically synthesized
agacattagctgttgaacag

SEQ ID NO: 499881 - DNA, 20 bp, Artificial Sequence
  chemically synthesized
agtccacatgcatttcctgg

SEQ ID NO: 499882 - DNA, 20 bp, Artificial Sequence
  chemically synthesized
taagaaaaaagtcctttatt

SEQ ID NO: 499883 - DNA, 20 bp, Artificial Sequence
  chemically synthesized
agaaatgggcaggtgtaatt

SEQ ID NO: 499884 - DNA, 20 bp, Artificial Sequence
  chemically synthesized
acacttggatcagtaaagtg

SEQ ID NO: 499885 - DNA, 20 bp, Artificial Sequence
  chemically synthesized
tcattttatctgagaaacac

SEQ ID NO: 499886 - DNA, 20 bp, Artificial Sequence
  chemically synthesized
tttacttagtgctgatggac

SEQ ID NO: 499887 - DNA, 20 bp, Artificial Sequence
  chemically synthesized
atgtgagtcaatttttctat

SEQ ID NO: 499888 - DNA, 20 bp, Artificial Sequence
  chemically synthesized
aaaccccctttgccatgcat

SEQ ID NO: 499889 - DNA, 20 bp, Artificial Sequence
  chemically synthesized
tgactcacatgcatggcaaa

SEQ ID NO: 499890 - DNA, 20 bp, Artificial Sequence
  chemically synthesized
ctctaagaaatttgggatca

SEQ ID NO: 499891 - DNA, 20 bp, Artificial Sequence
  chemically synthesized
ttctatgatcccaaatttct

SEQ ID NO: 499892 - DNA, 20 bp, Artificial Sequence
  chemically synthesized
tatcctgactctaagaaatt

SEQ ID NO: 499893 - DNA, 20 bp, Artificial Sequence
  chemically synthesized
gatcccaaatttcttagagt

SEQ ID NO: 499894 - DNA, 20 bp, Artificial Sequence
  chemically synthesized
acctacctggccctcctctg

SEQ ID NO: 499895 - DNA, 20 bp, Artificial Sequence
  chemically synthesized
cttggattgttgtattgctt

SEQ ID NO: 499896 - DNA, 20 bp, Artificial Sequence
  chemically synthesized
catcagtttttgaggttttc

SEQ ID NO: 499897 - DNA, 20 bp, Artificial Sequence
  chemically synthesized
tcaaaaactgatgatcacca

SEQ ID NO: 499898 - DNA, 20 bp, Artificial Sequence
  chemically synthesized
aactgatgatcaccaatgaa

SEQ ID NO: 499899 - DNA, 20 bp, Artificial Sequence
  chemically synthesized
atagaattaaaaagtataac

SEQ ID NO: 499900 - DNA, 20 bp, Artificial Sequence
  chemically synthesized
ctcatgattgcatatgtaaa

SEQ ID NO: 499901 - DNA, 20 bp, Artificial Sequence
  chemically synthesized
ttttttttagatgtatgcat

SEQ ID NO: 499902 - DNA, 20 bp, Artificial Sequence
  chemically synthesized
ccaaaaaggtaaacattgag

SEQ ID NO: 499903 - DNA, 20 bp, Artificial Sequence
  chemically synthesized
agcttccaaaaaggtaaaca

SEQ ID NO: 499904 - DNA, 20 bp, Artificial Sequence
  chemically synthesized
tggtttggcaaattaaattt

SEQ ID NO: 499905 - DNA, 20 bp, Artificial Sequence
  chemically synthesized
agttcttgttttttttccat

SEQ ID NO: 499906 - DNA, 20 bp, Artificial Sequence
  chemically synthesized
gtacccaagtctgcttattt

SEQ ID NO: 499907 - DNA, 20 bp, Artificial Sequence
  chemically synthesized
atattcagaaataagcagac

SEQ ID NO: 499908 - DNA, 20 bp, Artificial Sequence
  chemically synthesized
atgctattccattgaacctt

SEQ ID NO: 499909 - DNA, 20 bp, Artificial Sequence
  chemically synthesized
tgacaattcataaggttcaa

SEQ ID NO: 499910 - DNA, 20 bp, Artificial Sequence
  chemically synthesized
tttttttctcttttttgctt

SEQ ID NO: 499911 - DNA, 20 bp, Artificial Sequence
  chemically synthesized
tgattaaatcattctttgct

SEQ ID NO: 499912 - DNA, 20 bp, Artificial Sequence
  chemically synthesized
aaatattgaaactctaagca

SEQ ID NO: 499913 - DNA, 20 bp, Artificial Sequence
  chemically synthesized
taaaacccattgttctaatt

SEQ ID NO: 499914 - DNA, 20 bp, Artificial Sequence
  chemically synthesized
ctgaactcacaattagaaca

SEQ ID NO: 499915 - DNA, 20 bp, Artificial Sequence
  chemically synthesized
accataacttttaccaagaa

SEQ ID NO: 499916 - DNA, 20 bp, Artificial Sequence
  chemically synthesized
ttggtaaaagttatggtaca

SEQ ID NO: 499917 - DNA, 20 bp, Artificial Sequence
  chemically synthesized
agttatggtacacagaatct

SEQ ID NO: 499918 - DNA, 20 bp, Artificial Sequence
  chemically synthesized
cacagaatcttggaataatt

SEQ ID NO: 499919 - DNA, 20 bp, Artificial Sequence
  chemically synthesized
caagataaatatacaataaa

SEQ ID NO: 499920 - DNA, 20 bp, Artificial Sequence
  chemically synthesized
tttataccttaaataaatag

SEQ ID NO: 499921 - DNA, 20 bp, Artificial Sequence
  chemically synthesized
gaagaataaaaaaattactc

SEQ ID NO: 499922 - DNA, 20 bp, Artificial Sequence
  chemically synthesized
aggctagttgttacttattc

SEQ ID NO: 499923 - DNA, 20 bp, Artificial Sequence
  chemically synthesized
acttagtgatttttcaactt

SEQ ID NO: 499924 - DNA, 20 bp, Artificial Sequence
  chemically synthesized
atactgaagtatggtttcga

SEQ ID NO: 499925 - DNA, 20 bp, Artificial Sequence
  chemically synthesized
tactatactgaagtatggtt

SEQ ID NO: 499926 - DNA, 20 bp, Artificial Sequence
  chemically synthesized
tcagtatagtattcactaaa

SEQ ID NO: 499927 - DNA, 20 bp, Artificial Sequence
  chemically synthesized
tgaatatctcattcaattta

SEQ ID NO: 499928 - DNA, 20 bp, Artificial Sequence
  chemically synthesized
acctattttatagtaaagtg

SEQ ID NO: 499929 - DNA, 20 bp, Artificial Sequence
  chemically synthesized
aggctaaaccatgatatttg

SEQ ID NO: 499930 - DNA, 20 bp, Artificial Sequence
  chemically synthesized
tatttggtgggttaagtgta

SEQ ID NO: 499931 - DNA, 20 bp, Artificial Sequence
  chemically synthesized
agataaacccattgtaagtt

SEQ ID NO: 499932 - DNA, 20 bp, Artificial Sequence
  chemically synthesized
tacaaaattctcaacttaca

SEQ ID NO: 499933 - DNA, 20 bp, Artificial Sequence
  chemically synthesized
tcaacttacaatgggtttat

SEQ ID NO: 499934 - DNA, 20 bp, Artificial Sequence
  chemically synthesized
gaatgttccttgacttgtga

SEQ ID NO: 499935 - DNA, 20 bp, Artificial Sequence
  chemically synthesized
gatcatattcttctattgta

SEQ ID NO: 499936 - DNA, 20 bp, Artificial Sequence
  chemically synthesized
aggaacattctgtacaatag

SEQ ID NO: 499937 - DNA, 20 bp, Artificial Sequence
  chemically synthesized
ttttgacaaaatcttcctta

SEQ ID NO: 499938 - DNA, 20 bp, Artificial Sequence
  chemically synthesized
ctaaaaaaactttaaaataa

SEQ ID NO: 499939 - DNA, 20 bp, Artificial Sequence
  chemically synthesized
ttttaaagtttttttagctt

SEQ ID NO: 499940 - DNA, 20 bp, Artificial Sequence
  chemically synthesized
cctaaaaacaaattaccttt

SEQ ID NO: 499941 - DNA, 20 bp, Artificial Sequence
  chemically synthesized
tcttaaaggtaatttgtttt

SEQ ID NO: 499942 - DNA, 20 bp, Artificial Sequence
  chemically synthesized
gtggaaatttataactttct

SEQ ID NO: 499943 - DNA, 20 bp, Artificial Sequence
  chemically synthesized
tttataactttcttagaatt

SEQ ID NO: 499944 - DNA, 20 bp, Artificial Sequence
  chemically synthesized
atataattatacattttaac

SEQ ID NO: 499945 - DNA, 20 bp, Artificial Sequence
  chemically synthesized
tgatttcactgtatcttcac

SEQ ID NO: 499946 - DNA, 20 bp, Artificial Sequence
  chemically synthesized
gtatcttcacaagagtacag

SEQ ID NO: 499947 - DNA, 20 bp, Artificial Sequence
  chemically synthesized
atatcttatgttacttgccc

SEQ ID NO: 499948 - DNA, 20 bp, Artificial Sequence
  chemically synthesized
ttatgataagcagtagagta

SEQ ID NO: 499949 - DNA, 20 bp, Artificial Sequence
  chemically synthesized
tatgtggttatgataagcag

SEQ ID NO: 499950 - DNA, 20 bp, Artificial Sequence
  chemically synthesized
tagtaatgttttaattatat

SEQ ID NO: 499951 - DNA, 20 bp, Artificial Sequence
  chemically synthesized
ttgttctaggtttgtatata

SEQ ID NO: 499952 - DNA, 20 bp, Artificial Sequence
  chemically synthesized
cttatatgcatatagatttg

SEQ ID NO: 499953 - DNA, 20 bp, Artificial Sequence
  chemically synthesized
tgtctagatgatttaactca

SEQ ID NO: 499954 - DNA, 20 bp, Artificial Sequence
  chemically synthesized
gatgatttaactcagtgagt

SEQ ID NO: 499955 - DNA, 20 bp, Artificial Sequence
  chemically synthesized
ttatattgtatcctaactca

SEQ ID NO: 499956 - DNA, 20 bp, Artificial Sequence
  chemically synthesized
tgccctgtcttcttctatct

SEQ ID NO: 499957 - DNA, 20 bp, Artificial Sequence
  chemically synthesized
aatgtacatctgttgaatta

SEQ ID NO: 499958 - DNA, 20 bp, Artificial Sequence
  chemically synthesized
aggtactgaatgtacatctg

SEQ ID NO: 499959 - DNA, 20 bp, Artificial Sequence
  chemically synthesized
gcacctagcacttaaaggta

SEQ ID NO: 499960 - DNA, 20 bp, Artificial Sequence
  chemically synthesized
taagtgctaggtgctgttct

SEQ ID NO: 499961 - DNA, 20 bp, Artificial Sequence
  chemically synthesized
aaatgtagcactgcagttac

SEQ ID NO: 499962 - DNA, 20 bp, Artificial Sequence
  chemically synthesized
aatatgacgacaatagtgcc

SEQ ID NO: 499963 - DNA, 20 bp, Artificial Sequence
  chemically synthesized
aactttcatttctaagaaaa

SEQ ID NO: 499964 - DNA, 20 bp, Artificial Sequence
  chemically synthesized
cgctgtcacaacagttacta

SEQ ID NO: 499965 - DNA, 20 bp, Artificial Sequence
  chemically synthesized
tgttgtgacagcggccgttg

SEQ ID NO: 499966 - DNA, 20 bp, Artificial Sequence
  chemically synthesized
gagtgaaaatgaactggagt

SEQ ID NO: 499967 - DNA, 20 bp, Artificial Sequence
  chemically synthesized
tccagagagtgaaaatgaac

SEQ ID NO: 499968 - DNA, 20 bp, Artificial Sequence
  chemically synthesized
tccagttcattttcactctc

SEQ ID NO: 499969 - DNA, 20 bp, Artificial Sequence
  chemically synthesized
tcagataaagacaaattcca

SEQ ID NO: 499970 - DNA, 20 bp, Artificial Sequence
  chemically synthesized
gtgtaagaattagatttata

SEQ ID NO: 499971 - DNA, 20 bp, Artificial Sequence
  chemically synthesized
ggatgggatgtgaagagtgt

SEQ ID NO: 499972 - DNA, 20 bp, Artificial Sequence
  chemically synthesized
tggtagctggatgggatgtg

SEQ ID NO: 499973 - DNA, 20 bp, Artificial Sequence
  chemically synthesized
tgtagtgcctggtagctgga

SEQ ID NO: 499974 - DNA, 20 bp, Artificial Sequence
  chemically synthesized
attaatgtagtgcctggtag

SEQ ID NO: 499975 - DNA, 20 bp, Artificial Sequence
  chemically synthesized
ggcactacattaatgacata

SEQ ID NO: 499976 - DNA, 20 bp, Artificial Sequence
  chemically synthesized
ttggaccaaaatattcttca

SEQ ID NO: 499977 - DNA, 20 bp, Artificial Sequence
  chemically synthesized
agacaatgcatcatcctatg

SEQ ID NO: 499978 - DNA, 20 bp, Artificial Sequence
  chemically synthesized
gcattgtctttgcataaata

SEQ ID NO: 499979 - DNA, 20 bp, Artificial Sequence
  chemically synthesized
aagcacagcttcaaccgttt

SEQ ID NO: 499980 - DNA, 20 bp, Artificial Sequence
  chemically synthesized
ctttctacactttacacgat

SEQ ID NO: 499981 - DNA, 20 bp, Artificial Sequence
  chemically synthesized
tatgaaaacagtgctgctgg

SEQ ID NO: 499982 - DNA, 20 bp, Artificial Sequence
  chemically synthesized
agtgctgctgggagaatgga

SEQ ID NO: 499983 - DNA, 20 bp, Artificial Sequence
  chemically synthesized
gctgggagaatggaaggagt

SEQ ID NO: 499984 - DNA, 20 bp, Artificial Sequence
  chemically synthesized
gttcttaaagtacattttag

SEQ ID NO: 499985 - DNA, 20 bp, Artificial Sequence
  chemically synthesized
aagtacattttagcagagtt

SEQ ID NO: 499986 - DNA, 20 bp, Artificial Sequence
  chemically synthesized
ggcttgataaaataatggtt

SEQ ID NO: 499987 - DNA, 20 bp, Artificial Sequence
  chemically synthesized
taaaataatggttggggata

SEQ ID NO: 499988 - DNA, 20 bp, Artificial Sequence
  chemically synthesized
ataatggttggggataaaga

SEQ ID NO: 499989 - DNA, 20 bp, Artificial Sequence
  chemically synthesized
cttcaacagcttatatgact

SEQ ID NO: 499990 - DNA, 20 bp, Artificial Sequence
  chemically synthesized
agtggtttctcttagaaaaa

SEQ ID NO: 499991 - DNA, 20 bp, Artificial Sequence
  chemically synthesized
aaactattagaaaattcaac

SEQ ID NO: 499992 - DNA, 20 bp, Artificial Sequence
  chemically synthesized
aaatgctttttgaattcgag

SEQ ID NO: 499993 - DNA, 20 bp, Artificial Sequence
  chemically synthesized
tttgcaaatgctttttgaat

SEQ ID NO: 499994 - DNA, 20 bp, Artificial Sequence
  chemically synthesized
aatttgtttgcaaatgcttt

SEQ ID NO: 499995 - DNA, 20 bp, Artificial Sequence
  chemically synthesized
ttatatgatccatgattatt

SEQ ID NO: 499996 - DNA, 20 bp, Artificial Sequence
  chemically synthesized
tgcaattactctaaataatc

SEQ ID NO: 499997 - DNA, 20 bp, Artificial Sequence
  chemically synthesized
acaggggtatttaataatat

SEQ ID NO: 499998 - DNA, 20 bp, Artificial Sequence
  chemically synthesized
ttatatgcatattgtaatac

SEQ ID NO: 499999 - DNA, 20 bp, Artificial Sequence
  chemically synthesized
ttttccttcagatattttgt

SEQ ID NO: 500000 - DNA, 20 bp, Artificial Sequence
  chemically synthesized
ttatctaattctcctaatac

SEQ ID NO: 500001 - DNA, 20 bp, Artificial Sequence
  chemically synthesized
cttttctattctggtattag

SEQ ID NO: 500002 - DNA, 20 bp, Artificial Sequence
  chemically synthesized
tttgccttcatttaactaat

SEQ ID NO: 500003 - DNA, 20 bp, Artificial Sequence
  chemically synthesized
tggttaagatctttctcctc

SEQ ID NO: 500004 - DNA, 20 bp, Artificial Sequence
  chemically synthesized
cctacttcaaggcaagactg

SEQ ID NO: 500005 - DNA, 20 bp, Artificial Sequence
  chemically synthesized
aagaaatcatacatctctca

SEQ ID NO: 500006 - DNA, 20 bp, Artificial Sequence
  chemically synthesized
cattctcggccgacttgggg

SEQ ID NO: 500007 - DNA, 20 bp, Artificial Sequence
  chemically synthesized
aactcagccccaagtcggcc

SEQ ID NO: 500008 - DNA, 20 bp, Artificial Sequence
  chemically synthesized
cagccccaagtcggccgaga

SEQ ID NO: 500009 - DNA, 20 bp, Artificial Sequence
  chemically synthesized
ctctaatttcaaaatatttc

SEQ ID NO: 500010 - DNA, 20 bp, Artificial Sequence
  chemically synthesized
ttggacttggtcggtagtga

SEQ ID NO: 500011 - DNA, 20 bp, Artificial Sequence
  chemically synthesized
ggaccaataatagaatcaac

SEQ ID NO: 500012 - DNA, 20 bp, Artificial Sequence
  chemically synthesized
gaactgtaggggaccaataa

SEQ ID NO: 500013 - DNA, 20 bp, Artificial Sequence
  chemically synthesized
atcacactggcttctgggtt

SEQ ID NO: 500014 - DNA, 20 bp, Artificial Sequence
  chemically synthesized
taaaaggatcacactggctt

SEQ ID NO: 500015 - DNA, 20 bp, Artificial Sequence
  chemically synthesized
tgatctcaatcatgttttaa

SEQ ID NO: 500016 - DNA, 20 bp, Artificial Sequence
  chemically synthesized
aattgtaagtttctgagcag

SEQ ID NO: 500017 - DNA, 20 bp, Artificial Sequence
  chemically synthesized
acaattgctctcatctcatt

SEQ ID NO: 500018 - DNA, 20 bp, Artificial Sequence
  chemically synthesized
gagatgaggatatgggagtt

SEQ ID NO: 500019 - DNA, 20 bp, Artificial Sequence
  chemically synthesized
gtagaaagagatgaggatat

SEQ ID NO: 500020 - DNA, 20 bp, Artificial Sequence
  chemically synthesized
gtggaagggtagaaagagat

SEQ ID NO: 500021 - DNA, 20 bp, Artificial Sequence
  chemically synthesized
gaagcaaaacaagccagtgg

SEQ ID NO: 500022 - DNA, 20 bp, Artificial Sequence
  chemically synthesized
tggagtctgtgtagaggaaa

SEQ ID NO: 500023 - DNA, 20 bp, Artificial Sequence
  chemically synthesized
gaaggtaagggagtcagcca

SEQ ID NO: 500024 - DNA, 20 bp, Artificial Sequence
  chemically synthesized
caaagattggaagaaggtaa

SEQ ID NO: 500025 - DNA, 20 bp, Artificial Sequence
  chemically synthesized
ggcggaattgccatttcaaa

SEQ ID NO: 500026 - DNA, 20 bp, Artificial Sequence
  chemically synthesized
gtaggtataattgaaagtgg

SEQ ID NO: 500027 - DNA, 20 bp, Artificial Sequence
  chemically synthesized
aggggatataggaccactac

SEQ ID NO: 500028 - DNA, 20 bp, Artificial Sequence
  chemically synthesized
aaaaaaccagaatctgttaa

SEQ ID NO: 500029 - DNA, 20 bp, Artificial Sequence
  chemically synthesized
tttgggaaaaaaaaaaaaac

SEQ ID NO: 500030 - DNA, 20 bp, Artificial Sequence
  chemically synthesized
tttattataacattgggaga

SEQ ID NO: 500031 - DNA, 20 bp, Artificial Sequence
  chemically synthesized
tcccaatgttataataaaag

SEQ ID NO: 500032 - DNA, 20 bp, Artificial Sequence
  chemically synthesized
taaaacagtgaaaaagacta

SEQ ID NO: 500033 - DNA, 20 bp, Artificial Sequence
  chemically synthesized
ttcactgttttataagcact

SEQ ID NO: 500034 - DNA, 20 bp, Artificial Sequence
  chemically synthesized
aagagcttaataactatttt

SEQ ID NO: 500035 - DNA, 20 bp, Artificial Sequence
  chemically synthesized
aataactatttttggaatat

SEQ ID NO: 500036 - DNA, 20 bp, Artificial Sequence
  chemically synthesized
gacaagtaaacctaaggaat

SEQ ID NO: 500037 - DNA, 20 bp, Artificial Sequence
  chemically synthesized
tgttaggacaagtaaaccta

SEQ ID NO: 500038 - DNA, 20 bp, Artificial Sequence
  chemically synthesized
gccaggtcgttcaagtcctc

SEQ ID NO: 500039 - DNA, 20 bp, Artificial Sequence
  chemically synthesized
ttgtggtctcgaacttgaac

SEQ ID NO: 500040 - DNA, 20 bp, Artificial Sequence
  chemically synthesized
gtcctaatgtagattttaaa

SEQ ID NO: 500041 - DNA, 20 bp, Artificial Sequence
  chemically synthesized
tggccatatgaagaaagctc

SEQ ID NO: 500042 - DNA, 20 bp, Artificial Sequence
  chemically synthesized
gctatactttgggtaaccaa

SEQ ID NO: 500043 - DNA, 20 bp, Artificial Sequence
  chemically synthesized
tgaataaaatgtgctatact

SEQ ID NO: 500044 - DNA, 20 bp, Artificial Sequence
  chemically synthesized
gtacagatgccttgtttgga

SEQ ID NO: 500045 - DNA, 20 bp, Artificial Sequence
  chemically synthesized
tatagtacagatgccttgtt

SEQ ID NO: 500046 - DNA, 20 bp, Artificial Sequence
  chemically synthesized
gagtgagggaaggagggagg

SEQ ID NO: 500047 - DNA, 20 bp, Artificial Sequence
  chemically synthesized
gggaggaagtaaggaagaaa

SEQ ID NO: 500048 - DNA, 20 bp, Artificial Sequence
  chemically synthesized
ttcaatattccacattgcac

SEQ ID NO: 500049 - DNA, 20 bp, Artificial Sequence
  chemically synthesized
tttgaaactccagtgcaatg

SEQ ID NO: 500050 - DNA, 20 bp, Artificial Sequence
  chemically synthesized
agtgcaatgtggaatattga

SEQ ID NO: 500051 - DNA, 20 bp, Artificial Sequence
  chemically synthesized
ctgaagaacatgaacaagac

SEQ ID NO: 500052 - DNA, 20 bp, Artificial Sequence
  chemically synthesized
tattattctttatggtagag

SEQ ID NO: 500053 - DNA, 20 bp, Artificial Sequence
  chemically synthesized
agacattctgctctaccata

SEQ ID NO: 500054 - DNA, 20 bp, Artificial Sequence
  chemically synthesized
gctttaccttttgcaataat

SEQ ID NO: 500055 - DNA, 20 bp, Artificial Sequence
  chemically synthesized
ataagaacatagcttataat

SEQ ID NO: 500056 - DNA, 20 bp, Artificial Sequence
  chemically synthesized
aggccttggtatcaataaat

SEQ ID NO: 500057 - DNA, 20 bp, Artificial Sequence
  chemically synthesized
caaggcctaattgaacagct

SEQ ID NO: 500058 - DNA, 20 bp, Artificial Sequence
  chemically synthesized
attgaacagctaaggattcc

SEQ ID NO: 500059 - DNA, 20 bp, Artificial Sequence
  chemically synthesized
ttctgctgctccctcattca

SEQ ID NO: 500060 - DNA, 20 bp, Artificial Sequence
  chemically synthesized
ttccctgaatgagggagcag

SEQ ID NO: 500061 - DNA, 20 bp, Artificial Sequence
  chemically synthesized
gggagcagcagaatcacttg

SEQ ID NO: 500062 - DNA, 20 bp, Artificial Sequence
  chemically synthesized
aatagttcatgcctttggag

SEQ ID NO: 500063 - DNA, 20 bp, Artificial Sequence
  chemically synthesized
ttagaaatagttcatgcctt

SEQ ID NO: 500064 - DNA, 20 bp, Artificial Sequence
  chemically synthesized
caaaggcatgaactatttct

SEQ ID NO: 500065 - DNA, 20 bp, Artificial Sequence
  chemically synthesized
tatttcaaaaatgtcctaga

SEQ ID NO: 500066 - DNA, 20 bp, Artificial Sequence
  chemically synthesized
tataagcagattcgaagaca

SEQ ID NO: 500067 - DNA, 20 bp, Artificial Sequence
  chemically synthesized
cccaaagacatcccttgtct

SEQ ID NO: 500068 - DNA, 20 bp, Artificial Sequence
  chemically synthesized
cgaagacaagggatgtcttt

SEQ ID NO: 500069 - DNA, 20 bp, Artificial Sequence
  chemically synthesized
cacactttactagcacctcc

SEQ ID NO: 500070 - DNA, 20 bp, Artificial Sequence
  chemically synthesized
cacagtaaaaacctgcctca

SEQ ID NO: 500071 - DNA, 20 bp, Artificial Sequence
  chemically synthesized
caggtttttactgtgtgcga

SEQ ID NO: 500072 - DNA, 20 bp, Artificial Sequence
  chemically synthesized
atggggtcttaatcctggaa

SEQ ID NO: 500073 - DNA, 20 bp, Artificial Sequence
  chemically synthesized
tctgacccaaaattctgttc

SEQ ID NO: 500074 - DNA, 20 bp, Artificial Sequence
  chemically synthesized
cttaatcctggaacagaatt

SEQ ID NO: 500075 - DNA, 20 bp, Artificial Sequence
  chemically synthesized
tcagagcataaatcatgctt

SEQ ID NO: 500076 - DNA, 20 bp, Artificial Sequence
  chemically synthesized
cttcagagttaccctaactg

SEQ ID NO: 500077 - DNA, 20 bp, Artificial Sequence
  chemically synthesized
ctactcactcattcttcagt

SEQ ID NO: 500078 - DNA, 20 bp, Artificial Sequence
  chemically synthesized
agagttaccctaactgaaga

SEQ ID NO: 500079 - DNA, 20 bp, Artificial Sequence
  chemically synthesized
ttaccctaactgaagaatga

SEQ ID NO: 500080 - DNA, 20 bp, Artificial Sequence
  chemically synthesized
ccaataacaaataacttttg

SEQ ID NO: 500081 - DNA, 20 bp, Artificial Sequence
  chemically synthesized
gaggtttgctggggaacacg

SEQ ID NO: 500082 - DNA, 20 bp, Artificial Sequence
  chemically synthesized
ctctctagtaatcaaagctc

SEQ ID NO: 500083 - DNA, 20 bp, Artificial Sequence
  chemically synthesized
aggcaaacagtcagagacac

SEQ ID NO: 500084 - DNA, 20 bp, Artificial Sequence
  chemically synthesized
tggatctggcagctaccagt

SEQ ID NO: 500085 - DNA, 20 bp, Artificial Sequence
  chemically synthesized
cagtcagagtacaaggcatg

SEQ ID NO: 500086 - DNA, 20 bp, Artificial Sequence
  chemically synthesized
atgctgagtcaggaaatgat

SEQ ID NO: 500087 - DNA, 20 bp, Artificial Sequence
  chemically synthesized
aatgatatgggtgacatccc

SEQ ID NO: 500088 - DNA, 20 bp, Artificial Sequence
  chemically synthesized
attggaggatgaaacactct

SEQ ID NO: 500089 - DNA, 20 bp, Artificial Sequence
  chemically synthesized
tgaaagcatcagttttattg

SEQ ID NO: 500090 - DNA, 20 bp, Artificial Sequence
  chemically synthesized
cacttaaaagacttaactga

SEQ ID NO: 500091 - DNA, 20 bp, Artificial Sequence
  chemically synthesized
ctttcagttaagtcttttaa

SEQ ID NO: 500092 - DNA, 20 bp, Artificial Sequence
  chemically synthesized
aagtggatcatttctgcttt

SEQ ID NO: 500093 - DNA, 20 bp, Artificial Sequence
  chemically synthesized
accaaaaggttttctctgga

SEQ ID NO: 500094 - DNA, 20 bp, Artificial Sequence
  chemically synthesized
ctcatatgaaagcatgaaca

SEQ ID NO: 500095 - DNA, 20 bp, Artificial Sequence
  chemically synthesized
tcatatgagatactttaagg

SEQ ID NO: 500096 - DNA, 20 bp, Artificial Sequence
  chemically synthesized
acaagagtacataattttag

SEQ ID NO: 500097 - DNA, 20 bp, Artificial Sequence
  chemically synthesized
attatgtactcttgtctgtt

SEQ ID NO: 500098 - DNA, 20 bp, Artificial Sequence
  chemically synthesized
taataatactcataacagac

SEQ ID NO: 500099 - DNA, 20 bp, Artificial Sequence
  chemically synthesized
tagctaaggcagagctagag

SEQ ID NO: 500100 - DNA, 20 bp, Artificial Sequence
  chemically synthesized
gtatggtttcaatagatgta

SEQ ID NO: 500101 - DNA, 20 bp, Artificial Sequence
  chemically synthesized
aataatatgtaatatgttaa

SEQ ID NO: 500102 - DNA, 20 bp, Artificial Sequence
  chemically synthesized
tttattcctgacagatatgc

SEQ ID NO: 500103 - DNA, 20 bp, Artificial Sequence
  chemically synthesized
ttgattcatgcatatctgtc

SEQ ID NO: 500104 - DNA, 20 bp, Artificial Sequence
  chemically synthesized
ctgcttttccatttttacta

SEQ ID NO: 500105 - DNA, 20 bp, Artificial Sequence
  chemically synthesized
actactggataatgacaatg

SEQ ID NO: 500106 - DNA, 20 bp, Artificial Sequence
  chemically synthesized
ttttgagctcagtcttttca

SEQ ID NO: 500107 - DNA, 20 bp, Artificial Sequence
  chemically synthesized
cttcattgacttttttgaag

SEQ ID NO: 500108 - DNA, 20 bp, Artificial Sequence
  chemically synthesized
tcccaacaaatctccagcag

SEQ ID NO: 500109 - DNA, 20 bp, Artificial Sequence
  chemically synthesized
gagatttgttgggagacaga

SEQ ID NO: 500110 - DNA, 20 bp, Artificial Sequence
  chemically synthesized
tgcccacaactgtatcttat

SEQ ID NO: 500111 - DNA, 20 bp, Artificial Sequence
  chemically synthesized
gatttaatttagctaaatgg

SEQ ID NO: 500112 - DNA, 20 bp, Artificial Sequence
  chemically synthesized
tataataatattaaatagat

SEQ ID NO: 500113 - DNA, 20 bp, Artificial Sequence
  chemically synthesized
ggatgaacaaatgattcact

SEQ ID NO: 500114 - DNA, 20 bp, Artificial Sequence
  chemically synthesized
gacccttggctacactcaca

SEQ ID NO: 500115 - DNA, 20 bp, Artificial Sequence
  chemically synthesized
gattcactgtgagtgtagcc

SEQ ID NO: 500116 - DNA, 20 bp, Artificial Sequence
  chemically synthesized
gtagccaagggtctaacatt

SEQ ID NO: 500117 - DNA, 20 bp, Artificial Sequence
  chemically synthesized
acctcttagcctggcatact

SEQ ID NO: 500118 - DNA, 20 bp, Artificial Sequence
  chemically synthesized
caggctaagaggtatggaga

SEQ ID NO: 500119 - DNA, 20 bp, Artificial Sequence
  chemically synthesized
tgatcttattaagttgccca

SEQ ID NO: 500120 - DNA, 20 bp, Artificial Sequence
  chemically synthesized
aatgggcaacttaataagat

SEQ ID NO: 500121 - DNA, 20 bp, Artificial Sequence
  chemically synthesized
ttcatggacatttggttcag

SEQ ID NO: 500122 - DNA, 20 bp, Artificial Sequence
  chemically synthesized
aaatgtccatgaacctggga

SEQ ID NO: 500123 - DNA, 20 bp, Artificial Sequence
  chemically synthesized
gtccatgaacctgggaagga

SEQ ID NO: 500124 - DNA, 20 bp, Artificial Sequence
  chemically synthesized
cattggcaataatttactta

SEQ ID NO: 500125 - DNA, 20 bp, Artificial Sequence
  chemically synthesized
tagttaatagaaataatgac

SEQ ID NO: 500126 - DNA, 20 bp, Artificial Sequence
  chemically synthesized
ataaaataaagctgacatgc

SEQ ID NO: 500127 - DNA, 20 bp, Artificial Sequence
  chemically synthesized
gatttgacttttacttcaaa

SEQ ID NO: 500128 - DNA, 20 bp, Artificial Sequence
  chemically synthesized
agaaacagtgccacactgac

SEQ ID NO: 500129 - DNA, 20 bp, Artificial Sequence
  chemically synthesized
cagtgccacactgacatgga

SEQ ID NO: 500130 - DNA, 20 bp, Artificial Sequence
  chemically synthesized
ttgcctgtatgaatatacaa

SEQ ID NO: 500131 - DNA, 20 bp, Artificial Sequence
  chemically synthesized
tatatcacacatttgcctgt

SEQ ID NO: 500132 - DNA, 20 bp, Artificial Sequence
  chemically synthesized
atacaggcaaatgtgtgata

SEQ ID NO: 500133 - DNA, 20 bp, Artificial Sequence
  chemically synthesized
atgagcttccaggaaaccat

SEQ ID NO: 500134 - DNA, 20 bp, Artificial Sequence
  chemically synthesized
tatgtgattataggcaaaag

SEQ ID NO: 500135 - DNA, 20 bp, Artificial Sequence
  chemically synthesized
gcatttgaaaataccaagct

SEQ ID NO: 500136 - DNA, 20 bp, Artificial Sequence
  chemically synthesized
gtatactataatatttcatt

SEQ ID NO: 500137 - DNA, 20 bp, Artificial Sequence
  chemically synthesized
tgtctgaagataaatgaatg

SEQ ID NO: 500138 - DNA, 20 bp, Artificial Sequence
  chemically synthesized
aaggcagtgtctgaagataa

SEQ ID NO: 500139 - DNA, 20 bp, Artificial Sequence
  chemically synthesized
taatgatgatgaaataggct

SEQ ID NO: 500140 - DNA, 20 bp, Artificial Sequence
  chemically synthesized
catcattatttgccttactt

SEQ ID NO: 500141 - DNA, 20 bp, Artificial Sequence
  chemically synthesized
tgttggtggtttgaaaacag

SEQ ID NO: 500142 - DNA, 20 bp, Artificial Sequence
  chemically synthesized
ctataacatatggaataaaa

SEQ ID NO: 500143 - DNA, 20 bp, Artificial Sequence
  chemically synthesized
aatacctgtgctataacata

SEQ ID NO: 500144 - DNA, 20 bp, Artificial Sequence
  chemically synthesized
gtattgacattaatttgaaa

SEQ ID NO: 500145 - DNA, 20 bp, Artificial Sequence
  chemically synthesized
acagaagtcatccattaact

SEQ ID NO: 500146 - DNA, 20 bp, Artificial Sequence
  chemically synthesized
gaacagtttattcctagtta

SEQ ID NO: 500147 - DNA, 20 bp, Artificial Sequence
  chemically synthesized
ttttgtgcatttcttcattt

SEQ ID NO: 500148 - DNA, 20 bp, Artificial Sequence
  chemically synthesized
tgtggttggcttcagaaatc

SEQ ID NO: 500149 - DNA, 20 bp, Artificial Sequence
  chemically synthesized
ccacactatcaagtattttt

SEQ ID NO: 500150 - DNA, 20 bp, Artificial Sequence
  chemically synthesized
atggcattttgactttcaca

SEQ ID NO: 500151 - DNA, 20 bp, Artificial Sequence
  chemically synthesized
aagtcaattgttctggcact

SEQ ID NO: 500152 - DNA, 20 bp, Artificial Sequence
  chemically synthesized
gtatgatcaccttgtaaaat

SEQ ID NO: 500153 - DNA, 20 bp, Artificial Sequence
  chemically synthesized
tgaagatctctttaagcaag

SEQ ID NO: 500154 - DNA, 20 bp, Artificial Sequence
  chemically synthesized
tctaatagggcttgtgagac

SEQ ID NO: 500155 - DNA, 20 bp, Artificial Sequence
  chemically synthesized
gtagattcaattgtcagctg

SEQ ID NO: 500156 - DNA, 20 bp, Artificial Sequence
  chemically synthesized
tctcattctacagctgacaa

SEQ ID NO: 500157 - DNA, 20 bp, Artificial Sequence
  chemically synthesized
atctacaaactgggctgaaa

SEQ ID NO: 500158 - DNA, 20 bp, Artificial Sequence
  chemically synthesized
agacttaccatcgtgaggtt

SEQ ID NO: 500159 - DNA, 20 bp, Artificial Sequence
  chemically synthesized
aaagaccatgaggtcataag

SEQ ID NO: 500160 - DNA, 20 bp, Artificial Sequence
  chemically synthesized
tgcaaaaatcgtctttttct

SEQ ID NO: 500161 - DNA, 20 bp, Artificial Sequence
  chemically synthesized
tttaaatgccagttgcaaat

SEQ ID NO: 500162 - DNA, 20 bp, Artificial Sequence
  chemically synthesized
atctagatttccaggaaaat

SEQ ID NO: 500163 - DNA, 20 bp, Artificial Sequence
  chemically synthesized
ttttcctggaaatctagata

SEQ ID NO: 500164 - DNA, 20 bp, Artificial Sequence
  chemically synthesized
ctggaaatctagatatggga

SEQ ID NO: 500165 - DNA, 20 bp, Artificial Sequence
  chemically synthesized
gtgttaggaataaaacagat

SEQ ID NO: 500166 - DNA, 20 bp, Artificial Sequence
  chemically synthesized
acaggaaagttgcctgtgtt

SEQ ID NO: 500167 - DNA, 20 bp, Artificial Sequence
  chemically synthesized
caaaaacaggagctaatgtc

SEQ ID NO: 500168 - DNA, 20 bp, Artificial Sequence
  chemically synthesized
tatatgagcagaactgactg

SEQ ID NO: 500169 - DNA, 20 bp, Artificial Sequence
  chemically synthesized
ttatattttaaaaagaactc

SEQ ID NO: 500170 - DNA, 20 bp, Artificial Sequence
  chemically synthesized
ccttatatatcaggacattc

SEQ ID NO: 500171 - DNA, 20 bp, Artificial Sequence
  chemically synthesized
tgcacctacacttttctgac

SEQ ID NO: 500172 - DNA, 20 bp, Artificial Sequence
  chemically synthesized
attctcatcatgtctagcac

SEQ ID NO: 500173 - DNA, 20 bp, Artificial Sequence
  chemically synthesized
atccaagtgctagacatgat

SEQ ID NO: 500174 - DNA, 20 bp, Artificial Sequence
  chemically synthesized
atgatgagaatttccagctc

SEQ ID NO: 500175 - DNA, 20 bp, Artificial Sequence
  chemically synthesized
ttccagctccagagtccttt

SEQ ID NO: 500176 - DNA, 20 bp, Artificial Sequence
  chemically synthesized
atttattttttgctcttata

SEQ ID NO: 500177 - DNA, 20 bp, Artificial Sequence
  chemically synthesized
tggcaggcaaattcagaaag

SEQ ID NO: 500178 - DNA, 20 bp, Artificial Sequence
  chemically synthesized
agcacaggtcatccatcttt

SEQ ID NO: 500179 - DNA, 20 bp, Artificial Sequence
  chemically synthesized
gggagaataatttcaattac

SEQ ID NO: 500180 - DNA, 20 bp, Artificial Sequence
  chemically synthesized
attctagacaaagttattgg

SEQ ID NO: 500181 - DNA, 20 bp, Artificial Sequence
  chemically synthesized
attctcccaataactttgtc

SEQ ID NO: 500182 - DNA, 20 bp, Artificial Sequence
  chemically synthesized
gcctgttgatgaggtcacct

SEQ ID NO: 500183 - DNA, 20 bp, Artificial Sequence
  chemically synthesized
tcacctgagggtttcagtgg

SEQ ID NO: 500184 - DNA, 20 bp, Artificial Sequence
  chemically synthesized
aatgtaatacattggacttt

SEQ ID NO: 500185 - DNA, 20 bp, Artificial Sequence
  chemically synthesized
agactgaaccccacacaaag

SEQ ID NO: 500186 - DNA, 20 bp, Artificial Sequence
  chemically synthesized
aaattttactcctctttgtg

SEQ ID NO: 500187 - DNA, 20 bp, Artificial Sequence
  chemically synthesized
tgtttttaatttctctgacc

SEQ ID NO: 500188 - DNA, 20 bp, Artificial Sequence
  chemically synthesized
ttttttatatcatgtaagaa

SEQ ID NO: 500189 - DNA, 20 bp, Artificial Sequence
  chemically synthesized
cttcattttttatatcatgt

SEQ ID NO: 500190 - DNA, 20 bp, Artificial Sequence
  chemically synthesized
agtagatgagatatctaaat

SEQ ID NO: 500191 - DNA, 20 bp, Artificial Sequence
  chemically synthesized
cttgtgatatagcaaattca

SEQ ID NO: 500192 - DNA, 20 bp, Artificial Sequence
  chemically synthesized
tagctaatttgtgcaattct

SEQ ID NO: 500193 - DNA, 20 bp, Artificial Sequence
  chemically synthesized
aacatgaaggaatgtgtgcc

SEQ ID NO: 500194 - DNA, 20 bp, Artificial Sequence
  chemically synthesized
cattattccattgaacatga

SEQ ID NO: 500195 - DNA, 20 bp, Artificial Sequence
  chemically synthesized
acacattccttcatgttcaa

SEQ ID NO: 500196 - DNA, 20 bp, Artificial Sequence
  chemically synthesized
tatttctcatttacatttaa

SEQ ID NO: 500197 - DNA, 20 bp, Artificial Sequence
  chemically synthesized
aggatattagaaacttgagc

SEQ ID NO: 500198 - DNA, 20 bp, Artificial Sequence
  chemically synthesized
agagtttgataaataaaatt

SEQ ID NO: 500199 - DNA, 20 bp, Artificial Sequence
  chemically synthesized
cttaagaaatctgttaaatt

SEQ ID NO: 500200 - DNA, 20 bp, Artificial Sequence
  chemically synthesized
tatgatgaaatagtgaaatt

SEQ ID NO: 500201 - DNA, 20 bp, Artificial Sequence
  chemically synthesized
tttcacattcaaatagcctg

SEQ ID NO: 500202 - DNA, 20 bp, Artificial Sequence
  chemically synthesized
aaaataactcagcaggctat

SEQ ID NO: 500203 - DNA, 20 bp, Artificial Sequence
  chemically synthesized
ttcactgacacattaaacag

SEQ ID NO: 500204 - DNA, 20 bp, Artificial Sequence
  chemically synthesized
caggggttatagcaactaac

SEQ ID NO: 500205 - DNA, 20 bp, Artificial Sequence
  chemically synthesized
tgtgaagctatctttactgc

SEQ ID NO: 500206 - DNA, 20 bp, Artificial Sequence
  chemically synthesized
aaggtttttgttatcaggaa

SEQ ID NO: 500207 - DNA, 20 bp, Artificial Sequence
  chemically synthesized
ttgttttgttgtttaatcaa

SEQ ID NO: 500208 - DNA, 20 bp, Artificial Sequence
  chemically synthesized
tttaatcaagggagttgttt

SEQ ID NO: 500209 - DNA, 20 bp, Artificial Sequence
  chemically synthesized
gaaaatatttagaaaaaaat

SEQ ID NO: 500210 - DNA, 20 bp, Artificial Sequence
  chemically synthesized
gtggccttaacaaaagcagt

SEQ ID NO: 500211 - DNA, 20 bp, Artificial Sequence
  chemically synthesized
ggacatgcatcaaaactttt

SEQ ID NO: 500212 - DNA, 20 bp, Artificial Sequence
  chemically synthesized
gaaaatagataaaaacatct

SEQ ID NO: 500213 - DNA, 20 bp, Artificial Sequence
  chemically synthesized
gagaaaactacatatcaaag

SEQ ID NO: 500214 - DNA, 20 bp, Artificial Sequence
  chemically synthesized
tatatttattaagcaccaat

SEQ ID NO: 500215 - DNA, 20 bp, Artificial Sequence
  chemically synthesized
gcttaataaatatagtaatt

SEQ ID NO: 500216 - DNA, 20 bp, Artificial Sequence
  chemically synthesized
cagacaaaagtgagtatatt

SEQ ID NO: 500217 - DNA, 20 bp, Artificial Sequence
  chemically synthesized
atacaagttagcagacaaaa

SEQ ID NO: 500218 - DNA, 20 bp, Artificial Sequence
  chemically synthesized
aataccaaaatagtcaaaat

SEQ ID NO: 500219 - DNA, 20 bp, Artificial Sequence
  chemically synthesized
aataaaaatgagatttgcca

SEQ ID NO: 500220 - DNA, 20 bp, Artificial Sequence
  chemically synthesized
tcttttcaaaagaccagctc

SEQ ID NO: 500221 - DNA, 20 bp, Artificial Sequence
  chemically synthesized
taataaagaagaaaagagaa

SEQ ID NO: 500222 - DNA, 20 bp, Artificial Sequence
  chemically synthesized
gcacaataaaaaatgataaa

SEQ ID NO: 500223 - DNA, 20 bp, Artificial Sequence
  chemically synthesized
gatggtagtttgtatttctg

SEQ ID NO: 500224 - DNA, 20 bp, Artificial Sequence
  chemically synthesized
agaaatacaaactaccatca

SEQ ID NO: 500225 - DNA, 20 bp, Artificial Sequence
  chemically synthesized
aactagaaaatctagaaaaa

SEQ ID NO: 500226 - DNA, 20 bp, Artificial Sequence
  chemically synthesized
ttgggagggtgtatgtgtcc

SEQ ID NO: 500227 - DNA, 20 bp, Artificial Sequence
  chemically synthesized
tcttcctggtttagtcttgg

SEQ ID NO: 500228 - DNA, 20 bp, Artificial Sequence
  chemically synthesized
aagactaaaccaggaagaag

SEQ ID NO: 500229 - DNA, 20 bp, Artificial Sequence
  chemically synthesized
accaggaagaagttgaatcc

SEQ ID NO: 500230 - DNA, 20 bp, Artificial Sequence
  chemically synthesized
aacttgttattggtctattc

SEQ ID NO: 500231 - DNA, 20 bp, Artificial Sequence
  chemically synthesized
aaaaaaaagcccaggaccag

SEQ ID NO: 500232 - DNA, 20 bp, Artificial Sequence
  chemically synthesized
aggaccagacggattcacag

SEQ ID NO: 500233 - DNA, 20 bp, Artificial Sequence
  chemically synthesized
atctctggtagaattcagct

SEQ ID NO: 500234 - DNA, 20 bp, Artificial Sequence
  chemically synthesized
gctcctctttgtatctctgg

SEQ ID NO: 500235 - DNA, 20 bp, Artificial Sequence
  chemically synthesized
ttgcttggaatagttttaga

SEQ ID NO: 500236 - DNA, 20 bp, Artificial Sequence
  chemically synthesized
ttattttcttttgtattgct

SEQ ID NO: 500237 - DNA, 20 bp, Artificial Sequence
  chemically synthesized
cctcataaaaagagttaggg

SEQ ID NO: 500238 - DNA, 20 bp, Artificial Sequence
  chemically synthesized
gatgctgctggcctcataaa

SEQ ID NO: 500239 - DNA, 20 bp, Artificial Sequence
  chemically synthesized
tctttgccaggttttggtat

SEQ ID NO: 500240 - DNA, 20 bp, Artificial Sequence
  chemically synthesized
tggtttgccagtattttatt

SEQ ID NO: 500241 - DNA, 20 bp, Artificial Sequence
  chemically synthesized
atatgctttttaatgtgcta

SEQ ID NO: 500242 - DNA, 20 bp, Artificial Sequence
  chemically synthesized
atgaagcctacttgattgtg

SEQ ID NO: 500243 - DNA, 20 bp, Artificial Sequence
  chemically synthesized
aatcaagtaggcttcatccc

SEQ ID NO: 500244 - DNA, 20 bp, Artificial Sequence
  chemically synthesized
ttgaaccagctttgcatccc

SEQ ID NO: 500245 - DNA, 20 bp, Artificial Sequence
  chemically synthesized
tcattggttctgtttatgtg

SEQ ID NO: 500246 - DNA, 20 bp, Artificial Sequence
  chemically synthesized
caatagatgcagaaaaggtc

SEQ ID NO: 500247 - DNA, 20 bp, Artificial Sequence
  chemically synthesized
gtttttaacatgaaagggtg

SEQ ID NO: 500248 - DNA, 20 bp, Artificial Sequence
  chemically synthesized
attgagtgtttttaacatga

SEQ ID NO: 500249 - DNA, 20 bp, Artificial Sequence
  chemically synthesized
tcccatcaataactagttta

SEQ ID NO: 500250 - DNA, 20 bp, Artificial Sequence
  chemically synthesized
cattcagtatgatactggct

SEQ ID NO: 500251 - DNA, 20 bp, Artificial Sequence
  chemically synthesized
aacccacagccagtatcata

SEQ ID NO: 500252 - DNA, 20 bp, Artificial Sequence
  chemically synthesized
gtcttgtgccagttttcaaa

SEQ ID NO: 500253 - DNA, 20 bp, Artificial Sequence
  chemically synthesized
tttgaaaactggcacaagac

SEQ ID NO: 500254 - DNA, 20 bp, Artificial Sequence
  chemically synthesized
cttccaatactatgttgaat

SEQ ID NO: 500255 - DNA, 20 bp, Artificial Sequence
  chemically synthesized
ccaggacttccaatactatg

SEQ ID NO: 500256 - DNA, 20 bp, Artificial Sequence
  chemically synthesized
ttgacttcctctcttcctat

SEQ ID NO: 500257 - DNA, 20 bp, Artificial Sequence
  chemically synthesized
gagtttttgggctgagacga

SEQ ID NO: 500258 - DNA, 20 bp, Artificial Sequence
  chemically synthesized
tgaagttgcttatcagctta

SEQ ID NO: 500259 - DNA, 20 bp, Artificial Sequence
  chemically synthesized
aagcaacttcagcaaagtct

SEQ ID NO: 500260 - DNA, 20 bp, Artificial Sequence
  chemically synthesized
tctgtctgttattggtttat

SEQ ID NO: 500261 - DNA, 20 bp, Artificial Sequence
  chemically synthesized
tctttgtagcaatttttaat

SEQ ID NO: 500262 - DNA, 20 bp, Artificial Sequence
  chemically synthesized
ccattaaaaattgctacaaa

SEQ ID NO: 500263 - DNA, 20 bp, Artificial Sequence
  chemically synthesized
acaaagagaataaaatacct

SEQ ID NO: 500264 - DNA, 20 bp, Artificial Sequence
  chemically synthesized
acctaggaatacaacttgca

SEQ ID NO: 500265 - DNA, 20 bp, Artificial Sequence
  chemically synthesized
tggaatgtttttccatttgt

SEQ ID NO: 500266 - DNA, 20 bp, Artificial Sequence
  chemically synthesized
attcttcctttccataagca

SEQ ID NO: 500267 - DNA, 20 bp, Artificial Sequence
  chemically synthesized
attccatgcttatggaaagg

SEQ ID NO: 500268 - DNA, 20 bp, Artificial Sequence
  chemically synthesized
gtagcttgatgggagtagca

SEQ ID NO: 500269 - DNA, 20 bp, Artificial Sequence
  chemically synthesized
aaagtcaatggtagcttgat

SEQ ID NO: 500270 - DNA, 20 bp, Artificial Sequence
  chemically synthesized
gctaccattgactttcttca

SEQ ID NO: 500271 - DNA, 20 bp, Artificial Sequence
  chemically synthesized
tagccaagaaaatcctaagc

SEQ ID NO: 500272 - DNA, 20 bp, Artificial Sequence
  chemically synthesized
ccagctttgttattcttgct

SEQ ID NO: 500273 - DNA, 20 bp, Artificial Sequence
  chemically synthesized
ccgacaccatttattaaata

SEQ ID NO: 500274 - DNA, 20 bp, Artificial Sequence
  chemically synthesized
ttttgtataaggtgtaagaa

SEQ ID NO: 500275 - DNA, 20 bp, Artificial Sequence
  chemically synthesized
tatacaaaaattaactcatg

SEQ ID NO: 500276 - DNA, 20 bp, Artificial Sequence
  chemically synthesized
gtttaagtctttaatccatc

SEQ ID NO: 500277 - DNA, 20 bp, Artificial Sequence
  chemically synthesized
gtattgcctaggttttcttc

SEQ ID NO: 500278 - DNA, 20 bp, Artificial Sequence
  chemically synthesized
aaaacctaggcaataccatt

SEQ ID NO: 500279 - DNA, 20 bp, Artificial Sequence
  chemically synthesized
tctttgcccatgcctgtatc

SEQ ID NO: 500280 - DNA, 20 bp, Artificial Sequence
  chemically synthesized
caaaagccaaaattgacaaa

SEQ ID NO: 500281 - DNA, 20 bp, Artificial Sequence
  chemically synthesized
acagcaaaagaccctatcat

SEQ ID NO: 500282 - DNA, 20 bp, Artificial Sequence
  chemically synthesized
ttgcctgttgactctcatga

SEQ ID NO: 500283 - DNA, 20 bp, Artificial Sequence
  chemically synthesized
gagagtcaacaggcaaccta

SEQ ID NO: 500284 - DNA, 20 bp, Artificial Sequence
  chemically synthesized
ggataatagccctttgtcag

SEQ ID NO: 500285 - DNA, 20 bp, Artificial Sequence
  chemically synthesized
tctgacaaagggctattatc

SEQ ID NO: 500286 - DNA, 20 bp, Artificial Sequence
  chemically synthesized
gtttaagttccttatagatt

SEQ ID NO: 500287 - DNA, 20 bp, Artificial Sequence
  chemically synthesized
atcctttgcccactttctga

SEQ ID NO: 500288 - DNA, 20 bp, Artificial Sequence
  chemically synthesized
accccatcagaaagtgggca

SEQ ID NO: 500289 - DNA, 20 bp, Artificial Sequence
  chemically synthesized
agatagcatctcacaccagt

SEQ ID NO: 500290 - DNA, 20 bp, Artificial Sequence
  chemically synthesized
cactcccaccaacagtgtaa

SEQ ID NO: 500291 - DNA, 20 bp, Artificial Sequence
  chemically synthesized
aactcttttacactgttggt

SEQ ID NO: 500292 - DNA, 20 bp, Artificial Sequence
  chemically synthesized
agacagtgtgcagattcctc

SEQ ID NO: 500293 - DNA, 20 bp, Artificial Sequence
  chemically synthesized
tttctggttctagatccttg

SEQ ID NO: 500294 - DNA, 20 bp, Artificial Sequence
  chemically synthesized
tatatccagtaatgggattg

SEQ ID NO: 500295 - DNA, 20 bp, Artificial Sequence
  chemically synthesized
ttgacccagcaatcccatta

SEQ ID NO: 500296 - DNA, 20 bp, Artificial Sequence
  chemically synthesized
tttgggtatatatccagtaa

SEQ ID NO: 500297 - DNA, 20 bp, Artificial Sequence
  chemically synthesized
cattactggatatataccca

SEQ ID NO: 500298 - DNA, 20 bp, Artificial Sequence
  chemically synthesized
gtaggatgatttataatcct

SEQ ID NO: 500299 - DNA, 20 bp, Artificial Sequence
  chemically synthesized
gtgtgcatgtgtctttatag

SEQ ID NO: 500300 - DNA, 20 bp, Artificial Sequence
  chemically synthesized
cagcactgttcacaatagca

SEQ ID NO: 500301 - DNA, 20 bp, Artificial Sequence
  chemically synthesized
agtctatcactggtgggcat

SEQ ID NO: 500302 - DNA, 20 bp, Artificial Sequence
  chemically synthesized
aaatgcccaccagtgataga

SEQ ID NO: 500303 - DNA, 20 bp, Artificial Sequence
  chemically synthesized
gacactatgcagccataaaa

SEQ ID NO: 500304 - DNA, 20 bp, Artificial Sequence
  chemically synthesized
ctatgcagccataaaaaaga

SEQ ID NO: 500305 - DNA, 20 bp, Artificial Sequence
  chemically synthesized
ttcgtgtcctttgcaggaac

SEQ ID NO: 500306 - DNA, 20 bp, Artificial Sequence
  chemically synthesized
tgttcctgtgttagtttgct

SEQ ID NO: 500307 - DNA, 20 bp, Artificial Sequence
  chemically synthesized
tgcatgttctcactgataat

SEQ ID NO: 500308 - DNA, 20 bp, Artificial Sequence
  chemically synthesized
atggccgcaggggcctgttg

SEQ ID NO: 500309 - DNA, 20 bp, Artificial Sequence
  chemically synthesized
ggcgggtggggggcaagggg

SEQ ID NO: 500310 - DNA, 20 bp, Artificial Sequence
  chemically synthesized
ctaatgtagatgacaggttg

SEQ ID NO: 500311 - DNA, 20 bp, Artificial Sequence
  chemically synthesized
ttttaattatacttaagttc

SEQ ID NO: 500312 - DNA, 20 bp, Artificial Sequence
  chemically synthesized
gaaaaaatcattcagtgaca

SEQ ID NO: 500313 - DNA, 20 bp, Artificial Sequence
  chemically synthesized
ttttattttatccagtgtca

SEQ ID NO: 500314 - DNA, 20 bp, Artificial Sequence
  chemically synthesized
cacgaattattattttctaa

SEQ ID NO: 500315 - DNA, 20 bp, Artificial Sequence
  chemically synthesized
cagaattctggtctgagagc

SEQ ID NO: 500316 - DNA, 20 bp, Artificial Sequence
  chemically synthesized
aataattcgtgctctcagac

SEQ ID NO: 500317 - DNA, 20 bp, Artificial Sequence
  chemically synthesized
ggatcttatttgctgagaca

SEQ ID NO: 500318 - DNA, 20 bp, Artificial Sequence
  chemically synthesized
gtttaggactatgattaaca

SEQ ID NO: 500319 - DNA, 20 bp, Artificial Sequence
  chemically synthesized
tagtcctaaaccagggctta

SEQ ID NO: 500320 - DNA, 20 bp, Artificial Sequence
  chemically synthesized
aagcttaacagatgagaagc

SEQ ID NO: 500321 - DNA, 20 bp, Artificial Sequence
  chemically synthesized
aataatctatggtagacaca

SEQ ID NO: 500322 - DNA, 20 bp, Artificial Sequence
  chemically synthesized
gtttttagtttaatgttctg

SEQ ID NO: 500323 - DNA, 20 bp, Artificial Sequence
  chemically synthesized
tcaaagaaaatctcttttag

SEQ ID NO: 500324 - DNA, 20 bp, Artificial Sequence
  chemically synthesized
aactcttgtacagagagtaa

SEQ ID NO: 500325 - DNA, 20 bp, Artificial Sequence
  chemically synthesized
catccttttactctctgtac

SEQ ID NO: 500326 - DNA, 20 bp, Artificial Sequence
  chemically synthesized
aaaaattgaactcttgtaca

SEQ ID NO: 500327 - DNA, 20 bp, Artificial Sequence
  chemically synthesized
atgatttctagaaccagata

SEQ ID NO: 500328 - DNA, 20 bp, Artificial Sequence
  chemically synthesized
caatggctaatatttctttt

SEQ ID NO: 500329 - DNA, 20 bp, Artificial Sequence
  chemically synthesized
tagccattgaactgcaggtt

SEQ ID NO: 500330 - DNA, 20 bp, Artificial Sequence
  chemically synthesized
catgccatggctgagcatgt

SEQ ID NO: 500331 - DNA, 20 bp, Artificial Sequence
  chemically synthesized
tattgattatgttcaaccat

SEQ ID NO: 500332 - DNA, 20 bp, Artificial Sequence
  chemically synthesized
gtttattactttagaaaaat

SEQ ID NO: 500333 - DNA, 20 bp, Artificial Sequence
  chemically synthesized
ttacttaattatcagtagtt

SEQ ID NO: 500334 - DNA, 20 bp, Artificial Sequence
  chemically synthesized
tttccattataaagataaat

SEQ ID NO: 500335 - DNA, 20 bp, Artificial Sequence
  chemically synthesized
tttaaatatatttaatgaag

SEQ ID NO: 500336 - DNA, 20 bp, Artificial Sequence
  chemically synthesized
tcagctgactagagaaaact

SEQ ID NO: 500337 - DNA, 20 bp, Artificial Sequence
  chemically synthesized
ctatttctcaagaaagttca

SEQ ID NO: 500338 - DNA, 20 bp, Artificial Sequence
  chemically synthesized
gtggtgtcaaaaagttattt

SEQ ID NO: 500339 - DNA, 20 bp, Artificial Sequence
  chemically synthesized
aacacggaattttctagaaa

SEQ ID NO: 500340 - DNA, 20 bp, Artificial Sequence
  chemically synthesized
aatattcaaacttaataaca

SEQ ID NO: 500341 - DNA, 20 bp, Artificial Sequence
  chemically synthesized
aaaattccgtgttattaagt

SEQ ID NO: 500342 - DNA, 20 bp, Artificial Sequence
  chemically synthesized
atcagattgctataataaat

SEQ ID NO: 500343 - DNA, 20 bp, Artificial Sequence
  chemically synthesized
atacaagaaactaccagaaa

SEQ ID NO: 500344 - DNA, 20 bp, Artificial Sequence
  chemically synthesized
ataggaatgctatactttta

SEQ ID NO: 500345 - DNA, 20 bp, Artificial Sequence
  chemically synthesized
attcgcatgactgtgtcaat

SEQ ID NO: 500346 - DNA, 20 bp, Artificial Sequence
  chemically synthesized
attcctattgacacagtcat

SEQ ID NO: 500347 - DNA, 20 bp, Artificial Sequence
  chemically synthesized
taatgagaaaactacatcca

SEQ ID NO: 500348 - DNA, 20 bp, Artificial Sequence
  chemically synthesized
accaaactgaaagtcattca

SEQ ID NO: 500349 - DNA, 20 bp, Artificial Sequence
  chemically synthesized
ggattaatctgaatgagtac

SEQ ID NO: 500350 - DNA, 20 bp, Artificial Sequence
  chemically synthesized
aatgaaaaggattaatctga

SEQ ID NO: 500351 - DNA, 20 bp, Artificial Sequence
  chemically synthesized
ttcaaatgaaaaggattaat

SEQ ID NO: 500352 - DNA, 20 bp, Artificial Sequence
  chemically synthesized
ttcagattaatccttttcat

SEQ ID NO: 500353 - DNA, 20 bp, Artificial Sequence
  chemically synthesized
gttaatgaaattcaaatgaa

SEQ ID NO: 500354 - DNA, 20 bp, Artificial Sequence
  chemically synthesized
tgaatttcattaactctgcc

SEQ ID NO: 500355 - DNA, 20 bp, Artificial Sequence
  chemically synthesized
aaggataaaattattcaagg

SEQ ID NO: 500356 - DNA, 20 bp, Artificial Sequence
  chemically synthesized
ccttgaataattttatcctt

SEQ ID NO: 500357 - DNA, 20 bp, Artificial Sequence
  chemically synthesized
ttgtacacatcagaactcag

SEQ ID NO: 500358 - DNA, 20 bp, Artificial Sequence
  chemically synthesized
ttgattttcaaaaggttaga

SEQ ID NO: 500359 - DNA, 20 bp, Artificial Sequence
  chemically synthesized
catttccttgctaatgatgc

SEQ ID NO: 500360 - DNA, 20 bp, Artificial Sequence
  chemically synthesized
aataaacacaaagaaataaa

SEQ ID NO: 500361 - DNA, 20 bp, Artificial Sequence
  chemically synthesized
ttttaaccatatatacccca

SEQ ID NO: 500362 - DNA, 20 bp, Artificial Sequence
  chemically synthesized
aatgaggctagtatattctt

SEQ ID NO: 500363 - DNA, 20 bp, Artificial Sequence
  chemically synthesized
ctgtgcctatttacacagct

SEQ ID NO: 500364 - DNA, 20 bp, Artificial Sequence
  chemically synthesized
caggtatcactcacaaagtt

SEQ ID NO: 500365 - DNA, 20 bp, Artificial Sequence
  chemically synthesized
gaaaatgtattcaaaacttt

SEQ ID NO: 500366 - DNA, 20 bp, Artificial Sequence
  chemically synthesized
tgtgataacttaagtttcag

SEQ ID NO: 500367 - DNA, 20 bp, Artificial Sequence
  chemically synthesized
aacaaattttatgtaatgaa

SEQ ID NO: 500368 - DNA, 20 bp, Artificial Sequence
  chemically synthesized
cttgaagggccataactgca

SEQ ID NO: 500369 - DNA, 20 bp, Artificial Sequence
  chemically synthesized
atgcaccatttgtttcaaaa

SEQ ID NO: 500370 - DNA, 20 bp, Artificial Sequence
  chemically synthesized
ttgaggttactggcccattt

SEQ ID NO: 500371 - DNA, 20 bp, Artificial Sequence
  chemically synthesized
catatagcacatttttcttc

SEQ ID NO: 500372 - DNA, 20 bp, Artificial Sequence
  chemically synthesized
tcattaataaatcttacttt

SEQ ID NO: 500373 - DNA, 20 bp, Artificial Sequence
  chemically synthesized
aagggacattcttaaatatt

SEQ ID NO: 500374 - DNA, 20 bp, Artificial Sequence
  chemically synthesized
ttaaataatccataatattt

SEQ ID NO: 500375 - DNA, 20 bp, Artificial Sequence
  chemically synthesized
ttaaagcctgcagtcctatt

SEQ ID NO: 500376 - DNA, 20 bp, Artificial Sequence
  chemically synthesized
caggctttaagtaggttctg

SEQ ID NO: 500377 - DNA, 20 bp, Artificial Sequence
  chemically synthesized
agaaagacaagtttccttct

SEQ ID NO: 500378 - DNA, 20 bp, Artificial Sequence
  chemically synthesized
gcaaaaatattgtattggtc

SEQ ID NO: 500379 - DNA, 20 bp, Artificial Sequence
  chemically synthesized
tgtttttatgctttattgtt

SEQ ID NO: 500380 - DNA, 20 bp, Artificial Sequence
  chemically synthesized
aacaacatgatgcaggtgag

SEQ ID NO: 500381 - DNA, 20 bp, Artificial Sequence
  chemically synthesized
taatctgcgttgtcactgtt

SEQ ID NO: 500382 - DNA, 20 bp, Artificial Sequence
  chemically synthesized
cagacaaaacgaagtactgt

SEQ ID NO: 500383 - DNA, 20 bp, Artificial Sequence
  chemically synthesized
tgtctgttttagtcaagtca

SEQ ID NO: 500384 - DNA, 20 bp, Artificial Sequence
  chemically synthesized
agtcactgggtagaaagatg

SEQ ID NO: 500385 - DNA, 20 bp, Artificial Sequence
  chemically synthesized
gatgttgaataatcaatcta

SEQ ID NO: 500386 - DNA, 20 bp, Artificial Sequence
  chemically synthesized
catagaaaaaatagcaatga

SEQ ID NO: 500387 - DNA, 20 bp, Artificial Sequence
  chemically synthesized
aaaaaagggcctgtccatct

SEQ ID NO: 500388 - DNA, 20 bp, Artificial Sequence
  chemically synthesized
tccatctcagaataattatt

SEQ ID NO: 500389 - DNA, 20 bp, Artificial Sequence
  chemically synthesized
gggtaaattgttcattgatt

SEQ ID NO: 500390 - DNA, 20 bp, Artificial Sequence
  chemically synthesized
ttttattctttttaaacaaa

SEQ ID NO: 500391 - DNA, 20 bp, Artificial Sequence
  chemically synthesized
atttaccccctttgtttaaa

SEQ ID NO: 500392 - DNA, 20 bp, Artificial Sequence
  chemically synthesized
tgactattttgtgtatgtta

SEQ ID NO: 500393 - DNA, 20 bp, Artificial Sequence
  chemically synthesized
aaataaataatatgggcata

SEQ ID NO: 500394 - DNA, 20 bp, Artificial Sequence
  chemically synthesized
tattatttattttctaaagt

SEQ ID NO: 500395 - DNA, 20 bp, Artificial Sequence
  chemically synthesized
aaaaagatatgcagatgatg

SEQ ID NO: 500396 - DNA, 20 bp, Artificial Sequence
  chemically synthesized
tatacctggccttctagaag

SEQ ID NO: 500397 - DNA, 20 bp, Artificial Sequence
  chemically synthesized
tgctcattgacctgcctcat

SEQ ID NO: 500398 - DNA, 20 bp, Artificial Sequence
  chemically synthesized
aatttcatggtgtagaaagt

SEQ ID NO: 500399 - DNA, 20 bp, Artificial Sequence
  chemically synthesized
agtaattgagcttggccctg

SEQ ID NO: 500400 - DNA, 20 bp, Artificial Sequence
  chemically synthesized
tatcaaattaagctgataaa

SEQ ID NO: 500401 - DNA, 20 bp, Artificial Sequence
  chemically synthesized
catttttatacagattttca

SEQ ID NO: 500402 - DNA, 20 bp, Artificial Sequence
  chemically synthesized
ttgctgccttataagttggc

SEQ ID NO: 500403 - DNA, 20 bp, Artificial Sequence
  chemically synthesized
ctgtatgctaggtactaggc

SEQ ID NO: 500404 - DNA, 20 bp, Artificial Sequence
  chemically synthesized
tatgttatcaaaaatatttg

SEQ ID NO: 500405 - DNA, 20 bp, Artificial Sequence
  chemically synthesized
aaaaacaagtatcaacttaa

SEQ ID NO: 500406 - DNA, 20 bp, Artificial Sequence
  chemically synthesized
agatatgtggttacaattgc

SEQ ID NO: 500407 - DNA, 20 bp, Artificial Sequence
  chemically synthesized
tacatttataatttatattt

SEQ ID NO: 500408 - DNA, 20 bp, Artificial Sequence
  chemically synthesized
aatttatatttaggaatatt

SEQ ID NO: 500409 - DNA, 20 bp, Artificial Sequence
  chemically synthesized
aaaatattcctgtttgaatt

SEQ ID NO: 500410 - DNA, 20 bp, Artificial Sequence
  chemically synthesized
ggaatattcagaattcaaac

SEQ ID NO: 500411 - DNA, 20 bp, Artificial Sequence
  chemically synthesized
aatgaagaaaatattcctgt

SEQ ID NO: 500412 - DNA, 20 bp, Artificial Sequence
  chemically synthesized
tagcatgtagctaatgtgct

SEQ ID NO: 500413 - DNA, 20 bp, Artificial Sequence
  chemically synthesized
actaatctgactcattatac

SEQ ID NO: 500414 - DNA, 20 bp, Artificial Sequence
  chemically synthesized
tatgtttgtattcaagtata

SEQ ID NO: 500415 - DNA, 20 bp, Artificial Sequence
  chemically synthesized
atactgattttagcttcttc

SEQ ID NO: 500416 - DNA, 20 bp, Artificial Sequence
  chemically synthesized
taatgtctattagcaaattg

SEQ ID NO: 500417 - DNA, 20 bp, Artificial Sequence
  chemically synthesized
tcaaaggttaaaatgatttt

SEQ ID NO: 500418 - DNA, 20 bp, Artificial Sequence
  chemically synthesized
ttttatgagaagagtttggg

SEQ ID NO: 500419 - DNA, 20 bp, Artificial Sequence
  chemically synthesized
taaacgaaaacttttatgag

SEQ ID NO: 500420 - DNA, 20 bp, Artificial Sequence
  chemically synthesized
gtattcccaagctgaaattt

SEQ ID NO: 500421 - DNA, 20 bp, Artificial Sequence
  chemically synthesized
ctattccaaaatttcagctt

SEQ ID NO: 500422 - DNA, 20 bp, Artificial Sequence
  chemically synthesized
gtatgtgtgtgaggtggagg

SEQ ID NO: 500423 - DNA, 20 bp, Artificial Sequence
  chemically synthesized
gtgttacttttattttcaca

SEQ ID NO: 500424 - DNA, 20 bp, Artificial Sequence
  chemically synthesized
agaagttaaaagcgatatag

SEQ ID NO: 500425 - DNA, 20 bp, Artificial Sequence
  chemically synthesized
cttttaacttctgttgcctt

SEQ ID NO: 500426 - DNA, 20 bp, Artificial Sequence
  chemically synthesized
tgccttgtggatctgtcaac

SEQ ID NO: 500427 - DNA, 20 bp, Artificial Sequence
  chemically synthesized
gtcaacttgagtagattttt

SEQ ID NO: 500428 - DNA, 20 bp, Artificial Sequence
  chemically synthesized
tgtaatatagaaataaaagt

SEQ ID NO: 500429 - DNA, 20 bp, Artificial Sequence
  chemically synthesized
gatagtgtccacattttctg

SEQ ID NO: 500430 - DNA, 20 bp, Artificial Sequence
  chemically synthesized
tgcatatttagacatagata

SEQ ID NO: 500431 - DNA, 20 bp, Artificial Sequence
  chemically synthesized
tcactcgcatttctaatgaa

SEQ ID NO: 500432 - DNA, 20 bp, Artificial Sequence
  chemically synthesized
gtattctcttcattagaaat

SEQ ID NO: 500433 - DNA, 20 bp, Artificial Sequence
  chemically synthesized
tgtagctaatgactaccata

SEQ ID NO: 500434 - DNA, 20 bp, Artificial Sequence
  chemically synthesized
tataggacagtgctaatcta

SEQ ID NO: 500435 - DNA, 20 bp, Artificial Sequence
  chemically synthesized
ccctttggacagagactgag

SEQ ID NO: 500436 - DNA, 20 bp, Artificial Sequence
  chemically synthesized
gacagccctttggacagaga

SEQ ID NO: 500437 - DNA, 20 bp, Artificial Sequence
  chemically synthesized
ccattataaaagaatattaa

SEQ ID NO: 500438 - DNA, 20 bp, Artificial Sequence
  chemically synthesized
ttgtatgattgccattataa

SEQ ID NO: 500439 - DNA, 20 bp, Artificial Sequence
  chemically synthesized
aatgtgaaaactaagattat

SEQ ID NO: 500440 - DNA, 20 bp, Artificial Sequence
  chemically synthesized
gatagatataataccagcat

SEQ ID NO: 500441 - DNA, 20 bp, Artificial Sequence
  chemically synthesized
tcaccttgtgacattttagt

SEQ ID NO: 500442 - DNA, 20 bp, Artificial Sequence
  chemically synthesized
atagaataataacaaattag

SEQ ID NO: 500443 - DNA, 20 bp, Artificial Sequence
  chemically synthesized
tcagtaaaatcaattggata

SEQ ID NO: 500444 - DNA, 20 bp, Artificial Sequence
  chemically synthesized
tagcaattcagtaaaatcaa

SEQ ID NO: 500445 - DNA, 20 bp, Artificial Sequence
  chemically synthesized
tctatatccaattgatttta

SEQ ID NO: 500446 - DNA, 20 bp, Artificial Sequence
  chemically synthesized
taaattaattatcttcagag

SEQ ID NO: 500447 - DNA, 20 bp, Artificial Sequence
  chemically synthesized
gtttttaaattaattatctt

SEQ ID NO: 500448 - DNA, 20 bp, Artificial Sequence
  chemically synthesized
taatttaaaaacctattatt

SEQ ID NO: 500449 - DNA, 20 bp, Artificial Sequence
  chemically synthesized
acacacaaaatagaaatgtt

SEQ ID NO: 500450 - DNA, 20 bp, Artificial Sequence
  chemically synthesized
acaaaatagaaatgttgaga

SEQ ID NO: 500451 - DNA, 20 bp, Artificial Sequence
  chemically synthesized
gttttctgtttcactttgaa

SEQ ID NO: 500452 - DNA, 20 bp, Artificial Sequence
  chemically synthesized
aactaactgctacaatttag

SEQ ID NO: 500453 - DNA, 20 bp, Artificial Sequence
  chemically synthesized
aaaaaaattgcaggtgaaga

SEQ ID NO: 500454 - DNA, 20 bp, Artificial Sequence
  chemically synthesized
cacgatctgagacagaaatg

SEQ ID NO: 500455 - DNA, 20 bp, Artificial Sequence
  chemically synthesized
atggttttcaagtatatatg

SEQ ID NO: 500456 - DNA, 20 bp, Artificial Sequence
  chemically synthesized
agatctgtttgacttaagaa

SEQ ID NO: 500457 - DNA, 20 bp, Artificial Sequence
  chemically synthesized
gtttcatgcaggcattactg

SEQ ID NO: 500458 - DNA, 20 bp, Artificial Sequence
  chemically synthesized
catctctgatctcatggaca

SEQ ID NO: 500459 - DNA, 20 bp, Artificial Sequence
  chemically synthesized
ttttcccatatgtaaatttt

SEQ ID NO: 500460 - DNA, 20 bp, Artificial Sequence
  chemically synthesized
gttgttgttgttttgatctg

SEQ ID NO: 500461 - DNA, 20 bp, Artificial Sequence
  chemically synthesized
gtgattgattgagaagcaac

SEQ ID NO: 500462 - DNA, 20 bp, Artificial Sequence
  chemically synthesized
tttctctcatgcctaagtca

SEQ ID NO: 500463 - DNA, 20 bp, Artificial Sequence
  chemically synthesized
ctggagagaaagacaaagct

SEQ ID NO: 500464 - DNA, 20 bp, Artificial Sequence
  chemically synthesized
acaatagacaacttagaaaa

SEQ ID NO: 500465 - DNA, 20 bp, Artificial Sequence
  chemically synthesized
atcatggctaaaaataaaat

SEQ ID NO: 500466 - DNA, 20 bp, Artificial Sequence
  chemically synthesized
tattaagcaatgataagtac

SEQ ID NO: 500467 - DNA, 20 bp, Artificial Sequence
  chemically synthesized
tatttaattcttttttgcac

SEQ ID NO: 500468 - DNA, 20 bp, Artificial Sequence
  chemically synthesized
aacgttacccaagtgcaaaa

SEQ ID NO: 500469 - DNA, 20 bp, Artificial Sequence
  chemically synthesized
aaaaaagaattaaataagtg

SEQ ID NO: 500470 - DNA, 20 bp, Artificial Sequence
  chemically synthesized
acctcagcctcctaaagtgc

SEQ ID NO: 500471 - DNA, 20 bp, Artificial Sequence
  chemically synthesized
tgagaagattacttgattcc

SEQ ID NO: 500472 - DNA, 20 bp, Artificial Sequence
  chemically synthesized
ccaggctggtcttgaactcc

SEQ ID NO: 500473 - DNA, 20 bp, Artificial Sequence
  chemically synthesized
cactaaagaggctgaggcaa

SEQ ID NO: 500474 - DNA, 20 bp, Artificial Sequence
  chemically synthesized
caataggatctcctgagcct

SEQ ID NO: 500475 - DNA, 20 bp, Artificial Sequence
  chemically synthesized
ggtcttgctattgcccaagc

SEQ ID NO: 500476 - DNA, 20 bp, Artificial Sequence
  chemically synthesized
ttttgtttttatttttgaga

SEQ ID NO: 500477 - DNA, 20 bp, Artificial Sequence
  chemically synthesized
gatgggacagacagcaactt

SEQ ID NO: 500478 - DNA, 20 bp, Artificial Sequence
  chemically synthesized
caaataaatgatacttggac

SEQ ID NO: 500479 - DNA, 20 bp, Artificial Sequence
  chemically synthesized
aaaaaagaggagagatatta

SEQ ID NO: 500480 - DNA, 20 bp, Artificial Sequence
  chemically synthesized
cagtcatcatgatggattta

SEQ ID NO: 500481 - DNA, 20 bp, Artificial Sequence
  chemically synthesized
tttgctttgcagtcatcatg

SEQ ID NO: 500482 - DNA, 20 bp, Artificial Sequence
  chemically synthesized
aatgtcctcgtaaaaacata

SEQ ID NO: 500483 - DNA, 20 bp, Artificial Sequence
  chemically synthesized
acagttggccctctgtatcc

SEQ ID NO: 500484 - DNA, 20 bp, Artificial Sequence
  chemically synthesized
aatccacaaatgtggaaccc

SEQ ID NO: 500485 - DNA, 20 bp, Artificial Sequence
  chemically synthesized
tatccatgggttccacattt

SEQ ID NO: 500486 - DNA, 20 bp, Artificial Sequence
  chemically synthesized
gaacacatttgcaaaaatac

SEQ ID NO: 500487 - DNA, 20 bp, Artificial Sequence
  chemically synthesized
ttgttatgcagtattgttta

SEQ ID NO: 500488 - DNA, 20 bp, Artificial Sequence
  chemically synthesized
tacatagcatttacattgta

SEQ ID NO: 500489 - DNA, 20 bp, Artificial Sequence
  chemically synthesized
agatgatatgaagtgttcag

SEQ ID NO: 500490 - DNA, 20 bp, Artificial Sequence
  chemically synthesized
tgccattttatataaataat

SEQ ID NO: 500491 - DNA, 20 bp, Artificial Sequence
  chemically synthesized
tataaataatttgagtattc

SEQ ID NO: 500492 - DNA, 20 bp, Artificial Sequence
  chemically synthesized
gcattttgatatcaaaattc

SEQ ID NO: 500493 - DNA, 20 bp, Artificial Sequence
  chemically synthesized
ccagtgccccacagacactg

SEQ ID NO: 500494 - DNA, 20 bp, Artificial Sequence
  chemically synthesized
ttataaattatttcttttta

SEQ ID NO: 500495 - DNA, 20 bp, Artificial Sequence
  chemically synthesized
gcctttgattgaaaataatg

SEQ ID NO: 500496 - DNA, 20 bp, Artificial Sequence
  chemically synthesized
aagtgcgggaagagatgcag

SEQ ID NO: 500497 - DNA, 20 bp, Artificial Sequence
  chemically synthesized
agagtgcagtgaagaagatg

SEQ ID NO: 500498 - DNA, 20 bp, Artificial Sequence
  chemically synthesized
gaattataaaattatagaca

SEQ ID NO: 500499 - DNA, 20 bp, Artificial Sequence
  chemically synthesized
taaaattatagacaagggat

SEQ ID NO: 500500 - DNA, 20 bp, Artificial Sequence
  chemically synthesized
taatgaccatcaatatgaca

SEQ ID NO: 500501 - DNA, 20 bp, Artificial Sequence
  chemically synthesized
attaaaacagacacagttat

SEQ ID NO: 500502 - DNA, 20 bp, Artificial Sequence
  chemically synthesized
aagatcaagcacgtattggt

SEQ ID NO: 500503 - DNA, 20 bp, Artificial Sequence
  chemically synthesized
tatagataccagaggctggg

SEQ ID NO: 500504 - DNA, 20 bp, Artificial Sequence
  chemically synthesized
ctgggaagagtgtaggtggg

SEQ ID NO: 500505 - DNA, 20 bp, Artificial Sequence
  chemically synthesized
gaagagtgtaggtgggcgga

SEQ ID NO: 500506 - DNA, 20 bp, Artificial Sequence
  chemically synthesized
gggtgaagagagattggtta

SEQ ID NO: 500507 - DNA, 20 bp, Artificial Sequence
  chemically synthesized
cggacatacagttgcataga

SEQ ID NO: 500508 - DNA, 20 bp, Artificial Sequence
  chemically synthesized
taagtgctaatgtttgaaag

SEQ ID NO: 500509 - DNA, 20 bp, Artificial Sequence
  chemically synthesized
gctaatgtttgaaagaagag

SEQ ID NO: 500510 - DNA, 20 bp, Artificial Sequence
  chemically synthesized
tctcaaaatacctagaagag

SEQ ID NO: 500511 - DNA, 20 bp, Artificial Sequence
  chemically synthesized
aatgataaatacttgagatg

SEQ ID NO: 500512 - DNA, 20 bp, Artificial Sequence
  chemically synthesized
aatgattaagtcaggatagt

SEQ ID NO: 500513 - DNA, 20 bp, Artificial Sequence
  chemically synthesized
agaatgtataatgattaagt

SEQ ID NO: 500514 - DNA, 20 bp, Artificial Sequence
  chemically synthesized
gtaatattttgctacatgca

SEQ ID NO: 500515 - DNA, 20 bp, Artificial Sequence
  chemically synthesized
caaatatttttacatcttta

SEQ ID NO: 500516 - DNA, 20 bp, Artificial Sequence
  chemically synthesized
tcttgtaaacagcctataga

SEQ ID NO: 500517 - DNA, 20 bp, Artificial Sequence
  chemically synthesized
tcaagaccgaaaagcactaa

SEQ ID NO: 500518 - DNA, 20 bp, Artificial Sequence
  chemically synthesized
aattgctatgccccaaacaa

SEQ ID NO: 500519 - DNA, 20 bp, Artificial Sequence
  chemically synthesized
ctagtaatttttaccttatg

SEQ ID NO: 500520 - DNA, 20 bp, Artificial Sequence
  chemically synthesized
tttaatctaacaaattacag

SEQ ID NO: 500521 - DNA, 20 bp, Artificial Sequence
  chemically synthesized
aaaaaatacaaataaaaaac

SEQ ID NO: 500522 - DNA, 20 bp, Artificial Sequence
  chemically synthesized
ttttccagtgtgcacaaaat

SEQ ID NO: 500523 - DNA, 20 bp, Artificial Sequence
  chemically synthesized
ttgatgtcccaagtaaatag

SEQ ID NO: 500524 - DNA, 20 bp, Artificial Sequence
  chemically synthesized
tctattattcttctacattt

SEQ ID NO: 500525 - DNA, 20 bp, Artificial Sequence
  chemically synthesized
ataataatccagaaatgtag

SEQ ID NO: 500526 - DNA, 20 bp, Artificial Sequence
  chemically synthesized
ccagaaatgtagaagaataa

SEQ ID NO: 500527 - DNA, 20 bp, Artificial Sequence
  chemically synthesized
ctttgtgaaagtcttagatg

SEQ ID NO: 500528 - DNA, 20 bp, Artificial Sequence
  chemically synthesized
catcatctaagactttcaca

SEQ ID NO: 500529 - DNA, 20 bp, Artificial Sequence
  chemically synthesized
gttatatttaaaataataca

SEQ ID NO: 500530 - DNA, 20 bp, Artificial Sequence
  chemically synthesized
tatatatactattcattggt

SEQ ID NO: 500531 - DNA, 20 bp, Artificial Sequence
  chemically synthesized
tatactgttcattcttacca

SEQ ID NO: 500532 - DNA, 20 bp, Artificial Sequence
  chemically synthesized
tggtaagaatgaacagtata

SEQ ID NO: 500533 - DNA, 20 bp, Artificial Sequence
  chemically synthesized
tttttttgcttcagtgaggg

SEQ ID NO: 500534 - DNA, 20 bp, Artificial Sequence
  chemically synthesized
ttcagtgagggaggaatcag

SEQ ID NO: 500535 - DNA, 20 bp, Artificial Sequence
  chemically synthesized
atcagcagaatgaagaaatg

SEQ ID NO: 500536 - DNA, 20 bp, Artificial Sequence
  chemically synthesized
agagctctgaactagcacta

SEQ ID NO: 500537 - DNA, 20 bp, Artificial Sequence
  chemically synthesized
gatacagatttcaaggtaaa

SEQ ID NO: 500538 - DNA, 20 bp, Artificial Sequence
  chemically synthesized
agtacatgccttcctgcagc

SEQ ID NO: 500539 - DNA, 20 bp, Artificial Sequence
  chemically synthesized
ctaagacaaaattcagaagg

SEQ ID NO: 500540 - DNA, 20 bp, Artificial Sequence
  chemically synthesized
aaatgctttcattctccctt

SEQ ID NO: 500541 - DNA, 20 bp, Artificial Sequence
  chemically synthesized
actgcatacccaattgacag

SEQ ID NO: 500542 - DNA, 20 bp, Artificial Sequence
  chemically synthesized
tgccacgactcttctgtcaa

SEQ ID NO: 500543 - DNA, 20 bp, Artificial Sequence
  chemically synthesized
gctgttgcccatgaagtaaa

SEQ ID NO: 500544 - DNA, 20 bp, Artificial Sequence
  chemically synthesized
tgttaaatttcctcatctcc

SEQ ID NO: 500545 - DNA, 20 bp, Artificial Sequence
  chemically synthesized
agtattggatgctgtcacat

SEQ ID NO: 500546 - DNA, 20 bp, Artificial Sequence
  chemically synthesized
caattaaaatatatcgagta

SEQ ID NO: 500547 - DNA, 20 bp, Artificial Sequence
  chemically synthesized
ttaagatcaattaaaatata

SEQ ID NO: 500548 - DNA, 20 bp, Artificial Sequence
  chemically synthesized
aaaaaaaaaaaaaaaaaaaa

SEQ ID NO: 500549 - DNA, 20 bp, Artificial Sequence
  chemically synthesized
ttttttttttttttttgaga

SEQ ID NO: 500550 - DNA, 20 bp, Artificial Sequence
  chemically synthesized
tctcgctctgttgcccaggc

SEQ ID NO: 500551 - DNA, 20 bp, Artificial Sequence
  chemically synthesized
agctaaatgtttactttggc

SEQ ID NO: 500552 - DNA, 20 bp, Artificial Sequence
  chemically synthesized
gccaaagtaaacatttagct

SEQ ID NO: 500553 - DNA, 20 bp, Artificial Sequence
  chemically synthesized
aaacaaaaagttgtattttt

SEQ ID NO: 500554 - DNA, 20 bp, Artificial Sequence
  chemically synthesized
agtgacttcaaatacatggg

SEQ ID NO: 500555 - DNA, 20 bp, Artificial Sequence
  chemically synthesized
taactctcaaacttgttatt

SEQ ID NO: 500556 - DNA, 20 bp, Artificial Sequence
  chemically synthesized
taattccaaataacaagttt

SEQ ID NO: 500557 - DNA, 20 bp, Artificial Sequence
  chemically synthesized
tttcaaagaagaatagaatg

SEQ ID NO: 500558 - DNA, 20 bp, Artificial Sequence
  chemically synthesized
gtgcatatttcaaagaagaa

SEQ ID NO: 500559 - DNA, 20 bp, Artificial Sequence
  chemically synthesized
ttgttgtgcatatttcaaag

SEQ ID NO: 500560 - DNA, 20 bp, Artificial Sequence
  chemically synthesized
ggttattctccatcttttag

SEQ ID NO: 500561 - DNA, 20 bp, Artificial Sequence
  chemically synthesized
aggaactcgactaaaagatg

SEQ ID NO: 500562 - DNA, 20 bp, Artificial Sequence
  chemically synthesized
ctacaaaaatcataatcttg

SEQ ID NO: 500563 - DNA, 20 bp, Artificial Sequence
  chemically synthesized
taagcatatgtgtaacatat

SEQ ID NO: 500564 - DNA, 20 bp, Artificial Sequence
  chemically synthesized
tgagccatggcgcccagccc

SEQ ID NO: 500565 - DNA, 20 bp, Artificial Sequence
  chemically synthesized
gcctcggcctcccaaagtgc

SEQ ID NO: 500566 - DNA, 20 bp, Artificial Sequence
  chemically synthesized
caggcagatcatttgaggtc

SEQ ID NO: 500567 - DNA, 20 bp, Artificial Sequence
  chemically synthesized
ttttatttttttagtacaga

SEQ ID NO: 500568 - DNA, 20 bp, Artificial Sequence
  chemically synthesized
gcctcaacctccagagttgc

SEQ ID NO: 500569 - DNA, 20 bp, Artificial Sequence
  chemically synthesized
gattctcctgcctcaacctc

SEQ ID NO: 500570 - DNA, 20 bp, Artificial Sequence
  chemically synthesized
aactctggaggttgaggcag

SEQ ID NO: 500571 - DNA, 20 bp, Artificial Sequence
  chemically synthesized
tcacttgaacctgggagaca

SEQ ID NO: 500572 - DNA, 20 bp, Artificial Sequence
  chemically synthesized
tcatgccactgcactccagc

SEQ ID NO: 500573 - DNA, 20 bp, Artificial Sequence
  chemically synthesized
tctcaccctgtcacccaggc

SEQ ID NO: 500574 - DNA, 20 bp, Artificial Sequence
  chemically synthesized
ctgcactccagcctgggtga

SEQ ID NO: 500575 - DNA, 20 bp, Artificial Sequence
  chemically synthesized
tccagcctgggtgacagggt

SEQ ID NO: 500576 - DNA, 20 bp, Artificial Sequence
  chemically synthesized
aaaagtatttacctaactat

SEQ ID NO: 500577 - DNA, 20 bp, Artificial Sequence
  chemically synthesized
gtttatttcattttatactt

SEQ ID NO: 500578 - DNA, 20 bp, Artificial Sequence
  chemically synthesized
gcaacacagatgagagaggg

SEQ ID NO: 500579 - DNA, 20 bp, Artificial Sequence
  chemically synthesized
ctaaattatttccccaaact

SEQ ID NO: 500580 - DNA, 20 bp, Artificial Sequence
  chemically synthesized
aggagataatagctgcagcc

SEQ ID NO: 500581 - DNA, 20 bp, Artificial Sequence
  chemically synthesized
tgaagtcaaaatgggacaga

SEQ ID NO: 500582 - DNA, 20 bp, Artificial Sequence
  chemically synthesized
aaagagataattaagtttat

SEQ ID NO: 500583 - DNA, 20 bp, Artificial Sequence
  chemically synthesized
tttttaaaaaatctccaaaa

SEQ ID NO: 500584 - DNA, 20 bp, Artificial Sequence
  chemically synthesized
tacttatatttcattatgaa

SEQ ID NO: 500585 - DNA, 20 bp, Artificial Sequence
  chemically synthesized
taatgaaatataagtaagct

SEQ ID NO: 500586 - DNA, 20 bp, Artificial Sequence
  chemically synthesized
aaccttaaaaaatcaatttt

SEQ ID NO: 500587 - DNA, 20 bp, Artificial Sequence
  chemically synthesized
acacagccaagagtcaggaa

SEQ ID NO: 500588 - DNA, 20 bp, Artificial Sequence
  chemically synthesized
ctgcaacacagccaagagtc

SEQ ID NO: 500589 - DNA, 20 bp, Artificial Sequence
  chemically synthesized
aatttacctgcaacacagcc

SEQ ID NO: 500590 - DNA, 20 bp, Artificial Sequence
  chemically synthesized
aaatgatatccatctgacct

SEQ ID NO: 500591 - DNA, 20 bp, Artificial Sequence
  chemically synthesized
tttatttattcagaggtcag

SEQ ID NO: 500592 - DNA, 20 bp, Artificial Sequence
  chemically synthesized
aattcacaaaacttttaaaa

SEQ ID NO: 500593 - DNA, 20 bp, Artificial Sequence
  chemically synthesized
aattcttttttaaaagtttt

SEQ ID NO: 500594 - DNA, 20 bp, Artificial Sequence
  chemically synthesized
gctattttaggagaaactat

SEQ ID NO: 500595 - DNA, 20 bp, Artificial Sequence
  chemically synthesized
tcattgtattatcctatggc

SEQ ID NO: 500596 - DNA, 20 bp, Artificial Sequence
  chemically synthesized
ttatattggaatccttgcca

SEQ ID NO: 500597 - DNA, 20 bp, Artificial Sequence
  chemically synthesized
agaatagaacaattttatat

SEQ ID NO: 500598 - DNA, 20 bp, Artificial Sequence
  chemically synthesized
aaacttgtaaattttctgga

SEQ ID NO: 500599 - DNA, 20 bp, Artificial Sequence
  chemically synthesized
attgtgtcaatatgagtttt

SEQ ID NO: 500600 - DNA, 20 bp, Artificial Sequence
  chemically synthesized
tgaaaattgattgtgtcaat

SEQ ID NO: 500601 - DNA, 20 bp, Artificial Sequence
  chemically synthesized
tcaaaatatatgatctaaaa

SEQ ID NO: 500602 - DNA, 20 bp, Artificial Sequence
  chemically synthesized
aaaggtaattaactgagaac

SEQ ID NO: 500603 - DNA, 20 bp, Artificial Sequence
  chemically synthesized
tttcacttctcaaaactttt

SEQ ID NO: 500604 - DNA, 20 bp, Artificial Sequence
  chemically synthesized
ttatttaagaaataattggt

SEQ ID NO: 500605 - DNA, 20 bp, Artificial Sequence
  chemically synthesized
ttaactaaaatgatgaacgt

SEQ ID NO: 500606 - DNA, 20 bp, Artificial Sequence
  chemically synthesized
attatgatcactgggaaata

SEQ ID NO: 500607 - DNA, 20 bp, Artificial Sequence
  chemically synthesized
gaaaatgtaatacttctgtt

SEQ ID NO: 500608 - DNA, 20 bp, Artificial Sequence
  chemically synthesized
cttctgttttgaattaattt

SEQ ID NO: 500609 - DNA, 20 bp, Artificial Sequence
  chemically synthesized
tatcatttcctgatgatatt

SEQ ID NO: 500610 - DNA, 20 bp, Artificial Sequence
  chemically synthesized
catcaggaaatgatactatt

SEQ ID NO: 500611 - DNA, 20 bp, Artificial Sequence
  chemically synthesized
caaaaacagattcaaatcca

SEQ ID NO: 500612 - DNA, 20 bp, Artificial Sequence
  chemically synthesized
aatattttcatcctctggat

SEQ ID NO: 500613 - DNA, 20 bp, Artificial Sequence
  chemically synthesized
tgtataaatattttcatcct

SEQ ID NO: 500614 - DNA, 20 bp, Artificial Sequence
  chemically synthesized
tacacaaaaaagagtagaat

SEQ ID NO: 500615 - DNA, 20 bp, Artificial Sequence
  chemically synthesized
acaaaatacacaaaaaagag

SEQ ID NO: 500616 - DNA, 20 bp, Artificial Sequence
  chemically synthesized
acaagacaaaatacacaaaa

SEQ ID NO: 500617 - DNA, 20 bp, Artificial Sequence
  chemically synthesized
acatgtgacaaaataaattc

SEQ ID NO: 500618 - DNA, 20 bp, Artificial Sequence
  chemically synthesized
tatccactggaataacattc

SEQ ID NO: 500619 - DNA, 20 bp, Artificial Sequence
  chemically synthesized
aattcaagaatgttattcca

SEQ ID NO: 500620 - DNA, 20 bp, Artificial Sequence
  chemically synthesized
gccccataacagttatccac

SEQ ID NO: 500621 - DNA, 20 bp, Artificial Sequence
  chemically synthesized
atattggttgcttgaagttt

SEQ ID NO: 500622 - DNA, 20 bp, Artificial Sequence
  chemically synthesized
aaccaatatagaaacttagc

SEQ ID NO: 500623 - DNA, 20 bp, Artificial Sequence
  chemically synthesized
agataaatttatttacatga

SEQ ID NO: 500624 - DNA, 20 bp, Artificial Sequence
  chemically synthesized
ttgtcctttctttcaaaatt

SEQ ID NO: 500625 - DNA, 20 bp, Artificial Sequence
  chemically synthesized
aaagcaaagttttttaatgc

SEQ ID NO: 500626 - DNA, 20 bp, Artificial Sequence
  chemically synthesized
ggaccatggcagactggcat

SEQ ID NO: 500627 - DNA, 20 bp, Artificial Sequence
  chemically synthesized
acaaccaactctgaaactgc

SEQ ID NO: 500628 - DNA, 20 bp, Artificial Sequence
  chemically synthesized
tgtggaaatccctgcagttt

SEQ ID NO: 500629 - DNA, 20 bp, Artificial Sequence
  chemically synthesized
tggaatgaatgattgaatga

SEQ ID NO: 500630 - DNA, 20 bp, Artificial Sequence
  chemically synthesized
tatgtggaatgaatgattga

SEQ ID NO: 500631 - DNA, 20 bp, Artificial Sequence
  chemically synthesized
aaagtatgtggaatgaatga

SEQ ID NO: 500632 - DNA, 20 bp, Artificial Sequence
  chemically synthesized
atttaatgaaagtatgtgga

SEQ ID NO: 500633 - DNA, 20 bp, Artificial Sequence
  chemically synthesized
aggtatttaatgaaagtatg

SEQ ID NO: 500634 - DNA, 20 bp, Artificial Sequence
  chemically synthesized
gtcactgtttccccaagaca

SEQ ID NO: 500635 - DNA, 20 bp, Artificial Sequence
  chemically synthesized
ggaaacagtgactaacaaga

SEQ ID NO: 500636 - DNA, 20 bp, Artificial Sequence
  chemically synthesized
tataatttgtctgctatcat

SEQ ID NO: 500637 - DNA, 20 bp, Artificial Sequence
  chemically synthesized
atgttctagagcatgatggt

SEQ ID NO: 500638 - DNA, 20 bp, Artificial Sequence
  chemically synthesized
ctagagcatgatggtaagga

SEQ ID NO: 500639 - DNA, 20 bp, Artificial Sequence
  chemically synthesized
agcatgatggtaaggataga

SEQ ID NO: 500640 - DNA, 20 bp, Artificial Sequence
  chemically synthesized
tcccgtcacattgcaggatg

SEQ ID NO: 500641 - DNA, 20 bp, Artificial Sequence
  chemically synthesized
gctggtctcccgtcacattg

SEQ ID NO: 500642 - DNA, 20 bp, Artificial Sequence
  chemically synthesized
tttgacttgggcctctattt

SEQ ID NO: 500643 - DNA, 20 bp, Artificial Sequence
  chemically synthesized
tattggcctccctaatggga

SEQ ID NO: 500644 - DNA, 20 bp, Artificial Sequence
  chemically synthesized
attttccacatatgaaatac

SEQ ID NO: 500645 - DNA, 20 bp, Artificial Sequence
  chemically synthesized
ttcttgcttcgtagatacac

SEQ ID NO: 500646 - DNA, 20 bp, Artificial Sequence
  chemically synthesized
atcataaacacacatgaaac

SEQ ID NO: 500647 - DNA, 20 bp, Artificial Sequence
  chemically synthesized
taacacattttgagctttat

SEQ ID NO: 500648 - DNA, 20 bp, Artificial Sequence
  chemically synthesized
agctttatacgggtcacaga

SEQ ID NO: 500649 - DNA, 20 bp, Artificial Sequence
  chemically synthesized
atctgggtgatgaaaaataa

SEQ ID NO: 500650 - DNA, 20 bp, Artificial Sequence
  chemically synthesized
tttcttagttaatagactat

SEQ ID NO: 500651 - DNA, 20 bp, Artificial Sequence
  chemically synthesized
agtgcatgggcacttctcgc

SEQ ID NO: 500652 - DNA, 20 bp, Artificial Sequence
  chemically synthesized
aggcattgttaactgttttt

SEQ ID NO: 500653 - DNA, 20 bp, Artificial Sequence
  chemically synthesized
gtttgtacagatatgggcac

SEQ ID NO: 500654 - DNA, 20 bp, Artificial Sequence
  chemically synthesized
aatccatggatgaaagatgc

SEQ ID NO: 500655 - DNA, 20 bp, Artificial Sequence
  chemically synthesized
aatccatgcatctttcatcc

SEQ ID NO: 500656 - DNA, 20 bp, Artificial Sequence
  chemically synthesized
tatttagtggtgactaatcc

SEQ ID NO: 500657 - DNA, 20 bp, Artificial Sequence
  chemically synthesized
atgcgttaaaatagctattt

SEQ ID NO: 500658 - DNA, 20 bp, Artificial Sequence
  chemically synthesized
tagcatatggtgctaaattt

SEQ ID NO: 500659 - DNA, 20 bp, Artificial Sequence
  chemically synthesized
caagagaactaaatggaagt

SEQ ID NO: 500660 - DNA, 20 bp, Artificial Sequence
  chemically synthesized
gttctcttggctgttactaa

SEQ ID NO: 500661 - DNA, 20 bp, Artificial Sequence
  chemically synthesized
tttaccctttatttaatctt

SEQ ID NO: 500662 - DNA, 20 bp, Artificial Sequence
  chemically synthesized
tatactcaaaagattaaata

SEQ ID NO: 500663 - DNA, 20 bp, Artificial Sequence
  chemically synthesized
taaataaagggtaaaaatga

SEQ ID NO: 500664 - DNA, 20 bp, Artificial Sequence
  chemically synthesized
tgttataacatcaaggctat

SEQ ID NO: 500665 - DNA, 20 bp, Artificial Sequence
  chemically synthesized
tttgtttaaaatttagtttt

SEQ ID NO: 500666 - DNA, 20 bp, Artificial Sequence
  chemically synthesized
cttaattatttcaaaagcaa

SEQ ID NO: 500667 - DNA, 20 bp, Artificial Sequence
  chemically synthesized
tggatcataaaggagggcag

SEQ ID NO: 500668 - DNA, 20 bp, Artificial Sequence
  chemically synthesized
ctttgattttcacaaaataa

SEQ ID NO: 500669 - DNA, 20 bp, Artificial Sequence
  chemically synthesized
aagtggaaaacaatatacac

SEQ ID NO: 500670 - DNA, 20 bp, Artificial Sequence
  chemically synthesized
agattttattcatctgttct

SEQ ID NO: 500671 - DNA, 20 bp, Artificial Sequence
  chemically synthesized
ggaacatattctgagaacag

SEQ ID NO: 500672 - DNA, 20 bp, Artificial Sequence
  chemically synthesized
cagaatatgttccatacaat

SEQ ID NO: 500673 - DNA, 20 bp, Artificial Sequence
  chemically synthesized
agagtcttaagtaatcattg

SEQ ID NO: 500674 - DNA, 20 bp, Artificial Sequence
  chemically synthesized
ttaagtaatcattgaagaat

SEQ ID NO: 500675 - DNA, 20 bp, Artificial Sequence
  chemically synthesized
ttaaatcacttgcaccatct

SEQ ID NO: 500676 - DNA, 20 bp, Artificial Sequence
  chemically synthesized
gttgttctggacatgctcag

SEQ ID NO: 500677 - DNA, 20 bp, Artificial Sequence
  chemically synthesized
agctcagatggcttctgcag

SEQ ID NO: 500678 - DNA, 20 bp, Artificial Sequence
  chemically synthesized
caatgaagaaaaaaaagaac

SEQ ID NO: 500679 - DNA, 20 bp, Artificial Sequence
  chemically synthesized
ttcttttttttcttcattgt

SEQ ID NO: 500680 - DNA, 20 bp, Artificial Sequence
  chemically synthesized
acgtcttttgtatgattgct

SEQ ID NO: 500681 - DNA, 20 bp, Artificial Sequence
  chemically synthesized
ctgaattggtatttctttca

SEQ ID NO: 500682 - DNA, 20 bp, Artificial Sequence
  chemically synthesized
caagttttattttgaataca

SEQ ID NO: 500683 - DNA, 20 bp, Artificial Sequence
  chemically synthesized
aaataaattcaagttttatt

SEQ ID NO: 500684 - DNA, 20 bp, Artificial Sequence
  chemically synthesized
cagtgtattcaaaataaaac

SEQ ID NO: 500685 - DNA, 20 bp, Artificial Sequence
  chemically synthesized
ggtaactccatacacttagt

SEQ ID NO: 500686 - DNA, 20 bp, Artificial Sequence
  chemically synthesized
ctagactcacactaagtgta

SEQ ID NO: 500687 - DNA, 20 bp, Artificial Sequence
  chemically synthesized
gggaacctcccaataatggt

SEQ ID NO: 500688 - DNA, 20 bp, Artificial Sequence
  chemically synthesized
tgatgattttctttgatgat

SEQ ID NO: 500689 - DNA, 20 bp, Artificial Sequence
  chemically synthesized
ttttacttattgaattaaca

SEQ ID NO: 500690 - DNA, 20 bp, Artificial Sequence
  chemically synthesized
tcaagatgtagttttactta

SEQ ID NO: 500691 - DNA, 20 bp, Artificial Sequence
  chemically synthesized
gatcctataaaattagggga

SEQ ID NO: 500692 - DNA, 20 bp, Artificial Sequence
  chemically synthesized
aaccctgtcccctaatttta

SEQ ID NO: 500693 - DNA, 20 bp, Artificial Sequence
  chemically synthesized
tcacctttttaggctatcat

SEQ ID NO: 500694 - DNA, 20 bp, Artificial Sequence
  chemically synthesized
tgcaagactaaatttttaca

SEQ ID NO: 500695 - DNA, 20 bp, Artificial Sequence
  chemically synthesized
gtcttgcatacttcataatg

SEQ ID NO: 500696 - DNA, 20 bp, Artificial Sequence
  chemically synthesized
tttccactatgctaagaaaa

SEQ ID NO: 500697 - DNA, 20 bp, Artificial Sequence
  chemically synthesized
tgctaagaaaagggaatgga

SEQ ID NO: 500698 - DNA, 20 bp, Artificial Sequence
  chemically synthesized
attgtgactatggacattaa

SEQ ID NO: 500699 - DNA, 20 bp, Artificial Sequence
  chemically synthesized
aaagttagtattatctttat

SEQ ID NO: 500700 - DNA, 20 bp, Artificial Sequence
  chemically synthesized
ttcctcatctgatgctaaaa

SEQ ID NO: 500701 - DNA, 20 bp, Artificial Sequence
  chemically synthesized
tataaatacaaaatgaagtg

SEQ ID NO: 500702 - DNA, 20 bp, Artificial Sequence
  chemically synthesized
taatatatttttcagaaata

SEQ ID NO: 500703 - DNA, 20 bp, Artificial Sequence
  chemically synthesized
tttgcagtcaatatttcctg

SEQ ID NO: 500704 - DNA, 20 bp, Artificial Sequence
  chemically synthesized
attttatatttgcttatctt

SEQ ID NO: 500705 - DNA, 20 bp, Artificial Sequence
  chemically synthesized
aatctaactataaaataatt

SEQ ID NO: 500706 - DNA, 20 bp, Artificial Sequence
  chemically synthesized
agcacgttaaataaaaatag

SEQ ID NO: 500707 - DNA, 20 bp, Artificial Sequence
  chemically synthesized
tttatacaacatattacctc

SEQ ID NO: 500708 - DNA, 20 bp, Artificial Sequence
  chemically synthesized
gtaaatttgcttaaacttac

SEQ ID NO: 500709 - DNA, 20 bp, Artificial Sequence
  chemically synthesized
aacataggattttgtgtttt

SEQ ID NO: 500710 - DNA, 20 bp, Artificial Sequence
  chemically synthesized
agtaagaaactatatgaaca

SEQ ID NO: 500711 - DNA, 20 bp, Artificial Sequence
  chemically synthesized
atagtttcttactacccttg

SEQ ID NO: 500712 - DNA, 20 bp, Artificial Sequence
  chemically synthesized
gaacattaattgaattcatc

SEQ ID NO: 500713 - DNA, 20 bp, Artificial Sequence
  chemically synthesized
ctgaggtttaagaacattaa

SEQ ID NO: 500714 - DNA, 20 bp, Artificial Sequence
  chemically synthesized
cttaaacctcagttttctat

SEQ ID NO: 500715 - DNA, 20 bp, Artificial Sequence
  chemically synthesized
tcgatagaagtatacaattt

SEQ ID NO: 500716 - DNA, 20 bp, Artificial Sequence
  chemically synthesized
caaaatttcttgtgcgtgtt

SEQ ID NO: 500717 - DNA, 20 bp, Artificial Sequence
  chemically synthesized
tttaagattctcttagtgct

SEQ ID NO: 500718 - DNA, 20 bp, Artificial Sequence
  chemically synthesized
gttttcattctaagcactaa

SEQ ID NO: 500719 - DNA, 20 bp, Artificial Sequence
  chemically synthesized
aaataagtaattaatcaata

SEQ ID NO: 500720 - DNA, 20 bp, Artificial Sequence
  chemically synthesized
attgattaattacttatttt

SEQ ID NO: 500721 - DNA, 20 bp, Artificial Sequence
  chemically synthesized
ctgtgtacctagtcactgtt

SEQ ID NO: 500722 - DNA, 20 bp, Artificial Sequence
  chemically synthesized
gacaatttttttttgcattg

SEQ ID NO: 500723 - DNA, 20 bp, Artificial Sequence
  chemically synthesized
tattttccttctttatcttc

SEQ ID NO: 500724 - DNA, 20 bp, Artificial Sequence
  chemically synthesized
gaaaaataaatgaggaaagc

SEQ ID NO: 500725 - DNA, 20 bp, Artificial Sequence
  chemically synthesized
actcaaaagtgtttttttca

SEQ ID NO: 500726 - DNA, 20 bp, Artificial Sequence
  chemically synthesized
attcattgaaaaaaacactt

SEQ ID NO: 500727 - DNA, 20 bp, Artificial Sequence
  chemically synthesized
agccacatggagaaacgggg

SEQ ID NO: 500728 - DNA, 20 bp, Artificial Sequence
  chemically synthesized
cagaggtagcacacaatgca

SEQ ID NO: 500729 - DNA, 20 bp, Artificial Sequence
  chemically synthesized
atctgtgaaagcagcagcaa

SEQ ID NO: 500730 - DNA, 20 bp, Artificial Sequence
  chemically synthesized
aaagtattaagagataaggc

SEQ ID NO: 500731 - DNA, 20 bp, Artificial Sequence
  chemically synthesized
aaaactcttcatgaatttca

SEQ ID NO: 500732 - DNA, 20 bp, Artificial Sequence
  chemically synthesized
gatatcccttgaaattcatg

SEQ ID NO: 500733 - DNA, 20 bp, Artificial Sequence
  chemically synthesized
agtgaaatccaaaactcttc

SEQ ID NO: 500734 - DNA, 20 bp, Artificial Sequence
  chemically synthesized
cttgaaattcatgaagagtt

SEQ ID NO: 500735 - DNA, 20 bp, Artificial Sequence
  chemically synthesized
gatttcacttaaaaatagat

SEQ ID NO: 500736 - DNA, 20 bp, Artificial Sequence
  chemically synthesized
aaatagatgggaattcattg

SEQ ID NO: 500737 - DNA, 20 bp, Artificial Sequence
  chemically synthesized
aatctgatcataatccttca

SEQ ID NO: 500738 - DNA, 20 bp, Artificial Sequence
  chemically synthesized
tccactgcatttgaggggaa

SEQ ID NO: 500739 - DNA, 20 bp, Artificial Sequence
  chemically synthesized
gttttaatcaagtcacgagg

SEQ ID NO: 500740 - DNA, 20 bp, Artificial Sequence
  chemically synthesized
tgaaaacagcaagacatata

SEQ ID NO: 500741 - DNA, 20 bp, Artificial Sequence
  chemically synthesized
atagaaaggtagcaggtaaa

SEQ ID NO: 500742 - DNA, 20 bp, Artificial Sequence
  chemically synthesized
caatcttgacgtcctctaaa

SEQ ID NO: 500743 - DNA, 20 bp, Artificial Sequence
  chemically synthesized
tttcaatgttattcctgaaa

SEQ ID NO: 500744 - DNA, 20 bp, Artificial Sequence
  chemically synthesized
actgatagaaactctctttc

SEQ ID NO: 500745 - DNA, 20 bp, Artificial Sequence
  chemically synthesized
agaacatccacgtaggaacc

SEQ ID NO: 500746 - DNA, 20 bp, Artificial Sequence
  chemically synthesized
acacaattctaggttcctac

SEQ ID NO: 500747 - DNA, 20 bp, Artificial Sequence
  chemically synthesized
tgatagaagccagaagacgg

SEQ ID NO: 500748 - DNA, 20 bp, Artificial Sequence
  chemically synthesized
aaattatttctttgcttttt

SEQ ID NO: 500749 - DNA, 20 bp, Artificial Sequence
  chemically synthesized
actatgagacgatgaatctg

SEQ ID NO: 500750 - DNA, 20 bp, Artificial Sequence
  chemically synthesized
tagatcatcactatgagacg

SEQ ID NO: 500751 - DNA, 20 bp, Artificial Sequence
  chemically synthesized
gatttgctcagtttcccaat

SEQ ID NO: 500752 - DNA, 20 bp, Artificial Sequence
  chemically synthesized
cagtttcccaatcggagtat

SEQ ID NO: 500753 - DNA, 20 bp, Artificial Sequence
  chemically synthesized
tatctgtagtgataatagct

SEQ ID NO: 500754 - DNA, 20 bp, Artificial Sequence
  chemically synthesized
gataatgcctcttctccatt

SEQ ID NO: 500755 - DNA, 20 bp, Artificial Sequence
  chemically synthesized
tgcctcttctccattgtggg

SEQ ID NO: 500756 - DNA, 20 bp, Artificial Sequence
  chemically synthesized
ggcttccctcagctgtaaag

SEQ ID NO: 500757 - DNA, 20 bp, Artificial Sequence
  chemically synthesized
ataaaacccctccttaaagt

SEQ ID NO: 500758 - DNA, 20 bp, Artificial Sequence
  chemically synthesized
tgaaaattcagactttaagg

SEQ ID NO: 500759 - DNA, 20 bp, Artificial Sequence
  chemically synthesized
catcttacgtgaaactgaac

SEQ ID NO: 500760 - DNA, 20 bp, Artificial Sequence
  chemically synthesized
ctctcttccctctgtgtgcc

SEQ ID NO: 500761 - DNA, 20 bp, Artificial Sequence
  chemically synthesized
tttaaaaattatattttatt

SEQ ID NO: 500762 - DNA, 20 bp, Artificial Sequence
  chemically synthesized
acttcaaatgcgtggaaatt

SEQ ID NO: 500763 - DNA, 20 bp, Artificial Sequence
  chemically synthesized
tttccacgcatttgaagtga

SEQ ID NO: 500764 - DNA, 20 bp, Artificial Sequence
  chemically synthesized
gcatttgaagtgagggggtg

SEQ ID NO: 500765 - DNA, 20 bp, Artificial Sequence
  chemically synthesized
gttaagtagaggcatgttca

SEQ ID NO: 500766 - DNA, 20 bp, Artificial Sequence
  chemically synthesized
agtggttataaatatttgta

SEQ ID NO: 500767 - DNA, 20 bp, Artificial Sequence
  chemically synthesized
ttttgtaattaacatattac

SEQ ID NO: 500768 - DNA, 20 bp, Artificial Sequence
  chemically synthesized
caccaggatgtagctgtttg

SEQ ID NO: 500769 - DNA, 20 bp, Artificial Sequence
  chemically synthesized
tgttaagggaaatgttgcac

SEQ ID NO: 500770 - DNA, 20 bp, Artificial Sequence
  chemically synthesized
acagaatgttctttagcaaa

SEQ ID NO: 500771 - DNA, 20 bp, Artificial Sequence
  chemically synthesized
atgattttcttatttagaga

SEQ ID NO: 500772 - DNA, 20 bp, Artificial Sequence
  chemically synthesized
tttatcttcccaaattctcc

SEQ ID NO: 500773 - DNA, 20 bp, Artificial Sequence
  chemically synthesized
ctgccagtgcaacatccttg

SEQ ID NO: 500774 - DNA, 20 bp, Artificial Sequence
  chemically synthesized
cccctaattttattctcaaa

SEQ ID NO: 500775 - DNA, 20 bp, Artificial Sequence
  chemically synthesized
taataaaagcaactcatttt

SEQ ID NO: 500776 - DNA, 20 bp, Artificial Sequence
  chemically synthesized
atcattattcttctgttgtt

SEQ ID NO: 500777 - DNA, 20 bp, Artificial Sequence
  chemically synthesized
aaggaaatcccaaacaacag

SEQ ID NO: 500778 - DNA, 20 bp, Artificial Sequence
  chemically synthesized
gttcttcccatttttttcta

SEQ ID NO: 500779 - DNA, 20 bp, Artificial Sequence
  chemically synthesized
tatttgagtgatggtgaaat

SEQ ID NO: 500780 - DNA, 20 bp, Artificial Sequence
  chemically synthesized
attgatgaaaggtttcttat

SEQ ID NO: 500781 - DNA, 20 bp, Artificial Sequence
  chemically synthesized
tgtctagatgtgaaagtcta

SEQ ID NO: 500782 - DNA, 20 bp, Artificial Sequence
  chemically synthesized
gggattatgactttctatga

SEQ ID NO: 500783 - DNA, 20 bp, Artificial Sequence
  chemically synthesized
tagtgcgtttgatatgctaa

SEQ ID NO: 500784 - DNA, 20 bp, Artificial Sequence
  chemically synthesized
tcaaacgcactagaaagtta

SEQ ID NO: 500785 - DNA, 20 bp, Artificial Sequence
  chemically synthesized
actgctttccaaaacatggt

SEQ ID NO: 500786 - DNA, 20 bp, Artificial Sequence
  chemically synthesized
ccaccatgttttggaaagca

SEQ ID NO: 500787 - DNA, 20 bp, Artificial Sequence
  chemically synthesized
tgaggttaagagatttgtcc

SEQ ID NO: 500788 - DNA, 20 bp, Artificial Sequence
  chemically synthesized
acaaagaaaatgatacttga

SEQ ID NO: 500789 - DNA, 20 bp, Artificial Sequence
  chemically synthesized
gatgcatgtgaaaactcttt

SEQ ID NO: 500790 - DNA, 20 bp, Artificial Sequence
  chemically synthesized
aatagtattatacattcaca

SEQ ID NO: 500791 - DNA, 20 bp, Artificial Sequence
  chemically synthesized
cttttttaagttgtttgaat

SEQ ID NO: 500792 - DNA, 20 bp, Artificial Sequence
  chemically synthesized
cactaacttttttaagttgt

SEQ ID NO: 500793 - DNA, 20 bp, Artificial Sequence
  chemically synthesized
aaaataaacacctatatatt

SEQ ID NO: 500794 - DNA, 20 bp, Artificial Sequence
  chemically synthesized
gaaaaaaaagtagtccttaa

SEQ ID NO: 500795 - DNA, 20 bp, Artificial Sequence
  chemically synthesized
actacttttttttcttgagg

SEQ ID NO: 500796 - DNA, 20 bp, Artificial Sequence
  chemically synthesized
agacagaggttacagtcagc

SEQ ID NO: 500797 - DNA, 20 bp, Artificial Sequence
  chemically synthesized
cttctcagaggctgaggcat

SEQ ID NO: 500798 - DNA, 20 bp, Artificial Sequence
  chemically synthesized
tgcctcagcctctgagaagc

SEQ ID NO: 500799 - DNA, 20 bp, Artificial Sequence
  chemically synthesized
cttgtatatatatgttatat

SEQ ID NO: 500800 - DNA, 20 bp, Artificial Sequence
  chemically synthesized
catgttatacacatataacg

SEQ ID NO: 500801 - DNA, 20 bp, Artificial Sequence
  chemically synthesized
ggtgggcggatcacttgagg

SEQ ID NO: 500802 - DNA, 20 bp, Artificial Sequence
  chemically synthesized
tctttgtgaggccgaggtgg

SEQ ID NO: 500803 - DNA, 20 bp, Artificial Sequence
  chemically synthesized
acctcggcctcacaaagagc

SEQ ID NO: 500804 - DNA, 20 bp, Artificial Sequence
  chemically synthesized
ctacagcagagtaattgtaa

SEQ ID NO: 500805 - DNA, 20 bp, Artificial Sequence
  chemically synthesized
atggatagcttgtcctacag

SEQ ID NO: 500806 - DNA, 20 bp, Artificial Sequence
  chemically synthesized
ggttacaatattgtattgca

SEQ ID NO: 500807 - DNA, 20 bp, Artificial Sequence
  chemically synthesized
tggtaaaagatgaatatgaa

SEQ ID NO: 500808 - DNA, 20 bp, Artificial Sequence
  chemically synthesized
taaaagtgaggtggtaaaag

SEQ ID NO: 500809 - DNA, 20 bp, Artificial Sequence
  chemically synthesized
tgaacgagcagtcttaaact

SEQ ID NO: 500810 - DNA, 20 bp, Artificial Sequence
  chemically synthesized
tatacttatgtatgcaaatt

SEQ ID NO: 500811 - DNA, 20 bp, Artificial Sequence
  chemically synthesized
aatttgcatacataagtata

SEQ ID NO: 500812 - DNA, 20 bp, Artificial Sequence
  chemically synthesized
tatcctttcatttaggaaca

SEQ ID NO: 500813 - DNA, 20 bp, Artificial Sequence
  chemically synthesized
tattcattgttcctaaatga

SEQ ID NO: 500814 - DNA, 20 bp, Artificial Sequence
  chemically synthesized
ctaatggaatatttttcacc

SEQ ID NO: 500815 - DNA, 20 bp, Artificial Sequence
  chemically synthesized
ctttgaacatatttttctaa

SEQ ID NO: 500816 - DNA, 20 bp, Artificial Sequence
  chemically synthesized
agcaaaaagggagacaaagt

SEQ ID NO: 500817 - DNA, 20 bp, Artificial Sequence
  chemically synthesized
ggaaggggctacatcatata

SEQ ID NO: 500818 - DNA, 20 bp, Artificial Sequence
  chemically synthesized
ctacatcatatagcggatca

SEQ ID NO: 500819 - DNA, 20 bp, Artificial Sequence
  chemically synthesized
ggatcacaggatttcattta

SEQ ID NO: 500820 - DNA, 20 bp, Artificial Sequence
  chemically synthesized
aaggcagagagctccttcta

SEQ ID NO: 500821 - DNA, 20 bp, Artificial Sequence
  chemically synthesized
acaagattattatctctcat

SEQ ID NO: 500822 - DNA, 20 bp, Artificial Sequence
  chemically synthesized
cacttccataacagatacgg

SEQ ID NO: 500823 - DNA, 20 bp, Artificial Sequence
  chemically synthesized
attttgcaggtatatccaac

SEQ ID NO: 500824 - DNA, 20 bp, Artificial Sequence
  chemically synthesized
gtaaattatttccactcttg

SEQ ID NO: 500825 - DNA, 20 bp, Artificial Sequence
  chemically synthesized
tacatggtaatgtaagagaa

SEQ ID NO: 500826 - DNA, 20 bp, Artificial Sequence
  chemically synthesized
tgtaagagaaaagaatcatg

SEQ ID NO: 500827 - DNA, 20 bp, Artificial Sequence
  chemically synthesized
gatgccaattaacgtagatg

SEQ ID NO: 500828 - DNA, 20 bp, Artificial Sequence
  chemically synthesized
ccaattaacgtagatggggg

SEQ ID NO: 500829 - DNA, 20 bp, Artificial Sequence
  chemically synthesized
atatccaacagtctcttatc

SEQ ID NO: 500830 - DNA, 20 bp, Artificial Sequence
  chemically synthesized
gcatccaagataagagactg

SEQ ID NO: 500831 - DNA, 20 bp, Artificial Sequence
  chemically synthesized
ttatatttgttgccattatc

SEQ ID NO: 500832 - DNA, 20 bp, Artificial Sequence
  chemically synthesized
tacatagcatatgtaatatg

SEQ ID NO: 500833 - DNA, 20 bp, Artificial Sequence
  chemically synthesized
gcatatgtaatatgcaggat

SEQ ID NO: 500834 - DNA, 20 bp, Artificial Sequence
  chemically synthesized
taatatgcaggatatgaatt

SEQ ID NO: 500835 - DNA, 20 bp, Artificial Sequence
  chemically synthesized
aattaaggatatgtaattca

SEQ ID NO: 500836 - DNA, 20 bp, Artificial Sequence
  chemically synthesized
gaagacttattgcatatcct

SEQ ID NO: 500837 - DNA, 20 bp, Artificial Sequence
  chemically synthesized
ttgatttctctctctttaca

SEQ ID NO: 500838 - DNA, 20 bp, Artificial Sequence
  chemically synthesized
aggaaaacacagaatactag

SEQ ID NO: 500839 - DNA, 20 bp, Artificial Sequence
  chemically synthesized
cagtgccaccaaggaaaaca

SEQ ID NO: 500840 - DNA, 20 bp, Artificial Sequence
  chemically synthesized
tggtggcactgaccaaattt

SEQ ID NO: 500841 - DNA, 20 bp, Artificial Sequence
  chemically synthesized
gtttcacctgaacaaaaact

SEQ ID NO: 500842 - DNA, 20 bp, Artificial Sequence
  chemically synthesized
gtgaaactagctgtatgtct

SEQ ID NO: 500843 - DNA, 20 bp, Artificial Sequence
  chemically synthesized
agaatattttgccttaattc

SEQ ID NO: 500844 - DNA, 20 bp, Artificial Sequence
  chemically synthesized
taccaggtaaaacatgattc

SEQ ID NO: 500845 - DNA, 20 bp, Artificial Sequence
  chemically synthesized
caatagatattagaagacag

SEQ ID NO: 500846 - DNA, 20 bp, Artificial Sequence
  chemically synthesized
ttaagacaaaagaacattta

SEQ ID NO: 500847 - DNA, 20 bp, Artificial Sequence
  chemically synthesized
gtaatcaaaaaggtatcatt

SEQ ID NO: 500848 - DNA, 20 bp, Artificial Sequence
  chemically synthesized
cctttttgattactgatgct

SEQ ID NO: 500849 - DNA, 20 bp, Artificial Sequence
  chemically synthesized
aacaagtctaccagctagct

SEQ ID NO: 500850 - DNA, 20 bp, Artificial Sequence
  chemically synthesized
tccacgttggttgaccttta

SEQ ID NO: 500851 - DNA, 20 bp, Artificial Sequence
  chemically synthesized
ggttgacctttattgaattt

SEQ ID NO: 500852 - DNA, 20 bp, Artificial Sequence
  chemically synthesized
tggaataaatgtaaatttta

SEQ ID NO: 500853 - DNA, 20 bp, Artificial Sequence
  chemically synthesized
attaatgaaatttaataaaa

SEQ ID NO: 500854 - DNA, 20 bp, Artificial Sequence
  chemically synthesized
agtttcaagttgaaaaaaat

SEQ ID NO: 500855 - DNA, 20 bp, Artificial Sequence
  chemically synthesized
ttatttcacgcagatgtttg

SEQ ID NO: 500856 - DNA, 20 bp, Artificial Sequence
  chemically synthesized
taaatggatttttttccagt

SEQ ID NO: 500857 - DNA, 20 bp, Artificial Sequence
  chemically synthesized
tgttcaaaaataaaaattaa

SEQ ID NO: 500858 - DNA, 20 bp, Artificial Sequence
  chemically synthesized
agataagaggataatcacca

SEQ ID NO: 500859 - DNA, 20 bp, Artificial Sequence
  chemically synthesized
cctgaagaaaatagagataa

SEQ ID NO: 500860 - DNA, 20 bp, Artificial Sequence
  chemically synthesized
cagatgccaaacgttaaaag

SEQ ID NO: 500861 - DNA, 20 bp, Artificial Sequence
  chemically synthesized
agcagtttcacatgaccctt

SEQ ID NO: 500862 - DNA, 20 bp, Artificial Sequence
  chemically synthesized
aagataccactacaaccccc

SEQ ID NO: 500863 - DNA, 20 bp, Artificial Sequence
  chemically synthesized
atatttcctgtgtttattct

SEQ ID NO: 500864 - DNA, 20 bp, Artificial Sequence
  chemically synthesized
gatacttttctctagattca

SEQ ID NO: 500865 - DNA, 20 bp, Artificial Sequence
  chemically synthesized
aagtatctgcttatatatta

SEQ ID NO: 500866 - DNA, 20 bp, Artificial Sequence
  chemically synthesized
atattttcataagtcattaa

SEQ ID NO: 500867 - DNA, 20 bp, Artificial Sequence
  chemically synthesized
atagagataaggatgtttct

SEQ ID NO: 500868 - DNA, 20 bp, Artificial Sequence
  chemically synthesized
ttcatctgtacaatagagat

SEQ ID NO: 500869 - DNA, 20 bp, Artificial Sequence
  chemically synthesized
gctgtatgatcagggataaa

SEQ ID NO: 500870 - DNA, 20 bp, Artificial Sequence
  chemically synthesized
actttgagtgctgtatgatc

SEQ ID NO: 500871 - DNA, 20 bp, Artificial Sequence
  chemically synthesized
catacagcactcaaagtcac

SEQ ID NO: 500872 - DNA, 20 bp, Artificial Sequence
  chemically synthesized
gaatatgaatcccagtgact

SEQ ID NO: 500873 - DNA, 20 bp, Artificial Sequence
  chemically synthesized
ttggataaacagccttgaat

SEQ ID NO: 500874 - DNA, 20 bp, Artificial Sequence
  chemically synthesized
taactcttggataaacagcc

SEQ ID NO: 500875 - DNA, 20 bp, Artificial Sequence
  chemically synthesized
atattcaaggctgtttatcc

SEQ ID NO: 500876 - DNA, 20 bp, Artificial Sequence
  chemically synthesized
tggtctagtaaaattaactc

SEQ ID NO: 500877 - DNA, 20 bp, Artificial Sequence
  chemically synthesized
gaggaaaagggatagttcta

SEQ ID NO: 500878 - DNA, 20 bp, Artificial Sequence
  chemically synthesized
cggactgtaaactgaggaaa

SEQ ID NO: 500879 - DNA, 20 bp, Artificial Sequence
  chemically synthesized
ggaaatatattagaaatgat

SEQ ID NO: 500880 - DNA, 20 bp, Artificial Sequence
  chemically synthesized
agagaactcctgccttaatt

SEQ ID NO: 500881 - DNA, 20 bp, Artificial Sequence
  chemically synthesized
ttggaattcctaattaaggc

SEQ ID NO: 500882 - DNA, 20 bp, Artificial Sequence
  chemically synthesized
aaggcaggagttctctcatt

SEQ ID NO: 500883 - DNA, 20 bp, Artificial Sequence
  chemically synthesized
atgcagaccaaagcatagta

SEQ ID NO: 500884 - DNA, 20 bp, Artificial Sequence
  chemically synthesized
gaggcagcgcccagccacac

SEQ ID NO: 500885 - DNA, 20 bp, Artificial Sequence
  chemically synthesized
atatatagctctgacatgga

SEQ ID NO: 500886 - DNA, 20 bp, Artificial Sequence
  chemically synthesized
ttacagtggttagcacttct

SEQ ID NO: 500887 - DNA, 20 bp, Artificial Sequence
  chemically synthesized
gcttagtatgtgagagctga

SEQ ID NO: 500888 - DNA, 20 bp, Artificial Sequence
  chemically synthesized
aaatgcttagtatgtgagag

SEQ ID NO: 500889 - DNA, 20 bp, Artificial Sequence
  chemically synthesized
tctcacatactaagcatttt

SEQ ID NO: 500890 - DNA, 20 bp, Artificial Sequence
  chemically synthesized
aaatcaaacaattagagaag

SEQ ID NO: 500891 - DNA, 20 bp, Artificial Sequence
  chemically synthesized
tgcagcatatgccatagctt

SEQ ID NO: 500892 - DNA, 20 bp, Artificial Sequence
  chemically synthesized
cacaaatgactctagggcgt

SEQ ID NO: 500893 - DNA, 20 bp, Artificial Sequence
  chemically synthesized
ctttcccaattcttacgccc

SEQ ID NO: 500894 - DNA, 20 bp, Artificial Sequence
  chemically synthesized
atttcactgtggccactgat

SEQ ID NO: 500895 - DNA, 20 bp, Artificial Sequence
  chemically synthesized
gtcaagtataaagatgtatc

SEQ ID NO: 500896 - DNA, 20 bp, Artificial Sequence
  chemically synthesized
gtaggtagatagatagacag

SEQ ID NO: 500897 - DNA, 20 bp, Artificial Sequence
  chemically synthesized
tcgtattttaattagaactg

SEQ ID NO: 500898 - DNA, 20 bp, Artificial Sequence
  chemically synthesized
aagtaatcacaatctgtatg

SEQ ID NO: 500899 - DNA, 20 bp, Artificial Sequence
  chemically synthesized
attgtgattactttattatc

SEQ ID NO: 500900 - DNA, 20 bp, Artificial Sequence
  chemically synthesized
ctttattatcatggataatt

SEQ ID NO: 500901 - DNA, 20 bp, Artificial Sequence
  chemically synthesized
aaaatagcccccttcacatt

SEQ ID NO: 500902 - DNA, 20 bp, Artificial Sequence
  chemically synthesized
cccccttcacattctgaatt

SEQ ID NO: 500903 - DNA, 20 bp, Artificial Sequence
  chemically synthesized
tatattaaagatccaaaatt

SEQ ID NO: 500904 - DNA, 20 bp, Artificial Sequence
  chemically synthesized
atctttaatatataaaactt

SEQ ID NO: 500905 - DNA, 20 bp, Artificial Sequence
  chemically synthesized
tttatgaggaaaatatatcc

SEQ ID NO: 500906 - DNA, 20 bp, Artificial Sequence
  chemically synthesized
aaaaaattgtagtaaaattc

SEQ ID NO: 500907 - DNA, 20 bp, Artificial Sequence
  chemically synthesized
atatttgttgagagcctact

SEQ ID NO: 500908 - DNA, 20 bp, Artificial Sequence
  chemically synthesized
gctttatggctaaataggca

SEQ ID NO: 500909 - DNA, 20 bp, Artificial Sequence
  chemically synthesized
agcaacttgattagtttgta

SEQ ID NO: 500910 - DNA, 20 bp, Artificial Sequence
  chemically synthesized
acgaattttaaacctgcata

SEQ ID NO: 500911 - DNA, 20 bp, Artificial Sequence
  chemically synthesized
tgtcaagacctggggaaaat

SEQ ID NO: 500912 - DNA, 20 bp, Artificial Sequence
  chemically synthesized
gggaaaattggaatggagaa

SEQ ID NO: 500913 - DNA, 20 bp, Artificial Sequence
  chemically synthesized
tcaagggggagtcctttgct

SEQ ID NO: 500914 - DNA, 20 bp, Artificial Sequence
  chemically synthesized
tcaaagcaaaggactccccc

SEQ ID NO: 500915 - DNA, 20 bp, Artificial Sequence
  chemically synthesized
atttaatagatcattcaagg

SEQ ID NO: 500916 - DNA, 20 bp, Artificial Sequence
  chemically synthesized
ttgaggtgaaactattttat

SEQ ID NO: 500917 - DNA, 20 bp, Artificial Sequence
  chemically synthesized
tatccttcatattagatgtt

SEQ ID NO: 500918 - DNA, 20 bp, Artificial Sequence
  chemically synthesized
cattcataacatctaatatg

SEQ ID NO: 500919 - DNA, 20 bp, Artificial Sequence
  chemically synthesized
ggctgaaacattcagccagg

SEQ ID NO: 500920 - DNA, 20 bp, Artificial Sequence
  chemically synthesized
tgaagtctaattccacctgg

SEQ ID NO: 500921 - DNA, 20 bp, Artificial Sequence
  chemically synthesized
gaattattctgagcaattgg

SEQ ID NO: 500922 - DNA, 20 bp, Artificial Sequence
  chemically synthesized
ctcgtattcttccaattgct

SEQ ID NO: 500923 - DNA, 20 bp, Artificial Sequence
  chemically synthesized
accctaaagtttaatagcag

SEQ ID NO: 500924 - DNA, 20 bp, Artificial Sequence
  chemically synthesized
attcacctgctattaaactt

SEQ ID NO: 500925 - DNA, 20 bp, Artificial Sequence
  chemically synthesized
ctatgtaaataataactgca

SEQ ID NO: 500926 - DNA, 20 bp, Artificial Sequence
  chemically synthesized
atttacatagggcaaaatgg

SEQ ID NO: 500927 - DNA, 20 bp, Artificial Sequence
  chemically synthesized
gttaagttaggttgaattat

SEQ ID NO: 500928 - DNA, 20 bp, Artificial Sequence
  chemically synthesized
gtctttatagttaagttagg

SEQ ID NO: 500929 - DNA, 20 bp, Artificial Sequence
  chemically synthesized
gaaagtactcctcacaaaac

SEQ ID NO: 500930 - DNA, 20 bp, Artificial Sequence
  chemically synthesized
tttgacatcctggttttgtg

SEQ ID NO: 500931 - DNA, 20 bp, Artificial Sequence
  chemically synthesized
ttaacacttgtaagatgaag

SEQ ID NO: 500932 - DNA, 20 bp, Artificial Sequence
  chemically synthesized
gtgagaccaagctaacaatt

SEQ ID NO: 500933 - DNA, 20 bp, Artificial Sequence
  chemically synthesized
ctctctttaaaaaggcgatt

SEQ ID NO: 500934 - DNA, 20 bp, Artificial Sequence
  chemically synthesized
actgctcttctttcaaacaa

SEQ ID NO: 500935 - DNA, 20 bp, Artificial Sequence
  chemically synthesized
tgttaccagccaaaacaaaa

SEQ ID NO: 500936 - DNA, 20 bp, Artificial Sequence
  chemically synthesized
ttacagtgcccataaaagaa

SEQ ID NO: 500937 - DNA, 20 bp, Artificial Sequence
  chemically synthesized
acacctggtttaactactta

SEQ ID NO: 500938 - DNA, 20 bp, Artificial Sequence
  chemically synthesized
taagtagttaaaccaggtgt

SEQ ID NO: 500939 - DNA, 20 bp, Artificial Sequence
  chemically synthesized
gccattatctcattgacttg

SEQ ID NO: 500940 - DNA, 20 bp, Artificial Sequence
  chemically synthesized
ttaagaaagtaaaatcagca

SEQ ID NO: 500941 - DNA, 20 bp, Artificial Sequence
  chemically synthesized
aggaaagcaatacatatttt

SEQ ID NO: 500942 - DNA, 20 bp, Artificial Sequence
  chemically synthesized
ggattagacattgaagtaaa

SEQ ID NO: 500943 - DNA, 20 bp, Artificial Sequence
  chemically synthesized
atgtattttcatttttgata

SEQ ID NO: 500944 - DNA, 20 bp, Artificial Sequence
  chemically synthesized
tgagggaaaccactcacttt

SEQ ID NO: 500945 - DNA, 20 bp, Artificial Sequence
  chemically synthesized
ttctaatgtacattctgaaa

SEQ ID NO: 500946 - DNA, 20 bp, Artificial Sequence
  chemically synthesized
aaaaaaaagagacaaaaaat

SEQ ID NO: 500947 - DNA, 20 bp, Artificial Sequence
  chemically synthesized
tattagtaggcctctgttaa

SEQ ID NO: 500948 - DNA, 20 bp, Artificial Sequence
  chemically synthesized
tagtagttgcaaacacatac

SEQ ID NO: 500949 - DNA, 20 bp, Artificial Sequence
  chemically synthesized
gactcaactttgcacaaatt

SEQ ID NO: 500950 - DNA, 20 bp, Artificial Sequence
  chemically synthesized
aactcacaatttgtgcaaag

SEQ ID NO: 500951 - DNA, 20 bp, Artificial Sequence
  chemically synthesized
tcccgccagcgcttgctgag

SEQ ID NO: 500952 - DNA, 20 bp, Artificial Sequence
  chemically synthesized
cagcgcttgctgagctggat

SEQ ID NO: 500953 - DNA, 20 bp, Artificial Sequence
  chemically synthesized
ggcaagctgagggcttgtct

SEQ ID NO: 500954 - DNA, 20 bp, Artificial Sequence
  chemically synthesized
tgcagaagaagaaagaggag

SEQ ID NO: 500955 - DNA, 20 bp, Artificial Sequence
  chemically synthesized
tgctcaataggaaattgatc

SEQ ID NO: 500956 - DNA, 20 bp, Artificial Sequence
  chemically synthesized
tttcatatttgtaaacttca

SEQ ID NO: 500957 - DNA, 20 bp, Artificial Sequence
  chemically synthesized
taatatttgggttattgagc

SEQ ID NO: 500958 - DNA, 20 bp, Artificial Sequence
  chemically synthesized
aaggataactgaaataatat

SEQ ID NO: 500959 - DNA, 20 bp, Artificial Sequence
  chemically synthesized
aatattatttcagttatcct

SEQ ID NO: 500960 - DNA, 20 bp, Artificial Sequence
  chemically synthesized
tatctaaaaccaagcattca

SEQ ID NO: 500961 - DNA, 20 bp, Artificial Sequence
  chemically synthesized
aatttcaatatttacttaat

SEQ ID NO: 500962 - DNA, 20 bp, Artificial Sequence
  chemically synthesized
ttcaaatcccaagacaccag

SEQ ID NO: 500963 - DNA, 20 bp, Artificial Sequence
  chemically synthesized
tctaaattcctctggtgtct

SEQ ID NO: 500964 - DNA, 20 bp, Artificial Sequence
  chemically synthesized
tcttgggatttgaaacaatt

SEQ ID NO: 500965 - DNA, 20 bp, Artificial Sequence
  chemically synthesized
tggacggtccctaataaata

SEQ ID NO: 500966 - DNA, 20 bp, Artificial Sequence
  chemically synthesized
tttattagggaccgtccaca

SEQ ID NO: 500967 - DNA, 20 bp, Artificial Sequence
  chemically synthesized
tccacatagaatataattta

SEQ ID NO: 500968 - DNA, 20 bp, Artificial Sequence
  chemically synthesized
gaatataatttagagggtaa

SEQ ID NO: 500969 - DNA, 20 bp, Artificial Sequence
  chemically synthesized
aaggtttgaggaactcaaca

SEQ ID NO: 500970 - DNA, 20 bp, Artificial Sequence
  chemically synthesized
ttattttgcttcattctctg

SEQ ID NO: 500971 - DNA, 20 bp, Artificial Sequence
  chemically synthesized
aatatgcaaataaatctata

SEQ ID NO: 500972 - DNA, 20 bp, Artificial Sequence
  chemically synthesized
tgtgaagatgctctgatgaa

SEQ ID NO: 500973 - DNA, 20 bp, Artificial Sequence
  chemically synthesized
gatgaaatgaatgggctaac

SEQ ID NO: 500974 - DNA, 20 bp, Artificial Sequence
  chemically synthesized
ttcaattgacgtaatgttga

SEQ ID NO: 500975 - DNA, 20 bp, Artificial Sequence
  chemically synthesized
gttattcaattgacgtaatg

SEQ ID NO: 500976 - DNA, 20 bp, Artificial Sequence
  chemically synthesized
ttcattcaacattacgtcaa

SEQ ID NO: 500977 - DNA, 20 bp, Artificial Sequence
  chemically synthesized
aaataaaggtaatgttgttt

SEQ ID NO: 500978 - DNA, 20 bp, Artificial Sequence
  chemically synthesized
ctgatgatctcctgaaatgc

SEQ ID NO: 500979 - DNA, 20 bp, Artificial Sequence
  chemically synthesized
aataatgtctgcaccatgaa

SEQ ID NO: 500980 - DNA, 20 bp, Artificial Sequence
  chemically synthesized
ggtttcttagcttcctatac

SEQ ID NO: 500981 - DNA, 20 bp, Artificial Sequence
  chemically synthesized
tgtataggaagctaagaaac

SEQ ID NO: 500982 - DNA, 20 bp, Artificial Sequence
  chemically synthesized
gttagctcattaagagtcaa

SEQ ID NO: 500983 - DNA, 20 bp, Artificial Sequence
  chemically synthesized
tacacaacagttagctcatt

SEQ ID NO: 500984 - DNA, 20 bp, Artificial Sequence
  chemically synthesized
ctgttgtgtagtttatgtgc

SEQ ID NO: 500985 - DNA, 20 bp, Artificial Sequence
  chemically synthesized
tatgtgcaagagtttaatat

SEQ ID NO: 500986 - DNA, 20 bp, Artificial Sequence
  chemically synthesized
gatacaaactcacaaaccta

SEQ ID NO: 500987 - DNA, 20 bp, Artificial Sequence
  chemically synthesized
gatacaaactcactaggttt

SEQ ID NO: 500988 - DNA, 20 bp, Artificial Sequence
  chemically synthesized
aaggctaaagatatacattt

SEQ ID NO: 500989 - DNA, 20 bp, Artificial Sequence
  chemically synthesized
aaaacatgaatgtatattgg

SEQ ID NO: 500990 - DNA, 20 bp, Artificial Sequence
  chemically synthesized
atgtaggcatttctaaaaac

SEQ ID NO: 500991 - DNA, 20 bp, Artificial Sequence
  chemically synthesized
gtttttagaaatgcctacat

SEQ ID NO: 500992 - DNA, 20 bp, Artificial Sequence
  chemically synthesized
tctattaatcacagaagata

SEQ ID NO: 500993 - DNA, 20 bp, Artificial Sequence
  chemically synthesized
tcaatatcttctgtgattaa

SEQ ID NO: 500994 - DNA, 20 bp, Artificial Sequence
  chemically synthesized
atgaattataaaatggcatt

SEQ ID NO: 500995 - DNA, 20 bp, Artificial Sequence
  chemically synthesized
catgcagagcttatgttccc

SEQ ID NO: 500996 - DNA, 20 bp, Artificial Sequence
  chemically synthesized
tttctacagaaagtagcaat

SEQ ID NO: 500997 - DNA, 20 bp, Artificial Sequence
  chemically synthesized
ttttcgctcgaattaaacct

SEQ ID NO: 500998 - DNA, 20 bp, Artificial Sequence
  chemically synthesized
gatatttattattttttcgc

SEQ ID NO: 500999 - DNA, 20 bp, Artificial Sequence
  chemically synthesized
cgaaaaaataataaatatca

SEQ ID NO: 501000 - DNA, 20 bp, Artificial Sequence
  chemically synthesized
agaaggtcaaaattttccaa

SEQ ID NO: 501001 - DNA, 20 bp, Artificial Sequence
  chemically synthesized
ctaaaatatttcataaggac

SEQ ID NO: 501002 - DNA, 20 bp, Artificial Sequence
  chemically synthesized
ttgacaggtttaaaaagtta

SEQ ID NO: 501003 - DNA, 20 bp, Artificial Sequence
  chemically synthesized
tgttggtatagattggtttg

SEQ ID NO: 501004 - DNA, 20 bp, Artificial Sequence
  chemically synthesized
cacttatagcctgtatttgc

SEQ ID NO: 501005 - DNA, 20 bp, Artificial Sequence
  chemically synthesized
tatctagtttgtttaaaatt

SEQ ID NO: 501006 - DNA, 20 bp, Artificial Sequence
  chemically synthesized
gctgtactttatgttttatg

SEQ ID NO: 501007 - DNA, 20 bp, Artificial Sequence
  chemically synthesized
ttgaattttcaaaccttctg

SEQ ID NO: 501008 - DNA, 20 bp, Artificial Sequence
  chemically synthesized
aggtagcaagatacagccac

SEQ ID NO: 501009 - DNA, 20 bp, Artificial Sequence
  chemically synthesized
caagatacagccacgtgaat

SEQ ID NO: 501010 - DNA, 20 bp, Artificial Sequence
  chemically synthesized
ccctttctcctggcaaagat

SEQ ID NO: 501011 - DNA, 20 bp, Artificial Sequence
  chemically synthesized
tgtcatgtagatttctttag

SEQ ID NO: 501012 - DNA, 20 bp, Artificial Sequence
  chemically synthesized
gtatgatggtgtgtgtccta

SEQ ID NO: 501013 - DNA, 20 bp, Artificial Sequence
  chemically synthesized
gaaagcttgctcacagttgg

SEQ ID NO: 501014 - DNA, 20 bp, Artificial Sequence
  chemically synthesized
ttgctcacagttggaagggt

SEQ ID NO: 501015 - DNA, 20 bp, Artificial Sequence
  chemically synthesized
agaaaaggcctcttcctcga

SEQ ID NO: 501016 - DNA, 20 bp, Artificial Sequence
  chemically synthesized
tggccaattagactttcctt

SEQ ID NO: 501017 - DNA, 20 bp, Artificial Sequence
  chemically synthesized
tacacaatattgtgcctgca

SEQ ID NO: 501018 - DNA, 20 bp, Artificial Sequence
  chemically synthesized
tcaaccaaataaacactgct

SEQ ID NO: 501019 - DNA, 20 bp, Artificial Sequence
  chemically synthesized
tgctttctacatgcaaataa

SEQ ID NO: 501020 - DNA, 20 bp, Artificial Sequence
  chemically synthesized
ggatccacctagcaggtaga

SEQ ID NO: 501021 - DNA, 20 bp, Artificial Sequence
  chemically synthesized
agactccatctacctgctag

SEQ ID NO: 501022 - DNA, 20 bp, Artificial Sequence
  chemically synthesized
tgagctatgtagttatgaag

SEQ ID NO: 501023 - DNA, 20 bp, Artificial Sequence
  chemically synthesized
ttcataactacatagctcaa

SEQ ID NO: 501024 - DNA, 20 bp, Artificial Sequence
  chemically synthesized
tctggtttgtgcaggaagag

SEQ ID NO: 501025 - DNA, 20 bp, Artificial Sequence
  chemically synthesized
gctcttcctgcacaaaccag

SEQ ID NO: 501026 - DNA, 20 bp, Artificial Sequence
  chemically synthesized
aaaaaataatcttagtgccc

SEQ ID NO: 501027 - DNA, 20 bp, Artificial Sequence
  chemically synthesized
agggcactaagattattttt

SEQ ID NO: 501028 - DNA, 20 bp, Artificial Sequence
  chemically synthesized
aagtcaaatttcatttatgt

SEQ ID NO: 501029 - DNA, 20 bp, Artificial Sequence
  chemically synthesized
tgactttgtagatagttgca

SEQ ID NO: 501030 - DNA, 20 bp, Artificial Sequence
  chemically synthesized
aaagttttaaaaataaataa

SEQ ID NO: 501031 - DNA, 20 bp, Artificial Sequence
  chemically synthesized
atcaattaagtaaagaaagc

SEQ ID NO: 501032 - DNA, 20 bp, Artificial Sequence
  chemically synthesized
aagtaaagaaagcaggaata

SEQ ID NO: 501033 - DNA, 20 bp, Artificial Sequence
  chemically synthesized
aaaaaaacctgcctaactgc

SEQ ID NO: 501034 - DNA, 20 bp, Artificial Sequence
  chemically synthesized
aaattaaatgtataagtact

SEQ ID NO: 501035 - DNA, 20 bp, Artificial Sequence
  chemically synthesized
ctaagtagtaattgaaagat

SEQ ID NO: 501036 - DNA, 20 bp, Artificial Sequence
  chemically synthesized
gtatgctttatttaacattt

SEQ ID NO: 501037 - DNA, 20 bp, Artificial Sequence
  chemically synthesized
atacacattgaacagaaaaa

SEQ ID NO: 501038 - DNA, 20 bp, Artificial Sequence
  chemically synthesized
tgtggtttttttttaatata

SEQ ID NO: 501039 - DNA, 20 bp, Artificial Sequence
  chemically synthesized
agaggagacaacttacaaca

SEQ ID NO: 501040 - DNA, 20 bp, Artificial Sequence
  chemically synthesized
agacaatgagggtactgtaa

SEQ ID NO: 501041 - DNA, 20 bp, Artificial Sequence
  chemically synthesized
ttgatcagaatgaagacaat

SEQ ID NO: 501042 - DNA, 20 bp, Artificial Sequence
  chemically synthesized
ctgtacttgttgtttttgat

SEQ ID NO: 501043 - DNA, 20 bp, Artificial Sequence
  chemically synthesized
cattccatgaaagttttaaa

SEQ ID NO: 501044 - DNA, 20 bp, Artificial Sequence
  chemically synthesized
aatccaatttaaaactttca

SEQ ID NO: 501045 - DNA, 20 bp, Artificial Sequence
  chemically synthesized
gggcacctgtagaaagatgg

SEQ ID NO: 501046 - DNA, 20 bp, Artificial Sequence
  chemically synthesized
ttcatcatgtcagacaagtc

SEQ ID NO: 501047 - DNA, 20 bp, Artificial Sequence
  chemically synthesized
aactacactaaaaaagccaa

SEQ ID NO: 501048 - DNA, 20 bp, Artificial Sequence
  chemically synthesized
taatgttaactgatccataa

SEQ ID NO: 501049 - DNA, 20 bp, Artificial Sequence
  chemically synthesized
atacacatctgtattccttt

SEQ ID NO: 501050 - DNA, 20 bp, Artificial Sequence
  chemically synthesized
tgaagcaggagttattagat

SEQ ID NO: 501051 - DNA, 20 bp, Artificial Sequence
  chemically synthesized
ttaggtttcagaaatgaagc

SEQ ID NO: 501052 - DNA, 20 bp, Artificial Sequence
  chemically synthesized
aatattaataggagaaatat

SEQ ID NO: 501053 - DNA, 20 bp, Artificial Sequence
  chemically synthesized
aatggctttaaacattttca

SEQ ID NO: 501054 - DNA, 20 bp, Artificial Sequence
  chemically synthesized
ttacttagaaataaaatgtt

SEQ ID NO: 501055 - DNA, 20 bp, Artificial Sequence
  chemically synthesized
tagttttctttctttcaact

SEQ ID NO: 501056 - DNA, 20 bp, Artificial Sequence
  chemically synthesized
tgatacaaagttttcacatt

SEQ ID NO: 501057 - DNA, 20 bp, Artificial Sequence
  chemically synthesized
ccttatgtcatcagtgtacc

SEQ ID NO: 501058 - DNA, 20 bp, Artificial Sequence
  chemically synthesized
tatgtgtgtattacaattca

SEQ ID NO: 501059 - DNA, 20 bp, Artificial Sequence
  chemically synthesized
aatatataacatctaattcc

SEQ ID NO: 501060 - DNA, 20 bp, Artificial Sequence
  chemically synthesized
atccctttcccccatacaaa

SEQ ID NO: 501061 - DNA, 20 bp, Artificial Sequence
  chemically synthesized
attcattttgtatgggggaa

SEQ ID NO: 501062 - DNA, 20 bp, Artificial Sequence
  chemically synthesized
ggtatagggaaagaagtgaa

SEQ ID NO: 501063 - DNA, 20 bp, Artificial Sequence
  chemically synthesized
accagttgagggctctaggg

SEQ ID NO: 501064 - DNA, 20 bp, Artificial Sequence
  chemically synthesized
tgagggctctagggcagagt

SEQ ID NO: 501065 - DNA, 20 bp, Artificial Sequence
  chemically synthesized
ggaagaggctttccaagttg

SEQ ID NO: 501066 - DNA, 20 bp, Artificial Sequence
  chemically synthesized
ctcttccgtctttccacaag

SEQ ID NO: 501067 - DNA, 20 bp, Artificial Sequence
  chemically synthesized
gccaccaaaccccatacatg

SEQ ID NO: 501068 - DNA, 20 bp, Artificial Sequence
  chemically synthesized
caatcaatactccccatgta

SEQ ID NO: 501069 - DNA, 20 bp, Artificial Sequence
  chemically synthesized
aagtgggaactaagattggt

SEQ ID NO: 501070 - DNA, 20 bp, Artificial Sequence
  chemically synthesized
cactggtaattgtaaaggtt

SEQ ID NO: 501071 - DNA, 20 bp, Artificial Sequence
  chemically synthesized
ggggaaaaaattgtgaaaag

SEQ ID NO: 501072 - DNA, 20 bp, Artificial Sequence
  chemically synthesized
gaaaaaaaaagtcagttaat

SEQ ID NO: 501073 - DNA, 20 bp, Artificial Sequence
  chemically synthesized
ctactacatttctctctggc

SEQ ID NO: 501074 - DNA, 20 bp, Artificial Sequence
  chemically synthesized
gtagatactttgaaattagt

SEQ ID NO: 501075 - DNA, 20 bp, Artificial Sequence
  chemically synthesized
gaaattagttgggattgaag

SEQ ID NO: 501076 - DNA, 20 bp, Artificial Sequence
  chemically synthesized
atgtgtgctcttcccaacct

SEQ ID NO: 501077 - DNA, 20 bp, Artificial Sequence
  chemically synthesized
attcatgctgcttatttcat

SEQ ID NO: 501078 - DNA, 20 bp, Artificial Sequence
  chemically synthesized
actcccatgaaataagcagc

SEQ ID NO: 501079 - DNA, 20 bp, Artificial Sequence
  chemically synthesized
aacatttatttcaatgaaga

SEQ ID NO: 501080 - DNA, 20 bp, Artificial Sequence
  chemically synthesized
atgtcagtcatctatgatag

SEQ ID NO: 501081 - DNA, 20 bp, Artificial Sequence
  chemically synthesized
aatgtaattggaaaaaagag

SEQ ID NO: 501082 - DNA, 20 bp, Artificial Sequence
  chemically synthesized
ggcaaaatgtaattggaaaa

SEQ ID NO: 501083 - DNA, 20 bp, Artificial Sequence
  chemically synthesized
ttggccttttattacaaatg

SEQ ID NO: 501084 - DNA, 20 bp, Artificial Sequence
  chemically synthesized
agcatttgtaataaaaggcc

SEQ ID NO: 501085 - DNA, 20 bp, Artificial Sequence
  chemically synthesized
tctaatgaattttataaatg

SEQ ID NO: 501086 - DNA, 20 bp, Artificial Sequence
  chemically synthesized
tctgcatttataaaattcat

SEQ ID NO: 501087 - DNA, 20 bp, Artificial Sequence
  chemically synthesized
ttacacattttatgattcta

SEQ ID NO: 501088 - DNA, 20 bp, Artificial Sequence
  chemically synthesized
gaacttagataagtctccaa

SEQ ID NO: 501089 - DNA, 20 bp, Artificial Sequence
  chemically synthesized
gataaaagtgtgaatgaact

SEQ ID NO: 501090 - DNA, 20 bp, Artificial Sequence
  chemically synthesized
aaattggttgtgataaaagt

SEQ ID NO: 501091 - DNA, 20 bp, Artificial Sequence
  chemically synthesized
tctttcagattcaccccctg

SEQ ID NO: 501092 - DNA, 20 bp, Artificial Sequence
  chemically synthesized
aggctgaaattcagcagggg

SEQ ID NO: 501093 - DNA, 20 bp, Artificial Sequence
  chemically synthesized
ctggaggctgaaattcagca

SEQ ID NO: 501094 - DNA, 20 bp, Artificial Sequence
  chemically synthesized
ttcaagcaatttttgtatat

SEQ ID NO: 501095 - DNA, 20 bp, Artificial Sequence
  chemically synthesized
aactgctccaattccttcaa

SEQ ID NO: 501096 - DNA, 20 bp, Artificial Sequence
  chemically synthesized
ttaggcctccattcctttga

SEQ ID NO: 501097 - DNA, 20 bp, Artificial Sequence
  chemically synthesized
attagtttagcaacaggagg

SEQ ID NO: 501098 - DNA, 20 bp, Artificial Sequence
  chemically synthesized
tttccatattatgttttatg

SEQ ID NO: 501099 - DNA, 20 bp, Artificial Sequence
  chemically synthesized
atacaactggaaaagtacct

SEQ ID NO: 501100 - DNA, 20 bp, Artificial Sequence
  chemically synthesized
gttgttgatatcaccaaatg

SEQ ID NO: 501101 - DNA, 20 bp, Artificial Sequence
  chemically synthesized
cagtcaatttacagatacat

SEQ ID NO: 501102 - DNA, 20 bp, Artificial Sequence
  chemically synthesized
aataaggtcaaatttgactt

SEQ ID NO: 501103 - DNA, 20 bp, Artificial Sequence
  chemically synthesized
ttacccaaatgtatttatat

SEQ ID NO: 501104 - DNA, 20 bp, Artificial Sequence
  chemically synthesized
atattctgatataaatacat

SEQ ID NO: 501105 - DNA, 20 bp, Artificial Sequence
  chemically synthesized
agtaacctcaggtagaaatg

SEQ ID NO: 501106 - DNA, 20 bp, Artificial Sequence
  chemically synthesized
gattgccatgtagtttttct

SEQ ID NO: 501107 - DNA, 20 bp, Artificial Sequence
  chemically synthesized
ggtgatgcaaataaattcaa

SEQ ID NO: 501108 - DNA, 20 bp, Artificial Sequence
  chemically synthesized
aatatattaggttcattcgt

SEQ ID NO: 501109 - DNA, 20 bp, Artificial Sequence
  chemically synthesized
aacctaatatatttcacata

SEQ ID NO: 501110 - DNA, 20 bp, Artificial Sequence
  chemically synthesized
tctaaacaaaacccttgaaa

SEQ ID NO: 501111 - DNA, 20 bp, Artificial Sequence
  chemically synthesized
ttcacttatcactccttttc

SEQ ID NO: 501112 - DNA, 20 bp, Artificial Sequence
  chemically synthesized
actaaaccttgcccactttt

SEQ ID NO: 501113 - DNA, 20 bp, Artificial Sequence
  chemically synthesized
gtatcaatgtattttattaa

SEQ ID NO: 501114 - DNA, 20 bp, Artificial Sequence
  chemically synthesized
aaatacagcataaagattga

SEQ ID NO: 501115 - DNA, 20 bp, Artificial Sequence
  chemically synthesized
acactagaacatattttata

SEQ ID NO: 501116 - DNA, 20 bp, Artificial Sequence
  chemically synthesized
cagatttctgtatgtcatct

SEQ ID NO: 501117 - DNA, 20 bp, Artificial Sequence
  chemically synthesized
tacttttgtaaaaccaattc

SEQ ID NO: 501118 - DNA, 20 bp, Artificial Sequence
  chemically synthesized
aaaagacacgggggtcattc

SEQ ID NO: 501119 - DNA, 20 bp, Artificial Sequence
  chemically synthesized
atcgtcttggcaaaagacac

SEQ ID NO: 501120 - DNA, 20 bp, Artificial Sequence
  chemically synthesized
gtaggtggggaccaaacttg

SEQ ID NO: 501121 - DNA, 20 bp, Artificial Sequence
  chemically synthesized
tcctgggaatgtgactggag

SEQ ID NO: 501122 - DNA, 20 bp, Artificial Sequence
  chemically synthesized
taaaaattcaacctcttcct

SEQ ID NO: 501123 - DNA, 20 bp, Artificial Sequence
  chemically synthesized
gtcacattcccaggaagagg

SEQ ID NO: 501124 - DNA, 20 bp, Artificial Sequence
  chemically synthesized
ggcaacttctggtgaacaat

SEQ ID NO: 501125 - DNA, 20 bp, Artificial Sequence
  chemically synthesized
aatctgtcactattgaagaa

SEQ ID NO: 501126 - DNA, 20 bp, Artificial Sequence
  chemically synthesized
gagaatcatgtcatcatgaa

SEQ ID NO: 501127 - DNA, 20 bp, Artificial Sequence
  chemically synthesized
catatgagaatcatgtcatc

SEQ ID NO: 501128 - DNA, 20 bp, Artificial Sequence
  chemically synthesized
tggttattcatgttgcatat

SEQ ID NO: 501129 - DNA, 20 bp, Artificial Sequence
  chemically synthesized
acatgattctcatatgcaac

SEQ ID NO: 501130 - DNA, 20 bp, Artificial Sequence
  chemically synthesized
aattatctcataaatctttc

SEQ ID NO: 501131 - DNA, 20 bp, Artificial Sequence
  chemically synthesized
ttcaaatggcaaatgatcat

SEQ ID NO: 501132 - DNA, 20 bp, Artificial Sequence
  chemically synthesized
gtaaaaagattaacaaccct

SEQ ID NO: 501133 - DNA, 20 bp, Artificial Sequence
  chemically synthesized
aattgtatagttatgattct

SEQ ID NO: 501134 - DNA, 20 bp, Artificial Sequence
  chemically synthesized
actatgttctatgtgatttt

SEQ ID NO: 501135 - DNA, 20 bp, Artificial Sequence
  chemically synthesized
aaataacttttattgtgtac

SEQ ID NO: 501136 - DNA, 20 bp, Artificial Sequence
  chemically synthesized
tgagctagagaagaagcagt

SEQ ID NO: 501137 - DNA, 20 bp, Artificial Sequence
  chemically synthesized
cttctctagctcatctctcc

SEQ ID NO: 501138 - DNA, 20 bp, Artificial Sequence
  chemically synthesized
aatttaagatacaattttct

SEQ ID NO: 501139 - DNA, 20 bp, Artificial Sequence
  chemically synthesized
tcaaaagtcagataacagct

SEQ ID NO: 501140 - DNA, 20 bp, Artificial Sequence
  chemically synthesized
cctaagctgttatctgactt

SEQ ID NO: 501141 - DNA, 20 bp, Artificial Sequence
  chemically synthesized
ggctattggagagtctagat

SEQ ID NO: 501142 - DNA, 20 bp, Artificial Sequence
  chemically synthesized
gaaaattcagctggctattg

SEQ ID NO: 501143 - DNA, 20 bp, Artificial Sequence
  chemically synthesized
ctagactctccaatagccag

SEQ ID NO: 501144 - DNA, 20 bp, Artificial Sequence
  chemically synthesized
aagataatgtgctccatact

SEQ ID NO: 501145 - DNA, 20 bp, Artificial Sequence
  chemically synthesized
gcatgacttacgttttacgc

SEQ ID NO: 501146 - DNA, 20 bp, Artificial Sequence
  chemically synthesized
acttgatatttattagacat

SEQ ID NO: 501147 - DNA, 20 bp, Artificial Sequence
  chemically synthesized
tctctgggaatacaaagcaa

SEQ ID NO: 501148 - DNA, 20 bp, Artificial Sequence
  chemically synthesized
ccaggaacgatggagtctct

SEQ ID NO: 501149 - DNA, 20 bp, Artificial Sequence
  chemically synthesized
tgtgtaaggaccaggaacga

SEQ ID NO: 501150 - DNA, 20 bp, Artificial Sequence
  chemically synthesized
tgaagaacctcctgcatcta

SEQ ID NO: 501151 - DNA, 20 bp, Artificial Sequence
  chemically synthesized
ctgcatctattgagtataaa

SEQ ID NO: 501152 - DNA, 20 bp, Artificial Sequence
  chemically synthesized
tatgcctccttcaatgacct

SEQ ID NO: 501153 - DNA, 20 bp, Artificial Sequence
  chemically synthesized
tctgtatgaaaatgcataga

SEQ ID NO: 501154 - DNA, 20 bp, Artificial Sequence
  chemically synthesized
taaagaaactgaggttcaat

SEQ ID NO: 501155 - DNA, 20 bp, Artificial Sequence
  chemically synthesized
ctttataacatggagataag

SEQ ID NO: 501156 - DNA, 20 bp, Artificial Sequence
  chemically synthesized
attactaagatcaaatatgt

SEQ ID NO: 501157 - DNA, 20 bp, Artificial Sequence
  chemically synthesized
ttatagagcatgtatttata

SEQ ID NO: 501158 - DNA, 20 bp, Artificial Sequence
  chemically synthesized
aaatacatgctctataaatc

SEQ ID NO: 501159 - DNA, 20 bp, Artificial Sequence
  chemically synthesized
atggatgattaggattttga

SEQ ID NO: 501160 - DNA, 20 bp, Artificial Sequence
  chemically synthesized
gacctgagccaatggatgat

SEQ ID NO: 501161 - DNA, 20 bp, Artificial Sequence
  chemically synthesized
gaagggcttgacctgagcca

SEQ ID NO: 501162 - DNA, 20 bp, Artificial Sequence
  chemically synthesized
ctttgaaatctatggtttta

SEQ ID NO: 501163 - DNA, 20 bp, Artificial Sequence
  chemically synthesized
aatacatgcttattgatata

SEQ ID NO: 501164 - DNA, 20 bp, Artificial Sequence
  chemically synthesized
aatgagtctttattttacca

SEQ ID NO: 501165 - DNA, 20 bp, Artificial Sequence
  chemically synthesized
acattgtaatggtgaacatg

SEQ ID NO: 501166 - DNA, 20 bp, Artificial Sequence
  chemically synthesized
gattttagattccagtttgg

SEQ ID NO: 501167 - DNA, 20 bp, Artificial Sequence
  chemically synthesized
attatgtaactctaccaaac

SEQ ID NO: 501168 - DNA, 20 bp, Artificial Sequence
  chemically synthesized
taatctgtagttttgttctt

SEQ ID NO: 501169 - DNA, 20 bp, Artificial Sequence
  chemically synthesized
acagccttgcatttagttta

SEQ ID NO: 501170 - DNA, 20 bp, Artificial Sequence
  chemically synthesized
gcagttttttttttttaatc

SEQ ID NO: 501171 - DNA, 20 bp, Artificial Sequence
  chemically synthesized
cataccacagatacagtcag

SEQ ID NO: 501172 - DNA, 20 bp, Artificial Sequence
  chemically synthesized
tccctagacatcctatggag

SEQ ID NO: 501173 - DNA, 20 bp, Artificial Sequence
  chemically synthesized
acatgagaaactcagctcca

SEQ ID NO: 501174 - DNA, 20 bp, Artificial Sequence
  chemically synthesized
ttttcaggaaatatttactt

SEQ ID NO: 501175 - DNA, 20 bp, Artificial Sequence
  chemically synthesized
aaggagcttttttagtgaca

SEQ ID NO: 501176 - DNA, 20 bp, Artificial Sequence
  chemically synthesized
acctgactggttagcattat

SEQ ID NO: 501177 - DNA, 20 bp, Artificial Sequence
  chemically synthesized
ctaagtttccattatcttgc

SEQ ID NO: 501178 - DNA, 20 bp, Artificial Sequence
  chemically synthesized
gacttctttagttcaatgtg

SEQ ID NO: 501179 - DNA, 20 bp, Artificial Sequence
  chemically synthesized
ttaaaaaaattaggaagatt

SEQ ID NO: 501180 - DNA, 20 bp, Artificial Sequence
  chemically synthesized
aaattaggaagattaagaat

SEQ ID NO: 501181 - DNA, 20 bp, Artificial Sequence
  chemically synthesized
tttataagcagagactagat

SEQ ID NO: 501182 - DNA, 20 bp, Artificial Sequence
  chemically synthesized
attttgttcctaaaatgtga

SEQ ID NO: 501183 - DNA, 20 bp, Artificial Sequence
  chemically synthesized
taagaaaatgtctgtgtgaa

SEQ ID NO: 501184 - DNA, 20 bp, Artificial Sequence
  chemically synthesized
cactactataaaagttctac

SEQ ID NO: 501185 - DNA, 20 bp, Artificial Sequence
  chemically synthesized
ttgttttttactatggcaac

SEQ ID NO: 501186 - DNA, 20 bp, Artificial Sequence
  chemically synthesized
ttcatatttttgtattgatt

SEQ ID NO: 501187 - DNA, 20 bp, Artificial Sequence
  chemically synthesized
ctcataatcaatacaaaaat

SEQ ID NO: 501188 - DNA, 20 bp, Artificial Sequence
  chemically synthesized
aaatatgtgtgggttttgaa

SEQ ID NO: 501189 - DNA, 20 bp, Artificial Sequence
  chemically synthesized
taaataagtgtaaaatatgt

SEQ ID NO: 501190 - DNA, 20 bp, Artificial Sequence
  chemically synthesized
cttatttataaatcttaaca

SEQ ID NO: 501191 - DNA, 20 bp, Artificial Sequence
  chemically synthesized
tattagttctttacaatgtt

SEQ ID NO: 501192 - DNA, 20 bp, Artificial Sequence
  chemically synthesized
actaatatctcataattact

SEQ ID NO: 501193 - DNA, 20 bp, Artificial Sequence
  chemically synthesized
tgttttgtttataacttgtg

SEQ ID NO: 501194 - DNA, 20 bp, Artificial Sequence
  chemically synthesized
caagataataagaccgacgt

SEQ ID NO: 501195 - DNA, 20 bp, Artificial Sequence
  chemically synthesized
attatcttgcattatgtgtt

SEQ ID NO: 501196 - DNA, 20 bp, Artificial Sequence
  chemically synthesized
tgaaattttcaggcagtcct

SEQ ID NO: 501197 - DNA, 20 bp, Artificial Sequence
  chemically synthesized
cggggtataggaaaaattac

SEQ ID NO: 501198 - DNA, 20 bp, Artificial Sequence
  chemically synthesized
tataggaaaaattacgggag

SEQ ID NO: 501199 - DNA, 20 bp, Artificial Sequence
  chemically synthesized
tgggattgacctgttatttc

SEQ ID NO: 501200 - DNA, 20 bp, Artificial Sequence
  chemically synthesized
aagctgagatacacataaat

SEQ ID NO: 501201 - DNA, 20 bp, Artificial Sequence
  chemically synthesized
tgcactgctttcttatagac

SEQ ID NO: 501202 - DNA, 20 bp, Artificial Sequence
  chemically synthesized
taagacatattgccaacttt

SEQ ID NO: 501203 - DNA, 20 bp, Artificial Sequence
  chemically synthesized
gcagtgttttcactggaaaa

SEQ ID NO: 501204 - DNA, 20 bp, Artificial Sequence
  chemically synthesized
gtgaactcttaagaaaagca

SEQ ID NO: 501205 - DNA, 20 bp, Artificial Sequence
  chemically synthesized
aaaaattcattgcttttctt

SEQ ID NO: 501206 - DNA, 20 bp, Artificial Sequence
  chemically synthesized
tgggaaagtgttttctgttt

SEQ ID NO: 501207 - DNA, 20 bp, Artificial Sequence
  chemically synthesized
aatgacatgtagaattttaa

SEQ ID NO: 501208 - DNA, 20 bp, Artificial Sequence
  chemically synthesized
gaagaccaaggaatgacatg

SEQ ID NO: 501209 - DNA, 20 bp, Artificial Sequence
  chemically synthesized
tacaaagacagggaagacca

SEQ ID NO: 501210 - DNA, 20 bp, Artificial Sequence
  chemically synthesized
tcttccctgtctttgtaact

SEQ ID NO: 501211 - DNA, 20 bp, Artificial Sequence
  chemically synthesized
tttcctttataaagttgcat

SEQ ID NO: 501212 - DNA, 20 bp, Artificial Sequence
  chemically synthesized
tataatttaacagctcattc

SEQ ID NO: 501213 - DNA, 20 bp, Artificial Sequence
  chemically synthesized
gttttaaaatttggtgactc

SEQ ID NO: 501214 - DNA, 20 bp, Artificial Sequence
  chemically synthesized
atcatgcctgcttttcaatt

SEQ ID NO: 501215 - DNA, 20 bp, Artificial Sequence
  chemically synthesized
ttagacaatttatcataatt

SEQ ID NO: 501216 - DNA, 20 bp, Artificial Sequence
  chemically synthesized
ctgataaatcatcttaatta

SEQ ID NO: 501217 - DNA, 20 bp, Artificial Sequence
  chemically synthesized
atagatgaccacaaaagaac

SEQ ID NO: 501218 - DNA, 20 bp, Artificial Sequence
  chemically synthesized
aagacagggaagtataataa

SEQ ID NO: 501219 - DNA, 20 bp, Artificial Sequence
  chemically synthesized
caactattaattgtgctttg

SEQ ID NO: 501220 - DNA, 20 bp, Artificial Sequence
  chemically synthesized
tgtgctttgttggattattt

SEQ ID NO: 501221 - DNA, 20 bp, Artificial Sequence
  chemically synthesized
ttgaagttttggcattaaag

SEQ ID NO: 501222 - DNA, 20 bp, Artificial Sequence
  chemically synthesized
aattttataacaagttaaca

SEQ ID NO: 501223 - DNA, 20 bp, Artificial Sequence
  chemically synthesized
ttgaatgctttcaatttaca

SEQ ID NO: 501224 - DNA, 20 bp, Artificial Sequence
  chemically synthesized
taaagtgtatctgagtaatt

SEQ ID NO: 501225 - DNA, 20 bp, Artificial Sequence
  chemically synthesized
ttaaaactaataaagtgtat

SEQ ID NO: 501226 - DNA, 20 bp, Artificial Sequence
  chemically synthesized
acatttgttaatctggacta

SEQ ID NO: 501227 - DNA, 20 bp, Artificial Sequence
  chemically synthesized
aatttaggttttagtgtgat

SEQ ID NO: 501228 - DNA, 20 bp, Artificial Sequence
  chemically synthesized
tttaaaccaatctgtagcac

SEQ ID NO: 501229 - DNA, 20 bp, Artificial Sequence
  chemically synthesized
agaatggaaaaaggagactg

SEQ ID NO: 501230 - DNA, 20 bp, Artificial Sequence
  chemically synthesized
taaataaattttcaaagctg

SEQ ID NO: 501231 - DNA, 20 bp, Artificial Sequence
  chemically synthesized
aatattgatatagaaaaata

SEQ ID NO: 501232 - DNA, 20 bp, Artificial Sequence
  chemically synthesized
aatttttcatcttggtttcc

SEQ ID NO: 501233 - DNA, 20 bp, Artificial Sequence
  chemically synthesized
cagactactgatatgatatg

SEQ ID NO: 501234 - DNA, 20 bp, Artificial Sequence
  chemically synthesized
aagttcttttcctctacaga

SEQ ID NO: 501235 - DNA, 20 bp, Artificial Sequence
  chemically synthesized
ctctaataattttaaaataa

SEQ ID NO: 501236 - DNA, 20 bp, Artificial Sequence
  chemically synthesized
accaatgaaatgtcactatt

SEQ ID NO: 501237 - DNA, 20 bp, Artificial Sequence
  chemically synthesized
ttcattggttgcattctttt

SEQ ID NO: 501238 - DNA, 20 bp, Artificial Sequence
  chemically synthesized
agtactttatctattctcaa

SEQ ID NO: 501239 - DNA, 20 bp, Artificial Sequence
  chemically synthesized
ctaatttgtgaggctaatta

SEQ ID NO: 501240 - DNA, 20 bp, Artificial Sequence
  chemically synthesized
acaaaatcaattgaaatcta

SEQ ID NO: 501241 - DNA, 20 bp, Artificial Sequence
  chemically synthesized
tagatttcaattgattttgt

SEQ ID NO: 501242 - DNA, 20 bp, Artificial Sequence
  chemically synthesized
catgcttacacattttaaaa

SEQ ID NO: 501243 - DNA, 20 bp, Artificial Sequence
  chemically synthesized
actggatgcaaaatatattc

SEQ ID NO: 501244 - DNA, 20 bp, Artificial Sequence
  chemically synthesized
gcaaaatatattcgtgggtc

SEQ ID NO: 501245 - DNA, 20 bp, Artificial Sequence
  chemically synthesized
aggaagcagattcttgaccc

SEQ ID NO: 501246 - DNA, 20 bp, Artificial Sequence
  chemically synthesized
accttttataaagtttaact

SEQ ID NO: 501247 - DNA, 20 bp, Artificial Sequence
  chemically synthesized
ttcatgattacatgactttt

SEQ ID NO: 501248 - DNA, 20 bp, Artificial Sequence
  chemically synthesized
atgactttttggagtaggaa

SEQ ID NO: 501249 - DNA, 20 bp, Artificial Sequence
  chemically synthesized
tctgtctcccccatacattt

SEQ ID NO: 501250 - DNA, 20 bp, Artificial Sequence
  chemically synthesized
aagaaatggaagaaggaagg

SEQ ID NO: 501251 - DNA, 20 bp, Artificial Sequence
  chemically synthesized
tcactgtatttgaagtgaaa

SEQ ID NO: 501252 - DNA, 20 bp, Artificial Sequence
  chemically synthesized
aatagaggcagtaaactatg

SEQ ID NO: 501253 - DNA, 20 bp, Artificial Sequence
  chemically synthesized
aggaggttgtgagagtgtca

SEQ ID NO: 501254 - DNA, 20 bp, Artificial Sequence
  chemically synthesized
agatatttataggaggttgt

SEQ ID NO: 501255 - DNA, 20 bp, Artificial Sequence
  chemically synthesized
gaaataattaaagctatttg

SEQ ID NO: 501256 - DNA, 20 bp, Artificial Sequence
  chemically synthesized
gtgtcatttgataaaactat

SEQ ID NO: 501257 - DNA, 20 bp, Artificial Sequence
  chemically synthesized
tttttaaagtagatgtgtaa

SEQ ID NO: 501258 - DNA, 20 bp, Artificial Sequence
  chemically synthesized
atattttacatggttaccaa

SEQ ID NO: 501259 - DNA, 20 bp, Artificial Sequence
  chemically synthesized
aatggacttaaccttgttat

SEQ ID NO: 501260 - DNA, 20 bp, Artificial Sequence
  chemically synthesized
tggaaaaaataagctaacat

SEQ ID NO: 501261 - DNA, 20 bp, Artificial Sequence
  chemically synthesized
gcaaattttattttactaaa

SEQ ID NO: 501262 - DNA, 20 bp, Artificial Sequence
  chemically synthesized
tatagaaaattttactaaaa

SEQ ID NO: 501263 - DNA, 20 bp, Artificial Sequence
  chemically synthesized
attaaaaaaattaaaattta

SEQ ID NO: 501264 - DNA, 20 bp, Artificial Sequence
  chemically synthesized
atttaaagaatatatatagc

SEQ ID NO: 501265 - DNA, 20 bp, Artificial Sequence
  chemically synthesized
gaaggtccaatgaagatgta

SEQ ID NO: 501266 - DNA, 20 bp, Artificial Sequence
  chemically synthesized
agtgaccttcccatgtaatg

SEQ ID NO: 501267 - DNA, 20 bp, Artificial Sequence
  chemically synthesized
aagtttataggaggctgtga

SEQ ID NO: 501268 - DNA, 20 bp, Artificial Sequence
  chemically synthesized
ttgtgaaagtctcttatcca

SEQ ID NO: 501269 - DNA, 20 bp, Artificial Sequence
  chemically synthesized
gatataaaagtaatcattct

SEQ ID NO: 501270 - DNA, 20 bp, Artificial Sequence
  chemically synthesized
tacttttatatcttctgaca

SEQ ID NO: 501271 - DNA, 20 bp, Artificial Sequence
  chemically synthesized
attattgcagcaatcaaaca

SEQ ID NO: 501272 - DNA, 20 bp, Artificial Sequence
  chemically synthesized
atatatatagaaactgctac

SEQ ID NO: 501273 - DNA, 20 bp, Artificial Sequence
  chemically synthesized
ttactaagacttatttgcta

SEQ ID NO: 501274 - DNA, 20 bp, Artificial Sequence
  chemically synthesized
atagcaaataagtcttagta

SEQ ID NO: 501275 - DNA, 20 bp, Artificial Sequence
  chemically synthesized
tttctggttagtatcaattt

SEQ ID NO: 501276 - DNA, 20 bp, Artificial Sequence
  chemically synthesized
tttaatttttatttttgaga

SEQ ID NO: 501277 - DNA, 20 bp, Artificial Sequence
  chemically synthesized
ctgcaccccagcctgggcga

SEQ ID NO: 501278 - DNA, 20 bp, Artificial Sequence
  chemically synthesized
tctcactctgtcgcccaggc

SEQ ID NO: 501279 - DNA, 20 bp, Artificial Sequence
  chemically synthesized
ctcactgcaacctccgcctc

SEQ ID NO: 501280 - DNA, 20 bp, Artificial Sequence
  chemically synthesized
tcctcagcctcccaagtagc

SEQ ID NO: 501281 - DNA, 20 bp, Artificial Sequence
  chemically synthesized
tttgtatttttagtagagaa

SEQ ID NO: 501282 - DNA, 20 bp, Artificial Sequence
  chemically synthesized
caggcagatcacctgacgtc

SEQ ID NO: 501283 - DNA, 20 bp, Artificial Sequence
  chemically synthesized
gcagcggcctcccaaagtgt

SEQ ID NO: 501284 - DNA, 20 bp, Artificial Sequence
  chemically synthesized
caccgcaccaggcctattat

SEQ ID NO: 501285 - DNA, 20 bp, Artificial Sequence
  chemically synthesized
tgcagactttcctagtcaat

SEQ ID NO: 501286 - DNA, 20 bp, Artificial Sequence
  chemically synthesized
tagtcaatcagagttaaatt

SEQ ID NO: 501287 - DNA, 20 bp, Artificial Sequence
  chemically synthesized
agttaaatttggagtcattt

SEQ ID NO: 501288 - DNA, 20 bp, Artificial Sequence
  chemically synthesized
tttttgaattcatcatcttc

SEQ ID NO: 501289 - DNA, 20 bp, Artificial Sequence
  chemically synthesized
tacaaggacccaagaagatg

SEQ ID NO: 501290 - DNA, 20 bp, Artificial Sequence
  chemically synthesized
ggagatatttagaggtagcc

SEQ ID NO: 501291 - DNA, 20 bp, Artificial Sequence
  chemically synthesized
ctaggtctggagtggagcac

SEQ ID NO: 501292 - DNA, 20 bp, Artificial Sequence
  chemically synthesized
tgtgctccactccagaccta

SEQ ID NO: 501293 - DNA, 20 bp, Artificial Sequence
  chemically synthesized
agcttctgactcactaggtc

SEQ ID NO: 501294 - DNA, 20 bp, Artificial Sequence
  chemically synthesized
gacctagtgagtcagaagct

SEQ ID NO: 501295 - DNA, 20 bp, Artificial Sequence
  chemically synthesized
aatcttttgtatgcacttgg

SEQ ID NO: 501296 - DNA, 20 bp, Artificial Sequence
  chemically synthesized
agtaaatcttttgtatgcac

SEQ ID NO: 501297 - DNA, 20 bp, Artificial Sequence
  chemically synthesized
tcaaaaaaagggatagctat

SEQ ID NO: 501298 - DNA, 20 bp, Artificial Sequence
  chemically synthesized
acactgatgacctcaaaaaa

SEQ ID NO: 501299 - DNA, 20 bp, Artificial Sequence
  chemically synthesized
aacttcatgtcattattcag

SEQ ID NO: 501300 - DNA, 20 bp, Artificial Sequence
  chemically synthesized
tagttgtgaggagaattcca

SEQ ID NO: 501301 - DNA, 20 bp, Artificial Sequence
  chemically synthesized
agtccagtgatagttgtgag

SEQ ID NO: 501302 - DNA, 20 bp, Artificial Sequence
  chemically synthesized
gcttaattcagtatgcaatg

SEQ ID NO: 501303 - DNA, 20 bp, Artificial Sequence
  chemically synthesized
caagaactcttcattgcata

SEQ ID NO: 501304 - DNA, 20 bp, Artificial Sequence
  chemically synthesized
cattgcatactgaattaagc

SEQ ID NO: 501305 - DNA, 20 bp, Artificial Sequence
  chemically synthesized
atggaagataaaacttagtt

SEQ ID NO: 501306 - DNA, 20 bp, Artificial Sequence
  chemically synthesized
gagtgagttcctttagtttt

SEQ ID NO: 501307 - DNA, 20 bp, Artificial Sequence
  chemically synthesized
tacagtgtgttcaatgaaga

SEQ ID NO: 501308 - DNA, 20 bp, Artificial Sequence
  chemically synthesized
agcatacagtgtgttcaatg

SEQ ID NO: 501309 - DNA, 20 bp, Artificial Sequence
  chemically synthesized
agctttctcatatgtttatg

SEQ ID NO: 501310 - DNA, 20 bp, Artificial Sequence
  chemically synthesized
tgttacctcctctgtgttgc

SEQ ID NO: 501311 - DNA, 20 bp, Artificial Sequence
  chemically synthesized
tgagagtgagtgcatggtaa

SEQ ID NO: 501312 - DNA, 20 bp, Artificial Sequence
  chemically synthesized
tcatggatactagattgaga

SEQ ID NO: 501313 - DNA, 20 bp, Artificial Sequence
  chemically synthesized
gtgttcatggatactagatt

SEQ ID NO: 501314 - DNA, 20 bp, Artificial Sequence
  chemically synthesized
tgatagggcaagatgtgttc

SEQ ID NO: 501315 - DNA, 20 bp, Artificial Sequence
  chemically synthesized
atcatcaaacagtaagctcc

SEQ ID NO: 501316 - DNA, 20 bp, Artificial Sequence
  chemically synthesized
ctattgctaggtaaaatacg

SEQ ID NO: 501317 - DNA, 20 bp, Artificial Sequence
  chemically synthesized
taacagtgtttggtagtgag

SEQ ID NO: 501318 - DNA, 20 bp, Artificial Sequence
  chemically synthesized
gaaaataatatatggttggt

SEQ ID NO: 501319 - DNA, 20 bp, Artificial Sequence
  chemically synthesized
gagaaaagggattaatcagg

SEQ ID NO: 501320 - DNA, 20 bp, Artificial Sequence
  chemically synthesized
acttgagaaaagggattaat

SEQ ID NO: 501321 - DNA, 20 bp, Artificial Sequence
  chemically synthesized
atgagtgaagacttgagaaa

SEQ ID NO: 501322 - DNA, 20 bp, Artificial Sequence
  chemically synthesized
aggtatatctaaaagcacta

SEQ ID NO: 501323 - DNA, 20 bp, Artificial Sequence
  chemically synthesized
tagaagccaagttggagaag

SEQ ID NO: 501324 - DNA, 20 bp, Artificial Sequence
  chemically synthesized
ttctccaacttggcttctag

SEQ ID NO: 501325 - DNA, 20 bp, Artificial Sequence
  chemically synthesized
tggcttctagagggatggag

SEQ ID NO: 501326 - DNA, 20 bp, Artificial Sequence
  chemically synthesized
gtagaactgtcataattaat

SEQ ID NO: 501327 - DNA, 20 bp, Artificial Sequence
  chemically synthesized
agtggcatggctgagggcaa

SEQ ID NO: 501328 - DNA, 20 bp, Artificial Sequence
  chemically synthesized
ctgtctctgttttagggcat

SEQ ID NO: 501329 - DNA, 20 bp, Artificial Sequence
  chemically synthesized
aaacagagacagttgagaca

SEQ ID NO: 501330 - DNA, 20 bp, Artificial Sequence
  chemically synthesized
tagaaccctgagtaaattga

SEQ ID NO: 501331 - DNA, 20 bp, Artificial Sequence
  chemically synthesized
attgattctgtcaatttact

SEQ ID NO: 501332 - DNA, 20 bp, Artificial Sequence
  chemically synthesized
tcagagataatattagaacc

SEQ ID NO: 501333 - DNA, 20 bp, Artificial Sequence
  chemically synthesized
gcagttttaatggagaggat

SEQ ID NO: 501334 - DNA, 20 bp, Artificial Sequence
  chemically synthesized
gaaatggcagttttaatgga

SEQ ID NO: 501335 - DNA, 20 bp, Artificial Sequence
  chemically synthesized
acacgcttttttcaaagtca

SEQ ID NO: 501336 - DNA, 20 bp, Artificial Sequence
  chemically synthesized
ccattttattaaggttacct

SEQ ID NO: 501337 - DNA, 20 bp, Artificial Sequence
  chemically synthesized
gatgaatttaagaactacta

SEQ ID NO: 501338 - DNA, 20 bp, Artificial Sequence
  chemically synthesized
ccttaaagataatgaagtgg

SEQ ID NO: 501339 - DNA, 20 bp, Artificial Sequence
  chemically synthesized
ccagccttaaagataatgaa

SEQ ID NO: 501340 - DNA, 20 bp, Artificial Sequence
  chemically synthesized
tggtctctgctgtaatcgac

SEQ ID NO: 501341 - DNA, 20 bp, Artificial Sequence
  chemically synthesized
aaactgatggaaaaaaatga

SEQ ID NO: 501342 - DNA, 20 bp, Artificial Sequence
  chemically synthesized
cacttgaatggccgaatctg

SEQ ID NO: 501343 - DNA, 20 bp, Artificial Sequence
  chemically synthesized
cgtatattacacttgaatgg

SEQ ID NO: 501344 - DNA, 20 bp, Artificial Sequence
  chemically synthesized
catcgttacgtatattacac

SEQ ID NO: 501345 - DNA, 20 bp, Artificial Sequence
  chemically synthesized
gttaaaaataattaatatca

SEQ ID NO: 501346 - DNA, 20 bp, Artificial Sequence
  chemically synthesized
tttaatctaaagattgtaat

SEQ ID NO: 501347 - DNA, 20 bp, Artificial Sequence
  chemically synthesized
cacattactacttagtgatt

SEQ ID NO: 501348 - DNA, 20 bp, Artificial Sequence
  chemically synthesized
gtcctcagccaatctgaact

SEQ ID NO: 501349 - DNA, 20 bp, Artificial Sequence
  chemically synthesized
gcccagaaagcagtgagtaa

SEQ ID NO: 501350 - DNA, 20 bp, Artificial Sequence
  chemically synthesized
attccgaagcccagaaagca

SEQ ID NO: 501351 - DNA, 20 bp, Artificial Sequence
  chemically synthesized
actcactgctttctgggctt

SEQ ID NO: 501352 - DNA, 20 bp, Artificial Sequence
  chemically synthesized
acagtcctggcaggagacat

SEQ ID NO: 501353 - DNA, 20 bp, Artificial Sequence
  chemically synthesized
atttggtgaagaatacaaag

SEQ ID NO: 501354 - DNA, 20 bp, Artificial Sequence
  chemically synthesized
tctagatttactatttggtg

SEQ ID NO: 501355 - DNA, 20 bp, Artificial Sequence
  chemically synthesized
aatagtaaatctagacacca

SEQ ID NO: 501356 - DNA, 20 bp, Artificial Sequence
  chemically synthesized
aacataactctaaagagccc

SEQ ID NO: 501357 - DNA, 20 bp, Artificial Sequence
  chemically synthesized
ttctctattcaagggctctt

SEQ ID NO: 501358 - DNA, 20 bp, Artificial Sequence
  chemically synthesized
tactgaaattactgattaca

SEQ ID NO: 501359 - DNA, 20 bp, Artificial Sequence
  chemically synthesized
aaagtagatttggattgaac

SEQ ID NO: 501360 - DNA, 20 bp, Artificial Sequence
  chemically synthesized
tggtgataaaaaaagtagat

SEQ ID NO: 501361 - DNA, 20 bp, Artificial Sequence
  chemically synthesized
tctatgtctaagtttcatgg

SEQ ID NO: 501362 - DNA, 20 bp, Artificial Sequence
  chemically synthesized
agaatatggcttttctatgg

SEQ ID NO: 501363 - DNA, 20 bp, Artificial Sequence
  chemically synthesized
tatacaggataatattaggt

SEQ ID NO: 501364 - DNA, 20 bp, Artificial Sequence
  chemically synthesized
tctttatagtaggggttata

SEQ ID NO: 501365 - DNA, 20 bp, Artificial Sequence
  chemically synthesized
aaatcaggtttctttatagt

SEQ ID NO: 501366 - DNA, 20 bp, Artificial Sequence
  chemically synthesized
ctgaagtgctggaggtttta

SEQ ID NO: 501367 - DNA, 20 bp, Artificial Sequence
  chemically synthesized
tgtcttgtgtgtgtttgctc

SEQ ID NO: 501368 - DNA, 20 bp, Artificial Sequence
  chemically synthesized
ttgtaatcaacaaaagatta

SEQ ID NO: 501369 - DNA, 20 bp, Artificial Sequence
  chemically synthesized
agccaaattttagaacgagc

SEQ ID NO: 501370 - DNA, 20 bp, Artificial Sequence
  chemically synthesized
atgagcataatttatacttc

SEQ ID NO: 501371 - DNA, 20 bp, Artificial Sequence
  chemically synthesized
tatctttctccttcctatga

SEQ ID NO: 501372 - DNA, 20 bp, Artificial Sequence
  chemically synthesized
attaataaattggaaaataa

SEQ ID NO: 501373 - DNA, 20 bp, Artificial Sequence
  chemically synthesized
ttaaataataatattttggg

SEQ ID NO: 501374 - DNA, 20 bp, Artificial Sequence
  chemically synthesized
ctcatcttacaaacaatgaa

SEQ ID NO: 501375 - DNA, 20 bp, Artificial Sequence
  chemically synthesized
ctaactttttcagtagtagc

SEQ ID NO: 501376 - DNA, 20 bp, Artificial Sequence
  chemically synthesized
taatctcaccagagaaaaca

SEQ ID NO: 501377 - DNA, 20 bp, Artificial Sequence
  chemically synthesized
atttgaacatccccatgaag

SEQ ID NO: 501378 - DNA, 20 bp, Artificial Sequence
  chemically synthesized
taacactaattcatcttcat

SEQ ID NO: 501379 - DNA, 20 bp, Artificial Sequence
  chemically synthesized
atacatgttttcaaacagaa

SEQ ID NO: 501380 - DNA, 20 bp, Artificial Sequence
  chemically synthesized
aaaacatgtatttcttaagc

SEQ ID NO: 501381 - DNA, 20 bp, Artificial Sequence
  chemically synthesized
agattgtggtgagaagatac

SEQ ID NO: 501382 - DNA, 20 bp, Artificial Sequence
  chemically synthesized
atattcattgcatcagctaa

SEQ ID NO: 501383 - DNA, 20 bp, Artificial Sequence
  chemically synthesized
caatcccattagctgatgca

SEQ ID NO: 501384 - DNA, 20 bp, Artificial Sequence
  chemically synthesized
atctcttcagagccctaaaa

SEQ ID NO: 501385 - DNA, 20 bp, Artificial Sequence
  chemically synthesized
ctctaaattagtaaaggcaa

SEQ ID NO: 501386 - DNA, 20 bp, Artificial Sequence
  chemically synthesized
gcctgggcctctcaaagtgc

SEQ ID NO: 501387 - DNA, 20 bp, Artificial Sequence
  chemically synthesized
actttgagaggcccaggcag

SEQ ID NO: 501388 - DNA, 20 bp, Artificial Sequence
  chemically synthesized
caggaggatcacttgaggtc

SEQ ID NO: 501389 - DNA, 20 bp, Artificial Sequence
  chemically synthesized
tttttgtattttggcagaga

SEQ ID NO: 501390 - DNA, 20 bp, Artificial Sequence
  chemically synthesized
gcctcagcctcccaagtagc

SEQ ID NO: 501391 - DNA, 20 bp, Artificial Sequence
  chemically synthesized
tacttgggaggctgaggcag

SEQ ID NO: 501392 - DNA, 20 bp, Artificial Sequence
  chemically synthesized
tcactgcaacctctgcctcc

SEQ ID NO: 501393 - DNA, 20 bp, Artificial Sequence
  chemically synthesized
actctctctgttgcccaggc

SEQ ID NO: 501394 - DNA, 20 bp, Artificial Sequence
  chemically synthesized
actccagcctgggcaacaga

SEQ ID NO: 501395 - DNA, 20 bp, Artificial Sequence
  chemically synthesized
aataataataataataataa

SEQ ID NO: 501396 - DNA, 20 bp, Artificial Sequence
  chemically synthesized
taaggcataagaaatttcca

SEQ ID NO: 501397 - DNA, 20 bp, Artificial Sequence
  chemically synthesized
gggaaaataaaagaagttca

SEQ ID NO: 501398 - DNA, 20 bp, Artificial Sequence
  chemically synthesized
aaataaaagaagttcataga

SEQ ID NO: 501399 - DNA, 20 bp, Artificial Sequence
  chemically synthesized
agtatacttacaaattcatg

SEQ ID NO: 501400 - DNA, 20 bp, Artificial Sequence
  chemically synthesized
gttttcatttcacattctgc

SEQ ID NO: 501401 - DNA, 20 bp, Artificial Sequence
  chemically synthesized
tttgtgaccaagacaagttt

SEQ ID NO: 501402 - DNA, 20 bp, Artificial Sequence
  chemically synthesized
tggtcacaaacttgtattgg

SEQ ID NO: 501403 - DNA, 20 bp, Artificial Sequence
  chemically synthesized
cacagatattaaaaaatggg

SEQ ID NO: 501404 - DNA, 20 bp, Artificial Sequence
  chemically synthesized
tggttcacagatattaaaaa

SEQ ID NO: 501405 - DNA, 20 bp, Artificial Sequence
  chemically synthesized
gagaaaataaggtattatct

SEQ ID NO: 501406 - DNA, 20 bp, Artificial Sequence
  chemically synthesized
tttaataaatcactaagcta

SEQ ID NO: 501407 - DNA, 20 bp, Artificial Sequence
  chemically synthesized
atgaagtagtagcatttttt

SEQ ID NO: 501408 - DNA, 20 bp, Artificial Sequence
  chemically synthesized
gcttatgtaataacaagaca

SEQ ID NO: 501409 - DNA, 20 bp, Artificial Sequence
  chemically synthesized
aaaattgattaaagttttga

SEQ ID NO: 501410 - DNA, 20 bp, Artificial Sequence
  chemically synthesized
actgtcacaaatatatatat

SEQ ID NO: 501411 - DNA, 20 bp, Artificial Sequence
  chemically synthesized
gctgtctctctccatatgta

SEQ ID NO: 501412 - DNA, 20 bp, Artificial Sequence
  chemically synthesized
ggtctctatgtatggagaga

SEQ ID NO: 501413 - DNA, 20 bp, Artificial Sequence
  chemically synthesized
actattaaaaataacttgca

SEQ ID NO: 501414 - DNA, 20 bp, Artificial Sequence
  chemically synthesized
caactttttaatttgggaag

SEQ ID NO: 501415 - DNA, 20 bp, Artificial Sequence
  chemically synthesized
atttgggaaggtgaattttg

SEQ ID NO: 501416 - DNA, 20 bp, Artificial Sequence
  chemically synthesized
tgcatacaagctaaactatt

SEQ ID NO: 501417 - DNA, 20 bp, Artificial Sequence
  chemically synthesized
tgaaaatgttctatttttcc

SEQ ID NO: 501418 - DNA, 20 bp, Artificial Sequence
  chemically synthesized
atctgaaatgaaaaaaacat

SEQ ID NO: 501419 - DNA, 20 bp, Artificial Sequence
  chemically synthesized
aatgtataaatatagtgtta

SEQ ID NO: 501420 - DNA, 20 bp, Artificial Sequence
  chemically synthesized
ttactgtttaagaagaacca

SEQ ID NO: 501421 - DNA, 20 bp, Artificial Sequence
  chemically synthesized
gcatataaaattacaaaaat

SEQ ID NO: 501422 - DNA, 20 bp, Artificial Sequence
  chemically synthesized
gatcatttcattatagccta

SEQ ID NO: 501423 - DNA, 20 bp, Artificial Sequence
  chemically synthesized
tgtacatcttctgcacggtc

SEQ ID NO: 501424 - DNA, 20 bp, Artificial Sequence
  chemically synthesized
aagatgtacaagacctcatt

SEQ ID NO: 501425 - DNA, 20 bp, Artificial Sequence
  chemically synthesized
caatattgcttgtatgtaat

SEQ ID NO: 501426 - DNA, 20 bp, Artificial Sequence
  chemically synthesized
atcggtagtgctttatgttg

SEQ ID NO: 501427 - DNA, 20 bp, Artificial Sequence
  chemically synthesized
cagtttacatacgtactttc

SEQ ID NO: 501428 - DNA, 20 bp, Artificial Sequence
  chemically synthesized
tacgtatgtaaactgcagca

SEQ ID NO: 501429 - DNA, 20 bp, Artificial Sequence
  chemically synthesized
tgcagcatagaatgcagtcc

SEQ ID NO: 501430 - DNA, 20 bp, Artificial Sequence
  chemically synthesized
agagagagacagagacgggg

SEQ ID NO: 501431 - DNA, 20 bp, Artificial Sequence
  chemically synthesized
gcaaggttttcaaaaggaaa

SEQ ID NO: 501432 - DNA, 20 bp, Artificial Sequence
  chemically synthesized
tccttttgaaaaccttgctg

SEQ ID NO: 501433 - DNA, 20 bp, Artificial Sequence
  chemically synthesized
tggggtctacttgccccttt

SEQ ID NO: 501434 - DNA, 20 bp, Artificial Sequence
  chemically synthesized
tttagcacaagtttccacct

SEQ ID NO: 501435 - DNA, 20 bp, Artificial Sequence
  chemically synthesized
cgatttgcagccatttcaca

SEQ ID NO: 501436 - DNA, 20 bp, Artificial Sequence
  chemically synthesized
gtttgctgcttggtcacgtg

SEQ ID NO: 501437 - DNA, 20 bp, Artificial Sequence
  chemically synthesized
tatagcgtttaaaggcagaa

SEQ ID NO: 501438 - DNA, 20 bp, Artificial Sequence
  chemically synthesized
caagtcctatctcttgctca

SEQ ID NO: 501439 - DNA, 20 bp, Artificial Sequence
  chemically synthesized
gaaaaagagagccaaacaga

SEQ ID NO: 501440 - DNA, 20 bp, Artificial Sequence
  chemically synthesized
cgagtgagcaagtgagcgag

SEQ ID NO: 501441 - DNA, 20 bp, Artificial Sequence
  chemically synthesized
tatttagtccgaggaaggac

SEQ ID NO: 501442 - DNA, 20 bp, Artificial Sequence
  chemically synthesized
tataataaaataagactaaa

SEQ ID NO: 501443 - DNA, 20 bp, Artificial Sequence
  chemically synthesized
cttattttattatatcgtta

SEQ ID NO: 501444 - DNA, 20 bp, Artificial Sequence
  chemically synthesized
gttactgaatttaatagttg

SEQ ID NO: 501445 - DNA, 20 bp, Artificial Sequence
  chemically synthesized
ggaacttgaaagtgctagga

SEQ ID NO: 501446 - DNA, 20 bp, Artificial Sequence
  chemically synthesized
tcaagttcctctttattaca

SEQ ID NO: 501447 - DNA, 20 bp, Artificial Sequence
  chemically synthesized
aaagtgattttctaacacat

SEQ ID NO: 501448 - DNA, 20 bp, Artificial Sequence
  chemically synthesized
tgtcacatacagaggtactg

SEQ ID NO: 501449 - DNA, 20 bp, Artificial Sequence
  chemically synthesized
ggaatgttcttcctgacctg

SEQ ID NO: 501450 - DNA, 20 bp, Artificial Sequence
  chemically synthesized
ggctttttgaataatagggt

SEQ ID NO: 501451 - DNA, 20 bp, Artificial Sequence
  chemically synthesized
cttcaaggctttttgaataa

SEQ ID NO: 501452 - DNA, 20 bp, Artificial Sequence
  chemically synthesized
tgaatttccttcaaggcttt

SEQ ID NO: 501453 - DNA, 20 bp, Artificial Sequence
  chemically synthesized
gtcagagatgtcatcttatg

SEQ ID NO: 501454 - DNA, 20 bp, Artificial Sequence
  chemically synthesized
acatctctgactatacatca

SEQ ID NO: 501455 - DNA, 20 bp, Artificial Sequence
  chemically synthesized
tgtctgaagcttattttgat

SEQ ID NO: 501456 - DNA, 20 bp, Artificial Sequence
  chemically synthesized
caatggcataaatgtgtttt

SEQ ID NO: 501457 - DNA, 20 bp, Artificial Sequence
  chemically synthesized
aatgtgttttggggatagcc

SEQ ID NO: 501458 - DNA, 20 bp, Artificial Sequence
  chemically synthesized
tgttttggggatagcctgga

SEQ ID NO: 501459 - DNA, 20 bp, Artificial Sequence
  chemically synthesized
catagaaagaaacataattt

SEQ ID NO: 501460 - DNA, 20 bp, Artificial Sequence
  chemically synthesized
tcccaattaaataggtagag

SEQ ID NO: 501461 - DNA, 20 bp, Artificial Sequence
  chemically synthesized
tcttttcccaattaaatagg

SEQ ID NO: 501462 - DNA, 20 bp, Artificial Sequence
  chemically synthesized
cacctctcatacccttttat

SEQ ID NO: 501463 - DNA, 20 bp, Artificial Sequence
  chemically synthesized
ttaaaaaatgattccgataa

SEQ ID NO: 501464 - DNA, 20 bp, Artificial Sequence
  chemically synthesized
ttagtctcaaaactgactgt

SEQ ID NO: 501465 - DNA, 20 bp, Artificial Sequence
  chemically synthesized
aactacatgtaaactaggct

SEQ ID NO: 501466 - DNA, 20 bp, Artificial Sequence
  chemically synthesized
ttaagactaattaccaagat

SEQ ID NO: 501467 - DNA, 20 bp, Artificial Sequence
  chemically synthesized
taggcaaaaaaatcagctga

SEQ ID NO: 501468 - DNA, 20 bp, Artificial Sequence
  chemically synthesized
ctatcattcatttagcccat

SEQ ID NO: 501469 - DNA, 20 bp, Artificial Sequence
  chemically synthesized
tgttcattcagatgggctaa

SEQ ID NO: 501470 - DNA, 20 bp, Artificial Sequence
  chemically synthesized
ttgttctttgtgttagacac

SEQ ID NO: 501471 - DNA, 20 bp, Artificial Sequence
  chemically synthesized
tatgatttcaaaataaatct

SEQ ID NO: 501472 - DNA, 20 bp, Artificial Sequence
  chemically synthesized
tcttggaatatctttctgaa

SEQ ID NO: 501473 - DNA, 20 bp, Artificial Sequence
  chemically synthesized
ctttctgaacggagtttaca

SEQ ID NO: 501474 - DNA, 20 bp, Artificial Sequence
  chemically synthesized
tttacattgggtataattaa

SEQ ID NO: 501475 - DNA, 20 bp, Artificial Sequence
  chemically synthesized
tgggtataattaactgagtg

SEQ ID NO: 501476 - DNA, 20 bp, Artificial Sequence
  chemically synthesized
aatggaaatgaatgattttg

SEQ ID NO: 501477 - DNA, 20 bp, Artificial Sequence
  chemically synthesized
ccttccccctttgaatggaa

SEQ ID NO: 501478 - DNA, 20 bp, Artificial Sequence
  chemically synthesized
ctttttccttccttccccct

SEQ ID NO: 501479 - DNA, 20 bp, Artificial Sequence
  chemically synthesized
gaaagataaaggaaggaaga

SEQ ID NO: 501480 - DNA, 20 bp, Artificial Sequence
  chemically synthesized
gatactaaggacgtcttaat

SEQ ID NO: 501481 - DNA, 20 bp, Artificial Sequence
  chemically synthesized
taagcacgtcttctttttgc

SEQ ID NO: 501482 - DNA, 20 bp, Artificial Sequence
  chemically synthesized
tcaggctgacacacttttgg

SEQ ID NO: 501483 - DNA, 20 bp, Artificial Sequence
  chemically synthesized
tcattcaggctgacacactt

SEQ ID NO: 501484 - DNA, 20 bp, Artificial Sequence
  chemically synthesized
tcatccaaaagtgtgtcagc

SEQ ID NO: 501485 - DNA, 20 bp, Artificial Sequence
  chemically synthesized
aatgtggaccacatcacaaa

SEQ ID NO: 501486 - DNA, 20 bp, Artificial Sequence
  chemically synthesized
aacacatggaaacttttgac

SEQ ID NO: 501487 - DNA, 20 bp, Artificial Sequence
  chemically synthesized
ggtatgtctctgtacaatta

SEQ ID NO: 501488 - DNA, 20 bp, Artificial Sequence
  chemically synthesized
ttggttagacaatattctta

SEQ ID NO: 501489 - DNA, 20 bp, Artificial Sequence
  chemically synthesized
gaacataggaaaaattcttt

SEQ ID NO: 501490 - DNA, 20 bp, Artificial Sequence
  chemically synthesized
ttttaagtggtattttcata

SEQ ID NO: 501491 - DNA, 20 bp, Artificial Sequence
  chemically synthesized
ttaaaatattgttatagata

SEQ ID NO: 501492 - DNA, 20 bp, Artificial Sequence
  chemically synthesized
attaagagccagcatatacg

SEQ ID NO: 501493 - DNA, 20 bp, Artificial Sequence
  chemically synthesized
aattgagaaattttcaaaca

SEQ ID NO: 501494 - DNA, 20 bp, Artificial Sequence
  chemically synthesized
atctttttctcgtgacagag

SEQ ID NO: 501495 - DNA, 20 bp, Artificial Sequence
  chemically synthesized
agctgtcacctcccgagcag

SEQ ID NO: 501496 - DNA, 20 bp, Artificial Sequence
  chemically synthesized
ctcagtcttctgaatagtaa

SEQ ID NO: 501497 - DNA, 20 bp, Artificial Sequence
  chemically synthesized
tccagttactattcagaaga

SEQ ID NO: 501498 - DNA, 20 bp, Artificial Sequence
  chemically synthesized
tggaagataaactcagtctt

SEQ ID NO: 501499 - DNA, 20 bp, Artificial Sequence
  chemically synthesized
agaaacagaaggtgcacctg

SEQ ID NO: 501500 - DNA, 20 bp, Artificial Sequence
  chemically synthesized
ttctgtttctcaatctcttt

SEQ ID NO: 501501 - DNA, 20 bp, Artificial Sequence
  chemically synthesized
gttataggtttaaaaccttg

SEQ ID NO: 501502 - DNA, 20 bp, Artificial Sequence
  chemically synthesized
aaacctataactatgtatta

SEQ ID NO: 501503 - DNA, 20 bp, Artificial Sequence
  chemically synthesized
tatatactgaagcttcattg

SEQ ID NO: 501504 - DNA, 20 bp, Artificial Sequence
  chemically synthesized
tttataatgaaaaataagac

SEQ ID NO: 501505 - DNA, 20 bp, Artificial Sequence
  chemically synthesized
gggcagtttcttatttgtgg

SEQ ID NO: 501506 - DNA, 20 bp, Artificial Sequence
  chemically synthesized
ctaagggcagtttcttattt

SEQ ID NO: 501507 - DNA, 20 bp, Artificial Sequence
  chemically synthesized
aatacagtagcaccatactg

SEQ ID NO: 501508 - DNA, 20 bp, Artificial Sequence
  chemically synthesized
tgctactgtatttctgcagc

SEQ ID NO: 501509 - DNA, 20 bp, Artificial Sequence
  chemically synthesized
ttttttagccttttagtgcc

SEQ ID NO: 501510 - DNA, 20 bp, Artificial Sequence
  chemically synthesized
ttaaaagcattattatgaga

SEQ ID NO: 501511 - DNA, 20 bp, Artificial Sequence
  chemically synthesized
gcatttaaaagcattattat

SEQ ID NO: 501512 - DNA, 20 bp, Artificial Sequence
  chemically synthesized
aatgcataaaacaaaataca

SEQ ID NO: 501513 - DNA, 20 bp, Artificial Sequence
  chemically synthesized
aagatctagcatcaggtctt

SEQ ID NO: 501514 - DNA, 20 bp, Artificial Sequence
  chemically synthesized
tttctattagtgacaaagtc

SEQ ID NO: 501515 - DNA, 20 bp, Artificial Sequence
  chemically synthesized
gtcatgggtatctctattgc

SEQ ID NO: 501516 - DNA, 20 bp, Artificial Sequence
  chemically synthesized
ctgcttacttttggttttaa

SEQ ID NO: 501517 - DNA, 20 bp, Artificial Sequence
  chemically synthesized
tagaaataaggtctgtgaac

SEQ ID NO: 501518 - DNA, 20 bp, Artificial Sequence
  chemically synthesized
gagattttagtctagggtat

SEQ ID NO: 501519 - DNA, 20 bp, Artificial Sequence
  chemically synthesized
tctcttaggagattttagtc

SEQ ID NO: 501520 - DNA, 20 bp, Artificial Sequence
  chemically synthesized
cctagactaaaatctcctaa

SEQ ID NO: 501521 - DNA, 20 bp, Artificial Sequence
  chemically synthesized
atttaacatgaaaaaagata

SEQ ID NO: 501522 - DNA, 20 bp, Artificial Sequence
  chemically synthesized
tgtggccactcggcattcca

SEQ ID NO: 501523 - DNA, 20 bp, Artificial Sequence
  chemically synthesized
ggcacagactcagtggaatg

SEQ ID NO: 501524 - DNA, 20 bp, Artificial Sequence
  chemically synthesized
agaaccaggcacagactcag

SEQ ID NO: 501525 - DNA, 20 bp, Artificial Sequence
  chemically synthesized
gggctctggctcagctctct

SEQ ID NO: 501526 - DNA, 20 bp, Artificial Sequence
  chemically synthesized
ccttattgagaaaggagaaa

SEQ ID NO: 501527 - DNA, 20 bp, Artificial Sequence
  chemically synthesized
acagagactgtgattggcac

SEQ ID NO: 501528 - DNA, 20 bp, Artificial Sequence
  chemically synthesized
ctcgcaaatagcttttcaac

SEQ ID NO: 501529 - DNA, 20 bp, Artificial Sequence
  chemically synthesized
ctcgagttgaaaagctattt

SEQ ID NO: 501530 - DNA, 20 bp, Artificial Sequence
  chemically synthesized
taagaaaaaaattacagtac

SEQ ID NO: 501531 - DNA, 20 bp, Artificial Sequence
  chemically synthesized
ttaggtataggctggcctca

SEQ ID NO: 501532 - DNA, 20 bp, Artificial Sequence
  chemically synthesized
aaagatagaaaagacatgtt

SEQ ID NO: 501533 - DNA, 20 bp, Artificial Sequence
  chemically synthesized
agaaagtatgagaagtgatt

SEQ ID NO: 501534 - DNA, 20 bp, Artificial Sequence
  chemically synthesized
ttttggttttgcctttggca

SEQ ID NO: 501535 - DNA, 20 bp, Artificial Sequence
  chemically synthesized
tgtgacataaaaccatatct

SEQ ID NO: 501536 - DNA, 20 bp, Artificial Sequence
  chemically synthesized
aaccccatgcatgatagctg

SEQ ID NO: 501537 - DNA, 20 bp, Artificial Sequence
  chemically synthesized
aactcgacagctatcatgca

SEQ ID NO: 501538 - DNA, 20 bp, Artificial Sequence
  chemically synthesized
taaatgaagaaattgctttt

SEQ ID NO: 501539 - DNA, 20 bp, Artificial Sequence
  chemically synthesized
tatgccagttactactgtag

SEQ ID NO: 501540 - DNA, 20 bp, Artificial Sequence
  chemically synthesized
atctcccagaatatattgag

SEQ ID NO: 501541 - DNA, 20 bp, Artificial Sequence
  chemically synthesized
agagacttctaataatctcc

SEQ ID NO: 501542 - DNA, 20 bp, Artificial Sequence
  chemically synthesized
gattattagaagtctctcat

SEQ ID NO: 501543 - DNA, 20 bp, Artificial Sequence
  chemically synthesized
tactctgaagttaagctcta

SEQ ID NO: 501544 - DNA, 20 bp, Artificial Sequence
  chemically synthesized
gaccctttagagcttaactt

SEQ ID NO: 501545 - DNA, 20 bp, Artificial Sequence
  chemically synthesized
gttgaagtcaaagtattaaa

SEQ ID NO: 501546 - DNA, 20 bp, Artificial Sequence
  chemically synthesized
gccattgttactaggctctg

SEQ ID NO: 501547 - DNA, 20 bp, Artificial Sequence
  chemically synthesized
tacttggatataagtttttg

SEQ ID NO: 501548 - DNA, 20 bp, Artificial Sequence
  chemically synthesized
tcaaaaacttatatccaagt

SEQ ID NO: 501549 - DNA, 20 bp, Artificial Sequence
  chemically synthesized
tctctttgacaaactcatac

SEQ ID NO: 501550 - DNA, 20 bp, Artificial Sequence
  chemically synthesized
agatggacatatacgcaaat

SEQ ID NO: 501551 - DNA, 20 bp, Artificial Sequence
  chemically synthesized
acagcgagatgccagtagac

SEQ ID NO: 501552 - DNA, 20 bp, Artificial Sequence
  chemically synthesized
ctttgtgaagggttaccttt

SEQ ID NO: 501553 - DNA, 20 bp, Artificial Sequence
  chemically synthesized
aattaagcttcaactttgtg

SEQ ID NO: 501554 - DNA, 20 bp, Artificial Sequence
  chemically synthesized
agttgaagcttaatttatat

SEQ ID NO: 501555 - DNA, 20 bp, Artificial Sequence
  chemically synthesized
agcaatgcaattaaaggcaa

SEQ ID NO: 501556 - DNA, 20 bp, Artificial Sequence
  chemically synthesized
caaaacttttgtgatctctt

SEQ ID NO: 501557 - DNA, 20 bp, Artificial Sequence
  chemically synthesized
tcacaaaagttttgaactta

SEQ ID NO: 501558 - DNA, 20 bp, Artificial Sequence
  chemically synthesized
gataatgttgcaggtagttc

SEQ ID NO: 501559 - DNA, 20 bp, Artificial Sequence
  chemically synthesized
acattgtttaaattagctgg

SEQ ID NO: 501560 - DNA, 20 bp, Artificial Sequence
  chemically synthesized
tacagagtgtaaattgtcct

SEQ ID NO: 501561 - DNA, 20 bp, Artificial Sequence
  chemically synthesized
actctaggtctcttttttta

SEQ ID NO: 501562 - DNA, 20 bp, Artificial Sequence
  chemically synthesized
actctgtaaaaaaagagacc

SEQ ID NO: 501563 - DNA, 20 bp, Artificial Sequence
  chemically synthesized
tgaatactggttccttattg

SEQ ID NO: 501564 - DNA, 20 bp, Artificial Sequence
  chemically synthesized
aacagcatgtatacaaatga

SEQ ID NO: 501565 - DNA, 20 bp, Artificial Sequence
  chemically synthesized
tcatttgtatacatgctgtt

SEQ ID NO: 501566 - DNA, 20 bp, Artificial Sequence
  chemically synthesized
agtgaatagcacagtacaga

SEQ ID NO: 501567 - DNA, 20 bp, Artificial Sequence
  chemically synthesized
ctcattcctcatctctggca

SEQ ID NO: 501568 - DNA, 20 bp, Artificial Sequence
  chemically synthesized
gctattcactgccagagatg

SEQ ID NO: 501569 - DNA, 20 bp, Artificial Sequence
  chemically synthesized
agctacactgtaggcatgat

SEQ ID NO: 501570 - DNA, 20 bp, Artificial Sequence
  chemically synthesized
ggaaacagatgagccatggc

SEQ ID NO: 501571 - DNA, 20 bp, Artificial Sequence
  chemically synthesized
gagccatggctggaataagc

SEQ ID NO: 501572 - DNA, 20 bp, Artificial Sequence
  chemically synthesized
ggaaaggtgacacttgaagg

SEQ ID NO: 501573 - DNA, 20 bp, Artificial Sequence
  chemically synthesized
acttgaaggcggagtgtgca

SEQ ID NO: 501574 - DNA, 20 bp, Artificial Sequence
  chemically synthesized
cggagtgtgcatgggatggt

SEQ ID NO: 501575 - DNA, 20 bp, Artificial Sequence
  chemically synthesized
caacgagaaggtatgaaagt

SEQ ID NO: 501576 - DNA, 20 bp, Artificial Sequence
  chemically synthesized
aaggctgccatagaggaaca

SEQ ID NO: 501577 - DNA, 20 bp, Artificial Sequence
  chemically synthesized
gtattcttttagtttacagt

SEQ ID NO: 501578 - DNA, 20 bp, Artificial Sequence
  chemically synthesized
gaattcttactgtaaactaa

SEQ ID NO: 501579 - DNA, 20 bp, Artificial Sequence
  chemically synthesized
ctaatagtttcccacaacac

SEQ ID NO: 501580 - DNA, 20 bp, Artificial Sequence
  chemically synthesized
aggagctccctttgagagga

SEQ ID NO: 501581 - DNA, 20 bp, Artificial Sequence
  chemically synthesized
aataaggagctccctttgag

SEQ ID NO: 501582 - DNA, 20 bp, Artificial Sequence
  chemically synthesized
caaagggagctccttattta

SEQ ID NO: 501583 - DNA, 20 bp, Artificial Sequence
  chemically synthesized
gaaggcatgtatgctgagaa

SEQ ID NO: 501584 - DNA, 20 bp, Artificial Sequence
  chemically synthesized
cagaagaaggcatgtatgct

SEQ ID NO: 501585 - DNA, 20 bp, Artificial Sequence
  chemically synthesized
cttgtgaggtgagaagtgga

SEQ ID NO: 501586 - DNA, 20 bp, Artificial Sequence
  chemically synthesized
atttgaacttgctccttcag

SEQ ID NO: 501587 - DNA, 20 bp, Artificial Sequence
  chemically synthesized
taatttagtgaatttagtca

SEQ ID NO: 501588 - DNA, 20 bp, Artificial Sequence
  chemically synthesized
agtgtctgagttataattta

SEQ ID NO: 501589 - DNA, 20 bp, Artificial Sequence
  chemically synthesized
gactgaaaaacctaaagtgt

SEQ ID NO: 501590 - DNA, 20 bp, Artificial Sequence
  chemically synthesized
tgtagtaatgtgattgctgc

SEQ ID NO: 501591 - DNA, 20 bp, Artificial Sequence
  chemically synthesized
tgtcataggtcaagttaaaa

SEQ ID NO: 501592 - DNA, 20 bp, Artificial Sequence
  chemically synthesized
tagtttgcgttcaccttctc

SEQ ID NO: 501593 - DNA, 20 bp, Artificial Sequence
  chemically synthesized
caaactatatacttggcact

SEQ ID NO: 501594 - DNA, 20 bp, Artificial Sequence
  chemically synthesized
tgtgagaatttatagtttaa

SEQ ID NO: 501595 - DNA, 20 bp, Artificial Sequence
  chemically synthesized
aataatatgttagacattgt

SEQ ID NO: 501596 - DNA, 20 bp, Artificial Sequence
  chemically synthesized
ttcttttataataaggaaat

SEQ ID NO: 501597 - DNA, 20 bp, Artificial Sequence
  chemically synthesized
ctctaatttccttattataa

SEQ ID NO: 501598 - DNA, 20 bp, Artificial Sequence
  chemically synthesized
aatttccttattataaaaga

SEQ ID NO: 501599 - DNA, 20 bp, Artificial Sequence
  chemically synthesized
attataaaagaatgagtata

SEQ ID NO: 501600 - DNA, 20 bp, Artificial Sequence
  chemically synthesized
tcatgccccatgttgatggg

SEQ ID NO: 501601 - DNA, 20 bp, Artificial Sequence
  chemically synthesized
ccatgttgatgggaaggatg

SEQ ID NO: 501602 - DNA, 20 bp, Artificial Sequence
  chemically synthesized
tgtagatatggggaatgaat

SEQ ID NO: 501603 - DNA, 20 bp, Artificial Sequence
  chemically synthesized
tatacttgtagatatgggga

SEQ ID NO: 501604 - DNA, 20 bp, Artificial Sequence
  chemically synthesized
caattatacttgtagatatg

SEQ ID NO: 501605 - DNA, 20 bp, Artificial Sequence
  chemically synthesized
ttaaaaaggcatgttcggtt

SEQ ID NO: 501606 - DNA, 20 bp, Artificial Sequence
  chemically synthesized
ctttacaaacatttcccttc

SEQ ID NO: 501607 - DNA, 20 bp, Artificial Sequence
  chemically synthesized
aatacgaaatgggtggagga

SEQ ID NO: 501608 - DNA, 20 bp, Artificial Sequence
  chemically synthesized
aaaacttgtgaaaatacgaa

SEQ ID NO: 501609 - DNA, 20 bp, Artificial Sequence
  chemically synthesized
gtaccttccacagattttct

SEQ ID NO: 501610 - DNA, 20 bp, Artificial Sequence
  chemically synthesized
tcagacagagaagttatctt

SEQ ID NO: 501611 - DNA, 20 bp, Artificial Sequence
  chemically synthesized
ataaaatttgtttaaaaaga

SEQ ID NO: 501612 - DNA, 20 bp, Artificial Sequence
  chemically synthesized
taaacaaattttattatctt

SEQ ID NO: 501613 - DNA, 20 bp, Artificial Sequence
  chemically synthesized
aattgagtcctagtaaaggg

SEQ ID NO: 501614 - DNA, 20 bp, Artificial Sequence
  chemically synthesized
taaaataagtctgaatttaa

SEQ ID NO: 501615 - DNA, 20 bp, Artificial Sequence
  chemically synthesized
aaggaatagctaaaataagt

SEQ ID NO: 501616 - DNA, 20 bp, Artificial Sequence
  chemically synthesized
agggaacatgagtaagagaa

SEQ ID NO: 501617 - DNA, 20 bp, Artificial Sequence
  chemically synthesized
ttattcatattacagggaac

SEQ ID NO: 501618 - DNA, 20 bp, Artificial Sequence
  chemically synthesized
ttactcatgttccctgtaat

SEQ ID NO: 501619 - DNA, 20 bp, Artificial Sequence
  chemically synthesized
gacttctcaagatgcctttt

SEQ ID NO: 501620 - DNA, 20 bp, Artificial Sequence
  chemically synthesized
tgagaagtccccctacccag

SEQ ID NO: 501621 - DNA, 20 bp, Artificial Sequence
  chemically synthesized
atactaagtgcagaattcac

SEQ ID NO: 501622 - DNA, 20 bp, Artificial Sequence
  chemically synthesized
atatttgcaaatactaagtg

SEQ ID NO: 501623 - DNA, 20 bp, Artificial Sequence
  chemically synthesized
tctgatcacagagaacagga

SEQ ID NO: 501624 - DNA, 20 bp, Artificial Sequence
  chemically synthesized
aatgtattccttttctttcc

SEQ ID NO: 501625 - DNA, 20 bp, Artificial Sequence
  chemically synthesized
aacatattcgtggaaagaaa

SEQ ID NO: 501626 - DNA, 20 bp, Artificial Sequence
  chemically synthesized
aatgtgacaaatgcacatct

SEQ ID NO: 501627 - DNA, 20 bp, Artificial Sequence
  chemically synthesized
atgtgcatttgtcacatttt

SEQ ID NO: 501628 - DNA, 20 bp, Artificial Sequence
  chemically synthesized
tgtatgttacatctcaattt

SEQ ID NO: 501629 - DNA, 20 bp, Artificial Sequence
  chemically synthesized
ttgatatgattacagctgct

SEQ ID NO: 501630 - DNA, 20 bp, Artificial Sequence
  chemically synthesized
tcctaaacctctagccatga

SEQ ID NO: 501631 - DNA, 20 bp, Artificial Sequence
  chemically synthesized
ttactattaggctaatgtga

SEQ ID NO: 501632 - DNA, 20 bp, Artificial Sequence
  chemically synthesized
tttaatgctttatgttcttt

SEQ ID NO: 501633 - DNA, 20 bp, Artificial Sequence
  chemically synthesized
agaacataaagcattaaata

SEQ ID NO: 501634 - DNA, 20 bp, Artificial Sequence
  chemically synthesized
aaagtcaatacacattgcta

SEQ ID NO: 501635 - DNA, 20 bp, Artificial Sequence
  chemically synthesized
cactgtattgtttattaaag

SEQ ID NO: 501636 - DNA, 20 bp, Artificial Sequence
  chemically synthesized
aaagaagaatttcatgaaag

SEQ ID NO: 501637 - DNA, 20 bp, Artificial Sequence
  chemically synthesized
cagctctaactataatgaca

SEQ ID NO: 501638 - DNA, 20 bp, Artificial Sequence
  chemically synthesized
gaacatctgttacatgccat

SEQ ID NO: 501639 - DNA, 20 bp, Artificial Sequence
  chemically synthesized
cagatcattaacttggtgca

SEQ ID NO: 501640 - DNA, 20 bp, Artificial Sequence
  chemically synthesized
tcttttttttttaaagtgag

SEQ ID NO: 501641 - DNA, 20 bp, Artificial Sequence
  chemically synthesized
aaagatacgtaatttttcag

SEQ ID NO: 501642 - DNA, 20 bp, Artificial Sequence
  chemically synthesized
acgtaatttttcaggggaat

SEQ ID NO: 501643 - DNA, 20 bp, Artificial Sequence
  chemically synthesized
aatgagagtataacagactt

SEQ ID NO: 501644 - DNA, 20 bp, Artificial Sequence
  chemically synthesized
cttatatttttatagctaag

SEQ ID NO: 501645 - DNA, 20 bp, Artificial Sequence
  chemically synthesized
ttttatagctaagaggaatg

SEQ ID NO: 501646 - DNA, 20 bp, Artificial Sequence
  chemically synthesized
ggtttctggtcctagattat

SEQ ID NO: 501647 - DNA, 20 bp, Artificial Sequence
  chemically synthesized
acaagacatggttgactgag

SEQ ID NO: 501648 - DNA, 20 bp, Artificial Sequence
  chemically synthesized
cgtcagacagcttgaaattc

SEQ ID NO: 501649 - DNA, 20 bp, Artificial Sequence
  chemically synthesized
gataatgtgatacaagatcc

SEQ ID NO: 501650 - DNA, 20 bp, Artificial Sequence
  chemically synthesized
tctagtgattctcaactttg

SEQ ID NO: 501651 - DNA, 20 bp, Artificial Sequence
  chemically synthesized
ctctcttattcagcaaagtt

SEQ ID NO: 501652 - DNA, 20 bp, Artificial Sequence
  chemically synthesized
tgctgaataagagagctagt

SEQ ID NO: 501653 - DNA, 20 bp, Artificial Sequence
  chemically synthesized
tagagttagaccaattaaat

SEQ ID NO: 501654 - DNA, 20 bp, Artificial Sequence
  chemically synthesized
tggaagtgggccccaaacat

SEQ ID NO: 501655 - DNA, 20 bp, Artificial Sequence
  chemically synthesized
tgggatacttttcaagtttc

SEQ ID NO: 501656 - DNA, 20 bp, Artificial Sequence
  chemically synthesized
ggcaaacagaaagatgcatt

SEQ ID NO: 501657 - DNA, 20 bp, Artificial Sequence
  chemically synthesized
actatcactcaataaaaact

SEQ ID NO: 501658 - DNA, 20 bp, Artificial Sequence
  chemically synthesized
agatgcattctgagttttta

SEQ ID NO: 501659 - DNA, 20 bp, Artificial Sequence
  chemically synthesized
agtgatagtcattaaattct

SEQ ID NO: 501660 - DNA, 20 bp, Artificial Sequence
  chemically synthesized
tttggctttcagttcactct

SEQ ID NO: 501661 - DNA, 20 bp, Artificial Sequence
  chemically synthesized
taagagtgaactgaaagcca

SEQ ID NO: 501662 - DNA, 20 bp, Artificial Sequence
  chemically synthesized
ttaactgaaggtgttaaatg

SEQ ID NO: 501663 - DNA, 20 bp, Artificial Sequence
  chemically synthesized
aacagtagtcttagtatgcc

SEQ ID NO: 501664 - DNA, 20 bp, Artificial Sequence
  chemically synthesized
actgttaataaaacaggcgg

SEQ ID NO: 501665 - DNA, 20 bp, Artificial Sequence
  chemically synthesized
tcatctgaaagttcaaatgg

SEQ ID NO: 501666 - DNA, 20 bp, Artificial Sequence
  chemically synthesized
ttgaactttcagatgacacc

SEQ ID NO: 501667 - DNA, 20 bp, Artificial Sequence
  chemically synthesized
agatgacaccatggatattt

SEQ ID NO: 501668 - DNA, 20 bp, Artificial Sequence
  chemically synthesized
aatggaactaaattatttaa

SEQ ID NO: 501669 - DNA, 20 bp, Artificial Sequence
  chemically synthesized
actaaattatttaactgagt

SEQ ID NO: 501670 - DNA, 20 bp, Artificial Sequence
  chemically synthesized
tggccaatattgtttagcat

SEQ ID NO: 501671 - DNA, 20 bp, Artificial Sequence
  chemically synthesized
taaacaatattggccagtaa

SEQ ID NO: 501672 - DNA, 20 bp, Artificial Sequence
  chemically synthesized
tttacttacactcaactaat

SEQ ID NO: 501673 - DNA, 20 bp, Artificial Sequence
  chemically synthesized
cttaatatcactctgattag

SEQ ID NO: 501674 - DNA, 20 bp, Artificial Sequence
  chemically synthesized
gtagtaggtgatagatacac

SEQ ID NO: 501675 - DNA, 20 bp, Artificial Sequence
  chemically synthesized
tggtttgtttcatgcttatt

SEQ ID NO: 501676 - DNA, 20 bp, Artificial Sequence
  chemically synthesized
ttaaacgtaacttgcaaatt

SEQ ID NO: 501677 - DNA, 20 bp, Artificial Sequence
  chemically synthesized
tacgtttaaacagatatttc

SEQ ID NO: 501678 - DNA, 20 bp, Artificial Sequence
  chemically synthesized
acattttccctgtccttttg

SEQ ID NO: 501679 - DNA, 20 bp, Artificial Sequence
  chemically synthesized
tttccctgtccttttgctga

SEQ ID NO: 501680 - DNA, 20 bp, Artificial Sequence
  chemically synthesized
ttgcctacataacagtccaa

SEQ ID NO: 501681 - DNA, 20 bp, Artificial Sequence
  chemically synthesized
acataacagtccaagagagt

SEQ ID NO: 501682 - DNA, 20 bp, Artificial Sequence
  chemically synthesized
attactagcacctgaagagt

SEQ ID NO: 501683 - DNA, 20 bp, Artificial Sequence
  chemically synthesized
caggagattactagcacctg

SEQ ID NO: 501684 - DNA, 20 bp, Artificial Sequence
  chemically synthesized
gtgacaaacactgatagctg

SEQ ID NO: 501685 - DNA, 20 bp, Artificial Sequence
  chemically synthesized
tacttttccttttctgttaa

SEQ ID NO: 501686 - DNA, 20 bp, Artificial Sequence
  chemically synthesized
gaaaagtatctgaacattta

SEQ ID NO: 501687 - DNA, 20 bp, Artificial Sequence
  chemically synthesized
gtctggaccatgcagctagc

SEQ ID NO: 501688 - DNA, 20 bp, Artificial Sequence
  chemically synthesized
aatgttaagtttttaaaaat

SEQ ID NO: 501689 - DNA, 20 bp, Artificial Sequence
  chemically synthesized
tcaatcagagtagtattaaa

SEQ ID NO: 501690 - DNA, 20 bp, Artificial Sequence
  chemically synthesized
ctttaatactactctgattg

SEQ ID NO: 501691 - DNA, 20 bp, Artificial Sequence
  chemically synthesized
ttttaaattcacccttcaat

SEQ ID NO: 501692 - DNA, 20 bp, Artificial Sequence
  chemically synthesized
aatactactctgattgaagg

SEQ ID NO: 501693 - DNA, 20 bp, Artificial Sequence
  chemically synthesized
tgacaggaggaaagccattt

SEQ ID NO: 501694 - DNA, 20 bp, Artificial Sequence
  chemically synthesized
tctttaccttttaaacaatt

SEQ ID NO: 501695 - DNA, 20 bp, Artificial Sequence
  chemically synthesized
aaattatagttacagaaaaa

SEQ ID NO: 501696 - DNA, 20 bp, Artificial Sequence
  chemically synthesized
ataatttggaaacatggtca

SEQ ID NO: 501697 - DNA, 20 bp, Artificial Sequence
  chemically synthesized
gaagtagtgaggatgtggtc

SEQ ID NO: 501698 - DNA, 20 bp, Artificial Sequence
  chemically synthesized
ggagaacttccagaagtagt

SEQ ID NO: 501699 - DNA, 20 bp, Artificial Sequence
  chemically synthesized
gttctcccattctttctctg

SEQ ID NO: 501700 - DNA, 20 bp, Artificial Sequence
  chemically synthesized
tcttaatgatcccacagaga

SEQ ID NO: 501701 - DNA, 20 bp, Artificial Sequence
  chemically synthesized
tctttctctgtgggatcatt

SEQ ID NO: 501702 - DNA, 20 bp, Artificial Sequence
  chemically synthesized
tctgtgggatcattaagaat

SEQ ID NO: 501703 - DNA, 20 bp, Artificial Sequence
  chemically synthesized
ttagaatacctaagacattc

SEQ ID NO: 501704 - DNA, 20 bp, Artificial Sequence
  chemically synthesized
ttgaagagaattacgaactc

SEQ ID NO: 501705 - DNA, 20 bp, Artificial Sequence
  chemically synthesized
aaagataccatctacttgaa

SEQ ID NO: 501706 - DNA, 20 bp, Artificial Sequence
  chemically synthesized
catagcccttccaaaagata

SEQ ID NO: 501707 - DNA, 20 bp, Artificial Sequence
  chemically synthesized
atattccaaaccatagatac

SEQ ID NO: 501708 - DNA, 20 bp, Artificial Sequence
  chemically synthesized
gcattctagtatctatggtt

SEQ ID NO: 501709 - DNA, 20 bp, Artificial Sequence
  chemically synthesized
atctaagttttcttcctgct

SEQ ID NO: 501710 - DNA, 20 bp, Artificial Sequence
  chemically synthesized
tgagcaggaagaaaacttag

SEQ ID NO: 501711 - DNA, 20 bp, Artificial Sequence
  chemically synthesized
tagaattggtctttcctaaa

SEQ ID NO: 501712 - DNA, 20 bp, Artificial Sequence
  chemically synthesized
ttgataggccagtggcgttg

SEQ ID NO: 501713 - DNA, 20 bp, Artificial Sequence
  chemically synthesized
caacgccactggcctatcaa

SEQ ID NO: 501714 - DNA, 20 bp, Artificial Sequence
  chemically synthesized
tatcagaggtttgacatttc

SEQ ID NO: 501715 - DNA, 20 bp, Artificial Sequence
  chemically synthesized
ttgccatgtcttcttcttga

SEQ ID NO: 501716 - DNA, 20 bp, Artificial Sequence
  chemically synthesized
aattttgccatgtcttcttc

SEQ ID NO: 501717 - DNA, 20 bp, Artificial Sequence
  chemically synthesized
agcagcaccctgtttgacca

SEQ ID NO: 501718 - DNA, 20 bp, Artificial Sequence
  chemically synthesized
ggcaaaattctatggtcaaa

SEQ ID NO: 501719 - DNA, 20 bp, Artificial Sequence
  chemically synthesized
tattagctttcctctagttc

SEQ ID NO: 501720 - DNA, 20 bp, Artificial Sequence
  chemically synthesized
ctttcctctagttcaggagt

SEQ ID NO: 501721 - DNA, 20 bp, Artificial Sequence
  chemically synthesized
caggagtttgaatatgttct

SEQ ID NO: 501722 - DNA, 20 bp, Artificial Sequence
  chemically synthesized
tttgtgctaaaacagcagag

SEQ ID NO: 501723 - DNA, 20 bp, Artificial Sequence
  chemically synthesized
ctgcttttgtgctaaaacag

SEQ ID NO: 501724 - DNA, 20 bp, Artificial Sequence
  chemically synthesized
ggctgtacaaaagaaggtgg

SEQ ID NO: 501725 - DNA, 20 bp, Artificial Sequence
  chemically synthesized
gtacaaaagaaggtggctga

SEQ ID NO: 501726 - DNA, 20 bp, Artificial Sequence
  chemically synthesized
atttgccttcctcttggtga

SEQ ID NO: 501727 - DNA, 20 bp, Artificial Sequence
  chemically synthesized
tcttgagcttcctaatagag

SEQ ID NO: 501728 - DNA, 20 bp, Artificial Sequence
  chemically synthesized
aggaagctcaagaagttggc

SEQ ID NO: 501729 - DNA, 20 bp, Artificial Sequence
  chemically synthesized
gtaacattaatcctcatatt

SEQ ID NO: 501730 - DNA, 20 bp, Artificial Sequence
  chemically synthesized
gggtccaggatcctcaatat

SEQ ID NO: 501731 - DNA, 20 bp, Artificial Sequence
  chemically synthesized
atttcaaagtcatgtgggtc

SEQ ID NO: 501732 - DNA, 20 bp, Artificial Sequence
  chemically synthesized
cctaaggatttcaaagtcat

SEQ ID NO: 501733 - DNA, 20 bp, Artificial Sequence
  chemically synthesized
cacatgactttgaaatcctt

SEQ ID NO: 501734 - DNA, 20 bp, Artificial Sequence
  chemically synthesized
tgactttgaaatccttagga

SEQ ID NO: 501735 - DNA, 20 bp, Artificial Sequence
  chemically synthesized
tgtaatagtcattcactcct

SEQ ID NO: 501736 - DNA, 20 bp, Artificial Sequence
  chemically synthesized
acggatgttgattgctttca

SEQ ID NO: 501737 - DNA, 20 bp, Artificial Sequence
  chemically synthesized
tgttaaaaagtcagaaaata

SEQ ID NO: 501738 - DNA, 20 bp, Artificial Sequence
  chemically synthesized
agataccatctcacaccagt

SEQ ID NO: 501739 - DNA, 20 bp, Artificial Sequence
  chemically synthesized
gtgtgagatggtatcttatt

SEQ ID NO: 501740 - DNA, 20 bp, Artificial Sequence
  chemically synthesized
cgcttgtatgtcttctttcg

SEQ ID NO: 501741 - DNA, 20 bp, Artificial Sequence
  chemically synthesized
ttaaaaacaggacaaagaac

SEQ ID NO: 501742 - DNA, 20 bp, Artificial Sequence
  chemically synthesized
gtttaagttccttatagatt

SEQ ID NO: 501743 - DNA, 20 bp, Artificial Sequence
  chemically synthesized
tctgacaaaagaataatatc

SEQ ID NO: 501744 - DNA, 20 bp, Artificial Sequence
  chemically synthesized
gcaaactttgcatctgacaa

SEQ ID NO: 501745 - DNA, 20 bp, Artificial Sequence
  chemically synthesized
cacagtaaacagataacctc

SEQ ID NO: 501746 - DNA, 20 bp, Artificial Sequence
  chemically synthesized
aaaaacaaaaattgacaaat

SEQ ID NO: 501747 - DNA, 20 bp, Artificial Sequence
  chemically synthesized
tctggacactggcttaggca

SEQ ID NO: 501748 - DNA, 20 bp, Artificial Sequence
  chemically synthesized
acttttcctaggttttattc

SEQ ID NO: 501749 - DNA, 20 bp, Artificial Sequence
  chemically synthesized
cctgaaactactaaaaatcc

SEQ ID NO: 501750 - DNA, 20 bp, Artificial Sequence
  chemically synthesized
atttaagactttaatccatc

SEQ ID NO: 501751 - DNA, 20 bp, Artificial Sequence
  chemically synthesized
tatacaaaaattaactcaag

SEQ ID NO: 501752 - DNA, 20 bp, Artificial Sequence
  chemically synthesized
ttttgtatatggtgaaaggt

SEQ ID NO: 501753 - DNA, 20 bp, Artificial Sequence
  chemically synthesized
agctggctagccatatatag

SEQ ID NO: 501754 - DNA, 20 bp, Artificial Sequence
  chemically synthesized
ccttattcattaaatattgc

SEQ ID NO: 501755 - DNA, 20 bp, Artificial Sequence
  chemically synthesized
agctatcctagcaatattta

SEQ ID NO: 501756 - DNA, 20 bp, Artificial Sequence
  chemically synthesized
gtaggtgtgcagctttattt

SEQ ID NO: 501757 - DNA, 20 bp, Artificial Sequence
  chemically synthesized
agacacctagatcaatggaa

SEQ ID NO: 501758 - DNA, 20 bp, Artificial Sequence
  chemically synthesized
tcaactttgttcttttggct

SEQ ID NO: 501759 - DNA, 20 bp, Artificial Sequence
  chemically synthesized
aggccctttcttggttccat

SEQ ID NO: 501760 - DNA, 20 bp, Artificial Sequence
  chemically synthesized
tcttggttccatatgaattt

SEQ ID NO: 501761 - DNA, 20 bp, Artificial Sequence
  chemically synthesized
tacatgtgcaagtttgttac

SEQ ID NO: 501762 - DNA, 20 bp, Artificial Sequence
  chemically synthesized
caaacttgcacatgtaaccc

SEQ ID NO: 501763 - DNA, 20 bp, Artificial Sequence
  chemically synthesized
tttaaaattactttagattc

SEQ ID NO: 501764 - DNA, 20 bp, Artificial Sequence
  chemically synthesized
agtaatcgagaaacagagaa

SEQ ID NO: 501765 - DNA, 20 bp, Artificial Sequence
  chemically synthesized
gaggacagatctgtaagtca

SEQ ID NO: 501766 - DNA, 20 bp, Artificial Sequence
  chemically synthesized
ctctctaataacgattctct

SEQ ID NO: 501767 - DNA, 20 bp, Artificial Sequence
  chemically synthesized
taagaacacttctattcaga

SEQ ID NO: 501768 - DNA, 20 bp, Artificial Sequence
  chemically synthesized
ctctgaatagaagtgttctt

SEQ ID NO: 501769 - DNA, 20 bp, Artificial Sequence
  chemically synthesized
aatagcgcaaaccgagaact

SEQ ID NO: 501770 - DNA, 20 bp, Artificial Sequence
  chemically synthesized
gtgaaagcagagtcaaggga

SEQ ID NO: 501771 - DNA, 20 bp, Artificial Sequence
  chemically synthesized
ccttgtgaaagcagagtcaa

SEQ ID NO: 501772 - DNA, 20 bp, Artificial Sequence
  chemically synthesized
caatgatttccttgtgaaag

SEQ ID NO: 501773 - DNA, 20 bp, Artificial Sequence
  chemically synthesized
ttcacaaggaaatcattgat

SEQ ID NO: 501774 - DNA, 20 bp, Artificial Sequence
  chemically synthesized
ttgtctttccagtttttaaa

SEQ ID NO: 501775 - DNA, 20 bp, Artificial Sequence
  chemically synthesized
atgttccttattcatctcgc

SEQ ID NO: 501776 - DNA, 20 bp, Artificial Sequence
  chemically synthesized
agcagattaattccagcgag

SEQ ID NO: 501777 - DNA, 20 bp, Artificial Sequence
  chemically synthesized
tcctgttgctcaatcagcag

SEQ ID NO: 501778 - DNA, 20 bp, Artificial Sequence
  chemically synthesized
ttggccaatgcttaggcaaa

SEQ ID NO: 501779 - DNA, 20 bp, Artificial Sequence
  chemically synthesized
aaaccaataatactcacgaa

SEQ ID NO: 501780 - DNA, 20 bp, Artificial Sequence
  chemically synthesized
aattaaggaacacccacttc

SEQ ID NO: 501781 - DNA, 20 bp, Artificial Sequence
  chemically synthesized
atcttacagaacctggctag

SEQ ID NO: 501782 - DNA, 20 bp, Artificial Sequence
  chemically synthesized
aacatacaaaagcaaatgct

SEQ ID NO: 501783 - DNA, 20 bp, Artificial Sequence
  chemically synthesized
tgtatgcataactcatctta

SEQ ID NO: 501784 - DNA, 20 bp, Artificial Sequence
  chemically synthesized
gtaatatttcattccttaag

SEQ ID NO: 501785 - DNA, 20 bp, Artificial Sequence
  chemically synthesized
ggaaagacaaaagaattggg

SEQ ID NO: 501786 - DNA, 20 bp, Artificial Sequence
  chemically synthesized
tgtgaggaaagacaaaagaa

SEQ ID NO: 501787 - DNA, 20 bp, Artificial Sequence
  chemically synthesized
atctctgtgaggaaagacaa

SEQ ID NO: 501788 - DNA, 20 bp, Artificial Sequence
  chemically synthesized
tgtttgggaattaatataaa

SEQ ID NO: 501789 - DNA, 20 bp, Artificial Sequence
  chemically synthesized
gtaaaagcagaaagatgttt

SEQ ID NO: 501790 - DNA, 20 bp, Artificial Sequence
  chemically synthesized
agtgtgttaccatttacaca

SEQ ID NO: 501791 - DNA, 20 bp, Artificial Sequence
  chemically synthesized
acagcattagaaaacaaatg

SEQ ID NO: 501792 - DNA, 20 bp, Artificial Sequence
  chemically synthesized
agtgtaagaaactcttctgg

SEQ ID NO: 501793 - DNA, 20 bp, Artificial Sequence
  chemically synthesized
gagtcaccacacccggccag

SEQ ID NO: 501794 - DNA, 20 bp, Artificial Sequence
  chemically synthesized
aaagtgctgggattacaggt

SEQ ID NO: 501795 - DNA, 20 bp, Artificial Sequence
  chemically synthesized
gcctcggcctcccaaagtgc

SEQ ID NO: 501796 - DNA, 20 bp, Artificial Sequence
  chemically synthesized
actttgggaggccgaggcag

SEQ ID NO: 501797 - DNA, 20 bp, Artificial Sequence
  chemically synthesized
caggtggatgacctgaggtc

SEQ ID NO: 501798 - DNA, 20 bp, Artificial Sequence
  chemically synthesized
ttttgtgttttcggtagagt

SEQ ID NO: 501799 - DNA, 20 bp, Artificial Sequence
  chemically synthesized
ctaattttttgtgttttcgg

SEQ ID NO: 501800 - DNA, 20 bp, Artificial Sequence
  chemically synthesized
ccgaaaacacaaaaaattag

SEQ ID NO: 501801 - DNA, 20 bp, Artificial Sequence
  chemically synthesized
gccccagcctcccgggtagc

SEQ ID NO: 501802 - DNA, 20 bp, Artificial Sequence
  chemically synthesized
agttctcctgccccagcctc

SEQ ID NO: 501803 - DNA, 20 bp, Artificial Sequence
  chemically synthesized
tctcggctcactgcaacctc

SEQ ID NO: 501804 - DNA, 20 bp, Artificial Sequence
  chemically synthesized
gagatcgggccattgcactc

SEQ ID NO: 501805 - DNA, 20 bp, Artificial Sequence
  chemically synthesized
cttgctcttgtcaccgatcc

SEQ ID NO: 501806 - DNA, 20 bp, Artificial Sequence
  chemically synthesized
cttatttatttattttgaga

SEQ ID NO: 501807 - DNA, 20 bp, Artificial Sequence
  chemically synthesized
ccatctcaaaataaataaat

SEQ ID NO: 501808 - DNA, 20 bp, Artificial Sequence
  chemically synthesized
accaaatagataccgaaaga

SEQ ID NO: 501809 - DNA, 20 bp, Artificial Sequence
  chemically synthesized
tatttggtttccctacaagt

SEQ ID NO: 501810 - DNA, 20 bp, Artificial Sequence
  chemically synthesized
gaggtactactagcattgag

SEQ ID NO: 501811 - DNA, 20 bp, Artificial Sequence
  chemically synthesized
taggcctaccataaaataca

SEQ ID NO: 501812 - DNA, 20 bp, Artificial Sequence
  chemically synthesized
agttgtgatgggaccttatt

SEQ ID NO: 501813 - DNA, 20 bp, Artificial Sequence
  chemically synthesized
gtaagaaatgaaggaacagc

SEQ ID NO: 501814 - DNA, 20 bp, Artificial Sequence
  chemically synthesized
agccacggtaaggaggtgaa

SEQ ID NO: 501815 - DNA, 20 bp, Artificial Sequence
  chemically synthesized
aaggaggtgaaatgagtata

SEQ ID NO: 501816 - DNA, 20 bp, Artificial Sequence
  chemically synthesized
tttatgagaaaaaaaaaaaa

SEQ ID NO: 501817 - DNA, 20 bp, Artificial Sequence
  chemically synthesized
agggcttgatttgatatgac

SEQ ID NO: 501818 - DNA, 20 bp, Artificial Sequence
  chemically synthesized
tgataaaccgcattggtgac

SEQ ID NO: 501819 - DNA, 20 bp, Artificial Sequence
  chemically synthesized
acattacgaagctgagaaaa

SEQ ID NO: 501820 - DNA, 20 bp, Artificial Sequence
  chemically synthesized
gcttcgtaatgtaagaaaaa

SEQ ID NO: 501821 - DNA, 20 bp, Artificial Sequence
  chemically synthesized
atgcttatacttttctaatt

SEQ ID NO: 501822 - DNA, 20 bp, Artificial Sequence
  chemically synthesized
ttcatgtgacacaaaagttt

SEQ ID NO: 501823 - DNA, 20 bp, Artificial Sequence
  chemically synthesized
tggaagtattgctccaattg

SEQ ID NO: 501824 - DNA, 20 bp, Artificial Sequence
  chemically synthesized
tttcaagatcaaaattagca

SEQ ID NO: 501825 - DNA, 20 bp, Artificial Sequence
  chemically synthesized
gctaattttgatcttgaaaa

SEQ ID NO: 501826 - DNA, 20 bp, Artificial Sequence
  chemically synthesized
ttcctgtgatatgagaaaac

SEQ ID NO: 501827 - DNA, 20 bp, Artificial Sequence
  chemically synthesized
tatactggttaatgataata

SEQ ID NO: 501828 - DNA, 20 bp, Artificial Sequence
  chemically synthesized
ggggcatgaagtatcaagta

SEQ ID NO: 501829 - DNA, 20 bp, Artificial Sequence
  chemically synthesized
tggcatttaaaaggtgaagt

SEQ ID NO: 501830 - DNA, 20 bp, Artificial Sequence
  chemically synthesized
taaatgccatcatcaagtaa

SEQ ID NO: 501831 - DNA, 20 bp, Artificial Sequence
  chemically synthesized
gaacctgtatcaatctctca

SEQ ID NO: 501832 - DNA, 20 bp, Artificial Sequence
  chemically synthesized
cctagagaagtcaacatatt

SEQ ID NO: 501833 - DNA, 20 bp, Artificial Sequence
  chemically synthesized
catattttgagttgtcgatg

SEQ ID NO: 501834 - DNA, 20 bp, Artificial Sequence
  chemically synthesized
atttttgctaacatagagtt

SEQ ID NO: 501835 - DNA, 20 bp, Artificial Sequence
  chemically synthesized
gctaaaaatttttgctaaca

SEQ ID NO: 501836 - DNA, 20 bp, Artificial Sequence
  chemically synthesized
tctagtactatgacatacac

SEQ ID NO: 501837 - DNA, 20 bp, Artificial Sequence
  chemically synthesized
ttgaaggttatttattttct

SEQ ID NO: 501838 - DNA, 20 bp, Artificial Sequence
  chemically synthesized
cctgcaactgagcttttaag

SEQ ID NO: 501839 - DNA, 20 bp, Artificial Sequence
  chemically synthesized
gtcacatcatgtaaccttct

SEQ ID NO: 501840 - DNA, 20 bp, Artificial Sequence
  chemically synthesized
catactgggtgtatatattt

SEQ ID NO: 501841 - DNA, 20 bp, Artificial Sequence
  chemically synthesized
taattttgtatggatacata

SEQ ID NO: 501842 - DNA, 20 bp, Artificial Sequence
  chemically synthesized
ttattaatttttaattttgt

SEQ ID NO: 501843 - DNA, 20 bp, Artificial Sequence
  chemically synthesized
aattaaaaattaataaaata

SEQ ID NO: 501844 - DNA, 20 bp, Artificial Sequence
  chemically synthesized
tccaatattttttcctctca

SEQ ID NO: 501845 - DNA, 20 bp, Artificial Sequence
  chemically synthesized
ctctcatagaattgcttttc

SEQ ID NO: 501846 - DNA, 20 bp, Artificial Sequence
  chemically synthesized
atattcttataataaacaat

SEQ ID NO: 501847 - DNA, 20 bp, Artificial Sequence
  chemically synthesized
acattcttattgtttattat

SEQ ID NO: 501848 - DNA, 20 bp, Artificial Sequence
  chemically synthesized
ttattgtttattataagaat

SEQ ID NO: 501849 - DNA, 20 bp, Artificial Sequence
  chemically synthesized
tgccagaagaaaataaatgg

SEQ ID NO: 501850 - DNA, 20 bp, Artificial Sequence
  chemically synthesized
attttaataatttggaaact

SEQ ID NO: 501851 - DNA, 20 bp, Artificial Sequence
  chemically synthesized
ccacaatgtatcatgggtgg

SEQ ID NO: 501852 - DNA, 20 bp, Artificial Sequence
  chemically synthesized
aaatatatccacaatgtatc

SEQ ID NO: 501853 - DNA, 20 bp, Artificial Sequence
  chemically synthesized
tccaccacccatgatacatt

SEQ ID NO: 501854 - DNA, 20 bp, Artificial Sequence
  chemically synthesized
ttgtggatatatttctatgc

SEQ ID NO: 501855 - DNA, 20 bp, Artificial Sequence
  chemically synthesized
gccacactaaataatttttc

SEQ ID NO: 501856 - DNA, 20 bp, Artificial Sequence
  chemically synthesized
tacttgaaattatgctttgt

SEQ ID NO: 501857 - DNA, 20 bp, Artificial Sequence
  chemically synthesized
aaaggtcaaaaaatcacttc

SEQ ID NO: 501858 - DNA, 20 bp, Artificial Sequence
  chemically synthesized
taattgacatttttatgtat

SEQ ID NO: 501859 - DNA, 20 bp, Artificial Sequence
  chemically synthesized
cgaaaataaatataatgttc

SEQ ID NO: 501860 - DNA, 20 bp, Artificial Sequence
  chemically synthesized
gacaatttaatttatatctg

SEQ ID NO: 501861 - DNA, 20 bp, Artificial Sequence
  chemically synthesized
ctgcagcaaatttgaatatc

SEQ ID NO: 501862 - DNA, 20 bp, Artificial Sequence
  chemically synthesized
ggaatgtgactgcagcaaat

SEQ ID NO: 501863 - DNA, 20 bp, Artificial Sequence
  chemically synthesized
gcagtcacattccaaatact

SEQ ID NO: 501864 - DNA, 20 bp, Artificial Sequence
  chemically synthesized
tgccgatcattccaagtatt

SEQ ID NO: 501865 - DNA, 20 bp, Artificial Sequence
  chemically synthesized
atttaatgtattgcatttaa

SEQ ID NO: 501866 - DNA, 20 bp, Artificial Sequence
  chemically synthesized
cagcagatgaaacttatagc

SEQ ID NO: 501867 - DNA, 20 bp, Artificial Sequence
  chemically synthesized
accaagaaaccatgagaaat

SEQ ID NO: 501868 - DNA, 20 bp, Artificial Sequence
  chemically synthesized
gagaatgtactcaatagtca

SEQ ID NO: 501869 - DNA, 20 bp, Artificial Sequence
  chemically synthesized
tatatgaaaccccgtgacta

SEQ ID NO: 501870 - DNA, 20 bp, Artificial Sequence
  chemically synthesized
agtcacggggtttcatatat

SEQ ID NO: 501871 - DNA, 20 bp, Artificial Sequence
  chemically synthesized
ggggtttcatatatgagagt

SEQ ID NO: 501872 - DNA, 20 bp, Artificial Sequence
  chemically synthesized
tgaattttatgttaaaatat

SEQ ID NO: 501873 - DNA, 20 bp, Artificial Sequence
  chemically synthesized
tttaaaaataacaatcataa

SEQ ID NO: 501874 - DNA, 20 bp, Artificial Sequence
  chemically synthesized
gttctgtaattcagatgcaa

SEQ ID NO: 501875 - DNA, 20 bp, Artificial Sequence
  chemically synthesized
taaagtatattcatttgcat

SEQ ID NO: 501876 - DNA, 20 bp, Artificial Sequence
  chemically synthesized
atttgacaactaagagattt

SEQ ID NO: 501877 - DNA, 20 bp, Artificial Sequence
  chemically synthesized
agtgtttgaaaagatctaga

SEQ ID NO: 501878 - DNA, 20 bp, Artificial Sequence
  chemically synthesized
gcatttattttctttcttta

SEQ ID NO: 501879 - DNA, 20 bp, Artificial Sequence
  chemically synthesized
tctggagaattgtctgcttg

SEQ ID NO: 501880 - DNA, 20 bp, Artificial Sequence
  chemically synthesized
tagaaggcttgaatagtctg

SEQ ID NO: 501881 - DNA, 20 bp, Artificial Sequence
  chemically synthesized
atccttctcatatagaaggc

SEQ ID NO: 501882 - DNA, 20 bp, Artificial Sequence
  chemically synthesized
attcaagccttctatatgag

SEQ ID NO: 501883 - DNA, 20 bp, Artificial Sequence
  chemically synthesized
aggtcattaccttataacat

SEQ ID NO: 501884 - DNA, 20 bp, Artificial Sequence
  chemically synthesized
aaatacctcaagtaatatgt

SEQ ID NO: 501885 - DNA, 20 bp, Artificial Sequence
  chemically synthesized
taagaaaaaataaggctaat

SEQ ID NO: 501886 - DNA, 20 bp, Artificial Sequence
  chemically synthesized
tagtaatctcatgtatgatc

SEQ ID NO: 501887 - DNA, 20 bp, Artificial Sequence
  chemically synthesized
gatattgaattatagttatt

SEQ ID NO: 501888 - DNA, 20 bp, Artificial Sequence
  chemically synthesized
atgtaatgttagataagata

SEQ ID NO: 501889 - DNA, 20 bp, Artificial Sequence
  chemically synthesized
aaattgtttttcttctcttt

SEQ ID NO: 501890 - DNA, 20 bp, Artificial Sequence
  chemically synthesized
atatttccaaataaatagta

SEQ ID NO: 501891 - DNA, 20 bp, Artificial Sequence
  chemically synthesized
aatatattactacttgttct

SEQ ID NO: 501892 - DNA, 20 bp, Artificial Sequence
  chemically synthesized
acataaagacagttttcagt

SEQ ID NO: 501893 - DNA, 20 bp, Artificial Sequence
  chemically synthesized
gtattgaaaatttcccaact

SEQ ID NO: 501894 - DNA, 20 bp, Artificial Sequence
  chemically synthesized
atttcccaactttgaataat

SEQ ID NO: 501895 - DNA, 20 bp, Artificial Sequence
  chemically synthesized
gaataatctggatagccaca

SEQ ID NO: 501896 - DNA, 20 bp, Artificial Sequence
  chemically synthesized
tggtaactttaaaacattaa

SEQ ID NO: 501897 - DNA, 20 bp, Artificial Sequence
  chemically synthesized
cactttcaggtaatctggta

SEQ ID NO: 501898 - DNA, 20 bp, Artificial Sequence
  chemically synthesized
aaaaaaaaaaatactaagct

SEQ ID NO: 501899 - DNA, 20 bp, Artificial Sequence
  chemically synthesized
ttggccatcagagaaagggc

SEQ ID NO: 501900 - DNA, 20 bp, Artificial Sequence
  chemically synthesized
atttaacggctaatgattac

SEQ ID NO: 501901 - DNA, 20 bp, Artificial Sequence
  chemically synthesized
tgccaaagtcgcatttcaga

SEQ ID NO: 501902 - DNA, 20 bp, Artificial Sequence
  chemically synthesized
ccttgccctcttcatggctg

SEQ ID NO: 501903 - DNA, 20 bp, Artificial Sequence
  chemically synthesized
cctaagaccatactgcccag

SEQ ID NO: 501904 - DNA, 20 bp, Artificial Sequence
  chemically synthesized
ttaggcaagccagtacatta

SEQ ID NO: 501905 - DNA, 20 bp, Artificial Sequence
  chemically synthesized
tccttagagttcagtaaatt

SEQ ID NO: 501906 - DNA, 20 bp, Artificial Sequence
  chemically synthesized
agtctctccaaaagcttcct

SEQ ID NO: 501907 - DNA, 20 bp, Artificial Sequence
  chemically synthesized
aaccaatggtaagctttagc

SEQ ID NO: 501908 - DNA, 20 bp, Artificial Sequence
  chemically synthesized
acagattaatttttaagaaa

SEQ ID NO: 501909 - DNA, 20 bp, Artificial Sequence
  chemically synthesized
tacctttccccaggcaactt

SEQ ID NO: 501910 - DNA, 20 bp, Artificial Sequence
  chemically synthesized
ttgaaggaatgcctagtaat

SEQ ID NO: 501911 - DNA, 20 bp, Artificial Sequence
  chemically synthesized
acaaagagatcagcagttga

SEQ ID NO: 501912 - DNA, 20 bp, Artificial Sequence
  chemically synthesized
atggctggcagctacagata

SEQ ID NO: 501913 - DNA, 20 bp, Artificial Sequence
  chemically synthesized
aaaggaaatgaatgtcttga

SEQ ID NO: 501914 - DNA, 20 bp, Artificial Sequence
  chemically synthesized
cccgtaagatgcgaaaggaa

SEQ ID NO: 501915 - DNA, 20 bp, Artificial Sequence
  chemically synthesized
ctttctttctgttacctgaa

SEQ ID NO: 501916 - DNA, 20 bp, Artificial Sequence
  chemically synthesized
ttataacgaaatttgaatta

SEQ ID NO: 501917 - DNA, 20 bp, Artificial Sequence
  chemically synthesized
ataagtggttataacgaaat

SEQ ID NO: 501918 - DNA, 20 bp, Artificial Sequence
  chemically synthesized
ttttataaaaatcatatatt

SEQ ID NO: 501919 - DNA, 20 bp, Artificial Sequence
  chemically synthesized
aatcatatattctgaatatt

SEQ ID NO: 501920 - DNA, 20 bp, Artificial Sequence
  chemically synthesized
ttttattcactcttaatatt

SEQ ID NO: 501921 - DNA, 20 bp, Artificial Sequence
  chemically synthesized
atatattctgaatattaaga

SEQ ID NO: 501922 - DNA, 20 bp, Artificial Sequence
  chemically synthesized
gacatcgtttgtccaaaaga

SEQ ID NO: 501923 - DNA, 20 bp, Artificial Sequence
  chemically synthesized
atggtagaaaagaaacctat

SEQ ID NO: 501924 - DNA, 20 bp, Artificial Sequence
  chemically synthesized
cagtaagttttcagtgagaa

SEQ ID NO: 501925 - DNA, 20 bp, Artificial Sequence
  chemically synthesized
gctagtctcacttgtatata

SEQ ID NO: 501926 - DNA, 20 bp, Artificial Sequence
  chemically synthesized
gagactagctcatgctggta

SEQ ID NO: 501927 - DNA, 20 bp, Artificial Sequence
  chemically synthesized
caaatacttttaccttttga

SEQ ID NO: 501928 - DNA, 20 bp, Artificial Sequence
  chemically synthesized
aaaagtatttgtgtaatacc

SEQ ID NO: 501929 - DNA, 20 bp, Artificial Sequence
  chemically synthesized
gatgtaacgaggatacagtt

SEQ ID NO: 501930 - DNA, 20 bp, Artificial Sequence
  chemically synthesized
agacactttaaagatgtaac

SEQ ID NO: 501931 - DNA, 20 bp, Artificial Sequence
  chemically synthesized
atctgctcaaaaacaataca

SEQ ID NO: 501932 - DNA, 20 bp, Artificial Sequence
  chemically synthesized
cattcatctttttgtcccta

SEQ ID NO: 501933 - DNA, 20 bp, Artificial Sequence
  chemically synthesized
catccaatagggacaaaaag

SEQ ID NO: 501934 - DNA, 20 bp, Artificial Sequence
  chemically synthesized
tagtttttctattaatggga

SEQ ID NO: 501935 - DNA, 20 bp, Artificial Sequence
  chemically synthesized
taattagtttttctattaat

SEQ ID NO: 501936 - DNA, 20 bp, Artificial Sequence
  chemically synthesized
aaacactgagaacaggagca

SEQ ID NO: 501937 - DNA, 20 bp, Artificial Sequence
  chemically synthesized
aatatggataatttgctttt

SEQ ID NO: 501938 - DNA, 20 bp, Artificial Sequence
  chemically synthesized
ttcatttcttatgtgagaat

SEQ ID NO: 501939 - DNA, 20 bp, Artificial Sequence
  chemically synthesized
gatttgttcatttcttatgt

SEQ ID NO: 501940 - DNA, 20 bp, Artificial Sequence
  chemically synthesized
cctttagtagaaagagatgc

SEQ ID NO: 501941 - DNA, 20 bp, Artificial Sequence
  chemically synthesized
aggaactttcaggagtagag

SEQ ID NO: 501942 - DNA, 20 bp, Artificial Sequence
  chemically synthesized
tctttgttcaaggaactttc

SEQ ID NO: 501943 - DNA, 20 bp, Artificial Sequence
  chemically synthesized
cactaaatatgctttatgta

SEQ ID NO: 501944 - DNA, 20 bp, Artificial Sequence
  chemically synthesized
atgctttatgtattgaataa

SEQ ID NO: 501945 - DNA, 20 bp, Artificial Sequence
  chemically synthesized
tttatgtattgaataaagga

SEQ ID NO: 501946 - DNA, 20 bp, Artificial Sequence
  chemically synthesized
aagttagaaaatataactgg

SEQ ID NO: 501947 - DNA, 20 bp, Artificial Sequence
  chemically synthesized
taactggtagaatttacata

SEQ ID NO: 501948 - DNA, 20 bp, Artificial Sequence
  chemically synthesized
gaaaaccaggagcaacttgt

SEQ ID NO: 501949 - DNA, 20 bp, Artificial Sequence
  chemically synthesized
tcccaggcttcatgacagac

SEQ ID NO: 501950 - DNA, 20 bp, Artificial Sequence
  chemically synthesized
ccttgtctgtcatgaagcct

SEQ ID NO: 501951 - DNA, 20 bp, Artificial Sequence
  chemically synthesized
gctctgcagaaacagcatga

SEQ ID NO: 501952 - DNA, 20 bp, Artificial Sequence
  chemically synthesized
atacgtagtggactctcgac

SEQ ID NO: 501953 - DNA, 20 bp, Artificial Sequence
  chemically synthesized
ccaaaaatcatactcaagtc

SEQ ID NO: 501954 - DNA, 20 bp, Artificial Sequence
  chemically synthesized
ttctcaacacatctgtcaaa

SEQ ID NO: 501955 - DNA, 20 bp, Artificial Sequence
  chemically synthesized
tatacttattaatagaacac

SEQ ID NO: 501956 - DNA, 20 bp, Artificial Sequence
  chemically synthesized
atagaacacaggaatattgc

SEQ ID NO: 501957 - DNA, 20 bp, Artificial Sequence
  chemically synthesized
taaataatgagaataaagga

SEQ ID NO: 501958 - DNA, 20 bp, Artificial Sequence
  chemically synthesized
catccctaaaggtaaataat

SEQ ID NO: 501959 - DNA, 20 bp, Artificial Sequence
  chemically synthesized
tattctcattatttaccttt

SEQ ID NO: 501960 - DNA, 20 bp, Artificial Sequence
  chemically synthesized
ggttcaataaaaaactgtgc

SEQ ID NO: 501961 - DNA, 20 bp, Artificial Sequence
  chemically synthesized
cattacaattgaaattaatc

SEQ ID NO: 501962 - DNA, 20 bp, Artificial Sequence
  chemically synthesized
cagattaatttcaattgtaa

SEQ ID NO: 501963 - DNA, 20 bp, Artificial Sequence
  chemically synthesized
tgtgtgtgtacaaccaaaat

SEQ ID NO: 501964 - DNA, 20 bp, Artificial Sequence
  chemically synthesized
tggaattgttatcaaggttc

SEQ ID NO: 501965 - DNA, 20 bp, Artificial Sequence
  chemically synthesized
ggaattttattatttggaat

SEQ ID NO: 501966 - DNA, 20 bp, Artificial Sequence
  chemically synthesized
aaataaggaattttattatt

SEQ ID NO: 501967 - DNA, 20 bp, Artificial Sequence
  chemically synthesized
cacctctcctaaagaaaata

SEQ ID NO: 501968 - DNA, 20 bp, Artificial Sequence
  chemically synthesized
agggaaaatctgtttaaaaa

SEQ ID NO: 501969 - DNA, 20 bp, Artificial Sequence
  chemically synthesized
gcatctgcccttttgactgc

SEQ ID NO: 501970 - DNA, 20 bp, Artificial Sequence
  chemically synthesized
ctgcaagaattttgtgttgt

SEQ ID NO: 501971 - DNA, 20 bp, Artificial Sequence
  chemically synthesized
ttgtgttgtaggggtgtgtg

SEQ ID NO: 501972 - DNA, 20 bp, Artificial Sequence
  chemically synthesized
tttctttgaaatattgaatc

SEQ ID NO: 501973 - DNA, 20 bp, Artificial Sequence
  chemically synthesized
gatagaatttctttgaaata

SEQ ID NO: 501974 - DNA, 20 bp, Artificial Sequence
  chemically synthesized
ctgcattagctctgggaaga

SEQ ID NO: 501975 - DNA, 20 bp, Artificial Sequence
  chemically synthesized
cactgccatcttaaggaaaa

SEQ ID NO: 501976 - DNA, 20 bp, Artificial Sequence
  chemically synthesized
atactttgtgtgtgtatgcg

SEQ ID NO: 501977 - DNA, 20 bp, Artificial Sequence
  chemically synthesized
tttgtgtgtgtatgcgagga

SEQ ID NO: 501978 - DNA, 20 bp, Artificial Sequence
  chemically synthesized
cgaagttaacaatgtattta

SEQ ID NO: 501979 - DNA, 20 bp, Artificial Sequence
  chemically synthesized
cagagcatagagaaataaaa

SEQ ID NO: 501980 - DNA, 20 bp, Artificial Sequence
  chemically synthesized
tgctgtattcttacatggtg

SEQ ID NO: 501981 - DNA, 20 bp, Artificial Sequence
  chemically synthesized
ctccccactcatcaccatgt

SEQ ID NO: 501982 - DNA, 20 bp, Artificial Sequence
  chemically synthesized
acaagaagaaagctctcctc

SEQ ID NO: 501983 - DNA, 20 bp, Artificial Sequence
  chemically synthesized
aagctctcctcaggaatgaa

SEQ ID NO: 501984 - DNA, 20 bp, Artificial Sequence
  chemically synthesized
tttctgcaagtgtggagtct

SEQ ID NO: 501985 - DNA, 20 bp, Artificial Sequence
  chemically synthesized
taaattgatttctgcaagtg

SEQ ID NO: 501986 - DNA, 20 bp, Artificial Sequence
  chemically synthesized
ttgagtatgcattacctttt

SEQ ID NO: 501987 - DNA, 20 bp, Artificial Sequence
  chemically synthesized
tatggttgtgtctgccacaa

SEQ ID NO: 501988 - DNA, 20 bp, Artificial Sequence
  chemically synthesized
ccttctattttaaccatctt

SEQ ID NO: 501989 - DNA, 20 bp, Artificial Sequence
  chemically synthesized
tctgaagatggttaaaatag

SEQ ID NO: 501990 - DNA, 20 bp, Artificial Sequence
  chemically synthesized
agggttccttcttacataaa

SEQ ID NO: 501991 - DNA, 20 bp, Artificial Sequence
  chemically synthesized
ctactgctgttgaaaatatt

SEQ ID NO: 501992 - DNA, 20 bp, Artificial Sequence
  chemically synthesized
cctgagaataaaaatattgt

SEQ ID NO: 501993 - DNA, 20 bp, Artificial Sequence
  chemically synthesized
aatatttttattctcaggca

SEQ ID NO: 501994 - DNA, 20 bp, Artificial Sequence
  chemically synthesized
aagtcctatattctttgcct

SEQ ID NO: 501995 - DNA, 20 bp, Artificial Sequence
  chemically synthesized
tgtagaaacatttgtgacta

SEQ ID NO: 501996 - DNA, 20 bp, Artificial Sequence
  chemically synthesized
atttaactttaatagtatca

SEQ ID NO: 501997 - DNA, 20 bp, Artificial Sequence
  chemically synthesized
atacacttttattttgcttt

SEQ ID NO: 501998 - DNA, 20 bp, Artificial Sequence
  chemically synthesized
attactatgtggcaaatggt

SEQ ID NO: 501999 - DNA, 20 bp, Artificial Sequence
  chemically synthesized
gctctcagatatgtattttc

SEQ ID NO: 502000 - DNA, 20 bp, Artificial Sequence
  chemically synthesized
tatgtattttcaggaataaa

SEQ ID NO: 502001 - DNA, 20 bp, Artificial Sequence
  chemically synthesized
atagggtttgacatcattac

SEQ ID NO: 502002 - DNA, 20 bp, Artificial Sequence
  chemically synthesized
attacgagaatcattcattt

SEQ ID NO: 502003 - DNA, 20 bp, Artificial Sequence
  chemically synthesized
gagttgattattattcagaa

SEQ ID NO: 502004 - DNA, 20 bp, Artificial Sequence
  chemically synthesized
attagacgaataatagtgcc

SEQ ID NO: 502005 - DNA, 20 bp, Artificial Sequence
  chemically synthesized
agcaatgaaagtgacattag

SEQ ID NO: 502006 - DNA, 20 bp, Artificial Sequence
  chemically synthesized
aaataacagaataaatcaat

SEQ ID NO: 502007 - DNA, 20 bp, Artificial Sequence
  chemically synthesized
gtaaatttaacataaaataa

SEQ ID NO: 502008 - DNA, 20 bp, Artificial Sequence
  chemically synthesized
aatttttacgaaatcattgc

SEQ ID NO: 502009 - DNA, 20 bp, Artificial Sequence
  chemically synthesized
gtgggctttttatttgtcat

SEQ ID NO: 502010 - DNA, 20 bp, Artificial Sequence
  chemically synthesized
aaatatatgttttggtaaag

SEQ ID NO: 502011 - DNA, 20 bp, Artificial Sequence
  chemically synthesized
tatactaaaataatgtatgg

SEQ ID NO: 502012 - DNA, 20 bp, Artificial Sequence
  chemically synthesized
actttatactaaaataatgt

SEQ ID NO: 502013 - DNA, 20 bp, Artificial Sequence
  chemically synthesized
ataaattttaaattaataaa

SEQ ID NO: 502014 - DNA, 20 bp, Artificial Sequence
  chemically synthesized
cagaactgaagctgtagcat

SEQ ID NO: 502015 - DNA, 20 bp, Artificial Sequence
  chemically synthesized
agtctcaaatgtattagaga

SEQ ID NO: 502016 - DNA, 20 bp, Artificial Sequence
  chemically synthesized
ttaacatcaattacgaagga

SEQ ID NO: 502017 - DNA, 20 bp, Artificial Sequence
  chemically synthesized
ctataaaaattgataagcac

SEQ ID NO: 502018 - DNA, 20 bp, Artificial Sequence
  chemically synthesized
aacaatgataaatttctcta

SEQ ID NO: 502019 - DNA, 20 bp, Artificial Sequence
  chemically synthesized
ttggtctaccaaggtacctt

SEQ ID NO: 502020 - DNA, 20 bp, Artificial Sequence
  chemically synthesized
tcataatgctttcccatcaa

SEQ ID NO: 502021 - DNA, 20 bp, Artificial Sequence
  chemically synthesized
cttattttgaaacaaagtag

SEQ ID NO: 502022 - DNA, 20 bp, Artificial Sequence
  chemically synthesized
agtaggagaatcttttgtca

SEQ ID NO: 502023 - DNA, 20 bp, Artificial Sequence
  chemically synthesized
aacataacaaatattaatta

SEQ ID NO: 502024 - DNA, 20 bp, Artificial Sequence
  chemically synthesized
aaaatttactttctatggta

SEQ ID NO: 502025 - DNA, 20 bp, Artificial Sequence
  chemically synthesized
acctcatcttagacagaaat

SEQ ID NO: 502026 - DNA, 20 bp, Artificial Sequence
  chemically synthesized
aactcaggttctcaacttta

SEQ ID NO: 502027 - DNA, 20 bp, Artificial Sequence
  chemically synthesized
tattcactaaagttgagaac

SEQ ID NO: 502028 - DNA, 20 bp, Artificial Sequence
  chemically synthesized
tgaaagaactgaatttcttg

SEQ ID NO: 502029 - DNA, 20 bp, Artificial Sequence
  chemically synthesized
tttcgttctgactgaaagaa

SEQ ID NO: 502030 - DNA, 20 bp, Artificial Sequence
  chemically synthesized
tatgggatatctttccataa

SEQ ID NO: 502031 - DNA, 20 bp, Artificial Sequence
  chemically synthesized
tggaaagatatcccatattc

SEQ ID NO: 502032 - DNA, 20 bp, Artificial Sequence
  chemically synthesized
tttattccaatccatgaata

SEQ ID NO: 502033 - DNA, 20 bp, Artificial Sequence
  chemically synthesized
gatatcccatattcatggat

SEQ ID NO: 502034 - DNA, 20 bp, Artificial Sequence
  chemically synthesized
aatattatttattccaatcc

SEQ ID NO: 502035 - DNA, 20 bp, Artificial Sequence
  chemically synthesized
cattaagtctgtaaattgct

SEQ ID NO: 502036 - DNA, 20 bp, Artificial Sequence
  chemically synthesized
aatgtcactggaattttaat

SEQ ID NO: 502037 - DNA, 20 bp, Artificial Sequence
  chemically synthesized
acatctgccaaaaatgtcac

SEQ ID NO: 502038 - DNA, 20 bp, Artificial Sequence
  chemically synthesized
tttttggcagatgtagaaga

SEQ ID NO: 502039 - DNA, 20 bp, Artificial Sequence
  chemically synthesized
ttgttgttcaaaatgaaatt

SEQ ID NO: 502040 - DNA, 20 bp, Artificial Sequence
  chemically synthesized
attttgaacaacaaaagacc

SEQ ID NO: 502041 - DNA, 20 bp, Artificial Sequence
  chemically synthesized
ttaagattgctttggctatt

SEQ ID NO: 502042 - DNA, 20 bp, Artificial Sequence
  chemically synthesized
tagagcattatagaatattt

SEQ ID NO: 502043 - DNA, 20 bp, Artificial Sequence
  chemically synthesized
ttttaattactagagcatta

SEQ ID NO: 502044 - DNA, 20 bp, Artificial Sequence
  chemically synthesized
tgctctagtaattaaaagag

SEQ ID NO: 502045 - DNA, 20 bp, Artificial Sequence
  chemically synthesized
agacatatagaccaaaggaa

SEQ ID NO: 502046 - DNA, 20 bp, Artificial Sequence
  chemically synthesized
gatcagttgatcataaatat

SEQ ID NO: 502047 - DNA, 20 bp, Artificial Sequence
  chemically synthesized
aactgatcaaccaaggggcc

SEQ ID NO: 502048 - DNA, 20 bp, Artificial Sequence
  chemically synthesized
tctcagaaccatttattgaa

SEQ ID NO: 502049 - DNA, 20 bp, Artificial Sequence
  chemically synthesized
caataaatggttctgagaaa

SEQ ID NO: 502050 - DNA, 20 bp, Artificial Sequence
  chemically synthesized
ccaattgcattttcatgcat

SEQ ID NO: 502051 - DNA, 20 bp, Artificial Sequence
  chemically synthesized
ataggttcaggttttaagtc

SEQ ID NO: 502052 - DNA, 20 bp, Artificial Sequence
  chemically synthesized
gttctgggcaaacatttttt

SEQ ID NO: 502053 - DNA, 20 bp, Artificial Sequence
  chemically synthesized
cctcttgttgcctgtgcttt

SEQ ID NO: 502054 - DNA, 20 bp, Artificial Sequence
  chemically synthesized
tcagcaaaacaaacaatcaa

SEQ ID NO: 502055 - DNA, 20 bp, Artificial Sequence
  chemically synthesized
acttactatcataatctata

SEQ ID NO: 502056 - DNA, 20 bp, Artificial Sequence
  chemically synthesized
tcataatctatacagaatat

SEQ ID NO: 502057 - DNA, 20 bp, Artificial Sequence
  chemically synthesized
gatggagagatataggcatc

SEQ ID NO: 502058 - DNA, 20 bp, Artificial Sequence
  chemically synthesized
ttttgtatcattgtcctgat

SEQ ID NO: 502059 - DNA, 20 bp, Artificial Sequence
  chemically synthesized
cacttggctaataagatagc

SEQ ID NO: 502060 - DNA, 20 bp, Artificial Sequence
  chemically synthesized
taaacttaatgtggtctctg

SEQ ID NO: 502061 - DNA, 20 bp, Artificial Sequence
  chemically synthesized
ggtccatcagatagctctaa

SEQ ID NO: 502062 - DNA, 20 bp, Artificial Sequence
  chemically synthesized
agcgttacgtatttttcaat

SEQ ID NO: 502063 - DNA, 20 bp, Artificial Sequence
  chemically synthesized
attaattattgtttcttaat

SEQ ID NO: 502064 - DNA, 20 bp, Artificial Sequence
  chemically synthesized
catatacacatatttcgatg

SEQ ID NO: 502065 - DNA, 20 bp, Artificial Sequence
  chemically synthesized
catagagagagagaggtgtt

SEQ ID NO: 502066 - DNA, 20 bp, Artificial Sequence
  chemically synthesized
ggcaataaattatgtatgat

SEQ ID NO: 502067 - DNA, 20 bp, Artificial Sequence
  chemically synthesized
aatcccaaagaacttgatga

SEQ ID NO: 502068 - DNA, 20 bp, Artificial Sequence
  chemically synthesized
tactctttcatcaagttctt

SEQ ID NO: 502069 - DNA, 20 bp, Artificial Sequence
  chemically synthesized
cttagaacttgtataaaagt

SEQ ID NO: 502070 - DNA, 20 bp, Artificial Sequence
  chemically synthesized
aaacaaaacatgataatcag

SEQ ID NO: 502071 - DNA, 20 bp, Artificial Sequence
  chemically synthesized
aaacatggaatagcaattaa

SEQ ID NO: 502072 - DNA, 20 bp, Artificial Sequence
  chemically synthesized
ctctattaaaatttcaaaca

SEQ ID NO: 502073 - DNA, 20 bp, Artificial Sequence
  chemically synthesized
ttccatgtttgaaattttaa

SEQ ID NO: 502074 - DNA, 20 bp, Artificial Sequence
  chemically synthesized
tgattaactctctgtttaat

SEQ ID NO: 502075 - DNA, 20 bp, Artificial Sequence
  chemically synthesized
gcagctattcttattaaaca

SEQ ID NO: 502076 - DNA, 20 bp, Artificial Sequence
  chemically synthesized
aaagaacataaatgtcaatt

SEQ ID NO: 502077 - DNA, 20 bp, Artificial Sequence
  chemically synthesized
aatagaagtcatgtaaaatt

SEQ ID NO: 502078 - DNA, 20 bp, Artificial Sequence
  chemically synthesized
atgacttctattttaaatgt

SEQ ID NO: 502079 - DNA, 20 bp, Artificial Sequence
  chemically synthesized
aattcatccaaatttatggc

SEQ ID NO: 502080 - DNA, 20 bp, Artificial Sequence
  chemically synthesized
atataattctagccataaat

SEQ ID NO: 502081 - DNA, 20 bp, Artificial Sequence
  chemically synthesized
aattctagccataaatttgg

SEQ ID NO: 502082 - DNA, 20 bp, Artificial Sequence
  chemically synthesized
tgaattaattcactcctaca

SEQ ID NO: 502083 - DNA, 20 bp, Artificial Sequence
  chemically synthesized
aataaatacccgatgtagga

SEQ ID NO: 502084 - DNA, 20 bp, Artificial Sequence
  chemically synthesized
actcaataaatacccgatgt

SEQ ID NO: 502085 - DNA, 20 bp, Artificial Sequence
  chemically synthesized
actcctacatcgggtattta

SEQ ID NO: 502086 - DNA, 20 bp, Artificial Sequence
  chemically synthesized
tactatcaatcagatagtat

SEQ ID NO: 502087 - DNA, 20 bp, Artificial Sequence
  chemically synthesized
taagtaccatgagaacaata

SEQ ID NO: 502088 - DNA, 20 bp, Artificial Sequence
  chemically synthesized
tttatatttgtgatgtacat

SEQ ID NO: 502089 - DNA, 20 bp, Artificial Sequence
  chemically synthesized
attaagacatcaagtggtgt

SEQ ID NO: 502090 - DNA, 20 bp, Artificial Sequence
  chemically synthesized
atacacacacgtacatatat

SEQ ID NO: 502091 - DNA, 20 bp, Artificial Sequence
  chemically synthesized
acagtaggtaattgttttta

SEQ ID NO: 502092 - DNA, 20 bp, Artificial Sequence
  chemically synthesized
ttatggaattagaacaaaaa

SEQ ID NO: 502093 - DNA, 20 bp, Artificial Sequence
  chemically synthesized
tgttaacatcatttgtcaaa

SEQ ID NO: 502094 - DNA, 20 bp, Artificial Sequence
  chemically synthesized
gtcataattattagtgatga

SEQ ID NO: 502095 - DNA, 20 bp, Artificial Sequence
  chemically synthesized
ctaataattatgacttttgt

SEQ ID NO: 502096 - DNA, 20 bp, Artificial Sequence
  chemically synthesized
ggaaatcaacgatgctaatt

SEQ ID NO: 502097 - DNA, 20 bp, Artificial Sequence
  chemically synthesized
tttatattttttgaagttca

SEQ ID NO: 502098 - DNA, 20 bp, Artificial Sequence
  chemically synthesized
ataaatattttacttgccta

SEQ ID NO: 502099 - DNA, 20 bp, Artificial Sequence
  chemically synthesized
atgaaaaaactaaacagtgt

SEQ ID NO: 502100 - DNA, 20 bp, Artificial Sequence
  chemically synthesized
aattgaagcagttctttcat

SEQ ID NO: 502101 - DNA, 20 bp, Artificial Sequence
  chemically synthesized
ttttcagctcatatttactg

SEQ ID NO: 502102 - DNA, 20 bp, Artificial Sequence
  chemically synthesized
tcactttgcaaatattagtc

SEQ ID NO: 502103 - DNA, 20 bp, Artificial Sequence
  chemically synthesized
attagtcatgaataaggcac

SEQ ID NO: 502104 - DNA, 20 bp, Artificial Sequence
  chemically synthesized
ttttttggcaaaatttaaga

SEQ ID NO: 502105 - DNA, 20 bp, Artificial Sequence
  chemically synthesized
gatattagatgagtaaggat

SEQ ID NO: 502106 - DNA, 20 bp, Artificial Sequence
  chemically synthesized
ttagttgatattagatgagt

SEQ ID NO: 502107 - DNA, 20 bp, Artificial Sequence
  chemically synthesized
aagtagttagttgatattag

SEQ ID NO: 502108 - DNA, 20 bp, Artificial Sequence
  chemically synthesized
ctcacccccaaaaagaaact

SEQ ID NO: 502109 - DNA, 20 bp, Artificial Sequence
  chemically synthesized
tctattccaagtttcttttt

SEQ ID NO: 502110 - DNA, 20 bp, Artificial Sequence
  chemically synthesized
ccaagtttctttttgggggt

SEQ ID NO: 502111 - DNA, 20 bp, Artificial Sequence
  chemically synthesized
ttataccactaaaatgcagc

SEQ ID NO: 502112 - DNA, 20 bp, Artificial Sequence
  chemically synthesized
tgaattatgaaaatatatta

SEQ ID NO: 502113 - DNA, 20 bp, Artificial Sequence
  chemically synthesized
atgaaaatatattatcgaat

SEQ ID NO: 502114 - DNA, 20 bp, Artificial Sequence
  chemically synthesized
agatacatcgtagtcatatc

SEQ ID NO: 502115 - DNA, 20 bp, Artificial Sequence
  chemically synthesized
tccataatatcaatgaaaaa

SEQ ID NO: 502116 - DNA, 20 bp, Artificial Sequence
  chemically synthesized
tctgtttttcattgatatta

SEQ ID NO: 502117 - DNA, 20 bp, Artificial Sequence
  chemically synthesized
agtcacataaaatgaaaaca

SEQ ID NO: 502118 - DNA, 20 bp, Artificial Sequence
  chemically synthesized
ctacatgtactatcggccat

SEQ ID NO: 502119 - DNA, 20 bp, Artificial Sequence
  chemically synthesized
ctaatggccgatagtacatg

SEQ ID NO: 502120 - DNA, 20 bp, Artificial Sequence
  chemically synthesized
tataataatacttatgttac

SEQ ID NO: 502121 - DNA, 20 bp, Artificial Sequence
  chemically synthesized
tgaggtatgattgcatctac

SEQ ID NO: 502122 - DNA, 20 bp, Artificial Sequence
  chemically synthesized
tacctcagctttgttttcag

SEQ ID NO: 502123 - DNA, 20 bp, Artificial Sequence
  chemically synthesized
cagaggaatcatctcagttg

SEQ ID NO: 502124 - DNA, 20 bp, Artificial Sequence
  chemically synthesized
tgaaatgcctcaagacaaca

SEQ ID NO: 502125 - DNA, 20 bp, Artificial Sequence
  chemically synthesized
ctttcctttaaacaccagta

SEQ ID NO: 502126 - DNA, 20 bp, Artificial Sequence
  chemically synthesized
aaaggaaagttattaaagtt

SEQ ID NO: 502127 - DNA, 20 bp, Artificial Sequence
  chemically synthesized
aagttattaaagtttggaat

SEQ ID NO: 502128 - DNA, 20 bp, Artificial Sequence
  chemically synthesized
aaagtttggaataagagtac

SEQ ID NO: 502129 - DNA, 20 bp, Artificial Sequence
  chemically synthesized
tggaataagagtacctgaat

SEQ ID NO: 502130 - DNA, 20 bp, Artificial Sequence
  chemically synthesized
aatttaaggacaaacagctg

SEQ ID NO: 502131 - DNA, 20 bp, Artificial Sequence
  chemically synthesized
taaggctacagattacctga

SEQ ID NO: 502132 - DNA, 20 bp, Artificial Sequence
  chemically synthesized
ctcaggtaatctgtagcctt

SEQ ID NO: 502133 - DNA, 20 bp, Artificial Sequence
  chemically synthesized
tcctaacaacttcagaaata

SEQ ID NO: 502134 - DNA, 20 bp, Artificial Sequence
  chemically synthesized
tccattatttctgaagttgt

SEQ ID NO: 502135 - DNA, 20 bp, Artificial Sequence
  chemically synthesized
ttccatttaaaatatattta

SEQ ID NO: 502136 - DNA, 20 bp, Artificial Sequence
  chemically synthesized
aagaactgtgcagaatataa

SEQ ID NO: 502137 - DNA, 20 bp, Artificial Sequence
  chemically synthesized
taattctgctaagaactgtg

SEQ ID NO: 502138 - DNA, 20 bp, Artificial Sequence
  chemically synthesized
atattctgcacagttcttag

SEQ ID NO: 502139 - DNA, 20 bp, Artificial Sequence
  chemically synthesized
gcctattctgtgtgtctttt

SEQ ID NO: 502140 - DNA, 20 bp, Artificial Sequence
  chemically synthesized
atagactcaaaaaagacaca

SEQ ID NO: 502141 - DNA, 20 bp, Artificial Sequence
  chemically synthesized
gtaactgctcttttataaga

SEQ ID NO: 502142 - DNA, 20 bp, Artificial Sequence
  chemically synthesized
cttcttaatgaggaaagtca

SEQ ID NO: 502143 - DNA, 20 bp, Artificial Sequence
  chemically synthesized
acttgcctgcattggaaaca

SEQ ID NO: 502144 - DNA, 20 bp, Artificial Sequence
  chemically synthesized
gctcaaaattggctggtttc

SEQ ID NO: 502145 - DNA, 20 bp, Artificial Sequence
  chemically synthesized
tgtatgttttcctgtgttgg

SEQ ID NO: 502146 - DNA, 20 bp, Artificial Sequence
  chemically synthesized
caaatgtatgttttcctgtg

SEQ ID NO: 502147 - DNA, 20 bp, Artificial Sequence
  chemically synthesized
acaggaaaacatacatttgg

SEQ ID NO: 502148 - DNA, 20 bp, Artificial Sequence
  chemically synthesized
ataacattaagaaaaaacta

SEQ ID NO: 502149 - DNA, 20 bp, Artificial Sequence
  chemically synthesized
tataatttgatgtctaaaca

SEQ ID NO: 502150 - DNA, 20 bp, Artificial Sequence
  chemically synthesized
caacttgattattggcaaga

SEQ ID NO: 502151 - DNA, 20 bp, Artificial Sequence
  chemically synthesized
tcaagttgtccaatatagac

SEQ ID NO: 502152 - DNA, 20 bp, Artificial Sequence
  chemically synthesized
caggggaaggaggctgccca

SEQ ID NO: 502153 - DNA, 20 bp, Artificial Sequence
  chemically synthesized
tcatgacttgtcaaatcaga

SEQ ID NO: 502154 - DNA, 20 bp, Artificial Sequence
  chemically synthesized
cagattggattttctgttgg

SEQ ID NO: 502155 - DNA, 20 bp, Artificial Sequence
  chemically synthesized
gaggtggttgaggagagttt

SEQ ID NO: 502156 - DNA, 20 bp, Artificial Sequence
  chemically synthesized
acatggtagaggtggttgag

SEQ ID NO: 502157 - DNA, 20 bp, Artificial Sequence
  chemically synthesized
aaaatgaccgtaaattggcc

SEQ ID NO: 502158 - DNA, 20 bp, Artificial Sequence
  chemically synthesized
gcctcgacctcccaaagtgc

SEQ ID NO: 502159 - DNA, 20 bp, Artificial Sequence
  chemically synthesized
actttgggaggtcgaggcag

SEQ ID NO: 502160 - DNA, 20 bp, Artificial Sequence
  chemically synthesized
aggcaggtggatcacctaaa

SEQ ID NO: 502161 - DNA, 20 bp, Artificial Sequence
  chemically synthesized
gaagaaataaatcgtttcac

SEQ ID NO: 502162 - DNA, 20 bp, Artificial Sequence
  chemically synthesized
aacgatttatttcttcccta

SEQ ID NO: 502163 - DNA, 20 bp, Artificial Sequence
  chemically synthesized
tgaaaaaagcaataatcatt

SEQ ID NO: 502164 - DNA, 20 bp, Artificial Sequence
  chemically synthesized
ggtaatttatatattatatg

SEQ ID NO: 502165 - DNA, 20 bp, Artificial Sequence
  chemically synthesized
catcatgtctttggtccgat

SEQ ID NO: 502166 - DNA, 20 bp, Artificial Sequence
  chemically synthesized
ctcatccctgtcacagttgg

SEQ ID NO: 502167 - DNA, 20 bp, Artificial Sequence
  chemically synthesized
aagattcagccaactgtgac

SEQ ID NO: 502168 - DNA, 20 bp, Artificial Sequence
  chemically synthesized
aaataaaaagaaggtaatta

SEQ ID NO: 502169 - DNA, 20 bp, Artificial Sequence
  chemically synthesized
tttattttattttgtagagg

SEQ ID NO: 502170 - DNA, 20 bp, Artificial Sequence
  chemically synthesized
accaggagtttgggaccagg

SEQ ID NO: 502171 - DNA, 20 bp, Artificial Sequence
  chemically synthesized
caggagaattgcttaagacc

SEQ ID NO: 502172 - DNA, 20 bp, Artificial Sequence
  chemically synthesized
tctgtgggaggctgagacag

SEQ ID NO: 502173 - DNA, 20 bp, Artificial Sequence
  chemically synthesized
tgaaatatggcacataatga

SEQ ID NO: 502174 - DNA, 20 bp, Artificial Sequence
  chemically synthesized
agttaaatttcagggaagct

SEQ ID NO: 502175 - DNA, 20 bp, Artificial Sequence
  chemically synthesized
gcttccggcagatactgatt

SEQ ID NO: 502176 - DNA, 20 bp, Artificial Sequence
  chemically synthesized
cttgatcgaaaatgtcttta

SEQ ID NO: 502177 - DNA, 20 bp, Artificial Sequence
  chemically synthesized
agaaattcatatgttaaatg

SEQ ID NO: 502178 - DNA, 20 bp, Artificial Sequence
  chemically synthesized
gtatattctgcatttaacat

SEQ ID NO: 502179 - DNA, 20 bp, Artificial Sequence
  chemically synthesized
tttctgagccagttataggc

SEQ ID NO: 502180 - DNA, 20 bp, Artificial Sequence
  chemically synthesized
tgaccgctagctgattttgt

SEQ ID NO: 502181 - DNA, 20 bp, Artificial Sequence
  chemically synthesized
ataatgactgaattttaaat

SEQ ID NO: 502182 - DNA, 20 bp, Artificial Sequence
  chemically synthesized
ttataataatctaataatga

SEQ ID NO: 502183 - DNA, 20 bp, Artificial Sequence
  chemically synthesized
gagcagaaactaaattatac

SEQ ID NO: 502184 - DNA, 20 bp, Artificial Sequence
  chemically synthesized
cataacgtatattagtgtaa

SEQ ID NO: 502185 - DNA, 20 bp, Artificial Sequence
  chemically synthesized
gtaagtgaatttacaccaat

SEQ ID NO: 502186 - DNA, 20 bp, Artificial Sequence
  chemically synthesized
tatcttctaatgatatgtat

SEQ ID NO: 502187 - DNA, 20 bp, Artificial Sequence
  chemically synthesized
gagcgaactatagccctgaa

SEQ ID NO: 502188 - DNA, 20 bp, Artificial Sequence
  chemically synthesized
atagccctgaactgagtaat

SEQ ID NO: 502189 - DNA, 20 bp, Artificial Sequence
  chemically synthesized
aataatattgaggtacatct

SEQ ID NO: 502190 - DNA, 20 bp, Artificial Sequence
  chemically synthesized
tgtacctcaatattattcct

SEQ ID NO: 502191 - DNA, 20 bp, Artificial Sequence
  chemically synthesized
ttgttaggattaatattcta

SEQ ID NO: 502192 - DNA, 20 bp, Artificial Sequence
  chemically synthesized
tgatttgcctctataattgt

SEQ ID NO: 502193 - DNA, 20 bp, Artificial Sequence
  chemically synthesized
attatagaggcaaatcaatt

SEQ ID NO: 502194 - DNA, 20 bp, Artificial Sequence
  chemically synthesized
ttatgaattacctaaatagt

SEQ ID NO: 502195 - DNA, 20 bp, Artificial Sequence
  chemically synthesized
tgctctcatttgttttaagg

SEQ ID NO: 502196 - DNA, 20 bp, Artificial Sequence
  chemically synthesized
atatcgatgatcttcattgg

SEQ ID NO: 502197 - DNA, 20 bp, Artificial Sequence
  chemically synthesized
attgatatgtttcgtgaacc

SEQ ID NO: 502198 - DNA, 20 bp, Artificial Sequence
  chemically synthesized
gtttcgtgaacctagaatct

SEQ ID NO: 502199 - DNA, 20 bp, Artificial Sequence
  chemically synthesized
tgaacctagaatctgggagt

SEQ ID NO: 502200 - DNA, 20 bp, Artificial Sequence
  chemically synthesized
aaataacgtcatgcacctag

SEQ ID NO: 502201 - DNA, 20 bp, Artificial Sequence
  chemically synthesized
ttatagagcaagaaacatca

SEQ ID NO: 502202 - DNA, 20 bp, Artificial Sequence
  chemically synthesized
acatcacagaatctataaaa

SEQ ID NO: 502203 - DNA, 20 bp, Artificial Sequence
  chemically synthesized
taaaattggatggaagtatg

SEQ ID NO: 502204 - DNA, 20 bp, Artificial Sequence
  chemically synthesized
ttggatggaagtatgcaggg

SEQ ID NO: 502205 - DNA, 20 bp, Artificial Sequence
  chemically synthesized
ggtggagtgatgcttgtacg

SEQ ID NO: 502206 - DNA, 20 bp, Artificial Sequence
  chemically synthesized
ttgtacggaggatgtcataa

SEQ ID NO: 502207 - DNA, 20 bp, Artificial Sequence
  chemically synthesized
aataattagtaagcattgct

SEQ ID NO: 502208 - DNA, 20 bp, Artificial Sequence
  chemically synthesized
gggagtaacagatgctttag

SEQ ID NO: 502209 - DNA, 20 bp, Artificial Sequence
  chemically synthesized
tactggcccacctttttgag

SEQ ID NO: 502210 - DNA, 20 bp, Artificial Sequence
  chemically synthesized
acccataacatggagttggc

SEQ ID NO: 502211 - DNA, 20 bp, Artificial Sequence
  chemically synthesized
attctggccaactccatgtt

SEQ ID NO: 502212 - DNA, 20 bp, Artificial Sequence
  chemically synthesized
tattctgatcacccataaca

SEQ ID NO: 502213 - DNA, 20 bp, Artificial Sequence
  chemically synthesized
aactccatgttatgggtgat

SEQ ID NO: 502214 - DNA, 20 bp, Artificial Sequence
  chemically synthesized
acacaatgcttgtgttaaga

SEQ ID NO: 502215 - DNA, 20 bp, Artificial Sequence
  chemically synthesized
ttgtgttaagagagaatcat

SEQ ID NO: 502216 - DNA, 20 bp, Artificial Sequence
  chemically synthesized
cagaatctctctcagaaaat

SEQ ID NO: 502217 - DNA, 20 bp, Artificial Sequence
  chemically synthesized
cagaaaattagaattgacag

SEQ ID NO: 502218 - DNA, 20 bp, Artificial Sequence
  chemically synthesized
cagaagagtctggtcaaact

SEQ ID NO: 502219 - DNA, 20 bp, Artificial Sequence
  chemically synthesized
ctggtcaaactgtgagtgct

SEQ ID NO: 502220 - DNA, 20 bp, Artificial Sequence
  chemically synthesized
cttacgaagtccctagtttg

SEQ ID NO: 502221 - DNA, 20 bp, Artificial Sequence
  chemically synthesized
cgaagtccctagtttgcaga

SEQ ID NO: 502222 - DNA, 20 bp, Artificial Sequence
  chemically synthesized
aagaaagaagtagatgcata

SEQ ID NO: 502223 - DNA, 20 bp, Artificial Sequence
  chemically synthesized
tagttatttatgttttgaga

SEQ ID NO: 502224 - DNA, 20 bp, Artificial Sequence
  chemically synthesized
tcgtgctattgcgttccagc

SEQ ID NO: 502225 - DNA, 20 bp, Artificial Sequence
  chemically synthesized
tacttggttggctgaggcag

SEQ ID NO: 502226 - DNA, 20 bp, Artificial Sequence
  chemically synthesized
tttatattttttagtagcga

SEQ ID NO: 502227 - DNA, 20 bp, Artificial Sequence
  chemically synthesized
cagggttttaccatgttggt

SEQ ID NO: 502228 - DNA, 20 bp, Artificial Sequence
  chemically synthesized
ccatgttggtcaggatggtc

SEQ ID NO: 502229 - DNA, 20 bp, Artificial Sequence
  chemically synthesized
actttgggaagccgaggcag

SEQ ID NO: 502230 - DNA, 20 bp, Artificial Sequence
  chemically synthesized
gcctcggcttcccaaagtgc

SEQ ID NO: 502231 - DNA, 20 bp, Artificial Sequence
  chemically synthesized
taaacttcacctcttgttga

SEQ ID NO: 502232 - DNA, 20 bp, Artificial Sequence
  chemically synthesized
atttcttcagctctttaaat

SEQ ID NO: 502233 - DNA, 20 bp, Artificial Sequence
  chemically synthesized
tctattggtcaaagcagtca

SEQ ID NO: 502234 - DNA, 20 bp, Artificial Sequence
  chemically synthesized
tctttgactgctttgaccaa

SEQ ID NO: 502235 - DNA, 20 bp, Artificial Sequence
  chemically synthesized
ctttttagaacagtcattct

SEQ ID NO: 502236 - DNA, 20 bp, Artificial Sequence
  chemically synthesized
attctaaaagggagcaccct

SEQ ID NO: 502237 - DNA, 20 bp, Artificial Sequence
  chemically synthesized
attcttagggtgctcccttt

SEQ ID NO: 502238 - DNA, 20 bp, Artificial Sequence
  chemically synthesized
ctcagagcataatatgttgg

SEQ ID NO: 502239 - DNA, 20 bp, Artificial Sequence
  chemically synthesized
ctttctcagagcataatatg

SEQ ID NO: 502240 - DNA, 20 bp, Artificial Sequence
  chemically synthesized
ctaagtaacatcgaaaggcc

SEQ ID NO: 502241 - DNA, 20 bp, Artificial Sequence
  chemically synthesized
agccaacaactgctaggcat

SEQ ID NO: 502242 - DNA, 20 bp, Artificial Sequence
  chemically synthesized
aacaactgctaggcatgtga

SEQ ID NO: 502243 - DNA, 20 bp, Artificial Sequence
  chemically synthesized
ttgtctgatactatagtaac

SEQ ID NO: 502244 - DNA, 20 bp, Artificial Sequence
  chemically synthesized
tgcgtgttgagaaagctcac

SEQ ID NO: 502245 - DNA, 20 bp, Artificial Sequence
  chemically synthesized
caacacgcaaaaccattagt

SEQ ID NO: 502246 - DNA, 20 bp, Artificial Sequence
  chemically synthesized
acacaggcattagtcccttc

SEQ ID NO: 502247 - DNA, 20 bp, Artificial Sequence
  chemically synthesized
tcaaaactttattactgccc

SEQ ID NO: 502248 - DNA, 20 bp, Artificial Sequence
  chemically synthesized
atggaaacaggaatgtgtca

SEQ ID NO: 502249 - DNA, 20 bp, Artificial Sequence
  chemically synthesized
aaggtttttcatatggaaac

SEQ ID NO: 502250 - DNA, 20 bp, Artificial Sequence
  chemically synthesized
caattttgttacttctaaat

SEQ ID NO: 502251 - DNA, 20 bp, Artificial Sequence
  chemically synthesized
ctaaatactgtatatgcata

SEQ ID NO: 502252 - DNA, 20 bp, Artificial Sequence
  chemically synthesized
tatatgcatactggatacgc

SEQ ID NO: 502253 - DNA, 20 bp, Artificial Sequence
  chemically synthesized
tactggatacgcaaggatat

SEQ ID NO: 502254 - DNA, 20 bp, Artificial Sequence
  chemically synthesized
acagggcactgaagagcata

SEQ ID NO: 502255 - DNA, 20 bp, Artificial Sequence
  chemically synthesized
taaataactttatgtcccaa

SEQ ID NO: 502256 - DNA, 20 bp, Artificial Sequence
  chemically synthesized
cctatgaatttccttagtta

SEQ ID NO: 502257 - DNA, 20 bp, Artificial Sequence
  chemically synthesized
tacagtcgcatttcctccct

SEQ ID NO: 502258 - DNA, 20 bp, Artificial Sequence
  chemically synthesized
taaatcagcagtatgttgaa

SEQ ID NO: 502259 - DNA, 20 bp, Artificial Sequence
  chemically synthesized
tacagagagaaagagggaaa

SEQ ID NO: 502260 - DNA, 20 bp, Artificial Sequence
  chemically synthesized
aatctcacatcaattgatgt

SEQ ID NO: 502261 - DNA, 20 bp, Artificial Sequence
  chemically synthesized
tcaattgatgtgagaatttt

SEQ ID NO: 502262 - DNA, 20 bp, Artificial Sequence
  chemically synthesized
acagtttgagataggttcaa

SEQ ID NO: 502263 - DNA, 20 bp, Artificial Sequence
  chemically synthesized
tcaatgggatcaatagtaat

SEQ ID NO: 502264 - DNA, 20 bp, Artificial Sequence
  chemically synthesized
attgcagctagaagagagaa

SEQ ID NO: 502265 - DNA, 20 bp, Artificial Sequence
  chemically synthesized
tttcaagggctggcctgatt

SEQ ID NO: 502266 - DNA, 20 bp, Artificial Sequence
  chemically synthesized
gtaatttaaactatttttat

SEQ ID NO: 502267 - DNA, 20 bp, Artificial Sequence
  chemically synthesized
tatgttcaagtctgattgac

SEQ ID NO: 502268 - DNA, 20 bp, Artificial Sequence
  chemically synthesized
cctgtttaaagcaagaaaac

SEQ ID NO: 502269 - DNA, 20 bp, Artificial Sequence
  chemically synthesized
agatgtgaagacgcaagaag

SEQ ID NO: 502270 - DNA, 20 bp, Artificial Sequence
  chemically synthesized
tgcttcctacatggtgctct

SEQ ID NO: 502271 - DNA, 20 bp, Artificial Sequence
  chemically synthesized
acatggtgctctcagagtat

SEQ ID NO: 502272 - DNA, 20 bp, Artificial Sequence
  chemically synthesized
gaaatcatgttaacagtaac

SEQ ID NO: 502273 - DNA, 20 bp, Artificial Sequence
  chemically synthesized
gattttctcatgtctagccc

SEQ ID NO: 502274 - DNA, 20 bp, Artificial Sequence
  chemically synthesized
tagttgactactgaagaaat

SEQ ID NO: 502275 - DNA, 20 bp, Artificial Sequence
  chemically synthesized
tctcatcctcagcagatacc

SEQ ID NO: 502276 - DNA, 20 bp, Artificial Sequence
  chemically synthesized
caaaaccctaggtatctgct

SEQ ID NO: 502277 - DNA, 20 bp, Artificial Sequence
  chemically synthesized
atctgctgaggatgagagga

SEQ ID NO: 502278 - DNA, 20 bp, Artificial Sequence
  chemically synthesized
atgagaggagagaatcaagg

SEQ ID NO: 502279 - DNA, 20 bp, Artificial Sequence
  chemically synthesized
ggaaactgatttaaaaaaat

SEQ ID NO: 502280 - DNA, 20 bp, Artificial Sequence
  chemically synthesized
aaaataagaatacactcaga

SEQ ID NO: 502281 - DNA, 20 bp, Artificial Sequence
  chemically synthesized
atttgggccctctaccctct

SEQ ID NO: 502282 - DNA, 20 bp, Artificial Sequence
  chemically synthesized
ctactaaccttggaggctaa

SEQ ID NO: 502283 - DNA, 20 bp, Artificial Sequence
  chemically synthesized
agtcctttaaccttttatac

SEQ ID NO: 502284 - DNA, 20 bp, Artificial Sequence
  chemically synthesized
ccacaaatatctgtggtggt

SEQ ID NO: 502285 - DNA, 20 bp, Artificial Sequence
  chemically synthesized
atgttaatatgattaggaga

SEQ ID NO: 502286 - DNA, 20 bp, Artificial Sequence
  chemically synthesized
ttctcacaaatgtccatttg

SEQ ID NO: 502287 - DNA, 20 bp, Artificial Sequence
  chemically synthesized
tgactaaatgctatcaacat

SEQ ID NO: 502288 - DNA, 20 bp, Artificial Sequence
  chemically synthesized
agtagaagctgaacgatttg

SEQ ID NO: 502289 - DNA, 20 bp, Artificial Sequence
  chemically synthesized
tttgttctcactgtgtggaa

SEQ ID NO: 502290 - DNA, 20 bp, Artificial Sequence
  chemically synthesized
acaattttgttctcactgtg

SEQ ID NO: 502291 - DNA, 20 bp, Artificial Sequence
  chemically synthesized
tcacacaccagggcctgtcg

SEQ ID NO: 502292 - DNA, 20 bp, Artificial Sequence
  chemically synthesized
gtggggtggggggagggggg

SEQ ID NO: 502293 - DNA, 20 bp, Artificial Sequence
  chemically synthesized
ctaatgtaactgacaagtta

SEQ ID NO: 502294 - DNA, 20 bp, Artificial Sequence
  chemically synthesized
gcagcacaccaacatgtcac

SEQ ID NO: 502295 - DNA, 20 bp, Artificial Sequence
  chemically synthesized
ttaaattatactttaagttc

SEQ ID NO: 502296 - DNA, 20 bp, Artificial Sequence
  chemically synthesized
tatctttctgatcacagagc

SEQ ID NO: 502297 - DNA, 20 bp, Artificial Sequence
  chemically synthesized
taactagcatatggctgaga

SEQ ID NO: 502298 - DNA, 20 bp, Artificial Sequence
  chemically synthesized
atggctgagaaagggttttg

SEQ ID NO: 502299 - DNA, 20 bp, Artificial Sequence
  chemically synthesized
gaaagggttttggagggtca

SEQ ID NO: 502300 - DNA, 20 bp, Artificial Sequence
  chemically synthesized
gttttggagggtcagagaat

SEQ ID NO: 502301 - DNA, 20 bp, Artificial Sequence
  chemically synthesized
agggtcagagaataagaata

SEQ ID NO: 502302 - DNA, 20 bp, Artificial Sequence
  chemically synthesized
aagattaggcttggggcatg

SEQ ID NO: 502303 - DNA, 20 bp, Artificial Sequence
  chemically synthesized
taatttaatgggaggaaaga

SEQ ID NO: 502304 - DNA, 20 bp, Artificial Sequence
  chemically synthesized
aatgggaggaaagactgaat

SEQ ID NO: 502305 - DNA, 20 bp, Artificial Sequence
  chemically synthesized
aagactgaatgtgagttagt

SEQ ID NO: 502306 - DNA, 20 bp, Artificial Sequence
  chemically synthesized
taagaattactatctagatg

SEQ ID NO: 502307 - DNA, 20 bp, Artificial Sequence
  chemically synthesized
aattaaatgctggtttatag

SEQ ID NO: 502308 - DNA, 20 bp, Artificial Sequence
  chemically synthesized
gctttgtaatgctgagcttc

SEQ ID NO: 502309 - DNA, 20 bp, Artificial Sequence
  chemically synthesized
taagttccacattttcccaa

SEQ ID NO: 502310 - DNA, 20 bp, Artificial Sequence
  chemically synthesized
cccctgccaacagataaaag

SEQ ID NO: 502311 - DNA, 20 bp, Artificial Sequence
  chemically synthesized
aggaccaagtaacctgtgag

SEQ ID NO: 502312 - DNA, 20 bp, Artificial Sequence
  chemically synthesized
gctcaaggcaaagcattcca

SEQ ID NO: 502313 - DNA, 20 bp, Artificial Sequence
  chemically synthesized
tatgtatatttcaaattcca

SEQ ID NO: 502314 - DNA, 20 bp, Artificial Sequence
  chemically synthesized
aaatagttagaaaaactgtt

SEQ ID NO: 502315 - DNA, 20 bp, Artificial Sequence
  chemically synthesized
tggaacagtactacaaatat

SEQ ID NO: 502316 - DNA, 20 bp, Artificial Sequence
  chemically synthesized
gataaaattttctttatgca

SEQ ID NO: 502317 - DNA, 20 bp, Artificial Sequence
  chemically synthesized
ttccaaaatatgtttaacca

SEQ ID NO: 502318 - DNA, 20 bp, Artificial Sequence
  chemically synthesized
gtctataccacagaacttct

SEQ ID NO: 502319 - DNA, 20 bp, Artificial Sequence
  chemically synthesized
aatatatattgtgtatatcc

SEQ ID NO: 502320 - DNA, 20 bp, Artificial Sequence
  chemically synthesized
tacaaagtgttgtatgattc

SEQ ID NO: 502321 - DNA, 20 bp, Artificial Sequence
  chemically synthesized
actctggcaaaaaaaagcaa

SEQ ID NO: 502322 - DNA, 20 bp, Artificial Sequence
  chemically synthesized
atccttttgcttttttttgc

SEQ ID NO: 502323 - DNA, 20 bp, Artificial Sequence
  chemically synthesized
aatgaattgaattattatta

SEQ ID NO: 502324 - DNA, 20 bp, Artificial Sequence
  chemically synthesized
tttataattttagtaatgaa

SEQ ID NO: 502325 - DNA, 20 bp, Artificial Sequence
  chemically synthesized
tttattttataattttagta

SEQ ID NO: 502326 - DNA, 20 bp, Artificial Sequence
  chemically synthesized
tatttccaattgattctact

SEQ ID NO: 502327 - DNA, 20 bp, Artificial Sequence
  chemically synthesized
gttttacagcttacccatag

SEQ ID NO: 502328 - DNA, 20 bp, Artificial Sequence
  chemically synthesized
caatttaaatgtaaattttg

SEQ ID NO: 502329 - DNA, 20 bp, Artificial Sequence
  chemically synthesized
attaacttttagcttgtact

SEQ ID NO: 502330 - DNA, 20 bp, Artificial Sequence
  chemically synthesized
attttttacttatgtggttc

SEQ ID NO: 502331 - DNA, 20 bp, Artificial Sequence
  chemically synthesized
aaagtaacttgtacaaataa

SEQ ID NO: 502332 - DNA, 20 bp, Artificial Sequence
  chemically synthesized
tgattacattgtcttttttt

SEQ ID NO: 502333 - DNA, 20 bp, Artificial Sequence
  chemically synthesized
attttcttttttgacattat

SEQ ID NO: 502334 - DNA, 20 bp, Artificial Sequence
  chemically synthesized
aaattgtggaagaaaacatt

SEQ ID NO: 502335 - DNA, 20 bp, Artificial Sequence
  chemically synthesized
agagatcattttccttcaga

SEQ ID NO: 502336 - DNA, 20 bp, Artificial Sequence
  chemically synthesized
taagttgtcctaaagatgtg

SEQ ID NO: 502337 - DNA, 20 bp, Artificial Sequence
  chemically synthesized
agatgtgagggatgtataat

SEQ ID NO: 502338 - DNA, 20 bp, Artificial Sequence
  chemically synthesized
cacctaatatatacatctag

SEQ ID NO: 502339 - DNA, 20 bp, Artificial Sequence
  chemically synthesized
atatatacatctagggggat

SEQ ID NO: 502340 - DNA, 20 bp, Artificial Sequence
  chemically synthesized
agccaggctgataatttcac

SEQ ID NO: 502341 - DNA, 20 bp, Artificial Sequence
  chemically synthesized
tcctctcactttgtttccat

SEQ ID NO: 502342 - DNA, 20 bp, Artificial Sequence
  chemically synthesized
gtgagaggacatagcaaatc

SEQ ID NO: 502343 - DNA, 20 bp, Artificial Sequence
  chemically synthesized
gaacacctcatagagcatat

SEQ ID NO: 502344 - DNA, 20 bp, Artificial Sequence
  chemically synthesized
gttctcaatccagtaccttt

SEQ ID NO: 502345 - DNA, 20 bp, Artificial Sequence
  chemically synthesized
tctagtgattctgaaaggta

SEQ ID NO: 502346 - DNA, 20 bp, Artificial Sequence
  chemically synthesized
ctcaaatgccttttttataa

SEQ ID NO: 502347 - DNA, 20 bp, Artificial Sequence
  chemically synthesized
acttgttttattttcctact

SEQ ID NO: 502348 - DNA, 20 bp, Artificial Sequence
  chemically synthesized
ggaaaataaaacaagtgaaa

SEQ ID NO: 502349 - DNA, 20 bp, Artificial Sequence
  chemically synthesized
tcgaattaaccatttttcca

SEQ ID NO: 502350 - DNA, 20 bp, Artificial Sequence
  chemically synthesized
atttaaaatgtgattaatgt

SEQ ID NO: 502351 - DNA, 20 bp, Artificial Sequence
  chemically synthesized
ttttctgttactatatatat

SEQ ID NO: 502352 - DNA, 20 bp, Artificial Sequence
  chemically synthesized
cagcaggctaaagtacttaa

SEQ ID NO: 502353 - DNA, 20 bp, Artificial Sequence
  chemically synthesized
aaatgatatcaaataattat

SEQ ID NO: 502354 - DNA, 20 bp, Artificial Sequence
  chemically synthesized
acaaaatatatcaaaagatt

SEQ ID NO: 502355 - DNA, 20 bp, Artificial Sequence
  chemically synthesized
atttcttctttttttacttg

SEQ ID NO: 502356 - DNA, 20 bp, Artificial Sequence
  chemically synthesized
aaagagtagtacaaagctgt

SEQ ID NO: 502357 - DNA, 20 bp, Artificial Sequence
  chemically synthesized
tgggggggggggtttaaaaa

SEQ ID NO: 502358 - DNA, 20 bp, Artificial Sequence
  chemically synthesized
aagtaactctacttgggggg

SEQ ID NO: 502359 - DNA, 20 bp, Artificial Sequence
  chemically synthesized
tttaaacccccccccccaag

SEQ ID NO: 502360 - DNA, 20 bp, Artificial Sequence
  chemically synthesized
cctacattgttccttgacat

SEQ ID NO: 502361 - DNA, 20 bp, Artificial Sequence
  chemically synthesized
atttttgaaaatacaaaaaa

SEQ ID NO: 502362 - DNA, 20 bp, Artificial Sequence
  chemically synthesized
aataacgacaacgataatag

SEQ ID NO: 502363 - DNA, 20 bp, Artificial Sequence
  chemically synthesized
ttgttttttctatttctgtg

SEQ ID NO: 502364 - DNA, 20 bp, Artificial Sequence
  chemically synthesized
atatggaactgcagcagacc

SEQ ID NO: 502365 - DNA, 20 bp, Artificial Sequence
  chemically synthesized
ttaggatatatttggctatt

SEQ ID NO: 502366 - DNA, 20 bp, Artificial Sequence
  chemically synthesized
caaatatatcctaagcaaaa

SEQ ID NO: 502367 - DNA, 20 bp, Artificial Sequence
  chemically synthesized
cagtttcattcttttttgct

SEQ ID NO: 502368 - DNA, 20 bp, Artificial Sequence
  chemically synthesized
gcaaaaaagaatgaaactgg

SEQ ID NO: 502369 - DNA, 20 bp, Artificial Sequence
  chemically synthesized
aaacacacagcccaatagaa

SEQ ID NO: 502370 - DNA, 20 bp, Artificial Sequence
  chemically synthesized
aattaggtccctgtagatgt

SEQ ID NO: 502371 - DNA, 20 bp, Artificial Sequence
  chemically synthesized
caagaacacactttggggaa

SEQ ID NO: 502372 - DNA, 20 bp, Artificial Sequence
  chemically synthesized
aataaatggtgctgggaaaa

SEQ ID NO: 502373 - DNA, 20 bp, Artificial Sequence
  chemically synthesized
gaaaattggatatccaaatg

SEQ ID NO: 502374 - DNA, 20 bp, Artificial Sequence
  chemically synthesized
ggtctggttttattctgcat

SEQ ID NO: 502375 - DNA, 20 bp, Artificial Sequence
  chemically synthesized
tatacagaaatcaaatcaaa

SEQ ID NO: 502376 - DNA, 20 bp, Artificial Sequence
  chemically synthesized
gtgcttgtgtggtatggttc

SEQ ID NO: 502377 - DNA, 20 bp, Artificial Sequence
  chemically synthesized
atgggttgtctcttcacttt

SEQ ID NO: 502378 - DNA, 20 bp, Artificial Sequence
  chemically synthesized
caaagtgaagagacaaccca

SEQ ID NO: 502379 - DNA, 20 bp, Artificial Sequence
  chemically synthesized
gaaatattttctcccattcc

SEQ ID NO: 502380 - DNA, 20 bp, Artificial Sequence
  chemically synthesized
tccaaactacccatctgaca

SEQ ID NO: 502381 - DNA, 20 bp, Artificial Sequence
  chemically synthesized
agttattgatcccttgtcag

SEQ ID NO: 502382 - DNA, 20 bp, Artificial Sequence
  chemically synthesized
tctgacaagggatcaataac

SEQ ID NO: 502383 - DNA, 20 bp, Artificial Sequence
  chemically synthesized
agattattagttttttccta

SEQ ID NO: 502384 - DNA, 20 bp, Artificial Sequence
  chemically synthesized
attaaaaatgggcaaaatat

SEQ ID NO: 502385 - DNA, 20 bp, Artificial Sequence
  chemically synthesized
tgaaagaagataaatgacaa

SEQ ID NO: 502386 - DNA, 20 bp, Artificial Sequence
  chemically synthesized
atgacaaacgggtatatgaa

SEQ ID NO: 502387 - DNA, 20 bp, Artificial Sequence
  chemically synthesized
ctcaatatcactgatcataa

SEQ ID NO: 502388 - DNA, 20 bp, Artificial Sequence
  chemically synthesized
tgttttataaataaaaccat

SEQ ID NO: 502389 - DNA, 20 bp, Artificial Sequence
  chemically synthesized
aagcaataacaaatgttggc

SEQ ID NO: 502390 - DNA, 20 bp, Artificial Sequence
  chemically synthesized
cattcctaccagcagtgtat

SEQ ID NO: 502391 - DNA, 20 bp, Artificial Sequence
  chemically synthesized
aaccctcatacactgctggt

SEQ ID NO: 502392 - DNA, 20 bp, Artificial Sequence
  chemically synthesized
gctctgtttacagttttttg

SEQ ID NO: 502393 - DNA, 20 bp, Artificial Sequence
  chemically synthesized
tatacacagcagtgggattg

SEQ ID NO: 502394 - DNA, 20 bp, Artificial Sequence
  chemically synthesized
tttgggtatatacacagcag

SEQ ID NO: 502395 - DNA, 20 bp, Artificial Sequence
  chemically synthesized
gtgtactgattttctttctt

SEQ ID NO: 502396 - DNA, 20 bp, Artificial Sequence
  chemically synthesized
acagtgccgcaataaaacac

SEQ ID NO: 502397 - DNA, 20 bp, Artificial Sequence
  chemically synthesized
acctaaatgtccattaaaaa

SEQ ID NO: 502398 - DNA, 20 bp, Artificial Sequence
  chemically synthesized
aaatgtccattaaaaaacga

SEQ ID NO: 502399 - DNA, 20 bp, Artificial Sequence
  chemically synthesized
ttaggcaggagaaggaaata

SEQ ID NO: 502400 - DNA, 20 bp, Artificial Sequence
  chemically synthesized
ccagaacttccaacactatg

SEQ ID NO: 502401 - DNA, 20 bp, Artificial Sequence
  chemically synthesized
cttccaacactatgttgaat

SEQ ID NO: 502402 - DNA, 20 bp, Artificial Sequence
  chemically synthesized
tttgaaaactggcacaagac

SEQ ID NO: 502403 - DNA, 20 bp, Artificial Sequence
  chemically synthesized
gtcttgtgccagttttcaaa

SEQ ID NO: 502404 - DNA, 20 bp, Artificial Sequence
  chemically synthesized
aacccacagccaatatcata

SEQ ID NO: 502405 - DNA, 20 bp, Artificial Sequence
  chemically synthesized
cattcagtatgatattggct

SEQ ID NO: 502406 - DNA, 20 bp, Artificial Sequence
  chemically synthesized
ccatcaatacctaatttatt

SEQ ID NO: 502407 - DNA, 20 bp, Artificial Sequence
  chemically synthesized
atttttagcatgaagcgttg

SEQ ID NO: 502408 - DNA, 20 bp, Artificial Sequence
  chemically synthesized
tctttggctctgtttagatg

SEQ ID NO: 502409 - DNA, 20 bp, Artificial Sequence
  chemically synthesized
ttgaaccagccttgcatccc

SEQ ID NO: 502410 - DNA, 20 bp, Artificial Sequence
  chemically synthesized
gatcaagtgggcttcatcct

SEQ ID NO: 502411 - DNA, 20 bp, Artificial Sequence
  chemically synthesized
atgaagcccacttgatcatg

SEQ ID NO: 502412 - DNA, 20 bp, Artificial Sequence
  chemically synthesized
ataagctttttgatgtgctg

SEQ ID NO: 502413 - DNA, 20 bp, Artificial Sequence
  chemically synthesized
ctcaataaaatacttgcaaa

SEQ ID NO: 502414 - DNA, 20 bp, Artificial Sequence
  chemically synthesized
cgttttgcaagtattttatt

SEQ ID NO: 502415 - DNA, 20 bp, Artificial Sequence
  chemically synthesized
ttttttcatcaatgttcatc

SEQ ID NO: 502416 - DNA, 20 bp, Artificial Sequence
  chemically synthesized
gcagagacacaaccaaaaaa

SEQ ID NO: 502417 - DNA, 20 bp, Artificial Sequence
  chemically synthesized
tctctgcccggctttggtat

SEQ ID NO: 502418 - DNA, 20 bp, Artificial Sequence
  chemically synthesized
aatgatgctggcctcataaa

SEQ ID NO: 502419 - DNA, 20 bp, Artificial Sequence
  chemically synthesized
gcctcataaaatgagttagg

SEQ ID NO: 502420 - DNA, 20 bp, Artificial Sequence
  chemically synthesized
ttccaatccatagaaaaaga

SEQ ID NO: 502421 - DNA, 20 bp, Artificial Sequence
  chemically synthesized
ggaggattccctctttttct

SEQ ID NO: 502422 - DNA, 20 bp, Artificial Sequence
  chemically synthesized
ttccctctttttctatggat

SEQ ID NO: 502423 - DNA, 20 bp, Artificial Sequence
  chemically synthesized
tggattggaatagtttcaga

SEQ ID NO: 502424 - DNA, 20 bp, Artificial Sequence
  chemically synthesized
agataccatctcacaccagt

SEQ ID NO: 502425 - DNA, 20 bp, Artificial Sequence
  chemically synthesized
cacctgttgtttcctgactt

SEQ ID NO: 502426 - DNA, 20 bp, Artificial Sequence
  chemically synthesized
aggaaacaacaggtgctgga

SEQ ID NO: 502427 - DNA, 20 bp, Artificial Sequence
  chemically synthesized
agtcagtgtggcgattcctc

SEQ ID NO: 502428 - DNA, 20 bp, Artificial Sequence
  chemically synthesized
tttctagttctagatccctg

SEQ ID NO: 502429 - DNA, 20 bp, Artificial Sequence
  chemically synthesized
tatacccagtaatgggatgg

SEQ ID NO: 502430 - DNA, 20 bp, Artificial Sequence
  chemically synthesized
ttgacccagccatcccatta

SEQ ID NO: 502431 - DNA, 20 bp, Artificial Sequence
  chemically synthesized
tttgggtatatacccagtaa

SEQ ID NO: 502432 - DNA, 20 bp, Artificial Sequence
  chemically synthesized
gcagcatgatttatagtcct

SEQ ID NO: 502433 - DNA, 20 bp, Artificial Sequence
  chemically synthesized
ggttccaagtctttgctatt

SEQ ID NO: 502434 - DNA, 20 bp, Artificial Sequence
  chemically synthesized
attgtatcattgtgagacat

SEQ ID NO: 502435 - DNA, 20 bp, Artificial Sequence
  chemically synthesized
aaatgtctcacaatgataca

SEQ ID NO: 502436 - DNA, 20 bp, Artificial Sequence
  chemically synthesized
aatgtggcacatatacacct

SEQ ID NO: 502437 - DNA, 20 bp, Artificial Sequence
  chemically synthesized
aatactatgcagccataaaa

SEQ ID NO: 502438 - DNA, 20 bp, Artificial Sequence
  chemically synthesized
ctatgcagccataaaaaagg

SEQ ID NO: 502439 - DNA, 20 bp, Artificial Sequence
  chemically synthesized
ttcatgtcctttgtagggac

SEQ ID NO: 502440 - DNA, 20 bp, Artificial Sequence
  chemically synthesized
tgtccttgagatagtttgct

SEQ ID NO: 502441 - DNA, 20 bp, Artificial Sequence
  chemically synthesized
gcatgttctcactcataggt

SEQ ID NO: 502442 - DNA, 20 bp, Artificial Sequence
  chemically synthesized
tcattgttcaattcccacct

SEQ ID NO: 502443 - DNA, 20 bp, Artificial Sequence
  chemically synthesized
tcacacaccggggactgttg

SEQ ID NO: 502444 - DNA, 20 bp, Artificial Sequence
  chemically synthesized
gtggggtggggggagggggg

SEQ ID NO: 502445 - DNA, 20 bp, Artificial Sequence
  chemically synthesized
gatatacctaatgctagatg

SEQ ID NO: 502446 - DNA, 20 bp, Artificial Sequence
  chemically synthesized
taatgctagatgacgagtta

SEQ ID NO: 502447 - DNA, 20 bp, Artificial Sequence
  chemically synthesized
tattattatactttaagttt

SEQ ID NO: 502448 - DNA, 20 bp, Artificial Sequence
  chemically synthesized
cagtactattcagccataaa

SEQ ID NO: 502449 - DNA, 20 bp, Artificial Sequence
  chemically synthesized
ggacgtcattctttttatgg

SEQ ID NO: 502450 - DNA, 20 bp, Artificial Sequence
  chemically synthesized
gtcctgtcatttgcaataac

SEQ ID NO: 502451 - DNA, 20 bp, Artificial Sequence
  chemically synthesized
gtcatttgcaataacatgga

SEQ ID NO: 502452 - DNA, 20 bp, Artificial Sequence
  chemically synthesized
cccacaaataactgagaaca

SEQ ID NO: 502453 - DNA, 20 bp, Artificial Sequence
  chemically synthesized
ataattgaactatggagata

SEQ ID NO: 502454 - DNA, 20 bp, Artificial Sequence
  chemically synthesized
actatggagatagagagtag

SEQ ID NO: 502455 - DNA, 20 bp, Artificial Sequence
  chemically synthesized
tacccttcccagcctctagt

SEQ ID NO: 502456 - DNA, 20 bp, Artificial Sequence
  chemically synthesized
gatccttactagaggctggg

SEQ ID NO: 502457 - DNA, 20 bp, Artificial Sequence
  chemically synthesized
agaggctgggaagggtagtc

SEQ ID NO: 502458 - DNA, 20 bp, Artificial Sequence
  chemically synthesized
tcaggggttggggaggaagt

SEQ ID NO: 502459 - DNA, 20 bp, Artificial Sequence
  chemically synthesized
ggaggaagtggggatggtta

SEQ ID NO: 502460 - DNA, 20 bp, Artificial Sequence
  chemically synthesized
agacctagtatttgctagaa

SEQ ID NO: 502461 - DNA, 20 bp, Artificial Sequence
  chemically synthesized
gaccataataaaaaagtaat

SEQ ID NO: 502462 - DNA, 20 bp, Artificial Sequence
  chemically synthesized
tacattttaaaataaactaa

SEQ ID NO: 502463 - DNA, 20 bp, Artificial Sequence
  chemically synthesized
aataaactaaaagagtacaa

SEQ ID NO: 502464 - DNA, 20 bp, Artificial Sequence
  chemically synthesized
actgaattttttatatcaca

SEQ ID NO: 502465 - DNA, 20 bp, Artificial Sequence
  chemically synthesized
agcaatcaaatcagggtaaa

SEQ ID NO: 502466 - DNA, 20 bp, Artificial Sequence
  chemically synthesized
gcaatgcgtagcaatcaaat

SEQ ID NO: 502467 - DNA, 20 bp, Artificial Sequence
  chemically synthesized
ttacttttcaaaatagataa

SEQ ID NO: 502468 - DNA, 20 bp, Artificial Sequence
  chemically synthesized
cagcattccaaaatgttccc

SEQ ID NO: 502469 - DNA, 20 bp, Artificial Sequence
  chemically synthesized
tcaaactctagggaacattt

SEQ ID NO: 502470 - DNA, 20 bp, Artificial Sequence
  chemically synthesized
ttaaagtggagaaagcagat

SEQ ID NO: 502471 - DNA, 20 bp, Artificial Sequence
  chemically synthesized
tagcattaaaattcattaaa

SEQ ID NO: 502472 - DNA, 20 bp, Artificial Sequence
  chemically synthesized
tttacattctattccattta

SEQ ID NO: 502473 - DNA, 20 bp, Artificial Sequence
  chemically synthesized
ttaaaattcattaaatggaa

SEQ ID NO: 502474 - DNA, 20 bp, Artificial Sequence
  chemically synthesized
atgaatgttgttaaataacc

SEQ ID NO: 502475 - DNA, 20 bp, Artificial Sequence
  chemically synthesized
atagcaaagggtgaaatgtg

SEQ ID NO: 502476 - DNA, 20 bp, Artificial Sequence
  chemically synthesized
cattattttgatgcatagca

SEQ ID NO: 502477 - DNA, 20 bp, Artificial Sequence
  chemically synthesized
tttgctatgcatcaaaataa

SEQ ID NO: 502478 - DNA, 20 bp, Artificial Sequence
  chemically synthesized
ttgatatattctctattcaa

SEQ ID NO: 502479 - DNA, 20 bp, Artificial Sequence
  chemically synthesized
ttttaaaaccctattgaata

SEQ ID NO: 502480 - DNA, 20 bp, Artificial Sequence
  chemically synthesized
aagttgtttttaaaacccta

SEQ ID NO: 502481 - DNA, 20 bp, Artificial Sequence
  chemically synthesized
aatgaacaataggaaattta

SEQ ID NO: 502482 - DNA, 20 bp, Artificial Sequence
  chemically synthesized
taataaaaaatgtcctaaag

SEQ ID NO: 502483 - DNA, 20 bp, Artificial Sequence
  chemically synthesized
gaaaatggacacacaggttt

SEQ ID NO: 502484 - DNA, 20 bp, Artificial Sequence
  chemically synthesized
gcatgggttgagaacaggat

SEQ ID NO: 502485 - DNA, 20 bp, Artificial Sequence
  chemically synthesized
gttgaggcatgggttgagaa

SEQ ID NO: 502486 - DNA, 20 bp, Artificial Sequence
  chemically synthesized
actagatgaatggttgaggc

SEQ ID NO: 502487 - DNA, 20 bp, Artificial Sequence
  chemically synthesized
ggaatatttgaaaacactag

SEQ ID NO: 502488 - DNA, 20 bp, Artificial Sequence
  chemically synthesized
tataaaagttgtgtttaaaa

SEQ ID NO: 502489 - DNA, 20 bp, Artificial Sequence
  chemically synthesized
tgctgtaattaccaaataac

SEQ ID NO: 502490 - DNA, 20 bp, Artificial Sequence
  chemically synthesized
gtttttaaggattataccat

SEQ ID NO: 502491 - DNA, 20 bp, Artificial Sequence
  chemically synthesized
ttatgtattacctagttttt

SEQ ID NO: 502492 - DNA, 20 bp, Artificial Sequence
  chemically synthesized
cagtctttccttttcatgtg

SEQ ID NO: 502493 - DNA, 20 bp, Artificial Sequence
  chemically synthesized
gaaaacctttccaaaatact

SEQ ID NO: 502494 - DNA, 20 bp, Artificial Sequence
  chemically synthesized
tctttctttggtgctatcta

SEQ ID NO: 502495 - DNA, 20 bp, Artificial Sequence
  chemically synthesized
ggcagtgtaaaatttaaaat

SEQ ID NO: 502496 - DNA, 20 bp, Artificial Sequence
  chemically synthesized
acttagtgactaaacctcag

SEQ ID NO: 502497 - DNA, 20 bp, Artificial Sequence
  chemically synthesized
acaaatagctggcaaattta

SEQ ID NO: 502498 - DNA, 20 bp, Artificial Sequence
  chemically synthesized
agctatttgttagaaatctg

SEQ ID NO: 502499 - DNA, 20 bp, Artificial Sequence
  chemically synthesized
cagctgaactttagtggtta

SEQ ID NO: 502500 - DNA, 20 bp, Artificial Sequence
  chemically synthesized
aactttagtggttagagaat

SEQ ID NO: 502501 - DNA, 20 bp, Artificial Sequence
  chemically synthesized
cccaattttgtcttatgcaa

SEQ ID NO: 502502 - DNA, 20 bp, Artificial Sequence
  chemically synthesized
aagacaaaattgggaaataa

SEQ ID NO: 502503 - DNA, 20 bp, Artificial Sequence
  chemically synthesized
tgggaaataataggataaat

SEQ ID NO: 502504 - DNA, 20 bp, Artificial Sequence
  chemically synthesized
ttggatcacttcaaaatatt

SEQ ID NO: 502505 - DNA, 20 bp, Artificial Sequence
  chemically synthesized
gtgaacactattgcaacact

SEQ ID NO: 502506 - DNA, 20 bp, Artificial Sequence
  chemically synthesized
aataatttcatccttatatg

SEQ ID NO: 502507 - DNA, 20 bp, Artificial Sequence
  chemically synthesized
tatctacaaattctacatat

SEQ ID NO: 502508 - DNA, 20 bp, Artificial Sequence
  chemically synthesized
taacaagttattcttaaatg

SEQ ID NO: 502509 - DNA, 20 bp, Artificial Sequence
  chemically synthesized
gaacttattactctccattt

SEQ ID NO: 502510 - DNA, 20 bp, Artificial Sequence
  chemically synthesized
agttctgtatagcaacacat

SEQ ID NO: 502511 - DNA, 20 bp, Artificial Sequence
  chemically synthesized
taaacctagtgcatttaatt

SEQ ID NO: 502512 - DNA, 20 bp, Artificial Sequence
  chemically synthesized
taatatttgaacccaaatct

SEQ ID NO: 502513 - DNA, 20 bp, Artificial Sequence
  chemically synthesized
tggagaactaacccagagat

SEQ ID NO: 502514 - DNA, 20 bp, Artificial Sequence
  chemically synthesized
aaggggaatttatgtggtaa

SEQ ID NO: 502515 - DNA, 20 bp, Artificial Sequence
  chemically synthesized
gacagcagaaacctgcaaag

SEQ ID NO: 502516 - DNA, 20 bp, Artificial Sequence
  chemically synthesized
acagtctgctttattgattt

SEQ ID NO: 502517 - DNA, 20 bp, Artificial Sequence
  chemically synthesized
aatatgcctatttacactat

SEQ ID NO: 502518 - DNA, 20 bp, Artificial Sequence
  chemically synthesized
ttgagcttttgatttcatta

SEQ ID NO: 502519 - DNA, 20 bp, Artificial Sequence
  chemically synthesized
agccattgattttgatagct

SEQ ID NO: 502520 - DNA, 20 bp, Artificial Sequence
  chemically synthesized
gatgaccgattatatttaat

SEQ ID NO: 502521 - DNA, 20 bp, Artificial Sequence
  chemically synthesized
aacacgggaagattgcaatt

SEQ ID NO: 502522 - DNA, 20 bp, Artificial Sequence
  chemically synthesized
tacgttaaatgcactttaag

SEQ ID NO: 502523 - DNA, 20 bp, Artificial Sequence
  chemically synthesized
tgagtacaatttagaaaaga

SEQ ID NO: 502524 - DNA, 20 bp, Artificial Sequence
  chemically synthesized
ttttccctcccattaacaat

SEQ ID NO: 502525 - DNA, 20 bp, Artificial Sequence
  chemically synthesized
agctaggacgtcaggtgttc

SEQ ID NO: 502526 - DNA, 20 bp, Artificial Sequence
  chemically synthesized
gaaacaaattaccttcaaag

SEQ ID NO: 502527 - DNA, 20 bp, Artificial Sequence
  chemically synthesized
cacatagtagatttatgagc

SEQ ID NO: 502528 - DNA, 20 bp, Artificial Sequence
  chemically synthesized
aggttacaaaaaaatgagat

SEQ ID NO: 502529 - DNA, 20 bp, Artificial Sequence
  chemically synthesized
gttctatttgttttttccca

SEQ ID NO: 502530 - DNA, 20 bp, Artificial Sequence
  chemically synthesized
taaattactgcaagcaagag

SEQ ID NO: 502531 - DNA, 20 bp, Artificial Sequence
  chemically synthesized
actttcaacaggtgcccatg

SEQ ID NO: 502532 - DNA, 20 bp, Artificial Sequence
  chemically synthesized
cttttctactaattttagtt

SEQ ID NO: 502533 - DNA, 20 bp, Artificial Sequence
  chemically synthesized
ttaattgacatgttaacaaa

SEQ ID NO: 502534 - DNA, 20 bp, Artificial Sequence
  chemically synthesized
acaaatggggttagaaaaaa

SEQ ID NO: 502535 - DNA, 20 bp, Artificial Sequence
  chemically synthesized
atgaattgaagaaagccaag

SEQ ID NO: 502536 - DNA, 20 bp, Artificial Sequence
  chemically synthesized
caaattttaatttagacaaa

SEQ ID NO: 502537 - DNA, 20 bp, Artificial Sequence
  chemically synthesized
attttttcctctaatggaaa

SEQ ID NO: 502538 - DNA, 20 bp, Artificial Sequence
  chemically synthesized
aggaaaaaatcaaaatagga

SEQ ID NO: 502539 - DNA, 20 bp, Artificial Sequence
  chemically synthesized
acgtttcaatgggagggagt

SEQ ID NO: 502540 - DNA, 20 bp, Artificial Sequence
  chemically synthesized
gtgtcaacgtttcaatggga

SEQ ID NO: 502541 - DNA, 20 bp, Artificial Sequence
  chemically synthesized
acgttgacacagtcatagaa

SEQ ID NO: 502542 - DNA, 20 bp, Artificial Sequence
  chemically synthesized
atagaagagaatctttatag

SEQ ID NO: 502543 - DNA, 20 bp, Artificial Sequence
  chemically synthesized
tagtaatgactaaattgttc

SEQ ID NO: 502544 - DNA, 20 bp, Artificial Sequence
  chemically synthesized
tagctaattggagaatggct

SEQ ID NO: 502545 - DNA, 20 bp, Artificial Sequence
  chemically synthesized
ttctaatgtgtagctaattg

SEQ ID NO: 502546 - DNA, 20 bp, Artificial Sequence
  chemically synthesized
ttctccaattagctacacat

SEQ ID NO: 502547 - DNA, 20 bp, Artificial Sequence
  chemically synthesized
ccaattagctacacattaga

SEQ ID NO: 502548 - DNA, 20 bp, Artificial Sequence
  chemically synthesized
ctttaggtggatttggtctt

SEQ ID NO: 502549 - DNA, 20 bp, Artificial Sequence
  chemically synthesized
caatcaaatcaaatctttag

SEQ ID NO: 502550 - DNA, 20 bp, Artificial Sequence
  chemically synthesized
ggttacttagactgttgcta

SEQ ID NO: 502551 - DNA, 20 bp, Artificial Sequence
  chemically synthesized
cagaactatatattgaagca

SEQ ID NO: 502552 - DNA, 20 bp, Artificial Sequence
  chemically synthesized
atatcttagaaaacagaaac

SEQ ID NO: 502553 - DNA, 20 bp, Artificial Sequence
  chemically synthesized
agatatatttccatatctag

SEQ ID NO: 502554 - DNA, 20 bp, Artificial Sequence
  chemically synthesized
taagaaaagatttattgaaa

SEQ ID NO: 502555 - DNA, 20 bp, Artificial Sequence
  chemically synthesized
tctcattaaatgagctgaca

SEQ ID NO: 502556 - DNA, 20 bp, Artificial Sequence
  chemically synthesized
ctaagccaaaagaataaagc

SEQ ID NO: 502557 - DNA, 20 bp, Artificial Sequence
  chemically synthesized
ccagctttattcttttggct

SEQ ID NO: 502558 - DNA, 20 bp, Artificial Sequence
  chemically synthesized
ccaagtcaatcctaagccaa

SEQ ID NO: 502559 - DNA, 20 bp, Artificial Sequence
  chemically synthesized
gctaccaatgcctttcttca

SEQ ID NO: 502560 - DNA, 20 bp, Artificial Sequence
  chemically synthesized
aaaggcattggtagcttgat

SEQ ID NO: 502561 - DNA, 20 bp, Artificial Sequence
  chemically synthesized
gtagcttgatggggatggca

SEQ ID NO: 502562 - DNA, 20 bp, Artificial Sequence
  chemically synthesized
acacttcctacccatgagca

SEQ ID NO: 502563 - DNA, 20 bp, Artificial Sequence
  chemically synthesized
tggaagaacattccatgctc

SEQ ID NO: 502564 - DNA, 20 bp, Artificial Sequence
  chemically synthesized
cactgctcaatgaaataaaa

SEQ ID NO: 502565 - DNA, 20 bp, Artificial Sequence
  chemically synthesized
tccttcacatcccttgtaag

SEQ ID NO: 502566 - DNA, 20 bp, Artificial Sequence
  chemically synthesized
acctaggaatccaacttaca

SEQ ID NO: 502567 - DNA, 20 bp, Artificial Sequence
  chemically synthesized
tcaaagagaataaaatacct

SEQ ID NO: 502568 - DNA, 20 bp, Artificial Sequence
  chemically synthesized
ccattcgcaattgcttcaaa

SEQ ID NO: 502569 - DNA, 20 bp, Artificial Sequence
  chemically synthesized
ttattctctttgaagcaatt

SEQ ID NO: 502570 - DNA, 20 bp, Artificial Sequence
  chemically synthesized
tctttgaagcaattgcgaat

SEQ ID NO: 502571 - DNA, 20 bp, Artificial Sequence
  chemically synthesized
gacaaacagagagccaaatc

SEQ ID NO: 502572 - DNA, 20 bp, Artificial Sequence
  chemically synthesized
tttgtctgttattggtgtat

SEQ ID NO: 502573 - DNA, 20 bp, Artificial Sequence
  chemically synthesized
gagattttgggctgagacaa

SEQ ID NO: 502574 - DNA, 20 bp, Artificial Sequence
  chemically synthesized
ttgacttcctcttttcctga

SEQ ID NO: 502575 - DNA, 20 bp, Artificial Sequence
  chemically synthesized
ttaggcaggagaaggaaata

SEQ ID NO: 502576 - DNA, 20 bp, Artificial Sequence
  chemically synthesized
ccagaacttccaacagtatg

SEQ ID NO: 502577 - DNA, 20 bp, Artificial Sequence
  chemically synthesized
tttgaaaactggcacaagac

SEQ ID NO: 502578 - DNA, 20 bp, Artificial Sequence
  chemically synthesized
gtcttgtgccagttttcaaa

SEQ ID NO: 502579 - DNA, 20 bp, Artificial Sequence
  chemically synthesized
aacccacagccaatatcata

SEQ ID NO: 502580 - DNA, 20 bp, Artificial Sequence
  chemically synthesized
cattcagtatgatattggct

SEQ ID NO: 502581 - DNA, 20 bp, Artificial Sequence
  chemically synthesized
ccatcaatacctaatttatt

SEQ ID NO: 502582 - DNA, 20 bp, Artificial Sequence
  chemically synthesized
tattgagaatttttagcatg

SEQ ID NO: 502583 - DNA, 20 bp, Artificial Sequence
  chemically synthesized
atttttagcatgaggggtag

SEQ ID NO: 502584 - DNA, 20 bp, Artificial Sequence
  chemically synthesized
aatattgtcaaaggcctttt

SEQ ID NO: 502585 - DNA, 20 bp, Artificial Sequence
  chemically synthesized
tgattggttctgtttatatg

SEQ ID NO: 502586 - DNA, 20 bp, Artificial Sequence
  chemically synthesized
ttgaaccagccttgcatccc

SEQ ID NO: 502587 - DNA, 20 bp, Artificial Sequence
  chemically synthesized
gaccaagtgggcttcatccc

SEQ ID NO: 502588 - DNA, 20 bp, Artificial Sequence
  chemically synthesized
ataagctttttgatgtgctg

SEQ ID NO: 502589 - DNA, 20 bp, Artificial Sequence
  chemically synthesized
ctcaataaaatactggcaaa

SEQ ID NO: 502590 - DNA, 20 bp, Artificial Sequence
  chemically synthesized
cggtttgccagtattttatt

SEQ ID NO: 502591 - DNA, 20 bp, Artificial Sequence
  chemically synthesized
tttttgcatcgatgttcatc

SEQ ID NO: 502592 - DNA, 20 bp, Artificial Sequence
  chemically synthesized
ccttgtaatatacagaaaaa

SEQ ID NO: 502593 - DNA, 20 bp, Artificial Sequence
  chemically synthesized
ccagcaccatttattaaata

SEQ ID NO: 502594 - DNA, 20 bp, Artificial Sequence
  chemically synthesized
ccatatgtagaaagctgaaa

SEQ ID NO: 502595 - DNA, 20 bp, Artificial Sequence
  chemically synthesized
ttttgtataaggtgtaagga

SEQ ID NO: 502596 - DNA, 20 bp, Artificial Sequence
  chemically synthesized
tatacaaaaattaactcaag

SEQ ID NO: 502597 - DNA, 20 bp, Artificial Sequence
  chemically synthesized
atgtaagtctttaatccatc

SEQ ID NO: 502598 - DNA, 20 bp, Artificial Sequence
  chemically synthesized
gtaatgcctaggttttcttc

SEQ ID NO: 502599 - DNA, 20 bp, Artificial Sequence
  chemically synthesized
tccttgcccgtgcctatgtc

SEQ ID NO: 502600 - DNA, 20 bp, Artificial Sequence
  chemically synthesized
caaaagccaaaattgacaaa

SEQ ID NO: 502601 - DNA, 20 bp, Artificial Sequence
  chemically synthesized
acagcaaaagaaactaccat

SEQ ID NO: 502602 - DNA, 20 bp, Artificial Sequence
  chemically synthesized
cagagtgaacaggcaaccta

SEQ ID NO: 502603 - DNA, 20 bp, Artificial Sequence
  chemically synthesized
ggatattagccctttgtcag

SEQ ID NO: 502604 - DNA, 20 bp, Artificial Sequence
  chemically synthesized
tctgacaaagggctaatatc

SEQ ID NO: 502605 - DNA, 20 bp, Artificial Sequence
  chemically synthesized
gtttgagttcattgtagatt

SEQ ID NO: 502606 - DNA, 20 bp, Artificial Sequence
  chemically synthesized
cttttttcttgtacatttgt

SEQ ID NO: 502607 - DNA, 20 bp, Artificial Sequence
  chemically synthesized
gcaaacaaccccatcaacaa

SEQ ID NO: 502608 - DNA, 20 bp, Artificial Sequence
  chemically synthesized
atccttcacccacttgttga

SEQ ID NO: 502609 - DNA, 20 bp, Artificial Sequence
  chemically synthesized
accccatcaacaagtgggtg

SEQ ID NO: 502610 - DNA, 20 bp, Artificial Sequence
  chemically synthesized
agataccatctcacaccagt

SEQ ID NO: 502611 - DNA, 20 bp, Artificial Sequence
  chemically synthesized
aggaaacaacaggtgctgga

SEQ ID NO: 502612 - DNA, 20 bp, Artificial Sequence
  chemically synthesized
agtcactgtggcgattcctc

SEQ ID NO: 502613 - DNA, 20 bp, Artificial Sequence
  chemically synthesized
tttctagttctagatccctg

SEQ ID NO: 502614 - DNA, 20 bp, Artificial Sequence
  chemically synthesized
tatacccagtaacgggatgg

SEQ ID NO: 502615 - DNA, 20 bp, Artificial Sequence
  chemically synthesized
ttgacccagccatcccgtta

SEQ ID NO: 502616 - DNA, 20 bp, Artificial Sequence
  chemically synthesized
tttgggtatatacccagtaa

SEQ ID NO: 502617 - DNA, 20 bp, Artificial Sequence
  chemically synthesized
cgttactgggtatataccca

SEQ ID NO: 502618 - DNA, 20 bp, Artificial Sequence
  chemically synthesized
gcagcatgatttataatcct

SEQ ID NO: 502619 - DNA, 20 bp, Artificial Sequence
  chemically synthesized
ggttccaagtctttgctatt

SEQ ID NO: 502620 - DNA, 20 bp, Artificial Sequence
  chemically synthesized
attgtatcattgtgagacat

SEQ ID NO: 502621 - DNA, 20 bp, Artificial Sequence
  chemically synthesized
aaatgtctcacaatgataca

SEQ ID NO: 502622 - DNA, 20 bp, Artificial Sequence
  chemically synthesized
aatgtggcacatatacacct

SEQ ID NO: 502623 - DNA, 20 bp, Artificial Sequence
  chemically synthesized
aatactatgcagccataaaa

SEQ ID NO: 502624 - DNA, 20 bp, Artificial Sequence
  chemically synthesized
ctatgcagccataaaaaagg

SEQ ID NO: 502625 - DNA, 20 bp, Artificial Sequence
  chemically synthesized
ttcatgtcctttgtagggac

SEQ ID NO: 502626 - DNA, 20 bp, Artificial Sequence
  chemically synthesized
tgtccttgcgatagtttgct

SEQ ID NO: 502627 - DNA, 20 bp, Artificial Sequence
  chemically synthesized
gcatgttctcactcataggt

SEQ ID NO: 502628 - DNA, 20 bp, Artificial Sequence
  chemically synthesized
tcattgttcaattcccacct

SEQ ID NO: 502629 - DNA, 20 bp, Artificial Sequence
  chemically synthesized
aaggggaacatcacacacca

SEQ ID NO: 502630 - DNA, 20 bp, Artificial Sequence
  chemically synthesized
tcacacaccagggaatgttg

SEQ ID NO: 502631 - DNA, 20 bp, Artificial Sequence
  chemically synthesized
gtggggtggggggagggggg

SEQ ID NO: 502632 - DNA, 20 bp, Artificial Sequence
  chemically synthesized
gatatacctaatgttaaatg

SEQ ID NO: 502633 - DNA, 20 bp, Artificial Sequence
  chemically synthesized
taatgttaaatgacgagtta

SEQ ID NO: 502634 - DNA, 20 bp, Artificial Sequence
  chemically synthesized
ttttttaatactttaagttt

SEQ ID NO: 502635 - DNA, 20 bp, Artificial Sequence
  chemically synthesized
aagtattaaaaaaaaagact

SEQ ID NO: 502636 - DNA, 20 bp, Artificial Sequence
  chemically synthesized
gtaacagcatgtgttgacct

SEQ ID NO: 502637 - DNA, 20 bp, Artificial Sequence
  chemically synthesized
aaaataaagctgcatgctgc

SEQ ID NO: 502638 - DNA, 20 bp, Artificial Sequence
  chemically synthesized
acataattttaaatccaatt

SEQ ID NO: 502639 - DNA, 20 bp, Artificial Sequence
  chemically synthesized
ctgggccctcagattctgaa

SEQ ID NO: 502640 - DNA, 20 bp, Artificial Sequence
  chemically synthesized
tttctctgggccctcagatt

SEQ ID NO: 502641 - DNA, 20 bp, Artificial Sequence
  chemically synthesized
ctatagtaataaatgccaat

SEQ ID NO: 502642 - DNA, 20 bp, Artificial Sequence
  chemically synthesized
atataaaagtagatgtagat

SEQ ID NO: 502643 - DNA, 20 bp, Artificial Sequence
  chemically synthesized
catctacttttatatataac

SEQ ID NO: 502644 - DNA, 20 bp, Artificial Sequence
  chemically synthesized
gtgccatagcttttatatct

SEQ ID NO: 502645 - DNA, 20 bp, Artificial Sequence
  chemically synthesized
tgagagttttgctagttaat

SEQ ID NO: 502646 - DNA, 20 bp, Artificial Sequence
  chemically synthesized
actccaccgtgtggtgcact

SEQ ID NO: 502647 - DNA, 20 bp, Artificial Sequence
  chemically synthesized
actctcagtgcaccacacgg

SEQ ID NO: 502648 - DNA, 20 bp, Artificial Sequence
  chemically synthesized
tatactggtcacgcagattt

SEQ ID NO: 502649 - DNA, 20 bp, Artificial Sequence
  chemically synthesized
ttttttcctgcttctccgtg

SEQ ID NO: 502650 - DNA, 20 bp, Artificial Sequence
  chemically synthesized
aaagaaagaaaagaaaggaa

SEQ ID NO: 502651 - DNA, 20 bp, Artificial Sequence
  chemically synthesized
agatgaaagaaagaaaagaa

SEQ ID NO: 502652 - DNA, 20 bp, Artificial Sequence
  chemically synthesized
atggatgtatggattgatgg

SEQ ID NO: 502653 - DNA, 20 bp, Artificial Sequence
  chemically synthesized
atggatggatgtatggattg

SEQ ID NO: 502654 - DNA, 20 bp, Artificial Sequence
  chemically synthesized
gtggatagatggatggatgt

SEQ ID NO: 502655 - DNA, 20 bp, Artificial Sequence
  chemically synthesized
gagatggggtggatagatgg

SEQ ID NO: 502656 - DNA, 20 bp, Artificial Sequence
  chemically synthesized
tatagagatggggtggatag

SEQ ID NO: 502657 - DNA, 20 bp, Artificial Sequence
  chemically synthesized
attttaaatatagagatggg

SEQ ID NO: 502658 - DNA, 20 bp, Artificial Sequence
  chemically synthesized
tgacattttaaatatagaga

SEQ ID NO: 502659 - DNA, 20 bp, Artificial Sequence
  chemically synthesized
tcattttggtggcattctta

SEQ ID NO: 502660 - DNA, 20 bp, Artificial Sequence
  chemically synthesized
tgtaagatgaaggatccact

SEQ ID NO: 502661 - DNA, 20 bp, Artificial Sequence
  chemically synthesized
taagcacagtgtgtaagatg

SEQ ID NO: 502662 - DNA, 20 bp, Artificial Sequence
  chemically synthesized
aattcccatgaaataaaata

SEQ ID NO: 502663 - DNA, 20 bp, Artificial Sequence
  chemically synthesized
gactctctattttatttcat

SEQ ID NO: 502664 - DNA, 20 bp, Artificial Sequence
  chemically synthesized
caggtactcagatttgcttc

SEQ ID NO: 502665 - DNA, 20 bp, Artificial Sequence
  chemically synthesized
atataatccttgaagcaaat

SEQ ID NO: 502666 - DNA, 20 bp, Artificial Sequence
  chemically synthesized
aagtgaattgttttctagaa

SEQ ID NO: 502667 - DNA, 20 bp, Artificial Sequence
  chemically synthesized
ttattttaatatggcagtaa

SEQ ID NO: 502668 - DNA, 20 bp, Artificial Sequence
  chemically synthesized
aaaataaaaccctggagcag

SEQ ID NO: 502669 - DNA, 20 bp, Artificial Sequence
  chemically synthesized
cttaaaacattcttctgctc

SEQ ID NO: 502670 - DNA, 20 bp, Artificial Sequence
  chemically synthesized
aatggtaatacataatattg

SEQ ID NO: 502671 - DNA, 20 bp, Artificial Sequence
  chemically synthesized
tatcaacatagttcttgaca

SEQ ID NO: 502672 - DNA, 20 bp, Artificial Sequence
  chemically synthesized
gcatggaaaatagatttgat

SEQ ID NO: 502673 - DNA, 20 bp, Artificial Sequence
  chemically synthesized
caagtaatgtttataaaatc

SEQ ID NO: 502674 - DNA, 20 bp, Artificial Sequence
  chemically synthesized
ttcttatttagaaatggatt

SEQ ID NO: 502675 - DNA, 20 bp, Artificial Sequence
  chemically synthesized
gtgttttttcttatttagaa

SEQ ID NO: 502676 - DNA, 20 bp, Artificial Sequence
  chemically synthesized
cagacttgcggaatgaaatt

SEQ ID NO: 502677 - DNA, 20 bp, Artificial Sequence
  chemically synthesized
attactttgtgacagacttg

SEQ ID NO: 502678 - DNA, 20 bp, Artificial Sequence
  chemically synthesized
tttgtacttcaaaatgcata

SEQ ID NO: 502679 - DNA, 20 bp, Artificial Sequence
  chemically synthesized
taaggaaaaatttgagcagt

SEQ ID NO: 502680 - DNA, 20 bp, Artificial Sequence
  chemically synthesized
aatgcttgtgacgttctgaa

SEQ ID NO: 502681 - DNA, 20 bp, Artificial Sequence
  chemically synthesized
ttaaaaatgcttgtgacgtt

SEQ ID NO: 502682 - DNA, 20 bp, Artificial Sequence
  chemically synthesized
actaatgacatgagttttga

SEQ ID NO: 502683 - DNA, 20 bp, Artificial Sequence
  chemically synthesized
ctttcatttaaactaatgac

SEQ ID NO: 502684 - DNA, 20 bp, Artificial Sequence
  chemically synthesized
acatgactataaatgaaata

SEQ ID NO: 502685 - DNA, 20 bp, Artificial Sequence
  chemically synthesized
ataggaatgagtaattgttt

SEQ ID NO: 502686 - DNA, 20 bp, Artificial Sequence
  chemically synthesized
tagtaaaatgcatgatagga

SEQ ID NO: 502687 - DNA, 20 bp, Artificial Sequence
  chemically synthesized
ggtttagtaaaatgcatgat

SEQ ID NO: 502688 - DNA, 20 bp, Artificial Sequence
  chemically synthesized
atttagtgtgtctaccacgg

SEQ ID NO: 502689 - DNA, 20 bp, Artificial Sequence
  chemically synthesized
agaaagtgtaatgatcaagt

SEQ ID NO: 502690 - DNA, 20 bp, Artificial Sequence
  chemically synthesized
taaaatatttatacatattt

SEQ ID NO: 502691 - DNA, 20 bp, Artificial Sequence
  chemically synthesized
attcctaagtccgtcccagt

SEQ ID NO: 502692 - DNA, 20 bp, Artificial Sequence
  chemically synthesized
actcaaactgggacggactt

SEQ ID NO: 502693 - DNA, 20 bp, Artificial Sequence
  chemically synthesized
cttacacaagccaggttctc

SEQ ID NO: 502694 - DNA, 20 bp, Artificial Sequence
  chemically synthesized
agtttgaaaaatatatatac

SEQ ID NO: 502695 - DNA, 20 bp, Artificial Sequence
  chemically synthesized
taatgattgtacatatttta

SEQ ID NO: 502696 - DNA, 20 bp, Artificial Sequence
  chemically synthesized
atatcaagacaaattaaaaa

SEQ ID NO: 502697 - DNA, 20 bp, Artificial Sequence
  chemically synthesized
ggataatagtaaacatactt

SEQ ID NO: 502698 - DNA, 20 bp, Artificial Sequence
  chemically synthesized
taaatattgtagtagaagtg

SEQ ID NO: 502699 - DNA, 20 bp, Artificial Sequence
  chemically synthesized
atagttttccactgggcaac

SEQ ID NO: 502700 - DNA, 20 bp, Artificial Sequence
  chemically synthesized
gcccagtggaaaactatgat

SEQ ID NO: 502701 - DNA, 20 bp, Artificial Sequence
  chemically synthesized
tatgatgaggattttatcat

SEQ ID NO: 502702 - DNA, 20 bp, Artificial Sequence
  chemically synthesized
tgaagaaagagaattttggg

SEQ ID NO: 502703 - DNA, 20 bp, Artificial Sequence
  chemically synthesized
tgcaatagtggatgaagaaa

SEQ ID NO: 502704 - DNA, 20 bp, Artificial Sequence
  chemically synthesized
gagtgcatacaattgcaata

SEQ ID NO: 502705 - DNA, 20 bp, Artificial Sequence
  chemically synthesized
cagggaatattatttcctta

SEQ ID NO: 502706 - DNA, 20 bp, Artificial Sequence
  chemically synthesized
tgataggcttaaaaagtcca

SEQ ID NO: 502707 - DNA, 20 bp, Artificial Sequence
  chemically synthesized
atgtccctgataatatgtgg

SEQ ID NO: 502708 - DNA, 20 bp, Artificial Sequence
  chemically synthesized
catattgtctaactttgacc

SEQ ID NO: 502709 - DNA, 20 bp, Artificial Sequence
  chemically synthesized
gcaacagtatacacaatagc

SEQ ID NO: 502710 - DNA, 20 bp, Artificial Sequence
  chemically synthesized
ttacaatgcaattacagtta

SEQ ID NO: 502711 - DNA, 20 bp, Artificial Sequence
  chemically synthesized
tttcactttaaaatgaattt

SEQ ID NO: 502712 - DNA, 20 bp, Artificial Sequence
  chemically synthesized
ctgaagtttttcactttaaa

SEQ ID NO: 502713 - DNA, 20 bp, Artificial Sequence
  chemically synthesized
tcatagcatggacttggtga

SEQ ID NO: 502714 - DNA, 20 bp, Artificial Sequence
  chemically synthesized
tcacacaaccctaaagactt

SEQ ID NO: 502715 - DNA, 20 bp, Artificial Sequence
  chemically synthesized
attatttattcaaaagtctt

SEQ ID NO: 502716 - DNA, 20 bp, Artificial Sequence
  chemically synthesized
ttttaaaaatacttcttaca

SEQ ID NO: 502717 - DNA, 20 bp, Artificial Sequence
  chemically synthesized
aaatctgagttgacttttaa

SEQ ID NO: 502718 - DNA, 20 bp, Artificial Sequence
  chemically synthesized
aaatagtgttgaaaataaat

SEQ ID NO: 502719 - DNA, 20 bp, Artificial Sequence
  chemically synthesized
tttacctgtttttctagaat

SEQ ID NO: 502720 - DNA, 20 bp, Artificial Sequence
  chemically synthesized
aacgtgtttacctgtttttc

SEQ ID NO: 502721 - DNA, 20 bp, Artificial Sequence
  chemically synthesized
aacacgttttatattttcgt

SEQ ID NO: 502722 - DNA, 20 bp, Artificial Sequence
  chemically synthesized
ttttcgtttgaatgaagcat

SEQ ID NO: 502723 - DNA, 20 bp, Artificial Sequence
  chemically synthesized
cgtttgaatgaagcatggga

SEQ ID NO: 502724 - DNA, 20 bp, Artificial Sequence
  chemically synthesized
aaatgtgttagttacaagca

SEQ ID NO: 502725 - DNA, 20 bp, Artificial Sequence
  chemically synthesized
atagaccatgtgactaaacg

SEQ ID NO: 502726 - DNA, 20 bp, Artificial Sequence
  chemically synthesized
ctttttttctttttataaga

SEQ ID NO: 502727 - DNA, 20 bp, Artificial Sequence
  chemically synthesized
agtctcgctctgttccaggc

SEQ ID NO: 502728 - DNA, 20 bp, Artificial Sequence
  chemically synthesized
tactcgggaggctgaggcag

SEQ ID NO: 502729 - DNA, 20 bp, Artificial Sequence
  chemically synthesized
gattctcctgcctcagcctc

SEQ ID NO: 502730 - DNA, 20 bp, Artificial Sequence
  chemically synthesized
gcctcagcctcccgagtagc

SEQ ID NO: 502731 - DNA, 20 bp, Artificial Sequence
  chemically synthesized
ttttgtatttttagtagaga

SEQ ID NO: 502732 - DNA, 20 bp, Artificial Sequence
  chemically synthesized
ggcccacgaatcacaatgtc

SEQ ID NO: 502733 - DNA, 20 bp, Artificial Sequence
  chemically synthesized
cctttgggatgctgaggccc

SEQ ID NO: 502734 - DNA, 20 bp, Artificial Sequence
  chemically synthesized
gcctcagcatcccaaagggc

SEQ ID NO: 502735 - DNA, 20 bp, Artificial Sequence
  chemically synthesized
cacctgtaatcccagccctt

SEQ ID NO: 502736 - DNA, 20 bp, Artificial Sequence
  chemically synthesized
gtaaagaaaatgttttttgg

SEQ ID NO: 502737 - DNA, 20 bp, Artificial Sequence
  chemically synthesized
taaaagctagagtaaaacca

SEQ ID NO: 502738 - DNA, 20 bp, Artificial Sequence
  chemically synthesized
cttcaaactatactaaaagc

SEQ ID NO: 502739 - DNA, 20 bp, Artificial Sequence
  chemically synthesized
tttttttaaggatgtaatgg

SEQ ID NO: 502740 - DNA, 20 bp, Artificial Sequence
  chemically synthesized
agtctaagatttattttttt

SEQ ID NO: 502741 - DNA, 20 bp, Artificial Sequence
  chemically synthesized
ggaggtaggtaggaagaaaa

SEQ ID NO: 502742 - DNA, 20 bp, Artificial Sequence
  chemically synthesized
acctccaaatagtcaaatca

SEQ ID NO: 502743 - DNA, 20 bp, Artificial Sequence
  chemically synthesized
tttattcaactagttttcca

SEQ ID NO: 502744 - DNA, 20 bp, Artificial Sequence
  chemically synthesized
acaaccccatggaaaactag

SEQ ID NO: 502745 - DNA, 20 bp, Artificial Sequence
  chemically synthesized
tgttgaagtaataaaaacaa

SEQ ID NO: 502746 - DNA, 20 bp, Artificial Sequence
  chemically synthesized
aagcccaggcaagtacatct

SEQ ID NO: 502747 - DNA, 20 bp, Artificial Sequence
  chemically synthesized
aagctgccaactgcttgtca

SEQ ID NO: 502748 - DNA, 20 bp, Artificial Sequence
  chemically synthesized
tcaatgaatgtgagggactc

SEQ ID NO: 502749 - DNA, 20 bp, Artificial Sequence
  chemically synthesized
aaaatccttacacttaatcc

SEQ ID NO: 502750 - DNA, 20 bp, Artificial Sequence
  chemically synthesized
gggactcctggattaagtgt

SEQ ID NO: 502751 - DNA, 20 bp, Artificial Sequence
  chemically synthesized
ttttcagtctcctgggcaga

SEQ ID NO: 502752 - DNA, 20 bp, Artificial Sequence
  chemically synthesized
ctccttacagcctaaaaaga

SEQ ID NO: 502753 - DNA, 20 bp, Artificial Sequence
  chemically synthesized
acagcctaaaaagaaggaat

SEQ ID NO: 502754 - DNA, 20 bp, Artificial Sequence
  chemically synthesized
aggattacagaaaagctatc

SEQ ID NO: 502755 - DNA, 20 bp, Artificial Sequence
  chemically synthesized
aatcttcatttattgttcag

SEQ ID NO: 502756 - DNA, 20 bp, Artificial Sequence
  chemically synthesized
aaggtgattgtggaagagtc

SEQ ID NO: 502757 - DNA, 20 bp, Artificial Sequence
  chemically synthesized
ttacaaaaaggtgattgtgg

SEQ ID NO: 502758 - DNA, 20 bp, Artificial Sequence
  chemically synthesized
ttttctatcaacagagctga

SEQ ID NO: 502759 - DNA, 20 bp, Artificial Sequence
  chemically synthesized
ttttttttctatcaacagag

SEQ ID NO: 502760 - DNA, 20 bp, Artificial Sequence
  chemically synthesized
ataaatagcaaacaaaacta

SEQ ID NO: 502761 - DNA, 20 bp, Artificial Sequence
  chemically synthesized
gcaaacaaaactataggatc

SEQ ID NO: 502762 - DNA, 20 bp, Artificial Sequence
  chemically synthesized
tgcaatctgtctttctcagg

SEQ ID NO: 502763 - DNA, 20 bp, Artificial Sequence
  chemically synthesized
ttcaagagatttggtttgct

SEQ ID NO: 502764 - DNA, 20 bp, Artificial Sequence
  chemically synthesized
gagatttggtttgcttagaa

SEQ ID NO: 502765 - DNA, 20 bp, Artificial Sequence
  chemically synthesized
agcagattatctgtcttgaa

SEQ ID NO: 502766 - DNA, 20 bp, Artificial Sequence
  chemically synthesized
gtggaagcagattatctgtc

SEQ ID NO: 502767 - DNA, 20 bp, Artificial Sequence
  chemically synthesized
agatacatgtacaatctgtt

SEQ ID NO: 502768 - DNA, 20 bp, Artificial Sequence
  chemically synthesized
aatcagctccttgtcaaaaa

SEQ ID NO: 502769 - DNA, 20 bp, Artificial Sequence
  chemically synthesized
agtctggttaaagatttatt

SEQ ID NO: 502770 - DNA, 20 bp, Artificial Sequence
  chemically synthesized
tccctactttctttcacaat

SEQ ID NO: 502771 - DNA, 20 bp, Artificial Sequence
  chemically synthesized
tacagaaattgtttgtacaa

SEQ ID NO: 502772 - DNA, 20 bp, Artificial Sequence
  chemically synthesized
aagattaattgcagctatat

SEQ ID NO: 502773 - DNA, 20 bp, Artificial Sequence
  chemically synthesized
attgtaactataagtatgat

SEQ ID NO: 502774 - DNA, 20 bp, Artificial Sequence
  chemically synthesized
gtatttatacttgaacatta

SEQ ID NO: 502775 - DNA, 20 bp, Artificial Sequence
  chemically synthesized
agattggaaagtctcccttc

SEQ ID NO: 502776 - DNA, 20 bp, Artificial Sequence
  chemically synthesized
aaggatctgttcacttttaa

SEQ ID NO: 502777 - DNA, 20 bp, Artificial Sequence
  chemically synthesized
aatagggcaggcaacttatt

SEQ ID NO: 502778 - DNA, 20 bp, Artificial Sequence
  chemically synthesized
tgtattttaaatgacacata

SEQ ID NO: 502779 - DNA, 20 bp, Artificial Sequence
  chemically synthesized
cttggtttttatattatata

SEQ ID NO: 502780 - DNA, 20 bp, Artificial Sequence
  chemically synthesized
gttataggctggcttcactg

SEQ ID NO: 502781 - DNA, 20 bp, Artificial Sequence
  chemically synthesized
agcccaggataaaatcttaa

SEQ ID NO: 502782 - DNA, 20 bp, Artificial Sequence
  chemically synthesized
aatgagaagaaaggaaagcc

SEQ ID NO: 502783 - DNA, 20 bp, Artificial Sequence
  chemically synthesized
aattgaagttaaggtatggg

SEQ ID NO: 502784 - DNA, 20 bp, Artificial Sequence
  chemically synthesized
ggaggaattgaagttaaggt

SEQ ID NO: 502785 - DNA, 20 bp, Artificial Sequence
  chemically synthesized
agagttgtcagaatgtgagg

SEQ ID NO: 502786 - DNA, 20 bp, Artificial Sequence
  chemically synthesized
gatgtagagttgagagttgt

SEQ ID NO: 502787 - DNA, 20 bp, Artificial Sequence
  chemically synthesized
gacttgagagatgtagagtt

SEQ ID NO: 502788 - DNA, 20 bp, Artificial Sequence
  chemically synthesized
agatctggacttgagagatg

SEQ ID NO: 502789 - DNA, 20 bp, Artificial Sequence
  chemically synthesized
attcatgaggagatgtccaa

SEQ ID NO: 502790 - DNA, 20 bp, Artificial Sequence
  chemically synthesized
accctattggacatctcctc

SEQ ID NO: 502791 - DNA, 20 bp, Artificial Sequence
  chemically synthesized
gtgttagcttttggtggttg

SEQ ID NO: 502792 - DNA, 20 bp, Artificial Sequence
  chemically synthesized
tatgcaaggagttcatgtgt

SEQ ID NO: 502793 - DNA, 20 bp, Artificial Sequence
  chemically synthesized
aggtgagaagagtatatgca

SEQ ID NO: 502794 - DNA, 20 bp, Artificial Sequence
  chemically synthesized
ggagttgagaagtaggtgag

SEQ ID NO: 502795 - DNA, 20 bp, Artificial Sequence
  chemically synthesized
gaaggaggaaaagcaagttg

SEQ ID NO: 502796 - DNA, 20 bp, Artificial Sequence
  chemically synthesized
ctagaattacatctaataaa

SEQ ID NO: 502797 - DNA, 20 bp, Artificial Sequence
  chemically synthesized
atagaggaagtagaaatatc

SEQ ID NO: 502798 - DNA, 20 bp, Artificial Sequence
  chemically synthesized
tggagagagagagaaaagat

SEQ ID NO: 502799 - DNA, 20 bp, Artificial Sequence
  chemically synthesized
gatatagtaatgattttaac

SEQ ID NO: 502800 - DNA, 20 bp, Artificial Sequence
  chemically synthesized
gctttacaggtgggatgtgg

SEQ ID NO: 502801 - DNA, 20 bp, Artificial Sequence
  chemically synthesized
cattgcagctgctttacagg

SEQ ID NO: 502802 - DNA, 20 bp, Artificial Sequence
  chemically synthesized
tgcaatgtgttctctcaata

SEQ ID NO: 502803 - DNA, 20 bp, Artificial Sequence
  chemically synthesized
aggacagtaaagaatcacta

SEQ ID NO: 502804 - DNA, 20 bp, Artificial Sequence
  chemically synthesized
cttttatttgaaggacagta

SEQ ID NO: 502805 - DNA, 20 bp, Artificial Sequence
  chemically synthesized
aaaaaaaaaaaaaaaaaaaa

SEQ ID NO: 502806 - DNA, 20 bp, Artificial Sequence
  chemically synthesized
ttttttttttgagatggagg

SEQ ID NO: 502807 - DNA, 20 bp, Artificial Sequence
  chemically synthesized
tctctctctgtcacccagac

SEQ ID NO: 502808 - DNA, 20 bp, Artificial Sequence
  chemically synthesized
ttgtgccactgcactccagt

SEQ ID NO: 502809 - DNA, 20 bp, Artificial Sequence
  chemically synthesized
tacttgagaggctgaggcag

SEQ ID NO: 502810 - DNA, 20 bp, Artificial Sequence
  chemically synthesized
gcctcagcctctcaagtagc

SEQ ID NO: 502811 - DNA, 20 bp, Artificial Sequence
  chemically synthesized
ggtacctgccaccatgcctg

SEQ ID NO: 502812 - DNA, 20 bp, Artificial Sequence
  chemically synthesized
ttttgtatttttagtagaga

SEQ ID NO: 502813 - DNA, 20 bp, Artificial Sequence
  chemically synthesized
tgggtggatcatcttaggtc

SEQ ID NO: 502814 - DNA, 20 bp, Artificial Sequence
  chemically synthesized
acttagggaggccgaggtgg

SEQ ID NO: 502815 - DNA, 20 bp, Artificial Sequence
  chemically synthesized
cagcacttagggaggccgag

SEQ ID NO: 502816 - DNA, 20 bp, Artificial Sequence
  chemically synthesized
acctcggcctccctaagtgc

SEQ ID NO: 502817 - DNA, 20 bp, Artificial Sequence
  chemically synthesized
agggacttttaagccacatt

SEQ ID NO: 502818 - DNA, 20 bp, Artificial Sequence
  chemically synthesized
atttctgtatagctagagca

SEQ ID NO: 502819 - DNA, 20 bp, Artificial Sequence
  chemically synthesized
ggaacaacatgtttaaggcc

SEQ ID NO: 502820 - DNA, 20 bp, Artificial Sequence
  chemically synthesized
attagccaataaaaggaagt

SEQ ID NO: 502821 - DNA, 20 bp, Artificial Sequence
  chemically synthesized
acaaaattcaaagaacatgc

SEQ ID NO: 502822 - DNA, 20 bp, Artificial Sequence
  chemically synthesized
aggtaattcttgcatgttct

SEQ ID NO: 502823 - DNA, 20 bp, Artificial Sequence
  chemically synthesized
tgttacgtgctctaacttga

SEQ ID NO: 502824 - DNA, 20 bp, Artificial Sequence
  chemically synthesized
gtaacatgatgttttaatat

SEQ ID NO: 502825 - DNA, 20 bp, Artificial Sequence
  chemically synthesized
tttaatatatgaatatgtta

SEQ ID NO: 502826 - DNA, 20 bp, Artificial Sequence
  chemically synthesized
aagaacataatgtcatgtga

SEQ ID NO: 502827 - DNA, 20 bp, Artificial Sequence
  chemically synthesized
actttagactatcaactcta

SEQ ID NO: 502828 - DNA, 20 bp, Artificial Sequence
  chemically synthesized
gccgtaatccttgaactcat

SEQ ID NO: 502829 - DNA, 20 bp, Artificial Sequence
  chemically synthesized
ctatcaactctaatgagttc

SEQ ID NO: 502830 - DNA, 20 bp, Artificial Sequence
  chemically synthesized
cattgctcaataccagttcc

SEQ ID NO: 502831 - DNA, 20 bp, Artificial Sequence
  chemically synthesized
cccaatagctttatttatga

SEQ ID NO: 502832 - DNA, 20 bp, Artificial Sequence
  chemically synthesized
ttaaatagtcaaagacgaaa

SEQ ID NO: 502833 - DNA, 20 bp, Artificial Sequence
  chemically synthesized
tgtttttgtattaaaagtgt

SEQ ID NO: 502834 - DNA, 20 bp, Artificial Sequence
  chemically synthesized
tgtattaaaagtgtcagaat

SEQ ID NO: 502835 - DNA, 20 bp, Artificial Sequence
  chemically synthesized
tcggtcaccaatcttggata

SEQ ID NO: 502836 - DNA, 20 bp, Artificial Sequence
  chemically synthesized
caaagcctcggtcaccaatc

SEQ ID NO: 502837 - DNA, 20 bp, Artificial Sequence
  chemically synthesized
aaaggaagctatgtttgaat

SEQ ID NO: 502838 - DNA, 20 bp, Artificial Sequence
  chemically synthesized
agaacaaaaggaagctatgt

SEQ ID NO: 502839 - DNA, 20 bp, Artificial Sequence
  chemically synthesized
tccatttctttggaagagct

SEQ ID NO: 502840 - DNA, 20 bp, Artificial Sequence
  chemically synthesized
cccacagctcttccaaagaa

SEQ ID NO: 502841 - DNA, 20 bp, Artificial Sequence
  chemically synthesized
aaatctacagatgtgccttg

SEQ ID NO: 502842 - DNA, 20 bp, Artificial Sequence
  chemically synthesized
atctgtagattttaattgta

SEQ ID NO: 502843 - DNA, 20 bp, Artificial Sequence
  chemically synthesized
taattgtataggatgtaata

SEQ ID NO: 502844 - DNA, 20 bp, Artificial Sequence
  chemically synthesized
gaaaaagttaggtttctaaa

SEQ ID NO: 502845 - DNA, 20 bp, Artificial Sequence
  chemically synthesized
ctttcagctcatagaatctc

SEQ ID NO: 502846 - DNA, 20 bp, Artificial Sequence
  chemically synthesized
acactgttcctttcagctca

SEQ ID NO: 502847 - DNA, 20 bp, Artificial Sequence
  chemically synthesized
tgtggcttaagaaatgatgg

SEQ ID NO: 502848 - DNA, 20 bp, Artificial Sequence
  chemically synthesized
aaatgatggcagagttgact

SEQ ID NO: 502849 - DNA, 20 bp, Artificial Sequence
  chemically synthesized
gatggcagagttgacttcgg

SEQ ID NO: 502850 - DNA, 20 bp, Artificial Sequence
  chemically synthesized
ttcaatgactgagataatca

SEQ ID NO: 502851 - DNA, 20 bp, Artificial Sequence
  chemically synthesized
ctcatgtcaatgcaagcttg

SEQ ID NO: 502852 - DNA, 20 bp, Artificial Sequence
  chemically synthesized
cttatgccatgactagttga

SEQ ID NO: 502853 - DNA, 20 bp, Artificial Sequence
  chemically synthesized
tctgattaggcgcaccctga

SEQ ID NO: 502854 - DNA, 20 bp, Artificial Sequence
  chemically synthesized
tcataagcctgacattccat

SEQ ID NO: 502855 - DNA, 20 bp, Artificial Sequence
  chemically synthesized
cctgatggaatgtcaggctt

SEQ ID NO: 502856 - DNA, 20 bp, Artificial Sequence
  chemically synthesized
gcttgacctgtgctgtctca

SEQ ID NO: 502857 - DNA, 20 bp, Artificial Sequence
  chemically synthesized
ctgattttttgttgttgttc

SEQ ID NO: 502858 - DNA, 20 bp, Artificial Sequence
  chemically synthesized
ataattcctcttactgctaa

SEQ ID NO: 502859 - DNA, 20 bp, Artificial Sequence
  chemically synthesized
ctaatccacttagcagtaag

SEQ ID NO: 502860 - DNA, 20 bp, Artificial Sequence
  chemically synthesized
tttttcttggtaaccattac

SEQ ID NO: 502861 - DNA, 20 bp, Artificial Sequence
  chemically synthesized
gttttaattttcattgaaaa

SEQ ID NO: 502862 - DNA, 20 bp, Artificial Sequence
  chemically synthesized
taagtttaagaaaaagtttt

SEQ ID NO: 502863 - DNA, 20 bp, Artificial Sequence
  chemically synthesized
gaaaaagttttaagagttta

SEQ ID NO: 502864 - DNA, 20 bp, Artificial Sequence
  chemically synthesized
aatgtaaagtcatctctaca

SEQ ID NO: 502865 - DNA, 20 bp, Artificial Sequence
  chemically synthesized
acatgcagagttttctcttc

SEQ ID NO: 502866 - DNA, 20 bp, Artificial Sequence
  chemically synthesized
tcggttttttatttcacatg

SEQ ID NO: 502867 - DNA, 20 bp, Artificial Sequence
  chemically synthesized
tctgcatgtgaaataaaaaa

SEQ ID NO: 502868 - DNA, 20 bp, Artificial Sequence
  chemically synthesized
ccaaaaaatgtatttaacat

SEQ ID NO: 502869 - DNA, 20 bp, Artificial Sequence
  chemically synthesized
taggatacctagctccttta

SEQ ID NO: 502870 - DNA, 20 bp, Artificial Sequence
  chemically synthesized
tgagtttaataagtatagta

SEQ ID NO: 502871 - DNA, 20 bp, Artificial Sequence
  chemically synthesized
cagtaaaattgctttttgta

SEQ ID NO: 502872 - DNA, 20 bp, Artificial Sequence
  chemically synthesized
tttactgcatttatgaggtg

SEQ ID NO: 502873 - DNA, 20 bp, Artificial Sequence
  chemically synthesized
gggtaagcttatgcttgcaa

SEQ ID NO: 502874 - DNA, 20 bp, Artificial Sequence
  chemically synthesized
cttatgcttgcaaatggatt

SEQ ID NO: 502875 - DNA, 20 bp, Artificial Sequence
  chemically synthesized
cttgcaaatggattaagaat

SEQ ID NO: 502876 - DNA, 20 bp, Artificial Sequence
  chemically synthesized
tcacaatgatgaatacaatg

SEQ ID NO: 502877 - DNA, 20 bp, Artificial Sequence
  chemically synthesized
tacatgtctacatcacaatg

SEQ ID NO: 502878 - DNA, 20 bp, Artificial Sequence
  chemically synthesized
gcagttttaaatattttctt

SEQ ID NO: 502879 - DNA, 20 bp, Artificial Sequence
  chemically synthesized
atattttcttctgagtaaag

SEQ ID NO: 502880 - DNA, 20 bp, Artificial Sequence
  chemically synthesized
aaaataaagccctcattttt

SEQ ID NO: 502881 - DNA, 20 bp, Artificial Sequence
  chemically synthesized
gctttatttgaattggaatt

SEQ ID NO: 502882 - DNA, 20 bp, Artificial Sequence
  chemically synthesized
ttgctttgctttatttgaat

SEQ ID NO: 502883 - DNA, 20 bp, Artificial Sequence
  chemically synthesized
ttgtcgttgctttgctttat

SEQ ID NO: 502884 - DNA, 20 bp, Artificial Sequence
  chemically synthesized
aaagtcttgaagtttctgct

SEQ ID NO: 502885 - DNA, 20 bp, Artificial Sequence
  chemically synthesized
ttgcagaaagtagagcaata

SEQ ID NO: 502886 - DNA, 20 bp, Artificial Sequence
  chemically synthesized
ttattttatagaaagtgtct

SEQ ID NO: 502887 - DNA, 20 bp, Artificial Sequence
  chemically synthesized
tatagaaagtgtcttgggat

SEQ ID NO: 502888 - DNA, 20 bp, Artificial Sequence
  chemically synthesized
tttctgaagggcaggttgag

SEQ ID NO: 502889 - DNA, 20 bp, Artificial Sequence
  chemically synthesized
tgtagtttctgaagggcagg

SEQ ID NO: 502890 - DNA, 20 bp, Artificial Sequence
  chemically synthesized
atggagattaatgtcctctc

SEQ ID NO: 502891 - DNA, 20 bp, Artificial Sequence
  chemically synthesized
gacaaccacgcttcacttca

SEQ ID NO: 502892 - DNA, 20 bp, Artificial Sequence
  chemically synthesized
accagtcaagttttctttcc

SEQ ID NO: 502893 - DNA, 20 bp, Artificial Sequence
  chemically synthesized
accaagcaacacttgcttca

SEQ ID NO: 502894 - DNA, 20 bp, Artificial Sequence
  chemically synthesized
ttgttcaagtgccaagtact

SEQ ID NO: 502895 - DNA, 20 bp, Artificial Sequence
  chemically synthesized
gccaagtactaagaatactg

SEQ ID NO: 502896 - DNA, 20 bp, Artificial Sequence
  chemically synthesized
cttgctcttaagttaaatag

SEQ ID NO: 502897 - DNA, 20 bp, Artificial Sequence
  chemically synthesized
gcaagtgtgaaactgtcact

SEQ ID NO: 502898 - DNA, 20 bp, Artificial Sequence
  chemically synthesized
gtgaaactgtcactatggat

SEQ ID NO: 502899 - DNA, 20 bp, Artificial Sequence
  chemically synthesized
tcactatggatatgaatgca

SEQ ID NO: 502900 - DNA, 20 bp, Artificial Sequence
  chemically synthesized
caaaattctaagacaacaga

SEQ ID NO: 502901 - DNA, 20 bp, Artificial Sequence
  chemically synthesized
ttgaattctatctgttgtct

SEQ ID NO: 502902 - DNA, 20 bp, Artificial Sequence
  chemically synthesized
ctatctgttgtcttagaatt

SEQ ID NO: 502903 - DNA, 20 bp, Artificial Sequence
  chemically synthesized
gccctgctatttccatctct

SEQ ID NO: 502904 - DNA, 20 bp, Artificial Sequence
  chemically synthesized
ttcagagagttttagtataa

SEQ ID NO: 502905 - DNA, 20 bp, Artificial Sequence
  chemically synthesized
gattctttctaaaaccttca

SEQ ID NO: 502906 - DNA, 20 bp, Artificial Sequence
  chemically synthesized
aactctctgaaggttttaga

SEQ ID NO: 502907 - DNA, 20 bp, Artificial Sequence
  chemically synthesized
ttttagaaagaatcggtctt

SEQ ID NO: 502908 - DNA, 20 bp, Artificial Sequence
  chemically synthesized
ccctactctccctctgggcc

SEQ ID NO: 502909 - DNA, 20 bp, Artificial Sequence
  chemically synthesized
ctgaattcatggcccagagg

SEQ ID NO: 502910 - DNA, 20 bp, Artificial Sequence
  chemically synthesized
tcatggcccagagggagagt

SEQ ID NO: 502911 - DNA, 20 bp, Artificial Sequence
  chemically synthesized
ccatcttcttttccccctta

SEQ ID NO: 502912 - DNA, 20 bp, Artificial Sequence
  chemically synthesized
agctccaagaccactgatca

SEQ ID NO: 502913 - DNA, 20 bp, Artificial Sequence
  chemically synthesized
gaccactgatcacagggtct

SEQ ID NO: 502914 - DNA, 20 bp, Artificial Sequence
  chemically synthesized
gatcacagggtctgggagtc

SEQ ID NO: 502915 - DNA, 20 bp, Artificial Sequence
  chemically synthesized
tctgggagtccagagtagat

SEQ ID NO: 502916 - DNA, 20 bp, Artificial Sequence
  chemically synthesized
gaagcagacatcttcagaag

SEQ ID NO: 502917 - DNA, 20 bp, Artificial Sequence
  chemically synthesized
gcctacttgataggtaaaaa

SEQ ID NO: 502918 - DNA, 20 bp, Artificial Sequence
  chemically synthesized
gtttgccacaccaagcactg

SEQ ID NO: 502919 - DNA, 20 bp, Artificial Sequence
  chemically synthesized
tgaggtactcttgctccata

SEQ ID NO: 502920 - DNA, 20 bp, Artificial Sequence
  chemically synthesized
aggaacactctttatggagc

SEQ ID NO: 502921 - DNA, 20 bp, Artificial Sequence
  chemically synthesized
tttatggagcaagagtacct

SEQ ID NO: 502922 - DNA, 20 bp, Artificial Sequence
  chemically synthesized
gtttatttggggtacaagta

SEQ ID NO: 502923 - DNA, 20 bp, Artificial Sequence
  chemically synthesized
atacaaagttcgggtttatt

SEQ ID NO: 502924 - DNA, 20 bp, Artificial Sequence
  chemically synthesized
gtgtaacagagatacaaagt

SEQ ID NO: 502925 - DNA, 20 bp, Artificial Sequence
  chemically synthesized
ttaactagctatttgtagct

SEQ ID NO: 502926 - DNA, 20 bp, Artificial Sequence
  chemically synthesized
tctccaatgtcttgggaagt

SEQ ID NO: 502927 - DNA, 20 bp, Artificial Sequence
  chemically synthesized
tcctacttcccaagacattg

SEQ ID NO: 502928 - DNA, 20 bp, Artificial Sequence
  chemically synthesized
gaggcagtggaggtgtaaga

SEQ ID NO: 502929 - DNA, 20 bp, Artificial Sequence
  chemically synthesized
taataaagacttaaatctaa

SEQ ID NO: 502930 - DNA, 20 bp, Artificial Sequence
  chemically synthesized
cctcagaggccagaaagcaa

SEQ ID NO: 502931 - DNA, 20 bp, Artificial Sequence
  chemically synthesized
tcatccaggtagatggcgcc

SEQ ID NO: 502932 - DNA, 20 bp, Artificial Sequence
  chemically synthesized
ctattcatggcgccatctac

SEQ ID NO: 502933 - DNA, 20 bp, Artificial Sequence
  chemically synthesized
tcaaactactaacacagtcc

SEQ ID NO: 502934 - DNA, 20 bp, Artificial Sequence
  chemically synthesized
ttgctttatttgagtaagtg

SEQ ID NO: 502935 - DNA, 20 bp, Artificial Sequence
  chemically synthesized
ctcctttgcctttgctttat

SEQ ID NO: 502936 - DNA, 20 bp, Artificial Sequence
  chemically synthesized
caaataaagcaaaggcaaag

SEQ ID NO: 502937 - DNA, 20 bp, Artificial Sequence
  chemically synthesized
tgatagacatccagatcatc

SEQ ID NO: 502938 - DNA, 20 bp, Artificial Sequence
  chemically synthesized
tggaccacattctagatgat

SEQ ID NO: 502939 - DNA, 20 bp, Artificial Sequence
  chemically synthesized
atattcatgtatgttggtag

SEQ ID NO: 502940 - DNA, 20 bp, Artificial Sequence
  chemically synthesized
atatccgtctaccaacatac

SEQ ID NO: 502941 - DNA, 20 bp, Artificial Sequence
  chemically synthesized
acaggagcaatagttttcac

SEQ ID NO: 502942 - DNA, 20 bp, Artificial Sequence
  chemically synthesized
agaccttagaattatgcttc

SEQ ID NO: 502943 - DNA, 20 bp, Artificial Sequence
  chemically synthesized
gcatgcttctttaaagacct

SEQ ID NO: 502944 - DNA, 20 bp, Artificial Sequence
  chemically synthesized
aagcatgccataaaagtatc

SEQ ID NO: 502945 - DNA, 20 bp, Artificial Sequence
  chemically synthesized
ggaattatttaaggaccact

SEQ ID NO: 502946 - DNA, 20 bp, Artificial Sequence
  chemically synthesized
cagggtttcaccgtgtcagc

SEQ ID NO: 502947 - DNA, 20 bp, Artificial Sequence
  chemically synthesized
ttttgtatttttagtagaaa

SEQ ID NO: 502948 - DNA, 20 bp, Artificial Sequence
  chemically synthesized
tacgcaggaggctgaggcag

SEQ ID NO: 502949 - DNA, 20 bp, Artificial Sequence
  chemically synthesized
ctcactgccagctctacctc

SEQ ID NO: 502950 - DNA, 20 bp, Artificial Sequence
  chemically synthesized
tcgtgccattgcactacagt

SEQ ID NO: 502951 - DNA, 20 bp, Artificial Sequence
  chemically synthesized
ttgcactacagtctgggtga

SEQ ID NO: 502952 - DNA, 20 bp, Artificial Sequence
  chemically synthesized
ttttttttttttttttgaga

SEQ ID NO: 502953 - DNA, 20 bp, Artificial Sequence
  chemically synthesized
aaatttttgtataactttta

SEQ ID NO: 502954 - DNA, 20 bp, Artificial Sequence
  chemically synthesized
ttaatgaaatgttttccaaa

SEQ ID NO: 502955 - DNA, 20 bp, Artificial Sequence
  chemically synthesized
gaaatgttttccaaaaagaa

SEQ ID NO: 502956 - DNA, 20 bp, Artificial Sequence
  chemically synthesized
ttttccaaaaagaatagagt

SEQ ID NO: 502957 - DNA, 20 bp, Artificial Sequence
  chemically synthesized
tagagttaggattttgaaaa

SEQ ID NO: 502958 - DNA, 20 bp, Artificial Sequence
  chemically synthesized
agagaaaagcagagggagaa

SEQ ID NO: 502959 - DNA, 20 bp, Artificial Sequence
  chemically synthesized
aaaacaaagaaagcaacaaa

SEQ ID NO: 502960 - DNA, 20 bp, Artificial Sequence
  chemically synthesized
ctcctttctttaggaaaaaa

SEQ ID NO: 502961 - DNA, 20 bp, Artificial Sequence
  chemically synthesized
tcacaagagttatatttaaa

SEQ ID NO: 502962 - DNA, 20 bp, Artificial Sequence
  chemically synthesized
actgtaccaaagcccctcac

SEQ ID NO: 502963 - DNA, 20 bp, Artificial Sequence
  chemically synthesized
tatttgttaatgtatttaat

SEQ ID NO: 502964 - DNA, 20 bp, Artificial Sequence
  chemically synthesized
ccttctttattttatattta

SEQ ID NO: 502965 - DNA, 20 bp, Artificial Sequence
  chemically synthesized
cataaatctagaagcctttc

SEQ ID NO: 502966 - DNA, 20 bp, Artificial Sequence
  chemically synthesized
gagctccatgctcacggctt

SEQ ID NO: 502967 - DNA, 20 bp, Artificial Sequence
  chemically synthesized
tataattttctttaccagga

SEQ ID NO: 502968 - DNA, 20 bp, Artificial Sequence
  chemically synthesized
ttcctattaaccatgacacc

SEQ ID NO: 502969 - DNA, 20 bp, Artificial Sequence
  chemically synthesized
catacttgaaagtaacgttt

SEQ ID NO: 502970 - DNA, 20 bp, Artificial Sequence
  chemically synthesized
agtaaagcattgagcattga

SEQ ID NO: 502971 - DNA, 20 bp, Artificial Sequence
  chemically synthesized
atagaatggtcaatgagcta

SEQ ID NO: 502972 - DNA, 20 bp, Artificial Sequence
  chemically synthesized
gtaatatatctaagacattt

SEQ ID NO: 502973 - DNA, 20 bp, Artificial Sequence
  chemically synthesized
tgaggataaatggatgcagc

SEQ ID NO: 502974 - DNA, 20 bp, Artificial Sequence
  chemically synthesized
ttgtctacccatgaggataa

SEQ ID NO: 502975 - DNA, 20 bp, Artificial Sequence
  chemically synthesized
tgctgcatccatttatcctc

SEQ ID NO: 502976 - DNA, 20 bp, Artificial Sequence
  chemically synthesized
aatttcacttgtctacccat

SEQ ID NO: 502977 - DNA, 20 bp, Artificial Sequence
  chemically synthesized
atttaagcttcaaaaagaaa

SEQ ID NO: 502978 - DNA, 20 bp, Artificial Sequence
  chemically synthesized
gtagacttattttatgttta

SEQ ID NO: 502979 - DNA, 20 bp, Artificial Sequence
  chemically synthesized
gtaaacataaaataagtcta

SEQ ID NO: 502980 - DNA, 20 bp, Artificial Sequence
  chemically synthesized
cttgagaaagcttggatatg

SEQ ID NO: 502981 - DNA, 20 bp, Artificial Sequence
  chemically synthesized
tgaaggtaccttgagaaagc

SEQ ID NO: 502982 - DNA, 20 bp, Artificial Sequence
  chemically synthesized
ccggaaaaatttcactgact

SEQ ID NO: 502983 - DNA, 20 bp, Artificial Sequence
  chemically synthesized
tatgaacacatgtgcagtca

SEQ ID NO: 502984 - DNA, 20 bp, Artificial Sequence
  chemically synthesized
taaagtctaaactttaggca

SEQ ID NO: 502985 - DNA, 20 bp, Artificial Sequence
  chemically synthesized
taagtcgctgtctcctgata

SEQ ID NO: 502986 - DNA, 20 bp, Artificial Sequence
  chemically synthesized
cctgatatggaatagtgaga

SEQ ID NO: 502987 - DNA, 20 bp, Artificial Sequence
  chemically synthesized
gtgagacagaatcagattct

SEQ ID NO: 502988 - DNA, 20 bp, Artificial Sequence
  chemically synthesized
aatgctgaccaagtcatccc

SEQ ID NO: 502989 - DNA, 20 bp, Artificial Sequence
  chemically synthesized
tgagacaaaagtccaaatct

SEQ ID NO: 502990 - DNA, 20 bp, Artificial Sequence
  chemically synthesized
ctcagtatgctctctctcac

SEQ ID NO: 502991 - DNA, 20 bp, Artificial Sequence
  chemically synthesized
ttgtcacactactgtactga

SEQ ID NO: 502992 - DNA, 20 bp, Artificial Sequence
  chemically synthesized
cagtagtgtgacaaagatct

SEQ ID NO: 502993 - DNA, 20 bp, Artificial Sequence
  chemically synthesized
attcctaagtagagggacta

SEQ ID NO: 502994 - DNA, 20 bp, Artificial Sequence
  chemically synthesized
actcgttagtccctctactt

SEQ ID NO: 502995 - DNA, 20 bp, Artificial Sequence
  chemically synthesized
tgagtttctttcctgagagt

SEQ ID NO: 502996 - DNA, 20 bp, Artificial Sequence
  chemically synthesized
ctgtgttgagtttctttcct

SEQ ID NO: 502997 - DNA, 20 bp, Artificial Sequence
  chemically synthesized
agaaagccagagatgctgtg

SEQ ID NO: 502998 - DNA, 20 bp, Artificial Sequence
  chemically synthesized
ggtctataaaaggaagtgtg

SEQ ID NO: 502999 - DNA, 20 bp, Artificial Sequence
  chemically synthesized
cttccttttatagaccaggt

SEQ ID NO: 503000 - DNA, 20 bp, Artificial Sequence
  chemically synthesized
gatggccacacaggttgcct

SEQ ID NO: 503001 - DNA, 20 bp, Artificial Sequence
  chemically synthesized
atgtgcattagagatctctg

SEQ ID NO: 503002 - DNA, 20 bp, Artificial Sequence
  chemically synthesized
tgagcctacatcacagtaga

SEQ ID NO: 503003 - DNA, 20 bp, Artificial Sequence
  chemically synthesized
gagaacctgaacactggcct

SEQ ID NO: 503004 - DNA, 20 bp, Artificial Sequence
  chemically synthesized
ttctcttggactacagtgcc

SEQ ID NO: 503005 - DNA, 20 bp, Artificial Sequence
  chemically synthesized
aatttcaagttcgaaccaat

SEQ ID NO: 503006 - DNA, 20 bp, Artificial Sequence
  chemically synthesized
ggaaaaatgctcctctctcc

SEQ ID NO: 503007 - DNA, 20 bp, Artificial Sequence
  chemically synthesized
ttaatcttcatgtaattggg

SEQ ID NO: 503008 - DNA, 20 bp, Artificial Sequence
  chemically synthesized
tattgttaatcttcatgtaa

SEQ ID NO: 503009 - DNA, 20 bp, Artificial Sequence
  chemically synthesized
ccagagccatgacaatcatc

SEQ ID NO: 503010 - DNA, 20 bp, Artificial Sequence
  chemically synthesized
gaggactttttcaatgtagt

SEQ ID NO: 503011 - DNA, 20 bp, Artificial Sequence
  chemically synthesized
tattttgtcctccaagttgt

SEQ ID NO: 503012 - DNA, 20 bp, Artificial Sequence
  chemically synthesized
ttgtagaaaagaactcctac

SEQ ID NO: 503013 - DNA, 20 bp, Artificial Sequence
  chemically synthesized
tcagagccaaagatcctggt

SEQ ID NO: 503014 - DNA, 20 bp, Artificial Sequence
  chemically synthesized
ttggctctgatatgattcat

SEQ ID NO: 503015 - DNA, 20 bp, Artificial Sequence
  chemically synthesized
tctgatatgattcatttgga

SEQ ID NO: 503016 - DNA, 20 bp, Artificial Sequence
  chemically synthesized
aaggtgcacatcccatccaa

SEQ ID NO: 503017 - DNA, 20 bp, Artificial Sequence
  chemically synthesized
cctactcctaaagcactata

SEQ ID NO: 503018 - DNA, 20 bp, Artificial Sequence
  chemically synthesized
aacattctgtatagtgcttt

SEQ ID NO: 503019 - DNA, 20 bp, Artificial Sequence
  chemically synthesized
tagtgctttaggagtaggtt

SEQ ID NO: 503020 - DNA, 20 bp, Artificial Sequence
  chemically synthesized
ccctatgctcatataaacac

SEQ ID NO: 503021 - DNA, 20 bp, Artificial Sequence
  chemically synthesized
agggaacagataaacactgg

SEQ ID NO: 503022 - DNA, 20 bp, Artificial Sequence
  chemically synthesized
gatgaccctagtctgtaaca

SEQ ID NO: 503023 - DNA, 20 bp, Artificial Sequence
  chemically synthesized
atcgattccttgttacagac

SEQ ID NO: 503024 - DNA, 20 bp, Artificial Sequence
  chemically synthesized
acgatgagaagatgccattg

SEQ ID NO: 503025 - DNA, 20 bp, Artificial Sequence
  chemically synthesized
atagatgaaacccatcgtgc

SEQ ID NO: 503026 - DNA, 20 bp, Artificial Sequence
  chemically synthesized
tgccaaataattccagcacg

SEQ ID NO: 503027 - DNA, 20 bp, Artificial Sequence
  chemically synthesized
ggaattatttggcatgggag

SEQ ID NO: 503028 - DNA, 20 bp, Artificial Sequence
  chemically synthesized
cggtgtgacgctttaacttg

SEQ ID NO: 503029 - DNA, 20 bp, Artificial Sequence
  chemically synthesized
tgttccgtcaacattgtggt

SEQ ID NO: 503030 - DNA, 20 bp, Artificial Sequence
  chemically synthesized
ggagagaggtaatatataat

SEQ ID NO: 503031 - DNA, 20 bp, Artificial Sequence
  chemically synthesized
tgacacggaaagggcatcac

SEQ ID NO: 503032 - DNA, 20 bp, Artificial Sequence
  chemically synthesized
gccatagttccctgctgaag

SEQ ID NO: 503033 - DNA, 20 bp, Artificial Sequence
  chemically synthesized
tctgcttggtttagttgttg

SEQ ID NO: 503034 - DNA, 20 bp, Artificial Sequence
  chemically synthesized
ttggaaaggagcttcatttc

SEQ ID NO: 503035 - DNA, 20 bp, Artificial Sequence
  chemically synthesized
gtcatgagcagtggttgggc

SEQ ID NO: 503036 - DNA, 20 bp, Artificial Sequence
  chemically synthesized
ataaattactggtccacagt

SEQ ID NO: 503037 - DNA, 20 bp, Artificial Sequence
  chemically synthesized
tgataaaggtctatctagac

SEQ ID NO: 503038 - DNA, 20 bp, Artificial Sequence
  chemically synthesized
ctagactggggttcacaaac

SEQ ID NO: 503039 - DNA, 20 bp, Artificial Sequence
  chemically synthesized
tcacaaacctgaataatcat

SEQ ID NO: 503040 - DNA, 20 bp, Artificial Sequence
  chemically synthesized
tactaaattagaaaatcaga

SEQ ID NO: 503041 - DNA, 20 bp, Artificial Sequence
  chemically synthesized
aaaatcagagggagtcaaaa

SEQ ID NO: 503042 - DNA, 20 bp, Artificial Sequence
  chemically synthesized
caccaaaattacacagatag

SEQ ID NO: 503043 - DNA, 20 bp, Artificial Sequence
  chemically synthesized
cagcaaaaaagagcgaacag

SEQ ID NO: 503044 - DNA, 20 bp, Artificial Sequence
  chemically synthesized
aaattggtattaatgctggt

SEQ ID NO: 503045 - DNA, 20 bp, Artificial Sequence
  chemically synthesized
gaaagtatcaaagaaaattg

SEQ ID NO: 503046 - DNA, 20 bp, Artificial Sequence
  chemically synthesized
cagtgtccctagatggaatg

SEQ ID NO: 503047 - DNA, 20 bp, Artificial Sequence
  chemically synthesized
tgtattccagtgtccctaga

SEQ ID NO: 503048 - DNA, 20 bp, Artificial Sequence
  chemically synthesized
ctcattccatctagggacac

SEQ ID NO: 503049 - DNA, 20 bp, Artificial Sequence
  chemically synthesized
aaaaaatgataaatggaaaa

SEQ ID NO: 503050 - DNA, 20 bp, Artificial Sequence
  chemically synthesized
aacattttcagaaatttggc

SEQ ID NO: 503051 - DNA, 20 bp, Artificial Sequence
  chemically synthesized
agatttgattattcaatctc

SEQ ID NO: 503052 - DNA, 20 bp, Artificial Sequence
  chemically synthesized
tacttcatagattcttgaga

SEQ ID NO: 503053 - DNA, 20 bp, Artificial Sequence
  chemically synthesized
gaaaacggttttaaaaagtt

SEQ ID NO: 503054 - DNA, 20 bp, Artificial Sequence
  chemically synthesized
acgtaagatgaaagagagag

SEQ ID NO: 503055 - DNA, 20 bp, Artificial Sequence
  chemically synthesized
ataacacacaatactgttct

SEQ ID NO: 503056 - DNA, 20 bp, Artificial Sequence
  chemically synthesized
aacataaagatataaactcg

SEQ ID NO: 503057 - DNA, 20 bp, Artificial Sequence
  chemically synthesized
taccttttcagaaaaattcc

SEQ ID NO: 503058 - DNA, 20 bp, Artificial Sequence
  chemically synthesized
agcattttagtgataaattt

SEQ ID NO: 503059 - DNA, 20 bp, Artificial Sequence
  chemically synthesized
gtaaaagctaaatcagtagt

SEQ ID NO: 503060 - DNA, 20 bp, Artificial Sequence
  chemically synthesized
aaagttggaataacaaaaga

SEQ ID NO: 503061 - DNA, 20 bp, Artificial Sequence
  chemically synthesized
aaaaaaaagaataataaagt

SEQ ID NO: 503062 - DNA, 20 bp, Artificial Sequence
  chemically synthesized
gcctaccaaaaaaaaaaaaa

SEQ ID NO: 503063 - DNA, 20 bp, Artificial Sequence
  chemically synthesized
tgagttatttcttctgaagt

SEQ ID NO: 503064 - DNA, 20 bp, Artificial Sequence
  chemically synthesized
aatatctcataatttgatag

SEQ ID NO: 503065 - DNA, 20 bp, Artificial Sequence
  chemically synthesized
tgaagacaagataccattaa

SEQ ID NO: 503066 - DNA, 20 bp, Artificial Sequence
  chemically synthesized
gggcattaatatctttgtga

SEQ ID NO: 503067 - DNA, 20 bp, Artificial Sequence
  chemically synthesized
tggagggcattaatatcttt

SEQ ID NO: 503068 - DNA, 20 bp, Artificial Sequence
  chemically synthesized
aagagcaaacataatttgtc

SEQ ID NO: 503069 - DNA, 20 bp, Artificial Sequence
  chemically synthesized
gcaaacataatttgtctaga

SEQ ID NO: 503070 - DNA, 20 bp, Artificial Sequence
  chemically synthesized
ttatagaatattagcatttt

SEQ ID NO: 503071 - DNA, 20 bp, Artificial Sequence
  chemically synthesized
gttcgtctgtatgcctatta

SEQ ID NO: 503072 - DNA, 20 bp, Artificial Sequence
  chemically synthesized
ggaaacattattgattgaag

SEQ ID NO: 503073 - DNA, 20 bp, Artificial Sequence
  chemically synthesized
taaattatatctaaaaataa

SEQ ID NO: 503074 - DNA, 20 bp, Artificial Sequence
  chemically synthesized
tattttaatcaccatgaatc

SEQ ID NO: 503075 - DNA, 20 bp, Artificial Sequence
  chemically synthesized
taattcttattttaatcacc

SEQ ID NO: 503076 - DNA, 20 bp, Artificial Sequence
  chemically synthesized
tgattcatggtgattaaaat

SEQ ID NO: 503077 - DNA, 20 bp, Artificial Sequence
  chemically synthesized
ccttcacaaaagggtctgtg

SEQ ID NO: 503078 - DNA, 20 bp, Artificial Sequence
  chemically synthesized
agagtacatagccttcacaa

SEQ ID NO: 503079 - DNA, 20 bp, Artificial Sequence
  chemically synthesized
tttatagctacaggaactga

SEQ ID NO: 503080 - DNA, 20 bp, Artificial Sequence
  chemically synthesized
gttcctgtagctataaaata

SEQ ID NO: 503081 - DNA, 20 bp, Artificial Sequence
  chemically synthesized
tttaaaatattattaaaaac

SEQ ID NO: 503082 - DNA, 20 bp, Artificial Sequence
  chemically synthesized
cttgtcctaccatcaattgt

SEQ ID NO: 503083 - DNA, 20 bp, Artificial Sequence
  chemically synthesized
cttcttttgttatttgagaa

SEQ ID NO: 503084 - DNA, 20 bp, Artificial Sequence
  chemically synthesized
ttaatgtaagaaaaatagac

SEQ ID NO: 503085 - DNA, 20 bp, Artificial Sequence
  chemically synthesized
cattaaagaggtctgggcta

SEQ ID NO: 503086 - DNA, 20 bp, Artificial Sequence
  chemically synthesized
tatgtgtaaatattacacaa

SEQ ID NO: 503087 - DNA, 20 bp, Artificial Sequence
  chemically synthesized
tattaattgaataaatggtc

SEQ ID NO: 503088 - DNA, 20 bp, Artificial Sequence
  chemically synthesized
tgttctcataataatattaa

SEQ ID NO: 503089 - DNA, 20 bp, Artificial Sequence
  chemically synthesized
aaggtgactgcaattttcag

SEQ ID NO: 503090 - DNA, 20 bp, Artificial Sequence
  chemically synthesized
gaatcttgacttctcctagg

SEQ ID NO: 503091 - DNA, 20 bp, Artificial Sequence
  chemically synthesized
taaaaaggatattggatatc

SEQ ID NO: 503092 - DNA, 20 bp, Artificial Sequence
  chemically synthesized
cttaagtagtaaaaaggata

SEQ ID NO: 503093 - DNA, 20 bp, Artificial Sequence
  chemically synthesized
ttctttccttaagtagtaaa

SEQ ID NO: 503094 - DNA, 20 bp, Artificial Sequence
  chemically synthesized
ctacttaaggaaagaaagcc

SEQ ID NO: 503095 - DNA, 20 bp, Artificial Sequence
  chemically synthesized
ggtttacatctttccatact

SEQ ID NO: 503096 - DNA, 20 bp, Artificial Sequence
  chemically synthesized
ttattcttagtgtgttaata

SEQ ID NO: 503097 - DNA, 20 bp, Artificial Sequence
  chemically synthesized
atatccattattaacacact

SEQ ID NO: 503098 - DNA, 20 bp, Artificial Sequence
  chemically synthesized
ttacttgaaaatatttcatt

SEQ ID NO: 503099 - DNA, 20 bp, Artificial Sequence
  chemically synthesized
aaatgcttttgataaggttt

SEQ ID NO: 503100 - DNA, 20 bp, Artificial Sequence
  chemically synthesized
gcatggctttgaagccaatt

SEQ ID NO: 503101 - DNA, 20 bp, Artificial Sequence
  chemically synthesized
aagcatgggctctcctaagc

SEQ ID NO: 503102 - DNA, 20 bp, Artificial Sequence
  chemically synthesized
catcttacaatgcttaattt

SEQ ID NO: 503103 - DNA, 20 bp, Artificial Sequence
  chemically synthesized
ctcagggaagaaagaaaata

SEQ ID NO: 503104 - DNA, 20 bp, Artificial Sequence
  chemically synthesized
cccagtattttctttcttcc

SEQ ID NO: 503105 - DNA, 20 bp, Artificial Sequence
  chemically synthesized
ggctgtttttcccaaaatgt

SEQ ID NO: 503106 - DNA, 20 bp, Artificial Sequence
  chemically synthesized
taaaagactgacataaaaat

SEQ ID NO: 503107 - DNA, 20 bp, Artificial Sequence
  chemically synthesized
ttaccgccagtatgtcaaat

SEQ ID NO: 503108 - DNA, 20 bp, Artificial Sequence
  chemically synthesized
gacatactggcggtaaccag

SEQ ID NO: 503109 - DNA, 20 bp, Artificial Sequence
  chemically synthesized
cagatgaatgacttgcaaat

SEQ ID NO: 503110 - DNA, 20 bp, Artificial Sequence
  chemically synthesized
tggaagaagatacttcagac

SEQ ID NO: 503111 - DNA, 20 bp, Artificial Sequence
  chemically synthesized
gactagaatcctagttgttt

SEQ ID NO: 503112 - DNA, 20 bp, Artificial Sequence
  chemically synthesized
tgattatattctgaaacaac

SEQ ID NO: 503113 - DNA, 20 bp, Artificial Sequence
  chemically synthesized
gcatagaaaatcaaaagcga

SEQ ID NO: 503114 - DNA, 20 bp, Artificial Sequence
  chemically synthesized
gataactgattatttccatt

SEQ ID NO: 503115 - DNA, 20 bp, Artificial Sequence
  chemically synthesized
aataacttcattggctacta

SEQ ID NO: 503116 - DNA, 20 bp, Artificial Sequence
  chemically synthesized
taaaatcaggagaagtgtta

SEQ ID NO: 503117 - DNA, 20 bp, Artificial Sequence
  chemically synthesized
aacacttctcctgattttaa

SEQ ID NO: 503118 - DNA, 20 bp, Artificial Sequence
  chemically synthesized
aaatgagagtgaaaagtatt

SEQ ID NO: 503119 - DNA, 20 bp, Artificial Sequence
  chemically synthesized
actggtgtcattgaggaaat

SEQ ID NO: 503120 - DNA, 20 bp, Artificial Sequence
  chemically synthesized
ttaggactctgcacggtaaa

SEQ ID NO: 503121 - DNA, 20 bp, Artificial Sequence
  chemically synthesized
tcccaaccccctttaccgtg

SEQ ID NO: 503122 - DNA, 20 bp, Artificial Sequence
  chemically synthesized
agtcctaaacaacctgaaaa

SEQ ID NO: 503123 - DNA, 20 bp, Artificial Sequence
  chemically synthesized
aacagagttacctacttctc

SEQ ID NO: 503124 - DNA, 20 bp, Artificial Sequence
  chemically synthesized
cagggataaatttatccttg

SEQ ID NO: 503125 - DNA, 20 bp, Artificial Sequence
  chemically synthesized
tttgagaaagtttatccacc

SEQ ID NO: 503126 - DNA, 20 bp, Artificial Sequence
  chemically synthesized
tacaaggaggttctgaggtg

SEQ ID NO: 503127 - DNA, 20 bp, Artificial Sequence
  chemically synthesized
tacacgagcaaaaaaaatgg

SEQ ID NO: 503128 - DNA, 20 bp, Artificial Sequence
  chemically synthesized
aagagcaaagtcttacaaga

SEQ ID NO: 503129 - DNA, 20 bp, Artificial Sequence
  chemically synthesized
ttatatattatgtctttcta

SEQ ID NO: 503130 - DNA, 20 bp, Artificial Sequence
  chemically synthesized
aaagatgtgttgttgatttt

SEQ ID NO: 503131 - DNA, 20 bp, Artificial Sequence
  chemically synthesized
agaaaggccagtaactgaaa

SEQ ID NO: 503132 - DNA, 20 bp, Artificial Sequence
  chemically synthesized
agtcacatagaccaatgaaa

SEQ ID NO: 503133 - DNA, 20 bp, Artificial Sequence
  chemically synthesized
tcggctttgtcgaagatcag

SEQ ID NO: 503134 - DNA, 20 bp, Artificial Sequence
  chemically synthesized
ccagcaccatttatggaata

SEQ ID NO: 503135 - DNA, 20 bp, Artificial Sequence
  chemically synthesized
agttatcccagcaccattta

SEQ ID NO: 503136 - DNA, 20 bp, Artificial Sequence
  chemically synthesized
ccctattccataaatggtgc

SEQ ID NO: 503137 - DNA, 20 bp, Artificial Sequence
  chemically synthesized
aactggctaaccgtatacag

SEQ ID NO: 503138 - DNA, 20 bp, Artificial Sequence
  chemically synthesized
tatacaaaaatcaactcaag

SEQ ID NO: 503139 - DNA, 20 bp, Artificial Sequence
  chemically synthesized
ttttaagtctttcattcatc

SEQ ID NO: 503140 - DNA, 20 bp, Artificial Sequence
  chemically synthesized
gcaaaactttaaaaaccctg

SEQ ID NO: 503141 - DNA, 20 bp, Artificial Sequence
  chemically synthesized
gtattgcctaggttatcctc

SEQ ID NO: 503142 - DNA, 20 bp, Artificial Sequence
  chemically synthesized
ggcaataccatcctggacat

SEQ ID NO: 503143 - DNA, 20 bp, Artificial Sequence
  chemically synthesized
tcttttcccattcctatgtc

SEQ ID NO: 503144 - DNA, 20 bp, Artificial Sequence
  chemically synthesized
taaattacacaacttcctca

SEQ ID NO: 503145 - DNA, 20 bp, Artificial Sequence
  chemically synthesized
cctctgttgaactctgtcaa

SEQ ID NO: 503146 - DNA, 20 bp, Artificial Sequence
  chemically synthesized
ttgtctgtttactctgttga

SEQ ID NO: 503147 - DNA, 20 bp, Artificial Sequence
  chemically synthesized
ggagaaatattttgcaaact

SEQ ID NO: 503148 - DNA, 20 bp, Artificial Sequence
  chemically synthesized
tctgataaaggtttaacatc

SEQ ID NO: 503149 - DNA, 20 bp, Artificial Sequence
  chemically synthesized
gtttaagttacttagagatt

SEQ ID NO: 503150 - DNA, 20 bp, Artificial Sequence
  chemically synthesized
tttgcccatttttaatggag

SEQ ID NO: 503151 - DNA, 20 bp, Artificial Sequence
  chemically synthesized
tgtcctttgcccatttttaa

SEQ ID NO: 503152 - DNA, 20 bp, Artificial Sequence
  chemically synthesized
caaaaaataacagatgctgt

SEQ ID NO: 503153 - DNA, 20 bp, Artificial Sequence
  chemically synthesized
aacatttatacactgctggt

SEQ ID NO: 503154 - DNA, 20 bp, Artificial Sequence
  chemically synthesized
agaacacagcaaccccatta

SEQ ID NO: 503155 - DNA, 20 bp, Artificial Sequence
  chemically synthesized
tttggctatacacccggtaa

SEQ ID NO: 503156 - DNA, 20 bp, Artificial Sequence
  chemically synthesized
attaccgggtgtatagccaa

SEQ ID NO: 503157 - DNA, 20 bp, Artificial Sequence
  chemically synthesized
gattctgtatctttgctatt

SEQ ID NO: 503158 - DNA, 20 bp, Artificial Sequence
  chemically synthesized
tattcacaatagcaaagata

SEQ ID NO: 503159 - DNA, 20 bp, Artificial Sequence
  chemically synthesized
actacgcagccacaaaaaga

SEQ ID NO: 503160 - DNA, 20 bp, Artificial Sequence
  chemically synthesized
tcctgcattagtttgctaag

SEQ ID NO: 503161 - DNA, 20 bp, Artificial Sequence
  chemically synthesized
ataagtgggagctaaataat

SEQ ID NO: 503162 - DNA, 20 bp, Artificial Sequence
  chemically synthesized
acacaatgagggaacagaca

SEQ ID NO: 503163 - DNA, 20 bp, Artificial Sequence
  chemically synthesized
acagacactgggtcctactt

SEQ ID NO: 503164 - DNA, 20 bp, Artificial Sequence
  chemically synthesized
ctgggtcctacttgaggata

SEQ ID NO: 503165 - DNA, 20 bp, Artificial Sequence
  chemically synthesized
atagagaatgggaggaaggg

SEQ ID NO: 503166 - DNA, 20 bp, Artificial Sequence
  chemically synthesized
tcaggtagtatgcttattac

SEQ ID NO: 503167 - DNA, 20 bp, Artificial Sequence
  chemically synthesized
caggtaaacagtgtgtcatg

SEQ ID NO: 503168 - DNA, 20 bp, Artificial Sequence
  chemically synthesized
tgttgttttacttttatgtt

SEQ ID NO: 503169 - DNA, 20 bp, Artificial Sequence
  chemically synthesized
aaaggctggtaaagaaagac

SEQ ID NO: 503170 - DNA, 20 bp, Artificial Sequence
  chemically synthesized
gttttggtatgagaaatttc

SEQ ID NO: 503171 - DNA, 20 bp, Artificial Sequence
  chemically synthesized
cagaggtggagaaaacggtg

SEQ ID NO: 503172 - DNA, 20 bp, Artificial Sequence
  chemically synthesized
gctttgataggagctgtcat

SEQ ID NO: 503173 - DNA, 20 bp, Artificial Sequence
  chemically synthesized
gtcatctgagtatgttaagt

SEQ ID NO: 503174 - DNA, 20 bp, Artificial Sequence
  chemically synthesized
tctattgtgtatttttctct

SEQ ID NO: 503175 - DNA, 20 bp, Artificial Sequence
  chemically synthesized
gaaaaatacacaatagaagg

SEQ ID NO: 503176 - DNA, 20 bp, Artificial Sequence
  chemically synthesized
tgtgccagagataatatttt

SEQ ID NO: 503177 - DNA, 20 bp, Artificial Sequence
  chemically synthesized
acactgcataaagtattata

SEQ ID NO: 503178 - DNA, 20 bp, Artificial Sequence
  chemically synthesized
tgcataaagtattataaaga

SEQ ID NO: 503179 - DNA, 20 bp, Artificial Sequence
  chemically synthesized
aaacactgtttcatacacac

SEQ ID NO: 503180 - DNA, 20 bp, Artificial Sequence
  chemically synthesized
tgaaacaaattattggccaa

SEQ ID NO: 503181 - DNA, 20 bp, Artificial Sequence
  chemically synthesized
atttatgactgaaattggca

SEQ ID NO: 503182 - DNA, 20 bp, Artificial Sequence
  chemically synthesized
atattgccttgtatgttcta

SEQ ID NO: 503183 - DNA, 20 bp, Artificial Sequence
  chemically synthesized
ctactgagtttgttgatgac

SEQ ID NO: 503184 - DNA, 20 bp, Artificial Sequence
  chemically synthesized
caaatttgaacacactttct

SEQ ID NO: 503185 - DNA, 20 bp, Artificial Sequence
  chemically synthesized
cctagaaagtgtgttcaaat

SEQ ID NO: 503186 - DNA, 20 bp, Artificial Sequence
  chemically synthesized
ttgctacaaaaatgatggaa

SEQ ID NO: 503187 - DNA, 20 bp, Artificial Sequence
  chemically synthesized
tgaaatggatgaatttctag

SEQ ID NO: 503188 - DNA, 20 bp, Artificial Sequence
  chemically synthesized
tagaaacttacatgaaatgg

SEQ ID NO: 503189 - DNA, 20 bp, Artificial Sequence
  chemically synthesized
agtttagaaacttacatgaa

SEQ ID NO: 503190 - DNA, 20 bp, Artificial Sequence
  chemically synthesized
aaaaacaaatataaaatctt

SEQ ID NO: 503191 - DNA, 20 bp, Artificial Sequence
  chemically synthesized
ttgatttgtctaattaaaac

SEQ ID NO: 503192 - DNA, 20 bp, Artificial Sequence
  chemically synthesized
agaaataaataaaaacaaca

SEQ ID NO: 503193 - DNA, 20 bp, Artificial Sequence
  chemically synthesized
gtttttatttatttctgctc

SEQ ID NO: 503194 - DNA, 20 bp, Artificial Sequence
  chemically synthesized
gagaaagtaaatggaaagag

SEQ ID NO: 503195 - DNA, 20 bp, Artificial Sequence
  chemically synthesized
ttttattatcactcggttct

SEQ ID NO: 503196 - DNA, 20 bp, Artificial Sequence
  chemically synthesized
gatggttaaaattcatagaa

SEQ ID NO: 503197 - DNA, 20 bp, Artificial Sequence
  chemically synthesized
atgaattttaaccatccatt

SEQ ID NO: 503198 - DNA, 20 bp, Artificial Sequence
  chemically synthesized
ggatcaaagatgaattcaaa

SEQ ID NO: 503199 - DNA, 20 bp, Artificial Sequence
  chemically synthesized
aaataatttgtggatcaaag

SEQ ID NO: 503200 - DNA, 20 bp, Artificial Sequence
  chemically synthesized
ttgactaaagtaaataattt

SEQ ID NO: 503201 - DNA, 20 bp, Artificial Sequence
  chemically synthesized
ctcttaaatttgtaacaagc

SEQ ID NO: 503202 - DNA, 20 bp, Artificial Sequence
  chemically synthesized
ttctagcttgttacaaattt

SEQ ID NO: 503203 - DNA, 20 bp, Artificial Sequence
  chemically synthesized
atgaaatttacactctgatt

SEQ ID NO: 503204 - DNA, 20 bp, Artificial Sequence
  chemically synthesized
ctgtatagagaaccccaaat

SEQ ID NO: 503205 - DNA, 20 bp, Artificial Sequence
  chemically synthesized
gatgattaacagttgataag

SEQ ID NO: 503206 - DNA, 20 bp, Artificial Sequence
  chemically synthesized
gtatttcttcttgttattct

SEQ ID NO: 503207 - DNA, 20 bp, Artificial Sequence
  chemically synthesized
acacgtaaagcaaaaatcca

SEQ ID NO: 503208 - DNA, 20 bp, Artificial Sequence
  chemically synthesized
gatttttttgtttcttttga

SEQ ID NO: 503209 - DNA, 20 bp, Artificial Sequence
  chemically synthesized
ctccactccagcctgggtta

SEQ ID NO: 503210 - DNA, 20 bp, Artificial Sequence
  chemically synthesized
tctcactccgtaacccaggc

SEQ ID NO: 503211 - DNA, 20 bp, Artificial Sequence
  chemically synthesized
attgcagtctccactccagc

SEQ ID NO: 503212 - DNA, 20 bp, Artificial Sequence
  chemically synthesized
ggctgaggtgggagaattgc

SEQ ID NO: 503213 - DNA, 20 bp, Artificial Sequence
  chemically synthesized
tgcttgggaggctgaggtgg

SEQ ID NO: 503214 - DNA, 20 bp, Artificial Sequence
  chemically synthesized
ttttgtatttttagcagaga

SEQ ID NO: 503215 - DNA, 20 bp, Artificial Sequence
  chemically synthesized
tgggtggctcacctgaggtc

SEQ ID NO: 503216 - DNA, 20 bp, Artificial Sequence
  chemically synthesized
cagcactttgagaggccgag

SEQ ID NO: 503217 - DNA, 20 bp, Artificial Sequence
  chemically synthesized
acctcggcctctcaaagtgc

SEQ ID NO: 503218 - DNA, 20 bp, Artificial Sequence
  chemically synthesized
tatcattattaggcaaaaaa

SEQ ID NO: 503219 - DNA, 20 bp, Artificial Sequence
  chemically synthesized
atggaaacagattttccgaa

SEQ ID NO: 503220 - DNA, 20 bp, Artificial Sequence
  chemically synthesized
tttcttaaaaacaatgtatt

SEQ ID NO: 503221 - DNA, 20 bp, Artificial Sequence
  chemically synthesized
tatataaatgtagaaatttt

SEQ ID NO: 503222 - DNA, 20 bp, Artificial Sequence
  chemically synthesized
ttttttttttttttttgagg

SEQ ID NO: 503223 - DNA, 20 bp, Artificial Sequence
  chemically synthesized
ttttgctctttcacccagtc

SEQ ID NO: 503224 - DNA, 20 bp, Artificial Sequence
  chemically synthesized
tcatgccatttcactccaga

SEQ ID NO: 503225 - DNA, 20 bp, Artificial Sequence
  chemically synthesized
ctcactgcaacttccgttcc

SEQ ID NO: 503226 - DNA, 20 bp, Artificial Sequence
  chemically synthesized
tactcgggaggctgagacag

SEQ ID NO: 503227 - DNA, 20 bp, Artificial Sequence
  chemically synthesized
gattctcctgtctcagcctc

SEQ ID NO: 503228 - DNA, 20 bp, Artificial Sequence
  chemically synthesized
gtctcagcctcccgagtagt

SEQ ID NO: 503229 - DNA, 20 bp, Artificial Sequence
  chemically synthesized
aaaagtatccaggcttggtg

SEQ ID NO: 503230 - DNA, 20 bp, Artificial Sequence
  chemically synthesized
ataggcacccaccaccaagc

SEQ ID NO: 503231 - DNA, 20 bp, Artificial Sequence
  chemically synthesized
ccaagcctggatactttttt

SEQ ID NO: 503232 - DNA, 20 bp, Artificial Sequence
  chemically synthesized
gccttggcctcccaaagtgc

SEQ ID NO: 503233 - DNA, 20 bp, Artificial Sequence
  chemically synthesized
atccacctgggaaacaatca

SEQ ID NO: 503234 - DNA, 20 bp, Artificial Sequence
  chemically synthesized
attctttgattgtttcccag

SEQ ID NO: 503235 - DNA, 20 bp, Artificial Sequence
  chemically synthesized
ttatgctgtaataaattgtc

SEQ ID NO: 503236 - DNA, 20 bp, Artificial Sequence
  chemically synthesized
caagcccttttatttagaaa

SEQ ID NO: 503237 - DNA, 20 bp, Artificial Sequence
  chemically synthesized
agattaaaaacaatatggag

SEQ ID NO: 503238 - DNA, 20 bp, Artificial Sequence
  chemically synthesized
atttgttgcaaaaaatatat

SEQ ID NO: 503239 - DNA, 20 bp, Artificial Sequence
  chemically synthesized
aaatgtctaaaataagtatg

SEQ ID NO: 503240 - DNA, 20 bp, Artificial Sequence
  chemically synthesized
attttagacatttttatagt

SEQ ID NO: 503241 - DNA, 20 bp, Artificial Sequence
  chemically synthesized
tttttatagtaagggtctat

SEQ ID NO: 503242 - DNA, 20 bp, Artificial Sequence
  chemically synthesized
aagaggaaattagacattat

SEQ ID NO: 503243 - DNA, 20 bp, Artificial Sequence
  chemically synthesized
actcaacaaaattagttctt

SEQ ID NO: 503244 - DNA, 20 bp, Artificial Sequence
  chemically synthesized
actctgaagaactaattttg

SEQ ID NO: 503245 - DNA, 20 bp, Artificial Sequence
  chemically synthesized
agaactaattttgttgagtt

SEQ ID NO: 503246 - DNA, 20 bp, Artificial Sequence
  chemically synthesized
tgaaaaaattaccgtcaacc

SEQ ID NO: 503247 - DNA, 20 bp, Artificial Sequence
  chemically synthesized
tcttatctacaacaatgaat

SEQ ID NO: 503248 - DNA, 20 bp, Artificial Sequence
  chemically synthesized
tagacttcttatctacaaca

SEQ ID NO: 503249 - DNA, 20 bp, Artificial Sequence
  chemically synthesized
tattagcagctagaggtgag

SEQ ID NO: 503250 - DNA, 20 bp, Artificial Sequence
  chemically synthesized
ctgctaatataaatttgtct

SEQ ID NO: 503251 - DNA, 20 bp, Artificial Sequence
  chemically synthesized
tcactgtgatatgtctgaga

SEQ ID NO: 503252 - DNA, 20 bp, Artificial Sequence
  chemically synthesized
tggagatggagtaatatatg

SEQ ID NO: 503253 - DNA, 20 bp, Artificial Sequence
  chemically synthesized
atttttttgagaaatggaga

SEQ ID NO: 503254 - DNA, 20 bp, Artificial Sequence
  chemically synthesized
taattaacatacacaagttg

SEQ ID NO: 503255 - DNA, 20 bp, Artificial Sequence
  chemically synthesized
ggaggaaagttttggagatg

SEQ ID NO: 503256 - DNA, 20 bp, Artificial Sequence
  chemically synthesized
ttacagaataataataatat

SEQ ID NO: 503257 - DNA, 20 bp, Artificial Sequence
  chemically synthesized
ttatgttaagtgttctgtta

SEQ ID NO: 503258 - DNA, 20 bp, Artificial Sequence
  chemically synthesized
atttacttaaactttgctaa

SEQ ID NO: 503259 - DNA, 20 bp, Artificial Sequence
  chemically synthesized
atgctttacagtagatctct

SEQ ID NO: 503260 - DNA, 20 bp, Artificial Sequence
  chemically synthesized
aaatggagagatatttgtaa

SEQ ID NO: 503261 - DNA, 20 bp, Artificial Sequence
  chemically synthesized
aaactaatggaaggagaatg

SEQ ID NO: 503262 - DNA, 20 bp, Artificial Sequence
  chemically synthesized
tacagtcaaactaatggaag

SEQ ID NO: 503263 - DNA, 20 bp, Artificial Sequence
  chemically synthesized
tacatgatcccaatcatatt

SEQ ID NO: 503264 - DNA, 20 bp, Artificial Sequence
  chemically synthesized
tattagattcataatatgat

SEQ ID NO: 503265 - DNA, 20 bp, Artificial Sequence
  chemically synthesized
taccatttcgctgtaacaac

SEQ ID NO: 503266 - DNA, 20 bp, Artificial Sequence
  chemically synthesized
atgttgttacagcgaaatgg

SEQ ID NO: 503267 - DNA, 20 bp, Artificial Sequence
  chemically synthesized
atttgcttattttttaaggg

SEQ ID NO: 503268 - DNA, 20 bp, Artificial Sequence
  chemically synthesized
aataatgctgcaataaacaa

SEQ ID NO: 503269 - DNA, 20 bp, Artificial Sequence
  chemically synthesized
atatccaaaggaaattgaat

SEQ ID NO: 503270 - DNA, 20 bp, Artificial Sequence
  chemically synthesized
tgattctcattcaatttcct

SEQ ID NO: 503271 - DNA, 20 bp, Artificial Sequence
  chemically synthesized
agggatatatccaaaggaaa

SEQ ID NO: 503272 - DNA, 20 bp, Artificial Sequence
  chemically synthesized
tttggatatatccctagaag

SEQ ID NO: 503273 - DNA, 20 bp, Artificial Sequence
  chemically synthesized
gatccagcaattccacttct

SEQ ID NO: 503274 - DNA, 20 bp, Artificial Sequence
  chemically synthesized
tatccctagaagtggaattg

SEQ ID NO: 503275 - DNA, 20 bp, Artificial Sequence
  chemically synthesized
ctcaaaaaaaaaattaaaaa

SEQ ID NO: 503276 - DNA, 20 bp, Artificial Sequence
  chemically synthesized
tatttttaattttttttttg

SEQ ID NO: 503277 - DNA, 20 bp, Artificial Sequence
  chemically synthesized
ctgttttccatagtgtcagc

SEQ ID NO: 503278 - DNA, 20 bp, Artificial Sequence
  chemically synthesized
tgaattaacattcctgccat

SEQ ID NO: 503279 - DNA, 20 bp, Artificial Sequence
  chemically synthesized
gccccttgtaccctgatggc

SEQ ID NO: 503280 - DNA, 20 bp, Artificial Sequence
  chemically synthesized
caagagatgacaagtttggc

SEQ ID NO: 503281 - DNA, 20 bp, Artificial Sequence
  chemically synthesized
atatatgtcttcacatctgt

SEQ ID NO: 503282 - DNA, 20 bp, Artificial Sequence
  chemically synthesized
ttacatagccctgatgatta

SEQ ID NO: 503283 - DNA, 20 bp, Artificial Sequence
  chemically synthesized
ctcaactgctcatttttaaa

SEQ ID NO: 503284 - DNA, 20 bp, Artificial Sequence
  chemically synthesized
ggttatataatttttttata

SEQ ID NO: 503285 - DNA, 20 bp, Artificial Sequence
  chemically synthesized
caatgggagttttcaaagag

SEQ ID NO: 503286 - DNA, 20 bp, Artificial Sequence
  chemically synthesized
aacatataacttatctcaat

SEQ ID NO: 503287 - DNA, 20 bp, Artificial Sequence
  chemically synthesized
atagatacaggggtggggag

SEQ ID NO: 503288 - DNA, 20 bp, Artificial Sequence
  chemically synthesized
aggtaatagatacaggggtg

SEQ ID NO: 503289 - DNA, 20 bp, Artificial Sequence
  chemically synthesized
gaacaataggtaatagatac

SEQ ID NO: 503290 - DNA, 20 bp, Artificial Sequence
  chemically synthesized
gatttaaaagaaaactaaaa

SEQ ID NO: 503291 - DNA, 20 bp, Artificial Sequence
  chemically synthesized
ctacaattaaaaattagaaa

SEQ ID NO: 503292 - DNA, 20 bp, Artificial Sequence
  chemically synthesized
aaaagaaaacattgtaaaaa

SEQ ID NO: 503293 - DNA, 20 bp, Artificial Sequence
  chemically synthesized
catcttgcaattctaatatc

SEQ ID NO: 503294 - DNA, 20 bp, Artificial Sequence
  chemically synthesized
acttctagaattccggatat

SEQ ID NO: 503295 - DNA, 20 bp, Artificial Sequence
  chemically synthesized
gtgagtttacttctagaatt

SEQ ID NO: 503296 - DNA, 20 bp, Artificial Sequence
  chemically synthesized
acgaacggtgagtttacttc

SEQ ID NO: 503297 - DNA, 20 bp, Artificial Sequence
  chemically synthesized
gtcagcctatacaacgaacg

SEQ ID NO: 503298 - DNA, 20 bp, Artificial Sequence
  chemically synthesized
tgagggcttttcttgtgcgt

SEQ ID NO: 503299 - DNA, 20 bp, Artificial Sequence
  chemically synthesized
ggcttttcttgtgcgtgtga

SEQ ID NO: 503300 - DNA, 20 bp, Artificial Sequence
  chemically synthesized
tatgatgagctcaagttccc

SEQ ID NO: 503301 - DNA, 20 bp, Artificial Sequence
  chemically synthesized
atccaaacaagtgattaagt

SEQ ID NO: 503302 - DNA, 20 bp, Artificial Sequence
  chemically synthesized
accctgacttaatcacttgt

SEQ ID NO: 503303 - DNA, 20 bp, Artificial Sequence
  chemically synthesized
cttgagtgtatattatcaca

SEQ ID NO: 503304 - DNA, 20 bp, Artificial Sequence
  chemically synthesized
ctttgtgataatatacactc

SEQ ID NO: 503305 - DNA, 20 bp, Artificial Sequence
  chemically synthesized
tcttgtaaggtgaggaactc

SEQ ID NO: 503306 - DNA, 20 bp, Artificial Sequence
  chemically synthesized
tcaagagttcctcaccttac

SEQ ID NO: 503307 - DNA, 20 bp, Artificial Sequence
  chemically synthesized
tcactgtgagtgcaaagtaa

SEQ ID NO: 503308 - DNA, 20 bp, Artificial Sequence
  chemically synthesized
aagacatctgtcttctcact

SEQ ID NO: 503309 - DNA, 20 bp, Artificial Sequence
  chemically synthesized
atgtttgttctctctgcaga

SEQ ID NO: 503310 - DNA, 20 bp, Artificial Sequence
  chemically synthesized
tcagtaagataatgggcaga

SEQ ID NO: 503311 - DNA, 20 bp, Artificial Sequence
  chemically synthesized
acacagattccacataaaac

SEQ ID NO: 503312 - DNA, 20 bp, Artificial Sequence
  chemically synthesized
gatagaaccccagttttatg

SEQ ID NO: 503313 - DNA, 20 bp, Artificial Sequence
  chemically synthesized
tccaccattttcgtgagcca

SEQ ID NO: 503314 - DNA, 20 bp, Artificial Sequence
  chemically synthesized
tgacttaattcacctaaaat

SEQ ID NO: 503315 - DNA, 20 bp, Artificial Sequence
  chemically synthesized
actgggaaccccaattttag

SEQ ID NO: 503316 - DNA, 20 bp, Artificial Sequence
  chemically synthesized
taatgccctctggaaagcac

SEQ ID NO: 503317 - DNA, 20 bp, Artificial Sequence
  chemically synthesized
tctatttcataaagcaaatg

SEQ ID NO: 503318 - DNA, 20 bp, Artificial Sequence
  chemically synthesized
ttttcctggtaattatgact

SEQ ID NO: 503319 - DNA, 20 bp, Artificial Sequence
  chemically synthesized
aaaaattaatacggccctct

SEQ ID NO: 503320 - DNA, 20 bp, Artificial Sequence
  chemically synthesized
cataaatgttactattacag

SEQ ID NO: 503321 - DNA, 20 bp, Artificial Sequence
  chemically synthesized
agcctttaccacttctcttg

SEQ ID NO: 503322 - DNA, 20 bp, Artificial Sequence
  chemically synthesized
tgactaattaaaataaaatt

SEQ ID NO: 503323 - DNA, 20 bp, Artificial Sequence
  chemically synthesized
ataagtgaatatggcaatta

SEQ ID NO: 503324 - DNA, 20 bp, Artificial Sequence
  chemically synthesized
ttgccatattcacttattag

SEQ ID NO: 503325 - DNA, 20 bp, Artificial Sequence
  chemically synthesized
aataaaaactctgctaataa

SEQ ID NO: 503326 - DNA, 20 bp, Artificial Sequence
  chemically synthesized
ttttatttttaatatatgaa

SEQ ID NO: 503327 - DNA, 20 bp, Artificial Sequence
  chemically synthesized
taggcttcaagtgtaaagag

SEQ ID NO: 503328 - DNA, 20 bp, Artificial Sequence
  chemically synthesized
tcccattctacagaaattga

SEQ ID NO: 503329 - DNA, 20 bp, Artificial Sequence
  chemically synthesized
taatatcctttcaatttctg

SEQ ID NO: 503330 - DNA, 20 bp, Artificial Sequence
  chemically synthesized
cctttcaatttctgtagaat

SEQ ID NO: 503331 - DNA, 20 bp, Artificial Sequence
  chemically synthesized
tatgaaaaaccatatatcgg

SEQ ID NO: 503332 - DNA, 20 bp, Artificial Sequence
  chemically synthesized
gcctcggcctcccaaagtgc

SEQ ID NO: 503333 - DNA, 20 bp, Artificial Sequence
  chemically synthesized
actttgggaggccgaggcgg

SEQ ID NO: 503334 - DNA, 20 bp, Artificial Sequence
  chemically synthesized
gcctcagcctcccgagtagc

SEQ ID NO: 503335 - DNA, 20 bp, Artificial Sequence
  chemically synthesized
gattatcttgcctcagcctc

SEQ ID NO: 503336 - DNA, 20 bp, Artificial Sequence
  chemically synthesized
ctcactgcaacctcctcctc

SEQ ID NO: 503337 - DNA, 20 bp, Artificial Sequence
  chemically synthesized
tgttgcccaggctagagtac

SEQ ID NO: 503338 - DNA, 20 bp, Artificial Sequence
  chemically synthesized
tctttccctgttgcccaggc

SEQ ID NO: 503339 - DNA, 20 bp, Artificial Sequence
  chemically synthesized
tgttttttctttttttgaga

SEQ ID NO: 503340 - DNA, 20 bp, Artificial Sequence
  chemically synthesized
aatgcatatctgacaattaa

SEQ ID NO: 503341 - DNA, 20 bp, Artificial Sequence
  chemically synthesized
tgatttagtaatacaacaaa

SEQ ID NO: 503342 - DNA, 20 bp, Artificial Sequence
  chemically synthesized
gctgcttggttaccctgtta

SEQ ID NO: 503343 - DNA, 20 bp, Artificial Sequence
  chemically synthesized
gtaatagctttattctctaa

SEQ ID NO: 503344 - DNA, 20 bp, Artificial Sequence
  chemically synthesized
ccatctttcaaatcattact

SEQ ID NO: 503345 - DNA, 20 bp, Artificial Sequence
  chemically synthesized
tatagtgctatatgattatc

SEQ ID NO: 503346 - DNA, 20 bp, Artificial Sequence
  chemically synthesized
ggaaataatttattacttat

SEQ ID NO: 503347 - DNA, 20 bp, Artificial Sequence
  chemically synthesized
cccatccctaatttcagagt

SEQ ID NO: 503348 - DNA, 20 bp, Artificial Sequence
  chemically synthesized
caaactcacactctgaaatt

SEQ ID NO: 503349 - DNA, 20 bp, Artificial Sequence
  chemically synthesized
ctagatcccatccctaattt

SEQ ID NO: 503350 - DNA, 20 bp, Artificial Sequence
  chemically synthesized
tcacactctgaaattaggga

SEQ ID NO: 503351 - DNA, 20 bp, Artificial Sequence
  chemically synthesized
cagccagacttttattgcct

SEQ ID NO: 503352 - DNA, 20 bp, Artificial Sequence
  chemically synthesized
ttgactgatttaacaggcaa

SEQ ID NO: 503353 - DNA, 20 bp, Artificial Sequence
  chemically synthesized
agcaaatctggctgaggcag

SEQ ID NO: 503354 - DNA, 20 bp, Artificial Sequence
  chemically synthesized
ctcactgcaacctctgcctc

SEQ ID NO: 503355 - DNA, 20 bp, Artificial Sequence
  chemically synthesized
tctctccctgaagcccaggc

SEQ ID NO: 503356 - DNA, 20 bp, Artificial Sequence
  chemically synthesized
tttattttatttttttgaga

SEQ ID NO: 503357 - DNA, 20 bp, Artificial Sequence
  chemically synthesized
tttaaccaaccaaaaatcaa

SEQ ID NO: 503358 - DNA, 20 bp, Artificial Sequence
  chemically synthesized
atcatggcctaaaacaaatt

SEQ ID NO: 503359 - DNA, 20 bp, Artificial Sequence
  chemically synthesized
atgtgttataatcaagaatt

SEQ ID NO: 503360 - DNA, 20 bp, Artificial Sequence
  chemically synthesized
tacattaatgtgttataatc

SEQ ID NO: 503361 - DNA, 20 bp, Artificial Sequence
  chemically synthesized
ataacacattaatgtacaac

SEQ ID NO: 503362 - DNA, 20 bp, Artificial Sequence
  chemically synthesized
aaacaaaatgattacagtaa

SEQ ID NO: 503363 - DNA, 20 bp, Artificial Sequence
  chemically synthesized
cgatgcagtagaataagcct

SEQ ID NO: 503364 - DNA, 20 bp, Artificial Sequence
  chemically synthesized
agactgttgtttcgatgcag

SEQ ID NO: 503365 - DNA, 20 bp, Artificial Sequence
  chemically synthesized
ctagatagtggaaatatcca

SEQ ID NO: 503366 - DNA, 20 bp, Artificial Sequence
  chemically synthesized
ttattagctaaatcaatcct

SEQ ID NO: 503367 - DNA, 20 bp, Artificial Sequence
  chemically synthesized
cttatcacaggctgatacaa

SEQ ID NO: 503368 - DNA, 20 bp, Artificial Sequence
  chemically synthesized
ctgatacaacagaatttgag

SEQ ID NO: 503369 - DNA, 20 bp, Artificial Sequence
  chemically synthesized
tatttggccagtaataacct

SEQ ID NO: 503370 - DNA, 20 bp, Artificial Sequence
  chemically synthesized
cttgtacctcaatgattaag

SEQ ID NO: 503371 - DNA, 20 bp, Artificial Sequence
  chemically synthesized
gcttctgattttaagactta

SEQ ID NO: 503372 - DNA, 20 bp, Artificial Sequence
  chemically synthesized
aaaatgtgaagacagataaa

SEQ ID NO: 503373 - DNA, 20 bp, Artificial Sequence
  chemically synthesized
ttaccaatcactgccctcag

SEQ ID NO: 503374 - DNA, 20 bp, Artificial Sequence
  chemically synthesized
aattgtgtgtgtgtgtttgt

SEQ ID NO: 503375 - DNA, 20 bp, Artificial Sequence
  chemically synthesized
atttttgagggctgatactc

SEQ ID NO: 503376 - DNA, 20 bp, Artificial Sequence
  chemically synthesized
attttgactagatgatattc

SEQ ID NO: 503377 - DNA, 20 bp, Artificial Sequence
  chemically synthesized
ctgatcatgtattaaattta

SEQ ID NO: 503378 - DNA, 20 bp, Artificial Sequence
  chemically synthesized
taaatttattgaataattta

SEQ ID NO: 503379 - DNA, 20 bp, Artificial Sequence
  chemically synthesized
aaaaaaaaccccctatgaaa

SEQ ID NO: 503380 - DNA, 20 bp, Artificial Sequence
  chemically synthesized
tttcctcatcctgtttcata

SEQ ID NO: 503381 - DNA, 20 bp, Artificial Sequence
  chemically synthesized
aattcactggctatgtgatt

SEQ ID NO: 503382 - DNA, 20 bp, Artificial Sequence
  chemically synthesized
tactcaaaatcacatagcca

SEQ ID NO: 503383 - DNA, 20 bp, Artificial Sequence
  chemically synthesized
acatagccagtgaattacag

SEQ ID NO: 503384 - DNA, 20 bp, Artificial Sequence
  chemically synthesized
aaatgttcccgtgtcaaaaa

SEQ ID NO: 503385 - DNA, 20 bp, Artificial Sequence
  chemically synthesized
gatattaagttctgtcagta

SEQ ID NO: 503386 - DNA, 20 bp, Artificial Sequence
  chemically synthesized
gttctgtcagtaaaggatgc

SEQ ID NO: 503387 - DNA, 20 bp, Artificial Sequence
  chemically synthesized
ccagagtcacaggtttgaaa

SEQ ID NO: 503388 - DNA, 20 bp, Artificial Sequence
  chemically synthesized
gggcattccataggccagcc

SEQ ID NO: 503389 - DNA, 20 bp, Artificial Sequence
  chemically synthesized
tgtgactctgggctggccta

SEQ ID NO: 503390 - DNA, 20 bp, Artificial Sequence
  chemically synthesized
agtcttctgggtaaagtggg

SEQ ID NO: 503391 - DNA, 20 bp, Artificial Sequence
  chemically synthesized
tgaaagtcttctgggtaaag

SEQ ID NO: 503392 - DNA, 20 bp, Artificial Sequence
  chemically synthesized
atagtgttgctgaaagtctt

SEQ ID NO: 503393 - DNA, 20 bp, Artificial Sequence
  chemically synthesized
agaagactttcagcaacact

SEQ ID NO: 503394 - DNA, 20 bp, Artificial Sequence
  chemically synthesized
ggtcgtgtttgacaagttct

SEQ ID NO: 503395 - DNA, 20 bp, Artificial Sequence
  chemically synthesized
acccatcctcaatttgctta

SEQ ID NO: 503396 - DNA, 20 bp, Artificial Sequence
  chemically synthesized
gggtacccaataagcaaatt

SEQ ID NO: 503397 - DNA, 20 bp, Artificial Sequence
  chemically synthesized
acccaataagcaaattgagg

SEQ ID NO: 503398 - DNA, 20 bp, Artificial Sequence
  chemically synthesized
ggggctccaggaagctgcct

SEQ ID NO: 503399 - DNA, 20 bp, Artificial Sequence
  chemically synthesized
atggtgggaaactacctgta

SEQ ID NO: 503400 - DNA, 20 bp, Artificial Sequence
  chemically synthesized
gtagtttcccaccatgtcca

SEQ ID NO: 503401 - DNA, 20 bp, Artificial Sequence
  chemically synthesized
tagcctatggtggggaacca

SEQ ID NO: 503402 - DNA, 20 bp, Artificial Sequence
  chemically synthesized
ccaccataggctacttccct

SEQ ID NO: 503403 - DNA, 20 bp, Artificial Sequence
  chemically synthesized
gtgtgaagagaatattggag

SEQ ID NO: 503404 - DNA, 20 bp, Artificial Sequence
  chemically synthesized
tgagctgaagctagtgtgaa

SEQ ID NO: 503405 - DNA, 20 bp, Artificial Sequence
  chemically synthesized
tcactggctatagacttgtt

SEQ ID NO: 503406 - DNA, 20 bp, Artificial Sequence
  chemically synthesized
ggctatagacttgttctgga

SEQ ID NO: 503407 - DNA, 20 bp, Artificial Sequence
  chemically synthesized
aagtgtgtgtctgcctccca

SEQ ID NO: 503408 - DNA, 20 bp, Artificial Sequence
  chemically synthesized
cacacactttctaaagaagt

SEQ ID NO: 503409 - DNA, 20 bp, Artificial Sequence
  chemically synthesized
aaagaagtttgaatccagcc

SEQ ID NO: 503410 - DNA, 20 bp, Artificial Sequence
  chemically synthesized
gataggagctcaacccaagg

SEQ ID NO: 503411 - DNA, 20 bp, Artificial Sequence
  chemically synthesized
taaagaataccttaagcctg

SEQ ID NO: 503412 - DNA, 20 bp, Artificial Sequence
  chemically synthesized
ggaaataaaagagatctcta

SEQ ID NO: 503413 - DNA, 20 bp, Artificial Sequence
  chemically synthesized
aaccatctctgtttaagtga

SEQ ID NO: 503414 - DNA, 20 bp, Artificial Sequence
  chemically synthesized
taacaccttgtattagtagt

SEQ ID NO: 503415 - DNA, 20 bp, Artificial Sequence
  chemically synthesized
aaaatacttgaaacttgggc

SEQ ID NO: 503416 - DNA, 20 bp, Artificial Sequence
  chemically synthesized
agtttttaaagcataaactt

SEQ ID NO: 503417 - DNA, 20 bp, Artificial Sequence
  chemically synthesized
gtattatcttattttctgga

SEQ ID NO: 503418 - DNA, 20 bp, Artificial Sequence
  chemically synthesized
agaaaataagataatacgtg

SEQ ID NO: 503419 - DNA, 20 bp, Artificial Sequence
  chemically synthesized
taagataatacgtgttgaat

SEQ ID NO: 503420 - DNA, 20 bp, Artificial Sequence
  chemically synthesized
aatcagggtatgttgctgaa

SEQ ID NO: 503421 - DNA, 20 bp, Artificial Sequence
  chemically synthesized
tttttctttgggggaaatgt

SEQ ID NO: 503422 - DNA, 20 bp, Artificial Sequence
  chemically synthesized
taagtagttttgtgttaata

SEQ ID NO: 503423 - DNA, 20 bp, Artificial Sequence
  chemically synthesized
ttgcaatataattacattaa

SEQ ID NO: 503424 - DNA, 20 bp, Artificial Sequence
  chemically synthesized
ttaataccaagatcaagtta

SEQ ID NO: 503425 - DNA, 20 bp, Artificial Sequence
  chemically synthesized
gagtaagctattcctaagga

SEQ ID NO: 503426 - DNA, 20 bp, Artificial Sequence
  chemically synthesized
tactcatctattctgtcctt

SEQ ID NO: 503427 - DNA, 20 bp, Artificial Sequence
  chemically synthesized
tattcctaaggacagaatag

SEQ ID NO: 503428 - DNA, 20 bp, Artificial Sequence
  chemically synthesized
aaaaatgtcaaacactgaag

SEQ ID NO: 503429 - DNA, 20 bp, Artificial Sequence
  chemically synthesized
actttgggaggccaaggcaa

SEQ ID NO: 503430 - DNA, 20 bp, Artificial Sequence
  chemically synthesized
caagtggatagcttgagccc

SEQ ID NO: 503431 - DNA, 20 bp, Artificial Sequence
  chemically synthesized
acacacacacacaaataacc

SEQ ID NO: 503432 - DNA, 20 bp, Artificial Sequence
  chemically synthesized
gatcttcccacctcagcctc

SEQ ID NO: 503433 - DNA, 20 bp, Artificial Sequence
  chemically synthesized
tcttgctctgtccctgagac

SEQ ID NO: 503434 - DNA, 20 bp, Artificial Sequence
  chemically synthesized
aatttttttttttttaaaga

SEQ ID NO: 503435 - DNA, 20 bp, Artificial Sequence
  chemically synthesized
gtctttaaaaaaaaaaaaat

SEQ ID NO: 503436 - DNA, 20 bp, Artificial Sequence
  chemically synthesized
gaatgtgtttttatttctat

SEQ ID NO: 503437 - DNA, 20 bp, Artificial Sequence
  chemically synthesized
tgtgggttgtgatatggaat

SEQ ID NO: 503438 - DNA, 20 bp, Artificial Sequence
  chemically synthesized
tttcaatgtgggttgtgata

SEQ ID NO: 503439 - DNA, 20 bp, Artificial Sequence
  chemically synthesized
aaattgaagatcatttcaat

SEQ ID NO: 503440 - DNA, 20 bp, Artificial Sequence
  chemically synthesized
ttgttgcactattgctggat

SEQ ID NO: 503441 - DNA, 20 bp, Artificial Sequence
  chemically synthesized
tcatcattgttgcactattg

SEQ ID NO: 503442 - DNA, 20 bp, Artificial Sequence
  chemically synthesized
atgaaggaccagagattgtt

SEQ ID NO: 503443 - DNA, 20 bp, Artificial Sequence
  chemically synthesized
ggaattggggattggaaaag

SEQ ID NO: 503444 - DNA, 20 bp, Artificial Sequence
  chemically synthesized
ccaaatcaacataaggaatt

SEQ ID NO: 503445 - DNA, 20 bp, Artificial Sequence
  chemically synthesized
attttatccaaatcaacata

SEQ ID NO: 503446 - DNA, 20 bp, Artificial Sequence
  chemically synthesized
ccccaattccttatgttgat

SEQ ID NO: 503447 - DNA, 20 bp, Artificial Sequence
  chemically synthesized
tatgttgatttggataaaat

SEQ ID NO: 503448 - DNA, 20 bp, Artificial Sequence
  chemically synthesized
taaaatatggatatgccacc

SEQ ID NO: 503449 - DNA, 20 bp, Artificial Sequence
  chemically synthesized
agcacctccagtcttgaatc

SEQ ID NO: 503450 - DNA, 20 bp, Artificial Sequence
  chemically synthesized
taccagcagcacctccagtc

SEQ ID NO: 503451 - DNA, 20 bp, Artificial Sequence
  chemically synthesized
aattctgaagagaagtatgt

SEQ ID NO: 503452 - DNA, 20 bp, Artificial Sequence
  chemically synthesized
taccctcacatacttctctt

SEQ ID NO: 503453 - DNA, 20 bp, Artificial Sequence
  chemically synthesized
tcacatacttctcttcagaa

SEQ ID NO: 503454 - DNA, 20 bp, Artificial Sequence
  chemically synthesized
acagattgaaaaggaacgcc

SEQ ID NO: 503455 - DNA, 20 bp, Artificial Sequence
  chemically synthesized
aaccattgactaatgactta

SEQ ID NO: 503456 - DNA, 20 bp, Artificial Sequence
  chemically synthesized
gaataagggggggtagtaac

SEQ ID NO: 503457 - DNA, 20 bp, Artificial Sequence
  chemically synthesized
agagaaaaaagagaataagg

SEQ ID NO: 503458 - DNA, 20 bp, Artificial Sequence
  chemically synthesized
taacgtatgaagagaaaaaa

SEQ ID NO: 503459 - DNA, 20 bp, Artificial Sequence
  chemically synthesized
aggaagagttactgatttcc

SEQ ID NO: 503460 - DNA, 20 bp, Artificial Sequence
  chemically synthesized
aaaacattggttagttaagg

SEQ ID NO: 503461 - DNA, 20 bp, Artificial Sequence
  chemically synthesized
agatatggttctatggtttg

SEQ ID NO: 503462 - DNA, 20 bp, Artificial Sequence
  chemically synthesized
gtagtagatgtactcagtaa

SEQ ID NO: 503463 - DNA, 20 bp, Artificial Sequence
  chemically synthesized
tttagttttatattcactta

SEQ ID NO: 503464 - DNA, 20 bp, Artificial Sequence
  chemically synthesized
aaactaaacatcattataaa

SEQ ID NO: 503465 - DNA, 20 bp, Artificial Sequence
  chemically synthesized
ttgcatactatctcctaaga

SEQ ID NO: 503466 - DNA, 20 bp, Artificial Sequence
  chemically synthesized
tgttttgcatactatctcct

SEQ ID NO: 503467 - DNA, 20 bp, Artificial Sequence
  chemically synthesized
gaaatgtagtgttatttatg

SEQ ID NO: 503468 - DNA, 20 bp, Artificial Sequence
  chemically synthesized
tttatgaagaataaataata

SEQ ID NO: 503469 - DNA, 20 bp, Artificial Sequence
  chemically synthesized
taaataatatggggtactaa

SEQ ID NO: 503470 - DNA, 20 bp, Artificial Sequence
  chemically synthesized
tgtgacataacaaatgtgtg

SEQ ID NO: 503471 - DNA, 20 bp, Artificial Sequence
  chemically synthesized
tgtgtgtggaatggagggag

SEQ ID NO: 503472 - DNA, 20 bp, Artificial Sequence
  chemically synthesized
aaatgagacagcgagagaga

SEQ ID NO: 503473 - DNA, 20 bp, Artificial Sequence
  chemically synthesized
ctcaagatagaccagtatgt

SEQ ID NO: 503474 - DNA, 20 bp, Artificial Sequence
  chemically synthesized
cccacacatactggtctatc

SEQ ID NO: 503475 - DNA, 20 bp, Artificial Sequence
  chemically synthesized
aaggaaaagaactctgtggt

SEQ ID NO: 503476 - DNA, 20 bp, Artificial Sequence
  chemically synthesized
caagaaggttactctgacca

SEQ ID NO: 503477 - DNA, 20 bp, Artificial Sequence
  chemically synthesized
tgtggtcagagtaaccttct

SEQ ID NO: 503478 - DNA, 20 bp, Artificial Sequence
  chemically synthesized
ggatgtctcagttgcctttt

SEQ ID NO: 503479 - DNA, 20 bp, Artificial Sequence
  chemically synthesized
ttcacaaaaacattgtaagt

SEQ ID NO: 503480 - DNA, 20 bp, Artificial Sequence
  chemically synthesized
catgctataatacacatgta

SEQ ID NO: 503481 - DNA, 20 bp, Artificial Sequence
  chemically synthesized
agacaatccaatgccagaca

SEQ ID NO: 503482 - DNA, 20 bp, Artificial Sequence
  chemically synthesized
aatttacccagtgtctggca

SEQ ID NO: 503483 - DNA, 20 bp, Artificial Sequence
  chemically synthesized
ttcatgtagttccctccaac

SEQ ID NO: 503484 - DNA, 20 bp, Artificial Sequence
  chemically synthesized
ccctaacagatggcggagtc

SEQ ID NO: 503485 - DNA, 20 bp, Artificial Sequence
  chemically synthesized
gcacagaccctaacagatgg

SEQ ID NO: 503486 - DNA, 20 bp, Artificial Sequence
  chemically synthesized
tccatgactccgccatctgt

SEQ ID NO: 503487 - DNA, 20 bp, Artificial Sequence
  chemically synthesized
gttagggtctgtgccaatat

SEQ ID NO: 503488 - DNA, 20 bp, Artificial Sequence
  chemically synthesized
tgccaatatgcgaatctgat

SEQ ID NO: 503489 - DNA, 20 bp, Artificial Sequence
  chemically synthesized
aatctgatttgggttatcct

SEQ ID NO: 503490 - DNA, 20 bp, Artificial Sequence
  chemically synthesized
aaaatttgatgcgacattca

SEQ ID NO: 503491 - DNA, 20 bp, Artificial Sequence
  chemically synthesized
tccttttttttctaaataca

SEQ ID NO: 503492 - DNA, 20 bp, Artificial Sequence
  chemically synthesized
aatttaaagcaaattttaat

SEQ ID NO: 503493 - DNA, 20 bp, Artificial Sequence
  chemically synthesized
agcatttttgcttcaaaaaa

SEQ ID NO: 503494 - DNA, 20 bp, Artificial Sequence
  chemically synthesized
aaaataggatgtcattctat

SEQ ID NO: 503495 - DNA, 20 bp, Artificial Sequence
  chemically synthesized
taatcccatgaagattcata

SEQ ID NO: 503496 - DNA, 20 bp, Artificial Sequence
  chemically synthesized
tcattctatatgaatcttca

SEQ ID NO: 503497 - DNA, 20 bp, Artificial Sequence
  chemically synthesized
cgtcaaggaaaaaggtggtt

SEQ ID NO: 503498 - DNA, 20 bp, Artificial Sequence
  chemically synthesized
tgttttacctcttctggttt

SEQ ID NO: 503499 - DNA, 20 bp, Artificial Sequence
  chemically synthesized
cacgtgacacaattctgaaa

SEQ ID NO: 503500 - DNA, 20 bp, Artificial Sequence
  chemically synthesized
cttgagagagtactcttttt

SEQ ID NO: 503501 - DNA, 20 bp, Artificial Sequence
  chemically synthesized
aaaaagagtactctctcaag

SEQ ID NO: 503502 - DNA, 20 bp, Artificial Sequence
  chemically synthesized
ggcaaaaggattcttcttga

SEQ ID NO: 503503 - DNA, 20 bp, Artificial Sequence
  chemically synthesized
caaaaaagtaggaagggcaa

SEQ ID NO: 503504 - DNA, 20 bp, Artificial Sequence
  chemically synthesized
tgcactgggaggcaatgact

SEQ ID NO: 503505 - DNA, 20 bp, Artificial Sequence
  chemically synthesized
atgctcaggaagagagagca

SEQ ID NO: 503506 - DNA, 20 bp, Artificial Sequence
  chemically synthesized
tggttcagccatattatgag

SEQ ID NO: 503507 - DNA, 20 bp, Artificial Sequence
  chemically synthesized
tggctgaaccatcctcaacc

SEQ ID NO: 503508 - DNA, 20 bp, Artificial Sequence
  chemically synthesized
aagggaggttactcagggtt

SEQ ID NO: 503509 - DNA, 20 bp, Artificial Sequence
  chemically synthesized
aatagtgaagggaggttact

SEQ ID NO: 503510 - DNA, 20 bp, Artificial Sequence
  chemically synthesized
tgatcttttctcaccacgaa

SEQ ID NO: 503511 - DNA, 20 bp, Artificial Sequence
  chemically synthesized
ttattgggatgtacgtaaca

SEQ ID NO: 503512 - DNA, 20 bp, Artificial Sequence
  chemically synthesized
gtataggagatgggtattat

SEQ ID NO: 503513 - DNA, 20 bp, Artificial Sequence
  chemically synthesized
aattttgagcagtataggag

SEQ ID NO: 503514 - DNA, 20 bp, Artificial Sequence
  chemically synthesized
ggctagataatatgatgaaa

SEQ ID NO: 503515 - DNA, 20 bp, Artificial Sequence
  chemically synthesized
cataggcatgccagaaaaca

SEQ ID NO: 503516 - DNA, 20 bp, Artificial Sequence
  chemically synthesized
tgaggtccagtaagatgaaa

SEQ ID NO: 503517 - DNA, 20 bp, Artificial Sequence
  chemically synthesized
ttcctgtttatgtatttttc

SEQ ID NO: 503518 - DNA, 20 bp, Artificial Sequence
  chemically synthesized
aaacttaataggacaatgta

SEQ ID NO: 503519 - DNA, 20 bp, Artificial Sequence
  chemically synthesized
ctttaaaagccatcaaattt

SEQ ID NO: 503520 - DNA, 20 bp, Artificial Sequence
  chemically synthesized
aagatttgttagaagtaata

SEQ ID NO: 503521 - DNA, 20 bp, Artificial Sequence
  chemically synthesized
tgtaaatatttatttgcaaa

SEQ ID NO: 503522 - DNA, 20 bp, Artificial Sequence
  chemically synthesized
aatggatataaataatttta

SEQ ID NO: 503523 - DNA, 20 bp, Artificial Sequence
  chemically synthesized
cttgttaaatttttttaaag

SEQ ID NO: 503524 - DNA, 20 bp, Artificial Sequence
  chemically synthesized
aaagcaacaaagcaaaatta

SEQ ID NO: 503525 - DNA, 20 bp, Artificial Sequence
  chemically synthesized
agggatcagttataaatatc

SEQ ID NO: 503526 - DNA, 20 bp, Artificial Sequence
  chemically synthesized
gggctagatcaccacgtatc

SEQ ID NO: 503527 - DNA, 20 bp, Artificial Sequence
  chemically synthesized
tgcttatccaggaggacatt

SEQ ID NO: 503528 - DNA, 20 bp, Artificial Sequence
  chemically synthesized
ttttcactcaaaatgtcctc

SEQ ID NO: 503529 - DNA, 20 bp, Artificial Sequence
  chemically synthesized
atttatttattttttcactg

SEQ ID NO: 503530 - DNA, 20 bp, Artificial Sequence
  chemically synthesized
tcatttattggctccattat

SEQ ID NO: 503531 - DNA, 20 bp, Artificial Sequence
  chemically synthesized
aagcagggaggaggaaaatt

SEQ ID NO: 503532 - DNA, 20 bp, Artificial Sequence
  chemically synthesized
aaactagggcatgttcacaa

SEQ ID NO: 503533 - DNA, 20 bp, Artificial Sequence
  chemically synthesized
atcactgaaactgtgagagc

SEQ ID NO: 503534 - DNA, 20 bp, Artificial Sequence
  chemically synthesized
acagtggccagaacagaaga

SEQ ID NO: 503535 - DNA, 20 bp, Artificial Sequence
  chemically synthesized
taattgaccaaacatttctt

SEQ ID NO: 503536 - DNA, 20 bp, Artificial Sequence
  chemically synthesized
tgtttggtcaattaacttct

SEQ ID NO: 503537 - DNA, 20 bp, Artificial Sequence
  chemically synthesized
tccttttgaaaattaggaag

SEQ ID NO: 503538 - DNA, 20 bp, Artificial Sequence
  chemically synthesized
aggtgtctactctgatgttc

SEQ ID NO: 503539 - DNA, 20 bp, Artificial Sequence
  chemically synthesized
aatttgtaatcctagaacat

SEQ ID NO: 503540 - DNA, 20 bp, Artificial Sequence
  chemically synthesized
aggtatttctttagacagaa

SEQ ID NO: 503541 - DNA, 20 bp, Artificial Sequence
  chemically synthesized
atgtaaggtatttctttaga

SEQ ID NO: 503542 - DNA, 20 bp, Artificial Sequence
  chemically synthesized
ccttacattttcttcacatc

SEQ ID NO: 503543 - DNA, 20 bp, Artificial Sequence
  chemically synthesized
atgtaatgaatatgttgttt

SEQ ID NO: 503544 - DNA, 20 bp, Artificial Sequence
  chemically synthesized
ttttgacttatctatatgta

SEQ ID NO: 503545 - DNA, 20 bp, Artificial Sequence
  chemically synthesized
tacactaaaatgcatagagc

SEQ ID NO: 503546 - DNA, 20 bp, Artificial Sequence
  chemically synthesized
tggagactttcaataattaa

SEQ ID NO: 503547 - DNA, 20 bp, Artificial Sequence
  chemically synthesized
taaaaatgtacttacatttt

SEQ ID NO: 503548 - DNA, 20 bp, Artificial Sequence
  chemically synthesized
ggaatgttttgagttattaa

SEQ ID NO: 503549 - DNA, 20 bp, Artificial Sequence
  chemically synthesized
tttacaccttacggaatgtt

SEQ ID NO: 503550 - DNA, 20 bp, Artificial Sequence
  chemically synthesized
aatcacaaatttacacctta

SEQ ID NO: 503551 - DNA, 20 bp, Artificial Sequence
  chemically synthesized
cagtttaaaagctgcacgta

SEQ ID NO: 503552 - DNA, 20 bp, Artificial Sequence
  chemically synthesized
ctcactgctttagggctaat

SEQ ID NO: 503553 - DNA, 20 bp, Artificial Sequence
  chemically synthesized
tcccgattagccctaaagca

SEQ ID NO: 503554 - DNA, 20 bp, Artificial Sequence
  chemically synthesized
cacaaacctgcaaagacagt

SEQ ID NO: 503555 - DNA, 20 bp, Artificial Sequence
  chemically synthesized
ctaggtcacaagattttgca

SEQ ID NO: 503556 - DNA, 20 bp, Artificial Sequence
  chemically synthesized
tatcactcagcactggtact

SEQ ID NO: 503557 - DNA, 20 bp, Artificial Sequence
  chemically synthesized
ctttatccaaagtaccagtg

SEQ ID NO: 503558 - DNA, 20 bp, Artificial Sequence
  chemically synthesized
aacatagtaattatactctc

SEQ ID NO: 503559 - DNA, 20 bp, Artificial Sequence
  chemically synthesized
atccaaagaaaacaacccaa

SEQ ID NO: 503560 - DNA, 20 bp, Artificial Sequence
  chemically synthesized
actctcttgggttgttttct

SEQ ID NO: 503561 - DNA, 20 bp, Artificial Sequence
  chemically synthesized
gagatttcctcagctccgcc

SEQ ID NO: 503562 - DNA, 20 bp, Artificial Sequence
  chemically synthesized
aaacaagtggctaaatgaag

SEQ ID NO: 503563 - DNA, 20 bp, Artificial Sequence
  chemically synthesized
ggaagtttgggcatgttggc

SEQ ID NO: 503564 - DNA, 20 bp, Artificial Sequence
  chemically synthesized
tgaaactgtctagctgcatt

SEQ ID NO: 503565 - DNA, 20 bp, Artificial Sequence
  chemically synthesized
ttaagaaaacattttattac

SEQ ID NO: 503566 - DNA, 20 bp, Artificial Sequence
  chemically synthesized
aacattttattacatgaata

SEQ ID NO: 503567 - DNA, 20 bp, Artificial Sequence
  chemically synthesized
aaaaagtaaattactgtctt

SEQ ID NO: 503568 - DNA, 20 bp, Artificial Sequence
  chemically synthesized
ctggtaacagtgatgtgtga

SEQ ID NO: 503569 - DNA, 20 bp, Artificial Sequence
  chemically synthesized
ataaatttcagaggaggtca

SEQ ID NO: 503570 - DNA, 20 bp, Artificial Sequence
  chemically synthesized
atttgatagttaaaatttaa

SEQ ID NO: 503571 - DNA, 20 bp, Artificial Sequence
  chemically synthesized
aatttatggtaaacatcatc

SEQ ID NO: 503572 - DNA, 20 bp, Artificial Sequence
  chemically synthesized
atatacctcaaggaaataat

SEQ ID NO: 503573 - DNA, 20 bp, Artificial Sequence
  chemically synthesized
catttaaaataatcaaacct

SEQ ID NO: 503574 - DNA, 20 bp, Artificial Sequence
  chemically synthesized
ttttaaagttctgctttttt

SEQ ID NO: 503575 - DNA, 20 bp, Artificial Sequence
  chemically synthesized
tttctgactttggcatagag

SEQ ID NO: 503576 - DNA, 20 bp, Artificial Sequence
  chemically synthesized
ctgaccgtaagaaaaaagag

SEQ ID NO: 503577 - DNA, 20 bp, Artificial Sequence
  chemically synthesized
aggtcctaattttaatgtag

SEQ ID NO: 503578 - DNA, 20 bp, Artificial Sequence
  chemically synthesized
ttacttgatggtgtcctttg

SEQ ID NO: 503579 - DNA, 20 bp, Artificial Sequence
  chemically synthesized
tgcagttgttttcttctatt

SEQ ID NO: 503580 - DNA, 20 bp, Artificial Sequence
  chemically synthesized
ctgcaacatctgtaacacat

SEQ ID NO: 503581 - DNA, 20 bp, Artificial Sequence
  chemically synthesized
gccagcaagtcaaatagaag

SEQ ID NO: 503582 - DNA, 20 bp, Artificial Sequence
  chemically synthesized
ggttttcttttcattatcga

SEQ ID NO: 503583 - DNA, 20 bp, Artificial Sequence
  chemically synthesized
gtaatcaaggacatgtaggc

SEQ ID NO: 503584 - DNA, 20 bp, Artificial Sequence
  chemically synthesized
tgtatatcttctctcacacg

SEQ ID NO: 503585 - DNA, 20 bp, Artificial Sequence
  chemically synthesized
aaaatttgtatttattgttg

SEQ ID NO: 503586 - DNA, 20 bp, Artificial Sequence
  chemically synthesized
atgtgaatgttcaccttatt

SEQ ID NO: 503587 - DNA, 20 bp, Artificial Sequence
  chemically synthesized
gttgttgtcttgatgggtat

SEQ ID NO: 503588 - DNA, 20 bp, Artificial Sequence
  chemically synthesized
aaagtggagttgttgtcttg

SEQ ID NO: 503589 - DNA, 20 bp, Artificial Sequence
  chemically synthesized
aggatgcacatatcaaaaag

SEQ ID NO: 503590 - DNA, 20 bp, Artificial Sequence
  chemically synthesized
ccatgttaaacagtttctct

SEQ ID NO: 503591 - DNA, 20 bp, Artificial Sequence
  chemically synthesized
cctcagagaaactgtttaac

SEQ ID NO: 503592 - DNA, 20 bp, Artificial Sequence
  chemically synthesized
gaaataatgtccactgcaag

SEQ ID NO: 503593 - DNA, 20 bp, Artificial Sequence
  chemically synthesized
tataccgtcatctttaaaca

SEQ ID NO: 503594 - DNA, 20 bp, Artificial Sequence
  chemically synthesized
atctcatcaaaaagaaccat

SEQ ID NO: 503595 - DNA, 20 bp, Artificial Sequence
  chemically synthesized
catcaaaaagaaccataaga

SEQ ID NO: 503596 - DNA, 20 bp, Artificial Sequence
  chemically synthesized
gaatctcagacacaaatatg

SEQ ID NO: 503597 - DNA, 20 bp, Artificial Sequence
  chemically synthesized
gttttttcactcatatgtgt

SEQ ID NO: 503598 - DNA, 20 bp, Artificial Sequence
  chemically synthesized
taaaaaaaatccacacacat

SEQ ID NO: 503599 - DNA, 20 bp, Artificial Sequence
  chemically synthesized
tgtggattttttttaaacaa

SEQ ID NO: 503600 - DNA, 20 bp, Artificial Sequence
  chemically synthesized
aaagataggaagatgcgaga

SEQ ID NO: 503601 - DNA, 20 bp, Artificial Sequence
  chemically synthesized
aggaagatgcgagagaggat

SEQ ID NO: 503602 - DNA, 20 bp, Artificial Sequence
  chemically synthesized
ttctgttagctttgtaactg

SEQ ID NO: 503603 - DNA, 20 bp, Artificial Sequence
  chemically synthesized
gaaaggaagatttatttcag

SEQ ID NO: 503604 - DNA, 20 bp, Artificial Sequence
  chemically synthesized
ttctctatgttcatagccct

SEQ ID NO: 503605 - DNA, 20 bp, Artificial Sequence
  chemically synthesized
tcatagcccttagaatgaca

SEQ ID NO: 503606 - DNA, 20 bp, Artificial Sequence
  chemically synthesized
tacttttcatcagatagaga

SEQ ID NO: 503607 - DNA, 20 bp, Artificial Sequence
  chemically synthesized
aggtgatagaaatctaaaat

SEQ ID NO: 503608 - DNA, 20 bp, Artificial Sequence
  chemically synthesized
ttcccactgggatctttgcc

SEQ ID NO: 503609 - DNA, 20 bp, Artificial Sequence
  chemically synthesized
agatatttatattttcccac

SEQ ID NO: 503610 - DNA, 20 bp, Artificial Sequence
  chemically synthesized
aaatatcttcttaaataccc

SEQ ID NO: 503611 - DNA, 20 bp, Artificial Sequence
  chemically synthesized
ttcaaagctctaaggtaccc

SEQ ID NO: 503612 - DNA, 20 bp, Artificial Sequence
  chemically synthesized
taccttgctgatttaactgt

SEQ ID NO: 503613 - DNA, 20 bp, Artificial Sequence
  chemically synthesized
ttgctgatttaactgtcaga

SEQ ID NO: 503614 - DNA, 20 bp, Artificial Sequence
  chemically synthesized
gaaggacacagctggagagg

SEQ ID NO: 503615 - DNA, 20 bp, Artificial Sequence
  chemically synthesized
ataaaatatagtcttgaagc

SEQ ID NO: 503616 - DNA, 20 bp, Artificial Sequence
  chemically synthesized
aattggagctaaaagccact

SEQ ID NO: 503617 - DNA, 20 bp, Artificial Sequence
  chemically synthesized
taactgttaagcttaacagt

SEQ ID NO: 503618 - DNA, 20 bp, Artificial Sequence
  chemically synthesized
ttaaaattactttgaaatca

SEQ ID NO: 503619 - DNA, 20 bp, Artificial Sequence
  chemically synthesized
tactttccttcaaagccact

SEQ ID NO: 503620 - DNA, 20 bp, Artificial Sequence
  chemically synthesized
taactgaagcaggatatgtt

SEQ ID NO: 503621 - DNA, 20 bp, Artificial Sequence
  chemically synthesized
gtattttggtataactgaag

SEQ ID NO: 503622 - DNA, 20 bp, Artificial Sequence
  chemically synthesized
acatgttttacagatcagct

SEQ ID NO: 503623 - DNA, 20 bp, Artificial Sequence
  chemically synthesized
aaaatactggcgtatcagaa

SEQ ID NO: 503624 - DNA, 20 bp, Artificial Sequence
  chemically synthesized
ggcaagccagggaaatggga

SEQ ID NO: 503625 - DNA, 20 bp, Artificial Sequence
  chemically synthesized
ttctacttcttccttacagg

SEQ ID NO: 503626 - DNA, 20 bp, Artificial Sequence
  chemically synthesized
gatgttctacttcttcctta

SEQ ID NO: 503627 - DNA, 20 bp, Artificial Sequence
  chemically synthesized
agtagaacatccctagccat

SEQ ID NO: 503628 - DNA, 20 bp, Artificial Sequence
  chemically synthesized
atcataatattccaatggct

SEQ ID NO: 503629 - DNA, 20 bp, Artificial Sequence
  chemically synthesized
tagcaaggaaactattgttg

SEQ ID NO: 503630 - DNA, 20 bp, Artificial Sequence
  chemically synthesized
taagtttccgtttgttatgg

SEQ ID NO: 503631 - DNA, 20 bp, Artificial Sequence
  chemically synthesized
agcttaagtttccgtttgtt

SEQ ID NO: 503632 - DNA, 20 bp, Artificial Sequence
  chemically synthesized
agtttttgtattgttgccat

SEQ ID NO: 503633 - DNA, 20 bp, Artificial Sequence
  chemically synthesized
ctttttttttctctgggcta

SEQ ID NO: 503634 - DNA, 20 bp, Artificial Sequence
  chemically synthesized
ataataggaattgcctttac

SEQ ID NO: 503635 - DNA, 20 bp, Artificial Sequence
  chemically synthesized
tttgcgagctcatctataat

SEQ ID NO: 503636 - DNA, 20 bp, Artificial Sequence
  chemically synthesized
aatgactccctctaatggaa

SEQ ID NO: 503637 - DNA, 20 bp, Artificial Sequence
  chemically synthesized
ggaaattcacttccattaga

SEQ ID NO: 503638 - DNA, 20 bp, Artificial Sequence
  chemically synthesized
tcattagttgtaacaaatgg

SEQ ID NO: 503639 - DNA, 20 bp, Artificial Sequence
  chemically synthesized
ttatctttatgtcataaggt

SEQ ID NO: 503640 - DNA, 20 bp, Artificial Sequence
  chemically synthesized
ctcatggtgtatgtttccca

SEQ ID NO: 503641 - DNA, 20 bp, Artificial Sequence
  chemically synthesized
atttgcttgagactggcaag

SEQ ID NO: 503642 - DNA, 20 bp, Artificial Sequence
  chemically synthesized
ccaagccctttttcttaggt

SEQ ID NO: 503643 - DNA, 20 bp, Artificial Sequence
  chemically synthesized
agagctgacggagacttgag

SEQ ID NO: 503644 - DNA, 20 bp, Artificial Sequence
  chemically synthesized
cttgaggggagtgaggtgaa

SEQ ID NO: 503645 - DNA, 20 bp, Artificial Sequence
  chemically synthesized
gggagtgaggtgaagagagt

SEQ ID NO: 503646 - DNA, 20 bp, Artificial Sequence
  chemically synthesized
cccataaaagggtgagaaag

SEQ ID NO: 503647 - DNA, 20 bp, Artificial Sequence
  chemically synthesized
cttctttctcacccttttat

SEQ ID NO: 503648 - DNA, 20 bp, Artificial Sequence
  chemically synthesized
taccctacctatccccataa

SEQ ID NO: 503649 - DNA, 20 bp, Artificial Sequence
  chemically synthesized
cacccttttatggggatagg

SEQ ID NO: 503650 - DNA, 20 bp, Artificial Sequence
  chemically synthesized
gataggtagggtaaactcat

SEQ ID NO: 503651 - DNA, 20 bp, Artificial Sequence
  chemically synthesized
ctgtaaataaaatgattcag

SEQ ID NO: 503652 - DNA, 20 bp, Artificial Sequence
  chemically synthesized
catctgaatcattttattta

SEQ ID NO: 503653 - DNA, 20 bp, Artificial Sequence
  chemically synthesized
aaaacaaaaccactcatcta

SEQ ID NO: 503654 - DNA, 20 bp, Artificial Sequence
  chemically synthesized
caaaaccactcatctactgg

SEQ ID NO: 503655 - DNA, 20 bp, Artificial Sequence
  chemically synthesized
tgaatatatccacccagtag

SEQ ID NO: 503656 - DNA, 20 bp, Artificial Sequence
  chemically synthesized
ctgggtggatatattcagga

SEQ ID NO: 503657 - DNA, 20 bp, Artificial Sequence
  chemically synthesized
tgaataccaaccaccccttc

SEQ ID NO: 503658 - DNA, 20 bp, Artificial Sequence
  chemically synthesized
taccaacagctcaacaggaa

SEQ ID NO: 503659 - DNA, 20 bp, Artificial Sequence
  chemically synthesized
agctgttggtatggccaaga

SEQ ID NO: 503660 - DNA, 20 bp, Artificial Sequence
  chemically synthesized
ttcaggaatgagaagtttga

SEQ ID NO: 503661 - DNA, 20 bp, Artificial Sequence
  chemically synthesized
acctatactccgtacctttc

SEQ ID NO: 503662 - DNA, 20 bp, Artificial Sequence
  chemically synthesized
cttctcattcctgaaaggta

SEQ ID NO: 503663 - DNA, 20 bp, Artificial Sequence
  chemically synthesized
acttccagtgcccataggct

SEQ ID NO: 503664 - DNA, 20 bp, Artificial Sequence
  chemically synthesized
ccaatgctttagtgatgccc

SEQ ID NO: 503665 - DNA, 20 bp, Artificial Sequence
  chemically synthesized
cagctttacacaaactgctc

SEQ ID NO: 503666 - DNA, 20 bp, Artificial Sequence
  chemically synthesized
agtacctcgtagtgtttaac

SEQ ID NO: 503667 - DNA, 20 bp, Artificial Sequence
  chemically synthesized
agcctaggagatcttttttg

SEQ ID NO: 503668 - DNA, 20 bp, Artificial Sequence
  chemically synthesized
ttggggggttcaaagctcat

SEQ ID NO: 503669 - DNA, 20 bp, Artificial Sequence
  chemically synthesized
ctcatatgaataaggccaat

SEQ ID NO: 503670 - DNA, 20 bp, Artificial Sequence
  chemically synthesized
caatctggatcctcaacaga

SEQ ID NO: 503671 - DNA, 20 bp, Artificial Sequence
  chemically synthesized
tagacttgattcgctctgtt

SEQ ID NO: 503672 - DNA, 20 bp, Artificial Sequence
  chemically synthesized
actaggcattatagatgtgt

SEQ ID NO: 503673 - DNA, 20 bp, Artificial Sequence
  chemically synthesized
aaaaaggactttcacatgaa

SEQ ID NO: 503674 - DNA, 20 bp, Artificial Sequence
  chemically synthesized
gatctactgtcgatataagg

SEQ ID NO: 503675 - DNA, 20 bp, Artificial Sequence
  chemically synthesized
gtagatctgtatccagaaac

SEQ ID NO: 503676 - DNA, 20 bp, Artificial Sequence
  chemically synthesized
ctcctcctccatcccagttt

SEQ ID NO: 503677 - DNA, 20 bp, Artificial Sequence
  chemically synthesized
atttatacagacgcaggagt

SEQ ID NO: 503678 - DNA, 20 bp, Artificial Sequence
  chemically synthesized
tcagcaatttatacagacgc

SEQ ID NO: 503679 - DNA, 20 bp, Artificial Sequence
  chemically synthesized
tatgatatttaaatttaaat

SEQ ID NO: 503680 - DNA, 20 bp, Artificial Sequence
  chemically synthesized
gtacattttaataactaaaa

SEQ ID NO: 503681 - DNA, 20 bp, Artificial Sequence
  chemically synthesized
cttctttaacaatatttctc

SEQ ID NO: 503682 - DNA, 20 bp, Artificial Sequence
  chemically synthesized
aggcagaaggtgaaatttga

SEQ ID NO: 503683 - DNA, 20 bp, Artificial Sequence
  chemically synthesized
gaaggtgaaatttgacagag

SEQ ID NO: 503684 - DNA, 20 bp, Artificial Sequence
  chemically synthesized
gactgaaatgtttcaactta

SEQ ID NO: 503685 - DNA, 20 bp, Artificial Sequence
  chemically synthesized
tatctgtttaagttgtttaa

SEQ ID NO: 503686 - DNA, 20 bp, Artificial Sequence
  chemically synthesized
aagttgtttaaaggaataca

SEQ ID NO: 503687 - DNA, 20 bp, Artificial Sequence
  chemically synthesized
ttccatttctcaatatttta

SEQ ID NO: 503688 - DNA, 20 bp, Artificial Sequence
  chemically synthesized
atgagactatttctctattg

SEQ ID NO: 503689 - DNA, 20 bp, Artificial Sequence
  chemically synthesized
acgccacaggcagctgaagc

SEQ ID NO: 503690 - DNA, 20 bp, Artificial Sequence
  chemically synthesized
ggcagctgaagcgagaattt

SEQ ID NO: 503691 - DNA, 20 bp, Artificial Sequence
  chemically synthesized
ttatctctatctgctcaatt

SEQ ID NO: 503692 - DNA, 20 bp, Artificial Sequence
  chemically synthesized
aaaattgagcagatagagat

SEQ ID NO: 503693 - DNA, 20 bp, Artificial Sequence
  chemically synthesized
attaaagggaaaccagtaac

SEQ ID NO: 503694 - DNA, 20 bp, Artificial Sequence
  chemically synthesized
cagtaactggaatataagaa

SEQ ID NO: 503695 - DNA, 20 bp, Artificial Sequence
  chemically synthesized
aagaaagttttcccttagga

SEQ ID NO: 503696 - DNA, 20 bp, Artificial Sequence
  chemically synthesized
aaatttacacacagacaaag

SEQ ID NO: 503697 - DNA, 20 bp, Artificial Sequence
  chemically synthesized
tgaaactgtagaagacaaaa

SEQ ID NO: 503698 - DNA, 20 bp, Artificial Sequence
  chemically synthesized
cctttattttgccctgagta

SEQ ID NO: 503699 - DNA, 20 bp, Artificial Sequence
  chemically synthesized
gaaaatgcctttattttgcc

SEQ ID NO: 503700 - DNA, 20 bp, Artificial Sequence
  chemically synthesized
ttcttgctctttccttgagt

SEQ ID NO: 503701 - DNA, 20 bp, Artificial Sequence
  chemically synthesized
gtttctttcttgctctttcc

SEQ ID NO: 503702 - DNA, 20 bp, Artificial Sequence
  chemically synthesized
gaaaacggaagaggtaggtt

SEQ ID NO: 503703 - DNA, 20 bp, Artificial Sequence
  chemically synthesized
ttagtcctttttcactggtt

SEQ ID NO: 503704 - DNA, 20 bp, Artificial Sequence
  chemically synthesized
atattgaagttatcaaatta

SEQ ID NO: 503705 - DNA, 20 bp, Artificial Sequence
  chemically synthesized
aataatttgataacttcaat

SEQ ID NO: 503706 - DNA, 20 bp, Artificial Sequence
  chemically synthesized
tgataacttcaatatgaata

SEQ ID NO: 503707 - DNA, 20 bp, Artificial Sequence
  chemically synthesized
aaacttttcaagaccaatta

SEQ ID NO: 503708 - DNA, 20 bp, Artificial Sequence
  chemically synthesized
tattggagtacattttccga

SEQ ID NO: 503709 - DNA, 20 bp, Artificial Sequence
  chemically synthesized
gattcattagaaatttatat

SEQ ID NO: 503710 - DNA, 20 bp, Artificial Sequence
  chemically synthesized
tactccaatataaatttcta

SEQ ID NO: 503711 - DNA, 20 bp, Artificial Sequence
  chemically synthesized
tataaatttctaatgaatca

SEQ ID NO: 503712 - DNA, 20 bp, Artificial Sequence
  chemically synthesized
gtatcatttaaatgaacaac

SEQ ID NO: 503713 - DNA, 20 bp, Artificial Sequence
  chemically synthesized
acattgtcagaaagcatttc

SEQ ID NO: 503714 - DNA, 20 bp, Artificial Sequence
  chemically synthesized
ctccctattgtaacatgtta

SEQ ID NO: 503715 - DNA, 20 bp, Artificial Sequence
  chemically synthesized
taacaaagaatgggaaggga

SEQ ID NO: 503716 - DNA, 20 bp, Artificial Sequence
  chemically synthesized
gtgctatataaaatataaca

SEQ ID NO: 503717 - DNA, 20 bp, Artificial Sequence
  chemically synthesized
atcttatgtatcagtgttat

SEQ ID NO: 503718 - DNA, 20 bp, Artificial Sequence
  chemically synthesized
caggaaatattacagtttct

SEQ ID NO: 503719 - DNA, 20 bp, Artificial Sequence
  chemically synthesized
acatatagaaggcacttttc

SEQ ID NO: 503720 - DNA, 20 bp, Artificial Sequence
  chemically synthesized
aggcacttttcaagagtctg

SEQ ID NO: 503721 - DNA, 20 bp, Artificial Sequence
  chemically synthesized
acttttcaagagtctgagga

SEQ ID NO: 503722 - DNA, 20 bp, Artificial Sequence
  chemically synthesized
gtgaattgcatttaaaagaa

SEQ ID NO: 503723 - DNA, 20 bp, Artificial Sequence
  chemically synthesized
tgcatttaaaagaaaagaat

SEQ ID NO: 503724 - DNA, 20 bp, Artificial Sequence
  chemically synthesized
tttaaaagaaaagaataagg

SEQ ID NO: 503725 - DNA, 20 bp, Artificial Sequence
  chemically synthesized
agaactgataatggagaaac

SEQ ID NO: 503726 - DNA, 20 bp, Artificial Sequence
  chemically synthesized
ttccaattgtaaaatgtgat

SEQ ID NO: 503727 - DNA, 20 bp, Artificial Sequence
  chemically synthesized
gaaaatgataatactgtatt

SEQ ID NO: 503728 - DNA, 20 bp, Artificial Sequence
  chemically synthesized
aatactgtattgggaatata

SEQ ID NO: 503729 - DNA, 20 bp, Artificial Sequence
  chemically synthesized
aggtgtactttattattgat

SEQ ID NO: 503730 - DNA, 20 bp, Artificial Sequence
  chemically synthesized
tttagtttgcttcctatgtt

SEQ ID NO: 503731 - DNA, 20 bp, Artificial Sequence
  chemically synthesized
acacagactgagttattttg

SEQ ID NO: 503732 - DNA, 20 bp, Artificial Sequence
  chemically synthesized
gcccccttccctcacacaga

SEQ ID NO: 503733 - DNA, 20 bp, Artificial Sequence
  chemically synthesized
gatgctgccagacattgcac

SEQ ID NO: 503734 - DNA, 20 bp, Artificial Sequence
  chemically synthesized
tggcagcatcagcatttgta

SEQ ID NO: 503735 - DNA, 20 bp, Artificial Sequence
  chemically synthesized
actgtctagattatgcttat

SEQ ID NO: 503736 - DNA, 20 bp, Artificial Sequence
  chemically synthesized
caacttctgctttaactttt

SEQ ID NO: 503737 - DNA, 20 bp, Artificial Sequence
  chemically synthesized
ttagtaattgccgtgcccca

SEQ ID NO: 503738 - DNA, 20 bp, Artificial Sequence
  chemically synthesized
agtaaaaacatacttctcta

SEQ ID NO: 503739 - DNA, 20 bp, Artificial Sequence
  chemically synthesized
ataaatctggagaaaattta

SEQ ID NO: 503740 - DNA, 20 bp, Artificial Sequence
  chemically synthesized
tatgacctaataatagtaat

SEQ ID NO: 503741 - DNA, 20 bp, Artificial Sequence
  chemically synthesized
agcatagctactcacatata

SEQ ID NO: 503742 - DNA, 20 bp, Artificial Sequence
  chemically synthesized
tagcctagtactcaatatat

SEQ ID NO: 503743 - DNA, 20 bp, Artificial Sequence
  chemically synthesized
actaggctaagtagtttaaa

SEQ ID NO: 503744 - DNA, 20 bp, Artificial Sequence
  chemically synthesized
tttaattttctcaacaactt

SEQ ID NO: 503745 - DNA, 20 bp, Artificial Sequence
  chemically synthesized
gtcatacaacttataagtgc

SEQ ID NO: 503746 - DNA, 20 bp, Artificial Sequence
  chemically synthesized
aacttataagtgcctgaatg

SEQ ID NO: 503747 - DNA, 20 bp, Artificial Sequence
  chemically synthesized
cagtgcaaaacaactttggc

SEQ ID NO: 503748 - DNA, 20 bp, Artificial Sequence
  chemically synthesized
gaggcatagtggttaagaac

SEQ ID NO: 503749 - DNA, 20 bp, Artificial Sequence
  chemically synthesized
accagtggctctgcactagg

SEQ ID NO: 503750 - DNA, 20 bp, Artificial Sequence
  chemically synthesized
agccactggtagttggtggt

SEQ ID NO: 503751 - DNA, 20 bp, Artificial Sequence
  chemically synthesized
cactatttacagactcagta

SEQ ID NO: 503752 - DNA, 20 bp, Artificial Sequence
  chemically synthesized
agcgaaagtgaaactcctta

SEQ ID NO: 503753 - DNA, 20 bp, Artificial Sequence
  chemically synthesized
ctttagctctctgaaaaata

SEQ ID NO: 503754 - DNA, 20 bp, Artificial Sequence
  chemically synthesized
atgattcatagaaatgcatt

SEQ ID NO: 503755 - DNA, 20 bp, Artificial Sequence
  chemically synthesized
tacatccaaaatgcatttct

SEQ ID NO: 503756 - DNA, 20 bp, Artificial Sequence
  chemically synthesized
ctttctcacaacatcccagt

SEQ ID NO: 503757 - DNA, 20 bp, Artificial Sequence
  chemically synthesized
tttgtaattctcattctaac

SEQ ID NO: 503758 - DNA, 20 bp, Artificial Sequence
  chemically synthesized
cacaacatcccagttagaat

SEQ ID NO: 503759 - DNA, 20 bp, Artificial Sequence
  chemically synthesized
cttaaatttatggaagagac

SEQ ID NO: 503760 - DNA, 20 bp, Artificial Sequence
  chemically synthesized
ttaaagaaataatttattat

SEQ ID NO: 503761 - DNA, 20 bp, Artificial Sequence
  chemically synthesized
gaatacaacagatctgtaac

SEQ ID NO: 503762 - DNA, 20 bp, Artificial Sequence
  chemically synthesized
aaagtagtctgcatggaggt

SEQ ID NO: 503763 - DNA, 20 bp, Artificial Sequence
  chemically synthesized
ttaaaaaatatttggcagtc

SEQ ID NO: 503764 - DNA, 20 bp, Artificial Sequence
  chemically synthesized
tgaaatcacttataaattac

SEQ ID NO: 503765 - DNA, 20 bp, Artificial Sequence
  chemically synthesized
atcacttataaattacttgg

SEQ ID NO: 503766 - DNA, 20 bp, Artificial Sequence
  chemically synthesized
aaatatcattatttaagtta

SEQ ID NO: 503767 - DNA, 20 bp, Artificial Sequence
  chemically synthesized
gataaaagaaagtttcgttc

SEQ ID NO: 503768 - DNA, 20 bp, Artificial Sequence
  chemically synthesized
ttgagaagaccaaggcatag

SEQ ID NO: 503769 - DNA, 20 bp, Artificial Sequence
  chemically synthesized
gtggaaaataaactgtttca

SEQ ID NO: 503770 - DNA, 20 bp, Artificial Sequence
  chemically synthesized
aaggccactttgtttccata

SEQ ID NO: 503771 - DNA, 20 bp, Artificial Sequence
  chemically synthesized
tctggattcagacatgatta

SEQ ID NO: 503772 - DNA, 20 bp, Artificial Sequence
  chemically synthesized
agatcattccataatcatgt

SEQ ID NO: 503773 - DNA, 20 bp, Artificial Sequence
  chemically synthesized
ggtaatgttgatgtttttgt

SEQ ID NO: 503774 - DNA, 20 bp, Artificial Sequence
  chemically synthesized
agtgttgggcgttttgtggt

SEQ ID NO: 503775 - DNA, 20 bp, Artificial Sequence
  chemically synthesized
gttcatattaaccaggatag

SEQ ID NO: 503776 - DNA, 20 bp, Artificial Sequence
  chemically synthesized
cggcgttcgttcatattaac

SEQ ID NO: 503777 - DNA, 20 bp, Artificial Sequence
  chemically synthesized
tgtccagaaggagagaagac

SEQ ID NO: 503778 - DNA, 20 bp, Artificial Sequence
  chemically synthesized
tagtgtgtagggatagctat

SEQ ID NO: 503779 - DNA, 20 bp, Artificial Sequence
  chemically synthesized
attgcttgtcattagtgtgt

SEQ ID NO: 503780 - DNA, 20 bp, Artificial Sequence
  chemically synthesized
gagggtttaaaagctttact

SEQ ID NO: 503781 - DNA, 20 bp, Artificial Sequence
  chemically synthesized
ttgtgttaggggatttgagg

SEQ ID NO: 503782 - DNA, 20 bp, Artificial Sequence
  chemically synthesized
taggatttgtgcttgtgtta

SEQ ID NO: 503783 - DNA, 20 bp, Artificial Sequence
  chemically synthesized
gaaaaaaaaaaaaaacattg

SEQ ID NO: 503784 - DNA, 20 bp, Artificial Sequence
  chemically synthesized
atggaggccagggggtgcgt

SEQ ID NO: 503785 - DNA, 20 bp, Artificial Sequence
  chemically synthesized
aatacacaacatggaggcca

SEQ ID NO: 503786 - DNA, 20 bp, Artificial Sequence
  chemically synthesized
cattattttttgcaatgagg

SEQ ID NO: 503787 - DNA, 20 bp, Artificial Sequence
  chemically synthesized
ctctcttgtagctgaacaag

SEQ ID NO: 503788 - DNA, 20 bp, Artificial Sequence
  chemically synthesized
cccaacttgttcagctacaa

SEQ ID NO: 503789 - DNA, 20 bp, Artificial Sequence
  chemically synthesized
catgtacgcatttgaagtta

SEQ ID NO: 503790 - DNA, 20 bp, Artificial Sequence
  chemically synthesized
tctttagtctgtgttcctcc

SEQ ID NO: 503791 - DNA, 20 bp, Artificial Sequence
  chemically synthesized
tgtaaaagaaattctggtag

SEQ ID NO: 503792 - DNA, 20 bp, Artificial Sequence
  chemically synthesized
tcaattccccattcagctac

SEQ ID NO: 503793 - DNA, 20 bp, Artificial Sequence
  chemically synthesized
gaaattctggtagctgaatg

SEQ ID NO: 503794 - DNA, 20 bp, Artificial Sequence
  chemically synthesized
ggattaataagtatgcccat

SEQ ID NO: 503795 - DNA, 20 bp, Artificial Sequence
  chemically synthesized
tagtcattaacagtgtttgc

SEQ ID NO: 503796 - DNA, 20 bp, Artificial Sequence
  chemically synthesized
cagcaaacactgttaatgac

SEQ ID NO: 503797 - DNA, 20 bp, Artificial Sequence
  chemically synthesized
tatttctcagggctttctaa

SEQ ID NO: 503798 - DNA, 20 bp, Artificial Sequence
  chemically synthesized
gccctgagaaatatatgcct

SEQ ID NO: 503799 - DNA, 20 bp, Artificial Sequence
  chemically synthesized
gcctgcgggttatcccattc

SEQ ID NO: 503800 - DNA, 20 bp, Artificial Sequence
  chemically synthesized
ccaatttcttcacccctgaa

SEQ ID NO: 503801 - DNA, 20 bp, Artificial Sequence
  chemically synthesized
ataccccaatttcttcaccc

SEQ ID NO: 503802 - DNA, 20 bp, Artificial Sequence
  chemically synthesized
ccattcaggggtgaagaaat

SEQ ID NO: 503803 - DNA, 20 bp, Artificial Sequence
  chemically synthesized
ctaccacacaagtgcaaaag

SEQ ID NO: 503804 - DNA, 20 bp, Artificial Sequence
  chemically synthesized
ttgagggctttctgtggcca

SEQ ID NO: 503805 - DNA, 20 bp, Artificial Sequence
  chemically synthesized
caacttctacattatagaac

SEQ ID NO: 503806 - DNA, 20 bp, Artificial Sequence
  chemically synthesized
ttaaggtaagggcttattgg

SEQ ID NO: 503807 - DNA, 20 bp, Artificial Sequence
  chemically synthesized
taagggcttattggcaggat

SEQ ID NO: 503808 - DNA, 20 bp, Artificial Sequence
  chemically synthesized
agcataatcaccctactcct

SEQ ID NO: 503809 - DNA, 20 bp, Artificial Sequence
  chemically synthesized
tgggactaaatccaaaggag

SEQ ID NO: 503810 - DNA, 20 bp, Artificial Sequence
  chemically synthesized
aattgtgggactaaatccaa

SEQ ID NO: 503811 - DNA, 20 bp, Artificial Sequence
  chemically synthesized
tgacataatgcatactttta

SEQ ID NO: 503812 - DNA, 20 bp, Artificial Sequence
  chemically synthesized
aatgcaaattgttttgtcta

SEQ ID NO: 503813 - DNA, 20 bp, Artificial Sequence
  chemically synthesized
tgccaaaaagctgatttatt

SEQ ID NO: 503814 - DNA, 20 bp, Artificial Sequence
  chemically synthesized
acagtagcacatattaaatg

SEQ ID NO: 503815 - DNA, 20 bp, Artificial Sequence
  chemically synthesized
agatctttacccaaaccttc

SEQ ID NO: 503816 - DNA, 20 bp, Artificial Sequence
  chemically synthesized
caaaacacatccgagaaggt

SEQ ID NO: 503817 - DNA, 20 bp, Artificial Sequence
  chemically synthesized
cattagaaaactgaggttca

SEQ ID NO: 503818 - DNA, 20 bp, Artificial Sequence
  chemically synthesized
gagtttaaggaaatcatcct

SEQ ID NO: 503819 - DNA, 20 bp, Artificial Sequence
  chemically synthesized
gaaagagaggatataactct

SEQ ID NO: 503820 - DNA, 20 bp, Artificial Sequence
  chemically synthesized
aacagaaactatgagaaaga

SEQ ID NO: 503821 - DNA, 20 bp, Artificial Sequence
  chemically synthesized
tttctcatagtttctgttaa

SEQ ID NO: 503822 - DNA, 20 bp, Artificial Sequence
  chemically synthesized
agcatgctgtagtcagtcta

SEQ ID NO: 503823 - DNA, 20 bp, Artificial Sequence
  chemically synthesized
ctacatttttatatagttgc

SEQ ID NO: 503824 - DNA, 20 bp, Artificial Sequence
  chemically synthesized
caagcaactatataaaaatg

SEQ ID NO: 503825 - DNA, 20 bp, Artificial Sequence
  chemically synthesized
tctgagcctcttattaaacc

SEQ ID NO: 503826 - DNA, 20 bp, Artificial Sequence
  chemically synthesized
tcttctttcctcatatgtac

SEQ ID NO: 503827 - DNA, 20 bp, Artificial Sequence
  chemically synthesized
tatgaggaaagaagatgatg

SEQ ID NO: 503828 - DNA, 20 bp, Artificial Sequence
  chemically synthesized
acaagagccaccgtttttat

SEQ ID NO: 503829 - DNA, 20 bp, Artificial Sequence
  chemically synthesized
ggtggctcttgtttctttcc

SEQ ID NO: 503830 - DNA, 20 bp, Artificial Sequence
  chemically synthesized
gctctgccatctttcattgc

SEQ ID NO: 503831 - DNA, 20 bp, Artificial Sequence
  chemically synthesized
gggtgctcactttaagaagc

SEQ ID NO: 503832 - DNA, 20 bp, Artificial Sequence
  chemically synthesized
cttcttaaagtgagcaccct

SEQ ID NO: 503833 - DNA, 20 bp, Artificial Sequence
  chemically synthesized
acaagttgcagagtgattcc

SEQ ID NO: 503834 - DNA, 20 bp, Artificial Sequence
  chemically synthesized
tgataccaaagaacaagttg

SEQ ID NO: 503835 - DNA, 20 bp, Artificial Sequence
  chemically synthesized
gtttttcatttttaacaagt

SEQ ID NO: 503836 - DNA, 20 bp, Artificial Sequence
  chemically synthesized
caggcctcacccaagactca

SEQ ID NO: 503837 - DNA, 20 bp, Artificial Sequence
  chemically synthesized
aatttctgattcagtgagtc

SEQ ID NO: 503838 - DNA, 20 bp, Artificial Sequence
  chemically synthesized
accccagaatttctgattca

SEQ ID NO: 503839 - DNA, 20 bp, Artificial Sequence
  chemically synthesized
actcactgaatcagaaattc

SEQ ID NO: 503840 - DNA, 20 bp, Artificial Sequence
  chemically synthesized
agagtgctgggccctgaccc

SEQ ID NO: 503841 - DNA, 20 bp, Artificial Sequence
  chemically synthesized
tggaagtcttgtttaataca

SEQ ID NO: 503842 - DNA, 20 bp, Artificial Sequence
  chemically synthesized
tcctgcatctgaatggacat

SEQ ID NO: 503843 - DNA, 20 bp, Artificial Sequence
  chemically synthesized
tctgatgtccattcagatgc

SEQ ID NO: 503844 - DNA, 20 bp, Artificial Sequence
  chemically synthesized
tacagcagtgattcctgcat

SEQ ID NO: 503845 - DNA, 20 bp, Artificial Sequence
  chemically synthesized
ccagaacttacacataaagt

SEQ ID NO: 503846 - DNA, 20 bp, Artificial Sequence
  chemically synthesized
gttctggtaagcactagtac

SEQ ID NO: 503847 - DNA, 20 bp, Artificial Sequence
  chemically synthesized
cactagtactagagttataa

SEQ ID NO: 503848 - DNA, 20 bp, Artificial Sequence
  chemically synthesized
aaaaccagttaataactttc

SEQ ID NO: 503849 - DNA, 20 bp, Artificial Sequence
  chemically synthesized
actttccagagtgtttttca

SEQ ID NO: 503850 - DNA, 20 bp, Artificial Sequence
  chemically synthesized
gttgtttatcaaactgtacc

SEQ ID NO: 503851 - DNA, 20 bp, Artificial Sequence
  chemically synthesized
ttttttgacataaaagaacc

SEQ ID NO: 503852 - DNA, 20 bp, Artificial Sequence
  chemically synthesized
gaaagaacataaacagaagg

SEQ ID NO: 503853 - DNA, 20 bp, Artificial Sequence
  chemically synthesized
ggggggtctctatttcttct

SEQ ID NO: 503854 - DNA, 20 bp, Artificial Sequence
  chemically synthesized
gttgccttaaagaaactgtc

SEQ ID NO: 503855 - DNA, 20 bp, Artificial Sequence
  chemically synthesized
tggcaggaagatttcatttc

SEQ ID NO: 503856 - DNA, 20 bp, Artificial Sequence
  chemically synthesized
cctctggcaacaaccactgg

SEQ ID NO: 503857 - DNA, 20 bp, Artificial Sequence
  chemically synthesized
tggttgttgccagaggcttc

SEQ ID NO: 503858 - DNA, 20 bp, Artificial Sequence
  chemically synthesized
ctacaaaattggtttagtat

SEQ ID NO: 503859 - DNA, 20 bp, Artificial Sequence
  chemically synthesized
tttgttggaacactcatttc

SEQ ID NO: 503860 - DNA, 20 bp, Artificial Sequence
  chemically synthesized
atttgaaaaccatccttgaa

SEQ ID NO: 503861 - DNA, 20 bp, Artificial Sequence
  chemically synthesized
tctcttattttcctgtgctc

SEQ ID NO: 503862 - DNA, 20 bp, Artificial Sequence
  chemically synthesized
ggaaaataagagagatctga

SEQ ID NO: 503863 - DNA, 20 bp, Artificial Sequence
  chemically synthesized
gcactgaaccaaaggaaccc

SEQ ID NO: 503864 - DNA, 20 bp, Artificial Sequence
  chemically synthesized
ttcagctgctctgattatcc

SEQ ID NO: 503865 - DNA, 20 bp, Artificial Sequence
  chemically synthesized
agatccgtaagtagatacta

SEQ ID NO: 503866 - DNA, 20 bp, Artificial Sequence
  chemically synthesized
tgactctatagtatctactt

SEQ ID NO: 503867 - DNA, 20 bp, Artificial Sequence
  chemically synthesized
ataaatagacgcagtgagaa

SEQ ID NO: 503868 - DNA, 20 bp, Artificial Sequence
  chemically synthesized
gatacaagagaaaaggccat

SEQ ID NO: 503869 - DNA, 20 bp, Artificial Sequence
  chemically synthesized
aaaggaaaaaagagatgaaa

SEQ ID NO: 503870 - DNA, 20 bp, Artificial Sequence
  chemically synthesized
tttatttgtggtagagccca

SEQ ID NO: 503871 - DNA, 20 bp, Artificial Sequence
  chemically synthesized
ctaaatcatttgacctatct

SEQ ID NO: 503872 - DNA, 20 bp, Artificial Sequence
  chemically synthesized
tgataagcagagagagaagt

SEQ ID NO: 503873 - DNA, 20 bp, Artificial Sequence
  chemically synthesized
acccctgaggaaaactttat

SEQ ID NO: 503874 - DNA, 20 bp, Artificial Sequence
  chemically synthesized
attctgataaagttttcctc

SEQ ID NO: 503875 - DNA, 20 bp, Artificial Sequence
  chemically synthesized
aaatggacaagaaaaaccat

SEQ ID NO: 503876 - DNA, 20 bp, Artificial Sequence
  chemically synthesized
aatggtttttcttgtccatt

SEQ ID NO: 503877 - DNA, 20 bp, Artificial Sequence
  chemically synthesized
tgttaacaaacgggttttgt

SEQ ID NO: 503878 - DNA, 20 bp, Artificial Sequence
  chemically synthesized
gggcaaatatctgttaacaa

SEQ ID NO: 503879 - DNA, 20 bp, Artificial Sequence
  chemically synthesized
tctgcctgaaggaaggaaaa

SEQ ID NO: 503880 - DNA, 20 bp, Artificial Sequence
  chemically synthesized
tttctcttcccaattagctt

SEQ ID NO: 503881 - DNA, 20 bp, Artificial Sequence
  chemically synthesized
ctttgcagaagctatgctct

SEQ ID NO: 503882 - DNA, 20 bp, Artificial Sequence
  chemically synthesized
cagaagctatgctctctgaa

SEQ ID NO: 503883 - DNA, 20 bp, Artificial Sequence
  chemically synthesized
ttgtatgtaatatgagagaa

SEQ ID NO: 503884 - DNA, 20 bp, Artificial Sequence
  chemically synthesized
tgacttatagagcatttatg

SEQ ID NO: 503885 - DNA, 20 bp, Artificial Sequence
  chemically synthesized
caggcaggatttgagggtgg

SEQ ID NO: 503886 - DNA, 20 bp, Artificial Sequence
  chemically synthesized
ataatgttcaggcaggattt

SEQ ID NO: 503887 - DNA, 20 bp, Artificial Sequence
  chemically synthesized
aagaatgaataatgttcagg

SEQ ID NO: 503888 - DNA, 20 bp, Artificial Sequence
  chemically synthesized
catggattttgaaatcaaga

SEQ ID NO: 503889 - DNA, 20 bp, Artificial Sequence
  chemically synthesized
taaacatggattttgaaatc

SEQ ID NO: 503890 - DNA, 20 bp, Artificial Sequence
  chemically synthesized
taatttgcctagaagtaaac

SEQ ID NO: 503891 - DNA, 20 bp, Artificial Sequence
  chemically synthesized
ctcaccacacgctagaacac

SEQ ID NO: 503892 - DNA, 20 bp, Artificial Sequence
  chemically synthesized
ggtgagcaagaccactgcct

SEQ ID NO: 503893 - DNA, 20 bp, Artificial Sequence
  chemically synthesized
ccctctggctactgaatata

SEQ ID NO: 503894 - DNA, 20 bp, Artificial Sequence
  chemically synthesized
ccctctatattcagtagcca

SEQ ID NO: 503895 - DNA, 20 bp, Artificial Sequence
  chemically synthesized
tgccaaacaccctctggcta

SEQ ID NO: 503896 - DNA, 20 bp, Artificial Sequence
  chemically synthesized
taaatatgctattgctagat

SEQ ID NO: 503897 - DNA, 20 bp, Artificial Sequence
  chemically synthesized
tttctagagtattaaaaaca

SEQ ID NO: 503898 - DNA, 20 bp, Artificial Sequence
  chemically synthesized
aaaattagtataatcatttc

SEQ ID NO: 503899 - DNA, 20 bp, Artificial Sequence
  chemically synthesized
ataatatttatacatattta

SEQ ID NO: 503900 - DNA, 20 bp, Artificial Sequence
  chemically synthesized
aaaactcagatgtttaaata

SEQ ID NO: 503901 - DNA, 20 bp, Artificial Sequence
  chemically synthesized
cagattcgatatttaaacat

SEQ ID NO: 503902 - DNA, 20 bp, Artificial Sequence
  chemically synthesized
ttaaacatctgagttttcat

SEQ ID NO: 503903 - DNA, 20 bp, Artificial Sequence
  chemically synthesized
attaactataatagatattt

SEQ ID NO: 503904 - DNA, 20 bp, Artificial Sequence
  chemically synthesized
cacaattaaaataataaata

SEQ ID NO: 503905 - DNA, 20 bp, Artificial Sequence
  chemically synthesized
tctgctttcagaatcattag

SEQ ID NO: 503906 - DNA, 20 bp, Artificial Sequence
  chemically synthesized
ggtatcagaatgtctgcttt

SEQ ID NO: 503907 - DNA, 20 bp, Artificial Sequence
  chemically synthesized
ttcgtttgtgaactgggtat

SEQ ID NO: 503908 - DNA, 20 bp, Artificial Sequence
  chemically synthesized
caaattccttcgtttgtgaa

SEQ ID NO: 503909 - DNA, 20 bp, Artificial Sequence
  chemically synthesized
gatacccagttcacaaacga

SEQ ID NO: 503910 - DNA, 20 bp, Artificial Sequence
  chemically synthesized
tgccaactgtataaattggg

SEQ ID NO: 503911 - DNA, 20 bp, Artificial Sequence
  chemically synthesized
cccatgccaactgtataaat

SEQ ID NO: 503912 - DNA, 20 bp, Artificial Sequence
  chemically synthesized
atcaatgtggagccagatac

SEQ ID NO: 503913 - DNA, 20 bp, Artificial Sequence
  chemically synthesized
tgtagatctttttttggttc

SEQ ID NO: 503914 - DNA, 20 bp, Artificial Sequence
  chemically synthesized
tatgtgctagcaagaactta

SEQ ID NO: 503915 - DNA, 20 bp, Artificial Sequence
  chemically synthesized
ctactaattgagcaccaact

SEQ ID NO: 503916 - DNA, 20 bp, Artificial Sequence
  chemically synthesized
tgtgagtaaattgcctaact

SEQ ID NO: 503917 - DNA, 20 bp, Artificial Sequence
  chemically synthesized
ctgttgattgtaactaccat

SEQ ID NO: 503918 - DNA, 20 bp, Artificial Sequence
  chemically synthesized
atatcatcatacttcctcac

SEQ ID NO: 503919 - DNA, 20 bp, Artificial Sequence
  chemically synthesized
gatataaacatgataaaaca

SEQ ID NO: 503920 - DNA, 20 bp, Artificial Sequence
  chemically synthesized
actggtatgtagtatgtagt

SEQ ID NO: 503921 - DNA, 20 bp, Artificial Sequence
  chemically synthesized
tttaatatggatagaaagga

SEQ ID NO: 503922 - DNA, 20 bp, Artificial Sequence
  chemically synthesized
ttgaacccgtagcctttaat

SEQ ID NO: 503923 - DNA, 20 bp, Artificial Sequence
  chemically synthesized
ttctatccatattaaaggct

SEQ ID NO: 503924 - DNA, 20 bp, Artificial Sequence
  chemically synthesized
ggtagtttgaaggcatttct

SEQ ID NO: 503925 - DNA, 20 bp, Artificial Sequence
  chemically synthesized
cattataaatttgtcttttc

SEQ ID NO: 503926 - DNA, 20 bp, Artificial Sequence
  chemically synthesized
agctacagacagttaatgaa

SEQ ID NO: 503927 - DNA, 20 bp, Artificial Sequence
  chemically synthesized
atcatgtagtattaagagag

SEQ ID NO: 503928 - DNA, 20 bp, Artificial Sequence
  chemically synthesized
actgctttctgtaattcatc

SEQ ID NO: 503929 - DNA, 20 bp, Artificial Sequence
  chemically synthesized
ttttgaatataaaactccag

SEQ ID NO: 503930 - DNA, 20 bp, Artificial Sequence
  chemically synthesized
agagtatcttgagagagatt

SEQ ID NO: 503931 - DNA, 20 bp, Artificial Sequence
  chemically synthesized
atggatgacacaagctgaag

SEQ ID NO: 503932 - DNA, 20 bp, Artificial Sequence
  chemically synthesized
gatctatcagagatgcacga

SEQ ID NO: 503933 - DNA, 20 bp, Artificial Sequence
  chemically synthesized
gaaagatctatcagagatgc

SEQ ID NO: 503934 - DNA, 20 bp, Artificial Sequence
  chemically synthesized
tgcataagaaaataactcat

SEQ ID NO: 503935 - DNA, 20 bp, Artificial Sequence
  chemically synthesized
attgagtgtatctgatcccc

SEQ ID NO: 503936 - DNA, 20 bp, Artificial Sequence
  chemically synthesized
attttcacacttatgggaaa

SEQ ID NO: 503937 - DNA, 20 bp, Artificial Sequence
  chemically synthesized
aagcattgtcacacaaacag

SEQ ID NO: 503938 - DNA, 20 bp, Artificial Sequence
  chemically synthesized
ttgtgtgacaatgcttttct

SEQ ID NO: 503939 - DNA, 20 bp, Artificial Sequence
  chemically synthesized
aaacattatgaaagaacaca

SEQ ID NO: 503940 - DNA, 20 bp, Artificial Sequence
  chemically synthesized
atacatgattatgaagttct

SEQ ID NO: 503941 - DNA, 20 bp, Artificial Sequence
  chemically synthesized
gttttttctttttaatttat

SEQ ID NO: 503942 - DNA, 20 bp, Artificial Sequence
  chemically synthesized
tgccatatattatcttcttt

SEQ ID NO: 503943 - DNA, 20 bp, Artificial Sequence
  chemically synthesized
ttaaatgattgcaaatcgaa

SEQ ID NO: 503944 - DNA, 20 bp, Artificial Sequence
  chemically synthesized
ataaagagcccattttgggc

SEQ ID NO: 503945 - DNA, 20 bp, Artificial Sequence
  chemically synthesized
atctaaaaggttgtattatg

SEQ ID NO: 503946 - DNA, 20 bp, Artificial Sequence
  chemically synthesized
atataaaaatgttaatgtcc

SEQ ID NO: 503947 - DNA, 20 bp, Artificial Sequence
  chemically synthesized
aaatgttaatgtccacgaat

SEQ ID NO: 503948 - DNA, 20 bp, Artificial Sequence
  chemically synthesized
agtcaactgctccatttttt

SEQ ID NO: 503949 - DNA, 20 bp, Artificial Sequence
  chemically synthesized
aactgctccattttttgaga

SEQ ID NO: 503950 - DNA, 20 bp, Artificial Sequence
  chemically synthesized
aagatgtttggtctttaaag

SEQ ID NO: 503951 - DNA, 20 bp, Artificial Sequence
  chemically synthesized
aatctctcatgaaagcacct

SEQ ID NO: 503952 - DNA, 20 bp, Artificial Sequence
  chemically synthesized
attatgacatatatatacta

SEQ ID NO: 503953 - DNA, 20 bp, Artificial Sequence
  chemically synthesized
gtgtaaaatgcaagttgcaa

SEQ ID NO: 503954 - DNA, 20 bp, Artificial Sequence
  chemically synthesized
tttttctggttaatgagtaa

SEQ ID NO: 503955 - DNA, 20 bp, Artificial Sequence
  chemically synthesized
gttttgcatttttctggtta

SEQ ID NO: 503956 - DNA, 20 bp, Artificial Sequence
  chemically synthesized
gtataatgattgtaatacta

SEQ ID NO: 503957 - DNA, 20 bp, Artificial Sequence
  chemically synthesized
gaagaataccatcttttgaa

SEQ ID NO: 503958 - DNA, 20 bp, Artificial Sequence
  chemically synthesized
agagagaagaataccatctt

SEQ ID NO: 503959 - DNA, 20 bp, Artificial Sequence
  chemically synthesized
atgttgtttcaaccagagag

SEQ ID NO: 503960 - DNA, 20 bp, Artificial Sequence
  chemically synthesized
acattatacattttaagtaa

SEQ ID NO: 503961 - DNA, 20 bp, Artificial Sequence
  chemically synthesized
tgcccaatagtaaatatgtg

SEQ ID NO: 503962 - DNA, 20 bp, Artificial Sequence
  chemically synthesized
acatattgttctagatgtgt

SEQ ID NO: 503963 - DNA, 20 bp, Artificial Sequence
  chemically synthesized
tctaagtagaaatttagcag

SEQ ID NO: 503964 - DNA, 20 bp, Artificial Sequence
  chemically synthesized
cttaaaagattataacagag

SEQ ID NO: 503965 - DNA, 20 bp, Artificial Sequence
  chemically synthesized
aaaaatattagagggactaa

SEQ ID NO: 503966 - DNA, 20 bp, Artificial Sequence
  chemically synthesized
gtttttactagaagtcttgg

SEQ ID NO: 503967 - DNA, 20 bp, Artificial Sequence
  chemically synthesized
cacacacacaaagtatgtat

SEQ ID NO: 503968 - DNA, 20 bp, Artificial Sequence
  chemically synthesized
tcaagtatggtgagatattg

SEQ ID NO: 503969 - DNA, 20 bp, Artificial Sequence
  chemically synthesized
gtttttgccttcaaaatttc

SEQ ID NO: 503970 - DNA, 20 bp, Artificial Sequence
  chemically synthesized
taggagacaagaaaatctcg

SEQ ID NO: 503971 - DNA, 20 bp, Artificial Sequence
  chemically synthesized
aaaatctcgtgggatttggc

SEQ ID NO: 503972 - DNA, 20 bp, Artificial Sequence
  chemically synthesized
tgtaataacaggcaaatttc

SEQ ID NO: 503973 - DNA, 20 bp, Artificial Sequence
  chemically synthesized
aaatttctagggtagtagac

SEQ ID NO: 503974 - DNA, 20 bp, Artificial Sequence
  chemically synthesized
agtagactggggtatacatc

SEQ ID NO: 503975 - DNA, 20 bp, Artificial Sequence
  chemically synthesized
tattaattgatgtggaggtg

SEQ ID NO: 503976 - DNA, 20 bp, Artificial Sequence
  chemically synthesized
tggaggtgttgagtgggcaa

SEQ ID NO: 503977 - DNA, 20 bp, Artificial Sequence
  chemically synthesized
ggcaaatgggtatgcaggtc

SEQ ID NO: 503978 - DNA, 20 bp, Artificial Sequence
  chemically synthesized
gcaggtctaggatcattaga

SEQ ID NO: 503979 - DNA, 20 bp, Artificial Sequence
  chemically synthesized
gagcttgataagttgacccg

SEQ ID NO: 503980 - DNA, 20 bp, Artificial Sequence
  chemically synthesized
ttgataagttgacccggaga

SEQ ID NO: 503981 - DNA, 20 bp, Artificial Sequence
  chemically synthesized
cccctattaccacccactct

SEQ ID NO: 503982 - DNA, 20 bp, Artificial Sequence
  chemically synthesized
gtaatagggggaaaaaaaaa

SEQ ID NO: 503983 - DNA, 20 bp, Artificial Sequence
  chemically synthesized
gtcagggcaatagaaccacc

SEQ ID NO: 503984 - DNA, 20 bp, Artificial Sequence
  chemically synthesized
aaactaagagataattaaga

SEQ ID NO: 503985 - DNA, 20 bp, Artificial Sequence
  chemically synthesized
aatgatgacacagaagccaa

SEQ ID NO: 503986 - DNA, 20 bp, Artificial Sequence
  chemically synthesized
gaatttagcgatttagtaat

SEQ ID NO: 503987 - DNA, 20 bp, Artificial Sequence
  chemically synthesized
agattttgtcagggtcatca

SEQ ID NO: 503988 - DNA, 20 bp, Artificial Sequence
  chemically synthesized
tctattaaagcagattttgt

SEQ ID NO: 503989 - DNA, 20 bp, Artificial Sequence
  chemically synthesized
cctgacaaaatctgctttaa

SEQ ID NO: 503990 - DNA, 20 bp, Artificial Sequence
  chemically synthesized
atctgctttaatagaatagt

SEQ ID NO: 503991 - DNA, 20 bp, Artificial Sequence
  chemically synthesized
tggcatcaagagagaaggga

SEQ ID NO: 503992 - DNA, 20 bp, Artificial Sequence
  chemically synthesized
aaggagtgaaatggagagaa

SEQ ID NO: 503993 - DNA, 20 bp, Artificial Sequence
  chemically synthesized
gaatgtctgtaaagggaaac

SEQ ID NO: 503994 - DNA, 20 bp, Artificial Sequence
  chemically synthesized
agagagattgttgtccaatt

SEQ ID NO: 503995 - DNA, 20 bp, Artificial Sequence
  chemically synthesized
taatatctcctgtcatttaa

SEQ ID NO: 503996 - DNA, 20 bp, Artificial Sequence
  chemically synthesized
ttaaatgacaggagatatta

SEQ ID NO: 503997 - DNA, 20 bp, Artificial Sequence
  chemically synthesized
cagaataattctctactgat

SEQ ID NO: 503998 - DNA, 20 bp, Artificial Sequence
  chemically synthesized
tcccatcattcccatcagta

SEQ ID NO: 503999 - DNA, 20 bp, Artificial Sequence
  chemically synthesized
tctctactgatgggaatgat

SEQ ID NO: 504000 - DNA, 20 bp, Artificial Sequence
  chemically synthesized
cttgtgcagagacaagggaa

SEQ ID NO: 504001 - DNA, 20 bp, Artificial Sequence
  chemically synthesized
cagcttttccacttacgtac

SEQ ID NO: 504002 - DNA, 20 bp, Artificial Sequence
  chemically synthesized
ctatgtaaacaaagggaaag

SEQ ID NO: 504003 - DNA, 20 bp, Artificial Sequence
  chemically synthesized
gagcttatatgcaggtcagt

SEQ ID NO: 504004 - DNA, 20 bp, Artificial Sequence
  chemically synthesized
accgagaaaatataagcaat

SEQ ID NO: 504005 - DNA, 20 bp, Artificial Sequence
  chemically synthesized
agatctgacgaaagagatct

SEQ ID NO: 504006 - DNA, 20 bp, Artificial Sequence
  chemically synthesized
tctggggatcactacaccca

SEQ ID NO: 504007 - DNA, 20 bp, Artificial Sequence
  chemically synthesized
tctctgggtcagtatactct

SEQ ID NO: 504008 - DNA, 20 bp, Artificial Sequence
  chemically synthesized
ttgcagatcattgtctttct

SEQ ID NO: 504009 - DNA, 20 bp, Artificial Sequence
  chemically synthesized
aaatgggatttagaggttac

SEQ ID NO: 504010 - DNA, 20 bp, Artificial Sequence
  chemically synthesized
agtaaatagttatcaataaa

SEQ ID NO: 504011 - DNA, 20 bp, Artificial Sequence
  chemically synthesized
caaatagaaacctacatata

SEQ ID NO: 504012 - DNA, 20 bp, Artificial Sequence
  chemically synthesized
gctctatacaccttgaaaag

SEQ ID NO: 504013 - DNA, 20 bp, Artificial Sequence
  chemically synthesized
cataagtatataataattaa

SEQ ID NO: 504014 - DNA, 20 bp, Artificial Sequence
  chemically synthesized
catttaattattatatactt

SEQ ID NO: 504015 - DNA, 20 bp, Artificial Sequence
  chemically synthesized
gttgtttaacctttttgtgc

SEQ ID NO: 504016 - DNA, 20 bp, Artificial Sequence
  chemically synthesized
aaaaggttaaacaacttttc

SEQ ID NO: 504017 - DNA, 20 bp, Artificial Sequence
  chemically synthesized
tcacacaggcagtttatgat

SEQ ID NO: 504018 - DNA, 20 bp, Artificial Sequence
  chemically synthesized
aagctctgagatcagatcgc

SEQ ID NO: 504019 - DNA, 20 bp, Artificial Sequence
  chemically synthesized
tactggagaatatttttttt

SEQ ID NO: 504020 - DNA, 20 bp, Artificial Sequence
  chemically synthesized
acacacgcggtcaaatactg

SEQ ID NO: 504021 - DNA, 20 bp, Artificial Sequence
  chemically synthesized
cagcagcatagatgaacttg

SEQ ID NO: 504022 - DNA, 20 bp, Artificial Sequence
  chemically synthesized
atctatgctgctgcaaatgg

SEQ ID NO: 504023 - DNA, 20 bp, Artificial Sequence
  chemically synthesized
aacatggtatatgcatataa

SEQ ID NO: 504024 - DNA, 20 bp, Artificial Sequence
  chemically synthesized
aatattgctgctgtaaacat

SEQ ID NO: 504025 - DNA, 20 bp, Artificial Sequence
  chemically synthesized
atatccaaaggaaataaaat

SEQ ID NO: 504026 - DNA, 20 bp, Artificial Sequence
  chemically synthesized
agatcctgattttatttcct

SEQ ID NO: 504027 - DNA, 20 bp, Artificial Sequence
  chemically synthesized
tttggatatatatccagaag

SEQ ID NO: 504028 - DNA, 20 bp, Artificial Sequence
  chemically synthesized
ttgattcaccaatcccgctt

SEQ ID NO: 504029 - DNA, 20 bp, Artificial Sequence
  chemically synthesized
tatatccagaagcgggattg

SEQ ID NO: 504030 - DNA, 20 bp, Artificial Sequence
  chemically synthesized
gcgggattggtgaatcaaat

SEQ ID NO: 504031 - DNA, 20 bp, Artificial Sequence
  chemically synthesized
gttcctcaaaaaattacaaa

SEQ ID NO: 504032 - DNA, 20 bp, Artificial Sequence
  chemically synthesized
aattcttttatggtgttggt

SEQ ID NO: 504033 - DNA, 20 bp, Artificial Sequence
  chemically synthesized
cattccaaccaacaccataa

SEQ ID NO: 504034 - DNA, 20 bp, Artificial Sequence
  chemically synthesized
tggcaagaatgtggagaaaa

SEQ ID NO: 504035 - DNA, 20 bp, Artificial Sequence
  chemically synthesized
aaaagatactaagtgttggc

SEQ ID NO: 504036 - DNA, 20 bp, Artificial Sequence
  chemically synthesized
aagaacctcttcatacctgt

SEQ ID NO: 504037 - DNA, 20 bp, Artificial Sequence
  chemically synthesized
cttgaatagtcatttctcta

SEQ ID NO: 504038 - DNA, 20 bp, Artificial Sequence
  chemically synthesized
attaaaaatgagcacaggac

SEQ ID NO: 504039 - DNA, 20 bp, Artificial Sequence
  chemically synthesized
tttcagttttatttttgcta

SEQ ID NO: 504040 - DNA, 20 bp, Artificial Sequence
  chemically synthesized
ttagaagttccttatatatt

SEQ ID NO: 504041 - DNA, 20 bp, Artificial Sequence
  chemically synthesized
atttgccagacatatgattt

SEQ ID NO: 504042 - DNA, 20 bp, Artificial Sequence
  chemically synthesized
gaatatttccttccattccc

SEQ ID NO: 504043 - DNA, 20 bp, Artificial Sequence
  chemically synthesized
tttgactattttagattcta

SEQ ID NO: 504044 - DNA, 20 bp, Artificial Sequence
  chemically synthesized
tagtcaaactcacagaacta

SEQ ID NO: 504045 - DNA, 20 bp, Artificial Sequence
  chemically synthesized
ctattctactctctagttct

SEQ ID NO: 504046 - DNA, 20 bp, Artificial Sequence
  chemically synthesized
aaactcacagaactagagag

SEQ ID NO: 504047 - DNA, 20 bp, Artificial Sequence
  chemically synthesized
aaatggcaaaatgatgccca

SEQ ID NO: 504048 - DNA, 20 bp, Artificial Sequence
  chemically synthesized
caaagcttcagttatgcaag

SEQ ID NO: 504049 - DNA, 20 bp, Artificial Sequence
  chemically synthesized
tattgttaaaaatattccaa

SEQ ID NO: 504050 - DNA, 20 bp, Artificial Sequence
  chemically synthesized
gctcctaagatctatcctct

SEQ ID NO: 504051 - DNA, 20 bp, Artificial Sequence
  chemically synthesized
tgataggtaagtttatcatc

SEQ ID NO: 504052 - DNA, 20 bp, Artificial Sequence
  chemically synthesized
tgaatgtggtaataagtctc

SEQ ID NO: 504053 - DNA, 20 bp, Artificial Sequence
  chemically synthesized
ttatacaacttgattagttt

SEQ ID NO: 504054 - DNA, 20 bp, Artificial Sequence
  chemically synthesized
gtaaactcttagagatggaa

SEQ ID NO: 504055 - DNA, 20 bp, Artificial Sequence
  chemically synthesized
atagattctcttccatctct

SEQ ID NO: 504056 - DNA, 20 bp, Artificial Sequence
  chemically synthesized
tcttccatctctaagagttt

SEQ ID NO: 504057 - DNA, 20 bp, Artificial Sequence
  chemically synthesized
ccctaaaatgcttggtcaaa

SEQ ID NO: 504058 - DNA, 20 bp, Artificial Sequence
  chemically synthesized
ccaatttgaccaagcatttt

SEQ ID NO: 504059 - DNA, 20 bp, Artificial Sequence
  chemically synthesized
aacaaaatggaatagcttac

SEQ ID NO: 504060 - DNA, 20 bp, Artificial Sequence
  chemically synthesized
gtactaagagaagaacaaaa

SEQ ID NO: 504061 - DNA, 20 bp, Artificial Sequence
  chemically synthesized
attgtgattttaaagaaaga

SEQ ID NO: 504062 - DNA, 20 bp, Artificial Sequence
  chemically synthesized
ggtcattgtgattttaaaga

SEQ ID NO: 504063 - DNA, 20 bp, Artificial Sequence
  chemically synthesized
gtctagaggaagaatgaggg

SEQ ID NO: 504064 - DNA, 20 bp, Artificial Sequence
  chemically synthesized
gtttgttgatagtctagagg

SEQ ID NO: 504065 - DNA, 20 bp, Artificial Sequence
  chemically synthesized
tctggcagtacttgctgaag

SEQ ID NO: 504066 - DNA, 20 bp, Artificial Sequence
  chemically synthesized
gcaagtactgccagatctaa

SEQ ID NO: 504067 - DNA, 20 bp, Artificial Sequence
  chemically synthesized
atctaatgggatctgttaaa

SEQ ID NO: 504068 - DNA, 20 bp, Artificial Sequence
  chemically synthesized
ggatctgttaaaaagaataa

SEQ ID NO: 504069 - DNA, 20 bp, Artificial Sequence
  chemically synthesized
aataaaggaatgtgtcatgt

SEQ ID NO: 504070 - DNA, 20 bp, Artificial Sequence
  chemically synthesized
ggaatgtgtcatgttaggat

SEQ ID NO: 504071 - DNA, 20 bp, Artificial Sequence
  chemically synthesized
ttaggataggaataatactt

SEQ ID NO: 504072 - DNA, 20 bp, Artificial Sequence
  chemically synthesized
gtcctcatcaaaaatgtaat

SEQ ID NO: 504073 - DNA, 20 bp, Artificial Sequence
  chemically synthesized
atgaggatactaatcctctg

SEQ ID NO: 504074 - DNA, 20 bp, Artificial Sequence
  chemically synthesized
ggatactaatcctctgttgg

SEQ ID NO: 504075 - DNA, 20 bp, Artificial Sequence
  chemically synthesized
tgcaaactactcatccaaca

SEQ ID NO: 504076 - DNA, 20 bp, Artificial Sequence
  chemically synthesized
caaatattttttcccattct

SEQ ID NO: 504077 - DNA, 20 bp, Artificial Sequence
  chemically synthesized
cagaatgaaaagacaatcca

SEQ ID NO: 504078 - DNA, 20 bp, Artificial Sequence
  chemically synthesized
acagcaaaggaaacagtaaa

SEQ ID NO: 504079 - DNA, 20 bp, Artificial Sequence
  chemically synthesized
tatttttctttttatgatat

SEQ ID NO: 504080 - DNA, 20 bp, Artificial Sequence
  chemically synthesized
tataaaacatcatatcatat

SEQ ID NO: 504081 - DNA, 20 bp, Artificial Sequence
  chemically synthesized
catatcatatgtggatgtga

SEQ ID NO: 504082 - DNA, 20 bp, Artificial Sequence
  chemically synthesized
ttcagattatttgcccattt

SEQ ID NO: 504083 - DNA, 20 bp, Artificial Sequence
  chemically synthesized
ttatttgatgattaccgatg

SEQ ID NO: 504084 - DNA, 20 bp, Artificial Sequence
  chemically synthesized
aggtatcacctcaccccagc

SEQ ID NO: 504085 - DNA, 20 bp, Artificial Sequence
  chemically synthesized
ttggcaatatacatcctagc

SEQ ID NO: 504086 - DNA, 20 bp, Artificial Sequence
  chemically synthesized
gacaaaaaataattgttggc

SEQ ID NO: 504087 - DNA, 20 bp, Artificial Sequence
  chemically synthesized
aactacactacactgttagt

SEQ ID NO: 504088 - DNA, 20 bp, Artificial Sequence
  chemically synthesized
gcaggaaaaaggggatattt

SEQ ID NO: 504089 - DNA, 20 bp, Artificial Sequence
  chemically synthesized
aaaaaaacaggcaggaaaaa

SEQ ID NO: 504090 - DNA, 20 bp, Artificial Sequence
  chemically synthesized
gggctgaagtggaagcaggt

SEQ ID NO: 504091 - DNA, 20 bp, Artificial Sequence
  chemically synthesized
ctgcatattcctattagaag

SEQ ID NO: 504092 - DNA, 20 bp, Artificial Sequence
  chemically synthesized
tgatttattcttcttctaat

SEQ ID NO: 504093 - DNA, 20 bp, Artificial Sequence
  chemically synthesized
gtcatctgacttttaagcat

SEQ ID NO: 504094 - DNA, 20 bp, Artificial Sequence
  chemically synthesized
agtgggaaaatgagtcagaa

SEQ ID NO: 504095 - DNA, 20 bp, Artificial Sequence
  chemically synthesized
aggagaaaaagagtgggaaa

SEQ ID NO: 504096 - DNA, 20 bp, Artificial Sequence
  chemically synthesized
tcaaaggaagccaggagaaa

SEQ ID NO: 504097 - DNA, 20 bp, Artificial Sequence
  chemically synthesized
ttctccacttcattttctgg

SEQ ID NO: 504098 - DNA, 20 bp, Artificial Sequence
  chemically synthesized
cttgacaatttgttgtgtca

SEQ ID NO: 504099 - DNA, 20 bp, Artificial Sequence
  chemically synthesized
aattgtcaagttcctactac

SEQ ID NO: 504100 - DNA, 20 bp, Artificial Sequence
  chemically synthesized
ggcgaaattaaagctgatac

SEQ ID NO: 504101 - DNA, 20 bp, Artificial Sequence
  chemically synthesized
actttctattgggtagtcag

SEQ ID NO: 504102 - DNA, 20 bp, Artificial Sequence
  chemically synthesized
agcaggaaaactactttcta

SEQ ID NO: 504103 - DNA, 20 bp, Artificial Sequence
  chemically synthesized
gctcctgtcactctcattta

SEQ ID NO: 504104 - DNA, 20 bp, Artificial Sequence
  chemically synthesized
gcaataagaaccctttaaat

SEQ ID NO: 504105 - DNA, 20 bp, Artificial Sequence
  chemically synthesized
agggttcttattgctacatt

SEQ ID NO: 504106 - DNA, 20 bp, Artificial Sequence
  chemically synthesized
tttgaagtcttgcttacact

SEQ ID NO: 504107 - DNA, 20 bp, Artificial Sequence
  chemically synthesized
aaatgatcagatataagtga

SEQ ID NO: 504108 - DNA, 20 bp, Artificial Sequence
  chemically synthesized
atcatttttttagaaatagc

SEQ ID NO: 504109 - DNA, 20 bp, Artificial Sequence
  chemically synthesized
ggttattattttaaatttta

SEQ ID NO: 504110 - DNA, 20 bp, Artificial Sequence
  chemically synthesized
tcacatcccatgatctaatt

SEQ ID NO: 504111 - DNA, 20 bp, Artificial Sequence
  chemically synthesized
atatacccaaaattagatca

SEQ ID NO: 504112 - DNA, 20 bp, Artificial Sequence
  chemically synthesized
ttggcatctggtgacaaaaa

SEQ ID NO: 504113 - DNA, 20 bp, Artificial Sequence
  chemically synthesized
aggaattatctttaacccaa

SEQ ID NO: 504114 - DNA, 20 bp, Artificial Sequence
  chemically synthesized
taagtgtgtgatacactctt

SEQ ID NO: 504115 - DNA, 20 bp, Artificial Sequence
  chemically synthesized
ttcatttccattattctctc

SEQ ID NO: 504116 - DNA, 20 bp, Artificial Sequence
  chemically synthesized
taccaattcagcattccaga

SEQ ID NO: 504117 - DNA, 20 bp, Artificial Sequence
  chemically synthesized
ccattattctctctggaatg

SEQ ID NO: 504118 - DNA, 20 bp, Artificial Sequence
  chemically synthesized
taaaaacaaggaagccatat

SEQ ID NO: 504119 - DNA, 20 bp, Artificial Sequence
  chemically synthesized
tgttctgactttgtagccaa

SEQ ID NO: 504120 - DNA, 20 bp, Artificial Sequence
  chemically synthesized
ctacaaagtcagaacatggc

SEQ ID NO: 504121 - DNA, 20 bp, Artificial Sequence
  chemically synthesized
tgatctccattttctaatct

SEQ ID NO: 504122 - DNA, 20 bp, Artificial Sequence
  chemically synthesized
aatggagatcagaacatagc

SEQ ID NO: 504123 - DNA, 20 bp, Artificial Sequence
  chemically synthesized
gcttttttgctatgcaacag

SEQ ID NO: 504124 - DNA, 20 bp, Artificial Sequence
  chemically synthesized
ttatgtctgttatatgtact

SEQ ID NO: 504125 - DNA, 20 bp, Artificial Sequence
  chemically synthesized
tcaaggtttttacattttac

SEQ ID NO: 504126 - DNA, 20 bp, Artificial Sequence
  chemically synthesized
ttgttgaatgttcttaatgg

SEQ ID NO: 504127 - DNA, 20 bp, Artificial Sequence
  chemically synthesized
ttgtttgttgaatgttctta

SEQ ID NO: 504128 - DNA, 20 bp, Artificial Sequence
  chemically synthesized
aggtatttgttttttgtttg

SEQ ID NO: 504129 - DNA, 20 bp, Artificial Sequence
  chemically synthesized
ctgaagtaagtcagtgctag

SEQ ID NO: 504130 - DNA, 20 bp, Artificial Sequence
  chemically synthesized
gcactgacttacttcaggag

SEQ ID NO: 504131 - DNA, 20 bp, Artificial Sequence
  chemically synthesized
aattcacagatgagctgtcc

SEQ ID NO: 504132 - DNA, 20 bp, Artificial Sequence
  chemically synthesized
gacccagggacagctcatct

SEQ ID NO: 504133 - DNA, 20 bp, Artificial Sequence
  chemically synthesized
cttgtcagtgattgtattag

SEQ ID NO: 504134 - DNA, 20 bp, Artificial Sequence
  chemically synthesized
tacctttttggaaattaata

SEQ ID NO: 504135 - DNA, 20 bp, Artificial Sequence
  chemically synthesized
aggaaaaaatctagtgtata

SEQ ID NO: 504136 - DNA, 20 bp, Artificial Sequence
  chemically synthesized
attaaattttataggtatgt

SEQ ID NO: 504137 - DNA, 20 bp, Artificial Sequence
  chemically synthesized
tttactgtgctcaccgattt

SEQ ID NO: 504138 - DNA, 20 bp, Artificial Sequence
  chemically synthesized
ttcaaatgcttgtggtcaat

SEQ ID NO: 504139 - DNA, 20 bp, Artificial Sequence
  chemically synthesized
taaaattttgaactaaagca

SEQ ID NO: 504140 - DNA, 20 bp, Artificial Sequence
  chemically synthesized
gtatttgatatacactattt

SEQ ID NO: 504141 - DNA, 20 bp, Artificial Sequence
  chemically synthesized
atatatcttactatccgtaa

SEQ ID NO: 504142 - DNA, 20 bp, Artificial Sequence
  chemically synthesized
ttatatttaaatattcaatt

SEQ ID NO: 504143 - DNA, 20 bp, Artificial Sequence
  chemically synthesized
agtttctcatttttctacag

SEQ ID NO: 504144 - DNA, 20 bp, Artificial Sequence
  chemically synthesized
gaaaaatgagaaactcaaat

SEQ ID NO: 504145 - DNA, 20 bp, Artificial Sequence
  chemically synthesized
aaatgactgtacactcatat

SEQ ID NO: 504146 - DNA, 20 bp, Artificial Sequence
  chemically synthesized
tcagtaaccattaagaatag

SEQ ID NO: 504147 - DNA, 20 bp, Artificial Sequence
  chemically synthesized
attaagattcagtaaccatt

SEQ ID NO: 504148 - DNA, 20 bp, Artificial Sequence
  chemically synthesized
tcagctattcttaatggtta

SEQ ID NO: 504149 - DNA, 20 bp, Artificial Sequence
  chemically synthesized
aaaatgctggaattataggt

SEQ ID NO: 504150 - DNA, 20 bp, Artificial Sequence
  chemically synthesized
tccttggcctcccaaaatgc

SEQ ID NO: 504151 - DNA, 20 bp, Artificial Sequence
  chemically synthesized
aaagagcattgtttgagccc

SEQ ID NO: 504152 - DNA, 20 bp, Artificial Sequence
  chemically synthesized
ctgtgtttcccaggctggtt

SEQ ID NO: 504153 - DNA, 20 bp, Artificial Sequence
  chemically synthesized
ttgttattttttggtagaga

SEQ ID NO: 504154 - DNA, 20 bp, Artificial Sequence
  chemically synthesized
acttgtggggactgagatgg

SEQ ID NO: 504155 - DNA, 20 bp, Artificial Sequence
  chemically synthesized
gaggttgaggctgcagtgag

SEQ ID NO: 504156 - DNA, 20 bp, Artificial Sequence
  chemically synthesized
tcacaccactgcactccagc

SEQ ID NO: 504157 - DNA, 20 bp, Artificial Sequence
  chemically synthesized
tctccctctgtcacccaggc

SEQ ID NO: 504158 - DNA, 20 bp, Artificial Sequence
  chemically synthesized
atttattttattttttggga

SEQ ID NO: 504159 - DNA, 20 bp, Artificial Sequence
  chemically synthesized
aatatatgtgtatgtagaaa

SEQ ID NO: 504160 - DNA, 20 bp, Artificial Sequence
  chemically synthesized
acataaatgtataataataa

SEQ ID NO: 504161 - DNA, 20 bp, Artificial Sequence
  chemically synthesized
atttatgttctgaagaaaac

SEQ ID NO: 504162 - DNA, 20 bp, Artificial Sequence
  chemically synthesized
atggattggaaataatgact

SEQ ID NO: 504163 - DNA, 20 bp, Artificial Sequence
  chemically synthesized
ttggaaataatgactaagaa

SEQ ID NO: 504164 - DNA, 20 bp, Artificial Sequence
  chemically synthesized
tgtgttcaagaaagtcattt

SEQ ID NO: 504165 - DNA, 20 bp, Artificial Sequence
  chemically synthesized
cattttaggatcaaaataag

SEQ ID NO: 504166 - DNA, 20 bp, Artificial Sequence
  chemically synthesized
tagaaaaaagattaatttgt

SEQ ID NO: 504167 - DNA, 20 bp, Artificial Sequence
  chemically synthesized
tgttggcacatgtgatccca

SEQ ID NO: 504168 - DNA, 20 bp, Artificial Sequence
  chemically synthesized
tcaaagaacttaacactcag

SEQ ID NO: 504169 - DNA, 20 bp, Artificial Sequence
  chemically synthesized
cccactgagtgttaagttct

SEQ ID NO: 504170 - DNA, 20 bp, Artificial Sequence
  chemically synthesized
gataaagaatgaagcagagc

SEQ ID NO: 504171 - DNA, 20 bp, Artificial Sequence
  chemically synthesized
atgaaggtgggcagaagata

SEQ ID NO: 504172 - DNA, 20 bp, Artificial Sequence
  chemically synthesized
ttgacactgtttagactggg

SEQ ID NO: 504173 - DNA, 20 bp, Artificial Sequence
  chemically synthesized
tttagactgggctgaattgt

SEQ ID NO: 504174 - DNA, 20 bp, Artificial Sequence
  chemically synthesized
tgggactgatggcattgcat

SEQ ID NO: 504175 - DNA, 20 bp, Artificial Sequence
  chemically synthesized
tgttcaatggttattatggc

SEQ ID NO: 504176 - DNA, 20 bp, Artificial Sequence
  chemically synthesized
attatggcatgaatccagtg

SEQ ID NO: 504177 - DNA, 20 bp, Artificial Sequence
  chemically synthesized
agaatacaaataattcccca

SEQ ID NO: 504178 - DNA, 20 bp, Artificial Sequence
  chemically synthesized
ccttttgtttctgatataag

SEQ ID NO: 504179 - DNA, 20 bp, Artificial Sequence
  chemically synthesized
agtattttcattttcaaaca

SEQ ID NO: 504180 - DNA, 20 bp, Artificial Sequence
  chemically synthesized
cagaaattgtttacagtgta

SEQ ID NO: 504181 - DNA, 20 bp, Artificial Sequence
  chemically synthesized
gtgtgaaggttatttgtgag

SEQ ID NO: 504182 - DNA, 20 bp, Artificial Sequence
  chemically synthesized
tgctgcatgacaatggtata

SEQ ID NO: 504183 - DNA, 20 bp, Artificial Sequence
  chemically synthesized
gatgaagagaacaacacagt

SEQ ID NO: 504184 - DNA, 20 bp, Artificial Sequence
  chemically synthesized
aagaaataacaagtagctca

SEQ ID NO: 504185 - DNA, 20 bp, Artificial Sequence
  chemically synthesized
tgcagtataatttaaaggta

SEQ ID NO: 504186 - DNA, 20 bp, Artificial Sequence
  chemically synthesized
aataatgttatcaaatgagg

SEQ ID NO: 504187 - DNA, 20 bp, Artificial Sequence
  chemically synthesized
agttcctcatttactcaacc

SEQ ID NO: 504188 - DNA, 20 bp, Artificial Sequence
  chemically synthesized
caatgttgagaaaccctggg

SEQ ID NO: 504189 - DNA, 20 bp, Artificial Sequence
  chemically synthesized
agtgccaatgttgagaaacc

SEQ ID NO: 504190 - DNA, 20 bp, Artificial Sequence
  chemically synthesized
tgtgcagttccttgttctgg

SEQ ID NO: 504191 - DNA, 20 bp, Artificial Sequence
  chemically synthesized
ttgattgtcacagctgggtt

SEQ ID NO: 504192 - DNA, 20 bp, Artificial Sequence
  chemically synthesized
gacgtttttgattgtcacag

SEQ ID NO: 504193 - DNA, 20 bp, Artificial Sequence
  chemically synthesized
attttgctctcctctcccca

SEQ ID NO: 504194 - DNA, 20 bp, Artificial Sequence
  chemically synthesized
atcagtgttttacagctggg

SEQ ID NO: 504195 - DNA, 20 bp, Artificial Sequence
  chemically synthesized
ttagatcagtgttttacagc

SEQ ID NO: 504196 - DNA, 20 bp, Artificial Sequence
  chemically synthesized
tttaatatgaataattttgt

SEQ ID NO: 504197 - DNA, 20 bp, Artificial Sequence
  chemically synthesized
ttttatatgatgcctttaat

SEQ ID NO: 504198 - DNA, 20 bp, Artificial Sequence
  chemically synthesized
aaaaagcagctgaaacagtg

SEQ ID NO: 504199 - DNA, 20 bp, Artificial Sequence
  chemically synthesized
cactgtttcagctgcttttt

SEQ ID NO: 504200 - DNA, 20 bp, Artificial Sequence
  chemically synthesized
cagctgcttttttagaattt

SEQ ID NO: 504201 - DNA, 20 bp, Artificial Sequence
  chemically synthesized
aggaggaatggcctgccctt

SEQ ID NO: 504202 - DNA, 20 bp, Artificial Sequence
  chemically synthesized
agttgatgtttttctgaagg

SEQ ID NO: 504203 - DNA, 20 bp, Artificial Sequence
  chemically synthesized
acttcagccatccatttctt

SEQ ID NO: 504204 - DNA, 20 bp, Artificial Sequence
  chemically synthesized
cacatacaaaccctgaagaa

SEQ ID NO: 504205 - DNA, 20 bp, Artificial Sequence
  chemically synthesized
ccttataacgggtctcgttt

SEQ ID NO: 504206 - DNA, 20 bp, Artificial Sequence
  chemically synthesized
cacaccagtaatgccttata

SEQ ID NO: 504207 - DNA, 20 bp, Artificial Sequence
  chemically synthesized
tgtttagacataacacaatg

SEQ ID NO: 504208 - DNA, 20 bp, Artificial Sequence
  chemically synthesized
aaaaacaattcccatgttta

SEQ ID NO: 504209 - DNA, 20 bp, Artificial Sequence
  chemically synthesized
tagagacatcctttaaacat

SEQ ID NO: 504210 - DNA, 20 bp, Artificial Sequence
  chemically synthesized
tctaagtagttcttgaggca

SEQ ID NO: 504211 - DNA, 20 bp, Artificial Sequence
  chemically synthesized
ggatatgatttaatgttctc

SEQ ID NO: 504212 - DNA, 20 bp, Artificial Sequence
  chemically synthesized
aacttaaaatttctctagag

SEQ ID NO: 504213 - DNA, 20 bp, Artificial Sequence
  chemically synthesized
taagttacaaaacaactcat

SEQ ID NO: 504214 - DNA, 20 bp, Artificial Sequence
  chemically synthesized
gacacatttttagtattctc

SEQ ID NO: 504215 - DNA, 20 bp, Artificial Sequence
  chemically synthesized
gctataaagacaccattaca

SEQ ID NO: 504216 - DNA, 20 bp, Artificial Sequence
  chemically synthesized
agaaaataatttgtgaaagt

SEQ ID NO: 504217 - DNA, 20 bp, Artificial Sequence
  chemically synthesized
aggtaatacgggaaagaatc

SEQ ID NO: 504218 - DNA, 20 bp, Artificial Sequence
  chemically synthesized
gaaaaaaaggtaatacggga

SEQ ID NO: 504219 - DNA, 20 bp, Artificial Sequence
  chemically synthesized
aacacatgtagacagcatag

SEQ ID NO: 504220 - DNA, 20 bp, Artificial Sequence
  chemically synthesized
ttttttttttttttttgaga

SEQ ID NO: 504221 - DNA, 20 bp, Artificial Sequence
  chemically synthesized
tcttgctctgtcgcccaggc

SEQ ID NO: 504222 - DNA, 20 bp, Artificial Sequence
  chemically synthesized
tacttgggaggctgaggcag

SEQ ID NO: 504223 - DNA, 20 bp, Artificial Sequence
  chemically synthesized
gcctcagcctcccaagtagc

SEQ ID NO: 504224 - DNA, 20 bp, Artificial Sequence
  chemically synthesized
ttttgtgtttttagtagaga

SEQ ID NO: 504225 - DNA, 20 bp, Artificial Sequence
  chemically synthesized
atctacctgcctcagctgcc

SEQ ID NO: 504226 - DNA, 20 bp, Artificial Sequence
  chemically synthesized
gcctcagctgcccagagtgc

SEQ ID NO: 504227 - DNA, 20 bp, Artificial Sequence
  chemically synthesized
aaaacgagccagtgcattaa

SEQ ID NO: 504228 - DNA, 20 bp, Artificial Sequence
  chemically synthesized
catcactgtagatcagtaat

SEQ ID NO: 504229 - DNA, 20 bp, Artificial Sequence
  chemically synthesized
ctcctccttcctctcatctt

SEQ ID NO: 504230 - DNA, 20 bp, Artificial Sequence
  chemically synthesized
gaatgttttgaaaacacaag

SEQ ID NO: 504231 - DNA, 20 bp, Artificial Sequence
  chemically synthesized
tggatgctatgttttacaat

SEQ ID NO: 504232 - DNA, 20 bp, Artificial Sequence
  chemically synthesized
agagtagacagtgaatgtcc

SEQ ID NO: 504233 - DNA, 20 bp, Artificial Sequence
  chemically synthesized
aactggattgagagtagaca

SEQ ID NO: 504234 - DNA, 20 bp, Artificial Sequence
  chemically synthesized
tatggttggaaaactggatt

SEQ ID NO: 504235 - DNA, 20 bp, Artificial Sequence
  chemically synthesized
aaaatattatggttggaaaa

SEQ ID NO: 504236 - DNA, 20 bp, Artificial Sequence
  chemically synthesized
actgggtagacaatatatat

SEQ ID NO: 504237 - DNA, 20 bp, Artificial Sequence
  chemically synthesized
taaatgatataagttcaaca

SEQ ID NO: 504238 - DNA, 20 bp, Artificial Sequence
  chemically synthesized
ttagctaataccgagaaaga

SEQ ID NO: 504239 - DNA, 20 bp, Artificial Sequence
  chemically synthesized
tctgctatagattaaatagg

SEQ ID NO: 504240 - DNA, 20 bp, Artificial Sequence
  chemically synthesized
atccaacataaactaggaaa

SEQ ID NO: 504241 - DNA, 20 bp, Artificial Sequence
  chemically synthesized
atcctttttcctagtttatg

SEQ ID NO: 504242 - DNA, 20 bp, Artificial Sequence
  chemically synthesized
aatttatttaccatgcaagg

SEQ ID NO: 504243 - DNA, 20 bp, Artificial Sequence
  chemically synthesized
gattagggtgaggacatctt

SEQ ID NO: 504244 - DNA, 20 bp, Artificial Sequence
  chemically synthesized
tactcacaggtttcagagat

SEQ ID NO: 504245 - DNA, 20 bp, Artificial Sequence
  chemically synthesized
caccctaatctctgaaacct

SEQ ID NO: 504246 - DNA, 20 bp, Artificial Sequence
  chemically synthesized
tttgcagatgtgattacatt

SEQ ID NO: 504247 - DNA, 20 bp, Artificial Sequence
  chemically synthesized
ccagtataatctccccatct

SEQ ID NO: 504248 - DNA, 20 bp, Artificial Sequence
  chemically synthesized
tctgagatggggagattata

SEQ ID NO: 504249 - DNA, 20 bp, Artificial Sequence
  chemically synthesized
tgtgattacattatgccctg

SEQ ID NO: 504250 - DNA, 20 bp, Artificial Sequence
  chemically synthesized
aaggaagtcaacacagggaa

SEQ ID NO: 504251 - DNA, 20 bp, Artificial Sequence
  chemically synthesized
cactgctgactttgaagatg

SEQ ID NO: 504252 - DNA, 20 bp, Artificial Sequence
  chemically synthesized
gaggatggggacatgagaca

SEQ ID NO: 504253 - DNA, 20 bp, Artificial Sequence
  chemically synthesized
ctgttttggaggctttgcga

SEQ ID NO: 504254 - DNA, 20 bp, Artificial Sequence
  chemically synthesized
agttctggaagtcaaaagtt

SEQ ID NO: 504255 - DNA, 20 bp, Artificial Sequence
  chemically synthesized
ttcaagcaacacaaatttat

SEQ ID NO: 504256 - DNA, 20 bp, Artificial Sequence
  chemically synthesized
taaatttccggcaatttgtt

SEQ ID NO: 504257 - DNA, 20 bp, Artificial Sequence
  chemically synthesized
tgttaggagtgccataggaa

SEQ ID NO: 504258 - DNA, 20 bp, Artificial Sequence
  chemically synthesized
cacctaccttcctccttcac

SEQ ID NO: 504259 - DNA, 20 bp, Artificial Sequence
  chemically synthesized
caaaaactaagcagctagac

SEQ ID NO: 504260 - DNA, 20 bp, Artificial Sequence
  chemically synthesized
aacattgcaacaatatgctc

SEQ ID NO: 504261 - DNA, 20 bp, Artificial Sequence
  chemically synthesized
taaggtaagtaatgtgtccc

SEQ ID NO: 504262 - DNA, 20 bp, Artificial Sequence
  chemically synthesized
gggacacattacttacctta

SEQ ID NO: 504263 - DNA, 20 bp, Artificial Sequence
  chemically synthesized
gtttactgtttttctttagc

SEQ ID NO: 504264 - DNA, 20 bp, Artificial Sequence
  chemically synthesized
attcccttgacttaatttgt

SEQ ID NO: 504265 - DNA, 20 bp, Artificial Sequence
  chemically synthesized
attcaaacaaattaagtcaa

SEQ ID NO: 504266 - DNA, 20 bp, Artificial Sequence
  chemically synthesized
taacttattttatcaccata

SEQ ID NO: 504267 - DNA, 20 bp, Artificial Sequence
  chemically synthesized
atatatatatacgtgtataa

SEQ ID NO: 504268 - DNA, 20 bp, Artificial Sequence
  chemically synthesized
ctgttttggagactttgaaa

SEQ ID NO: 504269 - DNA, 20 bp, Artificial Sequence
  chemically synthesized
tgttctggaggtcagaagtt

SEQ ID NO: 504270 - DNA, 20 bp, Artificial Sequence
  chemically synthesized
taaatttctgctaatttctt

SEQ ID NO: 504271 - DNA, 20 bp, Artificial Sequence
  chemically synthesized
ctactgcacatatacatata

SEQ ID NO: 504272 - DNA, 20 bp, Artificial Sequence
  chemically synthesized
atatatggagttatacataa

SEQ ID NO: 504273 - DNA, 20 bp, Artificial Sequence
  chemically synthesized
atggagttatacataatggg

SEQ ID NO: 504274 - DNA, 20 bp, Artificial Sequence
  chemically synthesized
ttttgctacttataaaaagt

SEQ ID NO: 504275 - DNA, 20 bp, Artificial Sequence
  chemically synthesized
gtctggttgtcttttaagat

SEQ ID NO: 504276 - DNA, 20 bp, Artificial Sequence
  chemically synthesized
ttaaaagacaaccagactaa

SEQ ID NO: 504277 - DNA, 20 bp, Artificial Sequence
  chemically synthesized
ctattttcaccattaccaat

SEQ ID NO: 504278 - DNA, 20 bp, Artificial Sequence
  chemically synthesized
gttttctcagtgtttttaga

SEQ ID NO: 504279 - DNA, 20 bp, Artificial Sequence
  chemically synthesized
aggagttttctcagtgtttt

SEQ ID NO: 504280 - DNA, 20 bp, Artificial Sequence
  chemically synthesized
attccttctaggaaaagaat

SEQ ID NO: 504281 - DNA, 20 bp, Artificial Sequence
  chemically synthesized
ttgcttattccttctaggaa

SEQ ID NO: 504282 - DNA, 20 bp, Artificial Sequence
  chemically synthesized
actcctattcttttcctaga

SEQ ID NO: 504283 - DNA, 20 bp, Artificial Sequence
  chemically synthesized
aaagacatgagtcttttaca

SEQ ID NO: 504284 - DNA, 20 bp, Artificial Sequence
  chemically synthesized
tagtgagaagatgaaaagac

SEQ ID NO: 504285 - DNA, 20 bp, Artificial Sequence
  chemically synthesized
aaaaacaagtaaataaaaat

SEQ ID NO: 504286 - DNA, 20 bp, Artificial Sequence
  chemically synthesized
tgagggtagaaagtaaaatc

SEQ ID NO: 504287 - DNA, 20 bp, Artificial Sequence
  chemically synthesized
aaagtaaaatcttgaattac

SEQ ID NO: 504288 - DNA, 20 bp, Artificial Sequence
  chemically synthesized
cttgaattacctgaattttt

SEQ ID NO: 504289 - DNA, 20 bp, Artificial Sequence
  chemically synthesized
gtcaaaagctagaggagcaa

SEQ ID NO: 504290 - DNA, 20 bp, Artificial Sequence
  chemically synthesized
aattagccggaaatatcaat

SEQ ID NO: 504291 - DNA, 20 bp, Artificial Sequence
  chemically synthesized
aaatacatttaccctaattg

SEQ ID NO: 504292 - DNA, 20 bp, Artificial Sequence
  chemically synthesized
atcaattattattcatcaat

SEQ ID NO: 504293 - DNA, 20 bp, Artificial Sequence
  chemically synthesized
taattgatgaataataattg

SEQ ID NO: 504294 - DNA, 20 bp, Artificial Sequence
  chemically synthesized
catctactttgtttacatgt

SEQ ID NO: 504295 - DNA, 20 bp, Artificial Sequence
  chemically synthesized
taaattttacatattatcct

SEQ ID NO: 504296 - DNA, 20 bp, Artificial Sequence
  chemically synthesized
aataatattcaagttactct

SEQ ID NO: 504297 - DNA, 20 bp, Artificial Sequence
  chemically synthesized
catattatcctaagagtaac

SEQ ID NO: 504298 - DNA, 20 bp, Artificial Sequence
  chemically synthesized
attgttcagaaaaatacata

SEQ ID NO: 504299 - DNA, 20 bp, Artificial Sequence
  chemically synthesized
ttttggtgcatctaatttta

SEQ ID NO: 504300 - DNA, 20 bp, Artificial Sequence
  chemically synthesized
tgcatttgtgatacagttaa

SEQ ID NO: 504301 - DNA, 20 bp, Artificial Sequence
  chemically synthesized
ttattagctatagttttatg

SEQ ID NO: 504302 - DNA, 20 bp, Artificial Sequence
  chemically synthesized
tagctaataatattgatata

SEQ ID NO: 504303 - DNA, 20 bp, Artificial Sequence
  chemically synthesized
cccaccataatactacataa

SEQ ID NO: 504304 - DNA, 20 bp, Artificial Sequence
  chemically synthesized
tctgttatgtagtattatgg

SEQ ID NO: 504305 - DNA, 20 bp, Artificial Sequence
  chemically synthesized
gtagtattatggtgggattc

SEQ ID NO: 504306 - DNA, 20 bp, Artificial Sequence
  chemically synthesized
aattctccacaaaactatcc

SEQ ID NO: 504307 - DNA, 20 bp, Artificial Sequence
  chemically synthesized
gattcaaggatagttttgtg

SEQ ID NO: 504308 - DNA, 20 bp, Artificial Sequence
  chemically synthesized
aagaaattacatgtgttata

SEQ ID NO: 504309 - DNA, 20 bp, Artificial Sequence
  chemically synthesized
acacatgtaatttcttacag

SEQ ID NO: 504310 - DNA, 20 bp, Artificial Sequence
  chemically synthesized
ataggtcacattatagggga

SEQ ID NO: 504311 - DNA, 20 bp, Artificial Sequence
  chemically synthesized
acttagatatttgacaaatt

SEQ ID NO: 504312 - DNA, 20 bp, Artificial Sequence
  chemically synthesized
taagtaccaccaaataggca

SEQ ID NO: 504313 - DNA, 20 bp, Artificial Sequence
  chemically synthesized
acaggagtggaaaactagaa

SEQ ID NO: 504314 - DNA, 20 bp, Artificial Sequence
  chemically synthesized
tagagataaacataatttac

SEQ ID NO: 504315 - DNA, 20 bp, Artificial Sequence
  chemically synthesized
attgattgagggatggatgg

SEQ ID NO: 504316 - DNA, 20 bp, Artificial Sequence
  chemically synthesized
attgattgattgagggatgg

SEQ ID NO: 504317 - DNA, 20 bp, Artificial Sequence
  chemically synthesized
ggatattgattgattgaggg

SEQ ID NO: 504318 - DNA, 20 bp, Artificial Sequence
  chemically synthesized
gataggatattgattgattg

SEQ ID NO: 504319 - DNA, 20 bp, Artificial Sequence
  chemically synthesized
taaatggaactggagataga

SEQ ID NO: 504320 - DNA, 20 bp, Artificial Sequence
  chemically synthesized
ctccagttccatttacatct

SEQ ID NO: 504321 - DNA, 20 bp, Artificial Sequence
  chemically synthesized
ctgtatctgatggaaataat

SEQ ID NO: 504322 - DNA, 20 bp, Artificial Sequence
  chemically synthesized
atattaatgttgtatgttat

SEQ ID NO: 504323 - DNA, 20 bp, Artificial Sequence
  chemically synthesized
tatgttattaggatgcactg

SEQ ID NO: 504324 - DNA, 20 bp, Artificial Sequence
  chemically synthesized
taacctcagtaaaattcata

SEQ ID NO: 504325 - DNA, 20 bp, Artificial Sequence
  chemically synthesized
gctggaaatgtaaattcaat

SEQ ID NO: 504326 - DNA, 20 bp, Artificial Sequence
  chemically synthesized
aagtaaaaaaattacaagat

SEQ ID NO: 504327 - DNA, 20 bp, Artificial Sequence
  chemically synthesized
catatatgaataataaacct

SEQ ID NO: 504328 - DNA, 20 bp, Artificial Sequence
  chemically synthesized
tcctccaaaaagagacatat

SEQ ID NO: 504329 - DNA, 20 bp, Artificial Sequence
  chemically synthesized
ttcatatatgtctctttttg

SEQ ID NO: 504330 - DNA, 20 bp, Artificial Sequence
  chemically synthesized
tgtgagtaaggaagaaagtc

SEQ ID NO: 504331 - DNA, 20 bp, Artificial Sequence
  chemically synthesized
caaggaatctttttttttct

SEQ ID NO: 504332 - DNA, 20 bp, Artificial Sequence
  chemically synthesized
tttaaagaaatatgatacca

SEQ ID NO: 504333 - DNA, 20 bp, Artificial Sequence
  chemically synthesized
gaataaaaatgtgcaagaat

SEQ ID NO: 504334 - DNA, 20 bp, Artificial Sequence
  chemically synthesized
acataagaataaaaatgtgc

SEQ ID NO: 504335 - DNA, 20 bp, Artificial Sequence
  chemically synthesized
actagtaaacttttaaacat

SEQ ID NO: 504336 - DNA, 20 bp, Artificial Sequence
  chemically synthesized
acatttttccagatagactt

SEQ ID NO: 504337 - DNA, 20 bp, Artificial Sequence
  chemically synthesized
gctaccatttggtattgtag

SEQ ID NO: 504338 - DNA, 20 bp, Artificial Sequence
  chemically synthesized
ttgtttaaatgtatttttct

SEQ ID NO: 504339 - DNA, 20 bp, Artificial Sequence
  chemically synthesized
tttatcacatagaatttttt

SEQ ID NO: 504340 - DNA, 20 bp, Artificial Sequence
  chemically synthesized
caaatttaaactttatcaca

SEQ ID NO: 504341 - DNA, 20 bp, Artificial Sequence
  chemically synthesized
ctatgtgataaagtttaaat

SEQ ID NO: 504342 - DNA, 20 bp, Artificial Sequence
  chemically synthesized
gcctcagcctcccaaagtgc

SEQ ID NO: 504343 - DNA, 20 bp, Artificial Sequence
  chemically synthesized
caggcagatcatctgaggtc

SEQ ID NO: 504344 - DNA, 20 bp, Artificial Sequence
  chemically synthesized
ttgtatttttaaagtaaaga

SEQ ID NO: 504345 - DNA, 20 bp, Artificial Sequence
  chemically synthesized
gccttagcctcctgagtagc

SEQ ID NO: 504346 - DNA, 20 bp, Artificial Sequence
  chemically synthesized
gattctcctgccttagcctc

SEQ ID NO: 504347 - DNA, 20 bp, Artificial Sequence
  chemically synthesized
tactcaggaggctaaggcag

SEQ ID NO: 504348 - DNA, 20 bp, Artificial Sequence
  chemically synthesized
ctcactgcaacctacgcctc

SEQ ID NO: 504349 - DNA, 20 bp, Artificial Sequence
  chemically synthesized
ttcattcttgttgcccaggc

SEQ ID NO: 504350 - DNA, 20 bp, Artificial Sequence
  chemically synthesized
tgcactccagcctgggcaac

SEQ ID NO: 504351 - DNA, 20 bp, Artificial Sequence
  chemically synthesized
tactttattttatttttaga

SEQ ID NO: 504352 - DNA, 20 bp, Artificial Sequence
  chemically synthesized
tagtatatctttcctgatag

SEQ ID NO: 504353 - DNA, 20 bp, Artificial Sequence
  chemically synthesized
tgttaaaaaaatgtagctat

SEQ ID NO: 504354 - DNA, 20 bp, Artificial Sequence
  chemically synthesized
tctgtaatgtaatgagacat

SEQ ID NO: 504355 - DNA, 20 bp, Artificial Sequence
  chemically synthesized
atagccagccctccatattt

SEQ ID NO: 504356 - DNA, 20 bp, Artificial Sequence
  chemically synthesized
gccctccatatttgtggatt

SEQ ID NO: 504357 - DNA, 20 bp, Artificial Sequence
  chemically synthesized
tccatatttgtggattctga

SEQ ID NO: 504358 - DNA, 20 bp, Artificial Sequence
  chemically synthesized
tatttgtggattctgaatga

SEQ ID NO: 504359 - DNA, 20 bp, Artificial Sequence
  chemically synthesized
gttgactgaatccactcatt

SEQ ID NO: 504360 - DNA, 20 bp, Artificial Sequence
  chemically synthesized
tattatctattagtagttga

SEQ ID NO: 504361 - DNA, 20 bp, Artificial Sequence
  chemically synthesized
gcattataagtaatccagag

SEQ ID NO: 504362 - DNA, 20 bp, Artificial Sequence
  chemically synthesized
ccatatactttaactcatct

SEQ ID NO: 504363 - DNA, 20 bp, Artificial Sequence
  chemically synthesized
cagatgttcaagtcctttat

SEQ ID NO: 504364 - DNA, 20 bp, Artificial Sequence
  chemically synthesized
tataaaggacttgaacatct

SEQ ID NO: 504365 - DNA, 20 bp, Artificial Sequence
  chemically synthesized
ccaggaactcctatgaatat

SEQ ID NO: 504366 - DNA, 20 bp, Artificial Sequence
  chemically synthesized
ctgtgaattctgatattcat

SEQ ID NO: 504367 - DNA, 20 bp, Artificial Sequence
  chemically synthesized
aagtggttccaggaactcct

SEQ ID NO: 504368 - DNA, 20 bp, Artificial Sequence
  chemically synthesized
gttcctggaaccacttcccc

SEQ ID NO: 504369 - DNA, 20 bp, Artificial Sequence
  chemically synthesized
ccacttccccatggatacga

SEQ ID NO: 504370 - DNA, 20 bp, Artificial Sequence
  chemically synthesized
ctgattttacccaccagttt

SEQ ID NO: 504371 - DNA, 20 bp, Artificial Sequence
  chemically synthesized
cctgtcacattctcaaactg

SEQ ID NO: 504372 - DNA, 20 bp, Artificial Sequence
  chemically synthesized
caccagtttgagaatgtgac

SEQ ID NO: 504373 - DNA, 20 bp, Artificial Sequence
  chemically synthesized
caaataaagaagcaaaggtg

SEQ ID NO: 504374 - DNA, 20 bp, Artificial Sequence
  chemically synthesized
catacatatatatccataga

SEQ ID NO: 504375 - DNA, 20 bp, Artificial Sequence
  chemically synthesized
tttatgcatatactctatct

SEQ ID NO: 504376 - DNA, 20 bp, Artificial Sequence
  chemically synthesized
gggcaaactaccatacttgt

SEQ ID NO: 504377 - DNA, 20 bp, Artificial Sequence
  chemically synthesized
atataacctttaaataatat

SEQ ID NO: 504378 - DNA, 20 bp, Artificial Sequence
  chemically synthesized
tatttaaaggttatatcaat

SEQ ID NO: 504379 - DNA, 20 bp, Artificial Sequence
  chemically synthesized
aattgcaggtctgtgaatat

SEQ ID NO: 504380 - DNA, 20 bp, Artificial Sequence
  chemically synthesized
actcggggaattgcaggtct

SEQ ID NO: 504381 - DNA, 20 bp, Artificial Sequence
  chemically synthesized
attcacagacctgcaattcc

SEQ ID NO: 504382 - DNA, 20 bp, Artificial Sequence
  chemically synthesized
aatcatggagcagagactcg

SEQ ID NO: 504383 - DNA, 20 bp, Artificial Sequence
  chemically synthesized
tgacactaagttgaggtatg

SEQ ID NO: 504384 - DNA, 20 bp, Artificial Sequence
  chemically synthesized
accatgagtgccatcaggac

SEQ ID NO: 504385 - DNA, 20 bp, Artificial Sequence
  chemically synthesized
caatgcgctatcaggagacc

SEQ ID NO: 504386 - DNA, 20 bp, Artificial Sequence
  chemically synthesized
aactttatcaaaagggaaaa

SEQ ID NO: 504387 - DNA, 20 bp, Artificial Sequence
  chemically synthesized
atcaaaagggaaaaaagaat

SEQ ID NO: 504388 - DNA, 20 bp, Artificial Sequence
  chemically synthesized
atttgaaactagtaatataa

SEQ ID NO: 504389 - DNA, 20 bp, Artificial Sequence
  chemically synthesized
tggcatattacacatgtagc

SEQ ID NO: 504390 - DNA, 20 bp, Artificial Sequence
  chemically synthesized
tagattttacaggctgattt

SEQ ID NO: 504391 - DNA, 20 bp, Artificial Sequence
  chemically synthesized
ctgtttcctgaccttataaa

SEQ ID NO: 504392 - DNA, 20 bp, Artificial Sequence
  chemically synthesized
tggtatttgcagaaaccgag

SEQ ID NO: 504393 - DNA, 20 bp, Artificial Sequence
  chemically synthesized
ggcaaatgataacactgaga

SEQ ID NO: 504394 - DNA, 20 bp, Artificial Sequence
  chemically synthesized
taatttaaaaatcaaggtct

SEQ ID NO: 504395 - DNA, 20 bp, Artificial Sequence
  chemically synthesized
catatactaagcatgcgtac

SEQ ID NO: 504396 - DNA, 20 bp, Artificial Sequence
  chemically synthesized
aatatttatggggttattac

SEQ ID NO: 504397 - DNA, 20 bp, Artificial Sequence
  chemically synthesized
attaagaatgataatattta

SEQ ID NO: 504398 - DNA, 20 bp, Artificial Sequence
  chemically synthesized
acaggtttattataagaatt

SEQ ID NO: 504399 - DNA, 20 bp, Artificial Sequence
  chemically synthesized
atgtctcacaggtttattat

SEQ ID NO: 504400 - DNA, 20 bp, Artificial Sequence
  chemically synthesized
cctgttttctcaattgcaat

SEQ ID NO: 504401 - DNA, 20 bp, Artificial Sequence
  chemically synthesized
aaaaggacataacatatttt

SEQ ID NO: 504402 - DNA, 20 bp, Artificial Sequence
  chemically synthesized
ttttaattctagaatttctt

SEQ ID NO: 504403 - DNA, 20 bp, Artificial Sequence
  chemically synthesized
ggataatccaaaagaaattc

SEQ ID NO: 504404 - DNA, 20 bp, Artificial Sequence
  chemically synthesized
acttactgtatttttaattc

SEQ ID NO: 504405 - DNA, 20 bp, Artificial Sequence
  chemically synthesized
aaatacagtaagtgaaaaat

SEQ ID NO: 504406 - DNA, 20 bp, Artificial Sequence
  chemically synthesized
gaaaaataagaattaagtgc

SEQ ID NO: 504407 - DNA, 20 bp, Artificial Sequence
  chemically synthesized
ggtttaacagcaaatttgac

SEQ ID NO: 504408 - DNA, 20 bp, Artificial Sequence
  chemically synthesized
ttcattccaggtatttcctt

SEQ ID NO: 504409 - DNA, 20 bp, Artificial Sequence
  chemically synthesized
aagattcagaaggaaatacc

SEQ ID NO: 504410 - DNA, 20 bp, Artificial Sequence
  chemically synthesized
ggtctaatatatatgcatcc

SEQ ID NO: 504411 - DNA, 20 bp, Artificial Sequence
  chemically synthesized
atatggcttctgccacattc

SEQ ID NO: 504412 - DNA, 20 bp, Artificial Sequence
  chemically synthesized
aatcatattattttaattgc

SEQ ID NO: 504413 - DNA, 20 bp, Artificial Sequence
  chemically synthesized
attattttaattgctgggat

SEQ ID NO: 504414 - DNA, 20 bp, Artificial Sequence
  chemically synthesized
ttcttctcatttagtgtaga

SEQ ID NO: 504415 - DNA, 20 bp, Artificial Sequence
  chemically synthesized
ttccttctacactaaatgag

SEQ ID NO: 504416 - DNA, 20 bp, Artificial Sequence
  chemically synthesized
tctaagattatcgcaaccat

SEQ ID NO: 504417 - DNA, 20 bp, Artificial Sequence
  chemically synthesized
agatggttgcgataatctta

SEQ ID NO: 504418 - DNA, 20 bp, Artificial Sequence
  chemically synthesized
tcttagagagtgtgttggca

SEQ ID NO: 504419 - DNA, 20 bp, Artificial Sequence
  chemically synthesized
tggatgctgaaatgttagaa

SEQ ID NO: 504420 - DNA, 20 bp, Artificial Sequence
  chemically synthesized
tataatctcttaacattttt

SEQ ID NO: 504421 - DNA, 20 bp, Artificial Sequence
  chemically synthesized
ttatttttccataagttatt

SEQ ID NO: 504422 - DNA, 20 bp, Artificial Sequence
  chemically synthesized
taaaggtggtatttggttac

SEQ ID NO: 504423 - DNA, 20 bp, Artificial Sequence
  chemically synthesized
cagtgtatactgcttaggtg

SEQ ID NO: 504424 - DNA, 20 bp, Artificial Sequence
  chemically synthesized
gagagagaaaagactacaaa

SEQ ID NO: 504425 - DNA, 20 bp, Artificial Sequence
  chemically synthesized
ctatgaggacacacaggcat

SEQ ID NO: 504426 - DNA, 20 bp, Artificial Sequence
  chemically synthesized
caatgtttggttttccattc

SEQ ID NO: 504427 - DNA, 20 bp, Artificial Sequence
  chemically synthesized
tattctaagtgaagtaactc

SEQ ID NO: 504428 - DNA, 20 bp, Artificial Sequence
  chemically synthesized
cattcctgagttacttcact

SEQ ID NO: 504429 - DNA, 20 bp, Artificial Sequence
  chemically synthesized
ttaacagcatttgcagtgac

SEQ ID NO: 504430 - DNA, 20 bp, Artificial Sequence
  chemically synthesized
ctactcagtcataaaaatga

SEQ ID NO: 504431 - DNA, 20 bp, Artificial Sequence
  chemically synthesized
aatactactcagtcataaaa

SEQ ID NO: 504432 - DNA, 20 bp, Artificial Sequence
  chemically synthesized
taattcattcatttttatga

SEQ ID NO: 504433 - DNA, 20 bp, Artificial Sequence
  chemically synthesized
atgtatgtatgtatatatga

SEQ ID NO: 504434 - DNA, 20 bp, Artificial Sequence
  chemically synthesized
gagtggttaaagaaactgtg

SEQ ID NO: 504435 - DNA, 20 bp, Artificial Sequence
  chemically synthesized
atccaaatgcccatcactga

SEQ ID NO: 504436 - DNA, 20 bp, Artificial Sequence
  chemically synthesized
accaatccaaatgcccatca

SEQ ID NO: 504437 - DNA, 20 bp, Artificial Sequence
  chemically synthesized
actcattcagtgatgggcat

SEQ ID NO: 504438 - DNA, 20 bp, Artificial Sequence
  chemically synthesized
tgcatgtgcaagtatctttt

SEQ ID NO: 504439 - DNA, 20 bp, Artificial Sequence
  chemically synthesized
gaataatgactttttttcct

SEQ ID NO: 504440 - DNA, 20 bp, Artificial Sequence
  chemically synthesized
tctgggtagatacccagtaa

SEQ ID NO: 504441 - DNA, 20 bp, Artificial Sequence
  chemically synthesized
tcgatccagcaatcccatta

SEQ ID NO: 504442 - DNA, 20 bp, Artificial Sequence
  chemically synthesized
gatacccagtaatgggattg

SEQ ID NO: 504443 - DNA, 20 bp, Artificial Sequence
  chemically synthesized
ccagtaatgggattgctgga

SEQ ID NO: 504444 - DNA, 20 bp, Artificial Sequence
  chemically synthesized
ggtagttctacttttagtta

SEQ ID NO: 504445 - DNA, 20 bp, Artificial Sequence
  chemically synthesized
caagtacagccactatggaa

SEQ ID NO: 504446 - DNA, 20 bp, Artificial Sequence
  chemically synthesized
aacacttctacactgctgat

SEQ ID NO: 504447 - DNA, 20 bp, Artificial Sequence
  chemically synthesized
tttaaaaagtacatgtttgc

SEQ ID NO: 504448 - DNA, 20 bp, Artificial Sequence
  chemically synthesized
ttgattatggtcattcttgc

SEQ ID NO: 504449 - DNA, 20 bp, Artificial Sequence
  chemically synthesized
tgataccaccttactcttgc

SEQ ID NO: 504450 - DNA, 20 bp, Artificial Sequence
  chemically synthesized
tatgaaaaaatgctaacatt

SEQ ID NO: 504451 - DNA, 20 bp, Artificial Sequence
  chemically synthesized
tcaaaaagtgggctaaggac

SEQ ID NO: 504452 - DNA, 20 bp, Artificial Sequence
  chemically synthesized
gtccttagcccactttttga

SEQ ID NO: 504453 - DNA, 20 bp, Artificial Sequence
  chemically synthesized
attgtatttttcttactgat

SEQ ID NO: 504454 - DNA, 20 bp, Artificial Sequence
  chemically synthesized
atttgagtttgttgtagatt

SEQ ID NO: 504455 - DNA, 20 bp, Artificial Sequence
  chemically synthesized
tctgacaaaggactaatatc

SEQ ID NO: 504456 - DNA, 20 bp, Artificial Sequence
  chemically synthesized
tgaagattttatcccactcc

SEQ ID NO: 504457 - DNA, 20 bp, Artificial Sequence
  chemically synthesized
caaacaggcaacccatggag

SEQ ID NO: 504458 - DNA, 20 bp, Artificial Sequence
  chemically synthesized
cacagcaaacaggcaaccca

SEQ ID NO: 504459 - DNA, 20 bp, Artificial Sequence
  chemically synthesized
tgtttttattacatttgctt

SEQ ID NO: 504460 - DNA, 20 bp, Artificial Sequence
  chemically synthesized
ttctagacattggcttaggc

SEQ ID NO: 504461 - DNA, 20 bp, Artificial Sequence
  chemically synthesized
ttttttccaatgttatcttc

SEQ ID NO: 504462 - DNA, 20 bp, Artificial Sequence
  chemically synthesized
cccttttcatcaaatggtgc

SEQ ID NO: 504463 - DNA, 20 bp, Artificial Sequence
  chemically synthesized
tcccagcaccatttgatgaa

SEQ ID NO: 504464 - DNA, 20 bp, Artificial Sequence
  chemically synthesized
gtaagtattttggtttattt

SEQ ID NO: 504465 - DNA, 20 bp, Artificial Sequence
  chemically synthesized
aggcacatagaccaacagaa

SEQ ID NO: 504466 - DNA, 20 bp, Artificial Sequence
  chemically synthesized
ttttggttccatattaattt

SEQ ID NO: 504467 - DNA, 20 bp, Artificial Sequence
  chemically synthesized
attttttttctaattctgtg

SEQ ID NO: 504468 - DNA, 20 bp, Artificial Sequence
  chemically synthesized
aataacagcatcattcttca

SEQ ID NO: 504469 - DNA, 20 bp, Artificial Sequence
  chemically synthesized
aatgatgctgttattttgat

SEQ ID NO: 504470 - DNA, 20 bp, Artificial Sequence
  chemically synthesized
ttattttgatggggattgca

SEQ ID NO: 504471 - DNA, 20 bp, Artificial Sequence
  chemically synthesized
aacacatcccatagtcgtgg

SEQ ID NO: 504472 - DNA, 20 bp, Artificial Sequence
  chemically synthesized
attgtacccatccacgacta

SEQ ID NO: 504473 - DNA, 20 bp, Artificial Sequence
  chemically synthesized
tgaaaacacatcccatagtc

SEQ ID NO: 504474 - DNA, 20 bp, Artificial Sequence
  chemically synthesized
cttaggaatatacctaacca

SEQ ID NO: 504475 - DNA, 20 bp, Artificial Sequence
  chemically synthesized
acaacaacaacaaaaaactt

SEQ ID NO: 504476 - DNA, 20 bp, Artificial Sequence
  chemically synthesized
ttttttgcagctattgtaaa

SEQ ID NO: 504477 - DNA, 20 bp, Artificial Sequence
  chemically synthesized
tgcagctattgtaaaagggg

SEQ ID NO: 504478 - DNA, 20 bp, Artificial Sequence
  chemically synthesized
ataccaacaacgaccaagca

SEQ ID NO: 504479 - DNA, 20 bp, Artificial Sequence
  chemically synthesized
tcttgtatctggaaatgttg

SEQ ID NO: 504480 - DNA, 20 bp, Artificial Sequence
  chemically synthesized
cagttctagaaactttctgg

SEQ ID NO: 504481 - DNA, 20 bp, Artificial Sequence
  chemically synthesized
aaactttctggaggaatcct

SEQ ID NO: 504482 - DNA, 20 bp, Artificial Sequence
  chemically synthesized
tcatttaccttcaaaaccct

SEQ ID NO: 504483 - DNA, 20 bp, Artificial Sequence
  chemically synthesized
ttgacttcctctttaccgat

SEQ ID NO: 504484 - DNA, 20 bp, Artificial Sequence
  chemically synthesized
cttctagtactatgctgaag

SEQ ID NO: 504485 - DNA, 20 bp, Artificial Sequence
  chemically synthesized
ctatgctgaagaggagtggc

SEQ ID NO: 504486 - DNA, 20 bp, Artificial Sequence
  chemically synthesized
agagtggcatatgcatttat

SEQ ID NO: 504487 - DNA, 20 bp, Artificial Sequence
  chemically synthesized
tttgtttattaataatcatc

SEQ ID NO: 504488 - DNA, 20 bp, Artificial Sequence
  chemically synthesized
tgctatttataaggtccctt

SEQ ID NO: 504489 - DNA, 20 bp, Artificial Sequence
  chemically synthesized
ggcagacacatggcggtatg

SEQ ID NO: 504490 - DNA, 20 bp, Artificial Sequence
  chemically synthesized
gacacatggcggtatgttgg

SEQ ID NO: 504491 - DNA, 20 bp, Artificial Sequence
  chemically synthesized
aaactgaaacacttcagtct

SEQ ID NO: 504492 - DNA, 20 bp, Artificial Sequence
  chemically synthesized
acttctgatctgtccaacaa

SEQ ID NO: 504493 - DNA, 20 bp, Artificial Sequence
  chemically synthesized
gtccaacaactgaatctcac

SEQ ID NO: 504494 - DNA, 20 bp, Artificial Sequence
  chemically synthesized
atgagggttggaatgcaagg

SEQ ID NO: 504495 - DNA, 20 bp, Artificial Sequence
  chemically synthesized
tacaaaactaggatgagggt

SEQ ID NO: 504496 - DNA, 20 bp, Artificial Sequence
  chemically synthesized
atttaatacaaaactaggat

SEQ ID NO: 504497 - DNA, 20 bp, Artificial Sequence
  chemically synthesized
aaatgaatttaatacaaaac

SEQ ID NO: 504498 - DNA, 20 bp, Artificial Sequence
  chemically synthesized
tttgaaatgaccagtttcaa

SEQ ID NO: 504499 - DNA, 20 bp, Artificial Sequence
  chemically synthesized
tttatttcttaaagctacaa

SEQ ID NO: 504500 - DNA, 20 bp, Artificial Sequence
  chemically synthesized
ctttttctgattttcttatg

SEQ ID NO: 504501 - DNA, 20 bp, Artificial Sequence
  chemically synthesized
ttgacaaatttgcaacggta

SEQ ID NO: 504502 - DNA, 20 bp, Artificial Sequence
  chemically synthesized
catttaaaccatgcaggcca

SEQ ID NO: 504503 - DNA, 20 bp, Artificial Sequence
  chemically synthesized
caggccagggaatgccagtg

SEQ ID NO: 504504 - DNA, 20 bp, Artificial Sequence
  chemically synthesized
cttcttatctgaaacagatt

SEQ ID NO: 504505 - DNA, 20 bp, Artificial Sequence
  chemically synthesized
agctcatactgtgtttgccc

SEQ ID NO: 504506 - DNA, 20 bp, Artificial Sequence
  chemically synthesized
gtctatttctgctcctatgt

SEQ ID NO: 504507 - DNA, 20 bp, Artificial Sequence
  chemically synthesized
tctacataaaaggaaaaaaa

SEQ ID NO: 504508 - DNA, 20 bp, Artificial Sequence
  chemically synthesized
agtaaagataaacttatctg

SEQ ID NO: 504509 - DNA, 20 bp, Artificial Sequence
  chemically synthesized
taagatggtaggttattaga

SEQ ID NO: 504510 - DNA, 20 bp, Artificial Sequence
  chemically synthesized
ctaccatcttaaaagacctc

SEQ ID NO: 504511 - DNA, 20 bp, Artificial Sequence
  chemically synthesized
atatttttcctgagtctgtg

SEQ ID NO: 504512 - DNA, 20 bp, Artificial Sequence
  chemically synthesized
atcttcaggccatatttttc

SEQ ID NO: 504513 - DNA, 20 bp, Artificial Sequence
  chemically synthesized
cgaatagtagaaactgtcat

SEQ ID NO: 504514 - DNA, 20 bp, Artificial Sequence
  chemically synthesized
ttaaagtggtcctttagcag

SEQ ID NO: 504515 - DNA, 20 bp, Artificial Sequence
  chemically synthesized
ttatattgattttcattttg

SEQ ID NO: 504516 - DNA, 20 bp, Artificial Sequence
  chemically synthesized
tttcaagataaacagtagtg

SEQ ID NO: 504517 - DNA, 20 bp, Artificial Sequence
  chemically synthesized
attaaatgtctagatattaa

SEQ ID NO: 504518 - DNA, 20 bp, Artificial Sequence
  chemically synthesized
acatttaatatagccatgtg

SEQ ID NO: 504519 - DNA, 20 bp, Artificial Sequence
  chemically synthesized
gacatctaaaattatagtaa

SEQ ID NO: 504520 - DNA, 20 bp, Artificial Sequence
  chemically synthesized
ctttagcccctccctctttt

SEQ ID NO: 504521 - DNA, 20 bp, Artificial Sequence
  chemically synthesized
tagctcttttgttatcacaa

SEQ ID NO: 504522 - DNA, 20 bp, Artificial Sequence
  chemically synthesized
tgctacattttctaatacac

SEQ ID NO: 504523 - DNA, 20 bp, Artificial Sequence
  chemically synthesized
atctcgatagttatgtctct

SEQ ID NO: 504524 - DNA, 20 bp, Artificial Sequence
  chemically synthesized
gatgcttaagtgcctatttt

SEQ ID NO: 504525 - DNA, 20 bp, Artificial Sequence
  chemically synthesized
aaataggcacttaagcatca

SEQ ID NO: 504526 - DNA, 20 bp, Artificial Sequence
  chemically synthesized
acgtttcaagtgcttaacgg

SEQ ID NO: 504527 - DNA, 20 bp, Artificial Sequence
  chemically synthesized
gcacttgaaacgtggccagt

SEQ ID NO: 504528 - DNA, 20 bp, Artificial Sequence
  chemically synthesized
tattggacagttcatacaaa

SEQ ID NO: 504529 - DNA, 20 bp, Artificial Sequence
  chemically synthesized
ttgaaaatattgtttcatct

SEQ ID NO: 504530 - DNA, 20 bp, Artificial Sequence
  chemically synthesized
tggctcacattatttttctg

SEQ ID NO: 504531 - DNA, 20 bp, Artificial Sequence
  chemically synthesized
tctccccctaaatggattac

SEQ ID NO: 504532 - DNA, 20 bp, Artificial Sequence
  chemically synthesized
tcatctctttctccccctaa

SEQ ID NO: 504533 - DNA, 20 bp, Artificial Sequence
  chemically synthesized
aaaacattagaagtcctgtt

SEQ ID NO: 504534 - DNA, 20 bp, Artificial Sequence
  chemically synthesized
gtcctgttgtgaatatgaaa

SEQ ID NO: 504535 - DNA, 20 bp, Artificial Sequence
  chemically synthesized
aatatgaaatcgagtccaat

SEQ ID NO: 504536 - DNA, 20 bp, Artificial Sequence
  chemically synthesized
tttccccacaggtaataatg

SEQ ID NO: 504537 - DNA, 20 bp, Artificial Sequence
  chemically synthesized
aaggtgggatctggttggca

SEQ ID NO: 504538 - DNA, 20 bp, Artificial Sequence
  chemically synthesized
atggggaatgaggaaaaagg

SEQ ID NO: 504539 - DNA, 20 bp, Artificial Sequence
  chemically synthesized
ttgactttagattgatcatg

SEQ ID NO: 504540 - DNA, 20 bp, Artificial Sequence
  chemically synthesized
ttaatcatcatatatcatgc

SEQ ID NO: 504541 - DNA, 20 bp, Artificial Sequence
  chemically synthesized
tatatgatgattaacatact

SEQ ID NO: 504542 - DNA, 20 bp, Artificial Sequence
  chemically synthesized
aattacaagtgcaaggaagt

SEQ ID NO: 504543 - DNA, 20 bp, Artificial Sequence
  chemically synthesized
caaggaagtctgagtataac

SEQ ID NO: 504544 - DNA, 20 bp, Artificial Sequence
  chemically synthesized
gtttccttagtttgaaatac

SEQ ID NO: 504545 - DNA, 20 bp, Artificial Sequence
  chemically synthesized
atacaaggatctttgtgatt

SEQ ID NO: 504546 - DNA, 20 bp, Artificial Sequence
  chemically synthesized
aaattgggctaaaatgttga

SEQ ID NO: 504547 - DNA, 20 bp, Artificial Sequence
  chemically synthesized
ggcatattttgactggagga

SEQ ID NO: 504548 - DNA, 20 bp, Artificial Sequence
  chemically synthesized
taaaaggcatattttgactg

SEQ ID NO: 504549 - DNA, 20 bp, Artificial Sequence
  chemically synthesized
ccacaccaagtgccctttgt

SEQ ID NO: 504550 - DNA, 20 bp, Artificial Sequence
  chemically synthesized
ggcacttggtgtggtctgac

SEQ ID NO: 504551 - DNA, 20 bp, Artificial Sequence
  chemically synthesized
gtctgacatgagtgaaatag

SEQ ID NO: 504552 - DNA, 20 bp, Artificial Sequence
  chemically synthesized
agtgaaatagatgggtttat

SEQ ID NO: 504553 - DNA, 20 bp, Artificial Sequence
  chemically synthesized
aattttatctaagatcacca

SEQ ID NO: 504554 - DNA, 20 bp, Artificial Sequence
  chemically synthesized
cccaatttcagttggttcat

SEQ ID NO: 504555 - DNA, 20 bp, Artificial Sequence
  chemically synthesized
tccaatgaaccaactgaaat

SEQ ID NO: 504556 - DNA, 20 bp, Artificial Sequence
  chemically synthesized
ataaatcagttgtccaggag

SEQ ID NO: 504557 - DNA, 20 bp, Artificial Sequence
  chemically synthesized
cacactacagaaatatttat

SEQ ID NO: 504558 - DNA, 20 bp, Artificial Sequence
  chemically synthesized
agaaatatttattagaattt

SEQ ID NO: 504559 - DNA, 20 bp, Artificial Sequence
  chemically synthesized
ttaagagtttttttcttttg

SEQ ID NO: 504560 - DNA, 20 bp, Artificial Sequence
  chemically synthesized
tttgaaaataggattgctaa

SEQ ID NO: 504561 - DNA, 20 bp, Artificial Sequence
  chemically synthesized
ttaacatgatattttgaaaa

SEQ ID NO: 504562 - DNA, 20 bp, Artificial Sequence
  chemically synthesized
ataataattatgtgtattta

SEQ ID NO: 504563 - DNA, 20 bp, Artificial Sequence
  chemically synthesized
taatatgttaattaacctga

SEQ ID NO: 504564 - DNA, 20 bp, Artificial Sequence
  chemically synthesized
tgattaatatgttaattaac

SEQ ID NO: 504565 - DNA, 20 bp, Artificial Sequence
  chemically synthesized
aacttatctttttttgtgat

SEQ ID NO: 504566 - DNA, 20 bp, Artificial Sequence
  chemically synthesized
ctatgtttcaaaattggtaa

SEQ ID NO: 504567 - DNA, 20 bp, Artificial Sequence
  chemically synthesized
gaaagtttcagttagactgg

SEQ ID NO: 504568 - DNA, 20 bp, Artificial Sequence
  chemically synthesized
ttctataatttgactttttt

SEQ ID NO: 504569 - DNA, 20 bp, Artificial Sequence
  chemically synthesized
ctatacagtctttaaaagga

SEQ ID NO: 504570 - DNA, 20 bp, Artificial Sequence
  chemically synthesized
tatatgatatatatatgcaa

SEQ ID NO: 504571 - DNA, 20 bp, Artificial Sequence
  chemically synthesized
tatatatcatatatagacac

SEQ ID NO: 504572 - DNA, 20 bp, Artificial Sequence
  chemically synthesized
aaatgtctattacaggacga

SEQ ID NO: 504573 - DNA, 20 bp, Artificial Sequence
  chemically synthesized
acctaaatgtctattacagg

SEQ ID NO: 504574 - DNA, 20 bp, Artificial Sequence
  chemically synthesized
gtttccgtatcttggctgtt

SEQ ID NO: 504575 - DNA, 20 bp, Artificial Sequence
  chemically synthesized
ctgttatgaataatgctcaa

SEQ ID NO: 504576 - DNA, 20 bp, Artificial Sequence
  chemically synthesized
acaggaaaggaaactattaa

SEQ ID NO: 504577 - DNA, 20 bp, Artificial Sequence
  chemically synthesized
tgcaaaccaaatatctggta

SEQ ID NO: 504578 - DNA, 20 bp, Artificial Sequence
  chemically synthesized
ttttgaggtttctatatatt

SEQ ID NO: 504579 - DNA, 20 bp, Artificial Sequence
  chemically synthesized
ggttatttgttttcttgctg

SEQ ID NO: 504580 - DNA, 20 bp, Artificial Sequence
  chemically synthesized
acctgatttaaaaatgggca

SEQ ID NO: 504581 - DNA, 20 bp, Artificial Sequence
  chemically synthesized
tacacttacacattgttggt

SEQ ID NO: 504582 - DNA, 20 bp, Artificial Sequence
  chemically synthesized
tgtctacgtgtttatataca

SEQ ID NO: 504583 - DNA, 20 bp, Artificial Sequence
  chemically synthesized
tatacacaatatttgcctac

SEQ ID NO: 504584 - DNA, 20 bp, Artificial Sequence
  chemically synthesized
tagctttaacttggcattta

SEQ ID NO: 504585 - DNA, 20 bp, Artificial Sequence
  chemically synthesized
aagaattgttccctgacctc

SEQ ID NO: 504586 - DNA, 20 bp, Artificial Sequence
  chemically synthesized
atgtgcttattgtgagataa

SEQ ID NO: 504587 - DNA, 20 bp, Artificial Sequence
  chemically synthesized
caaacagtttacctagtttc

SEQ ID NO: 504588 - DNA, 20 bp, Artificial Sequence
  chemically synthesized
tttttaatacatctaggcaa

SEQ ID NO: 504589 - DNA, 20 bp, Artificial Sequence
  chemically synthesized
atttcctgaactgcagctag

SEQ ID NO: 504590 - DNA, 20 bp, Artificial Sequence
  chemically synthesized
cctgttaggatgctgagact

SEQ ID NO: 504591 - DNA, 20 bp, Artificial Sequence
  chemically synthesized
gtctcagcatcctaacaggg

SEQ ID NO: 504592 - DNA, 20 bp, Artificial Sequence
  chemically synthesized
tagtctctacccctccctgt

SEQ ID NO: 504593 - DNA, 20 bp, Artificial Sequence
  chemically synthesized
aaattttaagggtagccagc

SEQ ID NO: 504594 - DNA, 20 bp, Artificial Sequence
  chemically synthesized
agacagtagaagaaaatttt

SEQ ID NO: 504595 - DNA, 20 bp, Artificial Sequence
  chemically synthesized
tattttctttcaattctggc

SEQ ID NO: 504596 - DNA, 20 bp, Artificial Sequence
  chemically synthesized
agcacagaagatattcttgc

SEQ ID NO: 504597 - DNA, 20 bp, Artificial Sequence
  chemically synthesized
ccccagatcatcacctcttc

SEQ ID NO: 504598 - DNA, 20 bp, Artificial Sequence
  chemically synthesized
gaaagaatagccacacagag

SEQ ID NO: 504599 - DNA, 20 bp, Artificial Sequence
  chemically synthesized
gaagcaggaagacttgtgga

SEQ ID NO: 504600 - DNA, 20 bp, Artificial Sequence
  chemically synthesized
tcttcttcacataccagcta

SEQ ID NO: 504601 - DNA, 20 bp, Artificial Sequence
  chemically synthesized
cttcacataccagctagagg

SEQ ID NO: 504602 - DNA, 20 bp, Artificial Sequence
  chemically synthesized
agttttgaaaaaatacaact

SEQ ID NO: 504603 - DNA, 20 bp, Artificial Sequence
  chemically synthesized
agagcagtagacatttccga

SEQ ID NO: 504604 - DNA, 20 bp, Artificial Sequence
  chemically synthesized
atagaacttctataacaggt

SEQ ID NO: 504605 - DNA, 20 bp, Artificial Sequence
  chemically synthesized
agattaggacaagatgaggg

SEQ ID NO: 504606 - DNA, 20 bp, Artificial Sequence
  chemically synthesized
atgaaagattaggacaagat

SEQ ID NO: 504607 - DNA, 20 bp, Artificial Sequence
  chemically synthesized
ataagggaggccagaaaggc

SEQ ID NO: 504608 - DNA, 20 bp, Artificial Sequence
  chemically synthesized
aacacaaattgccaaaggtg

SEQ ID NO: 504609 - DNA, 20 bp, Artificial Sequence
  chemically synthesized
tgatgttagaaccaaacctg

SEQ ID NO: 504610 - DNA, 20 bp, Artificial Sequence
  chemically synthesized
tggttctaacatcatctccc

SEQ ID NO: 504611 - DNA, 20 bp, Artificial Sequence
  chemically synthesized
aagataataaaattgaatat

SEQ ID NO: 504612 - DNA, 20 bp, Artificial Sequence
  chemically synthesized
ttgaaagaaagataataaaa

SEQ ID NO: 504613 - DNA, 20 bp, Artificial Sequence
  chemically synthesized
caggtgttcaaaaatatttc

SEQ ID NO: 504614 - DNA, 20 bp, Artificial Sequence
  chemically synthesized
ccattagattgctttcagaa

SEQ ID NO: 504615 - DNA, 20 bp, Artificial Sequence
  chemically synthesized
tctaatggtgtagaacagaa

SEQ ID NO: 504616 - DNA, 20 bp, Artificial Sequence
  chemically synthesized
atcatgttaaaataattatt

SEQ ID NO: 504617 - DNA, 20 bp, Artificial Sequence
  chemically synthesized
aaaaagattggtcatataat

SEQ ID NO: 504618 - DNA, 20 bp, Artificial Sequence
  chemically synthesized
aaactcatgttatatgctag

SEQ ID NO: 504619 - DNA, 20 bp, Artificial Sequence
  chemically synthesized
atattcatctagcatataac

SEQ ID NO: 504620 - DNA, 20 bp, Artificial Sequence
  chemically synthesized
ggtctgggaggatgaggggg

SEQ ID NO: 504621 - DNA, 20 bp, Artificial Sequence
  chemically synthesized
gcctaggtctgggaggatga

SEQ ID NO: 504622 - DNA, 20 bp, Artificial Sequence
  chemically synthesized
tagtggttgcctaggtctgg

SEQ ID NO: 504623 - DNA, 20 bp, Artificial Sequence
  chemically synthesized
cacaaaagatcatatgttat

SEQ ID NO: 504624 - DNA, 20 bp, Artificial Sequence
  chemically synthesized
gtacccttgaagacattatg

SEQ ID NO: 504625 - DNA, 20 bp, Artificial Sequence
  chemically synthesized
tcactcagcataatgtcttc

SEQ ID NO: 504626 - DNA, 20 bp, Artificial Sequence
  chemically synthesized
tactgatacatgctacagca

SEQ ID NO: 504627 - DNA, 20 bp, Artificial Sequence
  chemically synthesized
gctcagtaacactgccttgt

SEQ ID NO: 504628 - DNA, 20 bp, Artificial Sequence
  chemically synthesized
ttttcttcatatagtcatca

SEQ ID NO: 504629 - DNA, 20 bp, Artificial Sequence
  chemically synthesized
agtcatcactggatggacat

SEQ ID NO: 504630 - DNA, 20 bp, Artificial Sequence
  chemically synthesized
tcttctacgttttggctatt

SEQ ID NO: 504631 - DNA, 20 bp, Artificial Sequence
  chemically synthesized
gtaagaactagatcgtatac

SEQ ID NO: 504632 - DNA, 20 bp, Artificial Sequence
  chemically synthesized
aataactaaaagcatggata

SEQ ID NO: 504633 - DNA, 20 bp, Artificial Sequence
  chemically synthesized
gggtttgaataactaaaagc

SEQ ID NO: 504634 - DNA, 20 bp, Artificial Sequence
  chemically synthesized
cacaagtaagctaatggggt

SEQ ID NO: 504635 - DNA, 20 bp, Artificial Sequence
  chemically synthesized
ctatatcacaagtaagctaa

SEQ ID NO: 504636 - DNA, 20 bp, Artificial Sequence
  chemically synthesized
aaccctcagagagaaacaca

SEQ ID NO: 504637 - DNA, 20 bp, Artificial Sequence
  chemically synthesized
tactcaatgtgtttctctct

SEQ ID NO: 504638 - DNA, 20 bp, Artificial Sequence
  chemically synthesized
atgtataaattagttatgca

SEQ ID NO: 504639 - DNA, 20 bp, Artificial Sequence
  chemically synthesized
agtaaaaagtgctttgaaaa

SEQ ID NO: 504640 - DNA, 20 bp, Artificial Sequence
  chemically synthesized
cagtgttggaaaatggcata

SEQ ID NO: 504641 - DNA, 20 bp, Artificial Sequence
  chemically synthesized
aagaggaaataaaagtcagt

SEQ ID NO: 504642 - DNA, 20 bp, Artificial Sequence
  chemically synthesized
atacgtccaaagtactgtgg

SEQ ID NO: 504643 - DNA, 20 bp, Artificial Sequence
  chemically synthesized
ttatatccgaactggcacca

SEQ ID NO: 504644 - DNA, 20 bp, Artificial Sequence
  chemically synthesized
atttactccctggtgccagt

SEQ ID NO: 504645 - DNA, 20 bp, Artificial Sequence
  chemically synthesized
gcatacacatgtgcaattat

SEQ ID NO: 504646 - DNA, 20 bp, Artificial Sequence
  chemically synthesized
tgtatatatatatatatata

SEQ ID NO: 504647 - DNA, 20 bp, Artificial Sequence
  chemically synthesized
atatacaccatatttaatta

SEQ ID NO: 504648 - DNA, 20 bp, Artificial Sequence
  chemically synthesized
aatctagacaagcattccaa

SEQ ID NO: 504649 - DNA, 20 bp, Artificial Sequence
  chemically synthesized
tagacaagcattccaaaagg

SEQ ID NO: 504650 - DNA, 20 bp, Artificial Sequence
  chemically synthesized
aattttactattcacccttt

SEQ ID NO: 504651 - DNA, 20 bp, Artificial Sequence
  chemically synthesized
aaaaagagaagaaagatgat

SEQ ID NO: 504652 - DNA, 20 bp, Artificial Sequence
  chemically synthesized
agagaagaaagatgataggg

SEQ ID NO: 504653 - DNA, 20 bp, Artificial Sequence
  chemically synthesized
aagaaagatgatagggatgg

SEQ ID NO: 504654 - DNA, 20 bp, Artificial Sequence
  chemically synthesized
aagatgatagggatggatgg

SEQ ID NO: 504655 - DNA, 20 bp, Artificial Sequence
  chemically synthesized
atggatggatggagagctgt

SEQ ID NO: 504656 - DNA, 20 bp, Artificial Sequence
  chemically synthesized
tcatttactttaaagatgtt

SEQ ID NO: 504657 - DNA, 20 bp, Artificial Sequence
  chemically synthesized
aaatgtatttaactttaagg

SEQ ID NO: 504658 - DNA, 20 bp, Artificial Sequence
  chemically synthesized
aatagtatcagctccctcta

SEQ ID NO: 504659 - DNA, 20 bp, Artificial Sequence
  chemically synthesized
cttcagagtcgtttttgcta

SEQ ID NO: 504660 - DNA, 20 bp, Artificial Sequence
  chemically synthesized
ttttttttttttttgtactt

SEQ ID NO: 504661 - DNA, 20 bp, Artificial Sequence
  chemically synthesized
gaaatgagctaaataaagca

SEQ ID NO: 504662 - DNA, 20 bp, Artificial Sequence
  chemically synthesized
tcaccatataatatcatttc

SEQ ID NO: 504663 - DNA, 20 bp, Artificial Sequence
  chemically synthesized
tctggaaatgatattatatg

SEQ ID NO: 504664 - DNA, 20 bp, Artificial Sequence
  chemically synthesized
cttttctttgtaaatattta

SEQ ID NO: 504665 - DNA, 20 bp, Artificial Sequence
  chemically synthesized
atatttacaaagaaaagcaa

SEQ ID NO: 504666 - DNA, 20 bp, Artificial Sequence
  chemically synthesized
aaaggaattattgagtaaaa

SEQ ID NO: 504667 - DNA, 20 bp, Artificial Sequence
  chemically synthesized
tgtgcacacaaaaggaatta

SEQ ID NO: 504668 - DNA, 20 bp, Artificial Sequence
  chemically synthesized
tgtgttcatgtgcacacaaa

SEQ ID NO: 504669 - DNA, 20 bp, Artificial Sequence
  chemically synthesized
cacatatatgcatgtatata

SEQ ID NO: 504670 - DNA, 20 bp, Artificial Sequence
  chemically synthesized
cacctttaagaaatagtaaa

SEQ ID NO: 504671 - DNA, 20 bp, Artificial Sequence
  chemically synthesized
aaaattcttttcagagacag

SEQ ID NO: 504672 - DNA, 20 bp, Artificial Sequence
  chemically synthesized
gtcattcatctgtctctgaa

SEQ ID NO: 504673 - DNA, 20 bp, Artificial Sequence
  chemically synthesized
tttgtcttaaaactaagttg

SEQ ID NO: 504674 - DNA, 20 bp, Artificial Sequence
  chemically synthesized
gatgtttcttttgtctcttc

SEQ ID NO: 504675 - DNA, 20 bp, Artificial Sequence
  chemically synthesized
aaatttgctagtcgcatggc

SEQ ID NO: 504676 - DNA, 20 bp, Artificial Sequence
  chemically synthesized
tttatcatcaaaggaaaaaa

SEQ ID NO: 504677 - DNA, 20 bp, Artificial Sequence
  chemically synthesized
ctttgggctacattttacta

SEQ ID NO: 504678 - DNA, 20 bp, Artificial Sequence
  chemically synthesized
cagtagtaaaatgtagccca

SEQ ID NO: 504679 - DNA, 20 bp, Artificial Sequence
  chemically synthesized
aaagaataatttgtcctttg

SEQ ID NO: 504680 - DNA, 20 bp, Artificial Sequence
  chemically synthesized
tatttctgtcaatttatctg

SEQ ID NO: 504681 - DNA, 20 bp, Artificial Sequence
  chemically synthesized
gtctggctcgctgtatatac

SEQ ID NO: 504682 - DNA, 20 bp, Artificial Sequence
  chemically synthesized
aaaagagcagttgaggtcat

SEQ ID NO: 504683 - DNA, 20 bp, Artificial Sequence
  chemically synthesized
agatttcaaaatcagatgtt

SEQ ID NO: 504684 - DNA, 20 bp, Artificial Sequence
  chemically synthesized
atgggaatagcttctccttg

SEQ ID NO: 504685 - DNA, 20 bp, Artificial Sequence
  chemically synthesized
aaacaaaacatgttttgtat

SEQ ID NO: 504686 - DNA, 20 bp, Artificial Sequence
  chemically synthesized
ttgttaatacaggttgtagg

SEQ ID NO: 504687 - DNA, 20 bp, Artificial Sequence
  chemically synthesized
ttgtttcatgttagtacctt

SEQ ID NO: 504688 - DNA, 20 bp, Artificial Sequence
  chemically synthesized
caaagtctgcatccaggaac

SEQ ID NO: 504689 - DNA, 20 bp, Artificial Sequence
  chemically synthesized
aaggacaaggacccatgttc

SEQ ID NO: 504690 - DNA, 20 bp, Artificial Sequence
  chemically synthesized
ttctctttcagggctatgct

SEQ ID NO: 504691 - DNA, 20 bp, Artificial Sequence
  chemically synthesized
gttgacttcatcctgtgcca

SEQ ID NO: 504692 - DNA, 20 bp, Artificial Sequence
  chemically synthesized
actttccatactctatggca

SEQ ID NO: 504693 - DNA, 20 bp, Artificial Sequence
  chemically synthesized
tttcttatcagatatttgtg

SEQ ID NO: 504694 - DNA, 20 bp, Artificial Sequence
  chemically synthesized
agaggcttgtctatactgtc

SEQ ID NO: 504695 - DNA, 20 bp, Artificial Sequence
  chemically synthesized
ctatcaccagccatacattt

SEQ ID NO: 504696 - DNA, 20 bp, Artificial Sequence
  chemically synthesized
gaaatttaaatatcattata

SEQ ID NO: 504697 - DNA, 20 bp, Artificial Sequence
  chemically synthesized
tgacataatttagagcatta

SEQ ID NO: 504698 - DNA, 20 bp, Artificial Sequence
  chemically synthesized
aatttagagcattaatgggt

SEQ ID NO: 504699 - DNA, 20 bp, Artificial Sequence
  chemically synthesized
acctatatttgatttatgga

SEQ ID NO: 504700 - DNA, 20 bp, Artificial Sequence
  chemically synthesized
gcacatcattttgatataag

SEQ ID NO: 504701 - DNA, 20 bp, Artificial Sequence
  chemically synthesized
gaaagagaaaatattgttca

SEQ ID NO: 504702 - DNA, 20 bp, Artificial Sequence
  chemically synthesized
ttatagatatatttttatat

SEQ ID NO: 504703 - DNA, 20 bp, Artificial Sequence
  chemically synthesized
ttttttttttttttttggga

SEQ ID NO: 504704 - DNA, 20 bp, Artificial Sequence
  chemically synthesized
ctcgctcttgttgcccaggc

SEQ ID NO: 504705 - DNA, 20 bp, Artificial Sequence
  chemically synthesized
gcagaagaatcgcttgaacc

SEQ ID NO: 504706 - DNA, 20 bp, Artificial Sequence
  chemically synthesized
tactcaggaggctgaggcag

SEQ ID NO: 504707 - DNA, 20 bp, Artificial Sequence
  chemically synthesized
gattcttctgcctcagcctc

SEQ ID NO: 504708 - DNA, 20 bp, Artificial Sequence
  chemically synthesized
gcctcagcctcctgagtagc

SEQ ID NO: 504709 - DNA, 20 bp, Artificial Sequence
  chemically synthesized
ttttttatttttagtagaga

SEQ ID NO: 504710 - DNA, 20 bp, Artificial Sequence
  chemically synthesized
actttgggaggccaaggtgg

SEQ ID NO: 504711 - DNA, 20 bp, Artificial Sequence
  chemically synthesized
cagcactttgggaggccaag

SEQ ID NO: 504712 - DNA, 20 bp, Artificial Sequence
  chemically synthesized
accttggcctcccaaagtgc

SEQ ID NO: 504713 - DNA, 20 bp, Artificial Sequence
  chemically synthesized
gggtactactgagagtgaaa

SEQ ID NO: 504714 - DNA, 20 bp, Artificial Sequence
  chemically synthesized
atacaaaccagggtactact

SEQ ID NO: 504715 - DNA, 20 bp, Artificial Sequence
  chemically synthesized
tgtgattttatcatacaaac

SEQ ID NO: 504716 - DNA, 20 bp, Artificial Sequence
  chemically synthesized
tcttagcttttcttaatctt

SEQ ID NO: 504717 - DNA, 20 bp, Artificial Sequence
  chemically synthesized
actttcaaataatatttttg

SEQ ID NO: 504718 - DNA, 20 bp, Artificial Sequence
  chemically synthesized
aaaggaaaaagaaacggtaa

SEQ ID NO: 504719 - DNA, 20 bp, Artificial Sequence
  chemically synthesized
ttttaaattacatatgtggc

SEQ ID NO: 504720 - DNA, 20 bp, Artificial Sequence
  chemically synthesized
ttggacaatgactttcttca

SEQ ID NO: 504721 - DNA, 20 bp, Artificial Sequence
  chemically synthesized
ccagctttgtcctgttggct

SEQ ID NO: 504722 - DNA, 20 bp, Artificial Sequence
  chemically synthesized
acaaaaacaagcaatgggga

SEQ ID NO: 504723 - DNA, 20 bp, Artificial Sequence
  chemically synthesized
ccagcaccatttattaaata

SEQ ID NO: 504724 - DNA, 20 bp, Artificial Sequence
  chemically synthesized
ccatatgtagaaagctgaaa

SEQ ID NO: 504725 - DNA, 20 bp, Artificial Sequence
  chemically synthesized
ttttgtataagttgtaagga

SEQ ID NO: 504726 - DNA, 20 bp, Artificial Sequence
  chemically synthesized
tatacaaaaatcaattcaag

SEQ ID NO: 504727 - DNA, 20 bp, Artificial Sequence
  chemically synthesized
gtttaaatctttaatccatc

SEQ ID NO: 504728 - DNA, 20 bp, Artificial Sequence
  chemically synthesized
gtattgcctaggttttcttc

SEQ ID NO: 504729 - DNA, 20 bp, Artificial Sequence
  chemically synthesized
tccttgcccatgcctatgcc

SEQ ID NO: 504730 - DNA, 20 bp, Artificial Sequence
  chemically synthesized
acaaaagacaaattgacaaa

SEQ ID NO: 504731 - DNA, 20 bp, Artificial Sequence
  chemically synthesized
acagcaaaagaaactaccat

SEQ ID NO: 504732 - DNA, 20 bp, Artificial Sequence
  chemically synthesized
ggatattagccctttgtcag

SEQ ID NO: 504733 - DNA, 20 bp, Artificial Sequence
  chemically synthesized
tctgacaaagggctaatatc

SEQ ID NO: 504734 - DNA, 20 bp, Artificial Sequence
  chemically synthesized
ttttgagttcgttgtagatt

SEQ ID NO: 504735 - DNA, 20 bp, Artificial Sequence
  chemically synthesized
tttttttcttgtaaattttt

SEQ ID NO: 504736 - DNA, 20 bp, Artificial Sequence
  chemically synthesized
gcccttcgcccactttttga

SEQ ID NO: 504737 - DNA, 20 bp, Artificial Sequence
  chemically synthesized
aacatgaaaacatttatgta

SEQ ID NO: 504738 - DNA, 20 bp, Artificial Sequence
  chemically synthesized
gttcttgtttccagtgaagt

SEQ ID NO: 504739 - DNA, 20 bp, Artificial Sequence
  chemically synthesized
taaaaagggcagtgaaaact

SEQ ID NO: 504740 - DNA, 20 bp, Artificial Sequence
  chemically synthesized
tttctaaagacagcatatat

SEQ ID NO: 504741 - DNA, 20 bp, Artificial Sequence
  chemically synthesized
gtctttagaaaaaaatactt

SEQ ID NO: 504742 - DNA, 20 bp, Artificial Sequence
  chemically synthesized
tagaagaaagagaaaatgga

SEQ ID NO: 504743 - DNA, 20 bp, Artificial Sequence
  chemically synthesized
aagaattataccaattctga

SEQ ID NO: 504744 - DNA, 20 bp, Artificial Sequence
  chemically synthesized
agctcagatttcaattcgtt

SEQ ID NO: 504745 - DNA, 20 bp, Artificial Sequence
  chemically synthesized
gttactctctcccaaagagt

SEQ ID NO: 504746 - DNA, 20 bp, Artificial Sequence
  chemically synthesized
ggcattcatactctttggga

SEQ ID NO: 504747 - DNA, 20 bp, Artificial Sequence
  chemically synthesized
acaaaagttactctctccca

SEQ ID NO: 504748 - DNA, 20 bp, Artificial Sequence
  chemically synthesized
cattagtcttgcaaccatga

SEQ ID NO: 504749 - DNA, 20 bp, Artificial Sequence
  chemically synthesized
tgtatttatgtttttttaat

SEQ ID NO: 504750 - DNA, 20 bp, Artificial Sequence
  chemically synthesized
aacataaatacagctttcag

SEQ ID NO: 504751 - DNA, 20 bp, Artificial Sequence
  chemically synthesized
atcgtcagagattattttac

SEQ ID NO: 504752 - DNA, 20 bp, Artificial Sequence
  chemically synthesized
atcttcacccaccaaaacga

SEQ ID NO: 504753 - DNA, 20 bp, Artificial Sequence
  chemically synthesized
ctgacgattcaatcgttttg

SEQ ID NO: 504754 - DNA, 20 bp, Artificial Sequence
  chemically synthesized
actttctagcactggtttga

SEQ ID NO: 504755 - DNA, 20 bp, Artificial Sequence
  chemically synthesized
tagaaagttggtatatatcc

SEQ ID NO: 504756 - DNA, 20 bp, Artificial Sequence
  chemically synthesized
tcttgtcttatttcttatcc

SEQ ID NO: 504757 - DNA, 20 bp, Artificial Sequence
  chemically synthesized
aagaaataagacaagaggta

SEQ ID NO: 504758 - DNA, 20 bp, Artificial Sequence
  chemically synthesized
atatttctgtactataaata

SEQ ID NO: 504759 - DNA, 20 bp, Artificial Sequence
  chemically synthesized
agttgagaccttaatgttct

SEQ ID NO: 504760 - DNA, 20 bp, Artificial Sequence
  chemically synthesized
tgttcacatctttttaaaca

SEQ ID NO: 504761 - DNA, 20 bp, Artificial Sequence
  chemically synthesized
attagccattatttccataa

SEQ ID NO: 504762 - DNA, 20 bp, Artificial Sequence
  chemically synthesized
atttggtttagttggtcctc

SEQ ID NO: 504763 - DNA, 20 bp, Artificial Sequence
  chemically synthesized
tccagagtatggtatctcct

SEQ ID NO: 504764 - DNA, 20 bp, Artificial Sequence
  chemically synthesized
gagataagcatataatttta

SEQ ID NO: 504765 - DNA, 20 bp, Artificial Sequence
  chemically synthesized
cttttgtatttttcacagga

SEQ ID NO: 504766 - DNA, 20 bp, Artificial Sequence
  chemically synthesized
tttttcacaggaaagggttc

SEQ ID NO: 504767 - DNA, 20 bp, Artificial Sequence
  chemically synthesized
tgggggttagagagccttat

SEQ ID NO: 504768 - DNA, 20 bp, Artificial Sequence
  chemically synthesized
gaactggtttttaatattgt

SEQ ID NO: 504769 - DNA, 20 bp, Artificial Sequence
  chemically synthesized
aaaccagttctgccgatcat

SEQ ID NO: 504770 - DNA, 20 bp, Artificial Sequence
  chemically synthesized
gtatatatatttgcccttgt

SEQ ID NO: 504771 - DNA, 20 bp, Artificial Sequence
  chemically synthesized
cattggtgtctattaatttg

SEQ ID NO: 504772 - DNA, 20 bp, Artificial Sequence
  chemically synthesized
cttcaaattaatagacacca

SEQ ID NO: 504773 - DNA, 20 bp, Artificial Sequence
  chemically synthesized
acaccaatgggtctgagaga

SEQ ID NO: 504774 - DNA, 20 bp, Artificial Sequence
  chemically synthesized
tgggtctgagagaaagagta

SEQ ID NO: 504775 - DNA, 20 bp, Artificial Sequence
  chemically synthesized
gggtgataaggaggtgacaa

SEQ ID NO: 504776 - DNA, 20 bp, Artificial Sequence
  chemically synthesized
taaggaggtgacaacggaat

SEQ ID NO: 504777 - DNA, 20 bp, Artificial Sequence
  chemically synthesized
gtaagagaagtattttccct

SEQ ID NO: 504778 - DNA, 20 bp, Artificial Sequence
  chemically synthesized
gaatgagaggagagacaaac

SEQ ID NO: 504779 - DNA, 20 bp, Artificial Sequence
  chemically synthesized
tgctgaacatagaggggcag

SEQ ID NO: 504780 - DNA, 20 bp, Artificial Sequence
  chemically synthesized
gagcaataaaggccaagcac

SEQ ID NO: 504781 - DNA, 20 bp, Artificial Sequence
  chemically synthesized
cttgccatgttccttctgcc

SEQ ID NO: 504782 - DNA, 20 bp, Artificial Sequence
  chemically synthesized
ttgagacttttgtgataagt

SEQ ID NO: 504783 - DNA, 20 bp, Artificial Sequence
  chemically synthesized
cttccttgagggaggaacat

SEQ ID NO: 504784 - DNA, 20 bp, Artificial Sequence
  chemically synthesized
agatgcaaagctttgggaga

SEQ ID NO: 504785 - DNA, 20 bp, Artificial Sequence
  chemically synthesized
actaagatgcaaagctttgg

SEQ ID NO: 504786 - DNA, 20 bp, Artificial Sequence
  chemically synthesized
agaagagagatatgaaacaa

SEQ ID NO: 504787 - DNA, 20 bp, Artificial Sequence
  chemically synthesized
ttccgtaaatacaataaaag

SEQ ID NO: 504788 - DNA, 20 bp, Artificial Sequence
  chemically synthesized
atacaataaaagcagagtcc

SEQ ID NO: 504789 - DNA, 20 bp, Artificial Sequence
  chemically synthesized
gcactaagttttgggaatat

SEQ ID NO: 504790 - DNA, 20 bp, Artificial Sequence
  chemically synthesized
agcccatagcactaagtttt

SEQ ID NO: 504791 - DNA, 20 bp, Artificial Sequence
  chemically synthesized
ccaaaacttagtgctatggg

SEQ ID NO: 504792 - DNA, 20 bp, Artificial Sequence
  chemically synthesized
aatggttaggacttcaacat

SEQ ID NO: 504793 - DNA, 20 bp, Artificial Sequence
  chemically synthesized
tgatgtttatatgacgtcat

SEQ ID NO: 504794 - DNA, 20 bp, Artificial Sequence
  chemically synthesized
tttatatgacgtcatcaggg

SEQ ID NO: 504795 - DNA, 20 bp, Artificial Sequence
  chemically synthesized
tgacgtcatcagggttgggt

SEQ ID NO: 504796 - DNA, 20 bp, Artificial Sequence
  chemically synthesized
tcagggttgggtaagggtgg

SEQ ID NO: 504797 - DNA, 20 bp, Artificial Sequence
  chemically synthesized
gggtggggggctaatccctt

SEQ ID NO: 504798 - DNA, 20 bp, Artificial Sequence
  chemically synthesized
tataaagccaccaatcccta

SEQ ID NO: 504799 - DNA, 20 bp, Artificial Sequence
  chemically synthesized
tgtgtatacatgcagagaga

SEQ ID NO: 504800 - DNA, 20 bp, Artificial Sequence
  chemically synthesized
agaggaaagccatgtgagga

SEQ ID NO: 504801 - DNA, 20 bp, Artificial Sequence
  chemically synthesized
agtccaggatcaaggtttgg

SEQ ID NO: 504802 - DNA, 20 bp, Artificial Sequence
  chemically synthesized
tctagaagtgagagaaagtc

SEQ ID NO: 504803 - DNA, 20 bp, Artificial Sequence
  chemically synthesized
acaacacaggtttattttct

SEQ ID NO: 504804 - DNA, 20 bp, Artificial Sequence
  chemically synthesized
aacctgtgttgtttaagcca

SEQ ID NO: 504805 - DNA, 20 bp, Artificial Sequence
  chemically synthesized
ctactgagtgtattaatcag

SEQ ID NO: 504806 - DNA, 20 bp, Artificial Sequence
  chemically synthesized
taatgtgtttaagaatgcta

SEQ ID NO: 504807 - DNA, 20 bp, Artificial Sequence
  chemically synthesized
taagtgtctctaatgtgttt

SEQ ID NO: 504808 - DNA, 20 bp, Artificial Sequence
  chemically synthesized
ttaatgtatatattttatgc

SEQ ID NO: 504809 - DNA, 20 bp, Artificial Sequence
  chemically synthesized
actattactaactactatat

SEQ ID NO: 504810 - DNA, 20 bp, Artificial Sequence
  chemically synthesized
aactactatatctgaatctc

SEQ ID NO: 504811 - DNA, 20 bp, Artificial Sequence
  chemically synthesized
ctatatctgaatctcaagaa

SEQ ID NO: 504812 - DNA, 20 bp, Artificial Sequence
  chemically synthesized
tgtggcaagaaataatgtat

SEQ ID NO: 504813 - DNA, 20 bp, Artificial Sequence
  chemically synthesized
ccgcttttcctgtgaatcag

SEQ ID NO: 504814 - DNA, 20 bp, Artificial Sequence
  chemically synthesized
gaaccaatgccgcttttcct

SEQ ID NO: 504815 - DNA, 20 bp, Artificial Sequence
  chemically synthesized
tgagatgcattttgtaattt

SEQ ID NO: 504816 - DNA, 20 bp, Artificial Sequence
  chemically synthesized
taggcaaatacacacatcta

SEQ ID NO: 504817 - DNA, 20 bp, Artificial Sequence
  chemically synthesized
acttttggataaagaatacc

SEQ ID NO: 504818 - DNA, 20 bp, Artificial Sequence
  chemically synthesized
agaaagtatacttttggata

SEQ ID NO: 504819 - DNA, 20 bp, Artificial Sequence
  chemically synthesized
taaactcagaaagtatactt

SEQ ID NO: 504820 - DNA, 20 bp, Artificial Sequence
  chemically synthesized
tttatccaaaagtatacttt

SEQ ID NO: 504821 - DNA, 20 bp, Artificial Sequence
  chemically synthesized
tttttctcttcaaaatagct

SEQ ID NO: 504822 - DNA, 20 bp, Artificial Sequence
  chemically synthesized
tttgaatttctcatcacttt

SEQ ID NO: 504823 - DNA, 20 bp, Artificial Sequence
  chemically synthesized
aagaatggcttaaataaagg

SEQ ID NO: 504824 - DNA, 20 bp, Artificial Sequence
  chemically synthesized
ttcatttgcatactgtaaaa

SEQ ID NO: 504825 - DNA, 20 bp, Artificial Sequence
  chemically synthesized
ttcttttttacagtatgcaa

SEQ ID NO: 504826 - DNA, 20 bp, Artificial Sequence
  chemically synthesized
tacatttaatacaaaaggca

SEQ ID NO: 504827 - DNA, 20 bp, Artificial Sequence
  chemically synthesized
aggatggactaaaacgtttc

SEQ ID NO: 504828 - DNA, 20 bp, Artificial Sequence
  chemically synthesized
ggggaatgagaaactgatta

SEQ ID NO: 504829 - DNA, 20 bp, Artificial Sequence
  chemically synthesized
tgagctatgtgcttttcgcg

SEQ ID NO: 504830 - DNA, 20 bp, Artificial Sequence
  chemically synthesized
agggcctgagaaagagatga

SEQ ID NO: 504831 - DNA, 20 bp, Artificial Sequence
  chemically synthesized
taacaggagaagagcggaca

SEQ ID NO: 504832 - DNA, 20 bp, Artificial Sequence
  chemically synthesized
catctgtaaatatcagtctc

SEQ ID NO: 504833 - DNA, 20 bp, Artificial Sequence
  chemically synthesized
ttcacttttttccctgcctc

SEQ ID NO: 504834 - DNA, 20 bp, Artificial Sequence
  chemically synthesized
aggcagggaaaaaagtgaag

SEQ ID NO: 504835 - DNA, 20 bp, Artificial Sequence
  chemically synthesized
ttgtctgactccatttctat

SEQ ID NO: 504836 - DNA, 20 bp, Artificial Sequence
  chemically synthesized
ttaaggaatcctcatagaaa

SEQ ID NO: 504837 - DNA, 20 bp, Artificial Sequence
  chemically synthesized
aaagcagcatggccggctta

SEQ ID NO: 504838 - DNA, 20 bp, Artificial Sequence
  chemically synthesized
ggccatgctgcttttaccat

SEQ ID NO: 504839 - DNA, 20 bp, Artificial Sequence
  chemically synthesized
gaggatctgactgtctcctt

SEQ ID NO: 504840 - DNA, 20 bp, Artificial Sequence
  chemically synthesized
cttaccccttttagtccaga

SEQ ID NO: 504841 - DNA, 20 bp, Artificial Sequence
  chemically synthesized
ctgatcctttctggactaaa

SEQ ID NO: 504842 - DNA, 20 bp, Artificial Sequence
  chemically synthesized
aaggggtaagaactctgatg

SEQ ID NO: 504843 - DNA, 20 bp, Artificial Sequence
  chemically synthesized
atagtgtagtaacccagcat

SEQ ID NO: 504844 - DNA, 20 bp, Artificial Sequence
  chemically synthesized
tggagtacagaggaaccaca

SEQ ID NO: 504845 - DNA, 20 bp, Artificial Sequence
  chemically synthesized
agatatttttaaaatgtagc

SEQ ID NO: 504846 - DNA, 20 bp, Artificial Sequence
  chemically synthesized
aacacgggtcaacaacaagc

SEQ ID NO: 504847 - DNA, 20 bp, Artificial Sequence
  chemically synthesized
ccatggaaatagttagaaac

SEQ ID NO: 504848 - DNA, 20 bp, Artificial Sequence
  chemically synthesized
ccgtgtttctaactatttcc

SEQ ID NO: 504849 - DNA, 20 bp, Artificial Sequence
  chemically synthesized
acatagtcattttgaaaaag

SEQ ID NO: 504850 - DNA, 20 bp, Artificial Sequence
  chemically synthesized
tttggaactctttctttgtg

SEQ ID NO: 504851 - DNA, 20 bp, Artificial Sequence
  chemically synthesized
tgtttcactcgtcacaaaga

SEQ ID NO: 504852 - DNA, 20 bp, Artificial Sequence
  chemically synthesized
aagtgagaggccatttttta

SEQ ID NO: 504853 - DNA, 20 bp, Artificial Sequence
  chemically synthesized
gcgtaagcatgaggcagttt

SEQ ID NO: 504854 - DNA, 20 bp, Artificial Sequence
  chemically synthesized
aactacgccaaatacaattt

SEQ ID NO: 504855 - DNA, 20 bp, Artificial Sequence
  chemically synthesized
gccaaatacaattttagaat

SEQ ID NO: 504856 - DNA, 20 bp, Artificial Sequence
  chemically synthesized
aatatgtaagacgtagatac

SEQ ID NO: 504857 - DNA, 20 bp, Artificial Sequence
  chemically synthesized
taatgaaacgttcaccttct

SEQ ID NO: 504858 - DNA, 20 bp, Artificial Sequence
  chemically synthesized
cagttaaaaatttgtaaggt

SEQ ID NO: 504859 - DNA, 20 bp, Artificial Sequence
  chemically synthesized
ttaattgctgttggctctga

SEQ ID NO: 504860 - DNA, 20 bp, Artificial Sequence
  chemically synthesized
ctgttggctctgatggggtg

SEQ ID NO: 504861 - DNA, 20 bp, Artificial Sequence
  chemically synthesized
ggctctgatggggtggtggg

SEQ ID NO: 504862 - DNA, 20 bp, Artificial Sequence
  chemically synthesized
aagtgagagacttaactggc

SEQ ID NO: 504863 - DNA, 20 bp, Artificial Sequence
  chemically synthesized
gtctctcacttagcaactgg

SEQ ID NO: 504864 - DNA, 20 bp, Artificial Sequence
  chemically synthesized
acaactgaacagccggtgga

SEQ ID NO: 504865 - DNA, 20 bp, Artificial Sequence
  chemically synthesized
tcagaacaactgaacagccg

SEQ ID NO: 504866 - DNA, 20 bp, Artificial Sequence
  chemically synthesized
taattatttttttctttcta

SEQ ID NO: 504867 - DNA, 20 bp, Artificial Sequence
  chemically synthesized
tctttcagtctgtgggttca

SEQ ID NO: 504868 - DNA, 20 bp, Artificial Sequence
  chemically synthesized
cagatcatttctttcagtct

SEQ ID NO: 504869 - DNA, 20 bp, Artificial Sequence
  chemically synthesized
gtggtgaatacttttataat

SEQ ID NO: 504870 - DNA, 20 bp, Artificial Sequence
  chemically synthesized
attataaaagtattcaccac

SEQ ID NO: 504871 - DNA, 20 bp, Artificial Sequence
  chemically synthesized
ggtttgaaatcattcatgtg

SEQ ID NO: 504872 - DNA, 20 bp, Artificial Sequence
  chemically synthesized
atgatttcagattattcaat

SEQ ID NO: 504873 - DNA, 20 bp, Artificial Sequence
  chemically synthesized
cgcaagtctgataattcaca

SEQ ID NO: 504874 - DNA, 20 bp, Artificial Sequence
  chemically synthesized
atcagacttgcgtcacaaca

SEQ ID NO: 504875 - DNA, 20 bp, Artificial Sequence
  chemically synthesized
agacataagatgtagaaaat

SEQ ID NO: 504876 - DNA, 20 bp, Artificial Sequence
  chemically synthesized
ctgcatgaacaagtaacatt

SEQ ID NO: 504877 - DNA, 20 bp, Artificial Sequence
  chemically synthesized
gttagtttggggaagtatat

SEQ ID NO: 504878 - DNA, 20 bp, Artificial Sequence
  chemically synthesized
aaatgaaataaagaataatc

SEQ ID NO: 504879 - DNA, 20 bp, Artificial Sequence
  chemically synthesized
aatcttctgtaaatgaaata

SEQ ID NO: 504880 - DNA, 20 bp, Artificial Sequence
  chemically synthesized
acctcggcctcccaaagtgt

SEQ ID NO: 504881 - DNA, 20 bp, Artificial Sequence
  chemically synthesized
cactttgggaggccgaggtg

SEQ ID NO: 504882 - DNA, 20 bp, Artificial Sequence
  chemically synthesized
cggggtttcaccgtgttagc

SEQ ID NO: 504883 - DNA, 20 bp, Artificial Sequence
  chemically synthesized
ttttgtatttttagtagaga

SEQ ID NO: 504884 - DNA, 20 bp, Artificial Sequence
  chemically synthesized
cgggcgtggtggcgggcgcc

SEQ ID NO: 504885 - DNA, 20 bp, Artificial Sequence
  chemically synthesized
cattctcctgcctcagcctc

SEQ ID NO: 504886 - DNA, 20 bp, Artificial Sequence
  chemically synthesized
tactcgggaggctgaggcag

SEQ ID NO: 504887 - DNA, 20 bp, Artificial Sequence
  chemically synthesized
ctcactgcaagctccgcctc

SEQ ID NO: 504888 - DNA, 20 bp, Artificial Sequence
  chemically synthesized
tcgcgccactgcactccagc

SEQ ID NO: 504889 - DNA, 20 bp, Artificial Sequence
  chemically synthesized
tctcgctctgtcacccaggc

SEQ ID NO: 504890 - DNA, 20 bp, Artificial Sequence
  chemically synthesized
catccatggacaatatgaga

SEQ ID NO: 504891 - DNA, 20 bp, Artificial Sequence
  chemically synthesized
gactctgtctcatattgtcc

SEQ ID NO: 504892 - DNA, 20 bp, Artificial Sequence
  chemically synthesized
ttttcccttgataaagtttt

SEQ ID NO: 504893 - DNA, 20 bp, Artificial Sequence
  chemically synthesized
cattatcaccattaccattc

SEQ ID NO: 504894 - DNA, 20 bp, Artificial Sequence
  chemically synthesized
atggtacatagtaggtactc

SEQ ID NO: 504895 - DNA, 20 bp, Artificial Sequence
  chemically synthesized
ggagtacctactatgtacca

SEQ ID NO: 504896 - DNA, 20 bp, Artificial Sequence
  chemically synthesized
ccatgctttcatgctatgta

SEQ ID NO: 504897 - DNA, 20 bp, Artificial Sequence
  chemically synthesized
tggcaacatcacgctgtgct

SEQ ID NO: 504898 - DNA, 20 bp, Artificial Sequence
  chemically synthesized
gtaaactaactttagagagt

SEQ ID NO: 504899 - DNA, 20 bp, Artificial Sequence
  chemically synthesized
aattttgtaaactaacttta

SEQ ID NO: 504900 - DNA, 20 bp, Artificial Sequence
  chemically synthesized
ttatatagttttcttaatga

SEQ ID NO: 504901 - DNA, 20 bp, Artificial Sequence
  chemically synthesized
tttcttatactttggaaata

SEQ ID NO: 504902 - DNA, 20 bp, Artificial Sequence
  chemically synthesized
cctagagaaagaaccttaca

SEQ ID NO: 504903 - DNA, 20 bp, Artificial Sequence
  chemically synthesized
ttaaaatacctaaaagttcg

SEQ ID NO: 504904 - DNA, 20 bp, Artificial Sequence
  chemically synthesized
ttcgaagagtagtttggtag

SEQ ID NO: 504905 - DNA, 20 bp, Artificial Sequence
  chemically synthesized
tattttttttagtctttaaa

SEQ ID NO: 504906 - DNA, 20 bp, Artificial Sequence
  chemically synthesized
agactaaaaaaaatatagat

SEQ ID NO: 504907 - DNA, 20 bp, Artificial Sequence
  chemically synthesized
aggataaaataatatagttg

SEQ ID NO: 504908 - DNA, 20 bp, Artificial Sequence
  chemically synthesized
cagggcagagggaagtgaaa

SEQ ID NO: 504909 - DNA, 20 bp, Artificial Sequence
  chemically synthesized
aagttacagttgtgtttcaa

SEQ ID NO: 504910 - DNA, 20 bp, Artificial Sequence
  chemically synthesized
tttcaaagcataatgctact

SEQ ID NO: 504911 - DNA, 20 bp, Artificial Sequence
  chemically synthesized
ttgtctccttcaccgccatc

SEQ ID NO: 504912 - DNA, 20 bp, Artificial Sequence
  chemically synthesized
atgagatacaatggaaataa

SEQ ID NO: 504913 - DNA, 20 bp, Artificial Sequence
  chemically synthesized
tggaaataatagaatgtaaa

SEQ ID NO: 504914 - DNA, 20 bp, Artificial Sequence
  chemically synthesized
cttaagcattaggaggatat

SEQ ID NO: 504915 - DNA, 20 bp, Artificial Sequence
  chemically synthesized
attgcttccttaagcattag

SEQ ID NO: 504916 - DNA, 20 bp, Artificial Sequence
  chemically synthesized
tttttgatcgttagattttg

SEQ ID NO: 504917 - DNA, 20 bp, Artificial Sequence
  chemically synthesized
tttggtataaagtgtaagag

SEQ ID NO: 504918 - DNA, 20 bp, Artificial Sequence
  chemically synthesized
atcataatacttttttcaaa

SEQ ID NO: 504919 - DNA, 20 bp, Artificial Sequence
  chemically synthesized
taattagaaaatatactgga

SEQ ID NO: 504920 - DNA, 20 bp, Artificial Sequence
  chemically synthesized
ttaataacaaaaaatgtggc

SEQ ID NO: 504921 - DNA, 20 bp, Artificial Sequence
  chemically synthesized
caagcagttagaagtccatg

SEQ ID NO: 504922 - DNA, 20 bp, Artificial Sequence
  chemically synthesized
aagggaccgatagactgatg

SEQ ID NO: 504923 - DNA, 20 bp, Artificial Sequence
  chemically synthesized
accgatagactgatgctgga

SEQ ID NO: 504924 - DNA, 20 bp, Artificial Sequence
  chemically synthesized
ccgtctcatttagacaaatg

SEQ ID NO: 504925 - DNA, 20 bp, Artificial Sequence
  chemically synthesized
actataagttgattttcaat

SEQ ID NO: 504926 - DNA, 20 bp, Artificial Sequence
  chemically synthesized
aaacctgtccctagatttta

SEQ ID NO: 504927 - DNA, 20 bp, Artificial Sequence
  chemically synthesized
aaatctagggacaggtttta

SEQ ID NO: 504928 - DNA, 20 bp, Artificial Sequence
  chemically synthesized
attttttggggggcaaaaca

SEQ ID NO: 504929 - DNA, 20 bp, Artificial Sequence
  chemically synthesized
gtattataaatttcagtgtt

SEQ ID NO: 504930 - DNA, 20 bp, Artificial Sequence
  chemically synthesized
ttgcatattgatctttataa

SEQ ID NO: 504931 - DNA, 20 bp, Artificial Sequence
  chemically synthesized
aaggcagagaaatgaccggt

SEQ ID NO: 504932 - DNA, 20 bp, Artificial Sequence
  chemically synthesized
aactccggtctctttaacgc

SEQ ID NO: 504933 - DNA, 20 bp, Artificial Sequence
  chemically synthesized
aattctggcgttaaagagac

SEQ ID NO: 504934 - DNA, 20 bp, Artificial Sequence
  chemically synthesized
ccccttactagatgtgtgaa

SEQ ID NO: 504935 - DNA, 20 bp, Artificial Sequence
  chemically synthesized
ggttcagttacttaatttca

SEQ ID NO: 504936 - DNA, 20 bp, Artificial Sequence
  chemically synthesized
gtttttctcatccatgaaat

SEQ ID NO: 504937 - DNA, 20 bp, Artificial Sequence
  chemically synthesized
ctatttttaatcctcatttc

SEQ ID NO: 504938 - DNA, 20 bp, Artificial Sequence
  chemically synthesized
catgaaatgaggattaaaaa

SEQ ID NO: 504939 - DNA, 20 bp, Artificial Sequence
  chemically synthesized
taaaaatagaatcgacctca

SEQ ID NO: 504940 - DNA, 20 bp, Artificial Sequence
  chemically synthesized
ataggatacttaccaaagtt

SEQ ID NO: 504941 - DNA, 20 bp, Artificial Sequence
  chemically synthesized
gccatatagaggaaatgaaa

SEQ ID NO: 504942 - DNA, 20 bp, Artificial Sequence
  chemically synthesized
gagagctggtcccttgtttt

SEQ ID NO: 504943 - DNA, 20 bp, Artificial Sequence
  chemically synthesized
tatataatatatgactaata

SEQ ID NO: 504944 - DNA, 20 bp, Artificial Sequence
  chemically synthesized
aagaagttttatcaataacc

SEQ ID NO: 504945 - DNA, 20 bp, Artificial Sequence
  chemically synthesized
accagggatcctttgagacc

SEQ ID NO: 504946 - DNA, 20 bp, Artificial Sequence
  chemically synthesized
gcctcgaactcctggtctca

SEQ ID NO: 504947 - DNA, 20 bp, Artificial Sequence
  chemically synthesized
tcttgctctgttgcccaggc

SEQ ID NO: 504948 - DNA, 20 bp, Artificial Sequence
  chemically synthesized
ccaactaaaataaaaataaa

SEQ ID NO: 504949 - DNA, 20 bp, Artificial Sequence
  chemically synthesized
aaaataaaaagagtttattt

SEQ ID NO: 504950 - DNA, 20 bp, Artificial Sequence
  chemically synthesized
aagagtttatttgggaatcc

SEQ ID NO: 504951 - DNA, 20 bp, Artificial Sequence
  chemically synthesized
ataaatgtggcagaatattc

SEQ ID NO: 504952 - DNA, 20 bp, Artificial Sequence
  chemically synthesized
tcacatgattataaatgtgg

SEQ ID NO: 504953 - DNA, 20 bp, Artificial Sequence
  chemically synthesized
aaatcagaagtcttgctatg

SEQ ID NO: 504954 - DNA, 20 bp, Artificial Sequence
  chemically synthesized
aaacattgtattaattcatt

SEQ ID NO: 504955 - DNA, 20 bp, Artificial Sequence
  chemically synthesized
gagcaggcagcatattcaca

SEQ ID NO: 504956 - DNA, 20 bp, Artificial Sequence
  chemically synthesized
ccagtggagacatttcctat

SEQ ID NO: 504957 - DNA, 20 bp, Artificial Sequence
  chemically synthesized
tctccactggcagtatctaa

SEQ ID NO: 504958 - DNA, 20 bp, Artificial Sequence
  chemically synthesized
atctaatagaattctcagct

SEQ ID NO: 504959 - DNA, 20 bp, Artificial Sequence
  chemically synthesized
tactctttctactccaagct

SEQ ID NO: 504960 - DNA, 20 bp, Artificial Sequence
  chemically synthesized
aattctcagcttggagtaga

SEQ ID NO: 504961 - DNA, 20 bp, Artificial Sequence
  chemically synthesized
atttggtattgaatgagttc

SEQ ID NO: 504962 - DNA, 20 bp, Artificial Sequence
  chemically synthesized
cactattgatttggtattga

SEQ ID NO: 504963 - DNA, 20 bp, Artificial Sequence
  chemically synthesized
agtacactattgatttggta

SEQ ID NO: 504964 - DNA, 20 bp, Artificial Sequence
  chemically synthesized
aaatcaatagtgtactctat

SEQ ID NO: 504965 - DNA, 20 bp, Artificial Sequence
  chemically synthesized
tcataatttttatattcata

SEQ ID NO: 504966 - DNA, 20 bp, Artificial Sequence
  chemically synthesized
tgctttaaaatacttgggca

SEQ ID NO: 504967 - DNA, 20 bp, Artificial Sequence
  chemically synthesized
atacttgggcaggggatgga

SEQ ID NO: 504968 - DNA, 20 bp, Artificial Sequence
  chemically synthesized
aatgctattacttcaacttt

SEQ ID NO: 504969 - DNA, 20 bp, Artificial Sequence
  chemically synthesized
aaagtccattaaaacctttc

SEQ ID NO: 504970 - DNA, 20 bp, Artificial Sequence
  chemically synthesized
aaaacctttctagaatgaaa

SEQ ID NO: 504971 - DNA, 20 bp, Artificial Sequence
  chemically synthesized
atccatatgcaaatatttac

SEQ ID NO: 504972 - DNA, 20 bp, Artificial Sequence
  chemically synthesized
atccaagtaaatatttgcat

SEQ ID NO: 504973 - DNA, 20 bp, Artificial Sequence
  chemically synthesized
attgttttatatgtattcca

SEQ ID NO: 504974 - DNA, 20 bp, Artificial Sequence
  chemically synthesized
agtcaaggagcataattcta

SEQ ID NO: 504975 - DNA, 20 bp, Artificial Sequence
  chemically synthesized
agaaaagttaaaattttcca

SEQ ID NO: 504976 - DNA, 20 bp, Artificial Sequence
  chemically synthesized
tggaaaattttaacttttct

SEQ ID NO: 504977 - DNA, 20 bp, Artificial Sequence
  chemically synthesized
taattttgtgttagctattt

SEQ ID NO: 504978 - DNA, 20 bp, Artificial Sequence
  chemically synthesized
accattttgttgtagcacat

SEQ ID NO: 504979 - DNA, 20 bp, Artificial Sequence
  chemically synthesized
ttgtagcacattagaatctc

SEQ ID NO: 504980 - DNA, 20 bp, Artificial Sequence
  chemically synthesized
acattagaatctcagggata

SEQ ID NO: 504981 - DNA, 20 bp, Artificial Sequence
  chemically synthesized
gtttagaatatgagatgtga

SEQ ID NO: 504982 - DNA, 20 bp, Artificial Sequence
  chemically synthesized
ggttgtttagaatatgagat

SEQ ID NO: 504983 - DNA, 20 bp, Artificial Sequence
  chemically synthesized
agactatttcaggggttgtt

SEQ ID NO: 504984 - DNA, 20 bp, Artificial Sequence
  chemically synthesized
atttattcacagactatttc

SEQ ID NO: 504985 - DNA, 20 bp, Artificial Sequence
  chemically synthesized
aacaacccctgaaatagtct

SEQ ID NO: 504986 - DNA, 20 bp, Artificial Sequence
  chemically synthesized
atatattgcacccagaggaa

SEQ ID NO: 504987 - DNA, 20 bp, Artificial Sequence
  chemically synthesized
caagtaatgatccatttcct

SEQ ID NO: 504988 - DNA, 20 bp, Artificial Sequence
  chemically synthesized
gtacacaagtaataaaatta

SEQ ID NO: 504989 - DNA, 20 bp, Artificial Sequence
  chemically synthesized
tacagtgcataacagactgt

SEQ ID NO: 504990 - DNA, 20 bp, Artificial Sequence
  chemically synthesized
aatgatgaatatacttgatg

SEQ ID NO: 504991 - DNA, 20 bp, Artificial Sequence
  chemically synthesized
ccctggcttcatggctaatg

SEQ ID NO: 504992 - DNA, 20 bp, Artificial Sequence
  chemically synthesized
ttcatcattagccatgaagc

SEQ ID NO: 504993 - DNA, 20 bp, Artificial Sequence
  chemically synthesized
cattagccatgaagccaggg

SEQ ID NO: 504994 - DNA, 20 bp, Artificial Sequence
  chemically synthesized
aacaagtgtttccagagctc

SEQ ID NO: 504995 - DNA, 20 bp, Artificial Sequence
  chemically synthesized
ttccagagctcttgaattaa

SEQ ID NO: 504996 - DNA, 20 bp, Artificial Sequence
  chemically synthesized
tcttgaattaaaagaatatt

SEQ ID NO: 504997 - DNA, 20 bp, Artificial Sequence
  chemically synthesized
atttttgctgaactttaagt

SEQ ID NO: 504998 - DNA, 20 bp, Artificial Sequence
  chemically synthesized
ttacattttagactattaca

SEQ ID NO: 504999 - DNA, 20 bp, Artificial Sequence
  chemically synthesized
agaacttgtcttcacaggtt

SEQ ID NO: 505000 - DNA, 20 bp, Artificial Sequence
  chemically synthesized
aaatttatattgccctcact

SEQ ID NO: 505001 - DNA, 20 bp, Artificial Sequence
  chemically synthesized
aatgagtggccaaaacaaat

SEQ ID NO: 505002 - DNA, 20 bp, Artificial Sequence
  chemically synthesized
tgtcactgttgttgtgggaa

SEQ ID NO: 505003 - DNA, 20 bp, Artificial Sequence
  chemically synthesized
acacgcacatgtctgcgcat

SEQ ID NO: 505004 - DNA, 20 bp, Artificial Sequence
  chemically synthesized
tgtgagcacggcgtgcatgc

SEQ ID NO: 505005 - DNA, 20 bp, Artificial Sequence
  chemically synthesized
ctccaaaaggaagagcctct

SEQ ID NO: 505006 - DNA, 20 bp, Artificial Sequence
  chemically synthesized
ctgtcaattaaaaacattta

SEQ ID NO: 505007 - DNA, 20 bp, Artificial Sequence
  chemically synthesized
acttagtataatgctctaca

SEQ ID NO: 505008 - DNA, 20 bp, Artificial Sequence
  chemically synthesized
aaactgcccagtactgagga

SEQ ID NO: 505009 - DNA, 20 bp, Artificial Sequence
  chemically synthesized
gcccagccccttcatcatga

SEQ ID NO: 505010 - DNA, 20 bp, Artificial Sequence
  chemically synthesized
agtagcccagccccttcatc

SEQ ID NO: 505011 - DNA, 20 bp, Artificial Sequence
  chemically synthesized
aaagtttttccagtgatcat

SEQ ID NO: 505012 - DNA, 20 bp, Artificial Sequence
  chemically synthesized
tttgtcagatgggtgagggt

SEQ ID NO: 505013 - DNA, 20 bp, Artificial Sequence
  chemically synthesized
ccagattttgtcagatgggt

SEQ ID NO: 505014 - DNA, 20 bp, Artificial Sequence
  chemically synthesized
gggcaaccagattttgtcag

SEQ ID NO: 505015 - DNA, 20 bp, Artificial Sequence
  chemically synthesized
agctcattagataatttcac

SEQ ID NO: 505016 - DNA, 20 bp, Artificial Sequence
  chemically synthesized
atagttacttggttaatgtt

SEQ ID NO: 505017 - DNA, 20 bp, Artificial Sequence
  chemically synthesized
actgttgtaattaaatggca

SEQ ID NO: 505018 - DNA, 20 bp, Artificial Sequence
  chemically synthesized
acactataatctagcactca

SEQ ID NO: 505019 - DNA, 20 bp, Artificial Sequence
  chemically synthesized
catctcaaaactatcattcc

SEQ ID NO: 505020 - DNA, 20 bp, Artificial Sequence
  chemically synthesized
tagttttctgtgtgttaatt

SEQ ID NO: 505021 - DNA, 20 bp, Artificial Sequence
  chemically synthesized
actacaaatagaaattgaaa

SEQ ID NO: 505022 - DNA, 20 bp, Artificial Sequence
  chemically synthesized
gagatactataattatgtaa

SEQ ID NO: 505023 - DNA, 20 bp, Artificial Sequence
  chemically synthesized
tcctctagaaattatggtga

SEQ ID NO: 505024 - DNA, 20 bp, Artificial Sequence
  chemically synthesized
ttgtaaaacagtgttctcgc

SEQ ID NO: 505025 - DNA, 20 bp, Artificial Sequence
  chemically synthesized
cgagaacactgttttacaaa

SEQ ID NO: 505026 - DNA, 20 bp, Artificial Sequence
  chemically synthesized
tatgtctgtttttatctatt

SEQ ID NO: 505027 - DNA, 20 bp, Artificial Sequence
  chemically synthesized
tcagtgtattattgagattg

SEQ ID NO: 505028 - DNA, 20 bp, Artificial Sequence
  chemically synthesized
ctttcttaaaaagtaaaata

SEQ ID NO: 505029 - DNA, 20 bp, Artificial Sequence
  chemically synthesized
gtagctgtgcatattgaaaa

SEQ ID NO: 505030 - DNA, 20 bp, Artificial Sequence
  chemically synthesized
ttttcaatatgcacagctac

SEQ ID NO: 505031 - DNA, 20 bp, Artificial Sequence
  chemically synthesized
agttaacagtttcctgagac

SEQ ID NO: 505032 - DNA, 20 bp, Artificial Sequence
  chemically synthesized
ttaccgtcaatatgtaagct

SEQ ID NO: 505033 - DNA, 20 bp, Artificial Sequence
  chemically synthesized
tctttttactagagacattt

SEQ ID NO: 505034 - DNA, 20 bp, Artificial Sequence
  chemically synthesized
tggataaatgtgacagaata

SEQ ID NO: 505035 - DNA, 20 bp, Artificial Sequence
  chemically synthesized
aattggttggataaatgtga

SEQ ID NO: 505036 - DNA, 20 bp, Artificial Sequence
  chemically synthesized
cttatgtcagcattaattgg

SEQ ID NO: 505037 - DNA, 20 bp, Artificial Sequence
  chemically synthesized
aaaagagaagctactaaaag

SEQ ID NO: 505038 - DNA, 20 bp, Artificial Sequence
  chemically synthesized
gatgttccagttcttttggt

SEQ ID NO: 505039 - DNA, 20 bp, Artificial Sequence
  chemically synthesized
tatacatggacgttttcctt

SEQ ID NO: 505040 - DNA, 20 bp, Artificial Sequence
  chemically synthesized
gtatagttttaaagcaggca

SEQ ID NO: 505041 - DNA, 20 bp, Artificial Sequence
  chemically synthesized
tggaatttttaaccaaagaa

SEQ ID NO: 505042 - DNA, 20 bp, Artificial Sequence
  chemically synthesized
gagattcttactaatttatt

SEQ ID NO: 505043 - DNA, 20 bp, Artificial Sequence
  chemically synthesized
aaaattccaaataaattagt

SEQ ID NO: 505044 - DNA, 20 bp, Artificial Sequence
  chemically synthesized
acagcaataatttgtatatt

SEQ ID NO: 505045 - DNA, 20 bp, Artificial Sequence
  chemically synthesized
caaatgtgaagagttgtatg

SEQ ID NO: 505046 - DNA, 20 bp, Artificial Sequence
  chemically synthesized
actgtattttatcaaatgtg

SEQ ID NO: 505047 - DNA, 20 bp, Artificial Sequence
  chemically synthesized
catatgctgagaagacagga

SEQ ID NO: 505048 - DNA, 20 bp, Artificial Sequence
  chemically synthesized
taagacatatgctgagaaga

SEQ ID NO: 505049 - DNA, 20 bp, Artificial Sequence
  chemically synthesized
tcctgaaggcaatttgttga

SEQ ID NO: 505050 - DNA, 20 bp, Artificial Sequence
  chemically synthesized
tctgcattacttaagtgatg

SEQ ID NO: 505051 - DNA, 20 bp, Artificial Sequence
  chemically synthesized
agaaattattttttccatct

SEQ ID NO: 505052 - DNA, 20 bp, Artificial Sequence
  chemically synthesized
gtaattcatcagtttgcttt

SEQ ID NO: 505053 - DNA, 20 bp, Artificial Sequence
  chemically synthesized
ttcattctaaaagcaaactg

SEQ ID NO: 505054 - DNA, 20 bp, Artificial Sequence
  chemically synthesized
taaactactttttaaaaatt

SEQ ID NO: 505055 - DNA, 20 bp, Artificial Sequence
  chemically synthesized
actggtatatgcatagcaaa

SEQ ID NO: 505056 - DNA, 20 bp, Artificial Sequence
  chemically synthesized
tacatataaaatatagttca

SEQ ID NO: 505057 - DNA, 20 bp, Artificial Sequence
  chemically synthesized
attcatagtgtaaaaatatg

SEQ ID NO: 505058 - DNA, 20 bp, Artificial Sequence
  chemically synthesized
attctacatatttttacact

SEQ ID NO: 505059 - DNA, 20 bp, Artificial Sequence
  chemically synthesized
tttattagtggcataataat

SEQ ID NO: 505060 - DNA, 20 bp, Artificial Sequence
  chemically synthesized
ataatatgagtggtttatac

SEQ ID NO: 505061 - DNA, 20 bp, Artificial Sequence
  chemically synthesized
tatagaaaggaaaatgagag

SEQ ID NO: 505062 - DNA, 20 bp, Artificial Sequence
  chemically synthesized
cctttctatacaaaaagggc

SEQ ID NO: 505063 - DNA, 20 bp, Artificial Sequence
  chemically synthesized
agctcttaaatttataagtc

SEQ ID NO: 505064 - DNA, 20 bp, Artificial Sequence
  chemically synthesized
aatgaagctttctgtaaact

SEQ ID NO: 505065 - DNA, 20 bp, Artificial Sequence
  chemically synthesized
tatagagcccaaaagtacag

SEQ ID NO: 505066 - DNA, 20 bp, Artificial Sequence
  chemically synthesized
ctaaaggagctattatgatt

SEQ ID NO: 505067 - DNA, 20 bp, Artificial Sequence
  chemically synthesized
tccctctgaaatacacctga

SEQ ID NO: 505068 - DNA, 20 bp, Artificial Sequence
  chemically synthesized
aacggaacaaatagataagt

SEQ ID NO: 505069 - DNA, 20 bp, Artificial Sequence
  chemically synthesized
gctcaagtttgggccataac

SEQ ID NO: 505070 - DNA, 20 bp, Artificial Sequence
  chemically synthesized
tatctttactggtagaacaa

SEQ ID NO: 505071 - DNA, 20 bp, Artificial Sequence
  chemically synthesized
attaacacagtcaaccaaac

SEQ ID NO: 505072 - DNA, 20 bp, Artificial Sequence
  chemically synthesized
accagggaacactggggggt

SEQ ID NO: 505073 - DNA, 20 bp, Artificial Sequence
  chemically synthesized
gcagataccagggaacactg

SEQ ID NO: 505074 - DNA, 20 bp, Artificial Sequence
  chemically synthesized
aagttagcattttccttcag

SEQ ID NO: 505075 - DNA, 20 bp, Artificial Sequence
  chemically synthesized
cttaattttgcttttctaaa

SEQ ID NO: 505076 - DNA, 20 bp, Artificial Sequence
  chemically synthesized
taaatgatcgtgtgactagt

SEQ ID NO: 505077 - DNA, 20 bp, Artificial Sequence
  chemically synthesized
ttggtaagtaaaactacatg

SEQ ID NO: 505078 - DNA, 20 bp, Artificial Sequence
  chemically synthesized
tttaaacatttagaaattac

SEQ ID NO: 505079 - DNA, 20 bp, Artificial Sequence
  chemically synthesized
atatatcaagcttacctaca

SEQ ID NO: 505080 - DNA, 20 bp, Artificial Sequence
  chemically synthesized
ggaacttacataacaactag

SEQ ID NO: 505081 - DNA, 20 bp, Artificial Sequence
  chemically synthesized
atcacataattttatttaac

SEQ ID NO: 505082 - DNA, 20 bp, Artificial Sequence
  chemically synthesized
acaaatataacaggtgagac

SEQ ID NO: 505083 - DNA, 20 bp, Artificial Sequence
  chemically synthesized
caattcattttcttcttcta

SEQ ID NO: 505084 - DNA, 20 bp, Artificial Sequence
  chemically synthesized
ggactcattagaagaagaaa

SEQ ID NO: 505085 - DNA, 20 bp, Artificial Sequence
  chemically synthesized
ctaggaagaccactgaactt

SEQ ID NO: 505086 - DNA, 20 bp, Artificial Sequence
  chemically synthesized
ggcaaaaaataacttataca

SEQ ID NO: 505087 - DNA, 20 bp, Artificial Sequence
  chemically synthesized
ttgtgcatgtcagctttttt

SEQ ID NO: 505088 - DNA, 20 bp, Artificial Sequence
  chemically synthesized
gataaaattttacgaaaatc

SEQ ID NO: 505089 - DNA, 20 bp, Artificial Sequence
  chemically synthesized
tacacataacttttgaggca

SEQ ID NO: 505090 - DNA, 20 bp, Artificial Sequence
  chemically synthesized
agtttttgtctttctttttc

SEQ ID NO: 505091 - DNA, 20 bp, Artificial Sequence
  chemically synthesized
ttacttttaagtaacttttt

SEQ ID NO: 505092 - DNA, 20 bp, Artificial Sequence
  chemically synthesized
atttaaaaaagaagtctctt

SEQ ID NO: 505093 - DNA, 20 bp, Artificial Sequence
  chemically synthesized
catatatattattacaaaac

SEQ ID NO: 505094 - DNA, 20 bp, Artificial Sequence
  chemically synthesized
ttccaaacactaaaattata

SEQ ID NO: 505095 - DNA, 20 bp, Artificial Sequence
  chemically synthesized
accttattttcttaaattat

SEQ ID NO: 505096 - DNA, 20 bp, Artificial Sequence
  chemically synthesized
aaattttaatgcaaatctgc

SEQ ID NO: 505097 - DNA, 20 bp, Artificial Sequence
  chemically synthesized
tggaagaaaatgggatgtgg

SEQ ID NO: 505098 - DNA, 20 bp, Artificial Sequence
  chemically synthesized
ttgagttcattggaagaaaa

SEQ ID NO: 505099 - DNA, 20 bp, Artificial Sequence
  chemically synthesized
ttcttccaatgaactcaaag

SEQ ID NO: 505100 - DNA, 20 bp, Artificial Sequence
  chemically synthesized
ttattaggagaaattcaact

SEQ ID NO: 505101 - DNA, 20 bp, Artificial Sequence
  chemically synthesized
aatttccttagcattaaaaa

SEQ ID NO: 505102 - DNA, 20 bp, Artificial Sequence
  chemically synthesized
cataggttcatatttatcag

SEQ ID NO: 505103 - DNA, 20 bp, Artificial Sequence
  chemically synthesized
ttgatttagataatcttctt

SEQ ID NO: 505104 - DNA, 20 bp, Artificial Sequence
  chemically synthesized
agatggtgaatggtaattac

SEQ ID NO: 505105 - DNA, 20 bp, Artificial Sequence
  chemically synthesized
aggccctggtggaacagatg

SEQ ID NO: 505106 - DNA, 20 bp, Artificial Sequence
  chemically synthesized
cctgcagcatgagagcaaag

SEQ ID NO: 505107 - DNA, 20 bp, Artificial Sequence
  chemically synthesized
gtagattcacagtccttgta

SEQ ID NO: 505108 - DNA, 20 bp, Artificial Sequence
  chemically synthesized
agtaattcaatacaaggact

SEQ ID NO: 505109 - DNA, 20 bp, Artificial Sequence
  chemically synthesized
agattcacgtgataagctga

SEQ ID NO: 505110 - DNA, 20 bp, Artificial Sequence
  chemically synthesized
tcactctgtcagcttatcac

SEQ ID NO: 505111 - DNA, 20 bp, Artificial Sequence
  chemically synthesized
aactataatgtaaaaaaaag

SEQ ID NO: 505112 - DNA, 20 bp, Artificial Sequence
  chemically synthesized
acactttatctttcattgtt

SEQ ID NO: 505113 - DNA, 20 bp, Artificial Sequence
  chemically synthesized
gcggtattaaaaatcaaatt

SEQ ID NO: 505114 - DNA, 20 bp, Artificial Sequence
  chemically synthesized
ttttccatcttatatacata

SEQ ID NO: 505115 - DNA, 20 bp, Artificial Sequence
  chemically synthesized
atcttgtcttccttggaaat

SEQ ID NO: 505116 - DNA, 20 bp, Artificial Sequence
  chemically synthesized
tatttccaaggaagacaaga

SEQ ID NO: 505117 - DNA, 20 bp, Artificial Sequence
  chemically synthesized
attgagtttcaaaaaacttt

SEQ ID NO: 505118 - DNA, 20 bp, Artificial Sequence
  chemically synthesized
gtaactcttaagggaaataa

SEQ ID NO: 505119 - DNA, 20 bp, Artificial Sequence
  chemically synthesized
tgaattcctttatttccctt

SEQ ID NO: 505120 - DNA, 20 bp, Artificial Sequence
  chemically synthesized
ttatttcagttaacaatagc

SEQ ID NO: 505121 - DNA, 20 bp, Artificial Sequence
  chemically synthesized
atagccagaatttcatacta

SEQ ID NO: 505122 - DNA, 20 bp, Artificial Sequence
  chemically synthesized
tttaaaatttatgtctccat

SEQ ID NO: 505123 - DNA, 20 bp, Artificial Sequence
  chemically synthesized
acataaattttaaactatga

SEQ ID NO: 505124 - DNA, 20 bp, Artificial Sequence
  chemically synthesized
tttaattgcgttatagttat

SEQ ID NO: 505125 - DNA, 20 bp, Artificial Sequence
  chemically synthesized
tattataacaaagatttctc

SEQ ID NO: 505126 - DNA, 20 bp, Artificial Sequence
  chemically synthesized
tcttaaaaaatagtctcatg

SEQ ID NO: 505127 - DNA, 20 bp, Artificial Sequence
  chemically synthesized
aaatatttttttaaatgcct

SEQ ID NO: 505128 - DNA, 20 bp, Artificial Sequence
  chemically synthesized
aatatttccaggtaaaatac

SEQ ID NO: 505129 - DNA, 20 bp, Artificial Sequence
  chemically synthesized
atggacagtctgcaccactg

SEQ ID NO: 505130 - DNA, 20 bp, Artificial Sequence
  chemically synthesized
tgttgagtataaatttgtgc

SEQ ID NO: 505131 - DNA, 20 bp, Artificial Sequence
  chemically synthesized
tgtggttattggctatcata

SEQ ID NO: 505132 - DNA, 20 bp, Artificial Sequence
  chemically synthesized
atgatagccaataaccacat

SEQ ID NO: 505133 - DNA, 20 bp, Artificial Sequence
  chemically synthesized
tgctgaccacctttcaagtg

SEQ ID NO: 505134 - DNA, 20 bp, Artificial Sequence
  chemically synthesized
tcagcatgacttgaaaataa

SEQ ID NO: 505135 - DNA, 20 bp, Artificial Sequence
  chemically synthesized
tcttaactatttgcttttaa

SEQ ID NO: 505136 - DNA, 20 bp, Artificial Sequence
  chemically synthesized
gcccaggccttctgagtagc

SEQ ID NO: 505137 - DNA, 20 bp, Artificial Sequence
  chemically synthesized
agtcttcctgcccaggcctt

SEQ ID NO: 505138 - DNA, 20 bp, Artificial Sequence
  chemically synthesized
caggaagactgcttcagtcc

SEQ ID NO: 505139 - DNA, 20 bp, Artificial Sequence
  chemically synthesized
gcctgtagtcccagctactc

SEQ ID NO: 505140 - DNA, 20 bp, Artificial Sequence
  chemically synthesized
agtccttctgcctcagattc

SEQ ID NO: 505141 - DNA, 20 bp, Artificial Sequence
  chemically synthesized
gactgcttgagcacagtagt

SEQ ID NO: 505142 - DNA, 20 bp, Artificial Sequence
  chemically synthesized
tttccctctgtcgcccaggc

SEQ ID NO: 505143 - DNA, 20 bp, Artificial Sequence
  chemically synthesized
gatattgccatattatatga

SEQ ID NO: 505144 - DNA, 20 bp, Artificial Sequence
  chemically synthesized
tttcagatacataaaaatat

SEQ ID NO: 505145 - DNA, 20 bp, Artificial Sequence
  chemically synthesized
gtttttgtttctctttgaga

SEQ ID NO: 505146 - DNA, 20 bp, Artificial Sequence
  chemically synthesized
ctgcactccagcctgggcga

SEQ ID NO: 505147 - DNA, 20 bp, Artificial Sequence
  chemically synthesized
tctcactctgtcgcccaggc

SEQ ID NO: 505148 - DNA, 20 bp, Artificial Sequence
  chemically synthesized
ctcactgcaacctctgcctc

SEQ ID NO: 505149 - DNA, 20 bp, Artificial Sequence
  chemically synthesized
tactcgggaggctgaagcag

SEQ ID NO: 505150 - DNA, 20 bp, Artificial Sequence
  chemically synthesized
aactctcctgcttcagcctc

SEQ ID NO: 505151 - DNA, 20 bp, Artificial Sequence
  chemically synthesized
gcttcagcctcccgagtagc

SEQ ID NO: 505152 - DNA, 20 bp, Artificial Sequence
  chemically synthesized
ttttgtatttttagtagaga

SEQ ID NO: 505153 - DNA, 20 bp, Artificial Sequence
  chemically synthesized
gctgggcggatgatgaggtc

SEQ ID NO: 505154 - DNA, 20 bp, Artificial Sequence
  chemically synthesized
ccaccccagcactgagctgg

SEQ ID NO: 505155 - DNA, 20 bp, Artificial Sequence
  chemically synthesized
tcatccgcccagctcagtgc

SEQ ID NO: 505156 - DNA, 20 bp, Artificial Sequence
  chemically synthesized
tcagtgctggggtggggcgg

SEQ ID NO: 505157 - DNA, 20 bp, Artificial Sequence
  chemically synthesized
tgtgagccaccgtgcctggc

SEQ ID NO: 505158 - DNA, 20 bp, Artificial Sequence
  chemically synthesized
tttcttaaaaatttatttta

SEQ ID NO: 505159 - DNA, 20 bp, Artificial Sequence
  chemically synthesized
taaaactgcagtaatcaaga

SEQ ID NO: 505160 - DNA, 20 bp, Artificial Sequence
  chemically synthesized
agacaggtaaatcaatggaa

SEQ ID NO: 505161 - DNA, 20 bp, Artificial Sequence
  chemically synthesized
aatcaattgattatatttat

SEQ ID NO: 505162 - DNA, 20 bp, Artificial Sequence
  chemically synthesized
aattgtaattaaaacaaaag

SEQ ID NO: 505163 - DNA, 20 bp, Artificial Sequence
  chemically synthesized
taacatgaaagtaaataaat

SEQ ID NO: 505164 - DNA, 20 bp, Artificial Sequence
  chemically synthesized
atttactttcatgttattca

SEQ ID NO: 505165 - DNA, 20 bp, Artificial Sequence
  chemically synthesized
cttccaatgaagttgatcca

SEQ ID NO: 505166 - DNA, 20 bp, Artificial Sequence
  chemically synthesized
gtgaaatatctgacattatt

SEQ ID NO: 505167 - DNA, 20 bp, Artificial Sequence
  chemically synthesized
ttcaatgttgaaattttaaa

SEQ ID NO: 505168 - DNA, 20 bp, Artificial Sequence
  chemically synthesized
ttcactttaaaatttcaaca

SEQ ID NO: 505169 - DNA, 20 bp, Artificial Sequence
  chemically synthesized
tgtacaaatgataacatggg

SEQ ID NO: 505170 - DNA, 20 bp, Artificial Sequence
  chemically synthesized
gcgttggccccccaaagtgc

SEQ ID NO: 505171 - DNA, 20 bp, Artificial Sequence
  chemically synthesized
cagcactttggggggccaac

SEQ ID NO: 505172 - DNA, 20 bp, Artificial Sequence
  chemically synthesized
actttggggggccaacgcgg

SEQ ID NO: 505173 - DNA, 20 bp, Artificial Sequence
  chemically synthesized
cgggtggatcacctgaggtc

SEQ ID NO: 505174 - DNA, 20 bp, Artificial Sequence
  chemically synthesized
gtttgtatttttagtagaga

SEQ ID NO: 505175 - DNA, 20 bp, Artificial Sequence
  chemically synthesized
gcctcagcctccagagtagc

SEQ ID NO: 505176 - DNA, 20 bp, Artificial Sequence
  chemically synthesized
gattttcctgcctcagcctc

SEQ ID NO: 505177 - DNA, 20 bp, Artificial Sequence
  chemically synthesized
acctctgcctcccgggttca

SEQ ID NO: 505178 - DNA, 20 bp, Artificial Sequence
  chemically synthesized
ctcactgcaacctctgcctc

SEQ ID NO: 505179 - DNA, 20 bp, Artificial Sequence
  chemically synthesized
tcacaccattgcactccagc

SEQ ID NO: 505180 - DNA, 20 bp, Artificial Sequence
  chemically synthesized
tcttactctgtcacccaggc

SEQ ID NO: 505181 - DNA, 20 bp, Artificial Sequence
  chemically synthesized
ttgcactccagcctgggtga

SEQ ID NO: 505182 - DNA, 20 bp, Artificial Sequence
  chemically synthesized
ttatttatttatttttgaga

SEQ ID NO: 505183 - DNA, 20 bp, Artificial Sequence
  chemically synthesized
tggttgaaaaccatgttttc

SEQ ID NO: 505184 - DNA, 20 bp, Artificial Sequence
  chemically synthesized
ccatgttttcttggatacac

SEQ ID NO: 505185 - DNA, 20 bp, Artificial Sequence
  chemically synthesized
caagaaacactgcggactac

SEQ ID NO: 505186 - DNA, 20 bp, Artificial Sequence
  chemically synthesized
gcggactactagagtgggga

SEQ ID NO: 505187 - DNA, 20 bp, Artificial Sequence
  chemically synthesized
aaggtccaaaatagtagcta

SEQ ID NO: 505188 - DNA, 20 bp, Artificial Sequence
  chemically synthesized
acaaacctgcacatttactc

SEQ ID NO: 505189 - DNA, 20 bp, Artificial Sequence
  chemically synthesized
taatttcaacttttggattc

SEQ ID NO: 505190 - DNA, 20 bp, Artificial Sequence
  chemically synthesized
attttttataatttcaactt

SEQ ID NO: 505191 - DNA, 20 bp, Artificial Sequence
  chemically synthesized
caaaaataaatacatttcca

SEQ ID NO: 505192 - DNA, 20 bp, Artificial Sequence
  chemically synthesized
attcattattaattaacttt

SEQ ID NO: 505193 - DNA, 20 bp, Artificial Sequence
  chemically synthesized
attcataaagttaattaata

SEQ ID NO: 505194 - DNA, 20 bp, Artificial Sequence
  chemically synthesized
aatgaatcaatcacagactc

SEQ ID NO: 505195 - DNA, 20 bp, Artificial Sequence
  chemically synthesized
tatagttttacattttactc

SEQ ID NO: 505196 - DNA, 20 bp, Artificial Sequence
  chemically synthesized
tttctccactgctatctgct

SEQ ID NO: 505197 - DNA, 20 bp, Artificial Sequence
  chemically synthesized
tggagaaaacagaggtgact

SEQ ID NO: 505198 - DNA, 20 bp, Artificial Sequence
  chemically synthesized
ttttttagatacaccaccaa

SEQ ID NO: 505199 - DNA, 20 bp, Artificial Sequence
  chemically synthesized
aagggatgatccatgaaaga

SEQ ID NO: 505200 - DNA, 20 bp, Artificial Sequence
  chemically synthesized
acttattaattctttctttc

SEQ ID NO: 505201 - DNA, 20 bp, Artificial Sequence
  chemically synthesized
tgaaagaaagaattaataag

SEQ ID NO: 505202 - DNA, 20 bp, Artificial Sequence
  chemically synthesized
tacgaaagacatatctggta

SEQ ID NO: 505203 - DNA, 20 bp, Artificial Sequence
  chemically synthesized
gttctttgtgtatttcggat

SEQ ID NO: 505204 - DNA, 20 bp, Artificial Sequence
  chemically synthesized
ttaagagttctttgtgtatt

SEQ ID NO: 505205 - DNA, 20 bp, Artificial Sequence
  chemically synthesized
tgtttttgttactgagtttt

SEQ ID NO: 505206 - DNA, 20 bp, Artificial Sequence
  chemically synthesized
tagtttgtttgtttttgtta

SEQ ID NO: 505207 - DNA, 20 bp, Artificial Sequence
  chemically synthesized
cctttggtgaggtgtctgtt

SEQ ID NO: 505208 - DNA, 20 bp, Artificial Sequence
  chemically synthesized
tttcacatcatatgttacca

SEQ ID NO: 505209 - DNA, 20 bp, Artificial Sequence
  chemically synthesized
agataccactacacacctat

SEQ ID NO: 505210 - DNA, 20 bp, Artificial Sequence
  chemically synthesized
ttttggttttgtcagtgttc

SEQ ID NO: 505211 - DNA, 20 bp, Artificial Sequence
  chemically synthesized
cattgccaccagaaatgaat

SEQ ID NO: 505212 - DNA, 20 bp, Artificial Sequence
  chemically synthesized
attttgcattgccaccagaa

SEQ ID NO: 505213 - DNA, 20 bp, Artificial Sequence
  chemically synthesized
atgattgctggatcatatag

SEQ ID NO: 505214 - DNA, 20 bp, Artificial Sequence
  chemically synthesized
aatgcctaagtgcatgattg

SEQ ID NO: 505215 - DNA, 20 bp, Artificial Sequence
  chemically synthesized
gcacttaggcatttacacaa

SEQ ID NO: 505216 - DNA, 20 bp, Artificial Sequence
  chemically synthesized
cagcattcatgtgcaggaat

SEQ ID NO: 505217 - DNA, 20 bp, Artificial Sequence
  chemically synthesized
gtccactcaaattcctgcac

SEQ ID NO: 505218 - DNA, 20 bp, Artificial Sequence
  chemically synthesized
ctgctgcagcattcatgtgc

SEQ ID NO: 505219 - DNA, 20 bp, Artificial Sequence
  chemically synthesized
atcaagatgttcttcagtag

SEQ ID NO: 505220 - DNA, 20 bp, Artificial Sequence
  chemically synthesized
agatgttcttcagtagatga

SEQ ID NO: 505221 - DNA, 20 bp, Artificial Sequence
  chemically synthesized
actgtgagacatccagacaa

SEQ ID NO: 505222 - DNA, 20 bp, Artificial Sequence
  chemically synthesized
actgaataatattccattgt

SEQ ID NO: 505223 - DNA, 20 bp, Artificial Sequence
  chemically synthesized
tgatagctcatttttaagca

SEQ ID NO: 505224 - DNA, 20 bp, Artificial Sequence
  chemically synthesized
aaaggctatatattttaccg

SEQ ID NO: 505225 - DNA, 20 bp, Artificial Sequence
  chemically synthesized
atatattcggaattggaatc

SEQ ID NO: 505226 - DNA, 20 bp, Artificial Sequence
  chemically synthesized
tttcaccctagattccaatt

SEQ ID NO: 505227 - DNA, 20 bp, Artificial Sequence
  chemically synthesized
gactatcatatattcggaat

SEQ ID NO: 505228 - DNA, 20 bp, Artificial Sequence
  chemically synthesized
tttccagactatcatatatt

SEQ ID NO: 505229 - DNA, 20 bp, Artificial Sequence
  chemically synthesized
agatgaacgggaaaagtatt

SEQ ID NO: 505230 - DNA, 20 bp, Artificial Sequence
  chemically synthesized
caatgacatgtatttatctt

SEQ ID NO: 505231 - DNA, 20 bp, Artificial Sequence
  chemically synthesized
tgtaaatttgtttaaactca

SEQ ID NO: 505232 - DNA, 20 bp, Artificial Sequence
  chemically synthesized
ctattggtgccacacattct

SEQ ID NO: 505233 - DNA, 20 bp, Artificial Sequence
  chemically synthesized
ccactgtcaacatttcccac

SEQ ID NO: 505234 - DNA, 20 bp, Artificial Sequence
  chemically synthesized
aggctatgtatctgtgggag

SEQ ID NO: 505235 - DNA, 20 bp, Artificial Sequence
  chemically synthesized
acctataattactctaaaaa

SEQ ID NO: 505236 - DNA, 20 bp, Artificial Sequence
  chemically synthesized
attttaatagactccatttt

SEQ ID NO: 505237 - DNA, 20 bp, Artificial Sequence
  chemically synthesized
aaatcacaaaaaaaggtttc

SEQ ID NO: 505238 - DNA, 20 bp, Artificial Sequence
  chemically synthesized
aaaaaaaggtttcatgaatt

SEQ ID NO: 505239 - DNA, 20 bp, Artificial Sequence
  chemically synthesized
ggtttcatgaattaggaata

SEQ ID NO: 505240 - DNA, 20 bp, Artificial Sequence
  chemically synthesized
ggaatactggattcaatatc

SEQ ID NO: 505241 - DNA, 20 bp, Artificial Sequence
  chemically synthesized
agcattttgtactcttgata

SEQ ID NO: 505242 - DNA, 20 bp, Artificial Sequence
  chemically synthesized
aaaaaaaagccaatcattca

SEQ ID NO: 505243 - DNA, 20 bp, Artificial Sequence
  chemically synthesized
ttcctgatggagtttattct

SEQ ID NO: 505244 - DNA, 20 bp, Artificial Sequence
  chemically synthesized
ttcacagaataaactccatc

SEQ ID NO: 505245 - DNA, 20 bp, Artificial Sequence
  chemically synthesized
tatattacagctattcctga

SEQ ID NO: 505246 - DNA, 20 bp, Artificial Sequence
  chemically synthesized
ataaaatactaattaaaact

SEQ ID NO: 505247 - DNA, 20 bp, Artificial Sequence
  chemically synthesized
attaaaactgagaataaatt

SEQ ID NO: 505248 - DNA, 20 bp, Artificial Sequence
  chemically synthesized
tcttaactaattagacaaaa

SEQ ID NO: 505249 - DNA, 20 bp, Artificial Sequence
  chemically synthesized
taaaaagtgtctgtcacttt

SEQ ID NO: 505250 - DNA, 20 bp, Artificial Sequence
  chemically synthesized
ggtgctttgaaattttcaag

SEQ ID NO: 505251 - DNA, 20 bp, Artificial Sequence
  chemically synthesized
aaatcacaaaataccacaaa

SEQ ID NO: 505252 - DNA, 20 bp, Artificial Sequence
  chemically synthesized
attttgtgattttatgttcc

SEQ ID NO: 505253 - DNA, 20 bp, Artificial Sequence
  chemically synthesized
gttttacctgctaattggaa

SEQ ID NO: 505254 - DNA, 20 bp, Artificial Sequence
  chemically synthesized
ccaattagcaggtaaaactt

SEQ ID NO: 505255 - DNA, 20 bp, Artificial Sequence
  chemically synthesized
tcaatactgtctttgtgaaa

SEQ ID NO: 505256 - DNA, 20 bp, Artificial Sequence
  chemically synthesized
tcagtttcacaaagacagta

SEQ ID NO: 505257 - DNA, 20 bp, Artificial Sequence
  chemically synthesized
ttccaggaacgtgcacaatc

SEQ ID NO: 505258 - DNA, 20 bp, Artificial Sequence
  chemically synthesized
aactgaaaagtccatgaaaa

SEQ ID NO: 505259 - DNA, 20 bp, Artificial Sequence
  chemically synthesized
agaaatattggagcttcatc

SEQ ID NO: 505260 - DNA, 20 bp, Artificial Sequence
  chemically synthesized
ataacatttaccttttaatg

SEQ ID NO: 505261 - DNA, 20 bp, Artificial Sequence
  chemically synthesized
tttttctcctctaagatgct

SEQ ID NO: 505262 - DNA, 20 bp, Artificial Sequence
  chemically synthesized
gtaaatatcaagaaagacag

SEQ ID NO: 505263 - DNA, 20 bp, Artificial Sequence
  chemically synthesized
tcaagaaagacaggaggatt

SEQ ID NO: 505264 - DNA, 20 bp, Artificial Sequence
  chemically synthesized
acaggaggatttggggtgtc

SEQ ID NO: 505265 - DNA, 20 bp, Artificial Sequence
  chemically synthesized
tttcatctgtatattgtttt

SEQ ID NO: 505266 - DNA, 20 bp, Artificial Sequence
  chemically synthesized
aaaggaacaatgacaacaag

SEQ ID NO: 505267 - DNA, 20 bp, Artificial Sequence
  chemically synthesized
gctgagtaaagtgatgttct

SEQ ID NO: 505268 - DNA, 20 bp, Artificial Sequence
  chemically synthesized
gatgttctttgagttacttt

SEQ ID NO: 505269 - DNA, 20 bp, Artificial Sequence
  chemically synthesized
gagttatcttctcctatcag

SEQ ID NO: 505270 - DNA, 20 bp, Artificial Sequence
  chemically synthesized
ttgtgaaatgatataaaaag

SEQ ID NO: 505271 - DNA, 20 bp, Artificial Sequence
  chemically synthesized
tctctttattctaagcttac

SEQ ID NO: 505272 - DNA, 20 bp, Artificial Sequence
  chemically synthesized
ttaattgattctagtaagct

SEQ ID NO: 505273 - DNA, 20 bp, Artificial Sequence
  chemically synthesized
acagagaacaaaacttatat

SEQ ID NO: 505274 - DNA, 20 bp, Artificial Sequence
  chemically synthesized
aacttatatttgaatatctc

SEQ ID NO: 505275 - DNA, 20 bp, Artificial Sequence
  chemically synthesized
gttactgagactatttatat

SEQ ID NO: 505276 - DNA, 20 bp, Artificial Sequence
  chemically synthesized
aactataatttggtagtata

SEQ ID NO: 505277 - DNA, 20 bp, Artificial Sequence
  chemically synthesized
agaagagcagggttctaata

SEQ ID NO: 505278 - DNA, 20 bp, Artificial Sequence
  chemically synthesized
tgaaattataagtagaagag

SEQ ID NO: 505279 - DNA, 20 bp, Artificial Sequence
  chemically synthesized
agacatgctctgctgttgct

SEQ ID NO: 505280 - DNA, 20 bp, Artificial Sequence
  chemically synthesized
ctgttgctaggggtatttca

SEQ ID NO: 505281 - DNA, 20 bp, Artificial Sequence
  chemically synthesized
tctgatacgctcacaccttt

SEQ ID NO: 505282 - DNA, 20 bp, Artificial Sequence
  chemically synthesized
tcaaaaaggtgtgagcgtat

SEQ ID NO: 505283 - DNA, 20 bp, Artificial Sequence
  chemically synthesized
gagcaaacagagcttatagt

SEQ ID NO: 505284 - DNA, 20 bp, Artificial Sequence
  chemically synthesized
gcttatagtttggatgtatt

SEQ ID NO: 505285 - DNA, 20 bp, Artificial Sequence
  chemically synthesized
gtgatatcttgttggccctg

SEQ ID NO: 505286 - DNA, 20 bp, Artificial Sequence
  chemically synthesized
agggccaacaagatatcaca

SEQ ID NO: 505287 - DNA, 20 bp, Artificial Sequence
  chemically synthesized
acaagatatcacaaggaatg

SEQ ID NO: 505288 - DNA, 20 bp, Artificial Sequence
  chemically synthesized
acaaggaatgccgggtcact

SEQ ID NO: 505289 - DNA, 20 bp, Artificial Sequence
  chemically synthesized
atagactgtcagagaccatt

SEQ ID NO: 505290 - DNA, 20 bp, Artificial Sequence
  chemically synthesized
cagtttatttgagctgtata

SEQ ID NO: 505291 - DNA, 20 bp, Artificial Sequence
  chemically synthesized
ctgtatacagctcaaataaa

SEQ ID NO: 505292 - DNA, 20 bp, Artificial Sequence
  chemically synthesized
taccattgactgcttctttc

SEQ ID NO: 505293 - DNA, 20 bp, Artificial Sequence
  chemically synthesized
tgtcaatgttcagacgatat

SEQ ID NO: 505294 - DNA, 20 bp, Artificial Sequence
  chemically synthesized
aggaacattgcaaaatgaag

SEQ ID NO: 505295 - DNA, 20 bp, Artificial Sequence
  chemically synthesized
atgcatacaagtatgccttg

SEQ ID NO: 505296 - DNA, 20 bp, Artificial Sequence
  chemically synthesized
acaagtatgccttgaagagt

SEQ ID NO: 505297 - DNA, 20 bp, Artificial Sequence
  chemically synthesized
actgataacagcagagcaaa

SEQ ID NO: 505298 - DNA, 20 bp, Artificial Sequence
  chemically synthesized
ctaccatgtgggacttctga

SEQ ID NO: 505299 - DNA, 20 bp, Artificial Sequence
  chemically synthesized
ttatagtaaaatggggagct

SEQ ID NO: 505300 - DNA, 20 bp, Artificial Sequence
  chemically synthesized
tgagcacatatttcagtttg

SEQ ID NO: 505301 - DNA, 20 bp, Artificial Sequence
  chemically synthesized
ttattgaagttacctttaag

SEQ ID NO: 505302 - DNA, 20 bp, Artificial Sequence
  chemically synthesized
ttttttttttctttttgaga

SEQ ID NO: 505303 - DNA, 20 bp, Artificial Sequence
  chemically synthesized
tctcgctctgtcgcccaggc

SEQ ID NO: 505304 - DNA, 20 bp, Artificial Sequence
  chemically synthesized
ctcactgcaagctccgcctc

SEQ ID NO: 505305 - DNA, 20 bp, Artificial Sequence
  chemically synthesized
tactcaggaggctgaggaag

SEQ ID NO: 505306 - DNA, 20 bp, Artificial Sequence
  chemically synthesized
cattctccttcctcagcctc

SEQ ID NO: 505307 - DNA, 20 bp, Artificial Sequence
  chemically synthesized
actttgggaggtcgaggcgg

SEQ ID NO: 505308 - DNA, 20 bp, Artificial Sequence
  chemically synthesized
cagcactttgggaggtcgag

SEQ ID NO: 505309 - DNA, 20 bp, Artificial Sequence
  chemically synthesized
tttttgacacaagagatgat

SEQ ID NO: 505310 - DNA, 20 bp, Artificial Sequence
  chemically synthesized
ctgaaaatcgccatttctcc

SEQ ID NO: 505311 - DNA, 20 bp, Artificial Sequence
  chemically synthesized
tttcatttgaggacgaacgt

SEQ ID NO: 505312 - DNA, 20 bp, Artificial Sequence
  chemically synthesized
aacttctgttttcaggtagg

SEQ ID NO: 505313 - DNA, 20 bp, Artificial Sequence
  chemically synthesized
gctttttaatgtatatttct

SEQ ID NO: 505314 - DNA, 20 bp, Artificial Sequence
  chemically synthesized
gttttgatgggactgagtaa

SEQ ID NO: 505315 - DNA, 20 bp, Artificial Sequence
  chemically synthesized
taagagcagttttgatggga

SEQ ID NO: 505316 - DNA, 20 bp, Artificial Sequence
  chemically synthesized
tgagaactgaacatcagtca

SEQ ID NO: 505317 - DNA, 20 bp, Artificial Sequence
  chemically synthesized
tatcaccatgatttgattga

SEQ ID NO: 505318 - DNA, 20 bp, Artificial Sequence
  chemically synthesized
aaatacttctaagaagaaaa

SEQ ID NO: 505319 - DNA, 20 bp, Artificial Sequence
  chemically synthesized
atgtccctgagctcgcactt

SEQ ID NO: 505320 - DNA, 20 bp, Artificial Sequence
  chemically synthesized
tcctttgtttaggccaaaaa

SEQ ID NO: 505321 - DNA, 20 bp, Artificial Sequence
  chemically synthesized
ttgagagagagaggggagtg

SEQ ID NO: 505322 - DNA, 20 bp, Artificial Sequence
  chemically synthesized
gtgaggcttgagagagagag

SEQ ID NO: 505323 - DNA, 20 bp, Artificial Sequence
  chemically synthesized
caacaggactttgtgatgga

SEQ ID NO: 505324 - DNA, 20 bp, Artificial Sequence
  chemically synthesized
agagccaacaggactttgtg

SEQ ID NO: 505325 - DNA, 20 bp, Artificial Sequence
  chemically synthesized
cctcaaaacatagccagaaa

SEQ ID NO: 505326 - DNA, 20 bp, Artificial Sequence
  chemically synthesized
ttcatacccctcagagatga

SEQ ID NO: 505327 - DNA, 20 bp, Artificial Sequence
  chemically synthesized
aaagtaccccatcatctctg

SEQ ID NO: 505328 - DNA, 20 bp, Artificial Sequence
  chemically synthesized
ccccatcatctctgaggggt

SEQ ID NO: 505329 - DNA, 20 bp, Artificial Sequence
  chemically synthesized
ggggtatgaatgtttcaaaa

SEQ ID NO: 505330 - DNA, 20 bp, Artificial Sequence
  chemically synthesized
taatatataatcagagaaca

SEQ ID NO: 505331 - DNA, 20 bp, Artificial Sequence
  chemically synthesized
aacacagcagacagagacaa

SEQ ID NO: 505332 - DNA, 20 bp, Artificial Sequence
  chemically synthesized
tcagctgtcagcgagttgag

SEQ ID NO: 505333 - DNA, 20 bp, Artificial Sequence
  chemically synthesized
tcagctcaactcgctgacag

SEQ ID NO: 505334 - DNA, 20 bp, Artificial Sequence
  chemically synthesized
gagcttttattcagctgtca

SEQ ID NO: 505335 - DNA, 20 bp, Artificial Sequence
  chemically synthesized
aattaacttccttaaccttt

SEQ ID NO: 505336 - DNA, 20 bp, Artificial Sequence
  chemically synthesized
atcacgatgtttagcagcag

SEQ ID NO: 505337 - DNA, 20 bp, Artificial Sequence
  chemically synthesized
ggtatgcatgtgcttgtaga

SEQ ID NO: 505338 - DNA, 20 bp, Artificial Sequence
  chemically synthesized
caaggagcagaataaaatga

SEQ ID NO: 505339 - DNA, 20 bp, Artificial Sequence
  chemically synthesized
tagtgataagttccaaggag

SEQ ID NO: 505340 - DNA, 20 bp, Artificial Sequence
  chemically synthesized
agactaatatgtaaagcatg

SEQ ID NO: 505341 - DNA, 20 bp, Artificial Sequence
  chemically synthesized
ttcatttccatctttcccac

SEQ ID NO: 505342 - DNA, 20 bp, Artificial Sequence
  chemically synthesized
gagtagagaaggatatagat

SEQ ID NO: 505343 - DNA, 20 bp, Artificial Sequence
  chemically synthesized
agacttgggatagagtagag

SEQ ID NO: 505344 - DNA, 20 bp, Artificial Sequence
  chemically synthesized
actttcatggagacttggga

SEQ ID NO: 505345 - DNA, 20 bp, Artificial Sequence
  chemically synthesized
cagccactttcatggagact

SEQ ID NO: 505346 - DNA, 20 bp, Artificial Sequence
  chemically synthesized
ttgcactttaagagagcatt

SEQ ID NO: 505347 - DNA, 20 bp, Artificial Sequence
  chemically synthesized
taaagctattagagttcgtt

SEQ ID NO: 505348 - DNA, 20 bp, Artificial Sequence
  chemically synthesized
gccactttatataaagctat

SEQ ID NO: 505349 - DNA, 20 bp, Artificial Sequence
  chemically synthesized
tgctgcaagctcagtaaagg

SEQ ID NO: 505350 - DNA, 20 bp, Artificial Sequence
  chemically synthesized
gcaagctcagtaaaggaagg

SEQ ID NO: 505351 - DNA, 20 bp, Artificial Sequence
  chemically synthesized
cctaactaatatgcagtttc

SEQ ID NO: 505352 - DNA, 20 bp, Artificial Sequence
  chemically synthesized
tagaaactgcatattagtta

SEQ ID NO: 505353 - DNA, 20 bp, Artificial Sequence
  chemically synthesized
ggacttgagctgaagaaaag

SEQ ID NO: 505354 - DNA, 20 bp, Artificial Sequence
  chemically synthesized
caatacctaagtagaaaaga

SEQ ID NO: 505355 - DNA, 20 bp, Artificial Sequence
  chemically synthesized
aagagtaccatatacaatcc

SEQ ID NO: 505356 - DNA, 20 bp, Artificial Sequence
  chemically synthesized
attctaccaagttttgactc

SEQ ID NO: 505357 - DNA, 20 bp, Artificial Sequence
  chemically synthesized
atccatgagtcaaaacttgg

SEQ ID NO: 505358 - DNA, 20 bp, Artificial Sequence
  chemically synthesized
tggtcttgaaaacatgggaa

SEQ ID NO: 505359 - DNA, 20 bp, Artificial Sequence
  chemically synthesized
tttcccatgttttcaagacc

SEQ ID NO: 505360 - DNA, 20 bp, Artificial Sequence
  chemically synthesized
ttcaagaccaagggtatcat

SEQ ID NO: 505361 - DNA, 20 bp, Artificial Sequence
  chemically synthesized
gaaaatgaagactgtggttg

SEQ ID NO: 505362 - DNA, 20 bp, Artificial Sequence
  chemically synthesized
ttggagtaatattgaaatac

SEQ ID NO: 505363 - DNA, 20 bp, Artificial Sequence
  chemically synthesized
gaagtctgactgtaggtatt

SEQ ID NO: 505364 - DNA, 20 bp, Artificial Sequence
  chemically synthesized
gccttggcctcccaaagtgc

SEQ ID NO: 505365 - DNA, 20 bp, Artificial Sequence
  chemically synthesized
actttgggaggccaaggcag

SEQ ID NO: 505366 - DNA, 20 bp, Artificial Sequence
  chemically synthesized
acggggtttcaactgttggc

SEQ ID NO: 505367 - DNA, 20 bp, Artificial Sequence
  chemically synthesized
ttttgtatttttagtagaga

SEQ ID NO: 505368 - DNA, 20 bp, Artificial Sequence
  chemically synthesized
gattctcctgcctcagcctc

SEQ ID NO: 505369 - DNA, 20 bp, Artificial Sequence
  chemically synthesized
tactcgggaggctgaggcag

SEQ ID NO: 505370 - DNA, 20 bp, Artificial Sequence
  chemically synthesized
ctcactgcaacttctgtctc

SEQ ID NO: 505371 - DNA, 20 bp, Artificial Sequence
  chemically synthesized
ttgcgccactgcactccagc

SEQ ID NO: 505372 - DNA, 20 bp, Artificial Sequence
  chemically synthesized
cctcgctctgtcacccaggc

SEQ ID NO: 505373 - DNA, 20 bp, Artificial Sequence
  chemically synthesized
aattgtagtttttatcagta

SEQ ID NO: 505374 - DNA, 20 bp, Artificial Sequence
  chemically synthesized
aaaacacacatacagaaaag

SEQ ID NO: 505375 - DNA, 20 bp, Artificial Sequence
  chemically synthesized
atatacatttttaatcttga

SEQ ID NO: 505376 - DNA, 20 bp, Artificial Sequence
  chemically synthesized
taaattatgctattaacata

SEQ ID NO: 505377 - DNA, 20 bp, Artificial Sequence
  chemically synthesized
gatcatatattaagcatata

SEQ ID NO: 505378 - DNA, 20 bp, Artificial Sequence
  chemically synthesized
acatgtttagaagccactac

SEQ ID NO: 505379 - DNA, 20 bp, Artificial Sequence
  chemically synthesized
tgtactaaataatttagaat

SEQ ID NO: 505380 - DNA, 20 bp, Artificial Sequence
  chemically synthesized
attatgtgtactaaataatt

SEQ ID NO: 505381 - DNA, 20 bp, Artificial Sequence
  chemically synthesized
agtaaatcaatgtatcagaa

SEQ ID NO: 505382 - DNA, 20 bp, Artificial Sequence
  chemically synthesized
tataattcttcatgatctct

SEQ ID NO: 505383 - DNA, 20 bp, Artificial Sequence
  chemically synthesized
gaaaattcttagagatcatg

SEQ ID NO: 505384 - DNA, 20 bp, Artificial Sequence
  chemically synthesized
gaagaattataaatactaaa

SEQ ID NO: 505385 - DNA, 20 bp, Artificial Sequence
  chemically synthesized
ttttacttttcttcctttta

SEQ ID NO: 505386 - DNA, 20 bp, Artificial Sequence
  chemically synthesized
aagtaaaataatttgaagca

SEQ ID NO: 505387 - DNA, 20 bp, Artificial Sequence
  chemically synthesized
aggttttaatcaacttattg

SEQ ID NO: 505388 - DNA, 20 bp, Artificial Sequence
  chemically synthesized
taacattatgaaaataagtt

SEQ ID NO: 505389 - DNA, 20 bp, Artificial Sequence
  chemically synthesized
ttcttaattacttctaatgt

SEQ ID NO: 505390 - DNA, 20 bp, Artificial Sequence
  chemically synthesized
ctccgacattagaagtaatt

SEQ ID NO: 505391 - DNA, 20 bp, Artificial Sequence
  chemically synthesized
acttcattatagaatgttaa

SEQ ID NO: 505392 - DNA, 20 bp, Artificial Sequence
  chemically synthesized
caaagggtaaaacttcatta

SEQ ID NO: 505393 - DNA, 20 bp, Artificial Sequence
  chemically synthesized
gaagttttaccctttgactg

SEQ ID NO: 505394 - DNA, 20 bp, Artificial Sequence
  chemically synthesized
aataagttactcttcagtca

SEQ ID NO: 505395 - DNA, 20 bp, Artificial Sequence
  chemically synthesized
acttctgaataaacatttga

SEQ ID NO: 505396 - DNA, 20 bp, Artificial Sequence
  chemically synthesized
aacaacttctgaataaacat

SEQ ID NO: 505397 - DNA, 20 bp, Artificial Sequence
  chemically synthesized
tatgaaggatagaacaactt

SEQ ID NO: 505398 - DNA, 20 bp, Artificial Sequence
  chemically synthesized
taggatctattaccaatatg

SEQ ID NO: 505399 - DNA, 20 bp, Artificial Sequence
  chemically synthesized
ttctgcagttgcatttaaga

SEQ ID NO: 505400 - DNA, 20 bp, Artificial Sequence
  chemically synthesized
accaataaatgtttaactat

SEQ ID NO: 505401 - DNA, 20 bp, Artificial Sequence
  chemically synthesized
tgatttctagaaaccaacaa

SEQ ID NO: 505402 - DNA, 20 bp, Artificial Sequence
  chemically synthesized
gttccagtggtctttgtctg

SEQ ID NO: 505403 - DNA, 20 bp, Artificial Sequence
  chemically synthesized
ggaactatggggctgtctct

SEQ ID NO: 505404 - DNA, 20 bp, Artificial Sequence
  chemically synthesized
gaagtggggctttgttttga

SEQ ID NO: 505405 - DNA, 20 bp, Artificial Sequence
  chemically synthesized
gattggatgttgtaaggaag

SEQ ID NO: 505406 - DNA, 20 bp, Artificial Sequence
  chemically synthesized
ggaagtagggtaattctatg

SEQ ID NO: 505407 - DNA, 20 bp, Artificial Sequence
  chemically synthesized
aaattttaggacactcaaca

SEQ ID NO: 505408 - DNA, 20 bp, Artificial Sequence
  chemically synthesized
atttttatctagatggcagg

SEQ ID NO: 505409 - DNA, 20 bp, Artificial Sequence
  chemically synthesized
gtgtcacattaatgaagatg

SEQ ID NO: 505410 - DNA, 20 bp, Artificial Sequence
  chemically synthesized
catatcttaatacagtaaaa

SEQ ID NO: 505411 - DNA, 20 bp, Artificial Sequence
  chemically synthesized
agggacacgctatggttgtg

SEQ ID NO: 505412 - DNA, 20 bp, Artificial Sequence
  chemically synthesized
gttgaatataaataattgct

SEQ ID NO: 505413 - DNA, 20 bp, Artificial Sequence
  chemically synthesized
gccagtctgatgttctctgg

SEQ ID NO: 505414 - DNA, 20 bp, Artificial Sequence
  chemically synthesized
ggtgatgtggaaacttctaa

SEQ ID NO: 505415 - DNA, 20 bp, Artificial Sequence
  chemically synthesized
gtagcagggaagaccagcta

SEQ ID NO: 505416 - DNA, 20 bp, Artificial Sequence
  chemically synthesized
gccatgatattagctttaat

SEQ ID NO: 505417 - DNA, 20 bp, Artificial Sequence
  chemically synthesized
ttaatcagggttttggtgat

SEQ ID NO: 505418 - DNA, 20 bp, Artificial Sequence
  chemically synthesized
ttcaagagctgttaagggag

SEQ ID NO: 505419 - DNA, 20 bp, Artificial Sequence
  chemically synthesized
acctgtcaaagattggactt

SEQ ID NO: 505420 - DNA, 20 bp, Artificial Sequence
  chemically synthesized
tccagaaacctgaaagtgaa

SEQ ID NO: 505421 - DNA, 20 bp, Artificial Sequence
  chemically synthesized
cccagttcactttcaggttt

SEQ ID NO: 505422 - DNA, 20 bp, Artificial Sequence
  chemically synthesized
tttctggattaggctgtttg

SEQ ID NO: 505423 - DNA, 20 bp, Artificial Sequence
  chemically synthesized
gcagggtgaaaggaaggaga

SEQ ID NO: 505424 - DNA, 20 bp, Artificial Sequence
  chemically synthesized
aggcagtcagatatatcacc

SEQ ID NO: 505425 - DNA, 20 bp, Artificial Sequence
  chemically synthesized
ctcatctctttcttaaaacc

SEQ ID NO: 505426 - DNA, 20 bp, Artificial Sequence
  chemically synthesized
gctaaagatacatatgggag

SEQ ID NO: 505427 - DNA, 20 bp, Artificial Sequence
  chemically synthesized
catttgaaaatagacactat

SEQ ID NO: 505428 - DNA, 20 bp, Artificial Sequence
  chemically synthesized
aaaatagacactatttgaat

SEQ ID NO: 505429 - DNA, 20 bp, Artificial Sequence
  chemically synthesized
tagacactatttgaatggga

SEQ ID NO: 505430 - DNA, 20 bp, Artificial Sequence
  chemically synthesized
ctatttgaatgggaatgaat

SEQ ID NO: 505431 - DNA, 20 bp, Artificial Sequence
  chemically synthesized
agagtccttgtgtttcttct

SEQ ID NO: 505432 - DNA, 20 bp, Artificial Sequence
  chemically synthesized
gaagaaacacaaggactctg

SEQ ID NO: 505433 - DNA, 20 bp, Artificial Sequence
  chemically synthesized
tctttaatattgatattctt

SEQ ID NO: 505434 - DNA, 20 bp, Artificial Sequence
  chemically synthesized
atatcaatattaaagaaaaa

SEQ ID NO: 505435 - DNA, 20 bp, Artificial Sequence
  chemically synthesized
ctgaattggaacaaatggcc

SEQ ID NO: 505436 - DNA, 20 bp, Artificial Sequence
  chemically synthesized
acaaatggccaagaatgtga

SEQ ID NO: 505437 - DNA, 20 bp, Artificial Sequence
  chemically synthesized
ttctttcctcgcttggctta

SEQ ID NO: 505438 - DNA, 20 bp, Artificial Sequence
  chemically synthesized
tcccataagccaagcgagga

SEQ ID NO: 505439 - DNA, 20 bp, Artificial Sequence
  chemically synthesized
aataggttctagttctacag

SEQ ID NO: 505440 - DNA, 20 bp, Artificial Sequence
  chemically synthesized
gttctagttctacagaggga

SEQ ID NO: 505441 - DNA, 20 bp, Artificial Sequence
  chemically synthesized
cctctcctataaacatgcat

SEQ ID NO: 505442 - DNA, 20 bp, Artificial Sequence
  chemically synthesized
aaaagctaatgataaagacc

SEQ ID NO: 505443 - DNA, 20 bp, Artificial Sequence
  chemically synthesized
ggatgtagatttttgacaat

SEQ ID NO: 505444 - DNA, 20 bp, Artificial Sequence
  chemically synthesized
ttgacaatctggatatacag

SEQ ID NO: 505445 - DNA, 20 bp, Artificial Sequence
  chemically synthesized
cacctggttgaggctcatct

SEQ ID NO: 505446 - DNA, 20 bp, Artificial Sequence
  chemically synthesized
agatgagcctcaaccaggtg

SEQ ID NO: 505447 - DNA, 20 bp, Artificial Sequence
  chemically synthesized
gaaataatatttctcaaatt

SEQ ID NO: 505448 - DNA, 20 bp, Artificial Sequence
  chemically synthesized
aggagatgaaatcatttact

SEQ ID NO: 505449 - DNA, 20 bp, Artificial Sequence
  chemically synthesized
acaattatttcaagcttttg

SEQ ID NO: 505450 - DNA, 20 bp, Artificial Sequence
  chemically synthesized
aactaagttgaaaatatact

SEQ ID NO: 505451 - DNA, 20 bp, Artificial Sequence
  chemically synthesized
gcctcggcctcccaaagtgc

SEQ ID NO: 505452 - DNA, 20 bp, Artificial Sequence
  chemically synthesized
actttgggaggccgaggcgg

SEQ ID NO: 505453 - DNA, 20 bp, Artificial Sequence
  chemically synthesized
cggggtttcaccgtgttagc

SEQ ID NO: 505454 - DNA, 20 bp, Artificial Sequence
  chemically synthesized
ttttgtatttttagtagaga

SEQ ID NO: 505455 - DNA, 20 bp, Artificial Sequence
  chemically synthesized
ctaaaaatacaaaaacttag

SEQ ID NO: 505456 - DNA, 20 bp, Artificial Sequence
  chemically synthesized
cgttctcctgcctcagcctc

SEQ ID NO: 505457 - DNA, 20 bp, Artificial Sequence
  chemically synthesized
ctcactgcaagctctgcctc

SEQ ID NO: 505458 - DNA, 20 bp, Artificial Sequence
  chemically synthesized
agtctcgctctgtcccaggc

SEQ ID NO: 505459 - DNA, 20 bp, Artificial Sequence
  chemically synthesized
ataagattatttttttgaga

SEQ ID NO: 505460 - DNA, 20 bp, Artificial Sequence
  chemically synthesized
aaataatcttattaaagaaa

SEQ ID NO: 505461 - DNA, 20 bp, Artificial Sequence
  chemically synthesized
acaatcatgacagcaggtag

SEQ ID NO: 505462 - DNA, 20 bp, Artificial Sequence
  chemically synthesized
gtgatagcaggagagcccac

SEQ ID NO: 505463 - DNA, 20 bp, Artificial Sequence
  chemically synthesized
acagggatgctgaaataact

SEQ ID NO: 505464 - DNA, 20 bp, Artificial Sequence
  chemically synthesized
catgaagagagcagtatctt

SEQ ID NO: 505465 - DNA, 20 bp, Artificial Sequence
  chemically synthesized
gaattgtctctgttaggtga

SEQ ID NO: 505466 - DNA, 20 bp, Artificial Sequence
  chemically synthesized
gtcagtcattctaaagtagt

SEQ ID NO: 505467 - DNA, 20 bp, Artificial Sequence
  chemically synthesized
cttttgtacccccactactt

SEQ ID NO: 505468 - DNA, 20 bp, Artificial Sequence
  chemically synthesized
aagtagtgggggtacaaaag

SEQ ID NO: 505469 - DNA, 20 bp, Artificial Sequence
  chemically synthesized
agtgggggtacaaaagaggg

SEQ ID NO: 505470 - DNA, 20 bp, Artificial Sequence
  chemically synthesized
tgagtcatagtgctgttttc

SEQ ID NO: 505471 - DNA, 20 bp, Artificial Sequence
  chemically synthesized
ggtaaaattggtttccacgt

SEQ ID NO: 505472 - DNA, 20 bp, Artificial Sequence
  chemically synthesized
aattggtttccacgtatgag

SEQ ID NO: 505473 - DNA, 20 bp, Artificial Sequence
  chemically synthesized
tgaaaaagtgtttgagcctg

SEQ ID NO: 505474 - DNA, 20 bp, Artificial Sequence
  chemically synthesized
agtgtttgagcctgccgagt

SEQ ID NO: 505475 - DNA, 20 bp, Artificial Sequence
  chemically synthesized
ctacccagagtataggtacc

SEQ ID NO: 505476 - DNA, 20 bp, Artificial Sequence
  chemically synthesized
agactcgaggtacctatact

SEQ ID NO: 505477 - DNA, 20 bp, Artificial Sequence
  chemically synthesized
tgttatctgtgtttactacc

SEQ ID NO: 505478 - DNA, 20 bp, Artificial Sequence
  chemically synthesized
ctggcttgatgatttccagc

SEQ ID NO: 505479 - DNA, 20 bp, Artificial Sequence
  chemically synthesized
gtaaaaagttgattctgaaa

SEQ ID NO: 505480 - DNA, 20 bp, Artificial Sequence
  chemically synthesized
tgcacttgattaccctcttt

SEQ ID NO: 505481 - DNA, 20 bp, Artificial Sequence
  chemically synthesized
atctggctttgggctcttcc

SEQ ID NO: 505482 - DNA, 20 bp, Artificial Sequence
  chemically synthesized
gaccataacgacttgatagg

SEQ ID NO: 505483 - DNA, 20 bp, Artificial Sequence
  chemically synthesized
atagcctcctttgatcacaa

SEQ ID NO: 505484 - DNA, 20 bp, Artificial Sequence
  chemically synthesized
catgtgctcacggaaaaaat

SEQ ID NO: 505485 - DNA, 20 bp, Artificial Sequence
  chemically synthesized
acggaaaaaattcgagttgt

SEQ ID NO: 505486 - DNA, 20 bp, Artificial Sequence
  chemically synthesized
aattaacagattctaacaac

SEQ ID NO: 505487 - DNA, 20 bp, Artificial Sequence
  chemically synthesized
ctgcagttcagactttttag

SEQ ID NO: 505488 - DNA, 20 bp, Artificial Sequence
  chemically synthesized
ctgaactgcagtgatactaa

SEQ ID NO: 505489 - DNA, 20 bp, Artificial Sequence
  chemically synthesized
taaagcccaagattgtgtcc

SEQ ID NO: 505490 - DNA, 20 bp, Artificial Sequence
  chemically synthesized
tcctatgcacataaaggctc

SEQ ID NO: 505491 - DNA, 20 bp, Artificial Sequence
  chemically synthesized
tctcgagcctttatgtgcat

SEQ ID NO: 505492 - DNA, 20 bp, Artificial Sequence
  chemically synthesized
tttgcctttgaacattttcc

SEQ ID NO: 505493 - DNA, 20 bp, Artificial Sequence
  chemically synthesized
ctgggagcttgtcagaaata

SEQ ID NO: 505494 - DNA, 20 bp, Artificial Sequence
  chemically synthesized
aagtgcattttgttaattat

SEQ ID NO: 505495 - DNA, 20 bp, Artificial Sequence
  chemically synthesized
ttatatgaataaaacacatg

SEQ ID NO: 505496 - DNA, 20 bp, Artificial Sequence
  chemically synthesized
actggctaaaagcatttgaa

SEQ ID NO: 505497 - DNA, 20 bp, Artificial Sequence
  chemically synthesized
agaaatcaagtgaaaaaaaa

SEQ ID NO: 505498 - DNA, 20 bp, Artificial Sequence
  chemically synthesized
tttttaatgaaagcctaaaa

SEQ ID NO: 505499 - DNA, 20 bp, Artificial Sequence
  chemically synthesized
ggcaggctcgtgtcatgaac

SEQ ID NO: 505500 - DNA, 20 bp, Artificial Sequence
  chemically synthesized
gttcatgacacgagcctgcc

SEQ ID NO: 505501 - DNA, 20 bp, Artificial Sequence
  chemically synthesized
gtgatgtagtaagaaaatta

SEQ ID NO: 505502 - DNA, 20 bp, Artificial Sequence
  chemically synthesized
aaaattaatggatacctaaa

SEQ ID NO: 505503 - DNA, 20 bp, Artificial Sequence
  chemically synthesized
agaaatacataattacgatg

SEQ ID NO: 505504 - DNA, 20 bp, Artificial Sequence
  chemically synthesized
cgtaattatgtatttctctc

SEQ ID NO: 505505 - DNA, 20 bp, Artificial Sequence
  chemically synthesized
tcccattttagtaggcaatt

SEQ ID NO: 505506 - DNA, 20 bp, Artificial Sequence
  chemically synthesized
atgttgttatttcagaaaat

SEQ ID NO: 505507 - DNA, 20 bp, Artificial Sequence
  chemically synthesized
aactggttttctgatacctt

SEQ ID NO: 505508 - DNA, 20 bp, Artificial Sequence
  chemically synthesized
aaattgagtttcagtatttc

SEQ ID NO: 505509 - DNA, 20 bp, Artificial Sequence
  chemically synthesized
gctttgatcaggcaggaaaa

SEQ ID NO: 505510 - DNA, 20 bp, Artificial Sequence
  chemically synthesized
gctgtcttaagataaagaaa

SEQ ID NO: 505511 - DNA, 20 bp, Artificial Sequence
  chemically synthesized
agtatcagacagaaacctgt

SEQ ID NO: 505512 - DNA, 20 bp, Artificial Sequence
  chemically synthesized
catatttgaccactgaaagt

SEQ ID NO: 505513 - DNA, 20 bp, Artificial Sequence
  chemically synthesized
gtaacatgatgtttgaaaat

SEQ ID NO: 505514 - DNA, 20 bp, Artificial Sequence
  chemically synthesized
aattaattttctactactaa

SEQ ID NO: 505515 - DNA, 20 bp, Artificial Sequence
  chemically synthesized
tcccatttcttgaaacaatt

SEQ ID NO: 505516 - DNA, 20 bp, Artificial Sequence
  chemically synthesized
attttgtcaccagttcttct

SEQ ID NO: 505517 - DNA, 20 bp, Artificial Sequence
  chemically synthesized
taaaaaatagattttttttc

SEQ ID NO: 505518 - DNA, 20 bp, Artificial Sequence
  chemically synthesized
tacaagctaatgtttgctgt

SEQ ID NO: 505519 - DNA, 20 bp, Artificial Sequence
  chemically synthesized
gtcgtatttgtaaaaataca

SEQ ID NO: 505520 - DNA, 20 bp, Artificial Sequence
  chemically synthesized
tggattttgaacttcatgat

SEQ ID NO: 505521 - DNA, 20 bp, Artificial Sequence
  chemically synthesized
ttagctctgctttttctctc

SEQ ID NO: 505522 - DNA, 20 bp, Artificial Sequence
  chemically synthesized
catttagatgtgatcttccc

SEQ ID NO: 505523 - DNA, 20 bp, Artificial Sequence
  chemically synthesized
aagctaaggaagcagtgatt

SEQ ID NO: 505524 - DNA, 20 bp, Artificial Sequence
  chemically synthesized
gtaaaataatttctaacagg

SEQ ID NO: 505525 - DNA, 20 bp, Artificial Sequence
  chemically synthesized
aaaattataccatctcagaa

SEQ ID NO: 505526 - DNA, 20 bp, Artificial Sequence
  chemically synthesized
aatatcttataatatatgac

SEQ ID NO: 505527 - DNA, 20 bp, Artificial Sequence
  chemically synthesized
gacagggattgatgactata

SEQ ID NO: 505528 - DNA, 20 bp, Artificial Sequence
  chemically synthesized
aataactttttgataacagt

SEQ ID NO: 505529 - DNA, 20 bp, Artificial Sequence
  chemically synthesized
tagaatagagtaaaatagaa

SEQ ID NO: 505530 - DNA, 20 bp, Artificial Sequence
  chemically synthesized
tagagtagaatagagtaaaa

SEQ ID NO: 505531 - DNA, 20 bp, Artificial Sequence
  chemically synthesized
cacaattgtgtagagtagaa

SEQ ID NO: 505532 - DNA, 20 bp, Artificial Sequence
  chemically synthesized
gcttgcacaattgtgtagag

SEQ ID NO: 505533 - DNA, 20 bp, Artificial Sequence
  chemically synthesized
agcaagcttgcacaattgtg

SEQ ID NO: 505534 - DNA, 20 bp, Artificial Sequence
  chemically synthesized
gtaactgaacaatatatgaa

SEQ ID NO: 505535 - DNA, 20 bp, Artificial Sequence
  chemically synthesized
aatatatgaaaggaatcaac

SEQ ID NO: 505536 - DNA, 20 bp, Artificial Sequence
  chemically synthesized
ggattcttctgtgactgact

SEQ ID NO: 505537 - DNA, 20 bp, Artificial Sequence
  chemically synthesized
gcatccctagtcagtcacag

SEQ ID NO: 505538 - DNA, 20 bp, Artificial Sequence
  chemically synthesized
tttagcctagagaaatcttt

SEQ ID NO: 505539 - DNA, 20 bp, Artificial Sequence
  chemically synthesized
cgcattaatctatcaactag

SEQ ID NO: 505540 - DNA, 20 bp, Artificial Sequence
  chemically synthesized
gaatcacagataacaaagca

SEQ ID NO: 505541 - DNA, 20 bp, Artificial Sequence
  chemically synthesized
gagtttacaagcagcacaaa

SEQ ID NO: 505542 - DNA, 20 bp, Artificial Sequence
  chemically synthesized
agaagctgtgttgcagagtc

SEQ ID NO: 505543 - DNA, 20 bp, Artificial Sequence
  chemically synthesized
ctcgctcagaagctgtgttg

SEQ ID NO: 505544 - DNA, 20 bp, Artificial Sequence
  chemically synthesized
ctctgcaacacagcttctga

SEQ ID NO: 505545 - DNA, 20 bp, Artificial Sequence
  chemically synthesized
gatataactgaacttcacag

SEQ ID NO: 505546 - DNA, 20 bp, Artificial Sequence
  chemically synthesized
ttattttttgctgtcttagg

SEQ ID NO: 505547 - DNA, 20 bp, Artificial Sequence
  chemically synthesized
ttgagaaaagaatgataaat

SEQ ID NO: 505548 - DNA, 20 bp, Artificial Sequence
  chemically synthesized
caggagtctcagattgagaa

SEQ ID NO: 505549 - DNA, 20 bp, Artificial Sequence
  chemically synthesized
tactaatagaggtgtcaggc

SEQ ID NO: 505550 - DNA, 20 bp, Artificial Sequence
  chemically synthesized
ctgttaggtagactcaaatt

SEQ ID NO: 505551 - DNA, 20 bp, Artificial Sequence
  chemically synthesized
gatcaaagctgactccaaat

SEQ ID NO: 505552 - DNA, 20 bp, Artificial Sequence
  chemically synthesized
atttggagtcagctttgatc

SEQ ID NO: 505553 - DNA, 20 bp, Artificial Sequence
  chemically synthesized
gaagtgatttttacattgag

SEQ ID NO: 505554 - DNA, 20 bp, Artificial Sequence
  chemically synthesized
agaggctgggtaatagctta

SEQ ID NO: 505555 - DNA, 20 bp, Artificial Sequence
  chemically synthesized
agctattacccagcctctgc

SEQ ID NO: 505556 - DNA, 20 bp, Artificial Sequence
  chemically synthesized
tggaaacattcaagcagagg

SEQ ID NO: 505557 - DNA, 20 bp, Artificial Sequence
  chemically synthesized
tttcaatggtgaccaccaac

SEQ ID NO: 505558 - DNA, 20 bp, Artificial Sequence
  chemically synthesized
agtctccaatcatactgcct

SEQ ID NO: 505559 - DNA, 20 bp, Artificial Sequence
  chemically synthesized
atcacaaatgggacaatagt

SEQ ID NO: 505560 - DNA, 20 bp, Artificial Sequence
  chemically synthesized
ttatataattgttgtcttct

SEQ ID NO: 505561 - DNA, 20 bp, Artificial Sequence
  chemically synthesized
tgtcttcagctggcattgag

SEQ ID NO: 505562 - DNA, 20 bp, Artificial Sequence
  chemically synthesized
tgccagctgaagacagacaa

SEQ ID NO: 505563 - DNA, 20 bp, Artificial Sequence
  chemically synthesized
ttcaacgtaggcagtgccct

SEQ ID NO: 505564 - DNA, 20 bp, Artificial Sequence
  chemically synthesized
aaagggcactgcctacgttg

SEQ ID NO: 505565 - DNA, 20 bp, Artificial Sequence
  chemically synthesized
ttaagccactacattttggt

SEQ ID NO: 505566 - DNA, 20 bp, Artificial Sequence
  chemically synthesized
aaaaaaaggtttgaaaataa

SEQ ID NO: 505567 - DNA, 20 bp, Artificial Sequence
  chemically synthesized
aagagatctttggagccacc

SEQ ID NO: 505568 - DNA, 20 bp, Artificial Sequence
  chemically synthesized
acctaaatcaccagattaga

SEQ ID NO: 505569 - DNA, 20 bp, Artificial Sequence
  chemically synthesized
ctatacctaaatcaccagat

SEQ ID NO: 505570 - DNA, 20 bp, Artificial Sequence
  chemically synthesized
ggtatagaagagccaaaata

SEQ ID NO: 505571 - DNA, 20 bp, Artificial Sequence
  chemically synthesized
aatactattccattagacac

SEQ ID NO: 505572 - DNA, 20 bp, Artificial Sequence
  chemically synthesized
gaatcaacccaagtgtctaa

SEQ ID NO: 505573 - DNA, 20 bp, Artificial Sequence
  chemically synthesized
agtattaagcctttaagact

SEQ ID NO: 505574 - DNA, 20 bp, Artificial Sequence
  chemically synthesized
ttcacttaacataatttcct

SEQ ID NO: 505575 - DNA, 20 bp, Artificial Sequence
  chemically synthesized
cacatgatctcacttacaag

SEQ ID NO: 505576 - DNA, 20 bp, Artificial Sequence
  chemically synthesized
gttcatttccaggagctggt

SEQ ID NO: 505577 - DNA, 20 bp, Artificial Sequence
  chemically synthesized
tccaggagctggtgggggtg

SEQ ID NO: 505578 - DNA, 20 bp, Artificial Sequence
  chemically synthesized
agttggaaagatattggcaa

SEQ ID NO: 505579 - DNA, 20 bp, Artificial Sequence
  chemically synthesized
tctactgataaatttaaaga

SEQ ID NO: 505580 - DNA, 20 bp, Artificial Sequence
  chemically synthesized
tccgttgaagtaattaagca

SEQ ID NO: 505581 - DNA, 20 bp, Artificial Sequence
  chemically synthesized
ccctatgcttaattacttca

SEQ ID NO: 505582 - DNA, 20 bp, Artificial Sequence
  chemically synthesized
actaagataacaacaagcca

SEQ ID NO: 505583 - DNA, 20 bp, Artificial Sequence
  chemically synthesized
gttatcttagtttccttaaa

SEQ ID NO: 505584 - DNA, 20 bp, Artificial Sequence
  chemically synthesized
agtgtgtaaaataaacaggg

SEQ ID NO: 505585 - DNA, 20 bp, Artificial Sequence
  chemically synthesized
taagtcaattgaattgcaat

SEQ ID NO: 505586 - DNA, 20 bp, Artificial Sequence
  chemically synthesized
tcctagaagttttaagtcaa

SEQ ID NO: 505587 - DNA, 20 bp, Artificial Sequence
  chemically synthesized
tcaattgacttaaaacttct

SEQ ID NO: 505588 - DNA, 20 bp, Artificial Sequence
  chemically synthesized
atgattcaaagtcccaaaac

SEQ ID NO: 505589 - DNA, 20 bp, Artificial Sequence
  chemically synthesized
tgaactccagttttgggact

SEQ ID NO: 505590 - DNA, 20 bp, Artificial Sequence
  chemically synthesized
tttgaatcatataaaccagt

SEQ ID NO: 505591 - DNA, 20 bp, Artificial Sequence
  chemically synthesized
attttgtgagaatataaaat

SEQ ID NO: 505592 - DNA, 20 bp, Artificial Sequence
  chemically synthesized
acctaaccaaagaattttgt

SEQ ID NO: 505593 - DNA, 20 bp, Artificial Sequence
  chemically synthesized
gaattggtgatacctaacca

SEQ ID NO: 505594 - DNA, 20 bp, Artificial Sequence
  chemically synthesized
catctcatcctatgggcagc

SEQ ID NO: 505595 - DNA, 20 bp, Artificial Sequence
  chemically synthesized
tcaccaattccagctgccca

SEQ ID NO: 505596 - DNA, 20 bp, Artificial Sequence
  chemically synthesized
agttaattgacctcaatacc

SEQ ID NO: 505597 - DNA, 20 bp, Artificial Sequence
  chemically synthesized
gacggttcatagcatacaga

SEQ ID NO: 505598 - DNA, 20 bp, Artificial Sequence
  chemically synthesized
cctagtctcttaatttcaag

SEQ ID NO: 505599 - DNA, 20 bp, Artificial Sequence
  chemically synthesized
caacttgaaattaagagact

SEQ ID NO: 505600 - DNA, 20 bp, Artificial Sequence
  chemically synthesized
gacatgggatttagaggaat

SEQ ID NO: 505601 - DNA, 20 bp, Artificial Sequence
  chemically synthesized
ttcagtgacatgggatttag

SEQ ID NO: 505602 - DNA, 20 bp, Artificial Sequence
  chemically synthesized
ttcctctaaatcccatgtca

SEQ ID NO: 505603 - DNA, 20 bp, Artificial Sequence
  chemically synthesized
cttactgacattcagtgaca

SEQ ID NO: 505604 - DNA, 20 bp, Artificial Sequence
  chemically synthesized
tgtatgcattacaaatgttt

SEQ ID NO: 505605 - DNA, 20 bp, Artificial Sequence
  chemically synthesized
ggaacctgatagtcaaactt

SEQ ID NO: 505606 - DNA, 20 bp, Artificial Sequence
  chemically synthesized
tgtatattttaatcaacatt

SEQ ID NO: 505607 - DNA, 20 bp, Artificial Sequence
  chemically synthesized
aaggagttaacatcgctgaa

SEQ ID NO: 505608 - DNA, 20 bp, Artificial Sequence
  chemically synthesized
ccatagtaggagagtattta

SEQ ID NO: 505609 - DNA, 20 bp, Artificial Sequence
  chemically synthesized
taatcaaataaccatagtag

SEQ ID NO: 505610 - DNA, 20 bp, Artificial Sequence
  chemically synthesized
ttgattacctacccaaacca

SEQ ID NO: 505611 - DNA, 20 bp, Artificial Sequence
  chemically synthesized
ttgaaatataattcactggt

SEQ ID NO: 505612 - DNA, 20 bp, Artificial Sequence
  chemically synthesized
gccagtatattggacagaga

SEQ ID NO: 505613 - DNA, 20 bp, Artificial Sequence
  chemically synthesized
attggacagagaaggagtgc

SEQ ID NO: 505614 - DNA, 20 bp, Artificial Sequence
  chemically synthesized
tgctggaatgttaatacttt

SEQ ID NO: 505615 - DNA, 20 bp, Artificial Sequence
  chemically synthesized
tcccttaaccagtgagagct

SEQ ID NO: 505616 - DNA, 20 bp, Artificial Sequence
  chemically synthesized
ccagtgagagcttggaattg

SEQ ID NO: 505617 - DNA, 20 bp, Artificial Sequence
  chemically synthesized
agacactgtgtatcatactt

SEQ ID NO: 505618 - DNA, 20 bp, Artificial Sequence
  chemically synthesized
gtatgatacacagtgtctca

SEQ ID NO: 505619 - DNA, 20 bp, Artificial Sequence
  chemically synthesized
ataaagtatggcacaaatat

SEQ ID NO: 505620 - DNA, 20 bp, Artificial Sequence
  chemically synthesized
cacttccctactttgtttcc

SEQ ID NO: 505621 - DNA, 20 bp, Artificial Sequence
  chemically synthesized
ccaagagtagatctgaagag

SEQ ID NO: 505622 - DNA, 20 bp, Artificial Sequence
  chemically synthesized
gccttagtttgggttgcccc

SEQ ID NO: 505623 - DNA, 20 bp, Artificial Sequence
  chemically synthesized
ctgttgattattgccttagt

SEQ ID NO: 505624 - DNA, 20 bp, Artificial Sequence
  chemically synthesized
aaaaaaaaaaaaaagtatgg

SEQ ID NO: 505625 - DNA, 20 bp, Artificial Sequence
  chemically synthesized
atctgagagagctgcagaaa

SEQ ID NO: 505626 - DNA, 20 bp, Artificial Sequence
  chemically synthesized
acagaaacaagtgcaattat

SEQ ID NO: 505627 - DNA, 20 bp, Artificial Sequence
  chemically synthesized
tgagaacggtggctacatat

SEQ ID NO: 505628 - DNA, 20 bp, Artificial Sequence
  chemically synthesized
gaaactcaaatgtaaaagaa

SEQ ID NO: 505629 - DNA, 20 bp, Artificial Sequence
  chemically synthesized
ctcattcccttcttttacat

SEQ ID NO: 505630 - DNA, 20 bp, Artificial Sequence
  chemically synthesized
aagttcaaaatgtaggtagt

SEQ ID NO: 505631 - DNA, 20 bp, Artificial Sequence
  chemically synthesized
agatgcttgagcaaaagtaa

SEQ ID NO: 505632 - DNA, 20 bp, Artificial Sequence
  chemically synthesized
tcttacttttgctcaagcat

SEQ ID NO: 505633 - DNA, 20 bp, Artificial Sequence
  chemically synthesized
aaataaacaaatactagaaa

SEQ ID NO: 505634 - DNA, 20 bp, Artificial Sequence
  chemically synthesized
agtatttgtttattttgaga

SEQ ID NO: 505635 - DNA, 20 bp, Artificial Sequence
  chemically synthesized
actgcactccagcctggtga

SEQ ID NO: 505636 - DNA, 20 bp, Artificial Sequence
  chemically synthesized
gtctcactctgtcaccaggc

SEQ ID NO: 505637 - DNA, 20 bp, Artificial Sequence
  chemically synthesized
ctcaccacaacctctgcctc

SEQ ID NO: 505638 - DNA, 20 bp, Artificial Sequence
  chemically synthesized
acctctgcctcccgggttca

SEQ ID NO: 505639 - DNA, 20 bp, Artificial Sequence
  chemically synthesized
tacttgggaggctgaggcag

SEQ ID NO: 505640 - DNA, 20 bp, Artificial Sequence
  chemically synthesized
caaaggaagaaaaattacaa

SEQ ID NO: 505641 - DNA, 20 bp, Artificial Sequence
  chemically synthesized
aaatagaaggcaaattagaa

SEQ ID NO: 505642 - DNA, 20 bp, Artificial Sequence
  chemically synthesized
catagaaatagaaggcaaat

SEQ ID NO: 505643 - DNA, 20 bp, Artificial Sequence
  chemically synthesized
tacataatgatagggtggag

SEQ ID NO: 505644 - DNA, 20 bp, Artificial Sequence
  chemically synthesized
tgacatctagtacataatga

SEQ ID NO: 505645 - DNA, 20 bp, Artificial Sequence
  chemically synthesized
tgttttctggtgagagatag

SEQ ID NO: 505646 - DNA, 20 bp, Artificial Sequence
  chemically synthesized
aacacatcagtcatcatgcc

SEQ ID NO: 505647 - DNA, 20 bp, Artificial Sequence
  chemically synthesized
tgaattagagatatacatat

SEQ ID NO: 505648 - DNA, 20 bp, Artificial Sequence
  chemically synthesized
gtggaattcagaacaagtgc

SEQ ID NO: 505649 - DNA, 20 bp, Artificial Sequence
  chemically synthesized
ctctaattcaggcacttgtt

SEQ ID NO: 505650 - DNA, 20 bp, Artificial Sequence
  chemically synthesized
ggcagatggttatatagctg

SEQ ID NO: 505651 - DNA, 20 bp, Artificial Sequence
  chemically synthesized
gctatataaccatctgccta

SEQ ID NO: 505652 - DNA, 20 bp, Artificial Sequence
  chemically synthesized
actgatctggggaatactga

SEQ ID NO: 505653 - DNA, 20 bp, Artificial Sequence
  chemically synthesized
tgatgctaattactgatctg

SEQ ID NO: 505654 - DNA, 20 bp, Artificial Sequence
  chemically synthesized
agatgaagataacaaatatg

SEQ ID NO: 505655 - DNA, 20 bp, Artificial Sequence
  chemically synthesized
atcttcatctccgctatgga

SEQ ID NO: 505656 - DNA, 20 bp, Artificial Sequence
  chemically synthesized
tcttttaatatcatcacatt

SEQ ID NO: 505657 - DNA, 20 bp, Artificial Sequence
  chemically synthesized
ttgggaggtaattaggtcaa

SEQ ID NO: 505658 - DNA, 20 bp, Artificial Sequence
  chemically synthesized
gagggtagagccctcatgaa

SEQ ID NO: 505659 - DNA, 20 bp, Artificial Sequence
  chemically synthesized
aaatttatgtctcccatttc

SEQ ID NO: 505660 - DNA, 20 bp, Artificial Sequence
  chemically synthesized
ctgtaacaaaataccataaa

SEQ ID NO: 505661 - DNA, 20 bp, Artificial Sequence
  chemically synthesized
taaacatgggaaggaagaga

SEQ ID NO: 505662 - DNA, 20 bp, Artificial Sequence
  chemically synthesized
acacatacattctctgtctc

SEQ ID NO: 505663 - DNA, 20 bp, Artificial Sequence
  chemically synthesized
gcatacatattcaggagaca

SEQ ID NO: 505664 - DNA, 20 bp, Artificial Sequence
  chemically synthesized
catttaatggcaacacagat

SEQ ID NO: 505665 - DNA, 20 bp, Artificial Sequence
  chemically synthesized
ttccagtagtacataaaaga

SEQ ID NO: 505666 - DNA, 20 bp, Artificial Sequence
  chemically synthesized
ataatagatgtacttagatt

SEQ ID NO: 505667 - DNA, 20 bp, Artificial Sequence
  chemically synthesized
atgcgatctttacaaattat

SEQ ID NO: 505668 - DNA, 20 bp, Artificial Sequence
  chemically synthesized
aaagatcgcatcagtgtact

SEQ ID NO: 505669 - DNA, 20 bp, Artificial Sequence
  chemically synthesized
atagacaaatatttaagatt

SEQ ID NO: 505670 - DNA, 20 bp, Artificial Sequence
  chemically synthesized
agtagctagaagagaataat

SEQ ID NO: 505671 - DNA, 20 bp, Artificial Sequence
  chemically synthesized
atatttcaaagtagctagaa

SEQ ID NO: 505672 - DNA, 20 bp, Artificial Sequence
  chemically synthesized
gaaagtctttgagtggtttt

SEQ ID NO: 505673 - DNA, 20 bp, Artificial Sequence
  chemically synthesized
taagaaaaatgagaaagtct

SEQ ID NO: 505674 - DNA, 20 bp, Artificial Sequence
  chemically synthesized
aaagactttctcatttttct

SEQ ID NO: 505675 - DNA, 20 bp, Artificial Sequence
  chemically synthesized
tctatgaaggccagattata

SEQ ID NO: 505676 - DNA, 20 bp, Artificial Sequence
  chemically synthesized
tacttgaataaaagacaaag

SEQ ID NO: 505677 - DNA, 20 bp, Artificial Sequence
  chemically synthesized
aaatttgtttctacaagtac

SEQ ID NO: 505678 - DNA, 20 bp, Artificial Sequence
  chemically synthesized
aacaagaataaagaatagct

SEQ ID NO: 505679 - DNA, 20 bp, Artificial Sequence
  chemically synthesized
ttggaggaggaacaagaata

SEQ ID NO: 505680 - DNA, 20 bp, Artificial Sequence
  chemically synthesized
tattccattggaggaggaac

SEQ ID NO: 505681 - DNA, 20 bp, Artificial Sequence
  chemically synthesized
tattcttgttcctcctccaa

SEQ ID NO: 505682 - DNA, 20 bp, Artificial Sequence
  chemically synthesized
tatttatggaagagtcagtg

SEQ ID NO: 505683 - DNA, 20 bp, Artificial Sequence
  chemically synthesized
agttttcaaaatatttatgg

SEQ ID NO: 505684 - DNA, 20 bp, Artificial Sequence
  chemically synthesized
ttccataaatattttgaaaa

SEQ ID NO: 505685 - DNA, 20 bp, Artificial Sequence
  chemically synthesized
agagggtatttgatgtataa

SEQ ID NO: 505686 - DNA, 20 bp, Artificial Sequence
  chemically synthesized
tatctcatatttatgagtca

SEQ ID NO: 505687 - DNA, 20 bp, Artificial Sequence
  chemically synthesized
gatattcctatctcatattt

SEQ ID NO: 505688 - DNA, 20 bp, Artificial Sequence
  chemically synthesized
ctgactcataaatatgagat

SEQ ID NO: 505689 - DNA, 20 bp, Artificial Sequence
  chemically synthesized
cgtgaatttgaaagtgactg

SEQ ID NO: 505690 - DNA, 20 bp, Artificial Sequence
  chemically synthesized
agagagattaagtttaaagc

SEQ ID NO: 505691 - DNA, 20 bp, Artificial Sequence
  chemically synthesized
agagatagtctaaatcaaat

SEQ ID NO: 505692 - DNA, 20 bp, Artificial Sequence
  chemically synthesized
cctagtaccttgaggcacgt

SEQ ID NO: 505693 - DNA, 20 bp, Artificial Sequence
  chemically synthesized
agaaagatttctactaggcg

SEQ ID NO: 505694 - DNA, 20 bp, Artificial Sequence
  chemically synthesized
catgccaaagtgccatactt

SEQ ID NO: 505695 - DNA, 20 bp, Artificial Sequence
  chemically synthesized
actcacttcagggaagaatg

SEQ ID NO: 505696 - DNA, 20 bp, Artificial Sequence
  chemically synthesized
actccacattcttccctgaa

SEQ ID NO: 505697 - DNA, 20 bp, Artificial Sequence
  chemically synthesized
tactatgactcacttcaggg

SEQ ID NO: 505698 - DNA, 20 bp, Artificial Sequence
  chemically synthesized
ctgaagtgagtcatagtaac

SEQ ID NO: 505699 - DNA, 20 bp, Artificial Sequence
  chemically synthesized
tatgacctaccttgaagaag

SEQ ID NO: 505700 - DNA, 20 bp, Artificial Sequence
  chemically synthesized
ttatggttggctttggagga

SEQ ID NO: 505701 - DNA, 20 bp, Artificial Sequence
  chemically synthesized
ccaaagccaaccataaaagc

SEQ ID NO: 505702 - DNA, 20 bp, Artificial Sequence
  chemically synthesized
agagaaaggtgggcaaaata

SEQ ID NO: 505703 - DNA, 20 bp, Artificial Sequence
  chemically synthesized
tatcaaacaaaagtatgtca

SEQ ID NO: 505704 - DNA, 20 bp, Artificial Sequence
  chemically synthesized
tcataagaccctcattcaag

SEQ ID NO: 505705 - DNA, 20 bp, Artificial Sequence
  chemically synthesized
gggtaggaccccacttgaat

SEQ ID NO: 505706 - DNA, 20 bp, Artificial Sequence
  chemically synthesized
cacatggggtaggaccccac

SEQ ID NO: 505707 - DNA, 20 bp, Artificial Sequence
  chemically synthesized
gaattccttcctcctacaca

SEQ ID NO: 505708 - DNA, 20 bp, Artificial Sequence
  chemically synthesized
ctaccccatgtgtaggagga

SEQ ID NO: 505709 - DNA, 20 bp, Artificial Sequence
  chemically synthesized
accagccaggcctgtctgtg

SEQ ID NO: 505710 - DNA, 20 bp, Artificial Sequence
  chemically synthesized
ggaatgtgattggacaaaaa

SEQ ID NO: 505711 - DNA, 20 bp, Artificial Sequence
  chemically synthesized
taaagagtagacagccatgt

SEQ ID NO: 505712 - DNA, 20 bp, Artificial Sequence
  chemically synthesized
ttttatgcttagagttgata

SEQ ID NO: 505713 - DNA, 20 bp, Artificial Sequence
  chemically synthesized
aggaaaactgtttttatgct

SEQ ID NO: 505714 - DNA, 20 bp, Artificial Sequence
  chemically synthesized
agcataaaaacagttttcct

SEQ ID NO: 505715 - DNA, 20 bp, Artificial Sequence
  chemically synthesized
aacagttttcctttgggtca

SEQ ID NO: 505716 - DNA, 20 bp, Artificial Sequence
  chemically synthesized
gttaacctatcttttgttat

SEQ ID NO: 505717 - DNA, 20 bp, Artificial Sequence
  chemically synthesized
cctgtataaggaggaaggaa

SEQ ID NO: 505718 - DNA, 20 bp, Artificial Sequence
  chemically synthesized
ctttgtttcttttttctgca

SEQ ID NO: 505719 - DNA, 20 bp, Artificial Sequence
  chemically synthesized
aaaaaaaaaaagatttcttt

SEQ ID NO: 505720 - DNA, 20 bp, Artificial Sequence
  chemically synthesized
ttttttttttttttttgaga

SEQ ID NO: 505721 - DNA, 20 bp, Artificial Sequence
  chemically synthesized
tcttgctctgtcacccagcc

SEQ ID NO: 505722 - DNA, 20 bp, Artificial Sequence
  chemically synthesized
tcgcgccactgcactccagg

SEQ ID NO: 505723 - DNA, 20 bp, Artificial Sequence
  chemically synthesized
tactcgggaggctgaggcag

SEQ ID NO: 505724 - DNA, 20 bp, Artificial Sequence
  chemically synthesized
cattctcctgcctcagcctc

SEQ ID NO: 505725 - DNA, 20 bp, Artificial Sequence
  chemically synthesized
tgtggtttcaccgtgttagc

SEQ ID NO: 505726 - DNA, 20 bp, Artificial Sequence
  chemically synthesized
actttgggaggccgaggcgg

SEQ ID NO: 505727 - DNA, 20 bp, Artificial Sequence
  chemically synthesized
gcctcggcctcccaaagtgc

SEQ ID NO: 505728 - DNA, 20 bp, Artificial Sequence
  chemically synthesized
attctcgtctctgttcttta

SEQ ID NO: 505729 - DNA, 20 bp, Artificial Sequence
  chemically synthesized
actccataaagaacagagac

SEQ ID NO: 505730 - DNA, 20 bp, Artificial Sequence
  chemically synthesized
gctcacactggtctttttaa

SEQ ID NO: 505731 - DNA, 20 bp, Artificial Sequence
  chemically synthesized
aaaacaccttctctgtaaat

SEQ ID NO: 505732 - DNA, 20 bp, Artificial Sequence
  chemically synthesized
tccacacaaagaaggctttg

SEQ ID NO: 505733 - DNA, 20 bp, Artificial Sequence
  chemically synthesized
atcctgttgtttgaattgat

SEQ ID NO: 505734 - DNA, 20 bp, Artificial Sequence
  chemically synthesized
attcaaatcaattcaaacaa

SEQ ID NO: 505735 - DNA, 20 bp, Artificial Sequence
  chemically synthesized
agaatttcacatcctgttgt

SEQ ID NO: 505736 - DNA, 20 bp, Artificial Sequence
  chemically synthesized
aatgaggaaagacctttctg

SEQ ID NO: 505737 - DNA, 20 bp, Artificial Sequence
  chemically synthesized
ttataaagtcagacaaaaaa

SEQ ID NO: 505738 - DNA, 20 bp, Artificial Sequence
  chemically synthesized
ctgactttataaatttggaa

SEQ ID NO: 505739 - DNA, 20 bp, Artificial Sequence
  chemically synthesized
ttttatacaaagatcgtatg

SEQ ID NO: 505740 - DNA, 20 bp, Artificial Sequence
  chemically synthesized
taacattaacctctgtgctt

SEQ ID NO: 505741 - DNA, 20 bp, Artificial Sequence
  chemically synthesized
tggaacaaagaaacatatta

SEQ ID NO: 505742 - DNA, 20 bp, Artificial Sequence
  chemically synthesized
gaagaactccaacaggtgag

SEQ ID NO: 505743 - DNA, 20 bp, Artificial Sequence
  chemically synthesized
tttggactcttctcacctgt

SEQ ID NO: 505744 - DNA, 20 bp, Artificial Sequence
  chemically synthesized
gagcttgaattgtgtaagaa

SEQ ID NO: 505745 - DNA, 20 bp, Artificial Sequence
  chemically synthesized
gctcagagcttgaattgtgt

SEQ ID NO: 505746 - DNA, 20 bp, Artificial Sequence
  chemically synthesized
ggttaggaatagctcagagc

SEQ ID NO: 505747 - DNA, 20 bp, Artificial Sequence
  chemically synthesized
ataaatattaagattaggtt

SEQ ID NO: 505748 - DNA, 20 bp, Artificial Sequence
  chemically synthesized
gcacattatgtgtggacaaa

SEQ ID NO: 505749 - DNA, 20 bp, Artificial Sequence
  chemically synthesized
tggtggtacatgttaagtat

SEQ ID NO: 505750 - DNA, 20 bp, Artificial Sequence
  chemically synthesized
taacatgtaccaccatctct

SEQ ID NO: 505751 - DNA, 20 bp, Artificial Sequence
  chemically synthesized
ccaccatctcttagagttct

SEQ ID NO: 505752 - DNA, 20 bp, Artificial Sequence
  chemically synthesized
ttctctccaatattctgcca

SEQ ID NO: 505753 - DNA, 20 bp, Artificial Sequence
  chemically synthesized
gagatgaggctatccactgg

SEQ ID NO: 505754 - DNA, 20 bp, Artificial Sequence
  chemically synthesized
catctctttatgccagcaat

SEQ ID NO: 505755 - DNA, 20 bp, Artificial Sequence
  chemically synthesized
tatgccagcaatgaggatgg

SEQ ID NO: 505756 - DNA, 20 bp, Artificial Sequence
  chemically synthesized
gggtgaagaggaagcagagg

SEQ ID NO: 505757 - DNA, 20 bp, Artificial Sequence
  chemically synthesized
aggcctcccatgtactctcc

SEQ ID NO: 505758 - DNA, 20 bp, Artificial Sequence
  chemically synthesized
gtaggccattggcactcagg

SEQ ID NO: 505759 - DNA, 20 bp, Artificial Sequence
  chemically synthesized
actgaacctaaaactaagcg

SEQ ID NO: 505760 - DNA, 20 bp, Artificial Sequence
  chemically synthesized
agtaggatccgggaaggaga

SEQ ID NO: 505761 - DNA, 20 bp, Artificial Sequence
  chemically synthesized
caatgaactcagtctccttc

SEQ ID NO: 505762 - DNA, 20 bp, Artificial Sequence
  chemically synthesized
cttggaagccagggtctgag

SEQ ID NO: 505763 - DNA, 20 bp, Artificial Sequence
  chemically synthesized
tgcttcttggaagccagggt

SEQ ID NO: 505764 - DNA, 20 bp, Artificial Sequence
  chemically synthesized
tgcaattgcttcttggaagc

SEQ ID NO: 505765 - DNA, 20 bp, Artificial Sequence
  chemically synthesized
cgatagttgctaaattgata

SEQ ID NO: 505766 - DNA, 20 bp, Artificial Sequence
  chemically synthesized
catctcagcaaagatatctg

SEQ ID NO: 505767 - DNA, 20 bp, Artificial Sequence
  chemically synthesized
aaatgtcttcatgctttaaa

SEQ ID NO: 505768 - DNA, 20 bp, Artificial Sequence
  chemically synthesized
gccatctgcaaagcactggg

SEQ ID NO: 505769 - DNA, 20 bp, Artificial Sequence
  chemically synthesized
atactttgcactaagtgagc

SEQ ID NO: 505770 - DNA, 20 bp, Artificial Sequence
  chemically synthesized
agaaggtaactgagttgcat

SEQ ID NO: 505771 - DNA, 20 bp, Artificial Sequence
  chemically synthesized
gagggttttaaagaaggtaa

SEQ ID NO: 505772 - DNA, 20 bp, Artificial Sequence
  chemically synthesized
aagtcttcagtgttttcctt

SEQ ID NO: 505773 - DNA, 20 bp, Artificial Sequence
  chemically synthesized
tttcaatgccatattcaacg

SEQ ID NO: 505774 - DNA, 20 bp, Artificial Sequence
  chemically synthesized
tacatgtacagaatccaacg

SEQ ID NO: 505775 - DNA, 20 bp, Artificial Sequence
  chemically synthesized
aagaagcaaaaatacatgta

SEQ ID NO: 505776 - DNA, 20 bp, Artificial Sequence
  chemically synthesized
ggaaaaaagaattattagaa

SEQ ID NO: 505777 - DNA, 20 bp, Artificial Sequence
  chemically synthesized
agttgttaaagtggggaaaa

SEQ ID NO: 505778 - DNA, 20 bp, Artificial Sequence
  chemically synthesized
ttcattagcaatggttttat

SEQ ID NO: 505779 - DNA, 20 bp, Artificial Sequence
  chemically synthesized
ataatgtgtccctacacctt

SEQ ID NO: 505780 - DNA, 20 bp, Artificial Sequence
  chemically synthesized
ggaaagtaagttaagcacta

SEQ ID NO: 505781 - DNA, 20 bp, Artificial Sequence
  chemically synthesized
attcggaagtacgttaagta

SEQ ID NO: 505782 - DNA, 20 bp, Artificial Sequence
  chemically synthesized
actctgtacttaacgtactt

SEQ ID NO: 505783 - DNA, 20 bp, Artificial Sequence
  chemically synthesized
gttagactgcatttaaggga

SEQ ID NO: 505784 - DNA, 20 bp, Artificial Sequence
  chemically synthesized
gtaaagttagactgcattta

SEQ ID NO: 505785 - DNA, 20 bp, Artificial Sequence
  chemically synthesized
aaataatcattttgtgaaca

SEQ ID NO: 505786 - DNA, 20 bp, Artificial Sequence
  chemically synthesized
gattatttctataattattg

SEQ ID NO: 505787 - DNA, 20 bp, Artificial Sequence
  chemically synthesized
tatacttgaagaatagagga

SEQ ID NO: 505788 - DNA, 20 bp, Artificial Sequence
  chemically synthesized
gaggttttaagatatacttg

SEQ ID NO: 505789 - DNA, 20 bp, Artificial Sequence
  chemically synthesized
tttaatttcaggggtttctg

SEQ ID NO: 505790 - DNA, 20 bp, Artificial Sequence
  chemically synthesized
actttacaagttttaatttc

SEQ ID NO: 505791 - DNA, 20 bp, Artificial Sequence
  chemically synthesized
gcatatataccaaatattca

SEQ ID NO: 505792 - DNA, 20 bp, Artificial Sequence
  chemically synthesized
ctgagaaaaattgtcactct

SEQ ID NO: 505793 - DNA, 20 bp, Artificial Sequence
  chemically synthesized
ggaaattcaactggatgagg

SEQ ID NO: 505794 - DNA, 20 bp, Artificial Sequence
  chemically synthesized
acagactcagcctcatccag

SEQ ID NO: 505795 - DNA, 20 bp, Artificial Sequence
  chemically synthesized
catttttatgggaaattcaa

SEQ ID NO: 505796 - DNA, 20 bp, Artificial Sequence
  chemically synthesized
atctctcagtatttaccata

SEQ ID NO: 505797 - DNA, 20 bp, Artificial Sequence
  chemically synthesized
gtttgtatgtgtttttgcct

SEQ ID NO: 505798 - DNA, 20 bp, Artificial Sequence
  chemically synthesized
catttaagaagttgtcaatt

SEQ ID NO: 505799 - DNA, 20 bp, Artificial Sequence
  chemically synthesized
tgtcaatagtaaaacattac

SEQ ID NO: 505800 - DNA, 20 bp, Artificial Sequence
  chemically synthesized
aacttgtatattgaaagtga

SEQ ID NO: 505801 - DNA, 20 bp, Artificial Sequence
  chemically synthesized
agtttacacatttgggaatg

SEQ ID NO: 505802 - DNA, 20 bp, Artificial Sequence
  chemically synthesized
ctctcaaagtttacacattt

SEQ ID NO: 505803 - DNA, 20 bp, Artificial Sequence
  chemically synthesized
ttcccaaatgtgtaaacttt

SEQ ID NO: 505804 - DNA, 20 bp, Artificial Sequence
  chemically synthesized
ttgattagtgaactaggttt

SEQ ID NO: 505805 - DNA, 20 bp, Artificial Sequence
  chemically synthesized
tatttaaacatcttagcatg

SEQ ID NO: 505806 - DNA, 20 bp, Artificial Sequence
  chemically synthesized
cattttcctttcaggtttct

SEQ ID NO: 505807 - DNA, 20 bp, Artificial Sequence
  chemically synthesized
gtgaaatacgttaaccattg

SEQ ID NO: 505808 - DNA, 20 bp, Artificial Sequence
  chemically synthesized
agctaattaaaatgttcatt

SEQ ID NO: 505809 - DNA, 20 bp, Artificial Sequence
  chemically synthesized
tttcttctttaataccaaca

SEQ ID NO: 505810 - DNA, 20 bp, Artificial Sequence
  chemically synthesized
taaaaatcacctttcttctt

SEQ ID NO: 505811 - DNA, 20 bp, Artificial Sequence
  chemically synthesized
aaagtgcctgtatagtaata

SEQ ID NO: 505812 - DNA, 20 bp, Artificial Sequence
  chemically synthesized
tcttcaaatggttggggatt

SEQ ID NO: 505813 - DNA, 20 bp, Artificial Sequence
  chemically synthesized
taggtcatcttcaaatggtt

SEQ ID NO: 505814 - DNA, 20 bp, Artificial Sequence
  chemically synthesized
cttgaactgagccttggaag

SEQ ID NO: 505815 - DNA, 20 bp, Artificial Sequence
  chemically synthesized
agaaggaaagttgaaagggg

SEQ ID NO: 505816 - DNA, 20 bp, Artificial Sequence
  chemically synthesized
gcatttgctttaaaaaaaaa

SEQ ID NO: 505817 - DNA, 20 bp, Artificial Sequence
  chemically synthesized
tttaaaaaaaaatcgagtaa

SEQ ID NO: 505818 - DNA, 20 bp, Artificial Sequence
  chemically synthesized
taagatctatttgatgcaaa

SEQ ID NO: 505819 - DNA, 20 bp, Artificial Sequence
  chemically synthesized
tagaactaataggatttata

SEQ ID NO: 505820 - DNA, 20 bp, Artificial Sequence
  chemically synthesized
aaaaatatttttagaactaa

SEQ ID NO: 505821 - DNA, 20 bp, Artificial Sequence
  chemically synthesized
catggcaattattatatttt

SEQ ID NO: 505822 - DNA, 20 bp, Artificial Sequence
  chemically synthesized
ttattatatttttggaatta

SEQ ID NO: 505823 - DNA, 20 bp, Artificial Sequence
  chemically synthesized
cttgttttcttttggttaaa

SEQ ID NO: 505824 - DNA, 20 bp, Artificial Sequence
  chemically synthesized
gcctcggcctctcaaagtgc

SEQ ID NO: 505825 - DNA, 20 bp, Artificial Sequence
  chemically synthesized
cgggcagttcacttgaggtc

SEQ ID NO: 505826 - DNA, 20 bp, Artificial Sequence
  chemically synthesized
ttttgtatttttagtagaga

SEQ ID NO: 505827 - DNA, 20 bp, Artificial Sequence
  chemically synthesized
gcctcagcctcccgagtagc

SEQ ID NO: 505828 - DNA, 20 bp, Artificial Sequence
  chemically synthesized
aattctcctgcctcagcctc

SEQ ID NO: 505829 - DNA, 20 bp, Artificial Sequence
  chemically synthesized
tactcgggaggctgaggcag

SEQ ID NO: 505830 - DNA, 20 bp, Artificial Sequence
  chemically synthesized
tctcgttctgttgcccaggc

SEQ ID NO: 505831 - DNA, 20 bp, Artificial Sequence
  chemically synthesized
tttttttttcttttttgaga

SEQ ID NO: 505832 - DNA, 20 bp, Artificial Sequence
  chemically synthesized
ataccagaaagataaaaatt

SEQ ID NO: 505833 - DNA, 20 bp, Artificial Sequence
  chemically synthesized
tttatctttctggtattttc

SEQ ID NO: 505834 - DNA, 20 bp, Artificial Sequence
  chemically synthesized
ggaggaagtccctttggagg

SEQ ID NO: 505835 - DNA, 20 bp, Artificial Sequence
  chemically synthesized
ttcaggccaagaagggaagt

SEQ ID NO: 505836 - DNA, 20 bp, Artificial Sequence
  chemically synthesized
gcttcagagagaagaggctg

SEQ ID NO: 505837 - DNA, 20 bp, Artificial Sequence
  chemically synthesized
ttgggttgagataagacatt

SEQ ID NO: 505838 - DNA, 20 bp, Artificial Sequence
  chemically synthesized
ggatcaatagaaaggaatgt

SEQ ID NO: 505839 - DNA, 20 bp, Artificial Sequence
  chemically synthesized
aagacctgggatcaatagaa

SEQ ID NO: 505840 - DNA, 20 bp, Artificial Sequence
  chemically synthesized
gttgagtttgtctaaagacc

SEQ ID NO: 505841 - DNA, 20 bp, Artificial Sequence
  chemically synthesized
attttctggttgacaattgg

SEQ ID NO: 505842 - DNA, 20 bp, Artificial Sequence
  chemically synthesized
gaaaggcaggacaactgggt

SEQ ID NO: 505843 - DNA, 20 bp, Artificial Sequence
  chemically synthesized
ggtccagaaaggcaggacaa

SEQ ID NO: 505844 - DNA, 20 bp, Artificial Sequence
  chemically synthesized
ttaattttatttttttcaga

SEQ ID NO: 505845 - DNA, 20 bp, Artificial Sequence
  chemically synthesized
tctcgctctgttgcccaagc

SEQ ID NO: 505846 - DNA, 20 bp, Artificial Sequence
  chemically synthesized
tactcgggaggctgaggcag

SEQ ID NO: 505847 - DNA, 20 bp, Artificial Sequence
  chemically synthesized
cattctcctgcctcagcctc

SEQ ID NO: 505848 - DNA, 20 bp, Artificial Sequence
  chemically synthesized
ttccctatttttcatagaga

SEQ ID NO: 505849 - DNA, 20 bp, Artificial Sequence
  chemically synthesized
cggggtttcactgtttcagc

SEQ ID NO: 505850 - DNA, 20 bp, Artificial Sequence
  chemically synthesized
actttgggaggctgagtcgg

SEQ ID NO: 505851 - DNA, 20 bp, Artificial Sequence
  chemically synthesized
aatcccagcactttgggagg

SEQ ID NO: 505852 - DNA, 20 bp, Artificial Sequence
  chemically synthesized
gactcagcctcccaaagtgc

SEQ ID NO: 505853 - DNA, 20 bp, Artificial Sequence
  chemically synthesized
cgacatgtgcccaaggtggt

SEQ ID NO: 505854 - DNA, 20 bp, Artificial Sequence
  chemically synthesized
tgaggctgtgtcacaggcgc

SEQ ID NO: 505855 - DNA, 20 bp, Artificial Sequence
  chemically synthesized
aaagttgatttttgccaagg

SEQ ID NO: 505856 - DNA, 20 bp, Artificial Sequence
  chemically synthesized
ctgcactccagcctgggtga

SEQ ID NO: 505857 - DNA, 20 bp, Artificial Sequence
  chemically synthesized
tctcattctatcacccaggc

SEQ ID NO: 505858 - DNA, 20 bp, Artificial Sequence
  chemically synthesized
ttgtgccactgcactccagc

SEQ ID NO: 505859 - DNA, 20 bp, Artificial Sequence
  chemically synthesized
attgcttgtccccaggaggc

SEQ ID NO: 505860 - DNA, 20 bp, Artificial Sequence
  chemically synthesized
tactcgggaggctgaggcac

SEQ ID NO: 505861 - DNA, 20 bp, Artificial Sequence
  chemically synthesized
aattctcgtgcctcagcctc

SEQ ID NO: 505862 - DNA, 20 bp, Artificial Sequence
  chemically synthesized
gcctcagcctcccgagtacc

SEQ ID NO: 505863 - DNA, 20 bp, Artificial Sequence
  chemically synthesized
tgagacctgtctcagatttt

SEQ ID NO: 505864 - DNA, 20 bp, Artificial Sequence
  chemically synthesized
ctgatctcagtttttgtatc

SEQ ID NO: 505865 - DNA, 20 bp, Artificial Sequence
  chemically synthesized
gatgaatagactaatgtaat

SEQ ID NO: 505866 - DNA, 20 bp, Artificial Sequence
  chemically synthesized
ttatttaatttgattgctag

SEQ ID NO: 505867 - DNA, 20 bp, Artificial Sequence
  chemically synthesized
ataggctttttattataact

SEQ ID NO: 505868 - DNA, 20 bp, Artificial Sequence
  chemically synthesized
aggtgctgtgtaaaccactg

SEQ ID NO: 505869 - DNA, 20 bp, Artificial Sequence
  chemically synthesized
cagtttccactaactgaaga

SEQ ID NO: 505870 - DNA, 20 bp, Artificial Sequence
  chemically synthesized
aggaaaaatagatttttgat

SEQ ID NO: 505871 - DNA, 20 bp, Artificial Sequence
  chemically synthesized
gtactgaaacatattatttt

SEQ ID NO: 505872 - DNA, 20 bp, Artificial Sequence
  chemically synthesized
tttaacatgtgcctcaaaag

SEQ ID NO: 505873 - DNA, 20 bp, Artificial Sequence
  chemically synthesized
acaatattttgtgcttggac

SEQ ID NO: 505874 - DNA, 20 bp, Artificial Sequence
  chemically synthesized
ttattatcaattatggcata

SEQ ID NO: 505875 - DNA, 20 bp, Artificial Sequence
  chemically synthesized
agggcatgtattttaaaaag

SEQ ID NO: 505876 - DNA, 20 bp, Artificial Sequence
  chemically synthesized
tacatgcccttgcatacaaa

SEQ ID NO: 505877 - DNA, 20 bp, Artificial Sequence
  chemically synthesized
gctattaatgccaaaaatgt

SEQ ID NO: 505878 - DNA, 20 bp, Artificial Sequence
  chemically synthesized
acgattctatgggtgccaag

SEQ ID NO: 505879 - DNA, 20 bp, Artificial Sequence
  chemically synthesized
gatattcatcttggcaccca

SEQ ID NO: 505880 - DNA, 20 bp, Artificial Sequence
  chemically synthesized
tcactgcaatcaacgattct

SEQ ID NO: 505881 - DNA, 20 bp, Artificial Sequence
  chemically synthesized
gaatcgttgattgcagtgaa

SEQ ID NO: 505882 - DNA, 20 bp, Artificial Sequence
  chemically synthesized
tttagaaataaatattacca

SEQ ID NO: 505883 - DNA, 20 bp, Artificial Sequence
  chemically synthesized
tctgacattttagaatttgt

SEQ ID NO: 505884 - DNA, 20 bp, Artificial Sequence
  chemically synthesized
tgtagcagtatctgacattt

SEQ ID NO: 505885 - DNA, 20 bp, Artificial Sequence
  chemically synthesized
gtcagatactgctacattag

SEQ ID NO: 505886 - DNA, 20 bp, Artificial Sequence
  chemically synthesized
aggaattagttataaagcca

SEQ ID NO: 505887 - DNA, 20 bp, Artificial Sequence
  chemically synthesized
ggcaaaaactgcatgaccca

SEQ ID NO: 505888 - DNA, 20 bp, Artificial Sequence
  chemically synthesized
agcattttatttcccatcct

SEQ ID NO: 505889 - DNA, 20 bp, Artificial Sequence
  chemically synthesized
ggatttcatctatcatttaa

SEQ ID NO: 505890 - DNA, 20 bp, Artificial Sequence
  chemically synthesized
aatgatagatgaaatcctgt

SEQ ID NO: 505891 - DNA, 20 bp, Artificial Sequence
  chemically synthesized
tcatagatttattactctga

SEQ ID NO: 505892 - DNA, 20 bp, Artificial Sequence
  chemically synthesized
tatgactcaggattttcaac

SEQ ID NO: 505893 - DNA, 20 bp, Artificial Sequence
  chemically synthesized
atatactcaagttgaaaatc

SEQ ID NO: 505894 - DNA, 20 bp, Artificial Sequence
  chemically synthesized
tgattttaaaatatatgact

SEQ ID NO: 505895 - DNA, 20 bp, Artificial Sequence
  chemically synthesized
cataaggacataggcagctt

SEQ ID NO: 505896 - DNA, 20 bp, Artificial Sequence
  chemically synthesized
tgtccttatgataaataaat

SEQ ID NO: 505897 - DNA, 20 bp, Artificial Sequence
  chemically synthesized
attgaagacaagctctgaaa

SEQ ID NO: 505898 - DNA, 20 bp, Artificial Sequence
  chemically synthesized
ggcattttaacagtgcatct

SEQ ID NO: 505899 - DNA, 20 bp, Artificial Sequence
  chemically synthesized
taccttgaagccataataca

SEQ ID NO: 505900 - DNA, 20 bp, Artificial Sequence
  chemically synthesized
actgtggacatattttctca

SEQ ID NO: 505901 - DNA, 20 bp, Artificial Sequence
  chemically synthesized
gaaaatatgtccacagtttg

SEQ ID NO: 505902 - DNA, 20 bp, Artificial Sequence
  chemically synthesized
aaataatttagtaaaatttt

SEQ ID NO: 505903 - DNA, 20 bp, Artificial Sequence
  chemically synthesized
tcattgattttaactaattt

SEQ ID NO: 505904 - DNA, 20 bp, Artificial Sequence
  chemically synthesized
tttaagcagatttttagagt

SEQ ID NO: 505905 - DNA, 20 bp, Artificial Sequence
  chemically synthesized
tataattttaagcagatttt

SEQ ID NO: 505906 - DNA, 20 bp, Artificial Sequence
  chemically synthesized
taaaaaactttaggtgattt

SEQ ID NO: 505907 - DNA, 20 bp, Artificial Sequence
  chemically synthesized
ctcttttctgttctttaaat

SEQ ID NO: 505908 - DNA, 20 bp, Artificial Sequence
  chemically synthesized
tttatttttgcagattgatc

SEQ ID NO: 505909 - DNA, 20 bp, Artificial Sequence
  chemically synthesized
tttcaatacacagtgaagca

SEQ ID NO: 505910 - DNA, 20 bp, Artificial Sequence
  chemically synthesized
ggattcagacagacctgttc

SEQ ID NO: 505911 - DNA, 20 bp, Artificial Sequence
  chemically synthesized
agactcaagaacaggtctgt

SEQ ID NO: 505912 - DNA, 20 bp, Artificial Sequence
  chemically synthesized
atgtagtgttgtagaaatct

SEQ ID NO: 505913 - DNA, 20 bp, Artificial Sequence
  chemically synthesized
atccttattttttttttaag

SEQ ID NO: 505914 - DNA, 20 bp, Artificial Sequence
  chemically synthesized
acccatcttaaaaaaaaaat

SEQ ID NO: 505915 - DNA, 20 bp, Artificial Sequence
  chemically synthesized
aaaataaggataagtcaata

SEQ ID NO: 505916 - DNA, 20 bp, Artificial Sequence
  chemically synthesized
gtggttttgactacgctatc

SEQ ID NO: 505917 - DNA, 20 bp, Artificial Sequence
  chemically synthesized
tacgctatcttggattatat

SEQ ID NO: 505918 - DNA, 20 bp, Artificial Sequence
  chemically synthesized
ttgattgaagtctctaatat

SEQ ID NO: 505919 - DNA, 20 bp, Artificial Sequence
  chemically synthesized
catattttaatgaaaaattt

SEQ ID NO: 505920 - DNA, 20 bp, Artificial Sequence
  chemically synthesized
agggtacaaagtatacaact

SEQ ID NO: 505921 - DNA, 20 bp, Artificial Sequence
  chemically synthesized
aaattattttatattgccat

SEQ ID NO: 505922 - DNA, 20 bp, Artificial Sequence
  chemically synthesized
ttcccaatttattattacct

SEQ ID NO: 505923 - DNA, 20 bp, Artificial Sequence
  chemically synthesized
tatcatcagattagaaagtt

SEQ ID NO: 505924 - DNA, 20 bp, Artificial Sequence
  chemically synthesized
ttttcagcatcaaaaataag

SEQ ID NO: 505925 - DNA, 20 bp, Artificial Sequence
  chemically synthesized
caagtgttgccatgggacac

SEQ ID NO: 505926 - DNA, 20 bp, Artificial Sequence
  chemically synthesized
cactagagtcaatgatactt

SEQ ID NO: 505927 - DNA, 20 bp, Artificial Sequence
  chemically synthesized
aatgtagaacagacataatc

SEQ ID NO: 505928 - DNA, 20 bp, Artificial Sequence
  chemically synthesized
tagactttggcaaattctta

SEQ ID NO: 505929 - DNA, 20 bp, Artificial Sequence
  chemically synthesized
atgcttgactgggactcctt

SEQ ID NO: 505930 - DNA, 20 bp, Artificial Sequence
  chemically synthesized
tattacaacatagcaaggcg

SEQ ID NO: 505931 - DNA, 20 bp, Artificial Sequence
  chemically synthesized
tgaacccagacagcctagct

SEQ ID NO: 505932 - DNA, 20 bp, Artificial Sequence
  chemically synthesized
aacaccctaagctaggctgt

SEQ ID NO: 505933 - DNA, 20 bp, Artificial Sequence
  chemically synthesized
tttacaggaagcatcgcagc

SEQ ID NO: 505934 - DNA, 20 bp, Artificial Sequence
  chemically synthesized
acacattgttatcattggca

SEQ ID NO: 505935 - DNA, 20 bp, Artificial Sequence
  chemically synthesized
gggcttaaagccagttaaaa

SEQ ID NO: 505936 - DNA, 20 bp, Artificial Sequence
  chemically synthesized
tttctcactttctcacgtgt

SEQ ID NO: 505937 - DNA, 20 bp, Artificial Sequence
  chemically synthesized
gataaagtaaaagccacaat

SEQ ID NO: 505938 - DNA, 20 bp, Artificial Sequence
  chemically synthesized
aaagccacaattggaataac

SEQ ID NO: 505939 - DNA, 20 bp, Artificial Sequence
  chemically synthesized
ctcattttacccattagtgc

SEQ ID NO: 505940 - DNA, 20 bp, Artificial Sequence
  chemically synthesized
ctttggggattccggcacta

SEQ ID NO: 505941 - DNA, 20 bp, Artificial Sequence
  chemically synthesized
tgtcccatagaacatacttt

SEQ ID NO: 505942 - DNA, 20 bp, Artificial Sequence
  chemically synthesized
gtataaatgaatgagcatga

SEQ ID NO: 505943 - DNA, 20 bp, Artificial Sequence
  chemically synthesized
cagccataaacaatgtataa

SEQ ID NO: 505944 - DNA, 20 bp, Artificial Sequence
  chemically synthesized
ctgctttctagctatagcag

SEQ ID NO: 505945 - DNA, 20 bp, Artificial Sequence
  chemically synthesized
ttctagctatagcagcagag

SEQ ID NO: 505946 - DNA, 20 bp, Artificial Sequence
  chemically synthesized
aagttttctctaaagggcca

SEQ ID NO: 505947 - DNA, 20 bp, Artificial Sequence
  chemically synthesized
atatcattttgatctcactt

SEQ ID NO: 505948 - DNA, 20 bp, Artificial Sequence
  chemically synthesized
ctacatgccttaatctttta

SEQ ID NO: 505949 - DNA, 20 bp, Artificial Sequence
  chemically synthesized
aatgaggttgaaaaggtagg

SEQ ID NO: 505950 - DNA, 20 bp, Artificial Sequence
  chemically synthesized
gtaaaggaagtttagaagta

SEQ ID NO: 505951 - DNA, 20 bp, Artificial Sequence
  chemically synthesized
tacttctgctggaggcaaac

SEQ ID NO: 505952 - DNA, 20 bp, Artificial Sequence
  chemically synthesized
gtatgcgaacaaaacttaca

SEQ ID NO: 505953 - DNA, 20 bp, Artificial Sequence
  chemically synthesized
catacaggctttcccctgca

SEQ ID NO: 505954 - DNA, 20 bp, Artificial Sequence
  chemically synthesized
agcatctgactggataatta

SEQ ID NO: 505955 - DNA, 20 bp, Artificial Sequence
  chemically synthesized
atgggaaaattagcatctga

SEQ ID NO: 505956 - DNA, 20 bp, Artificial Sequence
  chemically synthesized
cttcttcatgacagtttatg

SEQ ID NO: 505957 - DNA, 20 bp, Artificial Sequence
  chemically synthesized
agatttacagttaaagtaac

SEQ ID NO: 505958 - DNA, 20 bp, Artificial Sequence
  chemically synthesized
attcactcaactaatatcta

SEQ ID NO: 505959 - DNA, 20 bp, Artificial Sequence
  chemically synthesized
agcaatccattagatattag

SEQ ID NO: 505960 - DNA, 20 bp, Artificial Sequence
  chemically synthesized
atccattagatattagttga

SEQ ID NO: 505961 - DNA, 20 bp, Artificial Sequence
  chemically synthesized
tgaacacttctgtagtcatt

SEQ ID NO: 505962 - DNA, 20 bp, Artificial Sequence
  chemically synthesized
tcaaagaaacccaccatgca

SEQ ID NO: 505963 - DNA, 20 bp, Artificial Sequence
  chemically synthesized
aagtcatcatccaatgcatg

SEQ ID NO: 505964 - DNA, 20 bp, Artificial Sequence
  chemically synthesized
aaagtttaaattgcctccca

SEQ ID NO: 505965 - DNA, 20 bp, Artificial Sequence
  chemically synthesized
tcaaggacctttcacactga

SEQ ID NO: 505966 - DNA, 20 bp, Artificial Sequence
  chemically synthesized
tctctcagtgtgaaaggtcc

SEQ ID NO: 505967 - DNA, 20 bp, Artificial Sequence
  chemically synthesized
taagagaagtcaacatgctt

SEQ ID NO: 505968 - DNA, 20 bp, Artificial Sequence
  chemically synthesized
aagtttaaataacttccaac

SEQ ID NO: 505969 - DNA, 20 bp, Artificial Sequence
  chemically synthesized
acttccaacccgggttccaa

SEQ ID NO: 505970 - DNA, 20 bp, Artificial Sequence
  chemically synthesized
gcactagatccttttggaac

SEQ ID NO: 505971 - DNA, 20 bp, Artificial Sequence
  chemically synthesized
gatgcttactaacacagtag

SEQ ID NO: 505972 - DNA, 20 bp, Artificial Sequence
  chemically synthesized
aaaaccggctttgttaagca

SEQ ID NO: 505973 - DNA, 20 bp, Artificial Sequence
  chemically synthesized
acataacaaaataccataga

SEQ ID NO: 505974 - DNA, 20 bp, Artificial Sequence
  chemically synthesized
tcctgctggtaccttaattt

SEQ ID NO: 505975 - DNA, 20 bp, Artificial Sequence
  chemically synthesized
ttccaaaattaaggtaccag

SEQ ID NO: 505976 - DNA, 20 bp, Artificial Sequence
  chemically synthesized
tagacagcctctggtatagt

SEQ ID NO: 505977 - DNA, 20 bp, Artificial Sequence
  chemically synthesized
agcataagatttgggaaggg

SEQ ID NO: 505978 - DNA, 20 bp, Artificial Sequence
  chemically synthesized
gtcccttcccaaatcttatg

SEQ ID NO: 505979 - DNA, 20 bp, Artificial Sequence
  chemically synthesized
ccaggccccatttccagcac

SEQ ID NO: 505980 - DNA, 20 bp, Artificial Sequence
  chemically synthesized
tggggcctggtggcaggtgt

SEQ ID NO: 505981 - DNA, 20 bp, Artificial Sequence
  chemically synthesized
caggtgtttggatcatggga

SEQ ID NO: 505982 - DNA, 20 bp, Artificial Sequence
  chemically synthesized
aaagacagcactaagccgtg

SEQ ID NO: 505983 - DNA, 20 bp, Artificial Sequence
  chemically synthesized
ttagtgctgtctttgcgata

SEQ ID NO: 505984 - DNA, 20 bp, Artificial Sequence
  chemically synthesized
gaggtggcacacatttgtaa

SEQ ID NO: 505985 - DNA, 20 bp, Artificial Sequence
  chemically synthesized
acatggaagaatgggacaag

SEQ ID NO: 505986 - DNA, 20 bp, Artificial Sequence
  chemically synthesized
gaaacagtcacatcacatgg

SEQ ID NO: 505987 - DNA, 20 bp, Artificial Sequence
  chemically synthesized
ttataaagaaatacctgcaa

SEQ ID NO: 505988 - DNA, 20 bp, Artificial Sequence
  chemically synthesized
agctctaatctccaatgtga

SEQ ID NO: 505989 - DNA, 20 bp, Artificial Sequence
  chemically synthesized
ggagattagagcttcaatat

SEQ ID NO: 505990 - DNA, 20 bp, Artificial Sequence
  chemically synthesized
tgatgccaggctgggatggc

SEQ ID NO: 505991 - DNA, 20 bp, Artificial Sequence
  chemically synthesized
atataaaaatgatgccaggc

SEQ ID NO: 505992 - DNA, 20 bp, Artificial Sequence
  chemically synthesized
tgaccagggaagactttact

SEQ ID NO: 505993 - DNA, 20 bp, Artificial Sequence
  chemically synthesized
ttcttattctgacatcttct

SEQ ID NO: 505994 - DNA, 20 bp, Artificial Sequence
  chemically synthesized
agaatactctcagaagatgt

SEQ ID NO: 505995 - DNA, 20 bp, Artificial Sequence
  chemically synthesized
ctctcagaagatgtcagaat

SEQ ID NO: 505996 - DNA, 20 bp, Artificial Sequence
  chemically synthesized
gtcatgggaagataccatcc

SEQ ID NO: 505997 - DNA, 20 bp, Artificial Sequence
  chemically synthesized
gagtttccaattattaattc

SEQ ID NO: 505998 - DNA, 20 bp, Artificial Sequence
  chemically synthesized
ctcctttccccaggagaaag

SEQ ID NO: 505999 - DNA, 20 bp, Artificial Sequence
  chemically synthesized
ggccatatacattccatttc

SEQ ID NO: 506000 - DNA, 20 bp, Artificial Sequence
  chemically synthesized
ctatttcgtcacccctgaaa

SEQ ID NO: 506001 - DNA, 20 bp, Artificial Sequence
  chemically synthesized
ttaagccacttaatctcccc

SEQ ID NO: 506002 - DNA, 20 bp, Artificial Sequence
  chemically synthesized
atgggcatattactgcacag

SEQ ID NO: 506003 - DNA, 20 bp, Artificial Sequence
  chemically synthesized
gaaagtacagaagaaatgtg

SEQ ID NO: 506004 - DNA, 20 bp, Artificial Sequence
  chemically synthesized
ttctgtactttctgtattag

SEQ ID NO: 506005 - DNA, 20 bp, Artificial Sequence
  chemically synthesized
tgttcatttggaggcaatgg

SEQ ID NO: 506006 - DNA, 20 bp, Artificial Sequence
  chemically synthesized
ttttttcttctccaactacc

SEQ ID NO: 506007 - DNA, 20 bp, Artificial Sequence
  chemically synthesized
tgctgtggcttctgttttct

SEQ ID NO: 506008 - DNA, 20 bp, Artificial Sequence
  chemically synthesized
taggactgccaggcagaaaa

SEQ ID NO: 506009 - DNA, 20 bp, Artificial Sequence
  chemically synthesized
tgtattgtttctccagctct

SEQ ID NO: 506010 - DNA, 20 bp, Artificial Sequence
  chemically synthesized
ttccttacgttactagtgct

SEQ ID NO: 506011 - DNA, 20 bp, Artificial Sequence
  chemically synthesized
gaaaactgagacgcagcgca

SEQ ID NO: 506012 - DNA, 20 bp, Artificial Sequence
  chemically synthesized
aagagaggaaacgtaatata

SEQ ID NO: 506013 - DNA, 20 bp, Artificial Sequence
  chemically synthesized
agggattttccaggttttgt

SEQ ID NO: 506014 - DNA, 20 bp, Artificial Sequence
  chemically synthesized
atatttattggatgttgatg

SEQ ID NO: 506015 - DNA, 20 bp, Artificial Sequence
  chemically synthesized
aggtattgaataaatattta

SEQ ID NO: 506016 - DNA, 20 bp, Artificial Sequence
  chemically synthesized
aagtcagctcatagtaggta

SEQ ID NO: 506017 - DNA, 20 bp, Artificial Sequence
  chemically synthesized
gctaaggcctcccaaagtac

SEQ ID NO: 506018 - DNA, 20 bp, Artificial Sequence
  chemically synthesized
actttgggaggccttagcag

SEQ ID NO: 506019 - DNA, 20 bp, Artificial Sequence
  chemically synthesized
tggggtttcaccgtgttggc

SEQ ID NO: 506020 - DNA, 20 bp, Artificial Sequence
  chemically synthesized
ttttgtatttttagtagaga

SEQ ID NO: 506021 - DNA, 20 bp, Artificial Sequence
  chemically synthesized
tcgcttgaacccacggggca

SEQ ID NO: 506022 - DNA, 20 bp, Artificial Sequence
  chemically synthesized
cttactgcatcctctgcccc

SEQ ID NO: 506023 - DNA, 20 bp, Artificial Sequence
  chemically synthesized
gtctcactctgttgccagtc

SEQ ID NO: 506024 - DNA, 20 bp, Artificial Sequence
  chemically synthesized
actgcactccagactggcaa

SEQ ID NO: 506025 - DNA, 20 bp, Artificial Sequence
  chemically synthesized
tttttttttttttttggaga

SEQ ID NO: 506026 - DNA, 20 bp, Artificial Sequence
  chemically synthesized
agcacggtggcaggtaacat

SEQ ID NO: 506027 - DNA, 20 bp, Artificial Sequence
  chemically synthesized
gaaaaagaaaggtatctaaa

SEQ ID NO: 506028 - DNA, 20 bp, Artificial Sequence
  chemically synthesized
cacagagcatttggagatca

SEQ ID NO: 506029 - DNA, 20 bp, Artificial Sequence
  chemically synthesized
ctattagtctgtaagaagaa

SEQ ID NO: 506030 - DNA, 20 bp, Artificial Sequence
  chemically synthesized
aagaagaaaagagttttcac

SEQ ID NO: 506031 - DNA, 20 bp, Artificial Sequence
  chemically synthesized
ttcaccagagtataaatcaa

SEQ ID NO: 506032 - DNA, 20 bp, Artificial Sequence
  chemically synthesized
cgaactttcttgacaaagga

SEQ ID NO: 506033 - DNA, 20 bp, Artificial Sequence
  chemically synthesized
ttgagataagaagcttgagc

SEQ ID NO: 506034 - DNA, 20 bp, Artificial Sequence
  chemically synthesized
taaaaagtttgcagattatt

SEQ ID NO: 506035 - DNA, 20 bp, Artificial Sequence
  chemically synthesized
aaaaaaggagcagaggagaa

SEQ ID NO: 506036 - DNA, 20 bp, Artificial Sequence
  chemically synthesized
taggcagctaaagatcacaa

SEQ ID NO: 506037 - DNA, 20 bp, Artificial Sequence
  chemically synthesized
atttcaagatttatgggcag

SEQ ID NO: 506038 - DNA, 20 bp, Artificial Sequence
  chemically synthesized
atgctttttacagcctcccg

SEQ ID NO: 506039 - DNA, 20 bp, Artificial Sequence
  chemically synthesized
ctcgggaggctgtaaaaagc

SEQ ID NO: 506040 - DNA, 20 bp, Artificial Sequence
  chemically synthesized
agaaaaatttcagttttaac

SEQ ID NO: 506041 - DNA, 20 bp, Artificial Sequence
  chemically synthesized
ttaactagagtgaaggcagc

SEQ ID NO: 506042 - DNA, 20 bp, Artificial Sequence
  chemically synthesized
gaaaaaaataacaaactaaa

SEQ ID NO: 506043 - DNA, 20 bp, Artificial Sequence
  chemically synthesized
aatttaacaggtacatttgg

SEQ ID NO: 506044 - DNA, 20 bp, Artificial Sequence
  chemically synthesized
tggcagatatcaagaccact

SEQ ID NO: 506045 - DNA, 20 bp, Artificial Sequence
  chemically synthesized
ggttgctcactgcacaagtt

SEQ ID NO: 506046 - DNA, 20 bp, Artificial Sequence
  chemically synthesized
tcattcacatcatagtctct

SEQ ID NO: 506047 - DNA, 20 bp, Artificial Sequence
  chemically synthesized
ccattcttagagactatgat

SEQ ID NO: 506048 - DNA, 20 bp, Artificial Sequence
  chemically synthesized
atgatgtgaatgaccctctc

SEQ ID NO: 506049 - DNA, 20 bp, Artificial Sequence
  chemically synthesized
ttagatcgtataactctaga

SEQ ID NO: 506050 - DNA, 20 bp, Artificial Sequence
  chemically synthesized
tggaatctaaaatatagttt

SEQ ID NO: 506051 - DNA, 20 bp, Artificial Sequence
  chemically synthesized
tgtattcctggatttctgac

SEQ ID NO: 506052 - DNA, 20 bp, Artificial Sequence
  chemically synthesized
tagattccagtcagaaatcc

SEQ ID NO: 506053 - DNA, 20 bp, Artificial Sequence
  chemically synthesized
tgcttataggctatgtattc

SEQ ID NO: 506054 - DNA, 20 bp, Artificial Sequence
  chemically synthesized
aatacatagcctataagcat

SEQ ID NO: 506055 - DNA, 20 bp, Artificial Sequence
  chemically synthesized
tataagcatttgaattatac

SEQ ID NO: 506056 - DNA, 20 bp, Artificial Sequence
  chemically synthesized
agaggtagaaatatcaattt

SEQ ID NO: 506057 - DNA, 20 bp, Artificial Sequence
  chemically synthesized
gaagaaaataaaatcacaat

SEQ ID NO: 506058 - DNA, 20 bp, Artificial Sequence
  chemically synthesized
gtagactgacattaaagggc

SEQ ID NO: 506059 - DNA, 20 bp, Artificial Sequence
  chemically synthesized
tgttctctcctgttttcttt

SEQ ID NO: 506060 - DNA, 20 bp, Artificial Sequence
  chemically synthesized
tcaaaaagggaaaagaactg

SEQ ID NO: 506061 - DNA, 20 bp, Artificial Sequence
  chemically synthesized
agcagtttcagtgctcgatg

SEQ ID NO: 506062 - DNA, 20 bp, Artificial Sequence
  chemically synthesized
gtgctcgatgtagagtatga

SEQ ID NO: 506063 - DNA, 20 bp, Artificial Sequence
  chemically synthesized
gagtatgagagggtaaagga

SEQ ID NO: 506064 - DNA, 20 bp, Artificial Sequence
  chemically synthesized
agagggtaaaggaaagaatc

SEQ ID NO: 506065 - DNA, 20 bp, Artificial Sequence
  chemically synthesized
aaagaatcaggagtccgtaa

SEQ ID NO: 506066 - DNA, 20 bp, Artificial Sequence
  chemically synthesized
atctaaaaggagaagcatag

SEQ ID NO: 506067 - DNA, 20 bp, Artificial Sequence
  chemically synthesized
aactatgcttctccttttag

SEQ ID NO: 506068 - DNA, 20 bp, Artificial Sequence
  chemically synthesized
ctccttttagatgaataagt

SEQ ID NO: 506069 - DNA, 20 bp, Artificial Sequence
  chemically synthesized
catataattttgttcgtttt

SEQ ID NO: 506070 - DNA, 20 bp, Artificial Sequence
  chemically synthesized
aaattatatgtaacagctct

SEQ ID NO: 506071 - DNA, 20 bp, Artificial Sequence
  chemically synthesized
aatatcaacacgaaagaaga

SEQ ID NO: 506072 - DNA, 20 bp, Artificial Sequence
  chemically synthesized
ttccagaatgcaaggcgtaa

SEQ ID NO: 506073 - DNA, 20 bp, Artificial Sequence
  chemically synthesized
ttttacgccttgcattctgg

SEQ ID NO: 506074 - DNA, 20 bp, Artificial Sequence
  chemically synthesized
tatgtgaaaatgtattcttc

SEQ ID NO: 506075 - DNA, 20 bp, Artificial Sequence
  chemically synthesized
tcctatgagatactatatct

SEQ ID NO: 506076 - DNA, 20 bp, Artificial Sequence
  chemically synthesized
agtgcatttctattcacagc

SEQ ID NO: 506077 - DNA, 20 bp, Artificial Sequence
  chemically synthesized
gtagatgctcaattcaagct

SEQ ID NO: 506078 - DNA, 20 bp, Artificial Sequence
  chemically synthesized
acacaggtaacgaacaagaa

SEQ ID NO: 506079 - DNA, 20 bp, Artificial Sequence
  chemically synthesized
gaattaaagcttccctgggc

SEQ ID NO: 506080 - DNA, 20 bp, Artificial Sequence
  chemically synthesized
ccagggaagctttaattcta

SEQ ID NO: 506081 - DNA, 20 bp, Artificial Sequence
  chemically synthesized
catatgcttgtttcatccac

SEQ ID NO: 506082 - DNA, 20 bp, Artificial Sequence
  chemically synthesized
ctagtggatgaaacaagcat

SEQ ID NO: 506083 - DNA, 20 bp, Artificial Sequence
  chemically synthesized
atctattcctgggcaggtta

SEQ ID NO: 506084 - DNA, 20 bp, Artificial Sequence
  chemically synthesized
tagcatcccttaacctgccc

SEQ ID NO: 506085 - DNA, 20 bp, Artificial Sequence
  chemically synthesized
aaggtgcaggtcatagggga

SEQ ID NO: 506086 - DNA, 20 bp, Artificial Sequence
  chemically synthesized
cagatggcctgaagcaactg

SEQ ID NO: 506087 - DNA, 20 bp, Artificial Sequence
  chemically synthesized
gcaaaaacaaatcacaatgg

SEQ ID NO: 506088 - DNA, 20 bp, Artificial Sequence
  chemically synthesized
ggaggttttgagccaggaga

SEQ ID NO: 506089 - DNA, 20 bp, Artificial Sequence
  chemically synthesized
tttctcttgtgggcaggggc

SEQ ID NO: 506090 - DNA, 20 bp, Artificial Sequence
  chemically synthesized
agtggaaaattacagtcaaa

SEQ ID NO: 506091 - DNA, 20 bp, Artificial Sequence
  chemically synthesized
ggccgttttataggatttgg

SEQ ID NO: 506092 - DNA, 20 bp, Artificial Sequence
  chemically synthesized
gtggggccgttttataggat

SEQ ID NO: 506093 - DNA, 20 bp, Artificial Sequence
  chemically synthesized
ataggggtggggccgtttta

SEQ ID NO: 506094 - DNA, 20 bp, Artificial Sequence
  chemically synthesized
gagagtcacggaagggagat

SEQ ID NO: 506095 - DNA, 20 bp, Artificial Sequence
  chemically synthesized
aggcaggctgagtctgaaaa

SEQ ID NO: 506096 - DNA, 20 bp, Artificial Sequence
  chemically synthesized
ttcacctgggtgcaggcagg

SEQ ID NO: 506097 - DNA, 20 bp, Artificial Sequence
  chemically synthesized
aacaaggctgtctatttcac

SEQ ID NO: 506098 - DNA, 20 bp, Artificial Sequence
  chemically synthesized
tgggggctgtcataaggaaa

SEQ ID NO: 506099 - DNA, 20 bp, Artificial Sequence
  chemically synthesized
tgtcataaggaaagagaatc

SEQ ID NO: 506100 - DNA, 20 bp, Artificial Sequence
  chemically synthesized
cactttggaaatcagttcac

SEQ ID NO: 506101 - DNA, 20 bp, Artificial Sequence
  chemically synthesized
gggccctaaatcagtagcag

SEQ ID NO: 506102 - DNA, 20 bp, Artificial Sequence
  chemically synthesized
ataggcgtggagtggtgccc

SEQ ID NO: 506103 - DNA, 20 bp, Artificial Sequence
  chemically synthesized
gggcaccactccacgcctat

SEQ ID NO: 506104 - DNA, 20 bp, Artificial Sequence
  chemically synthesized
gtttctaattctaataggcg

SEQ ID NO: 506105 - DNA, 20 bp, Artificial Sequence
  chemically synthesized
tcagcatgcgtcggagtcac

SEQ ID NO: 506106 - DNA, 20 bp, Artificial Sequence
  chemically synthesized
tctcatgcttcagcatgcgt

SEQ ID NO: 506107 - DNA, 20 bp, Artificial Sequence
  chemically synthesized
cactgttgtcatgccagtgc

SEQ ID NO: 506108 - DNA, 20 bp, Artificial Sequence
  chemically synthesized
tatggtgtataagtatcacc

SEQ ID NO: 506109 - DNA, 20 bp, Artificial Sequence
  chemically synthesized
gagggcccttcccaaacctg

SEQ ID NO: 506110 - DNA, 20 bp, Artificial Sequence
  chemically synthesized
actgtttcatgcactgcagt

SEQ ID NO: 506111 - DNA, 20 bp, Artificial Sequence
  chemically synthesized
tagagaatgctatgggatca

SEQ ID NO: 506112 - DNA, 20 bp, Artificial Sequence
  chemically synthesized
gtgaattctagagaatgcta

SEQ ID NO: 506113 - DNA, 20 bp, Artificial Sequence
  chemically synthesized
tctgatcccatagcattctc

SEQ ID NO: 506114 - DNA, 20 bp, Artificial Sequence
  chemically synthesized
atatagtaatgtgaattcta

SEQ ID NO: 506115 - DNA, 20 bp, Artificial Sequence
  chemically synthesized
gttttgaagaatatagtaat

SEQ ID NO: 506116 - DNA, 20 bp, Artificial Sequence
  chemically synthesized
aaatcaatagcagtgttttg

SEQ ID NO: 506117 - DNA, 20 bp, Artificial Sequence
  chemically synthesized
attatgttgtcttatgcatc

SEQ ID NO: 506118 - DNA, 20 bp, Artificial Sequence
  chemically synthesized
taatagatggttatcttttt

SEQ ID NO: 506119 - DNA, 20 bp, Artificial Sequence
  chemically synthesized
aatagtgtctaaagcgaaat

SEQ ID NO: 506120 - DNA, 20 bp, Artificial Sequence
  chemically synthesized
tgacattgcaactataacac

SEQ ID NO: 506121 - DNA, 20 bp, Artificial Sequence
  chemically synthesized
attgcaactataacactaga

SEQ ID NO: 506122 - DNA, 20 bp, Artificial Sequence
  chemically synthesized
taacactagaatggatttag

SEQ ID NO: 506123 - DNA, 20 bp, Artificial Sequence
  chemically synthesized
aataggcaaaagtgtcatta

SEQ ID NO: 506124 - DNA, 20 bp, Artificial Sequence
  chemically synthesized
gtttaacatcccagatattt

SEQ ID NO: 506125 - DNA, 20 bp, Artificial Sequence
  chemically synthesized
taaattgatcctaaaatatc

SEQ ID NO: 506126 - DNA, 20 bp, Artificial Sequence
  chemically synthesized
aaaacaaaaatgttttaggc

SEQ ID NO: 506127 - DNA, 20 bp, Artificial Sequence
  chemically synthesized
aacagaaacaaactgaaaag

SEQ ID NO: 506128 - DNA, 20 bp, Artificial Sequence
  chemically synthesized
aaattgactgatctacatac

SEQ ID NO: 506129 - DNA, 20 bp, Artificial Sequence
  chemically synthesized
cctgcatcctaactacatag

SEQ ID NO: 506130 - DNA, 20 bp, Artificial Sequence
  chemically synthesized
aatttatcctcctatgtagt

SEQ ID NO: 506131 - DNA, 20 bp, Artificial Sequence
  chemically synthesized
ttccctccagggtaagcaga

SEQ ID NO: 506132 - DNA, 20 bp, Artificial Sequence
  chemically synthesized
cctggtctgttttttccctc

SEQ ID NO: 506133 - DNA, 20 bp, Artificial Sequence
  chemically synthesized
aaatgaatatctttgtcctc

SEQ ID NO: 506134 - DNA, 20 bp, Artificial Sequence
  chemically synthesized
cccaagtaaagcgttcataa

SEQ ID NO: 506135 - DNA, 20 bp, Artificial Sequence
  chemically synthesized
gaatggcaaattgtttttaa

SEQ ID NO: 506136 - DNA, 20 bp, Artificial Sequence
  chemically synthesized
ttttgtagcaaccaggcaga

SEQ ID NO: 506137 - DNA, 20 bp, Artificial Sequence
  chemically synthesized
atacttttgtagcaaccagg

SEQ ID NO: 506138 - DNA, 20 bp, Artificial Sequence
  chemically synthesized
atcatgtagcagttatttta

SEQ ID NO: 506139 - DNA, 20 bp, Artificial Sequence
  chemically synthesized
catgattaggaagtaatctc

SEQ ID NO: 506140 - DNA, 20 bp, Artificial Sequence
  chemically synthesized
agatctagttttaccctagg

SEQ ID NO: 506141 - DNA, 20 bp, Artificial Sequence
  chemically synthesized
tcagagtaaggaactcagcc

SEQ ID NO: 506142 - DNA, 20 bp, Artificial Sequence
  chemically synthesized
ttgtacacgtaggtaattat

SEQ ID NO: 506143 - DNA, 20 bp, Artificial Sequence
  chemically synthesized
ctacgtgtacaataatatca

SEQ ID NO: 506144 - DNA, 20 bp, Artificial Sequence
  chemically synthesized
caataatatcactgaattgc

SEQ ID NO: 506145 - DNA, 20 bp, Artificial Sequence
  chemically synthesized
tgcaaaagtgtctgatgatc

SEQ ID NO: 506146 - DNA, 20 bp, Artificial Sequence
  chemically synthesized
tagaaactgtataattattt

SEQ ID NO: 506147 - DNA, 20 bp, Artificial Sequence
  chemically synthesized
agaaactatgtggtagaaag

SEQ ID NO: 506148 - DNA, 20 bp, Artificial Sequence
  chemically synthesized
ttatttacccaaaacaatta

SEQ ID NO: 506149 - DNA, 20 bp, Artificial Sequence
  chemically synthesized
ttttaaatcccttaattgtt

SEQ ID NO: 506150 - DNA, 20 bp, Artificial Sequence
  chemically synthesized
cttaattgttttgggtaaat

SEQ ID NO: 506151 - DNA, 20 bp, Artificial Sequence
  chemically synthesized
gggtaaataaggatacccta

SEQ ID NO: 506152 - DNA, 20 bp, Artificial Sequence
  chemically synthesized
ataattccaattttacccat

SEQ ID NO: 506153 - DNA, 20 bp, Artificial Sequence
  chemically synthesized
gataccctaatgggtaaaat

SEQ ID NO: 506154 - DNA, 20 bp, Artificial Sequence
  chemically synthesized
ttggaattattaaagatcat

SEQ ID NO: 506155 - DNA, 20 bp, Artificial Sequence
  chemically synthesized
aaattctacctagctcttcc

SEQ ID NO: 506156 - DNA, 20 bp, Artificial Sequence
  chemically synthesized
caattccaggaagagctagg

SEQ ID NO: 506157 - DNA, 20 bp, Artificial Sequence
  chemically synthesized
attttagttactgcaattat

SEQ ID NO: 506158 - DNA, 20 bp, Artificial Sequence
  chemically synthesized
aataaatgtttgttgagaga

SEQ ID NO: 506159 - DNA, 20 bp, Artificial Sequence
  chemically synthesized
aaccaataaatgtttgttga

SEQ ID NO: 506160 - DNA, 20 bp, Artificial Sequence
  chemically synthesized
attccattgtagcaaatacc

SEQ ID NO: 506161 - DNA, 20 bp, Artificial Sequence
  chemically synthesized
atccacggtatttgctacaa

SEQ ID NO: 506162 - DNA, 20 bp, Artificial Sequence
  chemically synthesized
cgggcaatgagaaattttat

SEQ ID NO: 506163 - DNA, 20 bp, Artificial Sequence
  chemically synthesized
gcatgaaggcatacaacaaa

SEQ ID NO: 506164 - DNA, 20 bp, Artificial Sequence
  chemically synthesized
atgtaatttactggctgaag

SEQ ID NO: 506165 - DNA, 20 bp, Artificial Sequence
  chemically synthesized
aggtagacataaaattagtg

SEQ ID NO: 506166 - DNA, 20 bp, Artificial Sequence
  chemically synthesized
acataaaattagtggagaat

SEQ ID NO: 506167 - DNA, 20 bp, Artificial Sequence
  chemically synthesized
agtggagaatgagaataata

SEQ ID NO: 506168 - DNA, 20 bp, Artificial Sequence
  chemically synthesized
ctgaatgccataggaagcac

SEQ ID NO: 506169 - DNA, 20 bp, Artificial Sequence
  chemically synthesized
gggttttattttggaggtat

SEQ ID NO: 506170 - DNA, 20 bp, Artificial Sequence
  chemically synthesized
ttggaggtatctggatttat

SEQ ID NO: 506171 - DNA, 20 bp, Artificial Sequence
  chemically synthesized
tttgatgtctctccagacat

SEQ ID NO: 506172 - DNA, 20 bp, Artificial Sequence
  chemically synthesized
tttctaattgatttactaaa

SEQ ID NO: 506173 - DNA, 20 bp, Artificial Sequence
  chemically synthesized
caggttatggacttggcaat

SEQ ID NO: 506174 - DNA, 20 bp, Artificial Sequence
  chemically synthesized
ttccgtcatttcatgttcat

SEQ ID NO: 506175 - DNA, 20 bp, Artificial Sequence
  chemically synthesized
cacctgacatctctagttct

SEQ ID NO: 506176 - DNA, 20 bp, Artificial Sequence
  chemically synthesized
tcctgttttcctcttcaaaa

SEQ ID NO: 506177 - DNA, 20 bp, Artificial Sequence
  chemically synthesized
gtttgagataatgtttatta

SEQ ID NO: 506178 - DNA, 20 bp, Artificial Sequence
  chemically synthesized
ggaagattgtggtgggtagg

SEQ ID NO: 506179 - DNA, 20 bp, Artificial Sequence
  chemically synthesized
gaagatggaggaagattgtg

SEQ ID NO: 506180 - DNA, 20 bp, Artificial Sequence
  chemically synthesized
tatggtctccaccaccaaat

SEQ ID NO: 506181 - DNA, 20 bp, Artificial Sequence
  chemically synthesized
gaatcgaaccactgcattta

SEQ ID NO: 506182 - DNA, 20 bp, Artificial Sequence
  chemically synthesized
ctttataaaacaactgtcat

SEQ ID NO: 506183 - DNA, 20 bp, Artificial Sequence
  chemically synthesized
tgacagttgttttataaagt

SEQ ID NO: 506184 - DNA, 20 bp, Artificial Sequence
  chemically synthesized
gttttataaagtgagaatac

SEQ ID NO: 506185 - DNA, 20 bp, Artificial Sequence
  chemically synthesized
ctataagtgagagataaaca

SEQ ID NO: 506186 - DNA, 20 bp, Artificial Sequence
  chemically synthesized
gtacacatggacacaaagaa

SEQ ID NO: 506187 - DNA, 20 bp, Artificial Sequence
  chemically synthesized
atagacactggggcctattt

SEQ ID NO: 506188 - DNA, 20 bp, Artificial Sequence
  chemically synthesized
gtggaaggtgggaggcaggt

SEQ ID NO: 506189 - DNA, 20 bp, Artificial Sequence
  chemically synthesized
ttaacgtgtaggtttgttac

SEQ ID NO: 506190 - DNA, 20 bp, Artificial Sequence
  chemically synthesized
caacttttagtttaggttca

SEQ ID NO: 506191 - DNA, 20 bp, Artificial Sequence
  chemically synthesized
ggaatcagaattactgaggt

SEQ ID NO: 506192 - DNA, 20 bp, Artificial Sequence
  chemically synthesized
aaaatcattgcttttggaat

SEQ ID NO: 506193 - DNA, 20 bp, Artificial Sequence
  chemically synthesized
atggaaaaaatcattgcttt

SEQ ID NO: 506194 - DNA, 20 bp, Artificial Sequence
  chemically synthesized
cttctctagacacacaggca

SEQ ID NO: 506195 - DNA, 20 bp, Artificial Sequence
  chemically synthesized
gatgaacattgaggcagttg

SEQ ID NO: 506196 - DNA, 20 bp, Artificial Sequence
  chemically synthesized
tataaagctttaatttgagg

SEQ ID NO: 506197 - DNA, 20 bp, Artificial Sequence
  chemically synthesized
catctggagctacatgattt

SEQ ID NO: 506198 - DNA, 20 bp, Artificial Sequence
  chemically synthesized
tcagtcacttagagccaggc

SEQ ID NO: 506199 - DNA, 20 bp, Artificial Sequence
  chemically synthesized
cggccttttgacttctttat

SEQ ID NO: 506200 - DNA, 20 bp, Artificial Sequence
  chemically synthesized
acttcagcctcccaaagtgc

SEQ ID NO: 506201 - DNA, 20 bp, Artificial Sequence
  chemically synthesized
cagcactttgggaggctgaa

SEQ ID NO: 506202 - DNA, 20 bp, Artificial Sequence
  chemically synthesized
actttgggaggctgaagtgg

SEQ ID NO: 506203 - DNA, 20 bp, Artificial Sequence
  chemically synthesized
tttgtattttttagtagaga

SEQ ID NO: 506204 - DNA, 20 bp, Artificial Sequence
  chemically synthesized
aaaaatacaaaaaaaattag

SEQ ID NO: 506205 - DNA, 20 bp, Artificial Sequence
  chemically synthesized
aaaattagccggatgtggtg

SEQ ID NO: 506206 - DNA, 20 bp, Artificial Sequence
  chemically synthesized
gcctcaacctcccgagtagc

SEQ ID NO: 506207 - DNA, 20 bp, Artificial Sequence
  chemically synthesized
caattctctgcctcaacctc

SEQ ID NO: 506208 - DNA, 20 bp, Artificial Sequence
  chemically synthesized
ctactcgggaggttgaggca

SEQ ID NO: 506209 - DNA, 20 bp, Artificial Sequence
  chemically synthesized
cccaggctggagtgcagtgg

SEQ ID NO: 506210 - DNA, 20 bp, Artificial Sequence
  chemically synthesized
tcccgccactgcactccagc

SEQ ID NO: 506211 - DNA, 20 bp, Artificial Sequence
  chemically synthesized
tcttgctctgtcacccaggc

SEQ ID NO: 506212 - DNA, 20 bp, Artificial Sequence
  chemically synthesized
gaagtcagaaaggcaaagag

SEQ ID NO: 506213 - DNA, 20 bp, Artificial Sequence
  chemically synthesized
gatctgtgtgatactcccat

SEQ ID NO: 506214 - DNA, 20 bp, Artificial Sequence
  chemically synthesized
tccttctgccttattcctat

SEQ ID NO: 506215 - DNA, 20 bp, Artificial Sequence
  chemically synthesized
tcccataggaataaggcaga

SEQ ID NO: 506216 - DNA, 20 bp, Artificial Sequence
  chemically synthesized
ggaataaaacaagtcaggta

SEQ ID NO: 506217 - DNA, 20 bp, Artificial Sequence
  chemically synthesized
aacaagtcaggtaaagagtc

SEQ ID NO: 506218 - DNA, 20 bp, Artificial Sequence
  chemically synthesized
attgaggtcttgaccatctg

SEQ ID NO: 506219 - DNA, 20 bp, Artificial Sequence
  chemically synthesized
tgaagcccactaatatttca

SEQ ID NO: 506220 - DNA, 20 bp, Artificial Sequence
  chemically synthesized
attgataattgtctacaggg

SEQ ID NO: 506221 - DNA, 20 bp, Artificial Sequence
  chemically synthesized
cattaattgataattgtcta

SEQ ID NO: 506222 - DNA, 20 bp, Artificial Sequence
  chemically synthesized
ctgtagacaattatcaatta

SEQ ID NO: 506223 - DNA, 20 bp, Artificial Sequence
  chemically synthesized
gtccaaatcaggacacactt

SEQ ID NO: 506224 - DNA, 20 bp, Artificial Sequence
  chemically synthesized
gctgggacaacaggtgtaac

SEQ ID NO: 506225 - DNA, 20 bp, Artificial Sequence
  chemically synthesized
gatggcttcaggtaaatcaa

SEQ ID NO: 506226 - DNA, 20 bp, Artificial Sequence
  chemically synthesized
cagctacagtgtacctcaga

SEQ ID NO: 506227 - DNA, 20 bp, Artificial Sequence
  chemically synthesized
catgcgatgccaataaagca

SEQ ID NO: 506228 - DNA, 20 bp, Artificial Sequence
  chemically synthesized
aataaaagctaacataaatt

SEQ ID NO: 506229 - DNA, 20 bp, Artificial Sequence
  chemically synthesized
tttatgttagcttttatttg

SEQ ID NO: 506230 - DNA, 20 bp, Artificial Sequence
  chemically synthesized
acttctttttgttttcagga

SEQ ID NO: 506231 - DNA, 20 bp, Artificial Sequence
  chemically synthesized
tattggctcctgtttggaga

SEQ ID NO: 506232 - DNA, 20 bp, Artificial Sequence
  chemically synthesized
ttattattggctcctgtttg

SEQ ID NO: 506233 - DNA, 20 bp, Artificial Sequence
  chemically synthesized
ttttgaagacagagattgac

SEQ ID NO: 506234 - DNA, 20 bp, Artificial Sequence
  chemically synthesized
ccctccaacagttctccaaa

SEQ ID NO: 506235 - DNA, 20 bp, Artificial Sequence
  chemically synthesized
ctctgtttggagaactgttg

SEQ ID NO: 506236 - DNA, 20 bp, Artificial Sequence
  chemically synthesized
gagaactgttggagggttgt

SEQ ID NO: 506237 - DNA, 20 bp, Artificial Sequence
  chemically synthesized
cttagtggacatacagattt

SEQ ID NO: 506238 - DNA, 20 bp, Artificial Sequence
  chemically synthesized
aagttaatgtacatcttact

SEQ ID NO: 506239 - DNA, 20 bp, Artificial Sequence
  chemically synthesized
acaaatccgtgaagcttttg

SEQ ID NO: 506240 - DNA, 20 bp, Artificial Sequence
  chemically synthesized
agaaattcatcaaaagcttc

SEQ ID NO: 506241 - DNA, 20 bp, Artificial Sequence
  chemically synthesized
gaaaatctaacaaaaattga

SEQ ID NO: 506242 - DNA, 20 bp, Artificial Sequence
  chemically synthesized
ttagattttctattaccatc

SEQ ID NO: 506243 - DNA, 20 bp, Artificial Sequence
  chemically synthesized
ttttctattaccatcgtgag

SEQ ID NO: 506244 - DNA, 20 bp, Artificial Sequence
  chemically synthesized
ctgaaagttgttgccacaaa

SEQ ID NO: 506245 - DNA, 20 bp, Artificial Sequence
  chemically synthesized
aaaaagaatgctaatattca

SEQ ID NO: 506246 - DNA, 20 bp, Artificial Sequence
  chemically synthesized
tcaaatggctctcaaactct

SEQ ID NO: 506247 - DNA, 20 bp, Artificial Sequence
  chemically synthesized
gagagccatttgactggagc

SEQ ID NO: 506248 - DNA, 20 bp, Artificial Sequence
  chemically synthesized
tcgccaaactttttctgtga

SEQ ID NO: 506249 - DNA, 20 bp, Artificial Sequence
  chemically synthesized
tcgcattacaacggcagagt

SEQ ID NO: 506250 - DNA, 20 bp, Artificial Sequence
  chemically synthesized
ttactttcgcattacaacgg

SEQ ID NO: 506251 - DNA, 20 bp, Artificial Sequence
  chemically synthesized
taatcataagtgataaataa

SEQ ID NO: 506252 - DNA, 20 bp, Artificial Sequence
  chemically synthesized
attatttataacactgaaat

SEQ ID NO: 506253 - DNA, 20 bp, Artificial Sequence
  chemically synthesized
gtttggtgacccctggacta

SEQ ID NO: 506254 - DNA, 20 bp, Artificial Sequence
  chemically synthesized
ctaagcaaatccactagtcc

SEQ ID NO: 506255 - DNA, 20 bp, Artificial Sequence
  chemically synthesized
aaaggcccagtgatttactt

SEQ ID NO: 506256 - DNA, 20 bp, Artificial Sequence
  chemically synthesized
agttattcaaatatattatt

SEQ ID NO: 506257 - DNA, 20 bp, Artificial Sequence
  chemically synthesized
aaacatcccaaataatatat

SEQ ID NO: 506258 - DNA, 20 bp, Artificial Sequence
  chemically synthesized
acattagaatttgtgtatac

SEQ ID NO: 506259 - DNA, 20 bp, Artificial Sequence
  chemically synthesized
actcatggaacacttgacat

SEQ ID NO: 506260 - DNA, 20 bp, Artificial Sequence
  chemically synthesized
attctaatgtcaagtgttcc

SEQ ID NO: 506261 - DNA, 20 bp, Artificial Sequence
  chemically synthesized
ttaacgttctttcttaatct

SEQ ID NO: 506262 - DNA, 20 bp, Artificial Sequence
  chemically synthesized
aatcttagaattacaataac

SEQ ID NO: 506263 - DNA, 20 bp, Artificial Sequence
  chemically synthesized
aatgatggcaataaaatttt

SEQ ID NO: 506264 - DNA, 20 bp, Artificial Sequence
  chemically synthesized
gttaggtattatgtaaatca

SEQ ID NO: 506265 - DNA, 20 bp, Artificial Sequence
  chemically synthesized
cttatctaaaatgcataatt

SEQ ID NO: 506266 - DNA, 20 bp, Artificial Sequence
  chemically synthesized
ctgatctttttgtgactatt

SEQ ID NO: 506267 - DNA, 20 bp, Artificial Sequence
  chemically synthesized
aagtcttatcttgaaggtgt

SEQ ID NO: 506268 - DNA, 20 bp, Artificial Sequence
  chemically synthesized
ttctgtaattactcctgatt

SEQ ID NO: 506269 - DNA, 20 bp, Artificial Sequence
  chemically synthesized
cagtctgcgcatcctaaatc

SEQ ID NO: 506270 - DNA, 20 bp, Artificial Sequence
  chemically synthesized
atcatgttctcgtaaactac

SEQ ID NO: 506271 - DNA, 20 bp, Artificial Sequence
  chemically synthesized
tgttctcgtaaactaccagg

SEQ ID NO: 506272 - DNA, 20 bp, Artificial Sequence
  chemically synthesized
agaagtacacctataataga

SEQ ID NO: 506273 - DNA, 20 bp, Artificial Sequence
  chemically synthesized
ccttataaagggcctgcttg

SEQ ID NO: 506274 - DNA, 20 bp, Artificial Sequence
  chemically synthesized
aaaagaaagaaagaaacttt

SEQ ID NO: 506275 - DNA, 20 bp, Artificial Sequence
  chemically synthesized
ttaatggaaatggtgttttc

SEQ ID NO: 506276 - DNA, 20 bp, Artificial Sequence
  chemically synthesized
aactgacattacaggtaccc

SEQ ID NO: 506277 - DNA, 20 bp, Artificial Sequence
  chemically synthesized
cagcaatatttccagaatcc

SEQ ID NO: 506278 - DNA, 20 bp, Artificial Sequence
  chemically synthesized
tttcacttcagcaatatttc

SEQ ID NO: 506279 - DNA, 20 bp, Artificial Sequence
  chemically synthesized
caccaacaaaactgctgtaa

SEQ ID NO: 506280 - DNA, 20 bp, Artificial Sequence
  chemically synthesized
ctctcaccttttcctaattt

SEQ ID NO: 506281 - DNA, 20 bp, Artificial Sequence
  chemically synthesized
aaaagaagaggcagattact

SEQ ID NO: 506282 - DNA, 20 bp, Artificial Sequence
  chemically synthesized
tcctcttgagcatgctttac

SEQ ID NO: 506283 - DNA, 20 bp, Artificial Sequence
  chemically synthesized
gttgtctgtgttagtgatgg

SEQ ID NO: 506284 - DNA, 20 bp, Artificial Sequence
  chemically synthesized
agacttcagtaaagactgct

SEQ ID NO: 506285 - DNA, 20 bp, Artificial Sequence
  chemically synthesized
tggtcaaactgtaggaaata

SEQ ID NO: 506286 - DNA, 20 bp, Artificial Sequence
  chemically synthesized
gggggcagaggagaaaaatg

SEQ ID NO: 506287 - DNA, 20 bp, Artificial Sequence
  chemically synthesized
atgtagaattaactatcaga

SEQ ID NO: 506288 - DNA, 20 bp, Artificial Sequence
  chemically synthesized
cagcatgtagaattaactat

SEQ ID NO: 506289 - DNA, 20 bp, Artificial Sequence
  chemically synthesized
taaacattttaaacagcatg

SEQ ID NO: 506290 - DNA, 20 bp, Artificial Sequence
  chemically synthesized
tttaaaatgtttacattaat

SEQ ID NO: 506291 - DNA, 20 bp, Artificial Sequence
  chemically synthesized
atttaaaatgttctaggcaa

SEQ ID NO: 506292 - DNA, 20 bp, Artificial Sequence
  chemically synthesized
aaatgcttattaatagtttg

SEQ ID NO: 506293 - DNA, 20 bp, Artificial Sequence
  chemically synthesized
ctgtttcacttatttgatta

SEQ ID NO: 506294 - DNA, 20 bp, Artificial Sequence
  chemically synthesized
agtccatatatatctttatg

SEQ ID NO: 506295 - DNA, 20 bp, Artificial Sequence
  chemically synthesized
agtagtgtgttttttagcat

SEQ ID NO: 506296 - DNA, 20 bp, Artificial Sequence
  chemically synthesized
atcactaatttaaatcaaac

SEQ ID NO: 506297 - DNA, 20 bp, Artificial Sequence
  chemically synthesized
tagtgattatgttcaaatat

SEQ ID NO: 506298 - DNA, 20 bp, Artificial Sequence
  chemically synthesized
accaagaagtgtctccagtg

SEQ ID NO: 506299 - DNA, 20 bp, Artificial Sequence
  chemically synthesized
actggagacacttcttggtt

SEQ ID NO: 506300 - DNA, 20 bp, Artificial Sequence
  chemically synthesized
ggcaacagttcatccatctt

SEQ ID NO: 506301 - DNA, 20 bp, Artificial Sequence
  chemically synthesized
caaaatgtattattccaaag

SEQ ID NO: 506302 - DNA, 20 bp, Artificial Sequence
  chemically synthesized
gtgagacggagaatatgata

SEQ ID NO: 506303 - DNA, 20 bp, Artificial Sequence
  chemically synthesized
gagaggagctctgtgagacg

SEQ ID NO: 506304 - DNA, 20 bp, Artificial Sequence
  chemically synthesized
acgattgtaacgttacctct

SEQ ID NO: 506305 - DNA, 20 bp, Artificial Sequence
  chemically synthesized
catataagttggattgccag

SEQ ID NO: 506306 - DNA, 20 bp, Artificial Sequence
  chemically synthesized
aaacagaccttgcatataag

SEQ ID NO: 506307 - DNA, 20 bp, Artificial Sequence
  chemically synthesized
ctggttacaagcaaaggagc

SEQ ID NO: 506308 - DNA, 20 bp, Artificial Sequence
  chemically synthesized
gcaaaggagcagggatctgg

SEQ ID NO: 506309 - DNA, 20 bp, Artificial Sequence
  chemically synthesized
aattcaggaaaattgctaaa

SEQ ID NO: 506310 - DNA, 20 bp, Artificial Sequence
  chemically synthesized
gattcattttagcaattttc

SEQ ID NO: 506311 - DNA, 20 bp, Artificial Sequence
  chemically synthesized
aatttgccaagaggtaaggg

SEQ ID NO: 506312 - DNA, 20 bp, Artificial Sequence
  chemically synthesized
ttcccatttcctcacatgaa

SEQ ID NO: 506313 - DNA, 20 bp, Artificial Sequence
  chemically synthesized
tgaggaaatgggaaaagcct

SEQ ID NO: 506314 - DNA, 20 bp, Artificial Sequence
  chemically synthesized
aaattggcaatgaacagtga

SEQ ID NO: 506315 - DNA, 20 bp, Artificial Sequence
  chemically synthesized
tttacctatgtgagggactg

SEQ ID NO: 506316 - DNA, 20 bp, Artificial Sequence
  chemically synthesized
tttccattttggtaggctaa

SEQ ID NO: 506317 - DNA, 20 bp, Artificial Sequence
  chemically synthesized
tggtaggctaaaaggatact

SEQ ID NO: 506318 - DNA, 20 bp, Artificial Sequence
  chemically synthesized
agcacaggttttatcttctc

SEQ ID NO: 506319 - DNA, 20 bp, Artificial Sequence
  chemically synthesized
atctccatagattcattatt

SEQ ID NO: 506320 - DNA, 20 bp, Artificial Sequence
  chemically synthesized
tcagtgattcattctaaata

SEQ ID NO: 506321 - DNA, 20 bp, Artificial Sequence
  chemically synthesized
ccatagattcattatttaga

SEQ ID NO: 506322 - DNA, 20 bp, Artificial Sequence
  chemically synthesized
ttttgtgttgggtgcaatgt

SEQ ID NO: 506323 - DNA, 20 bp, Artificial Sequence
  chemically synthesized
cacgtaatggtcattttgtg

SEQ ID NO: 506324 - DNA, 20 bp, Artificial Sequence
  chemically synthesized
aaagaaaatgtagtttttag

SEQ ID NO: 506325 - DNA, 20 bp, Artificial Sequence
  chemically synthesized
aattacaaagtaaatgctct

SEQ ID NO: 506326 - DNA, 20 bp, Artificial Sequence
  chemically synthesized
aagagcatttactttgtaat

SEQ ID NO: 506327 - DNA, 20 bp, Artificial Sequence
  chemically synthesized
aaagaaaatgcagtttttag

SEQ ID NO: 506328 - DNA, 20 bp, Artificial Sequence
  chemically synthesized
aataaaaaaataaattatct

SEQ ID NO: 506329 - DNA, 20 bp, Artificial Sequence
  chemically synthesized
aagataatttatttttttat

SEQ ID NO: 506330 - DNA, 20 bp, Artificial Sequence
  chemically synthesized
ctaattttaaacatacagac

SEQ ID NO: 506331 - DNA, 20 bp, Artificial Sequence
  chemically synthesized
atgaattagcttggtatttt

SEQ ID NO: 506332 - DNA, 20 bp, Artificial Sequence
  chemically synthesized
atgagattggatataactgc

SEQ ID NO: 506333 - DNA, 20 bp, Artificial Sequence
  chemically synthesized
agcacaaatgttctatgaga

SEQ ID NO: 506334 - DNA, 20 bp, Artificial Sequence
  chemically synthesized
aatattacagaaattaattt

SEQ ID NO: 506335 - DNA, 20 bp, Artificial Sequence
  chemically synthesized
cgtggtatctacttataaaa

SEQ ID NO: 506336 - DNA, 20 bp, Artificial Sequence
  chemically synthesized
attggatacatgtgcccatg

SEQ ID NO: 506337 - DNA, 20 bp, Artificial Sequence
  chemically synthesized
catttttctttcttaaaagg

SEQ ID NO: 506338 - DNA, 20 bp, Artificial Sequence
  chemically synthesized
caaccttttaagaaagaaaa

SEQ ID NO: 506339 - DNA, 20 bp, Artificial Sequence
  chemically synthesized
aaatgaatcatttttaataa

SEQ ID NO: 506340 - DNA, 20 bp, Artificial Sequence
  chemically synthesized
taataaaagagtagtaagac

SEQ ID NO: 506341 - DNA, 20 bp, Artificial Sequence
  chemically synthesized
aaatactacttcatttcctt

SEQ ID NO: 506342 - DNA, 20 bp, Artificial Sequence
  chemically synthesized
ttctaccctatatttacagg

SEQ ID NO: 506343 - DNA, 20 bp, Artificial Sequence
  chemically synthesized
gtgcattcaccctgtaaata

SEQ ID NO: 506344 - DNA, 20 bp, Artificial Sequence
  chemically synthesized
tgagttctaccctatattta

SEQ ID NO: 506345 - DNA, 20 bp, Artificial Sequence
  chemically synthesized
ttattaatttgttatatgta

SEQ ID NO: 506346 - DNA, 20 bp, Artificial Sequence
  chemically synthesized
gattgtatgaagtaggtttt

SEQ ID NO: 506347 - DNA, 20 bp, Artificial Sequence
  chemically synthesized
caaaacctacttcatacaat

SEQ ID NO: 506348 - DNA, 20 bp, Artificial Sequence
  chemically synthesized
attgacacttaattatgtgt

SEQ ID NO: 506349 - DNA, 20 bp, Artificial Sequence
  chemically synthesized
gaaaggagctttctgtttca

SEQ ID NO: 506350 - DNA, 20 bp, Artificial Sequence
  chemically synthesized
aagatgttcttaacaaccag

SEQ ID NO: 506351 - DNA, 20 bp, Artificial Sequence
  chemically synthesized
aagaggaagtcttaatcagg

SEQ ID NO: 506352 - DNA, 20 bp, Artificial Sequence
  chemically synthesized
tcctcttgttaaaacttgtt

SEQ ID NO: 506353 - DNA, 20 bp, Artificial Sequence
  chemically synthesized
gttaaaacttgttttgagtt

SEQ ID NO: 506354 - DNA, 20 bp, Artificial Sequence
  chemically synthesized
ttttgagttctgaatgaaag

SEQ ID NO: 506355 - DNA, 20 bp, Artificial Sequence
  chemically synthesized
ctgaatgaaagcagagtaaa

SEQ ID NO: 506356 - DNA, 20 bp, Artificial Sequence
  chemically synthesized
gattattagatttcaaatct

SEQ ID NO: 506357 - DNA, 20 bp, Artificial Sequence
  chemically synthesized
agtttgaaaatgatatttat

SEQ ID NO: 506358 - DNA, 20 bp, Artificial Sequence
  chemically synthesized
ctagcaaataactggcatta

SEQ ID NO: 506359 - DNA, 20 bp, Artificial Sequence
  chemically synthesized
agaaacattggttttggatg

SEQ ID NO: 506360 - DNA, 20 bp, Artificial Sequence
  chemically synthesized
aaagccaagaaacattggtt

SEQ ID NO: 506361 - DNA, 20 bp, Artificial Sequence
  chemically synthesized
ttggacaccatagtcaatca

SEQ ID NO: 506362 - DNA, 20 bp, Artificial Sequence
  chemically synthesized
ctgaataacttacacagttt

SEQ ID NO: 506363 - DNA, 20 bp, Artificial Sequence
  chemically synthesized
gaaaccttgtggttcagctg

SEQ ID NO: 506364 - DNA, 20 bp, Artificial Sequence
  chemically synthesized
ctataaaattctaatgttta

SEQ ID NO: 506365 - DNA, 20 bp, Artificial Sequence
  chemically synthesized
aatatatattcaataaacat

SEQ ID NO: 506366 - DNA, 20 bp, Artificial Sequence
  chemically synthesized
tcatttctgaatgtcctata

SEQ ID NO: 506367 - DNA, 20 bp, Artificial Sequence
  chemically synthesized
tcactataggacattcagaa

SEQ ID NO: 506368 - DNA, 20 bp, Artificial Sequence
  chemically synthesized
agtttctattttactcattt

SEQ ID NO: 506369 - DNA, 20 bp, Artificial Sequence
  chemically synthesized
tgccgtaaggttcctaaata

SEQ ID NO: 506370 - DNA, 20 bp, Artificial Sequence
  chemically synthesized
tcacacaaataattgtgaag

SEQ ID NO: 506371 - DNA, 20 bp, Artificial Sequence
  chemically synthesized
ataatatttatccttgttta

SEQ ID NO: 506372 - DNA, 20 bp, Artificial Sequence
  chemically synthesized
gttagaaagaccctataaac

SEQ ID NO: 506373 - DNA, 20 bp, Artificial Sequence
  chemically synthesized
gtttaagtacattatggtat

SEQ ID NO: 506374 - DNA, 20 bp, Artificial Sequence
  chemically synthesized
gtacattatggtatatgaat

SEQ ID NO: 506375 - DNA, 20 bp, Artificial Sequence
  chemically synthesized
ttatggtatatgaatgtgga

SEQ ID NO: 506376 - DNA, 20 bp, Artificial Sequence
  chemically synthesized
aaaacgtttgctttacacta

SEQ ID NO: 506377 - DNA, 20 bp, Artificial Sequence
  chemically synthesized
agaagaactttggaaactaa

SEQ ID NO: 506378 - DNA, 20 bp, Artificial Sequence
  chemically synthesized
tatttatatattaagatcta

SEQ ID NO: 506379 - DNA, 20 bp, Artificial Sequence
  chemically synthesized
attctaatgcattgagtgac

SEQ ID NO: 506380 - DNA, 20 bp, Artificial Sequence
  chemically synthesized
actcctgtcactcaatgcat

SEQ ID NO: 506381 - DNA, 20 bp, Artificial Sequence
  chemically synthesized
gttttcctcattctaatgca

SEQ ID NO: 506382 - DNA, 20 bp, Artificial Sequence
  chemically synthesized
aggaaaacttcaagcatgat

SEQ ID NO: 506383 - DNA, 20 bp, Artificial Sequence
  chemically synthesized
cactaaaatgtttaatatgg

SEQ ID NO: 506384 - DNA, 20 bp, Artificial Sequence
  chemically synthesized
taatatggcagagtcaaaac

SEQ ID NO: 506385 - DNA, 20 bp, Artificial Sequence
  chemically synthesized
tggcagagtcaaaactagaa

SEQ ID NO: 506386 - DNA, 20 bp, Artificial Sequence
  chemically synthesized
ttagctagatacaaagattg

SEQ ID NO: 506387 - DNA, 20 bp, Artificial Sequence
  chemically synthesized
atcaaaatgaagaaaggtga

SEQ ID NO: 506388 - DNA, 20 bp, Artificial Sequence
  chemically synthesized
cacctttcttcattttgatt

SEQ ID NO: 506389 - DNA, 20 bp, Artificial Sequence
  chemically synthesized
ttcttttcatgatatcattt

SEQ ID NO: 506390 - DNA, 20 bp, Artificial Sequence
  chemically synthesized
gaaattaacttgcagttaaa

SEQ ID NO: 506391 - DNA, 20 bp, Artificial Sequence
  chemically synthesized
atttgggagctgattcctct

SEQ ID NO: 506392 - DNA, 20 bp, Artificial Sequence
  chemically synthesized
ctacttataaccactctaag

SEQ ID NO: 506393 - DNA, 20 bp, Artificial Sequence
  chemically synthesized
aatgtcacagtgtataaact

SEQ ID NO: 506394 - DNA, 20 bp, Artificial Sequence
  chemically synthesized
attttcttcatctttaaagt

SEQ ID NO: 506395 - DNA, 20 bp, Artificial Sequence
  chemically synthesized
gggcttcctgttcaagacct

SEQ ID NO: 506396 - DNA, 20 bp, Artificial Sequence
  chemically synthesized
atgtagccagtcctggtttt

SEQ ID NO: 506397 - DNA, 20 bp, Artificial Sequence
  chemically synthesized
agaattaaatgatataatat

SEQ ID NO: 506398 - DNA, 20 bp, Artificial Sequence
  chemically synthesized
taaacgctcagggaaatttg

SEQ ID NO: 506399 - DNA, 20 bp, Artificial Sequence
  chemically synthesized
taatcttatgagtaagaagg

SEQ ID NO: 506400 - DNA, 20 bp, Artificial Sequence
  chemically synthesized
tttttaacatatgtaatctt

SEQ ID NO: 506401 - DNA, 20 bp, Artificial Sequence
  chemically synthesized
aatgctcttccaatttttct

SEQ ID NO: 506402 - DNA, 20 bp, Artificial Sequence
  chemically synthesized
ggcacaccctggaataatat

SEQ ID NO: 506403 - DNA, 20 bp, Artificial Sequence
  chemically synthesized
ccagcatcctgatattattc

SEQ ID NO: 506404 - DNA, 20 bp, Artificial Sequence
  chemically synthesized
ctgcaagaagaggcacaccc

SEQ ID NO: 506405 - DNA, 20 bp, Artificial Sequence
  chemically synthesized
agtacatcaaagcaaattta

SEQ ID NO: 506406 - DNA, 20 bp, Artificial Sequence
  chemically synthesized
accactgtctccagtttatt

SEQ ID NO: 506407 - DNA, 20 bp, Artificial Sequence
  chemically synthesized
ttgtctaaggatgaatttct

SEQ ID NO: 506408 - DNA, 20 bp, Artificial Sequence
  chemically synthesized
aaggacaaaattgtctaagg

SEQ ID NO: 506409 - DNA, 20 bp, Artificial Sequence
  chemically synthesized
gtacaaggacaaaattgtct

SEQ ID NO: 506410 - DNA, 20 bp, Artificial Sequence
  chemically synthesized
ttgtccttgtacgaacgccg

SEQ ID NO: 506411 - DNA, 20 bp, Artificial Sequence
  chemically synthesized
ctgtacagcatgtgactata

SEQ ID NO: 506412 - DNA, 20 bp, Artificial Sequence
  chemically synthesized
tattgtacctttcgatatgt

SEQ ID NO: 506413 - DNA, 20 bp, Artificial Sequence
  chemically synthesized
tacaataaaaatatgatata

SEQ ID NO: 506414 - DNA, 20 bp, Artificial Sequence
  chemically synthesized
agtgttgttggtataatttt

SEQ ID NO: 506415 - DNA, 20 bp, Artificial Sequence
  chemically synthesized
tttttattgcactgtggtcc

SEQ ID NO: 506416 - DNA, 20 bp, Artificial Sequence
  chemically synthesized
ggaaatcaaacaaactgctc

SEQ ID NO: 506417 - DNA, 20 bp, Artificial Sequence
  chemically synthesized
aaactgctcctgaatgacct

SEQ ID NO: 506418 - DNA, 20 bp, Artificial Sequence
  chemically synthesized
tttaaaaagatgtaacatac

SEQ ID NO: 506419 - DNA, 20 bp, Artificial Sequence
  chemically synthesized
gatccttctaactttttgat

SEQ ID NO: 506420 - DNA, 20 bp, Artificial Sequence
  chemically synthesized
cacccatatcaaaaagttag

SEQ ID NO: 506421 - DNA, 20 bp, Artificial Sequence
  chemically synthesized
tatttcctgtcttctagctt

SEQ ID NO: 506422 - DNA, 20 bp, Artificial Sequence
  chemically synthesized
aaaaagcacagaaaaggtca

SEQ ID NO: 506423 - DNA, 20 bp, Artificial Sequence
  chemically synthesized
aataaagatagaccactacc

SEQ ID NO: 506424 - DNA, 20 bp, Artificial Sequence
  chemically synthesized
tcattttttattgtgtttat

SEQ ID NO: 506425 - DNA, 20 bp, Artificial Sequence
  chemically synthesized
acacaataaaaaatgacaaa

SEQ ID NO: 506426 - DNA, 20 bp, Artificial Sequence
  chemically synthesized
aagggttttctctatttctg

SEQ ID NO: 506427 - DNA, 20 bp, Artificial Sequence
  chemically synthesized
gttcattatgaatagtctct

SEQ ID NO: 506428 - DNA, 20 bp, Artificial Sequence
  chemically synthesized
tgtgcataggggtgttcatt

SEQ ID NO: 506429 - DNA, 20 bp, Artificial Sequence
  chemically synthesized
gttttctagcttgtgtgcat

SEQ ID NO: 506430 - DNA, 20 bp, Artificial Sequence
  chemically synthesized
agctagaaaacctagaagca

SEQ ID NO: 506431 - DNA, 20 bp, Artificial Sequence
  chemically synthesized
aagtttgaaccaggaagaaa

SEQ ID NO: 506432 - DNA, 20 bp, Artificial Sequence
  chemically synthesized
aatcattgaacagaccaata

SEQ ID NO: 506433 - DNA, 20 bp, Artificial Sequence
  chemically synthesized
aggaccagacagattcacac

SEQ ID NO: 506434 - DNA, 20 bp, Artificial Sequence
  chemically synthesized
atatctgttagtattcaggt

SEQ ID NO: 506435 - DNA, 20 bp, Artificial Sequence
  chemically synthesized
atttttgggagtggtttcat

SEQ ID NO: 506436 - DNA, 20 bp, Artificial Sequence
  chemically synthesized
ggagccgctcctcaattttt

SEQ ID NO: 506437 - DNA, 20 bp, Artificial Sequence
  chemically synthesized
gacaatgcttccctcataga

SEQ ID NO: 506438 - DNA, 20 bp, Artificial Sequence
  chemically synthesized
tcaggacaatgcttccctca

SEQ ID NO: 506439 - DNA, 20 bp, Artificial Sequence
  chemically synthesized
atagatgcaaaaatagtcaa

SEQ ID NO: 506440 - DNA, 20 bp, Artificial Sequence
  chemically synthesized
ctttttgatgtgctgctgga

SEQ ID NO: 506441 - DNA, 20 bp, Artificial Sequence
  chemically synthesized
attagctttttgatgtgctg

SEQ ID NO: 506442 - DNA, 20 bp, Artificial Sequence
  chemically synthesized
atagaagctccttgatcatg

SEQ ID NO: 506443 - DNA, 20 bp, Artificial Sequence
  chemically synthesized
tgatcaaggagcttctatcc

SEQ ID NO: 506444 - DNA, 20 bp, Artificial Sequence
  chemically synthesized
ttgaatcaacctcgcaaccc

SEQ ID NO: 506445 - DNA, 20 bp, Artificial Sequence
  chemically synthesized
catttattgacttgtgtatg

SEQ ID NO: 506446 - DNA, 20 bp, Artificial Sequence
  chemically synthesized
ttttttgttctgtttatgtg

SEQ ID NO: 506447 - DNA, 20 bp, Artificial Sequence
  chemically synthesized
tgaaagggtgttgaatttta

SEQ ID NO: 506448 - DNA, 20 bp, Artificial Sequence
  chemically synthesized
atttttaacatgaaagggtg

SEQ ID NO: 506449 - DNA, 20 bp, Artificial Sequence
  chemically synthesized
gtcgaggatttttaacatga

SEQ ID NO: 506450 - DNA, 20 bp, Artificial Sequence
  chemically synthesized
ccttcagtgcctagtttgtc

SEQ ID NO: 506451 - DNA, 20 bp, Artificial Sequence
  chemically synthesized
agtccacagccaacattata

SEQ ID NO: 506452 - DNA, 20 bp, Artificial Sequence
  chemically synthesized
tctttcctgattgctttggc

SEQ ID NO: 506453 - DNA, 20 bp, Artificial Sequence
  chemically synthesized
ttgacttcctctcttcctat

SEQ ID NO: 506454 - DNA, 20 bp, Artificial Sequence
  chemically synthesized
gaacctcatcgtctgcaaac

SEQ ID NO: 506455 - DNA, 20 bp, Artificial Sequence
  chemically synthesized
gtgatatttatacattgatt

SEQ ID NO: 506456 - DNA, 20 bp, Artificial Sequence
  chemically synthesized
cttatttctttttgacaatt

SEQ ID NO: 506457 - DNA, 20 bp, Artificial Sequence
  chemically synthesized
caaaaagaaataagatacct

SEQ ID NO: 506458 - DNA, 20 bp, Artificial Sequence
  chemically synthesized
aggtgaaacactgctaaact

SEQ ID NO: 506459 - DNA, 20 bp, Artificial Sequence
  chemically synthesized
ccattttttgtgtgttatct

SEQ ID NO: 506460 - DNA, 20 bp, Artificial Sequence
  chemically synthesized
tattgattcttccatgagca

SEQ ID NO: 506461 - DNA, 20 bp, Artificial Sequence
  chemically synthesized
aaaatattctatgctcatgg

SEQ ID NO: 506462 - DNA, 20 bp, Artificial Sequence
  chemically synthesized
catggaagaatcaatattga

SEQ ID NO: 506463 - DNA, 20 bp, Artificial Sequence
  chemically synthesized
gtagttttttgggaatagca

SEQ ID NO: 506464 - DNA, 20 bp, Artificial Sequence
  chemically synthesized
aatgttattggtagtttttt

SEQ ID NO: 506465 - DNA, 20 bp, Artificial Sequence
  chemically synthesized
actaccaataacattcttca

SEQ ID NO: 506466 - DNA, 20 bp, Artificial Sequence
  chemically synthesized
agtctttttcttattcagtg

SEQ ID NO: 506467 - DNA, 20 bp, Artificial Sequence
  chemically synthesized
ggctcttttagtggctccaa

SEQ ID NO: 506468 - DNA, 20 bp, Artificial Sequence
  chemically synthesized
gttggagccactaaaagagc

SEQ ID NO: 506469 - DNA, 20 bp, Artificial Sequence
  chemically synthesized
ccagcttttttctttttgct

SEQ ID NO: 506470 - DNA, 20 bp, Artificial Sequence
  chemically synthesized
tatagtttgcagtcaggcaa

SEQ ID NO: 506471 - DNA, 20 bp, Artificial Sequence
  chemically synthesized
ctgactgcaaactatactac

SEQ ID NO: 506472 - DNA, 20 bp, Artificial Sequence
  chemically synthesized
agacacataaaccaatggaa

SEQ ID NO: 506473 - DNA, 20 bp, Artificial Sequence
  chemically synthesized
taaaccaatggaaaagaata

SEQ ID NO: 506474 - DNA, 20 bp, Artificial Sequence
  chemically synthesized
tggtgtaaggaaggggtcca

SEQ ID NO: 506475 - DNA, 20 bp, Artificial Sequence
  chemically synthesized
ttttgtatatggtgtaagga

SEQ ID NO: 506476 - DNA, 20 bp, Artificial Sequence
  chemically synthesized
tatacaaaaattaacccgag

SEQ ID NO: 506477 - DNA, 20 bp, Artificial Sequence
  chemically synthesized
atttaagtctttaatccacc

SEQ ID NO: 506478 - DNA, 20 bp, Artificial Sequence
  chemically synthesized
aatgtccagagtggcattac

SEQ ID NO: 506479 - DNA, 20 bp, Artificial Sequence
  chemically synthesized
gtctttgcagtttcaatgtc

SEQ ID NO: 506480 - DNA, 20 bp, Artificial Sequence
  chemically synthesized
acaacaaaagaaactatcaa

SEQ ID NO: 506481 - DNA, 20 bp, Artificial Sequence
  chemically synthesized
cagagtaaacagacaacctg

SEQ ID NO: 506482 - DNA, 20 bp, Artificial Sequence
  chemically synthesized
ttgcaaactttccatctgac

SEQ ID NO: 506483 - DNA, 20 bp, Artificial Sequence
  chemically synthesized
tctgacaagggtctaatatc

SEQ ID NO: 506484 - DNA, 20 bp, Artificial Sequence
  chemically synthesized
tatgtatgtctttttctgga

SEQ ID NO: 506485 - DNA, 20 bp, Artificial Sequence
  chemically synthesized
gatgttcagcattttttcat

SEQ ID NO: 506486 - DNA, 20 bp, Artificial Sequence
  chemically synthesized
agataccatttgacaccagt

SEQ ID NO: 506487 - DNA, 20 bp, Artificial Sequence
  chemically synthesized
atttcccaaacaacgaaaac

SEQ ID NO: 506488 - DNA, 20 bp, Artificial Sequence
  chemically synthesized
caataattgttattgctggg

SEQ ID NO: 506489 - DNA, 20 bp, Artificial Sequence
  chemically synthesized
atacccaataattgttattg

SEQ ID NO: 506490 - DNA, 20 bp, Artificial Sequence
  chemically synthesized
cgacccagcaataacaatta

SEQ ID NO: 506491 - DNA, 20 bp, Artificial Sequence
  chemically synthesized
caattattgggtataccaag

SEQ ID NO: 506492 - DNA, 20 bp, Artificial Sequence
  chemically synthesized
tgcatgtgtctttagggttg

SEQ ID NO: 506493 - DNA, 20 bp, Artificial Sequence
  chemically synthesized
catacatgtgcatgtgtctt

SEQ ID NO: 506494 - DNA, 20 bp, Artificial Sequence
  chemically synthesized
gattccatgtgtttgctatt

SEQ ID NO: 506495 - DNA, 20 bp, Artificial Sequence
  chemically synthesized
tattcacaatagcaaacaca

SEQ ID NO: 506496 - DNA, 20 bp, Artificial Sequence
  chemically synthesized
aaatgcccatcagtggtaga

SEQ ID NO: 506497 - DNA, 20 bp, Artificial Sequence
  chemically synthesized
aatgtggtacatatacactg

SEQ ID NO: 506498 - DNA, 20 bp, Artificial Sequence
  chemically synthesized
tctcttttttcatggctgca

SEQ ID NO: 506499 - DNA, 20 bp, Artificial Sequence
  chemically synthesized
ttgtgttctttgcagcaaac

SEQ ID NO: 506500 - DNA, 20 bp, Artificial Sequence
  chemically synthesized
tgttattgtgttagtttgct

SEQ ID NO: 506501 - DNA, 20 bp, Artificial Sequence
  chemically synthesized
cgtgtctgttgtccccttct

SEQ ID NO: 506502 - DNA, 20 bp, Artificial Sequence
  chemically synthesized
cggtggtctatgtgaggctg

SEQ ID NO: 506503 - DNA, 20 bp, Artificial Sequence
  chemically synthesized
gtgaggctggagggtaagag

SEQ ID NO: 506504 - DNA, 20 bp, Artificial Sequence
  chemically synthesized
ctggagggtaagaggagggt

SEQ ID NO: 506505 - DNA, 20 bp, Artificial Sequence
  chemically synthesized
aggattaaaaaaactactta

SEQ ID NO: 506506 - DNA, 20 bp, Artificial Sequence
  chemically synthesized
ttgggtactatgcttattac

SEQ ID NO: 506507 - DNA, 20 bp, Artificial Sequence
  chemically synthesized
atagataaattgcatgtcac

SEQ ID NO: 506508 - DNA, 20 bp, Artificial Sequence
  chemically synthesized
aatttaaaattaaagaatag

SEQ ID NO: 506509 - DNA, 20 bp, Artificial Sequence
  chemically synthesized
acaaaatgaatttaaaatta

SEQ ID NO: 506510 - DNA, 20 bp, Artificial Sequence
  chemically synthesized
aaaataacagcataaacaaa

SEQ ID NO: 506511 - DNA, 20 bp, Artificial Sequence
  chemically synthesized
acagaattcaacatgaggat

SEQ ID NO: 506512 - DNA, 20 bp, Artificial Sequence
  chemically synthesized
tccccacccaaatcctcatg

SEQ ID NO: 506513 - DNA, 20 bp, Artificial Sequence
  chemically synthesized
ctgaagacagaattcaacat

SEQ ID NO: 506514 - DNA, 20 bp, Artificial Sequence
  chemically synthesized
ccttcctccaacactgaaga

SEQ ID NO: 506515 - DNA, 20 bp, Artificial Sequence
  chemically synthesized
aagggcctggtgggagggga

SEQ ID NO: 506516 - DNA, 20 bp, Artificial Sequence
  chemically synthesized
tggtgggaggggactgaatc

SEQ ID NO: 506517 - DNA, 20 bp, Artificial Sequence
  chemically synthesized
ccccttgctgctctcctgat

SEQ ID NO: 506518 - DNA, 20 bp, Artificial Sequence
  chemically synthesized
cagactggccacgatctggc

SEQ ID NO: 506519 - DNA, 20 bp, Artificial Sequence
  chemically synthesized
acccagtgaggaggatggat

SEQ ID NO: 506520 - DNA, 20 bp, Artificial Sequence
  chemically synthesized
ggtcccacccagtgaggagg

SEQ ID NO: 506521 - DNA, 20 bp, Artificial Sequence
  chemically synthesized
accctgatccatcctcctca

SEQ ID NO: 506522 - DNA, 20 bp, Artificial Sequence
  chemically synthesized
gggaggtcccacccagtgag

SEQ ID NO: 506523 - DNA, 20 bp, Artificial Sequence
  chemically synthesized
ggggcttcagccattccacc

SEQ ID NO: 506524 - DNA, 20 bp, Artificial Sequence
  chemically synthesized
tctatccattgaatcctggg

SEQ ID NO: 506525 - DNA, 20 bp, Artificial Sequence
  chemically synthesized
gccattccacccaggattca

SEQ ID NO: 506526 - DNA, 20 bp, Artificial Sequence
  chemically synthesized
agagctctatccattgaatc

SEQ ID NO: 506527 - DNA, 20 bp, Artificial Sequence
  chemically synthesized
agagatcagagctctatcca

SEQ ID NO: 506528 - DNA, 20 bp, Artificial Sequence
  chemically synthesized
agaacaaagagacaatttat

SEQ ID NO: 506529 - DNA, 20 bp, Artificial Sequence
  chemically synthesized
tggattcatttagttttttg

SEQ ID NO: 506530 - DNA, 20 bp, Artificial Sequence
  chemically synthesized
aaaaccctccaaaaaactaa

SEQ ID NO: 506531 - DNA, 20 bp, Artificial Sequence
  chemically synthesized
ttttttccaaaaaccagctc

SEQ ID NO: 506532 - DNA, 20 bp, Artificial Sequence
  chemically synthesized
taataaggaagaaaagagag

SEQ ID NO: 506533 - DNA, 20 bp, Artificial Sequence
  chemically synthesized
acacaatgaaaaatttgaag

SEQ ID NO: 506534 - DNA, 20 bp, Artificial Sequence
  chemically synthesized
gatggttgtttgtatttctg

SEQ ID NO: 506535 - DNA, 20 bp, Artificial Sequence
  chemically synthesized
agaaatacaaacaaccatca

SEQ ID NO: 506536 - DNA, 20 bp, Artificial Sequence
  chemically synthesized
aactagaaaacctagaggaa

SEQ ID NO: 506537 - DNA, 20 bp, Artificial Sequence
  chemically synthesized
aagactgaaccataaaggaa

SEQ ID NO: 506538 - DNA, 20 bp, Artificial Sequence
  chemically synthesized
accataaaggaaatgaattg

SEQ ID NO: 506539 - DNA, 20 bp, Artificial Sequence
  chemically synthesized
cctgggcttttgttggttgg

SEQ ID NO: 506540 - DNA, 20 bp, Artificial Sequence
  chemically synthesized
aacaaaagcccaggtccaga

SEQ ID NO: 506541 - DNA, 20 bp, Artificial Sequence
  chemically synthesized
aggtccagatggaatcatag

SEQ ID NO: 506542 - DNA, 20 bp, Artificial Sequence
  chemically synthesized
gctcttctttgtaccgctag

SEQ ID NO: 506543 - DNA, 20 bp, Artificial Sequence
  chemically synthesized
tcccttcttttcaatttttt

SEQ ID NO: 506544 - DNA, 20 bp, Artificial Sequence
  chemically synthesized
ttccaaaaaaattgaaaaga

SEQ ID NO: 506545 - DNA, 20 bp, Artificial Sequence
  chemically synthesized
tccctcccaggttttggcat

SEQ ID NO: 506546 - DNA, 20 bp, Artificial Sequence
  chemically synthesized
ggatttggtttgctggtatt

SEQ ID NO: 506547 - DNA, 20 bp, Artificial Sequence
  chemically synthesized
ataagctttttgatatgcta

SEQ ID NO: 506548 - DNA, 20 bp, Artificial Sequence
  chemically synthesized
atgaagcaaacttgattgtg

SEQ ID NO: 506549 - DNA, 20 bp, Artificial Sequence
  chemically synthesized
ttaaactaaccttgcatgct

SEQ ID NO: 506550 - DNA, 20 bp, Artificial Sequence
  chemically synthesized
tctttagttctgtttatgtg

SEQ ID NO: 506551 - DNA, 20 bp, Artificial Sequence
  chemically synthesized
atttttaacatgaagggatg

SEQ ID NO: 506552 - DNA, 20 bp, Artificial Sequence
  chemically synthesized
attgagaatttttaacatga

SEQ ID NO: 506553 - DNA, 20 bp, Artificial Sequence
  chemically synthesized
ccttcgatacctagtttatt

SEQ ID NO: 506554 - DNA, 20 bp, Artificial Sequence
  chemically synthesized
tagcttttgcccatttggat

SEQ ID NO: 506555 - DNA, 20 bp, Artificial Sequence
  chemically synthesized
tgcttctagcttttgcccat

SEQ ID NO: 506556 - DNA, 20 bp, Artificial Sequence
  chemically synthesized
atcttgggccagttttcagg

SEQ ID NO: 506557 - DNA, 20 bp, Artificial Sequence
  chemically synthesized
cctgaaaactggcccaagat

SEQ ID NO: 506558 - DNA, 20 bp, Artificial Sequence
  chemically synthesized
cttccaatactatgttgaaa

SEQ ID NO: 506559 - DNA, 20 bp, Artificial Sequence
  chemically synthesized
tcagggaagagaaagaaata

SEQ ID NO: 506560 - DNA, 20 bp, Artificial Sequence
  chemically synthesized
ttgacttcctctcttcctat

SEQ ID NO: 506561 - DNA, 20 bp, Artificial Sequence
  chemically synthesized
tggatataggttcatgtcat

SEQ ID NO: 506562 - DNA, 20 bp, Artificial Sequence
  chemically synthesized
gctgagacaatgggggtttt

SEQ ID NO: 506563 - DNA, 20 bp, Artificial Sequence
  chemically synthesized
agcttttgggctgagacaat

SEQ ID NO: 506564 - DNA, 20 bp, Artificial Sequence
  chemically synthesized
ggttacagtcaccagaaaag

SEQ ID NO: 506565 - DNA, 20 bp, Artificial Sequence
  chemically synthesized
agacacatagaccaatgaaa

SEQ ID NO: 506566 - DNA, 20 bp, Artificial Sequence
  chemically synthesized
gtaggtgcgtggtcttattt

SEQ ID NO: 506567 - DNA, 20 bp, Artificial Sequence
  chemically synthesized
gcctatttaatacatagtgc

SEQ ID NO: 506568 - DNA, 20 bp, Artificial Sequence
  chemically synthesized
tatacaaaaattaactcaag

SEQ ID NO: 506569 - DNA, 20 bp, Artificial Sequence
  chemically synthesized
atttaagtctttaatccatc

SEQ ID NO: 506570 - DNA, 20 bp, Artificial Sequence
  chemically synthesized
cttctaaggtttttattgtt

SEQ ID NO: 506571 - DNA, 20 bp, Artificial Sequence
  chemically synthesized
cctttgcccatgcctatgtc

SEQ ID NO: 506572 - DNA, 20 bp, Artificial Sequence
  chemically synthesized
caaaagcaaaaactgacaaa

SEQ ID NO: 506573 - DNA, 20 bp, Artificial Sequence
  chemically synthesized
acagcaaaataaactaccgt

SEQ ID NO: 506574 - DNA, 20 bp, Artificial Sequence
  chemically synthesized
cagagtaaataaacagccta

SEQ ID NO: 506575 - DNA, 20 bp, Artificial Sequence
  chemically synthesized
agactctggaccattgtcag

SEQ ID NO: 506576 - DNA, 20 bp, Artificial Sequence
  chemically synthesized
ctatccatctgacaatggtc

SEQ ID NO: 506577 - DNA, 20 bp, Artificial Sequence
  chemically synthesized
ttctctcatgatcaatgatg

SEQ ID NO: 506578 - DNA, 20 bp, Artificial Sequence
  chemically synthesized
agataacatctcacgccagt

SEQ ID NO: 506579 - DNA, 20 bp, Artificial Sequence
  chemically synthesized
aacacttttacactcttggt

SEQ ID NO: 506580 - DNA, 20 bp, Artificial Sequence
  chemically synthesized
aactaatttacactcccacc

SEQ ID NO: 506581 - DNA, 20 bp, Artificial Sequence
  chemically synthesized
atctccgcattgtcttccac

SEQ ID NO: 506582 - DNA, 20 bp, Artificial Sequence
  chemically synthesized
ttaagccagcaatcccatta

SEQ ID NO: 506583 - DNA, 20 bp, Artificial Sequence
  chemically synthesized
tttgggtatatacccagtaa

SEQ ID NO: 506584 - DNA, 20 bp, Artificial Sequence
  chemically synthesized
tataatagaatgatttatat

SEQ ID NO: 506585 - DNA, 20 bp, Artificial Sequence
  chemically synthesized
acatgcatgtatctttataa

SEQ ID NO: 506586 - DNA, 20 bp, Artificial Sequence
  chemically synthesized
tatacacaatagcaaagaca

SEQ ID NO: 506587 - DNA, 20 bp, Artificial Sequence
  chemically synthesized
aatgtggtacatttacacca

SEQ ID NO: 506588 - DNA, 20 bp, Artificial Sequence
  chemically synthesized
ctataatgccacaaacacga

SEQ ID NO: 506589 - DNA, 20 bp, Artificial Sequence
  chemically synthesized
ctataaagacatacctgaaa

SEQ ID NO: 506590 - DNA, 20 bp, Artificial Sequence
  chemically synthesized
gaaagttaaaagtttcaatt

SEQ ID NO: 506591 - DNA, 20 bp, Artificial Sequence
  chemically synthesized
ttgtaacttttttgttatgc

SEQ ID NO: 506592 - DNA, 20 bp, Artificial Sequence
  chemically synthesized
cttttgagatattctagtat

SEQ ID NO: 506593 - DNA, 20 bp, Artificial Sequence
  chemically synthesized
gtatctaaatattcaaatac

SEQ ID NO: 506594 - DNA, 20 bp, Artificial Sequence
  chemically synthesized
agtaactaatactttatagc

SEQ ID NO: 506595 - DNA, 20 bp, Artificial Sequence
  chemically synthesized
caaaacacttattgtaatgc

SEQ ID NO: 506596 - DNA, 20 bp, Artificial Sequence
  chemically synthesized
caggcattacaataagtgtt

SEQ ID NO: 506597 - DNA, 20 bp, Artificial Sequence
  chemically synthesized
agggagtttttctagatctt

SEQ ID NO: 506598 - DNA, 20 bp, Artificial Sequence
  chemically synthesized
aaagctttacaacatagcaa

SEQ ID NO: 506599 - DNA, 20 bp, Artificial Sequence
  chemically synthesized
tatgacctcacaatggccct

SEQ ID NO: 506600 - DNA, 20 bp, Artificial Sequence
  chemically synthesized
gtcactttcatctataaaat

SEQ ID NO: 506601 - DNA, 20 bp, Artificial Sequence
  chemically synthesized
gcatagatataaatccaagt

SEQ ID NO: 506602 - DNA, 20 bp, Artificial Sequence
  chemically synthesized
ggatgaatgaacattcagac

SEQ ID NO: 506603 - DNA, 20 bp, Artificial Sequence
  chemically synthesized
gcatagctgataagagttgg

SEQ ID NO: 506604 - DNA, 20 bp, Artificial Sequence
  chemically synthesized
gtgagcatagctgataagag

SEQ ID NO: 506605 - DNA, 20 bp, Artificial Sequence
  chemically synthesized
agcaagtgagcatagctgat

SEQ ID NO: 506606 - DNA, 20 bp, Artificial Sequence
  chemically synthesized
tcctacacttgtacactttt

SEQ ID NO: 506607 - DNA, 20 bp, Artificial Sequence
  chemically synthesized
tgaatggtggtttcctttta

SEQ ID NO: 506608 - DNA, 20 bp, Artificial Sequence
  chemically synthesized
tacacacacatatataaatt

SEQ ID NO: 506609 - DNA, 20 bp, Artificial Sequence
  chemically synthesized
ttgtttacaatttcagtatt

SEQ ID NO: 506610 - DNA, 20 bp, Artificial Sequence
  chemically synthesized
catcataactattatatagg

SEQ ID NO: 506611 - DNA, 20 bp, Artificial Sequence
  chemically synthesized
agagccaaacatatttaaca

SEQ ID NO: 506612 - DNA, 20 bp, Artificial Sequence
  chemically synthesized
acacaatcaggttgacaact

SEQ ID NO: 506613 - DNA, 20 bp, Artificial Sequence
  chemically synthesized
tctatgtatatgtaaccctt

SEQ ID NO: 506614 - DNA, 20 bp, Artificial Sequence
  chemically synthesized
aaaacttattgatcactcca

SEQ ID NO: 506615 - DNA, 20 bp, Artificial Sequence
  chemically synthesized
ataagttttaatgggcatgg

SEQ ID NO: 506616 - DNA, 20 bp, Artificial Sequence
  chemically synthesized
gccttgtgctaccatgcctg

SEQ ID NO: 506617 - DNA, 20 bp, Artificial Sequence
  chemically synthesized
atttatatgttgaactttgg

SEQ ID NO: 506618 - DNA, 20 bp, Artificial Sequence
  chemically synthesized
gaccatctgatcttttgccc

SEQ ID NO: 506619 - DNA, 20 bp, Artificial Sequence
  chemically synthesized
tcagatggtcacaaaggaag

SEQ ID NO: 506620 - DNA, 20 bp, Artificial Sequence
  chemically synthesized
gaagctgagttactaatcac

SEQ ID NO: 506621 - DNA, 20 bp, Artificial Sequence
  chemically synthesized
gtatagaggacttcccatag

SEQ ID NO: 506622 - DNA, 20 bp, Artificial Sequence
  chemically synthesized
atagctgaatgtagcataca

SEQ ID NO: 506623 - DNA, 20 bp, Artificial Sequence
  chemically synthesized
ctgtaaggtaataaaatttc

SEQ ID NO: 506624 - DNA, 20 bp, Artificial Sequence
  chemically synthesized
aaattggacagacagtttta

SEQ ID NO: 506625 - DNA, 20 bp, Artificial Sequence
  chemically synthesized
gaagagatgtatgttgtctt

SEQ ID NO: 506626 - DNA, 20 bp, Artificial Sequence
  chemically synthesized
gctcaaattccgtatttaat

SEQ ID NO: 506627 - DNA, 20 bp, Artificial Sequence
  chemically synthesized
ttctggattcatattaaata

SEQ ID NO: 506628 - DNA, 20 bp, Artificial Sequence
  chemically synthesized
tacggaatttgagcaactgt

SEQ ID NO: 506629 - DNA, 20 bp, Artificial Sequence
  chemically synthesized
ggtatgtagaggaaggccag

SEQ ID NO: 506630 - DNA, 20 bp, Artificial Sequence
  chemically synthesized
atgaaacacattctataatt

SEQ ID NO: 506631 - DNA, 20 bp, Artificial Sequence
  chemically synthesized
ataatatccatccctaatta

SEQ ID NO: 506632 - DNA, 20 bp, Artificial Sequence
  chemically synthesized
aacacattctataattaggg

SEQ ID NO: 506633 - DNA, 20 bp, Artificial Sequence
  chemically synthesized
gtattttaatgacatactca

SEQ ID NO: 506634 - DNA, 20 bp, Artificial Sequence
  chemically synthesized
aaattattacactgtattca

SEQ ID NO: 506635 - DNA, 20 bp, Artificial Sequence
  chemically synthesized
atttcataattaagtctcct

SEQ ID NO: 506636 - DNA, 20 bp, Artificial Sequence
  chemically synthesized
taattaagtctcctttgaat

SEQ ID NO: 506637 - DNA, 20 bp, Artificial Sequence
  chemically synthesized
aagtctcctttgaataggga

SEQ ID NO: 506638 - DNA, 20 bp, Artificial Sequence
  chemically synthesized
gcctttccagtggcaaaagt

SEQ ID NO: 506639 - DNA, 20 bp, Artificial Sequence
  chemically synthesized
atcttcttcactaagtactc

SEQ ID NO: 506640 - DNA, 20 bp, Artificial Sequence
  chemically synthesized
tttgcttttatgtgaaactc

SEQ ID NO: 506641 - DNA, 20 bp, Artificial Sequence
  chemically synthesized
gcagatttctatagtggcca

SEQ ID NO: 506642 - DNA, 20 bp, Artificial Sequence
  chemically synthesized
ttcctttaaatttataaata

SEQ ID NO: 506643 - DNA, 20 bp, Artificial Sequence
  chemically synthesized
aataaagaatgagagattcc

SEQ ID NO: 506644 - DNA, 20 bp, Artificial Sequence
  chemically synthesized
attcagtctgagttaactct

SEQ ID NO: 506645 - DNA, 20 bp, Artificial Sequence
  chemically synthesized
attccaagagttaactcaga

SEQ ID NO: 506646 - DNA, 20 bp, Artificial Sequence
  chemically synthesized
aaaaatttaatacattcagt

SEQ ID NO: 506647 - DNA, 20 bp, Artificial Sequence
  chemically synthesized
tccaactataataggtattt

SEQ ID NO: 506648 - DNA, 20 bp, Artificial Sequence
  chemically synthesized
tctcgctctgtcatcccggc

SEQ ID NO: 506649 - DNA, 20 bp, Artificial Sequence
  chemically synthesized
tcatgccactgcactccagc

SEQ ID NO: 506650 - DNA, 20 bp, Artificial Sequence
  chemically synthesized
ctcactgcaacctccacctc

SEQ ID NO: 506651 - DNA, 20 bp, Artificial Sequence
  chemically synthesized
tacttgggaggctgaggcag

SEQ ID NO: 506652 - DNA, 20 bp, Artificial Sequence
  chemically synthesized
ttttgtatttttagtaaaga

SEQ ID NO: 506653 - DNA, 20 bp, Artificial Sequence
  chemically synthesized
caggcaaatcatctgaggtc

SEQ ID NO: 506654 - DNA, 20 bp, Artificial Sequence
  chemically synthesized
gccttgtcctcccaaagtac

SEQ ID NO: 506655 - DNA, 20 bp, Artificial Sequence
  chemically synthesized
ttagaaaaatttgaagttga

SEQ ID NO: 506656 - DNA, 20 bp, Artificial Sequence
  chemically synthesized
tctaataaaactttaacctg

SEQ ID NO: 506657 - DNA, 20 bp, Artificial Sequence
  chemically synthesized
cttaaatttgagaacatgtt

SEQ ID NO: 506658 - DNA, 20 bp, Artificial Sequence
  chemically synthesized
aaacatgttctcaaatttaa

SEQ ID NO: 506659 - DNA, 20 bp, Artificial Sequence
  chemically synthesized
ttccttcttacttaaggtca

SEQ ID NO: 506660 - DNA, 20 bp, Artificial Sequence
  chemically synthesized
gaaaataattttttaaaatc

SEQ ID NO: 506661 - DNA, 20 bp, Artificial Sequence
  chemically synthesized
gtcttttaaataaaaagcct

SEQ ID NO: 506662 - DNA, 20 bp, Artificial Sequence
  chemically synthesized
tgtagacctctttgtacaag

SEQ ID NO: 506663 - DNA, 20 bp, Artificial Sequence
  chemically synthesized
ggtctacaaaatgatgctct

SEQ ID NO: 506664 - DNA, 20 bp, Artificial Sequence
  chemically synthesized
tacaaaatgatgctctgaga

SEQ ID NO: 506665 - DNA, 20 bp, Artificial Sequence
  chemically synthesized
tgaacataaaatattttatg

SEQ ID NO: 506666 - DNA, 20 bp, Artificial Sequence
  chemically synthesized
ttttatgaagggttaaaata

SEQ ID NO: 506667 - DNA, 20 bp, Artificial Sequence
  chemically synthesized
gttaaaatagaggatcttta

SEQ ID NO: 506668 - DNA, 20 bp, Artificial Sequence
  chemically synthesized
atagaggatctttaaagaat

SEQ ID NO: 506669 - DNA, 20 bp, Artificial Sequence
  chemically synthesized
tctttacatgttcttctttt

SEQ ID NO: 506670 - DNA, 20 bp, Artificial Sequence
  chemically synthesized
ggcatatttctatttgcatt

SEQ ID NO: 506671 - DNA, 20 bp, Artificial Sequence
  chemically synthesized
gttttatattactatttgat

SEQ ID NO: 506672 - DNA, 20 bp, Artificial Sequence
  chemically synthesized
acacataataaatctctcat

SEQ ID NO: 506673 - DNA, 20 bp, Artificial Sequence
  chemically synthesized
ttttctctttttgggcatcc

SEQ ID NO: 506674 - DNA, 20 bp, Artificial Sequence
  chemically synthesized
atatgtttgtgcctacattc

SEQ ID NO: 506675 - DNA, 20 bp, Artificial Sequence
  chemically synthesized
taagataaaatacatatgct

SEQ ID NO: 506676 - DNA, 20 bp, Artificial Sequence
  chemically synthesized
ttaaagaggtgctcacagtt

SEQ ID NO: 506677 - DNA, 20 bp, Artificial Sequence
  chemically synthesized
tagcaaaatattcacaaaat

SEQ ID NO: 506678 - DNA, 20 bp, Artificial Sequence
  chemically synthesized
aaatatctcattcccatttt

SEQ ID NO: 506679 - DNA, 20 bp, Artificial Sequence
  chemically synthesized
aataaattgtcttctttctc

SEQ ID NO: 506680 - DNA, 20 bp, Artificial Sequence
  chemically synthesized
gtagttttgtggatttttag

SEQ ID NO: 506681 - DNA, 20 bp, Artificial Sequence
  chemically synthesized
tctaaaggttttgtagtttt

SEQ ID NO: 506682 - DNA, 20 bp, Artificial Sequence
  chemically synthesized
atatatattttttttttcaa

SEQ ID NO: 506683 - DNA, 20 bp, Artificial Sequence
  chemically synthesized
gaaatcacatgtgctgttga

SEQ ID NO: 506684 - DNA, 20 bp, Artificial Sequence
  chemically synthesized
acatttatttttttaagttc

SEQ ID NO: 506685 - DNA, 20 bp, Artificial Sequence
  chemically synthesized
taagttccagggtacacgta

SEQ ID NO: 506686 - DNA, 20 bp, Artificial Sequence
  chemically synthesized
ctgggctcaatatctaccta

SEQ ID NO: 506687 - DNA, 20 bp, Artificial Sequence
  chemically synthesized
agcatcaggaaaaatagcta

SEQ ID NO: 506688 - DNA, 20 bp, Artificial Sequence
  chemically synthesized
tgttcccgcattagtttgct

SEQ ID NO: 506689 - DNA, 20 bp, Artificial Sequence
  chemically synthesized
agtatgtcctttgcagagac

SEQ ID NO: 506690 - DNA, 20 bp, Artificial Sequence
  chemically synthesized
atgcagccataaaaaggaat

SEQ ID NO: 506691 - DNA, 20 bp, Artificial Sequence
  chemically synthesized
aatagtatgcagccataaaa

SEQ ID NO: 506692 - DNA, 20 bp, Artificial Sequence
  chemically synthesized
aatgtgatacatatacacca

SEQ ID NO: 506693 - DNA, 20 bp, Artificial Sequence
  chemically synthesized
aaatgcccatcaatgataga

SEQ ID NO: 506694 - DNA, 20 bp, Artificial Sequence
  chemically synthesized
agtctatcattgatgggcat

SEQ ID NO: 506695 - DNA, 20 bp, Artificial Sequence
  chemically synthesized
tattcacaatagcaaagaca

SEQ ID NO: 506696 - DNA, 20 bp, Artificial Sequence
  chemically synthesized
gattctatgtctttgctatt

SEQ ID NO: 506697 - DNA, 20 bp, Artificial Sequence
  chemically synthesized
aaatgcatgtatctttataa

SEQ ID NO: 506698 - DNA, 20 bp, Artificial Sequence
  chemically synthesized
ataggatgatttatattcct

SEQ ID NO: 506699 - DNA, 20 bp, Artificial Sequence
  chemically synthesized
gttactggatatatacccaa

SEQ ID NO: 506700 - DNA, 20 bp, Artificial Sequence
  chemically synthesized
aatacccagcaaggccgtta

SEQ ID NO: 506701 - DNA, 20 bp, Artificial Sequence
  chemically synthesized
tatatccagtaacggccttg

SEQ ID NO: 506702 - DNA, 20 bp, Artificial Sequence
  chemically synthesized
ccaccacactgtcttccaca

SEQ ID NO: 506703 - DNA, 20 bp, Artificial Sequence
  chemically synthesized
aatgcttttacactgttggt

SEQ ID NO: 506704 - DNA, 20 bp, Artificial Sequence
  chemically synthesized
tggcatggtttcagagaaat

SEQ ID NO: 506705 - DNA, 20 bp, Artificial Sequence
  chemically synthesized
gcacaccatctcacgccaga

SEQ ID NO: 506706 - DNA, 20 bp, Artificial Sequence
  chemically synthesized
gatggtgtgctgaggctaat

SEQ ID NO: 506707 - DNA, 20 bp, Artificial Sequence
  chemically synthesized
gtgtgctgaggctaatatgg

SEQ ID NO: 506708 - DNA, 20 bp, Artificial Sequence
  chemically synthesized
gagagaagtaggcttcaaag

SEQ ID NO: 506709 - DNA, 20 bp, Artificial Sequence
  chemically synthesized
caaacttccctgagctagag

SEQ ID NO: 506710 - DNA, 20 bp, Artificial Sequence
  chemically synthesized
tggttgttagcttgtttgca

SEQ ID NO: 506711 - DNA, 20 bp, Artificial Sequence
  chemically synthesized
cacgataaaacgtaacagga

SEQ ID NO: 506712 - DNA, 20 bp, Artificial Sequence
  chemically synthesized
acgtaacaggagcggataac

SEQ ID NO: 506713 - DNA, 20 bp, Artificial Sequence
  chemically synthesized
taaccagtttacagaggaac

SEQ ID NO: 506714 - DNA, 20 bp, Artificial Sequence
  chemically synthesized
ttgacaatgtgatttcattg

SEQ ID NO: 506715 - DNA, 20 bp, Artificial Sequence
  chemically synthesized
tgaaatcacattgtcaatac

SEQ ID NO: 506716 - DNA, 20 bp, Artificial Sequence
  chemically synthesized
tgaatagaccaagcagagga

SEQ ID NO: 506717 - DNA, 20 bp, Artificial Sequence
  chemically synthesized
aaaagattagagaaaaagaa

SEQ ID NO: 506718 - DNA, 20 bp, Artificial Sequence
  chemically synthesized
agaaaaagaaaagaataaaa

SEQ ID NO: 506719 - DNA, 20 bp, Artificial Sequence
  chemically synthesized
tacaaaacgtctgacaaatg

SEQ ID NO: 506720 - DNA, 20 bp, Artificial Sequence
  chemically synthesized
tccccaaacagtctttgctt

SEQ ID NO: 506721 - DNA, 20 bp, Artificial Sequence
  chemically synthesized
ccaagttggaaatcacactt

SEQ ID NO: 506722 - DNA, 20 bp, Artificial Sequence
  chemically synthesized
tctagattggagaagttctc

SEQ ID NO: 506723 - DNA, 20 bp, Artificial Sequence
  chemically synthesized
gtatcttgtatttcctgaat

SEQ ID NO: 506724 - DNA, 20 bp, Artificial Sequence
  chemically synthesized
cagtgagtatcttgtatttc

SEQ ID NO: 506725 - DNA, 20 bp, Artificial Sequence
  chemically synthesized
gttgggctggcttctgctca

SEQ ID NO: 506726 - DNA, 20 bp, Artificial Sequence
  chemically synthesized
cagcccaacattcaaattca

SEQ ID NO: 506727 - DNA, 20 bp, Artificial Sequence
  chemically synthesized
gtatcttgcattccctgaat

SEQ ID NO: 506728 - DNA, 20 bp, Artificial Sequence
  chemically synthesized
tgctcagtatcttgcattcc

SEQ ID NO: 506729 - DNA, 20 bp, Artificial Sequence
  chemically synthesized
aattgtatgattacgtatgt

SEQ ID NO: 506730 - DNA, 20 bp, Artificial Sequence
  chemically synthesized
ttttctttcatttaaacctg

SEQ ID NO: 506731 - DNA, 20 bp, Artificial Sequence
  chemically synthesized
acctacaaagggaagcccat

SEQ ID NO: 506732 - DNA, 20 bp, Artificial Sequence
  chemically synthesized
ccccaatctctactggctta

SEQ ID NO: 506733 - DNA, 20 bp, Artificial Sequence
  chemically synthesized
aattcttttctttcacggtg

SEQ ID NO: 506734 - DNA, 20 bp, Artificial Sequence
  chemically synthesized
tattcaacaccgtgaaagaa

SEQ ID NO: 506735 - DNA, 20 bp, Artificial Sequence
  chemically synthesized
aaagaaaagaatttccaagg

SEQ ID NO: 506736 - DNA, 20 bp, Artificial Sequence
  chemically synthesized
acttatgaagcttactttgt

SEQ ID NO: 506737 - DNA, 20 bp, Artificial Sequence
  chemically synthesized
gtaagcttcataagtgaagg

SEQ ID NO: 506738 - DNA, 20 bp, Artificial Sequence
  chemically synthesized
tccagacaagcaaatgttga

SEQ ID NO: 506739 - DNA, 20 bp, Artificial Sequence
  chemically synthesized
aattatgaaatacgatagtg

SEQ ID NO: 506740 - DNA, 20 bp, Artificial Sequence
  chemically synthesized
tatgtttataaaaaattaca

SEQ ID NO: 506741 - DNA, 20 bp, Artificial Sequence
  chemically synthesized
ttacagggaatcatgatcat

SEQ ID NO: 506742 - DNA, 20 bp, Artificial Sequence
  chemically synthesized
agtttttaaagaagtcaatc

SEQ ID NO: 506743 - DNA, 20 bp, Artificial Sequence
  chemically synthesized
gaaaagagggcaaatatacc

SEQ ID NO: 506744 - DNA, 20 bp, Artificial Sequence
  chemically synthesized
attgtaagcctccagatagc

SEQ ID NO: 506745 - DNA, 20 bp, Artificial Sequence
  chemically synthesized
ataatacctggacacaagct

SEQ ID NO: 506746 - DNA, 20 bp, Artificial Sequence
  chemically synthesized
aggtattattcaagtcaaat

SEQ ID NO: 506747 - DNA, 20 bp, Artificial Sequence
  chemically synthesized
atttcaaactcagatttgac

SEQ ID NO: 506748 - DNA, 20 bp, Artificial Sequence
  chemically synthesized
gcgcaagcagtgttctttat

SEQ ID NO: 506749 - DNA, 20 bp, Artificial Sequence
  chemically synthesized
tgttctttatatgagtacaa

SEQ ID NO: 506750 - DNA, 20 bp, Artificial Sequence
  chemically synthesized
ggttaaaacctattgtgagg

SEQ ID NO: 506751 - DNA, 20 bp, Artificial Sequence
  chemically synthesized
tcttttaaataattagtata

SEQ ID NO: 506752 - DNA, 20 bp, Artificial Sequence
  chemically synthesized
tctttatactaattatttaa

SEQ ID NO: 506753 - DNA, 20 bp, Artificial Sequence
  chemically synthesized
taaaagaatttttgaaacaa

SEQ ID NO: 506754 - DNA, 20 bp, Artificial Sequence
  chemically synthesized
gaaacaattgagtatatcat

SEQ ID NO: 506755 - DNA, 20 bp, Artificial Sequence
  chemically synthesized
ataatgattgtgggagaaaa

SEQ ID NO: 506756 - DNA, 20 bp, Artificial Sequence
  chemically synthesized
aaccttacagctcatattct

SEQ ID NO: 506757 - DNA, 20 bp, Artificial Sequence
  chemically synthesized
aattacataaggagaattcc

SEQ ID NO: 506758 - DNA, 20 bp, Artificial Sequence
  chemically synthesized
cttgattaaaattacataag

SEQ ID NO: 506759 - DNA, 20 bp, Artificial Sequence
  chemically synthesized
ttaatcaaggtcaatttaac

SEQ ID NO: 506760 - DNA, 20 bp, Artificial Sequence
  chemically synthesized
tccttttaatttctcttttc

SEQ ID NO: 506761 - DNA, 20 bp, Artificial Sequence
  chemically synthesized
caaaaacagccagcaaagat

SEQ ID NO: 506762 - DNA, 20 bp, Artificial Sequence
  chemically synthesized
ttccaaaaattatgctgtca

SEQ ID NO: 506763 - DNA, 20 bp, Artificial Sequence
  chemically synthesized
tgttttccagaacactaagc

SEQ ID NO: 506764 - DNA, 20 bp, Artificial Sequence
  chemically synthesized
actttgggaggccgaagtgg

SEQ ID NO: 506765 - DNA, 20 bp, Artificial Sequence
  chemically synthesized
tggggtttcaccatgttggc

SEQ ID NO: 506766 - DNA, 20 bp, Artificial Sequence
  chemically synthesized
ttttgtaattttagtagaga

SEQ ID NO: 506767 - DNA, 20 bp, Artificial Sequence
  chemically synthesized
ctaaaattacaaaaaattag

SEQ ID NO: 506768 - DNA, 20 bp, Artificial Sequence
  chemically synthesized
ctcactgcaagctctgcctc

SEQ ID NO: 506769 - DNA, 20 bp, Artificial Sequence
  chemically synthesized
ttgtgccactgcactccagc

SEQ ID NO: 506770 - DNA, 20 bp, Artificial Sequence
  chemically synthesized
tctcactgtgtcacccaggc

SEQ ID NO: 506771 - DNA, 20 bp, Artificial Sequence
  chemically synthesized
ttttttttttttttttgaga

SEQ ID NO: 506772 - DNA, 20 bp, Artificial Sequence
  chemically synthesized
agcatttgaggggaaaaagg

SEQ ID NO: 506773 - DNA, 20 bp, Artificial Sequence
  chemically synthesized
gtatctcttcacttgctcat

SEQ ID NO: 506774 - DNA, 20 bp, Artificial Sequence
  chemically synthesized
aaaccagtattcttttatta

SEQ ID NO: 506775 - DNA, 20 bp, Artificial Sequence
  chemically synthesized
cttgtataattctataataa

SEQ ID NO: 506776 - DNA, 20 bp, Artificial Sequence
  chemically synthesized
tggtggtctcataatttcta

SEQ ID NO: 506777 - DNA, 20 bp, Artificial Sequence
  chemically synthesized
tcaaatgcttttctaccaat

SEQ ID NO: 506778 - DNA, 20 bp, Artificial Sequence
  chemically synthesized
aaaaagtagtcccattccaa

SEQ ID NO: 506779 - DNA, 20 bp, Artificial Sequence
  chemically synthesized
tataaatatgctcattccct

SEQ ID NO: 506780 - DNA, 20 bp, Artificial Sequence
  chemically synthesized
gtgaaaagggagagcttctt

SEQ ID NO: 506781 - DNA, 20 bp, Artificial Sequence
  chemically synthesized
cagggagcattgtggaaaac

SEQ ID NO: 506782 - DNA, 20 bp, Artificial Sequence
  chemically synthesized
attgtggaaaaccagaatgt

SEQ ID NO: 506783 - DNA, 20 bp, Artificial Sequence
  chemically synthesized
aaatagacagtgatatgtgt

SEQ ID NO: 506784 - DNA, 20 bp, Artificial Sequence
  chemically synthesized
taaacatttattttaggctc

SEQ ID NO: 506785 - DNA, 20 bp, Artificial Sequence
  chemically synthesized
cataggtaaatgtgtgtcac

SEQ ID NO: 506786 - DNA, 20 bp, Artificial Sequence
  chemically synthesized
ttggatactgggcttaatac

SEQ ID NO: 506787 - DNA, 20 bp, Artificial Sequence
  chemically synthesized
atgagcagtaaataagacta

SEQ ID NO: 506788 - DNA, 20 bp, Artificial Sequence
  chemically synthesized
ctgggatctacttgaggtgg

SEQ ID NO: 506789 - DNA, 20 bp, Artificial Sequence
  chemically synthesized
tagaggggatcaacatacac

SEQ ID NO: 506790 - DNA, 20 bp, Artificial Sequence
  chemically synthesized
tacaatctgcagaccataga

SEQ ID NO: 506791 - DNA, 20 bp, Artificial Sequence
  chemically synthesized
ttaggtccttatcacagctt

SEQ ID NO: 506792 - DNA, 20 bp, Artificial Sequence
  chemically synthesized
attttctgagcaaaatgttt

SEQ ID NO: 506793 - DNA, 20 bp, Artificial Sequence
  chemically synthesized
gcatggagtggttctcaaac

SEQ ID NO: 506794 - DNA, 20 bp, Artificial Sequence
  chemically synthesized
tctagttcatttgcattgca

SEQ ID NO: 506795 - DNA, 20 bp, Artificial Sequence
  chemically synthesized
ccctaaacatgtcccttaaa

SEQ ID NO: 506796 - DNA, 20 bp, Artificial Sequence
  chemically synthesized
agcaataatctgtggaagca

SEQ ID NO: 506797 - DNA, 20 bp, Artificial Sequence
  chemically synthesized
tggaagcaatgggtacatat

SEQ ID NO: 506798 - DNA, 20 bp, Artificial Sequence
  chemically synthesized
atatgggaatactctcagtg

SEQ ID NO: 506799 - DNA, 20 bp, Artificial Sequence
  chemically synthesized
atactttttaacccaacact

SEQ ID NO: 506800 - DNA, 20 bp, Artificial Sequence
  chemically synthesized
ggcagatcacataaaacagg

SEQ ID NO: 506801 - DNA, 20 bp, Artificial Sequence
  chemically synthesized
tatgtttaatggaaaacaaa

SEQ ID NO: 506802 - DNA, 20 bp, Artificial Sequence
  chemically synthesized
aaattataatttgaagaaat

SEQ ID NO: 506803 - DNA, 20 bp, Artificial Sequence
  chemically synthesized
tataattttttaacgtaaaa

SEQ ID NO: 506804 - DNA, 20 bp, Artificial Sequence
  chemically synthesized
aagtttgtagtattgcctcc

SEQ ID NO: 506805 - DNA, 20 bp, Artificial Sequence
  chemically synthesized
tctatattgagacaagtaca

SEQ ID NO: 506806 - DNA, 20 bp, Artificial Sequence
  chemically synthesized
aaatatttgcctaaaatcta

SEQ ID NO: 506807 - DNA, 20 bp, Artificial Sequence
  chemically synthesized
gtatgcctgtgcattgagct

SEQ ID NO: 506808 - DNA, 20 bp, Artificial Sequence
  chemically synthesized
tgtgcattgagctatgaatt

SEQ ID NO: 506809 - DNA, 20 bp, Artificial Sequence
  chemically synthesized
ccacatagcctggcattata

SEQ ID NO: 506810 - DNA, 20 bp, Artificial Sequence
  chemically synthesized
tataatgccaggctatgtgg

SEQ ID NO: 506811 - DNA, 20 bp, Artificial Sequence
  chemically synthesized
ttatatataatgtttatatc

SEQ ID NO: 506812 - DNA, 20 bp, Artificial Sequence
  chemically synthesized
tgtagttggatggtagaata

SEQ ID NO: 506813 - DNA, 20 bp, Artificial Sequence
  chemically synthesized
tgtcttatgtagttggatgg

SEQ ID NO: 506814 - DNA, 20 bp, Artificial Sequence
  chemically synthesized
cctctttttgtcttatgtag

SEQ ID NO: 506815 - DNA, 20 bp, Artificial Sequence
  chemically synthesized
taaagatttagtcactaaaa

SEQ ID NO: 506816 - DNA, 20 bp, Artificial Sequence
  chemically synthesized
gaaaacatctcagctacatt

SEQ ID NO: 506817 - DNA, 20 bp, Artificial Sequence
  chemically synthesized
actgctgatttcataaaatt

SEQ ID NO: 506818 - DNA, 20 bp, Artificial Sequence
  chemically synthesized
gaagttagtggtaggagaac

SEQ ID NO: 506819 - DNA, 20 bp, Artificial Sequence
  chemically synthesized
ccctaagtttcatttttctc

SEQ ID NO: 506820 - DNA, 20 bp, Artificial Sequence
  chemically synthesized
catttttctcaagagtaaaa

SEQ ID NO: 506821 - DNA, 20 bp, Artificial Sequence
  chemically synthesized
ggttctagcaatctctgatt

SEQ ID NO: 506822 - DNA, 20 bp, Artificial Sequence
  chemically synthesized
agcccaatagtaacggggaa

SEQ ID NO: 506823 - DNA, 20 bp, Artificial Sequence
  chemically synthesized
gaacttgttactgccctaga

SEQ ID NO: 506824 - DNA, 20 bp, Artificial Sequence
  chemically synthesized
aactgaacttgttactgccc

SEQ ID NO: 506825 - DNA, 20 bp, Artificial Sequence
  chemically synthesized
gttggagaatggtggtgagg

SEQ ID NO: 506826 - DNA, 20 bp, Artificial Sequence
  chemically synthesized
ttttgcctgtcttgttgttg

SEQ ID NO: 506827 - DNA, 20 bp, Artificial Sequence
  chemically synthesized
tccaacaacaagacaggcaa

SEQ ID NO: 506828 - DNA, 20 bp, Artificial Sequence
  chemically synthesized
taatctggttgcttcttttg

SEQ ID NO: 506829 - DNA, 20 bp, Artificial Sequence
  chemically synthesized
attttttaaacctgcattaa

SEQ ID NO: 506830 - DNA, 20 bp, Artificial Sequence
  chemically synthesized
atttagtccaaaaacttgaa

SEQ ID NO: 506831 - DNA, 20 bp, Artificial Sequence
  chemically synthesized
tggataactttgcccggtgt

SEQ ID NO: 506832 - DNA, 20 bp, Artificial Sequence
  chemically synthesized
cccagaagacggaagcatgg

SEQ ID NO: 506833 - DNA, 20 bp, Artificial Sequence
  chemically synthesized
tccagccatgcttccgtctt

SEQ ID NO: 506834 - DNA, 20 bp, Artificial Sequence
  chemically synthesized
aagatcttctttcaacactg

SEQ ID NO: 506835 - DNA, 20 bp, Artificial Sequence
  chemically synthesized
gtgttgaaagaagatcttgt

SEQ ID NO: 506836 - DNA, 20 bp, Artificial Sequence
  chemically synthesized
tgaaagaagatcttgtttga

SEQ ID NO: 506837 - DNA, 20 bp, Artificial Sequence
  chemically synthesized
tgagtgaatacagtttgccc

SEQ ID NO: 506838 - DNA, 20 bp, Artificial Sequence
  chemically synthesized
tgttttaacaggttttaaaa

SEQ ID NO: 506839 - DNA, 20 bp, Artificial Sequence
  chemically synthesized
tgttaaaacaagaaagatca

SEQ ID NO: 506840 - DNA, 20 bp, Artificial Sequence
  chemically synthesized
agaaagatcacagaataagc

SEQ ID NO: 506841 - DNA, 20 bp, Artificial Sequence
  chemically synthesized
gattgaactatagtggtgta

SEQ ID NO: 506842 - DNA, 20 bp, Artificial Sequence
  chemically synthesized
atatttcaatcgtgcccgca

SEQ ID NO: 506843 - DNA, 20 bp, Artificial Sequence
  chemically synthesized
tcttttctcttcaaacttct

SEQ ID NO: 506844 - DNA, 20 bp, Artificial Sequence
  chemically synthesized
agagaaaagaaactcaaacg

SEQ ID NO: 506845 - DNA, 20 bp, Artificial Sequence
  chemically synthesized
agtaggtctttattctacgt

SEQ ID NO: 506846 - DNA, 20 bp, Artificial Sequence
  chemically synthesized
aagcaatattaccttttcac

SEQ ID NO: 506847 - DNA, 20 bp, Artificial Sequence
  chemically synthesized
acatgtggaaattagaaggc

SEQ ID NO: 506848 - DNA, 20 bp, Artificial Sequence
  chemically synthesized
gaaattagaaggcacggatc

SEQ ID NO: 506849 - DNA, 20 bp, Artificial Sequence
  chemically synthesized
gatttccccttaattcctga

SEQ ID NO: 506850 - DNA, 20 bp, Artificial Sequence
  chemically synthesized
gttttcgtttgaattccgtc

SEQ ID NO: 506851 - DNA, 20 bp, Artificial Sequence
  chemically synthesized
acctgattgtcagttttcgt

SEQ ID NO: 506852 - DNA, 20 bp, Artificial Sequence
  chemically synthesized
aaaactgacaatcaggtacc

SEQ ID NO: 506853 - DNA, 20 bp, Artificial Sequence
  chemically synthesized
agctagtgagctgagaaaat

SEQ ID NO: 506854 - DNA, 20 bp, Artificial Sequence
  chemically synthesized
tccaaataatcacagcattt

SEQ ID NO: 506855 - DNA, 20 bp, Artificial Sequence
  chemically synthesized
ttctgaaatgctgtgattat

SEQ ID NO: 506856 - DNA, 20 bp, Artificial Sequence
  chemically synthesized
ttttatctccaaataatgaa

SEQ ID NO: 506857 - DNA, 20 bp, Artificial Sequence
  chemically synthesized
aaccagatgttaattgatta

SEQ ID NO: 506858 - DNA, 20 bp, Artificial Sequence
  chemically synthesized
atcaattaacatctggttat

SEQ ID NO: 506859 - DNA, 20 bp, Artificial Sequence
  chemically synthesized
aatgcttcagcatctctttt

SEQ ID NO: 506860 - DNA, 20 bp, Artificial Sequence
  chemically synthesized
caaagttcctgtgagctgtg

SEQ ID NO: 506861 - DNA, 20 bp, Artificial Sequence
  chemically synthesized
ttcctttcaaatcaaccaaa

SEQ ID NO: 506862 - DNA, 20 bp, Artificial Sequence
  chemically synthesized
ctccctttggttgatttgaa

SEQ ID NO: 506863 - DNA, 20 bp, Artificial Sequence
  chemically synthesized
ctgtgtatcaggcaaagtta

SEQ ID NO: 506864 - DNA, 20 bp, Artificial Sequence
  chemically synthesized
tacacagacaaattcaattc

SEQ ID NO: 506865 - DNA, 20 bp, Artificial Sequence
  chemically synthesized
taatgttcagtacccaggaa

SEQ ID NO: 506866 - DNA, 20 bp, Artificial Sequence
  chemically synthesized
gggagtaatgttcagtaccc

SEQ ID NO: 506867 - DNA, 20 bp, Artificial Sequence
  chemically synthesized
tttgtttacagattaagtca

SEQ ID NO: 506868 - DNA, 20 bp, Artificial Sequence
  chemically synthesized
attgtatttgctgccaaata

SEQ ID NO: 506869 - DNA, 20 bp, Artificial Sequence
  chemically synthesized
catatttggcagcaaataca

SEQ ID NO: 506870 - DNA, 20 bp, Artificial Sequence
  chemically synthesized
gcattgatagctctgaactg

SEQ ID NO: 506871 - DNA, 20 bp, Artificial Sequence
  chemically synthesized
caattagtttgtcttttact

SEQ ID NO: 506872 - DNA, 20 bp, Artificial Sequence
  chemically synthesized
tactccaggtgaagcagatt

SEQ ID NO: 506873 - DNA, 20 bp, Artificial Sequence
  chemically synthesized
tactcagaatctgcttcacc

SEQ ID NO: 506874 - DNA, 20 bp, Artificial Sequence
  chemically synthesized
cagtatttttctaagtttga

SEQ ID NO: 506875 - DNA, 20 bp, Artificial Sequence
  chemically synthesized
acaaattaagatattataca

SEQ ID NO: 506876 - DNA, 20 bp, Artificial Sequence
  chemically synthesized
accgtgagttttattttgat

SEQ ID NO: 506877 - DNA, 20 bp, Artificial Sequence
  chemically synthesized
caaaataaaactcacggtgt

SEQ ID NO: 506878 - DNA, 20 bp, Artificial Sequence
  chemically synthesized
tattgctaaacccccacacc

SEQ ID NO: 506879 - DNA, 20 bp, Artificial Sequence
  chemically synthesized
ggtggtttttcttttttgtt

SEQ ID NO: 506880 - DNA, 20 bp, Artificial Sequence
  chemically synthesized
ttttcttttttgttttgagt

SEQ ID NO: 506881 - DNA, 20 bp, Artificial Sequence
  chemically synthesized
ctgcactccagcctgggcga

SEQ ID NO: 506882 - DNA, 20 bp, Artificial Sequence
  chemically synthesized
tctaactctgtcgcccaggc

SEQ ID NO: 506883 - DNA, 20 bp, Artificial Sequence
  chemically synthesized
gctactcgtgaggctgacag

SEQ ID NO: 506884 - DNA, 20 bp, Artificial Sequence
  chemically synthesized
gcaattctcctgtcagcctc

SEQ ID NO: 506885 - DNA, 20 bp, Artificial Sequence
  chemically synthesized
tttaaatttttagaagagac

SEQ ID NO: 506886 - DNA, 20 bp, Artificial Sequence
  chemically synthesized
actttgggaggccaaggcgg

SEQ ID NO: 506887 - DNA, 20 bp, Artificial Sequence
  chemically synthesized
cagcactttgggaggccaag

SEQ ID NO: 506888 - DNA, 20 bp, Artificial Sequence
  chemically synthesized
gccttggcctcccaaagtgc

SEQ ID NO: 506889 - DNA, 20 bp, Artificial Sequence
  chemically synthesized
tgcaaaacctatctattggg

SEQ ID NO: 506890 - DNA, 20 bp, Artificial Sequence
  chemically synthesized
taacaagtgaattaaacaaa

SEQ ID NO: 506891 - DNA, 20 bp, Artificial Sequence
  chemically synthesized
atttaatggaaaactaacaa

SEQ ID NO: 506892 - DNA, 20 bp, Artificial Sequence
  chemically synthesized
tagttttccattaaatttaa

SEQ ID NO: 506893 - DNA, 20 bp, Artificial Sequence
  chemically synthesized
tcccaagctgagagccatat

SEQ ID NO: 506894 - DNA, 20 bp, Artificial Sequence
  chemically synthesized
aaaaatgacactataactgg

SEQ ID NO: 506895 - DNA, 20 bp, Artificial Sequence
  chemically synthesized
ttctgagtaagtaagtcaaa

SEQ ID NO: 506896 - DNA, 20 bp, Artificial Sequence
  chemically synthesized
tcctctttgacttacttact

SEQ ID NO: 506897 - DNA, 20 bp, Artificial Sequence
  chemically synthesized
ttaaaatagtttctaacatt

SEQ ID NO: 506898 - DNA, 20 bp, Artificial Sequence
  chemically synthesized
aaatagccatatgtgtaagg

SEQ ID NO: 506899 - DNA, 20 bp, Artificial Sequence
  chemically synthesized
ttacatattttgtttaaata

SEQ ID NO: 506900 - DNA, 20 bp, Artificial Sequence
  chemically synthesized
atttggaaacatgtcagaag

SEQ ID NO: 506901 - DNA, 20 bp, Artificial Sequence
  chemically synthesized
acatgtcagaagaggagtgt

SEQ ID NO: 506902 - DNA, 20 bp, Artificial Sequence
  chemically synthesized
tgagaattatgtttaaagaa

SEQ ID NO: 506903 - DNA, 20 bp, Artificial Sequence
  chemically synthesized
gaggattgcaataaaaacct

SEQ ID NO: 506904 - DNA, 20 bp, Artificial Sequence
  chemically synthesized
actttgggaggctgaggcgg

SEQ ID NO: 506905 - DNA, 20 bp, Artificial Sequence
  chemically synthesized
ggcgggcggatcacgaggtc

SEQ ID NO: 506906 - DNA, 20 bp, Artificial Sequence
  chemically synthesized
taaaaatacaataattagct

SEQ ID NO: 506907 - DNA, 20 bp, Artificial Sequence
  chemically synthesized
cgattccttgcctcagcttc

SEQ ID NO: 506908 - DNA, 20 bp, Artificial Sequence
  chemically synthesized
cgactcaggaagctgaggca

SEQ ID NO: 506909 - DNA, 20 bp, Artificial Sequence
  chemically synthesized
tcttgctctgttgcccaggc

SEQ ID NO: 506910 - DNA, 20 bp, Artificial Sequence
  chemically synthesized
tttttttttttttcttgaga

SEQ ID NO: 506911 - DNA, 20 bp, Artificial Sequence
  chemically synthesized
tgagtgcacttttttcctaa

SEQ ID NO: 506912 - DNA, 20 bp, Artificial Sequence
  chemically synthesized
aacattgattttactttacc

SEQ ID NO: 506913 - DNA, 20 bp, Artificial Sequence
  chemically synthesized
ataattacattgtgtgatta

SEQ ID NO: 506914 - DNA, 20 bp, Artificial Sequence
  chemically synthesized
attgtgtgattattgaataa

SEQ ID NO: 506915 - DNA, 20 bp, Artificial Sequence
  chemically synthesized
aaaatttactaggtataagt

SEQ ID NO: 506916 - DNA, 20 bp, Artificial Sequence
  chemically synthesized
atacctagtaaattttagat

SEQ ID NO: 506917 - DNA, 20 bp, Artificial Sequence
  chemically synthesized
tcccagttccagaactcccc

SEQ ID NO: 506918 - DNA, 20 bp, Artificial Sequence
  chemically synthesized
ccctcagttaataatcctgg

SEQ ID NO: 506919 - DNA, 20 bp, Artificial Sequence
  chemically synthesized
ctaatgtatctggccccatc

SEQ ID NO: 506920 - DNA, 20 bp, Artificial Sequence
  chemically synthesized
gggccagatacattagatca

SEQ ID NO: 506921 - DNA, 20 bp, Artificial Sequence
  chemically synthesized
cattagatcatagaattcat

SEQ ID NO: 506922 - DNA, 20 bp, Artificial Sequence
  chemically synthesized
gacaggacaaggtaattcta

SEQ ID NO: 506923 - DNA, 20 bp, Artificial Sequence
  chemically synthesized
gcttaaaagaatcagcatca

SEQ ID NO: 506924 - DNA, 20 bp, Artificial Sequence
  chemically synthesized
catgtaagacctaagcttaa

SEQ ID NO: 506925 - DNA, 20 bp, Artificial Sequence
  chemically synthesized
caataattaaccataggtct

SEQ ID NO: 506926 - DNA, 20 bp, Artificial Sequence
  chemically synthesized
cctgaattttctagagctct

SEQ ID NO: 506927 - DNA, 20 bp, Artificial Sequence
  chemically synthesized
ctagatcttccttttgccac

SEQ ID NO: 506928 - DNA, 20 bp, Artificial Sequence
  chemically synthesized
ggtggcaaaaggaagatcta

SEQ ID NO: 506929 - DNA, 20 bp, Artificial Sequence
  chemically synthesized
tgtacaaggcaaaggccagc

SEQ ID NO: 506930 - DNA, 20 bp, Artificial Sequence
  chemically synthesized
aaggccagctgggatagtaa

SEQ ID NO: 506931 - DNA, 20 bp, Artificial Sequence
  chemically synthesized
actttatttttatagaagcc

SEQ ID NO: 506932 - DNA, 20 bp, Artificial Sequence
  chemically synthesized
ggtacagtcaataaatcaga

SEQ ID NO: 506933 - DNA, 20 bp, Artificial Sequence
  chemically synthesized
taaatcagactgggtcagta

SEQ ID NO: 506934 - DNA, 20 bp, Artificial Sequence
  chemically synthesized
aggtttcctgggccttttgt

SEQ ID NO: 506935 - DNA, 20 bp, Artificial Sequence
  chemically synthesized
accttcacctcactctcatc

SEQ ID NO: 506936 - DNA, 20 bp, Artificial Sequence
  chemically synthesized
ctcttatgcgtattcctgat

SEQ ID NO: 506937 - DNA, 20 bp, Artificial Sequence
  chemically synthesized
ctcatcaggaatacgcataa

SEQ ID NO: 506938 - DNA, 20 bp, Artificial Sequence
  chemically synthesized
tttctcctatattggcaaaa

SEQ ID NO: 506939 - DNA, 20 bp, Artificial Sequence
  chemically synthesized
aagtacaactggtgattaga

SEQ ID NO: 506940 - DNA, 20 bp, Artificial Sequence
  chemically synthesized
cccaaagtacaactggtgat

SEQ ID NO: 506941 - DNA, 20 bp, Artificial Sequence
  chemically synthesized
ttctcatcttgaaagaacat

SEQ ID NO: 506942 - DNA, 20 bp, Artificial Sequence
  chemically synthesized
gaattacctgaaaggcttgt

SEQ ID NO: 506943 - DNA, 20 bp, Artificial Sequence
  chemically synthesized
agatgactaggctccacttc

SEQ ID NO: 506944 - DNA, 20 bp, Artificial Sequence
  chemically synthesized
cagtatcaaggaaatttgtt

SEQ ID NO: 506945 - DNA, 20 bp, Artificial Sequence
  chemically synthesized
ttgagaagcattgatcctgt

SEQ ID NO: 506946 - DNA, 20 bp, Artificial Sequence
  chemically synthesized
cctcaaataattaattcaga

SEQ ID NO: 506947 - DNA, 20 bp, Artificial Sequence
  chemically synthesized
aattatttgagggccatccc

SEQ ID NO: 506948 - DNA, 20 bp, Artificial Sequence
  chemically synthesized
gctacctttacctcaactcc

SEQ ID NO: 506949 - DNA, 20 bp, Artificial Sequence
  chemically synthesized
tggctgtgggatcaaaggac

SEQ ID NO: 506950 - DNA, 20 bp, Artificial Sequence
  chemically synthesized
aagatattctcaaatggctg

SEQ ID NO: 506951 - DNA, 20 bp, Artificial Sequence
  chemically synthesized
ctttgatcccacagccattt

SEQ ID NO: 506952 - DNA, 20 bp, Artificial Sequence
  chemically synthesized
taagggctacagaagtactt

SEQ ID NO: 506953 - DNA, 20 bp, Artificial Sequence
  chemically synthesized
cccttatataccataatctc

SEQ ID NO: 506954 - DNA, 20 bp, Artificial Sequence
  chemically synthesized
gaaggacagctctggggaag

SEQ ID NO: 506955 - DNA, 20 bp, Artificial Sequence
  chemically synthesized
agtcaagaagaaacctgttc

SEQ ID NO: 506956 - DNA, 20 bp, Artificial Sequence
  chemically synthesized
ggaacaggtttcttcttgac

SEQ ID NO: 506957 - DNA, 20 bp, Artificial Sequence
  chemically synthesized
gaggtgaattataagacttg

SEQ ID NO: 506958 - DNA, 20 bp, Artificial Sequence
  chemically synthesized
gaaacagtagcttttatgag

SEQ ID NO: 506959 - DNA, 20 bp, Artificial Sequence
  chemically synthesized
ttttaaactgatttggcatc

SEQ ID NO: 506960 - DNA, 20 bp, Artificial Sequence
  chemically synthesized
aaataatagatctacatgat

SEQ ID NO: 506961 - DNA, 20 bp, Artificial Sequence
  chemically synthesized
tagatctacatgatttggat

SEQ ID NO: 506962 - DNA, 20 bp, Artificial Sequence
  chemically synthesized
tttaatttgctctagatctt

SEQ ID NO: 506963 - DNA, 20 bp, Artificial Sequence
  chemically synthesized
ttgccattgaggtgggaggt

SEQ ID NO: 506964 - DNA, 20 bp, Artificial Sequence
  chemically synthesized
ggcaagcaggacacaatccc

SEQ ID NO: 506965 - DNA, 20 bp, Artificial Sequence
  chemically synthesized
atagtatcactgataaccca

SEQ ID NO: 506966 - DNA, 20 bp, Artificial Sequence
  chemically synthesized
tacacttattgtaaagagaa

SEQ ID NO: 506967 - DNA, 20 bp, Artificial Sequence
  chemically synthesized
ggtgacagatggtacctgtt

SEQ ID NO: 506968 - DNA, 20 bp, Artificial Sequence
  chemically synthesized
tgctgactcaggcagtgaat

SEQ ID NO: 506969 - DNA, 20 bp, Artificial Sequence
  chemically synthesized
attaaattcttattcactgc

SEQ ID NO: 506970 - DNA, 20 bp, Artificial Sequence
  chemically synthesized
ttcctttgctgactcaggca

SEQ ID NO: 506971 - DNA, 20 bp, Artificial Sequence
  chemically synthesized
ttcactgcctgagtcagcaa

SEQ ID NO: 506972 - DNA, 20 bp, Artificial Sequence
  chemically synthesized
acaaaacctgacagctggtc

SEQ ID NO: 506973 - DNA, 20 bp, Artificial Sequence
  chemically synthesized
gaaagtcaataattttccaa

SEQ ID NO: 506974 - DNA, 20 bp, Artificial Sequence
  chemically synthesized
agttgcagttattttttcca

SEQ ID NO: 506975 - DNA, 20 bp, Artificial Sequence
  chemically synthesized
atagattgaaaggcctggac

SEQ ID NO: 506976 - DNA, 20 bp, Artificial Sequence
  chemically synthesized
tgaaaggcctggacctgagt

SEQ ID NO: 506977 - DNA, 20 bp, Artificial Sequence
  chemically synthesized
taagtctgatactaatgttg

SEQ ID NO: 506978 - DNA, 20 bp, Artificial Sequence
  chemically synthesized
atcgagatcaagaaaaaaca

SEQ ID NO: 506979 - DNA, 20 bp, Artificial Sequence
  chemically synthesized
gattttctcttggaaacaaa

SEQ ID NO: 506980 - DNA, 20 bp, Artificial Sequence
  chemically synthesized
ctcatctagctttaacatat

SEQ ID NO: 506981 - DNA, 20 bp, Artificial Sequence
  chemically synthesized
tttgactagatattaagatt

SEQ ID NO: 506982 - DNA, 20 bp, Artificial Sequence
  chemically synthesized
ctttggaaagtaccacatgc

SEQ ID NO: 506983 - DNA, 20 bp, Artificial Sequence
  chemically synthesized
tatagcaaagcatctgagat

SEQ ID NO: 506984 - DNA, 20 bp, Artificial Sequence
  chemically synthesized
gaaatctaattcccttttcc

SEQ ID NO: 506985 - DNA, 20 bp, Artificial Sequence
  chemically synthesized
ctgcccagattcaaggaaaa

SEQ ID NO: 506986 - DNA, 20 bp, Artificial Sequence
  chemically synthesized
cttgtgactttttcagcaca

SEQ ID NO: 506987 - DNA, 20 bp, Artificial Sequence
  chemically synthesized
gatatattgctagttaaata

SEQ ID NO: 506988 - DNA, 20 bp, Artificial Sequence
  chemically synthesized
tgaatcctttcagtaaataa

SEQ ID NO: 506989 - DNA, 20 bp, Artificial Sequence
  chemically synthesized
gtcactcacttatttactga

SEQ ID NO: 506990 - DNA, 20 bp, Artificial Sequence
  chemically synthesized
ttgttcttctcaggcaaaat

SEQ ID NO: 506991 - DNA, 20 bp, Artificial Sequence
  chemically synthesized
tgagaagaacaatgtttgta

SEQ ID NO: 506992 - DNA, 20 bp, Artificial Sequence
  chemically synthesized
tggattacatctccttaaag

SEQ ID NO: 506993 - DNA, 20 bp, Artificial Sequence
  chemically synthesized
atatctagaggaatggatgc

SEQ ID NO: 506994 - DNA, 20 bp, Artificial Sequence
  chemically synthesized
attctatcatatctagagga

SEQ ID NO: 506995 - DNA, 20 bp, Artificial Sequence
  chemically synthesized
agggattctatcatatctag

SEQ ID NO: 506996 - DNA, 20 bp, Artificial Sequence
  chemically synthesized
atccattcctctagatatga

SEQ ID NO: 506997 - DNA, 20 bp, Artificial Sequence
  chemically synthesized
tagatatgatagaatccctc

SEQ ID NO: 506998 - DNA, 20 bp, Artificial Sequence
  chemically synthesized
gaggagaggataaattcatg

SEQ ID NO: 506999 - DNA, 20 bp, Artificial Sequence
  chemically synthesized
gtcacatgccacagagagga

SEQ ID NO: 507000 - DNA, 20 bp, Artificial Sequence
  chemically synthesized
agtggtatcacaaaagtgag

SEQ ID NO: 507001 - DNA, 20 bp, Artificial Sequence
  chemically synthesized
ctacaatcaaggagtaggca

SEQ ID NO: 507002 - DNA, 20 bp, Artificial Sequence
  chemically synthesized
gggaggaatgtctacaatca

SEQ ID NO: 507003 - DNA, 20 bp, Artificial Sequence
  chemically synthesized
gaaacgaatagatttcaggg

SEQ ID NO: 507004 - DNA, 20 bp, Artificial Sequence
  chemically synthesized
agagtgacacattaagtgaa

SEQ ID NO: 507005 - DNA, 20 bp, Artificial Sequence
  chemically synthesized
aatgcttctgagggattgtg

SEQ ID NO: 507006 - DNA, 20 bp, Artificial Sequence
  chemically synthesized
aagcaatcaaaatgcttctg

SEQ ID NO: 507007 - DNA, 20 bp, Artificial Sequence
  chemically synthesized
cagaagcattttgattgctt

SEQ ID NO: 507008 - DNA, 20 bp, Artificial Sequence
  chemically synthesized
aatcagttggtttacacaac

SEQ ID NO: 507009 - DNA, 20 bp, Artificial Sequence
  chemically synthesized
taaaccaactgattaatgga

SEQ ID NO: 507010 - DNA, 20 bp, Artificial Sequence
  chemically synthesized
taatggaaaggatttttaac

SEQ ID NO: 507011 - DNA, 20 bp, Artificial Sequence
  chemically synthesized
tgtctcaaagacattttaca

SEQ ID NO: 507012 - DNA, 20 bp, Artificial Sequence
  chemically synthesized
aaatgataattatttcagat

SEQ ID NO: 507013 - DNA, 20 bp, Artificial Sequence
  chemically synthesized
gagaatagaagaggaattgc

SEQ ID NO: 507014 - DNA, 20 bp, Artificial Sequence
  chemically synthesized
ccctaacaggagaatagaag

SEQ ID NO: 507015 - DNA, 20 bp, Artificial Sequence
  chemically synthesized
agggttattagccctaacag

SEQ ID NO: 507016 - DNA, 20 bp, Artificial Sequence
  chemically synthesized
ttgggtgactgggttcctag

SEQ ID NO: 507017 - DNA, 20 bp, Artificial Sequence
  chemically synthesized
tagacatttcatttgggtga

SEQ ID NO: 507018 - DNA, 20 bp, Artificial Sequence
  chemically synthesized
atggttcctagacatttcat

SEQ ID NO: 507019 - DNA, 20 bp, Artificial Sequence
  chemically synthesized
cattagaatgttaagatgtg

SEQ ID NO: 507020 - DNA, 20 bp, Artificial Sequence
  chemically synthesized
taagataagaagagaaacat

SEQ ID NO: 507021 - DNA, 20 bp, Artificial Sequence
  chemically synthesized
tcaaacatcttcctaccaaa

SEQ ID NO: 507022 - DNA, 20 bp, Artificial Sequence
  chemically synthesized
gagccattgagagtttgcaa

SEQ ID NO: 507023 - DNA, 20 bp, Artificial Sequence
  chemically synthesized
gcagctgatggggagccatt

SEQ ID NO: 507024 - DNA, 20 bp, Artificial Sequence
  chemically synthesized
acctgtatatgtttgaaaac

SEQ ID NO: 507025 - DNA, 20 bp, Artificial Sequence
  chemically synthesized
agtgatgtgactgccgaaaa

SEQ ID NO: 507026 - DNA, 20 bp, Artificial Sequence
  chemically synthesized
tgataagaaattattgctca

SEQ ID NO: 507027 - DNA, 20 bp, Artificial Sequence
  chemically synthesized
taataacaagtaatacataa

SEQ ID NO: 507028 - DNA, 20 bp, Artificial Sequence
  chemically synthesized
ttttaaattaaaagaccaat

SEQ ID NO: 507029 - DNA, 20 bp, Artificial Sequence
  chemically synthesized
taaaatggtacgtatttaaa

SEQ ID NO: 507030 - DNA, 20 bp, Artificial Sequence
  chemically synthesized
aattttaagaaatcataaag

SEQ ID NO: 507031 - DNA, 20 bp, Artificial Sequence
  chemically synthesized
aaagaggccggtctgatact

SEQ ID NO: 507032 - DNA, 20 bp, Artificial Sequence
  chemically synthesized
actagaaatgataaaattca

SEQ ID NO: 507033 - DNA, 20 bp, Artificial Sequence
  chemically synthesized
tctaaagtttctcttactct

SEQ ID NO: 507034 - DNA, 20 bp, Artificial Sequence
  chemically synthesized
tcacagagtaagagaaactt

SEQ ID NO: 507035 - DNA, 20 bp, Artificial Sequence
  chemically synthesized
ttgaagcatttggtttcagc

SEQ ID NO: 507036 - DNA, 20 bp, Artificial Sequence
  chemically synthesized
tgagatttctttggcaataa

SEQ ID NO: 507037 - DNA, 20 bp, Artificial Sequence
  chemically synthesized
ataaatacctcgagtgtttt

SEQ ID NO: 507038 - DNA, 20 bp, Artificial Sequence
  chemically synthesized
tgacattgattataaatacc

SEQ ID NO: 507039 - DNA, 20 bp, Artificial Sequence
  chemically synthesized
gaaaaactaggtgatattgt

SEQ ID NO: 507040 - DNA, 20 bp, Artificial Sequence
  chemically synthesized
caggccctacctccaatgct

SEQ ID NO: 507041 - DNA, 20 bp, Artificial Sequence
  chemically synthesized
gaggtgattggctcatgagg

SEQ ID NO: 507042 - DNA, 20 bp, Artificial Sequence
  chemically synthesized
ctcatgagggcggatgtctc

SEQ ID NO: 507043 - DNA, 20 bp, Artificial Sequence
  chemically synthesized
ttagcacaatccctttcatg

SEQ ID NO: 507044 - DNA, 20 bp, Artificial Sequence
  chemically synthesized
gggaactgactcatcatgaa

SEQ ID NO: 507045 - DNA, 20 bp, Artificial Sequence
  chemically synthesized
ccagatttcatgtgaactaa

SEQ ID NO: 507046 - DNA, 20 bp, Artificial Sequence
  chemically synthesized
catgaaatctggttgtttaa

SEQ ID NO: 507047 - DNA, 20 bp, Artificial Sequence
  chemically synthesized
gccagtgtatatcacattgc

SEQ ID NO: 507048 - DNA, 20 bp, Artificial Sequence
  chemically synthesized
aggggtacctgagactggga

SEQ ID NO: 507049 - DNA, 20 bp, Artificial Sequence
  chemically synthesized
ttaaccttagtttattataa

SEQ ID NO: 507050 - DNA, 20 bp, Artificial Sequence
  chemically synthesized
aggttaaactccatcaatgt

SEQ ID NO: 507051 - DNA, 20 bp, Artificial Sequence
  chemically synthesized
gacggttatcctgacattga

SEQ ID NO: 507052 - DNA, 20 bp, Artificial Sequence
  chemically synthesized
tgattctcagaataatatgt

SEQ ID NO: 507053 - DNA, 20 bp, Artificial Sequence
  chemically synthesized
taactctcacatattattct

SEQ ID NO: 507054 - DNA, 20 bp, Artificial Sequence
  chemically synthesized
aatagactgacgttgattct

SEQ ID NO: 507055 - DNA, 20 bp, Artificial Sequence
  chemically synthesized
cttgataaaacatagcatac

SEQ ID NO: 507056 - DNA, 20 bp, Artificial Sequence
  chemically synthesized
ctggtatgctatgttttatc

SEQ ID NO: 507057 - DNA, 20 bp, Artificial Sequence
  chemically synthesized
aaagtgggaaaaaactatag

SEQ ID NO: 507058 - DNA, 20 bp, Artificial Sequence
  chemically synthesized
gatgttatattgctactttt

SEQ ID NO: 507059 - DNA, 20 bp, Artificial Sequence
  chemically synthesized
aaagtagcaatataacatct

SEQ ID NO: 507060 - DNA, 20 bp, Artificial Sequence
  chemically synthesized
tattaaatgtttatttttgc

SEQ ID NO: 507061 - DNA, 20 bp, Artificial Sequence
  chemically synthesized
atttagtctcttctatgcta

SEQ ID NO: 507062 - DNA, 20 bp, Artificial Sequence
  chemically synthesized
aatagtgataatatacagta

SEQ ID NO: 507063 - DNA, 20 bp, Artificial Sequence
  chemically synthesized
tgatctttaaagccagttgt

SEQ ID NO: 507064 - DNA, 20 bp, Artificial Sequence
  chemically synthesized
aaaggcactgcaagacatta

SEQ ID NO: 507065 - DNA, 20 bp, Artificial Sequence
  chemically synthesized
caagacattaaagaattcca

SEQ ID NO: 507066 - DNA, 20 bp, Artificial Sequence
  chemically synthesized
atttatgtttatttattcct

SEQ ID NO: 507067 - DNA, 20 bp, Artificial Sequence
  chemically synthesized
actagctgtaaaagacacgg

SEQ ID NO: 507068 - DNA, 20 bp, Artificial Sequence
  chemically synthesized
gtaagacgttgccatttgag

SEQ ID NO: 507069 - DNA, 20 bp, Artificial Sequence
  chemically synthesized
tgtagatggacagaagaccg

SEQ ID NO: 507070 - DNA, 20 bp, Artificial Sequence
  chemically synthesized
tacgttttattaaaaatggc

SEQ ID NO: 507071 - DNA, 20 bp, Artificial Sequence
  chemically synthesized
ttaaatgtaagcagatcaga

SEQ ID NO: 507072 - DNA, 20 bp, Artificial Sequence
  chemically synthesized
aacaaagacatacatataga

SEQ ID NO: 507073 - DNA, 20 bp, Artificial Sequence
  chemically synthesized
aggtttgaaaatacacccta

SEQ ID NO: 507074 - DNA, 20 bp, Artificial Sequence
  chemically synthesized
gtagttagacttttattctt

SEQ ID NO: 507075 - DNA, 20 bp, Artificial Sequence
  chemically synthesized
ataaaagtctaactactaaa

SEQ ID NO: 507076 - DNA, 20 bp, Artificial Sequence
  chemically synthesized
tatgcaagattgtttcaatt

SEQ ID NO: 507077 - DNA, 20 bp, Artificial Sequence
  chemically synthesized
ttgaaacaatcttgcataat

SEQ ID NO: 507078 - DNA, 20 bp, Artificial Sequence
  chemically synthesized
taatgagaattgcctaccat

SEQ ID NO: 507079 - DNA, 20 bp, Artificial Sequence
  chemically synthesized
gtaatagaatttaagttact

SEQ ID NO: 507080 - DNA, 20 bp, Artificial Sequence
  chemically synthesized
ttgaaaaatctacatagtaa

SEQ ID NO: 507081 - DNA, 20 bp, Artificial Sequence
  chemically synthesized
gagattgttagttttctcac

SEQ ID NO: 507082 - DNA, 20 bp, Artificial Sequence
  chemically synthesized
agtgagaaaactaacaatct

SEQ ID NO: 507083 - DNA, 20 bp, Artificial Sequence
  chemically synthesized
attatgatgcactttatagc

SEQ ID NO: 507084 - DNA, 20 bp, Artificial Sequence
  chemically synthesized
ttgacgtgctttattttata

SEQ ID NO: 507085 - DNA, 20 bp, Artificial Sequence
  chemically synthesized
tgctttattttatatagaat

SEQ ID NO: 507086 - DNA, 20 bp, Artificial Sequence
  chemically synthesized
tgagtagatttttcaaaaat

SEQ ID NO: 507087 - DNA, 20 bp, Artificial Sequence
  chemically synthesized
aaattatgagaccttagaca

SEQ ID NO: 507088 - DNA, 20 bp, Artificial Sequence
  chemically synthesized
tatgtgtattaacccaccta

SEQ ID NO: 507089 - DNA, 20 bp, Artificial Sequence
  chemically synthesized
catgtgttaatatcctctag

SEQ ID NO: 507090 - DNA, 20 bp, Artificial Sequence
  chemically synthesized
tacaaaaaaaaaaaaaatag

SEQ ID NO: 507091 - DNA, 20 bp, Artificial Sequence
  chemically synthesized
attttttttttttttgtaga

SEQ ID NO: 507092 - DNA, 20 bp, Artificial Sequence
  chemically synthesized
tttgctcctgtcacccaggc

SEQ ID NO: 507093 - DNA, 20 bp, Artificial Sequence
  chemically synthesized
tagtgccattgcactccagc

SEQ ID NO: 507094 - DNA, 20 bp, Artificial Sequence
  chemically synthesized
ctcactgcaacctccacctc

SEQ ID NO: 507095 - DNA, 20 bp, Artificial Sequence
  chemically synthesized
acctccacctcctggattca

SEQ ID NO: 507096 - DNA, 20 bp, Artificial Sequence
  chemically synthesized
ggctgaggcaggagaattcc

SEQ ID NO: 507097 - DNA, 20 bp, Artificial Sequence
  chemically synthesized
tactggggaggctgaggcag

SEQ ID NO: 507098 - DNA, 20 bp, Artificial Sequence
  chemically synthesized
aaaattagccagacatggtg

SEQ ID NO: 507099 - DNA, 20 bp, Artificial Sequence
  chemically synthesized
ttttgtatttttagtagaca

SEQ ID NO: 507100 - DNA, 20 bp, Artificial Sequence
  chemically synthesized
caggtggatcacctgaggtc

SEQ ID NO: 507101 - DNA, 20 bp, Artificial Sequence
  chemically synthesized
actttgggaggctgaggcag

SEQ ID NO: 507102 - DNA, 20 bp, Artificial Sequence
  chemically synthesized
gcctcagcctcccaaagtga

SEQ ID NO: 507103 - DNA, 20 bp, Artificial Sequence
  chemically synthesized
tcctagtcacttagaaatag

SEQ ID NO: 507104 - DNA, 20 bp, Artificial Sequence
  chemically synthesized
acctatttctaagtgactag

SEQ ID NO: 507105 - DNA, 20 bp, Artificial Sequence
  chemically synthesized
acttaaaaaaaaatacacgc

SEQ ID NO: 507106 - DNA, 20 bp, Artificial Sequence
  chemically synthesized
tatatgcagctcaatcataa

SEQ ID NO: 507107 - DNA, 20 bp, Artificial Sequence
  chemically synthesized
cactttctactcaacttatt

SEQ ID NO: 507108 - DNA, 20 bp, Artificial Sequence
  chemically synthesized
taaacataattcaaaataag

SEQ ID NO: 507109 - DNA, 20 bp, Artificial Sequence
  chemically synthesized
tttaagctcgcacatttcct

SEQ ID NO: 507110 - DNA, 20 bp, Artificial Sequence
  chemically synthesized
aaatgtgcgagcttaaatca

SEQ ID NO: 507111 - DNA, 20 bp, Artificial Sequence
  chemically synthesized
ttttacctgacatgcactga

SEQ ID NO: 507112 - DNA, 20 bp, Artificial Sequence
  chemically synthesized
cccttgactgtcttcttcac

SEQ ID NO: 507113 - DNA, 20 bp, Artificial Sequence
  chemically synthesized
tatgaatatgatgctatagc

SEQ ID NO: 507114 - DNA, 20 bp, Artificial Sequence
  chemically synthesized
cttgaaagtcttttttgttt

SEQ ID NO: 507115 - DNA, 20 bp, Artificial Sequence
  chemically synthesized
aagcttaaaatgctgcttca

SEQ ID NO: 507116 - DNA, 20 bp, Artificial Sequence
  chemically synthesized
aaattatacatttccaccta

SEQ ID NO: 507117 - DNA, 20 bp, Artificial Sequence
  chemically synthesized
tataatttattaattttagt

SEQ ID NO: 507118 - DNA, 20 bp, Artificial Sequence
  chemically synthesized
ctggaataggggatctttat

SEQ ID NO: 507119 - DNA, 20 bp, Artificial Sequence
  chemically synthesized
atgttatacaacctggaata

SEQ ID NO: 507120 - DNA, 20 bp, Artificial Sequence
  chemically synthesized
tttgaaaatgttatacaacc

SEQ ID NO: 507121 - DNA, 20 bp, Artificial Sequence
  chemically synthesized
tgcatcccattagtacatct

SEQ ID NO: 507122 - DNA, 20 bp, Artificial Sequence
  chemically synthesized
gaaattctgagatgtactaa

SEQ ID NO: 507123 - DNA, 20 bp, Artificial Sequence
  chemically synthesized
attgcagttttgttcactgt

SEQ ID NO: 507124 - DNA, 20 bp, Artificial Sequence
  chemically synthesized
tatgagtcacaaaaaactaa

SEQ ID NO: 507125 - DNA, 20 bp, Artificial Sequence
  chemically synthesized
gtagttctcctttatccata

SEQ ID NO: 507126 - DNA, 20 bp, Artificial Sequence
  chemically synthesized
gattttgaagcatatcccct

SEQ ID NO: 507127 - DNA, 20 bp, Artificial Sequence
  chemically synthesized
atatgcttcaaaatcctcag

SEQ ID NO: 507128 - DNA, 20 bp, Artificial Sequence
  chemically synthesized
gcagttttaggcatccacct

SEQ ID NO: 507129 - DNA, 20 bp, Artificial Sequence
  chemically synthesized
aaattcataaatactatata

SEQ ID NO: 507130 - DNA, 20 bp, Artificial Sequence
  chemically synthesized
aaaccctatatatagtattt

SEQ ID NO: 507131 - DNA, 20 bp, Artificial Sequence
  chemically synthesized
ttttctttcttcgcaatttc

SEQ ID NO: 507132 - DNA, 20 bp, Artificial Sequence
  chemically synthesized
gcaagaaaaaaatcgcatgc

SEQ ID NO: 507133 - DNA, 20 bp, Artificial Sequence
  chemically synthesized
tatgccaaagaaaaactgtg

SEQ ID NO: 507134 - DNA, 20 bp, Artificial Sequence
  chemically synthesized
tagtcatggccccaaagtgc

SEQ ID NO: 507135 - DNA, 20 bp, Artificial Sequence
  chemically synthesized
gggccatgactaagtaaaac

SEQ ID NO: 507136 - DNA, 20 bp, Artificial Sequence
  chemically synthesized
tctaagaacctagacaggta

SEQ ID NO: 507137 - DNA, 20 bp, Artificial Sequence
  chemically synthesized
agacaggtactgagtaatgg

SEQ ID NO: 507138 - DNA, 20 bp, Artificial Sequence
  chemically synthesized
agcatgaagacgctggacaa

SEQ ID NO: 507139 - DNA, 20 bp, Artificial Sequence
  chemically synthesized
gacaaaggggtgattcagtc

SEQ ID NO: 507140 - DNA, 20 bp, Artificial Sequence
  chemically synthesized
cacctctgtctcacccagga

SEQ ID NO: 507141 - DNA, 20 bp, Artificial Sequence
  chemically synthesized
agtcctgggtgagacagagg

SEQ ID NO: 507142 - DNA, 20 bp, Artificial Sequence
  chemically synthesized
attttaaattgcatgctgtt

SEQ ID NO: 507143 - DNA, 20 bp, Artificial Sequence
  chemically synthesized
cagcatgcaatttaaaattt

SEQ ID NO: 507144 - DNA, 20 bp, Artificial Sequence
  chemically synthesized
atttatgaattgtttatttc

SEQ ID NO: 507145 - DNA, 20 bp, Artificial Sequence
  chemically synthesized
aagccaaggagagcaaaacc

SEQ ID NO: 507146 - DNA, 20 bp, Artificial Sequence
  chemically synthesized
agggagggagggagggaggg

SEQ ID NO: 507147 - DNA, 20 bp, Artificial Sequence
  chemically synthesized
taggttgcctatgtacctaa

SEQ ID NO: 507148 - DNA, 20 bp, Artificial Sequence
  chemically synthesized
tcataaacttgctccattat

SEQ ID NO: 507149 - DNA, 20 bp, Artificial Sequence
  chemically synthesized
aactgtaacctagatattag

SEQ ID NO: 507150 - DNA, 20 bp, Artificial Sequence
  chemically synthesized
aataaattcatgatcaatga

SEQ ID NO: 507151 - DNA, 20 bp, Artificial Sequence
  chemically synthesized
aatgcattcattcattgatc

SEQ ID NO: 507152 - DNA, 20 bp, Artificial Sequence
  chemically synthesized
atataataaattcatgatca

SEQ ID NO: 507153 - DNA, 20 bp, Artificial Sequence
  chemically synthesized
aacaaatatgtaccaaatat

SEQ ID NO: 507154 - DNA, 20 bp, Artificial Sequence
  chemically synthesized
gtggggcatagggcttcaac

SEQ ID NO: 507155 - DNA, 20 bp, Artificial Sequence
  chemically synthesized
ctatgccccacctactacat

SEQ ID NO: 507156 - DNA, 20 bp, Artificial Sequence
  chemically synthesized
aaatagaccattaagttaca

SEQ ID NO: 507157 - DNA, 20 bp, Artificial Sequence
  chemically synthesized
ttaagttacaatgagtctat

SEQ ID NO: 507158 - DNA, 20 bp, Artificial Sequence
  chemically synthesized
ggatacccatcatattggac

SEQ ID NO: 507159 - DNA, 20 bp, Artificial Sequence
  chemically synthesized
ggttactctagtccaatatg

SEQ ID NO: 507160 - DNA, 20 bp, Artificial Sequence
  chemically synthesized
tccaaatttcctcttctcat

SEQ ID NO: 507161 - DNA, 20 bp, Artificial Sequence
  chemically synthesized
tttggacacagcaaaacacc

SEQ ID NO: 507162 - DNA, 20 bp, Artificial Sequence
  chemically synthesized
acacagaggagagaccacgt

SEQ ID NO: 507163 - DNA, 20 bp, Artificial Sequence
  chemically synthesized
cctctctccttggattgcag

SEQ ID NO: 507164 - DNA, 20 bp, Artificial Sequence
  chemically synthesized
ctcttgtgaggcctctctcc

SEQ ID NO: 507165 - DNA, 20 bp, Artificial Sequence
  chemically synthesized
ttcaagaccaaggtactggc

SEQ ID NO: 507166 - DNA, 20 bp, Artificial Sequence
  chemically synthesized
ggtcttgaacttctggcccc

SEQ ID NO: 507167 - DNA, 20 bp, Artificial Sequence
  chemically synthesized
tttaatgatagccctcacaa

SEQ ID NO: 507168 - DNA, 20 bp, Artificial Sequence
  chemically synthesized
acaaaagacaattaagatag

SEQ ID NO: 507169 - DNA, 20 bp, Artificial Sequence
  chemically synthesized
tagccaagtatttcttgaaa

SEQ ID NO: 507170 - DNA, 20 bp, Artificial Sequence
  chemically synthesized
aatacttggctaaatgtctg

SEQ ID NO: 507171 - DNA, 20 bp, Artificial Sequence
  chemically synthesized
ataataataccaacccgtta

SEQ ID NO: 507172 - DNA, 20 bp, Artificial Sequence
  chemically synthesized
ttaacatttgcaattcttta

SEQ ID NO: 507173 - DNA, 20 bp, Artificial Sequence
  chemically synthesized
aagaattgcaaatgttaaac

SEQ ID NO: 507174 - DNA, 20 bp, Artificial Sequence
  chemically synthesized
taatttgaaacaagttattt

SEQ ID NO: 507175 - DNA, 20 bp, Artificial Sequence
  chemically synthesized
catcaaatctaagaactgcc

SEQ ID NO: 507176 - DNA, 20 bp, Artificial Sequence
  chemically synthesized
ttaatgggtgcctttctaca

SEQ ID NO: 507177 - DNA, 20 bp, Artificial Sequence
  chemically synthesized
catttattcgtaaagattta

SEQ ID NO: 507178 - DNA, 20 bp, Artificial Sequence
  chemically synthesized
aaggcacccattaaatcttt

SEQ ID NO: 507179 - DNA, 20 bp, Artificial Sequence
  chemically synthesized
tcttgtgttggaaaccttta

SEQ ID NO: 507180 - DNA, 20 bp, Artificial Sequence
  chemically synthesized
agcaatagaatatgttacta

SEQ ID NO: 507181 - DNA, 20 bp, Artificial Sequence
  chemically synthesized
agtaagataggtttaagcaa

SEQ ID NO: 507182 - DNA, 20 bp, Artificial Sequence
  chemically synthesized
caattcattgagtattttct

SEQ ID NO: 507183 - DNA, 20 bp, Artificial Sequence
  chemically synthesized
ttactcttagaaaatactca

SEQ ID NO: 507184 - DNA, 20 bp, Artificial Sequence
  chemically synthesized
cttagaaaatactcaatgaa

SEQ ID NO: 507185 - DNA, 20 bp, Artificial Sequence
  chemically synthesized
agtgacttagattcaattca

SEQ ID NO: 507186 - DNA, 20 bp, Artificial Sequence
  chemically synthesized
atctcagtgtaagcggaaaa

SEQ ID NO: 507187 - DNA, 20 bp, Artificial Sequence
  chemically synthesized
acacgaagtgctttaaattt

SEQ ID NO: 507188 - DNA, 20 bp, Artificial Sequence
  chemically synthesized
ttagcaatattggccttaat

SEQ ID NO: 507189 - DNA, 20 bp, Artificial Sequence
  chemically synthesized
tggccttaatttgaattaca

SEQ ID NO: 507190 - DNA, 20 bp, Artificial Sequence
  chemically synthesized
aagactatatccctcagctc

SEQ ID NO: 507191 - DNA, 20 bp, Artificial Sequence
  chemically synthesized
tttgagtgattccagagctg

SEQ ID NO: 507192 - DNA, 20 bp, Artificial Sequence
  chemically synthesized
aatgataggaaccagcatct

SEQ ID NO: 507193 - DNA, 20 bp, Artificial Sequence
  chemically synthesized
atgctggttcctatcattgc

SEQ ID NO: 507194 - DNA, 20 bp, Artificial Sequence
  chemically synthesized
tgttagacaagtgtaagaaa

SEQ ID NO: 507195 - DNA, 20 bp, Artificial Sequence
  chemically synthesized
tttttaaagaaccactgtat

SEQ ID NO: 507196 - DNA, 20 bp, Artificial Sequence
  chemically synthesized
gtaacttcaactctgtttct

SEQ ID NO: 507197 - DNA, 20 bp, Artificial Sequence
  chemically synthesized
taaatagaaactcagagaaa

SEQ ID NO: 507198 - DNA, 20 bp, Artificial Sequence
  chemically synthesized
ctgagtttctatttacgtat

SEQ ID NO: 507199 - DNA, 20 bp, Artificial Sequence
  chemically synthesized
gcattattgctaaaagctca

SEQ ID NO: 507200 - DNA, 20 bp, Artificial Sequence
  chemically synthesized
attggttttacatttatgtg

SEQ ID NO: 507201 - DNA, 20 bp, Artificial Sequence
  chemically synthesized
tacacataaatgtaaaacca

SEQ ID NO: 507202 - DNA, 20 bp, Artificial Sequence
  chemically synthesized
acttactgctgagacaaaat

SEQ ID NO: 507203 - DNA, 20 bp, Artificial Sequence
  chemically synthesized
gatctgagcatggacgataa

SEQ ID NO: 507204 - DNA, 20 bp, Artificial Sequence
  chemically synthesized
atgctcagatccacaacggg

SEQ ID NO: 507205 - DNA, 20 bp, Artificial Sequence
  chemically synthesized
aggaaaaaatcctccccgtt

SEQ ID NO: 507206 - DNA, 20 bp, Artificial Sequence
  chemically synthesized
cacgtacaacaatatgacat

SEQ ID NO: 507207 - DNA, 20 bp, Artificial Sequence
  chemically synthesized
gtgccaaggacatttctcat

SEQ ID NO: 507208 - DNA, 20 bp, Artificial Sequence
  chemically synthesized
atagcaactcaaccaaacaa

SEQ ID NO: 507209 - DNA, 20 bp, Artificial Sequence
  chemically synthesized
atctgaattcctttgtttgg

SEQ ID NO: 507210 - DNA, 20 bp, Artificial Sequence
  chemically synthesized
ttagtagccatttttcactt

SEQ ID NO: 507211 - DNA, 20 bp, Artificial Sequence
  chemically synthesized
aatggctactaaaagaacat

SEQ ID NO: 507212 - DNA, 20 bp, Artificial Sequence
  chemically synthesized
aatcttaagtatggtgaccc

SEQ ID NO: 507213 - DNA, 20 bp, Artificial Sequence
  chemically synthesized
tccctggctccagtaaattc

SEQ ID NO: 507214 - DNA, 20 bp, Artificial Sequence
  chemically synthesized
cccttgaatttactggagcc

SEQ ID NO: 507215 - DNA, 20 bp, Artificial Sequence
  chemically synthesized
gaatttactggagccaggga

SEQ ID NO: 507216 - DNA, 20 bp, Artificial Sequence
  chemically synthesized
tcagtattggcgttaagaga

SEQ ID NO: 507217 - DNA, 20 bp, Artificial Sequence
  chemically synthesized
acataattgtttccgcctta

SEQ ID NO: 507218 - DNA, 20 bp, Artificial Sequence
  chemically synthesized
ttaacctgcaataaaataag

SEQ ID NO: 507219 - DNA, 20 bp, Artificial Sequence
  chemically synthesized
tttagcagagaagtgtatta

SEQ ID NO: 507220 - DNA, 20 bp, Artificial Sequence
  chemically synthesized
ataatacacttctctgctaa

SEQ ID NO: 507221 - DNA, 20 bp, Artificial Sequence
  chemically synthesized
aagagaaaaatcaagaaata

SEQ ID NO: 507222 - DNA, 20 bp, Artificial Sequence
  chemically synthesized
atttccatttcaacatcagt

SEQ ID NO: 507223 - DNA, 20 bp, Artificial Sequence
  chemically synthesized
tgccacatttctgcctcata

SEQ ID NO: 507224 - DNA, 20 bp, Artificial Sequence
  chemically synthesized
attatgaggcagaaatgtgg

SEQ ID NO: 507225 - DNA, 20 bp, Artificial Sequence
  chemically synthesized
agaaatgtggcagagtccta

SEQ ID NO: 507226 - DNA, 20 bp, Artificial Sequence
  chemically synthesized
ctactgaatagtgtttagcc

SEQ ID NO: 507227 - DNA, 20 bp, Artificial Sequence
  chemically synthesized
tgtataacatatggtacagg

SEQ ID NO: 507228 - DNA, 20 bp, Artificial Sequence
  chemically synthesized
gggcggataaacctattttg

SEQ ID NO: 507229 - DNA, 20 bp, Artificial Sequence
  chemically synthesized
aggatcatttaaatagaagt

SEQ ID NO: 507230 - DNA, 20 bp, Artificial Sequence
  chemically synthesized
gttcagacaggagattatta

SEQ ID NO: 507231 - DNA, 20 bp, Artificial Sequence
  chemically synthesized
taatctcctgtctgaactca

SEQ ID NO: 507232 - DNA, 20 bp, Artificial Sequence
  chemically synthesized
aagtgacagctaaaaattcc

SEQ ID NO: 507233 - DNA, 20 bp, Artificial Sequence
  chemically synthesized
aggtcacagaagccacagta

SEQ ID NO: 507234 - DNA, 20 bp, Artificial Sequence
  chemically synthesized
aagccacagtactgagtgtc

SEQ ID NO: 507235 - DNA, 20 bp, Artificial Sequence
  chemically synthesized
gagcatgaacttgtagccaa

SEQ ID NO: 507236 - DNA, 20 bp, Artificial Sequence
  chemically synthesized
tataatgaatgccctactga

SEQ ID NO: 507237 - DNA, 20 bp, Artificial Sequence
  chemically synthesized
cttttataatgaatgcccta

SEQ ID NO: 507238 - DNA, 20 bp, Artificial Sequence
  chemically synthesized
tagaaggcatatcttttata

SEQ ID NO: 507239 - DNA, 20 bp, Artificial Sequence
  chemically synthesized
tacagtgagatatccagatg

SEQ ID NO: 507240 - DNA, 20 bp, Artificial Sequence
  chemically synthesized
actccaaagggattcggcat

SEQ ID NO: 507241 - DNA, 20 bp, Artificial Sequence
  chemically synthesized
atccagatgccgaatccctt

SEQ ID NO: 507242 - DNA, 20 bp, Artificial Sequence
  chemically synthesized
aaaatatgaaaagactccaa

SEQ ID NO: 507243 - DNA, 20 bp, Artificial Sequence
  chemically synthesized
tttaatctaatctgcttcac

SEQ ID NO: 507244 - DNA, 20 bp, Artificial Sequence
  chemically synthesized
agttacagtgtcaaatgttt

SEQ ID NO: 507245 - DNA, 20 bp, Artificial Sequence
  chemically synthesized
gttttatgattaaacaaata

SEQ ID NO: 507246 - DNA, 20 bp, Artificial Sequence
  chemically synthesized
tttcagcacaattgcaaagg

SEQ ID NO: 507247 - DNA, 20 bp, Artificial Sequence
  chemically synthesized
ttcctatattatttatttgt

SEQ ID NO: 507248 - DNA, 20 bp, Artificial Sequence
  chemically synthesized
tgtgagtatacaaagtgcta

SEQ ID NO: 507249 - DNA, 20 bp, Artificial Sequence
  chemically synthesized
gtcactgctgttattctttg

SEQ ID NO: 507250 - DNA, 20 bp, Artificial Sequence
  chemically synthesized
acattaaataatatcctgca

SEQ ID NO: 507251 - DNA, 20 bp, Artificial Sequence
  chemically synthesized
ctggtgggagctggagagta

SEQ ID NO: 507252 - DNA, 20 bp, Artificial Sequence
  chemically synthesized
gaacagactggtgggagctg

SEQ ID NO: 507253 - DNA, 20 bp, Artificial Sequence
  chemically synthesized
ctcccaccagtctgttcaat

SEQ ID NO: 507254 - DNA, 20 bp, Artificial Sequence
  chemically synthesized
gataccagaaaataaagagc

SEQ ID NO: 507255 - DNA, 20 bp, Artificial Sequence
  chemically synthesized
tggaaggaacactgttacgc

SEQ ID NO: 507256 - DNA, 20 bp, Artificial Sequence
  chemically synthesized
aaggaatgcctgggaatgtg

SEQ ID NO: 507257 - DNA, 20 bp, Artificial Sequence
  chemically synthesized
caagctaccaaggaatgcct

SEQ ID NO: 507258 - DNA, 20 bp, Artificial Sequence
  chemically synthesized
gaggaaacctcaagctacca

SEQ ID NO: 507259 - DNA, 20 bp, Artificial Sequence
  chemically synthesized
ggagcccacctcaaggagct

SEQ ID NO: 507260 - DNA, 20 bp, Artificial Sequence
  chemically synthesized
cttgcacaaatatcccaaaa

SEQ ID NO: 507261 - DNA, 20 bp, Artificial Sequence
  chemically synthesized
acagtagtagtattcagttt

SEQ ID NO: 507262 - DNA, 20 bp, Artificial Sequence
  chemically synthesized
agatggttctaagacaaaag

SEQ ID NO: 507263 - DNA, 20 bp, Artificial Sequence
  chemically synthesized
ttgtcttagaaccatctttt

SEQ ID NO: 507264 - DNA, 20 bp, Artificial Sequence
  chemically synthesized
ggcaacagtagaactgaagt

SEQ ID NO: 507265 - DNA, 20 bp, Artificial Sequence
  chemically synthesized
aaaactaaagcacagcaaga

SEQ ID NO: 507266 - DNA, 20 bp, Artificial Sequence
  chemically synthesized
cctagcagttacctgtctag

SEQ ID NO: 507267 - DNA, 20 bp, Artificial Sequence
  chemically synthesized
tctcctagacaggtaactgc

SEQ ID NO: 507268 - DNA, 20 bp, Artificial Sequence
  chemically synthesized
aaagtgctcttaaatctgtg

SEQ ID NO: 507269 - DNA, 20 bp, Artificial Sequence
  chemically synthesized
attgagatgcttgtgatagt

SEQ ID NO: 507270 - DNA, 20 bp, Artificial Sequence
  chemically synthesized
tgctccagatttatcacatc

SEQ ID NO: 507271 - DNA, 20 bp, Artificial Sequence
  chemically synthesized
gtgataaatctggagcatga

SEQ ID NO: 507272 - DNA, 20 bp, Artificial Sequence
  chemically synthesized
ataaagcttatgttttatac

SEQ ID NO: 507273 - DNA, 20 bp, Artificial Sequence
  chemically synthesized
aagaaaaaaaggatacctat

SEQ ID NO: 507274 - DNA, 20 bp, Artificial Sequence
  chemically synthesized
gtctcaaagaaaaagaaaaa

SEQ ID NO: 507275 - DNA, 20 bp, Artificial Sequence
  chemically synthesized
ttttttctttttctttgaga

SEQ ID NO: 507276 - DNA, 20 bp, Artificial Sequence
  chemically synthesized
acctccaccacccaagttca

SEQ ID NO: 507277 - DNA, 20 bp, Artificial Sequence
  chemically synthesized
ggcacaagaatcccttgaac

SEQ ID NO: 507278 - DNA, 20 bp, Artificial Sequence
  chemically synthesized
tacttgggaaactgaggcac

SEQ ID NO: 507279 - DNA, 20 bp, Artificial Sequence
  chemically synthesized
gcctcagtttcccaagtagc

SEQ ID NO: 507280 - DNA, 20 bp, Artificial Sequence
  chemically synthesized
tttttgtattttagtagaga

SEQ ID NO: 507281 - DNA, 20 bp, Artificial Sequence
  chemically synthesized
cgggcagatcacttgaggtc

SEQ ID NO: 507282 - DNA, 20 bp, Artificial Sequence
  chemically synthesized
gcctcggcctcgcaaagtgc

SEQ ID NO: 507283 - DNA, 20 bp, Artificial Sequence
  chemically synthesized
agagttggcatgagacatag

SEQ ID NO: 507284 - DNA, 20 bp, Artificial Sequence
  chemically synthesized
ggatgaaaagttgtgatgtc

SEQ ID NO: 507285 - DNA, 20 bp, Artificial Sequence
  chemically synthesized
gttagaatttgtgatttctt

SEQ ID NO: 507286 - DNA, 20 bp, Artificial Sequence
  chemically synthesized
attttattaggtatgtacgt

SEQ ID NO: 507287 - DNA, 20 bp, Artificial Sequence
  chemically synthesized
ataagataatgtaggtgtaa

SEQ ID NO: 507288 - DNA, 20 bp, Artificial Sequence
  chemically synthesized
ttctacatagtaaccagagc

SEQ ID NO: 507289 - DNA, 20 bp, Artificial Sequence
  chemically synthesized
actatgtagaaaaacagact

SEQ ID NO: 507290 - DNA, 20 bp, Artificial Sequence
  chemically synthesized
aaaaaaatgtgacatgaact

SEQ ID NO: 507291 - DNA, 20 bp, Artificial Sequence
  chemically synthesized
cgaatcatttgtgtctttct

SEQ ID NO: 507292 - DNA, 20 bp, Artificial Sequence
  chemically synthesized
ttttccgttttggagtcagc

SEQ ID NO: 507293 - DNA, 20 bp, Artificial Sequence
  chemically synthesized
tttttccagattttccgttt

SEQ ID NO: 507294 - DNA, 20 bp, Artificial Sequence
  chemically synthesized
taaaaatgtccatttttaat

SEQ ID NO: 507295 - DNA, 20 bp, Artificial Sequence
  chemically synthesized
ttggtaactggcttcataac

SEQ ID NO: 507296 - DNA, 20 bp, Artificial Sequence
  chemically synthesized
atggacgtaaaggaaaaact

SEQ ID NO: 507297 - DNA, 20 bp, Artificial Sequence
  chemically synthesized
cttcctgtaataaactaaac

SEQ ID NO: 507298 - DNA, 20 bp, Artificial Sequence
  chemically synthesized
tcatgtgatttgacatatag

SEQ ID NO: 507299 - DNA, 20 bp, Artificial Sequence
  chemically synthesized
aattttatcatatatttttc

SEQ ID NO: 507300 - DNA, 20 bp, Artificial Sequence
  chemically synthesized
tctaagaggttttatcacta

SEQ ID NO: 507301 - DNA, 20 bp, Artificial Sequence
  chemically synthesized
ccggtagtgataaaacctct

SEQ ID NO: 507302 - DNA, 20 bp, Artificial Sequence
  chemically synthesized
tctagtacaatgggagtatt

SEQ ID NO: 507303 - DNA, 20 bp, Artificial Sequence
  chemically synthesized
ccacaatactcccattgtac

SEQ ID NO: 507304 - DNA, 20 bp, Artificial Sequence
  chemically synthesized
tataaatactctagtacaat

SEQ ID NO: 507305 - DNA, 20 bp, Artificial Sequence
  chemically synthesized
tgtacatatataggttgttt

SEQ ID NO: 507306 - DNA, 20 bp, Artificial Sequence
  chemically synthesized
aacaacctatatatgtacat

SEQ ID NO: 507307 - DNA, 20 bp, Artificial Sequence
  chemically synthesized
tgctacatttacttaataat

SEQ ID NO: 507308 - DNA, 20 bp, Artificial Sequence
  chemically synthesized
aagtaaatgtagcatggtac

SEQ ID NO: 507309 - DNA, 20 bp, Artificial Sequence
  chemically synthesized
gtttttatatttttgctgtt

SEQ ID NO: 507310 - DNA, 20 bp, Artificial Sequence
  chemically synthesized
ctttctctgagatttatttc

SEQ ID NO: 507311 - DNA, 20 bp, Artificial Sequence
  chemically synthesized
ataaagacctaactaaatga

SEQ ID NO: 507312 - DNA, 20 bp, Artificial Sequence
  chemically synthesized
attctctggatcaacttgta

SEQ ID NO: 507313 - DNA, 20 bp, Artificial Sequence
  chemically synthesized
attctgtacaagttgatcca

SEQ ID NO: 507314 - DNA, 20 bp, Artificial Sequence
  chemically synthesized
aattggatttcatctattct

SEQ ID NO: 507315 - DNA, 20 bp, Artificial Sequence
  chemically synthesized
agaatctgctgtggttttaa

SEQ ID NO: 507316 - DNA, 20 bp, Artificial Sequence
  chemically synthesized
ttgtgaaccctgcccccaaa

SEQ ID NO: 507317 - DNA, 20 bp, Artificial Sequence
  chemically synthesized
cagcagattctttttggggg

SEQ ID NO: 507318 - DNA, 20 bp, Artificial Sequence
  chemically synthesized
ttggccatttcgatctccat

SEQ ID NO: 507319 - DNA, 20 bp, Artificial Sequence
  chemically synthesized
tagtcaaataaaagcctgtc

SEQ ID NO: 507320 - DNA, 20 bp, Artificial Sequence
  chemically synthesized
atttacatctcaaagaggca

SEQ ID NO: 507321 - DNA, 20 bp, Artificial Sequence
  chemically synthesized
atgtaaatcttctacaatcc

SEQ ID NO: 507322 - DNA, 20 bp, Artificial Sequence
  chemically synthesized
ggtccttgagaaagatattc

SEQ ID NO: 507323 - DNA, 20 bp, Artificial Sequence
  chemically synthesized
actggaagatattagggggt

SEQ ID NO: 507324 - DNA, 20 bp, Artificial Sequence
  chemically synthesized
aaaaatactggaagatatta

SEQ ID NO: 507325 - DNA, 20 bp, Artificial Sequence
  chemically synthesized
ctactgaaagaaagacagga

SEQ ID NO: 507326 - DNA, 20 bp, Artificial Sequence
  chemically synthesized
ttattcaagactactgaatt

SEQ ID NO: 507327 - DNA, 20 bp, Artificial Sequence
  chemically synthesized
tgatccataattcagtagtc

SEQ ID NO: 507328 - DNA, 20 bp, Artificial Sequence
  chemically synthesized
aaagactttattcaagacta

SEQ ID NO: 507329 - DNA, 20 bp, Artificial Sequence
  chemically synthesized
gcctcggcctgccgaagtgt

SEQ ID NO: 507330 - DNA, 20 bp, Artificial Sequence
  chemically synthesized
ctggcagatcacctgaggtc

SEQ ID NO: 507331 - DNA, 20 bp, Artificial Sequence
  chemically synthesized
ttttgtattttgagtagaga

SEQ ID NO: 507332 - DNA, 20 bp, Artificial Sequence
  chemically synthesized
tggctaattttttttgtatt

SEQ ID NO: 507333 - DNA, 20 bp, Artificial Sequence
  chemically synthesized
tgcctcaacctcctgaatag

SEQ ID NO: 507334 - DNA, 20 bp, Artificial Sequence
  chemically synthesized
aattctcctgcctcaacctc

SEQ ID NO: 507335 - DNA, 20 bp, Artificial Sequence
  chemically synthesized
tattcaggaggttgaggcag

SEQ ID NO: 507336 - DNA, 20 bp, Artificial Sequence
  chemically synthesized
gaattgcttgaaccagggag

SEQ ID NO: 507337 - DNA, 20 bp, Artificial Sequence
  chemically synthesized
tcttgccactgcactccagc

SEQ ID NO: 507338 - DNA, 20 bp, Artificial Sequence
  chemically synthesized
ttcgctgtttctacccaggc

SEQ ID NO: 507339 - DNA, 20 bp, Artificial Sequence
  chemically synthesized
atggtaatatttttttgaga

SEQ ID NO: 507340 - DNA, 20 bp, Artificial Sequence
  chemically synthesized
ctatagtaattaaaacaatg

SEQ ID NO: 507341 - DNA, 20 bp, Artificial Sequence
  chemically synthesized
agtagagaaataaaactgat

SEQ ID NO: 507342 - DNA, 20 bp, Artificial Sequence
  chemically synthesized
aataaaatgcctatacgtgc

SEQ ID NO: 507343 - DNA, 20 bp, Artificial Sequence
  chemically synthesized
tttcgtcaaagatgacacca

SEQ ID NO: 507344 - DNA, 20 bp, Artificial Sequence
  chemically synthesized
acaccacagaatattgagga

SEQ ID NO: 507345 - DNA, 20 bp, Artificial Sequence
  chemically synthesized
gaaacaacaagttggcactg

SEQ ID NO: 507346 - DNA, 20 bp, Artificial Sequence
  chemically synthesized
gtgccaacttgttgtttcag

SEQ ID NO: 507347 - DNA, 20 bp, Artificial Sequence
  chemically synthesized
attacaggtatgaggaaggg

SEQ ID NO: 507348 - DNA, 20 bp, Artificial Sequence
  chemically synthesized
tattattacaggtatgagga

SEQ ID NO: 507349 - DNA, 20 bp, Artificial Sequence
  chemically synthesized
cctcatacctgtaataatag

SEQ ID NO: 507350 - DNA, 20 bp, Artificial Sequence
  chemically synthesized
aaaattctgaagctatggtc

SEQ ID NO: 507351 - DNA, 20 bp, Artificial Sequence
  chemically synthesized
gcaacccaggaccatagctt

SEQ ID NO: 507352 - DNA, 20 bp, Artificial Sequence
  chemically synthesized
agcttcagaattttaaagta

SEQ ID NO: 507353 - DNA, 20 bp, Artificial Sequence
  chemically synthesized
tatgaagagatatatcatta

SEQ ID NO: 507354 - DNA, 20 bp, Artificial Sequence
  chemically synthesized
tattacatttttctttttga

SEQ ID NO: 507355 - DNA, 20 bp, Artificial Sequence
  chemically synthesized
tttatattacatttttcttt

SEQ ID NO: 507356 - DNA, 20 bp, Artificial Sequence
  chemically synthesized
aaaatgtaatataaacagca

SEQ ID NO: 507357 - DNA, 20 bp, Artificial Sequence
  chemically synthesized
tataaacagcaaagaatacc

SEQ ID NO: 507358 - DNA, 20 bp, Artificial Sequence
  chemically synthesized
tagtttaaaatatatatatt

SEQ ID NO: 507359 - DNA, 20 bp, Artificial Sequence
  chemically synthesized
ctgaaatgcctgtttttcta

SEQ ID NO: 507360 - DNA, 20 bp, Artificial Sequence
  chemically synthesized
gaaaaacaggcatttcagag

SEQ ID NO: 507361 - DNA, 20 bp, Artificial Sequence
  chemically synthesized
tatactgatgaccagtgagg

SEQ ID NO: 507362 - DNA, 20 bp, Artificial Sequence
  chemically synthesized
acaaactgcttcatatcttc

SEQ ID NO: 507363 - DNA, 20 bp, Artificial Sequence
  chemically synthesized
tactttcatttactactggt

SEQ ID NO: 507364 - DNA, 20 bp, Artificial Sequence
  chemically synthesized
catttactactggtgagaat

SEQ ID NO: 507365 - DNA, 20 bp, Artificial Sequence
  chemically synthesized
tagctttcaagatattaaca

SEQ ID NO: 507366 - DNA, 20 bp, Artificial Sequence
  chemically synthesized
agaatagcatttcttaatca

SEQ ID NO: 507367 - DNA, 20 bp, Artificial Sequence
  chemically synthesized
tttgtattaggtatttacct

SEQ ID NO: 507368 - DNA, 20 bp, Artificial Sequence
  chemically synthesized
cgtacaatttatgttgatag

SEQ ID NO: 507369 - DNA, 20 bp, Artificial Sequence
  chemically synthesized
acatattctgttcagaaaat

SEQ ID NO: 507370 - DNA, 20 bp, Artificial Sequence
  chemically synthesized
aacaaccccaattttctgaa

SEQ ID NO: 507371 - DNA, 20 bp, Artificial Sequence
  chemically synthesized
gctggatagaattactttgt

SEQ ID NO: 507372 - DNA, 20 bp, Artificial Sequence
  chemically synthesized
tattaattttcatcgctgga

SEQ ID NO: 507373 - DNA, 20 bp, Artificial Sequence
  chemically synthesized
tactttattaattttcatcg

SEQ ID NO: 507374 - DNA, 20 bp, Artificial Sequence
  chemically synthesized
gtaatgctatatgcaacata

SEQ ID NO: 507375 - DNA, 20 bp, Artificial Sequence
  chemically synthesized
tttttaactggcttttttca

SEQ ID NO: 507376 - DNA, 20 bp, Artificial Sequence
  chemically synthesized
cctcaaaggtaacatgtatc

SEQ ID NO: 507377 - DNA, 20 bp, Artificial Sequence
  chemically synthesized
gttacctttgaggagatggg

SEQ ID NO: 507378 - DNA, 20 bp, Artificial Sequence
  chemically synthesized
tggtaacatactatcttttt

SEQ ID NO: 507379 - DNA, 20 bp, Artificial Sequence
  chemically synthesized
atactatctttttctggatg

SEQ ID NO: 507380 - DNA, 20 bp, Artificial Sequence
  chemically synthesized
aatgttatttggccataaaa

SEQ ID NO: 507381 - DNA, 20 bp, Artificial Sequence
  chemically synthesized
caattttttagctcccacat

SEQ ID NO: 507382 - DNA, 20 bp, Artificial Sequence
  chemically synthesized
cacatgtgggagctaaaaaa

SEQ ID NO: 507383 - DNA, 20 bp, Artificial Sequence
  chemically synthesized
gatctcatagagctagagat

SEQ ID NO: 507384 - DNA, 20 bp, Artificial Sequence
  chemically synthesized
gatagatactggagactggg

SEQ ID NO: 507385 - DNA, 20 bp, Artificial Sequence
  chemically synthesized
ctggagactgggaagagtgt

SEQ ID NO: 507386 - DNA, 20 bp, Artificial Sequence
  chemically synthesized
gactgggaagagtgtgtgga

SEQ ID NO: 507387 - DNA, 20 bp, Artificial Sequence
  chemically synthesized
gaatgaagagaggttgttta

SEQ ID NO: 507388 - DNA, 20 bp, Artificial Sequence
  chemically synthesized
ggtacatacgcttagataga

SEQ ID NO: 507389 - DNA, 20 bp, Artificial Sequence
  chemically synthesized
taagttctaatgttcgatag

SEQ ID NO: 507390 - DNA, 20 bp, Artificial Sequence
  chemically synthesized
ataatatttgtacatactta

SEQ ID NO: 507391 - DNA, 20 bp, Artificial Sequence
  chemically synthesized
tattaacacttgcattcata

SEQ ID NO: 507392 - DNA, 20 bp, Artificial Sequence
  chemically synthesized
cccggccaataatattcttt

SEQ ID NO: 507393 - DNA, 20 bp, Artificial Sequence
  chemically synthesized
ttcataaagaatattattgg

SEQ ID NO: 507394 - DNA, 20 bp, Artificial Sequence
  chemically synthesized
gcctcggcctcccaaagtgc

SEQ ID NO: 507395 - DNA, 20 bp, Artificial Sequence
  chemically synthesized
actttgggaggccgaggctg

SEQ ID NO: 507396 - DNA, 20 bp, Artificial Sequence
  chemically synthesized
tttttgtattttctgtagag

SEQ ID NO: 507397 - DNA, 20 bp, Artificial Sequence
  chemically synthesized
gcctgcagtcccagctactc

SEQ ID NO: 507398 - DNA, 20 bp, Artificial Sequence
  chemically synthesized
cattctcctacctcagactc

SEQ ID NO: 507399 - DNA, 20 bp, Artificial Sequence
  chemically synthesized
tactcgggagtctgaggtag

SEQ ID NO: 507400 - DNA, 20 bp, Artificial Sequence
  chemically synthesized
ctcactgtaagctctgcctc

SEQ ID NO: 507401 - DNA, 20 bp, Artificial Sequence
  chemically synthesized
tcgcgccactgcactccagc

SEQ ID NO: 507402 - DNA, 20 bp, Artificial Sequence
  chemically synthesized
tcctgctctgtcacccaggc

SEQ ID NO: 507403 - DNA, 20 bp, Artificial Sequence
  chemically synthesized
ttttttttttttttttgaga

SEQ ID NO: 507404 - DNA, 20 bp, Artificial Sequence
  chemically synthesized
aaaaaaaaaaaaaaaaaaaa

SEQ ID NO: 507405 - DNA, 20 bp, Artificial Sequence
  chemically synthesized
ttcccctgtaattttgtatg

SEQ ID NO: 507406 - DNA, 20 bp, Artificial Sequence
  chemically synthesized
tattatgatcactgttatct

SEQ ID NO: 507407 - DNA, 20 bp, Artificial Sequence
  chemically synthesized
tttgataatttttatcatga

SEQ ID NO: 507408 - DNA, 20 bp, Artificial Sequence
  chemically synthesized
ctattctgactttataattt

SEQ ID NO: 507409 - DNA, 20 bp, Artificial Sequence
  chemically synthesized
caactcataaattataaagt

SEQ ID NO: 507410 - DNA, 20 bp, Artificial Sequence
  chemically synthesized
aagtcagaatagaaaacaga

SEQ ID NO: 507411 - DNA, 20 bp, Artificial Sequence
  chemically synthesized
gatttgaaagaacacaatgt

SEQ ID NO: 507412 - DNA, 20 bp, Artificial Sequence
  chemically synthesized
gttgtaatacatttggccaa

SEQ ID NO: 507413 - DNA, 20 bp, Artificial Sequence
  chemically synthesized
atacttacagcacattggct

SEQ ID NO: 507414 - DNA, 20 bp, Artificial Sequence
  chemically synthesized
tttggatgttcaaatttcat

SEQ ID NO: 507415 - DNA, 20 bp, Artificial Sequence
  chemically synthesized
gtatcaagtataaataaatg

SEQ ID NO: 507416 - DNA, 20 bp, Artificial Sequence
  chemically synthesized
attcagttattagaaaactt

SEQ ID NO: 507417 - DNA, 20 bp, Artificial Sequence
  chemically synthesized
actcaaaagttttctaataa

SEQ ID NO: 507418 - DNA, 20 bp, Artificial Sequence
  chemically synthesized
tgactggtatgcttgaggaa

SEQ ID NO: 507419 - DNA, 20 bp, Artificial Sequence
  chemically synthesized
cctttggctattttgagcac

SEQ ID NO: 507420 - DNA, 20 bp, Artificial Sequence
  chemically synthesized
aattttatatactaatgcaa

SEQ ID NO: 507421 - DNA, 20 bp, Artificial Sequence
  chemically synthesized
agaacaacactgttctagaa

SEQ ID NO: 507422 - DNA, 20 bp, Artificial Sequence
  chemically synthesized
atatttatgtactaatgcaa

SEQ ID NO: 507423 - DNA, 20 bp, Artificial Sequence
  chemically synthesized
tagatatagcatttgcatga

SEQ ID NO: 507424 - DNA, 20 bp, Artificial Sequence
  chemically synthesized
tgaatagatatagcatttgc

SEQ ID NO: 507425 - DNA, 20 bp, Artificial Sequence
  chemically synthesized
ctatatctattcatatatat

SEQ ID NO: 507426 - DNA, 20 bp, Artificial Sequence
  chemically synthesized
caatatctattcatatatat

SEQ ID NO: 507427 - DNA, 20 bp, Artificial Sequence
  chemically synthesized
tacagatagatagtatttgc

SEQ ID NO: 507428 - DNA, 20 bp, Artificial Sequence
  chemically synthesized
gatagatagtatttgcatga

SEQ ID NO: 507429 - DNA, 20 bp, Artificial Sequence
  chemically synthesized
aatgagttaaatttacaggt

SEQ ID NO: 507430 - DNA, 20 bp, Artificial Sequence
  chemically synthesized
ggtttactaatcagcaacgg

SEQ ID NO: 507431 - DNA, 20 bp, Artificial Sequence
  chemically synthesized
ccacatagcaaatttctact

SEQ ID NO: 507432 - DNA, 20 bp, Artificial Sequence
  chemically synthesized
agattgggagaaatctcagg

SEQ ID NO: 507433 - DNA, 20 bp, Artificial Sequence
  chemically synthesized
caggttgagttgtcacacat

SEQ ID NO: 507434 - DNA, 20 bp, Artificial Sequence
  chemically synthesized
cacctgcaagctatatgaac

SEQ ID NO: 507435 - DNA, 20 bp, Artificial Sequence
  chemically synthesized
tggctttctcatttgtgata

SEQ ID NO: 507436 - DNA, 20 bp, Artificial Sequence
  chemically synthesized
ttattagattattatttttc

SEQ ID NO: 507437 - DNA, 20 bp, Artificial Sequence
  chemically synthesized
aaatgttgatgcttagcttt

SEQ ID NO: 507438 - DNA, 20 bp, Artificial Sequence
  chemically synthesized
agttcctaattttatatttg

SEQ ID NO: 507439 - DNA, 20 bp, Artificial Sequence
  chemically synthesized
aatagaagttatttatgaag

SEQ ID NO: 507440 - DNA, 20 bp, Artificial Sequence
  chemically synthesized
acttctatttcttaatttga

SEQ ID NO: 507441 - DNA, 20 bp, Artificial Sequence
  chemically synthesized
gtatgagaaagaaaatttta

SEQ ID NO: 507442 - DNA, 20 bp, Artificial Sequence
  chemically synthesized
atttttatagtacatatctt

SEQ ID NO: 507443 - DNA, 20 bp, Artificial Sequence
  chemically synthesized
tgctatatctcagttacaaa

SEQ ID NO: 507444 - DNA, 20 bp, Artificial Sequence
  chemically synthesized
agtatcacacaggttacaaa

SEQ ID NO: 507445 - DNA, 20 bp, Artificial Sequence
  chemically synthesized
atagttttaacttgtgtaac

SEQ ID NO: 507446 - DNA, 20 bp, Artificial Sequence
  chemically synthesized
aatctggataagtagacaat

SEQ ID NO: 507447 - DNA, 20 bp, Artificial Sequence
  chemically synthesized
aatttttaaaggtgacaaat

SEQ ID NO: 507448 - DNA, 20 bp, Artificial Sequence
  chemically synthesized
ctgttggtcaaaataattgg

SEQ ID NO: 507449 - DNA, 20 bp, Artificial Sequence
  chemically synthesized
ctttcataagaaaaaacaat

SEQ ID NO: 507450 - DNA, 20 bp, Artificial Sequence
  chemically synthesized
tttcttatgaaagtaatttt

SEQ ID NO: 507451 - DNA, 20 bp, Artificial Sequence
  chemically synthesized
tttaaagctgaagttctcta

SEQ ID NO: 507452 - DNA, 20 bp, Artificial Sequence
  chemically synthesized
aagttctctacagaatgagg

SEQ ID NO: 507453 - DNA, 20 bp, Artificial Sequence
  chemically synthesized
aatgtcccttccaatacagg

SEQ ID NO: 507454 - DNA, 20 bp, Artificial Sequence
  chemically synthesized
gttttaaaagaggtgacata

SEQ ID NO: 507455 - DNA, 20 bp, Artificial Sequence
  chemically synthesized
taataatatttaacacaaac

SEQ ID NO: 507456 - DNA, 20 bp, Artificial Sequence
  chemically synthesized
cacagctcttatcgcattgt

SEQ ID NO: 507457 - DNA, 20 bp, Artificial Sequence
  chemically synthesized
cagatatctgtaaagggtaa

SEQ ID NO: 507458 - DNA, 20 bp, Artificial Sequence
  chemically synthesized
tacattatcagatatctgta

SEQ ID NO: 507459 - DNA, 20 bp, Artificial Sequence
  chemically synthesized
aagatggggaaactaaagcc

SEQ ID NO: 507460 - DNA, 20 bp, Artificial Sequence
  chemically synthesized
tagataaggaacagagcagg

SEQ ID NO: 507461 - DNA, 20 bp, Artificial Sequence
  chemically synthesized
gagcaggaagggtctatttc

SEQ ID NO: 507462 - DNA, 20 bp, Artificial Sequence
  chemically synthesized
taagtcaaaaaaatctttct

SEQ ID NO: 507463 - DNA, 20 bp, Artificial Sequence
  chemically synthesized
atgaacctatgaacagacgg

SEQ ID NO: 507464 - DNA, 20 bp, Artificial Sequence
  chemically synthesized
cagtaattcttgtaagataa

SEQ ID NO: 507465 - DNA, 20 bp, Artificial Sequence
  chemically synthesized
ggttcattcagttatcttac

SEQ ID NO: 507466 - DNA, 20 bp, Artificial Sequence
  chemically synthesized
ttgtatctgacaatgcaggc

SEQ ID NO: 507467 - DNA, 20 bp, Artificial Sequence
  chemically synthesized
tgtaatttagattctaataa

SEQ ID NO: 507468 - DNA, 20 bp, Artificial Sequence
  chemically synthesized
aatgtgctttactcttttat

SEQ ID NO: 507469 - DNA, 20 bp, Artificial Sequence
  chemically synthesized
ggtgcccaaacagacacaat

SEQ ID NO: 507470 - DNA, 20 bp, Artificial Sequence
  chemically synthesized
gtacagacatggcacaaaga

SEQ ID NO: 507471 - DNA, 20 bp, Artificial Sequence
  chemically synthesized
agggagtagtcatcactagg

SEQ ID NO: 507472 - DNA, 20 bp, Artificial Sequence
  chemically synthesized
ttcatggaggaaaacttgaa

SEQ ID NO: 507473 - DNA, 20 bp, Artificial Sequence
  chemically synthesized
tcaaagcagatcttatgaag

SEQ ID NO: 507474 - DNA, 20 bp, Artificial Sequence
  chemically synthesized
cgacctctttgcacatacca

SEQ ID NO: 507475 - DNA, 20 bp, Artificial Sequence
  chemically synthesized
tgcaaagaggtcgtaacata

SEQ ID NO: 507476 - DNA, 20 bp, Artificial Sequence
  chemically synthesized
gggtatcagaaacagcttgt

SEQ ID NO: 507477 - DNA, 20 bp, Artificial Sequence
  chemically synthesized
acaagtctatagagactggt

SEQ ID NO: 507478 - DNA, 20 bp, Artificial Sequence
  chemically synthesized
taccttgtaggccaaagtat

SEQ ID NO: 507479 - DNA, 20 bp, Artificial Sequence
  chemically synthesized
tcagaatctggaaagtgact

SEQ ID NO: 507480 - DNA, 20 bp, Artificial Sequence
  chemically synthesized
gttctcctttgcttaaaatc

SEQ ID NO: 507481 - DNA, 20 bp, Artificial Sequence
  chemically synthesized
atctccacattgaagtcagt

SEQ ID NO: 507482 - DNA, 20 bp, Artificial Sequence
  chemically synthesized
cactgacttcaatgtggaga

SEQ ID NO: 507483 - DNA, 20 bp, Artificial Sequence
  chemically synthesized
gggctcataagggaaaggac

SEQ ID NO: 507484 - DNA, 20 bp, Artificial Sequence
  chemically synthesized
tcataagggaaaggacaggg

SEQ ID NO: 507485 - DNA, 20 bp, Artificial Sequence
  chemically synthesized
gaaaggacagggatgaattt

SEQ ID NO: 507486 - DNA, 20 bp, Artificial Sequence
  chemically synthesized
tgacacctgtaccagaaacc

SEQ ID NO: 507487 - DNA, 20 bp, Artificial Sequence
  chemically synthesized
ctttaaacctgctttcctta

SEQ ID NO: 507488 - DNA, 20 bp, Artificial Sequence
  chemically synthesized
gtgaggtaagtttcatcttg

SEQ ID NO: 507489 - DNA, 20 bp, Artificial Sequence
  chemically synthesized
tgaagtgttgtttggacttc

SEQ ID NO: 507490 - DNA, 20 bp, Artificial Sequence
  chemically synthesized
gtcttctgcccagatctttc

SEQ ID NO: 507491 - DNA, 20 bp, Artificial Sequence
  chemically synthesized
agatctgggcagaagacatc

SEQ ID NO: 507492 - DNA, 20 bp, Artificial Sequence
  chemically synthesized
gcagacagaagttggtaact

SEQ ID NO: 507493 - DNA, 20 bp, Artificial Sequence
  chemically synthesized
catcctgtgaagaatatttg

SEQ ID NO: 507494 - DNA, 20 bp, Artificial Sequence
  chemically synthesized
cactctacaaatattcttca

SEQ ID NO: 507495 - DNA, 20 bp, Artificial Sequence
  chemically synthesized
tcagatggcagcatcctgtg

SEQ ID NO: 507496 - DNA, 20 bp, Artificial Sequence
  chemically synthesized
ctgagaaaatcctgctaaga

SEQ ID NO: 507497 - DNA, 20 bp, Artificial Sequence
  chemically synthesized
cgattggtactctatcttag

SEQ ID NO: 507498 - DNA, 20 bp, Artificial Sequence
  chemically synthesized
acagtgtattcaaatcagca

SEQ ID NO: 507499 - DNA, 20 bp, Artificial Sequence
  chemically synthesized
taattatactctatgctgat

SEQ ID NO: 507500 - DNA, 20 bp, Artificial Sequence
  chemically synthesized
agtctgtgattgcattaact

SEQ ID NO: 507501 - DNA, 20 bp, Artificial Sequence
  chemically synthesized
tttgaaacaagcttgatatt

SEQ ID NO: 507502 - DNA, 20 bp, Artificial Sequence
  chemically synthesized
aaacataagcacatatgaga

SEQ ID NO: 507503 - DNA, 20 bp, Artificial Sequence
  chemically synthesized
ttgaattagtttgagataca

SEQ ID NO: 507504 - DNA, 20 bp, Artificial Sequence
  chemically synthesized
atgcaagtagtataaatcag

SEQ ID NO: 507505 - DNA, 20 bp, Artificial Sequence
  chemically synthesized
caacatttcgaactataaac

SEQ ID NO: 507506 - DNA, 20 bp, Artificial Sequence
  chemically synthesized
agttttctgacttaaaacaa

SEQ ID NO: 507507 - DNA, 20 bp, Artificial Sequence
  chemically synthesized
atagctatgtcctgaggagt

SEQ ID NO: 507508 - DNA, 20 bp, Artificial Sequence
  chemically synthesized
aggtttatagctatgtcctg

SEQ ID NO: 507509 - DNA, 20 bp, Artificial Sequence
  chemically synthesized
gcccctgtaggagtggttaa

SEQ ID NO: 507510 - DNA, 20 bp, Artificial Sequence
  chemically synthesized
tgtgtaaagtgtgcccctgt

SEQ ID NO: 507511 - DNA, 20 bp, Artificial Sequence
  chemically synthesized
tctggggaaggaagccattt

SEQ ID NO: 507512 - DNA, 20 bp, Artificial Sequence
  chemically synthesized
cctcaaatggcttccttccc

SEQ ID NO: 507513 - DNA, 20 bp, Artificial Sequence
  chemically synthesized
acgtaaatcagatactagaa

SEQ ID NO: 507514 - DNA, 20 bp, Artificial Sequence
  chemically synthesized
ttctctatgagtgttcgtgg

SEQ ID NO: 507515 - DNA, 20 bp, Artificial Sequence
  chemically synthesized
atctttctctatgagtgttc

SEQ ID NO: 507516 - DNA, 20 bp, Artificial Sequence
  chemically synthesized
aggtgagtctatctttctct

SEQ ID NO: 507517 - DNA, 20 bp, Artificial Sequence
  chemically synthesized
tgatactgtttattggtaag

SEQ ID NO: 507518 - DNA, 20 bp, Artificial Sequence
  chemically synthesized
gctaaaaggttcaggaaaat

SEQ ID NO: 507519 - DNA, 20 bp, Artificial Sequence
  chemically synthesized
ggctgatccaatggaatgga

SEQ ID NO: 507520 - DNA, 20 bp, Artificial Sequence
  chemically synthesized
ctcaaattcattccattcca

SEQ ID NO: 507521 - DNA, 20 bp, Artificial Sequence
  chemically synthesized
aattggctgatccaatggaa

SEQ ID NO: 507522 - DNA, 20 bp, Artificial Sequence
  chemically synthesized
tattaaattggctgatccaa

SEQ ID NO: 507523 - DNA, 20 bp, Artificial Sequence
  chemically synthesized
gtttacatgactcaatttta

SEQ ID NO: 507524 - DNA, 20 bp, Artificial Sequence
  chemically synthesized
ctaagctacattcgctaaaa

SEQ ID NO: 507525 - DNA, 20 bp, Artificial Sequence
  chemically synthesized
taaacatatttattgcctga

SEQ ID NO: 507526 - DNA, 20 bp, Artificial Sequence
  chemically synthesized
aaaacctggaaaacacaatt

SEQ ID NO: 507527 - DNA, 20 bp, Artificial Sequence
  chemically synthesized
caggttttccttcttgaaaa

SEQ ID NO: 507528 - DNA, 20 bp, Artificial Sequence
  chemically synthesized
aatattatgtgtcaacttca

SEQ ID NO: 507529 - DNA, 20 bp, Artificial Sequence
  chemically synthesized
gtgtcaacttcatggaattg

SEQ ID NO: 507530 - DNA, 20 bp, Artificial Sequence
  chemically synthesized
ctgatgaagtattgtttctt

SEQ ID NO: 507531 - DNA, 20 bp, Artificial Sequence
  chemically synthesized
tttcttccgggtgtgtctgt

SEQ ID NO: 507532 - DNA, 20 bp, Artificial Sequence
  chemically synthesized
gaggaaggcccaccctcaat

SEQ ID NO: 507533 - DNA, 20 bp, Artificial Sequence
  chemically synthesized
gggtggtgcccacccacatt

SEQ ID NO: 507534 - DNA, 20 bp, Artificial Sequence
  chemically synthesized
ctagtctaactggcagctga

SEQ ID NO: 507535 - DNA, 20 bp, Artificial Sequence
  chemically synthesized
tagaacaaagccaggagaac

SEQ ID NO: 507536 - DNA, 20 bp, Artificial Sequence
  chemically synthesized
ccgcagggcacaggaagaga

SEQ ID NO: 507537 - DNA, 20 bp, Artificial Sequence
  chemically synthesized
tgccccgcagggcacaggaa

SEQ ID NO: 507538 - DNA, 20 bp, Artificial Sequence
  chemically synthesized
gactggagaacctggagtcc

SEQ ID NO: 507539 - DNA, 20 bp, Artificial Sequence
  chemically synthesized
agtccaaagactggagaacc

SEQ ID NO: 507540 - DNA, 20 bp, Artificial Sequence
  chemically synthesized
acatttaggagtttatcatg

SEQ ID NO: 507541 - DNA, 20 bp, Artificial Sequence
  chemically synthesized
tgtatataaaatatacattt

SEQ ID NO: 507542 - DNA, 20 bp, Artificial Sequence
  chemically synthesized
cccactggatggatggatgg

SEQ ID NO: 507543 - DNA, 20 bp, Artificial Sequence
  chemically synthesized
agaacccactggatggatgg

SEQ ID NO: 507544 - DNA, 20 bp, Artificial Sequence
  chemically synthesized
tccatccatccatccatcca

SEQ ID NO: 507545 - DNA, 20 bp, Artificial Sequence
  chemically synthesized
ggacagaacccactggatgg

SEQ ID NO: 507546 - DNA, 20 bp, Artificial Sequence
  chemically synthesized
agaaggacagaacccactgg

SEQ ID NO: 507547 - DNA, 20 bp, Artificial Sequence
  chemically synthesized
ctctagaaggacagaaccca

SEQ ID NO: 507548 - DNA, 20 bp, Artificial Sequence
  chemically synthesized
ttataaagaatggataaaga

SEQ ID NO: 507549 - DNA, 20 bp, Artificial Sequence
  chemically synthesized
aataaaaataattataaaga

SEQ ID NO: 507550 - DNA, 20 bp, Artificial Sequence
  chemically synthesized
tcctaataaaaataattata

SEQ ID NO: 507551 - DNA, 20 bp, Artificial Sequence
  chemically synthesized
gcactttggaaggctgggga

SEQ ID NO: 507552 - DNA, 20 bp, Artificial Sequence
  chemically synthesized
tccccagccttccaaagtgc

SEQ ID NO: 507553 - DNA, 20 bp, Artificial Sequence
  chemically synthesized
gagaattaaaagtatatgaa

SEQ ID NO: 507554 - DNA, 20 bp, Artificial Sequence
  chemically synthesized
agttactgcctaatattttg

SEQ ID NO: 507555 - DNA, 20 bp, Artificial Sequence
  chemically synthesized
ttctgccatataaaaggcat

SEQ ID NO: 507556 - DNA, 20 bp, Artificial Sequence
  chemically synthesized
ctgtgtggtcatagaaccag

SEQ ID NO: 507557 - DNA, 20 bp, Artificial Sequence
  chemically synthesized
ctctcaacttttaacttgta

SEQ ID NO: 507558 - DNA, 20 bp, Artificial Sequence
  chemically synthesized
cagaataacatacctaaaaa

SEQ ID NO: 507559 - DNA, 20 bp, Artificial Sequence
  chemically synthesized
aggtgggtagagtttctagg

SEQ ID NO: 507560 - DNA, 20 bp, Artificial Sequence
  chemically synthesized
gtggaggtgggtagagtttc

SEQ ID NO: 507561 - DNA, 20 bp, Artificial Sequence
  chemically synthesized
gtgagattggtggaggtggg

SEQ ID NO: 507562 - DNA, 20 bp, Artificial Sequence
  chemically synthesized
cataagtgagattggtggag

SEQ ID NO: 507563 - DNA, 20 bp, Artificial Sequence
  chemically synthesized
agcaggagcgctgctcccta

SEQ ID NO: 507564 - DNA, 20 bp, Artificial Sequence
  chemically synthesized
gctgctccctactgagttgg

SEQ ID NO: 507565 - DNA, 20 bp, Artificial Sequence
  chemically synthesized
gcccaggtccggagctgtgg

SEQ ID NO: 507566 - DNA, 20 bp, Artificial Sequence
  chemically synthesized
tcccaggcccccaagagcgc

SEQ ID NO: 507567 - DNA, 20 bp, Artificial Sequence
  chemically synthesized
cggggagcgaggagatgcca

SEQ ID NO: 507568 - DNA, 20 bp, Artificial Sequence
  chemically synthesized
tgatgagcatgggagagagg

SEQ ID NO: 507569 - DNA, 20 bp, Artificial Sequence
  chemically synthesized
agagaggctgagtggggact

SEQ ID NO: 507570 - DNA, 20 bp, Artificial Sequence
  chemically synthesized
agcctaggcagtttatacca

SEQ ID NO: 507571 - DNA, 20 bp, Artificial Sequence
  chemically synthesized
gtataaactgcctaggctac

SEQ ID NO: 507572 - DNA, 20 bp, Artificial Sequence
  chemically synthesized
cttgaaggaggggtttctct

SEQ ID NO: 507573 - DNA, 20 bp, Artificial Sequence
  chemically synthesized
ggccattcttggcttgaagg

SEQ ID NO: 507574 - DNA, 20 bp, Artificial Sequence
  chemically synthesized
agaaacccctccttcaagcc

SEQ ID NO: 507575 - DNA, 20 bp, Artificial Sequence
  chemically synthesized
tgggggctgggctgccagtt

SEQ ID NO: 507576 - DNA, 20 bp, Artificial Sequence
  chemically synthesized
gctgggctgccagttctggg

SEQ ID NO: 507577 - DNA, 20 bp, Artificial Sequence
  chemically synthesized
tctgggtggagtttgtggcc

SEQ ID NO: 507578 - DNA, 20 bp, Artificial Sequence
  chemically synthesized
tgctttttctgggcctatcc

SEQ ID NO: 507579 - DNA, 20 bp, Artificial Sequence
  chemically synthesized
taattggtccatggacatcc

SEQ ID NO: 507580 - DNA, 20 bp, Artificial Sequence
  chemically synthesized
atggatgtccatggaccaat

SEQ ID NO: 507581 - DNA, 20 bp, Artificial Sequence
  chemically synthesized
tgtctaagtttgtctgagtc

SEQ ID NO: 507582 - DNA, 20 bp, Artificial Sequence
  chemically synthesized
gtcccaatgtctaagtttgt

SEQ ID NO: 507583 - DNA, 20 bp, Artificial Sequence
  chemically synthesized
tttgtgtctccttgactctt

SEQ ID NO: 507584 - DNA, 20 bp, Artificial Sequence
  chemically synthesized
tatgcaggcaggtcatcctg

SEQ ID NO: 507585 - DNA, 20 bp, Artificial Sequence
  chemically synthesized
gcataaaggagccacccacc

SEQ ID NO: 507586 - DNA, 20 bp, Artificial Sequence
  chemically synthesized
gagtagagaggagacccatg

SEQ ID NO: 507587 - DNA, 20 bp, Artificial Sequence
  chemically synthesized
gtcccagggagtgtgcagct

SEQ ID NO: 507588 - DNA, 20 bp, Artificial Sequence
  chemically synthesized
tccacaggcaggtcgtccca

SEQ ID NO: 507589 - DNA, 20 bp, Artificial Sequence
  chemically synthesized
acagctctcaggataccacg

SEQ ID NO: 507590 - DNA, 20 bp, Artificial Sequence
  chemically synthesized
ttgagcgagagaacagctct

SEQ ID NO: 507591 - DNA, 20 bp, Artificial Sequence
  chemically synthesized
atgaggtacatggacaactg

SEQ ID NO: 507592 - DNA, 20 bp, Artificial Sequence
  chemically synthesized
gttcttgtcccatgtccagg

SEQ ID NO: 507593 - DNA, 20 bp, Artificial Sequence
  chemically synthesized
ggacaagaactcaggacttg

SEQ ID NO: 507594 - DNA, 20 bp, Artificial Sequence
  chemically synthesized
gtcctgccattcagcaagtc

SEQ ID NO: 507595 - DNA, 20 bp, Artificial Sequence
  chemically synthesized
ttctcattgcccatagcatg

SEQ ID NO: 507596 - DNA, 20 bp, Artificial Sequence
  chemically synthesized
gaccttggggctcctcaagc

SEQ ID NO: 507597 - DNA, 20 bp, Artificial Sequence
  chemically synthesized
caggcaccaatgtctggaca

SEQ ID NO: 507598 - DNA, 20 bp, Artificial Sequence
  chemically synthesized
ggcttgcccttggcaggcat

SEQ ID NO: 507599 - DNA, 20 bp, Artificial Sequence
  chemically synthesized
gcttggcttgcactactggc

SEQ ID NO: 507600 - DNA, 20 bp, Artificial Sequence
  chemically synthesized
gccaagcacagcctgccagg

SEQ ID NO: 507601 - DNA, 20 bp, Artificial Sequence
  chemically synthesized
agcacagcctgccaggctga

SEQ ID NO: 507602 - DNA, 20 bp, Artificial Sequence
  chemically synthesized
gtggccggcagcacctctgt

SEQ ID NO: 507603 - DNA, 20 bp, Artificial Sequence
  chemically synthesized
tggctggcaaagtgacaccc

SEQ ID NO: 507604 - DNA, 20 bp, Artificial Sequence
  chemically synthesized
atgtaagtgtcatgggatcc

SEQ ID NO: 507605 - DNA, 20 bp, Artificial Sequence
  chemically synthesized
aagtgtgcatgtaagtgtca

SEQ ID NO: 507606 - DNA, 20 bp, Artificial Sequence
  chemically synthesized
aaatcatacattggaggaaa

SEQ ID NO: 507607 - DNA, 20 bp, Artificial Sequence
  chemically synthesized
gcttaaagaaaactttcctc

SEQ ID NO: 507608 - DNA, 20 bp, Artificial Sequence
  chemically synthesized
gttcaaagttcagtctaagt

SEQ ID NO: 507609 - DNA, 20 bp, Artificial Sequence
  chemically synthesized
aaatgagcaaatgttaaaga

SEQ ID NO: 507610 - DNA, 20 bp, Artificial Sequence
  chemically synthesized
ttaaaaatgagcaaatgtta

SEQ ID NO: 507611 - DNA, 20 bp, Artificial Sequence
  chemically synthesized
tattaatgtctatttttata

SEQ ID NO: 507612 - DNA, 20 bp, Artificial Sequence
  chemically synthesized
acctgcctatcatagtgacc

SEQ ID NO: 507613 - DNA, 20 bp, Artificial Sequence
  chemically synthesized
catagtgaccatggatgaca

SEQ ID NO: 507614 - DNA, 20 bp, Artificial Sequence
  chemically synthesized
ctcagtctccctctttgtag

SEQ ID NO: 507615 - DNA, 20 bp, Artificial Sequence
  chemically synthesized
agatatagtcaccattgttc

SEQ ID NO: 507616 - DNA, 20 bp, Artificial Sequence
  chemically synthesized
ctcaaattacccatcgcaac

SEQ ID NO: 507617 - DNA, 20 bp, Artificial Sequence
  chemically synthesized
cactatctaccctggttgcg

SEQ ID NO: 507618 - DNA, 20 bp, Artificial Sequence
  chemically synthesized
caggtaagacagttaaaaaa

SEQ ID NO: 507619 - DNA, 20 bp, Artificial Sequence
  chemically synthesized
actatgtcccagggattgtg

SEQ ID NO: 507620 - DNA, 20 bp, Artificial Sequence
  chemically synthesized
ttatgttcttactatgtccc

SEQ ID NO: 507621 - DNA, 20 bp, Artificial Sequence
  chemically synthesized
tgggacatagtaagaacata

SEQ ID NO: 507622 - DNA, 20 bp, Artificial Sequence
  chemically synthesized
cttgttgaaaaaaattcaaa

SEQ ID NO: 507623 - DNA, 20 bp, Artificial Sequence
  chemically synthesized
ctaagcattccacatcccat

SEQ ID NO: 507624 - DNA, 20 bp, Artificial Sequence
  chemically synthesized
aaaaaaattcaaatgggatg

SEQ ID NO: 507625 - DNA, 20 bp, Artificial Sequence
  chemically synthesized
ttccaggatgtcagtgcgta

SEQ ID NO: 507626 - DNA, 20 bp, Artificial Sequence
  chemically synthesized
tccttaactttagaggcttc

SEQ ID NO: 507627 - DNA, 20 bp, Artificial Sequence
  chemically synthesized
tcagcaatgttactgcagat

SEQ ID NO: 507628 - DNA, 20 bp, Artificial Sequence
  chemically synthesized
caagctgaacctttgagaga

SEQ ID NO: 507629 - DNA, 20 bp, Artificial Sequence
  chemically synthesized
ttatcggagagcacactttt

SEQ ID NO: 507630 - DNA, 20 bp, Artificial Sequence
  chemically synthesized
gacaggtcagaatatatgct

SEQ ID NO: 507631 - DNA, 20 bp, Artificial Sequence
  chemically synthesized
gaagaaaaccaaagacaggt

SEQ ID NO: 507632 - DNA, 20 bp, Artificial Sequence
  chemically synthesized
ctctaactttaaaatacctt

SEQ ID NO: 507633 - DNA, 20 bp, Artificial Sequence
  chemically synthesized
attctattatgatgatattt

SEQ ID NO: 507634 - DNA, 20 bp, Artificial Sequence
  chemically synthesized
atcctaaaatatcatcataa

SEQ ID NO: 507635 - DNA, 20 bp, Artificial Sequence
  chemically synthesized
tatcatcataatagaattta

SEQ ID NO: 507636 - DNA, 20 bp, Artificial Sequence
  chemically synthesized
aactctaaaaatacttccaa

SEQ ID NO: 507637 - DNA, 20 bp, Artificial Sequence
  chemically synthesized
tatcctattggaagtatttt

SEQ ID NO: 507638 - DNA, 20 bp, Artificial Sequence
  chemically synthesized
gtatttttagagttctaact

SEQ ID NO: 507639 - DNA, 20 bp, Artificial Sequence
  chemically synthesized
agagatgcatacttaacacc

SEQ ID NO: 507640 - DNA, 20 bp, Artificial Sequence
  chemically synthesized
atgccatccagaggctcaaa

SEQ ID NO: 507641 - DNA, 20 bp, Artificial Sequence
  chemically synthesized
tggctatcctttttgagcct

SEQ ID NO: 507642 - DNA, 20 bp, Artificial Sequence
  chemically synthesized
gcctctggatggcatttcaa

SEQ ID NO: 507643 - DNA, 20 bp, Artificial Sequence
  chemically synthesized
ttcaacagaattttagtgca

SEQ ID NO: 507644 - DNA, 20 bp, Artificial Sequence
  chemically synthesized
aattttagtgcaatggatga

SEQ ID NO: 507645 - DNA, 20 bp, Artificial Sequence
  chemically synthesized
atgaaggaattgtggtgatg

SEQ ID NO: 507646 - DNA, 20 bp, Artificial Sequence
  chemically synthesized
ttcctcaaaacctattagtg

SEQ ID NO: 507647 - DNA, 20 bp, Artificial Sequence
  chemically synthesized
ctcaacactaataggttttg

SEQ ID NO: 507648 - DNA, 20 bp, Artificial Sequence
  chemically synthesized
taggttttgaggaataagtt

SEQ ID NO: 507649 - DNA, 20 bp, Artificial Sequence
  chemically synthesized
tagcaggctttttattagag

SEQ ID NO: 507650 - DNA, 20 bp, Artificial Sequence
  chemically synthesized
aagcctgctaagatccttct

SEQ ID NO: 507651 - DNA, 20 bp, Artificial Sequence
  chemically synthesized
acaatcatcaggactcagag

SEQ ID NO: 507652 - DNA, 20 bp, Artificial Sequence
  chemically synthesized
tgatgattgtttttctttta

SEQ ID NO: 507653 - DNA, 20 bp, Artificial Sequence
  chemically synthesized
caggaaagagaaacaggtat

SEQ ID NO: 507654 - DNA, 20 bp, Artificial Sequence
  chemically synthesized
attctggtagacgtaattag

SEQ ID NO: 507655 - DNA, 20 bp, Artificial Sequence
  chemically synthesized
attcttctaattacgtctac

SEQ ID NO: 507656 - DNA, 20 bp, Artificial Sequence
  chemically synthesized
atgtttaatactggactgag

SEQ ID NO: 507657 - DNA, 20 bp, Artificial Sequence
  chemically synthesized
cacagtctctgaagctaccc

SEQ ID NO: 507658 - DNA, 20 bp, Artificial Sequence
  chemically synthesized
ccctgggtatattataattc

SEQ ID NO: 507659 - DNA, 20 bp, Artificial Sequence
  chemically synthesized
ccctagaattataatatacc

SEQ ID NO: 507660 - DNA, 20 bp, Artificial Sequence
  chemically synthesized
aaaaatttaacacaaatacc

SEQ ID NO: 507661 - DNA, 20 bp, Artificial Sequence
  chemically synthesized
cgagaagatggtacagaagg

SEQ ID NO: 507662 - DNA, 20 bp, Artificial Sequence
  chemically synthesized
atatcacttgcaaagaacct

SEQ ID NO: 507663 - DNA, 20 bp, Artificial Sequence
  chemically synthesized
actattggctggaattgtcg

SEQ ID NO: 507664 - DNA, 20 bp, Artificial Sequence
  chemically synthesized
tactttatttaactattggc

SEQ ID NO: 507665 - DNA, 20 bp, Artificial Sequence
  chemically synthesized
ataaagtatagaactcaagc

SEQ ID NO: 507666 - DNA, 20 bp, Artificial Sequence
  chemically synthesized
agtcccaaaagaatccatgc

SEQ ID NO: 507667 - DNA, 20 bp, Artificial Sequence
  chemically synthesized
atcagttccttcagtcccaa

SEQ ID NO: 507668 - DNA, 20 bp, Artificial Sequence
  chemically synthesized
tttgggactgaaggaactga

SEQ ID NO: 507669 - DNA, 20 bp, Artificial Sequence
  chemically synthesized
gactgaaggaactgatggga

SEQ ID NO: 507670 - DNA, 20 bp, Artificial Sequence
  chemically synthesized
tctaaaagggcagcattaaa

SEQ ID NO: 507671 - DNA, 20 bp, Artificial Sequence
  chemically synthesized
tggaaggcagtagccattaa

SEQ ID NO: 507672 - DNA, 20 bp, Artificial Sequence
  chemically synthesized
caatcatggacaaatgcaga

SEQ ID NO: 507673 - DNA, 20 bp, Artificial Sequence
  chemically synthesized
agatagagtttaagcaaatt

SEQ ID NO: 507674 - DNA, 20 bp, Artificial Sequence
  chemically synthesized
caagtagaaaacaaatacag

SEQ ID NO: 507675 - DNA, 20 bp, Artificial Sequence
  chemically synthesized
ggcccaccatacaaccatct

SEQ ID NO: 507676 - DNA, 20 bp, Artificial Sequence
  chemically synthesized
ttaaccacacaagcatcacc

SEQ ID NO: 507677 - DNA, 20 bp, Artificial Sequence
  chemically synthesized
ccacacaagcatcaccttgg

SEQ ID NO: 507678 - DNA, 20 bp, Artificial Sequence
  chemically synthesized
atattgaaaagctattcaca

SEQ ID NO: 507679 - DNA, 20 bp, Artificial Sequence
  chemically synthesized
tcatcattagctgacccagt

SEQ ID NO: 507680 - DNA, 20 bp, Artificial Sequence
  chemically synthesized
ctgggtcagctaatgatgaa

SEQ ID NO: 507681 - DNA, 20 bp, Artificial Sequence
  chemically synthesized
gcagacatttttctaaggca

SEQ ID NO: 507682 - DNA, 20 bp, Artificial Sequence
  chemically synthesized
attaaataaggctgggaagc

SEQ ID NO: 507683 - DNA, 20 bp, Artificial Sequence
  chemically synthesized
acaatagtaactaactgcgg

SEQ ID NO: 507684 - DNA, 20 bp, Artificial Sequence
  chemically synthesized
tgatacaatagtaactaact

SEQ ID NO: 507685 - DNA, 20 bp, Artificial Sequence
  chemically synthesized
gcagttagttactattgtat

SEQ ID NO: 507686 - DNA, 20 bp, Artificial Sequence
  chemically synthesized
ttactattgtatcagaatta

SEQ ID NO: 507687 - DNA, 20 bp, Artificial Sequence
  chemically synthesized
agctgaagtgctgtgattta

SEQ ID NO: 507688 - DNA, 20 bp, Artificial Sequence
  chemically synthesized
tcacagcacttcagctgatt

SEQ ID NO: 507689 - DNA, 20 bp, Artificial Sequence
  chemically synthesized
aatttatatattaaaatact

SEQ ID NO: 507690 - DNA, 20 bp, Artificial Sequence
  chemically synthesized
tgaaaagtattttaaaaatt

SEQ ID NO: 507691 - DNA, 20 bp, Artificial Sequence
  chemically synthesized
tcacatggtggtggtagttg

SEQ ID NO: 507692 - DNA, 20 bp, Artificial Sequence
  chemically synthesized
tcatcaactaccaccaccat

SEQ ID NO: 507693 - DNA, 20 bp, Artificial Sequence
  chemically synthesized
taccaccaccatgtgagtga

SEQ ID NO: 507694 - DNA, 20 bp, Artificial Sequence
  chemically synthesized
gatctagaacaagaacaagt

SEQ ID NO: 507695 - DNA, 20 bp, Artificial Sequence
  chemically synthesized
aatcatttcaacacacatgt

SEQ ID NO: 507696 - DNA, 20 bp, Artificial Sequence
  chemically synthesized
gttttaggttaataaaaaat

SEQ ID NO: 507697 - DNA, 20 bp, Artificial Sequence
  chemically synthesized
gtcatagcagaaaattggct

SEQ ID NO: 507698 - DNA, 20 bp, Artificial Sequence
  chemically synthesized
aaatgttaagaaaggtacag

SEQ ID NO: 507699 - DNA, 20 bp, Artificial Sequence
  chemically synthesized
cttgaaagggagaaaggggg

SEQ ID NO: 507700 - DNA, 20 bp, Artificial Sequence
  chemically synthesized
aagtccttgaaagggagaaa

SEQ ID NO: 507701 - DNA, 20 bp, Artificial Sequence
  chemically synthesized
gaggaccggtttgttggatc

SEQ ID NO: 507702 - DNA, 20 bp, Artificial Sequence
  chemically synthesized
acagtaggaggaccggtttg

SEQ ID NO: 507703 - DNA, 20 bp, Artificial Sequence
  chemically synthesized
atatgtaggcacagtaacta

SEQ ID NO: 507704 - DNA, 20 bp, Artificial Sequence
  chemically synthesized
ttagtgggcaaagtgaatag

SEQ ID NO: 507705 - DNA, 20 bp, Artificial Sequence
  chemically synthesized
tcaatgggttagtgggcaaa

SEQ ID NO: 507706 - DNA, 20 bp, Artificial Sequence
  chemically synthesized
cctttacaaaagatatttca

SEQ ID NO: 507707 - DNA, 20 bp, Artificial Sequence
  chemically synthesized
gacgctataacaaatggtta

SEQ ID NO: 507708 - DNA, 20 bp, Artificial Sequence
  chemically synthesized
agagaaggtgtcaagaatga

SEQ ID NO: 507709 - DNA, 20 bp, Artificial Sequence
  chemically synthesized
ggtaatcaagagaaggtgtc

SEQ ID NO: 507710 - DNA, 20 bp, Artificial Sequence
  chemically synthesized
aaaaagtagcacataggtag

SEQ ID NO: 507711 - DNA, 20 bp, Artificial Sequence
  chemically synthesized
tttttttttctattttggag

SEQ ID NO: 507712 - DNA, 20 bp, Artificial Sequence
  chemically synthesized
tccaccctgggtgacacagt

SEQ ID NO: 507713 - DNA, 20 bp, Artificial Sequence
  chemically synthesized
cggattctcactgtgtcacc

SEQ ID NO: 507714 - DNA, 20 bp, Artificial Sequence
  chemically synthesized
tctcactgtgtcacccaggg

SEQ ID NO: 507715 - DNA, 20 bp, Artificial Sequence
  chemically synthesized
catgccattggcattccacc

SEQ ID NO: 507716 - DNA, 20 bp, Artificial Sequence
  chemically synthesized
ctcactgcaaactccaccta

SEQ ID NO: 507717 - DNA, 20 bp, Artificial Sequence
  chemically synthesized
aatcccttgaacccggtagg

SEQ ID NO: 507718 - DNA, 20 bp, Artificial Sequence
  chemically synthesized
aactccacctaccgggttca

SEQ ID NO: 507719 - DNA, 20 bp, Artificial Sequence
  chemically synthesized
tactcgggaggctgaggcag

SEQ ID NO: 507720 - DNA, 20 bp, Artificial Sequence
  chemically synthesized
gattctcctgcctcagcctc

SEQ ID NO: 507721 - DNA, 20 bp, Artificial Sequence
  chemically synthesized
ttttgtattttcagttgaga

SEQ ID NO: 507722 - DNA, 20 bp, Artificial Sequence
  chemically synthesized
tgggtagattacctgaggtc

SEQ ID NO: 507723 - DNA, 20 bp, Artificial Sequence
  chemically synthesized
cagcactttgggaggctgag

SEQ ID NO: 507724 - DNA, 20 bp, Artificial Sequence
  chemically synthesized
gtttgagcggaagggaaaaa

SEQ ID NO: 507725 - DNA, 20 bp, Artificial Sequence
  chemically synthesized
agtcaggtgctagatcatat

SEQ ID NO: 507726 - DNA, 20 bp, Artificial Sequence
  chemically synthesized
ttctgaaacactgtgagggc

SEQ ID NO: 507727 - DNA, 20 bp, Artificial Sequence
  chemically synthesized
ttctcgccctcacagtgttt

SEQ ID NO: 507728 - DNA, 20 bp, Artificial Sequence
  chemically synthesized
tgtcaagctgttccctctac

SEQ ID NO: 507729 - DNA, 20 bp, Artificial Sequence
  chemically synthesized
ggtgacacttacattgagtc

SEQ ID NO: 507730 - DNA, 20 bp, Artificial Sequence
  chemically synthesized
ctaggtaggtgacacttaca

SEQ ID NO: 507731 - DNA, 20 bp, Artificial Sequence
  chemically synthesized
tgaattactagggagcaaca

SEQ ID NO: 507732 - DNA, 20 bp, Artificial Sequence
  chemically synthesized
ttaaaaaaatgacagaaatg

SEQ ID NO: 507733 - DNA, 20 bp, Artificial Sequence
  chemically synthesized
agctgatacataagaaatta

SEQ ID NO: 507734 - DNA, 20 bp, Artificial Sequence
  chemically synthesized
tcagataaatggtaccatgt

SEQ ID NO: 507735 - DNA, 20 bp, Artificial Sequence
  chemically synthesized
tttggggaaaacatgcacag

SEQ ID NO: 507736 - DNA, 20 bp, Artificial Sequence
  chemically synthesized
aaagattacaatataatagg

SEQ ID NO: 507737 - DNA, 20 bp, Artificial Sequence
  chemically synthesized
acttggtctcaactgaaccc

SEQ ID NO: 507738 - DNA, 20 bp, Artificial Sequence
  chemically synthesized
gaattattctggttttatcc

SEQ ID NO: 507739 - DNA, 20 bp, Artificial Sequence
  chemically synthesized
actgaaccctaggataaaac

SEQ ID NO: 507740 - DNA, 20 bp, Artificial Sequence
  chemically synthesized
gtaagttagaaaggcagtat

SEQ ID NO: 507741 - DNA, 20 bp, Artificial Sequence
  chemically synthesized
attattttgtaatgatgaac

SEQ ID NO: 507742 - DNA, 20 bp, Artificial Sequence
  chemically synthesized
tgatgaacaggggtaaacac

SEQ ID NO: 507743 - DNA, 20 bp, Artificial Sequence
  chemically synthesized
ggtaaacacaggaataaatt

SEQ ID NO: 507744 - DNA, 20 bp, Artificial Sequence
  chemically synthesized
ctagaaccaaggtatgttgc

SEQ ID NO: 507745 - DNA, 20 bp, Artificial Sequence
  chemically synthesized
tgtaacagggtaaggtctta

SEQ ID NO: 507746 - DNA, 20 bp, Artificial Sequence
  chemically synthesized
cccaataataaatagtgtaa

SEQ ID NO: 507747 - DNA, 20 bp, Artificial Sequence
  chemically synthesized
cctgttacactatttattat

SEQ ID NO: 507748 - DNA, 20 bp, Artificial Sequence
  chemically synthesized
tatttattattgggatttct

SEQ ID NO: 507749 - DNA, 20 bp, Artificial Sequence
  chemically synthesized
aacattttgttacataacac

SEQ ID NO: 507750 - DNA, 20 bp, Artificial Sequence
  chemically synthesized
ccttccacctgccatagagt

SEQ ID NO: 507751 - DNA, 20 bp, Artificial Sequence
  chemically synthesized
aagttcccttccacctgcca

SEQ ID NO: 507752 - DNA, 20 bp, Artificial Sequence
  chemically synthesized
gcaggtggaagggaacttat

SEQ ID NO: 507753 - DNA, 20 bp, Artificial Sequence
  chemically synthesized
aagggaacttattaggatgg

SEQ ID NO: 507754 - DNA, 20 bp, Artificial Sequence
  chemically synthesized
ggcttcgaaaataagaagcc

SEQ ID NO: 507755 - DNA, 20 bp, Artificial Sequence
  chemically synthesized
cattttcaagtgaagcaatt

SEQ ID NO: 507756 - DNA, 20 bp, Artificial Sequence
  chemically synthesized
ttattaaccattataagctc

SEQ ID NO: 507757 - DNA, 20 bp, Artificial Sequence
  chemically synthesized
atttttggcctcatggcaaa

SEQ ID NO: 507758 - DNA, 20 bp, Artificial Sequence
  chemically synthesized
aaaatggaaacattaaaatt

SEQ ID NO: 507759 - DNA, 20 bp, Artificial Sequence
  chemically synthesized
catgactgtcaaggacaact

SEQ ID NO: 507760 - DNA, 20 bp, Artificial Sequence
  chemically synthesized
agttgtccttgacagtcatg

SEQ ID NO: 507761 - DNA, 20 bp, Artificial Sequence
  chemically synthesized
tcatgttgagtctgtgtttt

SEQ ID NO: 507762 - DNA, 20 bp, Artificial Sequence
  chemically synthesized
acattttgaaggtgtcagcc

SEQ ID NO: 507763 - DNA, 20 bp, Artificial Sequence
  chemically synthesized
gtgtatcataagttggtttt

SEQ ID NO: 507764 - DNA, 20 bp, Artificial Sequence
  chemically synthesized
atactcattgaaggacagaa

SEQ ID NO: 507765 - DNA, 20 bp, Artificial Sequence
  chemically synthesized
caattcttttctgtccttca

SEQ ID NO: 507766 - DNA, 20 bp, Artificial Sequence
  chemically synthesized
taagaagtgtaagaaaaaca

SEQ ID NO: 507767 - DNA, 20 bp, Artificial Sequence
  chemically synthesized
taagaaaaacattggatcca

SEQ ID NO: 507768 - DNA, 20 bp, Artificial Sequence
  chemically synthesized
aaaaacattggatccatgga

SEQ ID NO: 507769 - DNA, 20 bp, Artificial Sequence
  chemically synthesized
ataagagttggattcattcc

SEQ ID NO: 507770 - DNA, 20 bp, Artificial Sequence
  chemically synthesized
tggaatgaatccaactctta

SEQ ID NO: 507771 - DNA, 20 bp, Artificial Sequence
  chemically synthesized
tttaaaagactcaataagag

SEQ ID NO: 507772 - DNA, 20 bp, Artificial Sequence
  chemically synthesized
tagactttaaaagactcaat

SEQ ID NO: 507773 - DNA, 20 bp, Artificial Sequence
  chemically synthesized
atcagaacaactaagtaatg

SEQ ID NO: 507774 - DNA, 20 bp, Artificial Sequence
  chemically synthesized
aaacccttgatcaatatggc

SEQ ID NO: 507775 - DNA, 20 bp, Artificial Sequence
  chemically synthesized
gcattcttgccatattgatc

SEQ ID NO: 507776 - DNA, 20 bp, Artificial Sequence
  chemically synthesized
taacgtaaagtaccactaaa

SEQ ID NO: 507777 - DNA, 20 bp, Artificial Sequence
  chemically synthesized
ttgtactcaccgtaagtcca

SEQ ID NO: 507778 - DNA, 20 bp, Artificial Sequence
  chemically synthesized
aagaaccctctggacttacg

SEQ ID NO: 507779 - DNA, 20 bp, Artificial Sequence
  chemically synthesized
cggtgagtacaaggaaataa

SEQ ID NO: 507780 - DNA, 20 bp, Artificial Sequence
  chemically synthesized
tacagtgactaagaacgttg

SEQ ID NO: 507781 - DNA, 20 bp, Artificial Sequence
  chemically synthesized
actaagaacgttgaagagtc

SEQ ID NO: 507782 - DNA, 20 bp, Artificial Sequence
  chemically synthesized
cgttgaagagtccagagtgc

SEQ ID NO: 507783 - DNA, 20 bp, Artificial Sequence
  chemically synthesized
ttcttctttctcagctaatt

SEQ ID NO: 507784 - DNA, 20 bp, Artificial Sequence
  chemically synthesized
caaatgcgaaataaatatta

SEQ ID NO: 507785 - DNA, 20 bp, Artificial Sequence
  chemically synthesized
attatgaactatgcaacgtt

SEQ ID NO: 507786 - DNA, 20 bp, Artificial Sequence
  chemically synthesized
ctggcgtttctgctacttgt

SEQ ID NO: 507787 - DNA, 20 bp, Artificial Sequence
  chemically synthesized
aaacgccagacataaaaagc

SEQ ID NO: 507788 - DNA, 20 bp, Artificial Sequence
  chemically synthesized
ttcaattgttctgccaaact

SEQ ID NO: 507789 - DNA, 20 bp, Artificial Sequence
  chemically synthesized
ttctgccaaactaggaatcc

SEQ ID NO: 507790 - DNA, 20 bp, Artificial Sequence
  chemically synthesized
aatgatcaaggcctttattc

SEQ ID NO: 507791 - DNA, 20 bp, Artificial Sequence
  chemically synthesized
tgaataaaggccttgatcat

SEQ ID NO: 507792 - DNA, 20 bp, Artificial Sequence
  chemically synthesized
aggccttgatcattggggta

SEQ ID NO: 507793 - DNA, 20 bp, Artificial Sequence
  chemically synthesized
gtttctccagttggaaagaa

SEQ ID NO: 507794 - DNA, 20 bp, Artificial Sequence
  chemically synthesized
ttggaaagaaatgaattctc

SEQ ID NO: 507795 - DNA, 20 bp, Artificial Sequence
  chemically synthesized
tattttttttaaatactctt

SEQ ID NO: 507796 - DNA, 20 bp, Artificial Sequence
  chemically synthesized
attttaaatactgacttctt

SEQ ID NO: 507797 - DNA, 20 bp, Artificial Sequence
  chemically synthesized
tggatttcaatttgtcatag

SEQ ID NO: 507798 - DNA, 20 bp, Artificial Sequence
  chemically synthesized
ttatacaacggagatttata

SEQ ID NO: 507799 - DNA, 20 bp, Artificial Sequence
  chemically synthesized
acatttttgtgtacttctct

SEQ ID NO: 507800 - DNA, 20 bp, Artificial Sequence
  chemically synthesized
tattttcattattttattaa

SEQ ID NO: 507801 - DNA, 20 bp, Artificial Sequence
  chemically synthesized
caacagtgagatgtaacatt

SEQ ID NO: 507802 - DNA, 20 bp, Artificial Sequence
  chemically synthesized
acagtttttgttatacctct

SEQ ID NO: 507803 - DNA, 20 bp, Artificial Sequence
  chemically synthesized
aaattgggaacatgtactaa

SEQ ID NO: 507804 - DNA, 20 bp, Artificial Sequence
  chemically synthesized
tttaaatgccatcagtgata

SEQ ID NO: 507805 - DNA, 20 bp, Artificial Sequence
  chemically synthesized
ttgacatggacaagagccag

SEQ ID NO: 507806 - DNA, 20 bp, Artificial Sequence
  chemically synthesized
agggtaaaatagcatagatc

SEQ ID NO: 507807 - DNA, 20 bp, Artificial Sequence
  chemically synthesized
attttacatgtgttctaaga

SEQ ID NO: 507808 - DNA, 20 bp, Artificial Sequence
  chemically synthesized
atacttaggaaataaagaca

SEQ ID NO: 507809 - DNA, 20 bp, Artificial Sequence
  chemically synthesized
gtataatagaaaacaaaaac

SEQ ID NO: 507810 - DNA, 20 bp, Artificial Sequence
  chemically synthesized
aatagaaaacaaaaacaagg

SEQ ID NO: 507811 - DNA, 20 bp, Artificial Sequence
  chemically synthesized
agcttctcccatcgaattta

SEQ ID NO: 507812 - DNA, 20 bp, Artificial Sequence
  chemically synthesized
taaaacaaaagcttctccca

SEQ ID NO: 507813 - DNA, 20 bp, Artificial Sequence
  chemically synthesized
ttttcctgttctttccatag

SEQ ID NO: 507814 - DNA, 20 bp, Artificial Sequence
  chemically synthesized
tgggtattcaatgaagtcgg

SEQ ID NO: 507815 - DNA, 20 bp, Artificial Sequence
  chemically synthesized
taactactcctccgacttca

SEQ ID NO: 507816 - DNA, 20 bp, Artificial Sequence
  chemically synthesized
caagtaccggcaattagctg

SEQ ID NO: 507817 - DNA, 20 bp, Artificial Sequence
  chemically synthesized
cagcgttctgtgttgtttct

SEQ ID NO: 507818 - DNA, 20 bp, Artificial Sequence
  chemically synthesized
aacacagaacgctgttcatc

SEQ ID NO: 507819 - DNA, 20 bp, Artificial Sequence
  chemically synthesized
ttgagataaactacaaacta

SEQ ID NO: 507820 - DNA, 20 bp, Artificial Sequence
  chemically synthesized
taaaatttgcaaaggacatt

SEQ ID NO: 507821 - DNA, 20 bp, Artificial Sequence
  chemically synthesized
aactctattcctagaacctt

SEQ ID NO: 507822 - DNA, 20 bp, Artificial Sequence
  chemically synthesized
ttaagaattcagaaggttct

SEQ ID NO: 507823 - DNA, 20 bp, Artificial Sequence
  chemically synthesized
aattcagaaggttctaggaa

SEQ ID NO: 507824 - DNA, 20 bp, Artificial Sequence
  chemically synthesized
agaaggttctaggaatagag

SEQ ID NO: 507825 - DNA, 20 bp, Artificial Sequence
  chemically synthesized
ttttttaagatacttctttc

SEQ ID NO: 507826 - DNA, 20 bp, Artificial Sequence
  chemically synthesized
taacatgatcattagtatct

SEQ ID NO: 507827 - DNA, 20 bp, Artificial Sequence
  chemically synthesized
tcaattcctgtccagatgtc

SEQ ID NO: 507828 - DNA, 20 bp, Artificial Sequence
  chemically synthesized
ttaattcaagacatctggac

SEQ ID NO: 507829 - DNA, 20 bp, Artificial Sequence
  chemically synthesized
aagtacagatcagaaagtgt

SEQ ID NO: 507830 - DNA, 20 bp, Artificial Sequence
  chemically synthesized
taggatttcttgggaaatga

SEQ ID NO: 507831 - DNA, 20 bp, Artificial Sequence
  chemically synthesized
aggaatggggcatagaggaa

SEQ ID NO: 507832 - DNA, 20 bp, Artificial Sequence
  chemically synthesized
cccagtgtagaggtggtaga

SEQ ID NO: 507833 - DNA, 20 bp, Artificial Sequence
  chemically synthesized
gctctatatcccttgctggc

SEQ ID NO: 507834 - DNA, 20 bp, Artificial Sequence
  chemically synthesized
tcatatcattcaggccagca

SEQ ID NO: 507835 - DNA, 20 bp, Artificial Sequence
  chemically synthesized
gaccagccaggcttagcaaa

SEQ ID NO: 507836 - DNA, 20 bp, Artificial Sequence
  chemically synthesized
ataactttgttataaatttg

SEQ ID NO: 507837 - DNA, 20 bp, Artificial Sequence
  chemically synthesized
gtgaatatcaaaagcttttc

SEQ ID NO: 507838 - DNA, 20 bp, Artificial Sequence
  chemically synthesized
attcaatcacatttaagtaa

SEQ ID NO: 507839 - DNA, 20 bp, Artificial Sequence
  chemically synthesized
attcacttacttaaatgtga

SEQ ID NO: 507840 - DNA, 20 bp, Artificial Sequence
  chemically synthesized
attttatctttttgttagaa

SEQ ID NO: 507841 - DNA, 20 bp, Artificial Sequence
  chemically synthesized
gaacccccatttggtagctt

SEQ ID NO: 507842 - DNA, 20 bp, Artificial Sequence
  chemically synthesized
caactcctaagctaccaaat

SEQ ID NO: 507843 - DNA, 20 bp, Artificial Sequence
  chemically synthesized
acagtttcttttcgtattta

SEQ ID NO: 507844 - DNA, 20 bp, Artificial Sequence
  chemically synthesized
ctatgtccttttccatatgt

SEQ ID NO: 507845 - DNA, 20 bp, Artificial Sequence
  chemically synthesized
cctacatatggaaaaggaca

SEQ ID NO: 507846 - DNA, 20 bp, Artificial Sequence
  chemically synthesized
gattggttattgatgcttcc

SEQ ID NO: 507847 - DNA, 20 bp, Artificial Sequence
  chemically synthesized
tctttatgtggttaagaaga

SEQ ID NO: 507848 - DNA, 20 bp, Artificial Sequence
  chemically synthesized
taattagatgctaatatttt

SEQ ID NO: 507849 - DNA, 20 bp, Artificial Sequence
  chemically synthesized
attagcatctaattagttga

SEQ ID NO: 507850 - DNA, 20 bp, Artificial Sequence
  chemically synthesized
tgatataaatatggctaaat

SEQ ID NO: 507851 - DNA, 20 bp, Artificial Sequence
  chemically synthesized
atagtcagaatgtattagat

SEQ ID NO: 507852 - DNA, 20 bp, Artificial Sequence
  chemically synthesized
ctattagaaaggatgatagt

SEQ ID NO: 507853 - DNA, 20 bp, Artificial Sequence
  chemically synthesized
cacttatgatgtctattaga

SEQ ID NO: 507854 - DNA, 20 bp, Artificial Sequence
  chemically synthesized
agacatcataagtgcaggaa

SEQ ID NO: 507855 - DNA, 20 bp, Artificial Sequence
  chemically synthesized
tggaagttcaggtattattt

SEQ ID NO: 507856 - DNA, 20 bp, Artificial Sequence
  chemically synthesized
gcatgggcagacatatgtca

SEQ ID NO: 507857 - DNA, 20 bp, Artificial Sequence
  chemically synthesized
agaaagagtaggaaaggcaa

SEQ ID NO: 507858 - DNA, 20 bp, Artificial Sequence
  chemically synthesized
gtgcatgcatggattgtaga

SEQ ID NO: 507859 - DNA, 20 bp, Artificial Sequence
  chemically synthesized
atgtatgggtgggtgcatgc

SEQ ID NO: 507860 - DNA, 20 bp, Artificial Sequence
  chemically synthesized
actatatgcagaatgtatgg

SEQ ID NO: 507861 - DNA, 20 bp, Artificial Sequence
  chemically synthesized
tgtaactatatgcagaatgt

SEQ ID NO: 507862 - DNA, 20 bp, Artificial Sequence
  chemically synthesized
tttaattctgtaactatatg

SEQ ID NO: 507863 - DNA, 20 bp, Artificial Sequence
  chemically synthesized
atacattctgcatatagtta

SEQ ID NO: 507864 - DNA, 20 bp, Artificial Sequence
  chemically synthesized
cagattaaaaaccaataaca

SEQ ID NO: 507865 - DNA, 20 bp, Artificial Sequence
  chemically synthesized
agaaaagaagattattggga

SEQ ID NO: 507866 - DNA, 20 bp, Artificial Sequence
  chemically synthesized
gaagattattgggagagagt

SEQ ID NO: 507867 - DNA, 20 bp, Artificial Sequence
  chemically synthesized
gctatgcattgtgctgctaa

SEQ ID NO: 507868 - DNA, 20 bp, Artificial Sequence
  chemically synthesized
caggaggataatcattggaa

SEQ ID NO: 507869 - DNA, 20 bp, Artificial Sequence
  chemically synthesized
tggcaataccgtctgagcag

SEQ ID NO: 507870 - DNA, 20 bp, Artificial Sequence
  chemically synthesized
caggaatataggcttatgat

SEQ ID NO: 507871 - DNA, 20 bp, Artificial Sequence
  chemically synthesized
aaagagactataagggaaac

SEQ ID NO: 507872 - DNA, 20 bp, Artificial Sequence
  chemically synthesized
cctctattttaaagaactac

SEQ ID NO: 507873 - DNA, 20 bp, Artificial Sequence
  chemically synthesized
gaactacaggagtaatggtg

SEQ ID NO: 507874 - DNA, 20 bp, Artificial Sequence
  chemically synthesized
tttcattaagcattttgatt

SEQ ID NO: 507875 - DNA, 20 bp, Artificial Sequence
  chemically synthesized
gtagctacacattaaatact

SEQ ID NO: 507876 - DNA, 20 bp, Artificial Sequence
  chemically synthesized
tgcatatgagtcttcaaaca

SEQ ID NO: 507877 - DNA, 20 bp, Artificial Sequence
  chemically synthesized
ggtacagagactgtgtgcat

SEQ ID NO: 507878 - DNA, 20 bp, Artificial Sequence
  chemically synthesized
atctagacattcccaatcct

SEQ ID NO: 507879 - DNA, 20 bp, Artificial Sequence
  chemically synthesized
gcatttggattcccaggatt

SEQ ID NO: 507880 - DNA, 20 bp, Artificial Sequence
  chemically synthesized
tgttgtggcatttggattcc

SEQ ID NO: 507881 - DNA, 20 bp, Artificial Sequence
  chemically synthesized
atttgaagatgttgtggcat

SEQ ID NO: 507882 - DNA, 20 bp, Artificial Sequence
  chemically synthesized
tctgcaactgctctagtctc

SEQ ID NO: 507883 - DNA, 20 bp, Artificial Sequence
  chemically synthesized
ctagtctctaggatctcagg

SEQ ID NO: 507884 - DNA, 20 bp, Artificial Sequence
  chemically synthesized
caggtggagtcaagcttcac

SEQ ID NO: 507885 - DNA, 20 bp, Artificial Sequence
  chemically synthesized
agacaggtcaaagttaaaat

SEQ ID NO: 507886 - DNA, 20 bp, Artificial Sequence
  chemically synthesized
agatgtgttcaaagagttta

SEQ ID NO: 507887 - DNA, 20 bp, Artificial Sequence
  chemically synthesized
cagacaaatagatgtgttca

SEQ ID NO: 507888 - DNA, 20 bp, Artificial Sequence
  chemically synthesized
tctgtaagtgtctggcctgg

SEQ ID NO: 507889 - DNA, 20 bp, Artificial Sequence
  chemically synthesized
tacattctgtggtggtagaa

SEQ ID NO: 507890 - DNA, 20 bp, Artificial Sequence
  chemically synthesized
aacattctattctaccacca

SEQ ID NO: 507891 - DNA, 20 bp, Artificial Sequence
  chemically synthesized
taatgtacattctgtggtgg

SEQ ID NO: 507892 - DNA, 20 bp, Artificial Sequence
  chemically synthesized
ataatgatccacgtgcagat

SEQ ID NO: 507893 - DNA, 20 bp, Artificial Sequence
  chemically synthesized
tacattattctcatctgcac

SEQ ID NO: 507894 - DNA, 20 bp, Artificial Sequence
  chemically synthesized
acagtggaaaaaaactagaa

SEQ ID NO: 507895 - DNA, 20 bp, Artificial Sequence
  chemically synthesized
catgtatttgtatagattta

SEQ ID NO: 507896 - DNA, 20 bp, Artificial Sequence
  chemically synthesized
ggaaattaaacaacctgctc

SEQ ID NO: 507897 - DNA, 20 bp, Artificial Sequence
  chemically synthesized
atacaacatacctccacctc

SEQ ID NO: 507898 - DNA, 20 bp, Artificial Sequence
  chemically synthesized
caaaccgaaaccaaagctag

SEQ ID NO: 507899 - DNA, 20 bp, Artificial Sequence
  chemically synthesized
acaaaaaattaaaaaaatta

SEQ ID NO: 507900 - DNA, 20 bp, Artificial Sequence
  chemically synthesized
attaaccaagaaaaaaacag

SEQ ID NO: 507901 - DNA, 20 bp, Artificial Sequence
  chemically synthesized
aattagaaaatctggaggaa

SEQ ID NO: 507902 - DNA, 20 bp, Artificial Sequence
  chemically synthesized
tggaggaaatgaataaattc

SEQ ID NO: 507903 - DNA, 20 bp, Artificial Sequence
  chemically synthesized
ttgggagttgatatgtatcc

SEQ ID NO: 507904 - DNA, 20 bp, Artificial Sequence
  chemically synthesized
gcttcttgtggttcaatttt

SEQ ID NO: 507905 - DNA, 20 bp, Artificial Sequence
  chemically synthesized
accaataacaaatagtgaaa

SEQ ID NO: 507906 - DNA, 20 bp, Artificial Sequence
  chemically synthesized
aggaccagacgtattcacag

SEQ ID NO: 507907 - DNA, 20 bp, Artificial Sequence
  chemically synthesized
atgtctggtagaattcggct

SEQ ID NO: 507908 - DNA, 20 bp, Artificial Sequence
  chemically synthesized
ccagttctttgcatgtctgg

SEQ ID NO: 507909 - DNA, 20 bp, Artificial Sequence
  chemically synthesized
atattttgcaacagttacaa

SEQ ID NO: 507910 - DNA, 20 bp, Artificial Sequence
  chemically synthesized
gcttcgtagaattaattagg

SEQ ID NO: 507911 - DNA, 20 bp, Artificial Sequence
  chemically synthesized
tcatggtgatactggcttcg

SEQ ID NO: 507912 - DNA, 20 bp, Artificial Sequence
  chemically synthesized
tttttgcatctatgttcatc

SEQ ID NO: 507913 - DNA, 20 bp, Artificial Sequence
  chemically synthesized
atagatgcaaaaatcctcaa

SEQ ID NO: 507914 - DNA, 20 bp, Artificial Sequence
  chemically synthesized
tggtttgctagcattctgtt

SEQ ID NO: 507915 - DNA, 20 bp, Artificial Sequence
  chemically synthesized
attatctttttgttatgctt

SEQ ID NO: 507916 - DNA, 20 bp, Artificial Sequence
  chemically synthesized
gagctttatgccaggtaggc

SEQ ID NO: 507917 - DNA, 20 bp, Artificial Sequence
  chemically synthesized
aacatatattgtgttatgtg

SEQ ID NO: 507918 - DNA, 20 bp, Artificial Sequence
  chemically synthesized
tttttaattctttttatgtg

SEQ ID NO: 507919 - DNA, 20 bp, Artificial Sequence
  chemically synthesized
tatgtgattcaccacataaa

SEQ ID NO: 507920 - DNA, 20 bp, Artificial Sequence
  chemically synthesized
gtctttatcttggggagagg

SEQ ID NO: 507921 - DNA, 20 bp, Artificial Sequence
  chemically synthesized
tctttcaatgcctagttgtt

SEQ ID NO: 507922 - DNA, 20 bp, Artificial Sequence
  chemically synthesized
tgttgtagttcttgggggag

SEQ ID NO: 507923 - DNA, 20 bp, Artificial Sequence
  chemically synthesized
cccaagaactacaacaagac

SEQ ID NO: 507924 - DNA, 20 bp, Artificial Sequence
  chemically synthesized
gttgaattggagcagtgaaa

SEQ ID NO: 507925 - DNA, 20 bp, Artificial Sequence
  chemically synthesized
ctaggacttccagtactatg

SEQ ID NO: 507926 - DNA, 20 bp, Artificial Sequence
  chemically synthesized
ttgactttctttttcccaat

SEQ ID NO: 507927 - DNA, 20 bp, Artificial Sequence
  chemically synthesized
tgatttctcttcactgatga

SEQ ID NO: 507928 - DNA, 20 bp, Artificial Sequence
  chemically synthesized
ggtccttttggaggagtctt

SEQ ID NO: 507929 - DNA, 20 bp, Artificial Sequence
  chemically synthesized
caaatatagggtccttttgg

SEQ ID NO: 507930 - DNA, 20 bp, Artificial Sequence
  chemically synthesized
ctgaagtcatttatcaaata

SEQ ID NO: 507931 - DNA, 20 bp, Artificial Sequence
  chemically synthesized
aaatgacttcagtaaagttt

SEQ ID NO: 507932 - DNA, 20 bp, Artificial Sequence
  chemically synthesized
tgtagttgttgtaaatgaga

SEQ ID NO: 507933 - DNA, 20 bp, Artificial Sequence
  chemically synthesized
tacaaaaaaaaaaaatacct

SEQ ID NO: 507934 - DNA, 20 bp, Artificial Sequence
  chemically synthesized
tgtcatctatgatttatttc

SEQ ID NO: 507935 - DNA, 20 bp, Artificial Sequence
  chemically synthesized
tggaaaaactttccctgctc

SEQ ID NO: 507936 - DNA, 20 bp, Artificial Sequence
  chemically synthesized
attaccaacatcatttttca

SEQ ID NO: 507937 - DNA, 20 bp, Artificial Sequence
  chemically synthesized
aaaagatagtaaaatacata

SEQ ID NO: 507938 - DNA, 20 bp, Artificial Sequence
  chemically synthesized
tcaaagcaatgctaagcaag

SEQ ID NO: 507939 - DNA, 20 bp, Artificial Sequence
  chemically synthesized
atagatatgtggttttatat

SEQ ID NO: 507940 - DNA, 20 bp, Artificial Sequence
  chemically synthesized
ttacagcacaatttactgaa

SEQ ID NO: 507941 - DNA, 20 bp, Artificial Sequence
  chemically synthesized
aatatttacagcacaattta

SEQ ID NO: 507942 - DNA, 20 bp, Artificial Sequence
  chemically synthesized
agtaaattgtgctgtaaata

SEQ ID NO: 507943 - DNA, 20 bp, Artificial Sequence
  chemically synthesized
tattggatagtcataagcag

SEQ ID NO: 507944 - DNA, 20 bp, Artificial Sequence
  chemically synthesized
tcataagcagaagaatgaaa

SEQ ID NO: 507945 - DNA, 20 bp, Artificial Sequence
  chemically synthesized
atttaagtctttaatacatt

SEQ ID NO: 507946 - DNA, 20 bp, Artificial Sequence
  chemically synthesized
gtttttcctaggttttcttt

SEQ ID NO: 507947 - DNA, 20 bp, Artificial Sequence
  chemically synthesized
ttgcccaagccagtgtcgag

SEQ ID NO: 507948 - DNA, 20 bp, Artificial Sequence
  chemically synthesized
tctcgacactggcttgggca

SEQ ID NO: 507949 - DNA, 20 bp, Artificial Sequence
  chemically synthesized
ccatttgtctacttttgttt

SEQ ID NO: 507950 - DNA, 20 bp, Artificial Sequence
  chemically synthesized
aaaaaacaaaaaacaatcaa

SEQ ID NO: 507951 - DNA, 20 bp, Artificial Sequence
  chemically synthesized
cagaatgaacagacaactta

SEQ ID NO: 507952 - DNA, 20 bp, Artificial Sequence
  chemically synthesized
tttttgttagatgtatagtt

SEQ ID NO: 507953 - DNA, 20 bp, Artificial Sequence
  chemically synthesized
tctaacaaaaaactaatatc

SEQ ID NO: 507954 - DNA, 20 bp, Artificial Sequence
  chemically synthesized
gttatctatttttcttcttg

SEQ ID NO: 507955 - DNA, 20 bp, Artificial Sequence
  chemically synthesized
gtcctttgcctactttttaa

SEQ ID NO: 507956 - DNA, 20 bp, Artificial Sequence
  chemically synthesized
tcaatgtcatttaaaaattt

SEQ ID NO: 507957 - DNA, 20 bp, Artificial Sequence
  chemically synthesized
catttaaaaatttgtgggta

SEQ ID NO: 507958 - DNA, 20 bp, Artificial Sequence
  chemically synthesized
gtacagagtaggtgtatttg

SEQ ID NO: 507959 - DNA, 20 bp, Artificial Sequence
  chemically synthesized
agtgaaataatcacatcatg

SEQ ID NO: 507960 - DNA, 20 bp, Artificial Sequence
  chemically synthesized
gtacaaaaattacagttaga

SEQ ID NO: 507961 - DNA, 20 bp, Artificial Sequence
  chemically synthesized
aagggaggtggggatggtta

SEQ ID NO: 507962 - DNA, 20 bp, Artificial Sequence
  chemically synthesized
aagggtggtggaagggaggt

SEQ ID NO: 507963 - DNA, 20 bp, Artificial Sequence
  chemically synthesized
gatggttatcagagactggg

SEQ ID NO: 507964 - DNA, 20 bp, Artificial Sequence
  chemically synthesized
gtcatggaaatagagagtag

SEQ ID NO: 507965 - DNA, 20 bp, Artificial Sequence
  chemically synthesized
caattgaagtcatggaaata

SEQ ID NO: 507966 - DNA, 20 bp, Artificial Sequence
  chemically synthesized
cttatgttctgacttatttg

SEQ ID NO: 507967 - DNA, 20 bp, Artificial Sequence
  chemically synthesized
atactgtcatttggaacaat

SEQ ID NO: 507968 - DNA, 20 bp, Artificial Sequence
  chemically synthesized
acagtatctcatttttttaa

SEQ ID NO: 507969 - DNA, 20 bp, Artificial Sequence
  chemically synthesized
aaacaacaacaggtgttggc

SEQ ID NO: 507970 - DNA, 20 bp, Artificial Sequence
  chemically synthesized
aatgtttattcactcttggt

SEQ ID NO: 507971 - DNA, 20 bp, Artificial Sequence
  chemically synthesized
aacttacattcccaccaaga

SEQ ID NO: 507972 - DNA, 20 bp, Artificial Sequence
  chemically synthesized
tattaacttacattcccacc

SEQ ID NO: 507973 - DNA, 20 bp, Artificial Sequence
  chemically synthesized
aagaacttaaaacacaacta

SEQ ID NO: 507974 - DNA, 20 bp, Artificial Sequence
  chemically synthesized
tatacccagtactaggattg

SEQ ID NO: 507975 - DNA, 20 bp, Artificial Sequence
  chemically synthesized
tggatcctgcaatcctagta

SEQ ID NO: 507976 - DNA, 20 bp, Artificial Sequence
  chemically synthesized
gttgagtatatacccagtac

SEQ ID NO: 507977 - DNA, 20 bp, Artificial Sequence
  chemically synthesized
aacactttttgttgtttttg

SEQ ID NO: 507978 - DNA, 20 bp, Artificial Sequence
  chemically synthesized
tagcactatttacaatagca

SEQ ID NO: 507979 - DNA, 20 bp, Artificial Sequence
  chemically synthesized
aagcgtccatcagtaaatga

SEQ ID NO: 507980 - DNA, 20 bp, Artificial Sequence
  chemically synthesized
attcatgtaactgcaaaaga

SEQ ID NO: 507981 - DNA, 20 bp, Artificial Sequence
  chemically synthesized
atcctgtcttttgcagttac

SEQ ID NO: 507982 - DNA, 20 bp, Artificial Sequence
  chemically synthesized
tgtttccaagttacttcact

SEQ ID NO: 507983 - DNA, 20 bp, Artificial Sequence
  chemically synthesized
ttataagaagaaactaaaca

SEQ ID NO: 507984 - DNA, 20 bp, Artificial Sequence
  chemically synthesized
aaagggtacacacggacatc

SEQ ID NO: 507985 - DNA, 20 bp, Artificial Sequence
  chemically synthesized
gtacacacggacatctagag

SEQ ID NO: 507986 - DNA, 20 bp, Artificial Sequence
  chemically synthesized
aaaagattataggctggtag

SEQ ID NO: 507987 - DNA, 20 bp, Artificial Sequence
  chemically synthesized
tataggctggtaggggggtg

SEQ ID NO: 507988 - DNA, 20 bp, Artificial Sequence
  chemically synthesized
gaggggtgaaaaattaccta

SEQ ID NO: 507989 - DNA, 20 bp, Artificial Sequence
  chemically synthesized
tagtgttcgctattcagatt

SEQ ID NO: 507990 - DNA, 20 bp, Artificial Sequence
  chemically synthesized
gattttagtatatccataat

SEQ ID NO: 507991 - DNA, 20 bp, Artificial Sequence
  chemically synthesized
tatcgtgtagtggtggagtc

SEQ ID NO: 507992 - DNA, 20 bp, Artificial Sequence
  chemically synthesized
atggatatatcgtgtagtgg

SEQ ID NO: 507993 - DNA, 20 bp, Artificial Sequence
  chemically synthesized
tgcatgtgcaggtttgttac

SEQ ID NO: 507994 - DNA, 20 bp, Artificial Sequence
  chemically synthesized
gaagttttaaaatagattga

SEQ ID NO: 507995 - DNA, 20 bp, Artificial Sequence
  chemically synthesized
ttctaagacatgcttattac

SEQ ID NO: 507996 - DNA, 20 bp, Artificial Sequence
  chemically synthesized
tgtaagaatgcaaggataat

SEQ ID NO: 507997 - DNA, 20 bp, Artificial Sequence
  chemically synthesized
gaatctcagtgtaagaatgc

SEQ ID NO: 507998 - DNA, 20 bp, Artificial Sequence
  chemically synthesized
atttccatgaatctcagtgt

SEQ ID NO: 507999 - DNA, 20 bp, Artificial Sequence
  chemically synthesized
tgctcaaaagggctatttcc

SEQ ID NO: 508000 - DNA, 20 bp, Artificial Sequence
  chemically synthesized
gtctacagttttggcacact

SEQ ID NO: 508001 - DNA, 20 bp, Artificial Sequence
  chemically synthesized
agataaaaatttaattgtta

SEQ ID NO: 508002 - DNA, 20 bp, Artificial Sequence
  chemically synthesized
atacagtatcattacttcca

SEQ ID NO: 508003 - DNA, 20 bp, Artificial Sequence
  chemically synthesized
tcattacttccaatgaataa

SEQ ID NO: 508004 - DNA, 20 bp, Artificial Sequence
  chemically synthesized
tgttatgaacagaatttcta

SEQ ID NO: 508005 - DNA, 20 bp, Artificial Sequence
  chemically synthesized
tttaatatttctgttatgaa

SEQ ID NO: 508006 - DNA, 20 bp, Artificial Sequence
  chemically synthesized
ttcataacagaaatattaaa

SEQ ID NO: 508007 - DNA, 20 bp, Artificial Sequence
  chemically synthesized
tgaatatgatactttttctg

SEQ ID NO: 508008 - DNA, 20 bp, Artificial Sequence
  chemically synthesized
tcccgtgttaaaatataagg

SEQ ID NO: 508009 - DNA, 20 bp, Artificial Sequence
  chemically synthesized
ttcaaccttatattttaaca

SEQ ID NO: 508010 - DNA, 20 bp, Artificial Sequence
  chemically synthesized
ccttatattttaacacggga

SEQ ID NO: 508011 - DNA, 20 bp, Artificial Sequence
  chemically synthesized
gctaagacacacatgataac

SEQ ID NO: 508012 - DNA, 20 bp, Artificial Sequence
  chemically synthesized
agtaccctatttctaattta

SEQ ID NO: 508013 - DNA, 20 bp, Artificial Sequence
  chemically synthesized
ctaactcagtaaattagaaa

SEQ ID NO: 508014 - DNA, 20 bp, Artificial Sequence
  chemically synthesized
ttctcatgaggaagtattac

SEQ ID NO: 508015 - DNA, 20 bp, Artificial Sequence
  chemically synthesized
tgttagtgcctctaagatga

SEQ ID NO: 508016 - DNA, 20 bp, Artificial Sequence
  chemically synthesized
attgattcagtaacattact

SEQ ID NO: 508017 - DNA, 20 bp, Artificial Sequence
  chemically synthesized
tgacattctaagtaatgtta

SEQ ID NO: 508018 - DNA, 20 bp, Artificial Sequence
  chemically synthesized
atttactttattagaaatta

SEQ ID NO: 508019 - DNA, 20 bp, Artificial Sequence
  chemically synthesized
aaatacttgatttgtaaaat

SEQ ID NO: 508020 - DNA, 20 bp, Artificial Sequence
  chemically synthesized
tgtaaaataagaatatgggc

SEQ ID NO: 508021 - DNA, 20 bp, Artificial Sequence
  chemically synthesized
ttactgtgcaaatataccct

SEQ ID NO: 508022 - DNA, 20 bp, Artificial Sequence
  chemically synthesized
attaacaagcatcatattcc

SEQ ID NO: 508023 - DNA, 20 bp, Artificial Sequence
  chemically synthesized
tggaatatgatgcttgttaa

SEQ ID NO: 508024 - DNA, 20 bp, Artificial Sequence
  chemically synthesized
gcttgttaatagaattctta

SEQ ID NO: 508025 - DNA, 20 bp, Artificial Sequence
  chemically synthesized
gaagacatctaatatcccat

SEQ ID NO: 508026 - DNA, 20 bp, Artificial Sequence
  chemically synthesized
ttcagttacaatttttaaaa

SEQ ID NO: 508027 - DNA, 20 bp, Artificial Sequence
  chemically synthesized
ttcgattttaaaaattgtaa

SEQ ID NO: 508028 - DNA, 20 bp, Artificial Sequence
  chemically synthesized
ccattgactatgaaattggt

SEQ ID NO: 508029 - DNA, 20 bp, Artificial Sequence
  chemically synthesized
ctattaagatatttgcatat

SEQ ID NO: 508030 - DNA, 20 bp, Artificial Sequence
  chemically synthesized
atgtatttttctacagcttt

SEQ ID NO: 508031 - DNA, 20 bp, Artificial Sequence
  chemically synthesized
ttagccatgatggagacgat

SEQ ID NO: 508032 - DNA, 20 bp, Artificial Sequence
  chemically synthesized
ccagatttcttttgtgtttt

SEQ ID NO: 508033 - DNA, 20 bp, Artificial Sequence
  chemically synthesized
ttaatggttatgatggtaag

SEQ ID NO: 508034 - DNA, 20 bp, Artificial Sequence
  chemically synthesized
attttaaccttgctaaatat

SEQ ID NO: 508035 - DNA, 20 bp, Artificial Sequence
  chemically synthesized
taaccttgctaaatatgaga

SEQ ID NO: 508036 - DNA, 20 bp, Artificial Sequence
  chemically synthesized
agttaagtttgacagtgcca

SEQ ID NO: 508037 - DNA, 20 bp, Artificial Sequence
  chemically synthesized
tatggcactgtcaaacttaa

SEQ ID NO: 508038 - DNA, 20 bp, Artificial Sequence
  chemically synthesized
agaaatgcaatagttggaag

SEQ ID NO: 508039 - DNA, 20 bp, Artificial Sequence
  chemically synthesized
aagtcccaattgcccagtcc

SEQ ID NO: 508040 - DNA, 20 bp, Artificial Sequence
  chemically synthesized
aaaaccaataggactagatt

SEQ ID NO: 508041 - DNA, 20 bp, Artificial Sequence
  chemically synthesized
attggttttgatttgatatc

SEQ ID NO: 508042 - DNA, 20 bp, Artificial Sequence
  chemically synthesized
gtaaacaggtacaaagcatt

SEQ ID NO: 508043 - DNA, 20 bp, Artificial Sequence
  chemically synthesized
ttgctgaaagtatatagagc

SEQ ID NO: 508044 - DNA, 20 bp, Artificial Sequence
  chemically synthesized
gaggccggaaaacatgttaa

SEQ ID NO: 508045 - DNA, 20 bp, Artificial Sequence
  chemically synthesized
tatttaagaagatatttttt

SEQ ID NO: 508046 - DNA, 20 bp, Artificial Sequence
  chemically synthesized
tatttctagtttaatttctc

SEQ ID NO: 508047 - DNA, 20 bp, Artificial Sequence
  chemically synthesized
gcatttgcagtagtagttct

SEQ ID NO: 508048 - DNA, 20 bp, Artificial Sequence
  chemically synthesized
agaactactactgcaaatgc

SEQ ID NO: 508049 - DNA, 20 bp, Artificial Sequence
  chemically synthesized
cctgatcatggagggtgatc

SEQ ID NO: 508050 - DNA, 20 bp, Artificial Sequence
  chemically synthesized
aggatttaagcctgatcatg

SEQ ID NO: 508051 - DNA, 20 bp, Artificial Sequence
  chemically synthesized
ttgtactatactgaatgctg

SEQ ID NO: 508052 - DNA, 20 bp, Artificial Sequence
  chemically synthesized
ttacgatgtcttgtactata

SEQ ID NO: 508053 - DNA, 20 bp, Artificial Sequence
  chemically synthesized
tatagcacatgggtgctgtg

SEQ ID NO: 508054 - DNA, 20 bp, Artificial Sequence
  chemically synthesized
acaaaccctcattatagcac

SEQ ID NO: 508055 - DNA, 20 bp, Artificial Sequence
  chemically synthesized
cagcacccatgtgctataat

SEQ ID NO: 508056 - DNA, 20 bp, Artificial Sequence
  chemically synthesized
tgagggtttgttcagtgata

SEQ ID NO: 508057 - DNA, 20 bp, Artificial Sequence
  chemically synthesized
gtttgttcagtgatatggaa

SEQ ID NO: 508058 - DNA, 20 bp, Artificial Sequence
  chemically synthesized
tgatatggaatagaatgcaa

SEQ ID NO: 508059 - DNA, 20 bp, Artificial Sequence
  chemically synthesized
tgaaatgtcagatcctttgg

SEQ ID NO: 508060 - DNA, 20 bp, Artificial Sequence
  chemically synthesized
gattaggtataattctgcca

SEQ ID NO: 508061 - DNA, 20 bp, Artificial Sequence
  chemically synthesized
tagatgttcatgttacagag

SEQ ID NO: 508062 - DNA, 20 bp, Artificial Sequence
  chemically synthesized
cattttaaaggtcaccagat

SEQ ID NO: 508063 - DNA, 20 bp, Artificial Sequence
  chemically synthesized
ggttagttaaaggcagacat

SEQ ID NO: 508064 - DNA, 20 bp, Artificial Sequence
  chemically synthesized
ctttaactaaccttcaagaa

SEQ ID NO: 508065 - DNA, 20 bp, Artificial Sequence
  chemically synthesized
ttcaagaaaaggataggtga

SEQ ID NO: 508066 - DNA, 20 bp, Artificial Sequence
  chemically synthesized
catataaccttcactgaagt

SEQ ID NO: 508067 - DNA, 20 bp, Artificial Sequence
  chemically synthesized
ccttcactgaagtcagaata

SEQ ID NO: 508068 - DNA, 20 bp, Artificial Sequence
  chemically synthesized
aattacaagaatttgccgat

SEQ ID NO: 508069 - DNA, 20 bp, Artificial Sequence
  chemically synthesized
acaaagactttacaaattac

SEQ ID NO: 508070 - DNA, 20 bp, Artificial Sequence
  chemically synthesized
caaaagtctaaatctctcaa

SEQ ID NO: 508071 - DNA, 20 bp, Artificial Sequence
  chemically synthesized
gactgcgatgaagtttaaag

SEQ ID NO: 508072 - DNA, 20 bp, Artificial Sequence
  chemically synthesized
aatgaaaggatttccctcga

SEQ ID NO: 508073 - DNA, 20 bp, Artificial Sequence
  chemically synthesized
gtgatgttgacaaagaatga

SEQ ID NO: 508074 - DNA, 20 bp, Artificial Sequence
  chemically synthesized
atttattagtgatgttgaca

SEQ ID NO: 508075 - DNA, 20 bp, Artificial Sequence
  chemically synthesized
gtcttttttgtcttaagggg

SEQ ID NO: 508076 - DNA, 20 bp, Artificial Sequence
  chemically synthesized
agctggtcttttttgtctta

SEQ ID NO: 508077 - DNA, 20 bp, Artificial Sequence
  chemically synthesized
ttaagacaaaaaagaccagc

SEQ ID NO: 508078 - DNA, 20 bp, Artificial Sequence
  chemically synthesized
tgtgatatattttttcacag

SEQ ID NO: 508079 - DNA, 20 bp, Artificial Sequence
  chemically synthesized
cccaagagtgagtctttctg

SEQ ID NO: 508080 - DNA, 20 bp, Artificial Sequence
  chemically synthesized
ctccccagaaagactcactc

SEQ ID NO: 508081 - DNA, 20 bp, Artificial Sequence
  chemically synthesized
tagctttgaggcacccaaga

SEQ ID NO: 508082 - DNA, 20 bp, Artificial Sequence
  chemically synthesized
gctttagctttgaggcaccc

SEQ ID NO: 508083 - DNA, 20 bp, Artificial Sequence
  chemically synthesized
catagacattgctgtaggga

SEQ ID NO: 508084 - DNA, 20 bp, Artificial Sequence
  chemically synthesized
tccctacagcaatgtctatg

SEQ ID NO: 508085 - DNA, 20 bp, Artificial Sequence
  chemically synthesized
tacagcaatgtctatgaagg

SEQ ID NO: 508086 - DNA, 20 bp, Artificial Sequence
  chemically synthesized
ttgaacttttcttggttacc

SEQ ID NO: 508087 - DNA, 20 bp, Artificial Sequence
  chemically synthesized
tttcttggttacccagagta

SEQ ID NO: 508088 - DNA, 20 bp, Artificial Sequence
  chemically synthesized
atctagccaaactctttact

SEQ ID NO: 508089 - DNA, 20 bp, Artificial Sequence
  chemically synthesized
atttaatagtaaccaccata

SEQ ID NO: 508090 - DNA, 20 bp, Artificial Sequence
  chemically synthesized
ttcctgacatttcacagtgt

SEQ ID NO: 508091 - DNA, 20 bp, Artificial Sequence
  chemically synthesized
ctgttgaaatgaagatagca

SEQ ID NO: 508092 - DNA, 20 bp, Artificial Sequence
  chemically synthesized
gatagcaaaggatcctgtca

SEQ ID NO: 508093 - DNA, 20 bp, Artificial Sequence
  chemically synthesized
tgcttctgtatattctgtga

SEQ ID NO: 508094 - DNA, 20 bp, Artificial Sequence
  chemically synthesized
gcaaatcttgcaagtacact

SEQ ID NO: 508095 - DNA, 20 bp, Artificial Sequence
  chemically synthesized
caggcgacctctgatctgag

SEQ ID NO: 508096 - DNA, 20 bp, Artificial Sequence
  chemically synthesized
aagatacagattttattgct

SEQ ID NO: 508097 - DNA, 20 bp, Artificial Sequence
  chemically synthesized
agaaaaaatggtgatggcac

SEQ ID NO: 508098 - DNA, 20 bp, Artificial Sequence
  chemically synthesized
agtttggtgatgcagcagat

SEQ ID NO: 508099 - DNA, 20 bp, Artificial Sequence
  chemically synthesized
acaaaatgcatcagtaacct

SEQ ID NO: 508100 - DNA, 20 bp, Artificial Sequence
  chemically synthesized
gctttgcagctttttttccc

SEQ ID NO: 508101 - DNA, 20 bp, Artificial Sequence
  chemically synthesized
aagccttatttatatagtcg

SEQ ID NO: 508102 - DNA, 20 bp, Artificial Sequence
  chemically synthesized
aatgttacttctttgggtaa

SEQ ID NO: 508103 - DNA, 20 bp, Artificial Sequence
  chemically synthesized
agaaaataaatgttacttct

SEQ ID NO: 508104 - DNA, 20 bp, Artificial Sequence
  chemically synthesized
gactaaaaggagcatacata

SEQ ID NO: 508105 - DNA, 20 bp, Artificial Sequence
  chemically synthesized
taacatcaaacaatttagca

SEQ ID NO: 508106 - DNA, 20 bp, Artificial Sequence
  chemically synthesized
gcattatcaatattcaggac

SEQ ID NO: 508107 - DNA, 20 bp, Artificial Sequence
  chemically synthesized
gaaagattcatattcaagtc

SEQ ID NO: 508108 - DNA, 20 bp, Artificial Sequence
  chemically synthesized
tcaatattcaggacttgaat

SEQ ID NO: 508109 - DNA, 20 bp, Artificial Sequence
  chemically synthesized
ttgtcaaatctgtcaaaaaa

SEQ ID NO: 508110 - DNA, 20 bp, Artificial Sequence
  chemically synthesized
gtgctcaaatagttaaaagt

SEQ ID NO: 508111 - DNA, 20 bp, Artificial Sequence
  chemically synthesized
ggcattggttttctggctca

SEQ ID NO: 508112 - DNA, 20 bp, Artificial Sequence
  chemically synthesized
gtgaaacaaaagaaggcaac

SEQ ID NO: 508113 - DNA, 20 bp, Artificial Sequence
  chemically synthesized
aaatggcatactttcaagta

SEQ ID NO: 508114 - DNA, 20 bp, Artificial Sequence
  chemically synthesized
ttttttctgaaagatataat

SEQ ID NO: 508115 - DNA, 20 bp, Artificial Sequence
  chemically synthesized
aaaacatttcaggtacctgg

SEQ ID NO: 508116 - DNA, 20 bp, Artificial Sequence
  chemically synthesized
cctggcagaatattaagatc

SEQ ID NO: 508117 - DNA, 20 bp, Artificial Sequence
  chemically synthesized
ttaaggtgagacaagctatc

SEQ ID NO: 508118 - DNA, 20 bp, Artificial Sequence
  chemically synthesized
tagcttgtctcaccttaatg

SEQ ID NO: 508119 - DNA, 20 bp, Artificial Sequence
  chemically synthesized
gaatgttagcatagctaagt

SEQ ID NO: 508120 - DNA, 20 bp, Artificial Sequence
  chemically synthesized
ctccaaaagagcagtagaag

SEQ ID NO: 508121 - DNA, 20 bp, Artificial Sequence
  chemically synthesized
ctcttttggagctcttctcc

SEQ ID NO: 508122 - DNA, 20 bp, Artificial Sequence
  chemically synthesized
ggacactgctgctggatgcc

SEQ ID NO: 508123 - DNA, 20 bp, Artificial Sequence
  chemically synthesized
cagaaggcaggacactgctg

SEQ ID NO: 508124 - DNA, 20 bp, Artificial Sequence
  chemically synthesized
tttactttggaaataaaaga

SEQ ID NO: 508125 - DNA, 20 bp, Artificial Sequence
  chemically synthesized
tatctttactttggaaataa

SEQ ID NO: 508126 - DNA, 20 bp, Artificial Sequence
  chemically synthesized
gttagtggtagaactggagc

SEQ ID NO: 508127 - DNA, 20 bp, Artificial Sequence
  chemically synthesized
aaacttctcccactagaagc

SEQ ID NO: 508128 - DNA, 20 bp, Artificial Sequence
  chemically synthesized
tctagtgggagaagtttgtc

SEQ ID NO: 508129 - DNA, 20 bp, Artificial Sequence
  chemically synthesized
tgttcaggatgtgtttttgg

SEQ ID NO: 508130 - DNA, 20 bp, Artificial Sequence
  chemically synthesized
ttgttcacaaatcttttgtt

SEQ ID NO: 508131 - DNA, 20 bp, Artificial Sequence
  chemically synthesized
acaaataaatggtttatttg

SEQ ID NO: 508132 - DNA, 20 bp, Artificial Sequence
  chemically synthesized
ccgtgctctcataatgcctt

SEQ ID NO: 508133 - DNA, 20 bp, Artificial Sequence
  chemically synthesized
gacgttcaggaagttaccct

SEQ ID NO: 508134 - DNA, 20 bp, Artificial Sequence
  chemically synthesized
gactgagctccaggtatcca

SEQ ID NO: 508135 - DNA, 20 bp, Artificial Sequence
  chemically synthesized
cctggagctcagtcttactg

SEQ ID NO: 508136 - DNA, 20 bp, Artificial Sequence
  chemically synthesized
ggaatctctgaaagactgtg

SEQ ID NO: 508137 - DNA, 20 bp, Artificial Sequence
  chemically synthesized
actatgggacaaagattcta

SEQ ID NO: 508138 - DNA, 20 bp, Artificial Sequence
  chemically synthesized
aagttgatagagaaatcctg

SEQ ID NO: 508139 - DNA, 20 bp, Artificial Sequence
  chemically synthesized
agagctgcccttagccaatg

SEQ ID NO: 508140 - DNA, 20 bp, Artificial Sequence
  chemically synthesized
gtttgaaggtggacaggaag

SEQ ID NO: 508141 - DNA, 20 bp, Artificial Sequence
  chemically synthesized
gcaatggcttctctctaccg

SEQ ID NO: 508142 - DNA, 20 bp, Artificial Sequence
  chemically synthesized
accttgtccaatccatgacc

SEQ ID NO: 508143 - DNA, 20 bp, Artificial Sequence
  chemically synthesized
attgaaagccatcctgggtc

SEQ ID NO: 508144 - DNA, 20 bp, Artificial Sequence
  chemically synthesized
gggccacattgaaagccatc

SEQ ID NO: 508145 - DNA, 20 bp, Artificial Sequence
  chemically synthesized
gcttccctgggcgacattgg

SEQ ID NO: 508146 - DNA, 20 bp, Artificial Sequence
  chemically synthesized
aatgtcgcccagggaagcca

SEQ ID NO: 508147 - DNA, 20 bp, Artificial Sequence
  chemically synthesized
agaaagtgtctatataaacc

SEQ ID NO: 508148 - DNA, 20 bp, Artificial Sequence
  chemically synthesized
ttcctgatggcatagcagac

SEQ ID NO: 508149 - DNA, 20 bp, Artificial Sequence
  chemically synthesized
ctagatcttagaggactcct

SEQ ID NO: 508150 - DNA, 20 bp, Artificial Sequence
  chemically synthesized
ccttactattattgaccccc

SEQ ID NO: 508151 - DNA, 20 bp, Artificial Sequence
  chemically synthesized
aagtttaatgagcttcagtt

SEQ ID NO: 508152 - DNA, 20 bp, Artificial Sequence
  chemically synthesized
atacatttatttctaagttc

SEQ ID NO: 508153 - DNA, 20 bp, Artificial Sequence
  chemically synthesized
aactgtaaagctatatatga

SEQ ID NO: 508154 - DNA, 20 bp, Artificial Sequence
  chemically synthesized
gactgaatattataaaaaga

SEQ ID NO: 508155 - DNA, 20 bp, Artificial Sequence
  chemically synthesized
ttggatttatggctttgaat

SEQ ID NO: 508156 - DNA, 20 bp, Artificial Sequence
  chemically synthesized
tggtttttggatttatggct

SEQ ID NO: 508157 - DNA, 20 bp, Artificial Sequence
  chemically synthesized
ctacttatgatctgtggttt

SEQ ID NO: 508158 - DNA, 20 bp, Artificial Sequence
  chemically synthesized
caaaaaccacagatcataag

SEQ ID NO: 508159 - DNA, 20 bp, Artificial Sequence
  chemically synthesized
taaaagacactcagcaaaat

SEQ ID NO: 508160 - DNA, 20 bp, Artificial Sequence
  chemically synthesized
tatctgaaattcacattttg

SEQ ID NO: 508161 - DNA, 20 bp, Artificial Sequence
  chemically synthesized
ctttgtaattgtcccaggat

SEQ ID NO: 508162 - DNA, 20 bp, Artificial Sequence
  chemically synthesized
aagatcctttgtaattgtcc

SEQ ID NO: 508163 - DNA, 20 bp, Artificial Sequence
  chemically synthesized
ctaatcctgggacaattaca

SEQ ID NO: 508164 - DNA, 20 bp, Artificial Sequence
  chemically synthesized
gtgtgtgtgtgtgtttcctc

SEQ ID NO: 508165 - DNA, 20 bp, Artificial Sequence
  chemically synthesized
ataaaatattacaattagct

SEQ ID NO: 508166 - DNA, 20 bp, Artificial Sequence
  chemically synthesized
aataaagcaccctcataatt

SEQ ID NO: 508167 - DNA, 20 bp, Artificial Sequence
  chemically synthesized
tatttcttatccaaaattat

SEQ ID NO: 508168 - DNA, 20 bp, Artificial Sequence
  chemically synthesized
tctgaagcattgcttttcta

SEQ ID NO: 508169 - DNA, 20 bp, Artificial Sequence
  chemically synthesized
ggccaagcttgatgataaat

SEQ ID NO: 508170 - DNA, 20 bp, Artificial Sequence
  chemically synthesized
cagcttcaatttactataaa

SEQ ID NO: 508171 - DNA, 20 bp, Artificial Sequence
  chemically synthesized
tcctggaagacagacttcat

SEQ ID NO: 508172 - DNA, 20 bp, Artificial Sequence
  chemically synthesized
atttgtggatgagaacaacg

SEQ ID NO: 508173 - DNA, 20 bp, Artificial Sequence
  chemically synthesized
aaaagaaatcaaacatattt

SEQ ID NO: 508174 - DNA, 20 bp, Artificial Sequence
  chemically synthesized
ttttgttacagcagcacaaa

SEQ ID NO: 508175 - DNA, 20 bp, Artificial Sequence
  chemically synthesized
ctgctgtaacaaaaataact

SEQ ID NO: 508176 - DNA, 20 bp, Artificial Sequence
  chemically synthesized
tgagaatgaggtaatttagg

SEQ ID NO: 508177 - DNA, 20 bp, Artificial Sequence
  chemically synthesized
cctttattttttcacagttc

SEQ ID NO: 508178 - DNA, 20 bp, Artificial Sequence
  chemically synthesized
cagatgctaacatcttgatc

SEQ ID NO: 508179 - DNA, 20 bp, Artificial Sequence
  chemically synthesized
atctggtgagggccttttca

SEQ ID NO: 508180 - DNA, 20 bp, Artificial Sequence
  chemically synthesized
tcacatggtggtgcatggtg

SEQ ID NO: 508181 - DNA, 20 bp, Artificial Sequence
  chemically synthesized
cagggctcctcccttaagaa

SEQ ID NO: 508182 - DNA, 20 bp, Artificial Sequence
  chemically synthesized
tccatcagggctcctccctt

SEQ ID NO: 508183 - DNA, 20 bp, Artificial Sequence
  chemically synthesized
ttcttaagggaggagccctg

SEQ ID NO: 508184 - DNA, 20 bp, Artificial Sequence
  chemically synthesized
aggagatggaatatttaagg

SEQ ID NO: 508185 - DNA, 20 bp, Artificial Sequence
  chemically synthesized
tattaggagatggaatattt

SEQ ID NO: 508186 - DNA, 20 bp, Artificial Sequence
  chemically synthesized
caggtgattgtattaggaga

SEQ ID NO: 508187 - DNA, 20 bp, Artificial Sequence
  chemically synthesized
ccatctcctaatacaatcac

SEQ ID NO: 508188 - DNA, 20 bp, Artificial Sequence
  chemically synthesized
gcaatctttgttgcaatggc

SEQ ID NO: 508189 - DNA, 20 bp, Artificial Sequence
  chemically synthesized
agatgacatggttgatggga

SEQ ID NO: 508190 - DNA, 20 bp, Artificial Sequence
  chemically synthesized
ctgtgtataggtactataca

SEQ ID NO: 508191 - DNA, 20 bp, Artificial Sequence
  chemically synthesized
agaatcagaaactgaaagag

SEQ ID NO: 508192 - DNA, 20 bp, Artificial Sequence
  chemically synthesized
tctccagaatcagaaactga

SEQ ID NO: 508193 - DNA, 20 bp, Artificial Sequence
  chemically synthesized
atagagttttaatggatctc

SEQ ID NO: 508194 - DNA, 20 bp, Artificial Sequence
  chemically synthesized
tcagtttacatagagtttta

SEQ ID NO: 508195 - DNA, 20 bp, Artificial Sequence
  chemically synthesized
tttcaaattttcagtttaca

SEQ ID NO: 508196 - DNA, 20 bp, Artificial Sequence
  chemically synthesized
aacatcacaatgtaaaacaa

SEQ ID NO: 508197 - DNA, 20 bp, Artificial Sequence
  chemically synthesized
acaatagaatttataatata

SEQ ID NO: 508198 - DNA, 20 bp, Artificial Sequence
  chemically synthesized
ggcatctattggacattgag

SEQ ID NO: 508199 - DNA, 20 bp, Artificial Sequence
  chemically synthesized
agtctgagaaataatagttc

SEQ ID NO: 508200 - DNA, 20 bp, Artificial Sequence
  chemically synthesized
atgtgaaagtttttagaaat

SEQ ID NO: 508201 - DNA, 20 bp, Artificial Sequence
  chemically synthesized
caccacacatactaaataat

SEQ ID NO: 508202 - DNA, 20 bp, Artificial Sequence
  chemically synthesized
tcttgaagggaaaagtgaca

SEQ ID NO: 508203 - DNA, 20 bp, Artificial Sequence
  chemically synthesized
gaggtctattttccatccct

SEQ ID NO: 508204 - DNA, 20 bp, Artificial Sequence
  chemically synthesized
caagtccagatcatattcac

SEQ ID NO: 508205 - DNA, 20 bp, Artificial Sequence
  chemically synthesized
tgtgtttttttttttgacca

SEQ ID NO: 508206 - DNA, 20 bp, Artificial Sequence
  chemically synthesized
gttcttttatagcctacact

SEQ ID NO: 508207 - DNA, 20 bp, Artificial Sequence
  chemically synthesized
gcctggcctcctttacagca

SEQ ID NO: 508208 - DNA, 20 bp, Artificial Sequence
  chemically synthesized
aaggaggccaggctacacta

SEQ ID NO: 508209 - DNA, 20 bp, Artificial Sequence
  chemically synthesized
cgaatcattagagaccatat

SEQ ID NO: 508210 - DNA, 20 bp, Artificial Sequence
  chemically synthesized
accatataggagtgattctg

SEQ ID NO: 508211 - DNA, 20 bp, Artificial Sequence
  chemically synthesized
taatacagtattttatcctg

SEQ ID NO: 508212 - DNA, 20 bp, Artificial Sequence
  chemically synthesized
ttccagctcagcacagccca

SEQ ID NO: 508213 - DNA, 20 bp, Artificial Sequence
  chemically synthesized
atattactagttttatagct

SEQ ID NO: 508214 - DNA, 20 bp, Artificial Sequence
  chemically synthesized
tgcgtcatgatctgaagacc

SEQ ID NO: 508215 - DNA, 20 bp, Artificial Sequence
  chemically synthesized
tcaaatgacgtccaaactta

SEQ ID NO: 508216 - DNA, 20 bp, Artificial Sequence
  chemically synthesized
acacacaaatagactagaga

SEQ ID NO: 508217 - DNA, 20 bp, Artificial Sequence
  chemically synthesized
aagatatagaaaatagtggg

SEQ ID NO: 508218 - DNA, 20 bp, Artificial Sequence
  chemically synthesized
agaaaatagtgggctgggta

SEQ ID NO: 508219 - DNA, 20 bp, Artificial Sequence
  chemically synthesized
catttccagcatcagggaca

SEQ ID NO: 508220 - DNA, 20 bp, Artificial Sequence
  chemically synthesized
taattacacaactttatgtt

SEQ ID NO: 508221 - DNA, 20 bp, Artificial Sequence
  chemically synthesized
ctcaaattttggttgaatta

SEQ ID NO: 508222 - DNA, 20 bp, Artificial Sequence
  chemically synthesized
atttgcatctcaaattttgg

SEQ ID NO: 508223 - DNA, 20 bp, Artificial Sequence
  chemically synthesized
ctttaaacatgatgtttata

SEQ ID NO: 508224 - DNA, 20 bp, Artificial Sequence
  chemically synthesized
caaattataagatcaatgtt

SEQ ID NO: 508225 - DNA, 20 bp, Artificial Sequence
  chemically synthesized
ctgaacattgatcttataat

SEQ ID NO: 508226 - DNA, 20 bp, Artificial Sequence
  chemically synthesized
ttgatcttataatttgaatt

SEQ ID NO: 508227 - DNA, 20 bp, Artificial Sequence
  chemically synthesized
tgaattaggaatatgttatt

SEQ ID NO: 508228 - DNA, 20 bp, Artificial Sequence
  chemically synthesized
gaaacttccagtaaagattt

SEQ ID NO: 508229 - DNA, 20 bp, Artificial Sequence
  chemically synthesized
cacaaagtgcacacatagct

SEQ ID NO: 508230 - DNA, 20 bp, Artificial Sequence
  chemically synthesized
tataatctcattaatttttc

SEQ ID NO: 508231 - DNA, 20 bp, Artificial Sequence
  chemically synthesized
attaatgagattataataca

SEQ ID NO: 508232 - DNA, 20 bp, Artificial Sequence
  chemically synthesized
gatgttaataaaacgggaga

SEQ ID NO: 508233 - DNA, 20 bp, Artificial Sequence
  chemically synthesized
aaaaaatagtttaaggaaat

SEQ ID NO: 508234 - DNA, 20 bp, Artificial Sequence
  chemically synthesized
ttgtatttcagtatctctcc

SEQ ID NO: 508235 - DNA, 20 bp, Artificial Sequence
  chemically synthesized
caggacaattgagtgtaata

SEQ ID NO: 508236 - DNA, 20 bp, Artificial Sequence
  chemically synthesized
agattaaggaaacaggacaa

SEQ ID NO: 508237 - DNA, 20 bp, Artificial Sequence
  chemically synthesized
ttttggctatgacagtttct

SEQ ID NO: 508238 - DNA, 20 bp, Artificial Sequence
  chemically synthesized
tttgtagtatgcctctcagt

SEQ ID NO: 508239 - DNA, 20 bp, Artificial Sequence
  chemically synthesized
ttttttcctcataattaaac

SEQ ID NO: 508240 - DNA, 20 bp, Artificial Sequence
  chemically synthesized
taacattgataagtcacgtt

SEQ ID NO: 508241 - DNA, 20 bp, Artificial Sequence
  chemically synthesized
ggggaaagagtaactttata

SEQ ID NO: 508242 - DNA, 20 bp, Artificial Sequence
  chemically synthesized
acagtgtgaaaagaggggga

SEQ ID NO: 508243 - DNA, 20 bp, Artificial Sequence
  chemically synthesized
gtcactatacacagcccctg

SEQ ID NO: 508244 - DNA, 20 bp, Artificial Sequence
  chemically synthesized
tacacagcccctgtggagtg

SEQ ID NO: 508245 - DNA, 20 bp, Artificial Sequence
  chemically synthesized
cttctctgccctcacggaga

SEQ ID NO: 508246 - DNA, 20 bp, Artificial Sequence
  chemically synthesized
agagaagttacataagtttt

SEQ ID NO: 508247 - DNA, 20 bp, Artificial Sequence
  chemically synthesized
ataatttcataaataaatgg

SEQ ID NO: 508248 - DNA, 20 bp, Artificial Sequence
  chemically synthesized
aaagtatcaaataactatac

SEQ ID NO: 508249 - DNA, 20 bp, Artificial Sequence
  chemically synthesized
atccaaagcaaaaactagta

SEQ ID NO: 508250 - DNA, 20 bp, Artificial Sequence
  chemically synthesized
atccaatactagtttttgct

SEQ ID NO: 508251 - DNA, 20 bp, Artificial Sequence
  chemically synthesized
ctctaaacaaaaaacactga

SEQ ID NO: 508252 - DNA, 20 bp, Artificial Sequence
  chemically synthesized
ttttgtttagagcgagaccg

SEQ ID NO: 508253 - DNA, 20 bp, Artificial Sequence
  chemically synthesized
ctgattctaacactaggaaa

SEQ ID NO: 508254 - DNA, 20 bp, Artificial Sequence
  chemically synthesized
tatattccctttcctagtgt

SEQ ID NO: 508255 - DNA, 20 bp, Artificial Sequence
  chemically synthesized
tttttttttttttttcttta

SEQ ID NO: 508256 - DNA, 20 bp, Artificial Sequence
  chemically synthesized
gcatacctagcaacaggatc

SEQ ID NO: 508257 - DNA, 20 bp, Artificial Sequence
  chemically synthesized
gcaaggagcatacctagcaa

SEQ ID NO: 508258 - DNA, 20 bp, Artificial Sequence
  chemically synthesized
ctaggtatgctccttgcttc

SEQ ID NO: 508259 - DNA, 20 bp, Artificial Sequence
  chemically synthesized
tgttgtagcttacaggacct

SEQ ID NO: 508260 - DNA, 20 bp, Artificial Sequence
  chemically synthesized
ctctgggttgacataaagaa

SEQ ID NO: 508261 - DNA, 20 bp, Artificial Sequence
  chemically synthesized
tgacataaagaagtggatgt

SEQ ID NO: 508262 - DNA, 20 bp, Artificial Sequence
  chemically synthesized
atatatagaagtatttatgg

SEQ ID NO: 508263 - DNA, 20 bp, Artificial Sequence
  chemically synthesized
aattatatatagaagtattt

SEQ ID NO: 508264 - DNA, 20 bp, Artificial Sequence
  chemically synthesized
aagtcacaaggtggagagag

SEQ ID NO: 508265 - DNA, 20 bp, Artificial Sequence
  chemically synthesized
tgaactacctcttcaacatt

SEQ ID NO: 508266 - DNA, 20 bp, Artificial Sequence
  chemically synthesized
ctagtttaaagaaatcattt

SEQ ID NO: 508267 - DNA, 20 bp, Artificial Sequence
  chemically synthesized
atgtttggctcctcatgctg

SEQ ID NO: 508268 - DNA, 20 bp, Artificial Sequence
  chemically synthesized
ggtaacccctttctctgtct

SEQ ID NO: 508269 - DNA, 20 bp, Artificial Sequence
  chemically synthesized
ctgaatccacagacagagaa

SEQ ID NO: 508270 - DNA, 20 bp, Artificial Sequence
  chemically synthesized
acctaagcacaaatggtcaa

SEQ ID NO: 508271 - DNA, 20 bp, Artificial Sequence
  chemically synthesized
actacttgccccgcattgta

SEQ ID NO: 508272 - DNA, 20 bp, Artificial Sequence
  chemically synthesized
gaaaactatgggcatttgcc

SEQ ID NO: 508273 - DNA, 20 bp, Artificial Sequence
  chemically synthesized
attggttaacactatcatat

SEQ ID NO: 508274 - DNA, 20 bp, Artificial Sequence
  chemically synthesized
tattagtgtttccatattga

SEQ ID NO: 508275 - DNA, 20 bp, Artificial Sequence
  chemically synthesized
ctaataatatggttctttgg

SEQ ID NO: 508276 - DNA, 20 bp, Artificial Sequence
  chemically synthesized
tgctgtcttggttactatgg

SEQ ID NO: 508277 - DNA, 20 bp, Artificial Sequence
  chemically synthesized
tggaacataatagagaaccc

SEQ ID NO: 508278 - DNA, 20 bp, Artificial Sequence
  chemically synthesized
gcaaatgcattaatttattc

SEQ ID NO: 508279 - DNA, 20 bp, Artificial Sequence
  chemically synthesized
acacccatgtccaaaatcag

SEQ ID NO: 508280 - DNA, 20 bp, Artificial Sequence
  chemically synthesized
gcattcaactgattttggac

SEQ ID NO: 508281 - DNA, 20 bp, Artificial Sequence
  chemically synthesized
tcctggtagcatttgctgaa

SEQ ID NO: 508282 - DNA, 20 bp, Artificial Sequence
  chemically synthesized
caaatgctaccaggaaaagt

SEQ ID NO: 508283 - DNA, 20 bp, Artificial Sequence
  chemically synthesized
aagtaagaatctacatgcag

SEQ ID NO: 508284 - DNA, 20 bp, Artificial Sequence
  chemically synthesized
ttttgtatgtggcaagggat

SEQ ID NO: 508285 - DNA, 20 bp, Artificial Sequence
  chemically synthesized
attggtttttgtatgtggca

SEQ ID NO: 508286 - DNA, 20 bp, Artificial Sequence
  chemically synthesized
catacaaaaaccaatttgaa

SEQ ID NO: 508287 - DNA, 20 bp, Artificial Sequence
  chemically synthesized
ctactaatagattgagagtt

SEQ ID NO: 508288 - DNA, 20 bp, Artificial Sequence
  chemically synthesized
atgttttctactaatagatt

SEQ ID NO: 508289 - DNA, 20 bp, Artificial Sequence
  chemically synthesized
aattatttgggcaataactt

SEQ ID NO: 508290 - DNA, 20 bp, Artificial Sequence
  chemically synthesized
aaattaaaattaaaaattaa

SEQ ID NO: 508291 - DNA, 20 bp, Artificial Sequence
  chemically synthesized
cagagtaaagagatatccaa

SEQ ID NO: 508292 - DNA, 20 bp, Artificial Sequence
  chemically synthesized
caaatatttttctcattcta

SEQ ID NO: 508293 - DNA, 20 bp, Artificial Sequence
  chemically synthesized
ttgcaaactatatatctgat

SEQ ID NO: 508294 - DNA, 20 bp, Artificial Sequence
  chemically synthesized
ttttcttgctatggagttgg

SEQ ID NO: 508295 - DNA, 20 bp, Artificial Sequence
  chemically synthesized
ggttatttgttttcttgcta

SEQ ID NO: 508296 - DNA, 20 bp, Artificial Sequence
  chemically synthesized
atttatcataaaagggacaa

SEQ ID NO: 508297 - DNA, 20 bp, Artificial Sequence
  chemically synthesized
aacacttatacactgtttgt

SEQ ID NO: 508298 - DNA, 20 bp, Artificial Sequence
  chemically synthesized
gttctgttttgaggtctttg

SEQ ID NO: 508299 - DNA, 20 bp, Artificial Sequence
  chemically synthesized
tatacacaataataggattg

SEQ ID NO: 508300 - DNA, 20 bp, Artificial Sequence
  chemically synthesized
tttaagtgtatacacaataa

SEQ ID NO: 508301 - DNA, 20 bp, Artificial Sequence
  chemically synthesized
attattgtgtatacacttaa

SEQ ID NO: 508302 - DNA, 20 bp, Artificial Sequence
  chemically synthesized
gtgtgcatgtgtctttttgg

SEQ ID NO: 508303 - DNA, 20 bp, Artificial Sequence
  chemically synthesized
ggttgattgtctttgtgatt

SEQ ID NO: 508304 - DNA, 20 bp, Artificial Sequence
  chemically synthesized
aaatgcttatcagtggtaaa

SEQ ID NO: 508305 - DNA, 20 bp, Artificial Sequence
  chemically synthesized
aatgtggtaaacacatacca

SEQ ID NO: 508306 - DNA, 20 bp, Artificial Sequence
  chemically synthesized
aatactatgcggccatgaaa

SEQ ID NO: 508307 - DNA, 20 bp, Artificial Sequence
  chemically synthesized
tgtttctgcgttattttgct

SEQ ID NO: 508308 - DNA, 20 bp, Artificial Sequence
  chemically synthesized
acaacagacatggggcctat

SEQ ID NO: 508309 - DNA, 20 bp, Artificial Sequence
  chemically synthesized
atggggcctattggagtttg

SEQ ID NO: 508310 - DNA, 20 bp, Artificial Sequence
  chemically synthesized
tttggagggtggcagaagga

SEQ ID NO: 508311 - DNA, 20 bp, Artificial Sequence
  chemically synthesized
gaattaggaaaaaataacta

SEQ ID NO: 508312 - DNA, 20 bp, Artificial Sequence
  chemically synthesized
tacatgtgcagttttgttac

SEQ ID NO: 508313 - DNA, 20 bp, Artificial Sequence
  chemically synthesized
atattttaacttttaggtgc

SEQ ID NO: 508314 - DNA, 20 bp, Artificial Sequence
  chemically synthesized
aacatttatctttttttgtt

SEQ ID NO: 508315 - DNA, 20 bp, Artificial Sequence
  chemically synthesized
aacctttacacactgtaaat

SEQ ID NO: 508316 - DNA, 20 bp, Artificial Sequence
  chemically synthesized
atatgatacaaaatcccact

SEQ ID NO: 508317 - DNA, 20 bp, Artificial Sequence
  chemically synthesized
tttgtatatataattcatag

SEQ ID NO: 508318 - DNA, 20 bp, Artificial Sequence
  chemically synthesized
attgattccatatcttggcc

SEQ ID NO: 508319 - DNA, 20 bp, Artificial Sequence
  chemically synthesized
cactattcatggccaagata

SEQ ID NO: 508320 - DNA, 20 bp, Artificial Sequence
  chemically synthesized
gttcatatgttggtggatat

SEQ ID NO: 508321 - DNA, 20 bp, Artificial Sequence
  chemically synthesized
ctttatccgttcatatgttg

SEQ ID NO: 508322 - DNA, 20 bp, Artificial Sequence
  chemically synthesized
aaatatccaccaacatatga

SEQ ID NO: 508323 - DNA, 20 bp, Artificial Sequence
  chemically synthesized
tgtggtatacatatatacaa

SEQ ID NO: 508324 - DNA, 20 bp, Artificial Sequence
  chemically synthesized
tattttattcttttttatgg

SEQ ID NO: 508325 - DNA, 20 bp, Artificial Sequence
  chemically synthesized
aatactattcagccataaaa

SEQ ID NO: 508326 - DNA, 20 bp, Artificial Sequence
  chemically synthesized
atactgtcatttgcaacaac

SEQ ID NO: 508327 - DNA, 20 bp, Artificial Sequence
  chemically synthesized
caacaacatggatgaacctg

SEQ ID NO: 508328 - DNA, 20 bp, Artificial Sequence
  chemically synthesized
tgcctaatttcacttatatg

SEQ ID NO: 508329 - DNA, 20 bp, Artificial Sequence
  chemically synthesized
ctattcattccctacttctg

SEQ ID NO: 508330 - DNA, 20 bp, Artificial Sequence
  chemically synthesized
gagctgatcccacagaagta

SEQ ID NO: 508331 - DNA, 20 bp, Artificial Sequence
  chemically synthesized
tgatcccacagaagtaggga

SEQ ID NO: 508332 - DNA, 20 bp, Artificial Sequence
  chemically synthesized
aggtatggagatacttttca

SEQ ID NO: 508333 - DNA, 20 bp, Artificial Sequence
  chemically synthesized
catgctgtaaaatacatcac

SEQ ID NO: 508334 - DNA, 20 bp, Artificial Sequence
  chemically synthesized
cctctctctctacatttttc

SEQ ID NO: 508335 - DNA, 20 bp, Artificial Sequence
  chemically synthesized
atatttatcatttttatggt

SEQ ID NO: 508336 - DNA, 20 bp, Artificial Sequence
  chemically synthesized
aaatatatattgtggaacag

SEQ ID NO: 508337 - DNA, 20 bp, Artificial Sequence
  chemically synthesized
tcatgtacaacgtgatgctt

SEQ ID NO: 508338 - DNA, 20 bp, Artificial Sequence
  chemically synthesized
gaagcatcacgttgtacatg

SEQ ID NO: 508339 - DNA, 20 bp, Artificial Sequence
  chemically synthesized
ttttatctgtcaatttaaag

SEQ ID NO: 508340 - DNA, 20 bp, Artificial Sequence
  chemically synthesized
caaacaataaaatataaaag

SEQ ID NO: 508341 - DNA, 20 bp, Artificial Sequence
  chemically synthesized
aaatataaaagttgggtctg

SEQ ID NO: 508342 - DNA, 20 bp, Artificial Sequence
  chemically synthesized
tgggtctgttgagtgtgtgt

SEQ ID NO: 508343 - DNA, 20 bp, Artificial Sequence
  chemically synthesized
gtctactgagcgaaacatat

SEQ ID NO: 508344 - DNA, 20 bp, Artificial Sequence
  chemically synthesized
actacttacacatttatgtg

SEQ ID NO: 508345 - DNA, 20 bp, Artificial Sequence
  chemically synthesized
tccttttttcttccagttcc

SEQ ID NO: 508346 - DNA, 20 bp, Artificial Sequence
  chemically synthesized
agctgttgccggagctcagt

SEQ ID NO: 508347 - DNA, 20 bp, Artificial Sequence
  chemically synthesized
gtttcttactgtggagtggc

SEQ ID NO: 508348 - DNA, 20 bp, Artificial Sequence
  chemically synthesized
tcctcttctgtttcttactg

SEQ ID NO: 508349 - DNA, 20 bp, Artificial Sequence
  chemically synthesized
ccaatgggaggcactggcaa

SEQ ID NO: 508350 - DNA, 20 bp, Artificial Sequence
  chemically synthesized
aaccaaaggccaagaggaac

SEQ ID NO: 508351 - DNA, 20 bp, Artificial Sequence
  chemically synthesized
tccttcttgctctgttcaaa

SEQ ID NO: 508352 - DNA, 20 bp, Artificial Sequence
  chemically synthesized
gcaagaaggagaaaagtgaa

SEQ ID NO: 508353 - DNA, 20 bp, Artificial Sequence
  chemically synthesized
agtgaaatgaatctgctaaa

SEQ ID NO: 508354 - DNA, 20 bp, Artificial Sequence
  chemically synthesized
tataagtgtatttaaaacaa

SEQ ID NO: 508355 - DNA, 20 bp, Artificial Sequence
  chemically synthesized
tatgaggataaagatgctga

SEQ ID NO: 508356 - DNA, 20 bp, Artificial Sequence
  chemically synthesized
atagcctggcattagtgtat

SEQ ID NO: 508357 - DNA, 20 bp, Artificial Sequence
  chemically synthesized
attacatacaggttccatgt

SEQ ID NO: 508358 - DNA, 20 bp, Artificial Sequence
  chemically synthesized
tgtaattttatatgaagagt

SEQ ID NO: 508359 - DNA, 20 bp, Artificial Sequence
  chemically synthesized
tttccctgtaattttatatg

SEQ ID NO: 508360 - DNA, 20 bp, Artificial Sequence
  chemically synthesized
ccatagctggtccgaagtat

SEQ ID NO: 508361 - DNA, 20 bp, Artificial Sequence
  chemically synthesized
atgcatttcatattcctttt

SEQ ID NO: 508362 - DNA, 20 bp, Artificial Sequence
  chemically synthesized
ttattgtaaacactctcaaa

SEQ ID NO: 508363 - DNA, 20 bp, Artificial Sequence
  chemically synthesized
acattgcaatcagaagttat

SEQ ID NO: 508364 - DNA, 20 bp, Artificial Sequence
  chemically synthesized
cagtttttgcttccacttaa

SEQ ID NO: 508365 - DNA, 20 bp, Artificial Sequence
  chemically synthesized
tttccttcaacaaatcttta

SEQ ID NO: 508366 - DNA, 20 bp, Artificial Sequence
  chemically synthesized
gcaggaaactcatatttgtt

SEQ ID NO: 508367 - DNA, 20 bp, Artificial Sequence
  chemically synthesized
tttgtccattcctaacaaat

SEQ ID NO: 508368 - DNA, 20 bp, Artificial Sequence
  chemically synthesized
gacataaatacaaaaataat

SEQ ID NO: 508369 - DNA, 20 bp, Artificial Sequence
  chemically synthesized
tgtatataaatctaattata

SEQ ID NO: 508370 - DNA, 20 bp, Artificial Sequence
  chemically synthesized
agatttatatacattcctga

SEQ ID NO: 508371 - DNA, 20 bp, Artificial Sequence
  chemically synthesized
tatcctctccttactccctc

SEQ ID NO: 508372 - DNA, 20 bp, Artificial Sequence
  chemically synthesized
cattcctgagggagtaagga

SEQ ID NO: 508373 - DNA, 20 bp, Artificial Sequence
  chemically synthesized
cctcgcagaacacacagcct

SEQ ID NO: 508374 - DNA, 20 bp, Artificial Sequence
  chemically synthesized
tatatttcgtaaattaatga

SEQ ID NO: 508375 - DNA, 20 bp, Artificial Sequence
  chemically synthesized
attgtatatttcgtaaatta

SEQ ID NO: 508376 - DNA, 20 bp, Artificial Sequence
  chemically synthesized
atttacgaaatatacaatta

SEQ ID NO: 508377 - DNA, 20 bp, Artificial Sequence
  chemically synthesized
aatatacaattattgagtac

SEQ ID NO: 508378 - DNA, 20 bp, Artificial Sequence
  chemically synthesized
ttattgagtacctggatact

SEQ ID NO: 508379 - DNA, 20 bp, Artificial Sequence
  chemically synthesized
aacacagccccttgctatct

SEQ ID NO: 508380 - DNA, 20 bp, Artificial Sequence
  chemically synthesized
cttgctatcttggagtttat

SEQ ID NO: 508381 - DNA, 20 bp, Artificial Sequence
  chemically synthesized
tcttggagtttatatggatg

SEQ ID NO: 508382 - DNA, 20 bp, Artificial Sequence
  chemically synthesized
atactatgaaatgagagcaa

SEQ ID NO: 508383 - DNA, 20 bp, Artificial Sequence
  chemically synthesized
atgaaatgagagcaattgaa

SEQ ID NO: 508384 - DNA, 20 bp, Artificial Sequence
  chemically synthesized
ggtctttctttccgtctaga

SEQ ID NO: 508385 - DNA, 20 bp, Artificial Sequence
  chemically synthesized
ccttgtgcgatcaagctgca

SEQ ID NO: 508386 - DNA, 20 bp, Artificial Sequence
  chemically synthesized
cagcttgatcgcacaaggtg

SEQ ID NO: 508387 - DNA, 20 bp, Artificial Sequence
  chemically synthesized
atcatagcctaccttaatct

SEQ ID NO: 508388 - DNA, 20 bp, Artificial Sequence
  chemically synthesized
cgatagaacatgaaagatta

SEQ ID NO: 508389 - DNA, 20 bp, Artificial Sequence
  chemically synthesized
ctcttcttattggtcaatct

SEQ ID NO: 508390 - DNA, 20 bp, Artificial Sequence
  chemically synthesized
ggagaggattgcttgagcta

SEQ ID NO: 508391 - DNA, 20 bp, Artificial Sequence
  chemically synthesized
cttttgggaggccaagggga

SEQ ID NO: 508392 - DNA, 20 bp, Artificial Sequence
  chemically synthesized
ccttggcctcccaaaagtgc

SEQ ID NO: 508393 - DNA, 20 bp, Artificial Sequence
  chemically synthesized
aaagtgctgggattataggc

SEQ ID NO: 508394 - DNA, 20 bp, Artificial Sequence
  chemically synthesized
tataaagagaaaacacctgg

SEQ ID NO: 508395 - DNA, 20 bp, Artificial Sequence
  chemically synthesized
aggtgttttctctttataag

SEQ ID NO: 508396 - DNA, 20 bp, Artificial Sequence
  chemically synthesized
ggatacagaaacatctggtt

SEQ ID NO: 508397 - DNA, 20 bp, Artificial Sequence
  chemically synthesized
aacatctggttggggatttt

SEQ ID NO: 508398 - DNA, 20 bp, Artificial Sequence
  chemically synthesized
gggatttttggggtagggac

SEQ ID NO: 508399 - DNA, 20 bp, Artificial Sequence
  chemically synthesized
tggggtagggaccagaatgg

SEQ ID NO: 508400 - DNA, 20 bp, Artificial Sequence
  chemically synthesized
aatggctgggtgtgtgcaaa

SEQ ID NO: 508401 - DNA, 20 bp, Artificial Sequence
  chemically synthesized
atgggctgatgctgttggtc

SEQ ID NO: 508402 - DNA, 20 bp, Artificial Sequence
  chemically synthesized
gcacttctagcaagtttcta

SEQ ID NO: 508403 - DNA, 20 bp, Artificial Sequence
  chemically synthesized
gcacacacttctagcaagtt

SEQ ID NO: 508404 - DNA, 20 bp, Artificial Sequence
  chemically synthesized
gtgtgcaagactcacactta

SEQ ID NO: 508405 - DNA, 20 bp, Artificial Sequence
  chemically synthesized
gagtttctgattcagtaagt

SEQ ID NO: 508406 - DNA, 20 bp, Artificial Sequence
  chemically synthesized
acttactgaatcagaaactc

SEQ ID NO: 508407 - DNA, 20 bp, Artificial Sequence
  chemically synthesized
cacatttctagacctcatcc

SEQ ID NO: 508408 - DNA, 20 bp, Artificial Sequence
  chemically synthesized
tagagcagtaattttcaagt

SEQ ID NO: 508409 - DNA, 20 bp, Artificial Sequence
  chemically synthesized
atttgggtgagttgtgtttg

SEQ ID NO: 508410 - DNA, 20 bp, Artificial Sequence
  chemically synthesized
ttggtctctgcagaatttgg

SEQ ID NO: 508411 - DNA, 20 bp, Artificial Sequence
  chemically synthesized
tatcttggtctctgcagaat

SEQ ID NO: 508412 - DNA, 20 bp, Artificial Sequence
  chemically synthesized
tgttaatatcttggtctctg

SEQ ID NO: 508413 - DNA, 20 bp, Artificial Sequence
  chemically synthesized
ataattcatagtaatctcct

SEQ ID NO: 508414 - DNA, 20 bp, Artificial Sequence
  chemically synthesized
ccaatccccaggagattact

SEQ ID NO: 508415 - DNA, 20 bp, Artificial Sequence
  chemically synthesized
agtggaggtgaagtcaggaa

SEQ ID NO: 508416 - DNA, 20 bp, Artificial Sequence
  chemically synthesized
agtgtgactgccaactgcca

SEQ ID NO: 508417 - DNA, 20 bp, Artificial Sequence
  chemically synthesized
tgactgccaactgccaaaga

SEQ ID NO: 508418 - DNA, 20 bp, Artificial Sequence
  chemically synthesized
ctacctgaggctccaaaaag

SEQ ID NO: 508419 - DNA, 20 bp, Artificial Sequence
  chemically synthesized
gtttgaaaacagaagaacct

SEQ ID NO: 508420 - DNA, 20 bp, Artificial Sequence
  chemically synthesized
gaatcctttccaacaatggg

SEQ ID NO: 508421 - DNA, 20 bp, Artificial Sequence
  chemically synthesized
ctcagaatcctttccaacaa

SEQ ID NO: 508422 - DNA, 20 bp, Artificial Sequence
  chemically synthesized
gcattcatcccattgttgga

SEQ ID NO: 508423 - DNA, 20 bp, Artificial Sequence
  chemically synthesized
ttttctcaattaaaacatct

SEQ ID NO: 508424 - DNA, 20 bp, Artificial Sequence
  chemically synthesized
agcaaatagtagtccatatg

SEQ ID NO: 508425 - DNA, 20 bp, Artificial Sequence
  chemically synthesized
gaatcctattaaatatgatc

SEQ ID NO: 508426 - DNA, 20 bp, Artificial Sequence
  chemically synthesized
ccactcttgatcatatttaa

SEQ ID NO: 508427 - DNA, 20 bp, Artificial Sequence
  chemically synthesized
ggaaggaaggtttagggttg

SEQ ID NO: 508428 - DNA, 20 bp, Artificial Sequence
  chemically synthesized
gtcctataggaaggaaggtt

SEQ ID NO: 508429 - DNA, 20 bp, Artificial Sequence
  chemically synthesized
ttccttcctataggacaaaa

SEQ ID NO: 508430 - DNA, 20 bp, Artificial Sequence
  chemically synthesized
taattggatgcgaagtataa

SEQ ID NO: 508431 - DNA, 20 bp, Artificial Sequence
  chemically synthesized
actttgtatatgaagtataa

SEQ ID NO: 508432 - DNA, 20 bp, Artificial Sequence
  chemically synthesized
gttgcgtataaaaaaggata

SEQ ID NO: 508433 - DNA, 20 bp, Artificial Sequence
  chemically synthesized
gagatgagttgcgtataaaa

SEQ ID NO: 508434 - DNA, 20 bp, Artificial Sequence
  chemically synthesized
acataacataaggaagtgag

SEQ ID NO: 508435 - DNA, 20 bp, Artificial Sequence
  chemically synthesized
ctggcttctacaataggcat

SEQ ID NO: 508436 - DNA, 20 bp, Artificial Sequence
  chemically synthesized
catttggatttggtgccccc

SEQ ID NO: 508437 - DNA, 20 bp, Artificial Sequence
  chemically synthesized
acagcttctcaaacttaaat

SEQ ID NO: 508438 - DNA, 20 bp, Artificial Sequence
  chemically synthesized
ccaaccccgtgaatttaaat

SEQ ID NO: 508439 - DNA, 20 bp, Artificial Sequence
  chemically synthesized
gtgattctgatttaaattca

SEQ ID NO: 508440 - DNA, 20 bp, Artificial Sequence
  chemically synthesized
tctgatttaaattcacgggg

SEQ ID NO: 508441 - DNA, 20 bp, Artificial Sequence
  chemically synthesized
gaattcttcgacccaacccc

SEQ ID NO: 508442 - DNA, 20 bp, Artificial Sequence
  chemically synthesized
aaattcacggggttgggtcg

SEQ ID NO: 508443 - DNA, 20 bp, Artificial Sequence
  chemically synthesized
cacctggaagctggttagaa

SEQ ID NO: 508444 - DNA, 20 bp, Artificial Sequence
  chemically synthesized
tccaggtgaaaccaatgttg

SEQ ID NO: 508445 - DNA, 20 bp, Artificial Sequence
  chemically synthesized
gaaaccaatgttgctgggtc

SEQ ID NO: 508446 - DNA, 20 bp, Artificial Sequence
  chemically synthesized
gctgggtcatggatcacact

SEQ ID NO: 508447 - DNA, 20 bp, Artificial Sequence
  chemically synthesized
tgaatgacaacattccaggt

SEQ ID NO: 508448 - DNA, 20 bp, Artificial Sequence
  chemically synthesized
aaataaataatattcttacc

SEQ ID NO: 508449 - DNA, 20 bp, Artificial Sequence
  chemically synthesized
gtcacataaatctatatctt

SEQ ID NO: 508450 - DNA, 20 bp, Artificial Sequence
  chemically synthesized
acactggcagggaagtatca

SEQ ID NO: 508451 - DNA, 20 bp, Artificial Sequence
  chemically synthesized
gtatcaaagggtatcagact

SEQ ID NO: 508452 - DNA, 20 bp, Artificial Sequence
  chemically synthesized
gaagggcatacttgggcatt

SEQ ID NO: 508453 - DNA, 20 bp, Artificial Sequence
  chemically synthesized
ttactagttatttcaatctt

SEQ ID NO: 508454 - DNA, 20 bp, Artificial Sequence
  chemically synthesized
agagcatcagtaaagtgcag

SEQ ID NO: 508455 - DNA, 20 bp, Artificial Sequence
  chemically synthesized
agtgcaggtgaattataggc

SEQ ID NO: 508456 - DNA, 20 bp, Artificial Sequence
  chemically synthesized
gaattataggccagagtttt

SEQ ID NO: 508457 - DNA, 20 bp, Artificial Sequence
  chemically synthesized
tctgggtgattagcaaggaa

SEQ ID NO: 508458 - DNA, 20 bp, Artificial Sequence
  chemically synthesized
ggaggcactgatatcagaag

SEQ ID NO: 508459 - DNA, 20 bp, Artificial Sequence
  chemically synthesized
cccaaagatggtttaaataa

SEQ ID NO: 508460 - DNA, 20 bp, Artificial Sequence
  chemically synthesized
taaataaaggggtgacttca

SEQ ID NO: 508461 - DNA, 20 bp, Artificial Sequence
  chemically synthesized
gggagtggggaggttaacct

SEQ ID NO: 508462 - DNA, 20 bp, Artificial Sequence
  chemically synthesized
caaggttatgttaaaaaaag

SEQ ID NO: 508463 - DNA, 20 bp, Artificial Sequence
  chemically synthesized
ttttttttttttttttgaga

SEQ ID NO: 508464 - DNA, 20 bp, Artificial Sequence
  chemically synthesized
ctgtactcgagcctgggtaa

SEQ ID NO: 508465 - DNA, 20 bp, Artificial Sequence
  chemically synthesized
tctcattctgttacccaggc

SEQ ID NO: 508466 - DNA, 20 bp, Artificial Sequence
  chemically synthesized
ttgtgtcactgtactcgagc

SEQ ID NO: 508467 - DNA, 20 bp, Artificial Sequence
  chemically synthesized
cctgggaggtcaaggcttca

SEQ ID NO: 508468 - DNA, 20 bp, Artificial Sequence
  chemically synthesized
tactcaggaggctgaggcag

SEQ ID NO: 508469 - DNA, 20 bp, Artificial Sequence
  chemically synthesized
gatcctcctgcctcagcctc

SEQ ID NO: 508470 - DNA, 20 bp, Artificial Sequence
  chemically synthesized
ggagaccacatctatacaaa

SEQ ID NO: 508471 - DNA, 20 bp, Artificial Sequence
  chemically synthesized
caggaggatagctggagacc

SEQ ID NO: 508472 - DNA, 20 bp, Artificial Sequence
  chemically synthesized
actttgggaggtcgaggcag

SEQ ID NO: 508473 - DNA, 20 bp, Artificial Sequence
  chemically synthesized
gcctcgacctcccaaagttc

SEQ ID NO: 508474 - DNA, 20 bp, Artificial Sequence
  chemically synthesized
gctactgttattttatttct

SEQ ID NO: 508475 - DNA, 20 bp, Artificial Sequence
  chemically synthesized
gtgcacagtcttgggtcaca

SEQ ID NO: 508476 - DNA, 20 bp, Artificial Sequence
  chemically synthesized
aaataaaatagtgcacagtc

SEQ ID NO: 508477 - DNA, 20 bp, Artificial Sequence
  chemically synthesized
aaacatgatgaaaatgagac

SEQ ID NO: 508478 - DNA, 20 bp, Artificial Sequence
  chemically synthesized
tccaaatttatttacatctt

SEQ ID NO: 508479 - DNA, 20 bp, Artificial Sequence
  chemically synthesized
cccgtctaaatgacgacttg

SEQ ID NO: 508480 - DNA, 20 bp, Artificial Sequence
  chemically synthesized
cgggaaagtaaaagcaaaag

SEQ ID NO: 508481 - DNA, 20 bp, Artificial Sequence
  chemically synthesized
aagtaaaagcaaaaggtgaa

SEQ ID NO: 508482 - DNA, 20 bp, Artificial Sequence
  chemically synthesized
gactggcaatagagagccga

SEQ ID NO: 508483 - DNA, 20 bp, Artificial Sequence
  chemically synthesized
gcaatagagagccgagggag

SEQ ID NO: 508484 - DNA, 20 bp, Artificial Sequence
  chemically synthesized
gagagccgagggagtggaat

SEQ ID NO: 508485 - DNA, 20 bp, Artificial Sequence
  chemically synthesized
agaataaagtagtatagggc

SEQ ID NO: 508486 - DNA, 20 bp, Artificial Sequence
  chemically synthesized
tccaatcgttcagatcatct

SEQ ID NO: 508487 - DNA, 20 bp, Artificial Sequence
  chemically synthesized
aacttggaactttggcaaca

SEQ ID NO: 508488 - DNA, 20 bp, Artificial Sequence
  chemically synthesized
gaaacactgggcacaatcat

SEQ ID NO: 508489 - DNA, 20 bp, Artificial Sequence
  chemically synthesized
tctcaaactttaatgtacat

SEQ ID NO: 508490 - DNA, 20 bp, Artificial Sequence
  chemically synthesized
atgtacatatgaatcacctg

SEQ ID NO: 508491 - DNA, 20 bp, Artificial Sequence
  chemically synthesized
ccaacccaggcctactgact

SEQ ID NO: 508492 - DNA, 20 bp, Artificial Sequence
  chemically synthesized
tgcattctaagtcagtaggc

SEQ ID NO: 508493 - DNA, 20 bp, Artificial Sequence
  chemically synthesized
ttgggcagttgttagaaatg

SEQ ID NO: 508494 - DNA, 20 bp, Artificial Sequence
  chemically synthesized
gcatttctaacaactgccca

SEQ ID NO: 508495 - DNA, 20 bp, Artificial Sequence
  chemically synthesized
gcccaagggatatcaatgct

SEQ ID NO: 508496 - DNA, 20 bp, Artificial Sequence
  chemically synthesized
tgctccttaaaatgtgatta

SEQ ID NO: 508497 - DNA, 20 bp, Artificial Sequence
  chemically synthesized
gagcaatggtataagtcact

SEQ ID NO: 508498 - DNA, 20 bp, Artificial Sequence
  chemically synthesized
atttgaaaaatactacgtct

SEQ ID NO: 508499 - DNA, 20 bp, Artificial Sequence
  chemically synthesized
cgggggtgggatgacagctc

SEQ ID NO: 508500 - DNA, 20 bp, Artificial Sequence
  chemically synthesized
tacgttttcatgtccggggg

SEQ ID NO: 508501 - DNA, 20 bp, Artificial Sequence
  chemically synthesized
acagatacgttttcatgtcc

SEQ ID NO: 508502 - DNA, 20 bp, Artificial Sequence
  chemically synthesized
acgtatctgtatgaacataa

SEQ ID NO: 508503 - DNA, 20 bp, Artificial Sequence
  chemically synthesized
tgaacataaaggaattcaat

SEQ ID NO: 508504 - DNA, 20 bp, Artificial Sequence
  chemically synthesized
aagcaaagctggcattccca

SEQ ID NO: 508505 - DNA, 20 bp, Artificial Sequence
  chemically synthesized
ttgctttacagaaactctgt

SEQ ID NO: 508506 - DNA, 20 bp, Artificial Sequence
  chemically synthesized
gccgccttcctacattctaa

SEQ ID NO: 508507 - DNA, 20 bp, Artificial Sequence
  chemically synthesized
gttagaatgtaggaaggcgg

SEQ ID NO: 508508 - DNA, 20 bp, Artificial Sequence
  chemically synthesized
cactttgggaggctgaggcg

SEQ ID NO: 508509 - DNA, 20 bp, Artificial Sequence
  chemically synthesized
aggcggcggatcacaaggtc

SEQ ID NO: 508510 - DNA, 20 bp, Artificial Sequence
  chemically synthesized
tggggtttcaccatgttggc

SEQ ID NO: 508511 - DNA, 20 bp, Artificial Sequence
  chemically synthesized
ttttgtatttttagtggaga

SEQ ID NO: 508512 - DNA, 20 bp, Artificial Sequence
  chemically synthesized
taaaaatacaaaaattagcc

SEQ ID NO: 508513 - DNA, 20 bp, Artificial Sequence
  chemically synthesized
aattgtcctgcctcagcctc

SEQ ID NO: 508514 - DNA, 20 bp, Artificial Sequence
  chemically synthesized
ctcactgcaacctccgcctc

SEQ ID NO: 508515 - DNA, 20 bp, Artificial Sequence
  chemically synthesized
gaggcggaggttgcagtgag

SEQ ID NO: 508516 - DNA, 20 bp, Artificial Sequence
  chemically synthesized
tcgcaccattagactccagc

SEQ ID NO: 508517 - DNA, 20 bp, Artificial Sequence
  chemically synthesized
tttcactctgtcactcaggc

SEQ ID NO: 508518 - DNA, 20 bp, Artificial Sequence
  chemically synthesized
ttagactccagcctgagtga

SEQ ID NO: 508519 - DNA, 20 bp, Artificial Sequence
  chemically synthesized
gtttcaaaaaacaaaaaaga

SEQ ID NO: 508520 - DNA, 20 bp, Artificial Sequence
  chemically synthesized
gttctggacaacactggtta

SEQ ID NO: 508521 - DNA, 20 bp, Artificial Sequence
  chemically synthesized
gtatacctatagtgcacaca

SEQ ID NO: 508522 - DNA, 20 bp, Artificial Sequence
  chemically synthesized
ataatggacactagtcaggt

SEQ ID NO: 508523 - DNA, 20 bp, Artificial Sequence
  chemically synthesized
tggctagtaaggctcagaaa

SEQ ID NO: 508524 - DNA, 20 bp, Artificial Sequence
  chemically synthesized
taattagattaccaatatcc

SEQ ID NO: 508525 - DNA, 20 bp, Artificial Sequence
  chemically synthesized
gtacttgcaaataaggattc

SEQ ID NO: 508526 - DNA, 20 bp, Artificial Sequence
  chemically synthesized
atggataagtacttgcaaat

SEQ ID NO: 508527 - DNA, 20 bp, Artificial Sequence
  chemically synthesized
ggaggacaaaataaattggt

SEQ ID NO: 508528 - DNA, 20 bp, Artificial Sequence
  chemically synthesized
tttgtcctccaatgtctatg

SEQ ID NO: 508529 - DNA, 20 bp, Artificial Sequence
  chemically synthesized
tattgctagattgctaaact

SEQ ID NO: 508530 - DNA, 20 bp, Artificial Sequence
  chemically synthesized
actaactaataaaggcataa

SEQ ID NO: 508531 - DNA, 20 bp, Artificial Sequence
  chemically synthesized
ggctctcaggcccaattccc

SEQ ID NO: 508532 - DNA, 20 bp, Artificial Sequence
  chemically synthesized
gccagtaactgtgaattcta

SEQ ID NO: 508533 - DNA, 20 bp, Artificial Sequence
  chemically synthesized
ttgcatatatgccagtaact

SEQ ID NO: 508534 - DNA, 20 bp, Artificial Sequence
  chemically synthesized
taggtgtatttttttaaatt

SEQ ID NO: 508535 - DNA, 20 bp, Artificial Sequence
  chemically synthesized
aaaattgtactgatgaaaat

SEQ ID NO: 508536 - DNA, 20 bp, Artificial Sequence
  chemically synthesized
gcccagcctgagccatcatt

SEQ ID NO: 508537 - DNA, 20 bp, Artificial Sequence
  chemically synthesized
acctcggcctcccaaaatgc

SEQ ID NO: 508538 - DNA, 20 bp, Artificial Sequence
  chemically synthesized
attttgggaggccgaggtgg

SEQ ID NO: 508539 - DNA, 20 bp, Artificial Sequence
  chemically synthesized
tggctggatcacctgaggtc

SEQ ID NO: 508540 - DNA, 20 bp, Artificial Sequence
  chemically synthesized
ttttgtatttttagtagaga

SEQ ID NO: 508541 - DNA, 20 bp, Artificial Sequence
  chemically synthesized
gcctcagcctcctgagtagc

SEQ ID NO: 508542 - DNA, 20 bp, Artificial Sequence
  chemically synthesized
gattctcctgcctcagcctc

SEQ ID NO: 508543 - DNA, 20 bp, Artificial Sequence
  chemically synthesized
tactcaggaggctgaggcag

SEQ ID NO: 508544 - DNA, 20 bp, Artificial Sequence
  chemically synthesized
tcactgcaacctctgtcccc

SEQ ID NO: 508545 - DNA, 20 bp, Artificial Sequence
  chemically synthesized
tcacaccacttcactccagc

SEQ ID NO: 508546 - DNA, 20 bp, Artificial Sequence
  chemically synthesized
ttttgttctttcacccaggc

SEQ ID NO: 508547 - DNA, 20 bp, Artificial Sequence
  chemically synthesized
ttttatctatttttttaaga

SEQ ID NO: 508548 - DNA, 20 bp, Artificial Sequence
  chemically synthesized
atctataagaaccaccttgc

SEQ ID NO: 508549 - DNA, 20 bp, Artificial Sequence
  chemically synthesized
gaagcatctagttgcatata

SEQ ID NO: 508550 - DNA, 20 bp, Artificial Sequence
  chemically synthesized
tatatgcaactagatgcttc

SEQ ID NO: 508551 - DNA, 20 bp, Artificial Sequence
  chemically synthesized
ccccaatacctttcttaata

SEQ ID NO: 508552 - DNA, 20 bp, Artificial Sequence
  chemically synthesized
aaggtattgggggctgggga

SEQ ID NO: 508553 - DNA, 20 bp, Artificial Sequence
  chemically synthesized
tacctaatgtaaatgagctg

SEQ ID NO: 508554 - DNA, 20 bp, Artificial Sequence
  chemically synthesized
tatacctatgtatcaaacct

SEQ ID NO: 508555 - DNA, 20 bp, Artificial Sequence
  chemically synthesized
tattattatactttaatttc

SEQ ID NO: 508556 - DNA, 20 bp, Artificial Sequence
  chemically synthesized
tttctgttttttaacctatc

SEQ ID NO: 508557 - DNA, 20 bp, Artificial Sequence
  chemically synthesized
attcacctatctgtgatagt

SEQ ID NO: 508558 - DNA, 20 bp, Artificial Sequence
  chemically synthesized
attcaaactatcacagatag

SEQ ID NO: 508559 - DNA, 20 bp, Artificial Sequence
  chemically synthesized
atcacagataggtgaattag

SEQ ID NO: 508560 - DNA, 20 bp, Artificial Sequence
  chemically synthesized
ataaaaaggtactaattgat

SEQ ID NO: 508561 - DNA, 20 bp, Artificial Sequence
  chemically synthesized
atattctgattgaattgttg

SEQ ID NO: 508562 - DNA, 20 bp, Artificial Sequence
  chemically synthesized
ccattccccaacaattcaat

SEQ ID NO: 508563 - DNA, 20 bp, Artificial Sequence
  chemically synthesized
tccattcccagatattctga

SEQ ID NO: 508564 - DNA, 20 bp, Artificial Sequence
  chemically synthesized
acaattcaatcagaatatct

SEQ ID NO: 508565 - DNA, 20 bp, Artificial Sequence
  chemically synthesized
tgttcattcgaattacctgg

SEQ ID NO: 508566 - DNA, 20 bp, Artificial Sequence
  chemically synthesized
aaactatccaaccaggtaat

SEQ ID NO: 508567 - DNA, 20 bp, Artificial Sequence
  chemically synthesized
tctcaaccctggatgttcat

SEQ ID NO: 508568 - DNA, 20 bp, Artificial Sequence
  chemically synthesized
aggtaattcgaatgaacatc

SEQ ID NO: 508569 - DNA, 20 bp, Artificial Sequence
  chemically synthesized
aggcacaatcgttctcaacc

SEQ ID NO: 508570 - DNA, 20 bp, Artificial Sequence
  chemically synthesized
cataatttttactttagccc

SEQ ID NO: 508571 - DNA, 20 bp, Artificial Sequence
  chemically synthesized
accctaacaagtcatgttgt

SEQ ID NO: 508572 - DNA, 20 bp, Artificial Sequence
  chemically synthesized
atccagacaacatgacttgt

SEQ ID NO: 508573 - DNA, 20 bp, Artificial Sequence
  chemically synthesized
acagaggtaacatggagaca

SEQ ID NO: 508574 - DNA, 20 bp, Artificial Sequence
  chemically synthesized
gtaacatggagacaaaggat

SEQ ID NO: 508575 - DNA, 20 bp, Artificial Sequence
  chemically synthesized
cttttttatttgtaatttct

SEQ ID NO: 508576 - DNA, 20 bp, Artificial Sequence
  chemically synthesized
ataaaaaagaagacttacta

SEQ ID NO: 508577 - DNA, 20 bp, Artificial Sequence
  chemically synthesized
aaagagtaattttgatcttg

SEQ ID NO: 508578 - DNA, 20 bp, Artificial Sequence
  chemically synthesized
aatatcagttgctgaatcaa

SEQ ID NO: 508579 - DNA, 20 bp, Artificial Sequence
  chemically synthesized
attggggctaatatcagttg

SEQ ID NO: 508580 - DNA, 20 bp, Artificial Sequence
  chemically synthesized
gtggggaaacaaaggcttac

SEQ ID NO: 508581 - DNA, 20 bp, Artificial Sequence
  chemically synthesized
aggccccggagccaaactac

SEQ ID NO: 508582 - DNA, 20 bp, Artificial Sequence
  chemically synthesized
gaaaacagaagttcatttgg

SEQ ID NO: 508583 - DNA, 20 bp, Artificial Sequence
  chemically synthesized
atgctaagaacaattgtctc

SEQ ID NO: 508584 - DNA, 20 bp, Artificial Sequence
  chemically synthesized
aaaaataaaaatttaaaaaa

SEQ ID NO: 508585 - DNA, 20 bp, Artificial Sequence
  chemically synthesized
ttttttaaatttttattttt

SEQ ID NO: 508586 - DNA, 20 bp, Artificial Sequence
  chemically synthesized
atagtatgtgtttatattta

SEQ ID NO: 508587 - DNA, 20 bp, Artificial Sequence
  chemically synthesized
tattatgcctgtatgcctgt

SEQ ID NO: 508588 - DNA, 20 bp, Artificial Sequence
  chemically synthesized
atacaggcataatatgacat

SEQ ID NO: 508589 - DNA, 20 bp, Artificial Sequence
  chemically synthesized
taatatgacattagggttaa

SEQ ID NO: 508590 - DNA, 20 bp, Artificial Sequence
  chemically synthesized
aatgataagtgctcgaggtg

SEQ ID NO: 508591 - DNA, 20 bp, Artificial Sequence
  chemically synthesized
aaaataacaaaaagtataat

SEQ ID NO: 508592 - DNA, 20 bp, Artificial Sequence
  chemically synthesized
tgtagtatttgatagcacga

SEQ ID NO: 508593 - DNA, 20 bp, Artificial Sequence
  chemically synthesized
caaaaatatagttagattga

SEQ ID NO: 508594 - DNA, 20 bp, Artificial Sequence
  chemically synthesized
ggtacaaaaatatagttaga

SEQ ID NO: 508595 - DNA, 20 bp, Artificial Sequence
  chemically synthesized
gggggcagtggggatcatta

SEQ ID NO: 508596 - DNA, 20 bp, Artificial Sequence
  chemically synthesized
gctagtgggtcgggggcagt

SEQ ID NO: 508597 - DNA, 20 bp, Artificial Sequence
  chemically synthesized
accagaggatgggaatgcta

SEQ ID NO: 508598 - DNA, 20 bp, Artificial Sequence
  chemically synthesized
aatgatggttaccagaggat

SEQ ID NO: 508599 - DNA, 20 bp, Artificial Sequence
  chemically synthesized
gactagaatgatggttacca

SEQ ID NO: 508600 - DNA, 20 bp, Artificial Sequence
  chemically synthesized
gaactcatggagatagagac

SEQ ID NO: 508601 - DNA, 20 bp, Artificial Sequence
  chemically synthesized
tcattctagtctctatctcc

SEQ ID NO: 508602 - DNA, 20 bp, Artificial Sequence
  chemically synthesized
atccagtcacttacaacaac

SEQ ID NO: 508603 - DNA, 20 bp, Artificial Sequence
  chemically synthesized
atccatgttgttgtaagtga

SEQ ID NO: 508604 - DNA, 20 bp, Artificial Sequence
  chemically synthesized
agtcttaagcttgactaaga

SEQ ID NO: 508605 - DNA, 20 bp, Artificial Sequence
  chemically synthesized
caaaaagaaggtttttttga

SEQ ID NO: 508606 - DNA, 20 bp, Artificial Sequence
  chemically synthesized
tttattttctcatactaatt

SEQ ID NO: 508607 - DNA, 20 bp, Artificial Sequence
  chemically synthesized
gcagaagaactttcaaataa

SEQ ID NO: 508608 - DNA, 20 bp, Artificial Sequence
  chemically synthesized
aaactatagaatttcttgaa

SEQ ID NO: 508609 - DNA, 20 bp, Artificial Sequence
  chemically synthesized
agaagttaagaaggaaacta

SEQ ID NO: 508610 - DNA, 20 bp, Artificial Sequence
  chemically synthesized
aatatgctcttgaattatca

SEQ ID NO: 508611 - DNA, 20 bp, Artificial Sequence
  chemically synthesized
ggaaattaaacaatatgctc

SEQ ID NO: 508612 - DNA, 20 bp, Artificial Sequence
  chemically synthesized
tatatcaagatatcagtagg

SEQ ID NO: 508613 - DNA, 20 bp, Artificial Sequence
  chemically synthesized
attagcttttctgatcacaa

SEQ ID NO: 508614 - DNA, 20 bp, Artificial Sequence
  chemically synthesized
aatttatgttattttgattt

SEQ ID NO: 508615 - DNA, 20 bp, Artificial Sequence
  chemically synthesized
catattcttcttctcagcac

SEQ ID NO: 508616 - DNA, 20 bp, Artificial Sequence
  chemically synthesized
attatccatgtgctgagaag

SEQ ID NO: 508617 - DNA, 20 bp, Artificial Sequence
  chemically synthesized
gaatatgtactctgcagctg

SEQ ID NO: 508618 - DNA, 20 bp, Artificial Sequence
  chemically synthesized
aacattttatccaacagctg

SEQ ID NO: 508619 - DNA, 20 bp, Artificial Sequence
  chemically synthesized
tttctttgttgattttatgt

SEQ ID NO: 508620 - DNA, 20 bp, Artificial Sequence
  chemically synthesized
tctggccactgctgaaaatg

SEQ ID NO: 508621 - DNA, 20 bp, Artificial Sequence
  chemically synthesized
atcaccggctattactgttt

SEQ ID NO: 508622 - DNA, 20 bp, Artificial Sequence
  chemically synthesized
acgtataaatcaaatattat

SEQ ID NO: 508623 - DNA, 20 bp, Artificial Sequence
  chemically synthesized
ataatatttgatttatacgt

SEQ ID NO: 508624 - DNA, 20 bp, Artificial Sequence
  chemically synthesized
tacgtctgggtgttccaatg

SEQ ID NO: 508625 - DNA, 20 bp, Artificial Sequence
  chemically synthesized
acaattgttatgtcctcttg

SEQ ID NO: 508626 - DNA, 20 bp, Artificial Sequence
  chemically synthesized
cggtcattgtagaatgataa

SEQ ID NO: 508627 - DNA, 20 bp, Artificial Sequence
  chemically synthesized
agggacaacgccggtcattg

SEQ ID NO: 508628 - DNA, 20 bp, Artificial Sequence
  chemically synthesized
aaacctattttgtctgataa

SEQ ID NO: 508629 - DNA, 20 bp, Artificial Sequence
  chemically synthesized
caatcgaaaccaaaaaagaa

SEQ ID NO: 508630 - DNA, 20 bp, Artificial Sequence
  chemically synthesized
ttttttggtttcgattggca

SEQ ID NO: 508631 - DNA, 20 bp, Artificial Sequence
  chemically synthesized
taaagatagactgaaaataa

SEQ ID NO: 508632 - DNA, 20 bp, Artificial Sequence
  chemically synthesized
ttgagtgacagaatggataa

SEQ ID NO: 508633 - DNA, 20 bp, Artificial Sequence
  chemically synthesized
taaatacattgagtgacaga

SEQ ID NO: 508634 - DNA, 20 bp, Artificial Sequence
  chemically synthesized
aatctaaatacattgagtga

SEQ ID NO: 508635 - DNA, 20 bp, Artificial Sequence
  chemically synthesized
aactatccaatctaaataca

SEQ ID NO: 508636 - DNA, 20 bp, Artificial Sequence
  chemically synthesized
tgtcactcaatgtatttaga

SEQ ID NO: 508637 - DNA, 20 bp, Artificial Sequence
  chemically synthesized
ttaacgtaccaatgataaca

SEQ ID NO: 508638 - DNA, 20 bp, Artificial Sequence
  chemically synthesized
agtaagacaggaaggaaaga

SEQ ID NO: 508639 - DNA, 20 bp, Artificial Sequence
  chemically synthesized
tcaggtacataaaaattaat

SEQ ID NO: 508640 - DNA, 20 bp, Artificial Sequence
  chemically synthesized
tcttattaatttttatgtac

SEQ ID NO: 508641 - DNA, 20 bp, Artificial Sequence
  chemically synthesized
tggtaactatgaggtttgta

SEQ ID NO: 508642 - DNA, 20 bp, Artificial Sequence
  chemically synthesized
gttgtcatgaatttcaaata

SEQ ID NO: 508643 - DNA, 20 bp, Artificial Sequence
  chemically synthesized
tttatgcaaccagtgttgtc

SEQ ID NO: 508644 - DNA, 20 bp, Artificial Sequence
  chemically synthesized
agaaacaacaaaaagagtgg

SEQ ID NO: 508645 - DNA, 20 bp, Artificial Sequence
  chemically synthesized
atataaatagaaacaacaaa

SEQ ID NO: 508646 - DNA, 20 bp, Artificial Sequence
  chemically synthesized
ttagtctttttactcaagat

SEQ ID NO: 508647 - DNA, 20 bp, Artificial Sequence
  chemically synthesized
atgtctcaactacccatatc

SEQ ID NO: 508648 - DNA, 20 bp, Artificial Sequence
  chemically synthesized
ttataatattctctttgtaa

SEQ ID NO: 508649 - DNA, 20 bp, Artificial Sequence
  chemically synthesized
tgttactattctgttacaaa

SEQ ID NO: 508650 - DNA, 20 bp, Artificial Sequence
  chemically synthesized
aacaaaccttactatcacca

SEQ ID NO: 508651 - DNA, 20 bp, Artificial Sequence
  chemically synthesized
gaaaaggatgttaatgagca

SEQ ID NO: 508652 - DNA, 20 bp, Artificial Sequence
  chemically synthesized
cgttcttcaatcttaaagaa

SEQ ID NO: 508653 - DNA, 20 bp, Artificial Sequence
  chemically synthesized
atttctccttcaagtatgaa

SEQ ID NO: 508654 - DNA, 20 bp, Artificial Sequence
  chemically synthesized
ttttcatagatatactattc

SEQ ID NO: 508655 - DNA, 20 bp, Artificial Sequence
  chemically synthesized
gaaggaaaagacttttattc

SEQ ID NO: 508656 - DNA, 20 bp, Artificial Sequence
  chemically synthesized
gtggaaaacttccaggccag

SEQ ID NO: 508657 - DNA, 20 bp, Artificial Sequence
  chemically synthesized
aaatcaaacttccaaaggtc

SEQ ID NO: 508658 - DNA, 20 bp, Artificial Sequence
  chemically synthesized
gttctattatcttcttgtac

SEQ ID NO: 508659 - DNA, 20 bp, Artificial Sequence
  chemically synthesized
gtcctaaaaagtttattgaa

SEQ ID NO: 508660 - DNA, 20 bp, Artificial Sequence
  chemically synthesized
agaattgatcaagcaggaga

SEQ ID NO: 508661 - DNA, 20 bp, Artificial Sequence
  chemically synthesized
gcgtcagagacgagtaacag

SEQ ID NO: 508662 - DNA, 20 bp, Artificial Sequence
  chemically synthesized
tactgaagaatgcgtcagag

SEQ ID NO: 508663 - DNA, 20 bp, Artificial Sequence
  chemically synthesized
aagatttaactgacatactg

SEQ ID NO: 508664 - DNA, 20 bp, Artificial Sequence
  chemically synthesized
tcagttaaatctttcaactc

SEQ ID NO: 508665 - DNA, 20 bp, Artificial Sequence
  chemically synthesized
aaagaatcgaacaaaaattc

SEQ ID NO: 508666 - DNA, 20 bp, Artificial Sequence
  chemically synthesized
aacaaagggattgaaataaa

SEQ ID NO: 508667 - DNA, 20 bp, Artificial Sequence
  chemically synthesized
cctacacataaatttaacaa

SEQ ID NO: 508668 - DNA, 20 bp, Artificial Sequence
  chemically synthesized
ccctttgttaaatttatgtg

SEQ ID NO: 508669 - DNA, 20 bp, Artificial Sequence
  chemically synthesized
ttaaatttatgtgtaggatt

SEQ ID NO: 508670 - DNA, 20 bp, Artificial Sequence
  chemically synthesized
gatagtacagagaaggaatt

SEQ ID NO: 508671 - DNA, 20 bp, Artificial Sequence
  chemically synthesized
aatccaagatagtacagaga

SEQ ID NO: 508672 - DNA, 20 bp, Artificial Sequence
  chemically synthesized
aattccttctctgtactatc

SEQ ID NO: 508673 - DNA, 20 bp, Artificial Sequence
  chemically synthesized
gaattccaaatggctgattt

SEQ ID NO: 508674 - DNA, 20 bp, Artificial Sequence
  chemically synthesized
gcatcctcaaatcagccatt

SEQ ID NO: 508675 - DNA, 20 bp, Artificial Sequence
  chemically synthesized
gatatgtgacctttcagaca

SEQ ID NO: 508676 - DNA, 20 bp, Artificial Sequence
  chemically synthesized
gttggtgagatcatgttttc

SEQ ID NO: 508677 - DNA, 20 bp, Artificial Sequence
  chemically synthesized
cttggatggtcttgatgctt

SEQ ID NO: 508678 - DNA, 20 bp, Artificial Sequence
  chemically synthesized
ggaaagccctcctgagaagt

SEQ ID NO: 508679 - DNA, 20 bp, Artificial Sequence
  chemically synthesized
ttccaggtatttaaaggttc

SEQ ID NO: 508680 - DNA, 20 bp, Artificial Sequence
  chemically synthesized
tatatggctgcagtgaccaa

SEQ ID NO: 508681 - DNA, 20 bp, Artificial Sequence
  chemically synthesized
cactgcagccatatatgcac

SEQ ID NO: 508682 - DNA, 20 bp, Artificial Sequence
  chemically synthesized
gagtcacagcattactgggc

SEQ ID NO: 508683 - DNA, 20 bp, Artificial Sequence
  chemically synthesized
cagtacgtttaacagtctgc

SEQ ID NO: 508684 - DNA, 20 bp, Artificial Sequence
  chemically synthesized
aggtaatacaggggattttc

SEQ ID NO: 508685 - DNA, 20 bp, Artificial Sequence
  chemically synthesized
attatctaccaggtaataca

SEQ ID NO: 508686 - DNA, 20 bp, Artificial Sequence
  chemically synthesized
ctttccttcccctcaacaaa

SEQ ID NO: 508687 - DNA, 20 bp, Artificial Sequence
  chemically synthesized
atcctagtcgtggtagctac

SEQ ID NO: 508688 - DNA, 20 bp, Artificial Sequence
  chemically synthesized
acccctgtagctaccacgac

SEQ ID NO: 508689 - DNA, 20 bp, Artificial Sequence
  chemically synthesized
ctaccacgactaggattgtg

SEQ ID NO: 508690 - DNA, 20 bp, Artificial Sequence
  chemically synthesized
cccagtgttgtactggcttt

SEQ ID NO: 508691 - DNA, 20 bp, Artificial Sequence
  chemically synthesized
ctcctaaagccagtacaaca

SEQ ID NO: 508692 - DNA, 20 bp, Artificial Sequence
  chemically synthesized
gtagagtccttgggccctga

SEQ ID NO: 508693 - DNA, 20 bp, Artificial Sequence
  chemically synthesized
gattgtagagtccttgggcc

SEQ ID NO: 508694 - DNA, 20 bp, Artificial Sequence
  chemically synthesized
gatttgccacctgccgattg

SEQ ID NO: 508695 - DNA, 20 bp, Artificial Sequence
  chemically synthesized
agtgaaaaacacaagcttca

SEQ ID NO: 508696 - DNA, 20 bp, Artificial Sequence
  chemically synthesized
gaagcttgtgtttttcactt

SEQ ID NO: 508697 - DNA, 20 bp, Artificial Sequence
  chemically synthesized
agggtagcaatttttccctg

SEQ ID NO: 508698 - DNA, 20 bp, Artificial Sequence
  chemically synthesized
cccaggccctggcttacata

SEQ ID NO: 508699 - DNA, 20 bp, Artificial Sequence
  chemically synthesized
cctatatgtaagccagggcc

SEQ ID NO: 508700 - DNA, 20 bp, Artificial Sequence
  chemically synthesized
atatttctttatagcattgt

SEQ ID NO: 508701 - DNA, 20 bp, Artificial Sequence
  chemically synthesized
ctataaagaaatatctgata

SEQ ID NO: 508702 - DNA, 20 bp, Artificial Sequence
  chemically synthesized
gtcacacggccagggaagag

SEQ ID NO: 508703 - DNA, 20 bp, Artificial Sequence
  chemically synthesized
gccagggaagaggtgagtgg

SEQ ID NO: 508704 - DNA, 20 bp, Artificial Sequence
  chemically synthesized
taccacacacttttaaccaa

SEQ ID NO: 508705 - DNA, 20 bp, Artificial Sequence
  chemically synthesized
tttaaccaactggatctgac

SEQ ID NO: 508706 - DNA, 20 bp, Artificial Sequence
  chemically synthesized
tgctgttttcatgatagtgg

SEQ ID NO: 508707 - DNA, 20 bp, Artificial Sequence
  chemically synthesized
ttagtgctgttttcatgata

SEQ ID NO: 508708 - DNA, 20 bp, Artificial Sequence
  chemically synthesized
tatcatgaaaacagcactaa

SEQ ID NO: 508709 - DNA, 20 bp, Artificial Sequence
  chemically synthesized
atcatggcgttgaatttctc

SEQ ID NO: 508710 - DNA, 20 bp, Artificial Sequence
  chemically synthesized
gagccgaatgaatcatggcg

SEQ ID NO: 508711 - DNA, 20 bp, Artificial Sequence
  chemically synthesized
ggggcctgggtgggagccga

SEQ ID NO: 508712 - DNA, 20 bp, Artificial Sequence
  chemically synthesized
aggtggggcctgggtgggag

SEQ ID NO: 508713 - DNA, 20 bp, Artificial Sequence
  chemically synthesized
ctcactgtcagaggtggggc

SEQ ID NO: 508714 - DNA, 20 bp, Artificial Sequence
  chemically synthesized
caggccccacctctgacagt

SEQ ID NO: 508715 - DNA, 20 bp, Artificial Sequence
  chemically synthesized
gttcttgcccagatctcaca

SEQ ID NO: 508716 - DNA, 20 bp, Artificial Sequence
  chemically synthesized
ccaggatggaatagtatggt

SEQ ID NO: 508717 - DNA, 20 bp, Artificial Sequence
  chemically synthesized
agatttgggaggggccagga

SEQ ID NO: 508718 - DNA, 20 bp, Artificial Sequence
  chemically synthesized
acttgagatttgggaggggc

SEQ ID NO: 508719 - DNA, 20 bp, Artificial Sequence
  chemically synthesized
cccaaggtctttacttattc

SEQ ID NO: 508720 - DNA, 20 bp, Artificial Sequence
  chemically synthesized
ccggacttttgagttaattc

SEQ ID NO: 508721 - DNA, 20 bp, Artificial Sequence
  chemically synthesized
ccagaattaactcaaaagtc

SEQ ID NO: 508722 - DNA, 20 bp, Artificial Sequence
  chemically synthesized
tcagatgagactccggactt

SEQ ID NO: 508723 - DNA, 20 bp, Artificial Sequence
  chemically synthesized
tagttacttccaagatacaa

SEQ ID NO: 508724 - DNA, 20 bp, Artificial Sequence
  chemically synthesized
atacaatgggattataagca

SEQ ID NO: 508725 - DNA, 20 bp, Artificial Sequence
  chemically synthesized
agtcaacactcctattccaa

SEQ ID NO: 508726 - DNA, 20 bp, Artificial Sequence
  chemically synthesized
caatttcacccttttggaat

SEQ ID NO: 508727 - DNA, 20 bp, Artificial Sequence
  chemically synthesized
tttgaccaatttcacccttt

SEQ ID NO: 508728 - DNA, 20 bp, Artificial Sequence
  chemically synthesized
catgcaagtctgaaacccag

SEQ ID NO: 508729 - DNA, 20 bp, Artificial Sequence
  chemically synthesized
aagatttaatgactaccctg

SEQ ID NO: 508730 - DNA, 20 bp, Artificial Sequence
  chemically synthesized
ggagtcaaagcagataattt

SEQ ID NO: 508731 - DNA, 20 bp, Artificial Sequence
  chemically synthesized
tttaccctggatgtaggaca

SEQ ID NO: 508732 - DNA, 20 bp, Artificial Sequence
  chemically synthesized
ttgactccatgtcctacatc

SEQ ID NO: 508733 - DNA, 20 bp, Artificial Sequence
  chemically synthesized
accactcccaccagtttacc

SEQ ID NO: 508734 - DNA, 20 bp, Artificial Sequence
  chemically synthesized
tacatccagggtaaactggt

SEQ ID NO: 508735 - DNA, 20 bp, Artificial Sequence
  chemically synthesized
accctagaaagccacaaagt

SEQ ID NO: 508736 - DNA, 20 bp, Artificial Sequence
  chemically synthesized
actccaactttgtggctttc

SEQ ID NO: 508737 - DNA, 20 bp, Artificial Sequence
  chemically synthesized
gctgctcttatggtctggtg

SEQ ID NO: 508738 - DNA, 20 bp, Artificial Sequence
  chemically synthesized
tgtgtttcatttccagatac

SEQ ID NO: 508739 - DNA, 20 bp, Artificial Sequence
  chemically synthesized
atacaagggtcaagctgtca

SEQ ID NO: 508740 - DNA, 20 bp, Artificial Sequence
  chemically synthesized
tgtcagtggatctaccattc

SEQ ID NO: 508741 - DNA, 20 bp, Artificial Sequence
  chemically synthesized
ggccactgtcctccagactc

SEQ ID NO: 508742 - DNA, 20 bp, Artificial Sequence
  chemically synthesized
cccagtggggactacgtgtg

SEQ ID NO: 508743 - DNA, 20 bp, Artificial Sequence
  chemically synthesized
ccccaggagaagttctctgt

SEQ ID NO: 508744 - DNA, 20 bp, Artificial Sequence
  chemically synthesized
tagaggttgtatggaaaagc

SEQ ID NO: 508745 - DNA, 20 bp, Artificial Sequence
  chemically synthesized
atacaacctctaaaatctag

SEQ ID NO: 508746 - DNA, 20 bp, Artificial Sequence
  chemically synthesized
cctgcaggtgcacagagtgc

SEQ ID NO: 508747 - DNA, 20 bp, Artificial Sequence
  chemically synthesized
gccataagcctgcaggtgca

SEQ ID NO: 508748 - DNA, 20 bp, Artificial Sequence
  chemically synthesized
cagcttgggccacagctcca

SEQ ID NO: 508749 - DNA, 20 bp, Artificial Sequence
  chemically synthesized
ctgtagctccagctgtggct

SEQ ID NO: 508750 - DNA, 20 bp, Artificial Sequence
  chemically synthesized
gagctacagtggccaggacg

SEQ ID NO: 508751 - DNA, 20 bp, Artificial Sequence
  chemically synthesized
ggacgctgggtgcggggggg

SEQ ID NO: 508752 - DNA, 20 bp, Artificial Sequence
  chemically synthesized
atggtttcctgggccaggcc

SEQ ID NO: 508753 - DNA, 20 bp, Artificial Sequence
  chemically synthesized
gatccggaggcctaagagga

SEQ ID NO: 508754 - DNA, 20 bp, Artificial Sequence
  chemically synthesized
cattctgtcctcttaggcct

SEQ ID NO: 508755 - DNA, 20 bp, Artificial Sequence
  chemically synthesized
gtggttgctcagaagccttc

SEQ ID NO: 508756 - DNA, 20 bp, Artificial Sequence
  chemically synthesized
aggttttcaaaatttgcaac

SEQ ID NO: 508757 - DNA, 20 bp, Artificial Sequence
  chemically synthesized
gcaggagcaaagaaataaga

SEQ ID NO: 508758 - DNA, 20 bp, Artificial Sequence
  chemically synthesized
atttctttgctcctgcatca

SEQ ID NO: 508759 - DNA, 20 bp, Artificial Sequence
  chemically synthesized
gatctcgtgtgtctgacgga

SEQ ID NO: 508760 - DNA, 20 bp, Artificial Sequence
  chemically synthesized
tgatgatctcgtgtgtctga

SEQ ID NO: 508761 - DNA, 20 bp, Artificial Sequence
  chemically synthesized
atctgtgaaagtttgaactt

SEQ ID NO: 508762 - DNA, 20 bp, Artificial Sequence
  chemically synthesized
tacagccaacttctttgcta

SEQ ID NO: 508763 - DNA, 20 bp, Artificial Sequence
  chemically synthesized
agaatgaacttattggcaac

SEQ ID NO: 508764 - DNA, 20 bp, Artificial Sequence
  chemically synthesized
ctgtcgaggtctcagatgga

SEQ ID NO: 508765 - DNA, 20 bp, Artificial Sequence
  chemically synthesized
aagacagatgagggaaaatt

SEQ ID NO: 508766 - DNA, 20 bp, Artificial Sequence
  chemically synthesized
gggtaacagacagaagttgg

SEQ ID NO: 508767 - DNA, 20 bp, Artificial Sequence
  chemically synthesized
aattgggtaacagacagaag

SEQ ID NO: 508768 - DNA, 20 bp, Artificial Sequence
  chemically synthesized
atgtagaagctgctttgaaa

SEQ ID NO: 508769 - DNA, 20 bp, Artificial Sequence
  chemically synthesized
gtatttcttgatagcaatgc

SEQ ID NO: 508770 - DNA, 20 bp, Artificial Sequence
  chemically synthesized
ctatcaagaaatacctgaga

SEQ ID NO: 508771 - DNA, 20 bp, Artificial Sequence
  chemically synthesized
cacatggccacagcaggagc

SEQ ID NO: 508772 - DNA, 20 bp, Artificial Sequence
  chemically synthesized
gcaggagcaagagtgagagg

SEQ ID NO: 508773 - DNA, 20 bp, Artificial Sequence
  chemically synthesized
tttaaacaaccagatcttgc

SEQ ID NO: 508774 - DNA, 20 bp, Artificial Sequence
  chemically synthesized
ttgctactgtccttgcaata

SEQ ID NO: 508775 - DNA, 20 bp, Artificial Sequence
  chemically synthesized
tagggcctagtgggagctca

SEQ ID NO: 508776 - DNA, 20 bp, Artificial Sequence
  chemically synthesized
gtgcctgctcaaatctcacg

SEQ ID NO: 508777 - DNA, 20 bp, Artificial Sequence
  chemically synthesized
caggtagatttcttaggttc

SEQ ID NO: 508778 - DNA, 20 bp, Artificial Sequence
  chemically synthesized
gggtgccagcttagccacag

SEQ ID NO: 508779 - DNA, 20 bp, Artificial Sequence
  chemically synthesized
gaaggactttatcttttggg

SEQ ID NO: 508780 - DNA, 20 bp, Artificial Sequence
  chemically synthesized
agagggaaggactttatctt

SEQ ID NO: 508781 - DNA, 20 bp, Artificial Sequence
  chemically synthesized
acgacgactactgaaccaaa

SEQ ID NO: 508782 - DNA, 20 bp, Artificial Sequence
  chemically synthesized
ggccaaagtggccttggccc

SEQ ID NO: 508783 - DNA, 20 bp, Artificial Sequence
  chemically synthesized
gccactttggccagcctgtg

SEQ ID NO: 508784 - DNA, 20 bp, Artificial Sequence
  chemically synthesized
tgtggtgaatgctgtcagtc

SEQ ID NO: 508785 - DNA, 20 bp, Artificial Sequence
  chemically synthesized
ccttcagggcagtaagaaaa

SEQ ID NO: 508786 - DNA, 20 bp, Artificial Sequence
  chemically synthesized
ctgattccagagtttggctc

SEQ ID NO: 508787 - DNA, 20 bp, Artificial Sequence
  chemically synthesized
ggaatccaggagccaaactc

SEQ ID NO: 508788 - DNA, 20 bp, Artificial Sequence
  chemically synthesized
gctcctagggtccctgattc

SEQ ID NO: 508789 - DNA, 20 bp, Artificial Sequence
  chemically synthesized
cagagcatcaagtgggctcc

SEQ ID NO: 508790 - DNA, 20 bp, Artificial Sequence
  chemically synthesized
aggggactttggcttgcagc

SEQ ID NO: 508791 - DNA, 20 bp, Artificial Sequence
  chemically synthesized
tgcttcaggaaaggagaggt

SEQ ID NO: 508792 - DNA, 20 bp, Artificial Sequence
  chemically synthesized
cctctcctttcctgaagcag

SEQ ID NO: 508793 - DNA, 20 bp, Artificial Sequence
  chemically synthesized
agctgtggtggctacaggga

SEQ ID NO: 508794 - DNA, 20 bp, Artificial Sequence
  chemically synthesized
tccctgtagccaccacagct

SEQ ID NO: 508795 - DNA, 20 bp, Artificial Sequence
  chemically synthesized
ccaccacagctgggaatgta

SEQ ID NO: 508796 - DNA, 20 bp, Artificial Sequence
  chemically synthesized
cacctgaaaccatcacagct

SEQ ID NO: 508797 - DNA, 20 bp, Artificial Sequence
  chemically synthesized
ggcagtacttgctgtgggta

SEQ ID NO: 508798 - DNA, 20 bp, Artificial Sequence
  chemically synthesized
gtagccaggcagtacttgct

SEQ ID NO: 508799 - DNA, 20 bp, Artificial Sequence
  chemically synthesized
gaccaaagggacctagggcc

SEQ ID NO: 508800 - DNA, 20 bp, Artificial Sequence
  chemically synthesized
gtccctttggtcagcatgtc

SEQ ID NO: 508801 - DNA, 20 bp, Artificial Sequence
  chemically synthesized
tgtcatgaattctgccagga

SEQ ID NO: 508802 - DNA, 20 bp, Artificial Sequence
  chemically synthesized
agagaaggaccccgtcctgg

SEQ ID NO: 508803 - DNA, 20 bp, Artificial Sequence
  chemically synthesized
tgacaggctctcttctggcc

SEQ ID NO: 508804 - DNA, 20 bp, Artificial Sequence
  chemically synthesized
gttatctgtgagctagggcc

SEQ ID NO: 508805 - DNA, 20 bp, Artificial Sequence
  chemically synthesized
caataggatagggcaccagg

SEQ ID NO: 508806 - DNA, 20 bp, Artificial Sequence
  chemically synthesized
ataccagctcagacatacaa

SEQ ID NO: 508807 - DNA, 20 bp, Artificial Sequence
  chemically synthesized
agagaactttgtcttgctgc

SEQ ID NO: 508808 - DNA, 20 bp, Artificial Sequence
  chemically synthesized
cttcttcataagcggaagga

SEQ ID NO: 508809 - DNA, 20 bp, Artificial Sequence
  chemically synthesized
gagctgtgagctgtgctgcc

SEQ ID NO: 508810 - DNA, 20 bp, Artificial Sequence
  chemically synthesized
gcagtcccttagctgcccca

SEQ ID NO: 508811 - DNA, 20 bp, Artificial Sequence
  chemically synthesized
gggctcagagtcagtggact

SEQ ID NO: 508812 - DNA, 20 bp, Artificial Sequence
  chemically synthesized
tcctggtgctgtgccgggct

SEQ ID NO: 508813 - DNA, 20 bp, Artificial Sequence
  chemically synthesized
caagccttgtcatcatggat

SEQ ID NO: 508814 - DNA, 20 bp, Artificial Sequence
  chemically synthesized
ttccggcaagccttgtcatc

SEQ ID NO: 508815 - DNA, 20 bp, Artificial Sequence
  chemically synthesized
tccatcccagtgtttggaac

SEQ ID NO: 508816 - DNA, 20 bp, Artificial Sequence
  chemically synthesized
ggaactcaggttccaaacac

SEQ ID NO: 508817 - DNA, 20 bp, Artificial Sequence
  chemically synthesized
ctcaggttccaaacactggg

SEQ ID NO: 508818 - DNA, 20 bp, Artificial Sequence
  chemically synthesized
atggatgattcttccctgtc

SEQ ID NO: 508819 - DNA, 20 bp, Artificial Sequence
  chemically synthesized
tagatgaaccctagacaggg

SEQ ID NO: 508820 - DNA, 20 bp, Artificial Sequence
  chemically synthesized
tcatctaaatgctccctctg

SEQ ID NO: 508821 - DNA, 20 bp, Artificial Sequence
  chemically synthesized
gctccctctgcgggatttgg

SEQ ID NO: 508822 - DNA, 20 bp, Artificial Sequence
  chemically synthesized
gcagtcacatggcatgaaga

SEQ ID NO: 508823 - DNA, 20 bp, Artificial Sequence
  chemically synthesized
catgccatgtgactgctgcc

SEQ ID NO: 508824 - DNA, 20 bp, Artificial Sequence
  chemically synthesized
gggagagctggtataggtga

SEQ ID NO: 508825 - DNA, 20 bp, Artificial Sequence
  chemically synthesized
tcacagaaagaggcacagaa

SEQ ID NO: 508826 - DNA, 20 bp, Artificial Sequence
  chemically synthesized
atgatcgtagtacctggttt

SEQ ID NO: 508827 - DNA, 20 bp, Artificial Sequence
  chemically synthesized
cactagaaaagcaccttcat

SEQ ID NO: 508828 - DNA, 20 bp, Artificial Sequence
  chemically synthesized
caatttgatgttcctgcaac

SEQ ID NO: 508829 - DNA, 20 bp, Artificial Sequence
  chemically synthesized
caccatatatttgagggaaa

SEQ ID NO: 508830 - DNA, 20 bp, Artificial Sequence
  chemically synthesized
tatggtgtatcattaaatat

SEQ ID NO: 508831 - DNA, 20 bp, Artificial Sequence
  chemically synthesized
taaaacatgtttgccatttc

SEQ ID NO: 508832 - DNA, 20 bp, Artificial Sequence
  chemically synthesized
tactcaagcttttcttttaa

SEQ ID NO: 508833 - DNA, 20 bp, Artificial Sequence
  chemically synthesized
cattcatttaaaagaaaagc

SEQ ID NO: 508834 - DNA, 20 bp, Artificial Sequence
  chemically synthesized
gttgttgttgcatggcaata

SEQ ID NO: 508835 - DNA, 20 bp, Artificial Sequence
  chemically synthesized
tgataaacgttataaatctt

SEQ ID NO: 508836 - DNA, 20 bp, Artificial Sequence
  chemically synthesized
tgaaatataagctttaaagc

SEQ ID NO: 508837 - DNA, 20 bp, Artificial Sequence
  chemically synthesized
gagggggtaattggttctgt

SEQ ID NO: 508838 - DNA, 20 bp, Artificial Sequence
  chemically synthesized
ctgaagtcttacacatttga

SEQ ID NO: 508839 - DNA, 20 bp, Artificial Sequence
  chemically synthesized
agaactagaggacaatagcg

SEQ ID NO: 508840 - DNA, 20 bp, Artificial Sequence
  chemically synthesized
ctagttctcatgctaacttt

SEQ ID NO: 508841 - DNA, 20 bp, Artificial Sequence
  chemically synthesized
ttctcatgctaactttctga

SEQ ID NO: 508842 - DNA, 20 bp, Artificial Sequence
  chemically synthesized
tctacagcttcacagatgct

SEQ ID NO: 508843 - DNA, 20 bp, Artificial Sequence
  chemically synthesized
aagtaggtaaactaggccag

SEQ ID NO: 508844 - DNA, 20 bp, Artificial Sequence
  chemically synthesized
ctgagtctagtaaggaatac

SEQ ID NO: 508845 - DNA, 20 bp, Artificial Sequence
  chemically synthesized
ctttgcagctgagtctagta

SEQ ID NO: 508846 - DNA, 20 bp, Artificial Sequence
  chemically synthesized
tgcagtgtcaggctttgcag

SEQ ID NO: 508847 - DNA, 20 bp, Artificial Sequence
  chemically synthesized
taatatagtagtttccattg

SEQ ID NO: 508848 - DNA, 20 bp, Artificial Sequence
  chemically synthesized
aatgaacacattagttttag

SEQ ID NO: 508849 - DNA, 20 bp, Artificial Sequence
  chemically synthesized
aaagaaggtgctgtaaagag

SEQ ID NO: 508850 - DNA, 20 bp, Artificial Sequence
  chemically synthesized
taataactatggcaattagt

SEQ ID NO: 508851 - DNA, 20 bp, Artificial Sequence
  chemically synthesized
tgacctccaagatcaggttg

SEQ ID NO: 508852 - DNA, 20 bp, Artificial Sequence
  chemically synthesized
ttttccttcatttctagttg

SEQ ID NO: 508853 - DNA, 20 bp, Artificial Sequence
  chemically synthesized
acatttattttcctacttaa

SEQ ID NO: 508854 - DNA, 20 bp, Artificial Sequence
  chemically synthesized
gaaatagtattgtttttata

SEQ ID NO: 508855 - DNA, 20 bp, Artificial Sequence
  chemically synthesized
acacattttcgattttctca

SEQ ID NO: 508856 - DNA, 20 bp, Artificial Sequence
  chemically synthesized
gatggaggacaaaaatggat

SEQ ID NO: 508857 - DNA, 20 bp, Artificial Sequence
  chemically synthesized
tatatggatggaggacaaaa

SEQ ID NO: 508858 - DNA, 20 bp, Artificial Sequence
  chemically synthesized
taattaaactgttcagctat

SEQ ID NO: 508859 - DNA, 20 bp, Artificial Sequence
  chemically synthesized
atttgaactttaatgttgcc

SEQ ID NO: 508860 - DNA, 20 bp, Artificial Sequence
  chemically synthesized
tttatgttattgttactaaa

SEQ ID NO: 508861 - DNA, 20 bp, Artificial Sequence
  chemically synthesized
aacataaagaagctgcgtgg

SEQ ID NO: 508862 - DNA, 20 bp, Artificial Sequence
  chemically synthesized
atgagccaccacgcctggcc

SEQ ID NO: 508863 - DNA, 20 bp, Artificial Sequence
  chemically synthesized
agcctcctcagcctcagtgc

SEQ ID NO: 508864 - DNA, 20 bp, Artificial Sequence
  chemically synthesized
ggctgaggaggctaaggcag

SEQ ID NO: 508865 - DNA, 20 bp, Artificial Sequence
  chemically synthesized
gtcaggaggtcgagaccatc

SEQ ID NO: 508866 - DNA, 20 bp, Artificial Sequence
  chemically synthesized
cggggtttcaccatgttatt

SEQ ID NO: 508867 - DNA, 20 bp, Artificial Sequence
  chemically synthesized
ttttgtatttttagtagaga

SEQ ID NO: 508868 - DNA, 20 bp, Artificial Sequence
  chemically synthesized
tactggggaggctgaaccag

SEQ ID NO: 508869 - DNA, 20 bp, Artificial Sequence
  chemically synthesized
ctcactgcaagctccgcccc

SEQ ID NO: 508870 - DNA, 20 bp, Artificial Sequence
  chemically synthesized
agtctccctgtctcccaggc

SEQ ID NO: 508871 - DNA, 20 bp, Artificial Sequence
  chemically synthesized
tttttcttttttttttgaga

SEQ ID NO: 508872 - DNA, 20 bp, Artificial Sequence
  chemically synthesized
tgccataatgtatttgccac

SEQ ID NO: 508873 - DNA, 20 bp, Artificial Sequence
  chemically synthesized
ttaatcaggaagattgattt

SEQ ID NO: 508874 - DNA, 20 bp, Artificial Sequence
  chemically synthesized
atcaggagccaaggacaaat

SEQ ID NO: 508875 - DNA, 20 bp, Artificial Sequence
  chemically synthesized
ctgtttaaattatctctagt

SEQ ID NO: 508876 - DNA, 20 bp, Artificial Sequence
  chemically synthesized
cacataaatgaatagaattt

SEQ ID NO: 508877 - DNA, 20 bp, Artificial Sequence
  chemically synthesized
tctatttccacataaatgaa

SEQ ID NO: 508878 - DNA, 20 bp, Artificial Sequence
  chemically synthesized
gagcttctatttccacataa

SEQ ID NO: 508879 - DNA, 20 bp, Artificial Sequence
  chemically synthesized
gtggcaaaatttttgaagtt

SEQ ID NO: 508880 - DNA, 20 bp, Artificial Sequence
  chemically synthesized
atacattgaagaaatattta

SEQ ID NO: 508881 - DNA, 20 bp, Artificial Sequence
  chemically synthesized
tagttttgatatttctgatt

SEQ ID NO: 508882 - DNA, 20 bp, Artificial Sequence
  chemically synthesized
agatagtctattagtttaat

SEQ ID NO: 508883 - DNA, 20 bp, Artificial Sequence
  chemically synthesized
tttggaactgggtaacagcc

SEQ ID NO: 508884 - DNA, 20 bp, Artificial Sequence
  chemically synthesized
acgtggaagtgactttggaa

SEQ ID NO: 508885 - DNA, 20 bp, Artificial Sequence
  chemically synthesized
ccaaagtcacttccacgtgt

SEQ ID NO: 508886 - DNA, 20 bp, Artificial Sequence
  chemically synthesized
tacattggtaccgcagagag

SEQ ID NO: 508887 - DNA, 20 bp, Artificial Sequence
  chemically synthesized
tacagtacattggtaccgca

SEQ ID NO: 508888 - DNA, 20 bp, Artificial Sequence
  chemically synthesized
aattaaagacataatagaga

SEQ ID NO: 508889 - DNA, 20 bp, Artificial Sequence
  chemically synthesized
ctccccagccatgccgaact

SEQ ID NO: 508890 - DNA, 20 bp, Artificial Sequence
  chemically synthesized
tgctgttctcatgatagtga

SEQ ID NO: 508891 - DNA, 20 bp, Artificial Sequence
  chemically synthesized
ctcatgctgttctcatgata

SEQ ID NO: 508892 - DNA, 20 bp, Artificial Sequence
  chemically synthesized
cactatcatgagaacagcat

SEQ ID NO: 508893 - DNA, 20 bp, Artificial Sequence
  chemically synthesized
gtggaaggtaattgaatcat

SEQ ID NO: 508894 - DNA, 20 bp, Artificial Sequence
  chemically synthesized
agggacctggtggaaggtaa

SEQ ID NO: 508895 - DNA, 20 bp, Artificial Sequence
  chemically synthesized
aggtccctcccacaacacat

SEQ ID NO: 508896 - DNA, 20 bp, Artificial Sequence
  chemically synthesized
ctgatatggtttggctcatc

SEQ ID NO: 508897 - DNA, 20 bp, Artificial Sequence
  chemically synthesized
gatacggctctctcatttct

SEQ ID NO: 508898 - DNA, 20 bp, Artificial Sequence
  chemically synthesized
ttacaggaaagctaaatttc

SEQ ID NO: 508899 - DNA, 20 bp, Artificial Sequence
  chemically synthesized
gctttcctgtaatttaaact

SEQ ID NO: 508900 - DNA, 20 bp, Artificial Sequence
  chemically synthesized
gacattcggttaggttgcac

SEQ ID NO: 508901 - DNA, 20 bp, Artificial Sequence
  chemically synthesized
ataatccatgtgcaacctaa

SEQ ID NO: 508902 - DNA, 20 bp, Artificial Sequence
  chemically synthesized
ctattggactaataagaagt

SEQ ID NO: 508903 - DNA, 20 bp, Artificial Sequence
  chemically synthesized
cagacaatatatgagtgttg

SEQ ID NO: 508904 - DNA, 20 bp, Artificial Sequence
  chemically synthesized
taatatataacagacaatat

SEQ ID NO: 508905 - DNA, 20 bp, Artificial Sequence
  chemically synthesized
tctgttatatattattgcac

SEQ ID NO: 508906 - DNA, 20 bp, Artificial Sequence
  chemically synthesized
tgctactgcttaatcaccca

SEQ ID NO: 508907 - DNA, 20 bp, Artificial Sequence
  chemically synthesized
atatgttgatatcatacccc

SEQ ID NO: 508908 - DNA, 20 bp, Artificial Sequence
  chemically synthesized
atgatatcaacatatgagga

SEQ ID NO: 508909 - DNA, 20 bp, Artificial Sequence
  chemically synthesized
tgatctaactgaaattaaga

SEQ ID NO: 508910 - DNA, 20 bp, Artificial Sequence
  chemically synthesized
ttctcaaacttaaactgatc

SEQ ID NO: 508911 - DNA, 20 bp, Artificial Sequence
  chemically synthesized
taaactgatcagggatcacc

SEQ ID NO: 508912 - DNA, 20 bp, Artificial Sequence
  chemically synthesized
cattctgatatatacagaat

SEQ ID NO: 508913 - DNA, 20 bp, Artificial Sequence
  chemically synthesized
aattctgattctgtatatat

SEQ ID NO: 508914 - DNA, 20 bp, Artificial Sequence
  chemically synthesized
agctctcattctgatatata

SEQ ID NO: 508915 - DNA, 20 bp, Artificial Sequence
  chemically synthesized
tatatatcagaatgagagct

SEQ ID NO: 508916 - DNA, 20 bp, Artificial Sequence
  chemically synthesized
tgtgaaataaaatcacaatt

SEQ ID NO: 508917 - DNA, 20 bp, Artificial Sequence
  chemically synthesized
cctccaaagtatttactgca

SEQ ID NO: 508918 - DNA, 20 bp, Artificial Sequence
  chemically synthesized
aggtaattccaatcttggaa

SEQ ID NO: 508919 - DNA, 20 bp, Artificial Sequence
  chemically synthesized
aacgaattcaattccaagat

SEQ ID NO: 508920 - DNA, 20 bp, Artificial Sequence
  chemically synthesized
tattcaggtaattccaatct

SEQ ID NO: 508921 - DNA, 20 bp, Artificial Sequence
  chemically synthesized
aattccaagattggaattac

SEQ ID NO: 508922 - DNA, 20 bp, Artificial Sequence
  chemically synthesized
ttgcgtatgtgaatatatga

SEQ ID NO: 508923 - DNA, 20 bp, Artificial Sequence
  chemically synthesized
aagtttgcgtatgtgaatat

SEQ ID NO: 508924 - DNA, 20 bp, Artificial Sequence
  chemically synthesized
gtgcagtgaagtttgcgtat

SEQ ID NO: 508925 - DNA, 20 bp, Artificial Sequence
  chemically synthesized
aggaggtgctgaacaaatga

SEQ ID NO: 508926 - DNA, 20 bp, Artificial Sequence
  chemically synthesized
gaaaaggaggtgctgaacaa

SEQ ID NO: 508927 - DNA, 20 bp, Artificial Sequence
  chemically synthesized
ataagatggcatatgtgaga

SEQ ID NO: 508928 - DNA, 20 bp, Artificial Sequence
  chemically synthesized
ggaaataagatggcatatgt

SEQ ID NO: 508929 - DNA, 20 bp, Artificial Sequence
  chemically synthesized
cacatatgccatcttatttc

SEQ ID NO: 508930 - DNA, 20 bp, Artificial Sequence
  chemically synthesized
ccataatatggaaaataatt

SEQ ID NO: 508931 - DNA, 20 bp, Artificial Sequence
  chemically synthesized
aggagagatatgaatagtat

SEQ ID NO: 508932 - DNA, 20 bp, Artificial Sequence
  chemically synthesized
atatcagcaggaggagagat

SEQ ID NO: 508933 - DNA, 20 bp, Artificial Sequence
  chemically synthesized
ggaacttgctgtgcttaact

SEQ ID NO: 508934 - DNA, 20 bp, Artificial Sequence
  chemically synthesized
aacagaagattttcttctct

SEQ ID NO: 508935 - DNA, 20 bp, Artificial Sequence
  chemically synthesized
ggaagttgtgtgtttttctt

SEQ ID NO: 508936 - DNA, 20 bp, Artificial Sequence
  chemically synthesized
acttgggatggtaggaggta

SEQ ID NO: 508937 - DNA, 20 bp, Artificial Sequence
  chemically synthesized
ttaatgctgtggaatacact

SEQ ID NO: 508938 - DNA, 20 bp, Artificial Sequence
  chemically synthesized
tgattttttttttaatgctg

SEQ ID NO: 508939 - DNA, 20 bp, Artificial Sequence
  chemically synthesized
tcattggcttactcctctta

SEQ ID NO: 508940 - DNA, 20 bp, Artificial Sequence
  chemically synthesized
ttttgttagaaccccttaag

SEQ ID NO: 508941 - DNA, 20 bp, Artificial Sequence
  chemically synthesized
taatgtagtgtttaaaacaa

SEQ ID NO: 508942 - DNA, 20 bp, Artificial Sequence
  chemically synthesized
tttaaacactacattatgaa

SEQ ID NO: 508943 - DNA, 20 bp, Artificial Sequence
  chemically synthesized
taacacatctccagtcacaa

SEQ ID NO: 508944 - DNA, 20 bp, Artificial Sequence
  chemically synthesized
atttatgtccataaaagcaa

SEQ ID NO: 508945 - DNA, 20 bp, Artificial Sequence
  chemically synthesized
ggaaaatacaatagcaagga

SEQ ID NO: 508946 - DNA, 20 bp, Artificial Sequence
  chemically synthesized
tagcaaggaaagaatcaaat

SEQ ID NO: 508947 - DNA, 20 bp, Artificial Sequence
  chemically synthesized
atttaaaaatatgcttacaa

SEQ ID NO: 508948 - DNA, 20 bp, Artificial Sequence
  chemically synthesized
tggggataagggagcatgag

SEQ ID NO: 508949 - DNA, 20 bp, Artificial Sequence
  chemically synthesized
tagctgtggttattttgtat

SEQ ID NO: 508950 - DNA, 20 bp, Artificial Sequence
  chemically synthesized
tcagtcatttttttttccca

SEQ ID NO: 508951 - DNA, 20 bp, Artificial Sequence
  chemically synthesized
aaaaagtaaaaaacatctat

SEQ ID NO: 508952 - DNA, 20 bp, Artificial Sequence
  chemically synthesized
tttgggaggccaaggtggga

SEQ ID NO: 508953 - DNA, 20 bp, Artificial Sequence
  chemically synthesized
acttttaaaaaaattttgca

SEQ ID NO: 508954 - DNA, 20 bp, Artificial Sequence
  chemically synthesized
agggtataaaaagttagttt

SEQ ID NO: 508955 - DNA, 20 bp, Artificial Sequence
  chemically synthesized
ctgaaagatactagatgaga

SEQ ID NO: 508956 - DNA, 20 bp, Artificial Sequence
  chemically synthesized
aatcctctccagtttgccta

SEQ ID NO: 508957 - DNA, 20 bp, Artificial Sequence
  chemically synthesized
tattccttaggcaaactgga

SEQ ID NO: 508958 - DNA, 20 bp, Artificial Sequence
  chemically synthesized
gcataattgttgatggttta

SEQ ID NO: 508959 - DNA, 20 bp, Artificial Sequence
  chemically synthesized
tattatttcctagatgcaac

SEQ ID NO: 508960 - DNA, 20 bp, Artificial Sequence
  chemically synthesized
gctttgtcttgcacttagtc

SEQ ID NO: 508961 - DNA, 20 bp, Artificial Sequence
  chemically synthesized
cagggctttgaataagggct

SEQ ID NO: 508962 - DNA, 20 bp, Artificial Sequence
  chemically synthesized
ttgtagtgtcagtcagggct

SEQ ID NO: 508963 - DNA, 20 bp, Artificial Sequence
  chemically synthesized
tagatggctgaggtctgaga

SEQ ID NO: 508964 - DNA, 20 bp, Artificial Sequence
  chemically synthesized
ccagggggactgtagagttg

SEQ ID NO: 508965 - DNA, 20 bp, Artificial Sequence
  chemically synthesized
ccaaaaggccagggggactg

SEQ ID NO: 508966 - DNA, 20 bp, Artificial Sequence
  chemically synthesized
atcacaaggaagtgtggttc

SEQ ID NO: 508967 - DNA, 20 bp, Artificial Sequence
  chemically synthesized
ggtaccatttagtttgagat

SEQ ID NO: 508968 - DNA, 20 bp, Artificial Sequence
  chemically synthesized
accaaccttcaaagtcttac

SEQ ID NO: 508969 - DNA, 20 bp, Artificial Sequence
  chemically synthesized
gattaaaatgtaatgtgata

SEQ ID NO: 508970 - DNA, 20 bp, Artificial Sequence
  chemically synthesized
acacaagaaaaataccggat

SEQ ID NO: 508971 - DNA, 20 bp, Artificial Sequence
  chemically synthesized
aaaagaacacaagaaaaata

SEQ ID NO: 508972 - DNA, 20 bp, Artificial Sequence
  chemically synthesized
ttcttggctgccagcctcta

SEQ ID NO: 508973 - DNA, 20 bp, Artificial Sequence
  chemically synthesized
cagaccttgtatgatcatta

SEQ ID NO: 508974 - DNA, 20 bp, Artificial Sequence
  chemically synthesized
tctatatgaacaaatattaa

SEQ ID NO: 508975 - DNA, 20 bp, Artificial Sequence
  chemically synthesized
atagtaagtatgttggtaga

SEQ ID NO: 508976 - DNA, 20 bp, Artificial Sequence
  chemically synthesized
ttagaaattatagcatagct

SEQ ID NO: 508977 - DNA, 20 bp, Artificial Sequence
  chemically synthesized
caggaaataatggcttccga

SEQ ID NO: 508978 - DNA, 20 bp, Artificial Sequence
  chemically synthesized
ctctctacctaagacagggt

SEQ ID NO: 508979 - DNA, 20 bp, Artificial Sequence
  chemically synthesized
ttttctctctctacctaaga

SEQ ID NO: 508980 - DNA, 20 bp, Artificial Sequence
  chemically synthesized
gagagagaaaagaagtatcg

SEQ ID NO: 508981 - DNA, 20 bp, Artificial Sequence
  chemically synthesized
aagattactagtaaacaaaa

SEQ ID NO: 508982 - DNA, 20 bp, Artificial Sequence
  chemically synthesized
ttctaaatatatgattactt

SEQ ID NO: 508983 - DNA, 20 bp, Artificial Sequence
  chemically synthesized
ccattatcatggtcatgaga

SEQ ID NO: 508984 - DNA, 20 bp, Artificial Sequence
  chemically synthesized
gtttccattatcatggtcat

SEQ ID NO: 508985 - DNA, 20 bp, Artificial Sequence
  chemically synthesized
aaaaaacgtgattatgaaaa

SEQ ID NO: 508986 - DNA, 20 bp, Artificial Sequence
  chemically synthesized
tacataatggcttatcacat

SEQ ID NO: 508987 - DNA, 20 bp, Artificial Sequence
  chemically synthesized
cacaaattcagaaataatat

SEQ ID NO: 508988 - DNA, 20 bp, Artificial Sequence
  chemically synthesized
tataaactctcatattattt

SEQ ID NO: 508989 - DNA, 20 bp, Artificial Sequence
  chemically synthesized
gctttgtatattcattttta

SEQ ID NO: 508990 - DNA, 20 bp, Artificial Sequence
  chemically synthesized
ttctggaaaattccttaaaa

SEQ ID NO: 508991 - DNA, 20 bp, Artificial Sequence
  chemically synthesized
gcttttgctaaaacatctca

SEQ ID NO: 508992 - DNA, 20 bp, Artificial Sequence
  chemically synthesized
tttgtacgtgttacagcttt

SEQ ID NO: 508993 - DNA, 20 bp, Artificial Sequence
  chemically synthesized
tgtaacacgtacaaaagctc

SEQ ID NO: 508994 - DNA, 20 bp, Artificial Sequence
  chemically synthesized
ttagcatttccattctctag

SEQ ID NO: 508995 - DNA, 20 bp, Artificial Sequence
  chemically synthesized
tcctcatccccatcccacta

SEQ ID NO: 508996 - DNA, 20 bp, Artificial Sequence
  chemically synthesized
tttccattctctagtgggat

SEQ ID NO: 508997 - DNA, 20 bp, Artificial Sequence
  chemically synthesized
gggatgtctgccattaagtg

SEQ ID NO: 508998 - DNA, 20 bp, Artificial Sequence
  chemically synthesized
ggcagacatcccttgaaggg

SEQ ID NO: 508999 - DNA, 20 bp, Artificial Sequence
  chemically synthesized
ttcaaaaattccccccttca

SEQ ID NO: 509000 - DNA, 20 bp, Artificial Sequence
  chemically synthesized
tcccttgaaggggggaattt

SEQ ID NO: 509001 - DNA, 20 bp, Artificial Sequence
  chemically synthesized
atgaacatctttttaaatgt

SEQ ID NO: 509002 - DNA, 20 bp, Artificial Sequence
  chemically synthesized
gttgcaattttaattccagg

SEQ ID NO: 509003 - DNA, 20 bp, Artificial Sequence
  chemically synthesized
aagaaaatatgaattcctcc

SEQ ID NO: 509004 - DNA, 20 bp, Artificial Sequence
  chemically synthesized
aaattgagttgcaagaaaat

SEQ ID NO: 509005 - DNA, 20 bp, Artificial Sequence
  chemically synthesized
taattaattgctgtgtgaaa

SEQ ID NO: 509006 - DNA, 20 bp, Artificial Sequence
  chemically synthesized
caattaattaactgattagt

SEQ ID NO: 509007 - DNA, 20 bp, Artificial Sequence
  chemically synthesized
tgttagttttattgaaaatg

SEQ ID NO: 509008 - DNA, 20 bp, Artificial Sequence
  chemically synthesized
agagcatttagcctccagga

SEQ ID NO: 509009 - DNA, 20 bp, Artificial Sequence
  chemically synthesized
tccaggagaggatggaaacc

SEQ ID NO: 509010 - DNA, 20 bp, Artificial Sequence
  chemically synthesized
caaggacagtaaagaggtgg

SEQ ID NO: 509011 - DNA, 20 bp, Artificial Sequence
  chemically synthesized
caaatagaagttctaacctg

SEQ ID NO: 509012 - DNA, 20 bp, Artificial Sequence
  chemically synthesized
atcttaatatcgataataga

SEQ ID NO: 509013 - DNA, 20 bp, Artificial Sequence
  chemically synthesized
agtggacctggtaaacactg

SEQ ID NO: 509014 - DNA, 20 bp, Artificial Sequence
  chemically synthesized
caataatcatattataactg

SEQ ID NO: 509015 - DNA, 20 bp, Artificial Sequence
  chemically synthesized
ttattgtacctctcacatct

SEQ ID NO: 509016 - DNA, 20 bp, Artificial Sequence
  chemically synthesized
catcaccacgatcacagcag

SEQ ID NO: 509017 - DNA, 20 bp, Artificial Sequence
  chemically synthesized
tagattagtatctcctggct

SEQ ID NO: 509018 - DNA, 20 bp, Artificial Sequence
  chemically synthesized
tttaagctcaggccttttga

SEQ ID NO: 509019 - DNA, 20 bp, Artificial Sequence
  chemically synthesized
ttcacactataatttagtac

SEQ ID NO: 509020 - DNA, 20 bp, Artificial Sequence
  chemically synthesized
aaactcattagatatgctag

SEQ ID NO: 509021 - DNA, 20 bp, Artificial Sequence
  chemically synthesized
caatccttctagcatatcta

SEQ ID NO: 509022 - DNA, 20 bp, Artificial Sequence
  chemically synthesized
atgaagtgccaactgtggat

SEQ ID NO: 509023 - DNA, 20 bp, Artificial Sequence
  chemically synthesized
aaagaaatgaagtgccaact

SEQ ID NO: 509024 - DNA, 20 bp, Artificial Sequence
  chemically synthesized
cttgtcttgataggctttac

SEQ ID NO: 509025 - DNA, 20 bp, Artificial Sequence
  chemically synthesized
tataaatcaaaacacatatc

SEQ ID NO: 509026 - DNA, 20 bp, Artificial Sequence
  chemically synthesized
aacaagcagatctcatcatt

SEQ ID NO: 509027 - DNA, 20 bp, Artificial Sequence
  chemically synthesized
tatattgacttaataaaaaa

SEQ ID NO: 509028 - DNA, 20 bp, Artificial Sequence
  chemically synthesized
gtatggctatgaattatctt

SEQ ID NO: 509029 - DNA, 20 bp, Artificial Sequence
  chemically synthesized
tattaaaatacagtatggct

SEQ ID NO: 509030 - DNA, 20 bp, Artificial Sequence
  chemically synthesized
tagccatactgtattttaat

SEQ ID NO: 509031 - DNA, 20 bp, Artificial Sequence
  chemically synthesized
ataagaatttcccaaaacgt

SEQ ID NO: 509032 - DNA, 20 bp, Artificial Sequence
  chemically synthesized
gtttgaataatgtttttcaa

SEQ ID NO: 509033 - DNA, 20 bp, Artificial Sequence
  chemically synthesized
aagaggatttccatatatag

SEQ ID NO: 509034 - DNA, 20 bp, Artificial Sequence
  chemically synthesized
aaaagcccttgaaaatatta

SEQ ID NO: 509035 - DNA, 20 bp, Artificial Sequence
  chemically synthesized
ctagaaaataataactatga

SEQ ID NO: 509036 - DNA, 20 bp, Artificial Sequence
  chemically synthesized
tttctttcaagggagactgg

SEQ ID NO: 509037 - DNA, 20 bp, Artificial Sequence
  chemically synthesized
gtgtgccttgggaacaaact

SEQ ID NO: 509038 - DNA, 20 bp, Artificial Sequence
  chemically synthesized
aattcaagatgggaatgcct

SEQ ID NO: 509039 - DNA, 20 bp, Artificial Sequence
  chemically synthesized
taccctgaggcattcccatc

SEQ ID NO: 509040 - DNA, 20 bp, Artificial Sequence
  chemically synthesized
gaatctcctaaattcaagat

SEQ ID NO: 509041 - DNA, 20 bp, Artificial Sequence
  chemically synthesized
aaactgaagtacaagagcag

SEQ ID NO: 509042 - DNA, 20 bp, Artificial Sequence
  chemically synthesized
atcagcttacttcccaattg

SEQ ID NO: 509043 - DNA, 20 bp, Artificial Sequence
  chemically synthesized
gatttgacagcccatcaggg

SEQ ID NO: 509044 - DNA, 20 bp, Artificial Sequence
  chemically synthesized
ttctttgtcaggggtacatg

SEQ ID NO: 509045 - DNA, 20 bp, Artificial Sequence
  chemically synthesized
tgttaacttccttctttgtc

SEQ ID NO: 509046 - DNA, 20 bp, Artificial Sequence
  chemically synthesized
caaaaccacaccgatttacc

SEQ ID NO: 509047 - DNA, 20 bp, Artificial Sequence
  chemically synthesized
ctaggtaaatcggtgtggtt

SEQ ID NO: 509048 - DNA, 20 bp, Artificial Sequence
  chemically synthesized
agatttatattcccagtaaa

SEQ ID NO: 509049 - DNA, 20 bp, Artificial Sequence
  chemically synthesized
caaattaaattccttttact

SEQ ID NO: 509050 - DNA, 20 bp, Artificial Sequence
  chemically synthesized
aggaatttaatttgtatttg

SEQ ID NO: 509051 - DNA, 20 bp, Artificial Sequence
  chemically synthesized
attcatattaaaagtggttt

SEQ ID NO: 509052 - DNA, 20 bp, Artificial Sequence
  chemically synthesized
atcccaaaaccacttttaat

SEQ ID NO: 509053 - DNA, 20 bp, Artificial Sequence
  chemically synthesized
gctcccaggaagttccgcaa

SEQ ID NO: 509054 - DNA, 20 bp, Artificial Sequence
  chemically synthesized
agggaagggaaagaagccaa

SEQ ID NO: 509055 - DNA, 20 bp, Artificial Sequence
  chemically synthesized
ccaataccatacatcaactc

SEQ ID NO: 509056 - DNA, 20 bp, Artificial Sequence
  chemically synthesized
ctgaggcattacttacattc

SEQ ID NO: 509057 - DNA, 20 bp, Artificial Sequence
  chemically synthesized
tttctacctgatcggccaac

SEQ ID NO: 509058 - DNA, 20 bp, Artificial Sequence
  chemically synthesized
aaacttcaaaatctgactgt

SEQ ID NO: 509059 - DNA, 20 bp, Artificial Sequence
  chemically synthesized
tttagttactatgatgtgct

SEQ ID NO: 509060 - DNA, 20 bp, Artificial Sequence
  chemically synthesized
taactaaatttccaaaatac

SEQ ID NO: 509061 - DNA, 20 bp, Artificial Sequence
  chemically synthesized
tccaaaatacaaggatgtaa

SEQ ID NO: 509062 - DNA, 20 bp, Artificial Sequence
  chemically synthesized
taagagagtaattgaggaaa

SEQ ID NO: 509063 - DNA, 20 bp, Artificial Sequence
  chemically synthesized
ttaacgttttagtttacctc

SEQ ID NO: 509064 - DNA, 20 bp, Artificial Sequence
  chemically synthesized
catttggcagttcattgatg

SEQ ID NO: 509065 - DNA, 20 bp, Artificial Sequence
  chemically synthesized
atgctgcacaataaaataaa

SEQ ID NO: 509066 - DNA, 20 bp, Artificial Sequence
  chemically synthesized
ttgttccagtacattaaatg

SEQ ID NO: 509067 - DNA, 20 bp, Artificial Sequence
  chemically synthesized
ccagtacattaaatgatgaa

SEQ ID NO: 509068 - DNA, 20 bp, Artificial Sequence
  chemically synthesized
aacagcagatacagacaata

SEQ ID NO: 509069 - DNA, 20 bp, Artificial Sequence
  chemically synthesized
taatacaatattaatttggt

SEQ ID NO: 509070 - DNA, 20 bp, Artificial Sequence
  chemically synthesized
agctcttctagattactgga

SEQ ID NO: 509071 - DNA, 20 bp, Artificial Sequence
  chemically synthesized
ataacttacatatacattat

SEQ ID NO: 509072 - DNA, 20 bp, Artificial Sequence
  chemically synthesized
ctgttagaaattttagatgg

SEQ ID NO: 509073 - DNA, 20 bp, Artificial Sequence
  chemically synthesized
tatgctgttagaaattttag

SEQ ID NO: 509074 - DNA, 20 bp, Artificial Sequence
  chemically synthesized
ttaatatcctgctaattaaa

SEQ ID NO: 509075 - DNA, 20 bp, Artificial Sequence
  chemically synthesized
gctttacccaatttaattag

SEQ ID NO: 509076 - DNA, 20 bp, Artificial Sequence
  chemically synthesized
taattagcaggatattaagt

SEQ ID NO: 509077 - DNA, 20 bp, Artificial Sequence
  chemically synthesized
gagaatgcaaatggttgtct

SEQ ID NO: 509078 - DNA, 20 bp, Artificial Sequence
  chemically synthesized
gtacactttgctcttggctt

SEQ ID NO: 509079 - DNA, 20 bp, Artificial Sequence
  chemically synthesized
tggatcttctctttagaatt

SEQ ID NO: 509080 - DNA, 20 bp, Artificial Sequence
  chemically synthesized
ggtaccctggatcttctctt

SEQ ID NO: 509081 - DNA, 20 bp, Artificial Sequence
  chemically synthesized
ataattctaaagagaagatc

SEQ ID NO: 509082 - DNA, 20 bp, Artificial Sequence
  chemically synthesized
gcaattttttaacaggtacc

SEQ ID NO: 509083 - DNA, 20 bp, Artificial Sequence
  chemically synthesized
tttaagctagatattggatt

SEQ ID NO: 509084 - DNA, 20 bp, Artificial Sequence
  chemically synthesized
acacacctttaagctagata

SEQ ID NO: 509085 - DNA, 20 bp, Artificial Sequence
  chemically synthesized
ctgaagccaagtaatagaga

SEQ ID NO: 509086 - DNA, 20 bp, Artificial Sequence
  chemically synthesized
caagaagcctctcctgtcac

SEQ ID NO: 509087 - DNA, 20 bp, Artificial Sequence
  chemically synthesized
aagtgacaggagaggcttct

SEQ ID NO: 509088 - DNA, 20 bp, Artificial Sequence
  chemically synthesized
catttatcaagggcaaaaat

SEQ ID NO: 509089 - DNA, 20 bp, Artificial Sequence
  chemically synthesized
gcaggaggttttgctttggg

SEQ ID NO: 509090 - DNA, 20 bp, Artificial Sequence
  chemically synthesized
ttgaagcccggcgacctgca

SEQ ID NO: 509091 - DNA, 20 bp, Artificial Sequence
  chemically synthesized
gtccctcttgagcatgttct

SEQ ID NO: 509092 - DNA, 20 bp, Artificial Sequence
  chemically synthesized
tattggagaaatatttgtag

SEQ ID NO: 509093 - DNA, 20 bp, Artificial Sequence
  chemically synthesized
gtgcttgcttgcaatatttg

SEQ ID NO: 509094 - DNA, 20 bp, Artificial Sequence
  chemically synthesized
gcacggggccccctaacaaa

SEQ ID NO: 509095 - DNA, 20 bp, Artificial Sequence
  chemically synthesized
taacaaacagggttttgtaa

SEQ ID NO: 509096 - DNA, 20 bp, Artificial Sequence
  chemically synthesized
agaacaacagaagctgtttg

SEQ ID NO: 509097 - DNA, 20 bp, Artificial Sequence
  chemically synthesized
caccaaaggttgaattttct

SEQ ID NO: 509098 - DNA, 20 bp, Artificial Sequence
  chemically synthesized
caggggaaagccaccaaagg

SEQ ID NO: 509099 - DNA, 20 bp, Artificial Sequence
  chemically synthesized
ttcctgtccttctcagttct

SEQ ID NO: 509100 - DNA, 20 bp, Artificial Sequence
  chemically synthesized
aagttggtgctggcagctta

SEQ ID NO: 509101 - DNA, 20 bp, Artificial Sequence
  chemically synthesized
agttggggaaatttaaaata

SEQ ID NO: 509102 - DNA, 20 bp, Artificial Sequence
  chemically synthesized
acttttatagaaactggaaa

SEQ ID NO: 509103 - DNA, 20 bp, Artificial Sequence
  chemically synthesized
gttcggtgattttgacttac

SEQ ID NO: 509104 - DNA, 20 bp, Artificial Sequence
  chemically synthesized
ccgaacttcatcatatcaaa

SEQ ID NO: 509105 - DNA, 20 bp, Artificial Sequence
  chemically synthesized
aaattgccttactgttagac

SEQ ID NO: 509106 - DNA, 20 bp, Artificial Sequence
  chemically synthesized
aggcaatttctgaaggtctt

SEQ ID NO: 509107 - DNA, 20 bp, Artificial Sequence
  chemically synthesized
aataaaattatttacaattt

SEQ ID NO: 509108 - DNA, 20 bp, Artificial Sequence
  chemically synthesized
aattgtaaataattttattt

SEQ ID NO: 509109 - DNA, 20 bp, Artificial Sequence
  chemically synthesized
gtgaagtcctatgtgcaatg

SEQ ID NO: 509110 - DNA, 20 bp, Artificial Sequence
  chemically synthesized
agtaagtttagtaagattca

SEQ ID NO: 509111 - DNA, 20 bp, Artificial Sequence
  chemically synthesized
acacacttacgccatattct

SEQ ID NO: 509112 - DNA, 20 bp, Artificial Sequence
  chemically synthesized
taagtgtgttatgtctataa

SEQ ID NO: 509113 - DNA, 20 bp, Artificial Sequence
  chemically synthesized
ccttcttgctgcatttgaag

SEQ ID NO: 509114 - DNA, 20 bp, Artificial Sequence
  chemically synthesized
aggagtaggaaaggatatga

SEQ ID NO: 509115 - DNA, 20 bp, Artificial Sequence
  chemically synthesized
ggaacataacaggagtagga

SEQ ID NO: 509116 - DNA, 20 bp, Artificial Sequence
  chemically synthesized
ggttcatataggaacataac

SEQ ID NO: 509117 - DNA, 20 bp, Artificial Sequence
  chemically synthesized
attgatgatatagaaagaaa

SEQ ID NO: 509118 - DNA, 20 bp, Artificial Sequence
  chemically synthesized
aaagggaatcttgtgacttt

SEQ ID NO: 509119 - DNA, 20 bp, Artificial Sequence
  chemically synthesized
ttccataataagattgtggt

SEQ ID NO: 509120 - DNA, 20 bp, Artificial Sequence
  chemically synthesized
taagattgtggtaagaatta

SEQ ID NO: 509121 - DNA, 20 bp, Artificial Sequence
  chemically synthesized
agagtgcataatgcacttca

SEQ ID NO: 509122 - DNA, 20 bp, Artificial Sequence
  chemically synthesized
aacacttcttatatatgcag

SEQ ID NO: 509123 - DNA, 20 bp, Artificial Sequence
  chemically synthesized
gttaaggttcagatttcaaa

SEQ ID NO: 509124 - DNA, 20 bp, Artificial Sequence
  chemically synthesized
ccttaacctagctcgtattt

SEQ ID NO: 509125 - DNA, 20 bp, Artificial Sequence
  chemically synthesized
cttaaaaatcattaactatc

SEQ ID NO: 509126 - DNA, 20 bp, Artificial Sequence
  chemically synthesized
agtgtaaagtattgtgttac

SEQ ID NO: 509127 - DNA, 20 bp, Artificial Sequence
  chemically synthesized
aatactttacactgtgcaat

SEQ ID NO: 509128 - DNA, 20 bp, Artificial Sequence
  chemically synthesized
atgatttattgatatttaca

SEQ ID NO: 509129 - DNA, 20 bp, Artificial Sequence
  chemically synthesized
ttattgatatttacacagga

SEQ ID NO: 509130 - DNA, 20 bp, Artificial Sequence
  chemically synthesized
gagtactagatgtcatgtcc

SEQ ID NO: 509131 - DNA, 20 bp, Artificial Sequence
  chemically synthesized
aaaatatttaggttcagaat

SEQ ID NO: 509132 - DNA, 20 bp, Artificial Sequence
  chemically synthesized
tcagacaaaatatttaggtt

SEQ ID NO: 509133 - DNA, 20 bp, Artificial Sequence
  chemically synthesized
tgaacctaaatattttgtct

SEQ ID NO: 509134 - DNA, 20 bp, Artificial Sequence
  chemically synthesized
tcttaaagataaattcaaat

SEQ ID NO: 509135 - DNA, 20 bp, Artificial Sequence
  chemically synthesized
tttgcatagcttattcagat

SEQ ID NO: 509136 - DNA, 20 bp, Artificial Sequence
  chemically synthesized
gtatatatatagttgaattg

SEQ ID NO: 509137 - DNA, 20 bp, Artificial Sequence
  chemically synthesized
ataattctgtatatatatag

SEQ ID NO: 509138 - DNA, 20 bp, Artificial Sequence
  chemically synthesized
tcaattcaactatatatata

SEQ ID NO: 509139 - DNA, 20 bp, Artificial Sequence
  chemically synthesized
tacagaattataatcaaaat

SEQ ID NO: 509140 - DNA, 20 bp, Artificial Sequence
  chemically synthesized
tcaaaatttgaatttaagat

SEQ ID NO: 509141 - DNA, 20 bp, Artificial Sequence
  chemically synthesized
ttgtttttcaaattgtaagt

SEQ ID NO: 509142 - DNA, 20 bp, Artificial Sequence
  chemically synthesized
catgattttatgaaccatga

SEQ ID NO: 509143 - DNA, 20 bp, Artificial Sequence
  chemically synthesized
ctaacatgattttatgaacc

SEQ ID NO: 509144 - DNA, 20 bp, Artificial Sequence
  chemically synthesized
catgttagtaggttatgact

SEQ ID NO: 509145 - DNA, 20 bp, Artificial Sequence
  chemically synthesized
tttttgtttcagatgtgcat

SEQ ID NO: 509146 - DNA, 20 bp, Artificial Sequence
  chemically synthesized
aacaaaattggaaatggctc

SEQ ID NO: 509147 - DNA, 20 bp, Artificial Sequence
  chemically synthesized
cgacgaaaaaagaaatttgc

SEQ ID NO: 509148 - DNA, 20 bp, Artificial Sequence
  chemically synthesized
ctatggaaaatatacaaatg

SEQ ID NO: 509149 - DNA, 20 bp, Artificial Sequence
  chemically synthesized
tatattttccatagagacct

SEQ ID NO: 509150 - DNA, 20 bp, Artificial Sequence
  chemically synthesized
aataaaacgatgtttaatct

SEQ ID NO: 509151 - DNA, 20 bp, Artificial Sequence
  chemically synthesized
gtgatgataaaaacatattt

SEQ ID NO: 509152 - DNA, 20 bp, Artificial Sequence
  chemically synthesized
aaaatatgtttttatcatca

SEQ ID NO: 509153 - DNA, 20 bp, Artificial Sequence
  chemically synthesized
atcttcattcatgaaacgat

SEQ ID NO: 509154 - DNA, 20 bp, Artificial Sequence
  chemically synthesized
agatagaccccaatcgtttc

SEQ ID NO: 509155 - DNA, 20 bp, Artificial Sequence
  chemically synthesized
ctactgtgataaagacaaaa

SEQ ID NO: 509156 - DNA, 20 bp, Artificial Sequence
  chemically synthesized
ttacgatgagaggcatgaca

SEQ ID NO: 509157 - DNA, 20 bp, Artificial Sequence
  chemically synthesized
gatgagaggcatgacagtga

SEQ ID NO: 509158 - DNA, 20 bp, Artificial Sequence
  chemically synthesized
ggaaaaaaaaaaaacaaaaa

SEQ ID NO: 509159 - DNA, 20 bp, Artificial Sequence
  chemically synthesized
tttttttttttcccccaaaa

SEQ ID NO: 509160 - DNA, 20 bp, Artificial Sequence
  chemically synthesized
gtggataacgttgaataaat

SEQ ID NO: 509161 - DNA, 20 bp, Artificial Sequence
  chemically synthesized
tctgaagtctgtggataacg

SEQ ID NO: 509162 - DNA, 20 bp, Artificial Sequence
  chemically synthesized
taattaagcctctgaagtct

SEQ ID NO: 509163 - DNA, 20 bp, Artificial Sequence
  chemically synthesized
attaaaaaaggtggaagagg

SEQ ID NO: 509164 - DNA, 20 bp, Artificial Sequence
  chemically synthesized
gcctcagcctcccaaagtgc

SEQ ID NO: 509165 - DNA, 20 bp, Artificial Sequence
  chemically synthesized
actttgggaggctgaggcag

SEQ ID NO: 509166 - DNA, 20 bp, Artificial Sequence
  chemically synthesized
ttttgtatttttagtagaga

SEQ ID NO: 509167 - DNA, 20 bp, Artificial Sequence
  chemically synthesized
tctcctcctacctcagcctc

SEQ ID NO: 509168 - DNA, 20 bp, Artificial Sequence
  chemically synthesized
ctcactgcaagctccgcctc

SEQ ID NO: 509169 - DNA, 20 bp, Artificial Sequence
  chemically synthesized
tcttgctgttttgcccaggc

SEQ ID NO: 509170 - DNA, 20 bp, Artificial Sequence
  chemically synthesized
ttttttttttttaaaagaga

SEQ ID NO: 509171 - DNA, 20 bp, Artificial Sequence
  chemically synthesized
aggagaaaggtaaaaaaatc

SEQ ID NO: 509172 - DNA, 20 bp, Artificial Sequence
  chemically synthesized
actagaaattgtctccagaa

SEQ ID NO: 509173 - DNA, 20 bp, Artificial Sequence
  chemically synthesized
ctagtcataatttctactcg

SEQ ID NO: 509174 - DNA, 20 bp, Artificial Sequence
  chemically synthesized
tttctagtcagagaaattct

SEQ ID NO: 509175 - DNA, 20 bp, Artificial Sequence
  chemically synthesized
cagcaatagccttgatactt

SEQ ID NO: 509176 - DNA, 20 bp, Artificial Sequence
  chemically synthesized
aagatcagacagatagtaaa

SEQ ID NO: 509177 - DNA, 20 bp, Artificial Sequence
  chemically synthesized
agtttactatctgtctgatc

SEQ ID NO: 509178 - DNA, 20 bp, Artificial Sequence
  chemically synthesized
tatttttcttgttttataga

SEQ ID NO: 509179 - DNA, 20 bp, Artificial Sequence
  chemically synthesized
gcagagcatttcttgggatc

SEQ ID NO: 509180 - DNA, 20 bp, Artificial Sequence
  chemically synthesized
aggcattgcagagcatttct

SEQ ID NO: 509181 - DNA, 20 bp, Artificial Sequence
  chemically synthesized
tgatttttatggggaaacag

SEQ ID NO: 509182 - DNA, 20 bp, Artificial Sequence
  chemically synthesized
acttgattacttatctcagt

SEQ ID NO: 509183 - DNA, 20 bp, Artificial Sequence
  chemically synthesized
agttttatatcactgataaa

SEQ ID NO: 509184 - DNA, 20 bp, Artificial Sequence
  chemically synthesized
agtcgtatcatactttaagg

SEQ ID NO: 509185 - DNA, 20 bp, Artificial Sequence
  chemically synthesized
agtatgatacgactgttaac

SEQ ID NO: 509186 - DNA, 20 bp, Artificial Sequence
  chemically synthesized
caaaaacagttttattggtc

SEQ ID NO: 509187 - DNA, 20 bp, Artificial Sequence
  chemically synthesized
atgatacatttaaatgaact

SEQ ID NO: 509188 - DNA, 20 bp, Artificial Sequence
  chemically synthesized
tgtatcatacttctttttca

SEQ ID NO: 509189 - DNA, 20 bp, Artificial Sequence
  chemically synthesized
catggagtctaagtcaatgc

SEQ ID NO: 509190 - DNA, 20 bp, Artificial Sequence
  chemically synthesized
tctaagtcaatgcatggatg

SEQ ID NO: 509191 - DNA, 20 bp, Artificial Sequence
  chemically synthesized
actgaggggtaaaaagatta

SEQ ID NO: 509192 - DNA, 20 bp, Artificial Sequence
  chemically synthesized
ttggaaataatcttttactg

SEQ ID NO: 509193 - DNA, 20 bp, Artificial Sequence
  chemically synthesized
aaaagattatttccaagata

SEQ ID NO: 509194 - DNA, 20 bp, Artificial Sequence
  chemically synthesized
tccaagataaaggattacag

SEQ ID NO: 509195 - DNA, 20 bp, Artificial Sequence
  chemically synthesized
gaagagcatttctgaacaac

SEQ ID NO: 509196 - DNA, 20 bp, Artificial Sequence
  chemically synthesized
aaacacagcggaaatgtgtc

SEQ ID NO: 509197 - DNA, 20 bp, Artificial Sequence
  chemically synthesized
tcagtaatcatttttatgct

SEQ ID NO: 509198 - DNA, 20 bp, Artificial Sequence
  chemically synthesized
gtcatgtacagtgttgcatg

SEQ ID NO: 509199 - DNA, 20 bp, Artificial Sequence
  chemically synthesized
tatttaatagtgtcattagg

SEQ ID NO: 509200 - DNA, 20 bp, Artificial Sequence
  chemically synthesized
aatatagatagggcctgaaa

SEQ ID NO: 509201 - DNA, 20 bp, Artificial Sequence
  chemically synthesized
gttcaaagttaagccctaat

SEQ ID NO: 509202 - DNA, 20 bp, Artificial Sequence
  chemically synthesized
acaacagctgccattattta

SEQ ID NO: 509203 - DNA, 20 bp, Artificial Sequence
  chemically synthesized
catttttcactacaacagat

SEQ ID NO: 509204 - DNA, 20 bp, Artificial Sequence
  chemically synthesized
atcagggtgatagaaattag

SEQ ID NO: 509205 - DNA, 20 bp, Artificial Sequence
  chemically synthesized
gggacttaaaaccaggttgt

SEQ ID NO: 509206 - DNA, 20 bp, Artificial Sequence
  chemically synthesized
attgggataaagacgtgttt

SEQ ID NO: 509207 - DNA, 20 bp, Artificial Sequence
  chemically synthesized
tttaaagagattgatcatat

SEQ ID NO: 509208 - DNA, 20 bp, Artificial Sequence
  chemically synthesized
aatctctttaaatgaagaaa

SEQ ID NO: 509209 - DNA, 20 bp, Artificial Sequence
  chemically synthesized
ttaaatgaagaaaatgaatt

SEQ ID NO: 509210 - DNA, 20 bp, Artificial Sequence
  chemically synthesized
ttttttctgtttttttgaga

SEQ ID NO: 509211 - DNA, 20 bp, Artificial Sequence
  chemically synthesized
attgctcttcctgcccaggc

SEQ ID NO: 509212 - DNA, 20 bp, Artificial Sequence
  chemically synthesized
cccaggctggagtgcaatgg

SEQ ID NO: 509213 - DNA, 20 bp, Artificial Sequence
  chemically synthesized
ctcactgcagcctctccctt

SEQ ID NO: 509214 - DNA, 20 bp, Artificial Sequence
  chemically synthesized
tactcgggaggctgaggcag

SEQ ID NO: 509215 - DNA, 20 bp, Artificial Sequence
  chemically synthesized
cattctcctgcctcagcctc

SEQ ID NO: 509216 - DNA, 20 bp, Artificial Sequence
  chemically synthesized
gcctcagcctcccgagtagc

SEQ ID NO: 509217 - DNA, 20 bp, Artificial Sequence
  chemically synthesized
ttttatatttttaatagaga

SEQ ID NO: 509218 - DNA, 20 bp, Artificial Sequence
  chemically synthesized
tgggcggatgacctgaggtc

SEQ ID NO: 509219 - DNA, 20 bp, Artificial Sequence
  chemically synthesized
actttgggaggctgaggtgg

SEQ ID NO: 509220 - DNA, 20 bp, Artificial Sequence
  chemically synthesized
acctcagcctcccaaagtgc

SEQ ID NO: 509221 - DNA, 20 bp, Artificial Sequence
  chemically synthesized
agtagcttccaaaccattga

SEQ ID NO: 509222 - DNA, 20 bp, Artificial Sequence
  chemically synthesized
acctcgtcttcattacgttg

SEQ ID NO: 509223 - DNA, 20 bp, Artificial Sequence
  chemically synthesized
tatcacactgaggaagatac

SEQ ID NO: 509224 - DNA, 20 bp, Artificial Sequence
  chemically synthesized
catggataatggaggattta

SEQ ID NO: 509225 - DNA, 20 bp, Artificial Sequence
  chemically synthesized
taaggacatcatggataatg

SEQ ID NO: 509226 - DNA, 20 bp, Artificial Sequence
  chemically synthesized
cagtgtgaaataaggacatc

SEQ ID NO: 509227 - DNA, 20 bp, Artificial Sequence
  chemically synthesized
gtagtaggtgtatgtattta

SEQ ID NO: 509228 - DNA, 20 bp, Artificial Sequence
  chemically synthesized
gacacatgccttcttttaga

SEQ ID NO: 509229 - DNA, 20 bp, Artificial Sequence
  chemically synthesized
attaacagaaggcgcagagt

SEQ ID NO: 509230 - DNA, 20 bp, Artificial Sequence
  chemically synthesized
atagggattaacagaaggcg

SEQ ID NO: 509231 - DNA, 20 bp, Artificial Sequence
  chemically synthesized
taacatcaaaggcaaatcat

SEQ ID NO: 509232 - DNA, 20 bp, Artificial Sequence
  chemically synthesized
tgagtggttctgcaatagtg

SEQ ID NO: 509233 - DNA, 20 bp, Artificial Sequence
  chemically synthesized
aggcacaatgtagcatttct

SEQ ID NO: 509234 - DNA, 20 bp, Artificial Sequence
  chemically synthesized
ctccagttaagaagacaaaa

SEQ ID NO: 509235 - DNA, 20 bp, Artificial Sequence
  chemically synthesized
gggtatcatacgtacacata

SEQ ID NO: 509236 - DNA, 20 bp, Artificial Sequence
  chemically synthesized
accttttgtttaataggcta

SEQ ID NO: 509237 - DNA, 20 bp, Artificial Sequence
  chemically synthesized
tttttttatactttaaatac

SEQ ID NO: 509238 - DNA, 20 bp, Artificial Sequence
  chemically synthesized
tgatgttaaatgacgagtta

SEQ ID NO: 509239 - DNA, 20 bp, Artificial Sequence
  chemically synthesized
gatatacctgatgttaaatg

SEQ ID NO: 509240 - DNA, 20 bp, Artificial Sequence
  chemically synthesized
gtggggtggggggagggggg

SEQ ID NO: 509241 - DNA, 20 bp, Artificial Sequence
  chemically synthesized
tcacacactgggtcccgtag

SEQ ID NO: 509242 - DNA, 20 bp, Artificial Sequence
  chemically synthesized
aggaaggggaacatcacaca

SEQ ID NO: 509243 - DNA, 20 bp, Artificial Sequence
  chemically synthesized
atgttccccttcctgtgtcc

SEQ ID NO: 509244 - DNA, 20 bp, Artificial Sequence
  chemically synthesized
tcattgttcaattcccaccc

SEQ ID NO: 509245 - DNA, 20 bp, Artificial Sequence
  chemically synthesized
acatgttctcactcatgggt

SEQ ID NO: 509246 - DNA, 20 bp, Artificial Sequence
  chemically synthesized
aataccacatgttctcactc

SEQ ID NO: 509247 - DNA, 20 bp, Artificial Sequence
  chemically synthesized
tgtccttgcgttagcttgct

SEQ ID NO: 509248 - DNA, 20 bp, Artificial Sequence
  chemically synthesized
ttcatgtcctttgtagggac

SEQ ID NO: 509249 - DNA, 20 bp, Artificial Sequence
  chemically synthesized
ctatgcagccataaaacagg

SEQ ID NO: 509250 - DNA, 20 bp, Artificial Sequence
  chemically synthesized
aatactatgcagccataaaa

SEQ ID NO: 509251 - DNA, 20 bp, Artificial Sequence
  chemically synthesized
aaatgtccatcgatgataga

SEQ ID NO: 509252 - DNA, 20 bp, Artificial Sequence
  chemically synthesized
agtctatcatcgatggacat

SEQ ID NO: 509253 - DNA, 20 bp, Artificial Sequence
  chemically synthesized
ggttccaagtctttgctatt

SEQ ID NO: 509254 - DNA, 20 bp, Artificial Sequence
  chemically synthesized
agcatgatttttaatccttt

SEQ ID NO: 509255 - DNA, 20 bp, Artificial Sequence
  chemically synthesized
cattactgggtatattccca

SEQ ID NO: 509256 - DNA, 20 bp, Artificial Sequence
  chemically synthesized
ctttgggaatatacccagta

SEQ ID NO: 509257 - DNA, 20 bp, Artificial Sequence
  chemically synthesized
ttacagtaatatacccatta

SEQ ID NO: 509258 - DNA, 20 bp, Artificial Sequence
  chemically synthesized
taatgggtatattactgtaa

SEQ ID NO: 509259 - DNA, 20 bp, Artificial Sequence
  chemically synthesized
attactgtaatgggataaaa

SEQ ID NO: 509260 - DNA, 20 bp, Artificial Sequence
  chemically synthesized
aatgggataaaatgggatgg

SEQ ID NO: 509261 - DNA, 20 bp, Artificial Sequence
  chemically synthesized
tttctagttctagatccttg

SEQ ID NO: 509262 - DNA, 20 bp, Artificial Sequence
  chemically synthesized
aagagagtgtgcaattcctc

SEQ ID NO: 509263 - DNA, 20 bp, Artificial Sequence
  chemically synthesized
ctagttcaaccattgtggaa

SEQ ID NO: 509264 - DNA, 20 bp, Artificial Sequence
  chemically synthesized
gagcacttttacactgttga

SEQ ID NO: 509265 - DNA, 20 bp, Artificial Sequence
  chemically synthesized
aggaaacaacaggtgctgga

SEQ ID NO: 509266 - DNA, 20 bp, Artificial Sequence
  chemically synthesized
gagataccattgcacatagt

SEQ ID NO: 509267 - DNA, 20 bp, Artificial Sequence
  chemically synthesized
accctatcaaaaagtgggca

SEQ ID NO: 509268 - DNA, 20 bp, Artificial Sequence
  chemically synthesized
atcctttgcccactttttga

SEQ ID NO: 509269 - DNA, 20 bp, Artificial Sequence
  chemically synthesized
gtttgacttctttgtagatt

SEQ ID NO: 509270 - DNA, 20 bp, Artificial Sequence
  chemically synthesized
tctggcaaagggctaatatc

SEQ ID NO: 509271 - DNA, 20 bp, Artificial Sequence
  chemically synthesized
catagtgaacaggcaaccta

SEQ ID NO: 509272 - DNA, 20 bp, Artificial Sequence
  chemically synthesized
caagagtcaaaattgacaaa

SEQ ID NO: 509273 - DNA, 20 bp, Artificial Sequence
  chemically synthesized
acaccaaaagcaatggcaac

SEQ ID NO: 509274 - DNA, 20 bp, Artificial Sequence
  chemically synthesized
atacctttcaggacataggc

SEQ ID NO: 509275 - DNA, 20 bp, Artificial Sequence
  chemically synthesized
atttaagtctttgatccatc

SEQ ID NO: 509276 - DNA, 20 bp, Artificial Sequence
  chemically synthesized
tatacaaaaatgaattcaag

SEQ ID NO: 509277 - DNA, 20 bp, Artificial Sequence
  chemically synthesized
tccttacacattatacaaaa

SEQ ID NO: 509278 - DNA, 20 bp, Artificial Sequence
  chemically synthesized
ttttgtataatgtgtaagga

SEQ ID NO: 509279 - DNA, 20 bp, Artificial Sequence
  chemically synthesized
ccatatgtagaaagctgaaa

SEQ ID NO: 509280 - DNA, 20 bp, Artificial Sequence
  chemically synthesized
ccagcaccatttattaaata

SEQ ID NO: 509281 - DNA, 20 bp, Artificial Sequence
  chemically synthesized
agaaaaacaagcaatgggga

SEQ ID NO: 509282 - DNA, 20 bp, Artificial Sequence
  chemically synthesized
aaacagcatggtactggtat

SEQ ID NO: 509283 - DNA, 20 bp, Artificial Sequence
  chemically synthesized
ccagctttgttcttttggct

SEQ ID NO: 509284 - DNA, 20 bp, Artificial Sequence
  chemically synthesized
gctaccaatgactttctaca

SEQ ID NO: 509285 - DNA, 20 bp, Artificial Sequence
  chemically synthesized
aaagtcattggtagcttgat

SEQ ID NO: 509286 - DNA, 20 bp, Artificial Sequence
  chemically synthesized
gtagcttgatggggatggca

SEQ ID NO: 509287 - DNA, 20 bp, Artificial Sequence
  chemically synthesized
attctatgctcatggatagg

SEQ ID NO: 509288 - DNA, 20 bp, Artificial Sequence
  chemically synthesized
attcttcctatccatgagca

SEQ ID NO: 509289 - DNA, 20 bp, Artificial Sequence
  chemically synthesized
tggaagaacattctatgctc

SEQ ID NO: 509290 - DNA, 20 bp, Artificial Sequence
  chemically synthesized
tccttcacatcccttgcaag

SEQ ID NO: 509291 - DNA, 20 bp, Artificial Sequence
  chemically synthesized
acctaggaatccaacttgca

SEQ ID NO: 509292 - DNA, 20 bp, Artificial Sequence
  chemically synthesized
tcaaagagaataaaatacct

SEQ ID NO: 509293 - DNA, 20 bp, Artificial Sequence
  chemically synthesized
ccattcacaattgcttcaaa

SEQ ID NO: 509294 - DNA, 20 bp, Artificial Sequence
  chemically synthesized
ttattctctttgaagcaatt

SEQ ID NO: 509295 - DNA, 20 bp, Artificial Sequence
  chemically synthesized
ctctttgaagcaattgtgaa

SEQ ID NO: 509296 - DNA, 20 bp, Artificial Sequence
  chemically synthesized
ataacagacagaggcaaatc

SEQ ID NO: 509297 - DNA, 20 bp, Artificial Sequence
  chemically synthesized
tctgtctgttattggtgtat

SEQ ID NO: 509298 - DNA, 20 bp, Artificial Sequence
  chemically synthesized
aagcaacttcagcaaagtct

SEQ ID NO: 509299 - DNA, 20 bp, Artificial Sequence
  chemically synthesized
tagattttgggctgagacaa

SEQ ID NO: 509300 - DNA, 20 bp, Artificial Sequence
  chemically synthesized
ttgacttcctcttttcctaa

SEQ ID NO: 509301 - DNA, 20 bp, Artificial Sequence
  chemically synthesized
tcaggcagaagaaggaaata

SEQ ID NO: 509302 - DNA, 20 bp, Artificial Sequence
  chemically synthesized
ccggaacttccaacactatg

SEQ ID NO: 509303 - DNA, 20 bp, Artificial Sequence
  chemically synthesized
cttccaacactatgttgaat

SEQ ID NO: 509304 - DNA, 20 bp, Artificial Sequence
  chemically synthesized
tttgaaaactggcacaagac

SEQ ID NO: 509305 - DNA, 20 bp, Artificial Sequence
  chemically synthesized
gtcttgtgccagttttcaaa

SEQ ID NO: 509306 - DNA, 20 bp, Artificial Sequence
  chemically synthesized
aacccacagccactatcata

SEQ ID NO: 509307 - DNA, 20 bp, Artificial Sequence
  chemically synthesized
cattcaatatgatagtggct

SEQ ID NO: 509308 - DNA, 20 bp, Artificial Sequence
  chemically synthesized
ccatcaatacctaatttatt

SEQ ID NO: 509309 - DNA, 20 bp, Artificial Sequence
  chemically synthesized
agtttttagcatgaaggttg

SEQ ID NO: 509310 - DNA, 20 bp, Artificial Sequence
  chemically synthesized
ttgaaccagccctgcatccc

SEQ ID NO: 509311 - DNA, 20 bp, Artificial Sequence
  chemically synthesized
tatcaagtgggcttcatccc

SEQ ID NO: 509312 - DNA, 20 bp, Artificial Sequence
  chemically synthesized
atgaagcccacttgataatg

SEQ ID NO: 509313 - DNA, 20 bp, Artificial Sequence
  chemically synthesized
ataagctttttgatgtgctg

SEQ ID NO: 509314 - DNA, 20 bp, Artificial Sequence
  chemically synthesized
tttttgatgtgctgctggat

SEQ ID NO: 509315 - DNA, 20 bp, Artificial Sequence
  chemically synthesized
ctcaataaaatactggcaat

SEQ ID NO: 509316 - DNA, 20 bp, Artificial Sequence
  chemically synthesized
cggattgccagtattttatt

SEQ ID NO: 509317 - DNA, 20 bp, Artificial Sequence
  chemically synthesized
tttttgcatcaatgttcatc

SEQ ID NO: 509318 - DNA, 20 bp, Artificial Sequence
  chemically synthesized
cagagacaaaacaaaaaaaa

SEQ ID NO: 509319 - DNA, 20 bp, Artificial Sequence
  chemically synthesized
tctctgccaggctttggtat

SEQ ID NO: 509320 - DNA, 20 bp, Artificial Sequence
  chemically synthesized
gatgatgcttgcctcataaa

SEQ ID NO: 509321 - DNA, 20 bp, Artificial Sequence
  chemically synthesized
gcctcataaaatgagttagg

SEQ ID NO: 509322 - DNA, 20 bp, Artificial Sequence
  chemically synthesized
ttccaatgaatagaaaaaga

SEQ ID NO: 509323 - DNA, 20 bp, Artificial Sequence
  chemically synthesized
ttccctctttttctattcat

SEQ ID NO: 509324 - DNA, 20 bp, Artificial Sequence
  chemically synthesized
ttccttctgaaactattcca

SEQ ID NO: 509325 - DNA, 20 bp, Artificial Sequence
  chemically synthesized
ttcattggaatagtttcaga

SEQ ID NO: 509326 - DNA, 20 bp, Artificial Sequence
  chemically synthesized
gctcttccttgtacctctgg

SEQ ID NO: 509327 - DNA, 20 bp, Artificial Sequence
  chemically synthesized
acctctggtagaattcggct

SEQ ID NO: 509328 - DNA, 20 bp, Artificial Sequence
  chemically synthesized
aggaccagatggattcacag

SEQ ID NO: 509329 - DNA, 20 bp, Artificial Sequence
  chemically synthesized
caaaaaaagtccaggaccag

SEQ ID NO: 509330 - DNA, 20 bp, Artificial Sequence
  chemically synthesized
agcctgttattggtctattc

SEQ ID NO: 509331 - DNA, 20 bp, Artificial Sequence
  chemically synthesized
taaaccaggaagttgaatcc

SEQ ID NO: 509332 - DNA, 20 bp, Artificial Sequence
  chemically synthesized
cccaagactaaaccaggaag

SEQ ID NO: 509333 - DNA, 20 bp, Artificial Sequence
  chemically synthesized
acttcctggtttagtcttgg

SEQ ID NO: 509334 - DNA, 20 bp, Artificial Sequence
  chemically synthesized
ttgggagggtgtatgtgtcc

SEQ ID NO: 509335 - DNA, 20 bp, Artificial Sequence
  chemically synthesized
aactagaaaatctagaagga

SEQ ID NO: 509336 - DNA, 20 bp, Artificial Sequence
  chemically synthesized
aataaactagaaaatctaga

SEQ ID NO: 509337 - DNA, 20 bp, Artificial Sequence
  chemically synthesized
cagttttctctgatggtagt

SEQ ID NO: 509338 - DNA, 20 bp, Artificial Sequence
  chemically synthesized
gatggtagtttgaatttctg

SEQ ID NO: 509339 - DNA, 20 bp, Artificial Sequence
  chemically synthesized
atgcaataaaaaataataaa

SEQ ID NO: 509340 - DNA, 20 bp, Artificial Sequence
  chemically synthesized
agactaataagaaaagagag

SEQ ID NO: 509341 - DNA, 20 bp, Artificial Sequence
  chemically synthesized
aaaagccctttaaaaaatca

SEQ ID NO: 509342 - DNA, 20 bp, Artificial Sequence
  chemically synthesized
ttcttgccttctgctagctt

SEQ ID NO: 509343 - DNA, 20 bp, Artificial Sequence
  chemically synthesized
agttcttttaattgttatgt

SEQ ID NO: 509344 - DNA, 20 bp, Artificial Sequence
  chemically synthesized
gtagagggaaatttatagca

SEQ ID NO: 509345 - DNA, 20 bp, Artificial Sequence
  chemically synthesized
agaacaaagacacaacatac

SEQ ID NO: 509346 - DNA, 20 bp, Artificial Sequence
  chemically synthesized
aacctgctgctgaatgacta

SEQ ID NO: 509347 - DNA, 20 bp, Artificial Sequence
  chemically synthesized
ggaaactgaacaacctgctg

SEQ ID NO: 509348 - DNA, 20 bp, Artificial Sequence
  chemically synthesized
gttgttcagtttccatgtag

SEQ ID NO: 509349 - DNA, 20 bp, Artificial Sequence
  chemically synthesized
ttccatgtagttgagtggtt

SEQ ID NO: 509350 - DNA, 20 bp, Artificial Sequence
  chemically synthesized
atgtagttgagtggttttga

SEQ ID NO: 509351 - DNA, 20 bp, Artificial Sequence
  chemically synthesized
tttgagtgagtttcttaatc

SEQ ID NO: 509352 - DNA, 20 bp, Artificial Sequence
  chemically synthesized
agttcaatcaaactagaact

SEQ ID NO: 509353 - DNA, 20 bp, Artificial Sequence
  chemically synthesized
ctgttcttttacatttgctg

SEQ ID NO: 509354 - DNA, 20 bp, Artificial Sequence
  chemically synthesized
tccaactatgtggtcaattt

SEQ ID NO: 509355 - DNA, 20 bp, Artificial Sequence
  chemically synthesized
aagtgtgatgtggtgctgag

SEQ ID NO: 509356 - DNA, 20 bp, Artificial Sequence
  chemically synthesized
gaatgtataatctgttgatt

SEQ ID NO: 509357 - DNA, 20 bp, Artificial Sequence
  chemically synthesized
taatctgttgattaggggtg

SEQ ID NO: 509358 - DNA, 20 bp, Artificial Sequence
  chemically synthesized
gaggtccgcttgttgcagag

SEQ ID NO: 509359 - DNA, 20 bp, Artificial Sequence
  chemically synthesized
tgcagagctgagttcaattc

SEQ ID NO: 509360 - DNA, 20 bp, Artificial Sequence
  chemically synthesized
gaatgtcaacaaggatatcc

SEQ ID NO: 509361 - DNA, 20 bp, Artificial Sequence
  chemically synthesized
cagtgagacagaatgtcaac

SEQ ID NO: 509362 - DNA, 20 bp, Artificial Sequence
  chemically synthesized
cattagacagatcagtgaga

SEQ ID NO: 509363 - DNA, 20 bp, Artificial Sequence
  chemically synthesized
gatctgtctaatgttgtcag

SEQ ID NO: 509364 - DNA, 20 bp, Artificial Sequence
  chemically synthesized
gtctcccattattaacgtgt

SEQ ID NO: 509365 - DNA, 20 bp, Artificial Sequence
  chemically synthesized
ggtctataaggacttgcttt

SEQ ID NO: 509366 - DNA, 20 bp, Artificial Sequence
  chemically synthesized
taaggacttgctttatgaat

SEQ ID NO: 509367 - DNA, 20 bp, Artificial Sequence
  chemically synthesized
ctttatgaatctgggtgctc

SEQ ID NO: 509368 - DNA, 20 bp, Artificial Sequence
  chemically synthesized
tgaatctgggtgctcctgaa

SEQ ID NO: 509369 - DNA, 20 bp, Artificial Sequence
  chemically synthesized
gaattgggtgcatatatatt

SEQ ID NO: 509370 - DNA, 20 bp, Artificial Sequence
  chemically synthesized
aggatagttagctcttcttg

SEQ ID NO: 509371 - DNA, 20 bp, Artificial Sequence
  chemically synthesized
aggccattacataatggtaa

SEQ ID NO: 509372 - DNA, 20 bp, Artificial Sequence
  chemically synthesized
aagtctgttttatcagacac

SEQ ID NO: 509373 - DNA, 20 bp, Artificial Sequence
  chemically synthesized
aatgtttttcaaaaaaaggc

SEQ ID NO: 509374 - DNA, 20 bp, Artificial Sequence
  chemically synthesized
cagagccatttttttaatgt

SEQ ID NO: 509375 - DNA, 20 bp, Artificial Sequence
  chemically synthesized
gtgaagaaagatacatattg

SEQ ID NO: 509376 - DNA, 20 bp, Artificial Sequence
  chemically synthesized
aaactttctaatactacata

SEQ ID NO: 509377 - DNA, 20 bp, Artificial Sequence
  chemically synthesized
tgtaaccaagtattggccag

SEQ ID NO: 509378 - DNA, 20 bp, Artificial Sequence
  chemically synthesized
tttacgtcttaatgacgaag

SEQ ID NO: 509379 - DNA, 20 bp, Artificial Sequence
  chemically synthesized
ctgtcttcgtagtcacggtt

SEQ ID NO: 509380 - DNA, 20 bp, Artificial Sequence
  chemically synthesized
actacgaagacagcgtccca

SEQ ID NO: 509381 - DNA, 20 bp, Artificial Sequence
  chemically synthesized
aaaaactgggcaacaggact

SEQ ID NO: 509382 - DNA, 20 bp, Artificial Sequence
  chemically synthesized
ggcaacaggactatggatcc

SEQ ID NO: 509383 - DNA, 20 bp, Artificial Sequence
  chemically synthesized
taggaagtctctgctcattc

SEQ ID NO: 509384 - DNA, 20 bp, Artificial Sequence
  chemically synthesized
ctcttaaatgttgtgtagat

SEQ ID NO: 509385 - DNA, 20 bp, Artificial Sequence
  chemically synthesized
aaggatggatgaactaaaaa

SEQ ID NO: 509386 - DNA, 20 bp, Artificial Sequence
  chemically synthesized
gcactaacaaaaacacaagg

SEQ ID NO: 509387 - DNA, 20 bp, Artificial Sequence
  chemically synthesized
cgtggcactaacaaaaacac

SEQ ID NO: 509388 - DNA, 20 bp, Artificial Sequence
  chemically synthesized
aatctcagctgctagaaaat

SEQ ID NO: 509389 - DNA, 20 bp, Artificial Sequence
  chemically synthesized
gtatctgtaaaagcttatat

SEQ ID NO: 509390 - DNA, 20 bp, Artificial Sequence
  chemically synthesized
tatgttttagagagacagag

SEQ ID NO: 509391 - DNA, 20 bp, Artificial Sequence
  chemically synthesized
gagagtatgttttagagaga

SEQ ID NO: 509392 - DNA, 20 bp, Artificial Sequence
  chemically synthesized
aaatgactggaaccttcatt

SEQ ID NO: 509393 - DNA, 20 bp, Artificial Sequence
  chemically synthesized
tccccgccttcctacaatgc

SEQ ID NO: 509394 - DNA, 20 bp, Artificial Sequence
  chemically synthesized
gtgtactgtgctgttaggca

SEQ ID NO: 509395 - DNA, 20 bp, Artificial Sequence
  chemically synthesized
taaatatttactaaattgtt

SEQ ID NO: 509396 - DNA, 20 bp, Artificial Sequence
  chemically synthesized
accaatcaataccttgaaaa

SEQ ID NO: 509397 - DNA, 20 bp, Artificial Sequence
  chemically synthesized
gaagacatatatttgaaact

SEQ ID NO: 509398 - DNA, 20 bp, Artificial Sequence
  chemically synthesized
aacacatatgaaatatgaat

SEQ ID NO: 509399 - DNA, 20 bp, Artificial Sequence
  chemically synthesized
tgtataaacacatatgaaat

SEQ ID NO: 509400 - DNA, 20 bp, Artificial Sequence
  chemically synthesized
ttggtatactatatatgtat

SEQ ID NO: 509401 - DNA, 20 bp, Artificial Sequence
  chemically synthesized
atacccaaagatataaatgg

SEQ ID NO: 509402 - DNA, 20 bp, Artificial Sequence
  chemically synthesized
taattctaccatttatatct

SEQ ID NO: 509403 - DNA, 20 bp, Artificial Sequence
  chemically synthesized
tgaagtacaggaaaaaataa

SEQ ID NO: 509404 - DNA, 20 bp, Artificial Sequence
  chemically synthesized
tatgagaaaggttctattgt

SEQ ID NO: 509405 - DNA, 20 bp, Artificial Sequence
  chemically synthesized
ctgaccttccattgatttag

SEQ ID NO: 509406 - DNA, 20 bp, Artificial Sequence
  chemically synthesized
ttaaaaagaaatcttttata

SEQ ID NO: 509407 - DNA, 20 bp, Artificial Sequence
  chemically synthesized
cccccttttagggtgtttgt

SEQ ID NO: 509408 - DNA, 20 bp, Artificial Sequence
  chemically synthesized
tggaaataggtccccccttt

SEQ ID NO: 509409 - DNA, 20 bp, Artificial Sequence
  chemically synthesized
gggggacctatttccaagat

SEQ ID NO: 509410 - DNA, 20 bp, Artificial Sequence
  chemically synthesized
ccacacctcataggtgtgac

SEQ ID NO: 509411 - DNA, 20 bp, Artificial Sequence
  chemically synthesized
atgaggtgtgggaggaaaaa

SEQ ID NO: 509412 - DNA, 20 bp, Artificial Sequence
  chemically synthesized
aaggaatgtcggtttgttta

SEQ ID NO: 509413 - DNA, 20 bp, Artificial Sequence
  chemically synthesized
tcatgaatctctgtcagcca

SEQ ID NO: 509414 - DNA, 20 bp, Artificial Sequence
  chemically synthesized
atccttcttctctggacttc

SEQ ID NO: 509415 - DNA, 20 bp, Artificial Sequence
  chemically synthesized
attcatgaagtccagagaag

SEQ ID NO: 509416 - DNA, 20 bp, Artificial Sequence
  chemically synthesized
gaaacatccaccaaacagta

SEQ ID NO: 509417 - DNA, 20 bp, Artificial Sequence
  chemically synthesized
taataactctgtactgtttg

SEQ ID NO: 509418 - DNA, 20 bp, Artificial Sequence
  chemically synthesized
tttaaaagtcagtatttggt

SEQ ID NO: 509419 - DNA, 20 bp, Artificial Sequence
  chemically synthesized
agtatttggttggaattcat

SEQ ID NO: 509420 - DNA, 20 bp, Artificial Sequence
  chemically synthesized
cgtttcaattaccaactcat

SEQ ID NO: 509421 - DNA, 20 bp, Artificial Sequence
  chemically synthesized
gtactaaatttaatttaaaa

SEQ ID NO: 509422 - DNA, 20 bp, Artificial Sequence
  chemically synthesized
ggattaaggaaaataacatt

SEQ ID NO: 509423 - DNA, 20 bp, Artificial Sequence
  chemically synthesized
attaataaaattgttaaact

SEQ ID NO: 509424 - DNA, 20 bp, Artificial Sequence
  chemically synthesized
aataggaaaaaaatgattca

SEQ ID NO: 509425 - DNA, 20 bp, Artificial Sequence
  chemically synthesized
ttgcattttaaaagtatcca

SEQ ID NO: 509426 - DNA, 20 bp, Artificial Sequence
  chemically synthesized
ttgtctaaagcagtttactt

SEQ ID NO: 509427 - DNA, 20 bp, Artificial Sequence
  chemically synthesized
gcacttaaataatattcctc

SEQ ID NO: 509428 - DNA, 20 bp, Artificial Sequence
  chemically synthesized
atggactacggtcattctag

SEQ ID NO: 509429 - DNA, 20 bp, Artificial Sequence
  chemically synthesized
tctagaatgaccgtagtcca

SEQ ID NO: 509430 - DNA, 20 bp, Artificial Sequence
  chemically synthesized
aattccaaaacgggctacat

SEQ ID NO: 509431 - DNA, 20 bp, Artificial Sequence
  chemically synthesized
tattcccatgtagcccgttt

SEQ ID NO: 509432 - DNA, 20 bp, Artificial Sequence
  chemically synthesized
gaataaatgagtacatagct

SEQ ID NO: 509433 - DNA, 20 bp, Artificial Sequence
  chemically synthesized
catatagacttgtggaataa

SEQ ID NO: 509434 - DNA, 20 bp, Artificial Sequence
  chemically synthesized
tttctttacatatagacttg

SEQ ID NO: 509435 - DNA, 20 bp, Artificial Sequence
  chemically synthesized
gtcttggatcaaataacagg

SEQ ID NO: 509436 - DNA, 20 bp, Artificial Sequence
  chemically synthesized
aagcttaaggttaaggagtc

SEQ ID NO: 509437 - DNA, 20 bp, Artificial Sequence
  chemically synthesized
cagaaaaaagcttaaggtta

SEQ ID NO: 509438 - DNA, 20 bp, Artificial Sequence
  chemically synthesized
tacaatttgcagtgacagag

SEQ ID NO: 509439 - DNA, 20 bp, Artificial Sequence
  chemically synthesized
atctggagacaatacattaa

SEQ ID NO: 509440 - DNA, 20 bp, Artificial Sequence
  chemically synthesized
aatacattaagtgaataaac

SEQ ID NO: 509441 - DNA, 20 bp, Artificial Sequence
  chemically synthesized
gagatagcaatctatggcct

SEQ ID NO: 509442 - DNA, 20 bp, Artificial Sequence
  chemically synthesized
ccccctccaattgattctca

SEQ ID NO: 509443 - DNA, 20 bp, Artificial Sequence
  chemically synthesized
gagtgggaaagtgacccaat

SEQ ID NO: 509444 - DNA, 20 bp, Artificial Sequence
  chemically synthesized
tggctagcttggacatgcaa

SEQ ID NO: 509445 - DNA, 20 bp, Artificial Sequence
  chemically synthesized
tgaggccgacttaaagtttc

SEQ ID NO: 509446 - DNA, 20 bp, Artificial Sequence
  chemically synthesized
actttaagtcggcctcactt

SEQ ID NO: 509447 - DNA, 20 bp, Artificial Sequence
  chemically synthesized
atgaggtcaaattcaggttc

SEQ ID NO: 509448 - DNA, 20 bp, Artificial Sequence
  chemically synthesized
ctacctataaattccagaac

SEQ ID NO: 509449 - DNA, 20 bp, Artificial Sequence
  chemically synthesized
tctattttcaggtgtgtacc

SEQ ID NO: 509450 - DNA, 20 bp, Artificial Sequence
  chemically synthesized
atagatatgatactaattta

SEQ ID NO: 509451 - DNA, 20 bp, Artificial Sequence
  chemically synthesized
ttgaatggcaaagggtgatg

SEQ ID NO: 509452 - DNA, 20 bp, Artificial Sequence
  chemically synthesized
tttataaaagttgaatggca

SEQ ID NO: 509453 - DNA, 20 bp, Artificial Sequence
  chemically synthesized
tgaaagtgattttataaaag

SEQ ID NO: 509454 - DNA, 20 bp, Artificial Sequence
  chemically synthesized
tgtttttatttagtgcaacc

SEQ ID NO: 509455 - DNA, 20 bp, Artificial Sequence
  chemically synthesized
attgttgttagttctctatt

SEQ ID NO: 509456 - DNA, 20 bp, Artificial Sequence
  chemically synthesized
gagaactaacaacaataaag

SEQ ID NO: 509457 - DNA, 20 bp, Artificial Sequence
  chemically synthesized
gaaaagatgtgtcaatttag

SEQ ID NO: 509458 - DNA, 20 bp, Artificial Sequence
  chemically synthesized
aactggtgtatgttaaggag

SEQ ID NO: 509459 - DNA, 20 bp, Artificial Sequence
  chemically synthesized
gtgatatatgtgaaaggtaa

SEQ ID NO: 509460 - DNA, 20 bp, Artificial Sequence
  chemically synthesized
ataaataaagagaaagcaca

SEQ ID NO: 509461 - DNA, 20 bp, Artificial Sequence
  chemically synthesized
atataccacatctttgttta

SEQ ID NO: 509462 - DNA, 20 bp, Artificial Sequence
  chemically synthesized
agggatttctctcccttatg

SEQ ID NO: 509463 - DNA, 20 bp, Artificial Sequence
  chemically synthesized
ctacccattagttcccccat

SEQ ID NO: 509464 - DNA, 20 bp, Artificial Sequence
  chemically synthesized
aaatccctatgggggaacta

SEQ ID NO: 509465 - DNA, 20 bp, Artificial Sequence
  chemically synthesized
gggcatctatagtgcttctg

SEQ ID NO: 509466 - DNA, 20 bp, Artificial Sequence
  chemically synthesized
ctaattaggaagacaattat

SEQ ID NO: 509467 - DNA, 20 bp, Artificial Sequence
  chemically synthesized
tataacatactatatgtttg

SEQ ID NO: 509468 - DNA, 20 bp, Artificial Sequence
  chemically synthesized
catatcagtataaggtaaaa

SEQ ID NO: 509469 - DNA, 20 bp, Artificial Sequence
  chemically synthesized
gaggacattttttttcctaa

SEQ ID NO: 509470 - DNA, 20 bp, Artificial Sequence
  chemically synthesized
cagtaagtgaaataaacaag

SEQ ID NO: 509471 - DNA, 20 bp, Artificial Sequence
  chemically synthesized
gattccaagaatctctttcc

SEQ ID NO: 509472 - DNA, 20 bp, Artificial Sequence
  chemically synthesized
tattcaaggaaagagattct

SEQ ID NO: 509473 - DNA, 20 bp, Artificial Sequence
  chemically synthesized
aaggaataggaagagattcc

SEQ ID NO: 509474 - DNA, 20 bp, Artificial Sequence
  chemically synthesized
gacctttccttgaataggaa

SEQ ID NO: 509475 - DNA, 20 bp, Artificial Sequence
  chemically synthesized
caggctctgaagacctttcc

SEQ ID NO: 509476 - DNA, 20 bp, Artificial Sequence
  chemically synthesized
cttcagagcctgccatttca

SEQ ID NO: 509477 - DNA, 20 bp, Artificial Sequence
  chemically synthesized
aaatctaccagagtcttccc

SEQ ID NO: 509478 - DNA, 20 bp, Artificial Sequence
  chemically synthesized
caggtgttaatgaaatctac

SEQ ID NO: 509479 - DNA, 20 bp, Artificial Sequence
  chemically synthesized
actttccttgaggcagaggg

SEQ ID NO: 509480 - DNA, 20 bp, Artificial Sequence
  chemically synthesized
ttattactttccttgaggca

SEQ ID NO: 509481 - DNA, 20 bp, Artificial Sequence
  chemically synthesized
tttccactgctttcagccaa

SEQ ID NO: 509482 - DNA, 20 bp, Artificial Sequence
  chemically synthesized
ttttatcattggctcctaat

SEQ ID NO: 509483 - DNA, 20 bp, Artificial Sequence
  chemically synthesized
taataggagtaatcatgctt

SEQ ID NO: 509484 - DNA, 20 bp, Artificial Sequence
  chemically synthesized
acaactaaagcttttgatct

SEQ ID NO: 509485 - DNA, 20 bp, Artificial Sequence
  chemically synthesized
gtaaaaaaaaaactcaaaat

SEQ ID NO: 509486 - DNA, 20 bp, Artificial Sequence
  chemically synthesized
tcacttagcccaccctgatt

SEQ ID NO: 509487 - DNA, 20 bp, Artificial Sequence
  chemically synthesized
atttggtgaagatactagaa

SEQ ID NO: 509488 - DNA, 20 bp, Artificial Sequence
  chemically synthesized
aagatactagaagaggatta

SEQ ID NO: 509489 - DNA, 20 bp, Artificial Sequence
  chemically synthesized
ctttctatgttcacctcact

SEQ ID NO: 509490 - DNA, 20 bp, Artificial Sequence
  chemically synthesized
ccatttattttctgtaggta

SEQ ID NO: 509491 - DNA, 20 bp, Artificial Sequence
  chemically synthesized
atggagagagcattttaaaa

SEQ ID NO: 509492 - DNA, 20 bp, Artificial Sequence
  chemically synthesized
taaaatgctctctccatagc

SEQ ID NO: 509493 - DNA, 20 bp, Artificial Sequence
  chemically synthesized
tttcaggttggcaagtggct

SEQ ID NO: 509494 - DNA, 20 bp, Artificial Sequence
  chemically synthesized
tggcaaagtagttgaaaaga

SEQ ID NO: 509495 - DNA, 20 bp, Artificial Sequence
  chemically synthesized
aaaatctttgtcagcaaaat

SEQ ID NO: 509496 - DNA, 20 bp, Artificial Sequence
  chemically synthesized
gattatgttatcttaagtag

SEQ ID NO: 509497 - DNA, 20 bp, Artificial Sequence
  chemically synthesized
ctgacattatgcatcctatt

SEQ ID NO: 509498 - DNA, 20 bp, Artificial Sequence
  chemically synthesized
ggaaaatcagagatccttaa

SEQ ID NO: 509499 - DNA, 20 bp, Artificial Sequence
  chemically synthesized
gtctcttcacaggcttattt

SEQ ID NO: 509500 - DNA, 20 bp, Artificial Sequence
  chemically synthesized
aggagatacacacgatgaac

SEQ ID NO: 509501 - DNA, 20 bp, Artificial Sequence
  chemically synthesized
tcatcgtgtgtatctcctaa

SEQ ID NO: 509502 - DNA, 20 bp, Artificial Sequence
  chemically synthesized
tttaaagcacagtctacaca

SEQ ID NO: 509503 - DNA, 20 bp, Artificial Sequence
  chemically synthesized
cttcatcatctaaattcttt

SEQ ID NO: 509504 - DNA, 20 bp, Artificial Sequence
  chemically synthesized
gttctggtggtaaattctaa

SEQ ID NO: 509505 - DNA, 20 bp, Artificial Sequence
  chemically synthesized
accaccagaactgaagtata

SEQ ID NO: 509506 - DNA, 20 bp, Artificial Sequence
  chemically synthesized
ttaagtgtttaccatttgtg

SEQ ID NO: 509507 - DNA, 20 bp, Artificial Sequence
  chemically synthesized
ggttaaattagatgatttag

SEQ ID NO: 509508 - DNA, 20 bp, Artificial Sequence
  chemically synthesized
taatttaacctcacaacata

SEQ ID NO: 509509 - DNA, 20 bp, Artificial Sequence
  chemically synthesized
tgggcaagtttctaaccttt

SEQ ID NO: 509510 - DNA, 20 bp, Artificial Sequence
  chemically synthesized
ataaaaagcagagatgggaa

SEQ ID NO: 509511 - DNA, 20 bp, Artificial Sequence
  chemically synthesized
aggatttcgtgagacagata

SEQ ID NO: 509512 - DNA, 20 bp, Artificial Sequence
  chemically synthesized
agtatctgtctcacgaaatc

SEQ ID NO: 509513 - DNA, 20 bp, Artificial Sequence
  chemically synthesized
tctggcaacaagttaatatt

SEQ ID NO: 509514 - DNA, 20 bp, Artificial Sequence
  chemically synthesized
ctgggaaatgtttcttcccc

SEQ ID NO: 509515 - DNA, 20 bp, Artificial Sequence
  chemically synthesized
aataatgtgttatattttat

SEQ ID NO: 509516 - DNA, 20 bp, Artificial Sequence
  chemically synthesized
ctgtgagtgtatgagagact

SEQ ID NO: 509517 - DNA, 20 bp, Artificial Sequence
  chemically synthesized
ctaagtctctcatacactca

SEQ ID NO: 509518 - DNA, 20 bp, Artificial Sequence
  chemically synthesized
tctcatacactcacagaatt

SEQ ID NO: 509519 - DNA, 20 bp, Artificial Sequence
  chemically synthesized
agaaatctatccacaattct

SEQ ID NO: 509520 - DNA, 20 bp, Artificial Sequence
  chemically synthesized
ctaagggtgaaaaagactgg

SEQ ID NO: 509521 - DNA, 20 bp, Artificial Sequence
  chemically synthesized
atttctaagggtgaaaaaga

SEQ ID NO: 509522 - DNA, 20 bp, Artificial Sequence
  chemically synthesized
aattggtcacagaaatttct

SEQ ID NO: 509523 - DNA, 20 bp, Artificial Sequence
  chemically synthesized
atatagacaagctatctgtt

SEQ ID NO: 509524 - DNA, 20 bp, Artificial Sequence
  chemically synthesized
actgatttaaaatttaaaat

SEQ ID NO: 509525 - DNA, 20 bp, Artificial Sequence
  chemically synthesized
aaatatgcagcaaatattac

SEQ ID NO: 509526 - DNA, 20 bp, Artificial Sequence
  chemically synthesized
gttttaagttttgacaggtt

SEQ ID NO: 509527 - DNA, 20 bp, Artificial Sequence
  chemically synthesized
aaataagttgaaatgtacca

SEQ ID NO: 509528 - DNA, 20 bp, Artificial Sequence
  chemically synthesized
aaagcagaaatggaaagaaa

SEQ ID NO: 509529 - DNA, 20 bp, Artificial Sequence
  chemically synthesized
attttcaaaatagcctctag

SEQ ID NO: 509530 - DNA, 20 bp, Artificial Sequence
  chemically synthesized
ttataagtattatgcaaatc

SEQ ID NO: 509531 - DNA, 20 bp, Artificial Sequence
  chemically synthesized
acttccaaatagaatatgta

SEQ ID NO: 509532 - DNA, 20 bp, Artificial Sequence
  chemically synthesized
tatatataaaaacttccaaa

SEQ ID NO: 509533 - DNA, 20 bp, Artificial Sequence
  chemically synthesized
agctgccgtactttcatatt

SEQ ID NO: 509534 - DNA, 20 bp, Artificial Sequence
  chemically synthesized
gtaaattaaaattatgcaaa

SEQ ID NO: 509535 - DNA, 20 bp, Artificial Sequence
  chemically synthesized
tccagatttacagtttctgc

SEQ ID NO: 509536 - DNA, 20 bp, Artificial Sequence
  chemically synthesized
tcatgcagaaactgtaaatc

SEQ ID NO: 509537 - DNA, 20 bp, Artificial Sequence
  chemically synthesized
gaaatcgtcacaagtatgct

SEQ ID NO: 509538 - DNA, 20 bp, Artificial Sequence
  chemically synthesized
tatctgaaaagcttgatagg

SEQ ID NO: 509539 - DNA, 20 bp, Artificial Sequence
  chemically synthesized
catgcatgacatttgtttga

SEQ ID NO: 509540 - DNA, 20 bp, Artificial Sequence
  chemically synthesized
tcttttacaaatttattaac

SEQ ID NO: 509541 - DNA, 20 bp, Artificial Sequence
  chemically synthesized
aaactactcccagaataatt

SEQ ID NO: 509542 - DNA, 20 bp, Artificial Sequence
  chemically synthesized
cataaactcccaattattct

SEQ ID NO: 509543 - DNA, 20 bp, Artificial Sequence
  chemically synthesized
gtactctgataaactactcc

SEQ ID NO: 509544 - DNA, 20 bp, Artificial Sequence
  chemically synthesized
ttattctgggagtagtttat

SEQ ID NO: 509545 - DNA, 20 bp, Artificial Sequence
  chemically synthesized
tcaacaagaaagttaaggca

SEQ ID NO: 509546 - DNA, 20 bp, Artificial Sequence
  chemically synthesized
ggcaaaggatggaaaggctg

SEQ ID NO: 509547 - DNA, 20 bp, Artificial Sequence
  chemically synthesized
atcacacaaaataactaaaa

SEQ ID NO: 509548 - DNA, 20 bp, Artificial Sequence
  chemically synthesized
gtatactgtggcaattttcc

SEQ ID NO: 509549 - DNA, 20 bp, Artificial Sequence
  chemically synthesized
tgtactgtcaaaaatattga

SEQ ID NO: 509550 - DNA, 20 bp, Artificial Sequence
  chemically synthesized
acaaaggactttgaggtctg

SEQ ID NO: 509551 - DNA, 20 bp, Artificial Sequence
  chemically synthesized
tttagcgatatcacctgcca

SEQ ID NO: 509552 - DNA, 20 bp, Artificial Sequence
  chemically synthesized
aaggaagattgatgataatc

SEQ ID NO: 509553 - DNA, 20 bp, Artificial Sequence
  chemically synthesized
agattgatgataatcttgag

SEQ ID NO: 509554 - DNA, 20 bp, Artificial Sequence
  chemically synthesized
atatccctgtgctgatggca

SEQ ID NO: 509555 - DNA, 20 bp, Artificial Sequence
  chemically synthesized
gcattcgatgccatcagcac

SEQ ID NO: 509556 - DNA, 20 bp, Artificial Sequence
  chemically synthesized
cccttatttctcctcaaggc

SEQ ID NO: 509557 - DNA, 20 bp, Artificial Sequence
  chemically synthesized
cttgccttgaggagaaataa

SEQ ID NO: 509558 - DNA, 20 bp, Artificial Sequence
  chemically synthesized
ttaaggatatatcacctcta

SEQ ID NO: 509559 - DNA, 20 bp, Artificial Sequence
  chemically synthesized
acattattattttcatgatt

SEQ ID NO: 509560 - DNA, 20 bp, Artificial Sequence
  chemically synthesized
tattaaaaagcaaaataata

SEQ ID NO: 509561 - DNA, 20 bp, Artificial Sequence
  chemically synthesized
ttattattttgctttttaat

SEQ ID NO: 509562 - DNA, 20 bp, Artificial Sequence
  chemically synthesized
gataagtttaccaattgatt

SEQ ID NO: 509563 - DNA, 20 bp, Artificial Sequence
  chemically synthesized
ataaatgaagttatgatgta

SEQ ID NO: 509564 - DNA, 20 bp, Artificial Sequence
  chemically synthesized
agaagagcttgaaaatcata

SEQ ID NO: 509565 - DNA, 20 bp, Artificial Sequence
  chemically synthesized
tttgtactaagtgacagagc

SEQ ID NO: 509566 - DNA, 20 bp, Artificial Sequence
  chemically synthesized
gaaatctaagttctcattca

SEQ ID NO: 509567 - DNA, 20 bp, Artificial Sequence
  chemically synthesized
gccttcagtgacatgattca

SEQ ID NO: 509568 - DNA, 20 bp, Artificial Sequence
  chemically synthesized
aagagaaataagtaaaatag

SEQ ID NO: 509569 - DNA, 20 bp, Artificial Sequence
  chemically synthesized
gagaaaaggaagcaaggaag

SEQ ID NO: 509570 - DNA, 20 bp, Artificial Sequence
  chemically synthesized
aaaaagatttaaagatatga

SEQ ID NO: 509571 - DNA, 20 bp, Artificial Sequence
  chemically synthesized
gatatgagagagtaagtcat

SEQ ID NO: 509572 - DNA, 20 bp, Artificial Sequence
  chemically synthesized
agaggcatctatgactgcgg

SEQ ID NO: 509573 - DNA, 20 bp, Artificial Sequence
  chemically synthesized
aacagcaggactgcatttta

SEQ ID NO: 509574 - DNA, 20 bp, Artificial Sequence
  chemically synthesized
catgggaaggttttcagcag

SEQ ID NO: 509575 - DNA, 20 bp, Artificial Sequence
  chemically synthesized
aagaccatctggcagacaaa

SEQ ID NO: 509576 - DNA, 20 bp, Artificial Sequence
  chemically synthesized
tagtcagaagtgatcagatt

SEQ ID NO: 509577 - DNA, 20 bp, Artificial Sequence
  chemically synthesized
accttaaccaggtatatatc

SEQ ID NO: 509578 - DNA, 20 bp, Artificial Sequence
  chemically synthesized
ttttttttttttttttgaga

SEQ ID NO: 509579 - DNA, 20 bp, Artificial Sequence
  chemically synthesized
tctcgctctgtcacccaggc

SEQ ID NO: 509580 - DNA, 20 bp, Artificial Sequence
  chemically synthesized
tcgcgctactgcactccagc

SEQ ID NO: 509581 - DNA, 20 bp, Artificial Sequence
  chemically synthesized
ggaggcggagcttgtagtga

SEQ ID NO: 509582 - DNA, 20 bp, Artificial Sequence
  chemically synthesized
ctcactacaagctccgcctc

SEQ ID NO: 509583 - DNA, 20 bp, Artificial Sequence
  chemically synthesized
tactcgggaggctgaggcag

SEQ ID NO: 509584 - DNA, 20 bp, Artificial Sequence
  chemically synthesized
cattctcctgcctcagcctc

SEQ ID NO: 509585 - DNA, 20 bp, Artificial Sequence
  chemically synthesized
ttttgtatttttagtagaga

SEQ ID NO: 509586 - DNA, 20 bp, Artificial Sequence
  chemically synthesized
cggggtttcaccgtgttagc

SEQ ID NO: 509587 - DNA, 20 bp, Artificial Sequence
  chemically synthesized
actttgagaggccgaggcgg

SEQ ID NO: 509588 - DNA, 20 bp, Artificial Sequence
  chemically synthesized
gcctcggcctctcaaagtgc

SEQ ID NO: 509589 - DNA, 20 bp, Artificial Sequence
  chemically synthesized
gaaaactatgccaggtttgg

SEQ ID NO: 509590 - DNA, 20 bp, Artificial Sequence
  chemically synthesized
gttgccccaaatgaacatct

SEQ ID NO: 509591 - DNA, 20 bp, Artificial Sequence
  chemically synthesized
aaactattgacgaagcagat

SEQ ID NO: 509592 - DNA, 20 bp, Artificial Sequence
  chemically synthesized
ttagtaaatttagttttaca

SEQ ID NO: 509593 - DNA, 20 bp, Artificial Sequence
  chemically synthesized
tagttttacatagggtaaat

SEQ ID NO: 509594 - DNA, 20 bp, Artificial Sequence
  chemically synthesized
agggtaaatttgaattgact

SEQ ID NO: 509595 - DNA, 20 bp, Artificial Sequence
  chemically synthesized
aaaagttgtgtatctaagtt

SEQ ID NO: 509596 - DNA, 20 bp, Artificial Sequence
  chemically synthesized
ttggcagaaagctctgagct

SEQ ID NO: 509597 - DNA, 20 bp, Artificial Sequence
  chemically synthesized
tagataagatcatcgagaaa

SEQ ID NO: 509598 - DNA, 20 bp, Artificial Sequence
  chemically synthesized
ttcctgatatgacagtaacc

SEQ ID NO: 509599 - DNA, 20 bp, Artificial Sequence
  chemically synthesized
cccctggttactgtcatatc

SEQ ID NO: 509600 - DNA, 20 bp, Artificial Sequence
  chemically synthesized
agaaaaacaggaagaaaacc

SEQ ID NO: 509601 - DNA, 20 bp, Artificial Sequence
  chemically synthesized
agtaacttaagtaaatgtag

SEQ ID NO: 509602 - DNA, 20 bp, Artificial Sequence
  chemically synthesized
taatttaggtagtacatata

SEQ ID NO: 509603 - DNA, 20 bp, Artificial Sequence
  chemically synthesized
agtatcctgatatatgttgg

SEQ ID NO: 509604 - DNA, 20 bp, Artificial Sequence
  chemically synthesized
ataacccaaccaacatatat

SEQ ID NO: 509605 - DNA, 20 bp, Artificial Sequence
  chemically synthesized
gatactggttgtgatatatg

SEQ ID NO: 509606 - DNA, 20 bp, Artificial Sequence
  chemically synthesized
atgcagaatacatttggcaa

SEQ ID NO: 509607 - DNA, 20 bp, Artificial Sequence
  chemically synthesized
ctagagaagtgtagtgtacc

SEQ ID NO: 509608 - DNA, 20 bp, Artificial Sequence
  chemically synthesized
agtgtagtgtaccgagaatt

SEQ ID NO: 509609 - DNA, 20 bp, Artificial Sequence
  chemically synthesized
agaattaagaatatgggctg

SEQ ID NO: 509610 - DNA, 20 bp, Artificial Sequence
  chemically synthesized
tcagtggtacagaaaagaat

SEQ ID NO: 509611 - DNA, 20 bp, Artificial Sequence
  chemically synthesized
taaggttcagtggtacagaa

SEQ ID NO: 509612 - DNA, 20 bp, Artificial Sequence
  chemically synthesized
tagtgttctcgtctgaaaat

SEQ ID NO: 509613 - DNA, 20 bp, Artificial Sequence
  chemically synthesized
cgtctgaaaatgggaataac

SEQ ID NO: 509614 - DNA, 20 bp, Artificial Sequence
  chemically synthesized
taacttagcttaccaacatt

SEQ ID NO: 509615 - DNA, 20 bp, Artificial Sequence
  chemically synthesized
gcacaataacaaaatttgtt

SEQ ID NO: 509616 - DNA, 20 bp, Artificial Sequence
  chemically synthesized
tgtgctcattttagtattaa

SEQ ID NO: 509617 - DNA, 20 bp, Artificial Sequence
  chemically synthesized
tactaaaatgagcacatatt

SEQ ID NO: 509618 - DNA, 20 bp, Artificial Sequence
  chemically synthesized
gattaatacatagttgatac

SEQ ID NO: 509619 - DNA, 20 bp, Artificial Sequence
  chemically synthesized
ttatatccattgtgatctaa

SEQ ID NO: 509620 - DNA, 20 bp, Artificial Sequence
  chemically synthesized
aatcactcacttagatcaca

SEQ ID NO: 509621 - DNA, 20 bp, Artificial Sequence
  chemically synthesized
cttagatcacaatggatata

SEQ ID NO: 509622 - DNA, 20 bp, Artificial Sequence
  chemically synthesized
cgaaatatgaactgagaagt

SEQ ID NO: 509623 - DNA, 20 bp, Artificial Sequence
  chemically synthesized
aacacgttgatgaaacaacg

SEQ ID NO: 509624 - DNA, 20 bp, Artificial Sequence
  chemically synthesized
ttttcccggtaatcttttgg

SEQ ID NO: 509625 - DNA, 20 bp, Artificial Sequence
  chemically synthesized
tatatttatgaaagatcatt

SEQ ID NO: 509626 - DNA, 20 bp, Artificial Sequence
  chemically synthesized
atcattctccacactgcatc

SEQ ID NO: 509627 - DNA, 20 bp, Artificial Sequence
  chemically synthesized
atcattctggatgcagtgtg

SEQ ID NO: 509628 - DNA, 20 bp, Artificial Sequence
  chemically synthesized
caagaccagttagatatcca

SEQ ID NO: 509629 - DNA, 20 bp, Artificial Sequence
  chemically synthesized
ctattacatactgtcattca

SEQ ID NO: 509630 - DNA, 20 bp, Artificial Sequence
  chemically synthesized
attcattttttcaacagttc

SEQ ID NO: 509631 - DNA, 20 bp, Artificial Sequence
  chemically synthesized
actcaagaactgttgaaaaa

SEQ ID NO: 509632 - DNA, 20 bp, Artificial Sequence
  chemically synthesized
acttctgacatatatgatct

SEQ ID NO: 509633 - DNA, 20 bp, Artificial Sequence
  chemically synthesized
acaaggacagtacagttgtt

SEQ ID NO: 509634 - DNA, 20 bp, Artificial Sequence
  chemically synthesized
aataataaaaaaagacacct

SEQ ID NO: 509635 - DNA, 20 bp, Artificial Sequence
  chemically synthesized
tattattatacttcaagttc

SEQ ID NO: 509636 - DNA, 20 bp, Artificial Sequence
  chemically synthesized
aaaacctggatgacgggttg

SEQ ID NO: 509637 - DNA, 20 bp, Artificial Sequence
  chemically synthesized
cagggcttaaaacctggatg

SEQ ID NO: 509638 - DNA, 20 bp, Artificial Sequence
  chemically synthesized
atgcatgcagggcttaaaac

SEQ ID NO: 509639 - DNA, 20 bp, Artificial Sequence
  chemically synthesized
ggcaagggtagggagagcat

SEQ ID NO: 509640 - DNA, 20 bp, Artificial Sequence
  chemically synthesized
cctgtctgggagtggagggc

SEQ ID NO: 509641 - DNA, 20 bp, Artificial Sequence
  chemically synthesized
tcacacaccatcgcctgtct

SEQ ID NO: 509642 - DNA, 20 bp, Artificial Sequence
  chemically synthesized
tcattgttcaactcccactt

SEQ ID NO: 509643 - DNA, 20 bp, Artificial Sequence
  chemically synthesized
gcatgttctcactcataagt

SEQ ID NO: 509644 - DNA, 20 bp, Artificial Sequence
  chemically synthesized
cggtatttggttttctgttc

SEQ ID NO: 509645 - DNA, 20 bp, Artificial Sequence
  chemically synthesized
tgttcctgggttagtttgct

SEQ ID NO: 509646 - DNA, 20 bp, Artificial Sequence
  chemically synthesized
ttcttgtcctttgcagggac

SEQ ID NO: 509647 - DNA, 20 bp, Artificial Sequence
  chemically synthesized
ctatgcgaccataaaataga

SEQ ID NO: 509648 - DNA, 20 bp, Artificial Sequence
  chemically synthesized
aatactatgcgaccataaaa

SEQ ID NO: 509649 - DNA, 20 bp, Artificial Sequence
  chemically synthesized
gaaaatgtggcacatataca

SEQ ID NO: 509650 - DNA, 20 bp, Artificial Sequence
  chemically synthesized
ccattcccatcaatgataga

SEQ ID NO: 509651 - DNA, 20 bp, Artificial Sequence
  chemically synthesized
ttatccagtctatcattgat

SEQ ID NO: 509652 - DNA, 20 bp, Artificial Sequence
  chemically synthesized
tatcattgatgggaatggtc

SEQ ID NO: 509653 - DNA, 20 bp, Artificial Sequence
  chemically synthesized
ttttgttattttagtagaga

SEQ ID NO: 509654 - DNA, 20 bp, Artificial Sequence
  chemically synthesized
aaaattagccaggcgtggtg

SEQ ID NO: 509655 - DNA, 20 bp, Artificial Sequence
  chemically synthesized
tacttgggaggctgaggaag

SEQ ID NO: 509656 - DNA, 20 bp, Artificial Sequence
  chemically synthesized
aatcgttgaacctgggaggc

SEQ ID NO: 509657 - DNA, 20 bp, Artificial Sequence
  chemically synthesized
aggggtgcagtgagctgaaa

SEQ ID NO: 509658 - DNA, 20 bp, Artificial Sequence
  chemically synthesized
tattgctctgttgcccaggt

SEQ ID NO: 509659 - DNA, 20 bp, Artificial Sequence
  chemically synthesized
aagcaaggttttgtgaggca

SEQ ID NO: 509660 - DNA, 20 bp, Artificial Sequence
  chemically synthesized
tcttgggtcatatggtggtt

SEQ ID NO: 509661 - DNA, 20 bp, Artificial Sequence
  chemically synthesized
tcaaaaccaccatatgaccc

SEQ ID NO: 509662 - DNA, 20 bp, Artificial Sequence
  chemically synthesized
atgcccagaaggagggattc

SEQ ID NO: 509663 - DNA, 20 bp, Artificial Sequence
  chemically synthesized
ttgtgtatatgcccagaagg

SEQ ID NO: 509664 - DNA, 20 bp, Artificial Sequence
  chemically synthesized
gcttcaatgagcatagaagc

SEQ ID NO: 509665 - DNA, 20 bp, Artificial Sequence
  chemically synthesized
gaaacaacgtttaagtatcc

SEQ ID NO: 509666 - DNA, 20 bp, Artificial Sequence
  chemically synthesized
atgtctttaatcatttatcc

SEQ ID NO: 509667 - DNA, 20 bp, Artificial Sequence
  chemically synthesized
acattatggcatatatgcaa

SEQ ID NO: 509668 - DNA, 20 bp, Artificial Sequence
  chemically synthesized
tttcattctttttttaagga

SEQ ID NO: 509669 - DNA, 20 bp, Artificial Sequence
  chemically synthesized
tattattcagtccttaaaaa

SEQ ID NO: 509670 - DNA, 20 bp, Artificial Sequence
  chemically synthesized
atcttgccatttgctacaac

SEQ ID NO: 509671 - DNA, 20 bp, Artificial Sequence
  chemically synthesized
tgctacaacatggatgagcc

SEQ ID NO: 509672 - DNA, 20 bp, Artificial Sequence
  chemically synthesized
agcctagaatacattacact

SEQ ID NO: 509673 - DNA, 20 bp, Artificial Sequence
  chemically synthesized
ttacactaagaatttaaacc

SEQ ID NO: 509674 - DNA, 20 bp, Artificial Sequence
  chemically synthesized
tagggtgatttctacgcatg

SEQ ID NO: 509675 - DNA, 20 bp, Artificial Sequence
  chemically synthesized
aataaactgaaagtcaaatg

SEQ ID NO: 509676 - DNA, 20 bp, Artificial Sequence
  chemically synthesized
ttgtataatcacacaaaagt

SEQ ID NO: 509677 - DNA, 20 bp, Artificial Sequence
  chemically synthesized
attatatttgcagccacttt

SEQ ID NO: 509678 - DNA, 20 bp, Artificial Sequence
  chemically synthesized
ctgtgtgacacgataaattg

SEQ ID NO: 509679 - DNA, 20 bp, Artificial Sequence
  chemically synthesized
gcattaagcaacaccaacaa

SEQ ID NO: 509680 - DNA, 20 bp, Artificial Sequence
  chemically synthesized
catttcctccataaaactag

SEQ ID NO: 509681 - DNA, 20 bp, Artificial Sequence
  chemically synthesized
aagcataagatggaaatcct

SEQ ID NO: 509682 - DNA, 20 bp, Artificial Sequence
  chemically synthesized
tgtcacataatgttgacccc

SEQ ID NO: 509683 - DNA, 20 bp, Artificial Sequence
  chemically synthesized
tacattttgtctatttgaca

SEQ ID NO: 509684 - DNA, 20 bp, Artificial Sequence
  chemically synthesized
aaaaaaaaaacacaaaagca

SEQ ID NO: 509685 - DNA, 20 bp, Artificial Sequence
  chemically synthesized
tagatttaccattatctgac

SEQ ID NO: 509686 - DNA, 20 bp, Artificial Sequence
  chemically synthesized
gagccacagtgcccagcctt

SEQ ID NO: 509687 - DNA, 20 bp, Artificial Sequence
  chemically synthesized
gcctcggcctcccaaagtgc

SEQ ID NO: 509688 - DNA, 20 bp, Artificial Sequence
  chemically synthesized
actttgggaggccgaggcgg

SEQ ID NO: 509689 - DNA, 20 bp, Artificial Sequence
  chemically synthesized
cgggcggatcacctaaggtc

SEQ ID NO: 509690 - DNA, 20 bp, Artificial Sequence
  chemically synthesized
gccttagcctcactagtagc

SEQ ID NO: 509691 - DNA, 20 bp, Artificial Sequence
  chemically synthesized
tactagtgaggctaaggcag

SEQ ID NO: 509692 - DNA, 20 bp, Artificial Sequence
  chemically synthesized
cttttttttttttcccgaga

SEQ ID NO: 509693 - DNA, 20 bp, Artificial Sequence
  chemically synthesized
tatcaaatcttgttatattt

SEQ ID NO: 509694 - DNA, 20 bp, Artificial Sequence
  chemically synthesized
gacatatgagtgtatacact

SEQ ID NO: 509695 - DNA, 20 bp, Artificial Sequence
  chemically synthesized
gttgataggcatagggacat

SEQ ID NO: 509696 - DNA, 20 bp, Artificial Sequence
  chemically synthesized
tcaactttgtggactgagac

SEQ ID NO: 509697 - DNA, 20 bp, Artificial Sequence
  chemically synthesized
attttttttacctcaagtgt

SEQ ID NO: 509698 - DNA, 20 bp, Artificial Sequence
  chemically synthesized
gaaaaacatcagtaaatagt

SEQ ID NO: 509699 - DNA, 20 bp, Artificial Sequence
  chemically synthesized
tttactgatgtttttctaaa

SEQ ID NO: 509700 - DNA, 20 bp, Artificial Sequence
  chemically synthesized
aaaaacatgatttctcatga

SEQ ID NO: 509701 - DNA, 20 bp, Artificial Sequence
  chemically synthesized
agcaccttctacagcaatgt

SEQ ID NO: 509702 - DNA, 20 bp, Artificial Sequence
  chemically synthesized
aaaaacttggcatcaggaga

SEQ ID NO: 509703 - DNA, 20 bp, Artificial Sequence
  chemically synthesized
actgatcagcaggttatcat

SEQ ID NO: 509704 - DNA, 20 bp, Artificial Sequence
  chemically synthesized
gcaggttatcatatgaatag

SEQ ID NO: 509705 - DNA, 20 bp, Artificial Sequence
  chemically synthesized
tgttttaaaacacttgctgc

SEQ ID NO: 509706 - DNA, 20 bp, Artificial Sequence
  chemically synthesized
acagagactacggcattgaa

SEQ ID NO: 509707 - DNA, 20 bp, Artificial Sequence
  chemically synthesized
ggcattgaagagaattaagt

SEQ ID NO: 509708 - DNA, 20 bp, Artificial Sequence
  chemically synthesized
aataatcacttactaaaaat

SEQ ID NO: 509709 - DNA, 20 bp, Artificial Sequence
  chemically synthesized
gtatgttagttaaatactaa

SEQ ID NO: 509710 - DNA, 20 bp, Artificial Sequence
  chemically synthesized
cttcttatcgaagctgtatg

SEQ ID NO: 509711 - DNA, 20 bp, Artificial Sequence
  chemically synthesized
gcacattgtatgttatacac

SEQ ID NO: 509712 - DNA, 20 bp, Artificial Sequence
  chemically synthesized
tgtactgtagattcctacca

SEQ ID NO: 509713 - DNA, 20 bp, Artificial Sequence
  chemically synthesized
ttgatgatacactctgtggt

SEQ ID NO: 509714 - DNA, 20 bp, Artificial Sequence
  chemically synthesized
cagagtgtatcatcaaaatt

SEQ ID NO: 509715 - DNA, 20 bp, Artificial Sequence
  chemically synthesized
tttcagattgggagagaatt

SEQ ID NO: 509716 - DNA, 20 bp, Artificial Sequence
  chemically synthesized
gttaatatttcagattggga

SEQ ID NO: 509717 - DNA, 20 bp, Artificial Sequence
  chemically synthesized
ggagatgggatagttcatag

SEQ ID NO: 509718 - DNA, 20 bp, Artificial Sequence
  chemically synthesized
tgatgaaagtaaggaggaga

SEQ ID NO: 509719 - DNA, 20 bp, Artificial Sequence
  chemically synthesized
ttactttcatcactgaacct

SEQ ID NO: 509720 - DNA, 20 bp, Artificial Sequence
  chemically synthesized
ggaaaacaagaaataataca

SEQ ID NO: 509721 - DNA, 20 bp, Artificial Sequence
  chemically synthesized
gtatacttgtgtgctgtgag

SEQ ID NO: 509722 - DNA, 20 bp, Artificial Sequence
  chemically synthesized
tgcaggtaggggaagggcaa

SEQ ID NO: 509723 - DNA, 20 bp, Artificial Sequence
  chemically synthesized
agtgctgcaaatgaattgag

SEQ ID NO: 509724 - DNA, 20 bp, Artificial Sequence
  chemically synthesized
tatgttaaacagtgctgcaa

SEQ ID NO: 509725 - DNA, 20 bp, Artificial Sequence
  chemically synthesized
gacatagttaggtacgattt

SEQ ID NO: 509726 - DNA, 20 bp, Artificial Sequence
  chemically synthesized
aatttgaagaggttcaagga

SEQ ID NO: 509727 - DNA, 20 bp, Artificial Sequence
  chemically synthesized
gtgaaatttcatgtactttt

SEQ ID NO: 509728 - DNA, 20 bp, Artificial Sequence
  chemically synthesized
gctagggtggagagagataa

SEQ ID NO: 509729 - DNA, 20 bp, Artificial Sequence
  chemically synthesized
tagaatcgcattgcaggggc

SEQ ID NO: 509730 - DNA, 20 bp, Artificial Sequence
  chemically synthesized
agatcagttaagaccagtga

SEQ ID NO: 509731 - DNA, 20 bp, Artificial Sequence
  chemically synthesized
agctaactgtatttggaaat

SEQ ID NO: 509732 - DNA, 20 bp, Artificial Sequence
  chemically synthesized
gaaagtgtcaaggttgcctc

SEQ ID NO: 509733 - DNA, 20 bp, Artificial Sequence
  chemically synthesized
aaaaaccaaaaagggccatg

SEQ ID NO: 509734 - DNA, 20 bp, Artificial Sequence
  chemically synthesized
agaggcactttgcctttagg

SEQ ID NO: 509735 - DNA, 20 bp, Artificial Sequence
  chemically synthesized
caaccctgggacttatgaag

SEQ ID NO: 509736 - DNA, 20 bp, Artificial Sequence
  chemically synthesized
ccattcagcttcataagtcc

SEQ ID NO: 509737 - DNA, 20 bp, Artificial Sequence
  chemically synthesized
gagaagggcattggcaggtt

SEQ ID NO: 509738 - DNA, 20 bp, Artificial Sequence
  chemically synthesized
caatgcccttctcttgccta

SEQ ID NO: 509739 - DNA, 20 bp, Artificial Sequence
  chemically synthesized
aggttgaaggacacattgtg

SEQ ID NO: 509740 - DNA, 20 bp, Artificial Sequence
  chemically synthesized
gggcatatggttaggggagg

SEQ ID NO: 509741 - DNA, 20 bp, Artificial Sequence
  chemically synthesized
gagctaaatgagaaagaagc

SEQ ID NO: 509742 - DNA, 20 bp, Artificial Sequence
  chemically synthesized
aaagtgaagtaatatttcta

SEQ ID NO: 509743 - DNA, 20 bp, Artificial Sequence
  chemically synthesized
gcaggtagcagaaggtataa

SEQ ID NO: 509744 - DNA, 20 bp, Artificial Sequence
  chemically synthesized
agctataatttatggtccca

SEQ ID NO: 509745 - DNA, 20 bp, Artificial Sequence
  chemically synthesized
ctgtgtcttaaagcagctgt

SEQ ID NO: 509746 - DNA, 20 bp, Artificial Sequence
  chemically synthesized
catctaatttgtgttaatta

SEQ ID NO: 509747 - DNA, 20 bp, Artificial Sequence
  chemically synthesized
aacttagaaatcataggttt

SEQ ID NO: 509748 - DNA, 20 bp, Artificial Sequence
  chemically synthesized
gtaaaatagacctaggcatc

SEQ ID NO: 509749 - DNA, 20 bp, Artificial Sequence
  chemically synthesized
gtccttgtgctagtaagagg

SEQ ID NO: 509750 - DNA, 20 bp, Artificial Sequence
  chemically synthesized
attaagattaagacttactg

SEQ ID NO: 509751 - DNA, 20 bp, Artificial Sequence
  chemically synthesized
caggagcatgtggcagttac

SEQ ID NO: 509752 - DNA, 20 bp, Artificial Sequence
  chemically synthesized
tgccatattgtaagtgtaca

SEQ ID NO: 509753 - DNA, 20 bp, Artificial Sequence
  chemically synthesized
tttgcaaaccttgttctatt

SEQ ID NO: 509754 - DNA, 20 bp, Artificial Sequence
  chemically synthesized
aattctgacaggttgcactg

SEQ ID NO: 509755 - DNA, 20 bp, Artificial Sequence
  chemically synthesized
gattcatcagtgcaacctgt

SEQ ID NO: 509756 - DNA, 20 bp, Artificial Sequence
  chemically synthesized
gcaggaaaaaaactgtactt

SEQ ID NO: 509757 - DNA, 20 bp, Artificial Sequence
  chemically synthesized
tactaatttgaacagattct

SEQ ID NO: 509758 - DNA, 20 bp, Artificial Sequence
  chemically synthesized
tacaatgcttttggcattca

SEQ ID NO: 509759 - DNA, 20 bp, Artificial Sequence
  chemically synthesized
aatgtgtacttctaaacagt

SEQ ID NO: 509760 - DNA, 20 bp, Artificial Sequence
  chemically synthesized
gtgaggatgtgtgtgtgtgt

SEQ ID NO: 509761 - DNA, 20 bp, Artificial Sequence
  chemically synthesized
gtgtgtgtgtgtgtgagtgg

SEQ ID NO: 509762 - DNA, 20 bp, Artificial Sequence
  chemically synthesized
tacatataaagtacattccc

SEQ ID NO: 509763 - DNA, 20 bp, Artificial Sequence
  chemically synthesized
caaaacctaagcaaaccctg

SEQ ID NO: 509764 - DNA, 20 bp, Artificial Sequence
  chemically synthesized
tggtggatctttgcgatgct

SEQ ID NO: 509765 - DNA, 20 bp, Artificial Sequence
  chemically synthesized
ataaactgtcatctatattg

SEQ ID NO: 509766 - DNA, 20 bp, Artificial Sequence
  chemically synthesized
tttatgttggaacacaattt

SEQ ID NO: 509767 - DNA, 20 bp, Artificial Sequence
  chemically synthesized
gaatatatactcagctacaa

SEQ ID NO: 509768 - DNA, 20 bp, Artificial Sequence
  chemically synthesized
ttgtaccgacccacttgtag

SEQ ID NO: 509769 - DNA, 20 bp, Artificial Sequence
  chemically synthesized
tctcaatgtcaatactactc

SEQ ID NO: 509770 - DNA, 20 bp, Artificial Sequence
  chemically synthesized
atcttggtggtaatttactc

SEQ ID NO: 509771 - DNA, 20 bp, Artificial Sequence
  chemically synthesized
ttatacatatatctctcacc

SEQ ID NO: 509772 - DNA, 20 bp, Artificial Sequence
  chemically synthesized
ctaggtacttatataatgtt

SEQ ID NO: 509773 - DNA, 20 bp, Artificial Sequence
  chemically synthesized
ctggtaattgagaaatgttt

SEQ ID NO: 509774 - DNA, 20 bp, Artificial Sequence
  chemically synthesized
aaatcgaagttatagttaat

SEQ ID NO: 509775 - DNA, 20 bp, Artificial Sequence
  chemically synthesized
tgaactctgtctctttttct

SEQ ID NO: 509776 - DNA, 20 bp, Artificial Sequence
  chemically synthesized
cacactctgagaaaaagaga

SEQ ID NO: 509777 - DNA, 20 bp, Artificial Sequence
  chemically synthesized
gttttaaaataacatttata

SEQ ID NO: 509778 - DNA, 20 bp, Artificial Sequence
  chemically synthesized
acaaaagataaaaccataat

SEQ ID NO: 509779 - DNA, 20 bp, Artificial Sequence
  chemically synthesized
tgattataatatttttatca

SEQ ID NO: 509780 - DNA, 20 bp, Artificial Sequence
  chemically synthesized
cttttacattttaatggaaa

SEQ ID NO: 509781 - DNA, 20 bp, Artificial Sequence
  chemically synthesized
tagattactttgtaaaggac

SEQ ID NO: 509782 - DNA, 20 bp, Artificial Sequence
  chemically synthesized
aaaccatagggtttaataag

SEQ ID NO: 509783 - DNA, 20 bp, Artificial Sequence
  chemically synthesized
gaatttacagaaacaaacca

SEQ ID NO: 509784 - DNA, 20 bp, Artificial Sequence
  chemically synthesized
ctggtcttaaatgtgtacta

SEQ ID NO: 509785 - DNA, 20 bp, Artificial Sequence
  chemically synthesized
tatgcatctactttcatagt

SEQ ID NO: 509786 - DNA, 20 bp, Artificial Sequence
  chemically synthesized
ccaatgatggatgagcccac

SEQ ID NO: 509787 - DNA, 20 bp, Artificial Sequence
  chemically synthesized
agagaaacaataaaccaatg

SEQ ID NO: 509788 - DNA, 20 bp, Artificial Sequence
  chemically synthesized
tttatcatataaagaccttg

SEQ ID NO: 509789 - DNA, 20 bp, Artificial Sequence
  chemically synthesized
aacaatgacaaattggcttt

SEQ ID NO: 509790 - DNA, 20 bp, Artificial Sequence
  chemically synthesized
caaaatttagcaaaagttta

SEQ ID NO: 509791 - DNA, 20 bp, Artificial Sequence
  chemically synthesized
caataaacttttgctaaatt

SEQ ID NO: 509792 - DNA, 20 bp, Artificial Sequence
  chemically synthesized
cataggttaggctattactg

SEQ ID NO: 509793 - DNA, 20 bp, Artificial Sequence
  chemically synthesized
ttatgttctgtacatttcag

SEQ ID NO: 509794 - DNA, 20 bp, Artificial Sequence
  chemically synthesized
cagaacataaaaaaaatgca

SEQ ID NO: 509795 - DNA, 20 bp, Artificial Sequence
  chemically synthesized
gaaaaaatagagcatatttt

SEQ ID NO: 509796 - DNA, 20 bp, Artificial Sequence
  chemically synthesized
tgtgtgtgtgtctaatttta

SEQ ID NO: 509797 - DNA, 20 bp, Artificial Sequence
  chemically synthesized
ttaatagaataaaatatatc

SEQ ID NO: 509798 - DNA, 20 bp, Artificial Sequence
  chemically synthesized
atgatatattttattctatt

SEQ ID NO: 509799 - DNA, 20 bp, Artificial Sequence
  chemically synthesized
ttaataatataaatccttaa

SEQ ID NO: 509800 - DNA, 20 bp, Artificial Sequence
  chemically synthesized
tattttatggtagtatttga

SEQ ID NO: 509801 - DNA, 20 bp, Artificial Sequence
  chemically synthesized
acaagattccttcataagga

SEQ ID NO: 509802 - DNA, 20 bp, Artificial Sequence
  chemically synthesized
actatattccatccttatga

SEQ ID NO: 509803 - DNA, 20 bp, Artificial Sequence
  chemically synthesized
aagccacaagattccttcat

SEQ ID NO: 509804 - DNA, 20 bp, Artificial Sequence
  chemically synthesized
aagcaatcaggacttatgca

SEQ ID NO: 509805 - DNA, 20 bp, Artificial Sequence
  chemically synthesized
tgttctatgtccctggcaaa

SEQ ID NO: 509806 - DNA, 20 bp, Artificial Sequence
  chemically synthesized
taaagcataaaatgttgtag

SEQ ID NO: 509807 - DNA, 20 bp, Artificial Sequence
  chemically synthesized
tgttccaaccagaaggtgtc

SEQ ID NO: 509808 - DNA, 20 bp, Artificial Sequence
  chemically synthesized
ctacctggcatagataacgg

SEQ ID NO: 509809 - DNA, 20 bp, Artificial Sequence
  chemically synthesized
agctgcagtgtgatgacaat

SEQ ID NO: 509810 - DNA, 20 bp, Artificial Sequence
  chemically synthesized
tgtgatgacaatgtgaatat

SEQ ID NO: 509811 - DNA, 20 bp, Artificial Sequence
  chemically synthesized
tatttggattaaaggcttac

SEQ ID NO: 509812 - DNA, 20 bp, Artificial Sequence
  chemically synthesized
agaaaattccaaaggaatgg

SEQ ID NO: 509813 - DNA, 20 bp, Artificial Sequence
  chemically synthesized
ccagaatcctgccattcctt

SEQ ID NO: 509814 - DNA, 20 bp, Artificial Sequence
  chemically synthesized
tatgtaacagaaaattccaa

SEQ ID NO: 509815 - DNA, 20 bp, Artificial Sequence
  chemically synthesized
atttcttgtaattaaacctt

SEQ ID NO: 509816 - DNA, 20 bp, Artificial Sequence
  chemically synthesized
tcacatgttactgctccaat

SEQ ID NO: 509817 - DNA, 20 bp, Artificial Sequence
  chemically synthesized
atatttcaagttttcttgag

SEQ ID NO: 509818 - DNA, 20 bp, Artificial Sequence
  chemically synthesized
ataccaaagtccatataaac

SEQ ID NO: 509819 - DNA, 20 bp, Artificial Sequence
  chemically synthesized
atggactttggtatcaggaa

SEQ ID NO: 509820 - DNA, 20 bp, Artificial Sequence
  chemically synthesized
attcagcctgttccacatta

SEQ ID NO: 509821 - DNA, 20 bp, Artificial Sequence
  chemically synthesized
atcctataatgtggaacagg

SEQ ID NO: 509822 - DNA, 20 bp, Artificial Sequence
  chemically synthesized
aggctgaattatgagaagac

SEQ ID NO: 509823 - DNA, 20 bp, Artificial Sequence
  chemically synthesized
taccaagtatcattttgagt

SEQ ID NO: 509824 - DNA, 20 bp, Artificial Sequence
  chemically synthesized
atcatgtaccaagtatcatt

SEQ ID NO: 509825 - DNA, 20 bp, Artificial Sequence
  chemically synthesized
tactcgtaaggcacatgact

SEQ ID NO: 509826 - DNA, 20 bp, Artificial Sequence
  chemically synthesized
tatcctaagtcatgtgcctt

SEQ ID NO: 509827 - DNA, 20 bp, Artificial Sequence
  chemically synthesized
ctgataatttggagcctgat

SEQ ID NO: 509828 - DNA, 20 bp, Artificial Sequence
  chemically synthesized
atttgtatttttactccaaa

SEQ ID NO: 509829 - DNA, 20 bp, Artificial Sequence
  chemically synthesized
gttcatacaaacattcgatt

SEQ ID NO: 509830 - DNA, 20 bp, Artificial Sequence
  chemically synthesized
atgaacagagacaggagagg

SEQ ID NO: 509831 - DNA, 20 bp, Artificial Sequence
  chemically synthesized
agctgcttcttcatgatagg

SEQ ID NO: 509832 - DNA, 20 bp, Artificial Sequence
  chemically synthesized
gtagagggcatagccaatct

SEQ ID NO: 509833 - DNA, 20 bp, Artificial Sequence
  chemically synthesized
gaaaatttgcagcacagggt

SEQ ID NO: 509834 - DNA, 20 bp, Artificial Sequence
  chemically synthesized
gactgagaaaatttgcagca

SEQ ID NO: 509835 - DNA, 20 bp, Artificial Sequence
  chemically synthesized
gctgcaaattttctcagtca

SEQ ID NO: 509836 - DNA, 20 bp, Artificial Sequence
  chemically synthesized
tgaagcctaaaaccaaatca

SEQ ID NO: 509837 - DNA, 20 bp, Artificial Sequence
  chemically synthesized
ctaaaaccaaatcatagaat

SEQ ID NO: 509838 - DNA, 20 bp, Artificial Sequence
  chemically synthesized
aaatcatagaatttgggtta

SEQ ID NO: 509839 - DNA, 20 bp, Artificial Sequence
  chemically synthesized
gaatttgggttactgggtca

SEQ ID NO: 509840 - DNA, 20 bp, Artificial Sequence
  chemically synthesized
aaggtgtttttagttagacc

SEQ ID NO: 509841 - DNA, 20 bp, Artificial Sequence
  chemically synthesized
tcctggtgcttgccctaggt

SEQ ID NO: 509842 - DNA, 20 bp, Artificial Sequence
  chemically synthesized
cttttaaacaacacaataag

SEQ ID NO: 509843 - DNA, 20 bp, Artificial Sequence
  chemically synthesized
tatctgaagttgacatattt

SEQ ID NO: 509844 - DNA, 20 bp, Artificial Sequence
  chemically synthesized
ccaggaaggctctgaaagtg

SEQ ID NO: 509845 - DNA, 20 bp, Artificial Sequence
  chemically synthesized
aaatttagtttagttttaat

SEQ ID NO: 509846 - DNA, 20 bp, Artificial Sequence
  chemically synthesized
tttcacttagtcatagtcca

SEQ ID NO: 509847 - DNA, 20 bp, Artificial Sequence
  chemically synthesized
acttagtcatagtccactgg

SEQ ID NO: 509848 - DNA, 20 bp, Artificial Sequence
  chemically synthesized
cagctccaaggttgggatat

SEQ ID NO: 509849 - DNA, 20 bp, Artificial Sequence
  chemically synthesized
attgcattcagctccaaggt

SEQ ID NO: 509850 - DNA, 20 bp, Artificial Sequence
  chemically synthesized
cagatatcccaaccttggag

SEQ ID NO: 509851 - DNA, 20 bp, Artificial Sequence
  chemically synthesized
cttggagctgaatgcaatca

SEQ ID NO: 509852 - DNA, 20 bp, Artificial Sequence
  chemically synthesized
ttttatacttgctctttttg

SEQ ID NO: 509853 - DNA, 20 bp, Artificial Sequence
  chemically synthesized
gagtctgagcatctttgaaa

SEQ ID NO: 509854 - DNA, 20 bp, Artificial Sequence
  chemically synthesized
gaaagtgaatatatgctatg

SEQ ID NO: 509855 - DNA, 20 bp, Artificial Sequence
  chemically synthesized
atgaagggtgtatagcaatg

SEQ ID NO: 509856 - DNA, 20 bp, Artificial Sequence
  chemically synthesized
gcttactacagtcctcctct

SEQ ID NO: 509857 - DNA, 20 bp, Artificial Sequence
  chemically synthesized
tgccatcagagagtagaaga

SEQ ID NO: 509858 - DNA, 20 bp, Artificial Sequence
  chemically synthesized
accaggctactgtgccatca

SEQ ID NO: 509859 - DNA, 20 bp, Artificial Sequence
  chemically synthesized
ccgagcgcatatctagaact

SEQ ID NO: 509860 - DNA, 20 bp, Artificial Sequence
  chemically synthesized
cggtttttgtgcaagccaag

SEQ ID NO: 509861 - DNA, 20 bp, Artificial Sequence
  chemically synthesized
tcaggccaggcatatgatct

SEQ ID NO: 509862 - DNA, 20 bp, Artificial Sequence
  chemically synthesized
ccaaataggaaacaaaaggt

SEQ ID NO: 509863 - DNA, 20 bp, Artificial Sequence
  chemically synthesized
tcagaccttttgtttcctat

SEQ ID NO: 509864 - DNA, 20 bp, Artificial Sequence
  chemically synthesized
cttgtttacagctaaatgta

SEQ ID NO: 509865 - DNA, 20 bp, Artificial Sequence
  chemically synthesized
tttagctgtaaacaagggaa

SEQ ID NO: 509866 - DNA, 20 bp, Artificial Sequence
  chemically synthesized
gctgagggaagccggtctgt

SEQ ID NO: 509867 - DNA, 20 bp, Artificial Sequence
  chemically synthesized
tatgagttcgaaaagttatg

SEQ ID NO: 509868 - DNA, 20 bp, Artificial Sequence
  chemically synthesized
gtttaatacagagttttatt

SEQ ID NO: 509869 - DNA, 20 bp, Artificial Sequence
  chemically synthesized
gtttgctcaagggtttaata

SEQ ID NO: 509870 - DNA, 20 bp, Artificial Sequence
  chemically synthesized
aaagagttcaaggtttgctc

SEQ ID NO: 509871 - DNA, 20 bp, Artificial Sequence
  chemically synthesized
gagaatttgttggctaagta

SEQ ID NO: 509872 - DNA, 20 bp, Artificial Sequence
  chemically synthesized
aaatgtactcaagatacaaa

SEQ ID NO: 509873 - DNA, 20 bp, Artificial Sequence
  chemically synthesized
caacaaattctctttgtatc

SEQ ID NO: 509874 - DNA, 20 bp, Artificial Sequence
  chemically synthesized
accaagcatcctaaataata

SEQ ID NO: 509875 - DNA, 20 bp, Artificial Sequence
  chemically synthesized
ctattatatcctgtattatt

SEQ ID NO: 509876 - DNA, 20 bp, Artificial Sequence
  chemically synthesized
agaatgattgttgattattt

SEQ ID NO: 509877 - DNA, 20 bp, Artificial Sequence
  chemically synthesized
aagatgatataagtacatat

SEQ ID NO: 509878 - DNA, 20 bp, Artificial Sequence
  chemically synthesized
tacttatatcatcttcagtg

SEQ ID NO: 509879 - DNA, 20 bp, Artificial Sequence
  chemically synthesized
gtgaactgagcaattgaaca

SEQ ID NO: 509880 - DNA, 20 bp, Artificial Sequence
  chemically synthesized
atagcatcagtgtcattaat

SEQ ID NO: 509881 - DNA, 20 bp, Artificial Sequence
  chemically synthesized
tgatgctattatcaataaaa

SEQ ID NO: 509882 - DNA, 20 bp, Artificial Sequence
  chemically synthesized
atcaataaaatggagtcatt

SEQ ID NO: 509883 - DNA, 20 bp, Artificial Sequence
  chemically synthesized
tggtttgcttattcatcaaa

SEQ ID NO: 509884 - DNA, 20 bp, Artificial Sequence
  chemically synthesized
ctttctaaaaattccatttg

SEQ ID NO: 509885 - DNA, 20 bp, Artificial Sequence
  chemically synthesized
catcaaatggaatttttaga

SEQ ID NO: 509886 - DNA, 20 bp, Artificial Sequence
  chemically synthesized
atgtattatcttactacaac

SEQ ID NO: 509887 - DNA, 20 bp, Artificial Sequence
  chemically synthesized
ctacaactaggatgccaaat

SEQ ID NO: 509888 - DNA, 20 bp, Artificial Sequence
  chemically synthesized
ttcacaggcttgctataaat

SEQ ID NO: 509889 - DNA, 20 bp, Artificial Sequence
  chemically synthesized
tctttcaggagtggaagaga

SEQ ID NO: 509890 - DNA, 20 bp, Artificial Sequence
  chemically synthesized
atgatattaccatctctttc

SEQ ID NO: 509891 - DNA, 20 bp, Artificial Sequence
  chemically synthesized
gaaagagatggtaatatcat

SEQ ID NO: 509892 - DNA, 20 bp, Artificial Sequence
  chemically synthesized
tttgggaactggtaatgagg

SEQ ID NO: 509893 - DNA, 20 bp, Artificial Sequence
  chemically synthesized
tcatgatttactaaaagtgg

SEQ ID NO: 509894 - DNA, 20 bp, Artificial Sequence
  chemically synthesized
cacttcatgatttactaaaa

SEQ ID NO: 509895 - DNA, 20 bp, Artificial Sequence
  chemically synthesized
agctatcattagaggaaagg

SEQ ID NO: 509896 - DNA, 20 bp, Artificial Sequence
  chemically synthesized
cattttagcatacaggttaa

SEQ ID NO: 509897 - DNA, 20 bp, Artificial Sequence
  chemically synthesized
caggttaatagaatcaattc

SEQ ID NO: 509898 - DNA, 20 bp, Artificial Sequence
  chemically synthesized
acacacacacaatctcattc

SEQ ID NO: 509899 - DNA, 20 bp, Artificial Sequence
  chemically synthesized
cacatgaaaagcagctgtgc

SEQ ID NO: 509900 - DNA, 20 bp, Artificial Sequence
  chemically synthesized
tcaattttctcaagtgtaaa

SEQ ID NO: 509901 - DNA, 20 bp, Artificial Sequence
  chemically synthesized
gtgtaaaatggatatattaa

SEQ ID NO: 509902 - DNA, 20 bp, Artificial Sequence
  chemically synthesized
tattaacagaatcttctcaa

SEQ ID NO: 509903 - DNA, 20 bp, Artificial Sequence
  chemically synthesized
caatagggttgttataaaca

SEQ ID NO: 509904 - DNA, 20 bp, Artificial Sequence
  chemically synthesized
cttagataatgtctgtgatg

SEQ ID NO: 509905 - DNA, 20 bp, Artificial Sequence
  chemically synthesized
catcatcacagacattatct

SEQ ID NO: 509906 - DNA, 20 bp, Artificial Sequence
  chemically synthesized
ttattagcctaagctccttc

SEQ ID NO: 509907 - DNA, 20 bp, Artificial Sequence
  chemically synthesized
agttttccaatttctgggct

SEQ ID NO: 509908 - DNA, 20 bp, Artificial Sequence
  chemically synthesized
gagcccagaaattggaaaac

SEQ ID NO: 509909 - DNA, 20 bp, Artificial Sequence
  chemically synthesized
cagaaattggaaaacttggg

SEQ ID NO: 509910 - DNA, 20 bp, Artificial Sequence
  chemically synthesized
aacaaccttatatatcttga

SEQ ID NO: 509911 - DNA, 20 bp, Artificial Sequence
  chemically synthesized
taaaaacaaccttatatatc

SEQ ID NO: 509912 - DNA, 20 bp, Artificial Sequence
  chemically synthesized
ataaggttgtttttagttga

SEQ ID NO: 509913 - DNA, 20 bp, Artificial Sequence
  chemically synthesized
aataatacaaagcacgtaaa

SEQ ID NO: 509914 - DNA, 20 bp, Artificial Sequence
  chemically synthesized
tgaacattttataaggtgtg

SEQ ID NO: 509915 - DNA, 20 bp, Artificial Sequence
  chemically synthesized
gttatgctcttatgtataag

SEQ ID NO: 509916 - DNA, 20 bp, Artificial Sequence
  chemically synthesized
gggctctattgcttcaactg

SEQ ID NO: 509917 - DNA, 20 bp, Artificial Sequence
  chemically synthesized
gccctttcactacctgttct

SEQ ID NO: 509918 - DNA, 20 bp, Artificial Sequence
  chemically synthesized
caatctaccagattttcaac

SEQ ID NO: 509919 - DNA, 20 bp, Artificial Sequence
  chemically synthesized
tgcctggctttccaagtcct

SEQ ID NO: 509920 - DNA, 20 bp, Artificial Sequence
  chemically synthesized
tcaccataccctatttttct

SEQ ID NO: 509921 - DNA, 20 bp, Artificial Sequence
  chemically synthesized
caatgaaattctgagaaaaa

SEQ ID NO: 509922 - DNA, 20 bp, Artificial Sequence
  chemically synthesized
ttcattgccattttggggca

SEQ ID NO: 509923 - DNA, 20 bp, Artificial Sequence
  chemically synthesized
ttggggcaatgaattctttt

SEQ ID NO: 509924 - DNA, 20 bp, Artificial Sequence
  chemically synthesized
aatttcaatcatattctcaa

SEQ ID NO: 509925 - DNA, 20 bp, Artificial Sequence
  chemically synthesized
ttgagaatatgattgaaatt

SEQ ID NO: 509926 - DNA, 20 bp, Artificial Sequence
  chemically synthesized
tacacatagtgtaaaggatc

SEQ ID NO: 509927 - DNA, 20 bp, Artificial Sequence
  chemically synthesized
ttttgtgtacacatagtgta

SEQ ID NO: 509928 - DNA, 20 bp, Artificial Sequence
  chemically synthesized
atgtttggagattgtgttag

SEQ ID NO: 509929 - DNA, 20 bp, Artificial Sequence
  chemically synthesized
atgcacatttaacaaactct

SEQ ID NO: 509930 - DNA, 20 bp, Artificial Sequence
  chemically synthesized
atcacagtttataaaaccct

SEQ ID NO: 509931 - DNA, 20 bp, Artificial Sequence
  chemically synthesized
ttactaattactgaaggatg

SEQ ID NO: 509932 - DNA, 20 bp, Artificial Sequence
  chemically synthesized
gctaacattactaattactg

SEQ ID NO: 509933 - DNA, 20 bp, Artificial Sequence
  chemically synthesized
tgttaatcattgtccgtaat

SEQ ID NO: 509934 - DNA, 20 bp, Artificial Sequence
  chemically synthesized
tgaaattgaaaaatatatgt

SEQ ID NO: 509935 - DNA, 20 bp, Artificial Sequence
  chemically synthesized
acatttaaaaatatatgtaa

SEQ ID NO: 509936 - DNA, 20 bp, Artificial Sequence
  chemically synthesized
tttataggagtttcatttct

SEQ ID NO: 509937 - DNA, 20 bp, Artificial Sequence
  chemically synthesized
ctcttttcaattaattttat

SEQ ID NO: 509938 - DNA, 20 bp, Artificial Sequence
  chemically synthesized
ctcctataaaattaattgaa

SEQ ID NO: 509939 - DNA, 20 bp, Artificial Sequence
  chemically synthesized
agagtctagtgtaaaatatt

SEQ ID NO: 509940 - DNA, 20 bp, Artificial Sequence
  chemically synthesized
cttagaacaaaggttatatt

SEQ ID NO: 509941 - DNA, 20 bp, Artificial Sequence
  chemically synthesized
actacaaagttaagatataa

SEQ ID NO: 509942 - DNA, 20 bp, Artificial Sequence
  chemically synthesized
ttcagtggaaatatgcacat

SEQ ID NO: 509943 - DNA, 20 bp, Artificial Sequence
  chemically synthesized
taatttaaattatgagatga

SEQ ID NO: 509944 - DNA, 20 bp, Artificial Sequence
  chemically synthesized
gaaataaactacataggcac

SEQ ID NO: 509945 - DNA, 20 bp, Artificial Sequence
  chemically synthesized
tctttctacctcttaaaatt

SEQ ID NO: 509946 - DNA, 20 bp, Artificial Sequence
  chemically synthesized
ggtattttcttgtaagttat

SEQ ID NO: 509947 - DNA, 20 bp, Artificial Sequence
  chemically synthesized
tatagtaactttgtgtaaag

SEQ ID NO: 509948 - DNA, 20 bp, Artificial Sequence
  chemically synthesized
ttattttttaatcacacatg

SEQ ID NO: 509949 - DNA, 20 bp, Artificial Sequence
  chemically synthesized
atacttagcagctcaatttt

SEQ ID NO: 509950 - DNA, 20 bp, Artificial Sequence
  chemically synthesized
tcaaaaaaagagcaaaatat

SEQ ID NO: 509951 - DNA, 20 bp, Artificial Sequence
  chemically synthesized
aatcgtgctataatgagcac

SEQ ID NO: 509952 - DNA, 20 bp, Artificial Sequence
  chemically synthesized
acaacgtaaatgcccgatag

SEQ ID NO: 509953 - DNA, 20 bp, Artificial Sequence
  chemically synthesized
cgtaaatgcccgatagctga

SEQ ID NO: 509954 - DNA, 20 bp, Artificial Sequence
  chemically synthesized
gatgtggtaaatacatacaa

SEQ ID NO: 509955 - DNA, 20 bp, Artificial Sequence
  chemically synthesized
gttttccttctttttaaaga

SEQ ID NO: 509956 - DNA, 20 bp, Artificial Sequence
  chemically synthesized
aacttgcaatatgtgacaag

SEQ ID NO: 509957 - DNA, 20 bp, Artificial Sequence
  chemically synthesized
ttttagatacctggtgtgag

SEQ ID NO: 509958 - DNA, 20 bp, Artificial Sequence
  chemically synthesized
ggcaattttagatacctggt

SEQ ID NO: 509959 - DNA, 20 bp, Artificial Sequence
  chemically synthesized
atctaaaattgccaaactca

SEQ ID NO: 509960 - DNA, 20 bp, Artificial Sequence
  chemically synthesized
ccactctaatctctgattct

SEQ ID NO: 509961 - DNA, 20 bp, Artificial Sequence
  chemically synthesized
aaactcagagaatcagagat

SEQ ID NO: 509962 - DNA, 20 bp, Artificial Sequence
  chemically synthesized
taaaattttcatcatgcaag

SEQ ID NO: 509963 - DNA, 20 bp, Artificial Sequence
  chemically synthesized
aacgttgtgtagcagatctt

SEQ ID NO: 509964 - DNA, 20 bp, Artificial Sequence
  chemically synthesized
atggttatttgataaatctg

SEQ ID NO: 509965 - DNA, 20 bp, Artificial Sequence
  chemically synthesized
ttgtgctcacttttgtctat

SEQ ID NO: 509966 - DNA, 20 bp, Artificial Sequence
  chemically synthesized
catttagtaagtagcagaac

SEQ ID NO: 509967 - DNA, 20 bp, Artificial Sequence
  chemically synthesized
gttgtgttgtgtatgtgtgt

SEQ ID NO: 509968 - DNA, 20 bp, Artificial Sequence
  chemically synthesized
tgttgtgtatgtgtgtatgg

SEQ ID NO: 509969 - DNA, 20 bp, Artificial Sequence
  chemically synthesized
gggcaactgtccaggccaat

SEQ ID NO: 509970 - DNA, 20 bp, Artificial Sequence
  chemically synthesized
atgagtacattctacgaaac

SEQ ID NO: 509971 - DNA, 20 bp, Artificial Sequence
  chemically synthesized
tagtgtttattcttgtttcg

SEQ ID NO: 509972 - DNA, 20 bp, Artificial Sequence
  chemically synthesized
gaatgagggaggagtagaga

SEQ ID NO: 509973 - DNA, 20 bp, Artificial Sequence
  chemically synthesized
tgactgtgagagaatgaggg

SEQ ID NO: 509974 - DNA, 20 bp, Artificial Sequence
  chemically synthesized
ctccctcattctctcacagt

SEQ ID NO: 509975 - DNA, 20 bp, Artificial Sequence
  chemically synthesized
taatataactctgactgtga

SEQ ID NO: 509976 - DNA, 20 bp, Artificial Sequence
  chemically synthesized
tccctgccccatgaccaaaa

SEQ ID NO: 509977 - DNA, 20 bp, Artificial Sequence
  chemically synthesized
aattttctcttcacaaagga

SEQ ID NO: 509978 - DNA, 20 bp, Artificial Sequence
  chemically synthesized
ttacgcacgttgtcactcct

SEQ ID NO: 509979 - DNA, 20 bp, Artificial Sequence
  chemically synthesized
tatttattagaattattcac

SEQ ID NO: 509980 - DNA, 20 bp, Artificial Sequence
  chemically synthesized
gttcctagtcatttatttat

SEQ ID NO: 509981 - DNA, 20 bp, Artificial Sequence
  chemically synthesized
tattgccaaagttgtaagga

SEQ ID NO: 509982 - DNA, 20 bp, Artificial Sequence
  chemically synthesized
ataggacagtgcctaattat

SEQ ID NO: 509983 - DNA, 20 bp, Artificial Sequence
  chemically synthesized
gcttcatgatatggtataat

SEQ ID NO: 509984 - DNA, 20 bp, Artificial Sequence
  chemically synthesized
ccttctattaacttcccctg

SEQ ID NO: 509985 - DNA, 20 bp, Artificial Sequence
  chemically synthesized
aggggaagttaatagaagga

SEQ ID NO: 509986 - DNA, 20 bp, Artificial Sequence
  chemically synthesized
taaatctgaattgcatattg

SEQ ID NO: 509987 - DNA, 20 bp, Artificial Sequence
  chemically synthesized
gtaaatgttctttactaaat

SEQ ID NO: 509988 - DNA, 20 bp, Artificial Sequence
  chemically synthesized
gatttagtaaagaacattta

SEQ ID NO: 509989 - DNA, 20 bp, Artificial Sequence
  chemically synthesized
ggacaaaaaaccagaaagag

SEQ ID NO: 509990 - DNA, 20 bp, Artificial Sequence
  chemically synthesized
aacaaggacaaaaaaccaga

SEQ ID NO: 509991 - DNA, 20 bp, Artificial Sequence
  chemically synthesized
tggttttttgtccttgttaa

SEQ ID NO: 509992 - DNA, 20 bp, Artificial Sequence
  chemically synthesized
attccttctgttaaatgttt

SEQ ID NO: 509993 - DNA, 20 bp, Artificial Sequence
  chemically synthesized
attcaaaaacatttaacaga

SEQ ID NO: 509994 - DNA, 20 bp, Artificial Sequence
  chemically synthesized
agtcaaagatctctaaagat

SEQ ID NO: 509995 - DNA, 20 bp, Artificial Sequence
  chemically synthesized
aaatactattttgtttactg

SEQ ID NO: 509996 - DNA, 20 bp, Artificial Sequence
  chemically synthesized
atgaaaaaaacatgtttaaa

SEQ ID NO: 509997 - DNA, 20 bp, Artificial Sequence
  chemically synthesized
gtctcagtatactgtgaaaa

SEQ ID NO: 509998 - DNA, 20 bp, Artificial Sequence
  chemically synthesized
ttttttttttttttttgaga

SEQ ID NO: 509999 - DNA, 20 bp, Artificial Sequence
  chemically synthesized
ctgcactccagcctgggtga

SEQ ID NO: 510000 - DNA, 20 bp, Artificial Sequence
  chemically synthesized
tcttactctgtcacccaggc

SEQ ID NO: 510001 - DNA, 20 bp, Artificial Sequence
  chemically synthesized
tcgcgccactgcactccagc

SEQ ID NO: 510002 - DNA, 20 bp, Artificial Sequence
  chemically synthesized
ctcactgcaacctccgcctc

SEQ ID NO: 510003 - DNA, 20 bp, Artificial Sequence
  chemically synthesized
ctactcagaggctgaggcag

SEQ ID NO: 510004 - DNA, 20 bp, Artificial Sequence
  chemically synthesized
cgattctcctgcctcagcct

SEQ ID NO: 510005 - DNA, 20 bp, Artificial Sequence
  chemically synthesized
gcctcagcctctgagtagct

SEQ ID NO: 510006 - DNA, 20 bp, Artificial Sequence
  chemically synthesized
agcaggcggatcatgagttc

SEQ ID NO: 510007 - DNA, 20 bp, Artificial Sequence
  chemically synthesized
gaggccgaagcaggcggatc

SEQ ID NO: 510008 - DNA, 20 bp, Artificial Sequence
  chemically synthesized
actctgggaggccgaagcag

SEQ ID NO: 510009 - DNA, 20 bp, Artificial Sequence
  chemically synthesized
atccgcctgcttcggcctcc

SEQ ID NO: 510010 - DNA, 20 bp, Artificial Sequence
  chemically synthesized
gcttcggcctcccagagtgc

SEQ ID NO: 510011 - DNA, 20 bp, Artificial Sequence
  chemically synthesized
atatgatagcttagtttttt

SEQ ID NO: 510012 - DNA, 20 bp, Artificial Sequence
  chemically synthesized
atacaatcaaaatactgact

SEQ ID NO: 510013 - DNA, 20 bp, Artificial Sequence
  chemically synthesized
tcacaactggtcctcaggca

SEQ ID NO: 510014 - DNA, 20 bp, Artificial Sequence
  chemically synthesized
actggtcctcaggcactgag

SEQ ID NO: 510015 - DNA, 20 bp, Artificial Sequence
  chemically synthesized
actactaaaatttcctctca

SEQ ID NO: 510016 - DNA, 20 bp, Artificial Sequence
  chemically synthesized
ttctcaataaattaaagcat

SEQ ID NO: 510017 - DNA, 20 bp, Artificial Sequence
  chemically synthesized
ttgagatgtaatacctaatt

SEQ ID NO: 510018 - DNA, 20 bp, Artificial Sequence
  chemically synthesized
taggtattacatctcaaatt

SEQ ID NO: 510019 - DNA, 20 bp, Artificial Sequence
  chemically synthesized
tttgaagtaatattaaatat

SEQ ID NO: 510020 - DNA, 20 bp, Artificial Sequence
  chemically synthesized
aaggttggggtgggtggaag

SEQ ID NO: 510021 - DNA, 20 bp, Artificial Sequence
  chemically synthesized
tgctggggagaaaggttggg

SEQ ID NO: 510022 - DNA, 20 bp, Artificial Sequence
  chemically synthesized
tgtgtgctggggagaaaggt

SEQ ID NO: 510023 - DNA, 20 bp, Artificial Sequence
  chemically synthesized
aaatataaggggcgtagcct

SEQ ID NO: 510024 - DNA, 20 bp, Artificial Sequence
  chemically synthesized
acgccccttatatttgagac

SEQ ID NO: 510025 - DNA, 20 bp, Artificial Sequence
  chemically synthesized
cttatatttgagacgggagt

SEQ ID NO: 510026 - DNA, 20 bp, Artificial Sequence
  chemically synthesized
ctttttgctattaggcgata

SEQ ID NO: 510027 - DNA, 20 bp, Artificial Sequence
  chemically synthesized
gatggacgaaacagatattt

SEQ ID NO: 510028 - DNA, 20 bp, Artificial Sequence
  chemically synthesized
tttcgtccatctcttaagca

SEQ ID NO: 510029 - DNA, 20 bp, Artificial Sequence
  chemically synthesized
ttacgaggcttagataagaa

SEQ ID NO: 510030 - DNA, 20 bp, Artificial Sequence
  chemically synthesized
cgtactcaggaagatttcca

SEQ ID NO: 510031 - DNA, 20 bp, Artificial Sequence
  chemically synthesized
cttactctatggaaatcttc

SEQ ID NO: 510032 - DNA, 20 bp, Artificial Sequence
  chemically synthesized
ctatggaaatcttcctgagt

SEQ ID NO: 510033 - DNA, 20 bp, Artificial Sequence
  chemically synthesized
tacgagtcgatggaccattg

SEQ ID NO: 510034 - DNA, 20 bp, Artificial Sequence
  chemically synthesized
gatgcataaactgccgattc

SEQ ID NO: 510035 - DNA, 20 bp, Artificial Sequence
  chemically synthesized
tagcgtgatgaatgggatcc

SEQ ID NO: 510036 - DNA, 20 bp, Artificial Sequence
  chemically synthesized
cttattactagcgtgatgaa

SEQ ID NO: 510037 - DNA, 20 bp, Artificial Sequence
  chemically synthesized
taaggcttattactagcgtg

SEQ ID NO: 510038 - DNA, 20 bp, Artificial Sequence
  chemically synthesized
attggagagatcgtacaaat

SEQ ID NO: 510039 - DNA, 20 bp, Artificial Sequence
  chemically synthesized
aaagaatgagtaatacaagg

SEQ ID NO: 510040 - DNA, 20 bp, Artificial Sequence
  chemically synthesized
gaagagttacgtataaaaga

SEQ ID NO: 510041 - DNA, 20 bp, Artificial Sequence
  chemically synthesized
aatagaagagttacgtataa

SEQ ID NO: 510042 - DNA, 20 bp, Artificial Sequence
  chemically synthesized
catcaacctcatcgtaatag

SEQ ID NO: 510043 - DNA, 20 bp, Artificial Sequence
  chemically synthesized
ttctattacgatgaggttga

SEQ ID NO: 510044 - DNA, 20 bp, Artificial Sequence
  chemically synthesized
gtcatcttccttctcttact

SEQ ID NO: 510045 - DNA, 20 bp, Artificial Sequence
  chemically synthesized
gacgtaaaactgtgctgcag

SEQ ID NO: 510046 - DNA, 20 bp, Artificial Sequence
  chemically synthesized
cgtgaatctaatatattgtt

SEQ ID NO: 510047 - DNA, 20 bp, Artificial Sequence
  chemically synthesized
acttaagggagcagctgccc

SEQ ID NO: 510048 - DNA, 20 bp, Artificial Sequence
  chemically synthesized
attgctgttcactcaactct

SEQ ID NO: 510049 - DNA, 20 bp, Artificial Sequence
  chemically synthesized
tgtattgtatattctaagag

SEQ ID NO: 510050 - DNA, 20 bp, Artificial Sequence
  chemically synthesized
gcgattgtattgtatattct

SEQ ID NO: 510051 - DNA, 20 bp, Artificial Sequence
  chemically synthesized
acataaagcatattgatcaa

SEQ ID NO: 510052 - DNA, 20 bp, Artificial Sequence
  chemically synthesized
aactccaagaggaaaaggac

SEQ ID NO: 510053 - DNA, 20 bp, Artificial Sequence
  chemically synthesized
tattctagtccttttcctct

SEQ ID NO: 510054 - DNA, 20 bp, Artificial Sequence
  chemically synthesized
ttgcaggtcgtttttcccta

SEQ ID NO: 510055 - DNA, 20 bp, Artificial Sequence
  chemically synthesized
aatggtagtggcatatcaaa

SEQ ID NO: 510056 - DNA, 20 bp, Artificial Sequence
  chemically synthesized
aggtaaaggaagtgcgccat

SEQ ID NO: 510057 - DNA, 20 bp, Artificial Sequence
  chemically synthesized
atgtatctccctcttcctgg

SEQ ID NO: 510058 - DNA, 20 bp, Artificial Sequence
  chemically synthesized
tcaaatacgccaagcatact

SEQ ID NO: 510059 - DNA, 20 bp, Artificial Sequence
  chemically synthesized
gtgtatctggagctgagaaa

SEQ ID NO: 510060 - DNA, 20 bp, Artificial Sequence
  chemically synthesized
tggagctgagaaatggggtt

SEQ ID NO: 510061 - DNA, 20 bp, Artificial Sequence
  chemically synthesized
gttaagggtaggaaagaagg

SEQ ID NO: 510062 - DNA, 20 bp, Artificial Sequence
  chemically synthesized
gaacaaatcacgatggtgtt

SEQ ID NO: 510063 - DNA, 20 bp, Artificial Sequence
  chemically synthesized
atggtgttttggattttctt

SEQ ID NO: 510064 - DNA, 20 bp, Artificial Sequence
  chemically synthesized
agtgtaaagtgaaattattt

SEQ ID NO: 510065 - DNA, 20 bp, Artificial Sequence
  chemically synthesized
gagtaagtagagaagatgtt

SEQ ID NO: 510066 - DNA, 20 bp, Artificial Sequence
  chemically synthesized
gcccttaaggaatttacaaa

SEQ ID NO: 510067 - DNA, 20 bp, Artificial Sequence
  chemically synthesized
tggccatattattgccctta

SEQ ID NO: 510068 - DNA, 20 bp, Artificial Sequence
  chemically synthesized
tggaatagtggtaactatta

SEQ ID NO: 510069 - DNA, 20 bp, Artificial Sequence
  chemically synthesized
attctaatcgatgggtcttg

SEQ ID NO: 510070 - DNA, 20 bp, Artificial Sequence
  chemically synthesized
attccacaagacccatcgat

SEQ ID NO: 510071 - DNA, 20 bp, Artificial Sequence
  chemically synthesized
taaatccataattctaatcg

SEQ ID NO: 510072 - DNA, 20 bp, Artificial Sequence
  chemically synthesized
aagacccatcgattagaatt

SEQ ID NO: 510073 - DNA, 20 bp, Artificial Sequence
  chemically synthesized
ggggatagtgagccctctgt

SEQ ID NO: 510074 - DNA, 20 bp, Artificial Sequence
  chemically synthesized
aaatgcaataaaaggctttg

SEQ ID NO: 510075 - DNA, 20 bp, Artificial Sequence
  chemically synthesized
attttgagacatttctatta

SEQ ID NO: 510076 - DNA, 20 bp, Artificial Sequence
  chemically synthesized
tggggtcaaatatgtgatat

SEQ ID NO: 510077 - DNA, 20 bp, Artificial Sequence
  chemically synthesized
aatatcacatatttgacccc

SEQ ID NO: 510078 - DNA, 20 bp, Artificial Sequence
  chemically synthesized
agttaacttgctaaaattca

SEQ ID NO: 510079 - DNA, 20 bp, Artificial Sequence
  chemically synthesized
ttagtttatgatttcaattt

SEQ ID NO: 510080 - DNA, 20 bp, Artificial Sequence
  chemically synthesized
aatttaattttttatgcttg

SEQ ID NO: 510081 - DNA, 20 bp, Artificial Sequence
  chemically synthesized
gtagaaagctggaaataaat

SEQ ID NO: 510082 - DNA, 20 bp, Artificial Sequence
  chemically synthesized
ctacctttgagacatgtaat

SEQ ID NO: 510083 - DNA, 20 bp, Artificial Sequence
  chemically synthesized
atatatttcttagttctaag

SEQ ID NO: 510084 - DNA, 20 bp, Artificial Sequence
  chemically synthesized
ccatgtaactagttgtgctc

SEQ ID NO: 510085 - DNA, 20 bp, Artificial Sequence
  chemically synthesized
attgccagcacaagaccttt

SEQ ID NO: 510086 - DNA, 20 bp, Artificial Sequence
  chemically synthesized
cagaattttctttccctttg

SEQ ID NO: 510087 - DNA, 20 bp, Artificial Sequence
  chemically synthesized
tttccctttgcggagtgact

SEQ ID NO: 510088 - DNA, 20 bp, Artificial Sequence
  chemically synthesized
ctgatgaaacagctactatc

SEQ ID NO: 510089 - DNA, 20 bp, Artificial Sequence
  chemically synthesized
atagtagctgtttcatcagg

SEQ ID NO: 510090 - DNA, 20 bp, Artificial Sequence
  chemically synthesized
tgggtttccaaatgaccaca

SEQ ID NO: 510091 - DNA, 20 bp, Artificial Sequence
  chemically synthesized
ttttcattccaatgtgcact

SEQ ID NO: 510092 - DNA, 20 bp, Artificial Sequence
  chemically synthesized
tgctgattcacagtgcacat

SEQ ID NO: 510093 - DNA, 20 bp, Artificial Sequence
  chemically synthesized
tgaaatttaataaccagatc

SEQ ID NO: 510094 - DNA, 20 bp, Artificial Sequence
  chemically synthesized
tgcaggttaaagactgctgt

SEQ ID NO: 510095 - DNA, 20 bp, Artificial Sequence
  chemically synthesized
agtaaatctccaaaccacaa

SEQ ID NO: 510096 - DNA, 20 bp, Artificial Sequence
  chemically synthesized
cttctttcaatagaaaatta

SEQ ID NO: 510097 - DNA, 20 bp, Artificial Sequence
  chemically synthesized
aataattttctattgaaaga

SEQ ID NO: 510098 - DNA, 20 bp, Artificial Sequence
  chemically synthesized
agaaggagtggcgattcctc

SEQ ID NO: 510099 - DNA, 20 bp, Artificial Sequence
  chemically synthesized
tttctagttctagatccctg

SEQ ID NO: 510100 - DNA, 20 bp, Artificial Sequence
  chemically synthesized
tatacccagtaatgtgatgg

SEQ ID NO: 510101 - DNA, 20 bp, Artificial Sequence
  chemically synthesized
ttgacccagccatcacatta

SEQ ID NO: 510102 - DNA, 20 bp, Artificial Sequence
  chemically synthesized
cattactgggtatataccca

SEQ ID NO: 510103 - DNA, 20 bp, Artificial Sequence
  chemically synthesized
gcagcatgatttataatcct

SEQ ID NO: 510104 - DNA, 20 bp, Artificial Sequence
  chemically synthesized
gattccaagtctttgctatt

SEQ ID NO: 510105 - DNA, 20 bp, Artificial Sequence
  chemically synthesized
tactcacaatagcaaagact

SEQ ID NO: 510106 - DNA, 20 bp, Artificial Sequence
  chemically synthesized
agtctatcattgttggacat

SEQ ID NO: 510107 - DNA, 20 bp, Artificial Sequence
  chemically synthesized
aaatgtccaacaatgataga

SEQ ID NO: 510108 - DNA, 20 bp, Artificial Sequence
  chemically synthesized
aatgtgccacatatacacca

SEQ ID NO: 510109 - DNA, 20 bp, Artificial Sequence
  chemically synthesized
aatactatgcagccataaaa

SEQ ID NO: 510110 - DNA, 20 bp, Artificial Sequence
  chemically synthesized
ctatgcagccataaaaaagg

SEQ ID NO: 510111 - DNA, 20 bp, Artificial Sequence
  chemically synthesized
ttcatgtcctttgtagggac

SEQ ID NO: 510112 - DNA, 20 bp, Artificial Sequence
  chemically synthesized
tgtccttgcgatagtttgct

SEQ ID NO: 510113 - DNA, 20 bp, Artificial Sequence
  chemically synthesized
gcatgttctcactcataggt

SEQ ID NO: 510114 - DNA, 20 bp, Artificial Sequence
  chemically synthesized
tcattgttcgattcccacct

SEQ ID NO: 510115 - DNA, 20 bp, Artificial Sequence
  chemically synthesized
aggaaggggaacatcacaca

SEQ ID NO: 510116 - DNA, 20 bp, Artificial Sequence
  chemically synthesized
tcacacactgggtcccgtag

SEQ ID NO: 510117 - DNA, 20 bp, Artificial Sequence
  chemically synthesized
gtggggtggggggaggggga

SEQ ID NO: 510118 - DNA, 20 bp, Artificial Sequence
  chemically synthesized
gatatacctaatgttaaatg

SEQ ID NO: 510119 - DNA, 20 bp, Artificial Sequence
  chemically synthesized
taatgttaaatgatgagtta

SEQ ID NO: 510120 - DNA, 20 bp, Artificial Sequence
  chemically synthesized
ttttttttttattatacttt

SEQ ID NO: 510121 - DNA, 20 bp, Artificial Sequence
  chemically synthesized
aaaaaaaaaagaaagaaaga

SEQ ID NO: 510122 - DNA, 20 bp, Artificial Sequence
  chemically synthesized
aaaaaagaaagaaagaagga

SEQ ID NO: 510123 - DNA, 20 bp, Artificial Sequence
  chemically synthesized
tctcaaaaacttcttgttag

SEQ ID NO: 510124 - DNA, 20 bp, Artificial Sequence
  chemically synthesized
cctcaatatttcaagggcca

SEQ ID NO: 510125 - DNA, 20 bp, Artificial Sequence
  chemically synthesized
acacacagtgtgtatacata

SEQ ID NO: 510126 - DNA, 20 bp, Artificial Sequence
  chemically synthesized
gtgtgtatacataatggatt

SEQ ID NO: 510127 - DNA, 20 bp, Artificial Sequence
  chemically synthesized
ggatttagagttctagttat

SEQ ID NO: 510128 - DNA, 20 bp, Artificial Sequence
  chemically synthesized
ttctattcgaagttatacat

SEQ ID NO: 510129 - DNA, 20 bp, Artificial Sequence
  chemically synthesized
gacaacccatatgtataact

SEQ ID NO: 510130 - DNA, 20 bp, Artificial Sequence
  chemically synthesized
taatactaaacacttacata

SEQ ID NO: 510131 - DNA, 20 bp, Artificial Sequence
  chemically synthesized
gtgcatatatatgtgtgtgt

SEQ ID NO: 510132 - DNA, 20 bp, Artificial Sequence
  chemically synthesized
ttataagcaaagttttcaaa

SEQ ID NO: 510133 - DNA, 20 bp, Artificial Sequence
  chemically synthesized
attaagtatataactatagc

SEQ ID NO: 510134 - DNA, 20 bp, Artificial Sequence
  chemically synthesized
accataggattaataaaact

SEQ ID NO: 510135 - DNA, 20 bp, Artificial Sequence
  chemically synthesized
cacttgaatagtgatcacca

SEQ ID NO: 510136 - DNA, 20 bp, Artificial Sequence
  chemically synthesized
agggaaagtttaataaacac

SEQ ID NO: 510137 - DNA, 20 bp, Artificial Sequence
  chemically synthesized
taatcacaaaatttaaattt

SEQ ID NO: 510138 - DNA, 20 bp, Artificial Sequence
  chemically synthesized
agttgtaagagggcttatga

SEQ ID NO: 510139 - DNA, 20 bp, Artificial Sequence
  chemically synthesized
ttttctggctcatgttcttt

SEQ ID NO: 510140 - DNA, 20 bp, Artificial Sequence
  chemically synthesized
gataaatcaataagtaaaac

SEQ ID NO: 510141 - DNA, 20 bp, Artificial Sequence
  chemically synthesized
agtaacatttataacatacg

SEQ ID NO: 510142 - DNA, 20 bp, Artificial Sequence
  chemically synthesized
atttgacttctaactttcct

SEQ ID NO: 510143 - DNA, 20 bp, Artificial Sequence
  chemically synthesized
tcataaccaatacatgatgc

SEQ ID NO: 510144 - DNA, 20 bp, Artificial Sequence
  chemically synthesized
attatttatggagtcaataa

SEQ ID NO: 510145 - DNA, 20 bp, Artificial Sequence
  chemically synthesized
tgattatagttaattattta

SEQ ID NO: 510146 - DNA, 20 bp, Artificial Sequence
  chemically synthesized
tcacatttattcctggcttc

SEQ ID NO: 510147 - DNA, 20 bp, Artificial Sequence
  chemically synthesized
gccacttgatcctagaagcc

SEQ ID NO: 510148 - DNA, 20 bp, Artificial Sequence
  chemically synthesized
aaattataaagtagaagtag

SEQ ID NO: 510149 - DNA, 20 bp, Artificial Sequence
  chemically synthesized
atgagaaataagattagccc

SEQ ID NO: 510150 - DNA, 20 bp, Artificial Sequence
  chemically synthesized
gaagaaatttagatcattaa

SEQ ID NO: 510151 - DNA, 20 bp, Artificial Sequence
  chemically synthesized
tcaggtattataaagtaaat

SEQ ID NO: 510152 - DNA, 20 bp, Artificial Sequence
  chemically synthesized
taggaagcagataattgcca

SEQ ID NO: 510153 - DNA, 20 bp, Artificial Sequence
  chemically synthesized
tactaagattttaaattgac

SEQ ID NO: 510154 - DNA, 20 bp, Artificial Sequence
  chemically synthesized
cacaataaaacttacttata

SEQ ID NO: 510155 - DNA, 20 bp, Artificial Sequence
  chemically synthesized
atgagaggtatgtataacaa

SEQ ID NO: 510156 - DNA, 20 bp, Artificial Sequence
  chemically synthesized
aaaatgctaagcttgaaaat

SEQ ID NO: 510157 - DNA, 20 bp, Artificial Sequence
  chemically synthesized
aggaacatgactttatgtag

SEQ ID NO: 510158 - DNA, 20 bp, Artificial Sequence
  chemically synthesized
atgcagatgatctagaaatg

SEQ ID NO: 510159 - DNA, 20 bp, Artificial Sequence
  chemically synthesized
tatctttggaaggattaatg

SEQ ID NO: 510160 - DNA, 20 bp, Artificial Sequence
  chemically synthesized
gggaaataaactatctttgg

SEQ ID NO: 510161 - DNA, 20 bp, Artificial Sequence
  chemically synthesized
acagtcattttttaaattat

SEQ ID NO: 510162 - DNA, 20 bp, Artificial Sequence
  chemically synthesized
ataccttatttagtaataat

SEQ ID NO: 510163 - DNA, 20 bp, Artificial Sequence
  chemically synthesized
taaataaggtatctcttcaa

SEQ ID NO: 510164 - DNA, 20 bp, Artificial Sequence
  chemically synthesized
ctttacattgacatgcttaa

SEQ ID NO: 510165 - DNA, 20 bp, Artificial Sequence
  chemically synthesized
caaacttttttgttttcact

SEQ ID NO: 510166 - DNA, 20 bp, Artificial Sequence
  chemically synthesized
ctagtagatttgagacccac

SEQ ID NO: 510167 - DNA, 20 bp, Artificial Sequence
  chemically synthesized
catacatgtgttaaatccat

SEQ ID NO: 510168 - DNA, 20 bp, Artificial Sequence
  chemically synthesized
agataaagaccacaatatgc

SEQ ID NO: 510169 - DNA, 20 bp, Artificial Sequence
  chemically synthesized
tatgcaaggatatgtgctgc

SEQ ID NO: 510170 - DNA, 20 bp, Artificial Sequence
  chemically synthesized
tgctgccagaattctatagc

SEQ ID NO: 510171 - DNA, 20 bp, Artificial Sequence
  chemically synthesized
cctaattttaatccctgcta

SEQ ID NO: 510172 - DNA, 20 bp, Artificial Sequence
  chemically synthesized
agcagggattaaaattaggc

SEQ ID NO: 510173 - DNA, 20 bp, Artificial Sequence
  chemically synthesized
ttccttaaaatgtataatta

SEQ ID NO: 510174 - DNA, 20 bp, Artificial Sequence
  chemically synthesized
tccactaattatacatttta

SEQ ID NO: 510175 - DNA, 20 bp, Artificial Sequence
  chemically synthesized
acatctgtaatcacagaact

SEQ ID NO: 510176 - DNA, 20 bp, Artificial Sequence
  chemically synthesized
actttggatggccaaggcgg

SEQ ID NO: 510177 - DNA, 20 bp, Artificial Sequence
  chemically synthesized
cggctggatcacctgaggtc

SEQ ID NO: 510178 - DNA, 20 bp, Artificial Sequence
  chemically synthesized
ctgaaaaatacaaaaattag

SEQ ID NO: 510179 - DNA, 20 bp, Artificial Sequence
  chemically synthesized
aactctcctgcctcagcctc

SEQ ID NO: 510180 - DNA, 20 bp, Artificial Sequence
  chemically synthesized
tactcaggaggctgaggcag

SEQ ID NO: 510181 - DNA, 20 bp, Artificial Sequence
  chemically synthesized
ctcaatgcaacctctgcctc

SEQ ID NO: 510182 - DNA, 20 bp, Artificial Sequence
  chemically synthesized
ttttttttttttttttgaga

SEQ ID NO: 510183 - DNA, 20 bp, Artificial Sequence
  chemically synthesized
aattatgatgttacaacact

SEQ ID NO: 510184 - DNA, 20 bp, Artificial Sequence
  chemically synthesized
aaagaaaatcaaattactta

SEQ ID NO: 510185 - DNA, 20 bp, Artificial Sequence
  chemically synthesized
acagaaaatgtgacagtgtg

SEQ ID NO: 510186 - DNA, 20 bp, Artificial Sequence
  chemically synthesized
gttaaacatgatgtcttctt

SEQ ID NO: 510187 - DNA, 20 bp, Artificial Sequence
  chemically synthesized
acatcatgtttaacaaaatt

SEQ ID NO: 510188 - DNA, 20 bp, Artificial Sequence
  chemically synthesized
tttaacaaaattcaggatat

SEQ ID NO: 510189 - DNA, 20 bp, Artificial Sequence
  chemically synthesized
tggtctaggatcctgatatc

SEQ ID NO: 510190 - DNA, 20 bp, Artificial Sequence
  chemically synthesized
cagagcagaaatatttggtc

SEQ ID NO: 510191 - DNA, 20 bp, Artificial Sequence
  chemically synthesized
atgacttagcatatctcagc

SEQ ID NO: 510192 - DNA, 20 bp, Artificial Sequence
  chemically synthesized
tgtatgtgtaatttaatacc

SEQ ID NO: 510193 - DNA, 20 bp, Artificial Sequence
  chemically synthesized
cacatacaaattatttccaa

SEQ ID NO: 510194 - DNA, 20 bp, Artificial Sequence
  chemically synthesized
gtccttgcacataagtgtca

SEQ ID NO: 510195 - DNA, 20 bp, Artificial Sequence
  chemically synthesized
ggctcctgattaagaagttt

SEQ ID NO: 510196 - DNA, 20 bp, Artificial Sequence
  chemically synthesized
caaacttcttaatcaggagc

SEQ ID NO: 510197 - DNA, 20 bp, Artificial Sequence
  chemically synthesized
caagtacagtcatcagtaag

SEQ ID NO: 510198 - DNA, 20 bp, Artificial Sequence
  chemically synthesized
agccacatttcccaactaac

SEQ ID NO: 510199 - DNA, 20 bp, Artificial Sequence
  chemically synthesized
aactaacctggattcttcag

SEQ ID NO: 510200 - DNA, 20 bp, Artificial Sequence
  chemically synthesized
gaacttacaagattcttctg

SEQ ID NO: 510201 - DNA, 20 bp, Artificial Sequence
  chemically synthesized
acagattgtatttttttaag

SEQ ID NO: 510202 - DNA, 20 bp, Artificial Sequence
  chemically synthesized
ttcatcttacatgttattct

SEQ ID NO: 510203 - DNA, 20 bp, Artificial Sequence
  chemically synthesized
aagtatcagtgttacatccg

SEQ ID NO: 510204 - DNA, 20 bp, Artificial Sequence
  chemically synthesized
aacactgatacttctccatc

SEQ ID NO: 510205 - DNA, 20 bp, Artificial Sequence
  chemically synthesized
tgatacttctccatcaagag

SEQ ID NO: 510206 - DNA, 20 bp, Artificial Sequence
  chemically synthesized
ttatgtttctgccccttgac

SEQ ID NO: 510207 - DNA, 20 bp, Artificial Sequence
  chemically synthesized
gtataacttcttccatagtc

SEQ ID NO: 510208 - DNA, 20 bp, Artificial Sequence
  chemically synthesized
gactaagtcacaaaaggcaa

SEQ ID NO: 510209 - DNA, 20 bp, Artificial Sequence
  chemically synthesized
gagtttctgcttggtactct

SEQ ID NO: 510210 - DNA, 20 bp, Artificial Sequence
  chemically synthesized
ttccaagagtaagtgaccca

SEQ ID NO: 510211 - DNA, 20 bp, Artificial Sequence
  chemically synthesized
ctctttgggtcacttactct

SEQ ID NO: 510212 - DNA, 20 bp, Artificial Sequence
  chemically synthesized
ctaaatgctggctggattcc

SEQ ID NO: 510213 - DNA, 20 bp, Artificial Sequence
  chemically synthesized
agtcactcactaaatgctgg

SEQ ID NO: 510214 - DNA, 20 bp, Artificial Sequence
  chemically synthesized
tggaatccagccagcattta

SEQ ID NO: 510215 - DNA, 20 bp, Artificial Sequence
  chemically synthesized
cttttgattctgggtctcag

SEQ ID NO: 510216 - DNA, 20 bp, Artificial Sequence
  chemically synthesized
ccctgaacccatctgagacc

SEQ ID NO: 510217 - DNA, 20 bp, Artificial Sequence
  chemically synthesized
tcttattatctcttttgatt

SEQ ID NO: 510218 - DNA, 20 bp, Artificial Sequence
  chemically synthesized
caaaagagataataagaaaa

SEQ ID NO: 510219 - DNA, 20 bp, Artificial Sequence
  chemically synthesized
tttttataagctcccaagtt

SEQ ID NO: 510220 - DNA, 20 bp, Artificial Sequence
  chemically synthesized
acaggtatgccaagagataa

SEQ ID NO: 510221 - DNA, 20 bp, Artificial Sequence
  chemically synthesized
taaggtcaatcagttgtaac

SEQ ID NO: 510222 - DNA, 20 bp, Artificial Sequence
  chemically synthesized
aatcaagtctttatggaagt

SEQ ID NO: 510223 - DNA, 20 bp, Artificial Sequence
  chemically synthesized
tctttaggaagggcctctta

SEQ ID NO: 510224 - DNA, 20 bp, Artificial Sequence
  chemically synthesized
tgtaatcattaatagtttgt

SEQ ID NO: 510225 - DNA, 20 bp, Artificial Sequence
  chemically synthesized
aatttgaatgaattattgga

SEQ ID NO: 510226 - DNA, 20 bp, Artificial Sequence
  chemically synthesized
cctagaatttgaatgaatta

SEQ ID NO: 510227 - DNA, 20 bp, Artificial Sequence
  chemically synthesized
tgtcggttcctagaatttga

SEQ ID NO: 510228 - DNA, 20 bp, Artificial Sequence
  chemically synthesized
gatttgtcggttcctagaat

SEQ ID NO: 510229 - DNA, 20 bp, Artificial Sequence
  chemically synthesized
ttatgggatttgtcggttcc

SEQ ID NO: 510230 - DNA, 20 bp, Artificial Sequence
  chemically synthesized
gtcatgtttattacatttta

SEQ ID NO: 510231 - DNA, 20 bp, Artificial Sequence
  chemically synthesized
tttttgcgaaccaaggatat

SEQ ID NO: 510232 - DNA, 20 bp, Artificial Sequence
  chemically synthesized
agagtcaatttttgcgaacc

SEQ ID NO: 510233 - DNA, 20 bp, Artificial Sequence
  chemically synthesized
tgctgtggatgttacaaaaa

SEQ ID NO: 510234 - DNA, 20 bp, Artificial Sequence
  chemically synthesized
ataggtccagaggtattgct

SEQ ID NO: 510235 - DNA, 20 bp, Artificial Sequence
  chemically synthesized
gagacaaaaaagtcattttc

SEQ ID NO: 510236 - DNA, 20 bp, Artificial Sequence
  chemically synthesized
ttacatttggtaaagatatt

SEQ ID NO: 510237 - DNA, 20 bp, Artificial Sequence
  chemically synthesized
aaaatataagtcaaaaaatg

SEQ ID NO: 510238 - DNA, 20 bp, Artificial Sequence
  chemically synthesized
ataaatataatgcaaaatgg

SEQ ID NO: 510239 - DNA, 20 bp, Artificial Sequence
  chemically synthesized
aaagaaatatttacaacaac

SEQ ID NO: 510240 - DNA, 20 bp, Artificial Sequence
  chemically synthesized
caggcattcaataagtagtt

SEQ ID NO: 510241 - DNA, 20 bp, Artificial Sequence
  chemically synthesized
tctttacccttaactactta

SEQ ID NO: 510242 - DNA, 20 bp, Artificial Sequence
  chemically synthesized
aatgcctgttgtgtaagaag

SEQ ID NO: 510243 - DNA, 20 bp, Artificial Sequence
  chemically synthesized
ctgttgtgtaagaaggtgaa

SEQ ID NO: 510244 - DNA, 20 bp, Artificial Sequence
  chemically synthesized
gaaaagcctccactatcaca

SEQ ID NO: 510245 - DNA, 20 bp, Artificial Sequence
  chemically synthesized
aagatactttcaactttcca

SEQ ID NO: 510246 - DNA, 20 bp, Artificial Sequence
  chemically synthesized
ttattttagagatgagaaaa

SEQ ID NO: 510247 - DNA, 20 bp, Artificial Sequence
  chemically synthesized
gatgaaaacaggagtataat

SEQ ID NO: 510248 - DNA, 20 bp, Artificial Sequence
  chemically synthesized
taagatattaagatgaaaac

SEQ ID NO: 510249 - DNA, 20 bp, Artificial Sequence
  chemically synthesized
tcatcttaatatcttagcta

SEQ ID NO: 510250 - DNA, 20 bp, Artificial Sequence
  chemically synthesized
aaacttttcgaagaacatta

SEQ ID NO: 510251 - DNA, 20 bp, Artificial Sequence
  chemically synthesized
atgtttattttgatgtaaat

SEQ ID NO: 510252 - DNA, 20 bp, Artificial Sequence
  chemically synthesized
ttatttacatcaaaataaac

SEQ ID NO: 510253 - DNA, 20 bp, Artificial Sequence
  chemically synthesized
tacatcaaaataaacatgaa

SEQ ID NO: 510254 - DNA, 20 bp, Artificial Sequence
  chemically synthesized
tacatttcctgttttgtcct

SEQ ID NO: 510255 - DNA, 20 bp, Artificial Sequence
  chemically synthesized
acaggaaatgtatttgggac

SEQ ID NO: 510256 - DNA, 20 bp, Artificial Sequence
  chemically synthesized
gaaaatttcctattcttatt

SEQ ID NO: 510257 - DNA, 20 bp, Artificial Sequence
  chemically synthesized
tataagtgataattctaaat

SEQ ID NO: 510258 - DNA, 20 bp, Artificial Sequence
  chemically synthesized
aaaaaagctttgaatagtgt

SEQ ID NO: 510259 - DNA, 20 bp, Artificial Sequence
  chemically synthesized
attgatgcttaaaaaaagct

SEQ ID NO: 510260 - DNA, 20 bp, Artificial Sequence
  chemically synthesized
ttgataggtaactccatttg

SEQ ID NO: 510261 - DNA, 20 bp, Artificial Sequence
  chemically synthesized
caaagatgtaactccacaaa

SEQ ID NO: 510262 - DNA, 20 bp, Artificial Sequence
  chemically synthesized
ctaaatgcagacacacctag

SEQ ID NO: 510263 - DNA, 20 bp, Artificial Sequence
  chemically synthesized
attaagtatgaaaattttat

SEQ ID NO: 510264 - DNA, 20 bp, Artificial Sequence
  chemically synthesized
ttggtaggttttatgtttct

SEQ ID NO: 510265 - DNA, 20 bp, Artificial Sequence
  chemically synthesized
ctgtgtaaaaatggaaaagt

SEQ ID NO: 510266 - DNA, 20 bp, Artificial Sequence
  chemically synthesized
tgaatagatcaatacaagta

SEQ ID NO: 510267 - DNA, 20 bp, Artificial Sequence
  chemically synthesized
agatcaatacaagtaaggga

SEQ ID NO: 510268 - DNA, 20 bp, Artificial Sequence
  chemically synthesized
gtcttttgcttttctttgtt

SEQ ID NO: 510269 - DNA, 20 bp, Artificial Sequence
  chemically synthesized
cctccacttcagttttttca

SEQ ID NO: 510270 - DNA, 20 bp, Artificial Sequence
  chemically synthesized
ggtaatgctgaccttataaa

SEQ ID NO: 510271 - DNA, 20 bp, Artificial Sequence
  chemically synthesized
atattgagttgcagttttct

SEQ ID NO: 510272 - DNA, 20 bp, Artificial Sequence
  chemically synthesized
ctctatatctgtcaaggata

SEQ ID NO: 510273 - DNA, 20 bp, Artificial Sequence
  chemically synthesized
attttgcctctatatctgtc

SEQ ID NO: 510274 - DNA, 20 bp, Artificial Sequence
  chemically synthesized
aaatttgccagaattttgtt

SEQ ID NO: 510275 - DNA, 20 bp, Artificial Sequence
  chemically synthesized
aatgtgttgttaaaatttgc

SEQ ID NO: 510276 - DNA, 20 bp, Artificial Sequence
  chemically synthesized
aaattttaacaacacattaa

SEQ ID NO: 510277 - DNA, 20 bp, Artificial Sequence
  chemically synthesized
gaccaagtgagatttatcct

SEQ ID NO: 510278 - DNA, 20 bp, Artificial Sequence
  chemically synthesized
gagatttatccttgggatac

SEQ ID NO: 510279 - DNA, 20 bp, Artificial Sequence
  chemically synthesized
ttgaaccatccttgtatccc

SEQ ID NO: 510280 - DNA, 20 bp, Artificial Sequence
  chemically synthesized
agtatgatacaccacgttaa

SEQ ID NO: 510281 - DNA, 20 bp, Artificial Sequence
  chemically synthesized
ttttaaatagtgaaattgtg

SEQ ID NO: 510282 - DNA, 20 bp, Artificial Sequence
  chemically synthesized
ccttctattcctagtttgtt

SEQ ID NO: 510283 - DNA, 20 bp, Artificial Sequence
  chemically synthesized
cattaaactctcaacaaact

SEQ ID NO: 510284 - DNA, 20 bp, Artificial Sequence
  chemically synthesized
tcacaacaactgcgaactga

SEQ ID NO: 510285 - DNA, 20 bp, Artificial Sequence
  chemically synthesized
ttgccatcggtagaagtggc

SEQ ID NO: 510286 - DNA, 20 bp, Artificial Sequence
  chemically synthesized
gcaatactggaagtccttgc

SEQ ID NO: 510287 - DNA, 20 bp, Artificial Sequence
  chemically synthesized
aggtatataaatcagaaatg

SEQ ID NO: 510288 - DNA, 20 bp, Artificial Sequence
  chemically synthesized
agattatgtcatctgcaaat

SEQ ID NO: 510289 - DNA, 20 bp, Artificial Sequence
  chemically synthesized
tttgcagatgacataatctt

SEQ ID NO: 510290 - DNA, 20 bp, Artificial Sequence
  chemically synthesized
atcttatgaatagaaaaccc

SEQ ID NO: 510291 - DNA, 20 bp, Artificial Sequence
  chemically synthesized
ctagtgtttttaatggattc

SEQ ID NO: 510292 - DNA, 20 bp, Artificial Sequence
  chemically synthesized
aattggttctagtgttttta

SEQ ID NO: 510293 - DNA, 20 bp, Artificial Sequence
  chemically synthesized
tttaaaaatcagtaaagttg

SEQ ID NO: 510294 - DNA, 20 bp, Artificial Sequence
  chemically synthesized
aatcatcatacaaaaattag

SEQ ID NO: 510295 - DNA, 20 bp, Artificial Sequence
  chemically synthesized
ctttttggtgctcttgtgaa

SEQ ID NO: 510296 - DNA, 20 bp, Artificial Sequence
  chemically synthesized
gttttctttttggtgctctt

SEQ ID NO: 510297 - DNA, 20 bp, Artificial Sequence
  chemically synthesized
gtaataaactaaagaggtca

SEQ ID NO: 510298 - DNA, 20 bp, Artificial Sequence
  chemically synthesized
tggaaagacatcctacattc

SEQ ID NO: 510299 - DNA, 20 bp, Artificial Sequence
  chemically synthesized
agtccttcgatccatgaatg

SEQ ID NO: 510300 - DNA, 20 bp, Artificial Sequence
  chemically synthesized
aattttaagtccttcgatcc

SEQ ID NO: 510301 - DNA, 20 bp, Artificial Sequence
  chemically synthesized
tattagttctgtagatttct

SEQ ID NO: 510302 - DNA, 20 bp, Artificial Sequence
  chemically synthesized
gtttctgtgaaaaatgccat

SEQ ID NO: 510303 - DNA, 20 bp, Artificial Sequence
  chemically synthesized
ttgtggttccatatgaattt

SEQ ID NO: 510304 - DNA, 20 bp, Artificial Sequence
  chemically synthesized
gggattctttgtggttccat

SEQ ID NO: 510305 - DNA, 20 bp, Artificial Sequence
  chemically synthesized
gaaattcatatggaaccaca

SEQ ID NO: 510306 - DNA, 20 bp, Artificial Sequence
  chemically synthesized
tcaaggttgatttagccatt

SEQ ID NO: 510307 - DNA, 20 bp, Artificial Sequence
  chemically synthesized
agacatatagaccaatagaa

SEQ ID NO: 510308 - DNA, 20 bp, Artificial Sequence
  chemically synthesized
cagatataaatctacacata

SEQ ID NO: 510309 - DNA, 20 bp, Artificial Sequence
  chemically synthesized
ccaagcatacacaaggagga

SEQ ID NO: 510310 - DNA, 20 bp, Artificial Sequence
  chemically synthesized
aacaaatggtgttggaaaaa

SEQ ID NO: 510311 - DNA, 20 bp, Artificial Sequence
  chemically synthesized
ccaatttcattattttgcac

SEQ ID NO: 510312 - DNA, 20 bp, Artificial Sequence
  chemically synthesized
tatgcaaatatcaactccaa

SEQ ID NO: 510313 - DNA, 20 bp, Artificial Sequence
  chemically synthesized
atttacatattttatccgtt

SEQ ID NO: 510314 - DNA, 20 bp, Artificial Sequence
  chemically synthesized
tgttttcttctaggagtttt

SEQ ID NO: 510315 - DNA, 20 bp, Artificial Sequence
  chemically synthesized
tttttccaatgttttcttct

SEQ ID NO: 510316 - DNA, 20 bp, Artificial Sequence
  chemically synthesized
ttttggaaataattgcgagg

SEQ ID NO: 510317 - DNA, 20 bp, Artificial Sequence
  chemically synthesized
gtgcttttggaaataattgc

SEQ ID NO: 510318 - DNA, 20 bp, Artificial Sequence
  chemically synthesized
agcaataaaagcaaaaaaaa

SEQ ID NO: 510319 - DNA, 20 bp, Artificial Sequence
  chemically synthesized
cactgtgaaaaggcaatcta

SEQ ID NO: 510320 - DNA, 20 bp, Artificial Sequence
  chemically synthesized
aaaccatatatatatattat

SEQ ID NO: 510321 - DNA, 20 bp, Artificial Sequence
  chemically synthesized
atttaaccctcctaatagct

SEQ ID NO: 510322 - DNA, 20 bp, Artificial Sequence
  chemically synthesized
ttctaactcagagctattag

SEQ ID NO: 510323 - DNA, 20 bp, Artificial Sequence
  chemically synthesized
tattaggagggttaaataaa

SEQ ID NO: 510324 - DNA, 20 bp, Artificial Sequence
  chemically synthesized
taaataaaatgaattatata

SEQ ID NO: 510325 - DNA, 20 bp, Artificial Sequence
  chemically synthesized
ttgctgtctttttgataact

SEQ ID NO: 510326 - DNA, 20 bp, Artificial Sequence
  chemically synthesized
gttatcttctaaaatatata

SEQ ID NO: 510327 - DNA, 20 bp, Artificial Sequence
  chemically synthesized
tttttttgccaatgagttgt

SEQ ID NO: 510328 - DNA, 20 bp, Artificial Sequence
  chemically synthesized
tagtttttttttttttgcca

SEQ ID NO: 510329 - DNA, 20 bp, Artificial Sequence
  chemically synthesized
ttcatacacctgttgaccat

SEQ ID NO: 510330 - DNA, 20 bp, Artificial Sequence
  chemically synthesized
atgaaaatatgttcaacatt

SEQ ID NO: 510331 - DNA, 20 bp, Artificial Sequence
  chemically synthesized
agggaaatgtaaatgaaaag

SEQ ID NO: 510332 - DNA, 20 bp, Artificial Sequence
  chemically synthesized
agctatcacatttatacctg

SEQ ID NO: 510333 - DNA, 20 bp, Artificial Sequence
  chemically synthesized
tggatgcctactattaaaaa

SEQ ID NO: 510334 - DNA, 20 bp, Artificial Sequence
  chemically synthesized
ctattaaaaaatggattagt

SEQ ID NO: 510335 - DNA, 20 bp, Artificial Sequence
  chemically synthesized
aaaatggattagtaaggatg

SEQ ID NO: 510336 - DNA, 20 bp, Artificial Sequence
  chemically synthesized
gtgagattgctagatcaagt

SEQ ID NO: 510337 - DNA, 20 bp, Artificial Sequence
  chemically synthesized
ttgatctagcaatctcactt

SEQ ID NO: 510338 - DNA, 20 bp, Artificial Sequence
  chemically synthesized
acttttggatatttatccaa

SEQ ID NO: 510339 - DNA, 20 bp, Artificial Sequence
  chemically synthesized
agatcctgatttcaattctt

SEQ ID NO: 510340 - DNA, 20 bp, Artificial Sequence
  chemically synthesized
ttatccaaaagaattgaaat

SEQ ID NO: 510341 - DNA, 20 bp, Artificial Sequence
  chemically synthesized
aattgaaatcaggatcttga

SEQ ID NO: 510342 - DNA, 20 bp, Artificial Sequence
  chemically synthesized
gtttccacatcttggctctt

SEQ ID NO: 510343 - DNA, 20 bp, Artificial Sequence
  chemically synthesized
ctcatccatcagtggacact

SEQ ID NO: 510344 - DNA, 20 bp, Artificial Sequence
  chemically synthesized
aacatcctcagtgtccactg

SEQ ID NO: 510345 - DNA, 20 bp, Artificial Sequence
  chemically synthesized
cagtgtccactgatggatga

SEQ ID NO: 510346 - DNA, 20 bp, Artificial Sequence
  chemically synthesized
gtggcaggatctctttcttt

SEQ ID NO: 510347 - DNA, 20 bp, Artificial Sequence
  chemically synthesized
catccatgttgttaatgtgg

SEQ ID NO: 510348 - DNA, 20 bp, Artificial Sequence
  chemically synthesized
gatcctgccacattaacaac

SEQ ID NO: 510349 - DNA, 20 bp, Artificial Sequence
  chemically synthesized
ttcacttcccataatgtcct

SEQ ID NO: 510350 - DNA, 20 bp, Artificial Sequence
  chemically synthesized
acctcttataagtagaatca

SEQ ID NO: 510351 - DNA, 20 bp, Artificial Sequence
  chemically synthesized
ttttacatacctcttataag

SEQ ID NO: 510352 - DNA, 20 bp, Artificial Sequence
  chemically synthesized
cactctctgatttgatcagc

SEQ ID NO: 510353 - DNA, 20 bp, Artificial Sequence
  chemically synthesized
tactcaagctgatcaaatca

SEQ ID NO: 510354 - DNA, 20 bp, Artificial Sequence
  chemically synthesized
caagttgtacaacagatctt

SEQ ID NO: 510355 - DNA, 20 bp, Artificial Sequence
  chemically synthesized
tacacttaaaaatcagttaa

SEQ ID NO: 510356 - DNA, 20 bp, Artificial Sequence
  chemically synthesized
cttaaaaatcagttaagagg

SEQ ID NO: 510357 - DNA, 20 bp, Artificial Sequence
  chemically synthesized
gtgtgtaagaacacttaaca

SEQ ID NO: 510358 - DNA, 20 bp, Artificial Sequence
  chemically synthesized
ttcaaaagaagttaaacgat

SEQ ID NO: 510359 - DNA, 20 bp, Artificial Sequence
  chemically synthesized
aaactggaaggaaccttgaa

SEQ ID NO: 510360 - DNA, 20 bp, Artificial Sequence
  chemically synthesized
gtacactgaagacttctgag

SEQ ID NO: 510361 - DNA, 20 bp, Artificial Sequence
  chemically synthesized
aattggtacactgaagactt

SEQ ID NO: 510362 - DNA, 20 bp, Artificial Sequence
  chemically synthesized
gtcttcagtgtaccaattta

SEQ ID NO: 510363 - DNA, 20 bp, Artificial Sequence
  chemically synthesized
aaaacctaacaattctgttt

SEQ ID NO: 510364 - DNA, 20 bp, Artificial Sequence
  chemically synthesized
ctgaacaaattacccagaaa

SEQ ID NO: 510365 - DNA, 20 bp, Artificial Sequence
  chemically synthesized
ggtaatttgttcagtcacat

SEQ ID NO: 510366 - DNA, 20 bp, Artificial Sequence
  chemically synthesized
ttagtgatacttttaatcta

SEQ ID NO: 510367 - DNA, 20 bp, Artificial Sequence
  chemically synthesized
tagaaagtaattggcaaaca

SEQ ID NO: 510368 - DNA, 20 bp, Artificial Sequence
  chemically synthesized
ggagggggcaaaggcagaga

SEQ ID NO: 510369 - DNA, 20 bp, Artificial Sequence
  chemically synthesized
ccagcaatcctgtgttggga

SEQ ID NO: 510370 - DNA, 20 bp, Artificial Sequence
  chemically synthesized
tgcctcatcccctcccaaca

SEQ ID NO: 510371 - DNA, 20 bp, Artificial Sequence
  chemically synthesized
cccctcccaacacaggattg

SEQ ID NO: 510372 - DNA, 20 bp, Artificial Sequence
  chemically synthesized
ataaagcagaaaaagcactt

SEQ ID NO: 510373 - DNA, 20 bp, Artificial Sequence
  chemically synthesized
tcagcaacctcagaacaaaa

SEQ ID NO: 510374 - DNA, 20 bp, Artificial Sequence
  chemically synthesized
aaaaaggatatccttttcct

SEQ ID NO: 510375 - DNA, 20 bp, Artificial Sequence
  chemically synthesized
gagtaaaagattctaaggaa

SEQ ID NO: 510376 - DNA, 20 bp, Artificial Sequence
  chemically synthesized
gagttcggcaagttaatata

SEQ ID NO: 510377 - DNA, 20 bp, Artificial Sequence
  chemically synthesized
aaacaaactcacaacctgta

SEQ ID NO: 510378 - DNA, 20 bp, Artificial Sequence
  chemically synthesized
tgccgaactctatacaggtt

SEQ ID NO: 510379 - DNA, 20 bp, Artificial Sequence
  chemically synthesized
ttgtgagtttgtttataaat

SEQ ID NO: 510380 - DNA, 20 bp, Artificial Sequence
  chemically synthesized
cttttatgagaagagatagc

SEQ ID NO: 510381 - DNA, 20 bp, Artificial Sequence
  chemically synthesized
attactactttagatacatc

SEQ ID NO: 510382 - DNA, 20 bp, Artificial Sequence
  chemically synthesized
agtagtaatcatattggttg

SEQ ID NO: 510383 - DNA, 20 bp, Artificial Sequence
  chemically synthesized
ttctaactcatatagttatt

SEQ ID NO: 510384 - DNA, 20 bp, Artificial Sequence
  chemically synthesized
ttaacactcctaataactat

SEQ ID NO: 510385 - DNA, 20 bp, Artificial Sequence
  chemically synthesized
cacatgaggaaactgaggcc

SEQ ID NO: 510386 - DNA, 20 bp, Artificial Sequence
  chemically synthesized
tacttgctatgtgaccttca

SEQ ID NO: 510387 - DNA, 20 bp, Artificial Sequence
  chemically synthesized
aagtagatgtaggggggcag

SEQ ID NO: 510388 - DNA, 20 bp, Artificial Sequence
  chemically synthesized
gggggcagaagagtataggt

SEQ ID NO: 510389 - DNA, 20 bp, Artificial Sequence
  chemically synthesized
tcaaagctaacaagggcaaa

SEQ ID NO: 510390 - DNA, 20 bp, Artificial Sequence
  chemically synthesized
tgaaagggggcaatgagcca

SEQ ID NO: 510391 - DNA, 20 bp, Artificial Sequence
  chemically synthesized
aagctagaaaaggcatggaa

SEQ ID NO: 510392 - DNA, 20 bp, Artificial Sequence
  chemically synthesized
tccttttggaggctgtagag

SEQ ID NO: 510393 - DNA, 20 bp, Artificial Sequence
  chemically synthesized
tgctgatatgttaatgttag

SEQ ID NO: 510394 - DNA, 20 bp, Artificial Sequence
  chemically synthesized
aactaaagaactgtaaaata

SEQ ID NO: 510395 - DNA, 20 bp, Artificial Sequence
  chemically synthesized
atagacacatgattagttat

SEQ ID NO: 510396 - DNA, 20 bp, Artificial Sequence
  chemically synthesized
acacatgattagttatcagg

SEQ ID NO: 510397 - DNA, 20 bp, Artificial Sequence
  chemically synthesized
ccctgtggccatcaactatt

SEQ ID NO: 510398 - DNA, 20 bp, Artificial Sequence
  chemically synthesized
ctcggtctcaaaacactacc

SEQ ID NO: 510399 - DNA, 20 bp, Artificial Sequence
  chemically synthesized
ttcagggtagtgttttgaga

SEQ ID NO: 510400 - DNA, 20 bp, Artificial Sequence
  chemically synthesized
tcttgccctgtcacccaggc

SEQ ID NO: 510401 - DNA, 20 bp, Artificial Sequence
  chemically synthesized
atcggccactgcactccagc

SEQ ID NO: 510402 - DNA, 20 bp, Artificial Sequence
  chemically synthesized
tacttgggaagctgaggcat

SEQ ID NO: 510403 - DNA, 20 bp, Artificial Sequence
  chemically synthesized
gcctcagcttcccaagtagc

SEQ ID NO: 510404 - DNA, 20 bp, Artificial Sequence
  chemically synthesized
actgaaaacacaaaaattaa

SEQ ID NO: 510405 - DNA, 20 bp, Artificial Sequence
  chemically synthesized
cggggagatcacttgaggct

SEQ ID NO: 510406 - DNA, 20 bp, Artificial Sequence
  chemically synthesized
ctgtaatcccgcctcttttg

SEQ ID NO: 510407 - DNA, 20 bp, Artificial Sequence
  chemically synthesized
gcgtcatcctccaaaagagg

SEQ ID NO: 510408 - DNA, 20 bp, Artificial Sequence
  chemically synthesized
aaaacaaactacaccgcgag

SEQ ID NO: 510409 - DNA, 20 bp, Artificial Sequence
  chemically synthesized
gtttttttaagtgttacaat

SEQ ID NO: 510410 - DNA, 20 bp, Artificial Sequence
  chemically synthesized
tatttggaggtgttgctgat

SEQ ID NO: 510411 - DNA, 20 bp, Artificial Sequence
  chemically synthesized
ctgaaattgttcttattaaa

SEQ ID NO: 510412 - DNA, 20 bp, Artificial Sequence
  chemically synthesized
ggtcaaaatgggaaagtttt

SEQ ID NO: 510413 - DNA, 20 bp, Artificial Sequence
  chemically synthesized
aaaatgggaaagttttaaga

SEQ ID NO: 510414 - DNA, 20 bp, Artificial Sequence
  chemically synthesized
ggaaagttttaagagtgaat

SEQ ID NO: 510415 - DNA, 20 bp, Artificial Sequence
  chemically synthesized
atatatagcagttactacag

SEQ ID NO: 510416 - DNA, 20 bp, Artificial Sequence
  chemically synthesized
ctgtagtaactgctatatat

SEQ ID NO: 510417 - DNA, 20 bp, Artificial Sequence
  chemically synthesized
cagtgaatttaggaaaacag

SEQ ID NO: 510418 - DNA, 20 bp, Artificial Sequence
  chemically synthesized
ctactgttttcctaaattca

SEQ ID NO: 510419 - DNA, 20 bp, Artificial Sequence
  chemically synthesized
tgatgattgaaaattattca

SEQ ID NO: 510420 - DNA, 20 bp, Artificial Sequence
  chemically synthesized
aactacattaaatattgctg

SEQ ID NO: 510421 - DNA, 20 bp, Artificial Sequence
  chemically synthesized
ttctctgaaaacactttctt

SEQ ID NO: 510422 - DNA, 20 bp, Artificial Sequence
  chemically synthesized
aaacactttcttctggattc

SEQ ID NO: 510423 - DNA, 20 bp, Artificial Sequence
  chemically synthesized
agaagatagatgtggcattc

SEQ ID NO: 510424 - DNA, 20 bp, Artificial Sequence
  chemically synthesized
tggcaatcttatcctggccg

SEQ ID NO: 510425 - DNA, 20 bp, Artificial Sequence
  chemically synthesized
tgttatttaaatccatcggc

SEQ ID NO: 510426 - DNA, 20 bp, Artificial Sequence
  chemically synthesized
ggggttctaagatcagagtt

SEQ ID NO: 510427 - DNA, 20 bp, Artificial Sequence
  chemically synthesized
taaagaaggggttctaagat

SEQ ID NO: 510428 - DNA, 20 bp, Artificial Sequence
  chemically synthesized
gctatgaatgcatgtaaaga

SEQ ID NO: 510429 - DNA, 20 bp, Artificial Sequence
  chemically synthesized
cttgaggtgcctatgaggct

SEQ ID NO: 510430 - DNA, 20 bp, Artificial Sequence
  chemically synthesized
acaggtttgggagtgaacgt

SEQ ID NO: 510431 - DNA, 20 bp, Artificial Sequence
  chemically synthesized
actgtagaaggaacaggttt

SEQ ID NO: 510432 - DNA, 20 bp, Artificial Sequence
  chemically synthesized
tagagttgccacaaaccaag

SEQ ID NO: 510433 - DNA, 20 bp, Artificial Sequence
  chemically synthesized
tacttaagcaactggccaaa

SEQ ID NO: 510434 - DNA, 20 bp, Artificial Sequence
  chemically synthesized
atgaaataattagagaaatc

SEQ ID NO: 510435 - DNA, 20 bp, Artificial Sequence
  chemically synthesized
tagcatagcatatctggtag

SEQ ID NO: 510436 - DNA, 20 bp, Artificial Sequence
  chemically synthesized
ctaccagatatgctatgcta

SEQ ID NO: 510437 - DNA, 20 bp, Artificial Sequence
  chemically synthesized
ttatttatgtatttttgaga

SEQ ID NO: 510438 - DNA, 20 bp, Artificial Sequence
  chemically synthesized
tgcactacagcatgggcaac

SEQ ID NO: 510439 - DNA, 20 bp, Artificial Sequence
  chemically synthesized
cccgggaggtggaggttgca

SEQ ID NO: 510440 - DNA, 20 bp, Artificial Sequence
  chemically synthesized
ctcactgcaacctccacctc

SEQ ID NO: 510441 - DNA, 20 bp, Artificial Sequence
  chemically synthesized
tactcgggaggctgaggcag

SEQ ID NO: 510442 - DNA, 20 bp, Artificial Sequence
  chemically synthesized
gattctcctgcctcagcctc

SEQ ID NO: 510443 - DNA, 20 bp, Artificial Sequence
  chemically synthesized
gcctcagcctcccgagtagc

SEQ ID NO: 510444 - DNA, 20 bp, Artificial Sequence
  chemically synthesized
tactaaaaatacaaaattag

SEQ ID NO: 510445 - DNA, 20 bp, Artificial Sequence
  chemically synthesized
ttttgtatttttagtagaga

SEQ ID NO: 510446 - DNA, 20 bp, Artificial Sequence
  chemically synthesized
gtgggtggatcacctgaggt

SEQ ID NO: 510447 - DNA, 20 bp, Artificial Sequence
  chemically synthesized
actttgggaggccaaggtgg

SEQ ID NO: 510448 - DNA, 20 bp, Artificial Sequence
  chemically synthesized
cagtactttgggaggccaag

SEQ ID NO: 510449 - DNA, 20 bp, Artificial Sequence
  chemically synthesized
ccttggcctcccaaagtact

SEQ ID NO: 510450 - DNA, 20 bp, Artificial Sequence
  chemically synthesized
ccggccttaccatttattaa

SEQ ID NO: 510451 - DNA, 20 bp, Artificial Sequence
  chemically synthesized
ggcatgagggaagacagcag

SEQ ID NO: 510452 - DNA, 20 bp, Artificial Sequence
  chemically synthesized
cagcaggaggataataaaat

SEQ ID NO: 510453 - DNA, 20 bp, Artificial Sequence
  chemically synthesized
tgattatttagcgcttgtgt

SEQ ID NO: 510454 - DNA, 20 bp, Artificial Sequence
  chemically synthesized
agcgctaaataatcaaatgt

SEQ ID NO: 510455 - DNA, 20 bp, Artificial Sequence
  chemically synthesized
gtgtgcgtaacgcaatatat

SEQ ID NO: 510456 - DNA, 20 bp, Artificial Sequence
  chemically synthesized
catgcccatgctcattatag

SEQ ID NO: 510457 - DNA, 20 bp, Artificial Sequence
  chemically synthesized
tactataatgagcatgggca

SEQ ID NO: 510458 - DNA, 20 bp, Artificial Sequence
  chemically synthesized
taatgagcatgggcatggag

SEQ ID NO: 510459 - DNA, 20 bp, Artificial Sequence
  chemically synthesized
ggagttgaataaatgcaaat

SEQ ID NO: 510460 - DNA, 20 bp, Artificial Sequence
  chemically synthesized
taattagtaagtggcagaac

SEQ ID NO: 510461 - DNA, 20 bp, Artificial Sequence
  chemically synthesized
cttttatgcttcccttagct

SEQ ID NO: 510462 - DNA, 20 bp, Artificial Sequence
  chemically synthesized
tggggcacctgtgtgggaga

SEQ ID NO: 510463 - DNA, 20 bp, Artificial Sequence
  chemically synthesized
atcttttcgaggcagtttag

SEQ ID NO: 510464 - DNA, 20 bp, Artificial Sequence
  chemically synthesized
aaaattgtattattagggct

SEQ ID NO: 510465 - DNA, 20 bp, Artificial Sequence
  chemically synthesized
atactaggtttgagatatta

SEQ ID NO: 510466 - DNA, 20 bp, Artificial Sequence
  chemically synthesized
tcaaggtatagatacataca

SEQ ID NO: 510467 - DNA, 20 bp, Artificial Sequence
  chemically synthesized
ttcaccacttccaatcttac

SEQ ID NO: 510468 - DNA, 20 bp, Artificial Sequence
  chemically synthesized
aatgatcatttgcatacaga

SEQ ID NO: 510469 - DNA, 20 bp, Artificial Sequence
  chemically synthesized
aaaagaacaagtacagagat

SEQ ID NO: 510470 - DNA, 20 bp, Artificial Sequence
  chemically synthesized
agaatgccaagatatttccc

SEQ ID NO: 510471 - DNA, 20 bp, Artificial Sequence
  chemically synthesized
gagccaggtaatgaaagaca

SEQ ID NO: 510472 - DNA, 20 bp, Artificial Sequence
  chemically synthesized
agtcagagaggaagaacccg

SEQ ID NO: 510473 - DNA, 20 bp, Artificial Sequence
  chemically synthesized
tttctcagcctctacactca

SEQ ID NO: 510474 - DNA, 20 bp, Artificial Sequence
  chemically synthesized
gtggtagaaagttaggagag

SEQ ID NO: 510475 - DNA, 20 bp, Artificial Sequence
  chemically synthesized
agccatttgtctctgtgatt

SEQ ID NO: 510476 - DNA, 20 bp, Artificial Sequence
  chemically synthesized
tgattaagaatacttatttg

SEQ ID NO: 510477 - DNA, 20 bp, Artificial Sequence
  chemically synthesized
ataaataaatgaagttaaag

SEQ ID NO: 510478 - DNA, 20 bp, Artificial Sequence
  chemically synthesized
aaagcagagtgatgtgtctg

SEQ ID NO: 510479 - DNA, 20 bp, Artificial Sequence
  chemically synthesized
ctataagaggagagagccat

SEQ ID NO: 510480 - DNA, 20 bp, Artificial Sequence
  chemically synthesized
actttaataaagctttctga

SEQ ID NO: 510481 - DNA, 20 bp, Artificial Sequence
  chemically synthesized
ggaatcagatccagcctgtc

SEQ ID NO: 510482 - DNA, 20 bp, Artificial Sequence
  chemically synthesized
tcaaaggaactcaagacagg

SEQ ID NO: 510483 - DNA, 20 bp, Artificial Sequence
  chemically synthesized
ttgaaataaatgttcttagt

SEQ ID NO: 510484 - DNA, 20 bp, Artificial Sequence
  chemically synthesized
tgatatgcttcctttagtga

SEQ ID NO: 510485 - DNA, 20 bp, Artificial Sequence
  chemically synthesized
atcacaagagatgggggatg

SEQ ID NO: 510486 - DNA, 20 bp, Artificial Sequence
  chemically synthesized
agcacaaatcacaagagatg

SEQ ID NO: 510487 - DNA, 20 bp, Artificial Sequence
  chemically synthesized
atgataaacattacatttat

SEQ ID NO: 510488 - DNA, 20 bp, Artificial Sequence
  chemically synthesized
attttaaataaaacaagtaa

SEQ ID NO: 510489 - DNA, 20 bp, Artificial Sequence
  chemically synthesized
aaaacaagtaagtgaatttg

SEQ ID NO: 510490 - DNA, 20 bp, Artificial Sequence
  chemically synthesized
tggtaatatttacacaaagg

SEQ ID NO: 510491 - DNA, 20 bp, Artificial Sequence
  chemically synthesized
catttgtaattacttcatta

SEQ ID NO: 510492 - DNA, 20 bp, Artificial Sequence
  chemically synthesized
atgaggtgaaaatgtgctac

SEQ ID NO: 510493 - DNA, 20 bp, Artificial Sequence
  chemically synthesized
catacaccaagcaaagatat

SEQ ID NO: 510494 - DNA, 20 bp, Artificial Sequence
  chemically synthesized
gttgaaatcaccaagactta

SEQ ID NO: 510495 - DNA, 20 bp, Artificial Sequence
  chemically synthesized
gtcttggtgatttcaacgga

SEQ ID NO: 510496 - DNA, 20 bp, Artificial Sequence
  chemically synthesized
acggagggaatggtgataaa

SEQ ID NO: 510497 - DNA, 20 bp, Artificial Sequence
  chemically synthesized
atggtgataaattgagtcta

SEQ ID NO: 510498 - DNA, 20 bp, Artificial Sequence
  chemically synthesized
ttgagtctagagagtcgatg

SEQ ID NO: 510499 - DNA, 20 bp, Artificial Sequence
  chemically synthesized
cgatggagagtcaagaggtc

SEQ ID NO: 510500 - DNA, 20 bp, Artificial Sequence
  chemically synthesized
tcaagaggtccagaatgaga

SEQ ID NO: 510501 - DNA, 20 bp, Artificial Sequence
  chemically synthesized
gctttgcaagtaaactagcc

SEQ ID NO: 510502 - DNA, 20 bp, Artificial Sequence
  chemically synthesized
gtcataactatttcaaagct

SEQ ID NO: 510503 - DNA, 20 bp, Artificial Sequence
  chemically synthesized
accactatcttaacaaaaaa

SEQ ID NO: 510504 - DNA, 20 bp, Artificial Sequence
  chemically synthesized
tgtacacattttttagccga

SEQ ID NO: 510505 - DNA, 20 bp, Artificial Sequence
  chemically synthesized
atcaaaactacactatgaat

SEQ ID NO: 510506 - DNA, 20 bp, Artificial Sequence
  chemically synthesized
atttttatcaaaactacact

SEQ ID NO: 510507 - DNA, 20 bp, Artificial Sequence
  chemically synthesized
agccaattcgaaacgtgcta

SEQ ID NO: 510508 - DNA, 20 bp, Artificial Sequence
  chemically synthesized
atcacatcctctagcacgtt

SEQ ID NO: 510509 - DNA, 20 bp, Artificial Sequence
  chemically synthesized
gctaggattgctagatttgc

SEQ ID NO: 510510 - DNA, 20 bp, Artificial Sequence
  chemically synthesized
agcgtgggaatgaaatgtgc

SEQ ID NO: 510511 - DNA, 20 bp, Artificial Sequence
  chemically synthesized
ccttataaatgttacagcgt

SEQ ID NO: 510512 - DNA, 20 bp, Artificial Sequence
  chemically synthesized
ataaggctatttcttgtata

SEQ ID NO: 510513 - DNA, 20 bp, Artificial Sequence
  chemically synthesized
tgggttccatacaatattga

SEQ ID NO: 510514 - DNA, 20 bp, Artificial Sequence
  chemically synthesized
tgaaagggtggaaaactcca

SEQ ID NO: 510515 - DNA, 20 bp, Artificial Sequence
  chemically synthesized
tctatatgaggaagactcag

SEQ ID NO: 510516 - DNA, 20 bp, Artificial Sequence
  chemically synthesized
agaaagtactaaacattgcc

SEQ ID NO: 510517 - DNA, 20 bp, Artificial Sequence
  chemically synthesized
gcagttatatttttcttaca

SEQ ID NO: 510518 - DNA, 20 bp, Artificial Sequence
  chemically synthesized
cttacatagaatatatattt

SEQ ID NO: 510519 - DNA, 20 bp, Artificial Sequence
  chemically synthesized
catagaatatatattttaga

SEQ ID NO: 510520 - DNA, 20 bp, Artificial Sequence
  chemically synthesized
aatagataaaataattcact

SEQ ID NO: 510521 - DNA, 20 bp, Artificial Sequence
  chemically synthesized
aggaaatacatacattctaa

SEQ ID NO: 510522 - DNA, 20 bp, Artificial Sequence
  chemically synthesized
cactatttggggagattttt

SEQ ID NO: 510523 - DNA, 20 bp, Artificial Sequence
  chemically synthesized
atgaaagtagaaaccattac

SEQ ID NO: 510524 - DNA, 20 bp, Artificial Sequence
  chemically synthesized
tacgggaattcatatttatg

SEQ ID NO: 510525 - DNA, 20 bp, Artificial Sequence
  chemically synthesized
tacgttgattcttcataaat

SEQ ID NO: 510526 - DNA, 20 bp, Artificial Sequence
  chemically synthesized
catgtgattctgctttgtta

SEQ ID NO: 510527 - DNA, 20 bp, Artificial Sequence
  chemically synthesized
gagaagactcaataacaaag

SEQ ID NO: 510528 - DNA, 20 bp, Artificial Sequence
  chemically synthesized
aacaaagcagaatcacatga

SEQ ID NO: 510529 - DNA, 20 bp, Artificial Sequence
  chemically synthesized
ctaacactgcttttacttgc

SEQ ID NO: 510530 - DNA, 20 bp, Artificial Sequence
  chemically synthesized
gttctctggtttgtacaaca

SEQ ID NO: 510531 - DNA, 20 bp, Artificial Sequence
  chemically synthesized
tgaaggaaatgggctccgtg

SEQ ID NO: 510532 - DNA, 20 bp, Artificial Sequence
  chemically synthesized
cctgtgtgtaggcatagctc

SEQ ID NO: 510533 - DNA, 20 bp, Artificial Sequence
  chemically synthesized
gatcacggtcagtctagcac

SEQ ID NO: 510534 - DNA, 20 bp, Artificial Sequence
  chemically synthesized
actgaccgtgatctgcagag

SEQ ID NO: 510535 - DNA, 20 bp, Artificial Sequence
  chemically synthesized
atctgcagagaagggtttgg

SEQ ID NO: 510536 - DNA, 20 bp, Artificial Sequence
  chemically synthesized
gcagagaagggtttggggga

SEQ ID NO: 510537 - DNA, 20 bp, Artificial Sequence
  chemically synthesized
catgttggaaagtagtcctt

SEQ ID NO: 510538 - DNA, 20 bp, Artificial Sequence
  chemically synthesized
tatatgtttagtattaaaca

SEQ ID NO: 510539 - DNA, 20 bp, Artificial Sequence
  chemically synthesized
attctgggagtataccaatt

SEQ ID NO: 510540 - DNA, 20 bp, Artificial Sequence
  chemically synthesized
attcgaaattggtatactcc

SEQ ID NO: 510541 - DNA, 20 bp, Artificial Sequence
  chemically synthesized
atattaagtgccttcattct

SEQ ID NO: 510542 - DNA, 20 bp, Artificial Sequence
  chemically synthesized
aggcacttaatatcatgttg

SEQ ID NO: 510543 - DNA, 20 bp, Artificial Sequence
  chemically synthesized
tgagcatgctatttagccat

SEQ ID NO: 510544 - DNA, 20 bp, Artificial Sequence
  chemically synthesized
atgttggagttgtgttactt

SEQ ID NO: 510545 - DNA, 20 bp, Artificial Sequence
  chemically synthesized
gtaccatcccatataaatgt

SEQ ID NO: 510546 - DNA, 20 bp, Artificial Sequence
  chemically synthesized
acacaactccaacatttata

SEQ ID NO: 510547 - DNA, 20 bp, Artificial Sequence
  chemically synthesized
tgcctgtttttgccggattg

SEQ ID NO: 510548 - DNA, 20 bp, Artificial Sequence
  chemically synthesized
cttatggatgcctgtttttg

SEQ ID NO: 510549 - DNA, 20 bp, Artificial Sequence
  chemically synthesized
ggatttagagaaaattgctt

SEQ ID NO: 510550 - DNA, 20 bp, Artificial Sequence
  chemically synthesized
gaattctgtttttatttact

SEQ ID NO: 510551 - DNA, 20 bp, Artificial Sequence
  chemically synthesized
aaatccaaagtaaataaaaa

SEQ ID NO: 510552 - DNA, 20 bp, Artificial Sequence
  chemically synthesized
ctttccagggtatggacctg

SEQ ID NO: 510553 - DNA, 20 bp, Artificial Sequence
  chemically synthesized
atgaaatttttagtcctttc

SEQ ID NO: 510554 - DNA, 20 bp, Artificial Sequence
  chemically synthesized
gagctagctcagcaaagtga

SEQ ID NO: 510555 - DNA, 20 bp, Artificial Sequence
  chemically synthesized
aacctttagcaacatttctg

SEQ ID NO: 510556 - DNA, 20 bp, Artificial Sequence
  chemically synthesized
ttctctcaacagtgggtggt

SEQ ID NO: 510557 - DNA, 20 bp, Artificial Sequence
  chemically synthesized
gcttgttctttctctcaaca

SEQ ID NO: 510558 - DNA, 20 bp, Artificial Sequence
  chemically synthesized
cataattgtatagaatttag

SEQ ID NO: 510559 - DNA, 20 bp, Artificial Sequence
  chemically synthesized
ttcttcgttacataattgta

SEQ ID NO: 510560 - DNA, 20 bp, Artificial Sequence
  chemically synthesized
ttctatacaattatgtaacg

SEQ ID NO: 510561 - DNA, 20 bp, Artificial Sequence
  chemically synthesized
ctattttcaaaattgttatc

SEQ ID NO: 510562 - DNA, 20 bp, Artificial Sequence
  chemically synthesized
aaagtcagattttgattatt

SEQ ID NO: 510563 - DNA, 20 bp, Artificial Sequence
  chemically synthesized
gttctagttgatgaagattt

SEQ ID NO: 510564 - DNA, 20 bp, Artificial Sequence
  chemically synthesized
attcatatgtaccatatcat

SEQ ID NO: 510565 - DNA, 20 bp, Artificial Sequence
  chemically synthesized
attcctatgatatggtacat

SEQ ID NO: 510566 - DNA, 20 bp, Artificial Sequence
  chemically synthesized
tttttaaaatatgttttgaa

SEQ ID NO: 510567 - DNA, 20 bp, Artificial Sequence
  chemically synthesized
catataaaacagaaaacatc

SEQ ID NO: 510568 - DNA, 20 bp, Artificial Sequence
  chemically synthesized
ctttacacactttacctgtt

SEQ ID NO: 510569 - DNA, 20 bp, Artificial Sequence
  chemically synthesized
cttggcaacatttccacttc

SEQ ID NO: 510570 - DNA, 20 bp, Artificial Sequence
  chemically synthesized
cttgttgaggcaaaacttgg

SEQ ID NO: 510571 - DNA, 20 bp, Artificial Sequence
  chemically synthesized
cattaagatggacttcttat

SEQ ID NO: 510572 - DNA, 20 bp, Artificial Sequence
  chemically synthesized
ttctatatttgagactctaa

SEQ ID NO: 510573 - DNA, 20 bp, Artificial Sequence
  chemically synthesized
tgatttgttcattatccttt

SEQ ID NO: 510574 - DNA, 20 bp, Artificial Sequence
  chemically synthesized
agacgatagattaatgaaca

SEQ ID NO: 510575 - DNA, 20 bp, Artificial Sequence
  chemically synthesized
taatgaacagtgaattgtcc

SEQ ID NO: 510576 - DNA, 20 bp, Artificial Sequence
  chemically synthesized
ccagagactaattagaacat

SEQ ID NO: 510577 - DNA, 20 bp, Artificial Sequence
  chemically synthesized
tgacttaggaaaaagtaata

SEQ ID NO: 510578 - DNA, 20 bp, Artificial Sequence
  chemically synthesized
tgccaaactagcccatctaa

SEQ ID NO: 510579 - DNA, 20 bp, Artificial Sequence
  chemically synthesized
tttaattaccagtgcaccat

SEQ ID NO: 510580 - DNA, 20 bp, Artificial Sequence
  chemically synthesized
agaaacctgataccttttaa

SEQ ID NO: 510581 - DNA, 20 bp, Artificial Sequence
  chemically synthesized
ctaaataagtctctgctgaa

SEQ ID NO: 510582 - DNA, 20 bp, Artificial Sequence
  chemically synthesized
ttttctgtttaatttatatt

SEQ ID NO: 510583 - DNA, 20 bp, Artificial Sequence
  chemically synthesized
acaaatatttttaacataca

SEQ ID NO: 510584 - DNA, 20 bp, Artificial Sequence
  chemically synthesized
tttgtttacattgtggtgca

SEQ ID NO: 510585 - DNA, 20 bp, Artificial Sequence
  chemically synthesized
ttgtggtgcatgggataaag

SEQ ID NO: 510586 - DNA, 20 bp, Artificial Sequence
  chemically synthesized
ttcactttctggatgtggca

SEQ ID NO: 510587 - DNA, 20 bp, Artificial Sequence
  chemically synthesized
tcctttgccacatccagaaa

SEQ ID NO: 510588 - DNA, 20 bp, Artificial Sequence
  chemically synthesized
tgctgcgtttcattcacttt

SEQ ID NO: 510589 - DNA, 20 bp, Artificial Sequence
  chemically synthesized
attttaatgccaagtagcaa

SEQ ID NO: 510590 - DNA, 20 bp, Artificial Sequence
  chemically synthesized
ttacatcttggttcactgga

SEQ ID NO: 510591 - DNA, 20 bp, Artificial Sequence
  chemically synthesized
tactttacatcttggttcac

SEQ ID NO: 510592 - DNA, 20 bp, Artificial Sequence
  chemically synthesized
ctaatgacatacttcacata

SEQ ID NO: 510593 - DNA, 20 bp, Artificial Sequence
  chemically synthesized
cttctttttaaaggatgaaa

SEQ ID NO: 510594 - DNA, 20 bp, Artificial Sequence
  chemically synthesized
acaaaatttccttcttttta

SEQ ID NO: 510595 - DNA, 20 bp, Artificial Sequence
  chemically synthesized
agacagcatgtgtaaatctg

SEQ ID NO: 510596 - DNA, 20 bp, Artificial Sequence
  chemically synthesized
cacatgatctcactaacaca

SEQ ID NO: 510597 - DNA, 20 bp, Artificial Sequence
  chemically synthesized
aacacatggaatctaaaaag

SEQ ID NO: 510598 - DNA, 20 bp, Artificial Sequence
  chemically synthesized
aagttgaattcatagaagta

SEQ ID NO: 510599 - DNA, 20 bp, Artificial Sequence
  chemically synthesized
ccattctactctctacttct

SEQ ID NO: 510600 - DNA, 20 bp, Artificial Sequence
  chemically synthesized
gaattcatagaagtagagag

SEQ ID NO: 510601 - DNA, 20 bp, Artificial Sequence
  chemically synthesized
tttaccaggggctgtggggc

SEQ ID NO: 510602 - DNA, 20 bp, Artificial Sequence
  chemically synthesized
ctactctcgcagcaattttt

SEQ ID NO: 510603 - DNA, 20 bp, Artificial Sequence
  chemically synthesized
gtattcctaaaaattgctgc

SEQ ID NO: 510604 - DNA, 20 bp, Artificial Sequence
  chemically synthesized
tatgcttagcatgtttcatg

SEQ ID NO: 510605 - DNA, 20 bp, Artificial Sequence
  chemically synthesized
tttgaaatatgtatacgttc

SEQ ID NO: 510606 - DNA, 20 bp, Artificial Sequence
  chemically synthesized
ttttagttttttaatcatta

SEQ ID NO: 510607 - DNA, 20 bp, Artificial Sequence
  chemically synthesized
acattaccttgacctcctgc

SEQ ID NO: 510608 - DNA, 20 bp, Artificial Sequence
  chemically synthesized
acctgatcagaatatacata

SEQ ID NO: 510609 - DNA, 20 bp, Artificial Sequence
  chemically synthesized
ttataatcagaacacctgat

SEQ ID NO: 510610 - DNA, 20 bp, Artificial Sequence
  chemically synthesized
tgattataagtgaaaaagcc

SEQ ID NO: 510611 - DNA, 20 bp, Artificial Sequence
  chemically synthesized
catggttctgatacttgcaa

SEQ ID NO: 510612 - DNA, 20 bp, Artificial Sequence
  chemically synthesized
atttttaaagtatttttaaa

SEQ ID NO: 510613 - DNA, 20 bp, Artificial Sequence
  chemically synthesized
gagaagcactgtattgttct

SEQ ID NO: 510614 - DNA, 20 bp, Artificial Sequence
  chemically synthesized
aggtgattcatatgtacatt

SEQ ID NO: 510615 - DNA, 20 bp, Artificial Sequence
  chemically synthesized
tctcaattcttaatgtacat

SEQ ID NO: 510616 - DNA, 20 bp, Artificial Sequence
  chemically synthesized
aatgtacatatgaatcacct

SEQ ID NO: 510617 - DNA, 20 bp, Artificial Sequence
  chemically synthesized
ctggggatcttttaaaacta

SEQ ID NO: 510618 - DNA, 20 bp, Artificial Sequence
  chemically synthesized
cagaatctgattcaatagat

SEQ ID NO: 510619 - DNA, 20 bp, Artificial Sequence
  chemically synthesized
ccaggctctaccccgatcta

SEQ ID NO: 510620 - DNA, 20 bp, Artificial Sequence
  chemically synthesized
aactgctagtctgctacatt

SEQ ID NO: 510621 - DNA, 20 bp, Artificial Sequence
  chemically synthesized
gtctaatatcatttgaataa

SEQ ID NO: 510622 - DNA, 20 bp, Artificial Sequence
  chemically synthesized
attgaaatgtctaatatcat

SEQ ID NO: 510623 - DNA, 20 bp, Artificial Sequence
  chemically synthesized
taatcttacaaacttagctt

SEQ ID NO: 510624 - DNA, 20 bp, Artificial Sequence
  chemically synthesized
aattggagatttctaggctt

SEQ ID NO: 510625 - DNA, 20 bp, Artificial Sequence
  chemically synthesized
ttttgaaaaacaattatcaa

SEQ ID NO: 510626 - DNA, 20 bp, Artificial Sequence
  chemically synthesized
tgagaaggaagaacattttc

SEQ ID NO: 510627 - DNA, 20 bp, Artificial Sequence
  chemically synthesized
ccatgatgtgagaaaacaaa

SEQ ID NO: 510628 - DNA, 20 bp, Artificial Sequence
  chemically synthesized
tgtctatgtataacacagca

SEQ ID NO: 510629 - DNA, 20 bp, Artificial Sequence
  chemically synthesized
attccacataatctcagaag

SEQ ID NO: 510630 - DNA, 20 bp, Artificial Sequence
  chemically synthesized
atcccacttctgagattatg

SEQ ID NO: 510631 - DNA, 20 bp, Artificial Sequence
  chemically synthesized
atttctacctactggcagtt

SEQ ID NO: 510632 - DNA, 20 bp, Artificial Sequence
  chemically synthesized
aataagtaatttttgaagaa

SEQ ID NO: 510633 - DNA, 20 bp, Artificial Sequence
  chemically synthesized
tttaggtcttctaaaatatt

SEQ ID NO: 510634 - DNA, 20 bp, Artificial Sequence
  chemically synthesized
ggataatccattaaaatact

SEQ ID NO: 510635 - DNA, 20 bp, Artificial Sequence
  chemically synthesized
attatattcaaagtatttta

SEQ ID NO: 510636 - DNA, 20 bp, Artificial Sequence
  chemically synthesized
ttttctatctttcaaatttc

SEQ ID NO: 510637 - DNA, 20 bp, Artificial Sequence
  chemically synthesized
atttgaaagatagaaaattc

SEQ ID NO: 510638 - DNA, 20 bp, Artificial Sequence
  chemically synthesized
ccaaattagaagcagaattc

SEQ ID NO: 510639 - DNA, 20 bp, Artificial Sequence
  chemically synthesized
ttcttattccaaattagaag

SEQ ID NO: 510640 - DNA, 20 bp, Artificial Sequence
  chemically synthesized
catgaattctgcttctaatt

SEQ ID NO: 510641 - DNA, 20 bp, Artificial Sequence
  chemically synthesized
aaagtaattgcattgctgaa

SEQ ID NO: 510642 - DNA, 20 bp, Artificial Sequence
  chemically synthesized
tttaaaatcatataatattg

SEQ ID NO: 510643 - DNA, 20 bp, Artificial Sequence
  chemically synthesized
aattcagtttcctatttaaa

SEQ ID NO: 510644 - DNA, 20 bp, Artificial Sequence
  chemically synthesized
aattctctttaaataggaaa

SEQ ID NO: 510645 - DNA, 20 bp, Artificial Sequence
  chemically synthesized
gaaactgaattaattatgca

SEQ ID NO: 510646 - DNA, 20 bp, Artificial Sequence
  chemically synthesized
atttcaatagctggaaatga

SEQ ID NO: 510647 - DNA, 20 bp, Artificial Sequence
  chemically synthesized
ctggaaatgagggaatgggg

SEQ ID NO: 510648 - DNA, 20 bp, Artificial Sequence
  chemically synthesized
ggaagagtattcggggcagt

SEQ ID NO: 510649 - DNA, 20 bp, Artificial Sequence
  chemically synthesized
ttctacatattcccactgcc

SEQ ID NO: 510650 - DNA, 20 bp, Artificial Sequence
  chemically synthesized
ttcggggcagtgggaatatg

SEQ ID NO: 510651 - DNA, 20 bp, Artificial Sequence
  chemically synthesized
gtggctttgtgtgtcttaga

SEQ ID NO: 510652 - DNA, 20 bp, Artificial Sequence
  chemically synthesized
tttgtgtgtcttagagagag

SEQ ID NO: 510653 - DNA, 20 bp, Artificial Sequence
  chemically synthesized
agattgtacatagaaaactg

SEQ ID NO: 510654 - DNA, 20 bp, Artificial Sequence
  chemically synthesized
ggccttcattcaatagacta

SEQ ID NO: 510655 - DNA, 20 bp, Artificial Sequence
  chemically synthesized
agtatttactctctagtcta

SEQ ID NO: 510656 - DNA, 20 bp, Artificial Sequence
  chemically synthesized
gagtaaatacttttcaatga

SEQ ID NO: 510657 - DNA, 20 bp, Artificial Sequence
  chemically synthesized
taaagtaaattctttaagta

SEQ ID NO: 510658 - DNA, 20 bp, Artificial Sequence
  chemically synthesized
agcaatccattctgtactta

SEQ ID NO: 510659 - DNA, 20 bp, Artificial Sequence
  chemically synthesized
gtaaattctttaagtacaga

SEQ ID NO: 510660 - DNA, 20 bp, Artificial Sequence
  chemically synthesized
agatcttgaacactttatat

SEQ ID NO: 510661 - DNA, 20 bp, Artificial Sequence
  chemically synthesized
ggggaaatgaaaacaagtca

SEQ ID NO: 510662 - DNA, 20 bp, Artificial Sequence
  chemically synthesized
tgaatgacaaaaattctaag

SEQ ID NO: 510663 - DNA, 20 bp, Artificial Sequence
  chemically synthesized
aagtcatttttgatccatct

SEQ ID NO: 510664 - DNA, 20 bp, Artificial Sequence
  chemically synthesized
tggagtaaatgatttgaaaa

SEQ ID NO: 510665 - DNA, 20 bp, Artificial Sequence
  chemically synthesized
ataggcatttccaaagactg

SEQ ID NO: 510666 - DNA, 20 bp, Artificial Sequence
  chemically synthesized
aaagttatgtgctacagcct

SEQ ID NO: 510667 - DNA, 20 bp, Artificial Sequence
  chemically synthesized
ctaattgttaaatgaataaa

SEQ ID NO: 510668 - DNA, 20 bp, Artificial Sequence
  chemically synthesized
atggaggaactaattgttaa

SEQ ID NO: 510669 - DNA, 20 bp, Artificial Sequence
  chemically synthesized
ttggctgggggaagcatgat

SEQ ID NO: 510670 - DNA, 20 bp, Artificial Sequence
  chemically synthesized
actctggcaaagtttcagaa

SEQ ID NO: 510671 - DNA, 20 bp, Artificial Sequence
  chemically synthesized
actcccttctgaaactttgc

SEQ ID NO: 510672 - DNA, 20 bp, Artificial Sequence
  chemically synthesized
ccttctgaaactttgccaga

SEQ ID NO: 510673 - DNA, 20 bp, Artificial Sequence
  chemically synthesized
tgagaattatcttcattgaa

SEQ ID NO: 510674 - DNA, 20 bp, Artificial Sequence
  chemically synthesized
agaccattgttaattagttt

SEQ ID NO: 510675 - DNA, 20 bp, Artificial Sequence
  chemically synthesized
ctaattaacaatggtctcac

SEQ ID NO: 510676 - DNA, 20 bp, Artificial Sequence
  chemically synthesized
agaacatttcagattgggaa

SEQ ID NO: 510677 - DNA, 20 bp, Artificial Sequence
  chemically synthesized
atctaagaacatttcagatt

SEQ ID NO: 510678 - DNA, 20 bp, Artificial Sequence
  chemically synthesized
gtattcttaggttttgcggg

SEQ ID NO: 510679 - DNA, 20 bp, Artificial Sequence
  chemically synthesized
tgactccccccgcaaaacct

SEQ ID NO: 510680 - DNA, 20 bp, Artificial Sequence
  chemically synthesized
tcataacatcttaaataaga

SEQ ID NO: 510681 - DNA, 20 bp, Artificial Sequence
  chemically synthesized
ctttacagttttactaaaca

SEQ ID NO: 510682 - DNA, 20 bp, Artificial Sequence
  chemically synthesized
tactattaacaggaagccag

SEQ ID NO: 510683 - DNA, 20 bp, Artificial Sequence
  chemically synthesized
tgacaatcacttagcacata

SEQ ID NO: 510684 - DNA, 20 bp, Artificial Sequence
  chemically synthesized
taagtgattgtcatgtgcta

SEQ ID NO: 510685 - DNA, 20 bp, Artificial Sequence
  chemically synthesized
tacttagactatgttagatt

SEQ ID NO: 510686 - DNA, 20 bp, Artificial Sequence
  chemically synthesized
aaaagtaatgtttataatta

SEQ ID NO: 510687 - DNA, 20 bp, Artificial Sequence
  chemically synthesized
aaaataaatgttatggactt

SEQ ID NO: 510688 - DNA, 20 bp, Artificial Sequence
  chemically synthesized
ttagtgcagtcatcataaat

SEQ ID NO: 510689 - DNA, 20 bp, Artificial Sequence
  chemically synthesized
ttaggtgatcacagagtgcc

SEQ ID NO: 510690 - DNA, 20 bp, Artificial Sequence
  chemically synthesized
aacaaatacttaggtgatca

SEQ ID NO: 510691 - DNA, 20 bp, Artificial Sequence
  chemically synthesized
gactttaactgtcctctgta

SEQ ID NO: 510692 - DNA, 20 bp, Artificial Sequence
  chemically synthesized
ttaaagtcatagaaattgat

SEQ ID NO: 510693 - DNA, 20 bp, Artificial Sequence
  chemically synthesized
ctaaaggcaatggtatgata

SEQ ID NO: 510694 - DNA, 20 bp, Artificial Sequence
  chemically synthesized
tgagtactataaagtatttg

SEQ ID NO: 510695 - DNA, 20 bp, Artificial Sequence
  chemically synthesized
tttgaggagtatgaaaatga

SEQ ID NO: 510696 - DNA, 20 bp, Artificial Sequence
  chemically synthesized
ttatgaaatgagagcagtgg

SEQ ID NO: 510697 - DNA, 20 bp, Artificial Sequence
  chemically synthesized
aattgttaagttcttacttt

SEQ ID NO: 510698 - DNA, 20 bp, Artificial Sequence
  chemically synthesized
tccgtgagcattttatgtag

SEQ ID NO: 510699 - DNA, 20 bp, Artificial Sequence
  chemically synthesized
ttctgagacggcttcaaaga

SEQ ID NO: 510700 - DNA, 20 bp, Artificial Sequence
  chemically synthesized
tccaatctttgaagccgtct

SEQ ID NO: 510701 - DNA, 20 bp, Artificial Sequence
  chemically synthesized
gtaaaatctctagcagtatt

SEQ ID NO: 510702 - DNA, 20 bp, Artificial Sequence
  chemically synthesized
gaacaataacaccgtttctg

SEQ ID NO: 510703 - DNA, 20 bp, Artificial Sequence
  chemically synthesized
ctgatgagtgtttcatattt

SEQ ID NO: 510704 - DNA, 20 bp, Artificial Sequence
  chemically synthesized
tagcgaaatttgatcatttt

SEQ ID NO: 510705 - DNA, 20 bp, Artificial Sequence
  chemically synthesized
aatctgattttgactagcct

SEQ ID NO: 510706 - DNA, 20 bp, Artificial Sequence
  chemically synthesized
tacactgagatagtatctga

SEQ ID NO: 510707 - DNA, 20 bp, Artificial Sequence
  chemically synthesized
cttactcacattgactttct

SEQ ID NO: 510708 - DNA, 20 bp, Artificial Sequence
  chemically synthesized
ctcaccccaagaaagtcaat

SEQ ID NO: 510709 - DNA, 20 bp, Artificial Sequence
  chemically synthesized
gaagtccgattagccagtcg

SEQ ID NO: 510710 - DNA, 20 bp, Artificial Sequence
  chemically synthesized
gtttctgccaagggacaggc

SEQ ID NO: 510711 - DNA, 20 bp, Artificial Sequence
  chemically synthesized
gacaggcaggaatggaaata

SEQ ID NO: 510712 - DNA, 20 bp, Artificial Sequence
  chemically synthesized
gactgaccaactaaagcttt

SEQ ID NO: 510713 - DNA, 20 bp, Artificial Sequence
  chemically synthesized
ctttagttggtcagtctttt

SEQ ID NO: 510714 - DNA, 20 bp, Artificial Sequence
  chemically synthesized
ttaaacaacaaaaactgtga

SEQ ID NO: 510715 - DNA, 20 bp, Artificial Sequence
  chemically synthesized
gatgagcatcaacctcccca

SEQ ID NO: 510716 - DNA, 20 bp, Artificial Sequence
  chemically synthesized
ctctattccttttcttctca

SEQ ID NO: 510717 - DNA, 20 bp, Artificial Sequence
  chemically synthesized
ataaattcactgagaagaaa

SEQ ID NO: 510718 - DNA, 20 bp, Artificial Sequence
  chemically synthesized
ggtcataaactagccatagc

SEQ ID NO: 510719 - DNA, 20 bp, Artificial Sequence
  chemically synthesized
ccttttagaatatcacatca

SEQ ID NO: 510720 - DNA, 20 bp, Artificial Sequence
  chemically synthesized
cttccagcactttgtccttt

SEQ ID NO: 510721 - DNA, 20 bp, Artificial Sequence
  chemically synthesized
gacaaagtgctggaagtaaa

SEQ ID NO: 510722 - DNA, 20 bp, Artificial Sequence
  chemically synthesized
atcatctgatatctaaatgc

SEQ ID NO: 510723 - DNA, 20 bp, Artificial Sequence
  chemically synthesized
aataacaatatcatgcttta

SEQ ID NO: 510724 - DNA, 20 bp, Artificial Sequence
  chemically synthesized
tatgtacaatgcagtcagtg

SEQ ID NO: 510725 - DNA, 20 bp, Artificial Sequence
  chemically synthesized
tatatagtgacttgtaagta

SEQ ID NO: 510726 - DNA, 20 bp, Artificial Sequence
  chemically synthesized
gttaaaaaatttaacatggg

SEQ ID NO: 510727 - DNA, 20 bp, Artificial Sequence
  chemically synthesized
ctaaggcagaacatatcttg

SEQ ID NO: 510728 - DNA, 20 bp, Artificial Sequence
  chemically synthesized
tgctaaaaatggattaatta

SEQ ID NO: 510729 - DNA, 20 bp, Artificial Sequence
  chemically synthesized
cagtgaatgaagtgctaaaa

SEQ ID NO: 510730 - DNA, 20 bp, Artificial Sequence
  chemically synthesized
aaaagcaactgcttgtatca

SEQ ID NO: 510731 - DNA, 20 bp, Artificial Sequence
  chemically synthesized
atttgcgttgatgaagatga

SEQ ID NO: 510732 - DNA, 20 bp, Artificial Sequence
  chemically synthesized
aaaattgttttgtgtttctc

SEQ ID NO: 510733 - DNA, 20 bp, Artificial Sequence
  chemically synthesized
gcctcgtcctcccgaagtgc

SEQ ID NO: 510734 - DNA, 20 bp, Artificial Sequence
  chemically synthesized
caggtgcatcgcctgaggtt

SEQ ID NO: 510735 - DNA, 20 bp, Artificial Sequence
  chemically synthesized
aggaaacaacaggtgccgga

SEQ ID NO: 510736 - DNA, 20 bp, Artificial Sequence
  chemically synthesized
agataccatctcacaccagt

SEQ ID NO: 510737 - DNA, 20 bp, Artificial Sequence
  chemically synthesized
ttttttcatgtgttttttgg

SEQ ID NO: 510738 - DNA, 20 bp, Artificial Sequence
  chemically synthesized
tttggctgaataaatgtctc

SEQ ID NO: 510739 - DNA, 20 bp, Artificial Sequence
  chemically synthesized
ttgagccagccatcccatta

SEQ ID NO: 510740 - DNA, 20 bp, Artificial Sequence
  chemically synthesized
tttgggtatatacccagtaa

SEQ ID NO: 510741 - DNA, 20 bp, Artificial Sequence
  chemically synthesized
gcagcatgatttatagtcct

SEQ ID NO: 510742 - DNA, 20 bp, Artificial Sequence
  chemically synthesized
ggttccaagtctttgctatt

SEQ ID NO: 510743 - DNA, 20 bp, Artificial Sequence
  chemically synthesized
agtctatcattgttggacat

SEQ ID NO: 510744 - DNA, 20 bp, Artificial Sequence
  chemically synthesized
aaatgtccaacaatgataga

SEQ ID NO: 510745 - DNA, 20 bp, Artificial Sequence
  chemically synthesized
aatgtggcatatatgcacca

SEQ ID NO: 510746 - DNA, 20 bp, Artificial Sequence
  chemically synthesized
aatactatgcagtcataaaa

SEQ ID NO: 510747 - DNA, 20 bp, Artificial Sequence
  chemically synthesized
ctatgcagtcataaaaaagg

SEQ ID NO: 510748 - DNA, 20 bp, Artificial Sequence
  chemically synthesized
ttcatgtcctttgtagggac

SEQ ID NO: 510749 - DNA, 20 bp, Artificial Sequence
  chemically synthesized
tgtccttgtgatagtttgct

SEQ ID NO: 510750 - DNA, 20 bp, Artificial Sequence
  chemically synthesized
tcttttttcagttcccacct

SEQ ID NO: 510751 - DNA, 20 bp, Artificial Sequence
  chemically synthesized
tcacacaccggggcctgttg

SEQ ID NO: 510752 - DNA, 20 bp, Artificial Sequence
  chemically synthesized
ggggcctgttgtggggtggg

SEQ ID NO: 510753 - DNA, 20 bp, Artificial Sequence
  chemically synthesized
ggggggagtggggagggggg

SEQ ID NO: 510754 - DNA, 20 bp, Artificial Sequence
  chemically synthesized
gatatacctaatgcgaaatg

SEQ ID NO: 510755 - DNA, 20 bp, Artificial Sequence
  chemically synthesized
taatgcgaaatgacgagtta

SEQ ID NO: 510756 - DNA, 20 bp, Artificial Sequence
  chemically synthesized
tattattatactttaagttt

SEQ ID NO: 510757 - DNA, 20 bp, Artificial Sequence
  chemically synthesized
cccgaatagctgggatcacc

SEQ ID NO: 510758 - DNA, 20 bp, Artificial Sequence
  chemically synthesized
acctcagcctcccgaatagc

SEQ ID NO: 510759 - DNA, 20 bp, Artificial Sequence
  chemically synthesized
gattctctaacctcagcctc

SEQ ID NO: 510760 - DNA, 20 bp, Artificial Sequence
  chemically synthesized
tattcgggaggctgaggtta

SEQ ID NO: 510761 - DNA, 20 bp, Artificial Sequence
  chemically synthesized
tcgggccactgcactccacc

SEQ ID NO: 510762 - DNA, 20 bp, Artificial Sequence
  chemically synthesized
tctcactctctcacccaggg

SEQ ID NO: 510763 - DNA, 20 bp, Artificial Sequence
  chemically synthesized
ctgcactccaccctgggtga

SEQ ID NO: 510764 - DNA, 20 bp, Artificial Sequence
  chemically synthesized
tggagtctcactctctcacc

SEQ ID NO: 510765 - DNA, 20 bp, Artificial Sequence
  chemically synthesized
tgtttgtttgttttttgaga

SEQ ID NO: 510766 - DNA, 20 bp, Artificial Sequence
  chemically synthesized
tccatttgtattggtaggtt

SEQ ID NO: 510767 - DNA, 20 bp, Artificial Sequence
  chemically synthesized
cttccagctaccattattta

SEQ ID NO: 510768 - DNA, 20 bp, Artificial Sequence
  chemically synthesized
acctcagcctcccaaagtgc

SEQ ID NO: 510769 - DNA, 20 bp, Artificial Sequence
  chemically synthesized
actttgggaggctgaggtgg

SEQ ID NO: 510770 - DNA, 20 bp, Artificial Sequence
  chemically synthesized
tgggcggatcacctgaggtc

SEQ ID NO: 510771 - DNA, 20 bp, Artificial Sequence
  chemically synthesized
ttttgtatttttaatagaga

SEQ ID NO: 510772 - DNA, 20 bp, Artificial Sequence
  chemically synthesized
attaaaaatacaaaaatcag

SEQ ID NO: 510773 - DNA, 20 bp, Artificial Sequence
  chemically synthesized
gcctcagcctcccgagtagg

SEQ ID NO: 510774 - DNA, 20 bp, Artificial Sequence
  chemically synthesized
aattctcctgcctcagcctc

SEQ ID NO: 510775 - DNA, 20 bp, Artificial Sequence
  chemically synthesized
tactcgggaggctgaggcag

SEQ ID NO: 510776 - DNA, 20 bp, Artificial Sequence
  chemically synthesized
ctcaccgtcatctctgcctc

SEQ ID NO: 510777 - DNA, 20 bp, Artificial Sequence
  chemically synthesized
tcttgctctgtttcccaggc

SEQ ID NO: 510778 - DNA, 20 bp, Artificial Sequence
  chemically synthesized
gagcaagactccgtctcgga

SEQ ID NO: 510779 - DNA, 20 bp, Artificial Sequence
  chemically synthesized
tttttttaccccctccgaga

SEQ ID NO: 510780 - DNA, 20 bp, Artificial Sequence
  chemically synthesized
agtaactcaataaacgtttg

SEQ ID NO: 510781 - DNA, 20 bp, Artificial Sequence
  chemically synthesized
atatactccacaaacgttta

SEQ ID NO: 510782 - DNA, 20 bp, Artificial Sequence
  chemically synthesized
ctttcatgagaacatatctc

SEQ ID NO: 510783 - DNA, 20 bp, Artificial Sequence
  chemically synthesized
ccagagatatgttctcatga

SEQ ID NO: 510784 - DNA, 20 bp, Artificial Sequence
  chemically synthesized
ctgtaatgggaaaggaagtt

SEQ ID NO: 510785 - DNA, 20 bp, Artificial Sequence
  chemically synthesized
acagtggcaagtggtaaact

SEQ ID NO: 510786 - DNA, 20 bp, Artificial Sequence
  chemically synthesized
gccactgtatccctgcttca

SEQ ID NO: 510787 - DNA, 20 bp, Artificial Sequence
  chemically synthesized
ggaaggcaattcaatgaagc

SEQ ID NO: 510788 - DNA, 20 bp, Artificial Sequence
  chemically synthesized
tccataaaagccctcttcgc

SEQ ID NO: 510789 - DNA, 20 bp, Artificial Sequence
  chemically synthesized
atagtttttggaaattaaat

SEQ ID NO: 510790 - DNA, 20 bp, Artificial Sequence
  chemically synthesized
gtgttaataccaaacatcct

SEQ ID NO: 510791 - DNA, 20 bp, Artificial Sequence
  chemically synthesized
catttgctctgaggcactct

SEQ ID NO: 510792 - DNA, 20 bp, Artificial Sequence
  chemically synthesized
tcctaaagtcacagttggtt

SEQ ID NO: 510793 - DNA, 20 bp, Artificial Sequence
  chemically synthesized
tcgcaaccaactgtgacttt

SEQ ID NO: 510794 - DNA, 20 bp, Artificial Sequence
  chemically synthesized
ttctaaggatttaaatagtc

SEQ ID NO: 510795 - DNA, 20 bp, Artificial Sequence
  chemically synthesized
acataccaaatatttgttct

SEQ ID NO: 510796 - DNA, 20 bp, Artificial Sequence
  chemically synthesized
tcaagttagtgtctgttctc

SEQ ID NO: 510797 - DNA, 20 bp, Artificial Sequence
  chemically synthesized
tctgtagtctcccatgctga

SEQ ID NO: 510798 - DNA, 20 bp, Artificial Sequence
  chemically synthesized
tcccacaacaggcatgtcga

SEQ ID NO: 510799 - DNA, 20 bp, Artificial Sequence
  chemically synthesized
cctgttgtgggaagaactat

SEQ ID NO: 510800 - DNA, 20 bp, Artificial Sequence
  chemically synthesized
ttaagcagagttaaatgtca

SEQ ID NO: 510801 - DNA, 20 bp, Artificial Sequence
  chemically synthesized
gcaggtgacaatcacttaag

SEQ ID NO: 510802 - DNA, 20 bp, Artificial Sequence
  chemically synthesized
ttagcgaggaagataagggg

SEQ ID NO: 510803 - DNA, 20 bp, Artificial Sequence
  chemically synthesized
ttatgttagcgaggaagata

SEQ ID NO: 510804 - DNA, 20 bp, Artificial Sequence
  chemically synthesized
tacttgatacacagtgaggc

SEQ ID NO: 510805 - DNA, 20 bp, Artificial Sequence
  chemically synthesized
aaatcccaaaatataccaga

SEQ ID NO: 510806 - DNA, 20 bp, Artificial Sequence
  chemically synthesized
ttattctttctggtatattt

SEQ ID NO: 510807 - DNA, 20 bp, Artificial Sequence
  chemically synthesized
ctgcgttaagctagtcatca

SEQ ID NO: 510808 - DNA, 20 bp, Artificial Sequence
  chemically synthesized
gctaagctcttttatatgta

SEQ ID NO: 510809 - DNA, 20 bp, Artificial Sequence
  chemically synthesized
ttacctattagtgatagggt

SEQ ID NO: 510810 - DNA, 20 bp, Artificial Sequence
  chemically synthesized
agtcccttacctattagtga

SEQ ID NO: 510811 - DNA, 20 bp, Artificial Sequence
  chemically synthesized
aaactgggacagggaaatta

SEQ ID NO: 510812 - DNA, 20 bp, Artificial Sequence
  chemically synthesized
tcccagtttttatctataaa

SEQ ID NO: 510813 - DNA, 20 bp, Artificial Sequence
  chemically synthesized
ttagtatcttgcaaataatt

SEQ ID NO: 510814 - DNA, 20 bp, Artificial Sequence
  chemically synthesized
ggatgatgttaacagagaaa

SEQ ID NO: 510815 - DNA, 20 bp, Artificial Sequence
  chemically synthesized
gcatgaatgcaagcaaacct

SEQ ID NO: 510816 - DNA, 20 bp, Artificial Sequence
  chemically synthesized
cacaaatacttaatgaaggc

SEQ ID NO: 510817 - DNA, 20 bp, Artificial Sequence
  chemically synthesized
atgccttcattaagtatttg

SEQ ID NO: 510818 - DNA, 20 bp, Artificial Sequence
  chemically synthesized
aaaacgtgattaattgcttg

SEQ ID NO: 510819 - DNA, 20 bp, Artificial Sequence
  chemically synthesized
aattaatcacgttttataat

SEQ ID NO: 510820 - DNA, 20 bp, Artificial Sequence
  chemically synthesized
ggtccactcgtttcttcctt

SEQ ID NO: 510821 - DNA, 20 bp, Artificial Sequence
  chemically synthesized
tcctaattcctaaggaagaa

SEQ ID NO: 510822 - DNA, 20 bp, Artificial Sequence
  chemically synthesized
acataaatgttttgtgctga

SEQ ID NO: 510823 - DNA, 20 bp, Artificial Sequence
  chemically synthesized
ctcagcacaaaacatttatg

SEQ ID NO: 510824 - DNA, 20 bp, Artificial Sequence
  chemically synthesized
tcatatgtcatacgcaacat

SEQ ID NO: 510825 - DNA, 20 bp, Artificial Sequence
  chemically synthesized
tcatacgcaacatcagaata

SEQ ID NO: 510826 - DNA, 20 bp, Artificial Sequence
  chemically synthesized
aactgacaaaataactgatg

SEQ ID NO: 510827 - DNA, 20 bp, Artificial Sequence
  chemically synthesized
ttagagtactactgaaaact

SEQ ID NO: 510828 - DNA, 20 bp, Artificial Sequence
  chemically synthesized
cactggtttcagttttcagt

SEQ ID NO: 510829 - DNA, 20 bp, Artificial Sequence
  chemically synthesized
taaagtttgctacttcttga

SEQ ID NO: 510830 - DNA, 20 bp, Artificial Sequence
  chemically synthesized
tgtatctttgtaatttgaaa

SEQ ID NO: 510831 - DNA, 20 bp, Artificial Sequence
  chemically synthesized
cagtacttatgaaatttcat

SEQ ID NO: 510832 - DNA, 20 bp, Artificial Sequence
  chemically synthesized
tatgaaatttcatttgagtt

SEQ ID NO: 510833 - DNA, 20 bp, Artificial Sequence
  chemically synthesized
ctacaaatacaataatatcc

SEQ ID NO: 510834 - DNA, 20 bp, Artificial Sequence
  chemically synthesized
ttggaaattacttgacatcc

SEQ ID NO: 510835 - DNA, 20 bp, Artificial Sequence
  chemically synthesized
agaaaggtacaagtgaaaaa

SEQ ID NO: 510836 - DNA, 20 bp, Artificial Sequence
  chemically synthesized
catatttgtgttacatggtt

SEQ ID NO: 510837 - DNA, 20 bp, Artificial Sequence
  chemically synthesized
acacaaatatgatgatgata

SEQ ID NO: 510838 - DNA, 20 bp, Artificial Sequence
  chemically synthesized
taagggataactttataaaa

SEQ ID NO: 510839 - DNA, 20 bp, Artificial Sequence
  chemically synthesized
agaatgtaataaatgatgtt

SEQ ID NO: 510840 - DNA, 20 bp, Artificial Sequence
  chemically synthesized
tatatactaaagtatatttt

SEQ ID NO: 510841 - DNA, 20 bp, Artificial Sequence
  chemically synthesized
taaagtatattttttgaata

SEQ ID NO: 510842 - DNA, 20 bp, Artificial Sequence
  chemically synthesized
tatattttttgaatagtgaa

SEQ ID NO: 510843 - DNA, 20 bp, Artificial Sequence
  chemically synthesized
ttttagctaagtgtgaagga

SEQ ID NO: 510844 - DNA, 20 bp, Artificial Sequence
  chemically synthesized
agtgcttttagctaagtgtg

SEQ ID NO: 510845 - DNA, 20 bp, Artificial Sequence
  chemically synthesized
aagagaaagagggatgacat

SEQ ID NO: 510846 - DNA, 20 bp, Artificial Sequence
  chemically synthesized
ccaatgtgtgaaagagaaag

SEQ ID NO: 510847 - DNA, 20 bp, Artificial Sequence
  chemically synthesized
ttaagacctaatgggtgaga

SEQ ID NO: 510848 - DNA, 20 bp, Artificial Sequence
  chemically synthesized
tgagttaagacctaatgggt

SEQ ID NO: 510849 - DNA, 20 bp, Artificial Sequence
  chemically synthesized
gccatatgagttaagaccta

SEQ ID NO: 510850 - DNA, 20 bp, Artificial Sequence
  chemically synthesized
catctctgaagaggtgccat

SEQ ID NO: 510851 - DNA, 20 bp, Artificial Sequence
  chemically synthesized
aggggttgggcttctttaaa

SEQ ID NO: 510852 - DNA, 20 bp, Artificial Sequence
  chemically synthesized
tcaatgtaaaataaagggaa

SEQ ID NO: 510853 - DNA, 20 bp, Artificial Sequence
  chemically synthesized
attatgtttattttttatat

SEQ ID NO: 510854 - DNA, 20 bp, Artificial Sequence
  chemically synthesized
atttactgatttaacaaata

SEQ ID NO: 510855 - DNA, 20 bp, Artificial Sequence
  chemically synthesized
agtatttgttaaatcagtaa

SEQ ID NO: 510856 - DNA, 20 bp, Artificial Sequence
  chemically synthesized
gaatggagagagaacctttt

SEQ ID NO: 510857 - DNA, 20 bp, Artificial Sequence
  chemically synthesized
attttcatggtctacacccc

SEQ ID NO: 510858 - DNA, 20 bp, Artificial Sequence
  chemically synthesized
tggtctacaccccctgaatg

SEQ ID NO: 510859 - DNA, 20 bp, Artificial Sequence
  chemically synthesized
tgtgtcttactctacattca

SEQ ID NO: 510860 - DNA, 20 bp, Artificial Sequence
  chemically synthesized
accaaactgaatctcttttg

SEQ ID NO: 510861 - DNA, 20 bp, Artificial Sequence
  chemically synthesized
aaaagagattcagtttggta

SEQ ID NO: 510862 - DNA, 20 bp, Artificial Sequence
  chemically synthesized
aaaactaattctataccaaa

SEQ ID NO: 510863 - DNA, 20 bp, Artificial Sequence
  chemically synthesized
tcttaactcacaagagagtg

SEQ ID NO: 510864 - DNA, 20 bp, Artificial Sequence
  chemically synthesized
tttaaattcaccactctctt

SEQ ID NO: 510865 - DNA, 20 bp, Artificial Sequence
  chemically synthesized
gctgtattcttaactcacaa

SEQ ID NO: 510866 - DNA, 20 bp, Artificial Sequence
  chemically synthesized
tcaccactctcttgtgagtt

SEQ ID NO: 510867 - DNA, 20 bp, Artificial Sequence
  chemically synthesized
ttaaagtggaaaaaaaaaag

SEQ ID NO: 510868 - DNA, 20 bp, Artificial Sequence
  chemically synthesized
agttctttcattttgtgacc

SEQ ID NO: 510869 - DNA, 20 bp, Artificial Sequence
  chemically synthesized
gcaggttaatcaagaagcct

SEQ ID NO: 510870 - DNA, 20 bp, Artificial Sequence
  chemically synthesized
gtgtcttgagtattttcaat

SEQ ID NO: 510871 - DNA, 20 bp, Artificial Sequence
  chemically synthesized
aacattagttttcctgtgtc

SEQ ID NO: 510872 - DNA, 20 bp, Artificial Sequence
  chemically synthesized
gtatgccaaagtttagaaca

SEQ ID NO: 510873 - DNA, 20 bp, Artificial Sequence
  chemically synthesized
tatcctcagtctgagagcac

SEQ ID NO: 510874 - DNA, 20 bp, Artificial Sequence
  chemically synthesized
tactcaagtgctctcagact

SEQ ID NO: 510875 - DNA, 20 bp, Artificial Sequence
  chemically synthesized
gctatgcttccaaagttcta

SEQ ID NO: 510876 - DNA, 20 bp, Artificial Sequence
  chemically synthesized
tgctaagcgtctgcatacct

SEQ ID NO: 510877 - DNA, 20 bp, Artificial Sequence
  chemically synthesized
ggtttgaaagattcaagtgt

SEQ ID NO: 510878 - DNA, 20 bp, Artificial Sequence
  chemically synthesized
atgacaaggaattcacacac

SEQ ID NO: 510879 - DNA, 20 bp, Artificial Sequence
  chemically synthesized
atagttttagtgagatgaca

SEQ ID NO: 510880 - DNA, 20 bp, Artificial Sequence
  chemically synthesized
cttgtcatctcactaaaact

SEQ ID NO: 510881 - DNA, 20 bp, Artificial Sequence
  chemically synthesized
actaaaactatgagtcagcg

SEQ ID NO: 510882 - DNA, 20 bp, Artificial Sequence
  chemically synthesized
aactatgagtcagcggtggg

SEQ ID NO: 510883 - DNA, 20 bp, Artificial Sequence
  chemically synthesized
ttacaattatcattatttgg

SEQ ID NO: 510884 - DNA, 20 bp, Artificial Sequence
  chemically synthesized
taagctcagatatatgagaa

SEQ ID NO: 510885 - DNA, 20 bp, Artificial Sequence
  chemically synthesized
cctaggtttttgtttcttta

SEQ ID NO: 510886 - DNA, 20 bp, Artificial Sequence
  chemically synthesized
tcaataaagaaacaaaaacc

SEQ ID NO: 510887 - DNA, 20 bp, Artificial Sequence
  chemically synthesized
gttgctaatatctagtcaaa

SEQ ID NO: 510888 - DNA, 20 bp, Artificial Sequence
  chemically synthesized
agaaaaggaaaggctttgcg

SEQ ID NO: 510889 - DNA, 20 bp, Artificial Sequence
  chemically synthesized
tcttactgctattttaatta

SEQ ID NO: 510890 - DNA, 20 bp, Artificial Sequence
  chemically synthesized
ttctttccttttctcagtgg

SEQ ID NO: 510891 - DNA, 20 bp, Artificial Sequence
  chemically synthesized
ccttttctcagtggctggat

SEQ ID NO: 510892 - DNA, 20 bp, Artificial Sequence
  chemically synthesized
ctggaagctataccaagaaa

SEQ ID NO: 510893 - DNA, 20 bp, Artificial Sequence
  chemically synthesized
tttgagagaggccgacattt

SEQ ID NO: 510894 - DNA, 20 bp, Artificial Sequence
  chemically synthesized
gagatagttataccaagccc

SEQ ID NO: 510895 - DNA, 20 bp, Artificial Sequence
  chemically synthesized
tgataaggagtcaggctcca

SEQ ID NO: 510896 - DNA, 20 bp, Artificial Sequence
  chemically synthesized
tggggactggagctatgata

SEQ ID NO: 510897 - DNA, 20 bp, Artificial Sequence
  chemically synthesized
tccccatatgggctctgatc

SEQ ID NO: 510898 - DNA, 20 bp, Artificial Sequence
  chemically synthesized
tctgatcttggattgaccag

SEQ ID NO: 510899 - DNA, 20 bp, Artificial Sequence
  chemically synthesized
gggcacgttcccattgagat

SEQ ID NO: 510900 - DNA, 20 bp, Artificial Sequence
  chemically synthesized
cttggggccaaaaccgtcaa

SEQ ID NO: 510901 - DNA, 20 bp, Artificial Sequence
  chemically synthesized
ccattgacggttttggcccc

SEQ ID NO: 510902 - DNA, 20 bp, Artificial Sequence
  chemically synthesized
gatattttaatttcataagt

SEQ ID NO: 510903 - DNA, 20 bp, Artificial Sequence
  chemically synthesized
actgtggtgctgtagagata

SEQ ID NO: 510904 - DNA, 20 bp, Artificial Sequence
  chemically synthesized
atggatagatgcatggatgt

SEQ ID NO: 510905 - DNA, 20 bp, Artificial Sequence
  chemically synthesized
atggctgaatggatagatgc

SEQ ID NO: 510906 - DNA, 20 bp, Artificial Sequence
  chemically synthesized
atagctaaaagaatggctga

SEQ ID NO: 510907 - DNA, 20 bp, Artificial Sequence
  chemically synthesized
atggatagctaaaagaatgg

SEQ ID NO: 510908 - DNA, 20 bp, Artificial Sequence
  chemically synthesized
tatgataaatggatagctaa

SEQ ID NO: 510909 - DNA, 20 bp, Artificial Sequence
  chemically synthesized
caggcagatgagtatgataa

SEQ ID NO: 510910 - DNA, 20 bp, Artificial Sequence
  chemically synthesized
taatctcattagacaggcag

SEQ ID NO: 510911 - DNA, 20 bp, Artificial Sequence
  chemically synthesized
gtgagtggtaaagctaaatt

SEQ ID NO: 510912 - DNA, 20 bp, Artificial Sequence
  chemically synthesized
ctttaccactcactggtatt

SEQ ID NO: 510913 - DNA, 20 bp, Artificial Sequence
  chemically synthesized
tatccaaattcataatacca

SEQ ID NO: 510914 - DNA, 20 bp, Artificial Sequence
  chemically synthesized
cactcactggtattatgaat

SEQ ID NO: 510915 - DNA, 20 bp, Artificial Sequence
  chemically synthesized
ctttgcctcattttaccaat

SEQ ID NO: 510916 - DNA, 20 bp, Artificial Sequence
  chemically synthesized
cagaataaataaatggataa

SEQ ID NO: 510917 - DNA, 20 bp, Artificial Sequence
  chemically synthesized
aatagttacagaataaataa

SEQ ID NO: 510918 - DNA, 20 bp, Artificial Sequence
  chemically synthesized
aagtgtccaataaatagtta

SEQ ID NO: 510919 - DNA, 20 bp, Artificial Sequence
  chemically synthesized
ttggacacttgccataagtc

SEQ ID NO: 510920 - DNA, 20 bp, Artificial Sequence
  chemically synthesized
gactataggcaccataaaat

SEQ ID NO: 510921 - DNA, 20 bp, Artificial Sequence
  chemically synthesized
catatctacgacaaatgtgt

SEQ ID NO: 510922 - DNA, 20 bp, Artificial Sequence
  chemically synthesized
cacatttgtcgtagatatgt

SEQ ID NO: 510923 - DNA, 20 bp, Artificial Sequence
  chemically synthesized
gatcctgaggtttcacattt

SEQ ID NO: 510924 - DNA, 20 bp, Artificial Sequence
  chemically synthesized
aattcttaaatgtgaaacct

SEQ ID NO: 510925 - DNA, 20 bp, Artificial Sequence
  chemically synthesized
tacaaatatcttcttattat

SEQ ID NO: 510926 - DNA, 20 bp, Artificial Sequence
  chemically synthesized
gctatttctaattttcccaa

SEQ ID NO: 510927 - DNA, 20 bp, Artificial Sequence
  chemically synthesized
atactttgtatattcattgt

SEQ ID NO: 510928 - DNA, 20 bp, Artificial Sequence
  chemically synthesized
agtatgataacactcctaca

SEQ ID NO: 510929 - DNA, 20 bp, Artificial Sequence
  chemically synthesized
ataaaacctatgatggactg

SEQ ID NO: 510930 - DNA, 20 bp, Artificial Sequence
  chemically synthesized
aatactttattacaatgtag

SEQ ID NO: 510931 - DNA, 20 bp, Artificial Sequence
  chemically synthesized
ctttcagataatgattgaat

SEQ ID NO: 510932 - DNA, 20 bp, Artificial Sequence
  chemically synthesized
agataactttcagataatga

SEQ ID NO: 510933 - DNA, 20 bp, Artificial Sequence
  chemically synthesized
atcttagtatttgttgtgcc

SEQ ID NO: 510934 - DNA, 20 bp, Artificial Sequence
  chemically synthesized
acatttcatgtctctagaga

SEQ ID NO: 510935 - DNA, 20 bp, Artificial Sequence
  chemically synthesized
aggtaaatttagtacacaat

SEQ ID NO: 510936 - DNA, 20 bp, Artificial Sequence
  chemically synthesized
ctaaatttacctaaataaaa

SEQ ID NO: 510937 - DNA, 20 bp, Artificial Sequence
  chemically synthesized
agagaaataatttaatggtg

SEQ ID NO: 510938 - DNA, 20 bp, Artificial Sequence
  chemically synthesized
atttgtttaaatgtaaatgc

SEQ ID NO: 510939 - DNA, 20 bp, Artificial Sequence
  chemically synthesized
atttacatttaaacaaattt

SEQ ID NO: 510940 - DNA, 20 bp, Artificial Sequence
  chemically synthesized
ttttagaattatctagaaaa

SEQ ID NO: 510941 - DNA, 20 bp, Artificial Sequence
  chemically synthesized
taaatcacatgaatggtaag

SEQ ID NO: 510942 - DNA, 20 bp, Artificial Sequence
  chemically synthesized
gcacactgaacataaatcac

SEQ ID NO: 510943 - DNA, 20 bp, Artificial Sequence
  chemically synthesized
gaagaaagggtgtttatgtt

SEQ ID NO: 510944 - DNA, 20 bp, Artificial Sequence
  chemically synthesized
tagagaataagcagagaaga

SEQ ID NO: 510945 - DNA, 20 bp, Artificial Sequence
  chemically synthesized
gtgaaagggtcagccactta

SEQ ID NO: 510946 - DNA, 20 bp, Artificial Sequence
  chemically synthesized
tcacaggagatacagtgtga

SEQ ID NO: 510947 - DNA, 20 bp, Artificial Sequence
  chemically synthesized
tcccaccagcttaatgcaac

SEQ ID NO: 510948 - DNA, 20 bp, Artificial Sequence
  chemically synthesized
agagctgcataatgtagtat

SEQ ID NO: 510949 - DNA, 20 bp, Artificial Sequence
  chemically synthesized
gtgaaagctgcaccaatgga

SEQ ID NO: 510950 - DNA, 20 bp, Artificial Sequence
  chemically synthesized
agctgaaaggaaagggggaa

SEQ ID NO: 510951 - DNA, 20 bp, Artificial Sequence
  chemically synthesized
cctttcagctactatatagt

SEQ ID NO: 510952 - DNA, 20 bp, Artificial Sequence
  chemically synthesized
aacagaaccctagcaataaa

SEQ ID NO: 510953 - DNA, 20 bp, Artificial Sequence
  chemically synthesized
agataaattctatttattgc

SEQ ID NO: 510954 - DNA, 20 bp, Artificial Sequence
  chemically synthesized
tctatatttgtattatttta

SEQ ID NO: 510955 - DNA, 20 bp, Artificial Sequence
  chemically synthesized
aatacaaatatagatacaca

SEQ ID NO: 510956 - DNA, 20 bp, Artificial Sequence
  chemically synthesized
acatacatgtttgtgggcat

SEQ ID NO: 510957 - DNA, 20 bp, Artificial Sequence
  chemically synthesized
agatgctcctcgacttatga

SEQ ID NO: 510958 - DNA, 20 bp, Artificial Sequence
  chemically synthesized
tctatggacaatgggtttat

SEQ ID NO: 510959 - DNA, 20 bp, Artificial Sequence
  chemically synthesized
cactatattttctatggaca

SEQ ID NO: 510960 - DNA, 20 bp, Artificial Sequence
  chemically synthesized
cattgtccatagaaaatata

SEQ ID NO: 510961 - DNA, 20 bp, Artificial Sequence
  chemically synthesized
gttctataaaaactaaagta

SEQ ID NO: 510962 - DNA, 20 bp, Artificial Sequence
  chemically synthesized
gtgaaaaatggcatgattaa

SEQ ID NO: 510963 - DNA, 20 bp, Artificial Sequence
  chemically synthesized
cgttcagtagaaaccgtact

SEQ ID NO: 510964 - DNA, 20 bp, Artificial Sequence
  chemically synthesized
cttcaggaactttagattta

SEQ ID NO: 510965 - DNA, 20 bp, Artificial Sequence
  chemically synthesized
tacaagtgcaattttgttac

SEQ ID NO: 510966 - DNA, 20 bp, Artificial Sequence
  chemically synthesized
cattgtagactatttgtgtg

SEQ ID NO: 510967 - DNA, 20 bp, Artificial Sequence
  chemically synthesized
aaaagatgggagagtgggaa

SEQ ID NO: 510968 - DNA, 20 bp, Artificial Sequence
  chemically synthesized
ttggagactccaaaagatgg

SEQ ID NO: 510969 - DNA, 20 bp, Artificial Sequence
  chemically synthesized
cttcccactctcccatcttt

SEQ ID NO: 510970 - DNA, 20 bp, Artificial Sequence
  chemically synthesized
atcttttggagtctccaatg

SEQ ID NO: 510971 - DNA, 20 bp, Artificial Sequence
  chemically synthesized
gtacacatggacatacagaa

SEQ ID NO: 510972 - DNA, 20 bp, Artificial Sequence
  chemically synthesized
aatgggtacacatggacata

SEQ ID NO: 510973 - DNA, 20 bp, Artificial Sequence
  chemically synthesized
ctataagtggtaactaatca

SEQ ID NO: 510974 - DNA, 20 bp, Artificial Sequence
  chemically synthesized
tgtttctgacttatttcact

SEQ ID NO: 510975 - DNA, 20 bp, Artificial Sequence
  chemically synthesized
attatgtcttttgcagcaac

SEQ ID NO: 510976 - DNA, 20 bp, Artificial Sequence
  chemically synthesized
ggaatactaacgagccacaa

SEQ ID NO: 510977 - DNA, 20 bp, Artificial Sequence
  chemically synthesized
aatgtggtgtgtatatataa

SEQ ID NO: 510978 - DNA, 20 bp, Artificial Sequence
  chemically synthesized
cgtggaatcaagttgtgtcc

SEQ ID NO: 510979 - DNA, 20 bp, Artificial Sequence
  chemically synthesized
tatgcgtaatagcaaaatcg

SEQ ID NO: 510980 - DNA, 20 bp, Artificial Sequence
  chemically synthesized
catagtgctccagtgaacat

SEQ ID NO: 510981 - DNA, 20 bp, Artificial Sequence
  chemically synthesized
gggaacgattatgtgagatg

SEQ ID NO: 510982 - DNA, 20 bp, Artificial Sequence
  chemically synthesized
attatagcttctcgtggtca

SEQ ID NO: 510983 - DNA, 20 bp, Artificial Sequence
  chemically synthesized
gtattcagaatttttactaa

SEQ ID NO: 510984 - DNA, 20 bp, Artificial Sequence
  chemically synthesized
ctactcatttagtaaaaatt

SEQ ID NO: 510985 - DNA, 20 bp, Artificial Sequence
  chemically synthesized
agttaatagtgtgttgtatt

SEQ ID NO: 510986 - DNA, 20 bp, Artificial Sequence
  chemically synthesized
aaagatctaatataaaacat

SEQ ID NO: 510987 - DNA, 20 bp, Artificial Sequence
  chemically synthesized
tctataaagtagcaaatatg

SEQ ID NO: 510988 - DNA, 20 bp, Artificial Sequence
  chemically synthesized
aaaacagtggttaccaggtt

SEQ ID NO: 510989 - DNA, 20 bp, Artificial Sequence
  chemically synthesized
attgtgtataactatataga

SEQ ID NO: 510990 - DNA, 20 bp, Artificial Sequence
  chemically synthesized
ctctatatagttatacacaa

SEQ ID NO: 510991 - DNA, 20 bp, Artificial Sequence
  chemically synthesized
gccttggcctcccaaagtgc

SEQ ID NO: 510992 - DNA, 20 bp, Artificial Sequence
  chemically synthesized
actttgggaggccaaggcag

SEQ ID NO: 510993 - DNA, 20 bp, Artificial Sequence
  chemically synthesized
ttggcttttaccatgttggc

SEQ ID NO: 510994 - DNA, 20 bp, Artificial Sequence
  chemically synthesized
ccaccaagccaaactaattt

SEQ ID NO: 510995 - DNA, 20 bp, Artificial Sequence
  chemically synthesized
gcctcagcctcctgaatagc

SEQ ID NO: 510996 - DNA, 20 bp, Artificial Sequence
  chemically synthesized
gattctcctgcctcagcctc

SEQ ID NO: 510997 - DNA, 20 bp, Artificial Sequence
  chemically synthesized
tattcaggaggctgaggcag

SEQ ID NO: 510998 - DNA, 20 bp, Artificial Sequence
  chemically synthesized
ttttttttttttttttttga

SEQ ID NO: 510999 - DNA, 20 bp, Artificial Sequence
  chemically synthesized
ctccctaagtccctaagtgc

SEQ ID NO: 511000 - DNA, 20 bp, Artificial Sequence
  chemically synthesized
tacgcagatcacctgaggtc

SEQ ID NO: 511001 - DNA, 20 bp, Artificial Sequence
  chemically synthesized
tggggtttcaccatgttggc

SEQ ID NO: 511002 - DNA, 20 bp, Artificial Sequence
  chemically synthesized
ttttgcatttttagtagaga

SEQ ID NO: 511003 - DNA, 20 bp, Artificial Sequence
  chemically synthesized
actaaaaatgcaaaaattag

SEQ ID NO: 511004 - DNA, 20 bp, Artificial Sequence
  chemically synthesized
acctcagcctcccaagtagc

SEQ ID NO: 511005 - DNA, 20 bp, Artificial Sequence
  chemically synthesized
agctacttgggaggctgagg

SEQ ID NO: 511006 - DNA, 20 bp, Artificial Sequence
  chemically synthesized
gtgagccactgcactccagc

SEQ ID NO: 511007 - DNA, 20 bp, Artificial Sequence
  chemically synthesized
tctcactctgccactcaagc

SEQ ID NO: 511008 - DNA, 20 bp, Artificial Sequence
  chemically synthesized
ctgcactccagcttgagtgg

SEQ ID NO: 511009 - DNA, 20 bp, Artificial Sequence
  chemically synthesized
aaaaacaaaaagtaactatg

SEQ ID NO: 511010 - DNA, 20 bp, Artificial Sequence
  chemically synthesized
gaacagcgtcaatacagagg

SEQ ID NO: 511011 - DNA, 20 bp, Artificial Sequence
  chemically synthesized
actcaaacaataaatacgac

SEQ ID NO: 511012 - DNA, 20 bp, Artificial Sequence
  chemically synthesized
attcttgtcgtatttattgt

SEQ ID NO: 511013 - DNA, 20 bp, Artificial Sequence
  chemically synthesized
tccaaatcatatcaatatgc

SEQ ID NO: 511014 - DNA, 20 bp, Artificial Sequence
  chemically synthesized
ttctagcatattgatatgat

SEQ ID NO: 511015 - DNA, 20 bp, Artificial Sequence
  chemically synthesized
ttccttgcccaaatctcatg

SEQ ID NO: 511016 - DNA, 20 bp, Artificial Sequence
  chemically synthesized
aggggcctggtgggagatga

SEQ ID NO: 511017 - DNA, 20 bp, Artificial Sequence
  chemically synthesized
gtgggagatgataggatcat

SEQ ID NO: 511018 - DNA, 20 bp, Artificial Sequence
  chemically synthesized
gagatgataggatcatgagg

SEQ ID NO: 511019 - DNA, 20 bp, Artificial Sequence
  chemically synthesized
cagttgctgttctcatgata

SEQ ID NO: 511020 - DNA, 20 bp, Artificial Sequence
  chemically synthesized
gctgtacaggaagtatggct

SEQ ID NO: 511021 - DNA, 20 bp, Artificial Sequence
  chemically synthesized
cctgtacagcctgaagaact

SEQ ID NO: 511022 - DNA, 20 bp, Artificial Sequence
  chemically synthesized
ttgctataaactacctgaga

SEQ ID NO: 511023 - DNA, 20 bp, Artificial Sequence
  chemically synthesized
acgtggaactaactttggaa

SEQ ID NO: 511024 - DNA, 20 bp, Artificial Sequence
  chemically synthesized
tcatctgagaccacctcagc

SEQ ID NO: 511025 - DNA, 20 bp, Artificial Sequence
  chemically synthesized
tctttttgttaaagcattgc

SEQ ID NO: 511026 - DNA, 20 bp, Artificial Sequence
  chemically synthesized
ttaacttgagactgatgatt

SEQ ID NO: 511027 - DNA, 20 bp, Artificial Sequence
  chemically synthesized
aaaacaaaagcctattttct

SEQ ID NO: 511028 - DNA, 20 bp, Artificial Sequence
  chemically synthesized
tgcaaatttccgcagacagc

SEQ ID NO: 511029 - DNA, 20 bp, Artificial Sequence
  chemically synthesized
tttgcataagtaaaaaggaa

SEQ ID NO: 511030 - DNA, 20 bp, Artificial Sequence
  chemically synthesized
tgataggaggggctgctgca

SEQ ID NO: 511031 - DNA, 20 bp, Artificial Sequence
  chemically synthesized
tttttagtaacagctggagc

SEQ ID NO: 511032 - DNA, 20 bp, Artificial Sequence
  chemically synthesized
aaaaggccccagatgtgtct

SEQ ID NO: 511033 - DNA, 20 bp, Artificial Sequence
  chemically synthesized
tgtcttggggtgttgcttca

SEQ ID NO: 511034 - DNA, 20 bp, Artificial Sequence
  chemically synthesized
tctcacactctgcacacttg

SEQ ID NO: 511035 - DNA, 20 bp, Artificial Sequence
  chemically synthesized
gtgttaatcctgcaagtgtg

SEQ ID NO: 511036 - DNA, 20 bp, Artificial Sequence
  chemically synthesized
cctgcaagtgtgcagagtgt

SEQ ID NO: 511037 - DNA, 20 bp, Artificial Sequence
  chemically synthesized
acacattctctgaaatctag

SEQ ID NO: 511038 - DNA, 20 bp, Artificial Sequence
  chemically synthesized
gagcatccacctagatttca

SEQ ID NO: 511039 - DNA, 20 bp, Artificial Sequence
  chemically synthesized
cctctactagggcagtgcag

SEQ ID NO: 511040 - DNA, 20 bp, Artificial Sequence
  chemically synthesized
ggcagtgcagaagggtaatg

SEQ ID NO: 511041 - DNA, 20 bp, Artificial Sequence
  chemically synthesized
gtggggttagagctctcaca

SEQ ID NO: 511042 - DNA, 20 bp, Artificial Sequence
  chemically synthesized
ggccactgtcctccagagcc

SEQ ID NO: 511043 - DNA, 20 bp, Artificial Sequence
  chemically synthesized
gttgttttcatgggctggca

SEQ ID NO: 511044 - DNA, 20 bp, Artificial Sequence
  chemically synthesized
gccagcccatgaaaacaact

SEQ ID NO: 511045 - DNA, 20 bp, Artificial Sequence
  chemically synthesized
tctccatccctgtggctcag

SEQ ID NO: 511046 - DNA, 20 bp, Artificial Sequence
  chemically synthesized
tgtacaccctgctgagccac

SEQ ID NO: 511047 - DNA, 20 bp, Artificial Sequence
  chemically synthesized
gtcccttgcatcactgtggc

SEQ ID NO: 511048 - DNA, 20 bp, Artificial Sequence
  chemically synthesized
actgtggcttggatgagatg

SEQ ID NO: 511049 - DNA, 20 bp, Artificial Sequence
  chemically synthesized
aagatttaatgactaccctg

SEQ ID NO: 511050 - DNA, 20 bp, Artificial Sequence
  chemically synthesized
tgtgcaagtccaaaacccag

SEQ ID NO: 511051 - DNA, 20 bp, Artificial Sequence
  chemically synthesized
agttaaatcgatcagaagaa

SEQ ID NO: 511052 - DNA, 20 bp, Artificial Sequence
  chemically synthesized
gggtacaggcattagctcaa

SEQ ID NO: 511053 - DNA, 20 bp, Artificial Sequence
  chemically synthesized
agttacttccaagatacaat

SEQ ID NO: 511054 - DNA, 20 bp, Artificial Sequence
  chemically synthesized
tatgatcctgtaaaatcaaa

SEQ ID NO: 511055 - DNA, 20 bp, Artificial Sequence
  chemically synthesized
agtaactcattttgatttta

SEQ ID NO: 511056 - DNA, 20 bp, Artificial Sequence
  chemically synthesized
gtggacttttgaactaatac

SEQ ID NO: 511057 - DNA, 20 bp, Artificial Sequence
  chemically synthesized
acttttgaactaatactgga

SEQ ID NO: 511058 - DNA, 20 bp, Artificial Sequence
  chemically synthesized
agaacaatatgagatttggg

SEQ ID NO: 511059 - DNA, 20 bp, Artificial Sequence
  chemically synthesized
ttgtattgtgatccccaata

SEQ ID NO: 511060 - DNA, 20 bp, Artificial Sequence
  chemically synthesized
caggcgcctcattcaatatt

SEQ ID NO: 511061 - DNA, 20 bp, Artificial Sequence
  chemically synthesized
aggcgcctggtgggaggtga

SEQ ID NO: 511062 - DNA, 20 bp, Artificial Sequence
  chemically synthesized
ctcttactgttccaatgata

SEQ ID NO: 511063 - DNA, 20 bp, Artificial Sequence
  chemically synthesized
ctataaacaactacctgtga

SEQ ID NO: 511064 - DNA, 20 bp, Artificial Sequence
  chemically synthesized
agaaaggttcttactaatct

SEQ ID NO: 511065 - DNA, 20 bp, Artificial Sequence
  chemically synthesized
atgtatttaagcaaatgtca

SEQ ID NO: 511066 - DNA, 20 bp, Artificial Sequence
  chemically synthesized
acatcaattaaatgaaagcc

SEQ ID NO: 511067 - DNA, 20 bp, Artificial Sequence
  chemically synthesized
ctttaaaatatatggcaaat

SEQ ID NO: 511068 - DNA, 20 bp, Artificial Sequence
  chemically synthesized
atttacacttgagtcaacat

SEQ ID NO: 511069 - DNA, 20 bp, Artificial Sequence
  chemically synthesized
aggttattaactatttacac

SEQ ID NO: 511070 - DNA, 20 bp, Artificial Sequence
  chemically synthesized
aatcagactattttgctacc

SEQ ID NO: 511071 - DNA, 20 bp, Artificial Sequence
  chemically synthesized
gtaactatatatgtaggtaa

SEQ ID NO: 511072 - DNA, 20 bp, Artificial Sequence
  chemically synthesized
tatttgcctaccttctctag

SEQ ID NO: 511073 - DNA, 20 bp, Artificial Sequence
  chemically synthesized
tccagttatgtttagtgttt

SEQ ID NO: 511074 - DNA, 20 bp, Artificial Sequence
  chemically synthesized
tggacatagttggaaatact

SEQ ID NO: 511075 - DNA, 20 bp, Artificial Sequence
  chemically synthesized
ataatcatgatagaggatgc

SEQ ID NO: 511076 - DNA, 20 bp, Artificial Sequence
  chemically synthesized
ctgctatgataatcatgata

SEQ ID NO: 511077 - DNA, 20 bp, Artificial Sequence
  chemically synthesized
ttttcaattcatcagattat

SEQ ID NO: 511078 - DNA, 20 bp, Artificial Sequence
  chemically synthesized
cattgcatccacataatctg

SEQ ID NO: 511079 - DNA, 20 bp, Artificial Sequence
  chemically synthesized
ttgataatgagaaattgaaa

SEQ ID NO: 511080 - DNA, 20 bp, Artificial Sequence
  chemically synthesized
ttatcaatttgtttctctgt

SEQ ID NO: 511081 - DNA, 20 bp, Artificial Sequence
  chemically synthesized
tttgtttctctgtgtgagtg

SEQ ID NO: 511082 - DNA, 20 bp, Artificial Sequence
  chemically synthesized
tgtgtgagtgtagggtgatg

SEQ ID NO: 511083 - DNA, 20 bp, Artificial Sequence
  chemically synthesized
aggcaaataattctataact

SEQ ID NO: 511084 - DNA, 20 bp, Artificial Sequence
  chemically synthesized
agtacaatgacccaaagtta

SEQ ID NO: 511085 - DNA, 20 bp, Artificial Sequence
  chemically synthesized
caaatattatagtaaaataa

SEQ ID NO: 511086 - DNA, 20 bp, Artificial Sequence
  chemically synthesized
aatatccaaaatatttccac

SEQ ID NO: 511087 - DNA, 20 bp, Artificial Sequence
  chemically synthesized
ttaattctggtggaaatatt

SEQ ID NO: 511088 - DNA, 20 bp, Artificial Sequence
  chemically synthesized
tttaagttattttcactgct

SEQ ID NO: 511089 - DNA, 20 bp, Artificial Sequence
  chemically synthesized
tttttttttcatttatttag

SEQ ID NO: 511090 - DNA, 20 bp, Artificial Sequence
  chemically synthesized
aataactgcacaccaagcat

SEQ ID NO: 511091 - DNA, 20 bp, Artificial Sequence
  chemically synthesized
cttggtgtgcagttatttcc

SEQ ID NO: 511092 - DNA, 20 bp, Artificial Sequence
  chemically synthesized
gataacaacgtattatatga

SEQ ID NO: 511093 - DNA, 20 bp, Artificial Sequence
  chemically synthesized
gcacgtgtgcacatgcaagc

SEQ ID NO: 511094 - DNA, 20 bp, Artificial Sequence
  chemically synthesized
tactatatgacctgacccat

SEQ ID NO: 511095 - DNA, 20 bp, Artificial Sequence
  chemically synthesized
atatgaatgaatgaattcta

SEQ ID NO: 511096 - DNA, 20 bp, Artificial Sequence
  chemically synthesized
atatatatatatatgaatga

SEQ ID NO: 511097 - DNA, 20 bp, Artificial Sequence
  chemically synthesized
atatatatatatatatatga

SEQ ID NO: 511098 - DNA, 20 bp, Artificial Sequence
  chemically synthesized
gtgtatatatatatatatat

SEQ ID NO: 511099 - DNA, 20 bp, Artificial Sequence
  chemically synthesized
tataataggtgttacgagtg

SEQ ID NO: 511100 - DNA, 20 bp, Artificial Sequence
  chemically synthesized
tgactcgtataataggtgtt

SEQ ID NO: 511101 - DNA, 20 bp, Artificial Sequence
  chemically synthesized
acactcgtaacacctattat

SEQ ID NO: 511102 - DNA, 20 bp, Artificial Sequence
  chemically synthesized
agtcaaatcataccttacaa

SEQ ID NO: 511103 - DNA, 20 bp, Artificial Sequence
  chemically synthesized
tagaaaaggtaacaacaata

SEQ ID NO: 511104 - DNA, 20 bp, Artificial Sequence
  chemically synthesized
ttaccttttctaattttttt

SEQ ID NO: 511105 - DNA, 20 bp, Artificial Sequence
  chemically synthesized
gttaaaatgcattgtcttct

SEQ ID NO: 511106 - DNA, 20 bp, Artificial Sequence
  chemically synthesized
aattttttcacaggcattta

SEQ ID NO: 511107 - DNA, 20 bp, Artificial Sequence
  chemically synthesized
aatgaatgtaatttgctcat

SEQ ID NO: 511108 - DNA, 20 bp, Artificial Sequence
  chemically synthesized
gaatcgaataacatttccaa

SEQ ID NO: 511109 - DNA, 20 bp, Artificial Sequence
  chemically synthesized
atgggggcaaacaatgtgaa

SEQ ID NO: 511110 - DNA, 20 bp, Artificial Sequence
  chemically synthesized
tccccatgggggcaaacaat

SEQ ID NO: 511111 - DNA, 20 bp, Artificial Sequence
  chemically synthesized
ttcacattgtttgcccccat

SEQ ID NO: 511112 - DNA, 20 bp, Artificial Sequence
  chemically synthesized
taaatttattatcttggtcc

SEQ ID NO: 511113 - DNA, 20 bp, Artificial Sequence
  chemically synthesized
attatcttggtccatgggtg

SEQ ID NO: 511114 - DNA, 20 bp, Artificial Sequence
  chemically synthesized
ttttaacatcatttttaatg

SEQ ID NO: 511115 - DNA, 20 bp, Artificial Sequence
  chemically synthesized
taaaatctggtcatacatct

SEQ ID NO: 511116 - DNA, 20 bp, Artificial Sequence
  chemically synthesized
tattttagataaatattaga

SEQ ID NO: 511117 - DNA, 20 bp, Artificial Sequence
  chemically synthesized
aatataaaagcagataataa

SEQ ID NO: 511118 - DNA, 20 bp, Artificial Sequence
  chemically synthesized
gcttttatatttttttaaaa

SEQ ID NO: 511119 - DNA, 20 bp, Artificial Sequence
  chemically synthesized
ttatgtgggataaataaatt

SEQ ID NO: 511120 - DNA, 20 bp, Artificial Sequence
  chemically synthesized
catggaaacttgcagttatg

SEQ ID NO: 511121 - DNA, 20 bp, Artificial Sequence
  chemically synthesized
tggtgattaccaggagtagt

SEQ ID NO: 511122 - DNA, 20 bp, Artificial Sequence
  chemically synthesized
acagtagaatggtgattacc

SEQ ID NO: 511123 - DNA, 20 bp, Artificial Sequence
  chemically synthesized
taagttgaatacatagacag

SEQ ID NO: 511124 - DNA, 20 bp, Artificial Sequence
  chemically synthesized
atctgaagaaaatgtataag

SEQ ID NO: 511125 - DNA, 20 bp, Artificial Sequence
  chemically synthesized
tggcactatcttttgtgagg

SEQ ID NO: 511126 - DNA, 20 bp, Artificial Sequence
  chemically synthesized
agccaagatatgaaaataac

SEQ ID NO: 511127 - DNA, 20 bp, Artificial Sequence
  chemically synthesized
attttcatatcttggctatt

SEQ ID NO: 511128 - DNA, 20 bp, Artificial Sequence
  chemically synthesized
aatcataacgcaatgaacat

SEQ ID NO: 511129 - DNA, 20 bp, Artificial Sequence
  chemically synthesized
aggttctgatttcattttct

SEQ ID NO: 511130 - DNA, 20 bp, Artificial Sequence
  chemically synthesized
ttttctgtgggtctataccc

SEQ ID NO: 511131 - DNA, 20 bp, Artificial Sequence
  chemically synthesized
tgtgggtctatacccaggag

SEQ ID NO: 511132 - DNA, 20 bp, Artificial Sequence
  chemically synthesized
atgacccaacaatcccactc

SEQ ID NO: 511133 - DNA, 20 bp, Artificial Sequence
  chemically synthesized
tatacccaggagtgggattg

SEQ ID NO: 511134 - DNA, 20 bp, Artificial Sequence
  chemically synthesized
gacattatggaaaattgtct

SEQ ID NO: 511135 - DNA, 20 bp, Artificial Sequence
  chemically synthesized
caccgacaccagcagtatgt

SEQ ID NO: 511136 - DNA, 20 bp, Artificial Sequence
  chemically synthesized
attacttcatacctgttagg

SEQ ID NO: 511137 - DNA, 20 bp, Artificial Sequence
  chemically synthesized
aggtattacttcatacctgt

SEQ ID NO: 511138 - DNA, 20 bp, Artificial Sequence
  chemically synthesized
gttctttcccaattttttaa

SEQ ID NO: 511139 - DNA, 20 bp, Artificial Sequence
  chemically synthesized
ggttatttagtttgtcacta

SEQ ID NO: 511140 - DNA, 20 bp, Artificial Sequence
  chemically synthesized
gtgcaagttccttatatatt

SEQ ID NO: 511141 - DNA, 20 bp, Artificial Sequence
  chemically synthesized
ttgcaaaacatatatctgat

SEQ ID NO: 511142 - DNA, 20 bp, Artificial Sequence
  chemically synthesized
aaaaacacagcctacagatt

SEQ ID NO: 511143 - DNA, 20 bp, Artificial Sequence
  chemically synthesized
gtcgcctttgcaaggatttt

SEQ ID NO: 511144 - DNA, 20 bp, Artificial Sequence
  chemically synthesized
tctctgacagtcgcctttgc

SEQ ID NO: 511145 - DNA, 20 bp, Artificial Sequence
  chemically synthesized
tttcctctctgttttcttct

SEQ ID NO: 511146 - DNA, 20 bp, Artificial Sequence
  chemically synthesized
ttttgtgtacagtataagac

SEQ ID NO: 511147 - DNA, 20 bp, Artificial Sequence
  chemically synthesized
agacacataaactgatggaa

SEQ ID NO: 511148 - DNA, 20 bp, Artificial Sequence
  chemically synthesized
cataaatctacagtattaaa

SEQ ID NO: 511149 - DNA, 20 bp, Artificial Sequence
  chemically synthesized
aaagttggaaatactgctct

SEQ ID NO: 511150 - DNA, 20 bp, Artificial Sequence
  chemically synthesized
tcaagattgttctggctatt

SEQ ID NO: 511151 - DNA, 20 bp, Artificial Sequence
  chemically synthesized
aatgccatttagattttcac

SEQ ID NO: 511152 - DNA, 20 bp, Artificial Sequence
  chemically synthesized
acagtcaaccttctatttcc

SEQ ID NO: 511153 - DNA, 20 bp, Artificial Sequence
  chemically synthesized
taatattttttgttgttgta

SEQ ID NO: 511154 - DNA, 20 bp, Artificial Sequence
  chemically synthesized
agatgttttaaagtatatag

SEQ ID NO: 511155 - DNA, 20 bp, Artificial Sequence
  chemically synthesized
atactatgccattttgtata

SEQ ID NO: 511156 - DNA, 20 bp, Artificial Sequence
  chemically synthesized
tataagggatttaagcatct

SEQ ID NO: 511157 - DNA, 20 bp, Artificial Sequence
  chemically synthesized
acatgggttccaggatgcca

SEQ ID NO: 511158 - DNA, 20 bp, Artificial Sequence
  chemically synthesized
tatccacgggacatgggttc

SEQ ID NO: 511159 - DNA, 20 bp, Artificial Sequence
  chemically synthesized
catcctggaacccatgtccc

SEQ ID NO: 511160 - DNA, 20 bp, Artificial Sequence
  chemically synthesized
tcccttggtatccacgggac

SEQ ID NO: 511161 - DNA, 20 bp, Artificial Sequence
  chemically synthesized
agggacagctatatatccat

SEQ ID NO: 511162 - DNA, 20 bp, Artificial Sequence
  chemically synthesized
aaaatttccatactacccaa

SEQ ID NO: 511163 - DNA, 20 bp, Artificial Sequence
  chemically synthesized
cttcttccagtctacaaaca

SEQ ID NO: 511164 - DNA, 20 bp, Artificial Sequence
  chemically synthesized
ttttcactttcttctttaaa

SEQ ID NO: 511165 - DNA, 20 bp, Artificial Sequence
  chemically synthesized
aaattctatttatgataaca

SEQ ID NO: 511166 - DNA, 20 bp, Artificial Sequence
  chemically synthesized
ttattctatgttatcataaa

SEQ ID NO: 511167 - DNA, 20 bp, Artificial Sequence
  chemically synthesized
atagaattttttaaaatttt

SEQ ID NO: 511168 - DNA, 20 bp, Artificial Sequence
  chemically synthesized
taaatgagttcagtaagtag

SEQ ID NO: 511169 - DNA, 20 bp, Artificial Sequence
  chemically synthesized
aaaaatgttagaactaataa

SEQ ID NO: 511170 - DNA, 20 bp, Artificial Sequence
  chemically synthesized
tagttctaacatttttcttg

SEQ ID NO: 511171 - DNA, 20 bp, Artificial Sequence
  chemically synthesized
atttttcttgtggagtcctt

SEQ ID NO: 511172 - DNA, 20 bp, Artificial Sequence
  chemically synthesized
ctatgacaaatggaagtggt

SEQ ID NO: 511173 - DNA, 20 bp, Artificial Sequence
  chemically synthesized
cttaagatttgctaaaaagc

SEQ ID NO: 511174 - DNA, 20 bp, Artificial Sequence
  chemically synthesized
aatatgatcaacggtggttg

SEQ ID NO: 511175 - DNA, 20 bp, Artificial Sequence
  chemically synthesized
ccttccatacatattttgcg

SEQ ID NO: 511176 - DNA, 20 bp, Artificial Sequence
  chemically synthesized
gcgaagagttataataataa

SEQ ID NO: 511177 - DNA, 20 bp, Artificial Sequence
  chemically synthesized
ggattataaaccgtgaccag

SEQ ID NO: 511178 - DNA, 20 bp, Artificial Sequence
  chemically synthesized
ttagcaagacaaataacaca

SEQ ID NO: 511179 - DNA, 20 bp, Artificial Sequence
  chemically synthesized
tatatatgccaatatctagg

SEQ ID NO: 511180 - DNA, 20 bp, Artificial Sequence
  chemically synthesized
gtctgtttgactttcgtatt

SEQ ID NO: 511181 - DNA, 20 bp, Artificial Sequence
  chemically synthesized
tcatttcttccaaacattta

SEQ ID NO: 511182 - DNA, 20 bp, Artificial Sequence
  chemically synthesized
gacacaaacttgaagttata

SEQ ID NO: 511183 - DNA, 20 bp, Artificial Sequence
  chemically synthesized
aataactgttttggtatggt

SEQ ID NO: 511184 - DNA, 20 bp, Artificial Sequence
  chemically synthesized
aacagttattatggaagata

SEQ ID NO: 511185 - DNA, 20 bp, Artificial Sequence
  chemically synthesized
ttattatggaagataatgga

SEQ ID NO: 511186 - DNA, 20 bp, Artificial Sequence
  chemically synthesized
taatggataggataatttgg

SEQ ID NO: 511187 - DNA, 20 bp, Artificial Sequence
  chemically synthesized
tagacataatgaaatgatta

SEQ ID NO: 511188 - DNA, 20 bp, Artificial Sequence
  chemically synthesized
catcttgtaccccttaaatc

SEQ ID NO: 511189 - DNA, 20 bp, Artificial Sequence
  chemically synthesized
gattacatacccctgattta

SEQ ID NO: 511190 - DNA, 20 bp, Artificial Sequence
  chemically synthesized
gcttccttaggctccatttg

SEQ ID NO: 511191 - DNA, 20 bp, Artificial Sequence
  chemically synthesized
tctcataatgttttaagaaa

SEQ ID NO: 511192 - DNA, 20 bp, Artificial Sequence
  chemically synthesized
ataatgttttaagaaagtgg

SEQ ID NO: 511193 - DNA, 20 bp, Artificial Sequence
  chemically synthesized
acatgtggcccaggacagct

SEQ ID NO: 511194 - DNA, 20 bp, Artificial Sequence
  chemically synthesized
ccacatgtagcccatgggct

SEQ ID NO: 511195 - DNA, 20 bp, Artificial Sequence
  chemically synthesized
gccttaagtacatccagtaa

SEQ ID NO: 511196 - DNA, 20 bp, Artificial Sequence
  chemically synthesized
ttttagtttttattctttta

SEQ ID NO: 511197 - DNA, 20 bp, Artificial Sequence
  chemically synthesized
tatatttgacttgtcaactg

SEQ ID NO: 511198 - DNA, 20 bp, Artificial Sequence
  chemically synthesized
gaaaggatttcctcaagaag

SEQ ID NO: 511199 - DNA, 20 bp, Artificial Sequence
  chemically synthesized
cagttggaccaattttttga

SEQ ID NO: 511200 - DNA, 20 bp, Artificial Sequence
  chemically synthesized
tttcaaaaaattggtccaac

SEQ ID NO: 511201 - DNA, 20 bp, Artificial Sequence
  chemically synthesized
gaatgtataaatatacaatt

SEQ ID NO: 511202 - DNA, 20 bp, Artificial Sequence
  chemically synthesized
caaaaaagtctgatttaatt

SEQ ID NO: 511203 - DNA, 20 bp, Artificial Sequence
  chemically synthesized
ttttgctgaaactaaacgag

SEQ ID NO: 511204 - DNA, 20 bp, Artificial Sequence
  chemically synthesized
actgaacagaaatttatttg

SEQ ID NO: 511205 - DNA, 20 bp, Artificial Sequence
  chemically synthesized
tatgaggaactatgcaaatc

SEQ ID NO: 511206 - DNA, 20 bp, Artificial Sequence
  chemically synthesized
ttaacatgttttcttcctaa

SEQ ID NO: 511207 - DNA, 20 bp, Artificial Sequence
  chemically synthesized
attgggttgatttattgttt

SEQ ID NO: 511208 - DNA, 20 bp, Artificial Sequence
  chemically synthesized
gggctgtgatatacttcaca

SEQ ID NO: 511209 - DNA, 20 bp, Artificial Sequence
  chemically synthesized
tacatggttcaactgtacaa

SEQ ID NO: 511210 - DNA, 20 bp, Artificial Sequence
  chemically synthesized
gatgaagattttaagtgcca

SEQ ID NO: 511211 - DNA, 20 bp, Artificial Sequence
  chemically synthesized
tcttgagacttatttaatga

SEQ ID NO: 511212 - DNA, 20 bp, Artificial Sequence
  chemically synthesized
gttgtgcttatgtaaatctt

SEQ ID NO: 511213 - DNA, 20 bp, Artificial Sequence
  chemically synthesized
aaagatttacataagcacaa

SEQ ID NO: 511214 - DNA, 20 bp, Artificial Sequence
  chemically synthesized
actttattagctcttctctt

SEQ ID NO: 511215 - DNA, 20 bp, Artificial Sequence
  chemically synthesized
aaaaagagagctaccaaaac

SEQ ID NO: 511216 - DNA, 20 bp, Artificial Sequence
  chemically synthesized
ctagattctaaagcaaggat

SEQ ID NO: 511217 - DNA, 20 bp, Artificial Sequence
  chemically synthesized
tacaatcctaatccttgctt

SEQ ID NO: 511218 - DNA, 20 bp, Artificial Sequence
  chemically synthesized
caatgtctagattctaaagc

SEQ ID NO: 511219 - DNA, 20 bp, Artificial Sequence
  chemically synthesized
tggtaaagactctaatatat

SEQ ID NO: 511220 - DNA, 20 bp, Artificial Sequence
  chemically synthesized
tctggaacacccttatatat

SEQ ID NO: 511221 - DNA, 20 bp, Artificial Sequence
  chemically synthesized
ttgacagtatggcttgagag

SEQ ID NO: 511222 - DNA, 20 bp, Artificial Sequence
  chemically synthesized
aggcagagaatgctcagcag

SEQ ID NO: 511223 - DNA, 20 bp, Artificial Sequence
  chemically synthesized
gatccatgatatgagaggca

SEQ ID NO: 511224 - DNA, 20 bp, Artificial Sequence
  chemically synthesized
cattctctgcctctcatatc

SEQ ID NO: 511225 - DNA, 20 bp, Artificial Sequence
  chemically synthesized
taaagatgtcaagtattttg

SEQ ID NO: 511226 - DNA, 20 bp, Artificial Sequence
  chemically synthesized
aagatacacatgggctgaaa

SEQ ID NO: 511227 - DNA, 20 bp, Artificial Sequence
  chemically synthesized
ttttttggtttccattggca

SEQ ID NO: 511228 - DNA, 20 bp, Artificial Sequence
  chemically synthesized
aatggaaaccaaaaaacagc

SEQ ID NO: 511229 - DNA, 20 bp, Artificial Sequence
  chemically synthesized
cagatttcaagacaaaaaca

SEQ ID NO: 511230 - DNA, 20 bp, Artificial Sequence
  chemically synthesized
aggtcattatataatgagaa

SEQ ID NO: 511231 - DNA, 20 bp, Artificial Sequence
  chemically synthesized
gaaaggggtcaattcagcaa

SEQ ID NO: 511232 - DNA, 20 bp, Artificial Sequence
  chemically synthesized
gcaattgttgtatccttttg

SEQ ID NO: 511233 - DNA, 20 bp, Artificial Sequence
  chemically synthesized
tttatctgggtgctccagtg

SEQ ID NO: 511234 - DNA, 20 bp, Artificial Sequence
  chemically synthesized
ataatatttgctttatttat

SEQ ID NO: 511235 - DNA, 20 bp, Artificial Sequence
  chemically synthesized
gagagatctcaactcaaagg

SEQ ID NO: 511236 - DNA, 20 bp, Artificial Sequence
  chemically synthesized
cctagtaccctactcagcct

SEQ ID NO: 511237 - DNA, 20 bp, Artificial Sequence
  chemically synthesized
atctcaactcaaaggctgag

SEQ ID NO: 511238 - DNA, 20 bp, Artificial Sequence
  chemically synthesized
aaaggctgagtagggtacta

SEQ ID NO: 511239 - DNA, 20 bp, Artificial Sequence
  chemically synthesized
actagggggtggaggtaagc

SEQ ID NO: 511240 - DNA, 20 bp, Artificial Sequence
  chemically synthesized
aggtaagctggggttggtta

SEQ ID NO: 511241 - DNA, 20 bp, Artificial Sequence
  chemically synthesized
gggtacaaaaattccttaga

SEQ ID NO: 511242 - DNA, 20 bp, Artificial Sequence
  chemically synthesized
actatgttttattctttcta

SEQ ID NO: 511243 - DNA, 20 bp, Artificial Sequence
  chemically synthesized
taaaatgtacagttaaatta

SEQ ID NO: 511244 - DNA, 20 bp, Artificial Sequence
  chemically synthesized
tttataataactcagtatca

SEQ ID NO: 511245 - DNA, 20 bp, Artificial Sequence
  chemically synthesized
ttataaacaatccaatgata

SEQ ID NO: 511246 - DNA, 20 bp, Artificial Sequence
  chemically synthesized
attggattgtttataacaca

SEQ ID NO: 511247 - DNA, 20 bp, Artificial Sequence
  chemically synthesized
ataacacaaaggataaatgc

SEQ ID NO: 511248 - DNA, 20 bp, Artificial Sequence
  chemically synthesized
cacaaaggataaatgcttga

SEQ ID NO: 511249 - DNA, 20 bp, Artificial Sequence
  chemically synthesized
aaggataaatgcttgagtgg

SEQ ID NO: 511250 - DNA, 20 bp, Artificial Sequence
  chemically synthesized
aataataatcacatggagaa

SEQ ID NO: 511251 - DNA, 20 bp, Artificial Sequence
  chemically synthesized
cagtaaataataatcacatg

SEQ ID NO: 511252 - DNA, 20 bp, Artificial Sequence
  chemically synthesized
ggggaattttttaaattttt

SEQ ID NO: 511253 - DNA, 20 bp, Artificial Sequence
  chemically synthesized
aaaaatttaaaaaattcccc

SEQ ID NO: 511254 - DNA, 20 bp, Artificial Sequence
  chemically synthesized
agaaattgcatatattccag

SEQ ID NO: 511255 - DNA, 20 bp, Artificial Sequence
  chemically synthesized
tatattggataaaagtatat

SEQ ID NO: 511256 - DNA, 20 bp, Artificial Sequence
  chemically synthesized
ataaatttgtaacatatata

SEQ ID NO: 511257 - DNA, 20 bp, Artificial Sequence
  chemically synthesized
ttacaaatttattacagctg

SEQ ID NO: 511258 - DNA, 20 bp, Artificial Sequence
  chemically synthesized
ataaactatttatgacactg

SEQ ID NO: 511259 - DNA, 20 bp, Artificial Sequence
  chemically synthesized
agagaaaatgacatttgttc

SEQ ID NO: 511260 - DNA, 20 bp, Artificial Sequence
  chemically synthesized
agacattgataagctacatt

SEQ ID NO: 511261 - DNA, 20 bp, Artificial Sequence
  chemically synthesized
acagattcaaaattttgtct

SEQ ID NO: 511262 - DNA, 20 bp, Artificial Sequence
  chemically synthesized
ataaattcacagacaaaatt

SEQ ID NO: 511263 - DNA, 20 bp, Artificial Sequence
  chemically synthesized
atttgccatcactttttgga

SEQ ID NO: 511264 - DNA, 20 bp, Artificial Sequence
  chemically synthesized
aggccatttgccatcacttt

SEQ ID NO: 511265 - DNA, 20 bp, Artificial Sequence
  chemically synthesized
ttggtggaagcagtccaaat

SEQ ID NO: 511266 - DNA, 20 bp, Artificial Sequence
  chemically synthesized
aatataccttgccaatgatc

SEQ ID NO: 511267 - DNA, 20 bp, Artificial Sequence
  chemically synthesized
aaatattttactctcctgga

SEQ ID NO: 511268 - DNA, 20 bp, Artificial Sequence
  chemically synthesized
gtaaaagctaccctttccag

SEQ ID NO: 511269 - DNA, 20 bp, Artificial Sequence
  chemically synthesized
catagctgaattttattaca

SEQ ID NO: 511270 - DNA, 20 bp, Artificial Sequence
  chemically synthesized
ctttgtaataaaattcagct

SEQ ID NO: 511271 - DNA, 20 bp, Artificial Sequence
  chemically synthesized
tatagctaagacatccatag

SEQ ID NO: 511272 - DNA, 20 bp, Artificial Sequence
  chemically synthesized
agagcagttataaggactgc

SEQ ID NO: 511273 - DNA, 20 bp, Artificial Sequence
  chemically synthesized
atgataattatacatattta

SEQ ID NO: 511274 - DNA, 20 bp, Artificial Sequence
  chemically synthesized
aatgtttctacacacagaca

SEQ ID NO: 511275 - DNA, 20 bp, Artificial Sequence
  chemically synthesized
cattggatgtgctaattacc

SEQ ID NO: 511276 - DNA, 20 bp, Artificial Sequence
  chemically synthesized
tgaatatgtgataattaatt

SEQ ID NO: 511277 - DNA, 20 bp, Artificial Sequence
  chemically synthesized
cttatatatttataatttct

SEQ ID NO: 511278 - DNA, 20 bp, Artificial Sequence
  chemically synthesized
aattataaatatataagatg

SEQ ID NO: 511279 - DNA, 20 bp, Artificial Sequence
  chemically synthesized
ccttgattctcaaataatat

SEQ ID NO: 511280 - DNA, 20 bp, Artificial Sequence
  chemically synthesized
gatggattcagatattattt

SEQ ID NO: 511281 - DNA, 20 bp, Artificial Sequence
  chemically synthesized
gtaaacgttaggcctagaat

SEQ ID NO: 511282 - DNA, 20 bp, Artificial Sequence
  chemically synthesized
catctagtaaacgttaggcc

SEQ ID NO: 511283 - DNA, 20 bp, Artificial Sequence
  chemically synthesized
tgagcccaataataaaggct

SEQ ID NO: 511284 - DNA, 20 bp, Artificial Sequence
  chemically synthesized
atgaatctaccatctccaag

SEQ ID NO: 511285 - DNA, 20 bp, Artificial Sequence
  chemically synthesized
aaccatttgaaaaggtcttt

SEQ ID NO: 511286 - DNA, 20 bp, Artificial Sequence
  chemically synthesized
ggttgaagtaaaatcaatgt

SEQ ID NO: 511287 - DNA, 20 bp, Artificial Sequence
  chemically synthesized
ctggtacaaaaattcagtta

SEQ ID NO: 511288 - DNA, 20 bp, Artificial Sequence
  chemically synthesized
gatatctatgcattcactaa

SEQ ID NO: 511289 - DNA, 20 bp, Artificial Sequence
  chemically synthesized
ggaacaagaactatatagag

SEQ ID NO: 511290 - DNA, 20 bp, Artificial Sequence
  chemically synthesized
ccatttttatacaagtctca

SEQ ID NO: 511291 - DNA, 20 bp, Artificial Sequence
  chemically synthesized
aaaatggtttcacgagacca

SEQ ID NO: 511292 - DNA, 20 bp, Artificial Sequence
  chemically synthesized
cttgaacattaatcagaatt

SEQ ID NO: 511293 - DNA, 20 bp, Artificial Sequence
  chemically synthesized
tcagttgcttgaacattaat

SEQ ID NO: 511294 - DNA, 20 bp, Artificial Sequence
  chemically synthesized
caccttctaaattcatttac

SEQ ID NO: 511295 - DNA, 20 bp, Artificial Sequence
  chemically synthesized
tgtaagcaggactctagtaa

SEQ ID NO: 511296 - DNA, 20 bp, Artificial Sequence
  chemically synthesized
tgatattattggtcccttca

SEQ ID NO: 511297 - DNA, 20 bp, Artificial Sequence
  chemically synthesized
aaatacttgacgttcctatg

SEQ ID NO: 511298 - DNA, 20 bp, Artificial Sequence
  chemically synthesized
aaattaggaaagtcatgttt

SEQ ID NO: 511299 - DNA, 20 bp, Artificial Sequence
  chemically synthesized
gaaacatgactttcctaatt

SEQ ID NO: 511300 - DNA, 20 bp, Artificial Sequence
  chemically synthesized
tttggtaaataaaagtgaat

SEQ ID NO: 511301 - DNA, 20 bp, Artificial Sequence
  chemically synthesized
gtctaatttggtaaataaaa

SEQ ID NO: 511302 - DNA, 20 bp, Artificial Sequence
  chemically synthesized
aaaagtatgatcagagtgat

SEQ ID NO: 511303 - DNA, 20 bp, Artificial Sequence
  chemically synthesized
attaaaaacaaaagtatgat

SEQ ID NO: 511304 - DNA, 20 bp, Artificial Sequence
  chemically synthesized
taacaatccctgcctaactg

SEQ ID NO: 511305 - DNA, 20 bp, Artificial Sequence
  chemically synthesized
atgacactcctcagttaggc

SEQ ID NO: 511306 - DNA, 20 bp, Artificial Sequence
  chemically synthesized
ctatttgtcagtctccaatg

SEQ ID NO: 511307 - DNA, 20 bp, Artificial Sequence
  chemically synthesized
tacaagcagtgtaagagcat

SEQ ID NO: 511308 - DNA, 20 bp, Artificial Sequence
  chemically synthesized
tttacatgaaaatcacattt

SEQ ID NO: 511309 - DNA, 20 bp, Artificial Sequence
  chemically synthesized
aggaagcttgccagacactc

SEQ ID NO: 511310 - DNA, 20 bp, Artificial Sequence
  chemically synthesized
tgcttcacaaaatgttactc

SEQ ID NO: 511311 - DNA, 20 bp, Artificial Sequence
  chemically synthesized
attttgcctgtattacaaca

SEQ ID NO: 511312 - DNA, 20 bp, Artificial Sequence
  chemically synthesized
ctccatttatgaaaagacat

SEQ ID NO: 511313 - DNA, 20 bp, Artificial Sequence
  chemically synthesized
ttcaaatgtcttttcataaa

SEQ ID NO: 511314 - DNA, 20 bp, Artificial Sequence
  chemically synthesized
cctgctcttgataaactaca

SEQ ID NO: 511315 - DNA, 20 bp, Artificial Sequence
  chemically synthesized
gctgcgtataaaaagcagcc

SEQ ID NO: 511316 - DNA, 20 bp, Artificial Sequence
  chemically synthesized
tgctttatttgagcttagag

SEQ ID NO: 511317 - DNA, 20 bp, Artificial Sequence
  chemically synthesized
tgtcatgttaatattctaaa

SEQ ID NO: 511318 - DNA, 20 bp, Artificial Sequence
  chemically synthesized
taacacaatttaactcactt

SEQ ID NO: 511319 - DNA, 20 bp, Artificial Sequence
  chemically synthesized
tcagtaaggcagatatcttt

SEQ ID NO: 511320 - DNA, 20 bp, Artificial Sequence
  chemically synthesized
cttcttcttcctgtattttt

SEQ ID NO: 511321 - DNA, 20 bp, Artificial Sequence
  chemically synthesized
gcttcagtgagaacttcctg

SEQ ID NO: 511322 - DNA, 20 bp, Artificial Sequence
  chemically synthesized
ttaaacaattaaggaaagat

SEQ ID NO: 511323 - DNA, 20 bp, Artificial Sequence
  chemically synthesized
agtaaatatttactaaatga

SEQ ID NO: 511324 - DNA, 20 bp, Artificial Sequence
  chemically synthesized
actgagtaaatatttactaa

SEQ ID NO: 511325 - DNA, 20 bp, Artificial Sequence
  chemically synthesized
tagttggaaaatggtagaca

SEQ ID NO: 511326 - DNA, 20 bp, Artificial Sequence
  chemically synthesized
agatttcaaattttcctatt

SEQ ID NO: 511327 - DNA, 20 bp, Artificial Sequence
  chemically synthesized
gctacaaaatctgtaatttt

SEQ ID NO: 511328 - DNA, 20 bp, Artificial Sequence
  chemically synthesized
atttttaagggaaatcctta

SEQ ID NO: 511329 - DNA, 20 bp, Artificial Sequence
  chemically synthesized
gaaatccgaaatgattcaat

SEQ ID NO: 511330 - DNA, 20 bp, Artificial Sequence
  chemically synthesized
gaaatccttattgaatcatt

SEQ ID NO: 511331 - DNA, 20 bp, Artificial Sequence
  chemically synthesized
ggatttcagattttcagatt

SEQ ID NO: 511332 - DNA, 20 bp, Artificial Sequence
  chemically synthesized
ggaatatctttattatacat

SEQ ID NO: 511333 - DNA, 20 bp, Artificial Sequence
  chemically synthesized
gattttggatattttcagtt

SEQ ID NO: 511334 - DNA, 20 bp, Artificial Sequence
  chemically synthesized
gaccagaagtgttttggatt

SEQ ID NO: 511335 - DNA, 20 bp, Artificial Sequence
  chemically synthesized
tgcttgggaccagaagtgtt

SEQ ID NO: 511336 - DNA, 20 bp, Artificial Sequence
  chemically synthesized
cacttctggtcccaagcatt

SEQ ID NO: 511337 - DNA, 20 bp, Artificial Sequence
  chemically synthesized
ggtcccaagcattttggata

SEQ ID NO: 511338 - DNA, 20 bp, Artificial Sequence
  chemically synthesized
aacttgccccaaaatatatg

SEQ ID NO: 511339 - DNA, 20 bp, Artificial Sequence
  chemically synthesized
tttggaaacatttcatgtta

SEQ ID NO: 511340 - DNA, 20 bp, Artificial Sequence
  chemically synthesized
attcagcttgccaagctacc

SEQ ID NO: 511341 - DNA, 20 bp, Artificial Sequence
  chemically synthesized
attcatggtagcttggcaag

SEQ ID NO: 511342 - DNA, 20 bp, Artificial Sequence
  chemically synthesized
aagctgaatgattctccaag

SEQ ID NO: 511343 - DNA, 20 bp, Artificial Sequence
  chemically synthesized
agcatataatactcctcttg

SEQ ID NO: 511344 - DNA, 20 bp, Artificial Sequence
  chemically synthesized
aaatgttaaagatagattgg

SEQ ID NO: 511345 - DNA, 20 bp, Artificial Sequence
  chemically synthesized
tctttttaacaaaaacttac

SEQ ID NO: 511346 - DNA, 20 bp, Artificial Sequence
  chemically synthesized
aagaaatatgccaaatttaa

SEQ ID NO: 511347 - DNA, 20 bp, Artificial Sequence
  chemically synthesized
gaaccagaacatgtagtttt

SEQ ID NO: 511348 - DNA, 20 bp, Artificial Sequence
  chemically synthesized
tactttgataggaaagtcaa

SEQ ID NO: 511349 - DNA, 20 bp, Artificial Sequence
  chemically synthesized
tggtgaatggttaagatatg

SEQ ID NO: 511350 - DNA, 20 bp, Artificial Sequence
  chemically synthesized
attacatagtcagtactatg

SEQ ID NO: 511351 - DNA, 20 bp, Artificial Sequence
  chemically synthesized
atggtccaggaggtatactt

SEQ ID NO: 511352 - DNA, 20 bp, Artificial Sequence
  chemically synthesized
agttggttaaatatttatag

SEQ ID NO: 511353 - DNA, 20 bp, Artificial Sequence
  chemically synthesized
ccacgttacattttaacagt

SEQ ID NO: 511354 - DNA, 20 bp, Artificial Sequence
  chemically synthesized
cctccgaaaatgctgagatt

SEQ ID NO: 511355 - DNA, 20 bp, Artificial Sequence
  chemically synthesized
attttcggaggctgaggcag

SEQ ID NO: 511356 - DNA, 20 bp, Artificial Sequence
  chemically synthesized
caggaggatcgcttgaggcc

SEQ ID NO: 511357 - DNA, 20 bp, Artificial Sequence
  chemically synthesized
ttattgttattttgtagaga

SEQ ID NO: 511358 - DNA, 20 bp, Artificial Sequence
  chemically synthesized
agctcagcctcctgagtaac

SEQ ID NO: 511359 - DNA, 20 bp, Artificial Sequence
  chemically synthesized
gatccttctagctcagcctc

SEQ ID NO: 511360 - DNA, 20 bp, Artificial Sequence
  chemically synthesized
tactcaggaggctgagctag

SEQ ID NO: 511361 - DNA, 20 bp, Artificial Sequence
  chemically synthesized
ctagaaggatcacttgactc

SEQ ID NO: 511362 - DNA, 20 bp, Artificial Sequence
  chemically synthesized
ttaccacaggcctccaactc

SEQ ID NO: 511363 - DNA, 20 bp, Artificial Sequence
  chemically synthesized
tattactcttttgcccaggc

SEQ ID NO: 511364 - DNA, 20 bp, Artificial Sequence
  chemically synthesized
gtgcactccagcctgggcaa

SEQ ID NO: 511365 - DNA, 20 bp, Artificial Sequence
  chemically synthesized
atagatatgtgatccaatcc

SEQ ID NO: 511366 - DNA, 20 bp, Artificial Sequence
  chemically synthesized
catattttaaaactcatgga

SEQ ID NO: 511367 - DNA, 20 bp, Artificial Sequence
  chemically synthesized
cctgacatattttaaaactc

SEQ ID NO: 511368 - DNA, 20 bp, Artificial Sequence
  chemically synthesized
aagtaggacacaaaaacaat

SEQ ID NO: 511369 - DNA, 20 bp, Artificial Sequence
  chemically synthesized
caatttgaatgtttatgaaa

SEQ ID NO: 511370 - DNA, 20 bp, Artificial Sequence
  chemically synthesized
cttagagagccataggacag

SEQ ID NO: 511371 - DNA, 20 bp, Artificial Sequence
  chemically synthesized
agagtgtcttcctaggcaat

SEQ ID NO: 511372 - DNA, 20 bp, Artificial Sequence
  chemically synthesized
cctaggcaataggaatgacg

SEQ ID NO: 511373 - DNA, 20 bp, Artificial Sequence
  chemically synthesized
aatagtaagatgtttgccct

SEQ ID NO: 511374 - DNA, 20 bp, Artificial Sequence
  chemically synthesized
atgaaaaatattagtaacta

SEQ ID NO: 511375 - DNA, 20 bp, Artificial Sequence
  chemically synthesized
atattagtaactactgagtt

SEQ ID NO: 511376 - DNA, 20 bp, Artificial Sequence
  chemically synthesized
agtgggagccactaaatatt

SEQ ID NO: 511377 - DNA, 20 bp, Artificial Sequence
  chemically synthesized
gatgaaattagtattttatt

SEQ ID NO: 511378 - DNA, 20 bp, Artificial Sequence
  chemically synthesized
ctctttcatatttgaatcta

SEQ ID NO: 511379 - DNA, 20 bp, Artificial Sequence
  chemically synthesized
atctcccatctctttcatat

SEQ ID NO: 511380 - DNA, 20 bp, Artificial Sequence
  chemically synthesized
ttttcagccatgagcagaaa

SEQ ID NO: 511381 - DNA, 20 bp, Artificial Sequence
  chemically synthesized
gccatgagcagaaaaagagt

SEQ ID NO: 511382 - DNA, 20 bp, Artificial Sequence
  chemically synthesized
gaaaattaaaacttgaaata

SEQ ID NO: 511383 - DNA, 20 bp, Artificial Sequence
  chemically synthesized
gagaggaggagccaagatgg

SEQ ID NO: 511384 - DNA, 20 bp, Artificial Sequence
  chemically synthesized
cagctccggtctacagctcc

SEQ ID NO: 511385 - DNA, 20 bp, Artificial Sequence
  chemically synthesized
cagagtgagcgacgcagaag

SEQ ID NO: 511386 - DNA, 20 bp, Artificial Sequence
  chemically synthesized
gtaccaggttcatctcacta

SEQ ID NO: 511387 - DNA, 20 bp, Artificial Sequence
  chemically synthesized
cagacagtgggcgcagctca

SEQ ID NO: 511388 - DNA, 20 bp, Artificial Sequence
  chemically synthesized
gcaccgtgcgcgacccgaag

SEQ ID NO: 511389 - DNA, 20 bp, Artificial Sequence
  chemically synthesized
aggcaatgcctcaccctgct

SEQ ID NO: 511390 - DNA, 20 bp, Artificial Sequence
  chemically synthesized
tccctgaccccttgcacttc

SEQ ID NO: 511391 - DNA, 20 bp, Artificial Sequence
  chemically synthesized
tgcctcactcgggaagtgca

SEQ ID NO: 511392 - DNA, 20 bp, Artificial Sequence
  chemically synthesized
tcgggaagtgcaaggggtca

SEQ ID NO: 511393 - DNA, 20 bp, Artificial Sequence
  chemically synthesized
tccctttcctagtcaaagaa

SEQ ID NO: 511394 - DNA, 20 bp, Artificial Sequence
  chemically synthesized
gacggacagcacctggaaaa

SEQ ID NO: 511395 - DNA, 20 bp, Artificial Sequence
  chemically synthesized
gaaaatcgggtcacacccac

SEQ ID NO: 511396 - DNA, 20 bp, Artificial Sequence
  chemically synthesized
cggaaacacgcagtattcgg

SEQ ID NO: 511397 - DNA, 20 bp, Artificial Sequence
  chemically synthesized
ccgtcggaaacacgcagtat

SEQ ID NO: 511398 - DNA, 20 bp, Artificial Sequence
  chemically synthesized
aggaccctccgagccagatg

SEQ ID NO: 511399 - DNA, 20 bp, Artificial Sequence
  chemically synthesized
tatatcctgcatctggctcg

SEQ ID NO: 511400 - DNA, 20 bp, Artificial Sequence
  chemically synthesized
ctcggagggtcctaccccaa

SEQ ID NO: 511401 - DNA, 20 bp, Artificial Sequence
  chemically synthesized
agcaatcagcgagattccgt

SEQ ID NO: 511402 - DNA, 20 bp, Artificial Sequence
  chemically synthesized
ctaatcaagcctaggcaatg

SEQ ID NO: 511403 - DNA, 20 bp, Artificial Sequence
  chemically synthesized
aagcagctgggaagcttgaa

SEQ ID NO: 511404 - DNA, 20 bp, Artificial Sequence
  chemically synthesized
acagaggcaggcaggcctcc

SEQ ID NO: 511405 - DNA, 20 bp, Artificial Sequence
  chemically synthesized
tctcttcaaagctgtcagac

SEQ ID NO: 511406 - DNA, 20 bp, Artificial Sequence
  chemically synthesized
ggggcagactgcctcctcaa

SEQ ID NO: 511407 - DNA, 20 bp, Artificial Sequence
  chemically synthesized
agttagggtgctcgggggtc

SEQ ID NO: 511408 - DNA, 20 bp, Artificial Sequence
  chemically synthesized
gcctcccagttagggtgctc

SEQ ID NO: 511409 - DNA, 20 bp, Artificial Sequence
  chemically synthesized
tttggggagtgcctcccagt

SEQ ID NO: 511410 - DNA, 20 bp, Artificial Sequence
  chemically synthesized
gtgtcagtatgccccttttg

SEQ ID NO: 511411 - DNA, 20 bp, Artificial Sequence
  chemically synthesized
catactgacacctcacacgg

SEQ ID NO: 511412 - DNA, 20 bp, Artificial Sequence
  chemically synthesized
accctcagctgcaggtctgt

SEQ ID NO: 511413 - DNA, 20 bp, Artificial Sequence
  chemically synthesized
actccaacagacctgcagct

SEQ ID NO: 511414 - DNA, 20 bp, Artificial Sequence
  chemically synthesized
cgtccagatgggttttttgt

SEQ ID NO: 511415 - DNA, 20 bp, Artificial Sequence
  chemically synthesized
ttgatgatggtgacgtccag

SEQ ID NO: 511416 - DNA, 20 bp, Artificial Sequence
  chemically synthesized
aggagaggtgctctgctttt

SEQ ID NO: 511417 - DNA, 20 bp, Artificial Sequence
  chemically synthesized
caacggaacaaagctggaga

SEQ ID NO: 511418 - DNA, 20 bp, Artificial Sequence
  chemically synthesized
ttgaatgtcctcccgtagct

SEQ ID NO: 511419 - DNA, 20 bp, Artificial Sequence
  chemically synthesized
tcaacttctttgcctttggt

SEQ ID NO: 511420 - DNA, 20 bp, Artificial Sequence
  chemically synthesized
aaactttgaaaaacatttag

SEQ ID NO: 511421 - DNA, 20 bp, Artificial Sequence
  chemically synthesized
catttagaagaatgtataag

SEQ ID NO: 511422 - DNA, 20 bp, Artificial Sequence
  chemically synthesized
caaggctagagaagtacgtg

SEQ ID NO: 511423 - DNA, 20 bp, Artificial Sequence
  chemically synthesized
cgatgcgatcaactggaaga

SEQ ID NO: 511424 - DNA, 20 bp, Artificial Sequence
  chemically synthesized
gaagggaagtttagaggaaa

SEQ ID NO: 511425 - DNA, 20 bp, Artificial Sequence
  chemically synthesized
gtgtacctgaaagtgatggg

SEQ ID NO: 511426 - DNA, 20 bp, Artificial Sequence
  chemically synthesized
ccaatttggaaaacactctg

SEQ ID NO: 511427 - DNA, 20 bp, Artificial Sequence
  chemically synthesized
ttctcctggataatatcctg

SEQ ID NO: 511428 - DNA, 20 bp, Artificial Sequence
  chemically synthesized
gctagattggggaagttctc

SEQ ID NO: 511429 - DNA, 20 bp, Artificial Sequence
  chemically synthesized
attctctgtatttcctgaat

SEQ ID NO: 511430 - DNA, 20 bp, Artificial Sequence
  chemically synthesized
tgtggcattctctgtatttc

SEQ ID NO: 511431 - DNA, 20 bp, Artificial Sequence
  chemically synthesized
attcagattcaggaaataca

SEQ ID NO: 511432 - DNA, 20 bp, Artificial Sequence
  chemically synthesized
tcttggagttgctcttctcg

SEQ ID NO: 511433 - DNA, 20 bp, Artificial Sequence
  chemically synthesized
aatctgacaattatgtgtct

SEQ ID NO: 511434 - DNA, 20 bp, Artificial Sequence
  chemically synthesized
tttccttcatttcaactttg

SEQ ID NO: 511435 - DNA, 20 bp, Artificial Sequence
  chemically synthesized
agggcagccagagagaaagg

SEQ ID NO: 511436 - DNA, 20 bp, Artificial Sequence
  chemically synthesized
agtgtgatgggcttcccttt

SEQ ID NO: 511437 - DNA, 20 bp, Artificial Sequence
  chemically synthesized
ggaagcccatcacactaaca

SEQ ID NO: 511438 - DNA, 20 bp, Artificial Sequence
  chemically synthesized
ccccactctcttctggcttg

SEQ ID NO: 511439 - DNA, 20 bp, Artificial Sequence
  chemically synthesized
agacaccctacaagccagaa

SEQ ID NO: 511440 - DNA, 20 bp, Artificial Sequence
  chemically synthesized
aattcttttctttaagaatg

SEQ ID NO: 511441 - DNA, 20 bp, Artificial Sequence
  chemically synthesized
tattcaacattcttaaagaa

SEQ ID NO: 511442 - DNA, 20 bp, Artificial Sequence
  chemically synthesized
ggttgaaaattcttttcttt

SEQ ID NO: 511443 - DNA, 20 bp, Artificial Sequence
  chemically synthesized
aaagaaaagaattttcaacc

SEQ ID NO: 511444 - DNA, 20 bp, Artificial Sequence
  chemically synthesized
gtttgcctggatgtgaaatt

SEQ ID NO: 511445 - DNA, 20 bp, Artificial Sequence
  chemically synthesized
acttatgaagcttagtttgc

SEQ ID NO: 511446 - DNA, 20 bp, Artificial Sequence
  chemically synthesized
tctcagcatttgcttgtctg

SEQ ID NO: 511447 - DNA, 20 bp, Artificial Sequence
  chemically synthesized
accagctaacatcataatga

SEQ ID NO: 511448 - DNA, 20 bp, Artificial Sequence
  chemically synthesized
taaggttaatattgttatgt

SEQ ID NO: 511449 - DNA, 20 bp, Artificial Sequence
  chemically synthesized
aaaagacacagactggcaac

SEQ ID NO: 511450 - DNA, 20 bp, Artificial Sequence
  chemically synthesized
acagactggcaacttggata

SEQ ID NO: 511451 - DNA, 20 bp, Artificial Sequence
  chemically synthesized
ttcctgaatacagctcactg

SEQ ID NO: 511452 - DNA, 20 bp, Artificial Sequence
  chemically synthesized
ctgcacatgagatgggtttc

SEQ ID NO: 511453 - DNA, 20 bp, Artificial Sequence
  chemically synthesized
tgtgtgtctctgcacatgag

SEQ ID NO: 511454 - DNA, 20 bp, Artificial Sequence
  chemically synthesized
cacacataggctcaaaataa

SEQ ID NO: 511455 - DNA, 20 bp, Artificial Sequence
  chemically synthesized
aatggaaaacaaaaaaaggc

SEQ ID NO: 511456 - DNA, 20 bp, Artificial Sequence
  chemically synthesized
aagtctgttttatcagagac

SEQ ID NO: 511457 - DNA, 20 bp, Artificial Sequence
  chemically synthesized
aggccattacataatggtaa

SEQ ID NO: 511458 - DNA, 20 bp, Artificial Sequence
  chemically synthesized
aggatagttagctcttcctg

SEQ ID NO: 511459 - DNA, 20 bp, Artificial Sequence
  chemically synthesized
ttgttgggtgcatatatatt

SEQ ID NO: 511460 - DNA, 20 bp, Artificial Sequence
  chemically synthesized
tgaatctgggtgctcctttg

SEQ ID NO: 511461 - DNA, 20 bp, Artificial Sequence
  chemically synthesized
tcaggacttgctttatgaat

SEQ ID NO: 511462 - DNA, 20 bp, Artificial Sequence
  chemically synthesized
ggtcactcaggacttgcttt

SEQ ID NO: 511463 - DNA, 20 bp, Artificial Sequence
  chemically synthesized
ccagattcataaagcaagtc

SEQ ID NO: 511464 - DNA, 20 bp, Artificial Sequence
  chemically synthesized
gtctcccattattaatgtgt

SEQ ID NO: 511465 - DNA, 20 bp, Artificial Sequence
  chemically synthesized
gatctgtctaatgttgacag

SEQ ID NO: 511466 - DNA, 20 bp, Artificial Sequence
  chemically synthesized
caacgagacagaaagccaac

SEQ ID NO: 511467 - DNA, 20 bp, Artificial Sequence
  chemically synthesized
gaaagccaacaaggataccc

SEQ ID NO: 511468 - DNA, 20 bp, Artificial Sequence
  chemically synthesized
tgcagagctgagttcaattc

SEQ ID NO: 511469 - DNA, 20 bp, Artificial Sequence
  chemically synthesized
taggtccacttggtgcagag

SEQ ID NO: 511470 - DNA, 20 bp, Artificial Sequence
  chemically synthesized
tattctgttgatttggggtg

SEQ ID NO: 511471 - DNA, 20 bp, Artificial Sequence
  chemically synthesized
aactctccaccccaaatcaa

SEQ ID NO: 511472 - DNA, 20 bp, Artificial Sequence
  chemically synthesized
gaatgtatattctgttgatt

SEQ ID NO: 511473 - DNA, 20 bp, Artificial Sequence
  chemically synthesized
aggtgtggtgtggtgctgaa

SEQ ID NO: 511474 - DNA, 20 bp, Artificial Sequence
  chemically synthesized
tccaagtatgtggtcagttg

SEQ ID NO: 511475 - DNA, 20 bp, Artificial Sequence
  chemically synthesized
agtgcaatcaaactagaact

SEQ ID NO: 511476 - DNA, 20 bp, Artificial Sequence
  chemically synthesized
tcaaactagaactcagaatt

SEQ ID NO: 511477 - DNA, 20 bp, Artificial Sequence
  chemically synthesized
tttgagtgagattcttaatt

SEQ ID NO: 511478 - DNA, 20 bp, Artificial Sequence
  chemically synthesized
ttccatgtagttgagcggtt

SEQ ID NO: 511479 - DNA, 20 bp, Artificial Sequence
  chemically synthesized
ggaaactgaacaacctcctc

SEQ ID NO: 511480 - DNA, 20 bp, Artificial Sequence
  chemically synthesized
aacctcctcctgaatgacta

SEQ ID NO: 511481 - DNA, 20 bp, Artificial Sequence
  chemically synthesized
agaacaaagacacaacatac

SEQ ID NO: 511482 - DNA, 20 bp, Artificial Sequence
  chemically synthesized
atttccctctacacactgct

SEQ ID NO: 511483 - DNA, 20 bp, Artificial Sequence
  chemically synthesized
gtgatgttagggtgtcaatt

SEQ ID NO: 511484 - DNA, 20 bp, Artificial Sequence
  chemically synthesized
agttcttttaattgtgatgt

SEQ ID NO: 511485 - DNA, 20 bp, Artificial Sequence
  chemically synthesized
ttcttgtcttctgctagctt

SEQ ID NO: 511486 - DNA, 20 bp, Artificial Sequence
  chemically synthesized
ctggattcattaattttttg

SEQ ID NO: 511487 - DNA, 20 bp, Artificial Sequence
  chemically synthesized
aaaaacccttcaaaaaatta

SEQ ID NO: 511488 - DNA, 20 bp, Artificial Sequence
  chemically synthesized
tcctttcaaaaaaccagctc

SEQ ID NO: 511489 - DNA, 20 bp, Artificial Sequence
  chemically synthesized
tccaggagctggttttttga

SEQ ID NO: 511490 - DNA, 20 bp, Artificial Sequence
  chemically synthesized
taataaagaaaaaaagagag

SEQ ID NO: 511491 - DNA, 20 bp, Artificial Sequence
  chemically synthesized
atgcaataaaaaatgataaa

SEQ ID NO: 511492 - DNA, 20 bp, Artificial Sequence
  chemically synthesized
gatggtagtttgtatttctg

SEQ ID NO: 511493 - DNA, 20 bp, Artificial Sequence
  chemically synthesized
agaaatacaaactaccatca

SEQ ID NO: 511494 - DNA, 20 bp, Artificial Sequence
  chemically synthesized
aactagaaaatctagaagaa

SEQ ID NO: 511495 - DNA, 20 bp, Artificial Sequence
  chemically synthesized
ttgggagagtgtatgtgtgc

SEQ ID NO: 511496 - DNA, 20 bp, Artificial Sequence
  chemically synthesized
tcttcctggtttagtcttgg

SEQ ID NO: 511497 - DNA, 20 bp, Artificial Sequence
  chemically synthesized
aagactaaaccaggaagaag

SEQ ID NO: 511498 - DNA, 20 bp, Artificial Sequence
  chemically synthesized
accaggaagaagttgaatct

SEQ ID NO: 511499 - DNA, 20 bp, Artificial Sequence
  chemically synthesized
atctctgaatagaccaataa

SEQ ID NO: 511500 - DNA, 20 bp, Artificial Sequence
  chemically synthesized
tcaatagcttaccaaccaaa

SEQ ID NO: 511501 - DNA, 20 bp, Artificial Sequence
  chemically synthesized
caaaaagagtccaggaccag

SEQ ID NO: 511502 - DNA, 20 bp, Artificial Sequence
  chemically synthesized
aggaccagatggattcacag

SEQ ID NO: 511503 - DNA, 20 bp, Artificial Sequence
  chemically synthesized
acctctggtcgaattcggct

SEQ ID NO: 511504 - DNA, 20 bp, Artificial Sequence
  chemically synthesized
gttcctccttgtacctctgg

SEQ ID NO: 511505 - DNA, 20 bp, Artificial Sequence
  chemically synthesized
ttgattggaatagtttcaga

SEQ ID NO: 511506 - DNA, 20 bp, Artificial Sequence
  chemically synthesized
ttccctctttttctattgat

SEQ ID NO: 511507 - DNA, 20 bp, Artificial Sequence
  chemically synthesized
ttccaatcaatagaaaaaga

SEQ ID NO: 511508 - DNA, 20 bp, Artificial Sequence
  chemically synthesized
gcctcataaaatgagttagg

SEQ ID NO: 511509 - DNA, 20 bp, Artificial Sequence
  chemically synthesized
gatgatgctggcctcataaa

SEQ ID NO: 511510 - DNA, 20 bp, Artificial Sequence
  chemically synthesized
tctctgccaggctttcgtat

SEQ ID NO: 511511 - DNA, 20 bp, Artificial Sequence
  chemically synthesized
gcagagacacaaccaaaaaa

SEQ ID NO: 511512 - DNA, 20 bp, Artificial Sequence
  chemically synthesized
tttttgcatcagtgttcatc

SEQ ID NO: 511513 - DNA, 20 bp, Artificial Sequence
  chemically synthesized
cgttttgccagtattttatt

SEQ ID NO: 511514 - DNA, 20 bp, Artificial Sequence
  chemically synthesized
ctcaataaaatactggcaaa

SEQ ID NO: 511515 - DNA, 20 bp, Artificial Sequence
  chemically synthesized
ataagctttttgatgtgctg

SEQ ID NO: 511516 - DNA, 20 bp, Artificial Sequence
  chemically synthesized
atgaagcccacttgatcatg

SEQ ID NO: 511517 - DNA, 20 bp, Artificial Sequence
  chemically synthesized
gatcaagtgggcttcatccc

SEQ ID NO: 511518 - DNA, 20 bp, Artificial Sequence
  chemically synthesized
ttgaaccagccttgcatccc

SEQ ID NO: 511519 - DNA, 20 bp, Artificial Sequence
  chemically synthesized
tctttggctctgtttatatg

SEQ ID NO: 511520 - DNA, 20 bp, Artificial Sequence
  chemically synthesized
gtttttagcatgaagggttg

SEQ ID NO: 511521 - DNA, 20 bp, Artificial Sequence
  chemically synthesized
tactgagagtttttagcatg

SEQ ID NO: 511522 - DNA, 20 bp, Artificial Sequence
  chemically synthesized
ccgtcaatacctaatttact

SEQ ID NO: 511523 - DNA, 20 bp, Artificial Sequence
  chemically synthesized
cattcagtatgatattggct

SEQ ID NO: 511524 - DNA, 20 bp, Artificial Sequence
  chemically synthesized
aacccacagccaatatcata

SEQ ID NO: 511525 - DNA, 20 bp, Artificial Sequence
  chemically synthesized
gtcttgtgccagttttcaaa

SEQ ID NO: 511526 - DNA, 20 bp, Artificial Sequence
  chemically synthesized
tttgaaaactggcacaagac

SEQ ID NO: 511527 - DNA, 20 bp, Artificial Sequence
  chemically synthesized
cttccaacactatgttgaat

SEQ ID NO: 511528 - DNA, 20 bp, Artificial Sequence
  chemically synthesized
ccagaacttccaacactatg

SEQ ID NO: 511529 - DNA, 20 bp, Artificial Sequence
  chemically synthesized
ttaggcaggagaaggaaata

SEQ ID NO: 511530 - DNA, 20 bp, Artificial Sequence
  chemically synthesized
ttgactttctcttttcctaa

SEQ ID NO: 511531 - DNA, 20 bp, Artificial Sequence
  chemically synthesized
acaatcatgtcatctgcaaa

SEQ ID NO: 511532 - DNA, 20 bp, Artificial Sequence
  chemically synthesized
gagattttaggctgagacag

SEQ ID NO: 511533 - DNA, 20 bp, Artificial Sequence
  chemically synthesized
agggaacttcagcaaagtct

SEQ ID NO: 511534 - DNA, 20 bp, Artificial Sequence
  chemically synthesized
cttgtctgttgttggtgtat

SEQ ID NO: 511535 - DNA, 20 bp, Artificial Sequence
  chemically synthesized
gacaagcagagagccaaatc

SEQ ID NO: 511536 - DNA, 20 bp, Artificial Sequence
  chemically synthesized
tctttgaagcaattgtgaat

SEQ ID NO: 511537 - DNA, 20 bp, Artificial Sequence
  chemically synthesized
ttattctctttgaagcaatt

SEQ ID NO: 511538 - DNA, 20 bp, Artificial Sequence
  chemically synthesized
ccattcacaattgcttcaaa

SEQ ID NO: 511539 - DNA, 20 bp, Artificial Sequence
  chemically synthesized
tcaaagagaataaaatacct

SEQ ID NO: 511540 - DNA, 20 bp, Artificial Sequence
  chemically synthesized
acctaggaatccaacttaca

SEQ ID NO: 511541 - DNA, 20 bp, Artificial Sequence
  chemically synthesized
tccttcacatcccttgtaag

SEQ ID NO: 511542 - DNA, 20 bp, Artificial Sequence
  chemically synthesized
cactgctcaatgaaataaaa

SEQ ID NO: 511543 - DNA, 20 bp, Artificial Sequence
  chemically synthesized
tggaagaacattccatgctc

SEQ ID NO: 511544 - DNA, 20 bp, Artificial Sequence
  chemically synthesized
attcttcctacccatgagca

SEQ ID NO: 511545 - DNA, 20 bp, Artificial Sequence
  chemically synthesized
attccatgctcatgggtagg

SEQ ID NO: 511546 - DNA, 20 bp, Artificial Sequence
  chemically synthesized
gtagcttgatggggatgaca

SEQ ID NO: 511547 - DNA, 20 bp, Artificial Sequence
  chemically synthesized
aaaggcattggtagcttgat

SEQ ID NO: 511548 - DNA, 20 bp, Artificial Sequence
  chemically synthesized
gctaccaatgcctttcttca

SEQ ID NO: 511549 - DNA, 20 bp, Artificial Sequence
  chemically synthesized
cagctttgttcttttggctt

SEQ ID NO: 511550 - DNA, 20 bp, Artificial Sequence
  chemically synthesized
agaaaaacaagcaatgggga

SEQ ID NO: 511551 - DNA, 20 bp, Artificial Sequence
  chemically synthesized
ctagcaccatttattaaata

SEQ ID NO: 511552 - DNA, 20 bp, Artificial Sequence
  chemically synthesized
ccatatgtagaaagctgaaa

SEQ ID NO: 511553 - DNA, 20 bp, Artificial Sequence
  chemically synthesized
ttttgtataaggtgtgagga

SEQ ID NO: 511554 - DNA, 20 bp, Artificial Sequence
  chemically synthesized
tatacaaaaatcaattcaac

SEQ ID NO: 511555 - DNA, 20 bp, Artificial Sequence
  chemically synthesized
gtttaagtttttaatccatg

SEQ ID NO: 511556 - DNA, 20 bp, Artificial Sequence
  chemically synthesized
gtaatgcctaggttttcttc

SEQ ID NO: 511557 - DNA, 20 bp, Artificial Sequence
  chemically synthesized
tccttgcccatgcctatgtc

SEQ ID NO: 511558 - DNA, 20 bp, Artificial Sequence
  chemically synthesized
caaaagccagaactgacaaa

SEQ ID NO: 511559 - DNA, 20 bp, Artificial Sequence
  chemically synthesized
acaacaaaagaaactaccat

SEQ ID NO: 511560 - DNA, 20 bp, Artificial Sequence
  chemically synthesized
ggatattagccctttgtcag

SEQ ID NO: 511561 - DNA, 20 bp, Artificial Sequence
  chemically synthesized
tctgacaaagggctaatatc

SEQ ID NO: 511562 - DNA, 20 bp, Artificial Sequence
  chemically synthesized
gtttgagttcattgtagatt

SEQ ID NO: 511563 - DNA, 20 bp, Artificial Sequence
  chemically synthesized
gttttttcttgtaaatttgt

SEQ ID NO: 511564 - DNA, 20 bp, Artificial Sequence
  chemically synthesized
gtccttcgcccactttttga

SEQ ID NO: 511565 - DNA, 20 bp, Artificial Sequence
  chemically synthesized
ctgcataaatgtcttctttt

SEQ ID NO: 511566 - DNA, 20 bp, Artificial Sequence
  chemically synthesized
agataccatctcacaccagt

SEQ ID NO: 511567 - DNA, 20 bp, Artificial Sequence
  chemically synthesized
aggaaacaacaggtgctgga

SEQ ID NO: 511568 - DNA, 20 bp, Artificial Sequence
  chemically synthesized
agtcagtgtggccattcctc

SEQ ID NO: 511569 - DNA, 20 bp, Artificial Sequence
  chemically synthesized
tttctagttctagatccctg

SEQ ID NO: 511570 - DNA, 20 bp, Artificial Sequence
  chemically synthesized
tatacccagtaacgggatgg

SEQ ID NO: 511571 - DNA, 20 bp, Artificial Sequence
  chemically synthesized
ttgacccagccatcccgtta

SEQ ID NO: 511572 - DNA, 20 bp, Artificial Sequence
  chemically synthesized
tatgggtatatacccagtaa

SEQ ID NO: 511573 - DNA, 20 bp, Artificial Sequence
  chemically synthesized
gcagcatgatttatagtcct

SEQ ID NO: 511574 - DNA, 20 bp, Artificial Sequence
  chemically synthesized
ggttccaagtctttgctatc

SEQ ID NO: 511575 - DNA, 20 bp, Artificial Sequence
  chemically synthesized
actctatcattgttggacat

SEQ ID NO: 511576 - DNA, 20 bp, Artificial Sequence
  chemically synthesized
acccaaatgtccaacaatga

SEQ ID NO: 511577 - DNA, 20 bp, Artificial Sequence
  chemically synthesized
aaatgtccaacaatgataga

SEQ ID NO: 511578 - DNA, 20 bp, Artificial Sequence
  chemically synthesized
aatgtggcacatatacacca

SEQ ID NO: 511579 - DNA, 20 bp, Artificial Sequence
  chemically synthesized
ctatgcggccataaaaaatg

SEQ ID NO: 511580 - DNA, 20 bp, Artificial Sequence
  chemically synthesized
ttcatgtcctttgtagggac

SEQ ID NO: 511581 - DNA, 20 bp, Artificial Sequence
  chemically synthesized
tgttcttgcgatagtttact

SEQ ID NO: 511582 - DNA, 20 bp, Artificial Sequence
  chemically synthesized
ttcaattcccacctatgagt

SEQ ID NO: 511583 - DNA, 20 bp, Artificial Sequence
  chemically synthesized
acatattctcactcataggt

SEQ ID NO: 511584 - DNA, 20 bp, Artificial Sequence
  chemically synthesized
tcattgttcaattcccacct

SEQ ID NO: 511585 - DNA, 20 bp, Artificial Sequence
  chemically synthesized
ccccaccccaccacagtccc

SEQ ID NO: 511586 - DNA, 20 bp, Artificial Sequence
  chemically synthesized
ccacactctggggactgtgg

SEQ ID NO: 511587 - DNA, 20 bp, Artificial Sequence
  chemically synthesized
actgtggtggggtgggggga

SEQ ID NO: 511588 - DNA, 20 bp, Artificial Sequence
  chemically synthesized
gtggggtggggggagggggt

SEQ ID NO: 511589 - DNA, 20 bp, Artificial Sequence
  chemically synthesized
gatttatctaatgctagatg

SEQ ID NO: 511590 - DNA, 20 bp, Artificial Sequence
  chemically synthesized
taatgctagatgacgagtta

SEQ ID NO: 511591 - DNA, 20 bp, Artificial Sequence
  chemically synthesized
tattattatactttaagctt

SEQ ID NO: 511592 - DNA, 20 bp, Artificial Sequence
  chemically synthesized
tttttatatataatgaatat

SEQ ID NO: 511593 - DNA, 20 bp, Artificial Sequence
  chemically synthesized
aaagaaattttttatatata

SEQ ID NO: 511594 - DNA, 20 bp, Artificial Sequence
  chemically synthesized
taaaatatcatgctcataaa

SEQ ID NO: 511595 - DNA, 20 bp, Artificial Sequence
  chemically synthesized
gcaccaggtggccatttggg

SEQ ID NO: 511596 - DNA, 20 bp, Artificial Sequence
  chemically synthesized
ggtgcttcaagacgtgaagt

SEQ ID NO: 511597 - DNA, 20 bp, Artificial Sequence
  chemically synthesized
gtgtgaatacatgtttcact

SEQ ID NO: 511598 - DNA, 20 bp, Artificial Sequence
  chemically synthesized
ggtaaaatggagtttgaaat

SEQ ID NO: 511599 - DNA, 20 bp, Artificial Sequence
  chemically synthesized
actttgtgttcaaggtaaaa

SEQ ID NO: 511600 - DNA, 20 bp, Artificial Sequence
  chemically synthesized
acagccagtctgtcttgctc

SEQ ID NO: 511601 - DNA, 20 bp, Artificial Sequence
  chemically synthesized
tgtggagtctttttttttaa

SEQ ID NO: 511602 - DNA, 20 bp, Artificial Sequence
  chemically synthesized
agtttagttttcaagacttg

SEQ ID NO: 511603 - DNA, 20 bp, Artificial Sequence
  chemically synthesized
aactatattagcatgtagtt

SEQ ID NO: 511604 - DNA, 20 bp, Artificial Sequence
  chemically synthesized
atcattcagttttatctaat

SEQ ID NO: 511605 - DNA, 20 bp, Artificial Sequence
  chemically synthesized
tgcattcccattagataaaa

SEQ ID NO: 511606 - DNA, 20 bp, Artificial Sequence
  chemically synthesized
atgcgttacatcaatagtac

SEQ ID NO: 511607 - DNA, 20 bp, Artificial Sequence
  chemically synthesized
gttacatcaatagtacatga

SEQ ID NO: 511608 - DNA, 20 bp, Artificial Sequence
  chemically synthesized
atttgttggataatgagttt

SEQ ID NO: 511609 - DNA, 20 bp, Artificial Sequence
  chemically synthesized
aaaaataaatttgttggata

SEQ ID NO: 511610 - DNA, 20 bp, Artificial Sequence
  chemically synthesized
tgagggcaaaaataaatttg

SEQ ID NO: 511611 - DNA, 20 bp, Artificial Sequence
  chemically synthesized
gaaatctgatttgatataac

SEQ ID NO: 511612 - DNA, 20 bp, Artificial Sequence
  chemically synthesized
aactctatatgaagccgttt

SEQ ID NO: 511613 - DNA, 20 bp, Artificial Sequence
  chemically synthesized
gattcaaaaacggcttcata

SEQ ID NO: 511614 - DNA, 20 bp, Artificial Sequence
  chemically synthesized
tagagttgataccatataaa

SEQ ID NO: 511615 - DNA, 20 bp, Artificial Sequence
  chemically synthesized
gtgaaatatgggcaaaactg

SEQ ID NO: 511616 - DNA, 20 bp, Artificial Sequence
  chemically synthesized
ctgattaagccaaaatcaca

SEQ ID NO: 511617 - DNA, 20 bp, Artificial Sequence
  chemically synthesized
gtgcctacgcaaccacatta

SEQ ID NO: 511618 - DNA, 20 bp, Artificial Sequence
  chemically synthesized
taatgtggttgcgtaggcac

SEQ ID NO: 511619 - DNA, 20 bp, Artificial Sequence
  chemically synthesized
gcgtaggcacaggaataaaa

SEQ ID NO: 511620 - DNA, 20 bp, Artificial Sequence
  chemically synthesized
gaataaaactgagtttggtt

SEQ ID NO: 511621 - DNA, 20 bp, Artificial Sequence
  chemically synthesized
gatgatggactttacctaag

SEQ ID NO: 511622 - DNA, 20 bp, Artificial Sequence
  chemically synthesized
agatttttttttctttataa

SEQ ID NO: 511623 - DNA, 20 bp, Artificial Sequence
  chemically synthesized
ccagtgtcttaatgttattt

SEQ ID NO: 511624 - DNA, 20 bp, Artificial Sequence
  chemically synthesized
actgggcttcgacatcagtc

SEQ ID NO: 511625 - DNA, 20 bp, Artificial Sequence
  chemically synthesized
gaagtagagattggatttga

SEQ ID NO: 511626 - DNA, 20 bp, Artificial Sequence
  chemically synthesized
ataggaagtagagattggat

SEQ ID NO: 511627 - DNA, 20 bp, Artificial Sequence
  chemically synthesized
taactaataggaagtagaga

SEQ ID NO: 511628 - DNA, 20 bp, Artificial Sequence
  chemically synthesized
ctattagttatctgtataat

SEQ ID NO: 511629 - DNA, 20 bp, Artificial Sequence
  chemically synthesized
gcaaactgttgaggagagaa

SEQ ID NO: 511630 - DNA, 20 bp, Artificial Sequence
  chemically synthesized
tatgtgccagctactttacc

SEQ ID NO: 511631 - DNA, 20 bp, Artificial Sequence
  chemically synthesized
aatgtagattttaaagttaa

SEQ ID NO: 511632 - DNA, 20 bp, Artificial Sequence
  chemically synthesized
tctccaattctgttctgcag

SEQ ID NO: 511633 - DNA, 20 bp, Artificial Sequence
  chemically synthesized
cttgtcacccgtctgcagaa

SEQ ID NO: 511634 - DNA, 20 bp, Artificial Sequence
  chemically synthesized
aactctttccttgtgttatt

SEQ ID NO: 511635 - DNA, 20 bp, Artificial Sequence
  chemically synthesized
catccataataacacaagga

SEQ ID NO: 511636 - DNA, 20 bp, Artificial Sequence
  chemically synthesized
aggtatacgatatagatgat

SEQ ID NO: 511637 - DNA, 20 bp, Artificial Sequence
  chemically synthesized
gatatggatatacttataga

SEQ ID NO: 511638 - DNA, 20 bp, Artificial Sequence
  chemically synthesized
gctgtcccaaattcatagaa

SEQ ID NO: 511639 - DNA, 20 bp, Artificial Sequence
  chemically synthesized
cttttgaaagattcatttct

SEQ ID NO: 511640 - DNA, 20 bp, Artificial Sequence
  chemically synthesized
tattctaattgaatttcaga

SEQ ID NO: 511641 - DNA, 20 bp, Artificial Sequence
  chemically synthesized
attatattctaattgaattt

SEQ ID NO: 511642 - DNA, 20 bp, Artificial Sequence
  chemically synthesized
aattcactctgaaattcaat

SEQ ID NO: 511643 - DNA, 20 bp, Artificial Sequence
  chemically synthesized
agtcactaattatattctaa

SEQ ID NO: 511644 - DNA, 20 bp, Artificial Sequence
  chemically synthesized
gaatataattagtgactgtt

SEQ ID NO: 511645 - DNA, 20 bp, Artificial Sequence
  chemically synthesized
tgttgagaatacagttttga

SEQ ID NO: 511646 - DNA, 20 bp, Artificial Sequence
  chemically synthesized
gaggcagaagacagctttta

SEQ ID NO: 511647 - DNA, 20 bp, Artificial Sequence
  chemically synthesized
tttaagggattaaggagaaa

SEQ ID NO: 511648 - DNA, 20 bp, Artificial Sequence
  chemically synthesized
aaaatgtaacttcaggcata

SEQ ID NO: 511649 - DNA, 20 bp, Artificial Sequence
  chemically synthesized
tcaggcatagagaataactt

SEQ ID NO: 511650 - DNA, 20 bp, Artificial Sequence
  chemically synthesized
aggactgttacaagaattaa

SEQ ID NO: 511651 - DNA, 20 bp, Artificial Sequence
  chemically synthesized
tcataccataggactgttac

SEQ ID NO: 511652 - DNA, 20 bp, Artificial Sequence
  chemically synthesized
tcttgtaacagtcctatggt

SEQ ID NO: 511653 - DNA, 20 bp, Artificial Sequence
  chemically synthesized
ctcatctagaaaatgaaagt

SEQ ID NO: 511654 - DNA, 20 bp, Artificial Sequence
  chemically synthesized
tctagatgaggaaaaggctc

SEQ ID NO: 511655 - DNA, 20 bp, Artificial Sequence
  chemically synthesized
aggttctggagctggactgc

SEQ ID NO: 511656 - DNA, 20 bp, Artificial Sequence
  chemically synthesized
gttcacatggcttctgagac

SEQ ID NO: 511657 - DNA, 20 bp, Artificial Sequence
  chemically synthesized
tattcctgattttgccacat

SEQ ID NO: 511658 - DNA, 20 bp, Artificial Sequence
  chemically synthesized
taccctaatgtggcaaaatc

SEQ ID NO: 511659 - DNA, 20 bp, Artificial Sequence
  chemically synthesized
taagtgttttagtattcatt

SEQ ID NO: 511660 - DNA, 20 bp, Artificial Sequence
  chemically synthesized
ctcatagaaatttacccaaa

SEQ ID NO: 511661 - DNA, 20 bp, Artificial Sequence
  chemically synthesized
ttcattttgggtaaatttct

SEQ ID NO: 511662 - DNA, 20 bp, Artificial Sequence
  chemically synthesized
gtataggcaatacttctagt

SEQ ID NO: 511663 - DNA, 20 bp, Artificial Sequence
  chemically synthesized
tattatttcttttcctctgg

SEQ ID NO: 511664 - DNA, 20 bp, Artificial Sequence
  chemically synthesized
tgttgaagtgttttccattg

SEQ ID NO: 511665 - DNA, 20 bp, Artificial Sequence
  chemically synthesized
atagtgtggttctcagacat

SEQ ID NO: 511666 - DNA, 20 bp, Artificial Sequence
  chemically synthesized
catcagaatcaacagcaact

SEQ ID NO: 511667 - DNA, 20 bp, Artificial Sequence
  chemically synthesized
ctggctgtactctagaccta

SEQ ID NO: 511668 - DNA, 20 bp, Artificial Sequence
  chemically synthesized
agtttctcatcctgtaggtc

SEQ ID NO: 511669 - DNA, 20 bp, Artificial Sequence
  chemically synthesized
cctacaggatgagaaactca

SEQ ID NO: 511670 - DNA, 20 bp, Artificial Sequence
  chemically synthesized
caggatgagaaactcagggg

SEQ ID NO: 511671 - DNA, 20 bp, Artificial Sequence
  chemically synthesized
ggagtgttgggatccacccc

SEQ ID NO: 511672 - DNA, 20 bp, Artificial Sequence
  chemically synthesized
tttgttaaaacagggagtgt

SEQ ID NO: 511673 - DNA, 20 bp, Artificial Sequence
  chemically synthesized
cctagaggtttgttaaaaca

SEQ ID NO: 511674 - DNA, 20 bp, Artificial Sequence
  chemically synthesized
tctcaaacttgaacatgcat

SEQ ID NO: 511675 - DNA, 20 bp, Artificial Sequence
  chemically synthesized
gtttgagaacccttgtttta

SEQ ID NO: 511676 - DNA, 20 bp, Artificial Sequence
  chemically synthesized
gcaaccacatcccttaaaac

SEQ ID NO: 511677 - DNA, 20 bp, Artificial Sequence
  chemically synthesized
aataaaagaatggaactttg

SEQ ID NO: 511678 - DNA, 20 bp, Artificial Sequence
  chemically synthesized
ctatcaggagcctggaataa

SEQ ID NO: 511679 - DNA, 20 bp, Artificial Sequence
  chemically synthesized
aaaagatactatcaggagcc

SEQ ID NO: 511680 - DNA, 20 bp, Artificial Sequence
  chemically synthesized
catatcaaagtacaagtagg

SEQ ID NO: 511681 - DNA, 20 bp, Artificial Sequence
  chemically synthesized
catttccaagcagaagcttt

SEQ ID NO: 511682 - DNA, 20 bp, Artificial Sequence
  chemically synthesized
tgaaggacctgggctgagag

SEQ ID NO: 511683 - DNA, 20 bp, Artificial Sequence
  chemically synthesized
tctcagcccaggtccttcag

SEQ ID NO: 511684 - DNA, 20 bp, Artificial Sequence
  chemically synthesized
aggtccttcagctgagtaca

SEQ ID NO: 511685 - DNA, 20 bp, Artificial Sequence
  chemically synthesized
gggaagaaaattctattctt

SEQ ID NO: 511686 - DNA, 20 bp, Artificial Sequence
  chemically synthesized
atctcagcgactcaaaagaa

SEQ ID NO: 511687 - DNA, 20 bp, Artificial Sequence
  chemically synthesized
ctgatatctcagcgactcaa

SEQ ID NO: 511688 - DNA, 20 bp, Artificial Sequence
  chemically synthesized
cttttgagtcgctgagatat

SEQ ID NO: 511689 - DNA, 20 bp, Artificial Sequence
  chemically synthesized
acactacattatgcatctat

SEQ ID NO: 511690 - DNA, 20 bp, Artificial Sequence
  chemically synthesized
gtaccatggcccctataaat

SEQ ID NO: 511691 - DNA, 20 bp, Artificial Sequence
  chemically synthesized
taggggccatggtacagaga

SEQ ID NO: 511692 - DNA, 20 bp, Artificial Sequence
  chemically synthesized
tctatggaagaggaaaacat

SEQ ID NO: 511693 - DNA, 20 bp, Artificial Sequence
  chemically synthesized
cactattaaacctcagaaaa

SEQ ID NO: 511694 - DNA, 20 bp, Artificial Sequence
  chemically synthesized
caatatttatctttcggtgt

SEQ ID NO: 511695 - DNA, 20 bp, Artificial Sequence
  chemically synthesized
tttcggtgtaagaattttac

SEQ ID NO: 511696 - DNA, 20 bp, Artificial Sequence
  chemically synthesized
tatataatcataaaatagaa

SEQ ID NO: 511697 - DNA, 20 bp, Artificial Sequence
  chemically synthesized
tttatgacacaaaattggcc

SEQ ID NO: 511698 - DNA, 20 bp, Artificial Sequence
  chemically synthesized
tctaattaagaaagtcttcc

SEQ ID NO: 511699 - DNA, 20 bp, Artificial Sequence
  chemically synthesized
tttcttaattagaccatttt

SEQ ID NO: 511700 - DNA, 20 bp, Artificial Sequence
  chemically synthesized
cttaaaacagtgtcctacac

SEQ ID NO: 511701 - DNA, 20 bp, Artificial Sequence
  chemically synthesized
tgatctttctcatagacttg

SEQ ID NO: 511702 - DNA, 20 bp, Artificial Sequence
  chemically synthesized
tgagaattcaatgccaacct

SEQ ID NO: 511703 - DNA, 20 bp, Artificial Sequence
  chemically synthesized
ttgttatcccaaggttggca

SEQ ID NO: 511704 - DNA, 20 bp, Artificial Sequence
  chemically synthesized
ggcatgttatgtaaacactt

SEQ ID NO: 511705 - DNA, 20 bp, Artificial Sequence
  chemically synthesized
cagtaagtaaatatatactc

SEQ ID NO: 511706 - DNA, 20 bp, Artificial Sequence
  chemically synthesized
aaataacttgatttgaatcc

SEQ ID NO: 511707 - DNA, 20 bp, Artificial Sequence
  chemically synthesized
agagtcataaataacttgat

SEQ ID NO: 511708 - DNA, 20 bp, Artificial Sequence
  chemically synthesized
aatgaaaagaacttaagttt

SEQ ID NO: 511709 - DNA, 20 bp, Artificial Sequence
  chemically synthesized
gctgttgtatgaagatttat

SEQ ID NO: 511710 - DNA, 20 bp, Artificial Sequence
  chemically synthesized
acacacacaccttcctatat

SEQ ID NO: 511711 - DNA, 20 bp, Artificial Sequence
  chemically synthesized
gcctccttctcggcacatac

SEQ ID NO: 511712 - DNA, 20 bp, Artificial Sequence
  chemically synthesized
tgctcaatgtcatagtgtaa

SEQ ID NO: 511713 - DNA, 20 bp, Artificial Sequence
  chemically synthesized
gactggacatagctaatcac

SEQ ID NO: 511714 - DNA, 20 bp, Artificial Sequence
  chemically synthesized
tacaataaagcgatgtgata

SEQ ID NO: 511715 - DNA, 20 bp, Artificial Sequence
  chemically synthesized
tcagcgctgttgccctctca

SEQ ID NO: 511716 - DNA, 20 bp, Artificial Sequence
  chemically synthesized
caaaagttttcatgagatta

SEQ ID NO: 511717 - DNA, 20 bp, Artificial Sequence
  chemically synthesized
ctttgtcactcactgtcagt

SEQ ID NO: 511718 - DNA, 20 bp, Artificial Sequence
  chemically synthesized
gtttcgaatcctaactgaca

SEQ ID NO: 511719 - DNA, 20 bp, Artificial Sequence
  chemically synthesized
gagaaaagctttagtatgtt

SEQ ID NO: 511720 - DNA, 20 bp, Artificial Sequence
  chemically synthesized
aagtctggctcctaaagttt

SEQ ID NO: 511721 - DNA, 20 bp, Artificial Sequence
  chemically synthesized
ttgtcgttaaggtgatatcc

SEQ ID NO: 511722 - DNA, 20 bp, Artificial Sequence
  chemically synthesized
gttgatcgtcttatggactc

SEQ ID NO: 511723 - DNA, 20 bp, Artificial Sequence
  chemically synthesized
tcaacaaccttatctgtctg

SEQ ID NO: 511724 - DNA, 20 bp, Artificial Sequence
  chemically synthesized
tgtctgctggattgtacaaa

SEQ ID NO: 511725 - DNA, 20 bp, Artificial Sequence
  chemically synthesized
aattaatagctgccttaaga

SEQ ID NO: 511726 - DNA, 20 bp, Artificial Sequence
  chemically synthesized
ttaagatagagtttggctga

SEQ ID NO: 511727 - DNA, 20 bp, Artificial Sequence
  chemically synthesized
aatggacttcagagaagtcc

SEQ ID NO: 511728 - DNA, 20 bp, Artificial Sequence
  chemically synthesized
gcacatttgtacaaacacaa

SEQ ID NO: 511729 - DNA, 20 bp, Artificial Sequence
  chemically synthesized
gtttgtacaaatgtgcatga

SEQ ID NO: 511730 - DNA, 20 bp, Artificial Sequence
  chemically synthesized
atatttggttgcatagtcct

SEQ ID NO: 511731 - DNA, 20 bp, Artificial Sequence
  chemically synthesized
ctgtgaatatactaaaaaca

SEQ ID NO: 511732 - DNA, 20 bp, Artificial Sequence
  chemically synthesized
gcaccaacttaatatatttt

SEQ ID NO: 511733 - DNA, 20 bp, Artificial Sequence
  chemically synthesized
tcattagttgggattgagtc

SEQ ID NO: 511734 - DNA, 20 bp, Artificial Sequence
  chemically synthesized
gaacaggtcattagttggga

SEQ ID NO: 511735 - DNA, 20 bp, Artificial Sequence
  chemically synthesized
gcactgaacaggtcattagt

SEQ ID NO: 511736 - DNA, 20 bp, Artificial Sequence
  chemically synthesized
gttatctgttaccaaaggga

SEQ ID NO: 511737 - DNA, 20 bp, Artificial Sequence
  chemically synthesized
gtgtgttatctgttaccaaa

SEQ ID NO: 511738 - DNA, 20 bp, Artificial Sequence
  chemically synthesized
agaagatgcagtgacaatat

SEQ ID NO: 511739 - DNA, 20 bp, Artificial Sequence
  chemically synthesized
gttggattgtgtcattactg

SEQ ID NO: 511740 - DNA, 20 bp, Artificial Sequence
  chemically synthesized
aaaaataaaagacatattag

SEQ ID NO: 511741 - DNA, 20 bp, Artificial Sequence
  chemically synthesized
gtcttttatttttaggagga

SEQ ID NO: 511742 - DNA, 20 bp, Artificial Sequence
  chemically synthesized
acattggctttattttagaa

SEQ ID NO: 511743 - DNA, 20 bp, Artificial Sequence
  chemically synthesized
ttcacatcccagtgggcacg

SEQ ID NO: 511744 - DNA, 20 bp, Artificial Sequence
  chemically synthesized
taaatattcttcgtgcccac

SEQ ID NO: 511745 - DNA, 20 bp, Artificial Sequence
  chemically synthesized
ttcttcgtgcccactgggat

SEQ ID NO: 511746 - DNA, 20 bp, Artificial Sequence
  chemically synthesized
cactgggatgtgaatgccaa

SEQ ID NO: 511747 - DNA, 20 bp, Artificial Sequence
  chemically synthesized
aaaatacatcagagaagcct

SEQ ID NO: 511748 - DNA, 20 bp, Artificial Sequence
  chemically synthesized
tgtctgattccttgttctca

SEQ ID NO: 511749 - DNA, 20 bp, Artificial Sequence
  chemically synthesized
ctaaggattccatgagaaca

SEQ ID NO: 511750 - DNA, 20 bp, Artificial Sequence
  chemically synthesized
aatattttcacttccaccag

SEQ ID NO: 511751 - DNA, 20 bp, Artificial Sequence
  chemically synthesized
aatgcgaggtagagaagacc

SEQ ID NO: 511752 - DNA, 20 bp, Artificial Sequence
  chemically synthesized
cgaagcatgaaatattcaga

SEQ ID NO: 511753 - DNA, 20 bp, Artificial Sequence
  chemically synthesized
tgggtgtctgtgtatccctt

SEQ ID NO: 511754 - DNA, 20 bp, Artificial Sequence
  chemically synthesized
ttgtccagatgagctttagc

SEQ ID NO: 511755 - DNA, 20 bp, Artificial Sequence
  chemically synthesized
aagctcatctggacaatcac

SEQ ID NO: 511756 - DNA, 20 bp, Artificial Sequence
  chemically synthesized
acaatcacaagggtttagag

SEQ ID NO: 511757 - DNA, 20 bp, Artificial Sequence
  chemically synthesized
gaggagagtaaatgggacaa

SEQ ID NO: 511758 - DNA, 20 bp, Artificial Sequence
  chemically synthesized
gtaaatgggacaaaagaatc

SEQ ID NO: 511759 - DNA, 20 bp, Artificial Sequence
  chemically synthesized
taaggaaaaaggctggggcc

SEQ ID NO: 511760 - DNA, 20 bp, Artificial Sequence
  chemically synthesized
ctcttctgtaaaattgttac

SEQ ID NO: 511761 - DNA, 20 bp, Artificial Sequence
  chemically synthesized
ctacatcgtaggattgcagt

SEQ ID NO: 511762 - DNA, 20 bp, Artificial Sequence
  chemically synthesized
tcataatagtatctacatcg

SEQ ID NO: 511763 - DNA, 20 bp, Artificial Sequence
  chemically synthesized
cgtttcttcatctgtaaaat

SEQ ID NO: 511764 - DNA, 20 bp, Artificial Sequence
  chemically synthesized
tgaagaaacgaaggccaaga

SEQ ID NO: 511765 - DNA, 20 bp, Artificial Sequence
  chemically synthesized
cagcaccagcctaatggggt

SEQ ID NO: 511766 - DNA, 20 bp, Artificial Sequence
  chemically synthesized
tatcatcagcaccagcctaa

SEQ ID NO: 511767 - DNA, 20 bp, Artificial Sequence
  chemically synthesized
gaaggactcagaggaagaga

SEQ ID NO: 511768 - DNA, 20 bp, Artificial Sequence
  chemically synthesized
atgataccctgtctcttcct

SEQ ID NO: 511769 - DNA, 20 bp, Artificial Sequence
  chemically synthesized
tcctgcatctctttgcctac

SEQ ID NO: 511770 - DNA, 20 bp, Artificial Sequence
  chemically synthesized
cctactggagtctgttcttc

SEQ ID NO: 511771 - DNA, 20 bp, Artificial Sequence
  chemically synthesized
gcaatagatcaaaaatgcta

SEQ ID NO: 511772 - DNA, 20 bp, Artificial Sequence
  chemically synthesized
tagatcaaaaatgctaggga

SEQ ID NO: 511773 - DNA, 20 bp, Artificial Sequence
  chemically synthesized
agtgaatgcacagcccctcc

SEQ ID NO: 511774 - DNA, 20 bp, Artificial Sequence
  chemically synthesized
tctgccaacagatgaccagc

SEQ ID NO: 511775 - DNA, 20 bp, Artificial Sequence
  chemically synthesized
gacttatcctttgaagagat

SEQ ID NO: 511776 - DNA, 20 bp, Artificial Sequence
  chemically synthesized
ttagcattctcatctcttca

SEQ ID NO: 511777 - DNA, 20 bp, Artificial Sequence
  chemically synthesized
gtcaatgaagactacatttc

SEQ ID NO: 511778 - DNA, 20 bp, Artificial Sequence
  chemically synthesized
gggatgagatgctagggaat

SEQ ID NO: 511779 - DNA, 20 bp, Artificial Sequence
  chemically synthesized
ttatttgggatgagatgcta

SEQ ID NO: 511780 - DNA, 20 bp, Artificial Sequence
  chemically synthesized
cttcccccttctagtttatt

SEQ ID NO: 511781 - DNA, 20 bp, Artificial Sequence
  chemically synthesized
taccctgtctttatgatttt

SEQ ID NO: 511782 - DNA, 20 bp, Artificial Sequence
  chemically synthesized
tattctgaaaatcataaaga

SEQ ID NO: 511783 - DNA, 20 bp, Artificial Sequence
  chemically synthesized
taaccagaaagagtacaaat

SEQ ID NO: 511784 - DNA, 20 bp, Artificial Sequence
  chemically synthesized
ttatttgtactctttctggt

SEQ ID NO: 511785 - DNA, 20 bp, Artificial Sequence
  chemically synthesized
tggttagaatcctaaccaga

SEQ ID NO: 511786 - DNA, 20 bp, Artificial Sequence
  chemically synthesized
ttctggttaggattctaacc

SEQ ID NO: 511787 - DNA, 20 bp, Artificial Sequence
  chemically synthesized
aacattctaacactcatggt

SEQ ID NO: 511788 - DNA, 20 bp, Artificial Sequence
  chemically synthesized
aggattctaaccatgagtgt

SEQ ID NO: 511789 - DNA, 20 bp, Artificial Sequence
  chemically synthesized
aattattggaaactgtaact

SEQ ID NO: 511790 - DNA, 20 bp, Artificial Sequence
  chemically synthesized
gttacagtttccaataattt

SEQ ID NO: 511791 - DNA, 20 bp, Artificial Sequence
  chemically synthesized
aagtgaccgtggaaggaaag

SEQ ID NO: 511792 - DNA, 20 bp, Artificial Sequence
  chemically synthesized
aagcagagtttttaactctg

SEQ ID NO: 511793 - DNA, 20 bp, Artificial Sequence
  chemically synthesized
cacccactgaacacattcca

SEQ ID NO: 511794 - DNA, 20 bp, Artificial Sequence
  chemically synthesized
aactctgtggaatgtgttca

SEQ ID NO: 511795 - DNA, 20 bp, Artificial Sequence
  chemically synthesized
tggaatgtgttcagtgggtg

SEQ ID NO: 511796 - DNA, 20 bp, Artificial Sequence
  chemically synthesized
cccttatcttgggggaacca

SEQ ID NO: 511797 - DNA, 20 bp, Artificial Sequence
  chemically synthesized
tttatttagttgtataagta

SEQ ID NO: 511798 - DNA, 20 bp, Artificial Sequence
  chemically synthesized
tacaactaaataaaatagta

SEQ ID NO: 511799 - DNA, 20 bp, Artificial Sequence
  chemically synthesized
aaataaaatagtattgagtg

SEQ ID NO: 511800 - DNA, 20 bp, Artificial Sequence
  chemically synthesized
aaactatgctaggcacaggg

SEQ ID NO: 511801 - DNA, 20 bp, Artificial Sequence
  chemically synthesized
attttgtgtgtttatgagga

SEQ ID NO: 511802 - DNA, 20 bp, Artificial Sequence
  chemically synthesized
tgtcctcataaacacacaaa

SEQ ID NO: 511803 - DNA, 20 bp, Artificial Sequence
  chemically synthesized
tggtgagagagggtttaaag

SEQ ID NO: 511804 - DNA, 20 bp, Artificial Sequence
  chemically synthesized
gtgcttactagctggtgaga

SEQ ID NO: 511805 - DNA, 20 bp, Artificial Sequence
  chemically synthesized
tagagggtaactgaaaagcc

SEQ ID NO: 511806 - DNA, 20 bp, Artificial Sequence
  chemically synthesized
tcagaaatagcttgtaagta

SEQ ID NO: 511807 - DNA, 20 bp, Artificial Sequence
  chemically synthesized
cctctacttacaagctattt

SEQ ID NO: 511808 - DNA, 20 bp, Artificial Sequence
  chemically synthesized
ttctgcaaccatcttctagg

SEQ ID NO: 511809 - DNA, 20 bp, Artificial Sequence
  chemically synthesized
gcaaaaaaaaaaaaaattgt

SEQ ID NO: 511810 - DNA, 20 bp, Artificial Sequence
  chemically synthesized
attcaaaagagcaactttgg

SEQ ID NO: 511811 - DNA, 20 bp, Artificial Sequence
  chemically synthesized
attcctccaaagttgctctt

SEQ ID NO: 511812 - DNA, 20 bp, Artificial Sequence
  chemically synthesized
ctgaaaacattaagtaagat

SEQ ID NO: 511813 - DNA, 20 bp, Artificial Sequence
  chemically synthesized
atcttacttaatgttttcag

SEQ ID NO: 511814 - DNA, 20 bp, Artificial Sequence
  chemically synthesized
gtgggagggttgatcatgag

SEQ ID NO: 511815 - DNA, 20 bp, Artificial Sequence
  chemically synthesized
aggttgtggcagagaggtgg

SEQ ID NO: 511816 - DNA, 20 bp, Artificial Sequence
  chemically synthesized
tttaacagttgaaaccatga

SEQ ID NO: 511817 - DNA, 20 bp, Artificial Sequence
  chemically synthesized
tctactaggccaccatgtat

SEQ ID NO: 511818 - DNA, 20 bp, Artificial Sequence
  chemically synthesized
ggagggagggagtaaagaag

SEQ ID NO: 511819 - DNA, 20 bp, Artificial Sequence
  chemically synthesized
aataacgaggtttggaggga

SEQ ID NO: 511820 - DNA, 20 bp, Artificial Sequence
  chemically synthesized
gatagggaggtgaagtatgc

SEQ ID NO: 511821 - DNA, 20 bp, Artificial Sequence
  chemically synthesized
taaggaatgactagatatga

SEQ ID NO: 511822 - DNA, 20 bp, Artificial Sequence
  chemically synthesized
agattcattgatgggactta

SEQ ID NO: 511823 - DNA, 20 bp, Artificial Sequence
  chemically synthesized
tcattccttaagtcccatca

SEQ ID NO: 511824 - DNA, 20 bp, Artificial Sequence
  chemically synthesized
agcagatgaagaggattgat

SEQ ID NO: 511825 - DNA, 20 bp, Artificial Sequence
  chemically synthesized
gtattgacaaagcagatgaa

SEQ ID NO: 511826 - DNA, 20 bp, Artificial Sequence
  chemically synthesized
ctttgtcaatactctaggtt

SEQ ID NO: 511827 - DNA, 20 bp, Artificial Sequence
  chemically synthesized
aagtgtttatatcctgaacc

SEQ ID NO: 511828 - DNA, 20 bp, Artificial Sequence
  chemically synthesized
attttagaagagattaccat

SEQ ID NO: 511829 - DNA, 20 bp, Artificial Sequence
  chemically synthesized
ttatcttcagggcagtgatg

SEQ ID NO: 511830 - DNA, 20 bp, Artificial Sequence
  chemically synthesized
agggcagtgatgcggggtgg

SEQ ID NO: 511831 - DNA, 20 bp, Artificial Sequence
  chemically synthesized
atttgactcataatcacatg

SEQ ID NO: 511832 - DNA, 20 bp, Artificial Sequence
  chemically synthesized
actgtattctacatgtgatt

SEQ ID NO: 511833 - DNA, 20 bp, Artificial Sequence
  chemically synthesized
gatacctacacaacaactgt

SEQ ID NO: 511834 - DNA, 20 bp, Artificial Sequence
  chemically synthesized
tacacaacaactgtaaggat

SEQ ID NO: 511835 - DNA, 20 bp, Artificial Sequence
  chemically synthesized
attttgaaacaaacttagca

SEQ ID NO: 511836 - DNA, 20 bp, Artificial Sequence
  chemically synthesized
ttgtttcaaaatggacttaa

SEQ ID NO: 511837 - DNA, 20 bp, Artificial Sequence
  chemically synthesized
aggaaatgtttgttcagccc

SEQ ID NO: 511838 - DNA, 20 bp, Artificial Sequence
  chemically synthesized
aatgtttgttcagcccatga

SEQ ID NO: 511839 - DNA, 20 bp, Artificial Sequence
  chemically synthesized
tatagagcatttgtatgggg

SEQ ID NO: 511840 - DNA, 20 bp, Artificial Sequence
  chemically synthesized
gttttatagagcatttgtat

SEQ ID NO: 511841 - DNA, 20 bp, Artificial Sequence
  chemically synthesized
tacagaacaagatcagaaac

SEQ ID NO: 511842 - DNA, 20 bp, Artificial Sequence
  chemically synthesized
atagggatttcctgagttct

SEQ ID NO: 511843 - DNA, 20 bp, Artificial Sequence
  chemically synthesized
aaggaggctatagggatttc

SEQ ID NO: 511844 - DNA, 20 bp, Artificial Sequence
  chemically synthesized
atggaagctaaggaggctat

SEQ ID NO: 511845 - DNA, 20 bp, Artificial Sequence
  chemically synthesized
gcaaaggtaaaaataattgt

SEQ ID NO: 511846 - DNA, 20 bp, Artificial Sequence
  chemically synthesized
aggaatgatggtttcacaga

SEQ ID NO: 511847 - DNA, 20 bp, Artificial Sequence
  chemically synthesized
tcctatggtgagacactgta

SEQ ID NO: 511848 - DNA, 20 bp, Artificial Sequence
  chemically synthesized
ccaagaattcattgcattga

SEQ ID NO: 511849 - DNA, 20 bp, Artificial Sequence
  chemically synthesized
tcaaacactccttcaatgca

SEQ ID NO: 511850 - DNA, 20 bp, Artificial Sequence
  chemically synthesized
cacatttgtggcttgtagcc

SEQ ID NO: 511851 - DNA, 20 bp, Artificial Sequence
  chemically synthesized
tgtgctttgagaaataaaaa

SEQ ID NO: 511852 - DNA, 20 bp, Artificial Sequence
  chemically synthesized
ctttgagaaataaaaagcga

SEQ ID NO: 511853 - DNA, 20 bp, Artificial Sequence
  chemically synthesized
acctcgagaaaacttttatt

SEQ ID NO: 511854 - DNA, 20 bp, Artificial Sequence
  chemically synthesized
ccatgattcattactataag

SEQ ID NO: 511855 - DNA, 20 bp, Artificial Sequence
  chemically synthesized
tcaaaaccctgcttatagta

SEQ ID NO: 511856 - DNA, 20 bp, Artificial Sequence
  chemically synthesized
aaatcgtgatcatagtgaaa

SEQ ID NO: 511857 - DNA, 20 bp, Artificial Sequence
  chemically synthesized
catatagtcgaagacttttc

SEQ ID NO: 511858 - DNA, 20 bp, Artificial Sequence
  chemically synthesized
catttttattaaggaaaata

SEQ ID NO: 511859 - DNA, 20 bp, Artificial Sequence
  chemically synthesized
acagcgaacagctagatttg

SEQ ID NO: 511860 - DNA, 20 bp, Artificial Sequence
  chemically synthesized
agatttgaagagtaaaaata

SEQ ID NO: 511861 - DNA, 20 bp, Artificial Sequence
  chemically synthesized
ggcttatttttacaacttgt

SEQ ID NO: 511862 - DNA, 20 bp, Artificial Sequence
  chemically synthesized
taaaaataagccataattct

SEQ ID NO: 511863 - DNA, 20 bp, Artificial Sequence
  chemically synthesized
gataagagactttcaattct

SEQ ID NO: 511864 - DNA, 20 bp, Artificial Sequence
  chemically synthesized
ccaagtcatgttattacctg

SEQ ID NO: 511865 - DNA, 20 bp, Artificial Sequence
  chemically synthesized
acatgacttggtcctgttct

SEQ ID NO: 511866 - DNA, 20 bp, Artificial Sequence
  chemically synthesized
tggtcctgttctctgggtaa

SEQ ID NO: 511867 - DNA, 20 bp, Artificial Sequence
  chemically synthesized
ttgcaaatctgtctaaacat

SEQ ID NO: 511868 - DNA, 20 bp, Artificial Sequence
  chemically synthesized
cagatttgcaaatagcccca

SEQ ID NO: 511869 - DNA, 20 bp, Artificial Sequence
  chemically synthesized
aacatatcccaggttaggaa

SEQ ID NO: 511870 - DNA, 20 bp, Artificial Sequence
  chemically synthesized
agagaattccattcctaacc

SEQ ID NO: 511871 - DNA, 20 bp, Artificial Sequence
  chemically synthesized
tgagtaacatatcccaggtt

SEQ ID NO: 511872 - DNA, 20 bp, Artificial Sequence
  chemically synthesized
tgactccagatagaacgtct

SEQ ID NO: 511873 - DNA, 20 bp, Artificial Sequence
  chemically synthesized
ttactcaaagacgttctatc

SEQ ID NO: 511874 - DNA, 20 bp, Artificial Sequence
  chemically synthesized
ctggagtcaagctttcatac

SEQ ID NO: 511875 - DNA, 20 bp, Artificial Sequence
  chemically synthesized
agaatcatagacatacttca

SEQ ID NO: 511876 - DNA, 20 bp, Artificial Sequence
  chemically synthesized
ccatatactttccagtgttc

SEQ ID NO: 511877 - DNA, 20 bp, Artificial Sequence
  chemically synthesized
agaaaatctacaccatccag

SEQ ID NO: 511878 - DNA, 20 bp, Artificial Sequence
  chemically synthesized
aggatctgtgtgagattctg

SEQ ID NO: 511879 - DNA, 20 bp, Artificial Sequence
  chemically synthesized
tcttaactcattttaaaatt

SEQ ID NO: 511880 - DNA, 20 bp, Artificial Sequence
  chemically synthesized
cacagatccttaattttaaa

SEQ ID NO: 511881 - DNA, 20 bp, Artificial Sequence
  chemically synthesized
caggctatggttctcaaagt

SEQ ID NO: 511882 - DNA, 20 bp, Artificial Sequence
  chemically synthesized
caggtgacgctgatgctggt

SEQ ID NO: 511883 - DNA, 20 bp, Artificial Sequence
  chemically synthesized
ctgggacctttttagaaata

SEQ ID NO: 511884 - DNA, 20 bp, Artificial Sequence
  chemically synthesized
tactaaccaagtaagtctgg

SEQ ID NO: 511885 - DNA, 20 bp, Artificial Sequence
  chemically synthesized
cttacttggttagtatctca

SEQ ID NO: 511886 - DNA, 20 bp, Artificial Sequence
  chemically synthesized
taaaaagaaaacacagattt

SEQ ID NO: 511887 - DNA, 20 bp, Artificial Sequence
  chemically synthesized
ttatgcatatttaggaggta

SEQ ID NO: 511888 - DNA, 20 bp, Artificial Sequence
  chemically synthesized
acagagtgatattttcctat

SEQ ID NO: 511889 - DNA, 20 bp, Artificial Sequence
  chemically synthesized
aatgacaaatatttgaggta

SEQ ID NO: 511890 - DNA, 20 bp, Artificial Sequence
  chemically synthesized
atgtttaaatagctagaaga

SEQ ID NO: 511891 - DNA, 20 bp, Artificial Sequence
  chemically synthesized
aaaatgataagctaaatagg

SEQ ID NO: 511892 - DNA, 20 bp, Artificial Sequence
  chemically synthesized
agtggttagcagaagccggg

SEQ ID NO: 511893 - DNA, 20 bp, Artificial Sequence
  chemically synthesized
gatttcatagaagcaggcag

SEQ ID NO: 511894 - DNA, 20 bp, Artificial Sequence
  chemically synthesized
tggtggtaacatggatgagc

SEQ ID NO: 511895 - DNA, 20 bp, Artificial Sequence
  chemically synthesized
atcctgtaattggtggtaac

SEQ ID NO: 511896 - DNA, 20 bp, Artificial Sequence
  chemically synthesized
atccatgttaccaccaatta

SEQ ID NO: 511897 - DNA, 20 bp, Artificial Sequence
  chemically synthesized
ggatttcattctttttatgg

SEQ ID NO: 511898 - DNA, 20 bp, Artificial Sequence
  chemically synthesized
gaatattattcagccataaa

SEQ ID NO: 511899 - DNA, 20 bp, Artificial Sequence
  chemically synthesized
aatatggcatataaacacaa

SEQ ID NO: 511900 - DNA, 20 bp, Artificial Sequence
  chemically synthesized
aagtgtccattaacagataa

SEQ ID NO: 511901 - DNA, 20 bp, Artificial Sequence
  chemically synthesized
taaaacagattgttgagata

SEQ ID NO: 511902 - DNA, 20 bp, Artificial Sequence
  chemically synthesized
tctcaaacttgagtgcacat

SEQ ID NO: 511903 - DNA, 20 bp, Artificial Sequence
  chemically synthesized
caaattagaggttctcaaac

SEQ ID NO: 511904 - DNA, 20 bp, Artificial Sequence
  chemically synthesized
atttgcgcaacaattttcaa

SEQ ID NO: 511905 - DNA, 20 bp, Artificial Sequence
  chemically synthesized
aatatatttcccaaacataa

SEQ ID NO: 511906 - DNA, 20 bp, Artificial Sequence
  chemically synthesized
aaatcttcccaggcaattct

SEQ ID NO: 511907 - DNA, 20 bp, Artificial Sequence
  chemically synthesized
gtcccaaacaggttaatcct

SEQ ID NO: 511908 - DNA, 20 bp, Artificial Sequence
  chemically synthesized
aagtttgagtagctttgccc

SEQ ID NO: 511909 - DNA, 20 bp, Artificial Sequence
  chemically synthesized
actcgttctccaactaaagt

SEQ ID NO: 511910 - DNA, 20 bp, Artificial Sequence
  chemically synthesized
actcaaactttagttggaga

SEQ ID NO: 511911 - DNA, 20 bp, Artificial Sequence
  chemically synthesized
ctgggagacagttgtggctg

SEQ ID NO: 511912 - DNA, 20 bp, Artificial Sequence
  chemically synthesized
acgcttgattgagtatgtct

SEQ ID NO: 511913 - DNA, 20 bp, Artificial Sequence
  chemically synthesized
ggtctcactctcacgcttga

SEQ ID NO: 511914 - DNA, 20 bp, Artificial Sequence
  chemically synthesized
agacatactcaatcaagcgt

SEQ ID NO: 511915 - DNA, 20 bp, Artificial Sequence
  chemically synthesized
caagcgtgagagtgagacct

SEQ ID NO: 511916 - DNA, 20 bp, Artificial Sequence
  chemically synthesized
acctagggatctgtgttttg

SEQ ID NO: 511917 - DNA, 20 bp, Artificial Sequence
  chemically synthesized
ctgcactcgagcctggacaa

SEQ ID NO: 511918 - DNA, 20 bp, Artificial Sequence
  chemically synthesized
tctcactctgttgtccaggc

SEQ ID NO: 511919 - DNA, 20 bp, Artificial Sequence
  chemically synthesized
cacaggagtttgatgctaca

SEQ ID NO: 511920 - DNA, 20 bp, Artificial Sequence
  chemically synthesized
gatcaggattgcttaaacac

SEQ ID NO: 511921 - DNA, 20 bp, Artificial Sequence
  chemically synthesized
ggacgctgaggcgggaggat

SEQ ID NO: 511922 - DNA, 20 bp, Artificial Sequence
  chemically synthesized
tattcgggacgctgaggcgg

SEQ ID NO: 511923 - DNA, 20 bp, Artificial Sequence
  chemically synthesized
gatcctcccgcctcagcgtc

SEQ ID NO: 511924 - DNA, 20 bp, Artificial Sequence
  chemically synthesized
gtctggaactcctgggctga

SEQ ID NO: 511925 - DNA, 20 bp, Artificial Sequence
  chemically synthesized
caggcagatcccttcagccc

SEQ ID NO: 511926 - DNA, 20 bp, Artificial Sequence
  chemically synthesized
tgtgagccaacatgccgggg

SEQ ID NO: 511927 - DNA, 20 bp, Artificial Sequence
  chemically synthesized
cagggaaggtggtggttaaa

SEQ ID NO: 511928 - DNA, 20 bp, Artificial Sequence
  chemically synthesized
tctcaaagtgtggcctgcat

SEQ ID NO: 511929 - DNA, 20 bp, Artificial Sequence
  chemically synthesized
gctatatgcctttgtgtcac

SEQ ID NO: 511930 - DNA, 20 bp, Artificial Sequence
  chemically synthesized
atgccttctatatgtaggct

SEQ ID NO: 511931 - DNA, 20 bp, Artificial Sequence
  chemically synthesized
tttaataatagtaaaaaagc

SEQ ID NO: 511932 - DNA, 20 bp, Artificial Sequence
  chemically synthesized
catatagtaagtaccaaata

SEQ ID NO: 511933 - DNA, 20 bp, Artificial Sequence
  chemically synthesized
ctggcctacactttttcttt

SEQ ID NO: 511934 - DNA, 20 bp, Artificial Sequence
  chemically synthesized
gcctcagcctcccaaagtgc

SEQ ID NO: 511935 - DNA, 20 bp, Artificial Sequence
  chemically synthesized
tcgtgtatttttagtagaaa

SEQ ID NO: 511936 - DNA, 20 bp, Artificial Sequence
  chemically synthesized
cccgtttctactaaaaatac

SEQ ID NO: 511937 - DNA, 20 bp, Artificial Sequence
  chemically synthesized
cgaattagccaggtgtggtt

SEQ ID NO: 511938 - DNA, 20 bp, Artificial Sequence
  chemically synthesized
attctcctgcctcagcctcc

SEQ ID NO: 511939 - DNA, 20 bp, Artificial Sequence
  chemically synthesized
actcggggaggctgaggcag

SEQ ID NO: 511940 - DNA, 20 bp, Artificial Sequence
  chemically synthesized
ctcactgctaccgctgcctc

SEQ ID NO: 511941 - DNA, 20 bp, Artificial Sequence
  chemically synthesized
atgccactgcactctccaga

SEQ ID NO: 511942 - DNA, 20 bp, Artificial Sequence
  chemically synthesized
ttgttctgtcacccagtctg

SEQ ID NO: 511943 - DNA, 20 bp, Artificial Sequence
  chemically synthesized
tcttttttttttttttgaga

SEQ ID NO: 511944 - DNA, 20 bp, Artificial Sequence
  chemically synthesized
aaagaaaaaaggaaaactgc

SEQ ID NO: 511945 - DNA, 20 bp, Artificial Sequence
  chemically synthesized
cagttttcttatctgtataa

SEQ ID NO: 511946 - DNA, 20 bp, Artificial Sequence
  chemically synthesized
cattaagtaccatagccagc

SEQ ID NO: 511947 - DNA, 20 bp, Artificial Sequence
  chemically synthesized
gtaccatagccagctggggt

SEQ ID NO: 511948 - DNA, 20 bp, Artificial Sequence
  chemically synthesized
ttcagaaaatatattttgaa

SEQ ID NO: 511949 - DNA, 20 bp, Artificial Sequence
  chemically synthesized
tttaataatacatgtaatgc

SEQ ID NO: 511950 - DNA, 20 bp, Artificial Sequence
  chemically synthesized
tgtattattaaagggaaatt

SEQ ID NO: 511951 - DNA, 20 bp, Artificial Sequence
  chemically synthesized
aaaacagattatcaatacat

SEQ ID NO: 511952 - DNA, 20 bp, Artificial Sequence
  chemically synthesized
atatggcaaccaaattatcc

SEQ ID NO: 511953 - DNA, 20 bp, Artificial Sequence
  chemically synthesized
ttactttgagagggcaattc

SEQ ID NO: 511954 - DNA, 20 bp, Artificial Sequence
  chemically synthesized
gacacagtctttttacatca

SEQ ID NO: 511955 - DNA, 20 bp, Artificial Sequence
  chemically synthesized
tagtacccatagaggtgagg

SEQ ID NO: 511956 - DNA, 20 bp, Artificial Sequence
  chemically synthesized
gcacattcttcctcacctct

SEQ ID NO: 511957 - DNA, 20 bp, Artificial Sequence
  chemically synthesized
aactggactgtttaatgtga

SEQ ID NO: 511958 - DNA, 20 bp, Artificial Sequence
  chemically synthesized
cccacattggcttctatttt

SEQ ID NO: 511959 - DNA, 20 bp, Artificial Sequence
  chemically synthesized
gtgccatagcatataaaata

SEQ ID NO: 511960 - DNA, 20 bp, Artificial Sequence
  chemically synthesized
agccaaaatctaaggtgtga

SEQ ID NO: 511961 - DNA, 20 bp, Artificial Sequence
  chemically synthesized
tgagtcacagttctcaaggg

SEQ ID NO: 511962 - DNA, 20 bp, Artificial Sequence
  chemically synthesized
ctgctgagtcacagttctca

SEQ ID NO: 511963 - DNA, 20 bp, Artificial Sequence
  chemically synthesized
gttttctcttttcctatctg

SEQ ID NO: 511964 - DNA, 20 bp, Artificial Sequence
  chemically synthesized
aaaccatgaaataatttggc

SEQ ID NO: 511965 - DNA, 20 bp, Artificial Sequence
  chemically synthesized
gaaatgactcatttgttgta

SEQ ID NO: 511966 - DNA, 20 bp, Artificial Sequence
  chemically synthesized
gcaggaatccaatacaacaa

SEQ ID NO: 511967 - DNA, 20 bp, Artificial Sequence
  chemically synthesized
ataccatttagctggggaga

SEQ ID NO: 511968 - DNA, 20 bp, Artificial Sequence
  chemically synthesized
tgttaaaaagtcataaagga

SEQ ID NO: 511969 - DNA, 20 bp, Artificial Sequence
  chemically synthesized
atgactttttaacagccaac

SEQ ID NO: 511970 - DNA, 20 bp, Artificial Sequence
  chemically synthesized
agtacaataatgatattatc

SEQ ID NO: 511971 - DNA, 20 bp, Artificial Sequence
  chemically synthesized
gaatgttgaccatataaatt

SEQ ID NO: 511972 - DNA, 20 bp, Artificial Sequence
  chemically synthesized
tttaataaccttgtgagcaa

SEQ ID NO: 511973 - DNA, 20 bp, Artificial Sequence
  chemically synthesized
cagagagcaggggaagaaaa

SEQ ID NO: 511974 - DNA, 20 bp, Artificial Sequence
  chemically synthesized
ttcccctgctctctgctcct

SEQ ID NO: 511975 - DNA, 20 bp, Artificial Sequence
  chemically synthesized
ctaagaattacatttcttat

SEQ ID NO: 511976 - DNA, 20 bp, Artificial Sequence
  chemically synthesized
aattttcctaaggaaatgga

SEQ ID NO: 511977 - DNA, 20 bp, Artificial Sequence
  chemically synthesized
ttcctaaggaaatggaaaga

SEQ ID NO: 511978 - DNA, 20 bp, Artificial Sequence
  chemically synthesized
aacacgtttggacattattt

SEQ ID NO: 511979 - DNA, 20 bp, Artificial Sequence
  chemically synthesized
cagcaaatcttggctttagc

SEQ ID NO: 511980 - DNA, 20 bp, Artificial Sequence
  chemically synthesized
caagatttgctgaaggcttt

SEQ ID NO: 511981 - DNA, 20 bp, Artificial Sequence
  chemically synthesized
ttggtgtctacctcaattat

SEQ ID NO: 511982 - DNA, 20 bp, Artificial Sequence
  chemically synthesized
aaaagccaaaaaactcatta

SEQ ID NO: 511983 - DNA, 20 bp, Artificial Sequence
  chemically synthesized
ttctcactattgattcaata

SEQ ID NO: 511984 - DNA, 20 bp, Artificial Sequence
  chemically synthesized
ctcattattgaatcaatagt

SEQ ID NO: 511985 - DNA, 20 bp, Artificial Sequence
  chemically synthesized
aagatttgatgttaggtatt

SEQ ID NO: 511986 - DNA, 20 bp, Artificial Sequence
  chemically synthesized
tgcagctgttatatgaacca

SEQ ID NO: 511987 - DNA, 20 bp, Artificial Sequence
  chemically synthesized
gtgattgtgagccatttcca

SEQ ID NO: 511988 - DNA, 20 bp, Artificial Sequence
  chemically synthesized
gtagaaatgtactaggtttc

SEQ ID NO: 511989 - DNA, 20 bp, Artificial Sequence
  chemically synthesized
tcacaagtcaataaacactt

SEQ ID NO: 511990 - DNA, 20 bp, Artificial Sequence
  chemically synthesized
gacttgtgatttacaacatt

SEQ ID NO: 511991 - DNA, 20 bp, Artificial Sequence
  chemically synthesized
taatgctatgctagttttca

SEQ ID NO: 511992 - DNA, 20 bp, Artificial Sequence
  chemically synthesized
tatgaaaactagcatagcat

SEQ ID NO: 511993 - DNA, 20 bp, Artificial Sequence
  chemically synthesized
atagcattagagttagaaaa

SEQ ID NO: 511994 - DNA, 20 bp, Artificial Sequence
  chemically synthesized
ctagctttctcaaggatgga

SEQ ID NO: 511995 - DNA, 20 bp, Artificial Sequence
  chemically synthesized
agaaactagctttctcaagg

SEQ ID NO: 511996 - DNA, 20 bp, Artificial Sequence
  chemically synthesized
ctgaagaaactagctttctc

SEQ ID NO: 511997 - DNA, 20 bp, Artificial Sequence
  chemically synthesized
gaagtttttctcccttttgt

SEQ ID NO: 511998 - DNA, 20 bp, Artificial Sequence
  chemically synthesized
ttgatttacttctaaaataa

SEQ ID NO: 511999 - DNA, 20 bp, Artificial Sequence
  chemically synthesized
gtgcaaaatatctatcaggt

SEQ ID NO: 512000 - DNA, 20 bp, Artificial Sequence
  chemically synthesized
aatctgttataaattattga

SEQ ID NO: 512001 - DNA, 20 bp, Artificial Sequence
  chemically synthesized
tagcaatctgttataaatta

SEQ ID NO: 512002 - DNA, 20 bp, Artificial Sequence
  chemically synthesized
gtacccacccctatctgcct

SEQ ID NO: 512003 - DNA, 20 bp, Artificial Sequence
  chemically synthesized
agccaaactcctaggcagat

SEQ ID NO: 512004 - DNA, 20 bp, Artificial Sequence
  chemically synthesized
aaactcctaggcagataggg

SEQ ID NO: 512005 - DNA, 20 bp, Artificial Sequence
  chemically synthesized
agcttggaagtggggtttca

SEQ ID NO: 512006 - DNA, 20 bp, Artificial Sequence
  chemically synthesized
aactgtcttcagcttggaag

SEQ ID NO: 512007 - DNA, 20 bp, Artificial Sequence
  chemically synthesized
ctacaaatcaaatccttgca

SEQ ID NO: 512008 - DNA, 20 bp, Artificial Sequence
  chemically synthesized
acaagttctcaatccactgc

SEQ ID NO: 512009 - DNA, 20 bp, Artificial Sequence
  chemically synthesized
aggtataagtaaaataggtg

SEQ ID NO: 512010 - DNA, 20 bp, Artificial Sequence
  chemically synthesized
gtgggaattcatgatgatat

SEQ ID NO: 512011 - DNA, 20 bp, Artificial Sequence
  chemically synthesized
gccctcacccaaatatcatc

SEQ ID NO: 512012 - DNA, 20 bp, Artificial Sequence
  chemically synthesized
gggtccttcctacaacatgt

SEQ ID NO: 512013 - DNA, 20 bp, Artificial Sequence
  chemically synthesized
catgatccagttacctccca

SEQ ID NO: 512014 - DNA, 20 bp, Artificial Sequence
  chemically synthesized
aaggacccagtgggaggtaa

SEQ ID NO: 512015 - DNA, 20 bp, Artificial Sequence
  chemically synthesized
agtgggaggtaactggatca

SEQ ID NO: 512016 - DNA, 20 bp, Artificial Sequence
  chemically synthesized
cccgtgctgttctcatgata

SEQ ID NO: 512017 - DNA, 20 bp, Artificial Sequence
  chemically synthesized
aatctgatggctttgtaagg

SEQ ID NO: 512018 - DNA, 20 bp, Artificial Sequence
  chemically synthesized
aagagcaagtcacgtcttac

SEQ ID NO: 512019 - DNA, 20 bp, Artificial Sequence
  chemically synthesized
gaaaaagagtttaatggact

SEQ ID NO: 512020 - DNA, 20 bp, Artificial Sequence
  chemically synthesized
tggataatttatacaggaaa

SEQ ID NO: 512021 - DNA, 20 bp, Artificial Sequence
  chemically synthesized
tgataaagtcatgccagaga

SEQ ID NO: 512022 - DNA, 20 bp, Artificial Sequence
  chemically synthesized
ctgctgataaagtcatgcca

SEQ ID NO: 512023 - DNA, 20 bp, Artificial Sequence
  chemically synthesized
tataaaaacaaattaataca

SEQ ID NO: 512024 - DNA, 20 bp, Artificial Sequence
  chemically synthesized
atacagtgaattggtaccag

SEQ ID NO: 512025 - DNA, 20 bp, Artificial Sequence
  chemically synthesized
gtgaattggtaccagtagag

SEQ ID NO: 512026 - DNA, 20 bp, Artificial Sequence
  chemically synthesized
atgtggaagcaactttggaa

SEQ ID NO: 512027 - DNA, 20 bp, Artificial Sequence
  chemically synthesized
gtttgggacttcctagagac

SEQ ID NO: 512028 - DNA, 20 bp, Artificial Sequence
  chemically synthesized
aagatgctgataatgatgta

SEQ ID NO: 512029 - DNA, 20 bp, Artificial Sequence
  chemically synthesized
ctatctgagaccatctcagc

SEQ ID NO: 512030 - DNA, 20 bp, Artificial Sequence
  chemically synthesized
agtctctttgctaaaatata

SEQ ID NO: 512031 - DNA, 20 bp, Artificial Sequence
  chemically synthesized
ggagcattttgctcctgccc

SEQ ID NO: 512032 - DNA, 20 bp, Artificial Sequence
  chemically synthesized
tagggaactttgagcttgag

SEQ ID NO: 512033 - DNA, 20 bp, Artificial Sequence
  chemically synthesized
aacaggacccaagtcacctc

SEQ ID NO: 512034 - DNA, 20 bp, Artificial Sequence
  chemically synthesized
caaagcattcgtgaggtgac

SEQ ID NO: 512035 - DNA, 20 bp, Artificial Sequence
  chemically synthesized
gctctgtttcccttttaaaa

SEQ ID NO: 512036 - DNA, 20 bp, Artificial Sequence
  chemically synthesized
tacaaatttctgcagtgggc

SEQ ID NO: 512037 - DNA, 20 bp, Artificial Sequence
  chemically synthesized
tttgtataagtaacaaggaa

SEQ ID NO: 512038 - DNA, 20 bp, Artificial Sequence
  chemically synthesized
agcccctcccatcacatgtc

SEQ ID NO: 512039 - DNA, 20 bp, Artificial Sequence
  chemically synthesized
atggttttgtgggctaggcc

SEQ ID NO: 512040 - DNA, 20 bp, Artificial Sequence
  chemically synthesized
cggccccttttagtcacagc

SEQ ID NO: 512041 - DNA, 20 bp, Artificial Sequence
  chemically synthesized
gaacctctgcctagatttca

SEQ ID NO: 512042 - DNA, 20 bp, Artificial Sequence
  chemically synthesized
cagaggatgtatggaaaaac

SEQ ID NO: 512043 - DNA, 20 bp, Artificial Sequence
  chemically synthesized
ggcagtgcaaaagaaaaatg

SEQ ID NO: 512044 - DNA, 20 bp, Artificial Sequence
  chemically synthesized
tctaatagacagtgctctag

SEQ ID NO: 512045 - DNA, 20 bp, Artificial Sequence
  chemically synthesized
ggccactgtcctccagaccc

SEQ ID NO: 512046 - DNA, 20 bp, Artificial Sequence
  chemically synthesized
tgccagtggatctaccattc

SEQ ID NO: 512047 - DNA, 20 bp, Artificial Sequence
  chemically synthesized
gtgtgtgttgcaagctgcca

SEQ ID NO: 512048 - DNA, 20 bp, Artificial Sequence
  chemically synthesized
ttcagggtacagcctccctc

SEQ ID NO: 512049 - DNA, 20 bp, Artificial Sequence
  chemically synthesized
actctgcccctgcggctttt

SEQ ID NO: 512050 - DNA, 20 bp, Artificial Sequence
  chemically synthesized
accctgaaaagccgcagggg

SEQ ID NO: 512051 - DNA, 20 bp, Artificial Sequence
  chemically synthesized
aggtcatgctgatgcaagag

SEQ ID NO: 512052 - DNA, 20 bp, Artificial Sequence
  chemically synthesized
ctctcttgcatcagcatgac

SEQ ID NO: 512053 - DNA, 20 bp, Artificial Sequence
  chemically synthesized
tttaagatttgacagccctg

SEQ ID NO: 512054 - DNA, 20 bp, Artificial Sequence
  chemically synthesized
atacagtggggttacaggca

SEQ ID NO: 512055 - DNA, 20 bp, Artificial Sequence
  chemically synthesized
tagttacttcctagatacag

SEQ ID NO: 512056 - DNA, 20 bp, Artificial Sequence
  chemically synthesized
cagaaggaaattgccttatc

SEQ ID NO: 512057 - DNA, 20 bp, Artificial Sequence
  chemically synthesized
taggatgacactttggactg

SEQ ID NO: 512058 - DNA, 20 bp, Artificial Sequence
  chemically synthesized
acactttggactgtggagtt

SEQ ID NO: 512059 - DNA, 20 bp, Artificial Sequence
  chemically synthesized
gtggagttttgagttaatga

SEQ ID NO: 512060 - DNA, 20 bp, Artificial Sequence
  chemically synthesized
agttttgagttaatgaggga

SEQ ID NO: 512061 - DNA, 20 bp, Artificial Sequence
  chemically synthesized
caagattggttttcaaatgt

SEQ ID NO: 512062 - DNA, 20 bp, Artificial Sequence
  chemically synthesized
tatgagatttgggaggggcc

SEQ ID NO: 512063 - DNA, 20 bp, Artificial Sequence
  chemically synthesized
gatttgggaggggccggggg

SEQ ID NO: 512064 - DNA, 20 bp, Artificial Sequence
  chemically synthesized
ggtggaatgatatggtttgg

SEQ ID NO: 512065 - DNA, 20 bp, Artificial Sequence
  chemically synthesized
gtgggaattcaagatgagat

SEQ ID NO: 512066 - DNA, 20 bp, Artificial Sequence
  chemically synthesized
gtccccacccaaatctcatc

SEQ ID NO: 512067 - DNA, 20 bp, Artificial Sequence
  chemically synthesized
gggatcctctgacaacatgt

SEQ ID NO: 512068 - DNA, 20 bp, Artificial Sequence
  chemically synthesized
tgaattcccacatgttgtca

SEQ ID NO: 512069 - DNA, 20 bp, Artificial Sequence
  chemically synthesized
atgattcaattacctcccac

SEQ ID NO: 512070 - DNA, 20 bp, Artificial Sequence
  chemically synthesized
aggatccctgtgggaggtaa

SEQ ID NO: 512071 - DNA, 20 bp, Artificial Sequence
  chemically synthesized
agatctgatggctttgtaag

SEQ ID NO: 512072 - DNA, 20 bp, Artificial Sequence
  chemically synthesized
aggagtaagtcacattttac

SEQ ID NO: 512073 - DNA, 20 bp, Artificial Sequence
  chemically synthesized
aatcatggtggaaggcaagg

SEQ ID NO: 512074 - DNA, 20 bp, Artificial Sequence
  chemically synthesized
gtgaggcttccccatccaca

SEQ ID NO: 512075 - DNA, 20 bp, Artificial Sequence
  chemically synthesized
taatagacttgcaattctat

SEQ ID NO: 512076 - DNA, 20 bp, Artificial Sequence
  chemically synthesized
tgggtaatttatacagcaaa

SEQ ID NO: 512077 - DNA, 20 bp, Artificial Sequence
  chemically synthesized
tgataaagagatacctgaga

SEQ ID NO: 512078 - DNA, 20 bp, Artificial Sequence
  chemically synthesized
tgagggaggaaaatacaggt

SEQ ID NO: 512079 - DNA, 20 bp, Artificial Sequence
  chemically synthesized
agcttgttgtggagaaggaa

SEQ ID NO: 512080 - DNA, 20 bp, Artificial Sequence
  chemically synthesized
agtgatatttagatggaagt

SEQ ID NO: 512081 - DNA, 20 bp, Artificial Sequence
  chemically synthesized
atcagggaatctgtatctgg

SEQ ID NO: 512082 - DNA, 20 bp, Artificial Sequence
  chemically synthesized
gctataaaaatagtaaatca

SEQ ID NO: 512083 - DNA, 20 bp, Artificial Sequence
  chemically synthesized
tttactatttttatagcact

SEQ ID NO: 512084 - DNA, 20 bp, Artificial Sequence
  chemically synthesized
gatgtgtactatttaaaatt

SEQ ID NO: 512085 - DNA, 20 bp, Artificial Sequence
  chemically synthesized
ttggaatatattgtcttttg

SEQ ID NO: 512086 - DNA, 20 bp, Artificial Sequence
  chemically synthesized
ataagaaaaggctcatgtct

SEQ ID NO: 512087 - DNA, 20 bp, Artificial Sequence
  chemically synthesized
aagtgttctgttaggcctga

SEQ ID NO: 512088 - DNA, 20 bp, Artificial Sequence
  chemically synthesized
ggcaaagtgttctgttaggc

SEQ ID NO: 512089 - DNA, 20 bp, Artificial Sequence
  chemically synthesized
aggtgcttaatgaacattta

SEQ ID NO: 512090 - DNA, 20 bp, Artificial Sequence
  chemically synthesized
agatgtggttcgactttgca

SEQ ID NO: 512091 - DNA, 20 bp, Artificial Sequence
  chemically synthesized
tggtcaaataggaaatcttt

SEQ ID NO: 512092 - DNA, 20 bp, Artificial Sequence
  chemically synthesized
ttactatgagtggcagtgca

SEQ ID NO: 512093 - DNA, 20 bp, Artificial Sequence
  chemically synthesized
tactccctgtgtggcttact

SEQ ID NO: 512094 - DNA, 20 bp, Artificial Sequence
  chemically synthesized
cactcatagtaagccacaca

SEQ ID NO: 512095 - DNA, 20 bp, Artificial Sequence
  chemically synthesized
aatttgtactgaagcttggt

SEQ ID NO: 512096 - DNA, 20 bp, Artificial Sequence
  chemically synthesized
agaacacccacagctgaggg

SEQ ID NO: 512097 - DNA, 20 bp, Artificial Sequence
  chemically synthesized
tacaaattcttccctcagct

SEQ ID NO: 512098 - DNA, 20 bp, Artificial Sequence
  chemically synthesized
ctttgctctgacaaagcatc

SEQ ID NO: 512099 - DNA, 20 bp, Artificial Sequence
  chemically synthesized
ttgatgctttgtcagagcaa

SEQ ID NO: 512100 - DNA, 20 bp, Artificial Sequence
  chemically synthesized
ttctgttaatttagcatttt

SEQ ID NO: 512101 - DNA, 20 bp, Artificial Sequence
  chemically synthesized
acttgctaggttatataaag

SEQ ID NO: 512102 - DNA, 20 bp, Artificial Sequence
  chemically synthesized
acccacaaaatagaattgag

SEQ ID NO: 512103 - DNA, 20 bp, Artificial Sequence
  chemically synthesized
accctgctcaattctatttt

SEQ ID NO: 512104 - DNA, 20 bp, Artificial Sequence
  chemically synthesized
cggggtcaaaacccacaaaa

SEQ ID NO: 512105 - DNA, 20 bp, Artificial Sequence
  chemically synthesized
tttcatgataggctaaatca

SEQ ID NO: 512106 - DNA, 20 bp, Artificial Sequence
  chemically synthesized
tggggggtcaaaatgaagat

SEQ ID NO: 512107 - DNA, 20 bp, Artificial Sequence
  chemically synthesized
agatggcacaaatctgggtg

SEQ ID NO: 512108 - DNA, 20 bp, Artificial Sequence
  chemically synthesized
attttgcagatggcacaaat

SEQ ID NO: 512109 - DNA, 20 bp, Artificial Sequence
  chemically synthesized
accttacataacatcagcaa

SEQ ID NO: 512110 - DNA, 20 bp, Artificial Sequence
  chemically synthesized
ctaccacaggttctgtgctg

SEQ ID NO: 512111 - DNA, 20 bp, Artificial Sequence
  chemically synthesized
aattataataaaacaatatt

SEQ ID NO: 512112 - DNA, 20 bp, Artificial Sequence
  chemically synthesized
tttcaaaacaatcttatcag

SEQ ID NO: 512113 - DNA, 20 bp, Artificial Sequence
  chemically synthesized
cagcttttaagtaatacagc

SEQ ID NO: 512114 - DNA, 20 bp, Artificial Sequence
  chemically synthesized
ttgagatgcactgcttgggt

SEQ ID NO: 512115 - DNA, 20 bp, Artificial Sequence
  chemically synthesized
gagatcttgagatgcactgc

SEQ ID NO: 512116 - DNA, 20 bp, Artificial Sequence
  chemically synthesized
acacattttagtcaggaggg

SEQ ID NO: 512117 - DNA, 20 bp, Artificial Sequence
  chemically synthesized
gggagagtgagctctgtata

SEQ ID NO: 512118 - DNA, 20 bp, Artificial Sequence
  chemically synthesized
taataaccatattgacttgg

SEQ ID NO: 512119 - DNA, 20 bp, Artificial Sequence
  chemically synthesized
ctatatgacagagttggcag

SEQ ID NO: 512120 - DNA, 20 bp, Artificial Sequence
  chemically synthesized
gtgataagtgatctatatga

SEQ ID NO: 512121 - DNA, 20 bp, Artificial Sequence
  chemically synthesized
tggctaaggttctatggtat

SEQ ID NO: 512122 - DNA, 20 bp, Artificial Sequence
  chemically synthesized
ttttaatggtttatttctat

SEQ ID NO: 512123 - DNA, 20 bp, Artificial Sequence
  chemically synthesized
agaacaagctattaatttag

SEQ ID NO: 512124 - DNA, 20 bp, Artificial Sequence
  chemically synthesized
caagctattaatttagatga

SEQ ID NO: 512125 - DNA, 20 bp, Artificial Sequence
  chemically synthesized
ctataacagtataaatgcta

SEQ ID NO: 512126 - DNA, 20 bp, Artificial Sequence
  chemically synthesized
ctgcacaatgatttaatggc

SEQ ID NO: 512127 - DNA, 20 bp, Artificial Sequence
  chemically synthesized
atgtaaaggagccagatgaa

SEQ ID NO: 512128 - DNA, 20 bp, Artificial Sequence
  chemically synthesized
tcaaagcctttccttacggc

SEQ ID NO: 512129 - DNA, 20 bp, Artificial Sequence
  chemically synthesized
ggcaattcttcagcaatgtg

SEQ ID NO: 512130 - DNA, 20 bp, Artificial Sequence
  chemically synthesized
ccctactcatcacattgctg

SEQ ID NO: 512131 - DNA, 20 bp, Artificial Sequence
  chemically synthesized
aagctcaactttttttttgt

SEQ ID NO: 512132 - DNA, 20 bp, Artificial Sequence
  chemically synthesized
tcaactttttttttgtatgg

SEQ ID NO: 512133 - DNA, 20 bp, Artificial Sequence
  chemically synthesized
ctttttttttgtatgggtga

SEQ ID NO: 512134 - DNA, 20 bp, Artificial Sequence
  chemically synthesized
aagacaatatttttagagga

SEQ ID NO: 512135 - DNA, 20 bp, Artificial Sequence
  chemically synthesized
tagaaatattttaacttcag

SEQ ID NO: 512136 - DNA, 20 bp, Artificial Sequence
  chemically synthesized
aagatttagaatacagctat

SEQ ID NO: 512137 - DNA, 20 bp, Artificial Sequence
  chemically synthesized
ggattcttaccaaaaagatt

SEQ ID NO: 512138 - DNA, 20 bp, Artificial Sequence
  chemically synthesized
gtattctaaatctttttggt

SEQ ID NO: 512139 - DNA, 20 bp, Artificial Sequence
  chemically synthesized
tagaattcagaatacatttc

SEQ ID NO: 512140 - DNA, 20 bp, Artificial Sequence
  chemically synthesized
aagaatccctgaaatgtatt

SEQ ID NO: 512141 - DNA, 20 bp, Artificial Sequence
  chemically synthesized
acttttcatctattagaatt

SEQ ID NO: 512142 - DNA, 20 bp, Artificial Sequence
  chemically synthesized
acagggaacttttcatctat

SEQ ID NO: 512143 - DNA, 20 bp, Artificial Sequence
  chemically synthesized
tgtgttgggctgctcttagt

SEQ ID NO: 512144 - DNA, 20 bp, Artificial Sequence
  chemically synthesized
aactaagagcagcccaacac

SEQ ID NO: 512145 - DNA, 20 bp, Artificial Sequence
  chemically synthesized
acaggaatatttgctctttg

SEQ ID NO: 512146 - DNA, 20 bp, Artificial Sequence
  chemically synthesized
tcaagaatatgaaaacatca

SEQ ID NO: 512147 - DNA, 20 bp, Artificial Sequence
  chemically synthesized
tcaatgatgttttcatattc

SEQ ID NO: 512148 - DNA, 20 bp, Artificial Sequence
  chemically synthesized
atatttgtaattaagaactc

SEQ ID NO: 512149 - DNA, 20 bp, Artificial Sequence
  chemically synthesized
tatacctggcaagcaaataa

SEQ ID NO: 512150 - DNA, 20 bp, Artificial Sequence
  chemically synthesized
gcaataaaaatatcaatggt

SEQ ID NO: 512151 - DNA, 20 bp, Artificial Sequence
  chemically synthesized
aatggttgtgtatcaaaagg

SEQ ID NO: 512152 - DNA, 20 bp, Artificial Sequence
  chemically synthesized
aagttggttacaggaggaag

SEQ ID NO: 512153 - DNA, 20 bp, Artificial Sequence
  chemically synthesized
gttacaggaggaagcagggt

SEQ ID NO: 512154 - DNA, 20 bp, Artificial Sequence
  chemically synthesized
aagcttaatctagggcaaag

SEQ ID NO: 512155 - DNA, 20 bp, Artificial Sequence
  chemically synthesized
actttctgtagttactgcaa

SEQ ID NO: 512156 - DNA, 20 bp, Artificial Sequence
  chemically synthesized
tagccatagcacattaatta

SEQ ID NO: 512157 - DNA, 20 bp, Artificial Sequence
  chemically synthesized
ctattggctttgttttgtta

SEQ ID NO: 512158 - DNA, 20 bp, Artificial Sequence
  chemically synthesized
tgcatttgttccacagaaga

SEQ ID NO: 512159 - DNA, 20 bp, Artificial Sequence
  chemically synthesized
gactgaatttcttgttgagc

SEQ ID NO: 512160 - DNA, 20 bp, Artificial Sequence
  chemically synthesized
acttttttgtctgttcagga

SEQ ID NO: 512161 - DNA, 20 bp, Artificial Sequence
  chemically synthesized
cttcaatacttgttttctga

SEQ ID NO: 512162 - DNA, 20 bp, Artificial Sequence
  chemically synthesized
ctagacattcacatttagct

SEQ ID NO: 512163 - DNA, 20 bp, Artificial Sequence
  chemically synthesized
caaagtacccaaagctaaat

SEQ ID NO: 512164 - DNA, 20 bp, Artificial Sequence
  chemically synthesized
taggtcagaaaaatgtgtag

SEQ ID NO: 512165 - DNA, 20 bp, Artificial Sequence
  chemically synthesized
ctaaaaaccaaaagcattca

SEQ ID NO: 512166 - DNA, 20 bp, Artificial Sequence
  chemically synthesized
tgtttgttctcttacactct

SEQ ID NO: 512167 - DNA, 20 bp, Artificial Sequence
  chemically synthesized
acatcatatcaagttgccca

SEQ ID NO: 512168 - DNA, 20 bp, Artificial Sequence
  chemically synthesized
aatacaagattaatctcctt

SEQ ID NO: 512169 - DNA, 20 bp, Artificial Sequence
  chemically synthesized
tggatcaatttgggaaacaa

SEQ ID NO: 512170 - DNA, 20 bp, Artificial Sequence
  chemically synthesized
gctgaagtagtgattgtcct

SEQ ID NO: 512171 - DNA, 20 bp, Artificial Sequence
  chemically synthesized
ctacttcagcctttaatctt

SEQ ID NO: 512172 - DNA, 20 bp, Artificial Sequence
  chemically synthesized
tacctttttaataagtagct

SEQ ID NO: 512173 - DNA, 20 bp, Artificial Sequence
  chemically synthesized
gctacttattaaaaaggtaa

SEQ ID NO: 512174 - DNA, 20 bp, Artificial Sequence
  chemically synthesized
aaaggtaagaggatgttctt

SEQ ID NO: 512175 - DNA, 20 bp, Artificial Sequence
  chemically synthesized
cattttcccaactttacagt

SEQ ID NO: 512176 - DNA, 20 bp, Artificial Sequence
  chemically synthesized
tgatgcaaaacagcttaaga

SEQ ID NO: 512177 - DNA, 20 bp, Artificial Sequence
  chemically synthesized
aaaccagtgatgagctgtgg

SEQ ID NO: 512178 - DNA, 20 bp, Artificial Sequence
  chemically synthesized
aagactaatttggtcttgaa

SEQ ID NO: 512179 - DNA, 20 bp, Artificial Sequence
  chemically synthesized
gcaagaaattccctacaatt

SEQ ID NO: 512180 - DNA, 20 bp, Artificial Sequence
  chemically synthesized
gagttaaaccctgaattgta

SEQ ID NO: 512181 - DNA, 20 bp, Artificial Sequence
  chemically synthesized
atctctttaagagttaaacc

SEQ ID NO: 512182 - DNA, 20 bp, Artificial Sequence
  chemically synthesized
aaaatggagctaatctcttt

SEQ ID NO: 512183 - DNA, 20 bp, Artificial Sequence
  chemically synthesized
gctccattttttttctaatt

SEQ ID NO: 512184 - DNA, 20 bp, Artificial Sequence
  chemically synthesized
tctcacaagcatgtgaggta

SEQ ID NO: 512185 - DNA, 20 bp, Artificial Sequence
  chemically synthesized
gtatgcttgaaaatttcaaa

SEQ ID NO: 512186 - DNA, 20 bp, Artificial Sequence
  chemically synthesized
agggaaattcaagagaactg

SEQ ID NO: 512187 - DNA, 20 bp, Artificial Sequence
  chemically synthesized
atatacacccaacagttctc

SEQ ID NO: 512188 - DNA, 20 bp, Artificial Sequence
  chemically synthesized
atcatataacttgttaagaa

SEQ ID NO: 512189 - DNA, 20 bp, Artificial Sequence
  chemically synthesized
cctgaatcatataacttgtt

SEQ ID NO: 512190 - DNA, 20 bp, Artificial Sequence
  chemically synthesized
cttaacaagttatatgattc

SEQ ID NO: 512191 - DNA, 20 bp, Artificial Sequence
  chemically synthesized
caacattttctattatatcc

SEQ ID NO: 512192 - DNA, 20 bp, Artificial Sequence
  chemically synthesized
aaagttgggctaaaactaga

SEQ ID NO: 512193 - DNA, 20 bp, Artificial Sequence
  chemically synthesized
gcccaactttcaaggctctc

SEQ ID NO: 512194 - DNA, 20 bp, Artificial Sequence
  chemically synthesized
aagaaacaaccaaaccatat

SEQ ID NO: 512195 - DNA, 20 bp, Artificial Sequence
  chemically synthesized
gttgtttcttcccccaaatc

SEQ ID NO: 512196 - DNA, 20 bp, Artificial Sequence
  chemically synthesized
ggtccctcccatgacatggt

SEQ ID NO: 512197 - DNA, 20 bp, Artificial Sequence
  chemically synthesized
agggacctggtaggaggtaa

SEQ ID NO: 512198 - DNA, 20 bp, Artificial Sequence
  chemically synthesized
cccatgctgttctcgtgata

SEQ ID NO: 512199 - DNA, 20 bp, Artificial Sequence
  chemically synthesized
ctccccagccatgtagaact

SEQ ID NO: 512200 - DNA, 20 bp, Artificial Sequence
  chemically synthesized
tgttcaaaataaacctataa

SEQ ID NO: 512201 - DNA, 20 bp, Artificial Sequence
  chemically synthesized
aaaaatgagagatgggttga

SEQ ID NO: 512202 - DNA, 20 bp, Artificial Sequence
  chemically synthesized
aactgcagcaaaaatgagag

SEQ ID NO: 512203 - DNA, 20 bp, Artificial Sequence
  chemically synthesized
agttcctgtttctgctgtta

SEQ ID NO: 512204 - DNA, 20 bp, Artificial Sequence
  chemically synthesized
ttgctagagctaggaagtga

SEQ ID NO: 512205 - DNA, 20 bp, Artificial Sequence
  chemically synthesized
tttccaggtcccacatgttc

SEQ ID NO: 512206 - DNA, 20 bp, Artificial Sequence
  chemically synthesized
caatagtcaagagtgtcagt

SEQ ID NO: 512207 - DNA, 20 bp, Artificial Sequence
  chemically synthesized
tttaagtgacagcaatagtc

SEQ ID NO: 512208 - DNA, 20 bp, Artificial Sequence
  chemically synthesized
atgtatcaccactgctctct

SEQ ID NO: 512209 - DNA, 20 bp, Artificial Sequence
  chemically synthesized
ctctctggcccctaaagcta

SEQ ID NO: 512210 - DNA, 20 bp, Artificial Sequence
  chemically synthesized
cacgcagggaggagaaagac

SEQ ID NO: 512211 - DNA, 20 bp, Artificial Sequence
  chemically synthesized
gtgttcatttggatgagtag

SEQ ID NO: 512212 - DNA, 20 bp, Artificial Sequence
  chemically synthesized
tgactactgtgttcatttgg

SEQ ID NO: 512213 - DNA, 20 bp, Artificial Sequence
  chemically synthesized
aacatgactactgtgttcat

SEQ ID NO: 512214 - DNA, 20 bp, Artificial Sequence
  chemically synthesized
ccattattttatcaagtgga

SEQ ID NO: 512215 - DNA, 20 bp, Artificial Sequence
  chemically synthesized
gtgacccattattttatcaa

SEQ ID NO: 512216 - DNA, 20 bp, Artificial Sequence
  chemically synthesized
tccatccacttgataaaata

SEQ ID NO: 512217 - DNA, 20 bp, Artificial Sequence
  chemically synthesized
gtcttggtcgttgaataaca

SEQ ID NO: 512218 - DNA, 20 bp, Artificial Sequence
  chemically synthesized
gaactcaagagtcttggtcg

SEQ ID NO: 512219 - DNA, 20 bp, Artificial Sequence
  chemically synthesized
ttattcaacgaccaagactc

SEQ ID NO: 512220 - DNA, 20 bp, Artificial Sequence
  chemically synthesized
ttacataattacaggaactc

SEQ ID NO: 512221 - DNA, 20 bp, Artificial Sequence
  chemically synthesized
ctgtcagtggtcataaaggc

SEQ ID NO: 512222 - DNA, 20 bp, Artificial Sequence
  chemically synthesized
aaggcaagaatctcagactt

SEQ ID NO: 512223 - DNA, 20 bp, Artificial Sequence
  chemically synthesized
aattgcagtaagagtaaatg

SEQ ID NO: 512224 - DNA, 20 bp, Artificial Sequence
  chemically synthesized
gtgtgagggcaaattgcagt

SEQ ID NO: 512225 - DNA, 20 bp, Artificial Sequence
  chemically synthesized
ctttgttatctcgtaatctt

SEQ ID NO: 512226 - DNA, 20 bp, Artificial Sequence
  chemically synthesized
ttagcacagtgcctgaaaca

SEQ ID NO: 512227 - DNA, 20 bp, Artificial Sequence
  chemically synthesized
aacacaggatgtgttcaata

SEQ ID NO: 512228 - DNA, 20 bp, Artificial Sequence
  chemically synthesized
ctggctttgggagacaggca

SEQ ID NO: 512229 - DNA, 20 bp, Artificial Sequence
  chemically synthesized
catgtttcgaaatagagaag

SEQ ID NO: 512230 - DNA, 20 bp, Artificial Sequence
  chemically synthesized
tctcacattgttttgcaact

SEQ ID NO: 512231 - DNA, 20 bp, Artificial Sequence
  chemically synthesized
ttagaattggataagataaa

SEQ ID NO: 512232 - DNA, 20 bp, Artificial Sequence
  chemically synthesized
aaacttaaagatagttagaa

SEQ ID NO: 512233 - DNA, 20 bp, Artificial Sequence
  chemically synthesized
agctgaaacttaaagatagt

SEQ ID NO: 512234 - DNA, 20 bp, Artificial Sequence
  chemically synthesized
tttcagctcaacttctactt

SEQ ID NO: 512235 - DNA, 20 bp, Artificial Sequence
  chemically synthesized
taaatttcactttatagtgt

SEQ ID NO: 512236 - DNA, 20 bp, Artificial Sequence
  chemically synthesized
agcaactttcagtgtaactt

SEQ ID NO: 512237 - DNA, 20 bp, Artificial Sequence
  chemically synthesized
actgaaagttgctagaagga

SEQ ID NO: 512238 - DNA, 20 bp, Artificial Sequence
  chemically synthesized
gatcatttctaatttttctc

SEQ ID NO: 512239 - DNA, 20 bp, Artificial Sequence
  chemically synthesized
aatactaaacttatcaggca

SEQ ID NO: 512240 - DNA, 20 bp, Artificial Sequence
  chemically synthesized
ttacttccacattttgtcta

SEQ ID NO: 512241 - DNA, 20 bp, Artificial Sequence
  chemically synthesized
aagagtaaattaggtttttc

SEQ ID NO: 512242 - DNA, 20 bp, Artificial Sequence
  chemically synthesized
taagggggaatgagaaagag

SEQ ID NO: 512243 - DNA, 20 bp, Artificial Sequence
  chemically synthesized
atatagaaatgcatctaagg

SEQ ID NO: 512244 - DNA, 20 bp, Artificial Sequence
  chemically synthesized
cctggaaatcagaatgaaca

SEQ ID NO: 512245 - DNA, 20 bp, Artificial Sequence
  chemically synthesized
ggaaagtgctacctggaaat

SEQ ID NO: 512246 - DNA, 20 bp, Artificial Sequence
  chemically synthesized
cgcatattgctgagcagtga

SEQ ID NO: 512247 - DNA, 20 bp, Artificial Sequence
  chemically synthesized
cacctggcaacatgggagag

SEQ ID NO: 512248 - DNA, 20 bp, Artificial Sequence
  chemically synthesized
atttagcttagttcttctgt

SEQ ID NO: 512249 - DNA, 20 bp, Artificial Sequence
  chemically synthesized
aaacagaagaactaagctaa

SEQ ID NO: 512250 - DNA, 20 bp, Artificial Sequence
  chemically synthesized
aagaatcactttgtgaaatg

SEQ ID NO: 512251 - DNA, 20 bp, Artificial Sequence
  chemically synthesized
aaataataagaaaattgcta

SEQ ID NO: 512252 - DNA, 20 bp, Artificial Sequence
  chemically synthesized
gagttttaaactttgcatat

SEQ ID NO: 512253 - DNA, 20 bp, Artificial Sequence
  chemically synthesized
gctctctgaaactttaaaaa

SEQ ID NO: 512254 - DNA, 20 bp, Artificial Sequence
  chemically synthesized
acgagataagctttagcttg

SEQ ID NO: 512255 - DNA, 20 bp, Artificial Sequence
  chemically synthesized
gatgaatttcatactgacta

SEQ ID NO: 512256 - DNA, 20 bp, Artificial Sequence
  chemically synthesized
aatgtatcacatgggcctgc

SEQ ID NO: 512257 - DNA, 20 bp, Artificial Sequence
  chemically synthesized
gcccatgtgatacatttctt

SEQ ID NO: 512258 - DNA, 20 bp, Artificial Sequence
  chemically synthesized
ctttctgagtggaaaattgt

SEQ ID NO: 512259 - DNA, 20 bp, Artificial Sequence
  chemically synthesized
atttcctgagggactacttt

SEQ ID NO: 512260 - DNA, 20 bp, Artificial Sequence
  chemically synthesized
attaactgtaaaataagata

SEQ ID NO: 512261 - DNA, 20 bp, Artificial Sequence
  chemically synthesized
aataagatagaggataaaaa

SEQ ID NO: 512262 - DNA, 20 bp, Artificial Sequence
  chemically synthesized
ttccatgtatttttctgctt

SEQ ID NO: 512263 - DNA, 20 bp, Artificial Sequence
  chemically synthesized
ttctgaagcagaaaaataca

SEQ ID NO: 512264 - DNA, 20 bp, Artificial Sequence
  chemically synthesized
tggaatcagaagcaaagatg

SEQ ID NO: 512265 - DNA, 20 bp, Artificial Sequence
  chemically synthesized
catttaagaagaataattac

SEQ ID NO: 512266 - DNA, 20 bp, Artificial Sequence
  chemically synthesized
ggatttttgtgacatttaag

SEQ ID NO: 512267 - DNA, 20 bp, Artificial Sequence
  chemically synthesized
agtggaatagtaatagttgg

SEQ ID NO: 512268 - DNA, 20 bp, Artificial Sequence
  chemically synthesized
catctccacatacatagcag

SEQ ID NO: 512269 - DNA, 20 bp, Artificial Sequence
  chemically synthesized
ttgggtacgttacctaataa

SEQ ID NO: 512270 - DNA, 20 bp, Artificial Sequence
  chemically synthesized
aattattaggtaacgtaccc

SEQ ID NO: 512271 - DNA, 20 bp, Artificial Sequence
  chemically synthesized
ttttattatctaattgatcc

SEQ ID NO: 512272 - DNA, 20 bp, Artificial Sequence
  chemically synthesized
ggagacataagtatgtgaaa

SEQ ID NO: 512273 - DNA, 20 bp, Artificial Sequence
  chemically synthesized
ggtactaacaaatatgacaa

SEQ ID NO: 512274 - DNA, 20 bp, Artificial Sequence
  chemically synthesized
tgccctactttgttgccaca

SEQ ID NO: 512275 - DNA, 20 bp, Artificial Sequence
  chemically synthesized
agaagagaaatggaaaggtc

SEQ ID NO: 512276 - DNA, 20 bp, Artificial Sequence
  chemically synthesized
taatctcaagggacatacag

SEQ ID NO: 512277 - DNA, 20 bp, Artificial Sequence
  chemically synthesized
tagtgttcaataaatgcttg

SEQ ID NO: 512278 - DNA, 20 bp, Artificial Sequence
  chemically synthesized
gttcaataaatgcttggtga

SEQ ID NO: 512279 - DNA, 20 bp, Artificial Sequence
  chemically synthesized
tgaattggtgaaaataactt

SEQ ID NO: 512280 - DNA, 20 bp, Artificial Sequence
  chemically synthesized
atggttgcaggagggaagaa

SEQ ID NO: 512281 - DNA, 20 bp, Artificial Sequence
  chemically synthesized
cccattccttgcaagtaaac

SEQ ID NO: 512282 - DNA, 20 bp, Artificial Sequence
  chemically synthesized
catattcaggtttacttgca

SEQ ID NO: 512283 - DNA, 20 bp, Artificial Sequence
  chemically synthesized
tacttgcaaggaatgggaaa

SEQ ID NO: 512284 - DNA, 20 bp, Artificial Sequence
  chemically synthesized
taccttttgatctagctatc

SEQ ID NO: 512285 - DNA, 20 bp, Artificial Sequence
  chemically synthesized
gaggtatcatgctaggaacc

SEQ ID NO: 512286 - DNA, 20 bp, Artificial Sequence
  chemically synthesized
atgtgaggtacaaaaagcta

SEQ ID NO: 512287 - DNA, 20 bp, Artificial Sequence
  chemically synthesized
atgacatgattttctatacc

SEQ ID NO: 512288 - DNA, 20 bp, Artificial Sequence
  chemically synthesized
ttttgccttgctatttcacc

SEQ ID NO: 512289 - DNA, 20 bp, Artificial Sequence
  chemically synthesized
cttgataggtagaaataggg

SEQ ID NO: 512290 - DNA, 20 bp, Artificial Sequence
  chemically synthesized
agagagagaaataatgcccg

SEQ ID NO: 512291 - DNA, 20 bp, Artificial Sequence
  chemically synthesized
taacatttaagtgtagtcca

SEQ ID NO: 512292 - DNA, 20 bp, Artificial Sequence
  chemically synthesized
cacttgtaaacatcttggac

SEQ ID NO: 512293 - DNA, 20 bp, Artificial Sequence
  chemically synthesized
gaaatccctggataggccag

SEQ ID NO: 512294 - DNA, 20 bp, Artificial Sequence
  chemically synthesized
taaacccacctggcctatcc

SEQ ID NO: 512295 - DNA, 20 bp, Artificial Sequence
  chemically synthesized
tgtgcttcttgaagaaatcc

SEQ ID NO: 512296 - DNA, 20 bp, Artificial Sequence
  chemically synthesized
tatatactggggatttagtg

SEQ ID NO: 512297 - DNA, 20 bp, Artificial Sequence
  chemically synthesized
aaatgagcagattatatact

SEQ ID NO: 512298 - DNA, 20 bp, Artificial Sequence
  chemically synthesized
agagagacactcagaagtct

SEQ ID NO: 512299 - DNA, 20 bp, Artificial Sequence
  chemically synthesized
agcacacaattctaagactt

SEQ ID NO: 512300 - DNA, 20 bp, Artificial Sequence
  chemically synthesized
gtcttagaattgtgtgcttc

SEQ ID NO: 512301 - DNA, 20 bp, Artificial Sequence
  chemically synthesized
ttgtgtgcttctagaataca

SEQ ID NO: 512302 - DNA, 20 bp, Artificial Sequence
  chemically synthesized
acaaagaatttccacaatca

SEQ ID NO: 512303 - DNA, 20 bp, Artificial Sequence
  chemically synthesized
attactattttcacagcttt

SEQ ID NO: 512304 - DNA, 20 bp, Artificial Sequence
  chemically synthesized
attggccatttttctgggga

SEQ ID NO: 512305 - DNA, 20 bp, Artificial Sequence
  chemically synthesized
tgattccacatggaaatcta

SEQ ID NO: 512306 - DNA, 20 bp, Artificial Sequence
  chemically synthesized
ccacccagtagatttccatg

SEQ ID NO: 512307 - DNA, 20 bp, Artificial Sequence
  chemically synthesized
agtcagatgccataaatgac

SEQ ID NO: 512308 - DNA, 20 bp, Artificial Sequence
  chemically synthesized
gccataaatgactggagtgg

SEQ ID NO: 512309 - DNA, 20 bp, Artificial Sequence
  chemically synthesized
ggagtggcagagtctgtcag

SEQ ID NO: 512310 - DNA, 20 bp, Artificial Sequence
  chemically synthesized
ttacataaactgtgtgtatg

SEQ ID NO: 512311 - DNA, 20 bp, Artificial Sequence
  chemically synthesized
atgtgcccgctttgagggag

SEQ ID NO: 512312 - DNA, 20 bp, Artificial Sequence
  chemically synthesized
gcaccatcctggtagtactg

SEQ ID NO: 512313 - DNA, 20 bp, Artificial Sequence
  chemically synthesized
gtagcactcctcagtactac

SEQ ID NO: 512314 - DNA, 20 bp, Artificial Sequence
  chemically synthesized
ctaccaggatggtgccattg

SEQ ID NO: 512315 - DNA, 20 bp, Artificial Sequence
  chemically synthesized
atctacaccttactacagat

SEQ ID NO: 512316 - DNA, 20 bp, Artificial Sequence
  chemically synthesized
agatcaaacaaaacatatct

SEQ ID NO: 512317 - DNA, 20 bp, Artificial Sequence
  chemically synthesized
atctgttcacatacttaaac

SEQ ID NO: 512318 - DNA, 20 bp, Artificial Sequence
  chemically synthesized
atctcggcctcccaaagtgc

SEQ ID NO: 512319 - DNA, 20 bp, Artificial Sequence
  chemically synthesized
ctgggtttcactgtgttagc

SEQ ID NO: 512320 - DNA, 20 bp, Artificial Sequence
  chemically synthesized
ttttgtgtttttagtagaga

SEQ ID NO: 512321 - DNA, 20 bp, Artificial Sequence
  chemically synthesized
gtctcagcctcccgagtagc

SEQ ID NO: 512322 - DNA, 20 bp, Artificial Sequence
  chemically synthesized
attcctcctgtctcagcctc

SEQ ID NO: 512323 - DNA, 20 bp, Artificial Sequence
  chemically synthesized
actcgggaggctgagacagg

SEQ ID NO: 512324 - DNA, 20 bp, Artificial Sequence
  chemically synthesized
tcttgctctgtcacctagac

SEQ ID NO: 512325 - DNA, 20 bp, Artificial Sequence
  chemically synthesized
ttttttttctttttttgaga

SEQ ID NO: 512326 - DNA, 20 bp, Artificial Sequence
  chemically synthesized
tcaaaaaaaacaaaaaaacc

SEQ ID NO: 512327 - DNA, 20 bp, Artificial Sequence
  chemically synthesized
caggagagctagtcaggact

SEQ ID NO: 512328 - DNA, 20 bp, Artificial Sequence
  chemically synthesized
cctgactagctctcctgcag

SEQ ID NO: 512329 - DNA, 20 bp, Artificial Sequence
  chemically synthesized
tctcctgcaggagagtgtta

SEQ ID NO: 512330 - DNA, 20 bp, Artificial Sequence
  chemically synthesized
aataggtgaccatcggttga

SEQ ID NO: 512331 - DNA, 20 bp, Artificial Sequence
  chemically synthesized
tttgtggaatggataaataa

SEQ ID NO: 512332 - DNA, 20 bp, Artificial Sequence
  chemically synthesized
aggtgaaaaatgtttgtgga

SEQ ID NO: 512333 - DNA, 20 bp, Artificial Sequence
  chemically synthesized
tggtaggtgaaaaatgtttg

SEQ ID NO: 512334 - DNA, 20 bp, Artificial Sequence
  chemically synthesized
actgtatagccagtagctag

SEQ ID NO: 512335 - DNA, 20 bp, Artificial Sequence
  chemically synthesized
ttcttctctgcttcccctac

SEQ ID NO: 512336 - DNA, 20 bp, Artificial Sequence
  chemically synthesized
atgattttaaagcaagaagt

SEQ ID NO: 512337 - DNA, 20 bp, Artificial Sequence
  chemically synthesized
tttaaagcaagaagtgtgaa

SEQ ID NO: 512338 - DNA, 20 bp, Artificial Sequence
  chemically synthesized
aagaagtgtgaataggatac

SEQ ID NO: 512339 - DNA, 20 bp, Artificial Sequence
  chemically synthesized
tttacatatggtagactgca

SEQ ID NO: 512340 - DNA, 20 bp, Artificial Sequence
  chemically synthesized
ccgaaaggtctcatcttcag

SEQ ID NO: 512341 - DNA, 20 bp, Artificial Sequence
  chemically synthesized
atgagacctttcggctcaga

SEQ ID NO: 512342 - DNA, 20 bp, Artificial Sequence
  chemically synthesized
caagcaggggacagatcaca

SEQ ID NO: 512343 - DNA, 20 bp, Artificial Sequence
  chemically synthesized
attgtacttagaaaaatgtc

SEQ ID NO: 512344 - DNA, 20 bp, Artificial Sequence
  chemically synthesized
acatttttctaagtacaatg

SEQ ID NO: 512345 - DNA, 20 bp, Artificial Sequence
  chemically synthesized
actgcaatattaggaggcta

SEQ ID NO: 512346 - DNA, 20 bp, Artificial Sequence
  chemically synthesized
taggaggctatggaatatga

SEQ ID NO: 512347 - DNA, 20 bp, Artificial Sequence
  chemically synthesized
gagtgtcagtggtgcttcct

SEQ ID NO: 512348 - DNA, 20 bp, Artificial Sequence
  chemically synthesized
ccttatttctcctgcattaa

SEQ ID NO: 512349 - DNA, 20 bp, Artificial Sequence
  chemically synthesized
ggtcatttatatgatatgtc

SEQ ID NO: 512350 - DNA, 20 bp, Artificial Sequence
  chemically synthesized
cctattaatacaaagatgtc

SEQ ID NO: 512351 - DNA, 20 bp, Artificial Sequence
  chemically synthesized
attctgaataaacaatactt

SEQ ID NO: 512352 - DNA, 20 bp, Artificial Sequence
  chemically synthesized
attcaaaagtattgtttatt

SEQ ID NO: 512353 - DNA, 20 bp, Artificial Sequence
  chemically synthesized
aacgattgtattaaataatt

SEQ ID NO: 512354 - DNA, 20 bp, Artificial Sequence
  chemically synthesized
aatgttattaaatattatct

SEQ ID NO: 512355 - DNA, 20 bp, Artificial Sequence
  chemically synthesized
tctcaggatcttgaagtcta

SEQ ID NO: 512356 - DNA, 20 bp, Artificial Sequence
  chemically synthesized
tggattgttatgctgattta

SEQ ID NO: 512357 - DNA, 20 bp, Artificial Sequence
  chemically synthesized
tgatacattattttggccta

SEQ ID NO: 512358 - DNA, 20 bp, Artificial Sequence
  chemically synthesized
gctttagtgtattcatatgt

SEQ ID NO: 512359 - DNA, 20 bp, Artificial Sequence
  chemically synthesized
gccaaaattcatcctcacat

SEQ ID NO: 512360 - DNA, 20 bp, Artificial Sequence
  chemically synthesized
tagtgtattcatatgtgagg

SEQ ID NO: 512361 - DNA, 20 bp, Artificial Sequence
  chemically synthesized
ttagtggtgtttagagcatg

SEQ ID NO: 512362 - DNA, 20 bp, Artificial Sequence
  chemically synthesized
accactaagggagaaaagtg

SEQ ID NO: 512363 - DNA, 20 bp, Artificial Sequence
  chemically synthesized
accattactgtgctttgaac

SEQ ID NO: 512364 - DNA, 20 bp, Artificial Sequence
  chemically synthesized
gtgtctaccttgatatcttt

SEQ ID NO: 512365 - DNA, 20 bp, Artificial Sequence
  chemically synthesized
tgctttttttctatgttaat

SEQ ID NO: 512366 - DNA, 20 bp, Artificial Sequence
  chemically synthesized
tcagtaatagtaaatgaggc

SEQ ID NO: 512367 - DNA, 20 bp, Artificial Sequence
  chemically synthesized
ctgaagcaaaacgaaatact

SEQ ID NO: 512368 - DNA, 20 bp, Artificial Sequence
  chemically synthesized
tatttaggctgtttttaatt

SEQ ID NO: 512369 - DNA, 20 bp, Artificial Sequence
  chemically synthesized
aattaaaaacagcctaaata

SEQ ID NO: 512370 - DNA, 20 bp, Artificial Sequence
  chemically synthesized
atagcatactgttgttgtgt

SEQ ID NO: 512371 - DNA, 20 bp, Artificial Sequence
  chemically synthesized
gcacacaacaacagtatgct

SEQ ID NO: 512372 - DNA, 20 bp, Artificial Sequence
  chemically synthesized
attttcgttatcagtttagg

SEQ ID NO: 512373 - DNA, 20 bp, Artificial Sequence
  chemically synthesized
tgataacgaaaatctttaaa

SEQ ID NO: 512374 - DNA, 20 bp, Artificial Sequence
  chemically synthesized
aatatatttcacagtatgca

SEQ ID NO: 512375 - DNA, 20 bp, Artificial Sequence
  chemically synthesized
aatggactacataattccat

SEQ ID NO: 512376 - DNA, 20 bp, Artificial Sequence
  chemically synthesized
aacctcaacttaaacccaaa

SEQ ID NO: 512377 - DNA, 20 bp, Artificial Sequence
  chemically synthesized
caattgtatgcctattgtct

SEQ ID NO: 512378 - DNA, 20 bp, Artificial Sequence
  chemically synthesized
gattcataagtgttggatga

SEQ ID NO: 512379 - DNA, 20 bp, Artificial Sequence
  chemically synthesized
aactcaatcatccaacactt

SEQ ID NO: 512380 - DNA, 20 bp, Artificial Sequence
  chemically synthesized
aatgtttggattcataagtg

SEQ ID NO: 512381 - DNA, 20 bp, Artificial Sequence
  chemically synthesized
tgtaaagttttagaaaatgt

SEQ ID NO: 512382 - DNA, 20 bp, Artificial Sequence
  chemically synthesized
attgtatgcttataaatgat

SEQ ID NO: 512383 - DNA, 20 bp, Artificial Sequence
  chemically synthesized
aatttttggaggtggatggt

SEQ ID NO: 512384 - DNA, 20 bp, Artificial Sequence
  chemically synthesized
ggggaagataatttttggag

SEQ ID NO: 512385 - DNA, 20 bp, Artificial Sequence
  chemically synthesized
aaggtatggggagttattta

SEQ ID NO: 512386 - DNA, 20 bp, Artificial Sequence
  chemically synthesized
gctgggggagagaaggtatg

SEQ ID NO: 512387 - DNA, 20 bp, Artificial Sequence
  chemically synthesized
agtaaaatgcatagataaag

SEQ ID NO: 512388 - DNA, 20 bp, Artificial Sequence
  chemically synthesized
ctctagatagctcatacaaa

SEQ ID NO: 512389 - DNA, 20 bp, Artificial Sequence
  chemically synthesized
ggggaaaaagccagatacaa

SEQ ID NO: 512390 - DNA, 20 bp, Artificial Sequence
  chemically synthesized
tgacacacattatagcatgg

SEQ ID NO: 512391 - DNA, 20 bp, Artificial Sequence
  chemically synthesized
gttctgacacacattatagc

SEQ ID NO: 512392 - DNA, 20 bp, Artificial Sequence
  chemically synthesized
gtgtcagaactttcttaagg

SEQ ID NO: 512393 - DNA, 20 bp, Artificial Sequence
  chemically synthesized
aatgtggtaaatgtatacag

SEQ ID NO: 512394 - DNA, 20 bp, Artificial Sequence
  chemically synthesized
aaatgtccatctgaagatga

SEQ ID NO: 512395 - DNA, 20 bp, Artificial Sequence
  chemically synthesized
actcaaatgtccatctgaag

SEQ ID NO: 512396 - DNA, 20 bp, Artificial Sequence
  chemically synthesized
attcatcttcagatggacat

SEQ ID NO: 512397 - DNA, 20 bp, Artificial Sequence
  chemically synthesized
ttgctccatcttttgctact

SEQ ID NO: 512398 - DNA, 20 bp, Artificial Sequence
  chemically synthesized
tgaataatgctgctataaac

SEQ ID NO: 512399 - DNA, 20 bp, Artificial Sequence
  chemically synthesized
aggtccttttttcaattctt

SEQ ID NO: 512400 - DNA, 20 bp, Artificial Sequence
  chemically synthesized
acttctgggaatatactcaa

SEQ ID NO: 512401 - DNA, 20 bp, Artificial Sequence
  chemically synthesized
tttgagtatattcccagaag

SEQ ID NO: 512402 - DNA, 20 bp, Artificial Sequence
  chemically synthesized
gatccagcaattccacttct

SEQ ID NO: 512403 - DNA, 20 bp, Artificial Sequence
  chemically synthesized
tattcccagaagtggaattg

SEQ ID NO: 512404 - DNA, 20 bp, Artificial Sequence
  chemically synthesized
gtttctcaaaatatagaacg

SEQ ID NO: 512405 - DNA, 20 bp, Artificial Sequence
  chemically synthesized
aacacttgtgaactgctgga

SEQ ID NO: 512406 - DNA, 20 bp, Artificial Sequence
  chemically synthesized
cccagaaaataaatatggtt

SEQ ID NO: 512407 - DNA, 20 bp, Artificial Sequence
  chemically synthesized
tcctcaaccatatttatttt

SEQ ID NO: 512408 - DNA, 20 bp, Artificial Sequence
  chemically synthesized
ttaaaataatcatcatccta

SEQ ID NO: 512409 - DNA, 20 bp, Artificial Sequence
  chemically synthesized
agatagcacttcacacccat

SEQ ID NO: 512410 - DNA, 20 bp, Artificial Sequence
  chemically synthesized
gtgtgaagtgctatctcatt

SEQ ID NO: 512411 - DNA, 20 bp, Artificial Sequence
  chemically synthesized
aaagtttggccagtaagacc

SEQ ID NO: 512412 - DNA, 20 bp, Artificial Sequence
  chemically synthesized
gcaattaaaaaaatgaataa

SEQ ID NO: 512413 - DNA, 20 bp, Artificial Sequence
  chemically synthesized
gaaaaacagcaattaaaaaa

SEQ ID NO: 512414 - DNA, 20 bp, Artificial Sequence
  chemically synthesized
taattgctgtttttctgttg

SEQ ID NO: 512415 - DNA, 20 bp, Artificial Sequence
  chemically synthesized
acagttaaattatatcatcg

SEQ ID NO: 512416 - DNA, 20 bp, Artificial Sequence
  chemically synthesized
attacaattcaacatgagat

SEQ ID NO: 512417 - DNA, 20 bp, Artificial Sequence
  chemically synthesized
gtccccactcaaatctcatg

SEQ ID NO: 512418 - DNA, 20 bp, Artificial Sequence
  chemically synthesized
tgaattgtaatccccaatgt

SEQ ID NO: 512419 - DNA, 20 bp, Artificial Sequence
  chemically synthesized
cagacaccaactccaacatt

SEQ ID NO: 512420 - DNA, 20 bp, Artificial Sequence
  chemically synthesized
tggtgtctggtgggaggtga

SEQ ID NO: 512421 - DNA, 20 bp, Artificial Sequence
  chemically synthesized
atcactggggcaaatttctg

SEQ ID NO: 512422 - DNA, 20 bp, Artificial Sequence
  chemically synthesized
ttggtactattctcgtgata

SEQ ID NO: 512423 - DNA, 20 bp, Artificial Sequence
  chemically synthesized
tcataagaactctctatcac

SEQ ID NO: 512424 - DNA, 20 bp, Artificial Sequence
  chemically synthesized
atggtcagaacaggagcaag

SEQ ID NO: 512425 - DNA, 20 bp, Artificial Sequence
  chemically synthesized
gaaacataaagcagaaaggg

SEQ ID NO: 512426 - DNA, 20 bp, Artificial Sequence
  chemically synthesized
ctctaaagaaatatctgaaa

SEQ ID NO: 512427 - DNA, 20 bp, Artificial Sequence
  chemically synthesized
atatttctttagagcaatgc

SEQ ID NO: 512428 - DNA, 20 bp, Artificial Sequence
  chemically synthesized
gcaagaatggactaacatat

SEQ ID NO: 512429 - DNA, 20 bp, Artificial Sequence
  chemically synthesized
ataggagttcttggcacagt

SEQ ID NO: 512430 - DNA, 20 bp, Artificial Sequence
  chemically synthesized
gtctggatattaattcccta

SEQ ID NO: 512431 - DNA, 20 bp, Artificial Sequence
  chemically synthesized
tgcgaatcatatattcaata

SEQ ID NO: 512432 - DNA, 20 bp, Artificial Sequence
  chemically synthesized
cggaatgggagaagatgttt

SEQ ID NO: 512433 - DNA, 20 bp, Artificial Sequence
  chemically synthesized
cagagtgaaaaggcaactta

SEQ ID NO: 512434 - DNA, 20 bp, Artificial Sequence
  chemically synthesized
tgtgcatgaatgaacaccat

SEQ ID NO: 512435 - DNA, 20 bp, Artificial Sequence
  chemically synthesized
aacattaaaaacttctgtgc

SEQ ID NO: 512436 - DNA, 20 bp, Artificial Sequence
  chemically synthesized
agattgggcaattaaatatc

SEQ ID NO: 512437 - DNA, 20 bp, Artificial Sequence
  chemically synthesized
tacacaaaaattaagtcaaa

SEQ ID NO: 512438 - DNA, 20 bp, Artificial Sequence
  chemically synthesized
ttaatttttgtgtattttat

SEQ ID NO: 512439 - DNA, 20 bp, Artificial Sequence
  chemically synthesized
ccacaaatgttgctaagaaa

SEQ ID NO: 512440 - DNA, 20 bp, Artificial Sequence
  chemically synthesized
aattgtttgacaatatatag

SEQ ID NO: 512441 - DNA, 20 bp, Artificial Sequence
  chemically synthesized
aaaaagggaatgtagaacaa

SEQ ID NO: 512442 - DNA, 20 bp, Artificial Sequence
  chemically synthesized
gtggtattggcttaaaaaaa

SEQ ID NO: 512443 - DNA, 20 bp, Artificial Sequence
  chemically synthesized
ttgaaaaaagaatgaagttg

SEQ ID NO: 512444 - DNA, 20 bp, Artificial Sequence
  chemically synthesized
agttgaaacgatcttgaaaa

SEQ ID NO: 512445 - DNA, 20 bp, Artificial Sequence
  chemically synthesized
caagatcgtttcaactattc

SEQ ID NO: 512446 - DNA, 20 bp, Artificial Sequence
  chemically synthesized
ccatgtaatctcatggatcc

SEQ ID NO: 512447 - DNA, 20 bp, Artificial Sequence
  chemically synthesized
aaaaattcccatgtaatctc

SEQ ID NO: 512448 - DNA, 20 bp, Artificial Sequence
  chemically synthesized
ctggatccatgagattacat

SEQ ID NO: 512449 - DNA, 20 bp, Artificial Sequence
  chemically synthesized
gattacatgggaatttttga

SEQ ID NO: 512450 - DNA, 20 bp, Artificial Sequence
  chemically synthesized
atttctgcagaaaaactaat

SEQ ID NO: 512451 - DNA, 20 bp, Artificial Sequence
  chemically synthesized
ggattttcttagagatggca

SEQ ID NO: 512452 - DNA, 20 bp, Artificial Sequence
  chemically synthesized
cactgaatgtgtagtttgtt

SEQ ID NO: 512453 - DNA, 20 bp, Artificial Sequence
  chemically synthesized
tgtagtttgttttgagtaac

SEQ ID NO: 512454 - DNA, 20 bp, Artificial Sequence
  chemically synthesized
caatattgttgttgaggtat

SEQ ID NO: 512455 - DNA, 20 bp, Artificial Sequence
  chemically synthesized
cggatacctcaacaacaata

SEQ ID NO: 512456 - DNA, 20 bp, Artificial Sequence
  chemically synthesized
agtgttccatttcataaacc

SEQ ID NO: 512457 - DNA, 20 bp, Artificial Sequence
  chemically synthesized
aataaatgtttaatttcttt

SEQ ID NO: 512458 - DNA, 20 bp, Artificial Sequence
  chemically synthesized
acaaaaagagtaaaatactt

SEQ ID NO: 512459 - DNA, 20 bp, Artificial Sequence
  chemically synthesized
ttatttaaaatagtaacaaa

SEQ ID NO: 512460 - DNA, 20 bp, Artificial Sequence
  chemically synthesized
gttttttgtgtggaaatctc

SEQ ID NO: 512461 - DNA, 20 bp, Artificial Sequence
  chemically synthesized
atcagaaaaatcagctttga

SEQ ID NO: 512462 - DNA, 20 bp, Artificial Sequence
  chemically synthesized
tttgaaatgcattgcacagc

SEQ ID NO: 512463 - DNA, 20 bp, Artificial Sequence
  chemically synthesized
cacagcatgaatatagttaa

SEQ ID NO: 512464 - DNA, 20 bp, Artificial Sequence
  chemically synthesized
gctcatttcgaagctgctaa

SEQ ID NO: 512465 - DNA, 20 bp, Artificial Sequence
  chemically synthesized
tagaatttatgaatacaatg

SEQ ID NO: 512466 - DNA, 20 bp, Artificial Sequence
  chemically synthesized
acaaagtgatggtagaattt

SEQ ID NO: 512467 - DNA, 20 bp, Artificial Sequence
  chemically synthesized
tatggcatacaaagtgatgg

SEQ ID NO: 512468 - DNA, 20 bp, Artificial Sequence
  chemically synthesized
gcaagcattaaagactttaa

SEQ ID NO: 512469 - DNA, 20 bp, Artificial Sequence
  chemically synthesized
gcggcattggacagcttgaa

SEQ ID NO: 512470 - DNA, 20 bp, Artificial Sequence
  chemically synthesized
ttaatgcggcattggacagc

SEQ ID NO: 512471 - DNA, 20 bp, Artificial Sequence
  chemically synthesized
ctattactatgcctataatg

SEQ ID NO: 512472 - DNA, 20 bp, Artificial Sequence
  chemically synthesized
ccgcattataggcatagtaa

SEQ ID NO: 512473 - DNA, 20 bp, Artificial Sequence
  chemically synthesized
taaaataaaatattctcatc

SEQ ID NO: 512474 - DNA, 20 bp, Artificial Sequence
  chemically synthesized
tgaaattactaattcatgat

SEQ ID NO: 512475 - DNA, 20 bp, Artificial Sequence
  chemically synthesized
tttttgaggctcatttgcat

SEQ ID NO: 512476 - DNA, 20 bp, Artificial Sequence
  chemically synthesized
tacttttttggaaaagaaat

SEQ ID NO: 512477 - DNA, 20 bp, Artificial Sequence
  chemically synthesized
ctgttttctaaattttacac

SEQ ID NO: 512478 - DNA, 20 bp, Artificial Sequence
  chemically synthesized
aaaattttgtaaaaacttat

SEQ ID NO: 512479 - DNA, 20 bp, Artificial Sequence
  chemically synthesized
tctttagtccatctccattt

SEQ ID NO: 512480 - DNA, 20 bp, Artificial Sequence
  chemically synthesized
tcattttggggttttttttc

SEQ ID NO: 512481 - DNA, 20 bp, Artificial Sequence
  chemically synthesized
tataacacggaaaatcattt

SEQ ID NO: 512482 - DNA, 20 bp, Artificial Sequence
  chemically synthesized
tgaagctttttggtcaattt

SEQ ID NO: 512483 - DNA, 20 bp, Artificial Sequence
  chemically synthesized
tctaaattggatataaacgt

SEQ ID NO: 512484 - DNA, 20 bp, Artificial Sequence
  chemically synthesized
tctgacgtttatatccaatt

SEQ ID NO: 512485 - DNA, 20 bp, Artificial Sequence
  chemically synthesized
aaatagtctgacactctaaa

SEQ ID NO: 512486 - DNA, 20 bp, Artificial Sequence
  chemically synthesized
caagaaaattttgtaatgag

SEQ ID NO: 512487 - DNA, 20 bp, Artificial Sequence
  chemically synthesized
ttggagcccattttctcatc

SEQ ID NO: 512488 - DNA, 20 bp, Artificial Sequence
  chemically synthesized
agctaatgctattttgtcaa

SEQ ID NO: 512489 - DNA, 20 bp, Artificial Sequence
  chemically synthesized
tttgtcaataggatttttgt

SEQ ID NO: 512490 - DNA, 20 bp, Artificial Sequence
  chemically synthesized
agcatcggttcttgtgacag

SEQ ID NO: 512491 - DNA, 20 bp, Artificial Sequence
  chemically synthesized
tatctaattggtgttgaggt

SEQ ID NO: 512492 - DNA, 20 bp, Artificial Sequence
  chemically synthesized
agagatttacagacacatag

SEQ ID NO: 512493 - DNA, 20 bp, Artificial Sequence
  chemically synthesized
aggtgcaatacaccatgcta

SEQ ID NO: 512494 - DNA, 20 bp, Artificial Sequence
  chemically synthesized
taagagatatagatataaca

SEQ ID NO: 512495 - DNA, 20 bp, Artificial Sequence
  chemically synthesized
tataacattgagtgtttcac

SEQ ID NO: 512496 - DNA, 20 bp, Artificial Sequence
  chemically synthesized
agttgaaacattgctggaaa

SEQ ID NO: 512497 - DNA, 20 bp, Artificial Sequence
  chemically synthesized
attatgtaaattgactttga

SEQ ID NO: 512498 - DNA, 20 bp, Artificial Sequence
  chemically synthesized
agtaaaactaagaaacgtca

SEQ ID NO: 512499 - DNA, 20 bp, Artificial Sequence
  chemically synthesized
gaaacgtcagtggataccag

SEQ ID NO: 512500 - DNA, 20 bp, Artificial Sequence
  chemically synthesized
aaagaaaaatatgttaaaaa

SEQ ID NO: 512501 - DNA, 20 bp, Artificial Sequence
  chemically synthesized
tttccgtcagatgctgtctt

SEQ ID NO: 512502 - DNA, 20 bp, Artificial Sequence
  chemically synthesized
gatgctgtctttagaatttg

SEQ ID NO: 512503 - DNA, 20 bp, Artificial Sequence
  chemically synthesized
gggaatagagctattcatcc

SEQ ID NO: 512504 - DNA, 20 bp, Artificial Sequence
  chemically synthesized
tccaagaaacacatccaggg

SEQ ID NO: 512505 - DNA, 20 bp, Artificial Sequence
  chemically synthesized
catctccaagaaacacatcc

SEQ ID NO: 512506 - DNA, 20 bp, Artificial Sequence
  chemically synthesized
gatacaatctttgcccactc

SEQ ID NO: 512507 - DNA, 20 bp, Artificial Sequence
  chemically synthesized
cacaaagctttatgaaaccc

SEQ ID NO: 512508 - DNA, 20 bp, Artificial Sequence
  chemically synthesized
cccttcatgacatatgaatg

SEQ ID NO: 512509 - DNA, 20 bp, Artificial Sequence
  chemically synthesized
gctggttcccttcatgacat

SEQ ID NO: 512510 - DNA, 20 bp, Artificial Sequence
  chemically synthesized
aaatcaacaaaattcaatgt

SEQ ID NO: 512511 - DNA, 20 bp, Artificial Sequence
  chemically synthesized
aaaaatgatacattctgaca

SEQ ID NO: 512512 - DNA, 20 bp, Artificial Sequence
  chemically synthesized
gattataatttctaaaatga

SEQ ID NO: 512513 - DNA, 20 bp, Artificial Sequence
  chemically synthesized
taagaaaatcgtggtcccag

SEQ ID NO: 512514 - DNA, 20 bp, Artificial Sequence
  chemically synthesized
ggaccacgattttcttaaca

SEQ ID NO: 512515 - DNA, 20 bp, Artificial Sequence
  chemically synthesized
acgattttcttaacatagaa

SEQ ID NO: 512516 - DNA, 20 bp, Artificial Sequence
  chemically synthesized
ttaacatagaattgaatcta

SEQ ID NO: 512517 - DNA, 20 bp, Artificial Sequence
  chemically synthesized
aaggataatgcagtggctgg

SEQ ID NO: 512518 - DNA, 20 bp, Artificial Sequence
  chemically synthesized
atatagccatgcctgtctac

SEQ ID NO: 512519 - DNA, 20 bp, Artificial Sequence
  chemically synthesized
cccttcactttccacatgaa

SEQ ID NO: 512520 - DNA, 20 bp, Artificial Sequence
  chemically synthesized
ccagccacgtggaaccgtaa

SEQ ID NO: 512521 - DNA, 20 bp, Artificial Sequence
  chemically synthesized
catttacggttccacgtggc

SEQ ID NO: 512522 - DNA, 20 bp, Artificial Sequence
  chemically synthesized
gggtggcctcacaatcatgg

SEQ ID NO: 512523 - DNA, 20 bp, Artificial Sequence
  chemically synthesized
acgagaaggtaacttgtgca

SEQ ID NO: 512524 - DNA, 20 bp, Artificial Sequence
  chemically synthesized
agtggcccagtgggaggtaa

SEQ ID NO: 512525 - DNA, 20 bp, Artificial Sequence
  chemically synthesized
cttgaattcccacgtgttct

SEQ ID NO: 512526 - DNA, 20 bp, Artificial Sequence
  chemically synthesized
gggccactcccagaacacgt

SEQ ID NO: 512527 - DNA, 20 bp, Artificial Sequence
  chemically synthesized
gtccccacccaaattgcatc

SEQ ID NO: 512528 - DNA, 20 bp, Artificial Sequence
  chemically synthesized
gtgggaattcaagatgcaat

SEQ ID NO: 512529 - DNA, 20 bp, Artificial Sequence
  chemically synthesized
caaagtgtgatctcgtgtca

SEQ ID NO: 512530 - DNA, 20 bp, Artificial Sequence
  chemically synthesized
ttgtttctgatgatttaaat

SEQ ID NO: 512531 - DNA, 20 bp, Artificial Sequence
  chemically synthesized
atgatttaaataagaattaa

SEQ ID NO: 512532 - DNA, 20 bp, Artificial Sequence
  chemically synthesized
gtcttgatggcctggtgcaa

SEQ ID NO: 512533 - DNA, 20 bp, Artificial Sequence
  chemically synthesized
ttggaaagatataagagcag

SEQ ID NO: 512534 - DNA, 20 bp, Artificial Sequence
  chemically synthesized
ggctataagctgtagtacca

SEQ ID NO: 512535 - DNA, 20 bp, Artificial Sequence
  chemically synthesized
actcaatttactaataaaac

SEQ ID NO: 512536 - DNA, 20 bp, Artificial Sequence
  chemically synthesized
attctagttttattagtaaa

SEQ ID NO: 512537 - DNA, 20 bp, Artificial Sequence
  chemically synthesized
ttttttttttctggtttttc

SEQ ID NO: 512538 - DNA, 20 bp, Artificial Sequence
  chemically synthesized
tgaaatataaaccagcttca

SEQ ID NO: 512539 - DNA, 20 bp, Artificial Sequence
  chemically synthesized
atgcatagtctgtactaagt

SEQ ID NO: 512540 - DNA, 20 bp, Artificial Sequence
  chemically synthesized
tacatgttcctgaaccacaa

SEQ ID NO: 512541 - DNA, 20 bp, Artificial Sequence
  chemically synthesized
ccttcagttacaccaacctt

SEQ ID NO: 512542 - DNA, 20 bp, Artificial Sequence
  chemically synthesized
gtgtaactgaaggttagttt

SEQ ID NO: 512543 - DNA, 20 bp, Artificial Sequence
  chemically synthesized
aactgaaggttagtttaaga

SEQ ID NO: 512544 - DNA, 20 bp, Artificial Sequence
  chemically synthesized
taaaaggcaggcatagaaag

SEQ ID NO: 512545 - DNA, 20 bp, Artificial Sequence
  chemically synthesized
gattttgtttagaaagaaca

SEQ ID NO: 512546 - DNA, 20 bp, Artificial Sequence
  chemically synthesized
acatggggttgtattaacaa

SEQ ID NO: 512547 - DNA, 20 bp, Artificial Sequence
  chemically synthesized
ttatctgggcagcagttttg

SEQ ID NO: 512548 - DNA, 20 bp, Artificial Sequence
  chemically synthesized
ttttgggggatcatccagca

SEQ ID NO: 512549 - DNA, 20 bp, Artificial Sequence
  chemically synthesized
tttaaattctacattctctg

SEQ ID NO: 512550 - DNA, 20 bp, Artificial Sequence
  chemically synthesized
ggatcatccagcagagaatg

SEQ ID NO: 512551 - DNA, 20 bp, Artificial Sequence
  chemically synthesized
attccgaatagcaatactag

SEQ ID NO: 512552 - DNA, 20 bp, Artificial Sequence
  chemically synthesized
attcctctagtattgctatt

SEQ ID NO: 512553 - DNA, 20 bp, Artificial Sequence
  chemically synthesized
tgtaaatgtagttttctatt

SEQ ID NO: 512554 - DNA, 20 bp, Artificial Sequence
  chemically synthesized
gtaaaatgtttacgtgttct

SEQ ID NO: 512555 - DNA, 20 bp, Artificial Sequence
  chemically synthesized
ataaatatgtcgattacttt

SEQ ID NO: 512556 - DNA, 20 bp, Artificial Sequence
  chemically synthesized
accaaatgtacatttggaga

SEQ ID NO: 512557 - DNA, 20 bp, Artificial Sequence
  chemically synthesized
atgaatgattaaattactaa

SEQ ID NO: 512558 - DNA, 20 bp, Artificial Sequence
  chemically synthesized
atgtttaatgaaaaacataa

SEQ ID NO: 512559 - DNA, 20 bp, Artificial Sequence
  chemically synthesized
taggaccaggagatatagca

SEQ ID NO: 512560 - DNA, 20 bp, Artificial Sequence
  chemically synthesized
cttatttttatttctagtcc

SEQ ID NO: 512561 - DNA, 20 bp, Artificial Sequence
  chemically synthesized
gaggttggctctacttaaga

SEQ ID NO: 512562 - DNA, 20 bp, Artificial Sequence
  chemically synthesized
actacaggaacatttaaaaa

SEQ ID NO: 512563 - DNA, 20 bp, Artificial Sequence
  chemically synthesized
aggaacatttaaaaatagag

SEQ ID NO: 512564 - DNA, 20 bp, Artificial Sequence
  chemically synthesized
gagttgaatgaaataagcag

SEQ ID NO: 512565 - DNA, 20 bp, Artificial Sequence
  chemically synthesized
ttttctccagagagtcatca

SEQ ID NO: 512566 - DNA, 20 bp, Artificial Sequence
  chemically synthesized
atggaaatgtgttttctcca

SEQ ID NO: 512567 - DNA, 20 bp, Artificial Sequence
  chemically synthesized
gaaaacacatttccatatta

SEQ ID NO: 512568 - DNA, 20 bp, Artificial Sequence
  chemically synthesized
gcacttgactcccaatgagc

SEQ ID NO: 512569 - DNA, 20 bp, Artificial Sequence
  chemically synthesized
tagtcagatccaggctcatt

SEQ ID NO: 512570 - DNA, 20 bp, Artificial Sequence
  chemically synthesized
gattacaaagttactttaaa

SEQ ID NO: 512571 - DNA, 20 bp, Artificial Sequence
  chemically synthesized
tacatctaaacattttttgg

SEQ ID NO: 512572 - DNA, 20 bp, Artificial Sequence
  chemically synthesized
gaagccatgtgaaaattaag

SEQ ID NO: 512573 - DNA, 20 bp, Artificial Sequence
  chemically synthesized
ggctggcatgatcactaaat

SEQ ID NO: 512574 - DNA, 20 bp, Artificial Sequence
  chemically synthesized
gtattaacaaaatgggatta

SEQ ID NO: 512575 - DNA, 20 bp, Artificial Sequence
  chemically synthesized
gtgtgtgtgtattaacaaaa

SEQ ID NO: 512576 - DNA, 20 bp, Artificial Sequence
  chemically synthesized
gggcacagaaggagtagtgg

SEQ ID NO: 512577 - DNA, 20 bp, Artificial Sequence
  chemically synthesized
aagccgtattggggcacaga

SEQ ID NO: 512578 - DNA, 20 bp, Artificial Sequence
  chemically synthesized
attgttgttatgcatctttc

SEQ ID NO: 512579 - DNA, 20 bp, Artificial Sequence
  chemically synthesized
tattttggagagtcatcaca

SEQ ID NO: 512580 - DNA, 20 bp, Artificial Sequence
  chemically synthesized
acagaaactcgtatattttg

SEQ ID NO: 512581 - DNA, 20 bp, Artificial Sequence
  chemically synthesized
gtgatgactctccaaaatat

SEQ ID NO: 512582 - DNA, 20 bp, Artificial Sequence
  chemically synthesized
ttttagtttgagcatgtcac

SEQ ID NO: 512583 - DNA, 20 bp, Artificial Sequence
  chemically synthesized
tcaaactaaaagcactgatc

SEQ ID NO: 512584 - DNA, 20 bp, Artificial Sequence
  chemically synthesized
aaagcactgatcaagaatga

SEQ ID NO: 512585 - DNA, 20 bp, Artificial Sequence
  chemically synthesized
gtttatacattattcttctc

SEQ ID NO: 512586 - DNA, 20 bp, Artificial Sequence
  chemically synthesized
atgttgagcccatccttgag

SEQ ID NO: 512587 - DNA, 20 bp, Artificial Sequence
  chemically synthesized
gtatttttatctttttgact

SEQ ID NO: 512588 - DNA, 20 bp, Artificial Sequence
  chemically synthesized
tgaattggctatggcatagt

SEQ ID NO: 512589 - DNA, 20 bp, Artificial Sequence
  chemically synthesized
actatgccatagccaattca

SEQ ID NO: 512590 - DNA, 20 bp, Artificial Sequence
  chemically synthesized
gtgtttccttctattactcc

SEQ ID NO: 512591 - DNA, 20 bp, Artificial Sequence
  chemically synthesized
acagaagaagatagaactag

SEQ ID NO: 512592 - DNA, 20 bp, Artificial Sequence
  chemically synthesized
gtgatttaccatttcaaatt

SEQ ID NO: 512593 - DNA, 20 bp, Artificial Sequence
  chemically synthesized
aacaggtctttgcttcattt

SEQ ID NO: 512594 - DNA, 20 bp, Artificial Sequence
  chemically synthesized
tgcatatagtagaatatgtc

SEQ ID NO: 512595 - DNA, 20 bp, Artificial Sequence
  chemically synthesized
tgggatgtaagtgcatatag

SEQ ID NO: 512596 - DNA, 20 bp, Artificial Sequence
  chemically synthesized
atgcacttacatcccacaag

SEQ ID NO: 512597 - DNA, 20 bp, Artificial Sequence
  chemically synthesized
tccaaaggagattcatcttg

SEQ ID NO: 512598 - DNA, 20 bp, Artificial Sequence
  chemically synthesized
ctaatataagtcattgttag

SEQ ID NO: 512599 - DNA, 20 bp, Artificial Sequence
  chemically synthesized
aaggttaggaaagggagatg

SEQ ID NO: 512600 - DNA, 20 bp, Artificial Sequence
  chemically synthesized
tttacaagggggaacagcaa

SEQ ID NO: 512601 - DNA, 20 bp, Artificial Sequence
  chemically synthesized
atttaaaaatcagcaatagc

SEQ ID NO: 512602 - DNA, 20 bp, Artificial Sequence
  chemically synthesized
gttaaatacttcatatagta

SEQ ID NO: 512603 - DNA, 20 bp, Artificial Sequence
  chemically synthesized
tgcaatgtggttaataataa

SEQ ID NO: 512604 - DNA, 20 bp, Artificial Sequence
  chemically synthesized
catctggtaggtagcagagc

SEQ ID NO: 512605 - DNA, 20 bp, Artificial Sequence
  chemically synthesized
gctcttgagctgcactgtct

SEQ ID NO: 512606 - DNA, 20 bp, Artificial Sequence
  chemically synthesized
taaaacgtctacctctatgt

SEQ ID NO: 512607 - DNA, 20 bp, Artificial Sequence
  chemically synthesized
tttaaagggacaaaaatatt

SEQ ID NO: 512608 - DNA, 20 bp, Artificial Sequence
  chemically synthesized
atagggagaaatgatcaact

SEQ ID NO: 512609 - DNA, 20 bp, Artificial Sequence
  chemically synthesized
taggatacagggattgatta

SEQ ID NO: 512610 - DNA, 20 bp, Artificial Sequence
  chemically synthesized
atattaactctttaggatac

SEQ ID NO: 512611 - DNA, 20 bp, Artificial Sequence
  chemically synthesized
taatcaatccctgtatccta

SEQ ID NO: 512612 - DNA, 20 bp, Artificial Sequence
  chemically synthesized
tacatcctatattaactctt

SEQ ID NO: 512613 - DNA, 20 bp, Artificial Sequence
  chemically synthesized
tgtatcctaaagagttaata

SEQ ID NO: 512614 - DNA, 20 bp, Artificial Sequence
  chemically synthesized
agttaatataggatgtaata

SEQ ID NO: 512615 - DNA, 20 bp, Artificial Sequence
  chemically synthesized
atataggatgatctaagaac

SEQ ID NO: 512616 - DNA, 20 bp, Artificial Sequence
  chemically synthesized
taggggggagtctgttgtat

SEQ ID NO: 512617 - DNA, 20 bp, Artificial Sequence
  chemically synthesized
gactcttgcttgatataggg

SEQ ID NO: 512618 - DNA, 20 bp, Artificial Sequence
  chemically synthesized
gactcccccctatatcaagc

SEQ ID NO: 512619 - DNA, 20 bp, Artificial Sequence
  chemically synthesized
acgattttatgttagccatc

SEQ ID NO: 512620 - DNA, 20 bp, Artificial Sequence
  chemically synthesized
cttggaacacatgagtttgc

SEQ ID NO: 512621 - DNA, 20 bp, Artificial Sequence
  chemically synthesized
gtggtgttatcttggaacac

SEQ ID NO: 512622 - DNA, 20 bp, Artificial Sequence
  chemically synthesized
ggtcagaattagcttaccag

SEQ ID NO: 512623 - DNA, 20 bp, Artificial Sequence
  chemically synthesized
tatgctctcgacagattggt

SEQ ID NO: 512624 - DNA, 20 bp, Artificial Sequence
  chemically synthesized
taagagttttacacgctgag

SEQ ID NO: 512625 - DNA, 20 bp, Artificial Sequence
  chemically synthesized
agcatgacggaaggatactt

SEQ ID NO: 512626 - DNA, 20 bp, Artificial Sequence
  chemically synthesized
tcagaagaggagcatgacgg

SEQ ID NO: 512627 - DNA, 20 bp, Artificial Sequence
  chemically synthesized
aagggtaagcaccaccttca

SEQ ID NO: 512628 - DNA, 20 bp, Artificial Sequence
  chemically synthesized
gcttgttaaatttacaggga

SEQ ID NO: 512629 - DNA, 20 bp, Artificial Sequence
  chemically synthesized
taaatttaacaagctcagct

SEQ ID NO: 512630 - DNA, 20 bp, Artificial Sequence
  chemically synthesized
gctctacttttagtttatga

SEQ ID NO: 512631 - DNA, 20 bp, Artificial Sequence
  chemically synthesized
gtcagctctacttttagttt

SEQ ID NO: 512632 - DNA, 20 bp, Artificial Sequence
  chemically synthesized
ctacataatagttgtacatt

SEQ ID NO: 512633 - DNA, 20 bp, Artificial Sequence
  chemically synthesized
agttgtacatttggggtgca

SEQ ID NO: 512634 - DNA, 20 bp, Artificial Sequence
  chemically synthesized
tgcatgggatattttgatac

SEQ ID NO: 512635 - DNA, 20 bp, Artificial Sequence
  chemically synthesized
aatgataaatgcttgaggtg

SEQ ID NO: 512636 - DNA, 20 bp, Artificial Sequence
  chemically synthesized
tttcaaaataatagttaaat

SEQ ID NO: 512637 - DNA, 20 bp, Artificial Sequence
  chemically synthesized
attggtaactataatcactc

SEQ ID NO: 512638 - DNA, 20 bp, Artificial Sequence
  chemically synthesized
tctagtgtttggtagcaccc

SEQ ID NO: 512639 - DNA, 20 bp, Artificial Sequence
  chemically synthesized
aaagtatatagttagataga

SEQ ID NO: 512640 - DNA, 20 bp, Artificial Sequence
  chemically synthesized
tggggaggacaggataagga

SEQ ID NO: 512641 - DNA, 20 bp, Artificial Sequence
  chemically synthesized
agaagggtaagtggggagga

SEQ ID NO: 512642 - DNA, 20 bp, Artificial Sequence
  chemically synthesized
gatggttaccagatgctgag

SEQ ID NO: 512643 - DNA, 20 bp, Artificial Sequence
  chemically synthesized
gaactcatggagatagagag

SEQ ID NO: 512644 - DNA, 20 bp, Artificial Sequence
  chemically synthesized
tcatcccactctctatctcc

SEQ ID NO: 512645 - DNA, 20 bp, Artificial Sequence
  chemically synthesized
aaattgaactcatggagata

SEQ ID NO: 512646 - DNA, 20 bp, Artificial Sequence
  chemically synthesized
atttactttagctcccacat

SEQ ID NO: 512647 - DNA, 20 bp, Artificial Sequence
  chemically synthesized
ctccttttttaaagctcctc

SEQ ID NO: 512648 - DNA, 20 bp, Artificial Sequence
  chemically synthesized
acagaatatggataggttgt

SEQ ID NO: 512649 - DNA, 20 bp, Artificial Sequence
  chemically synthesized
aaatataggtcagacagaat

SEQ ID NO: 512650 - DNA, 20 bp, Artificial Sequence
  chemically synthesized
aaataaaaatataggtcaga

SEQ ID NO: 512651 - DNA, 20 bp, Artificial Sequence
  chemically synthesized
tatttatactttaattccat

SEQ ID NO: 512652 - DNA, 20 bp, Artificial Sequence
  chemically synthesized
gcccagagcagaaattcaaa

SEQ ID NO: 512653 - DNA, 20 bp, Artificial Sequence
  chemically synthesized
atgatatatttcttctgttc

SEQ ID NO: 512654 - DNA, 20 bp, Artificial Sequence
  chemically synthesized
tataatgtacatactgttgt

SEQ ID NO: 512655 - DNA, 20 bp, Artificial Sequence
  chemically synthesized
tatataaagatgttaagatt

SEQ ID NO: 512656 - DNA, 20 bp, Artificial Sequence
  chemically synthesized
ttagcaggccatttctccta

SEQ ID NO: 512657 - DNA, 20 bp, Artificial Sequence
  chemically synthesized
gaaatggcctgctaaagggc

SEQ ID NO: 512658 - DNA, 20 bp, Artificial Sequence
  chemically synthesized
gttccacgattgtaatataa

SEQ ID NO: 512659 - DNA, 20 bp, Artificial Sequence
  chemically synthesized
ttaacttatttttagtaaaa

SEQ ID NO: 512660 - DNA, 20 bp, Artificial Sequence
  chemically synthesized
tagtcccattacttgaaaga

SEQ ID NO: 512661 - DNA, 20 bp, Artificial Sequence
  chemically synthesized
taatggagaagttgcatctt

SEQ ID NO: 512662 - DNA, 20 bp, Artificial Sequence
  chemically synthesized
agattaacttaagatgctct

SEQ ID NO: 512663 - DNA, 20 bp, Artificial Sequence
  chemically synthesized
caagagcatcttaagttaat

SEQ ID NO: 512664 - DNA, 20 bp, Artificial Sequence
  chemically synthesized
aagtgatagaactacctaga

SEQ ID NO: 512665 - DNA, 20 bp, Artificial Sequence
  chemically synthesized
tccattttcacactgccata

SEQ ID NO: 512666 - DNA, 20 bp, Artificial Sequence
  chemically synthesized
gccataaggaatacctgaga

SEQ ID NO: 512667 - DNA, 20 bp, Artificial Sequence
  chemically synthesized
ttccccagccatgcggaact

SEQ ID NO: 512668 - DNA, 20 bp, Artificial Sequence
  chemically synthesized
ccctcctgccacctagtgaa

SEQ ID NO: 512669 - DNA, 20 bp, Artificial Sequence
  chemically synthesized
cagaacttgtgagaactatc

SEQ ID NO: 512670 - DNA, 20 bp, Artificial Sequence
  chemically synthesized
gatcatttgggggatggggg

SEQ ID NO: 512671 - DNA, 20 bp, Artificial Sequence
  chemically synthesized
attggatcatttgggggatg

SEQ ID NO: 512672 - DNA, 20 bp, Artificial Sequence
  chemically synthesized
gtgggatattggatcatttg

SEQ ID NO: 512673 - DNA, 20 bp, Artificial Sequence
  chemically synthesized
gggagggaactggtgggata

SEQ ID NO: 512674 - DNA, 20 bp, Artificial Sequence
  chemically synthesized
gtgtcaagggagggaactgg

SEQ ID NO: 512675 - DNA, 20 bp, Artificial Sequence
  chemically synthesized
agttccctcccttgacacgt

SEQ ID NO: 512676 - DNA, 20 bp, Artificial Sequence
  chemically synthesized
attacaatttgagacaaaat

SEQ ID NO: 512677 - DNA, 20 bp, Artificial Sequence
  chemically synthesized
caatttgagacaaaatttgg

SEQ ID NO: 512678 - DNA, 20 bp, Artificial Sequence
  chemically synthesized
ggcttgggaggggccgggag

SEQ ID NO: 512679 - DNA, 20 bp, Artificial Sequence
  chemically synthesized
aattttgacttaatgccgaa

SEQ ID NO: 512680 - DNA, 20 bp, Artificial Sequence
  chemically synthesized
ctcagatgaaactttggact

SEQ ID NO: 512681 - DNA, 20 bp, Artificial Sequence
  chemically synthesized
gtacaatgcaggtataagta

SEQ ID NO: 512682 - DNA, 20 bp, Artificial Sequence
  chemically synthesized
tttgaccagtttcccccatt

SEQ ID NO: 512683 - DNA, 20 bp, Artificial Sequence
  chemically synthesized
cctgccctggatatgagaca

SEQ ID NO: 512684 - DNA, 20 bp, Artificial Sequence
  chemically synthesized
accccttgcatcagcctgcc

SEQ ID NO: 512685 - DNA, 20 bp, Artificial Sequence
  chemically synthesized
atccagggcaggctgatgca

SEQ ID NO: 512686 - DNA, 20 bp, Artificial Sequence
  chemically synthesized
gtgcatggtgcaagttgtca

SEQ ID NO: 512687 - DNA, 20 bp, Artificial Sequence
  chemically synthesized
tgtcagtggatctaccattc

SEQ ID NO: 512688 - DNA, 20 bp, Artificial Sequence
  chemically synthesized
gaggcccaccatctagaccc

SEQ ID NO: 512689 - DNA, 20 bp, Artificial Sequence
  chemically synthesized
tggagcccttccccccacca

SEQ ID NO: 512690 - DNA, 20 bp, Artificial Sequence
  chemically synthesized
ggcaatgcaggggggaaatg

SEQ ID NO: 512691 - DNA, 20 bp, Artificial Sequence
  chemically synthesized
gtagaagtctgctgcagggg

SEQ ID NO: 512692 - DNA, 20 bp, Artificial Sequence
  chemically synthesized
tagaggatgtatggaaacac

SEQ ID NO: 512693 - DNA, 20 bp, Artificial Sequence
  chemically synthesized
aacctctgcctagatgtcta

SEQ ID NO: 512694 - DNA, 20 bp, Artificial Sequence
  chemically synthesized
catcttgcaccattgcttca

SEQ ID NO: 512695 - DNA, 20 bp, Artificial Sequence
  chemically synthesized
gacaatggggaaaacgtctt

SEQ ID NO: 512696 - DNA, 20 bp, Artificial Sequence
  chemically synthesized
tttgcataagtaaagagaag

SEQ ID NO: 512697 - DNA, 20 bp, Artificial Sequence
  chemically synthesized
cttgacttactccctagaaa

SEQ ID NO: 512698 - DNA, 20 bp, Artificial Sequence
  chemically synthesized
aaagaaaaacccattttcta

SEQ ID NO: 512699 - DNA, 20 bp, Artificial Sequence
  chemically synthesized
agaaaaagtcaagtcacatc

SEQ ID NO: 512700 - DNA, 20 bp, Artificial Sequence
  chemically synthesized
tttgaacttgagagatgatt

SEQ ID NO: 512701 - DNA, 20 bp, Artificial Sequence
  chemically synthesized
tctctttgctaaagcatagc

SEQ ID NO: 512702 - DNA, 20 bp, Artificial Sequence
  chemically synthesized
atgaggaacttgttgggaac

SEQ ID NO: 512703 - DNA, 20 bp, Artificial Sequence
  chemically synthesized
tggaatttcccagagacttg

SEQ ID NO: 512704 - DNA, 20 bp, Artificial Sequence
  chemically synthesized
cagaaagatgagggagagtt

SEQ ID NO: 512705 - DNA, 20 bp, Artificial Sequence
  chemically synthesized
aagaagacagaaagatgagg

SEQ ID NO: 512706 - DNA, 20 bp, Artificial Sequence
  chemically synthesized
aggttggaacaatttggggg

SEQ ID NO: 512707 - DNA, 20 bp, Artificial Sequence
  chemically synthesized
ttatagaagtgactttggaa

SEQ ID NO: 512708 - DNA, 20 bp, Artificial Sequence
  chemically synthesized
tctgttttcacactgttata

SEQ ID NO: 512709 - DNA, 20 bp, Artificial Sequence
  chemically synthesized
gttataaagagtacctgtgg

SEQ ID NO: 512710 - DNA, 20 bp, Artificial Sequence
  chemically synthesized
tgggtaatttataagtaaaa

SEQ ID NO: 512711 - DNA, 20 bp, Artificial Sequence
  chemically synthesized
ctccccacccatgtagaact

SEQ ID NO: 512712 - DNA, 20 bp, Artificial Sequence
  chemically synthesized
taatagactcacagttctac

SEQ ID NO: 512713 - DNA, 20 bp, Artificial Sequence
  chemically synthesized
gtaccttcttcacagggcag

SEQ ID NO: 512714 - DNA, 20 bp, Artificial Sequence
  chemically synthesized
tgctcttcttgtgatagtgt

SEQ ID NO: 512715 - DNA, 20 bp, Artificial Sequence
  chemically synthesized
agggtcctggtgggaggtga

SEQ ID NO: 512716 - DNA, 20 bp, Artificial Sequence
  chemically synthesized
gtaatccccacgtgtagagg

SEQ ID NO: 512717 - DNA, 20 bp, Artificial Sequence
  chemically synthesized
aggaccctccctctacacgt

SEQ ID NO: 512718 - DNA, 20 bp, Artificial Sequence
  chemically synthesized
attacaatttgagatgagac

SEQ ID NO: 512719 - DNA, 20 bp, Artificial Sequence
  chemically synthesized
attatatcaacttattaatg

SEQ ID NO: 512720 - DNA, 20 bp, Artificial Sequence
  chemically synthesized
acaagcatatttttggttgg

SEQ ID NO: 512721 - DNA, 20 bp, Artificial Sequence
  chemically synthesized
atgcacaagcatatttttgg

SEQ ID NO: 512722 - DNA, 20 bp, Artificial Sequence
  chemically synthesized
tcattcattttatcagtgca

SEQ ID NO: 512723 - DNA, 20 bp, Artificial Sequence
  chemically synthesized
gcattctatgcactgataaa

SEQ ID NO: 512724 - DNA, 20 bp, Artificial Sequence
  chemically synthesized
gataaaatgaatgaagctaa

SEQ ID NO: 512725 - DNA, 20 bp, Artificial Sequence
  chemically synthesized
aggcctcacgccctataaaa

SEQ ID NO: 512726 - DNA, 20 bp, Artificial Sequence
  chemically synthesized
tttttgtttttacagtaatt

SEQ ID NO: 512727 - DNA, 20 bp, Artificial Sequence
  chemically synthesized
gcaacacgctccacaattat

SEQ ID NO: 512728 - DNA, 20 bp, Artificial Sequence
  chemically synthesized
acgagcactgataagattag

SEQ ID NO: 512729 - DNA, 20 bp, Artificial Sequence
  chemically synthesized
cattatcaatttatccaggt

SEQ ID NO: 512730 - DNA, 20 bp, Artificial Sequence
  chemically synthesized
cctagatgtaagattctgac

SEQ ID NO: 512731 - DNA, 20 bp, Artificial Sequence
  chemically synthesized
caggtcagaatcttacatct

SEQ ID NO: 512732 - DNA, 20 bp, Artificial Sequence
  chemically synthesized
gtttggtttctggttggggg

SEQ ID NO: 512733 - DNA, 20 bp, Artificial Sequence
  chemically synthesized
ccattaatttcctagcttgg

SEQ ID NO: 512734 - DNA, 20 bp, Artificial Sequence
  chemically synthesized
ccaagctaggaaattaatgg

SEQ ID NO: 512735 - DNA, 20 bp, Artificial Sequence
  chemically synthesized
gaggatgcaattgaaataac

SEQ ID NO: 512736 - DNA, 20 bp, Artificial Sequence
  chemically synthesized
aaacatattttaagcaagta

SEQ ID NO: 512737 - DNA, 20 bp, Artificial Sequence
  chemically synthesized
attttaagattgtttatggt

SEQ ID NO: 512738 - DNA, 20 bp, Artificial Sequence
  chemically synthesized
gaaataataacagtaagaat

SEQ ID NO: 512739 - DNA, 20 bp, Artificial Sequence
  chemically synthesized
atgactgaaataataacagt

SEQ ID NO: 512740 - DNA, 20 bp, Artificial Sequence
  chemically synthesized
aaagttatgcttccttcaga

SEQ ID NO: 512741 - DNA, 20 bp, Artificial Sequence
  chemically synthesized
cttccttcagatggggtgat

SEQ ID NO: 512742 - DNA, 20 bp, Artificial Sequence
  chemically synthesized
atggggtgattagaataaac

SEQ ID NO: 512743 - DNA, 20 bp, Artificial Sequence
  chemically synthesized
aataaacaagaataagacct

SEQ ID NO: 512744 - DNA, 20 bp, Artificial Sequence
  chemically synthesized
ttttggaaaactgcgaagtc

SEQ ID NO: 512745 - DNA, 20 bp, Artificial Sequence
  chemically synthesized
taaagatttgctcaatagaa

SEQ ID NO: 512746 - DNA, 20 bp, Artificial Sequence
  chemically synthesized
catctgaaatttccttgcag

SEQ ID NO: 512747 - DNA, 20 bp, Artificial Sequence
  chemically synthesized
cttaaggaaagagctatctt

SEQ ID NO: 512748 - DNA, 20 bp, Artificial Sequence
  chemically synthesized
aatgtatacttgatacttaa

SEQ ID NO: 512749 - DNA, 20 bp, Artificial Sequence
  chemically synthesized
cagcgatgtgcacagggcat

SEQ ID NO: 512750 - DNA, 20 bp, Artificial Sequence
  chemically synthesized
gtgcacatcgctgctcaatt

SEQ ID NO: 512751 - DNA, 20 bp, Artificial Sequence
  chemically synthesized
aaatgaatgtgctcatgtgc

SEQ ID NO: 512752 - DNA, 20 bp, Artificial Sequence
  chemically synthesized
attgcttcttgtatggttaa

SEQ ID NO: 512753 - DNA, 20 bp, Artificial Sequence
  chemically synthesized
atacaagaagcaatcccagc

SEQ ID NO: 512754 - DNA, 20 bp, Artificial Sequence
  chemically synthesized
cagttttttagaattcttgc

SEQ ID NO: 512755 - DNA, 20 bp, Artificial Sequence
  chemically synthesized
tcagacatatatcagttttt

SEQ ID NO: 512756 - DNA, 20 bp, Artificial Sequence
  chemically synthesized
tctaaaaaactgatatatgt

SEQ ID NO: 512757 - DNA, 20 bp, Artificial Sequence
  chemically synthesized
gctgttaattaaaaataata

SEQ ID NO: 512758 - DNA, 20 bp, Artificial Sequence
  chemically synthesized
tgtgccaggtaagaagcgta

SEQ ID NO: 512759 - DNA, 20 bp, Artificial Sequence
  chemically synthesized
agaaatccctactgttttca

SEQ ID NO: 512760 - DNA, 20 bp, Artificial Sequence
  chemically synthesized
taatattccctgaaaacagt

SEQ ID NO: 512761 - DNA, 20 bp, Artificial Sequence
  chemically synthesized
ttttttttttttttttttgc

SEQ ID NO: 512762 - DNA, 20 bp, Artificial Sequence
  chemically synthesized
aaaaaatatggactttcgtc

SEQ ID NO: 512763 - DNA, 20 bp, Artificial Sequence
  chemically synthesized
atttctatagggttcgggac

SEQ ID NO: 512764 - DNA, 20 bp, Artificial Sequence
  chemically synthesized
tccagcagtgctcatttcta

SEQ ID NO: 512765 - DNA, 20 bp, Artificial Sequence
  chemically synthesized
tgaacagaaaaaaaactaca

SEQ ID NO: 512766 - DNA, 20 bp, Artificial Sequence
  chemically synthesized
ggaatatgttacaacagtaa

SEQ ID NO: 512767 - DNA, 20 bp, Artificial Sequence
  chemically synthesized
ttttaagccattaagatttt

SEQ ID NO: 512768 - DNA, 20 bp, Artificial Sequence
  chemically synthesized
acaaatgttttatcttacag

SEQ ID NO: 512769 - DNA, 20 bp, Artificial Sequence
  chemically synthesized
gagtaggttagacatctgac

SEQ ID NO: 512770 - DNA, 20 bp, Artificial Sequence
  chemically synthesized
gaacaaagccctgctgttgc

SEQ ID NO: 512771 - DNA, 20 bp, Artificial Sequence
  chemically synthesized
gaaagaaacatgatctcttc

SEQ ID NO: 512772 - DNA, 20 bp, Artificial Sequence
  chemically synthesized
tggaggaagaccaggggtta

SEQ ID NO: 512773 - DNA, 20 bp, Artificial Sequence
  chemically synthesized
ttgaagaatggaggaagacc

SEQ ID NO: 512774 - DNA, 20 bp, Artificial Sequence
  chemically synthesized
acctactgttgttcgctttg

SEQ ID NO: 512775 - DNA, 20 bp, Artificial Sequence
  chemically synthesized
aaagaggcacaagagtaggc

SEQ ID NO: 512776 - DNA, 20 bp, Artificial Sequence
  chemically synthesized
cttaaaaatgaaagaggcac

SEQ ID NO: 512777 - DNA, 20 bp, Artificial Sequence
  chemically synthesized
agtgcacactatgtagtcac

SEQ ID NO: 512778 - DNA, 20 bp, Artificial Sequence
  chemically synthesized
gggagattaacctggattac

SEQ ID NO: 512779 - DNA, 20 bp, Artificial Sequence
  chemically synthesized
aaatagggagggagattaac

SEQ ID NO: 512780 - DNA, 20 bp, Artificial Sequence
  chemically synthesized
gtacatgatacatgacacag

SEQ ID NO: 512781 - DNA, 20 bp, Artificial Sequence
  chemically synthesized
gtactatactcacaggttct

SEQ ID NO: 512782 - DNA, 20 bp, Artificial Sequence
  chemically synthesized
tgtcgaaatccctagaacct

SEQ ID NO: 512783 - DNA, 20 bp, Artificial Sequence
  chemically synthesized
caggttctagggatttcgac

SEQ ID NO: 512784 - DNA, 20 bp, Artificial Sequence
  chemically synthesized
tagttggatgctggctcccc

SEQ ID NO: 512785 - DNA, 20 bp, Artificial Sequence
  chemically synthesized
tttaaactctcctttggtag

SEQ ID NO: 512786 - DNA, 20 bp, Artificial Sequence
  chemically synthesized
ccagcatccaactaccaaag

SEQ ID NO: 512787 - DNA, 20 bp, Artificial Sequence
  chemically synthesized
aacaaaaaagtcgtatcata

SEQ ID NO: 512788 - DNA, 20 bp, Artificial Sequence
  chemically synthesized
tatcggagacaaagtgaaat

SEQ ID NO: 512789 - DNA, 20 bp, Artificial Sequence
  chemically synthesized
atacttgggaataccagaat

SEQ ID NO: 512790 - DNA, 20 bp, Artificial Sequence
  chemically synthesized
tatttaatacttgggaatac

SEQ ID NO: 512791 - DNA, 20 bp, Artificial Sequence
  chemically synthesized
gcccaagatatttaatactt

SEQ ID NO: 512792 - DNA, 20 bp, Artificial Sequence
  chemically synthesized
tttaagctaattgttcatgt

SEQ ID NO: 512793 - DNA, 20 bp, Artificial Sequence
  chemically synthesized
gctactgtgccacctatcag

SEQ ID NO: 512794 - DNA, 20 bp, Artificial Sequence
  chemically synthesized
tcatttgaaactaaatctct

SEQ ID NO: 512795 - DNA, 20 bp, Artificial Sequence
  chemically synthesized
taaaatcaataataaagggg

SEQ ID NO: 512796 - DNA, 20 bp, Artificial Sequence
  chemically synthesized
gcagtaaaatcaataataaa

SEQ ID NO: 512797 - DNA, 20 bp, Artificial Sequence
  chemically synthesized
gattttactgcacacacaca

SEQ ID NO: 512798 - DNA, 20 bp, Artificial Sequence
  chemically synthesized
tttaaaaacctcatgaaaaa

SEQ ID NO: 512799 - DNA, 20 bp, Artificial Sequence
  chemically synthesized
tcattgttcaattcccacct

SEQ ID NO: 512800 - DNA, 20 bp, Artificial Sequence
  chemically synthesized
gcatgttctcactcataggt

SEQ ID NO: 512801 - DNA, 20 bp, Artificial Sequence
  chemically synthesized
cattctcagcaaactatcgc

SEQ ID NO: 512802 - DNA, 20 bp, Artificial Sequence
  chemically synthesized
tatccttgcgatagtttgct

SEQ ID NO: 512803 - DNA, 20 bp, Artificial Sequence
  chemically synthesized
ttcatgtcctttgtagggac

SEQ ID NO: 512804 - DNA, 20 bp, Artificial Sequence
  chemically synthesized
gtatgcagccataaaaaagg

SEQ ID NO: 512805 - DNA, 20 bp, Artificial Sequence
  chemically synthesized
ggccgtatgcagccataaaa

SEQ ID NO: 512806 - DNA, 20 bp, Artificial Sequence
  chemically synthesized
tggctgcatacggcctgtgg

SEQ ID NO: 512807 - DNA, 20 bp, Artificial Sequence
  chemically synthesized
gcatacggcctgtggtgggg

SEQ ID NO: 512808 - DNA, 20 bp, Artificial Sequence
  chemically synthesized
cggcctgtggtggggtgggg

SEQ ID NO: 512809 - DNA, 20 bp, Artificial Sequence
  chemically synthesized
tgtggtggggtggggtgggg

SEQ ID NO: 512810 - DNA, 20 bp, Artificial Sequence
  chemically synthesized
ggggtggggtggggtggggt

SEQ ID NO: 512811 - DNA, 20 bp, Artificial Sequence
  chemically synthesized
gtggggtgggggtatggggg

SEQ ID NO: 512812 - DNA, 20 bp, Artificial Sequence
  chemically synthesized
taatgttaaatgacgagcta

SEQ ID NO: 512813 - DNA, 20 bp, Artificial Sequence
  chemically synthesized
tgatttttttattatacttt

SEQ ID NO: 512814 - DNA, 20 bp, Artificial Sequence
  chemically synthesized
aatattttcccaagaatatc

SEQ ID NO: 512815 - DNA, 20 bp, Artificial Sequence
  chemically synthesized
tataatttaaatattttccc

SEQ ID NO: 512816 - DNA, 20 bp, Artificial Sequence
  chemically synthesized
aattaaagtataatttaaat

SEQ ID NO: 512817 - DNA, 20 bp, Artificial Sequence
  chemically synthesized
tactatgaggggagaagtat

SEQ ID NO: 512818 - DNA, 20 bp, Artificial Sequence
  chemically synthesized
aaagcaatacacactacata

SEQ ID NO: 512819 - DNA, 20 bp, Artificial Sequence
  chemically synthesized
ttttgtctcaatggatttta

SEQ ID NO: 512820 - DNA, 20 bp, Artificial Sequence
  chemically synthesized
ataaggcatattttgtctca

SEQ ID NO: 512821 - DNA, 20 bp, Artificial Sequence
  chemically synthesized
tttaccatataaattaccaa

SEQ ID NO: 512822 - DNA, 20 bp, Artificial Sequence
  chemically synthesized
gatttttctaaaattatacg

SEQ ID NO: 512823 - DNA, 20 bp, Artificial Sequence
  chemically synthesized
tacaacttttgtaccataca

SEQ ID NO: 512824 - DNA, 20 bp, Artificial Sequence
  chemically synthesized
aagaatgtcggcttctagta

SEQ ID NO: 512825 - DNA, 20 bp, Artificial Sequence
  chemically synthesized
taaatagttctgtcgggcat

SEQ ID NO: 512826 - DNA, 20 bp, Artificial Sequence
  chemically synthesized
tcattttatgagacgtgcta

SEQ ID NO: 512827 - DNA, 20 bp, Artificial Sequence
  chemically synthesized
tttataacagcttattctgt

SEQ ID NO: 512828 - DNA, 20 bp, Artificial Sequence
  chemically synthesized
gataattgtatgcattctta

SEQ ID NO: 512829 - DNA, 20 bp, Artificial Sequence
  chemically synthesized
atacaattatcaattacctt

SEQ ID NO: 512830 - DNA, 20 bp, Artificial Sequence
  chemically synthesized
tccaagtattgaagttgtat

SEQ ID NO: 512831 - DNA, 20 bp, Artificial Sequence
  chemically synthesized
cccaaatacaacttcaatac

SEQ ID NO: 512832 - DNA, 20 bp, Artificial Sequence
  chemically synthesized
tgcttgttaatgttaattcc

SEQ ID NO: 512833 - DNA, 20 bp, Artificial Sequence
  chemically synthesized
taaattaactgattaatcca

SEQ ID NO: 512834 - DNA, 20 bp, Artificial Sequence
  chemically synthesized
taatatgtgtgaagaccagt

SEQ ID NO: 512835 - DNA, 20 bp, Artificial Sequence
  chemically synthesized
agcatattacatgaaagtgt

SEQ ID NO: 512836 - DNA, 20 bp, Artificial Sequence
  chemically synthesized
ccgcctcggcctctgaaagt

SEQ ID NO: 512837 - DNA, 20 bp, Artificial Sequence
  chemically synthesized
cggggtttcactgtgttagc

SEQ ID NO: 512838 - DNA, 20 bp, Artificial Sequence
  chemically synthesized
ttttttatttttagtagaga

SEQ ID NO: 512839 - DNA, 20 bp, Artificial Sequence
  chemically synthesized
tattctcctgcctcagcctc

SEQ ID NO: 512840 - DNA, 20 bp, Artificial Sequence
  chemically synthesized
tactcgggaggctgaggcag

SEQ ID NO: 512841 - DNA, 20 bp, Artificial Sequence
  chemically synthesized
ctcactgcaagctccgcctc

SEQ ID NO: 512842 - DNA, 20 bp, Artificial Sequence
  chemically synthesized
gctcgctccgtcgcccaggc

SEQ ID NO: 512843 - DNA, 20 bp, Artificial Sequence
  chemically synthesized
aaaaggcactcttatgctct

SEQ ID NO: 512844 - DNA, 20 bp, Artificial Sequence
  chemically synthesized
cagctgaattcccagagcat

SEQ ID NO: 512845 - DNA, 20 bp, Artificial Sequence
  chemically synthesized
tatgctctgggaattcagct

SEQ ID NO: 512846 - DNA, 20 bp, Artificial Sequence
  chemically synthesized
gggacctttattattcacag

SEQ ID NO: 512847 - DNA, 20 bp, Artificial Sequence
  chemically synthesized
attctcacttaatgttccag

SEQ ID NO: 512848 - DNA, 20 bp, Artificial Sequence
  chemically synthesized
actccactggaacattaagt

SEQ ID NO: 512849 - DNA, 20 bp, Artificial Sequence
  chemically synthesized
agaattattttttgaaggtt

SEQ ID NO: 512850 - DNA, 20 bp, Artificial Sequence
  chemically synthesized
tgaaggttaggaattttacg

SEQ ID NO: 512851 - DNA, 20 bp, Artificial Sequence
  chemically synthesized
ttaacagagtaaacaacagt

SEQ ID NO: 512852 - DNA, 20 bp, Artificial Sequence
  chemically synthesized
actgtttagtacaatattaa

SEQ ID NO: 512853 - DNA, 20 bp, Artificial Sequence
  chemically synthesized
taatattgtactaaacagta

SEQ ID NO: 512854 - DNA, 20 bp, Artificial Sequence
  chemically synthesized
cggtatattgagttatatat

SEQ ID NO: 512855 - DNA, 20 bp, Artificial Sequence
  chemically synthesized
tctacagtgttcccggtata

SEQ ID NO: 512856 - DNA, 20 bp, Artificial Sequence
  chemically synthesized
ttaattacataatacttatt

SEQ ID NO: 512857 - DNA, 20 bp, Artificial Sequence
  chemically synthesized
ttactggagtagaggcaagg

SEQ ID NO: 512858 - DNA, 20 bp, Artificial Sequence
  chemically synthesized
agcaagggaagagggattac

SEQ ID NO: 512859 - DNA, 20 bp, Artificial Sequence
  chemically synthesized
acaagcagcagcaagggaag

SEQ ID NO: 512860 - DNA, 20 bp, Artificial Sequence
  chemically synthesized
ctcttcccttgctgctgctt

SEQ ID NO: 512861 - DNA, 20 bp, Artificial Sequence
  chemically synthesized
taagacgaatgtagtatgtc

SEQ ID NO: 512862 - DNA, 20 bp, Artificial Sequence
  chemically synthesized
acatggagagatggaataag

SEQ ID NO: 512863 - DNA, 20 bp, Artificial Sequence
  chemically synthesized
cttgtcaatacatggagaga

SEQ ID NO: 512864 - DNA, 20 bp, Artificial Sequence
  chemically synthesized
tgtattgacaagatgggcac

SEQ ID NO: 512865 - DNA, 20 bp, Artificial Sequence
  chemically synthesized
aagctactttgccttagtat

SEQ ID NO: 512866 - DNA, 20 bp, Artificial Sequence
  chemically synthesized
aaactagcctaaacataagg

SEQ ID NO: 512867 - DNA, 20 bp, Artificial Sequence
  chemically synthesized
aagatacagataaagaacat

SEQ ID NO: 512868 - DNA, 20 bp, Artificial Sequence
  chemically synthesized
ttggggaaatagagagaaag

SEQ ID NO: 512869 - DNA, 20 bp, Artificial Sequence
  chemically synthesized
tcttgctatcttagtttgag

SEQ ID NO: 512870 - DNA, 20 bp, Artificial Sequence
  chemically synthesized
cctgggagcctacatgaata

SEQ ID NO: 512871 - DNA, 20 bp, Artificial Sequence
  chemically synthesized
tttcttacctgggagcctac

SEQ ID NO: 512872 - DNA, 20 bp, Artificial Sequence
  chemically synthesized
atttcatatttaaatgcaac

SEQ ID NO: 512873 - DNA, 20 bp, Artificial Sequence
  chemically synthesized
atagtaacatggtaattttt

SEQ ID NO: 512874 - DNA, 20 bp, Artificial Sequence
  chemically synthesized
ttttagaataaaaaccaatt

SEQ ID NO: 512875 - DNA, 20 bp, Artificial Sequence
  chemically synthesized
atattatcattaaaaatcac

SEQ ID NO: 512876 - DNA, 20 bp, Artificial Sequence
  chemically synthesized
acaaaacaaaacaaaaaact

SEQ ID NO: 512877 - DNA, 20 bp, Artificial Sequence
  chemically synthesized
gagacacatgctattctgag

SEQ ID NO: 512878 - DNA, 20 bp, Artificial Sequence
  chemically synthesized
tttgttgatttaacccttct

SEQ ID NO: 512879 - DNA, 20 bp, Artificial Sequence
  chemically synthesized
aacaaaggacataatctttc

SEQ ID NO: 512880 - DNA, 20 bp, Artificial Sequence
  chemically synthesized
tggggttcagctgtgaaatg

SEQ ID NO: 512881 - DNA, 20 bp, Artificial Sequence
  chemically synthesized
agtggaagaacaacatccca

SEQ ID NO: 512882 - DNA, 20 bp, Artificial Sequence
  chemically synthesized
cacttgctgttccaactccc

SEQ ID NO: 512883 - DNA, 20 bp, Artificial Sequence
  chemically synthesized
ctagatgattgtgtgtaaaa

SEQ ID NO: 512884 - DNA, 20 bp, Artificial Sequence
  chemically synthesized
tgactggccctattttcttt

SEQ ID NO: 512885 - DNA, 20 bp, Artificial Sequence
  chemically synthesized
ctgcagtcacagaaaaagat

SEQ ID NO: 512886 - DNA, 20 bp, Artificial Sequence
  chemically synthesized
ggttgtacaggtggagaggt

SEQ ID NO: 512887 - DNA, 20 bp, Artificial Sequence
  chemically synthesized
acagtgggccctccgtatct

SEQ ID NO: 512888 - DNA, 20 bp, Artificial Sequence
  chemically synthesized
tgtatcaaatcagaggttat

SEQ ID NO: 512889 - DNA, 20 bp, Artificial Sequence
  chemically synthesized
taacctctgatttgatacaa

SEQ ID NO: 512890 - DNA, 20 bp, Artificial Sequence
  chemically synthesized
ctctgatttgatacaatagg

SEQ ID NO: 512891 - DNA, 20 bp, Artificial Sequence
  chemically synthesized
gtgcatttgaaaataacttc

SEQ ID NO: 512892 - DNA, 20 bp, Artificial Sequence
  chemically synthesized
tgtaattagtttataactca

SEQ ID NO: 512893 - DNA, 20 bp, Artificial Sequence
  chemically synthesized
tcacctcaagcatttatcct

SEQ ID NO: 512894 - DNA, 20 bp, Artificial Sequence
  chemically synthesized
atatggaataagcacgtcat

SEQ ID NO: 512895 - DNA, 20 bp, Artificial Sequence
  chemically synthesized
tttgatagaggcatacaata

SEQ ID NO: 512896 - DNA, 20 bp, Artificial Sequence
  chemically synthesized
atataatttttgtgggtaca

SEQ ID NO: 512897 - DNA, 20 bp, Artificial Sequence
  chemically synthesized
tgtgtgtgtatataattttt

SEQ ID NO: 512898 - DNA, 20 bp, Artificial Sequence
  chemically synthesized
aatttttgtgggtacatact

SEQ ID NO: 512899 - DNA, 20 bp, Artificial Sequence
  chemically synthesized
tattttttttggaaattttt

SEQ ID NO: 512900 - DNA, 20 bp, Artificial Sequence
  chemically synthesized
gttaatttttattgtatttc

SEQ ID NO: 512901 - DNA, 20 bp, Artificial Sequence
  chemically synthesized
ggaaatacaataaaaattaa

SEQ ID NO: 512902 - DNA, 20 bp, Artificial Sequence
  chemically synthesized
acaggatagaaatctccctg

SEQ ID NO: 512903 - DNA, 20 bp, Artificial Sequence
  chemically synthesized
ttgggtactatgcttattac

SEQ ID NO: 512904 - DNA, 20 bp, Artificial Sequence
  chemically synthesized
aattatgtgttacaggggct

SEQ ID NO: 512905 - DNA, 20 bp, Artificial Sequence
  chemically synthesized
ttgtgtttaatttctaggtt

SEQ ID NO: 512906 - DNA, 20 bp, Artificial Sequence
  chemically synthesized
gaacctagaaattaaacaca

SEQ ID NO: 512907 - DNA, 20 bp, Artificial Sequence
  chemically synthesized
agataatttaatgtaaacag

SEQ ID NO: 512908 - DNA, 20 bp, Artificial Sequence
  chemically synthesized
aactccagatactaaaatct

SEQ ID NO: 512909 - DNA, 20 bp, Artificial Sequence
  chemically synthesized
catccacagattttagtatc

SEQ ID NO: 512910 - DNA, 20 bp, Artificial Sequence
  chemically synthesized
tgccttatagattatacttt

SEQ ID NO: 512911 - DNA, 20 bp, Artificial Sequence
  chemically synthesized
agtataatctataaggcatc

SEQ ID NO: 512912 - DNA, 20 bp, Artificial Sequence
  chemically synthesized
tctgcactgacattaatagc

SEQ ID NO: 512913 - DNA, 20 bp, Artificial Sequence
  chemically synthesized
acatggttgattcatggagc

SEQ ID NO: 512914 - DNA, 20 bp, Artificial Sequence
  chemically synthesized
cccccccccacccccgctcc

SEQ ID NO: 512915 - DNA, 20 bp, Artificial Sequence
  chemically synthesized
tttgtcctctaaacacacag

SEQ ID NO: 512916 - DNA, 20 bp, Artificial Sequence
  chemically synthesized
aaatcatttttaaatagccc

SEQ ID NO: 512917 - DNA, 20 bp, Artificial Sequence
  chemically synthesized
tgttcctattaaatcgtttt

SEQ ID NO: 512918 - DNA, 20 bp, Artificial Sequence
  chemically synthesized
aaattggcctataatacacc

SEQ ID NO: 512919 - DNA, 20 bp, Artificial Sequence
  chemically synthesized
gttggaggtgattaattgca

SEQ ID NO: 512920 - DNA, 20 bp, Artificial Sequence
  chemically synthesized
accatccttaggtttgagca

SEQ ID NO: 512921 - DNA, 20 bp, Artificial Sequence
  chemically synthesized
aaaatccattgctcaaacct

SEQ ID NO: 512922 - DNA, 20 bp, Artificial Sequence
  chemically synthesized
aagtccacacgtttgcacag

SEQ ID NO: 512923 - DNA, 20 bp, Artificial Sequence
  chemically synthesized
gtgatttctaataaaaagtt

SEQ ID NO: 512924 - DNA, 20 bp, Artificial Sequence
  chemically synthesized
tgataaagtccaccactatt

SEQ ID NO: 512925 - DNA, 20 bp, Artificial Sequence
  chemically synthesized
aactaataaaattagggaag

SEQ ID NO: 512926 - DNA, 20 bp, Artificial Sequence
  chemically synthesized
agcagagtaagaactactgt

SEQ ID NO: 512927 - DNA, 20 bp, Artificial Sequence
  chemically synthesized
aagaactactgtatggatcc

SEQ ID NO: 512928 - DNA, 20 bp, Artificial Sequence
  chemically synthesized
ttttaaatataccaaaatcc

SEQ ID NO: 512929 - DNA, 20 bp, Artificial Sequence
  chemically synthesized
gtatatttaaaatcccatat

SEQ ID NO: 512930 - DNA, 20 bp, Artificial Sequence
  chemically synthesized
gctgcatcataattcttata

SEQ ID NO: 512931 - DNA, 20 bp, Artificial Sequence
  chemically synthesized
ataaatatttgtacatttat

SEQ ID NO: 512932 - DNA, 20 bp, Artificial Sequence
  chemically synthesized
tgtactttaaaaaatattct

SEQ ID NO: 512933 - DNA, 20 bp, Artificial Sequence
  chemically synthesized
acagaatgtgaactaattca

SEQ ID NO: 512934 - DNA, 20 bp, Artificial Sequence
  chemically synthesized
taggtaactgttatataaga

SEQ ID NO: 512935 - DNA, 20 bp, Artificial Sequence
  chemically synthesized
cttttacttcctgacacact

SEQ ID NO: 512936 - DNA, 20 bp, Artificial Sequence
  chemically synthesized
tctattgataactttacata

SEQ ID NO: 512937 - DNA, 20 bp, Artificial Sequence
  chemically synthesized
aagttatcaatagacatttg

SEQ ID NO: 512938 - DNA, 20 bp, Artificial Sequence
  chemically synthesized
aatgcttatgtagcatctga

SEQ ID NO: 512939 - DNA, 20 bp, Artificial Sequence
  chemically synthesized
agaatttacaatgtcagact

SEQ ID NO: 512940 - DNA, 20 bp, Artificial Sequence
  chemically synthesized
agaataaaaagtaggggctc

SEQ ID NO: 512941 - DNA, 20 bp, Artificial Sequence
  chemically synthesized
gtagactaagattttttcca

SEQ ID NO: 512942 - DNA, 20 bp, Artificial Sequence
  chemically synthesized
acgagcatttgtgcaggtgg

SEQ ID NO: 512943 - DNA, 20 bp, Artificial Sequence
  chemically synthesized
actagtctatatgtactctg

SEQ ID NO: 512944 - DNA, 20 bp, Artificial Sequence
  chemically synthesized
ctaatgtgtcttttactctg

SEQ ID NO: 512945 - DNA, 20 bp, Artificial Sequence
  chemically synthesized
ggaatgaaaatgtttaaaat

SEQ ID NO: 512946 - DNA, 20 bp, Artificial Sequence
  chemically synthesized
tcaaactttaatcttgcaga

SEQ ID NO: 512947 - DNA, 20 bp, Artificial Sequence
  chemically synthesized
tccatctgcaagattaaagt

SEQ ID NO: 512948 - DNA, 20 bp, Artificial Sequence
  chemically synthesized
ctcagattgatcaagaggca

SEQ ID NO: 512949 - DNA, 20 bp, Artificial Sequence
  chemically synthesized
atagcaaaggtagtgcttga

SEQ ID NO: 512950 - DNA, 20 bp, Artificial Sequence
  chemically synthesized
aacgtgaagaaggctaggta

SEQ ID NO: 512951 - DNA, 20 bp, Artificial Sequence
  chemically synthesized
aatgtacatttctgtttatg

SEQ ID NO: 512952 - DNA, 20 bp, Artificial Sequence
  chemically synthesized
acgaaaaaagttaaaaaata

SEQ ID NO: 512953 - DNA, 20 bp, Artificial Sequence
  chemically synthesized
ttttttctctctattatatc

SEQ ID NO: 512954 - DNA, 20 bp, Artificial Sequence
  chemically synthesized
taaaaatgagacataagctc

SEQ ID NO: 512955 - DNA, 20 bp, Artificial Sequence
  chemically synthesized
tatcgttgttatattttgca

SEQ ID NO: 512956 - DNA, 20 bp, Artificial Sequence
  chemically synthesized
gaaaaataacgattgggcat

SEQ ID NO: 512957 - DNA, 20 bp, Artificial Sequence
  chemically synthesized
cacttctggctgtctctttt

SEQ ID NO: 512958 - DNA, 20 bp, Artificial Sequence
  chemically synthesized
tgctgtttaactacagtgag

SEQ ID NO: 512959 - DNA, 20 bp, Artificial Sequence
  chemically synthesized
cttattcctcctcaagaggc

SEQ ID NO: 512960 - DNA, 20 bp, Artificial Sequence
  chemically synthesized
tgtactcttgcctcttgagg

SEQ ID NO: 512961 - DNA, 20 bp, Artificial Sequence
  chemically synthesized
cttgcctcttgaggaggaat

SEQ ID NO: 512962 - DNA, 20 bp, Artificial Sequence
  chemically synthesized
aaactgtttttattaataat

SEQ ID NO: 512963 - DNA, 20 bp, Artificial Sequence
  chemically synthesized
gtatagaatcagttgggcaa

SEQ ID NO: 512964 - DNA, 20 bp, Artificial Sequence
  chemically synthesized
aatatctaagtttttctgta

SEQ ID NO: 512965 - DNA, 20 bp, Artificial Sequence
  chemically synthesized
aatcccaccttgagtcatat

SEQ ID NO: 512966 - DNA, 20 bp, Artificial Sequence
  chemically synthesized
aatccacatatgactcaagg

SEQ ID NO: 512967 - DNA, 20 bp, Artificial Sequence
  chemically synthesized
atctagattgaaatcccacc

SEQ ID NO: 512968 - DNA, 20 bp, Artificial Sequence
  chemically synthesized
atgcctttgccatctaattt

SEQ ID NO: 512969 - DNA, 20 bp, Artificial Sequence
  chemically synthesized
aattttagagttaactgaga

SEQ ID NO: 512970 - DNA, 20 bp, Artificial Sequence
  chemically synthesized
ttaactgagaaagagtagag

SEQ ID NO: 512971 - DNA, 20 bp, Artificial Sequence
  chemically synthesized
ggggaatattttcataactg

SEQ ID NO: 512972 - DNA, 20 bp, Artificial Sequence
  chemically synthesized
tttgataactttagtgtggc

SEQ ID NO: 512973 - DNA, 20 bp, Artificial Sequence
  chemically synthesized
taactttagtgtggcttgga

SEQ ID NO: 512974 - DNA, 20 bp, Artificial Sequence
  chemically synthesized
tcattaaataattaaagtag

SEQ ID NO: 512975 - DNA, 20 bp, Artificial Sequence
  chemically synthesized
ttactatgatgtttccttga

SEQ ID NO: 512976 - DNA, 20 bp, Artificial Sequence
  chemically synthesized
caaggaaacatcatagtaaa

SEQ ID NO: 512977 - DNA, 20 bp, Artificial Sequence
  chemically synthesized
gagccagaataagagggata

SEQ ID NO: 512978 - DNA, 20 bp, Artificial Sequence
  chemically synthesized
taaactagagccagaataag

SEQ ID NO: 512979 - DNA, 20 bp, Artificial Sequence
  chemically synthesized
aaagttttataaactagagc

SEQ ID NO: 512980 - DNA, 20 bp, Artificial Sequence
  chemically synthesized
ccatttattttcaaaacatt

SEQ ID NO: 512981 - DNA, 20 bp, Artificial Sequence
  chemically synthesized
aaaacatttggaatcaactg

SEQ ID NO: 512982 - DNA, 20 bp, Artificial Sequence
  chemically synthesized
ctaattgggtttgtttttaa

SEQ ID NO: 512983 - DNA, 20 bp, Artificial Sequence
  chemically synthesized
tcattttattacagggctaa

SEQ ID NO: 512984 - DNA, 20 bp, Artificial Sequence
  chemically synthesized
ccaattagccctgtaataaa

SEQ ID NO: 512985 - DNA, 20 bp, Artificial Sequence
  chemically synthesized
gaatattcctctcttcttcc

SEQ ID NO: 512986 - DNA, 20 bp, Artificial Sequence
  chemically synthesized
aaatattcatggaagaagag

SEQ ID NO: 512987 - DNA, 20 bp, Artificial Sequence
  chemically synthesized
tacagaatataatcttatgg

SEQ ID NO: 512988 - DNA, 20 bp, Artificial Sequence
  chemically synthesized
ttccctacttgtaactacta

SEQ ID NO: 512989 - DNA, 20 bp, Artificial Sequence
  chemically synthesized
ttctgtagtagttacaagta

SEQ ID NO: 512990 - DNA, 20 bp, Artificial Sequence
  chemically synthesized
acatcactcagctagtgagt

SEQ ID NO: 512991 - DNA, 20 bp, Artificial Sequence
  chemically synthesized
tcttaactccaactcactag

SEQ ID NO: 512992 - DNA, 20 bp, Artificial Sequence
  chemically synthesized
ttgcccacatcactcagcta

SEQ ID NO: 512993 - DNA, 20 bp, Artificial Sequence
  chemically synthesized
attttggtcatttgcaactg

SEQ ID NO: 512994 - DNA, 20 bp, Artificial Sequence
  chemically synthesized
aaataatagtctctacctcc

SEQ ID NO: 512995 - DNA, 20 bp, Artificial Sequence
  chemically synthesized
aaaactcaacttctgaagct

SEQ ID NO: 512996 - DNA, 20 bp, Artificial Sequence
  chemically synthesized
attactcccagcttcagaag

SEQ ID NO: 512997 - DNA, 20 bp, Artificial Sequence
  chemically synthesized
ttcagaagttgagtttttct

SEQ ID NO: 512998 - DNA, 20 bp, Artificial Sequence
  chemically synthesized
atatgacatcgtaaaagtgg

SEQ ID NO: 512999 - DNA, 20 bp, Artificial Sequence
  chemically synthesized
accatgtatccatgacaact

SEQ ID NO: 513000 - DNA, 20 bp, Artificial Sequence
  chemically synthesized
gagattgattcacagttgtc

SEQ ID NO: 513001 - DNA, 20 bp, Artificial Sequence
  chemically synthesized
agagagagagaaccactctg

SEQ ID NO: 513002 - DNA, 20 bp, Artificial Sequence
  chemically synthesized
atactatatcttaaattcct

SEQ ID NO: 513003 - DNA, 20 bp, Artificial Sequence
  chemically synthesized
tagattagactctggagctc

SEQ ID NO: 513004 - DNA, 20 bp, Artificial Sequence
  chemically synthesized
tctttgatatccttgagctc

SEQ ID NO: 513005 - DNA, 20 bp, Artificial Sequence
  chemically synthesized
gctggctcacagctggtgta

SEQ ID NO: 513006 - DNA, 20 bp, Artificial Sequence
  chemically synthesized
cattctggttttctggtctg

SEQ ID NO: 513007 - DNA, 20 bp, Artificial Sequence
  chemically synthesized
tattcctcagaccagaaaac

SEQ ID NO: 513008 - DNA, 20 bp, Artificial Sequence
  chemically synthesized
cctcagaccagaaaaccaga

SEQ ID NO: 513009 - DNA, 20 bp, Artificial Sequence
  chemically synthesized
acatatcccccgtggaaaag

SEQ ID NO: 513010 - DNA, 20 bp, Artificial Sequence
  chemically synthesized
gtagatcccccttttccacg

SEQ ID NO: 513011 - DNA, 20 bp, Artificial Sequence
  chemically synthesized
tatgcagtaataaaagttac

SEQ ID NO: 513012 - DNA, 20 bp, Artificial Sequence
  chemically synthesized
gagggtgggcagggagaggt

SEQ ID NO: 513013 - DNA, 20 bp, Artificial Sequence
  chemically synthesized
tacaattagatgatggtggg

SEQ ID NO: 513014 - DNA, 20 bp, Artificial Sequence
  chemically synthesized
caaccgtggtccttaaattg

SEQ ID NO: 513015 - DNA, 20 bp, Artificial Sequence
  chemically synthesized
tttaaggaccacggttgacc

SEQ ID NO: 513016 - DNA, 20 bp, Artificial Sequence
  chemically synthesized
catgggtagcagaaactgta

SEQ ID NO: 513017 - DNA, 20 bp, Artificial Sequence
  chemically synthesized
actctccccaaattaaatac

SEQ ID NO: 513018 - DNA, 20 bp, Artificial Sequence
  chemically synthesized
actcctgtatttaatttggg

SEQ ID NO: 513019 - DNA, 20 bp, Artificial Sequence
  chemically synthesized
ccagttattttgcctgcctc

SEQ ID NO: 513020 - DNA, 20 bp, Artificial Sequence
  chemically synthesized
gaaagatcagttttccctac

SEQ ID NO: 513021 - DNA, 20 bp, Artificial Sequence
  chemically synthesized
ctaaagttatgtcaaataac

SEQ ID NO: 513022 - DNA, 20 bp, Artificial Sequence
  chemically synthesized
tacctcccactgctacttca

SEQ ID NO: 513023 - DNA, 20 bp, Artificial Sequence
  chemically synthesized
ctacacagagccaactagtt

SEQ ID NO: 513024 - DNA, 20 bp, Artificial Sequence
  chemically synthesized
taggcagcatcagattaacc

SEQ ID NO: 513025 - DNA, 20 bp, Artificial Sequence
  chemically synthesized
aacatagaaacttattttct

SEQ ID NO: 513026 - DNA, 20 bp, Artificial Sequence
  chemically synthesized
aaacttattttcttaggatt

SEQ ID NO: 513027 - DNA, 20 bp, Artificial Sequence
  chemically synthesized
attaagagttaagataatag

SEQ ID NO: 513028 - DNA, 20 bp, Artificial Sequence
  chemically synthesized
agtagtcctacctagcaaac

SEQ ID NO: 513029 - DNA, 20 bp, Artificial Sequence
  chemically synthesized
gactactattaaattaactg

SEQ ID NO: 513030 - DNA, 20 bp, Artificial Sequence
  chemically synthesized
agcagctatatggagcacat

SEQ ID NO: 513031 - DNA, 20 bp, Artificial Sequence
  chemically synthesized
gtcatagaatctttgtatca

SEQ ID NO: 513032 - DNA, 20 bp, Artificial Sequence
  chemically synthesized
aggcaggagatacactgtca

SEQ ID NO: 513033 - DNA, 20 bp, Artificial Sequence
  chemically synthesized
acatttacttagctgtacag

SEQ ID NO: 513034 - DNA, 20 bp, Artificial Sequence
  chemically synthesized
aattatactcacagatggaa

SEQ ID NO: 513035 - DNA, 20 bp, Artificial Sequence
  chemically synthesized
gattaaattctattccatct

SEQ ID NO: 513036 - DNA, 20 bp, Artificial Sequence
  chemically synthesized
ttggcaattatactcacaga

SEQ ID NO: 513037 - DNA, 20 bp, Artificial Sequence
  chemically synthesized
actgtttagcaaaactaacc

SEQ ID NO: 513038 - DNA, 20 bp, Artificial Sequence
  chemically synthesized
gaatttatttaccatttatc

SEQ ID NO: 513039 - DNA, 20 bp, Artificial Sequence
  chemically synthesized
atattaatgccataaatagg

SEQ ID NO: 513040 - DNA, 20 bp, Artificial Sequence
  chemically synthesized
aagccatttgcttatttcaa

SEQ ID NO: 513041 - DNA, 20 bp, Artificial Sequence
  chemically synthesized
gcttatttcaagtggattta

SEQ ID NO: 513042 - DNA, 20 bp, Artificial Sequence
  chemically synthesized
cagagctgataaagaactag

SEQ ID NO: 513043 - DNA, 20 bp, Artificial Sequence
  chemically synthesized
aagaaataaattaaagaaca

SEQ ID NO: 513044 - DNA, 20 bp, Artificial Sequence
  chemically synthesized
aaattaaagaacaaagagtc

SEQ ID NO: 513045 - DNA, 20 bp, Artificial Sequence
  chemically synthesized
tgactcaaacagtttccagc

SEQ ID NO: 513046 - DNA, 20 bp, Artificial Sequence
  chemically synthesized
caacccttgctggaaactgt

SEQ ID NO: 513047 - DNA, 20 bp, Artificial Sequence
  chemically synthesized
ttgctggaaactgtttgagt

SEQ ID NO: 513048 - DNA, 20 bp, Artificial Sequence
  chemically synthesized
cttcacggacatgtttgtga

SEQ ID NO: 513049 - DNA, 20 bp, Artificial Sequence
  chemically synthesized
gtgaagcaataaatagaaga

SEQ ID NO: 513050 - DNA, 20 bp, Artificial Sequence
  chemically synthesized
gcaagtttcttaatcctaaa

SEQ ID NO: 513051 - DNA, 20 bp, Artificial Sequence
  chemically synthesized
ggccatcaaaacattctctt

SEQ ID NO: 513052 - DNA, 20 bp, Artificial Sequence
  chemically synthesized
agtctatttttactttgtct

SEQ ID NO: 513053 - DNA, 20 bp, Artificial Sequence
  chemically synthesized
ctgttcacatcttcaattac

SEQ ID NO: 513054 - DNA, 20 bp, Artificial Sequence
  chemically synthesized
aaatgctgggacaacagatt

SEQ ID NO: 513055 - DNA, 20 bp, Artificial Sequence
  chemically synthesized
cccttttataggataagatc

SEQ ID NO: 513056 - DNA, 20 bp, Artificial Sequence
  chemically synthesized
ctgtgagatatgccctttta

SEQ ID NO: 513057 - DNA, 20 bp, Artificial Sequence
  chemically synthesized
agttgtttctatcttagctg

SEQ ID NO: 513058 - DNA, 20 bp, Artificial Sequence
  chemically synthesized
tttttagaagctcagtaagt

SEQ ID NO: 513059 - DNA, 20 bp, Artificial Sequence
  chemically synthesized
gggaagctttatggcaacac

SEQ ID NO: 513060 - DNA, 20 bp, Artificial Sequence
  chemically synthesized
actttaagaagagataaacc

SEQ ID NO: 513061 - DNA, 20 bp, Artificial Sequence
  chemically synthesized
aactgagctataatcaaatc

SEQ ID NO: 513062 - DNA, 20 bp, Artificial Sequence
  chemically synthesized
agtttttccatttataaaag

SEQ ID NO: 513063 - DNA, 20 bp, Artificial Sequence
  chemically synthesized
aaaagaaggataaacttacc

SEQ ID NO: 513064 - DNA, 20 bp, Artificial Sequence
  chemically synthesized
ttgcaagttccttttggtag

SEQ ID NO: 513065 - DNA, 20 bp, Artificial Sequence
  chemically synthesized
accaaaaggaacttgcaaat

SEQ ID NO: 513066 - DNA, 20 bp, Artificial Sequence
  chemically synthesized
cttgtgagatgttaatattg

SEQ ID NO: 513067 - DNA, 20 bp, Artificial Sequence
  chemically synthesized
cagcaatattaacatctcac

SEQ ID NO: 513068 - DNA, 20 bp, Artificial Sequence
  chemically synthesized
atctcacaagaatgatatta

SEQ ID NO: 513069 - DNA, 20 bp, Artificial Sequence
  chemically synthesized
gttacaactattaaattatt

SEQ ID NO: 513070 - DNA, 20 bp, Artificial Sequence
  chemically synthesized
acagttttctcacttttcaa

SEQ ID NO: 513071 - DNA, 20 bp, Artificial Sequence
  chemically synthesized
atggcaatcgtgtggagtta

SEQ ID NO: 513072 - DNA, 20 bp, Artificial Sequence
  chemically synthesized
tttgtcttatggcaatcgtg

SEQ ID NO: 513073 - DNA, 20 bp, Artificial Sequence
  chemically synthesized
aatctggggcttcaaaatgg

SEQ ID NO: 513074 - DNA, 20 bp, Artificial Sequence
  chemically synthesized
gcttcaaaatggctgaattg

SEQ ID NO: 513075 - DNA, 20 bp, Artificial Sequence
  chemically synthesized
ggttcctctccatggaagag

SEQ ID NO: 513076 - DNA, 20 bp, Artificial Sequence
  chemically synthesized
accaagtagataatcatact

SEQ ID NO: 513077 - DNA, 20 bp, Artificial Sequence
  chemically synthesized
tggttttcattgcttctctg

SEQ ID NO: 513078 - DNA, 20 bp, Artificial Sequence
  chemically synthesized
cctagccaatctcagctgga

SEQ ID NO: 513079 - DNA, 20 bp, Artificial Sequence
  chemically synthesized
agactcctagccaatctcag

SEQ ID NO: 513080 - DNA, 20 bp, Artificial Sequence
  chemically synthesized
ctatccagctgagattggct

SEQ ID NO: 513081 - DNA, 20 bp, Artificial Sequence
  chemically synthesized
gaggctccctaacatgggga

SEQ ID NO: 513082 - DNA, 20 bp, Artificial Sequence
  chemically synthesized
ggattgtaggaatcttgtac

SEQ ID NO: 513083 - DNA, 20 bp, Artificial Sequence
  chemically synthesized
tctcaattggctaggattgt

SEQ ID NO: 513084 - DNA, 20 bp, Artificial Sequence
  chemically synthesized
ttgaagggctctcaattggc

SEQ ID NO: 513085 - DNA, 20 bp, Artificial Sequence
  chemically synthesized
gtgttggtttgggggcccac

SEQ ID NO: 513086 - DNA, 20 bp, Artificial Sequence
  chemically synthesized
cttcacggaagaagcccatg

SEQ ID NO: 513087 - DNA, 20 bp, Artificial Sequence
  chemically synthesized
atgctgggttccacaaactc

SEQ ID NO: 513088 - DNA, 20 bp, Artificial Sequence
  chemically synthesized
gttgcagctgcttaggactc

SEQ ID NO: 513089 - DNA, 20 bp, Artificial Sequence
  chemically synthesized
cttccctatctccacattcc

SEQ ID NO: 513090 - DNA, 20 bp, Artificial Sequence
  chemically synthesized
ggaaatatcactgagactcc

SEQ ID NO: 513091 - DNA, 20 bp, Artificial Sequence
  chemically synthesized
tggccccagcagttgcagcc

SEQ ID NO: 513092 - DNA, 20 bp, Artificial Sequence
  chemically synthesized
cacccctctgttgggcaggg

SEQ ID NO: 513093 - DNA, 20 bp, Artificial Sequence
  chemically synthesized
aaccctcccctgcccaacag

SEQ ID NO: 513094 - DNA, 20 bp, Artificial Sequence
  chemically synthesized
agtcttcagtgtgcatgaag

SEQ ID NO: 513095 - DNA, 20 bp, Artificial Sequence
  chemically synthesized
gtgacagcatttgcaggcag

SEQ ID NO: 513096 - DNA, 20 bp, Artificial Sequence
  chemically synthesized
gctgtcactgtgaactgctg

SEQ ID NO: 513097 - DNA, 20 bp, Artificial Sequence
  chemically synthesized
gagcagccataagcagttgc

SEQ ID NO: 513098 - DNA, 20 bp, Artificial Sequence
  chemically synthesized
actgtggccctgctactgga

SEQ ID NO: 513099 - DNA, 20 bp, Artificial Sequence
  chemically synthesized
cagtggttgcatgcaccacc

SEQ ID NO: 513100 - DNA, 20 bp, Artificial Sequence
  chemically synthesized
atacaaatttttatgtactg

SEQ ID NO: 513101 - DNA, 20 bp, Artificial Sequence
  chemically synthesized
agatgccaatggtggtaaac

SEQ ID NO: 513102 - DNA, 20 bp, Artificial Sequence
  chemically synthesized
ctgactagtcttcctggggc

SEQ ID NO: 513103 - DNA, 20 bp, Artificial Sequence
  chemically synthesized
gctttggtggtagtggaagc

SEQ ID NO: 513104 - DNA, 20 bp, Artificial Sequence
  chemically synthesized
aatccatgatggtgttggtg

SEQ ID NO: 513105 - DNA, 20 bp, Artificial Sequence
  chemically synthesized
catccaccaccaacaccatc

SEQ ID NO: 513106 - DNA, 20 bp, Artificial Sequence
  chemically synthesized
catggattgcttgcattcca

SEQ ID NO: 513107 - DNA, 20 bp, Artificial Sequence
  chemically synthesized
gtgggaggggggcaaccctc

SEQ ID NO: 513108 - DNA, 20 bp, Artificial Sequence
  chemically synthesized
ccaggggcagcaagcatggt

SEQ ID NO: 513109 - DNA, 20 bp, Artificial Sequence
  chemically synthesized
gaaaagcataggtgggctgg

SEQ ID NO: 513110 - DNA, 20 bp, Artificial Sequence
  chemically synthesized
tcaggaaaagcataggtggg

SEQ ID NO: 513111 - DNA, 20 bp, Artificial Sequence
  chemically synthesized
agcaagccacctataagcca

SEQ ID NO: 513112 - DNA, 20 bp, Artificial Sequence
  chemically synthesized
ctgtaacttcctcagtagct

SEQ ID NO: 513113 - DNA, 20 bp, Artificial Sequence
  chemically synthesized
tttctttggatgtaaacagt

SEQ ID NO: 513114 - DNA, 20 bp, Artificial Sequence
  chemically synthesized
atacttcctgtatgatttct

SEQ ID NO: 513115 - DNA, 20 bp, Artificial Sequence
  chemically synthesized
agtatactactatatacatt

SEQ ID NO: 513116 - DNA, 20 bp, Artificial Sequence
  chemically synthesized
ttgagtctttgcctttgatt

SEQ ID NO: 513117 - DNA, 20 bp, Artificial Sequence
  chemically synthesized
ctgttttatctagtctcctc

SEQ ID NO: 513118 - DNA, 20 bp, Artificial Sequence
  chemically synthesized
gaggagactagataaaacag

SEQ ID NO: 513119 - DNA, 20 bp, Artificial Sequence
  chemically synthesized
aattttttgttattttttgt

SEQ ID NO: 513120 - DNA, 20 bp, Artificial Sequence
  chemically synthesized
tcatctattattttgttaaa

SEQ ID NO: 513121 - DNA, 20 bp, Artificial Sequence
  chemically synthesized
gagatttagacatccagata

SEQ ID NO: 513122 - DNA, 20 bp, Artificial Sequence
  chemically synthesized
gatctttcagcatcctgtat

SEQ ID NO: 513123 - DNA, 20 bp, Artificial Sequence
  chemically synthesized
gatgctgaaagatctcaaaa

SEQ ID NO: 513124 - DNA, 20 bp, Artificial Sequence
  chemically synthesized
gtgtcatggacaagacattt

SEQ ID NO: 513125 - DNA, 20 bp, Artificial Sequence
  chemically synthesized
tctttttgtctttggctttt

SEQ ID NO: 513126 - DNA, 20 bp, Artificial Sequence
  chemically synthesized
tcaaaagccaaagacaaaaa

SEQ ID NO: 513127 - DNA, 20 bp, Artificial Sequence
  chemically synthesized
tgcttttctcttgctgtttt

SEQ ID NO: 513128 - DNA, 20 bp, Artificial Sequence
  chemically synthesized
aaacctccatcagattaaca

SEQ ID NO: 513129 - DNA, 20 bp, Artificial Sequence
  chemically synthesized
agaaaccttacaggccagag

SEQ ID NO: 513130 - DNA, 20 bp, Artificial Sequence
  chemically synthesized
aaagaaaacaaccaccagcc

SEQ ID NO: 513131 - DNA, 20 bp, Artificial Sequence
  chemically synthesized
tgaaggctaccttggctggg

SEQ ID NO: 513132 - DNA, 20 bp, Artificial Sequence
  chemically synthesized
atttatgaaggctaccttgg

SEQ ID NO: 513133 - DNA, 20 bp, Artificial Sequence
  chemically synthesized
agaaataaaatagttcctag

SEQ ID NO: 513134 - DNA, 20 bp, Artificial Sequence
  chemically synthesized
gccttacaagaaaggtttaa

SEQ ID NO: 513135 - DNA, 20 bp, Artificial Sequence
  chemically synthesized
agtcctatacctggaagtga

SEQ ID NO: 513136 - DNA, 20 bp, Artificial Sequence
  chemically synthesized
gtattctttagtggtaacat

SEQ ID NO: 513137 - DNA, 20 bp, Artificial Sequence
  chemically synthesized
ttactcaaatgttaccacta

SEQ ID NO: 513138 - DNA, 20 bp, Artificial Sequence
  chemically synthesized
tttattgatttatggttgtt

SEQ ID NO: 513139 - DNA, 20 bp, Artificial Sequence
  chemically synthesized
ctcacatatcagtaataatg

SEQ ID NO: 513140 - DNA, 20 bp, Artificial Sequence
  chemically synthesized
gccagtttatgtcttttatg

SEQ ID NO: 513141 - DNA, 20 bp, Artificial Sequence
  chemically synthesized
acataaaagacataaactgg

SEQ ID NO: 513142 - DNA, 20 bp, Artificial Sequence
  chemically synthesized
aaaagacataaactggctga

SEQ ID NO: 513143 - DNA, 20 bp, Artificial Sequence
  chemically synthesized
ttattttaggcagaatattt

SEQ ID NO: 513144 - DNA, 20 bp, Artificial Sequence
  chemically synthesized
tgaaatgagtttattttagg

SEQ ID NO: 513145 - DNA, 20 bp, Artificial Sequence
  chemically synthesized
tatgtgtctttacaggtgaa

SEQ ID NO: 513146 - DNA, 20 bp, Artificial Sequence
  chemically synthesized
cacatatagatttgaagtaa

SEQ ID NO: 513147 - DNA, 20 bp, Artificial Sequence
  chemically synthesized
aggtcattatataatgataa

SEQ ID NO: 513148 - DNA, 20 bp, Artificial Sequence
  chemically synthesized
gataaagggataagtttagc

SEQ ID NO: 513149 - DNA, 20 bp, Artificial Sequence
  chemically synthesized
gtgttgggtgtatgtatgtt

SEQ ID NO: 513150 - DNA, 20 bp, Artificial Sequence
  chemically synthesized
tatatctgggagctctcgtg

SEQ ID NO: 513151 - DNA, 20 bp, Artificial Sequence
  chemically synthesized
aagtgatctaatgctgagag

SEQ ID NO: 513152 - DNA, 20 bp, Artificial Sequence
  chemically synthesized
tgtctaagtgatctaatgct

SEQ ID NO: 513153 - DNA, 20 bp, Artificial Sequence
  chemically synthesized
aaaatgtgtatgactgttga

SEQ ID NO: 513154 - DNA, 20 bp, Artificial Sequence
  chemically synthesized
ataacatatggtctgtcctg

SEQ ID NO: 513155 - DNA, 20 bp, Artificial Sequence
  chemically synthesized
ggacagaccatatgttatga

SEQ ID NO: 513156 - DNA, 20 bp, Artificial Sequence
  chemically synthesized
ggaaattgaacaacatactc

SEQ ID NO: 513157 - DNA, 20 bp, Artificial Sequence
  chemically synthesized
ccttgacccaatggtcattc

SEQ ID NO: 513158 - DNA, 20 bp, Artificial Sequence
  chemically synthesized
aacatactcctgaatgacca

SEQ ID NO: 513159 - DNA, 20 bp, Artificial Sequence
  chemically synthesized
tcaaaaaattattgaaacaa

SEQ ID NO: 513160 - DNA, 20 bp, Artificial Sequence
  chemically synthesized
tcaaaatataataacaccta

SEQ ID NO: 513161 - DNA, 20 bp, Artificial Sequence
  chemically synthesized
atggcaaaagcagtgctaag

SEQ ID NO: 513162 - DNA, 20 bp, Artificial Sequence
  chemically synthesized
aaaaaaaaacaaaccaaacc

SEQ ID NO: 513163 - DNA, 20 bp, Artificial Sequence
  chemically synthesized
ttttcatccttctactaatt

SEQ ID NO: 513164 - DNA, 20 bp, Artificial Sequence
  chemically synthesized
accaaacccagaattagtag

SEQ ID NO: 513165 - DNA, 20 bp, Artificial Sequence
  chemically synthesized
cttgagttttgctcaatttt

SEQ ID NO: 513166 - DNA, 20 bp, Artificial Sequence
  chemically synthesized
attttttgctctctattttc

SEQ ID NO: 513167 - DNA, 20 bp, Artificial Sequence
  chemically synthesized
ctccgtcttcatttatgatt

SEQ ID NO: 513168 - DNA, 20 bp, Artificial Sequence
  chemically synthesized
ataataaactaaaaatctag

SEQ ID NO: 513169 - DNA, 20 bp, Artificial Sequence
  chemically synthesized
acggttggttgtatgtgtcc

SEQ ID NO: 513170 - DNA, 20 bp, Artificial Sequence
  chemically synthesized
ccggacacatacaaccaacc

SEQ ID NO: 513171 - DNA, 20 bp, Artificial Sequence
  chemically synthesized
atctataattagtaatgatc

SEQ ID NO: 513172 - DNA, 20 bp, Artificial Sequence
  chemically synthesized
aggaccagatgtctttactg

SEQ ID NO: 513173 - DNA, 20 bp, Artificial Sequence
  chemically synthesized
ggagaattggtaaagtttgg

SEQ ID NO: 513174 - DNA, 20 bp, Artificial Sequence
  chemically synthesized
ttttcttggaacacttacag

SEQ ID NO: 513175 - DNA, 20 bp, Artificial Sequence
  chemically synthesized
ccaagaaaaattgaagagga

SEQ ID NO: 513176 - DNA, 20 bp, Artificial Sequence
  chemically synthesized
gcttcatagaatgagatagg

SEQ ID NO: 513177 - DNA, 20 bp, Artificial Sequence
  chemically synthesized
tcagggtaatgctggcttca

SEQ ID NO: 513178 - DNA, 20 bp, Artificial Sequence
  chemically synthesized
taattgtctgggtttggcat

SEQ ID NO: 513179 - DNA, 20 bp, Artificial Sequence
  chemically synthesized
attttttgttgcataattgt

SEQ ID NO: 513180 - DNA, 20 bp, Artificial Sequence
  chemically synthesized
tttctacatcagtgttcatc

SEQ ID NO: 513181 - DNA, 20 bp, Artificial Sequence
  chemically synthesized
tggattgctagcattttgta

SEQ ID NO: 513182 - DNA, 20 bp, Artificial Sequence
  chemically synthesized
attacattttttatgttcta

SEQ ID NO: 513183 - DNA, 20 bp, Artificial Sequence
  chemically synthesized
aaaaatgtaatattatcaag

SEQ ID NO: 513184 - DNA, 20 bp, Artificial Sequence
  chemically synthesized
ggaatttatcccaatgatac

SEQ ID NO: 513185 - DNA, 20 bp, Artificial Sequence
  chemically synthesized
atgatgtatccttgtatcat

SEQ ID NO: 513186 - DNA, 20 bp, Artificial Sequence
  chemically synthesized
atatgacatattacatcaaa

SEQ ID NO: 513187 - DNA, 20 bp, Artificial Sequence
  chemically synthesized
tgttcttttgtgtctattga

SEQ ID NO: 513188 - DNA, 20 bp, Artificial Sequence
  chemically synthesized
tgttggagtttttatctcga

SEQ ID NO: 513189 - DNA, 20 bp, Artificial Sequence
  chemically synthesized
tttttgtatgcctagtttgt

SEQ ID NO: 513190 - DNA, 20 bp, Artificial Sequence
  chemically synthesized
aatctacaagtagtatcaaa

SEQ ID NO: 513191 - DNA, 20 bp, Artificial Sequence
  chemically synthesized
aaaatttctccctataaaac

SEQ ID NO: 513192 - DNA, 20 bp, Artificial Sequence
  chemically synthesized
acctctgcctcccaaagtgc

SEQ ID NO: 513193 - DNA, 20 bp, Artificial Sequence
  chemically synthesized
cagcactttgggaggcagag

SEQ ID NO: 513194 - DNA, 20 bp, Artificial Sequence
  chemically synthesized
actttgggaggcagaggtgg

SEQ ID NO: 513195 - DNA, 20 bp, Artificial Sequence
  chemically synthesized
tggggtttcaccgtgttagc

SEQ ID NO: 513196 - DNA, 20 bp, Artificial Sequence
  chemically synthesized
ttttgtatttttagtagaga

SEQ ID NO: 513197 - DNA, 20 bp, Artificial Sequence
  chemically synthesized
ctcattgcaagctcagcctc

SEQ ID NO: 513198 - DNA, 20 bp, Artificial Sequence
  chemically synthesized
tcttgctctgttgcccaggc

SEQ ID NO: 513199 - DNA, 20 bp, Artificial Sequence
  chemically synthesized
ttggttttttgtttttgaga

SEQ ID NO: 513200 - DNA, 20 bp, Artificial Sequence
  chemically synthesized
aacaaaaaaaagaacaagac

SEQ ID NO: 513201 - DNA, 20 bp, Artificial Sequence
  chemically synthesized
gacctccagtactatgttga

SEQ ID NO: 513202 - DNA, 20 bp, Artificial Sequence
  chemically synthesized
ctaggacctccagtactatg

SEQ ID NO: 513203 - DNA, 20 bp, Artificial Sequence
  chemically synthesized
agatctgagagctttctggt

SEQ ID NO: 513204 - DNA, 20 bp, Artificial Sequence
  chemically synthesized
aaataaatttagtaaagttg

SEQ ID NO: 513205 - DNA, 20 bp, Artificial Sequence
  chemically synthesized
attggtatatagaaatgcta

SEQ ID NO: 513206 - DNA, 20 bp, Artificial Sequence
  chemically synthesized
aacggctggaaataatacct

SEQ ID NO: 513207 - DNA, 20 bp, Artificial Sequence
  chemically synthesized
aacactgacaaaacaaattg

SEQ ID NO: 513208 - DNA, 20 bp, Artificial Sequence
  chemically synthesized
attcttctgaccgataaaca

SEQ ID NO: 513209 - DNA, 20 bp, Artificial Sequence
  chemically synthesized
atcccatgtttatcggtcag

SEQ ID NO: 513210 - DNA, 20 bp, Artificial Sequence
  chemically synthesized
attattcaatgtagaatgct

SEQ ID NO: 513211 - DNA, 20 bp, Artificial Sequence
  chemically synthesized
tctactcaaagcattctaca

SEQ ID NO: 513212 - DNA, 20 bp, Artificial Sequence
  chemically synthesized
agggactgcattattcaatg

SEQ ID NO: 513213 - DNA, 20 bp, Artificial Sequence
  chemically synthesized
ttgaataatgcagtccctat

SEQ ID NO: 513214 - DNA, 20 bp, Artificial Sequence
  chemically synthesized
tccctatcagaatacagaaa

SEQ ID NO: 513215 - DNA, 20 bp, Artificial Sequence
  chemically synthesized
atcaaagaccagcagagagc

SEQ ID NO: 513216 - DNA, 20 bp, Artificial Sequence
  chemically synthesized
aagtctttgttctttttgct

SEQ ID NO: 513217 - DNA, 20 bp, Artificial Sequence
  chemically synthesized
agcaaaaagaacaaagactt

SEQ ID NO: 513218 - DNA, 20 bp, Artificial Sequence
  chemically synthesized
ttgacaaaacagcaaggtgt

SEQ ID NO: 513219 - DNA, 20 bp, Artificial Sequence
  chemically synthesized
aaaacagacatatagaacaa

SEQ ID NO: 513220 - DNA, 20 bp, Artificial Sequence
  chemically synthesized
atggaatagattagagaact

SEQ ID NO: 513221 - DNA, 20 bp, Artificial Sequence
  chemically synthesized
gtaaatacatggatttaatt

SEQ ID NO: 513222 - DNA, 20 bp, Artificial Sequence
  chemically synthesized
aacaagttgtatgtaaatac

SEQ ID NO: 513223 - DNA, 20 bp, Artificial Sequence
  chemically synthesized
caccttcttcaaatggtgct

SEQ ID NO: 513224 - DNA, 20 bp, Artificial Sequence
  chemically synthesized
tcttcaaatggtgctgagaa

SEQ ID NO: 513225 - DNA, 20 bp, Artificial Sequence
  chemically synthesized
tcagatgcagaagtatgaaa

SEQ ID NO: 513226 - DNA, 20 bp, Artificial Sequence
  chemically synthesized
tttctaatatggtgagagac

SEQ ID NO: 513227 - DNA, 20 bp, Artificial Sequence
  chemically synthesized
attagaaaattcagctcaag

SEQ ID NO: 513228 - DNA, 20 bp, Artificial Sequence
  chemically synthesized
aatccttaatccatcttgag

SEQ ID NO: 513229 - DNA, 20 bp, Artificial Sequence
  chemically synthesized
aattcagctcaagatggatt

SEQ ID NO: 513230 - DNA, 20 bp, Artificial Sequence
  chemically synthesized
gagcttctgtaaaacaaagg

SEQ ID NO: 513231 - DNA, 20 bp, Artificial Sequence
  chemically synthesized
aaaacaaaggaaggattcaa

SEQ ID NO: 513232 - DNA, 20 bp, Artificial Sequence
  chemically synthesized
caggttgtctcttcactctg

SEQ ID NO: 513233 - DNA, 20 bp, Artificial Sequence
  chemically synthesized
cagagtgaagagacaacctg

SEQ ID NO: 513234 - DNA, 20 bp, Artificial Sequence
  chemically synthesized
cctagatattagtctcttgt

SEQ ID NO: 513235 - DNA, 20 bp, Artificial Sequence
  chemically synthesized
gactaatatctaggaaatac

SEQ ID NO: 513236 - DNA, 20 bp, Artificial Sequence
  chemically synthesized
ttttttactgttaaattgtt

SEQ ID NO: 513237 - DNA, 20 bp, Artificial Sequence
  chemically synthesized
caaaagaagacaaatgacca

SEQ ID NO: 513238 - DNA, 20 bp, Artificial Sequence
  chemically synthesized
agccatcatcttgccccagt

SEQ ID NO: 513239 - DNA, 20 bp, Artificial Sequence
  chemically synthesized
ctgaactacaacaatgtatt

SEQ ID NO: 513240 - DNA, 20 bp, Artificial Sequence
  chemically synthesized
cttaatacattgttgtagtt

SEQ ID NO: 513241 - DNA, 20 bp, Artificial Sequence
  chemically synthesized
caaaaaactaaacatagaaa

SEQ ID NO: 513242 - DNA, 20 bp, Artificial Sequence
  chemically synthesized
aagtgtccattagtgaacaa

SEQ ID NO: 513243 - DNA, 20 bp, Artificial Sequence
  chemically synthesized
aatgtggtacatatatacag

SEQ ID NO: 513244 - DNA, 20 bp, Artificial Sequence
  chemically synthesized
gtaattcttttttatggatg

SEQ ID NO: 513245 - DNA, 20 bp, Artificial Sequence
  chemically synthesized
aatactcttcatccataaaa

SEQ ID NO: 513246 - DNA, 20 bp, Artificial Sequence
  chemically synthesized
agaaaatgtaattctttttt

SEQ ID NO: 513247 - DNA, 20 bp, Artificial Sequence
  chemically synthesized
attacattttctgcaccaac

SEQ ID NO: 513248 - DNA, 20 bp, Artificial Sequence
  chemically synthesized
aactttttttacacctatat

SEQ ID NO: 513249 - DNA, 20 bp, Artificial Sequence
  chemically synthesized
aagttgttctcatggaaata

SEQ ID NO: 513250 - DNA, 20 bp, Artificial Sequence
  chemically synthesized
ataagataccagaggctagg

SEQ ID NO: 513251 - DNA, 20 bp, Artificial Sequence
  chemically synthesized
gaggctaggaagggtaggaa

SEQ ID NO: 513252 - DNA, 20 bp, Artificial Sequence
  chemically synthesized
ggtaggaagggaatataaaa

SEQ ID NO: 513253 - DNA, 20 bp, Artificial Sequence
  chemically synthesized
atataaaaaggggttattta

SEQ ID NO: 513254 - DNA, 20 bp, Artificial Sequence
  chemically synthesized
ccctttctgctgttgaacat

SEQ ID NO: 513255 - DNA, 20 bp, Artificial Sequence
  chemically synthesized
tctaatgttcaacagcagaa

SEQ ID NO: 513256 - DNA, 20 bp, Artificial Sequence
  chemically synthesized
caacagcagaaaggggtgac

SEQ ID NO: 513257 - DNA, 20 bp, Artificial Sequence
  chemically synthesized
ttttatgttctgtgaacatt

SEQ ID NO: 513258 - DNA, 20 bp, Artificial Sequence
  chemically synthesized
aatgataaatactcaaagta

SEQ ID NO: 513259 - DNA, 20 bp, Artificial Sequence
  chemically synthesized
tatttggggtattcattact

SEQ ID NO: 513260 - DNA, 20 bp, Artificial Sequence
  chemically synthesized
aatggtcaagtcagtgtatt

SEQ ID NO: 513261 - DNA, 20 bp, Artificial Sequence
  chemically synthesized
gtgatattttgttaaacgca

SEQ ID NO: 513262 - DNA, 20 bp, Artificial Sequence
  chemically synthesized
aaaaataaaagttctaaaaa

SEQ ID NO: 513263 - DNA, 20 bp, Artificial Sequence
  chemically synthesized
taaaaagagaataaatctaa

SEQ ID NO: 513264 - DNA, 20 bp, Artificial Sequence
  chemically synthesized
tcttcaggtttccctctgca

SEQ ID NO: 513265 - DNA, 20 bp, Artificial Sequence
  chemically synthesized
gaaatttaattgtcatacaa

SEQ ID NO: 513266 - DNA, 20 bp, Artificial Sequence
  chemically synthesized
atactattttacaacaatat

SEQ ID NO: 513267 - DNA, 20 bp, Artificial Sequence
  chemically synthesized
agtgcccagctttaaggttt

SEQ ID NO: 513268 - DNA, 20 bp, Artificial Sequence
  chemically synthesized
agacatcacagaacctgcaa

SEQ ID NO: 513269 - DNA, 20 bp, Artificial Sequence
  chemically synthesized
tctttttttgtttgtttttg

SEQ ID NO: 513270 - DNA, 20 bp, Artificial Sequence
  chemically synthesized
cagttcttttgcctaggctt

SEQ ID NO: 513271 - DNA, 20 bp, Artificial Sequence
  chemically synthesized
caggagaattgctttaggcc

SEQ ID NO: 513272 - DNA, 20 bp, Artificial Sequence
  chemically synthesized
acattgggaggccaaggcag

SEQ ID NO: 513273 - DNA, 20 bp, Artificial Sequence
  chemically synthesized
gccttggcctcccaatgtgc

SEQ ID NO: 513274 - DNA, 20 bp, Artificial Sequence
  chemically synthesized
ttataagtgatatcacaggg

SEQ ID NO: 513275 - DNA, 20 bp, Artificial Sequence
  chemically synthesized
ttacttcactgtcttcaaaa

SEQ ID NO: 513276 - DNA, 20 bp, Artificial Sequence
  chemically synthesized
ttttaagtcagtgataatat

SEQ ID NO: 513277 - DNA, 20 bp, Artificial Sequence
  chemically synthesized
ccattctaatgatggtaaat

SEQ ID NO: 513278 - DNA, 20 bp, Artificial Sequence
  chemically synthesized
ttattctcatttaccatcat

SEQ ID NO: 513279 - DNA, 20 bp, Artificial Sequence
  chemically synthesized
gatatctgtgtttcttgtca

SEQ ID NO: 513280 - DNA, 20 bp, Artificial Sequence
  chemically synthesized
atcaactatagaacactttt

SEQ ID NO: 513281 - DNA, 20 bp, Artificial Sequence
  chemically synthesized
taattttatttcagctatga

SEQ ID NO: 513282 - DNA, 20 bp, Artificial Sequence
  chemically synthesized
ttcctagtcatatcatcaca

SEQ ID NO: 513283 - DNA, 20 bp, Artificial Sequence
  chemically synthesized
taatatgtaatagacacttt

SEQ ID NO: 513284 - DNA, 20 bp, Artificial Sequence
  chemically synthesized
acagtgacattaagtgattt

SEQ ID NO: 513285 - DNA, 20 bp, Artificial Sequence
  chemically synthesized
ttaatgtcactgtataggcc

SEQ ID NO: 513286 - DNA, 20 bp, Artificial Sequence
  chemically synthesized
tctcttttcaattagcttac

SEQ ID NO: 513287 - DNA, 20 bp, Artificial Sequence
  chemically synthesized
taattcttacctagataact

SEQ ID NO: 513288 - DNA, 20 bp, Artificial Sequence
  chemically synthesized
agattctcagttatctaggt

SEQ ID NO: 513289 - DNA, 20 bp, Artificial Sequence
  chemically synthesized
tgcgattgaagatgtgcatt

SEQ ID NO: 513290 - DNA, 20 bp, Artificial Sequence
  chemically synthesized
tcattatttaaattccccaa

SEQ ID NO: 513291 - DNA, 20 bp, Artificial Sequence
  chemically synthesized
aagagtttcttactcagttg

SEQ ID NO: 513292 - DNA, 20 bp, Artificial Sequence
  chemically synthesized
aaagtatgctttagttaagt

SEQ ID NO: 513293 - DNA, 20 bp, Artificial Sequence
  chemically synthesized
aaaatggtgacaaatcatag

SEQ ID NO: 513294 - DNA, 20 bp, Artificial Sequence
  chemically synthesized
aaataccaaaatttgttata

SEQ ID NO: 513295 - DNA, 20 bp, Artificial Sequence
  chemically synthesized
tgtgtgtgcgggagcctggc

SEQ ID NO: 513296 - DNA, 20 bp, Artificial Sequence
  chemically synthesized
agtctctgttgtctaagtag

SEQ ID NO: 513297 - DNA, 20 bp, Artificial Sequence
  chemically synthesized
tccttatccatttcagttgt

SEQ ID NO: 513298 - DNA, 20 bp, Artificial Sequence
  chemically synthesized
ttgtcatccaaacaactgaa

SEQ ID NO: 513299 - DNA, 20 bp, Artificial Sequence
  chemically synthesized
gttcagataccataaaaaaa

SEQ ID NO: 513300 - DNA, 20 bp, Artificial Sequence
  chemically synthesized
ataacatcaagagaacacac

SEQ ID NO: 513301 - DNA, 20 bp, Artificial Sequence
  chemically synthesized
ctaaaagttagaagaggcat

SEQ ID NO: 513302 - DNA, 20 bp, Artificial Sequence
  chemically synthesized
ggaaattgctacaataatat

SEQ ID NO: 513303 - DNA, 20 bp, Artificial Sequence
  chemically synthesized
aatatttcactggcacttac

SEQ ID NO: 513304 - DNA, 20 bp, Artificial Sequence
  chemically synthesized
cttaaatatattttcaactg

SEQ ID NO: 513305 - DNA, 20 bp, Artificial Sequence
  chemically synthesized
tgtaaatatttcagacaatt

SEQ ID NO: 513306 - DNA, 20 bp, Artificial Sequence
  chemically synthesized
ttgtctgaaatatttacagt

SEQ ID NO: 513307 - DNA, 20 bp, Artificial Sequence
  chemically synthesized
tgaaaacaaggtactctata

SEQ ID NO: 513308 - DNA, 20 bp, Artificial Sequence
  chemically synthesized
tttttgtctagaactcatta

SEQ ID NO: 513309 - DNA, 20 bp, Artificial Sequence
  chemically synthesized
gggttaattctcaggaggat

SEQ ID NO: 513310 - DNA, 20 bp, Artificial Sequence
  chemically synthesized
aaattaactctaatcctcct

SEQ ID NO: 513311 - DNA, 20 bp, Artificial Sequence
  chemically synthesized
ttgagagggttaattctcag

SEQ ID NO: 513312 - DNA, 20 bp, Artificial Sequence
  chemically synthesized
tttacacaggttaaaattga

SEQ ID NO: 513313 - DNA, 20 bp, Artificial Sequence
  chemically synthesized
tatttttaaggcctcttatg

SEQ ID NO: 513314 - DNA, 20 bp, Artificial Sequence
  chemically synthesized
tagaatttgctataaaagag

SEQ ID NO: 513315 - DNA, 20 bp, Artificial Sequence
  chemically synthesized
aataatcatggaaagataca

SEQ ID NO: 513316 - DNA, 20 bp, Artificial Sequence
  chemically synthesized
gacttggctttgtatgcatg

SEQ ID NO: 513317 - DNA, 20 bp, Artificial Sequence
  chemically synthesized
agtctgaaagcattcactcc

SEQ ID NO: 513318 - DNA, 20 bp, Artificial Sequence
  chemically synthesized
tggaaagttttactcctgga

SEQ ID NO: 513319 - DNA, 20 bp, Artificial Sequence
  chemically synthesized
ctgttggaaagttttactcc

SEQ ID NO: 513320 - DNA, 20 bp, Artificial Sequence
  chemically synthesized
tttttatagccttcttttcc

SEQ ID NO: 513321 - DNA, 20 bp, Artificial Sequence
  chemically synthesized
gaaggctataaaaacaactc

SEQ ID NO: 513322 - DNA, 20 bp, Artificial Sequence
  chemically synthesized
ggctaatccctgcatcactc

SEQ ID NO: 513323 - DNA, 20 bp, Artificial Sequence
  chemically synthesized
aaacaactcaagagtgatgc

SEQ ID NO: 513324 - DNA, 20 bp, Artificial Sequence
  chemically synthesized
gggattagccaagcagaaaa

SEQ ID NO: 513325 - DNA, 20 bp, Artificial Sequence
  chemically synthesized
gacttcctgagaatggtgac

SEQ ID NO: 513326 - DNA, 20 bp, Artificial Sequence
  chemically synthesized
cccctttattttgacttcct

SEQ ID NO: 513327 - DNA, 20 bp, Artificial Sequence
  chemically synthesized
tctcaggaagtcaaaataaa

SEQ ID NO: 513328 - DNA, 20 bp, Artificial Sequence
  chemically synthesized
gggattaaaaccaaacccta

SEQ ID NO: 513329 - DNA, 20 bp, Artificial Sequence
  chemically synthesized
aatgacatttacaaacccgt

SEQ ID NO: 513330 - DNA, 20 bp, Artificial Sequence
  chemically synthesized
gggtttgtaaatgtcatttt

SEQ ID NO: 513331 - DNA, 20 bp, Artificial Sequence
  chemically synthesized
tgaggatacaaaaatttctc

SEQ ID NO: 513332 - DNA, 20 bp, Artificial Sequence
  chemically synthesized
agggtaactttagaacaaaa

SEQ ID NO: 513333 - DNA, 20 bp, Artificial Sequence
  chemically synthesized
aaatgttcttacttatttac

SEQ ID NO: 513334 - DNA, 20 bp, Artificial Sequence
  chemically synthesized
tgtagaaagccatttccatt

SEQ ID NO: 513335 - DNA, 20 bp, Artificial Sequence
  chemically synthesized
gcgcctgttctagatgtctt

SEQ ID NO: 513336 - DNA, 20 bp, Artificial Sequence
  chemically synthesized
aaggaataaaacaaaaaatc

SEQ ID NO: 513337 - DNA, 20 bp, Artificial Sequence
  chemically synthesized
agtgaggatgttctctttaa

SEQ ID NO: 513338 - DNA, 20 bp, Artificial Sequence
  chemically synthesized
tcccctgtgaataacaaagt

SEQ ID NO: 513339 - DNA, 20 bp, Artificial Sequence
  chemically synthesized
tgctttgtcagctttcccct

SEQ ID NO: 513340 - DNA, 20 bp, Artificial Sequence
  chemically synthesized
aaaaatcctccctatattaa

SEQ ID NO: 513341 - DNA, 20 bp, Artificial Sequence
  chemically synthesized
aagcactctcttaatatagg

SEQ ID NO: 513342 - DNA, 20 bp, Artificial Sequence
  chemically synthesized
gtttcatatacattgtttct

SEQ ID NO: 513343 - DNA, 20 bp, Artificial Sequence
  chemically synthesized
acattctacatgcgttggtc

SEQ ID NO: 513344 - DNA, 20 bp, Artificial Sequence
  chemically synthesized
aaacccacgaccaacgcatg

SEQ ID NO: 513345 - DNA, 20 bp, Artificial Sequence
  chemically synthesized
cagagaaatcataacgggaa

SEQ ID NO: 513346 - DNA, 20 bp, Artificial Sequence
  chemically synthesized
gagaattgtctgattcacaa

SEQ ID NO: 513347 - DNA, 20 bp, Artificial Sequence
  chemically synthesized
ctctttaaaaatatcctttt

SEQ ID NO: 513348 - DNA, 20 bp, Artificial Sequence
  chemically synthesized
tatgcaaaaataagtacatc

SEQ ID NO: 513349 - DNA, 20 bp, Artificial Sequence
  chemically synthesized
aagtggaattgccttttaaa

SEQ ID NO: 513350 - DNA, 20 bp, Artificial Sequence
  chemically synthesized
gcctgaggtttagttttaag

SEQ ID NO: 513351 - DNA, 20 bp, Artificial Sequence
  chemically synthesized
accttgtaggatttcatata

SEQ ID NO: 513352 - DNA, 20 bp, Artificial Sequence
  chemically synthesized
aggaagtcattgaaaccttg

SEQ ID NO: 513353 - DNA, 20 bp, Artificial Sequence
  chemically synthesized
ttaaacataagctttgttga

SEQ ID NO: 513354 - DNA, 20 bp, Artificial Sequence
  chemically synthesized
tggggagaattttattattg

SEQ ID NO: 513355 - DNA, 20 bp, Artificial Sequence
  chemically synthesized
agaataatgaaacatttggg

SEQ ID NO: 513356 - DNA, 20 bp, Artificial Sequence
  chemically synthesized
aaattagttatgccccttag

SEQ ID NO: 513357 - DNA, 20 bp, Artificial Sequence
  chemically synthesized
tttaaaatgaaatttctttg

SEQ ID NO: 513358 - DNA, 20 bp, Artificial Sequence
  chemically synthesized
aaagcaattactatacaggc

SEQ ID NO: 513359 - DNA, 20 bp, Artificial Sequence
  chemically synthesized
ttactatacaggcatgaatc

SEQ ID NO: 513360 - DNA, 20 bp, Artificial Sequence
  chemically synthesized
ttgctggtaaatctatcgaa

SEQ ID NO: 513361 - DNA, 20 bp, Artificial Sequence
  chemically synthesized
gtcagtaaataaaaattctt

SEQ ID NO: 513362 - DNA, 20 bp, Artificial Sequence
  chemically synthesized
agaaaaaaataataactcat

SEQ ID NO: 513363 - DNA, 20 bp, Artificial Sequence
  chemically synthesized
atgagttattatttttttct

SEQ ID NO: 513364 - DNA, 20 bp, Artificial Sequence
  chemically synthesized
ggtttccctaacacaatggc

SEQ ID NO: 513365 - DNA, 20 bp, Artificial Sequence
  chemically synthesized
ttaaaaatatatgacttatg

SEQ ID NO: 513366 - DNA, 20 bp, Artificial Sequence
  chemically synthesized
cttatggctgcaaataagat

SEQ ID NO: 513367 - DNA, 20 bp, Artificial Sequence
  chemically synthesized
tattattatactttaagttt

SEQ ID NO: 513368 - DNA, 20 bp, Artificial Sequence
  chemically synthesized
ggaaatacctaacatagatg

SEQ ID NO: 513369 - DNA, 20 bp, Artificial Sequence
  chemically synthesized
tttggggtgtgtggggctag

SEQ ID NO: 513370 - DNA, 20 bp, Artificial Sequence
  chemically synthesized
catcacacactggggccttt

SEQ ID NO: 513371 - DNA, 20 bp, Artificial Sequence
  chemically synthesized
gagttgaacaaccagaagac

SEQ ID NO: 513372 - DNA, 20 bp, Artificial Sequence
  chemically synthesized
tggttgttcaactccgattt

SEQ ID NO: 513373 - DNA, 20 bp, Artificial Sequence
  chemically synthesized
gcatgttctcactcataaat

SEQ ID NO: 513374 - DNA, 20 bp, Artificial Sequence
  chemically synthesized
gatttatgagtgagaacatg

SEQ ID NO: 513375 - DNA, 20 bp, Artificial Sequence
  chemically synthesized
tgttcctatgttagtttgct

SEQ ID NO: 513376 - DNA, 20 bp, Artificial Sequence
  chemically synthesized
ttcatgtcctttgcagggat

SEQ ID NO: 513377 - DNA, 20 bp, Artificial Sequence
  chemically synthesized
atgagtttcatgtcctttgc

SEQ ID NO: 513378 - DNA, 20 bp, Artificial Sequence
  chemically synthesized
ctatgcagcaacaaaaaagg

SEQ ID NO: 513379 - DNA, 20 bp, Artificial Sequence
  chemically synthesized
aatactatgcagcaacaaaa

SEQ ID NO: 513380 - DNA, 20 bp, Artificial Sequence
  chemically synthesized
aatttggcacatatacacca

SEQ ID NO: 513381 - DNA, 20 bp, Artificial Sequence
  chemically synthesized
aaatgcccatcaatgataga

SEQ ID NO: 513382 - DNA, 20 bp, Artificial Sequence
  chemically synthesized
agtctatcattgatgggcat

SEQ ID NO: 513383 - DNA, 20 bp, Artificial Sequence
  chemically synthesized
ggtttcaagtctttgctatt

SEQ ID NO: 513384 - DNA, 20 bp, Artificial Sequence
  chemically synthesized
gaatagtgctgaaataagca

SEQ ID NO: 513385 - DNA, 20 bp, Artificial Sequence
  chemically synthesized
acagaataatttataatcct

SEQ ID NO: 513386 - DNA, 20 bp, Artificial Sequence
  chemically synthesized
catcactgggtatataccca

SEQ ID NO: 513387 - DNA, 20 bp, Artificial Sequence
  chemically synthesized
tttgggtatatacccagtga

SEQ ID NO: 513388 - DNA, 20 bp, Artificial Sequence
  chemically synthesized
ttgaccaagcaatcccatca

SEQ ID NO: 513389 - DNA, 20 bp, Artificial Sequence
  chemically synthesized
agacagtgtggtgattgctc

SEQ ID NO: 513390 - DNA, 20 bp, Artificial Sequence
  chemically synthesized
aggaatgattttacactgtt

SEQ ID NO: 513391 - DNA, 20 bp, Artificial Sequence
  chemically synthesized
tggagagaatatggagaaat

SEQ ID NO: 513392 - DNA, 20 bp, Artificial Sequence
  chemically synthesized
aggaaacaacagatgctgga

SEQ ID NO: 513393 - DNA, 20 bp, Artificial Sequence
  chemically synthesized
agataccatctcatgctagt

SEQ ID NO: 513394 - DNA, 20 bp, Artificial Sequence
  chemically synthesized
acataaatgtcttctttgag

SEQ ID NO: 513395 - DNA, 20 bp, Artificial Sequence
  chemically synthesized
accccatcaaaaagtaggca

SEQ ID NO: 513396 - DNA, 20 bp, Artificial Sequence
  chemically synthesized
accctttgcctactttttga

SEQ ID NO: 513397 - DNA, 20 bp, Artificial Sequence
  chemically synthesized
aaatttgtttcttgtagatt

SEQ ID NO: 513398 - DNA, 20 bp, Artificial Sequence
  chemically synthesized
tctgacaaagggctaatatc

SEQ ID NO: 513399 - DNA, 20 bp, Artificial Sequence
  chemically synthesized
cagagtgaacaggcagccta

SEQ ID NO: 513400 - DNA, 20 bp, Artificial Sequence
  chemically synthesized
cagcaaaagaaaactatcat

SEQ ID NO: 513401 - DNA, 20 bp, Artificial Sequence
  chemically synthesized
gtattgcctaggttttcttc

SEQ ID NO: 513402 - DNA, 20 bp, Artificial Sequence
  chemically synthesized
atttaagtctttaatccatc

SEQ ID NO: 513403 - DNA, 20 bp, Artificial Sequence
  chemically synthesized
tatacaaaaattaactcaag

SEQ ID NO: 513404 - DNA, 20 bp, Artificial Sequence
  chemically synthesized
cttgagttaatttttgtata

SEQ ID NO: 513405 - DNA, 20 bp, Artificial Sequence
  chemically synthesized
ttttgtataaggggtaagga

SEQ ID NO: 513406 - DNA, 20 bp, Artificial Sequence
  chemically synthesized
ccatcatcatttattaaata

SEQ ID NO: 513407 - DNA, 20 bp, Artificial Sequence
  chemically synthesized
gtaccagaacagatacatag

SEQ ID NO: 513408 - DNA, 20 bp, Artificial Sequence
  chemically synthesized
ccagctttgttatttttgct

SEQ ID NO: 513409 - DNA, 20 bp, Artificial Sequence
  chemically synthesized
gctacaattcactttcttca

SEQ ID NO: 513410 - DNA, 20 bp, Artificial Sequence
  chemically synthesized
tttctaattctgtgaagaaa

SEQ ID NO: 513411 - DNA, 20 bp, Artificial Sequence
  chemically synthesized
tgtagcttaatgaggtaaca

SEQ ID NO: 513412 - DNA, 20 bp, Artificial Sequence
  chemically synthesized
attccatgcttatggatagg

SEQ ID NO: 513413 - DNA, 20 bp, Artificial Sequence
  chemically synthesized
attcttcctatccataagca

SEQ ID NO: 513414 - DNA, 20 bp, Artificial Sequence
  chemically synthesized
tgaaaaaacattccatgctt

SEQ ID NO: 513415 - DNA, 20 bp, Artificial Sequence
  chemically synthesized
tccttcacatcccttataag

SEQ ID NO: 513416 - DNA, 20 bp, Artificial Sequence
  chemically synthesized
tcctagcaatccaacttata

SEQ ID NO: 513417 - DNA, 20 bp, Artificial Sequence
  chemically synthesized
cccttataagttggattgct

SEQ ID NO: 513418 - DNA, 20 bp, Artificial Sequence
  chemically synthesized
tacaattgctacaaggagaa

SEQ ID NO: 513419 - DNA, 20 bp, Artificial Sequence
  chemically synthesized
ccatttacaattgctacaag

SEQ ID NO: 513420 - DNA, 20 bp, Artificial Sequence
  chemically synthesized
tccttgtagcaattgtaaat

SEQ ID NO: 513421 - DNA, 20 bp, Artificial Sequence
  chemically synthesized
cgataataaacagccaaatc

SEQ ID NO: 513422 - DNA, 20 bp, Artificial Sequence
  chemically synthesized
gctgtttattatcggtgtat

SEQ ID NO: 513423 - DNA, 20 bp, Artificial Sequence
  chemically synthesized
aggcagtgtcaacaaagtct

SEQ ID NO: 513424 - DNA, 20 bp, Artificial Sequence
  chemically synthesized
gagattttcggctgagatga

SEQ ID NO: 513425 - DNA, 20 bp, Artificial Sequence
  chemically synthesized
aatcatgtcatctgcaaaca

SEQ ID NO: 513426 - DNA, 20 bp, Artificial Sequence
  chemically synthesized
gtcatctgcaaacagagaat

SEQ ID NO: 513427 - DNA, 20 bp, Artificial Sequence
  chemically synthesized
acaatcaggcaggagaaaga

SEQ ID NO: 513428 - DNA, 20 bp, Artificial Sequence
  chemically synthesized
ccagaacttccaatactatg

SEQ ID NO: 513429 - DNA, 20 bp, Artificial Sequence
  chemically synthesized
cttccaatactatgttgaat

SEQ ID NO: 513430 - DNA, 20 bp, Artificial Sequence
  chemically synthesized
tgaataggagtgatgagaga

SEQ ID NO: 513431 - DNA, 20 bp, Artificial Sequence
  chemically synthesized
gtcttgtgccagtttttaaa

SEQ ID NO: 513432 - DNA, 20 bp, Artificial Sequence
  chemically synthesized
tacccacagccaatatcata

SEQ ID NO: 513433 - DNA, 20 bp, Artificial Sequence
  chemically synthesized
cattcagtatgatattggct

SEQ ID NO: 513434 - DNA, 20 bp, Artificial Sequence
  chemically synthesized
ttcaataaactaggtattga

SEQ ID NO: 513435 - DNA, 20 bp, Artificial Sequence
  chemically synthesized
tattgaaaatttttagcatg

SEQ ID NO: 513436 - DNA, 20 bp, Artificial Sequence
  chemically synthesized
aatttttagcatgaagggta

SEQ ID NO: 513437 - DNA, 20 bp, Artificial Sequence
  chemically synthesized
tcattggttctgtttatgtg

SEQ ID NO: 513438 - DNA, 20 bp, Artificial Sequence
  chemically synthesized
ttaaactaatcttgcatccc

SEQ ID NO: 513439 - DNA, 20 bp, Artificial Sequence
  chemically synthesized
gatcaagttggcttcatccc

SEQ ID NO: 513440 - DNA, 20 bp, Artificial Sequence
  chemically synthesized
atgaagccaacttgatcatg

SEQ ID NO: 513441 - DNA, 20 bp, Artificial Sequence
  chemically synthesized
ataacctttttgatgtgctg

SEQ ID NO: 513442 - DNA, 20 bp, Artificial Sequence
  chemically synthesized
ctcaataaaatactggcaaa

SEQ ID NO: 513443 - DNA, 20 bp, Artificial Sequence
  chemically synthesized
ctttcacattgatgttcatc

SEQ ID NO: 513444 - DNA, 20 bp, Artificial Sequence
  chemically synthesized
tctctgccaggttttggtat

SEQ ID NO: 513445 - DNA, 20 bp, Artificial Sequence
  chemically synthesized
gatgatgttggcctcataaa

SEQ ID NO: 513446 - DNA, 20 bp, Artificial Sequence
  chemically synthesized
cctcataaaatgagttaggg

SEQ ID NO: 513447 - DNA, 20 bp, Artificial Sequence
  chemically synthesized
gtccttatttttctattgtt

SEQ ID NO: 513448 - DNA, 20 bp, Artificial Sequence
  chemically synthesized
ttgtttggaatagtttcaga

SEQ ID NO: 513449 - DNA, 20 bp, Artificial Sequence
  chemically synthesized
gctcctctttgtacctctgg

SEQ ID NO: 513450 - DNA, 20 bp, Artificial Sequence
  chemically synthesized
acctctggtagaattcggct

SEQ ID NO: 513451 - DNA, 20 bp, Artificial Sequence
  chemically synthesized
aggaccagacagattcacag

SEQ ID NO: 513452 - DNA, 20 bp, Artificial Sequence
  chemically synthesized
aacttgttattgttctattc

SEQ ID NO: 513453 - DNA, 20 bp, Artificial Sequence
  chemically synthesized
accaggaagaagtcaaatcc

SEQ ID NO: 513454 - DNA, 20 bp, Artificial Sequence
  chemically synthesized
tcttcctggtttaatcttgg

SEQ ID NO: 513455 - DNA, 20 bp, Artificial Sequence
  chemically synthesized
ttggaagagtgtatatgtac

SEQ ID NO: 513456 - DNA, 20 bp, Artificial Sequence
  chemically synthesized
agaaatacaaactaccatca

SEQ ID NO: 513457 - DNA, 20 bp, Artificial Sequence
  chemically synthesized
gatggtagtttgtatttctg

SEQ ID NO: 513458 - DNA, 20 bp, Artificial Sequence
  chemically synthesized
acacagtaaaaaatgataaa

SEQ ID NO: 513459 - DNA, 20 bp, Artificial Sequence
  chemically synthesized
taaaaaagaagaaaagagag

SEQ ID NO: 513460 - DNA, 20 bp, Artificial Sequence
  chemically synthesized
tcttttcaaaaaaacagctc

SEQ ID NO: 513461 - DNA, 20 bp, Artificial Sequence
  chemically synthesized
tcaaaaaaacagctcctgaa

SEQ ID NO: 513462 - DNA, 20 bp, Artificial Sequence
  chemically synthesized
gaattgagtttttttttttt

SEQ ID NO: 513463 - DNA, 20 bp, Artificial Sequence
  chemically synthesized
tatttgtcttctgatagctt

SEQ ID NO: 513464 - DNA, 20 bp, Artificial Sequence
  chemically synthesized
agttcatttaattgtgatgt

SEQ ID NO: 513465 - DNA, 20 bp, Artificial Sequence
  chemically synthesized
agaacaaacacacaatgtag

SEQ ID NO: 513466 - DNA, 20 bp, Artificial Sequence
  chemically synthesized
aacctgctcctgggtgacta

SEQ ID NO: 513467 - DNA, 20 bp, Artificial Sequence
  chemically synthesized
gaagctgaacaaacctgctc

SEQ ID NO: 513468 - DNA, 20 bp, Artificial Sequence
  chemically synthesized
ttccatgtagttgtgcactt

SEQ ID NO: 513469 - DNA, 20 bp, Artificial Sequence
  chemically synthesized
agtgcaatctaattagaatg

SEQ ID NO: 513470 - DNA, 20 bp, Artificial Sequence
  chemically synthesized
agatcacagtgcaatctaat

SEQ ID NO: 513471 - DNA, 20 bp, Artificial Sequence
  chemically synthesized
atactcctcagcaaatgcaa

SEQ ID NO: 513472 - DNA, 20 bp, Artificial Sequence
  chemically synthesized
tcattcttttgcatttgctg

SEQ ID NO: 513473 - DNA, 20 bp, Artificial Sequence
  chemically synthesized
tccaattatgtcgtcaattt

SEQ ID NO: 513474 - DNA, 20 bp, Artificial Sequence
  chemically synthesized
aagtgcaatgtggtgctgag

SEQ ID NO: 513475 - DNA, 20 bp, Artificial Sequence
  chemically synthesized
gaatgtatattctgttgatt

SEQ ID NO: 513476 - DNA, 20 bp, Artificial Sequence
  chemically synthesized
aactctccaccccaaatcaa

SEQ ID NO: 513477 - DNA, 20 bp, Artificial Sequence
  chemically synthesized
tattctgttgatttggggtg

SEQ ID NO: 513478 - DNA, 20 bp, Artificial Sequence
  chemically synthesized
tccagagctgagctcaagta

SEQ ID NO: 513479 - DNA, 20 bp, Artificial Sequence
  chemically synthesized
caacgagacagaaaattaaa

SEQ ID NO: 513480 - DNA, 20 bp, Artificial Sequence
  chemically synthesized
gatctgtctaatattgacag

SEQ ID NO: 513481 - DNA, 20 bp, Artificial Sequence
  chemically synthesized
gtctcccactattattgtgt

SEQ ID NO: 513482 - DNA, 20 bp, Artificial Sequence
  chemically synthesized
cgctggcgttccaggcacca

SEQ ID NO: 513483 - DNA, 20 bp, Artificial Sequence
  chemically synthesized
ggtttcagccccctttccag

SEQ ID NO: 513484 - DNA, 20 bp, Artificial Sequence
  chemically synthesized
cttgctgggctccgtgggcg

SEQ ID NO: 513485 - DNA, 20 bp, Artificial Sequence
  chemically synthesized
gcagcgagaattacaagcca

SEQ ID NO: 513486 - DNA, 20 bp, Artificial Sequence
  chemically synthesized
cagactgctgtgctggcagc

SEQ ID NO: 513487 - DNA, 20 bp, Artificial Sequence
  chemically synthesized
gcgtccgccattactgaggc

SEQ ID NO: 513488 - DNA, 20 bp, Artificial Sequence
  chemically synthesized
agatgccctgcccagagagg

SEQ ID NO: 513489 - DNA, 20 bp, Artificial Sequence
  chemically synthesized
gtgctctgtctcagggagat

SEQ ID NO: 513490 - DNA, 20 bp, Artificial Sequence
  chemically synthesized
acgtgagggaaggggcagct

SEQ ID NO: 513491 - DNA, 20 bp, Artificial Sequence
  chemically synthesized
atctcctaggcaggaggcac

SEQ ID NO: 513492 - DNA, 20 bp, Artificial Sequence
  chemically synthesized
cctaggagatgcctcccagc

SEQ ID NO: 513493 - DNA, 20 bp, Artificial Sequence
  chemically synthesized
agagctctggctggcaactg

SEQ ID NO: 513494 - DNA, 20 bp, Artificial Sequence
  chemically synthesized
cctctgggacgaagcttcca

SEQ ID NO: 513495 - DNA, 20 bp, Artificial Sequence
  chemically synthesized
gctggtgatacccaggcaaa

SEQ ID NO: 513496 - DNA, 20 bp, Artificial Sequence
  chemically synthesized
ccactctagaccctatttgc

SEQ ID NO: 513497 - DNA, 20 bp, Artificial Sequence
  chemically synthesized
atacccaggcaaatagggtc

SEQ ID NO: 513498 - DNA, 20 bp, Artificial Sequence
  chemically synthesized
cccctctgctgcaggtttgc

SEQ ID NO: 513499 - DNA, 20 bp, Artificial Sequence
  chemically synthesized
gaaggaaaactaaaacagaa

SEQ ID NO: 513500 - DNA, 20 bp, Artificial Sequence
  chemically synthesized
ccttcagatggggtttctga

SEQ ID NO: 513501 - DNA, 20 bp, Artificial Sequence
  chemically synthesized
gtgaccttcagatggggttt

SEQ ID NO: 513502 - DNA, 20 bp, Artificial Sequence
  chemically synthesized
tgacattggtgaccttcaga

SEQ ID NO: 513503 - DNA, 20 bp, Artificial Sequence
  chemically synthesized
gctggtttttcctcatcttt

SEQ ID NO: 513504 - DNA, 20 bp, Artificial Sequence
  chemically synthesized
tgaggaaaaaccagcacaaa

SEQ ID NO: 513505 - DNA, 20 bp, Artificial Sequence
  chemically synthesized
agaagaggtgttctgggttt

SEQ ID NO: 513506 - DNA, 20 bp, Artificial Sequence
  chemically synthesized
tttggaggagaagaggtgtt

SEQ ID NO: 513507 - DNA, 20 bp, Artificial Sequence
  chemically synthesized
agaacacctcttctcctcca

SEQ ID NO: 513508 - DNA, 20 bp, Artificial Sequence
  chemically synthesized
ttttgttctcttgtttggtg

SEQ ID NO: 513509 - DNA, 20 bp, Artificial Sequence
  chemically synthesized
caccaaacaagagaacaaaa

SEQ ID NO: 513510 - DNA, 20 bp, Artificial Sequence
  chemically synthesized
caagagaacaaaactggatg

SEQ ID NO: 513511 - DNA, 20 bp, Artificial Sequence
  chemically synthesized
agaacaaaactggatggaga

SEQ ID NO: 513512 - DNA, 20 bp, Artificial Sequence
  chemically synthesized
ctggatggagaatgagtatg

SEQ ID NO: 513513 - DNA, 20 bp, Artificial Sequence
  chemically synthesized
acataagtaggcttcagaag

SEQ ID NO: 513514 - DNA, 20 bp, Artificial Sequence
  chemically synthesized
aacatgctcctttagcttgg

SEQ ID NO: 513515 - DNA, 20 bp, Artificial Sequence
  chemically synthesized
aggttcttagcttccttcca

SEQ ID NO: 513516 - DNA, 20 bp, Artificial Sequence
  chemically synthesized
gaaccttgaaaaaaggttag

SEQ ID NO: 513517 - DNA, 20 bp, Artificial Sequence
  chemically synthesized
ctctgatatcttttcttctg

SEQ ID NO: 513518 - DNA, 20 bp, Artificial Sequence
  chemically synthesized
gaagacaagattagagaaaa

SEQ ID NO: 513519 - DNA, 20 bp, Artificial Sequence
  chemically synthesized
ttagagaaaaaagaatgaaa

SEQ ID NO: 513520 - DNA, 20 bp, Artificial Sequence
  chemically synthesized
atacctgggaaaacattctt

SEQ ID NO: 513521 - DNA, 20 bp, Artificial Sequence
  chemically synthesized
ttcgccgggataatatcctg

SEQ ID NO: 513522 - DNA, 20 bp, Artificial Sequence
  chemically synthesized
gctagtttgggaaagttcgc

SEQ ID NO: 513523 - DNA, 20 bp, Artificial Sequence
  chemically synthesized
gttctctgtatttcctaaat

SEQ ID NO: 513524 - DNA, 20 bp, Artificial Sequence
  chemically synthesized
tctttttgaggagtattttt

SEQ ID NO: 513525 - DNA, 20 bp, Artificial Sequence
  chemically synthesized
tcttggggttgctctttttg

SEQ ID NO: 513526 - DNA, 20 bp, Artificial Sequence
  chemically synthesized
aatctgacaattatgtgtct

SEQ ID NO: 513527 - DNA, 20 bp, Artificial Sequence
  chemically synthesized
tttccttcatttcaaccttg

SEQ ID NO: 513528 - DNA, 20 bp, Artificial Sequence
  chemically synthesized
agtctgatgggcttcccttt

SEQ ID NO: 513529 - DNA, 20 bp, Artificial Sequence
  chemically synthesized
ccctactctcttctggcttg

SEQ ID NO: 513530 - DNA, 20 bp, Artificial Sequence
  chemically synthesized
agaaaccctacaagccagaa

SEQ ID NO: 513531 - DNA, 20 bp, Artificial Sequence
  chemically synthesized
taaaaattattttaagaatg

SEQ ID NO: 513532 - DNA, 20 bp, Artificial Sequence
  chemically synthesized
tctgagttaaaaattatttt

SEQ ID NO: 513533 - DNA, 20 bp, Artificial Sequence
  chemically synthesized
tcttaaaataatttttaact

SEQ ID NO: 513534 - DNA, 20 bp, Artificial Sequence
  chemically synthesized
gtttgactggctatgaaatt

SEQ ID NO: 513535 - DNA, 20 bp, Artificial Sequence
  chemically synthesized
cttcataagcgaaggagaaa

SEQ ID NO: 513536 - DNA, 20 bp, Artificial Sequence
  chemically synthesized
accagctagcatcataatga

SEQ ID NO: 513537 - DNA, 20 bp, Artificial Sequence
  chemically synthesized
aaaagacacagactggcaaa

SEQ ID NO: 513538 - DNA, 20 bp, Artificial Sequence
  chemically synthesized
acagactggcaaattggatg

SEQ ID NO: 513539 - DNA, 20 bp, Artificial Sequence
  chemically synthesized
cacacataggctcaaaataa

SEQ ID NO: 513540 - DNA, 20 bp, Artificial Sequence
  chemically synthesized
ggctcaaaataaaaggatag

SEQ ID NO: 513541 - DNA, 20 bp, Artificial Sequence
  chemically synthesized
aaagcaaaaaaaataaaagc

SEQ ID NO: 513542 - DNA, 20 bp, Artificial Sequence
  chemically synthesized
aagtctattttatcagagaa

SEQ ID NO: 513543 - DNA, 20 bp, Artificial Sequence
  chemically synthesized
gtttaaagtctattttatca

SEQ ID NO: 513544 - DNA, 20 bp, Artificial Sequence
  chemically synthesized
agggcattacataatggtaa

SEQ ID NO: 513545 - DNA, 20 bp, Artificial Sequence
  chemically synthesized
gtattgggtgcatatatatt

SEQ ID NO: 513546 - DNA, 20 bp, Artificial Sequence
  chemically synthesized
tgaatctgggtgctcctgta

SEQ ID NO: 513547 - DNA, 20 bp, Artificial Sequence
  chemically synthesized
taagaacttgctttatgaat

SEQ ID NO: 513548 - DNA, 20 bp, Artificial Sequence
  chemically synthesized
ggtctctaagaacttgcttt

SEQ ID NO: 513549 - DNA, 20 bp, Artificial Sequence
  chemically synthesized
gtctcccactattattgttt

SEQ ID NO: 513550 - DNA, 20 bp, Artificial Sequence
  chemically synthesized
cgttgatctaatgttggcag

SEQ ID NO: 513551 - DNA, 20 bp, Artificial Sequence
  chemically synthesized
caacgagacagaaaattaac

SEQ ID NO: 513552 - DNA, 20 bp, Artificial Sequence
  chemically synthesized
gaggtccacttggtccagag

SEQ ID NO: 513553 - DNA, 20 bp, Artificial Sequence
  chemically synthesized
tattctgttgatttggggtg

SEQ ID NO: 513554 - DNA, 20 bp, Artificial Sequence
  chemically synthesized
aactctccaccccaaatcaa

SEQ ID NO: 513555 - DNA, 20 bp, Artificial Sequence
  chemically synthesized
gaatgtatattctgttgatt

SEQ ID NO: 513556 - DNA, 20 bp, Artificial Sequence
  chemically synthesized
aagtatgatgtggtgctgag

SEQ ID NO: 513557 - DNA, 20 bp, Artificial Sequence
  chemically synthesized
tctaattatgtgatcaattt

SEQ ID NO: 513558 - DNA, 20 bp, Artificial Sequence
  chemically synthesized
tcattcttttgcatttgctg

SEQ ID NO: 513559 - DNA, 20 bp, Artificial Sequence
  chemically synthesized
acactcctcagcaaatgcaa

SEQ ID NO: 513560 - DNA, 20 bp, Artificial Sequence
  chemically synthesized
agtgcaaacaaattagaact

SEQ ID NO: 513561 - DNA, 20 bp, Artificial Sequence
  chemically synthesized
tttgagtgagtttcttaatc

SEQ ID NO: 513562 - DNA, 20 bp, Artificial Sequence
  chemically synthesized
atgtagttgtatggttttga

SEQ ID NO: 513563 - DNA, 20 bp, Artificial Sequence
  chemically synthesized
ttccatgtagttgtatggtt

SEQ ID NO: 513564 - DNA, 20 bp, Artificial Sequence
  chemically synthesized
tggaaactaacaatctgctt

SEQ ID NO: 513565 - DNA, 20 bp, Artificial Sequence
  chemically synthesized
aatctgcttctgaataacta

SEQ ID NO: 513566 - DNA, 20 bp, Artificial Sequence
  chemically synthesized
aataactactgggtaaataa

SEQ ID NO: 513567 - DNA, 20 bp, Artificial Sequence
  chemically synthesized
aagaacttctttatttctgt

SEQ ID NO: 513568 - DNA, 20 bp, Artificial Sequence
  chemically synthesized
agaacaaagatacaatgtgc

SEQ ID NO: 513569 - DNA, 20 bp, Artificial Sequence
  chemically synthesized
agttctttcagttgtgatgt

SEQ ID NO: 513570 - DNA, 20 bp, Artificial Sequence
  chemically synthesized
tcttcaaaaaaaaacacctc

SEQ ID NO: 513571 - DNA, 20 bp, Artificial Sequence
  chemically synthesized
actaataaagaaaaatagag

SEQ ID NO: 513572 - DNA, 20 bp, Artificial Sequence
  chemically synthesized
acacaataaaaaatgataaa

SEQ ID NO: 513573 - DNA, 20 bp, Artificial Sequence
  chemically synthesized
gatggtagtttgtatttctg

SEQ ID NO: 513574 - DNA, 20 bp, Artificial Sequence
  chemically synthesized
agaaatacaaactaccatca

SEQ ID NO: 513575 - DNA, 20 bp, Artificial Sequence
  chemically synthesized
taagatgctctttcaattgg

SEQ ID NO: 513576 - DNA, 20 bp, Artificial Sequence
  chemically synthesized
aacgagaccataagcagtgg

SEQ ID NO: 513577 - DNA, 20 bp, Artificial Sequence
  chemically synthesized
acagtaaaatggtgatctta

SEQ ID NO: 513578 - DNA, 20 bp, Artificial Sequence
  chemically synthesized
ttcccacttaggagagcata

SEQ ID NO: 513579 - DNA, 20 bp, Artificial Sequence
  chemically synthesized
aatcagaaaaaggcaggtac

SEQ ID NO: 513580 - DNA, 20 bp, Artificial Sequence
  chemically synthesized
tatatccacaaaaaatttaa

SEQ ID NO: 513581 - DNA, 20 bp, Artificial Sequence
  chemically synthesized
tttattcatttaaatttttt

SEQ ID NO: 513582 - DNA, 20 bp, Artificial Sequence
  chemically synthesized
acctattttctgattatgat

SEQ ID NO: 513583 - DNA, 20 bp, Artificial Sequence
  chemically synthesized
ctcctttgaacttacagaat

SEQ ID NO: 513584 - DNA, 20 bp, Artificial Sequence
  chemically synthesized
ctagtgctcctttgaactta

SEQ ID NO: 513585 - DNA, 20 bp, Artificial Sequence
  chemically synthesized
cttctcttactgttttatga

SEQ ID NO: 513586 - DNA, 20 bp, Artificial Sequence
  chemically synthesized
tgaaaggataggacacacac

SEQ ID NO: 513587 - DNA, 20 bp, Artificial Sequence
  chemically synthesized
atatggtcagttcccattat

SEQ ID NO: 513588 - DNA, 20 bp, Artificial Sequence
  chemically synthesized
gttaatatgtttgtttttta

SEQ ID NO: 513589 - DNA, 20 bp, Artificial Sequence
  chemically synthesized
aggataaagagctatactgt

SEQ ID NO: 513590 - DNA, 20 bp, Artificial Sequence
  chemically synthesized
aaatacggacttcaacctct

SEQ ID NO: 513591 - DNA, 20 bp, Artificial Sequence
  chemically synthesized
aaaacatacaaatgtgtact

SEQ ID NO: 513592 - DNA, 20 bp, Artificial Sequence
  chemically synthesized
ccttagtttgcagtataggg

SEQ ID NO: 513593 - DNA, 20 bp, Artificial Sequence
  chemically synthesized
tatactgcaaactaaggacg

SEQ ID NO: 513594 - DNA, 20 bp, Artificial Sequence
  chemically synthesized
tctcccttagagctaaaaac

SEQ ID NO: 513595 - DNA, 20 bp, Artificial Sequence
  chemically synthesized
gagctaaaaacaggggtagg

SEQ ID NO: 513596 - DNA, 20 bp, Artificial Sequence
  chemically synthesized
cgtgtatagaagcaataaaa

SEQ ID NO: 513597 - DNA, 20 bp, Artificial Sequence
  chemically synthesized
ggataatgcatggctgaaca

SEQ ID NO: 513598 - DNA, 20 bp, Artificial Sequence
  chemically synthesized
cttgaaatgtttcttctcct

SEQ ID NO: 513599 - DNA, 20 bp, Artificial Sequence
  chemically synthesized
aaaatgttagtttgtgaagt

SEQ ID NO: 513600 - DNA, 20 bp, Artificial Sequence
  chemically synthesized
aatatatttgtcaattgtat

SEQ ID NO: 513601 - DNA, 20 bp, Artificial Sequence
  chemically synthesized
aaatgagatataacaagcag

SEQ ID NO: 513602 - DNA, 20 bp, Artificial Sequence
  chemically synthesized
ttatatctcatttaagatta

SEQ ID NO: 513603 - DNA, 20 bp, Artificial Sequence
  chemically synthesized
cagatccacattggggtggg

SEQ ID NO: 513604 - DNA, 20 bp, Artificial Sequence
  chemically synthesized
ttaactcctcccaccccaat

SEQ ID NO: 513605 - DNA, 20 bp, Artificial Sequence
  chemically synthesized
atcatctagcagatccacat

SEQ ID NO: 513606 - DNA, 20 bp, Artificial Sequence
  chemically synthesized
aggcttctgcgtctgcaaaa

SEQ ID NO: 513607 - DNA, 20 bp, Artificial Sequence
  chemically synthesized
ccagtgaatttattatcaac

SEQ ID NO: 513608 - DNA, 20 bp, Artificial Sequence
  chemically synthesized
cagaagacagccttttgcca

SEQ ID NO: 513609 - DNA, 20 bp, Artificial Sequence
  chemically synthesized
cactggcaaaaggctgtctt

SEQ ID NO: 513610 - DNA, 20 bp, Artificial Sequence
  chemically synthesized
ggctgtcttctgggtcattt

SEQ ID NO: 513611 - DNA, 20 bp, Artificial Sequence
  chemically synthesized
aaaacaggagatctttcaat

SEQ ID NO: 513612 - DNA, 20 bp, Artificial Sequence
  chemically synthesized
tattgaaagatctcctgttt

SEQ ID NO: 513613 - DNA, 20 bp, Artificial Sequence
  chemically synthesized
gctgataattaaatgctttt

SEQ ID NO: 513614 - DNA, 20 bp, Artificial Sequence
  chemically synthesized
ggtgggattgaagatgatat

SEQ ID NO: 513615 - DNA, 20 bp, Artificial Sequence
  chemically synthesized
agttggaaaagtgaaatcgg

SEQ ID NO: 513616 - DNA, 20 bp, Artificial Sequence
  chemically synthesized
acttttccaactcctgattt

SEQ ID NO: 513617 - DNA, 20 bp, Artificial Sequence
  chemically synthesized
ctttactacactctaaaatc

SEQ ID NO: 513618 - DNA, 20 bp, Artificial Sequence
  chemically synthesized
ttagagtgtagtaaagcctt

SEQ ID NO: 513619 - DNA, 20 bp, Artificial Sequence
  chemically synthesized
tgtacttcataggctagaag

SEQ ID NO: 513620 - DNA, 20 bp, Artificial Sequence
  chemically synthesized
gactatgtagcaccagagat

SEQ ID NO: 513621 - DNA, 20 bp, Artificial Sequence
  chemically synthesized
atcaactaaagaagcagaaa

SEQ ID NO: 513622 - DNA, 20 bp, Artificial Sequence
  chemically synthesized
aaatgagtaaccatccaaca

SEQ ID NO: 513623 - DNA, 20 bp, Artificial Sequence
  chemically synthesized
cactctggggagatcctctg

SEQ ID NO: 513624 - DNA, 20 bp, Artificial Sequence
  chemically synthesized
catccaacagaggatctccc

SEQ ID NO: 513625 - DNA, 20 bp, Artificial Sequence
  chemically synthesized
attacaacagaagtagtggc

SEQ ID NO: 513626 - DNA, 20 bp, Artificial Sequence
  chemically synthesized
gtaaaccatgttgcctttta

SEQ ID NO: 513627 - DNA, 20 bp, Artificial Sequence
  chemically synthesized
tgttgccttttatagagtat

SEQ ID NO: 513628 - DNA, 20 bp, Artificial Sequence
  chemically synthesized
agtatatgaatgaaattggc

SEQ ID NO: 513629 - DNA, 20 bp, Artificial Sequence
  chemically synthesized
tatgctaccaagagatttga

SEQ ID NO: 513630 - DNA, 20 bp, Artificial Sequence
  chemically synthesized
attaactttttataattatt

SEQ ID NO: 513631 - DNA, 20 bp, Artificial Sequence
  chemically synthesized
tggatggagcatactgcatt

SEQ ID NO: 513632 - DNA, 20 bp, Artificial Sequence
  chemically synthesized
ctttaaaatgtgtatgccct

SEQ ID NO: 513633 - DNA, 20 bp, Artificial Sequence
  chemically synthesized
gatactggtattttgagaac

SEQ ID NO: 513634 - DNA, 20 bp, Artificial Sequence
  chemically synthesized
cagccttcttgcactatatt

SEQ ID NO: 513635 - DNA, 20 bp, Artificial Sequence
  chemically synthesized
taccactgcttttagtatgg

SEQ ID NO: 513636 - DNA, 20 bp, Artificial Sequence
  chemically synthesized
tccagaaatttaccaacctt

SEQ ID NO: 513637 - DNA, 20 bp, Artificial Sequence
  chemically synthesized
aaatttaccaaccttcagga

SEQ ID NO: 513638 - DNA, 20 bp, Artificial Sequence
  chemically synthesized
ctaattgatatctggcgatg

SEQ ID NO: 513639 - DNA, 20 bp, Artificial Sequence
  chemically synthesized
ttaggccagacctatttgac

SEQ ID NO: 513640 - DNA, 20 bp, Artificial Sequence
  chemically synthesized
aagacaaatataaatcaatc

SEQ ID NO: 513641 - DNA, 20 bp, Artificial Sequence
  chemically synthesized
atgcccatagtccttaagtc

SEQ ID NO: 513642 - DNA, 20 bp, Artificial Sequence
  chemically synthesized
agaaatattttaaagggtaa

SEQ ID NO: 513643 - DNA, 20 bp, Artificial Sequence
  chemically synthesized
gtttaaatagaaatatttta

SEQ ID NO: 513644 - DNA, 20 bp, Artificial Sequence
  chemically synthesized
aattttaatggaagatctca

SEQ ID NO: 513645 - DNA, 20 bp, Artificial Sequence
  chemically synthesized
gtcttgaacttctgggctca

SEQ ID NO: 513646 - DNA, 20 bp, Artificial Sequence
  chemically synthesized
aagaaagaaagaaaaactag

SEQ ID NO: 513647 - DNA, 20 bp, Artificial Sequence
  chemically synthesized
gatcctcccacctcagcctt

SEQ ID NO: 513648 - DNA, 20 bp, Artificial Sequence
  chemically synthesized
tactcagaaggctgaggtgg

SEQ ID NO: 513649 - DNA, 20 bp, Artificial Sequence
  chemically synthesized
cacctgagcccagggaggtt

SEQ ID NO: 513650 - DNA, 20 bp, Artificial Sequence
  chemically synthesized
tctcactctgttgcccaggc

SEQ ID NO: 513651 - DNA, 20 bp, Artificial Sequence
  chemically synthesized
ctgtactctagcctgggcaa

SEQ ID NO: 513652 - DNA, 20 bp, Artificial Sequence
  chemically synthesized
ctcagcattcttttttgata

SEQ ID NO: 513653 - DNA, 20 bp, Artificial Sequence
  chemically synthesized
agtgagaccctgtatcaaaa

SEQ ID NO: 513654 - DNA, 20 bp, Artificial Sequence
  chemically synthesized
ctgtatcaaaaaagaatgct

SEQ ID NO: 513655 - DNA, 20 bp, Artificial Sequence
  chemically synthesized
cgtagattatttgtcatctt

SEQ ID NO: 513656 - DNA, 20 bp, Artificial Sequence
  chemically synthesized
gatagataaatttttgttgc

SEQ ID NO: 513657 - DNA, 20 bp, Artificial Sequence
  chemically synthesized
tatctatctcatccagtctc

SEQ ID NO: 513658 - DNA, 20 bp, Artificial Sequence
  chemically synthesized
tggtattgaaatccacgaga

SEQ ID NO: 513659 - DNA, 20 bp, Artificial Sequence
  chemically synthesized
ttgaagtttagggaagaggt

SEQ ID NO: 513660 - DNA, 20 bp, Artificial Sequence
  chemically synthesized
tggagataatgagtgtttag

SEQ ID NO: 513661 - DNA, 20 bp, Artificial Sequence
  chemically synthesized
gtgattactaaatggagata

SEQ ID NO: 513662 - DNA, 20 bp, Artificial Sequence
  chemically synthesized
taggtttgggggagtatgat

SEQ ID NO: 513663 - DNA, 20 bp, Artificial Sequence
  chemically synthesized
agaaaagtaggtaggtttgg

SEQ ID NO: 513664 - DNA, 20 bp, Artificial Sequence
  chemically synthesized
gttgctcagataaaaaccct

SEQ ID NO: 513665 - DNA, 20 bp, Artificial Sequence
  chemically synthesized
tagtcattaaggatgactcc

SEQ ID NO: 513666 - DNA, 20 bp, Artificial Sequence
  chemically synthesized
gtgagagtaaaatagtcatt

SEQ ID NO: 513667 - DNA, 20 bp, Artificial Sequence
  chemically synthesized
ttttgaattaaatgttgtgt

SEQ ID NO: 513668 - DNA, 20 bp, Artificial Sequence
  chemically synthesized
agtcaaattctgaatacatt

SEQ ID NO: 513669 - DNA, 20 bp, Artificial Sequence
  chemically synthesized
catttaattcaaaatgtatt

SEQ ID NO: 513670 - DNA, 20 bp, Artificial Sequence
  chemically synthesized
tagtcagaagcagtcaaatt

SEQ ID NO: 513671 - DNA, 20 bp, Artificial Sequence
  chemically synthesized
tggactagagtgatggcagt

SEQ ID NO: 513672 - DNA, 20 bp, Artificial Sequence
  chemically synthesized
agataaaatggattttggac

SEQ ID NO: 513673 - DNA, 20 bp, Artificial Sequence
  chemically synthesized
gataattcatgcaagataaa

SEQ ID NO: 513674 - DNA, 20 bp, Artificial Sequence
  chemically synthesized
caaaatccattttatcttgc

SEQ ID NO: 513675 - DNA, 20 bp, Artificial Sequence
  chemically synthesized
aacgcaggcaagagtgagag

SEQ ID NO: 513676 - DNA, 20 bp, Artificial Sequence
  chemically synthesized
atgcactaattaacgcaggc

SEQ ID NO: 513677 - DNA, 20 bp, Artificial Sequence
  chemically synthesized
ctgcgttaattagtgcatag

SEQ ID NO: 513678 - DNA, 20 bp, Artificial Sequence
  chemically synthesized
ttagtgcatagcagagttgc

SEQ ID NO: 513679 - DNA, 20 bp, Artificial Sequence
  chemically synthesized
taaagcagagatttgagaag

SEQ ID NO: 513680 - DNA, 20 bp, Artificial Sequence
  chemically synthesized
atgtgatctacgaagtccaa

SEQ ID NO: 513681 - DNA, 20 bp, Artificial Sequence
  chemically synthesized
agagacaagaaataaaatca

SEQ ID NO: 513682 - DNA, 20 bp, Artificial Sequence
  chemically synthesized
ctttcctcatattccataaa

SEQ ID NO: 513683 - DNA, 20 bp, Artificial Sequence
  chemically synthesized
gaaactatggatcctgttta

SEQ ID NO: 513684 - DNA, 20 bp, Artificial Sequence
  chemically synthesized
aaatccaagtgcaggaaact

SEQ ID NO: 513685 - DNA, 20 bp, Artificial Sequence
  chemically synthesized
ggatccatagtttcctgcac

SEQ ID NO: 513686 - DNA, 20 bp, Artificial Sequence
  chemically synthesized
tagtttcctgcacttggatt

SEQ ID NO: 513687 - DNA, 20 bp, Artificial Sequence
  chemically synthesized
catgtttatgtcttcgaaaa

SEQ ID NO: 513688 - DNA, 20 bp, Artificial Sequence
  chemically synthesized
taaagacccaatggaagtaa

SEQ ID NO: 513689 - DNA, 20 bp, Artificial Sequence
  chemically synthesized
ggctcactcctttacttcca

SEQ ID NO: 513690 - DNA, 20 bp, Artificial Sequence
  chemically synthesized
acttatcagtgatgtgattt

SEQ ID NO: 513691 - DNA, 20 bp, Artificial Sequence
  chemically synthesized
actttgggaggctgaggctg

SEQ ID NO: 513692 - DNA, 20 bp, Artificial Sequence
  chemically synthesized
tgaaggatttgcttgaggcc

SEQ ID NO: 513693 - DNA, 20 bp, Artificial Sequence
  chemically synthesized
gattctccaacctcagcctc

SEQ ID NO: 513694 - DNA, 20 bp, Artificial Sequence
  chemically synthesized
tactcaggaggctgaggttg

SEQ ID NO: 513695 - DNA, 20 bp, Artificial Sequence
  chemically synthesized
ggttggagaatcacttgagc

SEQ ID NO: 513696 - DNA, 20 bp, Artificial Sequence
  chemically synthesized
ttgtaccactgcactccagc

SEQ ID NO: 513697 - DNA, 20 bp, Artificial Sequence
  chemically synthesized
tcttcctcagtcacccaggc

SEQ ID NO: 513698 - DNA, 20 bp, Artificial Sequence
  chemically synthesized
gagaaagaaaataagtatat

SEQ ID NO: 513699 - DNA, 20 bp, Artificial Sequence
  chemically synthesized
gttaaatagtaagtgttaat

SEQ ID NO: 513700 - DNA, 20 bp, Artificial Sequence
  chemically synthesized
tgtgtatctttctcttccac

SEQ ID NO: 513701 - DNA, 20 bp, Artificial Sequence
  chemically synthesized
aatatttatcaactacacga

SEQ ID NO: 513702 - DNA, 20 bp, Artificial Sequence
  chemically synthesized
tttatcaactacacgagaga

SEQ ID NO: 513703 - DNA, 20 bp, Artificial Sequence
  chemically synthesized
tgataatagagaaaatgcaa

SEQ ID NO: 513704 - DNA, 20 bp, Artificial Sequence
  chemically synthesized
agaggcagttcttgtcttat

SEQ ID NO: 513705 - DNA, 20 bp, Artificial Sequence
  chemically synthesized
aagaaaaatgaagaagccat

SEQ ID NO: 513706 - DNA, 20 bp, Artificial Sequence
  chemically synthesized
tgtctgtgttttttcacatt

SEQ ID NO: 513707 - DNA, 20 bp, Artificial Sequence
  chemically synthesized
taaaaaaaatgtattgataa

SEQ ID NO: 513708 - DNA, 20 bp, Artificial Sequence
  chemically synthesized
tctctaacgctcacacaact

SEQ ID NO: 513709 - DNA, 20 bp, Artificial Sequence
  chemically synthesized
tctaagttgtgtgagcgtta

SEQ ID NO: 513710 - DNA, 20 bp, Artificial Sequence
  chemically synthesized
atctcccaccacttgatact

SEQ ID NO: 513711 - DNA, 20 bp, Artificial Sequence
  chemically synthesized
gtttaaaagaaagaaactgg

SEQ ID NO: 513712 - DNA, 20 bp, Artificial Sequence
  chemically synthesized
ctaatgacttccagtgctgt

SEQ ID NO: 513713 - DNA, 20 bp, Artificial Sequence
  chemically synthesized
caagtggttcttcacctatt

SEQ ID NO: 513714 - DNA, 20 bp, Artificial Sequence
  chemically synthesized
tctcaaaggtgtctgtgatt

SEQ ID NO: 513715 - DNA, 20 bp, Artificial Sequence
  chemically synthesized
tctgaatcacagacaccttt

SEQ ID NO: 513716 - DNA, 20 bp, Artificial Sequence
  chemically synthesized
gatatggagagtttttttgt

SEQ ID NO: 513717 - DNA, 20 bp, Artificial Sequence
  chemically synthesized
agactctgttcacagatatg

SEQ ID NO: 513718 - DNA, 20 bp, Artificial Sequence
  chemically synthesized
aaactctccatatctgtgaa

SEQ ID NO: 513719 - DNA, 20 bp, Artificial Sequence
  chemically synthesized
acagagtctacatacagttt

SEQ ID NO: 513720 - DNA, 20 bp, Artificial Sequence
  chemically synthesized
tacatacagttttagaatat

SEQ ID NO: 513721 - DNA, 20 bp, Artificial Sequence
  chemically synthesized
catagcatgagctcttaaac

SEQ ID NO: 513722 - DNA, 20 bp, Artificial Sequence
  chemically synthesized
gccactgcgcctggccaatt

SEQ ID NO: 513723 - DNA, 20 bp, Artificial Sequence
  chemically synthesized
tctcggcctcccaaagtgct

SEQ ID NO: 513724 - DNA, 20 bp, Artificial Sequence
  chemically synthesized
cagcactttgggaggccgag

SEQ ID NO: 513725 - DNA, 20 bp, Artificial Sequence
  chemically synthesized
acgggtcaatcacctgaggc

SEQ ID NO: 513726 - DNA, 20 bp, Artificial Sequence
  chemically synthesized
ttttgtatttttagtagtgt

SEQ ID NO: 513727 - DNA, 20 bp, Artificial Sequence
  chemically synthesized
gattctactgcctcagcctc

SEQ ID NO: 513728 - DNA, 20 bp, Artificial Sequence
  chemically synthesized
tactcaggaggctgaggcag

SEQ ID NO: 513729 - DNA, 20 bp, Artificial Sequence
  chemically synthesized
atttatgtatttttttgaga

SEQ ID NO: 513730 - DNA, 20 bp, Artificial Sequence
  chemically synthesized
aaaaattctggtgtattaac

SEQ ID NO: 513731 - DNA, 20 bp, Artificial Sequence
  chemically synthesized
ttctactctagttaatacac

SEQ ID NO: 513732 - DNA, 20 bp, Artificial Sequence
  chemically synthesized
tttttacaattattaggaaa

SEQ ID NO: 513733 - DNA, 20 bp, Artificial Sequence
  chemically synthesized
aggggtattggaaaatatgg

SEQ ID NO: 513734 - DNA, 20 bp, Artificial Sequence
  chemically synthesized
ccataagcttgttagctgtt

SEQ ID NO: 513735 - DNA, 20 bp, Artificial Sequence
  chemically synthesized
gaaactagcttatttacaaa

SEQ ID NO: 513736 - DNA, 20 bp, Artificial Sequence
  chemically synthesized
ataaaaaaatttaaaaattg

SEQ ID NO: 513737 - DNA, 20 bp, Artificial Sequence
  chemically synthesized
agaaaaaaatgaagataagg

SEQ ID NO: 513738 - DNA, 20 bp, Artificial Sequence
  chemically synthesized
catttttttctgtaggcaat

SEQ ID NO: 513739 - DNA, 20 bp, Artificial Sequence
  chemically synthesized
gcatagtatacaaggttaaa

SEQ ID NO: 513740 - DNA, 20 bp, Artificial Sequence
  chemically synthesized
gtaagacaagggaatacagc

SEQ ID NO: 513741 - DNA, 20 bp, Artificial Sequence
  chemically synthesized
aaatggggaaggtaagacaa

SEQ ID NO: 513742 - DNA, 20 bp, Artificial Sequence
  chemically synthesized
cttggccactaactaaccaa

SEQ ID NO: 513743 - DNA, 20 bp, Artificial Sequence
  chemically synthesized
ctaactaaccaactgagtgt

SEQ ID NO: 513744 - DNA, 20 bp, Artificial Sequence
  chemically synthesized
tggttcaatgctttttgaat

SEQ ID NO: 513745 - DNA, 20 bp, Artificial Sequence
  chemically synthesized
gccttttggttcaatgcttt

SEQ ID NO: 513746 - DNA, 20 bp, Artificial Sequence
  chemically synthesized
ggtcacgtctagcattaaaa

SEQ ID NO: 513747 - DNA, 20 bp, Artificial Sequence
  chemically synthesized
cgtctagcattaaaaatgaa

SEQ ID NO: 513748 - DNA, 20 bp, Artificial Sequence
  chemically synthesized
aattaattttaatagtataa

SEQ ID NO: 513749 - DNA, 20 bp, Artificial Sequence
  chemically synthesized
aggttaacattaaatgctgt

SEQ ID NO: 513750 - DNA, 20 bp, Artificial Sequence
  chemically synthesized
taatttattgacttgcaacc

SEQ ID NO: 513751 - DNA, 20 bp, Artificial Sequence
  chemically synthesized
aattaaatcaacaccatgat

SEQ ID NO: 513752 - DNA, 20 bp, Artificial Sequence
  chemically synthesized
tggctaacatgtggtagagc

SEQ ID NO: 513753 - DNA, 20 bp, Artificial Sequence
  chemically synthesized
ccatctcacaaatagataaa

SEQ ID NO: 513754 - DNA, 20 bp, Artificial Sequence
  chemically synthesized
tcaatttatctatttgtgag

SEQ ID NO: 513755 - DNA, 20 bp, Artificial Sequence
  chemically synthesized
atctacgtcatggaacttga

SEQ ID NO: 513756 - DNA, 20 bp, Artificial Sequence
  chemically synthesized
attacagcaaaataatagaa

SEQ ID NO: 513757 - DNA, 20 bp, Artificial Sequence
  chemically synthesized
gttaattacatttatataag

SEQ ID NO: 513758 - DNA, 20 bp, Artificial Sequence
  chemically synthesized
taaagataggtgtttttggc

SEQ ID NO: 513759 - DNA, 20 bp, Artificial Sequence
  chemically synthesized
acaaatactactgatgcaaa

SEQ ID NO: 513760 - DNA, 20 bp, Artificial Sequence
  chemically synthesized
cctcttctccacctcccatt

SEQ ID NO: 513761 - DNA, 20 bp, Artificial Sequence
  chemically synthesized
atgggaggtggagaagaggc

SEQ ID NO: 513762 - DNA, 20 bp, Artificial Sequence
  chemically synthesized
ggtggagaagaggcgagagt

SEQ ID NO: 513763 - DNA, 20 bp, Artificial Sequence
  chemically synthesized
cttttattacattaaatggt

SEQ ID NO: 513764 - DNA, 20 bp, Artificial Sequence
  chemically synthesized
aataaaattaggaaatacct

SEQ ID NO: 513765 - DNA, 20 bp, Artificial Sequence
  chemically synthesized
tatggctggttttcatacta

SEQ ID NO: 513766 - DNA, 20 bp, Artificial Sequence
  chemically synthesized
agctgacagtgactgcatct

SEQ ID NO: 513767 - DNA, 20 bp, Artificial Sequence
  chemically synthesized
gaaataaggtaagttaagat

SEQ ID NO: 513768 - DNA, 20 bp, Artificial Sequence
  chemically synthesized
aattagaagcaaatgaacac

SEQ ID NO: 513769 - DNA, 20 bp, Artificial Sequence
  chemically synthesized
ctgtggtaatacactaaaat

SEQ ID NO: 513770 - DNA, 20 bp, Artificial Sequence
  chemically synthesized
atatttctaagcaattatca

SEQ ID NO: 513771 - DNA, 20 bp, Artificial Sequence
  chemically synthesized
tagaaatctggcttcctttg

SEQ ID NO: 513772 - DNA, 20 bp, Artificial Sequence
  chemically synthesized
atgtagttaatatagagcat

SEQ ID NO: 513773 - DNA, 20 bp, Artificial Sequence
  chemically synthesized
aggtgccctcatttcaataa

SEQ ID NO: 513774 - DNA, 20 bp, Artificial Sequence
  chemically synthesized
cgattgtcgttggcacaatt

SEQ ID NO: 513775 - DNA, 20 bp, Artificial Sequence
  chemically synthesized
acgacaatcgctatggaaca

SEQ ID NO: 513776 - DNA, 20 bp, Artificial Sequence
  chemically synthesized
accatttttttctttagata

SEQ ID NO: 513777 - DNA, 20 bp, Artificial Sequence
  chemically synthesized
cagttgtttaatgttctttc

SEQ ID NO: 513778 - DNA, 20 bp, Artificial Sequence
  chemically synthesized
gtaaccatgtaatacataaa

SEQ ID NO: 513779 - DNA, 20 bp, Artificial Sequence
  chemically synthesized
actctctcctgtcatattgg

SEQ ID NO: 513780 - DNA, 20 bp, Artificial Sequence
  chemically synthesized
atatactctctcctgtcata

SEQ ID NO: 513781 - DNA, 20 bp, Artificial Sequence
  chemically synthesized
attcatccaatatgacagga

SEQ ID NO: 513782 - DNA, 20 bp, Artificial Sequence
  chemically synthesized
acaggagagagtatataaat

SEQ ID NO: 513783 - DNA, 20 bp, Artificial Sequence
  chemically synthesized
tgaggatattttgacagaga

SEQ ID NO: 513784 - DNA, 20 bp, Artificial Sequence
  chemically synthesized
gatattttgacagagaaaga

SEQ ID NO: 513785 - DNA, 20 bp, Artificial Sequence
  chemically synthesized
gacagataaaacagggcaat

SEQ ID NO: 513786 - DNA, 20 bp, Artificial Sequence
  chemically synthesized
aatattctatttaatgattt

SEQ ID NO: 513787 - DNA, 20 bp, Artificial Sequence
  chemically synthesized
tgtattcagaaatcattaaa

SEQ ID NO: 513788 - DNA, 20 bp, Artificial Sequence
  chemically synthesized
aaatagaatattaacaaata

SEQ ID NO: 513789 - DNA, 20 bp, Artificial Sequence
  chemically synthesized
atagagtgggaacatgcttg

SEQ ID NO: 513790 - DNA, 20 bp, Artificial Sequence
  chemically synthesized
tgcagatgaataaaaatatc

SEQ ID NO: 513791 - DNA, 20 bp, Artificial Sequence
  chemically synthesized
gttcatgtacacatttgcag

SEQ ID NO: 513792 - DNA, 20 bp, Artificial Sequence
  chemically synthesized
gcattgacttaaaacacaga

SEQ ID NO: 513793 - DNA, 20 bp, Artificial Sequence
  chemically synthesized
ctcaatacagttagatgaga

SEQ ID NO: 513794 - DNA, 20 bp, Artificial Sequence
  chemically synthesized
aacgctgcttaacgtgacat

SEQ ID NO: 513795 - DNA, 20 bp, Artificial Sequence
  chemically synthesized
ctctgttctaaatcaggttg

SEQ ID NO: 513796 - DNA, 20 bp, Artificial Sequence
  chemically synthesized
catcccgactgggtttccag

SEQ ID NO: 513797 - DNA, 20 bp, Artificial Sequence
  chemically synthesized
aattcacctggaaacccagt

SEQ ID NO: 513798 - DNA, 20 bp, Artificial Sequence
  chemically synthesized
acctggaaacccagtcggga

SEQ ID NO: 513799 - DNA, 20 bp, Artificial Sequence
  chemically synthesized
tttaattaaccccatcccga

SEQ ID NO: 513800 - DNA, 20 bp, Artificial Sequence
  chemically synthesized
tgtcaggtgtcttgctccag

SEQ ID NO: 513801 - DNA, 20 bp, Artificial Sequence
  chemically synthesized
atcctgcttctagaaaagct

SEQ ID NO: 513802 - DNA, 20 bp, Artificial Sequence
  chemically synthesized
attcttagcttttctagaag

SEQ ID NO: 513803 - DNA, 20 bp, Artificial Sequence
  chemically synthesized
ggattggcataggaaaatgg

SEQ ID NO: 513804 - DNA, 20 bp, Artificial Sequence
  chemically synthesized
attaggcaatgcatttagcc

SEQ ID NO: 513805 - DNA, 20 bp, Artificial Sequence
  chemically synthesized
gcaatgcatttagccctggg

SEQ ID NO: 513806 - DNA, 20 bp, Artificial Sequence
  chemically synthesized
ccctgggttgggtaaatgaa

SEQ ID NO: 513807 - DNA, 20 bp, Artificial Sequence
  chemically synthesized
cacacatatatatacatata

SEQ ID NO: 513808 - DNA, 20 bp, Artificial Sequence
  chemically synthesized
tcttgtgtaaagttcagtaa

SEQ ID NO: 513809 - DNA, 20 bp, Artificial Sequence
  chemically synthesized
tcatcttaagaaatataatg

SEQ ID NO: 513810 - DNA, 20 bp, Artificial Sequence
  chemically synthesized
ttaagaaatataatgttgaa

SEQ ID NO: 513811 - DNA, 20 bp, Artificial Sequence
  chemically synthesized
ctttggttcactgtattaca

SEQ ID NO: 513812 - DNA, 20 bp, Artificial Sequence
  chemically synthesized
cttttgtggattttaataaa

SEQ ID NO: 513813 - DNA, 20 bp, Artificial Sequence
  chemically synthesized
aagcaagagagagatctttt

SEQ ID NO: 513814 - DNA, 20 bp, Artificial Sequence
  chemically synthesized
taattatatgacacaatgtt

SEQ ID NO: 513815 - DNA, 20 bp, Artificial Sequence
  chemically synthesized
ctgtatactttgttctagtt

SEQ ID NO: 513816 - DNA, 20 bp, Artificial Sequence
  chemically synthesized
aaaatgatactagatctcat

SEQ ID NO: 513817 - DNA, 20 bp, Artificial Sequence
  chemically synthesized
ggttgtattctaactttgcc

SEQ ID NO: 513818 - DNA, 20 bp, Artificial Sequence
  chemically synthesized
aacaccattctcggcaaagt

SEQ ID NO: 513819 - DNA, 20 bp, Artificial Sequence
  chemically synthesized
cggcaaagttagaatacaac

SEQ ID NO: 513820 - DNA, 20 bp, Artificial Sequence
  chemically synthesized
agaatacaacctggatttac

SEQ ID NO: 513821 - DNA, 20 bp, Artificial Sequence
  chemically synthesized
gtatcaatatgtttgacact

SEQ ID NO: 513822 - DNA, 20 bp, Artificial Sequence
  chemically synthesized
aagtggttatagtggagggg

SEQ ID NO: 513823 - DNA, 20 bp, Artificial Sequence
  chemically synthesized
taatgttaatgtttcaacaa

SEQ ID NO: 513824 - DNA, 20 bp, Artificial Sequence
  chemically synthesized
gaatattttccagtgttcta

SEQ ID NO: 513825 - DNA, 20 bp, Artificial Sequence
  chemically synthesized
tccattggaatgaactaatt

SEQ ID NO: 513826 - DNA, 20 bp, Artificial Sequence
  chemically synthesized
acattgatctaacgttccat

SEQ ID NO: 513827 - DNA, 20 bp, Artificial Sequence
  chemically synthesized
actggggaaaaatatgtcat

SEQ ID NO: 513828 - DNA, 20 bp, Artificial Sequence
  chemically synthesized
taatcttcttacctatgact

SEQ ID NO: 513829 - DNA, 20 bp, Artificial Sequence
  chemically synthesized
gctggtctgatggcctggct

SEQ ID NO: 513830 - DNA, 20 bp, Artificial Sequence
  chemically synthesized
gaagttgattacattaacct

SEQ ID NO: 513831 - DNA, 20 bp, Artificial Sequence
  chemically synthesized
acattaacctgtggataatt

SEQ ID NO: 513832 - DNA, 20 bp, Artificial Sequence
  chemically synthesized
gattgtcggacccagctcag

SEQ ID NO: 513833 - DNA, 20 bp, Artificial Sequence
  chemically synthesized
agtgaaaagattctcctgag

SEQ ID NO: 513834 - DNA, 20 bp, Artificial Sequence
  chemically synthesized
tgtaatgaaaaatatcatgg

SEQ ID NO: 513835 - DNA, 20 bp, Artificial Sequence
  chemically synthesized
gtttgcatggttcttgctca

SEQ ID NO: 513836 - DNA, 20 bp, Artificial Sequence
  chemically synthesized
agaaccatgcaaacttaaat

SEQ ID NO: 513837 - DNA, 20 bp, Artificial Sequence
  chemically synthesized
agaatagacttaacttctgg

SEQ ID NO: 513838 - DNA, 20 bp, Artificial Sequence
  chemically synthesized
taagtctattctcaaaggct

SEQ ID NO: 513839 - DNA, 20 bp, Artificial Sequence
  chemically synthesized
agaatagactcctagccttt

SEQ ID NO: 513840 - DNA, 20 bp, Artificial Sequence
  chemically synthesized
tggcatagataccaatgaat

SEQ ID NO: 513841 - DNA, 20 bp, Artificial Sequence
  chemically synthesized
atggtatggcatagatacca

SEQ ID NO: 513842 - DNA, 20 bp, Artificial Sequence
  chemically synthesized
tatctatgccataccattta

SEQ ID NO: 513843 - DNA, 20 bp, Artificial Sequence
  chemically synthesized
gaatgtgttcactattactc

SEQ ID NO: 513844 - DNA, 20 bp, Artificial Sequence
  chemically synthesized
ggtctaatatggcagaatcc

SEQ ID NO: 513845 - DNA, 20 bp, Artificial Sequence
  chemically synthesized
aaatgttgggtctaatatgg

SEQ ID NO: 513846 - DNA, 20 bp, Artificial Sequence
  chemically synthesized
aattctataaacagtaaatg

SEQ ID NO: 513847 - DNA, 20 bp, Artificial Sequence
  chemically synthesized
gacccaacatttactgttta

SEQ ID NO: 513848 - DNA, 20 bp, Artificial Sequence
  chemically synthesized
ttaagatataaaagcgcttt

SEQ ID NO: 513849 - DNA, 20 bp, Artificial Sequence
  chemically synthesized
aaaagcgctttttggatagg

SEQ ID NO: 513850 - DNA, 20 bp, Artificial Sequence
  chemically synthesized
ttaaatgatggtatgaaatc

SEQ ID NO: 513851 - DNA, 20 bp, Artificial Sequence
  chemically synthesized
gctacatatgtacacctctt

SEQ ID NO: 513852 - DNA, 20 bp, Artificial Sequence
  chemically synthesized
gaattaaacttgataatctg

SEQ ID NO: 513853 - DNA, 20 bp, Artificial Sequence
  chemically synthesized
gattatcaagtttaattctt

SEQ ID NO: 513854 - DNA, 20 bp, Artificial Sequence
  chemically synthesized
ttctgcatcagatgactcag

SEQ ID NO: 513855 - DNA, 20 bp, Artificial Sequence
  chemically synthesized
acttagaaaaaatgcttaga

SEQ ID NO: 513856 - DNA, 20 bp, Artificial Sequence
  chemically synthesized
tgaaacttagaaaaaatgct

SEQ ID NO: 513857 - DNA, 20 bp, Artificial Sequence
  chemically synthesized
aagcattttttctaagtttc

SEQ ID NO: 513858 - DNA, 20 bp, Artificial Sequence
  chemically synthesized
actgtctacatcttttatta

SEQ ID NO: 513859 - DNA, 20 bp, Artificial Sequence
  chemically synthesized
tatcaacatttgatcagatg

SEQ ID NO: 513860 - DNA, 20 bp, Artificial Sequence
  chemically synthesized
aaaaataaaattgtcatatt

SEQ ID NO: 513861 - DNA, 20 bp, Artificial Sequence
  chemically synthesized
aggcatttgttaacttctat

SEQ ID NO: 513862 - DNA, 20 bp, Artificial Sequence
  chemically synthesized
tagaagttaacaaatgcctt

SEQ ID NO: 513863 - DNA, 20 bp, Artificial Sequence
  chemically synthesized
taaaaagtaaatgcaaattt

SEQ ID NO: 513864 - DNA, 20 bp, Artificial Sequence
  chemically synthesized
catgcaaagatttcatatct

SEQ ID NO: 513865 - DNA, 20 bp, Artificial Sequence
  chemically synthesized
aataataggcttagttatca

SEQ ID NO: 513866 - DNA, 20 bp, Artificial Sequence
  chemically synthesized
gataactaagcctattattt

SEQ ID NO: 513867 - DNA, 20 bp, Artificial Sequence
  chemically synthesized
actaagcctattatttagga

SEQ ID NO: 513868 - DNA, 20 bp, Artificial Sequence
  chemically synthesized
caagaaggaattaggaaaac

SEQ ID NO: 513869 - DNA, 20 bp, Artificial Sequence
  chemically synthesized
actaaataagtaggtcaaga

SEQ ID NO: 513870 - DNA, 20 bp, Artificial Sequence
  chemically synthesized
cttatttagtcagttactca

SEQ ID NO: 513871 - DNA, 20 bp, Artificial Sequence
  chemically synthesized
aattatttgacctgtattca

SEQ ID NO: 513872 - DNA, 20 bp, Artificial Sequence
  chemically synthesized
ggttgagcaatttataattt

SEQ ID NO: 513873 - DNA, 20 bp, Artificial Sequence
  chemically synthesized
gtcctgtgctaaattacggt

SEQ ID NO: 513874 - DNA, 20 bp, Artificial Sequence
  chemically synthesized
atagtggcttaatggtggta

SEQ ID NO: 513875 - DNA, 20 bp, Artificial Sequence
  chemically synthesized
aatcaagcaatcctccaatg

SEQ ID NO: 513876 - DNA, 20 bp, Artificial Sequence
  chemically synthesized
atgaatcacattcatcattg

SEQ ID NO: 513877 - DNA, 20 bp, Artificial Sequence
  chemically synthesized
actggccaagcatttcacaa

SEQ ID NO: 513878 - DNA, 20 bp, Artificial Sequence
  chemically synthesized
tgctataaaggagttttgga

SEQ ID NO: 513879 - DNA, 20 bp, Artificial Sequence
  chemically synthesized
aatgatgctataaaggagtt

SEQ ID NO: 513880 - DNA, 20 bp, Artificial Sequence
  chemically synthesized
gtgacataatgatgctataa

SEQ ID NO: 513881 - DNA, 20 bp, Artificial Sequence
  chemically synthesized
gcgaggctgaggctgataag

SEQ ID NO: 513882 - DNA, 20 bp, Artificial Sequence
  chemically synthesized
agtgatttttaaaaatgact

SEQ ID NO: 513883 - DNA, 20 bp, Artificial Sequence
  chemically synthesized
ttagttctctcaggtaccac

SEQ ID NO: 513884 - DNA, 20 bp, Artificial Sequence
  chemically synthesized
ctcaggtaccacctgagttg

SEQ ID NO: 513885 - DNA, 20 bp, Artificial Sequence
  chemically synthesized
tagtagtgggttgccctaga

SEQ ID NO: 513886 - DNA, 20 bp, Artificial Sequence
  chemically synthesized
cccttcatcagtcaatagta

SEQ ID NO: 513887 - DNA, 20 bp, Artificial Sequence
  chemically synthesized
actattgactgatgaagggg

SEQ ID NO: 513888 - DNA, 20 bp, Artificial Sequence
  chemically synthesized
ctcaaatggggttaaaatgg

SEQ ID NO: 513889 - DNA, 20 bp, Artificial Sequence
  chemically synthesized
cccctcagagttgtctcaaa

SEQ ID NO: 513890 - DNA, 20 bp, Artificial Sequence
  chemically synthesized
ccccatttgagacaactctg

SEQ ID NO: 513891 - DNA, 20 bp, Artificial Sequence
  chemically synthesized
ttgcagctaggatgacccct

SEQ ID NO: 513892 - DNA, 20 bp, Artificial Sequence
  chemically synthesized
ccccatagacaacttgcagc

SEQ ID NO: 513893 - DNA, 20 bp, Artificial Sequence
  chemically synthesized
tcctagctgcaagttgtcta

SEQ ID NO: 513894 - DNA, 20 bp, Artificial Sequence
  chemically synthesized
ctgcaagttgtctatggggt

SEQ ID NO: 513895 - DNA, 20 bp, Artificial Sequence
  chemically synthesized
gggtttgaataagcgtgtca

SEQ ID NO: 513896 - DNA, 20 bp, Artificial Sequence
  chemically synthesized
tgtagaagggcagaggtgac

SEQ ID NO: 513897 - DNA, 20 bp, Artificial Sequence
  chemically synthesized
ctggggagtagacttcggag

SEQ ID NO: 513898 - DNA, 20 bp, Artificial Sequence
  chemically synthesized
gggttctggggagtagactt

SEQ ID NO: 513899 - DNA, 20 bp, Artificial Sequence
  chemically synthesized
taatcacagtctgggttctg

SEQ ID NO: 513900 - DNA, 20 bp, Artificial Sequence
  chemically synthesized
caacttcttttaatcacagt

SEQ ID NO: 513901 - DNA, 20 bp, Artificial Sequence
  chemically synthesized
attaaaagaagttgcagcag

SEQ ID NO: 513902 - DNA, 20 bp, Artificial Sequence
  chemically synthesized
agcagaggaatagaaatgaa

SEQ ID NO: 513903 - DNA, 20 bp, Artificial Sequence
  chemically synthesized
ggaatagaaatgaagagggt

SEQ ID NO: 513904 - DNA, 20 bp, Artificial Sequence
  chemically synthesized
taggaataatcttatatggt

SEQ ID NO: 513905 - DNA, 20 bp, Artificial Sequence
  chemically synthesized
acagaagtgacttggtaggc

SEQ ID NO: 513906 - DNA, 20 bp, Artificial Sequence
  chemically synthesized
cttggtaggcaggaatttac

SEQ ID NO: 513907 - DNA, 20 bp, Artificial Sequence
  chemically synthesized
gatacaatttgcaattacag

SEQ ID NO: 513908 - DNA, 20 bp, Artificial Sequence
  chemically synthesized
aataatatgaacattctaaa

SEQ ID NO: 513909 - DNA, 20 bp, Artificial Sequence
  chemically synthesized
atggcaacgctaattcactt

SEQ ID NO: 513910 - DNA, 20 bp, Artificial Sequence
  chemically synthesized
gttgccattaagtacatccc

SEQ ID NO: 513911 - DNA, 20 bp, Artificial Sequence
  chemically synthesized
tacttttactggacaattca

SEQ ID NO: 513912 - DNA, 20 bp, Artificial Sequence
  chemically synthesized
gtttagcactccgaaaaaaa

SEQ ID NO: 513913 - DNA, 20 bp, Artificial Sequence
  chemically synthesized
aagtgcaattcttttttttt

SEQ ID NO: 513914 - DNA, 20 bp, Artificial Sequence
  chemically synthesized
gaaaaacagtaataggaaaa

SEQ ID NO: 513915 - DNA, 20 bp, Artificial Sequence
  chemically synthesized
ggaaaacagagtttgcattc

SEQ ID NO: 513916 - DNA, 20 bp, Artificial Sequence
  chemically synthesized
cattgaacttgtgaaaactc

SEQ ID NO: 513917 - DNA, 20 bp, Artificial Sequence
  chemically synthesized
cgctcgttatctgatagatc

SEQ ID NO: 513918 - DNA, 20 bp, Artificial Sequence
  chemically synthesized
ctattaaatggtagaagccc

SEQ ID NO: 513919 - DNA, 20 bp, Artificial Sequence
  chemically synthesized
aaaacacatttttagattca

SEQ ID NO: 513920 - DNA, 20 bp, Artificial Sequence
  chemically synthesized
tcagtgttcatcataatcca

SEQ ID NO: 513921 - DNA, 20 bp, Artificial Sequence
  chemically synthesized
ataagtaagcagaggctggg

SEQ ID NO: 513922 - DNA, 20 bp, Artificial Sequence
  chemically synthesized
gtctacagtcttgcagtctc

SEQ ID NO: 513923 - DNA, 20 bp, Artificial Sequence
  chemically synthesized
gttgtttttcatttatgccc

SEQ ID NO: 513924 - DNA, 20 bp, Artificial Sequence
  chemically synthesized
ttgcaatgaggaatatcaga

SEQ ID NO: 513925 - DNA, 20 bp, Artificial Sequence
  chemically synthesized
gtggaggcgcttttgcaatg

SEQ ID NO: 513926 - DNA, 20 bp, Artificial Sequence
  chemically synthesized
tgctaataatgaaaaatggg

SEQ ID NO: 513927 - DNA, 20 bp, Artificial Sequence
  chemically synthesized
gtctcggcctcccaaagtgt

SEQ ID NO: 513928 - DNA, 20 bp, Artificial Sequence
  chemically synthesized
actttgggaggccgagacgg

SEQ ID NO: 513929 - DNA, 20 bp, Artificial Sequence
  chemically synthesized
tggggtttcaccgtgttagc

SEQ ID NO: 513930 - DNA, 20 bp, Artificial Sequence
  chemically synthesized
tgtattttgttcagtagaga

SEQ ID NO: 513931 - DNA, 20 bp, Artificial Sequence
  chemically synthesized
tacttgggaggctgaggcaa

SEQ ID NO: 513932 - DNA, 20 bp, Artificial Sequence
  chemically synthesized
ctcactgcaagctccgcctc

SEQ ID NO: 513933 - DNA, 20 bp, Artificial Sequence
  chemically synthesized
tcgcgccactgcactccagc

SEQ ID NO: 513934 - DNA, 20 bp, Artificial Sequence
  chemically synthesized
tctcgctctgtcacccaggc

SEQ ID NO: 513935 - DNA, 20 bp, Artificial Sequence
  chemically synthesized
tttattttttatttttgaga

SEQ ID NO: 513936 - DNA, 20 bp, Artificial Sequence
  chemically synthesized
ttatcttggactagttcaga

SEQ ID NO: 513937 - DNA, 20 bp, Artificial Sequence
  chemically synthesized
gatggagttggaaagggctt

SEQ ID NO: 513938 - DNA, 20 bp, Artificial Sequence
  chemically synthesized
tataaacaataaatacagtt

SEQ ID NO: 513939 - DNA, 20 bp, Artificial Sequence
  chemically synthesized
ttttggagctctgtgcatgc

SEQ ID NO: 513940 - DNA, 20 bp, Artificial Sequence
  chemically synthesized
tacatctgtcttacgcaaag

SEQ ID NO: 513941 - DNA, 20 bp, Artificial Sequence
  chemically synthesized
cgcaaagcgggatctgcaaa

SEQ ID NO: 513942 - DNA, 20 bp, Artificial Sequence
  chemically synthesized
ctgcaaactggattcactct

SEQ ID NO: 513943 - DNA, 20 bp, Artificial Sequence
  chemically synthesized
agtaacaaataattcctaga

SEQ ID NO: 513944 - DNA, 20 bp, Artificial Sequence
  chemically synthesized
gcatagtaacaaataattcc

SEQ ID NO: 513945 - DNA, 20 bp, Artificial Sequence
  chemically synthesized
ataagataaagtcaacaatt

SEQ ID NO: 513946 - DNA, 20 bp, Artificial Sequence
  chemically synthesized
cataagtttcttgatgcact

SEQ ID NO: 513947 - DNA, 20 bp, Artificial Sequence
  chemically synthesized
aaacttatgtagcgatttta

SEQ ID NO: 513948 - DNA, 20 bp, Artificial Sequence
  chemically synthesized
ttaataataaaggaggaagc

SEQ ID NO: 513949 - DNA, 20 bp, Artificial Sequence
  chemically synthesized
ctaatccattgtatgtaaga

SEQ ID NO: 513950 - DNA, 20 bp, Artificial Sequence
  chemically synthesized
tttattctatcttacataca

SEQ ID NO: 513951 - DNA, 20 bp, Artificial Sequence
  chemically synthesized
attaatatgtgctggcaaca

SEQ ID NO: 513952 - DNA, 20 bp, Artificial Sequence
  chemically synthesized
gagaggggaagagaaagagc

SEQ ID NO: 513953 - DNA, 20 bp, Artificial Sequence
  chemically synthesized
agtagcattaagcctgttca

SEQ ID NO: 513954 - DNA, 20 bp, Artificial Sequence
  chemically synthesized
ttaagcctgttcagagaatt

SEQ ID NO: 513955 - DNA, 20 bp, Artificial Sequence
  chemically synthesized
ttaggagagcaacatggctg

SEQ ID NO: 513956 - DNA, 20 bp, Artificial Sequence
  chemically synthesized
tcaaatagtgagtagacaca

SEQ ID NO: 513957 - DNA, 20 bp, Artificial Sequence
  chemically synthesized
ctcttgctcagagtcaaata

SEQ ID NO: 513958 - DNA, 20 bp, Artificial Sequence
  chemically synthesized
aattgtagattgctcttgct

SEQ ID NO: 513959 - DNA, 20 bp, Artificial Sequence
  chemically synthesized
cgcccggcttgaattttaac

SEQ ID NO: 513960 - DNA, 20 bp, Artificial Sequence
  chemically synthesized
catgagccactgcgcccggc

SEQ ID NO: 513961 - DNA, 20 bp, Artificial Sequence
  chemically synthesized
gcctcggcctcccaaagtgc

SEQ ID NO: 513962 - DNA, 20 bp, Artificial Sequence
  chemically synthesized
actttgggaggccgaggcag

SEQ ID NO: 513963 - DNA, 20 bp, Artificial Sequence
  chemically synthesized
cggggtttcaccgtgttagc

SEQ ID NO: 513964 - DNA, 20 bp, Artificial Sequence
  chemically synthesized
ttttgtatttttagtagaga

SEQ ID NO: 513965 - DNA, 20 bp, Artificial Sequence
  chemically synthesized
cattctcctgcctcagcctc

SEQ ID NO: 513966 - DNA, 20 bp, Artificial Sequence
  chemically synthesized
tactcgggaggctgaggcag

SEQ ID NO: 513967 - DNA, 20 bp, Artificial Sequence
  chemically synthesized
ggctgaggcaggagaatggc

SEQ ID NO: 513968 - DNA, 20 bp, Artificial Sequence
  chemically synthesized
ctcactgcaagctccgcctc

SEQ ID NO: 513969 - DNA, 20 bp, Artificial Sequence
  chemically synthesized
tcttgctctgtcgcccaggc

SEQ ID NO: 513970 - DNA, 20 bp, Artificial Sequence
  chemically synthesized
tttttatttttattttgaga

SEQ ID NO: 513971 - DNA, 20 bp, Artificial Sequence
  chemically synthesized
aataaaaaaattcaagttta

SEQ ID NO: 513972 - DNA, 20 bp, Artificial Sequence
  chemically synthesized
catggcttcattcggtaaac

SEQ ID NO: 513973 - DNA, 20 bp, Artificial Sequence
  chemically synthesized
tgatatctgctacaataggg

SEQ ID NO: 513974 - DNA, 20 bp, Artificial Sequence
  chemically synthesized
tgtgtctggcttcttgcaat

SEQ ID NO: 513975 - DNA, 20 bp, Artificial Sequence
  chemically synthesized
gtccatatgtatttgccttt

SEQ ID NO: 513976 - DNA, 20 bp, Artificial Sequence
  chemically synthesized
gattgacaattgcctagggc

SEQ ID NO: 513977 - DNA, 20 bp, Artificial Sequence
  chemically synthesized
caattgcctagggctggggt

SEQ ID NO: 513978 - DNA, 20 bp, Artificial Sequence
  chemically synthesized
taaaatttgcaggatattta

SEQ ID NO: 513979 - DNA, 20 bp, Artificial Sequence
  chemically synthesized
accacgttcattaaaatttg

SEQ ID NO: 513980 - DNA, 20 bp, Artificial Sequence
  chemically synthesized
ttttaatgaacgtggtgggg

SEQ ID NO: 513981 - DNA, 20 bp, Artificial Sequence
  chemically synthesized
ctctcaaactattttgaggg

SEQ ID NO: 513982 - DNA, 20 bp, Artificial Sequence
  chemically synthesized
tagcctctcaaactattttg

SEQ ID NO: 513983 - DNA, 20 bp, Artificial Sequence
  chemically synthesized
ctaaaccagattgatgcaaa

SEQ ID NO: 513984 - DNA, 20 bp, Artificial Sequence
  chemically synthesized
tgcaaattgaattttacact

SEQ ID NO: 513985 - DNA, 20 bp, Artificial Sequence
  chemically synthesized
aattgaattttacacttaga

SEQ ID NO: 513986 - DNA, 20 bp, Artificial Sequence
  chemically synthesized
tgactgctgtttttactggt

SEQ ID NO: 513987 - DNA, 20 bp, Artificial Sequence
  chemically synthesized
tcagcctccaaattttttaa

SEQ ID NO: 513988 - DNA, 20 bp, Artificial Sequence
  chemically synthesized
aataaaagtggtatactaca

SEQ ID NO: 513989 - DNA, 20 bp, Artificial Sequence
  chemically synthesized
ttcttatcacgattaagtgg

SEQ ID NO: 513990 - DNA, 20 bp, Artificial Sequence
  chemically synthesized
catggtcccttcactatcaa

SEQ ID NO: 513991 - DNA, 20 bp, Artificial Sequence
  chemically synthesized
aagggaccatggcccagaac

SEQ ID NO: 513992 - DNA, 20 bp, Artificial Sequence
  chemically synthesized
atatatataccaacatgaac

SEQ ID NO: 513993 - DNA, 20 bp, Artificial Sequence
  chemically synthesized
tatttatacatatgtgtata

SEQ ID NO: 513994 - DNA, 20 bp, Artificial Sequence
  chemically synthesized
ctattacgtatatatataca

SEQ ID NO: 513995 - DNA, 20 bp, Artificial Sequence
  chemically synthesized
acaatgagtggaaaatatta

SEQ ID NO: 513996 - DNA, 20 bp, Artificial Sequence
  chemically synthesized
ctattatgtatatgtataca

SEQ ID NO: 513997 - DNA, 20 bp, Artificial Sequence
  chemically synthesized
tatgtatatgtatacaatga

SEQ ID NO: 513998 - DNA, 20 bp, Artificial Sequence
  chemically synthesized
acaatgagtggataatatta

SEQ ID NO: 513999 - DNA, 20 bp, Artificial Sequence
  chemically synthesized
tatatatacatatataatgt

SEQ ID NO: 514000 - DNA, 20 bp, Artificial Sequence
  chemically synthesized
tacatatataatgtgtggat

SEQ ID NO: 514001 - DNA, 20 bp, Artificial Sequence
  chemically synthesized
tatatatacatatataatgt

SEQ ID NO: 514002 - DNA, 20 bp, Artificial Sequence
  chemically synthesized
tacatatataatgtgtggat

SEQ ID NO: 514003 - DNA, 20 bp, Artificial Sequence
  chemically synthesized
tatactacacacacacacac

SEQ ID NO: 514004 - DNA, 20 bp, Artificial Sequence
  chemically synthesized
gacctctgcaaaatgggttg

SEQ ID NO: 514005 - DNA, 20 bp, Artificial Sequence
  chemically synthesized
gtctatttgacctctgcaaa

SEQ ID NO: 514006 - DNA, 20 bp, Artificial Sequence
  chemically synthesized
atttttaagtcacctgagca

SEQ ID NO: 514007 - DNA, 20 bp, Artificial Sequence
  chemically synthesized
ataatttccaaatcacatta

SEQ ID NO: 514008 - DNA, 20 bp, Artificial Sequence
  chemically synthesized
caataaaagattagtagaat

SEQ ID NO: 514009 - DNA, 20 bp, Artificial Sequence
  chemically synthesized
tattgccaataaaagattag

SEQ ID NO: 514010 - DNA, 20 bp, Artificial Sequence
  chemically synthesized
tattggcaataatttatgtt

SEQ ID NO: 514011 - DNA, 20 bp, Artificial Sequence
  chemically synthesized
ggaatgaggctttctcagtc

SEQ ID NO: 514012 - DNA, 20 bp, Artificial Sequence
  chemically synthesized
tttattttaatcactaccaa

SEQ ID NO: 514013 - DNA, 20 bp, Artificial Sequence
  chemically synthesized
atacaaagtcccaatcatag

SEQ ID NO: 514014 - DNA, 20 bp, Artificial Sequence
  chemically synthesized
tttttcaaaattttatttca

SEQ ID NO: 514015 - DNA, 20 bp, Artificial Sequence
  chemically synthesized
ataggttctggtacatttac

SEQ ID NO: 514016 - DNA, 20 bp, Artificial Sequence
  chemically synthesized
accatgtcgtctgaaatgtt

SEQ ID NO: 514017 - DNA, 20 bp, Artificial Sequence
  chemically synthesized
taaaaagcagcactatggag

SEQ ID NO: 514018 - DNA, 20 bp, Artificial Sequence
  chemically synthesized
acacatttgtttcacacgtc

SEQ ID NO: 514019 - DNA, 20 bp, Artificial Sequence
  chemically synthesized
tcctgatgaatggtttcctt

SEQ ID NO: 514020 - DNA, 20 bp, Artificial Sequence
  chemically synthesized
cccaaaaggaaaccattcat

SEQ ID NO: 514021 - DNA, 20 bp, Artificial Sequence
  chemically synthesized
actggcaggtaagaatcctg

SEQ ID NO: 514022 - DNA, 20 bp, Artificial Sequence
  chemically synthesized
ataatcctccactggcaggt

SEQ ID NO: 514023 - DNA, 20 bp, Artificial Sequence
  chemically synthesized
aggattcttacctgccagtg

SEQ ID NO: 514024 - DNA, 20 bp, Artificial Sequence
  chemically synthesized
aactgactcttggtttgatt

SEQ ID NO: 514025 - DNA, 20 bp, Artificial Sequence
  chemically synthesized
attatattccaaatcaaacc

SEQ ID NO: 514026 - DNA, 20 bp, Artificial Sequence
  chemically synthesized
ttctttaacaggttgattta

SEQ ID NO: 514027 - DNA, 20 bp, Artificial Sequence
  chemically synthesized
taaatcaacctgttaaagaa

SEQ ID NO: 514028 - DNA, 20 bp, Artificial Sequence
  chemically synthesized
gtgctgaaagtaaatatatt

SEQ ID NO: 514029 - DNA, 20 bp, Artificial Sequence
  chemically synthesized
aatatatttactttcagcac

SEQ ID NO: 514030 - DNA, 20 bp, Artificial Sequence
  chemically synthesized
tgcagattaaagaggtcaac

SEQ ID NO: 514031 - DNA, 20 bp, Artificial Sequence
  chemically synthesized
ttaagatatgctttctagta

SEQ ID NO: 514032 - DNA, 20 bp, Artificial Sequence
  chemically synthesized
ggaagtactggtgaattttt

SEQ ID NO: 514033 - DNA, 20 bp, Artificial Sequence
  chemically synthesized
ggagctaggtggaagtactg

SEQ ID NO: 514034 - DNA, 20 bp, Artificial Sequence
  chemically synthesized
agtacttccacctagctcca

SEQ ID NO: 514035 - DNA, 20 bp, Artificial Sequence
  chemically synthesized
ttagtaaaacgcctctgttt

SEQ ID NO: 514036 - DNA, 20 bp, Artificial Sequence
  chemically synthesized
taaaacgcctctgttttaga

SEQ ID NO: 514037 - DNA, 20 bp, Artificial Sequence
  chemically synthesized
gtttggaaatgaaaatctgg

SEQ ID NO: 514038 - DNA, 20 bp, Artificial Sequence
  chemically synthesized
tactccaccttaaacatttg

SEQ ID NO: 514039 - DNA, 20 bp, Artificial Sequence
  chemically synthesized
cactcctcaaatgtttaagg

SEQ ID NO: 514040 - DNA, 20 bp, Artificial Sequence
  chemically synthesized
tcaatgtttttagccaatag

SEQ ID NO: 514041 - DNA, 20 bp, Artificial Sequence
  chemically synthesized
tagtgccataaaatgctggt

SEQ ID NO: 514042 - DNA, 20 bp, Artificial Sequence
  chemically synthesized
ctggtgagggtgtggagaaa

SEQ ID NO: 514043 - DNA, 20 bp, Artificial Sequence
  chemically synthesized
tgagtttccactagcagggg

SEQ ID NO: 514044 - DNA, 20 bp, Artificial Sequence
  chemically synthesized
tcatttgagtttccactagc

SEQ ID NO: 514045 - DNA, 20 bp, Artificial Sequence
  chemically synthesized
ttccaaagtggctatatcat

SEQ ID NO: 514046 - DNA, 20 bp, Artificial Sequence
  chemically synthesized
ttatctacccctgagggcat

SEQ ID NO: 514047 - DNA, 20 bp, Artificial Sequence
  chemically synthesized
ctgggaacccagatgccctc

SEQ ID NO: 514048 - DNA, 20 bp, Artificial Sequence
  chemically synthesized
accatagtacagccacacca

SEQ ID NO: 514049 - DNA, 20 bp, Artificial Sequence
  chemically synthesized
atagtttgttcttttcattg

SEQ ID NO: 514050 - DNA, 20 bp, Artificial Sequence
  chemically synthesized
ctattgatacatgcagcaaa

SEQ ID NO: 514051 - DNA, 20 bp, Artificial Sequence
  chemically synthesized
tgatacatgcagcaaattgg

SEQ ID NO: 514052 - DNA, 20 bp, Artificial Sequence
  chemically synthesized
tggggaaaaagtcattctga

SEQ ID NO: 514053 - DNA, 20 bp, Artificial Sequence
  chemically synthesized
catacagtatgctacccttt

SEQ ID NO: 514054 - DNA, 20 bp, Artificial Sequence
  chemically synthesized
ctgaaagggtagcatactgt

SEQ ID NO: 514055 - DNA, 20 bp, Artificial Sequence
  chemically synthesized
ctgtatgaatccgtatctat

SEQ ID NO: 514056 - DNA, 20 bp, Artificial Sequence
  chemically synthesized
ttttcaagactctcatagat

SEQ ID NO: 514057 - DNA, 20 bp, Artificial Sequence
  chemically synthesized
aaagttacagaaatagagaa

SEQ ID NO: 514058 - DNA, 20 bp, Artificial Sequence
  chemically synthesized
aatagcagttggcagaggtc

SEQ ID NO: 514059 - DNA, 20 bp, Artificial Sequence
  chemically synthesized
agttggcagaggtcaggaat

SEQ ID NO: 514060 - DNA, 20 bp, Artificial Sequence
  chemically synthesized
tcaggaatgggagtaagatg

SEQ ID NO: 514061 - DNA, 20 bp, Artificial Sequence
  chemically synthesized
gggagtaagatgtggggtag

SEQ ID NO: 514062 - DNA, 20 bp, Artificial Sequence
  chemically synthesized
cagaacagttccaccattac

SEQ ID NO: 514063 - DNA, 20 bp, Artificial Sequence
  chemically synthesized
tctgcatattgactctgatg

SEQ ID NO: 514064 - DNA, 20 bp, Artificial Sequence
  chemically synthesized
taggtttgtaaatccaccat

SEQ ID NO: 514065 - DNA, 20 bp, Artificial Sequence
  chemically synthesized
atgcacacatacacataaat

SEQ ID NO: 514066 - DNA, 20 bp, Artificial Sequence
  chemically synthesized
atgagtaaagctgggaaaat

SEQ ID NO: 514067 - DNA, 20 bp, Artificial Sequence
  chemically synthesized
tgaatactattggtggtttt

SEQ ID NO: 514068 - DNA, 20 bp, Artificial Sequence
  chemically synthesized
gaaggggagattgatcattc

SEQ ID NO: 514069 - DNA, 20 bp, Artificial Sequence
  chemically synthesized
atgatgatgctttcttattc

SEQ ID NO: 514070 - DNA, 20 bp, Artificial Sequence
  chemically synthesized
catcatctgcatcatcatct

SEQ ID NO: 514071 - DNA, 20 bp, Artificial Sequence
  chemically synthesized
ctctcctctactgccatatg

SEQ ID NO: 514072 - DNA, 20 bp, Artificial Sequence
  chemically synthesized
atagtggcttttccttatgg

SEQ ID NO: 514073 - DNA, 20 bp, Artificial Sequence
  chemically synthesized
ctccataaggaaaagccact

SEQ ID NO: 514074 - DNA, 20 bp, Artificial Sequence
  chemically synthesized
cttgttgagttagtgaatca

SEQ ID NO: 514075 - DNA, 20 bp, Artificial Sequence
  chemically synthesized
aaaaggtacttgttgagtta

SEQ ID NO: 514076 - DNA, 20 bp, Artificial Sequence
  chemically synthesized
agatagccaaaaggtacttg

SEQ ID NO: 514077 - DNA, 20 bp, Artificial Sequence
  chemically synthesized
catctgattgtcactatcac

SEQ ID NO: 514078 - DNA, 20 bp, Artificial Sequence
  chemically synthesized
catattctctgcttaactgc

SEQ ID NO: 514079 - DNA, 20 bp, Artificial Sequence
  chemically synthesized
aagactcaagcagttaagca

SEQ ID NO: 514080 - DNA, 20 bp, Artificial Sequence
  chemically synthesized
cagtgcttcccgcagtatga

SEQ ID NO: 514081 - DNA, 20 bp, Artificial Sequence
  chemically synthesized
ccagcagtgcttcccgcagt

SEQ ID NO: 514082 - DNA, 20 bp, Artificial Sequence
  chemically synthesized
gcactgctggtagatacgtt

SEQ ID NO: 514083 - DNA, 20 bp, Artificial Sequence
  chemically synthesized
ttacttgatctaagtctccc

SEQ ID NO: 514084 - DNA, 20 bp, Artificial Sequence
  chemically synthesized
gacagtggataaggggttac

SEQ ID NO: 514085 - DNA, 20 bp, Artificial Sequence
  chemically synthesized
aagtcttatgacagtggata

SEQ ID NO: 514086 - DNA, 20 bp, Artificial Sequence
  chemically synthesized
cagtgacaagtcttatgaca

SEQ ID NO: 514087 - DNA, 20 bp, Artificial Sequence
  chemically synthesized
atcaggtctgagcccagtac

SEQ ID NO: 514088 - DNA, 20 bp, Artificial Sequence
  chemically synthesized
tgtgaactttttgacactgg

SEQ ID NO: 514089 - DNA, 20 bp, Artificial Sequence
  chemically synthesized
tttggttataaacatagagg

SEQ ID NO: 514090 - DNA, 20 bp, Artificial Sequence
  chemically synthesized
gttctcacattttggctatt

SEQ ID NO: 514091 - DNA, 20 bp, Artificial Sequence
  chemically synthesized
atttatctgtagatggacat

SEQ ID NO: 514092 - DNA, 20 bp, Artificial Sequence
  chemically synthesized
aaatgtccatctacagataa

SEQ ID NO: 514093 - DNA, 20 bp, Artificial Sequence
  chemically synthesized
aatgtggtatgtacatacaa

SEQ ID NO: 514094 - DNA, 20 bp, Artificial Sequence
  chemically synthesized
gaatattttcagccttaaaa

SEQ ID NO: 514095 - DNA, 20 bp, Artificial Sequence
  chemically synthesized
atttatgttgtagtttgtat

SEQ ID NO: 514096 - DNA, 20 bp, Artificial Sequence
  chemically synthesized
ttttaggtacctcatataag

SEQ ID NO: 514097 - DNA, 20 bp, Artificial Sequence
  chemically synthesized
ataacttccattttttctct

SEQ ID NO: 514098 - DNA, 20 bp, Artificial Sequence
  chemically synthesized
ggctaggggaggtgaaaatg

SEQ ID NO: 514099 - DNA, 20 bp, Artificial Sequence
  chemically synthesized
agagtaatcgtttaatcagt

SEQ ID NO: 514100 - DNA, 20 bp, Artificial Sequence
  chemically synthesized
taatcagtatgaattcaact

SEQ ID NO: 514101 - DNA, 20 bp, Artificial Sequence
  chemically synthesized
aatgatttcatcatcccaag

SEQ ID NO: 514102 - DNA, 20 bp, Artificial Sequence
  chemically synthesized
atgatgaaatcattctagag

SEQ ID NO: 514103 - DNA, 20 bp, Artificial Sequence
  chemically synthesized
tcatcaccgctatccatctc

SEQ ID NO: 514104 - DNA, 20 bp, Artificial Sequence
  chemically synthesized
ctttaagtatatttctgttg

SEQ ID NO: 514105 - DNA, 20 bp, Artificial Sequence
  chemically synthesized
cagaaatatacttaaagcca

SEQ ID NO: 514106 - DNA, 20 bp, Artificial Sequence
  chemically synthesized
ttcaggttcattgccctaga

SEQ ID NO: 514107 - DNA, 20 bp, Artificial Sequence
  chemically synthesized
ccctatctagggcaatgaac

SEQ ID NO: 514108 - DNA, 20 bp, Artificial Sequence
  chemically synthesized
caatgaaatattacatcaca

SEQ ID NO: 514109 - DNA, 20 bp, Artificial Sequence
  chemically synthesized
tggcaaagatgtggagaaaa

SEQ ID NO: 514110 - DNA, 20 bp, Artificial Sequence
  chemically synthesized
ataaaactaccatataattc

SEQ ID NO: 514111 - DNA, 20 bp, Artificial Sequence
  chemically synthesized
tatacccagcagtagaattc

SEQ ID NO: 514112 - DNA, 20 bp, Artificial Sequence
  chemically synthesized
ataattcaggaattctactg

SEQ ID NO: 514113 - DNA, 20 bp, Artificial Sequence
  chemically synthesized
ttggaatatatacccagcag

SEQ ID NO: 514114 - DNA, 20 bp, Artificial Sequence
  chemically synthesized
acatattgatttgtttcctt

SEQ ID NO: 514115 - DNA, 20 bp, Artificial Sequence
  chemically synthesized
gatttcctatcttcgctatt

SEQ ID NO: 514116 - DNA, 20 bp, Artificial Sequence
  chemically synthesized
aagtgtccatcagtagatga

SEQ ID NO: 514117 - DNA, 20 bp, Artificial Sequence
  chemically synthesized
agacctacacacacacacac

SEQ ID NO: 514118 - DNA, 20 bp, Artificial Sequence
  chemically synthesized
ggattctctgctttttaagt

SEQ ID NO: 514119 - DNA, 20 bp, Artificial Sequence
  chemically synthesized
ctactcggacttaaaaagca

SEQ ID NO: 514120 - DNA, 20 bp, Artificial Sequence
  chemically synthesized
attaatttcattgcaaatga

SEQ ID NO: 514121 - DNA, 20 bp, Artificial Sequence
  chemically synthesized
tctcatttgcaatgaaatta

SEQ ID NO: 514122 - DNA, 20 bp, Artificial Sequence
  chemically synthesized
tgcaatgaaattaatgaatc

SEQ ID NO: 514123 - DNA, 20 bp, Artificial Sequence
  chemically synthesized
attttaaaatgttgagctca

SEQ ID NO: 514124 - DNA, 20 bp, Artificial Sequence
  chemically synthesized
aatgttgagctcatagaatt

SEQ ID NO: 514125 - DNA, 20 bp, Artificial Sequence
  chemically synthesized
gagtaaaatgttggttagca

SEQ ID NO: 514126 - DNA, 20 bp, Artificial Sequence
  chemically synthesized
ggggatagagcttggaggag

SEQ ID NO: 514127 - DNA, 20 bp, Artificial Sequence
  chemically synthesized
gatactaaattacatttaat

SEQ ID NO: 514128 - DNA, 20 bp, Artificial Sequence
  chemically synthesized
catgttgtacagtagatctc

SEQ ID NO: 514129 - DNA, 20 bp, Artificial Sequence
  chemically synthesized
tgtattttgaaaattgctaa

SEQ ID NO: 514130 - DNA, 20 bp, Artificial Sequence
  chemically synthesized
taacttatatgtttatcatt

SEQ ID NO: 514131 - DNA, 20 bp, Artificial Sequence
  chemically synthesized
tttaaaatatctagatgttg

SEQ ID NO: 514132 - DNA, 20 bp, Artificial Sequence
  chemically synthesized
tgtgtgtgtgtgtgtggggg

SEQ ID NO: 514133 - DNA, 20 bp, Artificial Sequence
  chemically synthesized
cctacctaattgtttttcct

SEQ ID NO: 514134 - DNA, 20 bp, Artificial Sequence
  chemically synthesized
ctgtgtctcacggaagccca

SEQ ID NO: 514135 - DNA, 20 bp, Artificial Sequence
  chemically synthesized
atttaatcaatactgagtac

SEQ ID NO: 514136 - DNA, 20 bp, Artificial Sequence
  chemically synthesized
ctttacagatttaatcaata

SEQ ID NO: 514137 - DNA, 20 bp, Artificial Sequence
  chemically synthesized
tctgtaaagaaaaaatagat

SEQ ID NO: 514138 - DNA, 20 bp, Artificial Sequence
  chemically synthesized
agaaagcattcagatcacta

SEQ ID NO: 514139 - DNA, 20 bp, Artificial Sequence
  chemically synthesized
gttaattaccccctagtgat

SEQ ID NO: 514140 - DNA, 20 bp, Artificial Sequence
  chemically synthesized
tagggggtaattaactgatt

SEQ ID NO: 514141 - DNA, 20 bp, Artificial Sequence
  chemically synthesized
ggagatattatattcaggga

SEQ ID NO: 514142 - DNA, 20 bp, Artificial Sequence
  chemically synthesized
cactgaatacaattctgtcc

SEQ ID NO: 514143 - DNA, 20 bp, Artificial Sequence
  chemically synthesized
aaaagagtagctgtctgcca

SEQ ID NO: 514144 - DNA, 20 bp, Artificial Sequence
  chemically synthesized
acctaatataaaagttaaaa

SEQ ID NO: 514145 - DNA, 20 bp, Artificial Sequence
  chemically synthesized
ttaacttttatattaggttc

SEQ ID NO: 514146 - DNA, 20 bp, Artificial Sequence
  chemically synthesized
ataggtaaattgcgtgtcat

SEQ ID NO: 514147 - DNA, 20 bp, Artificial Sequence
  chemically synthesized
gtaaaaggtgggaggaggga

SEQ ID NO: 514148 - DNA, 20 bp, Artificial Sequence
  chemically synthesized
cctcctcccaccttttactc

SEQ ID NO: 514149 - DNA, 20 bp, Artificial Sequence
  chemically synthesized
acagacactggagcctactc

SEQ ID NO: 514150 - DNA, 20 bp, Artificial Sequence
  chemically synthesized
ggagttaataacaagaacac

SEQ ID NO: 514151 - DNA, 20 bp, Artificial Sequence
  chemically synthesized
tcaaaaaaaaaaaaaaaaag

SEQ ID NO: 514152 - DNA, 20 bp, Artificial Sequence
  chemically synthesized
ttttttttttttttttgagg

SEQ ID NO: 514153 - DNA, 20 bp, Artificial Sequence
  chemically synthesized
ttcgctcttgttgcccagac

SEQ ID NO: 514154 - DNA, 20 bp, Artificial Sequence
  chemically synthesized
ctcaccacaacctccgcctc

SEQ ID NO: 514155 - DNA, 20 bp, Artificial Sequence
  chemically synthesized
tacttgggaggctgaggcag

SEQ ID NO: 514156 - DNA, 20 bp, Artificial Sequence
  chemically synthesized
gcctcagcctcccaagtagc

SEQ ID NO: 514157 - DNA, 20 bp, Artificial Sequence
  chemically synthesized
ttttgtatttttagtagaga

SEQ ID NO: 514158 - DNA, 20 bp, Artificial Sequence
  chemically synthesized
gagcgggatcacctgaggtc

SEQ ID NO: 514159 - DNA, 20 bp, Artificial Sequence
  chemically synthesized
ctttgggaggccgaggcgag

SEQ ID NO: 514160 - DNA, 20 bp, Artificial Sequence
  chemically synthesized
acatgttctcacttataagt

SEQ ID NO: 514161 - DNA, 20 bp, Artificial Sequence
  chemically synthesized
tgttcatgcactagtttgct

SEQ ID NO: 514162 - DNA, 20 bp, Artificial Sequence
  chemically synthesized
aaaaataagattgtagcaac

SEQ ID NO: 514163 - DNA, 20 bp, Artificial Sequence
  chemically synthesized
tgctacaatcttatttttgt

SEQ ID NO: 514164 - DNA, 20 bp, Artificial Sequence
  chemically synthesized
aatatgctacatatacacca

SEQ ID NO: 514165 - DNA, 20 bp, Artificial Sequence
  chemically synthesized
tattcacagtagcaaagatg

SEQ ID NO: 514166 - DNA, 20 bp, Artificial Sequence
  chemically synthesized
gattccccatctttgctact

SEQ ID NO: 514167 - DNA, 20 bp, Artificial Sequence
  chemically synthesized
gtagaacaatttatattcct

SEQ ID NO: 514168 - DNA, 20 bp, Artificial Sequence
  chemically synthesized
attatttggtatatacccaa

SEQ ID NO: 514169 - DNA, 20 bp, Artificial Sequence
  chemically synthesized
tataccaaataatgaggttg

SEQ ID NO: 514170 - DNA, 20 bp, Artificial Sequence
  chemically synthesized
caaataatgaggttgctggg

SEQ ID NO: 514171 - DNA, 20 bp, Artificial Sequence
  chemically synthesized
tttctgttttaacttctttg

SEQ ID NO: 514172 - DNA, 20 bp, Artificial Sequence
  chemically synthesized
cacactgctttccacaatgg

SEQ ID NO: 514173 - DNA, 20 bp, Artificial Sequence
  chemically synthesized
caggtgtggtgactgctggt

SEQ ID NO: 514174 - DNA, 20 bp, Artificial Sequence
  chemically synthesized
actgttattataacaattca

SEQ ID NO: 514175 - DNA, 20 bp, Artificial Sequence
  chemically synthesized
tgatccagtatatacatcct

SEQ ID NO: 514176 - DNA, 20 bp, Artificial Sequence
  chemically synthesized
caattcacaggatgtatata

SEQ ID NO: 514177 - DNA, 20 bp, Artificial Sequence
  chemically synthesized
acaggatgtatatactggat

SEQ ID NO: 514178 - DNA, 20 bp, Artificial Sequence
  chemically synthesized
tatagatgtatctactagag

SEQ ID NO: 514179 - DNA, 20 bp, Artificial Sequence
  chemically synthesized
ctgccttcctagaaacaatt

SEQ ID NO: 514180 - DNA, 20 bp, Artificial Sequence
  chemically synthesized
ttagaattacatattttaac

SEQ ID NO: 514181 - DNA, 20 bp, Artificial Sequence
  chemically synthesized
atattttaaccagaatgtat

SEQ ID NO: 514182 - DNA, 20 bp, Artificial Sequence
  chemically synthesized
gatcatacaaacaaaactaa

SEQ ID NO: 514183 - DNA, 20 bp, Artificial Sequence
  chemically synthesized
ttccatgattccttgtgcat

SEQ ID NO: 514184 - DNA, 20 bp, Artificial Sequence
  chemically synthesized
aaaatatattcaaatgcaca

SEQ ID NO: 514185 - DNA, 20 bp, Artificial Sequence
  chemically synthesized
gacctattacaattccatgt

SEQ ID NO: 514186 - DNA, 20 bp, Artificial Sequence
  chemically synthesized
attaacagacaattcacaca

SEQ ID NO: 514187 - DNA, 20 bp, Artificial Sequence
  chemically synthesized
tggtagttttcttttccttc

SEQ ID NO: 514188 - DNA, 20 bp, Artificial Sequence
  chemically synthesized
taaataagagataacatttg

SEQ ID NO: 514189 - DNA, 20 bp, Artificial Sequence
  chemically synthesized
gaatgaaatacaaaattttg

SEQ ID NO: 514190 - DNA, 20 bp, Artificial Sequence
  chemically synthesized
tctgtaagacagttttactt

SEQ ID NO: 514191 - DNA, 20 bp, Artificial Sequence
  chemically synthesized
ggttaacctgacatcacaaa

SEQ ID NO: 514192 - DNA, 20 bp, Artificial Sequence
  chemically synthesized
tgacatcacaaaaggaattg

SEQ ID NO: 514193 - DNA, 20 bp, Artificial Sequence
  chemically synthesized
ttttttcttttcatatgctt

SEQ ID NO: 514194 - DNA, 20 bp, Artificial Sequence
  chemically synthesized
aagtatataaattattcttt

SEQ ID NO: 514195 - DNA, 20 bp, Artificial Sequence
  chemically synthesized
tgaatttaacgtaaccctta

SEQ ID NO: 514196 - DNA, 20 bp, Artificial Sequence
  chemically synthesized
ttacgttaaattcatttgta

SEQ ID NO: 514197 - DNA, 20 bp, Artificial Sequence
  chemically synthesized
tgtagtaggattctttacaa

SEQ ID NO: 514198 - DNA, 20 bp, Artificial Sequence
  chemically synthesized
tgtactgttgaagagtgtag

SEQ ID NO: 514199 - DNA, 20 bp, Artificial Sequence
  chemically synthesized
ttattaaaggtgtactgttg

SEQ ID NO: 514200 - DNA, 20 bp, Artificial Sequence
  chemically synthesized
caaatcactaaaattgagat

SEQ ID NO: 514201 - DNA, 20 bp, Artificial Sequence
  chemically synthesized
tacgagaaaatcaagttttc

SEQ ID NO: 514202 - DNA, 20 bp, Artificial Sequence
  chemically synthesized
cagtcataacaaagaaaact

SEQ ID NO: 514203 - DNA, 20 bp, Artificial Sequence
  chemically synthesized
taagttttctttgttatgac

SEQ ID NO: 514204 - DNA, 20 bp, Artificial Sequence
  chemically synthesized
atcttttcaagagctcactt

SEQ ID NO: 514205 - DNA, 20 bp, Artificial Sequence
  chemically synthesized
tttcaagagctcacttttga

SEQ ID NO: 514206 - DNA, 20 bp, Artificial Sequence
  chemically synthesized
ttcaacgtagaaaattgaat

SEQ ID NO: 514207 - DNA, 20 bp, Artificial Sequence
  chemically synthesized
attgtattcaacgtagaaaa

SEQ ID NO: 514208 - DNA, 20 bp, Artificial Sequence
  chemically synthesized
ttcttattcaattttctacg

SEQ ID NO: 514209 - DNA, 20 bp, Artificial Sequence
  chemically synthesized
ttatggctatacagttctct

SEQ ID NO: 514210 - DNA, 20 bp, Artificial Sequence
  chemically synthesized
tttcactatgcctacatcat

SEQ ID NO: 514211 - DNA, 20 bp, Artificial Sequence
  chemically synthesized
tgagctatataaattttacc

SEQ ID NO: 514212 - DNA, 20 bp, Artificial Sequence
  chemically synthesized
gcattttaccaagagggaaa

SEQ ID NO: 514213 - DNA, 20 bp, Artificial Sequence
  chemically synthesized
ggtctgatttaaaactatgt

SEQ ID NO: 514214 - DNA, 20 bp, Artificial Sequence
  chemically synthesized
tatttcattaattacatcta

SEQ ID NO: 514215 - DNA, 20 bp, Artificial Sequence
  chemically synthesized
gcctcttaaagctttttgtg

SEQ ID NO: 514216 - DNA, 20 bp, Artificial Sequence
  chemically synthesized
tttcacaccatgatacagac

SEQ ID NO: 514217 - DNA, 20 bp, Artificial Sequence
  chemically synthesized
atgtcttcttcaaactacca

SEQ ID NO: 514218 - DNA, 20 bp, Artificial Sequence
  chemically synthesized
tgacaaatacctccctcctc

SEQ ID NO: 514219 - DNA, 20 bp, Artificial Sequence
  chemically synthesized
gaggtatttgtcatgcctga

SEQ ID NO: 514220 - DNA, 20 bp, Artificial Sequence
  chemically synthesized
accgtcaatgtgaggcattg

SEQ ID NO: 514221 - DNA, 20 bp, Artificial Sequence
  chemically synthesized
cggtctggtctgttttggcc

SEQ ID NO: 514222 - DNA, 20 bp, Artificial Sequence
  chemically synthesized
tataagagcaacaagcttat

SEQ ID NO: 514223 - DNA, 20 bp, Artificial Sequence
  chemically synthesized
ctgtaagtcataacattttt

SEQ ID NO: 514224 - DNA, 20 bp, Artificial Sequence
  chemically synthesized
ttatttaagaggaaatagta

SEQ ID NO: 514225 - DNA, 20 bp, Artificial Sequence
  chemically synthesized
aaagagaagttactgtatgg

SEQ ID NO: 514226 - DNA, 20 bp, Artificial Sequence
  chemically synthesized
tttttttctaatacacattc

SEQ ID NO: 514227 - DNA, 20 bp, Artificial Sequence
  chemically synthesized
attcttgaaagacataattc

SEQ ID NO: 514228 - DNA, 20 bp, Artificial Sequence
  chemically synthesized
attccagaattatgtctttc

SEQ ID NO: 514229 - DNA, 20 bp, Artificial Sequence
  chemically synthesized
tcagtctaattgctaaataa

SEQ ID NO: 514230 - DNA, 20 bp, Artificial Sequence
  chemically synthesized
ccttttaaaatctgtgtgaa

SEQ ID NO: 514231 - DNA, 20 bp, Artificial Sequence
  chemically synthesized
tactatttaatttccaacca

SEQ ID NO: 514232 - DNA, 20 bp, Artificial Sequence
  chemically synthesized
tatggttggaaattaaatag

SEQ ID NO: 514233 - DNA, 20 bp, Artificial Sequence
  chemically synthesized
caaaacaggaaagcagaact

SEQ ID NO: 514234 - DNA, 20 bp, Artificial Sequence
  chemically synthesized
catgttattacattttcaca

SEQ ID NO: 514235 - DNA, 20 bp, Artificial Sequence
  chemically synthesized
tgaaaatgtaataacatgcc

SEQ ID NO: 514236 - DNA, 20 bp, Artificial Sequence
  chemically synthesized
acagcatcccatgttacttt

SEQ ID NO: 514237 - DNA, 20 bp, Artificial Sequence
  chemically synthesized
attttactcataaagtaaca

SEQ ID NO: 514238 - DNA, 20 bp, Artificial Sequence
  chemically synthesized
agtaacatgggatgctgtct

SEQ ID NO: 514239 - DNA, 20 bp, Artificial Sequence
  chemically synthesized
tctatcctccaaaattacat

SEQ ID NO: 514240 - DNA, 20 bp, Artificial Sequence
  chemically synthesized
tttattcaaatgtaattttg

SEQ ID NO: 514241 - DNA, 20 bp, Artificial Sequence
  chemically synthesized
gaaacttattgtgactccag

SEQ ID NO: 514242 - DNA, 20 bp, Artificial Sequence
  chemically synthesized
ttcacattttaatattctac

SEQ ID NO: 514243 - DNA, 20 bp, Artificial Sequence
  chemically synthesized
tgtaacttgaggtgtttcta

SEQ ID NO: 514244 - DNA, 20 bp, Artificial Sequence
  chemically synthesized
agttacaataagcagtctgt

SEQ ID NO: 514245 - DNA, 20 bp, Artificial Sequence
  chemically synthesized
cattaaattattctttagta

SEQ ID NO: 514246 - DNA, 20 bp, Artificial Sequence
  chemically synthesized
caggagactactccatacta

SEQ ID NO: 514247 - DNA, 20 bp, Artificial Sequence
  chemically synthesized
ggcataggacaagaacttaa

SEQ ID NO: 514248 - DNA, 20 bp, Artificial Sequence
  chemically synthesized
aaatgattatatattaatct

SEQ ID NO: 514249 - DNA, 20 bp, Artificial Sequence
  chemically synthesized
tagcccagtcatttaggagg

SEQ ID NO: 514250 - DNA, 20 bp, Artificial Sequence
  chemically synthesized
gtctcgaacaagcaaatgac

SEQ ID NO: 514251 - DNA, 20 bp, Artificial Sequence
  chemically synthesized
tccatgttcctgaaggaaag

SEQ ID NO: 514252 - DNA, 20 bp, Artificial Sequence
  chemically synthesized
tcccactttccttcaggaac

SEQ ID NO: 514253 - DNA, 20 bp, Artificial Sequence
  chemically synthesized
atgggatatctaatcttagc

SEQ ID NO: 514254 - DNA, 20 bp, Artificial Sequence
  chemically synthesized
ccttttactgtaaaccatca

SEQ ID NO: 514255 - DNA, 20 bp, Artificial Sequence
  chemically synthesized
cccatgatggtttacagtaa

SEQ ID NO: 514256 - DNA, 20 bp, Artificial Sequence
  chemically synthesized
tattgatatattcaagattt

SEQ ID NO: 514257 - DNA, 20 bp, Artificial Sequence
  chemically synthesized
ttcttaagtattcttaaatc

SEQ ID NO: 514258 - DNA, 20 bp, Artificial Sequence
  chemically synthesized
ttgatttgctttacagaaag

SEQ ID NO: 514259 - DNA, 20 bp, Artificial Sequence
  chemically synthesized
cagaaagaagaatagcagac

SEQ ID NO: 514260 - DNA, 20 bp, Artificial Sequence
  chemically synthesized
gaaaatagtaaataagacgt

SEQ ID NO: 514261 - DNA, 20 bp, Artificial Sequence
  chemically synthesized
gagagagagaagggaaaatg

SEQ ID NO: 514262 - DNA, 20 bp, Artificial Sequence
  chemically synthesized
ggaaaatgatgaataaaact

SEQ ID NO: 514263 - DNA, 20 bp, Artificial Sequence
  chemically synthesized
cacacacgtaaatatcttac

SEQ ID NO: 514264 - DNA, 20 bp, Artificial Sequence
  chemically synthesized
aaagttctgacaaagcttta

SEQ ID NO: 514265 - DNA, 20 bp, Artificial Sequence
  chemically synthesized
tttgttagatgcagagagag

SEQ ID NO: 514266 - DNA, 20 bp, Artificial Sequence
  chemically synthesized
tgcagagagagatggatgtt

SEQ ID NO: 514267 - DNA, 20 bp, Artificial Sequence
  chemically synthesized
ataaagatgatggttcccct

SEQ ID NO: 514268 - DNA, 20 bp, Artificial Sequence
  chemically synthesized
tttagtctaatttcaattgg

SEQ ID NO: 514269 - DNA, 20 bp, Artificial Sequence
  chemically synthesized
gtttctcacatttgtttcaa

SEQ ID NO: 514270 - DNA, 20 bp, Artificial Sequence
  chemically synthesized
ttggttctcccagatcattt

SEQ ID NO: 514271 - DNA, 20 bp, Artificial Sequence
  chemically synthesized
gtttgatatttgtcctaaga

SEQ ID NO: 514272 - DNA, 20 bp, Artificial Sequence
  chemically synthesized
tttaaaattagctaagggag

SEQ ID NO: 514273 - DNA, 20 bp, Artificial Sequence
  chemically synthesized
attagctaagggagggggat

SEQ ID NO: 514274 - DNA, 20 bp, Artificial Sequence
  chemically synthesized
tctagttaaaatcaccaaga

SEQ ID NO: 514275 - DNA, 20 bp, Artificial Sequence
  chemically synthesized
ggatatttcagggttccttt

SEQ ID NO: 514276 - DNA, 20 bp, Artificial Sequence
  chemically synthesized
tcaaacttttaaggatattt

SEQ ID NO: 514277 - DNA, 20 bp, Artificial Sequence
  chemically synthesized
cctgaaatatccttaaaagt

SEQ ID NO: 514278 - DNA, 20 bp, Artificial Sequence
  chemically synthesized
ggaaatcaactcaaactttt

SEQ ID NO: 514279 - DNA, 20 bp, Artificial Sequence
  chemically synthesized
tttgagttgatttccttaaa

SEQ ID NO: 514280 - DNA, 20 bp, Artificial Sequence
  chemically synthesized
acataataattttcaatgca

SEQ ID NO: 514281 - DNA, 20 bp, Artificial Sequence
  chemically synthesized
cttgaggtttcagtgtcagg

SEQ ID NO: 514282 - DNA, 20 bp, Artificial Sequence
  chemically synthesized
cttccaacattctagataaa

SEQ ID NO: 514283 - DNA, 20 bp, Artificial Sequence
  chemically synthesized
aaaagcaaattctgtttatc

SEQ ID NO: 514284 - DNA, 20 bp, Artificial Sequence
  chemically synthesized
gaatacttgagaagtttctc

SEQ ID NO: 514285 - DNA, 20 bp, Artificial Sequence
  chemically synthesized
attatatttagaaggattgt

SEQ ID NO: 514286 - DNA, 20 bp, Artificial Sequence
  chemically synthesized
ttaaaatgcattatatttag

SEQ ID NO: 514287 - DNA, 20 bp, Artificial Sequence
  chemically synthesized
tccattgagagatgcatgta

SEQ ID NO: 514288 - DNA, 20 bp, Artificial Sequence
  chemically synthesized
gccatattgccactgtggac

SEQ ID NO: 514289 - DNA, 20 bp, Artificial Sequence
  chemically synthesized
tgaaatacggagataaggaa

SEQ ID NO: 514290 - DNA, 20 bp, Artificial Sequence
  chemically synthesized
cttccttatctccgtatttc

SEQ ID NO: 514291 - DNA, 20 bp, Artificial Sequence
  chemically synthesized
tctaatgtaaatttctatat

SEQ ID NO: 514292 - DNA, 20 bp, Artificial Sequence
  chemically synthesized
ctatattacaagatttaatt

SEQ ID NO: 514293 - DNA, 20 bp, Artificial Sequence
  chemically synthesized
gtatctttgtagtgagtacc

SEQ ID NO: 514294 - DNA, 20 bp, Artificial Sequence
  chemically synthesized
gtagagatagtatctttgta

SEQ ID NO: 514295 - DNA, 20 bp, Artificial Sequence
  chemically synthesized
tgagtggtcaaaaatagtta

SEQ ID NO: 514296 - DNA, 20 bp, Artificial Sequence
  chemically synthesized
cattctatgcgtggcatata

SEQ ID NO: 514297 - DNA, 20 bp, Artificial Sequence
  chemically synthesized
cactcactatatgccacgca

SEQ ID NO: 514298 - DNA, 20 bp, Artificial Sequence
  chemically synthesized
tatgccacgcatagaatgtt

SEQ ID NO: 514299 - DNA, 20 bp, Artificial Sequence
  chemically synthesized
ataattctcctgcaatgtat

SEQ ID NO: 514300 - DNA, 20 bp, Artificial Sequence
  chemically synthesized
atcactctgatacattgcag

SEQ ID NO: 514301 - DNA, 20 bp, Artificial Sequence
  chemically synthesized
tgcaggagaattatttttaa

SEQ ID NO: 514302 - DNA, 20 bp, Artificial Sequence
  chemically synthesized
atactgcctctttgacaata

SEQ ID NO: 514303 - DNA, 20 bp, Artificial Sequence
  chemically synthesized
attaaatgttcatattttct

SEQ ID NO: 514304 - DNA, 20 bp, Artificial Sequence
  chemically synthesized
attctatataaggaattttg

SEQ ID NO: 514305 - DNA, 20 bp, Artificial Sequence
  chemically synthesized
actcaacaaaattccttata

SEQ ID NO: 514306 - DNA, 20 bp, Artificial Sequence
  chemically synthesized
tctaatatatattctatata

SEQ ID NO: 514307 - DNA, 20 bp, Artificial Sequence
  chemically synthesized
tatatattagagggcattgc

SEQ ID NO: 514308 - DNA, 20 bp, Artificial Sequence
  chemically synthesized
ctttcagtatattatttaat

SEQ ID NO: 514309 - DNA, 20 bp, Artificial Sequence
  chemically synthesized
gtatcttttatctggcaata

SEQ ID NO: 514310 - DNA, 20 bp, Artificial Sequence
  chemically synthesized
gcttaaaaagttggggctat

SEQ ID NO: 514311 - DNA, 20 bp, Artificial Sequence
  chemically synthesized
ataaaaatcttaaaagatac

SEQ ID NO: 514312 - DNA, 20 bp, Artificial Sequence
  chemically synthesized
gttcacatatggaggtctgc

SEQ ID NO: 514313 - DNA, 20 bp, Artificial Sequence
  chemically synthesized
ctggctatctcaatttgaag

SEQ ID NO: 514314 - DNA, 20 bp, Artificial Sequence
  chemically synthesized
aaagcaagaggtatactaag

SEQ ID NO: 514315 - DNA, 20 bp, Artificial Sequence
  chemically synthesized
ggtatactaagggggatggg

SEQ ID NO: 514316 - DNA, 20 bp, Artificial Sequence
  chemically synthesized
catttaaaataattttctgg

SEQ ID NO: 514317 - DNA, 20 bp, Artificial Sequence
  chemically synthesized
ttctcatttaaaataatttt

SEQ ID NO: 514318 - DNA, 20 bp, Artificial Sequence
  chemically synthesized
atgagaacatgctgcaattt

SEQ ID NO: 514319 - DNA, 20 bp, Artificial Sequence
  chemically synthesized
gtagttatattaccttgcaa

SEQ ID NO: 514320 - DNA, 20 bp, Artificial Sequence
  chemically synthesized
atattaccttgcaactgaat

SEQ ID NO: 514321 - DNA, 20 bp, Artificial Sequence
  chemically synthesized
tgcaactgaatgtgagttta

SEQ ID NO: 514322 - DNA, 20 bp, Artificial Sequence
  chemically synthesized
tgcatttcgcagatgataaa

SEQ ID NO: 514323 - DNA, 20 bp, Artificial Sequence
  chemically synthesized
gataaagtgagtcaaagtca

SEQ ID NO: 514324 - DNA, 20 bp, Artificial Sequence
  chemically synthesized
actctgtaacttatcaacta

SEQ ID NO: 514325 - DNA, 20 bp, Artificial Sequence
  chemically synthesized
accctatagttgataagtta

SEQ ID NO: 514326 - DNA, 20 bp, Artificial Sequence
  chemically synthesized
tctacctcttctgcaaactt

SEQ ID NO: 514327 - DNA, 20 bp, Artificial Sequence
  chemically synthesized
cttgtctaacaaattaaatt

SEQ ID NO: 514328 - DNA, 20 bp, Artificial Sequence
  chemically synthesized
gtacttaaatactagatttt

SEQ ID NO: 514329 - DNA, 20 bp, Artificial Sequence
  chemically synthesized
atacatattttggagcatgt

SEQ ID NO: 514330 - DNA, 20 bp, Artificial Sequence
  chemically synthesized
ttatatggctatttaagttt

SEQ ID NO: 514331 - DNA, 20 bp, Artificial Sequence
  chemically synthesized
actagttttaaagaacattt

SEQ ID NO: 514332 - DNA, 20 bp, Artificial Sequence
  chemically synthesized
ggcatataatgttagataaa

SEQ ID NO: 514333 - DNA, 20 bp, Artificial Sequence
  chemically synthesized
aaaatagtcactgaattaga

SEQ ID NO: 514334 - DNA, 20 bp, Artificial Sequence
  chemically synthesized
cccatcattgaaaatagtca

SEQ ID NO: 514335 - DNA, 20 bp, Artificial Sequence
  chemically synthesized
tcagtgactattttcaatga

SEQ ID NO: 514336 - DNA, 20 bp, Artificial Sequence
  chemically synthesized
attttcaatgatggggttaa

SEQ ID NO: 514337 - DNA, 20 bp, Artificial Sequence
  chemically synthesized
tatttgaacatagctgtcat

SEQ ID NO: 514338 - DNA, 20 bp, Artificial Sequence
  chemically synthesized
aggtgagtatttaaaaagcc

SEQ ID NO: 514339 - DNA, 20 bp, Artificial Sequence
  chemically synthesized
aggctttttaaatactcacc

SEQ ID NO: 514340 - DNA, 20 bp, Artificial Sequence
  chemically synthesized
cattaaatcacaaatccaag

SEQ ID NO: 514341 - DNA, 20 bp, Artificial Sequence
  chemically synthesized
gtaacttcaaatctacaatg

SEQ ID NO: 514342 - DNA, 20 bp, Artificial Sequence
  chemically synthesized
cgaagtcttggtaatgttcc

SEQ ID NO: 514343 - DNA, 20 bp, Artificial Sequence
  chemically synthesized
ttcaacactataccttttgt

SEQ ID NO: 514344 - DNA, 20 bp, Artificial Sequence
  chemically synthesized
tttgtatgaatctttataaa

SEQ ID NO: 514345 - DNA, 20 bp, Artificial Sequence
  chemically synthesized
tgaatctttataaaagggat

SEQ ID NO: 514346 - DNA, 20 bp, Artificial Sequence
  chemically synthesized
gatttccttgcttacatttt

SEQ ID NO: 514347 - DNA, 20 bp, Artificial Sequence
  chemically synthesized
ataatacatcttggggagcg

SEQ ID NO: 514348 - DNA, 20 bp, Artificial Sequence
  chemically synthesized
aaaagtgcaaatatctaata

SEQ ID NO: 514349 - DNA, 20 bp, Artificial Sequence
  chemically synthesized
atataactaagttctaatca

SEQ ID NO: 514350 - DNA, 20 bp, Artificial Sequence
  chemically synthesized
atgggtaatttaaactttcc

SEQ ID NO: 514351 - DNA, 20 bp, Artificial Sequence
  chemically synthesized
tattctctcaaagatattta

SEQ ID NO: 514352 - DNA, 20 bp, Artificial Sequence
  chemically synthesized
tacccattaaatatctttga

SEQ ID NO: 514353 - DNA, 20 bp, Artificial Sequence
  chemically synthesized
attaaatatctttgagagaa

SEQ ID NO: 514354 - DNA, 20 bp, Artificial Sequence
  chemically synthesized
gaatagagttaagtgtagaa

SEQ ID NO: 514355 - DNA, 20 bp, Artificial Sequence
  chemically synthesized
gggacagggcaaagaaataa

SEQ ID NO: 514356 - DNA, 20 bp, Artificial Sequence
  chemically synthesized
aagagatgtttcatcctagc

SEQ ID NO: 514357 - DNA, 20 bp, Artificial Sequence
  chemically synthesized
aaggtaaagcaaatcccagc

SEQ ID NO: 514358 - DNA, 20 bp, Artificial Sequence
  chemically synthesized
cttgtaaataaaaagaagct

SEQ ID NO: 514359 - DNA, 20 bp, Artificial Sequence
  chemically synthesized
cctagagctgatgtagagac

SEQ ID NO: 514360 - DNA, 20 bp, Artificial Sequence
  chemically synthesized
tagcatagtctcccatttct

SEQ ID NO: 514361 - DNA, 20 bp, Artificial Sequence
  chemically synthesized
caaaatacattattgacagc

SEQ ID NO: 514362 - DNA, 20 bp, Artificial Sequence
  chemically synthesized
atgctaaaacagccaccaca

SEQ ID NO: 514363 - DNA, 20 bp, Artificial Sequence
  chemically synthesized
ctgagctctacagatataag

SEQ ID NO: 514364 - DNA, 20 bp, Artificial Sequence
  chemically synthesized
aagctgagtggcattcaagt

SEQ ID NO: 514365 - DNA, 20 bp, Artificial Sequence
  chemically synthesized
gtttaacctgttatcctcac

SEQ ID NO: 514366 - DNA, 20 bp, Artificial Sequence
  chemically synthesized
aaaggaaagaaactgaggaa

SEQ ID NO: 514367 - DNA, 20 bp, Artificial Sequence
  chemically synthesized
gaggagctagtttagaacta

SEQ ID NO: 514368 - DNA, 20 bp, Artificial Sequence
  chemically synthesized
tttgtcttctctcttttcct

SEQ ID NO: 514369 - DNA, 20 bp, Artificial Sequence
  chemically synthesized
atgatactttttggtaattt

SEQ ID NO: 514370 - DNA, 20 bp, Artificial Sequence
  chemically synthesized
tttagccctctgatttttaa

SEQ ID NO: 514371 - DNA, 20 bp, Artificial Sequence
  chemically synthesized
aaaaatcagagggctaaatt

SEQ ID NO: 514372 - DNA, 20 bp, Artificial Sequence
  chemically synthesized
tttgagtgatttttttaaac

SEQ ID NO: 514373 - DNA, 20 bp, Artificial Sequence
  chemically synthesized
ggtttcttttcataggttta

SEQ ID NO: 514374 - DNA, 20 bp, Artificial Sequence
  chemically synthesized
ccaaaaaaaaaaattttttt

SEQ ID NO: 514375 - DNA, 20 bp, Artificial Sequence
  chemically synthesized
tcttgctcgatcccccagac

SEQ ID NO: 514376 - DNA, 20 bp, Artificial Sequence
  chemically synthesized
taccactgcactctagtctg

SEQ ID NO: 514377 - DNA, 20 bp, Artificial Sequence
  chemically synthesized
ctcagtgcaacctccgcctc

SEQ ID NO: 514378 - DNA, 20 bp, Artificial Sequence
  chemically synthesized
tactggggaggctgaggcat

SEQ ID NO: 514379 - DNA, 20 bp, Artificial Sequence
  chemically synthesized
gcctcagcctccccagtagc

SEQ ID NO: 514380 - DNA, 20 bp, Artificial Sequence
  chemically synthesized
actaaaaaaaaaaaaattag

SEQ ID NO: 514381 - DNA, 20 bp, Artificial Sequence
  chemically synthesized
ttttttttttttagtagaga

SEQ ID NO: 514382 - DNA, 20 bp, Artificial Sequence
  chemically synthesized
cggggttttgccatgttggc

SEQ ID NO: 514383 - DNA, 20 bp, Artificial Sequence
  chemically synthesized
cgggcagatcacctgaggtc

SEQ ID NO: 514384 - DNA, 20 bp, Artificial Sequence
  chemically synthesized
gccccagcctcccaaagtgc

SEQ ID NO: 514385 - DNA, 20 bp, Artificial Sequence
  chemically synthesized
atgagatatagaaaccaaaa

SEQ ID NO: 514386 - DNA, 20 bp, Artificial Sequence
  chemically synthesized
ttgtttttctccctccttgt

SEQ ID NO: 514387 - DNA, 20 bp, Artificial Sequence
  chemically synthesized
atgaaatagattaatatctt

SEQ ID NO: 514388 - DNA, 20 bp, Artificial Sequence
  chemically synthesized
atcttcattaaaaagataaa

SEQ ID NO: 514389 - DNA, 20 bp, Artificial Sequence
  chemically synthesized
gctcaggctgtactgagagt

SEQ ID NO: 514390 - DNA, 20 bp, Artificial Sequence
  chemically synthesized
gaaatggctcaggctgtact

SEQ ID NO: 514391 - DNA, 20 bp, Artificial Sequence
  chemically synthesized
tacagcctgagccatttctc

SEQ ID NO: 514392 - DNA, 20 bp, Artificial Sequence
  chemically synthesized
atttctcatgggttttcata

SEQ ID NO: 514393 - DNA, 20 bp, Artificial Sequence
  chemically synthesized
tgattaaggtttgttaaacc

SEQ ID NO: 514394 - DNA, 20 bp, Artificial Sequence
  chemically synthesized
ttctactgttattaaataac

SEQ ID NO: 514395 - DNA, 20 bp, Artificial Sequence
  chemically synthesized
attataaacgggcaatatat

SEQ ID NO: 514396 - DNA, 20 bp, Artificial Sequence
  chemically synthesized
aagacacgctgagagtcact

SEQ ID NO: 514397 - DNA, 20 bp, Artificial Sequence
  chemically synthesized
ccagaaaagaaagacacgct

SEQ ID NO: 514398 - DNA, 20 bp, Artificial Sequence
  chemically synthesized
ctggctctggttgtctccag

SEQ ID NO: 514399 - DNA, 20 bp, Artificial Sequence
  chemically synthesized
ttgtctccagaagaatagga

SEQ ID NO: 514400 - DNA, 20 bp, Artificial Sequence
  chemically synthesized
accacttctatttgatgaca

SEQ ID NO: 514401 - DNA, 20 bp, Artificial Sequence
  chemically synthesized
ttggctagggcccagtcttg

SEQ ID NO: 514402 - DNA, 20 bp, Artificial Sequence
  chemically synthesized
gactgggccctagccaacat

SEQ ID NO: 514403 - DNA, 20 bp, Artificial Sequence
  chemically synthesized
tctgtgcgaaatgaggactt

SEQ ID NO: 514404 - DNA, 20 bp, Artificial Sequence
  chemically synthesized
acaaaacagaactagatacc

SEQ ID NO: 514405 - DNA, 20 bp, Artificial Sequence
  chemically synthesized
gtttggtgggttagtgaagt

SEQ ID NO: 514406 - DNA, 20 bp, Artificial Sequence
  chemically synthesized
agaagaggtgaagaagtttg

SEQ ID NO: 514407 - DNA, 20 bp, Artificial Sequence
  chemically synthesized
tatgtgatgactacatcacc

SEQ ID NO: 514408 - DNA, 20 bp, Artificial Sequence
  chemically synthesized
gcggcactggcaaaacactg

SEQ ID NO: 514409 - DNA, 20 bp, Artificial Sequence
  chemically synthesized
gtgataccttagtctctcca

SEQ ID NO: 514410 - DNA, 20 bp, Artificial Sequence
  chemically synthesized
actgagcccctaggtatcta

SEQ ID NO: 514411 - DNA, 20 bp, Artificial Sequence
  chemically synthesized
agtggcgctctcccaacatg

SEQ ID NO: 514412 - DNA, 20 bp, Artificial Sequence
  chemically synthesized
agtaaaggttattaactcat

SEQ ID NO: 514413 - DNA, 20 bp, Artificial Sequence
  chemically synthesized
tgaagaatgcagggattcac

SEQ ID NO: 514414 - DNA, 20 bp, Artificial Sequence
  chemically synthesized
gaaactatggtgaagaatgc

SEQ ID NO: 514415 - DNA, 20 bp, Artificial Sequence
  chemically synthesized
taaaggaagaaactatggtg

SEQ ID NO: 514416 - DNA, 20 bp, Artificial Sequence
  chemically synthesized
aatatttatagaaacgtggg

SEQ ID NO: 514417 - DNA, 20 bp, Artificial Sequence
  chemically synthesized
gttgaagagagtgtaatcag

SEQ ID NO: 514418 - DNA, 20 bp, Artificial Sequence
  chemically synthesized
ggcatacagaaaaagttgaa

SEQ ID NO: 514419 - DNA, 20 bp, Artificial Sequence
  chemically synthesized
agataccttaaaattgtata

SEQ ID NO: 514420 - DNA, 20 bp, Artificial Sequence
  chemically synthesized
tgccctatgaaagacaccat

SEQ ID NO: 514421 - DNA, 20 bp, Artificial Sequence
  chemically synthesized
aatgctctcccctgagccta

SEQ ID NO: 514422 - DNA, 20 bp, Artificial Sequence
  chemically synthesized
atcgtatgtctgtcattatt

SEQ ID NO: 514423 - DNA, 20 bp, Artificial Sequence
  chemically synthesized
aatgacagacatacgatttt

SEQ ID NO: 514424 - DNA, 20 bp, Artificial Sequence
  chemically synthesized
gattttctgaatgccttgtt

SEQ ID NO: 514425 - DNA, 20 bp, Artificial Sequence
  chemically synthesized
gccttgttgagagttcagac

SEQ ID NO: 514426 - DNA, 20 bp, Artificial Sequence
  chemically synthesized
caataaatctccctatgaag

SEQ ID NO: 514427 - DNA, 20 bp, Artificial Sequence
  chemically synthesized
atatttaacagcaaaagatt

SEQ ID NO: 514428 - DNA, 20 bp, Artificial Sequence
  chemically synthesized
atgtcataaacttgacagtg

SEQ ID NO: 514429 - DNA, 20 bp, Artificial Sequence
  chemically synthesized
atttccatcaatttttcttc

SEQ ID NO: 514430 - DNA, 20 bp, Artificial Sequence
  chemically synthesized
cgttattgactgtaactttc

SEQ ID NO: 514431 - DNA, 20 bp, Artificial Sequence
  chemically synthesized
tgatagaatactaacaaact

SEQ ID NO: 514432 - DNA, 20 bp, Artificial Sequence
  chemically synthesized
acaaaatgaaaaatcagtga

SEQ ID NO: 514433 - DNA, 20 bp, Artificial Sequence
  chemically synthesized
ttttattattctttaagttc

SEQ ID NO: 514434 - DNA, 20 bp, Artificial Sequence
  chemically synthesized
cacatgtaccccagaactta

SEQ ID NO: 514435 - DNA, 20 bp, Artificial Sequence
  chemically synthesized
ctaatgtaggtgacgggtct

SEQ ID NO: 514436 - DNA, 20 bp, Artificial Sequence
  chemically synthesized
agaaatacctaatgtaggtg

SEQ ID NO: 514437 - DNA, 20 bp, Artificial Sequence
  chemically synthesized
gtggggggctaggggaggga

SEQ ID NO: 514438 - DNA, 20 bp, Artificial Sequence
  chemically synthesized
agagggtggggggctagggg

SEQ ID NO: 514439 - DNA, 20 bp, Artificial Sequence
  chemically synthesized
tcacacaccatggcctgtca

SEQ ID NO: 514440 - DNA, 20 bp, Artificial Sequence
  chemically synthesized
tcattgttcagctaccactt

SEQ ID NO: 514441 - DNA, 20 bp, Artificial Sequence
  chemically synthesized
tgttcttgtgttagtttgct

SEQ ID NO: 514442 - DNA, 20 bp, Artificial Sequence
  chemically synthesized
ttcatgtcctttgcagggac

SEQ ID NO: 514443 - DNA, 20 bp, Artificial Sequence
  chemically synthesized
tatgcagccataaaaaaaga

SEQ ID NO: 514444 - DNA, 20 bp, Artificial Sequence
  chemically synthesized
atactatgcagccataaaaa

SEQ ID NO: 514445 - DNA, 20 bp, Artificial Sequence
  chemically synthesized
aatgtggtacatatacacca

SEQ ID NO: 514446 - DNA, 20 bp, Artificial Sequence
  chemically synthesized
aaatgtccatcagtgataga

SEQ ID NO: 514447 - DNA, 20 bp, Artificial Sequence
  chemically synthesized
agataccatttaacaacagt

SEQ ID NO: 514448 - DNA, 20 bp, Artificial Sequence
  chemically synthesized
agtcagcaaaagatgctgga

SEQ ID NO: 514449 - DNA, 20 bp, Artificial Sequence
  chemically synthesized
tggagagaatatggagaaat

SEQ ID NO: 514450 - DNA, 20 bp, Artificial Sequence
  chemically synthesized
aatgcttttacactgttggt

SEQ ID NO: 514451 - DNA, 20 bp, Artificial Sequence
  chemically synthesized
agacagtgtggtgattcctc

SEQ ID NO: 514452 - DNA, 20 bp, Artificial Sequence
  chemically synthesized
tttctagttccagatccttg

SEQ ID NO: 514453 - DNA, 20 bp, Artificial Sequence
  chemically synthesized
tatacccagtaacaggattg

SEQ ID NO: 514454 - DNA, 20 bp, Artificial Sequence
  chemically synthesized
ttgacccagcaatcctgtta

SEQ ID NO: 514455 - DNA, 20 bp, Artificial Sequence
  chemically synthesized
tttggatatatacccagtaa

SEQ ID NO: 514456 - DNA, 20 bp, Artificial Sequence
  chemically synthesized
tgttactgggtatatatcca

SEQ ID NO: 514457 - DNA, 20 bp, Artificial Sequence
  chemically synthesized
gtagaatgatttataatcct

SEQ ID NO: 514458 - DNA, 20 bp, Artificial Sequence
  chemically synthesized
gtgtgcatgtgtcttcatag

SEQ ID NO: 514459 - DNA, 20 bp, Artificial Sequence
  chemically synthesized
agttccaagtctttgctatt

SEQ ID NO: 514460 - DNA, 20 bp, Artificial Sequence
  chemically synthesized
aaaacactactagaaattaa

SEQ ID NO: 514461 - DNA, 20 bp, Artificial Sequence
  chemically synthesized
cattgtcatctcatttagac

SEQ ID NO: 514462 - DNA, 20 bp, Artificial Sequence
  chemically synthesized
gagcagagaggtagtaaggt

SEQ ID NO: 514463 - DNA, 20 bp, Artificial Sequence
  chemically synthesized
gcctcagcaagtggagtaga

SEQ ID NO: 514464 - DNA, 20 bp, Artificial Sequence
  chemically synthesized
tgaggcctcagcaagtggag

SEQ ID NO: 514465 - DNA, 20 bp, Artificial Sequence
  chemically synthesized
tggaatgaggcctcagcaag

SEQ ID NO: 514466 - DNA, 20 bp, Artificial Sequence
  chemically synthesized
ccttaaggtgaaaaagcatt

SEQ ID NO: 514467 - DNA, 20 bp, Artificial Sequence
  chemically synthesized
ttggaattgtctataggaag

SEQ ID NO: 514468 - DNA, 20 bp, Artificial Sequence
  chemically synthesized
tggagaaagggagtgagcct

SEQ ID NO: 514469 - DNA, 20 bp, Artificial Sequence
  chemically synthesized
tgagcagagacctggagaaa

SEQ ID NO: 514470 - DNA, 20 bp, Artificial Sequence
  chemically synthesized
gtgaataaaaaagagataca

SEQ ID NO: 514471 - DNA, 20 bp, Artificial Sequence
  chemically synthesized
atatacttaggaacagttaa

SEQ ID NO: 514472 - DNA, 20 bp, Artificial Sequence
  chemically synthesized
gctgtaatctctgacacaca

SEQ ID NO: 514473 - DNA, 20 bp, Artificial Sequence
  chemically synthesized
atcaatcaacttatatacct

SEQ ID NO: 514474 - DNA, 20 bp, Artificial Sequence
  chemically synthesized
tgtgaattttaaaaggaaat

SEQ ID NO: 514475 - DNA, 20 bp, Artificial Sequence
  chemically synthesized
tctatatcaataagcctgtg

SEQ ID NO: 514476 - DNA, 20 bp, Artificial Sequence
  chemically synthesized
ttttttttctaaagttgagc

SEQ ID NO: 514477 - DNA, 20 bp, Artificial Sequence
  chemically synthesized
aataaatcaaaatgctcaag

SEQ ID NO: 514478 - DNA, 20 bp, Artificial Sequence
  chemically synthesized
actttagtttgcttattagg

SEQ ID NO: 514479 - DNA, 20 bp, Artificial Sequence
  chemically synthesized
agcaaactaaagttgtactt

SEQ ID NO: 514480 - DNA, 20 bp, Artificial Sequence
  chemically synthesized
tttatacttatgacaaaatg

SEQ ID NO: 514481 - DNA, 20 bp, Artificial Sequence
  chemically synthesized
actgcactccagcctggcca

SEQ ID NO: 514482 - DNA, 20 bp, Artificial Sequence
  chemically synthesized
ttttcactctgtggccaggc

SEQ ID NO: 514483 - DNA, 20 bp, Artificial Sequence
  chemically synthesized
acctgggagcagaggttgca

SEQ ID NO: 514484 - DNA, 20 bp, Artificial Sequence
  chemically synthesized
tactcatgaggctgaggcag

SEQ ID NO: 514485 - DNA, 20 bp, Artificial Sequence
  chemically synthesized
gattctcctgcctcagcctc

SEQ ID NO: 514486 - DNA, 20 bp, Artificial Sequence
  chemically synthesized
ttttgtgtttttagtagaga

SEQ ID NO: 514487 - DNA, 20 bp, Artificial Sequence
  chemically synthesized
tggggtttcaccatgttggc

SEQ ID NO: 514488 - DNA, 20 bp, Artificial Sequence
  chemically synthesized
actttgggtggtccaggcgg

SEQ ID NO: 514489 - DNA, 20 bp, Artificial Sequence
  chemically synthesized
cagcactttgggtggtccag

SEQ ID NO: 514490 - DNA, 20 bp, Artificial Sequence
  chemically synthesized
atgcctgtaataccagcact

SEQ ID NO: 514491 - DNA, 20 bp, Artificial Sequence
  chemically synthesized
ctgtggctgaacaataacac

SEQ ID NO: 514492 - DNA, 20 bp, Artificial Sequence
  chemically synthesized
tccaagtttggtttctgcat

SEQ ID NO: 514493 - DNA, 20 bp, Artificial Sequence
  chemically synthesized
ataatggcttaaatttgaga

SEQ ID NO: 514494 - DNA, 20 bp, Artificial Sequence
  chemically synthesized
aaattagaatatgatgtcat

SEQ ID NO: 514495 - DNA, 20 bp, Artificial Sequence
  chemically synthesized
aatataagtgaatataaaat

SEQ ID NO: 514496 - DNA, 20 bp, Artificial Sequence
  chemically synthesized
aaattattaaatgaatataa

SEQ ID NO: 514497 - DNA, 20 bp, Artificial Sequence
  chemically synthesized
ttttctaatgaaattattaa

SEQ ID NO: 514498 - DNA, 20 bp, Artificial Sequence
  chemically synthesized
aataatttcattagaaaaca

SEQ ID NO: 514499 - DNA, 20 bp, Artificial Sequence
  chemically synthesized
agatttctatatatggcccg

SEQ ID NO: 514500 - DNA, 20 bp, Artificial Sequence
  chemically synthesized
agttcctcttttaattgaag

SEQ ID NO: 514501 - DNA, 20 bp, Artificial Sequence
  chemically synthesized
taagtcagtaaaacgcataa

SEQ ID NO: 514502 - DNA, 20 bp, Artificial Sequence
  chemically synthesized
gagagtggttaacttttgga

SEQ ID NO: 514503 - DNA, 20 bp, Artificial Sequence
  chemically synthesized
tccatgggtttaaaattgaa

SEQ ID NO: 514504 - DNA, 20 bp, Artificial Sequence
  chemically synthesized
aaaacgggcaaaatgtttcc

SEQ ID NO: 514505 - DNA, 20 bp, Artificial Sequence
  chemically synthesized
atgaagtcgttaaaatgtat

SEQ ID NO: 514506 - DNA, 20 bp, Artificial Sequence
  chemically synthesized
gctctgtaatatcccatcat

SEQ ID NO: 514507 - DNA, 20 bp, Artificial Sequence
  chemically synthesized
actatgatacattctcatga

SEQ ID NO: 514508 - DNA, 20 bp, Artificial Sequence
  chemically synthesized
ccaaaaacacatatatatgt

SEQ ID NO: 514509 - DNA, 20 bp, Artificial Sequence
  chemically synthesized
tgtaacttgtatgtctacaa

SEQ ID NO: 514510 - DNA, 20 bp, Artificial Sequence
  chemically synthesized
gtatgtctacaatagaattg

SEQ ID NO: 514511 - DNA, 20 bp, Artificial Sequence
  chemically synthesized
ataattcaggcaactaatta

SEQ ID NO: 514512 - DNA, 20 bp, Artificial Sequence
  chemically synthesized
ccaactctttaattagttgc

SEQ ID NO: 514513 - DNA, 20 bp, Artificial Sequence
  chemically synthesized
tgccaaatgttgatgaggac

SEQ ID NO: 514514 - DNA, 20 bp, Artificial Sequence
  chemically synthesized
acatttcttaaatatgattc

SEQ ID NO: 514515 - DNA, 20 bp, Artificial Sequence
  chemically synthesized
caaaaggtgttcacaaattc

SEQ ID NO: 514516 - DNA, 20 bp, Artificial Sequence
  chemically synthesized
tttttaaattttaggttttc

SEQ ID NO: 514517 - DNA, 20 bp, Artificial Sequence
  chemically synthesized
aatcaagaaaaacagaagac

SEQ ID NO: 514518 - DNA, 20 bp, Artificial Sequence
  chemically synthesized
ataactgacacatttacata

SEQ ID NO: 514519 - DNA, 20 bp, Artificial Sequence
  chemically synthesized
aacattgagttaaatctata

SEQ ID NO: 514520 - DNA, 20 bp, Artificial Sequence
  chemically synthesized
cattttaagtatgattaaca

SEQ ID NO: 514521 - DNA, 20 bp, Artificial Sequence
  chemically synthesized
caatgttaatcatacttaaa

SEQ ID NO: 514522 - DNA, 20 bp, Artificial Sequence
  chemically synthesized
cacacaaatatcatgtaatg

SEQ ID NO: 514523 - DNA, 20 bp, Artificial Sequence
  chemically synthesized
agagagagagaacaatgcaa

SEQ ID NO: 514524 - DNA, 20 bp, Artificial Sequence
  chemically synthesized
aaaaatttgtccgtacatat

SEQ ID NO: 514525 - DNA, 20 bp, Artificial Sequence
  chemically synthesized
gacttcaaataaaataaata

SEQ ID NO: 514526 - DNA, 20 bp, Artificial Sequence
  chemically synthesized
tgattattgcatatggtgtg

SEQ ID NO: 514527 - DNA, 20 bp, Artificial Sequence
  chemically synthesized
atcgttttaccattttgttt

SEQ ID NO: 514528 - DNA, 20 bp, Artificial Sequence
  chemically synthesized
aatatagtatcataatggct

SEQ ID NO: 514529 - DNA, 20 bp, Artificial Sequence
  chemically synthesized
cataaaaatataaagtttta

SEQ ID NO: 514530 - DNA, 20 bp, Artificial Sequence
  chemically synthesized
aataaaaacaagttctccac

SEQ ID NO: 514531 - DNA, 20 bp, Artificial Sequence
  chemically synthesized
tattaatattaaccattgaa

SEQ ID NO: 514532 - DNA, 20 bp, Artificial Sequence
  chemically synthesized
caaatgtattttccttttct

SEQ ID NO: 514533 - DNA, 20 bp, Artificial Sequence
  chemically synthesized
ctggatatgagccctttgtt

SEQ ID NO: 514534 - DNA, 20 bp, Artificial Sequence
  chemically synthesized
caaaacaaagggctcatatc

SEQ ID NO: 514535 - DNA, 20 bp, Artificial Sequence
  chemically synthesized
aattgagttattgctatatt

SEQ ID NO: 514536 - DNA, 20 bp, Artificial Sequence
  chemically synthesized
taacttggacttcatcaaaa

SEQ ID NO: 514537 - DNA, 20 bp, Artificial Sequence
  chemically synthesized
ttctctttttgaaacatgct

SEQ ID NO: 514538 - DNA, 20 bp, Artificial Sequence
  chemically synthesized
taggcaagtatttatgatac

SEQ ID NO: 514539 - DNA, 20 bp, Artificial Sequence
  chemically synthesized
gaaggaaatttatatgactt

SEQ ID NO: 514540 - DNA, 20 bp, Artificial Sequence
  chemically synthesized
ccttctatatgttttattgc

SEQ ID NO: 514541 - DNA, 20 bp, Artificial Sequence
  chemically synthesized
caggatttttctggttccct

SEQ ID NO: 514542 - DNA, 20 bp, Artificial Sequence
  chemically synthesized
gtcctgaagatgctgtttca

SEQ ID NO: 514543 - DNA, 20 bp, Artificial Sequence
  chemically synthesized
gacaatcagcgaaacggaca

SEQ ID NO: 514544 - DNA, 20 bp, Artificial Sequence
  chemically synthesized
tcgccagagataaccacgct

SEQ ID NO: 514545 - DNA, 20 bp, Artificial Sequence
  chemically synthesized
agaatagggcaagtttttgg

SEQ ID NO: 514546 - DNA, 20 bp, Artificial Sequence
  chemically synthesized
tacactattacaatgagcaa

SEQ ID NO: 514547 - DNA, 20 bp, Artificial Sequence
  chemically synthesized
acaaaaaaacccacacaccc

SEQ ID NO: 514548 - DNA, 20 bp, Artificial Sequence
  chemically synthesized
aaatctccacccaggggtgt

SEQ ID NO: 514549 - DNA, 20 bp, Artificial Sequence
  chemically synthesized
ggcatctaaaatctccaccc

SEQ ID NO: 514550 - DNA, 20 bp, Artificial Sequence
  chemically synthesized
atcatgaaagggtgtatggg

SEQ ID NO: 514551 - DNA, 20 bp, Artificial Sequence
  chemically synthesized
tcctacgtgataaatcatga

SEQ ID NO: 514552 - DNA, 20 bp, Artificial Sequence
  chemically synthesized
cctttcatgatttatcacgt
